United States Patent 7,655,785 (BIOINFORMATICALLY DETECTABLE GROUP OF NOVEL REGULATORY OLIGONUCLEOTIDES AND USES THEREOF) - sequence listing, part 5

SEQ ID NO: 159373 - RNA, 22 nt, Homo sapiens
uuguuguggauuaaauuugcau

SEQ ID NO: 159374 - RNA, 22 nt, Homo sapiens
uuuaauguuacaguauugguau

SEQ ID NO: 159375 - RNA, 23 nt, Homo sapiens
uuuaguccccuaugagcuggugu

SEQ ID NO: 159376 - RNA, 18 nt, Homo sapiens
uuucaagucuuaggugac

SEQ ID NO: 159377 - RNA, 22 nt, Homo sapiens
aaagcuaagguagcauuggaga

SEQ ID NO: 159378 - RNA, 22 nt, Homo sapiens
aaagcugucaaggcaggaggcu

SEQ ID NO: 159379 - RNA, 22 nt, Homo sapiens
aaagugauguccaggcuuucag

SEQ ID NO: 159380 - RNA, 22 nt, Homo sapiens
aacagugcauuccuguccauau

SEQ ID NO: 159381 - RNA, 22 nt, Homo sapiens
aacugcuguuuggguacuggug

SEQ ID NO: 159382 - RNA, 22 nt, Homo sapiens
aagagugcucgugggacucagc

SEQ ID NO: 159383 - RNA, 22 nt, Homo sapiens
aaggaguagacaacauggcgcc

SEQ ID NO: 159384 - RNA, 22 nt, Homo sapiens
aaggcaguggcagaagauguca

SEQ ID NO: 159385 - RNA, 22 nt, Homo sapiens
aaggcaugcaaagaacauuuua

SEQ ID NO: 159386 - RNA, 22 nt, Homo sapiens
aagugcauguauuaguguaguc

SEQ ID NO: 159387 - RNA, 19 nt, Homo sapiens
aagugguuuaaacuuguau

SEQ ID NO: 159388 - RNA, 22 nt, Homo sapiens
aaucacaggucuuggcugcaug

SEQ ID NO: 159389 - RNA, 22 nt, Homo sapiens
aaucacaguuaguaagggagaa

SEQ ID NO: 159390 - RNA, 22 nt, Homo sapiens
aaugacugugauauuuuucuuc

SEQ ID NO: 159391 - RNA, 22 nt, Homo sapiens
aauggcacacaccuggucuaac

SEQ ID NO: 159392 - RNA, 22 nt, Homo sapiens
aaugugcuucuggcugugguca

SEQ ID NO: 159393 - RNA, 22 nt, Homo sapiens
aauugcaauggacaaugcagca

SEQ ID NO: 159394 - RNA, 22 nt, Homo sapiens
acacaaugguaaguguuugugu

SEQ ID NO: 159395 - RNA, 22 nt, Homo sapiens
acagauagcacuaagggaucug

SEQ ID NO: 159396 - RNA, 22 nt, Homo sapiens
accaucuagauuuguguaggua

SEQ ID NO: 159397 - RNA, 18 nt, Homo sapiens
accuucauuccuuugccu

SEQ ID NO: 159398 - RNA, 22 nt, Homo sapiens
acucagagaacauucccagucu

SEQ ID NO: 159399 - RNA, 22 nt, Homo sapiens
acugcacuccaaccuuggugac

SEQ ID NO: 159400 - RNA, 22 nt, Homo sapiens
acugcacucccgcccgggugac

SEQ ID NO: 159401 - RNA, 22 nt, Homo sapiens
acuggcuuaaggaugggccacu

SEQ ID NO: 159402 - RNA, 20 nt, Homo sapiens
agacagcugcagcccacauc

SEQ ID NO: 159403 - RNA, 22 nt, Homo sapiens
agagaacugauuggaugugggc

SEQ ID NO: 159404 - RNA, 22 nt, Homo sapiens
agagugcaauggcaccaucucg

SEQ ID NO: 159405 - RNA, 20 nt, Homo sapiens
agagugcuggacugaggagc

SEQ ID NO: 159406 - RNA, 22 nt, Homo sapiens
agauggugugcuaggaaaugua

SEQ ID NO: 159407 - RNA, 22 nt, Homo sapiens
agcaagacauggcuuccaaaug

SEQ ID NO: 159408 - RNA, 22 nt, Homo sapiens
agcacaguuaaaugaggcuucu

SEQ ID NO: 159409 - RNA, 22 nt, Homo sapiens
cuuuaugagguuggauggaucu

SEQ ID NO: 159410 - RNA, 22 nt, Homo sapiens
cuuucacacuguuggugggaau

SEQ ID NO: 159411 - RNA, 22 nt, Homo sapiens
cuuucucagugagacccgagau

SEQ ID NO: 159412 - RNA, 22 nt, Homo sapiens
cuuugcuaauccaacccucauc

SEQ ID NO: 159413 - RNA, 22 nt, Homo sapiens
cuuugggaccgcgguuuauacu

SEQ ID NO: 159414 - RNA, 22 nt, Homo sapiens
cuuugguuuacuuggugcuagu

SEQ ID NO: 159415 - RNA, 22 nt, Homo sapiens
cuuuuacacuguuggcaggauu

SEQ ID NO: 159416 - RNA, 22 nt, Homo sapiens
gaaaauccauccccagggagua

SEQ ID NO: 159417 - RNA, 22 nt, Homo sapiens
gaaagcugguauagauacauua

SEQ ID NO: 159418 - RNA, 22 nt, Homo sapiens
gaaaugcucagggguuuuccag

SEQ ID NO: 159419 - RNA, 22 nt, Homo sapiens
gaagaaguacaagacaaauuuu

SEQ ID NO: 159420 - RNA, 18 nt, Homo sapiens
gaagaaguaggcauggca

SEQ ID NO: 159421 - RNA, 23 nt, Homo sapiens
gaaguaauaaauggauucuuaac

SEQ ID NO: 159422 - RNA, 22 nt, Homo sapiens
gaagugcuuuuggacuaacagu

SEQ ID NO: 159423 - RNA, 22 nt, Homo sapiens
gaaucaauugaucuaugugucu

SEQ ID NO: 159424 - RNA, 22 nt, Homo sapiens
gaaucauuggguugauucaaga

SEQ ID NO: 159425 - RNA, 18 nt, Homo sapiens
gacuccauuucagccaga

SEQ ID NO: 159426 - RNA, 22 nt, Homo sapiens
gacucuguagacaaucacaucu

SEQ ID NO: 159427 - RNA, 22 nt, Homo sapiens
gagaaguaaauuuauuugcaaa

SEQ ID NO: 159428 - RNA, 22 nt, Homo sapiens
gagacggagucucgcucugucg

SEQ ID NO: 159429 - RNA, 22 nt, Homo sapiens
gagacggagucuugcucuguug

SEQ ID NO: 159430 - RNA, 22 nt, Homo sapiens
gagacugagucucacucuguca

SEQ ID NO: 159431 - RNA, 22 nt, Homo sapiens
gagacugagucucgcucugccg

SEQ ID NO: 159432 - RNA, 22 nt, Homo sapiens
gagagcuaggccacuggggcuu

SEQ ID NO: 159433 - RNA, 22 nt, Homo sapiens
gagaugaagugucaauaaggau

SEQ ID NO: 159434 - RNA, 22 nt, Homo sapiens
gagaugugugugauuauauaau

SEQ ID NO: 159435 - RNA, 22 nt, Homo sapiens
gagauucaucuagguccagaga

SEQ ID NO: 159436 - RNA, 22 nt, Homo sapiens
gagauugucaugauuacauugu

SEQ ID NO: 159437 - RNA, 22 nt, Homo sapiens
gagcaacaguggcagugguggg

SEQ ID NO: 159438 - RNA, 22 nt, Homo sapiens
gagccuguaggaggagaggugg

SEQ ID NO: 159439 - RNA, 22 nt, Homo sapiens
gagcugaauugcugccauuugc

SEQ ID NO: 159440 - RNA, 22 nt, Homo sapiens
gaggcaaugugcccggcccaca

SEQ ID NO: 159441 - RNA, 22 nt, Homo sapiens
gaguaaaugucaaguacuuagg

SEQ ID NO: 159442 - RNA, 22 nt, Homo sapiens
gaguaaauguccuagcuucuug

SEQ ID NO: 159443 - RNA, 22 nt, Homo sapiens
gagugcaaagguccugaggugg

SEQ ID NO: 159444 - RNA, 23 nt, Homo sapiens
gagugcaaugacaugaucucgga

SEQ ID NO: 159445 - RNA, 22 nt, Homo sapiens
gagugcaauggugcuaucucgg

SEQ ID NO: 159446 - RNA, 21 nt, Homo sapiens
gaguggcuuuuguuucaccag

SEQ ID NO: 159447 - RNA, 22 nt, Homo sapiens
gauaaagauagcaauagggaca

SEQ ID NO: 159448 - RNA, 22 nt, Homo sapiens
gauaaaguauuggguacuaugc

SEQ ID NO: 159449 - RNA, 22 nt, Homo sapiens
gauacuguauccuaaaagcuuu

SEQ ID NO: 159450 - RNA, 21 nt, Homo sapiens
gauaucuuuauucccaagagc

SEQ ID NO: 159451 - RNA, 22 nt, Homo sapiens
gauauguaguaguugaaaaaga

SEQ ID NO: 159452 - RNA, 22 nt, Homo sapiens
gaucagauggcuguuggugugu

SEQ ID NO: 159453 - RNA, 22 nt, Homo sapiens
gaugagaucauaaguguggagc

SEQ ID NO: 159454 - RNA, 22 nt, Homo sapiens
gauggcaugugcugccaccaag

SEQ ID NO: 159455 - RNA, 22 nt, Homo sapiens
gauuugagagaggguguuuaua

SEQ ID NO: 159456 - RNA, 22 nt, Homo sapiens
gcaaaaaguagugcugguuagg

SEQ ID NO: 159457 - RNA, 22 nt, Homo sapiens
gcaaagaaugcagauuugccuc

SEQ ID NO: 159458 - RNA, 20 nt, Homo sapiens
gcaagcaugaagaguagaga

SEQ ID NO: 159459 - RNA, 21 nt, Homo sapiens
gcaaguacuaucaucauuauc

SEQ ID NO: 159460 - RNA, 22 nt, Homo sapiens
gcacaguguuacuugauauauu

SEQ ID NO: 159461 - RNA, 22 nt, Homo sapiens
gcacugggccacauuuauuuuc

SEQ ID NO: 159462 - RNA, 20 nt, Homo sapiens
gcagcaccauauuucuaaga

SEQ ID NO: 159463 - RNA, 22 nt, Homo sapiens
gcagcagugcccuggauggaaa

SEQ ID NO: 159464 - RNA, 22 nt, Homo sapiens
gcaguagugugaucuuggcuca

SEQ ID NO: 159465 - RNA, 22 nt, Homo sapiens
gcaugaugaauaauaucacaag

SEQ ID NO: 159466 - RNA, 22 nt, Homo sapiens
gcauggauguugauggcugcug

SEQ ID NO: 159467 - RNA, 22 nt, Homo sapiens
gcauugcacuuggcauagacug

SEQ ID NO: 159468 - RNA, 22 nt, Homo sapiens
gcccagauguuuggggucaugg

SEQ ID NO: 159469 - RNA, 17 nt, Homo sapiens
gcccuuugugccucuuc

SEQ ID NO: 159470 - RNA, 22 nt, Homo sapiens
gccuuuggugacaggcaugugu

SEQ ID NO: 159471 - RNA, 22 nt, Homo sapiens
gcuagcauucaaaugugcagcc

SEQ ID NO: 159472 - RNA, 22 nt, Homo sapiens
gcugagaucucuugccugaacu

SEQ ID NO: 159473 - RNA, 22 nt, Homo sapiens
gcugcuuuugaugacaaaaaca

SEQ ID NO: 159474 - RNA, 22 nt, Homo sapiens
gcuguauugacuuuguaucaua

SEQ ID NO: 159475 - RNA, 22 nt, Homo sapiens
gcugugauucuguguagauagu

SEQ ID NO: 159476 - RNA, 22 nt, Homo sapiens
gcuuuguugauggugagucugu

SEQ ID NO: 159477 - RNA, 21 nt, Homo sapiens
gcuuuuucggaagucuuuggc

SEQ ID NO: 159478 - RNA, 22 nt, Homo sapiens
ggaaagaucagcuaaauguaag

SEQ ID NO: 159479 - RNA, 22 nt, Homo sapiens
ggaaagauguaauauuaucuaa

SEQ ID NO: 159480 - RNA, 22 nt, Homo sapiens
ggaaauguaaacaauggggcua

SEQ ID NO: 159481 - RNA, 22 nt, Homo sapiens
ggaaauguuggugucaugaguu

SEQ ID NO: 159482 - RNA, 22 nt, Homo sapiens
ggaaauguuuagcauccacuuu

SEQ ID NO: 159483 - RNA, 18 nt, Homo sapiens
ggaagccuauuuaguaac

SEQ ID NO: 159484 - RNA, 22 nt, Homo sapiens
ggaagccuggaaaaaauuguga

SEQ ID NO: 159485 - RNA, 22 nt, Homo sapiens
ggacuagggacauggggagcug

SEQ ID NO: 159486 - RNA, 22 nt, Homo sapiens
ggagaucuuugaaguguugugc

SEQ ID NO: 159487 - RNA, 22 nt, Homo sapiens
ggagaugauuaugaaucacuua

SEQ ID NO: 159488 - RNA, 22 nt, Homo sapiens
ggagggugagaucaauuuggga

SEQ ID NO: 159489 - RNA, 20 nt, Homo sapiens
ggagguuguauaaguacauc

SEQ ID NO: 159490 - RNA, 22 nt, Homo sapiens
ggaguguaguggcuccaucucg

SEQ ID NO: 159491 - RNA, 22 nt, Homo sapiens
ggcaacaugccgaaaccacguc

SEQ ID NO: 159492 - RNA, 22 nt, Homo sapiens
ggcaagaaccagggauuugcgu

SEQ ID NO: 159493 - RNA, 21 nt, Homo sapiens
ggcaagagaauacaacauaaa

SEQ ID NO: 159494 - RNA, 21 nt, Homo sapiens
ggcaagugugagguuuggggu

SEQ ID NO: 159495 - RNA, 22 nt, Homo sapiens
ggcuagagaauagugccacuaa

SEQ ID NO: 159496 - RNA, 22 nt, Homo sapiens
gggaauggaagacauuaugaug

SEQ ID NO: 159497 - RNA, 22 nt, Homo sapiens
gggagugugcacacaugguaua

SEQ ID NO: 159498 - RNA, 22 nt, Homo sapiens
gggaugaaguugauguagaaag

SEQ ID NO: 159499 - RNA, 22 nt, Homo sapiens
gggcaacauugaguacccugaa

SEQ ID NO: 159500 - RNA, 22 nt, Homo sapiens
gggcaagaagucuuguaguuuu

SEQ ID NO: 159501 - RNA, 22 nt, Homo sapiens
gggcauaucacuugaggucagg

SEQ ID NO: 159502 - RNA, 22 nt, Homo sapiens
ggggaauguuaaagaauuugca

SEQ ID NO: 159503 - RNA, 22 nt, Homo sapiens
gguagacaucgugcucugugau

SEQ ID NO: 159504 - RNA, 22 nt, Homo sapiens
gguauuauuugccuuuuacuga

SEQ ID NO: 159505 - RNA, 22 nt, Homo sapiens
ggucagaaagacaggcauucag

SEQ ID NO: 159506 - RNA, 22 nt, Homo sapiens
ggugagaaaaacauagucucag

SEQ ID NO: 159507 - RNA, 22 nt, Homo sapiens
ggugagauguucagacgaacug

SEQ ID NO: 159508 - RNA, 22 nt, Homo sapiens
guaauacuggacaggguaucag

SEQ ID NO: 159509 - RNA, 22 nt, Homo sapiens
aaagaagucagccuguccuuug

SEQ ID NO: 159510 - RNA, 22 nt, Homo sapiens
aaagaguucagguagauuucaa

SEQ ID NO: 159511 - RNA, 22 nt, Homo sapiens
aaagcugucaaggcaggaggcu

SEQ ID NO: 159512 - RNA, 22 nt, Homo sapiens
aaagugaauguaucccguaagu

SEQ ID NO: 159513 - RNA, 22 nt, Homo sapiens
aaagugcaguauuugggcagaa

SEQ ID NO: 159514 - RNA, 22 nt, Homo sapiens
aaagugcugggauuggcugggc

SEQ ID NO: 159515 - RNA, 22 nt, Homo sapiens
aaagugcugggauuuuaggcau

SEQ ID NO: 159516 - RNA, 22 nt, Homo sapiens
aaagugguuuuucagacuuuga

SEQ ID NO: 159517 - RNA, 22 nt, Homo sapiens
aaaguucugcguuagggcuaaa

SEQ ID NO: 159518 - RNA, 22 nt, Homo sapiens
aaaugcaccacucuggugcagg

SEQ ID NO: 159519 - RNA, 22 nt, Homo sapiens
aaaugcagauucugcuuagguu

SEQ ID NO: 159520 - RNA, 22 nt, Homo sapiens
aaauggcaccggcucuucccuc

SEQ ID NO: 159521 - RNA, 22 nt, Homo sapiens
aaauucaucaaaugguuuguau

SEQ ID NO: 159522 - RNA, 23 nt, Homo sapiens
aaauuugccuauuauuccuaugg

SEQ ID NO: 159523 - RNA, 22 nt, Homo sapiens
aacaccauucucuguaacaaga

SEQ ID NO: 159524 - RNA, 22 nt, Homo sapiens
aacaccuugcagggauuaugac

SEQ ID NO: 159525 - RNA, 22 nt, Homo sapiens
aacccugacacaagcagaauuu

SEQ ID NO: 159526 - RNA, 22 nt, Homo sapiens
aacucacauucuuucuugguac

SEQ ID NO: 159527 - RNA, 22 nt, Homo sapiens
aagaugcagucauacuggagga

SEQ ID NO: 159528 - RNA, 22 nt, Homo sapiens
aagcacaauuucaccuucuugu

SEQ ID NO: 159529 - RNA, 20 nt, Homo sapiens
aagcagacauuuggaugaaa

SEQ ID NO: 159530 - RNA, 20 nt, Homo sapiens
aagcauggguuuuaggguca

SEQ ID NO: 159531 - RNA, 21 nt, Homo sapiens
aagcaugguguaucuuuccau

SEQ ID NO: 159532 - RNA, 22 nt, Homo sapiens
aagcuagugagacagugguacu

SEQ ID NO: 159533 - RNA, 22 nt, Homo sapiens
aagcugccaggcaugguggcug

SEQ ID NO: 159534 - RNA, 22 nt, Homo sapiens
aaggagcuuaagugacuuguac

SEQ ID NO: 159535 - RNA, 22 nt, Homo sapiens
aagggagcugcauaaucuugug

SEQ ID NO: 159536 - RNA, 17 nt, Homo sapiens
aaggugcuucgaccucc

SEQ ID NO: 159537 - RNA, 22 nt, Homo sapiens
aaguauuaugaguccuuguuuu

SEQ ID NO: 159538 - RNA, 23 nt, Homo sapiens
aagugagcuccaauugggugaga

SEQ ID NO: 159539 - RNA, 22 nt, Homo sapiens
aagugcaaaucuguggcugaaa

SEQ ID NO: 159540 - RNA, 22 nt, Homo sapiens
aagugcuggccuacucaaucga

SEQ ID NO: 159541 - RNA, 22 nt, Homo sapiens
aagugcuguccuaccuuuggga

SEQ ID NO: 159542 - RNA, 22 nt, Homo sapiens
aagugcuucagaagacaauauu

SEQ ID NO: 159543 - RNA, 22 nt, Homo sapiens
aagugguguuugggagcuggac

SEQ ID NO: 159544 - RNA, 22 nt, Homo sapiens
aauaaagccugucucuuuagag

SEQ ID NO: 159545 - RNA, 22 nt, Homo sapiens
aaucucagcauuuugggcugag

SEQ ID NO: 159546 - RNA, 22 nt, Homo sapiens
aaugcacauauauuuccuuauu

SEQ ID NO: 159547 - RNA, 22 nt, Homo sapiens
aaugcaucuagaaaggugaauu

SEQ ID NO: 159548 - RNA, 22 nt, Homo sapiens
aaugccaucagagaaaacucuu

SEQ ID NO: 159549 - RNA, 22 nt, Homo sapiens
aaugcuguguuauuucaugacc

SEQ ID NO: 159550 - RNA, 22 nt, Homo sapiens
aauggcuucuuauugugguuca

SEQ ID NO: 159551 - RNA, 18 nt, Homo sapiens
aaugggacuacaaagcca

SEQ ID NO: 159552 - RNA, 22 nt, Homo sapiens
aaugggacugacgccucccaga

SEQ ID NO: 159553 - RNA, 22 nt, Homo sapiens
aaugguguuuccguuaagcuga

SEQ ID NO: 159554 - RNA, 22 nt, Homo sapiens
aauuaguugaaagucugcuuuu

SEQ ID NO: 159555 - RNA, 22 nt, Homo sapiens
aauuaguugucgugagaguggu

SEQ ID NO: 159556 - RNA, 22 nt, Homo sapiens
aauucuguauuguuuagggacu

SEQ ID NO: 159557 - RNA, 22 nt, Homo sapiens
aauucugugagauggugcagau

SEQ ID NO: 159558 - RNA, 22 nt, Homo sapiens
aauugcauugaauuuguagcuu

SEQ ID NO: 159559 - RNA, 22 nt, Homo sapiens
acaagugcuuuuccuggagaca

SEQ ID NO: 159560 - RNA, 23 nt, Homo sapiens
acacaguaaacuaaaagcuagcu

SEQ ID NO: 159561 - RNA, 22 nt, Homo sapiens
acacuguccaguuaggcuacau

SEQ ID NO: 159562 - RNA, 22 nt, Homo sapiens
acagcacugccaagugacccau

SEQ ID NO: 159563 - RNA, 20 nt, Homo sapiens
acagcauagccuuuuaaagc

SEQ ID NO: 159564 - RNA, 21 nt, Homo sapiens
acaguacuugagaucuuuuga

SEQ ID NO: 159565 - RNA, 22 nt, Homo sapiens
acagucauagcagccuuuguua

SEQ ID NO: 159566 - RNA, 18 nt, Homo sapiens
acagugcuggcaugagau

SEQ ID NO: 159567 - RNA, 22 nt, Homo sapiens
acagugcuucugauaugaugcc

SEQ ID NO: 159568 - RNA, 22 nt, Homo sapiens
acaguguacaauagccuuuuaa

SEQ ID NO: 159569 - RNA, 22 nt, Homo sapiens
acauaguagacacugaaaauau

SEQ ID NO: 159570 - RNA, 17 nt, Homo sapiens
acaugagacuggauucu

SEQ ID NO: 159571 - RNA, 22 nt, Homo sapiens
acauggcuuaugaauuuggaga

SEQ ID NO: 159572 - RNA, 22 nt, Homo sapiens
acauguaauugauuuuguguua

SEQ ID NO: 159573 - RNA, 22 nt, Homo sapiens
accaccauugcacugaacuuuc

SEQ ID NO: 159574 - RNA, 22 nt, Homo sapiens
accauugcacuccuuucugggc

SEQ ID NO: 159575 - RNA, 22 nt, Homo sapiens
acccuuaagcacuaguucagcu

SEQ ID NO: 159576 - RNA, 22 nt, Homo sapiens
accuguauaacaagugggaaau

SEQ ID NO: 159577 - RNA, 22 nt, Homo sapiens
acucagagauuagcacauguuu

SEQ ID NO: 159578 - RNA, 19 nt, Homo sapiens
acugcacuccaaccuccug

SEQ ID NO: 159579 - RNA, 22 nt, Homo sapiens
acugcacuccaaccuuggugac

SEQ ID NO: 159580 - RNA, 22 nt, Homo sapiens
acugcacuccacccuuggcagc

SEQ ID NO: 159581 - RNA, 18 nt, Homo sapiens
acugcacuccaccuuggg

SEQ ID NO: 159582 - RNA, 22 nt, Homo sapiens
acugcacuccagccuaggcgac

SEQ ID NO: 159583 - RNA, 22 nt, Homo sapiens
acugcacuccagccucgugaca

SEQ ID NO: 159584 - RNA, 22 nt, Homo sapiens
acugcacuccagccucguggac

SEQ ID NO: 159585 - RNA, 22 nt, Homo sapiens
acugcacuccagccugagccug

SEQ ID NO: 159586 - RNA, 22 nt, Homo sapiens
acugcacuccagccugccgaca

SEQ ID NO: 159587 - RNA, 22 nt, Homo sapiens
acugcacuccagccugcuggca

SEQ ID NO: 159588 - RNA, 22 nt, Homo sapiens
acugcacuccagccugugagac

SEQ ID NO: 159589 - RNA, 22 nt, Homo sapiens
acugcacuccagccugugcgua

SEQ ID NO: 159590 - RNA, 22 nt, Homo sapiens
acugcacuccagccuucaggac

SEQ ID NO: 159591 - RNA, 22 nt, Homo sapiens
acugcacuccagccuuggagac

SEQ ID NO: 159592 - RNA, 22 nt, Homo sapiens
acugcacuccagccuuggcggc

SEQ ID NO: 159593 - RNA, 22 nt, Homo sapiens
acugcacuccagccuugugaca

SEQ ID NO: 159594 - RNA, 22 nt, Homo sapiens
acugcacuccagcuccagggug

SEQ ID NO: 159595 - RNA, 22 nt, Homo sapiens
acugcacuccagcuuuggguga

SEQ ID NO: 159596 - RNA, 22 nt, Homo sapiens
acugcacuccaguuccgggcaa

SEQ ID NO: 159597 - RNA, 22 nt, Homo sapiens
augcuguuuugaauucucuaga

SEQ ID NO: 159598 - RNA, 22 nt, Homo sapiens
augcuguuuuguagcucccucu

SEQ ID NO: 159599 - RNA, 22 nt, Homo sapiens
auggauauuuuuugaacauaga

SEQ ID NO: 159600 - RNA, 22 nt, Homo sapiens
auggcaccauguuaugauaaua

SEQ ID NO: 159601 - RNA, 22 nt, Homo sapiens
auggcaguuucagcuauaguuu

SEQ ID NO: 159602 - RNA, 22 nt, Homo sapiens
auggcguggagauauggucagc

SEQ ID NO: 159603 - RNA, 22 nt, Homo sapiens
auggcuagauuguaugguaguu

SEQ ID NO: 159604 - RNA, 22 nt, Homo sapiens
auggcucuggauagaaugcagg

SEQ ID NO: 159605 - RNA, 22 nt, Homo sapiens
auggcucuuauuauuuugaggu

SEQ ID NO: 159606 - RNA, 22 nt, Homo sapiens
auggcuguuccugggaguucua

SEQ ID NO: 159607 - RNA, 22 nt, Homo sapiens
auggcuuguuaugcauuaguac

SEQ ID NO: 159608 - RNA, 22 nt, Homo sapiens
augggguaggcuugcuguagua

SEQ ID NO: 159609 - RNA, 22 nt, Homo sapiens
augguuuauuuguaagcagagu

SEQ ID NO: 159610 - RNA, 22 nt, Homo sapiens
auguaagugugcucaaauguua

SEQ ID NO: 159611 - RNA, 22 nt, Homo sapiens
auguccauggaaucuguagcaa

SEQ ID NO: 159612 - RNA, 22 nt, Homo sapiens
augugcaauguguacguagccc

SEQ ID NO: 159613 - RNA, 22 nt, Homo sapiens
augugcagauguuacaaauugu

SEQ ID NO: 159614 - RNA, 22 nt, Homo sapiens
augugcuuauagguguauguuu

SEQ ID NO: 159615 - RNA, 22 nt, Homo sapiens
augugcuuuuuaaacagaugcu

SEQ ID NO: 159616 - RNA, 23 nt, Homo sapiens
augugugcuuggagagcaggaug

SEQ ID NO: 159617 - RNA, 23 nt, Homo sapiens
auuccaguggcaauuggagaaac

SEQ ID NO: 159618 - RNA, 18 nt, Homo sapiens
auucuacaggccuuuuga

SEQ ID NO: 159619 - RNA, 22 nt, Homo sapiens
auugcacacagaaucaggguaa

SEQ ID NO: 159620 - RNA, 22 nt, Homo sapiens
auugcacaccagucugggcaaa

SEQ ID NO: 159621 - RNA, 19 nt, Homo sapiens
auugcacuccaaccugggu

SEQ ID NO: 159622 - RNA, 22 nt, Homo sapiens
auugcuaacugaaauaagacca

SEQ ID NO: 159623 - RNA, 22 nt, Homo sapiens
auugcuucugauuuuaaaugag

SEQ ID NO: 159624 - RNA, 22 nt, Homo sapiens
auuggccccguuuuaaauguca

SEQ ID NO: 159625 - RNA, 22 nt, Homo sapiens
auuguacuagguccuagggcuu

SEQ ID NO: 159626 - RNA, 22 nt, Homo sapiens
auuguacuccagccugggcaag

SEQ ID NO: 159627 - RNA, 22 nt, Homo sapiens
auuguacuccagccugggcgac

SEQ ID NO: 159628 - RNA, 22 nt, Homo sapiens
auuguacuccagccugggcuaa

SEQ ID NO: 159629 - RNA, 22 nt, Homo sapiens
auuguacuccagccuguggagc

SEQ ID NO: 159630 - RNA, 22 nt, Homo sapiens
auugucacugugcuccaccagu

SEQ ID NO: 159631 - RNA, 22 nt, Homo sapiens
auuucacugagacaugugccca

SEQ ID NO: 159632 - RNA, 22 nt, Homo sapiens
auuuugguuacauaguugagcu

SEQ ID NO: 159633 - RNA, 22 nt, Homo sapiens
caaaccuguaggggccaagagg

SEQ ID NO: 159634 - RNA, 22 nt, Homo sapiens
caaagcacuuggcuuggaagau

SEQ ID NO: 159635 - RNA, 22 nt, Homo sapiens
caaaguaauugugguuuugcca

SEQ ID NO: 159636 - RNA, 22 nt, Homo sapiens
caacagucagcccauccacaga

SEQ ID NO: 159637 - RNA, 19 nt, Homo sapiens
caacccugcagagaaagga

SEQ ID NO: 159638 - RNA, 22 nt, Homo sapiens
caaguguuggcuuguauacaaa

SEQ ID NO: 159639 - RNA, 22 nt, Homo sapiens
caauacuguuaccugaaauagg

SEQ ID NO: 159640 - RNA, 21 nt, Homo sapiens
caaugacacuguagcugugcu

SEQ ID NO: 159641 - RNA, 22 nt, Homo sapiens
cacaguguuccagcuauuugaa

SEQ ID NO: 159642 - RNA, 22 nt, Homo sapiens
caccuguacauggcaguguccu

SEQ ID NO: 159643 - RNA, 22 nt, Homo sapiens
caccuguagucccagcugaggc

SEQ ID NO: 159644 - RNA, 22 nt, Homo sapiens
cacugcacuccagucccgucuc

SEQ ID NO: 159645 - RNA, 22 nt, Homo sapiens
cacugcauccuugaccuucugg

SEQ ID NO: 159646 - RNA, 22 nt, Homo sapiens
cacuggucagugaaacaguauu

SEQ ID NO: 159647 - RNA, 22 nt, Homo sapiens
cacuggucucauggcaugagag

SEQ ID NO: 159648 - RNA, 22 nt, Homo sapiens
cagagaacauucagagcuguag

SEQ ID NO: 159649 - RNA, 22 nt, Homo sapiens
cagcccguaaucccagcacuuu

SEQ ID NO: 159650 - RNA, 22 nt, Homo sapiens
cagcugcuuuggaaaauauuuu

SEQ ID NO: 159651 - RNA, 22 nt, Homo sapiens
cagcuguguuauaaacuaccau

SEQ ID NO: 159652 - RNA, 22 nt, Homo sapiens
cagggcauuggcugguaccugg

SEQ ID NO: 159653 - RNA, 22 nt, Homo sapiens
caguggaugaacaagaagugau

SEQ ID NO: 159654 - RNA, 22 nt, Homo sapiens
caguggauuggauggauaaugc

SEQ ID NO: 159655 - RNA, 22 nt, Homo sapiens
caguguaugcuucuauuuuugg

SEQ ID NO: 159656 - RNA, 21 nt, Homo sapiens
cauaaugcuacuuauuuuaug

SEQ ID NO: 159657 - RNA, 22 nt, Homo sapiens
caucacagcaaguagggagugg

SEQ ID NO: 159658 - RNA, 22 nt, Homo sapiens
caucacaguacuaaucgucaua

SEQ ID NO: 159659 - RNA, 22 nt, Homo sapiens
caucccugaaccccagaaaucu

SEQ ID NO: 159660 - RNA, 22 nt, Homo sapiens
caugccauugcucuccugggug

SEQ ID NO: 159661 - RNA, 22 nt, Homo sapiens
cauggccuuuggaaugugucua

SEQ ID NO: 159662 - RNA, 22 nt, Homo sapiens
cauggcuuucacaguaaagccu

SEQ ID NO: 159663 - RNA, 22 nt, Homo sapiens
caugugcaugcuuucuuaugug

SEQ ID NO: 159664 - RNA, 22 nt, Homo sapiens
cauugcaaugaggucuugcagu

SEQ ID NO: 159665 - RNA, 22 nt, Homo sapiens
cauugcuaaaagucauauauaa

SEQ ID NO: 159666 - RNA, 22 nt, Homo sapiens
cauugcuuuuggugguuuagac

SEQ ID NO: 159667 - RNA, 22 nt, Homo sapiens
cauugguuccaguuuguccuua

SEQ ID NO: 159668 - RNA, 22 nt, Homo sapiens
cauugguugaacagauuguguu

SEQ ID NO: 159669 - RNA, 22 nt, Homo sapiens
cauuguacauaaguauggagua

SEQ ID NO: 159670 - RNA, 22 nt, Homo sapiens
ccaaaucucauguugaaaugug

SEQ ID NO: 159671 - RNA, 22 nt, Homo sapiens
ccacaguggauuaaaguuacug

SEQ ID NO: 159672 - RNA, 22 nt, Homo sapiens
ccacaguugaaauuuugacugu

SEQ ID NO: 159673 - RNA, 22 nt, Homo sapiens
ccacugcacuccagcccggcaa

SEQ ID NO: 159674 - RNA, 22 nt, Homo sapiens
ccagugauuguauggugaaggu

SEQ ID NO: 159675 - RNA, 21 nt, Homo sapiens
ccagugguuggaaacuauggg

SEQ ID NO: 159676 - RNA, 22 nt, Homo sapiens
ccaguuuuucauuuauacuagu

SEQ ID NO: 159677 - RNA, 22 nt, Homo sapiens
ccaucccuuucugagcaguucc

SEQ ID NO: 159678 - RNA, 22 nt, Homo sapiens
ccauggcuucugcauucuguca

SEQ ID NO: 159679 - RNA, 22 nt, Homo sapiens
cccagaguucuuaaauacugag

SEQ ID NO: 159680 - RNA, 22 nt, Homo sapiens
aucuagagaggcagucuggccg

SEQ ID NO: 159681 - RNA, 22 nt, Homo sapiens
aucucagagaaaauuacuaaga

SEQ ID NO: 159682 - RNA, 22 nt, Homo sapiens
aucucauggagguagagaguaa

SEQ ID NO: 159683 - RNA, 22 nt, Homo sapiens
aucuuguguugaauggugcaga

SEQ ID NO: 159684 - RNA, 22 nt, Homo sapiens
aucuuuggugaguucuuugguc

SEQ ID NO: 159685 - RNA, 22 nt, Homo sapiens
augaaagguugucuuaagccau

SEQ ID NO: 159686 - RNA, 22 nt, Homo sapiens
augaaaguguguggaaacuuga

SEQ ID NO: 159687 - RNA, 22 nt, Homo sapiens
augaaaugcauguuaaguccgu

SEQ ID NO: 159688 - RNA, 22 nt, Homo sapiens
augaagacaucgucugggauua

SEQ ID NO: 159689 - RNA, 22 nt, Homo sapiens
augacagcaucugugaaguugu

SEQ ID NO: 159690 - RNA, 22 nt, Homo sapiens
augagaugcaagauuagauggg

SEQ ID NO: 159691 - RNA, 22 nt, Homo sapiens
augagauuauguaaagagacca

SEQ ID NO: 159692 - RNA, 22 nt, Homo sapiens
augagcuauggagacagggcca

SEQ ID NO: 159693 - RNA, 22 nt, Homo sapiens
augaggagguaugauuuucuga

SEQ ID NO: 159694 - RNA, 22 nt, Homo sapiens
augaguugaagcuacaagaggc

SEQ ID NO: 159695 - RNA, 22 nt, Homo sapiens
augauagucuugagaagcauuu

SEQ ID NO: 159696 - RNA, 22 nt, Homo sapiens
augauauggguugucaguugua

SEQ ID NO: 159697 - RNA, 22 nt, Homo sapiens
augcaagcacacaagaggaaau

SEQ ID NO: 159698 - RNA, 22 nt, Homo sapiens
augcacauggcuaacuuuuuuc

SEQ ID NO: 159699 - RNA, 22 nt, Homo sapiens
augcagguguuuugcacugagu

SEQ ID NO: 159700 - RNA, 22 nt, Homo sapiens
augccacugcacuucagcuugg

SEQ ID NO: 159701 - RNA, 22 nt, Homo sapiens
cacagugaacugguggguuuuu

SEQ ID NO: 159702 - RNA, 22 nt, Homo sapiens
cacagugaaugucaucauugcc

SEQ ID NO: 159703 - RNA, 22 nt, Homo sapiens
cacaguguuacugguaugaagu

SEQ ID NO: 159704 - RNA, 22 nt, Homo sapiens
caccacuacaccccaggcuggg

SEQ ID NO: 159705 - RNA, 22 nt, Homo sapiens
cacccaguaagcaugaggcccu

SEQ ID NO: 159706 - RNA, 22 nt, Homo sapiens
cacugcacuccagcuuugguga

SEQ ID NO: 159707 - RNA, 22 nt, Homo sapiens
cacugcacucuucuucugggca

SEQ ID NO: 159708 - RNA, 22 nt, Homo sapiens
cacugcauggucuagcuggguu

SEQ ID NO: 159709 - RNA, 22 nt, Homo sapiens
cacugggugccauauguuugcu

SEQ ID NO: 159710 - RNA, 21 nt, Homo sapiens
cacuggguucaggcuugugga

SEQ ID NO: 159711 - RNA, 22 nt, Homo sapiens
cagacaugucuuguggccgugg

SEQ ID NO: 159712 - RNA, 22 nt, Homo sapiens
cagagguaagcaagucagcauu

SEQ ID NO: 159713 - RNA, 22 nt, Homo sapiens
cagagugcauguuuagaugagu

SEQ ID NO: 159714 - RNA, 22 nt, Homo sapiens
cagauguaguauuuuagugaaa

SEQ ID NO: 159715 - RNA, 22 nt, Homo sapiens
cagggaauguuauuuaauagca

SEQ ID NO: 159716 - RNA, 22 nt, Homo sapiens
cagguacaugcaugugugugca

SEQ ID NO: 159717 - RNA, 23 nt, Homo sapiens
cagguaguucuuuauaguagugu

SEQ ID NO: 159718 - RNA, 22 nt, Homo sapiens
caggugaaugccucuccuucug

SEQ ID NO: 159719 - RNA, 22 nt, Homo sapiens
caguaaauaucugagcgagguc

SEQ ID NO: 159720 - RNA, 22 nt, Homo sapiens
cagugcaaccuccaucucucgg

SEQ ID NO: 159721 - RNA, 18 nt, Homo sapiens
cagugcaauacaggagag

SEQ ID NO: 159722 - RNA, 22 nt, Homo sapiens
cagugcauccauguucagcagu

SEQ ID NO: 159723 - RNA, 22 nt, Homo sapiens
caguggaugauguuuucugugg

SEQ ID NO: 159724 - RNA, 23 nt, Homo sapiens
cagugguguuagagaaaucuuuu

SEQ ID NO: 159725 - RNA, 22 nt, Homo sapiens
caguguuuuuaacaggugcccg

SEQ ID NO: 159726 - RNA, 22 nt, Homo sapiens
cauacaagcuacaaucacaaag

SEQ ID NO: 159727 - RNA, 22 nt, Homo sapiens
caucagcaauguaugaggguuc

SEQ ID NO: 159728 - RNA, 22 nt, Homo sapiens
caugcacugaguccaccucugg

SEQ ID NO: 159729 - RNA, 22 nt, Homo sapiens
cauggcuacugcagauguaggg

SEQ ID NO: 159730 - RNA, 22 nt, Homo sapiens
cauggucaccuuccaaguuauu

SEQ ID NO: 159731 - RNA, 22 nt, Homo sapiens
caugugcaugagcacauacgug

SEQ ID NO: 159732 - RNA, 22 nt, Homo sapiens
cauugcaauccagccugggcaa

SEQ ID NO: 159733 - RNA, 22 nt, Homo sapiens
cauugcacuccagccuggcaac

SEQ ID NO: 159734 - RNA, 22 nt, Homo sapiens
cauugcagauccuucaaaugac

SEQ ID NO: 159735 - RNA, 22 nt, Homo sapiens
cauuuuacuuuccagacgugga

SEQ ID NO: 159736 - RNA, 22 nt, Homo sapiens
ccacacugucuuggugggaaac

SEQ ID NO: 159737 - RNA, 23 nt, Homo sapiens
ccacacuguuuagaauggcauca

SEQ ID NO: 159738 - RNA, 22 nt, Homo sapiens
ccaccuguacuuaagucacuuu

SEQ ID NO: 159739 - RNA, 22 nt, Homo sapiens
ccagaguggagccuuugcgagg

SEQ ID NO: 159740 - RNA, 22 nt, Homo sapiens
ccagcaccauuuguugaauagg

SEQ ID NO: 159741 - RNA, 18 nt, Homo sapiens
ccagugcaaggaaagccc

SEQ ID NO: 159742 - RNA, 17 nt, Homo sapiens
ccaguuuucccucagug

SEQ ID NO: 159743 - RNA, 22 nt, Homo sapiens
ccaguuuucucacuguugcagu

SEQ ID NO: 159744 - RNA, 22 nt, Homo sapiens
ccaguuuuuggcaaugaugaau

SEQ ID NO: 159745 - RNA, 20 nt, Homo sapiens
ccaucaguccucucuuguuc

SEQ ID NO: 159746 - RNA, 22 nt, Homo sapiens
ccaugaacuagaauagaacaug

SEQ ID NO: 159747 - RNA, 22 nt, Homo sapiens
ccauuucacucuuccugaagga

SEQ ID NO: 159748 - RNA, 17 nt, Homo sapiens
ccccugagcgaugcagu

SEQ ID NO: 159749 - RNA, 22 nt, Homo sapiens
cccugaagauacagaguuuggg

SEQ ID NO: 159750 - RNA, 19 nt, Homo sapiens
cccuggcacauggaaaaug

SEQ ID NO: 159751 - RNA, 22 nt, Homo sapiens
cccuugcacuucagagcugcau

SEQ ID NO: 159752 - RNA, 22 nt, Homo sapiens
ccugagacuugagggggcuucu

SEQ ID NO: 159753 - RNA, 22 nt, Homo sapiens
ccugucuugaagagauccuccu

SEQ ID NO: 159754 - RNA, 22 nt, Homo sapiens
cgcuggugaucuagacccccaa

SEQ ID NO: 159755 - RNA, 22 nt, Homo sapiens
cuaacacagagguuuauuucuc

SEQ ID NO: 159756 - RNA, 22 nt, Homo sapiens
cuacagguaugaaagggaguau

SEQ ID NO: 159757 - RNA, 22 nt, Homo sapiens
cuacagugggucuguaguccuu

SEQ ID NO: 159758 - RNA, 22 nt, Homo sapiens
cuacaguguauuuauggagggu

SEQ ID NO: 159759 - RNA, 22 nt, Homo sapiens
cuagaagguaagagcuggaugc

SEQ ID NO: 159760 - RNA, 22 nt, Homo sapiens
cuagcccagugcuccuggauca

SEQ ID NO: 159761 - RNA, 22 nt, Homo sapiens
cucagauacuugggagguugag

SEQ ID NO: 159762 - RNA, 22 nt, Homo sapiens
cucagugaagggcaagaggcaa

SEQ ID NO: 159763 - RNA, 22 nt, Homo sapiens
cucaguguucccauucuaccuu

SEQ ID NO: 159764 - RNA, 22 nt, Homo sapiens
cucaguuuugccuuguuuaagg

SEQ ID NO: 159765 - RNA, 22 nt, Homo sapiens
cucauggagaaccucugcuagg

SEQ ID NO: 159766 - RNA, 22 nt, Homo sapiens
cuccaggugagguuaagggacu

SEQ ID NO: 159767 - RNA, 22 nt, Homo sapiens
cucugagccugagguuccuacu

SEQ ID NO: 159768 - RNA, 22 nt, Homo sapiens
cucuuacaguguguggugaaag

SEQ ID NO: 159769 - RNA, 19 nt, Homo sapiens
cucuuuggugucucuucuu

SEQ ID NO: 159770 - RNA, 22 nt, Homo sapiens
cugaaagagcauuugaaugggu

SEQ ID NO: 159771 - RNA, 22 nt, Homo sapiens
cugagaguugaugaaauauggu

SEQ ID NO: 159772 - RNA, 22 nt, Homo sapiens
cugagaucaugggucagguggu

SEQ ID NO: 159773 - RNA, 22 nt, Homo sapiens
cugagaucuuauuagaaaugca

SEQ ID NO: 159774 - RNA, 22 nt, Homo sapiens
cugagauggagucucgcauugu

SEQ ID NO: 159775 - RNA, 22 nt, Homo sapiens
cugaggcacggcgaccuuaagu

SEQ ID NO: 159776 - RNA, 22 nt, Homo sapiens
cugagguacccacuucaucuca

SEQ ID NO: 159777 - RNA, 22 nt, Homo sapiens
cugagguuaggaguuugagacc

SEQ ID NO: 159778 - RNA, 22 nt, Homo sapiens
cugaucuguagcagccaccaca

SEQ ID NO: 159779 - RNA, 22 nt, Homo sapiens
cugccacugacaccucaaggac

SEQ ID NO: 159780 - RNA, 22 nt, Homo sapiens
cugccuagaucugaaccuggcu

SEQ ID NO: 159781 - RNA, 22 nt, Homo sapiens
cuggaaagcaaagggugcauug

SEQ ID NO: 159782 - RNA, 22 nt, Homo sapiens
cuggagaucuugacauugaagu

SEQ ID NO: 159783 - RNA, 22 nt, Homo sapiens
cuggagcaaaggugacucuugu

SEQ ID NO: 159784 - RNA, 22 nt, Homo sapiens
cuggcagucugccucuucacug

SEQ ID NO: 159785 - RNA, 22 nt, Homo sapiens
cuggcaguguuucuugugggcu

SEQ ID NO: 159786 - RNA, 22 nt, Homo sapiens
cugggcaaugcggcuggauaga

SEQ ID NO: 159787 - RNA, 22 nt, Homo sapiens
cugguuuguaaaguuccugaga

SEQ ID NO: 159788 - RNA, 19 nt, Homo sapiens
cugucacugaggaagacug

SEQ ID NO: 159789 - RNA, 22 nt, Homo sapiens
cugucacuggggcacauguccc

SEQ ID NO: 159790 - RNA, 22 nt, Homo sapiens
cugucuaugagccaggaagcca

SEQ ID NO: 159791 - RNA, 22 nt, Homo sapiens
cugugcuuggagucccccuagg

SEQ ID NO: 159792 - RNA, 22 nt, Homo sapiens
cugugguauuauuagaaauauc

SEQ ID NO: 159793 - RNA, 18 nt, Homo sapiens
cuuaacauugggaugaua

SEQ ID NO: 159794 - RNA, 22 nt, Homo sapiens
cuuaagcauugacuuuggacag

SEQ ID NO: 159795 - RNA, 22 nt, Homo sapiens
cuucaccaguuuggcagucuca

SEQ ID NO: 159796 - RNA, 22 nt, Homo sapiens
cuucaguucuguaaggacagca

SEQ ID NO: 159797 - RNA, 22 nt, Homo sapiens
cuuccaaguggggcacgugcca

SEQ ID NO: 159798 - RNA, 23 nt, Homo sapiens
cuugagacaaaugcgugugugca

SEQ ID NO: 159799 - RNA, 22 nt, Homo sapiens
cuugauagugguaaucauuuuu

SEQ ID NO: 159800 - RNA, 22 nt, Homo sapiens
cuugggccccacccaaaucuua

SEQ ID NO: 159801 - RNA, 22 nt, Homo sapiens
aagugagugacaaaaacugggc

SEQ ID NO: 159802 - RNA, 22 nt, Homo sapiens
aagugcuuuacacaugcaugau

SEQ ID NO: 159803 - RNA, 17 nt, Homo sapiens
aaguggcuuguucacca

SEQ ID NO: 159804 - RNA, 22 nt, Homo sapiens
aagugguuuuuacaaagacaga

SEQ ID NO: 159805 - RNA, 22 nt, Homo sapiens
aauaaagucugaagugugcuua

SEQ ID NO: 159806 - RNA, 19 nt, Homo sapiens
aauaaugccagaugucugu

SEQ ID NO: 159807 - RNA, 22 nt, Homo sapiens
aauacagcacacagaugggucu

SEQ ID NO: 159808 - RNA, 22 nt, Homo sapiens
aaucacaguguucuugugaggg

SEQ ID NO: 159809 - RNA, 22 nt, Homo sapiens
aaucagcacacugugcuuucca

SEQ ID NO: 159810 - RNA, 22 nt, Homo sapiens
aauccugucuugccauccaaua

SEQ ID NO: 159811 - RNA, 22 nt, Homo sapiens
aaucucaacacuuugggaggcu

SEQ ID NO: 159812 - RNA, 22 nt, Homo sapiens
aaugacuaagaugguacauuuu

SEQ ID NO: 159813 - RNA, 22 nt, Homo sapiens
aaugucaucuucaguuguacag

SEQ ID NO: 159814 - RNA, 22 nt, Homo sapiens
aauuaguaaccuaauuccaucu

SEQ ID NO: 159815 - RNA, 22 nt, Homo sapiens
aauuaguuggcugccuaugauu

SEQ ID NO: 159816 - RNA, 22 nt, Homo sapiens
aauugcuucuguauuuuggaca

SEQ ID NO: 159817 - RNA, 22 nt, Homo sapiens
aauuguacucccauaauucccu

SEQ ID NO: 159818 - RNA, 22 nt, Homo sapiens
aauuguacucccaucauuccua

SEQ ID NO: 159819 - RNA, 22 nt, Homo sapiens
acacagucaaauccacuuggcu

SEQ ID NO: 159820 - RNA, 22 nt, Homo sapiens
acacagugucuguguauuuaaa

SEQ ID NO: 159821 - RNA, 22 nt, Homo sapiens
acacaguguuuauugugguuag

SEQ ID NO: 159822 - RNA, 22 nt, Homo sapiens
acacugucucuugcugaccaug

SEQ ID NO: 159823 - RNA, 22 nt, Homo sapiens
acacugucugaugaaaguaguu

SEQ ID NO: 159824 - RNA, 22 nt, Homo sapiens
acagaacugggcuugcuuuugg

SEQ ID NO: 159825 - RNA, 22 nt, Homo sapiens
acagaccuauuucaaucauuua

SEQ ID NO: 159826 - RNA, 22 nt, Homo sapiens
acaggugaaguauuacacuaag

SEQ ID NO: 159827 - RNA, 22 nt, Homo sapiens
acaguagugggcuacagaauca

SEQ ID NO: 159828 - RNA, 22 nt, Homo sapiens
acagugacagaaagcugauuau

SEQ ID NO: 159829 - RNA, 18 nt, Homo sapiens
acagugucuuacaccugu

SEQ ID NO: 159830 - RNA, 22 nt, Homo sapiens
acaucccuuucccacccuucac

SEQ ID NO: 159831 - RNA, 19 nt, Homo sapiens
acauugcauuuguaggcuu

SEQ ID NO: 159832 - RNA, 22 nt, Homo sapiens
accaccacucccgcauucuaaa

SEQ ID NO: 159833 - RNA, 22 nt, Homo sapiens
accaugcaguccaauaugcaca

SEQ ID NO: 159834 - RNA, 22 nt, Homo sapiens
acccaguaacauaugggaggga

SEQ ID NO: 159835 - RNA, 22 nt, Homo sapiens
acccuacauaguagauccuaca

SEQ ID NO: 159836 - RNA, 22 nt, Homo sapiens
acccuggauucguggccuugaa

SEQ ID NO: 159837 - RNA, 22 nt, Homo sapiens
acuacauaugacaucuucuuua

SEQ ID NO: 159838 - RNA, 22 nt, Homo sapiens
acucagagaacauucccagucu

SEQ ID NO: 159839 - RNA, 22 nt, Homo sapiens
uugaggugggaggaucacuuga

SEQ ID NO: 159840 - RNA, 21 nt, Homo sapiens
uugaguugaagcaaggaggga

SEQ ID NO: 159841 - RNA, 22 nt, Homo sapiens
uugauaguccuguaucuauuuu

SEQ ID NO: 159842 - RNA, 22 nt, Homo sapiens
uugauauguggaauauuuaucu

SEQ ID NO: 159843 - RNA, 22 nt, Homo sapiens
uugauauucugagaagcugaag

SEQ ID NO: 159844 - RNA, 22 nt, Homo sapiens
uugcaacauuguaaguuuauau

SEQ ID NO: 159845 - RNA, 22 nt, Homo sapiens
uugcacagucuagcuccaccuu

SEQ ID NO: 159846 - RNA, 22 nt, Homo sapiens
uugcacuccagcucgggugaca

SEQ ID NO: 159847 - RNA, 22 nt, Homo sapiens
accacuguuucaagaagcuugu

SEQ ID NO: 159848 - RNA, 19 nt, Homo sapiens
accagauugcauucuugga

SEQ ID NO: 159849 - RNA, 22 nt, Homo sapiens
acccaguagccagauguagcug

SEQ ID NO: 159850 - RNA, 22 nt, Homo sapiens
acccuguugucagaauguggau

SEQ ID NO: 159851 - RNA, 18 nt, Homo sapiens
acccuucagcacugggcc

SEQ ID NO: 159852 - RNA, 23 nt, Homo sapiens
accugugguuauuuuacucuucc

SEQ ID NO: 159853 - RNA, 22 nt, Homo sapiens
accuucauuguugccaugucca

SEQ ID NO: 159854 - RNA, 22 nt, Homo sapiens
acuacuucuaaguuuuggaaga

SEQ ID NO: 159855 - RNA, 22 nt, Homo sapiens
acugagaucuuuaaauaaauaa

SEQ ID NO: 159856 - RNA, 22 nt, Homo sapiens
acugcacuccagccucccgucu

SEQ ID NO: 159857 - RNA, 22 nt, Homo sapiens
acugcacuccagccuccugaca

SEQ ID NO: 159858 - RNA, 22 nt, Homo sapiens
acugcacuccagccuccugggu

SEQ ID NO: 159859 - RNA, 22 nt, Homo sapiens
acugcacuccagccucggcaau

SEQ ID NO: 159860 - RNA, 22 nt, Homo sapiens
acugcacuccagccucggggac

SEQ ID NO: 159861 - RNA, 22 nt, Homo sapiens
acugcacuccagccugcugaca

SEQ ID NO: 159862 - RNA, 22 nt, Homo sapiens
acugcacuccagccugcuggau

SEQ ID NO: 159863 - RNA, 22 nt, Homo sapiens
acugcacuccagccuguugaca

SEQ ID NO: 159864 - RNA, 22 nt, Homo sapiens
acugcacuccagccuucgugac

SEQ ID NO: 159865 - RNA, 22 nt, Homo sapiens
acugcacuccagccuuggcaac

SEQ ID NO: 159866 - RNA, 22 nt, Homo sapiens
acugcacuccaucuuagguggc

SEQ ID NO: 159867 - RNA, 19 nt, Homo sapiens
acugcacuccuccuugggu

SEQ ID NO: 159868 - RNA, 22 nt, Homo sapiens
acugcacuucagccuguugaca

SEQ ID NO: 159869 - RNA, 22 nt, Homo sapiens
acugcauaaauauguguaauau

SEQ ID NO: 159870 - RNA, 22 nt, Homo sapiens
acuggacuuaaugaugaauugu

SEQ ID NO: 159871 - RNA, 22 nt, Homo sapiens
acuguacuacagccugggugac

SEQ ID NO: 159872 - RNA, 22 nt, Homo sapiens
acuucauucucuggaucagaau

SEQ ID NO: 159873 - RNA, 22 nt, Homo sapiens
acuuggcaaaguuuuaaacagc

SEQ ID NO: 159874 - RNA, 22 nt, Homo sapiens
acuuugcuuagagggcauuaaa

SEQ ID NO: 159875 - RNA, 22 nt, Homo sapiens
agaaauguuuauucaaacccgu

SEQ ID NO: 159876 - RNA, 22 nt, Homo sapiens
agaagaacauagggugacugaa

SEQ ID NO: 159877 - RNA, 22 nt, Homo sapiens
agaauguauauucuguaguugu

SEQ ID NO: 159878 - RNA, 22 nt, Homo sapiens
agagaccuguaaaguucaggca

SEQ ID NO: 159879 - RNA, 22 nt, Homo sapiens
agagguauacauuugagagcca

SEQ ID NO: 159880 - RNA, 22 nt, Homo sapiens
agagguuuuggggcugagagcu

SEQ ID NO: 159881 - RNA, 22 nt, Homo sapiens
agaguaguaggaugaauggacu

SEQ ID NO: 159882 - RNA, 22 nt, Homo sapiens
agagugaagcuuuuuauauucu

SEQ ID NO: 159883 - RNA, 22 nt, Homo sapiens
agagugcuuuauuagauguagc

SEQ ID NO: 159884 - RNA, 22 nt, Homo sapiens
agauauguuauugauguuaaug

SEQ ID NO: 159885 - RNA, 22 nt, Homo sapiens
agauggauuuuguagccccagc

SEQ ID NO: 159886 - RNA, 22 nt, Homo sapiens
agauggugauaaaugugguacc

SEQ ID NO: 159887 - RNA, 22 nt, Homo sapiens
agaugguguuuucucaccagau

SEQ ID NO: 159888 - RNA, 22 nt, Homo sapiens
agauguuguucaucugauuguu

SEQ ID NO: 159889 - RNA, 22 nt, Homo sapiens
agcaacauagaaauuugggugg

SEQ ID NO: 159890 - RNA, 22 nt, Homo sapiens
agcaacauuguucauaauagcu

SEQ ID NO: 159891 - RNA, 22 nt, Homo sapiens
agcaccaauaaucagaguucuu

SEQ ID NO: 159892 - RNA, 22 nt, Homo sapiens
agcagcaugaggggacuucugc

SEQ ID NO: 159893 - RNA, 22 nt, Homo sapiens
agcagcauuaugauauaucuua

SEQ ID NO: 159894 - RNA, 22 nt, Homo sapiens
agcagcuuugcauggccuguga

SEQ ID NO: 159895 - RNA, 20 nt, Homo sapiens
agcaucguuguguuauagcc

SEQ ID NO: 159896 - RNA, 22 nt, Homo sapiens
agcauuaguugugaagccuuua

SEQ ID NO: 159897 - RNA, 22 nt, Homo sapiens
agccaagacucuguuccccuug

SEQ ID NO: 159898 - RNA, 23 nt, Homo sapiens
agccuguugccuaggcagcucau

SEQ ID NO: 159899 - RNA, 22 nt, Homo sapiens
agcgccacugcacuccagccug

SEQ ID NO: 159900 - RNA, 22 nt, Homo sapiens
agcuccuuucugcaggcagguc

SEQ ID NO: 159901 - RNA, 22 nt, Homo sapiens
agcuggauguggaugacccugu

SEQ ID NO: 159902 - RNA, 22 nt, Homo sapiens
agcuggauuguuuaccuggggc

SEQ ID NO: 159903 - RNA, 22 nt, Homo sapiens
agcuguuguacacuuuaccuuu

SEQ ID NO: 159904 - RNA, 20 nt, Homo sapiens
agcuugguuuggaugaucac

SEQ ID NO: 159905 - RNA, 21 nt, Homo sapiens
aggaagacuaugaucaauugg

SEQ ID NO: 159906 - RNA, 20 nt, Homo sapiens
aggagcauuuacauuggcuc

SEQ ID NO: 159907 - RNA, 22 nt, Homo sapiens
aggagcuuuggggaaaacagau

SEQ ID NO: 159908 - RNA, 22 nt, Homo sapiens
aggcaacaugguaaaacccugu

SEQ ID NO: 159909 - RNA, 21 nt, Homo sapiens
aggcaagacuuuuagguuugu

SEQ ID NO: 159910 - RNA, 22 nt, Homo sapiens
aggcagaugagguccucagcug

SEQ ID NO: 159911 - RNA, 22 nt, Homo sapiens
aggcuagacuuugagaauuuuu

SEQ ID NO: 159912 - RNA, 22 nt, Homo sapiens
aggcuuuuggagguggcuuucu

SEQ ID NO: 159913 - RNA, 22 nt, Homo sapiens
aggguuuuuauuuauguggcau

SEQ ID NO: 159914 - RNA, 22 nt, Homo sapiens
aggugcugacaggauagguuuc

SEQ ID NO: 159915 - RNA, 22 nt, Homo sapiens
agguuaugauuauagagcgagg

SEQ ID NO: 159916 - RNA, 22 nt, Homo sapiens
agguuaugauuguagagcgagg

SEQ ID NO: 159917 - RNA, 20 nt, Homo sapiens
agguucaaaucccaaucaug

SEQ ID NO: 159918 - RNA, 22 nt, Homo sapiens
agguuuucagccccagccuagg

SEQ ID NO: 159919 - RNA, 22 nt, Homo sapiens
aguaccacgugaugccauuuuc

SEQ ID NO: 159920 - RNA, 22 nt, Homo sapiens
aguaucaucuuguuggccaggc

SEQ ID NO: 159921 - RNA, 22 nt, Homo sapiens
agugaaaugucaccuuuuagga

SEQ ID NO: 159922 - RNA, 21 nt, Homo sapiens
agugagucauuuggaaagcaa

SEQ ID NO: 159923 - RNA, 22 nt, Homo sapiens
agugauuuuaacuuccagcaau

SEQ ID NO: 159924 - RNA, 19 nt, Homo sapiens
agugggcuagaaaucaggg

SEQ ID NO: 159925 - RNA, 22 nt, Homo sapiens
agugguuuuaaguagagcauac

SEQ ID NO: 159926 - RNA, 22 nt, Homo sapiens
aguguaaugauauuuggagagg

SEQ ID NO: 159927 - RNA, 22 nt, Homo sapiens
agugucaggagacagguagcug

SEQ ID NO: 159928 - RNA, 22 nt, Homo sapiens
aguguuuuuacaagcacucugg

SEQ ID NO: 159929 - RNA, 22 nt, Homo sapiens
auaagaagugaaccagacgucu

SEQ ID NO: 159930 - RNA, 22 nt, Homo sapiens
auaagagcaggcuucuggccag

SEQ ID NO: 159931 - RNA, 22 nt, Homo sapiens
auacaaguuauuugaacugcgg

SEQ ID NO: 159932 - RNA, 22 nt, Homo sapiens
auacaguguauguauaguacau

SEQ ID NO: 159933 - RNA, 22 nt, Homo sapiens
auacaugugcaggucagguuac

SEQ ID NO: 159934 - RNA, 22 nt, Homo sapiens
auacaugugugagcgaagaugu

SEQ ID NO: 159935 - RNA, 22 nt, Homo sapiens
auacauguuucauguuggugug

SEQ ID NO: 159936 - RNA, 22 nt, Homo sapiens
auaccugguagucuugcuacac

SEQ ID NO: 159937 - RNA, 22 nt, Homo sapiens
gugagcauaacaacagaguuua

SEQ ID NO: 159938 - RNA, 22 nt, Homo sapiens
gugaggucguagucauaggcaa

SEQ ID NO: 159939 - RNA, 17 nt, Homo sapiens
gugagguggguaguauc

SEQ ID NO: 159940 - RNA, 22 nt, Homo sapiens
gugcaagagugacugcaguuuu

SEQ ID NO: 159941 - RNA, 22 nt, Homo sapiens
gugcaagagugauugcaguuuu

SEQ ID NO: 159942 - RNA, 22 nt, Homo sapiens
gugcaugucuaugcgagucuaa

SEQ ID NO: 159943 - RNA, 22 nt, Homo sapiens
gugcuaggugcuaggaagauag

SEQ ID NO: 159944 - RNA, 22 nt, Homo sapiens
guggaauuauagagacaucuug

SEQ ID NO: 159945 - RNA, 22 nt, Homo sapiens
guggaggacuggauaaagaaaa

SEQ ID NO: 159946 - RNA, 22 nt, Homo sapiens
guggaucacuugagguuagaag

SEQ ID NO: 159947 - RNA, 22 nt, Homo sapiens
guggcuaaagauuuggaaucug

SEQ ID NO: 159948 - RNA, 22 nt, Homo sapiens
gugguaaaauggcauagagcua

SEQ ID NO: 159949 - RNA, 22 nt, Homo sapiens
gugguagaaauguagaugcuag

SEQ ID NO: 159950 - RNA, 22 nt, Homo sapiens
gugguucuagaauugaguaucc

SEQ ID NO: 159951 - RNA, 22 nt, Homo sapiens
gugucaguggggagugaucuuc

SEQ ID NO: 159952 - RNA, 22 nt, Homo sapiens
guguuugauugcaaauaaucua

SEQ ID NO: 159953 - RNA, 22 nt, Homo sapiens
guuaaugcuggaauaaguuaag

SEQ ID NO: 159954 - RNA, 22 nt, Homo sapiens
guucuauguugggaguucacua

SEQ ID NO: 159955 - RNA, 22 nt, Homo sapiens
guugaggcaggagaauuacuug

SEQ ID NO: 159956 - RNA, 22 nt, Homo sapiens
guugcucaggccggagugcagu

SEQ ID NO: 159957 - RNA, 22 nt, Homo sapiens
guugggcccauagacugccagu

SEQ ID NO: 159958 - RNA, 22 nt, Homo sapiens
uaaagccauugucaaguuugua

SEQ ID NO: 159959 - RNA, 22 nt, Homo sapiens
uaaagcugaaaugauuaugaca

SEQ ID NO: 159960 - RNA, 20 nt, Homo sapiens
uaaagcugcucagggggcuc

SEQ ID NO: 159961 - RNA, 18 nt, Homo sapiens
uaaaggcacuguguuguu

SEQ ID NO: 159962 - RNA, 22 nt, Homo sapiens
uaaagugcugagaugaggcugg

SEQ ID NO: 159963 - RNA, 22 nt, Homo sapiens
uaaaugcuugagaugauggaua

SEQ ID NO: 159964 - RNA, 22 nt, Homo sapiens
uaacaccuuugauagcacuuuu

SEQ ID NO: 159965 - RNA, 22 nt, Homo sapiens
uaacaguauauuuaccaaaccu

SEQ ID NO: 159966 - RNA, 22 nt, Homo sapiens
uaacccuuacaacuacacucgu

SEQ ID NO: 159967 - RNA, 22 nt, Homo sapiens
uaacucugccuagugacauggu

SEQ ID NO: 159968 - RNA, 22 nt, Homo sapiens
uaagacacuuaaaauguuacau

SEQ ID NO: 159969 - RNA, 22 nt, Homo sapiens
uaaguaauuguuaauagggaag

SEQ ID NO: 159970 - RNA, 20 nt, Homo sapiens
uaagugcuugaugaaugaac

SEQ ID NO: 159971 - RNA, 20 nt, Homo sapiens
uaaguuguauuugucaugaa

SEQ ID NO: 159972 - RNA, 22 nt, Homo sapiens
uaauccugucuugaccaucagg

SEQ ID NO: 159973 - RNA, 22 nt, Homo sapiens
uaaucucagcugagcugagauu

SEQ ID NO: 159974 - RNA, 22 nt, Homo sapiens
uaaugcauacagaagguguuuu

SEQ ID NO: 159975 - RNA, 22 nt, Homo sapiens
uaaugcauguaaugggcugaua

SEQ ID NO: 159976 - RNA, 22 nt, Homo sapiens
uaaugcuugguuguuuggaaaa

SEQ ID NO: 159977 - RNA, 22 nt, Homo sapiens
uacaaaguaacaguuccuguau

SEQ ID NO: 159978 - RNA, 22 nt, Homo sapiens
uacaacacugguucgacaugug

SEQ ID NO: 159979 - RNA, 22 nt, Homo sapiens
uacacacguguguauauauaca

SEQ ID NO: 159980 - RNA, 22 nt, Homo sapiens
uacaggacuauagaacuuuccc

SEQ ID NO: 159981 - RNA, 22 nt, Homo sapiens
uacaguaggauuuucagggucu

SEQ ID NO: 159982 - RNA, 22 nt, Homo sapiens
uacaguaguaucuucauuuguu

SEQ ID NO: 159983 - RNA, 22 nt, Homo sapiens
uacaguauuaugagugauugaa

SEQ ID NO: 159984 - RNA, 22 nt, Homo sapiens
uacagucauaaugccuagugac

SEQ ID NO: 159985 - RNA, 22 nt, Homo sapiens
uacaguggugugaucucagcuc

SEQ ID NO: 159986 - RNA, 22 nt, Homo sapiens
uaccacaggcuggguaaucuau

SEQ ID NO: 159987 - RNA, 22 nt, Homo sapiens
uaccaguaaugguucuagagga

SEQ ID NO: 159988 - RNA, 22 nt, Homo sapiens
uaccaugaagguggagagagaa

SEQ ID NO: 159989 - RNA, 22 nt, Homo sapiens
uaccugagcccucugcugaguu

SEQ ID NO: 159990 - RNA, 22 nt, Homo sapiens
uacuagaguagugcagagggga

SEQ ID NO: 159991 - RNA, 23 nt, Homo sapiens
uacuaguaagcguguucuuugca

SEQ ID NO: 159992 - RNA, 19 nt, Homo sapiens
uacugcaccucaaccuggg

SEQ ID NO: 159993 - RNA, 22 nt, Homo sapiens
uacugcacuccaaccugagaga

SEQ ID NO: 159994 - RNA, 22 nt, Homo sapiens
uacugcacuccaggcucaccug

SEQ ID NO: 159995 - RNA, 20 nt, Homo sapiens
uacugcacuccauccugggu

SEQ ID NO: 159996 - RNA, 20 nt, Homo sapiens
uacugcacuuuccucauggu

SEQ ID NO: 159997 - RNA, 22 nt, Homo sapiens
uacugcaguugcagcuugagga

SEQ ID NO: 159998 - RNA, 22 nt, Homo sapiens
uacuguguaguuagaccucaga

SEQ ID NO: 159999 - RNA, 22 nt, Homo sapiens
uacuucauucuugaccuugcau

SEQ ID NO: 160000 - RNA, 22 nt, Homo sapiens
uagaaagcaugaccuucagaua

SEQ ID NO: 160001 - RNA, 22 nt, Homo sapiens
uagaucaauuaauuguuacuug

SEQ ID NO: 160002 - RNA, 20 nt, Homo sapiens
uagaugcauuuagauucauu

SEQ ID NO: 160003 - RNA, 22 nt, Homo sapiens
uagauucaucuguuccuuuuga

SEQ ID NO: 160004 - RNA, 23 nt, Homo sapiens
uagcaacaguuggaggugaggua

SEQ ID NO: 160005 - RNA, 22 nt, Homo sapiens
uagcacagggaauugguucucu

SEQ ID NO: 160006 - RNA, 20 nt, Homo sapiens
uagcagcagacagagggagg

SEQ ID NO: 160007 - RNA, 22 nt, Homo sapiens
uagcagcaucucuggcuucuac

SEQ ID NO: 160008 - RNA, 22 nt, Homo sapiens
uagggcuuuccggccugucaga

SEQ ID NO: 160009 - RNA, 22 nt, Homo sapiens
uagguagaaucuugaagccauu

SEQ ID NO: 160010 - RNA, 22 nt, Homo sapiens
uagucacacacucaacuuuuca

SEQ ID NO: 160011 - RNA, 22 nt, Homo sapiens
uagucccauaugauuuagugaa

SEQ ID NO: 160012 - RNA, 22 nt, Homo sapiens
uauaugcacucagguguaugug

SEQ ID NO: 160013 - RNA, 18 nt, Homo sapiens
ugacaguuucuuuauauu

SEQ ID NO: 160014 - RNA, 20 nt, Homo sapiens
ugacaucagcaauguaauaa

SEQ ID NO: 160015 - RNA, 22 nt, Homo sapiens
ugacauguauaucuuacgcuau

SEQ ID NO: 160016 - RNA, 22 nt, Homo sapiens
ugacauguauuagcucagugcu

SEQ ID NO: 160017 - RNA, 21 nt, Homo sapiens
ugacauuauuucaugucagua

SEQ ID NO: 160018 - RNA, 22 nt, Homo sapiens
ugacucaguuucucagguagua

SEQ ID NO: 160019 - RNA, 22 nt, Homo sapiens
ugacugaguaguauuccacuau

SEQ ID NO: 160020 - RNA, 22 nt, Homo sapiens
ugagaagacaucagcuuucgga

SEQ ID NO: 160021 - RNA, 22 nt, Homo sapiens
ugagaagaugaacuccuugguc

SEQ ID NO: 160022 - RNA, 22 nt, Homo sapiens
ugagaauauuugaagauguuag

SEQ ID NO: 160023 - RNA, 23 nt, Homo sapiens
ugagacauuggaaaguuaggcag

SEQ ID NO: 160024 - RNA, 22 nt, Homo sapiens
ugagaccaacagauuccaguuc

SEQ ID NO: 160025 - RNA, 22 nt, Homo sapiens
ugagacugagucucccucuguc

SEQ ID NO: 160026 - RNA, 22 nt, Homo sapiens
ugagagacagacauuaucuuau

SEQ ID NO: 160027 - RNA, 22 nt, Homo sapiens
ugagauaaugcaugugaagauc

SEQ ID NO: 160028 - RNA, 22 nt, Homo sapiens
ugagauaggaucuugcucuguu

SEQ ID NO: 160029 - RNA, 22 nt, Homo sapiens
ugagaucaugccacugcacuuc

SEQ ID NO: 160030 - RNA, 22 nt, Homo sapiens
ugagaucaugucauuugcacuc

SEQ ID NO: 160031 - RNA, 22 nt, Homo sapiens
ugagaucgagucucgcucuguc

SEQ ID NO: 160032 - RNA, 22 nt, Homo sapiens
ugagaucuucgcucuucacaga

SEQ ID NO: 160033 - RNA, 22 nt, Homo sapiens
ugagaugaagucucacucuguc

SEQ ID NO: 160034 - RNA, 22 nt, Homo sapiens
ugagaugaagucuugcucuguu

SEQ ID NO: 160035 - RNA, 22 nt, Homo sapiens
ugagaugagggcugcacucaaa

SEQ ID NO: 160036 - RNA, 21 nt, Homo sapiens
ugagaugauccugcaugcaug

SEQ ID NO: 160037 - RNA, 22 nt, Homo sapiens
ugagaugcauauucuggcuccu

SEQ ID NO: 160038 - RNA, 22 nt, Homo sapiens
ugagauuacguucggcccacuu

SEQ ID NO: 160039 - RNA, 22 nt, Homo sapiens
ugagcaagaucuuuauaauuag

SEQ ID NO: 160040 - RNA, 22 nt, Homo sapiens
ugagcacagagccugggguggc

SEQ ID NO: 160041 - RNA, 22 nt, Homo sapiens
ugagcacagcgugugggagagc

SEQ ID NO: 160042 - RNA, 21 nt, Homo sapiens
auagcacaucagauuuuauua

SEQ ID NO: 160043 - RNA, 22 nt, Homo sapiens
auagcacuuaccacaggcugca

SEQ ID NO: 160044 - RNA, 22 nt, Homo sapiens
auagggcacgagaugugagccu

SEQ ID NO: 160045 - RNA, 22 nt, Homo sapiens
auagguuuucacuguagauucu

SEQ ID NO: 160046 - RNA, 22 nt, Homo sapiens
auagugaacuuugugagaacaa

SEQ ID NO: 160047 - RNA, 22 nt, Homo sapiens
auaucaagugacuggaguucca

SEQ ID NO: 160048 - RNA, 22 nt, Homo sapiens
auauggcauucagaacuguaua

SEQ ID NO: 160049 - RNA, 22 nt, Homo sapiens
auaugguacuuaugcucaaacu

SEQ ID NO: 160050 - RNA, 22 nt, Homo sapiens
auauuacagagaggaccuggga

SEQ ID NO: 160051 - RNA, 22 nt, Homo sapiens
auauuguacugcuacugguucu

SEQ ID NO: 160052 - RNA, 22 nt, Homo sapiens
aucaaaguaggcauauguuuuu

SEQ ID NO: 160053 - RNA, 22 nt, Homo sapiens
aucaaauugucauuuuaaggau

SEQ ID NO: 160054 - RNA, 22 nt, Homo sapiens
aucaaguaaucugaguaagagu

SEQ ID NO: 160055 - RNA, 22 nt, Homo sapiens
ugagcccauuguccugguuuau

SEQ ID NO: 160056 - RNA, 22 nt, Homo sapiens
ugagcucaugcauucuugagga

SEQ ID NO: 160057 - RNA, 22 nt, Homo sapiens
ugagcugagaaaugcagcagcu

SEQ ID NO: 160058 - RNA, 22 nt, Homo sapiens
ugagcugagauuaagcugcugc

SEQ ID NO: 160059 - RNA, 22 nt, Homo sapiens
ugagcugguacuaauauuauca

SEQ ID NO: 160060 - RNA, 22 nt, Homo sapiens
ugaggaauguguguuaaagaua

SEQ ID NO: 160061 - RNA, 22 nt, Homo sapiens
ugaggcaagauacugauuucau

SEQ ID NO: 160062 - RNA, 22 nt, Homo sapiens
ugagguaacagaagcgagcauu

SEQ ID NO: 160063 - RNA, 22 nt, Homo sapiens
ugagguugaaggacauuuuuau

SEQ ID NO: 160064 - RNA, 22 nt, Homo sapiens
ugagguugguauuacugucucu

SEQ ID NO: 160065 - RNA, 22 nt, Homo sapiens
ugagguugucagugucauucuu

SEQ ID NO: 160066 - RNA, 22 nt, Homo sapiens
ugagguuguccacuauaaucca

SEQ ID NO: 160067 - RNA, 22 nt, Homo sapiens
ugaguagaacaucaagucauac

SEQ ID NO: 160068 - RNA, 22 nt, Homo sapiens
ugaguagucagugggcaggaag

SEQ ID NO: 160069 - RNA, 22 nt, Homo sapiens
ugagugaggcugggcagucccu

SEQ ID NO: 160070 - RNA, 22 nt, Homo sapiens
ugaguguguaugugcauacaca

SEQ ID NO: 160071 - RNA, 22 nt, Homo sapiens
ugauaauguuaggcuuuauuca

SEQ ID NO: 160072 - RNA, 22 nt, Homo sapiens
ugaugacauugucacagucuga

SEQ ID NO: 160073 - RNA, 19 nt, Homo sapiens
ugcaaauucuaaaaacuga

SEQ ID NO: 160074 - RNA, 18 nt, Homo sapiens
ugcagcaucaguacccag

SEQ ID NO: 160075 - RNA, 22 nt, Homo sapiens
ugcagcauguaggcacguuauu

SEQ ID NO: 160076 - RNA, 22 nt, Homo sapiens
ugcagcauugcacuccagccug

SEQ ID NO: 160077 - RNA, 22 nt, Homo sapiens
ugcagcucagcugcggaguuuu

SEQ ID NO: 160078 - RNA, 22 nt, Homo sapiens
ugcauagaauguucuguaaaua

SEQ ID NO: 160079 - RNA, 22 nt, Homo sapiens
ugcauggagcucucuuuggacu

SEQ ID NO: 160080 - RNA, 22 nt, Homo sapiens
ugccaacaugccuggcuguuuu

SEQ ID NO: 160081 - RNA, 22 nt, Homo sapiens
ugccugagccagguuuuaggag

SEQ ID NO: 160082 - RNA, 22 nt, Homo sapiens
ugccuuauuccaacugagcucu

SEQ ID NO: 160083 - RNA, 22 nt, Homo sapiens
ugccuucuguuaaacgaggaug

SEQ ID NO: 160084 - RNA, 22 nt, Homo sapiens
ugcgccauugaacuccaggcug

SEQ ID NO: 160085 - RNA, 22 nt, Homo sapiens
ugcugguauuauguuauccaga

SEQ ID NO: 160086 - RNA, 22 nt, Homo sapiens
ugcuuuguugaaaaucauuugg

SEQ ID NO: 160087 - RNA, 22 nt, Homo sapiens
uggaaaauuaggggagguuaua

SEQ ID NO: 160088 - RNA, 22 nt, Homo sapiens
uggaaauuaacagggauugucc

SEQ ID NO: 160089 - RNA, 22 nt, Homo sapiens
uggaaauuaagucuuuccugag

SEQ ID NO: 160090 - RNA, 22 nt, Homo sapiens
uggaagcauagcagcgugugug

SEQ ID NO: 160091 - RNA, 22 nt, Homo sapiens
uggaagcaugcaaucugugggg

SEQ ID NO: 160092 - RNA, 22 nt, Homo sapiens
uggaagccuagauucuuuucuu

SEQ ID NO: 160093 - RNA, 22 nt, Homo sapiens
uggaaguagauagauuguguca

SEQ ID NO: 160094 - RNA, 21 nt, Homo sapiens
uggaauguucugacuucaggg

SEQ ID NO: 160095 - RNA, 22 nt, Homo sapiens
uggaauuuacuuauuuaggggc

SEQ ID NO: 160096 - RNA, 22 nt, Homo sapiens
uggaauuuagguugauaguaua

SEQ ID NO: 160097 - RNA, 22 nt, Homo sapiens
uggagagcaaagaauuuguuag

SEQ ID NO: 160098 - RNA, 20 nt, Homo sapiens
uggaggucaucugucacuac

SEQ ID NO: 160099 - RNA, 22 nt, Homo sapiens
uggaguaggccuaagaaugaca

SEQ ID NO: 160100 - RNA, 22 nt, Homo sapiens
uggagugaaaacacacuaaucu

SEQ ID NO: 160101 - RNA, 21 nt, Homo sapiens
uggagugaagaguuuauugac

SEQ ID NO: 160102 - RNA, 22 nt, Homo sapiens
uggcaaauauuuuguuuuguaa

SEQ ID NO: 160103 - RNA, 21 nt, Homo sapiens
uggcaacauggauggauucug

SEQ ID NO: 160104 - RNA, 22 nt, Homo sapiens
uggcaagaacaacaauuacuuu

SEQ ID NO: 160105 - RNA, 22 nt, Homo sapiens
uggcaagaaggauuuauuccuu

SEQ ID NO: 160106 - RNA, 23 nt, Homo sapiens
uggcaagaauucuuaccgugugg

SEQ ID NO: 160107 - RNA, 22 nt, Homo sapiens
uggcaagagauaugugucuaua

SEQ ID NO: 160108 - RNA, 22 nt, Homo sapiens
uggcaagagcugcauucaucug

SEQ ID NO: 160109 - RNA, 20 nt, Homo sapiens
uggcaagauggcagaauaga

SEQ ID NO: 160110 - RNA, 22 nt, Homo sapiens
uggcaagauuguuccgguuugg

SEQ ID NO: 160111 - RNA, 22 nt, Homo sapiens
uggcauggaguggauggcccca

SEQ ID NO: 160112 - RNA, 22 nt, Homo sapiens
uggcauuuuguuuuagaauuag

SEQ ID NO: 160113 - RNA, 20 nt, Homo sapiens
uggcuaaaugaaugauagca

SEQ ID NO: 160114 - RNA, 22 nt, Homo sapiens
uggcuuuucauccugggacauu

SEQ ID NO: 160115 - RNA, 22 nt, Homo sapiens
ugggcaaaacuaagagcugugg

SEQ ID NO: 160116 - RNA, 22 nt, Homo sapiens
ugggccgcugcaggaugguccc

SEQ ID NO: 160117 - RNA, 22 nt, Homo sapiens
ugggcuagaugcuuugggguca

SEQ ID NO: 160118 - RNA, 22 nt, Homo sapiens
uggguaaaucucuguucagggc

SEQ ID NO: 160119 - RNA, 22 nt, Homo sapiens
ugguauguuuauaaguauagga

SEQ ID NO: 160120 - RNA, 22 nt, Homo sapiens
uggucccaugaacuuuagguca

SEQ ID NO: 160121 - RNA, 22 nt, Homo sapiens
uggugagaaacuagauauuuuu

SEQ ID NO: 160122 - RNA, 22 nt, Homo sapiens
uggugccgugguccuggggcca

SEQ ID NO: 160123 - RNA, 18 nt, Homo sapiens
uguaaacuaccucaaccu

SEQ ID NO: 160124 - RNA, 22 nt, Homo sapiens
uguaagcauugggcaugcaguc

SEQ ID NO: 160125 - RNA, 23 nt, Homo sapiens
uguauacacccugugcaucuggg

SEQ ID NO: 160126 - RNA, 22 nt, Homo sapiens
uagauuaucuguaugugcucuu

SEQ ID NO: 160127 - RNA, 22 nt, Homo sapiens
uagcagaauaacuugccagccu

SEQ ID NO: 160128 - RNA, 22 nt, Homo sapiens
uagcagcaaagcaggaucugcu

SEQ ID NO: 160129 - RNA, 22 nt, Homo sapiens
uagcauggagucaugcacggcu

SEQ ID NO: 160130 - RNA, 22 nt, Homo sapiens
uagccucacaaagugcuuaaga

SEQ ID NO: 160131 - RNA, 20 nt, Homo sapiens
uaggagcaaugagaguagaa

SEQ ID NO: 160132 - RNA, 22 nt, Homo sapiens
uaggguaguaauaguuguuuca

SEQ ID NO: 160133 - RNA, 22 nt, Homo sapiens
uaguaccauucccaaaccaacu

SEQ ID NO: 160134 - RNA, 22 nt, Homo sapiens
uaguaucacaagguguacaccc

SEQ ID NO: 160135 - RNA, 22 nt, Homo sapiens
uagugacauugcugggaaugcu

SEQ ID NO: 160136 - RNA, 22 nt, Homo sapiens
uagugcaguggcuccaucucag

SEQ ID NO: 160137 - RNA, 21 nt, Homo sapiens
uagugcagugggguaugacuu

SEQ ID NO: 160138 - RNA, 20 nt, Homo sapiens
uaguggaaaucagguccucu

SEQ ID NO: 160139 - RNA, 22 nt, Homo sapiens
uaguucauuuuucuugcuuaga

SEQ ID NO: 160140 - RNA, 22 nt, Homo sapiens
uaguuuaucuucuggauggaca

SEQ ID NO: 160141 - RNA, 22 nt, Homo sapiens
uauacugucuuuguaugccuag

SEQ ID NO: 160142 - RNA, 22 nt, Homo sapiens
uauaugcaacauaguguaugug

SEQ ID NO: 160143 - RNA, 22 nt, Homo sapiens
uauauguuuucauaaggcuaga

SEQ ID NO: 160144 - RNA, 20 nt, Homo sapiens
uaucacaguucaggaacucu

SEQ ID NO: 160145 - RNA, 22 nt, Homo sapiens
uaucaccacccugggaaacaua

SEQ ID NO: 160146 - RNA, 22 nt, Homo sapiens
uaucucagagaaucagauuuac

SEQ ID NO: 160147 - RNA, 22 nt, Homo sapiens
uaucucagaguguacaagauua

SEQ ID NO: 160148 - RNA, 22 nt, Homo sapiens
uaucucagaugagacuuguaac

SEQ ID NO: 160149 - RNA, 19 nt, Homo sapiens
uaugcaacuuauagugcug

SEQ ID NO: 160150 - RNA, 22 nt, Homo sapiens
uaugcuuauuaaaacagugugu

SEQ ID NO: 160151 - RNA, 22 nt, Homo sapiens
uauggauuucauuagacuugag

SEQ ID NO: 160152 - RNA, 22 nt, Homo sapiens
uauggcguaugaauuauaucuc

SEQ ID NO: 160153 - RNA, 22 nt, Homo sapiens
uaugguuuuaagguuaaggacu

SEQ ID NO: 160154 - RNA, 20 nt, Homo sapiens
uaugguuuuagguauagcau

SEQ ID NO: 160155 - RNA, 22 nt, Homo sapiens
uaugguuuuggaauccugcaga

SEQ ID NO: 160156 - RNA, 22 nt, Homo sapiens
uaugugcacaugcccuggugac

SEQ ID NO: 160157 - RNA, 22 nt, Homo sapiens
uauuaugcacuuuauaaaaauu

SEQ ID NO: 160158 - RNA, 22 nt, Homo sapiens
uauugcaauuggggaaacuggg

SEQ ID NO: 160159 - RNA, 22 nt, Homo sapiens
uauuugauuaacaagagccuaa

SEQ ID NO: 160160 - RNA, 22 nt, Homo sapiens
uauuuggauagucuggaaaaaa

SEQ ID NO: 160161 - RNA, 22 nt, Homo sapiens
uauuugguuauaugaguaaguu

SEQ ID NO: 160162 - RNA, 18 nt, Homo sapiens
ucaagcuauugucaugcc

SEQ ID NO: 160163 - RNA, 22 nt, Homo sapiens
ucaaggcacauuugacauuuuc

SEQ ID NO: 160164 - RNA, 22 nt, Homo sapiens
ucacaauucacuacaggcuuga

SEQ ID NO: 160165 - RNA, 22 nt, Homo sapiens
ucacagucggugacuucuugcu

SEQ ID NO: 160166 - RNA, 23 nt, Homo sapiens
ucacaguggcugcuuaauuguga

SEQ ID NO: 160167 - RNA, 22 nt, Homo sapiens
ucacaguugauugaaacacagc

SEQ ID NO: 160168 - RNA, 22 nt, Homo sapiens
ucacauuguguagccugcucac

SEQ ID NO: 160169 - RNA, 18 nt, Homo sapiens
ucaccuugugagagagag

SEQ ID NO: 160170 - RNA, 22 nt, Homo sapiens
ucacugcacucuccgccuugcg

SEQ ID NO: 160171 - RNA, 22 nt, Homo sapiens
ucacugggagcauuugagccuu

SEQ ID NO: 160172 - RNA, 22 nt, Homo sapiens
ucacuggucuaaguggaggggg

SEQ ID NO: 160173 - RNA, 22 nt, Homo sapiens
ucagaucuucagcaggggcccc

SEQ ID NO: 160174 - RNA, 19 nt, Homo sapiens
ucagcaguaaucaacuuca

SEQ ID NO: 160175 - RNA, 21 nt, Homo sapiens
ucaggcuuuuugagugccaau

SEQ ID NO: 160176 - RNA, 20 nt, Homo sapiens
ucagguagaucuuugagguc

SEQ ID NO: 160177 - RNA, 22 nt, Homo sapiens
ucagguagcuagauuaugugag

SEQ ID NO: 160178 - RNA, 23 nt, Homo sapiens
ucagguaguuucagaggaccuug

SEQ ID NO: 160179 - RNA, 22 nt, Homo sapiens
ucagguaguuugugggagauga

SEQ ID NO: 160180 - RNA, 17 nt, Homo sapiens
ucagugcauuuaagaga

SEQ ID NO: 160181 - RNA, 22 nt, Homo sapiens
ucauacuguugugaaacaaaac

SEQ ID NO: 160182 - RNA, 22 nt, Homo sapiens
ucaucaguuuuuuauaugugau

SEQ ID NO: 160183 - RNA, 23 nt, Homo sapiens
ucaugaggccauucaaauccauu

SEQ ID NO: 160184 - RNA, 22 nt, Homo sapiens
ucauggcuuuuauuauguugag

SEQ ID NO: 160185 - RNA, 22 nt, Homo sapiens
ucaugugaggauaacaauagug

SEQ ID NO: 160186 - RNA, 22 nt, Homo sapiens
ucauguguugcacugaggaccu

SEQ ID NO: 160187 - RNA, 22 nt, Homo sapiens
uccaaaucucuggcacugggau

SEQ ID NO: 160188 - RNA, 22 nt, Homo sapiens
uccacaauggagaagaguauga

SEQ ID NO: 160189 - RNA, 22 nt, Homo sapiens
uccacaauggcugaacuagauu

SEQ ID NO: 160190 - RNA, 22 nt, Homo sapiens
uccacagugguugaacuaguaa

SEQ ID NO: 160191 - RNA, 22 nt, Homo sapiens
uccagaguggugaugcuggggc

SEQ ID NO: 160192 - RNA, 22 nt, Homo sapiens
uccaguacaggucucucauuuc

SEQ ID NO: 160193 - RNA, 20 nt, Homo sapiens
uccaguuuuggagacauucu

SEQ ID NO: 160194 - RNA, 22 nt, Homo sapiens
uccaugaguccauuagaaaaaa

SEQ ID NO: 160195 - RNA, 22 nt, Homo sapiens
uccaugugaaaucuaugaggac

SEQ ID NO: 160196 - RNA, 22 nt, Homo sapiens
ucccagaaacgcauauguucau

SEQ ID NO: 160197 - RNA, 22 nt, Homo sapiens
ucccugaaaauuagcauuuuaa

SEQ ID NO: 160198 - RNA, 22 nt, Homo sapiens
ucccugacagggucugagcuuu

SEQ ID NO: 160199 - RNA, 22 nt, Homo sapiens
ucccugguguuaguuuguucuu

SEQ ID NO: 160200 - RNA, 17 nt, Homo sapiens
ucccuguuuuuucaguc

SEQ ID NO: 160201 - RNA, 18 nt, Homo sapiens
ucccuuuguagaugaccc

SEQ ID NO: 160202 - RNA, 22 nt, Homo sapiens
uccuguaaucccagcuaccaga

SEQ ID NO: 160203 - RNA, 22 nt, Homo sapiens
uccuucacucuacaucuuuguu

SEQ ID NO: 160204 - RNA, 21 nt, Homo sapiens
uccuuggugaugcccugcagu

SEQ ID NO: 160205 - RNA, 22 nt, Homo sapiens
ucgugccacugcacuccagccu

SEQ ID NO: 160206 - RNA, 22 nt, Homo sapiens
ucuaagaauucauuuauaagcc

SEQ ID NO: 160207 - RNA, 22 nt, Homo sapiens
ucucacagccauuucucccucu

SEQ ID NO: 160208 - RNA, 20 nt, Homo sapiens
ucucauggagguagagaaua

SEQ ID NO: 160209 - RNA, 22 nt, Homo sapiens
ucucauggagucaggagcagaa

SEQ ID NO: 160210 - RNA, 22 nt, Homo sapiens
ucuccggguggcggcgaaggga

SEQ ID NO: 160211 - RNA, 22 nt, Homo sapiens
ucucugagaaaaguuucuccca

SEQ ID NO: 160212 - RNA, 22 nt, Homo sapiens
ucucuguuuauuuuugguguau

SEQ ID NO: 160213 - RNA, 22 nt, Homo sapiens
ucugagaugagacuuugaauuu

SEQ ID NO: 160214 - RNA, 22 nt, Homo sapiens
ucugagcaauaaacaacauauu

SEQ ID NO: 160215 - RNA, 22 nt, Homo sapiens
ucugagguaggugcauggauac

SEQ ID NO: 160216 - RNA, 22 nt, Homo sapiens
ucuggauuuuugaggcaauaua

SEQ ID NO: 160217 - RNA, 22 nt, Homo sapiens
ucuuauuuggggaaaggguccu

SEQ ID NO: 160218 - RNA, 22 nt, Homo sapiens
ucuuggcauggcugaagauucc

SEQ ID NO: 160219 - RNA, 22 nt, Homo sapiens
ucuuggguggauucauucuuuc

SEQ ID NO: 160220 - RNA, 22 nt, Homo sapiens
ucuuggguuugccuugcugcug

SEQ ID NO: 160221 - RNA, 22 nt, Homo sapiens
ucuuugccuaacccaaggucau

SEQ ID NO: 160222 - RNA, 22 nt, Homo sapiens
ucuuuggugaauggucauccag

SEQ ID NO: 160223 - RNA, 22 nt, Homo sapiens
ucuuugguucuguuuauguaau

SEQ ID NO: 160224 - RNA, 22 nt, Homo sapiens
ucuuuguuagaacccucuccuu

SEQ ID NO: 160225 - RNA, 22 nt, Homo sapiens
ugaaaugucuuuaggaggcuuc

SEQ ID NO: 160226 - RNA, 22 nt, Homo sapiens
ugaaauguguuaucugggccug

SEQ ID NO: 160227 - RNA, 22 nt, Homo sapiens
ugguaaacaacaggagaacuug

SEQ ID NO: 160228 - RNA, 22 nt, Homo sapiens
ugguauguauacuagcgacacu

SEQ ID NO: 160229 - RNA, 22 nt, Homo sapiens
ugguauguaugauuaacaugga

SEQ ID NO: 160230 - RNA, 21 nt, Homo sapiens
uggucccauaagauuacaaug

SEQ ID NO: 160231 - RNA, 15 nt, Homo sapiens
uggugguguugagac

SEQ ID NO: 160232 - RNA, 22 nt, Homo sapiens
uguaaugaucaaaucagaguaa

SEQ ID NO: 160233 - RNA, 22 nt, Homo sapiens
uguaauuuaaaugauccuugga

SEQ ID NO: 160234 - RNA, 22 nt, Homo sapiens
ugucaaauucuggguuaaaaca

SEQ ID NO: 160235 - RNA, 22 nt, Homo sapiens
ugucaucuagguauuaagcccc

SEQ ID NO: 160236 - RNA, 22 nt, Homo sapiens
uguccauuuuuaugcuuauggu

SEQ ID NO: 160237 - RNA, 18 nt, Homo sapiens
ugucccuuugcuguucau

SEQ ID NO: 160238 - RNA, 22 nt, Homo sapiens
ugucuaguuuugaaguauagca

SEQ ID NO: 160239 - RNA, 22 nt, Homo sapiens
ugucucaguucccuucucugga

SEQ ID NO: 160240 - RNA, 22 nt, Homo sapiens
ugucuuguagacaauguauagu

SEQ ID NO: 160241 - RNA, 22 nt, Homo sapiens
ugugaaacacgaaagucuaaaa

SEQ ID NO: 160242 - RNA, 22 nt, Homo sapiens
ugugaacaaaauuuguugcaua

SEQ ID NO: 160243 - RNA, 22 nt, Homo sapiens
ugugaagauggacuaauauagu

SEQ ID NO: 160244 - RNA, 22 nt, Homo sapiens
uguggaguguaugugacagaga

SEQ ID NO: 160245 - RNA, 22 nt, Homo sapiens
uguggcauugaauaaccuugga

SEQ ID NO: 160246 - RNA, 22 nt, Homo sapiens
ugugggaggugcuaauguaaau

SEQ ID NO: 160247 - RNA, 23 nt, Homo sapiens
ugugguauuauuccauuuauagg

SEQ ID NO: 160248 - RNA, 22 nt, Homo sapiens
ugugguuuuuuucuccaauagg

SEQ ID NO: 160249 - RNA, 22 nt, Homo sapiens
uguguaaauagcuacggaucug

SEQ ID NO: 160250 - RNA, 22 nt, Homo sapiens
uguuacagcagaauugauugca

SEQ ID NO: 160251 - RNA, 22 nt, Homo sapiens
uguuacagcagcacaaaaugga

SEQ ID NO: 160252 - RNA, 22 nt, Homo sapiens
uguuacaguguaggccuugggu

SEQ ID NO: 160253 - RNA, 22 nt, Homo sapiens
uguuauuuuguguuagggcaca

SEQ ID NO: 160254 - RNA, 22 nt, Homo sapiens
uguucuggagaggcaggccaca

SEQ ID NO: 160255 - RNA, 22 nt, Homo sapiens
uuaaaagcuaucuccaagguca

SEQ ID NO: 160256 - RNA, 22 nt, Homo sapiens
uuaaagcuggcguuacaguuug

SEQ ID NO: 160257 - RNA, 22 nt, Homo sapiens
uuaaaggcaugguuagacaugg

SEQ ID NO: 160258 - RNA, 22 nt, Homo sapiens
uuaaaugcauagaauguguagu

SEQ ID NO: 160259 - RNA, 22 nt, Homo sapiens
uuaacagucacuuagcucauuu

SEQ ID NO: 160260 - RNA, 22 nt, Homo sapiens
uuaagaagugauuuuccucauu

SEQ ID NO: 160261 - RNA, 22 nt, Homo sapiens
uuaaucucaggaguuugggacc

SEQ ID NO: 160262 - RNA, 22 nt, Homo sapiens
uuacagauggcacacucaaggg

SEQ ID NO: 160263 - RNA, 17 nt, Homo sapiens
uuacaggugcugagagu

SEQ ID NO: 160264 - RNA, 22 nt, Homo sapiens
uuacaguaugaguaagaguucu

SEQ ID NO: 160265 - RNA, 19 nt, Homo sapiens
uuacagugugcccuuuuag

SEQ ID NO: 160266 - RNA, 22 nt, Homo sapiens
uuacaguucugguggagaggua

SEQ ID NO: 160267 - RNA, 22 nt, Homo sapiens
uuaccagucugauuccuguuag

SEQ ID NO: 160268 - RNA, 21 nt, Homo sapiens
uuagccuguaagcacuuugca

SEQ ID NO: 160269 - RNA, 22 nt, Homo sapiens
uuaggacacuguggguggguca

SEQ ID NO: 160270 - RNA, 22 nt, Homo sapiens
uuagggaguaaucuaaaaaugg

SEQ ID NO: 160271 - RNA, 22 nt, Homo sapiens
uuaguucccucauucuugacuu

SEQ ID NO: 160272 - RNA, 22 nt, Homo sapiens
uuauaacagagacuccugugcu

SEQ ID NO: 160273 - RNA, 22 nt, Homo sapiens
uuauccagcgcuguuuuggaga

SEQ ID NO: 160274 - RNA, 17 nt, Homo sapiens
uuaugagacuucuuagc

SEQ ID NO: 160275 - RNA, 22 nt, Homo sapiens
uuaugucauuuuuggauguuaa

SEQ ID NO: 160276 - RNA, 22 nt, Homo sapiens
uuauuagguuaaccuauagcua

SEQ ID NO: 160277 - RNA, 22 nt, Homo sapiens
uuauugcacuccagccugggua

SEQ ID NO: 160278 - RNA, 22 nt, Homo sapiens
uucaaaucuuuggcucccacua

SEQ ID NO: 160279 - RNA, 22 nt, Homo sapiens
uucaagauggcaccagugagug

SEQ ID NO: 160280 - RNA, 22 nt, Homo sapiens
uucaagcuacaguggcaggguu

SEQ ID NO: 160281 - RNA, 22 nt, Homo sapiens
uucaauaugucauuggcaggca

SEQ ID NO: 160282 - RNA, 22 nt, Homo sapiens
uucacacuagccacucugguag

SEQ ID NO: 160283 - RNA, 22 nt, Homo sapiens
uucacagccgcaccccaucacu

SEQ ID NO: 160284 - RNA, 22 nt, Homo sapiens
uucacaguacucccuggaauua

SEQ ID NO: 160285 - RNA, 22 nt, Homo sapiens
uucacugcacuccagccugagc

SEQ ID NO: 160286 - RNA, 22 nt, Homo sapiens
uucacuguaaaaugaagagggu

SEQ ID NO: 160287 - RNA, 22 nt, Homo sapiens
uucacuguagccucagccucuu

SEQ ID NO: 160288 - RNA, 22 nt, Homo sapiens
uucacugugaacucauauucag

SEQ ID NO: 160289 - RNA, 22 nt, Homo sapiens
uucagaguggacagaaauuaag

SEQ ID NO: 160290 - RNA, 22 nt, Homo sapiens
uucagagugguaugaagugaug

SEQ ID NO: 160291 - RNA, 22 nt, Homo sapiens
uucagaugcacacuguagucua

SEQ ID NO: 160292 - RNA, 22 nt, Homo sapiens
uucaggcuccgugccagcuccg

SEQ ID NO: 160293 - RNA, 22 nt, Homo sapiens
uucauaguuuauacugauauuu

SEQ ID NO: 160294 - RNA, 18 nt, Homo sapiens
uucauauguugaaccaga

SEQ ID NO: 160295 - RNA, 22 nt, Homo sapiens
uucaucagggagaaauaauuuc

SEQ ID NO: 160296 - RNA, 22 nt, Homo sapiens
uucauguaauuccauaagguaa

SEQ ID NO: 160297 - RNA, 22 nt, Homo sapiens
uuccacuuuuuccuugugcucc

SEQ ID NO: 160298 - RNA, 22 nt, Homo sapiens
uuccauagucauagugcugaug

SEQ ID NO: 160299 - RNA, 22 nt, Homo sapiens
uucccagucaaacgaaggacuu

SEQ ID NO: 160300 - RNA, 22 nt, Homo sapiens
uucccuagaacacauggaggga

SEQ ID NO: 160301 - RNA, 22 nt, Homo sapiens
uucccugaaguguuacucuaga

SEQ ID NO: 160302 - RNA, 22 nt, Homo sapiens
uucccuguaucuucugccaugu

SEQ ID NO: 160303 - RNA, 22 nt, Homo sapiens
uucccugugggaguaggaaagu

SEQ ID NO: 160304 - RNA, 22 nt, Homo sapiens
uucccugugugcagaugggugu

SEQ ID NO: 160305 - RNA, 22 nt, Homo sapiens
uuccuugagagcuugauaucac

SEQ ID NO: 160306 - RNA, 22 nt, Homo sapiens
uucuaugguuuuuaugguguua

SEQ ID NO: 160307 - RNA, 22 nt, Homo sapiens
uucucacaguacagggagcucu

SEQ ID NO: 160308 - RNA, 22 nt, Homo sapiens
uucucagugaaguuuagaacau

SEQ ID NO: 160309 - RNA, 22 nt, Homo sapiens
uucucuggucagaggggagguu

SEQ ID NO: 160310 - RNA, 22 nt, Homo sapiens
uucuggcuuauaaacgugacuu

SEQ ID NO: 160311 - RNA, 22 nt, Homo sapiens
uucuguguuuaggucacggcua

SEQ ID NO: 160312 - RNA, 22 nt, Homo sapiens
uucuuagguuaaggcugagaga

SEQ ID NO: 160313 - RNA, 22 nt, Homo sapiens
uucuuagucauguaauagucca

SEQ ID NO: 160314 - RNA, 21 nt, Homo sapiens
uucuucaggcagaaggauuau

SEQ ID NO: 160315 - RNA, 21 nt, Homo sapiens
uucuuugcucaguguuagagu

SEQ ID NO: 160316 - RNA, 22 nt, Homo sapiens
uugaaugaaaugaugucauuug

SEQ ID NO: 160317 - RNA, 21 nt, Homo sapiens
uugacagugacagguaaaguu

SEQ ID NO: 160318 - RNA, 22 nt, Homo sapiens
uugacauaguuucugaaauaga

SEQ ID NO: 160319 - RNA, 21 nt, Homo sapiens
uugagaagaauuagcucuucc

SEQ ID NO: 160320 - RNA, 22 nt, Homo sapiens
uugagaagugucuguucauguc

SEQ ID NO: 160321 - RNA, 22 nt, Homo sapiens
uugagaucugugcuuuugcguu

SEQ ID NO: 160322 - RNA, 22 nt, Homo sapiens
uugagauggagucucgcucugu

SEQ ID NO: 160323 - RNA, 22 nt, Homo sapiens
uugagauggagucuugcacugu

SEQ ID NO: 160324 - RNA, 22 nt, Homo sapiens
uugagcaaaacauuaauauuag

SEQ ID NO: 160325 - RNA, 22 nt, Homo sapiens
uugagcucuuccagccuggagc

SEQ ID NO: 160326 - RNA, 22 nt, Homo sapiens
uugaggcaaugaggagaagcug

SEQ ID NO: 160327 - RNA, 22 nt, Homo sapiens
uugaggucagagguucgagacc

SEQ ID NO: 160328 - RNA, 22 nt, Homo sapiens
aaagagcugagaccugguggag

SEQ ID NO: 160329 - RNA, 22 nt, Homo sapiens
aaaggcacugugacuuuauagg

SEQ ID NO: 160330 - RNA, 22 nt, Homo sapiens
aaaggcuucggaucagaaggua

SEQ ID NO: 160331 - RNA, 22 nt, Homo sapiens
aaagggcuguuucuugacuugg

SEQ ID NO: 160332 - RNA, 22 nt, Homo sapiens
aaagucuagaggaucaugugug

SEQ ID NO: 160333 - RNA, 22 nt, Homo sapiens
aaagucuguuacagcuauuucu

SEQ ID NO: 160334 - RNA, 22 nt, Homo sapiens
aaagugcaguacuucguauauu

SEQ ID NO: 160335 - RNA, 22 nt, Homo sapiens
aaagugcaguauuugggcagga

SEQ ID NO: 160336 - RNA, 22 nt, Homo sapiens
aaagugcuaggauuaccugggg

SEQ ID NO: 160337 - RNA, 22 nt, Homo sapiens
aaagugcugagauuguaggcau

SEQ ID NO: 160338 - RNA, 19 nt, Homo sapiens
aaaguguuuuaaagaggau

SEQ ID NO: 160339 - RNA, 22 nt, Homo sapiens
aaaugcaugaauaagcucgugu

SEQ ID NO: 160340 - RNA, 22 nt, Homo sapiens
aaaugcauugagggaaaaggca

SEQ ID NO: 160341 - RNA, 22 nt, Homo sapiens
aaaugccucccauucuacugac

SEQ ID NO: 160342 - RNA, 22 nt, Homo sapiens
aaauggauuaaguucacuugcu

SEQ ID NO: 160343 - RNA, 22 nt, Homo sapiens
aaauucaugucaccucuaggua

SEQ ID NO: 160344 - RNA, 22 nt, Homo sapiens
aaauugcuuuugaagacuuagu

SEQ ID NO: 160345 - RNA, 22 nt, Homo sapiens
aacacggcccgcagagcaagcu

SEQ ID NO: 160346 - RNA, 22 nt, Homo sapiens
aacacuaucugccuuacaggga

SEQ ID NO: 160347 - RNA, 22 nt, Homo sapiens
aacaggcuccuaggggugcacc

SEQ ID NO: 160348 - RNA, 22 nt, Homo sapiens
aacaguaucuaacgagugauga

SEQ ID NO: 160349 - RNA, 22 nt, Homo sapiens
aacagucuccaguuguauccau

SEQ ID NO: 160350 - RNA, 22 nt, Homo sapiens
aaccuacauucuuaacuguugc

SEQ ID NO: 160351 - RNA, 22 nt, Homo sapiens
aacuccauuuuagacccuagau

SEQ ID NO: 160352 - RNA, 18 nt, Homo sapiens
aagagcucagcacagguu

SEQ ID NO: 160353 - RNA, 22 nt, Homo sapiens
aagaggcuguaggauaaugccu

SEQ ID NO: 160354 - RNA, 22 nt, Homo sapiens
aagcuacauuuuauuuauguca

SEQ ID NO: 160355 - RNA, 22 nt, Homo sapiens
aagcuggagugcaguggugcga

SEQ ID NO: 160356 - RNA, 22 nt, Homo sapiens
aagcuggauuuaguguggagca

SEQ ID NO: 160357 - RNA, 22 nt, Homo sapiens
aagcuggauuucgcauccuguu

SEQ ID NO: 160358 - RNA, 22 nt, Homo sapiens
aagcuguguguaagcucucaca

SEQ ID NO: 160359 - RNA, 22 nt, Homo sapiens
aagcuuucaacuguuugccauu

SEQ ID NO: 160360 - RNA, 22 nt, Homo sapiens
aaggaauucaaauuuucucugg

SEQ ID NO: 160361 - RNA, 22 nt, Homo sapiens
aaggcaagaaaauggauucucc

SEQ ID NO: 160362 - RNA, 22 nt, Homo sapiens
aaggcuagagaagaagggcauc

SEQ ID NO: 160363 - RNA, 22 nt, Homo sapiens
aagggaaugcgcugccuguguu

SEQ ID NO: 160364 - RNA, 22 nt, Homo sapiens
aaggugcuguaagcauccaugu

SEQ ID NO: 160365 - RNA, 22 nt, Homo sapiens
aagguuguauuuaauauacugu

SEQ ID NO: 160366 - RNA, 22 nt, Homo sapiens
aaguaauggaguuauuuuauga

SEQ ID NO: 160367 - RNA, 22 nt, Homo sapiens
aaguauuagcuaauugugcuua

SEQ ID NO: 160368 - RNA, 22 nt, Homo sapiens
aagugcaaauucccaggcucug

SEQ ID NO: 160369 - RNA, 22 nt, Homo sapiens
aagugcugggauuggccgggca

SEQ ID NO: 160370 - RNA, 22 nt, Homo sapiens
aagugcuguaugggagccuagg

SEQ ID NO: 160371 - RNA, 22 nt, Homo sapiens
aagugcuuacagggaacaugau

SEQ ID NO: 160372 - RNA, 22 nt, Homo sapiens
aagugguguuuguauuuaugca

SEQ ID NO: 160373 - RNA, 22 nt, Homo sapiens
aaguguaaguuaauguuuaggu

SEQ ID NO: 160374 - RNA, 23 nt, Homo sapiens
aaguucaugcucaucuguuacac

SEQ ID NO: 160375 - RNA, 22 nt, Homo sapiens
aaguuguaguuagagaguugcu

SEQ ID NO: 160376 - RNA, 22 nt, Homo sapiens
aaguuguuggaguuccauuguu

SEQ ID NO: 160377 - RNA, 22 nt, Homo sapiens
aauacugaaaguauuuucaaau

SEQ ID NO: 160378 - RNA, 22 nt, Homo sapiens
aauaugguuuuaugaagcaauu

SEQ ID NO: 160379 - RNA, 22 nt, Homo sapiens
aaucacaggucuuggcugcaug

SEQ ID NO: 160380 - RNA, 22 nt, Homo sapiens
aaucacauugaaucugcuaccu

SEQ ID NO: 160381 - RNA, 17 nt, Homo sapiens
aaucagauuucugagga

SEQ ID NO: 160382 - RNA, 20 nt, Homo sapiens
aaucuacuugcccauuuagc

SEQ ID NO: 160383 - RNA, 22 nt, Homo sapiens
aaugcacauaaaauccuccagg

SEQ ID NO: 160384 - RNA, 22 nt, Homo sapiens
aaugugcacuauuagggugaua

SEQ ID NO: 160385 - RNA, 22 nt, Homo sapiens
aucacacuguuauuuuaguuaa

SEQ ID NO: 160386 - RNA, 20 nt, Homo sapiens
aucacuggagaaggaaaccu

SEQ ID NO: 160387 - RNA, 22 nt, Homo sapiens
aucacuggucaugagagaagua

SEQ ID NO: 160388 - RNA, 22 nt, Homo sapiens
aucagaaucucuugagaguguu

SEQ ID NO: 160389 - RNA, 21 nt, Homo sapiens
aucagagacccaggcuuccuc

SEQ ID NO: 160390 - RNA, 19 nt, Homo sapiens
aucagcacaagugugcuuu

SEQ ID NO: 160391 - RNA, 22 nt, Homo sapiens
aucagcauucccaaaugaugug

SEQ ID NO: 160392 - RNA, 22 nt, Homo sapiens
aucauguaguaagacacauuua

SEQ ID NO: 160393 - RNA, 22 nt, Homo sapiens
aucccgagacuuugcugaaguu

SEQ ID NO: 160394 - RNA, 22 nt, Homo sapiens
auccucugagaucuaggcagag

SEQ ID NO: 160395 - RNA, 22 nt, Homo sapiens
auccugagacuuugcugaaguu

SEQ ID NO: 160396 - RNA, 22 nt, Homo sapiens
aucgcgccauuguacuccagcc

SEQ ID NO: 160397 - RNA, 22 nt, Homo sapiens
aucugauggagagcguguggcu

SEQ ID NO: 160398 - RNA, 22 nt, Homo sapiens
aucugguguauuggugcugggu

SEQ ID NO: 160399 - RNA, 22 nt, Homo sapiens
aucugguguccucgugggaguc

SEQ ID NO: 160400 - RNA, 22 nt, Homo sapiens
aucuguguuuaaggucccagaa

SEQ ID NO: 160401 - RNA, 22 nt, Homo sapiens
aucuuuaguggcuguuuucaga

SEQ ID NO: 160402 - RNA, 22 nt, Homo sapiens
augaaacuggcuaauuuuugua

SEQ ID NO: 160403 - RNA, 22 nt, Homo sapiens
augaaaucuuuccugugaggau

SEQ ID NO: 160404 - RNA, 22 nt, Homo sapiens
augaacacuccaauuguacucc

SEQ ID NO: 160405 - RNA, 22 nt, Homo sapiens
augaagcuagcugauugcugau

SEQ ID NO: 160406 - RNA, 22 nt, Homo sapiens
augacaagagccuucuuuccuu

SEQ ID NO: 160407 - RNA, 22 nt, Homo sapiens
augacauugaaaagcaagugga

SEQ ID NO: 160408 - RNA, 20 nt, Homo sapiens
augacuagaggacaugguaa

SEQ ID NO: 160409 - RNA, 22 nt, Homo sapiens
augagagcuaacuguggguaca

SEQ ID NO: 160410 - RNA, 22 nt, Homo sapiens
augagauacuacaaaugaguuu

SEQ ID NO: 160411 - RNA, 19 nt, Homo sapiens
augagcaauaguuuuaauc

SEQ ID NO: 160412 - RNA, 22 nt, Homo sapiens
augagcugauuuccuuaccaua

SEQ ID NO: 160413 - RNA, 22 nt, Homo sapiens
augagcuguuuggaagacacuu

SEQ ID NO: 160414 - RNA, 22 nt, Homo sapiens
augaggaaggagccuuugucug

SEQ ID NO: 160415 - RNA, 22 nt, Homo sapiens
augaggaagucaggcccagggg

SEQ ID NO: 160416 - RNA, 22 nt, Homo sapiens
augaguaguugcuaaauauuga

SEQ ID NO: 160417 - RNA, 18 nt, Homo sapiens
augagucauuguggaaau

SEQ ID NO: 160418 - RNA, 22 nt, Homo sapiens
augauauguuuguagcuaucuc

SEQ ID NO: 160419 - RNA, 22 nt, Homo sapiens
augaucacaccacugcacucca

SEQ ID NO: 160420 - RNA, 22 nt, Homo sapiens
augcaauucuagauugauagua

SEQ ID NO: 160421 - RNA, 22 nt, Homo sapiens
augcacuguuguuauuggauaa

SEQ ID NO: 160422 - RNA, 22 nt, Homo sapiens
augcacuguuuucuugaugaga

SEQ ID NO: 160423 - RNA, 22 nt, Homo sapiens
augcauggcagagucaggguac

SEQ ID NO: 160424 - RNA, 22 nt, Homo sapiens
augccacugcacuccaaccugg

SEQ ID NO: 160425 - RNA, 22 nt, Homo sapiens
auggagcaaaacagauuuggga

SEQ ID NO: 160426 - RNA, 22 nt, Homo sapiens
auggaguuuacuuaguguaaua

SEQ ID NO: 160427 - RNA, 22 nt, Homo sapiens
auggcaguguaugauuauauua

SEQ ID NO: 160428 - RNA, 22 nt, Homo sapiens
auggcagugucuagggguguuu

SEQ ID NO: 160429 - RNA, 22 nt, Homo sapiens
auggcaguuucacucugggauu

SEQ ID NO: 160430 - RNA, 22 nt, Homo sapiens
auggccugaugcaccuguccca

SEQ ID NO: 160431 - RNA, 22 nt, Homo sapiens
auggcuagaaccuguauauuca

SEQ ID NO: 160432 - RNA, 22 nt, Homo sapiens
auggcuguuucugcaaugucua

SEQ ID NO: 160433 - RNA, 22 nt, Homo sapiens
auggcuugugacccaugcuuca

SEQ ID NO: 160434 - RNA, 22 nt, Homo sapiens
augguugguuaaaucuguguau

SEQ ID NO: 160435 - RNA, 22 nt, Homo sapiens
auguaaacagaugugcagcuug

SEQ ID NO: 160436 - RNA, 20 nt, Homo sapiens
auguaauguaugauauguac

SEQ ID NO: 160437 - RNA, 22 nt, Homo sapiens
augucaaggugggugauaguuu

SEQ ID NO: 160438 - RNA, 22 nt, Homo sapiens
augucacugcacuccugccugg

SEQ ID NO: 160439 - RNA, 21 nt, Homo sapiens
augucauggaugacuaauuca

SEQ ID NO: 160440 - RNA, 22 nt, Homo sapiens
augucuuucauagagacccaga

SEQ ID NO: 160441 - RNA, 22 nt, Homo sapiens
augugcacaugcuuacauguga

SEQ ID NO: 160442 - RNA, 22 nt, Homo sapiens
augugcuuaaaaaugcagagaa

SEQ ID NO: 160443 - RNA, 22 nt, Homo sapiens
auguggcuuuccuagaucuuag

SEQ ID NO: 160444 - RNA, 22 nt, Homo sapiens
augugguaguuauagugauaag

SEQ ID NO: 160445 - RNA, 23 nt, Homo sapiens
augugguuuuagguguugaacug

SEQ ID NO: 160446 - RNA, 22 nt, Homo sapiens
auguuguaguaugagucaaaau

SEQ ID NO: 160447 - RNA, 22 nt, Homo sapiens
auuaagagcacauguucugggu

SEQ ID NO: 160448 - RNA, 22 nt, Homo sapiens
auuacaugucuauccaugaaca

SEQ ID NO: 160449 - RNA, 22 nt, Homo sapiens
auucacagggggagaaggguau

SEQ ID NO: 160450 - RNA, 22 nt, Homo sapiens
auucauagugcuaagguguauc

SEQ ID NO: 160451 - RNA, 22 nt, Homo sapiens
auuccacuuagugacucauuug

SEQ ID NO: 160452 - RNA, 22 nt, Homo sapiens
auucccuuagcugccucagccu

SEQ ID NO: 160453 - RNA, 18 nt, Homo sapiens
auugcacaccagccuggg

SEQ ID NO: 160454 - RNA, 22 nt, Homo sapiens
auugcacuccagccuggcaaua

SEQ ID NO: 160455 - RNA, 22 nt, Homo sapiens
auugcacuccggccugggugac

SEQ ID NO: 160456 - RNA, 22 nt, Homo sapiens
auugcucaaaucaguacuugag

SEQ ID NO: 160457 - RNA, 22 nt, Homo sapiens
auuggacagcauuucuagacuu

SEQ ID NO: 160458 - RNA, 22 nt, Homo sapiens
auuguacuccagccuaggcaac

SEQ ID NO: 160459 - RNA, 22 nt, Homo sapiens
auuguacuccagccugggcagc

SEQ ID NO: 160460 - RNA, 22 nt, Homo sapiens
auuguacuccagccugggcugc

SEQ ID NO: 160461 - RNA, 22 nt, Homo sapiens
auuguucuuacaugcugucauc

SEQ ID NO: 160462 - RNA, 19 nt, Homo sapiens
auuugaucaucaggcacag

SEQ ID NO: 160463 - RNA, 20 nt, Homo sapiens
auuugcauuauggagcaccc

SEQ ID NO: 160464 - RNA, 22 nt, Homo sapiens
auuuggcauagaguaucauucu

SEQ ID NO: 160465 - RNA, 22 nt, Homo sapiens
caaagucuucaguugauucuga

SEQ ID NO: 160466 - RNA, 22 nt, Homo sapiens
caacucuguaggauccaggugg

SEQ ID NO: 160467 - RNA, 22 nt, Homo sapiens
caaggugcugagacaggagccc

SEQ ID NO: 160468 - RNA, 22 nt, Homo sapiens
caaguguuuccuuaaauacuug

SEQ ID NO: 160469 - RNA, 22 nt, Homo sapiens
caaugcauuauucucccacuuc

SEQ ID NO: 160470 - RNA, 22 nt, Homo sapiens
cacaggccugucucuuucuaac

SEQ ID NO: 160471 - RNA, 22 nt, Homo sapiens
cacagugaacaauauccucugu

SEQ ID NO: 160472 - RNA, 22 nt, Homo sapiens
aauuacuucuacaccaaccuaa

SEQ ID NO: 160473 - RNA, 22 nt, Homo sapiens
aauugcuuuuauuuagggccag

SEQ ID NO: 160474 - RNA, 22 nt, Homo sapiens
acacaguauaugacaaugcuuu

SEQ ID NO: 160475 - RNA, 22 nt, Homo sapiens
acacugucaugucucacaggca

SEQ ID NO: 160476 - RNA, 20 nt, Homo sapiens
acacugugcuaaggauuuuc

SEQ ID NO: 160477 - RNA, 22 nt, Homo sapiens
acaguaaugggccccuuuuccu

SEQ ID NO: 160478 - RNA, 22 nt, Homo sapiens
acaguggugcgaucucggcuca

SEQ ID NO: 160479 - RNA, 22 nt, Homo sapiens
acaucccaugccuggguacucc

SEQ ID NO: 160480 - RNA, 22 nt, Homo sapiens
acauugcucuuaccaaguuugu

SEQ ID NO: 160481 - RNA, 22 nt, Homo sapiens
accacagugcuuccugcucacg

SEQ ID NO: 160482 - RNA, 22 nt, Homo sapiens
uguauguaaagacaggauaaca

SEQ ID NO: 160483 - RNA, 22 nt, Homo sapiens
uguaugucugcucuuuggaacu

SEQ ID NO: 160484 - RNA, 20 nt, Homo sapiens
ugucaagaaacauuacuuau

SEQ ID NO: 160485 - RNA, 22 nt, Homo sapiens
ugucaagaugguuugauguugu

SEQ ID NO: 160486 - RNA, 22 nt, Homo sapiens
ugucaauauguaauaacugaau

SEQ ID NO: 160487 - RNA, 22 nt, Homo sapiens
ugucaucuagguuuuaagccuu

SEQ ID NO: 160488 - RNA, 20 nt, Homo sapiens
ugucauuaagcacugugcca

SEQ ID NO: 160489 - RNA, 22 nt, Homo sapiens
uguccuggugaugcccaaauuc

SEQ ID NO: 160490 - RNA, 22 nt, Homo sapiens
ugugaaacauggauagaacugg

SEQ ID NO: 160491 - RNA, 22 nt, Homo sapiens
ugugaacauuuuguauauauua

SEQ ID NO: 160492 - RNA, 23 nt, Homo sapiens
ugugacacuuccgucaguucauu

SEQ ID NO: 160493 - RNA, 22 nt, Homo sapiens
ugugacaguguuacauuucaug

SEQ ID NO: 160494 - RNA, 22 nt, Homo sapiens
ugugagcuauggaguuguagag

SEQ ID NO: 160495 - RNA, 22 nt, Homo sapiens
ugugaguguguacuaguuauca

SEQ ID NO: 160496 - RNA, 18 nt, Homo sapiens
uguugguguucacucacu

SEQ ID NO: 160497 - RNA, 22 nt, Homo sapiens
uguuuuggaguggacuuugcau

SEQ ID NO: 160498 - RNA, 22 nt, Homo sapiens
uuaaaugcucacauaaagguag

SEQ ID NO: 160499 - RNA, 21 nt, Homo sapiens
uuaacagacaagugucuuccc

SEQ ID NO: 160500 - RNA, 22 nt, Homo sapiens
uuaagcaaagguaacaugagaa

SEQ ID NO: 160501 - RNA, 22 nt, Homo sapiens
uuaagcucauuuccauucuaca

SEQ ID NO: 160502 - RNA, 22 nt, Homo sapiens
uuaaggaaggagucuuaaaugg

SEQ ID NO: 160503 - RNA, 22 nt, Homo sapiens
uuaaggcagugcaucuggaguu

SEQ ID NO: 160504 - RNA, 22 nt, Homo sapiens
uuaaggccugaagcucauaaag

SEQ ID NO: 160505 - RNA, 22 nt, Homo sapiens
uuaauacucuucuaaguagucc

SEQ ID NO: 160506 - RNA, 22 nt, Homo sapiens
uuacaagaugucuguccaacac

SEQ ID NO: 160507 - RNA, 22 nt, Homo sapiens
uuacaccuguaauccagcacuu

SEQ ID NO: 160508 - RNA, 22 nt, Homo sapiens
uuacagcagugccccacuccca

SEQ ID NO: 160509 - RNA, 22 nt, Homo sapiens
uuacagucaccugggggacaua

SEQ ID NO: 160510 - RNA, 22 nt, Homo sapiens
uuacauguggugugaagaagag

SEQ ID NO: 160511 - RNA, 22 nt, Homo sapiens
uuaccaguggugcuguaaacuu

SEQ ID NO: 160512 - RNA, 22 nt, Homo sapiens
uuagagcacugaucugcucuuu

SEQ ID NO: 160513 - RNA, 22 nt, Homo sapiens
uuagcagcaucccuggccugua

SEQ ID NO: 160514 - RNA, 22 nt, Homo sapiens
guaaucucagcuacucgggagg

SEQ ID NO: 160515 - RNA, 17 nt, Homo sapiens
guacacuucuucuguga

SEQ ID NO: 160516 - RNA, 22 nt, Homo sapiens
guacauguaugcaugcaugcau

SEQ ID NO: 160517 - RNA, 22 nt, Homo sapiens
guagaaagcauuucagauuugc

SEQ ID NO: 160518 - RNA, 22 nt, Homo sapiens
guaguggcaugaucuuggcuca

SEQ ID NO: 160519 - RNA, 22 nt, Homo sapiens
guauacacccugugauauuauu

SEQ ID NO: 160520 - RNA, 22 nt, Homo sapiens
guauagcacauaauacuugaug

SEQ ID NO: 160521 - RNA, 22 nt, Homo sapiens
guaucaucauguuggccaggcu

SEQ ID NO: 160522 - RNA, 22 nt, Homo sapiens
guaucauugccuaaugcucuca

SEQ ID NO: 160523 - RNA, 22 nt, Homo sapiens
guauggaagucaguuuguuggc

SEQ ID NO: 160524 - RNA, 22 nt, Homo sapiens
guaugugacuggaacaguagga

SEQ ID NO: 160525 - RNA, 22 nt, Homo sapiens
gucacagaaaaagauaugccaa

SEQ ID NO: 160526 - RNA, 22 nt, Homo sapiens
gucagaugcagauuccaguucu

SEQ ID NO: 160527 - RNA, 22 nt, Homo sapiens
gucauggaggaugaauggccaa

SEQ ID NO: 160528 - RNA, 22 nt, Homo sapiens
guccaagacuaggaguuggcag

SEQ ID NO: 160529 - RNA, 18 nt, Homo sapiens
guccauuuguugguacac

SEQ ID NO: 160530 - RNA, 22 nt, Homo sapiens
guccauuuguuuccagagcacu

SEQ ID NO: 160531 - RNA, 22 nt, Homo sapiens
gucuggcuccuucuacuacaug

SEQ ID NO: 160532 - RNA, 22 nt, Homo sapiens
gucuuccagccuccaucuuucu

SEQ ID NO: 160533 - RNA, 22 nt, Homo sapiens
gucuuggagaacucagcuuggc

SEQ ID NO: 160534 - RNA, 22 nt, Homo sapiens
gucuuuugcuagccagagagcu

SEQ ID NO: 160535 - RNA, 22 nt, Homo sapiens
gugaccucuguugcugucacua

SEQ ID NO: 160536 - RNA, 22 nt, Homo sapiens
gugagaaucaaacuacauaaau

SEQ ID NO: 160537 - RNA, 19 nt, Homo sapiens
gugagcaaugcauugcacu

SEQ ID NO: 160538 - RNA, 22 nt, Homo sapiens
ucucagagccuaggguuuuuca

SEQ ID NO: 160539 - RNA, 20 nt, Homo sapiens
ucucauggagggaaagagca

SEQ ID NO: 160540 - RNA, 23 nt, Homo sapiens
ucucauuccuugaaaauaaugac

SEQ ID NO: 160541 - RNA, 22 nt, Homo sapiens
ucucuugguugaacaguuugga

SEQ ID NO: 160542 - RNA, 22 nt, Homo sapiens
ucugacuagacaagcaguguac

SEQ ID NO: 160543 - RNA, 22 nt, Homo sapiens
uugccauggaguagaauugaag

SEQ ID NO: 160544 - RNA, 22 nt, Homo sapiens
uugcuagaugaaaaugguaccu

SEQ ID NO: 160545 - RNA, 22 nt, Homo sapiens
uugcuauguugcccagucugga

SEQ ID NO: 160546 - RNA, 22 nt, Homo sapiens
uugcucaggcuagaguucagcu

SEQ ID NO: 160547 - RNA, 22 nt, Homo sapiens
uugcuccccaggaaaggaagca

SEQ ID NO: 160548 - RNA, 22 nt, Homo sapiens
uugcuuaggcuggagugcagug

SEQ ID NO: 160549 - RNA, 22 nt, Homo sapiens
uuggaagacauucugucugcua

SEQ ID NO: 160550 - RNA, 22 nt, Homo sapiens
uuggaagagaagggagauaaac

SEQ ID NO: 160551 - RNA, 22 nt, Homo sapiens
uuggacugagaguuccaccauu

SEQ ID NO: 160552 - RNA, 22 nt, Homo sapiens
uuggagagaaaggcaguuccug

SEQ ID NO: 160553 - RNA, 22 nt, Homo sapiens
uuggagagugauauucagaugc

SEQ ID NO: 160554 - RNA, 22 nt, Homo sapiens
uuggagugugcucauaacugcu

SEQ ID NO: 160555 - RNA, 22 nt, Homo sapiens
uuggcaaauagguuuuauugca

SEQ ID NO: 160556 - RNA, 22 nt, Homo sapiens
uuggcagugcccgaugcugggg

SEQ ID NO: 160557 - RNA, 22 nt, Homo sapiens
uuggcauuuuuagucaugggaa

SEQ ID NO: 160558 - RNA, 22 nt, Homo sapiens
uuggcccugcugaccauucccu

SEQ ID NO: 160559 - RNA, 22 nt, Homo sapiens
uuggccuuucucuaaauacuuu

SEQ ID NO: 160560 - RNA, 22 nt, Homo sapiens
uuggcucuggcugggcuccagc

SEQ ID NO: 160561 - RNA, 22 nt, Homo sapiens
uuggcuuuuaugcagcuuaggu

SEQ ID NO: 160562 - RNA, 22 nt, Homo sapiens
uugggagugucucuggacugca

SEQ ID NO: 160563 - RNA, 22 nt, Homo sapiens
uugggcuugagggugcccaguc

SEQ ID NO: 160564 - RNA, 20 nt, Homo sapiens
uuguacuccugggcucaagc

SEQ ID NO: 160565 - RNA, 22 nt, Homo sapiens
uugugacacagcugggccuaua

SEQ ID NO: 160566 - RNA, 22 nt, Homo sapiens
uugugcuugauuugccuagcug

SEQ ID NO: 160567 - RNA, 22 nt, Homo sapiens
uugugguaaucugugacagcag

SEQ ID NO: 160568 - RNA, 19 nt, Homo sapiens
uuguguccccacaaaauuc

SEQ ID NO: 160569 - RNA, 22 nt, Homo sapiens
uuuaaguguuuguuccugaaaa

SEQ ID NO: 160570 - RNA, 22 nt, Homo sapiens
uuuaaugcaucccaaaauguag

SEQ ID NO: 160571 - RNA, 22 nt, Homo sapiens
uuuacagucucauagguggaag

SEQ ID NO: 160572 - RNA, 22 nt, Homo sapiens
uuuagcucauucaauuucaguc

SEQ ID NO: 160573 - RNA, 22 nt, Homo sapiens
uuuauugcucuaaaguugccau

SEQ ID NO: 160574 - RNA, 18 nt, Homo sapiens
uuucaagucuuaggugac

SEQ ID NO: 160575 - RNA, 22 nt, Homo sapiens
uuucacagcaauugccuauugu

SEQ ID NO: 160576 - RNA, 21 nt, Homo sapiens
uuucacugugaguuuuucugu

SEQ ID NO: 160577 - RNA, 17 nt, Homo sapiens
uuucagaguggaagugu

SEQ ID NO: 160578 - RNA, 23 nt, Homo sapiens
uuucaggcaggugaaagaccagc

SEQ ID NO: 160579 - RNA, 22 nt, Homo sapiens
ggacaagagacugggacacuga

SEQ ID NO: 160580 - RNA, 22 nt, Homo sapiens
ggagaugaaaugagcuacuuaa

SEQ ID NO: 160581 - RNA, 22 nt, Homo sapiens
ggaguaaaagaguaggaggaau

SEQ ID NO: 160582 - RNA, 22 nt, Homo sapiens
ggcaacaauuccuacuucuuuu

SEQ ID NO: 160583 - RNA, 22 nt, Homo sapiens
ggcaagaggagauucugcuccc

SEQ ID NO: 160584 - RNA, 22 nt, Homo sapiens
ggcaaguugcuauucuuuaaug

SEQ ID NO: 160585 - RNA, 22 nt, Homo sapiens
ggcaaugaggcggaccagcagg

SEQ ID NO: 160586 - RNA, 22 nt, Homo sapiens
ggcacgguggcucacaccugua

SEQ ID NO: 160587 - RNA, 22 nt, Homo sapiens
ggcacgguggcucacgccugua

SEQ ID NO: 160588 - RNA, 22 nt, Homo sapiens
ggcagcaugggugccuuuguga

SEQ ID NO: 160589 - RNA, 17 nt, Homo sapiens
ggcaggauccaggaucc

SEQ ID NO: 160590 - RNA, 22 nt, Homo sapiens
gggaggucauuguaaggucuua

SEQ ID NO: 160591 - RNA, 22 nt, Homo sapiens
gggagguuguauguaugcgggg

SEQ ID NO: 160592 - RNA, 22 nt, Homo sapiens
gggaguagagaguuucucugac

SEQ ID NO: 160593 - RNA, 22 nt, Homo sapiens
gggcaugaugucuuaugccuau

SEQ ID NO: 160594 - RNA, 22 nt, Homo sapiens
gggccagaugcauuuguuauuu

SEQ ID NO: 160595 - RNA, 22 nt, Homo sapiens
ggguaggcaagcggaugucaga

SEQ ID NO: 160596 - RNA, 19 nt, Homo sapiens
ggucccucucaagucauuc

SEQ ID NO: 160597 - RNA, 23 nt, Homo sapiens
ggugaggaguacagagucuucau

SEQ ID NO: 160598 - RNA, 22 nt, Homo sapiens
ggugagguaggaaaaguuagga

SEQ ID NO: 160599 - RNA, 22 nt, Homo sapiens
ggugagguaguaagguacaaua

SEQ ID NO: 160600 - RNA, 19 nt, Homo sapiens
ggugcuugaauauuccucc

SEQ ID NO: 160601 - RNA, 22 nt, Homo sapiens
ggugcuugaggaacggaggcug

SEQ ID NO: 160602 - RNA, 22 nt, Homo sapiens
gguguguaaauuacuuaucucu

SEQ ID NO: 160603 - RNA, 22 nt, Homo sapiens
guaaaguaaagcacaucaaggu

SEQ ID NO: 160604 - RNA, 22 nt, Homo sapiens
guaaauaccaguuucuggaaca

SEQ ID NO: 160605 - RNA, 22 nt, Homo sapiens
guaaaucucuguuuucauggac

SEQ ID NO: 160606 - RNA, 23 nt, Homo sapiens
guaauacuagucauaguagcagg

SEQ ID NO: 160607 - RNA, 22 nt, Homo sapiens
guaaucucagcuacuugggagg

SEQ ID NO: 160608 - RNA, 22 nt, Homo sapiens
guaaucucagcuacuugggagu

SEQ ID NO: 160609 - RNA, 22 nt, Homo sapiens
guacaguaguaaaagugaauga

SEQ ID NO: 160610 - RNA, 22 nt, Homo sapiens
guacaguauaguaauaggauuu

SEQ ID NO: 160611 - RNA, 22 nt, Homo sapiens
guacaguggguguagggaccag

SEQ ID NO: 160612 - RNA, 22 nt, Homo sapiens
guacaguuuagugcuuugagaa

SEQ ID NO: 160613 - RNA, 19 nt, Homo sapiens
gucaaagucgguauucaaa

SEQ ID NO: 160614 - RNA, 22 nt, Homo sapiens
gucacugagcaauagaaaguuu

SEQ ID NO: 160615 - RNA, 22 nt, Homo sapiens
gucagcaaaguucuccugcaga

SEQ ID NO: 160616 - RNA, 22 nt, Homo sapiens
gucagugucuuaacagagauua

SEQ ID NO: 160617 - RNA, 22 nt, Homo sapiens
gucagugucuuugcagcucaga

SEQ ID NO: 160618 - RNA, 22 nt, Homo sapiens
gucagugugauaucugcagggg

SEQ ID NO: 160619 - RNA, 22 nt, Homo sapiens
gucauauaggguuuaccuguau

SEQ ID NO: 160620 - RNA, 22 nt, Homo sapiens
gucaugaaguuuugaaugaaau

SEQ ID NO: 160621 - RNA, 22 nt, Homo sapiens
gucccugaggaacauccagggc

SEQ ID NO: 160622 - RNA, 22 nt, Homo sapiens
gucuaugagucccugaauuuaa

SEQ ID NO: 160623 - RNA, 22 nt, Homo sapiens
gucuggagacuugggucaucaa

SEQ ID NO: 160624 - RNA, 22 nt, Homo sapiens
gucuggcuuaucucacuuacca

SEQ ID NO: 160625 - RNA, 22 nt, Homo sapiens
gucuggguuuguuuguacuugc

SEQ ID NO: 160626 - RNA, 20 nt, Homo sapiens
gucugucuccgaguagaauu

SEQ ID NO: 160627 - RNA, 21 nt, Homo sapiens
gucuuacagccagaugccucu

SEQ ID NO: 160628 - RNA, 17 nt, Homo sapiens
gucuuugguugaguuua

SEQ ID NO: 160629 - RNA, 22 nt, Homo sapiens
gugaaauauuuaacguccaggu

SEQ ID NO: 160630 - RNA, 22 nt, Homo sapiens
gugaaauguguagaggaucugg

SEQ ID NO: 160631 - RNA, 22 nt, Homo sapiens
gugacaguggagacuuacuuca

SEQ ID NO: 160632 - RNA, 22 nt, Homo sapiens
gugaccagaugggcaggggugu

SEQ ID NO: 160633 - RNA, 22 nt, Homo sapiens
gugacgucauuguuccuggcuc

SEQ ID NO: 160634 - RNA, 22 nt, Homo sapiens
gugagaauauuuuaaauacuaa

SEQ ID NO: 160635 - RNA, 22 nt, Homo sapiens
gugagaauugacacccuugucu

SEQ ID NO: 160636 - RNA, 22 nt, Homo sapiens
gugagacugaguuucgcucuug

SEQ ID NO: 160637 - RNA, 22 nt, Homo sapiens
gugagcaguguccuugggggca

SEQ ID NO: 160638 - RNA, 22 nt, Homo sapiens
gugagcuccucuucugcugcag

SEQ ID NO: 160639 - RNA, 22 nt, Homo sapiens
gugaguggacgugaccaauaaa

SEQ ID NO: 160640 - RNA, 22 nt, Homo sapiens
gugcaaguguaauacagcuagg

SEQ ID NO: 160641 - RNA, 18 nt, Homo sapiens
gugcaaugaauagcagag

SEQ ID NO: 160642 - RNA, 22 nt, Homo sapiens
gugcacaaucgugcauuccuug

SEQ ID NO: 160643 - RNA, 21 nt, Homo sapiens
gugcagaugccacagucacuc

SEQ ID NO: 160644 - RNA, 22 nt, Homo sapiens
gugcaugucugugacgacccug

SEQ ID NO: 160645 - RNA, 21 nt, Homo sapiens
guggaaauggaauuuacuaau

SEQ ID NO: 160646 - RNA, 22 nt, Homo sapiens
guggaucacuugaggucaagag

SEQ ID NO: 160647 - RNA, 22 nt, Homo sapiens
guggcagugugaggauccugcu

SEQ ID NO: 160648 - RNA, 22 nt, Homo sapiens
guggcaguuuuaaauaugaaaa

SEQ ID NO: 160649 - RNA, 22 nt, Homo sapiens
guggcaugaaagcaucugugau

SEQ ID NO: 160650 - RNA, 22 nt, Homo sapiens
gugggaagcuggaacucccucc

SEQ ID NO: 160651 - RNA, 22 nt, Homo sapiens
gugggaugcaaguaaaauuguc

SEQ ID NO: 160652 - RNA, 20 nt, Homo sapiens
gugggcaaauccuuuccucu

SEQ ID NO: 160653 - RNA, 22 nt, Homo sapiens
gugguuuuaucccagaaauuaa

SEQ ID NO: 160654 - RNA, 22 nt, Homo sapiens
gugugacuagucaugccugaau

SEQ ID NO: 160655 - RNA, 22 nt, Homo sapiens
gugugguaggauugguuacuca

SEQ ID NO: 160656 - RNA, 22 nt, Homo sapiens
guuaugcagcaauugauaaucu

SEQ ID NO: 160657 - RNA, 22 nt, Homo sapiens
guuauuguccauuuauuuagca

SEQ ID NO: 160658 - RNA, 22 nt, Homo sapiens
guucagguauucuggaacagag

SEQ ID NO: 160659 - RNA, 20 nt, Homo sapiens
guucauguaauuaguucagg

SEQ ID NO: 160660 - RNA, 22 nt, Homo sapiens
guugcucaggcuggagugcagu

SEQ ID NO: 160661 - RNA, 22 nt, Homo sapiens
guuuguaacucuagugacuaga

SEQ ID NO: 160662 - RNA, 22 nt, Homo sapiens
uaaacugucuugcaguuacaug

SEQ ID NO: 160663 - RNA, 17 nt, Homo sapiens
uaaagccagucaaguca

SEQ ID NO: 160664 - RNA, 22 nt, Homo sapiens
uaaagcuuagauccaugguggc

SEQ ID NO: 160665 - RNA, 22 nt, Homo sapiens
uaaaugcucuuuaaaagugcuu

SEQ ID NO: 160666 - RNA, 22 nt, Homo sapiens
uaaauggauaaaugaauaccua

SEQ ID NO: 160667 - RNA, 22 nt, Homo sapiens
uaacaccuugcucugucaauaa

SEQ ID NO: 160668 - RNA, 22 nt, Homo sapiens
uaacauugucuugcuuaguuuu

SEQ ID NO: 160669 - RNA, 22 nt, Homo sapiens
uaacugucucccuugguccuga

SEQ ID NO: 160670 - RNA, 22 nt, Homo sapiens
cucagugucuggggccccaggg

SEQ ID NO: 160671 - RNA, 22 nt, Homo sapiens
cucaguguuucagcugcucaga

SEQ ID NO: 160672 - RNA, 22 nt, Homo sapiens
cuccauuuaguccuuuuagaag

SEQ ID NO: 160673 - RNA, 17 nt, Homo sapiens
cucucugguuuaaagca

SEQ ID NO: 160674 - RNA, 22 nt, Homo sapiens
cucugagguuauucguaauauu

SEQ ID NO: 160675 - RNA, 22 nt, Homo sapiens
cucugauggagauauacaagga

SEQ ID NO: 160676 - RNA, 22 nt, Homo sapiens
cugaaauggaaugugugcacag

SEQ ID NO: 160677 - RNA, 22 nt, Homo sapiens
cugaagugcuugccacauaaaa

SEQ ID NO: 160678 - RNA, 22 nt, Homo sapiens
cugacaugcagccacugcaccu

SEQ ID NO: 160679 - RNA, 22 nt, Homo sapiens
cugagaucaagucuugcucugu

SEQ ID NO: 160680 - RNA, 22 nt, Homo sapiens
cugagaucguggggcugcuguc

SEQ ID NO: 160681 - RNA, 22 nt, Homo sapiens
cugagcacugagauccucuagc

SEQ ID NO: 160682 - RNA, 22 nt, Homo sapiens
cugagcucauuucuuuugcuac

SEQ ID NO: 160683 - RNA, 22 nt, Homo sapiens
cugaggugauauauacauauuu

SEQ ID NO: 160684 - RNA, 22 nt, Homo sapiens
cugaggugggaggauuacuuga

SEQ ID NO: 160685 - RNA, 22 nt, Homo sapiens
cugagguuguucuucucagugg

SEQ ID NO: 160686 - RNA, 19 nt, Homo sapiens
cugcaugagacaguugguu

SEQ ID NO: 160687 - RNA, 22 nt, Homo sapiens
cugcuguuguuaacuuuuggag

SEQ ID NO: 160688 - RNA, 22 nt, Homo sapiens
cuggaaacaucuuaggaaugca

SEQ ID NO: 160689 - RNA, 22 nt, Homo sapiens
cuggaauauuagcuggucuuaa

SEQ ID NO: 160690 - RNA, 22 nt, Homo sapiens
cuggaauucaaaaucugaauuu

SEQ ID NO: 160691 - RNA, 22 nt, Homo sapiens
cuggaguaugauguuagcguug

SEQ ID NO: 160692 - RNA, 22 nt, Homo sapiens
cuggcucugagguguuuagggc

SEQ ID NO: 160693 - RNA, 22 nt, Homo sapiens
cugggaugugacuguugccccc

SEQ ID NO: 160694 - RNA, 22 nt, Homo sapiens
cugugaagaaagucauugguag

SEQ ID NO: 160695 - RNA, 22 nt, Homo sapiens
cugugaucuuuuuucauguggu

SEQ ID NO: 160696 - RNA, 23 nt, Homo sapiens
cuguggugaggcccuagaaucug

SEQ ID NO: 160697 - RNA, 22 nt, Homo sapiens
cuuagcaaugucguguacucac

SEQ ID NO: 160698 - RNA, 22 nt, Homo sapiens
cuucaaaguuggcuaggagaca

SEQ ID NO: 160699 - RNA, 22 nt, Homo sapiens
cuucagcaauauauccccuggg

SEQ ID NO: 160700 - RNA, 22 nt, Homo sapiens
cuuccauaguauuuuuacaaaa

SEQ ID NO: 160701 - RNA, 22 nt, Homo sapiens
cuugccuuugucuucaaaggcu

SEQ ID NO: 160702 - RNA, 22 nt, Homo sapiens
cuuggacaccucaugcccaccu

SEQ ID NO: 160703 - RNA, 22 nt, Homo sapiens
cuuggcuagucaaaccuccccg

SEQ ID NO: 160704 - RNA, 22 nt, Homo sapiens
cuugucacuguuggcuuuagaa

SEQ ID NO: 160705 - RNA, 22 nt, Homo sapiens
cuuugguuaauaggauauggca

SEQ ID NO: 160706 - RNA, 19 nt, Homo sapiens
cuuugguugagcguguugg

SEQ ID NO: 160707 - RNA, 22 nt, Homo sapiens
cuuuuacacugcuggugggaau

SEQ ID NO: 160708 - RNA, 22 nt, Homo sapiens
cuuuuggucuaucagagaagca

SEQ ID NO: 160709 - RNA, 22 nt, Homo sapiens
cuuuuggugugaagaagcucuu

SEQ ID NO: 160710 - RNA, 22 nt, Homo sapiens
gaaaguaauuaacgauuguugc

SEQ ID NO: 160711 - RNA, 22 nt, Homo sapiens
gaaaugcucauuuuggauccuu

SEQ ID NO: 160712 - RNA, 22 nt, Homo sapiens
gaaauguauuaaugaguugaaa

SEQ ID NO: 160713 - RNA, 22 nt, Homo sapiens
gaaggugcuuggugaaugcauu

SEQ ID NO: 160714 - RNA, 22 nt, Homo sapiens
gacagagcaagacccuauuuaa

SEQ ID NO: 160715 - RNA, 22 nt, Homo sapiens
gacagugagaugucaugugaaa

SEQ ID NO: 160716 - RNA, 22 nt, Homo sapiens
gacaguguggcgauuccucaag

SEQ ID NO: 160717 - RNA, 20 nt, Homo sapiens
gacauaggcugguaucuggc

SEQ ID NO: 160718 - RNA, 20 nt, Homo sapiens
gacaugacuaggagauagcc

SEQ ID NO: 160719 - RNA, 20 nt, Homo sapiens
gacauguugguuugcugcac

SEQ ID NO: 160720 - RNA, 22 nt, Homo sapiens
gacauguuucucucuguuuacu

SEQ ID NO: 160721 - RNA, 22 nt, Homo sapiens
gacauguuuuuuaagguuuaug

SEQ ID NO: 160722 - RNA, 22 nt, Homo sapiens
gaccacauuccacacaggcuuu

SEQ ID NO: 160723 - RNA, 22 nt, Homo sapiens
gacccucuagagggaagcgcuu

SEQ ID NO: 160724 - RNA, 22 nt, Homo sapiens
gacuggcuguuuucuuuauuau

SEQ ID NO: 160725 - RNA, 22 nt, Homo sapiens
gacuugaagaaucuaagggagg

SEQ ID NO: 160726 - RNA, 22 nt, Homo sapiens
gagaacugacauuaucguguau

SEQ ID NO: 160727 - RNA, 22 nt, Homo sapiens
gagaacugagugugcuggcgga

SEQ ID NO: 160728 - RNA, 22 nt, Homo sapiens
gagauggugugcuguuggaagu

SEQ ID NO: 160729 - RNA, 22 nt, Homo sapiens
gagauuauuagauguucugcuu

SEQ ID NO: 160730 - RNA, 22 nt, Homo sapiens
gagcaccagucccugucagugc

SEQ ID NO: 160731 - RNA, 22 nt, Homo sapiens
gagcucaccuuaccucuggagc

SEQ ID NO: 160732 - RNA, 22 nt, Homo sapiens
gaggcaagaguaguuaaguuag

SEQ ID NO: 160733 - RNA, 22 nt, Homo sapiens
gaggcaauaugagggaggcuuc

SEQ ID NO: 160734 - RNA, 22 nt, Homo sapiens
gaggcagucugucccuuagcag

SEQ ID NO: 160735 - RNA, 22 nt, Homo sapiens
gagguauggauaucuggagagg

SEQ ID NO: 160736 - RNA, 22 nt, Homo sapiens
gagugcaauggcaccgucucgg

SEQ ID NO: 160737 - RNA, 22 nt, Homo sapiens
gagugcaauggcaugaucuggg

SEQ ID NO: 160738 - RNA, 22 nt, Homo sapiens
gagugcaauggcgcgaucuggg

SEQ ID NO: 160739 - RNA, 22 nt, Homo sapiens
gagugcaauggugccaucucgg

SEQ ID NO: 160740 - RNA, 22 nt, Homo sapiens
gaguucaauuuccagcuguucu

SEQ ID NO: 160741 - RNA, 22 nt, Homo sapiens
gauauguaaaaauuauaucuga

SEQ ID NO: 160742 - RNA, 22 nt, Homo sapiens
gaugagaugagcauuugaauug

SEQ ID NO: 160743 - RNA, 22 nt, Homo sapiens
gaugcaguaagaaugcauagcg

SEQ ID NO: 160744 - RNA, 22 nt, Homo sapiens
gauggcucugcaggugagggua

SEQ ID NO: 160745 - RNA, 22 nt, Homo sapiens
gauuagagaaauacugcugcua

SEQ ID NO: 160746 - RNA, 20 nt, Homo sapiens
gauuagagagaggcugugca

SEQ ID NO: 160747 - RNA, 22 nt, Homo sapiens
gcacaguggcucccgucuauaa

SEQ ID NO: 160748 - RNA, 17 nt, Homo sapiens
gcacuggcguaucccac

SEQ ID NO: 160749 - RNA, 22 nt, Homo sapiens
gcaggaaucuugagaaggauuc

SEQ ID NO: 160750 - RNA, 22 nt, Homo sapiens
gcaguagugcgaucucagcuca

SEQ ID NO: 160751 - RNA, 22 nt, Homo sapiens
gcagucaucugaaggcuuaacu

SEQ ID NO: 160752 - RNA, 22 nt, Homo sapiens
gcagugugaucacagcuuacug

SEQ ID NO: 160753 - RNA, 22 nt, Homo sapiens
gcagugugauguuuuaaucuau

SEQ ID NO: 160754 - RNA, 22 nt, Homo sapiens
gcaguguggguagagggcaaga

SEQ ID NO: 160755 - RNA, 22 nt, Homo sapiens
gcaugcacaugugaaaaaauga

SEQ ID NO: 160756 - RNA, 22 nt, Homo sapiens
uacaugcaugggcaugugugca

SEQ ID NO: 160757 - RNA, 22 nt, Homo sapiens
uacauguauguguuuauggcug

SEQ ID NO: 160758 - RNA, 22 nt, Homo sapiens
uaccagcauuucucuuuaagua

SEQ ID NO: 160759 - RNA, 22 nt, Homo sapiens
uaccaguaaugggucaaaggca

SEQ ID NO: 160760 - RNA, 22 nt, Homo sapiens
uacccuuuaguauaaaaucaga

SEQ ID NO: 160761 - RNA, 22 nt, Homo sapiens
uaccuguagacuacagcuucag

SEQ ID NO: 160762 - RNA, 22 nt, Homo sapiens
uacguuaucagguaugcaagag

SEQ ID NO: 160763 - RNA, 22 nt, Homo sapiens
uacucugcagagaugcauaaca

SEQ ID NO: 160764 - RNA, 22 nt, Homo sapiens
uacucugcaguaauuccagccc

SEQ ID NO: 160765 - RNA, 22 nt, Homo sapiens
uacugaccugucauucagaguu

SEQ ID NO: 160766 - RNA, 22 nt, Homo sapiens
uacugcacuccagccuggguga

SEQ ID NO: 160767 - RNA, 22 nt, Homo sapiens
uacugcacucuagccuggguga

SEQ ID NO: 160768 - RNA, 22 nt, Homo sapiens
uacugcacuggaggccucagau

SEQ ID NO: 160769 - RNA, 21 nt, Homo sapiens
uacuggagauacagucugcaa

SEQ ID NO: 160770 - RNA, 22 nt, Homo sapiens
uagauaguaaagccauuagcuu

SEQ ID NO: 160771 - RNA, 21 nt, Homo sapiens
uagcaaauugcuauuaaggca

SEQ ID NO: 160772 - RNA, 20 nt, Homo sapiens
uagcacacauguagaauagu

SEQ ID NO: 160773 - RNA, 23 nt, Homo sapiens
uagcacuuuuuacauauggacau

SEQ ID NO: 160774 - RNA, 18 nt, Homo sapiens
uagcagacaucauugggg

SEQ ID NO: 160775 - RNA, 19 nt, Homo sapiens
uagcagcaugauuuauaau

SEQ ID NO: 160776 - RNA, 22 nt, Homo sapiens
uagcugaucuuuuaaagaauga

SEQ ID NO: 160777 - RNA, 22 nt, Homo sapiens
uagcugguucuccaggagcuag

SEQ ID NO: 160778 - RNA, 22 nt, Homo sapiens
uaguaucacauggucuuaauua

SEQ ID NO: 160779 - RNA, 22 nt, Homo sapiens
uagugguaguagcaguaauauu

SEQ ID NO: 160780 - RNA, 22 nt, Homo sapiens
uaguguuuuucauuggcagagg

SEQ ID NO: 160781 - RNA, 22 nt, Homo sapiens
uauaaccauuucuucucucuuc

SEQ ID NO: 160782 - RNA, 22 nt, Homo sapiens
uauaaugcacauucccaaaucu

SEQ ID NO: 160783 - RNA, 22 nt, Homo sapiens
uauacaugugccauguuggugu

SEQ ID NO: 160784 - RNA, 22 nt, Homo sapiens
uauacaugugggcaucaggaga

SEQ ID NO: 160785 - RNA, 20 nt, Homo sapiens
uauagcaauuuuuuucuccu

SEQ ID NO: 160786 - RNA, 22 nt, Homo sapiens
uauagcacugaccuuccaggac

SEQ ID NO: 160787 - RNA, 22 nt, Homo sapiens
uauaucuguccauggcccugcu

SEQ ID NO: 160788 - RNA, 21 nt, Homo sapiens
uauaugacuuacuauugccuc

SEQ ID NO: 160789 - RNA, 22 nt, Homo sapiens
uauaugauugguagacccugca

SEQ ID NO: 160790 - RNA, 22 nt, Homo sapiens
uaucauagacaaucaguuauug

SEQ ID NO: 160791 - RNA, 21 nt, Homo sapiens
uaucauggugaaacccugucu

SEQ ID NO: 160792 - RNA, 20 nt, Homo sapiens
uaucuacuugcaaaugccau

SEQ ID NO: 160793 - RNA, 20 nt, Homo sapiens
uaugacaaagccuagugagu

SEQ ID NO: 160794 - RNA, 22 nt, Homo sapiens
uaugcuuauugucucauccacu

SEQ ID NO: 160795 - RNA, 22 nt, Homo sapiens
uauggaaaucuuaccuuauggu

SEQ ID NO: 160796 - RNA, 22 nt, Homo sapiens
uaugucaugggguuuuugagau

SEQ ID NO: 160797 - RNA, 22 nt, Homo sapiens
uauuauagugauaggucuacug

SEQ ID NO: 160798 - RNA, 22 nt, Homo sapiens
uauugcuuaugaugcugaauua

SEQ ID NO: 160799 - RNA, 22 nt, Homo sapiens
uauuucaguugugcagguaguu

SEQ ID NO: 160800 - RNA, 22 nt, Homo sapiens
uauuugauugacuuuagcagga

SEQ ID NO: 160801 - RNA, 22 nt, Homo sapiens
ucaaauuccaagucuagguagg

SEQ ID NO: 160802 - RNA, 20 nt, Homo sapiens
ucaaauucuuggccuccagc

SEQ ID NO: 160803 - RNA, 22 nt, Homo sapiens
ucaacagugggcacuguaaaug

SEQ ID NO: 160804 - RNA, 22 nt, Homo sapiens
ucaaggcaguggccuuccuucu

SEQ ID NO: 160805 - RNA, 22 nt, Homo sapiens
ucaaguaagaagugggcauaaa

SEQ ID NO: 160806 - RNA, 22 nt, Homo sapiens
ucacaaguguauagacaugucc

SEQ ID NO: 160807 - RNA, 23 nt, Homo sapiens
ucacacuuaagagaaaugcagcu

SEQ ID NO: 160808 - RNA, 22 nt, Homo sapiens
ucacagugaguggaguggggug

SEQ ID NO: 160809 - RNA, 22 nt, Homo sapiens
ucacaguguuaaaccuuucuuu

SEQ ID NO: 160810 - RNA, 22 nt, Homo sapiens
ucacauuguuauguaaauguuu

SEQ ID NO: 160811 - RNA, 22 nt, Homo sapiens
ucaccaccugcugauuguagag

SEQ ID NO: 160812 - RNA, 22 nt, Homo sapiens
ucaccaccuuccaggaccacug

SEQ ID NO: 160813 - RNA, 22 nt, Homo sapiens
ucacugagcacaggagaugugc

SEQ ID NO: 160814 - RNA, 20 nt, Homo sapiens
ucacugagugguccacagua

SEQ ID NO: 160815 - RNA, 22 nt, Homo sapiens
ucacugcacuagguaaugccac

SEQ ID NO: 160816 - RNA, 22 nt, Homo sapiens
ucacugcacuucaggcuuucuc

SEQ ID NO: 160817 - RNA, 22 nt, Homo sapiens
ucacugugguuggaaggcuuaa

SEQ ID NO: 160818 - RNA, 22 nt, Homo sapiens
ucagguaaucuauuugucuuuu

SEQ ID NO: 160819 - RNA, 23 nt, Homo sapiens
ucagguaggccuagaguauucuu

SEQ ID NO: 160820 - RNA, 22 nt, Homo sapiens
ucagguagugccaugauugauu

SEQ ID NO: 160821 - RNA, 20 nt, Homo sapiens
ucagugauugguuuaguuau

SEQ ID NO: 160822 - RNA, 20 nt, Homo sapiens
ucagugcagauuguccaagu

SEQ ID NO: 160823 - RNA, 22 nt, Homo sapiens
ucagugcaggaauuuccuuaga

SEQ ID NO: 160824 - RNA, 22 nt, Homo sapiens
ucaguguugauggcugcugacu

SEQ ID NO: 160825 - RNA, 18 nt, Homo sapiens
ucauagaucaugacagug

SEQ ID NO: 160826 - RNA, 22 nt, Homo sapiens
ucauaucauuagaucuacugua

SEQ ID NO: 160827 - RNA, 21 nt, Homo sapiens
ucauauguaucuuugugccuc

SEQ ID NO: 160828 - RNA, 21 nt, Homo sapiens
ucaucaagcuguagacaugau

SEQ ID NO: 160829 - RNA, 21 nt, Homo sapiens
ucaucagucaaagacaauggu

SEQ ID NO: 160830 - RNA, 22 nt, Homo sapiens
ucaugcaaugagucaggaggca

SEQ ID NO: 160831 - RNA, 22 nt, Homo sapiens
ucauuagagacagggugucacu

SEQ ID NO: 160832 - RNA, 22 nt, Homo sapiens
uccacaguaaggacccugccuu

SEQ ID NO: 160833 - RNA, 22 nt, Homo sapiens
uccacagugguggaauuguuca

SEQ ID NO: 160834 - RNA, 19 nt, Homo sapiens
uccacagugguugaacuag

SEQ ID NO: 160835 - RNA, 22 nt, Homo sapiens
uccaguuuuguuaacauauggu

SEQ ID NO: 160836 - RNA, 18 nt, Homo sapiens
uccauuuguaugggaugg

SEQ ID NO: 160837 - RNA, 22 nt, Homo sapiens
ucccaguggucuugaaacaggg

SEQ ID NO: 160838 - RNA, 22 nt, Homo sapiens
uccccuuuguaagauggaaacg

SEQ ID NO: 160839 - RNA, 22 nt, Homo sapiens
ucccuacugggguacugccuag

SEQ ID NO: 160840 - RNA, 20 nt, Homo sapiens
ucccucaaacuuuuccacug

SEQ ID NO: 160841 - RNA, 22 nt, Homo sapiens
ucccugacagucacagagcuac

SEQ ID NO: 160842 - RNA, 22 nt, Homo sapiens
ucccugagguccuggauuauug

SEQ ID NO: 160843 - RNA, 22 nt, Homo sapiens
ucccugaguaucuaauguguuu

SEQ ID NO: 160844 - RNA, 22 nt, Homo sapiens
ucccuguuaggcacagauuuau

SEQ ID NO: 160845 - RNA, 22 nt, Homo sapiens
uccugcauucugaaauacaagu

SEQ ID NO: 160846 - RNA, 22 nt, Homo sapiens
uccuugguugauccugugcaga

SEQ ID NO: 160847 - RNA, 22 nt, Homo sapiens
uccuuuaguuaauaaagacaag

SEQ ID NO: 160848 - RNA, 22 nt, Homo sapiens
ucgcgccauucuccugccucag

SEQ ID NO: 160849 - RNA, 22 nt, Homo sapiens
ucuaaaguacuacuacuguugg

SEQ ID NO: 160850 - RNA, 22 nt, Homo sapiens
ucuaugguuuauuuccaagugu

SEQ ID NO: 160851 - RNA, 22 nt, Homo sapiens
cccaguuuugccacuuacuagc

SEQ ID NO: 160852 - RNA, 22 nt, Homo sapiens
cccuagaucucagcgccuucau

SEQ ID NO: 160853 - RNA, 21 nt, Homo sapiens
cccugguguuuggaguuugag

SEQ ID NO: 160854 - RNA, 22 nt, Homo sapiens
cccuucauucaaggguugugag

SEQ ID NO: 160855 - RNA, 22 nt, Homo sapiens
ccucccuuuguugcaagggaaa

SEQ ID NO: 160856 - RNA, 21 nt, Homo sapiens
ccugaagaagugaccucugag

SEQ ID NO: 160857 - RNA, 22 nt, Homo sapiens
cuaaagugcugagauuauaggu

SEQ ID NO: 160858 - RNA, 22 nt, Homo sapiens
cuaagggaggaagcugugcagg

SEQ ID NO: 160859 - RNA, 22 nt, Homo sapiens
cuagcacauaguuauucacuca

SEQ ID NO: 160860 - RNA, 22 nt, Homo sapiens
cuagcacauuuaucuuuauaca

SEQ ID NO: 160861 - RNA, 22 nt, Homo sapiens
cuauggcucugguuauggcugu

SEQ ID NO: 160862 - RNA, 22 nt, Homo sapiens
cuaugguuucuccauaucauca

SEQ ID NO: 160863 - RNA, 18 nt, Homo sapiens
cucacacccuaaucagga

SEQ ID NO: 160864 - RNA, 22 nt, Homo sapiens
cucacaguucuaaaggcaagaa

SEQ ID NO: 160865 - RNA, 22 nt, Homo sapiens
cucacugcauuucaguuuuguu

SEQ ID NO: 160866 - RNA, 22 nt, Homo sapiens
cucagcuacuugggaagcugag

SEQ ID NO: 160867 - RNA, 20 nt, Homo sapiens
cucagguauuugaggcugca

SEQ ID NO: 160868 - RNA, 22 nt, Homo sapiens
acugcacuccuccuugggugac

SEQ ID NO: 160869 - RNA, 22 nt, Homo sapiens
acugcacucuagcauggguaau

SEQ ID NO: 160870 - RNA, 22 nt, Homo sapiens
acugcacugucaaccuccuggg

SEQ ID NO: 160871 - RNA, 20 nt, Homo sapiens
acugcacuucagccugcugg

SEQ ID NO: 160872 - RNA, 22 nt, Homo sapiens
acugcacuucagccuuggcuac

SEQ ID NO: 160873 - RNA, 22 nt, Homo sapiens
acuuugguuaucauacuuucag

SEQ ID NO: 160874 - RNA, 20 nt, Homo sapiens
agacagcugcagcccacauc

SEQ ID NO: 160875 - RNA, 22 nt, Homo sapiens
agagagcuugggguguuaaauu

SEQ ID NO: 160876 - RNA, 22 nt, Homo sapiens
agagcuguguuuuaacuuuuua

SEQ ID NO: 160877 - RNA, 22 nt, Homo sapiens
agauauuuguuaggucugucag

SEQ ID NO: 160878 - RNA, 22 nt, Homo sapiens
agaucacagucuuugguuuuag

SEQ ID NO: 160879 - RNA, 22 nt, Homo sapiens
agaugauguuuacugagcauca

SEQ ID NO: 160880 - RNA, 23 nt, Homo sapiens
agaugcauucuuguaggauauau

SEQ ID NO: 160881 - RNA, 18 nt, Homo sapiens
agaugguguugcuucugu

SEQ ID NO: 160882 - RNA, 22 nt, Homo sapiens
agcaacauuuuugaccuuucuu

SEQ ID NO: 160883 - RNA, 22 nt, Homo sapiens
agcagcauggguauaaaucucc

SEQ ID NO: 160884 - RNA, 22 nt, Homo sapiens
agcagcuuugaucugaaugauu

SEQ ID NO: 160885 - RNA, 16 nt, Homo sapiens
agcagguguuagguga

SEQ ID NO: 160886 - RNA, 22 nt, Homo sapiens
agcauggucacuuugggcccca

SEQ ID NO: 160887 - RNA, 22 nt, Homo sapiens
agccaguauuuccacagagugg

SEQ ID NO: 160888 - RNA, 19 nt, Homo sapiens
agccaguuuucccagcacc

SEQ ID NO: 160889 - RNA, 21 nt, Homo sapiens
agcuaaauuggaaauuucugu

SEQ ID NO: 160890 - RNA, 23 nt, Homo sapiens
agcuagagaggcuggggauacag

SEQ ID NO: 160891 - RNA, 22 nt, Homo sapiens
agcugauggucuuguaugaugu

SEQ ID NO: 160892 - RNA, 20 nt, Homo sapiens
agcuggguguguuggugcau

SEQ ID NO: 160893 - RNA, 22 nt, Homo sapiens
agcuguaguuugguggauguaa

SEQ ID NO: 160894 - RNA, 19 nt, Homo sapiens
agcuguguugccugugaga

SEQ ID NO: 160895 - RNA, 20 nt, Homo sapiens
agcuguuguuaaaaaggagg

SEQ ID NO: 160896 - RNA, 20 nt, Homo sapiens
agcuguuguuaugagguuua

SEQ ID NO: 160897 - RNA, 22 nt, Homo sapiens
agcuugugcuguaugaagggcc

SEQ ID NO: 160898 - RNA, 21 nt, Homo sapiens
aggagcauuguugugguggag

SEQ ID NO: 160899 - RNA, 22 nt, Homo sapiens
aggagguugguaccaucuguuu

SEQ ID NO: 160900 - RNA, 16 nt, Homo sapiens
aggcaagaauugaggu

SEQ ID NO: 160901 - RNA, 21 nt, Homo sapiens
aggcaagauuacuuacgagca

SEQ ID NO: 160902 - RNA, 22 nt, Homo sapiens
aggcaagugggagacagcauuu

SEQ ID NO: 160903 - RNA, 22 nt, Homo sapiens
aggcaaguugcucaaaugcaaa

SEQ ID NO: 160904 - RNA, 22 nt, Homo sapiens
aggcaugaaauacaugcauuga

SEQ ID NO: 160905 - RNA, 22 nt, Homo sapiens
aggcaugaguucagaggguaug

SEQ ID NO: 160906 - RNA, 21 nt, Homo sapiens
aggcuguuguuuugggaugga

SEQ ID NO: 160907 - RNA, 22 nt, Homo sapiens
agggagcaaaguggucuuucuc

SEQ ID NO: 160908 - RNA, 22 nt, Homo sapiens
agggcuuaucuguguagaguuc

SEQ ID NO: 160909 - RNA, 22 nt, Homo sapiens
agggcuuuugagcugagauggu

SEQ ID NO: 160910 - RNA, 20 nt, Homo sapiens
agguagauagaugauagaua

SEQ ID NO: 160911 - RNA, 22 nt, Homo sapiens
agguauguaugucuguacagcg

SEQ ID NO: 160912 - RNA, 22 nt, Homo sapiens
agguuguugcaugcuccuuagg

SEQ ID NO: 160913 - RNA, 22 nt, Homo sapiens
aguaaagcaucagcuagaugug

SEQ ID NO: 160914 - RNA, 22 nt, Homo sapiens
aguaagucucaagguaggguag

SEQ ID NO: 160915 - RNA, 22 nt, Homo sapiens
aguccagguuuuguaauggcaa

SEQ ID NO: 160916 - RNA, 22 nt, Homo sapiens
agugagcuggagaaaagaaacu

SEQ ID NO: 160917 - RNA, 22 nt, Homo sapiens
aguggauguuguggccugggag

SEQ ID NO: 160918 - RNA, 19 nt, Homo sapiens
aguggguguuuucuguuug

SEQ ID NO: 160919 - RNA, 18 nt, Homo sapiens
auaaacucaucauuuuua

SEQ ID NO: 160920 - RNA, 22 nt, Homo sapiens
auaaaugccuguuguuuuaagc

SEQ ID NO: 160921 - RNA, 19 nt, Homo sapiens
auaauuagcagugaggaca

SEQ ID NO: 160922 - RNA, 16 nt, Homo sapiens
auaccacagugacaca

SEQ ID NO: 160923 - RNA, 22 nt, Homo sapiens
auacugguuuuugucaugugga

SEQ ID NO: 160924 - RNA, 22 nt, Homo sapiens
auagaucauugucauuuuagau

SEQ ID NO: 160925 - RNA, 22 nt, Homo sapiens
auagcaauuugggaaucagacu

SEQ ID NO: 160926 - RNA, 22 nt, Homo sapiens
auagcacaguguguguacacca

SEQ ID NO: 160927 - RNA, 22 nt, Homo sapiens
auagcagcagcuaguagugaua

SEQ ID NO: 160928 - RNA, 22 nt, Homo sapiens
auagcagugugaaaauguacua

SEQ ID NO: 160929 - RNA, 22 nt, Homo sapiens
auagguagcauagcaggaauau

SEQ ID NO: 160930 - RNA, 22 nt, Homo sapiens
auagguauuuuuaaaugacugu

SEQ ID NO: 160931 - RNA, 22 nt, Homo sapiens
auaucacagguguuuaccugau

SEQ ID NO: 160932 - RNA, 17 nt, Homo sapiens
auaugaauuuuggagau

SEQ ID NO: 160933 - RNA, 20 nt, Homo sapiens
auaugcauguguuuucacuu

SEQ ID NO: 160934 - RNA, 22 nt, Homo sapiens
auaugguuuuuggaagcauauc

SEQ ID NO: 160935 - RNA, 22 nt, Homo sapiens
auaugugacuucaugcaaggcu

SEQ ID NO: 160936 - RNA, 22 nt, Homo sapiens
aucaaguacuguacugaaagug

SEQ ID NO: 160937 - RNA, 22 nt, Homo sapiens
aucacagagucacgggcaacuu

SEQ ID NO: 160938 - RNA, 22 nt, Homo sapiens
aucacauggccagguaguaauc

SEQ ID NO: 160939 - RNA, 22 nt, Homo sapiens
aucacuuucuauuucugugcca

SEQ ID NO: 160940 - RNA, 22 nt, Homo sapiens
aucagauguuuguauaggagua

SEQ ID NO: 160941 - RNA, 22 nt, Homo sapiens
aucagcagcaugaaaagcaacu

SEQ ID NO: 160942 - RNA, 22 nt, Homo sapiens
aucauggaguauuugcaagucu

SEQ ID NO: 160943 - RNA, 22 nt, Homo sapiens
auccacauucauggaccagucc

SEQ ID NO: 160944 - RNA, 23 nt, Homo sapiens
auccacauucuaguccuuuaugc

SEQ ID NO: 160945 - RNA, 22 nt, Homo sapiens
auccaucagacggcaggcguug

SEQ ID NO: 160946 - RNA, 22 nt, Homo sapiens
aucccaguaaaaauggcuucua

SEQ ID NO: 160947 - RNA, 22 nt, Homo sapiens
aucccugugacgagcaucccua

SEQ ID NO: 160948 - RNA, 20 nt, Homo sapiens
acugcacuccaaccuuugug

SEQ ID NO: 160949 - RNA, 22 nt, Homo sapiens
acugcacuccaccuugggcaac

SEQ ID NO: 160950 - RNA, 22 nt, Homo sapiens
acugcacuccagacucugucuc

SEQ ID NO: 160951 - RNA, 22 nt, Homo sapiens
acugcacuccagccucaugaca

SEQ ID NO: 160952 - RNA, 22 nt, Homo sapiens
acugcacuccagccucggugac

SEQ ID NO: 160953 - RNA, 22 nt, Homo sapiens
acugcacuccagccugcccaac

SEQ ID NO: 160954 - RNA, 22 nt, Homo sapiens
acugcacuccagccuggacgaa

SEQ ID NO: 160955 - RNA, 22 nt, Homo sapiens
acugcacuccagccuggacgac

SEQ ID NO: 160956 - RNA, 22 nt, Homo sapiens
acugcacuccagccuucggaca

SEQ ID NO: 160957 - RNA, 22 nt, Homo sapiens
acugcacuccagccuugagagc

SEQ ID NO: 160958 - RNA, 22 nt, Homo sapiens
acugcacuccagccuugauggc

SEQ ID NO: 160959 - RNA, 22 nt, Homo sapiens
acugcacuccagccuugcgaca

SEQ ID NO: 160960 - RNA, 22 nt, Homo sapiens
acugcacuccagccuuggccac

SEQ ID NO: 160961 - RNA, 22 nt, Homo sapiens
acugcacuccagccuuugcgau

SEQ ID NO: 160962 - RNA, 22 nt, Homo sapiens
acugcacuccagcuugggugac

SEQ ID NO: 160963 - RNA, 20 nt, Homo sapiens
acugcacuccaggcugccca

SEQ ID NO: 160964 - RNA, 22 nt, Homo sapiens
acugcacucccgcccgggugac

SEQ ID NO: 160965 - RNA, 22 nt, Homo sapiens
acugcacucuagccccugcgac

SEQ ID NO: 160966 - RNA, 22 nt, Homo sapiens
acugcacucuagcuugggugac

SEQ ID NO: 160967 - RNA, 22 nt, Homo sapiens
acugcacugcagccuggccaac

SEQ ID NO: 160968 - RNA, 22 nt, Homo sapiens
acugcacuguccuagaguccuc

SEQ ID NO: 160969 - RNA, 22 nt, Homo sapiens
acugcacuucagccuugggaaa

SEQ ID NO: 160970 - RNA, 22 nt, Homo sapiens
acugcauuugguaaagucaaga

SEQ ID NO: 160971 - RNA, 22 nt, Homo sapiens
acuggcaauggcagaaauaguu

SEQ ID NO: 160972 - RNA, 22 nt, Homo sapiens
acuguacuccagccugggugac

SEQ ID NO: 160973 - RNA, 19 nt, Homo sapiens
acuguacuccagucugggc

SEQ ID NO: 160974 - RNA, 22 nt, Homo sapiens
acuguacuccauccugggugac

SEQ ID NO: 160975 - RNA, 22 nt, Homo sapiens
acuuauuguggcugacccaaac

SEQ ID NO: 160976 - RNA, 22 nt, Homo sapiens
agaaagcgcuucccuuugcugg

SEQ ID NO: 160977 - RNA, 22 nt, Homo sapiens
agaaauguuuacucacccccuu

SEQ ID NO: 160978 - RNA, 22 nt, Homo sapiens
agaaccauuagagggagauauu

SEQ ID NO: 160979 - RNA, 22 nt, Homo sapiens
agaagugcuggguucaggcugg

SEQ ID NO: 160980 - RNA, 22 nt, Homo sapiens
agaaugugaccuuauuuggaga

SEQ ID NO: 160981 - RNA, 22 nt, Homo sapiens
agacagcugguagcacuuccug

SEQ ID NO: 160982 - RNA, 22 nt, Homo sapiens
agagaugaagauggggcucccg

SEQ ID NO: 160983 - RNA, 22 nt, Homo sapiens
agagauuauccuggcuucucug

SEQ ID NO: 160984 - RNA, 22 nt, Homo sapiens
agagcaccauuuagcaagguga

SEQ ID NO: 160985 - RNA, 22 nt, Homo sapiens
agagcacugcugcaggguucug

SEQ ID NO: 160986 - RNA, 22 nt, Homo sapiens
agagguauuggaaggaguguca

SEQ ID NO: 160987 - RNA, 20 nt, Homo sapiens
agagugcugucuguccugag

SEQ ID NO: 160988 - RNA, 22 nt, Homo sapiens
agaucaauugcugauucgcucu

SEQ ID NO: 160989 - RNA, 22 nt, Homo sapiens
agaugccuaugaagagaaauua

SEQ ID NO: 160990 - RNA, 22 nt, Homo sapiens
agcaacauggaguuugugcgca

SEQ ID NO: 160991 - RNA, 22 nt, Homo sapiens
agcaauaugacauugcuacauc

SEQ ID NO: 160992 - RNA, 23 nt, Homo sapiens
agcaccaccccaggucacaagug

SEQ ID NO: 160993 - RNA, 22 nt, Homo sapiens
agcaccagaaucugaguuauuc

SEQ ID NO: 160994 - RNA, 22 nt, Homo sapiens
agcagauguuuagugagcgccu

SEQ ID NO: 160995 - RNA, 22 nt, Homo sapiens
agcagcaugcaaauggacuaau

SEQ ID NO: 160996 - RNA, 22 nt, Homo sapiens
agcagcuuugcauggccugugg

SEQ ID NO: 160997 - RNA, 22 nt, Homo sapiens
agcaggacaauaugggaucagg

SEQ ID NO: 160998 - RNA, 22 nt, Homo sapiens
agcaugauugggguugggcaca

SEQ ID NO: 160999 - RNA, 22 nt, Homo sapiens
agcauuacaugguacagagaag

SEQ ID NO: 161000 - RNA, 22 nt, Homo sapiens
agcccagagacuguguaaauuu

SEQ ID NO: 161001 - RNA, 22 nt, Homo sapiens
agcuaguguucaccagagguca

SEQ ID NO: 161002 - RNA, 22 nt, Homo sapiens
agcugcacaaauggaugugagg

SEQ ID NO: 161003 - RNA, 22 nt, Homo sapiens
agcugcacugguauaggagaaa

SEQ ID NO: 161004 - RNA, 22 nt, Homo sapiens
agcuggacuugauaaaugaaua

SEQ ID NO: 161005 - RNA, 22 nt, Homo sapiens
agcuggcuguagcugcaagucu

SEQ ID NO: 161006 - RNA, 22 nt, Homo sapiens
agcuucauuccaacuuccuucu

SEQ ID NO: 161007 - RNA, 22 nt, Homo sapiens
agcuugugauuuagagugagag

SEQ ID NO: 161008 - RNA, 21 nt, Homo sapiens
agcuuguguguaucacagugu

SEQ ID NO: 161009 - RNA, 22 nt, Homo sapiens
aggaaauguuggucccauuucu

SEQ ID NO: 161010 - RNA, 22 nt, Homo sapiens
aggaagacugaaauugcuguuc

SEQ ID NO: 161011 - RNA, 18 nt, Homo sapiens
aggaaugguaauacuuca

SEQ ID NO: 161012 - RNA, 18 nt, Homo sapiens
aggagcauagugcuauga

SEQ ID NO: 161013 - RNA, 22 nt, Homo sapiens
aggcaagaaugcuuguuucacc

SEQ ID NO: 161014 - RNA, 23 nt, Homo sapiens
aggccaguuuuuccugcuugcug

SEQ ID NO: 161015 - RNA, 22 nt, Homo sapiens
agggcaagacuuguuaagaaca

SEQ ID NO: 161016 - RNA, 22 nt, Homo sapiens
agguaauuuuaucauuauguga

SEQ ID NO: 161017 - RNA, 22 nt, Homo sapiens
agguagcauagcgggaauauca

SEQ ID NO: 161018 - RNA, 22 nt, Homo sapiens
agguauauuggacagauguaaa

SEQ ID NO: 161019 - RNA, 22 nt, Homo sapiens
agguauuuucaacuuagaaugg

SEQ ID NO: 161020 - RNA, 22 nt, Homo sapiens
aggucccauguccucccugacc

SEQ ID NO: 161021 - RNA, 23 nt, Homo sapiens
agguuaugauuauagagcgagga

SEQ ID NO: 161022 - RNA, 22 nt, Homo sapiens
aguauguagugcaaucagucag

SEQ ID NO: 161023 - RNA, 22 nt, Homo sapiens
aguccauuugaugaugauucca

SEQ ID NO: 161024 - RNA, 22 nt, Homo sapiens
agucgguguuacugacagaaug

SEQ ID NO: 161025 - RNA, 22 nt, Homo sapiens
agugaacacagcuucuuugguu

SEQ ID NO: 161026 - RNA, 22 nt, Homo sapiens
agugagcugcagucuggggucc

SEQ ID NO: 161027 - RNA, 22 nt, Homo sapiens
agugagcuguuuuuacuuucug

SEQ ID NO: 161028 - RNA, 22 nt, Homo sapiens
agugcaaagccgagguuucuug

SEQ ID NO: 161029 - RNA, 22 nt, Homo sapiens
agugcauaugucuuuuuggaag

SEQ ID NO: 161030 - RNA, 22 nt, Homo sapiens
agugcauugagacuugugaguu

SEQ ID NO: 161031 - RNA, 22 nt, Homo sapiens
aguggcaaugugauguccugaa

SEQ ID NO: 161032 - RNA, 22 nt, Homo sapiens
auaaaccuacauuuucacuucu

SEQ ID NO: 161033 - RNA, 17 nt, Homo sapiens
auaaacucaucauuuuu

SEQ ID NO: 161034 - RNA, 22 nt, Homo sapiens
auaaaugcauugagaacugcug

SEQ ID NO: 161035 - RNA, 22 nt, Homo sapiens
auaacauggaguuugucauuua

SEQ ID NO: 161036 - RNA, 22 nt, Homo sapiens
auaauagcugaucauuuagaag

SEQ ID NO: 161037 - RNA, 22 nt, Homo sapiens
auacaguauggagggcccagcu

SEQ ID NO: 161038 - RNA, 22 nt, Homo sapiens
auacagucuguuagauuuccuc

SEQ ID NO: 161039 - RNA, 22 nt, Homo sapiens
auacagugaauaucuggggcag

SEQ ID NO: 161040 - RNA, 20 nt, Homo sapiens
auagaagacuagugcagcag

SEQ ID NO: 161041 - RNA, 22 nt, Homo sapiens
auagcagaagaagggacaauuc

SEQ ID NO: 161042 - RNA, 22 nt, Homo sapiens
auaguagagagggcaaaaugcu

SEQ ID NO: 161043 - RNA, 22 nt, Homo sapiens
auaugcacgugcauacacacuu

SEQ ID NO: 161044 - RNA, 22 nt, Homo sapiens
auauggguuuuauauuaggcuc

SEQ ID NO: 161045 - RNA, 22 nt, Homo sapiens
auauugguuaaauauuauguga

SEQ ID NO: 161046 - RNA, 22 nt, Homo sapiens
aucaaagugaaauauuaguuau

SEQ ID NO: 161047 - RNA, 22 nt, Homo sapiens
aucaagcugcuuguuugaaucu

SEQ ID NO: 161048 - RNA, 22 nt, Homo sapiens
aucacagaacuuugagcagaga

SEQ ID NO: 161049 - RNA, 22 nt, Homo sapiens
aucacagguacuauggcugaca

SEQ ID NO: 161050 - RNA, 22 nt, Homo sapiens
aucacauuuauaguggcacgca

SEQ ID NO: 161051 - RNA, 22 nt, Homo sapiens
aucacugggagcagccauuaau

SEQ ID NO: 161052 - RNA, 22 nt, Homo sapiens
aucacuguccacucaucuuucu

SEQ ID NO: 161053 - RNA, 22 nt, Homo sapiens
aucagaaucucuagugggacca

SEQ ID NO: 161054 - RNA, 22 nt, Homo sapiens
auccaagagacugaugacuucc

SEQ ID NO: 161055 - RNA, 22 nt, Homo sapiens
aucccugugauccaaucacuuc

SEQ ID NO: 161056 - RNA, 22 nt, Homo sapiens
auccucaguggcuuaaguauag

SEQ ID NO: 161057 - RNA, 22 nt, Homo sapiens
aucgcaccauugcacuccagca

SEQ ID NO: 161058 - RNA, 22 nt, Homo sapiens
aucugcaaauaaugaagauugg

SEQ ID NO: 161059 - RNA, 22 nt, Homo sapiens
aucuggcuccuuuugacaaugc

SEQ ID NO: 161060 - RNA, 22 nt, Homo sapiens
aucuggcuucuuuuaguccaca

SEQ ID NO: 161061 - RNA, 22 nt, Homo sapiens
aucugggguuggcaaaguuugg

SEQ ID NO: 161062 - RNA, 22 nt, Homo sapiens
aucugguguggcugugauccuc

SEQ ID NO: 161063 - RNA, 22 nt, Homo sapiens
aucuuugauuguagguacaaug

SEQ ID NO: 161064 - RNA, 22 nt, Homo sapiens
augaaagguauguuuucuguga

SEQ ID NO: 161065 - RNA, 22 nt, Homo sapiens
augaauagaguuaauugaguac

SEQ ID NO: 161066 - RNA, 22 nt, Homo sapiens
augacaaugaaucccuguuuca

SEQ ID NO: 161067 - RNA, 22 nt, Homo sapiens
augacuuuucugaaaaccacca

SEQ ID NO: 161068 - RNA, 22 nt, Homo sapiens
augagauauuuuauaagaucau

SEQ ID NO: 161069 - RNA, 22 nt, Homo sapiens
augaggugcagaggaaaugagu

SEQ ID NO: 161070 - RNA, 22 nt, Homo sapiens
augagguguuuauuguauccug

SEQ ID NO: 161071 - RNA, 22 nt, Homo sapiens
augauguaggccauggguuucu

SEQ ID NO: 161072 - RNA, 22 nt, Homo sapiens
augcaaaucuuaaguaugugug

SEQ ID NO: 161073 - RNA, 22 nt, Homo sapiens
augcaagacaccacgugagaau

SEQ ID NO: 161074 - RNA, 19 nt, Homo sapiens
augcacgugaaaugcauuu

SEQ ID NO: 161075 - RNA, 22 nt, Homo sapiens
augcagagaaaucuaaaauaug

SEQ ID NO: 161076 - RNA, 19 nt, Homo sapiens
augccacagugaggucaga

SEQ ID NO: 161077 - RNA, 22 nt, Homo sapiens
auggaagacuccucuuugggua

SEQ ID NO: 161078 - RNA, 22 nt, Homo sapiens
auggaaggagaggaaugaauga

SEQ ID NO: 161079 - RNA, 22 nt, Homo sapiens
auggacagacacuggccuucug

SEQ ID NO: 161080 - RNA, 22 nt, Homo sapiens
auggagagaauuauucucucag

SEQ ID NO: 161081 - RNA, 22 nt, Homo sapiens
auggagaugugcgaacugagua

SEQ ID NO: 161082 - RNA, 22 nt, Homo sapiens
auggauaugcuuccaacugccu

SEQ ID NO: 161083 - RNA, 22 nt, Homo sapiens
auggauuuguaguacaugguug

SEQ ID NO: 161084 - RNA, 22 nt, Homo sapiens
auggauuuuaggauacaguuga

SEQ ID NO: 161085 - RNA, 22 nt, Homo sapiens
auggauuuugaacuugagaguu

SEQ ID NO: 161086 - RNA, 22 nt, Homo sapiens
auggauuuuggggccagaggca

SEQ ID NO: 161087 - RNA, 22 nt, Homo sapiens
auggcagagucagaaagucagg

SEQ ID NO: 161088 - RNA, 22 nt, Homo sapiens
auggcaguuuggucucugugcu

SEQ ID NO: 161089 - RNA, 22 nt, Homo sapiens
auggcucuuauuauuugaggua

SEQ ID NO: 161090 - RNA, 22 nt, Homo sapiens
auggcuuuguguucagagcuga

SEQ ID NO: 161091 - RNA, 21 nt, Homo sapiens
auggugagaaaguagugucaa

SEQ ID NO: 161092 - RNA, 22 nt, Homo sapiens
auguaguaugaagaagaugcuu

SEQ ID NO: 161093 - RNA, 22 nt, Homo sapiens
augucaaggugaagaaagauca

SEQ ID NO: 161094 - RNA, 22 nt, Homo sapiens
augucacagguccuagccaagu

SEQ ID NO: 161095 - RNA, 22 nt, Homo sapiens
auguccaugagcacauguauca

SEQ ID NO: 161096 - RNA, 22 nt, Homo sapiens
augugacuuuuuccugugccuu

SEQ ID NO: 161097 - RNA, 22 nt, Homo sapiens
augugcuugagggaaaucaguu

SEQ ID NO: 161098 - RNA, 22 nt, Homo sapiens
augugugcuugugacacagccu

SEQ ID NO: 161099 - RNA, 22 nt, Homo sapiens
auguuuagagagggugucaaau

SEQ ID NO: 161100 - RNA, 22 nt, Homo sapiens
auuaaggaguggguucauggug

SEQ ID NO: 161101 - RNA, 21 nt, Homo sapiens
auuaaugcucugguuagaggc

SEQ ID NO: 161102 - RNA, 22 nt, Homo sapiens
auuagaugguuauaggugugag

SEQ ID NO: 161103 - RNA, 22 nt, Homo sapiens
auuauauguguaugugcauacc

SEQ ID NO: 161104 - RNA, 22 nt, Homo sapiens
auuaucacaguuuugcauaugg

SEQ ID NO: 161105 - RNA, 22 nt, Homo sapiens
auuauuagucggccagcuguua

SEQ ID NO: 161106 - RNA, 22 nt, Homo sapiens
auuauuaguuguugaaugaagu

SEQ ID NO: 161107 - RNA, 22 nt, Homo sapiens
auucaaagugcauguucccacu

SEQ ID NO: 161108 - RNA, 23 nt, Homo sapiens
auucaaguagugagagugguuau

SEQ ID NO: 161109 - RNA, 22 nt, Homo sapiens
auuccacagccgauaccaugac

SEQ ID NO: 161110 - RNA, 22 nt, Homo sapiens
uauaugcuaaacaagggguggg

SEQ ID NO: 161111 - RNA, 22 nt, Homo sapiens
uauaugcucugggauccugaaa

SEQ ID NO: 161112 - RNA, 20 nt, Homo sapiens
uaucacaggucagaaacccu

SEQ ID NO: 161113 - RNA, 21 nt, Homo sapiens
uaucacaguagaauaggaucu

SEQ ID NO: 161114 - RNA, 21 nt, Homo sapiens
uaucacauuggugauuaaguu

SEQ ID NO: 161115 - RNA, 21 nt, Homo sapiens
uaucagagacauugagaggca

SEQ ID NO: 161116 - RNA, 22 nt, Homo sapiens
uaucagcacaguggguucaugg

SEQ ID NO: 161117 - RNA, 22 nt, Homo sapiens
uaucucuuuucauguguaaaug

SEQ ID NO: 161118 - RNA, 22 nt, Homo sapiens
uaucuuggaguuugacaaccaa

SEQ ID NO: 161119 - RNA, 20 nt, Homo sapiens
uaugaaacaguguagagcaa

SEQ ID NO: 161120 - RNA, 22 nt, Homo sapiens
uaugaaagcuacuucucacaau

SEQ ID NO: 161121 - RNA, 22 nt, Homo sapiens
uaugagacugguuaauuuuugu

SEQ ID NO: 161122 - RNA, 22 nt, Homo sapiens
uaugcagacauuguuccaacca

SEQ ID NO: 161123 - RNA, 22 nt, Homo sapiens
uauggcuaugggaacugggagu

SEQ ID NO: 161124 - RNA, 22 nt, Homo sapiens
uauuaagcuaguugucagugcu

SEQ ID NO: 161125 - RNA, 20 nt, Homo sapiens
uauuacagaguaauggugga

SEQ ID NO: 161126 - RNA, 22 nt, Homo sapiens
uauuccagcccuggugagccag

SEQ ID NO: 161127 - RNA, 22 nt, Homo sapiens
uauugaacgugggauauugaag

SEQ ID NO: 161128 - RNA, 22 nt, Homo sapiens
uauugcacaugaggagacauug

SEQ ID NO: 161129 - RNA, 22 nt, Homo sapiens
uauugcacuccagccuuggcaa

SEQ ID NO: 161130 - RNA, 22 nt, Homo sapiens
uauugcacuuuuccauaggagu

SEQ ID NO: 161131 - RNA, 22 nt, Homo sapiens
uauugcuaacaucccuuaugua

SEQ ID NO: 161132 - RNA, 22 nt, Homo sapiens
uauuugguagcuauuuugcagu

SEQ ID NO: 161133 - RNA, 22 nt, Homo sapiens
ucaaaaucucuuagcugugucu

SEQ ID NO: 161134 - RNA, 22 nt, Homo sapiens
ucaacagugauggaaaguuaua

SEQ ID NO: 161135 - RNA, 19 nt, Homo sapiens
ucaagcuauucuccugccu

SEQ ID NO: 161136 - RNA, 21 nt, Homo sapiens
ucaaggaguauacguaugcca

SEQ ID NO: 161137 - RNA, 22 nt, Homo sapiens
ucaaguaauacucccaucuugg

SEQ ID NO: 161138 - RNA, 22 nt, Homo sapiens
ucaaugcaaccuccaccucugg

SEQ ID NO: 161139 - RNA, 16 nt, Homo sapiens
ucacaaacucuagcag

SEQ ID NO: 161140 - RNA, 22 nt, Homo sapiens
ucacaaagcuuggccugcuucu

SEQ ID NO: 161141 - RNA, 22 nt, Homo sapiens
ucacaagcuccugccuuugcuu

SEQ ID NO: 161142 - RNA, 22 nt, Homo sapiens
ucacacugaauuugaagcaaug

SEQ ID NO: 161143 - RNA, 19 nt, Homo sapiens
ucacacuguggcuucuuua

SEQ ID NO: 161144 - RNA, 22 nt, Homo sapiens
ucacagaggagaagaccuuuaa

SEQ ID NO: 161145 - RNA, 22 nt, Homo sapiens
ucacagauaaauaaagaugauu

SEQ ID NO: 161146 - RNA, 22 nt, Homo sapiens
ucacaguaucaugggggacaga

SEQ ID NO: 161147 - RNA, 22 nt, Homo sapiens
ucacaugaagauuuuaguauac

SEQ ID NO: 161148 - RNA, 22 nt, Homo sapiens
ucacaugaauugucuuguucca

SEQ ID NO: 161149 - RNA, 22 nt, Homo sapiens
ucacccacacaggagacaggga

SEQ ID NO: 161150 - RNA, 22 nt, Homo sapiens
ucacccuguguuuugcguuugc

SEQ ID NO: 161151 - RNA, 23 nt, Homo sapiens
ucacuagaguccuggaguuugag

SEQ ID NO: 161152 - RNA, 20 nt, Homo sapiens
ucacugugaacuucuugagg

SEQ ID NO: 161153 - RNA, 21 nt, Homo sapiens
ucagaagcucccagggaggac

SEQ ID NO: 161154 - RNA, 22 nt, Homo sapiens
ucagaugaucugguaagaacuu

SEQ ID NO: 161155 - RNA, 22 nt, Homo sapiens
ucagguagcauuuuggaaacag

SEQ ID NO: 161156 - RNA, 20 nt, Homo sapiens
ucagguagggcuucaacauu

SEQ ID NO: 161157 - RNA, 23 nt, Homo sapiens
ucaguacuccacuuucaauagug

SEQ ID NO: 161158 - RNA, 23 nt, Homo sapiens
ucaguacucuauaagugccagcu

SEQ ID NO: 161159 - RNA, 18 nt, Homo sapiens
ucagucacugccuggcuu

SEQ ID NO: 161160 - RNA, 21 nt, Homo sapiens
ucagugcaauucuauggggaa

SEQ ID NO: 161161 - RNA, 22 nt, Homo sapiens
ucagugcaggaaucucuagcca

SEQ ID NO: 161162 - RNA, 22 nt, Homo sapiens
ucauagaucaaguaauaagaca

SEQ ID NO: 161163 - RNA, 20 nt, Homo sapiens
ucauagggugguggcagugg

SEQ ID NO: 161164 - RNA, 19 nt, Homo sapiens
ucauagucuaagaugagaa

SEQ ID NO: 161165 - RNA, 22 nt, Homo sapiens
ucaucagaaucccuuagggaug

SEQ ID NO: 161166 - RNA, 22 nt, Homo sapiens
ucauugcuuauuuguuggugga

SEQ ID NO: 161167 - RNA, 22 nt, Homo sapiens
ucauuguccaacuucuuucagu

SEQ ID NO: 161168 - RNA, 22 nt, Homo sapiens
uccaauguaaucaucauugaau

SEQ ID NO: 161169 - RNA, 22 nt, Homo sapiens
uccacagugguugaacuaguuu

SEQ ID NO: 161170 - RNA, 22 nt, Homo sapiens
uccauuuguucagcuucaggaa

SEQ ID NO: 161171 - RNA, 22 nt, Homo sapiens
uccauuuguuguaggguauagu

SEQ ID NO: 161172 - RNA, 20 nt, Homo sapiens
ucccaguaggagaaggaagg

SEQ ID NO: 161173 - RNA, 22 nt, Homo sapiens
ucccaguauucauuuacagaag

SEQ ID NO: 161174 - RNA, 22 nt, Homo sapiens
uccccgaggcuggagugcagug

SEQ ID NO: 161175 - RNA, 19 nt, Homo sapiens
ucccugagucuuagcuuga

SEQ ID NO: 161176 - RNA, 22 nt, Homo sapiens
uccucugaacuccagacccaua

SEQ ID NO: 161177 - RNA, 22 nt, Homo sapiens
ucgcaccauugcacuccagcca

SEQ ID NO: 161178 - RNA, 22 nt, Homo sapiens
ucucagugaauugguuuugucu

SEQ ID NO: 161179 - RNA, 21 nt, Homo sapiens
ucucauagaguuucacuuucu

SEQ ID NO: 161180 - RNA, 22 nt, Homo sapiens
ucucauggagguagagaguaaa

SEQ ID NO: 161181 - RNA, 22 nt, Homo sapiens
ucucuggauaucuacuuauguu

SEQ ID NO: 161182 - RNA, 22 nt, Homo sapiens
ucugagaucaugucugugcugu

SEQ ID NO: 161183 - RNA, 22 nt, Homo sapiens
ucuggcaagagccgagggcagu

SEQ ID NO: 161184 - RNA, 21 nt, Homo sapiens
ucuggccccuccaaaucucau

SEQ ID NO: 161185 - RNA, 22 nt, Homo sapiens
ucuggccccucucaaaucucau

SEQ ID NO: 161186 - RNA, 22 nt, Homo sapiens
ucuggcuucugacuuaggggac

SEQ ID NO: 161187 - RNA, 22 nt, Homo sapiens
ucuggguuuuguaccgugcucg

SEQ ID NO: 161188 - RNA, 22 nt, Homo sapiens
ucugguggugaugagagacagu

SEQ ID NO: 161189 - RNA, 22 nt, Homo sapiens
ucugucuuguccucacccuaga

SEQ ID NO: 161190 - RNA, 22 nt, Homo sapiens
ucugucuuugccuaaguuuguc

SEQ ID NO: 161191 - RNA, 22 nt, Homo sapiens
ucugucuuugucaggaccagag

SEQ ID NO: 161192 - RNA, 20 nt, Homo sapiens
ucuugaacuuagucaacagg

SEQ ID NO: 161193 - RNA, 22 nt, Homo sapiens
ucuuggguuuguccuucuccua

SEQ ID NO: 161194 - RNA, 22 nt, Homo sapiens
ucuugguaaugucacauuuccu

SEQ ID NO: 161195 - RNA, 23 nt, Homo sapiens
ucuuguacuuugagugagcaugg

SEQ ID NO: 161196 - RNA, 22 nt, Homo sapiens
ucuuuagguguuauaguucaag

SEQ ID NO: 161197 - RNA, 22 nt, Homo sapiens
ucuuugaguuauugugcagacu

SEQ ID NO: 161198 - RNA, 22 nt, Homo sapiens
ucuuuggucuacuuucauaugu

SEQ ID NO: 161199 - RNA, 22 nt, Homo sapiens
ucuuuguuuucugauccugaag

SEQ ID NO: 161200 - RNA, 22 nt, Homo sapiens
ugaaaguaauugcaguuuuuac

SEQ ID NO: 161201 - RNA, 22 nt, Homo sapiens
ugaaaugauuauaugguguuug

SEQ ID NO: 161202 - RNA, 22 nt, Homo sapiens
ugaaauuauucuuaccaaggug

SEQ ID NO: 161203 - RNA, 22 nt, Homo sapiens
ugaacagcuaucuugucagugu

SEQ ID NO: 161204 - RNA, 22 nt, Homo sapiens
ugaagggcauuguuuugccaaa

SEQ ID NO: 161205 - RNA, 22 nt, Homo sapiens
ugaagugaagcaguaguguggg

SEQ ID NO: 161206 - RNA, 22 nt, Homo sapiens
ugaauauguuaaauaauguucu

SEQ ID NO: 161207 - RNA, 22 nt, Homo sapiens
ugaauguuguugguugagauau

SEQ ID NO: 161208 - RNA, 22 nt, Homo sapiens
ugaauugucucucacuggguuc

SEQ ID NO: 161209 - RNA, 18 nt, Homo sapiens
ugacaaugcuaguccugg

SEQ ID NO: 161210 - RNA, 22 nt, Homo sapiens
auuccacuuacaugaaguaccu

SEQ ID NO: 161211 - RNA, 22 nt, Homo sapiens
auugaacuuacuaucuaaacua

SEQ ID NO: 161212 - RNA, 18 nt, Homo sapiens
auugagcaugacagaccu

SEQ ID NO: 161213 - RNA, 22 nt, Homo sapiens
auugcacaucugcacuacagcc

SEQ ID NO: 161214 - RNA, 22 nt, Homo sapiens
auugcacuccagccugggugag

SEQ ID NO: 161215 - RNA, 22 nt, Homo sapiens
auugcacucuagccugggugac

SEQ ID NO: 161216 - RNA, 18 nt, Homo sapiens
auugcccucauggggcuu

SEQ ID NO: 161217 - RNA, 22 nt, Homo sapiens
auuggggaaugguggcuuuagu

SEQ ID NO: 161218 - RNA, 22 nt, Homo sapiens
auuguacuccagccugggcaaa

SEQ ID NO: 161219 - RNA, 22 nt, Homo sapiens
auugucacccgggcaguaagca

SEQ ID NO: 161220 - RNA, 15 nt, Homo sapiens
auuucacuuagcaug

SEQ ID NO: 161221 - RNA, 22 nt, Homo sapiens
auuucacuucgcaugguguccg

SEQ ID NO: 161222 - RNA, 22 nt, Homo sapiens
caaaagugauugcgguuuuugc

SEQ ID NO: 161223 - RNA, 22 nt, Homo sapiens
caaaguaauugcuguuuugcca

SEQ ID NO: 161224 - RNA, 22 nt, Homo sapiens
caaauacuuucauguugucuug

SEQ ID NO: 161225 - RNA, 22 nt, Homo sapiens
caaauccucaccucaucaugaa

SEQ ID NO: 161226 - RNA, 22 nt, Homo sapiens
cacaaaguagauuagucuucca

SEQ ID NO: 161227 - RNA, 22 nt, Homo sapiens
cacagagugagacccugucucu

SEQ ID NO: 161228 - RNA, 22 nt, Homo sapiens
cacaguagaauagagcacuagg

SEQ ID NO: 161229 - RNA, 22 nt, Homo sapiens
cacagucuugcaauauugagau

SEQ ID NO: 161230 - RNA, 22 nt, Homo sapiens
caccagcuggcauugaauaccu

SEQ ID NO: 161231 - RNA, 22 nt, Homo sapiens
cacugcacuccagccuaagagg

SEQ ID NO: 161232 - RNA, 22 nt, Homo sapiens
cacugcacuccagucugacgac

SEQ ID NO: 161233 - RNA, 22 nt, Homo sapiens
cacugcacuccagucuggcgac

SEQ ID NO: 161234 - RNA, 22 nt, Homo sapiens
cacugcacuccaguuucgguaa

SEQ ID NO: 161235 - RNA, 21 nt, Homo sapiens
cacugcacuugccuucugggu

SEQ ID NO: 161236 - RNA, 22 nt, Homo sapiens
cacugcauccucugccuggcgg

SEQ ID NO: 161237 - RNA, 22 nt, Homo sapiens
cacuggguuagaacaugcuccu

SEQ ID NO: 161238 - RNA, 21 nt, Homo sapiens
cacugguguugcuauaucaaa

SEQ ID NO: 161239 - RNA, 22 nt, Homo sapiens
cagaaguauugguaugcucugu

SEQ ID NO: 161240 - RNA, 20 nt, Homo sapiens
cagagcaaagcaguccuggc

SEQ ID NO: 161241 - RNA, 22 nt, Homo sapiens
cagagcaaugcuuuugcuuuga

SEQ ID NO: 161242 - RNA, 22 nt, Homo sapiens
cagauacuggccuggagcugug

SEQ ID NO: 161243 - RNA, 22 nt, Homo sapiens
cagaugguggucccacagccca

SEQ ID NO: 161244 - RNA, 22 nt, Homo sapiens
cagcaaaucauccuauuugagc

SEQ ID NO: 161245 - RNA, 22 nt, Homo sapiens
cagcccuacacagacugacuca

SEQ ID NO: 161246 - RNA, 22 nt, Homo sapiens
cagccgggugagguggcuuguu

SEQ ID NO: 161247 - RNA, 22 nt, Homo sapiens
cagcuggugggagcuggguucc

SEQ ID NO: 161248 - RNA, 22 nt, Homo sapiens
caguacaauguugauuagaagu

SEQ ID NO: 161249 - RNA, 22 nt, Homo sapiens
cagucacugggauuauggucau

SEQ ID NO: 161250 - RNA, 22 nt, Homo sapiens
cagugcaaagccucugcccaga

SEQ ID NO: 161251 - RNA, 22 nt, Homo sapiens
cagugcauagaugugccacauu

SEQ ID NO: 161252 - RNA, 22 nt, Homo sapiens
cauaaagauggaggaggccagg

SEQ ID NO: 161253 - RNA, 22 nt, Homo sapiens
cauaaugcuaagagcugccccu

SEQ ID NO: 161254 - RNA, 22 nt, Homo sapiens
gagauuauuuaaaaggugauuu

SEQ ID NO: 161255 - RNA, 22 nt, Homo sapiens
gagcacauaugacauuuucuuc

SEQ ID NO: 161256 - RNA, 22 nt, Homo sapiens
gagcacccuuuguugauugcaa

SEQ ID NO: 161257 - RNA, 22 nt, Homo sapiens
gaggagauauucugcuggaugg

SEQ ID NO: 161258 - RNA, 22 nt, Homo sapiens
gaggcaaguggccaccgagucu

SEQ ID NO: 161259 - RNA, 22 nt, Homo sapiens
gaggcagucugacccuuagcag

SEQ ID NO: 161260 - RNA, 22 nt, Homo sapiens
gaggucauguggcaggcagcca

SEQ ID NO: 161261 - RNA, 22 nt, Homo sapiens
gagguguagagauauaccugaa

SEQ ID NO: 161262 - RNA, 22 nt, Homo sapiens
gaguaaaugucacuguugcugu

SEQ ID NO: 161263 - RNA, 21 nt, Homo sapiens
gagugcaaauaaagagagggc

SEQ ID NO: 161264 - RNA, 22 nt, Homo sapiens
gagugcaauggcaagaucuugg

SEQ ID NO: 161265 - RNA, 22 nt, Homo sapiens
gagugcaauggcaugaucuugg

SEQ ID NO: 161266 - RNA, 22 nt, Homo sapiens
gagugcaauggcgcgaucucgg

SEQ ID NO: 161267 - RNA, 22 nt, Homo sapiens
gagugcugagcccacuuccuug

SEQ ID NO: 161268 - RNA, 22 nt, Homo sapiens
gaguggugguucugaaacuuuu

SEQ ID NO: 161269 - RNA, 22 nt, Homo sapiens
gaguuccuuugagccugagagg

SEQ ID NO: 161270 - RNA, 18 nt, Homo sapiens
gauaacaguggacuaugc

SEQ ID NO: 161271 - RNA, 22 nt, Homo sapiens
gaucuggagguuuuccucauga

SEQ ID NO: 161272 - RNA, 22 nt, Homo sapiens
gaugagcuaaguucucacagca

SEQ ID NO: 161273 - RNA, 22 nt, Homo sapiens
gauuucacuuucuggaugugca

SEQ ID NO: 161274 - RNA, 20 nt, Homo sapiens
gcaacauggccagagugaau

SEQ ID NO: 161275 - RNA, 22 nt, Homo sapiens
gcaagaauggaacaggagagcc

SEQ ID NO: 161276 - RNA, 22 nt, Homo sapiens
gcaagacaugucuaagguuuaa

SEQ ID NO: 161277 - RNA, 22 nt, Homo sapiens
gcagaguauagagggcugggcc

SEQ ID NO: 161278 - RNA, 22 nt, Homo sapiens
gcagcauuaccaagacauggca

SEQ ID NO: 161279 - RNA, 22 nt, Homo sapiens
gcagguaguuucugacuuuuac

SEQ ID NO: 161280 - RNA, 23 nt, Homo sapiens
gcagucauuuggaaaagguugaa

SEQ ID NO: 161281 - RNA, 22 nt, Homo sapiens
gcagugcaguggcgcgaucucg

SEQ ID NO: 161282 - RNA, 22 nt, Homo sapiens
gcagugcaugacgguauauaua

SEQ ID NO: 161283 - RNA, 22 nt, Homo sapiens
gcauaaagcuaauaagacgaag

SEQ ID NO: 161284 - RNA, 22 nt, Homo sapiens
gcaugcauuuuccuaacuagaa

SEQ ID NO: 161285 - RNA, 22 nt, Homo sapiens
gccaguguguguuguucuccgc

SEQ ID NO: 161286 - RNA, 22 nt, Homo sapiens
gcccugagauucuuggauucug

SEQ ID NO: 161287 - RNA, 22 nt, Homo sapiens
gcgugguguuagaaugagaagu

SEQ ID NO: 161288 - RNA, 23 nt, Homo sapiens
gcuaggagagaugaaacacaggu

SEQ ID NO: 161289 - RNA, 22 nt, Homo sapiens
gcuaugucuguugcucuugggc

SEQ ID NO: 161290 - RNA, 22 nt, Homo sapiens
gcugcuguaccagaugugguua

SEQ ID NO: 161291 - RNA, 22 nt, Homo sapiens
gcugcuguuuaguuucuccugg

SEQ ID NO: 161292 - RNA, 22 nt, Homo sapiens
gcuggucugccguaguaggugc

SEQ ID NO: 161293 - RNA, 22 nt, Homo sapiens
gcuguguguuaucagaaauugc

SEQ ID NO: 161294 - RNA, 22 nt, Homo sapiens
gcuguugugaacuauacaucua

SEQ ID NO: 161295 - RNA, 22 nt, Homo sapiens
ggaaagacuauuguaaaggaug

SEQ ID NO: 161296 - RNA, 22 nt, Homo sapiens
ggaagaauauuaggggauuucg

SEQ ID NO: 161297 - RNA, 22 nt, Homo sapiens
ggaagccugcacucgggcaggg

SEQ ID NO: 161298 - RNA, 20 nt, Homo sapiens
ggaauagucuacacucugac

SEQ ID NO: 161299 - RNA, 22 nt, Homo sapiens
ggaaucugaaccaugggaaugg

SEQ ID NO: 161300 - RNA, 22 nt, Homo sapiens
ggagaucuuuaggaguuggacu

SEQ ID NO: 161301 - RNA, 22 nt, Homo sapiens
ggagcugugauuugaguccaga

SEQ ID NO: 161302 - RNA, 22 nt, Homo sapiens
ggauaucauuauuucuagggcu

SEQ ID NO: 161303 - RNA, 22 nt, Homo sapiens
ggauugugauaauuguugcaaa

SEQ ID NO: 161304 - RNA, 22 nt, Homo sapiens
ggcaaaaucgcaauuacuuuug

SEQ ID NO: 161305 - RNA, 22 nt, Homo sapiens
ggcaacaugaugaaaugccauc

SEQ ID NO: 161306 - RNA, 22 nt, Homo sapiens
ggcaacauggugaaacucuguc

SEQ ID NO: 161307 - RNA, 22 nt, Homo sapiens
ggcaagauagauaucaguguca

SEQ ID NO: 161308 - RNA, 22 nt, Homo sapiens
ggcaagaucuuggcucacugaa

SEQ ID NO: 161309 - RNA, 22 nt, Homo sapiens
ggcagcauugccuuugcaguga

SEQ ID NO: 161310 - RNA, 22 nt, Homo sapiens
ggcaguuuguuugugaggucca

SEQ ID NO: 161311 - RNA, 22 nt, Homo sapiens
ggcaugcauuguacuaguaugc

SEQ ID NO: 161312 - RNA, 22 nt, Homo sapiens
ggcuagaauagggauagaccuu

SEQ ID NO: 161313 - RNA, 22 nt, Homo sapiens
ggcuuuggucacacaggggcaa

SEQ ID NO: 161314 - RNA, 22 nt, Homo sapiens
gggaagaaggagugguuuacuc

SEQ ID NO: 161315 - RNA, 22 nt, Homo sapiens
gggaggucauuguucaaugcug

SEQ ID NO: 161316 - RNA, 22 nt, Homo sapiens
ggguucaaaucuuggcucuuac

SEQ ID NO: 161317 - RNA, 22 nt, Homo sapiens
ggucaggagaaugguaacugag

SEQ ID NO: 161318 - RNA, 21 nt, Homo sapiens
ggugagaaaggagacauagac

SEQ ID NO: 161319 - RNA, 22 nt, Homo sapiens
ggugcagcacaccaacauggca

SEQ ID NO: 161320 - RNA, 22 nt, Homo sapiens
guaaucucagcuacuugggagc

SEQ ID NO: 161321 - RNA, 19 nt, Homo sapiens
guaaucucaguacuuuggu

SEQ ID NO: 161322 - RNA, 22 nt, Homo sapiens
guacaggugcaggaugggcagg

SEQ ID NO: 161323 - RNA, 22 nt, Homo sapiens
guaccacaguugcucacggguu

SEQ ID NO: 161324 - RNA, 22 nt, Homo sapiens
guaguuuaucagaaagaauagg

SEQ ID NO: 161325 - RNA, 22 nt, Homo sapiens
guauugcuugagcccaggaguu

SEQ ID NO: 161326 - RNA, 22 nt, Homo sapiens
gucaaggaauuuauccauuucu

SEQ ID NO: 161327 - RNA, 22 nt, Homo sapiens
gucaggugcuuacgcggagauc

SEQ ID NO: 161328 - RNA, 18 nt, Homo sapiens
gucauagaaugaugguuc

SEQ ID NO: 161329 - RNA, 22 nt, Homo sapiens
gucaugaacuguacuacuccua

SEQ ID NO: 161330 - RNA, 22 nt, Homo sapiens
gucccaguggaaccuccaagcu

SEQ ID NO: 161331 - RNA, 22 nt, Homo sapiens
gucccugcgauugugggauccu

SEQ ID NO: 161332 - RNA, 22 nt, Homo sapiens
guccugaagaccuuccucugga

SEQ ID NO: 161333 - RNA, 22 nt, Homo sapiens
gucucacagcuagcugcuuuau

SEQ ID NO: 161334 - RNA, 22 nt, Homo sapiens
gucuccgagccguguggagccg

SEQ ID NO: 161335 - RNA, 22 nt, Homo sapiens
gucucugguugcuuuuguacca

SEQ ID NO: 161336 - RNA, 22 nt, Homo sapiens
gucuggcuccugucuaaucacu

SEQ ID NO: 161337 - RNA, 22 nt, Homo sapiens
gucugucuuuugucuuugaaau

SEQ ID NO: 161338 - RNA, 20 nt, Homo sapiens
gucuuguagcucaaguuauu

SEQ ID NO: 161339 - RNA, 22 nt, Homo sapiens
gugacuggacucugaagaaaau

SEQ ID NO: 161340 - RNA, 22 nt, Homo sapiens
gugagaagaaaaauauggcugu

SEQ ID NO: 161341 - RNA, 22 nt, Homo sapiens
gugagcauuacucaugggauca

SEQ ID NO: 161342 - RNA, 22 nt, Homo sapiens
gugagcauucaaggaaggagcu

SEQ ID NO: 161343 - RNA, 22 nt, Homo sapiens
gugaggaaggaaaccugcuagc

SEQ ID NO: 161344 - RNA, 22 nt, Homo sapiens
gugaggcugguccugccuccca

SEQ ID NO: 161345 - RNA, 22 nt, Homo sapiens
gugagguagagcaugugaaaga

SEQ ID NO: 161346 - RNA, 22 nt, Homo sapiens
gugagguguuaaccaaccugug

SEQ ID NO: 161347 - RNA, 22 nt, Homo sapiens
gugccacaguguuaagggauuc

SEQ ID NO: 161348 - RNA, 23 nt, Homo sapiens
gugccuucugagccuagucucca

SEQ ID NO: 161349 - RNA, 21 nt, Homo sapiens
gugcuuguagccucacuucug

SEQ ID NO: 161350 - RNA, 22 nt, Homo sapiens
gugcuuguauuuaaaucaugug

SEQ ID NO: 161351 - RNA, 20 nt, Homo sapiens
guggaagauaaguagccuga

SEQ ID NO: 161352 - RNA, 22 nt, Homo sapiens
guggcagaaaagagaagcaaug

SEQ ID NO: 161353 - RNA, 22 nt, Homo sapiens
guggcaugaaagcagauaccac

SEQ ID NO: 161354 - RNA, 22 nt, Homo sapiens
guggcuagaaugaagguagcug

SEQ ID NO: 161355 - RNA, 22 nt, Homo sapiens
gugggcucguucguguuagaca

SEQ ID NO: 161356 - RNA, 22 nt, Homo sapiens
uguaugcuuuugagagauauuu

SEQ ID NO: 161357 - RNA, 22 nt, Homo sapiens
uguaugucuucuuuagauaagu

SEQ ID NO: 161358 - RNA, 22 nt, Homo sapiens
ugucaaagagacaucugcacuc

SEQ ID NO: 161359 - RNA, 18 nt, Homo sapiens
ugucacuggauaaugguc

SEQ ID NO: 161360 - RNA, 22 nt, Homo sapiens
ugucagaaucuagaggcugcua

SEQ ID NO: 161361 - RNA, 22 nt, Homo sapiens
ugucagaaucugagacgacaac

SEQ ID NO: 161362 - RNA, 22 nt, Homo sapiens
ugucccguuuucgaggcugcag

SEQ ID NO: 161363 - RNA, 22 nt, Homo sapiens
ugucuguuugcgaaauugcuuc

SEQ ID NO: 161364 - RNA, 22 nt, Homo sapiens
ugugaaaucagauagccuuuuu

SEQ ID NO: 161365 - RNA, 22 nt, Homo sapiens
ugugacagcacagcaucucuuu

SEQ ID NO: 161366 - RNA, 22 nt, Homo sapiens
ugugacagcacgguucaacugc

SEQ ID NO: 161367 - RNA, 22 nt, Homo sapiens
ugugacagguauccuguguucu

SEQ ID NO: 161368 - RNA, 18 nt, Homo sapiens
ugugacauugagcauguc

SEQ ID NO: 161369 - RNA, 22 nt, Homo sapiens
ugugagacugguucugaaccca

SEQ ID NO: 161370 - RNA, 22 nt, Homo sapiens
ugugcaaucuuccauuuuuagg

SEQ ID NO: 161371 - RNA, 22 nt, Homo sapiens
ugugcaguuuuagcguauuuua

SEQ ID NO: 161372 - RNA, 22 nt, Homo sapiens
uguggcauuuucagaaaggaug

SEQ ID NO: 161373 - RNA, 22 nt, Homo sapiens
uguggcucuucuguucuccacu

SEQ ID NO: 161374 - RNA, 18 nt, Homo sapiens
uguggcuguuuuccaaua

SEQ ID NO: 161375 - RNA, 22 nt, Homo sapiens
uguuacagcagaauugaaagag

SEQ ID NO: 161376 - RNA, 22 nt, Homo sapiens
uguuauugagguuacuuauaag

SEQ ID NO: 161377 - RNA, 22 nt, Homo sapiens
uuaaagccauaccugagagagu

SEQ ID NO: 161378 - RNA, 22 nt, Homo sapiens
uuaaaggcauguacacuagagu

SEQ ID NO: 161379 - RNA, 22 nt, Homo sapiens
uuaaagugaucauaaggauagu

SEQ ID NO: 161380 - RNA, 22 nt, Homo sapiens
uuaagaugcauuuugaaguuaa

SEQ ID NO: 161381 - RNA, 22 nt, Homo sapiens
uuaagguaugugggcauuuugu

SEQ ID NO: 161382 - RNA, 22 nt, Homo sapiens
uuaauagugacucauuuuccac

SEQ ID NO: 161383 - RNA, 22 nt, Homo sapiens
uuaaucaggccguuuccuaaga

SEQ ID NO: 161384 - RNA, 22 nt, Homo sapiens
uuaaucuguucucuguauucua

SEQ ID NO: 161385 - RNA, 22 nt, Homo sapiens
uuaauguaauugauugauugac

SEQ ID NO: 161386 - RNA, 22 nt, Homo sapiens
uuaauuguaucuauagauguca

SEQ ID NO: 161387 - RNA, 22 nt, Homo sapiens
uuacagguggagaaguaaggcu

SEQ ID NO: 161388 - RNA, 22 nt, Homo sapiens
uuaccacagugccugucuaaug

SEQ ID NO: 161389 - RNA, 22 nt, Homo sapiens
uuaccagucugauaaacagaaa

SEQ ID NO: 161390 - RNA, 22 nt, Homo sapiens
uuacuagaacauuuagggaacu

SEQ ID NO: 161391 - RNA, 22 nt, Homo sapiens
uuagcagcucuggugacaaggu

SEQ ID NO: 161392 - RNA, 21 nt, Homo sapiens
uuagcauccauguucaucaac

SEQ ID NO: 161393 - RNA, 22 nt, Homo sapiens
uuaggcuuuauugaaaacaaua

SEQ ID NO: 161394 - RNA, 22 nt, Homo sapiens
uuagggaggagucccucuuuuu

SEQ ID NO: 161395 - RNA, 22 nt, Homo sapiens
uuagugaaugcaccacuucuga

SEQ ID NO: 161396 - RNA, 22 nt, Homo sapiens
uuauauguuuguacuuaggccu

SEQ ID NO: 161397 - RNA, 21 nt, Homo sapiens
uuaucccagugucucugcagg

SEQ ID NO: 161398 - RNA, 22 nt, Homo sapiens
uuauggauuuauauucuguagu

SEQ ID NO: 161399 - RNA, 22 nt, Homo sapiens
uuauguguuuaauguuucugaa

SEQ ID NO: 161400 - RNA, 22 nt, Homo sapiens
uuauuagguugguggaaaagua

SEQ ID NO: 161401 - RNA, 22 nt, Homo sapiens
uuauugcuuaugauuagguguu

SEQ ID NO: 161402 - RNA, 22 nt, Homo sapiens
uucaaaggauagauuaagauca

SEQ ID NO: 161403 - RNA, 22 nt, Homo sapiens
uucaaggacuaaggauuuuugg

SEQ ID NO: 161404 - RNA, 22 nt, Homo sapiens
uucacagacaacuggucccuua

SEQ ID NO: 161405 - RNA, 22 nt, Homo sapiens
uucacaugacagggugaagcau

SEQ ID NO: 161406 - RNA, 22 nt, Homo sapiens
uucacuguuaagcaguuaaacu

SEQ ID NO: 161407 - RNA, 22 nt, Homo sapiens
uucaggcaccauggucauugau

SEQ ID NO: 161408 - RNA, 22 nt, Homo sapiens
uucaggcaccauugucauugau

SEQ ID NO: 161409 - RNA, 22 nt, Homo sapiens
uucagugucauuaacacaguag

SEQ ID NO: 161410 - RNA, 19 nt, Homo sapiens
uucauacagugagagcagc

SEQ ID NO: 161411 - RNA, 18 nt, Homo sapiens
uucauaguagcaugauuu

SEQ ID NO: 161412 - RNA, 22 nt, Homo sapiens
uucauagucuaauuuuuuccac

SEQ ID NO: 161413 - RNA, 22 nt, Homo sapiens
uucauagucuaugcaaguaaga

SEQ ID NO: 161414 - RNA, 22 nt, Homo sapiens
uucauaguguuuccuuccagug

SEQ ID NO: 161415 - RNA, 21 nt, Homo sapiens
uucaucagccagaaaucaagc

SEQ ID NO: 161416 - RNA, 18 nt, Homo sapiens
uucaucaguccucagcug

SEQ ID NO: 161417 - RNA, 22 nt, Homo sapiens
uucaugugagucuguauuaacu

SEQ ID NO: 161418 - RNA, 22 nt, Homo sapiens
uuccacagggauuugcauugau

SEQ ID NO: 161419 - RNA, 22 nt, Homo sapiens
uucccugagcaucuguugagcc

SEQ ID NO: 161420 - RNA, 22 nt, Homo sapiens
uucccugugggcuggugcucca

SEQ ID NO: 161421 - RNA, 22 nt, Homo sapiens
uuccuaguccugagucucugcg

SEQ ID NO: 161422 - RNA, 19 nt, Homo sapiens
uuccugagaacaagggcuu

SEQ ID NO: 161423 - RNA, 22 nt, Homo sapiens
uuccugaggccuccccagaagc

SEQ ID NO: 161424 - RNA, 22 nt, Homo sapiens
uucucagugcuaucuuuuaugc

SEQ ID NO: 161425 - RNA, 22 nt, Homo sapiens
uucucugggacauaggucgggu

SEQ ID NO: 161426 - RNA, 22 nt, Homo sapiens
uucugaguggcuuucaacacug

SEQ ID NO: 161427 - RNA, 22 nt, Homo sapiens
uucuggcuaugggauacuaaau

SEQ ID NO: 161428 - RNA, 22 nt, Homo sapiens
uucuggcucaggucaacacuuc

SEQ ID NO: 161429 - RNA, 22 nt, Homo sapiens
uucuggcucgauucucugaccg

SEQ ID NO: 161430 - RNA, 22 nt, Homo sapiens
uucuuugcaugaucucaaaguc

SEQ ID NO: 161431 - RNA, 22 nt, Homo sapiens
uugaauagcauguuuagugcau

SEQ ID NO: 161432 - RNA, 22 nt, Homo sapiens
uugacaguugggcagggaaguu

SEQ ID NO: 161433 - RNA, 22 nt, Homo sapiens
uugacauugcuguaguguccag

SEQ ID NO: 161434 - RNA, 22 nt, Homo sapiens
uugaccuggagaguacuuugac

SEQ ID NO: 161435 - RNA, 22 nt, Homo sapiens
uugagagaaaaggccaugccuu

SEQ ID NO: 161436 - RNA, 17 nt, Homo sapiens
uugagaguauaucuuac

SEQ ID NO: 161437 - RNA, 22 nt, Homo sapiens
uugagaucaugcuacugcacuc

SEQ ID NO: 161438 - RNA, 22 nt, Homo sapiens
uugagaugaagucuugcucucu

SEQ ID NO: 161439 - RNA, 22 nt, Homo sapiens
uugagaugaaguuuugcucuuu

SEQ ID NO: 161440 - RNA, 22 nt, Homo sapiens
uugagauggagucucacgcauu

SEQ ID NO: 161441 - RNA, 22 nt, Homo sapiens
uugagauggagucucacugugu

SEQ ID NO: 161442 - RNA, 22 nt, Homo sapiens
uugagauggagucucgcacugu

SEQ ID NO: 161443 - RNA, 22 nt, Homo sapiens
uugagauggagucuugcgcugu

SEQ ID NO: 161444 - RNA, 22 nt, Homo sapiens
uugagauggagucuugcucucu

SEQ ID NO: 161445 - RNA, 22 nt, Homo sapiens
uugagauggagucuuguucucu

SEQ ID NO: 161446 - RNA, 22 nt, Homo sapiens
uugagauggagucuuguucuuu

SEQ ID NO: 161447 - RNA, 22 nt, Homo sapiens
uugagauggaguguugcucugu

SEQ ID NO: 161448 - RNA, 22 nt, Homo sapiens
uugagcaccaugccuggccaug

SEQ ID NO: 161449 - RNA, 23 nt, Homo sapiens
uugaggcauguaccaucaauauc

SEQ ID NO: 161450 - RNA, 22 nt, Homo sapiens
uugagggaagccagaggucugc

SEQ ID NO: 161451 - RNA, 20 nt, Homo sapiens
uugaggucaggaguuuggga

SEQ ID NO: 161452 - RNA, 22 nt, Homo sapiens
ucugagcaugcaucuugccugg

SEQ ID NO: 161453 - RNA, 20 nt, Homo sapiens
ucuggccccucuaaaucuca

SEQ ID NO: 161454 - RNA, 22 nt, Homo sapiens
ucuggcuuuagcaugugggaag

SEQ ID NO: 161455 - RNA, 22 nt, Homo sapiens
ucuguaguuaacagcuucagcu

SEQ ID NO: 161456 - RNA, 22 nt, Homo sapiens
ucugucuugugguuugagugcc

SEQ ID NO: 161457 - RNA, 22 nt, Homo sapiens
ucugugcuugucauaugcuuug

SEQ ID NO: 161458 - RNA, 19 nt, Homo sapiens
ucugugcuugucccccugu

SEQ ID NO: 161459 - RNA, 22 nt, Homo sapiens
ucuguugguucuuugaggagga

SEQ ID NO: 161460 - RNA, 22 nt, Homo sapiens
ucuuggcaaagaauuuuuggcu

SEQ ID NO: 161461 - RNA, 22 nt, Homo sapiens
ucuuggccaugaauggcaaggc

SEQ ID NO: 161462 - RNA, 22 nt, Homo sapiens
ucuuucacuuagcaugauguuu

SEQ ID NO: 161463 - RNA, 22 nt, Homo sapiens
ucuuuguugcauaggcuuguuc

SEQ ID NO: 161464 - RNA, 22 nt, Homo sapiens
ugaaacacacauugcccuuuau

SEQ ID NO: 161465 - RNA, 22 nt, Homo sapiens
ugaaacacaccuccucuccauc

SEQ ID NO: 161466 - RNA, 18 nt, Homo sapiens
ugaaacacauuuuuuccu

SEQ ID NO: 161467 - RNA, 22 nt, Homo sapiens
ugaaggccgggcaugguggcuc

SEQ ID NO: 161468 - RNA, 22 nt, Homo sapiens
ugaagugaaugguaaguaugcc

SEQ ID NO: 161469 - RNA, 22 nt, Homo sapiens
ugaaugcaucuagaaauuuauu

SEQ ID NO: 161470 - RNA, 22 nt, Homo sapiens
ugaaugcauggggccaagaagg

SEQ ID NO: 161471 - RNA, 22 nt, Homo sapiens
ugaauguacuuaacacuggauu

SEQ ID NO: 161472 - RNA, 22 nt, Homo sapiens
ugacagagcaggacuucaucuc

SEQ ID NO: 161473 - RNA, 22 nt, Homo sapiens
ugacagugaacagguuaccacu

SEQ ID NO: 161474 - RNA, 22 nt, Homo sapiens
ugacaugaugagcaauaauggc

SEQ ID NO: 161475 - RNA, 22 nt, Homo sapiens
ugacauggugcucuuucaggca

SEQ ID NO: 161476 - RNA, 22 nt, Homo sapiens
ugacauguccaggugguccugu

SEQ ID NO: 161477 - RNA, 22 nt, Homo sapiens
ugacauguugcauuauauuucc

SEQ ID NO: 161478 - RNA, 21 nt, Homo sapiens
ugacauguugguuugcugcac

SEQ ID NO: 161479 - RNA, 22 nt, Homo sapiens
ugacugguguuuaaugagucaa

SEQ ID NO: 161480 - RNA, 21 nt, Homo sapiens
ugagaacaacaggucaagcag

SEQ ID NO: 161481 - RNA, 20 nt, Homo sapiens
ugagaacauguggcauuugg

SEQ ID NO: 161482 - RNA, 22 nt, Homo sapiens
ugagaagugauauagaaguuaa

SEQ ID NO: 161483 - RNA, 22 nt, Homo sapiens
ugagacggagucuugcucuguc

SEQ ID NO: 161484 - RNA, 22 nt, Homo sapiens
ugagacugagucucgcucuauu

SEQ ID NO: 161485 - RNA, 22 nt, Homo sapiens
ugagacugaguuuccaucuugu

SEQ ID NO: 161486 - RNA, 22 nt, Homo sapiens
ugagacugguaauguguagggc

SEQ ID NO: 161487 - RNA, 22 nt, Homo sapiens
ugagagacauuuguuguagagu

SEQ ID NO: 161488 - RNA, 19 nt, Homo sapiens
ugagaucuuuacuggguuu

SEQ ID NO: 161489 - RNA, 19 nt, Homo sapiens
ugagaugaagacagggguu

SEQ ID NO: 161490 - RNA, 22 nt, Homo sapiens
ugagaugagggaagccuaggca

SEQ ID NO: 161491 - RNA, 22 nt, Homo sapiens
ugagaugaggucucacucuguu

SEQ ID NO: 161492 - RNA, 22 nt, Homo sapiens
ugagaugaggucucgcucuguc

SEQ ID NO: 161493 - RNA, 22 nt, Homo sapiens
ugagaugaguucucgcucuguc

SEQ ID NO: 161494 - RNA, 22 nt, Homo sapiens
ugagaugauagauauguuaauu

SEQ ID NO: 161495 - RNA, 22 nt, Homo sapiens
ugagaugaucaaaguauaggcu

SEQ ID NO: 161496 - RNA, 22 nt, Homo sapiens
ugagauguagauauggauuaga

SEQ ID NO: 161497 - RNA, 22 nt, Homo sapiens
ugagauuaaucuuuaaguaaga

SEQ ID NO: 161498 - RNA, 22 nt, Homo sapiens
ugagcaagaaauagaaacagau

SEQ ID NO: 161499 - RNA, 17 nt, Homo sapiens
ugagcuaugauccuguc

SEQ ID NO: 161500 - RNA, 22 nt, Homo sapiens
ugagcugagaucuuaccacugc

SEQ ID NO: 161501 - RNA, 22 nt, Homo sapiens
ugaggcaaggcugaaugaaggc

SEQ ID NO: 161502 - RNA, 22 nt, Homo sapiens
ugagguuggggucagggcuagc

SEQ ID NO: 161503 - RNA, 22 nt, Homo sapiens
ugagguuggguaauuuaugaag

SEQ ID NO: 161504 - RNA, 23 nt, Homo sapiens
ugaguagguccacguaugugagu

SEQ ID NO: 161505 - RNA, 22 nt, Homo sapiens
ugaguagugcugcaauaaacau

SEQ ID NO: 161506 - RNA, 22 nt, Homo sapiens
ugaguauguaggaugugucuua

SEQ ID NO: 161507 - RNA, 22 nt, Homo sapiens
ugagugccuggagggcagggac

SEQ ID NO: 161508 - RNA, 20 nt, Homo sapiens
ugaguuccuuguucagaagc

SEQ ID NO: 161509 - RNA, 22 nt, Homo sapiens
ugaguuccuuucccaguccagu

SEQ ID NO: 161510 - RNA, 22 nt, Homo sapiens
ugauagugccuuuuauaucucu

SEQ ID NO: 161511 - RNA, 22 nt, Homo sapiens
ugauauauugaaugaugaaaca

SEQ ID NO: 161512 - RNA, 22 nt, Homo sapiens
ugauaugaaagggaaauaagug

SEQ ID NO: 161513 - RNA, 23 nt, Homo sapiens
ugauaugccuaggaguauauuuu

SEQ ID NO: 161514 - RNA, 21 nt, Homo sapiens
ugauaugguuuggauaugugu

SEQ ID NO: 161515 - RNA, 21 nt, Homo sapiens
ugaugcuuuucuuaaccuugc

SEQ ID NO: 161516 - RNA, 22 nt, Homo sapiens
ugauuuguuuagugccaaguuu

SEQ ID NO: 161517 - RNA, 22 nt, Homo sapiens
ugcaagacugcaguuacuuuug

SEQ ID NO: 161518 - RNA, 17 nt, Homo sapiens
ugcaauuuaagcuagau

SEQ ID NO: 161519 - RNA, 22 nt, Homo sapiens
ugcacaguccagugcccacuga

SEQ ID NO: 161520 - RNA, 22 nt, Homo sapiens
ugcacuguggucugagagacag

SEQ ID NO: 161521 - RNA, 22 nt, Homo sapiens
ugcauccauucuagacucaucu

SEQ ID NO: 161522 - RNA, 22 nt, Homo sapiens
ugcauugccgugauuacugucu

SEQ ID NO: 161523 - RNA, 21 nt, Homo sapiens
ugcauugucuugaguuuaaau

SEQ ID NO: 161524 - RNA, 21 nt, Homo sapiens
ugcauuguugcugagagcagg

SEQ ID NO: 161525 - RNA, 22 nt, Homo sapiens
ugccaguuuuuacauuuccugu

SEQ ID NO: 161526 - RNA, 22 nt, Homo sapiens
ugccuaggcuggagugcagugg

SEQ ID NO: 161527 - RNA, 22 nt, Homo sapiens
ugccuaguagaaggugaacaug

SEQ ID NO: 161528 - RNA, 22 nt, Homo sapiens
ugcgccauugcacucuagccug

SEQ ID NO: 161529 - RNA, 22 nt, Homo sapiens
ugcuguuguuugaugaaguaau

SEQ ID NO: 161530 - RNA, 21 nt, Homo sapiens
ugcuuuggucauacuucuucc

SEQ ID NO: 161531 - RNA, 22 nt, Homo sapiens
uggaaguaaucaugagguagca

SEQ ID NO: 161532 - RNA, 23 nt, Homo sapiens
uggaaguauggaggaggcagaau

SEQ ID NO: 161533 - RNA, 20 nt, Homo sapiens
uggaaucuaggcggagguuu

SEQ ID NO: 161534 - RNA, 22 nt, Homo sapiens
uggacuagagggugggcgaggu

SEQ ID NO: 161535 - RNA, 18 nt, Homo sapiens
uggagauaagaagaacuu

SEQ ID NO: 161536 - RNA, 22 nt, Homo sapiens
uggagcccuaguuccucauaac

SEQ ID NO: 161537 - RNA, 22 nt, Homo sapiens
uggagguagagaugggaucucc

SEQ ID NO: 161538 - RNA, 22 nt, Homo sapiens
uggcaaagugugacgugggggu

SEQ ID NO: 161539 - RNA, 22 nt, Homo sapiens
uggcaacaucuggggacauguu

SEQ ID NO: 161540 - RNA, 22 nt, Homo sapiens
uggcaagaacugcaauugcuuu

SEQ ID NO: 161541 - RNA, 22 nt, Homo sapiens
uggcaagagaacaacaucucuc

SEQ ID NO: 161542 - RNA, 22 nt, Homo sapiens
uggcagauggugacaccauuag

SEQ ID NO: 161543 - RNA, 22 nt, Homo sapiens
uggcaguuuacagcuuuaggag

SEQ ID NO: 161544 - RNA, 22 nt, Homo sapiens
uggcaguuucacauggcucaac

SEQ ID NO: 161545 - RNA, 23 nt, Homo sapiens
uggcuagacguccuuuccugaug

SEQ ID NO: 161546 - RNA, 19 nt, Homo sapiens
uggcuagaggccaggcguu

SEQ ID NO: 161547 - RNA, 22 nt, Homo sapiens
ugguaaaaugucauuuaccaga

SEQ ID NO: 161548 - RNA, 23 nt, Homo sapiens
ugguaacauguuguggcagggga

SEQ ID NO: 161549 - RNA, 22 nt, Homo sapiens
ugguaugucuagauggggaagu

SEQ ID NO: 161550 - RNA, 22 nt, Homo sapiens
uggugagaaaagaugucuuugu

SEQ ID NO: 161551 - RNA, 21 nt, Homo sapiens
ugguugauccuccuagugccu

SEQ ID NO: 161552 - RNA, 22 nt, Homo sapiens
uaagagagcuccaucuuuuccu

SEQ ID NO: 161553 - RNA, 22 nt, Homo sapiens
uaagagcuaggauuuuaaauca

SEQ ID NO: 161554 - RNA, 22 nt, Homo sapiens
uaauaauguuaggcuuacucaa

SEQ ID NO: 161555 - RNA, 22 nt, Homo sapiens
uaauagcaguguuacuaggacu

SEQ ID NO: 161556 - RNA, 22 nt, Homo sapiens
uaauaguuggcacuggagaaag

SEQ ID NO: 161557 - RNA, 22 nt, Homo sapiens
uaauccuagcacuuuggaagac

SEQ ID NO: 161558 - RNA, 22 nt, Homo sapiens
uacagaauugcagguguggcag

SEQ ID NO: 161559 - RNA, 22 nt, Homo sapiens
uacaggcaccuggcuaauuuuu

SEQ ID NO: 161560 - RNA, 22 nt, Homo sapiens
uacagucacauuccugaccaua

SEQ ID NO: 161561 - RNA, 20 nt, Homo sapiens
ucaaggcacgaauaaaaguu

SEQ ID NO: 161562 - RNA, 22 nt, Homo sapiens
ucaaggcacuagcugagcugca

SEQ ID NO: 161563 - RNA, 22 nt, Homo sapiens
ucaagugauucuugugccuuag

SEQ ID NO: 161564 - RNA, 22 nt, Homo sapiens
ucacaauggcugaacuaauuua

SEQ ID NO: 161565 - RNA, 22 nt, Homo sapiens
ucacaauucucaauuugugaaa

SEQ ID NO: 161566 - RNA, 22 nt, Homo sapiens
ucacagugcaggaucaguuaau

SEQ ID NO: 161567 - RNA, 17 nt, Homo sapiens
ucacaguguuaggauga

SEQ ID NO: 161568 - RNA, 22 nt, Homo sapiens
ucacauuguacaaacagguaag

SEQ ID NO: 161569 - RNA, 22 nt, Homo sapiens
ucacauuguauauguaccuauc

SEQ ID NO: 161570 - RNA, 22 nt, Homo sapiens
ucacugaaaccgccuccaccuc

SEQ ID NO: 161571 - RNA, 22 nt, Homo sapiens
ucacugcacuccagccuuuaug

SEQ ID NO: 161572 - RNA, 22 nt, Homo sapiens
ucacugcgaccuccaccucccg

SEQ ID NO: 161573 - RNA, 22 nt, Homo sapiens
ucacugcgaccuccaccuccug

SEQ ID NO: 161574 - RNA, 22 nt, Homo sapiens
ucacugcgaccuccgccucccg

SEQ ID NO: 161575 - RNA, 22 nt, Homo sapiens
ucacugcgaccucugccucccg

SEQ ID NO: 161576 - RNA, 22 nt, Homo sapiens
ucacugcgcuucagccugggug

SEQ ID NO: 161577 - RNA, 22 nt, Homo sapiens
ucacuggagguuccugaaguuc

SEQ ID NO: 161578 - RNA, 22 nt, Homo sapiens
ucacugugagaguuuauccugu

SEQ ID NO: 161579 - RNA, 22 nt, Homo sapiens
ucacugugcaugaaggaugcug

SEQ ID NO: 161580 - RNA, 18 nt, Homo sapiens
ucacugugugucuugggu

SEQ ID NO: 161581 - RNA, 22 nt, Homo sapiens
ucacuuugacggccaacuucua

SEQ ID NO: 161582 - RNA, 22 nt, Homo sapiens
ucacuuuguuuuuggauaaguu

SEQ ID NO: 161583 - RNA, 22 nt, Homo sapiens
ucagcacauucaaggccugccu

SEQ ID NO: 161584 - RNA, 22 nt, Homo sapiens
ucagcagucacuccuaugacaa

SEQ ID NO: 161585 - RNA, 20 nt, Homo sapiens
ucagcagucuggagcagagg

SEQ ID NO: 161586 - RNA, 22 nt, Homo sapiens
ucagcagugccccacucuacug

SEQ ID NO: 161587 - RNA, 22 nt, Homo sapiens
ucaguaaauguuaggacauuuc

SEQ ID NO: 161588 - RNA, 22 nt, Homo sapiens
ucaguaguaaauggauuuggaa

SEQ ID NO: 161589 - RNA, 22 nt, Homo sapiens
ucagugaacgaggaggagggug

SEQ ID NO: 161590 - RNA, 23 nt, Homo sapiens
ucagugaaggaacaacuaaauag

SEQ ID NO: 161591 - RNA, 22 nt, Homo sapiens
ucagugauugcuuucauggaaa

SEQ ID NO: 161592 - RNA, 22 nt, Homo sapiens
ucagugauugguuauuuuaggc

SEQ ID NO: 161593 - RNA, 22 nt, Homo sapiens
ucauacuguuaaaugguuuagu

SEQ ID NO: 161594 - RNA, 22 nt, Homo sapiens
ucauagucuaagguucuuuugc

SEQ ID NO: 161595 - RNA, 20 nt, Homo sapiens
ucaucaguuggugcucgcug

SEQ ID NO: 161596 - RNA, 22 nt, Homo sapiens
ucaucuggcgaaugugaagagu

SEQ ID NO: 161597 - RNA, 22 nt, Homo sapiens
ucauguaauuuugugucuauga

SEQ ID NO: 161598 - RNA, 22 nt, Homo sapiens
ucaugugagcacagagcaagau

SEQ ID NO: 161599 - RNA, 22 nt, Homo sapiens
ucauuagagaucuuggggaaaa

SEQ ID NO: 161600 - RNA, 22 nt, Homo sapiens
ucauucacucccuugaaguuag

SEQ ID NO: 161601 - RNA, 22 nt, Homo sapiens
ucauucauuugcucacuccaca

SEQ ID NO: 161602 - RNA, 22 nt, Homo sapiens
uccacaguggugaggugcagca

SEQ ID NO: 161603 - RNA, 22 nt, Homo sapiens
uccagguacucagggggcugag

SEQ ID NO: 161604 - RNA, 22 nt, Homo sapiens
uccauaguacuagaaacugacc

SEQ ID NO: 161605 - RNA, 22 nt, Homo sapiens
uccauagugagcagucaaugua

SEQ ID NO: 161606 - RNA, 23 nt, Homo sapiens
ucccaagauggaccagaccaagg

SEQ ID NO: 161607 - RNA, 22 nt, Homo sapiens
ucccacugucuucucgugcucg

SEQ ID NO: 161608 - RNA, 22 nt, Homo sapiens
ucccuacuggggcacugccuag

SEQ ID NO: 161609 - RNA, 22 nt, Homo sapiens
ucccugagcaaaguuuucugua

SEQ ID NO: 161610 - RNA, 22 nt, Homo sapiens
ucccugagugauugaaaauaaa

SEQ ID NO: 161611 - RNA, 22 nt, Homo sapiens
ucccuguuguuucauaauuuua

SEQ ID NO: 161612 - RNA, 22 nt, Homo sapiens
uccuggcuccacuguuuauucc

SEQ ID NO: 161613 - RNA, 22 nt, Homo sapiens
uccuucaugcaucaauguaucc

SEQ ID NO: 161614 - RNA, 22 nt, Homo sapiens
uccuucauuugucaacucuagu

SEQ ID NO: 161615 - RNA, 19 nt, Homo sapiens
ucgcgccauucuccugccu

SEQ ID NO: 161616 - RNA, 22 nt, Homo sapiens
ucuaaggcaccuagagucauca

SEQ ID NO: 161617 - RNA, 17 nt, Homo sapiens
ucuaauaauaugcauuu

SEQ ID NO: 161618 - RNA, 22 nt, Homo sapiens
ucuauguuuuugcuaguagugu

SEQ ID NO: 161619 - RNA, 22 nt, Homo sapiens
ucucacaccccucucauauacc

SEQ ID NO: 161620 - RNA, 22 nt, Homo sapiens
ucucacacugaauguguguggg

SEQ ID NO: 161621 - RNA, 18 nt, Homo sapiens
ucucacagcaaucuguca

SEQ ID NO: 161622 - RNA, 20 nt, Homo sapiens
ucucauagagguagagaaua

SEQ ID NO: 161623 - RNA, 22 nt, Homo sapiens
ucucaugaagauagagaauaga

SEQ ID NO: 161624 - RNA, 22 nt, Homo sapiens
ucucaugaagguggagaguagg

SEQ ID NO: 161625 - RNA, 22 nt, Homo sapiens
ucucugauuaaacaagauagug

SEQ ID NO: 161626 - RNA, 22 nt, Homo sapiens
ucucuuggcggaaguugcagug

SEQ ID NO: 161627 - RNA, 22 nt, Homo sapiens
ucugccuacugguuggaggaac

SEQ ID NO: 161628 - RNA, 23 nt, Homo sapiens
ucugcggguguggacccuagugc

SEQ ID NO: 161629 - RNA, 22 nt, Homo sapiens
ucuggaauguaaaguuuauggg

SEQ ID NO: 161630 - RNA, 21 nt, Homo sapiens
ucuggcccccucaaaucucau

SEQ ID NO: 161631 - RNA, 20 nt, Homo sapiens
ucuggccccuccaaaucuca

SEQ ID NO: 161632 - RNA, 22 nt, Homo sapiens
ucuggccccucccaaaucucau

SEQ ID NO: 161633 - RNA, 21 nt, Homo sapiens
ucuggcuuucauuccccuucu

SEQ ID NO: 161634 - RNA, 22 nt, Homo sapiens
ucuucaugcuugaaauaauagc

SEQ ID NO: 161635 - RNA, 22 nt, Homo sapiens
ucuugaacuucauaggucuaga

SEQ ID NO: 161636 - RNA, 22 nt, Homo sapiens
ucuugaacuucugcacacucag

SEQ ID NO: 161637 - RNA, 22 nt, Homo sapiens
ucuugcuuguuguucccuucau

SEQ ID NO: 161638 - RNA, 22 nt, Homo sapiens
ucuuugguuagguuuaguugau

SEQ ID NO: 161639 - RNA, 22 nt, Homo sapiens
ucuuuguuggaguccaaggaua

SEQ ID NO: 161640 - RNA, 22 nt, Homo sapiens
ugaaacauacacucugaugggg

SEQ ID NO: 161641 - RNA, 22 nt, Homo sapiens
ugaaaucuaaaauguuccaaga

SEQ ID NO: 161642 - RNA, 22 nt, Homo sapiens
ugaaaugaucaguuugguuacu

SEQ ID NO: 161643 - RNA, 22 nt, Homo sapiens
ugaaaugccuuuaaugaauuua

SEQ ID NO: 161644 - RNA, 22 nt, Homo sapiens
ugaaauguaaguugucuagucu

SEQ ID NO: 161645 - RNA, 22 nt, Homo sapiens
ugaaauguuaaacaaguggcuc

SEQ ID NO: 161646 - RNA, 22 nt, Homo sapiens
ugaaauguugggugauggaauc

SEQ ID NO: 161647 - RNA, 20 nt, Homo sapiens
ugaacugguuacuuucuguc

SEQ ID NO: 161648 - RNA, 22 nt, Homo sapiens
ugaagacauuuuugggugugua

SEQ ID NO: 161649 - RNA, 22 nt, Homo sapiens
ugaagcuaacuugauugugaug

SEQ ID NO: 161650 - RNA, 22 nt, Homo sapiens
ugaagugggaaaugaguauuaa

SEQ ID NO: 161651 - RNA, 22 nt, Homo sapiens
ugaauagacacuaaagacugua

SEQ ID NO: 161652 - RNA, 20 nt, Homo sapiens
ugaauguaauuacagaugua

SEQ ID NO: 161653 - RNA, 22 nt, Homo sapiens
ugaauuguuucauucuuuacau

SEQ ID NO: 161654 - RNA, 22 nt, Homo sapiens
ugacaagaguagagagggugcc

SEQ ID NO: 161655 - RNA, 20 nt, Homo sapiens
ugacaaggugcaaagaauca

SEQ ID NO: 161656 - RNA, 22 nt, Homo sapiens
ugacacuugcccuuagaaacau

SEQ ID NO: 161657 - RNA, 22 nt, Homo sapiens
ugacaggucuaauuuacugaca

SEQ ID NO: 161658 - RNA, 22 nt, Homo sapiens
ugacauuacagucacuugcugu

SEQ ID NO: 161659 - RNA, 22 nt, Homo sapiens
ugacauugggagugaagugaag

SEQ ID NO: 161660 - RNA, 19 nt, Homo sapiens
ugaccagggacagaaacca

SEQ ID NO: 161661 - RNA, 22 nt, Homo sapiens
ugacggaggcauuggaagcuug

SEQ ID NO: 161662 - RNA, 22 nt, Homo sapiens
ugacuaggaggcuggaggauga

SEQ ID NO: 161663 - RNA, 22 nt, Homo sapiens
ugacuaggggcccuggcuucuu

SEQ ID NO: 161664 - RNA, 22 nt, Homo sapiens
ugacucaguuguuagucuucau

SEQ ID NO: 161665 - RNA, 22 nt, Homo sapiens
ugacuugaaguuaccauaugca

SEQ ID NO: 161666 - RNA, 22 nt, Homo sapiens
ugacuugaggcucgcacaaguu

SEQ ID NO: 161667 - RNA, 22 nt, Homo sapiens
ugacuugauccauggggcucca

SEQ ID NO: 161668 - RNA, 22 nt, Homo sapiens
ugagacugaaauuaggaaacug

SEQ ID NO: 161669 - RNA, 22 nt, Homo sapiens
ugagacugagucuugcucuugu

SEQ ID NO: 161670 - RNA, 22 nt, Homo sapiens
ugagacugaguuuugcucguug

SEQ ID NO: 161671 - RNA, 22 nt, Homo sapiens
ugagagcuuugaugcacuguuu

SEQ ID NO: 161672 - RNA, 22 nt, Homo sapiens
ugagauaaucaugugauuucau

SEQ ID NO: 161673 - RNA, 22 nt, Homo sapiens
ugagaucuuggaggcuuuguga

SEQ ID NO: 161674 - RNA, 22 nt, Homo sapiens
ugagaugaagugauguaaaaca

SEQ ID NO: 161675 - RNA, 22 nt, Homo sapiens
ugagaugaguugcgcucugucg

SEQ ID NO: 161676 - RNA, 21 nt, Homo sapiens
ugagaugugaccagggcauca

SEQ ID NO: 161677 - RNA, 22 nt, Homo sapiens
ugagcaauaaaguuacacaguu

SEQ ID NO: 161678 - RNA, 22 nt, Homo sapiens
ugagcacaggugcgcgguuacu

SEQ ID NO: 161679 - RNA, 22 nt, Homo sapiens
ugagcacauuuacaucaguucc

SEQ ID NO: 161680 - RNA, 22 nt, Homo sapiens
ugagcagaaguuuugauuggcg

SEQ ID NO: 161681 - RNA, 22 nt, Homo sapiens
ugagcagagaagugcccugcgc

SEQ ID NO: 161682 - RNA, 22 nt, Homo sapiens
ugagccauggcaccuugucuaa

SEQ ID NO: 161683 - RNA, 22 nt, Homo sapiens
ugagcuaagugccaauauuaau

SEQ ID NO: 161684 - RNA, 22 nt, Homo sapiens
ugagcuagggccuggaauaggg

SEQ ID NO: 161685 - RNA, 20 nt, Homo sapiens
ugagcuauauauguccuuga

SEQ ID NO: 161686 - RNA, 22 nt, Homo sapiens
ugagcugagacaauaaguuuuu

SEQ ID NO: 161687 - RNA, 22 nt, Homo sapiens
ugagcugagaucacacuacugu

SEQ ID NO: 161688 - RNA, 18 nt, Homo sapiens
ugaggaaaggguuugcua

SEQ ID NO: 161689 - RNA, 22 nt, Homo sapiens
ugaggaaugaccccgugugguc

SEQ ID NO: 161690 - RNA, 22 nt, Homo sapiens
ugagguagaggugaacuugacc

SEQ ID NO: 161691 - RNA, 22 nt, Homo sapiens
ugaggucauguucugucagguu

SEQ ID NO: 161692 - RNA, 22 nt, Homo sapiens
ugaguauguuuagaaguaaagg

SEQ ID NO: 161693 - RNA, 22 nt, Homo sapiens
ugagugaaggggcucuguugug

SEQ ID NO: 161694 - RNA, 22 nt, Homo sapiens
ugaguucaugcuuguaguucua

SEQ ID NO: 161695 - RNA, 22 nt, Homo sapiens
ugaguuccuugugugaccuugc

SEQ ID NO: 161696 - RNA, 22 nt, Homo sapiens
ugauaucugaauagauacacaa

SEQ ID NO: 161697 - RNA, 22 nt, Homo sapiens
ugauaugugaguauaugguuau

SEQ ID NO: 161698 - RNA, 22 nt, Homo sapiens
ugaugcugaguggcuauuugaa

SEQ ID NO: 161699 - RNA, 22 nt, Homo sapiens
ugaugcugaugccugccagaag

SEQ ID NO: 161700 - RNA, 23 nt, Homo sapiens
ugauguccacuuagggucuaggu

SEQ ID NO: 161701 - RNA, 20 nt, Homo sapiens
ugauguccaggcagagguuu

SEQ ID NO: 161702 - RNA, 22 nt, Homo sapiens
ugauuggagaacaaacugcaua

SEQ ID NO: 161703 - RNA, 22 nt, Homo sapiens
ugauuguucuguccccaggggc

SEQ ID NO: 161704 - RNA, 22 nt, Homo sapiens
ugcaagaaucuuucaggcuagc

SEQ ID NO: 161705 - RNA, 22 nt, Homo sapiens
ugcaagaggagacuguacucag

SEQ ID NO: 161706 - RNA, 22 nt, Homo sapiens
ugcaauauccucuacuauaggu

SEQ ID NO: 161707 - RNA, 22 nt, Homo sapiens
ugcaccauugcauuccagccug

SEQ ID NO: 161708 - RNA, 22 nt, Homo sapiens
ugcaguuuaggaacugguaaca

SEQ ID NO: 161709 - RNA, 22 nt, Homo sapiens
ugcauggauguuugaacacacu

SEQ ID NO: 161710 - RNA, 22 nt, Homo sapiens
ugcauggucauacauggcaccc

SEQ ID NO: 161711 - RNA, 22 nt, Homo sapiens
ugcauguucuuacucauacaug

SEQ ID NO: 161712 - RNA, 22 nt, Homo sapiens
ugcauuguggaucuaaaugcau

SEQ ID NO: 161713 - RNA, 22 nt, Homo sapiens
ugccaguguuuuguugaagauu

SEQ ID NO: 161714 - RNA, 22 nt, Homo sapiens
ugccuacagaaggggcucagca

SEQ ID NO: 161715 - RNA, 22 nt, Homo sapiens
ugccuaggcuggaaugcagugg

SEQ ID NO: 161716 - RNA, 21 nt, Homo sapiens
ugccuuuguaguaggugucuu

SEQ ID NO: 161717 - RNA, 22 nt, Homo sapiens
ugcgccauugcacuccagucuu

SEQ ID NO: 161718 - RNA, 22 nt, Homo sapiens
ugcgccauugcauuccagccug

SEQ ID NO: 161719 - RNA, 22 nt, Homo sapiens
ugcuagaagaucacacacauca

SEQ ID NO: 161720 - RNA, 22 nt, Homo sapiens
ugcuaugucuucucucacagag

SEQ ID NO: 161721 - RNA, 22 nt, Homo sapiens
ugcugcuguuguuguuacuagc

SEQ ID NO: 161722 - RNA, 22 nt, Homo sapiens
ugcuggugauuaaauccugaag

SEQ ID NO: 161723 - RNA, 22 nt, Homo sapiens
ugcuguguugcuggcuuaaaga

SEQ ID NO: 161724 - RNA, 22 nt, Homo sapiens
ugcuucauuggccaccaggaag

SEQ ID NO: 161725 - RNA, 22 nt, Homo sapiens
uggaagguaaguuuugagcauu

SEQ ID NO: 161726 - RNA, 20 nt, Homo sapiens
uggaaucugaagaucucagu

SEQ ID NO: 161727 - RNA, 22 nt, Homo sapiens
uggaauguagcguugacacgag

SEQ ID NO: 161728 - RNA, 21 nt, Homo sapiens
uggaauuaauggagagguguu

SEQ ID NO: 161729 - RNA, 22 nt, Homo sapiens
uggagacaaagauagaaaagca

SEQ ID NO: 161730 - RNA, 20 nt, Homo sapiens
uggagugaagguucuggacc

SEQ ID NO: 161731 - RNA, 22 nt, Homo sapiens
uggagugagaacuucaaugaug

SEQ ID NO: 161732 - RNA, 22 nt, Homo sapiens
uggagugauaugguuauauggg

SEQ ID NO: 161733 - RNA, 22 nt, Homo sapiens
uggauagaacuaagugcuuaga

SEQ ID NO: 161734 - RNA, 22 nt, Homo sapiens
uggauagauacuauccaggacu

SEQ ID NO: 161735 - RNA, 22 nt, Homo sapiens
uggauauguuuauuacccugaa

SEQ ID NO: 161736 - RNA, 22 nt, Homo sapiens
uggaugaagagaugguaguugc

SEQ ID NO: 161737 - RNA, 22 nt, Homo sapiens
uggcaagaaccacaauuacuuu

SEQ ID NO: 161738 - RNA, 22 nt, Homo sapiens
uggcaagaacgaaauguagggu

SEQ ID NO: 161739 - RNA, 22 nt, Homo sapiens
uggcaagaagagcaugagacca

SEQ ID NO: 161740 - RNA, 22 nt, Homo sapiens
uggcaagaccccaucucuacaa

SEQ ID NO: 161741 - RNA, 22 nt, Homo sapiens
uggcaagagggaugcaagguuu

SEQ ID NO: 161742 - RNA, 22 nt, Homo sapiens
uggcaguuuacaaaugccauga

SEQ ID NO: 161743 - RNA, 22 nt, Homo sapiens
uggcaucuguucuacacauaaa

SEQ ID NO: 161744 - RNA, 22 nt, Homo sapiens
uggccaguguuuuuccugggcu

SEQ ID NO: 161745 - RNA, 22 nt, Homo sapiens
uggcuagaccugcauaacagcu

SEQ ID NO: 161746 - RNA, 22 nt, Homo sapiens
uggcucauuucuaaacccagcu

SEQ ID NO: 161747 - RNA, 22 nt, Homo sapiens
uggcucuguuuguuaacuagac

SEQ ID NO: 161748 - RNA, 22 nt, Homo sapiens
ugggaucagcugggcucucugu

SEQ ID NO: 161749 - RNA, 22 nt, Homo sapiens
ugggaucauucaaugacgaaau

SEQ ID NO: 161750 - RNA, 22 nt, Homo sapiens
ugggguaggcuguauacucugu

SEQ ID NO: 161751 - RNA, 22 nt, Homo sapiens
uggggugugagggagaaagaaa

SEQ ID NO: 161752 - RNA, 22 nt, Homo sapiens
uggguagagaaucaggaucuua

SEQ ID NO: 161753 - RNA, 22 nt, Homo sapiens
uggguagagcacugggggcgag

SEQ ID NO: 161754 - RNA, 22 nt, Homo sapiens
ugguacuucaugcucacagaua

SEQ ID NO: 161755 - RNA, 22 nt, Homo sapiens
uggucaaaucugaugugagaaa

SEQ ID NO: 161756 - RNA, 22 nt, Homo sapiens
uggucuggagagucccgcccag

SEQ ID NO: 161757 - RNA, 22 nt, Homo sapiens
uggucuucuggccuccagaacc

SEQ ID NO: 161758 - RNA, 22 nt, Homo sapiens
uggugagaaaugagaugcuuuu

SEQ ID NO: 161759 - RNA, 22 nt, Homo sapiens
ugguucaguugcacaggcuguu

SEQ ID NO: 161760 - RNA, 22 nt, Homo sapiens
uguacuucaagauuaugguuua

SEQ ID NO: 161761 - RNA, 22 nt, Homo sapiens
uguauauguuuguacauauguc

SEQ ID NO: 161762 - RNA, 22 nt, Homo sapiens
ugucaaaugcagugauauuuga

SEQ ID NO: 161763 - RNA, 22 nt, Homo sapiens
ugucaguuuuaacuagggaaua

SEQ ID NO: 161764 - RNA, 22 nt, Homo sapiens
ugucauguugguguacugcacc

SEQ ID NO: 161765 - RNA, 19 nt, Homo sapiens
ugucccagccauagaggca

SEQ ID NO: 161766 - RNA, 22 nt, Homo sapiens
ugucccaguuggguauugaauu

SEQ ID NO: 161767 - RNA, 22 nt, Homo sapiens
ugucucccuucccauuaggaag

SEQ ID NO: 161768 - RNA, 22 nt, Homo sapiens
ugucugagacuguuuuacuuuc

SEQ ID NO: 161769 - RNA, 22 nt, Homo sapiens
ugugacacugaauggcagaacu

SEQ ID NO: 161770 - RNA, 22 nt, Homo sapiens
ugugacaguuaguuugguguua

SEQ ID NO: 161771 - RNA, 22 nt, Homo sapiens
ugugacucuggcacauggugag

SEQ ID NO: 161772 - RNA, 19 nt, Homo sapiens
ugugacugguugucucgcu

SEQ ID NO: 161773 - RNA, 22 nt, Homo sapiens
ugugauaguuggcuaaagcagu

SEQ ID NO: 161774 - RNA, 22 nt, Homo sapiens
ugugaugauuugauaaacguau

SEQ ID NO: 161775 - RNA, 22 nt, Homo sapiens
ugugaugguuuagcauuuucuu

SEQ ID NO: 161776 - RNA, 22 nt, Homo sapiens
ugugcaaggcucucaaccugug

SEQ ID NO: 161777 - RNA, 22 nt, Homo sapiens
ugugccacugcacuccugggug

SEQ ID NO: 161778 - RNA, 22 nt, Homo sapiens
ugugccacuguucuguaaagug

SEQ ID NO: 161779 - RNA, 22 nt, Homo sapiens
ugugccuacugauagagccaag

SEQ ID NO: 161780 - RNA, 22 nt, Homo sapiens
ugugccuaguaauguguccaga

SEQ ID NO: 161781 - RNA, 22 nt, Homo sapiens
ugugcuaauacauacagugcua

SEQ ID NO: 161782 - RNA, 22 nt, Homo sapiens
uguguaaagcuuguuccagaaa

SEQ ID NO: 161783 - RNA, 22 nt, Homo sapiens
uguguacugcagaguauucugu

SEQ ID NO: 161784 - RNA, 22 nt, Homo sapiens
uguuacagugacuaauguuuua

SEQ ID NO: 161785 - RNA, 22 nt, Homo sapiens
uuaaagcgacucucaugccuca

SEQ ID NO: 161786 - RNA, 22 nt, Homo sapiens
uuaaauacagcaugguguuucu

SEQ ID NO: 161787 - RNA, 22 nt, Homo sapiens
uuaaaugcuagaauuuucuuug

SEQ ID NO: 161788 - RNA, 22 nt, Homo sapiens
uuaagacaccaaucauuggauu

SEQ ID NO: 161789 - RNA, 22 nt, Homo sapiens
uuaagagcauggugccagguug

SEQ ID NO: 161790 - RNA, 22 nt, Homo sapiens
uuaaggcagugucuaugccagu

SEQ ID NO: 161791 - RNA, 22 nt, Homo sapiens
uuaauucugucugcccucaucc

SEQ ID NO: 161792 - RNA, 22 nt, Homo sapiens
uuaauuguccaaguucaucucu

SEQ ID NO: 161793 - RNA, 22 nt, Homo sapiens
uuacaacugucuuacugguuau

SEQ ID NO: 161794 - RNA, 22 nt, Homo sapiens
uuacaaguggcaucucucugga

SEQ ID NO: 161795 - RNA, 21 nt, Homo sapiens
uuacaauggcuccuugaaggu

SEQ ID NO: 161796 - RNA, 22 nt, Homo sapiens
uuacaguagaugaggguauaau

SEQ ID NO: 161797 - RNA, 22 nt, Homo sapiens
uuacaguauugcaaggacuagg

SEQ ID NO: 161798 - RNA, 22 nt, Homo sapiens
uuaccagucuagggcucaguuu

SEQ ID NO: 161799 - RNA, 22 nt, Homo sapiens
uuaccucuguggcucucggacu

SEQ ID NO: 161800 - RNA, 20 nt, Homo sapiens
uuagaguaguaugauuuaua

SEQ ID NO: 161801 - RNA, 22 nt, Homo sapiens
uuagcacauuuccagcacaugg

SEQ ID NO: 161802 - RNA, 22 nt, Homo sapiens
uuagcccaucuugaggaaagua

SEQ ID NO: 161803 - RNA, 22 nt, Homo sapiens
uuagggaggacaguuacaacag

SEQ ID NO: 161804 - RNA, 22 nt, Homo sapiens
uuaguucauugugacuggacuc

SEQ ID NO: 161805 - RNA, 22 nt, Homo sapiens
uuauauguuucuguuuggaggc

SEQ ID NO: 161806 - RNA, 22 nt, Homo sapiens
uuauggccauucuuguaggagu

SEQ ID NO: 161807 - RNA, 22 nt, Homo sapiens
uuauuagguuagugcaaaaguu

SEQ ID NO: 161808 - RNA, 22 nt, Homo sapiens
uuauugaguaaaaagaaugguu

SEQ ID NO: 161809 - RNA, 22 nt, Homo sapiens
uucaagauggccccagugagcc

SEQ ID NO: 161810 - RNA, 22 nt, Homo sapiens
uucaaguaagaaagacaucagg

SEQ ID NO: 161811 - RNA, 22 nt, Homo sapiens
uucaagugguucagaagucuga

SEQ ID NO: 161812 - RNA, 22 nt, Homo sapiens
uucaauuaauauuauacucuca

SEQ ID NO: 161813 - RNA, 22 nt, Homo sapiens
uucacagaguuauuuuuaugcu

SEQ ID NO: 161814 - RNA, 22 nt, Homo sapiens
uucacugcacuccagccugggu

SEQ ID NO: 161815 - RNA, 22 nt, Homo sapiens
uucacugcauuucagccugggc

SEQ ID NO: 161816 - RNA, 22 nt, Homo sapiens
uucacugugugacccugggcca

SEQ ID NO: 161817 - RNA, 22 nt, Homo sapiens
uucagagagggagggauaccua

SEQ ID NO: 161818 - RNA, 22 nt, Homo sapiens
uucaguccauuuccuuggucac

SEQ ID NO: 161819 - RNA, 22 nt, Homo sapiens
uucauaguucuuuuagucauua

SEQ ID NO: 161820 - RNA, 22 nt, Homo sapiens
uucaucaggaauauugaccugu

SEQ ID NO: 161821 - RNA, 22 nt, Homo sapiens
uucaucuggcaauucagagauu

SEQ ID NO: 161822 - RNA, 21 nt, Homo sapiens
uucaucuggccguauuccagg

SEQ ID NO: 161823 - RNA, 22 nt, Homo sapiens
uucauggugguacaaaagcaau

SEQ ID NO: 161824 - RNA, 22 nt, Homo sapiens
uucauguaauauauuucaggcc

SEQ ID NO: 161825 - RNA, 22 nt, Homo sapiens
uucauguaauauuucacagcuu

SEQ ID NO: 161826 - RNA, 22 nt, Homo sapiens
uuccauuuguucggugucgcca

SEQ ID NO: 161827 - RNA, 22 nt, Homo sapiens
uucccagugccaggcacuggga

SEQ ID NO: 161828 - RNA, 22 nt, Homo sapiens
uucccugugguauagaagccgu

SEQ ID NO: 161829 - RNA, 22 nt, Homo sapiens
uuccuacugcccauuaaaaugg

SEQ ID NO: 161830 - RNA, 22 nt, Homo sapiens
uuccugagaucagaauucaaau

SEQ ID NO: 161831 - RNA, 20 nt, Homo sapiens
uuccuuaggcauuggaagaa

SEQ ID NO: 161832 - RNA, 22 nt, Homo sapiens
uuccuugaaacagucaagagaa

SEQ ID NO: 161833 - RNA, 19 nt, Homo sapiens
uucucugguuguacuaccc

SEQ ID NO: 161834 - RNA, 23 nt, Homo sapiens
uucugccacugaaaaugccucag

SEQ ID NO: 161835 - RNA, 22 nt, Homo sapiens
uucuggcuuuuaaagaaauguu

SEQ ID NO: 161836 - RNA, 19 nt, Homo sapiens
uucugguguuuuaagccaa

SEQ ID NO: 161837 - RNA, 22 nt, Homo sapiens
uugaaggaggugcucacucucg

SEQ ID NO: 161838 - RNA, 22 nt, Homo sapiens
uugaaguagcauuucaugucua

SEQ ID NO: 161839 - RNA, 22 nt, Homo sapiens
uugaaguguguauacauugugg

SEQ ID NO: 161840 - RNA, 22 nt, Homo sapiens
uugaauagugacuuugauucug

SEQ ID NO: 161841 - RNA, 22 nt, Homo sapiens
uugacaguggcuuaaauugguu

SEQ ID NO: 161842 - RNA, 22 nt, Homo sapiens
uugagacggagucuugcucuuu

SEQ ID NO: 161843 - RNA, 22 nt, Homo sapiens
uugagacggaguuuugcucuug

SEQ ID NO: 161844 - RNA, 22 nt, Homo sapiens
uugagaucuuuuaggccuuugu

SEQ ID NO: 161845 - RNA, 22 nt, Homo sapiens
uugagauggagucucgcucuuu

SEQ ID NO: 161846 - RNA, 22 nt, Homo sapiens
uugagauggagucuugcucuug

SEQ ID NO: 161847 - RNA, 22 nt, Homo sapiens
uugagauggaguuucgcucuug

SEQ ID NO: 161848 - RNA, 22 nt, Homo sapiens
uugagauggaguuucgcucuuu

SEQ ID NO: 161849 - RNA, 22 nt, Homo sapiens
uugagauggaguuuugcucuug

SEQ ID NO: 161850 - RNA, 22 nt, Homo sapiens
uugagcacugucugugugcagu

SEQ ID NO: 161851 - RNA, 22 nt, Homo sapiens
uugagcccuggagguggaggcu

SEQ ID NO: 161852 - RNA, 22 nt, Homo sapiens
uugaggaaugugauuucaaaua

SEQ ID NO: 161853 - RNA, 22 nt, Homo sapiens
uugaggacugcuaagcauuuga

SEQ ID NO: 161854 - RNA, 22 nt, Homo sapiens
uugaggcuuuugaccucaugug

SEQ ID NO: 161855 - RNA, 22 nt, Homo sapiens
uugagguagcuuugauggaggu

SEQ ID NO: 161856 - RNA, 22 nt, Homo sapiens
uugaguauuggacugguaucuu

SEQ ID NO: 161857 - RNA, 22 nt, Homo sapiens
uugauaugguauaagauuucau

SEQ ID NO: 161858 - RNA, 22 nt, Homo sapiens
uugauauguuguuagauucagu

SEQ ID NO: 161859 - RNA, 22 nt, Homo sapiens
uugaucaauagaauacaacaga

SEQ ID NO: 161860 - RNA, 22 nt, Homo sapiens
uugaugauguuucugccuugcc

SEQ ID NO: 161861 - RNA, 22 nt, Homo sapiens
uugcaacuuagaaaaaucauuu

SEQ ID NO: 161862 - RNA, 20 nt, Homo sapiens
uugcacagagaaggaggcag

SEQ ID NO: 161863 - RNA, 22 nt, Homo sapiens
uugcacagugcuuucuuugccc

SEQ ID NO: 161864 - RNA, 22 nt, Homo sapiens
uugcacuccagucuggggggca

SEQ ID NO: 161865 - RNA, 22 nt, Homo sapiens
uugcacuccauccuggguugac

SEQ ID NO: 161866 - RNA, 22 nt, Homo sapiens
uugcacuccggccuggguaaca

SEQ ID NO: 161867 - RNA, 22 nt, Homo sapiens
uugcacucuccagccucggcaa

SEQ ID NO: 161868 - RNA, 22 nt, Homo sapiens
uugcagagccccugcaaggguc

SEQ ID NO: 161869 - RNA, 22 nt, Homo sapiens
uugcauguacguacagagagag

SEQ ID NO: 161870 - RNA, 22 nt, Homo sapiens
uuggaaaugguaaaggguuaau

SEQ ID NO: 161871 - RNA, 22 nt, Homo sapiens
uuggaagacaaugcugauucuc

SEQ ID NO: 161872 - RNA, 22 nt, Homo sapiens
uuggaagcacauuguuuaauua

SEQ ID NO: 161873 - RNA, 22 nt, Homo sapiens
uuggaaggcuccuaaugaaugg

SEQ ID NO: 161874 - RNA, 22 nt, Homo sapiens
uuggagugugagagcagccugg

SEQ ID NO: 161875 - RNA, 22 nt, Homo sapiens
uuggaugauaaagaagccuaag

SEQ ID NO: 161876 - RNA, 22 nt, Homo sapiens
uugggcaaguggcaugaccaug

SEQ ID NO: 161877 - RNA, 22 nt, Homo sapiens
uugguaaaaugaccacagacau

SEQ ID NO: 161878 - RNA, 22 nt, Homo sapiens
uugguccucccaugcucaagag

SEQ ID NO: 161879 - RNA, 22 nt, Homo sapiens
uuguaauguuaccaaauggugu

SEQ ID NO: 161880 - RNA, 22 nt, Homo sapiens
uuguacaggaguguaagcuuca

SEQ ID NO: 161881 - RNA, 22 nt, Homo sapiens
uuguagaucuucaguugcuaca

SEQ ID NO: 161882 - RNA, 22 nt, Homo sapiens
uuguagcaaauguguaaacaaa

SEQ ID NO: 161883 - RNA, 22 nt, Homo sapiens
uuguauacucuauuuuagcagu

SEQ ID NO: 161884 - RNA, 22 nt, Homo sapiens
uuguauguuguuugucagagaa

SEQ ID NO: 161885 - RNA, 18 nt, Homo sapiens
uuguggccccuacaaauu

SEQ ID NO: 161886 - RNA, 22 nt, Homo sapiens
uugugguaggaugaagagauga

SEQ ID NO: 161887 - RNA, 17 nt, Homo sapiens
uuguucccauuaaaaag

SEQ ID NO: 161888 - RNA, 22 nt, Homo sapiens
uuuaaagcaugacgagaagaag

SEQ ID NO: 161889 - RNA, 22 nt, Homo sapiens
uuuaagccaggugcaguggcuc

SEQ ID NO: 161890 - RNA, 22 nt, Homo sapiens
uuuaaugcgucucugaguuuug

SEQ ID NO: 161891 - RNA, 22 nt, Homo sapiens
uuuaauguuacaguauugguau

SEQ ID NO: 161892 - RNA, 22 nt, Homo sapiens
uuuacugucuucagucccucug

SEQ ID NO: 161893 - RNA, 22 nt, Homo sapiens
uuuagguaauauuaaguagcug

SEQ ID NO: 161894 - RNA, 22 nt, Homo sapiens
uuuauggagagauauuuauggu

SEQ ID NO: 161895 - RNA, 22 nt, Homo sapiens
uuucacaguguucucccccaga

SEQ ID NO: 161896 - RNA, 22 nt, Homo sapiens
uuuccaagaugcuuacuuucuc

SEQ ID NO: 161897 - RNA, 22 nt, Homo sapiens
uuugcaucuuagaaaguucucc

SEQ ID NO: 161898 - RNA, 22 nt, Homo sapiens
uuugccaaugggaauuuuccua

SEQ ID NO: 161899 - RNA, 22 nt, Homo sapiens
uuuggcaauuugacuguauagg

SEQ ID NO: 161900 - RNA, 22 nt, Homo sapiens
uuugggaaugaguuuaucauuu

SEQ ID NO: 161901 - RNA, 22 nt, Homo sapiens
uuugggccaugcuucccgguca

SEQ ID NO: 161902 - RNA, 22 nt, Homo sapiens
uuugggccucugauuucuuugg

SEQ ID NO: 161903 - RNA, 22 nt, Homo sapiens
uuuguacacuguugguaggauu

SEQ ID NO: 161904 - RNA, 22 nt, Homo sapiens
uuugugugugauuauaaaaggu

SEQ ID NO: 161905 - RNA, 22 nt, Homo sapiens
uuuguucuucguuccugagcca

SEQ ID NO: 161906 - RNA, 22 nt, Homo sapiens
uuuuagcuuuucccaggacucc

SEQ ID NO: 161907 - RNA, 22 nt, Homo sapiens
uuuuaugggcuauuugcauuag

SEQ ID NO: 161908 - RNA, 22 nt, Homo sapiens
uuuucaguggccauaguggaga

SEQ ID NO: 161909 - RNA, 22 nt, Homo sapiens
uuuuggcuuaaagagaauguau

SEQ ID NO: 161910 - RNA, 21 nt, Homo sapiens
uuuuugguggucauggauaga

SEQ ID NO: 161911 - RNA, 22 nt, Homo sapiens
ugaauacuucguucaaagauaa

SEQ ID NO: 161912 - RNA, 22 nt, Homo sapiens
ugaauagugucacaauaaacau

SEQ ID NO: 161913 - RNA, 22 nt, Homo sapiens
ugacaagagaccccuccgcagg

SEQ ID NO: 161914 - RNA, 22 nt, Homo sapiens
ugacaaguaaacagucagcacc

SEQ ID NO: 161915 - RNA, 22 nt, Homo sapiens
ugacaagugauuaaggcauauu

SEQ ID NO: 161916 - RNA, 17 nt, Homo sapiens
ugacagaaacuuguugu

SEQ ID NO: 161917 - RNA, 22 nt, Homo sapiens
ugacagguuggaauuaugggag

SEQ ID NO: 161918 - RNA, 22 nt, Homo sapiens
ugacauguagagaacuucucau

SEQ ID NO: 161919 - RNA, 22 nt, Homo sapiens
ugaccaaugacauugaagagcu

SEQ ID NO: 161920 - RNA, 22 nt, Homo sapiens
ugacuugaguaacuggcucagg

SEQ ID NO: 161921 - RNA, 22 nt, Homo sapiens
ugacuugaucacccccuaaggg

SEQ ID NO: 161922 - RNA, 22 nt, Homo sapiens
ugacuuuagaauuuuauccaga

SEQ ID NO: 161923 - RNA, 22 nt, Homo sapiens
ugagaacagcagcuugggacac

SEQ ID NO: 161924 - RNA, 22 nt, Homo sapiens
ugagaacauuccucuuccuggc

SEQ ID NO: 161925 - RNA, 22 nt, Homo sapiens
ugagaacuagagaacaagguga

SEQ ID NO: 161926 - RNA, 22 nt, Homo sapiens
ugagaagacaucuuugcuuugu

SEQ ID NO: 161927 - RNA, 22 nt, Homo sapiens
ugagaauauuuuccaugucuca

SEQ ID NO: 161928 - RNA, 22 nt, Homo sapiens
ugagacacugaauccggccuga

SEQ ID NO: 161929 - RNA, 22 nt, Homo sapiens
ugagacugagucuugcucuauu

SEQ ID NO: 161930 - RNA, 22 nt, Homo sapiens
ugagacugaguuuugcucuugu

SEQ ID NO: 161931 - RNA, 22 nt, Homo sapiens
ugagagacaguuucgucggagg

SEQ ID NO: 161932 - RNA, 22 nt, Homo sapiens
ugagagacaguuuguuaaaauu

SEQ ID NO: 161933 - RNA, 22 nt, Homo sapiens
ugagaggugaauggcaggcuca

SEQ ID NO: 161934 - RNA, 22 nt, Homo sapiens
ugagaucacgccacugcacucc

SEQ ID NO: 161935 - RNA, 22 nt, Homo sapiens
ugagaucgaguaucgcugucac

SEQ ID NO: 161936 - RNA, 22 nt, Homo sapiens
ugagaugagaaucaguucuaau

SEQ ID NO: 161937 - RNA, 22 nt, Homo sapiens
ugagaugagucucgcucuguca

SEQ ID NO: 161938 - RNA, 22 nt, Homo sapiens
ugagauggguucugguccccug

SEQ ID NO: 161939 - RNA, 22 nt, Homo sapiens
ugagaugugaucaccugaaggg

SEQ ID NO: 161940 - RNA, 22 nt, Homo sapiens
ugagauguuccaaugacuauua

SEQ ID NO: 161941 - RNA, 21 nt, Homo sapiens
ugagauuauauuaacauggua

SEQ ID NO: 161942 - RNA, 22 nt, Homo sapiens
ugagauuauauuucuuaacaga

SEQ ID NO: 161943 - RNA, 22 nt, Homo sapiens
ugagcauuguguuugacuguga

SEQ ID NO: 161944 - RNA, 22 nt, Homo sapiens
ugagccaugguuagcuucucau

SEQ ID NO: 161945 - RNA, 22 nt, Homo sapiens
ugagcuaggaucacaccugcau

SEQ ID NO: 161946 - RNA, 22 nt, Homo sapiens
ugagcugagaucaugcuauugu

SEQ ID NO: 161947 - RNA, 22 nt, Homo sapiens
ugagcugagaucgugccauugu

SEQ ID NO: 161948 - RNA, 22 nt, Homo sapiens
ugaggacugagaggcacugugg

SEQ ID NO: 161949 - RNA, 22 nt, Homo sapiens
ugaggauaguguugaaggcagg

SEQ ID NO: 161950 - RNA, 22 nt, Homo sapiens
ugagggcguauccuucauuaag

SEQ ID NO: 161951 - RNA, 22 nt, Homo sapiens
ugaggguauagccagcccuuag

SEQ ID NO: 161952 - RNA, 22 nt, Homo sapiens
ugaggucacuuguuuuaugcuu

SEQ ID NO: 161953 - RNA, 20 nt, Homo sapiens
ugaggucaggaguuacagac

SEQ ID NO: 161954 - RNA, 22 nt, Homo sapiens
ugaggugaggguaucaaaugcu

SEQ ID NO: 161955 - RNA, 22 nt, Homo sapiens
ugagguguuauccagaguucuu

SEQ ID NO: 161956 - RNA, 22 nt, Homo sapiens
ugaguagugccacaauaagcau

SEQ ID NO: 161957 - RNA, 22 nt, Homo sapiens
ugaguaugaguucaggaaaggc

SEQ ID NO: 161958 - RNA, 22 nt, Homo sapiens
ugaguauguuuaaugugacaau

SEQ ID NO: 161959 - RNA, 22 nt, Homo sapiens
ugagucagucucacucugcugc

SEQ ID NO: 161960 - RNA, 22 nt, Homo sapiens
ugagucgagauugcgccacugu

SEQ ID NO: 161961 - RNA, 22 nt, Homo sapiens
ugagucuguucucacauugcua

SEQ ID NO: 161962 - RNA, 22 nt, Homo sapiens
ugagugagguucuacucuguga

SEQ ID NO: 161963 - RNA, 22 nt, Homo sapiens
ugaguguccaaguaaggugaaa

SEQ ID NO: 161964 - RNA, 22 nt, Homo sapiens
ugagugugacuuagcagaagga

SEQ ID NO: 161965 - RNA, 22 nt, Homo sapiens
ugaguuaauuuuuguaucaugu

SEQ ID NO: 161966 - RNA, 22 nt, Homo sapiens
ugaguucaauguuaaugaagca

SEQ ID NO: 161967 - RNA, 22 nt, Homo sapiens
ugaguucuuccuaucucugccu

SEQ ID NO: 161968 - RNA, 22 nt, Homo sapiens
ugaucucagcucacugguugaa

SEQ ID NO: 161969 - RNA, 22 nt, Homo sapiens
ugcaacauguguaccacucugu

SEQ ID NO: 161970 - RNA, 21 nt, Homo sapiens
ugcaagaaucaggaagcugcc

SEQ ID NO: 161971 - RNA, 22 nt, Homo sapiens
ugcaagauaggcaguuugcacu

SEQ ID NO: 161972 - RNA, 22 nt, Homo sapiens
ugcaaguaauuccagcuacuga

SEQ ID NO: 161973 - RNA, 22 nt, Homo sapiens
ugcaccaauucuaaacaguucu

SEQ ID NO: 161974 - RNA, 22 nt, Homo sapiens
ugcaccauugcacuccagccug

SEQ ID NO: 161975 - RNA, 22 nt, Homo sapiens
ugcagagaaacauuuuguauuu

SEQ ID NO: 161976 - RNA, 23 nt, Homo sapiens
ugcaguagugagaucuaggcuca

SEQ ID NO: 161977 - RNA, 22 nt, Homo sapiens
ugcaguagugugaucuuggcuc

SEQ ID NO: 161978 - RNA, 22 nt, Homo sapiens
ugcauacacaagcauacaugua

SEQ ID NO: 161979 - RNA, 23 nt, Homo sapiens
ugcauaguacccaauacuuuauc

SEQ ID NO: 161980 - RNA, 22 nt, Homo sapiens
ugcaugcaucuuuuauaguagc

SEQ ID NO: 161981 - RNA, 21 nt, Homo sapiens
ugcaugguagucacaugauuc

SEQ ID NO: 161982 - RNA, 22 nt, Homo sapiens
ugcccuguaucccacuguuuca

SEQ ID NO: 161983 - RNA, 22 nt, Homo sapiens
ugcgccauugaacuccuccugg

SEQ ID NO: 161984 - RNA, 22 nt, Homo sapiens
ugcgccauugcacuccagccug

SEQ ID NO: 161985 - RNA, 23 nt, Homo sapiens
ugcugagaccuagauccuaaaga

SEQ ID NO: 161986 - RNA, 22 nt, Homo sapiens
ugcuuaguguugacccucugcc

SEQ ID NO: 161987 - RNA, 22 nt, Homo sapiens
uggaagacauuuuggaccuugg

SEQ ID NO: 161988 - RNA, 22 nt, Homo sapiens
uggaagacucaagguggugaau

SEQ ID NO: 161989 - RNA, 22 nt, Homo sapiens
uggaagauggaguuuuaucauu

SEQ ID NO: 161990 - RNA, 22 nt, Homo sapiens
uggaagaugggaccucaguuuu

SEQ ID NO: 161991 - RNA, 22 nt, Homo sapiens
uggaagauucuagaagauucca

SEQ ID NO: 161992 - RNA, 20 nt, Homo sapiens
uggaagccuggugcuaucuu

SEQ ID NO: 161993 - RNA, 22 nt, Homo sapiens
uggaaugugaauaacuuccuuc

SEQ ID NO: 161994 - RNA, 22 nt, Homo sapiens
uggagaacauucauuugcaaga

SEQ ID NO: 161995 - RNA, 22 nt, Homo sapiens
uggagagucauuuauaguauuu

SEQ ID NO: 161996 - RNA, 22 nt, Homo sapiens
uggagggcuagucauuucuuuu

SEQ ID NO: 161997 - RNA, 22 nt, Homo sapiens
uggagugucaguuuccagaguu

SEQ ID NO: 161998 - RNA, 22 nt, Homo sapiens
uggcaagaaccacaguuacuuu

SEQ ID NO: 161999 - RNA, 22 nt, Homo sapiens
uggcaagagcaaaauguacagu

SEQ ID NO: 162000 - RNA, 22 nt, Homo sapiens
uggcaagaucacaauuacuuuu

SEQ ID NO: 162001 - RNA, 23 nt, Homo sapiens
uggcaagauuuguauugccugga

SEQ ID NO: 162002 - RNA, 22 nt, Homo sapiens
uggcagauaggauacaggacua

SEQ ID NO: 162003 - RNA, 22 nt, Homo sapiens
uggcagaugcucuuggugccca

SEQ ID NO: 162004 - RNA, 22 nt, Homo sapiens
uggcaggugcacuggcuuugaa

SEQ ID NO: 162005 - RNA, 22 nt, Homo sapiens
uggcgagaaaccauaugcuuuc

SEQ ID NO: 162006 - RNA, 21 nt, Homo sapiens
uggcuauuucuguggcauaca

SEQ ID NO: 162007 - RNA, 22 nt, Homo sapiens
ugggaagaagguuuacuugcca

SEQ ID NO: 162008 - RNA, 22 nt, Homo sapiens
ugggagcauugcauuagaagcc

SEQ ID NO: 162009 - RNA, 22 nt, Homo sapiens
uggguaaaucuguuuggggcuc

SEQ ID NO: 162010 - RNA, 22 nt, Homo sapiens
uggguagauaucauaguugccc

SEQ ID NO: 162011 - RNA, 22 nt, Homo sapiens
uggguccccuacucuuuccaca

SEQ ID NO: 162012 - RNA, 22 nt, Homo sapiens
uugaggugaauuugcaggaugc

SEQ ID NO: 162013 - RNA, 20 nt, Homo sapiens
uugaggugugaggggcagag

SEQ ID NO: 162014 - RNA, 22 nt, Homo sapiens
uugaguccccacacuggguccc

SEQ ID NO: 162015 - RNA, 22 nt, Homo sapiens
uugauagaucagggauuugauu

SEQ ID NO: 162016 - RNA, 22 nt, Homo sapiens
uugcacaauccugugagugagu

SEQ ID NO: 162017 - RNA, 22 nt, Homo sapiens
uugcacauggcaggugcucaau

SEQ ID NO: 162018 - RNA, 22 nt, Homo sapiens
uugcacauggcuggggaggccu

SEQ ID NO: 162019 - RNA, 22 nt, Homo sapiens
uugcacauuuuuucuggcagaa

SEQ ID NO: 162020 - RNA, 22 nt, Homo sapiens
uugcacuccagcucuaggugac

SEQ ID NO: 162021 - RNA, 18 nt, Homo sapiens
uugcacuccugccugggu

SEQ ID NO: 162022 - RNA, 22 nt, Homo sapiens
uugcacucugaagaccuacugu

SEQ ID NO: 162023 - RNA, 22 nt, Homo sapiens
uugcauaauaagagggauacgu

SEQ ID NO: 162024 - RNA, 22 nt, Homo sapiens
uugcaugcuccuuaugagaauc

SEQ ID NO: 162025 - RNA, 22 nt, Homo sapiens
uugcauuagugugguacauuug

SEQ ID NO: 162026 - RNA, 22 nt, Homo sapiens
uugccgggugcaguggcucaug

SEQ ID NO: 162027 - RNA, 22 nt, Homo sapiens
uugcucaggcuggaguacaaug

SEQ ID NO: 162028 - RNA, 22 nt, Homo sapiens
uugcuuagucaugaaucacuga

SEQ ID NO: 162029 - RNA, 22 nt, Homo sapiens
uuggaaauguguuugcauucag

SEQ ID NO: 162030 - RNA, 22 nt, Homo sapiens
uuggacuuuuauucugcaggca

SEQ ID NO: 162031 - RNA, 22 nt, Homo sapiens
uuggagagagaggacucccggc

SEQ ID NO: 162032 - RNA, 22 nt, Homo sapiens
uuggagagucacuaguuagugc

SEQ ID NO: 162033 - RNA, 22 nt, Homo sapiens
uuggauauucaguuuuuccauc

SEQ ID NO: 162034 - RNA, 22 nt, Homo sapiens
uuggcaagcuguuaauuauaaa

SEQ ID NO: 162035 - RNA, 22 nt, Homo sapiens
uuggcaguaucuacuacagcua

SEQ ID NO: 162036 - RNA, 22 nt, Homo sapiens
uuggcagugguucugacggacc

SEQ ID NO: 162037 - RNA, 23 nt, Homo sapiens
uuggcaucugggacacaagcuga

SEQ ID NO: 162038 - RNA, 23 nt, Homo sapiens
uugggcaaaucacuaacgucucc

SEQ ID NO: 162039 - RNA, 17 nt, Homo sapiens
uugggcaagguagguga

SEQ ID NO: 162040 - RNA, 22 nt, Homo sapiens
uugggccacuuuaguuuccuua

SEQ ID NO: 162041 - RNA, 22 nt, Homo sapiens
uugggcuuuuagguccuuaaca

SEQ ID NO: 162042 - RNA, 21 nt, Homo sapiens
uuggggaauggagagguuuuc

SEQ ID NO: 162043 - RNA, 22 nt, Homo sapiens
uugguaguuucugucuuuagau

SEQ ID NO: 162044 - RNA, 22 nt, Homo sapiens
uuggucaggcuaaucucgaacg

SEQ ID NO: 162045 - RNA, 22 nt, Homo sapiens
uugguucucuuagccaucuuaa

SEQ ID NO: 162046 - RNA, 22 nt, Homo sapiens
uuguacuccagccugggugaca

SEQ ID NO: 162047 - RNA, 22 nt, Homo sapiens
uuguaguagcauuauuuauaau

SEQ ID NO: 162048 - RNA, 22 nt, Homo sapiens
uuguauccaucuuucaggcaac

SEQ ID NO: 162049 - RNA, 22 nt, Homo sapiens
uugucacccuacauaacaggga

SEQ ID NO: 162050 - RNA, 22 nt, Homo sapiens
uuguccauggacagcaccacag

SEQ ID NO: 162051 - RNA, 22 nt, Homo sapiens
uugugguaggaguugccauguu

SEQ ID NO: 162052 - RNA, 22 nt, Homo sapiens
uugugguaggcauguaagauga

SEQ ID NO: 162053 - RNA, 22 nt, Homo sapiens
uugugguagugaaugagucuca

SEQ ID NO: 162054 - RNA, 22 nt, Homo sapiens
uugugucccugcggcugaggag

SEQ ID NO: 162055 - RNA, 22 nt, Homo sapiens
uuuaaugcacuaggugguguuc

SEQ ID NO: 162056 - RNA, 22 nt, Homo sapiens
uuuaaugcugcccagucauggg

SEQ ID NO: 162057 - RNA, 22 nt, Homo sapiens
uuuacugugggguuucuuagag

SEQ ID NO: 162058 - RNA, 22 nt, Homo sapiens
uuuagcaaugcuguggggaagu

SEQ ID NO: 162059 - RNA, 22 nt, Homo sapiens
uuuaugagguagagugguuuau

SEQ ID NO: 162060 - RNA, 22 nt, Homo sapiens
uuuauucggcuaggagcuucgg

SEQ ID NO: 162061 - RNA, 23 nt, Homo sapiens
uuucacaguagcuggaucagccu

SEQ ID NO: 162062 - RNA, 22 nt, Homo sapiens
uuucaccguguuggccaggcug

SEQ ID NO: 162063 - RNA, 22 nt, Homo sapiens
uuucaggcaagggugacccuga

SEQ ID NO: 162064 - RNA, 22 nt, Homo sapiens
uuucauagccuucuaaugaguu

SEQ ID NO: 162065 - RNA, 22 nt, Homo sapiens
uuucauggagaaucuucuuacu

SEQ ID NO: 162066 - RNA, 23 nt, Homo sapiens
uuucauggggauuuacucauucc

SEQ ID NO: 162067 - RNA, 18 nt, Homo sapiens
uuucauugagugugauau

SEQ ID NO: 162068 - RNA, 17 nt, Homo sapiens
uuucucagcccucuucu

SEQ ID NO: 162069 - RNA, 22 nt, Homo sapiens
uuugaaccauuugaagaaugau

SEQ ID NO: 162070 - RNA, 22 nt, Homo sapiens
uuugagauaucuuccaucagua

SEQ ID NO: 162071 - RNA, 22 nt, Homo sapiens
uuugcacauauuugggcaaaag

SEQ ID NO: 162072 - RNA, 22 nt, Homo sapiens
uuugcaguuuauuccuggggcu

SEQ ID NO: 162073 - RNA, 22 nt, Homo sapiens
uuuggcaacguuggaucccuca

SEQ ID NO: 162074 - RNA, 22 nt, Homo sapiens
uuuggcagaaaacuaaaaggua

SEQ ID NO: 162075 - RNA, 22 nt, Homo sapiens
uuugggccaugguuuguguaua

SEQ ID NO: 162076 - RNA, 22 nt, Homo sapiens
uuuggucuuuuauuuaaagcag

SEQ ID NO: 162077 - RNA, 22 nt, Homo sapiens
uuugguugcauucacauauuuc

SEQ ID NO: 162078 - RNA, 22 nt, Homo sapiens
uuugguugucacaacuggggga

SEQ ID NO: 162079 - RNA, 22 nt, Homo sapiens
uuugguuuuuguuaucacucau

SEQ ID NO: 162080 - RNA, 22 nt, Homo sapiens
uuuguaagaugcauagauugca

SEQ ID NO: 162081 - RNA, 22 nt, Homo sapiens
uuuguacacgugggugaauugu

SEQ ID NO: 162082 - RNA, 22 nt, Homo sapiens
uuuguacacuguuggugguuau

SEQ ID NO: 162083 - RNA, 23 nt, Homo sapiens
uuuguaguagcaugauuuauaau

SEQ ID NO: 162084 - RNA, 22 nt, Homo sapiens
uuuguguggccuuggccuggca

SEQ ID NO: 162085 - RNA, 19 nt, Homo sapiens
uuuuggaaaugugaacagc

SEQ ID NO: 162086 - RNA, 17 nt, Homo sapiens
uuuuggauuagaaaucc

SEQ ID NO: 162087 - RNA, 22 nt, Homo sapiens
uuuuugauuaauggguagacca

SEQ ID NO: 162088 - RNA, 22 nt, Homo sapiens
acugcacuccagcuuuggugac

SEQ ID NO: 162089 - RNA, 20 nt, Homo sapiens
acugcacuccagucucuggg

SEQ ID NO: 162090 - RNA, 22 nt, Homo sapiens
acugcacuccaguuugggcagc

SEQ ID NO: 162091 - RNA, 18 nt, Homo sapiens
acugcacuccauccuagg

SEQ ID NO: 162092 - RNA, 22 nt, Homo sapiens
acugcacuccggccucgugaca

SEQ ID NO: 162093 - RNA, 22 nt, Homo sapiens
acugcacuccggccuggcaaca

SEQ ID NO: 162094 - RNA, 22 nt, Homo sapiens
acugcacucuagccuuggcaac

SEQ ID NO: 162095 - RNA, 22 nt, Homo sapiens
acugcacuuauccuccaauguu

SEQ ID NO: 162096 - RNA, 22 nt, Homo sapiens
acugcacuucaaccucauugac

SEQ ID NO: 162097 - RNA, 22 nt, Homo sapiens
acugcacuucagccuuggggac

SEQ ID NO: 162098 - RNA, 22 nt, Homo sapiens
acugcacuucagccuugugaca

SEQ ID NO: 162099 - RNA, 20 nt, Homo sapiens
acugcauuuaguccucagga

SEQ ID NO: 162100 - RNA, 22 nt, Homo sapiens
acugcauuugucugucucaauu

SEQ ID NO: 162101 - RNA, 22 nt, Homo sapiens
acuggcucugcuuuacaaacag

SEQ ID NO: 162102 - RNA, 23 nt, Homo sapiens
agaaaugucuauucagggucccu

SEQ ID NO: 162103 - RNA, 20 nt, Homo sapiens
agaaccuguaguguagaggg

SEQ ID NO: 162104 - RNA, 22 nt, Homo sapiens
agaagacuauucuggguugggc

SEQ ID NO: 162105 - RNA, 22 nt, Homo sapiens
agacaagauggcuugagguuca

SEQ ID NO: 162106 - RNA, 22 nt, Homo sapiens
agacaguauuggcaaagugugu

SEQ ID NO: 162107 - RNA, 19 nt, Homo sapiens
agagacucauuguagcauu

SEQ ID NO: 162108 - RNA, 20 nt, Homo sapiens
agagaucaguaauucaucaa

SEQ ID NO: 162109 - RNA, 22 nt, Homo sapiens
agagccacauuaaauaugggaa

SEQ ID NO: 162110 - RNA, 18 nt, Homo sapiens
agagcuaugaacauaugc

SEQ ID NO: 162111 - RNA, 22 nt, Homo sapiens
agaguauacaugugagugagau

SEQ ID NO: 162112 - RNA, 22 nt, Homo sapiens
agaucauaugcaguaaugaacu

SEQ ID NO: 162113 - RNA, 22 nt, Homo sapiens
agaugccucauguucuagguuc

SEQ ID NO: 162114 - RNA, 22 nt, Homo sapiens
agaugcuguuaucaacuguagc

SEQ ID NO: 162115 - RNA, 22 nt, Homo sapiens
agauggguuuucacauguuggc

SEQ ID NO: 162116 - RNA, 22 nt, Homo sapiens
agaugguguuggcugaguguau

SEQ ID NO: 162117 - RNA, 22 nt, Homo sapiens
agcaacauagugagacccccau

SEQ ID NO: 162118 - RNA, 22 nt, Homo sapiens
agcaacaucagcagcaggaaaa

SEQ ID NO: 162119 - RNA, 22 nt, Homo sapiens
agcaacauugagacugcaguug

SEQ ID NO: 162120 - RNA, 22 nt, Homo sapiens
agcacuacugcacuccagccug

SEQ ID NO: 162121 - RNA, 22 nt, Homo sapiens
agcagcacaucccuuucuggcc

SEQ ID NO: 162122 - RNA, 22 nt, Homo sapiens
agcagcauauuuuuauaaugua

SEQ ID NO: 162123 - RNA, 22 nt, Homo sapiens
agcagcaucgggaaguuggcca

SEQ ID NO: 162124 - RNA, 22 nt, Homo sapiens
agcagcauuaguggaaucuugu

SEQ ID NO: 162125 - RNA, 22 nt, Homo sapiens
agcagcauuccaaaaaucugcu

SEQ ID NO: 162126 - RNA, 22 nt, Homo sapiens
agcagcgacacccuguggugag

SEQ ID NO: 162127 - RNA, 21 nt, Homo sapiens
agcagcuuugguugaagcaga

SEQ ID NO: 162128 - RNA, 22 nt, Homo sapiens
agcagugugaaaugauuuaagg

SEQ ID NO: 162129 - RNA, 20 nt, Homo sapiens
agcauugguuagaacaguag

SEQ ID NO: 162130 - RNA, 23 nt, Homo sapiens
agcccugugacucgaacgaggag

SEQ ID NO: 162131 - RNA, 22 nt, Homo sapiens
agcccugugauuacuuuuauaa

SEQ ID NO: 162132 - RNA, 22 nt, Homo sapiens
agcuccauuguaaucaccuggu

SEQ ID NO: 162133 - RNA, 22 nt, Homo sapiens
agcuggaauuuaagguagauag

SEQ ID NO: 162134 - RNA, 22 nt, Homo sapiens
agcuggcuguggagaaaccccu

SEQ ID NO: 162135 - RNA, 22 nt, Homo sapiens
agcugguuuaauaugcugucug

SEQ ID NO: 162136 - RNA, 22 nt, Homo sapiens
agcuguuguuaauuaacucauu

SEQ ID NO: 162137 - RNA, 22 nt, Homo sapiens
agcuguuguucucagaggcuuu

SEQ ID NO: 162138 - RNA, 22 nt, Homo sapiens
agcuguuguuuuaagauacuaa

SEQ ID NO: 162139 - RNA, 22 nt, Homo sapiens
agcuucauucugaauagguuga

SEQ ID NO: 162140 - RNA, 22 nt, Homo sapiens
agcuucauuguuaugaauguca

SEQ ID NO: 162141 - RNA, 22 nt, Homo sapiens
agcuuguagugauuugugguaa

SEQ ID NO: 162142 - RNA, 22 nt, Homo sapiens
agcuuguauuuguagccuguug

SEQ ID NO: 162143 - RNA, 22 nt, Homo sapiens
agcuuguguuuuucuaaguauc

SEQ ID NO: 162144 - RNA, 22 nt, Homo sapiens
aggaaaucuuagcugaggggau

SEQ ID NO: 162145 - RNA, 21 nt, Homo sapiens
aggagcauucaugacgagguu

SEQ ID NO: 162146 - RNA, 22 nt, Homo sapiens
aggcaagagugacuacgugaaa

SEQ ID NO: 162147 - RNA, 22 nt, Homo sapiens
aggcagcuguuauauacugagu

SEQ ID NO: 162148 - RNA, 22 nt, Homo sapiens
aggcaguuucagugagagguga

SEQ ID NO: 162149 - RNA, 22 nt, Homo sapiens
aggcuagaaucuuccaucuugg

SEQ ID NO: 162150 - RNA, 22 nt, Homo sapiens
agggaagugugcuaugcauuua

SEQ ID NO: 162151 - RNA, 22 nt, Homo sapiens
agggaauguaaguuuuaugaga

SEQ ID NO: 162152 - RNA, 22 nt, Homo sapiens
agggcuuguuuaacuaucauua

SEQ ID NO: 162153 - RNA, 22 nt, Homo sapiens
agguaauuuucccagagggaaa

SEQ ID NO: 162154 - RNA, 22 nt, Homo sapiens
aggugcugagcagagaauccug

SEQ ID NO: 162155 - RNA, 22 nt, Homo sapiens
aguaucaagccacacaugguca

SEQ ID NO: 162156 - RNA, 22 nt, Homo sapiens
agucaagauggcaagguaaggc

SEQ ID NO: 162157 - RNA, 22 nt, Homo sapiens
agucagucuguccugugcugag

SEQ ID NO: 162158 - RNA, 17 nt, Homo sapiens
agugagaucauggcuua

SEQ ID NO: 162159 - RNA, 22 nt, Homo sapiens
agugcaguggugccaucauaac

SEQ ID NO: 162160 - RNA, 22 nt, Homo sapiens
agugcaguugucacgugccuuc

SEQ ID NO: 162161 - RNA, 22 nt, Homo sapiens
agugcauuuguucugugucagg

SEQ ID NO: 162162 - RNA, 22 nt, Homo sapiens
aguucaaugcucuuucuacuau

SEQ ID NO: 162163 - RNA, 18 nt, Homo sapiens
aguuguuuuauccugccc

SEQ ID NO: 162164 - RNA, 22 nt, Homo sapiens
auaaaagcaggucuaggucagg

SEQ ID NO: 162165 - RNA, 22 nt, Homo sapiens
auaaagcaagucucuggccuca

SEQ ID NO: 162166 - RNA, 22 nt, Homo sapiens
auaaagccaugagcuugagaug

SEQ ID NO: 162167 - RNA, 22 nt, Homo sapiens
auaaagcuauuccucucuuuuu

SEQ ID NO: 162168 - RNA, 22 nt, Homo sapiens
auaaaugcuuagaucuguauau

SEQ ID NO: 162169 - RNA, 22 nt, Homo sapiens
auaaaugcuuccagucauuaaa

SEQ ID NO: 162170 - RNA, 22 nt, Homo sapiens
auaaauucauuuaagcuccuua

SEQ ID NO: 162171 - RNA, 18 nt, Homo sapiens
auaaccuggugcuuucaa

SEQ ID NO: 162172 - RNA, 22 nt, Homo sapiens
auaagugcuuguugaauaauag

SEQ ID NO: 162173 - RNA, 22 nt, Homo sapiens
auaauaucagguugugaugaug

SEQ ID NO: 162174 - RNA, 22 nt, Homo sapiens
auaaugcuggaacuagagggca

SEQ ID NO: 162175 - RNA, 22 nt, Homo sapiens
auacaguaaugucuuaggcugu

SEQ ID NO: 162176 - RNA, 22 nt, Homo sapiens
auacaguaucuucuggcaagca

SEQ ID NO: 162177 - RNA, 22 nt, Homo sapiens
auacauguucaagggcauauau

SEQ ID NO: 162178 - RNA, 20 nt, Homo sapiens
auaccacagacuggguaguu

SEQ ID NO: 162179 - RNA, 22 nt, Homo sapiens
auagcagugugagaaugaacua

SEQ ID NO: 162180 - RNA, 22 nt, Homo sapiens
auaggagugugcacagaguagg

SEQ ID NO: 162181 - RNA, 22 nt, Homo sapiens
auagguaguugaggagauuuca

SEQ ID NO: 162182 - RNA, 22 nt, Homo sapiens
auagugcugcaauuaacauaca

SEQ ID NO: 162183 - RNA, 22 nt, Homo sapiens
auauccguacaguggaauauua

SEQ ID NO: 162184 - RNA, 20 nt, Homo sapiens
auaugcagacacauacauac

SEQ ID NO: 162185 - RNA, 22 nt, Homo sapiens
auauggcuaugugagcauacca

SEQ ID NO: 162186 - RNA, 19 nt, Homo sapiens
auaugggguuugaacugug

SEQ ID NO: 162187 - RNA, 22 nt, Homo sapiens
aucaaaguuucccagaaguugu

SEQ ID NO: 162188 - RNA, 22 nt, Homo sapiens
aucaaaucuccagaaccugucu

SEQ ID NO: 162189 - RNA, 22 nt, Homo sapiens
cccugaagaaagccuaggacau

SEQ ID NO: 162190 - RNA, 22 nt, Homo sapiens
ccugagaucauacuguuaguaa

SEQ ID NO: 162191 - RNA, 22 nt, Homo sapiens
ccugucuugauuaaauuacuua

SEQ ID NO: 162192 - RNA, 22 nt, Homo sapiens
ccuugguggccacaagacauug

SEQ ID NO: 162193 - RNA, 22 nt, Homo sapiens
cuacagaguaucuaaagaggua

SEQ ID NO: 162194 - RNA, 23 nt, Homo sapiens
cuacagugccugucucuuuggcc

SEQ ID NO: 162195 - RNA, 22 nt, Homo sapiens
cuacucugugguguauuugcau

SEQ ID NO: 162196 - RNA, 22 nt, Homo sapiens
cuagguagcuuuucugucaugu

SEQ ID NO: 162197 - RNA, 22 nt, Homo sapiens
cuauacuguacacugaaugagg

SEQ ID NO: 162198 - RNA, 22 nt, Homo sapiens
cucaauuuggaauugucaguaa

SEQ ID NO: 162199 - RNA, 22 nt, Homo sapiens
cucagcuacuugagaggcuuag

SEQ ID NO: 162200 - RNA, 22 nt, Homo sapiens
cucagugucuggcacacagaaa

SEQ ID NO: 162201 - RNA, 22 nt, Homo sapiens
cuccauuuaucugaaauuuuau

SEQ ID NO: 162202 - RNA, 22 nt, Homo sapiens
cuccauuuggaacagauguccu

SEQ ID NO: 162203 - RNA, 22 nt, Homo sapiens
cucccagugacccaggaacagg

SEQ ID NO: 162204 - RNA, 22 nt, Homo sapiens
cuccuggugauuggagugugaa

SEQ ID NO: 162205 - RNA, 22 nt, Homo sapiens
cugaaucauugcauuaucaagg

SEQ ID NO: 162206 - RNA, 22 nt, Homo sapiens
cugagagaugagaccucucacu

SEQ ID NO: 162207 - RNA, 22 nt, Homo sapiens
cugagcaaagaagugauaauga

SEQ ID NO: 162208 - RNA, 18 nt, Homo sapiens
cugagcacugcuuuauga

SEQ ID NO: 162209 - RNA, 22 nt, Homo sapiens
cugagcuagaccacuuggcucc

SEQ ID NO: 162210 - RNA, 22 nt, Homo sapiens
cugagcuaugccuggaaaggca

SEQ ID NO: 162211 - RNA, 22 nt, Homo sapiens
cugaggauauucagccucugug

SEQ ID NO: 162212 - RNA, 22 nt, Homo sapiens
cugaggguagaaggaucacuug

SEQ ID NO: 162213 - RNA, 22 nt, Homo sapiens
cugauguagguggucugugauc

SEQ ID NO: 162214 - RNA, 22 nt, Homo sapiens
cugcaaauacuugugggauuuu

SEQ ID NO: 162215 - RNA, 19 nt, Homo sapiens
cugcaagguaauaggucag

SEQ ID NO: 162216 - RNA, 19 nt, Homo sapiens
cugcacugagaaaaggagg

SEQ ID NO: 162217 - RNA, 22 nt, Homo sapiens
cugcauuugaugacguauggug

SEQ ID NO: 162218 - RNA, 22 nt, Homo sapiens
cugccuagauguuguagggggu

SEQ ID NO: 162219 - RNA, 22 nt, Homo sapiens
cuggagauauuggaagaaagaa

SEQ ID NO: 162220 - RNA, 22 nt, Homo sapiens
cuggaguaugaaccauguauca

SEQ ID NO: 162221 - RNA, 22 nt, Homo sapiens
cuggauagagauugaugaugcu

SEQ ID NO: 162222 - RNA, 20 nt, Homo sapiens
cuggaugucgaggcagaggu

SEQ ID NO: 162223 - RNA, 22 nt, Homo sapiens
cuggcaagagugaaccagcugu

SEQ ID NO: 162224 - RNA, 22 nt, Homo sapiens
cuggcagugcuuguuauccugg

SEQ ID NO: 162225 - RNA, 22 nt, Homo sapiens
cuggcaucuaaauacuugaugu

SEQ ID NO: 162226 - RNA, 22 nt, Homo sapiens
cuggucaagagcaaaggccagg

SEQ ID NO: 162227 - RNA, 22 nt, Homo sapiens
cuggugauugguuucauucagu

SEQ ID NO: 162228 - RNA, 22 nt, Homo sapiens
cuggugugugacuuuucauuau

SEQ ID NO: 162229 - RNA, 22 nt, Homo sapiens
cuguagcuuuuauaugcuuagc

SEQ ID NO: 162230 - RNA, 22 nt, Homo sapiens
cugugcuugauuauaugagugu

SEQ ID NO: 162231 - RNA, 20 nt, Homo sapiens
cugugguagggaccaggaau

SEQ ID NO: 162232 - RNA, 22 nt, Homo sapiens
cugugguuacguucuuugugcu

SEQ ID NO: 162233 - RNA, 22 nt, Homo sapiens
cuguugguguuuaaucacugca

SEQ ID NO: 162234 - RNA, 22 nt, Homo sapiens
cuguugguuaaauuccaugcag

SEQ ID NO: 162235 - RNA, 22 nt, Homo sapiens
cuuacagucuaucagccacaac

SEQ ID NO: 162236 - RNA, 17 nt, Homo sapiens
cuucaaauaauuucccc

SEQ ID NO: 162237 - RNA, 22 nt, Homo sapiens
cuucaucugguuugugaacuuu

SEQ ID NO: 162238 - RNA, 22 nt, Homo sapiens
cuugacaaugcuucaggcugaa

SEQ ID NO: 162239 - RNA, 22 nt, Homo sapiens
cuugaccuauggaucuguuuuu

SEQ ID NO: 162240 - RNA, 22 nt, Homo sapiens
cuuuaguugucuccucaagggu

SEQ ID NO: 162241 - RNA, 22 nt, Homo sapiens
cuuugcaaaacauugagaccuc

SEQ ID NO: 162242 - RNA, 18 nt, Homo sapiens
cuuugcagcuuccagagg

SEQ ID NO: 162243 - RNA, 22 nt, Homo sapiens
cuuuuacacuguuggugggaau

SEQ ID NO: 162244 - RNA, 22 nt, Homo sapiens
gaaaucucuacuauuuugaucu

SEQ ID NO: 162245 - RNA, 22 nt, Homo sapiens
gaaauggaucagagcaagcuuu

SEQ ID NO: 162246 - RNA, 22 nt, Homo sapiens
gaaaugucugagauguggcuca

SEQ ID NO: 162247 - RNA, 22 nt, Homo sapiens
gaaguaggugcuguuauuaucu

SEQ ID NO: 162248 - RNA, 22 nt, Homo sapiens
gaaucacugugguaucccaugc

SEQ ID NO: 162249 - RNA, 18 nt, Homo sapiens
gacaguguggugauuccu

SEQ ID NO: 162250 - RNA, 22 nt, Homo sapiens
gacauguuuucauguauuugga

SEQ ID NO: 162251 - RNA, 22 nt, Homo sapiens
gacuagggaaaauuauuuuguu

SEQ ID NO: 162252 - RNA, 22 nt, Homo sapiens
gagaacagagauaauuuuacuu

SEQ ID NO: 162253 - RNA, 21 nt, Homo sapiens
gagaaucuuuucagggcaaac

SEQ ID NO: 162254 - RNA, 22 nt, Homo sapiens
gagacugagucuugcccuguca

SEQ ID NO: 162255 - RNA, 22 nt, Homo sapiens
gagaucaaguauucuccacuaa

SEQ ID NO: 162256 - RNA, 22 nt, Homo sapiens
gagcaucauucaacaaaagucu

SEQ ID NO: 162257 - RNA, 22 nt, Homo sapiens
gaggaaguuuacaaagcaucug

SEQ ID NO: 162258 - RNA, 22 nt, Homo sapiens
gaguauauuugcacuguuaugu

SEQ ID NO: 162259 - RNA, 22 nt, Homo sapiens
gagugcaagguuuuucugagug

SEQ ID NO: 162260 - RNA, 22 nt, Homo sapiens
gagugcaauggcagaucuccgc

SEQ ID NO: 162261 - RNA, 18 nt, Homo sapiens
gaguggugcuucccuugu

SEQ ID NO: 162262 - RNA, 22 nt, Homo sapiens
gaguucaaaucucagcucuguu

SEQ ID NO: 162263 - RNA, 22 nt, Homo sapiens
gauaauucuagcagauacaggc

SEQ ID NO: 162264 - RNA, 22 nt, Homo sapiens
gauaucuuuuguauggugagcu

SEQ ID NO: 162265 - RNA, 22 nt, Homo sapiens
gauuguguucauaggcauguua

SEQ ID NO: 162266 - RNA, 22 nt, Homo sapiens
gcacacguagaagcaugcauca

SEQ ID NO: 162267 - RNA, 22 nt, Homo sapiens
gcagcagugugggcugaaccua

SEQ ID NO: 162268 - RNA, 22 nt, Homo sapiens
gcagugaugugaucauagcuca

SEQ ID NO: 162269 - RNA, 22 nt, Homo sapiens
gcaugacaaugauugcucuuca

SEQ ID NO: 162270 - RNA, 20 nt, Homo sapiens
gcaugagucuuuauaguaga

SEQ ID NO: 162271 - RNA, 22 nt, Homo sapiens
gccaacauggcgcuccauucuu

SEQ ID NO: 162272 - RNA, 18 nt, Homo sapiens
gccaacauguaaacaggu

SEQ ID NO: 162273 - RNA, 20 nt, Homo sapiens
gccacaguuaagcuucugcc

SEQ ID NO: 162274 - RNA, 19 nt, Homo sapiens
gcucaccuugcugcuccag

SEQ ID NO: 162275 - RNA, 22 nt, Homo sapiens
gcuggcaagaugcugaugcaac

SEQ ID NO: 162276 - RNA, 22 nt, Homo sapiens
gcuggugacuuuaaguugaagc

SEQ ID NO: 162277 - RNA, 19 nt, Homo sapiens
gcugguuguccacucucuc

SEQ ID NO: 162278 - RNA, 22 nt, Homo sapiens
gcuguugguaaaaaggacauga

SEQ ID NO: 162279 - RNA, 22 nt, Homo sapiens
gcuuuguuaaaacacagccaca

SEQ ID NO: 162280 - RNA, 22 nt, Homo sapiens
ggaagaauaaugggccuuagag

SEQ ID NO: 162281 - RNA, 20 nt, Homo sapiens
ggaagagugacacaagguau

SEQ ID NO: 162282 - RNA, 17 nt, Homo sapiens
ggaaugaauuccagccc

SEQ ID NO: 162283 - RNA, 22 nt, Homo sapiens
ggaaugagaaauauuacacaau

SEQ ID NO: 162284 - RNA, 22 nt, Homo sapiens
ggaaugggauuugaagucuggc

SEQ ID NO: 162285 - RNA, 22 nt, Homo sapiens
ggacaaaguauuuucaaaugua

SEQ ID NO: 162286 - RNA, 22 nt, Homo sapiens
ggacaagaucuuccaccauuca

SEQ ID NO: 162287 - RNA, 22 nt, Homo sapiens
ggaggcuaguaaaaagguagaa

SEQ ID NO: 162288 - RNA, 22 nt, Homo sapiens
ggauacauuuuuccuccucuuc

SEQ ID NO: 162289 - RNA, 22 nt, Homo sapiens
ggcaaagagacaugcaucgggg

SEQ ID NO: 162290 - RNA, 18 nt, Homo sapiens
aaaaagugcucaggccua

SEQ ID NO: 162291 - RNA, 22 nt, Homo sapiens
aaacaccacgcggucccucgga

SEQ ID NO: 162292 - RNA, 20 nt, Homo sapiens
aaacucugucuucuuuauca

SEQ ID NO: 162293 - RNA, 22 nt, Homo sapiens
aaaguaauugcaguuuuugcaa

SEQ ID NO: 162294 - RNA, 22 nt, Homo sapiens
aaagugcugggaucacacugaa

SEQ ID NO: 162295 - RNA, 22 nt, Homo sapiens
aaagugcugggauuaggccagg

SEQ ID NO: 162296 - RNA, 22 nt, Homo sapiens
aaagugcugggauuggccgggc

SEQ ID NO: 162297 - RNA, 22 nt, Homo sapiens
aaagugcuguagacugggcgca

SEQ ID NO: 162298 - RNA, 22 nt, Homo sapiens
aaagugcuuccuuuuugagggu

SEQ ID NO: 162299 - RNA, 22 nt, Homo sapiens
aaagugcuucucuuuggugggu

SEQ ID NO: 162300 - RNA, 22 nt, Homo sapiens
aaauccauuuguucagcuaugc

SEQ ID NO: 162301 - RNA, 22 nt, Homo sapiens
aaaugcauaucaagauugcccu

SEQ ID NO: 162302 - RNA, 22 nt, Homo sapiens
aaaugcaugaggugggaagaaa

SEQ ID NO: 162303 - RNA, 22 nt, Homo sapiens
aaaugcauggacagcuggucuu

SEQ ID NO: 162304 - RNA, 22 nt, Homo sapiens
aaaugcugucaaauuguguucu

SEQ ID NO: 162305 - RNA, 22 nt, Homo sapiens
aaaugcuuucuuggaccauuug

SEQ ID NO: 162306 - RNA, 21 nt, Homo sapiens
aaaugugcuuuaguacccuca

SEQ ID NO: 162307 - RNA, 22 nt, Homo sapiens
aacagcacacccgcugcuucca

SEQ ID NO: 162308 - RNA, 22 nt, Homo sapiens
aacaggguguuugcaguuucuu

SEQ ID NO: 162309 - RNA, 22 nt, Homo sapiens
aaccuuuagucagcucuuagga

SEQ ID NO: 162310 - RNA, 22 nt, Homo sapiens
aacugcacauauuuguaugggu

SEQ ID NO: 162311 - RNA, 22 nt, Homo sapiens
aacugcacuaggacagguuuuu

SEQ ID NO: 162312 - RNA, 22 nt, Homo sapiens
aacuggcauguuuuaaggcuua

SEQ ID NO: 162313 - RNA, 22 nt, Homo sapiens
aacugguauuucccaugaauuu

SEQ ID NO: 162314 - RNA, 21 nt, Homo sapiens
aagaaagcuggacuugccgcu

SEQ ID NO: 162315 - RNA, 22 nt, Homo sapiens
aagagcauuauuuaguaauuuc

SEQ ID NO: 162316 - RNA, 22 nt, Homo sapiens
aagagguuuaacugacucacag

SEQ ID NO: 162317 - RNA, 22 nt, Homo sapiens
aagaugcagucauacuggagua

SEQ ID NO: 162318 - RNA, 22 nt, Homo sapiens
aagcaccaauaggagauuuguc

SEQ ID NO: 162319 - RNA, 22 nt, Homo sapiens
aagcaguguggacuaaugggaa

SEQ ID NO: 162320 - RNA, 22 nt, Homo sapiens
aagcaugguuuccaggggucac

SEQ ID NO: 162321 - RNA, 22 nt, Homo sapiens
aagccacuguaccugucucuua

SEQ ID NO: 162322 - RNA, 22 nt, Homo sapiens
aagcuggagugcaguggugcaa

SEQ ID NO: 162323 - RNA, 22 nt, Homo sapiens
aagcugugucuugucagcuacc

SEQ ID NO: 162324 - RNA, 22 nt, Homo sapiens
aagcuguugguggaucuaccau

SEQ ID NO: 162325 - RNA, 22 nt, Homo sapiens
aagcuguugguggauguaccau

SEQ ID NO: 162326 - RNA, 23 nt, Homo sapiens
aaggacacugaacacuucccagc

SEQ ID NO: 162327 - RNA, 22 nt, Homo sapiens
aaggcaagguggauaaugaagc

SEQ ID NO: 162328 - RNA, 22 nt, Homo sapiens
aaguaaacauuuuguacaauaa

SEQ ID NO: 162329 - RNA, 19 nt, Homo sapiens
aaguaguugugacagaugc

SEQ ID NO: 162330 - RNA, 22 nt, Homo sapiens
aagugaauucauuguguuauau

SEQ ID NO: 162331 - RNA, 22 nt, Homo sapiens
aagugaccuaacaaugaaggcc

SEQ ID NO: 162332 - RNA, 22 nt, Homo sapiens
uugcaggcaugagccaccgugc

SEQ ID NO: 162333 - RNA, 22 nt, Homo sapiens
uugcaucagcaggcauaauugg

SEQ ID NO: 162334 - RNA, 22 nt, Homo sapiens
uugcaugguuuuuaucugaaau

SEQ ID NO: 162335 - RNA, 22 nt, Homo sapiens
uugccuuuguuggaaacaagug

SEQ ID NO: 162336 - RNA, 22 nt, Homo sapiens
uugcuacauugauugccucuuu

SEQ ID NO: 162337 - RNA, 22 nt, Homo sapiens
uugcuagagaugagggaugugu

SEQ ID NO: 162338 - RNA, 22 nt, Homo sapiens
uugcuucauucaacauugaggg

SEQ ID NO: 162339 - RNA, 22 nt, Homo sapiens
uuggaaacaccuggugagguua

SEQ ID NO: 162340 - RNA, 22 nt, Homo sapiens
uuggaaaguuguuguaguuauu

SEQ ID NO: 162341 - RNA, 22 nt, Homo sapiens
uuggaaauauguuaagugucau

SEQ ID NO: 162342 - RNA, 20 nt, Homo sapiens
uuggaaaugugaauugggag

SEQ ID NO: 162343 - RNA, 22 nt, Homo sapiens
uuggaaugcaacagaaggauaa

SEQ ID NO: 162344 - RNA, 22 nt, Homo sapiens
uuggacuucuaacugacaugga

SEQ ID NO: 162345 - RNA, 22 nt, Homo sapiens
uuggagugugucuuauuccauu

SEQ ID NO: 162346 - RNA, 22 nt, Homo sapiens
uuggcagucugaggcacagacu

SEQ ID NO: 162347 - RNA, 22 nt, Homo sapiens
uugguaaugggcugguauaacc

SEQ ID NO: 162348 - RNA, 20 nt, Homo sapiens
uuggugaccuacagaugugg

SEQ ID NO: 162349 - RNA, 19 nt, Homo sapiens
uugguugguuauuucuuac

SEQ ID NO: 162350 - RNA, 22 nt, Homo sapiens
uuguacucucaccguaucccag

SEQ ID NO: 162351 - RNA, 22 nt, Homo sapiens
uuguacuuuuaguagagacggg

SEQ ID NO: 162352 - RNA, 22 nt, Homo sapiens
uugucucacuggaguuuaguaa

SEQ ID NO: 162353 - RNA, 22 nt, Homo sapiens
uugucuccuagacgaccaggcg

SEQ ID NO: 162354 - RNA, 20 nt, Homo sapiens
uugugcauugggccauuggg

SEQ ID NO: 162355 - RNA, 22 nt, Homo sapiens
uuguguaguaccucucacauug

SEQ ID NO: 162356 - RNA, 22 nt, Homo sapiens
uuguucccuucuggcuuuuaug

SEQ ID NO: 162357 - RNA, 22 nt, Homo sapiens
uuguuuagagacuggaauuaaa

SEQ ID NO: 162358 - RNA, 22 nt, Homo sapiens
uuuaacauuggaugagaucguc

SEQ ID NO: 162359 - RNA, 22 nt, Homo sapiens
uuuaauacugcaucuuuacucu

SEQ ID NO: 162360 - RNA, 17 nt, Homo sapiens
uuuaaugcuaggacucu

SEQ ID NO: 162361 - RNA, 18 nt, Homo sapiens
uuuacaguagaaggacuu

SEQ ID NO: 162362 - RNA, 22 nt, Homo sapiens
uuuauagucaggaacuugagga

SEQ ID NO: 162363 - RNA, 22 nt, Homo sapiens
uuuauccagccucuagcaaggu

SEQ ID NO: 162364 - RNA, 23 nt, Homo sapiens
uuucacagaaggauuguagggcc

SEQ ID NO: 162365 - RNA, 22 nt, Homo sapiens
uuucacagagggcuucuuucua

SEQ ID NO: 162366 - RNA, 22 nt, Homo sapiens
uuucacuagccagcccuuuauu

SEQ ID NO: 162367 - RNA, 22 nt, Homo sapiens
uuuccaguuggaaagccuguuu

SEQ ID NO: 162368 - RNA, 22 nt, Homo sapiens
uuucuacagugaacgauuucua

SEQ ID NO: 162369 - RNA, 22 nt, Homo sapiens
uuucucaguguuucaggguagg

SEQ ID NO: 162370 - RNA, 20 nt, Homo sapiens
uuucuccccuauaaaucuca

SEQ ID NO: 162371 - RNA, 22 nt, Homo sapiens
uuugagcaagaggugacauuau

SEQ ID NO: 162372 - RNA, 22 nt, Homo sapiens
uuugaguaggcuuauauuuugg

SEQ ID NO: 162373 - RNA, 22 nt, Homo sapiens
uuugaguuugaggugcugauga

SEQ ID NO: 162374 - RNA, 20 nt, Homo sapiens
uuugcagaaucuaagaagag

SEQ ID NO: 162375 - RNA, 22 nt, Homo sapiens
uuugcaguguaguuggccagca

SEQ ID NO: 162376 - RNA, 22 nt, Homo sapiens
uuugcagugucagcuucugugu

SEQ ID NO: 162377 - RNA, 19 nt, Homo sapiens
uuugcauagugagaauaua

SEQ ID NO: 162378 - RNA, 22 nt, Homo sapiens
uuugcuugaggucuagcuaccc

SEQ ID NO: 162379 - RNA, 22 nt, Homo sapiens
uuuggcaaagaucaacauguua

SEQ ID NO: 162380 - RNA, 22 nt, Homo sapiens
uuugggaaaugaaguugguaga

SEQ ID NO: 162381 - RNA, 22 nt, Homo sapiens
uuugggccauggcuuuuccacg

SEQ ID NO: 162382 - RNA, 22 nt, Homo sapiens
uuuguacuugaaacccagggcc

SEQ ID NO: 162383 - RNA, 22 nt, Homo sapiens
uuuguucaccucaaggauggga

SEQ ID NO: 162384 - RNA, 22 nt, Homo sapiens
uuuguuugaagucgagacaacu

SEQ ID NO: 162385 - RNA, 22 nt, Homo sapiens
uuuuagcagccaugacaaagau

SEQ ID NO: 162386 - RNA, 22 nt, Homo sapiens
uuuugcaggcauuggaaguuua

SEQ ID NO: 162387 - RNA, 22 nt, Homo sapiens
uuuugguguacaauucuaugga

SEQ ID NO: 162388 - RNA, 22 nt, Homo sapiens
uuuuguacaacagcucugggga

SEQ ID NO: 162389 - RNA, 22 nt, Homo sapiens
uuuuugguugguaggcuauuaa

SEQ ID NO: 162390 - RNA, 22 nt, Homo sapiens
uuuuuuaguuagcugggcauga

SEQ ID NO: 162391 - RNA, 22 nt, Homo sapiens
gcauggagaaggggacugauuc

SEQ ID NO: 162392 - RNA, 22 nt, Homo sapiens
gcccuguguuuggguaugguca

SEQ ID NO: 162393 - RNA, 22 nt, Homo sapiens
gcccuguugcccaggcuggagu

SEQ ID NO: 162394 - RNA, 22 nt, Homo sapiens
gcccuguugcccugaauacaua

SEQ ID NO: 162395 - RNA, 22 nt, Homo sapiens
gccuguagaagaguagaugacc

SEQ ID NO: 162396 - RNA, 22 nt, Homo sapiens
gcuacugucuaucugugcuucu

SEQ ID NO: 162397 - RNA, 22 nt, Homo sapiens
gcuccuuugaguagcuucugug

SEQ ID NO: 162398 - RNA, 22 nt, Homo sapiens
gcugauguugaccuugaucacc

SEQ ID NO: 162399 - RNA, 22 nt, Homo sapiens
gcugcacuuuaaggcauccccu

SEQ ID NO: 162400 - RNA, 19 nt, Homo sapiens
ggaaaugucuauuaagauc

SEQ ID NO: 162401 - RNA, 23 nt, Homo sapiens
ggaaauguuuaagggguugggag

SEQ ID NO: 162402 - RNA, 22 nt, Homo sapiens
ggaagacaguguggugauuccu

SEQ ID NO: 162403 - RNA, 22 nt, Homo sapiens
ggaagacuuagaguagcaucag

SEQ ID NO: 162404 - RNA, 22 nt, Homo sapiens
ggaauuaaggcaauugaaagcu

SEQ ID NO: 162405 - RNA, 22 nt, Homo sapiens
uuucauggaggcauuuuagauu

SEQ ID NO: 162406 - RNA, 22 nt, Homo sapiens
uuuccaguuggaagaaggggga

SEQ ID NO: 162407 - RNA, 22 nt, Homo sapiens
uuuccaguuguucuagaaagcu

SEQ ID NO: 162408 - RNA, 22 nt, Homo sapiens
uuucccuuacuuaaacuuacuc

SEQ ID NO: 162409 - RNA, 22 nt, Homo sapiens
uuucuacagggcuugccaggua

SEQ ID NO: 162410 - RNA, 22 nt, Homo sapiens
uuucuauguugaccagucuaga

SEQ ID NO: 162411 - RNA, 16 nt, Homo sapiens
uuucuauguuuuacua

SEQ ID NO: 162412 - RNA, 22 nt, Homo sapiens
uuucugaggccucaccagaagc

SEQ ID NO: 162413 - RNA, 22 nt, Homo sapiens
uuugaaguguggcacugaguuu

SEQ ID NO: 162414 - RNA, 22 nt, Homo sapiens
uuugagaaugcuaccagagaag

SEQ ID NO: 162415 - RNA, 21 nt, Homo sapiens
uuugaucauuaaaagugaauc

SEQ ID NO: 162416 - RNA, 22 nt, Homo sapiens
uuugcaauagguuguggggagg

SEQ ID NO: 162417 - RNA, 22 nt, Homo sapiens
uuugccaauauuuuauugagga

SEQ ID NO: 162418 - RNA, 23 nt, Homo sapiens
uuugccacuuauuagcugggagg

SEQ ID NO: 162419 - RNA, 22 nt, Homo sapiens
uuugcuuguguaaaaaucugga

SEQ ID NO: 162420 - RNA, 22 nt, Homo sapiens
uuuggucuuuuguaaguuaucu

SEQ ID NO: 162421 - RNA, 22 nt, Homo sapiens
uuuguacuugaagaaucuuuau

SEQ ID NO: 162422 - RNA, 21 nt, Homo sapiens
uuuguaguagcaugauuuaua

SEQ ID NO: 162423 - RNA, 22 nt, Homo sapiens
uuugucacccugaauguaagau

SEQ ID NO: 162424 - RNA, 22 nt, Homo sapiens
uuugucacucuuggagguuguu

SEQ ID NO: 162425 - RNA, 22 nt, Homo sapiens
uuugucuccuaagacucugugg

SEQ ID NO: 162426 - RNA, 22 nt, Homo sapiens
uuugugcugcaauuaauuuccc

SEQ ID NO: 162427 - RNA, 22 nt, Homo sapiens
uuuuaacagccaggggacggcc

SEQ ID NO: 162428 - RNA, 20 nt, Homo sapiens
uuuuagcuuuuauugaaagc

SEQ ID NO: 162429 - RNA, 22 nt, Homo sapiens
uuuuggacuugcuccccugucc

SEQ ID NO: 162430 - RNA, 22 nt, Homo sapiens
uuuuucacuuaaguuaggcuca

SEQ ID NO: 162431 - RNA, 18 nt, Homo sapiens
uuuuugaggcacagggga

SEQ ID NO: 162432 - RNA, 22 nt, Homo sapiens
uuaggcaaugcucucaaauuug

SEQ ID NO: 162433 - RNA, 21 nt, Homo sapiens
uuaggcagugucagaggugag

SEQ ID NO: 162434 - RNA, 22 nt, Homo sapiens
uuagggaggcucaggacaagag

SEQ ID NO: 162435 - RNA, 22 nt, Homo sapiens
uuaguaguagugcuguaauuuu

SEQ ID NO: 162436 - RNA, 22 nt, Homo sapiens
uuagugaaugggugugauuugu

SEQ ID NO: 162437 - RNA, 22 nt, Homo sapiens
uuauagcagugcccaacuccug

SEQ ID NO: 162438 - RNA, 21 nt, Homo sapiens
uuauaguggcaugauuuauaa

SEQ ID NO: 162439 - RNA, 22 nt, Homo sapiens
uuauauguuacucccucuagca

SEQ ID NO: 162440 - RNA, 22 nt, Homo sapiens
uuaucucagugaacugagugga

SEQ ID NO: 162441 - RNA, 22 nt, Homo sapiens
uuauucauuaauugcuaagguu

SEQ ID NO: 162442 - RNA, 22 nt, Homo sapiens
uucaaguaguucucaugccuca

SEQ ID NO: 162443 - RNA, 22 nt, Homo sapiens
uucaagucaacaagcacuugag

SEQ ID NO: 162444 - RNA, 22 nt, Homo sapiens
uucacaaugccuuguugauggu

SEQ ID NO: 162445 - RNA, 22 nt, Homo sapiens
uucacaauuaaaugugguuauu

SEQ ID NO: 162446 - RNA, 22 nt, Homo sapiens
uucacuguagcuuggauguuua

SEQ ID NO: 162447 - RNA, 22 nt, Homo sapiens
uucacugugaauaaaggcuccc

SEQ ID NO: 162448 - RNA, 22 nt, Homo sapiens
uucacugugcuuaaauucugcu

SEQ ID NO: 162449 - RNA, 22 nt, Homo sapiens
uucagcuacuugggaggcugaa

SEQ ID NO: 162450 - RNA, 22 nt, Homo sapiens
uucauagucacauucgaugucu

SEQ ID NO: 162451 - RNA, 23 nt, Homo sapiens
uucaucagggauauuggccugaa

SEQ ID NO: 162452 - RNA, 22 nt, Homo sapiens
uucaucaguuauauuggccuga

SEQ ID NO: 162453 - RNA, 22 nt, Homo sapiens
uucauguaaucaaggcagcuaa

SEQ ID NO: 162454 - RNA, 22 nt, Homo sapiens
uucaugucuuggcuguuagagu

SEQ ID NO: 162455 - RNA, 22 nt, Homo sapiens
uuccagaugggaguucuauucu

SEQ ID NO: 162456 - RNA, 22 nt, Homo sapiens
uuccaguaauagcacagcauug

SEQ ID NO: 162457 - RNA, 22 nt, Homo sapiens
uuccauaggcuagaucaaccag

SEQ ID NO: 162458 - RNA, 22 nt, Homo sapiens
uucccaguaaacucuaucccuc

SEQ ID NO: 162459 - RNA, 22 nt, Homo sapiens
uucccaguggaacauguaguca

SEQ ID NO: 162460 - RNA, 22 nt, Homo sapiens
uucccucagaaacacacagccc

SEQ ID NO: 162461 - RNA, 20 nt, Homo sapiens
uucuacagucacaggaagau

SEQ ID NO: 162462 - RNA, 20 nt, Homo sapiens
uucuauggugaugaguccug

SEQ ID NO: 162463 - RNA, 22 nt, Homo sapiens
uucuauugguaauauuuucugu

SEQ ID NO: 162464 - RNA, 21 nt, Homo sapiens
uucucaggguguguccuaccc

SEQ ID NO: 162465 - RNA, 22 nt, Homo sapiens
uucucuaguuacuuuaauggag

SEQ ID NO: 162466 - RNA, 22 nt, Homo sapiens
uucugagguuauauucucucaa

SEQ ID NO: 162467 - RNA, 22 nt, Homo sapiens
uucuggccccucccaaucucau

SEQ ID NO: 162468 - RNA, 22 nt, Homo sapiens
uucuuaguggcaccacuuuuuu

SEQ ID NO: 162469 - RNA, 22 nt, Homo sapiens
uucuucaggccacaaaaauggu

SEQ ID NO: 162470 - RNA, 22 nt, Homo sapiens
uucuuccagccuugaggggccc

SEQ ID NO: 162471 - RNA, 22 nt, Homo sapiens
uucuucugguuaugaaauuuga

SEQ ID NO: 162472 - RNA, 22 nt, Homo sapiens
uugaagacuauaugauucuuca

SEQ ID NO: 162473 - RNA, 22 nt, Homo sapiens
uugaaggaacgcuguucccuug

SEQ ID NO: 162474 - RNA, 22 nt, Homo sapiens
uugaauaggcucaugcuuauca

SEQ ID NO: 162475 - RNA, 22 nt, Homo sapiens
uugaauaguggugaaaguuuga

SEQ ID NO: 162476 - RNA, 22 nt, Homo sapiens
uugacugggccagacagagauc

SEQ ID NO: 162477 - RNA, 22 nt, Homo sapiens
uugagagaaaaaauuuauuggu

SEQ ID NO: 162478 - RNA, 22 nt, Homo sapiens
uugagauccuuuugcucaucag

SEQ ID NO: 162479 - RNA, 22 nt, Homo sapiens
uugagaucuugauauguuugaa

SEQ ID NO: 162480 - RNA, 22 nt, Homo sapiens
uugagauggagucucacuccuu

SEQ ID NO: 162481 - RNA, 22 nt, Homo sapiens
uugagauggagucuugcucugu

SEQ ID NO: 162482 - RNA, 22 nt, Homo sapiens
uugagauggugccacuguacuc

SEQ ID NO: 162483 - RNA, 22 nt, Homo sapiens
uugagauguaguuucacuccug

SEQ ID NO: 162484 - RNA, 22 nt, Homo sapiens
uugaggugaagggcagagcagc

SEQ ID NO: 162485 - RNA, 22 nt, Homo sapiens
uugagguggugucuugcucugu

SEQ ID NO: 162486 - RNA, 22 nt, Homo sapiens
uugaguagugugaugcaugucu

SEQ ID NO: 162487 - RNA, 22 nt, Homo sapiens
uugaguccauucgaugcugauu

SEQ ID NO: 162488 - RNA, 22 nt, Homo sapiens
uugcaaaguugccaaggaagga

SEQ ID NO: 162489 - RNA, 22 nt, Homo sapiens
uugcacagugguuuagagccug

SEQ ID NO: 162490 - RNA, 22 nt, Homo sapiens
uugcacaguguguacagcacca

SEQ ID NO: 162491 - RNA, 22 nt, Homo sapiens
uugcacuccagccuggaugaca

SEQ ID NO: 162492 - RNA, 22 nt, Homo sapiens
uugcacuccagccugggugaca

SEQ ID NO: 162493 - RNA, 22 nt, Homo sapiens
uugcacuccagccuuggggaga

SEQ ID NO: 162494 - RNA, 22 nt, Homo sapiens
uugcacucuagccugggugaca

SEQ ID NO: 162495 - RNA, 22 nt, Homo sapiens
uugcacuguaauuuauuuaugu

SEQ ID NO: 162496 - RNA, 22 nt, Homo sapiens
uugcagugguuucacuggcaaa

SEQ ID NO: 162497 - RNA, 22 nt, Homo sapiens
uugcagugugacgacuauauuu

SEQ ID NO: 162498 - RNA, 22 nt, Homo sapiens
uugcauagacaauauuaaucuu

SEQ ID NO: 162499 - RNA, 23 nt, Homo sapiens
uugcauagacauccucauagauu

SEQ ID NO: 162500 - RNA, 22 nt, Homo sapiens
gugguucuaaaccuuuuuuggu

SEQ ID NO: 162501 - RNA, 22 nt, Homo sapiens
guguaaaucugcugugaacauu

SEQ ID NO: 162502 - RNA, 22 nt, Homo sapiens
guguaaguccugaguuuggaua

SEQ ID NO: 162503 - RNA, 22 nt, Homo sapiens
guguagagaaauagccugaagg

SEQ ID NO: 162504 - RNA, 22 nt, Homo sapiens
guguaugguaggaugacggagu

SEQ ID NO: 162505 - RNA, 22 nt, Homo sapiens
gugucacuguugagaaguccac

SEQ ID NO: 162506 - RNA, 22 nt, Homo sapiens
gugucaugagggggacaggaag

SEQ ID NO: 162507 - RNA, 22 nt, Homo sapiens
gugucucagcccagaccuauuu

SEQ ID NO: 162508 - RNA, 23 nt, Homo sapiens
gugugguaggcuauaccaucuag

SEQ ID NO: 162509 - RNA, 22 nt, Homo sapiens
guugcucaggcugaagugcagu

SEQ ID NO: 162510 - RNA, 22 nt, Homo sapiens
guuggugaccugaagagaguaa

SEQ ID NO: 162511 - RNA, 22 nt, Homo sapiens
uaaagcacaaguaaagaauacu

SEQ ID NO: 162512 - RNA, 22 nt, Homo sapiens
uaacagucaagguuugaccagg

SEQ ID NO: 162513 - RNA, 22 nt, Homo sapiens
uaacccugaggggcuuggggac

SEQ ID NO: 162514 - RNA, 22 nt, Homo sapiens
uaacugucucaggccaugggcg

SEQ ID NO: 162515 - RNA, 22 nt, Homo sapiens
uaagaauucuguccgguauacu

SEQ ID NO: 162516 - RNA, 20 nt, Homo sapiens
uaagccacacagucuaaggu

SEQ ID NO: 162517 - RNA, 22 nt, Homo sapiens
uaaggcuuugcuggacucaguc

SEQ ID NO: 162518 - RNA, 22 nt, Homo sapiens
uaaguaaaugaaagguugauuu

SEQ ID NO: 162519 - RNA, 22 nt, Homo sapiens
uaaguaauugugguuucugcca

SEQ ID NO: 162520 - RNA, 22 nt, Homo sapiens
uaaguaguguugagacaaguuu

SEQ ID NO: 162521 - RNA, 23 nt, Homo sapiens
uaaguucaucucuaauaggugga

SEQ ID NO: 162522 - RNA, 22 nt, Homo sapiens
uaaguuguagaacguuuucuua

SEQ ID NO: 162523 - RNA, 22 nt, Homo sapiens
uaauacauucaaggugguaguu

SEQ ID NO: 162524 - RNA, 22 nt, Homo sapiens
uaaucacagagguuuggccuca

SEQ ID NO: 162525 - RNA, 22 nt, Homo sapiens
uaaucucagcuacucaggaggc

SEQ ID NO: 162526 - RNA, 22 nt, Homo sapiens
uaaugcacauuuauuuuaccuu

SEQ ID NO: 162527 - RNA, 22 nt, Homo sapiens
uaaugcaucaugguuggcaaac

SEQ ID NO: 162528 - RNA, 22 nt, Homo sapiens
uaaugcuguggucugguuuaaa

SEQ ID NO: 162529 - RNA, 22 nt, Homo sapiens
uaaugugaauagugcuguaaug

SEQ ID NO: 162530 - RNA, 22 nt, Homo sapiens
uacaaaucuagguuuguuacug

SEQ ID NO: 162531 - RNA, 16 nt, Homo sapiens
uacaacagugaguaug

SEQ ID NO: 162532 - RNA, 22 nt, Homo sapiens
uacaguaauguuaaucuuugug

SEQ ID NO: 162533 - RNA, 22 nt, Homo sapiens
uacagugcuuuuugguggagaa

SEQ ID NO: 162534 - RNA, 22 nt, Homo sapiens
uacaguggaaguuaaccccauu

SEQ ID NO: 162535 - RNA, 22 nt, Homo sapiens
uacagugggcacuggcgcccug

SEQ ID NO: 162536 - RNA, 22 nt, Homo sapiens
uacauugcacuuuauuagauac

SEQ ID NO: 162537 - RNA, 23 nt, Homo sapiens
uaccacauuccuucuuuccuguu

SEQ ID NO: 162538 - RNA, 22 nt, Homo sapiens
uaccacauuguagagggcauuc

SEQ ID NO: 162539 - RNA, 22 nt, Homo sapiens
uacccugaaggaaaguauguuu

SEQ ID NO: 162540 - RNA, 22 nt, Homo sapiens
uacucuuuagcuccuuaaggaa

SEQ ID NO: 162541 - RNA, 22 nt, Homo sapiens
uacugcacuccacccuggguga

SEQ ID NO: 162542 - RNA, 22 nt, Homo sapiens
uacugcacuccagccuugccaa

SEQ ID NO: 162543 - RNA, 22 nt, Homo sapiens
uacugcacuccagcuuaggaga

SEQ ID NO: 162544 - RNA, 19 nt, Homo sapiens
uacugcacuccagucuggg

SEQ ID NO: 162545 - RNA, 18 nt, Homo sapiens
uacugcacucuccagccu

SEQ ID NO: 162546 - RNA, 22 nt, Homo sapiens
uacugcacuugaccuccugggc

SEQ ID NO: 162547 - RNA, 22 nt, Homo sapiens
uacugcuuaaaagucaauuacu

SEQ ID NO: 162548 - RNA, 22 nt, Homo sapiens
uacugcuuaagggcaugggccc

SEQ ID NO: 162549 - RNA, 22 nt, Homo sapiens
uacuggguguucugagaaaaua

SEQ ID NO: 162550 - RNA, 22 nt, Homo sapiens
uagagcuugacacuuuccaugg

SEQ ID NO: 162551 - RNA, 22 nt, Homo sapiens
uagaggaaugaauuuggccaga

SEQ ID NO: 162552 - RNA, 22 nt, Homo sapiens
uagauuaucccugauuugucca

SEQ ID NO: 162553 - RNA, 22 nt, Homo sapiens
cauacaguaggcacuauuugua

SEQ ID NO: 162554 - RNA, 22 nt, Homo sapiens
caucagagugagauauaagauc

SEQ ID NO: 162555 - RNA, 22 nt, Homo sapiens
caugaaagugagaaacuccugg

SEQ ID NO: 162556 - RNA, 22 nt, Homo sapiens
caugcagcacacaugucugugc

SEQ ID NO: 162557 - RNA, 22 nt, Homo sapiens
caugcauuggucuauuauguga

SEQ ID NO: 162558 - RNA, 23 nt, Homo sapiens
cauggcuguuaacacuguuugag

SEQ ID NO: 162559 - RNA, 22 nt, Homo sapiens
cauugcauuuucuuuguaccuu

SEQ ID NO: 162560 - RNA, 22 nt, Homo sapiens
cauugguuaguuaacuuuaaga

SEQ ID NO: 162561 - RNA, 19 nt, Homo sapiens
ccacaaugguugaacuaga

SEQ ID NO: 162562 - RNA, 23 nt, Homo sapiens
ccacaaugguugaacuagauuac

SEQ ID NO: 162563 - RNA, 22 nt, Homo sapiens
ccacauuggaaaggaucccccc

SEQ ID NO: 162564 - RNA, 22 nt, Homo sapiens
ccacccuggagaauuugagguc

SEQ ID NO: 162565 - RNA, 22 nt, Homo sapiens
ccagugcauggaucccaggggg

SEQ ID NO: 162566 - RNA, 19 nt, Homo sapiens
ccaguguugccagagcuga

SEQ ID NO: 162567 - RNA, 22 nt, Homo sapiens
ccaguuuucccagcaccauuaa

SEQ ID NO: 162568 - RNA, 22 nt, Homo sapiens
ccaucacaggccucagugggaa

SEQ ID NO: 162569 - RNA, 22 nt, Homo sapiens
cccacaguggccucauauccuu

SEQ ID NO: 162570 - RNA, 22 nt, Homo sapiens
ccccaguguguaaaggccuugc

SEQ ID NO: 162571 - RNA, 22 nt, Homo sapiens
ccccauuguugugguuuuaucu

SEQ ID NO: 162572 - RNA, 22 nt, Homo sapiens
cccugacauucggagauguagu

SEQ ID NO: 162573 - RNA, 22 nt, Homo sapiens
ccugagacgaauggagugaaca

SEQ ID NO: 162574 - RNA, 22 nt, Homo sapiens
ccugagguagaguuuauauuga

SEQ ID NO: 162575 - RNA, 21 nt, Homo sapiens
ccugaugaccucugagaguua

SEQ ID NO: 162576 - RNA, 21 nt, Homo sapiens
ccuugguuaucuucccauuca

SEQ ID NO: 162577 - RNA, 22 nt, Homo sapiens
cgcccuguagcuagcuagaggu

SEQ ID NO: 162578 - RNA, 22 nt, Homo sapiens
cgccugagcugaggaagcugca

SEQ ID NO: 162579 - RNA, 22 nt, Homo sapiens
cuaaagugcuuaaaaucucauu

SEQ ID NO: 162580 - RNA, 21 nt, Homo sapiens
cuaaucucacccuuuucuggg

SEQ ID NO: 162581 - RNA, 22 nt, Homo sapiens
cuacaguagagaggauguagaa

SEQ ID NO: 162582 - RNA, 22 nt, Homo sapiens
cuacaguaugaaaccuuuacuc

SEQ ID NO: 162583 - RNA, 22 nt, Homo sapiens
cuagaagcauauucagaacaga

SEQ ID NO: 162584 - RNA, 22 nt, Homo sapiens
cuagagagaagcugugugaccu

SEQ ID NO: 162585 - RNA, 22 nt, Homo sapiens
cuagaggcacagccuaggcacu

SEQ ID NO: 162586 - RNA, 22 nt, Homo sapiens
cuagcccugagauaaaugucau

SEQ ID NO: 162587 - RNA, 22 nt, Homo sapiens
cuauggcucugucuuuuaaguu

SEQ ID NO: 162588 - RNA, 22 nt, Homo sapiens
cucaguagaaaauacauggacu

SEQ ID NO: 162589 - RNA, 22 nt, Homo sapiens
cucaguguuaaggccaccucug

SEQ ID NO: 162590 - RNA, 22 nt, Homo sapiens
cucaugcugucuucugggguaa

SEQ ID NO: 162591 - RNA, 22 nt, Homo sapiens
cucauggagaacaucugcuagg

SEQ ID NO: 162592 - RNA, 22 nt, Homo sapiens
cuccaggugucauccaccuccu

SEQ ID NO: 162593 - RNA, 22 nt, Homo sapiens
cucugcuuaaugucccacuuga

SEQ ID NO: 162594 - RNA, 19 nt, Homo sapiens
cugaaacacagagagggcu

SEQ ID NO: 162595 - RNA, 22 nt, Homo sapiens
cugaaagguauacgcuuguuau

SEQ ID NO: 162596 - RNA, 22 nt, Homo sapiens
cugaauguucuggauggaagag

SEQ ID NO: 162597 - RNA, 22 nt, Homo sapiens
cugacuaguuuuaaugcagauu

SEQ ID NO: 162598 - RNA, 22 nt, Homo sapiens
cugagaucugaaccaggagugu

SEQ ID NO: 162599 - RNA, 22 nt, Homo sapiens
cugagcaaaaugaagacacgau

SEQ ID NO: 162600 - RNA, 22 nt, Homo sapiens
cugagcaugacaucaugugacu

SEQ ID NO: 162601 - RNA, 22 nt, Homo sapiens
cugaggaaguucuuuaacaguu

SEQ ID NO: 162602 - RNA, 22 nt, Homo sapiens
cugagguaauuuguugccagua

SEQ ID NO: 162603 - RNA, 22 nt, Homo sapiens
cugagguacugggggccaggau

SEQ ID NO: 162604 - RNA, 22 nt, Homo sapiens
cugagguaggugaucagugcuu

SEQ ID NO: 162605 - RNA, 22 nt, Homo sapiens
cugcaagaugcauaggaauuuu

SEQ ID NO: 162606 - RNA, 22 nt, Homo sapiens
cugcuaagagaaugagacuuag

SEQ ID NO: 162607 - RNA, 22 nt, Homo sapiens
cuggcucugggcuaaagaaaua

SEQ ID NO: 162608 - RNA, 22 nt, Homo sapiens
cuguacucaucccauaugcacu

SEQ ID NO: 162609 - RNA, 22 nt, Homo sapiens
cuguccugcagagucagaauga

SEQ ID NO: 162610 - RNA, 22 nt, Homo sapiens
cugucucagccucuccaguagc

SEQ ID NO: 162611 - RNA, 22 nt, Homo sapiens
cugucucagugaauugguuuua

SEQ ID NO: 162612 - RNA, 22 nt, Homo sapiens
cugucuguuucaaaagugguua

SEQ ID NO: 162613 - RNA, 22 nt, Homo sapiens
cugugcauaucuuggacugugu

SEQ ID NO: 162614 - RNA, 22 nt, Homo sapiens
cugugcauggauuuuaagauug

SEQ ID NO: 162615 - RNA, 22 nt, Homo sapiens
cugugcauguaugcgugaguuc

SEQ ID NO: 162616 - RNA, 22 nt, Homo sapiens
cuguguaguacuagauugagca

SEQ ID NO: 162617 - RNA, 22 nt, Homo sapiens
cuugagcaaacaaaggugguag

SEQ ID NO: 162618 - RNA, 22 nt, Homo sapiens
cuugagcuugagauccuuucug

SEQ ID NO: 162619 - RNA, 22 nt, Homo sapiens
cuuggcuuguuguccccugcuc

SEQ ID NO: 162620 - RNA, 22 nt, Homo sapiens
cuugguacucugugucccagcu

SEQ ID NO: 162621 - RNA, 22 nt, Homo sapiens
cuuguacacuguuggugggaau

SEQ ID NO: 162622 - RNA, 21 nt, Homo sapiens
cuugucuugcuuagaauagac

SEQ ID NO: 162623 - RNA, 22 nt, Homo sapiens
cuuguuguggaggggagugcag

SEQ ID NO: 162624 - RNA, 21 nt, Homo sapiens
cuuuaugcuguguuagaaaag

SEQ ID NO: 162625 - RNA, 22 nt, Homo sapiens
cuuugguucuguuuauaugcug

SEQ ID NO: 162626 - RNA, 22 nt, Homo sapiens
cuuuuacacugguggugggaau

SEQ ID NO: 162627 - RNA, 22 nt, Homo sapiens
cuuuuacacuguuagugggaau

SEQ ID NO: 162628 - RNA, 22 nt, Homo sapiens
cuuuuggugguucugaugcagg

SEQ ID NO: 162629 - RNA, 22 nt, Homo sapiens
gaacccuggaggcggagguugc

SEQ ID NO: 162630 - RNA, 22 nt, Homo sapiens
gaacuuguguugcuucacaugu

SEQ ID NO: 162631 - RNA, 22 nt, Homo sapiens
gaagacauuuacaugggagacc

SEQ ID NO: 162632 - RNA, 22 nt, Homo sapiens
gaaggcaugcugcauggccaga

SEQ ID NO: 162633 - RNA, 22 nt, Homo sapiens
gaaguaauaaauggauucuuaa

SEQ ID NO: 162634 - RNA, 22 nt, Homo sapiens
gaagugcaguggcacagucaug

SEQ ID NO: 162635 - RNA, 17 nt, Homo sapiens
gaaguguuucagcagcu

SEQ ID NO: 162636 - RNA, 22 nt, Homo sapiens
gaaugcaugaggggaucagaug

SEQ ID NO: 162637 - RNA, 22 nt, Homo sapiens
gaaugugcuguuggcugggcgu

SEQ ID NO: 162638 - RNA, 22 nt, Homo sapiens
gacaagagaacacugcuauauu

SEQ ID NO: 162639 - RNA, 22 nt, Homo sapiens
gacacuggguguuuguuggcgu

SEQ ID NO: 162640 - RNA, 22 nt, Homo sapiens
gacagacacaauugauccauga

SEQ ID NO: 162641 - RNA, 22 nt, Homo sapiens
gacauguuuucaagauuuauaa

SEQ ID NO: 162642 - RNA, 22 nt, Homo sapiens
gacccucuagauggaagcacug

SEQ ID NO: 162643 - RNA, 22 nt, Homo sapiens
gacuggguuaguuugaaagacu

SEQ ID NO: 162644 - RNA, 22 nt, Homo sapiens
gagaacuggcgugaacugcacg

SEQ ID NO: 162645 - RNA, 22 nt, Homo sapiens
gagaacuggcugauucaaggac

SEQ ID NO: 162646 - RNA, 22 nt, Homo sapiens
gagaaugagaggggaaggccac

SEQ ID NO: 162647 - RNA, 22 nt, Homo sapiens
gagacauugacuuuguuccaga

SEQ ID NO: 162648 - RNA, 22 nt, Homo sapiens
gagacggagucucgcucuguca

SEQ ID NO: 162649 - RNA, 22 nt, Homo sapiens
gagacuaaagagcuugcccugg

SEQ ID NO: 162650 - RNA, 21 nt, Homo sapiens
gagaggauucgccagccucuu

SEQ ID NO: 162651 - RNA, 22 nt, Homo sapiens
gagagugcuuuggguguaggcc

SEQ ID NO: 162652 - RNA, 22 nt, Homo sapiens
gagauaaauaggucacaguucu

SEQ ID NO: 162653 - RNA, 22 nt, Homo sapiens
gagauaauuugaaucauggggg

SEQ ID NO: 162654 - RNA, 22 nt, Homo sapiens
uguaaaaagcccagccgcugag

SEQ ID NO: 162655 - RNA, 20 nt, Homo sapiens
uguaaaggagauugcagcug

SEQ ID NO: 162656 - RNA, 22 nt, Homo sapiens
uguagggagagggaguugcacc

SEQ ID NO: 162657 - RNA, 22 nt, Homo sapiens
uguaugagagugaaagcauuuc

SEQ ID NO: 162658 - RNA, 22 nt, Homo sapiens
uagcaacauucagcucagguac

SEQ ID NO: 162659 - RNA, 20 nt, Homo sapiens
uagcacaucuggcuguagag

SEQ ID NO: 162660 - RNA, 22 nt, Homo sapiens
uagcagcaccccacucuacugg

SEQ ID NO: 162661 - RNA, 22 nt, Homo sapiens
uagcagcagugguguauuuaga

SEQ ID NO: 162662 - RNA, 22 nt, Homo sapiens
uagcagcauaaauggacuaaga

SEQ ID NO: 162663 - RNA, 22 nt, Homo sapiens
uagcagcauuuuuguagaguau

SEQ ID NO: 162664 - RNA, 22 nt, Homo sapiens
uagcagccaggaagggcuggcu

SEQ ID NO: 162665 - RNA, 22 nt, Homo sapiens
uagcauggaggcggccauagug

SEQ ID NO: 162666 - RNA, 22 nt, Homo sapiens
uagcugagacuacaguaggugc

SEQ ID NO: 162667 - RNA, 23 nt, Homo sapiens
uagcuucucccagaccugcuccc

SEQ ID NO: 162668 - RNA, 22 nt, Homo sapiens
uaggacaaugguacagcagaaa

SEQ ID NO: 162669 - RNA, 22 nt, Homo sapiens
uaggagcacagcagcauguggg

SEQ ID NO: 162670 - RNA, 22 nt, Homo sapiens
uaggcaaguugcccaaucucuc

SEQ ID NO: 162671 - RNA, 22 nt, Homo sapiens
uaggcacuguguuuguaggagu

SEQ ID NO: 162672 - RNA, 22 nt, Homo sapiens
uaggcagccagcuguggauuga

SEQ ID NO: 162673 - RNA, 22 nt, Homo sapiens
uagggaguguccuuucgggaaa

SEQ ID NO: 162674 - RNA, 22 nt, Homo sapiens
uaguagcauaccuaaguauacu

SEQ ID NO: 162675 - RNA, 22 nt, Homo sapiens
uauacuguuuucuauaguggcu

SEQ ID NO: 162676 - RNA, 22 nt, Homo sapiens
uauagcaaugugccacucucug

SEQ ID NO: 162677 - RNA, 22 nt, Homo sapiens
uaucacagguggacugcacacc

SEQ ID NO: 162678 - RNA, 22 nt, Homo sapiens
uaucacaguaucuagcacagug

SEQ ID NO: 162679 - RNA, 22 nt, Homo sapiens
uaucagugaaucuuauuuugcc

SEQ ID NO: 162680 - RNA, 22 nt, Homo sapiens
uaucaucauguuuuugcugugu

SEQ ID NO: 162681 - RNA, 22 nt, Homo sapiens
uaucauggaaugagguuggaca

SEQ ID NO: 162682 - RNA, 21 nt, Homo sapiens
uaucccagucacaucuaccca

SEQ ID NO: 162683 - RNA, 22 nt, Homo sapiens
uaucccaguggauguaccccau

SEQ ID NO: 162684 - RNA, 22 nt, Homo sapiens
uaucucaguguacaggaugaua

SEQ ID NO: 162685 - RNA, 22 nt, Homo sapiens
uaugaaacucuaagauucacau

SEQ ID NO: 162686 - RNA, 22 nt, Homo sapiens
uaugaacacuuuugggaggcau

SEQ ID NO: 162687 - RNA, 22 nt, Homo sapiens
uaugaagccaggauuuauuauu

SEQ ID NO: 162688 - RNA, 22 nt, Homo sapiens
uaugagcacauauguaucuaug

SEQ ID NO: 162689 - RNA, 22 nt, Homo sapiens
uaugcacacacguguuuaugug

SEQ ID NO: 162690 - RNA, 22 nt, Homo sapiens
uauggcuucuauaaggaagcuu

SEQ ID NO: 162691 - RNA, 22 nt, Homo sapiens
uauggucuuugagaggugacug

SEQ ID NO: 162692 - RNA, 22 nt, Homo sapiens
uauuauuguccuucuauaccca

SEQ ID NO: 162693 - RNA, 22 nt, Homo sapiens
uauuccuuuugcauuuccacau

SEQ ID NO: 162694 - RNA, 22 nt, Homo sapiens
uauugcacgccagccugagcaa

SEQ ID NO: 162695 - RNA, 20 nt, Homo sapiens
uauugcacuccagucugggc

SEQ ID NO: 162696 - RNA, 22 nt, Homo sapiens
uauugcagugagauccaucugg

SEQ ID NO: 162697 - RNA, 22 nt, Homo sapiens
uauugcauauuauucuaguggc

SEQ ID NO: 162698 - RNA, 22 nt, Homo sapiens
uauugcuugaggaaaugguaau

SEQ ID NO: 162699 - RNA, 18 nt, Homo sapiens
uauugcuugguuuggaga

SEQ ID NO: 162700 - RNA, 22 nt, Homo sapiens
uauugcuuuacucucuuauccu

SEQ ID NO: 162701 - RNA, 22 nt, Homo sapiens
uauugcuuuuaacccaaucucu

SEQ ID NO: 162702 - RNA, 22 nt, Homo sapiens
uauugcuuuugauucaaggcag

SEQ ID NO: 162703 - RNA, 22 nt, Homo sapiens
uauuguacauauccucccuuca

SEQ ID NO: 162704 - RNA, 22 nt, Homo sapiens
uauuguacauguuauagauuuu

SEQ ID NO: 162705 - RNA, 22 nt, Homo sapiens
uauuguccacuuugcacugugu

SEQ ID NO: 162706 - RNA, 22 nt, Homo sapiens
ucaaaugauucacccaccuuug

SEQ ID NO: 162707 - RNA, 22 nt, Homo sapiens
aaaagucuguagugaaagguga

SEQ ID NO: 162708 - RNA, 22 nt, Homo sapiens
aaacugucuucugacaguuucc

SEQ ID NO: 162709 - RNA, 22 nt, Homo sapiens
aaagcacugaauaaauuugcuu

SEQ ID NO: 162710 - RNA, 22 nt, Homo sapiens
aaagcacuggagucaucaucua

SEQ ID NO: 162711 - RNA, 22 nt, Homo sapiens
aaagggcuugaauacucuuuuu

SEQ ID NO: 162712 - RNA, 22 nt, Homo sapiens
aaaguacucaguucaguuccgu

SEQ ID NO: 162713 - RNA, 22 nt, Homo sapiens
aaagugcugagacagacuggga

SEQ ID NO: 162714 - RNA, 22 nt, Homo sapiens
aaagugcugagaguucuaacuu

SEQ ID NO: 162715 - RNA, 22 nt, Homo sapiens
aaagugcugagucuaggcgggg

SEQ ID NO: 162716 - RNA, 22 nt, Homo sapiens
aaagugcuuacuaaguugccaa

SEQ ID NO: 162717 - RNA, 22 nt, Homo sapiens
aaaguggugugaguauguaucu

SEQ ID NO: 162718 - RNA, 22 nt, Homo sapiens
aaaugcacagaaaggaugugga

SEQ ID NO: 162719 - RNA, 22 nt, Homo sapiens
aaaugcaguugguggggauaug

SEQ ID NO: 162720 - RNA, 22 nt, Homo sapiens
aaaugcaucauuaggugauuuu

SEQ ID NO: 162721 - RNA, 22 nt, Homo sapiens
aaaugcucuguggguaguaaug

SEQ ID NO: 162722 - RNA, 22 nt, Homo sapiens
aacaccauuuuucugcagccuu

SEQ ID NO: 162723 - RNA, 22 nt, Homo sapiens
aaccacauggcucaguggacau

SEQ ID NO: 162724 - RNA, 22 nt, Homo sapiens
aacccugagucaugagucuaga

SEQ ID NO: 162725 - RNA, 22 nt, Homo sapiens
aacugcuguuuggguacuggug

SEQ ID NO: 162726 - RNA, 22 nt, Homo sapiens
aacuggcacuacaucaagagcu

SEQ ID NO: 162727 - RNA, 22 nt, Homo sapiens
aacuggcauagccagacuucuc

SEQ ID NO: 162728 - RNA, 19 nt, Homo sapiens
aacuggugugagaugguau

SEQ ID NO: 162729 - RNA, 22 nt, Homo sapiens
aagcaacacaucugccccgguu

SEQ ID NO: 162730 - RNA, 22 nt, Homo sapiens
aagcacccagccucacgccugc

SEQ ID NO: 162731 - RNA, 20 nt, Homo sapiens
aagcugaguguuuuuuuaau

SEQ ID NO: 162732 - RNA, 22 nt, Homo sapiens
aagcugccuugcugaggagaaa

SEQ ID NO: 162733 - RNA, 22 nt, Homo sapiens
aagcuggcauucaugagauuac

SEQ ID NO: 162734 - RNA, 22 nt, Homo sapiens
aagcugguuuuauaucugugag

SEQ ID NO: 162735 - RNA, 22 nt, Homo sapiens
aaggcaagagaaaauuucgagu

SEQ ID NO: 162736 - RNA, 22 nt, Homo sapiens
aaggcaagauacugguugcuga

SEQ ID NO: 162737 - RNA, 23 nt, Homo sapiens
aagguaagcuagaaagauguaga

SEQ ID NO: 162738 - RNA, 22 nt, Homo sapiens
aagguauuuuugucuauaucuu

SEQ ID NO: 162739 - RNA, 18 nt, Homo sapiens
aaggugcuucuguucuga

SEQ ID NO: 162740 - RNA, 22 nt, Homo sapiens
aaguaaacauugagagacaaga

SEQ ID NO: 162741 - RNA, 22 nt, Homo sapiens
aagugaauguuugguagcagug

SEQ ID NO: 162742 - RNA, 22 nt, Homo sapiens
aagugaguaauacgucaguugu

SEQ ID NO: 162743 - RNA, 20 nt, Homo sapiens
aagugaguguuaaacugaac

SEQ ID NO: 162744 - RNA, 20 nt, Homo sapiens
aagugcaucguugugucugc

SEQ ID NO: 162745 - RNA, 22 nt, Homo sapiens
aagugcauguauuaguguaguc

SEQ ID NO: 162746 - RNA, 22 nt, Homo sapiens
aagugcuuuuuagauaugguuu

SEQ ID NO: 162747 - RNA, 22 nt, Homo sapiens
aaguguaugaaacaguccaugg

SEQ ID NO: 162748 - RNA, 22 nt, Homo sapiens
aagugucuuaccgggagggagu

SEQ ID NO: 162749 - RNA, 22 nt, Homo sapiens
aaguugguguaugagacagaag

SEQ ID NO: 162750 - RNA, 22 nt, Homo sapiens
aauacugugauaucgagcgauu

SEQ ID NO: 162751 - RNA, 22 nt, Homo sapiens
aauaucacaguuggguguacac

SEQ ID NO: 162752 - RNA, 22 nt, Homo sapiens
aaucaccaugcacuacagccuu

SEQ ID NO: 162753 - RNA, 22 nt, Homo sapiens
aaucagagcccucugagcuuca

SEQ ID NO: 162754 - RNA, 22 nt, Homo sapiens
aauccaugugcuuuaccauuuu

SEQ ID NO: 162755 - RNA, 22 nt, Homo sapiens
aaugacacugagcaucuuucau

SEQ ID NO: 162756 - RNA, 22 nt, Homo sapiens
aaugcaagauguuaauuauagg

SEQ ID NO: 162757 - RNA, 22 nt, Homo sapiens
aauggcagaugaaauugucauu

SEQ ID NO: 162758 - RNA, 22 nt, Homo sapiens
aauggcaucuagaguggugaau

SEQ ID NO: 162759 - RNA, 22 nt, Homo sapiens
aauggcucuuccuggaguugug

SEQ ID NO: 162760 - RNA, 23 nt, Homo sapiens
aauugcuuuugaggacuuaguug

SEQ ID NO: 162761 - RNA, 22 nt, Homo sapiens
aauugugcuuguaggccaggca

SEQ ID NO: 162762 - RNA, 20 nt, Homo sapiens
acaaaugcauucugugacau

SEQ ID NO: 162763 - RNA, 22 nt, Homo sapiens
acaacaguuuuaucaccccaga

SEQ ID NO: 162764 - RNA, 22 nt, Homo sapiens
acaauguauauuuuacuguagg

SEQ ID NO: 162765 - RNA, 22 nt, Homo sapiens
acacauuggcaauucuggagca

SEQ ID NO: 162766 - RNA, 22 nt, Homo sapiens
acaccuguggucccaguaacuu

SEQ ID NO: 162767 - RNA, 22 nt, Homo sapiens
acagauagcacuaagggaucug

SEQ ID NO: 162768 - RNA, 22 nt, Homo sapiens
acaguacaugauaaauaaggua

SEQ ID NO: 162769 - RNA, 22 nt, Homo sapiens
acagugcuuggcacacaguaau

SEQ ID NO: 162770 - RNA, 22 nt, Homo sapiens
acagugcuuucaauguucagua

SEQ ID NO: 162771 - RNA, 23 nt, Homo sapiens
acaguggugugaucuuggcucag

SEQ ID NO: 162772 - RNA, 18 nt, Homo sapiens
acagugucauggcucaau

SEQ ID NO: 162773 - RNA, 22 nt, Homo sapiens
acaugcauccaugugaagagac

SEQ ID NO: 162774 - RNA, 22 nt, Homo sapiens
acaugcauggcaugcauuguac

SEQ ID NO: 162775 - RNA, 22 nt, Homo sapiens
acccaguagucauucaggagca

SEQ ID NO: 162776 - RNA, 22 nt, Homo sapiens
acccgugcugaauauguaggug

SEQ ID NO: 162777 - RNA, 22 nt, Homo sapiens
acccuguugagcaacuggccau

SEQ ID NO: 162778 - RNA, 22 nt, Homo sapiens
acccuguugguggaucagauug

SEQ ID NO: 162779 - RNA, 22 nt, Homo sapiens
accucagcccggggaaguugag

SEQ ID NO: 162780 - RNA, 22 nt, Homo sapiens
accugagauuacaggugcuggc

SEQ ID NO: 162781 - RNA, 23 nt, Homo sapiens
accugauguuucuguggggagcc

SEQ ID NO: 162782 - RNA, 23 nt, Homo sapiens
accuucauucauucagcugaagu

SEQ ID NO: 162783 - RNA, 18 nt, Homo sapiens
accuucauuccuuugccu

SEQ ID NO: 162784 - RNA, 22 nt, Homo sapiens
acuccauuucauuuuagcucuu

SEQ ID NO: 162785 - RNA, 22 nt, Homo sapiens
acucugucuaguuguaaaauuu

SEQ ID NO: 162786 - RNA, 21 nt, Homo sapiens
acugcacuccaaccucaacag

SEQ ID NO: 162787 - RNA, 22 nt, Homo sapiens
acugcacuccaaccuguugggc

SEQ ID NO: 162788 - RNA, 22 nt, Homo sapiens
acugcacuccagcccaggugac

SEQ ID NO: 162789 - RNA, 22 nt, Homo sapiens
acugcacuccagcccgggugac

SEQ ID NO: 162790 - RNA, 22 nt, Homo sapiens
acugcacuccagccucgcaaca

SEQ ID NO: 162791 - RNA, 22 nt, Homo sapiens
acugcacuccagccugaugaaa

SEQ ID NO: 162792 - RNA, 22 nt, Homo sapiens
acugcacuccagccugcugggu

SEQ ID NO: 162793 - RNA, 22 nt, Homo sapiens
acugcacuccagccuggaccac

SEQ ID NO: 162794 - RNA, 22 nt, Homo sapiens
acugcacuccagccuggcggac

SEQ ID NO: 162795 - RNA, 22 nt, Homo sapiens
acugcacuccagccuuagugac

SEQ ID NO: 162796 - RNA, 20 nt, Homo sapiens
acugcacuccagccuuccag

SEQ ID NO: 162797 - RNA, 22 nt, Homo sapiens
aucacugggcaagauaucauga

SEQ ID NO: 162798 - RNA, 20 nt, Homo sapiens
aucagagccggugaaagggc

SEQ ID NO: 162799 - RNA, 22 nt, Homo sapiens
aucagauggcuaaaacagaaga

SEQ ID NO: 162800 - RNA, 22 nt, Homo sapiens
aucagugaaagugaaaucuccg

SEQ ID NO: 162801 - RNA, 22 nt, Homo sapiens
aucagugcauguuuguugagcu

SEQ ID NO: 162802 - RNA, 22 nt, Homo sapiens
auccauguggauaaauguguau

SEQ ID NO: 162803 - RNA, 22 nt, Homo sapiens
aucccaguucagccucugacac

SEQ ID NO: 162804 - RNA, 22 nt, Homo sapiens
aucccuguguccagcaccugug

SEQ ID NO: 162805 - RNA, 22 nt, Homo sapiens
aucucugagauguucugauuuu

SEQ ID NO: 162806 - RNA, 20 nt, Homo sapiens
aucucugggcaaaggaaaau

SEQ ID NO: 162807 - RNA, 22 nt, Homo sapiens
aucugcauuagggugaagaccu

SEQ ID NO: 162808 - RNA, 19 nt, Homo sapiens
aucuggaguuccuggggcu

SEQ ID NO: 162809 - RNA, 21 nt, Homo sapiens
aucugugagaccuuggggguu

SEQ ID NO: 162810 - RNA, 22 nt, Homo sapiens
aucuuggauuaccugggugggu

SEQ ID NO: 162811 - RNA, 22 nt, Homo sapiens
augaagugcaugauaguugguu

SEQ ID NO: 162812 - RNA, 23 nt, Homo sapiens
augaauguaaggaguguaagaaa

SEQ ID NO: 162813 - RNA, 22 nt, Homo sapiens
augacacugcagagauguccca

SEQ ID NO: 162814 - RNA, 22 nt, Homo sapiens
augagaaucauuucagcuugua

SEQ ID NO: 162815 - RNA, 22 nt, Homo sapiens
augagaugaauaccgacgaugu

SEQ ID NO: 162816 - RNA, 22 nt, Homo sapiens
augagcaucaccagaaucaaua

SEQ ID NO: 162817 - RNA, 19 nt, Homo sapiens
augagucugcaagaaccag

SEQ ID NO: 162818 - RNA, 19 nt, Homo sapiens
augcaaugucacaggcugc

SEQ ID NO: 162819 - RNA, 22 nt, Homo sapiens
augcacaguccagcccaugugg

SEQ ID NO: 162820 - RNA, 22 nt, Homo sapiens
augcauagugggaugcucugug

SEQ ID NO: 162821 - RNA, 22 nt, Homo sapiens
augcauaugucuuuauaguggc

SEQ ID NO: 162822 - RNA, 22 nt, Homo sapiens
augccagggagaauuguucaag

SEQ ID NO: 162823 - RNA, 22 nt, Homo sapiens
augcuacauucuacaauuaggc

SEQ ID NO: 162824 - RNA, 22 nt, Homo sapiens
auggaaaugaagggcuggcccu

SEQ ID NO: 162825 - RNA, 22 nt, Homo sapiens
auggagaugaauaucaucuguu

SEQ ID NO: 162826 - RNA, 22 nt, Homo sapiens
auggcaaugcgaugaugacuga

SEQ ID NO: 162827 - RNA, 22 nt, Homo sapiens
auggcagugagucucuaguauu

SEQ ID NO: 162828 - RNA, 22 nt, Homo sapiens
auggcaguuuauucuaaaucaa

SEQ ID NO: 162829 - RNA, 22 nt, Homo sapiens
auggcaucgucaccuuuucagu

SEQ ID NO: 162830 - RNA, 22 nt, Homo sapiens
auggcccugaguucaauauauu

SEQ ID NO: 162831 - RNA, 22 nt, Homo sapiens
auggcguguggcuuggaggcug

SEQ ID NO: 162832 - RNA, 22 nt, Homo sapiens
auggcuuuuauuguguugaggu

SEQ ID NO: 162833 - RNA, 22 nt, Homo sapiens
auguaaacauuuggucuaaauu

SEQ ID NO: 162834 - RNA, 22 nt, Homo sapiens
augucauagaagccugugaacc

SEQ ID NO: 162835 - RNA, 22 nt, Homo sapiens
augugcaugcuguucugccaga

SEQ ID NO: 162836 - RNA, 22 nt, Homo sapiens
auguggcuuuucaacuguguga

SEQ ID NO: 162837 - RNA, 22 nt, Homo sapiens
augugguaggcccaugagucau

SEQ ID NO: 162838 - RNA, 22 nt, Homo sapiens
auuaacaucuagaguuuuggug

SEQ ID NO: 162839 - RNA, 20 nt, Homo sapiens
auuagagcuacauggcuaca

SEQ ID NO: 162840 - RNA, 22 nt, Homo sapiens
auuauaugucaucacagacacc

SEQ ID NO: 162841 - RNA, 22 nt, Homo sapiens
auucagaggggcagcugucuug

SEQ ID NO: 162842 - RNA, 21 nt, Homo sapiens
auugcacaauauacccaugua

SEQ ID NO: 162843 - RNA, 22 nt, Homo sapiens
auugcacuccagccugggugac

SEQ ID NO: 162844 - RNA, 23 nt, Homo sapiens
auugcagaaucacagagguagug

SEQ ID NO: 162845 - RNA, 23 nt, Homo sapiens
auugcagucuugaacuccugggc

SEQ ID NO: 162846 - RNA, 22 nt, Homo sapiens
auugcauugugaucuucccaga

SEQ ID NO: 162847 - RNA, 23 nt, Homo sapiens
auugcccuugaaggcuaaacucu

SEQ ID NO: 162848 - RNA, 22 nt, Homo sapiens
auugcuauuauuugaccauugu

SEQ ID NO: 162849 - RNA, 22 nt, Homo sapiens
auugcuuacccuguauuagauc

SEQ ID NO: 162850 - RNA, 22 nt, Homo sapiens
auugcuuuuacugggagcuuug

SEQ ID NO: 162851 - RNA, 22 nt, Homo sapiens
auuggcuuuauacauaagaaua

SEQ ID NO: 162852 - RNA, 22 nt, Homo sapiens
auuguacauacaccggugugua

SEQ ID NO: 162853 - RNA, 22 nt, Homo sapiens
auuguacuccagccugggugac

SEQ ID NO: 162854 - RNA, 22 nt, Homo sapiens
auuguacucuagccucugggca

SEQ ID NO: 162855 - RNA, 22 nt, Homo sapiens
auuguacugccccccuguugcu

SEQ ID NO: 162856 - RNA, 22 nt, Homo sapiens
auuguacuuaagccugggugaa

SEQ ID NO: 162857 - RNA, 22 nt, Homo sapiens
auugucacuuaaaagugcaugu

SEQ ID NO: 162858 - RNA, 22 nt, Homo sapiens
auuucuacuccuguguccagaa

SEQ ID NO: 162859 - RNA, 22 nt, Homo sapiens
caaaagugguucuuauccuuuu

SEQ ID NO: 162860 - RNA, 22 nt, Homo sapiens
caaagucuucucauuaugucuu

SEQ ID NO: 162861 - RNA, 22 nt, Homo sapiens
caaagugguuuauacaugauug

SEQ ID NO: 162862 - RNA, 22 nt, Homo sapiens
caaauugcuugucuguagugga

SEQ ID NO: 162863 - RNA, 22 nt, Homo sapiens
caacacagugaaacccgucucu

SEQ ID NO: 162864 - RNA, 22 nt, Homo sapiens
caacugcucacuccuggguuca

SEQ ID NO: 162865 - RNA, 22 nt, Homo sapiens
cacauugaauuucugaugacaa

SEQ ID NO: 162866 - RNA, 22 nt, Homo sapiens
cacauugcaggaaaguucauua

SEQ ID NO: 162867 - RNA, 16 nt, Homo sapiens
cacauugcugcauggc

SEQ ID NO: 162868 - RNA, 22 nt, Homo sapiens
caccacauuccauugaucaggc

SEQ ID NO: 162869 - RNA, 22 nt, Homo sapiens
cacugcacuccagcuugugggc

SEQ ID NO: 162870 - RNA, 22 nt, Homo sapiens
cacugcacuccaguuuggauga

SEQ ID NO: 162871 - RNA, 22 nt, Homo sapiens
cacuggcacuguguuuagaugg

SEQ ID NO: 162872 - RNA, 23 nt, Homo sapiens
cacugggcagcagguguucccag

SEQ ID NO: 162873 - RNA, 22 nt, Homo sapiens
cacugggugagauccauguuua

SEQ ID NO: 162874 - RNA, 17 nt, Homo sapiens
cacugggugcaagagga

SEQ ID NO: 162875 - RNA, 22 nt, Homo sapiens
cacuguggauggaacuauguga

SEQ ID NO: 162876 - RNA, 22 nt, Homo sapiens
cagauaguuguagauaugcagc

SEQ ID NO: 162877 - RNA, 22 nt, Homo sapiens
cagcaucauucaucugggguaa

SEQ ID NO: 162878 - RNA, 22 nt, Homo sapiens
cagccggguggcuccuagggua

SEQ ID NO: 162879 - RNA, 22 nt, Homo sapiens
cagcuaaauuguuaaauccaag

SEQ ID NO: 162880 - RNA, 22 nt, Homo sapiens
cagcuggugcugcaccaguggg

SEQ ID NO: 162881 - RNA, 22 nt, Homo sapiens
cagcugguggcaagaagacaga

SEQ ID NO: 162882 - RNA, 20 nt, Homo sapiens
cagucaugaagaacugugag

SEQ ID NO: 162883 - RNA, 22 nt, Homo sapiens
cagugcuuguuauuguucuauu

SEQ ID NO: 162884 - RNA, 22 nt, Homo sapiens
cagugucugcauuuggaacuca

SEQ ID NO: 162885 - RNA, 22 nt, Homo sapiens
caucacuuuuccuuuuacagau

SEQ ID NO: 162886 - RNA, 19 nt, Homo sapiens
caucccugagcugaagugg

SEQ ID NO: 162887 - RNA, 22 nt, Homo sapiens
caugaaagacugaggaauugga

SEQ ID NO: 162888 - RNA, 22 nt, Homo sapiens
caugaugcuagguauggaugaa

SEQ ID NO: 162889 - RNA, 22 nt, Homo sapiens
caugccacugcacuccaaccug

SEQ ID NO: 162890 - RNA, 19 nt, Homo sapiens
cauggcuuauaauuuuaau

SEQ ID NO: 162891 - RNA, 22 nt, Homo sapiens
cauggcuuuauuuucagcuucu

SEQ ID NO: 162892 - RNA, 22 nt, Homo sapiens
cauuaguugaagugcagggaga

SEQ ID NO: 162893 - RNA, 22 nt, Homo sapiens
ccagcaccauuuauuaaauagg

SEQ ID NO: 162894 - RNA, 22 nt, Homo sapiens
ccaggguuccacgccuggcugu

SEQ ID NO: 162895 - RNA, 22 nt, Homo sapiens
ccaguuuucaagauaaugguuu

SEQ ID NO: 162896 - RNA, 18 nt, Homo sapiens
ccauucaacagauuuguc

SEQ ID NO: 162897 - RNA, 22 nt, Homo sapiens
ccccauguucucucugcagcuc

SEQ ID NO: 162898 - RNA, 19 nt, Homo sapiens
ggcaagaguuguucugugu

SEQ ID NO: 162899 - RNA, 22 nt, Homo sapiens
ggcaguuuguucuugcuccuuu

SEQ ID NO: 162900 - RNA, 22 nt, Homo sapiens
ggcaugaugcgcacgccuguag

SEQ ID NO: 162901 - RNA, 22 nt, Homo sapiens
ggcaugauggcugaggcuucug

SEQ ID NO: 162902 - RNA, 22 nt, Homo sapiens
ggcaugguggugugugccuaua

SEQ ID NO: 162903 - RNA, 22 nt, Homo sapiens
ggcuacauuguuacaauuagua

SEQ ID NO: 162904 - RNA, 22 nt, Homo sapiens
ggcuagagacaaguugcugaga

SEQ ID NO: 162905 - RNA, 22 nt, Homo sapiens
ggcuuggaggaaugugagggcu

SEQ ID NO: 162906 - RNA, 22 nt, Homo sapiens
gggaaaaugucuauugaaugaa

SEQ ID NO: 162907 - RNA, 22 nt, Homo sapiens
gggaaauguaaagucauaagau

SEQ ID NO: 162908 - RNA, 22 nt, Homo sapiens
gggaugauuaugguucacuaca

SEQ ID NO: 162909 - RNA, 22 nt, Homo sapiens
ggggcaaaaugccacgagucuc

SEQ ID NO: 162910 - RNA, 19 nt, Homo sapiens
ggucagcaaagucuagcug

SEQ ID NO: 162911 - RNA, 22 nt, Homo sapiens
ggugagaaagggauuccuguuc

SEQ ID NO: 162912 - RNA, 20 nt, Homo sapiens
guaaacucucagcauagaug

SEQ ID NO: 162913 - RNA, 22 nt, Homo sapiens
guaaggaguaguguaacagugc

SEQ ID NO: 162914 - RNA, 22 nt, Homo sapiens
guaagugguagagcugggcuau

SEQ ID NO: 162915 - RNA, 22 nt, Homo sapiens
guaaucucaccuacuugggagg

SEQ ID NO: 162916 - RNA, 22 nt, Homo sapiens
guaaucucagcuacucgggaga

SEQ ID NO: 162917 - RNA, 22 nt, Homo sapiens
guaaucucagcuucuugggagg

SEQ ID NO: 162918 - RNA, 22 nt, Homo sapiens
guaaugcacucccaaagaucca

SEQ ID NO: 162919 - RNA, 22 nt, Homo sapiens
guacaguacugaaugaauguau

SEQ ID NO: 162920 - RNA, 22 nt, Homo sapiens
guacagugcucacaaugagagc

SEQ ID NO: 162921 - RNA, 22 nt, Homo sapiens
guacaugugcacagugugcagg

SEQ ID NO: 162922 - RNA, 22 nt, Homo sapiens
guagcagaacauguuccuugua

SEQ ID NO: 162923 - RNA, 22 nt, Homo sapiens
guaucucaguucucgugauuag

SEQ ID NO: 162924 - RNA, 22 nt, Homo sapiens
guauuguacuacaagcucuuua

SEQ ID NO: 162925 - RNA, 22 nt, Homo sapiens
guauuugauuauagcaugcuua

SEQ ID NO: 162926 - RNA, 20 nt, Homo sapiens
gucacuggcccagggcuugu

SEQ ID NO: 162927 - RNA, 22 nt, Homo sapiens
gucagcaucaccaugucuauga

SEQ ID NO: 162928 - RNA, 20 nt, Homo sapiens
guccauuugcugccauugcu

SEQ ID NO: 162929 - RNA, 22 nt, Homo sapiens
guccuguuuuuaagguucauag

SEQ ID NO: 162930 - RNA, 22 nt, Homo sapiens
gucuuugagauaggguuauuuu

SEQ ID NO: 162931 - RNA, 22 nt, Homo sapiens
gucuuugaugucuaugugcuuc

SEQ ID NO: 162932 - RNA, 22 nt, Homo sapiens
gugaaaugaaacgcuaugucuu

SEQ ID NO: 162933 - RNA, 22 nt, Homo sapiens
gugaaaugaaucuggaaauauu

SEQ ID NO: 162934 - RNA, 20 nt, Homo sapiens
gugagaacaugugguauuug

SEQ ID NO: 162935 - RNA, 22 nt, Homo sapiens
gugagaccaauguacuaccuuc

SEQ ID NO: 162936 - RNA, 22 nt, Homo sapiens
gugagaggaggcagcuuuuaca

SEQ ID NO: 162937 - RNA, 22 nt, Homo sapiens
gugagggaugugaaaaagguca

SEQ ID NO: 162938 - RNA, 21 nt, Homo sapiens
gugaggucauugggcuuucug

SEQ ID NO: 162939 - RNA, 22 nt, Homo sapiens
gugauguguuucaacagcuccu

SEQ ID NO: 162940 - RNA, 22 nt, Homo sapiens
gugcacaaaucuuaaauguaca

SEQ ID NO: 162941 - RNA, 21 nt, Homo sapiens
gugcacaguaguguuuaauag

SEQ ID NO: 162942 - RNA, 19 nt, Homo sapiens
gugcauaguuauuaaagag

SEQ ID NO: 162943 - RNA, 22 nt, Homo sapiens
gugcauguccacuaguccauau

SEQ ID NO: 162944 - RNA, 22 nt, Homo sapiens
gugcuuuguuguggcaguggca

SEQ ID NO: 162945 - RNA, 22 nt, Homo sapiens
guggaaaucucugugugacuua

SEQ ID NO: 162946 - RNA, 22 nt, Homo sapiens
guggaagaccagacuuuccaac

SEQ ID NO: 162947 - RNA, 22 nt, Homo sapiens
guggaagcacaggccuccugga

SEQ ID NO: 162948 - RNA, 22 nt, Homo sapiens
guggacggagguugcagugagc

SEQ ID NO: 162949 - RNA, 22 nt, Homo sapiens
guggcaaggaaaugcugcucac

SEQ ID NO: 162950 - RNA, 22 nt, Homo sapiens
guggcagagucagagggaaaug

SEQ ID NO: 162951 - RNA, 22 nt, Homo sapiens
guguaaaucaaucuguugucuu

SEQ ID NO: 162952 - RNA, 22 nt, Homo sapiens
guguauacauagaauuguguau

SEQ ID NO: 162953 - RNA, 22 nt, Homo sapiens
guguauauccuauuaguucugu

SEQ ID NO: 162954 - RNA, 22 nt, Homo sapiens
guguauucaucuggcugaggua

SEQ ID NO: 162955 - RNA, 22 nt, Homo sapiens
gugugcacaaucuggcaugugc

SEQ ID NO: 162956 - RNA, 22 nt, Homo sapiens
gugugguauuauaacuagguau

SEQ ID NO: 162957 - RNA, 22 nt, Homo sapiens
guguuauugagaaauagggugu

SEQ ID NO: 162958 - RNA, 22 nt, Homo sapiens
guguuauuuugcugggaaugau

SEQ ID NO: 162959 - RNA, 22 nt, Homo sapiens
guguucaaagcugauugagauu

SEQ ID NO: 162960 - RNA, 18 nt, Homo sapiens
guugagcuuuuccuuuag

SEQ ID NO: 162961 - RNA, 22 nt, Homo sapiens
guuggcaaguggcugagcuggg

SEQ ID NO: 162962 - RNA, 22 nt, Homo sapiens
guugguuuccuguaacuggaca

SEQ ID NO: 162963 - RNA, 22 nt, Homo sapiens
guuugugguuaaagccuuucau

SEQ ID NO: 162964 - RNA, 22 nt, Homo sapiens
guuuugguuauauggaucaguu

SEQ ID NO: 162965 - RNA, 22 nt, Homo sapiens
uaaaagucaucacaacuggagu

SEQ ID NO: 162966 - RNA, 22 nt, Homo sapiens
uaaagccagugauuaugucucu

SEQ ID NO: 162967 - RNA, 21 nt, Homo sapiens
uaaagcuuagcuauaguggcu

SEQ ID NO: 162968 - RNA, 22 nt, Homo sapiens
uaacaggcuacucuugcauugc

SEQ ID NO: 162969 - RNA, 22 nt, Homo sapiens
uaacauuguugauuauacuaag

SEQ ID NO: 162970 - RNA, 22 nt, Homo sapiens
uaagacuuuuugggaauauaga

SEQ ID NO: 162971 - RNA, 22 nt, Homo sapiens
uaaggaguagaauaguaaggca

SEQ ID NO: 162972 - RNA, 22 nt, Homo sapiens
uaagugcaacauaaguguuaaa

SEQ ID NO: 162973 - RNA, 22 nt, Homo sapiens
uaauagcucggauaaacaugau

SEQ ID NO: 162974 - RNA, 22 nt, Homo sapiens
uaauccuggcacuuugggaggc

SEQ ID NO: 162975 - RNA, 22 nt, Homo sapiens
uaaugcaucagugguaguucuu

SEQ ID NO: 162976 - RNA, 22 nt, Homo sapiens
uacaaagugggaaacgaagguu

SEQ ID NO: 162977 - RNA, 22 nt, Homo sapiens
uacaagcacaggcagcaggcug

SEQ ID NO: 162978 - RNA, 21 nt, Homo sapiens
uacaagcuguagcacaugcca

SEQ ID NO: 162979 - RNA, 21 nt, Homo sapiens
uacaaugcacaggagagccuc

SEQ ID NO: 162980 - RNA, 22 nt, Homo sapiens
uacaggauagacaauuuauuaa

SEQ ID NO: 162981 - RNA, 22 nt, Homo sapiens
uacaguggcaugucaggugcuu

SEQ ID NO: 162982 - RNA, 19 nt, Homo sapiens
uacaugcagcaggcacgca

SEQ ID NO: 162983 - RNA, 22 nt, Homo sapiens
uacaugugccauguugguuugc

SEQ ID NO: 162984 - RNA, 22 nt, Homo sapiens
uaccaaguauuuucacaugaac

SEQ ID NO: 162985 - RNA, 19 nt, Homo sapiens
uacccagaagcagcauugu

SEQ ID NO: 162986 - RNA, 22 nt, Homo sapiens
uaccuaguaggagggaggugga

SEQ ID NO: 162987 - RNA, 22 nt, Homo sapiens
uaccugagacaacuuugaggaa

SEQ ID NO: 162988 - RNA, 22 nt, Homo sapiens
uacucacauucuguuucuugcu

SEQ ID NO: 162989 - RNA, 22 nt, Homo sapiens
uacucugcagccauaaaacaga

SEQ ID NO: 162990 - RNA, 22 nt, Homo sapiens
uacugcacauaugaagguuccc

SEQ ID NO: 162991 - RNA, 20 nt, Homo sapiens
uacugcacuccaaccuaggc

SEQ ID NO: 162992 - RNA, 22 nt, Homo sapiens
uacugcacuccagccucgguga

SEQ ID NO: 162993 - RNA, 22 nt, Homo sapiens
uacugcacuccagccugccaac

SEQ ID NO: 162994 - RNA, 22 nt, Homo sapiens
uacugcacuccagccugggaga

SEQ ID NO: 162995 - RNA, 21 nt, Homo sapiens
uagagcuuggcacagaguaga

SEQ ID NO: 162996 - RNA, 22 nt, Homo sapiens
uagauaauuagaggguuuuaag

SEQ ID NO: 162997 - RNA, 22 nt, Homo sapiens
uagauaguuaugauuugaugau

SEQ ID NO: 162998 - RNA, 22 nt, Homo sapiens
uagauuaucauucauacaggga

SEQ ID NO: 162999 - RNA, 20 nt, Homo sapiens
auucauggaggagcaauugg

SEQ ID NO: 163000 - RNA, 22 nt, Homo sapiens
auucccuuagcugccucagccu

SEQ ID NO: 163001 - RNA, 22 nt, Homo sapiens
auuccuuaggcccuuugguuag

SEQ ID NO: 163002 - RNA, 22 nt, Homo sapiens
auugaacuuuugucacugacau

SEQ ID NO: 163003 - RNA, 22 nt, Homo sapiens
auugaauuugguuugcuaagaa

SEQ ID NO: 163004 - RNA, 22 nt, Homo sapiens
auugaggcaggaggaccaucua

SEQ ID NO: 163005 - RNA, 22 nt, Homo sapiens
auugagucauuucaaauccaag

SEQ ID NO: 163006 - RNA, 21 nt, Homo sapiens
auugcacaauauacccaugua

SEQ ID NO: 163007 - RNA, 22 nt, Homo sapiens
auugcacuccggccugggugac

SEQ ID NO: 163008 - RNA, 22 nt, Homo sapiens
auugcacuggggguuagaauuu

SEQ ID NO: 163009 - RNA, 23 nt, Homo sapiens
auugcagaaucacagagguagug

SEQ ID NO: 163010 - RNA, 23 nt, Homo sapiens
auugcagucuugaacuccugggc

SEQ ID NO: 163011 - RNA, 22 nt, Homo sapiens
auuggacagcauuucuagacuu

SEQ ID NO: 163012 - RNA, 22 nt, Homo sapiens
auuggcuauuuggugagugauu

SEQ ID NO: 163013 - RNA, 22 nt, Homo sapiens
auuggguuaaaggauaugaaca

SEQ ID NO: 163014 - RNA, 22 nt, Homo sapiens
auuguaguacauuuggugguca

SEQ ID NO: 163015 - RNA, 22 nt, Homo sapiens
auugucacugugcuccaccagu

SEQ ID NO: 163016 - RNA, 22 nt, Homo sapiens
auugucccucuuaaucccagca

SEQ ID NO: 163017 - RNA, 22 nt, Homo sapiens
auugugauggucaaaggaaaua

SEQ ID NO: 163018 - RNA, 22 nt, Homo sapiens
auuguucuuguguccuuuuccu

SEQ ID NO: 163019 - RNA, 22 nt, Homo sapiens
auuucuacuccuguguccagaa

SEQ ID NO: 163020 - RNA, 22 nt, Homo sapiens
auuuggcaauuuugaagaugcc

SEQ ID NO: 163021 - RNA, 22 nt, Homo sapiens
caaaggcuuccacugcauccuu

SEQ ID NO: 163022 - RNA, 22 nt, Homo sapiens
caaaggcuucugaaacugcaga

SEQ ID NO: 163023 - RNA, 22 nt, Homo sapiens
caaaguaauugcuguuuugcca

SEQ ID NO: 163024 - RNA, 22 nt, Homo sapiens
caaagucuucaguugauucuga

SEQ ID NO: 163025 - RNA, 22 nt, Homo sapiens
caaagucuucucauuaugucuu

SEQ ID NO: 163026 - RNA, 22 nt, Homo sapiens
caaagugcugaaagaggccagg

SEQ ID NO: 163027 - RNA, 22 nt, Homo sapiens
caaagugcuggaauuggccggg

SEQ ID NO: 163028 - RNA, 22 nt, Homo sapiens
caaagugcugggaugggccagg

SEQ ID NO: 163029 - RNA, 22 nt, Homo sapiens
caaauccucaccucaucaugaa

SEQ ID NO: 163030 - RNA, 22 nt, Homo sapiens
caaaugacaucauuucauucaa

SEQ ID NO: 163031 - RNA, 22 nt, Homo sapiens
caaauugcuugucuguagugga

SEQ ID NO: 163032 - RNA, 19 nt, Homo sapiens
caacccugcagagaaagga

SEQ ID NO: 163033 - RNA, 22 nt, Homo sapiens
caauggcaaugaaauagugaga

SEQ ID NO: 163034 - RNA, 21 nt, Homo sapiens
caauggcacaaucucugcuca

SEQ ID NO: 163035 - RNA, 22 nt, Homo sapiens
caauggcacuauuggaaaaggu

SEQ ID NO: 163036 - RNA, 22 nt, Homo sapiens
caaugguccccauuggcaggaa

SEQ ID NO: 163037 - RNA, 22 nt, Homo sapiens
caaugugcuuggggcacaugag

SEQ ID NO: 163038 - RNA, 22 nt, Homo sapiens
cacaaaguagauuagucuucca

SEQ ID NO: 163039 - RNA, 22 nt, Homo sapiens
cacaaccuccgccuccuggguu

SEQ ID NO: 163040 - RNA, 22 nt, Homo sapiens
cacaaugucuaagauguuucua

SEQ ID NO: 163041 - RNA, 22 nt, Homo sapiens
cacacugucuuucagaaugguu

SEQ ID NO: 163042 - RNA, 22 nt, Homo sapiens
cacagcgacuuccgccuaccgg

SEQ ID NO: 163043 - RNA, 22 nt, Homo sapiens
cacaggaagaggcacggucccu

SEQ ID NO: 163044 - RNA, 22 nt, Homo sapiens
cacaggccugucucuuucuaac

SEQ ID NO: 163045 - RNA, 22 nt, Homo sapiens
cacauguucaggagcacuuaga

SEQ ID NO: 163046 - RNA, 22 nt, Homo sapiens
cacauguuugcuacauuuuucu

SEQ ID NO: 163047 - RNA, 22 nt, Homo sapiens
caccacagccauuauugucccc

SEQ ID NO: 163048 - RNA, 22 nt, Homo sapiens
caccagcuggcauugaauaccu

SEQ ID NO: 163049 - RNA, 22 nt, Homo sapiens
caccagguuggagugcaguggu

SEQ ID NO: 163050 - RNA, 23 nt, Homo sapiens
caccaguagaaugugugggaggg

SEQ ID NO: 163051 - RNA, 19 nt, Homo sapiens
caccagugcaugcuacuau

SEQ ID NO: 163052 - RNA, 22 nt, Homo sapiens
caccccuaccugagucaggagu

SEQ ID NO: 163053 - RNA, 22 nt, Homo sapiens
caccugagcgggaugcucgccu

SEQ ID NO: 163054 - RNA, 22 nt, Homo sapiens
cacuaggcuggagugcaguggc

SEQ ID NO: 163055 - RNA, 22 nt, Homo sapiens
cacugcacuccagcuugugggc

SEQ ID NO: 163056 - RNA, 22 nt, Homo sapiens
cacugcauccucugccuggcgg

SEQ ID NO: 163057 - RNA, 21 nt, Homo sapiens
cacugguguugcuauaucaaa

SEQ ID NO: 163058 - RNA, 22 nt, Homo sapiens
cacuguggauggaacuauguga

SEQ ID NO: 163059 - RNA, 22 nt, Homo sapiens
cagacaugucuuguggccgugg

SEQ ID NO: 163060 - RNA, 22 nt, Homo sapiens
cagagaaugucuuuuuuaacca

SEQ ID NO: 163061 - RNA, 22 nt, Homo sapiens
cagcacauagcaguugcucagu

SEQ ID NO: 163062 - RNA, 22 nt, Homo sapiens
cagcaucauucaucugggguaa

SEQ ID NO: 163063 - RNA, 22 nt, Homo sapiens
cagccgggugagguggcuuguu

SEQ ID NO: 163064 - RNA, 22 nt, Homo sapiens
cagcuaaauuguuaaauccaag

SEQ ID NO: 163065 - RNA, 22 nt, Homo sapiens
cagcuaguaauuuauugaagau

SEQ ID NO: 163066 - RNA, 22 nt, Homo sapiens
cagcugguggcaagaagacaga

SEQ ID NO: 163067 - RNA, 22 nt, Homo sapiens
cagcuggugggagcuggguucc

SEQ ID NO: 163068 - RNA, 22 nt, Homo sapiens
caggcacgcuugggagacacac

SEQ ID NO: 163069 - RNA, 22 nt, Homo sapiens
caggcagucuggggguguaucc

SEQ ID NO: 163070 - RNA, 22 nt, Homo sapiens
caggcauagucuugaguuuuau

SEQ ID NO: 163071 - RNA, 22 nt, Homo sapiens
cagguacauuuuaaagggcuca

SEQ ID NO: 163072 - RNA, 22 nt, Homo sapiens
caggugcauuggcugacaccug

SEQ ID NO: 163073 - RNA, 22 nt, Homo sapiens
caguagcaugccucagaaugag

SEQ ID NO: 163074 - RNA, 22 nt, Homo sapiens
cagugacacugaaaaguucggg

SEQ ID NO: 163075 - RNA, 18 nt, Homo sapiens
cagugcaauacaggagag

SEQ ID NO: 163076 - RNA, 22 nt, Homo sapiens
cagugcacugggauuauaagug

SEQ ID NO: 163077 - RNA, 22 nt, Homo sapiens
cagugcauagaugugccacauu

SEQ ID NO: 163078 - RNA, 22 nt, Homo sapiens
cagugguuuucaacccugguug

SEQ ID NO: 163079 - RNA, 22 nt, Homo sapiens
cauacaguaggcacuauuugua

SEQ ID NO: 163080 - RNA, 22 nt, Homo sapiens
caucacagcaaguagggagugg

SEQ ID NO: 163081 - RNA, 22 nt, Homo sapiens
caucagcaauguaugaggguuc

SEQ ID NO: 163082 - RNA, 22 nt, Homo sapiens
caugacacauguuuaccuaugu

SEQ ID NO: 163083 - RNA, 22 nt, Homo sapiens
cugagcaauauagugagaucuu

SEQ ID NO: 163084 - RNA, 22 nt, Homo sapiens
cugagcaugacaucaugugacu

SEQ ID NO: 163085 - RNA, 22 nt, Homo sapiens
cugaggacaucagggaagcauc

SEQ ID NO: 163086 - RNA, 22 nt, Homo sapiens
cugaggguagaaggaucacuug

SEQ ID NO: 163087 - RNA, 21 nt, Homo sapiens
cugaucacaggugagcugccu

SEQ ID NO: 163088 - RNA, 22 nt, Homo sapiens
cugaucuggaggugucugggga

SEQ ID NO: 163089 - RNA, 22 nt, Homo sapiens
cugaucuguagcagccaccaca

SEQ ID NO: 163090 - RNA, 22 nt, Homo sapiens
cugcaagaaucguaguauuuga

SEQ ID NO: 163091 - RNA, 22 nt, Homo sapiens
cugcuggucuuuaaggucuagg

SEQ ID NO: 163092 - RNA, 22 nt, Homo sapiens
cuggaaacaucuuaggaaugca

SEQ ID NO: 163093 - RNA, 22 nt, Homo sapiens
cuggaagaaaaucacgccaucu

SEQ ID NO: 163094 - RNA, 22 nt, Homo sapiens
cuggaauucaaaaucugaauuu

SEQ ID NO: 163095 - RNA, 22 nt, Homo sapiens
cuggaguaugaaccauguauca

SEQ ID NO: 163096 - RNA, 20 nt, Homo sapiens
cuggaucaucaguaaaguua

SEQ ID NO: 163097 - RNA, 20 nt, Homo sapiens
cuggaugucgaggcagaggu

SEQ ID NO: 163098 - RNA, 22 nt, Homo sapiens
cuggcaagagugaaccagcugu

SEQ ID NO: 163099 - RNA, 22 nt, Homo sapiens
cuggcaccauacacuguuguug

SEQ ID NO: 163100 - RNA, 22 nt, Homo sapiens
cuggcaucuaaauacuugaugu

SEQ ID NO: 163101 - RNA, 22 nt, Homo sapiens
cuggcucugagguguuuagggc

SEQ ID NO: 163102 - RNA, 22 nt, Homo sapiens
cugggaugauguaaauaggcua

SEQ ID NO: 163103 - RNA, 22 nt, Homo sapiens
cugggguaggacuggcuuuuga

SEQ ID NO: 163104 - RNA, 22 nt, Homo sapiens
cuggguacccuuuaaacaggaa

SEQ ID NO: 163105 - RNA, 22 nt, Homo sapiens
cuguagcuuuuauaugcuuagc

SEQ ID NO: 163106 - RNA, 22 nt, Homo sapiens
cugucacuggggcacauguccc

SEQ ID NO: 163107 - RNA, 22 nt, Homo sapiens
cugucuggaggccugcaaauaa

SEQ ID NO: 163108 - RNA, 22 nt, Homo sapiens
cugugaagaaagucauugguag

SEQ ID NO: 163109 - RNA, 22 nt, Homo sapiens
cugugaucuuuuuucauguggu

SEQ ID NO: 163110 - RNA, 22 nt, Homo sapiens
cugugcaugcgcggagcugaaa

SEQ ID NO: 163111 - RNA, 22 nt, Homo sapiens
cugugcauguaugcgugaguuc

SEQ ID NO: 163112 - RNA, 22 nt, Homo sapiens
cugugccaagcuugcgaugugc

SEQ ID NO: 163113 - RNA, 22 nt, Homo sapiens
cugugcuugagagaugacacag

SEQ ID NO: 163114 - RNA, 19 nt, Homo sapiens
cuuaggugaccaguuccca

SEQ ID NO: 163115 - RNA, 22 nt, Homo sapiens
cuucagcaauauauccccuggg

SEQ ID NO: 163116 - RNA, 18 nt, Homo sapiens
cuucauugcuguuuugcu

SEQ ID NO: 163117 - RNA, 22 nt, Homo sapiens
cuucggugaguagauggguuaa

SEQ ID NO: 163118 - RNA, 22 nt, Homo sapiens
cuucugauugaaaauggaguag

SEQ ID NO: 163119 - RNA, 22 nt, Homo sapiens
cuugccuuugucuucaaaggcu

SEQ ID NO: 163120 - RNA, 22 nt, Homo sapiens
cuuggacaccucaugcccaccu

SEQ ID NO: 163121 - RNA, 22 nt, Homo sapiens
cuuggcauugccccuggaauuu

SEQ ID NO: 163122 - RNA, 22 nt, Homo sapiens
cuuggcuagucaaaccuccccg

SEQ ID NO: 163123 - RNA, 22 nt, Homo sapiens
cuuggcuccgacuccccuccaa

SEQ ID NO: 163124 - RNA, 20 nt, Homo sapiens
cuuggcuuucuugguguuaa

SEQ ID NO: 163125 - RNA, 21 nt, Homo sapiens
cuugucuugcuuagaauagac

SEQ ID NO: 163126 - RNA, 22 nt, Homo sapiens
cuuguguuacauauuuaagaga

SEQ ID NO: 163127 - RNA, 22 nt, Homo sapiens
cuuugcaaauggccuuuccaag

SEQ ID NO: 163128 - RNA, 22 nt, Homo sapiens
cuuugcacaucucugcuuuccc

SEQ ID NO: 163129 - RNA, 22 nt, Homo sapiens
cuuuggcauuagccuguauaga

SEQ ID NO: 163130 - RNA, 22 nt, Homo sapiens
cuuuggccauagcuaaaugauu

SEQ ID NO: 163131 - RNA, 18 nt, Homo sapiens
cuuugguccccgcacccu

SEQ ID NO: 163132 - RNA, 23 nt, Homo sapiens
cuuuguccccacccaaaucucau

SEQ ID NO: 163133 - RNA, 22 nt, Homo sapiens
cuuuuacacugcuggugggaau

SEQ ID NO: 163134 - RNA, 22 nt, Homo sapiens
cuuuuacacuguuggugggaau

SEQ ID NO: 163135 - RNA, 22 nt, Homo sapiens
gaaaauccauccccagggagua

SEQ ID NO: 163136 - RNA, 22 nt, Homo sapiens
gaaagguaggaacagggugcag

SEQ ID NO: 163137 - RNA, 18 nt, Homo sapiens
gaaaugccucuugcuuac

SEQ ID NO: 163138 - RNA, 23 nt, Homo sapiens
gaaauguaagugaugccccacag

SEQ ID NO: 163139 - RNA, 22 nt, Homo sapiens
gaacccuggaggcggagguugc

SEQ ID NO: 163140 - RNA, 22 nt, Homo sapiens
gaacugggguuggguugcgaua

SEQ ID NO: 163141 - RNA, 20 nt, Homo sapiens
gaacugguguauguuuaacu

SEQ ID NO: 163142 - RNA, 22 nt, Homo sapiens
gaaggagcuuaucugccauuuc

SEQ ID NO: 163143 - RNA, 22 nt, Homo sapiens
gaaggcacugugugccacccug

SEQ ID NO: 163144 - RNA, 22 nt, Homo sapiens
gaagugcaguggcacagucaug

SEQ ID NO: 163145 - RNA, 17 nt, Homo sapiens
gaaguguuucuucauga

SEQ ID NO: 163146 - RNA, 19 nt, Homo sapiens
gaaguguuuguucuccaug

SEQ ID NO: 163147 - RNA, 22 nt, Homo sapiens
gaaucacaguuauuagagcagc

SEQ ID NO: 163148 - RNA, 22 nt, Homo sapiens
gaaucauuguuucuaaguuugu

SEQ ID NO: 163149 - RNA, 22 nt, Homo sapiens
gaaugaauguuuauccuuagau

SEQ ID NO: 163150 - RNA, 22 nt, Homo sapiens
gaaugcuaaguuuccucccugu

SEQ ID NO: 163151 - RNA, 22 nt, Homo sapiens
gacagagcaagacccuauuuaa

SEQ ID NO: 163152 - RNA, 22 nt, Homo sapiens
gacagugagaugucaugugaaa

SEQ ID NO: 163153 - RNA, 22 nt, Homo sapiens
gacauguuuacaguguugagag

SEQ ID NO: 163154 - RNA, 22 nt, Homo sapiens
gacauguuucucucuguuuacu

SEQ ID NO: 163155 - RNA, 22 nt, Homo sapiens
gacccuguugggguuuagggcu

SEQ ID NO: 163156 - RNA, 22 nt, Homo sapiens
gacccuuagaaugugaucuuau

SEQ ID NO: 163157 - RNA, 21 nt, Homo sapiens
gacuacaccaggaugcuaguu

SEQ ID NO: 163158 - RNA, 22 nt, Homo sapiens
gacugaguaagcagaagcaauu

SEQ ID NO: 163159 - RNA, 21 nt, Homo sapiens
gagaaucuuuucagggcaaac

SEQ ID NO: 163160 - RNA, 22 nt, Homo sapiens
gagaaugagauuaugguuacau

SEQ ID NO: 163161 - RNA, 22 nt, Homo sapiens
gagacauugacuuuguuccaga

SEQ ID NO: 163162 - RNA, 22 nt, Homo sapiens
gagaccauuuacugccuacuua

SEQ ID NO: 163163 - RNA, 22 nt, Homo sapiens
gagacggagucucgcucuguca

SEQ ID NO: 163164 - RNA, 22 nt, Homo sapiens
gagagugaaguuugcuaccugu

SEQ ID NO: 163165 - RNA, 22 nt, Homo sapiens
gagauaaauaggucacaguucu

SEQ ID NO: 163166 - RNA, 22 nt, Homo sapiens
gagauaauuugaaucauggggg

SEQ ID NO: 163167 - RNA, 22 nt, Homo sapiens
ggaaagacaccuuacuauguua

SEQ ID NO: 163168 - RNA, 22 nt, Homo sapiens
ggaaagacuauuguaaaggaug

SEQ ID NO: 163169 - RNA, 22 nt, Homo sapiens
ggaaauguuuagcauccacuuu

SEQ ID NO: 163170 - RNA, 22 nt, Homo sapiens
ggaacaccauuuuuccugccuu

SEQ ID NO: 163171 - RNA, 18 nt, Homo sapiens
ggaagccuauuuaguaac

SEQ ID NO: 163172 - RNA, 22 nt, Homo sapiens
ggaagccugcacucgggcaggg

SEQ ID NO: 163173 - RNA, 22 nt, Homo sapiens
ggaaguuaauacagauagagua

SEQ ID NO: 163174 - RNA, 23 nt, Homo sapiens
ggaaugaaaccugguuaugauau

SEQ ID NO: 163175 - RNA, 22 nt, Homo sapiens
ggaaugcuaaaauaggaugcug

SEQ ID NO: 163176 - RNA, 22 nt, Homo sapiens
ggacaagaucuuccaccauuca

SEQ ID NO: 163177 - RNA, 22 nt, Homo sapiens
ggacugagaggacuacagugua

SEQ ID NO: 163178 - RNA, 22 nt, Homo sapiens
ggagaucuuugaaguguugugc

SEQ ID NO: 163179 - RNA, 22 nt, Homo sapiens
ggagggugagaucaauuuggga

SEQ ID NO: 163180 - RNA, 22 nt, Homo sapiens
ggaguaaaagaguaggaggaau

SEQ ID NO: 163181 - RNA, 22 nt, Homo sapiens
ggagucugacuuauaggaaccu

SEQ ID NO: 163182 - RNA, 22 nt, Homo sapiens
ggagucuugcuauguugccaag

SEQ ID NO: 163183 - RNA, 21 nt, Homo sapiens
ggauagaaaacuuggcuguau

SEQ ID NO: 163184 - RNA, 23 nt, Homo sapiens
ggauggaaaguuuugagggccac

SEQ ID NO: 163185 - RNA, 22 nt, Homo sapiens
ggcaaaugaagauggagaggcu

SEQ ID NO: 163186 - RNA, 22 nt, Homo sapiens
ggcaacauggugaaacucuguc

SEQ ID NO: 163187 - RNA, 22 nt, Homo sapiens
ggcaagaaccucaauuaccuuu

SEQ ID NO: 163188 - RNA, 22 nt, Homo sapiens
ggcaagaagagaguuuaaacau

SEQ ID NO: 163189 - RNA, 19 nt, Homo sapiens
ggcaagaguuguucugugu

SEQ ID NO: 163190 - RNA, 22 nt, Homo sapiens
ggcaaggugaugaaugucuaca

SEQ ID NO: 163191 - RNA, 22 nt, Homo sapiens
ggcaagugggagggaguguuuc

SEQ ID NO: 163192 - RNA, 22 nt, Homo sapiens
ggcaccauuuuacuccuucccu

SEQ ID NO: 163193 - RNA, 22 nt, Homo sapiens
ggcacuguugccggccugaauu

SEQ ID NO: 163194 - RNA, 22 nt, Homo sapiens
ggcagaauugcugaggaugcua

SEQ ID NO: 163195 - RNA, 22 nt, Homo sapiens
ggcagaguggacauuuaaaugu

SEQ ID NO: 163196 - RNA, 22 nt, Homo sapiens
ggcagcauugccuuugcaguga

SEQ ID NO: 163197 - RNA, 22 nt, Homo sapiens
ggcaguuucucaggcaggggua

SEQ ID NO: 163198 - RNA, 22 nt, Homo sapiens
ggcaguuuggcaguuucauaaa

SEQ ID NO: 163199 - RNA, 22 nt, Homo sapiens
ggcaguuuguuugugaggucca

SEQ ID NO: 163200 - RNA, 22 nt, Homo sapiens
ggccagaugcaguggcucacac

SEQ ID NO: 163201 - RNA, 22 nt, Homo sapiens
ggccggguggccauggcugccc

SEQ ID NO: 163202 - RNA, 22 nt, Homo sapiens
ggcucguguuuucuguccaguu

SEQ ID NO: 163203 - RNA, 21 nt, Homo sapiens
ggcucuguggucucagguuuc

SEQ ID NO: 163204 - RNA, 22 nt, Homo sapiens
ggcuuggaggaaugugagggcu

SEQ ID NO: 163205 - RNA, 22 nt, Homo sapiens
gggaagaaggagugguuuacuc

SEQ ID NO: 163206 - RNA, 22 nt, Homo sapiens
gggaagauauaggcugggcacc

SEQ ID NO: 163207 - RNA, 22 nt, Homo sapiens
gggaaugaagagaaccuuccca

SEQ ID NO: 163208 - RNA, 22 nt, Homo sapiens
gggcaagaagucuuguaguuuu

SEQ ID NO: 163209 - RNA, 20 nt, Homo sapiens
gggcaaguaugugggaaguc

SEQ ID NO: 163210 - RNA, 22 nt, Homo sapiens
ggggaguguggacaucacccug

SEQ ID NO: 163211 - RNA, 22 nt, Homo sapiens
ggggcaaaaugccacgagucuc

SEQ ID NO: 163212 - RNA, 22 nt, Homo sapiens
gggggagugugguacccagcau

SEQ ID NO: 163213 - RNA, 22 nt, Homo sapiens
ggguaggcaagcggaugucaga

SEQ ID NO: 163214 - RNA, 22 nt, Homo sapiens
ggguucccuucuggcucagggu

SEQ ID NO: 163215 - RNA, 22 nt, Homo sapiens
ggucaacaucaucaugguaagu

SEQ ID NO: 163216 - RNA, 22 nt, Homo sapiens
ggucacccugaugcuggugguc

SEQ ID NO: 163217 - RNA, 22 nt, Homo sapiens
ggucugguguugaaauucuuca

SEQ ID NO: 163218 - RNA, 22 nt, Homo sapiens
gguggucuuccccuggaguucg

SEQ ID NO: 163219 - RNA, 22 nt, Homo sapiens
guaacucugucacuuacuaguu

SEQ ID NO: 163220 - RNA, 22 nt, Homo sapiens
guaaucucagcuacuugggagc

SEQ ID NO: 163221 - RNA, 19 nt, Homo sapiens
guaaucucaguacuuuggu

SEQ ID NO: 163222 - RNA, 22 nt, Homo sapiens
guacacauacauauaugugugu

SEQ ID NO: 163223 - RNA, 17 nt, Homo sapiens
guacacuucuucuguga

SEQ ID NO: 163224 - RNA, 22 nt, Homo sapiens
guacaggugcaggaugggcagg

SEQ ID NO: 163225 - RNA, 22 nt, Homo sapiens
guacaguggguguagggaccag

SEQ ID NO: 163226 - RNA, 22 nt, Homo sapiens
guacaugcauaguuuauuucug

SEQ ID NO: 163227 - RNA, 22 nt, Homo sapiens
guagcagaauaucagauaauuu

SEQ ID NO: 163228 - RNA, 22 nt, Homo sapiens
guagcagcuacuaaguugcugu

SEQ ID NO: 163229 - RNA, 22 nt, Homo sapiens
guauacaugucaaaacucacau

SEQ ID NO: 163230 - RNA, 19 nt, Homo sapiens
guauuugacuuucuuguuu

SEQ ID NO: 163231 - RNA, 22 nt, Homo sapiens
guauuuuguuagggugugguau

SEQ ID NO: 163232 - RNA, 22 nt, Homo sapiens
gucaaagugauuguaauuaggu

SEQ ID NO: 163233 - RNA, 22 nt, Homo sapiens
gucacagaaaaagauaugccaa

SEQ ID NO: 163234 - RNA, 22 nt, Homo sapiens
gucacaggaaacuaauaugcgc

SEQ ID NO: 163235 - RNA, 22 nt, Homo sapiens
gucacugagcaauagaaaguuu

SEQ ID NO: 163236 - RNA, 22 nt, Homo sapiens
gucacugagcagaaggaagcga

SEQ ID NO: 163237 - RNA, 22 nt, Homo sapiens
gucacugggugcugcgccuguc

SEQ ID NO: 163238 - RNA, 22 nt, Homo sapiens
gucagaaucucagaugacaacg

SEQ ID NO: 163239 - RNA, 22 nt, Homo sapiens
gucagguaccugaaagcagcca

SEQ ID NO: 163240 - RNA, 22 nt, Homo sapiens
gucaucaucaguccucugugca

SEQ ID NO: 163241 - RNA, 22 nt, Homo sapiens
gucauucauucagcaagcacug

SEQ ID NO: 163242 - RNA, 20 nt, Homo sapiens
guccauuugcugccauugcu

SEQ ID NO: 163243 - RNA, 22 nt, Homo sapiens
guccugaagaccuuccucugga

SEQ ID NO: 163244 - RNA, 22 nt, Homo sapiens
gucucauugcaguuagaccugu

SEQ ID NO: 163245 - RNA, 23 nt, Homo sapiens
gucuggucccugguuggaaacca

SEQ ID NO: 163246 - RNA, 22 nt, Homo sapiens
gucugugguuccuaugucaccu

SEQ ID NO: 163247 - RNA, 22 nt, Homo sapiens
gucuuggagaacucagcuuggc

SEQ ID NO: 163248 - RNA, 22 nt, Homo sapiens
gucuuuaguugaaacauguggu

SEQ ID NO: 163249 - RNA, 22 nt, Homo sapiens
gucuuuugcuagccagagagcu

SEQ ID NO: 163250 - RNA, 22 nt, Homo sapiens
gugaaugcauuaagaaggggga

SEQ ID NO: 163251 - RNA, 22 nt, Homo sapiens
uaaguauuaugugcugcauuuu

SEQ ID NO: 163252 - RNA, 23 nt, Homo sapiens
uaagucacacagauuaauuuauu

SEQ ID NO: 163253 - RNA, 22 nt, Homo sapiens
uaagugaauuugacagguaaug

SEQ ID NO: 163254 - RNA, 20 nt, Homo sapiens
uaagugcauaggauauuucu

SEQ ID NO: 163255 - RNA, 22 nt, Homo sapiens
uaagugcuugacuuugauguuu

SEQ ID NO: 163256 - RNA, 22 nt, Homo sapiens
uaaguucauucaugaaacuuag

SEQ ID NO: 163257 - RNA, 22 nt, Homo sapiens
uaauacauucaaggugguaguu

SEQ ID NO: 163258 - RNA, 22 nt, Homo sapiens
uaauccuggcacuuugggaggc

SEQ ID NO: 163259 - RNA, 22 nt, Homo sapiens
uaauugcaguucuguguuauau

SEQ ID NO: 163260 - RNA, 22 nt, Homo sapiens
uacaaagcuuugaugugucuuu

SEQ ID NO: 163261 - RNA, 22 nt, Homo sapiens
uacaaagugggaaacgaagguu

SEQ ID NO: 163262 - RNA, 22 nt, Homo sapiens
uacaagcuaaaauggaagauca

SEQ ID NO: 163263 - RNA, 22 nt, Homo sapiens
uacaaguaauaagggaagaauu

SEQ ID NO: 163264 - RNA, 22 nt, Homo sapiens
uacaaguauuuuuauuagugcc

SEQ ID NO: 163265 - RNA, 22 nt, Homo sapiens
uacaaguggguuugugcaggag

SEQ ID NO: 163266 - RNA, 21 nt, Homo sapiens
uacaaugcacaggagagccuc

SEQ ID NO: 163267 - RNA, 22 nt, Homo sapiens
uacacacguguguauauauaca

SEQ ID NO: 163268 - RNA, 22 nt, Homo sapiens
uacacaugugaguucuuuucua

SEQ ID NO: 163269 - RNA, 22 nt, Homo sapiens
uacaccauuugauucuuuaagc

SEQ ID NO: 163270 - RNA, 22 nt, Homo sapiens
uacagaguauccauuugaguuc

SEQ ID NO: 163271 - RNA, 22 nt, Homo sapiens
uacaggauagacaauuuauuaa

SEQ ID NO: 163272 - RNA, 22 nt, Homo sapiens
uacaggcaccuggcuaauuuuu

SEQ ID NO: 163273 - RNA, 22 nt, Homo sapiens
uacaguacacagguaccaagcu

SEQ ID NO: 163274 - RNA, 22 nt, Homo sapiens
uacagugcauagaggcaugaua

SEQ ID NO: 163275 - RNA, 22 nt, Homo sapiens
uacagugcuugguaucuaguaa

SEQ ID NO: 163276 - RNA, 19 nt, Homo sapiens
uacauaguauuuaguggca

SEQ ID NO: 163277 - RNA, 19 nt, Homo sapiens
uacaugcagcaggcacgca

SEQ ID NO: 163278 - RNA, 22 nt, Homo sapiens
uacauguauacaggguuuacuu

SEQ ID NO: 163279 - RNA, 22 nt, Homo sapiens
uacaugugccauguugguuugc

SEQ ID NO: 163280 - RNA, 23 nt, Homo sapiens
uaccacauuccuucuuuccuguu

SEQ ID NO: 163281 - RNA, 22 nt, Homo sapiens
uaccaguaaugguucuagagga

SEQ ID NO: 163282 - RNA, 19 nt, Homo sapiens
uacccagaagcagcauugu

SEQ ID NO: 163283 - RNA, 22 nt, Homo sapiens
uacuacuuucugacaucuuuaa

SEQ ID NO: 163284 - RNA, 22 nt, Homo sapiens
uacuagaguagugcagagggga

SEQ ID NO: 163285 - RNA, 18 nt, Homo sapiens
uacuaguaaggcuucuga

SEQ ID NO: 163286 - RNA, 22 nt, Homo sapiens
uacugaccugaaggccauggaa

SEQ ID NO: 163287 - RNA, 22 nt, Homo sapiens
uacugcacuccacccuggguga

SEQ ID NO: 163288 - RNA, 22 nt, Homo sapiens
uacugcacuccagccugccaac

SEQ ID NO: 163289 - RNA, 22 nt, Homo sapiens
uacugcacucuagccuggguga

SEQ ID NO: 163290 - RNA, 22 nt, Homo sapiens
uacugguuuuauauauuucucc

SEQ ID NO: 163291 - RNA, 22 nt, Homo sapiens
uacuguacugcaguucugcaaa

SEQ ID NO: 163292 - RNA, 22 nt, Homo sapiens
uagaauguauaauauuuuacuu

SEQ ID NO: 163293 - RNA, 23 nt, Homo sapiens
uagaauguuuuuccauguuucuu

SEQ ID NO: 163294 - RNA, 22 nt, Homo sapiens
uagacccauuacguaguuucca

SEQ ID NO: 163295 - RNA, 22 nt, Homo sapiens
uagagagcuguuugaaagcagg

SEQ ID NO: 163296 - RNA, 18 nt, Homo sapiens
uagagcacaagcuuuggc

SEQ ID NO: 163297 - RNA, 22 nt, Homo sapiens
uagagcacauuaucauuuccaa

SEQ ID NO: 163298 - RNA, 22 nt, Homo sapiens
uagaggaaggauuggaaacgca

SEQ ID NO: 163299 - RNA, 22 nt, Homo sapiens
uagaggaaugaauuuggccaga

SEQ ID NO: 163300 - RNA, 22 nt, Homo sapiens
uagagguagguguaugaacuag

SEQ ID NO: 163301 - RNA, 21 nt, Homo sapiens
uagauacuguauuaaaccuag

SEQ ID NO: 163302 - RNA, 22 nt, Homo sapiens
uagauuauuccuuugaauggcc

SEQ ID NO: 163303 - RNA, 22 nt, Homo sapiens
uagauuguaauaugcagaaugg

SEQ ID NO: 163304 - RNA, 19 nt, Homo sapiens
uagcacagggucccagacu

SEQ ID NO: 163305 - RNA, 22 nt, Homo sapiens
uagcaccuuagcauuucuagug

SEQ ID NO: 163306 - RNA, 22 nt, Homo sapiens
uagcacugucuugcaccugugc

SEQ ID NO: 163307 - RNA, 22 nt, Homo sapiens
uagcagaauaacuugccagccu

SEQ ID NO: 163308 - RNA, 22 nt, Homo sapiens
uagcagcaaagcaggaucugcu

SEQ ID NO: 163309 - RNA, 22 nt, Homo sapiens
uagcagcaucucuggcuucuac

SEQ ID NO: 163310 - RNA, 20 nt, Homo sapiens
uagcaggugucaggugauau

SEQ ID NO: 163311 - RNA, 22 nt, Homo sapiens
uagcaguagacagacuuuggcu

SEQ ID NO: 163312 - RNA, 22 nt, Homo sapiens
uagcaguauacguacugggucc

SEQ ID NO: 163313 - RNA, 22 nt, Homo sapiens
uagcaguauugaaagaugaggg

SEQ ID NO: 163314 - RNA, 22 nt, Homo sapiens
uagcauggagucaugcacggcu

SEQ ID NO: 163315 - RNA, 21 nt, Homo sapiens
uagcuacacugugauucaugg

SEQ ID NO: 163316 - RNA, 22 nt, Homo sapiens
uagcuccacagcuauauauaau

SEQ ID NO: 163317 - RNA, 18 nt, Homo sapiens
uagcucuuguugguccau

SEQ ID NO: 163318 - RNA, 22 nt, Homo sapiens
uagcugagacuacaguaggugc

SEQ ID NO: 163319 - RNA, 22 nt, Homo sapiens
uagcugcaaaauauagacuucu

SEQ ID NO: 163320 - RNA, 18 nt, Homo sapiens
uaggaacauugauuggag

SEQ ID NO: 163321 - RNA, 22 nt, Homo sapiens
uaggacaaugguacagcagaaa

SEQ ID NO: 163322 - RNA, 22 nt, Homo sapiens
uaggacacucucuccaccagua

SEQ ID NO: 163323 - RNA, 20 nt, Homo sapiens
uaggagcaaugagaguagaa

SEQ ID NO: 163324 - RNA, 22 nt, Homo sapiens
uaggagcacaaacccuacugug

SEQ ID NO: 163325 - RNA, 22 nt, Homo sapiens
uaggcgagauguguguuucaug

SEQ ID NO: 163326 - RNA, 22 nt, Homo sapiens
uagggcauguguggaguguaug

SEQ ID NO: 163327 - RNA, 22 nt, Homo sapiens
uagggcuuuccggccugucaga

SEQ ID NO: 163328 - RNA, 19 nt, Homo sapiens
uagguacauucaagucucc

SEQ ID NO: 163329 - RNA, 22 nt, Homo sapiens
uagguaucuuuauagcaguagc

SEQ ID NO: 163330 - RNA, 22 nt, Homo sapiens
uagucccauaugauuuagugaa

SEQ ID NO: 163331 - RNA, 22 nt, Homo sapiens
uagugcaguggcuccaucucag

SEQ ID NO: 163332 - RNA, 22 nt, Homo sapiens
uagugcugugauuaacauaaug

SEQ ID NO: 163333 - RNA, 20 nt, Homo sapiens
uaguggcaugcaccuguagc

SEQ ID NO: 163334 - RNA, 22 nt, Homo sapiens
uauacagcaaguuacugugcug

SEQ ID NO: 163335 - RNA, 20 nt, Homo sapiens
uauagcaauuuuuuucuccu

SEQ ID NO: 163336 - RNA, 22 nt, Homo sapiens
ucuuggcauggcugaagauucc

SEQ ID NO: 163337 - RNA, 22 nt, Homo sapiens
ucuuugagugcccugagucccu

SEQ ID NO: 163338 - RNA, 22 nt, Homo sapiens
ucuuuggagacaaccccagucu

SEQ ID NO: 163339 - RNA, 22 nt, Homo sapiens
ucuuugguauugugaauagugu

SEQ ID NO: 163340 - RNA, 22 nt, Homo sapiens
ucuuuggucagaaagauuacac

SEQ ID NO: 163341 - RNA, 22 nt, Homo sapiens
ucuuugguuagguuuaguugau

SEQ ID NO: 163342 - RNA, 22 nt, Homo sapiens
ucuuugguucugugcagccuau

SEQ ID NO: 163343 - RNA, 22 nt, Homo sapiens
ucuuugguugcacugcaggugu

SEQ ID NO: 163344 - RNA, 22 nt, Homo sapiens
ucuuugucuacauccuguuaaa

SEQ ID NO: 163345 - RNA, 22 nt, Homo sapiens
ucuuuguguaggucaaucuggc

SEQ ID NO: 163346 - RNA, 22 nt, Homo sapiens
ugaaacacacauugcccuuuau

SEQ ID NO: 163347 - RNA, 18 nt, Homo sapiens
ugaaacacauuuuuuccu

SEQ ID NO: 163348 - RNA, 22 nt, Homo sapiens
ugaaauacuuuggcucuuuguu

SEQ ID NO: 163349 - RNA, 22 nt, Homo sapiens
ugaaauaguuaaguugccuagu

SEQ ID NO: 163350 - RNA, 22 nt, Homo sapiens
ugaaaucuaaaauguuccaaga

SEQ ID NO: 163351 - RNA, 22 nt, Homo sapiens
ugaaaugcuaauucguagcuaa

SEQ ID NO: 163352 - RNA, 22 nt, Homo sapiens
ugaaauuuuuuauucguuggcu

SEQ ID NO: 163353 - RNA, 16 nt, Homo sapiens
ugaacagagaggauuc

SEQ ID NO: 163354 - RNA, 20 nt, Homo sapiens
ugaacugguuacuuucuguc

SEQ ID NO: 163355 - RNA, 22 nt, Homo sapiens
ugaaggccgggcaugguggcuc

SEQ ID NO: 163356 - RNA, 22 nt, Homo sapiens
ugaauacuucguucaaagauaa

SEQ ID NO: 163357 - RNA, 22 nt, Homo sapiens
ugaauaggcaguuaaguuuaug

SEQ ID NO: 163358 - RNA, 22 nt, Homo sapiens
ugaauauguuaauuagcaucau

SEQ ID NO: 163359 - RNA, 21 nt, Homo sapiens
ugaaugcuuuaaauauuagaa

SEQ ID NO: 163360 - RNA, 22 nt, Homo sapiens
ugaauguucuuaaaacccuugu

SEQ ID NO: 163361 - RNA, 22 nt, Homo sapiens
ugaauguuugcagcuuauacca

SEQ ID NO: 163362 - RNA, 22 nt, Homo sapiens
ugaauucuguccaaaauaacug

SEQ ID NO: 163363 - RNA, 22 nt, Homo sapiens
ugacaagacuacauaucccauu

SEQ ID NO: 163364 - RNA, 22 nt, Homo sapiens
ugacaagagaccccuccgcagg

SEQ ID NO: 163365 - RNA, 20 nt, Homo sapiens
ugacaagugagaauuauggg

SEQ ID NO: 163366 - RNA, 22 nt, Homo sapiens
ugacagagaagcauugaguuca

SEQ ID NO: 163367 - RNA, 22 nt, Homo sapiens
ugacagcaucaggauuggagag

SEQ ID NO: 163368 - RNA, 22 nt, Homo sapiens
ugacagcugaggcccagaguac

SEQ ID NO: 163369 - RNA, 22 nt, Homo sapiens
ugacaguuuccagggcugucuc

SEQ ID NO: 163370 - RNA, 22 nt, Homo sapiens
ugacaugaagucucccucuguu

SEQ ID NO: 163371 - RNA, 22 nt, Homo sapiens
ugacauggagagagaagccuuu

SEQ ID NO: 163372 - RNA, 22 nt, Homo sapiens
ugacauggugcucuuucaggca

SEQ ID NO: 163373 - RNA, 21 nt, Homo sapiens
ugacauuauuucaugucagua

SEQ ID NO: 163374 - RNA, 22 nt, Homo sapiens
ugacccuguggcagcgucuaag

SEQ ID NO: 163375 - RNA, 22 nt, Homo sapiens
ugaccucugauagcaguaggug

SEQ ID NO: 163376 - RNA, 22 nt, Homo sapiens
ugacuaggggcccuggcuucuu

SEQ ID NO: 163377 - RNA, 22 nt, Homo sapiens
ugacucaguuguuagucuucau

SEQ ID NO: 163378 - RNA, 22 nt, Homo sapiens
ugacugaguaguauuccacuau

SEQ ID NO: 163379 - RNA, 22 nt, Homo sapiens
ugacuggaacuuuagugagucu

SEQ ID NO: 163380 - RNA, 22 nt, Homo sapiens
ugacugucuagauagagcuugg

SEQ ID NO: 163381 - RNA, 22 nt, Homo sapiens
ugacugugcagcuccaucaggg

SEQ ID NO: 163382 - RNA, 19 nt, Homo sapiens
ugagaaccucuacagaguc

SEQ ID NO: 163383 - RNA, 22 nt, Homo sapiens
ugagaacuaaugaagaauuuau

SEQ ID NO: 163384 - RNA, 22 nt, Homo sapiens
ugagaauauuugaagauguuag

SEQ ID NO: 163385 - RNA, 22 nt, Homo sapiens
ugagaaugcagaaucucgugca

SEQ ID NO: 163386 - RNA, 22 nt, Homo sapiens
ugagaccaacagauuccaguuc

SEQ ID NO: 163387 - RNA, 22 nt, Homo sapiens
ugagacgaagucucguucugua

SEQ ID NO: 163388 - RNA, 22 nt, Homo sapiens
ugagacgaagucuugcucuguu

SEQ ID NO: 163389 - RNA, 22 nt, Homo sapiens
ugagacggagucucacucuguu

SEQ ID NO: 163390 - RNA, 22 nt, Homo sapiens
ugagacggagucucgcucucua

SEQ ID NO: 163391 - RNA, 22 nt, Homo sapiens
ugagacggagucucgcucuguc

SEQ ID NO: 163392 - RNA, 22 nt, Homo sapiens
ugagacugaaauuaggaaacug

SEQ ID NO: 163393 - RNA, 22 nt, Homo sapiens
ugagacugaguuuugcucguug

SEQ ID NO: 163394 - RNA, 22 nt, Homo sapiens
ugagacugguaauguguagggc

SEQ ID NO: 163395 - RNA, 22 nt, Homo sapiens
ugagagaugauaaaauguuugu

SEQ ID NO: 163396 - RNA, 22 nt, Homo sapiens
ugagagcuuugaugcacuguuu

SEQ ID NO: 163397 - RNA, 22 nt, Homo sapiens
ugagaucacgccacugcacucc

SEQ ID NO: 163398 - RNA, 18 nt, Homo sapiens
ugagaucagcaucaaggg

SEQ ID NO: 163399 - RNA, 22 nt, Homo sapiens
ugagauccugugacuacacuga

SEQ ID NO: 163400 - RNA, 22 nt, Homo sapiens
ugagaucuuuuguggcugagaa

SEQ ID NO: 163401 - RNA, 19 nt, Homo sapiens
ugagaugaagacagggguu

SEQ ID NO: 163402 - RNA, 22 nt, Homo sapiens
ugagaugaagucucacucuguc

SEQ ID NO: 163403 - RNA, 22 nt, Homo sapiens
ugagauggaguuucgcccuugu

SEQ ID NO: 163404 - RNA, 22 nt, Homo sapiens
ugagauggaguuucgcuuuugu

SEQ ID NO: 163405 - RNA, 21 nt, Homo sapiens
ugagaugugaccagggcauca

SEQ ID NO: 163406 - RNA, 22 nt, Homo sapiens
ugagauguugcucugaaacaag

SEQ ID NO: 163407 - RNA, 22 nt, Homo sapiens
ugagauguuuguuucagugccu

SEQ ID NO: 163408 - RNA, 22 nt, Homo sapiens
ugagcaaaauuuuggacauaga

SEQ ID NO: 163409 - RNA, 22 nt, Homo sapiens
ugagcaagaaauagaaacagau

SEQ ID NO: 163410 - RNA, 22 nt, Homo sapiens
ugagcacauuuacaucaguucc

SEQ ID NO: 163411 - RNA, 22 nt, Homo sapiens
ugagcauauuuaagguaugcua

SEQ ID NO: 163412 - RNA, 22 nt, Homo sapiens
ugagccauggcaccuugucuaa

SEQ ID NO: 163413 - RNA, 20 nt, Homo sapiens
ugagcuauauauguccuuga

SEQ ID NO: 163414 - RNA, 22 nt, Homo sapiens
ugagcucaugcauucuugagga

SEQ ID NO: 163415 - RNA, 22 nt, Homo sapiens
ugagcugagaaaugcagcagcu

SEQ ID NO: 163416 - RNA, 22 nt, Homo sapiens
ugagcugagaucacacuacugu

SEQ ID NO: 163417 - RNA, 22 nt, Homo sapiens
ugaggcaaggcugaaugaaggc

SEQ ID NO: 163418 - RNA, 22 nt, Homo sapiens
ugaggcuaggauaggcugauuc

SEQ ID NO: 163419 - RNA, 22 nt, Homo sapiens
ugagggaugccugguuuguuuu

SEQ ID NO: 163420 - RNA, 22 nt, Homo sapiens
ugugccacugcacucuggccug

SEQ ID NO: 163421 - RNA, 22 nt, Homo sapiens
ugugccacugcacucugggcaa

SEQ ID NO: 163422 - RNA, 22 nt, Homo sapiens
ugugcuauguuauucacauggg

SEQ ID NO: 163423 - RNA, 21 nt, Homo sapiens
uguggcaauggccucacagau

SEQ ID NO: 163424 - RNA, 18 nt, Homo sapiens
uguggcuguuuuccaaua

SEQ ID NO: 163425 - RNA, 22 nt, Homo sapiens
uguggcuuuuucuuggcugagg

SEQ ID NO: 163426 - RNA, 22 nt, Homo sapiens
ugugguauuagguguaguaucu

SEQ ID NO: 163427 - RNA, 22 nt, Homo sapiens
uguguaaauacaagugcuugaa

SEQ ID NO: 163428 - RNA, 22 nt, Homo sapiens
uguguaauacucuaaugaugca

SEQ ID NO: 163429 - RNA, 22 nt, Homo sapiens
uguguauaucacugcaugagug

SEQ ID NO: 163430 - RNA, 22 nt, Homo sapiens
ugugucacugcacuccagcgug

SEQ ID NO: 163431 - RNA, 22 nt, Homo sapiens
uguuaacauggucucagucugu

SEQ ID NO: 163432 - RNA, 22 nt, Homo sapiens
uguuacagcagaauugaaagag

SEQ ID NO: 163433 - RNA, 22 nt, Homo sapiens
uguuagguuggugcaaaaguga

SEQ ID NO: 163434 - RNA, 22 nt, Homo sapiens
uguuaguuguucauguuaagag

SEQ ID NO: 163435 - RNA, 22 nt, Homo sapiens
uguuauugagguuacuuauaag

SEQ ID NO: 163436 - RNA, 22 nt, Homo sapiens
uguucaugaguucucauuuuua

SEQ ID NO: 163437 - RNA, 22 nt, Homo sapiens
uguucuugaguugggaguacaa

SEQ ID NO: 163438 - RNA, 22 nt, Homo sapiens
uguugcacuccauccugggcga

SEQ ID NO: 163439 - RNA, 22 nt, Homo sapiens
uguugcacucuagccugggcaa

SEQ ID NO: 163440 - RNA, 20 nt, Homo sapiens
uguugcacucuagccugggu

SEQ ID NO: 163441 - RNA, 22 nt, Homo sapiens
uguugccacuguuauuaaccua

SEQ ID NO: 163442 - RNA, 22 nt, Homo sapiens
uguuucuacugucucuguagua

SEQ ID NO: 163443 - RNA, 22 nt, Homo sapiens
uguuugcuguguggaguagcag

SEQ ID NO: 163444 - RNA, 22 nt, Homo sapiens
uguuuuguuagcacucugggaa

SEQ ID NO: 163445 - RNA, 22 nt, Homo sapiens
uuaaaagcuaucuccaagguca

SEQ ID NO: 163446 - RNA, 22 nt, Homo sapiens
uuaaaggcaugguuagacaugg

SEQ ID NO: 163447 - RNA, 22 nt, Homo sapiens
uuaaagugaucauaaggauagu

SEQ ID NO: 163448 - RNA, 22 nt, Homo sapiens
uuaaaguguuuucaaaauguca

SEQ ID NO: 163449 - RNA, 22 nt, Homo sapiens
uuaacacugccauugauacugu

SEQ ID NO: 163450 - RNA, 22 nt, Homo sapiens
uuaacagucacuuagcucauuu

SEQ ID NO: 163451 - RNA, 22 nt, Homo sapiens
uuaagcucauuuccauucuaca

SEQ ID NO: 163452 - RNA, 22 nt, Homo sapiens
uuaagguuuuuguagcaaggau

SEQ ID NO: 163453 - RNA, 22 nt, Homo sapiens
uuaauacugcuuaacuuuagga

SEQ ID NO: 163454 - RNA, 22 nt, Homo sapiens
uuaaucucaggaguuugggacc

SEQ ID NO: 163455 - RNA, 22 nt, Homo sapiens
uuaaugaacuuuauuuuguaga

SEQ ID NO: 163456 - RNA, 22 nt, Homo sapiens
uuaaugcuuuugggauauuucu

SEQ ID NO: 163457 - RNA, 22 nt, Homo sapiens
uuaauuguaucuauagauguca

SEQ ID NO: 163458 - RNA, 22 nt, Homo sapiens
uuaauuguccauuauucuguuc

SEQ ID NO: 163459 - RNA, 22 nt, Homo sapiens
uuacaacugucuuacugguuau

SEQ ID NO: 163460 - RNA, 22 nt, Homo sapiens
uuacaaguggcaucucucugga

SEQ ID NO: 163461 - RNA, 19 nt, Homo sapiens
uuacacaaccuaguggggc

SEQ ID NO: 163462 - RNA, 22 nt, Homo sapiens
uuacacaguugguaggggcaga

SEQ ID NO: 163463 - RNA, 22 nt, Homo sapiens
uuacagauggauggcagcuggc

SEQ ID NO: 163464 - RNA, 22 nt, Homo sapiens
uuacagguggagaaguaaggcu

SEQ ID NO: 163465 - RNA, 22 nt, Homo sapiens
uuacagucucaagagugcugca

SEQ ID NO: 163466 - RNA, 22 nt, Homo sapiens
uuacaugcaugacaaggugcca

SEQ ID NO: 163467 - RNA, 22 nt, Homo sapiens
uuacauguuguggguuguggcc

SEQ ID NO: 163468 - RNA, 22 nt, Homo sapiens
uuacauugcuucaaauucagug

SEQ ID NO: 163469 - RNA, 22 nt, Homo sapiens
uuaccacagugccugucuaaug

SEQ ID NO: 163470 - RNA, 20 nt, Homo sapiens
uuacuccuuaaugagguuuu

SEQ ID NO: 163471 - RNA, 22 nt, Homo sapiens
uuacuugagauggggugucacu

SEQ ID NO: 163472 - RNA, 22 nt, Homo sapiens
uuagaacuagaggaguuugagu

SEQ ID NO: 163473 - RNA, 22 nt, Homo sapiens
uuagacacacauacauuuaucu

SEQ ID NO: 163474 - RNA, 18 nt, Homo sapiens
uuagagugcauuacuuug

SEQ ID NO: 163475 - RNA, 22 nt, Homo sapiens
uuagauguuuagaagugggcca

SEQ ID NO: 163476 - RNA, 22 nt, Homo sapiens
uuagcagcacaaaagcagacua

SEQ ID NO: 163477 - RNA, 22 nt, Homo sapiens
uuagcagugugaaaaaagacua

SEQ ID NO: 163478 - RNA, 22 nt, Homo sapiens
uuagguauuuuguuaugucagc

SEQ ID NO: 163479 - RNA, 22 nt, Homo sapiens
uuagugaaugggugugauuugu

SEQ ID NO: 163480 - RNA, 20 nt, Homo sapiens
uuauaacuuuuguucugggg

SEQ ID NO: 163481 - RNA, 21 nt, Homo sapiens
uuauaguggcaugauuuauaa

SEQ ID NO: 163482 - RNA, 22 nt, Homo sapiens
uuauaguuuuucaccuggagaa

SEQ ID NO: 163483 - RNA, 18 nt, Homo sapiens
uuauaugcauguguagga

SEQ ID NO: 163484 - RNA, 22 nt, Homo sapiens
uuauauguuacucccucuagca

SEQ ID NO: 163485 - RNA, 22 nt, Homo sapiens
uuauauguuucuguuuggaggc

SEQ ID NO: 163486 - RNA, 22 nt, Homo sapiens
uuauggauuuauauucuguagu

SEQ ID NO: 163487 - RNA, 23 nt, Homo sapiens
uuauggcuuuuauuauguugagg

SEQ ID NO: 163488 - RNA, 22 nt, Homo sapiens
uuaugucuuuuguguucagcua

SEQ ID NO: 163489 - RNA, 22 nt, Homo sapiens
uuauuacuccuauuuuguagau

SEQ ID NO: 163490 - RNA, 17 nt, Homo sapiens
uuauugcuauaagcuga

SEQ ID NO: 163491 - RNA, 22 nt, Homo sapiens
uuauugcucauuugggcauucu

SEQ ID NO: 163492 - RNA, 22 nt, Homo sapiens
uuauugcuccagaggcugauuu

SEQ ID NO: 163493 - RNA, 22 nt, Homo sapiens
uucaaaaccucugcuuaagccc

SEQ ID NO: 163494 - RNA, 23 nt, Homo sapiens
uucaaaggaugcuuuauggaauu

SEQ ID NO: 163495 - RNA, 22 nt, Homo sapiens
uucaagucaacaagcacuugag

SEQ ID NO: 163496 - RNA, 22 nt, Homo sapiens
uucaauuaauauuauacucuca

SEQ ID NO: 163497 - RNA, 20 nt, Homo sapiens
uucacaggcagcuucuuucu

SEQ ID NO: 163498 - RNA, 22 nt, Homo sapiens
uucacaguacucccuggaauua

SEQ ID NO: 163499 - RNA, 22 nt, Homo sapiens
uucaccuggguuggccaucauu

SEQ ID NO: 163500 - RNA, 22 nt, Homo sapiens
uucacugagccagacuaagaca

SEQ ID NO: 163501 - RNA, 22 nt, Homo sapiens
uucacugcaugaaaaggacagc

SEQ ID NO: 163502 - RNA, 22 nt, Homo sapiens
uucacuguagccucagccucuu

SEQ ID NO: 163503 - RNA, 22 nt, Homo sapiens
uucacugugaacucauauucag

SEQ ID NO: 163504 - RNA, 22 nt, Homo sapiens
uugauauguuguuagauucagu

SEQ ID NO: 163505 - RNA, 22 nt, Homo sapiens
uugauauuaaguacugaagugg

SEQ ID NO: 163506 - RNA, 22 nt, Homo sapiens
uugauauuacucaguaacagau

SEQ ID NO: 163507 - RNA, 22 nt, Homo sapiens
uugaucaauagaauacaacaga

SEQ ID NO: 163508 - RNA, 22 nt, Homo sapiens
uugauguccaucucuagguaaa

SEQ ID NO: 163509 - RNA, 22 nt, Homo sapiens
uugcaaagaccucuucacuucc

SEQ ID NO: 163510 - RNA, 22 nt, Homo sapiens
uugcaaaucucuuguguuuggu

SEQ ID NO: 163511 - RNA, 22 nt, Homo sapiens
uugcaacauuguaaguuuauau

SEQ ID NO: 163512 - RNA, 22 nt, Homo sapiens
uugcacagugcuuucuuugccc

SEQ ID NO: 163513 - RNA, 22 nt, Homo sapiens
uugcacauggcaggugcucaau

SEQ ID NO: 163514 - RNA, 22 nt, Homo sapiens
uugcacauguugaaccagcaaa

SEQ ID NO: 163515 - RNA, 22 nt, Homo sapiens
uugcacuccagcucuaggugac

SEQ ID NO: 163516 - RNA, 18 nt, Homo sapiens
uugcacuccugccugggu

SEQ ID NO: 163517 - RNA, 20 nt, Homo sapiens
uugcagagcccaacccugga

SEQ ID NO: 163518 - RNA, 22 nt, Homo sapiens
uugcagagccccugcaaggguc

SEQ ID NO: 163519 - RNA, 22 nt, Homo sapiens
uugcagagucaguuauuuugcc

SEQ ID NO: 163520 - RNA, 22 nt, Homo sapiens
uugcagcaacauggaugaaacu

SEQ ID NO: 163521 - RNA, 22 nt, Homo sapiens
uugcauaauaagagggauacgu

SEQ ID NO: 163522 - RNA, 22 nt, Homo sapiens
uugcaucagcaggcauaauugg

SEQ ID NO: 163523 - RNA, 22 nt, Homo sapiens
uugccauagugcugccagauau

SEQ ID NO: 163524 - RNA, 22 nt, Homo sapiens
uugccuuuguuggaaacaagug

SEQ ID NO: 163525 - RNA, 22 nt, Homo sapiens
uugcuacauugauugccucuuu

SEQ ID NO: 163526 - RNA, 22 nt, Homo sapiens
uugcuccccaggaaaggaagca

SEQ ID NO: 163527 - RNA, 22 nt, Homo sapiens
uugcuuagucaugaaucacuga

SEQ ID NO: 163528 - RNA, 22 nt, Homo sapiens
uuggaaauguguuugcauucag

SEQ ID NO: 163529 - RNA, 22 nt, Homo sapiens
uuggaacuguucguauugaaau

SEQ ID NO: 163530 - RNA, 23 nt, Homo sapiens
uuggaaugagaccuaagaguuuu

SEQ ID NO: 163531 - RNA, 22 nt, Homo sapiens
uuggaaugcaacagaaggauaa

SEQ ID NO: 163532 - RNA, 22 nt, Homo sapiens
uuggaaugugacugauaauauu

SEQ ID NO: 163533 - RNA, 19 nt, Homo sapiens
uuggaauuuuagaguuuga

SEQ ID NO: 163534 - RNA, 22 nt, Homo sapiens
uuggagagaaaggcaguuccug

SEQ ID NO: 163535 - RNA, 22 nt, Homo sapiens
uuggagcacuggggcacugaca

SEQ ID NO: 163536 - RNA, 22 nt, Homo sapiens
uuggaugauaaagaagccuaag

SEQ ID NO: 163537 - RNA, 22 nt, Homo sapiens
uuggauggucuuuauauaguau

SEQ ID NO: 163538 - RNA, 22 nt, Homo sapiens
uuggcaagcuguuaauuauaaa

SEQ ID NO: 163539 - RNA, 22 nt, Homo sapiens
uuggcagucugaggcacagacu

SEQ ID NO: 163540 - RNA, 22 nt, Homo sapiens
uuggcuguguuccucaaggagu

SEQ ID NO: 163541 - RNA, 23 nt, Homo sapiens
uugggcaaaucacugagggcaga

SEQ ID NO: 163542 - RNA, 17 nt, Homo sapiens
uugggcaagguagguga

SEQ ID NO: 163543 - RNA, 22 nt, Homo sapiens
uugggcaaguggcaugaccaug

SEQ ID NO: 163544 - RNA, 22 nt, Homo sapiens
uugggcaauaggaagcaggugg

SEQ ID NO: 163545 - RNA, 22 nt, Homo sapiens
uugggcuuuuagguccuuaaca

SEQ ID NO: 163546 - RNA, 21 nt, Homo sapiens
uuggggaauggagagguuuuc

SEQ ID NO: 163547 - RNA, 22 nt, Homo sapiens
uugggguaggaauauggaauga

SEQ ID NO: 163548 - RNA, 22 nt, Homo sapiens
uuggucaggagccucccucuuu

SEQ ID NO: 163549 - RNA, 22 nt, Homo sapiens
uuggucaucucccuccuuuuag

SEQ ID NO: 163550 - RNA, 22 nt, Homo sapiens
uugguccucccaugcucaagag

SEQ ID NO: 163551 - RNA, 22 nt, Homo sapiens
uugguucucuuuauaugcugga

SEQ ID NO: 163552 - RNA, 22 nt, Homo sapiens
uuguaacaguucugcgagcagc

SEQ ID NO: 163553 - RNA, 22 nt, Homo sapiens
uuguaagaaucuagcucuuuau

SEQ ID NO: 163554 - RNA, 23 nt, Homo sapiens
uuguacacuaagaaucgcagaug

SEQ ID NO: 163555 - RNA, 22 nt, Homo sapiens
uuguacaggaguguaagcuuca

SEQ ID NO: 163556 - RNA, 21 nt, Homo sapiens
uuguaugguugaacuugauac

SEQ ID NO: 163557 - RNA, 22 nt, Homo sapiens
uuguauguuguuugucagagaa

SEQ ID NO: 163558 - RNA, 22 nt, Homo sapiens
uugucauuuucagaguguuacg

SEQ ID NO: 163559 - RNA, 22 nt, Homo sapiens
uuguccauggacagcaccacag

SEQ ID NO: 163560 - RNA, 22 nt, Homo sapiens
uuguccccaucugcugccagaa

SEQ ID NO: 163561 - RNA, 22 nt, Homo sapiens
uuguccucuccaaaucucaugu

SEQ ID NO: 163562 - RNA, 22 nt, Homo sapiens
uugugaucuucagaaaguggcu

SEQ ID NO: 163563 - RNA, 22 nt, Homo sapiens
uugugcaugaugcauacauggu

SEQ ID NO: 163564 - RNA, 20 nt, Homo sapiens
uugugcauugggccauuggg

SEQ ID NO: 163565 - RNA, 22 nt, Homo sapiens
uugugcuuguaacuacauucag

SEQ ID NO: 163566 - RNA, 22 nt, Homo sapiens
uugugcuuuugagcugagauga

SEQ ID NO: 163567 - RNA, 16 nt, Homo sapiens
uuguggcuuuugcaca

SEQ ID NO: 163568 - RNA, 22 nt, Homo sapiens
uuguguuugaugcugacacgca

SEQ ID NO: 163569 - RNA, 22 nt, Homo sapiens
uuguuaagaugcagauucugga

SEQ ID NO: 163570 - RNA, 22 nt, Homo sapiens
uuguugcacugcuuuccuggcc

SEQ ID NO: 163571 - RNA, 22 nt, Homo sapiens
uuuaaagcuaaaauauguuuau

SEQ ID NO: 163572 - RNA, 23 nt, Homo sapiens
uuuaagcuucauguccuaacauc

SEQ ID NO: 163573 - RNA, 22 nt, Homo sapiens
uuuaauguuacaguauugguau

SEQ ID NO: 163574 - RNA, 18 nt, Homo sapiens
uuuacaguagaaggacuu

SEQ ID NO: 163575 - RNA, 22 nt, Homo sapiens
uuuacagucuuuugugugaguc

SEQ ID NO: 163576 - RNA, 22 nt, Homo sapiens
uuuacccugaggaaucuauuuu

SEQ ID NO: 163577 - RNA, 22 nt, Homo sapiens
uuuagcaaugcuguggggaagu

SEQ ID NO: 163578 - RNA, 22 nt, Homo sapiens
uuuaggcaugcaguucuauuua

SEQ ID NO: 163579 - RNA, 22 nt, Homo sapiens
uuuauugcucuaaaguugccau

SEQ ID NO: 163580 - RNA, 19 nt, Homo sapiens
uuucaauguaaggauggag

SEQ ID NO: 163581 - RNA, 22 nt, Homo sapiens
uuucacagcaauugccuauugu

SEQ ID NO: 163582 - RNA, 22 nt, Homo sapiens
uuucacguuggggaguugagug

SEQ ID NO: 163583 - RNA, 22 nt, Homo sapiens
uuucacuagccagcccuuuauu

SEQ ID NO: 163584 - RNA, 22 nt, Homo sapiens
uuucagguauuuaagggccguu

SEQ ID NO: 163585 - RNA, 22 nt, Homo sapiens
uuucaucaagcacagaguagau

SEQ ID NO: 163586 - RNA, 23 nt, Homo sapiens
uuucauggggauuuacucauucc

SEQ ID NO: 163587 - RNA, 22 nt, Homo sapiens
uuuccaagaugcuuacuuucuc

SEQ ID NO: 163588 - RNA, 22 nt, Homo sapiens
uacaguggcaugucaggugcuu

SEQ ID NO: 163589 - RNA, 16 nt, Homo sapiens
uacauuuguuacaugg

SEQ ID NO: 163590 - RNA, 22 nt, Homo sapiens
uacccuguaaucugaaacauga

SEQ ID NO: 163591 - RNA, 22 nt, Homo sapiens
uacccuuuaguauaaaaucaga

SEQ ID NO: 163592 - RNA, 22 nt, Homo sapiens
uaccugagacaacuuugaggaa

SEQ ID NO: 163593 - RNA, 22 nt, Homo sapiens
uaccugagcccucugcugaguu

SEQ ID NO: 163594 - RNA, 22 nt, Homo sapiens
uacugcugucagugccaaguag

SEQ ID NO: 163595 - RNA, 22 nt, Homo sapiens
uacugcuuaaaagucaauuacu

SEQ ID NO: 163596 - RNA, 22 nt, Homo sapiens
uagaaaguagggaagguaggau

SEQ ID NO: 163597 - RNA, 22 nt, Homo sapiens
uagaaugaaacaagcugugccu

SEQ ID NO: 163598 - RNA, 22 nt, Homo sapiens
uagaauguaacaguuaaaagca

SEQ ID NO: 163599 - RNA, 22 nt, Homo sapiens
uagaauguaacuuccaugucau

SEQ ID NO: 163600 - RNA, 22 nt, Homo sapiens
uagaaugucagcuucuugaggg

SEQ ID NO: 163601 - RNA, 22 nt, Homo sapiens
uagacccauuguucagagagug

SEQ ID NO: 163602 - RNA, 22 nt, Homo sapiens
uagagcuugacacuuuccaugg

SEQ ID NO: 163603 - RNA, 21 nt, Homo sapiens
uagagcuuggcacagaguaga

SEQ ID NO: 163604 - RNA, 22 nt, Homo sapiens
uagagguagccuacuacacacc

SEQ ID NO: 163605 - RNA, 22 nt, Homo sapiens
uagagguauuaacaguagaaga

SEQ ID NO: 163606 - RNA, 22 nt, Homo sapiens
uagauaauuagaggguuuuaag

SEQ ID NO: 163607 - RNA, 21 nt, Homo sapiens
uagauaguugguucugaaucu

SEQ ID NO: 163608 - RNA, 22 nt, Homo sapiens
uagauuguuuaaguggcacaca

SEQ ID NO: 163609 - RNA, 22 nt, Homo sapiens
uagcaagaugaauuugugcaaa

SEQ ID NO: 163610 - RNA, 20 nt, Homo sapiens
uagcacacauguagaauagu

SEQ ID NO: 163611 - RNA, 22 nt, Homo sapiens
uagcacagggaauugguucucu

SEQ ID NO: 163612 - RNA, 20 nt, Homo sapiens
uagcacaucuggcuguagag

SEQ ID NO: 163613 - RNA, 22 nt, Homo sapiens
uagcagcagugguguauuuaga

SEQ ID NO: 163614 - RNA, 22 nt, Homo sapiens
uagcagcauaaauggacuaaga

SEQ ID NO: 163615 - RNA, 22 nt, Homo sapiens
uagcaguaaagaaugugauguu

SEQ ID NO: 163616 - RNA, 22 nt, Homo sapiens
uagcaguaagaaacugacauug

SEQ ID NO: 163617 - RNA, 22 nt, Homo sapiens
uagcaguaccccaguauccugg

SEQ ID NO: 163618 - RNA, 22 nt, Homo sapiens
uagcaguauaugagagcuauug

SEQ ID NO: 163619 - RNA, 22 nt, Homo sapiens
uagcaguauggagcgaggccca

SEQ ID NO: 163620 - RNA, 22 nt, Homo sapiens
uagcagugugaaaacagacuaa

SEQ ID NO: 163621 - RNA, 22 nt, Homo sapiens
uagcaguucauuguugugugaa

SEQ ID NO: 163622 - RNA, 22 nt, Homo sapiens
uagcaguuguuguuacuuguau

SEQ ID NO: 163623 - RNA, 22 nt, Homo sapiens
uagcaucagauuccauauucua

SEQ ID NO: 163624 - RNA, 17 nt, Homo sapiens
uagcucuauuucuagcc

SEQ ID NO: 163625 - RNA, 22 nt, Homo sapiens
uagcugcacuuacaagugagaa

SEQ ID NO: 163626 - RNA, 22 nt, Homo sapiens
ucaccuggggcacagcugaaga

SEQ ID NO: 163627 - RNA, 22 nt, Homo sapiens
ucaccuugcacaguuguguggg

SEQ ID NO: 163628 - RNA, 22 nt, Homo sapiens
ucacuaaagaaaauggcaugga

SEQ ID NO: 163629 - RNA, 22 nt, Homo sapiens
ucacuagggagaaacugaggcu

SEQ ID NO: 163630 - RNA, 22 nt, Homo sapiens
ucacuauugacaacagugugga

SEQ ID NO: 163631 - RNA, 22 nt, Homo sapiens
ucacucagaccuggugauaugc

SEQ ID NO: 163632 - RNA, 22 nt, Homo sapiens
ucacugaaaccuccgccuucug

SEQ ID NO: 163633 - RNA, 22 nt, Homo sapiens
ucacugagcacaggagaugugc

SEQ ID NO: 163634 - RNA, 22 nt, Homo sapiens
ucacugcacuccagccuuuaug

SEQ ID NO: 163635 - RNA, 22 nt, Homo sapiens
ucacugcacuucaggcuuucuc

SEQ ID NO: 163636 - RNA, 22 nt, Homo sapiens
ucacuggagguuccugaaguuc

SEQ ID NO: 163637 - RNA, 20 nt, Homo sapiens
ucacuggguucuugaagucu

SEQ ID NO: 163638 - RNA, 22 nt, Homo sapiens
ucacugugguuggaaggcuuaa

SEQ ID NO: 163639 - RNA, 22 nt, Homo sapiens
ucacuuggccgcagccuucucu

SEQ ID NO: 163640 - RNA, 22 nt, Homo sapiens
ucacuuuguuuuuggauaaguu

SEQ ID NO: 163641 - RNA, 21 nt, Homo sapiens
ucagaagcucccagggaggac

SEQ ID NO: 163642 - RNA, 22 nt, Homo sapiens
ucagagcaaagacacuuuauca

SEQ ID NO: 163643 - RNA, 22 nt, Homo sapiens
ucagaucacuggcgcuggcgga

SEQ ID NO: 163644 - RNA, 22 nt, Homo sapiens
ucagaucuucagcaggggcccc

SEQ ID NO: 163645 - RNA, 22 nt, Homo sapiens
ucagaugcauccauaccccacu

SEQ ID NO: 163646 - RNA, 20 nt, Homo sapiens
ucagcagucuggagcagagg

SEQ ID NO: 163647 - RNA, 21 nt, Homo sapiens
ucagcucaucacugccuggag

SEQ ID NO: 163648 - RNA, 22 nt, Homo sapiens
ucaggcuuuucccagagugaug

SEQ ID NO: 163649 - RNA, 22 nt, Homo sapiens
ucaggugcaguggcucugaccu

SEQ ID NO: 163650 - RNA, 22 nt, Homo sapiens
ucaguacuuuggagcucacaua

SEQ ID NO: 163651 - RNA, 20 nt, Homo sapiens
ucaguauauuguuuccacag

SEQ ID NO: 163652 - RNA, 18 nt, Homo sapiens
ucagucacugccuggcuu

SEQ ID NO: 163653 - RNA, 22 nt, Homo sapiens
ucagucauguuuaccagacgua

SEQ ID NO: 163654 - RNA, 22 nt, Homo sapiens
ucagucuuuuuuuggcaagcau

SEQ ID NO: 163655 - RNA, 23 nt, Homo sapiens
ucagugaaggaacaacuaaauag

SEQ ID NO: 163656 - RNA, 22 nt, Homo sapiens
ucagugaauauauaacagcgau

SEQ ID NO: 163657 - RNA, 22 nt, Homo sapiens
ucagugaauguuggccacuacu

SEQ ID NO: 163658 - RNA, 20 nt, Homo sapiens
ucagugcagauuguccaagu

SEQ ID NO: 163659 - RNA, 17 nt, Homo sapiens
ucagugcauuuaagaga

SEQ ID NO: 163660 - RNA, 19 nt, Homo sapiens
ucagugcuauguaauguag

SEQ ID NO: 163661 - RNA, 22 nt, Homo sapiens
ucagugcuuuuuguugucauca

SEQ ID NO: 163662 - RNA, 22 nt, Homo sapiens
ucaguggacuuagucuuucccc

SEQ ID NO: 163663 - RNA, 22 nt, Homo sapiens
ucaguggagccucacucugugg

SEQ ID NO: 163664 - RNA, 22 nt, Homo sapiens
ucagugggcuauguaauuaacu

SEQ ID NO: 163665 - RNA, 22 nt, Homo sapiens
ucaguuaaugcugccugcugga

SEQ ID NO: 163666 - RNA, 18 nt, Homo sapiens
ucauagaucaugacagug

SEQ ID NO: 163667 - RNA, 19 nt, Homo sapiens
ucauagucuaagaugagaa

SEQ ID NO: 163668 - RNA, 22 nt, Homo sapiens
ucauaugucauaguaugaucuu

SEQ ID NO: 163669 - RNA, 22 nt, Homo sapiens
ugugucacugcacuccagccug

SEQ ID NO: 163670 - RNA, 22 nt, Homo sapiens
uguuacagcagcacaaaaugga

SEQ ID NO: 163671 - RNA, 22 nt, Homo sapiens
uguuacagugacuaauguuuua

SEQ ID NO: 163672 - RNA, 22 nt, Homo sapiens
uguuacaguguaggccuugggu

SEQ ID NO: 163673 - RNA, 22 nt, Homo sapiens
uguucuggagaggcaggccaca

SEQ ID NO: 163674 - RNA, 22 nt, Homo sapiens
uguugcacuccagccugggcaa

SEQ ID NO: 163675 - RNA, 22 nt, Homo sapiens
uguuugguggucucuucacaug

SEQ ID NO: 163676 - RNA, 18 nt, Homo sapiens
uguuugguucugcgccuc

SEQ ID NO: 163677 - RNA, 22 nt, Homo sapiens
uuaaaguaauugaaauggccuu

SEQ ID NO: 163678 - RNA, 20 nt, Homo sapiens
uuaaaucuagugcagacuca

SEQ ID NO: 163679 - RNA, 22 nt, Homo sapiens
uuaaaugcacauacuugagaaa

SEQ ID NO: 163680 - RNA, 22 nt, Homo sapiens
uuaaaugcuagaauuuucuuug

SEQ ID NO: 163681 - RNA, 21 nt, Homo sapiens
uuaacagacaagugucuuccc

SEQ ID NO: 163682 - RNA, 22 nt, Homo sapiens
uuaagcaguggauuagaauuuu

SEQ ID NO: 163683 - RNA, 22 nt, Homo sapiens
uuaaggcuuguacuuguuuucu

SEQ ID NO: 163684 - RNA, 22 nt, Homo sapiens
uuaaggcuuucccuauguaaaa

SEQ ID NO: 163685 - RNA, 19 nt, Homo sapiens
uuaagguacuuagaugugu

SEQ ID NO: 163686 - RNA, 22 nt, Homo sapiens
uuaagucacacuagacaacuga

SEQ ID NO: 163687 - RNA, 22 nt, Homo sapiens
uuaaguuaggcuucagcagucu

SEQ ID NO: 163688 - RNA, 22 nt, Homo sapiens
uuaauagcaaagaguuuagacu

SEQ ID NO: 163689 - RNA, 22 nt, Homo sapiens
uuaaugacaucauaggugaagu

SEQ ID NO: 163690 - RNA, 22 nt, Homo sapiens
uuaauucugucugcccucaucc

SEQ ID NO: 163691 - RNA, 22 nt, Homo sapiens
uuacaccuguaauccagcacuu

SEQ ID NO: 163692 - RNA, 22 nt, Homo sapiens
uuacaggacuaagcagcuuugc

SEQ ID NO: 163693 - RNA, 17 nt, Homo sapiens
uuacaggugcugagagu

SEQ ID NO: 163694 - RNA, 23 nt, Homo sapiens
uuacaguggcaugaucucugcuc

SEQ ID NO: 163695 - RNA, 20 nt, Homo sapiens
uuacagugggaccuuccuga

SEQ ID NO: 163696 - RNA, 19 nt, Homo sapiens
uuacagugugcccuuuuag

SEQ ID NO: 163697 - RNA, 19 nt, Homo sapiens
uuacauccauugcauuuca

SEQ ID NO: 163698 - RNA, 22 nt, Homo sapiens
uuacccuuuaacccuuuaaagu

SEQ ID NO: 163699 - RNA, 22 nt, Homo sapiens
uuagauuauugguguuuugcaa

SEQ ID NO: 163700 - RNA, 22 nt, Homo sapiens
uuagcaccacacacuuuagagg

SEQ ID NO: 163701 - RNA, 22 nt, Homo sapiens
uuagcacuugggaguauuuauu

SEQ ID NO: 163702 - RNA, 22 nt, Homo sapiens
uuagcagcaugaaaauggacug

SEQ ID NO: 163703 - RNA, 22 nt, Homo sapiens
uuagcagcucuggugacaaggu

SEQ ID NO: 163704 - RNA, 22 nt, Homo sapiens
uuagcaguggauggguggagaa

SEQ ID NO: 163705 - RNA, 22 nt, Homo sapiens
uuaggaucacagaaaauccucu

SEQ ID NO: 163706 - RNA, 22 nt, Homo sapiens
uuaggcuuuauugaaaacaaua

SEQ ID NO: 163707 - RNA, 23 nt, Homo sapiens
uuaguaaacucaaugacaccaca

SEQ ID NO: 163708 - RNA, 21 nt, Homo sapiens
uuagugcucaguuugacaaaa

SEQ ID NO: 163709 - RNA, 22 nt, Homo sapiens
uuagugcugaguggaauguucu

SEQ ID NO: 163710 - RNA, 22 nt, Homo sapiens
uuagugcuuacgaugagcuaag

SEQ ID NO: 163711 - RNA, 22 nt, Homo sapiens
uuauagcacuaagaagguaaua

SEQ ID NO: 163712 - RNA, 20 nt, Homo sapiens
uuauagcuacaucuugacug

SEQ ID NO: 163713 - RNA, 22 nt, Homo sapiens
uuauauguuagacauggugggu

SEQ ID NO: 163714 - RNA, 22 nt, Homo sapiens
uuauauguuucuuagggacaga

SEQ ID NO: 163715 - RNA, 22 nt, Homo sapiens
uuaucauagugcaguuuucuga

SEQ ID NO: 163716 - RNA, 17 nt, Homo sapiens
uuaugagacuucuuagc

SEQ ID NO: 163717 - RNA, 22 nt, Homo sapiens
uuaugcuuauugguguacggua

SEQ ID NO: 163718 - RNA, 22 nt, Homo sapiens
uuauggcuauugaugacaauug

SEQ ID NO: 163719 - RNA, 22 nt, Homo sapiens
uuauugcuaaaucaugaccaca

SEQ ID NO: 163720 - RNA, 22 nt, Homo sapiens
uuauuguccaaguuucccuuug

SEQ ID NO: 163721 - RNA, 22 nt, Homo sapiens
uuauuugguugcugacuuggaa

SEQ ID NO: 163722 - RNA, 22 nt, Homo sapiens
uucaacagugauggccuuugua

SEQ ID NO: 163723 - RNA, 22 nt, Homo sapiens
uucaagucaaggaaagaggucu

SEQ ID NO: 163724 - RNA, 22 nt, Homo sapiens
uucaagucuuggcuuugccacc

SEQ ID NO: 163725 - RNA, 21 nt, Homo sapiens
uucacaagggaaguagggggc

SEQ ID NO: 163726 - RNA, 22 nt, Homo sapiens
uucacaauuaaaugugguuauu

SEQ ID NO: 163727 - RNA, 22 nt, Homo sapiens
uucacagaguuauuuuuaugcu

SEQ ID NO: 163728 - RNA, 22 nt, Homo sapiens
uucacaugguugccuuuugauc

SEQ ID NO: 163729 - RNA, 22 nt, Homo sapiens
uucacccugguuguagauggac

SEQ ID NO: 163730 - RNA, 22 nt, Homo sapiens
uucaccuggaguucaggauaag

SEQ ID NO: 163731 - RNA, 22 nt, Homo sapiens
uucacugcacuccagccugagc

SEQ ID NO: 163732 - RNA, 22 nt, Homo sapiens
uucacugugugacccugggcca

SEQ ID NO: 163733 - RNA, 22 nt, Homo sapiens
uucacuguuaagcaguuaaacu

SEQ ID NO: 163734 - RNA, 22 nt, Homo sapiens
uucagauugcauaccgaaagua

SEQ ID NO: 163735 - RNA, 22 nt, Homo sapiens
uucaggcaccauggucauugau

SEQ ID NO: 163736 - RNA, 22 nt, Homo sapiens
uucaggcuccugugagaaucua

SEQ ID NO: 163737 - RNA, 22 nt, Homo sapiens
uucaguagucaaaagauaaggg

SEQ ID NO: 163738 - RNA, 22 nt, Homo sapiens
uucaguggagaggcugaguggu

SEQ ID NO: 163739 - RNA, 22 nt, Homo sapiens
uucaucagggagaaauaauuuc

SEQ ID NO: 163740 - RNA, 22 nt, Homo sapiens
uucaucaguugagcugguugcu

SEQ ID NO: 163741 - RNA, 22 nt, Homo sapiens
uucaucuggcaauucagagauu

SEQ ID NO: 163742 - RNA, 20 nt, Homo sapiens
uucaugggagcaaagaggcc

SEQ ID NO: 163743 - RNA, 22 nt, Homo sapiens
uuccaagugggaaacaaaaaug

SEQ ID NO: 163744 - RNA, 22 nt, Homo sapiens
uuccaauguuccguguugcagu

SEQ ID NO: 163745 - RNA, 22 nt, Homo sapiens
uuccacagggauuugcauugau

SEQ ID NO: 163746 - RNA, 20 nt, Homo sapiens
uuccagcacauuagggaagc

SEQ ID NO: 163747 - RNA, 22 nt, Homo sapiens
uuccauugugucaucuuggugg

SEQ ID NO: 163748 - RNA, 22 nt, Homo sapiens
auauauguuuucugggaagaaa

SEQ ID NO: 163749 - RNA, 22 nt, Homo sapiens
auaucacaggaaaggaagauac

SEQ ID NO: 163750 - RNA, 22 nt, Homo sapiens
auaugcacgugcauacacacuu

SEQ ID NO: 163751 - RNA, 22 nt, Homo sapiens
auaugccacugaacuguaccca

SEQ ID NO: 163752 - RNA, 22 nt, Homo sapiens
auaugguguuugcuauucagcu

SEQ ID NO: 163753 - RNA, 22 nt, Homo sapiens
auauuacuggccauaucgcagg

SEQ ID NO: 163754 - RNA, 21 nt, Homo sapiens
auauuacuguuagaggacugc

SEQ ID NO: 163755 - RNA, 22 nt, Homo sapiens
auauuggccuaaaauucucuuu

SEQ ID NO: 163756 - RNA, 22 nt, Homo sapiens
aucaaaguaucucaauauggua

SEQ ID NO: 163757 - RNA, 22 nt, Homo sapiens
aucaaagugaauuaaugagaau

SEQ ID NO: 163758 - RNA, 22 nt, Homo sapiens
aucaagccaaagaaaguccuug

SEQ ID NO: 163759 - RNA, 22 nt, Homo sapiens
aucacacucaccuucuguccuu

SEQ ID NO: 163760 - RNA, 22 nt, Homo sapiens
aucacacuguuauuuuaguuaa

SEQ ID NO: 163761 - RNA, 22 nt, Homo sapiens
aucacagauauggguuuaaauc

SEQ ID NO: 163762 - RNA, 22 nt, Homo sapiens
aucacaggucaaaucauuauuu

SEQ ID NO: 163763 - RNA, 22 nt, Homo sapiens
aucacagugagcauaugucuau

SEQ ID NO: 163764 - RNA, 22 nt, Homo sapiens
aucaccuggaggugaucacuug

SEQ ID NO: 163765 - RNA, 22 nt, Homo sapiens
aucacuguaaguuuacacuuug

SEQ ID NO: 163766 - RNA, 22 nt, Homo sapiens
auggugugugaauuaaauguua

SEQ ID NO: 163767 - RNA, 22 nt, Homo sapiens
augguuuuacugcaaaauggga

SEQ ID NO: 163768 - RNA, 22 nt, Homo sapiens
auguaaacauuuggucuaaauu

SEQ ID NO: 163769 - RNA, 22 nt, Homo sapiens
auguaacaguauuuggagaugu

SEQ ID NO: 163770 - RNA, 22 nt, Homo sapiens
auguaacuaucugagccauggg

SEQ ID NO: 163771 - RNA, 21 nt, Homo sapiens
auguaacugggaaugugagag

SEQ ID NO: 163772 - RNA, 22 nt, Homo sapiens
auguaacugggacacaagccuc

SEQ ID NO: 163773 - RNA, 22 nt, Homo sapiens
auguccaugagcacauguauca

SEQ ID NO: 163774 - RNA, 22 nt, Homo sapiens
augucuuucauagagacccaga

SEQ ID NO: 163775 - RNA, 22 nt, Homo sapiens
augugacugauguaaucagaca

SEQ ID NO: 163776 - RNA, 22 nt, Homo sapiens
augugcaaauuuccaaacucuu

SEQ ID NO: 163777 - RNA, 21 nt, Homo sapiens
augugcacuaugucauuuaau

SEQ ID NO: 163778 - RNA, 22 nt, Homo sapiens
augugcauaugaagcacagaca

SEQ ID NO: 163779 - RNA, 22 nt, Homo sapiens
augugcuugagggaaaucaguu

SEQ ID NO: 163780 - RNA, 22 nt, Homo sapiens
auguggaaauguauaugugucu

SEQ ID NO: 163781 - RNA, 22 nt, Homo sapiens
augugggaggaauguguuucca

SEQ ID NO: 163782 - RNA, 22 nt, Homo sapiens
augugugaaucccagaaccugu

SEQ ID NO: 163783 - RNA, 22 nt, Homo sapiens
auguguucaucacagcacaauu

SEQ ID NO: 163784 - RNA, 22 nt, Homo sapiens
auguuagcaucuggcacuaugg

SEQ ID NO: 163785 - RNA, 20 nt, Homo sapiens
auguucuggaggacagaagc

SEQ ID NO: 163786 - RNA, 22 nt, Homo sapiens
auguuguaguaugagucaaaau

SEQ ID NO: 163787 - RNA, 20 nt, Homo sapiens
auuagagcuacauggcuaca

SEQ ID NO: 163788 - RNA, 22 nt, Homo sapiens
auuagguauuuguccuaaauau

SEQ ID NO: 163789 - RNA, 22 nt, Homo sapiens
auuauugacucauagaaaggau

SEQ ID NO: 163790 - RNA, 22 nt, Homo sapiens
auucaaagugcauguucccacu

SEQ ID NO: 163791 - RNA, 22 nt, Homo sapiens
auucaaggagucuucgucccaa

SEQ ID NO: 163792 - RNA, 22 nt, Homo sapiens
auucaagugaugugauucuucu

SEQ ID NO: 163793 - RNA, 22 nt, Homo sapiens
auucacagggggagaaggguau

SEQ ID NO: 163794 - RNA, 22 nt, Homo sapiens
auuccauaguacagugaugagu

SEQ ID NO: 163795 - RNA, 22 nt, Homo sapiens
auucccuuggucaacggaugca

SEQ ID NO: 163796 - RNA, 22 nt, Homo sapiens
auucuugcuugaacuuggugca

SEQ ID NO: 163797 - RNA, 22 nt, Homo sapiens
auugacaguuggccaguaagug

SEQ ID NO: 163798 - RNA, 21 nt, Homo sapiens
auugagcacaugaaacauggc

SEQ ID NO: 163799 - RNA, 22 nt, Homo sapiens
auugcaaugggaaacuaugaaa

SEQ ID NO: 163800 - RNA, 22 nt, Homo sapiens
auugcacaaagagggaaacuga

SEQ ID NO: 163801 - RNA, 22 nt, Homo sapiens
auugcacaccagucugggcaaa

SEQ ID NO: 163802 - RNA, 22 nt, Homo sapiens
auugcaccacugcccuccagcc

SEQ ID NO: 163803 - RNA, 22 nt, Homo sapiens
auugcacuccagccugagcaaa

SEQ ID NO: 163804 - RNA, 22 nt, Homo sapiens
auugcacuccagccugggugag

SEQ ID NO: 163805 - RNA, 22 nt, Homo sapiens
auugcacuccagcuugggugac

SEQ ID NO: 163806 - RNA, 22 nt, Homo sapiens
auugcacucuagccugggugac

SEQ ID NO: 163807 - RNA, 22 nt, Homo sapiens
auugcacucugaucugcacucc

SEQ ID NO: 163808 - RNA, 22 nt, Homo sapiens
auugcagcccacccugggugau

SEQ ID NO: 163809 - RNA, 22 nt, Homo sapiens
auugcucagucagggagcucgg

SEQ ID NO: 163810 - RNA, 22 nt, Homo sapiens
auugcuuaagucccuguauuag

SEQ ID NO: 163811 - RNA, 22 nt, Homo sapiens
auugcuuacuaaucaucuucag

SEQ ID NO: 163812 - RNA, 22 nt, Homo sapiens
auugcuucugauuuuaaaugag

SEQ ID NO: 163813 - RNA, 22 nt, Homo sapiens
auuggaguuguacgcacgcuca

SEQ ID NO: 163814 - RNA, 22 nt, Homo sapiens
auuggcaauggcaaagcagagu

SEQ ID NO: 163815 - RNA, 22 nt, Homo sapiens
auuguacucuagccucugggca

SEQ ID NO: 163816 - RNA, 22 nt, Homo sapiens
auugucacccgggcaguaagca

SEQ ID NO: 163817 - RNA, 22 nt, Homo sapiens
auuuagcaauggagguagugua

SEQ ID NO: 163818 - RNA, 22 nt, Homo sapiens
auuuggcaacguagggaggcau

SEQ ID NO: 163819 - RNA, 20 nt, Homo sapiens
auuuggcauaguuuaagcaa

SEQ ID NO: 163820 - RNA, 22 nt, Homo sapiens
caaaccuguaggggccaagagg

SEQ ID NO: 163821 - RNA, 22 nt, Homo sapiens
caaagcacuuggcuuggaagau

SEQ ID NO: 163822 - RNA, 22 nt, Homo sapiens
caaaggcuguuauaggccagga

SEQ ID NO: 163823 - RNA, 22 nt, Homo sapiens
caaaguaauuacgguuuuggcc

SEQ ID NO: 163824 - RNA, 22 nt, Homo sapiens
caaaguaauugugguuuugcca

SEQ ID NO: 163825 - RNA, 22 nt, Homo sapiens
caacauccaccuccuggguuca

SEQ ID NO: 163826 - RNA, 22 nt, Homo sapiens
caacugcucacuccuggguuca

SEQ ID NO: 163827 - RNA, 22 nt, Homo sapiens
caacugguuuuauacaguuuag

SEQ ID NO: 163828 - RNA, 22 nt, Homo sapiens
caagaggcuguguauaaagcca

SEQ ID NO: 163829 - RNA, 22 nt, Homo sapiens
ccuggcacugagcaguguucua

SEQ ID NO: 163830 - RNA, 23 nt, Homo sapiens
ccuguagaaugucugugauacuu

SEQ ID NO: 163831 - RNA, 22 nt, Homo sapiens
ccuguagcauccaagaagcugc

SEQ ID NO: 163832 - RNA, 22 nt, Homo sapiens
ccuuuuugaguugccagaguuc

SEQ ID NO: 163833 - RNA, 22 nt, Homo sapiens
cgccugagcugaggaagcugca

SEQ ID NO: 163834 - RNA, 22 nt, Homo sapiens
cuaaaguauugagugguaaaga

SEQ ID NO: 163835 - RNA, 22 nt, Homo sapiens
cuaacacagagguuuauuucuc

SEQ ID NO: 163836 - RNA, 22 nt, Homo sapiens
cuaaugcagucaggagaaggaa

SEQ ID NO: 163837 - RNA, 22 nt, Homo sapiens
cuacaguaugaaaccuuuacuc

SEQ ID NO: 163838 - RNA, 22 nt, Homo sapiens
cuacccuuaaguuucugugggg

SEQ ID NO: 163839 - RNA, 22 nt, Homo sapiens
cuagguuauacucugaaauggu

SEQ ID NO: 163840 - RNA, 22 nt, Homo sapiens
cuagucacaggaguugaaggau

SEQ ID NO: 163841 - RNA, 18 nt, Homo sapiens
cuaugccacuuuauauca

SEQ ID NO: 163842 - RNA, 21 nt, Homo sapiens
cucaaaguacugauauuacag

SEQ ID NO: 163843 - RNA, 22 nt, Homo sapiens
cucaaagucaagggaaagcagg

SEQ ID NO: 163844 - RNA, 22 nt, Homo sapiens
cucaaagugcugggacuggcug

SEQ ID NO: 163845 - RNA, 22 nt, Homo sapiens
cucaaaguguggucuguggguu

SEQ ID NO: 163846 - RNA, 22 nt, Homo sapiens
cucaaaugguccagcuaguggu

SEQ ID NO: 163847 - RNA, 18 nt, Homo sapiens
cucaaccucaugcagggc

SEQ ID NO: 163848 - RNA, 20 nt, Homo sapiens
cucacagacagcuucuuucu

SEQ ID NO: 163849 - RNA, 22 nt, Homo sapiens
cucacaguucuaaaggcaagaa

SEQ ID NO: 163850 - RNA, 22 nt, Homo sapiens
cucacaugcucaccugguguuc

SEQ ID NO: 163851 - RNA, 22 nt, Homo sapiens
cucaccuugugauccaccggcc

SEQ ID NO: 163852 - RNA, 22 nt, Homo sapiens
cucaccuugugauccuccugcc

SEQ ID NO: 163853 - RNA, 22 nt, Homo sapiens
cucacuaguaaggcuguuuagu

SEQ ID NO: 163854 - RNA, 22 nt, Homo sapiens
uggcacuggagauacauuaaua

SEQ ID NO: 163855 - RNA, 22 nt, Homo sapiens
uggcagauaggauacaggacua

SEQ ID NO: 163856 - RNA, 22 nt, Homo sapiens
uggcaugaagaccccauccuuu

SEQ ID NO: 163857 - RNA, 20 nt, Homo sapiens
uggcauguugguaugcaccc

SEQ ID NO: 163858 - RNA, 22 nt, Homo sapiens
uggcauuuugugugaauuagaa

SEQ ID NO: 163859 - RNA, 23 nt, Homo sapiens
uggccagaaacuucuuuucaucc

SEQ ID NO: 163860 - RNA, 22 nt, Homo sapiens
uggccuguaacgcugucucagc

SEQ ID NO: 163861 - RNA, 22 nt, Homo sapiens
uggcuagauauccagaguucug

SEQ ID NO: 163862 - RNA, 22 nt, Homo sapiens
uggcucuguuuguuaacuagac

SEQ ID NO: 163863 - RNA, 22 nt, Homo sapiens
uggcuuuucauccugggacauu

SEQ ID NO: 163864 - RNA, 22 nt, Homo sapiens
uggcuuuuccaggcauuacgau

SEQ ID NO: 163865 - RNA, 22 nt, Homo sapiens
ugggaaauguagccuagcugug

SEQ ID NO: 163866 - RNA, 22 nt, Homo sapiens
ugggaagaagguuuacuugcca

SEQ ID NO: 163867 - RNA, 22 nt, Homo sapiens
ugggaagcugcauuuuaacaag

SEQ ID NO: 163868 - RNA, 22 nt, Homo sapiens
ugggaccccuacucuuuccaca

SEQ ID NO: 163869 - RNA, 22 nt, Homo sapiens
ugggaugaugaaaaggcuuucu

SEQ ID NO: 163870 - RNA, 22 nt, Homo sapiens
ugggaugauguuaaacguacuc

SEQ ID NO: 163871 - RNA, 22 nt, Homo sapiens
uggguaguuucuuacaacucug

SEQ ID NO: 163872 - RNA, 22 nt, Homo sapiens
ugguaaacaacaggagaacuug

SEQ ID NO: 163873 - RNA, 23 nt, Homo sapiens
ugguaacauguuguggcagggga

SEQ ID NO: 163874 - RNA, 22 nt, Homo sapiens
ugguaagaucugugagccaggc

SEQ ID NO: 163875 - RNA, 22 nt, Homo sapiens
uggucaccuucuugcucugucu

SEQ ID NO: 163876 - RNA, 22 nt, Homo sapiens
uggucaugaggugaggcuucuc

SEQ ID NO: 163877 - RNA, 22 nt, Homo sapiens
ugguccaguucugugauauugc

SEQ ID NO: 163878 - RNA, 19 nt, Homo sapiens
uggucccccgcaaucucau

SEQ ID NO: 163879 - RNA, 22 nt, Homo sapiens
uggucuccuuuguacccugggc

SEQ ID NO: 163880 - RNA, 22 nt, Homo sapiens
uggucucuuugcuuuagucauc

SEQ ID NO: 163881 - RNA, 22 nt, Homo sapiens
uggucuuuucaacaaaugguau

SEQ ID NO: 163882 - RNA, 22 nt, Homo sapiens
uggugagaaacuagauauuuuu

SEQ ID NO: 163883 - RNA, 22 nt, Homo sapiens
uggugagaaaugagaugcuuuu

SEQ ID NO: 163884 - RNA, 22 nt, Homo sapiens
uggugcuugaugaggguggagc

SEQ ID NO: 163885 - RNA, 22 nt, Homo sapiens
ugguggcuuuucguagguucac

SEQ ID NO: 163886 - RNA, 20 nt, Homo sapiens
ugguguuugaacagugaaug

SEQ ID NO: 163887 - RNA, 18 nt, Homo sapiens
uguaaacuaccucaaccu

SEQ ID NO: 163888 - RNA, 22 nt, Homo sapiens
uguaaacucaguauguuuuacu

SEQ ID NO: 163889 - RNA, 22 nt, Homo sapiens
uguaaaucuauuuuuaguguuu

SEQ ID NO: 163890 - RNA, 22 nt, Homo sapiens
uguaaaucugguuaauuggaua

SEQ ID NO: 163891 - RNA, 22 nt, Homo sapiens
uguaagcagcagagacuauccu

SEQ ID NO: 163892 - RNA, 22 nt, Homo sapiens
uguacaugggacaggaggagag

SEQ ID NO: 163893 - RNA, 22 nt, Homo sapiens
uguagcaaauaaaagucuggau

SEQ ID NO: 163894 - RNA, 21 nt, Homo sapiens
uguagcagcauaauuuauaau

SEQ ID NO: 163895 - RNA, 22 nt, Homo sapiens
uguauaacucacauugaaguuu

SEQ ID NO: 163896 - RNA, 21 nt, Homo sapiens
uguauacauauguuaggugca

SEQ ID NO: 163897 - RNA, 22 nt, Homo sapiens
uguauaggcaaauuuccucaug

SEQ ID NO: 163898 - RNA, 19 nt, Homo sapiens
ugucaaaugucuccugggg

SEQ ID NO: 163899 - RNA, 22 nt, Homo sapiens
ugucaaauucuggguuaaaaca

SEQ ID NO: 163900 - RNA, 22 nt, Homo sapiens
ugucaauauguaauaacugaau

SEQ ID NO: 163901 - RNA, 22 nt, Homo sapiens
ugucacauccaagaaggugcag

SEQ ID NO: 163902 - RNA, 23 nt, Homo sapiens
ugucaucaagaugaggucacacu

SEQ ID NO: 163903 - RNA, 19 nt, Homo sapiens
ugucaucaucuuuucuugc

SEQ ID NO: 163904 - RNA, 22 nt, Homo sapiens
ugucaucauuccaucagggcuu

SEQ ID NO: 163905 - RNA, 22 nt, Homo sapiens
ugucaucuagguuuuaagccuu

SEQ ID NO: 163906 - RNA, 22 nt, Homo sapiens
ugucauguaaagaguaaauggu

SEQ ID NO: 163907 - RNA, 22 nt, Homo sapiens
uguccaaaucagagguaccaaa

SEQ ID NO: 163908 - RNA, 19 nt, Homo sapiens
ugucccagccauagaggca

SEQ ID NO: 163909 - RNA, 22 nt, Homo sapiens
ugucuaaagaauggcagacuca

SEQ ID NO: 163910 - RNA, 22 nt, Homo sapiens
ugucuagaucugaauguaauug

SEQ ID NO: 163911 - RNA, 22 nt, Homo sapiens
ugucuuuguuaguuguccuagu

SEQ ID NO: 163912 - RNA, 22 nt, Homo sapiens
ugugaaacauggauagaacugg

SEQ ID NO: 163913 - RNA, 21 nt, Homo sapiens
ugugaaaucuaggcagagguu

SEQ ID NO: 163914 - RNA, 19 nt, Homo sapiens
ugugaacaucacagagugu

SEQ ID NO: 163915 - RNA, 22 nt, Homo sapiens
ugugaagauggacuaauauagu

SEQ ID NO: 163916 - RNA, 22 nt, Homo sapiens
ugugaauggugcuuccuagaug

SEQ ID NO: 163917 - RNA, 22 nt, Homo sapiens
ugugaauguaagaaaauccaac

SEQ ID NO: 163918 - RNA, 18 nt, Homo sapiens
ugugacauugagcauguc

SEQ ID NO: 163919 - RNA, 22 nt, Homo sapiens
ugugacuaguggugaaugacgc

SEQ ID NO: 163920 - RNA, 22 nt, Homo sapiens
ugugagaucucagaauugaacu

SEQ ID NO: 163921 - RNA, 22 nt, Homo sapiens
ugugaguguguacuaguuauca

SEQ ID NO: 163922 - RNA, 19 nt, Homo sapiens
ugugauaguugaaccugcc

SEQ ID NO: 163923 - RNA, 22 nt, Homo sapiens
ugugaucaugugugccuuaguc

SEQ ID NO: 163924 - RNA, 20 nt, Homo sapiens
ugugauuauuuaguugcaug

SEQ ID NO: 163925 - RNA, 22 nt, Homo sapiens
ugugcaaaaguaauugcgguuu

SEQ ID NO: 163926 - RNA, 22 nt, Homo sapiens
ugugcaaucagcuucauuacau

SEQ ID NO: 163927 - RNA, 22 nt, Homo sapiens
ugugcacaaugugcagguuuga

SEQ ID NO: 163928 - RNA, 22 nt, Homo sapiens
ugugcauaugucuuuauaguag

SEQ ID NO: 163929 - RNA, 22 nt, Homo sapiens
ugugccacugcacuccugccug

SEQ ID NO: 163930 - RNA, 22 nt, Homo sapiens
ugugccacugcacuucagccug

SEQ ID NO: 163931 - RNA, 22 nt, Homo sapiens
ugugcgcaucggggccugcuuc

SEQ ID NO: 163932 - RNA, 22 nt, Homo sapiens
ugugcuaauacauacagugcua

SEQ ID NO: 163933 - RNA, 22 nt, Homo sapiens
ugugcuuguaaaggccagagca

SEQ ID NO: 163934 - RNA, 22 nt, Homo sapiens
uguggcaaauggucaggaagaa

SEQ ID NO: 163935 - RNA, 22 nt, Homo sapiens
aaaagagcugagagguauucuu

SEQ ID NO: 163936 - RNA, 22 nt, Homo sapiens
aaaaggcuagcuaguaacagaa

SEQ ID NO: 163937 - RNA, 22 nt, Homo sapiens
aaacaccacgcggucccucgga

SEQ ID NO: 163938 - RNA, 23 nt, Homo sapiens
aaagacuagucaggugcaguggu

SEQ ID NO: 163939 - RNA, 22 nt, Homo sapiens
aaagcuaccagauucuguugga

SEQ ID NO: 163940 - RNA, 22 nt, Homo sapiens
aaagggcuguuucuugacuugg

SEQ ID NO: 163941 - RNA, 22 nt, Homo sapiens
aaagucuguuuugucagagacu

SEQ ID NO: 163942 - RNA, 22 nt, Homo sapiens
aaagugcaguacuucguauauu

SEQ ID NO: 163943 - RNA, 22 nt, Homo sapiens
aaagugcugagucuaggcgggg

SEQ ID NO: 163944 - RNA, 22 nt, Homo sapiens
aaagugcugggaucacacugaa

SEQ ID NO: 163945 - RNA, 22 nt, Homo sapiens
aaagugcugggauuaggccagg

SEQ ID NO: 163946 - RNA, 22 nt, Homo sapiens
aaagugcugggauuggccgggc

SEQ ID NO: 163947 - RNA, 22 nt, Homo sapiens
aaagugcugggauuuuaggcau

SEQ ID NO: 163948 - RNA, 22 nt, Homo sapiens
aaagugcuguagacugggcgca

SEQ ID NO: 163949 - RNA, 22 nt, Homo sapiens
aaaugcacgcuacccagcuaga

SEQ ID NO: 163950 - RNA, 22 nt, Homo sapiens
aaaugcagauuccuaggcccca

SEQ ID NO: 163951 - RNA, 22 nt, Homo sapiens
aaaugcaucauuaggugauuuu

SEQ ID NO: 163952 - RNA, 22 nt, Homo sapiens
aaaugcauggacagcuggucuu

SEQ ID NO: 163953 - RNA, 22 nt, Homo sapiens
aaaugcccuaaaauggagcauc

SEQ ID NO: 163954 - RNA, 22 nt, Homo sapiens
aaaugccucccauucuacugac

SEQ ID NO: 163955 - RNA, 22 nt, Homo sapiens
aaaugcugcuuuggccucuucu

SEQ ID NO: 163956 - RNA, 22 nt, Homo sapiens
aaauggcacaguaagggcauuu

SEQ ID NO: 163957 - RNA, 19 nt, Homo sapiens
aaaugugcacuguuuucca

SEQ ID NO: 163958 - RNA, 22 nt, Homo sapiens
aacaccuugcgugggcgucaau

SEQ ID NO: 163959 - RNA, 22 nt, Homo sapiens
aacacuggcugcucgaguucuc

SEQ ID NO: 163960 - RNA, 22 nt, Homo sapiens
aacaggguggugccugguccau

SEQ ID NO: 163961 - RNA, 22 nt, Homo sapiens
aacaggguguuugcaguuucuu

SEQ ID NO: 163962 - RNA, 22 nt, Homo sapiens
aacagugcauucagggauauau

SEQ ID NO: 163963 - RNA, 22 nt, Homo sapiens
aacagugcuguuauaaauguac

SEQ ID NO: 163964 - RNA, 22 nt, Homo sapiens
aacagugcuucauucacacauu

SEQ ID NO: 163965 - RNA, 22 nt, Homo sapiens
aacauagucaugggguaauguu

SEQ ID NO: 163966 - RNA, 22 nt, Homo sapiens
cuagccuggagugcaguggugc

SEQ ID NO: 163967 - RNA, 22 nt, Homo sapiens
cuauaacagugugguuuggaga

SEQ ID NO: 163968 - RNA, 22 nt, Homo sapiens
cuauggcuguaaggauaguaac

SEQ ID NO: 163969 - RNA, 22 nt, Homo sapiens
cuauuugguuggugaaaaaagu

SEQ ID NO: 163970 - RNA, 22 nt, Homo sapiens
cucaaagugcugggauuggcca

SEQ ID NO: 163971 - RNA, 22 nt, Homo sapiens
cucaaguacaugggauuacagg

SEQ ID NO: 163972 - RNA, 22 nt, Homo sapiens
cucaauuuggaauugucaguaa

SEQ ID NO: 163973 - RNA, 17 nt, Homo sapiens
cucacugagaacagcua

SEQ ID NO: 163974 - RNA, 22 nt, Homo sapiens
cucagggugguggacucuaaua

SEQ ID NO: 163975 - RNA, 22 nt, Homo sapiens
cucaguggauuagauaaugcac

SEQ ID NO: 163976 - RNA, 22 nt, Homo sapiens
cucagugucuggcacacagaaa

SEQ ID NO: 163977 - RNA, 22 nt, Homo sapiens
cucauggagaacaucugcuagg

SEQ ID NO: 163978 - RNA, 22 nt, Homo sapiens
cucauggagaaccucugcuagg

SEQ ID NO: 163979 - RNA, 22 nt, Homo sapiens
cuccaggugucauccaccuccu

SEQ ID NO: 163980 - RNA, 22 nt, Homo sapiens
cucccacccucauuuuuaggca

SEQ ID NO: 163981 - RNA, 22 nt, Homo sapiens
cuccuguagccccaucaucuuu

SEQ ID NO: 163982 - RNA, 22 nt, Homo sapiens
cucugacagugguuagcacugu

SEQ ID NO: 163983 - RNA, 22 nt, Homo sapiens
cugaaaagcaucugcauagcug

SEQ ID NO: 163984 - RNA, 19 nt, Homo sapiens
cugaaacacagagagggcu

SEQ ID NO: 163985 - RNA, 22 nt, Homo sapiens
cugaaagagcauguaacacagu

SEQ ID NO: 163986 - RNA, 22 nt, Homo sapiens
cugaagugcuugccacauaaaa

SEQ ID NO: 163987 - RNA, 22 nt, Homo sapiens
cugaauagagcacacugauggg

SEQ ID NO: 163988 - RNA, 22 nt, Homo sapiens
cugaauguucuggauggaagag

SEQ ID NO: 163989 - RNA, 22 nt, Homo sapiens
cugaauguuucacucugaaaug

SEQ ID NO: 163990 - RNA, 22 nt, Homo sapiens
cugacauuguugaucacagcca

SEQ ID NO: 163991 - RNA, 22 nt, Homo sapiens
cugacuaguuuuaaugcagauu

SEQ ID NO: 163992 - RNA, 22 nt, Homo sapiens
cugagaacaucauucagauauu

SEQ ID NO: 163993 - RNA, 22 nt, Homo sapiens
cugagaguugaugaaauauggu

SEQ ID NO: 163994 - RNA, 22 nt, Homo sapiens
cugagauaggacucugcuggcu

SEQ ID NO: 163995 - RNA, 18 nt, Homo sapiens
cugagcacugcuuuauga

SEQ ID NO: 163996 - RNA, 22 nt, Homo sapiens
cugagcuagaccacuuggcucc

SEQ ID NO: 163997 - RNA, 22 nt, Homo sapiens
cugagcuagaccauuuggcucc

SEQ ID NO: 163998 - RNA, 22 nt, Homo sapiens
cugagcucauuucuuuugcuac

SEQ ID NO: 163999 - RNA, 22 nt, Homo sapiens
cugaggcacggcgaccuuaagu

SEQ ID NO: 164000 - RNA, 22 nt, Homo sapiens
cugagguaggcccugagaauau

SEQ ID NO: 164001 - RNA, 22 nt, Homo sapiens
cugagguaggugaucagugcuu

SEQ ID NO: 164002 - RNA, 22 nt, Homo sapiens
cugagguauaucccauuagaag

SEQ ID NO: 164003 - RNA, 22 nt, Homo sapiens
cugaggucugaauccagguauc

SEQ ID NO: 164004 - RNA, 22 nt, Homo sapiens
cugaggugggagaaucacauaa

SEQ ID NO: 164005 - RNA, 22 nt, Homo sapiens
cugaggugggaggauuggcuug

SEQ ID NO: 164006 - RNA, 22 nt, Homo sapiens
cugaucuaugaacacaggauau

SEQ ID NO: 164007 - RNA, 22 nt, Homo sapiens
cugaugguuuuacacaagggca

SEQ ID NO: 164008 - RNA, 20 nt, Homo sapiens
cugcaaaugcugcugcugau

SEQ ID NO: 164009 - RNA, 22 nt, Homo sapiens
cugcaauggagaaagugagacu

SEQ ID NO: 164010 - RNA, 22 nt, Homo sapiens
cugcaguaaccacuguaggugu

SEQ ID NO: 164011 - RNA, 22 nt, Homo sapiens
cugcagucaucugaagauuuug

SEQ ID NO: 164012 - RNA, 19 nt, Homo sapiens
cugcaugagacaguugguu

SEQ ID NO: 164013 - RNA, 20 nt, Homo sapiens
cugcuccccuacaaaucuca

SEQ ID NO: 164014 - RNA, 22 nt, Homo sapiens
cuggaaagcaaagggugcauug

SEQ ID NO: 164015 - RNA, 22 nt, Homo sapiens
cuggaaagcaaguccauugcuc

SEQ ID NO: 164016 - RNA, 22 nt, Homo sapiens
cuggauagucaggagauauaua

SEQ ID NO: 164017 - RNA, 18 nt, Homo sapiens
cuggaugucgaguguguu

SEQ ID NO: 164018 - RNA, 22 nt, Homo sapiens
cuggcaagaggauaaaguccua

SEQ ID NO: 164019 - RNA, 22 nt, Homo sapiens
cuggcacagugucagaaacaca

SEQ ID NO: 164020 - RNA, 22 nt, Homo sapiens
cuggccagagacauucauuaaa

SEQ ID NO: 164021 - RNA, 22 nt, Homo sapiens
cuggcugagugguaaguagagg

SEQ ID NO: 164022 - RNA, 22 nt, Homo sapiens
cugggaucaguucuagucagaa

SEQ ID NO: 164023 - RNA, 22 nt, Homo sapiens
cugggauggaggagaauuagag

SEQ ID NO: 164024 - RNA, 22 nt, Homo sapiens
cugggaugugacuguugccccc

SEQ ID NO: 164025 - RNA, 22 nt, Homo sapiens
cugggcaaugcggcuggauaga

SEQ ID NO: 164026 - RNA, 22 nt, Homo sapiens
cuggugagaugucuuuccucuu

SEQ ID NO: 164027 - RNA, 22 nt, Homo sapiens
cugguuguucuggaugggcagg

SEQ ID NO: 164028 - RNA, 22 nt, Homo sapiens
cuguaaaguucucauuguagcc

SEQ ID NO: 164029 - RNA, 22 nt, Homo sapiens
cuguaagcauuauaaagagaua

SEQ ID NO: 164030 - RNA, 22 nt, Homo sapiens
cuguacucaucccauaugcacu

SEQ ID NO: 164031 - RNA, 22 nt, Homo sapiens
cuguagacauuaggccugcacu

SEQ ID NO: 164032 - RNA, 22 nt, Homo sapiens
cugucacaguuuuggaggccag

SEQ ID NO: 164033 - RNA, 19 nt, Homo sapiens
cugucacugaggaagacug

SEQ ID NO: 164034 - RNA, 22 nt, Homo sapiens
cugucaucauuucuaugugcca

SEQ ID NO: 164035 - RNA, 22 nt, Homo sapiens
cugucuguuucaaaagugguua

SEQ ID NO: 164036 - RNA, 22 nt, Homo sapiens
cugugaacaugggagaaauggc

SEQ ID NO: 164037 - RNA, 22 nt, Homo sapiens
cugugcaaguuauaggccaggu

SEQ ID NO: 164038 - RNA, 22 nt, Homo sapiens
cugugcacaucuggcggcccga

SEQ ID NO: 164039 - RNA, 22 nt, Homo sapiens
cugugcauggauuuuaagauug

SEQ ID NO: 164040 - RNA, 22 nt, Homo sapiens
cugugguauuauuagaaauauc

SEQ ID NO: 164041 - RNA, 22 nt, Homo sapiens
cuguugguguuuaaucacugca

SEQ ID NO: 164042 - RNA, 22 nt, Homo sapiens
cuguuugaggguuugcuuucag

SEQ ID NO: 164043 - RNA, 22 nt, Homo sapiens
cuguuuguuuaggguacucaga

SEQ ID NO: 164044 - RNA, 22 nt, Homo sapiens
cuuaaagcgaauauugguggua

SEQ ID NO: 164045 - RNA, 18 nt, Homo sapiens
cuuaacauugggaugaua

SEQ ID NO: 164046 - RNA, 22 nt, Homo sapiens
cuuaagcauugacuuuggacag

SEQ ID NO: 164047 - RNA, 20 nt, Homo sapiens
cuucacagaaguggaaucau

SEQ ID NO: 164048 - RNA, 22 nt, Homo sapiens
cuucacuggagucccuggauuc

SEQ ID NO: 164049 - RNA, 22 nt, Homo sapiens
uauuucaguugcguuucccgag

SEQ ID NO: 164050 - RNA, 22 nt, Homo sapiens
uauuuggauagucuggaaaaaa

SEQ ID NO: 164051 - RNA, 22 nt, Homo sapiens
uauuugguuauaugaguaaguu

SEQ ID NO: 164052 - RNA, 22 nt, Homo sapiens
ucaaaguauucuucugagaacc

SEQ ID NO: 164053 - RNA, 22 nt, Homo sapiens
ucaaagugacaaaguugcagca

SEQ ID NO: 164054 - RNA, 22 nt, Homo sapiens
ucaaaugaucugcccgccuugg

SEQ ID NO: 164055 - RNA, 22 nt, Homo sapiens
ucaaaugauucuccugccucag

SEQ ID NO: 164056 - RNA, 22 nt, Homo sapiens
ucaaaugcuguauuguaguaau

SEQ ID NO: 164057 - RNA, 20 nt, Homo sapiens
ucaaauucuuggccuccagc

SEQ ID NO: 164058 - RNA, 22 nt, Homo sapiens
ucaagcaauucuccugccucag

SEQ ID NO: 164059 - RNA, 18 nt, Homo sapiens
ucaagcaauugucaugcc

SEQ ID NO: 164060 - RNA, 18 nt, Homo sapiens
ucaauguggauguucuuu

SEQ ID NO: 164061 - RNA, 16 nt, Homo sapiens
ucacaaacucuagcag

SEQ ID NO: 164062 - RNA, 22 nt, Homo sapiens
ucacaaggcaggaaugaaaggg

SEQ ID NO: 164063 - RNA, 22 nt, Homo sapiens
ucacaauggcugaacuaauuua

SEQ ID NO: 164064 - RNA, 22 nt, Homo sapiens
ucacagccuaguuuuauacauu

SEQ ID NO: 164065 - RNA, 22 nt, Homo sapiens
ucacaguagccccucccaucau

SEQ ID NO: 164066 - RNA, 23 nt, Homo sapiens
ucacaguuacuuuugcaucaacc

SEQ ID NO: 164067 - RNA, 22 nt, Homo sapiens
ucacaucucagguuucuugaca

SEQ ID NO: 164068 - RNA, 22 nt, Homo sapiens
ucacauuguuauguaaauguuu

SEQ ID NO: 164069 - RNA, 19 nt, Homo sapiens
ucaccaguacacaauacaa

SEQ ID NO: 164070 - RNA, 22 nt, Homo sapiens
ucacccuguguuuugcguuugc

SEQ ID NO: 164071 - RNA, 22 nt, Homo sapiens
ucaccuggagagcuugcuaaua

SEQ ID NO: 164072 - RNA, 21 nt, Homo sapiens
ucaccuguugcgaugaagcug

SEQ ID NO: 164073 - RNA, 19 nt, Homo sapiens
ucaccuugcccugcacaca

SEQ ID NO: 164074 - RNA, 18 nt, Homo sapiens
ucaccuugcuuuuagaac

SEQ ID NO: 164075 - RNA, 22 nt, Homo sapiens
ucacgugcucuuguguguucug

SEQ ID NO: 164076 - RNA, 23 nt, Homo sapiens
ucacuagaguccuggaguuugag

SEQ ID NO: 164077 - RNA, 22 nt, Homo sapiens
ucacugaaaccacugccuccug

SEQ ID NO: 164078 - RNA, 22 nt, Homo sapiens
ucacugaggucugagcuuuaug

SEQ ID NO: 164079 - RNA, 22 nt, Homo sapiens
ucacugcacucuccgccuugcg

SEQ ID NO: 164080 - RNA, 22 nt, Homo sapiens
ucacuggagauagcaaucuggu

SEQ ID NO: 164081 - RNA, 22 nt, Homo sapiens
ucacuggaggagaggaagugga

SEQ ID NO: 164082 - RNA, 22 nt, Homo sapiens
ucacuggccaaauucuggguga

SEQ ID NO: 164083 - RNA, 22 nt, Homo sapiens
ucacugggagaccaaagccauc

SEQ ID NO: 164084 - RNA, 22 nt, Homo sapiens
ucacugggagcauuugagccuu

SEQ ID NO: 164085 - RNA, 22 nt, Homo sapiens
ucacugugguuuugaugugcau

SEQ ID NO: 164086 - RNA, 22 nt, Homo sapiens
ucacugugugucucuguaucug

SEQ ID NO: 164087 - RNA, 22 nt, Homo sapiens
ucacuuggugaacacauuaugu

SEQ ID NO: 164088 - RNA, 22 nt, Homo sapiens
ucagaccauuucauuacagacu

SEQ ID NO: 164089 - RNA, 22 nt, Homo sapiens
ucagagugcagggaguagcagc

SEQ ID NO: 164090 - RNA, 22 nt, Homo sapiens
ucagaguguuuuccaacuuggu

SEQ ID NO: 164091 - RNA, 22 nt, Homo sapiens
ucagaucauauucuucgcugcu

SEQ ID NO: 164092 - RNA, 22 nt, Homo sapiens
ucagcagugugaaaacaaacua

SEQ ID NO: 164093 - RNA, 22 nt, Homo sapiens
ucagcaucacaggcagugagug

SEQ ID NO: 164094 - RNA, 22 nt, Homo sapiens
ucaggcacucagcuuagagucu

SEQ ID NO: 164095 - RNA, 21 nt, Homo sapiens
ucaggcuuuuugagugccaau

SEQ ID NO: 164096 - RNA, 22 nt, Homo sapiens
ucagguagcauuuuggaaacag

SEQ ID NO: 164097 - RNA, 22 nt, Homo sapiens
ucaggugccuuggcuaauuguu

SEQ ID NO: 164098 - RNA, 23 nt, Homo sapiens
ucaguagucauugggaaagugug

SEQ ID NO: 164099 - RNA, 22 nt, Homo sapiens
ucaguaguuuuuuuacuaggug

SEQ ID NO: 164100 - RNA, 22 nt, Homo sapiens
ucagucauucaauuguugaaug

SEQ ID NO: 164101 - RNA, 22 nt, Homo sapiens
ucagugaacgaggaggagggug

SEQ ID NO: 164102 - RNA, 22 nt, Homo sapiens
ucagugauugcuuucauggaaa

SEQ ID NO: 164103 - RNA, 22 nt, Homo sapiens
ucagugcuguaccaucuaagga

SEQ ID NO: 164104 - RNA, 22 nt, Homo sapiens
ucaguggagagcuuccaggauu

SEQ ID NO: 164105 - RNA, 22 nt, Homo sapiens
ucagugucugcauucuuauugu

SEQ ID NO: 164106 - RNA, 22 nt, Homo sapiens
ucauacaggccaccagggaagu

SEQ ID NO: 164107 - RNA, 20 nt, Homo sapiens
ucauagggugguggcagugg

SEQ ID NO: 164108 - RNA, 22 nt, Homo sapiens
ucauaguagucacuuaauaaau

SEQ ID NO: 164109 - RNA, 22 nt, Homo sapiens
ucauauguaugugcaauuuugu

SEQ ID NO: 164110 - RNA, 21 nt, Homo sapiens
ucaucaagcuguagacaugau

SEQ ID NO: 164111 - RNA, 22 nt, Homo sapiens
ucaucaguuuuuuauaugugau

SEQ ID NO: 164112 - RNA, 22 nt, Homo sapiens
ucaucuggcgaaugugaagagu

SEQ ID NO: 164113 - RNA, 22 nt, Homo sapiens
ucaugacacuggcaggagcuaa

SEQ ID NO: 164114 - RNA, 23 nt, Homo sapiens
ucaugaggccauucaaauccauu

SEQ ID NO: 164115 - RNA, 21 nt, Homo sapiens
ucaugccacugcacuuuagcc

SEQ ID NO: 164116 - RNA, 22 nt, Homo sapiens
ucaugggagcccccaucaugag

SEQ ID NO: 164117 - RNA, 22 nt, Homo sapiens
ucauggguuuugguccaagcaa

SEQ ID NO: 164118 - RNA, 22 nt, Homo sapiens
ucauguaauuuugugucuauga

SEQ ID NO: 164119 - RNA, 22 nt, Homo sapiens
ucaugugagcacagagcaagau

SEQ ID NO: 164120 - RNA, 22 nt, Homo sapiens
ucauucauucuucaguggguac

SEQ ID NO: 164121 - RNA, 22 nt, Homo sapiens
ucauugcauuccagcccaagca

SEQ ID NO: 164122 - RNA, 22 nt, Homo sapiens
uccaauguaaucaucauugaau

SEQ ID NO: 164123 - RNA, 22 nt, Homo sapiens
uccacagugguggaauuguuca

SEQ ID NO: 164124 - RNA, 22 nt, Homo sapiens
uccacagugguugaacuaguaa

SEQ ID NO: 164125 - RNA, 22 nt, Homo sapiens
uccagcuuuuucuaauucugug

SEQ ID NO: 164126 - RNA, 22 nt, Homo sapiens
uccaugagaauaguuaggcucu

SEQ ID NO: 164127 - RNA, 22 nt, Homo sapiens
ucccaagaugagaugggggcug

SEQ ID NO: 164128 - RNA, 22 nt, Homo sapiens
ucccagaaacgcauauguucau

SEQ ID NO: 164129 - RNA, 20 nt, Homo sapiens
ucccaguaggagaaggaagg

SEQ ID NO: 164130 - RNA, 22 nt, Homo sapiens
ucccaguguguagcuugucucu

SEQ ID NO: 164131 - RNA, 19 nt, Homo sapiens
uccccgggucuagugcagc

SEQ ID NO: 164132 - RNA, 22 nt, Homo sapiens
auggcguguggcuuggaggcug

SEQ ID NO: 164133 - RNA, 22 nt, Homo sapiens
auggcuuuaagagugucugaau

SEQ ID NO: 164134 - RNA, 22 nt, Homo sapiens
auggcuuuucacagaggguucu

SEQ ID NO: 164135 - RNA, 22 nt, Homo sapiens
auggcuuuuuaaaucauguugu

SEQ ID NO: 164136 - RNA, 22 nt, Homo sapiens
augggaaaaucagaaggccugg

SEQ ID NO: 164137 - RNA, 21 nt, Homo sapiens
augggacuaacugaugggucu

SEQ ID NO: 164138 - RNA, 22 nt, Homo sapiens
augggacugggugccguggagc

SEQ ID NO: 164139 - RNA, 22 nt, Homo sapiens
augggauaguaucaguggaaua

SEQ ID NO: 164140 - RNA, 22 nt, Homo sapiens
augggcaaauguuggaaauucc

SEQ ID NO: 164141 - RNA, 17 nt, Homo sapiens
augggguuguagcccca

SEQ ID NO: 164142 - RNA, 22 nt, Homo sapiens
auggucccuguuccaugcuccu

SEQ ID NO: 164143 - RNA, 22 nt, Homo sapiens
auguaaacuacagauuuugggu

SEQ ID NO: 164144 - RNA, 20 nt, Homo sapiens
auguaauguaugauauguac

SEQ ID NO: 164145 - RNA, 22 nt, Homo sapiens
auguaguagcagaaaauauuuu

SEQ ID NO: 164146 - RNA, 22 nt, Homo sapiens
auguauacauagauacgugugu

SEQ ID NO: 164147 - RNA, 22 nt, Homo sapiens
auguaugagaguuccagcugau

SEQ ID NO: 164148 - RNA, 22 nt, Homo sapiens
augucacugcacuccugccugg

SEQ ID NO: 164149 - RNA, 22 nt, Homo sapiens
auguccauggaaucuguagcaa

SEQ ID NO: 164150 - RNA, 22 nt, Homo sapiens
augucugguagccaccuggagg

SEQ ID NO: 164151 - RNA, 22 nt, Homo sapiens
augugcaaagcacuguucagca

SEQ ID NO: 164152 - RNA, 22 nt, Homo sapiens
augugcaagaucauuaaagcuc

SEQ ID NO: 164153 - RNA, 22 nt, Homo sapiens
augugcaauggugucaccacau

SEQ ID NO: 164154 - RNA, 22 nt, Homo sapiens
augugcaugcuguucugccaga

SEQ ID NO: 164155 - RNA, 22 nt, Homo sapiens
augugcuuuuuaaacagaugcu

SEQ ID NO: 164156 - RNA, 22 nt, Homo sapiens
auguggaaagcagcaugauaug

SEQ ID NO: 164157 - RNA, 18 nt, Homo sapiens
auguggcuuuugaaggcu

SEQ ID NO: 164158 - RNA, 22 nt, Homo sapiens
augugucaaaucuaggccaaag

SEQ ID NO: 164159 - RNA, 23 nt, Homo sapiens
augugugcuuggagagcaggaug

SEQ ID NO: 164160 - RNA, 22 nt, Homo sapiens
augugugcuugugacacagccu

SEQ ID NO: 164161 - RNA, 22 nt, Homo sapiens
auguugcuugaaggcauuuugu

SEQ ID NO: 164162 - RNA, 22 nt, Homo sapiens
auuaacaucuagaguuuuggug

SEQ ID NO: 164163 - RNA, 22 nt, Homo sapiens
auuaagugcuugccagugcugg

SEQ ID NO: 164164 - RNA, 22 nt, Homo sapiens
auuacuuugcaccaaccuaaua

SEQ ID NO: 164165 - RNA, 22 nt, Homo sapiens
auuauauguguaugugcauacc

SEQ ID NO: 164166 - RNA, 22 nt, Homo sapiens
auucaaggacuggauugcggga

SEQ ID NO: 164167 - RNA, 22 nt, Homo sapiens
auucaucagggauacuggccug

SEQ ID NO: 164168 - RNA, 22 nt, Homo sapiens
auuccacagccgauaccaugac

SEQ ID NO: 164169 - RNA, 22 nt, Homo sapiens
auuccacaguuaacacagaccg

SEQ ID NO: 164170 - RNA, 18 nt, Homo sapiens
auucuacaggccuuuuga

SEQ ID NO: 164171 - RNA, 22 nt, Homo sapiens
auugaacuuacuaucuaaacua

SEQ ID NO: 164172 - RNA, 22 nt, Homo sapiens
auugcacacagaaucaggguaa

SEQ ID NO: 164173 - RNA, 18 nt, Homo sapiens
auugcacaccagccuggg

SEQ ID NO: 164174 - RNA, 22 nt, Homo sapiens
auugcacaucugcacuacagcc

SEQ ID NO: 164175 - RNA, 19 nt, Homo sapiens
auugcaguguaaaacuauu

SEQ ID NO: 164176 - RNA, 22 nt, Homo sapiens
auugcaguuucaacuccagggc

SEQ ID NO: 164177 - RNA, 22 nt, Homo sapiens
auugcauaaacacauuucuuau

SEQ ID NO: 164178 - RNA, 22 nt, Homo sapiens
auugcucacacaaagccuguuu

SEQ ID NO: 164179 - RNA, 22 nt, Homo sapiens
auugcuuacccuguauuagauc

SEQ ID NO: 164180 - RNA, 22 nt, Homo sapiens
ugaacuguaagguauaggugau

SEQ ID NO: 164181 - RNA, 22 nt, Homo sapiens
ugaagacucaauuauuaugaac

SEQ ID NO: 164182 - RNA, 22 nt, Homo sapiens
ugaagcuaacuugauugugaug

SEQ ID NO: 164183 - RNA, 22 nt, Homo sapiens
ugaaggaguauggauaagucgu

SEQ ID NO: 164184 - RNA, 22 nt, Homo sapiens
ugaauacuucaaaaaaauagcu

SEQ ID NO: 164185 - RNA, 22 nt, Homo sapiens
ugaauagaaguuuacuccuuuu

SEQ ID NO: 164186 - RNA, 22 nt, Homo sapiens
cuucaucugguuugugaacuuu

SEQ ID NO: 164187 - RNA, 22 nt, Homo sapiens
cuucaugagacuuuuggaaggc

SEQ ID NO: 164188 - RNA, 22 nt, Homo sapiens
cuuccaaguggggcacgugcca

SEQ ID NO: 164189 - RNA, 22 nt, Homo sapiens
cuuccauaguauuuuuacaaaa

SEQ ID NO: 164190 - RNA, 22 nt, Homo sapiens
cuucuugagggccugcugggaa

SEQ ID NO: 164191 - RNA, 22 nt, Homo sapiens
cuugaauguaaauaauguacag

SEQ ID NO: 164192 - RNA, 22 nt, Homo sapiens
cuugacacugucacucaggcca

SEQ ID NO: 164193 - RNA, 22 nt, Homo sapiens
cuugaccaauauggugaaaccc

SEQ ID NO: 164194 - RNA, 22 nt, Homo sapiens
cuugcagaggcccuggggagag

SEQ ID NO: 164195 - RNA, 22 nt, Homo sapiens
cuugucuugcacacgguugcca

SEQ ID NO: 164196 - RNA, 22 nt, Homo sapiens
cuuguggugcuuuuacgugggc

SEQ ID NO: 164197 - RNA, 22 nt, Homo sapiens
cuuguucuccuaagaugaaugc

SEQ ID NO: 164198 - RNA, 22 nt, Homo sapiens
cuuucugaggagaauagagaac

SEQ ID NO: 164199 - RNA, 21 nt, Homo sapiens
cuuugcacugcuccucagcuc

SEQ ID NO: 164200 - RNA, 22 nt, Homo sapiens
cuuuggucaaaauaaguaaguu

SEQ ID NO: 164201 - RNA, 22 nt, Homo sapiens
cuuuggucaauugcugcgggga

SEQ ID NO: 164202 - RNA, 22 nt, Homo sapiens
cuuuggucaauugcugugggga

SEQ ID NO: 164203 - RNA, 20 nt, Homo sapiens
cuuuggugagucaacuccuu

SEQ ID NO: 164204 - RNA, 22 nt, Homo sapiens
cuuuggugauagauaccccaua

SEQ ID NO: 164205 - RNA, 21 nt, Homo sapiens
cuuugguuucugacuugcaua

SEQ ID NO: 164206 - RNA, 22 nt, Homo sapiens
cuuuguccuucaagguguguca

SEQ ID NO: 164207 - RNA, 22 nt, Homo sapiens
cuuuguguggacauuucaggca

SEQ ID NO: 164208 - RNA, 22 nt, Homo sapiens
cuuuuacacuguuggcaggauu

SEQ ID NO: 164209 - RNA, 22 nt, Homo sapiens
cuuuuggcuuaagauugucuug

SEQ ID NO: 164210 - RNA, 22 nt, Homo sapiens
gaaaacugcuucucuggguuuc

SEQ ID NO: 164211 - RNA, 22 nt, Homo sapiens
gaaagcugguauagauacauua

SEQ ID NO: 164212 - RNA, 22 nt, Homo sapiens
gaaaugcucagggguuuuccag

SEQ ID NO: 164213 - RNA, 22 nt, Homo sapiens
gaaaugucugagauguggcuca

SEQ ID NO: 164214 - RNA, 23 nt, Homo sapiens
gaaaugucuuagugaaauugcuu

SEQ ID NO: 164215 - RNA, 22 nt, Homo sapiens
gaacuguuucuggugaaagagu

SEQ ID NO: 164216 - RNA, 22 nt, Homo sapiens
gaagguacgcuuaggaaaugau

SEQ ID NO: 164217 - RNA, 19 nt, Homo sapiens
gaaguguuguccuccagua

SEQ ID NO: 164218 - RNA, 22 nt, Homo sapiens
gaauagugcugcaaugaacaua

SEQ ID NO: 164219 - RNA, 22 nt, Homo sapiens
gaaucaauugaucuaugugucu

SEQ ID NO: 164220 - RNA, 22 nt, Homo sapiens
gaaugcaugaggggaucagaug

SEQ ID NO: 164221 - RNA, 22 nt, Homo sapiens
gacaagagaacacugcuauauu

SEQ ID NO: 164222 - RNA, 22 nt, Homo sapiens
gacaccauuucaguacuagguu

SEQ ID NO: 164223 - RNA, 22 nt, Homo sapiens
gacaguguggcgauuccucaag

SEQ ID NO: 164224 - RNA, 20 nt, Homo sapiens
gacauaggcugguaucuggc

SEQ ID NO: 164225 - RNA, 20 nt, Homo sapiens
gacauguugguuugcugcac

SEQ ID NO: 164226 - RNA, 22 nt, Homo sapiens
gacauguuuucauguauuugga

SEQ ID NO: 164227 - RNA, 21 nt, Homo sapiens
gaccacagcagggaaugucag

SEQ ID NO: 164228 - RNA, 22 nt, Homo sapiens
gaccuaggaggauugcuugagc

SEQ ID NO: 164229 - RNA, 22 nt, Homo sapiens
gacuaaugaaagagugugauau

SEQ ID NO: 164230 - RNA, 22 nt, Homo sapiens
gacuggccauugauacagaggu

SEQ ID NO: 164231 - RNA, 22 nt, Homo sapiens
gagaacagaagcauuccuaauu

SEQ ID NO: 164232 - RNA, 22 nt, Homo sapiens
gagaacugacauuaucguguau

SEQ ID NO: 164233 - RNA, 20 nt, Homo sapiens
gagaacugagaugcguuuga

SEQ ID NO: 164234 - RNA, 22 nt, Homo sapiens
gagaacugagugugcuggcgga

SEQ ID NO: 164235 - RNA, 22 nt, Homo sapiens
gagacagugucagccauugaaa

SEQ ID NO: 164236 - RNA, 22 nt, Homo sapiens
gagacugagucucgcucugccg

SEQ ID NO: 164237 - RNA, 22 nt, Homo sapiens
gagacugagucuugcccuguca

SEQ ID NO: 164238 - RNA, 21 nt, Homo sapiens
gagaggauucgccagccucuu

SEQ ID NO: 164239 - RNA, 22 nt, Homo sapiens
gagaggucguauaugauuucug

SEQ ID NO: 164240 - RNA, 22 nt, Homo sapiens
gagaucuuggccaaguuucuua

SEQ ID NO: 164241 - RNA, 22 nt, Homo sapiens
gagauggagacuuggccuuaaa

SEQ ID NO: 164242 - RNA, 22 nt, Homo sapiens
gagauggaguuucacuucgcuc

SEQ ID NO: 164243 - RNA, 22 nt, Homo sapiens
gagauggugugcuguuggaagu

SEQ ID NO: 164244 - RNA, 22 nt, Homo sapiens
gagcacauaugacauuuucuuc

SEQ ID NO: 164245 - RNA, 22 nt, Homo sapiens
gagcacugauuuauuuuugucu

SEQ ID NO: 164246 - RNA, 22 nt, Homo sapiens
gagcaguugagagugcuggcca

SEQ ID NO: 164247 - RNA, 22 nt, Homo sapiens
gagcaucauucaacaaaagucu

SEQ ID NO: 164248 - RNA, 22 nt, Homo sapiens
gagcuagguuuugaauccagac

SEQ ID NO: 164249 - RNA, 22 nt, Homo sapiens
gagcucauuaaaguaggaccua

SEQ ID NO: 164250 - RNA, 22 nt, Homo sapiens
gaggaaguaauuuuaggccugu

SEQ ID NO: 164251 - RNA, 22 nt, Homo sapiens
gaggaaguagcuacugucuuuc

SEQ ID NO: 164252 - RNA, 22 nt, Homo sapiens
gaggagauauucugcuggaugg

SEQ ID NO: 164253 - RNA, 22 nt, Homo sapiens
gaggcagucugucccuuagcag

SEQ ID NO: 164254 - RNA, 22 nt, Homo sapiens
gaggcauugaaauauugcuuau

SEQ ID NO: 164255 - RNA, 22 nt, Homo sapiens
gagguaagagaauaaacaguuu

SEQ ID NO: 164256 - RNA, 22 nt, Homo sapiens
gagguaggggccuuaaagaugc

SEQ ID NO: 164257 - RNA, 22 nt, Homo sapiens
gagguagguacaauugccacca

SEQ ID NO: 164258 - RNA, 22 nt, Homo sapiens
gaggucaugucgggccccagga

SEQ ID NO: 164259 - RNA, 22 nt, Homo sapiens
gagguggugguggaggcauagc

SEQ ID NO: 164260 - RNA, 22 nt, Homo sapiens
gaguauguauaugagugugucu

SEQ ID NO: 164261 - RNA, 22 nt, Homo sapiens
gagugcauugguggucaggugu

SEQ ID NO: 164262 - RNA, 22 nt, Homo sapiens
gaguucauuuugaaaccuugau

SEQ ID NO: 164263 - RNA, 22 nt, Homo sapiens
gaguuuguacuaauuuguugua

SEQ ID NO: 164264 - RNA, 22 nt, Homo sapiens
gauaaagauagcaauagggaca

SEQ ID NO: 164265 - RNA, 22 nt, Homo sapiens
gauagguucuaagcagguguug

SEQ ID NO: 164266 - RNA, 22 nt, Homo sapiens
gauauguugaguagaguuuuug

SEQ ID NO: 164267 - RNA, 22 nt, Homo sapiens
gaucacauuguuucauacauau

SEQ ID NO: 164268 - RNA, 22 nt, Homo sapiens
gaugagaucauaaguguggagc

SEQ ID NO: 164269 - RNA, 23 nt, Homo sapiens
cacugggcagcagguguucccag

SEQ ID NO: 164270 - RNA, 22 nt, Homo sapiens
cacuggguuagaacaugcuccu

SEQ ID NO: 164271 - RNA, 22 nt, Homo sapiens
cacuggucagugaaacaguauu

SEQ ID NO: 164272 - RNA, 22 nt, Homo sapiens
cacuuugguucaccugaguuuc

SEQ ID NO: 164273 - RNA, 22 nt, Homo sapiens
cagagaucaugcaacugcucgc

SEQ ID NO: 164274 - RNA, 22 nt, Homo sapiens
cagagcacuaaagguaaaaggc

SEQ ID NO: 164275 - RNA, 22 nt, Homo sapiens
cagagugcauguuuagaugagu

SEQ ID NO: 164276 - RNA, 22 nt, Homo sapiens
cagauacuggaguccugaaguu

SEQ ID NO: 164277 - RNA, 22 nt, Homo sapiens
cagcccguaaucccagcacuuu

SEQ ID NO: 164278 - RNA, 22 nt, Homo sapiens
cagccggguggcuccuagggua

SEQ ID NO: 164279 - RNA, 22 nt, Homo sapiens
cagcgaggucugcgucacauug

SEQ ID NO: 164280 - RNA, 22 nt, Homo sapiens
cagcugaugucgaaugcacucu

SEQ ID NO: 164281 - RNA, 22 nt, Homo sapiens
caggaccucuugccuggaagcc

SEQ ID NO: 164282 - RNA, 22 nt, Homo sapiens
caggcaaggugaaguguacugg

SEQ ID NO: 164283 - RNA, 22 nt, Homo sapiens
caggcagucuggcucccaagug

SEQ ID NO: 164284 - RNA, 20 nt, Homo sapiens
cagggcaaugaggagguaaa

SEQ ID NO: 164285 - RNA, 22 nt, Homo sapiens
cagggcauuggcugguaccugg

SEQ ID NO: 164286 - RNA, 20 nt, Homo sapiens
cagucauagacaucagaguc

SEQ ID NO: 164287 - RNA, 22 nt, Homo sapiens
cagugcaaagccucugcccaga

SEQ ID NO: 164288 - RNA, 20 nt, Homo sapiens
cagugcaccuggcguguuga

SEQ ID NO: 164289 - RNA, 22 nt, Homo sapiens
cagugcuuguuauuguucuauu

SEQ ID NO: 164290 - RNA, 22 nt, Homo sapiens
caguggacuaaauggggaauau

SEQ ID NO: 164291 - RNA, 22 nt, Homo sapiens
caguggauuggauggauaaugc

SEQ ID NO: 164292 - RNA, 22 nt, Homo sapiens
cagugucugcauuuggaacuca

SEQ ID NO: 164293 - RNA, 22 nt, Homo sapiens
caguucaugguaggcaccauag

SEQ ID NO: 164294 - RNA, 22 nt, Homo sapiens
cauaaugcuaagagcugccccu

SEQ ID NO: 164295 - RNA, 22 nt, Homo sapiens
caucaaaguggagggaaggacc

SEQ ID NO: 164296 - RNA, 22 nt, Homo sapiens
caucacaguacuaaucgucaua

SEQ ID NO: 164297 - RNA, 22 nt, Homo sapiens
caucccauucgaggggcacagc

SEQ ID NO: 164298 - RNA, 22 nt, Homo sapiens
caucccugucgucaagucucug

SEQ ID NO: 164299 - RNA, 22 nt, Homo sapiens
caugccauugcucuccugggug

SEQ ID NO: 164300 - RNA, 22 nt, Homo sapiens
cauggcacaucuuuucugacua

SEQ ID NO: 164301 - RNA, 22 nt, Homo sapiens
cauggcccuggguccauaggaa

SEQ ID NO: 164302 - RNA, 22 nt, Homo sapiens
cauggcucuuguuuacucccag

SEQ ID NO: 164303 - RNA, 22 nt, Homo sapiens
cauggguuuucucaaguaguca

SEQ ID NO: 164304 - RNA, 21 nt, Homo sapiens
caugucacugcacucuagccu

SEQ ID NO: 164305 - RNA, 22 nt, Homo sapiens
caugugcaugagcacauacgug

SEQ ID NO: 164306 - RNA, 22 nt, Homo sapiens
cauuccacauguaggacaauuu

SEQ ID NO: 164307 - RNA, 22 nt, Homo sapiens
cauugcacacauuuaccuaugu

SEQ ID NO: 164308 - RNA, 22 nt, Homo sapiens
cauugcacuccagccugcugac

SEQ ID NO: 164309 - RNA, 22 nt, Homo sapiens
cauugcacuccagcucugggcg

SEQ ID NO: 164310 - RNA, 22 nt, Homo sapiens
cauugcacuccagcuugggcga

SEQ ID NO: 164311 - RNA, 22 nt, Homo sapiens
cauugcacuccaucuugggcaa

SEQ ID NO: 164312 - RNA, 22 nt, Homo sapiens
cauugcuaaaagucauauauaa

SEQ ID NO: 164313 - RNA, 22 nt, Homo sapiens
cauugguuaguuaacuuuaaga

SEQ ID NO: 164314 - RNA, 22 nt, Homo sapiens
cauuuuacuuuccagacgugga

SEQ ID NO: 164315 - RNA, 22 nt, Homo sapiens
ccaagccucaguuucccucugu

SEQ ID NO: 164316 - RNA, 22 nt, Homo sapiens
ccaaggcacugauucuguacuc

SEQ ID NO: 164317 - RNA, 22 nt, Homo sapiens
ccacagucuaugcaacaagguc

SEQ ID NO: 164318 - RNA, 22 nt, Homo sapiens
ccacaguggauuaaaguuacug

SEQ ID NO: 164319 - RNA, 22 nt, Homo sapiens
ccacccuuccauucuuccucuu

SEQ ID NO: 164320 - RNA, 22 nt, Homo sapiens
ccagaguugccucagguuucug

SEQ ID NO: 164321 - RNA, 22 nt, Homo sapiens
ccagauguuuucauucagcaag

SEQ ID NO: 164322 - RNA, 22 nt, Homo sapiens
ccagcaccauuuauuaaauagg

SEQ ID NO: 164323 - RNA, 22 nt, Homo sapiens
ccaucacaggccucagugggaa

SEQ ID NO: 164324 - RNA, 22 nt, Homo sapiens
ccaucccuuucugagcaguucc

SEQ ID NO: 164325 - RNA, 21 nt, Homo sapiens
ccauggcaaugguaaacugac

SEQ ID NO: 164326 - RNA, 21 nt, Homo sapiens
cccagguucucugaggguaga

SEQ ID NO: 164327 - RNA, 22 nt, Homo sapiens
cccagugugaacuuggcauuuu

SEQ ID NO: 164328 - RNA, 22 nt, Homo sapiens
cccagugugcugggugacagcu

SEQ ID NO: 164329 - RNA, 22 nt, Homo sapiens
cccaguguuacgugacagccug

SEQ ID NO: 164330 - RNA, 22 nt, Homo sapiens
ccccagugguugcaacagcaga

SEQ ID NO: 164331 - RNA, 22 nt, Homo sapiens
ccccauguucucucugcagcuc

SEQ ID NO: 164332 - RNA, 22 nt, Homo sapiens
ccccauuugaacuccuucaacu

SEQ ID NO: 164333 - RNA, 22 nt, Homo sapiens
ccccuguaucucagcgucuuca

SEQ ID NO: 164334 - RNA, 22 nt, Homo sapiens
cccuagaucucagcgccuucau

SEQ ID NO: 164335 - RNA, 22 nt, Homo sapiens
cccugaagaaagccuaggacau

SEQ ID NO: 164336 - RNA, 22 nt, Homo sapiens
cccugaagauacagaguuuggg

SEQ ID NO: 164337 - RNA, 22 nt, Homo sapiens
cccugagcagccugaguuuccc

SEQ ID NO: 164338 - RNA, 22 nt, Homo sapiens
ccucauggagaacuucugcuag

SEQ ID NO: 164339 - RNA, 22 nt, Homo sapiens
ccugguguuuugauggucgggu

SEQ ID NO: 164340 - RNA, 22 nt, Homo sapiens
ccugucuugauuaaauuacuua

SEQ ID NO: 164341 - RNA, 22 nt, Homo sapiens
cggcaguggguaagccaagcuu

SEQ ID NO: 164342 - RNA, 18 nt, Homo sapiens
cuaagacacuuggcagag

SEQ ID NO: 164343 - RNA, 17 nt, Homo sapiens
cuaaggcaagagucugc

SEQ ID NO: 164344 - RNA, 22 nt, Homo sapiens
cuaagugaacugucacugagaa

SEQ ID NO: 164345 - RNA, 22 nt, Homo sapiens
cuacagcacugagcugugugca

SEQ ID NO: 164346 - RNA, 23 nt, Homo sapiens
cuacagugccugucucuuuggcc

SEQ ID NO: 164347 - RNA, 22 nt, Homo sapiens
cuacaguguauuuauggagggu

SEQ ID NO: 164348 - RNA, 22 nt, Homo sapiens
cuacugcacaucaucugaguua

SEQ ID NO: 164349 - RNA, 22 nt, Homo sapiens
cuagaacuagaacugcuggggu

SEQ ID NO: 164350 - RNA, 22 nt, Homo sapiens
cuagagagaagcugugugaccu

SEQ ID NO: 164351 - RNA, 22 nt, Homo sapiens
cuagcagaacaauacaauucgg

SEQ ID NO: 164352 - RNA, 22 nt, Homo sapiens
gaugauguuugauaaauaauaa

SEQ ID NO: 164353 - RNA, 22 nt, Homo sapiens
gaugcaguaagaaugcauagcg

SEQ ID NO: 164354 - RNA, 22 nt, Homo sapiens
gaugguuuucaccugcaugcuu

SEQ ID NO: 164355 - RNA, 22 nt, Homo sapiens
gauuagaacagaagucagauua

SEQ ID NO: 164356 - RNA, 22 nt, Homo sapiens
gauuccacuuucaaauucaaau

SEQ ID NO: 164357 - RNA, 22 nt, Homo sapiens
gauuugguguucuggcucaaga

SEQ ID NO: 164358 - RNA, 21 nt, Homo sapiens
gcaaacauccuuugaugccag

SEQ ID NO: 164359 - RNA, 22 nt, Homo sapiens
gcaaagaaugcagauuugccuc

SEQ ID NO: 164360 - RNA, 22 nt, Homo sapiens
gcaaaguaauuguuguuuuugc

SEQ ID NO: 164361 - RNA, 21 nt, Homo sapiens
gcaaaguggcuaccuugcucc

SEQ ID NO: 164362 - RNA, 22 nt, Homo sapiens
gcaagaauggaacaggagagcc

SEQ ID NO: 164363 - RNA, 22 nt, Homo sapiens
gcaagacaugucuaagguuuaa

SEQ ID NO: 164364 - RNA, 22 nt, Homo sapiens
gcaagaguauuucaaggaagau

SEQ ID NO: 164365 - RNA, 22 nt, Homo sapiens
gcacauggccacuaggaauaaa

SEQ ID NO: 164366 - RNA, 22 nt, Homo sapiens
gcacgcauuguccuucuaguca

SEQ ID NO: 164367 - RNA, 22 nt, Homo sapiens
gcacgugcacccacaugcacgu

SEQ ID NO: 164368 - RNA, 22 nt, Homo sapiens
gcagcagugcccuggauggaaa

SEQ ID NO: 164369 - RNA, 22 nt, Homo sapiens
gcagcagugugggcugaaccua

SEQ ID NO: 164370 - RNA, 22 nt, Homo sapiens
gcaggaauuucucugcagaccc

SEQ ID NO: 164371 - RNA, 22 nt, Homo sapiens
gcaguguucugggcaggaagaa

SEQ ID NO: 164372 - RNA, 22 nt, Homo sapiens
gcaugaugaauaauaucacaag

SEQ ID NO: 164373 - RNA, 22 nt, Homo sapiens
gcaugcacaugugaaaaaauga

SEQ ID NO: 164374 - RNA, 22 nt, Homo sapiens
gcauggagaaggggacugauuc

SEQ ID NO: 164375 - RNA, 22 nt, Homo sapiens
gcaugguacuggaugguaguau

SEQ ID NO: 164376 - RNA, 22 nt, Homo sapiens
gccaguauuuuauugagaauuu

SEQ ID NO: 164377 - RNA, 22 nt, Homo sapiens
gccagugugaugugaucauggc

SEQ ID NO: 164378 - RNA, 22 nt, Homo sapiens
gccaguguguguuguucuccgc

SEQ ID NO: 164379 - RNA, 22 nt, Homo sapiens
gccaguguuuuauugagaauuu

SEQ ID NO: 164380 - RNA, 22 nt, Homo sapiens
gccauugcacucuagccuaggu

SEQ ID NO: 164381 - RNA, 22 nt, Homo sapiens
gcccugagauucuuggauucug

SEQ ID NO: 164382 - RNA, 22 nt, Homo sapiens
gcccuguguuuggguaugguca

SEQ ID NO: 164383 - RNA, 22 nt, Homo sapiens
gccuagauccaaauauggugca

SEQ ID NO: 164384 - RNA, 22 nt, Homo sapiens
gcuaggagaucugcugcucucu

SEQ ID NO: 164385 - RNA, 22 nt, Homo sapiens
gcucaugggcagugugauuguu

SEQ ID NO: 164386 - RNA, 22 nt, Homo sapiens
gcucguccccuccugacucugc

SEQ ID NO: 164387 - RNA, 22 nt, Homo sapiens
gcugaaauguuuaauuugggag

SEQ ID NO: 164388 - RNA, 22 nt, Homo sapiens
gcuggugacuuuaaguugaagc

SEQ ID NO: 164389 - RNA, 22 nt, Homo sapiens
gcugugauucuguguagauagu

SEQ ID NO: 164390 - RNA, 20 nt, Homo sapiens
gcugugcuuaauacacuuuc

SEQ ID NO: 164391 - RNA, 22 nt, Homo sapiens
gcuuuggauaaaugucaguuua

SEQ ID NO: 164392 - RNA, 19 nt, Homo sapiens
gcuuuguggggaaggagcc

SEQ ID NO: 164393 - RNA, 22 nt, Homo sapiens
ggaaaucaucauucucgguaua

SEQ ID NO: 164394 - RNA, 22 nt, Homo sapiens
ggaagccuggaaaaaauuguga

SEQ ID NO: 164395 - RNA, 22 nt, Homo sapiens
ggaaugggauuugaagucuggc

SEQ ID NO: 164396 - RNA, 22 nt, Homo sapiens
ggaauguuaaggcgcuguuggu

SEQ ID NO: 164397 - RNA, 20 nt, Homo sapiens
ggaauguuaaucuccaugau

SEQ ID NO: 164398 - RNA, 22 nt, Homo sapiens
ggaauuaaggcaauugaaagcu

SEQ ID NO: 164399 - RNA, 22 nt, Homo sapiens
ggacagugaaugccacuccucc

SEQ ID NO: 164400 - RNA, 22 nt, Homo sapiens
ggacuaggagcuaggaagaucu

SEQ ID NO: 164401 - RNA, 22 nt, Homo sapiens
ggacuagggacauggggagcug

SEQ ID NO: 164402 - RNA, 22 nt, Homo sapiens
ggagaucuuguuaaaguacaga

SEQ ID NO: 164403 - RNA, 22 nt, Homo sapiens
ggagguaauaaguuccagugua

SEQ ID NO: 164404 - RNA, 22 nt, Homo sapiens
ggaguaggaaggaaauguuaaa

SEQ ID NO: 164405 - RNA, 22 nt, Homo sapiens
ggagucugauguucuaaggcag

SEQ ID NO: 164406 - RNA, 22 nt, Homo sapiens
ggagugucagaaacaguguccu

SEQ ID NO: 164407 - RNA, 22 nt, Homo sapiens
ggcaaagagacaugcaucgggg

SEQ ID NO: 164408 - RNA, 22 nt, Homo sapiens
ggcaagaagaacuauaacuuuu

SEQ ID NO: 164409 - RNA, 20 nt, Homo sapiens
ggcaagacccaaagugugug

SEQ ID NO: 164410 - RNA, 22 nt, Homo sapiens
ggcaagauagauaucaguguca

SEQ ID NO: 164411 - RNA, 22 nt, Homo sapiens
ggcaagcucaggccucaggugu

SEQ ID NO: 164412 - RNA, 22 nt, Homo sapiens
ggcaaggauguuuuucuggcaa

SEQ ID NO: 164413 - RNA, 20 nt, Homo sapiens
ggcaagguagcauuucuucu

SEQ ID NO: 164414 - RNA, 22 nt, Homo sapiens
uaugucuuuugcuugcaaauag

SEQ ID NO: 164415 - RNA, 22 nt, Homo sapiens
uauguuaucaaaaagcuaagga

SEQ ID NO: 164416 - RNA, 22 nt, Homo sapiens
uauuaguuuucuguggauuaca

SEQ ID NO: 164417 - RNA, 22 nt, Homo sapiens
uauuccacaauaugauuuuuaa

SEQ ID NO: 164418 - RNA, 22 nt, Homo sapiens
uauuccacuuacaugagguauc

SEQ ID NO: 164419 - RNA, 22 nt, Homo sapiens
uauugacauuacagugggucuu

SEQ ID NO: 164420 - RNA, 22 nt, Homo sapiens
uauugcauuugagguugguuga

SEQ ID NO: 164421 - RNA, 22 nt, Homo sapiens
uauugccugucuccaaaaauca

SEQ ID NO: 164422 - RNA, 22 nt, Homo sapiens
uauugcuuaugaugcugaauua

SEQ ID NO: 164423 - RNA, 18 nt, Homo sapiens
uauugcuugguuuggaga

SEQ ID NO: 164424 - RNA, 22 nt, Homo sapiens
uauugcuuuuaacccaaucucu

SEQ ID NO: 164425 - RNA, 22 nt, Homo sapiens
uauuguuaaagauguuaaugau

SEQ ID NO: 164426 - RNA, 22 nt, Homo sapiens
uauuguuuuucccaggagucua

SEQ ID NO: 164427 - RNA, 22 nt, Homo sapiens
aaaagcauucagagugcugggc

SEQ ID NO: 164428 - RNA, 22 nt, Homo sapiens
aaaagcuuagaugggcuuguau

SEQ ID NO: 164429 - RNA, 22 nt, Homo sapiens
aaaaugcugauauugggcccca

SEQ ID NO: 164430 - RNA, 18 nt, Homo sapiens
aaacagugucucuuucug

SEQ ID NO: 164431 - RNA, 22 nt, Homo sapiens
aaacauugaccucauccuggca

SEQ ID NO: 164432 - RNA, 22 nt, Homo sapiens
aaacugccuuccuuguaggugc

SEQ ID NO: 164433 - RNA, 22 nt, Homo sapiens
aaacugucuucugacaguuucc

SEQ ID NO: 164434 - RNA, 22 nt, Homo sapiens
aaagaagucagccuguccuuug

SEQ ID NO: 164435 - RNA, 22 nt, Homo sapiens
aaagagaucuaugggcacuaug

SEQ ID NO: 164436 - RNA, 22 nt, Homo sapiens
aaaggcacugaucuuauccagu

SEQ ID NO: 164437 - RNA, 22 nt, Homo sapiens
aaaggcaucugcucggcucccu

SEQ ID NO: 164438 - RNA, 22 nt, Homo sapiens
aaagggcacugugcuuuggcaa

SEQ ID NO: 164439 - RNA, 22 nt, Homo sapiens
aaagggcuugaauacucuuuuu

SEQ ID NO: 164440 - RNA, 22 nt, Homo sapiens
aaagugauguccaggcuuucag

SEQ ID NO: 164441 - RNA, 22 nt, Homo sapiens
aaagugcaguauuugggcagaa

SEQ ID NO: 164442 - RNA, 22 nt, Homo sapiens
aaagugcaguauuugggcagga

SEQ ID NO: 164443 - RNA, 22 nt, Homo sapiens
aaagugcuuacuaaguugccaa

SEQ ID NO: 164444 - RNA, 22 nt, Homo sapiens
aaagugcuucucuuuggugggu

SEQ ID NO: 164445 - RNA, 22 nt, Homo sapiens
aaaguggacuaagugaauauga

SEQ ID NO: 164446 - RNA, 22 nt, Homo sapiens
aaaguggugggauuccaggcau

SEQ ID NO: 164447 - RNA, 22 nt, Homo sapiens
aaaguucuugcugaaggauuau

SEQ ID NO: 164448 - RNA, 22 nt, Homo sapiens
aaaugcacaaagauuuugcacu

SEQ ID NO: 164449 - RNA, 21 nt, Homo sapiens
aaaugcacauuacugcuggug

SEQ ID NO: 164450 - RNA, 22 nt, Homo sapiens
aaaugcaguugguggggauaug

SEQ ID NO: 164451 - RNA, 22 nt, Homo sapiens
aaaugcucuuuaugaaguugga

SEQ ID NO: 164452 - RNA, 22 nt, Homo sapiens
aaauggcuuugaggguaggaca

SEQ ID NO: 164453 - RNA, 22 nt, Homo sapiens
aaaugguguuaguagaucuuua

SEQ ID NO: 164454 - RNA, 22 nt, Homo sapiens
aaaugucauggaguguuucccc

SEQ ID NO: 164455 - RNA, 22 nt, Homo sapiens
uuccauuuguucggugucgcca

SEQ ID NO: 164456 - RNA, 22 nt, Homo sapiens
uucccaguaaacucuaucccuc

SEQ ID NO: 164457 - RNA, 22 nt, Homo sapiens
uucccagucaaacgaaggacuu

SEQ ID NO: 164458 - RNA, 22 nt, Homo sapiens
uucccaguuggggaaagcgacc

SEQ ID NO: 164459 - RNA, 22 nt, Homo sapiens
uucccuagaacacauggaggga

SEQ ID NO: 164460 - RNA, 22 nt, Homo sapiens
uucccugagcaucuguugagcc

SEQ ID NO: 164461 - RNA, 22 nt, Homo sapiens
uucccuuucugccuugaaucuu

SEQ ID NO: 164462 - RNA, 22 nt, Homo sapiens
aacaguaucuaacgagugauga

SEQ ID NO: 164463 - RNA, 22 nt, Homo sapiens
aacagucuccaguuguauccau

SEQ ID NO: 164464 - RNA, 22 nt, Homo sapiens
aacagugccugucauuuaguag

SEQ ID NO: 164465 - RNA, 21 nt, Homo sapiens
aacagugcugaacagacaccu

SEQ ID NO: 164466 - RNA, 21 nt, Homo sapiens
aacagugcuuaguagauguuc

SEQ ID NO: 164467 - RNA, 22 nt, Homo sapiens
aacccugagucaugagucuaga

SEQ ID NO: 164468 - RNA, 22 nt, Homo sapiens
aaccuucauuccuuucccugcc

SEQ ID NO: 164469 - RNA, 22 nt, Homo sapiens
aacuggcacuacaucaagagcu

SEQ ID NO: 164470 - RNA, 22 nt, Homo sapiens
aagaggccuaggaaucuguauu

SEQ ID NO: 164471 - RNA, 22 nt, Homo sapiens
aagaguuaguaaaauuuccucu

SEQ ID NO: 164472 - RNA, 19 nt, Homo sapiens
aagaugauguuugggcuaa

SEQ ID NO: 164473 - RNA, 22 nt, Homo sapiens
aagaugcagaagcccagauguu

SEQ ID NO: 164474 - RNA, 22 nt, Homo sapiens
aagcaucacauaauggaucaug

SEQ ID NO: 164475 - RNA, 20 nt, Homo sapiens
aagcauggguuuuaggguca

SEQ ID NO: 164476 - RNA, 22 nt, Homo sapiens
aagcuccauuucugccaugaga

SEQ ID NO: 164477 - RNA, 20 nt, Homo sapiens
aagcugaguguuuuuuuaau

SEQ ID NO: 164478 - RNA, 22 nt, Homo sapiens
aagcugccaggcaugguggcug

SEQ ID NO: 164479 - RNA, 22 nt, Homo sapiens
aagcuggauuuaguguggagca

SEQ ID NO: 164480 - RNA, 22 nt, Homo sapiens
aagcuggcuuucauugagugcu

SEQ ID NO: 164481 - RNA, 22 nt, Homo sapiens
aagcugugucuugucagcuacc

SEQ ID NO: 164482 - RNA, 22 nt, Homo sapiens
aaggaaguaauuugguuuauag

SEQ ID NO: 164483 - RNA, 22 nt, Homo sapiens
aaggaguagacaacauggcgcc

SEQ ID NO: 164484 - RNA, 22 nt, Homo sapiens
aaggcacugaacuuaaauucug

SEQ ID NO: 164485 - RNA, 22 nt, Homo sapiens
aaggcucuuucaacguaaauua

SEQ ID NO: 164486 - RNA, 22 nt, Homo sapiens
aaggcuguucauuuagcacagu

SEQ ID NO: 164487 - RNA, 23 nt, Homo sapiens
aagguaagcuagaaagauguaga

SEQ ID NO: 164488 - RNA, 22 nt, Homo sapiens
aagguagguuccaaaauaccua

SEQ ID NO: 164489 - RNA, 22 nt, Homo sapiens
aaguagugcuugugcucaucuc

SEQ ID NO: 164490 - RNA, 22 nt, Homo sapiens
aaguaguuaggaacauucucuc

SEQ ID NO: 164491 - RNA, 22 nt, Homo sapiens
aaguauagcuaugauaaacauu

SEQ ID NO: 164492 - RNA, 22 nt, Homo sapiens
aaguaucaggaauaguuauugg

SEQ ID NO: 164493 - RNA, 23 nt, Homo sapiens
aagucauggaaucaaaugaggug

SEQ ID NO: 164494 - RNA, 22 nt, Homo sapiens
aagucauggaggaguaugugag

SEQ ID NO: 164495 - RNA, 22 nt, Homo sapiens
aagugacauugugcccauuuga

SEQ ID NO: 164496 - RNA, 22 nt, Homo sapiens
aagugaccuaacaaugaaggcc

SEQ ID NO: 164497 - RNA, 22 nt, Homo sapiens
aagugcuggccuacucaaucga

SEQ ID NO: 164498 - RNA, 22 nt, Homo sapiens
aagugcuuaggauagugugugg

SEQ ID NO: 164499 - RNA, 22 nt, Homo sapiens
aagugcuucagaagacaauauu

SEQ ID NO: 164500 - RNA, 22 nt, Homo sapiens
aagugcuuccuuucagaggguu

SEQ ID NO: 164501 - RNA, 22 nt, Homo sapiens
aaguggcauugaggaaaaaaau

SEQ ID NO: 164502 - RNA, 22 nt, Homo sapiens
aagugguucuaugaguuugcaa

SEQ ID NO: 164503 - RNA, 22 nt, Homo sapiens
aaguguaugaaacaguccaugg

SEQ ID NO: 164504 - RNA, 21 nt, Homo sapiens
aauaaagcaaccuuaugccau

SEQ ID NO: 164505 - RNA, 22 nt, Homo sapiens
aauaaagcaggguccuugcacu

SEQ ID NO: 164506 - RNA, 22 nt, Homo sapiens
aauaaagcugaauccuuccuga

SEQ ID NO: 164507 - RNA, 22 nt, Homo sapiens
aauaaagcuuugagcuuugcug

SEQ ID NO: 164508 - RNA, 22 nt, Homo sapiens
aauaagcauaguaccugauagg

SEQ ID NO: 164509 - RNA, 22 nt, Homo sapiens
aauaaguugagaugaggucaua

SEQ ID NO: 164510 - RNA, 22 nt, Homo sapiens
aauacugaaaguauuuucaaau

SEQ ID NO: 164511 - RNA, 22 nt, Homo sapiens
aauacuuccaaaucuagucauu

SEQ ID NO: 164512 - RNA, 22 nt, Homo sapiens
aauauagcuauguacaugucca

SEQ ID NO: 164513 - RNA, 22 nt, Homo sapiens
aauaucacaguuggguguacac

SEQ ID NO: 164514 - RNA, 22 nt, Homo sapiens
aaucacaguguucuugugaggg

SEQ ID NO: 164515 - RNA, 22 nt, Homo sapiens
aaucacuaugccaugaaguaca

SEQ ID NO: 164516 - RNA, 22 nt, Homo sapiens
aaugacucugccuaaauuucac

SEQ ID NO: 164517 - RNA, 22 nt, Homo sapiens
aaugcacuccagccugggcgac

SEQ ID NO: 164518 - RNA, 22 nt, Homo sapiens
aaugcuguguuauuucaugacc

SEQ ID NO: 164519 - RNA, 19 nt, Homo sapiens
aauggcuuuuccuguuccc

SEQ ID NO: 164520 - RNA, 22 nt, Homo sapiens
aaugucacugugguccuccagu

SEQ ID NO: 164521 - RNA, 22 nt, Homo sapiens
aaugucaucuucaguuguacag

SEQ ID NO: 164522 - RNA, 22 nt, Homo sapiens
aauucacuucuuuuaggcaggg

SEQ ID NO: 164523 - RNA, 22 nt, Homo sapiens
aauucuguauuguuuagggacu

SEQ ID NO: 164524 - RNA, 22 nt, Homo sapiens
aauucugugagauggugcagau

SEQ ID NO: 164525 - RNA, 22 nt, Homo sapiens
acaaagcuagggaauccaucuu

SEQ ID NO: 164526 - RNA, 22 nt, Homo sapiens
acaaaguaggcagugggcugga

SEQ ID NO: 164527 - RNA, 22 nt, Homo sapiens
acaaaguguuuucugaaggccu

SEQ ID NO: 164528 - RNA, 22 nt, Homo sapiens
acaacaguuuuaucaccccaga

SEQ ID NO: 164529 - RNA, 22 nt, Homo sapiens
acaagcacaaaugcauagaugg

SEQ ID NO: 164530 - RNA, 22 nt, Homo sapiens
acacacgugcauguaugcguau

SEQ ID NO: 164531 - RNA, 22 nt, Homo sapiens
acacaguaaauauguauugaau

SEQ ID NO: 164532 - RNA, 22 nt, Homo sapiens
acacaguguuuauugugguuag

SEQ ID NO: 164533 - RNA, 22 nt, Homo sapiens
acaccaguacuuuauacaagca

SEQ ID NO: 164534 - RNA, 22 nt, Homo sapiens
acaccuguggucccaguaacuu

SEQ ID NO: 164535 - RNA, 22 nt, Homo sapiens
acacuggaguuaaaggugauuu

SEQ ID NO: 164536 - RNA, 22 nt, Homo sapiens
acacuguacuuauguuuugcag

SEQ ID NO: 164537 - RNA, 22 nt, Homo sapiens
uuugugcuaacuuuaacucuua

SEQ ID NO: 164538 - RNA, 18 nt, Homo sapiens
uuugugcuccacaaagga

SEQ ID NO: 164539 - RNA, 22 nt, Homo sapiens
uuugugcuccugugagaaucua

SEQ ID NO: 164540 - RNA, 22 nt, Homo sapiens
uuugugcuccuguugagaaucu

SEQ ID NO: 164541 - RNA, 16 nt, Homo sapiens
uuugugugugacgaga

SEQ ID NO: 164542 - RNA, 22 nt, Homo sapiens
uuuguucuucguuccugagcca

SEQ ID NO: 164543 - RNA, 22 nt, Homo sapiens
uuuuaagcuacaagagacauau

SEQ ID NO: 164544 - RNA, 20 nt, Homo sapiens
uuuuagcacuuguuauggug

SEQ ID NO: 164545 - RNA, 22 nt, Homo sapiens
uuuugcaggucaggggcagaga

SEQ ID NO: 164546 - RNA, 22 nt, Homo sapiens
uuuugcuccuggcaaacucaua

SEQ ID NO: 164547 - RNA, 22 nt, Homo sapiens
uuuugcucuucggaagagcuug

SEQ ID NO: 164548 - RNA, 22 nt, Homo sapiens
uuuuggcacuuugucugauucu

SEQ ID NO: 164549 - RNA, 22 nt, Homo sapiens
uuuugguguacaauucuaugga

SEQ ID NO: 164550 - RNA, 22 nt, Homo sapiens
uuuuguacgccuguguccauca

SEQ ID NO: 164551 - RNA, 22 nt, Homo sapiens
acauaaagaagcaggacauugu

SEQ ID NO: 164552 - RNA, 22 nt, Homo sapiens
acauagaguaguggugaggaug

SEQ ID NO: 164553 - RNA, 22 nt, Homo sapiens
acauggcuuaugaauuuggaga

SEQ ID NO: 164554 - RNA, 23 nt, Homo sapiens
acauguauagacuuuuuuuccuu

SEQ ID NO: 164555 - RNA, 22 nt, Homo sapiens
accacaggguaaaguuagauau

SEQ ID NO: 164556 - RNA, 22 nt, Homo sapiens
accaguuuuuuauacaucuucu

SEQ ID NO: 164557 - RNA, 22 nt, Homo sapiens
acccaguagccagauguagcug

SEQ ID NO: 164558 - RNA, 22 nt, Homo sapiens
acccaguagucauucaggagca

SEQ ID NO: 164559 - RNA, 22 nt, Homo sapiens
acccaguguucagacuaccugu

SEQ ID NO: 164560 - RNA, 22 nt, Homo sapiens
accccguagagucugcagcuac

SEQ ID NO: 164561 - RNA, 17 nt, Homo sapiens
accccuaccucagaagc

SEQ ID NO: 164562 - RNA, 22 nt, Homo sapiens
acccgcccagguguggccggga

SEQ ID NO: 164563 - RNA, 22 nt, Homo sapiens
acccgugcucacugccucugcc

SEQ ID NO: 164564 - RNA, 22 nt, Homo sapiens
acccguuacuuagcagaccagg

SEQ ID NO: 164565 - RNA, 22 nt, Homo sapiens
acccugcuaaacagcccccugc

SEQ ID NO: 164566 - RNA, 22 nt, Homo sapiens
acccuggaggucuacagugcag

SEQ ID NO: 164567 - RNA, 22 nt, Homo sapiens
acccuguugucagaauguggau

SEQ ID NO: 164568 - RNA, 22 nt, Homo sapiens
accuguagcagacuuaauauuu

SEQ ID NO: 164569 - RNA, 22 nt, Homo sapiens
acuacugucagacugccacuga

SEQ ID NO: 164570 - RNA, 22 nt, Homo sapiens
acucacagcaaccuccgccucc

SEQ ID NO: 164571 - RNA, 18 nt, Homo sapiens
acucuguauguggagugg

SEQ ID NO: 164572 - RNA, 22 nt, Homo sapiens
acugcaaugucgaauagagaug

SEQ ID NO: 164573 - RNA, 22 nt, Homo sapiens
acugcacuccacccuuggcagc

SEQ ID NO: 164574 - RNA, 22 nt, Homo sapiens
acugcacuccagccucggugac

SEQ ID NO: 164575 - RNA, 22 nt, Homo sapiens
acugcacuccagccugaugaaa

SEQ ID NO: 164576 - RNA, 22 nt, Homo sapiens
acugcacuccagccugcuggca

SEQ ID NO: 164577 - RNA, 22 nt, Homo sapiens
acugcacuccagccuucaggac

SEQ ID NO: 164578 - RNA, 22 nt, Homo sapiens
acugcacuccagcuuuggugac

SEQ ID NO: 164579 - RNA, 22 nt, Homo sapiens
acugcacucuagcuugggugac

SEQ ID NO: 164580 - RNA, 20 nt, Homo sapiens
acugcacuucagccugcugg

SEQ ID NO: 164581 - RNA, 22 nt, Homo sapiens
acugcacuucagccuugugaca

SEQ ID NO: 164582 - RNA, 22 nt, Homo sapiens
acugcauaaauauguguaauau

SEQ ID NO: 164583 - RNA, 22 nt, Homo sapiens
acuggcauagggcgggcacagu

SEQ ID NO: 164584 - RNA, 20 nt, Homo sapiens
acugggcuaccgaaguaagg

SEQ ID NO: 164585 - RNA, 22 nt, Homo sapiens
acugggucaaaguagaaaacua

SEQ ID NO: 164586 - RNA, 22 nt, Homo sapiens
acugguguaugggaggucccaa

SEQ ID NO: 164587 - RNA, 22 nt, Homo sapiens
acuuugguuaucauacuuucag

SEQ ID NO: 164588 - RNA, 22 nt, Homo sapiens
acuuuuugcaaccauuuggacc

SEQ ID NO: 164589 - RNA, 21 nt, Homo sapiens
agaaaaucuuaugggaaacau

SEQ ID NO: 164590 - RNA, 22 nt, Homo sapiens
agacacugaaauguauugaaga

SEQ ID NO: 164591 - RNA, 22 nt, Homo sapiens
agacagcugggaaauggagugu

SEQ ID NO: 164592 - RNA, 22 nt, Homo sapiens
agacagcugguagcacuuccug

SEQ ID NO: 164593 - RNA, 22 nt, Homo sapiens
agacucauuuccauagucagcu

SEQ ID NO: 164594 - RNA, 21 nt, Homo sapiens
agagaacugaaacaugugacu

SEQ ID NO: 164595 - RNA, 22 nt, Homo sapiens
agagaacugauuggaguugggc

SEQ ID NO: 164596 - RNA, 22 nt, Homo sapiens
agagaucaacugaauuacugga

SEQ ID NO: 164597 - RNA, 22 nt, Homo sapiens
agagcaaugacaugcuaugugg

SEQ ID NO: 164598 - RNA, 22 nt, Homo sapiens
agagcuaguauuuacggagcau

SEQ ID NO: 164599 - RNA, 22 nt, Homo sapiens
agagguauacauuugagagcca

SEQ ID NO: 164600 - RNA, 22 nt, Homo sapiens
agaggucuuaucaaacaugcuu

SEQ ID NO: 164601 - RNA, 22 nt, Homo sapiens
agagguuuugcacugguucuuu

SEQ ID NO: 164602 - RNA, 22 nt, Homo sapiens
agaguacugacguuugcaaauu

SEQ ID NO: 164603 - RNA, 23 nt, Homo sapiens
agagugcaauggugccaucucgg

SEQ ID NO: 164604 - RNA, 22 nt, Homo sapiens
agauauuuguuaggucugucag

SEQ ID NO: 164605 - RNA, 22 nt, Homo sapiens
agaugccuaugaagagaaauua

SEQ ID NO: 164606 - RNA, 22 nt, Homo sapiens
agaugcuguuaucaacuguagc

SEQ ID NO: 164607 - RNA, 22 nt, Homo sapiens
agauguuguucaucugauuguu

SEQ ID NO: 164608 - RNA, 22 nt, Homo sapiens
agcaagauuguucccauuuucu

SEQ ID NO: 164609 - RNA, 22 nt, Homo sapiens
agcacagccuuguguuuucuug

SEQ ID NO: 164610 - RNA, 22 nt, Homo sapiens
agcaccauuguacuccagccug

SEQ ID NO: 164611 - RNA, 22 nt, Homo sapiens
agcaccauuuauugaaaagaca

SEQ ID NO: 164612 - RNA, 22 nt, Homo sapiens
agcagauguuuagugagcgccu

SEQ ID NO: 164613 - RNA, 22 nt, Homo sapiens
agcagcacaucccuuucuggcc

SEQ ID NO: 164614 - RNA, 22 nt, Homo sapiens
agcagcaucgggaaguuggcca

SEQ ID NO: 164615 - RNA, 22 nt, Homo sapiens
agcagcauuaguggaaucuugu

SEQ ID NO: 164616 - RNA, 22 nt, Homo sapiens
agcagcauuccaaaaaucugcu

SEQ ID NO: 164617 - RNA, 22 nt, Homo sapiens
agcagugucauuuucuggugag

SEQ ID NO: 164618 - RNA, 22 nt, Homo sapiens
agcaguguggccuuagacccgg

SEQ ID NO: 164619 - RNA, 22 nt, Homo sapiens
agccaguauuuccacagagugg

SEQ ID NO: 164620 - RNA, 22 nt, Homo sapiens
agcgccacugcacuccagccug

SEQ ID NO: 164621 - RNA, 22 nt, Homo sapiens
agcgccauugcacuccagccuu

SEQ ID NO: 164622 - RNA, 22 nt, Homo sapiens
agcuaguguucaccagagguca

SEQ ID NO: 164623 - RNA, 21 nt, Homo sapiens
ggcaagaaacacaaucaagua

SEQ ID NO: 164624 - RNA, 22 nt, Homo sapiens
ggcaagaaccagggauuugcgu

SEQ ID NO: 164625 - RNA, 22 nt, Homo sapiens
ggcaagaggagauucugcuccc

SEQ ID NO: 164626 - RNA, 22 nt, Homo sapiens
ggcaccacagacgccaggcgug

SEQ ID NO: 164627 - RNA, 22 nt, Homo sapiens
ggcagcaugggugccuuuguga

SEQ ID NO: 164628 - RNA, 22 nt, Homo sapiens
ggcaguuuguucuugcuccuuu

SEQ ID NO: 164629 - RNA, 22 nt, Homo sapiens
ggcaugguggugugugccuaua

SEQ ID NO: 164630 - RNA, 22 nt, Homo sapiens
ggcccaguugcgggugguaccg

SEQ ID NO: 164631 - RNA, 22 nt, Homo sapiens
ggcuagagaauagugccacuaa

SEQ ID NO: 164632 - RNA, 22 nt, Homo sapiens
ggcuagagagcucagggauaug

SEQ ID NO: 164633 - RNA, 22 nt, Homo sapiens
ggcucagugggguccugguucu

SEQ ID NO: 164634 - RNA, 22 nt, Homo sapiens
gggaagugugguuucuuuacag

SEQ ID NO: 164635 - RNA, 22 nt, Homo sapiens
gggagcaaaaaugaugcccaag

SEQ ID NO: 164636 - RNA, 19 nt, Homo sapiens
gggaggaugcgucuucagg

SEQ ID NO: 164637 - RNA, 22 nt, Homo sapiens
gggagugugcacacaugguaua

SEQ ID NO: 164638 - RNA, 22 nt, Homo sapiens
gggaucaacuuauacuaaaauu

SEQ ID NO: 164639 - RNA, 18 nt, Homo sapiens
gggcaaguugccuggcuu

SEQ ID NO: 164640 - RNA, 22 nt, Homo sapiens
gggcagaugucuggacaccuca

SEQ ID NO: 164641 - RNA, 22 nt, Homo sapiens
gggcaugauggugcacacaugu

SEQ ID NO: 164642 - RNA, 20 nt, Homo sapiens
gugagaacaugugguauuug

SEQ ID NO: 164643 - RNA, 22 nt, Homo sapiens
gugagauacuagagauauagug

SEQ ID NO: 164644 - RNA, 22 nt, Homo sapiens
gugagauccucucuuauauggg

SEQ ID NO: 164645 - RNA, 22 nt, Homo sapiens
gugagaugaggucucacucugu

SEQ ID NO: 164646 - RNA, 22 nt, Homo sapiens
gugagaugguaucucauugugg

SEQ ID NO: 164647 - RNA, 22 nt, Homo sapiens
gugagaugugacuucugccucu

SEQ ID NO: 164648 - RNA, 22 nt, Homo sapiens
gugagcaguguccuugggggca

SEQ ID NO: 164649 - RNA, 22 nt, Homo sapiens
gugagcauaggaggcuucuguu

SEQ ID NO: 164650 - RNA, 22 nt, Homo sapiens
gugagcauauuaguauugcacu

SEQ ID NO: 164651 - RNA, 22 nt, Homo sapiens
gugaggaaggaaaccugcuagc

SEQ ID NO: 164652 - RNA, 22 nt, Homo sapiens
gugaggcacugcugcuuuccag

SEQ ID NO: 164653 - RNA, 22 nt, Homo sapiens
gugaggcugguccugccuccca

SEQ ID NO: 164654 - RNA, 22 nt, Homo sapiens
gugagggagcuggaauauuuau

SEQ ID NO: 164655 - RNA, 22 nt, Homo sapiens
gugagguagagcaugugaaaga

SEQ ID NO: 164656 - RNA, 22 nt, Homo sapiens
gugagucaaucugagggguuca

SEQ ID NO: 164657 - RNA, 22 nt, Homo sapiens
gugauguguuucaacagcuccu

SEQ ID NO: 164658 - RNA, 22 nt, Homo sapiens
gugauuauuaugcacugcaugc

SEQ ID NO: 164659 - RNA, 22 nt, Homo sapiens
gugauugucuaaucaagauaca

SEQ ID NO: 164660 - RNA, 22 nt, Homo sapiens
uggcauguagucugggaccugg

SEQ ID NO: 164661 - RNA, 22 nt, Homo sapiens
uggcaugucguuuuucauagga

SEQ ID NO: 164662 - RNA, 22 nt, Homo sapiens
uggcaugugugaagugcccagc

SEQ ID NO: 164663 - RNA, 22 nt, Homo sapiens
uggcauuuucucuguucuuaga

SEQ ID NO: 164664 - RNA, 22 nt, Homo sapiens
uggccaagagcacagauauugg

SEQ ID NO: 164665 - RNA, 23 nt, Homo sapiens
uggccaagauaaucucaguuuuc

SEQ ID NO: 164666 - RNA, 22 nt, Homo sapiens
uggcgagaugcucgugugcaga

SEQ ID NO: 164667 - RNA, 22 nt, Homo sapiens
uggcuagaugagauguacugca

SEQ ID NO: 164668 - RNA, 21 nt, Homo sapiens
uggcuauuucuguggcauaca

SEQ ID NO: 164669 - RNA, 22 nt, Homo sapiens
uggcuguguccucucccaaauc

SEQ ID NO: 164670 - RNA, 22 nt, Homo sapiens
uggcuguuuauuucacgugggu

SEQ ID NO: 164671 - RNA, 22 nt, Homo sapiens
ugggaacaugaagguuaaagag

SEQ ID NO: 164672 - RNA, 20 nt, Homo sapiens
ugggaacaugugguauaugg

SEQ ID NO: 164673 - RNA, 22 nt, Homo sapiens
ugggaagagggagcgauuuugg

SEQ ID NO: 164674 - RNA, 22 nt, Homo sapiens
ugggcaaaacuaagagcugugg

SEQ ID NO: 164675 - RNA, 22 nt, Homo sapiens
ugggcaaauugugagggaggua

SEQ ID NO: 164676 - RNA, 22 nt, Homo sapiens
ugggcaagagagcaugacccug

SEQ ID NO: 164677 - RNA, 22 nt, Homo sapiens
ugggcaagugacuuggcuucuc

SEQ ID NO: 164678 - RNA, 22 nt, Homo sapiens
ugggguaggcuguauacucugu

SEQ ID NO: 164679 - RNA, 22 nt, Homo sapiens
uggguagagaaucaggaucuua

SEQ ID NO: 164680 - RNA, 22 nt, Homo sapiens
uggguaggaccagaaaugcacu

SEQ ID NO: 164681 - RNA, 22 nt, Homo sapiens
uggguaguuuuucagcucuugc

SEQ ID NO: 164682 - RNA, 22 nt, Homo sapiens
uggguccccuacucuuuccaca

SEQ ID NO: 164683 - RNA, 22 nt, Homo sapiens
ugggugaguaucuauuauucag

SEQ ID NO: 164684 - RNA, 23 nt, Homo sapiens
uggguucauucuugaagucagug

SEQ ID NO: 164685 - RNA, 22 nt, Homo sapiens
ugguaagaggcccugaguuugu

SEQ ID NO: 164686 - RNA, 22 nt, Homo sapiens
ugguaauguaauuuggagaagg

SEQ ID NO: 164687 - RNA, 22 nt, Homo sapiens
ugguacuucaugcucacagaua

SEQ ID NO: 164688 - RNA, 22 nt, Homo sapiens
ugguauguauacuagcgacacu

SEQ ID NO: 164689 - RNA, 22 nt, Homo sapiens
ugguauguaugauuaacaugga

SEQ ID NO: 164690 - RNA, 22 nt, Homo sapiens
ugguaugucuagauggggaagu

SEQ ID NO: 164691 - RNA, 22 nt, Homo sapiens
ugguaugucuuucuuccuguag

SEQ ID NO: 164692 - RNA, 22 nt, Homo sapiens
ugguauguugucucuuuguucu

SEQ ID NO: 164693 - RNA, 19 nt, Homo sapiens
uggucaguucugggagcug

SEQ ID NO: 164694 - RNA, 21 nt, Homo sapiens
uggucccauaagauuauaaug

SEQ ID NO: 164695 - RNA, 21 nt, Homo sapiens
uggucccuucagaucggauuu

SEQ ID NO: 164696 - RNA, 22 nt, Homo sapiens
ugguccucugcuuccagaauuc

SEQ ID NO: 164697 - RNA, 22 nt, Homo sapiens
uggugagaaaagaugucuuugu

SEQ ID NO: 164698 - RNA, 22 nt, Homo sapiens
uggugcaaauguaauugugguu

SEQ ID NO: 164699 - RNA, 22 nt, Homo sapiens
uggugccgugguccuggggcca

SEQ ID NO: 164700 - RNA, 19 nt, Homo sapiens
uggugccuuguucuuggau

SEQ ID NO: 164701 - RNA, 22 nt, Homo sapiens
uggugcuuaaauaaggcuuuca

SEQ ID NO: 164702 - RNA, 17 nt, Homo sapiens
uggugcuugaaaguugc

SEQ ID NO: 164703 - RNA, 15 nt, Homo sapiens
uggugguguugagac

SEQ ID NO: 164704 - RNA, 23 nt, Homo sapiens
ugguuuguaagagauggacugga

SEQ ID NO: 164705 - RNA, 22 nt, Homo sapiens
uguaaacauguauguguuuaug

SEQ ID NO: 164706 - RNA, 22 nt, Homo sapiens
uguaaacuaugagcugauuauu

SEQ ID NO: 164707 - RNA, 20 nt, Homo sapiens
uguacacaguguacccacau

SEQ ID NO: 164708 - RNA, 22 nt, Homo sapiens
uguagacaccaaagacagcaua

SEQ ID NO: 164709 - RNA, 21 nt, Homo sapiens
uguagcagcaugauucauagu

SEQ ID NO: 164710 - RNA, 22 nt, Homo sapiens
uguagcagccauaaacacagug

SEQ ID NO: 164711 - RNA, 22 nt, Homo sapiens
uguauauguuuguacauauguc

SEQ ID NO: 164712 - RNA, 22 nt, Homo sapiens
uguauguuguaagacuuagacc

SEQ ID NO: 164713 - RNA, 22 nt, Homo sapiens
ugucaaagagacaucugcacuc

SEQ ID NO: 164714 - RNA, 22 nt, Homo sapiens
ugucaacauuuaucaaguuauu

SEQ ID NO: 164715 - RNA, 22 nt, Homo sapiens
ugucaagaugguuugauguugu

SEQ ID NO: 164716 - RNA, 22 nt, Homo sapiens
ugucacaguuuguacuuuauag

SEQ ID NO: 164717 - RNA, 22 nt, Homo sapiens
ugucacugugcagucaugcauu

SEQ ID NO: 164718 - RNA, 22 nt, Homo sapiens
ugucaggaguuuuagaaucuua

SEQ ID NO: 164719 - RNA, 22 nt, Homo sapiens
ugucaguggacugugaaaggca

SEQ ID NO: 164720 - RNA, 22 nt, Homo sapiens
ugucauacaguaacaugguugg

SEQ ID NO: 164721 - RNA, 22 nt, Homo sapiens
ugucaugguagcaaggacgagg

SEQ ID NO: 164722 - RNA, 22 nt, Homo sapiens
ugucauguugguguacugcacc

SEQ ID NO: 164723 - RNA, 16 nt, Homo sapiens
uguccaaauaaauaca

SEQ ID NO: 164724 - RNA, 22 nt, Homo sapiens
ugucccaguuggguauugaauu

SEQ ID NO: 164725 - RNA, 18 nt, Homo sapiens
ugucccuuugcuguucau

SEQ ID NO: 164726 - RNA, 22 nt, Homo sapiens
uguccuggugaugcccaaauuc

SEQ ID NO: 164727 - RNA, 22 nt, Homo sapiens
ugucuuugguucaggcaaggag

SEQ ID NO: 164728 - RNA, 22 nt, Homo sapiens
ugugaacagcagcugggcuuug

SEQ ID NO: 164729 - RNA, 23 nt, Homo sapiens
ugugacacuuccgucaguucauu

SEQ ID NO: 164730 - RNA, 19 nt, Homo sapiens
ugugacugggccagccuag

SEQ ID NO: 164731 - RNA, 22 nt, Homo sapiens
ugugagaaaugcagaaucucag

SEQ ID NO: 164732 - RNA, 22 nt, Homo sapiens
ugugcaaauguuaaacuaacuu

SEQ ID NO: 164733 - RNA, 22 nt, Homo sapiens
ugugcaaggcucucaaccugug

SEQ ID NO: 164734 - RNA, 22 nt, Homo sapiens
ugugcacaacaugcagguuugu

SEQ ID NO: 164735 - RNA, 22 nt, Homo sapiens
ugugcacaaccugcagguuugu

SEQ ID NO: 164736 - RNA, 22 nt, Homo sapiens
ugugcacaaugugcagguuugu

SEQ ID NO: 164737 - RNA, 22 nt, Homo sapiens
ugugcacauaacauuuuuuuag

SEQ ID NO: 164738 - RNA, 23 nt, Homo sapiens
ugugcacauuuacauauauacac

SEQ ID NO: 164739 - RNA, 22 nt, Homo sapiens
ugugcauagugugugcggggcg

SEQ ID NO: 164740 - RNA, 22 nt, Homo sapiens
ugugcauauaaguguguauaua

SEQ ID NO: 164741 - RNA, 22 nt, Homo sapiens
ugugccacuccaaccuggguga

SEQ ID NO: 164742 - RNA, 22 nt, Homo sapiens
ugugccacugcacuccugggug

SEQ ID NO: 164743 - RNA, 19 nt, Homo sapiens
uguggucauccugggacga

SEQ ID NO: 164744 - RNA, 22 nt, Homo sapiens
uguguaaagcuuguuccagaaa

SEQ ID NO: 164745 - RNA, 22 nt, Homo sapiens
ugugucuacugagaugaucaug

SEQ ID NO: 164746 - RNA, 22 nt, Homo sapiens
uguuacacugugcacuaaauuu

SEQ ID NO: 164747 - RNA, 22 nt, Homo sapiens
uguuacagcagaauugauugca

SEQ ID NO: 164748 - RNA, 22 nt, Homo sapiens
uguuaugaagaugccugguaca

SEQ ID NO: 164749 - RNA, 22 nt, Homo sapiens
uguucacaguguuucuuugaga

SEQ ID NO: 164750 - RNA, 22 nt, Homo sapiens
uguugcacacacugaaauacac

SEQ ID NO: 164751 - RNA, 19 nt, Homo sapiens
uguugcacauaucaauaug

SEQ ID NO: 164752 - RNA, 22 nt, Homo sapiens
uguugcacuccagccuggguga

SEQ ID NO: 164753 - RNA, 22 nt, Homo sapiens
uguugcauuugucaaggucaag

SEQ ID NO: 164754 - RNA, 22 nt, Homo sapiens
uguuggacuuacuuggcagauu

SEQ ID NO: 164755 - RNA, 22 nt, Homo sapiens
uguuuaguuaagacauagaauu

SEQ ID NO: 164756 - RNA, 22 nt, Homo sapiens
uguuuuggaguggacuuugcau

SEQ ID NO: 164757 - RNA, 22 nt, Homo sapiens
uuaagacaccaaucauuggauu

SEQ ID NO: 164758 - RNA, 23 nt, Homo sapiens
uuaagcaacggcugcuuuucaga

SEQ ID NO: 164759 - RNA, 19 nt, Homo sapiens
uuaagugugauaucucagu

SEQ ID NO: 164760 - RNA, 22 nt, Homo sapiens
uuaaucugucuaugauuuuggu

SEQ ID NO: 164761 - RNA, 21 nt, Homo sapiens
uuacaauggcuccuugaaggu

SEQ ID NO: 164762 - RNA, 22 nt, Homo sapiens
uuacagcugcuccccaucacuc

SEQ ID NO: 164763 - RNA, 22 nt, Homo sapiens
uuacaguaugaguaagaguucu

SEQ ID NO: 164764 - RNA, 22 nt, Homo sapiens
uuacaguauugcaaggacuagg

SEQ ID NO: 164765 - RNA, 22 nt, Homo sapiens
uuacaguggugaccuuguauug

SEQ ID NO: 164766 - RNA, 22 nt, Homo sapiens
uuacagugguugcuauugugaa

SEQ ID NO: 164767 - RNA, 22 nt, Homo sapiens
uuacaucaucacauuaguuugc

SEQ ID NO: 164768 - RNA, 22 nt, Homo sapiens
uuacauguggugugaagaagag

SEQ ID NO: 164769 - RNA, 22 nt, Homo sapiens
uuacccuuugcauuaccaacaa

SEQ ID NO: 164770 - RNA, 22 nt, Homo sapiens
uuacuauguuucaaagugucuc

SEQ ID NO: 164771 - RNA, 22 nt, Homo sapiens
uuacuguagugucauaucguau

SEQ ID NO: 164772 - RNA, 22 nt, Homo sapiens
uuagacaguggugcacugcacu

SEQ ID NO: 164773 - RNA, 22 nt, Homo sapiens
uuagacucauuuuggucaagga

SEQ ID NO: 164774 - RNA, 22 nt, Homo sapiens
uuagcaauugauucucauaagc

SEQ ID NO: 164775 - RNA, 22 nt, Homo sapiens
uuagcagcaugagaauggacua

SEQ ID NO: 164776 - RNA, 20 nt, Homo sapiens
uuagcagcaugauuuauaau

SEQ ID NO: 164777 - RNA, 22 nt, Homo sapiens
uuagcucaguuggugagagcgu

SEQ ID NO: 164778 - RNA, 22 nt, Homo sapiens
uuaguagcacagaguaucagca

SEQ ID NO: 164779 - RNA, 22 nt, Homo sapiens
uuauacacugugggaguguaaa

SEQ ID NO: 164780 - RNA, 22 nt, Homo sapiens
uuauauguuuguacuuaggccu

SEQ ID NO: 164781 - RNA, 22 nt, Homo sapiens
uuaugucuuugagcaaugcugu

SEQ ID NO: 164782 - RNA, 22 nt, Homo sapiens
uuauuagagauauuugguuagg

SEQ ID NO: 164783 - RNA, 22 nt, Homo sapiens
uuauugcuuaugauuagguguu

SEQ ID NO: 164784 - RNA, 22 nt, Homo sapiens
uucaaaggauuuagauuagcua

SEQ ID NO: 164785 - RNA, 22 nt, Homo sapiens
uucaaaguaaagggauggagac

SEQ ID NO: 164786 - RNA, 22 nt, Homo sapiens
uucaaaguguugguuuugggcu

SEQ ID NO: 164787 - RNA, 23 nt, Homo sapiens
uucaaauguucucugguugucag

SEQ ID NO: 164788 - RNA, 22 nt, Homo sapiens
uucaagaauuaaaguggcuuuu

SEQ ID NO: 164789 - RNA, 22 nt, Homo sapiens
uucaagucaauuuuugaaugac

SEQ ID NO: 164790 - RNA, 20 nt, Homo sapiens
uucaagugauucucaugccu

SEQ ID NO: 164791 - RNA, 22 nt, Homo sapiens
uucaagugguucagaagucuga

SEQ ID NO: 164792 - RNA, 22 nt, Homo sapiens
uucaauaugucauuggcaggca

SEQ ID NO: 164793 - RNA, 22 nt, Homo sapiens
uucacacuagccacucugguag

SEQ ID NO: 164794 - RNA, 22 nt, Homo sapiens
uucacacugggccuacucugug

SEQ ID NO: 164795 - RNA, 22 nt, Homo sapiens
uucacagcuuaauaaggcucag

SEQ ID NO: 164796 - RNA, 22 nt, Homo sapiens
uucacagucacccuucuccaug

SEQ ID NO: 164797 - RNA, 22 nt, Homo sapiens
uucacagugugaucuaugggca

SEQ ID NO: 164798 - RNA, 16 nt, Homo sapiens
uucacauggcagcagg

SEQ ID NO: 164799 - RNA, 22 nt, Homo sapiens
uucacugugcuuaaauucugcu

SEQ ID NO: 164800 - RNA, 22 nt, Homo sapiens
uucagaguggacagaaauuaag

SEQ ID NO: 164801 - RNA, 22 nt, Homo sapiens
uucagcacaguguggaucauuc

SEQ ID NO: 164802 - RNA, 22 nt, Homo sapiens
uucaguaguaaguuggaacucu

SEQ ID NO: 164803 - RNA, 22 nt, Homo sapiens
uucaguggacuuaguagugcuu

SEQ ID NO: 164804 - RNA, 22 nt, Homo sapiens
uucaguggguggaugaauauga

SEQ ID NO: 164805 - RNA, 22 nt, Homo sapiens
uucagugucauuaacacaguag

SEQ ID NO: 164806 - RNA, 22 nt, Homo sapiens
uucauaguauuuuucuccaaau

SEQ ID NO: 164807 - RNA, 22 nt, Homo sapiens
uucauagugaaaaauucaaagu

SEQ ID NO: 164808 - RNA, 22 nt, Homo sapiens
uucaucaguuauauuggccuga

SEQ ID NO: 164809 - RNA, 22 nt, Homo sapiens
uucauccccuccaaaucucaug

SEQ ID NO: 164810 - RNA, 22 nt, Homo sapiens
uucauggaugcauuugaggggu

SEQ ID NO: 164811 - RNA, 22 nt, Homo sapiens
uucauguaaucaaggcagcuaa

SEQ ID NO: 164812 - RNA, 22 nt, Homo sapiens
uucauugaaugauuuuuagaag

SEQ ID NO: 164813 - RNA, 23 nt, Homo sapiens
uuccaccauugacuaguuacaua

SEQ ID NO: 164814 - RNA, 22 nt, Homo sapiens
uuccagaugggaguucuauucu

SEQ ID NO: 164815 - RNA, 22 nt, Homo sapiens
uuccaggugggcgugggccugg

SEQ ID NO: 164816 - RNA, 22 nt, Homo sapiens
uucccagagaaaaggguuucuu

SEQ ID NO: 164817 - RNA, 22 nt, Homo sapiens
uucccagugccaggcacuggga

SEQ ID NO: 164818 - RNA, 22 nt, Homo sapiens
uucccauuguuggccagcaugu

SEQ ID NO: 164819 - RNA, 20 nt, Homo sapiens
uucccucagccuugagggua

SEQ ID NO: 164820 - RNA, 22 nt, Homo sapiens
uucccugugggcuggugcucca

SEQ ID NO: 164821 - RNA, 22 nt, Homo sapiens
uucccuuucuuaaagaguuagg

SEQ ID NO: 164822 - RNA, 22 nt, Homo sapiens
uucccuuuuuucuaguagguag

SEQ ID NO: 164823 - RNA, 22 nt, Homo sapiens
uuccuacuguucaucaggaacc

SEQ ID NO: 164824 - RNA, 22 nt, Homo sapiens
uuccuugagaaaguacaaggcu

SEQ ID NO: 164825 - RNA, 22 nt, Homo sapiens
uucuagcaauggcagagugucu

SEQ ID NO: 164826 - RNA, 20 nt, Homo sapiens
uucuaguacuucuguuucca

SEQ ID NO: 164827 - RNA, 22 nt, Homo sapiens
uucuauguuguuagacccacca

SEQ ID NO: 164828 - RNA, 22 nt, Homo sapiens
uucuauugguaauauuuucugu

SEQ ID NO: 164829 - RNA, 22 nt, Homo sapiens
uucucaaggagccuucguaacu

SEQ ID NO: 164830 - RNA, 22 nt, Homo sapiens
ugagguuauuuguucaagaagu

SEQ ID NO: 164831 - RNA, 22 nt, Homo sapiens
ugagguugaaggacauuuuuau

SEQ ID NO: 164832 - RNA, 22 nt, Homo sapiens
ugagguuggggucagggcuagc

SEQ ID NO: 164833 - RNA, 22 nt, Homo sapiens
augagaugaggaauggcccucc

SEQ ID NO: 164834 - RNA, 22 nt, Homo sapiens
augagcagaugcuccugccucu

SEQ ID NO: 164835 - RNA, 20 nt, Homo sapiens
augagcucaucuugaaaacc

SEQ ID NO: 164836 - RNA, 22 nt, Homo sapiens
augaggagguaugauuuucuga

SEQ ID NO: 164837 - RNA, 22 nt, Homo sapiens
augaggcacugcgcccuacuga

SEQ ID NO: 164838 - RNA, 22 nt, Homo sapiens
augagggaagcucacgugucca

SEQ ID NO: 164839 - RNA, 22 nt, Homo sapiens
augaggugcagaggaaaugagu

SEQ ID NO: 164840 - RNA, 19 nt, Homo sapiens
augaguuaggggaaauuuc

SEQ ID NO: 164841 - RNA, 22 nt, Homo sapiens
augauauggucacccuuaugaa

SEQ ID NO: 164842 - RNA, 22 nt, Homo sapiens
augauauguuuguagcuaucuc

SEQ ID NO: 164843 - RNA, 22 nt, Homo sapiens
augaucacugugccuccuguga

SEQ ID NO: 164844 - RNA, 22 nt, Homo sapiens
augaugcaguacuuugggaaca

SEQ ID NO: 164845 - RNA, 22 nt, Homo sapiens
augauggaggccgugauggacg

SEQ ID NO: 164846 - RNA, 22 nt, Homo sapiens
augauguaggccauggguuucu

SEQ ID NO: 164847 - RNA, 22 nt, Homo sapiens
augauguccacagggguguuca

SEQ ID NO: 164848 - RNA, 22 nt, Homo sapiens
augcaaacaucugaagagacau

SEQ ID NO: 164849 - RNA, 22 nt, Homo sapiens
augcacaugcgaaaacuugugu

SEQ ID NO: 164850 - RNA, 22 nt, Homo sapiens
augcacauggcuaacuuuuuuc

SEQ ID NO: 164851 - RNA, 19 nt, Homo sapiens
augcacgugaaaugcauuu

SEQ ID NO: 164852 - RNA, 22 nt, Homo sapiens
augcauggucugaagucaaccu

SEQ ID NO: 164853 - RNA, 22 nt, Homo sapiens
augcaugucaaauuuguagguu

SEQ ID NO: 164854 - RNA, 22 nt, Homo sapiens
augccaagagacaaagggaauc

SEQ ID NO: 164855 - RNA, 19 nt, Homo sapiens
augccacagugaggucaga

SEQ ID NO: 164856 - RNA, 22 nt, Homo sapiens
augccacuucucuaagucaugu

SEQ ID NO: 164857 - RNA, 22 nt, Homo sapiens
augccaguguccagaguggguu

SEQ ID NO: 164858 - RNA, 19 nt, Homo sapiens
augccuggagaugguuaua

SEQ ID NO: 164859 - RNA, 22 nt, Homo sapiens
augcuacauucuacaauuaggc

SEQ ID NO: 164860 - RNA, 22 nt, Homo sapiens
augcuacugaccccuacuuaca

SEQ ID NO: 164861 - RNA, 19 nt, Homo sapiens
augcugguguugcucaaac

SEQ ID NO: 164862 - RNA, 22 nt, Homo sapiens
augcuuguguuggggcagugga

SEQ ID NO: 164863 - RNA, 22 nt, Homo sapiens
auggaacauaacuauuugggga

SEQ ID NO: 164864 - RNA, 22 nt, Homo sapiens
auggaagucucuguuaaguuuc

SEQ ID NO: 164865 - RNA, 21 nt, Homo sapiens
auggacaugguuaggcuuugu

SEQ ID NO: 164866 - RNA, 22 nt, Homo sapiens
auggagagaauuauucucucag

SEQ ID NO: 164867 - RNA, 22 nt, Homo sapiens
auggaucauauucuugaggagg

SEQ ID NO: 164868 - RNA, 22 nt, Homo sapiens
auggaucuuucugcuuuugaau

SEQ ID NO: 164869 - RNA, 22 nt, Homo sapiens
auggcaaaaaaugcaauuacuu

SEQ ID NO: 164870 - RNA, 22 nt, Homo sapiens
auggcaauaauagcuaccauuu

SEQ ID NO: 164871 - RNA, 22 nt, Homo sapiens
auggcacagacucuuggucaag

SEQ ID NO: 164872 - RNA, 22 nt, Homo sapiens
auggcacuaaugggaguuuacu

SEQ ID NO: 164873 - RNA, 22 nt, Homo sapiens
auggcacugccuggcuucaugg

SEQ ID NO: 164874 - RNA, 22 nt, Homo sapiens
auggcacuuuggacugcuagau

SEQ ID NO: 164875 - RNA, 22 nt, Homo sapiens
auggcagaaucaagccgacagc

SEQ ID NO: 164876 - RNA, 22 nt, Homo sapiens
auggcaguguaugauuauauua

SEQ ID NO: 164877 - RNA, 22 nt, Homo sapiens
auggcagugucuagggguguuu

SEQ ID NO: 164878 - RNA, 22 nt, Homo sapiens
auggcaguuucagcuauaguuu

SEQ ID NO: 164879 - RNA, 22 nt, Homo sapiens
auggcaguuuggucucugugcu

SEQ ID NO: 164880 - RNA, 22 nt, Homo sapiens
auggcccugggaaaggaggcau

SEQ ID NO: 164881 - RNA, 22 nt, Homo sapiens
auggcccuguguggagcugcug

SEQ ID NO: 164882 - RNA, 22 nt, Homo sapiens
auggcuguuccugggaguucua

SEQ ID NO: 164883 - RNA, 22 nt, Homo sapiens
auggcuguuucugcaaugucua

SEQ ID NO: 164884 - RNA, 22 nt, Homo sapiens
auggcuucuuacucuucugcau

SEQ ID NO: 164885 - RNA, 22 nt, Homo sapiens
auggcuuugggcugcucugccc

SEQ ID NO: 164886 - RNA, 22 nt, Homo sapiens
auggcuuuggucucccagugau

SEQ ID NO: 164887 - RNA, 22 nt, Homo sapiens
auggcuuuuauuguguugaggu

SEQ ID NO: 164888 - RNA, 22 nt, Homo sapiens
auggcuuuuccugucuugcaug

SEQ ID NO: 164889 - RNA, 22 nt, Homo sapiens
auggcuuuugaccugguaggau

SEQ ID NO: 164890 - RNA, 22 nt, Homo sapiens
auggcuuuugcccuaaauggau

SEQ ID NO: 164891 - RNA, 22 nt, Homo sapiens
augggagugugguuagagaccu

SEQ ID NO: 164892 - RNA, 22 nt, Homo sapiens
augggcacugauguauucugug

SEQ ID NO: 164893 - RNA, 22 nt, Homo sapiens
augggguaggcuugcuguagua

SEQ ID NO: 164894 - RNA, 22 nt, Homo sapiens
augggguagguagcucggggaa

SEQ ID NO: 164895 - RNA, 22 nt, Homo sapiens
augggugaguaugaguugacuu

SEQ ID NO: 164896 - RNA, 22 nt, Homo sapiens
augguagacucucgggucaugg

SEQ ID NO: 164897 - RNA, 21 nt, Homo sapiens
auggugagaaaguagugucaa

SEQ ID NO: 164898 - RNA, 22 nt, Homo sapiens
augguuugugcuccuauaagaa

SEQ ID NO: 164899 - RNA, 22 nt, Homo sapiens
auguagauaucaagaggcauau

SEQ ID NO: 164900 - RNA, 22 nt, Homo sapiens
augucaacauagacaguagagu

SEQ ID NO: 164901 - RNA, 20 nt, Homo sapiens
augucaggaagggagucagg

SEQ ID NO: 164902 - RNA, 22 nt, Homo sapiens
augucauagaagccugugaacc

SEQ ID NO: 164903 - RNA, 22 nt, Homo sapiens
augucauagauaaggaagugga

SEQ ID NO: 164904 - RNA, 22 nt, Homo sapiens
augucuggcagaagacuucuca

SEQ ID NO: 164905 - RNA, 22 nt, Homo sapiens
augugacugauggagaauaugu

SEQ ID NO: 164906 - RNA, 22 nt, Homo sapiens
augugaugguuaauuuuaugug

SEQ ID NO: 164907 - RNA, 22 nt, Homo sapiens
augugcaacugcuggaacaguc

SEQ ID NO: 164908 - RNA, 18 nt, Homo sapiens
augugcaauuuuguauuu

SEQ ID NO: 164909 - RNA, 22 nt, Homo sapiens
augugcacauucugguaaauau

SEQ ID NO: 164910 - RNA, 22 nt, Homo sapiens
auguggcuuuccuagaucuuag

SEQ ID NO: 164911 - RNA, 22 nt, Homo sapiens
augugugcuugauguaaaaagu

SEQ ID NO: 164912 - RNA, 22 nt, Homo sapiens
auguuauguucuucucuguaua

SEQ ID NO: 164913 - RNA, 22 nt, Homo sapiens
auuaaauguuggacguauacau

SEQ ID NO: 164914 - RNA, 22 nt, Homo sapiens
auuaaguugugccugaaaacuu

SEQ ID NO: 164915 - RNA, 22 nt, Homo sapiens
auuauaugucaucacagacacc

SEQ ID NO: 164916 - RNA, 22 nt, Homo sapiens
auucaucagggauauugguuga

SEQ ID NO: 164917 - RNA, 22 nt, Homo sapiens
caugacacuggcauguuucuuu

SEQ ID NO: 164918 - RNA, 22 nt, Homo sapiens
caugauauugcagaauguuggu

SEQ ID NO: 164919 - RNA, 22 nt, Homo sapiens
caugaugcuagguauggaugaa

SEQ ID NO: 164920 - RNA, 22 nt, Homo sapiens
caugccacuguggacaaagaca

SEQ ID NO: 164921 - RNA, 22 nt, Homo sapiens
cauggcauuugcagaguugaaa

SEQ ID NO: 164922 - RNA, 22 nt, Homo sapiens
cauggcuacugcagauguaggg

SEQ ID NO: 164923 - RNA, 22 nt, Homo sapiens
caugggacugucuuggcuauac

SEQ ID NO: 164924 - RNA, 22 nt, Homo sapiens
cauggucaccuuccaaguuauu

SEQ ID NO: 164925 - RNA, 22 nt, Homo sapiens
cauguauagauuccauaguggu

SEQ ID NO: 164926 - RNA, 22 nt, Homo sapiens
cauuccacuggauaaacaaggu

SEQ ID NO: 164927 - RNA, 22 nt, Homo sapiens
cauugcacuccagccuagccaa

SEQ ID NO: 164928 - RNA, 22 nt, Homo sapiens
cauugcacuccagccugaccaa

SEQ ID NO: 164929 - RNA, 22 nt, Homo sapiens
cauugcacuccagccugaguga

SEQ ID NO: 164930 - RNA, 22 nt, Homo sapiens
cauugcacugcauucugggcaa

SEQ ID NO: 164931 - RNA, 22 nt, Homo sapiens
cauugcacugcuucuugggugu

SEQ ID NO: 164932 - RNA, 20 nt, Homo sapiens
cauugcccuccagccugggc

SEQ ID NO: 164933 - RNA, 22 nt, Homo sapiens
cauuugguggcuacagaguaac

SEQ ID NO: 164934 - RNA, 22 nt, Homo sapiens
ccacacugucuuggugggaaac

SEQ ID NO: 164935 - RNA, 22 nt, Homo sapiens
ccaccuguacuuaagucacuuu

SEQ ID NO: 164936 - RNA, 22 nt, Homo sapiens
ccagccgggugcaguggcucac

SEQ ID NO: 164937 - RNA, 22 nt, Homo sapiens
ccaggguuccacgccuggcugu

SEQ ID NO: 164938 - RNA, 22 nt, Homo sapiens
ccagugauuguauggugaaggu

SEQ ID NO: 164939 - RNA, 18 nt, Homo sapiens
ccagugcaaggaaagccc

SEQ ID NO: 164940 - RNA, 22 nt, Homo sapiens
ccagugguucccuguggccuga

SEQ ID NO: 164941 - RNA, 22 nt, Homo sapiens
ccagugguugggccggagacgg

SEQ ID NO: 164942 - RNA, 22 nt, Homo sapiens
ccaguuuucaagauaaugguuu

SEQ ID NO: 164943 - RNA, 17 nt, Homo sapiens
ccaguuuucccucagug

SEQ ID NO: 164944 - RNA, 22 nt, Homo sapiens
ccaguuuuucauuuauacuagu

SEQ ID NO: 164945 - RNA, 22 nt, Homo sapiens
ccaguuuuuggcaaugaugaau

SEQ ID NO: 164946 - RNA, 22 nt, Homo sapiens
ccaugaacuagaauagaacaug

SEQ ID NO: 164947 - RNA, 19 nt, Homo sapiens
cccagugucagagaagggu

SEQ ID NO: 164948 - RNA, 22 nt, Homo sapiens
ccccuguaaacuggcuucccug

SEQ ID NO: 164949 - RNA, 22 nt, Homo sapiens
cccugacauucggagauguagu

SEQ ID NO: 164950 - RNA, 19 nt, Homo sapiens
cccuggcacauggaaaaug

SEQ ID NO: 164951 - RNA, 22 nt, Homo sapiens
cccuguguuuagcugaagguuu

SEQ ID NO: 164952 - RNA, 22 nt, Homo sapiens
cccuuagacuacuaauaugagc

SEQ ID NO: 164953 - RNA, 22 nt, Homo sapiens
ccucauggagaacaucugcuag

SEQ ID NO: 164954 - RNA, 22 nt, Homo sapiens
ccucccuuuguugcaagggaaa

SEQ ID NO: 164955 - RNA, 22 nt, Homo sapiens
ccucuguaguccugcaagagga

SEQ ID NO: 164956 - RNA, 21 nt, Homo sapiens
ccucuuugagggaagaaaggg

SEQ ID NO: 164957 - RNA, 22 nt, Homo sapiens
ccucuuuguugagacuucacca

SEQ ID NO: 164958 - RNA, 21 nt, Homo sapiens
ccugaagaagugaccucugag

SEQ ID NO: 164959 - RNA, 22 nt, Homo sapiens
ccugagacgaauggagugaaca

SEQ ID NO: 164960 - RNA, 22 nt, Homo sapiens
ccugagacugauugacucacaa

SEQ ID NO: 164961 - RNA, 22 nt, Homo sapiens
ccugagaucauacuguuaguaa

SEQ ID NO: 164962 - RNA, 22 nt, Homo sapiens
ccugucuugaagagauccuccu

SEQ ID NO: 164963 - RNA, 22 nt, Homo sapiens
ccuugguggccacaagacauug

SEQ ID NO: 164964 - RNA, 22 nt, Homo sapiens
cggugcaaauguaauugcaguu

SEQ ID NO: 164965 - RNA, 22 nt, Homo sapiens
cuaaagugcuuaaaaucucauu

SEQ ID NO: 164966 - RNA, 22 nt, Homo sapiens
cuaacacagggcaagucaggcu

SEQ ID NO: 164967 - RNA, 22 nt, Homo sapiens
cuaagcaccuuaguggggaauc

SEQ ID NO: 164968 - RNA, 22 nt, Homo sapiens
cuaauccugugguagcacucaa

SEQ ID NO: 164969 - RNA, 22 nt, Homo sapiens
cuaauucuguaccuggcacaua

SEQ ID NO: 164970 - RNA, 22 nt, Homo sapiens
cuacagguaugaaagggaguau

SEQ ID NO: 164971 - RNA, 22 nt, Homo sapiens
cuacaguagagaggauguagaa

SEQ ID NO: 164972 - RNA, 22 nt, Homo sapiens
cuagaguguaguuuucuuagga

SEQ ID NO: 164973 - RNA, 22 nt, Homo sapiens
cuagcagacaugggcugaacca

SEQ ID NO: 164974 - RNA, 22 nt, Homo sapiens
cuaggcuguagagaaguucagu

SEQ ID NO: 164975 - RNA, 22 nt, Homo sapiens
cuaugcauuuuggaggagggaa

SEQ ID NO: 164976 - RNA, 22 nt, Homo sapiens
cuaugcuucuuaaauuaguuau

SEQ ID NO: 164977 - RNA, 22 nt, Homo sapiens
cuauucacaauggugaagauau

SEQ ID NO: 164978 - RNA, 22 nt, Homo sapiens
cucaaagugcuaagauuaggcu

SEQ ID NO: 164979 - RNA, 19 nt, Homo sapiens
cucaaagugguauuuggag

SEQ ID NO: 164980 - RNA, 18 nt, Homo sapiens
cucacacccuaaucagga

SEQ ID NO: 164981 - RNA, 22 nt, Homo sapiens
cucacugugguguccuuaggua

SEQ ID NO: 164982 - RNA, 22 nt, Homo sapiens
cucagagcacaguuuaugacag

SEQ ID NO: 164983 - RNA, 22 nt, Homo sapiens
cucagcaguggauuuaccacca

SEQ ID NO: 164984 - RNA, 22 nt, Homo sapiens
cucaggguacuucuccuuugcu

SEQ ID NO: 164985 - RNA, 22 nt, Homo sapiens
cucagugguugauuuauuuauc

SEQ ID NO: 164986 - RNA, 22 nt, Homo sapiens
cucaguguuucagcugcucaga

SEQ ID NO: 164987 - RNA, 22 nt, Homo sapiens
cucauggagauagagaauagaa

SEQ ID NO: 164988 - RNA, 22 nt, Homo sapiens
cuccauagucuucgaagaauga

SEQ ID NO: 164989 - RNA, 23 nt, Homo sapiens
cuccaugagccguccagggccug

SEQ ID NO: 164990 - RNA, 22 nt, Homo sapiens
cuccauuuaguccuuuuagaag

SEQ ID NO: 164991 - RNA, 22 nt, Homo sapiens
cucucuguuugucuguuauugg

SEQ ID NO: 164992 - RNA, 22 nt, Homo sapiens
cucugguuaaggcugaacuaua

SEQ ID NO: 164993 - RNA, 22 nt, Homo sapiens
cucuuggguagauuuugcagag

SEQ ID NO: 164994 - RNA, 22 nt, Homo sapiens
cugacaagugaucacagcagca

SEQ ID NO: 164995 - RNA, 17 nt, Homo sapiens
cugaccucauuguguac

SEQ ID NO: 164996 - RNA, 22 nt, Homo sapiens
cugacugaggaucaguucauca

SEQ ID NO: 164997 - RNA, 22 nt, Homo sapiens
cugagagaugagaccucucacu

SEQ ID NO: 164998 - RNA, 22 nt, Homo sapiens
cugagauacacuaauagucucu

SEQ ID NO: 164999 - RNA, 22 nt, Homo sapiens
cugagcaaaaugaagacacgau

SEQ ID NO: 165000 - RNA, 22 nt, Homo sapiens
cugagcaaagaagugauaauga

SEQ ID NO: 165001 - RNA, 22 nt, Homo sapiens
gagaucuuuaagaacuacugcu

SEQ ID NO: 165002 - RNA, 22 nt, Homo sapiens
gagaugaagugucaauaaggau

SEQ ID NO: 165003 - RNA, 22 nt, Homo sapiens
gagcacauguggagagucuggg

SEQ ID NO: 165004 - RNA, 21 nt, Homo sapiens
gagcacauuguccucuaacgc

SEQ ID NO: 165005 - RNA, 22 nt, Homo sapiens
gagcacugaauacugugguggu

SEQ ID NO: 165006 - RNA, 20 nt, Homo sapiens
gagcaucacaggccucugcu

SEQ ID NO: 165007 - RNA, 22 nt, Homo sapiens
gagcuccuccccuuggcuuuca

SEQ ID NO: 165008 - RNA, 22 nt, Homo sapiens
gagcugaauugcugccauuugc

SEQ ID NO: 165009 - RNA, 22 nt, Homo sapiens
gagcuguugguuugaaagaauu

SEQ ID NO: 165010 - RNA, 22 nt, Homo sapiens
gagcuuggguuaaaguugccuu

SEQ ID NO: 165011 - RNA, 22 nt, Homo sapiens
gaggcaauaugagggaggcuuc

SEQ ID NO: 165012 - RNA, 22 nt, Homo sapiens
gaggcaaugugcccggcccaca

SEQ ID NO: 165013 - RNA, 22 nt, Homo sapiens
gaggcagucugacccuuagcag

SEQ ID NO: 165014 - RNA, 22 nt, Homo sapiens
gaggcaguguguccguucucgg

SEQ ID NO: 165015 - RNA, 22 nt, Homo sapiens
gagguaaguaagaauggcaagc

SEQ ID NO: 165016 - RNA, 22 nt, Homo sapiens
gagguagguuugguuacaaaag

SEQ ID NO: 165017 - RNA, 22 nt, Homo sapiens
gagguaugauugacauauaaaa

SEQ ID NO: 165018 - RNA, 22 nt, Homo sapiens
gaggucaggacauuuuugcuuu

SEQ ID NO: 165019 - RNA, 22 nt, Homo sapiens
gagguguagagauauaccugaa

SEQ ID NO: 165020 - RNA, 22 nt, Homo sapiens
gagguuauuggggugcuugugu

SEQ ID NO: 165021 - RNA, 22 nt, Homo sapiens
gaguaaaugucacuguugcugu

SEQ ID NO: 165022 - RNA, 22 nt, Homo sapiens
gagugcaauggcaagaucuugg

SEQ ID NO: 165023 - RNA, 22 nt, Homo sapiens
gaguuacauuguaauugccgag

SEQ ID NO: 165024 - RNA, 22 nt, Homo sapiens
gauaagagaugauuuugccaug

SEQ ID NO: 165025 - RNA, 22 nt, Homo sapiens
gauaauucuagcagauacaggc

SEQ ID NO: 165026 - RNA, 22 nt, Homo sapiens
gaucacaguuccucacgggcau

SEQ ID NO: 165027 - RNA, 22 nt, Homo sapiens
gaucacauggccauuucuagcu

SEQ ID NO: 165028 - RNA, 22 nt, Homo sapiens
gaucacaugggagaaugagagu

SEQ ID NO: 165029 - RNA, 22 nt, Homo sapiens
gaucuggucuuugauuagacac

SEQ ID NO: 165030 - RNA, 19 nt, Homo sapiens
gaucuguugaucaaugugu

SEQ ID NO: 165031 - RNA, 22 nt, Homo sapiens
gaugacagcugacucccuugcu

SEQ ID NO: 165032 - RNA, 22 nt, Homo sapiens
gaugaggcuagagacaugugua

SEQ ID NO: 165033 - RNA, 22 nt, Homo sapiens
gaugccuuuuuguccucaguua

SEQ ID NO: 165034 - RNA, 22 nt, Homo sapiens
gauggaguaauguaaucuugag

SEQ ID NO: 165035 - RNA, 22 nt, Homo sapiens
gauggauuuuaagugaaugaaa

SEQ ID NO: 165036 - RNA, 22 nt, Homo sapiens
gauggcacuaagccauguagga

SEQ ID NO: 165037 - RNA, 22 nt, Homo sapiens
gauggcagugcagccccuggcu

SEQ ID NO: 165038 - RNA, 22 nt, Homo sapiens
gauggguuuuuugaagacagca

SEQ ID NO: 165039 - RNA, 22 nt, Homo sapiens
gauuguguucauaggcauguua

SEQ ID NO: 165040 - RNA, 22 nt, Homo sapiens
gauuuguauuaaaagugugacg

SEQ ID NO: 165041 - RNA, 22 nt, Homo sapiens
gcaagaaugagaaggauuaauu

SEQ ID NO: 165042 - RNA, 21 nt, Homo sapiens
gcaaguacuaucaucauuauc

SEQ ID NO: 165043 - RNA, 22 nt, Homo sapiens
gcaaugcugucugugcacagau

SEQ ID NO: 165044 - RNA, 22 nt, Homo sapiens
gcaccauugacaagaaauaggu

SEQ ID NO: 165045 - RNA, 22 nt, Homo sapiens
gcacugagagaagccccaagua

SEQ ID NO: 165046 - RNA, 22 nt, Homo sapiens
gcagaguauagagggcugggcc

SEQ ID NO: 165047 - RNA, 22 nt, Homo sapiens
gcagcacaugacuguauguaua

SEQ ID NO: 165048 - RNA, 22 nt, Homo sapiens
gcagcaguggcaguuaauauuu

SEQ ID NO: 165049 - RNA, 22 nt, Homo sapiens
gcagcaucaaaucacacaagau

SEQ ID NO: 165050 - RNA, 22 nt, Homo sapiens
gcagcauuaccaagacauggca

SEQ ID NO: 165051 - RNA, 22 nt, Homo sapiens
gcaggcaugacauuucacucuu

SEQ ID NO: 165052 - RNA, 23 nt, Homo sapiens
gcagucauuuggaaaagguugaa

SEQ ID NO: 165053 - RNA, 22 nt, Homo sapiens
gcaguguugugauccaggucuu

SEQ ID NO: 165054 - RNA, 22 nt, Homo sapiens
gcaguucuguaguugaaauuua

SEQ ID NO: 165055 - RNA, 22 nt, Homo sapiens
gcauaugucuuuauagcagcau

SEQ ID NO: 165056 - RNA, 22 nt, Homo sapiens
gcaucacagcuccugugcuggc

SEQ ID NO: 165057 - RNA, 22 nt, Homo sapiens
gcaugacaaugauugcucuuca

SEQ ID NO: 165058 - RNA, 20 nt, Homo sapiens
gcaugagucuuuauaguaga

SEQ ID NO: 165059 - RNA, 22 nt, Homo sapiens
gcaugcacuguauuuaaguauc

SEQ ID NO: 165060 - RNA, 22 nt, Homo sapiens
gcauggauguugauggcugcug

SEQ ID NO: 165061 - RNA, 22 nt, Homo sapiens
gccaaaaugcugggauuacagg

SEQ ID NO: 165062 - RNA, 22 nt, Homo sapiens
gccauugcacuccagccuagcg

SEQ ID NO: 165063 - RNA, 22 nt, Homo sapiens
gccauugcacuccagccuaggu

SEQ ID NO: 165064 - RNA, 22 nt, Homo sapiens
gcccagauguuuggggucaugg

SEQ ID NO: 165065 - RNA, 22 nt, Homo sapiens
gcccaguagcaguacaucccuu

SEQ ID NO: 165066 - RNA, 22 nt, Homo sapiens
gcccuguaguauaguuugaagu

SEQ ID NO: 165067 - RNA, 22 nt, Homo sapiens
gcccuuugugucuggcuggggu

SEQ ID NO: 165068 - RNA, 22 nt, Homo sapiens
gccucaguuguggccagggauu

SEQ ID NO: 165069 - RNA, 22 nt, Homo sapiens
gccuguagaagaguagaugacc

SEQ ID NO: 165070 - RNA, 22 nt, Homo sapiens
gccuuuggugacaggcaugugu

SEQ ID NO: 165071 - RNA, 16 nt, Homo sapiens
gcucuuguucucuguu

SEQ ID NO: 165072 - RNA, 22 nt, Homo sapiens
gcugagcuaugccauauaugcc

SEQ ID NO: 165073 - RNA, 22 nt, Homo sapiens
gcugagguucaagaagguuaaa

SEQ ID NO: 165074 - RNA, 22 nt, Homo sapiens
gcugcuguggcagauuggauuc

SEQ ID NO: 165075 - RNA, 22 nt, Homo sapiens
gcugcuguuucucuuucagcau

SEQ ID NO: 165076 - RNA, 22 nt, Homo sapiens
gcuggcaagaugcugaugcaac

SEQ ID NO: 165077 - RNA, 22 nt, Homo sapiens
gcugguguagagugcagaaagg

SEQ ID NO: 165078 - RNA, 22 nt, Homo sapiens
gcugguguucaggcccucaguc

SEQ ID NO: 165079 - RNA, 22 nt, Homo sapiens
gcugguguugugaaucaggccg

SEQ ID NO: 165080 - RNA, 22 nt, Homo sapiens
gcugugguuuaguagaaagaag

SEQ ID NO: 165081 - RNA, 22 nt, Homo sapiens
gcuguguucucgaggcggggga

SEQ ID NO: 165082 - RNA, 22 nt, Homo sapiens
gcuguugguaaaaaggacauga

SEQ ID NO: 165083 - RNA, 19 nt, Homo sapiens
gcuuguccacgugagauaa

SEQ ID NO: 165084 - RNA, 22 nt, Homo sapiens
gcuuugcaauggcauugaccau

SEQ ID NO: 165085 - RNA, 22 nt, Homo sapiens
gugacagaguaagacccuguau

SEQ ID NO: 165086 - RNA, 22 nt, Homo sapiens
gugaccagaugggcaggggugu

SEQ ID NO: 165087 - RNA, 22 nt, Homo sapiens
gugaccauuugacauauccuug

SEQ ID NO: 165088 - RNA, 22 nt, Homo sapiens
gugacugcauccauccaggcuu

SEQ ID NO: 165089 - RNA, 22 nt, Homo sapiens
gugacugggaguggugaagaua

SEQ ID NO: 165090 - RNA, 22 nt, Homo sapiens
gugagaccaauguacuaccuuc

SEQ ID NO: 165091 - RNA, 22 nt, Homo sapiens
gugagauaaugucucauugugg

SEQ ID NO: 165092 - RNA, 22 nt, Homo sapiens
gugagauuaguucuggaccugg

SEQ ID NO: 165093 - RNA, 22 nt, Homo sapiens
gugagcaaacuuaccuaagguu

SEQ ID NO: 165094 - RNA, 22 nt, Homo sapiens
gugagguaauuagcucccuuag

SEQ ID NO: 165095 - RNA, 22 nt, Homo sapiens
gugagguauacugggaucacua

SEQ ID NO: 165096 - RNA, 17 nt, Homo sapiens
gugagguggguaguauc

SEQ ID NO: 165097 - RNA, 22 nt, Homo sapiens
gugaggugguacaauauuaacu

SEQ ID NO: 165098 - RNA, 22 nt, Homo sapiens
gugaucuuucaggcuugaccau

SEQ ID NO: 165099 - RNA, 22 nt, Homo sapiens
gugauuuaguagaugcuaguua

SEQ ID NO: 165100 - RNA, 22 nt, Homo sapiens
gugcaaugucaggagaugcagc

SEQ ID NO: 165101 - RNA, 22 nt, Homo sapiens
gugcaauucacuguuaugucug

SEQ ID NO: 165102 - RNA, 22 nt, Homo sapiens
gugcacaaaucuuaaauguaca

SEQ ID NO: 165103 - RNA, 22 nt, Homo sapiens
gugcaguguuugcauggaauca

SEQ ID NO: 165104 - RNA, 22 nt, Homo sapiens
gugccacugcacuccggccugg

SEQ ID NO: 165105 - RNA, 22 nt, Homo sapiens
gugcuuauccccauucuggagg

SEQ ID NO: 165106 - RNA, 22 nt, Homo sapiens
gugcuuuguuguggcaguggca

SEQ ID NO: 165107 - RNA, 22 nt, Homo sapiens
guggaagugucuggggccaggg

SEQ ID NO: 165108 - RNA, 22 nt, Homo sapiens
guggaaguuaagugacuuucug

SEQ ID NO: 165109 - RNA, 22 nt, Homo sapiens
guggacggagguugcagugagc

SEQ ID NO: 165110 - RNA, 18 nt, Homo sapiens
guggagugucuuccugga

SEQ ID NO: 165111 - RNA, 22 nt, Homo sapiens
guggcagagucagagggaaaug

SEQ ID NO: 165112 - RNA, 22 nt, Homo sapiens
gugggaagcuggaacucccucc

SEQ ID NO: 165113 - RNA, 22 nt, Homo sapiens
gugggcaagucacuucaguucu

SEQ ID NO: 165114 - RNA, 22 nt, Homo sapiens
gugggguaggaggaguacuucc

SEQ ID NO: 165115 - RNA, 22 nt, Homo sapiens
gugggguaggguaggacucaac

SEQ ID NO: 165116 - RNA, 21 nt, Homo sapiens
gugguucuagagaaacagaau

SEQ ID NO: 165117 - RNA, 22 nt, Homo sapiens
gugguucuagagggacagaaug

SEQ ID NO: 165118 - RNA, 22 nt, Homo sapiens
guguaacaacagcacuccacug

SEQ ID NO: 165119 - RNA, 22 nt, Homo sapiens
gugugcaacuuucauuaauauu

SEQ ID NO: 165120 - RNA, 22 nt, Homo sapiens
gugugcacaaucuggcaugugc

SEQ ID NO: 165121 - RNA, 19 nt, Homo sapiens
gugugcauaucacagagca

SEQ ID NO: 165122 - RNA, 20 nt, Homo sapiens
gugugcauuucagauuuugg

SEQ ID NO: 165123 - RNA, 22 nt, Homo sapiens
guguggcaggugggggcucaga

SEQ ID NO: 165124 - RNA, 22 nt, Homo sapiens
gugugguaggauugguuacuca

SEQ ID NO: 165125 - RNA, 22 nt, Homo sapiens
guguugcacauucuguggaugu

SEQ ID NO: 165126 - RNA, 22 nt, Homo sapiens
guuacagucuuguguaagguua

SEQ ID NO: 165127 - RNA, 20 nt, Homo sapiens
guucacaggcuuccuuucag

SEQ ID NO: 165128 - RNA, 22 nt, Homo sapiens
guucacaguucagccuguaaca

SEQ ID NO: 165129 - RNA, 22 nt, Homo sapiens
guucaguuuuaaagggaaauug

SEQ ID NO: 165130 - RNA, 22 nt, Homo sapiens
guucaucaggaauauuggccua

SEQ ID NO: 165131 - RNA, 20 nt, Homo sapiens
guucauguaauuaguucagg

SEQ ID NO: 165132 - RNA, 17 nt, Homo sapiens
guucccaguggcauuug

SEQ ID NO: 165133 - RNA, 22 nt, Homo sapiens
guuccuuguagaugcuggauau

SEQ ID NO: 165134 - RNA, 22 nt, Homo sapiens
guugaaauccuaacccccuagu

SEQ ID NO: 165135 - RNA, 17 nt, Homo sapiens
guugaguuugagucaag

SEQ ID NO: 165136 - RNA, 22 nt, Homo sapiens
guugcaaaguaauugugguuuu

SEQ ID NO: 165137 - RNA, 22 nt, Homo sapiens
guugcccuuagcacuucagccu

SEQ ID NO: 165138 - RNA, 22 nt, Homo sapiens
guugcucaggcugaagugcagu

SEQ ID NO: 165139 - RNA, 22 nt, Homo sapiens
guuuacagucgacuugggaaua

SEQ ID NO: 165140 - RNA, 22 nt, Homo sapiens
guuugccuuuuagauaggaaug

SEQ ID NO: 165141 - RNA, 22 nt, Homo sapiens
guuuugguuauauggaucaguu

SEQ ID NO: 165142 - RNA, 21 nt, Homo sapiens
uaaaacuguaacuuuguccug

SEQ ID NO: 165143 - RNA, 22 nt, Homo sapiens
uaaaagucaucacaacuggagu

SEQ ID NO: 165144 - RNA, 22 nt, Homo sapiens
uaaacugcuugaggguaaguac

SEQ ID NO: 165145 - RNA, 22 nt, Homo sapiens
uaaacugucuugcaguuacaug

SEQ ID NO: 165146 - RNA, 22 nt, Homo sapiens
uaaagccagugauuaugucucu

SEQ ID NO: 165147 - RNA, 22 nt, Homo sapiens
uaaaguguuuguuauuaaaggu

SEQ ID NO: 165148 - RNA, 22 nt, Homo sapiens
uaaaugacugucaguagaugaa

SEQ ID NO: 165149 - RNA, 22 nt, Homo sapiens
uaaaugcuuaauugaaugugga

SEQ ID NO: 165150 - RNA, 22 nt, Homo sapiens
uaacaacauucuaacugacggc

SEQ ID NO: 165151 - RNA, 22 nt, Homo sapiens
uaacacccuucuccagguacau

SEQ ID NO: 165152 - RNA, 22 nt, Homo sapiens
uaacaggcaaggucacaccuug

SEQ ID NO: 165153 - RNA, 22 nt, Homo sapiens
uaacaggcuacucuugcauugc

SEQ ID NO: 165154 - RNA, 22 nt, Homo sapiens
uaacagucuccucaagguguug

SEQ ID NO: 165155 - RNA, 22 nt, Homo sapiens
uaacaguguauuccuuuggaca

SEQ ID NO: 165156 - RNA, 22 nt, Homo sapiens
uaacaguguauuuacuacuucc

SEQ ID NO: 165157 - RNA, 22 nt, Homo sapiens
uaacccacgcagaauggacaag

SEQ ID NO: 165158 - RNA, 22 nt, Homo sapiens
uaacccuuacaacuacacucgu

SEQ ID NO: 165159 - RNA, 22 nt, Homo sapiens
uaacucugccuagugacauggu

SEQ ID NO: 165160 - RNA, 22 nt, Homo sapiens
uaaggcaaaccuuggcugcagu

SEQ ID NO: 165161 - RNA, 22 nt, Homo sapiens
uaaggcaaucagucaugguguu

SEQ ID NO: 165162 - RNA, 22 nt, Homo sapiens
uaaggcacuacuuuaggcuuuc

SEQ ID NO: 165163 - RNA, 18 nt, Homo sapiens
uaaggcacuauaggcauu

SEQ ID NO: 165164 - RNA, 22 nt, Homo sapiens
uaaggcuagcaagaugagaaua

SEQ ID NO: 165165 - RNA, 22 nt, Homo sapiens
uaagggacgcccccuucucucu

SEQ ID NO: 165166 - RNA, 22 nt, Homo sapiens
uaaguacaugcuagauggaaug

SEQ ID NO: 165167 - RNA, 22 nt, Homo sapiens
uaaguacugucagaauuggacu

SEQ ID NO: 165168 - RNA, 22 nt, Homo sapiens
uaaguacuuuacagacauuauc

SEQ ID NO: 165169 - RNA, 22 nt, Homo sapiens
uaucacacuggaagaaguuaag

SEQ ID NO: 165170 - RNA, 23 nt, Homo sapiens
uaucacacuuucucugugccaca

SEQ ID NO: 165171 - RNA, 22 nt, Homo sapiens
uaucacagaggguauccuagag

SEQ ID NO: 165172 - RNA, 22 nt, Homo sapiens
uaucacuuugauaguuuaaaug

SEQ ID NO: 165173 - RNA, 22 nt, Homo sapiens
uaucagcagcaggggcugcaga

SEQ ID NO: 165174 - RNA, 22 nt, Homo sapiens
uaucagugaaucuuauuuugcc

SEQ ID NO: 165175 - RNA, 22 nt, Homo sapiens
uaucaucauguuuuugcugugu

SEQ ID NO: 165176 - RNA, 22 nt, Homo sapiens
uaucauggggacugcagccuag

SEQ ID NO: 165177 - RNA, 22 nt, Homo sapiens
uaucccaauguaauaucacaaa

SEQ ID NO: 165178 - RNA, 22 nt, Homo sapiens
uaucuacauguagguauguaug

SEQ ID NO: 165179 - RNA, 22 nt, Homo sapiens
uaucucaguguacaggaugaua

SEQ ID NO: 165180 - RNA, 22 nt, Homo sapiens
uaugaauuuuauccaggauaua

SEQ ID NO: 165181 - RNA, 22 nt, Homo sapiens
uaugcacaugcaugcuugaaua

SEQ ID NO: 165182 - RNA, 22 nt, Homo sapiens
uaugcagacauuguuccaacca

SEQ ID NO: 165183 - RNA, 22 nt, Homo sapiens
uaugccuuugaccauuuuguga

SEQ ID NO: 165184 - RNA, 22 nt, Homo sapiens
uaugcuuauaaacauuugucag

SEQ ID NO: 165185 - RNA, 22 nt, Homo sapiens
uauggccccuacaugugcaaaa

SEQ ID NO: 165186 - RNA, 22 nt, Homo sapiens
uauggcccuuaaguauugguug

SEQ ID NO: 165187 - RNA, 22 nt, Homo sapiens
uaugucacagguuuuggugaaa

SEQ ID NO: 165188 - RNA, 22 nt, Homo sapiens
uauuaagcuaguugucagugcu

SEQ ID NO: 165189 - RNA, 20 nt, Homo sapiens
uauuacagaguaauggugga

SEQ ID NO: 165190 - RNA, 22 nt, Homo sapiens
uauuacauccauaggcucugcu

SEQ ID NO: 165191 - RNA, 22 nt, Homo sapiens
uauuaguuguaugauucccaag

SEQ ID NO: 165192 - RNA, 22 nt, Homo sapiens
uauucacaggugugggacaaag

SEQ ID NO: 165193 - RNA, 18 nt, Homo sapiens
uauuccucuuccucuauc

SEQ ID NO: 165194 - RNA, 22 nt, Homo sapiens
uauugaacgugggauauugaag

SEQ ID NO: 165195 - RNA, 22 nt, Homo sapiens
uauugauuaauugugauuaggc

SEQ ID NO: 165196 - RNA, 22 nt, Homo sapiens
uauugcaacagaagaaagaguc

SEQ ID NO: 165197 - RNA, 23 nt, Homo sapiens
uauugcacuaugguaacccuuuu

SEQ ID NO: 165198 - RNA, 22 nt, Homo sapiens
uauugcacuuuuccauaggagu

SEQ ID NO: 165199 - RNA, 22 nt, Homo sapiens
uauugcagugagauccaucugg

SEQ ID NO: 165200 - RNA, 22 nt, Homo sapiens
uauugcauauuauucuaguggc

SEQ ID NO: 165201 - RNA, 22 nt, Homo sapiens
uauugcuugaggaaaugguaau

SEQ ID NO: 165202 - RNA, 22 nt, Homo sapiens
uauuguacauguuauagauuuu

SEQ ID NO: 165203 - RNA, 22 nt, Homo sapiens
uauugucacuaaaggaagcugg

SEQ ID NO: 165204 - RNA, 22 nt, Homo sapiens
ucaaaguagaaaaggggcaauu

SEQ ID NO: 165205 - RNA, 22 nt, Homo sapiens
ucaaagugagcuccuucucacu

SEQ ID NO: 165206 - RNA, 21 nt, Homo sapiens
ucaaaguguucuuuuguugaa

SEQ ID NO: 165207 - RNA, 22 nt, Homo sapiens
ucaaaugauucagaagccaccu

SEQ ID NO: 165208 - RNA, 17 nt, Homo sapiens
ucaaaugcucccaguga

SEQ ID NO: 165209 - RNA, 22 nt, Homo sapiens
ucaaaugguccacgugaacauu

SEQ ID NO: 165210 - RNA, 22 nt, Homo sapiens
ucaaauuccaagucuagguagg

SEQ ID NO: 165211 - RNA, 22 nt, Homo sapiens
ucaagcaauucgccugucucag

SEQ ID NO: 165212 - RNA, 22 nt, Homo sapiens
ucaagcaauucugcugccucag

SEQ ID NO: 165213 - RNA, 19 nt, Homo sapiens
ucaagcuauucuccugccu

SEQ ID NO: 165214 - RNA, 20 nt, Homo sapiens
ucaaggcaggaacuguacau

SEQ ID NO: 165215 - RNA, 22 nt, Homo sapiens
ucaagugcauugauucaguauu

SEQ ID NO: 165216 - RNA, 19 nt, Homo sapiens
ucaauucugucaauggcuu

SEQ ID NO: 165217 - RNA, 22 nt, Homo sapiens
ucacaaagcuuggccugcuucu

SEQ ID NO: 165218 - RNA, 22 nt, Homo sapiens
ucacaauucucaauuugugaaa

SEQ ID NO: 165219 - RNA, 22 nt, Homo sapiens
ucacagugaguggaguggggug

SEQ ID NO: 165220 - RNA, 22 nt, Homo sapiens
ucacaguguuaaaccuuucuuu

SEQ ID NO: 165221 - RNA, 22 nt, Homo sapiens
ucacaguugauugaaacacagc

SEQ ID NO: 165222 - RNA, 22 nt, Homo sapiens
ucacaugcacaucucuggaacc

SEQ ID NO: 165223 - RNA, 22 nt, Homo sapiens
ucacauggaaaaguccaguaaa

SEQ ID NO: 165224 - RNA, 22 nt, Homo sapiens
ucacauggauuaacucauuuau

SEQ ID NO: 165225 - RNA, 22 nt, Homo sapiens
ucaccaccugcugaucauagag

SEQ ID NO: 165226 - RNA, 22 nt, Homo sapiens
ucaccaguaauaaagagccugc

SEQ ID NO: 165227 - RNA, 22 nt, Homo sapiens
ucaccuggagacaugaagacug

SEQ ID NO: 165228 - RNA, 22 nt, Homo sapiens
ucaccuuacuugcuucugaacu

SEQ ID NO: 165229 - RNA, 22 nt, Homo sapiens
ucacgcugcugcaaccagccug

SEQ ID NO: 165230 - RNA, 19 nt, Homo sapiens
ucacgugcagcagccacac

SEQ ID NO: 165231 - RNA, 22 nt, Homo sapiens
ucacuagggaucacuuuacccg

SEQ ID NO: 165232 - RNA, 22 nt, Homo sapiens
ucacugaaaccuccaccucucg

SEQ ID NO: 165233 - RNA, 21 nt, Homo sapiens
ucacugagcaucaugguuuca

SEQ ID NO: 165234 - RNA, 22 nt, Homo sapiens
ucacuggucuaaguggaggggg

SEQ ID NO: 165235 - RNA, 22 nt, Homo sapiens
ucacugugagaguuuauccugu

SEQ ID NO: 165236 - RNA, 18 nt, Homo sapiens
ucacugugugucuugggu

SEQ ID NO: 165237 - RNA, 22 nt, Homo sapiens
ucacuugguggcaaaguuuaug

SEQ ID NO: 165238 - RNA, 22 nt, Homo sapiens
ucacuuugacggccaacuucua

SEQ ID NO: 165239 - RNA, 22 nt, Homo sapiens
ucagaacugauacuagaacuuu

SEQ ID NO: 165240 - RNA, 22 nt, Homo sapiens
ucagacacugcccuccaccugu

SEQ ID NO: 165241 - RNA, 22 nt, Homo sapiens
ucagaguggagucugcagccuu

SEQ ID NO: 165242 - RNA, 22 nt, Homo sapiens
ucagauacuggugacaugaaug

SEQ ID NO: 165243 - RNA, 22 nt, Homo sapiens
ucagaucaguuccacaagaacu

SEQ ID NO: 165244 - RNA, 22 nt, Homo sapiens
ucagaucauuaagguagguuua

SEQ ID NO: 165245 - RNA, 22 nt, Homo sapiens
ucagcaccauguaacaauugau

SEQ ID NO: 165246 - RNA, 22 nt, Homo sapiens
ucaggugcagagaagaaauggg

SEQ ID NO: 165247 - RNA, 22 nt, Homo sapiens
ucaggugcaguggcucaugcuu

SEQ ID NO: 165248 - RNA, 22 nt, Homo sapiens
ucagguugcuaaguauaauauu

SEQ ID NO: 165249 - RNA, 22 nt, Homo sapiens
ucaguaaauguuaggacauuuc

SEQ ID NO: 165250 - RNA, 22 nt, Homo sapiens
ucagucuuuuaccauuaaguau

SEQ ID NO: 165251 - RNA, 22 nt, Homo sapiens
ucagugaauacauguacucaug

SEQ ID NO: 165252 - RNA, 21 nt, Homo sapiens
ucagugcaauucuauggggaa

SEQ ID NO: 165253 - RNA, 22 nt, Homo sapiens
ucagugccucaguuuuuaaaga

SEQ ID NO: 165254 - RNA, 22 nt, Homo sapiens
ucaguggauuauuaaagucacc

SEQ ID NO: 165255 - RNA, 22 nt, Homo sapiens
ucagugucugugauggagaggu

SEQ ID NO: 165256 - RNA, 22 nt, Homo sapiens
ucauaaaguuguuuuaauggga

SEQ ID NO: 165257 - RNA, 22 nt, Homo sapiens
ucaugaaguaguuaacugguug

SEQ ID NO: 165258 - RNA, 22 nt, Homo sapiens
ucauggggugcuuugcuagauu

SEQ ID NO: 165259 - RNA, 22 nt, Homo sapiens
ucauuggauggaaugcucugua

SEQ ID NO: 165260 - RNA, 18 nt, Homo sapiens
ucauuggugagcaccucc

SEQ ID NO: 165261 - RNA, 22 nt, Homo sapiens
uccaaaucucuggcacugggau

SEQ ID NO: 165262 - RNA, 22 nt, Homo sapiens
uccaagaugcuggcagcuacag

SEQ ID NO: 165263 - RNA, 19 nt, Homo sapiens
uccacagugguugaacuag

SEQ ID NO: 165264 - RNA, 22 nt, Homo sapiens
uccacguggucuaucuguccuu

SEQ ID NO: 165265 - RNA, 22 nt, Homo sapiens
uccacugagcuagaccacuugg

SEQ ID NO: 165266 - RNA, 22 nt, Homo sapiens
uccaugaggcuacaguaaucuc

SEQ ID NO: 165267 - RNA, 22 nt, Homo sapiens
uccauggagacacauuuuauau

SEQ ID NO: 165268 - RNA, 22 nt, Homo sapiens
uccauugucuagauguaacaca

SEQ ID NO: 165269 - RNA, 22 nt, Homo sapiens
ucccacugucuucucgugcucg

SEQ ID NO: 165270 - RNA, 22 nt, Homo sapiens
ucccauguagcuaggauuacag

SEQ ID NO: 165271 - RNA, 23 nt, Homo sapiens
uccccgggagcaccagcuuguug

SEQ ID NO: 165272 - RNA, 22 nt, Homo sapiens
uccccuuuguaagauggaaacg

SEQ ID NO: 165273 - RNA, 18 nt, Homo sapiens
ucccucagaauuauagaa

SEQ ID NO: 165274 - RNA, 22 nt, Homo sapiens
ucccugaaucucagguucugua

SEQ ID NO: 165275 - RNA, 22 nt, Homo sapiens
ucccugacagggucugagcuuu

SEQ ID NO: 165276 - RNA, 17 nt, Homo sapiens
ucccuguuuuuucaguc

SEQ ID NO: 165277 - RNA, 22 nt, Homo sapiens
uccuacugucuucggggcacug

SEQ ID NO: 165278 - RNA, 22 nt, Homo sapiens
uccucauggagaaccucugcua

SEQ ID NO: 165279 - RNA, 22 nt, Homo sapiens
uccuucaguccaguggguuuug

SEQ ID NO: 165280 - RNA, 22 nt, Homo sapiens
uccuuugguggagucuuuaggg

SEQ ID NO: 165281 - RNA, 22 nt, Homo sapiens
ucgcaccauugcacuccagcca

SEQ ID NO: 165282 - RNA, 19 nt, Homo sapiens
ucgcgccauucuccugccu

SEQ ID NO: 165283 - RNA, 22 nt, Homo sapiens
ucguucuugucaguuuauaaag

SEQ ID NO: 165284 - RNA, 22 nt, Homo sapiens
ucuaaaacuagauugugaugau

SEQ ID NO: 165285 - RNA, 22 nt, Homo sapiens
ucuaaaguacuacuacuguugg

SEQ ID NO: 165286 - RNA, 22 nt, Homo sapiens
ucuaagaauucauuuauaagcc

SEQ ID NO: 165287 - RNA, 22 nt, Homo sapiens
ucuaaggcaccuagagucauca

SEQ ID NO: 165288 - RNA, 22 nt, Homo sapiens
ucuaauguaaccugcaaauauu

SEQ ID NO: 165289 - RNA, 22 nt, Homo sapiens
ucuacagccaguucaggaagaa

SEQ ID NO: 165290 - RNA, 21 nt, Homo sapiens
ucuaccuacugcucacaggcu

SEQ ID NO: 165291 - RNA, 22 nt, Homo sapiens
ucucaaccucccaaguagcugg

SEQ ID NO: 165292 - RNA, 22 nt, Homo sapiens
ucucaagaugguagaugggaau

SEQ ID NO: 165293 - RNA, 22 nt, Homo sapiens
ucucaauggguuguagacaaag

SEQ ID NO: 165294 - RNA, 22 nt, Homo sapiens
ucucacaccccucucauauacc

SEQ ID NO: 165295 - RNA, 22 nt, Homo sapiens
ucucacagaguugaacuuucuu

SEQ ID NO: 165296 - RNA, 22 nt, Homo sapiens
ucucagugugguaaaaguuuuu

SEQ ID NO: 165297 - RNA, 19 nt, Homo sapiens
ucucaguguuggucaggug

SEQ ID NO: 165298 - RNA, 20 nt, Homo sapiens
ucucauggagguagagaaua

SEQ ID NO: 165299 - RNA, 22 nt, Homo sapiens
ucucauggcucacccugcauag

SEQ ID NO: 165300 - RNA, 23 nt, Homo sapiens
ucucauuccuugaaaauaaugac

SEQ ID NO: 165301 - RNA, 22 nt, Homo sapiens
ucuccaguuuccuucgucuauc

SEQ ID NO: 165302 - RNA, 22 nt, Homo sapiens
ucucugauuauugcauuucauu

SEQ ID NO: 165303 - RNA, 22 nt, Homo sapiens
ucucuugguugaacaguuugga

SEQ ID NO: 165304 - RNA, 22 nt, Homo sapiens
ucugagacuguuucuaacaagc

SEQ ID NO: 165305 - RNA, 22 nt, Homo sapiens
ucugagcaauagauguggauau

SEQ ID NO: 165306 - RNA, 22 nt, Homo sapiens
ucugagguaggugcauggauac

SEQ ID NO: 165307 - RNA, 22 nt, Homo sapiens
ucugaguggcagaaugagcuga

SEQ ID NO: 165308 - RNA, 22 nt, Homo sapiens
ucugcauaucaugcagaacuau

SEQ ID NO: 165309 - RNA, 22 nt, Homo sapiens
ucugccuacugguuggaggaac

SEQ ID NO: 165310 - RNA, 22 nt, Homo sapiens
ucuggcaagagccgagggcagu

SEQ ID NO: 165311 - RNA, 20 nt, Homo sapiens
ucuggccccuccaaaucuca

SEQ ID NO: 165312 - RNA, 22 nt, Homo sapiens
ucuggccccucccaaaucucau

SEQ ID NO: 165313 - RNA, 22 nt, Homo sapiens
ucuggccccucucaaaucucau

SEQ ID NO: 165314 - RNA, 22 nt, Homo sapiens
ucuggccuacaaguaauuuuau

SEQ ID NO: 165315 - RNA, 22 nt, Homo sapiens
ucuggccuccuaugagaaucga

SEQ ID NO: 165316 - RNA, 22 nt, Homo sapiens
ucuggcuuugugaguugccaga

SEQ ID NO: 165317 - RNA, 20 nt, Homo sapiens
ucuggguuuuggccacgccc

SEQ ID NO: 165318 - RNA, 22 nt, Homo sapiens
ucuggguuuuuccauugccggu

SEQ ID NO: 165319 - RNA, 22 nt, Homo sapiens
ucuggucccugcacauauuuuc

SEQ ID NO: 165320 - RNA, 23 nt, Homo sapiens
ucugguguugucaaaugcugguu

SEQ ID NO: 165321 - RNA, 22 nt, Homo sapiens
ucugucaaaucuuauguuguag

SEQ ID NO: 165322 - RNA, 22 nt, Homo sapiens
ucugugcugagaguugaaaguu

SEQ ID NO: 165323 - RNA, 22 nt, Homo sapiens
ucugugcuugucauaugcuuug

SEQ ID NO: 165324 - RNA, 19 nt, Homo sapiens
ucugugcuugucccccugu

SEQ ID NO: 165325 - RNA, 22 nt, Homo sapiens
ucuguggucagcauccgccacu

SEQ ID NO: 165326 - RNA, 22 nt, Homo sapiens
ucugugguucaaaccagcaacu

SEQ ID NO: 165327 - RNA, 22 nt, Homo sapiens
ucugugguuguugcauggaaug

SEQ ID NO: 165328 - RNA, 22 nt, Homo sapiens
ucuguguugaucacacugggag

SEQ ID NO: 165329 - RNA, 22 nt, Homo sapiens
ucuguguuuagacccaggguag

SEQ ID NO: 165330 - RNA, 22 nt, Homo sapiens
ucuguguuugaucaagauugua

SEQ ID NO: 165331 - RNA, 22 nt, Homo sapiens
ucuguguuugguuggcaauuuc

SEQ ID NO: 165332 - RNA, 22 nt, Homo sapiens
ucuuaggugggccaucacccca

SEQ ID NO: 165333 - RNA, 22 nt, Homo sapiens
ucuuaguuuagauuagcaauuc

SEQ ID NO: 165334 - RNA, 22 nt, Homo sapiens
ucuucagucauauuggccugga

SEQ ID NO: 165335 - RNA, 22 nt, Homo sapiens
ucuugcaccuacaugcuuuguc

SEQ ID NO: 165336 - RNA, 22 nt, Homo sapiens
ucuugcuuguuguucccuucau

SEQ ID NO: 165337 - RNA, 22 nt, Homo sapiens
ugagguaacagaagcgagcauu

SEQ ID NO: 165338 - RNA, 21 nt, Homo sapiens
ugaggucaugaugcugcuucc

SEQ ID NO: 165339 - RNA, 22 nt, Homo sapiens
ugaguacuacuaguuacugcua

SEQ ID NO: 165340 - RNA, 22 nt, Homo sapiens
ugaguagcuaagacgauaggca

SEQ ID NO: 165341 - RNA, 23 nt, Homo sapiens
ugaguaggcaguuuuccccucac

SEQ ID NO: 165342 - RNA, 22 nt, Homo sapiens
ugaguagucagugggcaggaag

SEQ ID NO: 165343 - RNA, 22 nt, Homo sapiens
ugagucagucucacucugcugc

SEQ ID NO: 165344 - RNA, 22 nt, Homo sapiens
ugagucuguuccaaagaaauaa

SEQ ID NO: 165345 - RNA, 22 nt, Homo sapiens
ugagugaggcugggcagucccu

SEQ ID NO: 165346 - RNA, 22 nt, Homo sapiens
ugaguguguaugugcauacaca

SEQ ID NO: 165347 - RNA, 22 nt, Homo sapiens
ugaguucuuuguagauucugug

SEQ ID NO: 165348 - RNA, 22 nt, Homo sapiens
ugauaacauugggggaagcuga

SEQ ID NO: 165349 - RNA, 22 nt, Homo sapiens
ugauaagugagauagcaaguga

SEQ ID NO: 165350 - RNA, 22 nt, Homo sapiens
ugauaauguuaggcuuuauuca

SEQ ID NO: 165351 - RNA, 22 nt, Homo sapiens
ugauauguaacuacuccuuaua

SEQ ID NO: 165352 - RNA, 22 nt, Homo sapiens
ugaucaaagugcuggaauuaca

SEQ ID NO: 165353 - RNA, 21 nt, Homo sapiens
ugaugcuuuucuuaaccuugc

SEQ ID NO: 165354 - RNA, 22 nt, Homo sapiens
ugaugucuugagauggagcuua

SEQ ID NO: 165355 - RNA, 22 nt, Homo sapiens
ugauuuguuuagugccaaguuu

SEQ ID NO: 165356 - RNA, 22 nt, Homo sapiens
ugauuuguuucaggaguuuucu

SEQ ID NO: 165357 - RNA, 22 nt, Homo sapiens
ugcaaagaaauuuuggugacca

SEQ ID NO: 165358 - RNA, 22 nt, Homo sapiens
ugcaaaguccucauucuuaccc

SEQ ID NO: 165359 - RNA, 22 nt, Homo sapiens
ugcaaaugucaaggguuagugu

SEQ ID NO: 165360 - RNA, 22 nt, Homo sapiens
ugcaaauguuaggugucauuau

SEQ ID NO: 165361 - RNA, 22 nt, Homo sapiens
ugcaagauaggcaguuugcacu

SEQ ID NO: 165362 - RNA, 22 nt, Homo sapiens
ugcaagcacacccagggauugu

SEQ ID NO: 165363 - RNA, 20 nt, Homo sapiens
ugcaaguugccuuuggaggc

SEQ ID NO: 165364 - RNA, 18 nt, Homo sapiens
ugcaauggagaugcagcc

SEQ ID NO: 165365 - RNA, 22 nt, Homo sapiens
ugcaaugugaaauaagcacauc

SEQ ID NO: 165366 - RNA, 17 nt, Homo sapiens
ugcaauuuaagcuagau

SEQ ID NO: 165367 - RNA, 22 nt, Homo sapiens
ugcaccacugcacuccagcuug

SEQ ID NO: 165368 - RNA, 22 nt, Homo sapiens
ugcaccacugcacugccugggu

SEQ ID NO: 165369 - RNA, 22 nt, Homo sapiens
ugcaccacugcacuucagccug

SEQ ID NO: 165370 - RNA, 22 nt, Homo sapiens
ugcaccacugcuagccugggua

SEQ ID NO: 165371 - RNA, 22 nt, Homo sapiens
ugcaccacuguacuccagucug

SEQ ID NO: 165372 - RNA, 22 nt, Homo sapiens
ugcacuguggucugagagacag

SEQ ID NO: 165373 - RNA, 20 nt, Homo sapiens
ugcagcacugggaaugcagu

SEQ ID NO: 165374 - RNA, 22 nt, Homo sapiens
ugcagcauugcacuccagccug

SEQ ID NO: 165375 - RNA, 22 nt, Homo sapiens
ugcaguaggcccagcgggaggc

SEQ ID NO: 165376 - RNA, 20 nt, Homo sapiens
ugcaguguccucacuuguca

SEQ ID NO: 165377 - RNA, 21 nt, Homo sapiens
ugcagugugguugcccugcug

SEQ ID NO: 165378 - RNA, 22 nt, Homo sapiens
ugcauaggagcagggucuaugu

SEQ ID NO: 165379 - RNA, 19 nt, Homo sapiens
ugcauaggguuacauacuc

SEQ ID NO: 165380 - RNA, 22 nt, Homo sapiens
ugcauauuuuauaaagauggaa

SEQ ID NO: 165381 - RNA, 22 nt, Homo sapiens
ugcauggaagggagggaaagag

SEQ ID NO: 165382 - RNA, 22 nt, Homo sapiens
ugccaacaugccuggcuguuuu

SEQ ID NO: 165383 - RNA, 22 nt, Homo sapiens
ugccagagacguagggaauauu

SEQ ID NO: 165384 - RNA, 22 nt, Homo sapiens
ugccagaugcaguguucaacaa

SEQ ID NO: 165385 - RNA, 22 nt, Homo sapiens
ugccagaugcuggugugagggg

SEQ ID NO: 165386 - RNA, 22 nt, Homo sapiens
ugccaguauuuuguugaggauu

SEQ ID NO: 165387 - RNA, 22 nt, Homo sapiens
ugccaguuuuuacauuuccugu

SEQ ID NO: 165388 - RNA, 22 nt, Homo sapiens
ugccuaggcccaguccucagaa

SEQ ID NO: 165389 - RNA, 22 nt, Homo sapiens
ugccuaggcuggaaugcagugg

SEQ ID NO: 165390 - RNA, 22 nt, Homo sapiens
ugccuaguggccuuaugaguau

SEQ ID NO: 165391 - RNA, 22 nt, Homo sapiens
ugccuaguguguugagaguuuu

SEQ ID NO: 165392 - RNA, 22 nt, Homo sapiens
ugccuggagagcuccuacauau

SEQ ID NO: 165393 - RNA, 22 nt, Homo sapiens
ugcuauagcuauaucaucuccu

SEQ ID NO: 165394 - RNA, 22 nt, Homo sapiens
ugcucaccugcugcucaccucc

SEQ ID NO: 165395 - RNA, 23 nt, Homo sapiens
ugcuccccucauggaugaauaaa

SEQ ID NO: 165396 - RNA, 22 nt, Homo sapiens
ugcugcaaacaggcaucugugg

SEQ ID NO: 165397 - RNA, 22 nt, Homo sapiens
ugcugcacuuauggcucugagg

SEQ ID NO: 165398 - RNA, 19 nt, Homo sapiens
ugcugcauugugaccuugc

SEQ ID NO: 165399 - RNA, 22 nt, Homo sapiens
ugcugcuguuaucauuuuacca

SEQ ID NO: 165400 - RNA, 22 nt, Homo sapiens
ugcugguauuuggaccagccug

SEQ ID NO: 165401 - RNA, 22 nt, Homo sapiens
ugcugguguggucuagccgcuu

SEQ ID NO: 165402 - RNA, 22 nt, Homo sapiens
ugcuguguugcuggcuuaaaga

SEQ ID NO: 165403 - RNA, 17 nt, Homo sapiens
ugcuuagagagccucag

SEQ ID NO: 165404 - RNA, 22 nt, Homo sapiens
ugcuuaggcuaacaaaaauagc

SEQ ID NO: 165405 - RNA, 22 nt, Homo sapiens
ugcuuugguagaaaucuuuggu

SEQ ID NO: 165406 - RNA, 22 nt, Homo sapiens
uggaaaguacuugaguuuguau

SEQ ID NO: 165407 - RNA, 22 nt, Homo sapiens
uggaaaguaguucuaaucuaag

SEQ ID NO: 165408 - RNA, 22 nt, Homo sapiens
uggaagcauagcagcgugugug

SEQ ID NO: 165409 - RNA, 22 nt, Homo sapiens
uggaaguauagauaauugaaag

SEQ ID NO: 165410 - RNA, 22 nt, Homo sapiens
uggaagugaacaaccaaggcag

SEQ ID NO: 165411 - RNA, 22 nt, Homo sapiens
uggaagugucugugcccagcuc

SEQ ID NO: 165412 - RNA, 22 nt, Homo sapiens
uggaauggagagagggugcacg

SEQ ID NO: 165413 - RNA, 22 nt, Homo sapiens
uggaauguagcguugacacgag

SEQ ID NO: 165414 - RNA, 22 nt, Homo sapiens
uggaaugugaauaacuuccuuc

SEQ ID NO: 165415 - RNA, 18 nt, Homo sapiens
uggaauguuuggguuaau

SEQ ID NO: 165416 - RNA, 22 nt, Homo sapiens
uggacagagagaccggcauuuu

SEQ ID NO: 165417 - RNA, 20 nt, Homo sapiens
uggaccagagagguggggac

SEQ ID NO: 165418 - RNA, 21 nt, Homo sapiens
uggaccccuacuucucaccau

SEQ ID NO: 165419 - RNA, 22 nt, Homo sapiens
uggacuagagggugggcgaggu

SEQ ID NO: 165420 - RNA, 22 nt, Homo sapiens
uggacuguaagugccuugagua

SEQ ID NO: 165421 - RNA, 22 nt, Homo sapiens
uggagcccuaguuccucauaac

SEQ ID NO: 165422 - RNA, 22 nt, Homo sapiens
uggagguagacauugggaagag

SEQ ID NO: 165423 - RNA, 22 nt, Homo sapiens
uggagguaggugauauguagca

SEQ ID NO: 165424 - RNA, 22 nt, Homo sapiens
uggagucuugcucuguugccca

SEQ ID NO: 165425 - RNA, 22 nt, Homo sapiens
uggaucaugcgaggccuccccu

SEQ ID NO: 165426 - RNA, 22 nt, Homo sapiens
uggaucuguucuauuuaucuga

SEQ ID NO: 165427 - RNA, 22 nt, Homo sapiens
uggaugacuguuauaugcauau

SEQ ID NO: 165428 - RNA, 22 nt, Homo sapiens
uggauggucagaggguuucugu

SEQ ID NO: 165429 - RNA, 22 nt, Homo sapiens
uggauuuuaauuauucugucau

SEQ ID NO: 165430 - RNA, 22 nt, Homo sapiens
uggcaagaaccacaauuacuuu

SEQ ID NO: 165431 - RNA, 22 nt, Homo sapiens
uggcaagaacgaaauguagggu

SEQ ID NO: 165432 - RNA, 19 nt, Homo sapiens
uggcacauguauacauaug

SEQ ID NO: 165433 - RNA, 19 nt, Homo sapiens
uggcacauguauacuuaug

SEQ ID NO: 165434 - RNA, 22 nt, Homo sapiens
uggcagacaaauuugagcauau

SEQ ID NO: 165435 - RNA, 22 nt, Homo sapiens
uggcagugggagauauuuuauu

SEQ ID NO: 165436 - RNA, 22 nt, Homo sapiens
uggcaguuuugauguggagaga

SEQ ID NO: 165437 - RNA, 19 nt, Homo sapiens
uggcaugaaugugaacuaa

SEQ ID NO: 165438 - RNA, 23 nt, Homo sapiens
uggcauuuuaguuagcuucagug

SEQ ID NO: 165439 - RNA, 22 nt, Homo sapiens
uggcauuuuguuuuagaauuag

SEQ ID NO: 165440 - RNA, 23 nt, Homo sapiens
uggcauuuuuggcaaugccuucu

SEQ ID NO: 165441 - RNA, 22 nt, Homo sapiens
uggccuguaacccucucauagg

SEQ ID NO: 165442 - RNA, 22 nt, Homo sapiens
uggcgagaaaccauaugcuuuc

SEQ ID NO: 165443 - RNA, 22 nt, Homo sapiens
uggcuacagaaaguacuaguga

SEQ ID NO: 165444 - RNA, 22 nt, Homo sapiens
uggcucauuucuaaacccagcu

SEQ ID NO: 165445 - RNA, 20 nt, Homo sapiens
uggcucuuugcugcuaaagu

SEQ ID NO: 165446 - RNA, 20 nt, Homo sapiens
uggcuucuuaauugcaggca

SEQ ID NO: 165447 - RNA, 20 nt, Homo sapiens
ugggaaauguccaggacaua

SEQ ID NO: 165448 - RNA, 18 nt, Homo sapiens
ugggaagaaauucuucuc

SEQ ID NO: 165449 - RNA, 22 nt, Homo sapiens
ugggaagaugcugcuucuuccu

SEQ ID NO: 165450 - RNA, 22 nt, Homo sapiens
ugggaagcugcugaacuacagu

SEQ ID NO: 165451 - RNA, 22 nt, Homo sapiens
ugggagcauugcauuagaagcc

SEQ ID NO: 165452 - RNA, 22 nt, Homo sapiens
ugggaucuuuccuauuagcgag

SEQ ID NO: 165453 - RNA, 22 nt, Homo sapiens
ugggaugaauacaaugggauca

SEQ ID NO: 165454 - RNA, 22 nt, Homo sapiens
ugggaugaugcuugagaauauc

SEQ ID NO: 165455 - RNA, 22 nt, Homo sapiens
ugggcagugggacagcuuugug

SEQ ID NO: 165456 - RNA, 22 nt, Homo sapiens
ugggccgcugcaggaugguccc

SEQ ID NO: 165457 - RNA, 22 nt, Homo sapiens
uggggucguaggugcccgccag

SEQ ID NO: 165458 - RNA, 22 nt, Homo sapiens
uggguaaaucuguuuggggcuc

SEQ ID NO: 165459 - RNA, 22 nt, Homo sapiens
uggguagauaucauaguugccc

SEQ ID NO: 165460 - RNA, 22 nt, Homo sapiens
ugguaaaaugucauuuaccaga

SEQ ID NO: 165461 - RNA, 22 nt, Homo sapiens
ugguauguguucuaaaauuaug

SEQ ID NO: 165462 - RNA, 22 nt, Homo sapiens
ugguauguuuauaaguauagga

SEQ ID NO: 165463 - RNA, 21 nt, Homo sapiens
uggucccauaagauuacaaug

SEQ ID NO: 165464 - RNA, 22 nt, Homo sapiens
uggucuucuggccuccagaacc

SEQ ID NO: 165465 - RNA, 22 nt, Homo sapiens
uguaacaguaguuacuauucuu

SEQ ID NO: 165466 - RNA, 22 nt, Homo sapiens
uguaagugugcaauucagugau

SEQ ID NO: 165467 - RNA, 22 nt, Homo sapiens
uguaaugaucaaaucagaguaa

SEQ ID NO: 165468 - RNA, 22 nt, Homo sapiens
uguaauguuucaucauuauuaa

SEQ ID NO: 165469 - RNA, 22 nt, Homo sapiens
uguacaaaacaagaugggggua

SEQ ID NO: 165470 - RNA, 22 nt, Homo sapiens
uguaguuugaaagcucccucug

SEQ ID NO: 165471 - RNA, 23 nt, Homo sapiens
uguauacacccugugcaucuggg

SEQ ID NO: 165472 - RNA, 22 nt, Homo sapiens
uguauacauguguguucacgca

SEQ ID NO: 165473 - RNA, 22 nt, Homo sapiens
ugucaaaugcagugauauuuga

SEQ ID NO: 165474 - RNA, 22 nt, Homo sapiens
ugucaagaaaucaaggugugag

SEQ ID NO: 165475 - RNA, 22 nt, Homo sapiens
ugucaaugggaauuuguuuuag

SEQ ID NO: 165476 - RNA, 22 nt, Homo sapiens
ugucacagagauuuugguaugu

SEQ ID NO: 165477 - RNA, 22 nt, Homo sapiens
ugucacuuugccuucuggacuu

SEQ ID NO: 165478 - RNA, 22 nt, Homo sapiens
ugucagcacaacucagguuccu

SEQ ID NO: 165479 - RNA, 22 nt, Homo sapiens
ugucaggagcaaugauaaauuu

SEQ ID NO: 165480 - RNA, 22 nt, Homo sapiens
ugucaggaggguccagagaaaa

SEQ ID NO: 165481 - RNA, 22 nt, Homo sapiens
ugucagggaggcucggccgcac

SEQ ID NO: 165482 - RNA, 22 nt, Homo sapiens
ugucaguuucuugagauggaac

SEQ ID NO: 165483 - RNA, 22 nt, Homo sapiens
ugucaucuagguauuaagcccc

SEQ ID NO: 165484 - RNA, 22 nt, Homo sapiens
ugucccugagccuggauuccug

SEQ ID NO: 165485 - RNA, 22 nt, Homo sapiens
ugucucccuucccauuaggaag

SEQ ID NO: 165486 - RNA, 22 nt, Homo sapiens
ugucucggagaucucucaaagu

SEQ ID NO: 165487 - RNA, 22 nt, Homo sapiens
ugucuggaaggguggccuccug

SEQ ID NO: 165488 - RNA, 22 nt, Homo sapiens
ugucuggaguccauagaagugu

SEQ ID NO: 165489 - RNA, 22 nt, Homo sapiens
ugucuuggagaauccuggguuu

SEQ ID NO: 165490 - RNA, 22 nt, Homo sapiens
ugucuuguagacaauguauagu

SEQ ID NO: 165491 - RNA, 22 nt, Homo sapiens
ugugaacagcuccaaaugugga

SEQ ID NO: 165492 - RNA, 20 nt, Homo sapiens
ugugaacuguagauagucuu

SEQ ID NO: 165493 - RNA, 22 nt, Homo sapiens
ugugacagguauccuguguucu

SEQ ID NO: 165494 - RNA, 22 nt, Homo sapiens
ugugacaguuaguuugguguua

SEQ ID NO: 165495 - RNA, 21 nt, Homo sapiens
ugugaccucugucucugaguc

SEQ ID NO: 165496 - RNA, 22 nt, Homo sapiens
ugugauagagaaugguggagaa

SEQ ID NO: 165497 - RNA, 22 nt, Homo sapiens
ugugaucaugcuccaggcgaga

SEQ ID NO: 165498 - RNA, 22 nt, Homo sapiens
ugugaugaagaguccaagaaca

SEQ ID NO: 165499 - RNA, 22 nt, Homo sapiens
ugugcaaaaacaauugcgguuu

SEQ ID NO: 165500 - RNA, 18 nt, Homo sapiens
ugugcaauauuaaccacc

SEQ ID NO: 165501 - RNA, 22 nt, Homo sapiens
ugugcacaugauauaucacaua

SEQ ID NO: 165502 - RNA, 22 nt, Homo sapiens
ugugcaguuuugagugaauuuc

SEQ ID NO: 165503 - RNA, 22 nt, Homo sapiens
ugugccacuccagcucuagcuu

SEQ ID NO: 165504 - RNA, 22 nt, Homo sapiens
ugugccacugcacucccgccug

SEQ ID NO: 165505 - RNA, 22 nt, Homo sapiens
uucagagcauugguuuuuugaa

SEQ ID NO: 165506 - RNA, 22 nt, Homo sapiens
uucagaucaucccagcuccacu

SEQ ID NO: 165507 - RNA, 19 nt, Homo sapiens
uucagcagugucugcucuu

SEQ ID NO: 165508 - RNA, 22 nt, Homo sapiens
uucaggcaccauugucauugau

SEQ ID NO: 165509 - RNA, 22 nt, Homo sapiens
uucaggcuccgugccagcuccg

SEQ ID NO: 165510 - RNA, 22 nt, Homo sapiens
uucagggagaaggcaaacguug

SEQ ID NO: 165511 - RNA, 22 nt, Homo sapiens
uucaguauugcaccuggagucc

SEQ ID NO: 165512 - RNA, 22 nt, Homo sapiens
uucaguccauuuccuuggucac

SEQ ID NO: 165513 - RNA, 21 nt, Homo sapiens
uucauaaggcuucucuccugu

SEQ ID NO: 165514 - RNA, 22 nt, Homo sapiens
uucauaguguuuccuuccagug

SEQ ID NO: 165515 - RNA, 22 nt, Homo sapiens
uucauaguuuauacugauauuu

SEQ ID NO: 165516 - RNA, 22 nt, Homo sapiens
uucaucaggaauauugaccugu

SEQ ID NO: 165517 - RNA, 23 nt, Homo sapiens
uucaucagggauauuggccugaa

SEQ ID NO: 165518 - RNA, 22 nt, Homo sapiens
uucaucagggguauuggccaau

SEQ ID NO: 165519 - RNA, 22 nt, Homo sapiens
uucauguaauuccauaagguaa

SEQ ID NO: 165520 - RNA, 22 nt, Homo sapiens
uuccacaaugguugaacuaauu

SEQ ID NO: 165521 - RNA, 22 nt, Homo sapiens
uuccacaaugguugaacuagcu

SEQ ID NO: 165522 - RNA, 22 nt, Homo sapiens
uuccacaaugguugaacuaguu

SEQ ID NO: 165523 - RNA, 22 nt, Homo sapiens
uuccacuuuuuccuugugcucc

SEQ ID NO: 165524 - RNA, 22 nt, Homo sapiens
uuccaguuauuauaccucuuaa

SEQ ID NO: 165525 - RNA, 22 nt, Homo sapiens
uuccaugagaugcaucaaagcu

SEQ ID NO: 165526 - RNA, 22 nt, Homo sapiens
uucccaguggaacauguaguca

SEQ ID NO: 165527 - RNA, 22 nt, Homo sapiens
uucccucagaaacacacagccc

SEQ ID NO: 165528 - RNA, 22 nt, Homo sapiens
uucccugaguaucuuaccaugg

SEQ ID NO: 165529 - RNA, 22 nt, Homo sapiens
uucccuguaucuucugccaugu

SEQ ID NO: 165530 - RNA, 22 nt, Homo sapiens
uucccugugggaguaggaaagu

SEQ ID NO: 165531 - RNA, 22 nt, Homo sapiens
uucccugugguauagaagccgu

SEQ ID NO: 165532 - RNA, 22 nt, Homo sapiens
uucccuuugugcauaggauuug

SEQ ID NO: 165533 - RNA, 22 nt, Homo sapiens
uuccugagagggcugggugcag

SEQ ID NO: 165534 - RNA, 22 nt, Homo sapiens
uuccuuguagcaaaugcgauga

SEQ ID NO: 165535 - RNA, 22 nt, Homo sapiens
uuccuugugacuaguagugacc

SEQ ID NO: 165536 - RNA, 20 nt, Homo sapiens
uucuacagucacaggaagau

SEQ ID NO: 165537 - RNA, 21 nt, Homo sapiens
uucuacuccggcguuguuuuu

SEQ ID NO: 165538 - RNA, 22 nt, Homo sapiens
uucuagagagaagacuuaagcu

SEQ ID NO: 165539 - RNA, 22 nt, Homo sapiens
uucucaguaauuccagauuuuu

SEQ ID NO: 165540 - RNA, 22 nt, Homo sapiens
uucucugggacauaggucgggu

SEQ ID NO: 165541 - RNA, 22 nt, Homo sapiens
uucucuguggauugggugagag

SEQ ID NO: 165542 - RNA, 22 nt, Homo sapiens
uucugcuagucugucagaucuu

SEQ ID NO: 165543 - RNA, 22 nt, Homo sapiens
uucugugcuuguggaugaagug

SEQ ID NO: 165544 - RNA, 22 nt, Homo sapiens
uucugugguugaaaggagagau

SEQ ID NO: 165545 - RNA, 21 nt, Homo sapiens
uucuucaggcagaaggauuau

SEQ ID NO: 165546 - RNA, 22 nt, Homo sapiens
uucuucaguuacaacaaggggg

SEQ ID NO: 165547 - RNA, 22 nt, Homo sapiens
uucuugguguaguaguugaaaa

SEQ ID NO: 165548 - RNA, 22 nt, Homo sapiens
uucuuuggaaacaguacuaauu

SEQ ID NO: 165549 - RNA, 22 nt, Homo sapiens
uugaaauguuuagaaguuugga

SEQ ID NO: 165550 - RNA, 22 nt, Homo sapiens
uugaacuagaaccugcaaauuu

SEQ ID NO: 165551 - RNA, 22 nt, Homo sapiens
uugaagacuaaguuaucaggau

SEQ ID NO: 165552 - RNA, 22 nt, Homo sapiens
uugaagacuaauuuagauaaug

SEQ ID NO: 165553 - RNA, 22 nt, Homo sapiens
uugaagagaaccgcggcuuauu

SEQ ID NO: 165554 - RNA, 22 nt, Homo sapiens
uugaauagugacuuugauucug

SEQ ID NO: 165555 - RNA, 22 nt, Homo sapiens
uugaaugaaauuggugugggga

SEQ ID NO: 165556 - RNA, 22 nt, Homo sapiens
uugaauggaauguuggaacuau

SEQ ID NO: 165557 - RNA, 22 nt, Homo sapiens
uugaaugucuauuaaguuguuu

SEQ ID NO: 165558 - RNA, 22 nt, Homo sapiens
uugacaaggagccauugcaucu

SEQ ID NO: 165559 - RNA, 20 nt, Homo sapiens
uugacaguggguuguuaaag

SEQ ID NO: 165560 - RNA, 22 nt, Homo sapiens
uugaccacugggcacaguaagu

SEQ ID NO: 165561 - RNA, 22 nt, Homo sapiens
uugaccuggagaguacuuugac

SEQ ID NO: 165562 - RNA, 22 nt, Homo sapiens
uugacuucagagcugauucaag

SEQ ID NO: 165563 - RNA, 22 nt, Homo sapiens
uugagaagugucuguucauguc

SEQ ID NO: 165564 - RNA, 22 nt, Homo sapiens
uugagauaggagcuguuguucu

SEQ ID NO: 165565 - RNA, 22 nt, Homo sapiens
uugagaugauggauaugcuaau

SEQ ID NO: 165566 - RNA, 22 nt, Homo sapiens
uugagauggagccucacucugc

SEQ ID NO: 165567 - RNA, 22 nt, Homo sapiens
uugagauggagcuucacucuug

SEQ ID NO: 165568 - RNA, 22 nt, Homo sapiens
uugagauggagucucacucugu

SEQ ID NO: 165569 - RNA, 22 nt, Homo sapiens
uugagauggagucucacucuuc

SEQ ID NO: 165570 - RNA, 22 nt, Homo sapiens
uugagauggagucuugcacugu

SEQ ID NO: 165571 - RNA, 22 nt, Homo sapiens
uugagauggagucuuguucuuu

SEQ ID NO: 165572 - RNA, 22 nt, Homo sapiens
uugagauggaguuucaauauug

SEQ ID NO: 165573 - RNA, 22 nt, Homo sapiens
uugagauggaguuucgcucuuu

SEQ ID NO: 165574 - RNA, 22 nt, Homo sapiens
uugagauguaagauguuaauau

SEQ ID NO: 165575 - RNA, 22 nt, Homo sapiens
uugagauguggcaguuuaugag

SEQ ID NO: 165576 - RNA, 22 nt, Homo sapiens
uugagcacaggaguuugagacc

SEQ ID NO: 165577 - RNA, 22 nt, Homo sapiens
uugagcuuuuuacuuguccaau

SEQ ID NO: 165578 - RNA, 22 nt, Homo sapiens
uugaggaggcagucuucccauu

SEQ ID NO: 165579 - RNA, 22 nt, Homo sapiens
uugaggaguacugauuagguau

SEQ ID NO: 165580 - RNA, 22 nt, Homo sapiens
uugaggcaaugaggagaagcug

SEQ ID NO: 165581 - RNA, 22 nt, Homo sapiens
uugagggcugaauaccaaucag

SEQ ID NO: 165582 - RNA, 22 nt, Homo sapiens
uugagguaguacuuauuauugg

SEQ ID NO: 165583 - RNA, 22 nt, Homo sapiens
uugaggugaauuugcaggaugc

SEQ ID NO: 165584 - RNA, 22 nt, Homo sapiens
uugaggugggaggaucacuuga

SEQ ID NO: 165585 - RNA, 20 nt, Homo sapiens
uugaggugugaggggcagag

SEQ ID NO: 165586 - RNA, 22 nt, Homo sapiens
uugaguccccacacuggguccc

SEQ ID NO: 165587 - RNA, 22 nt, Homo sapiens
uugagugaaugaaugauuaaau

SEQ ID NO: 165588 - RNA, 22 nt, Homo sapiens
uugaguuugaguauucuaaagc

SEQ ID NO: 165589 - RNA, 22 nt, Homo sapiens
aaaagucuguagugaaagguga

SEQ ID NO: 165590 - RNA, 22 nt, Homo sapiens
aaaccaccauuacuuuugcacc

SEQ ID NO: 165591 - RNA, 18 nt, Homo sapiens
aaacugcuuccuuggccu

SEQ ID NO: 165592 - RNA, 22 nt, Homo sapiens
aaagaguucagguagauuucaa

SEQ ID NO: 165593 - RNA, 22 nt, Homo sapiens
aaagcuaagguagcauuggaga

SEQ ID NO: 165594 - RNA, 22 nt, Homo sapiens
aaaggcacacacuccuuguuau

SEQ ID NO: 165595 - RNA, 22 nt, Homo sapiens
aaaggcacuagaaguuaccuuu

SEQ ID NO: 165596 - RNA, 20 nt, Homo sapiens
aaaggcugugagaacgagau

SEQ ID NO: 165597 - RNA, 22 nt, Homo sapiens
aaaggcuucggaucagaaggua

SEQ ID NO: 165598 - RNA, 22 nt, Homo sapiens
aaaguacucaguucaguuccgu

SEQ ID NO: 165599 - RNA, 19 nt, Homo sapiens
aaaguacucugaugccucu

SEQ ID NO: 165600 - RNA, 22 nt, Homo sapiens
aaagucuagaggaucaugugug

SEQ ID NO: 165601 - RNA, 18 nt, Homo sapiens
aaagugaugucauucuuu

SEQ ID NO: 165602 - RNA, 22 nt, Homo sapiens
aaagugcacuuggaagagggcc

SEQ ID NO: 165603 - RNA, 22 nt, Homo sapiens
aaagugcuaggauuaccugggg

SEQ ID NO: 165604 - RNA, 22 nt, Homo sapiens
aaagugcugagaguucuaacuu

SEQ ID NO: 165605 - RNA, 22 nt, Homo sapiens
aaagugcuuccuuuuugagggu

SEQ ID NO: 165606 - RNA, 22 nt, Homo sapiens
aaaguggugugaguauguaucu

SEQ ID NO: 165607 - RNA, 22 nt, Homo sapiens
aaaguucuguugauagugcuga

SEQ ID NO: 165608 - RNA, 22 nt, Homo sapiens
aaaucccuugcucucucagacc

SEQ ID NO: 165609 - RNA, 22 nt, Homo sapiens
aaaugcacagaaaggaugugga

SEQ ID NO: 165610 - RNA, 22 nt, Homo sapiens
aauggcuuuuaauauccauaau

SEQ ID NO: 165611 - RNA, 22 nt, Homo sapiens
aaugugcacuauuagggugaua

SEQ ID NO: 165612 - RNA, 22 nt, Homo sapiens
aaugugcuuucuuucacacagu

SEQ ID NO: 165613 - RNA, 22 nt, Homo sapiens
aauugcacuaagcauaguccag

SEQ ID NO: 165614 - RNA, 22 nt, Homo sapiens
aauugguuaagauaagaucaua

SEQ ID NO: 165615 - RNA, 23 nt, Homo sapiens
acacaguaaacuaaaagcuagcu

SEQ ID NO: 165616 - RNA, 22 nt, Homo sapiens
acacagucaaauccacuuggcu

SEQ ID NO: 165617 - RNA, 22 nt, Homo sapiens
acaccaucuccuuauuucucuu

SEQ ID NO: 165618 - RNA, 22 nt, Homo sapiens
acacguguugaaauuuaauugc

SEQ ID NO: 165619 - RNA, 22 nt, Homo sapiens
acacuguauccuucuguccuuu

SEQ ID NO: 165620 - RNA, 22 nt, Homo sapiens
acacuguccaguuaggcuacau

SEQ ID NO: 165621 - RNA, 22 nt, Homo sapiens
acacugucugaugaaaguaguu

SEQ ID NO: 165622 - RNA, 22 nt, Homo sapiens
acagaaccauucacuccccugg

SEQ ID NO: 165623 - RNA, 22 nt, Homo sapiens
acagaauucucagaacugggag

SEQ ID NO: 165624 - RNA, 22 nt, Homo sapiens
acagcacugccaagugacccau

SEQ ID NO: 165625 - RNA, 22 nt, Homo sapiens
acaggagugggauuugaguccu

SEQ ID NO: 165626 - RNA, 22 nt, Homo sapiens
acagguacaagggauuaggaug

SEQ ID NO: 165627 - RNA, 21 nt, Homo sapiens
acaguaguaauaguguagcca

SEQ ID NO: 165628 - RNA, 20 nt, Homo sapiens
acaguauguuuggaugcaua

SEQ ID NO: 165629 - RNA, 22 nt, Homo sapiens
acagucacaauuuguaccuuuu

SEQ ID NO: 165630 - RNA, 18 nt, Homo sapiens
acagugcugucacugcuu

SEQ ID NO: 165631 - RNA, 17 nt, Homo sapiens
acagugcuuugcuuucc

SEQ ID NO: 165632 - RNA, 22 nt, Homo sapiens
acagugcuuuuguuccucuccu

SEQ ID NO: 165633 - RNA, 23 nt, Homo sapiens
acaguggugugaucuuggcucag

SEQ ID NO: 165634 - RNA, 22 nt, Homo sapiens
acauaguagacacugaaaauau

SEQ ID NO: 165635 - RNA, 22 nt, Homo sapiens
acauauaaggagacuagggcau

SEQ ID NO: 165636 - RNA, 22 nt, Homo sapiens
acauaugaguacaugugccaug

SEQ ID NO: 165637 - RNA, 22 nt, Homo sapiens
acaucauugggggcuacaggug

SEQ ID NO: 165638 - RNA, 22 nt, Homo sapiens
acaucccaugccuggguacucc

SEQ ID NO: 165639 - RNA, 22 nt, Homo sapiens
acaugcauggcaugcauuguac

SEQ ID NO: 165640 - RNA, 22 nt, Homo sapiens
acauguauauaaugcauagcga

SEQ ID NO: 165641 - RNA, 17 nt, Homo sapiens
accagugcaugugcuuu

SEQ ID NO: 165642 - RNA, 22 nt, Homo sapiens
acccaguaacauaugggaggga

SEQ ID NO: 165643 - RNA, 22 nt, Homo sapiens
acccaguguugggcagaacugu

SEQ ID NO: 165644 - RNA, 22 nt, Homo sapiens
acccucaagggacugacagaau

SEQ ID NO: 165645 - RNA, 22 nt, Homo sapiens
acccucagaccaguuucccugg

SEQ ID NO: 165646 - RNA, 18 nt, Homo sapiens
acccuucagcacugggcc

SEQ ID NO: 165647 - RNA, 22 nt, Homo sapiens
acccuuuagguuggaugaggau

SEQ ID NO: 165648 - RNA, 22 nt, Homo sapiens
accugggugcugaugggcuuua

SEQ ID NO: 165649 - RNA, 22 nt, Homo sapiens
accuggguguauguucaguuug

SEQ ID NO: 165650 - RNA, 22 nt, Homo sapiens
accugugguuacagucugucuc

SEQ ID NO: 165651 - RNA, 22 nt, Homo sapiens
acugagaucuuuaaauaaauaa

SEQ ID NO: 165652 - RNA, 22 nt, Homo sapiens
acugagccuuuaaaugacuuca

SEQ ID NO: 165653 - RNA, 22 nt, Homo sapiens
acugagucauugaggcccucuc

SEQ ID NO: 165654 - RNA, 22 nt, Homo sapiens
acugagucauugggugcccaga

SEQ ID NO: 165655 - RNA, 22 nt, Homo sapiens
acugcacuccagccuaggcgac

SEQ ID NO: 165656 - RNA, 22 nt, Homo sapiens
acugcacuccagccugagccug

SEQ ID NO: 165657 - RNA, 22 nt, Homo sapiens
acugcacuccagccugcugggu

SEQ ID NO: 165658 - RNA, 22 nt, Homo sapiens
acugcacuccagccuggacgaa

SEQ ID NO: 165659 - RNA, 22 nt, Homo sapiens
acugcacuccagccuggacgac

SEQ ID NO: 165660 - RNA, 22 nt, Homo sapiens
acugcacuccagccuggcggac

SEQ ID NO: 165661 - RNA, 22 nt, Homo sapiens
acugcacuccagccugugcgua

SEQ ID NO: 165662 - RNA, 22 nt, Homo sapiens
acugcacuccagccuugcgaca

SEQ ID NO: 165663 - RNA, 22 nt, Homo sapiens
acugcacuccagccuuggccac

SEQ ID NO: 165664 - RNA, 22 nt, Homo sapiens
acugcacuccagccuuggcggc

SEQ ID NO: 165665 - RNA, 22 nt, Homo sapiens
acugcacuccagccuugugaca

SEQ ID NO: 165666 - RNA, 20 nt, Homo sapiens
acugcacuccaggcugccca

SEQ ID NO: 165667 - RNA, 20 nt, Homo sapiens
acugcacuccagucucuggg

SEQ ID NO: 165668 - RNA, 22 nt, Homo sapiens
acugcacuccaguuccgggcaa

SEQ ID NO: 165669 - RNA, 22 nt, Homo sapiens
acugcacucccgcccgggugac

SEQ ID NO: 165670 - RNA, 22 nt, Homo sapiens
acugcacucuagccuuggcaac

SEQ ID NO: 165671 - RNA, 22 nt, Homo sapiens
acugcacugcagccuggccaac

SEQ ID NO: 165672 - RNA, 20 nt, Homo sapiens
acuggcacugguaggugugg

SEQ ID NO: 165673 - RNA, 19 nt, Homo sapiens
acuuuggugauuagaggga

SEQ ID NO: 165674 - RNA, 22 nt, Homo sapiens
acuuuguuauggcaacccuaag

SEQ ID NO: 165675 - RNA, 22 nt, Homo sapiens
acuuuuugauggggagaacauu

SEQ ID NO: 165676 - RNA, 22 nt, Homo sapiens
agaacuguccauucagcaugaa

SEQ ID NO: 165677 - RNA, 19 nt, Homo sapiens
agaagugcauggucuagag

SEQ ID NO: 165678 - RNA, 22 nt, Homo sapiens
agaauguaaacagaauagagga

SEQ ID NO: 165679 - RNA, 22 nt, Homo sapiens
agaaugucaguauuggcuaaaa

SEQ ID NO: 165680 - RNA, 22 nt, Homo sapiens
agacaagauggcuugagguuca

SEQ ID NO: 165681 - RNA, 22 nt, Homo sapiens
agacacuguugaaaaggcccca

SEQ ID NO: 165682 - RNA, 22 nt, Homo sapiens
agacagcuggaguaucauagcu

SEQ ID NO: 165683 - RNA, 22 nt, Homo sapiens
agacaguauuggcaaagugugu

SEQ ID NO: 165684 - RNA, 20 nt, Homo sapiens
agacaguguggagauuccuu

SEQ ID NO: 165685 - RNA, 20 nt, Homo sapiens
agacuagggagcagaaagcc

SEQ ID NO: 165686 - RNA, 22 nt, Homo sapiens
agagaacuguuuacacguuaau

SEQ ID NO: 165687 - RNA, 22 nt, Homo sapiens
agagagcuugggguguuaaauu

SEQ ID NO: 165688 - RNA, 20 nt, Homo sapiens
agagaucaguaauucaucaa

SEQ ID NO: 165689 - RNA, 18 nt, Homo sapiens
agagcacugaguuuuaga

SEQ ID NO: 165690 - RNA, 22 nt, Homo sapiens
agagcacuguggguccaaauau

SEQ ID NO: 165691 - RNA, 22 nt, Homo sapiens
agagcuguguuuuaacuuuuua

SEQ ID NO: 165692 - RNA, 21 nt, Homo sapiens
agaggacugaccacagcccua

SEQ ID NO: 165693 - RNA, 22 nt, Homo sapiens
agagguaugccugggcuggagc

SEQ ID NO: 165694 - RNA, 22 nt, Homo sapiens
agagguuuaacuggcuuauggu

SEQ ID NO: 165695 - RNA, 22 nt, Homo sapiens
auaaauucauuuaagcuccuua

SEQ ID NO: 165696 - RNA, 22 nt, Homo sapiens
auaacauggaguuugucauuua

SEQ ID NO: 165697 - RNA, 18 nt, Homo sapiens
auaaccuggugcuuucaa

SEQ ID NO: 165698 - RNA, 22 nt, Homo sapiens
auaagaguaguacauaugagac

SEQ ID NO: 165699 - RNA, 22 nt, Homo sapiens
auaaguagaaugauggucaaaa

SEQ ID NO: 165700 - RNA, 22 nt, Homo sapiens
auaagugagugauucaguguua

SEQ ID NO: 165701 - RNA, 22 nt, Homo sapiens
auacaaguuauuugaacugcgg

SEQ ID NO: 165702 - RNA, 22 nt, Homo sapiens
auacacgugcagaacaugcagg

SEQ ID NO: 165703 - RNA, 22 nt, Homo sapiens
auacaguaucuucuggcaagca

SEQ ID NO: 165704 - RNA, 22 nt, Homo sapiens
auacagugaauaucuggggcag

SEQ ID NO: 165705 - RNA, 16 nt, Homo sapiens
auaccacagugacaca

SEQ ID NO: 165706 - RNA, 19 nt, Homo sapiens
auaccucugugaaccccug

SEQ ID NO: 165707 - RNA, 22 nt, Homo sapiens
auacuccugucucagcugagau

SEQ ID NO: 165708 - RNA, 22 nt, Homo sapiens
auacuguuucugaacuuugauu

SEQ ID NO: 165709 - RNA, 21 nt, Homo sapiens
auacuugagacuggguaauuu

SEQ ID NO: 165710 - RNA, 22 nt, Homo sapiens
auagcacuuauagauuuggucu

SEQ ID NO: 165711 - RNA, 21 nt, Homo sapiens
auagcacuucacuugguuaga

SEQ ID NO: 165712 - RNA, 22 nt, Homo sapiens
auagcagacauuucaaggcagg

SEQ ID NO: 165713 - RNA, 22 nt, Homo sapiens
auagcagugugaaaauguacua

SEQ ID NO: 165714 - RNA, 22 nt, Homo sapiens
auagugcuauggcagaccuuga

SEQ ID NO: 165715 - RNA, 22 nt, Homo sapiens
auagugcugcaauaaccauggg

SEQ ID NO: 165716 - RNA, 19 nt, Homo sapiens
auauaacauccaggagcag

SEQ ID NO: 165717 - RNA, 22 nt, Homo sapiens
auauaccuaggcuacaugguuu

SEQ ID NO: 165718 - RNA, 22 nt, Homo sapiens
auauaugcuaagugcuaauaaa

SEQ ID NO: 165719 - RNA, 22 nt, Homo sapiens
auaucaacaugguaggguuggu

SEQ ID NO: 165720 - RNA, 22 nt, Homo sapiens
auaucacucccaauaucgcagg

SEQ ID NO: 165721 - RNA, 22 nt, Homo sapiens
auaucccuguauaagugaaugu

SEQ ID NO: 165722 - RNA, 22 nt, Homo sapiens
auaugcacaguggaguacuauu

SEQ ID NO: 165723 - RNA, 20 nt, Homo sapiens
auaugcauguguuuucacuu

SEQ ID NO: 165724 - RNA, 22 nt, Homo sapiens
auaugcuuauuagcaagaaaua

SEQ ID NO: 165725 - RNA, 22 nt, Homo sapiens
auauguaguuucagaaguggaa

SEQ ID NO: 165726 - RNA, 17 nt, Homo sapiens
auaugucugcuggggga

SEQ ID NO: 165727 - RNA, 22 nt, Homo sapiens
auauuacagagaggaccuggga

SEQ ID NO: 165728 - RNA, 22 nt, Homo sapiens
auauucacagguaucagagauu

SEQ ID NO: 165729 - RNA, 19 nt, Homo sapiens
aucaaacugcucuuugagg

SEQ ID NO: 165730 - RNA, 20 nt, Homo sapiens
aucaaagacuuagaggggga

SEQ ID NO: 165731 - RNA, 22 nt, Homo sapiens
aucaaaguuucccagaaguugu

SEQ ID NO: 165732 - RNA, 22 nt, Homo sapiens
aucacaggcaaaauuccuucuc

SEQ ID NO: 165733 - RNA, 22 nt, Homo sapiens
aucacagugaaaacagucaauu

SEQ ID NO: 165734 - RNA, 22 nt, Homo sapiens
aucacaguggucagguauagau

SEQ ID NO: 165735 - RNA, 22 nt, Homo sapiens
aucacauggccuagccuaaccu

SEQ ID NO: 165736 - RNA, 19 nt, Homo sapiens
aucaccagucuuuccacug

SEQ ID NO: 165737 - RNA, 22 nt, Homo sapiens
aucaccuggaguagcccguccc

SEQ ID NO: 165738 - RNA, 22 nt, Homo sapiens
aucacugggagcagccauuaau

SEQ ID NO: 165739 - RNA, 22 nt, Homo sapiens
aucacuggucaugagagaagua

SEQ ID NO: 165740 - RNA, 22 nt, Homo sapiens
aucacuguccacucaucuuucu

SEQ ID NO: 165741 - RNA, 22 nt, Homo sapiens
aucagaguugucagggagcuuu

SEQ ID NO: 165742 - RNA, 22 nt, Homo sapiens
aucaggaaccuuuuuggugugu

SEQ ID NO: 165743 - RNA, 22 nt, Homo sapiens
aucagugagugguuagugaaug

SEQ ID NO: 165744 - RNA, 22 nt, Homo sapiens
aucagugcagugggaacuagaa

SEQ ID NO: 165745 - RNA, 22 nt, Homo sapiens
aucccaguucagccucugacac

SEQ ID NO: 165746 - RNA, 22 nt, Homo sapiens
aucccugugauccaaucacuuc

SEQ ID NO: 165747 - RNA, 21 nt, Homo sapiens
auccuucuuuuucaaccugug

SEQ ID NO: 165748 - RNA, 22 nt, Homo sapiens
aucgcaauguuuagaauuuugu

SEQ ID NO: 165749 - RNA, 22 nt, Homo sapiens
aucgcaccauugcacuccagca

SEQ ID NO: 165750 - RNA, 22 nt, Homo sapiens
aucuacuugcugggucucugga

SEQ ID NO: 165751 - RNA, 22 nt, Homo sapiens
aucuagagaggcagucuggccg

SEQ ID NO: 165752 - RNA, 16 nt, Homo sapiens
aucucagaccugcuga

SEQ ID NO: 165753 - RNA, 22 nt, Homo sapiens
aucucagcaacuaaagauccuu

SEQ ID NO: 165754 - RNA, 22 nt, Homo sapiens
aucucauuccuucugggcugau

SEQ ID NO: 165755 - RNA, 22 nt, Homo sapiens
aucucuugccagucagaauggu

SEQ ID NO: 165756 - RNA, 19 nt, Homo sapiens
aucuggaguuccuggggcu

SEQ ID NO: 165757 - RNA, 22 nt, Homo sapiens
aucugggguuggcaaaguuugg

SEQ ID NO: 165758 - RNA, 22 nt, Homo sapiens
aucugguguuuccuucacauug

SEQ ID NO: 165759 - RNA, 22 nt, Homo sapiens
aucuuggauuaccugggugggu

SEQ ID NO: 165760 - RNA, 22 nt, Homo sapiens
aucuuugauuagacugauggau

SEQ ID NO: 165761 - RNA, 22 nt, Homo sapiens
aucuuugauuguagguacaaug

SEQ ID NO: 165762 - RNA, 22 nt, Homo sapiens
aucuuuggauacuugauauagu

SEQ ID NO: 165763 - RNA, 22 nt, Homo sapiens
aucuuuggcgggaauaucacag

SEQ ID NO: 165764 - RNA, 22 nt, Homo sapiens
aucuuuggugaguucuuugguc

SEQ ID NO: 165765 - RNA, 22 nt, Homo sapiens
aucuuuggugcaugauacuuug

SEQ ID NO: 165766 - RNA, 22 nt, Homo sapiens
augaaagguugucuuaagccau

SEQ ID NO: 165767 - RNA, 22 nt, Homo sapiens
augaaaucacugugaugcccua

SEQ ID NO: 165768 - RNA, 22 nt, Homo sapiens
augaacucaucauuuuuauggc

SEQ ID NO: 165769 - RNA, 22 nt, Homo sapiens
augaauguaaagaaugugggaa

SEQ ID NO: 165770 - RNA, 22 nt, Homo sapiens
augacauguauuuccaggauuu

SEQ ID NO: 165771 - RNA, 19 nt, Homo sapiens
augacauuuggggguggac

SEQ ID NO: 165772 - RNA, 22 nt, Homo sapiens
augaccagagagugcgcagggu

SEQ ID NO: 165773 - RNA, 22 nt, Homo sapiens
augaccauuucaauugauaugg

SEQ ID NO: 165774 - RNA, 22 nt, Homo sapiens
augacccugaccuaagccaauc

SEQ ID NO: 165775 - RNA, 19 nt, Homo sapiens
augagaacagacuccauuu

SEQ ID NO: 165776 - RNA, 22 nt, Homo sapiens
augagaacugucaaugagagcu

SEQ ID NO: 165777 - RNA, 22 nt, Homo sapiens
augagaauguaaguuaaugaaa

SEQ ID NO: 165778 - RNA, 22 nt, Homo sapiens
augagacauuaaaguguguuug

SEQ ID NO: 165779 - RNA, 22 nt, Homo sapiens
augagagcaacaccuucacuug

SEQ ID NO: 165780 - RNA, 22 nt, Homo sapiens
auucaagugaugcagcuguuuu

SEQ ID NO: 165781 - RNA, 22 nt, Homo sapiens
auucacagcuuuaaaaggcgug

SEQ ID NO: 165782 - RNA, 22 nt, Homo sapiens
auucaucagggauauuggucug

SEQ ID NO: 165783 - RNA, 22 nt, Homo sapiens
auugaacacuucugugugccag

SEQ ID NO: 165784 - RNA, 23 nt, Homo sapiens
auugaacacuuucauaugugagg

SEQ ID NO: 165785 - RNA, 22 nt, Homo sapiens
auugacuugauauauagcugau

SEQ ID NO: 165786 - RNA, 22 nt, Homo sapiens
auugagcuuuuuaaaauauagu

SEQ ID NO: 165787 - RNA, 22 nt, Homo sapiens
auugcaaagcguagacucuaaa

SEQ ID NO: 165788 - RNA, 21 nt, Homo sapiens
auugcacuccagccugggcga

SEQ ID NO: 165789 - RNA, 22 nt, Homo sapiens
auugcacuccagccugggcgac

SEQ ID NO: 165790 - RNA, 22 nt, Homo sapiens
auugcacuccagccugggugac

SEQ ID NO: 165791 - RNA, 22 nt, Homo sapiens
auugcaguuagaacagaagucu

SEQ ID NO: 165792 - RNA, 22 nt, Homo sapiens
auuggcauauccacgacaaugc

SEQ ID NO: 165793 - RNA, 22 nt, Homo sapiens
auuggcuuuauacauaagaaua

SEQ ID NO: 165794 - RNA, 22 nt, Homo sapiens
auuggugaccugcggcaguaug

SEQ ID NO: 165795 - RNA, 22 nt, Homo sapiens
auuguaauuuuagagaaagugg

SEQ ID NO: 165796 - RNA, 22 nt, Homo sapiens
auuguucuuacaugcugucauc

SEQ ID NO: 165797 - RNA, 22 nt, Homo sapiens
auuucacugagacaugugccca

SEQ ID NO: 165798 - RNA, 22 nt, Homo sapiens
auuucacuucgcaugguguccg

SEQ ID NO: 165799 - RNA, 21 nt, Homo sapiens
auuugcacugagcuccugugc

SEQ ID NO: 165800 - RNA, 20 nt, Homo sapiens
auuugcauuauggagcaccc

SEQ ID NO: 165801 - RNA, 22 nt, Homo sapiens
auuuggcauagaguaucauucu

SEQ ID NO: 165802 - RNA, 22 nt, Homo sapiens
auuuguccugccuuuuccuccu

SEQ ID NO: 165803 - RNA, 22 nt, Homo sapiens
auuuugcauugcuguaaaggaa

SEQ ID NO: 165804 - RNA, 22 nt, Homo sapiens
caaagcuauagcaccagaggga

SEQ ID NO: 165805 - RNA, 22 nt, Homo sapiens
caaagucuauucuacccuuacc

SEQ ID NO: 165806 - RNA, 22 nt, Homo sapiens
caaagugcuggccgggcgcagu

SEQ ID NO: 165807 - RNA, 22 nt, Homo sapiens
caaagugcugggacuggccggg

SEQ ID NO: 165808 - RNA, 22 nt, Homo sapiens
caaagugguuuauacaugauug

SEQ ID NO: 165809 - RNA, 19 nt, Homo sapiens
caaaguguucuucuuugcc

SEQ ID NO: 165810 - RNA, 22 nt, Homo sapiens
caaaugaucugcuggccucagc

SEQ ID NO: 165811 - RNA, 22 nt, Homo sapiens
caaaugcuucuauggacugucu

SEQ ID NO: 165812 - RNA, 22 nt, Homo sapiens
caaauugcuuguggaggauaau

SEQ ID NO: 165813 - RNA, 22 nt, Homo sapiens
caacacagugaaacccgucucu

SEQ ID NO: 165814 - RNA, 22 nt, Homo sapiens
caacacuguuuauuggauagcc

SEQ ID NO: 165815 - RNA, 22 nt, Homo sapiens
caaggcacagccccuacuuccu

SEQ ID NO: 165816 - RNA, 22 nt, Homo sapiens
caagugcucuaggauccugagu

SEQ ID NO: 165817 - RNA, 22 nt, Homo sapiens
caaucugucuuuuagggggcca

SEQ ID NO: 165818 - RNA, 21 nt, Homo sapiens
caaugacacuguagcugugcu

SEQ ID NO: 165819 - RNA, 22 nt, Homo sapiens
cacacuguuuuccauggggguu

SEQ ID NO: 165820 - RNA, 22 nt, Homo sapiens
cacagcuaacaacuguuucuuc

SEQ ID NO: 165821 - RNA, 22 nt, Homo sapiens
cacagugaacaauauccucugu

SEQ ID NO: 165822 - RNA, 22 nt, Homo sapiens
cacaguguucauagccaucagg

SEQ ID NO: 165823 - RNA, 22 nt, Homo sapiens
cacaguguuccagcuauuugaa

SEQ ID NO: 165824 - RNA, 22 nt, Homo sapiens
cacugaaugugagguuggggag

SEQ ID NO: 165825 - RNA, 22 nt, Homo sapiens
cacugcaguaaauugcgucggu

SEQ ID NO: 165826 - RNA, 22 nt, Homo sapiens
cacugcaguggaagauuaagaa

SEQ ID NO: 165827 - RNA, 22 nt, Homo sapiens
cacugcaguguaauuaagguug

SEQ ID NO: 165828 - RNA, 22 nt, Homo sapiens
cacugcauccuccauauccugg

SEQ ID NO: 165829 - RNA, 22 nt, Homo sapiens
cacugcauccuugaccuucugg

SEQ ID NO: 165830 - RNA, 22 nt, Homo sapiens
cacugcauggccacccauguua

SEQ ID NO: 165831 - RNA, 22 nt, Homo sapiens
cacugcauggucuagcuggguu

SEQ ID NO: 165832 - RNA, 22 nt, Homo sapiens
cacuggcacuguguuuagaugg

SEQ ID NO: 165833 - RNA, 17 nt, Homo sapiens
cacugggugcaagagga

SEQ ID NO: 165834 - RNA, 22 nt, Homo sapiens
cacugggugccauauguuugcu

SEQ ID NO: 165835 - RNA, 21 nt, Homo sapiens
cacuggguucaggcuugugga

SEQ ID NO: 165836 - RNA, 20 nt, Homo sapiens
cagagcaaagcaguccuggc

SEQ ID NO: 165837 - RNA, 22 nt, Homo sapiens
cagagcaaugcuuuugcuuuga

SEQ ID NO: 165838 - RNA, 21 nt, Homo sapiens
uuuggcuucucugcugcagcc

SEQ ID NO: 165839 - RNA, 22 nt, Homo sapiens
uuuggcuuuuguaauaacugcc

SEQ ID NO: 165840 - RNA, 22 nt, Homo sapiens
uuuggucacugccgccgccagc

SEQ ID NO: 165841 - RNA, 22 nt, Homo sapiens
uuuggucuuuuguaaguuaucu

SEQ ID NO: 165842 - RNA, 22 nt, Homo sapiens
uuugguuauuugaaacuagcau

SEQ ID NO: 165843 - RNA, 22 nt, Homo sapiens
uuuguacugagccaagauggua

SEQ ID NO: 165844 - RNA, 22 nt, Homo sapiens
uuuguagcucacucugagcuga

SEQ ID NO: 165845 - RNA, 22 nt, Homo sapiens
uuugucaauaacuaccaacagg

SEQ ID NO: 165846 - RNA, 21 nt, Homo sapiens
uuuguccaccuguguucacca

SEQ ID NO: 165847 - RNA, 22 nt, Homo sapiens
uuugucuccuaagacucugugg

SEQ ID NO: 165848 - RNA, 22 nt, Homo sapiens
uuugugcuccuaugagaaucua

SEQ ID NO: 165849 - RNA, 22 nt, Homo sapiens
uuugugcugcaauuaauuuccc

SEQ ID NO: 165850 - RNA, 21 nt, Homo sapiens
uuugugguuacugugugagcu

SEQ ID NO: 165851 - RNA, 21 nt, Homo sapiens
uuuguguccccacccaaaucu

SEQ ID NO: 165852 - RNA, 22 nt, Homo sapiens
uuuguguccccacccaaaucuc

SEQ ID NO: 165853 - RNA, 22 nt, Homo sapiens
uuuguguggccuuggccuggca

SEQ ID NO: 165854 - RNA, 22 nt, Homo sapiens
uuugugugugauuauaaaaggu

SEQ ID NO: 165855 - RNA, 22 nt, Homo sapiens
uuuuacacaucaccgcucgugu

SEQ ID NO: 165856 - RNA, 22 nt, Homo sapiens
uuuuagcuuuucccaggacucc

SEQ ID NO: 165857 - RNA, 22 nt, Homo sapiens
uuuuaguggaauauuuacaguu

SEQ ID NO: 165858 - RNA, 22 nt, Homo sapiens
uuuugcaauauguuccugaaua

SEQ ID NO: 165859 - RNA, 22 nt, Homo sapiens
uuuugcaggcauuggaaguuua

SEQ ID NO: 165860 - RNA, 20 nt, Homo sapiens
uuuuggacuaaaggcauccc

SEQ ID NO: 165861 - RNA, 22 nt, Homo sapiens
uuuuggacuucaauuugacacu

SEQ ID NO: 165862 - RNA, 22 nt, Homo sapiens
uuuugguauauacggggguccu

SEQ ID NO: 165863 - RNA, 22 nt, Homo sapiens
uuuuguacaacagcucugggga

SEQ ID NO: 165864 - RNA, 22 nt, Homo sapiens
uuuuugaguaaauauaaauugu

SEQ ID NO: 165865 - RNA, 22 nt, Homo sapiens
uuuuuuaguuagcugggcauga

SEQ ID NO: 165866 - RNA, 18 nt, Homo sapiens
aaaaagugcucaggccua

SEQ ID NO: 165867 - RNA, 22 nt, Homo sapiens
ugaguucaauuguauuuuauua

SEQ ID NO: 165868 - RNA, 23 nt, Homo sapiens
ugauaacagcauaugaagauucu

SEQ ID NO: 165869 - RNA, 22 nt, Homo sapiens
ugauaacauuucuucugguaca

SEQ ID NO: 165870 - RNA, 22 nt, Homo sapiens
ugauauauugaaugaugaaaca

SEQ ID NO: 165871 - RNA, 22 nt, Homo sapiens
ugauaucugaauagauacacaa

SEQ ID NO: 165872 - RNA, 22 nt, Homo sapiens
ugauaugcuuugaacucucugg

SEQ ID NO: 165873 - RNA, 21 nt, Homo sapiens
ugauaugguuuggauaugugu

SEQ ID NO: 165874 - RNA, 22 nt, Homo sapiens
ugauaugucacuugaucauggu

SEQ ID NO: 165875 - RNA, 22 nt, Homo sapiens
ugauauguguaaacaauguaua

SEQ ID NO: 165876 - RNA, 17 nt, Homo sapiens
ugauauuuucccagaua

SEQ ID NO: 165877 - RNA, 22 nt, Homo sapiens
ugaucacagcuugacuaaagga

SEQ ID NO: 165878 - RNA, 22 nt, Homo sapiens
ugaucuguccaccucagcuucc

SEQ ID NO: 165879 - RNA, 22 nt, Homo sapiens
ugaugacacugauuucuucaau

SEQ ID NO: 165880 - RNA, 22 nt, Homo sapiens
ugaugacucuguggccccaggc

SEQ ID NO: 165881 - RNA, 20 nt, Homo sapiens
ugaugcaaaucuuuaaaagu

SEQ ID NO: 165882 - RNA, 22 nt, Homo sapiens
ugaugcuacuaccugggcugaa

SEQ ID NO: 165883 - RNA, 22 nt, Homo sapiens
ugaugcugaugccugccagaag

SEQ ID NO: 165884 - RNA, 22 nt, Homo sapiens
ugauggccuguucuccauaugu

SEQ ID NO: 165885 - RNA, 22 nt, Homo sapiens
ugaugguuuuaaaaagaggagu

SEQ ID NO: 165886 - RNA, 22 nt, Homo sapiens
ugaugguuuuauuaauaggacc

SEQ ID NO: 165887 - RNA, 22 nt, Homo sapiens
ugaugucuugcaggcacgagau

SEQ ID NO: 165888 - RNA, 22 nt, Homo sapiens
ugcaaauguuaguaacaccacu

SEQ ID NO: 165889 - RNA, 22 nt, Homo sapiens
ugcaaauguuauuuugguuucu

SEQ ID NO: 165890 - RNA, 22 nt, Homo sapiens
ugcaagaaacauauuccacaag

SEQ ID NO: 165891 - RNA, 21 nt, Homo sapiens
ugcaagaaucaggaagcugcc

SEQ ID NO: 165892 - RNA, 22 nt, Homo sapiens
ugcaagaugagauuuuggaugg

SEQ ID NO: 165893 - RNA, 22 nt, Homo sapiens
ugcaagaugauuucaauugaua

SEQ ID NO: 165894 - RNA, 22 nt, Homo sapiens
ugcaauauccucuacuauaggu

SEQ ID NO: 165895 - RNA, 22 nt, Homo sapiens
ugcaaucaucgcuguuggccac

SEQ ID NO: 165896 - RNA, 22 nt, Homo sapiens
ugcacaguccagugcccacuga

SEQ ID NO: 165897 - RNA, 22 nt, Homo sapiens
ugcaccacacuccauccugggc

SEQ ID NO: 165898 - RNA, 22 nt, Homo sapiens
ugcaccacugcaccccagucug

SEQ ID NO: 165899 - RNA, 22 nt, Homo sapiens
ugcaccacugcacuccacccug

SEQ ID NO: 165900 - RNA, 19 nt, Homo sapiens
ugcagcaauguaaaagaca

SEQ ID NO: 165901 - RNA, 23 nt, Homo sapiens
ugcagcacacugaugggucuuga

SEQ ID NO: 165902 - RNA, 22 nt, Homo sapiens
ugcagcacuguucacaauagcc

SEQ ID NO: 165903 - RNA, 18 nt, Homo sapiens
ugcagcaucaguacccag

SEQ ID NO: 165904 - RNA, 22 nt, Homo sapiens
ugcagcucagcugcggaguuuu

SEQ ID NO: 165905 - RNA, 22 nt, Homo sapiens
ugcaggauguucaguaauuucc

SEQ ID NO: 165906 - RNA, 22 nt, Homo sapiens
ugcagugcaugacuguguuaug

SEQ ID NO: 165907 - RNA, 22 nt, Homo sapiens
ugcaguuuaggaacugguaaca

SEQ ID NO: 165908 - RNA, 17 nt, Homo sapiens
ugcauaggcaggcucag

SEQ ID NO: 165909 - RNA, 22 nt, Homo sapiens
ugcaucacaguacuccagccug

SEQ ID NO: 165910 - RNA, 22 nt, Homo sapiens
ugcaucaggcugcuuauuacaa

SEQ ID NO: 165911 - RNA, 21 nt, Homo sapiens
ugcauggagaacacugagggu

SEQ ID NO: 165912 - RNA, 21 nt, Homo sapiens
ugcaugguagucacaugauuc

SEQ ID NO: 165913 - RNA, 22 nt, Homo sapiens
uagcugcccagcacgaaguugg

SEQ ID NO: 165914 - RNA, 22 nt, Homo sapiens
uagcugguucuccaggagcuag

SEQ ID NO: 165915 - RNA, 23 nt, Homo sapiens
uagcuucucccagaccugcuccc

SEQ ID NO: 165916 - RNA, 22 nt, Homo sapiens
uaggaaguuuucuugcugggcc

SEQ ID NO: 165917 - RNA, 22 nt, Homo sapiens
uaggacacagauggagaaaagc

SEQ ID NO: 165918 - RNA, 22 nt, Homo sapiens
uaggcaauggagauagaggaug

SEQ ID NO: 165919 - RNA, 22 nt, Homo sapiens
uaggcacacaucuacuacaaau

SEQ ID NO: 165920 - RNA, 22 nt, Homo sapiens
uaggcaguggagaaauaaacag

SEQ ID NO: 165921 - RNA, 22 nt, Homo sapiens
uaggcuuuuggacccugucucu

SEQ ID NO: 165922 - RNA, 19 nt, Homo sapiens
uagggcacgaggcagaguc

SEQ ID NO: 165923 - RNA, 22 nt, Homo sapiens
uagggcaugugggaaguuauaa

SEQ ID NO: 165924 - RNA, 22 nt, Homo sapiens
uaggguaguaauaguuguuuca

SEQ ID NO: 165925 - RNA, 22 nt, Homo sapiens
uagguagaacccagaaaucuga

SEQ ID NO: 165926 - RNA, 22 nt, Homo sapiens
uaggugaauguaguaagguguu

SEQ ID NO: 165927 - RNA, 22 nt, Homo sapiens
uaguaucacaagguguacaccc

SEQ ID NO: 165928 - RNA, 22 nt, Homo sapiens
uagugcuguaauucuaaugaaa

SEQ ID NO: 165929 - RNA, 18 nt, Homo sapiens
uagugcuguucucaugau

SEQ ID NO: 165930 - RNA, 22 nt, Homo sapiens
uaguuaguagacucugauuauu

SEQ ID NO: 165931 - RNA, 22 nt, Homo sapiens
uaguucguguuugaacuagauc

SEQ ID NO: 165932 - RNA, 22 nt, Homo sapiens
uauagcagccugaacaaaguaa

SEQ ID NO: 165933 - RNA, 22 nt, Homo sapiens
uaucaacaggguggccagugua

SEQ ID NO: 165934 - RNA, 22 nt, Homo sapiens
uaucaagaugacaaacuuugcu

SEQ ID NO: 165935 - RNA, 22 nt, Homo sapiens
uaucaaguuggaagagaaguaa

SEQ ID NO: 165936 - RNA, 22 nt, Homo sapiens
uaucacacgccuugcuucauuu

SEQ ID NO: 165937 - RNA, 22 nt, Homo sapiens
uaucacagauauuaugggccaa

SEQ ID NO: 165938 - RNA, 20 nt, Homo sapiens
uaucacauggggagaaaccu

SEQ ID NO: 165939 - RNA, 22 nt, Homo sapiens
uaucagaguuacacugaagacu

SEQ ID NO: 165940 - RNA, 22 nt, Homo sapiens
uaucucagagaaucagauuuac

SEQ ID NO: 165941 - RNA, 22 nt, Homo sapiens
uaucuuggaguuugacaaccaa

SEQ ID NO: 165942 - RNA, 20 nt, Homo sapiens
uaugacaaagccuagugagu

SEQ ID NO: 165943 - RNA, 22 nt, Homo sapiens
uaugccuuuuggcucaagaaac

SEQ ID NO: 165944 - RNA, 22 nt, Homo sapiens
uaugccuuuugguucaagcaac

SEQ ID NO: 165945 - RNA, 22 nt, Homo sapiens
uauggaaaucuuaccuuauggu

SEQ ID NO: 165946 - RNA, 22 nt, Homo sapiens
uauggauguuaagguucacagc

SEQ ID NO: 165947 - RNA, 22 nt, Homo sapiens
uauggauuuucagauucuuauc

SEQ ID NO: 165948 - RNA, 22 nt, Homo sapiens
uauggcuacuacgaauaaugcu

SEQ ID NO: 165949 - RNA, 22 nt, Homo sapiens
uauggcuucuauaaggaagcuu

SEQ ID NO: 165950 - RNA, 22 nt, Homo sapiens
uaugggauuucauuaagugucu

SEQ ID NO: 165951 - RNA, 22 nt, Homo sapiens
uaugguuuucucuuacguguug

SEQ ID NO: 165952 - RNA, 22 nt, Homo sapiens
uaugucacuggacauaaguucu

SEQ ID NO: 165953 - RNA, 22 nt, Homo sapiens
uaugucuucuuuagagaaaugu

SEQ ID NO: 165954 - RNA, 22 nt, Homo sapiens
uauuacugucaauaucacagaa

SEQ ID NO: 165955 - RNA, 22 nt, Homo sapiens
uauuaugcacuuuauaaaaauu

SEQ ID NO: 165956 - RNA, 22 nt, Homo sapiens
uauugacuugagaagggauuag

SEQ ID NO: 165957 - RNA, 22 nt, Homo sapiens
uauugcaauuggcagagugcua

SEQ ID NO: 165958 - RNA, 22 nt, Homo sapiens
ugaaagguuuaauucugugaga

SEQ ID NO: 165959 - RNA, 22 nt, Homo sapiens
ugaaaugaucaguuugguuacu

SEQ ID NO: 165960 - RNA, 22 nt, Homo sapiens
ugaaaugauuauaugguguuug

SEQ ID NO: 165961 - RNA, 22 nt, Homo sapiens
ugaaaugccuuuaaugaauuua

SEQ ID NO: 165962 - RNA, 22 nt, Homo sapiens
ugaacagagaaacacuggccau

SEQ ID NO: 165963 - RNA, 22 nt, Homo sapiens
ugaagcuuguuucuguaccuuu

SEQ ID NO: 165964 - RNA, 22 nt, Homo sapiens
ugaaggacauucuaugguagau

SEQ ID NO: 165965 - RNA, 20 nt, Homo sapiens
ugaaggaggucauuuauacc

SEQ ID NO: 165966 - RNA, 22 nt, Homo sapiens
ugaagggcauuguuuugccaaa

SEQ ID NO: 165967 - RNA, 22 nt, Homo sapiens
ugaaguaauguuuuauucuauu

SEQ ID NO: 165968 - RNA, 22 nt, Homo sapiens
ugaaguaggcauaaguuaagcu

SEQ ID NO: 165969 - RNA, 22 nt, Homo sapiens
ugaauagacagucacugccucc

SEQ ID NO: 165970 - RNA, 21 nt, Homo sapiens
ugaauauuuggguugugucca

SEQ ID NO: 165971 - RNA, 22 nt, Homo sapiens
ugaaucaugcugcuauaaagac

SEQ ID NO: 165972 - RNA, 22 nt, Homo sapiens
ugaaugcaucuagaaauuuauu

SEQ ID NO: 165973 - RNA, 22 nt, Homo sapiens
ugaaugcauggggccaagaagg

SEQ ID NO: 165974 - RNA, 22 nt, Homo sapiens
ugaauggauccaauucuuagua

SEQ ID NO: 165975 - RNA, 22 nt, Homo sapiens
ugaauguacacgcguacuuguu

SEQ ID NO: 165976 - RNA, 22 nt, Homo sapiens
ugaauguccauugauguuuuga

SEQ ID NO: 165977 - RNA, 22 nt, Homo sapiens
ugaauguccugacgcugcaguu

SEQ ID NO: 165978 - RNA, 23 nt, Homo sapiens
ugaauguuuauucucggugcaga

SEQ ID NO: 165979 - RNA, 22 nt, Homo sapiens
ugaauguuugcuuacuuccaua

SEQ ID NO: 165980 - RNA, 22 nt, Homo sapiens
ugaauuguuuacgagaugugag

SEQ ID NO: 165981 - RNA, 22 nt, Homo sapiens
ugacaagaaagcgucuucuuuu

SEQ ID NO: 165982 - RNA, 22 nt, Homo sapiens
ugacacuugcccuuagaaacau

SEQ ID NO: 165983 - RNA, 22 nt, Homo sapiens
ugacagguuggaauuaugggag

SEQ ID NO: 165984 - RNA, 22 nt, Homo sapiens
ugacaguaaacagucuugauua

SEQ ID NO: 165985 - RNA, 22 nt, Homo sapiens
ugacaugagauuugggaggggc

SEQ ID NO: 165986 - RNA, 22 nt, Homo sapiens
ugacauggaagauguucaugau

SEQ ID NO: 165987 - RNA, 18 nt, Homo sapiens
ugacauugagcugagaaa

SEQ ID NO: 165988 - RNA, 22 nt, Homo sapiens
ugaccacagaaagugagggagc

SEQ ID NO: 165989 - RNA, 19 nt, Homo sapiens
ugaccagggacagaaacca

SEQ ID NO: 165990 - RNA, 22 nt, Homo sapiens
ugacuauaguuuucuugacaca

SEQ ID NO: 165991 - RNA, 22 nt, Homo sapiens
ugacucaagagccugacucauc

SEQ ID NO: 165992 - RNA, 17 nt, Homo sapiens
ugagaacaugugguauu

SEQ ID NO: 165993 - RNA, 18 nt, Homo sapiens
ugagaacauguguacaca

SEQ ID NO: 165994 - RNA, 22 nt, Homo sapiens
ugagaagaugaacuccuugguc

SEQ ID NO: 165995 - RNA, 22 nt, Homo sapiens
ugagacacugaauccggccuga

SEQ ID NO: 165996 - RNA, 22 nt, Homo sapiens
ugagacaugugaacuguaguuc

SEQ ID NO: 165997 - RNA, 22 nt, Homo sapiens
ugagacggagucucgcucuguu

SEQ ID NO: 165998 - RNA, 22 nt, Homo sapiens
ugagacggagucucgcuguguc

SEQ ID NO: 165999 - RNA, 22 nt, Homo sapiens
ugagacggagucuugcucuguc

SEQ ID NO: 166000 - RNA, 22 nt, Homo sapiens
ugagacugagucuugcucuugu

SEQ ID NO: 166001 - RNA, 22 nt, Homo sapiens
ugagacugauaggacauuuucu

SEQ ID NO: 166002 - RNA, 22 nt, Homo sapiens
ugagagcuuuuuugccugguga

SEQ ID NO: 166003 - RNA, 22 nt, Homo sapiens
ugagagucauacaaauaaaaau

SEQ ID NO: 166004 - RNA, 22 nt, Homo sapiens
ugagaucuuggaggcuuuguga

SEQ ID NO: 166005 - RNA, 22 nt, Homo sapiens
ugagaucuuugcuguccucacc

SEQ ID NO: 166006 - RNA, 22 nt, Homo sapiens
ugagaugaaagcagaaagacuu

SEQ ID NO: 166007 - RNA, 22 nt, Homo sapiens
ugagaugagagaaugcuugccu

SEQ ID NO: 166008 - RNA, 22 nt, Homo sapiens
ugagaugauaucuuauuguaau

SEQ ID NO: 166009 - RNA, 21 nt, Homo sapiens
ugagaugauccugcaugcaug

SEQ ID NO: 166010 - RNA, 22 nt, Homo sapiens
ugagaugaugggauaagagggc

SEQ ID NO: 166011 - RNA, 22 nt, Homo sapiens
ugagauggagucuugucgccua

SEQ ID NO: 166012 - RNA, 22 nt, Homo sapiens
ugagauggaucuuggauuugaa

SEQ ID NO: 166013 - RNA, 22 nt, Homo sapiens
ugagauggcugaauucagaaua

SEQ ID NO: 166014 - RNA, 22 nt, Homo sapiens
ugagauggcuuuauugcugaau

SEQ ID NO: 166015 - RNA, 22 nt, Homo sapiens
ugagauggguucugguccccug

SEQ ID NO: 166016 - RNA, 22 nt, Homo sapiens
ugagaugguaaauuuuuguugu

SEQ ID NO: 166017 - RNA, 22 nt, Homo sapiens
ugagaugugugcauucaacuca

SEQ ID NO: 166018 - RNA, 22 nt, Homo sapiens
ugagauguuccaaugacuauua

SEQ ID NO: 166019 - RNA, 22 nt, Homo sapiens
ugagcaagaucuuuauaauuag

SEQ ID NO: 166020 - RNA, 22 nt, Homo sapiens
ugagcacaggugcgcgguuacu

SEQ ID NO: 166021 - RNA, 22 nt, Homo sapiens
ugagcacuguacuuuaucaggu

SEQ ID NO: 166022 - RNA, 22 nt, Homo sapiens
ugagcagugagugugcugcagg

SEQ ID NO: 166023 - RNA, 22 nt, Homo sapiens
ugagcauuguuuggacuuggau

SEQ ID NO: 166024 - RNA, 22 nt, Homo sapiens
ugagccaugguuagcuucucau

SEQ ID NO: 166025 - RNA, 20 nt, Homo sapiens
ugagccccuggacucaagcg

SEQ ID NO: 166026 - RNA, 22 nt, Homo sapiens
ugagcucaguauuucauaaaca

SEQ ID NO: 166027 - RNA, 22 nt, Homo sapiens
ugagcuguuugaagaagcauuu

SEQ ID NO: 166028 - RNA, 22 nt, Homo sapiens
ugaggagugaacuauuucugau

SEQ ID NO: 166029 - RNA, 22 nt, Homo sapiens
ugaggauaguguugaaggcagg

SEQ ID NO: 166030 - RNA, 22 nt, Homo sapiens
ugaggcaggagaacggcuugaa

SEQ ID NO: 166031 - RNA, 22 nt, Homo sapiens
ugagggaugcguacccuaugcc

SEQ ID NO: 166032 - RNA, 22 nt, Homo sapiens
ugaggguauagccagcccuuag

SEQ ID NO: 166033 - RNA, 22 nt, Homo sapiens
ugagguagaggugaacuugacc

SEQ ID NO: 166034 - RNA, 22 nt, Homo sapiens
ugagguaucauugcccaggcug

SEQ ID NO: 166035 - RNA, 22 nt, Homo sapiens
ugaggucauucaugugggcgca

SEQ ID NO: 166036 - RNA, 20 nt, Homo sapiens
ugaggucugagaaagaauga

SEQ ID NO: 166037 - RNA, 22 nt, Homo sapiens
ugagguugguauuacugucucu

SEQ ID NO: 166038 - RNA, 22 nt, Homo sapiens
ugagguuguccacuauaaucca

SEQ ID NO: 166039 - RNA, 22 nt, Homo sapiens
ugaguauagaucaguucaagug

SEQ ID NO: 166040 - RNA, 22 nt, Homo sapiens
ugaguguccaaguaaggugaaa

SEQ ID NO: 166041 - RNA, 22 nt, Homo sapiens
uucaugcaucuguagugguuaa

SEQ ID NO: 166042 - RNA, 22 nt, Homo sapiens
uucauggugguacaaaagcaau

SEQ ID NO: 166043 - RNA, 22 nt, Homo sapiens
uucauguaauauauuucaggcc

SEQ ID NO: 166044 - RNA, 22 nt, Homo sapiens
uucaugucuuggcuguuagagu

SEQ ID NO: 166045 - RNA, 22 nt, Homo sapiens
uucaugugagucuguauuaacu

SEQ ID NO: 166046 - RNA, 22 nt, Homo sapiens
uuccacaauggcugaacuaguu

SEQ ID NO: 166047 - RNA, 22 nt, Homo sapiens
uuccacaggguugaacuaguuu

SEQ ID NO: 166048 - RNA, 22 nt, Homo sapiens
uuccagagucaccuuucugucg

SEQ ID NO: 166049 - RNA, 22 nt, Homo sapiens
uuccaguuuuauggguauagag

SEQ ID NO: 166050 - RNA, 22 nt, Homo sapiens
uucccagagagggacuucuaau

SEQ ID NO: 166051 - RNA, 22 nt, Homo sapiens
uucccagagccugggagugagg

SEQ ID NO: 166052 - RNA, 22 nt, Homo sapiens
uucccagugguuagcucugguc

SEQ ID NO: 166053 - RNA, 22 nt, Homo sapiens
uucccugaaguguuacucuaga

SEQ ID NO: 166054 - RNA, 22 nt, Homo sapiens
uucccugugugcagaugggugu

SEQ ID NO: 166055 - RNA, 22 nt, Homo sapiens
uucccuugcaggaugaucugga

SEQ ID NO: 166056 - RNA, 22 nt, Homo sapiens
uucccuuucugaaaaucucauu

SEQ ID NO: 166057 - RNA, 22 nt, Homo sapiens
uucccuuugaaacuaaacuugc

SEQ ID NO: 166058 - RNA, 22 nt, Homo sapiens
uucccuuugaauuggaaaggug

SEQ ID NO: 166059 - RNA, 22 nt, Homo sapiens
uuccuacugcccauuaaaaugg

SEQ ID NO: 166060 - RNA, 19 nt, Homo sapiens
uuccuagugguugggaagu

SEQ ID NO: 166061 - RNA, 22 nt, Homo sapiens
uuccugagaucagaauucaaau

SEQ ID NO: 166062 - RNA, 22 nt, Homo sapiens
uuccugagccuuguaucuagua

SEQ ID NO: 166063 - RNA, 22 nt, Homo sapiens
uuccugaggccuccccagaagc

SEQ ID NO: 166064 - RNA, 22 nt, Homo sapiens
uuccugucuuccaagagagauu

SEQ ID NO: 166065 - RNA, 22 nt, Homo sapiens
uuccuugagagcuugauaucac

SEQ ID NO: 166066 - RNA, 22 nt, Homo sapiens
uucuacaggcuguucaagaagc

SEQ ID NO: 166067 - RNA, 22 nt, Homo sapiens
uucuacagugacugcagccaua

SEQ ID NO: 166068 - RNA, 22 nt, Homo sapiens
uucuagcacuuugggagacuga

SEQ ID NO: 166069 - RNA, 23 nt, Homo sapiens
uucuaucaggcccaggagcccug

SEQ ID NO: 166070 - RNA, 22 nt, Homo sapiens
uucucacaguacagggagcucu

SEQ ID NO: 166071 - RNA, 21 nt, Homo sapiens
uucucagaggcaggggauaaa

SEQ ID NO: 166072 - RNA, 22 nt, Homo sapiens
uucucauggugauggcaaaauc

SEQ ID NO: 166073 - RNA, 22 nt, Homo sapiens
uucuccugguggacccuaaacg

SEQ ID NO: 166074 - RNA, 22 nt, Homo sapiens
uucucuaguuacuuuaauggag

SEQ ID NO: 166075 - RNA, 22 nt, Homo sapiens
uucucuggucagaggggagguu

SEQ ID NO: 166076 - RNA, 22 nt, Homo sapiens
uucugauggaguaguccacaga

SEQ ID NO: 166077 - RNA, 22 nt, Homo sapiens
uucuggccuccauuuuucuccu

SEQ ID NO: 166078 - RNA, 22 nt, Homo sapiens
uucuggcuuuuaaagaaauguu

SEQ ID NO: 166079 - RNA, 22 nt, Homo sapiens
uucugugcugaaucaaagacug

SEQ ID NO: 166080 - RNA, 22 nt, Homo sapiens
uucuuaguggcaccacuuuuuu

SEQ ID NO: 166081 - RNA, 22 nt, Homo sapiens
uucuucaggcauucccagaagc

SEQ ID NO: 166082 - RNA, 22 nt, Homo sapiens
uucuugcuguauccucacaugg

SEQ ID NO: 166083 - RNA, 22 nt, Homo sapiens
uugaagacuauaugauucuuca

SEQ ID NO: 166084 - RNA, 22 nt, Homo sapiens
uugaauaguggugaaaguuuga

SEQ ID NO: 166085 - RNA, 22 nt, Homo sapiens
uugaaugaauggaaagaagggu

SEQ ID NO: 166086 - RNA, 22 nt, Homo sapiens
uugacauaaucauuucacagug

SEQ ID NO: 166087 - RNA, 22 nt, Homo sapiens
uugacguaggaggauguugaga

SEQ ID NO: 166088 - RNA, 22 nt, Homo sapiens
uugagauaucuuggccuuugca

SEQ ID NO: 166089 - RNA, 22 nt, Homo sapiens
uugagauggagucucacgcauu

SEQ ID NO: 166090 - RNA, 22 nt, Homo sapiens
uugagauggagucucacucugc

SEQ ID NO: 166091 - RNA, 22 nt, Homo sapiens
uugagauggagucucacucuuu

SEQ ID NO: 166092 - RNA, 22 nt, Homo sapiens
uugagauggagucuuguucucu

SEQ ID NO: 166093 - RNA, 22 nt, Homo sapiens
uugagauggaguucauuuuugu

SEQ ID NO: 166094 - RNA, 22 nt, Homo sapiens
uugagauggaguuucacucuug

SEQ ID NO: 166095 - RNA, 22 nt, Homo sapiens
uugagauguauguauauaaugu

SEQ ID NO: 166096 - RNA, 22 nt, Homo sapiens
uugagauguggguuggugacuu

SEQ ID NO: 166097 - RNA, 22 nt, Homo sapiens
uugagcaaugucacugaggcuu

SEQ ID NO: 166098 - RNA, 22 nt, Homo sapiens
uugagcacaggaguuuugagac

SEQ ID NO: 166099 - RNA, 22 nt, Homo sapiens
uugagcccuggaggcagaggcu

SEQ ID NO: 166100 - RNA, 22 nt, Homo sapiens
uugagcucaucuucagggguga

SEQ ID NO: 166101 - RNA, 22 nt, Homo sapiens
uugaggaggcagucugcccauu

SEQ ID NO: 166102 - RNA, 22 nt, Homo sapiens
uugagggaaacauucacaucau

SEQ ID NO: 166103 - RNA, 22 nt, Homo sapiens
uugaggugaagggcagagcagc

SEQ ID NO: 166104 - RNA, 22 nt, Homo sapiens
uugagugaaggcuguguucuug

SEQ ID NO: 166105 - RNA, 22 nt, Homo sapiens
uugauaauguuaacuuugguca

SEQ ID NO: 166106 - RNA, 22 nt, Homo sapiens
uugauaugcuugucaguccauu

SEQ ID NO: 166107 - RNA, 22 nt, Homo sapiens
uugauauguuguuggauucacu

SEQ ID NO: 166108 - RNA, 22 nt, Homo sapiens
uugauauucugagaagcugaag

SEQ ID NO: 166109 - RNA, 22 nt, Homo sapiens
uugauguguuuccaggauuugu

SEQ ID NO: 166110 - RNA, 22 nt, Homo sapiens
uugauuuguagaaugccccaac

SEQ ID NO: 166111 - RNA, 22 nt, Homo sapiens
uugcacaauggaauuuaucuuu

SEQ ID NO: 166112 - RNA, 22 nt, Homo sapiens
uugcaccacugcguuccagccu

SEQ ID NO: 166113 - RNA, 22 nt, Homo sapiens
uugcaccuuaugucuguucucu

SEQ ID NO: 166114 - RNA, 22 nt, Homo sapiens
uugcacuguaauuuauuuaugu

SEQ ID NO: 166115 - RNA, 22 nt, Homo sapiens
uugcacuugcugaggagugauu

SEQ ID NO: 166116 - RNA, 22 nt, Homo sapiens
uugcagagaaauuucugguuua

SEQ ID NO: 166117 - RNA, 22 nt, Homo sapiens
uugcagcauucugguuccuggu

SEQ ID NO: 166118 - RNA, 22 nt, Homo sapiens
uugcagugguuucacuggcaaa

SEQ ID NO: 166119 - RNA, 22 nt, Homo sapiens
uugcauaagugcauucugugau

SEQ ID NO: 166120 - RNA, 22 nt, Homo sapiens
uugcauaauaagauuggggggg

SEQ ID NO: 166121 - RNA, 22 nt, Homo sapiens
uugcaugucauaacugauggaa

SEQ ID NO: 166122 - RNA, 23 nt, Homo sapiens
uugcauugcccuccauaguacuc

SEQ ID NO: 166123 - RNA, 22 nt, Homo sapiens
uugccauggaguagaauugaag

SEQ ID NO: 166124 - RNA, 22 nt, Homo sapiens
aggcagaugagguccucagcug

SEQ ID NO: 166125 - RNA, 23 nt, Homo sapiens
aggccaguuuuuccugcuugcug

SEQ ID NO: 166126 - RNA, 22 nt, Homo sapiens
aggcuagaaucuuccaucuugg

SEQ ID NO: 166127 - RNA, 22 nt, Homo sapiens
agguaagaugugacuugguguu

SEQ ID NO: 166128 - RNA, 22 nt, Homo sapiens
agguaauagcacaugauaccuu

SEQ ID NO: 166129 - RNA, 20 nt, Homo sapiens
agguaguuauacaaaugugu

SEQ ID NO: 166130 - RNA, 22 nt, Homo sapiens
agguccacuuacuacuccuguu

SEQ ID NO: 166131 - RNA, 22 nt, Homo sapiens
aggugaaugcucacauucuaau

SEQ ID NO: 166132 - RNA, 22 nt, Homo sapiens
agguuaccuggugauuuugucu

SEQ ID NO: 166133 - RNA, 22 nt, Homo sapiens
agguucccuuuuggccugggau

SEQ ID NO: 166134 - RNA, 22 nt, Homo sapiens
agguuguguuugugauuagaua

SEQ ID NO: 166135 - RNA, 22 nt, Homo sapiens
aguaagauggcaacucuccaca

SEQ ID NO: 166136 - RNA, 22 nt, Homo sapiens
aguacacuguuaaaaagaagug

SEQ ID NO: 166137 - RNA, 22 nt, Homo sapiens
aguacaucuggcuggauagaua

SEQ ID NO: 166138 - RNA, 22 nt, Homo sapiens
aguacugucagcaggguguuga

SEQ ID NO: 166139 - RNA, 22 nt, Homo sapiens
aguaucaucuuguuggccaggc

SEQ ID NO: 166140 - RNA, 22 nt, Homo sapiens
agucacagccuuuuacuuuaga

SEQ ID NO: 166141 - RNA, 22 nt, Homo sapiens
agucacaugcauuuucuucaau

SEQ ID NO: 166142 - RNA, 22 nt, Homo sapiens
aguccagguuuuguaauggcaa

SEQ ID NO: 166143 - RNA, 22 nt, Homo sapiens
agugcaaagccgagguuucuug

SEQ ID NO: 166144 - RNA, 22 nt, Homo sapiens
agugcaaugauccggugcuggg

SEQ ID NO: 166145 - RNA, 22 nt, Homo sapiens
aguggcacaauuuugacucccc

SEQ ID NO: 166146 - RNA, 22 nt, Homo sapiens
aguucaaugcucuuucuacuau

SEQ ID NO: 166147 - RNA, 22 nt, Homo sapiens
aguugcaagucuugaguaaaga

SEQ ID NO: 166148 - RNA, 22 nt, Homo sapiens
aguuuugguugaguuacuagca

SEQ ID NO: 166149 - RNA, 22 nt, Homo sapiens
auaaacagcuuauccucuauuc

SEQ ID NO: 166150 - RNA, 22 nt, Homo sapiens
auaaacugucaguggagaguaa

SEQ ID NO: 166151 - RNA, 22 nt, Homo sapiens
auaaaguucugcuggcauauau

SEQ ID NO: 166152 - RNA, 22 nt, Homo sapiens
auaaaugcaaugguauuuuuga

SEQ ID NO: 166153 - RNA, 19 nt, Homo sapiens
auaaaugccuacaagggug

SEQ ID NO: 166154 - RNA, 22 nt, Homo sapiens
auaagagcaggcuucuggccag

SEQ ID NO: 166155 - RNA, 22 nt, Homo sapiens
auaagaugaaggaagccauauc

SEQ ID NO: 166156 - RNA, 22 nt, Homo sapiens
auaaggcagcugcuaaaaggca

SEQ ID NO: 166157 - RNA, 22 nt, Homo sapiens
auaagugcuuguugaauaauag

SEQ ID NO: 166158 - RNA, 22 nt, Homo sapiens
auaauagcugaucauuuagaag

SEQ ID NO: 166159 - RNA, 22 nt, Homo sapiens
auaauaucagguugugaugaug

SEQ ID NO: 166160 - RNA, 22 nt, Homo sapiens
auaauguuugauugagcagaua

SEQ ID NO: 166161 - RNA, 19 nt, Homo sapiens
auacacguguauacauaca

SEQ ID NO: 166162 - RNA, 22 nt, Homo sapiens
auacagcuaaaauauuaaguua

SEQ ID NO: 166163 - RNA, 22 nt, Homo sapiens
auacaguaaugucuuaggcugu

SEQ ID NO: 166164 - RNA, 22 nt, Homo sapiens
auacaucugccauguuggugug

SEQ ID NO: 166165 - RNA, 22 nt, Homo sapiens
auacauguucaagggcauauau

SEQ ID NO: 166166 - RNA, 20 nt, Homo sapiens
auaccacagacuggguaguu

SEQ ID NO: 166167 - RNA, 22 nt, Homo sapiens
auacuagucaagaauguaugag

SEQ ID NO: 166168 - RNA, 22 nt, Homo sapiens
auacugguuuuugucaugugga

SEQ ID NO: 166169 - RNA, 22 nt, Homo sapiens
auagaauguuugcgccagguga

SEQ ID NO: 166170 - RNA, 22 nt, Homo sapiens
auagaggacugaggugaucuuu

SEQ ID NO: 166171 - RNA, 22 nt, Homo sapiens
auagcagugugaaaacagacug

SEQ ID NO: 166172 - RNA, 22 nt, Homo sapiens
auagcauaucccacaugucaga

SEQ ID NO: 166173 - RNA, 22 nt, Homo sapiens
auaggagugugaacccuaucgu

SEQ ID NO: 166174 - RNA, 22 nt, Homo sapiens
auaggagugugcacagaguagg

SEQ ID NO: 166175 - RNA, 22 nt, Homo sapiens
auaggcaagaugagguuuuuau

SEQ ID NO: 166176 - RNA, 22 nt, Homo sapiens
auagguuauuagagcaaagcuu

SEQ ID NO: 166177 - RNA, 21 nt, Homo sapiens
auagugcuagagaguagcagg

SEQ ID NO: 166178 - RNA, 22 nt, Homo sapiens
auagugcugcaauaaacacacg

SEQ ID NO: 166179 - RNA, 22 nt, Homo sapiens
auagugcuggaauaaauauacg

SEQ ID NO: 166180 - RNA, 22 nt, Homo sapiens
auaguggcaugaucauagcuca

SEQ ID NO: 166181 - RNA, 22 nt, Homo sapiens
auauaguguuuuuugguacgcu

SEQ ID NO: 166182 - RNA, 22 nt, Homo sapiens
auaucaacaucgugucauuagu

SEQ ID NO: 166183 - RNA, 22 nt, Homo sapiens
auaucaaggccauuuucuaaau

SEQ ID NO: 166184 - RNA, 22 nt, Homo sapiens
auaucagugucuuacuguuuuu

SEQ ID NO: 166185 - RNA, 22 nt, Homo sapiens
auaucccaguguguaaacacug

SEQ ID NO: 166186 - RNA, 22 nt, Homo sapiens
auaucugcauugccauuuaugu

SEQ ID NO: 166187 - RNA, 22 nt, Homo sapiens
auauuacuggcuauaucgcaag

SEQ ID NO: 166188 - RNA, 22 nt, Homo sapiens
auauucacuauaugcagaacca

SEQ ID NO: 166189 - RNA, 18 nt, Homo sapiens
auauugccuucagacuag

SEQ ID NO: 166190 - RNA, 22 nt, Homo sapiens
auauuggacugugcuaguuaga

SEQ ID NO: 166191 - RNA, 22 nt, Homo sapiens
aucaaagccaugcucaguuuuc

SEQ ID NO: 166192 - RNA, 22 nt, Homo sapiens
aucaaguaaucugaguaagagu

SEQ ID NO: 166193 - RNA, 22 nt, Homo sapiens
aucacauggccagguaguaauc

SEQ ID NO: 166194 - RNA, 22 nt, Homo sapiens
aucacauuuauaguggcacgca

SEQ ID NO: 166195 - RNA, 20 nt, Homo sapiens
aucaccacagcucguucaug

SEQ ID NO: 166196 - RNA, 22 nt, Homo sapiens
aucaccugagcaguauacacug

SEQ ID NO: 166197 - RNA, 22 nt, Homo sapiens
aucacuuugcucuccagugugg

SEQ ID NO: 166198 - RNA, 22 nt, Homo sapiens
aucagagccugugugcccugaa

SEQ ID NO: 166199 - RNA, 22 nt, Homo sapiens
aucagcagcaugaaaacaggcu

SEQ ID NO: 166200 - RNA, 22 nt, Homo sapiens
aucagucacugcguuuuuggga

SEQ ID NO: 166201 - RNA, 22 nt, Homo sapiens
aucaucaugcacuacagccugg

SEQ ID NO: 166202 - RNA, 22 nt, Homo sapiens
aucauugugcaucuucauucca

SEQ ID NO: 166203 - RNA, 22 nt, Homo sapiens
aucauugugugaguugauggga

SEQ ID NO: 166204 - RNA, 22 nt, Homo sapiens
auccaguuuuaggagauuucua

SEQ ID NO: 166205 - RNA, 22 nt, Homo sapiens
aucccagaaacucggguuucuc

SEQ ID NO: 166206 - RNA, 22 nt, Homo sapiens
aucccaguaaaaauggcuucua

SEQ ID NO: 166207 - RNA, 22 nt, Homo sapiens
uugccgggugcaguggcucaug

SEQ ID NO: 166208 - RNA, 22 nt, Homo sapiens
uugccuaggcuggaguguggug

SEQ ID NO: 166209 - RNA, 22 nt, Homo sapiens
uugccuauucacucugaugaua

SEQ ID NO: 166210 - RNA, 22 nt, Homo sapiens
uugcuccucugccaggaccugu

SEQ ID NO: 166211 - RNA, 22 nt, Homo sapiens
uugcugagucuuucuagguugc

SEQ ID NO: 166212 - RNA, 22 nt, Homo sapiens
uuggaaaaauccaccuugaucu

SEQ ID NO: 166213 - RNA, 22 nt, Homo sapiens
uuggaagacaaugcugauucuc

SEQ ID NO: 166214 - RNA, 22 nt, Homo sapiens
uuggaaugcacacugagccugc

SEQ ID NO: 166215 - RNA, 22 nt, Homo sapiens
uuggaauguacucuagccuaug

SEQ ID NO: 166216 - RNA, 22 nt, Homo sapiens
uuggaauuaagagauauuuucu

SEQ ID NO: 166217 - RNA, 22 nt, Homo sapiens
uuggacaagauugcagagaauu

SEQ ID NO: 166218 - RNA, 22 nt, Homo sapiens
uuggaccacuugauuucugguc

SEQ ID NO: 166219 - RNA, 22 nt, Homo sapiens
uuggagugugucuuauuccauu

SEQ ID NO: 166220 - RNA, 22 nt, Homo sapiens
uuggauauucaguuuuuccauc

SEQ ID NO: 166221 - RNA, 22 nt, Homo sapiens
uuggauuguuucuagauugggg

SEQ ID NO: 166222 - RNA, 22 nt, Homo sapiens
uuggcaagaaccuucuuccaag

SEQ ID NO: 166223 - RNA, 22 nt, Homo sapiens
uuggcaauugcuaugauuugaa

SEQ ID NO: 166224 - RNA, 20 nt, Homo sapiens
uuggcauuuagacaagaguu

SEQ ID NO: 166225 - RNA, 22 nt, Homo sapiens
uuggcccugcugaccauucccu

SEQ ID NO: 166226 - RNA, 19 nt, Homo sapiens
uuggcccugguucucuucu

SEQ ID NO: 166227 - RNA, 22 nt, Homo sapiens
uuggcucuggcugggcuccagc

SEQ ID NO: 166228 - RNA, 22 nt, Homo sapiens
uuggcuguguuucccuacaaau

SEQ ID NO: 166229 - RNA, 22 nt, Homo sapiens
uugggaauguccuaauaucucg

SEQ ID NO: 166230 - RNA, 22 nt, Homo sapiens
uugggagugucucuggacugca

SEQ ID NO: 166231 - RNA, 22 nt, Homo sapiens
uugggcauugggcuaaacuccc

SEQ ID NO: 166232 - RNA, 22 nt, Homo sapiens
uugguaaaaugaccacagacau

SEQ ID NO: 166233 - RNA, 22 nt, Homo sapiens
uuggucagcuagauuauucccu

SEQ ID NO: 166234 - RNA, 22 nt, Homo sapiens
uugguuaccuucagaaaugagu

SEQ ID NO: 166235 - RNA, 22 nt, Homo sapiens
uuguaaacaucuguacauugcu

SEQ ID NO: 166236 - RNA, 23 nt, Homo sapiens
uuguaacuggagaguaacauucc

SEQ ID NO: 166237 - RNA, 22 nt, Homo sapiens
uuguaaucaacacaucauuggg

SEQ ID NO: 166238 - RNA, 22 nt, Homo sapiens
uuguacuagaaaauuauucuuu

SEQ ID NO: 166239 - RNA, 22 nt, Homo sapiens
uuguaguagcauuauuuauaau

SEQ ID NO: 166240 - RNA, 22 nt, Homo sapiens
uuguauacucuauuuuagcagu

SEQ ID NO: 166241 - RNA, 22 nt, Homo sapiens
uuguauaguucuauguguuuug

SEQ ID NO: 166242 - RNA, 22 nt, Homo sapiens
uuguauguuucugugcacauga

SEQ ID NO: 166243 - RNA, 22 nt, Homo sapiens
uugucaaacucauucuccaucc

SEQ ID NO: 166244 - RNA, 22 nt, Homo sapiens
uugucacuauaaauaagcauuu

SEQ ID NO: 166245 - RNA, 22 nt, Homo sapiens
uugucacugcacuccagucugg

SEQ ID NO: 166246 - RNA, 22 nt, Homo sapiens
uugucaguguucacucaaagcu

SEQ ID NO: 166247 - RNA, 22 nt, Homo sapiens
uugugaauggugcugcaguaaa

SEQ ID NO: 166248 - RNA, 22 nt, Homo sapiens
uugugauggugcauacugagcu

SEQ ID NO: 166249 - RNA, 22 nt, Homo sapiens
uugugcaaaguugugguuucug

SEQ ID NO: 166250 - RNA, 22 nt, Homo sapiens
uugugguuuucagcuuauauau

SEQ ID NO: 166251 - RNA, 22 nt, Homo sapiens
uugugucccugcccaaaucuca

SEQ ID NO: 166252 - RNA, 22 nt, Homo sapiens
uuguguuuuuaguagggaaggg

SEQ ID NO: 166253 - RNA, 22 nt, Homo sapiens
uuuaacauuggaugagaucguc

SEQ ID NO: 166254 - RNA, 22 nt, Homo sapiens
uuuaaggcaugccuguacaugc

SEQ ID NO: 166255 - RNA, 22 nt, Homo sapiens
uuuaauacugcaucuuuacucu

SEQ ID NO: 166256 - RNA, 21 nt, Homo sapiens
uuuacuguggacccauugcuu

SEQ ID NO: 166257 - RNA, 22 nt, Homo sapiens
uuuaucaggccuuuggaaaaau

SEQ ID NO: 166258 - RNA, 22 nt, Homo sapiens
uuuaugucuguacaucgggcgg

SEQ ID NO: 166259 - RNA, 18 nt, Homo sapiens
uuucaagucuuaggugac

SEQ ID NO: 166260 - RNA, 22 nt, Homo sapiens
uuucacagcugucuuccgucuc

SEQ ID NO: 166261 - RNA, 22 nt, Homo sapiens
uuucacaguguucucccccaga

SEQ ID NO: 166262 - RNA, 21 nt, Homo sapiens
uuucacugugaguuuuucugu

SEQ ID NO: 166263 - RNA, 22 nt, Homo sapiens
uuucaucagccagggucagucu

SEQ ID NO: 166264 - RNA, 22 nt, Homo sapiens
uuucauguuuuucugugaggca

SEQ ID NO: 166265 - RNA, 19 nt, Homo sapiens
uuucauguuuuuggugaga

SEQ ID NO: 166266 - RNA, 18 nt, Homo sapiens
uuucauugagugugauau

SEQ ID NO: 166267 - RNA, 22 nt, Homo sapiens
uuuccacauggacuuaccuucg

SEQ ID NO: 166268 - RNA, 22 nt, Homo sapiens
uuuccaguuggaagaaggggga

SEQ ID NO: 166269 - RNA, 22 nt, Homo sapiens
uuucccagugguacaguuuaua

SEQ ID NO: 166270 - RNA, 22 nt, Homo sapiens
uuucccuuuagcuuagugauuu

SEQ ID NO: 166271 - RNA, 22 nt, Homo sapiens
uuucucaguguuucaggguagg

SEQ ID NO: 166272 - RNA, 22 nt, Homo sapiens
uuugaaccauuugaagaaugau

SEQ ID NO: 166273 - RNA, 22 nt, Homo sapiens
uuugagcaagaggugacauuau

SEQ ID NO: 166274 - RNA, 22 nt, Homo sapiens
uuugagcuagagucucacucug

SEQ ID NO: 166275 - RNA, 22 nt, Homo sapiens
uuugagcuugacucagcuggag

SEQ ID NO: 166276 - RNA, 22 nt, Homo sapiens
uuugaguuugaggugcugauga

SEQ ID NO: 166277 - RNA, 22 nt, Homo sapiens
uuugcacuugaaaacacucuca

SEQ ID NO: 166278 - RNA, 22 nt, Homo sapiens
uuugcaguguaguuggccagca

SEQ ID NO: 166279 - RNA, 22 nt, Homo sapiens
uuugcagugucagcuucugugu

SEQ ID NO: 166280 - RNA, 22 nt, Homo sapiens
uuugcaguuuauuccuggggcu

SEQ ID NO: 166281 - RNA, 22 nt, Homo sapiens
uuugcaucuuagaaaguucucc

SEQ ID NO: 166282 - RNA, 22 nt, Homo sapiens
uuugccaauauuuuauugagga

SEQ ID NO: 166283 - RNA, 22 nt, Homo sapiens
uuugccuuugugauauggucua

SEQ ID NO: 166284 - RNA, 22 nt, Homo sapiens
uuuggaaugugcacucagauug

SEQ ID NO: 166285 - RNA, 22 nt, Homo sapiens
uuuggacuucuagccuccagag

SEQ ID NO: 166286 - RNA, 20 nt, Homo sapiens
uuuggcaauaggguuuuugu

SEQ ID NO: 166287 - RNA, 22 nt, Homo sapiens
uuuggcagaaaacaagaaucug

SEQ ID NO: 166288 - RNA, 21 nt, Homo sapiens
uuuggcauuaugucaccagag

SEQ ID NO: 166289 - RNA, 22 nt, Homo sapiens
uuuggcauuuuacuacucaaau

SEQ ID NO: 166290 - RNA, 22 nt, Homo sapiens
auccccuugcagugaccggggc

SEQ ID NO: 166291 - RNA, 22 nt, Homo sapiens
aucccuugacguggagucucug

SEQ ID NO: 166292 - RNA, 22 nt, Homo sapiens
aucccuuucucuggcuaggggg

SEQ ID NO: 166293 - RNA, 22 nt, Homo sapiens
auccucugagagaguuucauaa

SEQ ID NO: 166294 - RNA, 22 nt, Homo sapiens
auccucugagaucuaggcagag

SEQ ID NO: 166295 - RNA, 22 nt, Homo sapiens
auccuguagagaugagggugga

SEQ ID NO: 166296 - RNA, 22 nt, Homo sapiens
auccuguaggcuaguagacagu

SEQ ID NO: 166297 - RNA, 22 nt, Homo sapiens
aucgcacuccauccugggcaac

SEQ ID NO: 166298 - RNA, 22 nt, Homo sapiens
aucuaaucaucgcaaccuucaa

SEQ ID NO: 166299 - RNA, 22 nt, Homo sapiens
aucuccaggugccagcugcgcc

SEQ ID NO: 166300 - RNA, 20 nt, Homo sapiens
aucucugggcaaaggaaaau

SEQ ID NO: 166301 - RNA, 22 nt, Homo sapiens
aucugcauuagggugaagaccu

SEQ ID NO: 166302 - RNA, 22 nt, Homo sapiens
aucugguguccucgugggaguc

SEQ ID NO: 166303 - RNA, 22 nt, Homo sapiens
aucugguguggcugugauccuc

SEQ ID NO: 166304 - RNA, 22 nt, Homo sapiens
augaaacuggagcgccuggagg

SEQ ID NO: 166305 - RNA, 22 nt, Homo sapiens
augaaagugauaaaugucucua

SEQ ID NO: 166306 - RNA, 22 nt, Homo sapiens
augaaaucuuuccugugaggau

SEQ ID NO: 166307 - RNA, 22 nt, Homo sapiens
augaacagagccuugagaaccu

SEQ ID NO: 166308 - RNA, 23 nt, Homo sapiens
augaauguaaggaguguaagaaa

SEQ ID NO: 166309 - RNA, 22 nt, Homo sapiens
augaaugucuuauuuugagaaa

SEQ ID NO: 166310 - RNA, 22 nt, Homo sapiens
augacaagagccuucuuuccuu

SEQ ID NO: 166311 - RNA, 22 nt, Homo sapiens
augacacugcagagauguccca

SEQ ID NO: 166312 - RNA, 22 nt, Homo sapiens
augacagugagugagcucucac

SEQ ID NO: 166313 - RNA, 22 nt, Homo sapiens
augacauugaugcucuggcugg

SEQ ID NO: 166314 - RNA, 21 nt, Homo sapiens
augacccuggguguccuuucc

SEQ ID NO: 166315 - RNA, 22 nt, Homo sapiens
augacucagaucuguuccuggu

SEQ ID NO: 166316 - RNA, 22 nt, Homo sapiens
augacuggaacggcacuuuaca

SEQ ID NO: 166317 - RNA, 22 nt, Homo sapiens
augacuggauaauggacacaca

SEQ ID NO: 166318 - RNA, 17 nt, Homo sapiens
augacuucuucagugug

SEQ ID NO: 166319 - RNA, 22 nt, Homo sapiens
augagagcuaacuguggguaca

SEQ ID NO: 166320 - RNA, 19 nt, Homo sapiens
augagcaauaguuuuaauc

SEQ ID NO: 166321 - RNA, 22 nt, Homo sapiens
augagcacuuguuuugggcaca

SEQ ID NO: 166322 - RNA, 22 nt, Homo sapiens
augagcuauggagacagggcca

SEQ ID NO: 166323 - RNA, 22 nt, Homo sapiens
augagcugauuuccuuaccaua

SEQ ID NO: 166324 - RNA, 22 nt, Homo sapiens
augagcuguuuggaagacacuu

SEQ ID NO: 166325 - RNA, 22 nt, Homo sapiens
augaggagauauuaaauaccau

SEQ ID NO: 166326 - RNA, 22 nt, Homo sapiens
augagggagggcaccugaccuu

SEQ ID NO: 166327 - RNA, 22 nt, Homo sapiens
augauccagugaguuucaguuc

SEQ ID NO: 166328 - RNA, 22 nt, Homo sapiens
augaugaaguaagugcuuagga

SEQ ID NO: 166329 - RNA, 22 nt, Homo sapiens
augcaagacaccgauuagcuuu

SEQ ID NO: 166330 - RNA, 22 nt, Homo sapiens
augcauauuccugggccucacu

SEQ ID NO: 166331 - RNA, 22 nt, Homo sapiens
augcccauuuguuuucugaaag

SEQ ID NO: 166332 - RNA, 19 nt, Homo sapiens
augccucaguuuuguacuu

SEQ ID NO: 166333 - RNA, 22 nt, Homo sapiens
augccucugacaauuggauucu

SEQ ID NO: 166334 - RNA, 22 nt, Homo sapiens
auggaaagcuguuccuacacaa

SEQ ID NO: 166335 - RNA, 22 nt, Homo sapiens
auggaagaaaguuggguucuug

SEQ ID NO: 166336 - RNA, 22 nt, Homo sapiens
auggaaggagaggaaugaauga

SEQ ID NO: 166337 - RNA, 22 nt, Homo sapiens
auggaauguauagucauguagg

SEQ ID NO: 166338 - RNA, 22 nt, Homo sapiens
auggacauuaaagcgauguaga

SEQ ID NO: 166339 - RNA, 21 nt, Homo sapiens
auggacugugugacccugcac

SEQ ID NO: 166340 - RNA, 22 nt, Homo sapiens
auggagaugugcgaacugagua

SEQ ID NO: 166341 - RNA, 22 nt, Homo sapiens
auggaguguaauauugagagcu

SEQ ID NO: 166342 - RNA, 19 nt, Homo sapiens
auggauacauuuucugcua

SEQ ID NO: 166343 - RNA, 22 nt, Homo sapiens
auggauauugccuaggguagua

SEQ ID NO: 166344 - RNA, 22 nt, Homo sapiens
auggcaaaauguuccuaguggu

SEQ ID NO: 166345 - RNA, 22 nt, Homo sapiens
auggcaaugcgauggugacuga

SEQ ID NO: 166346 - RNA, 22 nt, Homo sapiens
auggcacuacugggaaugucuu

SEQ ID NO: 166347 - RNA, 22 nt, Homo sapiens
auggcacugaagcguauugaca

SEQ ID NO: 166348 - RNA, 22 nt, Homo sapiens
auggcacuguguauuuuucugu

SEQ ID NO: 166349 - RNA, 22 nt, Homo sapiens
auggcagagucagaaagucagg

SEQ ID NO: 166350 - RNA, 22 nt, Homo sapiens
auggcagcugacacuuccgucu

SEQ ID NO: 166351 - RNA, 22 nt, Homo sapiens
auggcaguuucacucugggauu

SEQ ID NO: 166352 - RNA, 22 nt, Homo sapiens
auggcaucgucaccuuuucagu

SEQ ID NO: 166353 - RNA, 22 nt, Homo sapiens
auggcuguuuaagaguuucauu

SEQ ID NO: 166354 - RNA, 22 nt, Homo sapiens
auggcuucuucuaaaagugggg

SEQ ID NO: 166355 - RNA, 21 nt, Homo sapiens
augggguagaagagaaggcuu

SEQ ID NO: 166356 - RNA, 22 nt, Homo sapiens
auggucuuuucccuggauuaua

SEQ ID NO: 166357 - RNA, 22 nt, Homo sapiens
augguuuauuuguaagcagagu

SEQ ID NO: 166358 - RNA, 22 nt, Homo sapiens
auguaaacagaugugcagcuug

SEQ ID NO: 166359 - RNA, 22 nt, Homo sapiens
auguauacaugcaggucacagg

SEQ ID NO: 166360 - RNA, 22 nt, Homo sapiens
augugaacaucauagaaugcac

SEQ ID NO: 166361 - RNA, 22 nt, Homo sapiens
augugacagcaacccccagccc

SEQ ID NO: 166362 - RNA, 22 nt, Homo sapiens
augugacuggaucauggggacg

SEQ ID NO: 166363 - RNA, 22 nt, Homo sapiens
augugcaaaguuaagaucccag

SEQ ID NO: 166364 - RNA, 22 nt, Homo sapiens
augugcaauguguacguagccc

SEQ ID NO: 166365 - RNA, 22 nt, Homo sapiens
augugcacaugcuuacauguga

SEQ ID NO: 166366 - RNA, 22 nt, Homo sapiens
auguggcuuuucaacuguguga

SEQ ID NO: 166367 - RNA, 22 nt, Homo sapiens
auguggugguagccaggacagg

SEQ ID NO: 166368 - RNA, 22 nt, Homo sapiens
auuaagugaaugaaguuguucc

SEQ ID NO: 166369 - RNA, 22 nt, Homo sapiens
auuaauguaauuaguaaaguug

SEQ ID NO: 166370 - RNA, 22 nt, Homo sapiens
auuacaugucuauccaugaaca

SEQ ID NO: 166371 - RNA, 22 nt, Homo sapiens
auuauaguguauacuugaaauu

SEQ ID NO: 166372 - RNA, 22 nt, Homo sapiens
auucaagggauuucaggaggcu

SEQ ID NO: 166373 - RNA, 22 nt, Homo sapiens
ucaucagaaucccuuagggaug

SEQ ID NO: 166374 - RNA, 22 nt, Homo sapiens
ucaugacacagcauacugacuu

SEQ ID NO: 166375 - RNA, 22 nt, Homo sapiens
ucaugaccaugguauagaccac

SEQ ID NO: 166376 - RNA, 22 nt, Homo sapiens
ucauggcuuuuauuauguugag

SEQ ID NO: 166377 - RNA, 22 nt, Homo sapiens
ucaugucuuguuguauuuauuu

SEQ ID NO: 166378 - RNA, 22 nt, Homo sapiens
ucauucauucauccagcuugag

SEQ ID NO: 166379 - RNA, 22 nt, Homo sapiens
uccaaguaauuggcggggaguu

SEQ ID NO: 166380 - RNA, 22 nt, Homo sapiens
uccacaguaaggacccugccuu

SEQ ID NO: 166381 - RNA, 22 nt, Homo sapiens
uccacaguggugaggugcagca

SEQ ID NO: 166382 - RNA, 18 nt, Homo sapiens
uccacgugcuuuccagau

SEQ ID NO: 166383 - RNA, 22 nt, Homo sapiens
uccacuuuugugcugaauugga

SEQ ID NO: 166384 - RNA, 22 nt, Homo sapiens
uccaguggacagacauaccaug

SEQ ID NO: 166385 - RNA, 22 nt, Homo sapiens
uccaguuguucucgaagcuccu

SEQ ID NO: 166386 - RNA, 22 nt, Homo sapiens
uccaguuuggaggcuugaugug

SEQ ID NO: 166387 - RNA, 20 nt, Homo sapiens
uccaguuuuggagacauucu

SEQ ID NO: 166388 - RNA, 22 nt, Homo sapiens
uccauaguacuagaaacugacc

SEQ ID NO: 166389 - RNA, 19 nt, Homo sapiens
uccaugagcccacagugau

SEQ ID NO: 166390 - RNA, 22 nt, Homo sapiens
ucccagugaaaccccaccuuca

SEQ ID NO: 166391 - RNA, 22 nt, Homo sapiens
uccccgaggcuggagugcagug

SEQ ID NO: 166392 - RNA, 20 nt, Homo sapiens
ucccucaaacuuuuccacug

SEQ ID NO: 166393 - RNA, 22 nt, Homo sapiens
ucccugaaagcugagauuggaa

SEQ ID NO: 166394 - RNA, 22 nt, Homo sapiens
ucccugagcaaaguuuucugua

SEQ ID NO: 166395 - RNA, 22 nt, Homo sapiens
ucccuguagugccuagaucaga

SEQ ID NO: 166396 - RNA, 22 nt, Homo sapiens
ucccuguguuccuuuugaauug

SEQ ID NO: 166397 - RNA, 22 nt, Homo sapiens
ucccuguuguuucauaauuuua

SEQ ID NO: 166398 - RNA, 18 nt, Homo sapiens
ucccuuuguagaugaccc

SEQ ID NO: 166399 - RNA, 22 nt, Homo sapiens
uccugagacucacaggcucccc

SEQ ID NO: 166400 - RNA, 22 nt, Homo sapiens
uccugagucagcauccguuugu

SEQ ID NO: 166401 - RNA, 22 nt, Homo sapiens
uccugcauucauccugguguug

SEQ ID NO: 166402 - RNA, 22 nt, Homo sapiens
uccuucaugcaucaauguaucc

SEQ ID NO: 166403 - RNA, 22 nt, Homo sapiens
uccuuggucaaaaagaaagugu

SEQ ID NO: 166404 - RNA, 22 nt, Homo sapiens
uccuugguugauccugugcaga

SEQ ID NO: 166405 - RNA, 22 nt, Homo sapiens
uccuuuaguuaauaaagacaag

SEQ ID NO: 166406 - RNA, 22 nt, Homo sapiens
uccuuuggucaguauucuuuug

SEQ ID NO: 166407 - RNA, 22 nt, Homo sapiens
ucgcauuucccucuguagcuuc

SEQ ID NO: 166408 - RNA, 22 nt, Homo sapiens
ucgcugggaagacugaaguguc

SEQ ID NO: 166409 - RNA, 23 nt, Homo sapiens
ucgguccccuuggcugcccucgg

SEQ ID NO: 166410 - RNA, 22 nt, Homo sapiens
ucgugccacugcacuccagccu

SEQ ID NO: 166411 - RNA, 22 nt, Homo sapiens
ucuauggauaaaaugcccucau

SEQ ID NO: 166412 - RNA, 22 nt, Homo sapiens
ucucaaccuccacacuacaaua

SEQ ID NO: 166413 - RNA, 22 nt, Homo sapiens
ucucacagaguugaauguuucu

SEQ ID NO: 166414 - RNA, 22 nt, Homo sapiens
ucucacagccauuucucccucu

SEQ ID NO: 166415 - RNA, 19 nt, Homo sapiens
ucucacagcucuacuaugu

SEQ ID NO: 166416 - RNA, 22 nt, Homo sapiens
ucucagcacaaacaaaauugcu

SEQ ID NO: 166417 - RNA, 20 nt, Homo sapiens
ucucauagagguagagaaua

SEQ ID NO: 166418 - RNA, 22 nt, Homo sapiens
ucucauggagguagagaguaaa

SEQ ID NO: 166419 - RNA, 22 nt, Homo sapiens
ucucauuggucugagucaccug

SEQ ID NO: 166420 - RNA, 22 nt, Homo sapiens
ucucccauccaugaacuucugu

SEQ ID NO: 166421 - RNA, 22 nt, Homo sapiens
ucucugguuaugucauuaagca

SEQ ID NO: 166422 - RNA, 22 nt, Homo sapiens
ucucugguuuucaaagcaguau

SEQ ID NO: 166423 - RNA, 22 nt, Homo sapiens
ucucuguuuauuuuugguguau

SEQ ID NO: 166424 - RNA, 22 nt, Homo sapiens
ucucuuggcggaaguugcagug

SEQ ID NO: 166425 - RNA, 22 nt, Homo sapiens
ucugacaaugaacaaucuauag

SEQ ID NO: 166426 - RNA, 19 nt, Homo sapiens
ucugacagccccagucaac

SEQ ID NO: 166427 - RNA, 22 nt, Homo sapiens
ucugacagugagagaaaucuga

SEQ ID NO: 166428 - RNA, 22 nt, Homo sapiens
ucugagaucaugucugugcugu

SEQ ID NO: 166429 - RNA, 22 nt, Homo sapiens
ucugagaugagacuuugaauuu

SEQ ID NO: 166430 - RNA, 22 nt, Homo sapiens
ucugauggaguugccagggaga

SEQ ID NO: 166431 - RNA, 23 nt, Homo sapiens
ucugauguuauaaaauucuuugg

SEQ ID NO: 166432 - RNA, 23 nt, Homo sapiens
ucuggaucauucguagugccagc

SEQ ID NO: 166433 - RNA, 21 nt, Homo sapiens
ucuggccccuccaaaucucau

SEQ ID NO: 166434 - RNA, 22 nt, Homo sapiens
ucuggccuacaucauuuuuccg

SEQ ID NO: 166435 - RNA, 23 nt, Homo sapiens
ucuggcuuugggaugcucaaggg

SEQ ID NO: 166436 - RNA, 22 nt, Homo sapiens
ucugguggugaugagagacagu

SEQ ID NO: 166437 - RNA, 22 nt, Homo sapiens
ucugugaaaucauuuccuguaa

SEQ ID NO: 166438 - RNA, 22 nt, Homo sapiens
ucugugguaagaaacgcauguc

SEQ ID NO: 166439 - RNA, 22 nt, Homo sapiens
ucuuaggugaugauugauguga

SEQ ID NO: 166440 - RNA, 22 nt, Homo sapiens
ucuucaugcuugaaauaauagc

SEQ ID NO: 166441 - RNA, 22 nt, Homo sapiens
ucuuggguuugccuugcugcug

SEQ ID NO: 166442 - RNA, 22 nt, Homo sapiens
ucuugguuaggggaaauaggca

SEQ ID NO: 166443 - RNA, 20 nt, Homo sapiens
ucuugguuggaggucuuuua

SEQ ID NO: 166444 - RNA, 22 nt, Homo sapiens
ucuuucacuuagcaugauguuu

SEQ ID NO: 166445 - RNA, 20 nt, Homo sapiens
ucuuucgguuaccaggcagu

SEQ ID NO: 166446 - RNA, 22 nt, Homo sapiens
ucuuugaguguauacuuagauu

SEQ ID NO: 166447 - RNA, 22 nt, Homo sapiens
ucuuugauguucugaaagaugg

SEQ ID NO: 166448 - RNA, 22 nt, Homo sapiens
ucuuugauuuuguuacuaagac

SEQ ID NO: 166449 - RNA, 22 nt, Homo sapiens
ucuuuggguagauauguagcug

SEQ ID NO: 166450 - RNA, 22 nt, Homo sapiens
ucuuugguaauggaugucugau

SEQ ID NO: 166451 - RNA, 22 nt, Homo sapiens
ucuuugguaugugcaugugcuu

SEQ ID NO: 166452 - RNA, 22 nt, Homo sapiens
ucuuugguucuguuuauguaau

SEQ ID NO: 166453 - RNA, 22 nt, Homo sapiens
ucuuuguguucaggagccacgu

SEQ ID NO: 166454 - RNA, 22 nt, Homo sapiens
ugaaaagucuaagauuaagguu

SEQ ID NO: 166455 - RNA, 22 nt, Homo sapiens
ugaaaaguuguugaaggcuuca

SEQ ID NO: 166456 - RNA, 22 nt, Homo sapiens
ucccgaggacaucugggggcaa

SEQ ID NO: 166457 - RNA, 22 nt, Homo sapiens
ucccuacuggggcacugccuag

SEQ ID NO: 166458 - RNA, 22 nt, Homo sapiens
ucccuacugggguacugccuag

SEQ ID NO: 166459 - RNA, 22 nt, Homo sapiens
ucccugacagucacagagcuac

SEQ ID NO: 166460 - RNA, 19 nt, Homo sapiens
ucccugagucuuagcuuga

SEQ ID NO: 166461 - RNA, 19 nt, Homo sapiens
ucccuguagaccacagugc

SEQ ID NO: 166462 - RNA, 22 nt, Homo sapiens
ucccuguguccugggggcaccu

SEQ ID NO: 166463 - RNA, 22 nt, Homo sapiens
ucccuugguaauucuguuccuu

SEQ ID NO: 166464 - RNA, 22 nt, Homo sapiens
ucccuuucuggaguuucccaag

SEQ ID NO: 166465 - RNA, 19 nt, Homo sapiens
ucccuuuguagguaaccug

SEQ ID NO: 166466 - RNA, 22 nt, Homo sapiens
uccuacaugcaguacauucaaa

SEQ ID NO: 166467 - RNA, 20 nt, Homo sapiens
uccugagauucccaguucuc

SEQ ID NO: 166468 - RNA, 22 nt, Homo sapiens
uccuucauuugucaacucuagu

SEQ ID NO: 166469 - RNA, 22 nt, Homo sapiens
uccuugagucugaacuuuggau

SEQ ID NO: 166470 - RNA, 22 nt, Homo sapiens
uccuuggugacauuucuugucu

SEQ ID NO: 166471 - RNA, 23 nt, Homo sapiens
uccuugguuggcgcccuaugugu

SEQ ID NO: 166472 - RNA, 22 nt, Homo sapiens
uccuuuggguagcuguucagau

SEQ ID NO: 166473 - RNA, 22 nt, Homo sapiens
uccuuugguuauaggcaccucu

SEQ ID NO: 166474 - RNA, 22 nt, Homo sapiens
uccuuugguucuugucacccca

SEQ ID NO: 166475 - RNA, 18 nt, Homo sapiens
ucucacagcaaucuguca

SEQ ID NO: 166476 - RNA, 22 nt, Homo sapiens
ucucagagccuaggguuuuuca

SEQ ID NO: 166477 - RNA, 22 nt, Homo sapiens
ucucagugaaauaaauuauuuu

SEQ ID NO: 166478 - RNA, 22 nt, Homo sapiens
ucucagugaauugguuuugucu

SEQ ID NO: 166479 - RNA, 22 nt, Homo sapiens
ucucaguggcacccccaacacc

SEQ ID NO: 166480 - RNA, 22 nt, Homo sapiens
ucucaguggcuuccucacuuuu

SEQ ID NO: 166481 - RNA, 22 nt, Homo sapiens
ucucaguggugcuggcagggga

SEQ ID NO: 166482 - RNA, 22 nt, Homo sapiens
ucucaguguuaucuaucugccu

SEQ ID NO: 166483 - RNA, 20 nt, Homo sapiens
ucucauggagggaaagagca

SEQ ID NO: 166484 - RNA, 21 nt, Homo sapiens
ucucauugugguuuuaauugg

SEQ ID NO: 166485 - RNA, 20 nt, Homo sapiens
ucucccaaacagcaggcccu

SEQ ID NO: 166486 - RNA, 17 nt, Homo sapiens
ucucccaucccuuucuc

SEQ ID NO: 166487 - RNA, 22 nt, Homo sapiens
ucucuagagagccugguguuca

SEQ ID NO: 166488 - RNA, 22 nt, Homo sapiens
ucucugaaacucuugacauccu

SEQ ID NO: 166489 - RNA, 22 nt, Homo sapiens
ucucuggauaucuacuuauguu

SEQ ID NO: 166490 - RNA, 19 nt, Homo sapiens
ucucugguguuggagggga

SEQ ID NO: 166491 - RNA, 22 nt, Homo sapiens
ucugagcaugcaucuugccugg

SEQ ID NO: 166492 - RNA, 22 nt, Homo sapiens
ucugagguuaaauuuuauaguu

SEQ ID NO: 166493 - RNA, 22 nt, Homo sapiens
ucugccacugucauugugugau

SEQ ID NO: 166494 - RNA, 21 nt, Homo sapiens
ucuggcccccucaaaucucau

SEQ ID NO: 166495 - RNA, 22 nt, Homo sapiens
ucuggccuagaacaauuaauua

SEQ ID NO: 166496 - RNA, 18 nt, Homo sapiens
ucuggcuucuuuguucca

SEQ ID NO: 166497 - RNA, 22 nt, Homo sapiens
ucuggcuugugaacugucuucu

SEQ ID NO: 166498 - RNA, 22 nt, Homo sapiens
ucuggguuuuguaccgugcucg

SEQ ID NO: 166499 - RNA, 22 nt, Homo sapiens
ucugguguuauucauguaguuu

SEQ ID NO: 166500 - RNA, 22 nt, Homo sapiens
ucugguuccuuggcuucggguc

SEQ ID NO: 166501 - RNA, 22 nt, Homo sapiens
ucugucacugaaucccugucac

SEQ ID NO: 166502 - RNA, 22 nt, Homo sapiens
ucugucuuguccucacccuaga

SEQ ID NO: 166503 - RNA, 22 nt, Homo sapiens
ucugugaaugaacacuugaaaa

SEQ ID NO: 166504 - RNA, 22 nt, Homo sapiens
ucuguggugggcuccacccagu

SEQ ID NO: 166505 - RNA, 21 nt, Homo sapiens
ucuguguugaucucacuggga

SEQ ID NO: 166506 - RNA, 22 nt, Homo sapiens
ucuguguugaugcucauuaauu

SEQ ID NO: 166507 - RNA, 22 nt, Homo sapiens
ucuguuguuguuuuaagagaca

SEQ ID NO: 166508 - RNA, 22 nt, Homo sapiens
ucuuauuuggggaaaggguccu

SEQ ID NO: 166509 - RNA, 22 nt, Homo sapiens
ucuugaacuucauaggucuaga

SEQ ID NO: 166510 - RNA, 22 nt, Homo sapiens
ucuugcuuuugcagagcuucuc

SEQ ID NO: 166511 - RNA, 20 nt, Homo sapiens
ucuugggaauguagccuagg

SEQ ID NO: 166512 - RNA, 22 nt, Homo sapiens
ucuugguugaaaauucauaaua

SEQ ID NO: 166513 - RNA, 22 nt, Homo sapiens
ucuugguuuauugauggagagg

SEQ ID NO: 166514 - RNA, 22 nt, Homo sapiens
ucuugguuuauugugguaugaa

SEQ ID NO: 166515 - RNA, 22 nt, Homo sapiens
ucuuuaguaauuucuguaaggc

SEQ ID NO: 166516 - RNA, 22 nt, Homo sapiens
ucuuugaguggagcgaggcaga

SEQ ID NO: 166517 - RNA, 22 nt, Homo sapiens
ucuuugaguuauugugcagacu

SEQ ID NO: 166518 - RNA, 22 nt, Homo sapiens
ucuuugauaagauccagaagaa

SEQ ID NO: 166519 - RNA, 22 nt, Homo sapiens
ucuuuggauggaaauuggaguc

SEQ ID NO: 166520 - RNA, 22 nt, Homo sapiens
ucuuugguagaagcuauuuuau

SEQ ID NO: 166521 - RNA, 22 nt, Homo sapiens
ucuuugguaggaguaggaggcc

SEQ ID NO: 166522 - RNA, 22 nt, Homo sapiens
ucuuuggucuacuuucauaugu

SEQ ID NO: 166523 - RNA, 22 nt, Homo sapiens
ucuuugguuguuuagggugcau

SEQ ID NO: 166524 - RNA, 22 nt, Homo sapiens
ucuuuugggccucuugucagac

SEQ ID NO: 166525 - RNA, 22 nt, Homo sapiens
ucuuuugguuucuagaggccgc

SEQ ID NO: 166526 - RNA, 22 nt, Homo sapiens
ucuuuuguucuauucaggccuu

SEQ ID NO: 166527 - RNA, 22 nt, Homo sapiens
ugaaacauacacucugaugggg

SEQ ID NO: 166528 - RNA, 22 nt, Homo sapiens
ugaaagacugaaagcuuuucuu

SEQ ID NO: 166529 - RNA, 22 nt, Homo sapiens
ugaaagacugaagaauaggcau

SEQ ID NO: 166530 - RNA, 22 nt, Homo sapiens
ugaaaugccuugagauuuugac

SEQ ID NO: 166531 - RNA, 22 nt, Homo sapiens
ugaacuaguaguuuacuugaug

SEQ ID NO: 166532 - RNA, 22 nt, Homo sapiens
ugaacucauccuuucuuauggc

SEQ ID NO: 166533 - RNA, 22 nt, Homo sapiens
ugagguuggguaauuuaugaag

SEQ ID NO: 166534 - RNA, 22 nt, Homo sapiens
ugagguugucagugucauucuu

SEQ ID NO: 166535 - RNA, 22 nt, Homo sapiens
ugaguagauccaagacuguccu

SEQ ID NO: 166536 - RNA, 21 nt, Homo sapiens
ugaguagcuagaacuaggggc

SEQ ID NO: 166537 - RNA, 23 nt, Homo sapiens
ugaguagguccacguaugugagu

SEQ ID NO: 166538 - RNA, 22 nt, Homo sapiens
ugaguaugaguucaggaaaggc

SEQ ID NO: 166539 - RNA, 22 nt, Homo sapiens
ugagucuguucucacauugcua

SEQ ID NO: 166540 - RNA, 22 nt, Homo sapiens
ugagugaaugugaaggcuaggg

SEQ ID NO: 166541 - RNA, 22 nt, Homo sapiens
ugagugccuggagggcagggac

SEQ ID NO: 166542 - RNA, 22 nt, Homo sapiens
ugaguucauggucauuugucac

SEQ ID NO: 166543 - RNA, 22 nt, Homo sapiens
ugaguuccuuucccaguccagu

SEQ ID NO: 166544 - RNA, 22 nt, Homo sapiens
ugaguuguaggggucaccuggc

SEQ ID NO: 166545 - RNA, 22 nt, Homo sapiens
ugauaguguccugugccacauu

SEQ ID NO: 166546 - RNA, 22 nt, Homo sapiens
ugauaguugucagugggggacc

SEQ ID NO: 166547 - RNA, 22 nt, Homo sapiens
ugauaucugaucauccuugaua

SEQ ID NO: 166548 - RNA, 22 nt, Homo sapiens
ugauauuuuugauccuuaaguu

SEQ ID NO: 166549 - RNA, 21 nt, Homo sapiens
ugaucacaugaaaaccaugca

SEQ ID NO: 166550 - RNA, 22 nt, Homo sapiens
ugauccagugcucaguuggagu

SEQ ID NO: 166551 - RNA, 23 nt, Homo sapiens
ugauguccacuuagggucuaggu

SEQ ID NO: 166552 - RNA, 18 nt, Homo sapiens
ugauugacuuauuuaggu

SEQ ID NO: 166553 - RNA, 22 nt, Homo sapiens
ugauuugucucucagcccuacu

SEQ ID NO: 166554 - RNA, 22 nt, Homo sapiens
ugcaagaaucuuucaggcuagc

SEQ ID NO: 166555 - RNA, 22 nt, Homo sapiens
ugcaaguaauuccagcuacuga

SEQ ID NO: 166556 - RNA, 22 nt, Homo sapiens
ugcaccacuacacuccaggcug

SEQ ID NO: 166557 - RNA, 22 nt, Homo sapiens
ugcaccauugcacuccagccug

SEQ ID NO: 166558 - RNA, 22 nt, Homo sapiens
ugcaccauugcauuccagccug

SEQ ID NO: 166559 - RNA, 22 nt, Homo sapiens
ugcagaaucccuucagauccga

SEQ ID NO: 166560 - RNA, 22 nt, Homo sapiens
ugcagcacaguagguuugcaau

SEQ ID NO: 166561 - RNA, 20 nt, Homo sapiens
ugcagcacgggcccuuucca

SEQ ID NO: 166562 - RNA, 22 nt, Homo sapiens
ugcagcacugaacuucugggcu

SEQ ID NO: 166563 - RNA, 22 nt, Homo sapiens
ugcagcauguaggcacguuauu

SEQ ID NO: 166564 - RNA, 21 nt, Homo sapiens
ugcagccauucagcccuaugc

SEQ ID NO: 166565 - RNA, 22 nt, Homo sapiens
ugcagugugauuuucuggcuga

SEQ ID NO: 166566 - RNA, 22 nt, Homo sapiens
ugcauaucuuguggaauaucuc

SEQ ID NO: 166567 - RNA, 22 nt, Homo sapiens
ugcauauguugagaugcauauu

SEQ ID NO: 166568 - RNA, 22 nt, Homo sapiens
ugcauggucauacauggcaccc

SEQ ID NO: 166569 - RNA, 20 nt, Homo sapiens
ugcauguccucacuuacuug

SEQ ID NO: 166570 - RNA, 22 nt, Homo sapiens
ugccaguauuuuauuaagaauu

SEQ ID NO: 166571 - RNA, 22 nt, Homo sapiens
ugccaguauuuuauugaggauu

SEQ ID NO: 166572 - RNA, 19 nt, Homo sapiens
ugccauguagcacaugguc

SEQ ID NO: 166573 - RNA, 22 nt, Homo sapiens
ugccauugcacuccagccuggg

SEQ ID NO: 166574 - RNA, 22 nt, Homo sapiens
ugcccuguaucccacuguuuca

SEQ ID NO: 166575 - RNA, 20 nt, Homo sapiens
ugccugacacucuuugcuuc

SEQ ID NO: 166576 - RNA, 22 nt, Homo sapiens
ugccuucuguuaaacgaggaug

SEQ ID NO: 166577 - RNA, 22 nt, Homo sapiens
ugcuacccuucgucucucuggu

SEQ ID NO: 166578 - RNA, 22 nt, Homo sapiens
ugcuagaugcuguagggauuua

SEQ ID NO: 166579 - RNA, 22 nt, Homo sapiens
ugcugcaaacaugagaggaagu

SEQ ID NO: 166580 - RNA, 22 nt, Homo sapiens
ugcuggcguuacucuccaucag

SEQ ID NO: 166581 - RNA, 22 nt, Homo sapiens
ugcugguggucccauaugauua

SEQ ID NO: 166582 - RNA, 22 nt, Homo sapiens
ugcugguuuucaucaucagugg

SEQ ID NO: 166583 - RNA, 22 nt, Homo sapiens
ugcuguuguuugaugaaguaau

SEQ ID NO: 166584 - RNA, 22 nt, Homo sapiens
ugcuuuguugaaaaucauuugg

SEQ ID NO: 166585 - RNA, 22 nt, Homo sapiens
uggaaauaaaauagaguuugcc

SEQ ID NO: 166586 - RNA, 22 nt, Homo sapiens
uggaaauuaagucuuuccugag

SEQ ID NO: 166587 - RNA, 22 nt, Homo sapiens
uggaagacacauaccugauaac

SEQ ID NO: 166588 - RNA, 22 nt, Homo sapiens
uggaagcaugcaaucugugggg

SEQ ID NO: 166589 - RNA, 20 nt, Homo sapiens
uggaaggcaucugcauuauu

SEQ ID NO: 166590 - RNA, 22 nt, Homo sapiens
uggaaguuaaauuaguugauga

SEQ ID NO: 166591 - RNA, 20 nt, Homo sapiens
uggaaucugaagaucucagu

SEQ ID NO: 166592 - RNA, 22 nt, Homo sapiens
uggaaugcucuccccacggacu

SEQ ID NO: 166593 - RNA, 22 nt, Homo sapiens
uggaaugucuauguuuuugauu

SEQ ID NO: 166594 - RNA, 21 nt, Homo sapiens
uggaccccuuccuuacaucau

SEQ ID NO: 166595 - RNA, 22 nt, Homo sapiens
uggaccccuucuccuauuaaaa

SEQ ID NO: 166596 - RNA, 21 nt, Homo sapiens
uggaccccuuucuuacaccgu

SEQ ID NO: 166597 - RNA, 22 nt, Homo sapiens
uggacuguaauuuuauaggcau

SEQ ID NO: 166598 - RNA, 22 nt, Homo sapiens
uggagagcaaaaucaauccaaa

SEQ ID NO: 166599 - RNA, 22 nt, Homo sapiens
uggagagcaaagaauuuguuag

SEQ ID NO: 166600 - RNA, 22 nt, Homo sapiens
uggagauguuuaaaauccacug

SEQ ID NO: 166601 - RNA, 22 nt, Homo sapiens
uggagcccuaaacuucuaauau

SEQ ID NO: 166602 - RNA, 22 nt, Homo sapiens
uggagguagagaugggaucucc

SEQ ID NO: 166603 - RNA, 22 nt, Homo sapiens
uggagugcaauggugagaucuu

SEQ ID NO: 166604 - RNA, 22 nt, Homo sapiens
uggagugcgagggugaaacuuu

SEQ ID NO: 166605 - RNA, 22 nt, Homo sapiens
uggauagaacuaagugcuuaga

SEQ ID NO: 166606 - RNA, 22 nt, Homo sapiens
uggauagauacuauccaggacu

SEQ ID NO: 166607 - RNA, 22 nt, Homo sapiens
uggaugacauccuuguaugcag

SEQ ID NO: 166608 - RNA, 18 nt, Homo sapiens
uggauuguacuguguucu

SEQ ID NO: 166609 - RNA, 22 nt, Homo sapiens
uggcaaaaaaacgcaauuacgu

SEQ ID NO: 166610 - RNA, 22 nt, Homo sapiens
uggcaaagugugacgugggggu

SEQ ID NO: 166611 - RNA, 22 nt, Homo sapiens
uggcaaauagcaauaggagggu

SEQ ID NO: 166612 - RNA, 22 nt, Homo sapiens
uggcaaaugaagucagcuguac

SEQ ID NO: 166613 - RNA, 21 nt, Homo sapiens
uggcaacauggauggauucug

SEQ ID NO: 166614 - RNA, 22 nt, Homo sapiens
uggcaagaccccaucucuacaa

SEQ ID NO: 166615 - RNA, 22 nt, Homo sapiens
uggcaagagggaugcaagguuu

SEQ ID NO: 166616 - RNA, 22 nt, Homo sapiens
uguggcauugaauaaccuugga

SEQ ID NO: 166617 - RNA, 22 nt, Homo sapiens
uguggcucuucuguucuccacu

SEQ ID NO: 166618 - RNA, 22 nt, Homo sapiens
uguggcugguggcaccuuuucc

SEQ ID NO: 166619 - RNA, 22 nt, Homo sapiens
uguguaaauaugauagaggaau

SEQ ID NO: 166620 - RNA, 19 nt, Homo sapiens
uuuuguacucugugacuug

SEQ ID NO: 166621 - RNA, 22 nt, Homo sapiens
uuuuucacuuaaguuaggcuca

SEQ ID NO: 166622 - RNA, 22 nt, Homo sapiens
uuuuugauuaauggguagacca

SEQ ID NO: 166623 - RNA, 22 nt, Homo sapiens
auggcaauaugaugcacuguuu

SEQ ID NO: 166624 - RNA, 22 nt, Homo sapiens
auggcaaugcgaugaugacuga

SEQ ID NO: 166625 - RNA, 22 nt, Homo sapiens
auggcacugauggaaguaccuu

SEQ ID NO: 166626 - RNA, 22 nt, Homo sapiens
auggcacuguguccugggguca

SEQ ID NO: 166627 - RNA, 18 nt, Homo sapiens
auggcagaacaauuuaca

SEQ ID NO: 166628 - RNA, 22 nt, Homo sapiens
auggcauugaagaguugucccu

SEQ ID NO: 166629 - RNA, 22 nt, Homo sapiens
auggccauuacuaagaauguuu

SEQ ID NO: 166630 - RNA, 22 nt, Homo sapiens
auggcccugaguucaauauauu

SEQ ID NO: 166631 - RNA, 22 nt, Homo sapiens
auggcucuggauagaaugcagg

SEQ ID NO: 166632 - RNA, 22 nt, Homo sapiens
auggcugagugauuucaaacag

SEQ ID NO: 166633 - RNA, 22 nt, Homo sapiens
auggcugugaaaugguaggugg

SEQ ID NO: 166634 - RNA, 22 nt, Homo sapiens
auggcugugagaucgacuuauu

SEQ ID NO: 166635 - RNA, 22 nt, Homo sapiens
auggcuguuuuuuauguuacag

SEQ ID NO: 166636 - RNA, 22 nt, Homo sapiens
auggcuuucaggacguggcgag

SEQ ID NO: 166637 - RNA, 22 nt, Homo sapiens
auggcuuuguguucagagcuga

SEQ ID NO: 166638 - RNA, 22 nt, Homo sapiens
auggcuuuuuucuugggcacuc

SEQ ID NO: 166639 - RNA, 22 nt, Homo sapiens
augggguaggcuuugcugcagu

SEQ ID NO: 166640 - RNA, 22 nt, Homo sapiens
augguaagcugaaaauaucgaa

SEQ ID NO: 166641 - RNA, 22 nt, Homo sapiens
augguacuagaguaagaauugu

SEQ ID NO: 166642 - RNA, 21 nt, Homo sapiens
augguacugucucuggagaua

SEQ ID NO: 166643 - RNA, 20 nt, Homo sapiens
agcuccauuccugaaggcug

SEQ ID NO: 166644 - RNA, 22 nt, Homo sapiens
agcuccuacuguuacaucauug

SEQ ID NO: 166645 - RNA, 22 nt, Homo sapiens
agcucuuguuaguauuagcagu

SEQ ID NO: 166646 - RNA, 22 nt, Homo sapiens
agcugauuuuaaguccuugucc

SEQ ID NO: 166647 - RNA, 20 nt, Homo sapiens
agcugcagauauaaauccgc

SEQ ID NO: 166648 - RNA, 22 nt, Homo sapiens
agcuggacuugauaaaugaaua

SEQ ID NO: 166649 - RNA, 20 nt, Homo sapiens
agcuggguguguuggugcau

SEQ ID NO: 166650 - RNA, 22 nt, Homo sapiens
agcuggucucaggugcccugcu

SEQ ID NO: 166651 - RNA, 22 nt, Homo sapiens
agcuguaguuuauucauguuaa

SEQ ID NO: 166652 - RNA, 22 nt, Homo sapiens
agcuguaguuugguggauguaa

SEQ ID NO: 166653 - RNA, 20 nt, Homo sapiens
agcuguuguuaaaaaggagg

SEQ ID NO: 166654 - RNA, 22 nt, Homo sapiens
agcuguuguuuuaagauacuaa

SEQ ID NO: 166655 - RNA, 22 nt, Homo sapiens
agcuugugauucuccaucaugu

SEQ ID NO: 166656 - RNA, 22 nt, Homo sapiens
aggaaaucuuagcugaggggau

SEQ ID NO: 166657 - RNA, 22 nt, Homo sapiens
aggacacugauagucuuuggca

SEQ ID NO: 166658 - RNA, 22 nt, Homo sapiens
caaguacugggcuauggauauu

SEQ ID NO: 166659 - RNA, 22 nt, Homo sapiens
caagugaauaguugcucucaga

SEQ ID NO: 166660 - RNA, 22 nt, Homo sapiens
caagugacugagccgccucggc

SEQ ID NO: 166661 - RNA, 21 nt, Homo sapiens
caagugaugcuucugcuuuaa

SEQ ID NO: 166662 - RNA, 22 nt, Homo sapiens
caagugcuacagagaaaucuuu

SEQ ID NO: 166663 - RNA, 22 nt, Homo sapiens
caagugcuuucuuggggauuua

SEQ ID NO: 166664 - RNA, 22 nt, Homo sapiens
cacaaugucugguaggccacuu

SEQ ID NO: 166665 - RNA, 22 nt, Homo sapiens
cacagagugagacccugucucu

SEQ ID NO: 166666 - RNA, 22 nt, Homo sapiens
cacagcuagucaaugguagaca

SEQ ID NO: 166667 - RNA, 22 nt, Homo sapiens
cacagggcuaacauuuuugccc

SEQ ID NO: 166668 - RNA, 23 nt, Homo sapiens
cacagggugaacaccccuaaucc

SEQ ID NO: 166669 - RNA, 22 nt, Homo sapiens
cacauagcuagucaguagugaa

SEQ ID NO: 166670 - RNA, 21 nt, Homo sapiens
cacauggaggcagagagugua

SEQ ID NO: 166671 - RNA, 22 nt, Homo sapiens
cacccaguaagcaugaggcccu

SEQ ID NO: 166672 - RNA, 22 nt, Homo sapiens
caccuagacuggagugcagugg

SEQ ID NO: 166673 - RNA, 22 nt, Homo sapiens
caccuguagucccagcugaggc

SEQ ID NO: 166674 - RNA, 22 nt, Homo sapiens
caccuugugauccacccgccuu

SEQ ID NO: 166675 - RNA, 22 nt, Homo sapiens
cacugcacuccagucccgucuc

SEQ ID NO: 166676 - RNA, 22 nt, Homo sapiens
cacugggugagauccauguuua

SEQ ID NO: 166677 - RNA, 22 nt, Homo sapiens
cacuggucucauggcaugagag

SEQ ID NO: 166678 - RNA, 22 nt, Homo sapiens
cacugugcaaccuccaccuccc

SEQ ID NO: 166679 - RNA, 22 nt, Homo sapiens
cagaaguauugguaugcucugu

SEQ ID NO: 166680 - RNA, 22 nt, Homo sapiens
guguuugauugcaaauaaucua

SEQ ID NO: 166681 - RNA, 22 nt, Homo sapiens
guuaaagacauccacauaggag

SEQ ID NO: 166682 - RNA, 22 nt, Homo sapiens
guuaagaaguguaacuuaaguu

SEQ ID NO: 166683 - RNA, 22 nt, Homo sapiens
guucaagcaauucugcugccuc

SEQ ID NO: 166684 - RNA, 22 nt, Homo sapiens
guucaagugauagcugggauua

SEQ ID NO: 166685 - RNA, 22 nt, Homo sapiens
guucaagugauucuacugccuc

SEQ ID NO: 166686 - RNA, 22 nt, Homo sapiens
guucacaguuaggacaacugcu

SEQ ID NO: 166687 - RNA, 22 nt, Homo sapiens
guucaucagggauacuggccuu

SEQ ID NO: 166688 - RNA, 22 nt, Homo sapiens
guucaucagggauacuggcuua

SEQ ID NO: 166689 - RNA, 23 nt, Homo sapiens
guucaucagggauauuggccuga

SEQ ID NO: 166690 - RNA, 18 nt, Homo sapiens
guugagcuuuuccuuuag

SEQ ID NO: 166691 - RNA, 22 nt, Homo sapiens
guugauguugcagucuugagga

SEQ ID NO: 166692 - RNA, 22 nt, Homo sapiens
guuggcuguuucccccaaguga

SEQ ID NO: 166693 - RNA, 22 nt, Homo sapiens
guuuaacugguacuucaagucu

SEQ ID NO: 166694 - RNA, 22 nt, Homo sapiens
guuugcagaucaugaagaaccc

SEQ ID NO: 166695 - RNA, 22 nt, Homo sapiens
guuuguaacucuagugacuaga

SEQ ID NO: 166696 - RNA, 22 nt, Homo sapiens
uaaaccuagcauuuugcauaug

SEQ ID NO: 166697 - RNA, 21 nt, Homo sapiens
uaaagcuuagcuauaguggcu

SEQ ID NO: 166698 - RNA, 18 nt, Homo sapiens
uaaaggcacuguguuguu

SEQ ID NO: 166699 - RNA, 20 nt, Homo sapiens
uaaaugccucaugcuuuauu

SEQ ID NO: 166700 - RNA, 22 nt, Homo sapiens
uaaaugcuugagaugauggaua

SEQ ID NO: 166701 - RNA, 21 nt, Homo sapiens
uaaaugucauacaaagcaaug

SEQ ID NO: 166702 - RNA, 22 nt, Homo sapiens
uaaauugcauaaguacaaauga

SEQ ID NO: 166703 - RNA, 22 nt, Homo sapiens
uaacuaaagagaagucaauguc

SEQ ID NO: 166704 - RNA, 22 nt, Homo sapiens
uaacuauagagaauguugagua

SEQ ID NO: 166705 - RNA, 22 nt, Homo sapiens
uaacugccuacugugcaaauau

SEQ ID NO: 166706 - RNA, 22 nt, Homo sapiens
uaaggauuuuggugauuacacu

SEQ ID NO: 166707 - RNA, 22 nt, Homo sapiens
uaagucacuccagguuaaagug

SEQ ID NO: 166708 - RNA, 22 nt, Homo sapiens
uaagugcaacauaaguguuaaa

SEQ ID NO: 166709 - RNA, 20 nt, Homo sapiens
uaagugcuugagacuucuga

SEQ ID NO: 166710 - RNA, 20 nt, Homo sapiens
uaagugcuugaugaaugaac

SEQ ID NO: 166711 - RNA, 20 nt, Homo sapiens
uaagugcuuuauauugauua

SEQ ID NO: 166712 - RNA, 22 nt, Homo sapiens
uaaguggaagaugucaaucaua

SEQ ID NO: 166713 - RNA, 22 nt, Homo sapiens
uaaguggugcauuguuaaaugg

SEQ ID NO: 166714 - RNA, 23 nt, Homo sapiens
uaaguucaucucuaauaggugga

SEQ ID NO: 166715 - RNA, 22 nt, Homo sapiens
uaauacuugucauaaaggcauu

SEQ ID NO: 166716 - RNA, 22 nt, Homo sapiens
uaauaguuggcacuggagaaag

SEQ ID NO: 166717 - RNA, 22 nt, Homo sapiens
uaauccugucuugaccaucagg

SEQ ID NO: 166718 - RNA, 22 nt, Homo sapiens
uaaugcaucaugguuggcaaac

SEQ ID NO: 166719 - RNA, 22 nt, Homo sapiens
uaaugcuugguuguuuggaaaa

SEQ ID NO: 166720 - RNA, 22 nt, Homo sapiens
uaauucuguauguaucagaguu

SEQ ID NO: 166721 - RNA, 22 nt, Homo sapiens
uacaaagcuuucugcaaaucau

SEQ ID NO: 166722 - RNA, 22 nt, Homo sapiens
uacacagucaaaaauuuccagg

SEQ ID NO: 166723 - RNA, 18 nt, Homo sapiens
uacagaacuggaguagaa

SEQ ID NO: 166724 - RNA, 22 nt, Homo sapiens
uacagcacaggugcagguguug

SEQ ID NO: 166725 - RNA, 23 nt, Homo sapiens
uacagcugcagaaucaggcuaag

SEQ ID NO: 166726 - RNA, 22 nt, Homo sapiens
uacaggcagguguucccugguu

SEQ ID NO: 166727 - RNA, 22 nt, Homo sapiens
uacaguauuaugagugauugaa

SEQ ID NO: 166728 - RNA, 22 nt, Homo sapiens
uuguccuugagauaguuugcag

SEQ ID NO: 166729 - RNA, 22 nt, Homo sapiens
uugucucacuggaguuuaguaa

SEQ ID NO: 166730 - RNA, 22 nt, Homo sapiens
uugugaagaaaccagaaaaguu

SEQ ID NO: 166731 - RNA, 22 nt, Homo sapiens
uugugacacagcugggccuaua

SEQ ID NO: 166732 - RNA, 22 nt, Homo sapiens
uugugagggagcuaagaugagu

SEQ ID NO: 166733 - RNA, 22 nt, Homo sapiens
uugugaucauugucaaauagug

SEQ ID NO: 166734 - RNA, 22 nt, Homo sapiens
uugugcaaaaguaauugcgguu

SEQ ID NO: 166735 - RNA, 22 nt, Homo sapiens
uugugcauguauauuaguucac

SEQ ID NO: 166736 - RNA, 22 nt, Homo sapiens
uugugcuccagagacgggcucg

SEQ ID NO: 166737 - RNA, 22 nt, Homo sapiens
uuguggcuuaucucauuuagcg

SEQ ID NO: 166738 - RNA, 19 nt, Homo sapiens
uugugggaggacagagggg

SEQ ID NO: 166739 - RNA, 22 nt, Homo sapiens
uugugggaggugauuagaucau

SEQ ID NO: 166740 - RNA, 19 nt, Homo sapiens
uuguguccccacaaaauuc

SEQ ID NO: 166741 - RNA, 22 nt, Homo sapiens
uugugucccuacccaaaucuca

SEQ ID NO: 166742 - RNA, 22 nt, Homo sapiens
uuguuauguaucucaagauaaa

SEQ ID NO: 166743 - RNA, 22 nt, Homo sapiens
uuguuauguuaaacuacugaaa

SEQ ID NO: 166744 - RNA, 22 nt, Homo sapiens
uuuaaaguuagaaggaaagggc

SEQ ID NO: 166745 - RNA, 22 nt, Homo sapiens
uuuaaugcgucucugaguuuug

SEQ ID NO: 166746 - RNA, 22 nt, Homo sapiens
uuuacugugggguuucuuagag

SEQ ID NO: 166747 - RNA, 22 nt, Homo sapiens
uuuagcaaagcaauuuacacca

SEQ ID NO: 166748 - RNA, 22 nt, Homo sapiens
uuuaggcaauauauucaugucu

SEQ ID NO: 166749 - RNA, 22 nt, Homo sapiens
uuuaguucauuaaggaaucucc

SEQ ID NO: 166750 - RNA, 19 nt, Homo sapiens
uuucacacucgccuacuuc

SEQ ID NO: 166751 - RNA, 23 nt, Homo sapiens
uuucacagaaggauuguagggcc

SEQ ID NO: 166752 - RNA, 22 nt, Homo sapiens
uuucacagagggcuucuuucua

SEQ ID NO: 166753 - RNA, 23 nt, Homo sapiens
uuucacaguagcuggaucagccu

SEQ ID NO: 166754 - RNA, 19 nt, Homo sapiens
uuuccaguaaucuuaugug

SEQ ID NO: 166755 - RNA, 19 nt, Homo sapiens
uuucccugcagaccuacua

SEQ ID NO: 166756 - RNA, 22 nt, Homo sapiens
uuuccuggagaaucuuaacaaa

SEQ ID NO: 166757 - RNA, 22 nt, Homo sapiens
uuucugaggccucaccagaagc

SEQ ID NO: 166758 - RNA, 22 nt, Homo sapiens
uuucugguuaauuucuaagagc

SEQ ID NO: 166759 - RNA, 22 nt, Homo sapiens
uuugaaguguggcacugaguuu

SEQ ID NO: 166760 - RNA, 22 nt, Homo sapiens
uuugaauguaaugagcaggaag

SEQ ID NO: 166761 - RNA, 22 nt, Homo sapiens
uuugacucacagccuggcugcc

SEQ ID NO: 166762 - RNA, 23 nt, Homo sapiens
uuugagugugauaaacacuguca

SEQ ID NO: 166763 - RNA, 21 nt, Homo sapiens
uuugaucauuaaaagugaauc

SEQ ID NO: 166764 - RNA, 22 nt, Homo sapiens
uuugauguugagacuauaaagc

SEQ ID NO: 166765 - RNA, 22 nt, Homo sapiens
uuugcaagaugaaaaaguucua

SEQ ID NO: 166766 - RNA, 22 nt, Homo sapiens
uuugcuuaguaaauguagaaaa

SEQ ID NO: 166767 - RNA, 22 nt, Homo sapiens
uuuggcaacguuggaucccuca

SEQ ID NO: 166768 - RNA, 22 nt, Homo sapiens
uuuggcaauuugacuguauagg

SEQ ID NO: 166769 - RNA, 22 nt, Homo sapiens
uuuggcagaugacccucaaguu

SEQ ID NO: 166770 - RNA, 22 nt, Homo sapiens
uuuggcaugggcuauuugcuuu

SEQ ID NO: 166771 - RNA, 22 nt, Homo sapiens
uuuggcucugugucccacccaa

SEQ ID NO: 166772 - RNA, 22 nt, Homo sapiens
uuuggcuguuucuggacuaaga

SEQ ID NO: 166773 - RNA, 22 nt, Homo sapiens
uuuggcuuaagauugacugcaa

SEQ ID NO: 166774 - RNA, 22 nt, Homo sapiens
uuugggaaugguuugucuccca

SEQ ID NO: 166775 - RNA, 22 nt, Homo sapiens
uuuggucuuuuauuuaaagcag

SEQ ID NO: 166776 - RNA, 22 nt, Homo sapiens
uuugguguauaaaaaugcuagu

SEQ ID NO: 166777 - RNA, 22 nt, Homo sapiens
uuuguaagaugcauagauugca

SEQ ID NO: 166778 - RNA, 22 nt, Homo sapiens
uuuguaauccuauuccaaagga

SEQ ID NO: 166779 - RNA, 23 nt, Homo sapiens
uuuguaguagcaugauuuauaau

SEQ ID NO: 166780 - RNA, 22 nt, Homo sapiens
uuugucauagcagcaggaaugg

SEQ ID NO: 166781 - RNA, 22 nt, Homo sapiens
uuugugaggugauggauauguc

SEQ ID NO: 166782 - RNA, 22 nt, Homo sapiens
uuugugcuaaugcuagauuacu

SEQ ID NO: 166783 - RNA, 23 nt, Homo sapiens
uuugugcuaauuuaugggcucuu

SEQ ID NO: 166784 - RNA, 22 nt, Homo sapiens
uuugugcuccucucaguaugug

SEQ ID NO: 166785 - RNA, 22 nt, Homo sapiens
uuugugucccucuaaaauuuau

SEQ ID NO: 166786 - RNA, 22 nt, Homo sapiens
uuuguuugaagucgagacaacu

SEQ ID NO: 166787 - RNA, 22 nt, Homo sapiens
uuuuacagaggagguugcugau

SEQ ID NO: 166788 - RNA, 22 nt, Homo sapiens
uuuuagcagccaugacaaagau

SEQ ID NO: 166789 - RNA, 22 nt, Homo sapiens
uuuuaguggacaaagguauuua

SEQ ID NO: 166790 - RNA, 22 nt, Homo sapiens
uuuucaguggccauaguggaga

SEQ ID NO: 166791 - RNA, 20 nt, Homo sapiens
uuuugcacuccuacuaaggu

SEQ ID NO: 166792 - RNA, 19 nt, Homo sapiens
uuuugcucuuuauaccuau

SEQ ID NO: 166793 - RNA, 19 nt, Homo sapiens
uuuuggaaaugugaacagc

SEQ ID NO: 166794 - RNA, 22 nt, Homo sapiens
uuuuggacuugcuccccugucc

SEQ ID NO: 166795 - RNA, 22 nt, Homo sapiens
uuuuggcuuaaagagaauguau

SEQ ID NO: 166796 - RNA, 22 nt, Homo sapiens
uuuuugagaauuggugaaacac

SEQ ID NO: 166797 - RNA, 22 nt, Homo sapiens
uucuuugguacaagggccgacc

SEQ ID NO: 166798 - RNA, 19 nt, Homo sapiens
uucuuuguugugggggcug

SEQ ID NO: 166799 - RNA, 23 nt, Homo sapiens
uugaaaagucaguagccucugau

SEQ ID NO: 166800 - RNA, 22 nt, Homo sapiens
uugaaagcuaucagagauucca

SEQ ID NO: 166801 - RNA, 22 nt, Homo sapiens
uugaaaucuuccacagcccaag

SEQ ID NO: 166802 - RNA, 22 nt, Homo sapiens
uugaagugaagaacaauaucac

SEQ ID NO: 166803 - RNA, 22 nt, Homo sapiens
uugaauaggcucaugcuuauca

SEQ ID NO: 166804 - RNA, 22 nt, Homo sapiens
uugaauguacuuguucucacua

SEQ ID NO: 166805 - RNA, 22 nt, Homo sapiens
uugacauugcuguaguguccag

SEQ ID NO: 166806 - RNA, 23 nt, Homo sapiens
uugacuguggguacaaugugaua

SEQ ID NO: 166807 - RNA, 21 nt, Homo sapiens
uugagaagaauuagcucuucc

SEQ ID NO: 166808 - RNA, 22 nt, Homo sapiens
uugagagcugaugaaagauaaa

SEQ ID NO: 166809 - RNA, 22 nt, Homo sapiens
uugagaguggaggcuauaucuu

SEQ ID NO: 166810 - RNA, 22 nt, Homo sapiens
uugagauggagucucacuccuu

SEQ ID NO: 166811 - RNA, 22 nt, Homo sapiens
uugagauggagucucgcucugu

SEQ ID NO: 166812 - RNA, 22 nt, Homo sapiens
uugagauggagucucguucugu

SEQ ID NO: 166813 - RNA, 22 nt, Homo sapiens
uugagauggaguuucgcucuug

SEQ ID NO: 166814 - RNA, 22 nt, Homo sapiens
uugagauggauagacauagcau

SEQ ID NO: 166815 - RNA, 19 nt, Homo sapiens
uugagaugugaacucacac

SEQ ID NO: 166816 - RNA, 22 nt, Homo sapiens
uugagcacaguagguuguggcu

SEQ ID NO: 166817 - RNA, 22 nt, Homo sapiens
uugagcacugucugugugcagu

SEQ ID NO: 166818 - RNA, 21 nt, Homo sapiens
uugagcuuuuaguacagacag

SEQ ID NO: 166819 - RNA, 22 nt, Homo sapiens
uugaggaggcagucucuccauu

SEQ ID NO: 166820 - RNA, 23 nt, Homo sapiens
uugaggcauguaccaucaauauc

SEQ ID NO: 166821 - RNA, 16 nt, Homo sapiens
uugaggcaugucucag

SEQ ID NO: 166822 - RNA, 22 nt, Homo sapiens
uugaggccugauaacacacuga

SEQ ID NO: 166823 - RNA, 22 nt, Homo sapiens
uugagggaagccagaggucugc

SEQ ID NO: 166824 - RNA, 22 nt, Homo sapiens
uugagggagcacagauucuuau

SEQ ID NO: 166825 - RNA, 22 nt, Homo sapiens
uugagggagccuguuagucccg

SEQ ID NO: 166826 - RNA, 22 nt, Homo sapiens
uugagggaggccucaguuuaca

SEQ ID NO: 166827 - RNA, 22 nt, Homo sapiens
uugagguagcuuugauggaggu

SEQ ID NO: 166828 - RNA, 22 nt, Homo sapiens
uugagguauugauaaaacauuu

SEQ ID NO: 166829 - RNA, 22 nt, Homo sapiens
uugagguauuuugucaacugua

SEQ ID NO: 166830 - RNA, 22 nt, Homo sapiens
uugagguguauuguacagcaca

SEQ ID NO: 166831 - RNA, 22 nt, Homo sapiens
uugaguauuggacugguaucuu

SEQ ID NO: 166832 - RNA, 22 nt, Homo sapiens
uugauuagauccaguugauuga

SEQ ID NO: 166833 - RNA, 22 nt, Homo sapiens
uugauugacaugucucuguuca

SEQ ID NO: 166834 - RNA, 22 nt, Homo sapiens
uugcaaaguuugccuccuguag

SEQ ID NO: 166835 - RNA, 21 nt, Homo sapiens
uugcaaaugcugcugccugau

SEQ ID NO: 166836 - RNA, 22 nt, Homo sapiens
uugcaagauguucaugggcugu

SEQ ID NO: 166837 - RNA, 22 nt, Homo sapiens
uugcacagucuagcuccaccuu

SEQ ID NO: 166838 - RNA, 22 nt, Homo sapiens
uugcacagugguuuagagccug

SEQ ID NO: 166839 - RNA, 22 nt, Homo sapiens
uugcaccacugcacuccacccu

SEQ ID NO: 166840 - RNA, 22 nt, Homo sapiens
uugcacuccagccugggugaca

SEQ ID NO: 166841 - RNA, 22 nt, Homo sapiens
uugcacucuagccugggugaca

SEQ ID NO: 166842 - RNA, 22 nt, Homo sapiens
uugcaguagucugaaagcaaua

SEQ ID NO: 166843 - RNA, 22 nt, Homo sapiens
uugcauuagugugguacauuug

SEQ ID NO: 166844 - RNA, 22 nt, Homo sapiens
uugccuaggcuggagugcagug

SEQ ID NO: 166845 - RNA, 22 nt, Homo sapiens
uugcuacuuggauguacaugug

SEQ ID NO: 166846 - RNA, 22 nt, Homo sapiens
uugcugguuuucauaugagcag

SEQ ID NO: 166847 - RNA, 22 nt, Homo sapiens
uugcuuaggcuggagugcagug

SEQ ID NO: 166848 - RNA, 22 nt, Homo sapiens
uugcuucauucaacauugaggg

SEQ ID NO: 166849 - RNA, 22 nt, Homo sapiens
uugcuuuguuacugcaguuucc

SEQ ID NO: 166850 - RNA, 22 nt, Homo sapiens
uuggaagacauucugucugcua

SEQ ID NO: 166851 - RNA, 22 nt, Homo sapiens
uuggaagcaugguuauugacgu

SEQ ID NO: 166852 - RNA, 22 nt, Homo sapiens
uuggaauguauggcaucuugcg

SEQ ID NO: 166853 - RNA, 22 nt, Homo sapiens
uuggacugagaguuccaccauu

SEQ ID NO: 166854 - RNA, 22 nt, Homo sapiens
uuggacugggauggccgaggcu

SEQ ID NO: 166855 - RNA, 22 nt, Homo sapiens
uuggacuuuaagauagagaugu

SEQ ID NO: 166856 - RNA, 22 nt, Homo sapiens
uuggagagucacuaguuagugc

SEQ ID NO: 166857 - RNA, 22 nt, Homo sapiens
uuggcaaagaggaaugccacuu

SEQ ID NO: 166858 - RNA, 22 nt, Homo sapiens
uuggcaaauagguuuuauugca

SEQ ID NO: 166859 - RNA, 22 nt, Homo sapiens
uuggcaacauagugagaccccc

SEQ ID NO: 166860 - RNA, 22 nt, Homo sapiens
uuggcaagaauguaugccgauc

SEQ ID NO: 166861 - RNA, 21 nt, Homo sapiens
uuggcacucuucucuccuuau

SEQ ID NO: 166862 - RNA, 22 nt, Homo sapiens
uuggcagaauguuagaaacuua

SEQ ID NO: 166863 - RNA, 22 nt, Homo sapiens
uuggcaguaucuacuacagcua

SEQ ID NO: 166864 - RNA, 22 nt, Homo sapiens
uuggcauugccaaacugucaac

SEQ ID NO: 166865 - RNA, 22 nt, Homo sapiens
uuggcauuuuuagucaugggaa

SEQ ID NO: 166866 - RNA, 22 nt, Homo sapiens
uuggccauaugacuugcuuugg

SEQ ID NO: 166867 - RNA, 22 nt, Homo sapiens
uuggccuuucucuaaauacuuu

SEQ ID NO: 166868 - RNA, 22 nt, Homo sapiens
uuggcuguguuuauaugcugga

SEQ ID NO: 166869 - RNA, 22 nt, Homo sapiens
uugggaaugcuaaaccucuauu

SEQ ID NO: 166870 - RNA, 22 nt, Homo sapiens
uuggucagcucaauggagaggg

SEQ ID NO: 166871 - RNA, 22 nt, Homo sapiens
uuggucaggcuaaucucgaacg

SEQ ID NO: 166872 - RNA, 22 nt, Homo sapiens
uugguccccacuccccugccaa

SEQ ID NO: 166873 - RNA, 22 nt, Homo sapiens
uuggucucuuaaucacacuuuu

SEQ ID NO: 166874 - RNA, 22 nt, Homo sapiens
uuguacuucagacaugccaaag

SEQ ID NO: 166875 - RNA, 22 nt, Homo sapiens
uuguauaggcucaguaagaauc

SEQ ID NO: 166876 - RNA, 22 nt, Homo sapiens
uugucacauggggcggcugccc

SEQ ID NO: 166877 - RNA, 22 nt, Homo sapiens
uugucacucuuccuaggguagg

SEQ ID NO: 166878 - RNA, 22 nt, Homo sapiens
uugucccauggggucuuccuuu

SEQ ID NO: 166879 - RNA, 22 nt, Homo sapiens
uuguccuggagguucuugcaag

SEQ ID NO: 166880 - RNA, 19 nt, Homo sapiens
agcaucauuauuguuuugg

SEQ ID NO: 166881 - RNA, 22 nt, Homo sapiens
agcauuaguugugaagccuuua

SEQ ID NO: 166882 - RNA, 16 nt, Homo sapiens
agccaccauuuacuug

SEQ ID NO: 166883 - RNA, 22 nt, Homo sapiens
agcccagagacuguguaaauuu

SEQ ID NO: 166884 - RNA, 22 nt, Homo sapiens
agccccauuuguugaaaagacg

SEQ ID NO: 166885 - RNA, 22 nt, Homo sapiens
agcggcuguuccccuggucuau

SEQ ID NO: 166886 - RNA, 22 nt, Homo sapiens
agcuacaucuugcucugggaug

SEQ ID NO: 166887 - RNA, 22 nt, Homo sapiens
agcuaguggucauucaauccuu

SEQ ID NO: 166888 - RNA, 22 nt, Homo sapiens
agcucacagccuagcacuguga

SEQ ID NO: 166889 - RNA, 22 nt, Homo sapiens
agcuccaugauaguaugucugu

SEQ ID NO: 166890 - RNA, 22 nt, Homo sapiens
agcuccuuucugcaggcagguc

SEQ ID NO: 166891 - RNA, 22 nt, Homo sapiens
agcugaguguuccaagagcgag

SEQ ID NO: 166892 - RNA, 22 nt, Homo sapiens
agcugcaaagggagagaugauu

SEQ ID NO: 166893 - RNA, 22 nt, Homo sapiens
agcugcacugguauaggagaaa

SEQ ID NO: 166894 - RNA, 21 nt, Homo sapiens
agcugguuuccacagugugcu

SEQ ID NO: 166895 - RNA, 22 nt, Homo sapiens
agcuguguugucugaagucaga

SEQ ID NO: 166896 - RNA, 22 nt, Homo sapiens
agcuguuguucucagaggcuuu

SEQ ID NO: 166897 - RNA, 20 nt, Homo sapiens
agcuugguuuggaugaucac

SEQ ID NO: 166898 - RNA, 22 nt, Homo sapiens
agcuugugcuguaugaagggcc

SEQ ID NO: 166899 - RNA, 22 nt, Homo sapiens
agcuuguuuuccugcaacuaga

SEQ ID NO: 166900 - RNA, 22 nt, Homo sapiens
aggaacuguaacuaugucucug

SEQ ID NO: 166901 - RNA, 22 nt, Homo sapiens
aggaagacauauagaacuaaaa

SEQ ID NO: 166902 - RNA, 22 nt, Homo sapiens
aggaagacugaaauugcuguuc

SEQ ID NO: 166903 - RNA, 22 nt, Homo sapiens
aggaagguaaacuaacuugccu

SEQ ID NO: 166904 - RNA, 22 nt, Homo sapiens
aggacacugagcaugggagguu

SEQ ID NO: 166905 - RNA, 22 nt, Homo sapiens
aggaccccucaucagcaccagu

SEQ ID NO: 166906 - RNA, 22 nt, Homo sapiens
aggagaucagccucccugcaac

SEQ ID NO: 166907 - RNA, 22 nt, Homo sapiens
aggagcacaauggucaugugga

SEQ ID NO: 166908 - RNA, 23 nt, Homo sapiens
aggagcuuagaaguugccauugc

SEQ ID NO: 166909 - RNA, 22 nt, Homo sapiens
aggagguugguaccaucuguuu

SEQ ID NO: 166910 - RNA, 16 nt, Homo sapiens
aggcaagaauugaggu

SEQ ID NO: 166911 - RNA, 22 nt, Homo sapiens
aggcaagagugacuacgugaaa

SEQ ID NO: 166912 - RNA, 22 nt, Homo sapiens
gggcgagaaucggcugcucagc

SEQ ID NO: 166913 - RNA, 22 nt, Homo sapiens
ggggaauguuaaagaauuugca

SEQ ID NO: 166914 - RNA, 22 nt, Homo sapiens
gggguaggcuacacugaguucc

SEQ ID NO: 166915 - RNA, 22 nt, Homo sapiens
gggucaguuuugagaaagcgug

SEQ ID NO: 166916 - RNA, 22 nt, Homo sapiens
ggguucaaaucuuggcucuuac

SEQ ID NO: 166917 - RNA, 22 nt, Homo sapiens
gguaaacauaagagagcugacu

SEQ ID NO: 166918 - RNA, 22 nt, Homo sapiens
gguaggcacuggugggaagaga

SEQ ID NO: 166919 - RNA, 22 nt, Homo sapiens
gguauguagcaaaagaggugcu

SEQ ID NO: 166920 - RNA, 22 nt, Homo sapiens
gguauuauuugccuuuuacuga

SEQ ID NO: 166921 - RNA, 22 nt, Homo sapiens
ggucacauugcuagcauggguu

SEQ ID NO: 166922 - RNA, 22 nt, Homo sapiens
ggucacauuggacuaucaaguu

SEQ ID NO: 166923 - RNA, 22 nt, Homo sapiens
ggucagaaagacaggcauucag

SEQ ID NO: 166924 - RNA, 19 nt, Homo sapiens
ggucagcaaagucuagcug

SEQ ID NO: 166925 - RNA, 22 nt, Homo sapiens
ggugacagugguuaaaauuugu

SEQ ID NO: 166926 - RNA, 22 nt, Homo sapiens
ggugagaaaaacauagucucag

SEQ ID NO: 166927 - RNA, 19 nt, Homo sapiens
ggugagaaauuaugggucu

SEQ ID NO: 166928 - RNA, 22 nt, Homo sapiens
ggugaggaaaguugaguuucua

SEQ ID NO: 166929 - RNA, 23 nt, Homo sapiens
ggugaggaguacagagucuucau

SEQ ID NO: 166930 - RNA, 22 nt, Homo sapiens
ggugagguaggaaaaguuagga

SEQ ID NO: 166931 - RNA, 22 nt, Homo sapiens
ggugccuacugugugucaggca

SEQ ID NO: 166932 - RNA, 22 nt, Homo sapiens
gguggugguauuucagaaaaug

SEQ ID NO: 166933 - RNA, 22 nt, Homo sapiens
guaaacuuccccucaugaauga

SEQ ID NO: 166934 - RNA, 22 nt, Homo sapiens
guaacagucucaacaguggucu

SEQ ID NO: 166935 - RNA, 22 nt, Homo sapiens
guaagagcauguaguggcucua

SEQ ID NO: 166936 - RNA, 22 nt, Homo sapiens
guaagucucaugagaucugaug

SEQ ID NO: 166937 - RNA, 22 nt, Homo sapiens
guaagugguagagcugggcuau

SEQ ID NO: 166938 - RNA, 23 nt, Homo sapiens
guaauacuagucauaguagcagg

SEQ ID NO: 166939 - RNA, 22 nt, Homo sapiens
guaaucucagcuacuugggagg

SEQ ID NO: 166940 - RNA, 22 nt, Homo sapiens
guaaugcacucccaaagaucca

SEQ ID NO: 166941 - RNA, 22 nt, Homo sapiens
guacaaguaagaaaauugccca

SEQ ID NO: 166942 - RNA, 22 nt, Homo sapiens
guacauagucacacauauacau

SEQ ID NO: 166943 - RNA, 22 nt, Homo sapiens
guacaugcauacaugcacaucu

SEQ ID NO: 166944 - RNA, 22 nt, Homo sapiens
guaccucaguuggaaaugcaga

SEQ ID NO: 166945 - RNA, 22 nt, Homo sapiens
guagcagcaauuuacuccauac

SEQ ID NO: 166946 - RNA, 22 nt, Homo sapiens
guauaggcuuucaccacgccau

SEQ ID NO: 166947 - RNA, 22 nt, Homo sapiens
guaugacacaggaagcuuaacc

SEQ ID NO: 166948 - RNA, 21 nt, Homo sapiens
guauggcauugauuaguuacu

SEQ ID NO: 166949 - RNA, 22 nt, Homo sapiens
guauuagguuggggcaaaagua

SEQ ID NO: 166950 - RNA, 22 nt, Homo sapiens
guauuuguugcagcagcacuau

SEQ ID NO: 166951 - RNA, 22 nt, Homo sapiens
gucacagcacuuuuaguaagug

SEQ ID NO: 166952 - RNA, 22 nt, Homo sapiens
gucacggaauguaaguggaagu

SEQ ID NO: 166953 - RNA, 22 nt, Homo sapiens
gucacugccugaggcugaugca

SEQ ID NO: 166954 - RNA, 22 nt, Homo sapiens
gucaguggauacugucucuguc

SEQ ID NO: 166955 - RNA, 22 nt, Homo sapiens
gucagugucuuaacagagauua

SEQ ID NO: 166956 - RNA, 22 nt, Homo sapiens
gucaugggguacuacacauggg

SEQ ID NO: 166957 - RNA, 22 nt, Homo sapiens
gucauugagucagggaguaucu

SEQ ID NO: 166958 - RNA, 22 nt, Homo sapiens
guccaguacucuuuccugaaaa

SEQ ID NO: 166959 - RNA, 22 nt, Homo sapiens
gucucagugcgaaucucaaaga

SEQ ID NO: 166960 - RNA, 22 nt, Homo sapiens
gucugagcauggggccggcagg

SEQ ID NO: 166961 - RNA, 22 nt, Homo sapiens
gucuggagacuugggucaucaa

SEQ ID NO: 166962 - RNA, 22 nt, Homo sapiens
gucuguuugauccagaucaaaa

SEQ ID NO: 166963 - RNA, 22 nt, Homo sapiens
gucuguuuggggaccuguggcc

SEQ ID NO: 166964 - RNA, 22 nt, Homo sapiens
gucuuccagccuccaucuuucu

SEQ ID NO: 166965 - RNA, 22 nt, Homo sapiens
gucuuugaugucuaugugcuuc

SEQ ID NO: 166966 - RNA, 22 nt, Homo sapiens
gugaaaagaugagcaccauaca

SEQ ID NO: 166967 - RNA, 22 nt, Homo sapiens
gugaaagacagcauuaauggcu

SEQ ID NO: 166968 - RNA, 22 nt, Homo sapiens
gugaaauacauaaucccaagug

SEQ ID NO: 166969 - RNA, 22 nt, Homo sapiens
gugaaauguguagaggaucugg

SEQ ID NO: 166970 - RNA, 22 nt, Homo sapiens
gugaacaagcaaaggcaggagg

SEQ ID NO: 166971 - RNA, 22 nt, Homo sapiens
gugaagugugaccucagcaucu

SEQ ID NO: 166972 - RNA, 22 nt, Homo sapiens
gugaaguuuuuugcugagaguc

SEQ ID NO: 166973 - RNA, 22 nt, Homo sapiens
gugacacuggagcuggcacaau

SEQ ID NO: 166974 - RNA, 22 nt, Homo sapiens
gugacauuauuucagcuacaug

SEQ ID NO: 166975 - RNA, 22 nt, Homo sapiens
gugacauuuuuacugaugagag

SEQ ID NO: 166976 - RNA, 22 nt, Homo sapiens
gugacuggacucugaagaaaau

SEQ ID NO: 166977 - RNA, 21 nt, Homo sapiens
gugcaaacaucauagaaugua

SEQ ID NO: 166978 - RNA, 22 nt, Homo sapiens
gugcaaaucucugaguaucuuu

SEQ ID NO: 166979 - RNA, 22 nt, Homo sapiens
gugcaacaugccuggcuaauuu

SEQ ID NO: 166980 - RNA, 22 nt, Homo sapiens
gugcaaugagaaggggcucugg

SEQ ID NO: 166981 - RNA, 22 nt, Homo sapiens
gugcacauauggugcauaagug

SEQ ID NO: 166982 - RNA, 22 nt, Homo sapiens
gugcacaucgugcagguuuguu

SEQ ID NO: 166983 - RNA, 22 nt, Homo sapiens
gugcacauuguuuaugucuguu

SEQ ID NO: 166984 - RNA, 22 nt, Homo sapiens
gugcagugugauccuuccguau

SEQ ID NO: 166985 - RNA, 22 nt, Homo sapiens
gugcauacgucuuuauaguagc

SEQ ID NO: 166986 - RNA, 22 nt, Homo sapiens
gugccacugcaccuggccuaag

SEQ ID NO: 166987 - RNA, 22 nt, Homo sapiens
gugcuauguuauccagcaagau

SEQ ID NO: 166988 - RNA, 22 nt, Homo sapiens
guggaggacuggauaaagaaaa

SEQ ID NO: 166989 - RNA, 22 nt, Homo sapiens
guggaucacuugagguuagaag

SEQ ID NO: 166990 - RNA, 22 nt, Homo sapiens
guggcaagaauguacaaaaggu

SEQ ID NO: 166991 - RNA, 22 nt, Homo sapiens
guggcauuucccaaaguauucu

SEQ ID NO: 166992 - RNA, 22 nt, Homo sapiens
gugggauauaaucaguccugua

SEQ ID NO: 166993 - RNA, 20 nt, Homo sapiens
gugggcaaauccuuuccucu

SEQ ID NO: 166994 - RNA, 22 nt, Homo sapiens
gugggguagcaggcuccuaucu

SEQ ID NO: 166995 - RNA, 22 nt, Homo sapiens
gugggguaggugacuugaugag

SEQ ID NO: 166996 - RNA, 22 nt, Homo sapiens
gugguaaaauggcauagagcua

SEQ ID NO: 166997 - RNA, 22 nt, Homo sapiens
guggucagaaaucucaguggca

SEQ ID NO: 166998 - RNA, 22 nt, Homo sapiens
gugguucuagaauugaguaucc

SEQ ID NO: 166999 - RNA, 22 nt, Homo sapiens
gugguuuuaauauucagucuag

SEQ ID NO: 167000 - RNA, 22 nt, Homo sapiens
gugguuuuuaaaguaccugugg

SEQ ID NO: 167001 - RNA, 22 nt, Homo sapiens
gugguuuuuagauuucuacagu

SEQ ID NO: 167002 - RNA, 22 nt, Homo sapiens
guguaaaucugcugugaacauu

SEQ ID NO: 167003 - RNA, 22 nt, Homo sapiens
guguaugguaggaugacggagu

SEQ ID NO: 167004 - RNA, 22 nt, Homo sapiens
guguauguuguccauggaugcg

SEQ ID NO: 167005 - RNA, 22 nt, Homo sapiens
gugucaguggggagugaucuuc

SEQ ID NO: 167006 - RNA, 21 nt, Homo sapiens
gugugcuugagugaugggauu

SEQ ID NO: 167007 - RNA, 22 nt, Homo sapiens
guuagugcuuauuaaauaguau

SEQ ID NO: 167008 - RNA, 22 nt, Homo sapiens
guuaugcagcaauugauaaucu

SEQ ID NO: 167009 - RNA, 21 nt, Homo sapiens
guucaagugauccuccugucu

SEQ ID NO: 167010 - RNA, 22 nt, Homo sapiens
guucaguuugcugaugcguuga

SEQ ID NO: 167011 - RNA, 22 nt, Homo sapiens
guucaguuuugaaauguuaauu

SEQ ID NO: 167012 - RNA, 22 nt, Homo sapiens
guucaucagggauacuggccug

SEQ ID NO: 167013 - RNA, 22 nt, Homo sapiens
guucaucagggauauuggccug

SEQ ID NO: 167014 - RNA, 22 nt, Homo sapiens
guucccaguugaaaugauuagu

SEQ ID NO: 167015 - RNA, 22 nt, Homo sapiens
guugaacaauagauucauauca

SEQ ID NO: 167016 - RNA, 22 nt, Homo sapiens
guugaucuauguugcuggcagu

SEQ ID NO: 167017 - RNA, 22 nt, Homo sapiens
guugcucaggcuggagugcagu

SEQ ID NO: 167018 - RNA, 22 nt, Homo sapiens
guugcuuauuccuguaauccca

SEQ ID NO: 167019 - RNA, 22 nt, Homo sapiens
guuugcauagugcugggagggg

SEQ ID NO: 167020 - RNA, 22 nt, Homo sapiens
guuugguugcauggaaaauuua

SEQ ID NO: 167021 - RNA, 22 nt, Homo sapiens
uaaaccacguuuacauuugaga

SEQ ID NO: 167022 - RNA, 22 nt, Homo sapiens
uaaacugcuugaaaugguguca

SEQ ID NO: 167023 - RNA, 22 nt, Homo sapiens
uaaacugucuuuggagcuuugc

SEQ ID NO: 167024 - RNA, 22 nt, Homo sapiens
uaaagcacaaguaaagaauacu

SEQ ID NO: 167025 - RNA, 22 nt, Homo sapiens
uaaagcacuuuuuucugcaugg

SEQ ID NO: 167026 - RNA, 17 nt, Homo sapiens
uaaagccagucaaguca

SEQ ID NO: 167027 - RNA, 22 nt, Homo sapiens
uaaagugaggauggcaguaggu

SEQ ID NO: 167028 - RNA, 22 nt, Homo sapiens
uaacauagucauauacuugcuu

SEQ ID NO: 167029 - RNA, 22 nt, Homo sapiens
uaacauucacaugcugcaaaaa

SEQ ID NO: 167030 - RNA, 18 nt, Homo sapiens
uaacuggugugagauggu

SEQ ID NO: 167031 - RNA, 22 nt, Homo sapiens
uaacugucucaggccaugggcg

SEQ ID NO: 167032 - RNA, 22 nt, Homo sapiens
uaagacacauguguucccaggc

SEQ ID NO: 167033 - RNA, 22 nt, Homo sapiens
uaagacugccccagacagcaag

SEQ ID NO: 167034 - RNA, 16 nt, Homo sapiens
uaagccccacgugcau

SEQ ID NO: 167035 - RNA, 22 nt, Homo sapiens
uaaggaacucugauaucuggaa

SEQ ID NO: 167036 - RNA, 20 nt, Homo sapiens
uaaggcacugugcuuuuagg

SEQ ID NO: 167037 - RNA, 22 nt, Homo sapiens
uaagguuuuugauaugcugcug

SEQ ID NO: 167038 - RNA, 19 nt, Homo sapiens
uaaguagaugacugaugcu

SEQ ID NO: 167039 - RNA, 22 nt, Homo sapiens
uaaguaucaguuuagcuaugau

SEQ ID NO: 167040 - RNA, 22 nt, Homo sapiens
uaaguauuaggccccaggcugg

SEQ ID NO: 167041 - RNA, 22 nt, Homo sapiens
uaagucguggaugauucuucgg

SEQ ID NO: 167042 - RNA, 22 nt, Homo sapiens
uaagugaauuucacuacugagu

SEQ ID NO: 167043 - RNA, 22 nt, Homo sapiens
aagcuguugguggaucuaccau

SEQ ID NO: 167044 - RNA, 22 nt, Homo sapiens
aaggagcagagagcccuguuuc

SEQ ID NO: 167045 - RNA, 22 nt, Homo sapiens
aaggagcuaagagaucauacau

SEQ ID NO: 167046 - RNA, 22 nt, Homo sapiens
aaggaguagaauagaugcaccu

SEQ ID NO: 167047 - RNA, 22 nt, Homo sapiens
aaggaguagaggaauagcaaug

SEQ ID NO: 167048 - RNA, 22 nt, Homo sapiens
aaggcaagaaaauggauucucc

SEQ ID NO: 167049 - RNA, 22 nt, Homo sapiens
aaggcaagaaugcgugcuuuca

SEQ ID NO: 167050 - RNA, 22 nt, Homo sapiens
aaggcaagagaaaauuucgagu

SEQ ID NO: 167051 - RNA, 22 nt, Homo sapiens
aaggcaagauacugguugcuga

SEQ ID NO: 167052 - RNA, 22 nt, Homo sapiens
aaggcagugugcacauaacacu

SEQ ID NO: 167053 - RNA, 22 nt, Homo sapiens
aaggcaugcugaguccuaaaag

SEQ ID NO: 167054 - RNA, 22 nt, Homo sapiens
aaggcgguguggauccuacagc

SEQ ID NO: 167055 - RNA, 22 nt, Homo sapiens
aaggcuuuuugcugacguccuu

SEQ ID NO: 167056 - RNA, 22 nt, Homo sapiens
aagggaaugcgcugccuguguu

SEQ ID NO: 167057 - RNA, 22 nt, Homo sapiens
aagggaauguuguggcugguuu

SEQ ID NO: 167058 - RNA, 22 nt, Homo sapiens
aagguucuugcuugcaugacug

SEQ ID NO: 167059 - RNA, 22 nt, Homo sapiens
aagugaauguuugguagcagug

SEQ ID NO: 167060 - RNA, 23 nt, Homo sapiens
aagugagcuccaauugggugaga

SEQ ID NO: 167061 - RNA, 22 nt, Homo sapiens
aagugcaaaucuguggcugaaa

SEQ ID NO: 167062 - RNA, 22 nt, Homo sapiens
aagugcucuugaaacugccuua

SEQ ID NO: 167063 - RNA, 22 nt, Homo sapiens
aagugcucuugaaacugucuua

SEQ ID NO: 167064 - RNA, 20 nt, Homo sapiens
aagugcuuccuuuuagaggg

SEQ ID NO: 167065 - RNA, 22 nt, Homo sapiens
aagugguuuuuacaaagacaga

SEQ ID NO: 167066 - RNA, 22 nt, Homo sapiens
aauaaagcauggcuacuccaua

SEQ ID NO: 167067 - RNA, 22 nt, Homo sapiens
aauagcacuguagauggaggaa

SEQ ID NO: 167068 - RNA, 22 nt, Homo sapiens
aauagugcugugcagugagugg

SEQ ID NO: 167069 - RNA, 22 nt, Homo sapiens
aaucaacauuguuuuaagucaa

SEQ ID NO: 167070 - RNA, 22 nt, Homo sapiens
aaucacacuugauguugagcaa

SEQ ID NO: 167071 - RNA, 22 nt, Homo sapiens
aaucauggaguauuuguccuug

SEQ ID NO: 167072 - RNA, 16 nt, Homo sapiens
aauccauuggcccugc

SEQ ID NO: 167073 - RNA, 22 nt, Homo sapiens
aaucccauuucucuguguuuuu

SEQ ID NO: 167074 - RNA, 22 nt, Homo sapiens
aaucccugagcuagacacaaag

SEQ ID NO: 167075 - RNA, 22 nt, Homo sapiens
aaucucagcauuuugggcugag

SEQ ID NO: 167076 - RNA, 22 nt, Homo sapiens
aaucugauguuaucagcuuaag

SEQ ID NO: 167077 - RNA, 22 nt, Homo sapiens
aaugacagccagauucuucucu

SEQ ID NO: 167078 - RNA, 17 nt, Homo sapiens
aaugagacauuucugcu

SEQ ID NO: 167079 - RNA, 22 nt, Homo sapiens
uggacauguacauauguguaug

SEQ ID NO: 167080 - RNA, 22 nt, Homo sapiens
uggaccccugcucgggagcccu

SEQ ID NO: 167081 - RNA, 19 nt, Homo sapiens
uggaccccuuccuuacacc

SEQ ID NO: 167082 - RNA, 21 nt, Homo sapiens
uggaccccuuccuugcaccau

SEQ ID NO: 167083 - RNA, 22 nt, Homo sapiens
uggacugagauuucagcugcca

SEQ ID NO: 167084 - RNA, 22 nt, Homo sapiens
uggacuguaaauuggggacucu

SEQ ID NO: 167085 - RNA, 22 nt, Homo sapiens
uggaggucauuggaucaugggg

SEQ ID NO: 167086 - RNA, 22 nt, Homo sapiens
uggagugaaaacacacuaaucu

SEQ ID NO: 167087 - RNA, 20 nt, Homo sapiens
uggagugaagguucuggacc

SEQ ID NO: 167088 - RNA, 22 nt, Homo sapiens
uggauagaaauguacuguuuuc

SEQ ID NO: 167089 - RNA, 22 nt, Homo sapiens
uggauauguuuauuacccugaa

SEQ ID NO: 167090 - RNA, 22 nt, Homo sapiens
uggauggagaggcuugugaugc

SEQ ID NO: 167091 - RNA, 22 nt, Homo sapiens
uggauugaaagcuuuaauauug

SEQ ID NO: 167092 - RNA, 22 nt, Homo sapiens
uggcaaaaaucacaaguaccuu

SEQ ID NO: 167093 - RNA, 22 nt, Homo sapiens
uggcaaaauauuuugguuucug

SEQ ID NO: 167094 - RNA, 21 nt, Homo sapiens
uggcaaaaugggcaguggguu

SEQ ID NO: 167095 - RNA, 22 nt, Homo sapiens
uggcaaaucagaggcauggaca

SEQ ID NO: 167096 - RNA, 22 nt, Homo sapiens
uggcaaauuccaaaguuaauuc

SEQ ID NO: 167097 - RNA, 22 nt, Homo sapiens
uggcaagaacaacaauuacuuu

SEQ ID NO: 167098 - RNA, 22 nt, Homo sapiens
uggcaagaaccacaguuacuuu

SEQ ID NO: 167099 - RNA, 22 nt, Homo sapiens
uggcaagaacugcaauugcuuu

SEQ ID NO: 167100 - RNA, 22 nt, Homo sapiens
uggcaagaagagcaugagacca

SEQ ID NO: 167101 - RNA, 23 nt, Homo sapiens
uggcaagaauucuuaccgugugg

SEQ ID NO: 167102 - RNA, 22 nt, Homo sapiens
uggcaagagaacaacaucucuc

SEQ ID NO: 167103 - RNA, 22 nt, Homo sapiens
uggcaagaucacaauuacuuuu

SEQ ID NO: 167104 - RNA, 22 nt, Homo sapiens
uggcaagugggaccuaguuaaa

SEQ ID NO: 167105 - RNA, 22 nt, Homo sapiens
uggcacaaugacccuugugggc

SEQ ID NO: 167106 - RNA, 22 nt, Homo sapiens
uggcagcgcaguugaaaaagaa

SEQ ID NO: 167107 - RNA, 22 nt, Homo sapiens
uggcaguuuacaaaugccauga

SEQ ID NO: 167108 - RNA, 22 nt, Homo sapiens
uggcaguuucacauggcucaac

SEQ ID NO: 167109 - RNA, 22 nt, Homo sapiens
uggcaguuucauaugguucaac

SEQ ID NO: 167110 - RNA, 22 nt, Homo sapiens
uggcaugauccuagauucaaca

SEQ ID NO: 167111 - RNA, 22 nt, Homo sapiens
uggcauggaguggauggcccca

SEQ ID NO: 167112 - RNA, 22 nt, Homo sapiens
uggccagugucggaggccagga

SEQ ID NO: 167113 - RNA, 22 nt, Homo sapiens
uggcgggaaaguugggagaaga

SEQ ID NO: 167114 - RNA, 19 nt, Homo sapiens
uggcuagagcagauauccu

SEQ ID NO: 167115 - RNA, 22 nt, Homo sapiens
uggcuguuguuacuaacaguuc

SEQ ID NO: 167116 - RNA, 22 nt, Homo sapiens
uggcuguuuauuucacaugggu

SEQ ID NO: 167117 - RNA, 22 nt, Homo sapiens
uggcuuuuauuauguugaggua

SEQ ID NO: 167118 - RNA, 22 nt, Homo sapiens
ugggaauaugauacaggucuuu

SEQ ID NO: 167119 - RNA, 22 nt, Homo sapiens
ugggaucauucaaugacgaaau

SEQ ID NO: 167120 - RNA, 22 nt, Homo sapiens
ugggcuagaugcuuugggguca

SEQ ID NO: 167121 - RNA, 22 nt, Homo sapiens
uggguaaaucucuguucagggc

SEQ ID NO: 167122 - RNA, 22 nt, Homo sapiens
uggguaguguaaagcacuccag

SEQ ID NO: 167123 - RNA, 20 nt, Homo sapiens
uggucaccuucaggagguuc

SEQ ID NO: 167124 - RNA, 21 nt, Homo sapiens
uggucaguuuucucacuagga

SEQ ID NO: 167125 - RNA, 22 nt, Homo sapiens
uggucauggaaauagaaugcac

SEQ ID NO: 167126 - RNA, 22 nt, Homo sapiens
ugguccccaauacuucuauaga

SEQ ID NO: 167127 - RNA, 21 nt, Homo sapiens
acauguacacauguaugcaca

SEQ ID NO: 167128 - RNA, 22 nt, Homo sapiens
acauugcagauguguuuaaugu

SEQ ID NO: 167129 - RNA, 22 nt, Homo sapiens
accacuguuucaagaagcuugu

SEQ ID NO: 167130 - RNA, 22 nt, Homo sapiens
accagucucagguaugucuuua

SEQ ID NO: 167131 - RNA, 22 nt, Homo sapiens
accauugcacuccagcccaggc

SEQ ID NO: 167132 - RNA, 22 nt, Homo sapiens
accauugcacuccagccugggc

SEQ ID NO: 167133 - RNA, 22 nt, Homo sapiens
acccauacacacauauuuaugu

SEQ ID NO: 167134 - RNA, 22 nt, Homo sapiens
accccauuugcacugagcccuu

SEQ ID NO: 167135 - RNA, 21 nt, Homo sapiens
acccccacaccuccuuaguuc

SEQ ID NO: 167136 - RNA, 23 nt, Homo sapiens
accccuacaggcuuguguccugc

SEQ ID NO: 167137 - RNA, 22 nt, Homo sapiens
acccugaagccaugaguggaac

SEQ ID NO: 167138 - RNA, 22 nt, Homo sapiens
acccuggaguaguaggaaucug

SEQ ID NO: 167139 - RNA, 22 nt, Homo sapiens
acccugguagcuaugaagucuu

SEQ ID NO: 167140 - RNA, 22 nt, Homo sapiens
acccuguaggugcuggcagaga

SEQ ID NO: 167141 - RNA, 22 nt, Homo sapiens
acccuguaguuagaaacuuuca

SEQ ID NO: 167142 - RNA, 22 nt, Homo sapiens
acccugucaaaacggaccaauc

SEQ ID NO: 167143 - RNA, 22 nt, Homo sapiens
acccugucaaaauggaccaauc

SEQ ID NO: 167144 - RNA, 22 nt, Homo sapiens
acccugucacucccaucaauuu

SEQ ID NO: 167145 - RNA, 22 nt, Homo sapiens
acccugucagcuggccugggca

SEQ ID NO: 167146 - RNA, 22 nt, Homo sapiens
acccugugaauauuuaaacuuc

SEQ ID NO: 167147 - RNA, 22 nt, Homo sapiens
accugagauuacaggugcuggc

SEQ ID NO: 167148 - RNA, 23 nt, Homo sapiens
accugauguuucuguggggagcc

SEQ ID NO: 167149 - RNA, 19 nt, Homo sapiens
accuguagaaaguacaaca

SEQ ID NO: 167150 - RNA, 22 nt, Homo sapiens
acuacaugugaugucaguauau

SEQ ID NO: 167151 - RNA, 22 nt, Homo sapiens
acuacuucuaaguuuuggaaga

SEQ ID NO: 167152 - RNA, 22 nt, Homo sapiens
acucagagauuagcacauguuu

SEQ ID NO: 167153 - RNA, 22 nt, Homo sapiens
acucagagugggccccuagaua

SEQ ID NO: 167154 - RNA, 22 nt, Homo sapiens
acuccacuuucaccacagcgga

SEQ ID NO: 167155 - RNA, 22 nt, Homo sapiens
acucuguaagcaagcuggggaa

SEQ ID NO: 167156 - RNA, 22 nt, Homo sapiens
acucuguauaaacauugcugua

SEQ ID NO: 167157 - RNA, 22 nt, Homo sapiens
acugagacugagaauguuucuu

SEQ ID NO: 167158 - RNA, 21 nt, Homo sapiens
acugagagaucuggggcacau

SEQ ID NO: 167159 - RNA, 23 nt, Homo sapiens
acugagcaauguuuacauacuug

SEQ ID NO: 167160 - RNA, 19 nt, Homo sapiens
acugagcuaccugggggca

SEQ ID NO: 167161 - RNA, 22 nt, Homo sapiens
gugcaagagugauugcaguuuu

SEQ ID NO: 167162 - RNA, 21 nt, Homo sapiens
gugcacaguaguguuuaauag

SEQ ID NO: 167163 - RNA, 21 nt, Homo sapiens
gugcagaugccacagucacuc

SEQ ID NO: 167164 - RNA, 23 nt, Homo sapiens
gugcaguggcgagauuucggcuc

SEQ ID NO: 167165 - RNA, 22 nt, Homo sapiens
gugcauacucuggagacauugu

SEQ ID NO: 167166 - RNA, 22 nt, Homo sapiens
gugccuucuagcuaugguuggc

SEQ ID NO: 167167 - RNA, 23 nt, Homo sapiens
gugccuucugagccuagucucca

SEQ ID NO: 167168 - RNA, 22 nt, Homo sapiens
gugcgggaggcgcgccuaggug

SEQ ID NO: 167169 - RNA, 22 nt, Homo sapiens
gugcuaggugcuaggaagauag

SEQ ID NO: 167170 - RNA, 16 nt, Homo sapiens
gugcuguguuguuagg

SEQ ID NO: 167171 - RNA, 22 nt, Homo sapiens
gugcuuguguuaauauguagcu

SEQ ID NO: 167172 - RNA, 22 nt, Homo sapiens
guggaaaacauaugcuuguuga

SEQ ID NO: 167173 - RNA, 22 nt, Homo sapiens
guggaaagaacacaaaauuagg

SEQ ID NO: 167174 - RNA, 22 nt, Homo sapiens
guggaguacugagggucacuua

SEQ ID NO: 167175 - RNA, 22 nt, Homo sapiens
guggcaugaaagcaucugugau

SEQ ID NO: 167176 - RNA, 23 nt, Homo sapiens
guggccuuuggccaguccgaguc

SEQ ID NO: 167177 - RNA, 22 nt, Homo sapiens
guggcgagaucauagcucauug

SEQ ID NO: 167178 - RNA, 22 nt, Homo sapiens
guggcuauucaccuuuaugaaa

SEQ ID NO: 167179 - RNA, 22 nt, Homo sapiens
guggcuuuauuuagaagcaggg

SEQ ID NO: 167180 - RNA, 22 nt, Homo sapiens
gugggaugcaaguaaaauuguc

SEQ ID NO: 167181 - RNA, 22 nt, Homo sapiens
gugggauggaaaugggcuucag

SEQ ID NO: 167182 - RNA, 22 nt, Homo sapiens
gugggcucguucguguuagaca

SEQ ID NO: 167183 - RNA, 22 nt, Homo sapiens
gugguaggaaagugcaaaugua

SEQ ID NO: 167184 - RNA, 19 nt, Homo sapiens
gugguauuaccuuuugauu

SEQ ID NO: 167185 - RNA, 22 nt, Homo sapiens
gugguucuaaaccuuuuuuggu

SEQ ID NO: 167186 - RNA, 22 nt, Homo sapiens
gugguuguuggaguggcaauuu

SEQ ID NO: 167187 - RNA, 22 nt, Homo sapiens
guguaaaacaauuagaggauuu

SEQ ID NO: 167188 - RNA, 18 nt, Homo sapiens
guguauggauggaggcca

SEQ ID NO: 167189 - RNA, 22 nt, Homo sapiens
guguccucgaguacacaucagg

SEQ ID NO: 167190 - RNA, 22 nt, Homo sapiens
gugucucagcccagaccuauuu

SEQ ID NO: 167191 - RNA, 22 nt, Homo sapiens
gugugcaaauguguaccuacau

SEQ ID NO: 167192 - RNA, 22 nt, Homo sapiens
gugugcaauuuugugggaggca

SEQ ID NO: 167193 - RNA, 22 nt, Homo sapiens
gugugcauggagggggcaguga

SEQ ID NO: 167194 - RNA, 21 nt, Homo sapiens
gugugcuugaauucagcuguc

SEQ ID NO: 167195 - RNA, 22 nt, Homo sapiens
guguucauggaauuugcaauug

SEQ ID NO: 167196 - RNA, 22 nt, Homo sapiens
ggcaugauggcugaggcuucug

SEQ ID NO: 167197 - RNA, 22 nt, Homo sapiens
ggcauguaauuauucaaagugg

SEQ ID NO: 167198 - RNA, 22 nt, Homo sapiens
ggccagaugcgguggcucacac

SEQ ID NO: 167199 - RNA, 22 nt, Homo sapiens
ggcccugagacaggaaaaagcu

SEQ ID NO: 167200 - RNA, 22 nt, Homo sapiens
ggcccugauacaaguaaggucu

SEQ ID NO: 167201 - RNA, 22 nt, Homo sapiens
gggaagugugcagaguucucuu

SEQ ID NO: 167202 - RNA, 20 nt, Homo sapiens
gggaaugcaaauucucaucc

SEQ ID NO: 167203 - RNA, 22 nt, Homo sapiens
gggaggucauuguucaaugcug

SEQ ID NO: 167204 - RNA, 22 nt, Homo sapiens
gggagguuguauguaugcgggg

SEQ ID NO: 167205 - RNA, 20 nt, Homo sapiens
gggaugugagguacacucuu

SEQ ID NO: 167206 - RNA, 22 nt, Homo sapiens
gggcaaaacuguacugccaagg

SEQ ID NO: 167207 - RNA, 22 nt, Homo sapiens
gggcaaauuauguaucucucag

SEQ ID NO: 167208 - RNA, 22 nt, Homo sapiens
ggggcauugugacauaucucug

SEQ ID NO: 167209 - RNA, 17 nt, Homo sapiens
gggucaccuugcaggua

SEQ ID NO: 167210 - RNA, 19 nt, Homo sapiens
ggucccucucaagucauuc

SEQ ID NO: 167211 - RNA, 22 nt, Homo sapiens
ggucuagagagagggguggacu

SEQ ID NO: 167212 - RNA, 22 nt, Homo sapiens
ggugagguaguaagguacaaua

SEQ ID NO: 167213 - RNA, 22 nt, Homo sapiens
ggugcagcacaccaacauggca

SEQ ID NO: 167214 - RNA, 22 nt, Homo sapiens
gguggcaaaucugaguggcgcu

SEQ ID NO: 167215 - RNA, 22 nt, Homo sapiens
ggugucuuguuuaauacucauu

SEQ ID NO: 167216 - RNA, 22 nt, Homo sapiens
guaaaugcagaugcaugaccuu

SEQ ID NO: 167217 - RNA, 18 nt, Homo sapiens
guaaauguaucuauugcc

SEQ ID NO: 167218 - RNA, 22 nt, Homo sapiens
guaacccuguaggccuaaagua

SEQ ID NO: 167219 - RNA, 22 nt, Homo sapiens
guaacugguuuucuucccucuc

SEQ ID NO: 167220 - RNA, 22 nt, Homo sapiens
guaaucucagcuacuugggagu

SEQ ID NO: 167221 - RNA, 22 nt, Homo sapiens
guaaucucagcuccucaugagg

SEQ ID NO: 167222 - RNA, 22 nt, Homo sapiens
guaaucucagcuucuugggagg

SEQ ID NO: 167223 - RNA, 22 nt, Homo sapiens
guacaguauaguaauaggauuu

SEQ ID NO: 167224 - RNA, 22 nt, Homo sapiens
guacaugugcacagugugcagg

SEQ ID NO: 167225 - RNA, 22 nt, Homo sapiens
guacccuggaacaacccaauuu

SEQ ID NO: 167226 - RNA, 22 nt, Homo sapiens
guagaccauuuaucuggggagu

SEQ ID NO: 167227 - RNA, 18 nt, Homo sapiens
guaggucaguaccaagca

SEQ ID NO: 167228 - RNA, 22 nt, Homo sapiens
guaucauugccuaaugcucuca

SEQ ID NO: 167229 - RNA, 22 nt, Homo sapiens
aaacgugcagagaucaauagca

SEQ ID NO: 167230 - RNA, 22 nt, Homo sapiens
aaacucuguagcagagacagau

SEQ ID NO: 167231 - RNA, 22 nt, Homo sapiens
aaagcacugaauaaauuugcuu

SEQ ID NO: 167232 - RNA, 22 nt, Homo sapiens
aaagcacuggagucaucaucua

SEQ ID NO: 167233 - RNA, 22 nt, Homo sapiens
aaagcagcaggugguuuucaau

SEQ ID NO: 167234 - RNA, 22 nt, Homo sapiens
aaaggcacugugacuuuauagg

SEQ ID NO: 167235 - RNA, 22 nt, Homo sapiens
aaaggcaucauuaguaccaagu

SEQ ID NO: 167236 - RNA, 22 nt, Homo sapiens
aaagggcuuuguaaacuucaag

SEQ ID NO: 167237 - RNA, 19 nt, Homo sapiens
aaagguaguaaccucugau

SEQ ID NO: 167238 - RNA, 22 nt, Homo sapiens
aaagguaguacuucuagaaggg

SEQ ID NO: 167239 - RNA, 22 nt, Homo sapiens
aaaguacugggauuggccgggu

SEQ ID NO: 167240 - RNA, 22 nt, Homo sapiens
aaagucacuggagaaggaauau

SEQ ID NO: 167241 - RNA, 22 nt, Homo sapiens
aaagugacuuagugccccauuu

SEQ ID NO: 167242 - RNA, 22 nt, Homo sapiens
aaagugccugacucauaguuag

SEQ ID NO: 167243 - RNA, 22 nt, Homo sapiens
aaagugcugagacagacuggga

SEQ ID NO: 167244 - RNA, 22 nt, Homo sapiens
aaagugcugagauuguaggcau

SEQ ID NO: 167245 - RNA, 22 nt, Homo sapiens
aaagugcugggauuggcugggc

SEQ ID NO: 167246 - RNA, 22 nt, Homo sapiens
aaauaacugucagguucuggaa

SEQ ID NO: 167247 - RNA, 22 nt, Homo sapiens
aaaugacuuuuuaugcagagua

SEQ ID NO: 167248 - RNA, 22 nt, Homo sapiens
aaaugcaccacucuggugcagg

SEQ ID NO: 167249 - RNA, 22 nt, Homo sapiens
aaaugcagcacucaagugggaa

SEQ ID NO: 167250 - RNA, 22 nt, Homo sapiens
aaaugcagucuuuguucugggc

SEQ ID NO: 167251 - RNA, 23 nt, Homo sapiens
aaaugcucucaggugccaguaga

SEQ ID NO: 167252 - RNA, 20 nt, Homo sapiens
aaaugcuguaauguuuggga

SEQ ID NO: 167253 - RNA, 22 nt, Homo sapiens
aaaugcuuucuuggaccauuug

SEQ ID NO: 167254 - RNA, 22 nt, Homo sapiens
aaauugcaaugcgaggcagagg

SEQ ID NO: 167255 - RNA, 22 nt, Homo sapiens
aacagcauaguacccgugauaa

SEQ ID NO: 167256 - RNA, 22 nt, Homo sapiens
aacagugcauuccuguccauau

SEQ ID NO: 167257 - RNA, 22 nt, Homo sapiens
aacccugacacaagcagaauuu

SEQ ID NO: 167258 - RNA, 22 nt, Homo sapiens
aaccuacauucuuaacuguugc

SEQ ID NO: 167259 - RNA, 22 nt, Homo sapiens
aacuggcauagccagacuucuc

SEQ ID NO: 167260 - RNA, 22 nt, Homo sapiens
aacugggcaagcauuacauggu

SEQ ID NO: 167261 - RNA, 22 nt, Homo sapiens
aacugguauugaauuuaggaag

SEQ ID NO: 167262 - RNA, 22 nt, Homo sapiens
aacugguauuucccaugaauuu

SEQ ID NO: 167263 - RNA, 19 nt, Homo sapiens
aacuggugugagaugguau

SEQ ID NO: 167264 - RNA, 21 nt, Homo sapiens
aagaaagcuggacuugccgcu

SEQ ID NO: 167265 - RNA, 20 nt, Homo sapiens
aagacacuguccccacugga

SEQ ID NO: 167266 - RNA, 22 nt, Homo sapiens
aagagcauuauuuaguaauuuc

SEQ ID NO: 167267 - RNA, 20 nt, Homo sapiens
aagagcucaccagaauaucu

SEQ ID NO: 167268 - RNA, 18 nt, Homo sapiens
aagagcucagcacagguu

SEQ ID NO: 167269 - RNA, 22 nt, Homo sapiens
aagagcucauccauaguuguca

SEQ ID NO: 167270 - RNA, 22 nt, Homo sapiens
aagagcucucuguagcauguga

SEQ ID NO: 167271 - RNA, 21 nt, Homo sapiens
aagcacauugaguguguguga

SEQ ID NO: 167272 - RNA, 22 nt, Homo sapiens
aagcaccguugccuccccugca

SEQ ID NO: 167273 - RNA, 22 nt, Homo sapiens
aagcagauguguugaaaguacu

SEQ ID NO: 167274 - RNA, 22 nt, Homo sapiens
aagcuacauuuuauuuauguca

SEQ ID NO: 167275 - RNA, 22 nt, Homo sapiens
aagcugcauuuucuagaugcuu

SEQ ID NO: 167276 - RNA, 22 nt, Homo sapiens
ugugauggaguuucauggacug

SEQ ID NO: 167277 - RNA, 22 nt, Homo sapiens
ugugcaaucuuccauuuuuagg

SEQ ID NO: 167278 - RNA, 22 nt, Homo sapiens
ugugcacaacgugcagguuugu

SEQ ID NO: 167279 - RNA, 22 nt, Homo sapiens
ugugcacaauguacagguuagu

SEQ ID NO: 167280 - RNA, 22 nt, Homo sapiens
ugugcacauugugcagguugau

SEQ ID NO: 167281 - RNA, 22 nt, Homo sapiens
ugugcaccucuucacacaggga

SEQ ID NO: 167282 - RNA, 22 nt, Homo sapiens
ugugcaguuuuagcguauuuua

SEQ ID NO: 167283 - RNA, 22 nt, Homo sapiens
ugugccacuccaggaggcuguu

SEQ ID NO: 167284 - RNA, 22 nt, Homo sapiens
ugugcucaucucagucaacugu

SEQ ID NO: 167285 - RNA, 22 nt, Homo sapiens
ugugcuugaaauucaguuuuga

SEQ ID NO: 167286 - RNA, 22 nt, Homo sapiens
uguggcaaagucuugugaauau

SEQ ID NO: 167287 - RNA, 22 nt, Homo sapiens
uguggcagugcuuuaugaaacc

SEQ ID NO: 167288 - RNA, 22 nt, Homo sapiens
uguggcauuuucagaaaggaug

SEQ ID NO: 167289 - RNA, 22 nt, Homo sapiens
uguggccuuuguuucaguuggg

SEQ ID NO: 167290 - RNA, 22 nt, Homo sapiens
uguggcuuuacagcaugguuca

SEQ ID NO: 167291 - RNA, 22 nt, Homo sapiens
uguggcuuuguaaccauggguc

SEQ ID NO: 167292 - RNA, 22 nt, Homo sapiens
ugugggaggugcuaauguaaau

SEQ ID NO: 167293 - RNA, 22 nt, Homo sapiens
uguguaaauauauacacacgug

SEQ ID NO: 167294 - RNA, 22 nt, Homo sapiens
ugugucuugaauuuuguaugua

SEQ ID NO: 167295 - RNA, 21 nt, Homo sapiens
uguuaacaugcagauuacugg

SEQ ID NO: 167296 - RNA, 22 nt, Homo sapiens
uguucaauucccaccuaugagu

SEQ ID NO: 167297 - RNA, 22 nt, Homo sapiens
uguugcaccugccuugcuuuag

SEQ ID NO: 167298 - RNA, 19 nt, Homo sapiens
uguugcacuccagcuuggg

SEQ ID NO: 167299 - RNA, 22 nt, Homo sapiens
uguugcacugguaauguacuga

SEQ ID NO: 167300 - RNA, 22 nt, Homo sapiens
uguuuguuugagauggagucuc

SEQ ID NO: 167301 - RNA, 22 nt, Homo sapiens
uuaaaaguauaggccuggcaua

SEQ ID NO: 167302 - RNA, 22 nt, Homo sapiens
uuaaaggcauguacacuagagu

SEQ ID NO: 167303 - RNA, 22 nt, Homo sapiens
uuaagaucagugcaaacuggag

SEQ ID NO: 167304 - RNA, 22 nt, Homo sapiens
uuaagcaaagguaacaugagaa

SEQ ID NO: 167305 - RNA, 22 nt, Homo sapiens
uuaaggcagugcaucuggaguu

SEQ ID NO: 167306 - RNA, 21 nt, Homo sapiens
uuaaguaauuacccaacucuc

SEQ ID NO: 167307 - RNA, 22 nt, Homo sapiens
uuaaguguaaguggugugggac

SEQ ID NO: 167308 - RNA, 22 nt, Homo sapiens
uuaaguuguagcuacaaauaca

SEQ ID NO: 167309 - RNA, 22 nt, Homo sapiens
uuaauacucuucuaaguagucc

SEQ ID NO: 167310 - RNA, 22 nt, Homo sapiens
uuaaugcuuggggaguaguucu

SEQ ID NO: 167311 - RNA, 22 nt, Homo sapiens
uuaauguaauugauugauugac

SEQ ID NO: 167312 - RNA, 22 nt, Homo sapiens
uuaauguaucuaucacaucaca

SEQ ID NO: 167313 - RNA, 22 nt, Homo sapiens
uuaauuguccaaguucaucucu

SEQ ID NO: 167314 - RNA, 22 nt, Homo sapiens
uuacaagaugucuguccaacac

SEQ ID NO: 167315 - RNA, 22 nt, Homo sapiens
uuacaguagaugaggguauaau

SEQ ID NO: 167316 - RNA, 22 nt, Homo sapiens
uuacagucaccugggggacaua

SEQ ID NO: 167317 - RNA, 22 nt, Homo sapiens
uuacaguucugguggagaggua

SEQ ID NO: 167318 - RNA, 22 nt, Homo sapiens
uuaccaguggugcuguaaacuu

SEQ ID NO: 167319 - RNA, 22 nt, Homo sapiens
uuacccauuagagaauuuaaga

SEQ ID NO: 167320 - RNA, 22 nt, Homo sapiens
uuaccugagaaggugacauuug

SEQ ID NO: 167321 - RNA, 22 nt, Homo sapiens
uuacugcauaauuccugggaag

SEQ ID NO: 167322 - RNA, 22 nt, Homo sapiens
uuagaacagugcucaccacaaa

SEQ ID NO: 167323 - RNA, 22 nt, Homo sapiens
uuagaacaguguuugccucgcu

SEQ ID NO: 167324 - RNA, 22 nt, Homo sapiens
uuagaucaacauggaacucuau

SEQ ID NO: 167325 - RNA, 22 nt, Homo sapiens
uuaggcaggauaguuacauauu

SEQ ID NO: 167326 - RNA, 22 nt, Homo sapiens
uaauuggaucucaaaaaagugu

SEQ ID NO: 167327 - RNA, 22 nt, Homo sapiens
uacaacacugguucgacaugug

SEQ ID NO: 167328 - RNA, 22 nt, Homo sapiens
uacaaccucugccucccaaguu

SEQ ID NO: 167329 - RNA, 22 nt, Homo sapiens
uacaagcacaggcagcaggcug

SEQ ID NO: 167330 - RNA, 16 nt, Homo sapiens
uacaauguagaaaaca

SEQ ID NO: 167331 - RNA, 20 nt, Homo sapiens
uacacguguagcauucucua

SEQ ID NO: 167332 - RNA, 22 nt, Homo sapiens
uacagaguagaagauuugcaga

SEQ ID NO: 167333 - RNA, 22 nt, Homo sapiens
uacagcacugugcauagugguu

SEQ ID NO: 167334 - RNA, 22 nt, Homo sapiens
uacaggaaugucagguugcugu

SEQ ID NO: 167335 - RNA, 19 nt, Homo sapiens
uacaggacugagcugaggu

SEQ ID NO: 167336 - RNA, 22 nt, Homo sapiens
uacagugcuuuuugguggagaa

SEQ ID NO: 167337 - RNA, 22 nt, Homo sapiens
uacaguggugugaucucagcuc

SEQ ID NO: 167338 - RNA, 22 nt, Homo sapiens
uacauacuguaugguucuguuu

SEQ ID NO: 167339 - RNA, 22 nt, Homo sapiens
uacauaguaagcacuaugccaa

SEQ ID NO: 167340 - RNA, 22 nt, Homo sapiens
uacauagucuucuuuugguuau

SEQ ID NO: 167341 - RNA, 22 nt, Homo sapiens
uacaugcaugggcaugugugca

SEQ ID NO: 167342 - RNA, 22 nt, Homo sapiens
uaccacaggcuggguaaucuau

SEQ ID NO: 167343 - RNA, 22 nt, Homo sapiens
uaccacagucauuacacuugua

SEQ ID NO: 167344 - RNA, 22 nt, Homo sapiens
uaccaccauuguaguuuggaaa

SEQ ID NO: 167345 - RNA, 22 nt, Homo sapiens
uaccucagccaaugcccagaag

SEQ ID NO: 167346 - RNA, 22 nt, Homo sapiens
uacuagaggaaaacuugaagac

SEQ ID NO: 167347 - RNA, 22 nt, Homo sapiens
uacugcacuccagccuggguga

SEQ ID NO: 167348 - RNA, 22 nt, Homo sapiens
uacugcacuccagccuugccaa

SEQ ID NO: 167349 - RNA, 18 nt, Homo sapiens
uacugcacucuccagccu

SEQ ID NO: 167350 - RNA, 22 nt, Homo sapiens
uacugcuuaagggcaugggccc

SEQ ID NO: 167351 - RNA, 22 nt, Homo sapiens
uacuggccuugaacucuggugu

SEQ ID NO: 167352 - RNA, 22 nt, Homo sapiens
uacuguguaguuagaccucaga

SEQ ID NO: 167353 - RNA, 22 nt, Homo sapiens
uacuuuguagagugugagaauu

SEQ ID NO: 167354 - RNA, 22 nt, Homo sapiens
uagaagcuacucuucuuguggc

SEQ ID NO: 167355 - RNA, 22 nt, Homo sapiens
uagaagcugagaauguccucag

SEQ ID NO: 167356 - RNA, 22 nt, Homo sapiens
uagaauggaaggcauguuugcc

SEQ ID NO: 167357 - RNA, 22 nt, Homo sapiens
uagagcaaugacucuggaaacc

SEQ ID NO: 167358 - RNA, 22 nt, Homo sapiens
uagagcacagugauuagaccua

SEQ ID NO: 167359 - RNA, 22 nt, Homo sapiens
uagaguguuuuguuaggcagca

SEQ ID NO: 167360 - RNA, 22 nt, Homo sapiens
uagauaguaaagccauuagcuu

SEQ ID NO: 167361 - RNA, 22 nt, Homo sapiens
uagauaguuaugauuugaugau

SEQ ID NO: 167362 - RNA, 22 nt, Homo sapiens
uagaucaacuuugguaagagaa

SEQ ID NO: 167363 - RNA, 22 nt, Homo sapiens
uagauuaucccugauuugucca

SEQ ID NO: 167364 - RNA, 22 nt, Homo sapiens
uagauuaucuguaugugcucuu

SEQ ID NO: 167365 - RNA, 22 nt, Homo sapiens
uagauuauuggcugauuugauc

SEQ ID NO: 167366 - RNA, 22 nt, Homo sapiens
uagcaaaucaauggaauugaag

SEQ ID NO: 167367 - RNA, 22 nt, Homo sapiens
uagcaccaaacauauacucagu

SEQ ID NO: 167368 - RNA, 18 nt, Homo sapiens
uagcagacaucauugggg

SEQ ID NO: 167369 - RNA, 19 nt, Homo sapiens
uagcagcaugauuuauaau

SEQ ID NO: 167370 - RNA, 22 nt, Homo sapiens
uagcagugugaaaacggacuaa

SEQ ID NO: 167371 - RNA, 22 nt, Homo sapiens
uagcauggaggcggccauagug

SEQ ID NO: 167372 - RNA, 22 nt, Homo sapiens
uagccucacaaagugcuuaaga

SEQ ID NO: 167373 - RNA, 22 nt, Homo sapiens
uagcuucuccauagcuccaugu

SEQ ID NO: 167374 - RNA, 22 nt, Homo sapiens
uaggacacaggacauauguaga

SEQ ID NO: 167375 - RNA, 22 nt, Homo sapiens
uaggcaguguucucacuuguaa

SEQ ID NO: 167376 - RNA, 22 nt, Homo sapiens
uaggcaguuuuccuuucacagu

SEQ ID NO: 167377 - RNA, 22 nt, Homo sapiens
uagggaguuuuggggugcagaa

SEQ ID NO: 167378 - RNA, 22 nt, Homo sapiens
uaggugaaugcuggaagaaaug

SEQ ID NO: 167379 - RNA, 22 nt, Homo sapiens
uagguugucuguucacucugau

SEQ ID NO: 167380 - RNA, 22 nt, Homo sapiens
uaguagcaccucucaugagcuu

SEQ ID NO: 167381 - RNA, 22 nt, Homo sapiens
uaguaguuuuguguauaauaau

SEQ ID NO: 167382 - RNA, 22 nt, Homo sapiens
uaguaucacauggucuuaauua

SEQ ID NO: 167383 - RNA, 22 nt, Homo sapiens
uaguauguuuauagcauugagu

SEQ ID NO: 167384 - RNA, 22 nt, Homo sapiens
uagugaaugucacuggcuguug

SEQ ID NO: 167385 - RNA, 21 nt, Homo sapiens
uagugcugaggcaguauggga

SEQ ID NO: 167386 - RNA, 22 nt, Homo sapiens
uagugcugugauaaacauauau

SEQ ID NO: 167387 - RNA, 22 nt, Homo sapiens
uaguggucccccagucccagcu

SEQ ID NO: 167388 - RNA, 22 nt, Homo sapiens
uauagcagugugagaacagacu

SEQ ID NO: 167389 - RNA, 22 nt, Homo sapiens
uauaucacaugcacucauuuuc

SEQ ID NO: 167390 - RNA, 22 nt, Homo sapiens
uauaugucugagacugggggau

SEQ ID NO: 167391 - RNA, 22 nt, Homo sapiens
uaucacaaacuuagcaguuuaa

SEQ ID NO: 167392 - RNA, 22 nt, Homo sapiens
uaucagauugcugccaucugcu

SEQ ID NO: 167393 - RNA, 22 nt, Homo sapiens
uaucagcacaguggguucaugg

SEQ ID NO: 167394 - RNA, 21 nt, Homo sapiens
uaucauggugaaacccugucu

SEQ ID NO: 167395 - RNA, 18 nt, Homo sapiens
uaucauguagggaaguug

SEQ ID NO: 167396 - RNA, 21 nt, Homo sapiens
uauccacuugcaacagagaag

SEQ ID NO: 167397 - RNA, 21 nt, Homo sapiens
uaucccagucacaucuaccca

SEQ ID NO: 167398 - RNA, 22 nt, Homo sapiens
uaucccuguggacuucccaaca

SEQ ID NO: 167399 - RNA, 22 nt, Homo sapiens
uaucugcacauacacuuauagc

SEQ ID NO: 167400 - RNA, 22 nt, Homo sapiens
uaugaaacucuaagauucacau

SEQ ID NO: 167401 - RNA, 22 nt, Homo sapiens
uaugaaagcuacuucucacaau

SEQ ID NO: 167402 - RNA, 22 nt, Homo sapiens
uaugagcacauauguaucuaug

SEQ ID NO: 167403 - RNA, 19 nt, Homo sapiens
uaugagcuaugacaugcau

SEQ ID NO: 167404 - RNA, 22 nt, Homo sapiens
uaugaggaguauaacccgguga

SEQ ID NO: 167405 - RNA, 21 nt, Homo sapiens
uaugagucugcaagaaccaca

SEQ ID NO: 167406 - RNA, 22 nt, Homo sapiens
uaugaucauuauguuauugcag

SEQ ID NO: 167407 - RNA, 22 nt, Homo sapiens
uaugcuuguuuauuuaagaaac

SEQ ID NO: 167408 - RNA, 22 nt, Homo sapiens
uauggcaaugcauaggaaggaa

SEQ ID NO: 167409 - RNA, 22 nt, Homo sapiens
uauggcuuuguuaacauuuucu

SEQ ID NO: 167410 - RNA, 19 nt, Homo sapiens
uaugggauuuuuagggugu

SEQ ID NO: 167411 - RNA, 22 nt, Homo sapiens
uaugucacuugguuuggugcua

SEQ ID NO: 167412 - RNA, 22 nt, Homo sapiens
gugcaaguguaauacagcuagg

SEQ ID NO: 167413 - RNA, 18 nt, Homo sapiens
gugcaaugaauagcagag

SEQ ID NO: 167414 - RNA, 22 nt, Homo sapiens
gugcaaugaguguggcaaagcc

SEQ ID NO: 167415 - RNA, 22 nt, Homo sapiens
gugccacaguguuaagggauuc

SEQ ID NO: 167416 - RNA, 22 nt, Homo sapiens
guggaaaaguaguugcgguuuu

SEQ ID NO: 167417 - RNA, 22 nt, Homo sapiens
guggaaaauuauugcuguuuuu

SEQ ID NO: 167418 - RNA, 21 nt, Homo sapiens
guggaaauggaauuuacuaau

SEQ ID NO: 167419 - RNA, 22 nt, Homo sapiens
guggacagagacuaaauguugu

SEQ ID NO: 167420 - RNA, 22 nt, Homo sapiens
guggacaugaauuuuggaggca

SEQ ID NO: 167421 - RNA, 22 nt, Homo sapiens
guggagcuguguggccuugggc

SEQ ID NO: 167422 - RNA, 22 nt, Homo sapiens
guggaggagaaagaagcauuuc

SEQ ID NO: 167423 - RNA, 22 nt, Homo sapiens
guggaucacuugaggucaagag

SEQ ID NO: 167424 - RNA, 22 nt, Homo sapiens
guggcaaguguuccaagaggcg

SEQ ID NO: 167425 - RNA, 21 nt, Homo sapiens
guggccuuuggagcaugucag

SEQ ID NO: 167426 - RNA, 22 nt, Homo sapiens
guggcuaaagauuuggaaucug

SEQ ID NO: 167427 - RNA, 22 nt, Homo sapiens
guggcuuuaaguacgauugagg

SEQ ID NO: 167428 - RNA, 22 nt, Homo sapiens
gugggaugaucacaguucacug

SEQ ID NO: 167429 - RNA, 22 nt, Homo sapiens
gugggauggagagaagguauga

SEQ ID NO: 167430 - RNA, 22 nt, Homo sapiens
gugggcaaagcuaguguguaga

SEQ ID NO: 167431 - RNA, 22 nt, Homo sapiens
uaagugcuguguuguuaccuaa

SEQ ID NO: 167432 - RNA, 18 nt, Homo sapiens
uaagugcuuuaaacacau

SEQ ID NO: 167433 - RNA, 22 nt, Homo sapiens
uaaguguaaugucugaaguuug

SEQ ID NO: 167434 - RNA, 18 nt, Homo sapiens
uaauaacugugaccuuga

SEQ ID NO: 167435 - RNA, 21 nt, Homo sapiens
uaauaaugucucagacaccua

SEQ ID NO: 167436 - RNA, 22 nt, Homo sapiens
uaauagcucggauaaacaugau

SEQ ID NO: 167437 - RNA, 22 nt, Homo sapiens
uaaugcacauuuauuuuaccuu

SEQ ID NO: 167438 - RNA, 22 nt, Homo sapiens
uaaugcauguaaugggcugaua

SEQ ID NO: 167439 - RNA, 22 nt, Homo sapiens
uaaugugcuucucuaccauagg

SEQ ID NO: 167440 - RNA, 22 nt, Homo sapiens
uaauucacauaaagcacuuaga

SEQ ID NO: 167441 - RNA, 22 nt, Homo sapiens
uacaaagcuacucgagggcagg

SEQ ID NO: 167442 - RNA, 21 nt, Homo sapiens
uacaagcuguagcacaugcca

SEQ ID NO: 167443 - RNA, 22 nt, Homo sapiens
uacacgugcacaacgugcacgu

SEQ ID NO: 167444 - RNA, 22 nt, Homo sapiens
uacagcuaugugcaugcaugcu

SEQ ID NO: 167445 - RNA, 22 nt, Homo sapiens
uacaguaauguuaaucuuugug

SEQ ID NO: 167446 - RNA, 22 nt, Homo sapiens
uacaguggaaguuaaccccauu

SEQ ID NO: 167447 - RNA, 22 nt, Homo sapiens
uacagugggcacuggcgcccug

SEQ ID NO: 167448 - RNA, 22 nt, Homo sapiens
ugaaugcuucaugucugggcug

SEQ ID NO: 167449 - RNA, 22 nt, Homo sapiens
ugaauuguuucauucuuuacau

SEQ ID NO: 167450 - RNA, 23 nt, Homo sapiens
ugacaagagcgagacuuggucuc

SEQ ID NO: 167451 - RNA, 22 nt, Homo sapiens
ugacaagauauggucuuaucaa

SEQ ID NO: 167452 - RNA, 20 nt, Homo sapiens
ugacaaggugcaaagaauca

SEQ ID NO: 167453 - RNA, 22 nt, Homo sapiens
ugacacagcaagauggaaccau

SEQ ID NO: 167454 - RNA, 19 nt, Homo sapiens
ugacacuguuggugggagg

SEQ ID NO: 167455 - RNA, 22 nt, Homo sapiens
ugacagagcaggacuucaucuc

SEQ ID NO: 167456 - RNA, 18 nt, Homo sapiens
ugacagcacaugugggga

SEQ ID NO: 167457 - RNA, 22 nt, Homo sapiens
ugacaggagauuaugugauguu

SEQ ID NO: 167458 - RNA, 22 nt, Homo sapiens
ugacaguaucuacagcuucuua

SEQ ID NO: 167459 - RNA, 22 nt, Homo sapiens
ugacagugaauaagucucuuaa

SEQ ID NO: 167460 - RNA, 22 nt, Homo sapiens
ugacaguguccucauucccaac

SEQ ID NO: 167461 - RNA, 22 nt, Homo sapiens
ugacagugugagauccugucuc

SEQ ID NO: 167462 - RNA, 22 nt, Homo sapiens
ugacauggaaguagguauacau

SEQ ID NO: 167463 - RNA, 22 nt, Homo sapiens
ugacauggagguggaggaagau

SEQ ID NO: 167464 - RNA, 22 nt, Homo sapiens
ugacauguagagaacuucucau

SEQ ID NO: 167465 - RNA, 22 nt, Homo sapiens
ugacauguauuagcucagugcu

SEQ ID NO: 167466 - RNA, 22 nt, Homo sapiens
ugacauguugcauuauauuucc

SEQ ID NO: 167467 - RNA, 22 nt, Homo sapiens
ugacauuacagucacuugcugu

SEQ ID NO: 167468 - RNA, 22 nt, Homo sapiens
ugacauugggagugaagugaag

SEQ ID NO: 167469 - RNA, 22 nt, Homo sapiens
ugacuauaggauaacaugcauu

SEQ ID NO: 167470 - RNA, 20 nt, Homo sapiens
ugacuggauacccuuuggcu

SEQ ID NO: 167471 - RNA, 22 nt, Homo sapiens
ugacuucauuuuuggccaugag

SEQ ID NO: 167472 - RNA, 22 nt, Homo sapiens
ugacuugaaacgugaacagauc

SEQ ID NO: 167473 - RNA, 22 nt, Homo sapiens
ugacuugaacuucuaugucacc

SEQ ID NO: 167474 - RNA, 22 nt, Homo sapiens
ugacuuuagaauuuuauccaga

SEQ ID NO: 167475 - RNA, 22 nt, Homo sapiens
ugagaacagauggcuuuauuau

SEQ ID NO: 167476 - RNA, 22 nt, Homo sapiens
ugagaagugauauagaaguuaa

SEQ ID NO: 167477 - RNA, 22 nt, Homo sapiens
ugagaauauuuuccaugucuca

SEQ ID NO: 167478 - RNA, 21 nt, Homo sapiens
ugagacaauccuggucaauau

SEQ ID NO: 167479 - RNA, 22 nt, Homo sapiens
ugagacauacuuacaggggaug

SEQ ID NO: 167480 - RNA, 22 nt, Homo sapiens
ugagacggagucuggcacuguc

SEQ ID NO: 167481 - RNA, 22 nt, Homo sapiens
ugagacggagucuugcuaaguu

SEQ ID NO: 167482 - RNA, 22 nt, Homo sapiens
ugagacggaguuucacucuugu

SEQ ID NO: 167483 - RNA, 22 nt, Homo sapiens
ugagacggaguuucgcucuugu

SEQ ID NO: 167484 - RNA, 22 nt, Homo sapiens
ugagacggaguuuugcucuugu

SEQ ID NO: 167485 - RNA, 22 nt, Homo sapiens
ugagacugagucucccucuguc

SEQ ID NO: 167486 - RNA, 22 nt, Homo sapiens
ugagacugaguuuccaucuugu

SEQ ID NO: 167487 - RNA, 22 nt, Homo sapiens
ugagacugaguuucucucuugu

SEQ ID NO: 167488 - RNA, 22 nt, Homo sapiens
ugagacugaguuuugccuuugu

SEQ ID NO: 167489 - RNA, 22 nt, Homo sapiens
ugagagaugaacucugauaugu

SEQ ID NO: 167490 - RNA, 22 nt, Homo sapiens
ugagaggugaauggcaggcuca

SEQ ID NO: 167491 - RNA, 22 nt, Homo sapiens
ugagaggugauaaagcaagggu

SEQ ID NO: 167492 - RNA, 22 nt, Homo sapiens
ugagagucacugaccugguaua

SEQ ID NO: 167493 - RNA, 22 nt, Homo sapiens
ugagauaacuaaaaacauuuug

SEQ ID NO: 167494 - RNA, 22 nt, Homo sapiens
ugagauaaugcaugugaagauc

SEQ ID NO: 167495 - RNA, 22 nt, Homo sapiens
ugagauaauuuacuuguugagg

SEQ ID NO: 167496 - RNA, 22 nt, Homo sapiens
ugagauagaaaacauaggagaa

SEQ ID NO: 167497 - RNA, 22 nt, Homo sapiens
ugagauauugggaguaauguca

SEQ ID NO: 167498 - RNA, 20 nt, Homo sapiens
ugagaucaggauuaaggcua

SEQ ID NO: 167499 - RNA, 22 nt, Homo sapiens
ugagaucaugccacugcacuuc

SEQ ID NO: 167500 - RNA, 20 nt, Homo sapiens
ugagauccacgugaaguaug

SEQ ID NO: 167501 - RNA, 23 nt, Homo sapiens
ugagaucuacagaucucagaucu

SEQ ID NO: 167502 - RNA, 19 nt, Homo sapiens
ugagaucuuuacuggguuu

SEQ ID NO: 167503 - RNA, 22 nt, Homo sapiens
ugagaugaacuugauuguuuua

SEQ ID NO: 167504 - RNA, 22 nt, Homo sapiens
ugagaugaagcuagaagaaugg

SEQ ID NO: 167505 - RNA, 22 nt, Homo sapiens
ugagaugauagauauguuaauu

SEQ ID NO: 167506 - RNA, 22 nt, Homo sapiens
ugagaugaucaaaguauaggcu

SEQ ID NO: 167507 - RNA, 22 nt, Homo sapiens
ugagaugcauauucuggcuccu

SEQ ID NO: 167508 - RNA, 22 nt, Homo sapiens
ugagauggaguuucacuuuugu

SEQ ID NO: 167509 - RNA, 22 nt, Homo sapiens
ugagauggaguuucgcucuugu

SEQ ID NO: 167510 - RNA, 22 nt, Homo sapiens
ugagaugugaagaucacaugaa

SEQ ID NO: 167511 - RNA, 22 nt, Homo sapiens
ugagcagagaagugcccugcgc

SEQ ID NO: 167512 - RNA, 17 nt, Homo sapiens
ugagcuaugauccuguc

SEQ ID NO: 167513 - RNA, 20 nt, Homo sapiens
ugagcucaauuguugcaagu

SEQ ID NO: 167514 - RNA, 20 nt, Homo sapiens
ugagcucaugacauuuuucu

SEQ ID NO: 167515 - RNA, 22 nt, Homo sapiens
ugagcugagauuaagcugcugc

SEQ ID NO: 167516 - RNA, 22 nt, Homo sapiens
ugagcugguacuaauauuauca

SEQ ID NO: 167517 - RNA, 22 nt, Homo sapiens
ugaggaaugaccccgugugguc

SEQ ID NO: 167518 - RNA, 22 nt, Homo sapiens
ugaggaauguguguuaaagaua

SEQ ID NO: 167519 - RNA, 22 nt, Homo sapiens
ugaggagugagaaauugguuuc

SEQ ID NO: 167520 - RNA, 22 nt, Homo sapiens
ugaggcuagucagaucagauga

SEQ ID NO: 167521 - RNA, 22 nt, Homo sapiens
ugagguaauagauaauauuuuu

SEQ ID NO: 167522 - RNA, 19 nt, Homo sapiens
ugagguauuuguugggaga

SEQ ID NO: 167523 - RNA, 22 nt, Homo sapiens
ugaggucacuuguuuuaugcuu

SEQ ID NO: 167524 - RNA, 22 nt, Homo sapiens
ugaggucuuuauuuagugcuca

SEQ ID NO: 167525 - RNA, 22 nt, Homo sapiens
ugaggugcagcaauccucaugu

SEQ ID NO: 167526 - RNA, 22 nt, Homo sapiens
ugagguguauugggggaaauuc

SEQ ID NO: 167527 - RNA, 23 nt, Homo sapiens
ugagguguuaagcagacuugucu

SEQ ID NO: 167528 - RNA, 20 nt, Homo sapiens
uggcaagauggcagaauaga

SEQ ID NO: 167529 - RNA, 22 nt, Homo sapiens
uggcaccauccaggugucucua

SEQ ID NO: 167530 - RNA, 22 nt, Homo sapiens
aggagaugaagcuuuaucuaaa

SEQ ID NO: 167531 - RNA, 18 nt, Homo sapiens
aggagcauagugcuauga

SEQ ID NO: 167532 - RNA, 22 nt, Homo sapiens
aggagcuuuggggaaaacagau

SEQ ID NO: 167533 - RNA, 22 nt, Homo sapiens
aggcaacaugguaaaacccugu

SEQ ID NO: 167534 - RNA, 22 nt, Homo sapiens
aggcaagugauagcugcguaau

SEQ ID NO: 167535 - RNA, 22 nt, Homo sapiens
aggcaagugggagacagcauuu

SEQ ID NO: 167536 - RNA, 22 nt, Homo sapiens
aggcaaguugcucaaaugcaaa

SEQ ID NO: 167537 - RNA, 22 nt, Homo sapiens
aggcaaugugagaguuuauuca

SEQ ID NO: 167538 - RNA, 22 nt, Homo sapiens
aggcacgguggcucacaccugu

SEQ ID NO: 167539 - RNA, 22 nt, Homo sapiens
aggcagcuguuauauacugagu

SEQ ID NO: 167540 - RNA, 22 nt, Homo sapiens
aggcaggugaaagauaguuuua

SEQ ID NO: 167541 - RNA, 22 nt, Homo sapiens
aggcaugaaauacaugcauuga

SEQ ID NO: 167542 - RNA, 22 nt, Homo sapiens
aggcauguggcucuguucugac

SEQ ID NO: 167543 - RNA, 22 nt, Homo sapiens
aggccaguuuuuggagggaaac

SEQ ID NO: 167544 - RNA, 22 nt, Homo sapiens
aggcuagacuuugagaauuuuu

SEQ ID NO: 167545 - RNA, 21 nt, Homo sapiens
aggcuguuguuuugggaugga

SEQ ID NO: 167546 - RNA, 22 nt, Homo sapiens
aggcuuuauuacagggucucag

SEQ ID NO: 167547 - RNA, 22 nt, Homo sapiens
agggaauguaaguuuuaugaga

SEQ ID NO: 167548 - RNA, 22 nt, Homo sapiens
agggagcaaaguggucuuucuc

SEQ ID NO: 167549 - RNA, 22 nt, Homo sapiens
agggcaguguuaggacugucug

SEQ ID NO: 167550 - RNA, 22 nt, Homo sapiens
agggcuuuugagcugagauggu

SEQ ID NO: 167551 - RNA, 22 nt, Homo sapiens
agguaguguuauuugcagcuga

SEQ ID NO: 167552 - RNA, 22 nt, Homo sapiens
agguauguauguaugggagaaa

SEQ ID NO: 167553 - RNA, 21 nt, Homo sapiens
aggucaugaagauguucuaau

SEQ ID NO: 167554 - RNA, 22 nt, Homo sapiens
aggugcugacaggauagguuuc

SEQ ID NO: 167555 - RNA, 22 nt, Homo sapiens
aggugguuuuaggcagagacau

SEQ ID NO: 167556 - RNA, 22 nt, Homo sapiens
agguuuucagccccagccuagg

SEQ ID NO: 167557 - RNA, 22 nt, Homo sapiens
aguaaagcaucagcuagaugug

SEQ ID NO: 167558 - RNA, 22 nt, Homo sapiens
aguaccauuacucacuuauuuu

SEQ ID NO: 167559 - RNA, 22 nt, Homo sapiens
agucaaguuuuuucagagaaua

SEQ ID NO: 167560 - RNA, 22 nt, Homo sapiens
agucacagguucuugggauuag

SEQ ID NO: 167561 - RNA, 22 nt, Homo sapiens
agucacagugaccuugucugac

SEQ ID NO: 167562 - RNA, 22 nt, Homo sapiens
agucacaugccagcacacccag

SEQ ID NO: 167563 - RNA, 22 nt, Homo sapiens
agucacggugguuugcacuugu

SEQ ID NO: 167564 - RNA, 22 nt, Homo sapiens
agucagugucuguaaggagaac

SEQ ID NO: 167565 - RNA, 22 nt, Homo sapiens
agucauaggagagauaucacug

SEQ ID NO: 167566 - RNA, 22 nt, Homo sapiens
agucauuguugagaugguguca

SEQ ID NO: 167567 - RNA, 22 nt, Homo sapiens
agugaauuguucaacaggagga

SEQ ID NO: 167568 - RNA, 22 nt, Homo sapiens
agugacaugggaucaaaucuga

SEQ ID NO: 167569 - RNA, 22 nt, Homo sapiens
agugagcugcagucuggggucc

SEQ ID NO: 167570 - RNA, 22 nt, Homo sapiens
agugcaauaaggauguagaacu

SEQ ID NO: 167571 - RNA, 22 nt, Homo sapiens
agugcaauggugccaucauagc

SEQ ID NO: 167572 - RNA, 22 nt, Homo sapiens
agugcacugcccgcuuccuguc

SEQ ID NO: 167573 - RNA, 22 nt, Homo sapiens
agugcaguggcacaaucuuggc

SEQ ID NO: 167574 - RNA, 22 nt, Homo sapiens
agugcaguugucacgugccuuc

SEQ ID NO: 167575 - RNA, 22 nt, Homo sapiens
aguggauguuguggccugggag

SEQ ID NO: 167576 - RNA, 22 nt, Homo sapiens
agugggccccuagaggugaggu

SEQ ID NO: 167577 - RNA, 22 nt, Homo sapiens
auaaagcaagucucuggccuca

SEQ ID NO: 167578 - RNA, 22 nt, Homo sapiens
auaaaguguuuaguauaggcaa

SEQ ID NO: 167579 - RNA, 22 nt, Homo sapiens
auaaauaguaguugugguggcc

SEQ ID NO: 167580 - RNA, 22 nt, Homo sapiens
auaaaugcuuccagucauuaaa

SEQ ID NO: 167581 - RNA, 22 nt, Homo sapiens
auaacucuguuuuuuucaugca

SEQ ID NO: 167582 - RNA, 22 nt, Homo sapiens
auaaguaguaaagcagugacua

SEQ ID NO: 167583 - RNA, 19 nt, Homo sapiens
auaagugaaucacgggggc

SEQ ID NO: 167584 - RNA, 22 nt, Homo sapiens
auaaucaugucugaaaccuuug

SEQ ID NO: 167585 - RNA, 22 nt, Homo sapiens
auacagucuguuagauuuccuc

SEQ ID NO: 167586 - RNA, 22 nt, Homo sapiens
auacaugcauuugcacgagagu

SEQ ID NO: 167587 - RNA, 22 nt, Homo sapiens
auacaugugugagcgaagaugu

SEQ ID NO: 167588 - RNA, 22 nt, Homo sapiens
auacuggcuuuccaauugugau

SEQ ID NO: 167589 - RNA, 20 nt, Homo sapiens
auagaagacuagugcagcag

SEQ ID NO: 167590 - RNA, 22 nt, Homo sapiens
auagcaagaugauugauccauu

SEQ ID NO: 167591 - RNA, 22 nt, Homo sapiens
auagcacaguguguguacacca

SEQ ID NO: 167592 - RNA, 22 nt, Homo sapiens
auagcacugguuuuucuugguu

SEQ ID NO: 167593 - RNA, 22 nt, Homo sapiens
auagcagcagcuaguagugaua

SEQ ID NO: 167594 - RNA, 22 nt, Homo sapiens
auagcucuugcuuacccacugu

SEQ ID NO: 167595 - RNA, 19 nt, Homo sapiens
auagggcuagcauauacug

SEQ ID NO: 167596 - RNA, 22 nt, Homo sapiens
auagguagcauagcaggaauau

SEQ ID NO: 167597 - RNA, 22 nt, Homo sapiens
auagugcugcagucaauguacg

SEQ ID NO: 167598 - RNA, 22 nt, Homo sapiens
cugucuagagggcacaugaugc

SEQ ID NO: 167599 - RNA, 22 nt, Homo sapiens
cugucuaugagccaggaagcca

SEQ ID NO: 167600 - RNA, 17 nt, Homo sapiens
cugugaugaucuugucu

SEQ ID NO: 167601 - RNA, 22 nt, Homo sapiens
cugugcaaagcgcucucggggu

SEQ ID NO: 167602 - RNA, 22 nt, Homo sapiens
cuguucaaauuguuugugaagu

SEQ ID NO: 167603 - RNA, 22 nt, Homo sapiens
cuguuugguaaggaugccucag

SEQ ID NO: 167604 - RNA, 22 nt, Homo sapiens
cuuacagucuaucagccacaac

SEQ ID NO: 167605 - RNA, 22 nt, Homo sapiens
cuucaaguguggccaccugacc

SEQ ID NO: 167606 - RNA, 22 nt, Homo sapiens
cuucaguucuguaaggacagca

SEQ ID NO: 167607 - RNA, 22 nt, Homo sapiens
cuucuguuaguucugauaacuu

SEQ ID NO: 167608 - RNA, 22 nt, Homo sapiens
cuugagacauuguuuuccaagu

SEQ ID NO: 167609 - RNA, 22 nt, Homo sapiens
cuugcacuccacuguucuccug

SEQ ID NO: 167610 - RNA, 22 nt, Homo sapiens
cuuggcacugcucacccuccuu

SEQ ID NO: 167611 - RNA, 22 nt, Homo sapiens
cuuggcuucuuuauguggcuau

SEQ ID NO: 167612 - RNA, 22 nt, Homo sapiens
cuugggccccacccaaaucuua

SEQ ID NO: 167613 - RNA, 22 nt, Homo sapiens
cuuuacacauccuaaccagugu

SEQ ID NO: 167614 - RNA, 22 nt, Homo sapiens
cuuuggcaaugucauuuucaau

SEQ ID NO: 167615 - RNA, 22 nt, Homo sapiens
cuuuggugagggauaaauuuca

SEQ ID NO: 167616 - RNA, 23 nt, Homo sapiens
cuuuguacagcuugacuacuggg

SEQ ID NO: 167617 - RNA, 20 nt, Homo sapiens
cuuuguccuccugcugugcu

SEQ ID NO: 167618 - RNA, 22 nt, Homo sapiens
cuuuuacacuguuagugggaau

SEQ ID NO: 167619 - RNA, 22 nt, Homo sapiens
cuuuuggcuuagaauugucuug

SEQ ID NO: 167620 - RNA, 22 nt, Homo sapiens
cuuuugugauuccucaguuacu

SEQ ID NO: 167621 - RNA, 22 nt, Homo sapiens
cuuuugugauucuucaguuacu

SEQ ID NO: 167622 - RNA, 21 nt, Homo sapiens
cuuuuuacucguucauaugca

SEQ ID NO: 167623 - RNA, 22 nt, Homo sapiens
gaaacugcauuucuaacaagcu

SEQ ID NO: 167624 - RNA, 22 nt, Homo sapiens
gaaagugcugcaaggccaugca

SEQ ID NO: 167625 - RNA, 21 nt, Homo sapiens
gaaauacugccuuaggagcug

SEQ ID NO: 167626 - RNA, 22 nt, Homo sapiens
gaacacaucuuugguuagagga

SEQ ID NO: 167627 - RNA, 18 nt, Homo sapiens
gaagaaguaggcauggca

SEQ ID NO: 167628 - RNA, 22 nt, Homo sapiens
gaagagacagguucccacaaaa

SEQ ID NO: 167629 - RNA, 22 nt, Homo sapiens
gaagauguugcuuaccuuggag

SEQ ID NO: 167630 - RNA, 22 nt, Homo sapiens
gaagauucaaccaaaccagaac

SEQ ID NO: 167631 - RNA, 22 nt, Homo sapiens
gaagcagcauucugguuuuugg

SEQ ID NO: 167632 - RNA, 22 nt, Homo sapiens
gaagguaguuuauagauguggu

SEQ ID NO: 167633 - RNA, 22 nt, Homo sapiens
gaauaaacuagagaggacugag

SEQ ID NO: 167634 - RNA, 22 nt, Homo sapiens
gaaucccuugcauuaucccuuu

SEQ ID NO: 167635 - RNA, 22 nt, Homo sapiens
gaaugcuaagcaugugggaguu

SEQ ID NO: 167636 - RNA, 22 nt, Homo sapiens
gaaugcuaaguuuccucccuau

SEQ ID NO: 167637 - RNA, 22 nt, Homo sapiens
gaaugcuaccagcaucuagugg

SEQ ID NO: 167638 - RNA, 22 nt, Homo sapiens
gacacugucuucugcucuuaaa

SEQ ID NO: 167639 - RNA, 21 nt, Homo sapiens
gacauggcgauacuccgucuc

SEQ ID NO: 167640 - RNA, 22 nt, Homo sapiens
gacauguuuucaagauuuauaa

SEQ ID NO: 167641 - RNA, 22 nt, Homo sapiens
gacauuaucagguuuguuuucu

SEQ ID NO: 167642 - RNA, 22 nt, Homo sapiens
gaccugagagguacauguauuu

SEQ ID NO: 167643 - RNA, 22 nt, Homo sapiens
gacuagggaccaugagcaaucc

SEQ ID NO: 167644 - RNA, 22 nt, Homo sapiens
gacuauaucaggaauggggauu

SEQ ID NO: 167645 - RNA, 22 nt, Homo sapiens
gacugcagugcagcuguuaggc

SEQ ID NO: 167646 - RNA, 22 nt, Homo sapiens
gagaaguaaauuuauuugcaaa

SEQ ID NO: 167647 - RNA, 20 nt, Homo sapiens
gagaccugagauucacucaa

SEQ ID NO: 167648 - RNA, 22 nt, Homo sapiens
gagacggagucucgcucugucg

SEQ ID NO: 167649 - RNA, 22 nt, Homo sapiens
gagacggagucuugcucuguug

SEQ ID NO: 167650 - RNA, 22 nt, Homo sapiens
gagagcaugugcuggcaucagu

SEQ ID NO: 167651 - RNA, 22 nt, Homo sapiens
gagagugcuuuggguguaggcc

SEQ ID NO: 167652 - RNA, 22 nt, Homo sapiens
gagagugugucagaggcugcga

SEQ ID NO: 167653 - RNA, 22 nt, Homo sapiens
gagaugaucaugugguuuuguc

SEQ ID NO: 167654 - RNA, 22 nt, Homo sapiens
gagauggagucuuuuucuguca

SEQ ID NO: 167655 - RNA, 22 nt, Homo sapiens
gagaugguguuccacugccagu

SEQ ID NO: 167656 - RNA, 22 nt, Homo sapiens
gagauuaauacacaucaaaugc

SEQ ID NO: 167657 - RNA, 22 nt, Homo sapiens
gagauucuucaauauuuauucu

SEQ ID NO: 167658 - RNA, 22 nt, Homo sapiens
gagauugucaugauuacauugu

SEQ ID NO: 167659 - RNA, 22 nt, Homo sapiens
gagcaaaaguauguauugguua

SEQ ID NO: 167660 - RNA, 22 nt, Homo sapiens
gagcaaugagcugccugcugag

SEQ ID NO: 167661 - RNA, 22 nt, Homo sapiens
gagcaaugauugagccacugua

SEQ ID NO: 167662 - RNA, 22 nt, Homo sapiens
gagcuacauggauagucugcau

SEQ ID NO: 167663 - RNA, 22 nt, Homo sapiens
gagcucauuaaaaauguagaau

SEQ ID NO: 167664 - RNA, 22 nt, Homo sapiens
gagcucauuguugcuaaagaga

SEQ ID NO: 167665 - RNA, 22 nt, Homo sapiens
gagcugaaguuuccauuuguac

SEQ ID NO: 167666 - RNA, 22 nt, Homo sapiens
gagcuggacuucuuaccuuuuc

SEQ ID NO: 167667 - RNA, 22 nt, Homo sapiens
gagcugguccuuuaaggaugca

SEQ ID NO: 167668 - RNA, 22 nt, Homo sapiens
gaggaucucuugagcccagaag

SEQ ID NO: 167669 - RNA, 22 nt, Homo sapiens
gaggcaagaguaguuaaguuag

SEQ ID NO: 167670 - RNA, 22 nt, Homo sapiens
gaggcauuauucccaucuuaca

SEQ ID NO: 167671 - RNA, 22 nt, Homo sapiens
gagggcacugcuuuccuuucaa

SEQ ID NO: 167672 - RNA, 22 nt, Homo sapiens
gagguaggaggauugcuuaagg

SEQ ID NO: 167673 - RNA, 22 nt, Homo sapiens
gagguagggucccacuauguug

SEQ ID NO: 167674 - RNA, 17 nt, Homo sapiens
gagguaguuuacuuuca

SEQ ID NO: 167675 - RNA, 22 nt, Homo sapiens
gaggucuuacauuuuaauauuu

SEQ ID NO: 167676 - RNA, 22 nt, Homo sapiens
gaggugguagguucacagcagc

SEQ ID NO: 167677 - RNA, 22 nt, Homo sapiens
gaguagaacugguuaucuaaua

SEQ ID NO: 167678 - RNA, 22 nt, Homo sapiens
gagugcugagcccacuuccuug

SEQ ID NO: 167679 - RNA, 23 nt, Homo sapiens
gaguggagacucauugauuuccu

SEQ ID NO: 167680 - RNA, 22 nt, Homo sapiens
gaguucauaucuaugagugugc

SEQ ID NO: 167681 - RNA, 20 nt, Homo sapiens
uauugccuaaauaccagaau

SEQ ID NO: 167682 - RNA, 22 nt, Homo sapiens
uauugccuugccuacuuuucca

SEQ ID NO: 167683 - RNA, 22 nt, Homo sapiens
uauugcuuuacucucuuauccu

SEQ ID NO: 167684 - RNA, 22 nt, Homo sapiens
uauugcuuuugauucaaggcag

SEQ ID NO: 167685 - RNA, 22 nt, Homo sapiens
uauugucaccaucccuguuuua

SEQ ID NO: 167686 - RNA, 22 nt, Homo sapiens
uauuugauugacuuuagcagga

SEQ ID NO: 167687 - RNA, 22 nt, Homo sapiens
ucaaacacuccauaucgcgauu

SEQ ID NO: 167688 - RNA, 22 nt, Homo sapiens
ucaaacauccccaccagggacu

SEQ ID NO: 167689 - RNA, 22 nt, Homo sapiens
ucaaacugucagguugaccaga

SEQ ID NO: 167690 - RNA, 22 nt, Homo sapiens
ucaaaucaucuuuuccaaagcu

SEQ ID NO: 167691 - RNA, 22 nt, Homo sapiens
ucaaaugauucacccaccuuug

SEQ ID NO: 167692 - RNA, 22 nt, Homo sapiens
ucaacacaguuaaauggggaaa

SEQ ID NO: 167693 - RNA, 22 nt, Homo sapiens
ucaacauugcugucaggcaucu

SEQ ID NO: 167694 - RNA, 21 nt, Homo sapiens
ucaacccuugcgucaccaagc

SEQ ID NO: 167695 - RNA, 22 nt, Homo sapiens
ucaaggcacauuugacauuuuc

SEQ ID NO: 167696 - RNA, 22 nt, Homo sapiens
ucaaggcacuagcugagcugca

SEQ ID NO: 167697 - RNA, 22 nt, Homo sapiens
ucaaugaaugaugguugguaug

SEQ ID NO: 167698 - RNA, 22 nt, Homo sapiens
ucaaugggcuacacauugagug

SEQ ID NO: 167699 - RNA, 22 nt, Homo sapiens
ucaauguaucuccaagaauuga

SEQ ID NO: 167700 - RNA, 22 nt, Homo sapiens
ucacacugcaucuguuggaauu

SEQ ID NO: 167701 - RNA, 19 nt, Homo sapiens
ucacacuguggcuucuuua

SEQ ID NO: 167702 - RNA, 22 nt, Homo sapiens
ucacagaggagaagaccuuuaa

SEQ ID NO: 167703 - RNA, 21 nt, Homo sapiens
ucacagccuaggaccugaaga

SEQ ID NO: 167704 - RNA, 22 nt, Homo sapiens
ucacagcuaaaaugaaaguagu

SEQ ID NO: 167705 - RNA, 22 nt, Homo sapiens
ucacaguaaauccagaagaaau

SEQ ID NO: 167706 - RNA, 22 nt, Homo sapiens
ucacagucggugacuucuugcu

SEQ ID NO: 167707 - RNA, 22 nt, Homo sapiens
ucacagugcaggaucaguuaau

SEQ ID NO: 167708 - RNA, 23 nt, Homo sapiens
ucacaguggcugcuuaauuguga

SEQ ID NO: 167709 - RNA, 17 nt, Homo sapiens
ucacaguguuaggauga

SEQ ID NO: 167710 - RNA, 22 nt, Homo sapiens
ucacauggaggugauaguugaa

SEQ ID NO: 167711 - RNA, 22 nt, Homo sapiens
ucacauggcagagaagaagcuc

SEQ ID NO: 167712 - RNA, 18 nt, Homo sapiens
ucacauggccgagagaga

SEQ ID NO: 167713 - RNA, 22 nt, Homo sapiens
ucacaugugacauauauauuug

SEQ ID NO: 167714 - RNA, 22 nt, Homo sapiens
ucacauguguaaauugguguaa

SEQ ID NO: 167715 - RNA, 22 nt, Homo sapiens
ucaccaccuuccaggaccacug

SEQ ID NO: 167716 - RNA, 22 nt, Homo sapiens
ucaccaguggcacuccagccug

SEQ ID NO: 167717 - RNA, 22 nt, Homo sapiens
ucaccagugucagggaacugcu

SEQ ID NO: 167718 - RNA, 20 nt, Homo sapiens
ucacccugacaucugcccag

SEQ ID NO: 167719 - RNA, 22 nt, Homo sapiens
ucacccugacaugcggccgaac

SEQ ID NO: 167720 - RNA, 22 nt, Homo sapiens
ucaccuggggaucuuguuuaca

SEQ ID NO: 167721 - RNA, 22 nt, Homo sapiens
cucaguagaaaauacauggacu

SEQ ID NO: 167722 - RNA, 22 nt, Homo sapiens
cucagucuaugauacuuugcua

SEQ ID NO: 167723 - RNA, 22 nt, Homo sapiens
cucaugcugucuucugggguaa

SEQ ID NO: 167724 - RNA, 19 nt, Homo sapiens
cucauggagaaggagaaua

SEQ ID NO: 167725 - RNA, 22 nt, Homo sapiens
cucauggauggucuggcagcca

SEQ ID NO: 167726 - RNA, 22 nt, Homo sapiens
cuccacgugaaugccaaguauu

SEQ ID NO: 167727 - RNA, 22 nt, Homo sapiens
cuccaggugagguuaagggacu

SEQ ID NO: 167728 - RNA, 22 nt, Homo sapiens
cuccagugcaaagucaugauca

SEQ ID NO: 167729 - RNA, 22 nt, Homo sapiens
cuccauuuaucugaaauuuuau

SEQ ID NO: 167730 - RNA, 22 nt, Homo sapiens
cuccauuuggaacagauguccu

SEQ ID NO: 167731 - RNA, 22 nt, Homo sapiens
cucccagagccaguuauaggcu

SEQ ID NO: 167732 - RNA, 22 nt, Homo sapiens
cucccagugacccaggaacagg

SEQ ID NO: 167733 - RNA, 22 nt, Homo sapiens
cucccugagccagggcuuugac

SEQ ID NO: 167734 - RNA, 22 nt, Homo sapiens
cuccuaaccagggcuguuaguc

SEQ ID NO: 167735 - RNA, 22 nt, Homo sapiens
cucucugagccauggcugcccu

SEQ ID NO: 167736 - RNA, 22 nt, Homo sapiens
cucugcuuaaugucccacuuga

SEQ ID NO: 167737 - RNA, 22 nt, Homo sapiens
cucugguggaagcagggggcaa

SEQ ID NO: 167738 - RNA, 22 nt, Homo sapiens
cucugguuucgcaggaaauaga

SEQ ID NO: 167739 - RNA, 22 nt, Homo sapiens
cucugguuuuucuuccauuaag

SEQ ID NO: 167740 - RNA, 22 nt, Homo sapiens
cucuuugaugugaaccgugguu

SEQ ID NO: 167741 - RNA, 22 nt, Homo sapiens
cucuuuggaugccuuaggguua

SEQ ID NO: 167742 - RNA, 19 nt, Homo sapiens
cucuuuggugucucuucuu

SEQ ID NO: 167743 - RNA, 22 nt, Homo sapiens
cugaaauggaaugugugcacag

SEQ ID NO: 167744 - RNA, 22 nt, Homo sapiens
cugaaggcagguagaauagaga

SEQ ID NO: 167745 - RNA, 20 nt, Homo sapiens
cugaaugucaaggcagaggu

SEQ ID NO: 167746 - RNA, 22 nt, Homo sapiens
cugacaugcagccacugcaccu

SEQ ID NO: 167747 - RNA, 22 nt, Homo sapiens
cugacugugcaugcccagcccc

SEQ ID NO: 167748 - RNA, 22 nt, Homo sapiens
cugacuuuagaacccaaaaagu

SEQ ID NO: 167749 - RNA, 22 nt, Homo sapiens
cugagagugguauguuuaagug

SEQ ID NO: 167750 - RNA, 22 nt, Homo sapiens
cugagaucaugggucagguggu

SEQ ID NO: 167751 - RNA, 22 nt, Homo sapiens
cugagcacugagauccucuagc

SEQ ID NO: 167752 - RNA, 22 nt, Homo sapiens
cugagcccauucuggggagaag

SEQ ID NO: 167753 - RNA, 22 nt, Homo sapiens
cugagguacccacuucaucuca

SEQ ID NO: 167754 - RNA, 22 nt, Homo sapiens
cugaggugggaggauuacuuga

SEQ ID NO: 167755 - RNA, 20 nt, Homo sapiens
cugagguugggguccuuccc

SEQ ID NO: 167756 - RNA, 22 nt, Homo sapiens
cugagguuguucuucucagugg

SEQ ID NO: 167757 - RNA, 22 nt, Homo sapiens
cugauuguagagccccagggcu

SEQ ID NO: 167758 - RNA, 22 nt, Homo sapiens
cugauugucaucaauauuauua

SEQ ID NO: 167759 - RNA, 22 nt, Homo sapiens
cugauuuguccccagccucaug

SEQ ID NO: 167760 - RNA, 22 nt, Homo sapiens
cugcaagaugcauaggaauuuu

SEQ ID NO: 167761 - RNA, 22 nt, Homo sapiens
cugcaauguuugaaauggcaaa

SEQ ID NO: 167762 - RNA, 22 nt, Homo sapiens
cugcagguaggggcagcuuugg

SEQ ID NO: 167763 - RNA, 22 nt, Homo sapiens
cugcauaaucaucucucugcau

SEQ ID NO: 167764 - RNA, 22 nt, Homo sapiens
cugccacugacaccucaaggac

SEQ ID NO: 167765 - RNA, 22 nt, Homo sapiens
cugccaguuugauucgggccac

SEQ ID NO: 167766 - RNA, 22 nt, Homo sapiens
cugcuaagagaaugagacuuag

SEQ ID NO: 167767 - RNA, 22 nt, Homo sapiens
cuggaagcacaacgcauuuauu

SEQ ID NO: 167768 - RNA, 22 nt, Homo sapiens
cuggaggccugaacauaaaugg

SEQ ID NO: 167769 - RNA, 22 nt, Homo sapiens
cuggauagagauugaugaugcu

SEQ ID NO: 167770 - RNA, 22 nt, Homo sapiens
cuggauauuaacauugaugaaa

SEQ ID NO: 167771 - RNA, 22 nt, Homo sapiens
cuggauggugagauaaagaaaa

SEQ ID NO: 167772 - RNA, 22 nt, Homo sapiens
cuggcaaauaguagagccagga

SEQ ID NO: 167773 - RNA, 22 nt, Homo sapiens
cuggcaaauguuuucuguaaag

SEQ ID NO: 167774 - RNA, 22 nt, Homo sapiens
cuggcaccauuuugaucaaagg

SEQ ID NO: 167775 - RNA, 22 nt, Homo sapiens
cuggcgagacagcuccaucacu

SEQ ID NO: 167776 - RNA, 22 nt, Homo sapiens
cuggugugugacuuuucauuau

SEQ ID NO: 167777 - RNA, 21 nt, Homo sapiens
cugguguuagcacuucuuccc

SEQ ID NO: 167778 - RNA, 22 nt, Homo sapiens
cugguuguuacaugcuugccag

SEQ ID NO: 167779 - RNA, 22 nt, Homo sapiens
cagagagcuugcccuuguauau

SEQ ID NO: 167780 - RNA, 22 nt, Homo sapiens
cagagguaagcaagucagcauu

SEQ ID NO: 167781 - RNA, 22 nt, Homo sapiens
cagagguauugcaaaagccuag

SEQ ID NO: 167782 - RNA, 22 nt, Homo sapiens
cagauacuccuggucucaggag

SEQ ID NO: 167783 - RNA, 23 nt, Homo sapiens
cagcucauuuggguccccuuguc

SEQ ID NO: 167784 - RNA, 23 nt, Homo sapiens
cagcuggugauuuuaaguugaag

SEQ ID NO: 167785 - RNA, 22 nt, Homo sapiens
cagcuggugcugcaccaguggg

SEQ ID NO: 167786 - RNA, 22 nt, Homo sapiens
cagcuguguuauaaacuaccau

SEQ ID NO: 167787 - RNA, 22 nt, Homo sapiens
cagcuguuguuaugucugcagg

SEQ ID NO: 167788 - RNA, 22 nt, Homo sapiens
cagguaggccaauguuuuccaa

SEQ ID NO: 167789 - RNA, 22 nt, Homo sapiens
caggugaaugccucuccuucug

SEQ ID NO: 167790 - RNA, 22 nt, Homo sapiens
caggugcuuacuuaauagccau

SEQ ID NO: 167791 - RNA, 19 nt, Homo sapiens
caguaucauugcacauagu

SEQ ID NO: 167792 - RNA, 22 nt, Homo sapiens
cagucacagugacaggaugugg

SEQ ID NO: 167793 - RNA, 22 nt, Homo sapiens
cagucacugggauuauggucau

SEQ ID NO: 167794 - RNA, 22 nt, Homo sapiens
cagugcaaccuccaucucucgg

SEQ ID NO: 167795 - RNA, 22 nt, Homo sapiens
cagugcuuuaucaaguccucca

SEQ ID NO: 167796 - RNA, 22 nt, Homo sapiens
caguggaugaacaagaagugau

SEQ ID NO: 167797 - RNA, 22 nt, Homo sapiens
cagugguuuucucaguucagca

SEQ ID NO: 167798 - RNA, 22 nt, Homo sapiens
cauacaagcuacaaucacaaag

SEQ ID NO: 167799 - RNA, 23 nt, Homo sapiens
caucacagagccuuccuugacuc

SEQ ID NO: 167800 - RNA, 22 nt, Homo sapiens
caucacaucugcaugguaagua

SEQ ID NO: 167801 - RNA, 22 nt, Homo sapiens
caucacaugcuuauuuuccuca

SEQ ID NO: 167802 - RNA, 22 nt, Homo sapiens
caucacuguugguacaaguaau

SEQ ID NO: 167803 - RNA, 22 nt, Homo sapiens
caucccugaaccccagaaaucu

SEQ ID NO: 167804 - RNA, 23 nt, Homo sapiens
caugaacuaguuugcagccauga

SEQ ID NO: 167805 - RNA, 22 nt, Homo sapiens
caugcagcacacaugucugugc

SEQ ID NO: 167806 - RNA, 19 nt, Homo sapiens
caugccacugcacuugagu

SEQ ID NO: 167807 - RNA, 22 nt, Homo sapiens
cauggcacagagaauguguucu

SEQ ID NO: 167808 - RNA, 22 nt, Homo sapiens
caugugcaugcuuucuuaugug

SEQ ID NO: 167809 - RNA, 22 nt, Homo sapiens
cauugcacuccagccuaggcaa

SEQ ID NO: 167810 - RNA, 20 nt, Homo sapiens
cauugcacuccagcuugggc

SEQ ID NO: 167811 - RNA, 22 nt, Homo sapiens
cauugcacuccagcuugggcaa

SEQ ID NO: 167812 - RNA, 16 nt, Homo sapiens
cauugcacucuagccu

SEQ ID NO: 167813 - RNA, 22 nt, Homo sapiens
cauugcacucugcauuccaguc

SEQ ID NO: 167814 - RNA, 22 nt, Homo sapiens
cauugcaguuuuugguguaucu

SEQ ID NO: 167815 - RNA, 22 nt, Homo sapiens
cauugcaugcauauggcuuggu

SEQ ID NO: 167816 - RNA, 22 nt, Homo sapiens
cauugcccuccagccugggcaa

SEQ ID NO: 167817 - RNA, 22 nt, Homo sapiens
cauugcuuuuggugguuuagac

SEQ ID NO: 167818 - RNA, 19 nt, Homo sapiens
cauuggacuugcuuuugcc

SEQ ID NO: 167819 - RNA, 22 nt, Homo sapiens
cauugguuccaguuuguccuua

SEQ ID NO: 167820 - RNA, 22 nt, Homo sapiens
cauugguuggacaguucucucu

SEQ ID NO: 167821 - RNA, 22 nt, Homo sapiens
cauuuugcaguuucugucucca

SEQ ID NO: 167822 - RNA, 22 nt, Homo sapiens
ccaaaguauuuucacugauauc

SEQ ID NO: 167823 - RNA, 22 nt, Homo sapiens
ccaaaucucauguugaaaugug

SEQ ID NO: 167824 - RNA, 22 nt, Homo sapiens
ccaagugcuuaaaauuucauuu

SEQ ID NO: 167825 - RNA, 23 nt, Homo sapiens
ccacaaugguugaacuagauuac

SEQ ID NO: 167826 - RNA, 22 nt, Homo sapiens
ccacccuggagaauuugagguc

SEQ ID NO: 167827 - RNA, 22 nt, Homo sapiens
ccacuguuuaaauggcugagga

SEQ ID NO: 167828 - RNA, 20 nt, Homo sapiens
ccagcaucauuagauucugg

SEQ ID NO: 167829 - RNA, 21 nt, Homo sapiens
ccaguguaaugauagcaggca

SEQ ID NO: 167830 - RNA, 19 nt, Homo sapiens
ccaguguugccagagcuga

SEQ ID NO: 167831 - RNA, 22 nt, Homo sapiens
ccaguuuucccagcaccauuaa

SEQ ID NO: 167832 - RNA, 22 nt, Homo sapiens
cccaguagagauugccgaauug

SEQ ID NO: 167833 - RNA, 22 nt, Homo sapiens
cccagugguuacauaaggagua

SEQ ID NO: 167834 - RNA, 22 nt, Homo sapiens
ccccagguuucaauaaagccca

SEQ ID NO: 167835 - RNA, 22 nt, Homo sapiens
ccccggguggauguacauguga

SEQ ID NO: 167836 - RNA, 22 nt, Homo sapiens
cccugagagcagggucuuucuc

SEQ ID NO: 167837 - RNA, 22 nt, Homo sapiens
ccuaggcacugggguccagccc

SEQ ID NO: 167838 - RNA, 22 nt, Homo sapiens
ccucacaaccuuuauugaagag

SEQ ID NO: 167839 - RNA, 22 nt, Homo sapiens
ccucauggagaaccucugcuag

SEQ ID NO: 167840 - RNA, 20 nt, Homo sapiens
aucagagccggugaaagggc

SEQ ID NO: 167841 - RNA, 22 nt, Homo sapiens
aucagcagcaugaaaagcaacu

SEQ ID NO: 167842 - RNA, 18 nt, Homo sapiens
aucagggugaagagagga

SEQ ID NO: 167843 - RNA, 22 nt, Homo sapiens
aucagugcauaguauuuaauga

SEQ ID NO: 167844 - RNA, 22 nt, Homo sapiens
aucauacuguuuugauuacugu

SEQ ID NO: 167845 - RNA, 22 nt, Homo sapiens
aucauccagccccagaagggag

SEQ ID NO: 167846 - RNA, 22 nt, Homo sapiens
auccacagugucaauguuguga

SEQ ID NO: 167847 - RNA, 23 nt, Homo sapiens
auccacauucuaguccuuuaugc

SEQ ID NO: 167848 - RNA, 22 nt, Homo sapiens
auccccugcacggggugucauu

SEQ ID NO: 167849 - RNA, 22 nt, Homo sapiens
aucccugugacgagcaucccua

SEQ ID NO: 167850 - RNA, 22 nt, Homo sapiens
aucccuuucugauacuuucccu

SEQ ID NO: 167851 - RNA, 22 nt, Homo sapiens
auccucaguggcuuaaguauag

SEQ ID NO: 167852 - RNA, 22 nt, Homo sapiens
auccugaagcuuuacugaauuc

SEQ ID NO: 167853 - RNA, 22 nt, Homo sapiens
auccugagacuuugcugaaguu

SEQ ID NO: 167854 - RNA, 22 nt, Homo sapiens
aucucaguucaggcuggccaca

SEQ ID NO: 167855 - RNA, 22 nt, Homo sapiens
aucucugagauguucugauuuu

SEQ ID NO: 167856 - RNA, 22 nt, Homo sapiens
aucuggcuucuuuuaguccaca

SEQ ID NO: 167857 - RNA, 22 nt, Homo sapiens
aucugguguauuggugcugggu

SEQ ID NO: 167858 - RNA, 22 nt, Homo sapiens
aucugguguuuuucucccucgu

SEQ ID NO: 167859 - RNA, 22 nt, Homo sapiens
aucuguagauucagcacaagcu

SEQ ID NO: 167860 - RNA, 22 nt, Homo sapiens
aucuguguuuaaggucccagaa

SEQ ID NO: 167861 - RNA, 22 nt, Homo sapiens
aucuugggugggaacugagaau

SEQ ID NO: 167862 - RNA, 22 nt, Homo sapiens
aucuuugcugagaugcauggca

SEQ ID NO: 167863 - RNA, 22 nt, Homo sapiens
augaaaacaugauuugccuguu

SEQ ID NO: 167864 - RNA, 22 nt, Homo sapiens
augaaaucuuuggcagaucuua

SEQ ID NO: 167865 - RNA, 22 nt, Homo sapiens
augaaauguaugagucuggguu

SEQ ID NO: 167866 - RNA, 22 nt, Homo sapiens
augaacacuccaauuguacucc

SEQ ID NO: 167867 - RNA, 22 nt, Homo sapiens
augaacuaugugggauguuuua

SEQ ID NO: 167868 - RNA, 23 nt, Homo sapiens
augaacucaucauuuuuuauggc

SEQ ID NO: 167869 - RNA, 22 nt, Homo sapiens
augaauagaguuaauugaguac

SEQ ID NO: 167870 - RNA, 21 nt, Homo sapiens
augaauguaaagaauguggga

SEQ ID NO: 167871 - RNA, 22 nt, Homo sapiens
augacaguguggauuauuguaa

SEQ ID NO: 167872 - RNA, 22 nt, Homo sapiens
augacauuccacagccguagag

SEQ ID NO: 167873 - RNA, 22 nt, Homo sapiens
augacauugaaaagcaagugga

SEQ ID NO: 167874 - RNA, 18 nt, Homo sapiens
augaccugcggguuauau

SEQ ID NO: 167875 - RNA, 22 nt, Homo sapiens
augacugagacuaacuuacuuu

SEQ ID NO: 167876 - RNA, 18 nt, Homo sapiens
augagagccgauuccugg

SEQ ID NO: 167877 - RNA, 22 nt, Homo sapiens
augagauacuacaaaugaguuu

SEQ ID NO: 167878 - RNA, 22 nt, Homo sapiens
augagauuauguaaagagacca

SEQ ID NO: 167879 - RNA, 22 nt, Homo sapiens
augagcagaagagauacacugu

SEQ ID NO: 167880 - RNA, 20 nt, Homo sapiens
augagguguaugacacugaa

SEQ ID NO: 167881 - RNA, 22 nt, Homo sapiens
augaguaugagaauacauuaag

SEQ ID NO: 167882 - RNA, 22 nt, Homo sapiens
augauagucuugagaagcauuu

SEQ ID NO: 167883 - RNA, 22 nt, Homo sapiens
augaucacuguggaaauucagc

SEQ ID NO: 167884 - RNA, 22 nt, Homo sapiens
augaucuguuuggugaucuugu

SEQ ID NO: 167885 - RNA, 22 nt, Homo sapiens
augauugaccaucugcugggcu

SEQ ID NO: 167886 - RNA, 19 nt, Homo sapiens
augauugucuauggaggaa

SEQ ID NO: 167887 - RNA, 22 nt, Homo sapiens
augauuguucucacucaagaga

SEQ ID NO: 167888 - RNA, 19 nt, Homo sapiens
augcaaugucacaggcugc

SEQ ID NO: 167889 - RNA, 22 nt, Homo sapiens
augcacuuggcaggaugauucc

SEQ ID NO: 167890 - RNA, 22 nt, Homo sapiens
augcagaucacauuuuucuguc

SEQ ID NO: 167891 - RNA, 22 nt, Homo sapiens
augcauaugucuuuauaguggc

SEQ ID NO: 167892 - RNA, 22 nt, Homo sapiens
augcauauuuuaccuagaagag

SEQ ID NO: 167893 - RNA, 22 nt, Homo sapiens
augccacagaaauaaccaaaau

SEQ ID NO: 167894 - RNA, 22 nt, Homo sapiens
augccacugcacuccaaccugg

SEQ ID NO: 167895 - RNA, 22 nt, Homo sapiens
augccagggagaauuguucaag

SEQ ID NO: 167896 - RNA, 21 nt, Homo sapiens
auggaaagacugccucuucaa

SEQ ID NO: 167897 - RNA, 22 nt, Homo sapiens
auggaaaugaagggcuggcccu

SEQ ID NO: 167898 - RNA, 22 nt, Homo sapiens
auggaacauuauagauguaaaa

SEQ ID NO: 167899 - RNA, 22 nt, Homo sapiens
auggaagacuccucuuugggua

SEQ ID NO: 167900 - RNA, 22 nt, Homo sapiens
auggaauguaaguuauguuugc

SEQ ID NO: 167901 - RNA, 22 nt, Homo sapiens
auggacagaaaaaaauagaugu

SEQ ID NO: 167902 - RNA, 22 nt, Homo sapiens
auggacuuuuuguucagugucu

SEQ ID NO: 167903 - RNA, 22 nt, Homo sapiens
auggagguguggggagugaguu

SEQ ID NO: 167904 - RNA, 22 nt, Homo sapiens
auggagugagaauggagguucc

SEQ ID NO: 167905 - RNA, 22 nt, Homo sapiens
aucauuaguuguggaauucuug

SEQ ID NO: 167906 - RNA, 22 nt, Homo sapiens
auccacauucauggaccagucc

SEQ ID NO: 167907 - RNA, 22 nt, Homo sapiens
aucccgagacuuugcugaaguu

SEQ ID NO: 167908 - RNA, 22 nt, Homo sapiens
aucgcgccauuguacuccagcc

SEQ ID NO: 167909 - RNA, 22 nt, Homo sapiens
aucgcugagaaagggacuuuca

SEQ ID NO: 167910 - RNA, 22 nt, Homo sapiens
aucuacagccagucugguuugu

SEQ ID NO: 167911 - RNA, 22 nt, Homo sapiens
aucuagagacauaguaaagaau

SEQ ID NO: 167912 - RNA, 22 nt, Homo sapiens
aucucagagaaaauuacuaaga

SEQ ID NO: 167913 - RNA, 22 nt, Homo sapiens
aucuucucuugaagggugggga

SEQ ID NO: 167914 - RNA, 22 nt, Homo sapiens
aucuuguguugaauggugcaga

SEQ ID NO: 167915 - RNA, 22 nt, Homo sapiens
aucuuugauugaagggacccug

SEQ ID NO: 167916 - RNA, 22 nt, Homo sapiens
aucuuuggucaucacagcuaga

SEQ ID NO: 167917 - RNA, 22 nt, Homo sapiens
augaaaagcauaaacgcugaag

SEQ ID NO: 167918 - RNA, 22 nt, Homo sapiens
augaaaguguguggaaacuuga

SEQ ID NO: 167919 - RNA, 22 nt, Homo sapiens
augaaaugcauguuaaguccgu

SEQ ID NO: 167920 - RNA, 22 nt, Homo sapiens
augaagacaucgucugggauua

SEQ ID NO: 167921 - RNA, 22 nt, Homo sapiens
augaagagaaaguggaucuugg

SEQ ID NO: 167922 - RNA, 20 nt, Homo sapiens
augaaggcaggugugaguuu

SEQ ID NO: 167923 - RNA, 18 nt, Homo sapiens
augaagucaucacuuuua

SEQ ID NO: 167924 - RNA, 22 nt, Homo sapiens
augaagucguuacuaccaauug

SEQ ID NO: 167925 - RNA, 22 nt, Homo sapiens
augaaguuagcucauuucuuuu

SEQ ID NO: 167926 - RNA, 22 nt, Homo sapiens
augaauacugcugcaaugaaca

SEQ ID NO: 167927 - RNA, 22 nt, Homo sapiens
augacaagaguguucagggaga

SEQ ID NO: 167928 - RNA, 22 nt, Homo sapiens
augacaaugaaucccuguuuca

SEQ ID NO: 167929 - RNA, 22 nt, Homo sapiens
augacauagaagcaauccccua

SEQ ID NO: 167930 - RNA, 22 nt, Homo sapiens
augaccagagguaugauguuug

SEQ ID NO: 167931 - RNA, 22 nt, Homo sapiens
augacuaaaggguuuauguuga

SEQ ID NO: 167932 - RNA, 22 nt, Homo sapiens
augacuggaacagcaauuuaca

SEQ ID NO: 167933 - RNA, 22 nt, Homo sapiens
augagaacauaucaagugauug

SEQ ID NO: 167934 - RNA, 22 nt, Homo sapiens
augagaccagcagaaaaccugu

SEQ ID NO: 167935 - RNA, 22 nt, Homo sapiens
augagacuagaagagaauaaua

SEQ ID NO: 167936 - RNA, 22 nt, Homo sapiens
augagauaaaccaucucuuaag

SEQ ID NO: 167937 - RNA, 22 nt, Homo sapiens
augagauauuuuauaagaucau

SEQ ID NO: 167938 - RNA, 22 nt, Homo sapiens
augagaucaaauuuaagcuguu

SEQ ID NO: 167939 - RNA, 22 nt, Homo sapiens
augagaugcaagauuagauggg

SEQ ID NO: 167940 - RNA, 22 nt, Homo sapiens
augagauuguuugugugaaaua

SEQ ID NO: 167941 - RNA, 22 nt, Homo sapiens
augaggcaggaaaggcguaucu

SEQ ID NO: 167942 - RNA, 22 nt, Homo sapiens
augagggagggguggugccgca

SEQ ID NO: 167943 - RNA, 22 nt, Homo sapiens
augagggcggacgcccuggaga

SEQ ID NO: 167944 - RNA, 22 nt, Homo sapiens
augaggugauuucuguucgggu

SEQ ID NO: 167945 - RNA, 22 nt, Homo sapiens
augaggugggagaaucacuuga

SEQ ID NO: 167946 - RNA, 21 nt, Homo sapiens
augagguguacuguggugaaa

SEQ ID NO: 167947 - RNA, 22 nt, Homo sapiens
augagguguuuauuguauccug

SEQ ID NO: 167948 - RNA, 19 nt, Homo sapiens
augagucugcaagaaccag

SEQ ID NO: 167949 - RNA, 22 nt, Homo sapiens
aaaugcagauucugcuuagguu

SEQ ID NO: 167950 - RNA, 22 nt, Homo sapiens
aaaugcauugagggaaaaggca

SEQ ID NO: 167951 - RNA, 22 nt, Homo sapiens
aaaugcucucuacacguuucug

SEQ ID NO: 167952 - RNA, 22 nt, Homo sapiens
aaaugcucuguggguaguaaug

SEQ ID NO: 167953 - RNA, 18 nt, Homo sapiens
aaaugcucuucuggaaua

SEQ ID NO: 167954 - RNA, 22 nt, Homo sapiens
aaaugcugucaaauuguguucu

SEQ ID NO: 167955 - RNA, 22 nt, Homo sapiens
aaaugcugucugugagccucau

SEQ ID NO: 167956 - RNA, 22 nt, Homo sapiens
aaaugcuguuccaggaccuauc

SEQ ID NO: 167957 - RNA, 22 nt, Homo sapiens
aaauggauuaaguucacuugcu

SEQ ID NO: 167958 - RNA, 22 nt, Homo sapiens
aaauggcuuuuugggcaaggug

SEQ ID NO: 167959 - RNA, 22 nt, Homo sapiens
aaauucaucaaaugguuuguau

SEQ ID NO: 167960 - RNA, 22 nt, Homo sapiens
aaauucaugucaccucuaggua

SEQ ID NO: 167961 - RNA, 23 nt, Homo sapiens
aaauuugccuauuauuccuaugg

SEQ ID NO: 167962 - RNA, 22 nt, Homo sapiens
aacaccguagaaacacaaggga

SEQ ID NO: 167963 - RNA, 22 nt, Homo sapiens
aacacuguuuccagucaugauc

SEQ ID NO: 167964 - RNA, 22 nt, Homo sapiens
aacagaauccucuuuuccuggg

SEQ ID NO: 167965 - RNA, 20 nt, Homo sapiens
aacagcacugucugaagcuu

SEQ ID NO: 167966 - RNA, 22 nt, Homo sapiens
aacaggcuccuaggggugcacc

SEQ ID NO: 167967 - RNA, 22 nt, Homo sapiens
aaccuauaguauugaaaucaag

SEQ ID NO: 167968 - RNA, 22 nt, Homo sapiens
aacucacauucuuucuugguac

SEQ ID NO: 167969 - RNA, 22 nt, Homo sapiens
aacugccucugacauaggcagg

SEQ ID NO: 167970 - RNA, 22 nt, Homo sapiens
aacugcuguuuggguacuggug

SEQ ID NO: 167971 - RNA, 22 nt, Homo sapiens
aacuggucuuaugcaagcacua

SEQ ID NO: 167972 - RNA, 22 nt, Homo sapiens
aagaggcuguaggauaaugccu

SEQ ID NO: 167973 - RNA, 22 nt, Homo sapiens
aagagguuauagaguguauacu

SEQ ID NO: 167974 - RNA, 22 nt, Homo sapiens
aagagguuuaacugacucacag

SEQ ID NO: 167975 - RNA, 22 nt, Homo sapiens
aagcacaauuucaccuucuugu

SEQ ID NO: 167976 - RNA, 22 nt, Homo sapiens
aagcaccaauaggagauuuguc

SEQ ID NO: 167977 - RNA, 22 nt, Homo sapiens
aagcaggugucugugucuguaa

SEQ ID NO: 167978 - RNA, 22 nt, Homo sapiens
aagcaggugugggaggaaaugg

SEQ ID NO: 167979 - RNA, 21 nt, Homo sapiens
aagcaugguguaucuuuccau

SEQ ID NO: 167980 - RNA, 22 nt, Homo sapiens
aagccacuguaccugucucuua

SEQ ID NO: 167981 - RNA, 22 nt, Homo sapiens
aagcuaccauuuguauauaaag

SEQ ID NO: 167982 - RNA, 22 nt, Homo sapiens
aagcuggagugcaguggugcga

SEQ ID NO: 167983 - RNA, 22 nt, Homo sapiens
aagcugguuuuauaucugugag

SEQ ID NO: 167984 - RNA, 22 nt, Homo sapiens
aaggaagcuagcaggaauuggu

SEQ ID NO: 167985 - RNA, 22 nt, Homo sapiens
aaggaauucaaauuuucucugg

SEQ ID NO: 167986 - RNA, 23 nt, Homo sapiens
aaggacacugaacacuucccagc

SEQ ID NO: 167987 - RNA, 22 nt, Homo sapiens
aaggagcuuaagugacuuguac

SEQ ID NO: 167988 - RNA, 22 nt, Homo sapiens
aaggcaagaagagaaccaucgg

SEQ ID NO: 167989 - RNA, 22 nt, Homo sapiens
aaggcaauuuguugugaggauu

SEQ ID NO: 167990 - RNA, 22 nt, Homo sapiens
aaggcaugcaaagaacauuuua

SEQ ID NO: 167991 - RNA, 22 nt, Homo sapiens
aaggcuguuguguaauaggauu

SEQ ID NO: 167992 - RNA, 22 nt, Homo sapiens
aagggaauguuguggcugguug

SEQ ID NO: 167993 - RNA, 22 nt, Homo sapiens
aagggagcugcauaaucuugug

SEQ ID NO: 167994 - RNA, 22 nt, Homo sapiens
aaggugcucucuuauguagaaa

SEQ ID NO: 167995 - RNA, 18 nt, Homo sapiens
aaggugcuucuguucuga

SEQ ID NO: 167996 - RNA, 21 nt, Homo sapiens
aaggugguggugauugagaug

SEQ ID NO: 167997 - RNA, 22 nt, Homo sapiens
aagguggugucagagagcuuau

SEQ ID NO: 167998 - RNA, 22 nt, Homo sapiens
aagguuguauuuaauauacugu

SEQ ID NO: 167999 - RNA, 19 nt, Homo sapiens
aaguaguugugacagaugc

SEQ ID NO: 168000 - RNA, 18 nt, Homo sapiens
aaguauagagagcccuua

SEQ ID NO: 168001 - RNA, 22 nt, Homo sapiens
aaguauuaagacuaagaggcuu

SEQ ID NO: 168002 - RNA, 22 nt, Homo sapiens
aagucaugaagaggaaaggaca

SEQ ID NO: 168003 - RNA, 22 nt, Homo sapiens
aaguccaugaagucuugugggu

SEQ ID NO: 168004 - RNA, 22 nt, Homo sapiens
aagugagaugcaguggaguucc

SEQ ID NO: 168005 - RNA, 22 nt, Homo sapiens
aagugaguaauacgucaguugu

SEQ ID NO: 168006 - RNA, 22 nt, Homo sapiens
aagugcacuguaagugcaggau

SEQ ID NO: 168007 - RNA, 22 nt, Homo sapiens
aagugcugggauuggccgggca

SEQ ID NO: 168008 - RNA, 22 nt, Homo sapiens
aagugcuguaugggagccuagg

SEQ ID NO: 168009 - RNA, 22 nt, Homo sapiens
aagugcuucuuuccucgagaag

SEQ ID NO: 168010 - RNA, 22 nt, Homo sapiens
aagugcuuuguacagggguuga

SEQ ID NO: 168011 - RNA, 17 nt, Homo sapiens
aaguggcuuguucacca

SEQ ID NO: 168012 - RNA, 22 nt, Homo sapiens
aauaauggcaccaaagcacaag

SEQ ID NO: 168013 - RNA, 21 nt, Homo sapiens
aauacucuagguuaagagagc

SEQ ID NO: 168014 - RNA, 22 nt, Homo sapiens
aauacuggcacugaagaccaug

SEQ ID NO: 168015 - RNA, 22 nt, Homo sapiens
aauagcauugaaucuaccaauu

SEQ ID NO: 168016 - RNA, 22 nt, Homo sapiens
aauagcuguuuuuaauuccugc

SEQ ID NO: 168017 - RNA, 22 nt, Homo sapiens
aauaucacaggguguacacuca

SEQ ID NO: 168018 - RNA, 23 nt, Homo sapiens
aauaucacaguggguguacaccc

SEQ ID NO: 168019 - RNA, 22 nt, Homo sapiens
aaucacauugaaucugcuaccu

SEQ ID NO: 168020 - RNA, 22 nt, Homo sapiens
aaucagcacacugugcuuucca

SEQ ID NO: 168021 - RNA, 22 nt, Homo sapiens
aaucgcuuuugguaggcaagga

SEQ ID NO: 168022 - RNA, 22 nt, Homo sapiens
aaucucaacacuuugggaggcu

SEQ ID NO: 168023 - RNA, 22 nt, Homo sapiens
aaucucagagauaucugugucc

SEQ ID NO: 168024 - RNA, 22 nt, Homo sapiens
aaucuguagaaggugcacauuc

SEQ ID NO: 168025 - RNA, 22 nt, Homo sapiens
aaugaaguuagauguugagaag

SEQ ID NO: 168026 - RNA, 22 nt, Homo sapiens
aaugacacugagcaucuuucau

SEQ ID NO: 168027 - RNA, 22 nt, Homo sapiens
aaugcaagauguuaauuauagg

SEQ ID NO: 168028 - RNA, 22 nt, Homo sapiens
aaugcaucuagaaaggugaauu

SEQ ID NO: 168029 - RNA, 22 nt, Homo sapiens
aauggcaaauguuuucuguuga

SEQ ID NO: 168030 - RNA, 18 nt, Homo sapiens
aauggcucuggguucuaa

SEQ ID NO: 168031 - RNA, 22 nt, Homo sapiens
aauggcucuuccuggaguugug

SEQ ID NO: 168032 - RNA, 22 nt, Homo sapiens
aauggcucuuuaggcaauagau

SEQ ID NO: 168033 - RNA, 22 nt, Homo sapiens
agaguauacaugugagugagau

SEQ ID NO: 168034 - RNA, 22 nt, Homo sapiens
agaguauagcaacuuaguaaaa

SEQ ID NO: 168035 - RNA, 22 nt, Homo sapiens
agaugauguuuacugagcauca

SEQ ID NO: 168036 - RNA, 23 nt, Homo sapiens
agaugcaucuggcugcgaggcaa

SEQ ID NO: 168037 - RNA, 22 nt, Homo sapiens
agcaacaucagcagcaggaaaa

SEQ ID NO: 168038 - RNA, 22 nt, Homo sapiens
agcaacauugagacugcaguug

SEQ ID NO: 168039 - RNA, 22 nt, Homo sapiens
agcaagaaugaacucucccaga

SEQ ID NO: 168040 - RNA, 22 nt, Homo sapiens
agcaccaauaaucagaguucuu

SEQ ID NO: 168041 - RNA, 19 nt, Homo sapiens
agcagaacaaauguguggg

SEQ ID NO: 168042 - RNA, 22 nt, Homo sapiens
agcagcaccaaacagacuaaga

SEQ ID NO: 168043 - RNA, 20 nt, Homo sapiens
agcagccacagauuccucag

SEQ ID NO: 168044 - RNA, 22 nt, Homo sapiens
agcagcgacacccuguggugag

SEQ ID NO: 168045 - RNA, 22 nt, Homo sapiens
agcagcuuugcauggccuguga

SEQ ID NO: 168046 - RNA, 22 nt, Homo sapiens
agcagguguggcuuauccugaa

SEQ ID NO: 168047 - RNA, 20 nt, Homo sapiens
agcaucagugguaguguugc

SEQ ID NO: 168048 - RNA, 20 nt, Homo sapiens
agcaucauugcaauuuguca

SEQ ID NO: 168049 - RNA, 22 nt, Homo sapiens
agcaugauugggguugggcaca

SEQ ID NO: 168050 - RNA, 17 nt, Homo sapiens
agcauguguuugagauu

SEQ ID NO: 168051 - RNA, 22 nt, Homo sapiens
agccuagagagccacuuugaga

SEQ ID NO: 168052 - RNA, 21 nt, Homo sapiens
agccugugggucauaguugcc

SEQ ID NO: 168053 - RNA, 23 nt, Homo sapiens
agccuguugccuaggcagcucau

SEQ ID NO: 168054 - RNA, 23 nt, Homo sapiens
agcuagagaggcuggggauacag

SEQ ID NO: 168055 - RNA, 22 nt, Homo sapiens
agcuccauuguaaucaccuggu

SEQ ID NO: 168056 - RNA, 22 nt, Homo sapiens
agcugcaauguuuaguauaaua

SEQ ID NO: 168057 - RNA, 22 nt, Homo sapiens
agcuggcuguagcugcaagucu

SEQ ID NO: 168058 - RNA, 22 nt, Homo sapiens
agcuggucuacguguguaugag

SEQ ID NO: 168059 - RNA, 22 nt, Homo sapiens
agcugugucuucuuaaagauuu

SEQ ID NO: 168060 - RNA, 19 nt, Homo sapiens
agcuguguugccugugaga

SEQ ID NO: 168061 - RNA, 22 nt, Homo sapiens
agcuucauuguuaugaauguca

SEQ ID NO: 168062 - RNA, 22 nt, Homo sapiens
agcuugugauuuagagugagag

SEQ ID NO: 168063 - RNA, 22 nt, Homo sapiens
agcuuguuuucccauaacuaga

SEQ ID NO: 168064 - RNA, 22 nt, Homo sapiens
agcuuuuugggaggccuuagga

SEQ ID NO: 168065 - RNA, 22 nt, Homo sapiens
aggaaauguuggucccauuucu

SEQ ID NO: 168066 - RNA, 22 nt, Homo sapiens
aggaagugugcaauuaauuucu

SEQ ID NO: 168067 - RNA, 22 nt, Homo sapiens
aggaauggaaacuuuugauggu

SEQ ID NO: 168068 - RNA, 18 nt, Homo sapiens
aggaaugguaauacuuca

SEQ ID NO: 168069 - RNA, 22 nt, Homo sapiens
aggacacugauguaugcugugg

SEQ ID NO: 168070 - RNA, 22 nt, Homo sapiens
aggaccauuguguagcagacau

SEQ ID NO: 168071 - RNA, 21 nt, Homo sapiens
aggagcauuguugugguggag

SEQ ID NO: 168072 - RNA, 20 nt, Homo sapiens
aggagcauuuacauuggcuc

SEQ ID NO: 168073 - RNA, 22 nt, Homo sapiens
aggagguaggaauugugcuagg

SEQ ID NO: 168074 - RNA, 22 nt, Homo sapiens
aggagguagggugugaaacagc

SEQ ID NO: 168075 - RNA, 22 nt, Homo sapiens
aggagguagucugucccuuagc

SEQ ID NO: 168076 - RNA, 22 nt, Homo sapiens
aggcaaaugccagcaaucacac

SEQ ID NO: 168077 - RNA, 21 nt, Homo sapiens
aggcaagauuacuuacgagca

SEQ ID NO: 168078 - RNA, 22 nt, Homo sapiens
aggcaugaguucagaggguaug

SEQ ID NO: 168079 - RNA, 22 nt, Homo sapiens
aggcaugugugcagacugucug

SEQ ID NO: 168080 - RNA, 22 nt, Homo sapiens
aggcugguauuuacaaaagcuc

SEQ ID NO: 168081 - RNA, 22 nt, Homo sapiens
aggcuguguggauaauauuggg

SEQ ID NO: 168082 - RNA, 22 nt, Homo sapiens
aggcuuguuuuacuaacuggua

SEQ ID NO: 168083 - RNA, 22 nt, Homo sapiens
aggcuuuuggagguggcuuucu

SEQ ID NO: 168084 - RNA, 22 nt, Homo sapiens
agggaagugugcuaugcauuua

SEQ ID NO: 168085 - RNA, 22 nt, Homo sapiens
agggcacuguagguccugccuc

SEQ ID NO: 168086 - RNA, 22 nt, Homo sapiens
agggcuuguuuaacuaucauua

SEQ ID NO: 168087 - RNA, 22 nt, Homo sapiens
aggguuuuuauuuauguggcau

SEQ ID NO: 168088 - RNA, 20 nt, Homo sapiens
agguagauagaugauagaua

SEQ ID NO: 168089 - RNA, 22 nt, Homo sapiens
agguauguaugucuguacagcg

SEQ ID NO: 168090 - RNA, 22 nt, Homo sapiens
aggucaccucaggaaauacuga

SEQ ID NO: 168091 - RNA, 22 nt, Homo sapiens
aggugacugguuuaucuggcag

SEQ ID NO: 168092 - RNA, 22 nt, Homo sapiens
aggugcuugaaucuaugagcuc

SEQ ID NO: 168093 - RNA, 22 nt, Homo sapiens
aguaaauuucugugcuuucaua

SEQ ID NO: 168094 - RNA, 22 nt, Homo sapiens
aguagguguugguagagguuuc

SEQ ID NO: 168095 - RNA, 22 nt, Homo sapiens
aguaucaagccacacaugguca

SEQ ID NO: 168096 - RNA, 22 nt, Homo sapiens
agucaagaugagauuugggugg

SEQ ID NO: 168097 - RNA, 17 nt, Homo sapiens
agucaguaguuuguauu

SEQ ID NO: 168098 - RNA, 23 nt, Homo sapiens
agucaguaugcuccuuggauccc

SEQ ID NO: 168099 - RNA, 22 nt, Homo sapiens
agucagugcauaagaaugaagu

SEQ ID NO: 168100 - RNA, 22 nt, Homo sapiens
agucauagaguuugcccuucuc

SEQ ID NO: 168101 - RNA, 22 nt, Homo sapiens
agucugguguucucacacuagu

SEQ ID NO: 168102 - RNA, 22 nt, Homo sapiens
agugagcuguuuuuacuuucug

SEQ ID NO: 168103 - RNA, 22 nt, Homo sapiens
agugauggagccaggauuuaau

SEQ ID NO: 168104 - RNA, 22 nt, Homo sapiens
agugcauaugucuuuuuggaag

SEQ ID NO: 168105 - RNA, 22 nt, Homo sapiens
agugcauuuguucugugucagg

SEQ ID NO: 168106 - RNA, 22 nt, Homo sapiens
agugccaaaucgagggcucuga

SEQ ID NO: 168107 - RNA, 22 nt, Homo sapiens
agugccauggcugcuagauggc

SEQ ID NO: 168108 - RNA, 22 nt, Homo sapiens
agugccuauugauggaaagaua

SEQ ID NO: 168109 - RNA, 22 nt, Homo sapiens
aguggaauuaagaaacugaauu

SEQ ID NO: 168110 - RNA, 22 nt, Homo sapiens
aguggcuuuuuaguggcagaug

SEQ ID NO: 168111 - RNA, 19 nt, Homo sapiens
agugggcuagaaaucaggg

SEQ ID NO: 168112 - RNA, 22 nt, Homo sapiens
agugguauaauauuauuuugaa

SEQ ID NO: 168113 - RNA, 23 nt, Homo sapiens
aguggucuccugggcccagcugu

SEQ ID NO: 168114 - RNA, 21 nt, Homo sapiens
aguucacauggcuccuguguu

SEQ ID NO: 168115 - RNA, 18 nt, Homo sapiens
aguuguuuuauccugccc

SEQ ID NO: 168116 - RNA, 22 nt, Homo sapiens
auaaaagcaggucuaggucagg

SEQ ID NO: 168117 - RNA, 22 nt, Homo sapiens
auaaagcaaauaggacuauugc

SEQ ID NO: 168118 - RNA, 22 nt, Homo sapiens
uuucccauuguucugcucugug

SEQ ID NO: 168119 - RNA, 22 nt, Homo sapiens
uuucccugaaggcucugaaguc

SEQ ID NO: 168120 - RNA, 22 nt, Homo sapiens
uuucccuuacuuaaacuuacuc

SEQ ID NO: 168121 - RNA, 21 nt, Homo sapiens
uuuccuggagcguauggcuuc

SEQ ID NO: 168122 - RNA, 22 nt, Homo sapiens
uuucuacagugaacgauuucua

SEQ ID NO: 168123 - RNA, 20 nt, Homo sapiens
uuucuccccuauaaaucuca

SEQ ID NO: 168124 - RNA, 23 nt, Homo sapiens
uuucuugggcaugcuaugucagu

SEQ ID NO: 168125 - RNA, 22 nt, Homo sapiens
uuugagcaggcuaaucaauaua

SEQ ID NO: 168126 - RNA, 22 nt, Homo sapiens
uuugagugugauaucgauugga

SEQ ID NO: 168127 - RNA, 22 nt, Homo sapiens
uuugauguccaccucagcccac

SEQ ID NO: 168128 - RNA, 22 nt, Homo sapiens
uuugauuguacuaaaauuguac

SEQ ID NO: 168129 - RNA, 18 nt, Homo sapiens
uuugccacuucccagaaa

SEQ ID NO: 168130 - RNA, 22 nt, Homo sapiens
uuuggaagaugccacuguauca

SEQ ID NO: 168131 - RNA, 22 nt, Homo sapiens
uuuggaaugaaacagcagagcc

SEQ ID NO: 168132 - RNA, 22 nt, Homo sapiens
uuuggcauuagagagacuugca

SEQ ID NO: 168133 - RNA, 22 nt, Homo sapiens
uuuggcauuuaaauaugcaugg

SEQ ID NO: 168134 - RNA, 22 nt, Homo sapiens
uuugggaaugaguuuaucauuu

SEQ ID NO: 168135 - RNA, 22 nt, Homo sapiens
uuugggcuuuuaaucuagagca

SEQ ID NO: 168136 - RNA, 22 nt, Homo sapiens
uuuggucagcugcgggucagcu

SEQ ID NO: 168137 - RNA, 22 nt, Homo sapiens
uuugguugucacaacuggggga

SEQ ID NO: 168138 - RNA, 22 nt, Homo sapiens
uuuguacacgugggugaauugu

SEQ ID NO: 168139 - RNA, 22 nt, Homo sapiens
uuuguacacuguugguaggauu

SEQ ID NO: 168140 - RNA, 22 nt, Homo sapiens
uuuguacuucauugguucuacu

SEQ ID NO: 168141 - RNA, 22 nt, Homo sapiens
uuugucccuuugcaguggcaca

SEQ ID NO: 168142 - RNA, 22 nt, Homo sapiens
uuugugagguggauagauugca

SEQ ID NO: 168143 - RNA, 22 nt, Homo sapiens
uuugugauugcacacucaagau

SEQ ID NO: 168144 - RNA, 22 nt, Homo sapiens
uuugugcuauguuauauauucu

SEQ ID NO: 168145 - RNA, 23 nt, Homo sapiens
uuuguguccccacccaaaucuca

SEQ ID NO: 168146 - RNA, 22 nt, Homo sapiens
uuuuacacuguugguuggaaug

SEQ ID NO: 168147 - RNA, 22 nt, Homo sapiens
uuuuagcaaagagacugguggc

SEQ ID NO: 168148 - RNA, 20 nt, Homo sapiens
uuuuagcuuuuauugaaagc

SEQ ID NO: 168149 - RNA, 22 nt, Homo sapiens
uuuuccagugggacucccauua

SEQ ID NO: 168150 - RNA, 23 nt, Homo sapiens
uuuugcaauaagucacuggaaua

SEQ ID NO: 168151 - RNA, 22 nt, Homo sapiens
uuuugcacauugauuugguauc

SEQ ID NO: 168152 - RNA, 22 nt, Homo sapiens
uuuugcaguuacagagagugag

SEQ ID NO: 168153 - RNA, 22 nt, Homo sapiens
uuuugcucuugguaaugaaaga

SEQ ID NO: 168154 - RNA, 17 nt, Homo sapiens
uuuuggauuagaaaucc

SEQ ID NO: 168155 - RNA, 22 nt, Homo sapiens
uuuugguauaugcaggggucuu

SEQ ID NO: 168156 - RNA, 22 nt, Homo sapiens
uuuugguguauuguauaaggua

SEQ ID NO: 168157 - RNA, 22 nt, Homo sapiens
uuuugucccaugggcuguuccc

SEQ ID NO: 168158 - RNA, 22 nt, Homo sapiens
uuuuugaguagcuggagagcag

SEQ ID NO: 168159 - RNA, 22 nt, Homo sapiens
uuuuuugcuguaugcaaacauc

SEQ ID NO: 168160 - RNA, 22 nt, Homo sapiens
cagagcacugauacuggguucu

SEQ ID NO: 168161 - RNA, 22 nt, Homo sapiens
cagauaguuguagauaugcagc

SEQ ID NO: 168162 - RNA, 22 nt, Homo sapiens
cagauaguuguagguguguggc

SEQ ID NO: 168163 - RNA, 22 nt, Homo sapiens
cagaugcaugaccugggcuugg

SEQ ID NO: 168164 - RNA, 22 nt, Homo sapiens
cagauguaguauuuuagugaaa

SEQ ID NO: 168165 - RNA, 22 nt, Homo sapiens
cagcaaaucauccuauuugagc

SEQ ID NO: 168166 - RNA, 22 nt, Homo sapiens
cagcacauuacaaguacuuggu

SEQ ID NO: 168167 - RNA, 22 nt, Homo sapiens
cagcuugugguauugcugguug

SEQ ID NO: 168168 - RNA, 22 nt, Homo sapiens
caggcagugggagacaaaacug

SEQ ID NO: 168169 - RNA, 22 nt, Homo sapiens
caggcauuguccaugcugaagg

SEQ ID NO: 168170 - RNA, 22 nt, Homo sapiens
caggguccccuaccuuuugaug

SEQ ID NO: 168171 - RNA, 22 nt, Homo sapiens
cagguacuucugggcugagcag

SEQ ID NO: 168172 - RNA, 22 nt, Homo sapiens
cagguaguauuugguuacauaa

SEQ ID NO: 168173 - RNA, 22 nt, Homo sapiens
cagugaauuucaggucaagagu

SEQ ID NO: 168174 - RNA, 20 nt, Homo sapiens
cagugcacuuucccacuggu

SEQ ID NO: 168175 - RNA, 22 nt, Homo sapiens
cagugguuuuuagcuugcuggg

SEQ ID NO: 168176 - RNA, 22 nt, Homo sapiens
cauaaagauggaggaggccagg

SEQ ID NO: 168177 - RNA, 22 nt, Homo sapiens
cauaaaucuuguugaauagcac

SEQ ID NO: 168178 - RNA, 21 nt, Homo sapiens
cauaaugcuacuuauuuuaug

SEQ ID NO: 168179 - RNA, 18 nt, Homo sapiens
cauagcacuucagcacau

SEQ ID NO: 168180 - RNA, 22 nt, Homo sapiens
cauaguacuugcauaguacuau

SEQ ID NO: 168181 - RNA, 22 nt, Homo sapiens
cauauucacuuuacagagcugu

SEQ ID NO: 168182 - RNA, 19 nt, Homo sapiens
caucacagagucuuccauu

SEQ ID NO: 168183 - RNA, 21 nt, Homo sapiens
caucacauuacucaaaguccu

SEQ ID NO: 168184 - RNA, 22 nt, Homo sapiens
caucagagugagauauaagauc

SEQ ID NO: 168185 - RNA, 19 nt, Homo sapiens
caucccugagcugaagugg

SEQ ID NO: 168186 - RNA, 22 nt, Homo sapiens
caugcacugagagggucucggc

SEQ ID NO: 168187 - RNA, 22 nt, Homo sapiens
caugccacugcacgccauccug

SEQ ID NO: 168188 - RNA, 22 nt, Homo sapiens
caugccacugcacuccaaccug

SEQ ID NO: 168189 - RNA, 22 nt, Homo sapiens
cauggagcuaggcuugaucccu

SEQ ID NO: 168190 - RNA, 22 nt, Homo sapiens
cauggcacuguaugaaaugugc

SEQ ID NO: 168191 - RNA, 22 nt, Homo sapiens
cauggcccugggcugggcgaac

SEQ ID NO: 168192 - RNA, 23 nt, Homo sapiens
cauggcuguuaacacuguuugag

SEQ ID NO: 168193 - RNA, 19 nt, Homo sapiens
cauggcuuauaauuuuaau

SEQ ID NO: 168194 - RNA, 22 nt, Homo sapiens
cauggcuuuaagcaacaccaag

SEQ ID NO: 168195 - RNA, 22 nt, Homo sapiens
cauggcuuuauuuucagcuucu

SEQ ID NO: 168196 - RNA, 22 nt, Homo sapiens
cauggcuuucacaguaaagccu

SEQ ID NO: 168197 - RNA, 22 nt, Homo sapiens
cauggcuuuuauaacaagaaau

SEQ ID NO: 168198 - RNA, 22 nt, Homo sapiens
caugucacuuccucucugaugg

SEQ ID NO: 168199 - RNA, 19 nt, Homo sapiens
caugugcacuacuggcuuc

SEQ ID NO: 168200 - RNA, 19 nt, Homo sapiens
cauugcacuccacccuggg

SEQ ID NO: 168201 - RNA, 22 nt, Homo sapiens
cauugcacuccaccuuggguaa

SEQ ID NO: 168202 - RNA, 22 nt, Homo sapiens
cauugcacuccagucugggcaa

SEQ ID NO: 168203 - RNA, 22 nt, Homo sapiens
cauugcacucuagucuggguga

SEQ ID NO: 168204 - RNA, 22 nt, Homo sapiens
cauugcagauccuucaaaugac

SEQ ID NO: 168205 - RNA, 22 nt, Homo sapiens
cauugcaguaagagugggcucu

SEQ ID NO: 168206 - RNA, 22 nt, Homo sapiens
cauuugcacugagacucagcuu

SEQ ID NO: 168207 - RNA, 22 nt, Homo sapiens
cauuuugguuaaauagguagcu

SEQ ID NO: 168208 - RNA, 22 nt, Homo sapiens
ccaaauccauccaaaucauaga

SEQ ID NO: 168209 - RNA, 22 nt, Homo sapiens
ccacaaccucaacagcaucuau

SEQ ID NO: 168210 - RNA, 22 nt, Homo sapiens
ccacaaccuccauauccugggu

SEQ ID NO: 168211 - RNA, 23 nt, Homo sapiens
ccacacuguuuagaauggcauca

SEQ ID NO: 168212 - RNA, 22 nt, Homo sapiens
ccacaguugaaauuuugacugu

SEQ ID NO: 168213 - RNA, 22 nt, Homo sapiens
ccacccuuccacacccugggua

SEQ ID NO: 168214 - RNA, 22 nt, Homo sapiens
ccacugugguaucugauacugg

SEQ ID NO: 168215 - RNA, 22 nt, Homo sapiens
ccagaguuucugauucagcagg

SEQ ID NO: 168216 - RNA, 22 nt, Homo sapiens
ccagcaccauuuguugaauagg

SEQ ID NO: 168217 - RNA, 22 nt, Homo sapiens
ccaggguugagacccacugacu

SEQ ID NO: 168218 - RNA, 22 nt, Homo sapiens
ccagugcugugcaguguaugag

SEQ ID NO: 168219 - RNA, 22 nt, Homo sapiens
ccagugucugacagacacggcg

SEQ ID NO: 168220 - RNA, 22 nt, Homo sapiens
ccaguuuucucacuguugcagu

SEQ ID NO: 168221 - RNA, 19 nt, Homo sapiens
ccauggcaaugaucugaug

SEQ ID NO: 168222 - RNA, 22 nt, Homo sapiens
ccauggcaauggucagucuauu

SEQ ID NO: 168223 - RNA, 22 nt, Homo sapiens
ccauggcuauucuguaaggguu

SEQ ID NO: 168224 - RNA, 18 nt, Homo sapiens
ccauucaacagauuuguc

SEQ ID NO: 168225 - RNA, 22 nt, Homo sapiens
cccagagacagaaugauaaacu

SEQ ID NO: 168226 - RNA, 22 nt, Homo sapiens
cccagaguucuuaaauacugag

SEQ ID NO: 168227 - RNA, 22 nt, Homo sapiens
cccaguaaucuugccaguuuuc

SEQ ID NO: 168228 - RNA, 22 nt, Homo sapiens
ccccaguguguaaaggccuugc

SEQ ID NO: 168229 - RNA, 17 nt, Homo sapiens
ccccugagcgaugcagu

SEQ ID NO: 168230 - RNA, 19 nt, Homo sapiens
ccccuguggauaccgaggg

SEQ ID NO: 168231 - RNA, 17 nt, Homo sapiens
cccuaguagcugggacu

SEQ ID NO: 168232 - RNA, 23 nt, Homo sapiens
cccucagaagugcagggagagaa

SEQ ID NO: 168233 - RNA, 22 nt, Homo sapiens
cccugagaugcuguuaaucugu

SEQ ID NO: 168234 - RNA, 22 nt, Homo sapiens
cccuggacauucaucauuaugu

SEQ ID NO: 168235 - RNA, 21 nt, Homo sapiens
cccugguguuuggaguuugag

SEQ ID NO: 168236 - RNA, 22 nt, Homo sapiens
cccuguagcagcauucuuaaau

SEQ ID NO: 168237 - RNA, 22 nt, Homo sapiens
cccuuagaauuuuguaguuauu

SEQ ID NO: 168238 - RNA, 22 nt, Homo sapiens
ccucauugcuaucccaggcuga

SEQ ID NO: 168239 - RNA, 22 nt, Homo sapiens
ccugagacuugagggggcuucu

SEQ ID NO: 168240 - RNA, 22 nt, Homo sapiens
ccugagguagaguuuauauuga

SEQ ID NO: 168241 - RNA, 21 nt, Homo sapiens
ccugaguacaacccacuccac

SEQ ID NO: 168242 - RNA, 22 nt, Homo sapiens
ccuggaagaaaggugcuaaaua

SEQ ID NO: 168243 - RNA, 22 nt, Homo sapiens
ccuggaucauugucauucccaa

SEQ ID NO: 168244 - RNA, 22 nt, Homo sapiens
ccuggcacugggccccguggcu

SEQ ID NO: 168245 - RNA, 22 nt, Homo sapiens
ccuggguuacaggugugagcca

SEQ ID NO: 168246 - RNA, 22 nt, Homo sapiens
ccugugguuaaccagcuagaug

SEQ ID NO: 168247 - RNA, 22 nt, Homo sapiens
ccuguguuaugguuucuaaugu

SEQ ID NO: 168248 - RNA, 22 nt, Homo sapiens
ccuucacaggcacugguucaga

SEQ ID NO: 168249 - RNA, 22 nt, Homo sapiens
ccuucauccuccagcaggcuag

SEQ ID NO: 168250 - RNA, 22 nt, Homo sapiens
ccuucuuuuguaaggcugaaua

SEQ ID NO: 168251 - RNA, 22 nt, Homo sapiens
ccuuggcaauggcuggggcuga

SEQ ID NO: 168252 - RNA, 22 nt, Homo sapiens
ccuuggcacuuugccacagugc

SEQ ID NO: 168253 - RNA, 19 nt, Homo sapiens
ccuuugguuuccaugacau

SEQ ID NO: 168254 - RNA, 21 nt, Homo sapiens
cgauaacagcccuuucccaaa

SEQ ID NO: 168255 - RNA, 19 nt, Homo sapiens
cuaaaugggucccuagugg

SEQ ID NO: 168256 - RNA, 22 nt, Homo sapiens
cuaacuaugucucaggaugucc

SEQ ID NO: 168257 - RNA, 22 nt, Homo sapiens
cuaagugaguauaauuuuaaga

SEQ ID NO: 168258 - RNA, 20 nt, Homo sapiens
cuaaucaucccagaagaaau

SEQ ID NO: 168259 - RNA, 22 nt, Homo sapiens
cuacagcagcccaguccccgaa

SEQ ID NO: 168260 - RNA, 22 nt, Homo sapiens
cuaccuggguggcucaugacuu

SEQ ID NO: 168261 - RNA, 22 nt, Homo sapiens
cuagaggcacagccuaggcacu

SEQ ID NO: 168262 - RNA, 22 nt, Homo sapiens
cuagauuauccaacuuauuagc

SEQ ID NO: 168263 - RNA, 22 nt, Homo sapiens
cuagcagacacuuccagagagu

SEQ ID NO: 168264 - RNA, 22 nt, Homo sapiens
cuagcagacaggcugggagcag

SEQ ID NO: 168265 - RNA, 22 nt, Homo sapiens
cuagcccugagauaaaugucau

SEQ ID NO: 168266 - RNA, 21 nt, Homo sapiens
cuaggaccaguucuguaauuc

SEQ ID NO: 168267 - RNA, 22 nt, Homo sapiens
cuaggcacgccugggucuccag

SEQ ID NO: 168268 - RNA, 22 nt, Homo sapiens
cuauauacugccugcugauuag

SEQ ID NO: 168269 - RNA, 22 nt, Homo sapiens
cuauaugucuguuuugguacca

SEQ ID NO: 168270 - RNA, 19 nt, Homo sapiens
cuaugaccaugugauuuuu

SEQ ID NO: 168271 - RNA, 22 nt, Homo sapiens
cuaugucuuucauauuuugggg

SEQ ID NO: 168272 - RNA, 19 nt, Homo sapiens
cuauugcacauagcugaag

SEQ ID NO: 168273 - RNA, 22 nt, Homo sapiens
cucaccuugugauccacccacc

SEQ ID NO: 168274 - RNA, 22 nt, Homo sapiens
cucaccuugugauccacccgcc

SEQ ID NO: 168275 - RNA, 22 nt, Homo sapiens
cucacuaggaaguaaaguuugu

SEQ ID NO: 168276 - RNA, 22 nt, Homo sapiens
cucagcuacuugagaggcuuag

SEQ ID NO: 168277 - RNA, 22 nt, Homo sapiens
cucagugucuggggccccaggg

SEQ ID NO: 168278 - RNA, 22 nt, Homo sapiens
cucaguuuugccuuguuuaagg

SEQ ID NO: 168279 - RNA, 22 nt, Homo sapiens
cuccccuuuaguuucuuaauaa

SEQ ID NO: 168280 - RNA, 20 nt, Homo sapiens
cucccugacaaauguggaaa

SEQ ID NO: 168281 - RNA, 22 nt, Homo sapiens
cucccuuugcugaauguuuuuc

SEQ ID NO: 168282 - RNA, 22 nt, Homo sapiens
cuccgggugcgucggcgcccug

SEQ ID NO: 168283 - RNA, 22 nt, Homo sapiens
cuccuggugauuggagugugaa

SEQ ID NO: 168284 - RNA, 20 nt, Homo sapiens
cuccuucauuccuuuggacc

SEQ ID NO: 168285 - RNA, 22 nt, Homo sapiens
cuccuugauuagaguauagagu

SEQ ID NO: 168286 - RNA, 22 nt, Homo sapiens
cucucugagccccagacaccuu

SEQ ID NO: 168287 - RNA, 17 nt, Homo sapiens
cucucugguuuaaagca

SEQ ID NO: 168288 - RNA, 22 nt, Homo sapiens
cucugagguuauucguaauauu

SEQ ID NO: 168289 - RNA, 22 nt, Homo sapiens
cucuuagauuagccauccuaau

SEQ ID NO: 168290 - RNA, 22 nt, Homo sapiens
cucuuugaggugagcugcccau

SEQ ID NO: 168291 - RNA, 22 nt, Homo sapiens
cucuuugaguuccuccuggugu

SEQ ID NO: 168292 - RNA, 22 nt, Homo sapiens
cucuuuuguuccuaguuugauc

SEQ ID NO: 168293 - RNA, 22 nt, Homo sapiens
cugaaagguauacgcuuguuau

SEQ ID NO: 168294 - RNA, 22 nt, Homo sapiens
cugaagugugaaagucuuuuuu

SEQ ID NO: 168295 - RNA, 22 nt, Homo sapiens
cugacagaugacugccacugua

SEQ ID NO: 168296 - RNA, 22 nt, Homo sapiens
cugaccucugucaaagacaccc

SEQ ID NO: 168297 - RNA, 22 nt, Homo sapiens
cugagacacucuuaucugcaua

SEQ ID NO: 168298 - RNA, 22 nt, Homo sapiens
cugagauaauuucuagguguca

SEQ ID NO: 168299 - RNA, 22 nt, Homo sapiens
cugagaucguggggcugcuguc

SEQ ID NO: 168300 - RNA, 22 nt, Homo sapiens
cugagaucugaaccaggagugu

SEQ ID NO: 168301 - RNA, 22 nt, Homo sapiens
cugagauggagucucgcauugu

SEQ ID NO: 168302 - RNA, 22 nt, Homo sapiens
cugagauuaagauauugggagu

SEQ ID NO: 168303 - RNA, 22 nt, Homo sapiens
cugagcaagucauuuuguuaaa

SEQ ID NO: 168304 - RNA, 22 nt, Homo sapiens
cugagguaauuuguugccagua

SEQ ID NO: 168305 - RNA, 22 nt, Homo sapiens
cugagguacugggggccaggau

SEQ ID NO: 168306 - RNA, 22 nt, Homo sapiens
cugagguuaggaguuugagacc

SEQ ID NO: 168307 - RNA, 22 nt, Homo sapiens
cugauugucuauuuaguucacu

SEQ ID NO: 168308 - RNA, 22 nt, Homo sapiens
cugauuguucuugcugggccuu

SEQ ID NO: 168309 - RNA, 22 nt, Homo sapiens
cugcauuugaugacguauggug

SEQ ID NO: 168310 - RNA, 18 nt, Homo sapiens
cugccagugugcucuccg

SEQ ID NO: 168311 - RNA, 22 nt, Homo sapiens
cugccuagauguuguagggggu

SEQ ID NO: 168312 - RNA, 22 nt, Homo sapiens
cuggaaaguagacaaucuaaaa

SEQ ID NO: 168313 - RNA, 22 nt, Homo sapiens
cuggacguugaggcugcaguga

SEQ ID NO: 168314 - RNA, 22 nt, Homo sapiens
cuggagucugacugacacaagg

SEQ ID NO: 168315 - RNA, 22 nt, Homo sapiens
cuggcaaaaagagggcaauaau

SEQ ID NO: 168316 - RNA, 22 nt, Homo sapiens
cuggcagucugccucuucacug

SEQ ID NO: 168317 - RNA, 22 nt, Homo sapiens
cuggcccaguucugcguuuugc

SEQ ID NO: 168318 - RNA, 22 nt, Homo sapiens
cuggcucugggcuaaagaaaua

SEQ ID NO: 168319 - RNA, 22 nt, Homo sapiens
cuggcucuguuagaagaaccag

SEQ ID NO: 168320 - RNA, 22 nt, Homo sapiens
cuggucaugggggcacccucug

SEQ ID NO: 168321 - RNA, 21 nt, Homo sapiens
cugguccccuuuauguaugug

SEQ ID NO: 168322 - RNA, 22 nt, Homo sapiens
cugguuuguaaaguuccugaga

SEQ ID NO: 168323 - RNA, 22 nt, Homo sapiens
cuguaacagaauaaauuuguuu

SEQ ID NO: 168324 - RNA, 22 nt, Homo sapiens
cuguccugcagagucagaauga

SEQ ID NO: 168325 - RNA, 22 nt, Homo sapiens
cugucuggaguccuucgugugc

SEQ ID NO: 168326 - RNA, 22 nt, Homo sapiens
cugugauagguuagucaugaau

SEQ ID NO: 168327 - RNA, 22 nt, Homo sapiens
cugugcaaacaagugaaccccu

SEQ ID NO: 168328 - RNA, 22 nt, Homo sapiens
cugugcauaucuuggacugugu

SEQ ID NO: 168329 - RNA, 22 nt, Homo sapiens
cugugcuugauuauaugagugu

SEQ ID NO: 168330 - RNA, 22 nt, Homo sapiens
cugugcuuggagucccccuagg

SEQ ID NO: 168331 - RNA, 22 nt, Homo sapiens
cugugguguaacucuuggggcg

SEQ ID NO: 168332 - RNA, 22 nt, Homo sapiens
cuguguaguacuagauugagca

SEQ ID NO: 168333 - RNA, 22 nt, Homo sapiens
cuguucaggaggcauuuggugg

SEQ ID NO: 168334 - RNA, 22 nt, Homo sapiens
cuguugguuaaauuccaugcag

SEQ ID NO: 168335 - RNA, 22 nt, Homo sapiens
cuuagcaaugucguguacucac

SEQ ID NO: 168336 - RNA, 18 nt, Homo sapiens
cuuagguagcucauucca

SEQ ID NO: 168337 - RNA, 22 nt, Homo sapiens
cuucaccaguuuggcagucuca

SEQ ID NO: 168338 - RNA, 22 nt, Homo sapiens
cuucacuuuguuaaacuccaau

SEQ ID NO: 168339 - RNA, 22 nt, Homo sapiens
cuuccaguggcagccgggcaug

SEQ ID NO: 168340 - RNA, 22 nt, Homo sapiens
cuuccugaguccugggcucaca

SEQ ID NO: 168341 - RNA, 21 nt, Homo sapiens
cuucuuggggcagggcagggu

SEQ ID NO: 168342 - RNA, 22 nt, Homo sapiens
cuugaacaaagagauuccauua

SEQ ID NO: 168343 - RNA, 20 nt, Homo sapiens
cuugaagacuaugcugcuga

SEQ ID NO: 168344 - RNA, 23 nt, Homo sapiens
cuugagacaaaugcgugugugca

SEQ ID NO: 168345 - RNA, 22 nt, Homo sapiens
cuugagcuugagauccuuucug

SEQ ID NO: 168346 - RNA, 22 nt, Homo sapiens
cuugcagagcccauggauguca

SEQ ID NO: 168347 - RNA, 22 nt, Homo sapiens
cuugcagagucauucuaauuuc

SEQ ID NO: 168348 - RNA, 22 nt, Homo sapiens
cuugccuaaucugcaugauuuu

SEQ ID NO: 168349 - RNA, 22 nt, Homo sapiens
cuuuacaguuggacucacgagg

SEQ ID NO: 168350 - RNA, 21 nt, Homo sapiens
cuuuaugcuguguuagaaaag

SEQ ID NO: 168351 - RNA, 22 nt, Homo sapiens
cuuuccauuguuggagcauaaa

SEQ ID NO: 168352 - RNA, 22 nt, Homo sapiens
cuuuggauggaaccucucuuuc

SEQ ID NO: 168353 - RNA, 20 nt, Homo sapiens
cuuuggcaaugagaacaggg

SEQ ID NO: 168354 - RNA, 22 nt, Homo sapiens
cuuuggcacuuccuaagugcca

SEQ ID NO: 168355 - RNA, 22 nt, Homo sapiens
cuuugguggagucuuuagguuc

SEQ ID NO: 168356 - RNA, 22 nt, Homo sapiens
cuuugguguauuuucagagacc

SEQ ID NO: 168357 - RNA, 22 nt, Homo sapiens
cuuugguuaauaggauauggca

SEQ ID NO: 168358 - RNA, 22 nt, Homo sapiens
cuuuguaugucaugacaacugu

SEQ ID NO: 168359 - RNA, 22 nt, Homo sapiens
cuuugugcccuucugcccauca

SEQ ID NO: 168360 - RNA, 22 nt, Homo sapiens
cuuuguguaggugccucuggcu

SEQ ID NO: 168361 - RNA, 22 nt, Homo sapiens
cuuugugugggccaagggcugg

SEQ ID NO: 168362 - RNA, 22 nt, Homo sapiens
cuuuuacacugguggugggaau

SEQ ID NO: 168363 - RNA, 21 nt, Homo sapiens
cuuuugcacuccagccugggu

SEQ ID NO: 168364 - RNA, 22 nt, Homo sapiens
cuuuugcugggucagcgguggu

SEQ ID NO: 168365 - RNA, 22 nt, Homo sapiens
cuuuuggugguucugaugcagg

SEQ ID NO: 168366 - RNA, 22 nt, Homo sapiens
cuuuuugcugcagcaauacugg

SEQ ID NO: 168367 - RNA, 22 nt, Homo sapiens
gaaagacuuucugcuguggaua

SEQ ID NO: 168368 - RNA, 22 nt, Homo sapiens
gaaagugcugcuugacugggau

SEQ ID NO: 168369 - RNA, 22 nt, Homo sapiens
gaaauguauuaaugaguugaaa

SEQ ID NO: 168370 - RNA, 22 nt, Homo sapiens
gaaccagcagacuuugacaggu

SEQ ID NO: 168371 - RNA, 22 nt, Homo sapiens
gaagugcuuuuggacuaacagu

SEQ ID NO: 168372 - RNA, 22 nt, Homo sapiens
gaaucauuggguugauucaaga

SEQ ID NO: 168373 - RNA, 22 nt, Homo sapiens
gaauucugucgcuuacuagaug

SEQ ID NO: 168374 - RNA, 22 nt, Homo sapiens
gaauugcacaaaaacugcuugu

SEQ ID NO: 168375 - RNA, 22 nt, Homo sapiens
gaauuguacugcaaucagggga

SEQ ID NO: 168376 - RNA, 22 nt, Homo sapiens
gacacagugaagucucuacuug

SEQ ID NO: 168377 - RNA, 22 nt, Homo sapiens
gacacuggguguuuguuggcgu

SEQ ID NO: 168378 - RNA, 22 nt, Homo sapiens
gacauguaaggcucucucuguu

SEQ ID NO: 168379 - RNA, 17 nt, Homo sapiens
gacgaucaucaggaggc

SEQ ID NO: 168380 - RNA, 22 nt, Homo sapiens
gacuagauauuguucuauguca

SEQ ID NO: 168381 - RNA, 19 nt, Homo sapiens
gacuccagaguugugugcu

SEQ ID NO: 168382 - RNA, 22 nt, Homo sapiens
gacucuguagacaaucacaucu

SEQ ID NO: 168383 - RNA, 22 nt, Homo sapiens
gacuggagcuguaugugguuac

SEQ ID NO: 168384 - RNA, 22 nt, Homo sapiens
gacuggccuauaauggcgaauu

SEQ ID NO: 168385 - RNA, 16 nt, Homo sapiens
gacugggcugaggaau

SEQ ID NO: 168386 - RNA, 22 nt, Homo sapiens
gacuggguuaguuugaaagacu

SEQ ID NO: 168387 - RNA, 22 nt, Homo sapiens
gacuucaucauacuaugugugg

SEQ ID NO: 168388 - RNA, 22 nt, Homo sapiens
gagaaccauuuggagaaaaagu

SEQ ID NO: 168389 - RNA, 22 nt, Homo sapiens
gagaaccuccagcaagguagua

SEQ ID NO: 168390 - RNA, 22 nt, Homo sapiens
gagaacuaaugauguacuaggc

SEQ ID NO: 168391 - RNA, 22 nt, Homo sapiens
gagaacuaaugguuugauaagg

SEQ ID NO: 168392 - RNA, 22 nt, Homo sapiens
gagaacugagauaagugauauu

SEQ ID NO: 168393 - RNA, 22 nt, Homo sapiens
gagaacuggcgugaacugcacg

SEQ ID NO: 168394 - RNA, 22 nt, Homo sapiens
gagaacuggcugauucaaggac

SEQ ID NO: 168395 - RNA, 21 nt, Homo sapiens
gagaaucaucauggcugcaua

SEQ ID NO: 168396 - RNA, 22 nt, Homo sapiens
gagaaugaacagacugccucuu

SEQ ID NO: 168397 - RNA, 22 nt, Homo sapiens
gagaaugagaggggaaggccac

SEQ ID NO: 168398 - RNA, 22 nt, Homo sapiens
gagacggagucacgcccuguca

SEQ ID NO: 168399 - RNA, 22 nt, Homo sapiens
gagacucuuagauuggaaaucu

SEQ ID NO: 168400 - RNA, 22 nt, Homo sapiens
gagagguaguuuuuuggucguc

SEQ ID NO: 168401 - RNA, 22 nt, Homo sapiens
gagaucauguacuagaacaccu

SEQ ID NO: 168402 - RNA, 22 nt, Homo sapiens
gagauguagucuugcccuguca

SEQ ID NO: 168403 - RNA, 22 nt, Homo sapiens
gagaugugguucaaggguguuu

SEQ ID NO: 168404 - RNA, 22 nt, Homo sapiens
gagcaccagucccugucagugc

SEQ ID NO: 168405 - RNA, 22 nt, Homo sapiens
gagccuguaggaggagaggugg

SEQ ID NO: 168406 - RNA, 22 nt, Homo sapiens
gagcuagggucaugcuacugca

SEQ ID NO: 168407 - RNA, 22 nt, Homo sapiens
gagcucaccuuaccucuggagc

SEQ ID NO: 168408 - RNA, 22 nt, Homo sapiens
gagcugaucuuuucugauucca

SEQ ID NO: 168409 - RNA, 20 nt, Homo sapiens
gagcugguguacugccgggc

SEQ ID NO: 168410 - RNA, 22 nt, Homo sapiens
gagcuguuuuucacuagaccaa

SEQ ID NO: 168411 - RNA, 22 nt, Homo sapiens
gaggacauuaugcuaaguggaa

SEQ ID NO: 168412 - RNA, 22 nt, Homo sapiens
gaggcaaguggccaccgagucu

SEQ ID NO: 168413 - RNA, 22 nt, Homo sapiens
gaggcagucuguccauucucag

SEQ ID NO: 168414 - RNA, 22 nt, Homo sapiens
gagguaggaauaaacauuugaa

SEQ ID NO: 168415 - RNA, 22 nt, Homo sapiens
gagguauggauaucuggagagg

SEQ ID NO: 168416 - RNA, 22 nt, Homo sapiens
gagguaugugggcagacauuua

SEQ ID NO: 168417 - RNA, 22 nt, Homo sapiens
gagguugggaugagggauacag

SEQ ID NO: 168418 - RNA, 22 nt, Homo sapiens
gaguaaaugucaaguacuuagg

SEQ ID NO: 168419 - RNA, 22 nt, Homo sapiens
gagucagugucuugcucuguca

SEQ ID NO: 168420 - RNA, 21 nt, Homo sapiens
gagugcaaauaaagagagggc

SEQ ID NO: 168421 - RNA, 22 nt, Homo sapiens
gagugcuguuagcccuggguuu

SEQ ID NO: 168422 - RNA, 22 nt, Homo sapiens
gaguuagguugucaaugucuua

SEQ ID NO: 168423 - RNA, 22 nt, Homo sapiens
gaguucaaaucucagcucuguu

SEQ ID NO: 168424 - RNA, 22 nt, Homo sapiens
gauaaaguauuggguacuaugc

SEQ ID NO: 168425 - RNA, 18 nt, Homo sapiens
gauaacaguggacuaugc

SEQ ID NO: 168426 - RNA, 22 nt, Homo sapiens
gauauguaguaguugaaaaaga

SEQ ID NO: 168427 - RNA, 22 nt, Homo sapiens
gaucacauguguacucaaugug

SEQ ID NO: 168428 - RNA, 22 nt, Homo sapiens
gaucucaguggauacugugaug

SEQ ID NO: 168429 - RNA, 22 nt, Homo sapiens
gaucugucuuuccuuauagucu

SEQ ID NO: 168430 - RNA, 22 nt, Homo sapiens
gaucugugugauuggaugcauu

SEQ ID NO: 168431 - RNA, 22 nt, Homo sapiens
gaucuguuucaauugucuuagu

SEQ ID NO: 168432 - RNA, 22 nt, Homo sapiens
gaugacacugggucaaaucuca

SEQ ID NO: 168433 - RNA, 22 nt, Homo sapiens
gaugagaugagcauuugaauug

SEQ ID NO: 168434 - RNA, 22 nt, Homo sapiens
uacaguguuuugguauuccaca

SEQ ID NO: 168435 - RNA, 22 nt, Homo sapiens
uacaucagccugaaagagcucg

SEQ ID NO: 168436 - RNA, 22 nt, Homo sapiens
uaccaaguauuuucacaugaac

SEQ ID NO: 168437 - RNA, 22 nt, Homo sapiens
uaccucaguucaauaacagaua

SEQ ID NO: 168438 - RNA, 22 nt, Homo sapiens
uacuacagccugagcgacugag

SEQ ID NO: 168439 - RNA, 22 nt, Homo sapiens
uacuacuuucucuucugggaaa

SEQ ID NO: 168440 - RNA, 22 nt, Homo sapiens
uacuagaaccuuauucagagug

SEQ ID NO: 168441 - RNA, 22 nt, Homo sapiens
uacucugcagagaugcauaaca

SEQ ID NO: 168442 - RNA, 22 nt, Homo sapiens
uacugcagucagacuccugggc

SEQ ID NO: 168443 - RNA, 22 nt, Homo sapiens
uacugcaguugcagcuugagga

SEQ ID NO: 168444 - RNA, 22 nt, Homo sapiens
uacugcauucuccgccuccggg

SEQ ID NO: 168445 - RNA, 21 nt, Homo sapiens
uacuggagauacagucugcaa

SEQ ID NO: 168446 - RNA, 22 nt, Homo sapiens
uacuggccccaaaguagguagu

SEQ ID NO: 168447 - RNA, 22 nt, Homo sapiens
uacugguuuuggugggcaggug

SEQ ID NO: 168448 - RNA, 22 nt, Homo sapiens
uacuuagagauuccaggaacuc

SEQ ID NO: 168449 - RNA, 22 nt, Homo sapiens
uagaaagcaugaccuucagaua

SEQ ID NO: 168450 - RNA, 22 nt, Homo sapiens
uagaaucuaacucgcaugaaaa

SEQ ID NO: 168451 - RNA, 22 nt, Homo sapiens
uagaauguaaauuccaagggca

SEQ ID NO: 168452 - RNA, 22 nt, Homo sapiens
uagacacuagauaugugacuga

SEQ ID NO: 168453 - RNA, 22 nt, Homo sapiens
uagaccauucuauuuccuaugc

SEQ ID NO: 168454 - RNA, 20 nt, Homo sapiens
uagagagauauggggguucc

SEQ ID NO: 168455 - RNA, 22 nt, Homo sapiens
uagagccauugcagauguuuga

SEQ ID NO: 168456 - RNA, 22 nt, Homo sapiens
uagagguucuaagauucucaga

SEQ ID NO: 168457 - RNA, 20 nt, Homo sapiens
uagaugcauuuagauucauu

SEQ ID NO: 168458 - RNA, 21 nt, Homo sapiens
uagaugguguucuagagagaa

SEQ ID NO: 168459 - RNA, 22 nt, Homo sapiens
uagauucauuuuagcaaaaguu

SEQ ID NO: 168460 - RNA, 21 nt, Homo sapiens
uagcaaauugcuauuaaggca

SEQ ID NO: 168461 - RNA, 22 nt, Homo sapiens
uagcaaguguuuaagcacuuuu

SEQ ID NO: 168462 - RNA, 17 nt, Homo sapiens
uagcacagugccuggua

SEQ ID NO: 168463 - RNA, 22 nt, Homo sapiens
uagcacagugucauucuaggua

SEQ ID NO: 168464 - RNA, 22 nt, Homo sapiens
uagcacaucuucuuggccugca

SEQ ID NO: 168465 - RNA, 22 nt, Homo sapiens
uagcagcaccccacucuacugg

SEQ ID NO: 168466 - RNA, 20 nt, Homo sapiens
uagcagcagacagagggagg

SEQ ID NO: 168467 - RNA, 22 nt, Homo sapiens
uagcagcauuuuuguagaguau

SEQ ID NO: 168468 - RNA, 22 nt, Homo sapiens
uagcagguguuccacaaauauu

SEQ ID NO: 168469 - RNA, 22 nt, Homo sapiens
uagcaguaucccaccaucuggu

SEQ ID NO: 168470 - RNA, 22 nt, Homo sapiens
uagcagugucuagguaggccau

SEQ ID NO: 168471 - RNA, 22 nt, Homo sapiens
uagcccagugagguugauuugg

SEQ ID NO: 168472 - RNA, 22 nt, Homo sapiens
uagcucagcccagcuaagcuca

SEQ ID NO: 168473 - RNA, 21 nt, Homo sapiens
uagcucagugguguugccaua

SEQ ID NO: 168474 - RNA, 21 nt, Homo sapiens
uagcugcacccaggccuccuu

SEQ ID NO: 168475 - RNA, 22 nt, Homo sapiens
uagcugcauccugugcacucaa

SEQ ID NO: 168476 - RNA, 22 nt, Homo sapiens
uagcuggaauuacuugcaccug

SEQ ID NO: 168477 - RNA, 22 nt, Homo sapiens
uaggacacagaccuggauggaa

SEQ ID NO: 168478 - RNA, 22 nt, Homo sapiens
uaggagcacagcagcauguggg

SEQ ID NO: 168479 - RNA, 22 nt, Homo sapiens
uaggcaaguugcccaaucucuc

SEQ ID NO: 168480 - RNA, 22 nt, Homo sapiens
uaggcuuuucugggaugugggc

SEQ ID NO: 168481 - RNA, 22 nt, Homo sapiens
uagggcuuuaguuugcuugugu

SEQ ID NO: 168482 - RNA, 22 nt, Homo sapiens
uaggggcacacuucgguuagca

SEQ ID NO: 168483 - RNA, 22 nt, Homo sapiens
uagguagaaucuugaagccauu

SEQ ID NO: 168484 - RNA, 22 nt, Homo sapiens
uaggugauugaagguggaaugu

SEQ ID NO: 168485 - RNA, 22 nt, Homo sapiens
uagguugucucuucacucugau

SEQ ID NO: 168486 - RNA, 22 nt, Homo sapiens
uagguuguucuauuaucuuaca

SEQ ID NO: 168487 - RNA, 22 nt, Homo sapiens
uaguagagauggggcacaugcc

SEQ ID NO: 168488 - RNA, 22 nt, Homo sapiens
uaguaucauugaaacggcuugu

SEQ ID NO: 168489 - RNA, 21 nt, Homo sapiens
uagugcagugggguaugacuu

SEQ ID NO: 168490 - RNA, 22 nt, Homo sapiens
uagugcugagauugagaagccc

SEQ ID NO: 168491 - RNA, 22 nt, Homo sapiens
uagugcugugauauuuuuggcc

SEQ ID NO: 168492 - RNA, 20 nt, Homo sapiens
uaguggaaaucagguccucu

SEQ ID NO: 168493 - RNA, 22 nt, Homo sapiens
uauaacaaugcaagaauggccu

SEQ ID NO: 168494 - RNA, 22 nt, Homo sapiens
uauaacacccacauauagucuu

SEQ ID NO: 168495 - RNA, 22 nt, Homo sapiens
uauacaguaggcacucaguggc

SEQ ID NO: 168496 - RNA, 22 nt, Homo sapiens
uauacaugugggcaucaggaga

SEQ ID NO: 168497 - RNA, 22 nt, Homo sapiens
uauagcacugaaagaggugauu

SEQ ID NO: 168498 - RNA, 22 nt, Homo sapiens
uauagcauuuugauccuguaga

SEQ ID NO: 168499 - RNA, 22 nt, Homo sapiens
uauaucuguccauggcccugcu

SEQ ID NO: 168500 - RNA, 22 nt, Homo sapiens
uaucaccauguccguuuuaaaa

SEQ ID NO: 168501 - RNA, 22 nt, Homo sapiens
uauccuagugggguuucaguca

SEQ ID NO: 168502 - RNA, 22 nt, Homo sapiens
uaucucacauauucaguagguu

SEQ ID NO: 168503 - RNA, 22 nt, Homo sapiens
uaucucagaguguacaagauua

SEQ ID NO: 168504 - RNA, 22 nt, Homo sapiens
uaucucauccuccuugauccca

SEQ ID NO: 168505 - RNA, 22 nt, Homo sapiens
uaucucuuuucauguguaaaug

SEQ ID NO: 168506 - RNA, 20 nt, Homo sapiens
uaugaaacaguguagagcaa

SEQ ID NO: 168507 - RNA, 22 nt, Homo sapiens
uaugacuuuggaaaaauuacuu

SEQ ID NO: 168508 - RNA, 22 nt, Homo sapiens
uaugacuuuugaauacagaugg

SEQ ID NO: 168509 - RNA, 22 nt, Homo sapiens
uaugauuuuugggagaggucaa

SEQ ID NO: 168510 - RNA, 22 nt, Homo sapiens
uaugccuuucucacuaagcuua

SEQ ID NO: 168511 - RNA, 22 nt, Homo sapiens
uauggguaguacaaaguguaua

SEQ ID NO: 168512 - RNA, 21 nt, Homo sapiens
uaugguuucuaauucugcagg

SEQ ID NO: 168513 - RNA, 22 nt, Homo sapiens
uaugucaugggguuuuugagau

SEQ ID NO: 168514 - RNA, 22 nt, Homo sapiens
uaugucauggguaaagugcccu

SEQ ID NO: 168515 - RNA, 22 nt, Homo sapiens
uaugucuggaguuacugagcug

SEQ ID NO: 168516 - RNA, 22 nt, Homo sapiens
uaugugcacaugcccuggugac

SEQ ID NO: 168517 - RNA, 22 nt, Homo sapiens
uauuacuugucugugucucaau

SEQ ID NO: 168518 - RNA, 22 nt, Homo sapiens
uauuagugucuuuugguuagaa

SEQ ID NO: 168519 - RNA, 22 nt, Homo sapiens
uauucaagccaaauucaagcca

SEQ ID NO: 168520 - RNA, 22 nt, Homo sapiens
uauucacuguaucauugauggg

SEQ ID NO: 168521 - RNA, 22 nt, Homo sapiens
uauuccuuuugcauuuccacau

SEQ ID NO: 168522 - RNA, 22 nt, Homo sapiens
uauugaacuggaucagaaggcc

SEQ ID NO: 168523 - RNA, 22 nt, Homo sapiens
uauugauuuucaguguucagcu

SEQ ID NO: 168524 - RNA, 22 nt, Homo sapiens
uauugcagauacccaggaaguu

SEQ ID NO: 168525 - RNA, 22 nt, Homo sapiens
uauuggcucuguuucucugaag

SEQ ID NO: 168526 - RNA, 22 nt, Homo sapiens
uauuucaguugugcagguaguu

SEQ ID NO: 168527 - RNA, 22 nt, Homo sapiens
uauuugauuaacaagagccuaa

SEQ ID NO: 168528 - RNA, 22 nt, Homo sapiens
ucaaaaccucagagaguagagc

SEQ ID NO: 168529 - RNA, 22 nt, Homo sapiens
ucaaagugcuauggcucagguu

SEQ ID NO: 168530 - RNA, 22 nt, Homo sapiens
ucaacaggucaauugcauagaa

SEQ ID NO: 168531 - RNA, 22 nt, Homo sapiens
ucaacagugauggaaaguuaua

SEQ ID NO: 168532 - RNA, 22 nt, Homo sapiens
ucaacagugggcacuguaaaug

SEQ ID NO: 168533 - RNA, 22 nt, Homo sapiens
ucaacugcuugagaucacaaau

SEQ ID NO: 168534 - RNA, 22 nt, Homo sapiens
ucaagcaauucuccucucagcc

SEQ ID NO: 168535 - RNA, 20 nt, Homo sapiens
ucaaggcacgaauaaaaguu

SEQ ID NO: 168536 - RNA, 22 nt, Homo sapiens
ucaaggcaguggccuuccuucu

SEQ ID NO: 168537 - RNA, 22 nt, Homo sapiens
ucaaguaguaacuaacugugac

SEQ ID NO: 168538 - RNA, 22 nt, Homo sapiens
ucaaguagugacucgaguuauu

SEQ ID NO: 168539 - RNA, 22 nt, Homo sapiens
ucaaugcaaccuccaccucugg

SEQ ID NO: 168540 - RNA, 22 nt, Homo sapiens
ucaaugcaugugacaaagagua

SEQ ID NO: 168541 - RNA, 22 nt, Homo sapiens
ucacaagugagaggaauuagau

SEQ ID NO: 168542 - RNA, 22 nt, Homo sapiens
ucacaaguguauagacaugucc

SEQ ID NO: 168543 - RNA, 22 nt, Homo sapiens
ucacacgugaacucaucacaga

SEQ ID NO: 168544 - RNA, 22 nt, Homo sapiens
ucacacucucaccaacauuugg

SEQ ID NO: 168545 - RNA, 22 nt, Homo sapiens
ucacacugaauuugaagcaaug

SEQ ID NO: 168546 - RNA, 23 nt, Homo sapiens
ucacacuuaagagaaaugcagcu

SEQ ID NO: 168547 - RNA, 22 nt, Homo sapiens
ucacagacugagccaaauagag

SEQ ID NO: 168548 - RNA, 22 nt, Homo sapiens
ucacagaugaggcgagaggcag

SEQ ID NO: 168549 - RNA, 19 nt, Homo sapiens
ucacaggguugacuugagg

SEQ ID NO: 168550 - RNA, 22 nt, Homo sapiens
ucacaguaucaugggggacaga

SEQ ID NO: 168551 - RNA, 22 nt, Homo sapiens
ucacaguucagcauggcugagg

SEQ ID NO: 168552 - RNA, 22 nt, Homo sapiens
ucacaugaagauuuuaguauac

SEQ ID NO: 168553 - RNA, 22 nt, Homo sapiens
ucacauguguaugagcuuugau

SEQ ID NO: 168554 - RNA, 22 nt, Homo sapiens
ucacauucaauuguaauccccg

SEQ ID NO: 168555 - RNA, 22 nt, Homo sapiens
ucaccuggagaagauggaucau

SEQ ID NO: 168556 - RNA, 22 nt, Homo sapiens
ucaccuggagccuucacauucu

SEQ ID NO: 168557 - RNA, 18 nt, Homo sapiens
ucaccuugaugcuggguc

SEQ ID NO: 168558 - RNA, 22 nt, Homo sapiens
ucacgugguucauaaggcagaa

SEQ ID NO: 168559 - RNA, 22 nt, Homo sapiens
ucacugaaaccgccuccaccuc

SEQ ID NO: 168560 - RNA, 22 nt, Homo sapiens
ucacugaaacuguccuggguua

SEQ ID NO: 168561 - RNA, 20 nt, Homo sapiens
ucacugagugguccacagua

SEQ ID NO: 168562 - RNA, 22 nt, Homo sapiens
ucacugcgaccucugccucccg

SEQ ID NO: 168563 - RNA, 22 nt, Homo sapiens
ucacugcgcuucagccugggug

SEQ ID NO: 168564 - RNA, 19 nt, Homo sapiens
ucacuggacagcacacuca

SEQ ID NO: 168565 - RNA, 22 nt, Homo sapiens
ucacuggacucuagccugggug

SEQ ID NO: 168566 - RNA, 22 nt, Homo sapiens
ucacugugcaugaaggaugcug

SEQ ID NO: 168567 - RNA, 22 nt, Homo sapiens
ucacuguugaugggcaugcagg

SEQ ID NO: 168568 - RNA, 22 nt, Homo sapiens
ucagaacugaacaaaccagucu

SEQ ID NO: 168569 - RNA, 22 nt, Homo sapiens
ucagaauguaacuuuaguugga

SEQ ID NO: 168570 - RNA, 22 nt, Homo sapiens
ucagacacugagcaaacgacua

SEQ ID NO: 168571 - RNA, 22 nt, Homo sapiens
ucagacacuguggccuuuggac

SEQ ID NO: 168572 - RNA, 22 nt, Homo sapiens
ucagaguagaaacacuuccaua

SEQ ID NO: 168573 - RNA, 22 nt, Homo sapiens
ucagagucuagaucacucacug

SEQ ID NO: 168574 - RNA, 22 nt, Homo sapiens
ucagaguggccucucuugaaga

SEQ ID NO: 168575 - RNA, 19 nt, Homo sapiens
ucagaugcauuagggguua

SEQ ID NO: 168576 - RNA, 22 nt, Homo sapiens
ucagauguuucuuuaacgcaug

SEQ ID NO: 168577 - RNA, 22 nt, Homo sapiens
ucagauguuugagaaguauacu

SEQ ID NO: 168578 - RNA, 22 nt, Homo sapiens
ucagauguuuuguuuaucugcu

SEQ ID NO: 168579 - RNA, 22 nt, Homo sapiens
ucagcaaugaccuaagcaaaua

SEQ ID NO: 168580 - RNA, 22 nt, Homo sapiens
ucagcacauucaaggccugccu

SEQ ID NO: 168581 - RNA, 22 nt, Homo sapiens
ucagcagugugaaaauggacua

SEQ ID NO: 168582 - RNA, 20 nt, Homo sapiens
ucaggcuccgcauuaacuua

SEQ ID NO: 168583 - RNA, 20 nt, Homo sapiens
ucagguagggcuucaacauu

SEQ ID NO: 168584 - RNA, 22 nt, Homo sapiens
ucaggucauuccaggagggcca

SEQ ID NO: 168585 - RNA, 23 nt, Homo sapiens
ucaguacuccacuuucaauagug

SEQ ID NO: 168586 - RNA, 22 nt, Homo sapiens
ucaguagcaugaaaacagacua

SEQ ID NO: 168587 - RNA, 22 nt, Homo sapiens
ucagucauugauggaguagguc

SEQ ID NO: 168588 - RNA, 22 nt, Homo sapiens
ucagugccauugccauaugagu

SEQ ID NO: 168589 - RNA, 22 nt, Homo sapiens
ucagugcuguuugcccucguuu

SEQ ID NO: 168590 - RNA, 22 nt, Homo sapiens
ucagugcuuggcacagagagcu

SEQ ID NO: 168591 - RNA, 23 nt, Homo sapiens
ucagugucuggauccugcucagu

SEQ ID NO: 168592 - RNA, 22 nt, Homo sapiens
ucauacuguuaaaugguuuagu

SEQ ID NO: 168593 - RNA, 22 nt, Homo sapiens
ucauacuguugugaaacaaaac

SEQ ID NO: 168594 - RNA, 21 nt, Homo sapiens
ucauauguaucuuugugccuc

SEQ ID NO: 168595 - RNA, 22 nt, Homo sapiens
ucaucaggaaacuuaugcagug

SEQ ID NO: 168596 - RNA, 22 nt, Homo sapiens
ucaucagguaugucagcggagu

SEQ ID NO: 168597 - RNA, 21 nt, Homo sapiens
ucaucagucaaagacaauggu

SEQ ID NO: 168598 - RNA, 19 nt, Homo sapiens
ucauggcuuuuucagcugu

SEQ ID NO: 168599 - RNA, 22 nt, Homo sapiens
ucaugugaggauaacaauagug

SEQ ID NO: 168600 - RNA, 22 nt, Homo sapiens
ucauuagagacagggugucacu

SEQ ID NO: 168601 - RNA, 22 nt, Homo sapiens
ucauugcaaucucugccucccg

SEQ ID NO: 168602 - RNA, 22 nt, Homo sapiens
uccacaauggagaagaguauga

SEQ ID NO: 168603 - RNA, 22 nt, Homo sapiens
uccacagugguugaacuaguuu

SEQ ID NO: 168604 - RNA, 19 nt, Homo sapiens
uccaccgcgugcaccucua

SEQ ID NO: 168605 - RNA, 22 nt, Homo sapiens
uccagaguggugaugcuggggc

SEQ ID NO: 168606 - RNA, 22 nt, Homo sapiens
uccagguacucagggggcugag

SEQ ID NO: 168607 - RNA, 22 nt, Homo sapiens
uccaguacaggucucucauuuc

SEQ ID NO: 168608 - RNA, 22 nt, Homo sapiens
uccaguguuucuuccacuauuu

SEQ ID NO: 168609 - RNA, 22 nt, Homo sapiens
uccauaguugcacucuggagcc

SEQ ID NO: 168610 - RNA, 19 nt, Homo sapiens
ucccaagaugcucauacau

SEQ ID NO: 168611 - RNA, 19 nt, Homo sapiens
ucccaauguuuccaggcag

SEQ ID NO: 168612 - RNA, 22 nt, Homo sapiens
ucccaguauucauuuacagaag

SEQ ID NO: 168613 - RNA, 22 nt, Homo sapiens
ucccagugcuaugcaaaagccu

SEQ ID NO: 168614 - RNA, 22 nt, Homo sapiens
ucccaguggucuugaaacaggg

SEQ ID NO: 168615 - RNA, 22 nt, Homo sapiens
ucccaguuuuucugaauaguca

SEQ ID NO: 168616 - RNA, 17 nt, Homo sapiens
ucccauguuucuucuac

SEQ ID NO: 168617 - RNA, 20 nt, Homo sapiens
ucccuaagagccuuuccuuc

SEQ ID NO: 168618 - RNA, 22 nt, Homo sapiens
ucccuagacuccugccuuucag

SEQ ID NO: 168619 - RNA, 22 nt, Homo sapiens
ucccugaagcugcagcaacaca

SEQ ID NO: 168620 - RNA, 22 nt, Homo sapiens
ucccugagugauugaaaauaaa

SEQ ID NO: 168621 - RNA, 22 nt, Homo sapiens
ucccuggacagccuugccuggg

SEQ ID NO: 168622 - RNA, 22 nt, Homo sapiens
ucccuguuaggcacagauuuau

SEQ ID NO: 168623 - RNA, 19 nt, Homo sapiens
ucccuuuguauggacauac

SEQ ID NO: 168624 - RNA, 22 nt, Homo sapiens
ucccuuuguccaacggauccac

SEQ ID NO: 168625 - RNA, 22 nt, Homo sapiens
uccucugaacuccagacccaua

SEQ ID NO: 168626 - RNA, 22 nt, Homo sapiens
uccugagaauagaguugcaugu

SEQ ID NO: 168627 - RNA, 22 nt, Homo sapiens
uccuugagaggacagagccaua

SEQ ID NO: 168628 - RNA, 22 nt, Homo sapiens
ucgcagcucacuggagccucga

SEQ ID NO: 168629 - RNA, 22 nt, Homo sapiens
ucgcgccauucuccugccucag

SEQ ID NO: 168630 - RNA, 22 nt, Homo sapiens
ucgugcaaacguaauugugguu

SEQ ID NO: 168631 - RNA, 22 nt, Homo sapiens
ucguggccugugaguccucccc

SEQ ID NO: 168632 - RNA, 22 nt, Homo sapiens
ucuaaguaguagcuggucagaa

SEQ ID NO: 168633 - RNA, 17 nt, Homo sapiens
ucuaauaauaugcauuu

SEQ ID NO: 168634 - RNA, 22 nt, Homo sapiens
ucucaauuugauuacauucaua

SEQ ID NO: 168635 - RNA, 22 nt, Homo sapiens
ucucagugaauguggaaaaagc

SEQ ID NO: 168636 - RNA, 21 nt, Homo sapiens
ucucauagaguuucacuuucu

SEQ ID NO: 168637 - RNA, 22 nt, Homo sapiens
ucucauggagucaggagcagaa

SEQ ID NO: 168638 - RNA, 22 nt, Homo sapiens
ucucccauccguacacggauug

SEQ ID NO: 168639 - RNA, 22 nt, Homo sapiens
ucuccggguggcggcgaaggga

SEQ ID NO: 168640 - RNA, 22 nt, Homo sapiens
ucucugauuaaacaagauagug

SEQ ID NO: 168641 - RNA, 22 nt, Homo sapiens
ucucuguuuagagccagcaauu

SEQ ID NO: 168642 - RNA, 22 nt, Homo sapiens
ucugacucugugaugggcccaa

SEQ ID NO: 168643 - RNA, 22 nt, Homo sapiens
ucugagcaauaaacaacauauu

SEQ ID NO: 168644 - RNA, 22 nt, Homo sapiens
ucugagguuacugcuuuguaga

SEQ ID NO: 168645 - RNA, 21 nt, Homo sapiens
ucugagucauucaguggccug

SEQ ID NO: 168646 - RNA, 20 nt, Homo sapiens
ucuggccccucuaaaucuca

SEQ ID NO: 168647 - RNA, 22 nt, Homo sapiens
ucuggguuuuuacaauguuuac

SEQ ID NO: 168648 - RNA, 22 nt, Homo sapiens
ucugguguuacugagccuccca

SEQ ID NO: 168649 - RNA, 22 nt, Homo sapiens
ucuguacuccuugaguagugcu

SEQ ID NO: 168650 - RNA, 22 nt, Homo sapiens
ucugucuugugguuugagugcc

SEQ ID NO: 168651 - RNA, 22 nt, Homo sapiens
ucugucuuugccuaaguuuguc

SEQ ID NO: 168652 - RNA, 22 nt, Homo sapiens
ucugucuuugucaggaccagag

SEQ ID NO: 168653 - RNA, 22 nt, Homo sapiens
ucuuggacuuuugugagaaauc

SEQ ID NO: 168654 - RNA, 22 nt, Homo sapiens
ucuuggcaaagaauuuuuggcu

SEQ ID NO: 168655 - RNA, 22 nt, Homo sapiens
ucuuuaguuaagggacauuuua

SEQ ID NO: 168656 - RNA, 19 nt, Homo sapiens
ucuuugaggcaucgcccuc

SEQ ID NO: 168657 - RNA, 22 nt, Homo sapiens
ucuuugauuaugcagauggguu

SEQ ID NO: 168658 - RNA, 22 nt, Homo sapiens
ucuuuggaggcgaucuguuuga

SEQ ID NO: 168659 - RNA, 22 nt, Homo sapiens
ucuuuggucaucaugggaagca

SEQ ID NO: 168660 - RNA, 22 nt, Homo sapiens
ucuuugguuucugucucuguaa

SEQ ID NO: 168661 - RNA, 22 nt, Homo sapiens
ucuuuguuagaacccucuccuu

SEQ ID NO: 168662 - RNA, 22 nt, Homo sapiens
ucuuuguucaggagccaacucc

SEQ ID NO: 168663 - RNA, 22 nt, Homo sapiens
ucuuuguuuucugauccugaag

SEQ ID NO: 168664 - RNA, 22 nt, Homo sapiens
ucuuuuggguauggagccauca

SEQ ID NO: 168665 - RNA, 22 nt, Homo sapiens
ugaaacacacagagaagggaga

SEQ ID NO: 168666 - RNA, 22 nt, Homo sapiens
ugaaacacaccuccucuccauc

SEQ ID NO: 168667 - RNA, 22 nt, Homo sapiens
ugaaagacacagaaguugccca

SEQ ID NO: 168668 - RNA, 22 nt, Homo sapiens
ugaaaguuauauugugaaauuc

SEQ ID NO: 168669 - RNA, 22 nt, Homo sapiens
ugaaauacuuaauuucuccaug

SEQ ID NO: 168670 - RNA, 22 nt, Homo sapiens
ugaaaucauguaguuauugcaa

SEQ ID NO: 168671 - RNA, 21 nt, Homo sapiens
ugaaaugcaugugcacauuaa

SEQ ID NO: 168672 - RNA, 22 nt, Homo sapiens
ugaaauguaaguugucuagucu

SEQ ID NO: 168673 - RNA, 22 nt, Homo sapiens
ugaacagcaccuccuagaguug

SEQ ID NO: 168674 - RNA, 22 nt, Homo sapiens
ugaaggcaggagggagaaaagu

SEQ ID NO: 168675 - RNA, 22 nt, Homo sapiens
ugaagugggaaaugaguauuaa

SEQ ID NO: 168676 - RNA, 22 nt, Homo sapiens
ugaaguguuuuuucaggcaugu

SEQ ID NO: 168677 - RNA, 22 nt, Homo sapiens
ugaauagacacuaaagacugua

SEQ ID NO: 168678 - RNA, 22 nt, Homo sapiens
ugaaugcaucauguagggcuca

SEQ ID NO: 168679 - RNA, 22 nt, Homo sapiens
ugaauguaagaugucugcuggu

SEQ ID NO: 168680 - RNA, 22 nt, Homo sapiens
ugaauguuguugguugagauau

SEQ ID NO: 168681 - RNA, 22 nt, Homo sapiens
ugacaagaacuuuccauaguaa

SEQ ID NO: 168682 - RNA, 22 nt, Homo sapiens
ugacaagaguagagagggugcc

SEQ ID NO: 168683 - RNA, 22 nt, Homo sapiens
ugacacagugggggauccuuuu

SEQ ID NO: 168684 - RNA, 22 nt, Homo sapiens
ugacagaggucuuuuaauagcu

SEQ ID NO: 168685 - RNA, 22 nt, Homo sapiens
ugacagguugauaggugcagca

SEQ ID NO: 168686 - RNA, 22 nt, Homo sapiens
ugacagugaacagguuaccacu

SEQ ID NO: 168687 - RNA, 22 nt, Homo sapiens
ugacaguguccuccuccugaga

SEQ ID NO: 168688 - RNA, 22 nt, Homo sapiens
ugacagugugagacuuugucuc

SEQ ID NO: 168689 - RNA, 20 nt, Homo sapiens
ugacaguuaagggauagaag

SEQ ID NO: 168690 - RNA, 18 nt, Homo sapiens
ugacaguuucuuuauauu

SEQ ID NO: 168691 - RNA, 18 nt, Homo sapiens
ugacaucauuuagaaagg

SEQ ID NO: 168692 - RNA, 22 nt, Homo sapiens
ugacauggagggugcggcugca

SEQ ID NO: 168693 - RNA, 22 nt, Homo sapiens
ugacauguauaucuuacgcuau

SEQ ID NO: 168694 - RNA, 22 nt, Homo sapiens
ugacauguccaggugguccugu

SEQ ID NO: 168695 - RNA, 21 nt, Homo sapiens
ugacauguugguuugcugcac

SEQ ID NO: 168696 - RNA, 22 nt, Homo sapiens
ugaccacugucuaagauaggug

SEQ ID NO: 168697 - RNA, 22 nt, Homo sapiens
ugacggaggcauuggaagcuug

SEQ ID NO: 168698 - RNA, 22 nt, Homo sapiens
ugacuaaaacugaguuucauua

SEQ ID NO: 168699 - RNA, 22 nt, Homo sapiens
ugacuacagauuugcugccaga

SEQ ID NO: 168700 - RNA, 22 nt, Homo sapiens
ugacuacauaaguaaucucaaa

SEQ ID NO: 168701 - RNA, 21 nt, Homo sapiens
ugacuagauuccagauuggcc

SEQ ID NO: 168702 - RNA, 22 nt, Homo sapiens
ugacucagauagguguguauuc

SEQ ID NO: 168703 - RNA, 22 nt, Homo sapiens
ugacucaguuucucagguagua

SEQ ID NO: 168704 - RNA, 22 nt, Homo sapiens
ugacuggagaccucaguagggu

SEQ ID NO: 168705 - RNA, 18 nt, Homo sapiens
ugacuguccagguggacc

SEQ ID NO: 168706 - RNA, 22 nt, Homo sapiens
ugacuuaugcaacucugaugug

SEQ ID NO: 168707 - RNA, 21 nt, Homo sapiens
ugagaacaacaggucaagcag

SEQ ID NO: 168708 - RNA, 22 nt, Homo sapiens
ugagaaugacugggcaugcugc

SEQ ID NO: 168709 - RNA, 22 nt, Homo sapiens
ugagacacuucccagaucccuu

SEQ ID NO: 168710 - RNA, 22 nt, Homo sapiens
ugagaccugaucuugguacugc

SEQ ID NO: 168711 - RNA, 22 nt, Homo sapiens
ugagacugagucucgcucuauu

SEQ ID NO: 168712 - RNA, 22 nt, Homo sapiens
ugagacugagucucgcucuugu

SEQ ID NO: 168713 - RNA, 22 nt, Homo sapiens
ugagacugagucuugcucuauu

SEQ ID NO: 168714 - RNA, 22 nt, Homo sapiens
ugagacugaguuucgcucuugu

SEQ ID NO: 168715 - RNA, 22 nt, Homo sapiens
ugagacugaguuuugcucuugu

SEQ ID NO: 168716 - RNA, 19 nt, Homo sapiens
ugagagcacaacugaacaa

SEQ ID NO: 168717 - RNA, 22 nt, Homo sapiens
ugagagcugcauucuugaaagc

SEQ ID NO: 168718 - RNA, 18 nt, Homo sapiens
ugagauacuagaauaggu

SEQ ID NO: 168719 - RNA, 22 nt, Homo sapiens
ugagaucaaggugggcccuggg

SEQ ID NO: 168720 - RNA, 22 nt, Homo sapiens
ugagaucaagguuaauauaauc

SEQ ID NO: 168721 - RNA, 22 nt, Homo sapiens
ugagaucugauaggccuggguu

SEQ ID NO: 168722 - RNA, 22 nt, Homo sapiens
ugagaugagggcugcacucaaa

SEQ ID NO: 168723 - RNA, 22 nt, Homo sapiens
ugagaugaggucucacucuguu

SEQ ID NO: 168724 - RNA, 22 nt, Homo sapiens
ugagauggguaauuaaauggug

SEQ ID NO: 168725 - RNA, 22 nt, Homo sapiens
ugagauguguccagaucuaguu

SEQ ID NO: 168726 - RNA, 21 nt, Homo sapiens
ugagauuaaguuguuuagaag

SEQ ID NO: 168727 - RNA, 19 nt, Homo sapiens
ugagauuguaugaggagau

SEQ ID NO: 168728 - RNA, 22 nt, Homo sapiens
ugagauuguucuaugucugguu

SEQ ID NO: 168729 - RNA, 22 nt, Homo sapiens
ugagcagaaagcugcaaggucg

SEQ ID NO: 168730 - RNA, 22 nt, Homo sapiens
ugagcagaaguuuugauuggcg

SEQ ID NO: 168731 - RNA, 22 nt, Homo sapiens
ugagcagugaguguggugcagg

SEQ ID NO: 168732 - RNA, 22 nt, Homo sapiens
ugagcucagcuaguugaggugu

SEQ ID NO: 168733 - RNA, 18 nt, Homo sapiens
ugaggaaaggguuugcua

SEQ ID NO: 168734 - RNA, 22 nt, Homo sapiens
ugaggaguauguucuguagacc

SEQ ID NO: 168735 - RNA, 22 nt, Homo sapiens
ugaggcaagauacugauuucau

SEQ ID NO: 168736 - RNA, 22 nt, Homo sapiens
ugagguagaaugauucuaauau

SEQ ID NO: 168737 - RNA, 22 nt, Homo sapiens
ugagguaugacuuauuauucuu

SEQ ID NO: 168738 - RNA, 22 nt, Homo sapiens
ugagguaugugaugucuuuuag

SEQ ID NO: 168739 - RNA, 22 nt, Homo sapiens
ugaggugagggguuaggugcua

SEQ ID NO: 168740 - RNA, 23 nt, Homo sapiens
ugaguaggugguuuuccccucac

SEQ ID NO: 168741 - RNA, 22 nt, Homo sapiens
ugagucauguaauaaugcugcu

SEQ ID NO: 168742 - RNA, 22 nt, Homo sapiens
ugagucgagauugcgccacugu

SEQ ID NO: 168743 - RNA, 22 nt, Homo sapiens
ugagugagguucuacucuguga

SEQ ID NO: 168744 - RNA, 22 nt, Homo sapiens
ugaguuagguaauaauaaauau

SEQ ID NO: 168745 - RNA, 22 nt, Homo sapiens
ugaguucaauguuaaugaagca

SEQ ID NO: 168746 - RNA, 18 nt, Homo sapiens
ugaguucauuagacuucc

SEQ ID NO: 168747 - RNA, 22 nt, Homo sapiens
ugaguuccuugugugaccuugc

SEQ ID NO: 168748 - RNA, 22 nt, Homo sapiens
ugaguucuuccuaucucugccu

SEQ ID NO: 168749 - RNA, 22 nt, Homo sapiens
ugauaagaaauuguucauguag

SEQ ID NO: 168750 - RNA, 22 nt, Homo sapiens
ugauaucucuugccuccaaaug

SEQ ID NO: 168751 - RNA, 22 nt, Homo sapiens
ugauauguaugugaccuagaaa

SEQ ID NO: 168752 - RNA, 22 nt, Homo sapiens
ugaucugucacuuaucacauuu

SEQ ID NO: 168753 - RNA, 22 nt, Homo sapiens
ugaucugucucggguuaucagu

SEQ ID NO: 168754 - RNA, 22 nt, Homo sapiens
ugaucuuuuuaauguccauggg

SEQ ID NO: 168755 - RNA, 22 nt, Homo sapiens
ugaugaaguauaggaagggcuu

SEQ ID NO: 168756 - RNA, 22 nt, Homo sapiens
ugaugacauugucacagucuga

SEQ ID NO: 168757 - RNA, 22 nt, Homo sapiens
ugcaaagucgaaacugcaguuu

SEQ ID NO: 168758 - RNA, 22 nt, Homo sapiens
ugcaaaugcugcuauuucucuu

SEQ ID NO: 168759 - RNA, 19 nt, Homo sapiens
ugcaaauucuaaaaacuga

SEQ ID NO: 168760 - RNA, 22 nt, Homo sapiens
ugcaagaaucagccuaucauua

SEQ ID NO: 168761 - RNA, 22 nt, Homo sapiens
ugcaagaggagacuguacucag

SEQ ID NO: 168762 - RNA, 22 nt, Homo sapiens
ugcaauagcuucaggagaaggg

SEQ ID NO: 168763 - RNA, 22 nt, Homo sapiens
ugcaaucauuuggaggagaaga

SEQ ID NO: 168764 - RNA, 22 nt, Homo sapiens
ugcaaugucuucugaggggagc

SEQ ID NO: 168765 - RNA, 22 nt, Homo sapiens
ugcaccacugcacuccaggcug

SEQ ID NO: 168766 - RNA, 18 nt, Homo sapiens
ugcaccaguuuacacuuc

SEQ ID NO: 168767 - RNA, 22 nt, Homo sapiens
ugcaccaucuugcuucuguggu

SEQ ID NO: 168768 - RNA, 22 nt, Homo sapiens
ugcagagaaacauuuuguauuu

SEQ ID NO: 168769 - RNA, 22 nt, Homo sapiens
ugcagagucuguccugccugcc

SEQ ID NO: 168770 - RNA, 17 nt, Homo sapiens
ugcagcacacugauggg

SEQ ID NO: 168771 - RNA, 22 nt, Homo sapiens
ugcagcucaaauuccuaacaag

SEQ ID NO: 168772 - RNA, 22 nt, Homo sapiens
ugcaguacugucagacuucuua

SEQ ID NO: 168773 - RNA, 22 nt, Homo sapiens
ugcauacacaagcauacaugua

SEQ ID NO: 168774 - RNA, 21 nt, Homo sapiens
ugcauacuucucagaugauua

SEQ ID NO: 168775 - RNA, 21 nt, Homo sapiens
ugcauaucucuaaugaccagu

SEQ ID NO: 168776 - RNA, 22 nt, Homo sapiens
ugcauauguugaaccagccuug

SEQ ID NO: 168777 - RNA, 22 nt, Homo sapiens
ugcauggauguuugaacacacu

SEQ ID NO: 168778 - RNA, 22 nt, Homo sapiens
ugcauguucuuacucauacaug

SEQ ID NO: 168779 - RNA, 22 nt, Homo sapiens
ugcauuaucagauguuugcuuu

SEQ ID NO: 168780 - RNA, 22 nt, Homo sapiens
ugcauuguuccgaauguguccu

SEQ ID NO: 168781 - RNA, 22 nt, Homo sapiens
ugccagaugugcccucuccacc

SEQ ID NO: 168782 - RNA, 22 nt, Homo sapiens
ugccaggaugaggucaauguuu

SEQ ID NO: 168783 - RNA, 22 nt, Homo sapiens
ugccaguauuuuauugaagauu

SEQ ID NO: 168784 - RNA, 22 nt, Homo sapiens
ugccuaguagaaggugaacaug

SEQ ID NO: 168785 - RNA, 22 nt, Homo sapiens
ugccuaguggaaggagagcaaa

SEQ ID NO: 168786 - RNA, 16 nt, Homo sapiens
ugccuuauuccagcuc

SEQ ID NO: 168787 - RNA, 16 nt, Homo sapiens
ugccuucuucuguauu

SEQ ID NO: 168788 - RNA, 22 nt, Homo sapiens
ugcuaugucuucucucacagag

SEQ ID NO: 168789 - RNA, 23 nt, Homo sapiens
ugcugagaccuagauccuaaaga

SEQ ID NO: 168790 - RNA, 22 nt, Homo sapiens
ugcugaguguuaccggacaccg

SEQ ID NO: 168791 - RNA, 22 nt, Homo sapiens
ugcugguaguuuaugacuaauu

SEQ ID NO: 168792 - RNA, 22 nt, Homo sapiens
uggaaaauuaggggagguuaua

SEQ ID NO: 168793 - RNA, 20 nt, Homo sapiens
uggaaaguaagucaugauau

SEQ ID NO: 168794 - RNA, 22 nt, Homo sapiens
uggaagacaggcuguauuuuaa

SEQ ID NO: 168795 - RNA, 22 nt, Homo sapiens
uggaagacucuagucucuugag

SEQ ID NO: 168796 - RNA, 22 nt, Homo sapiens
uggaagucauugagguguguua

SEQ ID NO: 168797 - RNA, 21 nt, Homo sapiens
uggaaucuauuauuccaguuu

SEQ ID NO: 168798 - RNA, 22 nt, Homo sapiens
uggaaucuuaggugaaggcuuu

SEQ ID NO: 168799 - RNA, 22 nt, Homo sapiens
uggaaugggauuggaaauuuug

SEQ ID NO: 168800 - RNA, 22 nt, Homo sapiens
uggaaugguaucuuguuggggu

SEQ ID NO: 168801 - RNA, 22 nt, Homo sapiens
uggaauguggacucuuaugggg

SEQ ID NO: 168802 - RNA, 21 nt, Homo sapiens
uggaauuaauggagagguguu

SEQ ID NO: 168803 - RNA, 22 nt, Homo sapiens
uggacaagugcccuccaccuca

SEQ ID NO: 168804 - RNA, 22 nt, Homo sapiens
uggacagacaagguuauagauc

SEQ ID NO: 168805 - RNA, 22 nt, Homo sapiens
uggacaugaagggcacaggagg

SEQ ID NO: 168806 - RNA, 21 nt, Homo sapiens
uggaccccuuccagucaucau

SEQ ID NO: 168807 - RNA, 22 nt, Homo sapiens
uggagaacugaugucuccaaga

SEQ ID NO: 168808 - RNA, 22 nt, Homo sapiens
uggagacaaagauagaaaagca

SEQ ID NO: 168809 - RNA, 20 nt, Homo sapiens
uggaggucaucugucacuac

SEQ ID NO: 168810 - RNA, 22 nt, Homo sapiens
uggagucgugcccuugcauuua

SEQ ID NO: 168811 - RNA, 21 nt, Homo sapiens
uggagugaagaguuuauugac

SEQ ID NO: 168812 - RNA, 22 nt, Homo sapiens
uggagugagaacuucaaugaug

SEQ ID NO: 168813 - RNA, 22 nt, Homo sapiens
uggaguguaauuagccaucagu

SEQ ID NO: 168814 - RNA, 20 nt, Homo sapiens
uggaguuguggcaguuugga

SEQ ID NO: 168815 - RNA, 18 nt, Homo sapiens
uggauuggaaaaguuccu

SEQ ID NO: 168816 - RNA, 22 nt, Homo sapiens
uggcaaaaaaccgcaguugccu

SEQ ID NO: 168817 - RNA, 22 nt, Homo sapiens
uggcaaaauggaauauguuggg

SEQ ID NO: 168818 - RNA, 22 nt, Homo sapiens
uggcaaaugugagaugagaacu

SEQ ID NO: 168819 - RNA, 22 nt, Homo sapiens
uggcaacaucuggggacauguu

SEQ ID NO: 168820 - RNA, 22 nt, Homo sapiens
uggcaacuugcaaccucauucu

SEQ ID NO: 168821 - RNA, 22 nt, Homo sapiens
uggcaagaaggauuuauuccuu

SEQ ID NO: 168822 - RNA, 22 nt, Homo sapiens
uggcaagagauaugugucuaua

SEQ ID NO: 168823 - RNA, 22 nt, Homo sapiens
uggcaagagcugcauucaucug

SEQ ID NO: 168824 - RNA, 20 nt, Homo sapiens
uggcaagugggaauuguggg

SEQ ID NO: 168825 - RNA, 18 nt, Homo sapiens
uggcaaguuuaguagcac

SEQ ID NO: 168826 - RNA, 22 nt, Homo sapiens
uggcaaguuucaauccgaggga

SEQ ID NO: 168827 - RNA, 18 nt, Homo sapiens
uggcaauaugguucuacc

SEQ ID NO: 168828 - RNA, 19 nt, Homo sapiens
uggcaaugucagcagagau

SEQ ID NO: 168829 - RNA, 22 nt, Homo sapiens
uggcaauguggaaugguccagg

SEQ ID NO: 168830 - RNA, 22 nt, Homo sapiens
uggcagcgugaauguggcugaa

SEQ ID NO: 168831 - RNA, 22 nt, Homo sapiens
uggcaggugcacuggcuuugaa

SEQ ID NO: 168832 - RNA, 22 nt, Homo sapiens
uggcaguuuuaugugguucaac

SEQ ID NO: 168833 - RNA, 22 nt, Homo sapiens
uggcauggaaagcuuuucauac

SEQ ID NO: 168834 - RNA, 22 nt, Homo sapiens
uggcaugggguaguagcgcugg

SEQ ID NO: 168835 - RNA, 21 nt, Homo sapiens
uucucaggguguguccuaccc

SEQ ID NO: 168836 - RNA, 22 nt, Homo sapiens
uucucaguuccuacuuugguga

SEQ ID NO: 168837 - RNA, 17 nt, Homo sapiens
uucucaguucugaucuc

SEQ ID NO: 168838 - RNA, 22 nt, Homo sapiens
uucugaguggcuuucaacacug

SEQ ID NO: 168839 - RNA, 22 nt, Homo sapiens
uucuggccccucccaaucucau

SEQ ID NO: 168840 - RNA, 22 nt, Homo sapiens
uucugguuaauacuugcaaaaa

SEQ ID NO: 168841 - RNA, 22 nt, Homo sapiens
uucuuccagccuugaggggccc

SEQ ID NO: 168842 - RNA, 18 nt, Homo sapiens
uucuuguguugauauuuu

SEQ ID NO: 168843 - RNA, 21 nt, Homo sapiens
uucuuugcucaguguuagagu

SEQ ID NO: 168844 - RNA, 22 nt, Homo sapiens
uucuuuggauaaaguuuuaugc

SEQ ID NO: 168845 - RNA, 22 nt, Homo sapiens
augauaugagaaaggaucaaca

SEQ ID NO: 168846 - RNA, 22 nt, Homo sapiens
augaucacaccacugcacucca

SEQ ID NO: 168847 - RNA, 22 nt, Homo sapiens
augauguguguuuaagaugucu

SEQ ID NO: 168848 - RNA, 22 nt, Homo sapiens
augauucugaucuagagcuugg

SEQ ID NO: 168849 - RNA, 22 nt, Homo sapiens
augcaaaucuuaaguaugugug

SEQ ID NO: 168850 - RNA, 22 nt, Homo sapiens
augcaagacaccacgugagaau

SEQ ID NO: 168851 - RNA, 22 nt, Homo sapiens
augcaaggaugguuagauauau

SEQ ID NO: 168852 - RNA, 22 nt, Homo sapiens
augcaauucuagauugauagua

SEQ ID NO: 168853 - RNA, 22 nt, Homo sapiens
augcacaguccagcccaugugg

SEQ ID NO: 168854 - RNA, 22 nt, Homo sapiens
augcagagaaaucuaaaauaug

SEQ ID NO: 168855 - RNA, 22 nt, Homo sapiens
augcagagucccagccccuagc

SEQ ID NO: 168856 - RNA, 22 nt, Homo sapiens
augcagauauuuuugugguugc

SEQ ID NO: 168857 - RNA, 18 nt, Homo sapiens
augcauauuuuaaguugu

SEQ ID NO: 168858 - RNA, 22 nt, Homo sapiens
augcauggcagagucaggguac

SEQ ID NO: 168859 - RNA, 20 nt, Homo sapiens
augccacugagcagugguga

SEQ ID NO: 168860 - RNA, 22 nt, Homo sapiens
augccacugcacucuagccugg

SEQ ID NO: 168861 - RNA, 22 nt, Homo sapiens
augccacugcgcucuagccugg

SEQ ID NO: 168862 - RNA, 22 nt, Homo sapiens
augccacuguacucuagccuag

SEQ ID NO: 168863 - RNA, 22 nt, Homo sapiens
augccuagagucaguggaggug

SEQ ID NO: 168864 - RNA, 22 nt, Homo sapiens
augcuacuggacaauggugacu

SEQ ID NO: 168865 - RNA, 22 nt, Homo sapiens
augcuacuggauuuguauaaau

SEQ ID NO: 168866 - RNA, 22 nt, Homo sapiens
augcuggugguucacaugcgca

SEQ ID NO: 168867 - RNA, 22 nt, Homo sapiens
auggaaacauaagaguauagau

SEQ ID NO: 168868 - RNA, 22 nt, Homo sapiens
auggaaugccauuuauaaugga

SEQ ID NO: 168869 - RNA, 22 nt, Homo sapiens
auggaggaggaagcugaaacaa

SEQ ID NO: 168870 - RNA, 22 nt, Homo sapiens
auggaguguucugaauccuuug

SEQ ID NO: 168871 - RNA, 22 nt, Homo sapiens
auggcaauguaagucagaaaaa

SEQ ID NO: 168872 - RNA, 22 nt, Homo sapiens
auggcacagaguagaugcucaa

SEQ ID NO: 168873 - RNA, 22 nt, Homo sapiens
auggcacuaaguucaacacuua

SEQ ID NO: 168874 - RNA, 22 nt, Homo sapiens
auggcacucaaucaaguugaga

SEQ ID NO: 168875 - RNA, 22 nt, Homo sapiens
auggcacuccagccugggcaac

SEQ ID NO: 168876 - RNA, 22 nt, Homo sapiens
auggcagcaccccacucuacug

SEQ ID NO: 168877 - RNA, 22 nt, Homo sapiens
auggcagugagucucuaguauu

SEQ ID NO: 168878 - RNA, 22 nt, Homo sapiens
auggcaguuuauucuaaaucaa

SEQ ID NO: 168879 - RNA, 22 nt, Homo sapiens
auggcccaguuugcuaucccua

SEQ ID NO: 168880 - RNA, 22 nt, Homo sapiens
auggcccccuguuugugaacau

SEQ ID NO: 168881 - RNA, 22 nt, Homo sapiens
auggccugaugcaccuguccca

SEQ ID NO: 168882 - RNA, 22 nt, Homo sapiens
auggccuuguauaccuggcaaa

SEQ ID NO: 168883 - RNA, 22 nt, Homo sapiens
auggccuuucuggcacauuucc

SEQ ID NO: 168884 - RNA, 22 nt, Homo sapiens
auuguaguuugcuauggcaaua

SEQ ID NO: 168885 - RNA, 22 nt, Homo sapiens
auugucacuuaaaagugcaugu

SEQ ID NO: 168886 - RNA, 22 nt, Homo sapiens
auuguguagucuuacugcuugc

SEQ ID NO: 168887 - RNA, 22 nt, Homo sapiens
auuguuccccggucauuuuugu

SEQ ID NO: 168888 - RNA, 15 nt, Homo sapiens
auuucacuuagcaug

SEQ ID NO: 168889 - RNA, 19 nt, Homo sapiens
auuuccuggagcuggucuc

SEQ ID NO: 168890 - RNA, 22 nt, Homo sapiens
auuuccuguaggggcuugcgaa

SEQ ID NO: 168891 - RNA, 22 nt, Homo sapiens
auuuggcaguauaaugcuuugg

SEQ ID NO: 168892 - RNA, 22 nt, Homo sapiens
auuuggcagugaagggaucaca

SEQ ID NO: 168893 - RNA, 22 nt, Homo sapiens
auuuggguaaugagugcaaggg

SEQ ID NO: 168894 - RNA, 21 nt, Homo sapiens
auuugguguuagaaauaaauu

SEQ ID NO: 168895 - RNA, 22 nt, Homo sapiens
auuugucacuauguggcuaaua

SEQ ID NO: 168896 - RNA, 22 nt, Homo sapiens
caaauacuuucauguugucuug

SEQ ID NO: 168897 - RNA, 22 nt, Homo sapiens
caacaguaaagcauuuuuaagu

SEQ ID NO: 168898 - RNA, 22 nt, Homo sapiens
caaggugcugagacaggagccc

SEQ ID NO: 168899 - RNA, 22 nt, Homo sapiens
caagugcuugaugaaugaucaa

SEQ ID NO: 168900 - RNA, 22 nt, Homo sapiens
caaguguuggcuuguauacaaa

SEQ ID NO: 168901 - RNA, 22 nt, Homo sapiens
caaguguuuccuuaaauacuug

SEQ ID NO: 168902 - RNA, 22 nt, Homo sapiens
caauacuguuaccugaaauagg

SEQ ID NO: 168903 - RNA, 22 nt, Homo sapiens
caaugcagcuuuuggagagaaa

SEQ ID NO: 168904 - RNA, 22 nt, Homo sapiens
cacacugucuucaauggguggu

SEQ ID NO: 168905 - RNA, 22 nt, Homo sapiens
cacacugucuucauuacuguag

SEQ ID NO: 168906 - RNA, 22 nt, Homo sapiens
cacaguagaauagagcacuagg

SEQ ID NO: 168907 - RNA, 22 nt, Homo sapiens
cacauguuuuagcauggcuguu

SEQ ID NO: 168908 - RNA, 22 nt, Homo sapiens
caccauguguucagaaggauug

SEQ ID NO: 168909 - RNA, 19 nt, Homo sapiens
caccgccugcccccugcug

SEQ ID NO: 168910 - RNA, 22 nt, Homo sapiens
caccuguacauggcaguguccu

SEQ ID NO: 168911 - RNA, 18 nt, Homo sapiens
cacugagcccuucacucu

SEQ ID NO: 168912 - RNA, 22 nt, Homo sapiens
cacugcacuccagucugacgac

SEQ ID NO: 168913 - RNA, 21 nt, Homo sapiens
cacugcaucacaggacagcau

SEQ ID NO: 168914 - RNA, 22 nt, Homo sapiens
cacugcauccuccaccuccugg

SEQ ID NO: 168915 - RNA, 22 nt, Homo sapiens
cacugcauccuccaccugccag

SEQ ID NO: 168916 - RNA, 22 nt, Homo sapiens
cacugcauuacucaugagcaug

SEQ ID NO: 168917 - RNA, 22 nt, Homo sapiens
cacugcauucuccaccucccag

SEQ ID NO: 168918 - RNA, 22 nt, Homo sapiens
cacugcauuggaugguuccucc

SEQ ID NO: 168919 - RNA, 22 nt, Homo sapiens
uucccuuuguuaaauuggaaga

SEQ ID NO: 168920 - RNA, 22 nt, Homo sapiens
uuccugugacuguguggcaccc

SEQ ID NO: 168921 - RNA, 22 nt, Homo sapiens
uuccuuguuuauuuacaggagg

SEQ ID NO: 168922 - RNA, 21 nt, Homo sapiens
uucggcaauaugaaccaaugu

SEQ ID NO: 168923 - RNA, 22 nt, Homo sapiens
uucuaaacaucuuacaaugcau

SEQ ID NO: 168924 - RNA, 22 nt, Homo sapiens
uucuauguuugaaaaugccaaa

SEQ ID NO: 168925 - RNA, 22 nt, Homo sapiens
uucucauggaacaucuguacug

SEQ ID NO: 168926 - RNA, 19 nt, Homo sapiens
uucucugguuguacuaccc

SEQ ID NO: 168927 - RNA, 22 nt, Homo sapiens
uucugagguuauauucucucaa

SEQ ID NO: 168928 - RNA, 23 nt, Homo sapiens
uucugccacugaaaaugccucag

SEQ ID NO: 168929 - RNA, 22 nt, Homo sapiens
uucuguguuuaggucacggcua

SEQ ID NO: 168930 - RNA, 22 nt, Homo sapiens
uucuuagucauguaauagucca

SEQ ID NO: 168931 - RNA, 22 nt, Homo sapiens
uucuucaggccacaaaaauggu

SEQ ID NO: 168932 - RNA, 22 nt, Homo sapiens
uucuucugguuaugaaauuuga

SEQ ID NO: 168933 - RNA, 22 nt, Homo sapiens
uucuuugcaugaucucaaaguc

SEQ ID NO: 168934 - RNA, 22 nt, Homo sapiens
uucuuugcuuggaagcggggga

SEQ ID NO: 168935 - RNA, 22 nt, Homo sapiens
uugaacugguaguuggaaaucu

SEQ ID NO: 168936 - RNA, 22 nt, Homo sapiens
uugaagacuaccuaccauacuu

SEQ ID NO: 168937 - RNA, 19 nt, Homo sapiens
uugaaggccgccuugcaga

SEQ ID NO: 168938 - RNA, 22 nt, Homo sapiens
uugaaguauagaguuuaagaac

SEQ ID NO: 168939 - RNA, 22 nt, Homo sapiens
uugaaguguguauacauugugg

SEQ ID NO: 168940 - RNA, 22 nt, Homo sapiens
uugaaugaaaugaugucauuug

SEQ ID NO: 168941 - RNA, 22 nt, Homo sapiens
uugacacuuuguaagaaagggg

SEQ ID NO: 168942 - RNA, 22 nt, Homo sapiens
uugacauaguuucugaaauaga

SEQ ID NO: 168943 - RNA, 22 nt, Homo sapiens
uugacugugguaauggaagcug

SEQ ID NO: 168944 - RNA, 22 nt, Homo sapiens
uugagaaucuuucgaauguucu

SEQ ID NO: 168945 - RNA, 22 nt, Homo sapiens
uugagacugaacauuuguguac

SEQ ID NO: 168946 - RNA, 22 nt, Homo sapiens
uugagauacauaauuaugaaug

SEQ ID NO: 168947 - RNA, 22 nt, Homo sapiens
uugagauauccauaaaugggaa

SEQ ID NO: 168948 - RNA, 22 nt, Homo sapiens
uugagaucaugcuacugcacuc

SEQ ID NO: 168949 - RNA, 22 nt, Homo sapiens
uugagauggagucucacucuug

SEQ ID NO: 168950 - RNA, 22 nt, Homo sapiens
uugagauggagucucacugugu

SEQ ID NO: 168951 - RNA, 22 nt, Homo sapiens
uugagauggagucucgcacugu

SEQ ID NO: 168952 - RNA, 22 nt, Homo sapiens
uugagauggagucucgcucuuu

SEQ ID NO: 168953 - RNA, 22 nt, Homo sapiens
uugagauggaguuucacucucg

SEQ ID NO: 168954 - RNA, 22 nt, Homo sapiens
uugagauggaguuucacucugu

SEQ ID NO: 168955 - RNA, 22 nt, Homo sapiens
uugagauggugccacuguacuc

SEQ ID NO: 168956 - RNA, 22 nt, Homo sapiens
uugagauguaguuucacuccug

SEQ ID NO: 168957 - RNA, 22 nt, Homo sapiens
uugagcaacauagugagacugu

SEQ ID NO: 168958 - RNA, 22 nt, Homo sapiens
uugagcaccaugccuggccaug

SEQ ID NO: 168959 - RNA, 22 nt, Homo sapiens
uugagcccuggagguggaggcu

SEQ ID NO: 168960 - RNA, 22 nt, Homo sapiens
uugagcuagggagaucgagguc

SEQ ID NO: 168961 - RNA, 22 nt, Homo sapiens
uugagcucaucaagauagagaa

SEQ ID NO: 168962 - RNA, 22 nt, Homo sapiens
uugagcucuuccagccuggagc

SEQ ID NO: 168963 - RNA, 22 nt, Homo sapiens
uugaggaggcagucuguccguu

SEQ ID NO: 168964 - RNA, 22 nt, Homo sapiens
uugaggcuuuugaccucaugug

SEQ ID NO: 168965 - RNA, 22 nt, Homo sapiens
uugagggagcauuuguuuugag

SEQ ID NO: 168966 - RNA, 22 nt, Homo sapiens
uugagggaggcagggcuugucu

SEQ ID NO: 168967 - RNA, 22 nt, Homo sapiens
uugaggguggcauauauugauu

SEQ ID NO: 168968 - RNA, 22 nt, Homo sapiens
uugauagacacauauccaugug

SEQ ID NO: 168969 - RNA, 22 nt, Homo sapiens
uugauagaucagggauuugauu

SEQ ID NO: 168970 - RNA, 22 nt, Homo sapiens
uugauaguuuuaaaauuaaucu

SEQ ID NO: 168971 - RNA, 22 nt, Homo sapiens
uugauauguguauagcaugugg

SEQ ID NO: 168972 - RNA, 22 nt, Homo sapiens
uugauauucuuucuggauccca

SEQ ID NO: 168973 - RNA, 20 nt, Homo sapiens
uugauucccucuaaacucgc

SEQ ID NO: 168974 - RNA, 22 nt, Homo sapiens
uugcaaacaucuuguuucacau

SEQ ID NO: 168975 - RNA, 18 nt, Homo sapiens
uugcaaauucuucccugu

SEQ ID NO: 168976 - RNA, 22 nt, Homo sapiens
uugcaacauguauucuggugau

SEQ ID NO: 168977 - RNA, 22 nt, Homo sapiens
uugcaagaaaucagagccuucc

SEQ ID NO: 168978 - RNA, 20 nt, Homo sapiens
uugcacagagaaggaggcag

SEQ ID NO: 168979 - RNA, 22 nt, Homo sapiens
uugcacaguguguacagcacca

SEQ ID NO: 168980 - RNA, 22 nt, Homo sapiens
uugcagagccccacacugggcu

SEQ ID NO: 168981 - RNA, 22 nt, Homo sapiens
uugcaggcaugagccaccgugc

SEQ ID NO: 168982 - RNA, 22 nt, Homo sapiens
uugcaggugguuuaugcaagac

SEQ ID NO: 168983 - RNA, 22 nt, Homo sapiens
uugcauaaguugaaccagccuu

SEQ ID NO: 168984 - RNA, 19 nt, Homo sapiens
uugcauagguugaaccagc

SEQ ID NO: 168985 - RNA, 22 nt, Homo sapiens
uugcauguacguacagagagag

SEQ ID NO: 168986 - RNA, 22 nt, Homo sapiens
uugcauuuucuaggagggcaaa

SEQ ID NO: 168987 - RNA, 22 nt, Homo sapiens
uugccacuucucuugccccauu

SEQ ID NO: 168988 - RNA, 22 nt, Homo sapiens
uugccaucaucucuuacucagu

SEQ ID NO: 168989 - RNA, 22 nt, Homo sapiens
uugccuaggcuggagugcagua

SEQ ID NO: 168990 - RNA, 22 nt, Homo sapiens
uugcucaggcuagaguucagcu

SEQ ID NO: 168991 - RNA, 20 nt, Homo sapiens
uuggaaaugugaauugggag

SEQ ID NO: 168992 - RNA, 22 nt, Homo sapiens
uuggaacacauguuuuucuacc

SEQ ID NO: 168993 - RNA, 22 nt, Homo sapiens
uuggaaggcugaauggccucuc

SEQ ID NO: 168994 - RNA, 22 nt, Homo sapiens
uuggaaguguguauguauagcu

SEQ ID NO: 168995 - RNA, 21 nt, Homo sapiens
aaaugugcuuuaguacccuca

SEQ ID NO: 168996 - RNA, 22 nt, Homo sapiens
aaauucauuucagcucugggua

SEQ ID NO: 168997 - RNA, 18 nt, Homo sapiens
aaauucugucccuucuuc

SEQ ID NO: 168998 - RNA, 22 nt, Homo sapiens
aaauugcacaaguggugauuug

SEQ ID NO: 168999 - RNA, 22 nt, Homo sapiens
aaauugcaguuaggaugauggu

SEQ ID NO: 169000 - RNA, 22 nt, Homo sapiens
aacaccuugcagggauuaugac

SEQ ID NO: 169001 - RNA, 22 nt, Homo sapiens
aacagcacacccgcugcuucca

SEQ ID NO: 169002 - RNA, 22 nt, Homo sapiens
aacagcuaguaccaauccacua

SEQ ID NO: 169003 - RNA, 22 nt, Homo sapiens
guauggaagucaguuuguuggc

SEQ ID NO: 169004 - RNA, 22 nt, Homo sapiens
guauuaguuaucuacugcugug

SEQ ID NO: 169005 - RNA, 22 nt, Homo sapiens
guauuugauuauagcaugcuua

SEQ ID NO: 169006 - RNA, 22 nt, Homo sapiens
gucaagagaacuuucuaucacu

SEQ ID NO: 169007 - RNA, 22 nt, Homo sapiens
gucacagcuggcauugucugca

SEQ ID NO: 169008 - RNA, 22 nt, Homo sapiens
gucacaguguuuguucauccca

SEQ ID NO: 169009 - RNA, 20 nt, Homo sapiens
gucacuggcccagggcuugu

SEQ ID NO: 169010 - RNA, 21 nt, Homo sapiens
gucacuggggcuggauaauuc

SEQ ID NO: 169011 - RNA, 22 nt, Homo sapiens
gucagagcacugaguugugggc

SEQ ID NO: 169012 - RNA, 22 nt, Homo sapiens
gucagcaaaguucuccugcaga

SEQ ID NO: 169013 - RNA, 22 nt, Homo sapiens
gucaggaccucgguggcauucu

SEQ ID NO: 169014 - RNA, 22 nt, Homo sapiens
gucagggagucucuaucagugg

SEQ ID NO: 169015 - RNA, 22 nt, Homo sapiens
gucagugccugucccaggcuuu

SEQ ID NO: 169016 - RNA, 22 nt, Homo sapiens
gucagugcuuuaguucaggaug

SEQ ID NO: 169017 - RNA, 22 nt, Homo sapiens
gucagugucuuugcagcucaga

SEQ ID NO: 169018 - RNA, 22 nt, Homo sapiens
gucauccaggcuggagugaagc

SEQ ID NO: 169019 - RNA, 22 nt, Homo sapiens
gucaugaacuguacuacuccua

SEQ ID NO: 169020 - RNA, 22 nt, Homo sapiens
gucaugcaggguucgccagccc

SEQ ID NO: 169021 - RNA, 22 nt, Homo sapiens
gucccugcgauugugggauccu

SEQ ID NO: 169022 - RNA, 22 nt, Homo sapiens
guccuggagaagcguggaccgg

SEQ ID NO: 169023 - RNA, 22 nt, Homo sapiens
gucuagaacuucugaccuuagg

SEQ ID NO: 169024 - RNA, 22 nt, Homo sapiens
gucucacagcuagcugcuuuau

SEQ ID NO: 169025 - RNA, 22 nt, Homo sapiens
gucucccagccuacauauuucu

SEQ ID NO: 169026 - RNA, 22 nt, Homo sapiens
gucucugagaugucaacaccua

SEQ ID NO: 169027 - RNA, 22 nt, Homo sapiens
gucucugguugcuuuuguacca

SEQ ID NO: 169028 - RNA, 22 nt, Homo sapiens
gucugcaugucauaugauagua

SEQ ID NO: 169029 - RNA, 22 nt, Homo sapiens
gucuggcaauggcagacuggca

SEQ ID NO: 169030 - RNA, 22 nt, Homo sapiens
gucuggguuuguuuguacuugc

SEQ ID NO: 169031 - RNA, 22 nt, Homo sapiens
gucugguuggaguaguuuucag

SEQ ID NO: 169032 - RNA, 22 nt, Homo sapiens
gucuuugcuuuuaaccagaggu

SEQ ID NO: 169033 - RNA, 22 nt, Homo sapiens
gucuuuggaaaaaaugucuguu

SEQ ID NO: 169034 - RNA, 17 nt, Homo sapiens
gucuuugguugaguuua

SEQ ID NO: 169035 - RNA, 22 nt, Homo sapiens
gugaaagauuaaaccagugugu

SEQ ID NO: 169036 - RNA, 22 nt, Homo sapiens
gugaaauauuuaacguccaggu

SEQ ID NO: 169037 - RNA, 22 nt, Homo sapiens
gugaaaugaaacgcuaugucuu

SEQ ID NO: 169038 - RNA, 22 nt, Homo sapiens
gugaaguuuuugugaggccuaa

SEQ ID NO: 169039 - RNA, 22 nt, Homo sapiens
gugacacagcaagacuccgucu

SEQ ID NO: 169040 - RNA, 22 nt, Homo sapiens
gugacaguggagacuuacuuca

SEQ ID NO: 169041 - RNA, 22 nt, Homo sapiens
gugacaucagcuccagguauaa

SEQ ID NO: 169042 - RNA, 22 nt, Homo sapiens
gugaccaaagauagcucaaguu

SEQ ID NO: 169043 - RNA, 22 nt, Homo sapiens
gugaccucuguugcugucacua

SEQ ID NO: 169044 - RNA, 22 nt, Homo sapiens
gugagauggagucuugcuuugu

SEQ ID NO: 169045 - RNA, 22 nt, Homo sapiens
gugagcuccucucuauguguca

SEQ ID NO: 169046 - RNA, 22 nt, Homo sapiens
gugagcuccucuucugcugcag

SEQ ID NO: 169047 - RNA, 22 nt, Homo sapiens
gugagggaugugaaaaagguca

SEQ ID NO: 169048 - RNA, 20 nt, Homo sapiens
gugagguagaggguuaccug

SEQ ID NO: 169049 - RNA, 22 nt, Homo sapiens
gugaggucagggcuguggacag

SEQ ID NO: 169050 - RNA, 22 nt, Homo sapiens
gugagguguuaaccaaccugug

SEQ ID NO: 169051 - RNA, 22 nt, Homo sapiens
gugaguggacgugaccaauaaa

SEQ ID NO: 169052 - RNA, 22 nt, Homo sapiens
gugaucuucauggaaggugaaa

SEQ ID NO: 169053 - RNA, 20 nt, Homo sapiens
ugguccccaccaaaucucau

SEQ ID NO: 169054 - RNA, 20 nt, Homo sapiens
ugguccccugagucuggcuu

SEQ ID NO: 169055 - RNA, 22 nt, Homo sapiens
ugguucaguugcacaggcuguu

SEQ ID NO: 169056 - RNA, 20 nt, Homo sapiens
uguaacacauggagaacucu

SEQ ID NO: 169057 - RNA, 22 nt, Homo sapiens
uguaagcauuauauaauuguug

SEQ ID NO: 169058 - RNA, 22 nt, Homo sapiens
uguaagcauugggcaugcaguc

SEQ ID NO: 169059 - RNA, 20 nt, Homo sapiens
uguaaucuaaguuuuaagcc

SEQ ID NO: 169060 - RNA, 22 nt, Homo sapiens
uguaauguuugguagguuaggu

SEQ ID NO: 169061 - RNA, 22 nt, Homo sapiens
uguaauuuaaaugauccuugga

SEQ ID NO: 169062 - RNA, 22 nt, Homo sapiens
uguacccuuagagagugaucga

SEQ ID NO: 169063 - RNA, 22 nt, Homo sapiens
uguacuucaagauuaugguuua

SEQ ID NO: 169064 - RNA, 22 nt, Homo sapiens
uguagacagcacguaguugagu

SEQ ID NO: 169065 - RNA, 22 nt, Homo sapiens
uguagcacauuugaagagaagc

SEQ ID NO: 169066 - RNA, 21 nt, Homo sapiens
uguagcagcaugauuuauaau

SEQ ID NO: 169067 - RNA, 22 nt, Homo sapiens
uguagguguacauacaugguua

SEQ ID NO: 169068 - RNA, 22 nt, Homo sapiens
uguagucauuugaaggaugucc

SEQ ID NO: 169069 - RNA, 22 nt, Homo sapiens
uguaugcuuuugagagauauuu

SEQ ID NO: 169070 - RNA, 22 nt, Homo sapiens
uguaugguuauuuguggauggu

SEQ ID NO: 169071 - RNA, 22 nt, Homo sapiens
uguauguaaagacaggauaaca

SEQ ID NO: 169072 - RNA, 22 nt, Homo sapiens
ugucaccauuuguaggugagga

SEQ ID NO: 169073 - RNA, 22 nt, Homo sapiens
ugucaguggucuggaugcagcc

SEQ ID NO: 169074 - RNA, 22 nt, Homo sapiens
ugucaguguaugagccccggau

SEQ ID NO: 169075 - RNA, 22 nt, Homo sapiens
ugucauggauucugagucuggg

SEQ ID NO: 169076 - RNA, 22 nt, Homo sapiens
uguccaaauugaaucaucuggu

SEQ ID NO: 169077 - RNA, 22 nt, Homo sapiens
ugucccguuuucgaggcugcag

SEQ ID NO: 169078 - RNA, 22 nt, Homo sapiens
ugucuaguuuugaaguauagca

SEQ ID NO: 169079 - RNA, 22 nt, Homo sapiens
ugucucaguucccuucucugga

SEQ ID NO: 169080 - RNA, 21 nt, Homo sapiens
ugucugagagaggagaucuac

SEQ ID NO: 169081 - RNA, 22 nt, Homo sapiens
ugucuuguagacugaaggcuuc

SEQ ID NO: 169082 - RNA, 22 nt, Homo sapiens
ugugaacauuuuguauauauua

SEQ ID NO: 169083 - RNA, 22 nt, Homo sapiens
ugugacaaauuuaguggacugu

SEQ ID NO: 169084 - RNA, 22 nt, Homo sapiens
ugugacaguguuacauuucaug

SEQ ID NO: 169085 - RNA, 17 nt, Homo sapiens
ugugacccugggcuacc

SEQ ID NO: 169086 - RNA, 22 nt, Homo sapiens
ugugagcuauggaguuguagag

SEQ ID NO: 169087 - RNA, 17 nt, Homo sapiens
ugugaucaucacccuug

SEQ ID NO: 169088 - RNA, 22 nt, Homo sapiens
aaugaucaauguuugaggugau

SEQ ID NO: 169089 - RNA, 22 nt, Homo sapiens
aaugcacauauauuuccuuauu

SEQ ID NO: 169090 - RNA, 22 nt, Homo sapiens
aaugcuaucuggaacauuguug

SEQ ID NO: 169091 - RNA, 22 nt, Homo sapiens
aauggcacacaccuggucuaac

SEQ ID NO: 169092 - RNA, 22 nt, Homo sapiens
aauggcacaccuagcccuaacc

SEQ ID NO: 169093 - RNA, 22 nt, Homo sapiens
aauggcagaugaaauugucauu

SEQ ID NO: 169094 - RNA, 22 nt, Homo sapiens
aauggcaucuacguuaaauguc

SEQ ID NO: 169095 - RNA, 22 nt, Homo sapiens
aauggcuucuuauugugguuca

SEQ ID NO: 169096 - RNA, 21 nt, Homo sapiens
aaugguguugccaacaaggug

SEQ ID NO: 169097 - RNA, 22 nt, Homo sapiens
aaugucaugaguccaaccagaa

SEQ ID NO: 169098 - RNA, 22 nt, Homo sapiens
aauguguuuugaaaucaggaag

SEQ ID NO: 169099 - RNA, 22 nt, Homo sapiens
aauuaguaaccuaauuccaucu

SEQ ID NO: 169100 - RNA, 22 nt, Homo sapiens
aauugcaauggacaaugcagca

SEQ ID NO: 169101 - RNA, 22 nt, Homo sapiens
aauugcaccaucuagaucaaga

SEQ ID NO: 169102 - RNA, 22 nt, Homo sapiens
aauugcauaugcaguagaucua

SEQ ID NO: 169103 - RNA, 22 nt, Homo sapiens
aauugcuucuguauuuuggaca

SEQ ID NO: 169104 - RNA, 23 nt, Homo sapiens
aauugcuuuugaggacuuaguug

SEQ ID NO: 169105 - RNA, 22 nt, Homo sapiens
aauuguacucccauaauucccu

SEQ ID NO: 169106 - RNA, 21 nt, Homo sapiens
acaaagcuggagggagacugc

SEQ ID NO: 169107 - RNA, 20 nt, Homo sapiens
acaaaugcauucugugacau

SEQ ID NO: 169108 - RNA, 22 nt, Homo sapiens
acaagugcuuuuccuggagaca

SEQ ID NO: 169109 - RNA, 22 nt, Homo sapiens
acacagugucuguguauuuaaa

SEQ ID NO: 169110 - RNA, 22 nt, Homo sapiens
acacgggugccggcaucagcac

SEQ ID NO: 169111 - RNA, 22 nt, Homo sapiens
acacgugcagauuuauauaaau

SEQ ID NO: 169112 - RNA, 22 nt, Homo sapiens
acacgugcguauauguacguau

SEQ ID NO: 169113 - RNA, 22 nt, Homo sapiens
acacugcugaguaaauaauuuu

SEQ ID NO: 169114 - RNA, 20 nt, Homo sapiens
acacuggaguaucaaggccc

SEQ ID NO: 169115 - RNA, 22 nt, Homo sapiens
acacuguaacucuuugagggca

SEQ ID NO: 169116 - RNA, 22 nt, Homo sapiens
acacuguuggugggaguguaaa

SEQ ID NO: 169117 - RNA, 22 nt, Homo sapiens
acacuguuuuaguuauuauagc

SEQ ID NO: 169118 - RNA, 22 nt, Homo sapiens
acagauagacauauauagcuca

SEQ ID NO: 169119 - RNA, 22 nt, Homo sapiens
acagauagcacuaagggaucug

SEQ ID NO: 169120 - RNA, 22 nt, Homo sapiens
acagcagugccccacucuacug

SEQ ID NO: 169121 - RNA, 22 nt, Homo sapiens
acaguacaugauaaauaaggua

SEQ ID NO: 169122 - RNA, 22 nt, Homo sapiens
acaguagugggcuacagaauca

SEQ ID NO: 169123 - RNA, 23 nt, Homo sapiens
acaguauguggauguggcuaagu

SEQ ID NO: 169124 - RNA, 22 nt, Homo sapiens
acagucauagcagccuuuguua

SEQ ID NO: 169125 - RNA, 23 nt, Homo sapiens
acagucuaguuugaagucaggua

SEQ ID NO: 169126 - RNA, 18 nt, Homo sapiens
acagugcuggcaugagau

SEQ ID NO: 169127 - RNA, 22 nt, Homo sapiens
acagugcuguuguguuuucacg

SEQ ID NO: 169128 - RNA, 22 nt, Homo sapiens
acagugcuuucaauguucagua

SEQ ID NO: 169129 - RNA, 17 nt, Homo sapiens
acagugucuaugaaaug

SEQ ID NO: 169130 - RNA, 19 nt, Homo sapiens
acagugucucuauaaugau

SEQ ID NO: 169131 - RNA, 22 nt, Homo sapiens
acagugucugacacguaggaag

SEQ ID NO: 169132 - RNA, 22 nt, Homo sapiens
acauacacuagggauguggugu

SEQ ID NO: 169133 - RNA, 22 nt, Homo sapiens
acaucccuugcucggggccccu

SEQ ID NO: 169134 - RNA, 22 nt, Homo sapiens
acaucccuuucccacccuucac

SEQ ID NO: 169135 - RNA, 22 nt, Homo sapiens
acaugcauccaugugaagagac

SEQ ID NO: 169136 - RNA, 22 nt, Homo sapiens
acauggcacugcgggcuucuug

SEQ ID NO: 169137 - RNA, 22 nt, Homo sapiens
uuaggucaucgcuguccuucag

SEQ ID NO: 169138 - RNA, 22 nt, Homo sapiens
uuagguuauuacugacaauaau

SEQ ID NO: 169139 - RNA, 22 nt, Homo sapiens
uuaguaguagcugcaugucagu

SEQ ID NO: 169140 - RNA, 22 nt, Homo sapiens
uuaguaguaguuugcauuuacc

SEQ ID NO: 169141 - RNA, 22 nt, Homo sapiens
uuagugaaugcaccacuucuga

SEQ ID NO: 169142 - RNA, 22 nt, Homo sapiens
uuauaacucugcagccugguau

SEQ ID NO: 169143 - RNA, 22 nt, Homo sapiens
uuaucacauugacugauuugca

SEQ ID NO: 169144 - RNA, 21 nt, Homo sapiens
uuaucccagugucucugcagg

SEQ ID NO: 169145 - RNA, 22 nt, Homo sapiens
uuaugccagugauuauaagggc

SEQ ID NO: 169146 - RNA, 22 nt, Homo sapiens
uuaugcuguuuucuggagauuu

SEQ ID NO: 169147 - RNA, 22 nt, Homo sapiens
uuauugcuuuugugcaggugag

SEQ ID NO: 169148 - RNA, 22 nt, Homo sapiens
uucaaaguaaaaauguguucac

SEQ ID NO: 169149 - RNA, 22 nt, Homo sapiens
uucaaguaagaaagacaucagg

SEQ ID NO: 169150 - RNA, 22 nt, Homo sapiens
uucaaguagguaggaccacagg

SEQ ID NO: 169151 - RNA, 22 nt, Homo sapiens
uucacaaugccuuguugauggu

SEQ ID NO: 169152 - RNA, 22 nt, Homo sapiens
uucacaugacagggugaagcau

SEQ ID NO: 169153 - RNA, 23 nt, Homo sapiens
uucaccugguuauuaauagccuc

SEQ ID NO: 169154 - RNA, 22 nt, Homo sapiens
uucaccuguagcaugcccuugg

SEQ ID NO: 169155 - RNA, 22 nt, Homo sapiens
uucacuggagcccaggaguugg

SEQ ID NO: 169156 - RNA, 20 nt, Homo sapiens
uucacugggcucucuguugg

SEQ ID NO: 169157 - RNA, 22 nt, Homo sapiens
uucagcaaugacagccuauaua

SEQ ID NO: 169158 - RNA, 22 nt, Homo sapiens
uucagggacuuuagacaagaga

SEQ ID NO: 169159 - RNA, 22 nt, Homo sapiens
uucagggcauuggaguuucuga

SEQ ID NO: 169160 - RNA, 22 nt, Homo sapiens
uucaggguggagaguaugaggu

SEQ ID NO: 169161 - RNA, 22 nt, Homo sapiens
uucagguucauuugcugcuauu

SEQ ID NO: 169162 - RNA, 22 nt, Homo sapiens
uucagugguuauuugugagauu

SEQ ID NO: 169163 - RNA, 22 nt, Homo sapiens
uucaguucugcacugaucuuag

SEQ ID NO: 169164 - RNA, 22 nt, Homo sapiens
uucaguucugcucugaucuuag

SEQ ID NO: 169165 - RNA, 22 nt, Homo sapiens
uucauaguaacaguaacuaugg

SEQ ID NO: 169166 - RNA, 22 nt, Homo sapiens
uucauaguucuuuuagucauua

SEQ ID NO: 169167 - RNA, 22 nt, Homo sapiens
uucaucacagucuccgaugccc

SEQ ID NO: 169168 - RNA, 22 nt, Homo sapiens
uucaucagcuguagaugucaug

SEQ ID NO: 169169 - RNA, 21 nt, Homo sapiens
uucaucuggccguauuccagg

SEQ ID NO: 169170 - RNA, 22 nt, Homo sapiens
acugcacuccaaccuuggugac

SEQ ID NO: 169171 - RNA, 22 nt, Homo sapiens
acugcacuccagccucggcaau

SEQ ID NO: 169172 - RNA, 22 nt, Homo sapiens
acugcacuccagccugcuggau

SEQ ID NO: 169173 - RNA, 22 nt, Homo sapiens
acugcacuccagccuggaccac

SEQ ID NO: 169174 - RNA, 22 nt, Homo sapiens
acugcacuccagcuugggugac

SEQ ID NO: 169175 - RNA, 22 nt, Homo sapiens
acugcacuccggccuggcaaca

SEQ ID NO: 169176 - RNA, 19 nt, Homo sapiens
acugcacuccuccuugggu

SEQ ID NO: 169177 - RNA, 22 nt, Homo sapiens
acugcacuccuccuugggugac

SEQ ID NO: 169178 - RNA, 18 nt, Homo sapiens
acuggauguaaagggucc

SEQ ID NO: 169179 - RNA, 22 nt, Homo sapiens
acuguacuacagccugggugac

SEQ ID NO: 169180 - RNA, 19 nt, Homo sapiens
acuguacuccagucugggc

SEQ ID NO: 169181 - RNA, 22 nt, Homo sapiens
acuguacuccauccugggugac

SEQ ID NO: 169182 - RNA, 22 nt, Homo sapiens
acuguauagauggaguugauuu

SEQ ID NO: 169183 - RNA, 23 nt, Homo sapiens
agaaaugucuauucagggucccu

SEQ ID NO: 169184 - RNA, 22 nt, Homo sapiens
agaacacugaguucagggucag

SEQ ID NO: 169185 - RNA, 22 nt, Homo sapiens
agaauaauguccccccaaggga

SEQ ID NO: 169186 - RNA, 22 nt, Homo sapiens
agacccuguauguguuuaguuu

SEQ ID NO: 169187 - RNA, 22 nt, Homo sapiens
agagauaaagauuuuaauuuug

SEQ ID NO: 169188 - RNA, 22 nt, Homo sapiens
agagauaauuagguuaaaugag

SEQ ID NO: 169189 - RNA, 22 nt, Homo sapiens
agagaugaagauggggcucccg

SEQ ID NO: 169190 - RNA, 20 nt, Homo sapiens
agagcaaagccgcaccccua

SEQ ID NO: 169191 - RNA, 22 nt, Homo sapiens
agagcaccauuuagcaagguga

SEQ ID NO: 169192 - RNA, 22 nt, Homo sapiens
agagguagaagauaggcuacag

SEQ ID NO: 169193 - RNA, 22 nt, Homo sapiens
agagguauuggaaggaguguca

SEQ ID NO: 169194 - RNA, 19 nt, Homo sapiens
agaguauugaauuugcccu

SEQ ID NO: 169195 - RNA, 22 nt, Homo sapiens
agagugcuuuauuagauguagc

SEQ ID NO: 169196 - RNA, 22 nt, Homo sapiens
agauauguuauugauguuaaug

SEQ ID NO: 169197 - RNA, 23 nt, Homo sapiens
agaugcauucuuguaggauauau

SEQ ID NO: 169198 - RNA, 18 nt, Homo sapiens
agaugguguugcuucugu

SEQ ID NO: 169199 - RNA, 22 nt, Homo sapiens
agaugguguuuucucaccagau

SEQ ID NO: 169200 - RNA, 22 nt, Homo sapiens
agcaaaucuaugaauguauauu

SEQ ID NO: 169201 - RNA, 23 nt, Homo sapiens
agcaaaugcucuagcacuccaac

SEQ ID NO: 169202 - RNA, 22 nt, Homo sapiens
agcaacauagaaauuugggugg

SEQ ID NO: 169203 - RNA, 22 nt, Homo sapiens
agcaacauuguucauaauagcu

SEQ ID NO: 169204 - RNA, 22 nt, Homo sapiens
agcaacauuuuugaccuuucuu

SEQ ID NO: 169205 - RNA, 22 nt, Homo sapiens
agcacagugaaugguuuacuca

SEQ ID NO: 169206 - RNA, 22 nt, Homo sapiens
agcacaguuaaaugaggcuucu

SEQ ID NO: 169207 - RNA, 22 nt, Homo sapiens
agcaccacaauuuccugccuaa

SEQ ID NO: 169208 - RNA, 23 nt, Homo sapiens
agcaccaccccaggucacaagug

SEQ ID NO: 169209 - RNA, 22 nt, Homo sapiens
agcaccaccguugcucuauccc

SEQ ID NO: 169210 - RNA, 22 nt, Homo sapiens
agcaccagaaucugaguuauuc

SEQ ID NO: 169211 - RNA, 22 nt, Homo sapiens
agcaccauugcacuccagccug

SEQ ID NO: 169212 - RNA, 22 nt, Homo sapiens
agcagcaauuuuguaugguuua

SEQ ID NO: 169213 - RNA, 22 nt, Homo sapiens
agcagcauauuuuuauaaugua

SEQ ID NO: 169214 - RNA, 22 nt, Homo sapiens
agcagcaugcaaauggacuaau

SEQ ID NO: 169215 - RNA, 22 nt, Homo sapiens
agcagcauggguauaaaucucc

SEQ ID NO: 169216 - RNA, 22 nt, Homo sapiens
agcagcauuaugauauaucuua

SEQ ID NO: 169217 - RNA, 17 nt, Homo sapiens
agcagcccauaucccca

SEQ ID NO: 169218 - RNA, 22 nt, Homo sapiens
agcagcucaagacuuaaauuug

SEQ ID NO: 169219 - RNA, 22 nt, Homo sapiens
agcaguagugaaaguagacuua

SEQ ID NO: 169220 - RNA, 19 nt, Homo sapiens
agcaguguggagauuucuc

SEQ ID NO: 169221 - RNA, 22 nt, Homo sapiens
uuggacuggaacuauaccauug

SEQ ID NO: 169222 - RNA, 22 nt, Homo sapiens
uuggagugugagagcagccugg

SEQ ID NO: 169223 - RNA, 22 nt, Homo sapiens
uuggauuauaaacugagauuug

SEQ ID NO: 169224 - RNA, 22 nt, Homo sapiens
uuggauuuugguggcaacucau

SEQ ID NO: 169225 - RNA, 22 nt, Homo sapiens
uuggcacugagcaagaacaggg

SEQ ID NO: 169226 - RNA, 22 nt, Homo sapiens
uuggcacugggaaaaugaccac

SEQ ID NO: 169227 - RNA, 22 nt, Homo sapiens
uuggcacuugauaauauucugg

SEQ ID NO: 169228 - RNA, 22 nt, Homo sapiens
uuggcauuuauucuaaggucaa

SEQ ID NO: 169229 - RNA, 22 nt, Homo sapiens
uuggccauggagcacuuuucua

SEQ ID NO: 169230 - RNA, 22 nt, Homo sapiens
uuggccccuccaaaucucaugu

SEQ ID NO: 169231 - RNA, 22 nt, Homo sapiens
uuggccccuuucauccacagcu

SEQ ID NO: 169232 - RNA, 23 nt, Homo sapiens
uuggccuccuugugucuagggcu

SEQ ID NO: 169233 - RNA, 22 nt, Homo sapiens
uuggcuuaguugaccacagucu

SEQ ID NO: 169234 - RNA, 22 nt, Homo sapiens
uuggcuucuggacuauugugca

SEQ ID NO: 169235 - RNA, 22 nt, Homo sapiens
uuggcuuuuaugcagcuuaggu

SEQ ID NO: 169236 - RNA, 22 nt, Homo sapiens
uugggacuggaaggaguaaggg

SEQ ID NO: 169237 - RNA, 23 nt, Homo sapiens
uugggcaaaucacuaacgucucc

SEQ ID NO: 169238 - RNA, 22 nt, Homo sapiens
uugggcauugcuauaaauucuu

SEQ ID NO: 169239 - RNA, 22 nt, Homo sapiens
uugggcuugagggugcccaguc

SEQ ID NO: 169240 - RNA, 22 nt, Homo sapiens
uugggguagaauugcaacauau

SEQ ID NO: 169241 - RNA, 22 nt, Homo sapiens
uuggucacugacauguuugaaa

SEQ ID NO: 169242 - RNA, 22 nt, Homo sapiens
uuggucaggcuagaguguggug

SEQ ID NO: 169243 - RNA, 19 nt, Homo sapiens
uuggucccuuuggguucuu

SEQ ID NO: 169244 - RNA, 23 nt, Homo sapiens
uuggucucccaaaguguugagau

SEQ ID NO: 169245 - RNA, 21 nt, Homo sapiens
uuggucuucucugugauucuu

SEQ ID NO: 169246 - RNA, 22 nt, Homo sapiens
uugguuaucaucauuucagcaa

SEQ ID NO: 169247 - RNA, 22 nt, Homo sapiens
uuguagaucuucaguugcuaca

SEQ ID NO: 169248 - RNA, 22 nt, Homo sapiens
uuguauugucuugaugaguuga

SEQ ID NO: 169249 - RNA, 23 nt, Homo sapiens
uuguccccuccaaagcucauguu

SEQ ID NO: 169250 - RNA, 22 nt, Homo sapiens
uuguccuccacauuugaucagu

SEQ ID NO: 169251 - RNA, 22 nt, Homo sapiens
uuguccuugagauaguuugcug

SEQ ID NO: 169252 - RNA, 22 nt, Homo sapiens
uugugaaaaaccucucguggaa

SEQ ID NO: 169253 - RNA, 22 nt, Homo sapiens
uugugaaaucuaggcagagguu

SEQ ID NO: 169254 - RNA, 22 nt, Homo sapiens
uugugauugagugauccuuguu

SEQ ID NO: 169255 - RNA, 21 nt, Homo sapiens
uugugccaaacccuggaggga

SEQ ID NO: 169256 - RNA, 22 nt, Homo sapiens
uugugcuuaaugaguguaaggu

SEQ ID NO: 169257 - RNA, 22 nt, Homo sapiens
uuguguccccacccaaaucuca

SEQ ID NO: 169258 - RNA, 22 nt, Homo sapiens
uuguguccccacucaaauuaca

SEQ ID NO: 169259 - RNA, 22 nt, Homo sapiens
uuguuauguuggucaguaaugu

SEQ ID NO: 169260 - RNA, 22 nt, Homo sapiens
uuguucaggagguuggggaugc

SEQ ID NO: 169261 - RNA, 23 nt, Homo sapiens
uuguucccuuccacucagucucc

SEQ ID NO: 169262 - RNA, 22 nt, Homo sapiens
uuguucccuucuggcuuuuaug

SEQ ID NO: 169263 - RNA, 22 nt, Homo sapiens
uuuaaacugucuuggguuugga

SEQ ID NO: 169264 - RNA, 22 nt, Homo sapiens
uuuaaagcaugacgagaagaag

SEQ ID NO: 169265 - RNA, 22 nt, Homo sapiens
uuuaaggcacuucaugguuuca

SEQ ID NO: 169266 - RNA, 22 nt, Homo sapiens
uuuaagguauguggugaaaauu

SEQ ID NO: 169267 - RNA, 22 nt, Homo sapiens
uuuaauagcagggacuuccggg

SEQ ID NO: 169268 - RNA, 22 nt, Homo sapiens
uuuaaugcugcccagucauggg

SEQ ID NO: 169269 - RNA, 22 nt, Homo sapiens
uuuacagucucauagguggaag

SEQ ID NO: 169270 - RNA, 22 nt, Homo sapiens
uuuacaguuuucuaggcuacca

SEQ ID NO: 169271 - RNA, 22 nt, Homo sapiens
uuuagcacugugauugacaaaa

SEQ ID NO: 169272 - RNA, 22 nt, Homo sapiens
uuuagcagcaaagagccaugcu

SEQ ID NO: 169273 - RNA, 22 nt, Homo sapiens
uuuagguaauauuaaguagcug

SEQ ID NO: 169274 - RNA, 22 nt, Homo sapiens
uuuagguauuugguauagcagu

SEQ ID NO: 169275 - RNA, 22 nt, Homo sapiens
uuuaguacugcuuuaugugugu

SEQ ID NO: 169276 - RNA, 23 nt, Homo sapiens
uuuaguccccuaugagcuggugu

SEQ ID NO: 169277 - RNA, 22 nt, Homo sapiens
uuuauagucaggaacuugagga

SEQ ID NO: 169278 - RNA, 22 nt, Homo sapiens
uuuaugcuacauguguuggaaa

SEQ ID NO: 169279 - RNA, 22 nt, Homo sapiens
uuucaagugcugucuuagcugu

SEQ ID NO: 169280 - RNA, 18 nt, Homo sapiens
uuucaggguggacaugag

SEQ ID NO: 169281 - RNA, 20 nt, Homo sapiens
uuucaguacuuucuacuggc

SEQ ID NO: 169282 - RNA, 22 nt, Homo sapiens
uuucauggagaaucuucuuacu

SEQ ID NO: 169283 - RNA, 22 nt, Homo sapiens
uuucuacagggcuugccaggua

SEQ ID NO: 169284 - RNA, 22 nt, Homo sapiens
uuucugugguccucuugaaggu

SEQ ID NO: 169285 - RNA, 18 nt, Homo sapiens
uuugacugguguccuuau

SEQ ID NO: 169286 - RNA, 22 nt, Homo sapiens
uuugagcauggaaauggcauga

SEQ ID NO: 169287 - RNA, 22 nt, Homo sapiens
uuugauugguguaccugaaagu

SEQ ID NO: 169288 - RNA, 22 nt, Homo sapiens
uuugcacuuuuguaauaugguu

SEQ ID NO: 169289 - RNA, 22 nt, Homo sapiens
uuugcaugcuccuuaugagaau

SEQ ID NO: 169290 - RNA, 22 nt, Homo sapiens
uuugccaaugggaauuuuccua

SEQ ID NO: 169291 - RNA, 22 nt, Homo sapiens
uuugcuucacuguuuggcaaaa

SEQ ID NO: 169292 - RNA, 22 nt, Homo sapiens
uuuggcaaagaucaacauguua

SEQ ID NO: 169293 - RNA, 23 nt, Homo sapiens
uuuggcauuccagaaauuuucau

SEQ ID NO: 169294 - RNA, 22 nt, Homo sapiens
uuuggcauuugaguuuguagga

SEQ ID NO: 169295 - RNA, 18 nt, Homo sapiens
uuuggcuguucaugacuc

SEQ ID NO: 169296 - RNA, 22 nt, Homo sapiens
uuugggaaaugaaguugguaga

SEQ ID NO: 169297 - RNA, 22 nt, Homo sapiens
uuugguuauauauauacacucu

SEQ ID NO: 169298 - RNA, 22 nt, Homo sapiens
uuuguacacuguuggugguuau

SEQ ID NO: 169299 - RNA, 22 nt, Homo sapiens
uuuguacuccuuggccagcuuc

SEQ ID NO: 169300 - RNA, 21 nt, Homo sapiens
uuuguaguagcaugauuuaua

SEQ ID NO: 169301 - RNA, 19 nt, Homo sapiens
uuuguauguuuccaguaau

SEQ ID NO: 169302 - RNA, 22 nt, Homo sapiens
uuugucacccugaauguaagau

SEQ ID NO: 169303 - RNA, 22 nt, Homo sapiens
uuugugaaugucauaagcucca

SEQ ID NO: 169304 - RNA, 22 nt, Homo sapiens
acacuguagcugagggcaugcg

SEQ ID NO: 169305 - RNA, 22 nt, Homo sapiens
acacugucucuugcugaccaug

SEQ ID NO: 169306 - RNA, 22 nt, Homo sapiens
acacuuucuggagcugcacaua

SEQ ID NO: 169307 - RNA, 19 nt, Homo sapiens
acagauagaauguucuaca

SEQ ID NO: 169308 - RNA, 19 nt, Homo sapiens
acagcugguuuugguuucu

SEQ ID NO: 169309 - RNA, 22 nt, Homo sapiens
acagucuggagaaugggugcuc

SEQ ID NO: 169310 - RNA, 22 nt, Homo sapiens
acagugcugucugcuuuggcua

SEQ ID NO: 169311 - RNA, 22 nt, Homo sapiens
acaguggaauguaggguuugag

SEQ ID NO: 169312 - RNA, 18 nt, Homo sapiens
acagugucauggcucaau

SEQ ID NO: 169313 - RNA, 18 nt, Homo sapiens
acagugucuuacaccugu

SEQ ID NO: 169314 - RNA, 22 nt, Homo sapiens
acaguguguguguucaccuaga

SEQ ID NO: 169315 - RNA, 22 nt, Homo sapiens
gaguuccuuugagccugagagg

SEQ ID NO: 169316 - RNA, 22 nt, Homo sapiens
gaguuuguaaacuauucacuaa

SEQ ID NO: 169317 - RNA, 21 nt, Homo sapiens
gauaucuuuauucccaagagc

SEQ ID NO: 169318 - RNA, 22 nt, Homo sapiens
gaucuggagguuuuccucauga

SEQ ID NO: 169319 - RNA, 22 nt, Homo sapiens
gaucuguguuuguaugcauaag

SEQ ID NO: 169320 - RNA, 22 nt, Homo sapiens
gaucuguuuuccuauuguuugu

SEQ ID NO: 169321 - RNA, 22 nt, Homo sapiens
gaugagcuaaguucucacagca

SEQ ID NO: 169322 - RNA, 22 nt, Homo sapiens
gauggcacuuaagagcaagagc

SEQ ID NO: 169323 - RNA, 22 nt, Homo sapiens
gauggcauuucuggaucugaca

SEQ ID NO: 169324 - RNA, 22 nt, Homo sapiens
gauguagaaagagugggcugga

SEQ ID NO: 169325 - RNA, 22 nt, Homo sapiens
gauguaggugcauuugcacgug

SEQ ID NO: 169326 - RNA, 20 nt, Homo sapiens
gauuagagagaggcugugca

SEQ ID NO: 169327 - RNA, 22 nt, Homo sapiens
gauuccacuuucugucucuaug

SEQ ID NO: 169328 - RNA, 22 nt, Homo sapiens
gauuccauugcgaauuuucaga

SEQ ID NO: 169329 - RNA, 22 nt, Homo sapiens
gcaaaucuuauguccucacauu

SEQ ID NO: 169330 - RNA, 20 nt, Homo sapiens
gcaacauggccagagugaau

SEQ ID NO: 169331 - RNA, 22 nt, Homo sapiens
gcacacuuacacgaaccuagau

SEQ ID NO: 169332 - RNA, 22 nt, Homo sapiens
gcacaggguuacauucuaaggu

SEQ ID NO: 169333 - RNA, 22 nt, Homo sapiens
gcacaguggcucccgucuauaa

SEQ ID NO: 169334 - RNA, 22 nt, Homo sapiens
gcacaguguuacuugauauauu

SEQ ID NO: 169335 - RNA, 22 nt, Homo sapiens
gcacauggccccaucgugccga

SEQ ID NO: 169336 - RNA, 22 nt, Homo sapiens
gcaccaugguagaauaauggua

SEQ ID NO: 169337 - RNA, 22 nt, Homo sapiens
gcaccccuuaccgggcuggguu

SEQ ID NO: 169338 - RNA, 22 nt, Homo sapiens
gcacgugcucauuugaggucuu

SEQ ID NO: 169339 - RNA, 22 nt, Homo sapiens
gcaguagugcgaucucagcuca

SEQ ID NO: 169340 - RNA, 22 nt, Homo sapiens
gcagucaucugaaggcuuaacu

SEQ ID NO: 169341 - RNA, 22 nt, Homo sapiens
gcaguguucaaaucaugcccau

SEQ ID NO: 169342 - RNA, 22 nt, Homo sapiens
gcauaaagcuaauaagacgaag

SEQ ID NO: 169343 - RNA, 22 nt, Homo sapiens
gcauggccuuuaaaugucacag

SEQ ID NO: 169344 - RNA, 22 nt, Homo sapiens
gcaugguaguaaccuacauuug

SEQ ID NO: 169345 - RNA, 22 nt, Homo sapiens
gcauguaguagauguugaauaa

SEQ ID NO: 169346 - RNA, 22 nt, Homo sapiens
gccaguauuuuguugagaauuu

SEQ ID NO: 169347 - RNA, 22 nt, Homo sapiens
gccauggaggauuuauagaggc

SEQ ID NO: 169348 - RNA, 22 nt, Homo sapiens
gccauugcacuacagccuaggc

SEQ ID NO: 169349 - RNA, 22 nt, Homo sapiens
gccauugcacuccagccuaggc

SEQ ID NO: 169350 - RNA, 22 nt, Homo sapiens
gccccaguacaggcuccuuaga

SEQ ID NO: 169351 - RNA, 22 nt, Homo sapiens
gccccgggugaugcagccguca

SEQ ID NO: 169352 - RNA, 22 nt, Homo sapiens
gccccugagacuugccucgggc

SEQ ID NO: 169353 - RNA, 22 nt, Homo sapiens
gcccugauacauucuucugccu

SEQ ID NO: 169354 - RNA, 22 nt, Homo sapiens
gccgagagauuuggaaugggga

SEQ ID NO: 169355 - RNA, 22 nt, Homo sapiens
gcgugguguuagaaugagaagu

SEQ ID NO: 169356 - RNA, 22 nt, Homo sapiens
gcuagcauucaaaugugcagcc

SEQ ID NO: 169357 - RNA, 23 nt, Homo sapiens
gcuaggagagaugaaacacaggu

SEQ ID NO: 169358 - RNA, 22 nt, Homo sapiens
gcuauggccugaauguuugugu

SEQ ID NO: 169359 - RNA, 19 nt, Homo sapiens
gcucaccuugcugcuccag

SEQ ID NO: 169360 - RNA, 22 nt, Homo sapiens
gcugcacuuuaaggcauccccu

SEQ ID NO: 169361 - RNA, 22 nt, Homo sapiens
gcugcuuuugaugacaaaaaca

SEQ ID NO: 169362 - RNA, 22 nt, Homo sapiens
gcuggcuuucuccugaucucag

SEQ ID NO: 169363 - RNA, 22 nt, Homo sapiens
gcuggguugccagguuacuuaa

SEQ ID NO: 169364 - RNA, 22 nt, Homo sapiens
gcuggucugccguaguaggugc

SEQ ID NO: 169365 - RNA, 22 nt, Homo sapiens
gcuguaguugaggauuuuaaga

SEQ ID NO: 169366 - RNA, 22 nt, Homo sapiens
gcugucuggagucuguucaaug

SEQ ID NO: 169367 - RNA, 22 nt, Homo sapiens
gcuucauggaggcugggcgcag

SEQ ID NO: 169368 - RNA, 22 nt, Homo sapiens
ggaaagcuagguguggguguac

SEQ ID NO: 169369 - RNA, 22 nt, Homo sapiens
ggaaaguaacccauucucuuac

SEQ ID NO: 169370 - RNA, 22 nt, Homo sapiens
ggaagacaguguggugauuccu

SEQ ID NO: 169371 - RNA, 20 nt, Homo sapiens
ggaagagugacacaagguau

SEQ ID NO: 169372 - RNA, 18 nt, Homo sapiens
ggaagauuggcuaugugc

SEQ ID NO: 169373 - RNA, 22 nt, Homo sapiens
ggaagguaauugucagcucaua

SEQ ID NO: 169374 - RNA, 22 nt, Homo sapiens
ggaaucugaaccaugggaaugg

SEQ ID NO: 169375 - RNA, 22 nt, Homo sapiens
ggaaugagaaauauuacacaau

SEQ ID NO: 169376 - RNA, 22 nt, Homo sapiens
ggaaugcagugagcauuagaua

SEQ ID NO: 169377 - RNA, 21 nt, Homo sapiens
ggaauuuagggaaugauuuag

SEQ ID NO: 169378 - RNA, 22 nt, Homo sapiens
ggagagcuaggcagagguuugu

SEQ ID NO: 169379 - RNA, 20 nt, Homo sapiens
ggagagugacauaauucugg

SEQ ID NO: 169380 - RNA, 22 nt, Homo sapiens
ggagcucaucuagcauagaggu

SEQ ID NO: 169381 - RNA, 22 nt, Homo sapiens
ggagcugugauuugaguccaga

SEQ ID NO: 169382 - RNA, 16 nt, Homo sapiens
ggaggucaucugggaa

SEQ ID NO: 169383 - RNA, 20 nt, Homo sapiens
ggagguuguauaaguacauc

SEQ ID NO: 169384 - RNA, 22 nt, Homo sapiens
ggaguaggcuguccggcaccca

SEQ ID NO: 169385 - RNA, 22 nt, Homo sapiens
ggagucugauuuuuauguugcu

SEQ ID NO: 169386 - RNA, 22 nt, Homo sapiens
ggaucauaugauagcucaauuu

SEQ ID NO: 169387 - RNA, 22 nt, Homo sapiens
ggcaagaaagaaaucaucuguc

SEQ ID NO: 169388 - RNA, 22 nt, Homo sapiens
ggcaagaaccacaauuacuuuu

SEQ ID NO: 169389 - RNA, 22 nt, Homo sapiens
ggcaagaacuucacucacuuuu

SEQ ID NO: 169390 - RNA, 17 nt, Homo sapiens
ggcaagaaguggaacuc

SEQ ID NO: 169391 - RNA, 21 nt, Homo sapiens
ggcaagagaauacaacauaaa

SEQ ID NO: 169392 - RNA, 22 nt, Homo sapiens
ggcacgguggcucacgccugua

SEQ ID NO: 169393 - RNA, 22 nt, Homo sapiens
ggcagagucuugcaucuuuaga

SEQ ID NO: 169394 - RNA, 22 nt, Homo sapiens
ggcagcacaauuuucugaugga

SEQ ID NO: 169395 - RNA, 22 nt, Homo sapiens
ggcagcucaggccccgcgcuga

SEQ ID NO: 169396 - RNA, 22 nt, Homo sapiens
ggcaguggaagugccaguuucu

SEQ ID NO: 169397 - RNA, 22 nt, Homo sapiens
ggcaugaugcgcacgccuguag

SEQ ID NO: 169398 - RNA, 22 nt, Homo sapiens
ggcaaggugcuacagacaguga

SEQ ID NO: 169399 - RNA, 22 nt, Homo sapiens
ggcaagugucagcagcaacacc

SEQ ID NO: 169400 - RNA, 19 nt, Homo sapiens
ggcaauacuuucuuguugg

SEQ ID NO: 169401 - RNA, 22 nt, Homo sapiens
ggcacgguggcucacaccugua

SEQ ID NO: 169402 - RNA, 22 nt, Homo sapiens
ggcagacuguggaguucuuucu

SEQ ID NO: 169403 - RNA, 22 nt, Homo sapiens
ggcagcgugcacuuucgccacu

SEQ ID NO: 169404 - RNA, 17 nt, Homo sapiens
ggcaggaauuaauguca

SEQ ID NO: 169405 - RNA, 17 nt, Homo sapiens
ggcaggauccaggaucc

SEQ ID NO: 169406 - RNA, 22 nt, Homo sapiens
ggcaguguggcugcauauagca

SEQ ID NO: 169407 - RNA, 22 nt, Homo sapiens
ggcaguguuauuauauuuuugg

SEQ ID NO: 169408 - RNA, 22 nt, Homo sapiens
ggcaugaggccauaaaaguaag

SEQ ID NO: 169409 - RNA, 22 nt, Homo sapiens
ggcuacauuguuacaauuagua

SEQ ID NO: 169410 - RNA, 22 nt, Homo sapiens
ggcuauagauaugugaacacuu

SEQ ID NO: 169411 - RNA, 22 nt, Homo sapiens
ggcucaguuuccuccgucugcu

SEQ ID NO: 169412 - RNA, 18 nt, Homo sapiens
ggcugguguuuuaguaua

SEQ ID NO: 169413 - RNA, 22 nt, Homo sapiens
ggcugguuuucaguuacugagu

SEQ ID NO: 169414 - RNA, 22 nt, Homo sapiens
gggaaaaugucuauugaaugaa

SEQ ID NO: 169415 - RNA, 22 nt, Homo sapiens
gggaggucauuguaaggucuua

SEQ ID NO: 169416 - RNA, 22 nt, Homo sapiens
gggaugaagaagaauaguucgu

SEQ ID NO: 169417 - RNA, 22 nt, Homo sapiens
gggaugaagcccuaggguuggu

SEQ ID NO: 169418 - RNA, 22 nt, Homo sapiens
gggaugaauuagguauguuuau

SEQ ID NO: 169419 - RNA, 21 nt, Homo sapiens
agcuuguguguaucacagugu

SEQ ID NO: 169420 - RNA, 22 nt, Homo sapiens
agcuuguuuuauagaaagucaa

SEQ ID NO: 169421 - RNA, 22 nt, Homo sapiens
aggaagcuagcauuuguucagu

SEQ ID NO: 169422 - RNA, 22 nt, Homo sapiens
aggaaugcuaaguuuuccuccu

SEQ ID NO: 169423 - RNA, 19 nt, Homo sapiens
aggacuaaagacuagaagu

SEQ ID NO: 169424 - RNA, 21 nt, Homo sapiens
aggagcauucaugacgagguu

SEQ ID NO: 169425 - RNA, 22 nt, Homo sapiens
aggaggauugcuuucaucuuuu

SEQ ID NO: 169426 - RNA, 22 nt, Homo sapiens
aggagguagaacauugccauuu

SEQ ID NO: 169427 - RNA, 22 nt, Homo sapiens
aggcacggugucucaugccugu

SEQ ID NO: 169428 - RNA, 22 nt, Homo sapiens
aggcaguuucagugagagguga

SEQ ID NO: 169429 - RNA, 22 nt, Homo sapiens
aggcaugauggcuccagaucau

SEQ ID NO: 169430 - RNA, 22 nt, Homo sapiens
aggcaugguggcacauacaugu

SEQ ID NO: 169431 - RNA, 22 nt, Homo sapiens
agggcaagacuuguuaagaaca

SEQ ID NO: 169432 - RNA, 22 nt, Homo sapiens
aggucccauguccucccugacc

SEQ ID NO: 169433 - RNA, 22 nt, Homo sapiens
aggugcaugcuucacuggauau

SEQ ID NO: 169434 - RNA, 22 nt, Homo sapiens
aggugcucuuccuguaggucac

SEQ ID NO: 169435 - RNA, 22 nt, Homo sapiens
aggugcugagcagagaauccug

SEQ ID NO: 169436 - RNA, 22 nt, Homo sapiens
aggugguguuggguuccagccc

SEQ ID NO: 169437 - RNA, 22 nt, Homo sapiens
aggugguuuugaugagcaggua

SEQ ID NO: 169438 - RNA, 22 nt, Homo sapiens
agguuguugcaugcuccuuagg

SEQ ID NO: 169439 - RNA, 22 nt, Homo sapiens
aguacacuguugaacagaagug

SEQ ID NO: 169440 - RNA, 23 nt, Homo sapiens
aguacuguaguaauugaggggaa

SEQ ID NO: 169441 - RNA, 17 nt, Homo sapiens
aguacugucccauccuu

SEQ ID NO: 169442 - RNA, 22 nt, Homo sapiens
aguacugucugguuaccugaca

SEQ ID NO: 169443 - RNA, 22 nt, Homo sapiens
aguauguagugcaaucagucag

SEQ ID NO: 169444 - RNA, 22 nt, Homo sapiens
agucaaggaggccuuucagaug

SEQ ID NO: 169445 - RNA, 22 nt, Homo sapiens
agucaguguguauugauggcac

SEQ ID NO: 169446 - RNA, 22 nt, Homo sapiens
agucaugggagagaugugaucg

SEQ ID NO: 169447 - RNA, 22 nt, Homo sapiens
aguccauuugaugaugauucca

SEQ ID NO: 169448 - RNA, 22 nt, Homo sapiens
agugcacuccagccugggcaac

SEQ ID NO: 169449 - RNA, 22 nt, Homo sapiens
agugcaguggcucaaaaugccu

SEQ ID NO: 169450 - RNA, 22 nt, Homo sapiens
agugcauugcaucucugcuuca

SEQ ID NO: 169451 - RNA, 22 nt, Homo sapiens
aguggauuuuauuugacaacua

SEQ ID NO: 169452 - RNA, 22 nt, Homo sapiens
aguggugucugaguggccaggg

SEQ ID NO: 169453 - RNA, 22 nt, Homo sapiens
agugucaggagacagguagcug

SEQ ID NO: 169454 - RNA, 22 nt, Homo sapiens
aguguuuuuacaagcacucugg

SEQ ID NO: 169455 - RNA, 22 nt, Homo sapiens
aguguuuuuaucaugaaagggu

SEQ ID NO: 169456 - RNA, 22 nt, Homo sapiens
aguuuuugcugauagcaugcuu

SEQ ID NO: 169457 - RNA, 22 nt, Homo sapiens
auaaaugcuuagaucuguauau

SEQ ID NO: 169458 - RNA, 20 nt, Homo sapiens
auaaauguauagguguacau

SEQ ID NO: 169459 - RNA, 22 nt, Homo sapiens
auaacagcauuauugcauacgu

SEQ ID NO: 169460 - RNA, 22 nt, Homo sapiens
auaagaagugaaccagacgucu

SEQ ID NO: 169461 - RNA, 19 nt, Homo sapiens
auaauuagcagugaggaca

SEQ ID NO: 169462 - RNA, 22 nt, Homo sapiens
auacagguauacaaugcauaau

SEQ ID NO: 169463 - RNA, 22 nt, Homo sapiens
auacaguauggagggcccagcu

SEQ ID NO: 169464 - RNA, 22 nt, Homo sapiens
auacagugaauacuuacagugu

SEQ ID NO: 169465 - RNA, 22 nt, Homo sapiens
auacaguguucugggaagaagu

SEQ ID NO: 169466 - RNA, 22 nt, Homo sapiens
auacaguugccauuucuugugc

SEQ ID NO: 169467 - RNA, 22 nt, Homo sapiens
auacaugugcaggucagguuac

SEQ ID NO: 169468 - RNA, 22 nt, Homo sapiens
auacccugucgugagucagaga

SEQ ID NO: 169469 - RNA, 21 nt, Homo sapiens
auacuugcauccuuggagaga

SEQ ID NO: 169470 - RNA, 22 nt, Homo sapiens
auagaaucaucugugcacuagu

SEQ ID NO: 169471 - RNA, 21 nt, Homo sapiens
auagcacaucagauuuuauua

SEQ ID NO: 169472 - RNA, 22 nt, Homo sapiens
auagcagaagaagggacaauuc

SEQ ID NO: 169473 - RNA, 22 nt, Homo sapiens
auagcagugccccaaacuccug

SEQ ID NO: 169474 - RNA, 22 nt, Homo sapiens
auagcagugugaaaacagacua

SEQ ID NO: 169475 - RNA, 22 nt, Homo sapiens
auagugcugcaacaaauauacg

SEQ ID NO: 169476 - RNA, 22 nt, Homo sapiens
auagugcugcaaucaacauaca

SEQ ID NO: 169477 - RNA, 22 nt, Homo sapiens
auagugcugcaauuaacauaca

SEQ ID NO: 169478 - RNA, 22 nt, Homo sapiens
auauagcaaugaaagagaugaa

SEQ ID NO: 169479 - RNA, 22 nt, Homo sapiens
auaucacaaacaagucuguacu

SEQ ID NO: 169480 - RNA, 22 nt, Homo sapiens
auaucacagguguuuaccugau

SEQ ID NO: 169481 - RNA, 17 nt, Homo sapiens
auaugaauuuuggagau

SEQ ID NO: 169482 - RNA, 22 nt, Homo sapiens
auaugcaaauccauagagacag

SEQ ID NO: 169483 - RNA, 22 nt, Homo sapiens
auaugcacuauacacacguaua

SEQ ID NO: 169484 - RNA, 20 nt, Homo sapiens
auaugcagacacauacauac

SEQ ID NO: 169485 - RNA, 19 nt, Homo sapiens
auaugggguuugaacugug

SEQ ID NO: 169486 - RNA, 22 nt, Homo sapiens
auaugguacuuaugcucaaacu

SEQ ID NO: 169487 - RNA, 22 nt, Homo sapiens
auauucaagugaggauggcuaa

SEQ ID NO: 169488 - RNA, 22 nt, Homo sapiens
auauuguuggcugcuggcugau

SEQ ID NO: 169489 - RNA, 22 nt, Homo sapiens
aucaaaguaggcauauguuuuu

SEQ ID NO: 169490 - RNA, 22 nt, Homo sapiens
aucaaagugaaauauuaguuau

SEQ ID NO: 169491 - RNA, 22 nt, Homo sapiens
aucacaauuguacguaggagcc

SEQ ID NO: 169492 - RNA, 22 nt, Homo sapiens
aucacagcuacuccucugucuu

SEQ ID NO: 169493 - RNA, 22 nt, Homo sapiens
aucacagguacuauggcugaca

SEQ ID NO: 169494 - RNA, 22 nt, Homo sapiens
aucaccagaugcuucaagcaga

SEQ ID NO: 169495 - RNA, 22 nt, Homo sapiens
aucagauaccuguugggaaaug

SEQ ID NO: 169496 - RNA, 19 nt, Homo sapiens
aucagcacaagugugcuuu

SEQ ID NO: 169497 - RNA, 22 nt, Homo sapiens
aucagcauucccaaaugaugug

SEQ ID NO: 169498 - RNA, 23 nt, Homo sapiens
aucagguuguagaauguguuugc

SEQ ID NO: 169499 - RNA, 22 nt, Homo sapiens
aucagugaaagugaaaucuccg

SEQ ID NO: 169500 - RNA, 22 nt, Homo sapiens
aucagugcauguuuguugagcu

SEQ ID NO: 169501 - RNA, 22 nt, Homo sapiens
aucauggaguauuugcaagucu

SEQ ID NO: 169502 - RNA, 22 nt, Homo sapiens
gugggguaggcaauuccuagug

SEQ ID NO: 169503 - RNA, 22 nt, Homo sapiens
gugguguccugcaccuauaguc

SEQ ID NO: 169504 - RNA, 22 nt, Homo sapiens
gugguuuucaacuccaccugca

SEQ ID NO: 169505 - RNA, 22 nt, Homo sapiens
guguaaaucaaucuguugucuu

SEQ ID NO: 169506 - RNA, 22 nt, Homo sapiens
guguauauccuauuaguucugu

SEQ ID NO: 169507 - RNA, 21 nt, Homo sapiens
gugucacagacaugacagaug

SEQ ID NO: 169508 - RNA, 22 nt, Homo sapiens
gugucccagugugcauacaggu

SEQ ID NO: 169509 - RNA, 18 nt, Homo sapiens
gugucugguuaugggagu

SEQ ID NO: 169510 - RNA, 22 nt, Homo sapiens
gugugacugcucuauuagggcg

SEQ ID NO: 169511 - RNA, 22 nt, Homo sapiens
gugugauuguuaauuuuaggug

SEQ ID NO: 169512 - RNA, 22 nt, Homo sapiens
guguuaaucucaaguacucuca

SEQ ID NO: 169513 - RNA, 22 nt, Homo sapiens
guguuugguugauagagccacu

SEQ ID NO: 169514 - RNA, 22 nt, Homo sapiens
guucaaggaauguuggcuucuc

SEQ ID NO: 169515 - RNA, 22 nt, Homo sapiens
guucaaguuuucucuugugggu

SEQ ID NO: 169516 - RNA, 20 nt, Homo sapiens
guucacagagguuaugauua

SEQ ID NO: 169517 - RNA, 22 nt, Homo sapiens
guucacagugguugccuuccag

SEQ ID NO: 169518 - RNA, 22 nt, Homo sapiens
guucacaguuucuaaucccagc

SEQ ID NO: 169519 - RNA, 22 nt, Homo sapiens
guugaaaucaucacuuggcaug

SEQ ID NO: 169520 - RNA, 22 nt, Homo sapiens
guugcagcacacaggcugucag

SEQ ID NO: 169521 - RNA, 22 nt, Homo sapiens
guugcucaggccggagugcagu

SEQ ID NO: 169522 - RNA, 22 nt, Homo sapiens
guugcugagucccaucaccaga

SEQ ID NO: 169523 - RNA, 22 nt, Homo sapiens
guuggugaccugaagagaguaa

SEQ ID NO: 169524 - RNA, 22 nt, Homo sapiens
guuuggcucuuguuucugucaa

SEQ ID NO: 169525 - RNA, 22 nt, Homo sapiens
guuuggcuuucucucuauccug

SEQ ID NO: 169526 - RNA, 22 nt, Homo sapiens
guuugugguuaaagccuuucau

SEQ ID NO: 169527 - RNA, 22 nt, Homo sapiens
uaaacacucacuucauagccau

SEQ ID NO: 169528 - RNA, 22 nt, Homo sapiens
uaaagaugcugggaaggcuagg

SEQ ID NO: 169529 - RNA, 22 nt, Homo sapiens
uaaagccauugucaaguuugua

SEQ ID NO: 169530 - RNA, 22 nt, Homo sapiens
uaaagcugaaaugauuaugaca

SEQ ID NO: 169531 - RNA, 20 nt, Homo sapiens
uaaagcugcucagggggcuc

SEQ ID NO: 169532 - RNA, 22 nt, Homo sapiens
uaaagcuuagauccaugguggc

SEQ ID NO: 169533 - RNA, 22 nt, Homo sapiens
uaaagcuuggauuuaggcuaau

SEQ ID NO: 169534 - RNA, 22 nt, Homo sapiens
uaaaguuauugccccucaguua

SEQ ID NO: 169535 - RNA, 22 nt, Homo sapiens
uaaaugcucuuuaaaagugcuu

SEQ ID NO: 169536 - RNA, 19 nt, Homo sapiens
uaacacaguuguguuugag

SEQ ID NO: 169537 - RNA, 22 nt, Homo sapiens
uaacaccuuugauagcacuuuu

SEQ ID NO: 169538 - RNA, 22 nt, Homo sapiens
uaacagcauuugugucuaguag

SEQ ID NO: 169539 - RNA, 22 nt, Homo sapiens
uaacaguauaugugguaucuau

SEQ ID NO: 169540 - RNA, 22 nt, Homo sapiens
uaacaguauauuuaccaaaccu

SEQ ID NO: 169541 - RNA, 22 nt, Homo sapiens
uaacccuuaguaucuguggguu

SEQ ID NO: 169542 - RNA, 22 nt, Homo sapiens
uaacuacuucugcuucagagua

SEQ ID NO: 169543 - RNA, 22 nt, Homo sapiens
uaacuagaaaggagacaguugc

SEQ ID NO: 169544 - RNA, 23 nt, Homo sapiens
uaagacacuaacuuuaugcuuug

SEQ ID NO: 169545 - RNA, 22 nt, Homo sapiens
uaagacacuuaaaauguuacau

SEQ ID NO: 169546 - RNA, 22 nt, Homo sapiens
uaagacuuuuugggaauauaga

SEQ ID NO: 169547 - RNA, 22 nt, Homo sapiens
uaagagagcuccaucuuuuccu

SEQ ID NO: 169548 - RNA, 22 nt, Homo sapiens
uaagagcuaggauuuuaaauca

SEQ ID NO: 169549 - RNA, 22 nt, Homo sapiens
uaagcaguaaaugaagucuugc

SEQ ID NO: 169550 - RNA, 22 nt, Homo sapiens
uaagcagugcaagaauggaaua

SEQ ID NO: 169551 - RNA, 22 nt, Homo sapiens
uaaggaaccagaaguggguagc

SEQ ID NO: 169552 - RNA, 22 nt, Homo sapiens
uaaggcaaguuuuuaguggaca

SEQ ID NO: 169553 - RNA, 22 nt, Homo sapiens
uaaggcacauaggccuggaaac

SEQ ID NO: 169554 - RNA, 22 nt, Homo sapiens
uaaggcacccuucugaguagag

SEQ ID NO: 169555 - RNA, 22 nt, Homo sapiens
uaaggcacucuucugugugccu

SEQ ID NO: 169556 - RNA, 22 nt, Homo sapiens
uaagguauuuacauuucuguuu

SEQ ID NO: 169557 - RNA, 22 nt, Homo sapiens
uaaguaauugcagcaauuugcc

SEQ ID NO: 169558 - RNA, 22 nt, Homo sapiens
uaaguagaggaaucauuuugug

SEQ ID NO: 169559 - RNA, 22 nt, Homo sapiens
uaaguauuuuaauuccuggcau

SEQ ID NO: 169560 - RNA, 22 nt, Homo sapiens
uaagucuuuuuggaguuuauaa

SEQ ID NO: 169561 - RNA, 22 nt, Homo sapiens
uaagugcaugauuacaugcaua

SEQ ID NO: 169562 - RNA, 22 nt, Homo sapiens
uaauaauguuaggcuuacucaa

SEQ ID NO: 169563 - RNA, 22 nt, Homo sapiens
uaauacuguaauggugguuccg

SEQ ID NO: 169564 - RNA, 22 nt, Homo sapiens
uaauaguuucagaaguuguuuu

SEQ ID NO: 169565 - RNA, 22 nt, Homo sapiens
uaaucucagcuacucaggaggc

SEQ ID NO: 169566 - RNA, 22 nt, Homo sapiens
uaaugcucauuagcaggccaau

SEQ ID NO: 169567 - RNA, 22 nt, Homo sapiens
uaaugugaauagugcuguaaug

SEQ ID NO: 169568 - RNA, 22 nt, Homo sapiens
uaauucugacaacaguggcguu

SEQ ID NO: 169569 - RNA, 19 nt, Homo sapiens
gggcaaaucuggaaauuua

SEQ ID NO: 169570 - RNA, 22 nt, Homo sapiens
gggcaacauugaguacccugaa

SEQ ID NO: 169571 - RNA, 22 nt, Homo sapiens
gggcauaucacuugaggucagg

SEQ ID NO: 169572 - RNA, 22 nt, Homo sapiens
gggcaugaugucuuaugccuau

SEQ ID NO: 169573 - RNA, 22 nt, Homo sapiens
gggguauguaagugagugagug

SEQ ID NO: 169574 - RNA, 22 nt, Homo sapiens
ggucaggagaaugguaacugag

SEQ ID NO: 169575 - RNA, 22 nt, Homo sapiens
ggucccccuccacucucgcaaa

SEQ ID NO: 169576 - RNA, 22 nt, Homo sapiens
ggugacugguuuaucuggcagu

SEQ ID NO: 169577 - RNA, 21 nt, Homo sapiens
ggugagaaaggagacauagac

SEQ ID NO: 169578 - RNA, 22 nt, Homo sapiens
ggugagaaagggauuccuguuc

SEQ ID NO: 169579 - RNA, 22 nt, Homo sapiens
ggugagauaucugcugauguuu

SEQ ID NO: 169580 - RNA, 22 nt, Homo sapiens
ggugaguggugcuuaaguucag

SEQ ID NO: 169581 - RNA, 22 nt, Homo sapiens
ggugauauguugagguuuuggg

SEQ ID NO: 169582 - RNA, 20 nt, Homo sapiens
guaaacucucagcauagaug

SEQ ID NO: 169583 - RNA, 22 nt, Homo sapiens
guaaauguccccugugauauug

SEQ ID NO: 169584 - RNA, 22 nt, Homo sapiens
guaauacuuuugggauauuaga

SEQ ID NO: 169585 - RNA, 22 nt, Homo sapiens
guaaucucaccuacuugggagg

SEQ ID NO: 169586 - RNA, 22 nt, Homo sapiens
guacaguacugaaugaauguau

SEQ ID NO: 169587 - RNA, 22 nt, Homo sapiens
guacaguaguaaaagugaauga

SEQ ID NO: 169588 - RNA, 22 nt, Homo sapiens
guacaugcaugcaugggugugc

SEQ ID NO: 169589 - RNA, 22 nt, Homo sapiens
guagaaagcauuucagauuugc

SEQ ID NO: 169590 - RNA, 22 nt, Homo sapiens
guagagagaaauacaaagcugu

SEQ ID NO: 169591 - RNA, 23 nt, Homo sapiens
guaguuugaugcaauccacuugu

SEQ ID NO: 169592 - RNA, 22 nt, Homo sapiens
guauacuucugaaaauagcuau

SEQ ID NO: 169593 - RNA, 22 nt, Homo sapiens
guaugaaaaucggagauugggu

SEQ ID NO: 169594 - RNA, 22 nt, Homo sapiens
guaugugcauuguaaauuuuga

SEQ ID NO: 169595 - RNA, 22 nt, Homo sapiens
guauugacuaucaaucaugugc

SEQ ID NO: 169596 - RNA, 19 nt, Homo sapiens
gucaaagucgguauucaaa

SEQ ID NO: 169597 - RNA, 22 nt, Homo sapiens
gucaaagucuauuggcuaauuc

SEQ ID NO: 169598 - RNA, 22 nt, Homo sapiens
gucacauugaugcccauggugg

SEQ ID NO: 169599 - RNA, 22 nt, Homo sapiens
gucacuggcugucuuguaugau

SEQ ID NO: 169600 - RNA, 22 nt, Homo sapiens
gucagcaaagaggaauaguuug

SEQ ID NO: 169601 - RNA, 22 nt, Homo sapiens
gucaggcaccgauacaguuuuu

SEQ ID NO: 169602 - RNA, 22 nt, Homo sapiens
gucagggagggauagaugauua

SEQ ID NO: 169603 - RNA, 22 nt, Homo sapiens
gucagugcauguaaacauaaaa

SEQ ID NO: 169604 - RNA, 22 nt, Homo sapiens
gucaguggagaaaaggacaugu

SEQ ID NO: 169605 - RNA, 22 nt, Homo sapiens
gucagugugauaucugcagggg

SEQ ID NO: 169606 - RNA, 22 nt, Homo sapiens
gucauggaacaacuuaaaguca

SEQ ID NO: 169607 - RNA, 22 nt, Homo sapiens
gucccagagauauugugucuuu

SEQ ID NO: 169608 - RNA, 22 nt, Homo sapiens
gucccaguggaaccuccaagcu

SEQ ID NO: 169609 - RNA, 22 nt, Homo sapiens
gucucccaaccccugugcccag

SEQ ID NO: 169610 - RNA, 22 nt, Homo sapiens
gucucccagccuacaucuuucu

SEQ ID NO: 169611 - RNA, 22 nt, Homo sapiens
gucuggcacagggaaaguacaa

SEQ ID NO: 169612 - RNA, 22 nt, Homo sapiens
gucuggcuuaucucacuuacca

SEQ ID NO: 169613 - RNA, 22 nt, Homo sapiens
gucugucuuuugucuuugaaau

SEQ ID NO: 169614 - RNA, 22 nt, Homo sapiens
gucuugaaggcugaguaccugu

SEQ ID NO: 169615 - RNA, 22 nt, Homo sapiens
gucuuggagacauugccauuga

SEQ ID NO: 169616 - RNA, 22 nt, Homo sapiens
gucuuugagauaggguuauuuu

SEQ ID NO: 169617 - RNA, 22 nt, Homo sapiens
gucuuugcauguauguucauga

SEQ ID NO: 169618 - RNA, 22 nt, Homo sapiens
gucuuuggaaagacaaaguuca

SEQ ID NO: 169619 - RNA, 22 nt, Homo sapiens
gugaaagacauauaugguuuga

SEQ ID NO: 169620 - RNA, 22 nt, Homo sapiens
gugacagucaaagacaugacuu

SEQ ID NO: 169621 - RNA, 22 nt, Homo sapiens
gugacugcauauaaguguaugu

SEQ ID NO: 169622 - RNA, 22 nt, Homo sapiens
gugagaggaggcagcuuuuaca

SEQ ID NO: 169623 - RNA, 22 nt, Homo sapiens
gugagcagagaucgcgugauug

SEQ ID NO: 169624 - RNA, 21 nt, Homo sapiens
gugaggaguuacuggcuuuga

SEQ ID NO: 169625 - RNA, 22 nt, Homo sapiens
gugagucagucuguguagggcu

SEQ ID NO: 169626 - RNA, 20 nt, Homo sapiens
gugagucauuaguaaccaaa

SEQ ID NO: 169627 - RNA, 22 nt, Homo sapiens
gugauagguugucacugucacu

SEQ ID NO: 169628 - RNA, 22 nt, Homo sapiens
gugauuauccacgucuuuguga

SEQ ID NO: 169629 - RNA, 22 nt, Homo sapiens
gugcaaauguuauugagguuuu

SEQ ID NO: 169630 - RNA, 22 nt, Homo sapiens
gugcaacaucccuccauaauuu

SEQ ID NO: 169631 - RNA, 22 nt, Homo sapiens
gugcaaccaucaccacugacuc

SEQ ID NO: 169632 - RNA, 22 nt, Homo sapiens
gugcaagagugacugcaguuuu

SEQ ID NO: 169633 - RNA, 22 nt, Homo sapiens
acagugcuucugauaugaugcc

SEQ ID NO: 169634 - RNA, 22 nt, Homo sapiens
acagugcuuggcacacaguaau

SEQ ID NO: 169635 - RNA, 19 nt, Homo sapiens
acagugcuuugucagaagc

SEQ ID NO: 169636 - RNA, 22 nt, Homo sapiens
acaugguacugauuuacgaaau

SEQ ID NO: 169637 - RNA, 22 nt, Homo sapiens
acauugcucuuaccaaguuugu

SEQ ID NO: 169638 - RNA, 22 nt, Homo sapiens
acccgugcugaauauguaggug

SEQ ID NO: 169639 - RNA, 21 nt, Homo sapiens
acccucuaguuuucaacaggc

SEQ ID NO: 169640 - RNA, 22 nt, Homo sapiens
acccugacacgauucuucacuu

SEQ ID NO: 169641 - RNA, 22 nt, Homo sapiens
acccuggauucguggccuugaa

SEQ ID NO: 169642 - RNA, 22 nt, Homo sapiens
acccuguaacauacaagugguu

SEQ ID NO: 169643 - RNA, 22 nt, Homo sapiens
acccuguaggacuauucuaauc

SEQ ID NO: 169644 - RNA, 22 nt, Homo sapiens
acccuuaagcacuaguucagcu

SEQ ID NO: 169645 - RNA, 22 nt, Homo sapiens
acccuuagguuaaaguugaguc

SEQ ID NO: 169646 - RNA, 22 nt, Homo sapiens
accucagcccggggaaguugag

SEQ ID NO: 169647 - RNA, 22 nt, Homo sapiens
accugcacagccgaacauagac

SEQ ID NO: 169648 - RNA, 22 nt, Homo sapiens
accuggcacuuagcaaaucuga

SEQ ID NO: 169649 - RNA, 23 nt, Homo sapiens
accugugguuauuuuacucuucc

SEQ ID NO: 169650 - RNA, 22 nt, Homo sapiens
acuacauaugacaucuucuuua

SEQ ID NO: 169651 - RNA, 22 nt, Homo sapiens
acuaugagacgaaugcaucagu

SEQ ID NO: 169652 - RNA, 22 nt, Homo sapiens
acucagagaacauucccagucu

SEQ ID NO: 169653 - RNA, 22 nt, Homo sapiens
acucagagagaacugucauuug

SEQ ID NO: 169654 - RNA, 22 nt, Homo sapiens
acucauugcucauaccuuaucu

SEQ ID NO: 169655 - RNA, 22 nt, Homo sapiens
acugcacuccagcccgggugac

SEQ ID NO: 169656 - RNA, 22 nt, Homo sapiens
acugcacuccagccuccugggu

SEQ ID NO: 169657 - RNA, 22 nt, Homo sapiens
acugcacuccagccugccgaca

SEQ ID NO: 169658 - RNA, 22 nt, Homo sapiens
acugcacuccagccugcugaca

SEQ ID NO: 169659 - RNA, 22 nt, Homo sapiens
acugcacuccagccugugagac

SEQ ID NO: 169660 - RNA, 22 nt, Homo sapiens
acugcacuccagccuuggcaac

SEQ ID NO: 169661 - RNA, 22 nt, Homo sapiens
acuggcuuaaggaugggccacu

SEQ ID NO: 169662 - RNA, 22 nt, Homo sapiens
acuggcuuuugagaaaaacacu

SEQ ID NO: 169663 - RNA, 22 nt, Homo sapiens
acuggguuaauuugaagguuga

SEQ ID NO: 169664 - RNA, 22 nt, Homo sapiens
acuguacuccagccugggugac

SEQ ID NO: 169665 - RNA, 22 nt, Homo sapiens
acuguguguuugucuagcacag

SEQ ID NO: 169666 - RNA, 22 nt, Homo sapiens
acuuaguauggggcuuuugaga

SEQ ID NO: 169667 - RNA, 21 nt, Homo sapiens
acuuucuguggcaguccauuc

SEQ ID NO: 169668 - RNA, 22 nt, Homo sapiens
acuuuuugaugaggucguuugu

SEQ ID NO: 169669 - RNA, 22 nt, Homo sapiens
agaaccaaucccacauggauac

SEQ ID NO: 169670 - RNA, 22 nt, Homo sapiens
agaagugcuggguucaggcugg

SEQ ID NO: 169671 - RNA, 19 nt, Homo sapiens
agaaucuaaauuauuucug

SEQ ID NO: 169672 - RNA, 22 nt, Homo sapiens
agaauguauauucuguaguugu

SEQ ID NO: 169673 - RNA, 22 nt, Homo sapiens
agaauucugucauguuuauauu

SEQ ID NO: 169674 - RNA, 22 nt, Homo sapiens
agacaguguguguauauauggu

SEQ ID NO: 169675 - RNA, 22 nt, Homo sapiens
agaccacuuuagagauuguuca

SEQ ID NO: 169676 - RNA, 22 nt, Homo sapiens
agacuagaaaucauuuguugag

SEQ ID NO: 169677 - RNA, 19 nt, Homo sapiens
agacuggcccaggcgggug

SEQ ID NO: 169678 - RNA, 22 nt, Homo sapiens
agagaacugauuggaugugggc

SEQ ID NO: 169679 - RNA, 19 nt, Homo sapiens
agagacucauuguagcauu

SEQ ID NO: 169680 - RNA, 22 nt, Homo sapiens
agagauuauccuggcuucucug

SEQ ID NO: 169681 - RNA, 23 nt, Homo sapiens
agagguuuaaucaggcaguugcu

SEQ ID NO: 169682 - RNA, 20 nt, Homo sapiens
agagguuuugauagguucug

SEQ ID NO: 169683 - RNA, 22 nt, Homo sapiens
agagugaagcuuuuuauauucu

SEQ ID NO: 169684 - RNA, 22 nt, Homo sapiens
agagugcaauggcaccaucucg

SEQ ID NO: 169685 - RNA, 22 nt, Homo sapiens
agagugcuaaggaaguaauuua

SEQ ID NO: 169686 - RNA, 20 nt, Homo sapiens
agagugcuggacugaggagc

SEQ ID NO: 169687 - RNA, 20 nt, Homo sapiens
agagugcugucuguccugag

SEQ ID NO: 169688 - RNA, 22 nt, Homo sapiens
agauacaucuaugugucugugu

SEQ ID NO: 169689 - RNA, 22 nt, Homo sapiens
agaucauaugcaguaaugaacu

SEQ ID NO: 169690 - RNA, 23 nt, Homo sapiens
agauggcauuucaguucuuuagg

SEQ ID NO: 169691 - RNA, 22 nt, Homo sapiens
agcacagugguuaaguuucuua

SEQ ID NO: 169692 - RNA, 22 nt, Homo sapiens
agcaccauuucucuaaagcacu

SEQ ID NO: 169693 - RNA, 22 nt, Homo sapiens
agcagcaugaggggacuucugc

SEQ ID NO: 169694 - RNA, 22 nt, Homo sapiens
agcagcuuugcauggccugugg

SEQ ID NO: 169695 - RNA, 21 nt, Homo sapiens
agcagcuuugguugaagcaga

SEQ ID NO: 169696 - RNA, 22 nt, Homo sapiens
agcagguguccacaauguuugc

SEQ ID NO: 169697 - RNA, 16 nt, Homo sapiens
agcagguguuagguga

SEQ ID NO: 169698 - RNA, 22 nt, Homo sapiens
agcauggucacuuugggcccca

SEQ ID NO: 169699 - RNA, 20 nt, Homo sapiens
agcauugguuagaacaguag

SEQ ID NO: 169700 - RNA, 22 nt, Homo sapiens
agccaagacucuguuccccuug

SEQ ID NO: 169701 - RNA, 19 nt, Homo sapiens
agccaguuuucccagcacc

SEQ ID NO: 169702 - RNA, 17 nt, Homo sapiens
agccccauuagcuaguu

SEQ ID NO: 169703 - RNA, 23 nt, Homo sapiens
agccugguuucccugcuucuccc

SEQ ID NO: 169704 - RNA, 22 nt, Homo sapiens
agcuagcauucauaguuugagg

SEQ ID NO: 169705 - RNA, 22 nt, Homo sapiens
agcuccaucuucagggguucag

SEQ ID NO: 169706 - RNA, 22 nt, Homo sapiens
agcugcauucguaucauauugu

SEQ ID NO: 169707 - RNA, 22 nt, Homo sapiens
agcugccagucuuguaaggccu

SEQ ID NO: 169708 - RNA, 22 nt, Homo sapiens
agcuggaauuuaagguagauag

SEQ ID NO: 169709 - RNA, 22 nt, Homo sapiens
agcuggauuguuuaccuggggc

SEQ ID NO: 169710 - RNA, 22 nt, Homo sapiens
agcuggcuguggagaaaccccu

SEQ ID NO: 169711 - RNA, 22 nt, Homo sapiens
agcugguaugaaaaucucccca

SEQ ID NO: 169712 - RNA, 22 nt, Homo sapiens
agcugguauuuugucgaggacu

SEQ ID NO: 169713 - RNA, 22 nt, Homo sapiens
agcuggucuuggggaagaguag

SEQ ID NO: 169714 - RNA, 20 nt, Homo sapiens
agcugguuuuaugaaucuuu

SEQ ID NO: 169715 - RNA, 22 nt, Homo sapiens
agcuucauucugaauagguuga

SEQ ID NO: 169716 - RNA, 22 nt, Homo sapiens
aaccuuuagucagcucuuagga

SEQ ID NO: 169717 - RNA, 22 nt, Homo sapiens
aacuacaucucuuugaggcagg

SEQ ID NO: 169718 - RNA, 22 nt, Homo sapiens
aacuggcauaugaacuuguucu

SEQ ID NO: 169719 - RNA, 22 nt, Homo sapiens
aacuggcauauucugguugcgg

SEQ ID NO: 169720 - RNA, 22 nt, Homo sapiens
aacuggcauguuuuaaggcuua

SEQ ID NO: 169721 - RNA, 19 nt, Homo sapiens
aacuggugugagaugauau

SEQ ID NO: 169722 - RNA, 22 nt, Homo sapiens
aagagaugaagguccugacugu

SEQ ID NO: 169723 - RNA, 22 nt, Homo sapiens
aagagcauuggauggggagauu

SEQ ID NO: 169724 - RNA, 22 nt, Homo sapiens
aagaugauguuguguuuucacu

SEQ ID NO: 169725 - RNA, 22 nt, Homo sapiens
aagcagacauguucauuuugaa

SEQ ID NO: 169726 - RNA, 22 nt, Homo sapiens
aagcaggugaugagugggugug

SEQ ID NO: 169727 - RNA, 22 nt, Homo sapiens
aagcaucauuuggaauuugaga

SEQ ID NO: 169728 - RNA, 22 nt, Homo sapiens
aagcaugguuuccaggggucac

SEQ ID NO: 169729 - RNA, 22 nt, Homo sapiens
aagcugccuugcugaggagaaa

SEQ ID NO: 169730 - RNA, 22 nt, Homo sapiens
aagcuggagugcaguggugcaa

SEQ ID NO: 169731 - RNA, 22 nt, Homo sapiens
aagcuggauuucgcauccuguu

SEQ ID NO: 169732 - RNA, 22 nt, Homo sapiens
aagcugguguugcugcucuguu

SEQ ID NO: 169733 - RNA, 22 nt, Homo sapiens
aagcuguuguucauccugaauu

SEQ ID NO: 169734 - RNA, 22 nt, Homo sapiens
aaggaauacuggugguugcuau

SEQ ID NO: 169735 - RNA, 22 nt, Homo sapiens
aaggaguguggugaucuugggc

SEQ ID NO: 169736 - RNA, 22 nt, Homo sapiens
aaggcaacgugaguuguugauu

SEQ ID NO: 169737 - RNA, 22 nt, Homo sapiens
aaggcaagguggauaaugaagc

SEQ ID NO: 169738 - RNA, 22 nt, Homo sapiens
aaggcagucacuaaauagugag

SEQ ID NO: 169739 - RNA, 22 nt, Homo sapiens
aaggcaguggcagaagauguca

SEQ ID NO: 169740 - RNA, 22 nt, Homo sapiens
aaggcaugcaguacguuucuau

SEQ ID NO: 169741 - RNA, 22 nt, Homo sapiens
aaggcauggugacuauuuaggc

SEQ ID NO: 169742 - RNA, 22 nt, Homo sapiens
aaggcauucucaaacuaguucu

SEQ ID NO: 169743 - RNA, 22 nt, Homo sapiens
aaggcuauuugagaaugugugu

SEQ ID NO: 169744 - RNA, 22 nt, Homo sapiens
aaggugcuguaagcauccaugu

SEQ ID NO: 169745 - RNA, 22 nt, Homo sapiens
aaguaauggaguuauuuuauga

SEQ ID NO: 169746 - RNA, 22 nt, Homo sapiens
aaguauuagcuaauugugcuua

SEQ ID NO: 169747 - RNA, 22 nt, Homo sapiens
aaguauuaugaguccuuguuuu

SEQ ID NO: 169748 - RNA, 22 nt, Homo sapiens
aagugagugacaaaaacugggc

SEQ ID NO: 169749 - RNA, 22 nt, Homo sapiens
aagugauguuauugggugacuc

SEQ ID NO: 169750 - RNA, 22 nt, Homo sapiens
aagugcauguauuaguguaguc

SEQ ID NO: 169751 - RNA, 22 nt, Homo sapiens
aagugcuguccuaccuuuggga

SEQ ID NO: 169752 - RNA, 22 nt, Homo sapiens
aagugcuuacagggaacaugau

SEQ ID NO: 169753 - RNA, 22 nt, Homo sapiens
aagugcuuuacacaugcaugau

SEQ ID NO: 169754 - RNA, 22 nt, Homo sapiens
aagugcuuuuuagauaugguuu

SEQ ID NO: 169755 - RNA, 22 nt, Homo sapiens
aaguggaauguuuguggcacaa

SEQ ID NO: 169756 - RNA, 22 nt, Homo sapiens
aaguggccuagagcgaccauuu

SEQ ID NO: 169757 - RNA, 23 nt, Homo sapiens
aaguucaugcucaucuguuacac

SEQ ID NO: 169758 - RNA, 22 nt, Homo sapiens
aauaaagcagcuuuuugggacu

SEQ ID NO: 169759 - RNA, 22 nt, Homo sapiens
aauaaagccugucucuuuagag

SEQ ID NO: 169760 - RNA, 22 nt, Homo sapiens
aauaagcugagagaauucuaca

SEQ ID NO: 169761 - RNA, 22 nt, Homo sapiens
aauaucacaguggguguacacc

SEQ ID NO: 169762 - RNA, 22 nt, Homo sapiens
aauaucuguguauagauggggg

SEQ ID NO: 169763 - RNA, 22 nt, Homo sapiens
aaucagagcccucugagcuuca

SEQ ID NO: 169764 - RNA, 22 nt, Homo sapiens
aaucauauugucugccaagagg

SEQ ID NO: 169765 - RNA, 22 nt, Homo sapiens
aauccauuugccgucuauccau

SEQ ID NO: 169766 - RNA, 22 nt, Homo sapiens
aaugacagugcuaaagaacccu

SEQ ID NO: 169767 - RNA, 22 nt, Homo sapiens
aaugauauguuauguuuagguu

SEQ ID NO: 169768 - RNA, 22 nt, Homo sapiens
aauggcacaagacaugaagaag

SEQ ID NO: 169769 - RNA, 22 nt, Homo sapiens
aauggcacuuuauaaauguuaa

SEQ ID NO: 169770 - RNA, 22 nt, Homo sapiens
aauggcaguagauggaugggua

SEQ ID NO: 169771 - RNA, 22 nt, Homo sapiens
aauggcauuugccagggcaaag

SEQ ID NO: 169772 - RNA, 22 nt, Homo sapiens
aauggcucugauguuguuguga

SEQ ID NO: 169773 - RNA, 22 nt, Homo sapiens
aauggcucuguuggcccaagac

SEQ ID NO: 169774 - RNA, 22 nt, Homo sapiens
aauggcuuucagcuuuucccca

SEQ ID NO: 169775 - RNA, 22 nt, Homo sapiens
aaugggacugacgccucccaga

SEQ ID NO: 169776 - RNA, 22 nt, Homo sapiens
aaugugcacuuggagccuugcu

SEQ ID NO: 169777 - RNA, 22 nt, Homo sapiens
aauuacuucuacaccaaccuaa

SEQ ID NO: 169778 - RNA, 22 nt, Homo sapiens
aauuaggcuagaauguuauuaa

SEQ ID NO: 169779 - RNA, 22 nt, Homo sapiens
aauuaguuggcugccuaugauu

SEQ ID NO: 169780 - RNA, 22 nt, Homo sapiens
aauugccucaagugaucauggc

SEQ ID NO: 169781 - RNA, 22 nt, Homo sapiens
acaaaguauggaauguuggugu

SEQ ID NO: 169782 - RNA, 22 nt, Homo sapiens
acaaagugccuccuuuuagagu

SEQ ID NO: 169783 - RNA, 17 nt, Homo sapiens
acaaauugccagcuagg

SEQ ID NO: 169784 - RNA, 22 nt, Homo sapiens
acacaaugguaaguguuugugu

SEQ ID NO: 169785 - RNA, 22 nt, Homo sapiens
acacaguaagcacaguguagau

SEQ ID NO: 169786 - RNA, 22 nt, Homo sapiens
acacauacacauaugguguaua

SEQ ID NO: 169787 - RNA, 22 nt, Homo sapiens
acacaugugaaaaaaauguuac

SEQ ID NO: 169788 - RNA, 22 nt, Homo sapiens
acacaugugcguagacucuuua

SEQ ID NO: 169789 - RNA, 22 nt, Homo sapiens
acaccauugcauuccagccugg

SEQ ID NO: 169790 - RNA, 22 nt, Homo sapiens
acacuacuggguauauguguuu

SEQ ID NO: 169791 - RNA, 22 nt, Homo sapiens
acacucucucauuacuuguuug

SEQ ID NO: 169792 - RNA, 22 nt, Homo sapiens
acacugucaugucucacaggca

SEQ ID NO: 169793 - RNA, 22 nt, Homo sapiens
acacuguugacauuuuguagug

SEQ ID NO: 169794 - RNA, 22 nt, Homo sapiens
acagaacugggcuugcuuuugg

SEQ ID NO: 169795 - RNA, 22 nt, Homo sapiens
acagagcaaugagcuacggucu

SEQ ID NO: 169796 - RNA, 20 nt, Homo sapiens
acagcacugguuucaagcaa

SEQ ID NO: 169797 - RNA, 22 nt, Homo sapiens
acaguacuuuuggauuugugaa

SEQ ID NO: 169798 - RNA, 20 nt, Homo sapiens
acaguagaagggauuucaaa

SEQ ID NO: 169799 - RNA, 22 nt, Homo sapiens
ugcauuguauuguugacucgcc

SEQ ID NO: 169800 - RNA, 21 nt, Homo sapiens
ugcauugucuugaguuuaaau

SEQ ID NO: 169801 - RNA, 22 nt, Homo sapiens
ugcauuguggaucuaaaugcau

SEQ ID NO: 169802 - RNA, 22 nt, Homo sapiens
ugccaagaacauuuucuguuuu

SEQ ID NO: 169803 - RNA, 22 nt, Homo sapiens
ugccaguauuuuauugagcauu

SEQ ID NO: 169804 - RNA, 22 nt, Homo sapiens
ugccaguauuuuguugaagauu

SEQ ID NO: 169805 - RNA, 22 nt, Homo sapiens
ugccaugaagagaggaagcagu

SEQ ID NO: 169806 - RNA, 22 nt, Homo sapiens
ugcccguaauuccagcacuuug

SEQ ID NO: 169807 - RNA, 22 nt, Homo sapiens
ugccuacugagacuggguggcc

SEQ ID NO: 169808 - RNA, 22 nt, Homo sapiens
ugccugagcccagcccuguagu

SEQ ID NO: 169809 - RNA, 22 nt, Homo sapiens
ugccuuauuccaacugagcucu

SEQ ID NO: 169810 - RNA, 22 nt, Homo sapiens
ugcuagaugaaguuugaguuuu

SEQ ID NO: 169811 - RNA, 22 nt, Homo sapiens
ugcuaucauugauuagugaugu

SEQ ID NO: 169812 - RNA, 18 nt, Homo sapiens
ugcuaugagauuauuuua

SEQ ID NO: 169813 - RNA, 21 nt, Homo sapiens
ugcucaugaguaaugcaguga

SEQ ID NO: 169814 - RNA, 21 nt, Homo sapiens
ugcuccauuuucuagccugaa

SEQ ID NO: 169815 - RNA, 18 nt, Homo sapiens
ugcuccccugggugagca

SEQ ID NO: 169816 - RNA, 22 nt, Homo sapiens
ugcugcaaucucggcacuuugg

SEQ ID NO: 169817 - RNA, 22 nt, Homo sapiens
ugcugcacaguucuuaagauua

SEQ ID NO: 169818 - RNA, 21 nt, Homo sapiens
ugcugcacuucuuuugcugug

SEQ ID NO: 169819 - RNA, 22 nt, Homo sapiens
ugcugcuguuguuguuacuagc

SEQ ID NO: 169820 - RNA, 22 nt, Homo sapiens
ugcuggugauucagauucaaau

SEQ ID NO: 169821 - RNA, 22 nt, Homo sapiens
ugcuuaggcuuccuuacaguau

SEQ ID NO: 169822 - RNA, 22 nt, Homo sapiens
ugcuuaguuguauguuccacau

SEQ ID NO: 169823 - RNA, 22 nt, Homo sapiens
ugcuugagacacauaugaauuu

SEQ ID NO: 169824 - RNA, 21 nt, Homo sapiens
ugcuuuggucauacuucuucc

SEQ ID NO: 169825 - RNA, 22 nt, Homo sapiens
uggaaaguacugagguccaccu

SEQ ID NO: 169826 - RNA, 22 nt, Homo sapiens
uggaaaguccaagccaaccggg

SEQ ID NO: 169827 - RNA, 22 nt, Homo sapiens
uggaagauggaguuuuaucauu

SEQ ID NO: 169828 - RNA, 22 nt, Homo sapiens
uggaagaugggaccucaguuuu

SEQ ID NO: 169829 - RNA, 22 nt, Homo sapiens
uggaagguaaguuuugagcauu

SEQ ID NO: 169830 - RNA, 22 nt, Homo sapiens
uggaaggucauuguucauuuga

SEQ ID NO: 169831 - RNA, 22 nt, Homo sapiens
uggaaguuaaaugacucuuucu

SEQ ID NO: 169832 - RNA, 22 nt, Homo sapiens
uggaaucuacuaaagcaaaauc

SEQ ID NO: 169833 - RNA, 21 nt, Homo sapiens
uggaauguucugacuucaggg

SEQ ID NO: 169834 - RNA, 22 nt, Homo sapiens
uggacaagauagguucuauauu

SEQ ID NO: 169835 - RNA, 22 nt, Homo sapiens
uggacacuggagauucgucagu

SEQ ID NO: 169836 - RNA, 22 nt, Homo sapiens
gauggaauuaaaaucagaauca

SEQ ID NO: 169837 - RNA, 22 nt, Homo sapiens
gauggaguugucgccugggcug

SEQ ID NO: 169838 - RNA, 22 nt, Homo sapiens
gauggcacuguagcaacacaaa

SEQ ID NO: 169839 - RNA, 22 nt, Homo sapiens
gauuugagagaggguguuuaua

SEQ ID NO: 169840 - RNA, 22 nt, Homo sapiens
gauuuuccaguggcccugauca

SEQ ID NO: 169841 - RNA, 22 nt, Homo sapiens
gcaaaaaguagugcugguuagg

SEQ ID NO: 169842 - RNA, 22 nt, Homo sapiens
gcaaaugcuaugccauuuuaua

SEQ ID NO: 169843 - RNA, 20 nt, Homo sapiens
gcaaauggaucccacaagcc

SEQ ID NO: 169844 - RNA, 22 nt, Homo sapiens
gcaacugguuucaguuuuucag

SEQ ID NO: 169845 - RNA, 22 nt, Homo sapiens
gcacacguagaagcaugcauca

SEQ ID NO: 169846 - RNA, 22 nt, Homo sapiens
gcacaguaggugguaggacuuu

SEQ ID NO: 169847 - RNA, 22 nt, Homo sapiens
gcacccugucaaaauggaccaa

SEQ ID NO: 169848 - RNA, 22 nt, Homo sapiens
gcacugggccacauuuauuuuc

SEQ ID NO: 169849 - RNA, 22 nt, Homo sapiens
gcagagaaacaggucuaaggag

SEQ ID NO: 169850 - RNA, 23 nt, Homo sapiens
gcagcaaugucacagggguccgg

SEQ ID NO: 169851 - RNA, 22 nt, Homo sapiens
gcagcacauggcagaacauauu

SEQ ID NO: 169852 - RNA, 22 nt, Homo sapiens
gcagguguuaugcaaacaacug

SEQ ID NO: 169853 - RNA, 22 nt, Homo sapiens
gcaguggugugugccagccuag

SEQ ID NO: 169854 - RNA, 22 nt, Homo sapiens
gcagugugauguuuuaaucuau

SEQ ID NO: 169855 - RNA, 22 nt, Homo sapiens
gcaguguggguagagggcaaga

SEQ ID NO: 169856 - RNA, 16 nt, Homo sapiens
gcaguguguuuaauag

SEQ ID NO: 169857 - RNA, 17 nt, Homo sapiens
gcauauguugaaccagc

SEQ ID NO: 169858 - RNA, 17 nt, Homo sapiens
gcauauguugaaccagu

SEQ ID NO: 169859 - RNA, 22 nt, Homo sapiens
gcccagcguucagggaggggcu

SEQ ID NO: 169860 - RNA, 22 nt, Homo sapiens
gccuagagaguuaucaggcugu

SEQ ID NO: 169861 - RNA, 22 nt, Homo sapiens
gcuaaaugcaugaggcgaugug

SEQ ID NO: 169862 - RNA, 22 nt, Homo sapiens
gcuaggagauccacugcucucu

SEQ ID NO: 169863 - RNA, 22 nt, Homo sapiens
gcucaaguaauggcaguuuugc

SEQ ID NO: 169864 - RNA, 22 nt, Homo sapiens
gcucaugagacaagcaggagua

SEQ ID NO: 169865 - RNA, 22 nt, Homo sapiens
gcugauguuggccucugggcuu

SEQ ID NO: 169866 - RNA, 22 nt, Homo sapiens
gcuggcaaguggccuacuuugu

SEQ ID NO: 169867 - RNA, 22 nt, Homo sapiens
gcuggguucagagugggcugcg

SEQ ID NO: 169868 - RNA, 22 nt, Homo sapiens
gcugguauuacaggcaugagcc

SEQ ID NO: 169869 - RNA, 22 nt, Homo sapiens
gcuguauugacuuuguaucaua

SEQ ID NO: 169870 - RNA, 22 nt, Homo sapiens
gcuguguguuaucagaaauugc

SEQ ID NO: 169871 - RNA, 21 nt, Homo sapiens
gcuuuuucggaagucuuuggc

SEQ ID NO: 169872 - RNA, 18 nt, Homo sapiens
ggaaaacuuuucuaagua

SEQ ID NO: 169873 - RNA, 22 nt, Homo sapiens
ggaaagaucagcuaaauguaag

SEQ ID NO: 169874 - RNA, 22 nt, Homo sapiens
ggaaauguuggugucaugaguu

SEQ ID NO: 169875 - RNA, 17 nt, Homo sapiens
ggaagccuuugguuuaa

SEQ ID NO: 169876 - RNA, 22 nt, Homo sapiens
ggaaggucaaagggaaagcaga

SEQ ID NO: 169877 - RNA, 22 nt, Homo sapiens
ggaagugcuguguggaagucug

SEQ ID NO: 169878 - RNA, 17 nt, Homo sapiens
ggaaugaauuccagccc

SEQ ID NO: 169879 - RNA, 19 nt, Homo sapiens
ggaaugcaccaguccuugc

SEQ ID NO: 169880 - RNA, 19 nt, Homo sapiens
ggaaugcuauucaaccuuu

SEQ ID NO: 169881 - RNA, 22 nt, Homo sapiens
ggaauggaacaaagucuugaaa

SEQ ID NO: 169882 - RNA, 22 nt, Homo sapiens
ggacaaaguauuuucaaaugua

SEQ ID NO: 169883 - RNA, 22 nt, Homo sapiens
ggacaagagacugggacacuga

SEQ ID NO: 169884 - RNA, 22 nt, Homo sapiens
ggacacaucaugugaccaaggu

SEQ ID NO: 169885 - RNA, 22 nt, Homo sapiens
ggacagaaaggguucaccaaac

SEQ ID NO: 169886 - RNA, 22 nt, Homo sapiens
ggacuagaggugaaaagaagac

SEQ ID NO: 169887 - RNA, 22 nt, Homo sapiens
ggagauaauccagggagggacu

SEQ ID NO: 169888 - RNA, 22 nt, Homo sapiens
ggagaucuuuaggaguuggacu

SEQ ID NO: 169889 - RNA, 22 nt, Homo sapiens
ggagaucuuuguuaucuuuuga

SEQ ID NO: 169890 - RNA, 22 nt, Homo sapiens
ggagcaaugccucauucucacu

SEQ ID NO: 169891 - RNA, 22 nt, Homo sapiens
ggaggcuaguaaaaagguagaa

SEQ ID NO: 169892 - RNA, 22 nt, Homo sapiens
ggagucugaacuggacaaugac

SEQ ID NO: 169893 - RNA, 22 nt, Homo sapiens
ggagugcuguuguuacacaagg

SEQ ID NO: 169894 - RNA, 22 nt, Homo sapiens
ggaguguaguggcuccaucucg

SEQ ID NO: 169895 - RNA, 22 nt, Homo sapiens
ggaguguguaggagaaagguaa

SEQ ID NO: 169896 - RNA, 22 nt, Homo sapiens
ggaucacagagcuugggaaagg

SEQ ID NO: 169897 - RNA, 23 nt, Homo sapiens
ggauucaucuguuuguucgcugu

SEQ ID NO: 169898 - RNA, 22 nt, Homo sapiens
ggcaacaauuccuacuucuuuu

SEQ ID NO: 169899 - RNA, 22 nt, Homo sapiens
ggcaagaaaaugcaauuacugu

SEQ ID NO: 169900 - RNA, 23 nt, Homo sapiens
uuaguaaacucaaugacaccaca

SEQ ID NO: 169901 - RNA, 22 nt, Homo sapiens
uuauacuacuauaaagagguag

SEQ ID NO: 169902 - RNA, 22 nt, Homo sapiens
uuauagacacguuguaacaaac

SEQ ID NO: 169903 - RNA, 22 nt, Homo sapiens
uuauugcacuccagccugggua

SEQ ID NO: 169904 - RNA, 22 nt, Homo sapiens
uucagauugcauaccgaaagua

SEQ ID NO: 169905 - RNA, 22 nt, Homo sapiens
uucaguagucuccauagaaccg

SEQ ID NO: 169906 - RNA, 22 nt, Homo sapiens
uucagugucauuaacacaguag

SEQ ID NO: 169907 - RNA, 22 nt, Homo sapiens
uucauaguguuuccuuccagug

SEQ ID NO: 169908 - RNA, 21 nt, Homo sapiens
uucaucuggccguauuccagg

SEQ ID NO: 169909 - RNA, 22 nt, Homo sapiens
uuccagcugggggcaacucugc

SEQ ID NO: 169910 - RNA, 19 nt, Homo sapiens
uuccugagaacaagggcuu

SEQ ID NO: 169911 - RNA, 22 nt, Homo sapiens
uuccugagagggcugggugcag

SEQ ID NO: 169912 - RNA, 22 nt, Homo sapiens
uucuacaggcuguucaagaagc

SEQ ID NO: 169913 - RNA, 22 nt, Homo sapiens
uucuuagucauguaauagucca

SEQ ID NO: 169914 - RNA, 22 nt, Homo sapiens
uucuuuggaaacaguacuaauu

SEQ ID NO: 169915 - RNA, 22 nt, Homo sapiens
uugaagacuauaugauucuuca

SEQ ID NO: 169916 - RNA, 22 nt, Homo sapiens
uugagauguaguuucacuccug

SEQ ID NO: 169917 - RNA, 22 nt, Homo sapiens
uugagcaaaacauuaauauuag

SEQ ID NO: 169918 - RNA, 22 nt, Homo sapiens
uugagccaaggauugucuuucc

SEQ ID NO: 169919 - RNA, 22 nt, Homo sapiens
uugaggcaaugaggagaagcug

SEQ ID NO: 169920 - RNA, 23 nt, Homo sapiens
uugaggcauguaccaucaauauc

SEQ ID NO: 169921 - RNA, 16 nt, Homo sapiens
uugaggcaugucucag

SEQ ID NO: 169922 - RNA, 22 nt, Homo sapiens
uugaggucagagguucgagacc

SEQ ID NO: 169923 - RNA, 22 nt, Homo sapiens
uugaguccccacacuggguccc

SEQ ID NO: 169924 - RNA, 22 nt, Homo sapiens
uugcacagugguuuagagccug

SEQ ID NO: 169925 - RNA, 22 nt, Homo sapiens
uugcauauucucugaggcagga

SEQ ID NO: 169926 - RNA, 22 nt, Homo sapiens
uugcuuaggcuggagugcagug

SEQ ID NO: 169927 - RNA, 22 nt, Homo sapiens
uuggaaauauguuaagugucau

SEQ ID NO: 169928 - RNA, 22 nt, Homo sapiens
uuggaaauguguuugcauucag

SEQ ID NO: 169929 - RNA, 22 nt, Homo sapiens
uuggaagacaaugcugauucuc

SEQ ID NO: 169930 - RNA, 22 nt, Homo sapiens
uuggucaggcuaaucucgaacg

SEQ ID NO: 169931 - RNA, 22 nt, Homo sapiens
uuggucaucucccuccuuuuag

SEQ ID NO: 169932 - RNA, 22 nt, Homo sapiens
uuguaaucaacacaucauuggg

SEQ ID NO: 169933 - RNA, 21 nt, Homo sapiens
uuuagguagcuuuucugggag

SEQ ID NO: 169934 - RNA, 22 nt, Homo sapiens
uuuccaagaugcuuacuuucuc

SEQ ID NO: 169935 - RNA, 22 nt, Homo sapiens
uuugccaauauuuuauugagga

SEQ ID NO: 169936 - RNA, 23 nt, Homo sapiens
uuuggcauuccagaaauuuucau

SEQ ID NO: 169937 - RNA, 22 nt, Homo sapiens
uuugugcaaacuaggauugcga

SEQ ID NO: 169938 - RNA, 22 nt, Homo sapiens
uuugugugugauuauaaaaggu

SEQ ID NO: 169939 - RNA, 22 nt, Homo sapiens
uuuugcaaauuccaguggccau

SEQ ID NO: 169940 - RNA, 22 nt, Homo sapiens
uuuugcaguuacagagagugag

SEQ ID NO: 169941 - RNA, 22 nt, Homo sapiens
ccugucuugaagagauccuccu

SEQ ID NO: 169942 - RNA, 22 nt, Homo sapiens
cucaguagaaaauacauggacu

SEQ ID NO: 169943 - RNA, 22 nt, Homo sapiens
cucaguguuaaggccaccucug

SEQ ID NO: 169944 - RNA, 22 nt, Homo sapiens
cugaggcacggcgaccuuaagu

SEQ ID NO: 169945 - RNA, 22 nt, Homo sapiens
cugagugcaagugauccuccca

SEQ ID NO: 169946 - RNA, 22 nt, Homo sapiens
cuggcagucugccucuucacug

SEQ ID NO: 169947 - RNA, 22 nt, Homo sapiens
cugucucagugaauugguuuua

SEQ ID NO: 169948 - RNA, 22 nt, Homo sapiens
cuugguacucugugucccagcu

SEQ ID NO: 169949 - RNA, 22 nt, Homo sapiens
cuuugguucuguuuauaugcug

SEQ ID NO: 169950 - RNA, 22 nt, Homo sapiens
gaaugcagcagugacagggcug

SEQ ID NO: 169951 - RNA, 22 nt, Homo sapiens
gagaaccuccagcaagguagua

SEQ ID NO: 169952 - RNA, 22 nt, Homo sapiens
gagcucauuguugcuaaagaga

SEQ ID NO: 169953 - RNA, 22 nt, Homo sapiens
gagcuguuuuucacuagaccaa

SEQ ID NO: 169954 - RNA, 22 nt, Homo sapiens
gauaaagauagcaauagggaca

SEQ ID NO: 169955 - RNA, 22 nt, Homo sapiens
gaucacuuugaugccaggaacu

SEQ ID NO: 169956 - RNA, 22 nt, Homo sapiens
gcugaaauguuuaauuugggag

SEQ ID NO: 169957 - RNA, 22 nt, Homo sapiens
gcugagaucucuugccugaacu

SEQ ID NO: 169958 - RNA, 18 nt, Homo sapiens
ggaaaacuuuucuaagua

SEQ ID NO: 169959 - RNA, 23 nt, Homo sapiens
ggaaugaaaccugguuaugauau

SEQ ID NO: 169960 - RNA, 22 nt, Homo sapiens
ggacaagaucuuccaccauuca

SEQ ID NO: 169961 - RNA, 22 nt, Homo sapiens
ggagaugauuaugaaucacuua

SEQ ID NO: 169962 - RNA, 22 nt, Homo sapiens
ggcacgguggcucacgccugua

SEQ ID NO: 169963 - RNA, 22 nt, Homo sapiens
gggaauguagcaaaucugcaau

SEQ ID NO: 169964 - RNA, 22 nt, Homo sapiens
gggcaacauugaguacccugaa

SEQ ID NO: 169965 - RNA, 22 nt, Homo sapiens
ggucagaaagacaggcauucag

SEQ ID NO: 169966 - RNA, 18 nt, Homo sapiens
guaaauguaucuauugcc

SEQ ID NO: 169967 - RNA, 22 nt, Homo sapiens
guacaguuuucaguguucacug

SEQ ID NO: 169968 - RNA, 22 nt, Homo sapiens
guccaagacuaggaguuggcag

SEQ ID NO: 169969 - RNA, 22 nt, Homo sapiens
gucuguuuggggaccuguggcc

SEQ ID NO: 169970 - RNA, 22 nt, Homo sapiens
gucuuuggaaaaaaugucuguu

SEQ ID NO: 169971 - RNA, 22 nt, Homo sapiens
gucuuuggaaagacaaaguuca

SEQ ID NO: 169972 - RNA, 22 nt, Homo sapiens
gugaggcacugcugcuuuccag

SEQ ID NO: 169973 - RNA, 22 nt, Homo sapiens
guggaaaucucugugugacuua

SEQ ID NO: 169974 - RNA, 21 nt, Homo sapiens
guggaaauggaauuuacuaau

SEQ ID NO: 169975 - RNA, 22 nt, Homo sapiens
guggaagaccagacuuuccaac

SEQ ID NO: 169976 - RNA, 22 nt, Homo sapiens
guggaaugcaguguugauucaa

SEQ ID NO: 169977 - RNA, 22 nt, Homo sapiens
guggaauggaaugauuguguau

SEQ ID NO: 169978 - RNA, 22 nt, Homo sapiens
guggcaguuuuaaauaugaaaa

SEQ ID NO: 169979 - RNA, 22 nt, Homo sapiens
uaagacugccccagacagcaag

SEQ ID NO: 169980 - RNA, 22 nt, Homo sapiens
uaaggcucuuguuauuuugagg

SEQ ID NO: 169981 - RNA, 22 nt, Homo sapiens
uaagugcaugauuacaugcaua

SEQ ID NO: 169982 - RNA, 22 nt, Homo sapiens
uacaagcaggaaaugguauaug

SEQ ID NO: 169983 - RNA, 22 nt, Homo sapiens
uagacaacugaaacacugugca

SEQ ID NO: 169984 - RNA, 22 nt, Homo sapiens
uagcaggaaaggggucagaucu

SEQ ID NO: 169985 - RNA, 22 nt, Homo sapiens
uagcauaauuuguagaaaauca

SEQ ID NO: 169986 - RNA, 19 nt, Homo sapiens
uagguacauucaagucucc

SEQ ID NO: 169987 - RNA, 22 nt, Homo sapiens
uagucacacacucaacuuuuca

SEQ ID NO: 169988 - RNA, 22 nt, Homo sapiens
uaguucauuuuucuugcuuaga

SEQ ID NO: 169989 - RNA, 22 nt, Homo sapiens
uauacagcaaguuacugugcug

SEQ ID NO: 169990 - RNA, 22 nt, Homo sapiens
uaucucuguggguagugcugaa

SEQ ID NO: 169991 - RNA, 22 nt, Homo sapiens
uauggcuucuuuaaauugaggu

SEQ ID NO: 169992 - RNA, 22 nt, Homo sapiens
uauuguccacuuugcacugugu

SEQ ID NO: 169993 - RNA, 22 nt, Homo sapiens
ucaaauguuuguuuaaggcuua

SEQ ID NO: 169994 - RNA, 22 nt, Homo sapiens
ucacaaguguauagacaugucc

SEQ ID NO: 169995 - RNA, 23 nt, Homo sapiens
ucacacuuaagagaaaugcagcu

SEQ ID NO: 169996 - RNA, 22 nt, Homo sapiens
ucacuagaucaagggagagaaa

SEQ ID NO: 169997 - RNA, 22 nt, Homo sapiens
ucacugugcaugaaggaugcug

SEQ ID NO: 169998 - RNA, 21 nt, Homo sapiens
ucagaagcucccagggaggac

SEQ ID NO: 169999 - RNA, 22 nt, Homo sapiens
ucaguagcaugaaaacagacua

SEQ ID NO: 170000 - RNA, 22 nt, Homo sapiens
ucagugccucaguuuuuaaaga

SEQ ID NO: 170001 - RNA, 22 nt, Homo sapiens
ucauugcacuccagccugggug

SEQ ID NO: 170002 - RNA, 22 nt, Homo sapiens
uccauuugucuauguuucuguu

SEQ ID NO: 170003 - RNA, 22 nt, Homo sapiens
uccuguaaucccagcuaccaga

SEQ ID NO: 170004 - RNA, 22 nt, Homo sapiens
ucuaaguaguagcuggucagaa

SEQ ID NO: 170005 - RNA, 22 nt, Homo sapiens
ucuaugguuuauuuccaagugu

SEQ ID NO: 170006 - RNA, 22 nt, Homo sapiens
ucucuugguugaacaguuugga

SEQ ID NO: 170007 - RNA, 22 nt, Homo sapiens
ucuugcuuguuguucccuucau

SEQ ID NO: 170008 - RNA, 19 nt, Homo sapiens
ucuuuagucacauuuuuau

SEQ ID NO: 170009 - RNA, 22 nt, Homo sapiens
ugaaggcaggagggagaaaagu

SEQ ID NO: 170010 - RNA, 21 nt, Homo sapiens
ugaaugcuuuaaauauuagaa

SEQ ID NO: 170011 - RNA, 22 nt, Homo sapiens
ugagaucacuaagagguaaugg

SEQ ID NO: 170012 - RNA, 22 nt, Homo sapiens
ugagaucagaaggauuucucug

SEQ ID NO: 170013 - RNA, 22 nt, Homo sapiens
ugagaugaaagcagaaagacuu

SEQ ID NO: 170014 - RNA, 22 nt, Homo sapiens
ugagaugaagcuagaagaaugg

SEQ ID NO: 170015 - RNA, 22 nt, Homo sapiens
ugagaugagaaucaguucuaau

SEQ ID NO: 170016 - RNA, 22 nt, Homo sapiens
ugagaugagagaaugcuugccu

SEQ ID NO: 170017 - RNA, 22 nt, Homo sapiens
ugagaugagggaagccuaggca

SEQ ID NO: 170018 - RNA, 22 nt, Homo sapiens
ugagaugaggucucacucuguu

SEQ ID NO: 170019 - RNA, 22 nt, Homo sapiens
ugagaugaggucucgcucuguc

SEQ ID NO: 170020 - RNA, 21 nt, Homo sapiens
ugagaugauccugcaugcaug

SEQ ID NO: 170021 - RNA, 19 nt, Homo sapiens
ugagauuguaugaggagau

SEQ ID NO: 170022 - RNA, 22 nt, Homo sapiens
ugagcacuguacuuuaucaggu

SEQ ID NO: 170023 - RNA, 22 nt, Homo sapiens
ugagcccauuguccugguuuau

SEQ ID NO: 170024 - RNA, 17 nt, Homo sapiens
ugagcuaagauuacccc

SEQ ID NO: 170025 - RNA, 22 nt, Homo sapiens
ugagcugagaucaugcuauugu

SEQ ID NO: 170026 - RNA, 22 nt, Homo sapiens
ugagcuguuugaagaagcauuu

SEQ ID NO: 170027 - RNA, 22 nt, Homo sapiens
ugauauuuuugauccuuaaguu

SEQ ID NO: 170028 - RNA, 19 nt, Homo sapiens
ugcaaagucuuuuccuauu

SEQ ID NO: 170029 - RNA, 19 nt, Homo sapiens
ugcagcaauguaaaagaca

SEQ ID NO: 170030 - RNA, 22 nt, Homo sapiens
ugcauggauguuugaacacacu

SEQ ID NO: 170031 - RNA, 19 nt, Homo sapiens
uggaacugauucaguucug

SEQ ID NO: 170032 - RNA, 22 nt, Homo sapiens
uggaagacaaguguuagcaugg

SEQ ID NO: 170033 - RNA, 21 nt, Homo sapiens
uggagugaagaguuuauugac

SEQ ID NO: 170034 - RNA, 20 nt, Homo sapiens
uggagugaagguucuggacc

SEQ ID NO: 170035 - RNA, 22 nt, Homo sapiens
uggccuguaacgcugucucagc

SEQ ID NO: 170036 - RNA, 22 nt, Homo sapiens
ugucucaguucccuucucugga

SEQ ID NO: 170037 - RNA, 19 nt, Homo sapiens
ugugacugguugucucgcu

SEQ ID NO: 170038 - RNA, 22 nt, Homo sapiens
ugugccacugcacuccugccug

SEQ ID NO: 170039 - RNA, 22 nt, Homo sapiens
ugugggaggugcuaauguaaau

SEQ ID NO: 170040 - RNA, 22 nt, Homo sapiens
uguuacagugacuaauguuuua

SEQ ID NO: 170041 - RNA, 22 nt, Homo sapiens
uuaaggaaggagucuuaaaugg

SEQ ID NO: 170042 - RNA, 22 nt, Homo sapiens
uuaauacugcuuaacuuuagga

SEQ ID NO: 170043 - RNA, 22 nt, Homo sapiens
uuacacaguaggucccuaguaa

SEQ ID NO: 170044 - RNA, 22 nt, Homo sapiens
uuaccugagaaggugacauuug

SEQ ID NO: 170045 - RNA, 22 nt, Homo sapiens
uuagcacauuuccagcacaugg

SEQ ID NO: 170046 - RNA, 18 nt, Homo sapiens
aaacagugucucuuucug

SEQ ID NO: 170047 - RNA, 18 nt, Homo sapiens
aaacugcuuccuuggccu

SEQ ID NO: 170048 - RNA, 22 nt, Homo sapiens
aaagagaucuaugggcacuaug

SEQ ID NO: 170049 - RNA, 22 nt, Homo sapiens
aacagacugucacauaaaauug

SEQ ID NO: 170050 - RNA, 22 nt, Homo sapiens
aaccuguaaccauaugaucagu

SEQ ID NO: 170051 - RNA, 22 nt, Homo sapiens
aagcacccagccucacgccugc

SEQ ID NO: 170052 - RNA, 22 nt, Homo sapiens
aaguggcauugaggaaaaaaau

SEQ ID NO: 170053 - RNA, 22 nt, Homo sapiens
aauaucacaguggguguacacc

SEQ ID NO: 170054 - RNA, 23 nt, Homo sapiens
aauaucacaguggguguacaccc

SEQ ID NO: 170055 - RNA, 22 nt, Homo sapiens
aaucacuuuggcaccaaccuaa

SEQ ID NO: 170056 - RNA, 19 nt, Homo sapiens
aauggcuuuuccuguuccc

SEQ ID NO: 170057 - RNA, 22 nt, Homo sapiens
acacaguguuuauugugguuag

SEQ ID NO: 170058 - RNA, 22 nt, Homo sapiens
acacuguagcugagggcaugcg

SEQ ID NO: 170059 - RNA, 22 nt, Homo sapiens
acacuuucuagacaagggaaua

SEQ ID NO: 170060 - RNA, 22 nt, Homo sapiens
acacuuucuggagcugcacaua

SEQ ID NO: 170061 - RNA, 22 nt, Homo sapiens
acaguguagugacugccaacuu

SEQ ID NO: 170062 - RNA, 17 nt, Homo sapiens
acagugucuaugaaaug

SEQ ID NO: 170063 - RNA, 22 nt, Homo sapiens
acuuuuugauggggagaacauu

SEQ ID NO: 170064 - RNA, 22 nt, Homo sapiens
agaacuguccauucagcaugaa

SEQ ID NO: 170065 - RNA, 22 nt, Homo sapiens
agaauguuuuagaccaauacaa

SEQ ID NO: 170066 - RNA, 22 nt, Homo sapiens
agcuggcuguagcugcaagucu

SEQ ID NO: 170067 - RNA, 21 nt, Homo sapiens
agcugguuuccacagugugcu

SEQ ID NO: 170068 - RNA, 22 nt, Homo sapiens
aggcaaugugagaguuuauuca

SEQ ID NO: 170069 - RNA, 22 nt, Homo sapiens
aggcaugaaauacaugcauuga

SEQ ID NO: 170070 - RNA, 22 nt, Homo sapiens
aggugguuuugaugagcaggua

SEQ ID NO: 170071 - RNA, 22 nt, Homo sapiens
auaaagacacuuggcaugauuu

SEQ ID NO: 170072 - RNA, 22 nt, Homo sapiens
auaaauaguaguugugguggcc

SEQ ID NO: 170073 - RNA, 22 nt, Homo sapiens
auacauguuucauguuggugug

SEQ ID NO: 170074 - RNA, 22 nt, Homo sapiens
aucacuuucuauuucugugcca

SEQ ID NO: 170075 - RNA, 22 nt, Homo sapiens
aucacuuugcucuccagugugg

SEQ ID NO: 170076 - RNA, 22 nt, Homo sapiens
aucauauccuagauauaacuuc

SEQ ID NO: 170077 - RNA, 22 nt, Homo sapiens
aucauccagccccagaagggag

SEQ ID NO: 170078 - RNA, 22 nt, Homo sapiens
aucccugugauccaaucacuuc

SEQ ID NO: 170079 - RNA, 20 nt, Homo sapiens
aucucugggcaaaggaaaau

SEQ ID NO: 170080 - RNA, 22 nt, Homo sapiens
aucuuuggauacuugauauagu

SEQ ID NO: 170081 - RNA, 22 nt, Homo sapiens
aucuuuggcgggaauaucacag

SEQ ID NO: 170082 - RNA, 22 nt, Homo sapiens
aucuuuggugcaugauacuuug

SEQ ID NO: 170083 - RNA, 22 nt, Homo sapiens
augagacuagaagagaauaaua

SEQ ID NO: 170084 - RNA, 22 nt, Homo sapiens
augagcugauuuccuuaccaua

SEQ ID NO: 170085 - RNA, 22 nt, Homo sapiens
augaucacuguggaaauucagc

SEQ ID NO: 170086 - RNA, 22 nt, Homo sapiens
auggaacauuauagauguaaaa

SEQ ID NO: 170087 - RNA, 22 nt, Homo sapiens
auggauauuuuuugaacauaga

SEQ ID NO: 170088 - RNA, 22 nt, Homo sapiens
auggcaguguaugauuauauua

SEQ ID NO: 170089 - RNA, 22 nt, Homo sapiens
auggcucuggauagaaugcagg

SEQ ID NO: 170090 - RNA, 22 nt, Homo sapiens
auuccacuuacaugaaguaccu

SEQ ID NO: 170091 - RNA, 22 nt, Homo sapiens
auuccacuuagugacucauuug

SEQ ID NO: 170092 - RNA, 22 nt, Homo sapiens
auuccacuuauaugagguaucu

SEQ ID NO: 170093 - RNA, 18 nt, Homo sapiens
auucuacaggccuuuuga

SEQ ID NO: 170094 - RNA, 22 nt, Homo sapiens
auugaguaaaaaauagugaugu

SEQ ID NO: 170095 - RNA, 22 nt, Homo sapiens
auugcacuccagccuaggcaac

SEQ ID NO: 170096 - RNA, 22 nt, Homo sapiens
auugcacuccagccugagcaaa

SEQ ID NO: 170097 - RNA, 22 nt, Homo sapiens
auugcacuccagccugggcagc

SEQ ID NO: 170098 - RNA, 21 nt, Homo sapiens
auugcacuccagccugggcga

SEQ ID NO: 170099 - RNA, 22 nt, Homo sapiens
ugagaugagucucgcucuguca

SEQ ID NO: 170100 - RNA, 22 nt, Homo sapiens
ugagaugaguucucgcucuguc

SEQ ID NO: 170101 - RNA, 22 nt, Homo sapiens
ugagaugaguugcgcucugucg

SEQ ID NO: 170102 - RNA, 22 nt, Homo sapiens
ugagcugagaaaugcagcagcu

SEQ ID NO: 170103 - RNA, 22 nt, Homo sapiens
ugagcugagaucgugccauugu

SEQ ID NO: 170104 - RNA, 22 nt, Homo sapiens
ugauuuguuuagugccaaguuu

SEQ ID NO: 170105 - RNA, 22 nt, Homo sapiens
ugcaaauguuaggugucauuau

SEQ ID NO: 170106 - RNA, 22 nt, Homo sapiens
ugcaaugugaaauaagcacauc

SEQ ID NO: 170107 - RNA, 22 nt, Homo sapiens
ugcacuguggucugagagacag

SEQ ID NO: 170108 - RNA, 22 nt, Homo sapiens
ugcuuaguguugacccucugcc

SEQ ID NO: 170109 - RNA, 20 nt, Homo sapiens
uggaaauuaaccuuucaggu

SEQ ID NO: 170110 - RNA, 22 nt, Homo sapiens
uggcuuuguaagguuucauuuu

SEQ ID NO: 170111 - RNA, 22 nt, Homo sapiens
uggucuccuuuguacccugggc

SEQ ID NO: 170112 - RNA, 22 nt, Homo sapiens
uguagcaaaucgauacuauugg

SEQ ID NO: 170113 - RNA, 23 nt, Homo sapiens
uguauacacccugugcaucuggg

SEQ ID NO: 170114 - RNA, 22 nt, Homo sapiens
uguauguuguaagacuuagacc

SEQ ID NO: 170115 - RNA, 22 nt, Homo sapiens
ugucagaaucugagacgacaac

SEQ ID NO: 170116 - RNA, 22 nt, Homo sapiens
ugugccuacugauagagccaag

SEQ ID NO: 170117 - RNA, 22 nt, Homo sapiens
ugugccuaguaauguguccaga

SEQ ID NO: 170118 - RNA, 22 nt, Homo sapiens
uguggccuuuguuucaguuggg

SEQ ID NO: 170119 - RNA, 18 nt, Homo sapiens
uguggcuguuuuccaaua

SEQ ID NO: 170120 - RNA, 22 nt, Homo sapiens
ugugucacugcacuccagccug

SEQ ID NO: 170121 - RNA, 22 nt, Homo sapiens
ugugucuccugaaaauucacau

SEQ ID NO: 170122 - RNA, 22 nt, Homo sapiens
uuagguaauauauugcugcuuu

SEQ ID NO: 170123 - RNA, 22 nt, Homo sapiens
uuaguucccucauucuugacuu

SEQ ID NO: 170124 - RNA, 22 nt, Homo sapiens
uuaugacauugacaguuuuuag

SEQ ID NO: 170125 - RNA, 22 nt, Homo sapiens
uucaaaaccucugcuuaagccc

SEQ ID NO: 170126 - RNA, 22 nt, Homo sapiens
uucagacugggugaagagggua

SEQ ID NO: 170127 - RNA, 22 nt, Homo sapiens
uucagguaguuuaacuguucca

SEQ ID NO: 170128 - RNA, 22 nt, Homo sapiens
uucauacaguggcugcacucca

SEQ ID NO: 170129 - RNA, 22 nt, Homo sapiens
uucccuguaucuucugccaugu

SEQ ID NO: 170130 - RNA, 21 nt, Homo sapiens
uucuaaguaaauguuggacau

SEQ ID NO: 170131 - RNA, 20 nt, Homo sapiens
uucuacagucacaggaagau

SEQ ID NO: 170132 - RNA, 22 nt, Homo sapiens
uucucuggucagaggggagguu

SEQ ID NO: 170133 - RNA, 19 nt, Homo sapiens
uucucugguuguacuaccc

SEQ ID NO: 170134 - RNA, 22 nt, Homo sapiens
uugacauaguuucugaaauaga

SEQ ID NO: 170135 - RNA, 22 nt, Homo sapiens
uugacauguaaguacucuauag

SEQ ID NO: 170136 - RNA, 22 nt, Homo sapiens
uugagaugaagucuugcucucu

SEQ ID NO: 170137 - RNA, 22 nt, Homo sapiens
uugagaugaaguuuugcucuuu

SEQ ID NO: 170138 - RNA, 22 nt, Homo sapiens
uugagauggagucucacugugu

SEQ ID NO: 170139 - RNA, 22 nt, Homo sapiens
uugagauggagucucgcucuuu

SEQ ID NO: 170140 - RNA, 22 nt, Homo sapiens
uugagauggagucuugcucugu

SEQ ID NO: 170141 - RNA, 22 nt, Homo sapiens
uugagauggaguuucgcucuuu

SEQ ID NO: 170142 - RNA, 22 nt, Homo sapiens
uugagauggaguuuugcucuug

SEQ ID NO: 170143 - RNA, 20 nt, Homo sapiens
uugaggucaggaguuuggga

SEQ ID NO: 170144 - RNA, 22 nt, Homo sapiens
uugcacuccggccuggguaaca

SEQ ID NO: 170145 - RNA, 18 nt, Homo sapiens
uugcacuccugccugggu

SEQ ID NO: 170146 - RNA, 22 nt, Homo sapiens
uugcacucuccagccucggcaa

SEQ ID NO: 170147 - RNA, 22 nt, Homo sapiens
uuggaaaccucugcagguguuu

SEQ ID NO: 170148 - RNA, 22 nt, Homo sapiens
uuggaaacgucaccuuuuccuu

SEQ ID NO: 170149 - RNA, 18 nt, Homo sapiens
uuggacggagagucaaau

SEQ ID NO: 170150 - RNA, 22 nt, Homo sapiens
uuggacuucuaacugacaugga

SEQ ID NO: 170151 - RNA, 22 nt, Homo sapiens
uuggcagugcccgaugcugggg

SEQ ID NO: 170152 - RNA, 22 nt, Homo sapiens
uugguucucuuagccaucuuaa

SEQ ID NO: 170153 - RNA, 22 nt, Homo sapiens
uuguguuuuuaguagggaaggg

SEQ ID NO: 170154 - RNA, 22 nt, Homo sapiens
uuuagcaaagcaauuuacacca

SEQ ID NO: 170155 - RNA, 21 nt, Homo sapiens
uuuccuggagcguauggcuuc

SEQ ID NO: 170156 - RNA, 22 nt, Homo sapiens
uuucuauguugaccagucuaga

SEQ ID NO: 170157 - RNA, 22 nt, Homo sapiens
uuugaaaguaauuugguuggug

SEQ ID NO: 170158 - RNA, 22 nt, Homo sapiens
uuugaguaggcuuauauuuugg

SEQ ID NO: 170159 - RNA, 22 nt, Homo sapiens
uuugaguuugaggugcugauga

SEQ ID NO: 170160 - RNA, 22 nt, Homo sapiens
uuugccaaucagaggcaucuug

SEQ ID NO: 170161 - RNA, 22 nt, Homo sapiens
uuugcuuguguaaaaaucugga

SEQ ID NO: 170162 - RNA, 22 nt, Homo sapiens
uuugguugcauucacauauuuc

SEQ ID NO: 170163 - RNA, 22 nt, Homo sapiens
uuugugagguggauagauugca

SEQ ID NO: 170164 - RNA, 19 nt, Homo sapiens
uuuuggaaaugugaacagc

SEQ ID NO: 170165 - RNA, 22 nt, Homo sapiens
agagaugaagauggggcucccg

SEQ ID NO: 170166 - RNA, 22 nt, Homo sapiens
agagaugauuaacauuuuggua

SEQ ID NO: 170167 - RNA, 22 nt, Homo sapiens
agcugauggucuuguaugaugu

SEQ ID NO: 170168 - RNA, 20 nt, Homo sapiens
agcuggguguguuggugcau

SEQ ID NO: 170169 - RNA, 22 nt, Homo sapiens
agcugguuuauuucuauauccu

SEQ ID NO: 170170 - RNA, 22 nt, Homo sapiens
aggaagugugcaauuaauuucu

SEQ ID NO: 170171 - RNA, 22 nt, Homo sapiens
agugaaaugucaccuuuuagga

SEQ ID NO: 170172 - RNA, 22 nt, Homo sapiens
auaaccuauggaucuacucggg

SEQ ID NO: 170173 - RNA, 22 nt, Homo sapiens
auacaagcaguccaacuccaua

SEQ ID NO: 170174 - RNA, 22 nt, Homo sapiens
auagcagaagaagggacaauuc

SEQ ID NO: 170175 - RNA, 22 nt, Homo sapiens
auaucaaggccauuuucuaaau

SEQ ID NO: 170176 - RNA, 22 nt, Homo sapiens
aucccuagaaaaaucagcacau

SEQ ID NO: 170177 - RNA, 22 nt, Homo sapiens
aucccuguaguaauauucuagc

SEQ ID NO: 170178 - RNA, 22 nt, Homo sapiens
aucgcacuccauccugggcaac

SEQ ID NO: 170179 - RNA, 22 nt, Homo sapiens
aucuuuggucaucacagcuaga

SEQ ID NO: 170180 - RNA, 22 nt, Homo sapiens
aucuuuggugaguucuuugguc

SEQ ID NO: 170181 - RNA, 22 nt, Homo sapiens
augaacagagccuugagaaccu

SEQ ID NO: 170182 - RNA, 22 nt, Homo sapiens
augaagcuagcugauugcugau

SEQ ID NO: 170183 - RNA, 22 nt, Homo sapiens
augacaagaguguucagggaga

SEQ ID NO: 170184 - RNA, 22 nt, Homo sapiens
augacagagauaugugaauuuu

SEQ ID NO: 170185 - RNA, 22 nt, Homo sapiens
augaugcugagguuugggguau

SEQ ID NO: 170186 - RNA, 22 nt, Homo sapiens
auggaaaugaagggcuggcccu

SEQ ID NO: 170187 - RNA, 22 nt, Homo sapiens
auggacuuuuuguucagugucu

SEQ ID NO: 170188 - RNA, 22 nt, Homo sapiens
auggcaguuucacucugggauu

SEQ ID NO: 170189 - RNA, 22 nt, Homo sapiens
auggcaguuuggucucugugcu

SEQ ID NO: 170190 - RNA, 22 nt, Homo sapiens
auggcuuuaagagugucugaau

SEQ ID NO: 170191 - RNA, 17 nt, Homo sapiens
auguaauccucaucucu

SEQ ID NO: 170192 - RNA, 22 nt, Homo sapiens
augugcaaagcacuguucagca

SEQ ID NO: 170193 - RNA, 23 nt, Homo sapiens
augugugcuuggagagcaggaug

SEQ ID NO: 170194 - RNA, 21 nt, Homo sapiens
auuccacuuuuccuucaggga

SEQ ID NO: 170195 - RNA, 18 nt, Homo sapiens
auugcacaccagccuggg

SEQ ID NO: 170196 - RNA, 22 nt, Homo sapiens
auugcacuccagccugggcaac

SEQ ID NO: 170197 - RNA, 22 nt, Homo sapiens
auugcacuccagccuugggcaa

SEQ ID NO: 170198 - RNA, 22 nt, Homo sapiens
auuguacuccagccugggcaaa

SEQ ID NO: 170199 - RNA, 22 nt, Homo sapiens
caccugagcgggaugcucgccu

SEQ ID NO: 170200 - RNA, 22 nt, Homo sapiens
cacuagagaauagguaguucug

SEQ ID NO: 170201 - RNA, 19 nt, Homo sapiens
cauggcuuauaauuuuaau

SEQ ID NO: 170202 - RNA, 22 nt, Homo sapiens
cauugcaauccagccugggcaa

SEQ ID NO: 170203 - RNA, 22 nt, Homo sapiens
cauugcacuccagccuagccaa

SEQ ID NO: 170204 - RNA, 22 nt, Homo sapiens
cauugcacuccagccugcugac

SEQ ID NO: 170205 - RNA, 22 nt, Homo sapiens
cauugcacuccagccuuggcaa

SEQ ID NO: 170206 - RNA, 22 nt, Homo sapiens
cauugcacuccagcuugggcaa

SEQ ID NO: 170207 - RNA, 22 nt, Homo sapiens
cauugcacuccagcuugggcga

SEQ ID NO: 170208 - RNA, 22 nt, Homo sapiens
cauugcacuccagucugggcaa

SEQ ID NO: 170209 - RNA, 22 nt, Homo sapiens
cauugcacuccaucuugggcaa

SEQ ID NO: 170210 - RNA, 22 nt, Homo sapiens
ccauugaacaugaaggaaugug

SEQ ID NO: 170211 - RNA, 22 nt, Homo sapiens
ccuucauucauuaauuuagccc

SEQ ID NO: 170212 - RNA, 20 nt, Homo sapiens
cguugcacuccagccugggc

SEQ ID NO: 170213 - RNA, 22 nt, Homo sapiens
cguugcacuccagccugggcaa

SEQ ID NO: 170214 - RNA, 22 nt, Homo sapiens
cuacagcacugagcugugugca

SEQ ID NO: 170215 - RNA, 22 nt, Homo sapiens
cuagaagcauauucagaacaga

SEQ ID NO: 170216 - RNA, 22 nt, Homo sapiens
cuauggcucugucuuuuaaguu

SEQ ID NO: 170217 - RNA, 22 nt, Homo sapiens
cucaguguucccauucuaccuu

SEQ ID NO: 170218 - RNA, 22 nt, Homo sapiens
cucaguguuucagcugcucaga

SEQ ID NO: 170219 - RNA, 22 nt, Homo sapiens
cucauggagaacaucugcuagg

SEQ ID NO: 170220 - RNA, 22 nt, Homo sapiens
cucauggagaaccucugcuagg

SEQ ID NO: 170221 - RNA, 19 nt, Homo sapiens
cucuuuggugucucuucuu

SEQ ID NO: 170222 - RNA, 22 nt, Homo sapiens
cuggaauauuagcuggucuuaa

SEQ ID NO: 170223 - RNA, 22 nt, Homo sapiens
cuggcucauuucauuuagcaua

SEQ ID NO: 170224 - RNA, 22 nt, Homo sapiens
cuggcucugggcuaaagaaaua

SEQ ID NO: 170225 - RNA, 21 nt, Homo sapiens
cuuugguagaguuuuuagggu

SEQ ID NO: 170226 - RNA, 22 nt, Homo sapiens
cuuugguuuacuuggugcuagu

SEQ ID NO: 170227 - RNA, 22 nt, Homo sapiens
gaauaaacuagagaggacugag

SEQ ID NO: 170228 - RNA, 22 nt, Homo sapiens
gagagcauuaagccaucaucau

SEQ ID NO: 170229 - RNA, 22 nt, Homo sapiens
gagaucauguacuagaacaccu

SEQ ID NO: 170230 - RNA, 22 nt, Homo sapiens
gagcucauuaaaaauguagaau

SEQ ID NO: 170231 - RNA, 22 nt, Homo sapiens
gagcugaucuuuauguaaauuc

SEQ ID NO: 170232 - RNA, 22 nt, Homo sapiens
gagcugaucuuuucugauucca

SEQ ID NO: 170233 - RNA, 22 nt, Homo sapiens
gaugagaugagcauuugaauug

SEQ ID NO: 170234 - RNA, 22 nt, Homo sapiens
gccaacauggcgcuccauucuu

SEQ ID NO: 170235 - RNA, 22 nt, Homo sapiens
gcugcuuuugaugacaaaaaca

SEQ ID NO: 170236 - RNA, 22 nt, Homo sapiens
gcuguguugugcccagcaucau

SEQ ID NO: 170237 - RNA, 23 nt, Homo sapiens
ggaaacauccagucuuucaccau

SEQ ID NO: 170238 - RNA, 22 nt, Homo sapiens
ggaaagaucagcuaaauguaag

SEQ ID NO: 170239 - RNA, 22 nt, Homo sapiens
ggaaugugugucaugcuuuugc

SEQ ID NO: 170240 - RNA, 22 nt, Homo sapiens
ggaucacuugagaccaggaguu

SEQ ID NO: 170241 - RNA, 22 nt, Homo sapiens
ggcaacaugccgaaaccacguc

SEQ ID NO: 170242 - RNA, 22 nt, Homo sapiens
ggcaacauggugaaacucuguc

SEQ ID NO: 170243 - RNA, 22 nt, Homo sapiens
guaaagacacaugcacacguau

SEQ ID NO: 170244 - RNA, 22 nt, Homo sapiens
guaacacucuaaagggaugcac

SEQ ID NO: 170245 - RNA, 22 nt, Homo sapiens
gucagugucuuaacagagauua

SEQ ID NO: 170246 - RNA, 22 nt, Homo sapiens
gucagugucuuugcagcucaga

SEQ ID NO: 170247 - RNA, 22 nt, Homo sapiens
gucagugugauaucugcagggg

SEQ ID NO: 170248 - RNA, 22 nt, Homo sapiens
gucucccagccuacauauuucu

SEQ ID NO: 170249 - RNA, 22 nt, Homo sapiens
gucucugguugcuuuuguacca

SEQ ID NO: 170250 - RNA, 22 nt, Homo sapiens
gucuuggagacauugccauuga

SEQ ID NO: 170251 - RNA, 22 nt, Homo sapiens
gucuuuaguugaaacauguggu

SEQ ID NO: 170252 - RNA, 17 nt, Homo sapiens
gucuuugguugaguuua

SEQ ID NO: 170253 - RNA, 22 nt, Homo sapiens
gugagccaugauuuuaccacug

SEQ ID NO: 170254 - RNA, 21 nt, Homo sapiens
gugcaaacaucauagaaugua

SEQ ID NO: 170255 - RNA, 22 nt, Homo sapiens
gugcuuuguuguggcaguggca

SEQ ID NO: 170256 - RNA, 22 nt, Homo sapiens
guggaaugaaaacucucucaca

SEQ ID NO: 170257 - RNA, 22 nt, Homo sapiens
guucucacuggacugugaaaau

SEQ ID NO: 170258 - RNA, 22 nt, Homo sapiens
uaagacuguuggcaauuuuugc

SEQ ID NO: 170259 - RNA, 22 nt, Homo sapiens
uaaguucauucaugaaacuuag

SEQ ID NO: 170260 - RNA, 22 nt, Homo sapiens
uacacagucaaaaauuuccagg

SEQ ID NO: 170261 - RNA, 22 nt, Homo sapiens
uacuguacugcaguucugcaaa

SEQ ID NO: 170262 - RNA, 22 nt, Homo sapiens
aagacuguaauccaucuugagu

SEQ ID NO: 170263 - RNA, 22 nt, Homo sapiens
aaguaaacauuuuguacaauaa

SEQ ID NO: 170264 - RNA, 22 nt, Homo sapiens
aagugucagaguugcuaaugac

SEQ ID NO: 170265 - RNA, 22 nt, Homo sapiens
aaguuaauguuuaagacuccua

SEQ ID NO: 170266 - RNA, 22 nt, Homo sapiens
aauauagcuauguacaugucca

SEQ ID NO: 170267 - RNA, 22 nt, Homo sapiens
aaugcuguucuuugcuuaaguu

SEQ ID NO: 170268 - RNA, 22 nt, Homo sapiens
aauggcuuuuaauauccauaau

SEQ ID NO: 170269 - RNA, 22 nt, Homo sapiens
aauuaguuggcugggugcggug

SEQ ID NO: 170270 - RNA, 22 nt, Homo sapiens
acaaagugccuccuuuuagagu

SEQ ID NO: 170271 - RNA, 22 nt, Homo sapiens
acaauguauauuuuacuguagg

SEQ ID NO: 170272 - RNA, 22 nt, Homo sapiens
acacauuagcaagugcuguuau

SEQ ID NO: 170273 - RNA, 22 nt, Homo sapiens
acacuauugagguuuguuugca

SEQ ID NO: 170274 - RNA, 22 nt, Homo sapiens
acaguaugcuuuaaacuuuguu

SEQ ID NO: 170275 - RNA, 22 nt, Homo sapiens
acauaaagaagcaggacauugu

SEQ ID NO: 170276 - RNA, 22 nt, Homo sapiens
acugaucaauguuaaggcuuau

SEQ ID NO: 170277 - RNA, 22 nt, Homo sapiens
acuggcuuauuucacuuagcau

SEQ ID NO: 170278 - RNA, 22 nt, Homo sapiens
agaaugugaccuuauuuggaga

SEQ ID NO: 170279 - RNA, 22 nt, Homo sapiens
uucuuugguacaagggccgacc

SEQ ID NO: 170280 - RNA, 22 nt, Homo sapiens
uugacaaggagccauugcaucu

SEQ ID NO: 170281 - RNA, 22 nt, Homo sapiens
uugacagaccuuggucauaucc

SEQ ID NO: 170282 - RNA, 22 nt, Homo sapiens
uugagaagugucuguucauguc

SEQ ID NO: 170283 - RNA, 22 nt, Homo sapiens
uugagauggaguuucgcucuug

SEQ ID NO: 170284 - RNA, 22 nt, Homo sapiens
uugagcaccaugccuggccaug

SEQ ID NO: 170285 - RNA, 22 nt, Homo sapiens
uugcacuauuaguauagauguc

SEQ ID NO: 170286 - RNA, 22 nt, Homo sapiens
uugcauaagugcauucugugau

SEQ ID NO: 170287 - RNA, 22 nt, Homo sapiens
uugcauauguugaaccaagcgu

SEQ ID NO: 170288 - RNA, 22 nt, Homo sapiens
uuggaaacauuuaugguaacag

SEQ ID NO: 170289 - RNA, 22 nt, Homo sapiens
uuggaaaugguaaaggguuaau

SEQ ID NO: 170290 - RNA, 22 nt, Homo sapiens
uuggaagauuacuuaguuuucu

SEQ ID NO: 170291 - RNA, 22 nt, Homo sapiens
uuggagugugcucauaacugcu

SEQ ID NO: 170292 - RNA, 22 nt, Homo sapiens
uuggcagucugaggcacagacu

SEQ ID NO: 170293 - RNA, 22 nt, Homo sapiens
uuugacaaugugugcuuguauu

SEQ ID NO: 170294 - RNA, 22 nt, Homo sapiens
uuugcauaauaagauuagggug

SEQ ID NO: 170295 - RNA, 22 nt, Homo sapiens
uuugcuugaggucuagcuaccc

SEQ ID NO: 170296 - RNA, 22 nt, Homo sapiens
uuugguuuuuguuaucacucau

SEQ ID NO: 170297 - RNA, 22 nt, Homo sapiens
uuugugauugcacacucaagau

SEQ ID NO: 170298 - RNA, 22 nt, Homo sapiens
uuuguucaccucaaggauggga

SEQ ID NO: 170299 - RNA, 22 nt, Homo sapiens
uuuuauguuuguucccugccaa

SEQ ID NO: 170300 - RNA, 23 nt, Homo sapiens
uuuugcaauaagucacuggaaua

SEQ ID NO: 170301 - RNA, 20 nt, Homo sapiens
aaacucugucuucuuuauca

SEQ ID NO: 170302 - RNA, 22 nt, Homo sapiens
aaacugcuuuccaugguggcug

SEQ ID NO: 170303 - RNA, 22 nt, Homo sapiens
aaaguucugcguuagggcuaaa

SEQ ID NO: 170304 - RNA, 22 nt, Homo sapiens
aaauaguagcugaaugagggaa

SEQ ID NO: 170305 - RNA, 22 nt, Homo sapiens
aaccuacauucuuaacuguugc

SEQ ID NO: 170306 - RNA, 22 nt, Homo sapiens
aaggagcuaagagaucauacau

SEQ ID NO: 170307 - RNA, 22 nt, Homo sapiens
aaggcaauuuguugugaggauu

SEQ ID NO: 170308 - RNA, 22 nt, Homo sapiens
aagucaaggagagaagcuucag

SEQ ID NO: 170309 - RNA, 22 nt, Homo sapiens
aagugaguaauacgucaguugu

SEQ ID NO: 170310 - RNA, 22 nt, Homo sapiens
aagugucuuaccgggagggagu

SEQ ID NO: 170311 - RNA, 22 nt, Homo sapiens
aaguugguguaugagacagaag

SEQ ID NO: 170312 - RNA, 22 nt, Homo sapiens
aaucacuuugcuacaaggcagu

SEQ ID NO: 170313 - RNA, 22 nt, Homo sapiens
aaugcuguguuauuucaugacc

SEQ ID NO: 170314 - RNA, 22 nt, Homo sapiens
aauggcuuucagcuuuucccca

SEQ ID NO: 170315 - RNA, 22 nt, Homo sapiens
acccuguaggacuauucuaauc

SEQ ID NO: 170316 - RNA, 22 nt, Homo sapiens
acugagaucuuuaaauaaauaa

SEQ ID NO: 170317 - RNA, 22 nt, Homo sapiens
acuguauagauggaguugauuu

SEQ ID NO: 170318 - RNA, 22 nt, Homo sapiens
acuuuguguuacccagcaagga

SEQ ID NO: 170319 - RNA, 22 nt, Homo sapiens
acuuuuguuauacagugugaua

SEQ ID NO: 170320 - RNA, 22 nt, Homo sapiens
agaagaacauagggugacugaa

SEQ ID NO: 170321 - RNA, 22 nt, Homo sapiens
agagaccuguaaaguucaggca

SEQ ID NO: 170322 - RNA, 19 nt, Homo sapiens
agaguauuguuacuucucu

SEQ ID NO: 170323 - RNA, 22 nt, Homo sapiens
agauguuguucaucugauuguu

SEQ ID NO: 170324 - RNA, 22 nt, Homo sapiens
agcaagaugaaguugagcuagg

SEQ ID NO: 170325 - RNA, 23 nt, Homo sapiens
agccugguuucccugcuucuccc

SEQ ID NO: 170326 - RNA, 20 nt, Homo sapiens
agguagauagaugauagaua

SEQ ID NO: 170327 - RNA, 22 nt, Homo sapiens
aggugguuuuaggcagagacau

SEQ ID NO: 170328 - RNA, 22 nt, Homo sapiens
agugcaauggugccaucauagc

SEQ ID NO: 170329 - RNA, 22 nt, Homo sapiens
agugcacuccagccugggcaac

SEQ ID NO: 170330 - RNA, 22 nt, Homo sapiens
auaaagccaugagcuugagaug

SEQ ID NO: 170331 - RNA, 22 nt, Homo sapiens
auacaucugccauguuggugug

SEQ ID NO: 170332 - RNA, 22 nt, Homo sapiens
auacaugugccauguugguaug

SEQ ID NO: 170333 - RNA, 22 nt, Homo sapiens
auagaagcugccaacguuucag

SEQ ID NO: 170334 - RNA, 22 nt, Homo sapiens
auagcagaacagugucucacug

SEQ ID NO: 170335 - RNA, 22 nt, Homo sapiens
auagcagaauuuggucaagucu

SEQ ID NO: 170336 - RNA, 22 nt, Homo sapiens
auagcauaucccacaugucaga

SEQ ID NO: 170337 - RNA, 22 nt, Homo sapiens
auaugcaaauccauagagacag

SEQ ID NO: 170338 - RNA, 23 nt, Homo sapiens
aucagguuguagaauguguuugc

SEQ ID NO: 170339 - RNA, 22 nt, Homo sapiens
auccugaagcuuuacugaauuc

SEQ ID NO: 170340 - RNA, 22 nt, Homo sapiens
aucugugaaugaaguuauuuug

SEQ ID NO: 170341 - RNA, 22 nt, Homo sapiens
augacugucagggcagucauug

SEQ ID NO: 170342 - RNA, 22 nt, Homo sapiens
augacuuuucugaaaaccacca

SEQ ID NO: 170343 - RNA, 22 nt, Homo sapiens
augaggcacugcgcccuacuga

SEQ ID NO: 170344 - RNA, 22 nt, Homo sapiens
augaggcaggaaaggcguaucu

SEQ ID NO: 170345 - RNA, 22 nt, Homo sapiens
augcaacugcacuccagccugg

SEQ ID NO: 170346 - RNA, 22 nt, Homo sapiens
augcaacuugaaauuuuccgga

SEQ ID NO: 170347 - RNA, 22 nt, Homo sapiens
auggcacuccagccugggcaac

SEQ ID NO: 170348 - RNA, 22 nt, Homo sapiens
auggcagugagucucuaguauu

SEQ ID NO: 170349 - RNA, 22 nt, Homo sapiens
auggcagugucuagggguguuu

SEQ ID NO: 170350 - RNA, 22 nt, Homo sapiens
auggcaguuucagcuauaguuu

SEQ ID NO: 170351 - RNA, 22 nt, Homo sapiens
auggcucuguuccaugugucuu

SEQ ID NO: 170352 - RNA, 22 nt, Homo sapiens
auggcucuuauuauuugaggua

SEQ ID NO: 170353 - RNA, 22 nt, Homo sapiens
auggcuuugggcugcucugccc

SEQ ID NO: 170354 - RNA, 22 nt, Homo sapiens
augucaacauagacaguagagu

SEQ ID NO: 170355 - RNA, 22 nt, Homo sapiens
auguccaugagcacauguauca

SEQ ID NO: 170356 - RNA, 22 nt, Homo sapiens
auguccauggaaucuguagcaa

SEQ ID NO: 170357 - RNA, 22 nt, Homo sapiens
auuacuuugcaccaaccuaaua

SEQ ID NO: 170358 - RNA, 20 nt, Homo sapiens
auuccacuuauaugaggucc

SEQ ID NO: 170359 - RNA, 22 nt, Homo sapiens
auuccacuuccacuaguuucuc

SEQ ID NO: 170360 - RNA, 22 nt, Homo sapiens
auucuauaguccuaggauuggg

SEQ ID NO: 170361 - RNA, 22 nt, Homo sapiens
auugcacaccagucugggcaaa

SEQ ID NO: 170362 - RNA, 22 nt, Homo sapiens
auugcacaucugcacuacagcc

SEQ ID NO: 170363 - RNA, 19 nt, Homo sapiens
auugcacuccaaccugggu

SEQ ID NO: 170364 - RNA, 22 nt, Homo sapiens
auugcacuccagccuggcaaua

SEQ ID NO: 170365 - RNA, 22 nt, Homo sapiens
auugcacuccagccuggccaac

SEQ ID NO: 170366 - RNA, 22 nt, Homo sapiens
auugcacuccagccugggcuag

SEQ ID NO: 170367 - RNA, 22 nt, Homo sapiens
auugcacuccagucugggcaac

SEQ ID NO: 170368 - RNA, 22 nt, Homo sapiens
auugcacuccauccugggcaau

SEQ ID NO: 170369 - RNA, 22 nt, Homo sapiens
auugcacugcagccugggcaac

SEQ ID NO: 170370 - RNA, 22 nt, Homo sapiens
auugcauaaacacauuucuuau

SEQ ID NO: 170371 - RNA, 22 nt, Homo sapiens
auuucuacuccuguguccagaa

SEQ ID NO: 170372 - RNA, 22 nt, Homo sapiens
cacaguugccuaucuccugaag

SEQ ID NO: 170373 - RNA, 22 nt, Homo sapiens
caguuacuugacacaaccaauu

SEQ ID NO: 170374 - RNA, 22 nt, Homo sapiens
cauacaagcuacaaucacaaag

SEQ ID NO: 170375 - RNA, 22 nt, Homo sapiens
caugccacuguggacaaagaca

SEQ ID NO: 170376 - RNA, 22 nt, Homo sapiens
cauggcuuguauaagauucuca

SEQ ID NO: 170377 - RNA, 22 nt, Homo sapiens
cauggcuuuauuuucagcuucu

SEQ ID NO: 170378 - RNA, 22 nt, Homo sapiens
cauggcuuucacaguaaagccu

SEQ ID NO: 170379 - RNA, 22 nt, Homo sapiens
cauugcacuccagccucggcaa

SEQ ID NO: 170380 - RNA, 20 nt, Homo sapiens
cauugcacuccagccugcug

SEQ ID NO: 170381 - RNA, 22 nt, Homo sapiens
cauugcacucuagccucggcaa

SEQ ID NO: 170382 - RNA, 22 nt, Homo sapiens
cauugcacugcagcccgggcaa

SEQ ID NO: 170383 - RNA, 22 nt, Homo sapiens
cauugcacuuagacaacuuuug

SEQ ID NO: 170384 - RNA, 22 nt, Homo sapiens
aaaagcauucagagugcugggc

SEQ ID NO: 170385 - RNA, 23 nt, Homo sapiens
aaagacuagucaggugcaguggu

SEQ ID NO: 170386 - RNA, 22 nt, Homo sapiens
aaaugcuuucuuggaccauuug

SEQ ID NO: 170387 - RNA, 22 nt, Homo sapiens
aacacuguuuccagucaugauc

SEQ ID NO: 170388 - RNA, 22 nt, Homo sapiens
aagagaugaagguccugacugu

SEQ ID NO: 170389 - RNA, 22 nt, Homo sapiens
aaguauguaucaagucauacuu

SEQ ID NO: 170390 - RNA, 22 nt, Homo sapiens
aagugccauguggaugggcccu

SEQ ID NO: 170391 - RNA, 17 nt, Homo sapiens
aaguggcuuguucacca

SEQ ID NO: 170392 - RNA, 22 nt, Homo sapiens
aagugguuuuuacaaagacaga

SEQ ID NO: 170393 - RNA, 22 nt, Homo sapiens
aauaucacaggguguacacuca

SEQ ID NO: 170394 - RNA, 22 nt, Homo sapiens
aauggcuucuuauugugguuca

SEQ ID NO: 170395 - RNA, 22 nt, Homo sapiens
acacacgugcauguaugcguau

SEQ ID NO: 170396 - RNA, 22 nt, Homo sapiens
acacagugucuguguauuuaaa

SEQ ID NO: 170397 - RNA, 21 nt, Homo sapiens
acaucagaguugugaagguag

SEQ ID NO: 170398 - RNA, 22 nt, Homo sapiens
acauucagcuguuguuucaaug

SEQ ID NO: 170399 - RNA, 18 nt, Homo sapiens
acauucagcuugaagaua

SEQ ID NO: 170400 - RNA, 22 nt, Homo sapiens
accugagacuaggcauuuuaua

SEQ ID NO: 170401 - RNA, 22 nt, Homo sapiens
acucagagauuagcacauguuu

SEQ ID NO: 170402 - RNA, 22 nt, Homo sapiens
agaaugugaacaucuugaaagu

SEQ ID NO: 170403 - RNA, 22 nt, Homo sapiens
agacaagauggcuugagguuca

SEQ ID NO: 170404 - RNA, 22 nt, Homo sapiens
agaugauguuuacugagcauca

SEQ ID NO: 170405 - RNA, 22 nt, Homo sapiens
agcuggcuguggagaaaccccu

SEQ ID NO: 170406 - RNA, 22 nt, Homo sapiens
agcugguuuaauaugcugucug

SEQ ID NO: 170407 - RNA, 20 nt, Homo sapiens
agcugguuuuaugaaucuuu

SEQ ID NO: 170408 - RNA, 22 nt, Homo sapiens
aggcaagagugacuacgugaaa

SEQ ID NO: 170409 - RNA, 22 nt, Homo sapiens
aguaaauuucugugcuuucaua

SEQ ID NO: 170410 - RNA, 19 nt, Homo sapiens
aguggguguuuucuguuug

SEQ ID NO: 170411 - RNA, 22 nt, Homo sapiens
auacaagugccauguuggugug

SEQ ID NO: 170412 - RNA, 22 nt, Homo sapiens
auacaaguuauuugaacugcgg

SEQ ID NO: 170413 - RNA, 21 nt, Homo sapiens
auagcacuucacuugguuaga

SEQ ID NO: 170414 - RNA, 22 nt, Homo sapiens
auagcagacauuucaaggcagg

SEQ ID NO: 170415 - RNA, 22 nt, Homo sapiens
auaugcuuauuagcaagaaaua

SEQ ID NO: 170416 - RNA, 22 nt, Homo sapiens
auauggcuaugugagcauacca

SEQ ID NO: 170417 - RNA, 22 nt, Homo sapiens
auauucacagguaucagagauu

SEQ ID NO: 170418 - RNA, 22 nt, Homo sapiens
auccaagagacugaugacuucc

SEQ ID NO: 170419 - RNA, 22 nt, Homo sapiens
auccauugucuaaugcuaagau

SEQ ID NO: 170420 - RNA, 22 nt, Homo sapiens
aucccaguucagccucugacac

SEQ ID NO: 170421 - RNA, 22 nt, Homo sapiens
aucuacagccagucugguuugu

SEQ ID NO: 170422 - RNA, 22 nt, Homo sapiens
augacauugaugcucuggcugg

SEQ ID NO: 170423 - RNA, 22 nt, Homo sapiens
auggaaacauaagaguauagau

SEQ ID NO: 170424 - RNA, 22 nt, Homo sapiens
auggcaguuuauucuaaaucaa

SEQ ID NO: 170425 - RNA, 22 nt, Homo sapiens
auggccugaugcaccuguccca

SEQ ID NO: 170426 - RNA, 22 nt, Homo sapiens
auggcucuuauuauuuugaggu

SEQ ID NO: 170427 - RNA, 22 nt, Homo sapiens
auggcuguuccugggaguucua

SEQ ID NO: 170428 - RNA, 22 nt, Homo sapiens
auguaacugggacacaagccuc

SEQ ID NO: 170429 - RNA, 22 nt, Homo sapiens
augucuuucauagagacccaga

SEQ ID NO: 170430 - RNA, 22 nt, Homo sapiens
augugacuuuuuccugugccuu

SEQ ID NO: 170431 - RNA, 22 nt, Homo sapiens
augugcaagaucauuaaagcuc

SEQ ID NO: 170432 - RNA, 22 nt, Homo sapiens
augugcuuauagguguauguuu

SEQ ID NO: 170433 - RNA, 20 nt, Homo sapiens
auuccacuuguuugagguac

SEQ ID NO: 170434 - RNA, 22 nt, Homo sapiens
auugaacuguuggagagguuuu

SEQ ID NO: 170435 - RNA, 22 nt, Homo sapiens
auugcacuccacccugggcaac

SEQ ID NO: 170436 - RNA, 22 nt, Homo sapiens
auugcacuccagccuggggaac

SEQ ID NO: 170437 - RNA, 22 nt, Homo sapiens
auuggcuuuugaaagucugcga

SEQ ID NO: 170438 - RNA, 22 nt, Homo sapiens
auuguacuccagccugggcaag

SEQ ID NO: 170439 - RNA, 22 nt, Homo sapiens
caaugguuuuuuaguauaagua

SEQ ID NO: 170440 - RNA, 22 nt, Homo sapiens
cacagugaacugguggguuuuu

SEQ ID NO: 170441 - RNA, 22 nt, Homo sapiens
cacaguguuacugguaugaagu

SEQ ID NO: 170442 - RNA, 22 nt, Homo sapiens
cacuguggauggaacuauguga

SEQ ID NO: 170443 - RNA, 22 nt, Homo sapiens
cagagagcuugcccuuguauau

SEQ ID NO: 170444 - RNA, 22 nt, Homo sapiens
caggaaugugaggguucccugc

SEQ ID NO: 170445 - RNA, 22 nt, Homo sapiens
cauaaagauggaggaggccagg

SEQ ID NO: 170446 - RNA, 23 nt, Homo sapiens
caugaacuaguuugcagccauga

SEQ ID NO: 170447 - RNA, 22 nt, Homo sapiens
cauugcacuccagccugaggga

SEQ ID NO: 170448 - RNA, 22 nt, Homo sapiens
cauugcacuccagccuggccaa

SEQ ID NO: 170449 - RNA, 22 nt, Homo sapiens
cauugcacuccauccuuggcaa

SEQ ID NO: 170450 - RNA, 22 nt, Homo sapiens
cauugcacugcauucugggcaa

SEQ ID NO: 170451 - RNA, 20 nt, Homo sapiens
cauugcccuccagccugggc

SEQ ID NO: 170452 - RNA, 22 nt, Homo sapiens
cauugcccuccagccugggcaa

SEQ ID NO: 170453 - RNA, 22 nt, Homo sapiens
auugcacuccagccugggcgac

SEQ ID NO: 170454 - RNA, 18 nt, Homo sapiens
auugcacuccugccuggg

SEQ ID NO: 170455 - RNA, 23 nt, Homo sapiens
auugcagaaucacagagguagug

SEQ ID NO: 170456 - RNA, 22 nt, Homo sapiens
auugcucuuagaaauauuucuu

SEQ ID NO: 170457 - RNA, 22 nt, Homo sapiens
auuguacuccagccugggcagc

SEQ ID NO: 170458 - RNA, 22 nt, Homo sapiens
caacacagugaaacccgucucu

SEQ ID NO: 170459 - RNA, 22 nt, Homo sapiens
caguuacuuuugcaccaaccua

SEQ ID NO: 170460 - RNA, 22 nt, Homo sapiens
caucacuuugccuccgucucua

SEQ ID NO: 170461 - RNA, 22 nt, Homo sapiens
caucacuuuuccuuuuacagau

SEQ ID NO: 170462 - RNA, 22 nt, Homo sapiens
caucgcacuccagccugggcaa

SEQ ID NO: 170463 - RNA, 22 nt, Homo sapiens
caugaaagugagaaacuccugg

SEQ ID NO: 170464 - RNA, 22 nt, Homo sapiens
caugcacugaguccaccucugg

SEQ ID NO: 170465 - RNA, 22 nt, Homo sapiens
cauggcuuuaagcaacaccaag

SEQ ID NO: 170466 - RNA, 22 nt, Homo sapiens
cauggcuuuuauaacaagaaau

SEQ ID NO: 170467 - RNA, 22 nt, Homo sapiens
cauuaguugaagugcagggaga

SEQ ID NO: 170468 - RNA, 19 nt, Homo sapiens
cauugcacuccacccuggg

SEQ ID NO: 170469 - RNA, 22 nt, Homo sapiens
cauugcacuccagccuaggcaa

SEQ ID NO: 170470 - RNA, 22 nt, Homo sapiens
cauugcacuccagccugccugg

SEQ ID NO: 170471 - RNA, 22 nt, Homo sapiens
cauugcacuccagccuggcaac

SEQ ID NO: 170472 - RNA, 22 nt, Homo sapiens
cauugcacuccagcucugggcg

SEQ ID NO: 170473 - RNA, 20 nt, Homo sapiens
cauugcacuccagcuugggc

SEQ ID NO: 170474 - RNA, 22 nt, Homo sapiens
cauuuuacuuuccagacgugga

SEQ ID NO: 170475 - RNA, 22 nt, Homo sapiens
ccagucuuggugucuguagcac

SEQ ID NO: 170476 - RNA, 22 nt, Homo sapiens
ccuucuuuuguaaggcugaaua

SEQ ID NO: 170477 - RNA, 22 nt, Homo sapiens
ccuuggcacuuugccacagugc

SEQ ID NO: 170478 - RNA, 22 nt, Homo sapiens
cuaauacaguuguccaagcugg

SEQ ID NO: 170479 - RNA, 22 nt, Homo sapiens
cuacagcagcccaguccccgaa

SEQ ID NO: 170480 - RNA, 22 nt, Homo sapiens
cuauaacagugugguuuggaga

SEQ ID NO: 170481 - RNA, 22 nt, Homo sapiens
cucagugucuggcacacagaaa

SEQ ID NO: 170482 - RNA, 17 nt, Homo sapiens
cucucugguuuaaagca

SEQ ID NO: 170483 - RNA, 22 nt, Homo sapiens
cucuuuggaugccuuaggguua

SEQ ID NO: 170484 - RNA, 22 nt, Homo sapiens
cuggcagugcuuguuauccugg

SEQ ID NO: 170485 - RNA, 22 nt, Homo sapiens
cuggcaguguuucuugugggcu

SEQ ID NO: 170486 - RNA, 22 nt, Homo sapiens
cugugcauguuguccaauucuu

SEQ ID NO: 170487 - RNA, 22 nt, Homo sapiens
cuguucaggaggcauuuggugg

SEQ ID NO: 170488 - RNA, 22 nt, Homo sapiens
cuucaucugguuugugaacuuu

SEQ ID NO: 170489 - RNA, 22 nt, Homo sapiens
cuucuguuaguucugauaacuu

SEQ ID NO: 170490 - RNA, 22 nt, Homo sapiens
cuuuacaguuggacucacgagg

SEQ ID NO: 170491 - RNA, 22 nt, Homo sapiens
cuuugguuaauaggauauggca

SEQ ID NO: 170492 - RNA, 22 nt, Homo sapiens
cuuuguaugucaugacaacugu

SEQ ID NO: 170493 - RNA, 22 nt, Homo sapiens
cuuuugugauucuucaguugcu

SEQ ID NO: 170494 - RNA, 22 nt, Homo sapiens
gaaaacugcuucucuggguuuc

SEQ ID NO: 170495 - RNA, 22 nt, Homo sapiens
gaaagauuuccugagcuagaaa

SEQ ID NO: 170496 - RNA, 22 nt, Homo sapiens
gaaaugcucauuuuggauccuu

SEQ ID NO: 170497 - RNA, 23 nt, Homo sapiens
gaaguaauaaauggauucuuaac

SEQ ID NO: 170498 - RNA, 22 nt, Homo sapiens
gacaagagaacacugcuauauu

SEQ ID NO: 170499 - RNA, 18 nt, Homo sapiens
gacuuggaguuuacagug

SEQ ID NO: 170500 - RNA, 22 nt, Homo sapiens
gagacauugacuuuguuccaga

SEQ ID NO: 170501 - RNA, 22 nt, Homo sapiens
gagaucacuguuuauauucucu

SEQ ID NO: 170502 - RNA, 22 nt, Homo sapiens
gagaugaugagauguucacagu

SEQ ID NO: 170503 - RNA, 22 nt, Homo sapiens
gagcucaccuuaccucuggagc

SEQ ID NO: 170504 - RNA, 22 nt, Homo sapiens
gauacaccauuuucuagcuauu

SEQ ID NO: 170505 - RNA, 22 nt, Homo sapiens
gaugauguugaauguucucacc

SEQ ID NO: 170506 - RNA, 22 nt, Homo sapiens
ggagaauugcuuggacccggga

SEQ ID NO: 170507 - RNA, 22 nt, Homo sapiens
ggagaugaaaugagcuacuuaa

SEQ ID NO: 170508 - RNA, 22 nt, Homo sapiens
ggcagaauugcugaggaugcua

SEQ ID NO: 170509 - RNA, 22 nt, Homo sapiens
ggggaauguuaaagaauuugca

SEQ ID NO: 170510 - RNA, 22 nt, Homo sapiens
guacacauacauauaugugugu

SEQ ID NO: 170511 - RNA, 22 nt, Homo sapiens
guccaguacucuuuccugaaaa

SEQ ID NO: 170512 - RNA, 22 nt, Homo sapiens
gucuguuugauccagaucaaaa

SEQ ID NO: 170513 - RNA, 22 nt, Homo sapiens
guggacaugaauuuuggaggca

SEQ ID NO: 170514 - RNA, 22 nt, Homo sapiens
guggcagugugaggauccugcu

SEQ ID NO: 170515 - RNA, 22 nt, Homo sapiens
guguuauuuugcugggaaugau

SEQ ID NO: 170516 - RNA, 22 nt, Homo sapiens
guugguuuccuguaacuggaca

SEQ ID NO: 170517 - RNA, 21 nt, Homo sapiens
uaaaacuguaacuuuguccug

SEQ ID NO: 170518 - RNA, 22 nt, Homo sapiens
uaaagugcugagaugaggcugg

SEQ ID NO: 170519 - RNA, 20 nt, Homo sapiens
uaagccacacagucuaaggu

SEQ ID NO: 170520 - RNA, 22 nt, Homo sapiens
uaaucucagcuacucaggaggc

SEQ ID NO: 170521 - RNA, 22 nt, Homo sapiens
uacaaaucuagguuuguuacug

SEQ ID NO: 170522 - RNA, 22 nt, Homo sapiens
uacagucacauuccugaccaua

SEQ ID NO: 170523 - RNA, 22 nt, Homo sapiens
uacaguguuuugguauuccaca

SEQ ID NO: 170524 - RNA, 22 nt, Homo sapiens
uaccacugccgagaaaacagau

SEQ ID NO: 170525 - RNA, 20 nt, Homo sapiens
uagcacacauguagaauagu

SEQ ID NO: 170526 - RNA, 22 nt, Homo sapiens
uagcuguuggugggaagucaga

SEQ ID NO: 170527 - RNA, 22 nt, Homo sapiens
uauacaugugccauguuggugu

SEQ ID NO: 170528 - RNA, 22 nt, Homo sapiens
uaucagcagagucauacuucaa

SEQ ID NO: 170529 - RNA, 20 nt, Homo sapiens
uaugacacugucauaaaaau

SEQ ID NO: 170530 - RNA, 22 nt, Homo sapiens
uaugacauaguccuuaacccuc

SEQ ID NO: 170531 - RNA, 22 nt, Homo sapiens
uaugagacugguuaauuuuugu

SEQ ID NO: 170532 - RNA, 22 nt, Homo sapiens
uauggaaaucuuaccuuauggu

SEQ ID NO: 170533 - RNA, 21 nt, Homo sapiens
uauggauuugccuauucugga

SEQ ID NO: 170534 - RNA, 21 nt, Homo sapiens
uauggcuuagucaguguuucc

SEQ ID NO: 170535 - RNA, 22 nt, Homo sapiens
uauggcuucuauaaggaagcuu

SEQ ID NO: 170536 - RNA, 22 nt, Homo sapiens
uauggcuucuuauucuuucccg

SEQ ID NO: 170537 - RNA, 22 nt, Homo sapiens
uauggcuuuguucaacagccuc

SEQ ID NO: 170538 - RNA, 22 nt, Homo sapiens
uauugcaauuggcagagugcua

SEQ ID NO: 170539 - RNA, 22 nt, Homo sapiens
uauuugguagcuauuuugcagu

SEQ ID NO: 170540 - RNA, 20 nt, Homo sapiens
ucaaagacauggcugucaga

SEQ ID NO: 170541 - RNA, 22 nt, Homo sapiens
ucaagugcauugauucaguauu

SEQ ID NO: 170542 - RNA, 22 nt, Homo sapiens
ucacaguccuguuuaggagagg

SEQ ID NO: 170543 - RNA, 22 nt, Homo sapiens
ucacuuugacggccaacuucua

SEQ ID NO: 170544 - RNA, 22 nt, Homo sapiens
ucauaucauuagaucuacugua

SEQ ID NO: 170545 - RNA, 22 nt, Homo sapiens
uccagaguggugaugcuggggc

SEQ ID NO: 170546 - RNA, 17 nt, Homo sapiens
ucuaauaauaugcauuu

SEQ ID NO: 170547 - RNA, 22 nt, Homo sapiens
ucuggaauguaaaguuuauggg

SEQ ID NO: 170548 - RNA, 22 nt, Homo sapiens
ucugucuuguccucacccuaga

SEQ ID NO: 170549 - RNA, 22 nt, Homo sapiens
ucugucuuugucaggaccagag

SEQ ID NO: 170550 - RNA, 21 nt, Homo sapiens
ugaacacuggacugagugucc

SEQ ID NO: 170551 - RNA, 22 nt, Homo sapiens
ugacaagaaagcgucuucuuuu

SEQ ID NO: 170552 - RNA, 22 nt, Homo sapiens
ugacaagaacuuuccauaguaa

SEQ ID NO: 170553 - RNA, 22 nt, Homo sapiens
ugagaccuuucauuucucagug

SEQ ID NO: 170554 - RNA, 22 nt, Homo sapiens
ugagaucaagguuaauauaauc

SEQ ID NO: 170555 - RNA, 22 nt, Homo sapiens
ugagaucugauaggccuggguu

SEQ ID NO: 170556 - RNA, 22 nt, Homo sapiens
ugagaucuuuuguggcugagaa

SEQ ID NO: 170557 - RNA, 22 nt, Homo sapiens
ugagaugacgacacaccucagu

SEQ ID NO: 170558 - RNA, 22 nt, Homo sapiens
ucuaaaacuagauugugaugau

SEQ ID NO: 170559 - RNA, 22 nt, Homo sapiens
ucuacagccaguucaggaagaa

SEQ ID NO: 170560 - RNA, 22 nt, Homo sapiens
ucucuggauaucuacuuauguu

SEQ ID NO: 170561 - RNA, 20 nt, Homo sapiens
ucugauugcaacugcaugag

SEQ ID NO: 170562 - RNA, 22 nt, Homo sapiens
ucugucuuugccuaaguuuguc

SEQ ID NO: 170563 - RNA, 22 nt, Homo sapiens
ucuugguugaaaauucauaaua

SEQ ID NO: 170564 - RNA, 22 nt, Homo sapiens
ugaauagacacuaaagacugua

SEQ ID NO: 170565 - RNA, 22 nt, Homo sapiens
ugacaagauauggucuuaucaa

SEQ ID NO: 170566 - RNA, 22 nt, Homo sapiens
ugacaaguaaacagucagcacc

SEQ ID NO: 170567 - RNA, 20 nt, Homo sapiens
ugagaacauguggcauuugg

SEQ ID NO: 170568 - RNA, 20 nt, Homo sapiens
ugagaacaugugguauuugg

SEQ ID NO: 170569 - RNA, 22 nt, Homo sapiens
ugagaacugguagcacuuguga

SEQ ID NO: 170570 - RNA, 22 nt, Homo sapiens
ugagaucaguuguuauaauucu

SEQ ID NO: 170571 - RNA, 22 nt, Homo sapiens
ugagaucuuggaggcuuuguga

SEQ ID NO: 170572 - RNA, 19 nt, Homo sapiens
ugagaugaagacagggguu

SEQ ID NO: 170573 - RNA, 22 nt, Homo sapiens
ugagaugaagucucacucuguc

SEQ ID NO: 170574 - RNA, 22 nt, Homo sapiens
ugagaugaagucuugcucuguu

SEQ ID NO: 170575 - RNA, 22 nt, Homo sapiens
ugagaugagggcugcacucaaa

SEQ ID NO: 170576 - RNA, 22 nt, Homo sapiens
ugagccaaugauuugaauagag

SEQ ID NO: 170577 - RNA, 22 nt, Homo sapiens
ugagcugagauuaagcugcugc

SEQ ID NO: 170578 - RNA, 22 nt, Homo sapiens
ugagguagaggugaacuugacc

SEQ ID NO: 170579 - RNA, 22 nt, Homo sapiens
ugauuggagaacaaacugcaua

SEQ ID NO: 170580 - RNA, 22 nt, Homo sapiens
ugccaaaaugggcuuuauaccg

SEQ ID NO: 170581 - RNA, 22 nt, Homo sapiens
ugcucaguuuaaaacuuuugag

SEQ ID NO: 170582 - RNA, 22 nt, Homo sapiens
uggaacacauaaauagcauagu

SEQ ID NO: 170583 - RNA, 20 nt, Homo sapiens
uggaaucugaagaucucagu

SEQ ID NO: 170584 - RNA, 22 nt, Homo sapiens
uggagcccuaguuccucauaac

SEQ ID NO: 170585 - RNA, 22 nt, Homo sapiens
uggagugaaaacacacuaaucu

SEQ ID NO: 170586 - RNA, 22 nt, Homo sapiens
uggcuuuuauuauguugaggua

SEQ ID NO: 170587 - RNA, 22 nt, Homo sapiens
uggucaguugaguccuugccaa

SEQ ID NO: 170588 - RNA, 21 nt, Homo sapiens
uggucaguuuucucacuagga

SEQ ID NO: 170589 - RNA, 22 nt, Homo sapiens
ugguucaguugcacaggcuguu

SEQ ID NO: 170590 - RNA, 22 nt, Homo sapiens
uguaacaggaggaaaaugugaa

SEQ ID NO: 170591 - RNA, 22 nt, Homo sapiens
ugucagaaucuagaggcugcua

SEQ ID NO: 170592 - RNA, 19 nt, Homo sapiens
ugugaacaucacagagugu

SEQ ID NO: 170593 - RNA, 22 nt, Homo sapiens
ugugagacugguucugaaccca

SEQ ID NO: 170594 - RNA, 22 nt, Homo sapiens
ugugcaaggcucucaaccugug

SEQ ID NO: 170595 - RNA, 22 nt, Homo sapiens
uguuucuacugucucuguagua

SEQ ID NO: 170596 - RNA, 22 nt, Homo sapiens
uuaaaaguauaggccuggcaua

SEQ ID NO: 170597 - RNA, 22 nt, Homo sapiens
uuaaguaaucagagaagagaac

SEQ ID NO: 170598 - RNA, 21 nt, Homo sapiens
uuaaguaauuacccaacucuc

SEQ ID NO: 170599 - RNA, 22 nt, Homo sapiens
uuacagcagugccccacuccca

SEQ ID NO: 170600 - RNA, 22 nt, Homo sapiens
uuaguucauugugacuggacuc

SEQ ID NO: 170601 - RNA, 22 nt, Homo sapiens
uuauggauuuauauucuguagu

SEQ ID NO: 170602 - RNA, 22 nt, Homo sapiens
uuauggccauucuuguaggagu

SEQ ID NO: 170603 - RNA, 22 nt, Homo sapiens
uuauucagcaccugcuguguuc

SEQ ID NO: 170604 - RNA, 22 nt, Homo sapiens
uucaagaauuaaaguggcuuuu

SEQ ID NO: 170605 - RNA, 22 nt, Homo sapiens
uucaauaugucauuggcaggca

SEQ ID NO: 170606 - RNA, 22 nt, Homo sapiens
uucagcuacuugggaggcugaa

SEQ ID NO: 170607 - RNA, 19 nt, Homo sapiens
uucauacagugagagcagc

SEQ ID NO: 170608 - RNA, 22 nt, Homo sapiens
uucccagugccaggcacuggga

SEQ ID NO: 170609 - RNA, 22 nt, Homo sapiens
uucucugggacauaggucgggu

SEQ ID NO: 170610 - RNA, 22 nt, Homo sapiens
uucuguguuuaggucacggcua

SEQ ID NO: 170611 - RNA, 22 nt, Homo sapiens
uugacuagaccaucuuucuaga

SEQ ID NO: 170612 - RNA, 22 nt, Homo sapiens
uugacuuuuauucacucugcua

SEQ ID NO: 170613 - RNA, 22 nt, Homo sapiens
uugagauggaaucucgcuuugu

SEQ ID NO: 170614 - RNA, 22 nt, Homo sapiens
uugagauggagucucacuccuu

SEQ ID NO: 170615 - RNA, 22 nt, Homo sapiens
uugagauggagucucgcucugu

SEQ ID NO: 170616 - RNA, 22 nt, Homo sapiens
uugagauggagucuugcucucu

SEQ ID NO: 170617 - RNA, 22 nt, Homo sapiens
uugagauggagucuugcucuug

SEQ ID NO: 170618 - RNA, 22 nt, Homo sapiens
uugagauggaguguugcucugu

SEQ ID NO: 170619 - RNA, 22 nt, Homo sapiens
uugagggaggcagggcuugucu

SEQ ID NO: 170620 - RNA, 22 nt, Homo sapiens
uugaguccauucgaugcugauu

SEQ ID NO: 170621 - RNA, 22 nt, Homo sapiens
uugcacauguugaaccagcaaa

SEQ ID NO: 170622 - RNA, 22 nt, Homo sapiens
uugcuccucugccaggaccugu

SEQ ID NO: 170623 - RNA, 22 nt, Homo sapiens
uugcugagucuuucuagguugc

SEQ ID NO: 170624 - RNA, 22 nt, Homo sapiens
uugcuuagucaugaaucacuga

SEQ ID NO: 170625 - RNA, 22 nt, Homo sapiens
uuggaaacaccuggugagguua

SEQ ID NO: 170626 - RNA, 20 nt, Homo sapiens
uuggaaaugugaauugggag

SEQ ID NO: 170627 - RNA, 22 nt, Homo sapiens
uuggaacacauguuuuucuacc

SEQ ID NO: 170628 - RNA, 22 nt, Homo sapiens
uuggacuucucaaggcaauaaa

SEQ ID NO: 170629 - RNA, 22 nt, Homo sapiens
uuggcaguaucuacuacagcua

SEQ ID NO: 170630 - RNA, 22 nt, Homo sapiens
uuggcagugguucugacggacc

SEQ ID NO: 170631 - RNA, 22 nt, Homo sapiens
uugggagugucucuggacugca

SEQ ID NO: 170632 - RNA, 22 nt, Homo sapiens
uuguuuuggagaugagcuaaaa

SEQ ID NO: 170633 - RNA, 22 nt, Homo sapiens
uuucauggaggcauuuuagauu

SEQ ID NO: 170634 - RNA, 22 nt, Homo sapiens
uuucuacagggcuugccaggua

SEQ ID NO: 170635 - RNA, 22 nt, Homo sapiens
uuucuacagugaacgauuucua

SEQ ID NO: 170636 - RNA, 22 nt, Homo sapiens
uuugaaccauuugaagaaugau

SEQ ID NO: 170637 - RNA, 22 nt, Homo sapiens
uuuggucacugccgccgccagc

SEQ ID NO: 170638 - RNA, 22 nt, Homo sapiens
uuugugaggugauggauauguc

SEQ ID NO: 170639 - RNA, 22 nt, Homo sapiens
uuugugcaugaagagggggugc

SEQ ID NO: 170640 - RNA, 22 nt, Homo sapiens
uuuuaacagccaggggacggcc

SEQ ID NO: 170641 - RNA, 22 nt, Homo sapiens
uuuuaugggcuauuugcauuag

SEQ ID NO: 170642 - RNA, 22 nt, Homo sapiens
uagaccaauuggcauauaguaa

SEQ ID NO: 170643 - RNA, 22 nt, Homo sapiens
uagauuguaauaugcagaaugg

SEQ ID NO: 170644 - RNA, 22 nt, Homo sapiens
uagugaauguuggcuauuaaua

SEQ ID NO: 170645 - RNA, 22 nt, Homo sapiens
uauggcuuuuaacugucguaug

SEQ ID NO: 170646 - RNA, 22 nt, Homo sapiens
uauggcuuuuauuauguuguag

SEQ ID NO: 170647 - RNA, 22 nt, Homo sapiens
ucagagucuagaucacucacug

SEQ ID NO: 170648 - RNA, 22 nt, Homo sapiens
ucccugaaaauuagcauuuuaa

SEQ ID NO: 170649 - RNA, 19 nt, Homo sapiens
ucccugagucuuagcuuga

SEQ ID NO: 170650 - RNA, 22 nt, Homo sapiens
cauugcaugccagccugggcaa

SEQ ID NO: 170651 - RNA, 22 nt, Homo sapiens
cccagaguucuuaaauacugag

SEQ ID NO: 170652 - RNA, 22 nt, Homo sapiens
ccugucuugauuaaauuacuua

SEQ ID NO: 170653 - RNA, 18 nt, Homo sapiens
cuaagacacuuggcagag

SEQ ID NO: 170654 - RNA, 22 nt, Homo sapiens
cuacucugugguguauuugcau

SEQ ID NO: 170655 - RNA, 22 nt, Homo sapiens
cuagaguacuuaccacagcaug

SEQ ID NO: 170656 - RNA, 22 nt, Homo sapiens
cucagugucuggggccccaggg

SEQ ID NO: 170657 - RNA, 22 nt, Homo sapiens
cucuuugaguuccuccuggugu

SEQ ID NO: 170658 - RNA, 22 nt, Homo sapiens
cugaaagagcauguaacacagu

SEQ ID NO: 170659 - RNA, 22 nt, Homo sapiens
cugacuaguuuuaaugcagauu

SEQ ID NO: 170660 - RNA, 22 nt, Homo sapiens
cugagacacucuuaucugcaua

SEQ ID NO: 170661 - RNA, 22 nt, Homo sapiens
cugagcuagaccacuuggcucc

SEQ ID NO: 170662 - RNA, 22 nt, Homo sapiens
cugagcucauuucuuuugcuac

SEQ ID NO: 170663 - RNA, 22 nt, Homo sapiens
cuggaaacaucuuaggaaugca

SEQ ID NO: 170664 - RNA, 22 nt, Homo sapiens
cuggaauguuccuaaagauuca

SEQ ID NO: 170665 - RNA, 22 nt, Homo sapiens
cuggcacagugucagaaacaca

SEQ ID NO: 170666 - RNA, 22 nt, Homo sapiens
cugggaugugacuguugccccc

SEQ ID NO: 170667 - RNA, 22 nt, Homo sapiens
cugucuagagggcacaugaugc

SEQ ID NO: 170668 - RNA, 22 nt, Homo sapiens
cuuccaaguggggcacgugcca

SEQ ID NO: 170669 - RNA, 22 nt, Homo sapiens
gaaacugcauuucuaacaagcu

SEQ ID NO: 170670 - RNA, 22 nt, Homo sapiens
gacacagugaagucucuacuug

SEQ ID NO: 170671 - RNA, 22 nt, Homo sapiens
gacuugaagaaucuaagggagg

SEQ ID NO: 170672 - RNA, 22 nt, Homo sapiens
gaggcaagaguaguuaaguuag

SEQ ID NO: 170673 - RNA, 22 nt, Homo sapiens
gcauaaagcuaauaagacgaag

SEQ ID NO: 170674 - RNA, 22 nt, Homo sapiens
gcuuuguuaaaacacagccaca

SEQ ID NO: 170675 - RNA, 22 nt, Homo sapiens
ggaauggaacaaagucuugaaa

SEQ ID NO: 170676 - RNA, 22 nt, Homo sapiens
ggacaagagacugggacacuga

SEQ ID NO: 170677 - RNA, 22 nt, Homo sapiens
ggcaagaacuucacucacuuuu

SEQ ID NO: 170678 - RNA, 22 nt, Homo sapiens
ggcaaugucagcuaaugaugga

SEQ ID NO: 170679 - RNA, 22 nt, Homo sapiens
gggaaauguaaagucauaagau

SEQ ID NO: 170680 - RNA, 22 nt, Homo sapiens
gguaaaucuucacuaagacuga

SEQ ID NO: 170681 - RNA, 22 nt, Homo sapiens
guaaucucagcuacucaggagg

SEQ ID NO: 170682 - RNA, 22 nt, Homo sapiens
guagcagaauaucagauaauuu

SEQ ID NO: 170683 - RNA, 22 nt, Homo sapiens
guauacaugucaaaacucacau

SEQ ID NO: 170684 - RNA, 22 nt, Homo sapiens
gucauugcacuccagccuggac

SEQ ID NO: 170685 - RNA, 22 nt, Homo sapiens
gucucccagccuacaucuuucu

SEQ ID NO: 170686 - RNA, 19 nt, Homo sapiens
gugguauuaccuuuugauu

SEQ ID NO: 170687 - RNA, 22 nt, Homo sapiens
gugugacuagucaugccugaau

SEQ ID NO: 170688 - RNA, 22 nt, Homo sapiens
guguuauugagaaauagggugu

SEQ ID NO: 170689 - RNA, 22 nt, Homo sapiens
guucaagugauucuacugccuc

SEQ ID NO: 170690 - RNA, 22 nt, Homo sapiens
uaaagcauguaauuagguuaga

SEQ ID NO: 170691 - RNA, 22 nt, Homo sapiens
uaagacacuuaaaauguuacau

SEQ ID NO: 170692 - RNA, 22 nt, Homo sapiens
uaagacuguguaauuuaugaag

SEQ ID NO: 170693 - RNA, 22 nt, Homo sapiens
uaagagagcuccaucuuuuccu

SEQ ID NO: 170694 - RNA, 22 nt, Homo sapiens
uaaguacuuuacagacauuauc

SEQ ID NO: 170695 - RNA, 22 nt, Homo sapiens
uaaguauagguaacagaagcaa

SEQ ID NO: 170696 - RNA, 22 nt, Homo sapiens
uacaaguauuuuuauuagugcc

SEQ ID NO: 170697 - RNA, 22 nt, Homo sapiens
uacaccauuugauucuuuaagc

SEQ ID NO: 170698 - RNA, 22 nt, Homo sapiens
uacagucauaaugccuagugac

SEQ ID NO: 170699 - RNA, 22 nt, Homo sapiens
uacauagucuucuuuugguuau

SEQ ID NO: 170700 - RNA, 22 nt, Homo sapiens
uaccagcauuucucuuuaagua

SEQ ID NO: 170701 - RNA, 22 nt, Homo sapiens
uacccucuggauacccuuguuc

SEQ ID NO: 170702 - RNA, 19 nt, Homo sapiens
uaucacuucccuggaaaca

SEQ ID NO: 170703 - RNA, 22 nt, Homo sapiens
uaucacuuugauaguuuaaaug

SEQ ID NO: 170704 - RNA, 22 nt, Homo sapiens
uaucaguauggauucauggauu

SEQ ID NO: 170705 - RNA, 20 nt, Homo sapiens
uaugacaaagccuagugagu

SEQ ID NO: 170706 - RNA, 19 nt, Homo sapiens
uaugcaacuuauagugcug

SEQ ID NO: 170707 - RNA, 22 nt, Homo sapiens
uauggccccuacaugugcaaaa

SEQ ID NO: 170708 - RNA, 22 nt, Homo sapiens
uauggccuuuuuaaugauauug

SEQ ID NO: 170709 - RNA, 22 nt, Homo sapiens
uauggcuuucuacuugaguucu

SEQ ID NO: 170710 - RNA, 22 nt, Homo sapiens
uauggcuuuguuaacauuuucu

SEQ ID NO: 170711 - RNA, 22 nt, Homo sapiens
uauggcuuuucacuuaaguccu

SEQ ID NO: 170712 - RNA, 22 nt, Homo sapiens
uauuguacauauccucccuuca

SEQ ID NO: 170713 - RNA, 22 nt, Homo sapiens
uauuugguuggugcaaaaguaa

SEQ ID NO: 170714 - RNA, 22 nt, Homo sapiens
ucacaauucucaauuugugaaa

SEQ ID NO: 170715 - RNA, 23 nt, Homo sapiens
ucaguacuccacuuucaauagug

SEQ ID NO: 170716 - RNA, 22 nt, Homo sapiens
ucauacaguaguccucacuugu

SEQ ID NO: 170717 - RNA, 22 nt, Homo sapiens
ucauauugcgguucauugacuu

SEQ ID NO: 170718 - RNA, 22 nt, Homo sapiens
ucuauguuuuugcuaguagugu

SEQ ID NO: 170719 - RNA, 22 nt, Homo sapiens
ucucugagaaaaguuucuccca

SEQ ID NO: 170720 - RNA, 22 nt, Homo sapiens
ucugucuugugguuugagugcc

SEQ ID NO: 170721 - RNA, 22 nt, Homo sapiens
ucuuucacuuagcaugauguuu

SEQ ID NO: 170722 - RNA, 22 nt, Homo sapiens
ucuuuggugaauggucauccag

SEQ ID NO: 170723 - RNA, 22 nt, Homo sapiens
ucuuuguuggaguccaaggaua

SEQ ID NO: 170724 - RNA, 22 nt, Homo sapiens
ugaaacacacauugcccuuuau

SEQ ID NO: 170725 - RNA, 18 nt, Homo sapiens
ugaaacacauuuuuuccu

SEQ ID NO: 170726 - RNA, 22 nt, Homo sapiens
ugaaaucuaaaauguuccaaga

SEQ ID NO: 170727 - RNA, 22 nt, Homo sapiens
ugaaauuuuuuauucguuggcu

SEQ ID NO: 170728 - RNA, 22 nt, Homo sapiens
ugacaagagaccccuccgcagg

SEQ ID NO: 170729 - RNA, 22 nt, Homo sapiens
ugacuaaaacugaguuucauua

SEQ ID NO: 170730 - RNA, 22 nt, Homo sapiens
ugagaccugaucuugguacugc

SEQ ID NO: 170731 - RNA, 22 nt, Homo sapiens
ugagaucaugucauuugcacuc

SEQ ID NO: 170732 - RNA, 22 nt, Homo sapiens
ugagaugaacuugauuguuuua

SEQ ID NO: 170733 - RNA, 22 nt, Homo sapiens
ugagaugaagugauguaaaaca

SEQ ID NO: 170734 - RNA, 22 nt, Homo sapiens
ugagaugaguugcuggcucuga

SEQ ID NO: 170735 - RNA, 22 nt, Homo sapiens
ugagaugauagauauguuaauu

SEQ ID NO: 170736 - RNA, 22 nt, Homo sapiens
ugagaugauaucuuauuguaau

SEQ ID NO: 170737 - RNA, 22 nt, Homo sapiens
ugagaugaucaaaguauaggcu

SEQ ID NO: 170738 - RNA, 22 nt, Homo sapiens
ugagaugaugggauaagagggc

SEQ ID NO: 170739 - RNA, 22 nt, Homo sapiens
ugagaugauuuaauggagccca

SEQ ID NO: 170740 - RNA, 22 nt, Homo sapiens
ugagcaagaucuuuauaauuag

SEQ ID NO: 170741 - RNA, 22 nt, Homo sapiens
ugagccaugggguaaaugugau

SEQ ID NO: 170742 - RNA, 22 nt, Homo sapiens
ugagcucagcuaguugaggugu

SEQ ID NO: 170743 - RNA, 20 nt, Homo sapiens
ugagcucaugacauuuuucu

SEQ ID NO: 170744 - RNA, 22 nt, Homo sapiens
ugagcugagacaauaaguuuuu

SEQ ID NO: 170745 - RNA, 22 nt, Homo sapiens
ugaggugaggguaucaaaugcu

SEQ ID NO: 170746 - RNA, 22 nt, Homo sapiens
ugauuugucucucagcccuacu

SEQ ID NO: 170747 - RNA, 21 nt, Homo sapiens
ugcaagaaucaggaagcugcc

SEQ ID NO: 170748 - RNA, 22 nt, Homo sapiens
ugcaauuuaaugugucccaauu

SEQ ID NO: 170749 - RNA, 22 nt, Homo sapiens
ugcagaaucccuucagauccga

SEQ ID NO: 170750 - RNA, 22 nt, Homo sapiens
ugccaacugguuucuuuuaguu

SEQ ID NO: 170751 - RNA, 22 nt, Homo sapiens
ugccauugcacuccagccuggg

SEQ ID NO: 170752 - RNA, 22 nt, Homo sapiens
uggaaaacaugcacauuggauu

SEQ ID NO: 170753 - RNA, 22 nt, Homo sapiens
uggaagauggaguuuuaucauu

SEQ ID NO: 170754 - RNA, 22 nt, Homo sapiens
uggaagaugggaccucaguuuu

SEQ ID NO: 170755 - RNA, 22 nt, Homo sapiens
uggaagauucuagaagauucca

SEQ ID NO: 170756 - RNA, 22 nt, Homo sapiens
uggaaguuaaaugacucuuucu

SEQ ID NO: 170757 - RNA, 22 nt, Homo sapiens
uggagugagaacuucaaugaug

SEQ ID NO: 170758 - RNA, 22 nt, Homo sapiens
uggcagaugcucuuggugccca

SEQ ID NO: 170759 - RNA, 22 nt, Homo sapiens
uggcucauuucuaaacccagcu

SEQ ID NO: 170760 - RNA, 22 nt, Homo sapiens
uggugagaaaagaugucuuugu

SEQ ID NO: 170761 - RNA, 22 nt, Homo sapiens
uguagcuuuugagauuuauauu

SEQ ID NO: 170762 - RNA, 22 nt, Homo sapiens
ugucaauauguaauaacugaau

SEQ ID NO: 170763 - RNA, 22 nt, Homo sapiens
ugucucccuucccauuaggaag

SEQ ID NO: 170764 - RNA, 22 nt, Homo sapiens
ugugaaacauggauagaacugg

SEQ ID NO: 170765 - RNA, 22 nt, Homo sapiens
ugugacucuggcacauggugag

SEQ ID NO: 170766 - RNA, 22 nt, Homo sapiens
uguggaguguaugugacagaga

SEQ ID NO: 170767 - RNA, 22 nt, Homo sapiens
uuaacacugccauugauacugu

SEQ ID NO: 170768 - RNA, 22 nt, Homo sapiens
uuaagggaggagcuucaagaug

SEQ ID NO: 170769 - RNA, 22 nt, Homo sapiens
uuaauagugacucauuuuccac

SEQ ID NO: 170770 - RNA, 22 nt, Homo sapiens
uuauagcuaacaucugugaaaa

SEQ ID NO: 170771 - RNA, 21 nt, Homo sapiens
uuaucccagugucucugcagg

SEQ ID NO: 170772 - RNA, 22 nt, Homo sapiens
uuauguaaaucaaucuggaauc

SEQ ID NO: 170773 - RNA, 22 nt, Homo sapiens
uuccugagccuuguaucuagua

SEQ ID NO: 170774 - RNA, 22 nt, Homo sapiens
uucuacagugacugcagccaua

SEQ ID NO: 170775 - RNA, 22 nt, Homo sapiens
uucuacaugggucgucggugag

SEQ ID NO: 170776 - RNA, 22 nt, Homo sapiens
uucuacuucauuaggaggauug

SEQ ID NO: 170777 - RNA, 20 nt, Homo sapiens
uucuauggugaugaguccug

SEQ ID NO: 170778 - RNA, 22 nt, Homo sapiens
uucuaugguuuuuaugguguua

SEQ ID NO: 170779 - RNA, 22 nt, Homo sapiens
uucuuugcaugaucucaaaguc

SEQ ID NO: 170780 - RNA, 22 nt, Homo sapiens
uucuuuggauaaaguuuuaugc

SEQ ID NO: 170781 - RNA, 22 nt, Homo sapiens
aagaggccuaggaaucuguauu

SEQ ID NO: 170782 - RNA, 22 nt, Homo sapiens
aagagguaauaacaaagcuucu

SEQ ID NO: 170783 - RNA, 23 nt, Homo sapiens
aagagguaugacuaugaagugga

SEQ ID NO: 170784 - RNA, 22 nt, Homo sapiens
aagaguaguaguggcacucucu

SEQ ID NO: 170785 - RNA, 22 nt, Homo sapiens
aagagugucuuugugcuggccc

SEQ ID NO: 170786 - RNA, 21 nt, Homo sapiens
aagcacauugaguguguguga

SEQ ID NO: 170787 - RNA, 22 nt, Homo sapiens
aagcacccagccucacgccugc

SEQ ID NO: 170788 - RNA, 22 nt, Homo sapiens
aagcaggugaugagugggugug

SEQ ID NO: 170789 - RNA, 22 nt, Homo sapiens
aagcaguguggacuaaugggaa

SEQ ID NO: 170790 - RNA, 22 nt, Homo sapiens
aagcucauugagaucuauggcu

SEQ ID NO: 170791 - RNA, 22 nt, Homo sapiens
aagcuccauuucugccaugaga

SEQ ID NO: 170792 - RNA, 22 nt, Homo sapiens
aagcucuuguugaaucuuguca

SEQ ID NO: 170793 - RNA, 20 nt, Homo sapiens
aagcugaguguuuuuuuaau

SEQ ID NO: 170794 - RNA, 22 nt, Homo sapiens
aagcugccaggcaugguggcug

SEQ ID NO: 170795 - RNA, 22 nt, Homo sapiens
aagcugccuugcugaggagaaa

SEQ ID NO: 170796 - RNA, 22 nt, Homo sapiens
aagcuggauuuaguguggagca

SEQ ID NO: 170797 - RNA, 22 nt, Homo sapiens
aagcuggcauucaugagauuac

SEQ ID NO: 170798 - RNA, 22 nt, Homo sapiens
aagcugguguugcugcucuguu

SEQ ID NO: 170799 - RNA, 22 nt, Homo sapiens
aagcugugucuugucagcuacc

SEQ ID NO: 170800 - RNA, 22 nt, Homo sapiens
aagcuguguguaagcucucaca

SEQ ID NO: 170801 - RNA, 22 nt, Homo sapiens
aaggaacuggaauauuuugaac

SEQ ID NO: 170802 - RNA, 22 nt, Homo sapiens
aaggaagcuagcaggaauuggu

SEQ ID NO: 170803 - RNA, 22 nt, Homo sapiens
aaggaauucaaauuuucucugg

SEQ ID NO: 170804 - RNA, 22 nt, Homo sapiens
aaggagcagagagcccuguuuc

SEQ ID NO: 170805 - RNA, 22 nt, Homo sapiens
aaggagcuaagagaucauacau

SEQ ID NO: 170806 - RNA, 22 nt, Homo sapiens
aaggaguagaggaauagcaaug

SEQ ID NO: 170807 - RNA, 22 nt, Homo sapiens
aaggcaagaaaauggauucucc

SEQ ID NO: 170808 - RNA, 22 nt, Homo sapiens
aaggcaagagaaaauuucgagu

SEQ ID NO: 170809 - RNA, 22 nt, Homo sapiens
aaggcaagguggauaaugaagc

SEQ ID NO: 170810 - RNA, 22 nt, Homo sapiens
auucacuguggcuuucucugau

SEQ ID NO: 170811 - RNA, 22 nt, Homo sapiens
auuccacuuagugacucauuug

SEQ ID NO: 170812 - RNA, 22 nt, Homo sapiens
auuccacuuccacuaguuucuc

SEQ ID NO: 170813 - RNA, 22 nt, Homo sapiens
auuccauagugucuguggcaga

SEQ ID NO: 170814 - RNA, 22 nt, Homo sapiens
auuccauuuguguggaauggcu

SEQ ID NO: 170815 - RNA, 23 nt, Homo sapiens
auugaacacuuucauaugugagg

SEQ ID NO: 170816 - RNA, 22 nt, Homo sapiens
auugaacuguuggagagguuuu

SEQ ID NO: 170817 - RNA, 20 nt, Homo sapiens
auugaagacuccggggcaga

SEQ ID NO: 170818 - RNA, 21 nt, Homo sapiens
auugagcacaugaaacauggc

SEQ ID NO: 170819 - RNA, 18 nt, Homo sapiens
auugagcaugacagaccu

SEQ ID NO: 170820 - RNA, 22 nt, Homo sapiens
auugaguaaaaaauagugaugu

SEQ ID NO: 170821 - RNA, 22 nt, Homo sapiens
auugauagaucauaugguaggu

SEQ ID NO: 170822 - RNA, 23 nt, Homo sapiens
auugauagugccuuugugcuaau

SEQ ID NO: 170823 - RNA, 19 nt, Homo sapiens
auugauuaaguuugcuguc

SEQ ID NO: 170824 - RNA, 22 nt, Homo sapiens
auugcaauuaguccauagaguu

SEQ ID NO: 170825 - RNA, 22 nt, Homo sapiens
auugcaccacugcccuccagcc

SEQ ID NO: 170826 - RNA, 22 nt, Homo sapiens
auugcacuccacccugggcaac

SEQ ID NO: 170827 - RNA, 22 nt, Homo sapiens
auugcacuccagccccggggac

SEQ ID NO: 170828 - RNA, 22 nt, Homo sapiens
auugcacuccagcccgggugac

SEQ ID NO: 170829 - RNA, 22 nt, Homo sapiens
auugcacuccagccuagucaac

SEQ ID NO: 170830 - RNA, 22 nt, Homo sapiens
auugcacuccagccucggugac

SEQ ID NO: 170831 - RNA, 22 nt, Homo sapiens
auugcacuccagccugagcaaa

SEQ ID NO: 170832 - RNA, 22 nt, Homo sapiens
auugcacuccagccugcggaac

SEQ ID NO: 170833 - RNA, 22 nt, Homo sapiens
auugcacuccagccuggaugac

SEQ ID NO: 170834 - RNA, 22 nt, Homo sapiens
auugcacuccagccuggcagca

SEQ ID NO: 170835 - RNA, 22 nt, Homo sapiens
auugcacuccagccuggccgag

SEQ ID NO: 170836 - RNA, 22 nt, Homo sapiens
auugcacuccagccugggugag

SEQ ID NO: 170837 - RNA, 22 nt, Homo sapiens
auugcacuccagccuugugaca

SEQ ID NO: 170838 - RNA, 22 nt, Homo sapiens
auugcacuccggccugggugac

SEQ ID NO: 170839 - RNA, 22 nt, Homo sapiens
auugcacuggggguuagaauuu

SEQ ID NO: 170840 - RNA, 22 nt, Homo sapiens
auugcaguuagaacagaagucu

SEQ ID NO: 170841 - RNA, 22 nt, Homo sapiens
auugcaugucauguuuagugua

SEQ ID NO: 170842 - RNA, 22 nt, Homo sapiens
auugcauugugaucuucccaga

SEQ ID NO: 170843 - RNA, 22 nt, Homo sapiens
auugccacaucucagaggcaga

SEQ ID NO: 170844 - RNA, 22 nt, Homo sapiens
auugcccauaaggauauuguca

SEQ ID NO: 170845 - RNA, 22 nt, Homo sapiens
auugcucacacaaagccuguuu

SEQ ID NO: 170846 - RNA, 22 nt, Homo sapiens
auugcucuuagaaauauuucuu

SEQ ID NO: 170847 - RNA, 22 nt, Homo sapiens
auugcuuacuaaucaucuucag

SEQ ID NO: 170848 - RNA, 22 nt, Homo sapiens
auuggaacugaaauaauaacuu

SEQ ID NO: 170849 - RNA, 22 nt, Homo sapiens
auuggaguuguacgcacgcuca

SEQ ID NO: 170850 - RNA, 22 nt, Homo sapiens
auuggauagucuuuaucuguug

SEQ ID NO: 170851 - RNA, 22 nt, Homo sapiens
auuggcaagauagcauaugagg

SEQ ID NO: 170852 - RNA, 22 nt, Homo sapiens
auuggcaauggcaaagcagagu

SEQ ID NO: 170853 - RNA, 18 nt, Homo sapiens
auuguaagauguauggga

SEQ ID NO: 170854 - RNA, 22 nt, Homo sapiens
auuguaguuugcuauggcaaua

SEQ ID NO: 170855 - RNA, 22 nt, Homo sapiens
auugucacccgggcaguaagca

SEQ ID NO: 170856 - RNA, 22 nt, Homo sapiens
auugucauuuucugagaaguaa

SEQ ID NO: 170857 - RNA, 22 nt, Homo sapiens
auugucccucuuaaucccagca

SEQ ID NO: 170858 - RNA, 22 nt, Homo sapiens
auugugauggucaaaggaaaua

SEQ ID NO: 170859 - RNA, 22 nt, Homo sapiens
auuguguagucuuacugcuugc

SEQ ID NO: 170860 - RNA, 19 nt, Homo sapiens
auuuccuggagcuggucuc

SEQ ID NO: 170861 - RNA, 19 nt, Homo sapiens
auuugaucaucaggcacag

SEQ ID NO: 170862 - RNA, 22 nt, Homo sapiens
auuuggcaauuuugaagaugcc

SEQ ID NO: 170863 - RNA, 22 nt, Homo sapiens
auuugggaaugugcauuauacu

SEQ ID NO: 170864 - RNA, 22 nt, Homo sapiens
auuuggguaaugagugcaaggg

SEQ ID NO: 170865 - RNA, 22 nt, Homo sapiens
auuuggguuuuacaucaggcua

SEQ ID NO: 170866 - RNA, 22 nt, Homo sapiens
auuuugguuacauaguugagcu

SEQ ID NO: 170867 - RNA, 22 nt, Homo sapiens
caaaccuguaggggccaagagg

SEQ ID NO: 170868 - RNA, 22 nt, Homo sapiens
caaaggugcuuuccagguccaa

SEQ ID NO: 170869 - RNA, 22 nt, Homo sapiens
caaaguaauugcuguuuugcca

SEQ ID NO: 170870 - RNA, 22 nt, Homo sapiens
caaagucuucucauuaugucuu

SEQ ID NO: 170871 - RNA, 22 nt, Homo sapiens
caaagugcugggacuggccggg

SEQ ID NO: 170872 - RNA, 22 nt, Homo sapiens
caaauacuuucauguugucuug

SEQ ID NO: 170873 - RNA, 22 nt, Homo sapiens
caaauccucaccucaucaugaa

SEQ ID NO: 170874 - RNA, 22 nt, Homo sapiens
caacaguaaagcauuuuuaagu

SEQ ID NO: 170875 - RNA, 22 nt, Homo sapiens
caagacuguccaacauauuggg

SEQ ID NO: 170876 - RNA, 22 nt, Homo sapiens
caagagagcugaugguuuuaaa

SEQ ID NO: 170877 - RNA, 22 nt, Homo sapiens
caagaucauuuaugcuaaaauu

SEQ ID NO: 170878 - RNA, 22 nt, Homo sapiens
caagugaauaguugcucucaga

SEQ ID NO: 170879 - RNA, 22 nt, Homo sapiens
caagugcuacagagaaaucuuu

SEQ ID NO: 170880 - RNA, 22 nt, Homo sapiens
caagugcuugaugaaugaucaa

SEQ ID NO: 170881 - RNA, 22 nt, Homo sapiens
caauacuguguugaauaagagu

SEQ ID NO: 170882 - RNA, 22 nt, Homo sapiens
caauacuguuaccugaaauagg

SEQ ID NO: 170883 - RNA, 19 nt, Homo sapiens
caauacuucuuggcauaca

SEQ ID NO: 170884 - RNA, 22 nt, Homo sapiens
caaugguccccauuggcaggaa

SEQ ID NO: 170885 - RNA, 22 nt, Homo sapiens
cacacugucuucauuacuguag

SEQ ID NO: 170886 - RNA, 22 nt, Homo sapiens
cacagagugagacccugucucu

SEQ ID NO: 170887 - RNA, 22 nt, Homo sapiens
cacaggaagaggcacggucccu

SEQ ID NO: 170888 - RNA, 22 nt, Homo sapiens
cacagggcuaacauuuuugccc

SEQ ID NO: 170889 - RNA, 23 nt, Homo sapiens
cacagggugaacaccccuaaucc

SEQ ID NO: 170890 - RNA, 22 nt, Homo sapiens
cacagucuugcaauauugagau

SEQ ID NO: 170891 - RNA, 22 nt, Homo sapiens
cacagugaacugguggguuuuu

SEQ ID NO: 170892 - RNA, 22 nt, Homo sapiens
cacagugaaugucaucauugcc

SEQ ID NO: 170893 - RNA, 22 nt, Homo sapiens
cacaguguuacugguaugaagu

SEQ ID NO: 170894 - RNA, 22 nt, Homo sapiens
cacauugaauuucugaugacaa

SEQ ID NO: 170895 - RNA, 22 nt, Homo sapiens
caccagguggcugaggccauga

SEQ ID NO: 170896 - RNA, 22 nt, Homo sapiens
caccaguuuuucagugauucaa

SEQ ID NO: 170897 - RNA, 19 nt, Homo sapiens
caccgccugcccccugcug

SEQ ID NO: 170898 - RNA, 22 nt, Homo sapiens
caccuguagucccagcugaggc

SEQ ID NO: 170899 - RNA, 22 nt, Homo sapiens
cacgugcuuucuuuucauuuag

SEQ ID NO: 170900 - RNA, 22 nt, Homo sapiens
cacugcacuccagccuaagagg

SEQ ID NO: 170901 - RNA, 22 nt, Homo sapiens
cacugcaguaaauugcgucggu

SEQ ID NO: 170902 - RNA, 22 nt, Homo sapiens
cacugcaguguaauuaagguug

SEQ ID NO: 170903 - RNA, 22 nt, Homo sapiens
cacugcauccuccauauccugg

SEQ ID NO: 170904 - RNA, 22 nt, Homo sapiens
cacugcauccuugaccuucugg

SEQ ID NO: 170905 - RNA, 22 nt, Homo sapiens
cacugcauuacucaugagcaug

SEQ ID NO: 170906 - RNA, 22 nt, Homo sapiens
cacugcgaccuccaccucccgg

SEQ ID NO: 170907 - RNA, 22 nt, Homo sapiens
cacugcgacguccgccucccgg

SEQ ID NO: 170908 - RNA, 22 nt, Homo sapiens
cacuguggauggaacuauguga

SEQ ID NO: 170909 - RNA, 22 nt, Homo sapiens
cagagaacugaguuauuuucuu

SEQ ID NO: 170910 - RNA, 22 nt, Homo sapiens
cagagaaugucuuuuuuaacca

SEQ ID NO: 170911 - RNA, 22 nt, Homo sapiens
cagauaguuguagauaugcagc

SEQ ID NO: 170912 - RNA, 22 nt, Homo sapiens
cagaucaucuugagcuuaggaa

SEQ ID NO: 170913 - RNA, 22 nt, Homo sapiens
cagaugcaugaccugggcuugg

SEQ ID NO: 170914 - RNA, 22 nt, Homo sapiens
cagcacauuacaaguacuuggu

SEQ ID NO: 170915 - RNA, 22 nt, Homo sapiens
cagcgaggucugcgucacauug

SEQ ID NO: 170916 - RNA, 23 nt, Homo sapiens
cagcuggugauuuuaaguugaag

SEQ ID NO: 170917 - RNA, 22 nt, Homo sapiens
cagcuguuguuccagucuuuua

SEQ ID NO: 170918 - RNA, 22 nt, Homo sapiens
caggcacgcuugggagacacac

SEQ ID NO: 170919 - RNA, 22 nt, Homo sapiens
caggcagucuggcucccaagug

SEQ ID NO: 170920 - RNA, 22 nt, Homo sapiens
cagggaauguuauuuaauagca

SEQ ID NO: 170921 - RNA, 22 nt, Homo sapiens
cagggcaugugggucuauuggc

SEQ ID NO: 170922 - RNA, 20 nt, Homo sapiens
acacuggaguaucaaggccc

SEQ ID NO: 170923 - RNA, 22 nt, Homo sapiens
acacuggaguuaaaggugauuu

SEQ ID NO: 170924 - RNA, 22 nt, Homo sapiens
acacuguacuuauguuuugcag

SEQ ID NO: 170925 - RNA, 22 nt, Homo sapiens
acacugucaugucucacaggca

SEQ ID NO: 170926 - RNA, 22 nt, Homo sapiens
acacuguuggugggaguguaaa

SEQ ID NO: 170927 - RNA, 22 nt, Homo sapiens
acacuguuuuaguuauuauagc

SEQ ID NO: 170928 - RNA, 23 nt, Homo sapiens
acacuugcugaguaaaucaaaua

SEQ ID NO: 170929 - RNA, 22 nt, Homo sapiens
acagaauucucagaacugggag

SEQ ID NO: 170930 - RNA, 22 nt, Homo sapiens
acagaccuauuucaaucauuua

SEQ ID NO: 170931 - RNA, 22 nt, Homo sapiens
acagaucagagauauuuagguu

SEQ ID NO: 170932 - RNA, 22 nt, Homo sapiens
acagccauuccagccaaauacu

SEQ ID NO: 170933 - RNA, 19 nt, Homo sapiens
acagcugguuuugguuucu

SEQ ID NO: 170934 - RNA, 22 nt, Homo sapiens
acaggagugggauuugaguccu

SEQ ID NO: 170935 - RNA, 22 nt, Homo sapiens
acagguacacagaauauccaga

SEQ ID NO: 170936 - RNA, 22 nt, Homo sapiens
acaguacaugauaaauaaggua

SEQ ID NO: 170937 - RNA, 22 nt, Homo sapiens
acaguacucugcucuuuugauu

SEQ ID NO: 170938 - RNA, 22 nt, Homo sapiens
acaguagcgcaaucucggcuca

SEQ ID NO: 170939 - RNA, 22 nt, Homo sapiens
acaguaugcuuuaaacuuuguu

SEQ ID NO: 170940 - RNA, 23 nt, Homo sapiens
acagucuaguuugaagucaggua

SEQ ID NO: 170941 - RNA, 22 nt, Homo sapiens
acagugacagaaagcugauuau

SEQ ID NO: 170942 - RNA, 22 nt, Homo sapiens
acagugcuuggcacacaguaau

SEQ ID NO: 170943 - RNA, 22 nt, Homo sapiens
acauacacuagggauguggugu

SEQ ID NO: 170944 - RNA, 17 nt, Homo sapiens
acaugagacuggauucu

SEQ ID NO: 170945 - RNA, 22 nt, Homo sapiens
acaugagacuggguuuguaggg

SEQ ID NO: 170946 - RNA, 22 nt, Homo sapiens
acauggcuuaugaauuuggaga

SEQ ID NO: 170947 - RNA, 22 nt, Homo sapiens
accacaggguaaaguuagauau

SEQ ID NO: 170948 - RNA, 22 nt, Homo sapiens
accacagugcuuccugcucacg

SEQ ID NO: 170949 - RNA, 17 nt, Homo sapiens
accagugcaugugcuuu

SEQ ID NO: 170950 - RNA, 22 nt, Homo sapiens
accaugcaguccaauaugcaca

SEQ ID NO: 170951 - RNA, 22 nt, Homo sapiens
accauugcacuccagcccaggc

SEQ ID NO: 170952 - RNA, 22 nt, Homo sapiens
accauugcacuucagccuaggc

SEQ ID NO: 170953 - RNA, 22 nt, Homo sapiens
acccagaagucauucaggaaca

SEQ ID NO: 170954 - RNA, 22 nt, Homo sapiens
acccaguguucaacauucacau

SEQ ID NO: 170955 - RNA, 22 nt, Homo sapiens
acccucagaccaguuucccugg

SEQ ID NO: 170956 - RNA, 21 nt, Homo sapiens
acccucuaguuuucaacaggc

SEQ ID NO: 170957 - RNA, 22 nt, Homo sapiens
acccugcuaaacagcccccugc

SEQ ID NO: 170958 - RNA, 22 nt, Homo sapiens
uacaguacacagguaccaagcu

SEQ ID NO: 170959 - RNA, 22 nt, Homo sapiens
uacaguaguaucuucauuuguu

SEQ ID NO: 170960 - RNA, 22 nt, Homo sapiens
uacaguauuaugagugauugaa

SEQ ID NO: 170961 - RNA, 22 nt, Homo sapiens
uacagucauaaugccuagugac

SEQ ID NO: 170962 - RNA, 22 nt, Homo sapiens
cucacugggaccacucugaagu

SEQ ID NO: 170963 - RNA, 22 nt, Homo sapiens
cucacugucaacauguauuugg

SEQ ID NO: 170964 - RNA, 22 nt, Homo sapiens
cucagaguacuuuucccacuuc

SEQ ID NO: 170965 - RNA, 22 nt, Homo sapiens
cucagggugguggacucuaaua

SEQ ID NO: 170966 - RNA, 22 nt, Homo sapiens
cucaguagaaaauacauggacu

SEQ ID NO: 170967 - RNA, 22 nt, Homo sapiens
cucagugucuggcacacagaaa

SEQ ID NO: 170968 - RNA, 22 nt, Homo sapiens
cucaguguucccauucuaccuu

SEQ ID NO: 170969 - RNA, 22 nt, Homo sapiens
cucauggagauagagaauagaa

SEQ ID NO: 170970 - RNA, 22 nt, Homo sapiens
cuccacugagcaggugggaggc

SEQ ID NO: 170971 - RNA, 22 nt, Homo sapiens
cuccaggugucauccaccuccu

SEQ ID NO: 170972 - RNA, 22 nt, Homo sapiens
cuccaugagauuguugaaguag

SEQ ID NO: 170973 - RNA, 23 nt, Homo sapiens
cuccaugagccguccagggccug

SEQ ID NO: 170974 - RNA, 22 nt, Homo sapiens
cuccuguagccccaucaucuuu

SEQ ID NO: 170975 - RNA, 20 nt, Homo sapiens
cuccuucauuccuuuggacc

SEQ ID NO: 170976 - RNA, 22 nt, Homo sapiens
cucucaguugucuaauuaguuu

SEQ ID NO: 170977 - RNA, 22 nt, Homo sapiens
cucucuguuugucuguuauugg

SEQ ID NO: 170978 - RNA, 22 nt, Homo sapiens
cucugauggagauauacaagga

SEQ ID NO: 170979 - RNA, 22 nt, Homo sapiens
cucugguggaagcagggggcaa

SEQ ID NO: 170980 - RNA, 22 nt, Homo sapiens
cucuuacaguguguggugaaag

SEQ ID NO: 170981 - RNA, 22 nt, Homo sapiens
cucuuugaugugaaccgugguu

SEQ ID NO: 170982 - RNA, 19 nt, Homo sapiens
cucuuuggugucucuucuu

SEQ ID NO: 170983 - RNA, 22 nt, Homo sapiens
cucuuuuguuuagcugagaggg

SEQ ID NO: 170984 - RNA, 22 nt, Homo sapiens
cugaaaagcaucugcauagcug

SEQ ID NO: 170985 - RNA, 22 nt, Homo sapiens
cugaaagagcauguaacacagu

SEQ ID NO: 170986 - RNA, 22 nt, Homo sapiens
cugaaauguccaucgacugaug

SEQ ID NO: 170987 - RNA, 22 nt, Homo sapiens
cugaaggcagguagaauagaga

SEQ ID NO: 170988 - RNA, 22 nt, Homo sapiens
cugaagugcuugccacauaaaa

SEQ ID NO: 170989 - RNA, 22 nt, Homo sapiens
cugaaucauugguuaugaguac

SEQ ID NO: 170990 - RNA, 22 nt, Homo sapiens
cugaauguccaggcagagguuu

SEQ ID NO: 170991 - RNA, 22 nt, Homo sapiens
cugaauguucuggauggaagag

SEQ ID NO: 170992 - RNA, 22 nt, Homo sapiens
cugacaagugaucacagcagca

SEQ ID NO: 170993 - RNA, 22 nt, Homo sapiens
cugacagucucauugauuugcu

SEQ ID NO: 170994 - RNA, 22 nt, Homo sapiens
cugacaugcagccacugcaccu

SEQ ID NO: 170995 - RNA, 22 nt, Homo sapiens
cugacauuguugaucacagcca

SEQ ID NO: 170996 - RNA, 22 nt, Homo sapiens
cugacucagacacauguauaug

SEQ ID NO: 170997 - RNA, 22 nt, Homo sapiens
cugacugugcaugcccagcccc

SEQ ID NO: 170998 - RNA, 22 nt, Homo sapiens
cugagaacaucauucagauauu

SEQ ID NO: 170999 - RNA, 22 nt, Homo sapiens
cugagaagaaacagguaaggac

SEQ ID NO: 171000 - RNA, 22 nt, Homo sapiens
cugagacacucuuaucugcaua

SEQ ID NO: 171001 - RNA, 22 nt, Homo sapiens
cugagagaugagaccucucacu

SEQ ID NO: 171002 - RNA, 22 nt, Homo sapiens
cugagagugguauguuuaagug

SEQ ID NO: 171003 - RNA, 22 nt, Homo sapiens
cugagaucguggggcugcuguc

SEQ ID NO: 171004 - RNA, 22 nt, Homo sapiens
cugagauuaagauauugggagu

SEQ ID NO: 171005 - RNA, 22 nt, Homo sapiens
cugagcaaaaugaagacacgau

SEQ ID NO: 171006 - RNA, 18 nt, Homo sapiens
cugagcacugcuuuauga

SEQ ID NO: 171007 - RNA, 22 nt, Homo sapiens
cugagcaugacaucaugugacu

SEQ ID NO: 171008 - RNA, 22 nt, Homo sapiens
cugagcccauucuggggagaag

SEQ ID NO: 171009 - RNA, 22 nt, Homo sapiens
cugagcuaugccuggaaaggca

SEQ ID NO: 171010 - RNA, 22 nt, Homo sapiens
cugaggacaucagggaagcauc

SEQ ID NO: 171011 - RNA, 22 nt, Homo sapiens
cugaggauauucagccucugug

SEQ ID NO: 171012 - RNA, 22 nt, Homo sapiens
cugagguagcucaggguauugc

SEQ ID NO: 171013 - RNA, 22 nt, Homo sapiens
cugagguaggcccugagaauau

SEQ ID NO: 171014 - RNA, 22 nt, Homo sapiens
cugagguauaucccauuagaag

SEQ ID NO: 171015 - RNA, 22 nt, Homo sapiens
cugaggugggagaaucacauaa

SEQ ID NO: 171016 - RNA, 20 nt, Homo sapiens
cugaggugggagaaucgcuu

SEQ ID NO: 171017 - RNA, 20 nt, Homo sapiens
cugagguugggguccuuccc

SEQ ID NO: 171018 - RNA, 22 nt, Homo sapiens
cugagguuguucuucucagugg

SEQ ID NO: 171019 - RNA, 22 nt, Homo sapiens
cugauacugaaagcuguugguu

SEQ ID NO: 171020 - RNA, 22 nt, Homo sapiens
cugaucuguuauacuuuucuau

SEQ ID NO: 171021 - RNA, 22 nt, Homo sapiens
cugauuguagagccccagggcu

SEQ ID NO: 171022 - RNA, 22 nt, Homo sapiens
cugauugucuauuuaguucacu

SEQ ID NO: 171023 - RNA, 22 nt, Homo sapiens
cugauuguuugccucuaaaauc

SEQ ID NO: 171024 - RNA, 22 nt, Homo sapiens
cugcaaauacuugugggauuuu

SEQ ID NO: 171025 - RNA, 21 nt, Homo sapiens
cugcaaaugcugcugccugau

SEQ ID NO: 171026 - RNA, 19 nt, Homo sapiens
cugcaagguaauaggucag

SEQ ID NO: 171027 - RNA, 22 nt, Homo sapiens
cugcaguaaacuuucccauuca

SEQ ID NO: 171028 - RNA, 22 nt, Homo sapiens
cugcauaaucaucucucugcau

SEQ ID NO: 171029 - RNA, 22 nt, Homo sapiens
cugcauuagucuguuuaguguu

SEQ ID NO: 171030 - RNA, 22 nt, Homo sapiens
cugccaguuugauucgggccac

SEQ ID NO: 171031 - RNA, 20 nt, Homo sapiens
cugcuccccuacaaaucuca

SEQ ID NO: 171032 - RNA, 22 nt, Homo sapiens
cugcuggucuuuaaggucuagg

SEQ ID NO: 171033 - RNA, 22 nt, Homo sapiens
cuggaaacaucuuaggaaugca

SEQ ID NO: 171034 - RNA, 22 nt, Homo sapiens
cuggaaaguagacaaucuaaaa

SEQ ID NO: 171035 - RNA, 22 nt, Homo sapiens
cuggaaugcagcuuuaggggcu

SEQ ID NO: 171036 - RNA, 22 nt, Homo sapiens
cuggagauauuggaagaaagaa

SEQ ID NO: 171037 - RNA, 22 nt, Homo sapiens
cuggagcaaaggugacucuugu

SEQ ID NO: 171038 - RNA, 18 nt, Homo sapiens
cuggaugucgaguguguu

SEQ ID NO: 171039 - RNA, 22 nt, Homo sapiens
cuggcaaaaagagggcaauaau

SEQ ID NO: 171040 - RNA, 22 nt, Homo sapiens
cuggcagugcuuguuauccugg

SEQ ID NO: 171041 - RNA, 22 nt, Homo sapiens
cuggccagagacauucauuaaa

SEQ ID NO: 171042 - RNA, 22 nt, Homo sapiens
cuggcgagacagcuccaucacu

SEQ ID NO: 171043 - RNA, 22 nt, Homo sapiens
cugggguaggacuggcuuuuga

SEQ ID NO: 171044 - RNA, 22 nt, Homo sapiens
cuggguacccuuuaaacaggaa

SEQ ID NO: 171045 - RNA, 22 nt, Homo sapiens
cuggucaagagcaaaggccagg

SEQ ID NO: 171046 - RNA, 22 nt, Homo sapiens
cuggucaugggggcacccucug

SEQ ID NO: 171047 - RNA, 21 nt, Homo sapiens
cugguccccuuuauguaugug

SEQ ID NO: 171048 - RNA, 22 nt, Homo sapiens
cuggugagaugucuuuccucuu

SEQ ID NO: 171049 - RNA, 21 nt, Homo sapiens
cugguguuagcacuucuuccc

SEQ ID NO: 171050 - RNA, 22 nt, Homo sapiens
cuguaaagaucacagagcuggu

SEQ ID NO: 171051 - RNA, 22 nt, Homo sapiens
cuguagcuuuuauaugcuuagc

SEQ ID NO: 171052 - RNA, 22 nt, Homo sapiens
cugucacaguuuuggaggccag

SEQ ID NO: 171053 - RNA, 22 nt, Homo sapiens
cugucacuggggcacauguccc

SEQ ID NO: 171054 - RNA, 22 nt, Homo sapiens
cugucuggaguccuucgugugc

SEQ ID NO: 171055 - RNA, 22 nt, Homo sapiens
cugugcacaucuggcggcccga

SEQ ID NO: 171056 - RNA, 22 nt, Homo sapiens
cugugccaagcuugcgaugugc

SEQ ID NO: 171057 - RNA, 22 nt, Homo sapiens
cugugcuaggcaaugugguaga

SEQ ID NO: 171058 - RNA, 22 nt, Homo sapiens
cugugcuugauuauaugagugu

SEQ ID NO: 171059 - RNA, 22 nt, Homo sapiens
cugugguauuauuagaaauauc

SEQ ID NO: 171060 - RNA, 23 nt, Homo sapiens
cuguggugaggcccuagaaucug

SEQ ID NO: 171061 - RNA, 22 nt, Homo sapiens
cuguugguuaaauuccaugcag

SEQ ID NO: 171062 - RNA, 19 nt, Homo sapiens
cuguuguacuccaggcauu

SEQ ID NO: 171063 - RNA, 22 nt, Homo sapiens
uacauacuucacagacuuuaaa

SEQ ID NO: 171064 - RNA, 19 nt, Homo sapiens
uacauaguauuuaguggca

SEQ ID NO: 171065 - RNA, 22 nt, Homo sapiens
uacaugugcaggucuguggggg

SEQ ID NO: 171066 - RNA, 22 nt, Homo sapiens
uacauugcacuuuauuagauac

SEQ ID NO: 171067 - RNA, 22 nt, Homo sapiens
uaccacugccgagaaaacagau

SEQ ID NO: 171068 - RNA, 22 nt, Homo sapiens
uaccaguaaugguucuagagga

SEQ ID NO: 171069 - RNA, 22 nt, Homo sapiens
uaccagugaauuccaggggcua

SEQ ID NO: 171070 - RNA, 22 nt, Homo sapiens
uaccaugaagguggagagagaa

SEQ ID NO: 171071 - RNA, 22 nt, Homo sapiens
uaccucaguucaauaacagaua

SEQ ID NO: 171072 - RNA, 22 nt, Homo sapiens
uaccucuguaaguaaagauuca

SEQ ID NO: 171073 - RNA, 23 nt, Homo sapiens
uaccugagacuggguaauuaaua

SEQ ID NO: 171074 - RNA, 22 nt, Homo sapiens
uaccugagcccucugcugaguu

SEQ ID NO: 171075 - RNA, 22 nt, Homo sapiens
uaccuuugucaguuacucaccu

SEQ ID NO: 171076 - RNA, 22 nt, Homo sapiens
uacucaauugcagucaccuggc

SEQ ID NO: 171077 - RNA, 22 nt, Homo sapiens
uacucacauucuguuucuugcu

SEQ ID NO: 171078 - RNA, 22 nt, Homo sapiens
uacucugcaguaauuccagccc

SEQ ID NO: 171079 - RNA, 22 nt, Homo sapiens
uacugagagaggaauauugaaa

SEQ ID NO: 171080 - RNA, 22 nt, Homo sapiens
uacugcacuccacccuggguga

SEQ ID NO: 171081 - RNA, 22 nt, Homo sapiens
uacugcacuccagccugggaga

SEQ ID NO: 171082 - RNA, 22 nt, Homo sapiens
uacugcacucuagccuggguga

SEQ ID NO: 171083 - RNA, 22 nt, Homo sapiens
uacugcuuaagggcaugggccc

SEQ ID NO: 171084 - RNA, 19 nt, Homo sapiens
uacuggcucgggaauuuuc

SEQ ID NO: 171085 - RNA, 20 nt, Homo sapiens
uagaaaguagaguggugguu

SEQ ID NO: 171086 - RNA, 22 nt, Homo sapiens
uagaaguaggcuacgugucugg

SEQ ID NO: 171087 - RNA, 22 nt, Homo sapiens
uagaauguaacuuccaugucau

SEQ ID NO: 171088 - RNA, 22 nt, Homo sapiens
uagacacuagauaugugacuga

SEQ ID NO: 171089 - RNA, 20 nt, Homo sapiens
uagacagcuagauuagauag

SEQ ID NO: 171090 - RNA, 22 nt, Homo sapiens
uagacccauuguucagagagug

SEQ ID NO: 171091 - RNA, 22 nt, Homo sapiens
uagagcacagugauuagaccua

SEQ ID NO: 171092 - RNA, 22 nt, Homo sapiens
uagagcuaguugcucacugcuu

SEQ ID NO: 171093 - RNA, 22 nt, Homo sapiens
uagagcucaucuucuuuaaacu

SEQ ID NO: 171094 - RNA, 21 nt, Homo sapiens
uagagcuuggcacagaguaga

SEQ ID NO: 171095 - RNA, 22 nt, Homo sapiens
uagagguaggucuucgagucuc

SEQ ID NO: 171096 - RNA, 22 nt, Homo sapiens
uagagguauguauaguauucuu

SEQ ID NO: 171097 - RNA, 22 nt, Homo sapiens
uagagguauuaacaguagaaga

SEQ ID NO: 171098 - RNA, 22 nt, Homo sapiens
uagaguguaaaccacauaguga

SEQ ID NO: 171099 - RNA, 22 nt, Homo sapiens
uagaucacucaggcaauaaaag

SEQ ID NO: 171100 - RNA, 19 nt, Homo sapiens
uagaugucuuugcauagau

SEQ ID NO: 171101 - RNA, 22 nt, Homo sapiens
uagauuauuccuuugaauggcc

SEQ ID NO: 171102 - RNA, 19 nt, Homo sapiens
uagcacagggucccagacu

SEQ ID NO: 171103 - RNA, 22 nt, Homo sapiens
uagcacaguucacccucgauuu

SEQ ID NO: 171104 - RNA, 22 nt, Homo sapiens
uagcacaucccuaaaaugcugu

SEQ ID NO: 171105 - RNA, 22 nt, Homo sapiens
uagcaccacaaucaagauacag

SEQ ID NO: 171106 - RNA, 22 nt, Homo sapiens
uagcaccugugcacaccaggca

SEQ ID NO: 171107 - RNA, 22 nt, Homo sapiens
uagcacuauuuuucacuauccu

SEQ ID NO: 171108 - RNA, 22 nt, Homo sapiens
uagcagcagugguguauuuaga

SEQ ID NO: 171109 - RNA, 22 nt, Homo sapiens
uagcagccaggaagggcuggcu

SEQ ID NO: 171110 - RNA, 22 nt, Homo sapiens
uagcagcuuuauugagguaaau

SEQ ID NO: 171111 - RNA, 22 nt, Homo sapiens
uagcaggaaaccuguguugagg

SEQ ID NO: 171112 - RNA, 22 nt, Homo sapiens
uagcaguaagaaacugacauug

SEQ ID NO: 171113 - RNA, 22 nt, Homo sapiens
uagcaguauacguacugggucc

SEQ ID NO: 171114 - RNA, 22 nt, Homo sapiens
uagcaguaucccaccaucuggu

SEQ ID NO: 171115 - RNA, 22 nt, Homo sapiens
uagcugauguuugucuaguagc

SEQ ID NO: 171116 - RNA, 21 nt, Homo sapiens
uagcugcacccaggccuccuu

SEQ ID NO: 171117 - RNA, 22 nt, Homo sapiens
uagcugcugcuaggcuaaggau

SEQ ID NO: 171118 - RNA, 22 nt, Homo sapiens
uagcuggaguuuuuguuauagg

SEQ ID NO: 171119 - RNA, 17 nt, Homo sapiens
uagcuucacauuaggaa

SEQ ID NO: 171120 - RNA, 23 nt, Homo sapiens
uagcuucucccagaccugcuccc

SEQ ID NO: 171121 - RNA, 22 nt, Homo sapiens
uaggaaguuuucuugcugggcc

SEQ ID NO: 171122 - RNA, 22 nt, Homo sapiens
uaggacaaugguacagcagaaa

SEQ ID NO: 171123 - RNA, 22 nt, Homo sapiens
uaggacacagauggagaaaagc

SEQ ID NO: 171124 - RNA, 22 nt, Homo sapiens
uaggcaaaugcaagaguagaac

SEQ ID NO: 171125 - RNA, 22 nt, Homo sapiens
uaggcuuuucugggaugugggc

SEQ ID NO: 171126 - RNA, 22 nt, Homo sapiens
uagguaguugugggcuugaaug

SEQ ID NO: 171127 - RNA, 22 nt, Homo sapiens
uagguauguauauacacacaca

SEQ ID NO: 171128 - RNA, 22 nt, Homo sapiens
uaggucuuuuaugaaauauauu

SEQ ID NO: 171129 - RNA, 22 nt, Homo sapiens
uaggugaaugcuggaagaaaug

SEQ ID NO: 171130 - RNA, 22 nt, Homo sapiens
uagguugucuucccagaguuuu

SEQ ID NO: 171131 - RNA, 22 nt, Homo sapiens
uaguaucacauggucuuaauua

SEQ ID NO: 171132 - RNA, 22 nt, Homo sapiens
uagucacacacucaacuuuuca

SEQ ID NO: 171133 - RNA, 22 nt, Homo sapiens
uaguccauuuucaugcugcuau

SEQ ID NO: 171134 - RNA, 22 nt, Homo sapiens
uagucccuuucuauuaaugaga

SEQ ID NO: 171135 - RNA, 22 nt, Homo sapiens
uagugaauguuggcuauuaaua

SEQ ID NO: 171136 - RNA, 22 nt, Homo sapiens
uagugcaguggcuccaucucag

SEQ ID NO: 171137 - RNA, 22 nt, Homo sapiens
uagugcccuuauaagagcagga

SEQ ID NO: 171138 - RNA, 22 nt, Homo sapiens
uagugcuagaugacuuugccau

SEQ ID NO: 171139 - RNA, 22 nt, Homo sapiens
uagugcuguaauucuaaugaaa

SEQ ID NO: 171140 - RNA, 22 nt, Homo sapiens
uagugcugugauuaacauaaug

SEQ ID NO: 171141 - RNA, 18 nt, Homo sapiens
uagugcuguucucaugau

SEQ ID NO: 171142 - RNA, 22 nt, Homo sapiens
uaguggauguucagagauuuga

SEQ ID NO: 171143 - RNA, 22 nt, Homo sapiens
uaguugcauucaggauaugacg

SEQ ID NO: 171144 - RNA, 22 nt, Homo sapiens
uaguugcauuggcugcuaugcu

SEQ ID NO: 171145 - RNA, 22 nt, Homo sapiens
uauaagacuagcagcugaauug

SEQ ID NO: 171146 - RNA, 22 nt, Homo sapiens
uauacagcaaguuacugugcug

SEQ ID NO: 171147 - RNA, 22 nt, Homo sapiens
uauacaguaggcacucaguggc

SEQ ID NO: 171148 - RNA, 22 nt, Homo sapiens
uauaguguuuucaaaaguaugu

SEQ ID NO: 171149 - RNA, 22 nt, Homo sapiens
uauaucacaugcacucauuuuc

SEQ ID NO: 171150 - RNA, 21 nt, Homo sapiens
uauaugacuuacuauugccuc

SEQ ID NO: 171151 - RNA, 22 nt, Homo sapiens
uauaugucuuuguuauguugag

SEQ ID NO: 171152 - RNA, 22 nt, Homo sapiens
uaucaagauggauaaggauaga

SEQ ID NO: 171153 - RNA, 22 nt, Homo sapiens
uaucaaguuggaagagaaguaa

SEQ ID NO: 171154 - RNA, 22 nt, Homo sapiens
uaucacacaucaugguaaaucu

SEQ ID NO: 171155 - RNA, 22 nt, Homo sapiens
uaucacagcaaggacccauuau

SEQ ID NO: 171156 - RNA, 22 nt, Homo sapiens
uaucacagcauugucuauaaua

SEQ ID NO: 171157 - RNA, 21 nt, Homo sapiens
uaucacaguagaauaggaucu

SEQ ID NO: 171158 - RNA, 20 nt, Homo sapiens
uaucacaguucaggaacucu

SEQ ID NO: 171159 - RNA, 22 nt, Homo sapiens
uaucacuguuguuuguuuaagg

SEQ ID NO: 171160 - RNA, 22 nt, Homo sapiens
uaucacuuugauaguuuaaaug

SEQ ID NO: 171161 - RNA, 22 nt, Homo sapiens
uaucagaguuacacugaagacu

SEQ ID NO: 171162 - RNA, 22 nt, Homo sapiens
uaucagugaaucuuauuuugcc

SEQ ID NO: 171163 - RNA, 22 nt, Homo sapiens
uaucauaguuuggacuuucauu

SEQ ID NO: 171164 - RNA, 21 nt, Homo sapiens
uaucauggugaaacccugucu

SEQ ID NO: 171165 - RNA, 21 nt, Homo sapiens
uaucccagucacaucuaccca

SEQ ID NO: 171166 - RNA, 22 nt, Homo sapiens
uaucuacauguagguauguaug

SEQ ID NO: 171167 - RNA, 22 nt, Homo sapiens
uaucucauccuccuugauccca

SEQ ID NO: 171168 - RNA, 22 nt, Homo sapiens
uaucugcacauacacuuauagc

SEQ ID NO: 171169 - RNA, 20 nt, Homo sapiens
uaugaaacaguguagagcaa

SEQ ID NO: 171170 - RNA, 22 nt, Homo sapiens
uaugaagccaggauuuauuauu

SEQ ID NO: 171171 - RNA, 22 nt, Homo sapiens
gagcuaguguuuacuugccacu

SEQ ID NO: 171172 - RNA, 22 nt, Homo sapiens
gagcucaccuuaccucuggagc

SEQ ID NO: 171173 - RNA, 22 nt, Homo sapiens
gagcuccuccccuuggcuuuca

SEQ ID NO: 171174 - RNA, 22 nt, Homo sapiens
gagcugguccuuuaaggaugca

SEQ ID NO: 171175 - RNA, 22 nt, Homo sapiens
gaggaaguaauuuuaggccugu

SEQ ID NO: 171176 - RNA, 22 nt, Homo sapiens
gaggaaguuuacaaagcaucug

SEQ ID NO: 171177 - RNA, 22 nt, Homo sapiens
gaggagauauucugcuggaugg

SEQ ID NO: 171178 - RNA, 22 nt, Homo sapiens
gaggaguagggcacaaagccuu

SEQ ID NO: 171179 - RNA, 22 nt, Homo sapiens
gaggcaaugugcccggcccaca

SEQ ID NO: 171180 - RNA, 22 nt, Homo sapiens
gaggcagucugacccuuagcag

SEQ ID NO: 171181 - RNA, 22 nt, Homo sapiens
gaggcagucuguccauucucag

SEQ ID NO: 171182 - RNA, 22 nt, Homo sapiens
gaggcagucugucccuuagcag

SEQ ID NO: 171183 - RNA, 22 nt, Homo sapiens
gagguaagagaauaaacaguuu

SEQ ID NO: 171184 - RNA, 22 nt, Homo sapiens
gagguaaguaagaauggcaagc

SEQ ID NO: 171185 - RNA, 22 nt, Homo sapiens
gagguaaguggauuaugagguc

SEQ ID NO: 171186 - RNA, 22 nt, Homo sapiens
gagguagagacuauguauuaga

SEQ ID NO: 171187 - RNA, 21 nt, Homo sapiens
gagguagggauuaaagaccuc

SEQ ID NO: 171188 - RNA, 22 nt, Homo sapiens
gagguagggucccacuauguug

SEQ ID NO: 171189 - RNA, 22 nt, Homo sapiens
gagguaugugggcagacauuua

SEQ ID NO: 171190 - RNA, 22 nt, Homo sapiens
gaggucauguggcaggcagcca

SEQ ID NO: 171191 - RNA, 22 nt, Homo sapiens
gagguugggaugagggauacag

SEQ ID NO: 171192 - RNA, 22 nt, Homo sapiens
gaguaacagcauaaauuuguga

SEQ ID NO: 171193 - RNA, 22 nt, Homo sapiens
gaguagaacugguuaucuaaua

SEQ ID NO: 171194 - RNA, 22 nt, Homo sapiens
gaguagugcugcaguaaacaca

SEQ ID NO: 171195 - RNA, 22 nt, Homo sapiens
gaguagugcuguaauaaacaua

SEQ ID NO: 171196 - RNA, 22 nt, Homo sapiens
gaguauguauaugagugugucu

SEQ ID NO: 171197 - RNA, 22 nt, Homo sapiens
gagucagugucuugcucuguca

SEQ ID NO: 171198 - RNA, 22 nt, Homo sapiens
gagugcaaagguccugaggugg

SEQ ID NO: 171199 - RNA, 21 nt, Homo sapiens
gagugcaaauaaagagagggc

SEQ ID NO: 171200 - RNA, 23 nt, Homo sapiens
gagugcaaugacaugaucucgga

SEQ ID NO: 171201 - RNA, 22 nt, Homo sapiens
gagugcaauggugcuaucucgg

SEQ ID NO: 171202 - RNA, 22 nt, Homo sapiens
gagugcauaugggccuguguca

SEQ ID NO: 171203 - RNA, 22 nt, Homo sapiens
gagugcaucguggccauuuuaa

SEQ ID NO: 171204 - RNA, 22 nt, Homo sapiens
gagugcuguuagcccuggguuu

SEQ ID NO: 171205 - RNA, 22 nt, Homo sapiens
gaguucaaaucucagcucuguu

SEQ ID NO: 171206 - RNA, 22 nt, Homo sapiens
gaguuguuuuaaggcacugacu

SEQ ID NO: 171207 - RNA, 22 nt, Homo sapiens
gauaaaucuuggcuagucuaag

SEQ ID NO: 171208 - RNA, 22 nt, Homo sapiens
gauaacagauaaugucaguuau

SEQ ID NO: 171209 - RNA, 22 nt, Homo sapiens
gauaagagaugauuuugccaug

SEQ ID NO: 171210 - RNA, 22 nt, Homo sapiens
gauacaccauuuucuagcuauu

SEQ ID NO: 171211 - RNA, 19 nt, Homo sapiens
gauagacaucacagugcca

SEQ ID NO: 171212 - RNA, 21 nt, Homo sapiens
gauaucuuuauucccaagagc

SEQ ID NO: 171213 - RNA, 22 nt, Homo sapiens
gauauguguuuuagucaggguu

SEQ ID NO: 171214 - RNA, 22 nt, Homo sapiens
gaucacauuguuucauacauau

SEQ ID NO: 171215 - RNA, 22 nt, Homo sapiens
gaucuggagguuuuccucauga

SEQ ID NO: 171216 - RNA, 22 nt, Homo sapiens
gaucugugugauuggaugcauu

SEQ ID NO: 171217 - RNA, 22 nt, Homo sapiens
gaugagaucauaaguguggagc

SEQ ID NO: 171218 - RNA, 22 nt, Homo sapiens
gaugagguaggccugcuuugaa

SEQ ID NO: 171219 - RNA, 22 nt, Homo sapiens
gauggaguaauguaaucuugag

SEQ ID NO: 171220 - RNA, 22 nt, Homo sapiens
gauggaguugacuaagacaaca

SEQ ID NO: 171221 - RNA, 22 nt, Homo sapiens
gauggaguugucgccugggcug

SEQ ID NO: 171222 - RNA, 22 nt, Homo sapiens
gauuagugacguugagcacugu

SEQ ID NO: 171223 - RNA, 22 nt, Homo sapiens
gauuccauuuguggcuauuuac

SEQ ID NO: 171224 - RNA, 22 nt, Homo sapiens
gauuggcauugcugcaccugag

SEQ ID NO: 171225 - RNA, 22 nt, Homo sapiens
gauuguguucauaggcauguua

SEQ ID NO: 171226 - RNA, 22 nt, Homo sapiens
gauuuguauuaaaagugugacg

SEQ ID NO: 171227 - RNA, 22 nt, Homo sapiens
gauuuuuggggaagccucuuau

SEQ ID NO: 171228 - RNA, 22 nt, Homo sapiens
gcaaaaaguagugcugguuagg

SEQ ID NO: 171229 - RNA, 22 nt, Homo sapiens
gcaaaauugagaagggaauaua

SEQ ID NO: 171230 - RNA, 22 nt, Homo sapiens
gcaaaguguuuuccaacuuggu

SEQ ID NO: 171231 - RNA, 20 nt, Homo sapiens
gcaaaguuuagcucccacua

SEQ ID NO: 171232 - RNA, 23 nt, Homo sapiens
gcaaauaucguagagugucccug

SEQ ID NO: 171233 - RNA, 20 nt, Homo sapiens
gcaacauggccagagugaau

SEQ ID NO: 171234 - RNA, 22 nt, Homo sapiens
gcaagaguauuucaaggaagau

SEQ ID NO: 171235 - RNA, 22 nt, Homo sapiens
gcaagauguuaccauuagggaa

SEQ ID NO: 171236 - RNA, 22 nt, Homo sapiens
gcaagcuugcugggccugacuc

SEQ ID NO: 171237 - RNA, 22 nt, Homo sapiens
gcaauggaaucccuugaucaau

SEQ ID NO: 171238 - RNA, 22 nt, Homo sapiens
gcacaggguuacauucuaaggu

SEQ ID NO: 171239 - RNA, 22 nt, Homo sapiens
gcacagucaacacuuauucacc

SEQ ID NO: 171240 - RNA, 22 nt, Homo sapiens
gcacgugcacccacaugcacgu

SEQ ID NO: 171241 - RNA, 22 nt, Homo sapiens
gcacugagagaagccccaagua

SEQ ID NO: 171242 - RNA, 22 nt, Homo sapiens
gcagaucuucgcgguaaguguu

SEQ ID NO: 171243 - RNA, 22 nt, Homo sapiens
gcagcauuaccaagacauggca

SEQ ID NO: 171244 - RNA, 22 nt, Homo sapiens
gcagguaguuucugacuuuuac

SEQ ID NO: 171245 - RNA, 22 nt, Homo sapiens
gcagugcuggagcccccgugug

SEQ ID NO: 171246 - RNA, 22 nt, Homo sapiens
gcaguggugugugccagccuag

SEQ ID NO: 171247 - RNA, 22 nt, Homo sapiens
gcagugugauguuuuaaucuau

SEQ ID NO: 171248 - RNA, 22 nt, Homo sapiens
gcaguguucugggcaggaagaa

SEQ ID NO: 171249 - RNA, 22 nt, Homo sapiens
gcaguguuggggccggaggcug

SEQ ID NO: 171250 - RNA, 22 nt, Homo sapiens
gcaguguugugauccaggucuu

SEQ ID NO: 171251 - RNA, 22 nt, Homo sapiens
gcaguucuguaguugaaauuua

SEQ ID NO: 171252 - RNA, 20 nt, Homo sapiens
gcauaugucuuuauagcaga

SEQ ID NO: 171253 - RNA, 17 nt, Homo sapiens
gcauauguugaaccagc

SEQ ID NO: 171254 - RNA, 22 nt, Homo sapiens
gcauauguuuggguguguauau

SEQ ID NO: 171255 - RNA, 22 nt, Homo sapiens
gcauauuuuaaaguguaaccug

SEQ ID NO: 171256 - RNA, 22 nt, Homo sapiens
gcaucacagggagacaggccuc

SEQ ID NO: 171257 - RNA, 19 nt, Homo sapiens
gcaucauuaguugcuuuuc

SEQ ID NO: 171258 - RNA, 22 nt, Homo sapiens
gcaugcacaugugaaaaaauga

SEQ ID NO: 171259 - RNA, 22 nt, Homo sapiens
gcaugcacuguauuuaaguauc

SEQ ID NO: 171260 - RNA, 22 nt, Homo sapiens
gcaugcauuuuccuaacuagaa

SEQ ID NO: 171261 - RNA, 22 nt, Homo sapiens
gccaaaaugcugggauuacagg

SEQ ID NO: 171262 - RNA, 22 nt, Homo sapiens
gccaagauugguuuaauauucc

SEQ ID NO: 171263 - RNA, 22 nt, Homo sapiens
gccaagauuuaauucaucaguu

SEQ ID NO: 171264 - RNA, 22 nt, Homo sapiens
gccaguguuuuauugagaauuu

SEQ ID NO: 171265 - RNA, 22 nt, Homo sapiens
gccauagucauagauggcaggg

SEQ ID NO: 171266 - RNA, 22 nt, Homo sapiens
gccauugcacuccagccuagcg

SEQ ID NO: 171267 - RNA, 22 nt, Homo sapiens
gccauugcacuccagcuugggc

SEQ ID NO: 171268 - RNA, 22 nt, Homo sapiens
gccgagagauuuggaaugggga

SEQ ID NO: 171269 - RNA, 22 nt, Homo sapiens
gccuagagaaguaaauauuauc

SEQ ID NO: 171270 - RNA, 22 nt, Homo sapiens
gccugagaggauaugauccccu

SEQ ID NO: 171271 - RNA, 19 nt, Homo sapiens
gcggcacuggagacacagc

SEQ ID NO: 171272 - RNA, 22 nt, Homo sapiens
gcgugguguuagaaugagaagu

SEQ ID NO: 171273 - RNA, 22 nt, Homo sapiens
ucucagugacugcugggucccc

SEQ ID NO: 171274 - RNA, 22 nt, Homo sapiens
ucucagugugguaaaaguuuuu

SEQ ID NO: 171275 - RNA, 22 nt, Homo sapiens
ucucaguuuucaagcugucgau

SEQ ID NO: 171276 - RNA, 22 nt, Homo sapiens
ucucauagaggcagagaguaaa

SEQ ID NO: 171277 - RNA, 21 nt, Homo sapiens
ucucauagaguuucacuuucu

SEQ ID NO: 171278 - RNA, 22 nt, Homo sapiens
ucucaugaagauagagaauaga

SEQ ID NO: 171279 - RNA, 22 nt, Homo sapiens
ucucauggagucaggagcagaa

SEQ ID NO: 171280 - RNA, 22 nt, Homo sapiens
ucucauggcucacccugcauag

SEQ ID NO: 171281 - RNA, 22 nt, Homo sapiens
ucucauuggucugagucaccug

SEQ ID NO: 171282 - RNA, 22 nt, Homo sapiens
ucucccauccaugaacuucugu

SEQ ID NO: 171283 - RNA, 17 nt, Homo sapiens
ucucccaucccuuucuc

SEQ ID NO: 171284 - RNA, 22 nt, Homo sapiens
ucucccauccguacacggauug

SEQ ID NO: 171285 - RNA, 22 nt, Homo sapiens
ucucccuaccugagccgagcca

SEQ ID NO: 171286 - RNA, 22 nt, Homo sapiens
ucuccggguggcggcgaaggga

SEQ ID NO: 171287 - RNA, 21 nt, Homo sapiens
ucucucaaccaggaagugggc

SEQ ID NO: 171288 - RNA, 22 nt, Homo sapiens
ucucugagaccacuccaaacuc

SEQ ID NO: 171289 - RNA, 22 nt, Homo sapiens
ucucugauuaaacaagauagug

SEQ ID NO: 171290 - RNA, 22 nt, Homo sapiens
ucucugauuauugcauuucauu

SEQ ID NO: 171291 - RNA, 22 nt, Homo sapiens
ucucugguuaugucauuaagca

SEQ ID NO: 171292 - RNA, 22 nt, Homo sapiens
ucucuugguugaacaguuugga

SEQ ID NO: 171293 - RNA, 22 nt, Homo sapiens
ucugacucuggagucucagguu

SEQ ID NO: 171294 - RNA, 22 nt, Homo sapiens
ucugagaucaugucugugcugu

SEQ ID NO: 171295 - RNA, 22 nt, Homo sapiens
ucugagguaggugcauggauac

SEQ ID NO: 171296 - RNA, 20 nt, Homo sapiens
ucugauugcaacugcaugag

SEQ ID NO: 171297 - RNA, 22 nt, Homo sapiens
ucuggaauguaaaguuuauggg

SEQ ID NO: 171298 - RNA, 23 nt, Homo sapiens
ucuggaucauucguagugccagc

SEQ ID NO: 171299 - RNA, 22 nt, Homo sapiens
ucuggcaagagccgagggcagu

SEQ ID NO: 171300 - RNA, 21 nt, Homo sapiens
ucuggccccuccaaaucucau

SEQ ID NO: 171301 - RNA, 22 nt, Homo sapiens
ucuggccccucucaaaucucau

SEQ ID NO: 171302 - RNA, 22 nt, Homo sapiens
ucuggcuuauuucacuuagcau

SEQ ID NO: 171303 - RNA, 18 nt, Homo sapiens
ucuggcuucuuuguucca

SEQ ID NO: 171304 - RNA, 22 nt, Homo sapiens
ucuggcuuuagcaugugggaag

SEQ ID NO: 171305 - RNA, 22 nt, Homo sapiens
ucugggguuagucaaagguaug

SEQ ID NO: 171306 - RNA, 22 nt, Homo sapiens
ucugggguuuccacuuuuacuu

SEQ ID NO: 171307 - RNA, 22 nt, Homo sapiens
ucuggguuuuuacaauguuuac

SEQ ID NO: 171308 - RNA, 22 nt, Homo sapiens
ucugguguuacugagccuccca

SEQ ID NO: 171309 - RNA, 22 nt, Homo sapiens
ucugucaaaucuuauguuguag

SEQ ID NO: 171310 - RNA, 22 nt, Homo sapiens
ucugugcauggcagaggaauga

SEQ ID NO: 171311 - RNA, 22 nt, Homo sapiens
ucugugcauuuucuuuuagacu

SEQ ID NO: 171312 - RNA, 22 nt, Homo sapiens
ucugugcuugucauaugcuuug

SEQ ID NO: 171313 - RNA, 22 nt, Homo sapiens
ucuguggucagaguccuuggcc

SEQ ID NO: 171314 - RNA, 22 nt, Homo sapiens
ucugugguucaaaccagcaacu

SEQ ID NO: 171315 - RNA, 22 nt, Homo sapiens
ucugugguucuagcuacuuugg

SEQ ID NO: 171316 - RNA, 22 nt, Homo sapiens
ucuguguuugguuggcaauuuc

SEQ ID NO: 171317 - RNA, 22 nt, Homo sapiens
ucuuaggugaugauugauguga

SEQ ID NO: 171318 - RNA, 22 nt, Homo sapiens
ucuuaggugggccaucacccca

SEQ ID NO: 171319 - RNA, 22 nt, Homo sapiens
ucuuagugcggcugcugcagcc

SEQ ID NO: 171320 - RNA, 22 nt, Homo sapiens
ucuucuagcggaacccucuugu

SEQ ID NO: 171321 - RNA, 20 nt, Homo sapiens
ucuugaacuuagucaacagg

SEQ ID NO: 171322 - RNA, 22 nt, Homo sapiens
ucuugcacacaguaaguguuuu

SEQ ID NO: 171323 - RNA, 22 nt, Homo sapiens
ucuugcaccuacaugcuuuguc

SEQ ID NO: 171324 - RNA, 22 nt, Homo sapiens
ucuugcaguucccaaauucaca

SEQ ID NO: 171325 - RNA, 22 nt, Homo sapiens
ucuuggccaugaauggcaaggc

SEQ ID NO: 171326 - RNA, 22 nt, Homo sapiens
ucuuggguuguuggcuucuccu

SEQ ID NO: 171327 - RNA, 22 nt, Homo sapiens
ucuugguugaaaauucauaaua

SEQ ID NO: 171328 - RNA, 22 nt, Homo sapiens
ucuuuagugacaguugugcaag

SEQ ID NO: 171329 - RNA, 22 nt, Homo sapiens
ucuuugaguggagcgaggcaga

SEQ ID NO: 171330 - RNA, 22 nt, Homo sapiens
ucuuugaguguauacuuagauu

SEQ ID NO: 171331 - RNA, 22 nt, Homo sapiens
ucuuugauuaugcagauggguu

SEQ ID NO: 171332 - RNA, 22 nt, Homo sapiens
ucuuuggaggcgaucuguuuga

SEQ ID NO: 171333 - RNA, 22 nt, Homo sapiens
ucuuuggcugugaagaauaaug

SEQ ID NO: 171334 - RNA, 22 nt, Homo sapiens
ucuuugguaauggaugucugau

SEQ ID NO: 171335 - RNA, 22 nt, Homo sapiens
ucuuugguaggaguaggaggcc

SEQ ID NO: 171336 - RNA, 22 nt, Homo sapiens
ucuuugguaugugcaugugcuu

SEQ ID NO: 171337 - RNA, 22 nt, Homo sapiens
ucuuugguauugugaauagugu

SEQ ID NO: 171338 - RNA, 22 nt, Homo sapiens
ucuuuggucagaaagauuacac

SEQ ID NO: 171339 - RNA, 22 nt, Homo sapiens
ucuuuggucuacuuucauaugu

SEQ ID NO: 171340 - RNA, 22 nt, Homo sapiens
ucuuuggugaauggucauccag

SEQ ID NO: 171341 - RNA, 22 nt, Homo sapiens
ucuuugguucuguuuauguaau

SEQ ID NO: 171342 - RNA, 22 nt, Homo sapiens
ucuuugguuguuuagggugcau

SEQ ID NO: 171343 - RNA, 22 nt, Homo sapiens
ucuuugguuucugucucuguaa

SEQ ID NO: 171344 - RNA, 22 nt, Homo sapiens
ucuuugucuacauccuguuaaa

SEQ ID NO: 171345 - RNA, 22 nt, Homo sapiens
ucuuuguguaggucaaucuggc

SEQ ID NO: 171346 - RNA, 22 nt, Homo sapiens
ucuuuguucaggagccaacucc

SEQ ID NO: 171347 - RNA, 22 nt, Homo sapiens
ucuuuguuggaguccaaggaua

SEQ ID NO: 171348 - RNA, 22 nt, Homo sapiens
ucuuuguuuucugauccugaag

SEQ ID NO: 171349 - RNA, 22 nt, Homo sapiens
ucuuuugguuucuagaggccgc

SEQ ID NO: 171350 - RNA, 22 nt, Homo sapiens
ucuuuuugagucaguuucggua

SEQ ID NO: 171351 - RNA, 20 nt, Homo sapiens
ucuuuuuguggccccagagu

SEQ ID NO: 171352 - RNA, 22 nt, Homo sapiens
ugaaaagucuaagauuaagguu

SEQ ID NO: 171353 - RNA, 22 nt, Homo sapiens
ugaaaaguuguugaaggcuuca

SEQ ID NO: 171354 - RNA, 22 nt, Homo sapiens
ugaaacugcagugggcuuggca

SEQ ID NO: 171355 - RNA, 22 nt, Homo sapiens
ugaaagacugaaagcuuuucuu

SEQ ID NO: 171356 - RNA, 22 nt, Homo sapiens
ugaaagacugaagaauaggcau

SEQ ID NO: 171357 - RNA, 22 nt, Homo sapiens
ugaaagcuacagucuccuagga

SEQ ID NO: 171358 - RNA, 22 nt, Homo sapiens
ugaaauacuuuggcucuuuguu

SEQ ID NO: 171359 - RNA, 22 nt, Homo sapiens
ugaaaugauuauaugguguuug

SEQ ID NO: 171360 - RNA, 21 nt, Homo sapiens
uuuagguagcuuuucugggag

SEQ ID NO: 171361 - RNA, 22 nt, Homo sapiens
uuuauagucaggaacuugagga

SEQ ID NO: 171362 - RNA, 22 nt, Homo sapiens
uuuaucuguuuaaaacuguuca

SEQ ID NO: 171363 - RNA, 22 nt, Homo sapiens
uuuauguggagcacuugacaca

SEQ ID NO: 171364 - RNA, 22 nt, Homo sapiens
uuuauugcucuaaaguugccau

SEQ ID NO: 171365 - RNA, 22 nt, Homo sapiens
uuucaagugcugucuuagcugu

SEQ ID NO: 171366 - RNA, 19 nt, Homo sapiens
uuucacacucgccuacuuc

SEQ ID NO: 171367 - RNA, 23 nt, Homo sapiens
uuucacagaaggauuguagggcc

SEQ ID NO: 171368 - RNA, 22 nt, Homo sapiens
uuucacagagggcuucuuucua

SEQ ID NO: 171369 - RNA, 22 nt, Homo sapiens
uuucacagcugucuuccgucuc

SEQ ID NO: 171370 - RNA, 23 nt, Homo sapiens
uuucacaguagcuggaucagccu

SEQ ID NO: 171371 - RNA, 22 nt, Homo sapiens
uuucaccguguuggccaggcug

SEQ ID NO: 171372 - RNA, 22 nt, Homo sapiens
uuucacguuggggaguugagug

SEQ ID NO: 171373 - RNA, 22 nt, Homo sapiens
uuucaggcagggagcuucagug

SEQ ID NO: 171374 - RNA, 22 nt, Homo sapiens
uuucaguagagacacgguuuug

SEQ ID NO: 171375 - RNA, 23 nt, Homo sapiens
uuucaguaguuguauccuguugc

SEQ ID NO: 171376 - RNA, 22 nt, Homo sapiens
uuucaguguggcaggcauagcu

SEQ ID NO: 171377 - RNA, 22 nt, Homo sapiens
uuucauaguuugcauagggcau

SEQ ID NO: 171378 - RNA, 16 nt, Homo sapiens
uuucaucaguuuuaau

SEQ ID NO: 171379 - RNA, 22 nt, Homo sapiens
uuucauccggcuguguauuaug

SEQ ID NO: 171380 - RNA, 22 nt, Homo sapiens
uuucauggaggauuugcuucuu

SEQ ID NO: 171381 - RNA, 22 nt, Homo sapiens
uuucauggcaguuuggggccug

SEQ ID NO: 171382 - RNA, 22 nt, Homo sapiens
uuucauggcgaggcuucauggg

SEQ ID NO: 171383 - RNA, 22 nt, Homo sapiens
uuucauguuuuucugugaggca

SEQ ID NO: 171384 - RNA, 22 nt, Homo sapiens
uuucccugaaggcucugaaguc

SEQ ID NO: 171385 - RNA, 22 nt, Homo sapiens
uuucccuuuagcuuagugauuu

SEQ ID NO: 171386 - RNA, 16 nt, Homo sapiens
uuucccuuugguguuu

SEQ ID NO: 171387 - RNA, 22 nt, Homo sapiens
uuucuacagugaacgauuucua

SEQ ID NO: 171388 - RNA, 20 nt, Homo sapiens
uuucuccccuauaaaucuca

SEQ ID NO: 171389 - RNA, 21 nt, Homo sapiens
uuucugggggagcauggcagg

SEQ ID NO: 171390 - RNA, 22 nt, Homo sapiens
uuucugggggugcugauggaaa

SEQ ID NO: 171391 - RNA, 22 nt, Homo sapiens
uuucuuggagcucuuagggucg

SEQ ID NO: 171392 - RNA, 22 nt, Homo sapiens
uuucuugguuguauuuagacuu

SEQ ID NO: 171393 - RNA, 22 nt, Homo sapiens
uuugaagcuaaggugcuugguu

SEQ ID NO: 171394 - RNA, 19 nt, Homo sapiens
uuugaauauaaugcagcua

SEQ ID NO: 171395 - RNA, 22 nt, Homo sapiens
uuugaauggaaguuuugugaaa

SEQ ID NO: 171396 - RNA, 22 nt, Homo sapiens
uuugacuaccaggaauguucuu

SEQ ID NO: 171397 - RNA, 22 nt, Homo sapiens
uuugagaaugcuaccagagaag

SEQ ID NO: 171398 - RNA, 22 nt, Homo sapiens
uuugagaucuuuagaaucaggc

SEQ ID NO: 171399 - RNA, 22 nt, Homo sapiens
uuugagcaugcagauugccagg

SEQ ID NO: 171400 - RNA, 22 nt, Homo sapiens
uuugagcauuagggcaaaggca

SEQ ID NO: 171401 - RNA, 22 nt, Homo sapiens
gcugguauuacaggcaugagcc

SEQ ID NO: 171402 - RNA, 22 nt, Homo sapiens
gcuggugaaggcugaaaagugg

SEQ ID NO: 171403 - RNA, 22 nt, Homo sapiens
gcuggugacuuuaaguugaagc

SEQ ID NO: 171404 - RNA, 22 nt, Homo sapiens
gcugucaugagcaacacaugaa

SEQ ID NO: 171405 - RNA, 20 nt, Homo sapiens
gcugugcuuaauacacuuuc

SEQ ID NO: 171406 - RNA, 22 nt, Homo sapiens
gcuguugugaacuauacaucua

SEQ ID NO: 171407 - RNA, 22 nt, Homo sapiens
gcuuguguauuaaaccuugcag

SEQ ID NO: 171408 - RNA, 22 nt, Homo sapiens
gcuuguguuuacuguaguuacu

SEQ ID NO: 171409 - RNA, 22 nt, Homo sapiens
gcuuuggauaaaugucaguuua

SEQ ID NO: 171410 - RNA, 22 nt, Homo sapiens
ggaaagaucagcuaaauguaag

SEQ ID NO: 171411 - RNA, 22 nt, Homo sapiens
ggaaaucaucauucucgguaua

SEQ ID NO: 171412 - RNA, 22 nt, Homo sapiens
ggaaauguuggugucaugaguu

SEQ ID NO: 171413 - RNA, 23 nt, Homo sapiens
ggaaauguuuaagggguugggag

SEQ ID NO: 171414 - RNA, 22 nt, Homo sapiens
ggaagugcuguguggaagucug

SEQ ID NO: 171415 - RNA, 23 nt, Homo sapiens
ggaaugaaaccugguuaugauau

SEQ ID NO: 171416 - RNA, 19 nt, Homo sapiens
ggaaugcaccaguccuugc

SEQ ID NO: 171417 - RNA, 22 nt, Homo sapiens
ggacaaaguauuuucaaaugua

SEQ ID NO: 171418 - RNA, 22 nt, Homo sapiens
ggacagugaaugccacuccucc

SEQ ID NO: 171419 - RNA, 22 nt, Homo sapiens
ggacauguauauauaugugugu

SEQ ID NO: 171420 - RNA, 22 nt, Homo sapiens
ggacugagaggacuacagugua

SEQ ID NO: 171421 - RNA, 22 nt, Homo sapiens
ggagagcuaggcagagguuugu

SEQ ID NO: 171422 - RNA, 22 nt, Homo sapiens
ggagauccucugcgggcaaaga

SEQ ID NO: 171423 - RNA, 22 nt, Homo sapiens
ggagaucuuguuaaaguacaga

SEQ ID NO: 171424 - RNA, 22 nt, Homo sapiens
ggagaucuuugaaguguugugc

SEQ ID NO: 171425 - RNA, 22 nt, Homo sapiens
ggagauguuuaaccuuuuaucu

SEQ ID NO: 171426 - RNA, 22 nt, Homo sapiens
ggagcucaucuagcauagaggu

SEQ ID NO: 171427 - RNA, 22 nt, Homo sapiens
ggaggcuaguaaaaagguagaa

SEQ ID NO: 171428 - RNA, 22 nt, Homo sapiens
ggagguagguuugugauuugua

SEQ ID NO: 171429 - RNA, 16 nt, Homo sapiens
ggaggucaucugggaa

SEQ ID NO: 171430 - RNA, 20 nt, Homo sapiens
ggagguguugauuuuucuuu

SEQ ID NO: 171431 - RNA, 20 nt, Homo sapiens
ggagguuguauaaguacauc

SEQ ID NO: 171432 - RNA, 22 nt, Homo sapiens
ggagucuugcuauguugccaag

SEQ ID NO: 171433 - RNA, 23 nt, Homo sapiens
ggaguguaaugacucgaucucgg

SEQ ID NO: 171434 - RNA, 22 nt, Homo sapiens
ggagugucccaaucucagcuca

SEQ ID NO: 171435 - RNA, 22 nt, Homo sapiens
ggagugugauucaguauaauau

SEQ ID NO: 171436 - RNA, 22 nt, Homo sapiens
ggaguuuaagucuugugcaucu

SEQ ID NO: 171437 - RNA, 22 nt, Homo sapiens
ggauaacagccaggucaaacaa

SEQ ID NO: 171438 - RNA, 22 nt, Homo sapiens
ggaucacuugagaccaggaguu

SEQ ID NO: 171439 - RNA, 22 nt, Homo sapiens
ggaucauaugauagcucaauuu

SEQ ID NO: 171440 - RNA, 21 nt, Homo sapiens
ggauucaucccucaugaauuu

SEQ ID NO: 171441 - RNA, 22 nt, Homo sapiens
ggauuuguuggcauuagugaug

SEQ ID NO: 171442 - RNA, 22 nt, Homo sapiens
ggcaaauucuuguaugccuacu

SEQ ID NO: 171443 - RNA, 22 nt, Homo sapiens
ggcaacaaagacauuucaacau

SEQ ID NO: 171444 - RNA, 22 nt, Homo sapiens
ggcaacaauuccuacuucuuuu

SEQ ID NO: 171445 - RNA, 22 nt, Homo sapiens
ggcaacaugccgaaaccacguc

SEQ ID NO: 171446 - RNA, 22 nt, Homo sapiens
ggcaacauggugaaacucuguc

SEQ ID NO: 171447 - RNA, 22 nt, Homo sapiens
ggcaagaaaaugcaauuacugu

SEQ ID NO: 171448 - RNA, 22 nt, Homo sapiens
ggcaagaaccagggauuugcgu

SEQ ID NO: 171449 - RNA, 22 nt, Homo sapiens
ggcaagaggagauucugcuccc

SEQ ID NO: 171450 - RNA, 22 nt, Homo sapiens
ggcaagauagauaucaguguca

SEQ ID NO: 171451 - RNA, 22 nt, Homo sapiens
ggcaaggaggggcacuuucacu

SEQ ID NO: 171452 - RNA, 22 nt, Homo sapiens
ggcaaggauguuuuucuggcaa

SEQ ID NO: 171453 - RNA, 22 nt, Homo sapiens
ggcaaggauuagauucuccccu

SEQ ID NO: 171454 - RNA, 22 nt, Homo sapiens
ggcaaggugcuacagacaguga

SEQ ID NO: 171455 - RNA, 22 nt, Homo sapiens
ggcaagugggagggaguguuuc

SEQ ID NO: 171456 - RNA, 21 nt, Homo sapiens
ggcaagugugagguuuggggu

SEQ ID NO: 171457 - RNA, 22 nt, Homo sapiens
ggcaaguucuaaugauuagaau

SEQ ID NO: 171458 - RNA, 22 nt, Homo sapiens
ggcaauauuauuaacccucugu

SEQ ID NO: 171459 - RNA, 22 nt, Homo sapiens
ggcaaugucagcuaaugaugga

SEQ ID NO: 171460 - RNA, 22 nt, Homo sapiens
ggcacaauugcagcaauaaaca

SEQ ID NO: 171461 - RNA, 22 nt, Homo sapiens
ggcacgguggcucacaccugua

SEQ ID NO: 171462 - RNA, 22 nt, Homo sapiens
ggcagaauugcugaggaugcua

SEQ ID NO: 171463 - RNA, 22 nt, Homo sapiens
ggcaguggaagugccaguuucu

SEQ ID NO: 171464 - RNA, 22 nt, Homo sapiens
ggcaguuuguuugugaggucca

SEQ ID NO: 171465 - RNA, 22 nt, Homo sapiens
ggcaugaaguagcccacaggca

SEQ ID NO: 171466 - RNA, 22 nt, Homo sapiens
ggcaugguggugugugccuaua

SEQ ID NO: 171467 - RNA, 22 nt, Homo sapiens
ggcauguugauagguagaugua

SEQ ID NO: 171468 - RNA, 22 nt, Homo sapiens
ggcauguuuaguagaauguggu

SEQ ID NO: 171469 - RNA, 22 nt, Homo sapiens
ggcccugagacaggaaaaagcu

SEQ ID NO: 171470 - RNA, 18 nt, Homo sapiens
ggcggguguuuuauucac

SEQ ID NO: 171471 - RNA, 22 nt, Homo sapiens
ggcuagaauagggauagaccuu

SEQ ID NO: 171472 - RNA, 22 nt, Homo sapiens
ggcuagagaauagugccacuaa

SEQ ID NO: 171473 - RNA, 21 nt, Homo sapiens
ggcucuguggucucagguuuc

SEQ ID NO: 171474 - RNA, 22 nt, Homo sapiens
ggcuguguguuaaaauaggcuu

SEQ ID NO: 171475 - RNA, 22 nt, Homo sapiens
ggcuuggaggaaugugagggcu

SEQ ID NO: 171476 - RNA, 22 nt, Homo sapiens
gggaaauguaaagucauaagau

SEQ ID NO: 171477 - RNA, 22 nt, Homo sapiens
gggaagugugguuucuuuacag

SEQ ID NO: 171478 - RNA, 22 nt, Homo sapiens
gggagcaaaaaugaugcccaag

SEQ ID NO: 171479 - RNA, 22 nt, Homo sapiens
gggaugaaguugauguagaaag

SEQ ID NO: 171480 - RNA, 22 nt, Homo sapiens
gggcacgugugugcugugcuca

SEQ ID NO: 171481 - RNA, 22 nt, Homo sapiens
gggcauugugggcagagggcag

SEQ ID NO: 171482 - RNA, 22 nt, Homo sapiens
ggggcauugugacauaucucug

SEQ ID NO: 171483 - RNA, 22 nt, Homo sapiens
gggggagugugguacccagcau

SEQ ID NO: 171484 - RNA, 22 nt, Homo sapiens
ggguaggcaagcggaugucaga

SEQ ID NO: 171485 - RNA, 22 nt, Homo sapiens
ggguucccugaugagaguuagu

SEQ ID NO: 171486 - RNA, 22 nt, Homo sapiens
gguaaacauaagagagcugacu

SEQ ID NO: 171487 - RNA, 22 nt, Homo sapiens
gguaaacauacugcugucuucu

SEQ ID NO: 171488 - RNA, 22 nt, Homo sapiens
gguaaaucuucacuaagacuga

SEQ ID NO: 171489 - RNA, 22 nt, Homo sapiens
gguaggcacuggugggaagaga

SEQ ID NO: 171490 - RNA, 22 nt, Homo sapiens
gguauuuaaaguaccugucugc

SEQ ID NO: 171491 - RNA, 22 nt, Homo sapiens
ggucaggagaaugguaacugag

SEQ ID NO: 171492 - RNA, 22 nt, Homo sapiens
ggugaauuguaccccauaggau

SEQ ID NO: 171493 - RNA, 22 nt, Homo sapiens
ggugagaaaaacauagucucag

SEQ ID NO: 171494 - RNA, 22 nt, Homo sapiens
ggugagcacagaaugcccugag

SEQ ID NO: 171495 - RNA, 22 nt, Homo sapiens
ggugaucauugucucuaguaug

SEQ ID NO: 171496 - RNA, 18 nt, Homo sapiens
guaaauguaucuauugcc

SEQ ID NO: 171497 - RNA, 22 nt, Homo sapiens
guaaauguccugcuacagagug

SEQ ID NO: 171498 - RNA, 22 nt, Homo sapiens
guaaggaguaguguaacagugc

SEQ ID NO: 171499 - RNA, 22 nt, Homo sapiens
guaagugguagagcugggcuau

SEQ ID NO: 171500 - RNA, 23 nt, Homo sapiens
guaauacuagucauaguagcagg

SEQ ID NO: 171501 - RNA, 22 nt, Homo sapiens
guaaucucagcuacucgggaga

SEQ ID NO: 171502 - RNA, 22 nt, Homo sapiens
acaguacuuuuggauuugugaa

SEQ ID NO: 171503 - RNA, 22 nt, Homo sapiens
acaguagaaaacaauggauuug

SEQ ID NO: 171504 - RNA, 22 nt, Homo sapiens
acagugcuguggucaugggucu

SEQ ID NO: 171505 - RNA, 18 nt, Homo sapiens
acagugucauggcucaau

SEQ ID NO: 171506 - RNA, 22 nt, Homo sapiens
acaguguuacuugauaguguau

SEQ ID NO: 171507 - RNA, 22 nt, Homo sapiens
acauaugaguacaugugccaug

SEQ ID NO: 171508 - RNA, 21 nt, Homo sapiens
acaucagaguugugaagguag

SEQ ID NO: 171509 - RNA, 22 nt, Homo sapiens
acaucaggcuugugaugauuac

SEQ ID NO: 171510 - RNA, 22 nt, Homo sapiens
acaucauugggggcuacaggug

SEQ ID NO: 171511 - RNA, 22 nt, Homo sapiens
acaucccaugccuggguacucc

SEQ ID NO: 171512 - RNA, 22 nt, Homo sapiens
acaugccucccugguccgcugu

SEQ ID NO: 171513 - RNA, 19 nt, Homo sapiens
acauggauuuugugcaaac

SEQ ID NO: 171514 - RNA, 22 nt, Homo sapiens
acauguaauugauuuuguguua

SEQ ID NO: 171515 - RNA, 18 nt, Homo sapiens
acauucagcuugaagaua

SEQ ID NO: 171516 - RNA, 19 nt, Homo sapiens
acauugcauuuguaggcuu

SEQ ID NO: 171517 - RNA, 22 nt, Homo sapiens
accaccauugcacugaacuuuc

SEQ ID NO: 171518 - RNA, 22 nt, Homo sapiens
accauugcacuccagccugggc

SEQ ID NO: 171519 - RNA, 22 nt, Homo sapiens
acccaguagucauucaggagca

SEQ ID NO: 171520 - RNA, 17 nt, Homo sapiens
acccagucuuuuugcac

SEQ ID NO: 171521 - RNA, 22 nt, Homo sapiens
acccaguguucagacuaccugu

SEQ ID NO: 171522 - RNA, 22 nt, Homo sapiens
acccgcccagguguggccggga

SEQ ID NO: 171523 - RNA, 22 nt, Homo sapiens
acccuggauucguggccuugaa

SEQ ID NO: 171524 - RNA, 22 nt, Homo sapiens
acccuguaacauacaagugguu

SEQ ID NO: 171525 - RNA, 22 nt, Homo sapiens
acccuguaguuagaaacuuuca

SEQ ID NO: 171526 - RNA, 22 nt, Homo sapiens
acccuugaguguguuucaggca

SEQ ID NO: 171527 - RNA, 22 nt, Homo sapiens
accucagcccggggaaguugag

SEQ ID NO: 171528 - RNA, 22 nt, Homo sapiens
accuggguguauguucaguuug

SEQ ID NO: 171529 - RNA, 22 nt, Homo sapiens
accugguuuucucacaguggcu

SEQ ID NO: 171530 - RNA, 18 nt, Homo sapiens
accuucauuccuuugccu

SEQ ID NO: 171531 - RNA, 22 nt, Homo sapiens
accuugcacugagccgagauug

SEQ ID NO: 171532 - RNA, 22 nt, Homo sapiens
accuuguagcaaaccuaacaua

SEQ ID NO: 171533 - RNA, 22 nt, Homo sapiens
accuuguaucuguuaggauugc

SEQ ID NO: 171534 - RNA, 22 nt, Homo sapiens
accuuuacaacuuguuagagua

SEQ ID NO: 171535 - RNA, 22 nt, Homo sapiens
acgcagcacauucacagcuaug

SEQ ID NO: 171536 - RNA, 22 nt, Homo sapiens
acggcacugguggaaguguagc

SEQ ID NO: 171537 - RNA, 22 nt, Homo sapiens
acgugcaugcacacacaugcgc

SEQ ID NO: 171538 - RNA, 22 nt, Homo sapiens
acucugucuaguuguaaaauuu

SEQ ID NO: 171539 - RNA, 22 nt, Homo sapiens
acugaaucaucagguguguuug

SEQ ID NO: 171540 - RNA, 21 nt, Homo sapiens
acugagagaucuggggcacau

SEQ ID NO: 171541 - RNA, 23 nt, Homo sapiens
acugagcaauguuuacauacuug

SEQ ID NO: 171542 - RNA, 19 nt, Homo sapiens
acugcacuccaaccuccug

SEQ ID NO: 171543 - RNA, 22 nt, Homo sapiens
acugcacuccaaccuuggugac

SEQ ID NO: 171544 - RNA, 20 nt, Homo sapiens
acugcacuccaaccuuugug

SEQ ID NO: 171545 - RNA, 22 nt, Homo sapiens
acugcacuccacccuuggcagc

SEQ ID NO: 171546 - RNA, 22 nt, Homo sapiens
acugcacuccagccuccugggu

SEQ ID NO: 171547 - RNA, 22 nt, Homo sapiens
acugcacuccagccugaugaaa

SEQ ID NO: 171548 - RNA, 22 nt, Homo sapiens
acugcacuccagccugcugaca

SEQ ID NO: 171549 - RNA, 22 nt, Homo sapiens
acugcacuccagccugugcgua

SEQ ID NO: 171550 - RNA, 22 nt, Homo sapiens
acugcacuccagccuuagugac

SEQ ID NO: 171551 - RNA, 22 nt, Homo sapiens
acugcacuccagccuucggaca

SEQ ID NO: 171552 - RNA, 22 nt, Homo sapiens
acugcacuccagccuugauggc

SEQ ID NO: 171553 - RNA, 22 nt, Homo sapiens
acugcacuccagccuuggcaac

SEQ ID NO: 171554 - RNA, 22 nt, Homo sapiens
acugcacuccagccuugugaca

SEQ ID NO: 171555 - RNA, 22 nt, Homo sapiens
acugcacuccagccuuugcgau

SEQ ID NO: 171556 - RNA, 22 nt, Homo sapiens
acugcacuccaguuccgggcaa

SEQ ID NO: 171557 - RNA, 22 nt, Homo sapiens
acugcacuccaucuuagguggc

SEQ ID NO: 171558 - RNA, 22 nt, Homo sapiens
acugcacucuagcauggguaau

SEQ ID NO: 171559 - RNA, 22 nt, Homo sapiens
acugcacugucaaccuccuggg

SEQ ID NO: 171560 - RNA, 22 nt, Homo sapiens
acugcacuucagccuguugaca

SEQ ID NO: 171561 - RNA, 22 nt, Homo sapiens
acugcacuucagccuuggcuac

SEQ ID NO: 171562 - RNA, 22 nt, Homo sapiens
acugcacuucagccuugugaca

SEQ ID NO: 171563 - RNA, 22 nt, Homo sapiens
acugguguaugggaggucccaa

SEQ ID NO: 171564 - RNA, 22 nt, Homo sapiens
acuguacuacagccugggugac

SEQ ID NO: 171565 - RNA, 22 nt, Homo sapiens
acuguacuccagccugggugac

SEQ ID NO: 171566 - RNA, 22 nt, Homo sapiens
acugugcuguuuuaauuauuga

SEQ ID NO: 171567 - RNA, 22 nt, Homo sapiens
acuugacacuuauauuacucac

SEQ ID NO: 171568 - RNA, 20 nt, Homo sapiens
acuuuuugaugaggucguuu

SEQ ID NO: 171569 - RNA, 22 nt, Homo sapiens
acuuuuugcaaccauuuggacc

SEQ ID NO: 171570 - RNA, 22 nt, Homo sapiens
agaaugauccuucucagaggca

SEQ ID NO: 171571 - RNA, 22 nt, Homo sapiens
agaaugugaccuuauuuggaga

SEQ ID NO: 171572 - RNA, 22 nt, Homo sapiens
agaauguuuuagaccaauacaa

SEQ ID NO: 171573 - RNA, 22 nt, Homo sapiens
agacacuguugaaaaggcccca

SEQ ID NO: 171574 - RNA, 22 nt, Homo sapiens
agagagcuuuugguugcccuaa

SEQ ID NO: 171575 - RNA, 22 nt, Homo sapiens
agagaucaacugaauuacugga

SEQ ID NO: 171576 - RNA, 22 nt, Homo sapiens
agagaucacugaaucacggggg

SEQ ID NO: 171577 - RNA, 22 nt, Homo sapiens
agagaucauuuuguuucaaauc

SEQ ID NO: 171578 - RNA, 22 nt, Homo sapiens
agagaugauuaacauuuuggua

SEQ ID NO: 171579 - RNA, 22 nt, Homo sapiens
agagcaccauuuagcaagguga

SEQ ID NO: 171580 - RNA, 22 nt, Homo sapiens
agagcuaguauuuacggagcau

SEQ ID NO: 171581 - RNA, 18 nt, Homo sapiens
agagcuaugaacauaugc

SEQ ID NO: 171582 - RNA, 22 nt, Homo sapiens
agagcuguguuuuaacuuuuua

SEQ ID NO: 171583 - RNA, 22 nt, Homo sapiens
agaggaguacuacuccaagucu

SEQ ID NO: 171584 - RNA, 22 nt, Homo sapiens
agagguaagcaguggcaagugc

SEQ ID NO: 171585 - RNA, 22 nt, Homo sapiens
agagguagaagauaggcuacag

SEQ ID NO: 171586 - RNA, 22 nt, Homo sapiens
agaggucuuaucaaacaugcuu

SEQ ID NO: 171587 - RNA, 22 nt, Homo sapiens
agagguuuaacuggcuuauggu

SEQ ID NO: 171588 - RNA, 22 nt, Homo sapiens
aguaagauggcaacucuccaca

SEQ ID NO: 171589 - RNA, 22 nt, Homo sapiens
aguacacuguugaacagaagug

SEQ ID NO: 171590 - RNA, 22 nt, Homo sapiens
aguacaucuggcuggauagaua

SEQ ID NO: 171591 - RNA, 22 nt, Homo sapiens
aguaccauuacucacuuauuuu

SEQ ID NO: 171592 - RNA, 22 nt, Homo sapiens
aguagcacaugccacccugucu

SEQ ID NO: 171593 - RNA, 22 nt, Homo sapiens
aguaucacaggcaaaacagaau

SEQ ID NO: 171594 - RNA, 22 nt, Homo sapiens
aguaucaucuuguuggccaggc

SEQ ID NO: 171595 - RNA, 22 nt, Homo sapiens
aguauguagugcaaucagucag

SEQ ID NO: 171596 - RNA, 22 nt, Homo sapiens
aguauuaggugaguguauuuca

SEQ ID NO: 171597 - RNA, 22 nt, Homo sapiens
agucaagaaucucagcaucuuu

SEQ ID NO: 171598 - RNA, 22 nt, Homo sapiens
agucaagauggcaagguaaggc

SEQ ID NO: 171599 - RNA, 22 nt, Homo sapiens
agucagauuggcauuuguuggg

SEQ ID NO: 171600 - RNA, 22 nt, Homo sapiens
agucaguggaguaaauguaauu

SEQ ID NO: 171601 - RNA, 22 nt, Homo sapiens
agucagugucuguaaggagaac

SEQ ID NO: 171602 - RNA, 22 nt, Homo sapiens
agucgguguuacugacagaaug

SEQ ID NO: 171603 - RNA, 23 nt, Homo sapiens
agucuguguuuacaggcucucug

SEQ ID NO: 171604 - RNA, 17 nt, Homo sapiens
agugagaucauggcuua

SEQ ID NO: 171605 - RNA, 19 nt, Homo sapiens
agugagccaagauccuacc

SEQ ID NO: 171606 - RNA, 22 nt, Homo sapiens
agugagcugcagucuggggucc

SEQ ID NO: 171607 - RNA, 22 nt, Homo sapiens
agugauguggaguuuggaugga

SEQ ID NO: 171608 - RNA, 22 nt, Homo sapiens
agugcaauggcgugaucuuggc

SEQ ID NO: 171609 - RNA, 22 nt, Homo sapiens
agugcaguggcacaaucuuggc

SEQ ID NO: 171610 - RNA, 22 nt, Homo sapiens
ugagaucuuugcuguccucacc

SEQ ID NO: 171611 - RNA, 19 nt, Homo sapiens
ugagaugaagacagggguu

SEQ ID NO: 171612 - RNA, 22 nt, Homo sapiens
ugagaugaagcuagaagaaugg

SEQ ID NO: 171613 - RNA, 22 nt, Homo sapiens
ugagaugaagucucacucuguc

SEQ ID NO: 171614 - RNA, 22 nt, Homo sapiens
ugagaugaagucuugcucuguu

SEQ ID NO: 171615 - RNA, 22 nt, Homo sapiens
ugagaugagggcugcacucaaa

SEQ ID NO: 171616 - RNA, 22 nt, Homo sapiens
ugagaugaggucucacucuguu

SEQ ID NO: 171617 - RNA, 22 nt, Homo sapiens
ugagaugaguugcgcucugucg

SEQ ID NO: 171618 - RNA, 22 nt, Homo sapiens
ugagaugcauauucuggcuccu

SEQ ID NO: 171619 - RNA, 22 nt, Homo sapiens
ugagauggagucuugucgccua

SEQ ID NO: 171620 - RNA, 22 nt, Homo sapiens
ugagauggcugaauucagaaua

SEQ ID NO: 171621 - RNA, 22 nt, Homo sapiens
ugagauggguaauuaaauggug

SEQ ID NO: 171622 - RNA, 22 nt, Homo sapiens
ugagaugugaagaucacaugaa

SEQ ID NO: 171623 - RNA, 22 nt, Homo sapiens
ugagauguguccagaucuaguu

SEQ ID NO: 171624 - RNA, 22 nt, Homo sapiens
ugagauuaaucuuuaaguaaga

SEQ ID NO: 171625 - RNA, 22 nt, Homo sapiens
ugagcaauaaaguuacacaguu

SEQ ID NO: 171626 - RNA, 22 nt, Homo sapiens
ugagcacagcgugugggagagc

SEQ ID NO: 171627 - RNA, 22 nt, Homo sapiens
ugagcagaaguuuugauuggcg

SEQ ID NO: 171628 - RNA, 22 nt, Homo sapiens
ugagcagaguuguuucuccuga

SEQ ID NO: 171629 - RNA, 22 nt, Homo sapiens
ugagcauuguuuggacuuggau

SEQ ID NO: 171630 - RNA, 22 nt, Homo sapiens
ugagcuaggucuugcucuguca

SEQ ID NO: 171631 - RNA, 22 nt, Homo sapiens
ugagcucagcuaguugaggugu

SEQ ID NO: 171632 - RNA, 22 nt, Homo sapiens
ugagcuccuucauaaaaaggca

SEQ ID NO: 171633 - RNA, 20 nt, Homo sapiens
ugagcuuguaaacacuguuu

SEQ ID NO: 171634 - RNA, 17 nt, Homo sapiens
ugaggcacuaguaucac

SEQ ID NO: 171635 - RNA, 22 nt, Homo sapiens
ugagggaugcguacccuaugcc

SEQ ID NO: 171636 - RNA, 22 nt, Homo sapiens
ugagguagguaccauuaucacu

SEQ ID NO: 171637 - RNA, 20 nt, Homo sapiens
ugaggucaggaguuacagac

SEQ ID NO: 171638 - RNA, 22 nt, Homo sapiens
ugaggucauucaugugggcgca

SEQ ID NO: 171639 - RNA, 22 nt, Homo sapiens
ugaggucuuuauuuagugcuca

SEQ ID NO: 171640 - RNA, 22 nt, Homo sapiens
ugaggugcagcaauccucaugu

SEQ ID NO: 171641 - RNA, 22 nt, Homo sapiens
ugagguugucagugucauucuu

SEQ ID NO: 171642 - RNA, 22 nt, Homo sapiens
ugaguagaacaucaagucauac

SEQ ID NO: 171643 - RNA, 22 nt, Homo sapiens
ugaguagagaauucagcuaagg

SEQ ID NO: 171644 - RNA, 22 nt, Homo sapiens
ugaguagauccaagacuguccu

SEQ ID NO: 171645 - RNA, 22 nt, Homo sapiens
ugaguaggauugguauuucuuc

SEQ ID NO: 171646 - RNA, 22 nt, Homo sapiens
ugaguaguauucuaugguaugu

SEQ ID NO: 171647 - RNA, 22 nt, Homo sapiens
ugaguagugcugcaauaaacau

SEQ ID NO: 171648 - RNA, 19 nt, Homo sapiens
ugaguaucuuuacacaucu

SEQ ID NO: 171649 - RNA, 22 nt, Homo sapiens
ugaguauguaggaugugucuua

SEQ ID NO: 171650 - RNA, 22 nt, Homo sapiens
ugagucaauggaggcucagagc

SEQ ID NO: 171651 - RNA, 22 nt, Homo sapiens
ugagucaugcuggagucauggc

SEQ ID NO: 171652 - RNA, 22 nt, Homo sapiens
ugagucuguuccaaagaaauaa

SEQ ID NO: 171653 - RNA, 22 nt, Homo sapiens
ugagugaaagaagcacuaagga

SEQ ID NO: 171654 - RNA, 22 nt, Homo sapiens
ugagugccuggagggcagggac

SEQ ID NO: 171655 - RNA, 22 nt, Homo sapiens
ugaguguccaccccuuucacag

SEQ ID NO: 171656 - RNA, 22 nt, Homo sapiens
ugaguuaauuuuuguaucaugu

SEQ ID NO: 171657 - RNA, 22 nt, Homo sapiens
ugaguuagguaauaauaaauau

SEQ ID NO: 171658 - RNA, 20 nt, Homo sapiens
ugaguuccuuguucagaagc

SEQ ID NO: 171659 - RNA, 22 nt, Homo sapiens
ugaguucuuuuacauuuugaau

SEQ ID NO: 171660 - RNA, 22 nt, Homo sapiens
ugauauauugaaugaugaaaca

SEQ ID NO: 171661 - RNA, 18 nt, Homo sapiens
ugauaucaaugauagcca

SEQ ID NO: 171662 - RNA, 22 nt, Homo sapiens
ugauaugaaagggaaauaagug

SEQ ID NO: 171663 - RNA, 22 nt, Homo sapiens
ugauaugcuuugaacucucugg

SEQ ID NO: 171664 - RNA, 22 nt, Homo sapiens
ugauauguaacuacuccuuaua

SEQ ID NO: 171665 - RNA, 22 nt, Homo sapiens
ugauaugucacuugaucauggu

SEQ ID NO: 171666 - RNA, 17 nt, Homo sapiens
ugauauuuucccagaua

SEQ ID NO: 171667 - RNA, 22 nt, Homo sapiens
ugauccuguccuuaugauguua

SEQ ID NO: 171668 - RNA, 22 nt, Homo sapiens
ugaucucauuagcaccuuuagc

SEQ ID NO: 171669 - RNA, 22 nt, Homo sapiens
ugaugacacugauuucuucaau

SEQ ID NO: 171670 - RNA, 22 nt, Homo sapiens
ugaugacauugucacagucuga

SEQ ID NO: 171671 - RNA, 21 nt, Homo sapiens
ugaugcaauccgcuaggucgc

SEQ ID NO: 171672 - RNA, 21 nt, Homo sapiens
ugaugcuuuucuuaaccuugc

SEQ ID NO: 171673 - RNA, 22 nt, Homo sapiens
ugauggccuguucuccauaugu

SEQ ID NO: 171674 - RNA, 22 nt, Homo sapiens
ugauguccaguucauagaaacu

SEQ ID NO: 171675 - RNA, 22 nt, Homo sapiens
ugauuagagcccaagcuuugaa

SEQ ID NO: 171676 - RNA, 22 nt, Homo sapiens
ugauugacauacauaggugugg

SEQ ID NO: 171677 - RNA, 18 nt, Homo sapiens
ugauugacuuauuuaggu

SEQ ID NO: 171678 - RNA, 22 nt, Homo sapiens
ugauuggagaacaaacugcaua

SEQ ID NO: 171679 - RNA, 22 nt, Homo sapiens
ugauuuguuuagugccaaguuu

SEQ ID NO: 171680 - RNA, 22 nt, Homo sapiens
ugcaaaugucaaggguuagugu

SEQ ID NO: 171681 - RNA, 22 nt, Homo sapiens
ugcaaauguuaguaacaccacu

SEQ ID NO: 171682 - RNA, 19 nt, Homo sapiens
ugcaaauucuaaaaacuga

SEQ ID NO: 171683 - RNA, 22 nt, Homo sapiens
ugcaacauguguaccacucugu

SEQ ID NO: 171684 - RNA, 22 nt, Homo sapiens
ugcaaccauuguuaagugugca

SEQ ID NO: 171685 - RNA, 22 nt, Homo sapiens
ugcaagaaacauauuccacaag

SEQ ID NO: 171686 - RNA, 22 nt, Homo sapiens
ugcaagacacuguccugggcau

SEQ ID NO: 171687 - RNA, 22 nt, Homo sapiens
ugcaagcacacccagggauugu

SEQ ID NO: 171688 - RNA, 20 nt, Homo sapiens
ugcaaguugccuuuggaggc

SEQ ID NO: 171689 - RNA, 22 nt, Homo sapiens
ugcaauauccucuacuauaggu

SEQ ID NO: 171690 - RNA, 22 nt, Homo sapiens
ugcaaugugaaauaagcacauc

SEQ ID NO: 171691 - RNA, 22 nt, Homo sapiens
ugcacacucuguaugagaaucu

SEQ ID NO: 171692 - RNA, 22 nt, Homo sapiens
ugcaccacugcacugccugggu

SEQ ID NO: 171693 - RNA, 21 nt, Homo sapiens
ugcagccauucagcccuaugc

SEQ ID NO: 171694 - RNA, 18 nt, Homo sapiens
ugcagcuuugugauuggc

SEQ ID NO: 171695 - RNA, 22 nt, Homo sapiens
ugcaggauguucaguaauuucc

SEQ ID NO: 171696 - RNA, 23 nt, Homo sapiens
ugcaguagugagaucuaggcuca

SEQ ID NO: 171697 - RNA, 20 nt, Homo sapiens
ugcaguguccucacuuguca

SEQ ID NO: 171698 - RNA, 22 nt, Homo sapiens
ucaucaggcucauucaagcuga

SEQ ID NO: 171699 - RNA, 22 nt, Homo sapiens
ucaucagguaugucagcggagu

SEQ ID NO: 171700 - RNA, 21 nt, Homo sapiens
ucaucagucaaagacaauggu

SEQ ID NO: 171701 - RNA, 20 nt, Homo sapiens
ucaucaguuggugcucgcug

SEQ ID NO: 171702 - RNA, 22 nt, Homo sapiens
ucaucucaguuucuugccguac

SEQ ID NO: 171703 - RNA, 22 nt, Homo sapiens
ucaugacacagcauacugacuu

SEQ ID NO: 171704 - RNA, 22 nt, Homo sapiens
ucaugagacacacuggaaagga

SEQ ID NO: 171705 - RNA, 22 nt, Homo sapiens
ucauggcacugaugagaguuuc

SEQ ID NO: 171706 - RNA, 19 nt, Homo sapiens
ucauggcuuuuucagcugu

SEQ ID NO: 171707 - RNA, 22 nt, Homo sapiens
ucauggggugagcuacaggcac

SEQ ID NO: 171708 - RNA, 22 nt, Homo sapiens
ucaugucuuguuguauuuauuu

SEQ ID NO: 171709 - RNA, 22 nt, Homo sapiens
ucaugugaggauaacaauagug

SEQ ID NO: 171710 - RNA, 22 nt, Homo sapiens
ucauuagagacagggugucacu

SEQ ID NO: 171711 - RNA, 22 nt, Homo sapiens
ucauucacucccuugaaguuag

SEQ ID NO: 171712 - RNA, 22 nt, Homo sapiens
ucauugcacucccagacacccu

SEQ ID NO: 171713 - RNA, 22 nt, Homo sapiens
ucauugcauguuaauuaaacag

SEQ ID NO: 171714 - RNA, 22 nt, Homo sapiens
ucauugcauuccagcccaagca

SEQ ID NO: 171715 - RNA, 22 nt, Homo sapiens
ucauuggcuaagcuuguuacac

SEQ ID NO: 171716 - RNA, 22 nt, Homo sapiens
uccacagugguugaacuaguaa

SEQ ID NO: 171717 - RNA, 22 nt, Homo sapiens
uccacugagcuagaccacuugg

SEQ ID NO: 171718 - RNA, 22 nt, Homo sapiens
uccagguuuggcuuuauaacuu

SEQ ID NO: 171719 - RNA, 22 nt, Homo sapiens
uccagguuuugugaguuuaaau

SEQ ID NO: 171720 - RNA, 22 nt, Homo sapiens
uccaguggacagacauaccaug

SEQ ID NO: 171721 - RNA, 22 nt, Homo sapiens
uccauuuguagguagugagaca

SEQ ID NO: 171722 - RNA, 23 nt, Homo sapiens
ucccaagauggaccagaccaagg

SEQ ID NO: 171723 - RNA, 16 nt, Homo sapiens
ucccaccauugcuugu

SEQ ID NO: 171724 - RNA, 22 nt, Homo sapiens
ucccagaaacgcauauguucau

SEQ ID NO: 171725 - RNA, 22 nt, Homo sapiens
ucccagugcuaugcaaaagccu

SEQ ID NO: 171726 - RNA, 22 nt, Homo sapiens
ucccauguagcuaggauuacag

SEQ ID NO: 171727 - RNA, 17 nt, Homo sapiens
ucccauguuucuucuac

SEQ ID NO: 171728 - RNA, 22 nt, Homo sapiens
uccccggaugacggccgcuuca

SEQ ID NO: 171729 - RNA, 22 nt, Homo sapiens
uccccugagaacuugcuagaaa

SEQ ID NO: 171730 - RNA, 22 nt, Homo sapiens
ucccuagacuccugccuuucag

SEQ ID NO: 171731 - RNA, 20 nt, Homo sapiens
ucccucaaacuuuuccacug

SEQ ID NO: 171732 - RNA, 22 nt, Homo sapiens
ucccugaaaauuagcauuuuaa

SEQ ID NO: 171733 - RNA, 22 nt, Homo sapiens
ucccugaaucucagguucugua

SEQ ID NO: 171734 - RNA, 22 nt, Homo sapiens
ucccugacagucacagagcuac

SEQ ID NO: 171735 - RNA, 22 nt, Homo sapiens
ucccuguguccugggggcaccu

SEQ ID NO: 171736 - RNA, 22 nt, Homo sapiens
ucccuuagccaaauccccagcc

SEQ ID NO: 171737 - RNA, 22 nt, Homo sapiens
uccgaguguuagagagcugugu

SEQ ID NO: 171738 - RNA, 22 nt, Homo sapiens
uccucaguggauuggauggugc

SEQ ID NO: 171739 - RNA, 22 nt, Homo sapiens
uccucugaacuccagacccaua

SEQ ID NO: 171740 - RNA, 22 nt, Homo sapiens
uccugagacucacaggcucccc

SEQ ID NO: 171741 - RNA, 21 nt, Homo sapiens
uccugagagaggaguaacucu

SEQ ID NO: 171742 - RNA, 22 nt, Homo sapiens
uccugagucagcauccguuugu

SEQ ID NO: 171743 - RNA, 22 nt, Homo sapiens
uccugcauucauccugguguug

SEQ ID NO: 171744 - RNA, 22 nt, Homo sapiens
uccuggcuccacuguuuauucc

SEQ ID NO: 171745 - RNA, 22 nt, Homo sapiens
uccuguaaucccagcuaccaga

SEQ ID NO: 171746 - RNA, 22 nt, Homo sapiens
uccuucacucuacaucuuuguu

SEQ ID NO: 171747 - RNA, 19 nt, Homo sapiens
uccuugauugcaccacugc

SEQ ID NO: 171748 - RNA, 22 nt, Homo sapiens
uccuugguugauccugugcaga

SEQ ID NO: 171749 - RNA, 22 nt, Homo sapiens
uccuuuggguagcuguucagau

SEQ ID NO: 171750 - RNA, 22 nt, Homo sapiens
uccuuuggucaguauucuuuug

SEQ ID NO: 171751 - RNA, 22 nt, Homo sapiens
ucgcugggaagacugaaguguc

SEQ ID NO: 171752 - RNA, 22 nt, Homo sapiens
ucuauggaguuugaaugagaaa

SEQ ID NO: 171753 - RNA, 22 nt, Homo sapiens
ucuauguuuuugcuaguagugu

SEQ ID NO: 171754 - RNA, 22 nt, Homo sapiens
ucuauugguaggggcugaggca

SEQ ID NO: 171755 - RNA, 22 nt, Homo sapiens
ucuauuugggguaccuguggua

SEQ ID NO: 171756 - RNA, 22 nt, Homo sapiens
ucucaagaugguagaugggaau

SEQ ID NO: 171757 - RNA, 22 nt, Homo sapiens
ucucaaguggucgcaguuagau

SEQ ID NO: 171758 - RNA, 22 nt, Homo sapiens
ucucaauuugauuacauucaua

SEQ ID NO: 171759 - RNA, 22 nt, Homo sapiens
ucucacaggguuauugaggggg

SEQ ID NO: 171760 - RNA, 22 nt, Homo sapiens
ucucagugaaauaaauuauuuu

SEQ ID NO: 171761 - RNA, 22 nt, Homo sapiens
ucucaguggcacccccaacacc

SEQ ID NO: 171762 - RNA, 22 nt, Homo sapiens
ucucaguggcuuccucacuuuu

SEQ ID NO: 171763 - RNA, 22 nt, Homo sapiens
ucucaguguuaucuaucugccu

SEQ ID NO: 171764 - RNA, 22 nt, Homo sapiens
ucucaguuuucuggggaagaaa

SEQ ID NO: 171765 - RNA, 20 nt, Homo sapiens
ucucccaaacagcaggcccu

SEQ ID NO: 171766 - RNA, 19 nt, Homo sapiens
ucucugguguuggagggga

SEQ ID NO: 171767 - RNA, 22 nt, Homo sapiens
ucucugguuuguggaaucuuag

SEQ ID NO: 171768 - RNA, 22 nt, Homo sapiens
ucucugguuuucaaagcaguau

SEQ ID NO: 171769 - RNA, 22 nt, Homo sapiens
ucucuuggcggaaguugcagug

SEQ ID NO: 171770 - RNA, 22 nt, Homo sapiens
ucugaaucguucccaugcagga

SEQ ID NO: 171771 - RNA, 22 nt, Homo sapiens
ucugacacagugauuaguaaau

SEQ ID NO: 171772 - RNA, 22 nt, Homo sapiens
ucugacagugugaauauugacu

SEQ ID NO: 171773 - RNA, 22 nt, Homo sapiens
ucugagaugagacuuugaauuu

SEQ ID NO: 171774 - RNA, 22 nt, Homo sapiens
ucugagcaugcaucuugccugg

SEQ ID NO: 171775 - RNA, 22 nt, Homo sapiens
ucugagguuaaauuuuauaguu

SEQ ID NO: 171776 - RNA, 22 nt, Homo sapiens
ucugagucaucacaaaugaugc

SEQ ID NO: 171777 - RNA, 21 nt, Homo sapiens
ucugagucauucaguggccug

SEQ ID NO: 171778 - RNA, 22 nt, Homo sapiens
ucugccuacugagcacacagug

SEQ ID NO: 171779 - RNA, 22 nt, Homo sapiens
ucugccuuuucaugugggaugg

SEQ ID NO: 171780 - RNA, 21 nt, Homo sapiens
ucuggcccccucaaaucucau

SEQ ID NO: 171781 - RNA, 22 nt, Homo sapiens
ucuggccccucccaaaucucau

SEQ ID NO: 171782 - RNA, 22 nt, Homo sapiens
ucuggccuacaucauuuuuccg

SEQ ID NO: 171783 - RNA, 22 nt, Homo sapiens
agauacauuggauaaugguggg

SEQ ID NO: 171784 - RNA, 22 nt, Homo sapiens
agauauguuauugauguuaaug

SEQ ID NO: 171785 - RNA, 22 nt, Homo sapiens
agaucauaugcaguaaugaacu

SEQ ID NO: 171786 - RNA, 22 nt, Homo sapiens
agaugauguuuacugagcauca

SEQ ID NO: 171787 - RNA, 22 nt, Homo sapiens
agaugccuaugaagagaaauua

SEQ ID NO: 171788 - RNA, 22 nt, Homo sapiens
agauggauuuuguagccccagc

SEQ ID NO: 171789 - RNA, 23 nt, Homo sapiens
agauggcauuucaguucuuuagg

SEQ ID NO: 171790 - RNA, 22 nt, Homo sapiens
agauggugugcuaggaaaugua

SEQ ID NO: 171791 - RNA, 22 nt, Homo sapiens
agcaagacauggcuuccaaaug

SEQ ID NO: 171792 - RNA, 22 nt, Homo sapiens
agcacagugguuaaguuucuua

SEQ ID NO: 171793 - RNA, 22 nt, Homo sapiens
agcaccaauaacaguuucuagc

SEQ ID NO: 171794 - RNA, 22 nt, Homo sapiens
agcaccaauaaucagaguucuu

SEQ ID NO: 171795 - RNA, 22 nt, Homo sapiens
agcaccagaaucugaguuauuc

SEQ ID NO: 171796 - RNA, 22 nt, Homo sapiens
agcaccauugcacuccagccug

SEQ ID NO: 171797 - RNA, 23 nt, Homo sapiens
agcaccuuuccuccacuaucugc

SEQ ID NO: 171798 - RNA, 22 nt, Homo sapiens
agcagagcaguggauuuuguga

SEQ ID NO: 171799 - RNA, 22 nt, Homo sapiens
agcagcgacacccuguggugag

SEQ ID NO: 171800 - RNA, 22 nt, Homo sapiens
agcagcucaagacuuaaauuug

SEQ ID NO: 171801 - RNA, 22 nt, Homo sapiens
agcagcuuugcauggccuguga

SEQ ID NO: 171802 - RNA, 22 nt, Homo sapiens
agcagugugaaaauggacuaau

SEQ ID NO: 171803 - RNA, 22 nt, Homo sapiens
agcaucacacacuacagggaaa

SEQ ID NO: 171804 - RNA, 20 nt, Homo sapiens
agcaucagugguaguguugc

SEQ ID NO: 171805 - RNA, 20 nt, Homo sapiens
agcauugguuagaacaguag

SEQ ID NO: 171806 - RNA, 22 nt, Homo sapiens
agcccugugauuacuuuuauaa

SEQ ID NO: 171807 - RNA, 22 nt, Homo sapiens
agccucauucuacauguuaaug

SEQ ID NO: 171808 - RNA, 22 nt, Homo sapiens
agcggcuguuccccuggucuau

SEQ ID NO: 171809 - RNA, 22 nt, Homo sapiens
agcuacuguuagucuaguuagg

SEQ ID NO: 171810 - RNA, 22 nt, Homo sapiens
agcucacagccuagcacuguga

SEQ ID NO: 171811 - RNA, 22 nt, Homo sapiens
agcuccaucuucagggguucag

SEQ ID NO: 171812 - RNA, 22 nt, Homo sapiens
agcuccaugauaguaugucugu

SEQ ID NO: 171813 - RNA, 20 nt, Homo sapiens
agcuccauuccugaaggcug

SEQ ID NO: 171814 - RNA, 22 nt, Homo sapiens
agcucuuguuaguauuagcagu

SEQ ID NO: 171815 - RNA, 22 nt, Homo sapiens
agcugauuuuaaguccuugucc

SEQ ID NO: 171816 - RNA, 22 nt, Homo sapiens
agcugcaaagggagagaugauu

SEQ ID NO: 171817 - RNA, 22 nt, Homo sapiens
agcugcacugguauaggagaaa

SEQ ID NO: 171818 - RNA, 22 nt, Homo sapiens
agcuggauuguuuaccuggggc

SEQ ID NO: 171819 - RNA, 22 nt, Homo sapiens
agcuggcuguagcugcaagucu

SEQ ID NO: 171820 - RNA, 22 nt, Homo sapiens
agcugguaguuuucuaguguuu

SEQ ID NO: 171821 - RNA, 18 nt, Homo sapiens
aaaaagugcucaggccua

SEQ ID NO: 171822 - RNA, 22 nt, Homo sapiens
aaaagugguguuguuucuaaau

SEQ ID NO: 171823 - RNA, 22 nt, Homo sapiens
aaacaccacgcggucccucgga

SEQ ID NO: 171824 - RNA, 20 nt, Homo sapiens
aaacucugucuucuuuauca

SEQ ID NO: 171825 - RNA, 22 nt, Homo sapiens
aaacugcuuuccaugguggcug

SEQ ID NO: 171826 - RNA, 22 nt, Homo sapiens
aaagaguucagguagauuucaa

SEQ ID NO: 171827 - RNA, 22 nt, Homo sapiens
aaagcaucacuuuuccuacuuu

SEQ ID NO: 171828 - RNA, 22 nt, Homo sapiens
aaaggcacacacuccuuguuau

SEQ ID NO: 171829 - RNA, 22 nt, Homo sapiens
aaaggcacuagaaguuaccuuu

SEQ ID NO: 171830 - RNA, 22 nt, Homo sapiens
aaaggcacugaucuuauccagu

SEQ ID NO: 171831 - RNA, 22 nt, Homo sapiens
aaagggcuguuucuugacuugg

SEQ ID NO: 171832 - RNA, 22 nt, Homo sapiens
aaagggcuugaauacucuuuuu

SEQ ID NO: 171833 - RNA, 20 nt, Homo sapiens
aaaguaggcuaauaccaaaa

SEQ ID NO: 171834 - RNA, 22 nt, Homo sapiens
aaagucacuggagaaggaauau

SEQ ID NO: 171835 - RNA, 22 nt, Homo sapiens
aaagugauuguaguuuuugcca

SEQ ID NO: 171836 - RNA, 22 nt, Homo sapiens
aaagugcacuuggaagagggcc

SEQ ID NO: 171837 - RNA, 22 nt, Homo sapiens
aaagugccuucuauuuuaguga

SEQ ID NO: 171838 - RNA, 22 nt, Homo sapiens
aaagugcuaggauuaccugggg

SEQ ID NO: 171839 - RNA, 22 nt, Homo sapiens
aaagugguuuuucagacuuuga

SEQ ID NO: 171840 - RNA, 19 nt, Homo sapiens
aaaguguuuuaaagaggau

SEQ ID NO: 171841 - RNA, 15 nt, Homo sapiens
aaauaugucaguucu

SEQ ID NO: 171842 - RNA, 22 nt, Homo sapiens
aaauccauuuguucagcuaugc

SEQ ID NO: 171843 - RNA, 21 nt, Homo sapiens
gcugguaaucacuuugccaaa

SEQ ID NO: 171844 - RNA, 22 nt, Homo sapiens
gcuggucugccguaguaggugc

SEQ ID NO: 171845 - RNA, 22 nt, Homo sapiens
gcugguguagagugcagaaagg

SEQ ID NO: 171846 - RNA, 22 nt, Homo sapiens
gcugguguucaggcccucaguc

SEQ ID NO: 171847 - RNA, 19 nt, Homo sapiens
gcugguuguccacucucuc

SEQ ID NO: 171848 - RNA, 22 nt, Homo sapiens
gcuguauuguugaaggaaaugu

SEQ ID NO: 171849 - RNA, 22 nt, Homo sapiens
gcugugauucuguguagauagu

SEQ ID NO: 171850 - RNA, 22 nt, Homo sapiens
gcugugguuuaguagaaagaag

SEQ ID NO: 171851 - RNA, 22 nt, Homo sapiens
gcuguguugugcccagcaucau

SEQ ID NO: 171852 - RNA, 22 nt, Homo sapiens
gcuucauggaggcugggcgcag

SEQ ID NO: 171853 - RNA, 22 nt, Homo sapiens
gcuugguccccacccaaaucgc

SEQ ID NO: 171854 - RNA, 22 nt, Homo sapiens
gcuuguguucaagucacccuua

SEQ ID NO: 171855 - RNA, 22 nt, Homo sapiens
gcuuugcaauggcauugaccau

SEQ ID NO: 171856 - RNA, 21 nt, Homo sapiens
gcuuuuucggaagucuuuggc

SEQ ID NO: 171857 - RNA, 18 nt, Homo sapiens
ggaaaacuuuucuaagua

SEQ ID NO: 171858 - RNA, 22 nt, Homo sapiens
ggaaaucucugaggcucccuuc

SEQ ID NO: 171859 - RNA, 22 nt, Homo sapiens
ggaagaauaaugggccuuagag

SEQ ID NO: 171860 - RNA, 22 nt, Homo sapiens
ggaagaauauuaggggauuucg

SEQ ID NO: 171861 - RNA, 22 nt, Homo sapiens
ggaagacaguguggugauuccu

SEQ ID NO: 171862 - RNA, 22 nt, Homo sapiens
ggaagacuuagaguagcaucag

SEQ ID NO: 171863 - RNA, 20 nt, Homo sapiens
ggaagagugacacaagguau

SEQ ID NO: 171864 - RNA, 22 nt, Homo sapiens
ggaaguuaauacagauagagua

SEQ ID NO: 171865 - RNA, 20 nt, Homo sapiens
ggaauagucuacacucugac

SEQ ID NO: 171866 - RNA, 22 nt, Homo sapiens
ggaaugugugucaugcuuuugc

SEQ ID NO: 171867 - RNA, 22 nt, Homo sapiens
ggacacaucaugugaccaaggu

SEQ ID NO: 171868 - RNA, 22 nt, Homo sapiens
ggacaguagugcuuucuaucau

SEQ ID NO: 171869 - RNA, 20 nt, Homo sapiens
ggagagugacauaauucugg

SEQ ID NO: 171870 - RNA, 22 nt, Homo sapiens
ggagauuauuaguguuucaugc

SEQ ID NO: 171871 - RNA, 20 nt, Homo sapiens
ggagguguuggauuucuagu

SEQ ID NO: 171872 - RNA, 22 nt, Homo sapiens
ggaguaggcuguccggcaccca

SEQ ID NO: 171873 - RNA, 22 nt, Homo sapiens
ggagucugacuuauaggaaccu

SEQ ID NO: 171874 - RNA, 22 nt, Homo sapiens
ggagucugauguucuaaggcag

SEQ ID NO: 171875 - RNA, 22 nt, Homo sapiens
ggaguguaauggcgccaucuca

SEQ ID NO: 171876 - RNA, 22 nt, Homo sapiens
ggagugucagaaacaguguccu

SEQ ID NO: 171877 - RNA, 22 nt, Homo sapiens
ggauaucauuauuucuagggcu

SEQ ID NO: 171878 - RNA, 22 nt, Homo sapiens
ggcaaaaucgcaauuacuuuug

SEQ ID NO: 171879 - RNA, 22 nt, Homo sapiens
ggcaaagaugaccauuacuuuu

SEQ ID NO: 171880 - RNA, 22 nt, Homo sapiens
ggcaacaugaugaaaugccauc

SEQ ID NO: 171881 - RNA, 19 nt, Homo sapiens
ggcaagaguuguucugugu

SEQ ID NO: 171882 - RNA, 22 nt, Homo sapiens
ggcaagugucagcagcaacacc

SEQ ID NO: 171883 - RNA, 19 nt, Homo sapiens
ggcaauacuuucuuguugg

SEQ ID NO: 171884 - RNA, 22 nt, Homo sapiens
ggcaauauauucugaauucagu

SEQ ID NO: 171885 - RNA, 22 nt, Homo sapiens
ggcacaguuaagugcuaccuaa

SEQ ID NO: 171886 - RNA, 22 nt, Homo sapiens
ggcagacuguggaguucuuucu

SEQ ID NO: 171887 - RNA, 22 nt, Homo sapiens
ggcagaguggacauuuaaaugu

SEQ ID NO: 171888 - RNA, 22 nt, Homo sapiens
ggcagcaugggugccuuuguga

SEQ ID NO: 171889 - RNA, 22 nt, Homo sapiens
ggcagcucaggccccgcgcuga

SEQ ID NO: 171890 - RNA, 17 nt, Homo sapiens
ggcaggaauuaauguca

SEQ ID NO: 171891 - RNA, 17 nt, Homo sapiens
ggcaggauccaggaucc

SEQ ID NO: 171892 - RNA, 22 nt, Homo sapiens
ggcaguguauuacuuaggguuc

SEQ ID NO: 171893 - RNA, 22 nt, Homo sapiens
ggcaugauguauuugagguuug

SEQ ID NO: 171894 - RNA, 22 nt, Homo sapiens
ggccagaugcaguggcucacac

SEQ ID NO: 171895 - RNA, 22 nt, Homo sapiens
ggcccugauacaaguaaggucu

SEQ ID NO: 171896 - RNA, 18 nt, Homo sapiens
ggcugguguuuuaguaua

SEQ ID NO: 171897 - RNA, 22 nt, Homo sapiens
ggcuuuggucacacaggggcaa

SEQ ID NO: 171898 - RNA, 22 nt, Homo sapiens
gggaacauggaaauucugcucu

SEQ ID NO: 171899 - RNA, 22 nt, Homo sapiens
gggaagaaggagugguuuacuc

SEQ ID NO: 171900 - RNA, 22 nt, Homo sapiens
gggaauguagcaaaucugcaau

SEQ ID NO: 171901 - RNA, 22 nt, Homo sapiens
gggagcacaagaaauguuucau

SEQ ID NO: 171902 - RNA, 22 nt, Homo sapiens
gggagguaggaguuauuauuuu

SEQ ID NO: 171903 - RNA, 22 nt, Homo sapiens
gggagguuguauguaugcgggg

SEQ ID NO: 171904 - RNA, 22 nt, Homo sapiens
gggaucaacuuauacuaaaauu

SEQ ID NO: 171905 - RNA, 23 nt, Homo sapiens
gggauuguaaaauaugagggcag

SEQ ID NO: 171906 - RNA, 22 nt, Homo sapiens
gggcgagaaucggcugcucagc

SEQ ID NO: 171907 - RNA, 22 nt, Homo sapiens
gggcuagaauccgcgucucuug

SEQ ID NO: 171908 - RNA, 22 nt, Homo sapiens
gggguauguaagugagugagug

SEQ ID NO: 171909 - RNA, 22 nt, Homo sapiens
ggguucaaaucuuggcucuuac

SEQ ID NO: 171910 - RNA, 22 nt, Homo sapiens
ggguucccuucuggcucagggu

SEQ ID NO: 171911 - RNA, 22 nt, Homo sapiens
gguauuauuugccuuuuacuga

SEQ ID NO: 171912 - RNA, 22 nt, Homo sapiens
ggucaacaucaucaugguaagu

SEQ ID NO: 171913 - RNA, 22 nt, Homo sapiens
ggucacauuggacuaucaaguu

SEQ ID NO: 171914 - RNA, 22 nt, Homo sapiens
ggucacccugaugcuggugguc

SEQ ID NO: 171915 - RNA, 22 nt, Homo sapiens
ggucagauggcagcugggccug

SEQ ID NO: 171916 - RNA, 22 nt, Homo sapiens
ggucauagagaauucaccagga

SEQ ID NO: 171917 - RNA, 22 nt, Homo sapiens
ggucauggagcuuuacuuuaug

SEQ ID NO: 171918 - RNA, 22 nt, Homo sapiens
ggucugguguugaaauucuuca

SEQ ID NO: 171919 - RNA, 22 nt, Homo sapiens
ggugaggaaaguugaguuucua

SEQ ID NO: 171920 - RNA, 23 nt, Homo sapiens
ggugaggaguacagagucuucau

SEQ ID NO: 171921 - RNA, 22 nt, Homo sapiens
ggugagguaggaaaaguuagga

SEQ ID NO: 171922 - RNA, 22 nt, Homo sapiens
ggugcagcacaccaacauggca

SEQ ID NO: 171923 - RNA, 19 nt, Homo sapiens
ggugcuugaauauuccucc

SEQ ID NO: 171924 - RNA, 22 nt, Homo sapiens
gguggcuuuuugugauggcuga

SEQ ID NO: 171925 - RNA, 22 nt, Homo sapiens
gguguguaaauuacuuaucucu

SEQ ID NO: 171926 - RNA, 22 nt, Homo sapiens
gguguuccccuuaccucuuggc

SEQ ID NO: 171927 - RNA, 22 nt, Homo sapiens
guaaacuuccccucaugaauga

SEQ ID NO: 171928 - RNA, 22 nt, Homo sapiens
guaacacaugcugcucucuggu

SEQ ID NO: 171929 - RNA, 22 nt, Homo sapiens
guaagugauagaauuaggauuc

SEQ ID NO: 171930 - RNA, 22 nt, Homo sapiens
guaauacuuuugggauauuaga

SEQ ID NO: 171931 - RNA, 22 nt, Homo sapiens
guaaucucagcuacucaggagg

SEQ ID NO: 171932 - RNA, 22 nt, Homo sapiens
guaaucucagcuacuugggagg

SEQ ID NO: 171933 - RNA, 22 nt, Homo sapiens
guaaucucagcuccucaugagg

SEQ ID NO: 171934 - RNA, 22 nt, Homo sapiens
guaaucucagcuucuugggagg

SEQ ID NO: 171935 - RNA, 22 nt, Homo sapiens
guacaagugcaguuucguuaca

SEQ ID NO: 171936 - RNA, 22 nt, Homo sapiens
guacaguacugaaugaauguau

SEQ ID NO: 171937 - RNA, 22 nt, Homo sapiens
guacuuagagauagggucuuua

SEQ ID NO: 171938 - RNA, 22 nt, Homo sapiens
guagaaaguuugcugucacaug

SEQ ID NO: 171939 - RNA, 22 nt, Homo sapiens
guagaagcacagggccuguauu

SEQ ID NO: 171940 - RNA, 22 nt, Homo sapiens
guagagagaaauacaaagcugu

SEQ ID NO: 171941 - RNA, 22 nt, Homo sapiens
guauagaucguagaccaauaaa

SEQ ID NO: 171942 - RNA, 22 nt, Homo sapiens
guauagcacauaauacuugaug

SEQ ID NO: 171943 - RNA, 22 nt, Homo sapiens
guauaguaguacaaaaguuuuu

SEQ ID NO: 171944 - RNA, 22 nt, Homo sapiens
guaucucaguucucgugauuag

SEQ ID NO: 171945 - RNA, 22 nt, Homo sapiens
guaugacacaggaagcuuaacc

SEQ ID NO: 171946 - RNA, 22 nt, Homo sapiens
guauggcacuauccucucugau

SEQ ID NO: 171947 - RNA, 22 nt, Homo sapiens
guggcuauuguucccugguugc

SEQ ID NO: 171948 - RNA, 22 nt, Homo sapiens
gugggguaggaggaguacuucc

SEQ ID NO: 171949 - RNA, 22 nt, Homo sapiens
gugggguaggcaauuccuagug

SEQ ID NO: 171950 - RNA, 22 nt, Homo sapiens
guggguaaaucucuguucgagg

SEQ ID NO: 171951 - RNA, 22 nt, Homo sapiens
gugguaggaaagugcaaaugua

SEQ ID NO: 171952 - RNA, 19 nt, Homo sapiens
gugguauuaccuuuugauu

SEQ ID NO: 171953 - RNA, 22 nt, Homo sapiens
agaaacacagguggaauugcuu

SEQ ID NO: 171954 - RNA, 22 nt, Homo sapiens
agaaacauucucuugccuccuu

SEQ ID NO: 171955 - RNA, 22 nt, Homo sapiens
agaaagcgcuucccuuugcugg

SEQ ID NO: 171956 - RNA, 22 nt, Homo sapiens
agaaagugcuucccuuugguga

SEQ ID NO: 171957 - RNA, 22 nt, Homo sapiens
agaacacugaguucagggucag

SEQ ID NO: 171958 - RNA, 22 nt, Homo sapiens
agaaccauuagagggagauauu

SEQ ID NO: 171959 - RNA, 22 nt, Homo sapiens
agaacuguccauucagcaugaa

SEQ ID NO: 171960 - RNA, 19 nt, Homo sapiens
agaaucuaaauuauuucug

SEQ ID NO: 171961 - RNA, 20 nt, Homo sapiens
agacagcugcagcccacauc

SEQ ID NO: 171962 - RNA, 22 nt, Homo sapiens
agacagcugggaaauggagugu

SEQ ID NO: 171963 - RNA, 20 nt, Homo sapiens
agacaguguggagauuccuu

SEQ ID NO: 171964 - RNA, 22 nt, Homo sapiens
agacuagagcagagcccucucu

SEQ ID NO: 171965 - RNA, 19 nt, Homo sapiens
agacuggcccaggcgggug

SEQ ID NO: 171966 - RNA, 22 nt, Homo sapiens
agagaacugauucagggaaaau

SEQ ID NO: 171967 - RNA, 22 nt, Homo sapiens
agagacauugcuccaacucacc

SEQ ID NO: 171968 - RNA, 22 nt, Homo sapiens
agagagcuugggguguuaaauu

SEQ ID NO: 171969 - RNA, 22 nt, Homo sapiens
agagauaauuagguuaaaugag

SEQ ID NO: 171970 - RNA, 22 nt, Homo sapiens
agagauacauucugagaagugc

SEQ ID NO: 171971 - RNA, 22 nt, Homo sapiens
agagaugaagauggggcucccg

SEQ ID NO: 171972 - RNA, 22 nt, Homo sapiens
agagauuauccuggcuucucug

SEQ ID NO: 171973 - RNA, 22 nt, Homo sapiens
agagcauugaguuaaugguuca

SEQ ID NO: 171974 - RNA, 21 nt, Homo sapiens
agaggacugaccacagcccua

SEQ ID NO: 171975 - RNA, 22 nt, Homo sapiens
agagguaagaauaguaguugga

SEQ ID NO: 171976 - RNA, 22 nt, Homo sapiens
agagguauacauuugagagcca

SEQ ID NO: 171977 - RNA, 23 nt, Homo sapiens
agagguuuaaucaggcaguugcu

SEQ ID NO: 171978 - RNA, 22 nt, Homo sapiens
agaguaguaggaugaauggacu

SEQ ID NO: 171979 - RNA, 22 nt, Homo sapiens
agaguaguuucuauauucuuca

SEQ ID NO: 171980 - RNA, 22 nt, Homo sapiens
agaguauacaugugagugagau

SEQ ID NO: 171981 - RNA, 22 nt, Homo sapiens
agagugcuauagauuagauuuc

SEQ ID NO: 171982 - RNA, 20 nt, Homo sapiens
agagugcuggacugaggagc

SEQ ID NO: 171983 - RNA, 20 nt, Homo sapiens
agagugcugucuguccugag

SEQ ID NO: 171984 - RNA, 22 nt, Homo sapiens
agaucacagucuuugguuuuag

SEQ ID NO: 171985 - RNA, 22 nt, Homo sapiens
agauggguuuucacauguuggc

SEQ ID NO: 171986 - RNA, 18 nt, Homo sapiens
agaugguguugcuucugu

SEQ ID NO: 171987 - RNA, 22 nt, Homo sapiens
agaugguguuuucucaccagau

SEQ ID NO: 171988 - RNA, 22 nt, Homo sapiens
agcaacauagugagacccccau

SEQ ID NO: 171989 - RNA, 22 nt, Homo sapiens
agcaacaucagcagcaggaaaa

SEQ ID NO: 171990 - RNA, 22 nt, Homo sapiens
agcaauaugacauugcuacauc

SEQ ID NO: 171991 - RNA, 22 nt, Homo sapiens
agcacagccuuguguuuucuug

SEQ ID NO: 171992 - RNA, 22 nt, Homo sapiens
agcaccaccguugcucuauccc

SEQ ID NO: 171993 - RNA, 22 nt, Homo sapiens
agcaccauuguacuccagccug

SEQ ID NO: 171994 - RNA, 22 nt, Homo sapiens
agcacuacugcacuccagccug

SEQ ID NO: 171995 - RNA, 19 nt, Homo sapiens
agcagaacaaauguguggg

SEQ ID NO: 171996 - RNA, 22 nt, Homo sapiens
agcagcacaucccuuucuggcc

SEQ ID NO: 171997 - RNA, 22 nt, Homo sapiens
agcagcauuccaaaaaucugcu

SEQ ID NO: 171998 - RNA, 20 nt, Homo sapiens
agcagccacagauuccucag

SEQ ID NO: 171999 - RNA, 22 nt, Homo sapiens
agcaggacaauaugggaucagg

SEQ ID NO: 172000 - RNA, 22 nt, Homo sapiens
agcaggauuguuacaauaguaa

SEQ ID NO: 172001 - RNA, 22 nt, Homo sapiens
agcagguauucgggucaugggg

SEQ ID NO: 172002 - RNA, 22 nt, Homo sapiens
agcaguagugaaaguagacuua

SEQ ID NO: 172003 - RNA, 22 nt, Homo sapiens
agcagugucauuuucuggugag

SEQ ID NO: 172004 - RNA, 18 nt, Homo sapiens
agcaucacugaucauccu

SEQ ID NO: 172005 - RNA, 22 nt, Homo sapiens
agcaucauguuuucgagguuca

SEQ ID NO: 172006 - RNA, 22 nt, Homo sapiens
agcauggucacuuugggcccca

SEQ ID NO: 172007 - RNA, 17 nt, Homo sapiens
agcauguguuugagauu

SEQ ID NO: 172008 - RNA, 22 nt, Homo sapiens
agccaguauuuuauugaggauu

SEQ ID NO: 172009 - RNA, 22 nt, Homo sapiens
agccaguauuuugaguuggucu

SEQ ID NO: 172010 - RNA, 19 nt, Homo sapiens
agccaguuuucccagcacc

SEQ ID NO: 172011 - RNA, 22 nt, Homo sapiens
agcccauguggcugaggcuucu

SEQ ID NO: 172012 - RNA, 22 nt, Homo sapiens
agcccauuuugcacugagaugc

SEQ ID NO: 172013 - RNA, 20 nt, Homo sapiens
agccccauguaaaccacaug

SEQ ID NO: 172014 - RNA, 22 nt, Homo sapiens
agccccauuuguugaaaagacg

SEQ ID NO: 172015 - RNA, 22 nt, Homo sapiens
agcccuuagauggcuccuucca

SEQ ID NO: 172016 - RNA, 23 nt, Homo sapiens
agccugguuucccugcuucuccc

SEQ ID NO: 172017 - RNA, 23 nt, Homo sapiens
agccuguugccuaggcagcucau

SEQ ID NO: 172018 - RNA, 22 nt, Homo sapiens
agcgccacugcacuccagccug

SEQ ID NO: 172019 - RNA, 22 nt, Homo sapiens
agcgguguuaggaaggugaggg

SEQ ID NO: 172020 - RNA, 21 nt, Homo sapiens
agcuaaauuggaaauuucugu

SEQ ID NO: 172021 - RNA, 22 nt, Homo sapiens
agcuaguguucaccagagguca

SEQ ID NO: 172022 - RNA, 22 nt, Homo sapiens
agcuauauugaggaugccauuc

SEQ ID NO: 172023 - RNA, 22 nt, Homo sapiens
agcuccuacuguuacaucauug

SEQ ID NO: 172024 - RNA, 22 nt, Homo sapiens
agcuccuuucugcaggcagguc

SEQ ID NO: 172025 - RNA, 22 nt, Homo sapiens
agcugauggucuuguaugaugu

SEQ ID NO: 172026 - RNA, 22 nt, Homo sapiens
agcugcauucguaucauauugu

SEQ ID NO: 172027 - RNA, 22 nt, Homo sapiens
agcugcauuuacuuuugcacaa

SEQ ID NO: 172028 - RNA, 22 nt, Homo sapiens
agcuggaauuuaagguagauag

SEQ ID NO: 172029 - RNA, 22 nt, Homo sapiens
agcuggauguggaugacccugu

SEQ ID NO: 172030 - RNA, 22 nt, Homo sapiens
agcuggucugauacuuaccucc

SEQ ID NO: 172031 - RNA, 22 nt, Homo sapiens
agcuggucuuggggaagaguag

SEQ ID NO: 172032 - RNA, 22 nt, Homo sapiens
agcugguuuaauaugcugucug

SEQ ID NO: 172033 - RNA, 22 nt, Homo sapiens
agcugugucuucuuaaagauuu

SEQ ID NO: 172034 - RNA, 22 nt, Homo sapiens
agcuguguugucugaagucaga

SEQ ID NO: 172035 - RNA, 20 nt, Homo sapiens
agcuguuguuaugagguuua

SEQ ID NO: 172036 - RNA, 22 nt, Homo sapiens
agcuguuguuuuaagauacuaa

SEQ ID NO: 172037 - RNA, 22 nt, Homo sapiens
agcuucacaaugcagagggcag

SEQ ID NO: 172038 - RNA, 22 nt, Homo sapiens
agcuugugauuuagagugagag

SEQ ID NO: 172039 - RNA, 22 nt, Homo sapiens
agcuugugcuguaugaagggcc

SEQ ID NO: 172040 - RNA, 21 nt, Homo sapiens
agcuuguguguaucacagugu

SEQ ID NO: 172041 - RNA, 22 nt, Homo sapiens
agcuuguguuuuucuaaguauc

SEQ ID NO: 172042 - RNA, 19 nt, Homo sapiens
agcuuuggcuaacuuucuc

SEQ ID NO: 172043 - RNA, 22 nt, Homo sapiens
agcuuuuugggaggccuuagga

SEQ ID NO: 172044 - RNA, 22 nt, Homo sapiens
aggaagguaaacuaacuugccu

SEQ ID NO: 172045 - RNA, 22 nt, Homo sapiens
aggaaguaauaaguuugguucu

SEQ ID NO: 172046 - RNA, 22 nt, Homo sapiens
aggaagugucuucuuuuaggca

SEQ ID NO: 172047 - RNA, 22 nt, Homo sapiens
aggacacugagcaugggagguu

SEQ ID NO: 172048 - RNA, 21 nt, Homo sapiens
aggagauguuuguccuuuuag

SEQ ID NO: 172049 - RNA, 22 nt, Homo sapiens
aggagcacaggacuuugauuau

SEQ ID NO: 172050 - RNA, 23 nt, Homo sapiens
aggagcuuagaaguugccauugc

SEQ ID NO: 172051 - RNA, 22 nt, Homo sapiens
aggaguguguauuaaugaaauu

SEQ ID NO: 172052 - RNA, 21 nt, Homo sapiens
aggcaaaugaagcagccgcuc

SEQ ID NO: 172053 - RNA, 22 nt, Homo sapiens
aggcaacaugguaaaacccugu

SEQ ID NO: 172054 - RNA, 21 nt, Homo sapiens
aggcaagacuuuuagguuugu

SEQ ID NO: 172055 - RNA, 22 nt, Homo sapiens
aggcaagagugacuacgugaaa

SEQ ID NO: 172056 - RNA, 22 nt, Homo sapiens
aggcaggugaaagauaguuuua

SEQ ID NO: 172057 - RNA, 22 nt, Homo sapiens
aggcuuuuggagaacacugcac

SEQ ID NO: 172058 - RNA, 22 nt, Homo sapiens
agggcacuguagguccugccuc

SEQ ID NO: 172059 - RNA, 22 nt, Homo sapiens
agggcaguguuaggacugucug

SEQ ID NO: 172060 - RNA, 22 nt, Homo sapiens
agggcuuaucuguguagaguuc

SEQ ID NO: 172061 - RNA, 22 nt, Homo sapiens
agggcuuguuuaacuaucauua

SEQ ID NO: 172062 - RNA, 22 nt, Homo sapiens
agggcuuuugagcugagauggu

SEQ ID NO: 172063 - RNA, 22 nt, Homo sapiens
agguagcauagcgggaauauca

SEQ ID NO: 172064 - RNA, 22 nt, Homo sapiens
agguauuuuuuauccuccagca

SEQ ID NO: 172065 - RNA, 21 nt, Homo sapiens
aggucaguaagaaugcagcac

SEQ ID NO: 172066 - RNA, 22 nt, Homo sapiens
aggugaauggauaaacuguggg

SEQ ID NO: 172067 - RNA, 22 nt, Homo sapiens
aggugcaugcuucacuggauau

SEQ ID NO: 172068 - RNA, 22 nt, Homo sapiens
aggugcuugagggaagaaauua

SEQ ID NO: 172069 - RNA, 20 nt, Homo sapiens
agguucaaaucccaaucaug

SEQ ID NO: 172070 - RNA, 22 nt, Homo sapiens
aguaaagccagaccuguuaauu

SEQ ID NO: 172071 - RNA, 22 nt, Homo sapiens
aguaccauuccguuggagcugg

SEQ ID NO: 172072 - RNA, 22 nt, Homo sapiens
aguacugucugguuaccugaca

SEQ ID NO: 172073 - RNA, 22 nt, Homo sapiens
aguagcaauggcucugagcuau

SEQ ID NO: 172074 - RNA, 16 nt, Homo sapiens
aguaguuuuacagauu

SEQ ID NO: 172075 - RNA, 22 nt, Homo sapiens
aguaucaagccacacaugguca

SEQ ID NO: 172076 - RNA, 20 nt, Homo sapiens
aguauucacuuuuuucaugg

SEQ ID NO: 172077 - RNA, 22 nt, Homo sapiens
aguauuuguuggaauaccuguu

SEQ ID NO: 172078 - RNA, 22 nt, Homo sapiens
agucaaaugcuuauguauaaag

SEQ ID NO: 172079 - RNA, 22 nt, Homo sapiens
agucagugcauaagaaugaagu

SEQ ID NO: 172080 - RNA, 22 nt, Homo sapiens
agucauuguugagaugguguca

SEQ ID NO: 172081 - RNA, 22 nt, Homo sapiens
agugaacaaagaagugcagaua

SEQ ID NO: 172082 - RNA, 22 nt, Homo sapiens
agugagcuguuuuuacuuucug

SEQ ID NO: 172083 - RNA, 21 nt, Homo sapiens
agugagucauuuggaaagcaa

SEQ ID NO: 172084 - RNA, 22 nt, Homo sapiens
agugaucauuugaauugaugau

SEQ ID NO: 172085 - RNA, 22 nt, Homo sapiens
agugcaauaaggauguagaacu

SEQ ID NO: 172086 - RNA, 22 nt, Homo sapiens
agugcaauggugccaucauagc

SEQ ID NO: 172087 - RNA, 22 nt, Homo sapiens
agugcacugcccgcuuccuguc

SEQ ID NO: 172088 - RNA, 22 nt, Homo sapiens
agugcaguggcauggucauaac

SEQ ID NO: 172089 - RNA, 22 nt, Homo sapiens
agugcagugguuaggagccagg

SEQ ID NO: 172090 - RNA, 22 nt, Homo sapiens
agugcauaugucuuuuuggaag

SEQ ID NO: 172091 - RNA, 22 nt, Homo sapiens
agugccauggcugcuagauggc

SEQ ID NO: 172092 - RNA, 22 nt, Homo sapiens
aguggcaaugugauguccugaa

SEQ ID NO: 172093 - RNA, 22 nt, Homo sapiens
aguggcacaauuuugacucccc

SEQ ID NO: 172094 - RNA, 22 nt, Homo sapiens
aguggcuuuuuaguggcagaug

SEQ ID NO: 172095 - RNA, 22 nt, Homo sapiens
aguggguguuccauuggauaaa

SEQ ID NO: 172096 - RNA, 19 nt, Homo sapiens
aguggguguuuucuguuug

SEQ ID NO: 172097 - RNA, 22 nt, Homo sapiens
agugguaguacaggagauaccg

SEQ ID NO: 172098 - RNA, 22 nt, Homo sapiens
agugguuugaucacagcucacu

SEQ ID NO: 172099 - RNA, 20 nt, Homo sapiens
agugguuuucaaauaugucu

SEQ ID NO: 172100 - RNA, 22 nt, Homo sapiens
aguguuuuuaacaagaaagggu

SEQ ID NO: 172101 - RNA, 22 nt, Homo sapiens
aguguuuuuaucaugaaagggu

SEQ ID NO: 172102 - RNA, 22 nt, Homo sapiens
aguuaguguugugauaaaucca

SEQ ID NO: 172103 - RNA, 22 nt, Homo sapiens
aguucaauggguuuucacucau

SEQ ID NO: 172104 - RNA, 22 nt, Homo sapiens
aguuuuugcugauagcaugcuu

SEQ ID NO: 172105 - RNA, 19 nt, Homo sapiens
auaaaugccuacaagggug

SEQ ID NO: 172106 - RNA, 22 nt, Homo sapiens
auaagaguaguacauaugagac

SEQ ID NO: 172107 - RNA, 22 nt, Homo sapiens
auaagaugaaggaagccauauc

SEQ ID NO: 172108 - RNA, 22 nt, Homo sapiens
auaaggcagcugcuaaaaggca

SEQ ID NO: 172109 - RNA, 22 nt, Homo sapiens
auaaggcuaguguaggagccag

SEQ ID NO: 172110 - RNA, 22 nt, Homo sapiens
auaaguagaaugauggucaaaa

SEQ ID NO: 172111 - RNA, 22 nt, Homo sapiens
auaauagcugaucauuuagaag

SEQ ID NO: 172112 - RNA, 22 nt, Homo sapiens
auaaugcuggaacuagagggca

SEQ ID NO: 172113 - RNA, 22 nt, Homo sapiens
auaauugcuaagugaagauggu

SEQ ID NO: 172114 - RNA, 18 nt, Homo sapiens
auacaagcagcagagauu

SEQ ID NO: 172115 - RNA, 22 nt, Homo sapiens
auacaagugccauguuggugug

SEQ ID NO: 172116 - RNA, 22 nt, Homo sapiens
auacacauuccugggccucacc

SEQ ID NO: 172117 - RNA, 22 nt, Homo sapiens
auacaguauggagggcccagcu

SEQ ID NO: 172118 - RNA, 22 nt, Homo sapiens
auacagugaauaucuggggcag

SEQ ID NO: 172119 - RNA, 22 nt, Homo sapiens
auacaugugucauguugguuug

SEQ ID NO: 172120 - RNA, 22 nt, Homo sapiens
auacuguacugaaguacccauu

SEQ ID NO: 172121 - RNA, 21 nt, Homo sapiens
auacuugagacuggguaauuu

SEQ ID NO: 172122 - RNA, 22 nt, Homo sapiens
auagcaauuugggaaucagacu

SEQ ID NO: 172123 - RNA, 22 nt, Homo sapiens
auagcccuuuucuaacuaugug

SEQ ID NO: 172124 - RNA, 22 nt, Homo sapiens
auagcugcucaggcuuuccuca

SEQ ID NO: 172125 - RNA, 22 nt, Homo sapiens
auaggagcacgaacucuagugu

SEQ ID NO: 172126 - RNA, 22 nt, Homo sapiens
auagguagcauagcaggaauau

SEQ ID NO: 172127 - RNA, 22 nt, Homo sapiens
auagguauuuuuaaaugacugu

SEQ ID NO: 172128 - RNA, 22 nt, Homo sapiens
auagguuuucacuguagauucu

SEQ ID NO: 172129 - RNA, 22 nt, Homo sapiens
auagugcuauggcagaccuuga

SEQ ID NO: 172130 - RNA, 22 nt, Homo sapiens
auagugcugcaauaaacauaca

SEQ ID NO: 172131 - RNA, 22 nt, Homo sapiens
auagugcugcaauuaacauaca

SEQ ID NO: 172132 - RNA, 22 nt, Homo sapiens
auauaugcuaagugcuaauaaa

SEQ ID NO: 172133 - RNA, 22 nt, Homo sapiens
auaucaagugacuggaguucca

SEQ ID NO: 172134 - RNA, 20 nt, Homo sapiens
auaugcagacacauacauac

SEQ ID NO: 172135 - RNA, 22 nt, Homo sapiens
auaugcauacauguaugcagga

SEQ ID NO: 172136 - RNA, 22 nt, Homo sapiens
auauggguuuuauauuaggcuc

SEQ ID NO: 172137 - RNA, 22 nt, Homo sapiens
auauguauuuuaacguguaagg

SEQ ID NO: 172138 - RNA, 22 nt, Homo sapiens
auaugucuguuuagucuguaau

SEQ ID NO: 172139 - RNA, 22 nt, Homo sapiens
auauuagguuggugccaaagua

SEQ ID NO: 172140 - RNA, 22 nt, Homo sapiens
auauucacagguaucagagauu

SEQ ID NO: 172141 - RNA, 19 nt, Homo sapiens
aucaaacugcucuuugagg

SEQ ID NO: 172142 - RNA, 22 nt, Homo sapiens
aucaaagcagcauggcccaguc

SEQ ID NO: 172143 - RNA, 22 nt, Homo sapiens
aucaaagugaauuaaugagaau

SEQ ID NO: 172144 - RNA, 22 nt, Homo sapiens
aucaaaucuccagaaccugucu

SEQ ID NO: 172145 - RNA, 22 nt, Homo sapiens
aucaagcuacacccuuuggaaa

SEQ ID NO: 172146 - RNA, 22 nt, Homo sapiens
aucaagcugcuuguuugaaucu

SEQ ID NO: 172147 - RNA, 22 nt, Homo sapiens
aucacagaacuuugagcagaga

SEQ ID NO: 172148 - RNA, 22 nt, Homo sapiens
aucacagagucacgggcaacuu

SEQ ID NO: 172149 - RNA, 22 nt, Homo sapiens
aucacaguggucagguauagau

SEQ ID NO: 172150 - RNA, 22 nt, Homo sapiens
aucacauuuauaguggcacgca

SEQ ID NO: 172151 - RNA, 22 nt, Homo sapiens
aucaccagaugcuucaagcaga

SEQ ID NO: 172152 - RNA, 22 nt, Homo sapiens
aucaccugagcaguauacacug

SEQ ID NO: 172153 - RNA, 22 nt, Homo sapiens
aucaccuggaggugaucacuug

SEQ ID NO: 172154 - RNA, 22 nt, Homo sapiens
aucaccuuucccuuucugaauc

SEQ ID NO: 172155 - RNA, 22 nt, Homo sapiens
aucacuagaucauagguaaaca

SEQ ID NO: 172156 - RNA, 20 nt, Homo sapiens
aucacuggagaaggaaaccu

SEQ ID NO: 172157 - RNA, 22 nt, Homo sapiens
aucacugggauggaacugcuga

SEQ ID NO: 172158 - RNA, 22 nt, Homo sapiens
aucacuguaaguuuacacuuug

SEQ ID NO: 172159 - RNA, 22 nt, Homo sapiens
aucacugugauuucuacugugc

SEQ ID NO: 172160 - RNA, 16 nt, Homo sapiens
aucacuugcuucuuuu

SEQ ID NO: 172161 - RNA, 22 nt, Homo sapiens
aucagagccugugugcccugaa

SEQ ID NO: 172162 - RNA, 22 nt, Homo sapiens
auuuguccugccuuuuccuccu

SEQ ID NO: 172163 - RNA, 21 nt, Homo sapiens
auuuuugcagagcugguagug

SEQ ID NO: 172164 - RNA, 22 nt, Homo sapiens
auuuuugguugguaggcuauua

SEQ ID NO: 172165 - RNA, 22 nt, Homo sapiens
caaaagugauugcgguuuuugc

SEQ ID NO: 172166 - RNA, 22 nt, Homo sapiens
caaaagugguucuuauccuuuu

SEQ ID NO: 172167 - RNA, 22 nt, Homo sapiens
caaagcacuuggcuuggaagau

SEQ ID NO: 172168 - RNA, 22 nt, Homo sapiens
caaaggcuuccacugcauccuu

SEQ ID NO: 172169 - RNA, 22 nt, Homo sapiens
caaaggcuucugaaacugcaga

SEQ ID NO: 172170 - RNA, 22 nt, Homo sapiens
caaagucuucaguugauucuga

SEQ ID NO: 172171 - RNA, 22 nt, Homo sapiens
caaagugcugaaagaggccagg

SEQ ID NO: 172172 - RNA, 22 nt, Homo sapiens
caaagugcuggaauuggccggg

SEQ ID NO: 172173 - RNA, 22 nt, Homo sapiens
caaagugcuggccgggcgcagu

SEQ ID NO: 172174 - RNA, 22 nt, Homo sapiens
caacacagugaaacccgucucu

SEQ ID NO: 172175 - RNA, 22 nt, Homo sapiens
caacagucagcccauccacaga

SEQ ID NO: 172176 - RNA, 22 nt, Homo sapiens
caaccaguagcugaguucaaaa

SEQ ID NO: 172177 - RNA, 19 nt, Homo sapiens
caacccugcagagaaagga

SEQ ID NO: 172178 - RNA, 22 nt, Homo sapiens
caacucuguaggauccaggugg

SEQ ID NO: 172179 - RNA, 22 nt, Homo sapiens
caacugcucacuccuggguuca

SEQ ID NO: 172180 - RNA, 22 nt, Homo sapiens
caacugguuuuauacaguuuag

SEQ ID NO: 172181 - RNA, 22 nt, Homo sapiens
caagaggcuguguauaaagcca

SEQ ID NO: 172182 - RNA, 22 nt, Homo sapiens
caaggaauucucaauagaguua

SEQ ID NO: 172183 - RNA, 22 nt, Homo sapiens
caagguacuuuuacaauuuccc

SEQ ID NO: 172184 - RNA, 21 nt, Homo sapiens
caagugaugcuucugcuuuaa

SEQ ID NO: 172185 - RNA, 22 nt, Homo sapiens
caauggcaaugaaauagugaga

SEQ ID NO: 172186 - RNA, 21 nt, Homo sapiens
caauggcacaaucucugcuca

SEQ ID NO: 172187 - RNA, 21 nt, Homo sapiens
caauggcacgaucuuggcuca

SEQ ID NO: 172188 - RNA, 22 nt, Homo sapiens
caauggcacuauuggaaaaggu

SEQ ID NO: 172189 - RNA, 22 nt, Homo sapiens
cacaccuaccucauuauggaca

SEQ ID NO: 172190 - RNA, 22 nt, Homo sapiens
cacacugucuuucagaaugguu

SEQ ID NO: 172191 - RNA, 22 nt, Homo sapiens
cacacuguuuuccauggggguu

SEQ ID NO: 172192 - RNA, 22 nt, Homo sapiens
cacagcacaggcaugaguguca

SEQ ID NO: 172193 - RNA, 22 nt, Homo sapiens
cacagcgacuuccgccuaccgg

SEQ ID NO: 172194 - RNA, 22 nt, Homo sapiens
cacagcuaacaacuguuucuuc

SEQ ID NO: 172195 - RNA, 22 nt, Homo sapiens
cacagcuagucaaugguagaca

SEQ ID NO: 172196 - RNA, 22 nt, Homo sapiens
cacagucugggcuuguuuguac

SEQ ID NO: 172197 - RNA, 22 nt, Homo sapiens
cacagugaacaauauccucugu

SEQ ID NO: 172198 - RNA, 22 nt, Homo sapiens
cacaguguucauagccaucagg

SEQ ID NO: 172199 - RNA, 22 nt, Homo sapiens
cacaguguuccagcuauuugaa

SEQ ID NO: 172200 - RNA, 22 nt, Homo sapiens
cacaguugccuaucuccugaag

SEQ ID NO: 172201 - RNA, 22 nt, Homo sapiens
cacauagcuagucaguagugaa

SEQ ID NO: 172202 - RNA, 21 nt, Homo sapiens
cacauggaggcagagagugua

SEQ ID NO: 172203 - RNA, 22 nt, Homo sapiens
cacauguucaggagcacuuaga

SEQ ID NO: 172204 - RNA, 22 nt, Homo sapiens
cacauguuugcuacauuuuucu

SEQ ID NO: 172205 - RNA, 22 nt, Homo sapiens
cacauguuuuagcauggcuguu

SEQ ID NO: 172206 - RNA, 22 nt, Homo sapiens
cacauugcaggaaaguucauua

SEQ ID NO: 172207 - RNA, 22 nt, Homo sapiens
caccacagccauuauugucccc

SEQ ID NO: 172208 - RNA, 22 nt, Homo sapiens
caccagcuggcauugaauaccu

SEQ ID NO: 172209 - RNA, 23 nt, Homo sapiens
caccaguauaauuagcuuuuaaa

SEQ ID NO: 172210 - RNA, 22 nt, Homo sapiens
caccugagcgggaugcucgccu

SEQ ID NO: 172211 - RNA, 22 nt, Homo sapiens
cacugaaugugagguuggggag

SEQ ID NO: 172212 - RNA, 18 nt, Homo sapiens
cacugagcccuucacucu

SEQ ID NO: 172213 - RNA, 22 nt, Homo sapiens
cacugcaauuacuuuugcacca

SEQ ID NO: 172214 - RNA, 22 nt, Homo sapiens
cacugcacuccagucccgucuc

SEQ ID NO: 172215 - RNA, 22 nt, Homo sapiens
cacugcacuccagucuggcgac

SEQ ID NO: 172216 - RNA, 22 nt, Homo sapiens
cacugcacuccaguuucgguaa

SEQ ID NO: 172217 - RNA, 22 nt, Homo sapiens
cacugcacucuucuucugggca

SEQ ID NO: 172218 - RNA, 21 nt, Homo sapiens
cacugcacuugccuucugggu

SEQ ID NO: 172219 - RNA, 22 nt, Homo sapiens
cacugcauccuccaccuccugg

SEQ ID NO: 172220 - RNA, 22 nt, Homo sapiens
cacugcauuggaugguuccucc

SEQ ID NO: 172221 - RNA, 22 nt, Homo sapiens
cacuggcacuguguuuagaugg

SEQ ID NO: 172222 - RNA, 22 nt, Homo sapiens
cacugggccaucacuuaauauu

SEQ ID NO: 172223 - RNA, 21 nt, Homo sapiens
cacuggguucaggcuugugga

SEQ ID NO: 172224 - RNA, 21 nt, Homo sapiens
cacugguguugcuauaucaaa

SEQ ID NO: 172225 - RNA, 18 nt, Homo sapiens
cacuuggcuuugccccuc

SEQ ID NO: 172226 - RNA, 22 nt, Homo sapiens
cagacagugucccgagucccug

SEQ ID NO: 172227 - RNA, 22 nt, Homo sapiens
cagagcaaugcuuuugcuuuga

SEQ ID NO: 172228 - RNA, 22 nt, Homo sapiens
cagagugcauguuuagaugagu

SEQ ID NO: 172229 - RNA, 22 nt, Homo sapiens
cagauacuggccuggagcugug

SEQ ID NO: 172230 - RNA, 20 nt, Homo sapiens
cagcaaccugcucucuuccu

SEQ ID NO: 172231 - RNA, 22 nt, Homo sapiens
cagcaucauucaucugggguaa

SEQ ID NO: 172232 - RNA, 22 nt, Homo sapiens
cagcccuacacagacugacuca

SEQ ID NO: 172233 - RNA, 22 nt, Homo sapiens
cagcucuuguuaaaacuaacua

SEQ ID NO: 172234 - RNA, 22 nt, Homo sapiens
cagcuggugggagcuggguucc

SEQ ID NO: 172235 - RNA, 22 nt, Homo sapiens
cagcuguuguuaugucugcagg

SEQ ID NO: 172236 - RNA, 22 nt, Homo sapiens
cagcuugugguauugcugguug

SEQ ID NO: 172237 - RNA, 22 nt, Homo sapiens
caggaaugugaggguucccugc

SEQ ID NO: 172238 - RNA, 22 nt, Homo sapiens
caggcaaggugaaguguacugg

SEQ ID NO: 172239 - RNA, 22 nt, Homo sapiens
caggcagugggagacaaaacug

SEQ ID NO: 172240 - RNA, 22 nt, Homo sapiens
caggcauuguauuguaaucccc

SEQ ID NO: 172241 - RNA, 22 nt, Homo sapiens
cagguacaugcaugugugugca

SEQ ID NO: 172242 - RNA, 22 nt, Homo sapiens
cagguaguauuugguuacauaa

SEQ ID NO: 172243 - RNA, 22 nt, Homo sapiens
caggugcauuggcugacaccug

SEQ ID NO: 172244 - RNA, 22 nt, Homo sapiens
caguaaauaucugagcgagguc

SEQ ID NO: 172245 - RNA, 19 nt, Homo sapiens
caguaucauugcacauagu

SEQ ID NO: 172246 - RNA, 22 nt, Homo sapiens
cagugaauuucaggucaagagu

SEQ ID NO: 172247 - RNA, 20 nt, Homo sapiens
cagugcaccuggcguguuga

SEQ ID NO: 172248 - RNA, 22 nt, Homo sapiens
cagugcauccauguucagcagu

SEQ ID NO: 172249 - RNA, 22 nt, Homo sapiens
cagugcaugacuguauauuauc

SEQ ID NO: 172250 - RNA, 22 nt, Homo sapiens
cagugguuuucucaguucagca

SEQ ID NO: 172251 - RNA, 22 nt, Homo sapiens
cagugguuuuuagcuugcuggg

SEQ ID NO: 172252 - RNA, 22 nt, Homo sapiens
caguugcacuagccccguuuca

SEQ ID NO: 172253 - RNA, 22 nt, Homo sapiens
cauaaagauggaggaggccagg

SEQ ID NO: 172254 - RNA, 22 nt, Homo sapiens
cauaaaucuuguugaauagcac

SEQ ID NO: 172255 - RNA, 21 nt, Homo sapiens
cauaaugcuacuuauuuuaug

SEQ ID NO: 172256 - RNA, 22 nt, Homo sapiens
cauacaguaggcacuauuugua

SEQ ID NO: 172257 - RNA, 22 nt, Homo sapiens
cauaguacuugcauaguacuau

SEQ ID NO: 172258 - RNA, 22 nt, Homo sapiens
cauauaguaguacuguuagguu

SEQ ID NO: 172259 - RNA, 22 nt, Homo sapiens
caucacacuuggauguaagaca

SEQ ID NO: 172260 - RNA, 22 nt, Homo sapiens
caucacagcaaguagggagugg

SEQ ID NO: 172261 - RNA, 22 nt, Homo sapiens
caucacuuuuccuuuuacagau

SEQ ID NO: 172262 - RNA, 19 nt, Homo sapiens
caucccugagcugaagugg

SEQ ID NO: 172263 - RNA, 22 nt, Homo sapiens
caucgcacuccagccugggcaa

SEQ ID NO: 172264 - RNA, 23 nt, Homo sapiens
caugaacuaguuugcagccauga

SEQ ID NO: 172265 - RNA, 22 nt, Homo sapiens
caugauauugcagaauguuggu

SEQ ID NO: 172266 - RNA, 22 nt, Homo sapiens
caugaugcuagguauggaugaa

SEQ ID NO: 172267 - RNA, 22 nt, Homo sapiens
caugcacugagagggucucggc

SEQ ID NO: 172268 - RNA, 22 nt, Homo sapiens
caugccauugcucuccugggug

SEQ ID NO: 172269 - RNA, 22 nt, Homo sapiens
cauggagcuaggcuugaucccu

SEQ ID NO: 172270 - RNA, 22 nt, Homo sapiens
ucagggacuuacaaaccagaag

SEQ ID NO: 172271 - RNA, 22 nt, Homo sapiens
cauggcacugagcagguaugca

SEQ ID NO: 172272 - RNA, 22 nt, Homo sapiens
caugggacugucuuggcuauac

SEQ ID NO: 172273 - RNA, 22 nt, Homo sapiens
caugggcacugacuugcauucg

SEQ ID NO: 172274 - RNA, 22 nt, Homo sapiens
cauggucaccuuccaaguuauu

SEQ ID NO: 172275 - RNA, 22 nt, Homo sapiens
cauguauagauuccauaguggu

SEQ ID NO: 172276 - RNA, 20 nt, Homo sapiens
cauuacacuccaaccugggu

SEQ ID NO: 172277 - RNA, 22 nt, Homo sapiens
cauuacacuccagccuggguga

SEQ ID NO: 172278 - RNA, 22 nt, Homo sapiens
cauuccacuggauaaacaaggu

SEQ ID NO: 172279 - RNA, 20 nt, Homo sapiens
cauuccacuuuccugucagu

SEQ ID NO: 172280 - RNA, 22 nt, Homo sapiens
cauugcaauccagccugggcaa

SEQ ID NO: 172281 - RNA, 22 nt, Homo sapiens
cauugcacacauuuaccuaugu

SEQ ID NO: 172282 - RNA, 22 nt, Homo sapiens
cauugcacuccacuccugaaca

SEQ ID NO: 172283 - RNA, 22 nt, Homo sapiens
cauugcacuccagcccuggcaa

SEQ ID NO: 172284 - RNA, 22 nt, Homo sapiens
cauugcacuccagccuagccaa

SEQ ID NO: 172285 - RNA, 22 nt, Homo sapiens
cauugcacuccagccucggcaa

SEQ ID NO: 172286 - RNA, 22 nt, Homo sapiens
cauugcacuccagccugaccaa

SEQ ID NO: 172287 - RNA, 22 nt, Homo sapiens
cauugcacuccagccugcacga

SEQ ID NO: 172288 - RNA, 20 nt, Homo sapiens
cauugcacuccagccugcug

SEQ ID NO: 172289 - RNA, 22 nt, Homo sapiens
cauugcacuccagccuuggcaa

SEQ ID NO: 172290 - RNA, 22 nt, Homo sapiens
cauugcacuccagccuugguga

SEQ ID NO: 172291 - RNA, 20 nt, Homo sapiens
cauugcacuccagcuugggc

SEQ ID NO: 172292 - RNA, 22 nt, Homo sapiens
cauugcacuccagcuugggcaa

SEQ ID NO: 172293 - RNA, 22 nt, Homo sapiens
cauugcacuccagcuugggcga

SEQ ID NO: 172294 - RNA, 22 nt, Homo sapiens
cauugcacucuagccucggcaa

SEQ ID NO: 172295 - RNA, 22 nt, Homo sapiens
cauugcacucuagucuggguga

SEQ ID NO: 172296 - RNA, 22 nt, Homo sapiens
cauugcacugcauucugggcaa

SEQ ID NO: 172297 - RNA, 22 nt, Homo sapiens
cauugcaguaagagugggcucu

SEQ ID NO: 172298 - RNA, 22 nt, Homo sapiens
cauugcaguggaguggggaaga

SEQ ID NO: 172299 - RNA, 22 nt, Homo sapiens
cauugcaguuuuugguguaucu

SEQ ID NO: 172300 - RNA, 22 nt, Homo sapiens
cauugcaugcauauggcuuggu

SEQ ID NO: 172301 - RNA, 22 nt, Homo sapiens
cauugcaugccagccugggcaa

SEQ ID NO: 172302 - RNA, 20 nt, Homo sapiens
cauugcccuccagccugggc

SEQ ID NO: 172303 - RNA, 22 nt, Homo sapiens
ccaaauccauccaaaucauaga

SEQ ID NO: 172304 - RNA, 22 nt, Homo sapiens
ccaaaucucauguugaaaugug

SEQ ID NO: 172305 - RNA, 22 nt, Homo sapiens
ccaaggaauacccucccuuuuu

SEQ ID NO: 172306 - RNA, 22 nt, Homo sapiens
ccaagugcuuaaaauuucauuu

SEQ ID NO: 172307 - RNA, 22 nt, Homo sapiens
ccacaaccucaacagcaucuau

SEQ ID NO: 172308 - RNA, 22 nt, Homo sapiens
ccacaaccuccauauccugggu

SEQ ID NO: 172309 - RNA, 23 nt, Homo sapiens
ccacacuguuuagaauggcauca

SEQ ID NO: 172310 - RNA, 22 nt, Homo sapiens
ccacugugguaucugauacugg

SEQ ID NO: 172311 - RNA, 22 nt, Homo sapiens
ccagaguugccucagguuucug

SEQ ID NO: 172312 - RNA, 22 nt, Homo sapiens
ccagauguuuucauucagcaag

SEQ ID NO: 172313 - RNA, 22 nt, Homo sapiens
ccagcaccauuuauuaaauagg

SEQ ID NO: 172314 - RNA, 22 nt, Homo sapiens
ccagccgggugcaguggcucac

SEQ ID NO: 172315 - RNA, 22 nt, Homo sapiens
ccagugauuguauggugaaggu

SEQ ID NO: 172316 - RNA, 21 nt, Homo sapiens
ccagugguuggaaacuauggg

SEQ ID NO: 172317 - RNA, 22 nt, Homo sapiens
ccaguucaaugauauggaaacu

SEQ ID NO: 172318 - RNA, 22 nt, Homo sapiens
ccaguuuucccagcaccauuaa

SEQ ID NO: 172319 - RNA, 22 nt, Homo sapiens
ccaguuuucucacuguugcagu

SEQ ID NO: 172320 - RNA, 22 nt, Homo sapiens
ccauacugucaaauagauuucc

SEQ ID NO: 172321 - RNA, 22 nt, Homo sapiens
ccauggcaauggucagucuauu

SEQ ID NO: 172322 - RNA, 18 nt, Homo sapiens
ccauucaacagauuuguc

SEQ ID NO: 172323 - RNA, 22 nt, Homo sapiens
ccauugaacaugaaggaaugug

SEQ ID NO: 172324 - RNA, 22 nt, Homo sapiens
cccagcguucggcauggcugag

SEQ ID NO: 172325 - RNA, 18 nt, Homo sapiens
cccagugacuuauggccu

SEQ ID NO: 172326 - RNA, 19 nt, Homo sapiens
cccagugucagagaagggu

SEQ ID NO: 172327 - RNA, 22 nt, Homo sapiens
cccagugugaacuuggcauuuu

SEQ ID NO: 172328 - RNA, 22 nt, Homo sapiens
cccaguguguuguggauauuua

SEQ ID NO: 172329 - RNA, 22 nt, Homo sapiens
cccaguguuacgugacagccug

SEQ ID NO: 172330 - RNA, 22 nt, Homo sapiens
cccaguguuuauuuugagccaa

SEQ ID NO: 172331 - RNA, 22 nt, Homo sapiens
ccccagugguugcaacagcaga

SEQ ID NO: 172332 - RNA, 21 nt, Homo sapiens
ccccugauacuuagucaagag

SEQ ID NO: 172333 - RNA, 22 nt, Homo sapiens
cccgggcugaaaucagauuugu

SEQ ID NO: 172334 - RNA, 22 nt, Homo sapiens
cccuagaucucagcgccuucau

SEQ ID NO: 172335 - RNA, 22 nt, Homo sapiens
cccucauucauucauccuaugu

SEQ ID NO: 172336 - RNA, 22 nt, Homo sapiens
cccucgagaaaccaucugcuga

SEQ ID NO: 172337 - RNA, 22 nt, Homo sapiens
cccugaagacuccaccgucaug

SEQ ID NO: 172338 - RNA, 22 nt, Homo sapiens
ccggcuguguggagaggccccu

SEQ ID NO: 172339 - RNA, 22 nt, Homo sapiens
ccuaaguaauggcaguuuuugc

SEQ ID NO: 172340 - RNA, 20 nt, Homo sapiens
ccuaguguucuuaggcugca

SEQ ID NO: 172341 - RNA, 22 nt, Homo sapiens
ccucaguguuuaucauuauuuu

SEQ ID NO: 172342 - RNA, 22 nt, Homo sapiens
ccucccuuuguugcaagggaaa

SEQ ID NO: 172343 - RNA, 22 nt, Homo sapiens
ccugagacgaauggagugaaca

SEQ ID NO: 172344 - RNA, 22 nt, Homo sapiens
ccugagacuugagggggcuucu

SEQ ID NO: 172345 - RNA, 22 nt, Homo sapiens
ccugcauugucaaggccaagcc

SEQ ID NO: 172346 - RNA, 19 nt, Homo sapiens
ccugcuguucuuuugcacc

SEQ ID NO: 172347 - RNA, 22 nt, Homo sapiens
ccuggcaagagacugaagauag

SEQ ID NO: 172348 - RNA, 22 nt, Homo sapiens
ccuggguuacaggugugagcca

SEQ ID NO: 172349 - RNA, 22 nt, Homo sapiens
ccuguagcauccaagaagcugc

SEQ ID NO: 172350 - RNA, 22 nt, Homo sapiens
ccuucacaggcacugguucaga

SEQ ID NO: 172351 - RNA, 22 nt, Homo sapiens
ccuugcacuucccaagugaggc

SEQ ID NO: 172352 - RNA, 22 nt, Homo sapiens
ccuugcacuucccaggugaggc

SEQ ID NO: 172353 - RNA, 22 nt, Homo sapiens
ccuuggcaauggcuggggcuga

SEQ ID NO: 172354 - RNA, 22 nt, Homo sapiens
cgaggaguaucuuugugguguu

SEQ ID NO: 172355 - RNA, 22 nt, Homo sapiens
cgccugagcugaggaagcugca

SEQ ID NO: 172356 - RNA, 22 nt, Homo sapiens
cggaaugaaaauguccuucagu

SEQ ID NO: 172357 - RNA, 22 nt, Homo sapiens
cgugaauguuuuggucuuucac

SEQ ID NO: 172358 - RNA, 20 nt, Homo sapiens
cguugcacuccagccugggc

SEQ ID NO: 172359 - RNA, 22 nt, Homo sapiens
cuaaaacuuucugagugcagca

SEQ ID NO: 172360 - RNA, 22 nt, Homo sapiens
cuaaagugcugagauuauaggu

SEQ ID NO: 172361 - RNA, 22 nt, Homo sapiens
cuaaaugcacugucaaaggaag

SEQ ID NO: 172362 - RNA, 22 nt, Homo sapiens
cuaacacagggcaagucaggcu

SEQ ID NO: 172363 - RNA, 19 nt, Homo sapiens
cuaaguccccuugauuaga

SEQ ID NO: 172364 - RNA, 22 nt, Homo sapiens
cuaaucuagccuuauaaguauu

SEQ ID NO: 172365 - RNA, 22 nt, Homo sapiens
cuaaucugugcauagaagaggc

SEQ ID NO: 172366 - RNA, 22 nt, Homo sapiens
cuaauucuggccaaagggauaa

SEQ ID NO: 172367 - RNA, 22 nt, Homo sapiens
cuacaguguauuuauggagggu

SEQ ID NO: 172368 - RNA, 22 nt, Homo sapiens
cuacauuguagguauucaaacu

SEQ ID NO: 172369 - RNA, 21 nt, Homo sapiens
cuacccuguauuagagaaaga

SEQ ID NO: 172370 - RNA, 22 nt, Homo sapiens
cuacucuggagagugacaauca

SEQ ID NO: 172371 - RNA, 22 nt, Homo sapiens
cuagaguagaguuuccuuagga

SEQ ID NO: 172372 - RNA, 22 nt, Homo sapiens
cuagcacauuuaucuuuauaca

SEQ ID NO: 172373 - RNA, 22 nt, Homo sapiens
cuagcagaacaauacaauucgg

SEQ ID NO: 172374 - RNA, 22 nt, Homo sapiens
cuagccuggagugcaguggugc

SEQ ID NO: 172375 - RNA, 22 nt, Homo sapiens
cuagucacauuuucaucaaaua

SEQ ID NO: 172376 - RNA, 22 nt, Homo sapiens
cuauaacagugugguuuggaga

SEQ ID NO: 172377 - RNA, 22 nt, Homo sapiens
cuauaugucuguuuugguacca

SEQ ID NO: 172378 - RNA, 22 nt, Homo sapiens
cuaugcuucuuaaauuaguuau

SEQ ID NO: 172379 - RNA, 22 nt, Homo sapiens
cuaugcuuucugggcccugggu

SEQ ID NO: 172380 - RNA, 22 nt, Homo sapiens
caucacaguacuaaucgucaua

SEQ ID NO: 172381 - RNA, 22 nt, Homo sapiens
caucacuguugguacaaguaau

SEQ ID NO: 172382 - RNA, 22 nt, Homo sapiens
caucacuuugccuccgucucua

SEQ ID NO: 172383 - RNA, 22 nt, Homo sapiens
caucagcaauguaugaggguuc

SEQ ID NO: 172384 - RNA, 22 nt, Homo sapiens
caucauugcacccuauagagaa

SEQ ID NO: 172385 - RNA, 21 nt, Homo sapiens
cauccccugccauuguggucu

SEQ ID NO: 172386 - RNA, 22 nt, Homo sapiens
caucgcacuccagcuugggcaa

SEQ ID NO: 172387 - RNA, 22 nt, Homo sapiens
caucucauugaauugcugagca

SEQ ID NO: 172388 - RNA, 22 nt, Homo sapiens
caugacacauguuuaccuaugu

SEQ ID NO: 172389 - RNA, 22 nt, Homo sapiens
caugcacugaguccaccucugg

SEQ ID NO: 172390 - RNA, 22 nt, Homo sapiens
caugcauuggucuauuauguga

SEQ ID NO: 172391 - RNA, 22 nt, Homo sapiens
caugccacugcacgccauccug

SEQ ID NO: 172392 - RNA, 22 nt, Homo sapiens
cauggcacuguaugaaaugugc

SEQ ID NO: 172393 - RNA, 22 nt, Homo sapiens
uugagcucuuccagccuggagc

SEQ ID NO: 172394 - RNA, 22 nt, Homo sapiens
uugagcuuuuuacuuguccaau

SEQ ID NO: 172395 - RNA, 22 nt, Homo sapiens
uugaggaaugucauuuguguuu

SEQ ID NO: 172396 - RNA, 22 nt, Homo sapiens
uugaggacugguugaaagcuuu

SEQ ID NO: 172397 - RNA, 22 nt, Homo sapiens
uugaggaggcagucugcccauu

SEQ ID NO: 172398 - RNA, 22 nt, Homo sapiens
uugaggaucauuguuuucggag

SEQ ID NO: 172399 - RNA, 22 nt, Homo sapiens
uugagggaaacauucacaucau

SEQ ID NO: 172400 - RNA, 21 nt, Homo sapiens
uugagguaaaauccuauggga

SEQ ID NO: 172401 - RNA, 22 nt, Homo sapiens
uugagguaauaaacagccauuc

SEQ ID NO: 172402 - RNA, 22 nt, Homo sapiens
uugagguauaaagguagguugu

SEQ ID NO: 172403 - RNA, 20 nt, Homo sapiens
uugaggucaggaguuuggga

SEQ ID NO: 172404 - RNA, 22 nt, Homo sapiens
uugaggucuucaggaucaggcu

SEQ ID NO: 172405 - RNA, 22 nt, Homo sapiens
uugaggucuuugagcaaacgca

SEQ ID NO: 172406 - RNA, 22 nt, Homo sapiens
uugaguaguaaggauauuaucu

SEQ ID NO: 172407 - RNA, 22 nt, Homo sapiens
uugaguccauucgaugcugauu

SEQ ID NO: 172408 - RNA, 21 nt, Homo sapiens
uugaguugaagcaaggaggga

SEQ ID NO: 172409 - RNA, 22 nt, Homo sapiens
uugauagacaucugaguuguug

SEQ ID NO: 172410 - RNA, 22 nt, Homo sapiens
uugauguguuuccaggauuugu

SEQ ID NO: 172411 - RNA, 22 nt, Homo sapiens
uugauuagauccaguugauuga

SEQ ID NO: 172412 - RNA, 18 nt, Homo sapiens
uugcaaauucuucccugu

SEQ ID NO: 172413 - RNA, 22 nt, Homo sapiens
uugcaacuuagaaaaaucauuu

SEQ ID NO: 172414 - RNA, 22 nt, Homo sapiens
uugcaagaaaugcagauucuca

SEQ ID NO: 172415 - RNA, 22 nt, Homo sapiens
uugcaaugugaugugauuugga

SEQ ID NO: 172416 - RNA, 22 nt, Homo sapiens
uugcacagugcuuucuuugccc

SEQ ID NO: 172417 - RNA, 22 nt, Homo sapiens
uugcacagugguuuagagccug

SEQ ID NO: 172418 - RNA, 22 nt, Homo sapiens
uugcacaguguguacagcacca

SEQ ID NO: 172419 - RNA, 22 nt, Homo sapiens
uugcacauggcaggugcucaau

SEQ ID NO: 172420 - RNA, 22 nt, Homo sapiens
uugcaccuugaagccaauagca

SEQ ID NO: 172421 - RNA, 22 nt, Homo sapiens
uugcacuauuaguauagauguc

SEQ ID NO: 172422 - RNA, 22 nt, Homo sapiens
uugcacuccagccugggugaca

SEQ ID NO: 172423 - RNA, 22 nt, Homo sapiens
uugcacuccagccuuggggaga

SEQ ID NO: 172424 - RNA, 22 nt, Homo sapiens
uugcacuugcugaggagugauu

SEQ ID NO: 172425 - RNA, 22 nt, Homo sapiens
uugcagagaaauuucugguuua

SEQ ID NO: 172426 - RNA, 22 nt, Homo sapiens
uugcagcaaauaggaaugagga

SEQ ID NO: 172427 - RNA, 22 nt, Homo sapiens
uugcagcauucugguuccuggu

SEQ ID NO: 172428 - RNA, 22 nt, Homo sapiens
uugcaggcaugagccaccgugc

SEQ ID NO: 172429 - RNA, 23 nt, Homo sapiens
uugcauagacauccucauagauu

SEQ ID NO: 172430 - RNA, 22 nt, Homo sapiens
uugcauagaccgaugucuugga

SEQ ID NO: 172431 - RNA, 22 nt, Homo sapiens
uugcauagaggugaguauagua

SEQ ID NO: 172432 - RNA, 18 nt, Homo sapiens
uugcauaguguauccaaa

SEQ ID NO: 172433 - RNA, 19 nt, Homo sapiens
uugcauauguugaaccagc

SEQ ID NO: 172434 - RNA, 22 nt, Homo sapiens
uugcaucagcuccugauguacu

SEQ ID NO: 172435 - RNA, 22 nt, Homo sapiens
uugcaugcuccuuaugagaauc

SEQ ID NO: 172436 - RNA, 22 nt, Homo sapiens
uugcaugggagcugggugaagc

SEQ ID NO: 172437 - RNA, 22 nt, Homo sapiens
uugcaugggagcugggugaggc

SEQ ID NO: 172438 - RNA, 22 nt, Homo sapiens
uugccaacauggugaacuccca

SEQ ID NO: 172439 - RNA, 22 nt, Homo sapiens
uugccauggaguagaauugaag

SEQ ID NO: 172440 - RNA, 22 nt, Homo sapiens
uugccuaggcuggauugcagug

SEQ ID NO: 172441 - RNA, 22 nt, Homo sapiens
uugccuauucacucugaugaua

SEQ ID NO: 172442 - RNA, 22 nt, Homo sapiens
uugccugagaagccaagaauaa

SEQ ID NO: 172443 - RNA, 22 nt, Homo sapiens
uugcuagagaugagggaugugu

SEQ ID NO: 172444 - RNA, 22 nt, Homo sapiens
uugcuaguguuugguugauggu

SEQ ID NO: 172445 - RNA, 22 nt, Homo sapiens
uugcucaggcuagaguucagcu

SEQ ID NO: 172446 - RNA, 22 nt, Homo sapiens
uugcugagucuuucuagguugc

SEQ ID NO: 172447 - RNA, 22 nt, Homo sapiens
uugcuggugguucgagcaacac

SEQ ID NO: 172448 - RNA, 22 nt, Homo sapiens
uugcugguuuucauaugagcag

SEQ ID NO: 172449 - RNA, 22 nt, Homo sapiens
uugcuuagucaugaaucacuga

SEQ ID NO: 172450 - RNA, 22 nt, Homo sapiens
uugcuucauucaacauugaggg

SEQ ID NO: 172451 - RNA, 22 nt, Homo sapiens
uugcuucuuucgucuggcccca

SEQ ID NO: 172452 - RNA, 22 nt, Homo sapiens
uugcuuuguuacugcaguuucc

SEQ ID NO: 172453 - RNA, 22 nt, Homo sapiens
uuggaaacaccuggugagguua

SEQ ID NO: 172454 - RNA, 22 nt, Homo sapiens
uuggaaagagguguuuaugacu

SEQ ID NO: 172455 - RNA, 22 nt, Homo sapiens
uuggaaaugguaaaggguuaau

SEQ ID NO: 172456 - RNA, 22 nt, Homo sapiens
uuggaaauguguuugcauucag

SEQ ID NO: 172457 - RNA, 22 nt, Homo sapiens
uuggaacacauguuuuucuacc

SEQ ID NO: 172458 - RNA, 22 nt, Homo sapiens
uuggaacuguucguauugaaau

SEQ ID NO: 172459 - RNA, 22 nt, Homo sapiens
uuggaagacaaugcugauucuc

SEQ ID NO: 172460 - RNA, 22 nt, Homo sapiens
uuggaagauuacuuaguuuucu

SEQ ID NO: 172461 - RNA, 22 nt, Homo sapiens
uuggaagguaaucaaaaguucu

SEQ ID NO: 172462 - RNA, 22 nt, Homo sapiens
uuggaaguguguauguauagcu

SEQ ID NO: 172463 - RNA, 22 nt, Homo sapiens
uuggaauguacucuagccuaug

SEQ ID NO: 172464 - RNA, 22 nt, Homo sapiens
uuggacuacagauuacuucauc

SEQ ID NO: 172465 - RNA, 22 nt, Homo sapiens
uuggacuuuaagauagagaugu

SEQ ID NO: 172466 - RNA, 22 nt, Homo sapiens
uuggacuuuuauucugcaggca

SEQ ID NO: 172467 - RNA, 22 nt, Homo sapiens
uuggagcccuaacucucaguac

SEQ ID NO: 172468 - RNA, 22 nt, Homo sapiens
uuggagucaucucuguacugua

SEQ ID NO: 172469 - RNA, 22 nt, Homo sapiens
uuggagugugcucauaacugcu

SEQ ID NO: 172470 - RNA, 22 nt, Homo sapiens
uuggauuauaaacugagauuug

SEQ ID NO: 172471 - RNA, 22 nt, Homo sapiens
uuggauugugaaaguauucucu

SEQ ID NO: 172472 - RNA, 22 nt, Homo sapiens
uuggcaaagaggaaugccacuu

SEQ ID NO: 172473 - RNA, 22 nt, Homo sapiens
uuggcaaagugucuggcauuua

SEQ ID NO: 172474 - RNA, 22 nt, Homo sapiens
uuggcacugagcaagaacaggg

SEQ ID NO: 172475 - RNA, 22 nt, Homo sapiens
uuggcagaauguuagaaacuua

SEQ ID NO: 172476 - RNA, 22 nt, Homo sapiens
uuggcaguaucuacuacagcua

SEQ ID NO: 172477 - RNA, 22 nt, Homo sapiens
uuggcauugccaaacugucaac

SEQ ID NO: 172478 - RNA, 22 nt, Homo sapiens
uuggccccucccaaauuucaug

SEQ ID NO: 172479 - RNA, 19 nt, Homo sapiens
uuggcccugguucucuucu

SEQ ID NO: 172480 - RNA, 23 nt, Homo sapiens
uuggccuccuugugucuagggcu

SEQ ID NO: 172481 - RNA, 22 nt, Homo sapiens
uuggcgacugcugcuaaucagg

SEQ ID NO: 172482 - RNA, 22 nt, Homo sapiens
uuggcucugcgucucgcggacg

SEQ ID NO: 172483 - RNA, 22 nt, Homo sapiens
uuggcuguguuuauaugcugga

SEQ ID NO: 172484 - RNA, 22 nt, Homo sapiens
uuggcuucuggacuauugugca

SEQ ID NO: 172485 - RNA, 22 nt, Homo sapiens
uuggcuuguaaaaugaaaagcu

SEQ ID NO: 172486 - RNA, 22 nt, Homo sapiens
uugggaaugcuaaaccucuauu

SEQ ID NO: 172487 - RNA, 22 nt, Homo sapiens
uugggacccuguccuguaacaa

SEQ ID NO: 172488 - RNA, 22 nt, Homo sapiens
uugggguaggaauauggaauga

SEQ ID NO: 172489 - RNA, 22 nt, Homo sapiens
gagccggugugauggggcuucu

SEQ ID NO: 172490 - RNA, 22 nt, Homo sapiens
gagcgcauugauguuggaugcu

SEQ ID NO: 172491 - RNA, 22 nt, Homo sapiens
gagcuagguuuugaauccagac

SEQ ID NO: 172492 - RNA, 22 nt, Homo sapiens
gagcugaucuuuauguaaauuc

SEQ ID NO: 172493 - RNA, 22 nt, Homo sapiens
gagcuguuuuucacuagaccaa

SEQ ID NO: 172494 - RNA, 22 nt, Homo sapiens
gagcuuggguuaaaguugccuu

SEQ ID NO: 172495 - RNA, 22 nt, Homo sapiens
gagcuuguggucuucguguuau

SEQ ID NO: 172496 - RNA, 22 nt, Homo sapiens
gaggaaguagcuacugucuuuc

SEQ ID NO: 172497 - RNA, 22 nt, Homo sapiens
auggaagaauugucggggaugu

SEQ ID NO: 172498 - RNA, 22 nt, Homo sapiens
auggaaggagaggaaugaauga

SEQ ID NO: 172499 - RNA, 22 nt, Homo sapiens
auggaauggcacuuugaagauu

SEQ ID NO: 172500 - RNA, 22 nt, Homo sapiens
auggaauguaaguuauguuugc

SEQ ID NO: 172501 - RNA, 22 nt, Homo sapiens
auggaauguauagucauguagg

SEQ ID NO: 172502 - RNA, 22 nt, Homo sapiens
auggagaugaacuuggguaaag

SEQ ID NO: 172503 - RNA, 22 nt, Homo sapiens
auggagaugugcgaacugagua

SEQ ID NO: 172504 - RNA, 22 nt, Homo sapiens
auggagcaaaacagauuuggga

SEQ ID NO: 172505 - RNA, 22 nt, Homo sapiens
auggagugagaauggagguucc

SEQ ID NO: 172506 - RNA, 22 nt, Homo sapiens
auggauagucucacucacauac

SEQ ID NO: 172507 - RNA, 22 nt, Homo sapiens
auggcaaaaaaugcaauuacuu

SEQ ID NO: 172508 - RNA, 22 nt, Homo sapiens
auggcaagaagagcaauuauuu

SEQ ID NO: 172509 - RNA, 22 nt, Homo sapiens
auggcacagacucuuggucaag

SEQ ID NO: 172510 - RNA, 22 nt, Homo sapiens
auggcacuaaguucaacacuua

SEQ ID NO: 172511 - RNA, 22 nt, Homo sapiens
auggcacucaaucaaguugaga

SEQ ID NO: 172512 - RNA, 22 nt, Homo sapiens
auggcacuccagccugggcaac

SEQ ID NO: 172513 - RNA, 22 nt, Homo sapiens
auggcacugaagcguauugaca

SEQ ID NO: 172514 - RNA, 18 nt, Homo sapiens
auggcagaacaauuuaca

SEQ ID NO: 172515 - RNA, 22 nt, Homo sapiens
auggcagugucuagggguguuu

SEQ ID NO: 172516 - RNA, 22 nt, Homo sapiens
auggcaguuuauucuaaaucaa

SEQ ID NO: 172517 - RNA, 22 nt, Homo sapiens
auggcauuuuuagggcugggug

SEQ ID NO: 172518 - RNA, 23 nt, Homo sapiens
auggcccuggugggagugucuuu

SEQ ID NO: 172519 - RNA, 22 nt, Homo sapiens
auggcccuguguggagcugcug

SEQ ID NO: 172520 - RNA, 22 nt, Homo sapiens
auggccuuuacaauuugguaug

SEQ ID NO: 172521 - RNA, 22 nt, Homo sapiens
auggcggugugaucuuggcuca

SEQ ID NO: 172522 - RNA, 22 nt, Homo sapiens
auggcuauuccauaggcagagc

SEQ ID NO: 172523 - RNA, 22 nt, Homo sapiens
auggcucuuauuauuuugaggu

SEQ ID NO: 172524 - RNA, 22 nt, Homo sapiens
auggcugugaaaugguaggugg

SEQ ID NO: 172525 - RNA, 22 nt, Homo sapiens
auggcuguuuaagaguuucauu

SEQ ID NO: 172526 - RNA, 22 nt, Homo sapiens
auggcuguuuuuuauguuacag

SEQ ID NO: 172527 - RNA, 22 nt, Homo sapiens
auggcuuaagacaaccuuucau

SEQ ID NO: 172528 - RNA, 22 nt, Homo sapiens
auggcuuugggcugcucugccc

SEQ ID NO: 172529 - RNA, 22 nt, Homo sapiens
auggcuuuggucucccagugau

SEQ ID NO: 172530 - RNA, 21 nt, Homo sapiens
augggacuaacugaugggucu

SEQ ID NO: 172531 - RNA, 22 nt, Homo sapiens
augggacugggugccguggagc

SEQ ID NO: 172532 - RNA, 22 nt, Homo sapiens
augggagugugguuagagaccu

SEQ ID NO: 172533 - RNA, 22 nt, Homo sapiens
augggcacugauguauucugug

SEQ ID NO: 172534 - RNA, 18 nt, Homo sapiens
auggguguuggaaaauga

SEQ ID NO: 172535 - RNA, 22 nt, Homo sapiens
augguauggaaggucuggagga

SEQ ID NO: 172536 - RNA, 22 nt, Homo sapiens
auggucccuguuccaugcuccu

SEQ ID NO: 172537 - RNA, 20 nt, Homo sapiens
auguaauguaugauauguac

SEQ ID NO: 172538 - RNA, 22 nt, Homo sapiens
auguauggagauauuuuugguu

SEQ ID NO: 172539 - RNA, 22 nt, Homo sapiens
augucaaagaggaaaacuggau

SEQ ID NO: 172540 - RNA, 22 nt, Homo sapiens
augucaaggugaagaaagauca

SEQ ID NO: 172541 - RNA, 22 nt, Homo sapiens
augucuggcagaagacuucuca

SEQ ID NO: 172542 - RNA, 22 nt, Homo sapiens
augugaacugaauuaauucaca

SEQ ID NO: 172543 - RNA, 22 nt, Homo sapiens
augugaugguuaauuuuaugug

SEQ ID NO: 172544 - RNA, 22 nt, Homo sapiens
augugcaaauuuccaaacucuu

SEQ ID NO: 172545 - RNA, 22 nt, Homo sapiens
augugcacauucugguaaauau

SEQ ID NO: 172546 - RNA, 20 nt, Homo sapiens
augugcaguguggcaaccaa

SEQ ID NO: 172547 - RNA, 22 nt, Homo sapiens
augugcaugcuguucugccaga

SEQ ID NO: 172548 - RNA, 22 nt, Homo sapiens
augugcuuaaaaaugcagagaa

SEQ ID NO: 172549 - RNA, 22 nt, Homo sapiens
augugcuuauagguguauguuu

SEQ ID NO: 172550 - RNA, 22 nt, Homo sapiens
augugcuugagggaaaucaguu

SEQ ID NO: 172551 - RNA, 22 nt, Homo sapiens
auguggaaagcagcaugauaug

SEQ ID NO: 172552 - RNA, 22 nt, Homo sapiens
auguggcuuuccuagaucuuag

SEQ ID NO: 172553 - RNA, 22 nt, Homo sapiens
auguggugguagccaggacagg

SEQ ID NO: 172554 - RNA, 23 nt, Homo sapiens
augugugcuuggagagcaggaug

SEQ ID NO: 172555 - RNA, 22 nt, Homo sapiens
augugugcuugugacacagccu

SEQ ID NO: 172556 - RNA, 22 nt, Homo sapiens
auguuagcaucuggcacuaugg

SEQ ID NO: 172557 - RNA, 20 nt, Homo sapiens
auguucuggaggacagaagc

SEQ ID NO: 172558 - RNA, 22 nt, Homo sapiens
auuaaauguuggacguauacau

SEQ ID NO: 172559 - RNA, 22 nt, Homo sapiens
auuaagugaaugaaguuguucc

SEQ ID NO: 172560 - RNA, 21 nt, Homo sapiens
auuaaugcucugguuagaggc

SEQ ID NO: 172561 - RNA, 22 nt, Homo sapiens
auuacauagucaaggugucuca

SEQ ID NO: 172562 - RNA, 22 nt, Homo sapiens
auuacuuugcaccaaccuaaua

SEQ ID NO: 172563 - RNA, 20 nt, Homo sapiens
auuagacuugccuuauccuu

SEQ ID NO: 172564 - RNA, 20 nt, Homo sapiens
auuagagcuacauggcuaca

SEQ ID NO: 172565 - RNA, 22 nt, Homo sapiens
auuagguauuuucuggacaggg

SEQ ID NO: 172566 - RNA, 22 nt, Homo sapiens
auuagugaaugugaugucuuga

SEQ ID NO: 172567 - RNA, 22 nt, Homo sapiens
auuauguuguauuuccuugcag

SEQ ID NO: 172568 - RNA, 22 nt, Homo sapiens
auuauuagucggccagcuguua

SEQ ID NO: 172569 - RNA, 22 nt, Homo sapiens
auuauuaguuguugaaugaagu

SEQ ID NO: 172570 - RNA, 22 nt, Homo sapiens
auucaaggagucuucgucccaa

SEQ ID NO: 172571 - RNA, 22 nt, Homo sapiens
auucaagggauuucaggaggcu

SEQ ID NO: 172572 - RNA, 22 nt, Homo sapiens
auucaagucaucucuccgcauu

SEQ ID NO: 172573 - RNA, 22 nt, Homo sapiens
auucaccauggaccaggggccu

SEQ ID NO: 172574 - RNA, 22 nt, Homo sapiens
auucaccauggcuaccaagggu

SEQ ID NO: 172575 - RNA, 22 nt, Homo sapiens
auucacugugcuuggccaaauu

SEQ ID NO: 172576 - RNA, 22 nt, Homo sapiens
auucauagugcuaagguguauc

SEQ ID NO: 172577 - RNA, 22 nt, Homo sapiens
auucaucagggauauugguuga

SEQ ID NO: 172578 - RNA, 22 nt, Homo sapiens
auuccacaguuaacacagaccg

SEQ ID NO: 172579 - RNA, 23 nt, Homo sapiens
auuccaguggcaauuggagaaac

SEQ ID NO: 172580 - RNA, 22 nt, Homo sapiens
auucccuuggucaacggaugca

SEQ ID NO: 172581 - RNA, 20 nt, Homo sapiens
auugaacucaguauucugaa

SEQ ID NO: 172582 - RNA, 22 nt, Homo sapiens
auugaacuuacuaucuaaacua

SEQ ID NO: 172583 - RNA, 22 nt, Homo sapiens
auugaaugaaauggcagacacu

SEQ ID NO: 172584 - RNA, 22 nt, Homo sapiens
auugaguaaaugaaaauugccu

SEQ ID NO: 172585 - RNA, 22 nt, Homo sapiens
auugcaaagcguagacucuaaa

SEQ ID NO: 172586 - RNA, 22 nt, Homo sapiens
auugcaacaguguugagaggug

SEQ ID NO: 172587 - RNA, 22 nt, Homo sapiens
auugcaaugggaaacuaugaaa

SEQ ID NO: 172588 - RNA, 22 nt, Homo sapiens
auugcacaaagagggaaacuga

SEQ ID NO: 172589 - RNA, 18 nt, Homo sapiens
auugcacaccagccuggg

SEQ ID NO: 172590 - RNA, 22 nt, Homo sapiens
auugcacaucugcacuacagcc

SEQ ID NO: 172591 - RNA, 22 nt, Homo sapiens
uugagauggagucucacucuuu

SEQ ID NO: 172592 - RNA, 22 nt, Homo sapiens
uugagauggagucucgcucuuu

SEQ ID NO: 172593 - RNA, 22 nt, Homo sapiens
uugagauggagucucgcugugu

SEQ ID NO: 172594 - RNA, 22 nt, Homo sapiens
uugagauggagucuugcgcugu

SEQ ID NO: 172595 - RNA, 22 nt, Homo sapiens
uugagauggagucuugcucucu

SEQ ID NO: 172596 - RNA, 22 nt, Homo sapiens
uugagauggaguguugcucugu

SEQ ID NO: 172597 - RNA, 22 nt, Homo sapiens
uugagauggaguuucacucucg

SEQ ID NO: 172598 - RNA, 22 nt, Homo sapiens
uugagauggaguuucacucugu

SEQ ID NO: 172599 - RNA, 22 nt, Homo sapiens
uugagauggaguuucgcucuuu

SEQ ID NO: 172600 - RNA, 22 nt, Homo sapiens
uugagauggugccacuguacuc

SEQ ID NO: 172601 - RNA, 22 nt, Homo sapiens
uugagauguauguauauaaugu

SEQ ID NO: 172602 - RNA, 22 nt, Homo sapiens
uugagauguggguuggugacuu

SEQ ID NO: 172603 - RNA, 22 nt, Homo sapiens
uugagauuauuguguuccuuua

SEQ ID NO: 172604 - RNA, 22 nt, Homo sapiens
uugagcaaugaacgauucaggg

SEQ ID NO: 172605 - RNA, 22 nt, Homo sapiens
uugagcaaugucacugaggcuu

SEQ ID NO: 172606 - RNA, 22 nt, Homo sapiens
gaggagucagacugugcaaggu

SEQ ID NO: 172607 - RNA, 21 nt, Homo sapiens
gaggauauuuuuauguuugga

SEQ ID NO: 172608 - RNA, 22 nt, Homo sapiens
gaggcauugaaauauugcuuau

SEQ ID NO: 172609 - RNA, 22 nt, Homo sapiens
gaggcggugugaugucacaugc

SEQ ID NO: 172610 - RNA, 22 nt, Homo sapiens
gagguaagaugauucguguccu

SEQ ID NO: 172611 - RNA, 21 nt, Homo sapiens
gagguaccucauguaagugga

SEQ ID NO: 172612 - RNA, 22 nt, Homo sapiens
gagguagguacaauugccacca

SEQ ID NO: 172613 - RNA, 22 nt, Homo sapiens
gagguauagaacaccuuucaag

SEQ ID NO: 172614 - RNA, 22 nt, Homo sapiens
gaggucaggacauuuuugcuuu

SEQ ID NO: 172615 - RNA, 22 nt, Homo sapiens
gagguggugguggaggcauagc

SEQ ID NO: 172616 - RNA, 22 nt, Homo sapiens
gagguguaaggacaacagagac

SEQ ID NO: 172617 - RNA, 22 nt, Homo sapiens
gaguaaaugucaaguacuuagg

SEQ ID NO: 172618 - RNA, 22 nt, Homo sapiens
gagugcaauggcaccgucucgg

SEQ ID NO: 172619 - RNA, 22 nt, Homo sapiens
gagugcaauggcagaucuccgc

SEQ ID NO: 172620 - RNA, 22 nt, Homo sapiens
gagugcaauggcgcgaucucgg

SEQ ID NO: 172621 - RNA, 22 nt, Homo sapiens
gagugcugagcccacuuccuug

SEQ ID NO: 172622 - RNA, 22 nt, Homo sapiens
gagugguuuugauuuauagcug

SEQ ID NO: 172623 - RNA, 22 nt, Homo sapiens
gaguucaauuuccagcuguucu

SEQ ID NO: 172624 - RNA, 22 nt, Homo sapiens
gaguuccuuugagccugagagg

SEQ ID NO: 172625 - RNA, 22 nt, Homo sapiens
gaguuuguacuaauuuguugua

SEQ ID NO: 172626 - RNA, 22 nt, Homo sapiens
gauaaaguauuggguacuaugc

SEQ ID NO: 172627 - RNA, 22 nt, Homo sapiens
gauagcagccauucuuuuuauu

SEQ ID NO: 172628 - RNA, 22 nt, Homo sapiens
gauagugaaccaagggguaauu

SEQ ID NO: 172629 - RNA, 22 nt, Homo sapiens
gauauguguaucuauguacaug

SEQ ID NO: 172630 - RNA, 22 nt, Homo sapiens
gaucacaguuccucacgggcau

SEQ ID NO: 172631 - RNA, 22 nt, Homo sapiens
gaucacauggccauuucuagcu

SEQ ID NO: 172632 - RNA, 22 nt, Homo sapiens
gaucacauguguacucaaugug

SEQ ID NO: 172633 - RNA, 22 nt, Homo sapiens
gaucugagaaagugucauaaca

SEQ ID NO: 172634 - RNA, 19 nt, Homo sapiens
gaucuguugaucaaugugu

SEQ ID NO: 172635 - RNA, 22 nt, Homo sapiens
gaugaucucuggugguaaagac

SEQ ID NO: 172636 - RNA, 22 nt, Homo sapiens
gaugcaaauuaagcuugggaca

SEQ ID NO: 172637 - RNA, 22 nt, Homo sapiens
gauggaauuaaaaucagaauca

SEQ ID NO: 172638 - RNA, 22 nt, Homo sapiens
gauggauuuuuuaggcagagcu

SEQ ID NO: 172639 - RNA, 22 nt, Homo sapiens
gauggcacuaagccauguagga

SEQ ID NO: 172640 - RNA, 22 nt, Homo sapiens
gauggcacuuaagagcaagagc

SEQ ID NO: 172641 - RNA, 22 nt, Homo sapiens
gauggcagugcagccccuggcu

SEQ ID NO: 172642 - RNA, 22 nt, Homo sapiens
gauggcaucugagaguguuaga

SEQ ID NO: 172643 - RNA, 22 nt, Homo sapiens
gauggcucugcaggugagggua

SEQ ID NO: 172644 - RNA, 22 nt, Homo sapiens
gaugguggucuacccuuucccu

SEQ ID NO: 172645 - RNA, 22 nt, Homo sapiens
gauggugucccaggcucaggcu

SEQ ID NO: 172646 - RNA, 22 nt, Homo sapiens
gauuagcacuucaguuacagua

SEQ ID NO: 172647 - RNA, 22 nt, Homo sapiens
gauuccauugcgaauuuucaga

SEQ ID NO: 172648 - RNA, 21 nt, Homo sapiens
gcaaacauccuuugaugccag

SEQ ID NO: 172649 - RNA, 22 nt, Homo sapiens
gcaaagaaugcagauuugccuc

SEQ ID NO: 172650 - RNA, 21 nt, Homo sapiens
gcaaaggaauugccuaagcuu

SEQ ID NO: 172651 - RNA, 22 nt, Homo sapiens
gcaaaguaauuguuguuuuugc

SEQ ID NO: 172652 - RNA, 20 nt, Homo sapiens
gcaaauggaucccacaagcc

SEQ ID NO: 172653 - RNA, 22 nt, Homo sapiens
gcaagaaucugggaguaaaauu

SEQ ID NO: 172654 - RNA, 22 nt, Homo sapiens
gcaagacaugucuaagguuuaa

SEQ ID NO: 172655 - RNA, 20 nt, Homo sapiens
gcaagcaugaagaguagaga

SEQ ID NO: 172656 - RNA, 22 nt, Homo sapiens
gcaaugcugucugugcacagau

SEQ ID NO: 172657 - RNA, 22 nt, Homo sapiens
gcacaguaggugguaggacuuu

SEQ ID NO: 172658 - RNA, 22 nt, Homo sapiens
gcacaguguuacuugauauauu

SEQ ID NO: 172659 - RNA, 22 nt, Homo sapiens
gcacaguuaaagggucauguga

SEQ ID NO: 172660 - RNA, 22 nt, Homo sapiens
gcaccacugcacucucagcuug

SEQ ID NO: 172661 - RNA, 22 nt, Homo sapiens
gcaccaugguagaauaauggua

SEQ ID NO: 172662 - RNA, 22 nt, Homo sapiens
gcaccccuuaccgggcuggguu

SEQ ID NO: 172663 - RNA, 22 nt, Homo sapiens
gcacccugucaaaauggaccaa

SEQ ID NO: 172664 - RNA, 22 nt, Homo sapiens
gcacgugcucauuugaggucuu

SEQ ID NO: 172665 - RNA, 22 nt, Homo sapiens
gcacugggccacauuuauuuuc

SEQ ID NO: 172666 - RNA, 22 nt, Homo sapiens
gcagagaaacaggucuaaggag

SEQ ID NO: 172667 - RNA, 22 nt, Homo sapiens
gcagaucucuucauuucucuua

SEQ ID NO: 172668 - RNA, 22 nt, Homo sapiens
gcagcacauggcagaacauauu

SEQ ID NO: 172669 - RNA, 20 nt, Homo sapiens
gcagcaccauauuucuaaga

SEQ ID NO: 172670 - RNA, 22 nt, Homo sapiens
gcagcaucaaaucacacaagau

SEQ ID NO: 172671 - RNA, 22 nt, Homo sapiens
gcaggaaucuugagaaggauuc

SEQ ID NO: 172672 - RNA, 22 nt, Homo sapiens
gcaguagugcgaucucagcuca

SEQ ID NO: 172673 - RNA, 22 nt, Homo sapiens
gcagugcaguggcgcgaucucg

SEQ ID NO: 172674 - RNA, 22 nt, Homo sapiens
gcagugugugaggaauuugggu

SEQ ID NO: 172675 - RNA, 20 nt, Homo sapiens
gcaguguucacuguauuccu

SEQ ID NO: 172676 - RNA, 22 nt, Homo sapiens
gcauaaagcuaauaagacgaag

SEQ ID NO: 172677 - RNA, 17 nt, Homo sapiens
gcauaugucgaaccagc

SEQ ID NO: 172678 - RNA, 22 nt, Homo sapiens
gcauaugucuuuauagcagcau

SEQ ID NO: 172679 - RNA, 20 nt, Homo sapiens
gcauaugucuuuauggcagc

SEQ ID NO: 172680 - RNA, 17 nt, Homo sapiens
gcauauguugaaccagu

SEQ ID NO: 172681 - RNA, 22 nt, Homo sapiens
gcaucacagcuccugugcuggc

SEQ ID NO: 172682 - RNA, 22 nt, Homo sapiens
gcaugauuuuauaucuauguaa

SEQ ID NO: 172683 - RNA, 22 nt, Homo sapiens
gcauggaguggaaauucuuggg

SEQ ID NO: 172684 - RNA, 22 nt, Homo sapiens
gcauggccuuuaaaugucacag

SEQ ID NO: 172685 - RNA, 22 nt, Homo sapiens
gcauguaguagauguugaauaa

SEQ ID NO: 172686 - RNA, 22 nt, Homo sapiens
gccaacauggcgcuccauucuu

SEQ ID NO: 172687 - RNA, 18 nt, Homo sapiens
gccaacauguaaacaggu

SEQ ID NO: 172688 - RNA, 19 nt, Homo sapiens
gccaccuggugcguguucu

SEQ ID NO: 172689 - RNA, 22 nt, Homo sapiens
gccauugcacuccagccucggc

SEQ ID NO: 172690 - RNA, 22 nt, Homo sapiens
gccauugcacuccgcccugggc

SEQ ID NO: 172691 - RNA, 22 nt, Homo sapiens
gccauugcacucuagccugagc

SEQ ID NO: 172692 - RNA, 22 nt, Homo sapiens
gcccaguagcaguacaucccuu

SEQ ID NO: 172693 - RNA, 22 nt, Homo sapiens
gccccaguacaggcuccuuaga

SEQ ID NO: 172694 - RNA, 22 nt, Homo sapiens
gccccgggugaugcagccguca

SEQ ID NO: 172695 - RNA, 22 nt, Homo sapiens
gcccuacuguuuauacauagga

SEQ ID NO: 172696 - RNA, 22 nt, Homo sapiens
gcccuguguuuggguaugguca

SEQ ID NO: 172697 - RNA, 17 nt, Homo sapiens
gcccuuugugccucuuc

SEQ ID NO: 172698 - RNA, 22 nt, Homo sapiens
gccuagagacuugguaucuugc

SEQ ID NO: 172699 - RNA, 22 nt, Homo sapiens
gccuagagaguuaucaggcugu

SEQ ID NO: 172700 - RNA, 22 nt, Homo sapiens
gccuagggacaaaccguccgac

SEQ ID NO: 172701 - RNA, 22 nt, Homo sapiens
gccuguagaagaguagaugacc

SEQ ID NO: 172702 - RNA, 22 nt, Homo sapiens
gccuuuggugacaggcaugugu

SEQ ID NO: 172703 - RNA, 22 nt, Homo sapiens
gcgagcauuguaggaaguucag

SEQ ID NO: 172704 - RNA, 22 nt, Homo sapiens
gcguugcacuccagccugggua

SEQ ID NO: 172705 - RNA, 22 nt, Homo sapiens
gcuaaggcaggagcauugcuug

SEQ ID NO: 172706 - RNA, 22 nt, Homo sapiens
gcuacugucuaucugugcuucu

SEQ ID NO: 172707 - RNA, 22 nt, Homo sapiens
gcuaggagauccacugcucucu

SEQ ID NO: 172708 - RNA, 22 nt, Homo sapiens
gcuaggagaucugcugcucucu

SEQ ID NO: 172709 - RNA, 22 nt, Homo sapiens
gcucaugagacaagcaggagua

SEQ ID NO: 172710 - RNA, 22 nt, Homo sapiens
gcuccuuugaguagcuucugug

SEQ ID NO: 172711 - RNA, 22 nt, Homo sapiens
gcucguccccuccugacucugc

SEQ ID NO: 172712 - RNA, 22 nt, Homo sapiens
gcugcguguagaguucucacug

SEQ ID NO: 172713 - RNA, 22 nt, Homo sapiens
gcugcuguuauucaucagaacu

SEQ ID NO: 172714 - RNA, 22 nt, Homo sapiens
gcugcuuuugaugacaaaaaca

SEQ ID NO: 172715 - RNA, 22 nt, Homo sapiens
gcuggcaaguggccuacuuugu

SEQ ID NO: 172716 - RNA, 22 nt, Homo sapiens
aaaugacuuuuuaugcagagua

SEQ ID NO: 172717 - RNA, 22 nt, Homo sapiens
aaaugcacaaagauuuugcacu

SEQ ID NO: 172718 - RNA, 21 nt, Homo sapiens
aaaugcacauuacugcuggug

SEQ ID NO: 172719 - RNA, 22 nt, Homo sapiens
aaaugcagauuccuaggcccca

SEQ ID NO: 172720 - RNA, 22 nt, Homo sapiens
aaaugcagauucugcuuagguu

SEQ ID NO: 172721 - RNA, 22 nt, Homo sapiens
aaaugcaugaggugggaagaaa

SEQ ID NO: 172722 - RNA, 22 nt, Homo sapiens
aaaugcauugagggaaaaggca

SEQ ID NO: 172723 - RNA, 22 nt, Homo sapiens
aaaugcccuaaaauggagcauc

SEQ ID NO: 172724 - RNA, 22 nt, Homo sapiens
aaaugccucccauucuacugac

SEQ ID NO: 172725 - RNA, 22 nt, Homo sapiens
aaaugcucucuacacguuucug

SEQ ID NO: 172726 - RNA, 22 nt, Homo sapiens
aaauggauuaaguucacuugcu

SEQ ID NO: 172727 - RNA, 21 nt, Homo sapiens
aaaugugcuuuaguacccuca

SEQ ID NO: 172728 - RNA, 18 nt, Homo sapiens
aaauucugucccuucuuc

SEQ ID NO: 172729 - RNA, 22 nt, Homo sapiens
aaauugcauugagcugcuuauu

SEQ ID NO: 172730 - RNA, 23 nt, Homo sapiens
aaauuugccuauuauuccuaugg

SEQ ID NO: 172731 - RNA, 22 nt, Homo sapiens
aacaccauuuuucugcagccuu

SEQ ID NO: 172732 - RNA, 20 nt, Homo sapiens
aacagcacugucugaagcuu

SEQ ID NO: 172733 - RNA, 22 nt, Homo sapiens
aacauagucaugggguaauguu

SEQ ID NO: 172734 - RNA, 22 nt, Homo sapiens
aacaucaaccaugaggguugga

SEQ ID NO: 172735 - RNA, 22 nt, Homo sapiens
aacccugagucaugagucuaga

SEQ ID NO: 172736 - RNA, 22 nt, Homo sapiens
aaccugaagaaaauauuugcug

SEQ ID NO: 172737 - RNA, 15 nt, Homo sapiens
aaccuggaggagcuu

SEQ ID NO: 172738 - RNA, 22 nt, Homo sapiens
aaccuguaaccauaugaucagu

SEQ ID NO: 172739 - RNA, 22 nt, Homo sapiens
aacuccauuuuagacccuagau

SEQ ID NO: 172740 - RNA, 22 nt, Homo sapiens
aacugcacauauuuguaugggu

SEQ ID NO: 172741 - RNA, 22 nt, Homo sapiens
aacugcuguuuggguacuggug

SEQ ID NO: 172742 - RNA, 22 nt, Homo sapiens
aacuggcacuacaucaagagcu

SEQ ID NO: 172743 - RNA, 22 nt, Homo sapiens
aacuggcauauucugguugcgg

SEQ ID NO: 172744 - RNA, 22 nt, Homo sapiens
aacuggcauguuuuaaggcuua

SEQ ID NO: 172745 - RNA, 22 nt, Homo sapiens
aacuggugauccacccgccuca

SEQ ID NO: 172746 - RNA, 22 nt, Homo sapiens
aagacuguaauccaucuugagu

SEQ ID NO: 172747 - RNA, 22 nt, Homo sapiens
aagagagccagcugguauauuu

SEQ ID NO: 172748 - RNA, 22 nt, Homo sapiens
aagagguuguaccuaaaguguu

SEQ ID NO: 172749 - RNA, 19 nt, Homo sapiens
aagaugauguuugggcuaa

SEQ ID NO: 172750 - RNA, 22 nt, Homo sapiens
aagcaaacaucagcuugguuaa

SEQ ID NO: 172751 - RNA, 20 nt, Homo sapiens
aagcagacauuuggaugaaa

SEQ ID NO: 172752 - RNA, 22 nt, Homo sapiens
aagcagauguguugaaaguacu

SEQ ID NO: 172753 - RNA, 22 nt, Homo sapiens
aagcaggugucugugucuguaa

SEQ ID NO: 172754 - RNA, 22 nt, Homo sapiens
aagcaggugugggaggaaaugg

SEQ ID NO: 172755 - RNA, 22 nt, Homo sapiens
aagcaucacuggaggcagccau

SEQ ID NO: 172756 - RNA, 22 nt, Homo sapiens
aagcaucauuuggaauuugaga

SEQ ID NO: 172757 - RNA, 22 nt, Homo sapiens
aagcaugguuuccaggggucac

SEQ ID NO: 172758 - RNA, 22 nt, Homo sapiens
aagcugcauuuucuagaugcuu

SEQ ID NO: 172759 - RNA, 22 nt, Homo sapiens
aagcuggauuucgcauccuguu

SEQ ID NO: 172760 - RNA, 22 nt, Homo sapiens
aagcuggcauucauucguucuu

SEQ ID NO: 172761 - RNA, 22 nt, Homo sapiens
aagcuggcuuucauugagugcu

SEQ ID NO: 172762 - RNA, 22 nt, Homo sapiens
aagcugguguguauuauucacu

SEQ ID NO: 172763 - RNA, 22 nt, Homo sapiens
aagcugguuuuauaucugugag

SEQ ID NO: 172764 - RNA, 22 nt, Homo sapiens
aagcuguugguggaucuaccau

SEQ ID NO: 172765 - RNA, 22 nt, Homo sapiens
aagcuguuguucauccugaauu

SEQ ID NO: 172766 - RNA, 23 nt, Homo sapiens
aaggacacugaacacuucccagc

SEQ ID NO: 172767 - RNA, 22 nt, Homo sapiens
aaggagcaguggacggguccua

SEQ ID NO: 172768 - RNA, 22 nt, Homo sapiens
aaggagcuuaagugacuuguac

SEQ ID NO: 172769 - RNA, 22 nt, Homo sapiens
aaggagugugauucuucaguuu

SEQ ID NO: 172770 - RNA, 22 nt, Homo sapiens
aaggaguguggugaucuugggc

SEQ ID NO: 172771 - RNA, 22 nt, Homo sapiens
aaggauuguaaaguugacaaau

SEQ ID NO: 172772 - RNA, 22 nt, Homo sapiens
aaggauuguaacaccaagguua

SEQ ID NO: 172773 - RNA, 22 nt, Homo sapiens
aaggcaacgugaguuguugauu

SEQ ID NO: 172774 - RNA, 22 nt, Homo sapiens
aaggcaagauacugguugcuga

SEQ ID NO: 172775 - RNA, 22 nt, Homo sapiens
aaggcagucacuaaauagugag

SEQ ID NO: 172776 - RNA, 22 nt, Homo sapiens
aagggaauguuguggcugguuu

SEQ ID NO: 172777 - RNA, 22 nt, Homo sapiens
aagggagcugcauaaucuugug

SEQ ID NO: 172778 - RNA, 22 nt, Homo sapiens
aaggugcucucuuauguagaaa

SEQ ID NO: 172779 - RNA, 17 nt, Homo sapiens
aaggugcuucgaccucc

SEQ ID NO: 172780 - RNA, 21 nt, Homo sapiens
aaggugguggugauugagaug

SEQ ID NO: 172781 - RNA, 22 nt, Homo sapiens
aagguucuugcuugcaugacug

SEQ ID NO: 172782 - RNA, 22 nt, Homo sapiens
aaguaaacauugagagacaaga

SEQ ID NO: 172783 - RNA, 22 nt, Homo sapiens
aaguaaauauccgguaguccca

SEQ ID NO: 172784 - RNA, 22 nt, Homo sapiens
aaguaauggaguuauuuuauga

SEQ ID NO: 172785 - RNA, 22 nt, Homo sapiens
aaguacuguuuaaauugcagaa

SEQ ID NO: 172786 - RNA, 22 nt, Homo sapiens
aaguagcagaggcaagacuuga

SEQ ID NO: 172787 - RNA, 22 nt, Homo sapiens
aaguagcuggaugcaguggcac

SEQ ID NO: 172788 - RNA, 22 nt, Homo sapiens
aaguaguuaggaacauucucuc

SEQ ID NO: 172789 - RNA, 22 nt, Homo sapiens
aaguauguaucaagucauacuu

SEQ ID NO: 172790 - RNA, 22 nt, Homo sapiens
aaguccccugacagaggggagg

SEQ ID NO: 172791 - RNA, 22 nt, Homo sapiens
aagugaaugaugugaaguguaa

SEQ ID NO: 172792 - RNA, 19 nt, Homo sapiens
aagugaaugcuuuguucac

SEQ ID NO: 172793 - RNA, 22 nt, Homo sapiens
aagugacauugugcccauuuga

SEQ ID NO: 172794 - RNA, 22 nt, Homo sapiens
aagugaccuaacaaugaaggcc

SEQ ID NO: 172795 - RNA, 22 nt, Homo sapiens
aagugacuagacuaugaaaccu

SEQ ID NO: 172796 - RNA, 22 nt, Homo sapiens
aagugauguuauugggugacuc

SEQ ID NO: 172797 - RNA, 22 nt, Homo sapiens
aagugcaaauucccaggcucug

SEQ ID NO: 172798 - RNA, 22 nt, Homo sapiens
aagugcauguauuaguguaguc

SEQ ID NO: 172799 - RNA, 22 nt, Homo sapiens
aagugccauguggaugggcccu

SEQ ID NO: 172800 - RNA, 22 nt, Homo sapiens
aagugcuucagaagacaauauu

SEQ ID NO: 172801 - RNA, 22 nt, Homo sapiens
aagugcuucuuuccucgagaag

SEQ ID NO: 172802 - RNA, 22 nt, Homo sapiens
aaguggccuagagcgaccauuu

SEQ ID NO: 172803 - RNA, 17 nt, Homo sapiens
aaguggcuuguucacca

SEQ ID NO: 172804 - RNA, 23 nt, Homo sapiens
aagugguuuugaacccggacccu

SEQ ID NO: 172805 - RNA, 22 nt, Homo sapiens
aaguguaaguuaauguuuaggu

SEQ ID NO: 172806 - RNA, 22 nt, Homo sapiens
aagugucagaguugcuaaugac

SEQ ID NO: 172807 - RNA, 22 nt, Homo sapiens
aaguuaauguuuaagacuccua

SEQ ID NO: 172808 - RNA, 23 nt, Homo sapiens
aaguucaugcucaucuguuacac

SEQ ID NO: 172809 - RNA, 22 nt, Homo sapiens
aaguugguguaugagacagaag

SEQ ID NO: 172810 - RNA, 21 nt, Homo sapiens
aauaaagcaaccuuaugccau

SEQ ID NO: 172811 - RNA, 22 nt, Homo sapiens
aauaaagcaggguccuugcacu

SEQ ID NO: 172812 - RNA, 22 nt, Homo sapiens
aauaaguugagaugaggucaua

SEQ ID NO: 172813 - RNA, 22 nt, Homo sapiens
aauaauggcaccaaagcacaag

SEQ ID NO: 172814 - RNA, 22 nt, Homo sapiens
aauagugcugcaaaaacauacg

SEQ ID NO: 172815 - RNA, 22 nt, Homo sapiens
aauaucacaggguguacacuca

SEQ ID NO: 172816 - RNA, 22 nt, Homo sapiens
aauauguccaguguuuugggag

SEQ ID NO: 172817 - RNA, 22 nt, Homo sapiens
aaucacaggucuuggcugcaug

SEQ ID NO: 172818 - RNA, 16 nt, Homo sapiens
aauccauuggcccugc

SEQ ID NO: 172819 - RNA, 22 nt, Homo sapiens
aauccugucuugccauccaaua

SEQ ID NO: 172820 - RNA, 22 nt, Homo sapiens
aaucuguagaaggugcacauuc

SEQ ID NO: 172821 - RNA, 22 nt, Homo sapiens
aaucugucuuuuguuauugagg

SEQ ID NO: 172822 - RNA, 22 nt, Homo sapiens
aaugaucaauguuugaggugau

SEQ ID NO: 172823 - RNA, 22 nt, Homo sapiens
aaugccacugugccugccaagg

SEQ ID NO: 172824 - RNA, 22 nt, Homo sapiens
aaugcuguguuauuucaugacc

SEQ ID NO: 172825 - RNA, 22 nt, Homo sapiens
aaugcuguucuuugcuuaaguu

SEQ ID NO: 172826 - RNA, 22 nt, Homo sapiens
ugggauguagccuucuauuuuc

SEQ ID NO: 172827 - RNA, 23 nt, Homo sapiens
ugggauguuuuuggaaacuucug

SEQ ID NO: 172828 - RNA, 22 nt, Homo sapiens
ugggcaaauugugagggaggua

SEQ ID NO: 172829 - RNA, 22 nt, Homo sapiens
ugggcaagugacuuggcuucuc

SEQ ID NO: 172830 - RNA, 22 nt, Homo sapiens
ugggccgcugcaggaugguccc

SEQ ID NO: 172831 - RNA, 22 nt, Homo sapiens
uggggcaaugaacauuuuugca

SEQ ID NO: 172832 - RNA, 22 nt, Homo sapiens
ugggguaggcuguauacucugu

SEQ ID NO: 172833 - RNA, 22 nt, Homo sapiens
uggguaaaucucuguucagggc

SEQ ID NO: 172834 - RNA, 22 nt, Homo sapiens
uggguagagcacugggggcgag

SEQ ID NO: 172835 - RNA, 23 nt, Homo sapiens
uggguucauucuugaagucagug

SEQ ID NO: 172836 - RNA, 23 nt, Homo sapiens
uggguucccuaagcgcaugcugc

SEQ ID NO: 172837 - RNA, 22 nt, Homo sapiens
ugguaaaaugucauuuaccaga

SEQ ID NO: 172838 - RNA, 22 nt, Homo sapiens
ugguaagaggcccugaguuugu

SEQ ID NO: 172839 - RNA, 22 nt, Homo sapiens
ugguaagaucugugagccaggc

SEQ ID NO: 172840 - RNA, 20 nt, Homo sapiens
ugguaauguaagagaggaga

SEQ ID NO: 172841 - RNA, 17 nt, Homo sapiens
ugguagguuuuucuggc

SEQ ID NO: 172842 - RNA, 22 nt, Homo sapiens
uggucaaaucugaugugagaaa

SEQ ID NO: 172843 - RNA, 21 nt, Homo sapiens
uggucaguuuucucacuagga

SEQ ID NO: 172844 - RNA, 22 nt, Homo sapiens
uggucaugaggugaggcuucuc

SEQ ID NO: 172845 - RNA, 22 nt, Homo sapiens
ugguccacuaacccucaguauc

SEQ ID NO: 172846 - RNA, 20 nt, Homo sapiens
ugguccccugagucuggcuu

SEQ ID NO: 172847 - RNA, 22 nt, Homo sapiens
ugguccuuuccauuggagacac

SEQ ID NO: 172848 - RNA, 22 nt, Homo sapiens
uggucucuuugcuuuagucauc

SEQ ID NO: 172849 - RNA, 22 nt, Homo sapiens
uggugagaaaagaugucuuugu

SEQ ID NO: 172850 - RNA, 22 nt, Homo sapiens
uggugccgugguccuggggcca

SEQ ID NO: 172851 - RNA, 19 nt, Homo sapiens
uggugccuuguucuuggau

SEQ ID NO: 172852 - RNA, 22 nt, Homo sapiens
uggugcuuaaauaaggcuuuca

SEQ ID NO: 172853 - RNA, 15 nt, Homo sapiens
uggugguguugagac

SEQ ID NO: 172854 - RNA, 22 nt, Homo sapiens
ugguguccugucucugcgcuug

SEQ ID NO: 172855 - RNA, 22 nt, Homo sapiens
uguaaaaagcccagccgcugag

SEQ ID NO: 172856 - RNA, 22 nt, Homo sapiens
uguaaacuuuugagauugacuu

SEQ ID NO: 172857 - RNA, 22 nt, Homo sapiens
uguaaagaaagcuguuguugua

SEQ ID NO: 172858 - RNA, 22 nt, Homo sapiens
uguaaaucugguuaauuggaua

SEQ ID NO: 172859 - RNA, 16 nt, Homo sapiens
uguaaauguuuugcau

SEQ ID NO: 172860 - RNA, 22 nt, Homo sapiens
uguaacugcuuagaagguuuua

SEQ ID NO: 172861 - RNA, 22 nt, Homo sapiens
uguaagcagcagagacuauccu

SEQ ID NO: 172862 - RNA, 22 nt, Homo sapiens
uguaagcauugggcaugcaguc

SEQ ID NO: 172863 - RNA, 22 nt, Homo sapiens
uguaagugugcaauucagugau

SEQ ID NO: 172864 - RNA, 22 nt, Homo sapiens
uguaaugaucaaaucagaguaa

SEQ ID NO: 172865 - RNA, 22 nt, Homo sapiens
uguaauguuugguagguuaggu

SEQ ID NO: 172866 - RNA, 19 nt, Homo sapiens
uguacacuguaaaccugug

SEQ ID NO: 172867 - RNA, 22 nt, Homo sapiens
uguacaugggacaggaggagag

SEQ ID NO: 172868 - RNA, 22 nt, Homo sapiens
uguacccuuagagagugaucga

SEQ ID NO: 172869 - RNA, 22 nt, Homo sapiens
uguagcaaaucgauacuauugg

SEQ ID NO: 172870 - RNA, 22 nt, Homo sapiens
uguagcagccauaaacacagug

SEQ ID NO: 172871 - RNA, 22 nt, Homo sapiens
uguauacauauguauguuuugu

SEQ ID NO: 172872 - RNA, 22 nt, Homo sapiens
uguauacugucuaauauguugu

SEQ ID NO: 172873 - RNA, 22 nt, Homo sapiens
uguauagaucugauucaucucc

SEQ ID NO: 172874 - RNA, 22 nt, Homo sapiens
uguauaguugagucaaguuuca

SEQ ID NO: 172875 - RNA, 22 nt, Homo sapiens
uguauauguuuguacauauguc

SEQ ID NO: 172876 - RNA, 22 nt, Homo sapiens
uguaugaguuguuuauaaauuu

SEQ ID NO: 172877 - RNA, 22 nt, Homo sapiens
uguaugcuuuugagagauauuu

SEQ ID NO: 172878 - RNA, 22 nt, Homo sapiens
uguauguaaagacaggauaaca

SEQ ID NO: 172879 - RNA, 22 nt, Homo sapiens
uguauguugauguuauauucug

SEQ ID NO: 172880 - RNA, 16 nt, Homo sapiens
uguauugcuaaaaaga

SEQ ID NO: 172881 - RNA, 21 nt, Homo sapiens
ugucaagugggaaaacaugua

SEQ ID NO: 172882 - RNA, 22 nt, Homo sapiens
ugucacccuuuauccauuuccu

SEQ ID NO: 172883 - RNA, 22 nt, Homo sapiens
ugucacugugaguuugacugcu

SEQ ID NO: 172884 - RNA, 22 nt, Homo sapiens
ugucacugugcagucaugcauu

SEQ ID NO: 172885 - RNA, 22 nt, Homo sapiens
ugucacuuugccuucuggacuu

SEQ ID NO: 172886 - RNA, 22 nt, Homo sapiens
ugucagcacaacucagguuccu

SEQ ID NO: 172887 - RNA, 21 nt, Homo sapiens
ugucaguuuccagaguucaac

SEQ ID NO: 172888 - RNA, 22 nt, Homo sapiens
ugucaguuucccuccucuuccu

SEQ ID NO: 172889 - RNA, 22 nt, Homo sapiens
ugucauauagaauguucuauga

SEQ ID NO: 172890 - RNA, 22 nt, Homo sapiens
ugucaucauuggaaucugccuc

SEQ ID NO: 172891 - RNA, 22 nt, Homo sapiens
ugucaugaacucacauucuggg

SEQ ID NO: 172892 - RNA, 22 nt, Homo sapiens
ugucauggggaaaauaacagac

SEQ ID NO: 172893 - RNA, 22 nt, Homo sapiens
ugucaugguagcaaggacgagg

SEQ ID NO: 172894 - RNA, 22 nt, Homo sapiens
ugucauuguggugcagauauaa

SEQ ID NO: 172895 - RNA, 22 nt, Homo sapiens
ugucccugagccuggauuccug

SEQ ID NO: 172896 - RNA, 19 nt, Homo sapiens
uguccuagaggaguucaca

SEQ ID NO: 172897 - RNA, 22 nt, Homo sapiens
uguccuggugaugcccaaauuc

SEQ ID NO: 172898 - RNA, 22 nt, Homo sapiens
ugucuggaaggguggccuccug

SEQ ID NO: 172899 - RNA, 22 nt, Homo sapiens
ugucuugagagaggacaugacu

SEQ ID NO: 172900 - RNA, 22 nt, Homo sapiens
ugucuuguagacaauguauagu

SEQ ID NO: 172901 - RNA, 22 nt, Homo sapiens
ugugaaacauggauagaacugg

SEQ ID NO: 172902 - RNA, 21 nt, Homo sapiens
ugugaaaucuaggcagagguu

SEQ ID NO: 172903 - RNA, 22 nt, Homo sapiens
ugugaaauguuaucccgucgug

SEQ ID NO: 172904 - RNA, 22 nt, Homo sapiens
ugugaacacagaggcuauggca

SEQ ID NO: 172905 - RNA, 22 nt, Homo sapiens
ugugaacagcuccaaaugugga

SEQ ID NO: 172906 - RNA, 19 nt, Homo sapiens
ugugaagaaaugcugcaag

SEQ ID NO: 172907 - RNA, 22 nt, Homo sapiens
ugugaauggugcugcaaugaac

SEQ ID NO: 172908 - RNA, 22 nt, Homo sapiens
ugugacagcacgguucaacugc

SEQ ID NO: 172909 - RNA, 22 nt, Homo sapiens
ugugacagguagguaauuuuug

SEQ ID NO: 172910 - RNA, 22 nt, Homo sapiens
ugugacaguuaguuugguguua

SEQ ID NO: 172911 - RNA, 22 nt, Homo sapiens
ugugagacugacagggcagggu

SEQ ID NO: 172912 - RNA, 20 nt, Homo sapiens
ugugagacugguuuugaacu

SEQ ID NO: 172913 - RNA, 22 nt, Homo sapiens
ugugagaucucagaauugaacu

SEQ ID NO: 172914 - RNA, 22 nt, Homo sapiens
ugugaguguguacuaguuauca

SEQ ID NO: 172915 - RNA, 22 nt, Homo sapiens
ugugaucaaccugcagggcugg

SEQ ID NO: 172916 - RNA, 17 nt, Homo sapiens
ugugaucaucacccuug

SEQ ID NO: 172917 - RNA, 16 nt, Homo sapiens
ugugaucuuuuuucuu

SEQ ID NO: 172918 - RNA, 22 nt, Homo sapiens
ugugaugauuugauaaacguau

SEQ ID NO: 172919 - RNA, 20 nt, Homo sapiens
ugugauuauuuaguugcaug

SEQ ID NO: 172920 - RNA, 22 nt, Homo sapiens
ugugauugauuaaugugugcua

SEQ ID NO: 172921 - RNA, 22 nt, Homo sapiens
ugugcaaauguuaaacuaacuu

SEQ ID NO: 172922 - RNA, 22 nt, Homo sapiens
ugugcaaauuagcacaacccga

SEQ ID NO: 172923 - RNA, 22 nt, Homo sapiens
ugugcaaucagcuucauuacau

SEQ ID NO: 172924 - RNA, 22 nt, Homo sapiens
ugugcacaaugugcagguuuga

SEQ ID NO: 172925 - RNA, 22 nt, Homo sapiens
ugugcacaaugugcagguuugu

SEQ ID NO: 172926 - RNA, 22 nt, Homo sapiens
ugugcauauaaguguguauaua

SEQ ID NO: 172927 - RNA, 22 nt, Homo sapiens
ugugccaaucauagggcuuggu

SEQ ID NO: 172928 - RNA, 22 nt, Homo sapiens
ugugccacugcacuccugccug

SEQ ID NO: 172929 - RNA, 22 nt, Homo sapiens
ugugccacugcacuccugggug

SEQ ID NO: 172930 - RNA, 22 nt, Homo sapiens
ugugccacuguucuguaaagug

SEQ ID NO: 172931 - RNA, 22 nt, Homo sapiens
cuuaaugcuacggcucuguguu

SEQ ID NO: 172932 - RNA, 22 nt, Homo sapiens
cuuaggguacuuuggugcauca

SEQ ID NO: 172933 - RNA, 18 nt, Homo sapiens
cuuagguagcucauucca

SEQ ID NO: 172934 - RNA, 22 nt, Homo sapiens
cuucaaguaauucugauggcua

SEQ ID NO: 172935 - RNA, 22 nt, Homo sapiens
cuucaccaguuuggcagucuca

SEQ ID NO: 172936 - RNA, 22 nt, Homo sapiens
uugagcaacauagugagacugu

SEQ ID NO: 172937 - RNA, 22 nt, Homo sapiens
uugagcaauccuccugccaugu

SEQ ID NO: 172938 - RNA, 22 nt, Homo sapiens
uugagcacaggaguuugagacc

SEQ ID NO: 172939 - RNA, 22 nt, Homo sapiens
uugagcacaggaguuuugagac

SEQ ID NO: 172940 - RNA, 19 nt, Homo sapiens
uugagcacugccggaguua

SEQ ID NO: 172941 - RNA, 22 nt, Homo sapiens
uugagcacugucugugugcagu

SEQ ID NO: 172942 - RNA, 22 nt, Homo sapiens
uugagcaucauguuagcacuca

SEQ ID NO: 172943 - RNA, 22 nt, Homo sapiens
uugagcuagggagaucgagguc

SEQ ID NO: 172944 - RNA, 22 nt, Homo sapiens
uugagcuaugaguuaauaggac

SEQ ID NO: 172945 - RNA, 22 nt, Homo sapiens
uugaggaagugguuccccagag

SEQ ID NO: 172946 - RNA, 22 nt, Homo sapiens
uugaggacugcuaagcauuuga

SEQ ID NO: 172947 - RNA, 22 nt, Homo sapiens
uugaggaggcagucuucccauu

SEQ ID NO: 172948 - RNA, 22 nt, Homo sapiens
uugaggccugauaacacacuga

SEQ ID NO: 172949 - RNA, 22 nt, Homo sapiens
uugagggaagccagaggucugc

SEQ ID NO: 172950 - RNA, 22 nt, Homo sapiens
uugagggaggcagggcuugucu

SEQ ID NO: 172951 - RNA, 22 nt, Homo sapiens
uugagggcugaauaccaaucag

SEQ ID NO: 172952 - RNA, 22 nt, Homo sapiens
uugagguaggaggagcuuggau

SEQ ID NO: 172953 - RNA, 22 nt, Homo sapiens
uugagguaguacuuauuauugg

SEQ ID NO: 172954 - RNA, 22 nt, Homo sapiens
uugaggucagagguucgagacc

SEQ ID NO: 172955 - RNA, 22 nt, Homo sapiens
uugaggugaagggcagagcagc

SEQ ID NO: 172956 - RNA, 22 nt, Homo sapiens
uugaggugggaggaucacuuga

SEQ ID NO: 172957 - RNA, 22 nt, Homo sapiens
uugaguaguaagugguucaccg

SEQ ID NO: 172958 - RNA, 22 nt, Homo sapiens
uugaguagugugaugcaugucu

SEQ ID NO: 172959 - RNA, 22 nt, Homo sapiens
uugaguauuggacugguaucuu

SEQ ID NO: 172960 - RNA, 22 nt, Homo sapiens
uugaguauuugcagucugaaca

SEQ ID NO: 172961 - RNA, 22 nt, Homo sapiens
uugaguuugaguauucuaaagc

SEQ ID NO: 172962 - RNA, 22 nt, Homo sapiens
uugauaauguuaacuuugguca

SEQ ID NO: 172963 - RNA, 22 nt, Homo sapiens
uugauagguuuuauguauaguu

SEQ ID NO: 172964 - RNA, 22 nt, Homo sapiens
uugauaguuuuaaaauuaaucu

SEQ ID NO: 172965 - RNA, 22 nt, Homo sapiens
uugauaugacuaucuuuuaugu

SEQ ID NO: 172966 - RNA, 22 nt, Homo sapiens
uugauauuaaguacugaagugg

SEQ ID NO: 172967 - RNA, 22 nt, Homo sapiens
uugauauucugagaagcugaag

SEQ ID NO: 172968 - RNA, 22 nt, Homo sapiens
uugaucacuguacuaugacuau

SEQ ID NO: 172969 - RNA, 22 nt, Homo sapiens
uugaucuggagagaggcccgug

SEQ ID NO: 172970 - RNA, 22 nt, Homo sapiens
uugauguccaucucuagguaaa

SEQ ID NO: 172971 - RNA, 22 nt, Homo sapiens
uugauguugaggacauaaaccu

SEQ ID NO: 172972 - RNA, 20 nt, Homo sapiens
uugauucccucuaaacucgc

SEQ ID NO: 172973 - RNA, 22 nt, Homo sapiens
uugauuuguagaaugccccaac

SEQ ID NO: 172974 - RNA, 22 nt, Homo sapiens
uugcaaagaccucuucacuucc

SEQ ID NO: 172975 - RNA, 23 nt, Homo sapiens
uugcaaagccugaaacucuucag

SEQ ID NO: 172976 - RNA, 22 nt, Homo sapiens
uugcaaaucucuuguguuuggu

SEQ ID NO: 172977 - RNA, 21 nt, Homo sapiens
uugcaaaugcugcugccugau

SEQ ID NO: 172978 - RNA, 22 nt, Homo sapiens
uugcaagaaaucagagccuucc

SEQ ID NO: 172979 - RNA, 22 nt, Homo sapiens
uugcaaggugcagcuuaugcaa

SEQ ID NO: 172980 - RNA, 22 nt, Homo sapiens
uugcacagucuagcuccaccuu

SEQ ID NO: 172981 - RNA, 22 nt, Homo sapiens
uugcacauugauuuuguauccu

SEQ ID NO: 172982 - RNA, 22 nt, Homo sapiens
uugcacauugcaccuuuuguau

SEQ ID NO: 172983 - RNA, 22 nt, Homo sapiens
uugcacauuuuuucuggcagaa

SEQ ID NO: 172984 - RNA, 22 nt, Homo sapiens
uugcacuccggccuggguaaca

SEQ ID NO: 172985 - RNA, 22 nt, Homo sapiens
uugcacuuccgccugggugaca

SEQ ID NO: 172986 - RNA, 20 nt, Homo sapiens
uugcagagcccaacccugga

SEQ ID NO: 172987 - RNA, 22 nt, Homo sapiens
uugcagagccccugcaaggguc

SEQ ID NO: 172988 - RNA, 22 nt, Homo sapiens
uugcagaucccacacucacccu

SEQ ID NO: 172989 - RNA, 22 nt, Homo sapiens
uugcagcaacauggaugaaacu

SEQ ID NO: 172990 - RNA, 22 nt, Homo sapiens
uugcauaagugcauucugugau

SEQ ID NO: 172991 - RNA, 22 nt, Homo sapiens
uugcauagacaauauuaaucuu

SEQ ID NO: 172992 - RNA, 18 nt, Homo sapiens
uugcaucauuuuguuguu

SEQ ID NO: 172993 - RNA, 22 nt, Homo sapiens
uugccaauauuuuacugagaag

SEQ ID NO: 172994 - RNA, 22 nt, Homo sapiens
uugccauagugcugccagauau

SEQ ID NO: 172995 - RNA, 22 nt, Homo sapiens
uugccuaguuuaggucugugcu

SEQ ID NO: 172996 - RNA, 22 nt, Homo sapiens
uugccuuuguuggaaacaagug

SEQ ID NO: 172997 - RNA, 22 nt, Homo sapiens
uugcuagucucuguuucaggau

SEQ ID NO: 172998 - RNA, 22 nt, Homo sapiens
uugcuauguugcccagucugga

SEQ ID NO: 172999 - RNA, 22 nt, Homo sapiens
uugcuccccaggaaaggaagca

SEQ ID NO: 173000 - RNA, 20 nt, Homo sapiens
uugcugguguuagaggaggc

SEQ ID NO: 173001 - RNA, 22 nt, Homo sapiens
uugcuuuguugucuggggaaua

SEQ ID NO: 173002 - RNA, 22 nt, Homo sapiens
uuggaaaaauccaccuugaucu

SEQ ID NO: 173003 - RNA, 22 nt, Homo sapiens
uuggaaacgucaccuuuuccuu

SEQ ID NO: 173004 - RNA, 22 nt, Homo sapiens
uuggaaggcuccuaaugaaugg

SEQ ID NO: 173005 - RNA, 23 nt, Homo sapiens
uuggaaugagaccuaagaguuuu

SEQ ID NO: 173006 - RNA, 22 nt, Homo sapiens
uuggaaugcaacagaaggauaa

SEQ ID NO: 173007 - RNA, 19 nt, Homo sapiens
uuggaauuuuagaguuuga

SEQ ID NO: 173008 - RNA, 22 nt, Homo sapiens
uuggacugagaguuccaccauu

SEQ ID NO: 173009 - RNA, 22 nt, Homo sapiens
uuggacugugagguuucguggg

SEQ ID NO: 173010 - RNA, 22 nt, Homo sapiens
uuggagagagaggacucccggc

SEQ ID NO: 173011 - RNA, 22 nt, Homo sapiens
uuggagagugauauucagaugc

SEQ ID NO: 173012 - RNA, 22 nt, Homo sapiens
uuggagugugagagcagccugg

SEQ ID NO: 173013 - RNA, 22 nt, Homo sapiens
uuggauauucaguuuuuccauc

SEQ ID NO: 173014 - RNA, 22 nt, Homo sapiens
uuggcaaaugucacaaaucagg

SEQ ID NO: 173015 - RNA, 22 nt, Homo sapiens
uuggcaacauagugagaccccc

SEQ ID NO: 173016 - RNA, 22 nt, Homo sapiens
uuggcacuugauaauauucugg

SEQ ID NO: 173017 - RNA, 22 nt, Homo sapiens
uuggcagugcccgaugcugggg

SEQ ID NO: 173018 - RNA, 22 nt, Homo sapiens
uuggccccuccaaaucucaugu

SEQ ID NO: 173019 - RNA, 22 nt, Homo sapiens
uuggccccuuucauccacagcu

SEQ ID NO: 173020 - RNA, 21 nt, Homo sapiens
uuggcuacugcuucagaggga

SEQ ID NO: 173021 - RNA, 22 nt, Homo sapiens
uuggcuauagauacauggauua

SEQ ID NO: 173022 - RNA, 21 nt, Homo sapiens
uuggggaauggagagguuuuc

SEQ ID NO: 173023 - RNA, 22 nt, Homo sapiens
uuggggcacggccucuguugcc

SEQ ID NO: 173024 - RNA, 22 nt, Homo sapiens
uugggucaguuccuugacuccu

SEQ ID NO: 173025 - RNA, 22 nt, Homo sapiens
uuggucagcuagauuauucccu

SEQ ID NO: 173026 - RNA, 22 nt, Homo sapiens
uuggucaggagccucccucuuu

SEQ ID NO: 173027 - RNA, 22 nt, Homo sapiens
uuggucaucucccuccuuuuag

SEQ ID NO: 173028 - RNA, 21 nt, Homo sapiens
uugguccacaugucauaguua

SEQ ID NO: 173029 - RNA, 22 nt, Homo sapiens
uugguccacugugaaauuggga

SEQ ID NO: 173030 - RNA, 22 nt, Homo sapiens
uugguccauuacauugaugaca

SEQ ID NO: 173031 - RNA, 22 nt, Homo sapiens
uuggucucuuaaucacacuuuu

SEQ ID NO: 173032 - RNA, 22 nt, Homo sapiens
uugguucaguuuaacgaguaau

SEQ ID NO: 173033 - RNA, 22 nt, Homo sapiens
uuguaaagucugucucagucag

SEQ ID NO: 173034 - RNA, 22 nt, Homo sapiens
uuguaagaaucuagcucuuuau

SEQ ID NO: 173035 - RNA, 22 nt, Homo sapiens
uuguaauggagcaaacagguug

SEQ ID NO: 173036 - RNA, 22 nt, Homo sapiens
guaaucucagcuacuugggagc

SEQ ID NO: 173037 - RNA, 22 nt, Homo sapiens
guaaucucagcuacuugggagu

SEQ ID NO: 173038 - RNA, 19 nt, Homo sapiens
guaaucucaguacuuuggu

SEQ ID NO: 173039 - RNA, 22 nt, Homo sapiens
guacaaguaagaaaauugccca

SEQ ID NO: 173040 - RNA, 22 nt, Homo sapiens
guacaguggguguagggaccag

SEQ ID NO: 173041 - RNA, 22 nt, Homo sapiens
guacaguuuucaguguucacug

SEQ ID NO: 173042 - RNA, 22 nt, Homo sapiens
guacuuuguuauaacccacagg

SEQ ID NO: 173043 - RNA, 22 nt, Homo sapiens
guagaaagcauuucagauuugc

SEQ ID NO: 173044 - RNA, 22 nt, Homo sapiens
guaggcacuggcucagcuuauc

SEQ ID NO: 173045 - RNA, 22 nt, Homo sapiens
uugucaguguucacucaaagcu

SEQ ID NO: 173046 - RNA, 22 nt, Homo sapiens
uuguccuugagauaguuugcug

SEQ ID NO: 173047 - RNA, 22 nt, Homo sapiens
uugugaaaucuaggcagagguu

SEQ ID NO: 173048 - RNA, 22 nt, Homo sapiens
uugugaagaugugaagcaagca

SEQ ID NO: 173049 - RNA, 22 nt, Homo sapiens
uugugaaugaugccgcaauaaa

SEQ ID NO: 173050 - RNA, 22 nt, Homo sapiens
uugugaaugaugucgcaauaaa

SEQ ID NO: 173051 - RNA, 22 nt, Homo sapiens
uugugaauggugccgcaguaaa

SEQ ID NO: 173052 - RNA, 22 nt, Homo sapiens
uugugagggagcuaagaugagu

SEQ ID NO: 173053 - RNA, 22 nt, Homo sapiens
uugugcaaaguugugguuucug

SEQ ID NO: 173054 - RNA, 22 nt, Homo sapiens
uugugcacauguacccuagaac

SEQ ID NO: 173055 - RNA, 18 nt, Homo sapiens
uugugccugagaaggugg

SEQ ID NO: 173056 - RNA, 22 nt, Homo sapiens
uugugccugguacauggagaaa

SEQ ID NO: 173057 - RNA, 22 nt, Homo sapiens
uugugcuuaaugaguguaaggu

SEQ ID NO: 173058 - RNA, 22 nt, Homo sapiens
uugugcuuuacuuacuaccaga

SEQ ID NO: 173059 - RNA, 22 nt, Homo sapiens
uuguggcuuaucucauuuagcg

SEQ ID NO: 173060 - RNA, 22 nt, Homo sapiens
uugugguugauacacguaggaa

SEQ ID NO: 173061 - RNA, 22 nt, Homo sapiens
uugugguugaugaagacugucu

SEQ ID NO: 173062 - RNA, 22 nt, Homo sapiens
uuguguccccacccaaauuuca

SEQ ID NO: 173063 - RNA, 22 nt, Homo sapiens
uugugucccuacccaaaucuca

SEQ ID NO: 173064 - RNA, 22 nt, Homo sapiens
uuguguuugaugcugacacgca

SEQ ID NO: 173065 - RNA, 22 nt, Homo sapiens
uuguuaugggguggcuugaaag

SEQ ID NO: 173066 - RNA, 22 nt, Homo sapiens
uuguuauguaucucaagauaaa

SEQ ID NO: 173067 - RNA, 22 nt, Homo sapiens
uuguugcacugcuuuccuggcc

SEQ ID NO: 173068 - RNA, 22 nt, Homo sapiens
uuguuuuggagaugagcuaaaa

SEQ ID NO: 173069 - RNA, 22 nt, Homo sapiens
uuuaaagcacggaguuuguggc

SEQ ID NO: 173070 - RNA, 22 nt, Homo sapiens
uuuaaagcaugacgagaagaag

SEQ ID NO: 173071 - RNA, 20 nt, Homo sapiens
uuuaagacaugcugaauuga

SEQ ID NO: 173072 - RNA, 22 nt, Homo sapiens
uuuaagccaggugcaguggcuc

SEQ ID NO: 173073 - RNA, 22 nt, Homo sapiens
uuuaaggcaugccuguacaugc

SEQ ID NO: 173074 - RNA, 22 nt, Homo sapiens
uuuaaugcgucucugaguuuug

SEQ ID NO: 173075 - RNA, 22 nt, Homo sapiens
uuuaauguuacaguauugguau

SEQ ID NO: 173076 - RNA, 22 nt, Homo sapiens
uuuacagucuuuugugugaguc

SEQ ID NO: 173077 - RNA, 22 nt, Homo sapiens
uuuacugucuucagucccucug

SEQ ID NO: 173078 - RNA, 22 nt, Homo sapiens
uuuagcaauggagggugacuuu

SEQ ID NO: 173079 - RNA, 22 nt, Homo sapiens
uuuagcucauucaauuucaguc

SEQ ID NO: 173080 - RNA, 22 nt, Homo sapiens
uuuagggcaggccuggugguga

SEQ ID NO: 173081 - RNA, 22 nt, Homo sapiens
uuuagguagucaaagguuaguc

SEQ ID NO: 173082 - RNA, 22 nt, Homo sapiens
uuuaguucauuaaggaaucucc

SEQ ID NO: 173083 - RNA, 22 nt, Homo sapiens
uuuaucaggccuuuggaaaaau

SEQ ID NO: 173084 - RNA, 22 nt, Homo sapiens
uuuaugcuacauguguuggaaa

SEQ ID NO: 173085 - RNA, 22 nt, Homo sapiens
uuuauggagagauauuuauggu

SEQ ID NO: 173086 - RNA, 22 nt, Homo sapiens
uuuauucggcuaggagcuucgg

SEQ ID NO: 173087 - RNA, 22 nt, Homo sapiens
uuucaacaggucuggggugguc

SEQ ID NO: 173088 - RNA, 22 nt, Homo sapiens
uuucagagucaucugcccaagu

SEQ ID NO: 173089 - RNA, 17 nt, Homo sapiens
uuucagaguggaagugu

SEQ ID NO: 173090 - RNA, 22 nt, Homo sapiens
uuucagcguggggugcugaaga

SEQ ID NO: 173091 - RNA, 23 nt, Homo sapiens
uuucaggcaggugaaagaccagc

SEQ ID NO: 173092 - RNA, 20 nt, Homo sapiens
uuucaguacuuucuacuggc

SEQ ID NO: 173093 - RNA, 22 nt, Homo sapiens
uuucauggaauauagucauuuu

SEQ ID NO: 173094 - RNA, 23 nt, Homo sapiens
uuucauggggauuuacucauucc

SEQ ID NO: 173095 - RNA, 22 nt, Homo sapiens
uuuccacauggacuuaccuucg

SEQ ID NO: 173096 - RNA, 22 nt, Homo sapiens
uuucccagugguacaguuuaua

SEQ ID NO: 173097 - RNA, 21 nt, Homo sapiens
uuuccuggagcguauggcuuc

SEQ ID NO: 173098 - RNA, 22 nt, Homo sapiens
uuucuacagggcuugccaggua

SEQ ID NO: 173099 - RNA, 17 nt, Homo sapiens
uuucucagcccucuucu

SEQ ID NO: 173100 - RNA, 22 nt, Homo sapiens
uuucucaguguuucaggguagg

SEQ ID NO: 173101 - RNA, 22 nt, Homo sapiens
uuugaaaguaauuugguuggug

SEQ ID NO: 173102 - RNA, 22 nt, Homo sapiens
uuugaaccauuugaagaaugau

SEQ ID NO: 173103 - RNA, 22 nt, Homo sapiens
uuugaagugugaugccuugaug

SEQ ID NO: 173104 - RNA, 22 nt, Homo sapiens
uuugacacugggagugugggug

SEQ ID NO: 173105 - RNA, 22 nt, Homo sapiens
uuugagcauguaguuuaacccu

SEQ ID NO: 173106 - RNA, 22 nt, Homo sapiens
uuugaggaaaggcauaaguagg

SEQ ID NO: 173107 - RNA, 22 nt, Homo sapiens
uuugaguaggcuuauauuuugg

SEQ ID NO: 173108 - RNA, 21 nt, Homo sapiens
uuugaucauuaaaagugaauc

SEQ ID NO: 173109 - RNA, 22 nt, Homo sapiens
uuugcaauguugugauggugaa

SEQ ID NO: 173110 - RNA, 22 nt, Homo sapiens
uuugcacuugaaaacacucuca

SEQ ID NO: 173111 - RNA, 22 nt, Homo sapiens
uuugccaaugggaauuuuccua

SEQ ID NO: 173112 - RNA, 22 nt, Homo sapiens
uuugccuguagacacuuacccu

SEQ ID NO: 173113 - RNA, 22 nt, Homo sapiens
uuugcuucacuguuuggcaaaa

SEQ ID NO: 173114 - RNA, 22 nt, Homo sapiens
uuugcuuguguaaaaaucugga

SEQ ID NO: 173115 - RNA, 22 nt, Homo sapiens
uuuggaaugaaacagcagagcc

SEQ ID NO: 173116 - RNA, 22 nt, Homo sapiens
uuuggcaaagaucaacauguua

SEQ ID NO: 173117 - RNA, 22 nt, Homo sapiens
uuuggcagaaaacaagaaucug

SEQ ID NO: 173118 - RNA, 22 nt, Homo sapiens
uuuggcaugggcuauuugcuuu

SEQ ID NO: 173119 - RNA, 23 nt, Homo sapiens
uuuggcauuccagaaauuuucau

SEQ ID NO: 173120 - RNA, 22 nt, Homo sapiens
uuuggcauuuuacuacucaaau

SEQ ID NO: 173121 - RNA, 22 nt, Homo sapiens
uuuggcuuuuguaauaacugcc

SEQ ID NO: 173122 - RNA, 22 nt, Homo sapiens
uuugggccaugcuucccgguca

SEQ ID NO: 173123 - RNA, 22 nt, Homo sapiens
uuugggccucugauuucuuugg

SEQ ID NO: 173124 - RNA, 22 nt, Homo sapiens
uuuggguuaguuuuccaaucuu

SEQ ID NO: 173125 - RNA, 22 nt, Homo sapiens
uuuggucccaaugugauaaggu

SEQ ID NO: 173126 - RNA, 18 nt, Homo sapiens
uuugguccuuuauaaaca

SEQ ID NO: 173127 - RNA, 22 nt, Homo sapiens
uuuggucuuuuauuuaaagcag

SEQ ID NO: 173128 - RNA, 22 nt, Homo sapiens
uuugguguauaaaaaugcuagu

SEQ ID NO: 173129 - RNA, 22 nt, Homo sapiens
uuugguugucacaacuggggga

SEQ ID NO: 173130 - RNA, 22 nt, Homo sapiens
uuuguaauccuauuccaaagga

SEQ ID NO: 173131 - RNA, 22 nt, Homo sapiens
uuuguacuccuuggccagcuuc

SEQ ID NO: 173132 - RNA, 22 nt, Homo sapiens
uuuguacuucauacaauaacuc

SEQ ID NO: 173133 - RNA, 22 nt, Homo sapiens
uuuguacuugaaacccagggcc

SEQ ID NO: 173134 - RNA, 18 nt, Homo sapiens
uuuguacuuuuucuaaug

SEQ ID NO: 173135 - RNA, 21 nt, Homo sapiens
uuuguccaccuguguucacca

SEQ ID NO: 173136 - RNA, 22 nt, Homo sapiens
uuugucccccguaguucauaua

SEQ ID NO: 173137 - RNA, 23 nt, Homo sapiens
uuugugacacucuccaucuccag

SEQ ID NO: 173138 - RNA, 22 nt, Homo sapiens
uuugugaggugauggauauguc

SEQ ID NO: 173139 - RNA, 22 nt, Homo sapiens
uuugugauugcacacucaagau

SEQ ID NO: 173140 - RNA, 18 nt, Homo sapiens
uuugugcuccacaaagga

SEQ ID NO: 173141 - RNA, 22 nt, Homo sapiens
uuugugcuccuguugagaaucu

SEQ ID NO: 173142 - RNA, 22 nt, Homo sapiens
uuugugcugcaauuaauuuccc

SEQ ID NO: 173143 - RNA, 21 nt, Homo sapiens
uuugugguuacugugugagcu

SEQ ID NO: 173144 - RNA, 22 nt, Homo sapiens
guggaaaucucugugugacuua

SEQ ID NO: 173145 - RNA, 22 nt, Homo sapiens
guggaagauaguguguuaaugu

SEQ ID NO: 173146 - RNA, 22 nt, Homo sapiens
guggaaugcaguguugauucaa

SEQ ID NO: 173147 - RNA, 22 nt, Homo sapiens
guggagacaaaggcugagugag

SEQ ID NO: 173148 - RNA, 22 nt, Homo sapiens
guggaggagaaagaagcauuuc

SEQ ID NO: 173149 - RNA, 22 nt, Homo sapiens
guggcaaguguuccaagaggcg

SEQ ID NO: 173150 - RNA, 22 nt, Homo sapiens
guggcacaauuaaguagcuauu

SEQ ID NO: 173151 - RNA, 22 nt, Homo sapiens
guggcuuuauuuagaagcaggg

SEQ ID NO: 173152 - RNA, 22 nt, Homo sapiens
gugggaugaucacaguucacug

SEQ ID NO: 173153 - RNA, 22 nt, Homo sapiens
gugggcaaagcuaguguguaga

SEQ ID NO: 173154 - RNA, 22 nt, Homo sapiens
uuuuggucuccaguuucugcug

SEQ ID NO: 173155 - RNA, 22 nt, Homo sapiens
uuuugguucaauuaauuugcua

SEQ ID NO: 173156 - RNA, 22 nt, Homo sapiens
uuuuuauggccaauccucagaa

SEQ ID NO: 173157 - RNA, 22 nt, Homo sapiens
uuuuugaguaaauauaaauugu

SEQ ID NO: 173158 - RNA, 22 nt, Homo sapiens
uuuuugauuaauggguagacca

SEQ ID NO: 173159 - RNA, 22 nt, Homo sapiens
uuuuuggguaaugauuaucaau

SEQ ID NO: 173160 - RNA, 21 nt, Homo sapiens
uuuuugguggucauggauaga

SEQ ID NO: 173161 - RNA, 23 nt, Homo sapiens
uuuuuguguuucauggaaauagg

SEQ ID NO: 173162 - RNA, 22 nt, Homo sapiens
uacaguagaaugucuuucaaaa

SEQ ID NO: 173163 - RNA, 22 nt, Homo sapiens
uacaguagagaucagcaaacua

SEQ ID NO: 173164 - RNA, 22 nt, Homo sapiens
uacagucuggaggccuguguug

SEQ ID NO: 173165 - RNA, 22 nt, Homo sapiens
uacagugcauagaggcaugaua

SEQ ID NO: 173166 - RNA, 22 nt, Homo sapiens
uacaguggaaguuaaccccauu

SEQ ID NO: 173167 - RNA, 22 nt, Homo sapiens
uacaguguuuugguauuccaca

SEQ ID NO: 173168 - RNA, 22 nt, Homo sapiens
uacauaguuacuuccauuucca

SEQ ID NO: 173169 - RNA, 22 nt, Homo sapiens
uacaucagccugaaagagcucg

SEQ ID NO: 173170 - RNA, 22 nt, Homo sapiens
uacaugugccauguugguuugc

SEQ ID NO: 173171 - RNA, 22 nt, Homo sapiens
uacauugucauauucucucucu

SEQ ID NO: 173172 - RNA, 22 nt, Homo sapiens
uacccaguaacaaguauuuugg

SEQ ID NO: 173173 - RNA, 20 nt, Homo sapiens
uacccgugaauguuuauucu

SEQ ID NO: 173174 - RNA, 22 nt, Homo sapiens
uacccugaaggaaaguauguuu

SEQ ID NO: 173175 - RNA, 22 nt, Homo sapiens
uaccucagccaaugcccagaag

SEQ ID NO: 173176 - RNA, 22 nt, Homo sapiens
uaccugagaaagaaagcccucg

SEQ ID NO: 173177 - RNA, 22 nt, Homo sapiens
uaccugagacaacuuugaggaa

SEQ ID NO: 173178 - RNA, 22 nt, Homo sapiens
uacuacuuucucuucugggaaa

SEQ ID NO: 173179 - RNA, 22 nt, Homo sapiens
uacuagaggcgggguuucgcca

SEQ ID NO: 173180 - RNA, 22 nt, Homo sapiens
uacucugcagagaugcauaaca

SEQ ID NO: 173181 - RNA, 20 nt, Homo sapiens
uacugcacuccaaccuaggc

SEQ ID NO: 173182 - RNA, 22 nt, Homo sapiens
uacugcacuccagccuggguga

SEQ ID NO: 173183 - RNA, 23 nt, Homo sapiens
uacugcauccuccgccucuaggg

SEQ ID NO: 173184 - RNA, 22 nt, Homo sapiens
uacugcuuaaaagucaauuacu

SEQ ID NO: 173185 - RNA, 21 nt, Homo sapiens
uacuggagauacagucugcaa

SEQ ID NO: 173186 - RNA, 22 nt, Homo sapiens
uacuguacugcaguucugcaaa

SEQ ID NO: 173187 - RNA, 22 nt, Homo sapiens
uacuguguaguuagaccucaga

SEQ ID NO: 173188 - RNA, 22 nt, Homo sapiens
uacuuuguagauuguuuccuuu

SEQ ID NO: 173189 - RNA, 22 nt, Homo sapiens
uagaaagcaugaccuucagaua

SEQ ID NO: 173190 - RNA, 18 nt, Homo sapiens
uagaauauaggucauucu

SEQ ID NO: 173191 - RNA, 22 nt, Homo sapiens
uagaauguaaauuccaagggca

SEQ ID NO: 173192 - RNA, 23 nt, Homo sapiens
uagaauguuuuuccauguuucuu

SEQ ID NO: 173193 - RNA, 22 nt, Homo sapiens
uagacacugcauauuuuuuuaa

SEQ ID NO: 173194 - RNA, 22 nt, Homo sapiens
uagaccaauuggcauauaguaa

SEQ ID NO: 173195 - RNA, 21 nt, Homo sapiens
uagagagcaauaccuccagag

SEQ ID NO: 173196 - RNA, 21 nt, Homo sapiens
uagagcaacacacgcccucuc

SEQ ID NO: 173197 - RNA, 22 nt, Homo sapiens
uagagccauugcagauguuuga

SEQ ID NO: 173198 - RNA, 22 nt, Homo sapiens
uagaggaaugaauuuggccaga

SEQ ID NO: 173199 - RNA, 22 nt, Homo sapiens
uagagguagguguaugaacuag

SEQ ID NO: 173200 - RNA, 22 nt, Homo sapiens
uagagguauaccaaaaaggcau

SEQ ID NO: 173201 - RNA, 22 nt, Homo sapiens
uagagguucuaagauucucaga

SEQ ID NO: 173202 - RNA, 22 nt, Homo sapiens
uagaucaacuuugguaagagaa

SEQ ID NO: 173203 - RNA, 22 nt, Homo sapiens
uagaucuuuaaaaggugcuaga

SEQ ID NO: 173204 - RNA, 22 nt, Homo sapiens
uagauuaucucaccacucgagu

SEQ ID NO: 173205 - RNA, 22 nt, Homo sapiens
uagauuaucuguaugugcucuu

SEQ ID NO: 173206 - RNA, 22 nt, Homo sapiens
uagauucaucuguuccuuuuga

SEQ ID NO: 173207 - RNA, 22 nt, Homo sapiens
uagauuguaauaugcagaaugg

SEQ ID NO: 173208 - RNA, 22 nt, Homo sapiens
uagcaaaucaauggaauugaag

SEQ ID NO: 173209 - RNA, 21 nt, Homo sapiens
uagcaaauugcuauuaaggca

SEQ ID NO: 173210 - RNA, 22 nt, Homo sapiens
uagcaacauucagcucagguac

SEQ ID NO: 173211 - RNA, 22 nt, Homo sapiens
uagcaagaugaauuugugcaaa

SEQ ID NO: 173212 - RNA, 22 nt, Homo sapiens
uagcacaugucagguaauuugc

SEQ ID NO: 173213 - RNA, 22 nt, Homo sapiens
uagcacugucuugcaccugugc

SEQ ID NO: 173214 - RNA, 22 nt, Homo sapiens
uagcagaauauaccucuuacuu

SEQ ID NO: 173215 - RNA, 20 nt, Homo sapiens
uagcagcagacagagggagg

SEQ ID NO: 173216 - RNA, 22 nt, Homo sapiens
uagcagcaucucuggcuucuac

SEQ ID NO: 173217 - RNA, 19 nt, Homo sapiens
uagcagcaugauuuauaau

SEQ ID NO: 173218 - RNA, 22 nt, Homo sapiens
uagcagcauuuuuguagaguau

SEQ ID NO: 173219 - RNA, 21 nt, Homo sapiens
uagcagcguuguugcaaaugu

SEQ ID NO: 173220 - RNA, 22 nt, Homo sapiens
uagcaguauggagcgaggccca

SEQ ID NO: 173221 - RNA, 22 nt, Homo sapiens
uagcaguauugaaagaugaggg

SEQ ID NO: 173222 - RNA, 22 nt, Homo sapiens
uagcagugugaaaacagacuaa

SEQ ID NO: 173223 - RNA, 22 nt, Homo sapiens
uagcugcaaaauauagacuucu

SEQ ID NO: 173224 - RNA, 22 nt, Homo sapiens
uagcugcacuuacaagugagaa

SEQ ID NO: 173225 - RNA, 22 nt, Homo sapiens
uagcuucuccauagcuccaugu

SEQ ID NO: 173226 - RNA, 18 nt, Homo sapiens
uaggaacauugauuggag

SEQ ID NO: 173227 - RNA, 19 nt, Homo sapiens
uaggacccugguggccccc

SEQ ID NO: 173228 - RNA, 20 nt, Homo sapiens
uaggagcaaugagaguagaa

SEQ ID NO: 173229 - RNA, 22 nt, Homo sapiens
uaggagcacaaacccuacugug

SEQ ID NO: 173230 - RNA, 22 nt, Homo sapiens
uaggagcacagcagcauguggg

SEQ ID NO: 173231 - RNA, 22 nt, Homo sapiens
uaggcaaguugcccaaucucuc

SEQ ID NO: 173232 - RNA, 22 nt, Homo sapiens
uaggcaauguggcgaaacucug

SEQ ID NO: 173233 - RNA, 22 nt, Homo sapiens
uaggcaguguucucacuuguaa

SEQ ID NO: 173234 - RNA, 22 nt, Homo sapiens
uaggcaguuuuccuuucacagu

SEQ ID NO: 173235 - RNA, 22 nt, Homo sapiens
uaggggcacacuucgguuagca

SEQ ID NO: 173236 - RNA, 22 nt, Homo sapiens
uagguaaguaugugugaugggg

SEQ ID NO: 173237 - RNA, 22 nt, Homo sapiens
uagguacuuaagaucucagcua

SEQ ID NO: 173238 - RNA, 22 nt, Homo sapiens
uagguaguuagcauacuacaca

SEQ ID NO: 173239 - RNA, 22 nt, Homo sapiens
uaggugaauguaguaagguguu

SEQ ID NO: 173240 - RNA, 22 nt, Homo sapiens
uaggugauugaagguggaaugu

SEQ ID NO: 173241 - RNA, 22 nt, Homo sapiens
uaggugguuugaaauacucaag

SEQ ID NO: 173242 - RNA, 22 nt, Homo sapiens
uagguuauucauucaucauuua

SEQ ID NO: 173243 - RNA, 22 nt, Homo sapiens
uaguaaacauuuuucuaucauu

SEQ ID NO: 173244 - RNA, 22 nt, Homo sapiens
uaguagagauggggcacaugcc

SEQ ID NO: 173245 - RNA, 22 nt, Homo sapiens
uaguagcaccucucaugagcuu

SEQ ID NO: 173246 - RNA, 22 nt, Homo sapiens
uagucaaaucugaaggaaauuu

SEQ ID NO: 173247 - RNA, 22 nt, Homo sapiens
uagucagcaauguucauguucu

SEQ ID NO: 173248 - RNA, 21 nt, Homo sapiens
uagugcagugggguaugacuu

SEQ ID NO: 173249 - RNA, 21 nt, Homo sapiens
uagugcugaggcaguauggga

SEQ ID NO: 173250 - RNA, 22 nt, Homo sapiens
uagugcugugauauuuuuggcc

SEQ ID NO: 173251 - RNA, 22 nt, Homo sapiens
uaguguuuuucauuggcagagg

SEQ ID NO: 173252 - RNA, 22 nt, Homo sapiens
uaguucauuauguguugcucag

SEQ ID NO: 173253 - RNA, 22 nt, Homo sapiens
uaguugcaucuuaggucuguga

SEQ ID NO: 173254 - RNA, 20 nt, Homo sapiens
uaguuggugauacagugcau

SEQ ID NO: 173255 - RNA, 22 nt, Homo sapiens
uauacaugugccauguuggugu

SEQ ID NO: 173256 - RNA, 22 nt, Homo sapiens
uauacugucuuuguaugccuag

SEQ ID NO: 173257 - RNA, 20 nt, Homo sapiens
uauagcaauuuuuuucuccu

SEQ ID NO: 173258 - RNA, 22 nt, Homo sapiens
uauaugcaacauaguguaugug

SEQ ID NO: 173259 - RNA, 22 nt, Homo sapiens
uauaugcucugggauccugaaa

SEQ ID NO: 173260 - RNA, 22 nt, Homo sapiens
uauauguucuugcacuggaaag

SEQ ID NO: 173261 - RNA, 22 nt, Homo sapiens
uauauguuuucauaaggcuaga

SEQ ID NO: 173262 - RNA, 22 nt, Homo sapiens
uaucaacaggguggccagugua

SEQ ID NO: 173263 - RNA, 19 nt, Homo sapiens
uaucaaguaugcacuguac

SEQ ID NO: 173264 - RNA, 23 nt, Homo sapiens
uaucacacuuucucugugccaca

SEQ ID NO: 173265 - RNA, 22 nt, Homo sapiens
uaucacagaggguauccuagag

SEQ ID NO: 173266 - RNA, 22 nt, Homo sapiens
uaucacagauauuaugggccaa

SEQ ID NO: 173267 - RNA, 22 nt, Homo sapiens
uaucacagcgggguguacaccc

SEQ ID NO: 173268 - RNA, 22 nt, Homo sapiens
uaucacagguggacugcacacc

SEQ ID NO: 173269 - RNA, 22 nt, Homo sapiens
uaucacaguagaacucuuucca

SEQ ID NO: 173270 - RNA, 22 nt, Homo sapiens
uaucagaucccaauuucuggcc

SEQ ID NO: 173271 - RNA, 22 nt, Homo sapiens
uaucagcacaguggguucaugg

SEQ ID NO: 173272 - RNA, 22 nt, Homo sapiens
uaucaucauguuuuugcugugu

SEQ ID NO: 173273 - RNA, 22 nt, Homo sapiens
uaucccaguggauguaccccau

SEQ ID NO: 173274 - RNA, 22 nt, Homo sapiens
uaucccuguggacuucccaaca

SEQ ID NO: 173275 - RNA, 20 nt, Homo sapiens
uaucuacuugcaaaugccau

SEQ ID NO: 173276 - RNA, 22 nt, Homo sapiens
uaucucacauauucaguagguu

SEQ ID NO: 173277 - RNA, 22 nt, Homo sapiens
uaucucagaugagacuuguaac

SEQ ID NO: 173278 - RNA, 21 nt, Homo sapiens
uaucucaguuuuccuuugugg

SEQ ID NO: 173279 - RNA, 18 nt, Homo sapiens
uaucucauuucuuagguc

SEQ ID NO: 173280 - RNA, 22 nt, Homo sapiens
uaucucuguggguagugcugaa

SEQ ID NO: 173281 - RNA, 22 nt, Homo sapiens
uaucugcacuucugucuagguc

SEQ ID NO: 173282 - RNA, 22 nt, Homo sapiens
uaugaaucugagagaucuggaa

SEQ ID NO: 173283 - RNA, 22 nt, Homo sapiens
uaugaaucuggcuacuccaggg

SEQ ID NO: 173284 - RNA, 23 nt, Homo sapiens
uaugacagaggaagggggagcug

SEQ ID NO: 173285 - RNA, 22 nt, Homo sapiens
uaugacucagaaggcacacaca

SEQ ID NO: 173286 - RNA, 22 nt, Homo sapiens
uaugacuuuugaauacagaugg

SEQ ID NO: 173287 - RNA, 22 nt, Homo sapiens
uaugagcacauauguaucuaug

SEQ ID NO: 173288 - RNA, 22 nt, Homo sapiens
uaugaugcuguuuagaaucucu

SEQ ID NO: 173289 - RNA, 19 nt, Homo sapiens
uaugcaacuuauagugcug

SEQ ID NO: 173290 - RNA, 22 nt, Homo sapiens
uaugcacaugugccugggugug

SEQ ID NO: 173291 - RNA, 22 nt, Homo sapiens
uaugcacuaggcacuguguuug

SEQ ID NO: 173292 - RNA, 22 nt, Homo sapiens
uaugcacuauggaaguagcuca

SEQ ID NO: 173293 - RNA, 22 nt, Homo sapiens
uaugccuuugaccauuuuguga

SEQ ID NO: 173294 - RNA, 22 nt, Homo sapiens
uaugcuguuucugauuuaggga

SEQ ID NO: 173295 - RNA, 22 nt, Homo sapiens
uauggauguuaagguucacagc

SEQ ID NO: 173296 - RNA, 22 nt, Homo sapiens
uauggauucuagcucaguaggu

SEQ ID NO: 173297 - RNA, 22 nt, Homo sapiens
uauggauuucauuagacuugag

SEQ ID NO: 173298 - RNA, 22 nt, Homo sapiens
uauggauuugccuauucuguau

SEQ ID NO: 173299 - RNA, 22 nt, Homo sapiens
uauggcaaugcauaggaaggaa

SEQ ID NO: 173300 - RNA, 22 nt, Homo sapiens
uauggcugcuuucacacuacaa

SEQ ID NO: 173301 - RNA, 21 nt, Homo sapiens
uauggcuuagucaguguuucc

SEQ ID NO: 173302 - RNA, 22 nt, Homo sapiens
uauggcuucuauaaggaagcuu

SEQ ID NO: 173303 - RNA, 22 nt, Homo sapiens
uauggcuucuuauucuuucccg

SEQ ID NO: 173304 - RNA, 22 nt, Homo sapiens
uauggcuuuuaacugucguaug

SEQ ID NO: 173305 - RNA, 22 nt, Homo sapiens
uauggguaguacaaaguguaua

SEQ ID NO: 173306 - RNA, 22 nt, Homo sapiens
uauggguuuuugucuguuuacu

SEQ ID NO: 173307 - RNA, 22 nt, Homo sapiens
uaugucuauuauguagcaggaa

SEQ ID NO: 173308 - RNA, 22 nt, Homo sapiens
uaugucuggaguuacugagcug

SEQ ID NO: 173309 - RNA, 22 nt, Homo sapiens
uaugugcaaauuaauugcuaga

SEQ ID NO: 173310 - RNA, 22 nt, Homo sapiens
uaugugguuaauaggaauuugu

SEQ ID NO: 173311 - RNA, 22 nt, Homo sapiens
uauuacugucaauaucacagaa

SEQ ID NO: 173312 - RNA, 22 nt, Homo sapiens
uauuagugucuuuugguuagaa

SEQ ID NO: 173313 - RNA, 22 nt, Homo sapiens
uauuauuguccuucuauaccca

SEQ ID NO: 173314 - RNA, 22 nt, Homo sapiens
uauucaagccaaauucaagcca

SEQ ID NO: 173315 - RNA, 22 nt, Homo sapiens
uauuccacuauuaguccagaug

SEQ ID NO: 173316 - RNA, 22 nt, Homo sapiens
uauuccacucuguuggagguaa

SEQ ID NO: 173317 - RNA, 22 nt, Homo sapiens
uauuccauuugggucaggauga

SEQ ID NO: 173318 - RNA, 22 nt, Homo sapiens
uauuccauuugugaaaggaagu

SEQ ID NO: 173319 - RNA, 22 nt, Homo sapiens
uauugaacgugggauauugaag

SEQ ID NO: 173320 - RNA, 22 nt, Homo sapiens
uauugacauuacagugggucuu

SEQ ID NO: 173321 - RNA, 22 nt, Homo sapiens
uauugacuuuuuuguuaggagg

SEQ ID NO: 173322 - RNA, 22 nt, Homo sapiens
uauugcaacagaagaaagaguc

SEQ ID NO: 173323 - RNA, 22 nt, Homo sapiens
uauugcaauuggggaaacuggg

SEQ ID NO: 173324 - RNA, 22 nt, Homo sapiens
uauugcacuccagccuuggcaa

SEQ ID NO: 173325 - RNA, 22 nt, Homo sapiens
uauugcacuuuuccauaggagu

SEQ ID NO: 173326 - RNA, 22 nt, Homo sapiens
uauugcagaaugugaguuggca

SEQ ID NO: 173327 - RNA, 22 nt, Homo sapiens
uauugcccugcuuuguucuaaa

SEQ ID NO: 173328 - RNA, 22 nt, Homo sapiens
uauugcuaaaacucaugguugc

SEQ ID NO: 173329 - RNA, 22 nt, Homo sapiens
uauugcucaugcauuuaauuuc

SEQ ID NO: 173330 - RNA, 22 nt, Homo sapiens
uauugcuggauguauuacaugu

SEQ ID NO: 173331 - RNA, 22 nt, Homo sapiens
uauugcuuuacucucuuauccu

SEQ ID NO: 173332 - RNA, 22 nt, Homo sapiens
uauuguccaauaggauguuccu

SEQ ID NO: 173333 - RNA, 22 nt, Homo sapiens
uauuguccacuuugcacugugu

SEQ ID NO: 173334 - RNA, 22 nt, Homo sapiens
uauuugguagcuauuuugcagu

SEQ ID NO: 173335 - RNA, 22 nt, Homo sapiens
uauuugguuauaugaguaaguu

SEQ ID NO: 173336 - RNA, 22 nt, Homo sapiens
ucaaaaccucagagaguagagc

SEQ ID NO: 173337 - RNA, 22 nt, Homo sapiens
ucaaagacacacaaggagaagg

SEQ ID NO: 173338 - RNA, 18 nt, Homo sapiens
ucaaauacuuugggcagu

SEQ ID NO: 173339 - RNA, 22 nt, Homo sapiens
ucaaaugcacguagagaaaaua

SEQ ID NO: 173340 - RNA, 17 nt, Homo sapiens
ucaaaugcucccaguga

SEQ ID NO: 173341 - RNA, 22 nt, Homo sapiens
ucaaauguucccuguacuggcc

SEQ ID NO: 173342 - RNA, 21 nt, Homo sapiens
ucaaauugaaauuaggucauu

SEQ ID NO: 173343 - RNA, 22 nt, Homo sapiens
ucaacguauuuauauagcagag

SEQ ID NO: 173344 - RNA, 18 nt, Homo sapiens
ucaagcaauugucaugcc

SEQ ID NO: 173345 - RNA, 18 nt, Homo sapiens
ucaagcuauugucaugcc

SEQ ID NO: 173346 - RNA, 22 nt, Homo sapiens
ucaaggacucagagagggauua

SEQ ID NO: 173347 - RNA, 21 nt, Homo sapiens
ucaaggaguauacguaugcca

SEQ ID NO: 173348 - RNA, 22 nt, Homo sapiens
ucaaggcacuagcugagcugca

SEQ ID NO: 173349 - RNA, 22 nt, Homo sapiens
ucaaggcaguggccuuccuucu

SEQ ID NO: 173350 - RNA, 22 nt, Homo sapiens
ucaaguaagaagugggcauaaa

SEQ ID NO: 173351 - RNA, 22 nt, Homo sapiens
ucaauugcuuaugaagauacau

SEQ ID NO: 173352 - RNA, 20 nt, Homo sapiens
ucacaagccaagaucacguc

SEQ ID NO: 173353 - RNA, 22 nt, Homo sapiens
ucacaauguaaaugaggguugg

SEQ ID NO: 173354 - RNA, 22 nt, Homo sapiens
ucacaccauucuucuacuucag

SEQ ID NO: 173355 - RNA, 19 nt, Homo sapiens
ucacacuguggcuucuuua

SEQ ID NO: 173356 - RNA, 22 nt, Homo sapiens
ucacagaggagaagaccuuuaa

SEQ ID NO: 173357 - RNA, 22 nt, Homo sapiens
ucacagccuaguuuuauacauu

SEQ ID NO: 173358 - RNA, 22 nt, Homo sapiens
ucacagcuaaaaugaaaguagu

SEQ ID NO: 173359 - RNA, 22 nt, Homo sapiens
ucacaguaacuuuguugcuuuu

SEQ ID NO: 173360 - RNA, 22 nt, Homo sapiens
ucacaguauucaugaacaugga

SEQ ID NO: 173361 - RNA, 20 nt, Homo sapiens
ucacagucacacauaauccu

SEQ ID NO: 173362 - RNA, 22 nt, Homo sapiens
ucacagucacugucacguugaa

SEQ ID NO: 173363 - RNA, 17 nt, Homo sapiens
ucacaguguuaggauga

SEQ ID NO: 173364 - RNA, 23 nt, Homo sapiens
ucacaguuacuuuugcaucaacc

SEQ ID NO: 173365 - RNA, 20 nt, Homo sapiens
ucacauccucucccaacaug

SEQ ID NO: 173366 - RNA, 22 nt, Homo sapiens
ucacaugaagauuuuaguauac

SEQ ID NO: 173367 - RNA, 22 nt, Homo sapiens
ucacauggauuaacucauuuau

SEQ ID NO: 173368 - RNA, 18 nt, Homo sapiens
ucacauggccgagagaga

SEQ ID NO: 173369 - RNA, 22 nt, Homo sapiens
ucacauggggaagggacuagcu

SEQ ID NO: 173370 - RNA, 22 nt, Homo sapiens
ugccaguguuuuguugaagauu

SEQ ID NO: 173371 - RNA, 22 nt, Homo sapiens
ugccauagcaaugguaagcuga

SEQ ID NO: 173372 - RNA, 19 nt, Homo sapiens
ugccauguagcacaugguc

SEQ ID NO: 173373 - RNA, 22 nt, Homo sapiens
ugccauugcacuccagccuggg

SEQ ID NO: 173374 - RNA, 22 nt, Homo sapiens
ugcccuguaucccacuguuuca

SEQ ID NO: 173375 - RNA, 22 nt, Homo sapiens
ugccuacagaaggggcucagca

SEQ ID NO: 173376 - RNA, 18 nt, Homo sapiens
ugccuacugggcucaagc

SEQ ID NO: 173377 - RNA, 23 nt, Homo sapiens
ugccuagaugcugcccugggaca

SEQ ID NO: 173378 - RNA, 22 nt, Homo sapiens
ugccuaggcuggagugcagugg

SEQ ID NO: 173379 - RNA, 22 nt, Homo sapiens
ugccuaguggaaggagagcaaa

SEQ ID NO: 173380 - RNA, 20 nt, Homo sapiens
ugccugacacucuuugcuuc

SEQ ID NO: 173381 - RNA, 22 nt, Homo sapiens
ugccugagcccagcccuguagu

SEQ ID NO: 173382 - RNA, 22 nt, Homo sapiens
ugccugcugucuaauauauucu

SEQ ID NO: 173383 - RNA, 22 nt, Homo sapiens
ugccuuauuccaacugagcucu

SEQ ID NO: 173384 - RNA, 16 nt, Homo sapiens
ugccuucuucuguauu

SEQ ID NO: 173385 - RNA, 21 nt, Homo sapiens
ugcuacugucacuuccuuugu

SEQ ID NO: 173386 - RNA, 22 nt, Homo sapiens
ugcuaugucagccaggcugguc

SEQ ID NO: 173387 - RNA, 21 nt, Homo sapiens
ugcuauguuguccaggcuggc

SEQ ID NO: 173388 - RNA, 23 nt, Homo sapiens
ugcugagaccuagauccuaaaga

SEQ ID NO: 173389 - RNA, 22 nt, Homo sapiens
ugcugcacaguucuuaagauua

SEQ ID NO: 173390 - RNA, 22 nt, Homo sapiens
ugcugguauuuggaccagccug

SEQ ID NO: 173391 - RNA, 22 nt, Homo sapiens
ugcuggugauuaaauccugaag

SEQ ID NO: 173392 - RNA, 22 nt, Homo sapiens
ugcuggugucaucaaggcuuug

SEQ ID NO: 173393 - RNA, 22 nt, Homo sapiens
ugcuugagacacauaugaauuu

SEQ ID NO: 173394 - RNA, 21 nt, Homo sapiens
ugcuuuggucauacuucuucc

SEQ ID NO: 173395 - RNA, 22 nt, Homo sapiens
uggaaaacaugcacauuggauu

SEQ ID NO: 173396 - RNA, 22 nt, Homo sapiens
uggaaaauuaggggagguuaua

SEQ ID NO: 173397 - RNA, 22 nt, Homo sapiens
uggaaaguacuugaguuuguau

SEQ ID NO: 173398 - RNA, 22 nt, Homo sapiens
uggaaaguccaagccaaccggg

SEQ ID NO: 173399 - RNA, 20 nt, Homo sapiens
uggaacuuaauugauggaca

SEQ ID NO: 173400 - RNA, 22 nt, Homo sapiens
uuaaggcagugucuaugccagu

SEQ ID NO: 173401 - RNA, 22 nt, Homo sapiens
uuaaggcauucuuugucuucau

SEQ ID NO: 173402 - RNA, 22 nt, Homo sapiens
uuaaggcuuguacuuguuuucu

SEQ ID NO: 173403 - RNA, 22 nt, Homo sapiens
uuaagggaggagcuucaagaug

SEQ ID NO: 173404 - RNA, 19 nt, Homo sapiens
uuaagguacuuagaugugu

SEQ ID NO: 173405 - RNA, 22 nt, Homo sapiens
uuaaguacuucccuguuggaca

SEQ ID NO: 173406 - RNA, 19 nt, Homo sapiens
uuaaguaguuagagggucu

SEQ ID NO: 173407 - RNA, 22 nt, Homo sapiens
uuaagucacacuagacaacuga

SEQ ID NO: 173408 - RNA, 22 nt, Homo sapiens
uuaaguguaaguggugugggac

SEQ ID NO: 173409 - RNA, 22 nt, Homo sapiens
uuaaucaggccguuuccuaaga

SEQ ID NO: 173410 - RNA, 22 nt, Homo sapiens
uuaaugcuuggggaguaguucu

SEQ ID NO: 173411 - RNA, 22 nt, Homo sapiens
uuaauguaucuaucacaucaca

SEQ ID NO: 173412 - RNA, 22 nt, Homo sapiens
uuacaaguggcaucucucugga

SEQ ID NO: 173413 - RNA, 22 nt, Homo sapiens
uuacagucucaagagugcugca

SEQ ID NO: 173414 - RNA, 22 nt, Homo sapiens
uuacaguggugaccuuguauug

SEQ ID NO: 173415 - RNA, 19 nt, Homo sapiens
uuacauccauugcauuuca

SEQ ID NO: 173416 - RNA, 22 nt, Homo sapiens
uuacaugcaugacaaggugcca

SEQ ID NO: 173417 - RNA, 22 nt, Homo sapiens
uuacauguuguggguuguggcc

SEQ ID NO: 173418 - RNA, 22 nt, Homo sapiens
uuacauugcuucaaauucagug

SEQ ID NO: 173419 - RNA, 22 nt, Homo sapiens
uuagagcacugaucugcucuuu

SEQ ID NO: 173420 - RNA, 22 nt, Homo sapiens
uuagaucaacauggaacucuau

SEQ ID NO: 173421 - RNA, 18 nt, Homo sapiens
uuagaugguuuuaaaacu

SEQ ID NO: 173422 - RNA, 22 nt, Homo sapiens
uuagauuauugguguuuugcaa

SEQ ID NO: 173423 - RNA, 22 nt, Homo sapiens
uuagcacaguucauucauguua

SEQ ID NO: 173424 - RNA, 22 nt, Homo sapiens
uuagcacaucuuucuauguaag

SEQ ID NO: 173425 - RNA, 22 nt, Homo sapiens
uuagcacugagaauggcuugcu

SEQ ID NO: 173426 - RNA, 22 nt, Homo sapiens
uuagcagcacaaaagcagacua

SEQ ID NO: 173427 - RNA, 22 nt, Homo sapiens
uuagccggguguguuggcgggc

SEQ ID NO: 173428 - RNA, 22 nt, Homo sapiens
uuaggacacuguggguggguca

SEQ ID NO: 173429 - RNA, 22 nt, Homo sapiens
uuaggcaaugcucucaaauuug

SEQ ID NO: 173430 - RNA, 22 nt, Homo sapiens
auucagaggggcagcugucuug

SEQ ID NO: 173431 - RNA, 22 nt, Homo sapiens
auucaucagggauauuggucug

SEQ ID NO: 173432 - RNA, 20 nt, Homo sapiens
auucauggaggagcaauugg

SEQ ID NO: 173433 - RNA, 20 nt, Homo sapiens
auucauggugguacguuguc

SEQ ID NO: 173434 - RNA, 22 nt, Homo sapiens
auuccacuuacaugaaguaccu

SEQ ID NO: 173435 - RNA, 20 nt, Homo sapiens
auuccacuuauaugaggucc

SEQ ID NO: 173436 - RNA, 20 nt, Homo sapiens
auuccacuuguuugagguac

SEQ ID NO: 173437 - RNA, 22 nt, Homo sapiens
auuccagauggaguugaggguu

SEQ ID NO: 173438 - RNA, 22 nt, Homo sapiens
auuccaguuugugagaagcugu

SEQ ID NO: 173439 - RNA, 22 nt, Homo sapiens
auuccauaguacagugaugagu

SEQ ID NO: 173440 - RNA, 22 nt, Homo sapiens
auuccauuuguuaucacacccg

SEQ ID NO: 173441 - RNA, 22 nt, Homo sapiens
auucccuuagcugccucagccu

SEQ ID NO: 173442 - RNA, 22 nt, Homo sapiens
auuccuuaggcccuuugguuag

SEQ ID NO: 173443 - RNA, 22 nt, Homo sapiens
auucuauaguccuaggauuggg

SEQ ID NO: 173444 - RNA, 22 nt, Homo sapiens
auucuugcuugaacuuggugca

SEQ ID NO: 173445 - RNA, 22 nt, Homo sapiens
auugaacuuaaaagacuugcca

SEQ ID NO: 173446 - RNA, 22 nt, Homo sapiens
auugacaguuggccaguaagug

SEQ ID NO: 173447 - RNA, 22 nt, Homo sapiens
auugagacaaauuuguaugcag

SEQ ID NO: 173448 - RNA, 22 nt, Homo sapiens
auugagcaauuccuaugugcuu

SEQ ID NO: 173449 - RNA, 22 nt, Homo sapiens
auugagcuuuuuaaaauauagu

SEQ ID NO: 173450 - RNA, 22 nt, Homo sapiens
auugaguaacaauuuuguucaa

SEQ ID NO: 173451 - RNA, 22 nt, Homo sapiens
auugcaacuuccgccuccuggg

SEQ ID NO: 173452 - RNA, 22 nt, Homo sapiens
auugcaaucuccgccuccgggg

SEQ ID NO: 173453 - RNA, 21 nt, Homo sapiens
auugcacaauauacccaugua

SEQ ID NO: 173454 - RNA, 22 nt, Homo sapiens
auugcacacagaaucaggguaa

SEQ ID NO: 173455 - RNA, 22 nt, Homo sapiens
auugcacaccagucugggcaaa

SEQ ID NO: 173456 - RNA, 19 nt, Homo sapiens
auugcacuccaaccugggu

SEQ ID NO: 173457 - RNA, 23 nt, Homo sapiens
auugcacuccagccuaccugggc

SEQ ID NO: 173458 - RNA, 22 nt, Homo sapiens
auugcacuccagccuaggcaac

SEQ ID NO: 173459 - RNA, 22 nt, Homo sapiens
auugcacuccagccugggcaac

SEQ ID NO: 173460 - RNA, 22 nt, Homo sapiens
auugcacuccagccugggcgac

SEQ ID NO: 173461 - RNA, 22 nt, Homo sapiens
auugcacuccagccugggcuag

SEQ ID NO: 173462 - RNA, 22 nt, Homo sapiens
auugcacuccagccuuggggau

SEQ ID NO: 173463 - RNA, 22 nt, Homo sapiens
auugcacuccagcuugggugac

SEQ ID NO: 173464 - RNA, 22 nt, Homo sapiens
auugcacuccagucucaccagg

SEQ ID NO: 173465 - RNA, 22 nt, Homo sapiens
auugcacuccauccuaggugac

SEQ ID NO: 173466 - RNA, 20 nt, Homo sapiens
auugcagcaugauuuauaau

SEQ ID NO: 173467 - RNA, 19 nt, Homo sapiens
auugcaguguaaaacuauu

SEQ ID NO: 173468 - RNA, 22 nt, Homo sapiens
auugcauaaacacauuucuuau

SEQ ID NO: 173469 - RNA, 22 nt, Homo sapiens
auugcauuuucagguuggucug

SEQ ID NO: 173470 - RNA, 21 nt, Homo sapiens
auugcccaaaguggaggggaa

SEQ ID NO: 173471 - RNA, 22 nt, Homo sapiens
auugcuaacugaaauaagacca

SEQ ID NO: 173472 - RNA, 22 nt, Homo sapiens
auuggacagcauuucuagacuu

SEQ ID NO: 173473 - RNA, 22 nt, Homo sapiens
auuggcaauagcuuucuuacua

SEQ ID NO: 173474 - RNA, 22 nt, Homo sapiens
auuggccccguuuuaaauguca

SEQ ID NO: 173475 - RNA, 22 nt, Homo sapiens
auuguaauuuuagagaaagugg

SEQ ID NO: 173476 - RNA, 22 nt, Homo sapiens
auuguacuccagccugggcaaa

SEQ ID NO: 173477 - RNA, 22 nt, Homo sapiens
auuguacucuagccucugggca

SEQ ID NO: 173478 - RNA, 22 nt, Homo sapiens
auuguacuuaagccugggugaa

SEQ ID NO: 173479 - RNA, 21 nt, Homo sapiens
auuguauguaaaccaaaugag

SEQ ID NO: 173480 - RNA, 22 nt, Homo sapiens
auuguccuacuaggguuccagu

SEQ ID NO: 173481 - RNA, 20 nt, Homo sapiens
auuguccuugauuacacaga

SEQ ID NO: 173482 - RNA, 22 nt, Homo sapiens
auuguuccccggucauuuuugu

SEQ ID NO: 173483 - RNA, 22 nt, Homo sapiens
auuuccuguaggggcuugcgaa

SEQ ID NO: 173484 - RNA, 22 nt, Homo sapiens
auuuggcaacguagggaggcau

SEQ ID NO: 173485 - RNA, 22 nt, Homo sapiens
auuuggcauagaguaucauucu

SEQ ID NO: 173486 - RNA, 20 nt, Homo sapiens
auuuggcauaguuuaagcaa

SEQ ID NO: 173487 - RNA, 22 nt, Homo sapiens
auuugucaauacacuucuucca

SEQ ID NO: 173488 - RNA, 22 nt, Homo sapiens
auuugucacuuaacagccauua

SEQ ID NO: 173489 - RNA, 22 nt, Homo sapiens
auuuugcauugcuguaaaggaa

SEQ ID NO: 173490 - RNA, 18 nt, Homo sapiens
auuuuugcaguccacaug

SEQ ID NO: 173491 - RNA, 22 nt, Homo sapiens
auuuuuggauauagggaaggau

SEQ ID NO: 173492 - RNA, 22 nt, Homo sapiens
auuuuugguuucaccugcacgc

SEQ ID NO: 173493 - RNA, 22 nt, Homo sapiens
caaaggauucauuuccaggagu

SEQ ID NO: 173494 - RNA, 22 nt, Homo sapiens
caaaggcuguuauaggccagga

SEQ ID NO: 173495 - RNA, 22 nt, Homo sapiens
caaagugguuuauacaugauug

SEQ ID NO: 173496 - RNA, 22 nt, Homo sapiens
caaaugacaucauuucauucaa

SEQ ID NO: 173497 - RNA, 22 nt, Homo sapiens
caaaugaucugcuggccucagc

SEQ ID NO: 173498 - RNA, 22 nt, Homo sapiens
caaauugcuuguggaggauaau

SEQ ID NO: 173499 - RNA, 20 nt, Homo sapiens
caaauugcuuucuugguuuu

SEQ ID NO: 173500 - RNA, 22 nt, Homo sapiens
caacauccaccuccuggguuca

SEQ ID NO: 173501 - RNA, 22 nt, Homo sapiens
caaggugcugagacaggagccc

SEQ ID NO: 173502 - RNA, 22 nt, Homo sapiens
caagugcucuaggauccugagu

SEQ ID NO: 173503 - RNA, 22 nt, Homo sapiens
caaguguuuccuuaaauacuug

SEQ ID NO: 173504 - RNA, 21 nt, Homo sapiens
caaugacacuguagcugugcu

SEQ ID NO: 173505 - RNA, 22 nt, Homo sapiens
caaugcauuauucucccacuuc

SEQ ID NO: 173506 - RNA, 22 nt, Homo sapiens
caaugguuuuuuaguauaagua

SEQ ID NO: 173507 - RNA, 22 nt, Homo sapiens
caaugugcuuggggcacaugag

SEQ ID NO: 173508 - RNA, 22 nt, Homo sapiens
cacaaaguagauuagucuucca

SEQ ID NO: 173509 - RNA, 22 nt, Homo sapiens
cacaaccuccgccuccuggguu

SEQ ID NO: 173510 - RNA, 22 nt, Homo sapiens
cacaaugucugguaggccacuu

SEQ ID NO: 173511 - RNA, 22 nt, Homo sapiens
cacaccuacuagggccgugggc

SEQ ID NO: 173512 - RNA, 22 nt, Homo sapiens
cacccaguaagcaugaggcccu

SEQ ID NO: 173513 - RNA, 22 nt, Homo sapiens
cacccagucaucuuggguuuuu

SEQ ID NO: 173514 - RNA, 22 nt, Homo sapiens
caccgagguuggagugcagugg

SEQ ID NO: 173515 - RNA, 22 nt, Homo sapiens
caccuagacuggagugcagugg

SEQ ID NO: 173516 - RNA, 22 nt, Homo sapiens
cacuaccucuacaggcagcugg

SEQ ID NO: 173517 - RNA, 22 nt, Homo sapiens
cacuagagaauagguaguucug

SEQ ID NO: 173518 - RNA, 22 nt, Homo sapiens
cacucaguuugugguacuuugu

SEQ ID NO: 173519 - RNA, 22 nt, Homo sapiens
cacugcacuccagcuugugggc

SEQ ID NO: 173520 - RNA, 22 nt, Homo sapiens
cacugcacuccagcuuugguga

SEQ ID NO: 173521 - RNA, 22 nt, Homo sapiens
cacugcauccuccaccugccag

SEQ ID NO: 173522 - RNA, 22 nt, Homo sapiens
cacugcauccucugccuggcgg

SEQ ID NO: 173523 - RNA, 22 nt, Homo sapiens
cacugcauggccacccauguua

SEQ ID NO: 173524 - RNA, 22 nt, Homo sapiens
cacugcauggucuagcuggguu

SEQ ID NO: 173525 - RNA, 17 nt, Homo sapiens
cacugggugcaagagga

SEQ ID NO: 173526 - RNA, 22 nt, Homo sapiens
cacugggugccauauguuugcu

SEQ ID NO: 173527 - RNA, 22 nt, Homo sapiens
cacuggucagugaaacaguauu

SEQ ID NO: 173528 - RNA, 22 nt, Homo sapiens
cagaaguauugguaugcucugu

SEQ ID NO: 173529 - RNA, 22 nt, Homo sapiens
cagagaacauucagagcuguag

SEQ ID NO: 173530 - RNA, 22 nt, Homo sapiens
cagagagcuugcccuuguauau

SEQ ID NO: 173531 - RNA, 21 nt, Homo sapiens
cagagaucaucucuguuuuaa

SEQ ID NO: 173532 - RNA, 20 nt, Homo sapiens
cagagcaaagcaguccuggc

SEQ ID NO: 173533 - RNA, 22 nt, Homo sapiens
cagagguaagcaagucagcauu

SEQ ID NO: 173534 - RNA, 22 nt, Homo sapiens
cagagucaagcucuuguuccau

SEQ ID NO: 173535 - RNA, 22 nt, Homo sapiens
cagauaguuguagguguguggc

SEQ ID NO: 173536 - RNA, 22 nt, Homo sapiens
cagauggucuuaaggcagccuu

SEQ ID NO: 173537 - RNA, 22 nt, Homo sapiens
cagcaagucucuaagaguucau

SEQ ID NO: 173538 - RNA, 22 nt, Homo sapiens
cagcacauagcaguugcucagu

SEQ ID NO: 173539 - RNA, 20 nt, Homo sapiens
cagcacgcacaugagacugu

SEQ ID NO: 173540 - RNA, 22 nt, Homo sapiens
cagcagguuuuuaucaguuaag

SEQ ID NO: 173541 - RNA, 22 nt, Homo sapiens
cagcccguaaucccagcacuuu

SEQ ID NO: 173542 - RNA, 22 nt, Homo sapiens
cagcuaaauuguuaaauccaag

SEQ ID NO: 173543 - RNA, 22 nt, Homo sapiens
cagcugaugucgaaugcacucu

SEQ ID NO: 173544 - RNA, 23 nt, Homo sapiens
cagcuucauugaacauaacuccu

SEQ ID NO: 173545 - RNA, 22 nt, Homo sapiens
caggaccucuugccuggaagcc

SEQ ID NO: 173546 - RNA, 22 nt, Homo sapiens
caggcuuuuccacacauggguu

SEQ ID NO: 173547 - RNA, 20 nt, Homo sapiens
cagggcaaugaggagguaaa

SEQ ID NO: 173548 - RNA, 22 nt, Homo sapiens
cagguacuucugggcugagcag

SEQ ID NO: 173549 - RNA, 22 nt, Homo sapiens
cagguaggccaauguuuuccaa

SEQ ID NO: 173550 - RNA, 22 nt, Homo sapiens
cagguagucaacgggucuugga

SEQ ID NO: 173551 - RNA, 22 nt, Homo sapiens
caggugaaugccucuccuucug

SEQ ID NO: 173552 - RNA, 22 nt, Homo sapiens
caguaguagccccuuagaugga

SEQ ID NO: 173553 - RNA, 22 nt, Homo sapiens
cagucacugggauuauggucau

SEQ ID NO: 173554 - RNA, 22 nt, Homo sapiens
cagugguuuucaacccugguug

SEQ ID NO: 173555 - RNA, 22 nt, Homo sapiens
caguucaugguaggcaccauag

SEQ ID NO: 173556 - RNA, 22 nt, Homo sapiens
caguuguuuuaugacauaagau

SEQ ID NO: 173557 - RNA, 22 nt, Homo sapiens
cauacagcuaguaaguguaaga

SEQ ID NO: 173558 - RNA, 22 nt, Homo sapiens
cauauaguaggugcucuguguu

SEQ ID NO: 173559 - RNA, 22 nt, Homo sapiens
cauauucacuuuacagagcugu

SEQ ID NO: 173560 - RNA, 23 nt, Homo sapiens
caucacagagccuuccuugacuc

SEQ ID NO: 173561 - RNA, 19 nt, Homo sapiens
caucacagagucuuccauu

SEQ ID NO: 173562 - RNA, 22 nt, Homo sapiens
caucacaucugcaugguaagua

SEQ ID NO: 173563 - RNA, 22 nt, Homo sapiens
caucacaugcuuauuuuccuca

SEQ ID NO: 173564 - RNA, 21 nt, Homo sapiens
caucacauuacucaaaguccu

SEQ ID NO: 173565 - RNA, 22 nt, Homo sapiens
cauccccugcaccaaccuuuac

SEQ ID NO: 173566 - RNA, 22 nt, Homo sapiens
caugaaagugagaaacuccugg

SEQ ID NO: 173567 - RNA, 22 nt, Homo sapiens
caugcagcacacaugucugugc

SEQ ID NO: 173568 - RNA, 19 nt, Homo sapiens
caugccacugcacuugagu

SEQ ID NO: 173569 - RNA, 22 nt, Homo sapiens
cauggauuuuuuugaauggcag

SEQ ID NO: 173570 - RNA, 22 nt, Homo sapiens
cauggcacaucuuuucugacua

SEQ ID NO: 173571 - RNA, 22 nt, Homo sapiens
cauggccuuuggaaugugucua

SEQ ID NO: 173572 - RNA, 23 nt, Homo sapiens
cauggcuguuaacacuguuugag

SEQ ID NO: 173573 - RNA, 19 nt, Homo sapiens
cauggcuuauaauuuuaau

SEQ ID NO: 173574 - RNA, 22 nt, Homo sapiens
cauggcuuguauaagauucuca

SEQ ID NO: 173575 - RNA, 22 nt, Homo sapiens
cauggcuuuaagcaacaccaag

SEQ ID NO: 173576 - RNA, 22 nt, Homo sapiens
cauggcuuucacaguaaagccu

SEQ ID NO: 173577 - RNA, 22 nt, Homo sapiens
cauggcuuuuauaacaagaaau

SEQ ID NO: 173578 - RNA, 22 nt, Homo sapiens
caugguacugccacagaagagu

SEQ ID NO: 173579 - RNA, 22 nt, Homo sapiens
cauugcaacuucugccucccag

SEQ ID NO: 173580 - RNA, 19 nt, Homo sapiens
cauugcacuccacccuggg

SEQ ID NO: 173581 - RNA, 22 nt, Homo sapiens
cauugcacuccagccuggccaa

SEQ ID NO: 173582 - RNA, 22 nt, Homo sapiens
cauugcacuccagucugggcaa

SEQ ID NO: 173583 - RNA, 22 nt, Homo sapiens
cauugcacuccaucccgggaaa

SEQ ID NO: 173584 - RNA, 22 nt, Homo sapiens
cauugcacuccaucuugggcaa

SEQ ID NO: 173585 - RNA, 16 nt, Homo sapiens
cauugcacucuagccu

SEQ ID NO: 173586 - RNA, 22 nt, Homo sapiens
cauugcacucuaucccgguggg

SEQ ID NO: 173587 - RNA, 22 nt, Homo sapiens
cauugcacugcuucuugggugu

SEQ ID NO: 173588 - RNA, 22 nt, Homo sapiens
cauugcauuuucuuuguaccuu

SEQ ID NO: 173589 - RNA, 22 nt, Homo sapiens
cauugcccuccagccugggcaa

SEQ ID NO: 173590 - RNA, 22 nt, Homo sapiens
cauugcuaaaagucauauauaa

SEQ ID NO: 173591 - RNA, 22 nt, Homo sapiens
cauuggugauuagugaaugaac

SEQ ID NO: 173592 - RNA, 22 nt, Homo sapiens
cauuuugguuaaauagguagcu

SEQ ID NO: 173593 - RNA, 19 nt, Homo sapiens
ccacaaugguugaacuaga

SEQ ID NO: 173594 - RNA, 22 nt, Homo sapiens
ccacccuggagaauuugagguc

SEQ ID NO: 173595 - RNA, 22 nt, Homo sapiens
ccaccuguacuuaagucacuuu

SEQ ID NO: 173596 - RNA, 22 nt, Homo sapiens
ccagguuucuagaauaauuccu

SEQ ID NO: 173597 - RNA, 22 nt, Homo sapiens
ccagucuuggugucuguagcac

SEQ ID NO: 173598 - RNA, 22 nt, Homo sapiens
ccagugcauggaucccaggggg

SEQ ID NO: 173599 - RNA, 22 nt, Homo sapiens
ccagugcugugcaguguaugag

SEQ ID NO: 173600 - RNA, 22 nt, Homo sapiens
ccaguguauuuuugggaccugc

SEQ ID NO: 173601 - RNA, 22 nt, Homo sapiens
ccaguguucuggaaggcugagu

SEQ ID NO: 173602 - RNA, 17 nt, Homo sapiens
ccaguuuucccucagug

SEQ ID NO: 173603 - RNA, 22 nt, Homo sapiens
ccaguuuuucauuuauacuagu

SEQ ID NO: 173604 - RNA, 19 nt, Homo sapiens
ccauggcaaugaucugaug

SEQ ID NO: 173605 - RNA, 22 nt, Homo sapiens
ccauggcuucugcauucuguca

SEQ ID NO: 173606 - RNA, 22 nt, Homo sapiens
cccacaguggccucauauccuu

SEQ ID NO: 173607 - RNA, 22 nt, Homo sapiens
cccagaguucuuaaauacugag

SEQ ID NO: 173608 - RNA, 21 nt, Homo sapiens
cccagguucucugaggguaga

SEQ ID NO: 173609 - RNA, 19 nt, Homo sapiens
ccccuguggauaccgaggg

SEQ ID NO: 173610 - RNA, 20 nt, Homo sapiens
cccuaagccagaugcugggg

SEQ ID NO: 173611 - RNA, 22 nt, Homo sapiens
cccugaagauacagaguuuggg

SEQ ID NO: 173612 - RNA, 19 nt, Homo sapiens
cccuggcacauggaaaaug

SEQ ID NO: 173613 - RNA, 22 nt, Homo sapiens
ccucauggagaacaucugcuag

SEQ ID NO: 173614 - RNA, 21 nt, Homo sapiens
ccucuuugagggaagaaaggg

SEQ ID NO: 173615 - RNA, 22 nt, Homo sapiens
ccugagacugauugacucacaa

SEQ ID NO: 173616 - RNA, 21 nt, Homo sapiens
ccugaugaccucugagaguua

SEQ ID NO: 173617 - RNA, 22 nt, Homo sapiens
ccuggaucauugucauucccaa

SEQ ID NO: 173618 - RNA, 22 nt, Homo sapiens
ccugguguuuugauggucgggu

SEQ ID NO: 173619 - RNA, 18 nt, Homo sapiens
ccuuaguuauagagaguc

SEQ ID NO: 173620 - RNA, 21 nt, Homo sapiens
ccuugagaacaucaauuugcu

SEQ ID NO: 173621 - RNA, 22 nt, Homo sapiens
ccuuggcacuacugacauugua

SEQ ID NO: 173622 - RNA, 22 nt, Homo sapiens
ccuuuuuguaguggaaguagga

SEQ ID NO: 173623 - RNA, 22 nt, Homo sapiens
cgacuggccuagacuaguguuu

SEQ ID NO: 173624 - RNA, 22 nt, Homo sapiens
cgcccuguagcuagcuagaggu

SEQ ID NO: 173625 - RNA, 22 nt, Homo sapiens
cgccgggggaugggcaccagcg

SEQ ID NO: 173626 - RNA, 22 nt, Homo sapiens
cgcuggugaucuagacccccaa

SEQ ID NO: 173627 - RNA, 22 nt, Homo sapiens
cgcuggugucuaagcgacagcu

SEQ ID NO: 173628 - RNA, 22 nt, Homo sapiens
cgugaggaguauuuuuaggugc

SEQ ID NO: 173629 - RNA, 22 nt, Homo sapiens
cguugcacuccagccugggcaa

SEQ ID NO: 173630 - RNA, 22 nt, Homo sapiens
cuaaagugcuuaaaaucucauu

SEQ ID NO: 173631 - RNA, 22 nt, Homo sapiens
cuaagugaguauaauuuuaaga

SEQ ID NO: 173632 - RNA, 18 nt, Homo sapiens
cuaauacuauucaacaag

SEQ ID NO: 173633 - RNA, 22 nt, Homo sapiens
cuacaguagagaggauguagaa

SEQ ID NO: 173634 - RNA, 22 nt, Homo sapiens
cuaccuggguggcucaugacuu

SEQ ID NO: 173635 - RNA, 22 nt, Homo sapiens
cuacugcacaucaucugaguua

SEQ ID NO: 173636 - RNA, 22 nt, Homo sapiens
cuagaagguaagagcuggaugc

SEQ ID NO: 173637 - RNA, 22 nt, Homo sapiens
cuagacacugacguuccuccga

SEQ ID NO: 173638 - RNA, 22 nt, Homo sapiens
cuagagagaagcugugugaccu

SEQ ID NO: 173639 - RNA, 22 nt, Homo sapiens
cuagauuguuuccauaaugaca

SEQ ID NO: 173640 - RNA, 22 nt, Homo sapiens
cuagcagacaggcugggagcag

SEQ ID NO: 173641 - RNA, 22 nt, Homo sapiens
cuagcuccauauaaagcaggau

SEQ ID NO: 173642 - RNA, 22 nt, Homo sapiens
cuagguucucaaaccagcguca

SEQ ID NO: 173643 - RNA, 22 nt, Homo sapiens
cuaguaaugucugucuuaugga

SEQ ID NO: 173644 - RNA, 21 nt, Homo sapiens
cuaucucaguguuuacauuug

SEQ ID NO: 173645 - RNA, 22 nt, Homo sapiens
cuaucucauugguuuuugaaag

SEQ ID NO: 173646 - RNA, 22 nt, Homo sapiens
cuaugagucugcagaucuauua

SEQ ID NO: 173647 - RNA, 22 nt, Homo sapiens
cuaugguuucuccauaucauca

SEQ ID NO: 173648 - RNA, 22 nt, Homo sapiens
cuauuagguuggugcaaaagua

SEQ ID NO: 173649 - RNA, 22 nt, Homo sapiens
gagguggauacauuaaauaaug

SEQ ID NO: 173650 - RNA, 22 nt, Homo sapiens
gagguuauuggggugcuugugu

SEQ ID NO: 173651 - RNA, 23 nt, Homo sapiens
gaguacauuaaaagcccagacug

SEQ ID NO: 173652 - RNA, 22 nt, Homo sapiens
gaguagugcugcaguaaacaua

SEQ ID NO: 173653 - RNA, 22 nt, Homo sapiens
gaguauauuugcacuguuaugu

SEQ ID NO: 173654 - RNA, 22 nt, Homo sapiens
gaguaucuuuaaggugguuugg

SEQ ID NO: 173655 - RNA, 22 nt, Homo sapiens
gagugcaauggugccaucucgg

SEQ ID NO: 173656 - RNA, 22 nt, Homo sapiens
gagugcauugguggucaggugu

SEQ ID NO: 173657 - RNA, 23 nt, Homo sapiens
gaguggagacucauugauuuccu

SEQ ID NO: 173658 - RNA, 18 nt, Homo sapiens
gaguggugcuucccuugu

SEQ ID NO: 173659 - RNA, 22 nt, Homo sapiens
gaguggugguucugaaacuuuu

SEQ ID NO: 173660 - RNA, 22 nt, Homo sapiens
gagugguucuauauguaauugg

SEQ ID NO: 173661 - RNA, 22 nt, Homo sapiens
gaguuagguugucaaugucuua

SEQ ID NO: 173662 - RNA, 22 nt, Homo sapiens
gaguucauuuugaaaccuugau

SEQ ID NO: 173663 - RNA, 22 nt, Homo sapiens
gaguugagagaguuguuauuuc

SEQ ID NO: 173664 - RNA, 19 nt, Homo sapiens
gaguugggguuuacuguaa

SEQ ID NO: 173665 - RNA, 18 nt, Homo sapiens
gauaacaguggacuaugc

SEQ ID NO: 173666 - RNA, 21 nt, Homo sapiens
gauaaguuggcagccagcacc

SEQ ID NO: 173667 - RNA, 22 nt, Homo sapiens
gauacuguauccuaaaagcuuu

SEQ ID NO: 173668 - RNA, 22 nt, Homo sapiens
gauaguugugagaacucuuacu

SEQ ID NO: 173669 - RNA, 22 nt, Homo sapiens
gauaucuuuuguauggugagcu

SEQ ID NO: 173670 - RNA, 22 nt, Homo sapiens
gauaugaguagucgcauugaug

SEQ ID NO: 173671 - RNA, 22 nt, Homo sapiens
gauauguaguaguugaaaaaga

SEQ ID NO: 173672 - RNA, 22 nt, Homo sapiens
gauauguucugagaaaugcauu

SEQ ID NO: 173673 - RNA, 22 nt, Homo sapiens
gauauguugaguagaguuuuug

SEQ ID NO: 173674 - RNA, 22 nt, Homo sapiens
gauauugacuuauucuauguuu

SEQ ID NO: 173675 - RNA, 22 nt, Homo sapiens
gaucacaugggagaaugagagu

SEQ ID NO: 173676 - RNA, 22 nt, Homo sapiens
gaucacuuugaugccaggaacu

SEQ ID NO: 173677 - RNA, 22 nt, Homo sapiens
gaucaguuucuggagauacgua

SEQ ID NO: 173678 - RNA, 22 nt, Homo sapiens
gaucugucuuuccuuauagucu

SEQ ID NO: 173679 - RNA, 22 nt, Homo sapiens
gaucuguguuuguaugcauaag

SEQ ID NO: 173680 - RNA, 22 nt, Homo sapiens
gaucuguuguuuggaaguauca

SEQ ID NO: 173681 - RNA, 22 nt, Homo sapiens
gaucuguuucaauugucuuagu

SEQ ID NO: 173682 - RNA, 22 nt, Homo sapiens
gaugaaacaucuuuggaaacug

SEQ ID NO: 173683 - RNA, 22 nt, Homo sapiens
gaugacagcugacucccuugcu

SEQ ID NO: 173684 - RNA, 22 nt, Homo sapiens
gaugagaugagcauuugaauug

SEQ ID NO: 173685 - RNA, 22 nt, Homo sapiens
gaugagauguucucauggauug

SEQ ID NO: 173686 - RNA, 22 nt, Homo sapiens
gaugaggcuagagacaugugua

SEQ ID NO: 173687 - RNA, 22 nt, Homo sapiens
gaugagguaguguaccuagucu

SEQ ID NO: 173688 - RNA, 22 nt, Homo sapiens
gaugccuauugcuaguccuaaa

SEQ ID NO: 173689 - RNA, 22 nt, Homo sapiens
gaugccuuuuuguccucaguua

SEQ ID NO: 173690 - RNA, 22 nt, Homo sapiens
gauggcaugugcugccaccaag

SEQ ID NO: 173691 - RNA, 22 nt, Homo sapiens
gauggcauuucuggaucugccc

SEQ ID NO: 173692 - RNA, 22 nt, Homo sapiens
gaugguuuuuuaagaagagccu

SEQ ID NO: 173693 - RNA, 22 nt, Homo sapiens
gauguagaaagagugggcugga

SEQ ID NO: 173694 - RNA, 22 nt, Homo sapiens
gauguaggugcauuugcacgug

SEQ ID NO: 173695 - RNA, 22 nt, Homo sapiens
gauguguuuaucacccaguccu

SEQ ID NO: 173696 - RNA, 22 nt, Homo sapiens
gauguguuuccaggauuuguuu

SEQ ID NO: 173697 - RNA, 22 nt, Homo sapiens
gauguguuuuaggaucucagca

SEQ ID NO: 173698 - RNA, 22 nt, Homo sapiens
gauguuguuuagccuuugaugu

SEQ ID NO: 173699 - RNA, 22 nt, Homo sapiens
gauuagaacagaagucagauua

SEQ ID NO: 173700 - RNA, 20 nt, Homo sapiens
gauuagagagaggcugugca

SEQ ID NO: 173701 - RNA, 22 nt, Homo sapiens
gauuagucccauuuuacaggug

SEQ ID NO: 173702 - RNA, 22 nt, Homo sapiens
gauuccacuuacuuagcauucc

SEQ ID NO: 173703 - RNA, 22 nt, Homo sapiens
gauuccacuuucugucucuaug

SEQ ID NO: 173704 - RNA, 22 nt, Homo sapiens
gauuuuccaguggcccugauca

SEQ ID NO: 173705 - RNA, 22 nt, Homo sapiens
gcaaaugcuaugccauuuuaua

SEQ ID NO: 173706 - RNA, 22 nt, Homo sapiens
gcaaggacucccugggucauuc

SEQ ID NO: 173707 - RNA, 21 nt, Homo sapiens
gcaaguacuaucaucauuauc

SEQ ID NO: 173708 - RNA, 22 nt, Homo sapiens
gcaauacugacagcauuaguuu

SEQ ID NO: 173709 - RNA, 22 nt, Homo sapiens
gcacaaugccugacgaguccug

SEQ ID NO: 173710 - RNA, 22 nt, Homo sapiens
gcacacguagaagcaugcauca

SEQ ID NO: 173711 - RNA, 22 nt, Homo sapiens
gcacagaugaggagaggucuca

SEQ ID NO: 173712 - RNA, 22 nt, Homo sapiens
gcacauauguaaauagcugccu

SEQ ID NO: 173713 - RNA, 22 nt, Homo sapiens
gcacauggccacuaggaauaaa

SEQ ID NO: 173714 - RNA, 22 nt, Homo sapiens
gcacauggccccaucgugccga

SEQ ID NO: 173715 - RNA, 22 nt, Homo sapiens
gcagaguauagagggcugggcc

SEQ ID NO: 173716 - RNA, 22 nt, Homo sapiens
gcaggcaugacauuucacucuu

SEQ ID NO: 173717 - RNA, 22 nt, Homo sapiens
gcagguauuagagagccugaaa

SEQ ID NO: 173718 - RNA, 22 nt, Homo sapiens
gcaguagugugaucuuggcuca

SEQ ID NO: 173719 - RNA, 22 nt, Homo sapiens
gcaguauuguugaaauguccau

SEQ ID NO: 173720 - RNA, 22 nt, Homo sapiens
gcagucacagggagauggugac

SEQ ID NO: 173721 - RNA, 23 nt, Homo sapiens
gcagucauuuggaaaagguugaa

SEQ ID NO: 173722 - RNA, 22 nt, Homo sapiens
gcagugugaucacagcuuacug

SEQ ID NO: 173723 - RNA, 22 nt, Homo sapiens
gcaguguggguagagggcaaga

SEQ ID NO: 173724 - RNA, 20 nt, Homo sapiens
gcaguguucugaccugaauc

SEQ ID NO: 173725 - RNA, 22 nt, Homo sapiens
gcauggagaaggggacugauuc

SEQ ID NO: 173726 - RNA, 22 nt, Homo sapiens
gcauggauguugauggcugcug

SEQ ID NO: 173727 - RNA, 22 nt, Homo sapiens
gcauugcacuuggcauagacug

SEQ ID NO: 173728 - RNA, 22 nt, Homo sapiens
gccaagaagugucuaagcagga

SEQ ID NO: 173729 - RNA, 22 nt, Homo sapiens
gccaagaucugaauaauuaaga

SEQ ID NO: 173730 - RNA, 22 nt, Homo sapiens
gccaagaugcugcccacagaca

SEQ ID NO: 173731 - RNA, 20 nt, Homo sapiens
gccacaguuaagcuucugcc

SEQ ID NO: 173732 - RNA, 22 nt, Homo sapiens
gccagugugaugugaucauggc

SEQ ID NO: 173733 - RNA, 21 nt, Homo sapiens
gccaguguggcaauuuuucaa

SEQ ID NO: 173734 - RNA, 22 nt, Homo sapiens
gccauugcacuccagccugagc

SEQ ID NO: 173735 - RNA, 22 nt, Homo sapiens
gcccagauguuuggggucaugg

SEQ ID NO: 173736 - RNA, 22 nt, Homo sapiens
gcccagcguucagggaggggcu

SEQ ID NO: 173737 - RNA, 22 nt, Homo sapiens
gcccuguugcccaggcuggagu

SEQ ID NO: 173738 - RNA, 22 nt, Homo sapiens
gcccuuugugucuggcuggggu

SEQ ID NO: 173739 - RNA, 22 nt, Homo sapiens
gccuagauccaaauauggugca

SEQ ID NO: 173740 - RNA, 22 nt, Homo sapiens
gccucaguuguggccagggauu

SEQ ID NO: 173741 - RNA, 22 nt, Homo sapiens
gcgcagugggcugugccaucca

SEQ ID NO: 173742 - RNA, 23 nt, Homo sapiens
gcuaggagagaugaaacacaggu

SEQ ID NO: 173743 - RNA, 22 nt, Homo sapiens
gcuauggccugaauguuugugu

SEQ ID NO: 173744 - RNA, 22 nt, Homo sapiens
gcuaugucuguugcucuugggc

SEQ ID NO: 173745 - RNA, 22 nt, Homo sapiens
gcucaugggcagugugauuguu

SEQ ID NO: 173746 - RNA, 22 nt, Homo sapiens
gcucguuuuugccucugguugc

SEQ ID NO: 173747 - RNA, 22 nt, Homo sapiens
gcucugguuacaaaggcaaauu

SEQ ID NO: 173748 - RNA, 22 nt, Homo sapiens
gcugaaauguuuaauuugggag

SEQ ID NO: 173749 - RNA, 22 nt, Homo sapiens
gcugagcuaugccauauaugcc

SEQ ID NO: 173750 - RNA, 22 nt, Homo sapiens
gcugagguucaagaagguuaaa

SEQ ID NO: 173751 - RNA, 22 nt, Homo sapiens
gcugauguugaccuugaucacc

SEQ ID NO: 173752 - RNA, 22 nt, Homo sapiens
gcugcacuuuaaggcauccccu

SEQ ID NO: 173753 - RNA, 22 nt, Homo sapiens
gcugcuguuuaguuucuccugg

SEQ ID NO: 173754 - RNA, 22 nt, Homo sapiens
gcuggguugccagguuacuuaa

SEQ ID NO: 173755 - RNA, 22 nt, Homo sapiens
gcugguguugugaaucaggccg

SEQ ID NO: 173756 - RNA, 22 nt, Homo sapiens
gcuguaguugaggauuuuaaga

SEQ ID NO: 173757 - RNA, 22 nt, Homo sapiens
gcuguauugacuuuguaucaua

SEQ ID NO: 173758 - RNA, 22 nt, Homo sapiens
guacauguaugcaugcaugcau

SEQ ID NO: 173759 - RNA, 22 nt, Homo sapiens
guacaugugcacagugugcagg

SEQ ID NO: 173760 - RNA, 22 nt, Homo sapiens
guaccacaguugcucacggguu

SEQ ID NO: 173761 - RNA, 22 nt, Homo sapiens
guagaauguauacaguauacag

SEQ ID NO: 173762 - RNA, 22 nt, Homo sapiens
guagaauguauguauaacgcaa

SEQ ID NO: 173763 - RNA, 22 nt, Homo sapiens
guagagguagacuuccuugucu

SEQ ID NO: 173764 - RNA, 22 nt, Homo sapiens
guagaugcauggauuuacuucu

SEQ ID NO: 173765 - RNA, 22 nt, Homo sapiens
guagcagaauaucagauaauuu

SEQ ID NO: 173766 - RNA, 22 nt, Homo sapiens
guagcagccacacuugauaacu

SEQ ID NO: 173767 - RNA, 22 nt, Homo sapiens
guaguggcaugaucuuggcuca

SEQ ID NO: 173768 - RNA, 22 nt, Homo sapiens
guauacaguugacccuugaacc

SEQ ID NO: 173769 - RNA, 22 nt, Homo sapiens
guaucaucauguuggccaggcu

SEQ ID NO: 173770 - RNA, 22 nt, Homo sapiens
guaucaugaaguuucuucauuu

SEQ ID NO: 173771 - RNA, 22 nt, Homo sapiens
guaucauuggcauguaaccaga

SEQ ID NO: 173772 - RNA, 22 nt, Homo sapiens
guauccugaaguucucagcacu

SEQ ID NO: 173773 - RNA, 22 nt, Homo sapiens
guaugcacauauguguauguau

SEQ ID NO: 173774 - RNA, 22 nt, Homo sapiens
guauggaagucaguuuguuggc

SEQ ID NO: 173775 - RNA, 22 nt, Homo sapiens
guaugucuugucuauggcugcu

SEQ ID NO: 173776 - RNA, 22 nt, Homo sapiens
guaugucuuuauagcagugugg

SEQ ID NO: 173777 - RNA, 18 nt, Homo sapiens
guauuccagccugaguga

SEQ ID NO: 173778 - RNA, 22 nt, Homo sapiens
guauugaguaaauguuuauugg

SEQ ID NO: 173779 - RNA, 22 nt, Homo sapiens
guauugcuugagcccaggaguu

SEQ ID NO: 173780 - RNA, 22 nt, Homo sapiens
guauuugauuauagcaugcuua

SEQ ID NO: 173781 - RNA, 19 nt, Homo sapiens
guauuugguaaacucucca

SEQ ID NO: 173782 - RNA, 22 nt, Homo sapiens
guauuuguugcagcagcacuau

SEQ ID NO: 173783 - RNA, 22 nt, Homo sapiens
gucaacauauuaauuauguucu

SEQ ID NO: 173784 - RNA, 22 nt, Homo sapiens
gucacagcuggcauugucugca

SEQ ID NO: 173785 - RNA, 22 nt, Homo sapiens
gucaccauugagucauuuccuc

SEQ ID NO: 173786 - RNA, 22 nt, Homo sapiens
gucacugacaagagagaagaac

SEQ ID NO: 173787 - RNA, 21 nt, Homo sapiens
gucacuggggcuggauaauuc

SEQ ID NO: 173788 - RNA, 22 nt, Homo sapiens
gucagguauguuccaaaggcgg

SEQ ID NO: 173789 - RNA, 22 nt, Homo sapiens
gucaguggauacugucucuguc

SEQ ID NO: 173790 - RNA, 22 nt, Homo sapiens
gucagugucuuugcagcucaga

SEQ ID NO: 173791 - RNA, 22 nt, Homo sapiens
gucagugugauaucugcagggg

SEQ ID NO: 173792 - RNA, 18 nt, Homo sapiens
gucauagaaugaugguuc

SEQ ID NO: 173793 - RNA, 22 nt, Homo sapiens
gucauccaggcuggagugaagc

SEQ ID NO: 173794 - RNA, 22 nt, Homo sapiens
gucauggaaaucuacauuguua

SEQ ID NO: 173795 - RNA, 22 nt, Homo sapiens
gucauugcacuccagccuggac

SEQ ID NO: 173796 - RNA, 22 nt, Homo sapiens
gucauugucaauugacaauugu

SEQ ID NO: 173797 - RNA, 22 nt, Homo sapiens
guccaaauccaugggauguaca

SEQ ID NO: 173798 - RNA, 22 nt, Homo sapiens
guccaguguuggagguuuuacc

SEQ ID NO: 173799 - RNA, 22 nt, Homo sapiens
guccaguuguuuucugagguug

SEQ ID NO: 173800 - RNA, 22 nt, Homo sapiens
guccauuuguuuccagagcacu

SEQ ID NO: 173801 - RNA, 22 nt, Homo sapiens
gucccugcgauugugggauccu

SEQ ID NO: 173802 - RNA, 22 nt, Homo sapiens
guccuggagaagcguggaccgg

SEQ ID NO: 173803 - RNA, 18 nt, Homo sapiens
gucucacaugguggaagc

SEQ ID NO: 173804 - RNA, 22 nt, Homo sapiens
gucucauugcaguuagaccugu

SEQ ID NO: 173805 - RNA, 22 nt, Homo sapiens
gucucccagccuacaucuuucu

SEQ ID NO: 173806 - RNA, 22 nt, Homo sapiens
gucugguugacagcauguggcc

SEQ ID NO: 173807 - RNA, 22 nt, Homo sapiens
gucuguuugauccagaucaaaa

SEQ ID NO: 173808 - RNA, 22 nt, Homo sapiens
gucuuggcaugugcagcuggga

SEQ ID NO: 173809 - RNA, 20 nt, Homo sapiens
gucuuguagcucaaguuauu

SEQ ID NO: 173810 - RNA, 22 nt, Homo sapiens
gucuuuaguugaaacauguggu

SEQ ID NO: 173811 - RNA, 22 nt, Homo sapiens
gucuuuguuuugauuuaccaga

SEQ ID NO: 173812 - RNA, 22 nt, Homo sapiens
gucuuuugcuagccagagagcu

SEQ ID NO: 173813 - RNA, 22 nt, Homo sapiens
gugaaaagaugagcaccauaca

SEQ ID NO: 173814 - RNA, 22 nt, Homo sapiens
gugaaacuggguggugagagac

SEQ ID NO: 173815 - RNA, 22 nt, Homo sapiens
gugaaagacauauaugguuuga

SEQ ID NO: 173816 - RNA, 22 nt, Homo sapiens
gugaaauauuuaacguccaggu

SEQ ID NO: 173817 - RNA, 22 nt, Homo sapiens
gugaaaugaaucuggaaauauu

SEQ ID NO: 173818 - RNA, 22 nt, Homo sapiens
gugaacagaaccugggaucgaa

SEQ ID NO: 173819 - RNA, 22 nt, Homo sapiens
gugaacagcagaugagugagug

SEQ ID NO: 173820 - RNA, 22 nt, Homo sapiens
gugaaguuuuuugcugagaguc

SEQ ID NO: 173821 - RNA, 22 nt, Homo sapiens
gugaauugagagaacuguguua

SEQ ID NO: 173822 - RNA, 22 nt, Homo sapiens
gugacacagcaagacuccgucu

SEQ ID NO: 173823 - RNA, 22 nt, Homo sapiens
gugacauuuuuacugaugagag

SEQ ID NO: 173824 - RNA, 22 nt, Homo sapiens
gugacuggacucugaagaaaau

SEQ ID NO: 173825 - RNA, 22 nt, Homo sapiens
gugagaccaauguacuaccuuc

SEQ ID NO: 173826 - RNA, 22 nt, Homo sapiens
gugagacugguccugaacccag

SEQ ID NO: 173827 - RNA, 22 nt, Homo sapiens
gugagagaaugacuauguguuu

SEQ ID NO: 173828 - RNA, 22 nt, Homo sapiens
gugagauccucucuuauauggg

SEQ ID NO: 173829 - RNA, 22 nt, Homo sapiens
gugagaugguaucucauugugg

SEQ ID NO: 173830 - RNA, 22 nt, Homo sapiens
gugagauuagcugagauccuug

SEQ ID NO: 173831 - RNA, 22 nt, Homo sapiens
gugagauuuucuccagguucag

SEQ ID NO: 173832 - RNA, 22 nt, Homo sapiens
gugagcaauugauacuugaagu

SEQ ID NO: 173833 - RNA, 19 nt, Homo sapiens
gugagcacagacaauacaa

SEQ ID NO: 173834 - RNA, 22 nt, Homo sapiens
gugagcauaacaacagaguuua

SEQ ID NO: 173835 - RNA, 22 nt, Homo sapiens
gugagcauaggaggcuucuguu

SEQ ID NO: 173836 - RNA, 22 nt, Homo sapiens
gugagcuaguuucuuugcugug

SEQ ID NO: 173837 - RNA, 22 nt, Homo sapiens
gugagcuauguccugguuuggg

SEQ ID NO: 173838 - RNA, 22 nt, Homo sapiens
gugaggaaggaaaccugcuagc

SEQ ID NO: 173839 - RNA, 22 nt, Homo sapiens
gugaggcacugcugcuuuccag

SEQ ID NO: 173840 - RNA, 22 nt, Homo sapiens
gugaggcuuuuccuguuagacu

SEQ ID NO: 173841 - RNA, 17 nt, Homo sapiens
gugagguauccucaaaa

SEQ ID NO: 173842 - RNA, 17 nt, Homo sapiens
gugagguggguaguauc

SEQ ID NO: 173843 - RNA, 22 nt, Homo sapiens
gugagguugaaaauaauggaaa

SEQ ID NO: 173844 - RNA, 22 nt, Homo sapiens
gugagucaaucugagggguuca

SEQ ID NO: 173845 - RNA, 20 nt, Homo sapiens
gugagucauuaguaaccaaa

SEQ ID NO: 173846 - RNA, 22 nt, Homo sapiens
gugaguggacgugaccaauaaa

SEQ ID NO: 173847 - RNA, 22 nt, Homo sapiens
gugauagaucugggauucagaa

SEQ ID NO: 173848 - RNA, 22 nt, Homo sapiens
gugaucaugauccugaagcauu

SEQ ID NO: 173849 - RNA, 22 nt, Homo sapiens
gugaucuguccuucauagccug

SEQ ID NO: 173850 - RNA, 22 nt, Homo sapiens
gugaugguaguuuguauuucug

SEQ ID NO: 173851 - RNA, 22 nt, Homo sapiens
gugauguguuucaacagcuccu

SEQ ID NO: 173852 - RNA, 22 nt, Homo sapiens
gugauugucuaaucaagauaca

SEQ ID NO: 173853 - RNA, 22 nt, Homo sapiens
gugauuguuaaacugccucucu

SEQ ID NO: 173854 - RNA, 21 nt, Homo sapiens
gugcaaacaucauagaaugua

SEQ ID NO: 173855 - RNA, 22 nt, Homo sapiens
gugcaaauuccagcucaacucc

SEQ ID NO: 173856 - RNA, 22 nt, Homo sapiens
gugcaagagugacugcaguuuu

SEQ ID NO: 173857 - RNA, 22 nt, Homo sapiens
gugcaagagugauugcaguuuu

SEQ ID NO: 173858 - RNA, 22 nt, Homo sapiens
gugcacauauggugcauaagug

SEQ ID NO: 173859 - RNA, 22 nt, Homo sapiens
gugcacaugguagguauugagu

SEQ ID NO: 173860 - RNA, 21 nt, Homo sapiens
gugcagacacacauauaggcu

SEQ ID NO: 173861 - RNA, 22 nt, Homo sapiens
gugcagaugucuuuauaguagc

SEQ ID NO: 173862 - RNA, 22 nt, Homo sapiens
gugcaguguuugcauggaauca

SEQ ID NO: 173863 - RNA, 22 nt, Homo sapiens
gugcauacgucuuuauaguagc

SEQ ID NO: 173864 - RNA, 18 nt, Homo sapiens
gugcauagccauggcagc

SEQ ID NO: 173865 - RNA, 19 nt, Homo sapiens
gugcauaguuauuaaagag

SEQ ID NO: 173866 - RNA, 22 nt, Homo sapiens
gugcauguccacuaguccauau

SEQ ID NO: 173867 - RNA, 22 nt, Homo sapiens
gugccacugcaccuggccuaag

SEQ ID NO: 173868 - RNA, 22 nt, Homo sapiens
gugcuaggugcuaggaagauag

SEQ ID NO: 173869 - RNA, 16 nt, Homo sapiens
gugcuguguuguuagg

SEQ ID NO: 173870 - RNA, 22 nt, Homo sapiens
guggaaagaacacaaaauuagg

SEQ ID NO: 173871 - RNA, 21 nt, Homo sapiens
guggaaauggaauuuacuaau

SEQ ID NO: 173872 - RNA, 22 nt, Homo sapiens
guggaagaaaucagguuauuug

SEQ ID NO: 173873 - RNA, 20 nt, Homo sapiens
guggaaguagaaacauaugu

SEQ ID NO: 173874 - RNA, 22 nt, Homo sapiens
guggaagugucuggggccaggg

SEQ ID NO: 173875 - RNA, 22 nt, Homo sapiens
guggaaguuaagugacuuucug

SEQ ID NO: 173876 - RNA, 22 nt, Homo sapiens
guggaauauaaagcaucgugua

SEQ ID NO: 173877 - RNA, 22 nt, Homo sapiens
guggaaucuagagaggcaguag

SEQ ID NO: 173878 - RNA, 22 nt, Homo sapiens
guggaaugauaucucauugugg

SEQ ID NO: 173879 - RNA, 22 nt, Homo sapiens
guggaauggaaugauuguguau

SEQ ID NO: 173880 - RNA, 22 nt, Homo sapiens
guggaauuauagagacaucuug

SEQ ID NO: 173881 - RNA, 22 nt, Homo sapiens
guggacagagacuaaauguugu

SEQ ID NO: 173882 - RNA, 22 nt, Homo sapiens
guggagcuguguggccuugggc

SEQ ID NO: 173883 - RNA, 22 nt, Homo sapiens
guggaggacuggauaaagaaaa

SEQ ID NO: 173884 - RNA, 22 nt, Homo sapiens
guggcaaagaugccuucuccaa

SEQ ID NO: 173885 - RNA, 22 nt, Homo sapiens
guggcaaggaaaugcugcucac

SEQ ID NO: 173886 - RNA, 22 nt, Homo sapiens
guggcauuucccaaaguauucu

SEQ ID NO: 173887 - RNA, 23 nt, Homo sapiens
guggccuuuggccaguccgaguc

SEQ ID NO: 173888 - RNA, 22 nt, Homo sapiens
guggcgaagauggauugaguca

SEQ ID NO: 173889 - RNA, 22 nt, Homo sapiens
guggcgagaucauagcucauug

SEQ ID NO: 173890 - RNA, 22 nt, Homo sapiens
guggcuaaagauuuggaaucug

SEQ ID NO: 173891 - RNA, 22 nt, Homo sapiens
guggcuagaaugaagguagcug

SEQ ID NO: 173892 - RNA, 22 nt, Homo sapiens
guggcuuguaggggucaaggga

SEQ ID NO: 173893 - RNA, 22 nt, Homo sapiens
gugggaagcuggaacucccucc

SEQ ID NO: 173894 - RNA, 22 nt, Homo sapiens
gugggagugucccguuuuucca

SEQ ID NO: 173895 - RNA, 22 nt, Homo sapiens
gugggaugaucgcuugagccca

SEQ ID NO: 173896 - RNA, 22 nt, Homo sapiens
gugggaugcaaguaaaauuguc

SEQ ID NO: 173897 - RNA, 22 nt, Homo sapiens
gugggauggagagaagguauga

SEQ ID NO: 173898 - RNA, 22 nt, Homo sapiens
gugggguagcaggcuccuaucu

SEQ ID NO: 173899 - RNA, 22 nt, Homo sapiens
gugggguaggguaggacucaac

SEQ ID NO: 173900 - RNA, 22 nt, Homo sapiens
guggggucaucucauuugugga

SEQ ID NO: 173901 - RNA, 22 nt, Homo sapiens
guggguaaaucucuggggcucu

SEQ ID NO: 173902 - RNA, 22 nt, Homo sapiens
guggguaaaucucuguuugagg

SEQ ID NO: 173903 - RNA, 22 nt, Homo sapiens
gugguucuaaaccuuuuuuggu

SEQ ID NO: 173904 - RNA, 21 nt, Homo sapiens
gugguucuagagaaacagaau

SEQ ID NO: 173905 - RNA, 22 nt, Homo sapiens
gugguuguuggaguggcaauuu

SEQ ID NO: 173906 - RNA, 22 nt, Homo sapiens
gugguuuucaacuccaccugca

SEQ ID NO: 173907 - RNA, 22 nt, Homo sapiens
guguaaaacaauuagaggauuu

SEQ ID NO: 173908 - RNA, 22 nt, Homo sapiens
guguaauacacacauauaugca

SEQ ID NO: 173909 - RNA, 22 nt, Homo sapiens
guguagagaaauagccugaagg

SEQ ID NO: 173910 - RNA, 22 nt, Homo sapiens
guguaugguaggaugacggagu

SEQ ID NO: 173911 - RNA, 22 nt, Homo sapiens
guguaugugagaaugcucaugu

SEQ ID NO: 173912 - RNA, 22 nt, Homo sapiens
gugucaugggcauguccuuaac

SEQ ID NO: 173913 - RNA, 22 nt, Homo sapiens
gugucccagugugcauacaggu

SEQ ID NO: 173914 - RNA, 22 nt, Homo sapiens
gugucuccuguggagcuaugua

SEQ ID NO: 173915 - RNA, 22 nt, Homo sapiens
gugugacagcuauagacaugau

SEQ ID NO: 173916 - RNA, 22 nt, Homo sapiens
gugugauuauuucaauugaugc

SEQ ID NO: 173917 - RNA, 22 nt, Homo sapiens
gugugcaaauguguaccuacau

SEQ ID NO: 173918 - RNA, 22 nt, Homo sapiens
gugugcauaugucuuuauagua

SEQ ID NO: 173919 - RNA, 22 nt, Homo sapiens
gugugcauggagggggcaguga

SEQ ID NO: 173920 - RNA, 22 nt, Homo sapiens
gugugcaugucuuuuuaguagg

SEQ ID NO: 173921 - RNA, 22 nt, Homo sapiens
guguucaaauucugacagagag

SEQ ID NO: 173922 - RNA, 22 nt, Homo sapiens
guguuugauugcaaauaaucua

SEQ ID NO: 173923 - RNA, 23 nt, Homo sapiens
guuaagugaauguguacucuauu

SEQ ID NO: 173924 - RNA, 22 nt, Homo sapiens
guuaaugcuggaauaaguuaag

SEQ ID NO: 173925 - RNA, 22 nt, Homo sapiens
guuagcuaguagacaauuuucc

SEQ ID NO: 173926 - RNA, 22 nt, Homo sapiens
guuagguagaaguuuacuuuga

SEQ ID NO: 173927 - RNA, 22 nt, Homo sapiens
guuaugcagcaauugauaaucu

SEQ ID NO: 173928 - RNA, 22 nt, Homo sapiens
guuauuaguugauauuaaguuc

SEQ ID NO: 173929 - RNA, 22 nt, Homo sapiens
guucaagcaauucugcugccuc

SEQ ID NO: 173930 - RNA, 22 nt, Homo sapiens
guucaaggaauguuggcuucuc

SEQ ID NO: 173931 - RNA, 22 nt, Homo sapiens
guucaagugauagcugggauua

SEQ ID NO: 173932 - RNA, 20 nt, Homo sapiens
guucacagagguuaugauua

SEQ ID NO: 173933 - RNA, 20 nt, Homo sapiens
guucacaggcuuccuuucag

SEQ ID NO: 173934 - RNA, 22 nt, Homo sapiens
guucacaguuucuaaucccagc

SEQ ID NO: 173935 - RNA, 22 nt, Homo sapiens
guucagcaggggcuucaauggu

SEQ ID NO: 173936 - RNA, 22 nt, Homo sapiens
guucaguaguucauucauuuau

SEQ ID NO: 173937 - RNA, 22 nt, Homo sapiens
guucaucagggauacuggcuua

SEQ ID NO: 173938 - RNA, 22 nt, Homo sapiens
guucaucagggauauuggcuua

SEQ ID NO: 173939 - RNA, 17 nt, Homo sapiens
guucccaguggcauuug

SEQ ID NO: 173940 - RNA, 22 nt, Homo sapiens
guuccuuguagaugcuggauau

SEQ ID NO: 173941 - RNA, 22 nt, Homo sapiens
guucuauguugggaguucacua

SEQ ID NO: 173942 - RNA, 22 nt, Homo sapiens
guugaaauccuaacccccuagu

SEQ ID NO: 173943 - RNA, 22 nt, Homo sapiens
guugagcaagcuuuggagccua

SEQ ID NO: 173944 - RNA, 22 nt, Homo sapiens
guugcaaaguaauugugguuuu

SEQ ID NO: 173945 - RNA, 22 nt, Homo sapiens
guugccuaggcuggagugcagu

SEQ ID NO: 173946 - RNA, 22 nt, Homo sapiens
guugcucaggccggagugcagu

SEQ ID NO: 173947 - RNA, 22 nt, Homo sapiens
guugcucaggcuggagugcagu

SEQ ID NO: 173948 - RNA, 22 nt, Homo sapiens
guuggcuguuucccccaaguga

SEQ ID NO: 173949 - RNA, 22 nt, Homo sapiens
guuuggauauuaggcaagagua

SEQ ID NO: 173950 - RNA, 22 nt, Homo sapiens
guuuggcuuucucucuauccug

SEQ ID NO: 173951 - RNA, 17 nt, Homo sapiens
guuuggguacuggguaa

SEQ ID NO: 173952 - RNA, 22 nt, Homo sapiens
uaaacugucuuuggagcuuugc

SEQ ID NO: 173953 - RNA, 22 nt, Homo sapiens
uaaagaugcugggaaggcuagg

SEQ ID NO: 173954 - RNA, 17 nt, Homo sapiens
uaaagccagucaaguca

SEQ ID NO: 173955 - RNA, 22 nt, Homo sapiens
uaaagcuagagcuggaguggca

SEQ ID NO: 173956 - RNA, 18 nt, Homo sapiens
uaaaggcacuguguuguu

SEQ ID NO: 173957 - RNA, 22 nt, Homo sapiens
uaaagugcugagaugaggcugg

SEQ ID NO: 173958 - RNA, 22 nt, Homo sapiens
uaaaugcuugagaugauggaua

SEQ ID NO: 173959 - RNA, 22 nt, Homo sapiens
uaaauggauauugccaucuccu

SEQ ID NO: 173960 - RNA, 21 nt, Homo sapiens
uaaaugucauacaaagcaaug

SEQ ID NO: 173961 - RNA, 22 nt, Homo sapiens
uaacaacauucuaacugacggc

SEQ ID NO: 173962 - RNA, 21 nt, Homo sapiens
uaacagcuccacuccauucuc

SEQ ID NO: 173963 - RNA, 22 nt, Homo sapiens
uaacagcucuacagcugcucuu

SEQ ID NO: 173964 - RNA, 22 nt, Homo sapiens
uaacagucuccucaagguguug

SEQ ID NO: 173965 - RNA, 22 nt, Homo sapiens
uaacaguguauuccuuuggaca

SEQ ID NO: 173966 - RNA, 22 nt, Homo sapiens
uaacauagucauauacuugcuu

SEQ ID NO: 173967 - RNA, 22 nt, Homo sapiens
uaacccacgcagaauggacaag

SEQ ID NO: 173968 - RNA, 22 nt, Homo sapiens
uaacccuuacaacuacacucgu

SEQ ID NO: 173969 - RNA, 22 nt, Homo sapiens
uaacccuuaguaucuguggguu

SEQ ID NO: 173970 - RNA, 22 nt, Homo sapiens
uaacugcaaccuccgccucccg

SEQ ID NO: 173971 - RNA, 22 nt, Homo sapiens
uaacugcaaccucugccugcug

SEQ ID NO: 173972 - RNA, 22 nt, Homo sapiens
uaacugccuacugugcaaauau

SEQ ID NO: 173973 - RNA, 20 nt, Homo sapiens
uaacuguggcuucuuuuggc

SEQ ID NO: 173974 - RNA, 20 nt, Homo sapiens
uaagacaugguccacaugcc

SEQ ID NO: 173975 - RNA, 19 nt, Homo sapiens
uaagaugaagcugucuggg

SEQ ID NO: 173976 - RNA, 22 nt, Homo sapiens
uauugcugaugcugaagggaag

SEQ ID NO: 173977 - RNA, 22 nt, Homo sapiens
uauugcuggcacauaguagguc

SEQ ID NO: 173978 - RNA, 22 nt, Homo sapiens
uauugcuuuugauucaaggcag

SEQ ID NO: 173979 - RNA, 22 nt, Homo sapiens
uauuguacauauccucccuuca

SEQ ID NO: 173980 - RNA, 22 nt, Homo sapiens
uauuguuaaagauguuaaugau

SEQ ID NO: 173981 - RNA, 22 nt, Homo sapiens
uauuucccuuaacuuuccugca

SEQ ID NO: 173982 - RNA, 22 nt, Homo sapiens
uauuugauuaacaagagccuaa

SEQ ID NO: 173983 - RNA, 22 nt, Homo sapiens
uauuugauugacuuuagcagga

SEQ ID NO: 173984 - RNA, 22 nt, Homo sapiens
uauuugguuacuugaauagcua

SEQ ID NO: 173985 - RNA, 22 nt, Homo sapiens
ucaaaguaaagccucaggaugg

SEQ ID NO: 173986 - RNA, 22 nt, Homo sapiens
ucaaagucuucucaaguaacau

SEQ ID NO: 173987 - RNA, 22 nt, Homo sapiens
ucaaagugacaaaguugcagca

SEQ ID NO: 173988 - RNA, 21 nt, Homo sapiens
ucaaaguguucuuuuguugaa

SEQ ID NO: 173989 - RNA, 22 nt, Homo sapiens
ucaaaugguccacgugaacauu

SEQ ID NO: 173990 - RNA, 22 nt, Homo sapiens
ucaaauguuuguuuaaggcuua

SEQ ID NO: 173991 - RNA, 22 nt, Homo sapiens
ucaaauuccaagucuagguagg

SEQ ID NO: 173992 - RNA, 22 nt, Homo sapiens
ucaacaggucaauugcauagaa

SEQ ID NO: 173993 - RNA, 22 nt, Homo sapiens
ucaacagugauggaaaguuaua

SEQ ID NO: 173994 - RNA, 22 nt, Homo sapiens
ucaaccggugagagcuuccucc

SEQ ID NO: 173995 - RNA, 22 nt, Homo sapiens
ucaagaccucacauagaggaga

SEQ ID NO: 173996 - RNA, 22 nt, Homo sapiens
ucaaggacuacauggggugaaa

SEQ ID NO: 173997 - RNA, 22 nt, Homo sapiens
ucaaggcacauuugacauuuuc

SEQ ID NO: 173998 - RNA, 22 nt, Homo sapiens
ucaaguaauacucccaucuugg

SEQ ID NO: 173999 - RNA, 22 nt, Homo sapiens
ucaagugcauaugcuaacgguu

SEQ ID NO: 174000 - RNA, 22 nt, Homo sapiens
ucaagugcauugauucaguauu

SEQ ID NO: 174001 - RNA, 22 nt, Homo sapiens
ucaaugcaaccuccaccucugg

SEQ ID NO: 174002 - RNA, 22 nt, Homo sapiens
ucaaugcaugugacaaagagua

SEQ ID NO: 174003 - RNA, 22 nt, Homo sapiens
ucaauguaucuccaagaauuga

SEQ ID NO: 174004 - RNA, 18 nt, Homo sapiens
ucaauguggauguucuuu

SEQ ID NO: 174005 - RNA, 22 nt, Homo sapiens
ucacaaagcuuggccugcuucu

SEQ ID NO: 174006 - RNA, 22 nt, Homo sapiens
ucacaaggcaggaaugaaaggg

SEQ ID NO: 174007 - RNA, 22 nt, Homo sapiens
ucacaagugagaggaauuagau

SEQ ID NO: 174008 - RNA, 22 nt, Homo sapiens
ucacaauucucaauuugugaaa

SEQ ID NO: 174009 - RNA, 22 nt, Homo sapiens
ucacacugaaacuaggguguga

SEQ ID NO: 174010 - RNA, 21 nt, Homo sapiens
ucacagccuaggaccugaaga

SEQ ID NO: 174011 - RNA, 22 nt, Homo sapiens
ucacaggguguuauuagaauua

SEQ ID NO: 174012 - RNA, 22 nt, Homo sapiens
ucacaguaaauccagaagaaau

SEQ ID NO: 174013 - RNA, 22 nt, Homo sapiens
ucacaguaucaugggggacaga

SEQ ID NO: 174014 - RNA, 22 nt, Homo sapiens
ucacaguauggggggugguuau

SEQ ID NO: 174015 - RNA, 22 nt, Homo sapiens
ucacagucaaaguaaucauaga

SEQ ID NO: 174016 - RNA, 22 nt, Homo sapiens
ucacagucggugacuucuugcu

SEQ ID NO: 174017 - RNA, 22 nt, Homo sapiens
ucacagugcaggaucaguuaau

SEQ ID NO: 174018 - RNA, 23 nt, Homo sapiens
ucacaguggcugcuuaauuguga

SEQ ID NO: 174019 - RNA, 22 nt, Homo sapiens
ucacaguucagcauggcugagg

SEQ ID NO: 174020 - RNA, 22 nt, Homo sapiens
ucacaguuggccuggccuuuua

SEQ ID NO: 174021 - RNA, 22 nt, Homo sapiens
ucacauggaaaaguccaguaaa

SEQ ID NO: 174022 - RNA, 21 nt, Homo sapiens
ucacauggccagaguaggaac

SEQ ID NO: 174023 - RNA, 22 nt, Homo sapiens
ucacaugggugcaauauaauca

SEQ ID NO: 174024 - RNA, 22 nt, Homo sapiens
ucacauuguauauguaccuauc

SEQ ID NO: 174025 - RNA, 22 nt, Homo sapiens
ucaccaccugcugaucauagag

SEQ ID NO: 174026 - RNA, 22 nt, Homo sapiens
ucaccaccuuccaggaccacug

SEQ ID NO: 174027 - RNA, 19 nt, Homo sapiens
ucaccaguacacaauacaa

SEQ ID NO: 174028 - RNA, 22 nt, Homo sapiens
ucaccaguacuccaaauugagg

SEQ ID NO: 174029 - RNA, 22 nt, Homo sapiens
ucaccuggagagcuugcuaaua

SEQ ID NO: 174030 - RNA, 22 nt, Homo sapiens
ucaccuggggaucuuguuuaca

SEQ ID NO: 174031 - RNA, 22 nt, Homo sapiens
ucaccuuacuugcuucugaacu

SEQ ID NO: 174032 - RNA, 19 nt, Homo sapiens
ucaccuugcccugcacaca

SEQ ID NO: 174033 - RNA, 22 nt, Homo sapiens
ucacuauugacaacagugugga

SEQ ID NO: 174034 - RNA, 22 nt, Homo sapiens
ucacugaaaccacugccuccug

SEQ ID NO: 174035 - RNA, 22 nt, Homo sapiens
ucacugaaacuguccuggguua

SEQ ID NO: 174036 - RNA, 22 nt, Homo sapiens
ucacugagaaugauguuucuga

SEQ ID NO: 174037 - RNA, 22 nt, Homo sapiens
ucacugagcacaggagaugugc

SEQ ID NO: 174038 - RNA, 21 nt, Homo sapiens
ucacugagcaucaugguuuca

SEQ ID NO: 174039 - RNA, 20 nt, Homo sapiens
ucacugaguaucuacgauua

SEQ ID NO: 174040 - RNA, 22 nt, Homo sapiens
ucacugcgaccuccgccucccg

SEQ ID NO: 174041 - RNA, 22 nt, Homo sapiens
ucacugugagaguuuauccugu

SEQ ID NO: 174042 - RNA, 22 nt, Homo sapiens
ucacugugguuugggaaagugc

SEQ ID NO: 174043 - RNA, 22 nt, Homo sapiens
ucacuguguauguauaugcagg

SEQ ID NO: 174044 - RNA, 22 nt, Homo sapiens
ucacugugugucucuguaucug

SEQ ID NO: 174045 - RNA, 22 nt, Homo sapiens
ucacuuuguuuuuggauaaguu

SEQ ID NO: 174046 - RNA, 21 nt, Homo sapiens
ucagaagcucccagggaggac

SEQ ID NO: 174047 - RNA, 22 nt, Homo sapiens
ucagaauguaacuuuaguugga

SEQ ID NO: 174048 - RNA, 22 nt, Homo sapiens
ucagaguggccucucuugaaga

SEQ ID NO: 174049 - RNA, 22 nt, Homo sapiens
ucagauacuggugacaugaaug

SEQ ID NO: 174050 - RNA, 19 nt, Homo sapiens
ucagaucagcccaagggau

SEQ ID NO: 174051 - RNA, 22 nt, Homo sapiens
ucagaucaguuccacaagaacu

SEQ ID NO: 174052 - RNA, 22 nt, Homo sapiens
ucagaugauuccguugacgaga

SEQ ID NO: 174053 - RNA, 19 nt, Homo sapiens
ucagaugcauuagggguua

SEQ ID NO: 174054 - RNA, 22 nt, Homo sapiens
ucagauguuugagaaguauacu

SEQ ID NO: 174055 - RNA, 22 nt, Homo sapiens
ucagauugaugcauacuuaaau

SEQ ID NO: 174056 - RNA, 22 nt, Homo sapiens
ucagcaaugcugcacucuacug

SEQ ID NO: 174057 - RNA, 20 nt, Homo sapiens
ucagcagucuggagcagagg

SEQ ID NO: 174058 - RNA, 22 nt, Homo sapiens
ucagcaguggacagaaugguag

SEQ ID NO: 174059 - RNA, 21 nt, Homo sapiens
ucagcucaucacugccuggag

SEQ ID NO: 174060 - RNA, 21 nt, Homo sapiens
ucaggaccucuaguuagccag

SEQ ID NO: 174061 - RNA, 22 nt, Homo sapiens
ucaggcaccuuccucuuaucug

SEQ ID NO: 174062 - RNA, 22 nt, Homo sapiens
ucaggcuuuucccagagugaug

SEQ ID NO: 174063 - RNA, 21 nt, Homo sapiens
ucaggcuuuuugagugccaau

SEQ ID NO: 174064 - RNA, 22 nt, Homo sapiens
ucaggguacuuguggccaaagu

SEQ ID NO: 174065 - RNA, 22 nt, Homo sapiens
ucagguagcauuuuggaaacag

SEQ ID NO: 174066 - RNA, 20 nt, Homo sapiens
ucagguagggcuucaacauu

SEQ ID NO: 174067 - RNA, 22 nt, Homo sapiens
ucagguagugccaugauugauu

SEQ ID NO: 174068 - RNA, 22 nt, Homo sapiens
ucagguaugucuuuaacagcag

SEQ ID NO: 174069 - RNA, 22 nt, Homo sapiens
ucagguauuuauagcaaugcaa

SEQ ID NO: 174070 - RNA, 22 nt, Homo sapiens
ucaggucauuccaggagggcca

SEQ ID NO: 174071 - RNA, 22 nt, Homo sapiens
ucaggugcaguggcucaugcuu

SEQ ID NO: 174072 - RNA, 22 nt, Homo sapiens
ucaggugcaguggcucugaccu

SEQ ID NO: 174073 - RNA, 22 nt, Homo sapiens
ucagguugcuaaguauaauauu

SEQ ID NO: 174074 - RNA, 22 nt, Homo sapiens
ucaguaccugagagugggcaga

SEQ ID NO: 174075 - RNA, 22 nt, Homo sapiens
ucaguacuuuggagcucacaua

SEQ ID NO: 174076 - RNA, 22 nt, Homo sapiens
ucaguaguaaauggauuuggaa

SEQ ID NO: 174077 - RNA, 19 nt, Homo sapiens
ucaguagugcacauaagcc

SEQ ID NO: 174078 - RNA, 22 nt, Homo sapiens
ucaguccccucgcugagucuac

SEQ ID NO: 174079 - RNA, 22 nt, Homo sapiens
ucagugacuggguauuaaauca

SEQ ID NO: 174080 - RNA, 22 nt, Homo sapiens
ucagugcaggaaucucuagcca

SEQ ID NO: 174081 - RNA, 22 nt, Homo sapiens
ucagugcuuuuuguugucauca

SEQ ID NO: 174082 - RNA, 22 nt, Homo sapiens
ucaguggagagcuuccaggauu

SEQ ID NO: 174083 - RNA, 22 nt, Homo sapiens
ucaguggagccucacucugugg

SEQ ID NO: 174084 - RNA, 22 nt, Homo sapiens
ucaguggagcuacaauucuggg

SEQ ID NO: 174085 - RNA, 22 nt, Homo sapiens
ugcaagacuaaaccuuccccuc

SEQ ID NO: 174086 - RNA, 22 nt, Homo sapiens
ugcaagaugagauuuuggaugg

SEQ ID NO: 174087 - RNA, 22 nt, Homo sapiens
ugcaagaugauuucaauugaua

SEQ ID NO: 174088 - RNA, 22 nt, Homo sapiens
ugcaccacugcacuccacccug

SEQ ID NO: 174089 - RNA, 22 nt, Homo sapiens
ugcaccacugcacuccagcuug

SEQ ID NO: 174090 - RNA, 22 nt, Homo sapiens
ugcaccacugcuagccugggua

SEQ ID NO: 174091 - RNA, 18 nt, Homo sapiens
ugcaccaguuuacacuuc

SEQ ID NO: 174092 - RNA, 22 nt, Homo sapiens
ugcaccaucuugcuucuguggu

SEQ ID NO: 174093 - RNA, 22 nt, Homo sapiens
ugcagagucuguccugccugcc

SEQ ID NO: 174094 - RNA, 22 nt, Homo sapiens
ugcagauucguuuugaggggua

SEQ ID NO: 174095 - RNA, 17 nt, Homo sapiens
ugcagcacacugauggg

SEQ ID NO: 174096 - RNA, 22 nt, Homo sapiens
ugcagcacaguagguuugcaau

SEQ ID NO: 174097 - RNA, 23 nt, Homo sapiens
ugcagcuacauguggccaugugc

SEQ ID NO: 174098 - RNA, 22 nt, Homo sapiens
ugcagcucagcugcggaguuuu

SEQ ID NO: 174099 - RNA, 22 nt, Homo sapiens
ugcaguaggcccagcgggaggc

SEQ ID NO: 174100 - RNA, 22 nt, Homo sapiens
ugcagugugauuuucuggcuga

SEQ ID NO: 174101 - RNA, 18 nt, Homo sapiens
ugcauauguugaaccagc

SEQ ID NO: 174102 - RNA, 22 nt, Homo sapiens
ugcauauguugagaugcauauu

SEQ ID NO: 174103 - RNA, 22 nt, Homo sapiens
ugcauauucuaggauuuuguau

SEQ ID NO: 174104 - RNA, 22 nt, Homo sapiens
ugcauggaagggagggaaagag

SEQ ID NO: 174105 - RNA, 21 nt, Homo sapiens
ugcauggagaacacugagggu

SEQ ID NO: 174106 - RNA, 21 nt, Homo sapiens
ugcaugguagucacaugauuc

SEQ ID NO: 174107 - RNA, 20 nt, Homo sapiens
ugcauguccucacuuacuug

SEQ ID NO: 174108 - RNA, 22 nt, Homo sapiens
ugcauugcacuugcaugagaua

SEQ ID NO: 174109 - RNA, 19 nt, Homo sapiens
ugcauugucugggaaaugg

SEQ ID NO: 174110 - RNA, 21 nt, Homo sapiens
ugcauugucuugaguuuaaau

SEQ ID NO: 174111 - RNA, 22 nt, Homo sapiens
ugccaaaaugggcuuuauaccg

SEQ ID NO: 174112 - RNA, 22 nt, Homo sapiens
ugccaacaugccuggcuguuuu

SEQ ID NO: 174113 - RNA, 22 nt, Homo sapiens
ugccaacugguuucuuuuaguu

SEQ ID NO: 174114 - RNA, 19 nt, Homo sapiens
ugccaagaaagucagcuua

SEQ ID NO: 174115 - RNA, 20 nt, Homo sapiens
ugccaagaugacuauagcuc

SEQ ID NO: 174116 - RNA, 22 nt, Homo sapiens
ugccaagauuucaggaauuaag

SEQ ID NO: 174117 - RNA, 22 nt, Homo sapiens
ugccaaggagucagucccuaga

SEQ ID NO: 174118 - RNA, 22 nt, Homo sapiens
ugccagaugugcccucuccacc

SEQ ID NO: 174119 - RNA, 22 nt, Homo sapiens
ugccaguauuuuauugaagauu

SEQ ID NO: 174120 - RNA, 22 nt, Homo sapiens
ugccaguauuuuguugaggauu

SEQ ID NO: 174121 - RNA, 20 nt, Homo sapiens
ugccagugugucaauuuaua

SEQ ID NO: 174122 - RNA, 22 nt, Homo sapiens
ugccauagagauuuguggaacu

SEQ ID NO: 174123 - RNA, 22 nt, Homo sapiens
ugccaucauuaauauuaggcau

SEQ ID NO: 174124 - RNA, 22 nt, Homo sapiens
ugccaugaagagaggaagcagu

SEQ ID NO: 174125 - RNA, 22 nt, Homo sapiens
ugccaugucauagguuaagccu

SEQ ID NO: 174126 - RNA, 22 nt, Homo sapiens
ugcccguaauuccagcacuuug

SEQ ID NO: 174127 - RNA, 22 nt, Homo sapiens
ugccuaggcuggaaugcaaugg

SEQ ID NO: 174128 - RNA, 22 nt, Homo sapiens
ugccuaggcuggaaugcagugg

SEQ ID NO: 174129 - RNA, 22 nt, Homo sapiens
ugccuaguagaaggugaacaug

SEQ ID NO: 174130 - RNA, 22 nt, Homo sapiens
ugccugagccagguuuuaggag

SEQ ID NO: 174131 - RNA, 22 nt, Homo sapiens
ugccuggagagcuccuacauau

SEQ ID NO: 174132 - RNA, 22 nt, Homo sapiens
ugcgcacugcagauuugaacuc

SEQ ID NO: 174133 - RNA, 22 nt, Homo sapiens
ugcuauguccccacccaaaucu

SEQ ID NO: 174134 - RNA, 21 nt, Homo sapiens
ugcucaugaguaaugcaguga

SEQ ID NO: 174135 - RNA, 22 nt, Homo sapiens
ugcugcaaacaggcaucugugg

SEQ ID NO: 174136 - RNA, 22 nt, Homo sapiens
ugcugcaaacaugagaggaagu

SEQ ID NO: 174137 - RNA, 22 nt, Homo sapiens
ugcugcaaucucggcacuuugg

SEQ ID NO: 174138 - RNA, 19 nt, Homo sapiens
ugcugcauugugaccuugc

SEQ ID NO: 174139 - RNA, 22 nt, Homo sapiens
ugcuggcguuacucuccaucag

SEQ ID NO: 174140 - RNA, 22 nt, Homo sapiens
ugcugguauuauguuauccaga

SEQ ID NO: 174141 - RNA, 22 nt, Homo sapiens
ugcuggugauucagauucaaau

SEQ ID NO: 174142 - RNA, 22 nt, Homo sapiens
ugcuguuguuugaugaaguaau

SEQ ID NO: 174143 - RNA, 21 nt, Homo sapiens
ugcuuacugaauguuaauuuc

SEQ ID NO: 174144 - RNA, 22 nt, Homo sapiens
ugcuuagucuugcuuuagcuau

SEQ ID NO: 174145 - RNA, 22 nt, Homo sapiens
ugcuuaguguugacccucugcc

SEQ ID NO: 174146 - RNA, 22 nt, Homo sapiens
ugcuuaguuguauguuccacau

SEQ ID NO: 174147 - RNA, 19 nt, Homo sapiens
ugcuuaguuuuauguguaa

SEQ ID NO: 174148 - RNA, 22 nt, Homo sapiens
ugcuuugguagaaaucuuuggu

SEQ ID NO: 174149 - RNA, 22 nt, Homo sapiens
ugcuuuguugaaaaucauuugg

SEQ ID NO: 174150 - RNA, 22 nt, Homo sapiens
uggaaaguacugagguccaccu

SEQ ID NO: 174151 - RNA, 22 nt, Homo sapiens
uggaaaguaguucuaaucuaag

SEQ ID NO: 174152 - RNA, 22 nt, Homo sapiens
uggaaauaaaauagaguuugcc

SEQ ID NO: 174153 - RNA, 20 nt, Homo sapiens
uggaaauuaaccuuucaggu

SEQ ID NO: 174154 - RNA, 22 nt, Homo sapiens
uggaagacauuuuggaccuugg

SEQ ID NO: 174155 - RNA, 22 nt, Homo sapiens
uggaagacucaagguggugaau

SEQ ID NO: 174156 - RNA, 22 nt, Homo sapiens
uggaaggucauuguucauuuga

SEQ ID NO: 174157 - RNA, 22 nt, Homo sapiens
uggaagucuauggcauuugagu

SEQ ID NO: 174158 - RNA, 20 nt, Homo sapiens
uggaaucuaggcggagguuu

SEQ ID NO: 174159 - RNA, 22 nt, Homo sapiens
uggaaucuuaggugaaggcuuu

SEQ ID NO: 174160 - RNA, 21 nt, Homo sapiens
uggaaugaauggccaacaugg

SEQ ID NO: 174161 - RNA, 20 nt, Homo sapiens
uggaaugcagccuccuucug

SEQ ID NO: 174162 - RNA, 22 nt, Homo sapiens
uggaaugguuggugugauuuua

SEQ ID NO: 174163 - RNA, 22 nt, Homo sapiens
uggaaugucagcuacaagaggg

SEQ ID NO: 174164 - RNA, 17 nt, Homo sapiens
uggaaugucuaagccug

SEQ ID NO: 174165 - RNA, 22 nt, Homo sapiens
uggaaugucuauguuuuugauu

SEQ ID NO: 174166 - RNA, 22 nt, Homo sapiens
uggaauguggacucuuaugggg

SEQ ID NO: 174167 - RNA, 21 nt, Homo sapiens
uggaauguucugacuucaggg

SEQ ID NO: 174168 - RNA, 22 nt, Homo sapiens
uggacagacaagguuauagauc

SEQ ID NO: 174169 - RNA, 20 nt, Homo sapiens
uggaccagagagguggggac

SEQ ID NO: 174170 - RNA, 22 nt, Homo sapiens
uggaccccugcucgggagcccu

SEQ ID NO: 174171 - RNA, 22 nt, Homo sapiens
uggaccccuucuccuauuaaaa

SEQ ID NO: 174172 - RNA, 22 nt, Homo sapiens
uggacuguaaauuggggacucu

SEQ ID NO: 174173 - RNA, 22 nt, Homo sapiens
uggacuguaagugccuugagua

SEQ ID NO: 174174 - RNA, 22 nt, Homo sapiens
uggacuuuaauaaaagggaaau

SEQ ID NO: 174175 - RNA, 22 nt, Homo sapiens
uggagagcaaaaucaauccaaa

SEQ ID NO: 174176 - RNA, 22 nt, Homo sapiens
uggagagcaaagaauuuguuag

SEQ ID NO: 174177 - RNA, 22 nt, Homo sapiens
uggagcccuaguuccucauaac

SEQ ID NO: 174178 - RNA, 22 nt, Homo sapiens
uggagguagagaugggaucucc

SEQ ID NO: 174179 - RNA, 22 nt, Homo sapiens
uggagguagggccuaggaaucu

SEQ ID NO: 174180 - RNA, 20 nt, Homo sapiens
uggaggucaucugucacuac

SEQ ID NO: 174181 - RNA, 19 nt, Homo sapiens
uggagucaucaugcugcua

SEQ ID NO: 174182 - RNA, 16 nt, Homo sapiens
uggagucauccuugac

SEQ ID NO: 174183 - RNA, 22 nt, Homo sapiens
uggagugcaauggugagaucuu

SEQ ID NO: 174184 - RNA, 22 nt, Homo sapiens
uggaguguaaauuaguucagcc

SEQ ID NO: 174185 - RNA, 22 nt, Homo sapiens
uggaguguguugcagaugaagg

SEQ ID NO: 174186 - RNA, 22 nt, Homo sapiens
uggaugccuaauaaaugcagac

SEQ ID NO: 174187 - RNA, 22 nt, Homo sapiens
uggauugaaagcuuuaauauug

SEQ ID NO: 174188 - RNA, 22 nt, Homo sapiens
uggauugagaagcuguggcuca

SEQ ID NO: 174189 - RNA, 19 nt, Homo sapiens
uggauuguuagagcagugu

SEQ ID NO: 174190 - RNA, 22 nt, Homo sapiens
uggcaaaauggaauauguuggg

SEQ ID NO: 174191 - RNA, 21 nt, Homo sapiens
uggcaaaaugggcaguggguu

SEQ ID NO: 174192 - RNA, 22 nt, Homo sapiens
uggcaaaucagaggcauggaca

SEQ ID NO: 174193 - RNA, 22 nt, Homo sapiens
uggcaaauuccaaaguuaauuc

SEQ ID NO: 174194 - RNA, 22 nt, Homo sapiens
uggcaacaucuggggacauguu

SEQ ID NO: 174195 - RNA, 22 nt, Homo sapiens
aacaggcuccuaggggugcacc

SEQ ID NO: 174196 - RNA, 22 nt, Homo sapiens
aacaggguggugccugguccau

SEQ ID NO: 174197 - RNA, 22 nt, Homo sapiens
aacaguaucuaacgagugauga

SEQ ID NO: 174198 - RNA, 22 nt, Homo sapiens
aacagucaauugcugaugaccu

SEQ ID NO: 174199 - RNA, 22 nt, Homo sapiens
aacagugcauucagggauauau

SEQ ID NO: 174200 - RNA, 22 nt, Homo sapiens
aacagugcuguuauaaauguac

SEQ ID NO: 174201 - RNA, 20 nt, Homo sapiens
aacaguguguaaguuuccuu

SEQ ID NO: 174202 - RNA, 22 nt, Homo sapiens
aacauugaacuuggcacaccca

SEQ ID NO: 174203 - RNA, 20 nt, Homo sapiens
aaccccuauagagaaaccau

SEQ ID NO: 174204 - RNA, 22 nt, Homo sapiens
aaccuacauucuuaacuguugc

SEQ ID NO: 174205 - RNA, 22 nt, Homo sapiens
aaccuuuagucagcucuuagga

SEQ ID NO: 174206 - RNA, 22 nt, Homo sapiens
aacuacaucucuuugaggcagg

SEQ ID NO: 174207 - RNA, 22 nt, Homo sapiens
aacucugucuccuucaaguuca

SEQ ID NO: 174208 - RNA, 22 nt, Homo sapiens
aacuggcauaugaacuuguucu

SEQ ID NO: 174209 - RNA, 22 nt, Homo sapiens
aacuggccuggcgugcagaggg

SEQ ID NO: 174210 - RNA, 22 nt, Homo sapiens
aacugggcaagcauuacauggu

SEQ ID NO: 174211 - RNA, 19 nt, Homo sapiens
aacuggugugagaugguau

SEQ ID NO: 174212 - RNA, 20 nt, Homo sapiens
aagacacuguccccacugga

SEQ ID NO: 174213 - RNA, 22 nt, Homo sapiens
aagagagcuaugugcauaauua

SEQ ID NO: 174214 - RNA, 22 nt, Homo sapiens
aagagcauuauuuaguaauuuc

SEQ ID NO: 174215 - RNA, 22 nt, Homo sapiens
aagagcucucuguagcauguga

SEQ ID NO: 174216 - RNA, 22 nt, Homo sapiens
aagagguagcagucacaaaaga

SEQ ID NO: 174217 - RNA, 22 nt, Homo sapiens
aagaguuaguaaaauuuccucu

SEQ ID NO: 174218 - RNA, 22 nt, Homo sapiens
aagauaguaaacauuuucugcu

SEQ ID NO: 174219 - RNA, 22 nt, Homo sapiens
aagauauguuaguuauaaacuc

SEQ ID NO: 174220 - RNA, 22 nt, Homo sapiens
aagaucaucauagagggcauga

SEQ ID NO: 174221 - RNA, 22 nt, Homo sapiens
aagaucauucagggaaggcuga

SEQ ID NO: 174222 - RNA, 22 nt, Homo sapiens
aagaugauguuguguuuucacu

SEQ ID NO: 174223 - RNA, 22 nt, Homo sapiens
aagaugcagaagcccagauguu

SEQ ID NO: 174224 - RNA, 22 nt, Homo sapiens
aagaugguauuucauuaguuuu

SEQ ID NO: 174225 - RNA, 22 nt, Homo sapiens
aagcaacacaucugccccgguu

SEQ ID NO: 174226 - RNA, 20 nt, Homo sapiens
aagcaagcauuugcaaucau

SEQ ID NO: 174227 - RNA, 22 nt, Homo sapiens
aagcaucacauaauggaucaug

SEQ ID NO: 174228 - RNA, 20 nt, Homo sapiens
aagcauggguuuuaggguca

SEQ ID NO: 174229 - RNA, 22 nt, Homo sapiens
aagcuacuuuggugguuccuua

SEQ ID NO: 174230 - RNA, 22 nt, Homo sapiens
aagcuagugagacagugguacu

SEQ ID NO: 174231 - RNA, 22 nt, Homo sapiens
aagcugccuugugaaggcauuc

SEQ ID NO: 174232 - RNA, 22 nt, Homo sapiens
aagcuguugguggauguaccau

SEQ ID NO: 174233 - RNA, 22 nt, Homo sapiens
aaggcaagaaugcgugcuuuca

SEQ ID NO: 174234 - RNA, 22 nt, Homo sapiens
aaggcaauuuguugugaggauu

SEQ ID NO: 174235 - RNA, 22 nt, Homo sapiens
aaggcuguucauuuagcacagu

SEQ ID NO: 174236 - RNA, 22 nt, Homo sapiens
aaggcuuuuugcugacguccuu

SEQ ID NO: 174237 - RNA, 22 nt, Homo sapiens
aagggaaugcuuccaguuugug

SEQ ID NO: 174238 - RNA, 22 nt, Homo sapiens
aagggaauguuguagcugguuu

SEQ ID NO: 174239 - RNA, 22 nt, Homo sapiens
aagggaauguuguggcugguug

SEQ ID NO: 174240 - RNA, 23 nt, Homo sapiens
aagguaagcuagaaagauguaga

SEQ ID NO: 174241 - RNA, 22 nt, Homo sapiens
aagguacuggaaagaggaaugg

SEQ ID NO: 174242 - RNA, 22 nt, Homo sapiens
aagguagguuccaaaauaccua

SEQ ID NO: 174243 - RNA, 22 nt, Homo sapiens
aagguauuucuaugggaauaga

SEQ ID NO: 174244 - RNA, 18 nt, Homo sapiens
aaggugcuucuguucuga

SEQ ID NO: 174245 - RNA, 22 nt, Homo sapiens
aagguggugucagagagcuuau

SEQ ID NO: 174246 - RNA, 21 nt, Homo sapiens
aagguuuuuagugcuugacuu

SEQ ID NO: 174247 - RNA, 22 nt, Homo sapiens
aaguaaaucuuaugucagggag

SEQ ID NO: 174248 - RNA, 22 nt, Homo sapiens
aaguaagcauccaauaaauguu

SEQ ID NO: 174249 - RNA, 22 nt, Homo sapiens
aaguagugcuugugcucaucuc

SEQ ID NO: 174250 - RNA, 18 nt, Homo sapiens
aaguauagagagcccuua

SEQ ID NO: 174251 - RNA, 22 nt, Homo sapiens
aaguaucaggaauaguuauugg

SEQ ID NO: 174252 - RNA, 22 nt, Homo sapiens
aaguauuaagacuaagaggcuu

SEQ ID NO: 174253 - RNA, 22 nt, Homo sapiens
aagucaaggagagaagcuucag

SEQ ID NO: 174254 - RNA, 22 nt, Homo sapiens
aagucauggagaagguggaggu

SEQ ID NO: 174255 - RNA, 22 nt, Homo sapiens
aaguccaugaagucuugugggu

SEQ ID NO: 174256 - RNA, 22 nt, Homo sapiens
aagugcaaaucuguggcugaaa

SEQ ID NO: 174257 - RNA, 22 nt, Homo sapiens
aagugcacuguaagugcaggau

SEQ ID NO: 174258 - RNA, 20 nt, Homo sapiens
aagugcaucguugugucugc

SEQ ID NO: 174259 - RNA, 22 nt, Homo sapiens
aagugcucuugugggaagagag

SEQ ID NO: 174260 - RNA, 22 nt, Homo sapiens
aagugcugggauuggccgggca

SEQ ID NO: 174261 - RNA, 22 nt, Homo sapiens
aagugcuuccuuucagaggguu

SEQ ID NO: 174262 - RNA, 22 nt, Homo sapiens
aagugcuuuacacaugcaugau

SEQ ID NO: 174263 - RNA, 22 nt, Homo sapiens
aagugguguuugggagcuggac

SEQ ID NO: 174264 - RNA, 22 nt, Homo sapiens
aagugguguuuguauuuaugca

SEQ ID NO: 174265 - RNA, 19 nt, Homo sapiens
aagugguuuaaacuuguau

SEQ ID NO: 174266 - RNA, 22 nt, Homo sapiens
aagugguuuuaaucuggugagu

SEQ ID NO: 174267 - RNA, 22 nt, Homo sapiens
aaguuguaguuagagaguugcu

SEQ ID NO: 174268 - RNA, 22 nt, Homo sapiens
aauaaagcugaauccuuccuga

SEQ ID NO: 174269 - RNA, 22 nt, Homo sapiens
aauaagcugagagaauucuaca

SEQ ID NO: 174270 - RNA, 22 nt, Homo sapiens
aauaaugucacaggggguuagc

SEQ ID NO: 174271 - RNA, 22 nt, Homo sapiens
aauacagcacacagaugggucu

SEQ ID NO: 174272 - RNA, 21 nt, Homo sapiens
aauacucuagguuaagagagc

SEQ ID NO: 174273 - RNA, 22 nt, Homo sapiens
aauacucuauaagggaagcugu

SEQ ID NO: 174274 - RNA, 22 nt, Homo sapiens
aauacugaaaguauuuucaaau

SEQ ID NO: 174275 - RNA, 22 nt, Homo sapiens
aauacugcuuugauguaagcua

SEQ ID NO: 174276 - RNA, 22 nt, Homo sapiens
aauacugugauaucgagcgauu

SEQ ID NO: 174277 - RNA, 22 nt, Homo sapiens
aauacuuccaaaucuagucauu

SEQ ID NO: 174278 - RNA, 22 nt, Homo sapiens
aauaucuguguauagauggggg

SEQ ID NO: 174279 - RNA, 22 nt, Homo sapiens
aaucacaguguucuugugaggg

SEQ ID NO: 174280 - RNA, 22 nt, Homo sapiens
aaucaccaugcacuacagccuu

SEQ ID NO: 174281 - RNA, 22 nt, Homo sapiens
aaucacguagcaguagggagaa

SEQ ID NO: 174282 - RNA, 22 nt, Homo sapiens
aaucacuaugccaugaaguaca

SEQ ID NO: 174283 - RNA, 21 nt, Homo sapiens
aaucacugucuguuuccccuu

SEQ ID NO: 174284 - RNA, 22 nt, Homo sapiens
aaucacuuuggcaccaaccuaa

SEQ ID NO: 174285 - RNA, 22 nt, Homo sapiens
aauccuguagauucuaauuccu

SEQ ID NO: 174286 - RNA, 22 nt, Homo sapiens
aaucucaacacuuugggaggcu

SEQ ID NO: 174287 - RNA, 22 nt, Homo sapiens
aaucucagagauaucugugucc

SEQ ID NO: 174288 - RNA, 22 nt, Homo sapiens
aaucucagcauuuugggcugag

SEQ ID NO: 174289 - RNA, 22 nt, Homo sapiens
aaucugauguuaucagcuuaag

SEQ ID NO: 174290 - RNA, 23 nt, Homo sapiens
aaucugucuuuguuauagggguc

SEQ ID NO: 174291 - RNA, 22 nt, Homo sapiens
aaugaaguuagauguugagaag

SEQ ID NO: 174292 - RNA, 22 nt, Homo sapiens
aaugacuaagaugguacauuuu

SEQ ID NO: 174293 - RNA, 22 nt, Homo sapiens
aaugauacuguguacaagggca

SEQ ID NO: 174294 - RNA, 22 nt, Homo sapiens
aaugcacauauauuuccuuauu

SEQ ID NO: 174295 - RNA, 22 nt, Homo sapiens
aaugccuagugugugacaggug

SEQ ID NO: 174296 - RNA, 22 nt, Homo sapiens
aauggcacaagacaugaagaag

SEQ ID NO: 174297 - RNA, 22 nt, Homo sapiens
aauggcaguagauggaugggua

SEQ ID NO: 174298 - RNA, 22 nt, Homo sapiens
aauggcauugguccuuuuggau

SEQ ID NO: 174299 - RNA, 22 nt, Homo sapiens
aauggcucuuuaggcaauagau

SEQ ID NO: 174300 - RNA, 22 nt, Homo sapiens
aauggcuucuuauugugguuca

SEQ ID NO: 174301 - RNA, 22 nt, Homo sapiens
aauggcuuucagcuuuucccca

SEQ ID NO: 174302 - RNA, 22 nt, Homo sapiens
aaugugccuacuggagcuugca

SEQ ID NO: 174303 - RNA, 22 nt, Homo sapiens
aauucugugagauggugcagau

SEQ ID NO: 174304 - RNA, 20 nt, Homo sapiens
acugcauuuaguccucagga

SEQ ID NO: 174305 - RNA, 22 nt, Homo sapiens
acugcauuugguaaagucaaga

SEQ ID NO: 174306 - RNA, 20 nt, Homo sapiens
acuggcacugguaggugugg

SEQ ID NO: 174307 - RNA, 22 nt, Homo sapiens
acuggcuuaaggaugggccacu

SEQ ID NO: 174308 - RNA, 22 nt, Homo sapiens
acuggcuuuugagaaaaacacu

SEQ ID NO: 174309 - RNA, 20 nt, Homo sapiens
acugggcuaccgaaguaagg

SEQ ID NO: 174310 - RNA, 22 nt, Homo sapiens
acugggucaaaguagaaaacua

SEQ ID NO: 174311 - RNA, 22 nt, Homo sapiens
acuuaguauggggcuuuugaga

SEQ ID NO: 174312 - RNA, 22 nt, Homo sapiens
acuuauuguggcugacccaaac

SEQ ID NO: 174313 - RNA, 22 nt, Homo sapiens
acuucauucucuggaucagaau

SEQ ID NO: 174314 - RNA, 21 nt, Homo sapiens
acuuucuguggcaguccauuc

SEQ ID NO: 174315 - RNA, 22 nt, Homo sapiens
acuuugcuuaucccaggcacug

SEQ ID NO: 174316 - RNA, 22 nt, Homo sapiens
acuuuguuauggcaacccuaag

SEQ ID NO: 174317 - RNA, 21 nt, Homo sapiens
acuuuguugggggcugaggca

SEQ ID NO: 174318 - RNA, 23 nt, Homo sapiens
agaaaugucuauucagggucccu

SEQ ID NO: 174319 - RNA, 22 nt, Homo sapiens
agaacccuuugaaauguguuug

SEQ ID NO: 174320 - RNA, 20 nt, Homo sapiens
agaaccuguaguguagaggg

SEQ ID NO: 174321 - RNA, 20 nt, Homo sapiens
agaagcauugcucucuucag

SEQ ID NO: 174322 - RNA, 22 nt, Homo sapiens
agaaugugaacaucuugaaagu

SEQ ID NO: 174323 - RNA, 22 nt, Homo sapiens
agacacugaaauguauugaaga

SEQ ID NO: 174324 - RNA, 21 nt, Homo sapiens
agacacuuggaagguuuuaga

SEQ ID NO: 174325 - RNA, 22 nt, Homo sapiens
agacagcuggaguaucauagcu

SEQ ID NO: 174326 - RNA, 22 nt, Homo sapiens
agacaucauuugauggugggag

SEQ ID NO: 174327 - RNA, 22 nt, Homo sapiens
agacuagagggaaaugaguugg

SEQ ID NO: 174328 - RNA, 20 nt, Homo sapiens
agacuagggagcagaaagcc

SEQ ID NO: 174329 - RNA, 22 nt, Homo sapiens
agacucauuuccauagucagcu

SEQ ID NO: 174330 - RNA, 22 nt, Homo sapiens
agagaacugauuggaugugggc

SEQ ID NO: 174331 - RNA, 22 nt, Homo sapiens
agagauaaagauuuuaauuuug

SEQ ID NO: 174332 - RNA, 22 nt, Homo sapiens
agagauaguuuccaacucauac

SEQ ID NO: 174333 - RNA, 22 nt, Homo sapiens
agagaucaauaugaaggaaaug

SEQ ID NO: 174334 - RNA, 20 nt, Homo sapiens
agagaucaguaauucaucaa

SEQ ID NO: 174335 - RNA, 22 nt, Homo sapiens
agagauccucauuuuauagaca

SEQ ID NO: 174336 - RNA, 22 nt, Homo sapiens
agagcaauguuaucagucucug

SEQ ID NO: 174337 - RNA, 22 nt, Homo sapiens
agagcacuguggguccaaauau

SEQ ID NO: 174338 - RNA, 22 nt, Homo sapiens
agagguaugccugggcuggagc

SEQ ID NO: 174339 - RNA, 22 nt, Homo sapiens
agagguuuaauugauucacagu

SEQ ID NO: 174340 - RNA, 22 nt, Homo sapiens
agaguacaggcaaguuagucau

SEQ ID NO: 174341 - RNA, 22 nt, Homo sapiens
agagugaagcuuuuuauauucu

SEQ ID NO: 174342 - RNA, 23 nt, Homo sapiens
agagugcaauggugccaucucgg

SEQ ID NO: 174343 - RNA, 22 nt, Homo sapiens
agauaugucugcuauuugcugu

SEQ ID NO: 174344 - RNA, 22 nt, Homo sapiens
agaugauguuucuggcacauga

SEQ ID NO: 174345 - RNA, 20 nt, Homo sapiens
agaugcaugcacauaaacac

SEQ ID NO: 174346 - RNA, 22 nt, Homo sapiens
agaugcauugguggcauauuca

SEQ ID NO: 174347 - RNA, 22 nt, Homo sapiens
agaugcauuuuuauuggaauac

SEQ ID NO: 174348 - RNA, 22 nt, Homo sapiens
agaugguauuauagguuucugu

SEQ ID NO: 174349 - RNA, 22 nt, Homo sapiens
agauggugauaaaugugguacc

SEQ ID NO: 174350 - RNA, 22 nt, Homo sapiens
agcaacauugagacugcaguug

SEQ ID NO: 174351 - RNA, 22 nt, Homo sapiens
agcaacauuguucauaauagcu

SEQ ID NO: 174352 - RNA, 22 nt, Homo sapiens
agcaacauuuuugaccuuucuu

SEQ ID NO: 174353 - RNA, 22 nt, Homo sapiens
agcaagaaugaacucucccaga

SEQ ID NO: 174354 - RNA, 22 nt, Homo sapiens
agcaagauccagucgcacagga

SEQ ID NO: 174355 - RNA, 22 nt, Homo sapiens
agcacauuaguaucuaagaaca

SEQ ID NO: 174356 - RNA, 22 nt, Homo sapiens
agcaccacaauuuccugccuaa

SEQ ID NO: 174357 - RNA, 22 nt, Homo sapiens
agcaccacauacuacagagaua

SEQ ID NO: 174358 - RNA, 22 nt, Homo sapiens
agcaccaugggcugaguaagug

SEQ ID NO: 174359 - RNA, 22 nt, Homo sapiens
agcaccauuucucuaaagcacu

SEQ ID NO: 174360 - RNA, 21 nt, Homo sapiens
agcagaguggcagcucuuuug

SEQ ID NO: 174361 - RNA, 22 nt, Homo sapiens
agcagcaccaaacagacuaaga

SEQ ID NO: 174362 - RNA, 22 nt, Homo sapiens
agcagcauggguauaaaucucc

SEQ ID NO: 174363 - RNA, 22 nt, Homo sapiens
agcagcauuaguggaaucuugu

SEQ ID NO: 174364 - RNA, 17 nt, Homo sapiens
agcagcccauaucccca

SEQ ID NO: 174365 - RNA, 16 nt, Homo sapiens
agcagguguuagguga

SEQ ID NO: 174366 - RNA, 22 nt, Homo sapiens
agcaguacauaaaaagcauccu

SEQ ID NO: 174367 - RNA, 22 nt, Homo sapiens
agcagugugagaauggacuaau

SEQ ID NO: 174368 - RNA, 19 nt, Homo sapiens
agcaguguggagauuucuc

SEQ ID NO: 174369 - RNA, 22 nt, Homo sapiens
agcaucagugauuuuguugaag

SEQ ID NO: 174370 - RNA, 22 nt, Homo sapiens
agcaucaugcaguugcuauuca

SEQ ID NO: 174371 - RNA, 19 nt, Homo sapiens
agcaucauuauuguuuugg

SEQ ID NO: 174372 - RNA, 22 nt, Homo sapiens
agccauacaacguaugcaugua

SEQ ID NO: 174373 - RNA, 17 nt, Homo sapiens
agccccauuagcuaguu

SEQ ID NO: 174374 - RNA, 23 nt, Homo sapiens
agcccugugacucgaacgaggag

SEQ ID NO: 174375 - RNA, 22 nt, Homo sapiens
agccuagagagccacuuugaga

SEQ ID NO: 174376 - RNA, 22 nt, Homo sapiens
agcgccauugcacuccagccuu

SEQ ID NO: 174377 - RNA, 22 nt, Homo sapiens
agcuagugugauucuuuggggu

SEQ ID NO: 174378 - RNA, 22 nt, Homo sapiens
agcucauugcaaccuccgccuc

SEQ ID NO: 174379 - RNA, 22 nt, Homo sapiens
agcucauugcuguccuggagga

SEQ ID NO: 174380 - RNA, 21 nt, Homo sapiens
agcuccacucguucccaaagc

SEQ ID NO: 174381 - RNA, 22 nt, Homo sapiens
agcuccauuguaaucaccuggu

SEQ ID NO: 174382 - RNA, 22 nt, Homo sapiens
agcuccuuugcuuuuuccagga

SEQ ID NO: 174383 - RNA, 22 nt, Homo sapiens
agcugccagucuuguaaggccu

SEQ ID NO: 174384 - RNA, 21 nt, Homo sapiens
agcugcguuuaggcauuuucc

SEQ ID NO: 174385 - RNA, 17 nt, Homo sapiens
agcuggaauuacgggag

SEQ ID NO: 174386 - RNA, 22 nt, Homo sapiens
agcuggacuugauaaaugaaua

SEQ ID NO: 174387 - RNA, 22 nt, Homo sapiens
agcuggauguauguuaagugaa

SEQ ID NO: 174388 - RNA, 20 nt, Homo sapiens
agcuggguguguuggugcau

SEQ ID NO: 174389 - RNA, 22 nt, Homo sapiens
agcugguauuuguuagggaguu

SEQ ID NO: 174390 - RNA, 22 nt, Homo sapiens
agcugguauuuugucgaggacu

SEQ ID NO: 174391 - RNA, 22 nt, Homo sapiens
agcugguccugugacuugcuuc

SEQ ID NO: 174392 - RNA, 21 nt, Homo sapiens
agcugguuuccacagugugcu

SEQ ID NO: 174393 - RNA, 20 nt, Homo sapiens
agcugguuuuaugaaucuuu

SEQ ID NO: 174394 - RNA, 20 nt, Homo sapiens
agcuguuguuaaaaaggagg

SEQ ID NO: 174395 - RNA, 22 nt, Homo sapiens
agcuugugauucuccaucaugu

SEQ ID NO: 174396 - RNA, 22 nt, Homo sapiens
agcuuguuuuauagaaagucaa

SEQ ID NO: 174397 - RNA, 22 nt, Homo sapiens
agcuuguuuuccugcaacuaga

SEQ ID NO: 174398 - RNA, 22 nt, Homo sapiens
agcuuuuugggcagcuauugac

SEQ ID NO: 174399 - RNA, 22 nt, Homo sapiens
aggaaaucuuagcugaggggau

SEQ ID NO: 174400 - RNA, 22 nt, Homo sapiens
aggaaauguuggucccauuucu

SEQ ID NO: 174401 - RNA, 22 nt, Homo sapiens
aggaagcuagcauuuguucagu

SEQ ID NO: 174402 - RNA, 22 nt, Homo sapiens
aggaauguuaguacuucuuagu

SEQ ID NO: 174403 - RNA, 22 nt, Homo sapiens
aggacacugauguaugcugugg

SEQ ID NO: 174404 - RNA, 22 nt, Homo sapiens
aggaccccucaucagcaccagu

SEQ ID NO: 174405 - RNA, 22 nt, Homo sapiens
aggagaauugguucuucuugau

SEQ ID NO: 174406 - RNA, 22 nt, Homo sapiens
aggagaucagccucccugcaac

SEQ ID NO: 174407 - RNA, 21 nt, Homo sapiens
aggagcauucaugacgagguu

SEQ ID NO: 174408 - RNA, 20 nt, Homo sapiens
aggagcauuuacauuggcuc

SEQ ID NO: 174409 - RNA, 22 nt, Homo sapiens
aggaggauugcuuucaucuuuu

SEQ ID NO: 174410 - RNA, 22 nt, Homo sapiens
aggagguaggaauugugcuagg

SEQ ID NO: 174411 - RNA, 22 nt, Homo sapiens
aggaucauugacuauuauaagg

SEQ ID NO: 174412 - RNA, 22 nt, Homo sapiens
aggcaagaaugcuuguuucacc

SEQ ID NO: 174413 - RNA, 21 nt, Homo sapiens
aggcaagguguuauuauugaa

SEQ ID NO: 174414 - RNA, 17 nt, Homo sapiens
auaugaauuuuggagau

SEQ ID NO: 174415 - RNA, 16 nt, Homo sapiens
auaugacuuuaggagg

SEQ ID NO: 174416 - RNA, 22 nt, Homo sapiens
auaugacuuuccucuacuuccu

SEQ ID NO: 174417 - RNA, 22 nt, Homo sapiens
auaugcacaguggaguacuauu

SEQ ID NO: 174418 - RNA, 22 nt, Homo sapiens
auaugcacgugcauacacacuu

SEQ ID NO: 174419 - RNA, 22 nt, Homo sapiens
auaugcacuauacacacguaua

SEQ ID NO: 174420 - RNA, 21 nt, Homo sapiens
auauggaacuggugacguguu

SEQ ID NO: 174421 - RNA, 22 nt, Homo sapiens
auauggcuaugugagcauacca

SEQ ID NO: 174422 - RNA, 22 nt, Homo sapiens
auaugguacuuaugcucaaacu

SEQ ID NO: 174423 - RNA, 22 nt, Homo sapiens
auaugguguuugcuauucagcu

SEQ ID NO: 174424 - RNA, 17 nt, Homo sapiens
auaugucugcuggggga

SEQ ID NO: 174425 - RNA, 22 nt, Homo sapiens
auaugucuuaguuaccuugggc

SEQ ID NO: 174426 - RNA, 22 nt, Homo sapiens
auaugugacuucaugcaaggcu

SEQ ID NO: 174427 - RNA, 21 nt, Homo sapiens
auaugugcuguggaagucagc

SEQ ID NO: 174428 - RNA, 22 nt, Homo sapiens
auauuacagagaggaccuggga

SEQ ID NO: 174429 - RNA, 22 nt, Homo sapiens
auauuagguuggugcaaaagua

SEQ ID NO: 174430 - RNA, 22 nt, Homo sapiens
auauucaagugaggauggcuaa

SEQ ID NO: 174431 - RNA, 22 nt, Homo sapiens
auauucacuauaugcagaacca

SEQ ID NO: 174432 - RNA, 22 nt, Homo sapiens
auauugcuuagugaugaagucu

SEQ ID NO: 174433 - RNA, 22 nt, Homo sapiens
aucaaacugcaaggcagcagca

SEQ ID NO: 174434 - RNA, 22 nt, Homo sapiens
aucaaaguaucucaauauggua

SEQ ID NO: 174435 - RNA, 22 nt, Homo sapiens
aucaaaugcuggcagagugccu

SEQ ID NO: 174436 - RNA, 22 nt, Homo sapiens
aucacacuguuauuuuaguuaa

SEQ ID NO: 174437 - RNA, 22 nt, Homo sapiens
aucacagauauggguuuaaauc

SEQ ID NO: 174438 - RNA, 22 nt, Homo sapiens
aucacagcccuccucuuggaug

SEQ ID NO: 174439 - RNA, 22 nt, Homo sapiens
aucacagcuacuccucugucuu

SEQ ID NO: 174440 - RNA, 22 nt, Homo sapiens
aucacagugaaaacagucaauu

SEQ ID NO: 174441 - RNA, 22 nt, Homo sapiens
aucacaguuaagaggugaugaa

SEQ ID NO: 174442 - RNA, 19 nt, Homo sapiens
aucaccagucuuuccacug

SEQ ID NO: 174443 - RNA, 22 nt, Homo sapiens
aucacugggcaagauaucauga

SEQ ID NO: 174444 - RNA, 22 nt, Homo sapiens
aucacuggucaugagagaagua

SEQ ID NO: 174445 - RNA, 22 nt, Homo sapiens
aucacuguccacucaucuuucu

SEQ ID NO: 174446 - RNA, 23 nt, Homo sapiens
aucacuguuaacaauuucuuccu

SEQ ID NO: 174447 - RNA, 22 nt, Homo sapiens
aucagaaucucuagaggacugu

SEQ ID NO: 174448 - RNA, 20 nt, Homo sapiens
aucagagccggugaaagggc

SEQ ID NO: 174449 - RNA, 22 nt, Homo sapiens
aucagauggcuaaaacagaaga

SEQ ID NO: 174450 - RNA, 22 nt, Homo sapiens
aucagcacugaucauacagcuu

SEQ ID NO: 174451 - RNA, 22 nt, Homo sapiens
aucagcagcaugaaaagcaacu

SEQ ID NO: 174452 - RNA, 22 nt, Homo sapiens
aucagcaguguaaaaacggacu

SEQ ID NO: 174453 - RNA, 22 nt, Homo sapiens
aucagcaugcagaagucggggg

SEQ ID NO: 174454 - RNA, 22 nt, Homo sapiens
aucagcauucccaaaugaugug

SEQ ID NO: 174455 - RNA, 22 nt, Homo sapiens
aucaggaaccuuuuuggugugu

SEQ ID NO: 174456 - RNA, 18 nt, Homo sapiens
aucagggugaagagagga

SEQ ID NO: 174457 - RNA, 22 nt, Homo sapiens
aucagugcauaguauuuaauga

SEQ ID NO: 174458 - RNA, 22 nt, Homo sapiens
aucauaucaucugcaaacaaag

SEQ ID NO: 174459 - RNA, 22 nt, Homo sapiens
aucauauccuagauauaacuuc

SEQ ID NO: 174460 - RNA, 22 nt, Homo sapiens
aucauccagccccagaagggag

SEQ ID NO: 174461 - RNA, 22 nt, Homo sapiens
auccauugucuaaugcuaagau

SEQ ID NO: 174462 - RNA, 22 nt, Homo sapiens
aucccugaggaauuucugcacu

SEQ ID NO: 174463 - RNA, 22 nt, Homo sapiens
aucccuuccuagcacuuggugu

SEQ ID NO: 174464 - RNA, 22 nt, Homo sapiens
aucccuuucucuggcuaggggg

SEQ ID NO: 174465 - RNA, 21 nt, Homo sapiens
auccuucuuuuucaaccugug

SEQ ID NO: 174466 - RNA, 22 nt, Homo sapiens
aucgcacuccauccugggcaac

SEQ ID NO: 174467 - RNA, 22 nt, Homo sapiens
aucuaaucaucgcaaccuucaa

SEQ ID NO: 174468 - RNA, 22 nt, Homo sapiens
aucuacagccagucugguuugu

SEQ ID NO: 174469 - RNA, 22 nt, Homo sapiens
aucucagcaacuaaagauccuu

SEQ ID NO: 174470 - RNA, 22 nt, Homo sapiens
aucucaguuaauuccaucuuuc

SEQ ID NO: 174471 - RNA, 22 nt, Homo sapiens
aucucugagauguucugauuuu

SEQ ID NO: 174472 - RNA, 22 nt, Homo sapiens
aucucuugccagucagaauggu

SEQ ID NO: 174473 - RNA, 22 nt, Homo sapiens
aucugcaaauaaugaagauugg

SEQ ID NO: 174474 - RNA, 22 nt, Homo sapiens
aucuggcguuuacuuccuuccu

SEQ ID NO: 174475 - RNA, 22 nt, Homo sapiens
aucugggguuggcaaaguuugg

SEQ ID NO: 174476 - RNA, 22 nt, Homo sapiens
aucuggguccguucugcuucuc

SEQ ID NO: 174477 - RNA, 22 nt, Homo sapiens
aucugguguauuggugcugggu

SEQ ID NO: 174478 - RNA, 22 nt, Homo sapiens
aucugguguggcugugauccuc

SEQ ID NO: 174479 - RNA, 22 nt, Homo sapiens
aucugugaaugaaguuauuuug

SEQ ID NO: 174480 - RNA, 22 nt, Homo sapiens
aucugugguuguaugcauauua

SEQ ID NO: 174481 - RNA, 22 nt, Homo sapiens
aucuucucuugaagggugggga

SEQ ID NO: 174482 - RNA, 21 nt, Homo sapiens
aucuugguauagucuuauugg

SEQ ID NO: 174483 - RNA, 22 nt, Homo sapiens
aucuuguguugaauggugcaga

SEQ ID NO: 174484 - RNA, 22 nt, Homo sapiens
aucuuuaguggcuguuuucaga

SEQ ID NO: 174485 - RNA, 22 nt, Homo sapiens
aucuuuggugaguucuuugguc

SEQ ID NO: 174486 - RNA, 23 nt, Homo sapiens
augaaagcccuugcaaaugcugg

SEQ ID NO: 174487 - RNA, 22 nt, Homo sapiens
augaaagguauguuuucuguga

SEQ ID NO: 174488 - RNA, 22 nt, Homo sapiens
augaaagucaauccccaagugu

SEQ ID NO: 174489 - RNA, 18 nt, Homo sapiens
augaacucaucaguucuu

SEQ ID NO: 174490 - RNA, 19 nt, Homo sapiens
augaacucaucauuucuca

SEQ ID NO: 174491 - RNA, 23 nt, Homo sapiens
augaacucaucauuuuuuauggc

SEQ ID NO: 174492 - RNA, 22 nt, Homo sapiens
augaagacaucgucugggauua

SEQ ID NO: 174493 - RNA, 17 nt, Homo sapiens
augaagucaucauuuuu

SEQ ID NO: 174494 - RNA, 20 nt, Homo sapiens
augaagugaaguuagggaac

SEQ ID NO: 174495 - RNA, 22 nt, Homo sapiens
augaaguuagcucauuucuuuu

SEQ ID NO: 174496 - RNA, 22 nt, Homo sapiens
augaauacagcuaugcgugcau

SEQ ID NO: 174497 - RNA, 22 nt, Homo sapiens
augaaugcaugaagguugggug

SEQ ID NO: 174498 - RNA, 23 nt, Homo sapiens
augaauguaaggaguguaagaaa

SEQ ID NO: 174499 - RNA, 20 nt, Homo sapiens
augaauguccuugauggcau

SEQ ID NO: 174500 - RNA, 22 nt, Homo sapiens
augacaaugaaucccuguuuca

SEQ ID NO: 174501 - RNA, 22 nt, Homo sapiens
augacaguaugacuccaaaagu

SEQ ID NO: 174502 - RNA, 22 nt, Homo sapiens
augaccaaugggcagagcuaga

SEQ ID NO: 174503 - RNA, 22 nt, Homo sapiens
augacuaaaggguuuauguuga

SEQ ID NO: 174504 - RNA, 18 nt, Homo sapiens
augacucuggguguuccu

SEQ ID NO: 174505 - RNA, 22 nt, Homo sapiens
augacuggaacagcaauuuaca

SEQ ID NO: 174506 - RNA, 22 nt, Homo sapiens
augacugucagggcagucauug

SEQ ID NO: 174507 - RNA, 22 nt, Homo sapiens
augacugucuugcagaggcuau

SEQ ID NO: 174508 - RNA, 22 nt, Homo sapiens
augagagcuaacuguggguaca

SEQ ID NO: 174509 - RNA, 22 nt, Homo sapiens
augagagcugacuuuaaggcaa

SEQ ID NO: 174510 - RNA, 22 nt, Homo sapiens
augagaucugugaacaccuguc

SEQ ID NO: 174511 - RNA, 22 nt, Homo sapiens
augagaugaauaccgacgaugu

SEQ ID NO: 174512 - RNA, 21 nt, Homo sapiens
augagauguuagacuuuagac

SEQ ID NO: 174513 - RNA, 22 nt, Homo sapiens
augagcaucaccagaaucaaua

SEQ ID NO: 174514 - RNA, 22 nt, Homo sapiens
augagcuauggagcucccaccu

SEQ ID NO: 174515 - RNA, 22 nt, Homo sapiens
augagcucauugggugacuggg

SEQ ID NO: 174516 - RNA, 22 nt, Homo sapiens
augagcuguuuggaagacacuu

SEQ ID NO: 174517 - RNA, 22 nt, Homo sapiens
augaggagauauuaaauaccau

SEQ ID NO: 174518 - RNA, 22 nt, Homo sapiens
augaggagguaugauuuucuga

SEQ ID NO: 174519 - RNA, 22 nt, Homo sapiens
augaggauagguuucuauuagg

SEQ ID NO: 174520 - RNA, 22 nt, Homo sapiens
augaggcaggaaaggcguaucu

SEQ ID NO: 174521 - RNA, 22 nt, Homo sapiens
augagggagggguggugccgca

SEQ ID NO: 174522 - RNA, 22 nt, Homo sapiens
augaggugcagaggaaaugagu

SEQ ID NO: 174523 - RNA, 22 nt, Homo sapiens
uuauuagguuaaccuauagcua

SEQ ID NO: 174524 - RNA, 22 nt, Homo sapiens
uuauuagguugguggaaaagua

SEQ ID NO: 174525 - RNA, 22 nt, Homo sapiens
uuauucugucuuuggucucaau

SEQ ID NO: 174526 - RNA, 22 nt, Homo sapiens
uuauugcacuccagccugggua

SEQ ID NO: 174527 - RNA, 22 nt, Homo sapiens
uuauugcuaaaucaugaccaca

SEQ ID NO: 174528 - RNA, 22 nt, Homo sapiens
uucaaaguaaaaauguguucac

SEQ ID NO: 174529 - RNA, 22 nt, Homo sapiens
uucaaaguguugguuuugggcu

SEQ ID NO: 174530 - RNA, 22 nt, Homo sapiens
uucaaaucuuuggcucccacua

SEQ ID NO: 174531 - RNA, 23 nt, Homo sapiens
uucaaauguucucugguugucag

SEQ ID NO: 174532 - RNA, 22 nt, Homo sapiens
uucaagauggccccagugagcc

SEQ ID NO: 174533 - RNA, 22 nt, Homo sapiens
uucaaguaagaaagacaucagg

SEQ ID NO: 174534 - RNA, 22 nt, Homo sapiens
uucacagugugaucuaugggca

SEQ ID NO: 174535 - RNA, 22 nt, Homo sapiens
uucaccuggaguucaggauaag

SEQ ID NO: 174536 - RNA, 22 nt, Homo sapiens
uucacugcacuccagccugagc

SEQ ID NO: 174537 - RNA, 22 nt, Homo sapiens
uucacuggagcccaggaguugg

SEQ ID NO: 174538 - RNA, 22 nt, Homo sapiens
uucagagagggagggauaccua

SEQ ID NO: 174539 - RNA, 22 nt, Homo sapiens
uucagagcauugguuuuuugaa

SEQ ID NO: 174540 - RNA, 19 nt, Homo sapiens
uucagcagugucugcucuu

SEQ ID NO: 174541 - RNA, 22 nt, Homo sapiens
uucagcuacuuggaaacagcaa

SEQ ID NO: 174542 - RNA, 22 nt, Homo sapiens
uucaggcaccauggucauugau

SEQ ID NO: 174543 - RNA, 22 nt, Homo sapiens
uucaggcaccauugucauugau

SEQ ID NO: 174544 - RNA, 22 nt, Homo sapiens
uucaggcuccgugccagcuccg

SEQ ID NO: 174545 - RNA, 22 nt, Homo sapiens
uucaggcuuuuauuuacugaua

SEQ ID NO: 174546 - RNA, 22 nt, Homo sapiens
uucagggagaaggcaaacguug

SEQ ID NO: 174547 - RNA, 22 nt, Homo sapiens
uucagguaauuaugguuugucu

SEQ ID NO: 174548 - RNA, 22 nt, Homo sapiens
uucaguacacguguucucauuu

SEQ ID NO: 174549 - RNA, 22 nt, Homo sapiens
uucaguccauuuccuuggucac

SEQ ID NO: 174550 - RNA, 18 nt, Homo sapiens
uucagugaauucuuuuga

SEQ ID NO: 174551 - RNA, 20 nt, Homo sapiens
uucagugcagguaacaaucc

SEQ ID NO: 174552 - RNA, 22 nt, Homo sapiens
uucaguucugcucugaucuuag

SEQ ID NO: 174553 - RNA, 22 nt, Homo sapiens
uucauacaguggcugcacucca

SEQ ID NO: 174554 - RNA, 22 nt, Homo sapiens
uucauagucuaugcaaguaaga

SEQ ID NO: 174555 - RNA, 22 nt, Homo sapiens
uucauaguuuauacugauauuu

SEQ ID NO: 174556 - RNA, 22 nt, Homo sapiens
uucaucacagucuccgaugccc

SEQ ID NO: 174557 - RNA, 21 nt, Homo sapiens
uucaucagccagaaaucaagc

SEQ ID NO: 174558 - RNA, 22 nt, Homo sapiens
uucaucagcuguagaugucaug

SEQ ID NO: 174559 - RNA, 22 nt, Homo sapiens
uucauccccuccaaaucucaug

SEQ ID NO: 174560 - RNA, 22 nt, Homo sapiens
uucaugcaucuguagugguuaa

SEQ ID NO: 174561 - RNA, 22 nt, Homo sapiens
uucauggagccauccuuugauc

SEQ ID NO: 174562 - RNA, 22 nt, Homo sapiens
uucauggaguuuaaauuguagu

SEQ ID NO: 174563 - RNA, 22 nt, Homo sapiens
uucauggauggaaaugauuuug

SEQ ID NO: 174564 - RNA, 22 nt, Homo sapiens
uucauggugguacaaaagcaau

SEQ ID NO: 174565 - RNA, 22 nt, Homo sapiens
uucauguaauauauuucaggcc

SEQ ID NO: 174566 - RNA, 22 nt, Homo sapiens
uucauguaaucaaggcagcuaa

SEQ ID NO: 174567 - RNA, 22 nt, Homo sapiens
uucauuggacuuguguucuuga

SEQ ID NO: 174568 - RNA, 22 nt, Homo sapiens
uuccaagugggaaacaaaaaug

SEQ ID NO: 174569 - RNA, 22 nt, Homo sapiens
uuccacaaugguugaacuaguu

SEQ ID NO: 174570 - RNA, 22 nt, Homo sapiens
uuccagagucaccuuucugucg

SEQ ID NO: 174571 - RNA, 22 nt, Homo sapiens
uuccagcugggggcaacucugc

SEQ ID NO: 174572 - RNA, 22 nt, Homo sapiens
uuccaguguguucauccucaga

SEQ ID NO: 174573 - RNA, 22 nt, Homo sapiens
uuccaguguuugacucaccuuu

SEQ ID NO: 174574 - RNA, 22 nt, Homo sapiens
uuccaugagaugcaucaaagcu

SEQ ID NO: 174575 - RNA, 22 nt, Homo sapiens
uuccauguaguugaacgguuuu

SEQ ID NO: 174576 - RNA, 22 nt, Homo sapiens
uucccagagaaaaggguuucuu

SEQ ID NO: 174577 - RNA, 22 nt, Homo sapiens
uucccaguaaacucuaucccuc

SEQ ID NO: 174578 - RNA, 22 nt, Homo sapiens
uucccaguuggggaaagcgacc

SEQ ID NO: 174579 - RNA, 22 nt, Homo sapiens
uucccuagaacacauggaggga

SEQ ID NO: 174580 - RNA, 22 nt, Homo sapiens
uucccugagcaucuguugagcc

SEQ ID NO: 174581 - RNA, 22 nt, Homo sapiens
uucccugugugcagaugggugu

SEQ ID NO: 174582 - RNA, 22 nt, Homo sapiens
uucccuugcaggaugaucugga

SEQ ID NO: 174583 - RNA, 22 nt, Homo sapiens
uucccuuugugcauaggauuug

SEQ ID NO: 174584 - RNA, 22 nt, Homo sapiens
uuccuagagauuagcaagcugc

SEQ ID NO: 174585 - RNA, 22 nt, Homo sapiens
uuccugagccuuguaucuagua

SEQ ID NO: 174586 - RNA, 20 nt, Homo sapiens
uuccuuaggcauuggaagaa

SEQ ID NO: 174587 - RNA, 22 nt, Homo sapiens
uuccuuguagcaaaugcgauga

SEQ ID NO: 174588 - RNA, 22 nt, Homo sapiens
uuccuugugacuaguagugacc

SEQ ID NO: 174589 - RNA, 22 nt, Homo sapiens
uucgucccuuuuggaauccucu

SEQ ID NO: 174590 - RNA, 21 nt, Homo sapiens
uucuacuccggcguuguuuuu

SEQ ID NO: 174591 - RNA, 20 nt, Homo sapiens
uucuauggugaugaguccug

SEQ ID NO: 174592 - RNA, 22 nt, Homo sapiens
uucuauguuugaaaaugccaaa

SEQ ID NO: 174593 - RNA, 21 nt, Homo sapiens
uucucaggguguguccuaccc

SEQ ID NO: 174594 - RNA, 22 nt, Homo sapiens
uucucaguuccuacuuugguga

SEQ ID NO: 174595 - RNA, 22 nt, Homo sapiens
uucucauggugauggcaaaauc

SEQ ID NO: 174596 - RNA, 22 nt, Homo sapiens
uucucuggucagaggggagguu

SEQ ID NO: 174597 - RNA, 19 nt, Homo sapiens
uucucugguuguacuaccc

SEQ ID NO: 174598 - RNA, 22 nt, Homo sapiens
uucugccaaucaacccacaucc

SEQ ID NO: 174599 - RNA, 23 nt, Homo sapiens
uucugccacugaaaaugccucag

SEQ ID NO: 174600 - RNA, 22 nt, Homo sapiens
uucuggcucaggucaacacuuc

SEQ ID NO: 174601 - RNA, 22 nt, Homo sapiens
uucugguuaauacuugcaaaaa

SEQ ID NO: 174602 - RNA, 22 nt, Homo sapiens
uucuuagucaaguuguauuuca

SEQ ID NO: 174603 - RNA, 22 nt, Homo sapiens
uucuugaggcaugccgcuggga

SEQ ID NO: 174604 - RNA, 22 nt, Homo sapiens
uucuugcacuuaacugacauuc

SEQ ID NO: 174605 - RNA, 22 nt, Homo sapiens
uucuugguuuaucgcuuuaaaa

SEQ ID NO: 174606 - RNA, 22 nt, Homo sapiens
uucuuugcaugaucucaaaguc

SEQ ID NO: 174607 - RNA, 22 nt, Homo sapiens
uucuuuggaaacaguacuaauu

SEQ ID NO: 174608 - RNA, 22 nt, Homo sapiens
uucuuuggauaaaguuuuaugc

SEQ ID NO: 174609 - RNA, 22 nt, Homo sapiens
uugaaagaugaacuggauugga

SEQ ID NO: 174610 - RNA, 22 nt, Homo sapiens
uugaaaguaaacaucacaaaga

SEQ ID NO: 174611 - RNA, 22 nt, Homo sapiens
uugaaagucauuucuucuaagu

SEQ ID NO: 174612 - RNA, 22 nt, Homo sapiens
uugaacuagaaccugcaaauuu

SEQ ID NO: 174613 - RNA, 22 nt, Homo sapiens
uugaagacuaccuaccauacuu

SEQ ID NO: 174614 - RNA, 22 nt, Homo sapiens
uugaagguaauugguuuuauga

SEQ ID NO: 174615 - RNA, 22 nt, Homo sapiens
uugaagguagaaguucucaauu

SEQ ID NO: 174616 - RNA, 22 nt, Homo sapiens
uugaaguagaaagacgaaauuu

SEQ ID NO: 174617 - RNA, 22 nt, Homo sapiens
uugaaguauagaguuuaagaac

SEQ ID NO: 174618 - RNA, 22 nt, Homo sapiens
uugaaugaaauuggugugggga

SEQ ID NO: 174619 - RNA, 22 nt, Homo sapiens
uugacagaccuuggucauaucc

SEQ ID NO: 174620 - RNA, 22 nt, Homo sapiens
uugacauaaucauuucacagug

SEQ ID NO: 174621 - RNA, 22 nt, Homo sapiens
uugaccuggagaguacuuugac

SEQ ID NO: 174622 - RNA, 23 nt, Homo sapiens
uugacuguggguacaaugugaua

SEQ ID NO: 174623 - RNA, 21 nt, Homo sapiens
uugagaagaauuagcucuucc

SEQ ID NO: 174624 - RNA, 22 nt, Homo sapiens
uugagagaaaaaauuuauuggu

SEQ ID NO: 174625 - RNA, 22 nt, Homo sapiens
uugagagaaaaggccaugccuu

SEQ ID NO: 174626 - RNA, 22 nt, Homo sapiens
uugagagagaacauuuguuaca

SEQ ID NO: 174627 - RNA, 22 nt, Homo sapiens
uugagagcugaugaaagauaaa

SEQ ID NO: 174628 - RNA, 22 nt, Homo sapiens
uugagaguggcagagguggaac

SEQ ID NO: 174629 - RNA, 22 nt, Homo sapiens
uugagaucaugcuacugcacuc

SEQ ID NO: 174630 - RNA, 22 nt, Homo sapiens
uugagaucuacuacuguaggag

SEQ ID NO: 174631 - RNA, 22 nt, Homo sapiens
uugagaugauggauaugcuaau

SEQ ID NO: 174632 - RNA, 22 nt, Homo sapiens
uuguauaggcucaguaagaauc

SEQ ID NO: 174633 - RNA, 22 nt, Homo sapiens
uuguauugucuugaugaguuga

SEQ ID NO: 174634 - RNA, 22 nt, Homo sapiens
uugucccauggggucuuccuuu

SEQ ID NO: 174635 - RNA, 23 nt, Homo sapiens
uuguccccuccaaagcucauguu

SEQ ID NO: 174636 - RNA, 19 nt, Homo sapiens
uuguccccucuaaaucuca

SEQ ID NO: 174637 - RNA, 22 nt, Homo sapiens
uuguccuccacauuugaucagu

SEQ ID NO: 174638 - RNA, 22 nt, Homo sapiens
uuguccuggagguucuugcaag

SEQ ID NO: 174639 - RNA, 22 nt, Homo sapiens
uugucucacuggaguuuaguaa

SEQ ID NO: 174640 - RNA, 19 nt, Homo sapiens
uugucuuagaguugucauu

SEQ ID NO: 174641 - RNA, 22 nt, Homo sapiens
uugugaaaaaccucucguggaa

SEQ ID NO: 174642 - RNA, 22 nt, Homo sapiens
uugugaagaaaccagaaaaguu

SEQ ID NO: 174643 - RNA, 22 nt, Homo sapiens
uugugaauggugccgcaauaaa

SEQ ID NO: 174644 - RNA, 22 nt, Homo sapiens
uugugaucuucagaaaguggcu

SEQ ID NO: 174645 - RNA, 22 nt, Homo sapiens
uugugauugagugauccuuguu

SEQ ID NO: 174646 - RNA, 22 nt, Homo sapiens
uugugcaugaugcauacauggu

SEQ ID NO: 174647 - RNA, 22 nt, Homo sapiens
uugugcauguauauuaguucac

SEQ ID NO: 174648 - RNA, 20 nt, Homo sapiens
uugugcauugggccauuggg

SEQ ID NO: 174649 - RNA, 21 nt, Homo sapiens
uugugccaaacccuggaggga

SEQ ID NO: 174650 - RNA, 22 nt, Homo sapiens
uugugcuuaauaaaaaguggua

SEQ ID NO: 174651 - RNA, 22 nt, Homo sapiens
uugugcuucaucaccuagcaga

SEQ ID NO: 174652 - RNA, 22 nt, Homo sapiens
uugugguuuuuaaaacuaggug

SEQ ID NO: 174653 - RNA, 22 nt, Homo sapiens
uuguguaguaccucucacauug

SEQ ID NO: 174654 - RNA, 22 nt, Homo sapiens
uuguguuuuuaguagggaaggg

SEQ ID NO: 174655 - RNA, 22 nt, Homo sapiens
uuguucaggagguuggggaugc

SEQ ID NO: 174656 - RNA, 23 nt, Homo sapiens
uuguucccuuccacucagucucc

SEQ ID NO: 174657 - RNA, 22 nt, Homo sapiens
uuguuuagagacuggaauuaaa

SEQ ID NO: 174658 - RNA, 22 nt, Homo sapiens
uuuaaagcuaaaauauguuuau

SEQ ID NO: 174659 - RNA, 22 nt, Homo sapiens
uuuaacauuggaugagaucguc

SEQ ID NO: 174660 - RNA, 22 nt, Homo sapiens
uuuaaguguuuguuccugaaaa

SEQ ID NO: 174661 - RNA, 22 nt, Homo sapiens
uuuaaugcugcccagucauggg

SEQ ID NO: 174662 - RNA, 21 nt, Homo sapiens
uuuacuguggacccauugcuu

SEQ ID NO: 174663 - RNA, 22 nt, Homo sapiens
uuuagcaaagcaauuuacacca

SEQ ID NO: 174664 - RNA, 22 nt, Homo sapiens
uuuagcaauucauuuugugucu

SEQ ID NO: 174665 - RNA, 22 nt, Homo sapiens
uuuagcagcaaagagccaugcu

SEQ ID NO: 174666 - RNA, 22 nt, Homo sapiens
uuuagguauuugguauagcagu

SEQ ID NO: 174667 - RNA, 22 nt, Homo sapiens
uuuagguuacauauaauccaaa

SEQ ID NO: 174668 - RNA, 22 nt, Homo sapiens
uuucaacuaauuuuuuggugag

SEQ ID NO: 174669 - RNA, 18 nt, Homo sapiens
uuucaagucuuaggugac

SEQ ID NO: 174670 - RNA, 22 nt, Homo sapiens
uuucacagcaauugccuauugu

SEQ ID NO: 174671 - RNA, 22 nt, Homo sapiens
uuucacuagccagcccuuuauu

SEQ ID NO: 174672 - RNA, 21 nt, Homo sapiens
uuucacugugaguuuuucugu

SEQ ID NO: 174673 - RNA, 22 nt, Homo sapiens
uuucauagaucaugcuuuugga

SEQ ID NO: 174674 - RNA, 22 nt, Homo sapiens
uuucauagccuucuaaugaguu

SEQ ID NO: 174675 - RNA, 22 nt, Homo sapiens
uuucauagccuuugucgucuga

SEQ ID NO: 174676 - RNA, 22 nt, Homo sapiens
uuucaucaagcacagaguagau

SEQ ID NO: 174677 - RNA, 22 nt, Homo sapiens
uuucaucagccagggucagucu

SEQ ID NO: 174678 - RNA, 22 nt, Homo sapiens
uuucauggacgcaaugccuuuu

SEQ ID NO: 174679 - RNA, 22 nt, Homo sapiens
uuucauggaggcauuuuagauu

SEQ ID NO: 174680 - RNA, 19 nt, Homo sapiens
uuucauguuuuuggugaga

SEQ ID NO: 174681 - RNA, 22 nt, Homo sapiens
uuuccaagaugcuuacuuucuc

SEQ ID NO: 174682 - RNA, 19 nt, Homo sapiens
uuuccaguaaucuuaugug

SEQ ID NO: 174683 - RNA, 22 nt, Homo sapiens
uuuccauguuggugaaaugagg

SEQ ID NO: 174684 - RNA, 22 nt, Homo sapiens
uuucccauuguucugcucugug

SEQ ID NO: 174685 - RNA, 19 nt, Homo sapiens
uuucccugcagaccuacua

SEQ ID NO: 174686 - RNA, 22 nt, Homo sapiens
uuucccuuugcuuugucagcca

SEQ ID NO: 174687 - RNA, 22 nt, Homo sapiens
uuucgguuaucuagcuuuauga

SEQ ID NO: 174688 - RNA, 22 nt, Homo sapiens
uuucgugucuggucugugaugg

SEQ ID NO: 174689 - RNA, 15 nt, Homo sapiens
uuucuacugcacuuc

SEQ ID NO: 174690 - RNA, 22 nt, Homo sapiens
uuucugagaccaaaacuuguaa

SEQ ID NO: 174691 - RNA, 22 nt, Homo sapiens
uuucugaggccucaccagaagc

SEQ ID NO: 174692 - RNA, 23 nt, Homo sapiens
uuucuugggcaugcuaugucagu

SEQ ID NO: 174693 - RNA, 22 nt, Homo sapiens
uuugaaugcaacaaaugcggga

SEQ ID NO: 174694 - RNA, 22 nt, Homo sapiens
uuugaauguaaugagcaggaag

SEQ ID NO: 174695 - RNA, 22 nt, Homo sapiens
uuugacaaugugugcuuguauu

SEQ ID NO: 174696 - RNA, 22 nt, Homo sapiens
uuugacuacugaugguguacgc

SEQ ID NO: 174697 - RNA, 22 nt, Homo sapiens
uuugacuagaguguuuuacaac

SEQ ID NO: 174698 - RNA, 22 nt, Homo sapiens
uuugacucacagccuggcugcc

SEQ ID NO: 174699 - RNA, 22 nt, Homo sapiens
uuugagauaucuuccaucagua

SEQ ID NO: 174700 - RNA, 22 nt, Homo sapiens
uuugagcaggcuaaucaauaua

SEQ ID NO: 174701 - RNA, 22 nt, Homo sapiens
uuugagcauggaaauggcauga

SEQ ID NO: 174702 - RNA, 23 nt, Homo sapiens
uuugagugugauaaacacuguca

SEQ ID NO: 174703 - RNA, 16 nt, Homo sapiens
uuugcaagaucagaag

SEQ ID NO: 174704 - RNA, 22 nt, Homo sapiens
uuugcaagaugaaaaaguucua

SEQ ID NO: 174705 - RNA, 22 nt, Homo sapiens
uuugcaccuuccuaguggcuga

SEQ ID NO: 174706 - RNA, 22 nt, Homo sapiens
uuugcacucaguaagugggagc

SEQ ID NO: 174707 - RNA, 22 nt, Homo sapiens
uuugcacuggagauucaauggg

SEQ ID NO: 174708 - RNA, 22 nt, Homo sapiens
uuugcacuuuaauauaauguga

SEQ ID NO: 174709 - RNA, 21 nt, Homo sapiens
uuugcacuuugcaaaucccua

SEQ ID NO: 174710 - RNA, 22 nt, Homo sapiens
uuugcagagucuuucgcugggc

SEQ ID NO: 174711 - RNA, 22 nt, Homo sapiens
uuugcagugucagcuucugugu

SEQ ID NO: 174712 - RNA, 22 nt, Homo sapiens
uuugccaauauuuuacugagga

SEQ ID NO: 174713 - RNA, 22 nt, Homo sapiens
uuugccaauauuuuauugagga

SEQ ID NO: 174714 - RNA, 18 nt, Homo sapiens
uuugccacuucccagaaa

SEQ ID NO: 174715 - RNA, 22 nt, Homo sapiens
uuugccuuugugauauggucua

SEQ ID NO: 174716 - RNA, 22 nt, Homo sapiens
uuugcuaaucaacacuggccug

SEQ ID NO: 174717 - RNA, 22 nt, Homo sapiens
uuugcuauagugaauagugcug

SEQ ID NO: 174718 - RNA, 22 nt, Homo sapiens
uuugcugagucauuccaugcug

SEQ ID NO: 174719 - RNA, 22 nt, Homo sapiens
uuugcuuaguaaauguagaaaa

SEQ ID NO: 174720 - RNA, 22 nt, Homo sapiens
uuuggacuucuagccuccagag

SEQ ID NO: 174721 - RNA, 22 nt, Homo sapiens
uuuggcauuugaguuuguagga

SEQ ID NO: 174722 - RNA, 22 nt, Homo sapiens
uuuggcccugagggauggcaua

SEQ ID NO: 174723 - RNA, 18 nt, Homo sapiens
uuuggcuguucaugacuc

SEQ ID NO: 174724 - RNA, 22 nt, Homo sapiens
uuugguaguuuguugggaccca

SEQ ID NO: 174725 - RNA, 22 nt, Homo sapiens
uuugguccaguguucagguccu

SEQ ID NO: 174726 - RNA, 22 nt, Homo sapiens
uuugguuauuugaaacuagcau

SEQ ID NO: 174727 - RNA, 22 nt, Homo sapiens
uuugguugcauucacauauuuc

SEQ ID NO: 174728 - RNA, 22 nt, Homo sapiens
uuuguacacgugggugaauugu

SEQ ID NO: 174729 - RNA, 22 nt, Homo sapiens
uuuguacuaugguuuuucacua

SEQ ID NO: 174730 - RNA, 22 nt, Homo sapiens
uuuguacugagccaagauggua

SEQ ID NO: 174731 - RNA, 22 nt, Homo sapiens
uuuguacuugaagaaucuuuau

SEQ ID NO: 174732 - RNA, 22 nt, Homo sapiens
uuuguagcucacucugagcuga

SEQ ID NO: 174733 - RNA, 21 nt, Homo sapiens
uuuguaguagcaugauuuaua

SEQ ID NO: 174734 - RNA, 22 nt, Homo sapiens
uuuguauguuggagauuggaga

SEQ ID NO: 174735 - RNA, 22 nt, Homo sapiens
uuugucacccugaauguaagau

SEQ ID NO: 174736 - RNA, 22 nt, Homo sapiens
uuugucauagcagcaggaaugg

SEQ ID NO: 174737 - RNA, 22 nt, Homo sapiens
uuugucuccuaagacucugugg

SEQ ID NO: 174738 - RNA, 22 nt, Homo sapiens
uuugugaaugucauaagcucca

SEQ ID NO: 174739 - RNA, 22 nt, Homo sapiens
uuugugcuauguuauauauucu

SEQ ID NO: 174740 - RNA, 22 nt, Homo sapiens
uuugugcuccugugagaaucua

SEQ ID NO: 174741 - RNA, 22 nt, Homo sapiens
uuuguucaccucaaggauggga

SEQ ID NO: 174742 - RNA, 22 nt, Homo sapiens
uuuuacacuguugguuggaaug

SEQ ID NO: 174743 - RNA, 22 nt, Homo sapiens
uuuuacagaggagguugcugau

SEQ ID NO: 174744 - RNA, 22 nt, Homo sapiens
uuuuagcagccaugacaaagau

SEQ ID NO: 174745 - RNA, 22 nt, Homo sapiens
uuuuagcuuuucccaggacucc

SEQ ID NO: 174746 - RNA, 22 nt, Homo sapiens
uuuuaguugcucagguauucuc

SEQ ID NO: 174747 - RNA, 22 nt, Homo sapiens
uuuuaugggcuauuugcauuag

SEQ ID NO: 174748 - RNA, 19 nt, Homo sapiens
uuuuccccuuucuuaagac

SEQ ID NO: 174749 - RNA, 23 nt, Homo sapiens
uuuugcaauaagucacuggaaua

SEQ ID NO: 174750 - RNA, 22 nt, Homo sapiens
uuuugcacauugauuugguauc

SEQ ID NO: 174751 - RNA, 20 nt, Homo sapiens
uuuugcacuccuacuaaggu

SEQ ID NO: 174752 - RNA, 22 nt, Homo sapiens
uuuugcacuguuuuaucugaca

SEQ ID NO: 174753 - RNA, 22 nt, Homo sapiens
uuuugcaggucaggggcagaga

SEQ ID NO: 174754 - RNA, 22 nt, Homo sapiens
uuuugcauuggcugaggagugu

SEQ ID NO: 174755 - RNA, 19 nt, Homo sapiens
uuuugcucuuuauaccuau

SEQ ID NO: 174756 - RNA, 22 nt, Homo sapiens
uuuuggcucuugguaggucaga

SEQ ID NO: 174757 - RNA, 22 nt, Homo sapiens
uuuuggcuuuuccucagcaagc

SEQ ID NO: 174758 - RNA, 22 nt, Homo sapiens
uuuugguaaugaacuuaggaag

SEQ ID NO: 174759 - RNA, 22 nt, Homo sapiens
uuuugugacuauuguaaauggg

SEQ ID NO: 174760 - RNA, 22 nt, Homo sapiens
uuuuugaguagcuggagagcag

SEQ ID NO: 174761 - RNA, 16 nt, Homo sapiens
uuuuugcagaaaugac

SEQ ID NO: 174762 - RNA, 22 nt, Homo sapiens
uuuuugugguauauugcaacaa

SEQ ID NO: 174763 - RNA, 22 nt, Homo sapiens
uuuuuugguaauugaacaauga

SEQ ID NO: 174764 - RNA, 22 nt, Homo sapiens
ugcaaucauuuggaggagaaga

SEQ ID NO: 174765 - RNA, 18 nt, Homo sapiens
ugcaauggagaugcagcc

SEQ ID NO: 174766 - RNA, 22 nt, Homo sapiens
ugcaaugucuucugaggggagc

SEQ ID NO: 174767 - RNA, 22 nt, Homo sapiens
ugcacaguccagugcccacuga

SEQ ID NO: 174768 - RNA, 22 nt, Homo sapiens
ugcaccacacuccauccugggc

SEQ ID NO: 174769 - RNA, 22 nt, Homo sapiens
uggcuugauggcacaagguuuc

SEQ ID NO: 174770 - RNA, 22 nt, Homo sapiens
uggcuuuuaucuacucucaacu

SEQ ID NO: 174771 - RNA, 22 nt, Homo sapiens
uggcuuuuccuugaaucugccu

SEQ ID NO: 174772 - RNA, 22 nt, Homo sapiens
ugggaagauucuguguuuuucc

SEQ ID NO: 174773 - RNA, 22 nt, Homo sapiens
ugggagcauugcauuagaagcc

SEQ ID NO: 174774 - RNA, 22 nt, Homo sapiens
cuucaucugguuugugaacuuu

SEQ ID NO: 174775 - RNA, 22 nt, Homo sapiens
cuucaugagacuuuuggaaggc

SEQ ID NO: 174776 - RNA, 22 nt, Homo sapiens
cuucaugggagaaccacaggua

SEQ ID NO: 174777 - RNA, 22 nt, Homo sapiens
cuucaugucuucaauggggggg

SEQ ID NO: 174778 - RNA, 22 nt, Homo sapiens
cuuccaguggcagccgggcaug

SEQ ID NO: 174779 - RNA, 22 nt, Homo sapiens
cuucucagugcucaucuuauuu

SEQ ID NO: 174780 - RNA, 22 nt, Homo sapiens
cuucugauugaaaauggaguag

SEQ ID NO: 174781 - RNA, 22 nt, Homo sapiens
cuugaauguaaauaauguacag

SEQ ID NO: 174782 - RNA, 22 nt, Homo sapiens
cuugacacugucacucaggcca

SEQ ID NO: 174783 - RNA, 22 nt, Homo sapiens
cuugaccuauggaucuguuuuu

SEQ ID NO: 174784 - RNA, 23 nt, Homo sapiens
cuugagacaaaugcgugugugca

SEQ ID NO: 174785 - RNA, 22 nt, Homo sapiens
cuugagcauauucuauauuaaa

SEQ ID NO: 174786 - RNA, 22 nt, Homo sapiens
cuugcacuccacuguucuccug

SEQ ID NO: 174787 - RNA, 22 nt, Homo sapiens
cuugcacuugaaauuccaguuu

SEQ ID NO: 174788 - RNA, 22 nt, Homo sapiens
cuugcagagcccauggauguca

SEQ ID NO: 174789 - RNA, 22 nt, Homo sapiens
cuugcauagaguuauugcccuu

SEQ ID NO: 174790 - RNA, 22 nt, Homo sapiens
cuuggacaccucaugcccaccu

SEQ ID NO: 174791 - RNA, 22 nt, Homo sapiens
cuuggcacgugauagguguuga

SEQ ID NO: 174792 - RNA, 22 nt, Homo sapiens
cuuggcacugcucacccuccuu

SEQ ID NO: 174793 - RNA, 22 nt, Homo sapiens
cuuggcuugguaucaaauaacc

SEQ ID NO: 174794 - RNA, 22 nt, Homo sapiens
cuugggauauguguuacucugu

SEQ ID NO: 174795 - RNA, 22 nt, Homo sapiens
cuugggccccacccaaaucuua

SEQ ID NO: 174796 - RNA, 22 nt, Homo sapiens
cuugguuacauuuuccuagaaa

SEQ ID NO: 174797 - RNA, 18 nt, Homo sapiens
cuugucaaaucuuuccuc

SEQ ID NO: 174798 - RNA, 22 nt, Homo sapiens
cuuguguuacauauuuaagaga

SEQ ID NO: 174799 - RNA, 22 nt, Homo sapiens
cuuguucuccuaagaugaaugc

SEQ ID NO: 174800 - RNA, 22 nt, Homo sapiens
cuuuagcaauugauuaugccau

SEQ ID NO: 174801 - RNA, 22 nt, Homo sapiens
cuuucucagugagacccgagau

SEQ ID NO: 174802 - RNA, 22 nt, Homo sapiens
cuuugcaaauggccuuuccaag

SEQ ID NO: 174803 - RNA, 18 nt, Homo sapiens
cuuugcagcuuccagagg

SEQ ID NO: 174804 - RNA, 22 nt, Homo sapiens
cuuuggcauuagccuguauaga

SEQ ID NO: 174805 - RNA, 22 nt, Homo sapiens
cuuugggaccgcgguuuauacu

SEQ ID NO: 174806 - RNA, 22 nt, Homo sapiens
cuuuggucaauugcugcgggga

SEQ ID NO: 174807 - RNA, 18 nt, Homo sapiens
cuuugguccccgcacccu

SEQ ID NO: 174808 - RNA, 23 nt, Homo sapiens
cuuuggucucugguugacuucag

SEQ ID NO: 174809 - RNA, 22 nt, Homo sapiens
cuuugguguauuuucagagacc

SEQ ID NO: 174810 - RNA, 22 nt, Homo sapiens
cuuugguugugcucuccacuuu

SEQ ID NO: 174811 - RNA, 21 nt, Homo sapiens
cuuugguuucugacuugcaua

SEQ ID NO: 174812 - RNA, 22 nt, Homo sapiens
cuuuguguaggugccucuggcu

SEQ ID NO: 174813 - RNA, 23 nt, Homo sapiens
cuuuugcaaugugaucuugccac

SEQ ID NO: 174814 - RNA, 22 nt, Homo sapiens
cuuuugugauucuucaguuacu

SEQ ID NO: 174815 - RNA, 22 nt, Homo sapiens
cuuuuugcuagagucuaggguc

SEQ ID NO: 174816 - RNA, 22 nt, Homo sapiens
cuuuuugcugcagcaauacugg

SEQ ID NO: 174817 - RNA, 20 nt, Homo sapiens
cuuuuugcugugcugggagc

SEQ ID NO: 174818 - RNA, 22 nt, Homo sapiens
gaaacugcauuucuaacaagcu

SEQ ID NO: 174819 - RNA, 22 nt, Homo sapiens
gaaagacuuucugcuguggaua

SEQ ID NO: 174820 - RNA, 22 nt, Homo sapiens
gaaagcuaaugacuuuggguga

SEQ ID NO: 174821 - RNA, 22 nt, Homo sapiens
gaaaguaauuaacgauuguugc

SEQ ID NO: 174822 - RNA, 21 nt, Homo sapiens
gaaauacugccuuaggagcug

SEQ ID NO: 174823 - RNA, 22 nt, Homo sapiens
gaaaucucuacuauuuugaucu

SEQ ID NO: 174824 - RNA, 18 nt, Homo sapiens
gaaaugccucuugcuuac

SEQ ID NO: 174825 - RNA, 22 nt, Homo sapiens
gaaaugucugagauguggcuca

SEQ ID NO: 174826 - RNA, 22 nt, Homo sapiens
gaacuguaaagaaauucuaagg

SEQ ID NO: 174827 - RNA, 22 nt, Homo sapiens
gaagacauuuacaugggagacc

SEQ ID NO: 174828 - RNA, 22 nt, Homo sapiens
gaagauaucuaguaccauuguc

SEQ ID NO: 174829 - RNA, 22 nt, Homo sapiens
gaaggcaugcugcauggccaga

SEQ ID NO: 174830 - RNA, 22 nt, Homo sapiens
gaagguacgcuuaggaaaugau

SEQ ID NO: 174831 - RNA, 22 nt, Homo sapiens
gaagguaguuuauagauguggu

SEQ ID NO: 174832 - RNA, 22 nt, Homo sapiens
gaaguaauaaauggauucuuaa

SEQ ID NO: 174833 - RNA, 22 nt, Homo sapiens
gaagugcuuuuggacuaacagu

SEQ ID NO: 174834 - RNA, 22 nt, Homo sapiens
gaauacugacuauuucaucugg

SEQ ID NO: 174835 - RNA, 22 nt, Homo sapiens
gaaucauuguuucuaaguuugu

SEQ ID NO: 174836 - RNA, 22 nt, Homo sapiens
gaaugauacuguuaacgaaaga

SEQ ID NO: 174837 - RNA, 22 nt, Homo sapiens
gaaugcaugaggggaucagaug

SEQ ID NO: 174838 - RNA, 22 nt, Homo sapiens
gaaugucuuauugcucguugua

SEQ ID NO: 174839 - RNA, 22 nt, Homo sapiens
gaauguuuacuuuguuuaauac

SEQ ID NO: 174840 - RNA, 22 nt, Homo sapiens
gaauugcacaaaaacugcuugu

SEQ ID NO: 174841 - RNA, 22 nt, Homo sapiens
gaauuguacugcaaucagggga

SEQ ID NO: 174842 - RNA, 22 nt, Homo sapiens
gacaccugguguggaacuggag

SEQ ID NO: 174843 - RNA, 18 nt, Homo sapiens
gacagugugaagauuccu

SEQ ID NO: 174844 - RNA, 18 nt, Homo sapiens
gacaguguggcgauuccu

SEQ ID NO: 174845 - RNA, 22 nt, Homo sapiens
gacaguuuggugaggaagacga

SEQ ID NO: 174846 - RNA, 22 nt, Homo sapiens
gacauagagccuugacuucauu

SEQ ID NO: 174847 - RNA, 22 nt, Homo sapiens
gacauagcuagauaaccucaug

SEQ ID NO: 174848 - RNA, 20 nt, Homo sapiens
gacauaggcugguaucuggc

SEQ ID NO: 174849 - RNA, 20 nt, Homo sapiens
gacauguugguuugcugcac

SEQ ID NO: 174850 - RNA, 22 nt, Homo sapiens
gaccacagacuggaaagagggc

SEQ ID NO: 174851 - RNA, 22 nt, Homo sapiens
gacccuuagaaugugaucuuau

SEQ ID NO: 174852 - RNA, 22 nt, Homo sapiens
gaccugagagguacauguauuu

SEQ ID NO: 174853 - RNA, 22 nt, Homo sapiens
gacugcagugcagcuguuaggc

SEQ ID NO: 174854 - RNA, 22 nt, Homo sapiens
gacuggauagauaaaguuaguu

SEQ ID NO: 174855 - RNA, 22 nt, Homo sapiens
gacuggcuguuuucuuuauuau

SEQ ID NO: 174856 - RNA, 22 nt, Homo sapiens
gacuucaucauacuaugugugg

SEQ ID NO: 174857 - RNA, 22 nt, Homo sapiens
gagaacagagauaauuuuacuu

SEQ ID NO: 174858 - RNA, 22 nt, Homo sapiens
gagaacauuuaagccacucagg

SEQ ID NO: 174859 - RNA, 22 nt, Homo sapiens
gagaacugacauuaucguguau

SEQ ID NO: 174860 - RNA, 20 nt, Homo sapiens
gagaacugagaugcguuuga

SEQ ID NO: 174861 - RNA, 22 nt, Homo sapiens
gagaacuggcugauucaaggac

SEQ ID NO: 174862 - RNA, 22 nt, Homo sapiens
gagaaguaaauuuauuugcaaa

SEQ ID NO: 174863 - RNA, 21 nt, Homo sapiens
gagaaucuuuucagggcaaac

SEQ ID NO: 174864 - RNA, 22 nt, Homo sapiens
gagaaugagauuaugguuacau

SEQ ID NO: 174865 - RNA, 22 nt, Homo sapiens
gagaaugaugauuuccaauuuc

SEQ ID NO: 174866 - RNA, 22 nt, Homo sapiens
gagacauguuugccaauaauuu

SEQ ID NO: 174867 - RNA, 22 nt, Homo sapiens
gagacauugacuuuguuccaga

SEQ ID NO: 174868 - RNA, 22 nt, Homo sapiens
gagacugagucuugcucuguca

SEQ ID NO: 174869 - RNA, 22 nt, Homo sapiens
gagagaguacuugauauaauuu

SEQ ID NO: 174870 - RNA, 22 nt, Homo sapiens
gagagcaugugcuggcaucagu

SEQ ID NO: 174871 - RNA, 22 nt, Homo sapiens
gagagguaguuuuuuggucguc

SEQ ID NO: 174872 - RNA, 22 nt, Homo sapiens
gagagugaaguuugcuaccugu

SEQ ID NO: 174873 - RNA, 22 nt, Homo sapiens
gagagugugucagaggcugcga

SEQ ID NO: 174874 - RNA, 22 nt, Homo sapiens
gagauggaguuucacuucgcuc

SEQ ID NO: 174875 - RNA, 22 nt, Homo sapiens
gagaugguacacauacgauucu

SEQ ID NO: 174876 - RNA, 22 nt, Homo sapiens
gagauuaacauuugaggagcug

SEQ ID NO: 174877 - RNA, 22 nt, Homo sapiens
gagauuuucagcuugacuggga

SEQ ID NO: 174878 - RNA, 22 nt, Homo sapiens
gagcaacaguggcagugguggg

SEQ ID NO: 174879 - RNA, 18 nt, Homo sapiens
guaggucaguaccaagca

SEQ ID NO: 174880 - RNA, 22 nt, Homo sapiens
guagugcaguuugagaaucagu

SEQ ID NO: 174881 - RNA, 22 nt, Homo sapiens
guaguuuaucagaaagaauagg

SEQ ID NO: 174882 - RNA, 22 nt, Homo sapiens
guauacaugucaaaacucacau

SEQ ID NO: 174883 - RNA, 22 nt, Homo sapiens
guauaggcuuucaccacgccau

SEQ ID NO: 174884 - RNA, 22 nt, Homo sapiens
guauaugccucaguuauagcac

SEQ ID NO: 174885 - RNA, 22 nt, Homo sapiens
guaucauugccuaaugcucuca

SEQ ID NO: 174886 - RNA, 22 nt, Homo sapiens
guaugauacuguaacagugggu

SEQ ID NO: 174887 - RNA, 22 nt, Homo sapiens
guaugugacuggaacaguagga

SEQ ID NO: 174888 - RNA, 22 nt, Homo sapiens
guauugccugugugccagccac

SEQ ID NO: 174889 - RNA, 22 nt, Homo sapiens
guauuugguuauugcagccuga

SEQ ID NO: 174890 - RNA, 22 nt, Homo sapiens
gucaaaugcacagaaccauuaa

SEQ ID NO: 174891 - RNA, 22 nt, Homo sapiens
gucaagagaacuuucuaucacu

SEQ ID NO: 174892 - RNA, 22 nt, Homo sapiens
gucacaggaaacuaauaugcgc

SEQ ID NO: 174893 - RNA, 22 nt, Homo sapiens
gucacauugaugcccauggugg

SEQ ID NO: 174894 - RNA, 22 nt, Homo sapiens
gucacugagauugguauuaaug

SEQ ID NO: 174895 - RNA, 22 nt, Homo sapiens
gucacugagcaauagaaaguuu

SEQ ID NO: 174896 - RNA, 22 nt, Homo sapiens
gucacuggcugucuuguaugau

SEQ ID NO: 174897 - RNA, 22 nt, Homo sapiens
gucacugugacggcaguuacau

SEQ ID NO: 174898 - RNA, 22 nt, Homo sapiens
gucacugugaggaggggccagg

SEQ ID NO: 174899 - RNA, 22 nt, Homo sapiens
gucagauaauuugcauccaucu

SEQ ID NO: 174900 - RNA, 22 nt, Homo sapiens
gucagaugcagauuccaguucu

SEQ ID NO: 174901 - RNA, 22 nt, Homo sapiens
gucagggagggauagaugauua

SEQ ID NO: 174902 - RNA, 22 nt, Homo sapiens
gucagugcauguaaacauaaaa

SEQ ID NO: 174903 - RNA, 22 nt, Homo sapiens
gucagugucuuaacagagauua

SEQ ID NO: 174904 - RNA, 22 nt, Homo sapiens
gucaguucuugugguugcauuc

SEQ ID NO: 174905 - RNA, 22 nt, Homo sapiens
gucaguuucacucagcuggaac

SEQ ID NO: 174906 - RNA, 22 nt, Homo sapiens
gucaguuugguuaaucauucca

SEQ ID NO: 174907 - RNA, 22 nt, Homo sapiens
gucauauaggguuuaccuguau

SEQ ID NO: 174908 - RNA, 22 nt, Homo sapiens
gucaugaaguuuugaaugaaau

SEQ ID NO: 174909 - RNA, 22 nt, Homo sapiens
gucauggacaaggugugagcca

SEQ ID NO: 174910 - RNA, 22 nt, Homo sapiens
gucauugaaguggaaucaucca

SEQ ID NO: 174911 - RNA, 22 nt, Homo sapiens
gucccugugucuuuauguggcc

SEQ ID NO: 174912 - RNA, 22 nt, Homo sapiens
guccugaagaccuuccucugga

SEQ ID NO: 174913 - RNA, 22 nt, Homo sapiens
gucuaugagucccugaauuuaa

SEQ ID NO: 174914 - RNA, 22 nt, Homo sapiens
gucucacagcuagcugcuuuau

SEQ ID NO: 174915 - RNA, 22 nt, Homo sapiens
gucucccaaccccugugcccag

SEQ ID NO: 174916 - RNA, 22 nt, Homo sapiens
gucucuuguuaucauuucugag

SEQ ID NO: 174917 - RNA, 22 nt, Homo sapiens
gucugagcauggggccggcagg

SEQ ID NO: 174918 - RNA, 22 nt, Homo sapiens
gucuggcacagggaaaguacaa

SEQ ID NO: 174919 - RNA, 22 nt, Homo sapiens
gucuggcuccugucuaaucacu

SEQ ID NO: 174920 - RNA, 23 nt, Homo sapiens
gucuggucccugguuggaaacca

SEQ ID NO: 174921 - RNA, 21 nt, Homo sapiens
gucugguguuuuaaugaggac

SEQ ID NO: 174922 - RNA, 22 nt, Homo sapiens
gucugguuccugggagauuucu

SEQ ID NO: 174923 - RNA, 20 nt, Homo sapiens
gucugucuccgaguagaauu

SEQ ID NO: 174924 - RNA, 22 nt, Homo sapiens
gucugucuuuugucuuugaaau

SEQ ID NO: 174925 - RNA, 22 nt, Homo sapiens
gucuugaaggcugaguaccugu

SEQ ID NO: 174926 - RNA, 20 nt, Homo sapiens
gucuugcuccguugcccagg

SEQ ID NO: 174927 - RNA, 22 nt, Homo sapiens
gucuuggagacauugccauuga

SEQ ID NO: 174928 - RNA, 22 nt, Homo sapiens
gucuuuguuuggucuguaucag

SEQ ID NO: 174929 - RNA, 22 nt, Homo sapiens
gugaagaugugcaucagaucca

SEQ ID NO: 174930 - RNA, 22 nt, Homo sapiens
gugaaguuuuugugaggccuaa

SEQ ID NO: 174931 - RNA, 22 nt, Homo sapiens
gugaauagggaauaaugggauc

SEQ ID NO: 174932 - RNA, 22 nt, Homo sapiens
gugaaugaaugggugaauacau

SEQ ID NO: 174933 - RNA, 22 nt, Homo sapiens
gugaauguaaagucaugugacu

SEQ ID NO: 174934 - RNA, 22 nt, Homo sapiens
gugaauguuuucuuacauggua

SEQ ID NO: 174935 - RNA, 22 nt, Homo sapiens
gugacagaguaagacccuguau

SEQ ID NO: 174936 - RNA, 22 nt, Homo sapiens
gugacagucaaagacaugacuu

SEQ ID NO: 174937 - RNA, 22 nt, Homo sapiens
gugacaguggagacuuacuuca

SEQ ID NO: 174938 - RNA, 22 nt, Homo sapiens
gugaccauuugacauauccuug

SEQ ID NO: 174939 - RNA, 22 nt, Homo sapiens
gugacugggaguggugaagaua

SEQ ID NO: 174940 - RNA, 20 nt, Homo sapiens
gugagaacaugugguauuug

SEQ ID NO: 174941 - RNA, 18 nt, Homo sapiens
gugagaaugacuguucug

SEQ ID NO: 174942 - RNA, 22 nt, Homo sapiens
gugagaugaggucucacucugu

SEQ ID NO: 174943 - RNA, 22 nt, Homo sapiens
gugagauggagucuugcuuugu

SEQ ID NO: 174944 - RNA, 22 nt, Homo sapiens
gugagauuaguucuggaccugg

SEQ ID NO: 174945 - RNA, 22 nt, Homo sapiens
gugagccaugauuuuaccacug

SEQ ID NO: 174946 - RNA, 22 nt, Homo sapiens
gugagggagcuggaauauuuau

SEQ ID NO: 174947 - RNA, 22 nt, Homo sapiens
gugagggaugugaaaaagguca

SEQ ID NO: 174948 - RNA, 22 nt, Homo sapiens
gugagguaagaguugcuuugcu

SEQ ID NO: 174949 - RNA, 22 nt, Homo sapiens
gugagguaauuagcucccuuag

SEQ ID NO: 174950 - RNA, 21 nt, Homo sapiens
gugaggucauugggcuuucug

SEQ ID NO: 174951 - RNA, 22 nt, Homo sapiens
gugaggucguagucauaggcaa

SEQ ID NO: 174952 - RNA, 22 nt, Homo sapiens
gugagucagucuguguagggcu

SEQ ID NO: 174953 - RNA, 22 nt, Homo sapiens
gugagucaugucccaucugauu

SEQ ID NO: 174954 - RNA, 22 nt, Homo sapiens
gugaguuauuauuuauguaaac

SEQ ID NO: 174955 - RNA, 22 nt, Homo sapiens
gugauaucuuacaauucucuuu

SEQ ID NO: 174956 - RNA, 22 nt, Homo sapiens
gugauuauccacgucuuuguga

SEQ ID NO: 174957 - RNA, 20 nt, Homo sapiens
gugauuggucacugguuguu

SEQ ID NO: 174958 - RNA, 22 nt, Homo sapiens
gugcaaccaucaccacugacuc

SEQ ID NO: 174959 - RNA, 22 nt, Homo sapiens
gugcaaugaguguggcaaagcc

SEQ ID NO: 174960 - RNA, 22 nt, Homo sapiens
gugcacaacaugcagguuuguu

SEQ ID NO: 174961 - RNA, 22 nt, Homo sapiens
gugcacaacaugcaguuuuguu

SEQ ID NO: 174962 - RNA, 22 nt, Homo sapiens
gugcacaacgugcaaguuuguu

SEQ ID NO: 174963 - RNA, 22 nt, Homo sapiens
gugcacaacgugcagguuuguu

SEQ ID NO: 174964 - RNA, 22 nt, Homo sapiens
gugcacaacguguagguuuguu

SEQ ID NO: 174965 - RNA, 22 nt, Homo sapiens
gugcacaucgugcagguuuguu

SEQ ID NO: 174966 - RNA, 23 nt, Homo sapiens
gugcaguggcgagauuucggcuc

SEQ ID NO: 174967 - RNA, 22 nt, Homo sapiens
gugcaguuuuaagugaguuucu

SEQ ID NO: 174968 - RNA, 22 nt, Homo sapiens
gugcauacucuggagacauugu

SEQ ID NO: 174969 - RNA, 22 nt, Homo sapiens
gugcauaucugugguuggcuga

SEQ ID NO: 174970 - RNA, 22 nt, Homo sapiens
gugcauaugcaugugcaugcac

SEQ ID NO: 174971 - RNA, 22 nt, Homo sapiens
gugcaugcaucuuuauaguagc

SEQ ID NO: 174972 - RNA, 22 nt, Homo sapiens
gugcaugucuaugcgagucuaa

SEQ ID NO: 174973 - RNA, 22 nt, Homo sapiens
gugcaugucugugacgacccug

SEQ ID NO: 174974 - RNA, 22 nt, Homo sapiens
gugccuucuagcuaugguuggc

SEQ ID NO: 174975 - RNA, 22 nt, Homo sapiens
gugcucauuuagagagaagcac

SEQ ID NO: 174976 - RNA, 22 nt, Homo sapiens
gugcuuauccccauucuggagg

SEQ ID NO: 174977 - RNA, 22 nt, Homo sapiens
gugcuuguauuuaaaucaugug

SEQ ID NO: 174978 - RNA, 22 nt, Homo sapiens
gugcuuguguuaauauguagcu

SEQ ID NO: 174979 - RNA, 22 nt, Homo sapiens
ugagaguauaaauugaugcagc

SEQ ID NO: 174980 - RNA, 22 nt, Homo sapiens
ugagagucacugaccugguaua

SEQ ID NO: 174981 - RNA, 22 nt, Homo sapiens
ugagauaaagcauguacugugu

SEQ ID NO: 174982 - RNA, 22 nt, Homo sapiens
ugagauaacuaaaaacauuuug

SEQ ID NO: 174983 - RNA, 22 nt, Homo sapiens
ugagauaaucaugugauuucau

SEQ ID NO: 174984 - RNA, 22 nt, Homo sapiens
ugagauaauuuacuuguugagg

SEQ ID NO: 174985 - RNA, 22 nt, Homo sapiens
ugagauagcauaagggacagaa

SEQ ID NO: 174986 - RNA, 22 nt, Homo sapiens
ugagauaggaucuugcucuguu

SEQ ID NO: 174987 - RNA, 22 nt, Homo sapiens
ugagauagggucucacucuguc

SEQ ID NO: 174988 - RNA, 22 nt, Homo sapiens
ugagauaguuguagauguacau

SEQ ID NO: 174989 - RNA, 22 nt, Homo sapiens
ugagauauauauauuugagaca

SEQ ID NO: 174990 - RNA, 22 nt, Homo sapiens
ugagauauugggaguaauguca

SEQ ID NO: 174991 - RNA, 22 nt, Homo sapiens
ugagaucacgccacugcacucc

SEQ ID NO: 174992 - RNA, 20 nt, Homo sapiens
ugagaucaggauuaaggcua

SEQ ID NO: 174993 - RNA, 22 nt, Homo sapiens
ugagaucaguuguuauaauucu

SEQ ID NO: 174994 - RNA, 19 nt, Homo sapiens
ugagauccacugaagauuc

SEQ ID NO: 174995 - RNA, 22 nt, Homo sapiens
ugagauccaugcuauuugggcu

SEQ ID NO: 174996 - RNA, 22 nt, Homo sapiens
ugagaucgagucucgcucuguc

SEQ ID NO: 174997 - RNA, 22 nt, Homo sapiens
ugagaugaaagcagaaagacuu

SEQ ID NO: 174998 - RNA, 22 nt, Homo sapiens
ugagaugaacuugauuguuuua

SEQ ID NO: 174999 - RNA, 22 nt, Homo sapiens
ugagaugagagaaugcuugccu

SEQ ID NO: 175000 - RNA, 22 nt, Homo sapiens
ugagaugagggaagccuaggca

SEQ ID NO: 175001 - RNA, 22 nt, Homo sapiens
ugagaugaggucucgcucuguc

SEQ ID NO: 175002 - RNA, 22 nt, Homo sapiens
ugagaugaguucucgcucuguc

SEQ ID NO: 175003 - RNA, 22 nt, Homo sapiens
ugagaugauagauauguuaauu

SEQ ID NO: 175004 - RNA, 21 nt, Homo sapiens
ugagaugauccugcaugcaug

SEQ ID NO: 175005 - RNA, 22 nt, Homo sapiens
ugagaugguaaauuuuuguugu

SEQ ID NO: 175006 - RNA, 22 nt, Homo sapiens
ugagauguugcucugaaacaag

SEQ ID NO: 175007 - RNA, 23 nt, Homo sapiens
ugagauuauaaucuuuuacuucu

SEQ ID NO: 175008 - RNA, 22 nt, Homo sapiens
ugagauuaucuugaucuugaaa

SEQ ID NO: 175009 - RNA, 22 nt, Homo sapiens
ugagcacauuuacaucaguucc

SEQ ID NO: 175010 - RNA, 22 nt, Homo sapiens
ugagcagagaagugcccugcgc

SEQ ID NO: 175011 - RNA, 22 nt, Homo sapiens
ugagcagugagugugcugcagg

SEQ ID NO: 175012 - RNA, 20 nt, Homo sapiens
ugagccccuggacucaagcg

SEQ ID NO: 175013 - RNA, 22 nt, Homo sapiens
ugagcgaugggaggaagugaua

SEQ ID NO: 175014 - RNA, 20 nt, Homo sapiens
ugagcucaauuguugcaagu

SEQ ID NO: 175015 - RNA, 22 nt, Homo sapiens
ugagcucagcuuucuuuuucac

SEQ ID NO: 175016 - RNA, 22 nt, Homo sapiens
ugagcucaguauuucauaaaca

SEQ ID NO: 175017 - RNA, 22 nt, Homo sapiens
ugagcucaugcauucuugagga

SEQ ID NO: 175018 - RNA, 22 nt, Homo sapiens
ugagcugagauuaagcugcugc

SEQ ID NO: 175019 - RNA, 22 nt, Homo sapiens
ugagcuguuugaagaagcauuu

SEQ ID NO: 175020 - RNA, 22 nt, Homo sapiens
ugaggaaugaccccgugugguc

SEQ ID NO: 175021 - RNA, 22 nt, Homo sapiens
ugaggacugagaggcacugugg

SEQ ID NO: 175022 - RNA, 22 nt, Homo sapiens
ugaggagugagaaauugguuuc

SEQ ID NO: 175023 - RNA, 22 nt, Homo sapiens
ugaggaguguauuucauucgcu

SEQ ID NO: 175024 - RNA, 22 nt, Homo sapiens
ugaggcaagauacugauuucau

SEQ ID NO: 175025 - RNA, 22 nt, Homo sapiens
ugaggcacucuagacuuauuca

SEQ ID NO: 175026 - RNA, 22 nt, Homo sapiens
ugagggcguauccuucauuaag

SEQ ID NO: 175027 - RNA, 22 nt, Homo sapiens
ugaggguauagccagcccuuag

SEQ ID NO: 175028 - RNA, 22 nt, Homo sapiens
ugagguaaaacaaggauuggau

SEQ ID NO: 175029 - RNA, 22 nt, Homo sapiens
ugagguaaugcuguagcuguga

SEQ ID NO: 175030 - RNA, 22 nt, Homo sapiens
ugaggucacuuguuuuaugcuu

SEQ ID NO: 175031 - RNA, 22 nt, Homo sapiens
ugagguguauugggggaaauuc

SEQ ID NO: 175032 - RNA, 23 nt, Homo sapiens
ugagguguuaagcagacuugucu

SEQ ID NO: 175033 - RNA, 22 nt, Homo sapiens
ugaguagaacuagucuagagcu

SEQ ID NO: 175034 - RNA, 22 nt, Homo sapiens
ugaguagaacuccuggagaugu

SEQ ID NO: 175035 - RNA, 22 nt, Homo sapiens
ugaguagaagugaagauagugg

SEQ ID NO: 175036 - RNA, 23 nt, Homo sapiens
ugaguagguccacguaugugagu

SEQ ID NO: 175037 - RNA, 22 nt, Homo sapiens
ugaguagucagugggcaggaag

SEQ ID NO: 175038 - RNA, 22 nt, Homo sapiens
ugaguagucuagaguggaaugu

SEQ ID NO: 175039 - RNA, 22 nt, Homo sapiens
ugaguaugaguucaggaaaggc

SEQ ID NO: 175040 - RNA, 22 nt, Homo sapiens
ugaguauguuuaaugugacaau

SEQ ID NO: 175041 - RNA, 22 nt, Homo sapiens
ugaguauguuuagaaguaaagg

SEQ ID NO: 175042 - RNA, 22 nt, Homo sapiens
ugagucagucucacucugcugc

SEQ ID NO: 175043 - RNA, 22 nt, Homo sapiens
ugagucgagauugcgccacugu

SEQ ID NO: 175044 - RNA, 22 nt, Homo sapiens
ugagugaacgcugagaccaaau

SEQ ID NO: 175045 - RNA, 22 nt, Homo sapiens
ugagugaaggggcucuguugug

SEQ ID NO: 175046 - RNA, 22 nt, Homo sapiens
ugaguggagacuguguguagag

SEQ ID NO: 175047 - RNA, 22 nt, Homo sapiens
ugagugugacuuagcagaagga

SEQ ID NO: 175048 - RNA, 17 nt, Homo sapiens
ugaguuaaucuuugugc

SEQ ID NO: 175049 - RNA, 22 nt, Homo sapiens
ugaguucaugcuuguaguucua

SEQ ID NO: 175050 - RNA, 22 nt, Homo sapiens
ugaguucauggucauuugucac

SEQ ID NO: 175051 - RNA, 18 nt, Homo sapiens
ugaguucauuagacuucc

SEQ ID NO: 175052 - RNA, 22 nt, Homo sapiens
ugaguucuuccaccgggaccag

SEQ ID NO: 175053 - RNA, 22 nt, Homo sapiens
ugaguucuuuuagggauauugc

SEQ ID NO: 175054 - RNA, 22 nt, Homo sapiens
ugaguuguaggggucaccuggc

SEQ ID NO: 175055 - RNA, 23 nt, Homo sapiens
ugauaacagcauaugaagauucu

SEQ ID NO: 175056 - RNA, 22 nt, Homo sapiens
ugauaacauuucuucugguaca

SEQ ID NO: 175057 - RNA, 22 nt, Homo sapiens
ugauaagugagauagcaaguga

SEQ ID NO: 175058 - RNA, 17 nt, Homo sapiens
ugauaagugugagguga

SEQ ID NO: 175059 - RNA, 22 nt, Homo sapiens
ugauaauuuugucagguuuugg

SEQ ID NO: 175060 - RNA, 22 nt, Homo sapiens
ugauaugaaguuagcuggcugu

SEQ ID NO: 175061 - RNA, 22 nt, Homo sapiens
ugauaugaaguucaaaccaggu

SEQ ID NO: 175062 - RNA, 22 nt, Homo sapiens
ugaucaaagugcuggaauuaca

SEQ ID NO: 175063 - RNA, 22 nt, Homo sapiens
ugauccagugcucaguuggagu

SEQ ID NO: 175064 - RNA, 22 nt, Homo sapiens
ugaucugucacuuaucacauuu

SEQ ID NO: 175065 - RNA, 22 nt, Homo sapiens
ugaucuuuuuaauguccauggg

SEQ ID NO: 175066 - RNA, 22 nt, Homo sapiens
ugaugaaguauaggaagggcuu

SEQ ID NO: 175067 - RNA, 22 nt, Homo sapiens
ugaugcugaugccugccagaag

SEQ ID NO: 175068 - RNA, 22 nt, Homo sapiens
ugauggcacagugaguuccagg

SEQ ID NO: 175069 - RNA, 22 nt, Homo sapiens
ugauggcauuucauguuuguaa

SEQ ID NO: 175070 - RNA, 22 nt, Homo sapiens
ugaugguccauaguucauggua

SEQ ID NO: 175071 - RNA, 22 nt, Homo sapiens
ugaugguuuuauuaauaggacc

SEQ ID NO: 175072 - RNA, 22 nt, Homo sapiens
ugauguauuauuaagaccuggc

SEQ ID NO: 175073 - RNA, 22 nt, Homo sapiens
ugaugucuugagauggagcuua

SEQ ID NO: 175074 - RNA, 22 nt, Homo sapiens
ugaugucuugcaggcacgagau

SEQ ID NO: 175075 - RNA, 22 nt, Homo sapiens
ugauugacauucuuuggaguau

SEQ ID NO: 175076 - RNA, 22 nt, Homo sapiens
ugcaaacuuccuugggcagcau

SEQ ID NO: 175077 - RNA, 22 nt, Homo sapiens
ugcaaagucgaaacugcaguuu

SEQ ID NO: 175078 - RNA, 22 nt, Homo sapiens
ugcaaaucuuguguaguuguga

SEQ ID NO: 175079 - RNA, 22 nt, Homo sapiens
ugcaaauguuauuuugguuucu

SEQ ID NO: 175080 - RNA, 21 nt, Homo sapiens
ugcaagaaucaggaagcugcc

SEQ ID NO: 175081 - RNA, 22 nt, Homo sapiens
ugcaagaaucuuucaggcuagc

SEQ ID NO: 175082 - RNA, 22 nt, Homo sapiens
ugcaagauaggcaguuugcacu

SEQ ID NO: 175083 - RNA, 22 nt, Homo sapiens
cuauggugauagaaaucagaau

SEQ ID NO: 175084 - RNA, 22 nt, Homo sapiens
cuauuagguuggggcgaaagua

SEQ ID NO: 175085 - RNA, 22 nt, Homo sapiens
cuauucacaauggugaagauau

SEQ ID NO: 175086 - RNA, 22 nt, Homo sapiens
cucaaagugcugggauuggcca

SEQ ID NO: 175087 - RNA, 18 nt, Homo sapiens
cucacacccuaaucagga

SEQ ID NO: 175088 - RNA, 20 nt, Homo sapiens
gugggcaaauccuuuccucu

SEQ ID NO: 175089 - RNA, 22 nt, Homo sapiens
gugggcaagucacuucaguucu

SEQ ID NO: 175090 - RNA, 22 nt, Homo sapiens
gugggcucguucguguuagaca

SEQ ID NO: 175091 - RNA, 22 nt, Homo sapiens
gugguuuuaucccagaaauuaa

SEQ ID NO: 175092 - RNA, 22 nt, Homo sapiens
gugguuuuuaaaguaccugugg

SEQ ID NO: 175093 - RNA, 22 nt, Homo sapiens
guguaaaucaaucuguugucuu

SEQ ID NO: 175094 - RNA, 22 nt, Homo sapiens
guguaaaucugcugugaacauu

SEQ ID NO: 175095 - RNA, 22 nt, Homo sapiens
guguaaaugagugcugaaggag

SEQ ID NO: 175096 - RNA, 22 nt, Homo sapiens
guguaaguccugaguuuggaua

SEQ ID NO: 175097 - RNA, 21 nt, Homo sapiens
gugucacagacaugacagaug

SEQ ID NO: 175098 - RNA, 22 nt, Homo sapiens
gugucacuguugagaaguccac

SEQ ID NO: 175099 - RNA, 22 nt, Homo sapiens
gugucucagcccagaccuauuu

SEQ ID NO: 175100 - RNA, 18 nt, Homo sapiens
gugucugguuaugggagu

SEQ ID NO: 175101 - RNA, 22 nt, Homo sapiens
gugugacuagucaugccugaau

SEQ ID NO: 175102 - RNA, 22 nt, Homo sapiens
gugugcaauuuugugggaggca

SEQ ID NO: 175103 - RNA, 22 nt, Homo sapiens
guguggcaggugggggcucaga

SEQ ID NO: 175104 - RNA, 22 nt, Homo sapiens
gugugguaggauugguuacuca

SEQ ID NO: 175105 - RNA, 22 nt, Homo sapiens
gugugguauuauaacuagguau

SEQ ID NO: 175106 - RNA, 22 nt, Homo sapiens
guguguaaauggcagugagcuc

SEQ ID NO: 175107 - RNA, 22 nt, Homo sapiens
gugugucuugaccaggaucgga

SEQ ID NO: 175108 - RNA, 22 nt, Homo sapiens
guguuaaucucaaguacucuca

SEQ ID NO: 175109 - RNA, 22 nt, Homo sapiens
guguugcacauucuguggaugu

SEQ ID NO: 175110 - RNA, 22 nt, Homo sapiens
guuaagaaguguaacuuaaguu

SEQ ID NO: 175111 - RNA, 22 nt, Homo sapiens
guuagugcuuauuaaauaguau

SEQ ID NO: 175112 - RNA, 22 nt, Homo sapiens
guuauccugucuuuacauacaa

SEQ ID NO: 175113 - RNA, 22 nt, Homo sapiens
guuauguuaaauuguuguaugc

SEQ ID NO: 175114 - RNA, 22 nt, Homo sapiens
guuauguuauguuauguuaugu

SEQ ID NO: 175115 - RNA, 22 nt, Homo sapiens
guucaagugauucuacugccuc

SEQ ID NO: 175116 - RNA, 22 nt, Homo sapiens
guucaaguuuucucuugugggu

SEQ ID NO: 175117 - RNA, 22 nt, Homo sapiens
guucacacuugcaaccccagca

SEQ ID NO: 175118 - RNA, 22 nt, Homo sapiens
guucacaguuaggacaacugcu

SEQ ID NO: 175119 - RNA, 22 nt, Homo sapiens
guucagguauucuggaacagag

SEQ ID NO: 175120 - RNA, 22 nt, Homo sapiens
guucaguuugcugaugcguuga

SEQ ID NO: 175121 - RNA, 20 nt, Homo sapiens
guucauguaauuaguucagg

SEQ ID NO: 175122 - RNA, 22 nt, Homo sapiens
guucccaguugaaaugauuagu

SEQ ID NO: 175123 - RNA, 22 nt, Homo sapiens
guugaaaucaucacuuggcaug

SEQ ID NO: 175124 - RNA, 22 nt, Homo sapiens
guugagcaaacagcuuaacagu

SEQ ID NO: 175125 - RNA, 18 nt, Homo sapiens
guugagcuuuuccuuuag

SEQ ID NO: 175126 - RNA, 17 nt, Homo sapiens
guugaguuugagucaag

SEQ ID NO: 175127 - RNA, 22 nt, Homo sapiens
guugcaauugauguaugucuga

SEQ ID NO: 175128 - RNA, 22 nt, Homo sapiens
guugggcccauagacugccagu

SEQ ID NO: 175129 - RNA, 22 nt, Homo sapiens
guuggguaauggggcgcaccgu

SEQ ID NO: 175130 - RNA, 22 nt, Homo sapiens
guuggucaaugugauuaggcca

SEQ ID NO: 175131 - RNA, 22 nt, Homo sapiens
guuggugaccugaagagaguaa

SEQ ID NO: 175132 - RNA, 22 nt, Homo sapiens
guugguuuccuguaacuggaca

SEQ ID NO: 175133 - RNA, 22 nt, Homo sapiens
guuguauaggcauggggagaau

SEQ ID NO: 175134 - RNA, 22 nt, Homo sapiens
guuguggagucuucuguucugg

SEQ ID NO: 175135 - RNA, 22 nt, Homo sapiens
guuugccuuuuagauaggaaug

SEQ ID NO: 175136 - RNA, 22 nt, Homo sapiens
uaaaagucaucacaacuggagu

SEQ ID NO: 175137 - RNA, 22 nt, Homo sapiens
uaaagcacuuuuuucugcaugg

SEQ ID NO: 175138 - RNA, 22 nt, Homo sapiens
uaaagcuacaguauaugguauu

SEQ ID NO: 175139 - RNA, 21 nt, Homo sapiens
uaaagcuagaaccuuagcuuu

SEQ ID NO: 175140 - RNA, 22 nt, Homo sapiens
uaaagcuaucacauuggugauu

SEQ ID NO: 175141 - RNA, 22 nt, Homo sapiens
uaaagcuaugagaacaccguag

SEQ ID NO: 175142 - RNA, 22 nt, Homo sapiens
uaaagcuauuauaguuauguuu

SEQ ID NO: 175143 - RNA, 22 nt, Homo sapiens
uaaagcugaaaugauuaugaca

SEQ ID NO: 175144 - RNA, 21 nt, Homo sapiens
uaaaggcuccaauuauacccc

SEQ ID NO: 175145 - RNA, 22 nt, Homo sapiens
uaaaguguuuguuauuaaaggu

SEQ ID NO: 175146 - RNA, 22 nt, Homo sapiens
uaaaugcucuuuaaaagugcuu

SEQ ID NO: 175147 - RNA, 22 nt, Homo sapiens
uaaauggauaaaugaauaccua

SEQ ID NO: 175148 - RNA, 18 nt, Homo sapiens
uaaauugcuucaccugag

SEQ ID NO: 175149 - RNA, 22 nt, Homo sapiens
uaacaagagagucagucagucc

SEQ ID NO: 175150 - RNA, 19 nt, Homo sapiens
uaacacaguuguguuugag

SEQ ID NO: 175151 - RNA, 22 nt, Homo sapiens
uaacaggcuacucuugcauugc

SEQ ID NO: 175152 - RNA, 18 nt, Homo sapiens
uaacagucucucaggauc

SEQ ID NO: 175153 - RNA, 23 nt, Homo sapiens
uaacauugcaugauuaccugcau

SEQ ID NO: 175154 - RNA, 22 nt, Homo sapiens
uaacccugaggggcuuggggac

SEQ ID NO: 175155 - RNA, 22 nt, Homo sapiens
uaacuaguagauggcugacaua

SEQ ID NO: 175156 - RNA, 22 nt, Homo sapiens
uaacucugccuagugacauggu

SEQ ID NO: 175157 - RNA, 18 nt, Homo sapiens
uaacuggugugagauggu

SEQ ID NO: 175158 - RNA, 18 nt, Homo sapiens
uaacugugggaacuaacu

SEQ ID NO: 175159 - RNA, 22 nt, Homo sapiens
uaagacucuggacucuaauguu

SEQ ID NO: 175160 - RNA, 21 nt, Homo sapiens
uaagacugccaguagggcugu

SEQ ID NO: 175161 - RNA, 22 nt, Homo sapiens
uaagaugaaggcucaccuagaa

SEQ ID NO: 175162 - RNA, 22 nt, Homo sapiens
uaaggaaggcugugugcuuuua

SEQ ID NO: 175163 - RNA, 22 nt, Homo sapiens
uaaggcaaaccuuggcugcagu

SEQ ID NO: 175164 - RNA, 22 nt, Homo sapiens
uaaggcaaguuuuuaguggaca

SEQ ID NO: 175165 - RNA, 20 nt, Homo sapiens
uaaggcacugugcuuuuagg

SEQ ID NO: 175166 - RNA, 22 nt, Homo sapiens
uaaggcuuaugguaaaguccug

SEQ ID NO: 175167 - RNA, 22 nt, Homo sapiens
uaaggcuugaucuuggugagau

SEQ ID NO: 175168 - RNA, 22 nt, Homo sapiens
uaagggcaugcugcaugagagu

SEQ ID NO: 175169 - RNA, 22 nt, Homo sapiens
uaaguaaaugaaagguugauuu

SEQ ID NO: 175170 - RNA, 22 nt, Homo sapiens
uaaguauuuuaauuccuggcau

SEQ ID NO: 175171 - RNA, 22 nt, Homo sapiens
uaagucacuccagguuaaagug

SEQ ID NO: 175172 - RNA, 22 nt, Homo sapiens
uaagucuuuuuggaguuuauaa

SEQ ID NO: 175173 - RNA, 22 nt, Homo sapiens
uaagugaauauggacaguuagc

SEQ ID NO: 175174 - RNA, 22 nt, Homo sapiens
uaagugaauguuggcuacugaa

SEQ ID NO: 175175 - RNA, 22 nt, Homo sapiens
uaagugaauuucacuacugagu

SEQ ID NO: 175176 - RNA, 20 nt, Homo sapiens
uaagugcuugaugaaugaac

SEQ ID NO: 175177 - RNA, 22 nt, Homo sapiens
uaaguggugcauuguuaaaugg

SEQ ID NO: 175178 - RNA, 22 nt, Homo sapiens
uaaguguaaugucugaaguuug

SEQ ID NO: 175179 - RNA, 22 nt, Homo sapiens
uaauacugcugugcuugaguug

SEQ ID NO: 175180 - RNA, 22 nt, Homo sapiens
uaauagagucauuauuauuguu

SEQ ID NO: 175181 - RNA, 22 nt, Homo sapiens
uaauaguuggcacuggagaaag

SEQ ID NO: 175182 - RNA, 22 nt, Homo sapiens
uaauaguuucagaaguuguuuu

SEQ ID NO: 175183 - RNA, 22 nt, Homo sapiens
uaaucacagagguuuggccuca

SEQ ID NO: 175184 - RNA, 22 nt, Homo sapiens
uaaugcaucaugguuggcaaac

SEQ ID NO: 175185 - RNA, 22 nt, Homo sapiens
uaaugcuccauggguuauuaaa

SEQ ID NO: 175186 - RNA, 22 nt, Homo sapiens
uaaugcuugguuguuuggaaaa

SEQ ID NO: 175187 - RNA, 22 nt, Homo sapiens
uaaugguuuugcaccaucccuc

SEQ ID NO: 175188 - RNA, 22 nt, Homo sapiens
uuuguguggccuuggccuggca

SEQ ID NO: 175189 - RNA, 20 nt, Homo sapiens
uuuuagcacuuguuauggug

SEQ ID NO: 175190 - RNA, 20 nt, Homo sapiens
uuuuagcuuuuauugaaagc

SEQ ID NO: 175191 - RNA, 22 nt, Homo sapiens
uuuuauguuuguucccugccaa

SEQ ID NO: 175192 - RNA, 22 nt, Homo sapiens
uuuugcaccauccuaauaguau

SEQ ID NO: 175193 - RNA, 22 nt, Homo sapiens
uuuugcaggcauuggaaguuua

SEQ ID NO: 175194 - RNA, 20 nt, Homo sapiens
uuuuggacuaaaggcauccc

SEQ ID NO: 175195 - RNA, 22 nt, Homo sapiens
uuuuggacuucaauuugacacu

SEQ ID NO: 175196 - RNA, 22 nt, Homo sapiens
uuuuggcucugucuguaucuuu

SEQ ID NO: 175197 - RNA, 21 nt, Homo sapiens
uuuuggucauucaggaagaaa

SEQ ID NO: 175198 - RNA, 22 nt, Homo sapiens
ucacaugugacauauauauuug

SEQ ID NO: 175199 - RNA, 22 nt, Homo sapiens
ucacauguguaaauugguguaa

SEQ ID NO: 175200 - RNA, 22 nt, Homo sapiens
ucacauguguaugagcuuugau

SEQ ID NO: 175201 - RNA, 22 nt, Homo sapiens
ucacauuguguagccugcucac

SEQ ID NO: 175202 - RNA, 22 nt, Homo sapiens
ucaccaguaauaaagagccugc

SEQ ID NO: 175203 - RNA, 22 nt, Homo sapiens
ucaccuggagacaugaagacug

SEQ ID NO: 175204 - RNA, 22 nt, Homo sapiens
ucaccuguagcuaagaccuaau

SEQ ID NO: 175205 - RNA, 21 nt, Homo sapiens
ucaccuguagcugcauguucu

SEQ ID NO: 175206 - RNA, 21 nt, Homo sapiens
ucaccuguugcgaugaagcug

SEQ ID NO: 175207 - RNA, 18 nt, Homo sapiens
ucacggggagcagcagcc

SEQ ID NO: 175208 - RNA, 22 nt, Homo sapiens
ucacuagggagaaacugaggcu

SEQ ID NO: 175209 - RNA, 22 nt, Homo sapiens
ucacuauagaaaacagugugga

SEQ ID NO: 175210 - RNA, 21 nt, Homo sapiens
ucacugagguuaaauaggguu

SEQ ID NO: 175211 - RNA, 20 nt, Homo sapiens
ucacugagugguccacagua

SEQ ID NO: 175212 - RNA, 22 nt, Homo sapiens
ucacuggacagaaauaaaggug

SEQ ID NO: 175213 - RNA, 19 nt, Homo sapiens
ucacuggacagcacacuca

SEQ ID NO: 175214 - RNA, 22 nt, Homo sapiens
ucacuggcaaauauauccguug

SEQ ID NO: 175215 - RNA, 20 nt, Homo sapiens
ucacuggguucuugaagucu

SEQ ID NO: 175216 - RNA, 22 nt, Homo sapiens
ucacugugcacauaugauaggu

SEQ ID NO: 175217 - RNA, 22 nt, Homo sapiens
ucacuguggaacucaaaaagcu

SEQ ID NO: 175218 - RNA, 22 nt, Homo sapiens
ucacugugguuggaaggcuuaa

SEQ ID NO: 175219 - RNA, 22 nt, Homo sapiens
ucacugugguuuugaugugcau

SEQ ID NO: 175220 - RNA, 18 nt, Homo sapiens
ucacugugugucuugggu

SEQ ID NO: 175221 - RNA, 22 nt, Homo sapiens
ucacuguugaugggcaugcagg

SEQ ID NO: 175222 - RNA, 22 nt, Homo sapiens
ucagaacugaacaaaccagucu

SEQ ID NO: 175223 - RNA, 22 nt, Homo sapiens
ucagaacugauacuagaacuuu

SEQ ID NO: 175224 - RNA, 22 nt, Homo sapiens
ucagacacugagcaaacgacua

SEQ ID NO: 175225 - RNA, 22 nt, Homo sapiens
ucagaguagaaacacuuccaua

SEQ ID NO: 175226 - RNA, 22 nt, Homo sapiens
ucagagucuagaucacucacug

SEQ ID NO: 175227 - RNA, 22 nt, Homo sapiens
ucagaucaugcuuaugauggga

SEQ ID NO: 175228 - RNA, 22 nt, Homo sapiens
ucagaucauuaagguagguuua

SEQ ID NO: 175229 - RNA, 22 nt, Homo sapiens
ucagauguuucuuuaacgcaug

SEQ ID NO: 175230 - RNA, 22 nt, Homo sapiens
ucagcagugccccacucuacug

SEQ ID NO: 175231 - RNA, 22 nt, Homo sapiens
ucagcagugugaaaacaaacua

SEQ ID NO: 175232 - RNA, 22 nt, Homo sapiens
ucaggcacuaguaagaaaaagg

SEQ ID NO: 175233 - RNA, 21 nt, Homo sapiens
ucagggaccugcuguacugau

SEQ ID NO: 175234 - RNA, 22 nt, Homo sapiens
ucagggacgcuugacacaagcc

SEQ ID NO: 175235 - RNA, 20 nt, Homo sapiens
ucagguagaucuuugagguc

SEQ ID NO: 175236 - RNA, 22 nt, Homo sapiens
ucagguaguuugugggagauga

SEQ ID NO: 175237 - RNA, 22 nt, Homo sapiens
ucagguaucucuauagcaaugu

SEQ ID NO: 175238 - RNA, 22 nt, Homo sapiens
ucagguaucuucauagcaaugc

SEQ ID NO: 175239 - RNA, 22 nt, Homo sapiens
ucagguccuuacugugcucccu

SEQ ID NO: 175240 - RNA, 22 nt, Homo sapiens
ucaggugcagagaagaaauggg

SEQ ID NO: 175241 - RNA, 22 nt, Homo sapiens
ucaggugccuuggcuaauuguu

SEQ ID NO: 175242 - RNA, 22 nt, Homo sapiens
ucaguagagacaggauuucacc

SEQ ID NO: 175243 - RNA, 22 nt, Homo sapiens
ucaguagcaugaaaacagacua

SEQ ID NO: 175244 - RNA, 22 nt, Homo sapiens
ucaguaguuccaguggguauuu

SEQ ID NO: 175245 - RNA, 23 nt, Homo sapiens
ucagugaaggaacaacuaaauag

SEQ ID NO: 175246 - RNA, 22 nt, Homo sapiens
ucagugaauauauaacagcgau

SEQ ID NO: 175247 - RNA, 17 nt, Homo sapiens
ucagugcauuuaagaga

SEQ ID NO: 175248 - RNA, 19 nt, Homo sapiens
ucagugcuauguaauguag

SEQ ID NO: 175249 - RNA, 22 nt, Homo sapiens
ucagugcuuggcacagagagcu

SEQ ID NO: 175250 - RNA, 22 nt, Homo sapiens
ucaguggacuuagucuuucccc

SEQ ID NO: 175251 - RNA, 22 nt, Homo sapiens
ucagugucugcauucuuauugu

SEQ ID NO: 175252 - RNA, 22 nt, Homo sapiens
ucaguuuguauuucagguugca

SEQ ID NO: 175253 - RNA, 22 nt, Homo sapiens
ucauaaaguuguuuuaauggga

SEQ ID NO: 175254 - RNA, 22 nt, Homo sapiens
ucauacuguuaaaugguuuagu

SEQ ID NO: 175255 - RNA, 20 nt, Homo sapiens
ucauagcuuuuuccacuuua

SEQ ID NO: 175256 - RNA, 22 nt, Homo sapiens
ucauaguacuuuguuuugaaaa

SEQ ID NO: 175257 - RNA, 19 nt, Homo sapiens
ucauagucuaagaugagaa

SEQ ID NO: 175258 - RNA, 22 nt, Homo sapiens
ucauagucuaagguucuuuugc

SEQ ID NO: 175259 - RNA, 22 nt, Homo sapiens
ucauaucauuagaucuacugua

SEQ ID NO: 175260 - RNA, 23 nt, Homo sapiens
ucaucacagcauuuccugguauu

SEQ ID NO: 175261 - RNA, 22 nt, Homo sapiens
ucaucaggaaacuuaugcagug

SEQ ID NO: 175262 - RNA, 22 nt, Homo sapiens
ucauccauacaguuagcaaagg

SEQ ID NO: 175263 - RNA, 22 nt, Homo sapiens
ucauggcuuuuauuauguugag

SEQ ID NO: 175264 - RNA, 22 nt, Homo sapiens
ucaugggagcccccaucaugag

SEQ ID NO: 175265 - RNA, 22 nt, Homo sapiens
ucauguaauuuugugucuauga

SEQ ID NO: 175266 - RNA, 22 nt, Homo sapiens
ucaugugagcacagagcaagau

SEQ ID NO: 175267 - RNA, 19 nt, Homo sapiens
ucaugugcauacauuuggg

SEQ ID NO: 175268 - RNA, 22 nt, Homo sapiens
ucauugcaaucucugccucccg

SEQ ID NO: 175269 - RNA, 22 nt, Homo sapiens
ucauugcacuccagccugggug

SEQ ID NO: 175270 - RNA, 18 nt, Homo sapiens
ucauuggugagcaccucc

SEQ ID NO: 175271 - RNA, 22 nt, Homo sapiens
ucauuguccaacuucuuucagu

SEQ ID NO: 175272 - RNA, 22 nt, Homo sapiens
uccacaauggcugaacuagauu

SEQ ID NO: 175273 - RNA, 22 nt, Homo sapiens
uccacagugguggaauuguuca

SEQ ID NO: 175274 - RNA, 19 nt, Homo sapiens
uccaccgcgugcaccucua

SEQ ID NO: 175275 - RNA, 22 nt, Homo sapiens
uccaccgugggcugcggggcuc

SEQ ID NO: 175276 - RNA, 22 nt, Homo sapiens
uccacuuuugugcugaauugga

SEQ ID NO: 175277 - RNA, 22 nt, Homo sapiens
uccagaguggugaugcuggggc

SEQ ID NO: 175278 - RNA, 17 nt, Homo sapiens
uccagauuucaauugaa

SEQ ID NO: 175279 - RNA, 22 nt, Homo sapiens
uccagguacucagggggcugag

SEQ ID NO: 175280 - RNA, 22 nt, Homo sapiens
uccagguuucaugcucuuuauu

SEQ ID NO: 175281 - RNA, 22 nt, Homo sapiens
uccaguacaggucucucauuuc

SEQ ID NO: 175282 - RNA, 22 nt, Homo sapiens
uccaguguuccucagucacccc

SEQ ID NO: 175283 - RNA, 22 nt, Homo sapiens
uccaguuuggaggcuugaugug

SEQ ID NO: 175284 - RNA, 22 nt, Homo sapiens
uccaugaggcuacaguaaucuc

SEQ ID NO: 175285 - RNA, 22 nt, Homo sapiens
uccauguaguugagcggcuuug

SEQ ID NO: 175286 - RNA, 22 nt, Homo sapiens
uccaugugaaaaggucgugaua

SEQ ID NO: 175287 - RNA, 22 nt, Homo sapiens
uccaugugaaaucuaugaggac

SEQ ID NO: 175288 - RNA, 18 nt, Homo sapiens
uccauuuguaugggaugg

SEQ ID NO: 175289 - RNA, 22 nt, Homo sapiens
uccauuugucuauguuucuguu

SEQ ID NO: 175290 - RNA, 22 nt, Homo sapiens
uccauuuguucagcuucaggaa

SEQ ID NO: 175291 - RNA, 22 nt, Homo sapiens
uccauuuguuguaggguauagu

SEQ ID NO: 175292 - RNA, 22 nt, Homo sapiens
ucccaagaugagaugggggcug

SEQ ID NO: 175293 - RNA, 19 nt, Homo sapiens
ucccaagaugcucauacau

SEQ ID NO: 175294 - RNA, 20 nt, Homo sapiens
ucccaguaggagaaggaagg

SEQ ID NO: 175295 - RNA, 22 nt, Homo sapiens
ucccaguguguagcuugucucu

SEQ ID NO: 175296 - RNA, 22 nt, Homo sapiens
uccccugauaccaaccaccaug

SEQ ID NO: 175297 - RNA, 20 nt, Homo sapiens
ucccuaagagccuuuccuuc

SEQ ID NO: 175298 - RNA, 22 nt, Homo sapiens
ucccuacuggggcacugccuag

SEQ ID NO: 175299 - RNA, 22 nt, Homo sapiens
ucccugaaaaauuggcuuaaca

SEQ ID NO: 175300 - RNA, 22 nt, Homo sapiens
ucccugaacacauguugagaag

SEQ ID NO: 175301 - RNA, 22 nt, Homo sapiens
ucccugacagggucugagcuuu

SEQ ID NO: 175302 - RNA, 18 nt, Homo sapiens
ucccugacucaaauucuu

SEQ ID NO: 175303 - RNA, 22 nt, Homo sapiens
ucccugguguuaguuuguucuu

SEQ ID NO: 175304 - RNA, 16 nt, Homo sapiens
ucccugugacaugugc

SEQ ID NO: 175305 - RNA, 22 nt, Homo sapiens
ucccuuaaugaugaacaaugag

SEQ ID NO: 175306 - RNA, 22 nt, Homo sapiens
ucccuugguaauucuguuccuu

SEQ ID NO: 175307 - RNA, 22 nt, Homo sapiens
ucccuuucuggaguuucccaag

SEQ ID NO: 175308 - RNA, 22 nt, Homo sapiens
ugagauggguucugguccccug

SEQ ID NO: 175309 - RNA, 22 nt, Homo sapiens
ugagaugugugcauucaacuca

SEQ ID NO: 175310 - RNA, 23 nt, Homo sapiens
ugagauuacccagaaagaguaua

SEQ ID NO: 175311 - RNA, 22 nt, Homo sapiens
ugagauuaucuguacauaggag

SEQ ID NO: 175312 - RNA, 22 nt, Homo sapiens
ugagauucucugauuguagguc

SEQ ID NO: 175313 - RNA, 22 nt, Homo sapiens
ugagauuguaucugcaaugugu

SEQ ID NO: 175314 - RNA, 19 nt, Homo sapiens
ugagauuguaugaggagau

SEQ ID NO: 175315 - RNA, 22 nt, Homo sapiens
ugagcaacauuucaaaacucca

SEQ ID NO: 175316 - RNA, 22 nt, Homo sapiens
ugagcaagaaauagaaacagau

SEQ ID NO: 175317 - RNA, 22 nt, Homo sapiens
ugagcacagagccugggguggc

SEQ ID NO: 175318 - RNA, 22 nt, Homo sapiens
ugagcagaaagcugcaaggucg

SEQ ID NO: 175319 - RNA, 22 nt, Homo sapiens
ugagcaucauucacaccuuggu

SEQ ID NO: 175320 - RNA, 22 nt, Homo sapiens
ugagcaucucuaaaaggagcaa

SEQ ID NO: 175321 - RNA, 22 nt, Homo sapiens
ugagccauggcaccuugucuaa

SEQ ID NO: 175322 - RNA, 23 nt, Homo sapiens
ugagccaugggacuccaagggag

SEQ ID NO: 175323 - RNA, 22 nt, Homo sapiens
ugagccaugggguaaaugugau

SEQ ID NO: 175324 - RNA, 22 nt, Homo sapiens
ugagcuaggaucacaccugcau

SEQ ID NO: 175325 - RNA, 22 nt, Homo sapiens
ugagcuaggauccugucacugu

SEQ ID NO: 175326 - RNA, 22 nt, Homo sapiens
ugagcugagaaaugcagcagcu

SEQ ID NO: 175327 - RNA, 22 nt, Homo sapiens
ugagcugagaucacacuacugu

SEQ ID NO: 175328 - RNA, 22 nt, Homo sapiens
ugagcugagaucaugcuauugu

SEQ ID NO: 175329 - RNA, 22 nt, Homo sapiens
ugagcugagaucgugccauugu

SEQ ID NO: 175330 - RNA, 22 nt, Homo sapiens
ugaggauaguguugaaggcagg

SEQ ID NO: 175331 - RNA, 22 nt, Homo sapiens
ugaggcaaggcugaaugaaggc

SEQ ID NO: 175332 - RNA, 22 nt, Homo sapiens
ugaggcuagucagaucagauga

SEQ ID NO: 175333 - RNA, 22 nt, Homo sapiens
ugagggaugccugguuuguuuu

SEQ ID NO: 175334 - RNA, 22 nt, Homo sapiens
ugagguaauagauaauauuuuu

SEQ ID NO: 175335 - RNA, 22 nt, Homo sapiens
ugagguagaaugauucuaauau

SEQ ID NO: 175336 - RNA, 22 nt, Homo sapiens
ugagguauuuuguuaugcagcc

SEQ ID NO: 175337 - RNA, 22 nt, Homo sapiens
ugaggugaaguaauauucuaag

SEQ ID NO: 175338 - RNA, 22 nt, Homo sapiens
ugaggugagauggcuaccccaa

SEQ ID NO: 175339 - RNA, 22 nt, Homo sapiens
ugaggugagggguuaggugcua

SEQ ID NO: 175340 - RNA, 22 nt, Homo sapiens
ugagguguuaacuuuacuuuua

SEQ ID NO: 175341 - RNA, 22 nt, Homo sapiens
ugagguguuauccagaguucuu

SEQ ID NO: 175342 - RNA, 22 nt, Homo sapiens
ugagguuauuuguucaagaagu

SEQ ID NO: 175343 - RNA, 22 nt, Homo sapiens
ugaguaauguugaucuuugaua

SEQ ID NO: 175344 - RNA, 22 nt, Homo sapiens
ugaguagaaauaaacgcaaacu

SEQ ID NO: 175345 - RNA, 22 nt, Homo sapiens
ugaguagugccacaauaagcau

SEQ ID NO: 175346 - RNA, 19 nt, Homo sapiens
ugaguauauuguauucauu

SEQ ID NO: 175347 - RNA, 22 nt, Homo sapiens
ugagucauguaauaaugcugcu

SEQ ID NO: 175348 - RNA, 22 nt, Homo sapiens
ugagugaaugugaaggcuaggg

SEQ ID NO: 175349 - RNA, 22 nt, Homo sapiens
ugagugagguucuacucuguga

SEQ ID NO: 175350 - RNA, 21 nt, Homo sapiens
ugagugcugagugaggguuga

SEQ ID NO: 175351 - RNA, 22 nt, Homo sapiens
ugaguguccaaguaaggugaaa

SEQ ID NO: 175352 - RNA, 22 nt, Homo sapiens
ugaguguguaugugcauacaca

SEQ ID NO: 175353 - RNA, 22 nt, Homo sapiens
ugaguuauuaguagaggcuaug

SEQ ID NO: 175354 - RNA, 22 nt, Homo sapiens
ugaguucaauguuaaugaagca

SEQ ID NO: 175355 - RNA, 22 nt, Homo sapiens
ugaguuccuugugugaccuugc

SEQ ID NO: 175356 - RNA, 22 nt, Homo sapiens
ugaguuccuuucccaguccagu

SEQ ID NO: 175357 - RNA, 22 nt, Homo sapiens
ugaguucuuccuaucucugccu

SEQ ID NO: 175358 - RNA, 22 nt, Homo sapiens
ugaguugagauaagguuacauu

SEQ ID NO: 175359 - RNA, 22 nt, Homo sapiens
ugauaacauugggggaagcuga

SEQ ID NO: 175360 - RNA, 22 nt, Homo sapiens
ugauaagaaauuguucauguag

SEQ ID NO: 175361 - RNA, 22 nt, Homo sapiens
ugauaauguuaggcuuuauuca

SEQ ID NO: 175362 - RNA, 22 nt, Homo sapiens
ugauacuggcuucauagaauga

SEQ ID NO: 175363 - RNA, 22 nt, Homo sapiens
ugauaucugaauagauacacaa

SEQ ID NO: 175364 - RNA, 22 nt, Homo sapiens
ugauaugugaguauaugguuau

SEQ ID NO: 175365 - RNA, 22 nt, Homo sapiens
ugauauguguaaacaauguaua

SEQ ID NO: 175366 - RNA, 20 nt, Homo sapiens
ugauauuuucugagcaggaa

SEQ ID NO: 175367 - RNA, 21 nt, Homo sapiens
ugaucacaugaaaaccaugca

SEQ ID NO: 175368 - RNA, 22 nt, Homo sapiens
ugaucucagcucacugguugaa

SEQ ID NO: 175369 - RNA, 22 nt, Homo sapiens
ugaucugucucggguuaucagu

SEQ ID NO: 175370 - RNA, 22 nt, Homo sapiens
ugaucuguguauauugaaccag

SEQ ID NO: 175371 - RNA, 20 nt, Homo sapiens
ugaugcaaaucuuuaaaagu

SEQ ID NO: 175372 - RNA, 22 nt, Homo sapiens
ugaugcugaguggcuauuugaa

SEQ ID NO: 175373 - RNA, 22 nt, Homo sapiens
ugauggcaauggcauucauuuu

SEQ ID NO: 175374 - RNA, 22 nt, Homo sapiens
ugaugguaguucagucaaugua

SEQ ID NO: 175375 - RNA, 22 nt, Homo sapiens
ugauguaggcauuuaagguuau

SEQ ID NO: 175376 - RNA, 20 nt, Homo sapiens
ugauguccaggcagagguuu

SEQ ID NO: 175377 - RNA, 22 nt, Homo sapiens
ugauguguuuuguaguucaacu

SEQ ID NO: 175378 - RNA, 22 nt, Homo sapiens
ugauguugacuguaggcagaga

SEQ ID NO: 175379 - RNA, 20 nt, Homo sapiens
ugauuaguccacuuggcucu

SEQ ID NO: 175380 - RNA, 20 nt, Homo sapiens
ugauugaccagagcaguuuu

SEQ ID NO: 175381 - RNA, 22 nt, Homo sapiens
ugauuugucugcaggaauagug

SEQ ID NO: 175382 - RNA, 19 nt, Homo sapiens
ugcaaagucagugaagggu

SEQ ID NO: 175383 - RNA, 22 nt, Homo sapiens
ugcaaaguccucauucuuaccc

SEQ ID NO: 175384 - RNA, 19 nt, Homo sapiens
ugcaaagucuuuuccuauu

SEQ ID NO: 175385 - RNA, 22 nt, Homo sapiens
ugcaaaugcugcuauuucucuu

SEQ ID NO: 175386 - RNA, 22 nt, Homo sapiens
ugcaaauguuaggugucauuau

SEQ ID NO: 175387 - RNA, 22 nt, Homo sapiens
ugcaagaaucagccuaucauua

SEQ ID NO: 175388 - RNA, 22 nt, Homo sapiens
ugcaagacugcaguuacuuuug

SEQ ID NO: 175389 - RNA, 22 nt, Homo sapiens
ugcaaucaucgcuguuggccac

SEQ ID NO: 175390 - RNA, 17 nt, Homo sapiens
ugcaauuuaagcuagau

SEQ ID NO: 175391 - RNA, 22 nt, Homo sapiens
ugcacuguggucugagagacag

SEQ ID NO: 175392 - RNA, 16 nt, Homo sapiens
ugcagaguaggugaau

SEQ ID NO: 175393 - RNA, 19 nt, Homo sapiens
ugcagcaauguaaaagaca

SEQ ID NO: 175394 - RNA, 20 nt, Homo sapiens
ugcagcacugggaaugcagu

SEQ ID NO: 175395 - RNA, 22 nt, Homo sapiens
ugcagcacuguucacaauagcc

SEQ ID NO: 175396 - RNA, 18 nt, Homo sapiens
ugcagcaucaguacccag

SEQ ID NO: 175397 - RNA, 22 nt, Homo sapiens
ugcagcauguaggcacguuauu

SEQ ID NO: 175398 - RNA, 22 nt, Homo sapiens
ugcagcauugcacuccagccug

SEQ ID NO: 175399 - RNA, 22 nt, Homo sapiens
ugcagcucaaauuccuaacaag

SEQ ID NO: 175400 - RNA, 22 nt, Homo sapiens
ugcaggguccauugucccaagu

SEQ ID NO: 175401 - RNA, 22 nt, Homo sapiens
ugcaguagugugaucuuggcuc

SEQ ID NO: 175402 - RNA, 22 nt, Homo sapiens
ugcagugcaugacuguguuaug

SEQ ID NO: 175403 - RNA, 22 nt, Homo sapiens
ugcagugucaauaauaauuagu

SEQ ID NO: 175404 - RNA, 22 nt, Homo sapiens
ugcagugugcuggggucuccau

SEQ ID NO: 175405 - RNA, 22 nt, Homo sapiens
ugcaguuuaggaacugguaaca

SEQ ID NO: 175406 - RNA, 22 nt, Homo sapiens
ugcauacuguaugcgugcauac

SEQ ID NO: 175407 - RNA, 22 nt, Homo sapiens
ugcauagaauguucuguaaaua

SEQ ID NO: 175408 - RNA, 22 nt, Homo sapiens
ugcauaggcuaaaauccuggcc

SEQ ID NO: 175409 - RNA, 19 nt, Homo sapiens
ugcauaggguuacauacuc

SEQ ID NO: 175410 - RNA, 22 nt, Homo sapiens
ugcauaugucuuuauaguagca

SEQ ID NO: 175411 - RNA, 22 nt, Homo sapiens
ugcauauguugaaccaggcuug

SEQ ID NO: 175412 - RNA, 21 nt, Homo sapiens
ugcauauuggaacuuucucuc

SEQ ID NO: 175413 - RNA, 22 nt, Homo sapiens
ugcauguucuuacucauacaug

SEQ ID NO: 175414 - RNA, 22 nt, Homo sapiens
ugcauuaucagauguuugcuuu

SEQ ID NO: 175415 - RNA, 20 nt, Homo sapiens
ugccaagaaaugaggguauu

SEQ ID NO: 175416 - RNA, 22 nt, Homo sapiens
ugccagaugcaguguucaacaa

SEQ ID NO: 175417 - RNA, 22 nt, Homo sapiens
ugccaguauuuuguugaagauu

SEQ ID NO: 175418 - RNA, 22 nt, Homo sapiens
uggaagacacauaccugauaac

SEQ ID NO: 175419 - RNA, 23 nt, Homo sapiens
uggaagacuccucucuuggcugc

SEQ ID NO: 175420 - RNA, 22 nt, Homo sapiens
uggaagauuacuuuuuguugaa

SEQ ID NO: 175421 - RNA, 22 nt, Homo sapiens
uggaaguagauagauuguguca

SEQ ID NO: 175422 - RNA, 22 nt, Homo sapiens
uggaagucauugagguguguua

SEQ ID NO: 175423 - RNA, 22 nt, Homo sapiens
uggaaucuacuaaagcaaaauc

SEQ ID NO: 175424 - RNA, 20 nt, Homo sapiens
uggaaucugaagaucucagu

SEQ ID NO: 175425 - RNA, 22 nt, Homo sapiens
uggaaugcucuccccacggacu

SEQ ID NO: 175426 - RNA, 22 nt, Homo sapiens
uggaaugguaucuuguuggggu

SEQ ID NO: 175427 - RNA, 22 nt, Homo sapiens
uggaaugugaauaacuuccuuc

SEQ ID NO: 175428 - RNA, 18 nt, Homo sapiens
uggaauguuuggguuaau

SEQ ID NO: 175429 - RNA, 21 nt, Homo sapiens
uggaauuaauggagagguguu

SEQ ID NO: 175430 - RNA, 22 nt, Homo sapiens
uggaauuuagguugauaguaua

SEQ ID NO: 175431 - RNA, 22 nt, Homo sapiens
uggacaugaagggcacaggagg

SEQ ID NO: 175432 - RNA, 19 nt, Homo sapiens
uggaccccuuccuuacacc

SEQ ID NO: 175433 - RNA, 21 nt, Homo sapiens
uggaccccuuccuuacaucau

SEQ ID NO: 175434 - RNA, 22 nt, Homo sapiens
uggacuguaauagagaacagaa

SEQ ID NO: 175435 - RNA, 22 nt, Homo sapiens
uggacuguaauuuuauaggcau

SEQ ID NO: 175436 - RNA, 22 nt, Homo sapiens
uggagaacugaugucuccaaga

SEQ ID NO: 175437 - RNA, 22 nt, Homo sapiens
uggagagucauuuauaguauuu

SEQ ID NO: 175438 - RNA, 18 nt, Homo sapiens
uggagauaagaagaacuu

SEQ ID NO: 175439 - RNA, 22 nt, Homo sapiens
uggagcccuaaacuucuaauau

SEQ ID NO: 175440 - RNA, 22 nt, Homo sapiens
uggaggacugcagaacugaggc

SEQ ID NO: 175441 - RNA, 22 nt, Homo sapiens
uggagggcuagucauuucuuuu

SEQ ID NO: 175442 - RNA, 22 nt, Homo sapiens
uggagguagacauugggaagag

SEQ ID NO: 175443 - RNA, 22 nt, Homo sapiens
uggagguaggacgaagaacucu

SEQ ID NO: 175444 - RNA, 22 nt, Homo sapiens
uggagguaggugauauguagca

SEQ ID NO: 175445 - RNA, 22 nt, Homo sapiens
uggaguaggccuaagaaugaca

SEQ ID NO: 175446 - RNA, 21 nt, Homo sapiens
uggagugaagaguuuauugac

SEQ ID NO: 175447 - RNA, 20 nt, Homo sapiens
uggagugaagguucuggacc

SEQ ID NO: 175448 - RNA, 22 nt, Homo sapiens
uggagugauaugguuauauggg

SEQ ID NO: 175449 - RNA, 22 nt, Homo sapiens
uggagugcaauggcaccaucuu

SEQ ID NO: 175450 - RNA, 20 nt, Homo sapiens
uggagugcuguguugagaag

SEQ ID NO: 175451 - RNA, 22 nt, Homo sapiens
uggaguguagaagccagccucc

SEQ ID NO: 175452 - RNA, 22 nt, Homo sapiens
uggagugucaguuuccagaguu

SEQ ID NO: 175453 - RNA, 22 nt, Homo sapiens
uggaguguguuaacuuuacaag

SEQ ID NO: 175454 - RNA, 20 nt, Homo sapiens
uggaguuguggcaguuugga

SEQ ID NO: 175455 - RNA, 22 nt, Homo sapiens
uggaguuugacaugccuuuggg

SEQ ID NO: 175456 - RNA, 20 nt, Homo sapiens
uggaguuugaguucuuggag

SEQ ID NO: 175457 - RNA, 22 nt, Homo sapiens
uggauagaaauguacuguuuuc

SEQ ID NO: 175458 - RNA, 22 nt, Homo sapiens
uggauggagaggcuugugaugc

SEQ ID NO: 175459 - RNA, 22 nt, Homo sapiens
uggauguaauugauucauguug

SEQ ID NO: 175460 - RNA, 21 nt, Homo sapiens
uggauuguacacccuaucauu

SEQ ID NO: 175461 - RNA, 22 nt, Homo sapiens
uggcaaaaaaccgcaguugccu

SEQ ID NO: 175462 - RNA, 22 nt, Homo sapiens
uggcaaaauauuuugguuucug

SEQ ID NO: 175463 - RNA, 22 nt, Homo sapiens
uggcaaagugugacgugggggu

SEQ ID NO: 175464 - RNA, 22 nt, Homo sapiens
uggcaaauagcaauaggagggu

SEQ ID NO: 175465 - RNA, 22 nt, Homo sapiens
uggcaaaugugagaugagaacu

SEQ ID NO: 175466 - RNA, 21 nt, Homo sapiens
uggcaacauggauggauucug

SEQ ID NO: 175467 - RNA, 22 nt, Homo sapiens
uggcaagauuguuccgguuugg

SEQ ID NO: 175468 - RNA, 23 nt, Homo sapiens
uggcaagauuuguauugccugga

SEQ ID NO: 175469 - RNA, 22 nt, Homo sapiens
uggcaagugggaccuaguuaaa

SEQ ID NO: 175470 - RNA, 18 nt, Homo sapiens
uggcaaguuuaguagcac

SEQ ID NO: 175471 - RNA, 22 nt, Homo sapiens
uggcacaaugacccuugugggc

SEQ ID NO: 175472 - RNA, 19 nt, Homo sapiens
uggcacauguauacauaug

SEQ ID NO: 175473 - RNA, 19 nt, Homo sapiens
uggcacauguauacuuaug

SEQ ID NO: 175474 - RNA, 21 nt, Homo sapiens
uggcacuauucacaauagcaa

SEQ ID NO: 175475 - RNA, 22 nt, Homo sapiens
uggcagacaaauuugagcauau

SEQ ID NO: 175476 - RNA, 22 nt, Homo sapiens
uggcagaugcucuuggugccca

SEQ ID NO: 175477 - RNA, 22 nt, Homo sapiens
uggcagaugggugagcuggaga

SEQ ID NO: 175478 - RNA, 22 nt, Homo sapiens
uggcaggugcacuggcuuugaa

SEQ ID NO: 175479 - RNA, 17 nt, Homo sapiens
uggcaugaggguguggg

SEQ ID NO: 175480 - RNA, 22 nt, Homo sapiens
uggcaugauguguucauugaaa

SEQ ID NO: 175481 - RNA, 22 nt, Homo sapiens
uggcaugcauuguggguaauua

SEQ ID NO: 175482 - RNA, 22 nt, Homo sapiens
uggcauggaguggauggcccca

SEQ ID NO: 175483 - RNA, 22 nt, Homo sapiens
uggcaugucagguuucuggguu

SEQ ID NO: 175484 - RNA, 22 nt, Homo sapiens
uggcauuuuguuuuagaauuag

SEQ ID NO: 175485 - RNA, 22 nt, Homo sapiens
uggccagagggcaauuagcugu

SEQ ID NO: 175486 - RNA, 22 nt, Homo sapiens
uggcuacagaaaguacuaguga

SEQ ID NO: 175487 - RNA, 22 nt, Homo sapiens
uggcucuuucuagacuuaauua

SEQ ID NO: 175488 - RNA, 22 nt, Homo sapiens
uggcuguuuauuucaccuggau

SEQ ID NO: 175489 - RNA, 22 nt, Homo sapiens
uggcuguuuauuucaccugggc

SEQ ID NO: 175490 - RNA, 22 nt, Homo sapiens
uggcuguuuauuucaccugggu

SEQ ID NO: 175491 - RNA, 21 nt, Homo sapiens
uggcuuauuugaaucuggcuu

SEQ ID NO: 175492 - RNA, 20 nt, Homo sapiens
uggcuucuuaauugcaggca

SEQ ID NO: 175493 - RNA, 22 nt, Homo sapiens
ugggaacugaggugaaaagaca

SEQ ID NO: 175494 - RNA, 22 nt, Homo sapiens
ugggaagcugcauuuuaacaag

SEQ ID NO: 175495 - RNA, 22 nt, Homo sapiens
ugggaaugaaauuacauagcuu

SEQ ID NO: 175496 - RNA, 22 nt, Homo sapiens
ugggaucauucaaugacgaaau

SEQ ID NO: 175497 - RNA, 22 nt, Homo sapiens
ugggaucuuuccuauuagcgag

SEQ ID NO: 175498 - RNA, 22 nt, Homo sapiens
ugggaugaaaauagcuucuucc

SEQ ID NO: 175499 - RNA, 22 nt, Homo sapiens
ugggcaguauggucauuuucgu

SEQ ID NO: 175500 - RNA, 22 nt, Homo sapiens
uggggugugagggagaaagaaa

SEQ ID NO: 175501 - RNA, 22 nt, Homo sapiens
uggguagaugaauccauuccaa

SEQ ID NO: 175502 - RNA, 22 nt, Homo sapiens
uggguaggcccucauuggacag

SEQ ID NO: 175503 - RNA, 19 nt, Homo sapiens
uggguaguuuucuggcugg

SEQ ID NO: 175504 - RNA, 22 nt, Homo sapiens
ugggucaguagcauguaugucu

SEQ ID NO: 175505 - RNA, 23 nt, Homo sapiens
ugggucaguuuuucugacaucau

SEQ ID NO: 175506 - RNA, 22 nt, Homo sapiens
ugguaauguaauuuggagaagg

SEQ ID NO: 175507 - RNA, 22 nt, Homo sapiens
ugguccaguucugugauauugc

SEQ ID NO: 175508 - RNA, 22 nt, Homo sapiens
uggucccaugaacuuuagguca

SEQ ID NO: 175509 - RNA, 23 nt, Homo sapiens
uggucccguguucuggcuuuagg

SEQ ID NO: 175510 - RNA, 22 nt, Homo sapiens
uggucuccuuuguacccugggc

SEQ ID NO: 175511 - RNA, 22 nt, Homo sapiens
uggugagaaaugagaugcuuuu

SEQ ID NO: 175512 - RNA, 22 nt, Homo sapiens
uggugcaaauguaauugugguu

SEQ ID NO: 175513 - RNA, 22 nt, Homo sapiens
uggugcccuguccuucuguggc

SEQ ID NO: 175514 - RNA, 22 nt, Homo sapiens
uguaaacauguauguguuuaug

SEQ ID NO: 175515 - RNA, 22 nt, Homo sapiens
uguaacaggaggaaaaugugaa

SEQ ID NO: 175516 - RNA, 22 nt, Homo sapiens
uguaagcauuauauaauuguug

SEQ ID NO: 175517 - RNA, 22 nt, Homo sapiens
uguaauaguaggcucacauuug

SEQ ID NO: 175518 - RNA, 20 nt, Homo sapiens
uguaaucuaaguuuuaagcc

SEQ ID NO: 175519 - RNA, 22 nt, Homo sapiens
uguacaaaacaagaugggggua

SEQ ID NO: 175520 - RNA, 19 nt, Homo sapiens
uguaccagcaagucuuuuc

SEQ ID NO: 175521 - RNA, 22 nt, Homo sapiens
uguacuucaagauuaugguuua

SEQ ID NO: 175522 - RNA, 22 nt, Homo sapiens
uguagacaccaaagacagcaua

SEQ ID NO: 175523 - RNA, 22 nt, Homo sapiens
uguagcacauuugaagagaagc

SEQ ID NO: 175524 - RNA, 22 nt, Homo sapiens
uguagucauuuggaguccagcu

SEQ ID NO: 175525 - RNA, 22 nt, Homo sapiens
uguauguaauugaaguuaaguu

SEQ ID NO: 175526 - RNA, 22 nt, Homo sapiens
uguauguagugaccagggccag

SEQ ID NO: 175527 - RNA, 22 nt, Homo sapiens
uguauuuguuguuaaauggaga

SEQ ID NO: 175528 - RNA, 22 nt, Homo sapiens
ugucaaacauuaugaugcucua

SEQ ID NO: 175529 - RNA, 22 nt, Homo sapiens
uuaggcuaguuucuuaaacucu

SEQ ID NO: 175530 - RNA, 22 nt, Homo sapiens
uuaggcuuuauugaaaacaaua

SEQ ID NO: 175531 - RNA, 22 nt, Homo sapiens
uuaggcuuuuuaaccaguuguu

SEQ ID NO: 175532 - RNA, 22 nt, Homo sapiens
uuagguauuuuguuaugucagc

SEQ ID NO: 175533 - RNA, 22 nt, Homo sapiens
uuaguagagacgagcguuccac

SEQ ID NO: 175534 - RNA, 20 nt, Homo sapiens
uuagucuccucugcccuguc

SEQ ID NO: 175535 - RNA, 22 nt, Homo sapiens
uuagugaaugcaccacuucuga

SEQ ID NO: 175536 - RNA, 22 nt, Homo sapiens
uuagugaaugggugugauuugu

SEQ ID NO: 175537 - RNA, 22 nt, Homo sapiens
uuaguucauugugacuggacuc

SEQ ID NO: 175538 - RNA, 22 nt, Homo sapiens
uuauaaacaugaagauuugggg

SEQ ID NO: 175539 - RNA, 22 nt, Homo sapiens
uuauacacugugggaguguaaa

SEQ ID NO: 175540 - RNA, 22 nt, Homo sapiens
uuauagcacuaagaagguaaua

SEQ ID NO: 175541 - RNA, 22 nt, Homo sapiens
uuauaggcaggugguguagaug

SEQ ID NO: 175542 - RNA, 18 nt, Homo sapiens
uuauaugcauguguagga

SEQ ID NO: 175543 - RNA, 22 nt, Homo sapiens
uuauccucuagacauagguuua

SEQ ID NO: 175544 - RNA, 22 nt, Homo sapiens
uuaugcagcaaagugcuugaaa

SEQ ID NO: 175545 - RNA, 22 nt, Homo sapiens
uuauggauuuauauucuguagu

SEQ ID NO: 175546 - RNA, 22 nt, Homo sapiens
uuaugucuuugagcaaugcugu

SEQ ID NO: 175547 - RNA, 22 nt, Homo sapiens
uuauuagguuagugcaaaaguu

SEQ ID NO: 175548 - RNA, 22 nt, Homo sapiens
uuauucauuaacagggaccaaa

SEQ ID NO: 175549 - RNA, 22 nt, Homo sapiens
uuauucauuaauugcuaagguu

SEQ ID NO: 175550 - RNA, 22 nt, Homo sapiens
uuauugaguaaaaagaaugguu

SEQ ID NO: 175551 - RNA, 20 nt, Homo sapiens
uuauugcggcaucauucaug

SEQ ID NO: 175552 - RNA, 22 nt, Homo sapiens
uuauugcucauuugggcauucu

SEQ ID NO: 175553 - RNA, 22 nt, Homo sapiens
uuauugcuccagaggcugauuu

SEQ ID NO: 175554 - RNA, 22 nt, Homo sapiens
uucaaauguucuuucaccaccc

SEQ ID NO: 175555 - RNA, 22 nt, Homo sapiens
uucaagauggcaccagugagug

SEQ ID NO: 175556 - RNA, 22 nt, Homo sapiens
uucaagcuacaguggcaggguu

SEQ ID NO: 175557 - RNA, 22 nt, Homo sapiens
uucaagcuauggugaucuuuuc

SEQ ID NO: 175558 - RNA, 22 nt, Homo sapiens
uucaagucaaggaaagaggucu

SEQ ID NO: 175559 - RNA, 22 nt, Homo sapiens
uucaagucuuggcuuugccacc

SEQ ID NO: 175560 - RNA, 20 nt, Homo sapiens
uucaagugauucucaugccu

SEQ ID NO: 175561 - RNA, 22 nt, Homo sapiens
uucaagugguucagaagucuga

SEQ ID NO: 175562 - RNA, 22 nt, Homo sapiens
uucaauuaauauuauacucuca

SEQ ID NO: 175563 - RNA, 22 nt, Homo sapiens
uucacagccgcaccccaucacu

SEQ ID NO: 175564 - RNA, 22 nt, Homo sapiens
uucacagcuuaauaaggcucag

SEQ ID NO: 175565 - RNA, 22 nt, Homo sapiens
uucacaguacucccuggaauua

SEQ ID NO: 175566 - RNA, 22 nt, Homo sapiens
uucacagucacccuucuccaug

SEQ ID NO: 175567 - RNA, 22 nt, Homo sapiens
uucaccaguuuugucacgaaug

SEQ ID NO: 175568 - RNA, 22 nt, Homo sapiens
uucacccugguuguagauggac

SEQ ID NO: 175569 - RNA, 22 nt, Homo sapiens
uucaccuguagcaugcccuugg

SEQ ID NO: 175570 - RNA, 22 nt, Homo sapiens
uucacgguguucacgggggucc

SEQ ID NO: 175571 - RNA, 22 nt, Homo sapiens
uucacugcaugaaaaggacagc

SEQ ID NO: 175572 - RNA, 22 nt, Homo sapiens
uucacuguagccucagccucuu

SEQ ID NO: 175573 - RNA, 22 nt, Homo sapiens
uucacugugugacccugggcca

SEQ ID NO: 175574 - RNA, 22 nt, Homo sapiens
uucagauugcauaccgaaagua

SEQ ID NO: 175575 - RNA, 20 nt, Homo sapiens
uucagcaaaggaaugggagu

SEQ ID NO: 175576 - RNA, 22 nt, Homo sapiens
uucagcacaguguggaucauuc

SEQ ID NO: 175577 - RNA, 22 nt, Homo sapiens
uucagcacugaaaauaugucau

SEQ ID NO: 175578 - RNA, 22 nt, Homo sapiens
uucaggguggagaguaugaggu

SEQ ID NO: 175579 - RNA, 22 nt, Homo sapiens
uucagguacuauaggcuguugg

SEQ ID NO: 175580 - RNA, 22 nt, Homo sapiens
uucaguaaauguucuuacuaua

SEQ ID NO: 175581 - RNA, 22 nt, Homo sapiens
uucaguggacuuaguagugcuu

SEQ ID NO: 175582 - RNA, 22 nt, Homo sapiens
uucagugucauuaacacaguag

SEQ ID NO: 175583 - RNA, 22 nt, Homo sapiens
uucauagaggacauuacuggag

SEQ ID NO: 175584 - RNA, 22 nt, Homo sapiens
uucaucuggcaauucagagauu

SEQ ID NO: 175585 - RNA, 22 nt, Homo sapiens
uucauggaguugagaaggcuaa

SEQ ID NO: 175586 - RNA, 22 nt, Homo sapiens
uucauggaugcauuugaggggu

SEQ ID NO: 175587 - RNA, 20 nt, Homo sapiens
uucaugggagcaaagaggcc

SEQ ID NO: 175588 - RNA, 22 nt, Homo sapiens
uucauugaaugauuuuuagaag

SEQ ID NO: 175589 - RNA, 22 nt, Homo sapiens
uuccacaauggcugaacuaguu

SEQ ID NO: 175590 - RNA, 22 nt, Homo sapiens
uuccacagggauuugcauugau

SEQ ID NO: 175591 - RNA, 22 nt, Homo sapiens
uuccacaggguugaacuaguuu

SEQ ID NO: 175592 - RNA, 22 nt, Homo sapiens
uuccagaugggaguucuauucu

SEQ ID NO: 175593 - RNA, 20 nt, Homo sapiens
uuccagcacauuagggaagc

SEQ ID NO: 175594 - RNA, 21 nt, Homo sapiens
uuccagugagccuagaugccu

SEQ ID NO: 175595 - RNA, 22 nt, Homo sapiens
uuccaguugugagcuauccggg

SEQ ID NO: 175596 - RNA, 22 nt, Homo sapiens
uuccaguuuuauggguauagag

SEQ ID NO: 175597 - RNA, 22 nt, Homo sapiens
uuccauagucauagugcugaug

SEQ ID NO: 175598 - RNA, 22 nt, Homo sapiens
uuccaugugggcuugucaagua

SEQ ID NO: 175599 - RNA, 22 nt, Homo sapiens
uuccauuuguucggugucgcca

SEQ ID NO: 175600 - RNA, 22 nt, Homo sapiens
uucccucagaaacacacagccc

SEQ ID NO: 175601 - RNA, 22 nt, Homo sapiens
uucccugaaguguuacucuaga

SEQ ID NO: 175602 - RNA, 22 nt, Homo sapiens
uucccugugguauagaagccgu

SEQ ID NO: 175603 - RNA, 22 nt, Homo sapiens
uucccuuucugccuugaaucuu

SEQ ID NO: 175604 - RNA, 22 nt, Homo sapiens
uucccuuugaaacuaaacuugc

SEQ ID NO: 175605 - RNA, 22 nt, Homo sapiens
uuccgcuguaguuguugguacc

SEQ ID NO: 175606 - RNA, 22 nt, Homo sapiens
uuccuacugcccauuaaaaugg

SEQ ID NO: 175607 - RNA, 22 nt, Homo sapiens
uuccuacugugcaaaguugcaa

SEQ ID NO: 175608 - RNA, 22 nt, Homo sapiens
aaaagcuuagaugggcuuguau

SEQ ID NO: 175609 - RNA, 22 nt, Homo sapiens
aaaaggcuagcuaguaacagaa

SEQ ID NO: 175610 - RNA, 22 nt, Homo sapiens
aaacagucuucuccugagggac

SEQ ID NO: 175611 - RNA, 22 nt, Homo sapiens
aaaccaccauuacuuuugcacc

SEQ ID NO: 175612 - RNA, 15 nt, Homo sapiens
aaacccugucucaag

SEQ ID NO: 175613 - RNA, 22 nt, Homo sapiens
aaacugccuuccuuguaggugc

SEQ ID NO: 175614 - RNA, 22 nt, Homo sapiens
aaagagaucuaugggcacuaug

SEQ ID NO: 175615 - RNA, 22 nt, Homo sapiens
aaagcacuggagucaucaucua

SEQ ID NO: 175616 - RNA, 22 nt, Homo sapiens
aaagcuaagguagcauuggaga

SEQ ID NO: 175617 - RNA, 22 nt, Homo sapiens
aaagcuacaggaccugcucauu

SEQ ID NO: 175618 - RNA, 22 nt, Homo sapiens
aaagcugucaaggcaggaggcu

SEQ ID NO: 175619 - RNA, 22 nt, Homo sapiens
aaaggcaucugcucggcucccu

SEQ ID NO: 175620 - RNA, 22 nt, Homo sapiens
aaaggcuucggaucagaaggua

SEQ ID NO: 175621 - RNA, 22 nt, Homo sapiens
aaagggcacugugcuuuggcaa

SEQ ID NO: 175622 - RNA, 22 nt, Homo sapiens
aaaguaauugcaguuuuugcaa

SEQ ID NO: 175623 - RNA, 19 nt, Homo sapiens
aaaguacucugaugccucu

SEQ ID NO: 175624 - RNA, 22 nt, Homo sapiens
aaagugacuuagugccccauuu

SEQ ID NO: 175625 - RNA, 18 nt, Homo sapiens
aaagugaugucauucuuu

SEQ ID NO: 175626 - RNA, 22 nt, Homo sapiens
aaagugcaguauuugggcagaa

SEQ ID NO: 175627 - RNA, 22 nt, Homo sapiens
aaagugcugggaucacacugaa

SEQ ID NO: 175628 - RNA, 22 nt, Homo sapiens
aaagugcugggauuggcugggc

SEQ ID NO: 175629 - RNA, 22 nt, Homo sapiens
aaaguggugugaguauguaucu

SEQ ID NO: 175630 - RNA, 22 nt, Homo sapiens
aaagugucuguuccuagcauga

SEQ ID NO: 175631 - RNA, 22 nt, Homo sapiens
aaaguguguuuccaaccugugg

SEQ ID NO: 175632 - RNA, 19 nt, Homo sapiens
aaaguucuucccuuuggag

SEQ ID NO: 175633 - RNA, 22 nt, Homo sapiens
aaaguucuugcugaaggauuau

SEQ ID NO: 175634 - RNA, 22 nt, Homo sapiens
aaauccaucucuuggggcauug

SEQ ID NO: 175635 - RNA, 22 nt, Homo sapiens
aaaugcacagaaaggaugugga

SEQ ID NO: 175636 - RNA, 22 nt, Homo sapiens
aaaugcaccacucuggugcagg

SEQ ID NO: 175637 - RNA, 22 nt, Homo sapiens
aaaugcacgcuacccagcuaga

SEQ ID NO: 175638 - RNA, 22 nt, Homo sapiens
aaaugcauaucaagauugcccu

SEQ ID NO: 175639 - RNA, 22 nt, Homo sapiens
aaaugcauggacagcuggucuu

SEQ ID NO: 175640 - RNA, 22 nt, Homo sapiens
aaaugcugcuuuggccucuucu

SEQ ID NO: 175641 - RNA, 22 nt, Homo sapiens
aaaugcugucaaauuguguucu

SEQ ID NO: 175642 - RNA, 22 nt, Homo sapiens
aaaugcuguuccaggaccuauc

SEQ ID NO: 175643 - RNA, 22 nt, Homo sapiens
aaauggcacaguaagggcauuu

SEQ ID NO: 175644 - RNA, 22 nt, Homo sapiens
aaauggcuuugaggguaggaca

SEQ ID NO: 175645 - RNA, 22 nt, Homo sapiens
aaaugggacugggguccuuuga

SEQ ID NO: 175646 - RNA, 22 nt, Homo sapiens
aaauuguccuauugguuuaagc

SEQ ID NO: 175647 - RNA, 22 nt, Homo sapiens
aacaccauucucuguaacaaga

SEQ ID NO: 175648 - RNA, 22 nt, Homo sapiens
aacaccuugcagggauuaugac

SEQ ID NO: 175649 - RNA, 22 nt, Homo sapiens
aacacggcccgcagagcaagcu

SEQ ID NO: 175650 - RNA, 22 nt, Homo sapiens
aacacuaucugccuuacaggga

SEQ ID NO: 175651 - RNA, 22 nt, Homo sapiens
aacacuggcugcucgaguucuc

SEQ ID NO: 175652 - RNA, 22 nt, Homo sapiens
aacagcauaguacccgugauaa

SEQ ID NO: 175653 - RNA, 22 nt, Homo sapiens
aacagugccugucauuuaguag

SEQ ID NO: 175654 - RNA, 22 nt, Homo sapiens
aacagugcuucauucacacauu

SEQ ID NO: 175655 - RNA, 22 nt, Homo sapiens
aacccugacacaagcagaauuu

SEQ ID NO: 175656 - RNA, 22 nt, Homo sapiens
aacuaugucaaauaaaaugagg

SEQ ID NO: 175657 - RNA, 22 nt, Homo sapiens
aacugcacuaggacagguuuuu

SEQ ID NO: 175658 - RNA, 22 nt, Homo sapiens
aacuggccuccuugggaaauua

SEQ ID NO: 175659 - RNA, 22 nt, Homo sapiens
aacugguauuucccaugaauuu

SEQ ID NO: 175660 - RNA, 22 nt, Homo sapiens
aacuggucuuuggaggaggagg

SEQ ID NO: 175661 - RNA, 21 nt, Homo sapiens
aacuggugugagaugguaugu

SEQ ID NO: 175662 - RNA, 22 nt, Homo sapiens
aagagaacugacaguaccuggg

SEQ ID NO: 175663 - RNA, 22 nt, Homo sapiens
aagagcauuggauggggagauu

SEQ ID NO: 175664 - RNA, 22 nt, Homo sapiens
aagagccgcaagggugaagggu

SEQ ID NO: 175665 - RNA, 20 nt, Homo sapiens
aagagcucaccagaauaucu

SEQ ID NO: 175666 - RNA, 18 nt, Homo sapiens
aagagcucagcacagguu

SEQ ID NO: 175667 - RNA, 22 nt, Homo sapiens
aaggcaugcaaagaacauuuua

SEQ ID NO: 175668 - RNA, 22 nt, Homo sapiens
aaggcaugcugaguccuaaaag

SEQ ID NO: 175669 - RNA, 22 nt, Homo sapiens
aaggcauggugacuauuuaggc

SEQ ID NO: 175670 - RNA, 22 nt, Homo sapiens
aaggcuagagaagaagggcauc

SEQ ID NO: 175671 - RNA, 22 nt, Homo sapiens
aaggcuauuugagaaugugugu

SEQ ID NO: 175672 - RNA, 22 nt, Homo sapiens
aaggcuguuguguaauaggauu

SEQ ID NO: 175673 - RNA, 22 nt, Homo sapiens
aagggaaugcgcugccuguguu

SEQ ID NO: 175674 - RNA, 22 nt, Homo sapiens
aagggaaugugguagcugguuu

SEQ ID NO: 175675 - RNA, 22 nt, Homo sapiens
aagguaguuagaaaauauaacu

SEQ ID NO: 175676 - RNA, 22 nt, Homo sapiens
aaggugcuguaagcauccaugu

SEQ ID NO: 175677 - RNA, 22 nt, Homo sapiens
aagguggaguugacaauuuuca

SEQ ID NO: 175678 - RNA, 22 nt, Homo sapiens
aaguauuagcuaauugugcuua

SEQ ID NO: 175679 - RNA, 22 nt, Homo sapiens
aaguauuaugaguccuuguuuu

SEQ ID NO: 175680 - RNA, 22 nt, Homo sapiens
aagucacugagacuuguggcug

SEQ ID NO: 175681 - RNA, 22 nt, Homo sapiens
aagucaguuugggagaagcuau

SEQ ID NO: 175682 - RNA, 22 nt, Homo sapiens
aagucaugaagaggaaaggaca

SEQ ID NO: 175683 - RNA, 22 nt, Homo sapiens
aagucauggaggaguaugugag

SEQ ID NO: 175684 - RNA, 22 nt, Homo sapiens
aagugaauguuugguagcagug

SEQ ID NO: 175685 - RNA, 22 nt, Homo sapiens
aagugagaugcaguggaguucc

SEQ ID NO: 175686 - RNA, 22 nt, Homo sapiens
aagugaguaauacgucaguugu

SEQ ID NO: 175687 - RNA, 20 nt, Homo sapiens
aagugaguguuaaacugaac

SEQ ID NO: 175688 - RNA, 22 nt, Homo sapiens
aagugcccuauuuggcccuuga

SEQ ID NO: 175689 - RNA, 22 nt, Homo sapiens
aagugcuguccuaccuuuggga

SEQ ID NO: 175690 - RNA, 22 nt, Homo sapiens
aagugcuuacagggaacaugau

SEQ ID NO: 175691 - RNA, 22 nt, Homo sapiens
aagugcuuaggauagugugugg

SEQ ID NO: 175692 - RNA, 20 nt, Homo sapiens
aagugcuuccuuuuagaggg

SEQ ID NO: 175693 - RNA, 22 nt, Homo sapiens
aagugcuuuguacagggguuga

SEQ ID NO: 175694 - RNA, 22 nt, Homo sapiens
aagugcuuuuuagauaugguuu

SEQ ID NO: 175695 - RNA, 22 nt, Homo sapiens
aagugguucuaugaguuugcaa

SEQ ID NO: 175696 - RNA, 22 nt, Homo sapiens
aagugguuuuuacaaagacaga

SEQ ID NO: 175697 - RNA, 22 nt, Homo sapiens
aagugucuuaccgggagggagu

SEQ ID NO: 175698 - RNA, 22 nt, Homo sapiens
aaguugcuuuagguaagucaau

SEQ ID NO: 175699 - RNA, 22 nt, Homo sapiens
aauaaagccugucucuuuagag

SEQ ID NO: 175700 - RNA, 22 nt, Homo sapiens
aauaaaguaggaggugaggaaa

SEQ ID NO: 175701 - RNA, 22 nt, Homo sapiens
aauaaagucugaagugugcuua

SEQ ID NO: 175702 - RNA, 20 nt, Homo sapiens
aauaacagccccagggaggu

SEQ ID NO: 175703 - RNA, 22 nt, Homo sapiens
aauaagaaguggaagggaccgg

SEQ ID NO: 175704 - RNA, 22 nt, Homo sapiens
aauaagcauaguaccugauagg

SEQ ID NO: 175705 - RNA, 22 nt, Homo sapiens
aauagcauugaaucuaccaauu

SEQ ID NO: 175706 - RNA, 22 nt, Homo sapiens
aauagcuguccuuagaagugug

SEQ ID NO: 175707 - RNA, 22 nt, Homo sapiens
aauagcuguuuuuaauuccugc

SEQ ID NO: 175708 - RNA, 22 nt, Homo sapiens
aauagugcugugcagugagugg

SEQ ID NO: 175709 - RNA, 22 nt, Homo sapiens
aaucacacuugauguugagcaa

SEQ ID NO: 175710 - RNA, 22 nt, Homo sapiens
aaucacuuugcuacaaggcagu

SEQ ID NO: 175711 - RNA, 22 nt, Homo sapiens
aaucagagcccucugagcuuca

SEQ ID NO: 175712 - RNA, 22 nt, Homo sapiens
aaucccuuuguccagucucuuu

SEQ ID NO: 175713 - RNA, 22 nt, Homo sapiens
aaucugucuagacaaggagucu

SEQ ID NO: 175714 - RNA, 22 nt, Homo sapiens
aaugacccugauuggcaaguug

SEQ ID NO: 175715 - RNA, 22 nt, Homo sapiens
aaugacugugauauuuuucuuc

SEQ ID NO: 175716 - RNA, 22 nt, Homo sapiens
aaugauauguuauguuuagguu

SEQ ID NO: 175717 - RNA, 22 nt, Homo sapiens
aaugcacuccagccugggcgac

SEQ ID NO: 175718 - RNA, 22 nt, Homo sapiens
aaugcauaauuuguaugaggua

SEQ ID NO: 175719 - RNA, 22 nt, Homo sapiens
aaugcaucuagaaaggugaauu

SEQ ID NO: 175720 - RNA, 22 nt, Homo sapiens
aauggcaucuacguuaaauguc

SEQ ID NO: 175721 - RNA, 22 nt, Homo sapiens
aauggcuuuuaauauccauaau

SEQ ID NO: 175722 - RNA, 18 nt, Homo sapiens
aaugggacuacaaagcca

SEQ ID NO: 175723 - RNA, 22 nt, Homo sapiens
aaugguguuuccguuaagcuga

SEQ ID NO: 175724 - RNA, 22 nt, Homo sapiens
aaugugcacuauuagggugaua

SEQ ID NO: 175725 - RNA, 22 nt, Homo sapiens
aaugugcuguucagaggagucc

SEQ ID NO: 175726 - RNA, 22 nt, Homo sapiens
aaugugcuucuggcugugguca

SEQ ID NO: 175727 - RNA, 22 nt, Homo sapiens
aaugugcuuucuuucacacagu

SEQ ID NO: 175728 - RNA, 22 nt, Homo sapiens
aaugugcuuugaaaagagcuga

SEQ ID NO: 175729 - RNA, 22 nt, Homo sapiens
aauguguuuugaaaucaggaag

SEQ ID NO: 175730 - RNA, 22 nt, Homo sapiens
aauuaguaaccuaauuccaucu

SEQ ID NO: 175731 - RNA, 22 nt, Homo sapiens
aauuaguuggcugccuaugauu

SEQ ID NO: 175732 - RNA, 22 nt, Homo sapiens
aauugaaugauaugggacauuu

SEQ ID NO: 175733 - RNA, 22 nt, Homo sapiens
aauugaccuaaucugauuacug

SEQ ID NO: 175734 - RNA, 22 nt, Homo sapiens
aauugcaauggacaaugcagca

SEQ ID NO: 175735 - RNA, 22 nt, Homo sapiens
aauugcacuggaaguaacugag

SEQ ID NO: 175736 - RNA, 22 nt, Homo sapiens
aauugcauaugcaguagaucua

SEQ ID NO: 175737 - RNA, 22 nt, Homo sapiens
acaaagcgcuucucuuuagagu

SEQ ID NO: 175738 - RNA, 22 nt, Homo sapiens
acaagcacaaaugcauagaugg

SEQ ID NO: 175739 - RNA, 22 nt, Homo sapiens
acaauguauauuuuacuguagg

SEQ ID NO: 175740 - RNA, 22 nt, Homo sapiens
acacacgugcauguaugcguau

SEQ ID NO: 175741 - RNA, 22 nt, Homo sapiens
acacaguaaauauugucuccuc

SEQ ID NO: 175742 - RNA, 22 nt, Homo sapiens
acacaguguuuauugugguuag

SEQ ID NO: 175743 - RNA, 22 nt, Homo sapiens
acacaugugcguagacucuuua

SEQ ID NO: 175744 - RNA, 22 nt, Homo sapiens
acacauuagcaagugcuguuau

SEQ ID NO: 175745 - RNA, 22 nt, Homo sapiens
acacauuggcaauucuggagca

SEQ ID NO: 175746 - RNA, 22 nt, Homo sapiens
acaccaguacuuuauacaagca

SEQ ID NO: 175747 - RNA, 22 nt, Homo sapiens
augguuuuacugcaaaauggga

SEQ ID NO: 175748 - RNA, 22 nt, Homo sapiens
auguaaacauuuggucuaaauu

SEQ ID NO: 175749 - RNA, 21 nt, Homo sapiens
auguaacugggaaugugagag

SEQ ID NO: 175750 - RNA, 22 nt, Homo sapiens
auguaacugggacacaagccuc

SEQ ID NO: 175751 - RNA, 17 nt, Homo sapiens
auguaauccucaucucu

SEQ ID NO: 175752 - RNA, 21 nt, Homo sapiens
auguaaugaagaagccacugg

SEQ ID NO: 175753 - RNA, 22 nt, Homo sapiens
auguaauugagguuuuugccau

SEQ ID NO: 175754 - RNA, 22 nt, Homo sapiens
auguagauaucaagaggcauau

SEQ ID NO: 175755 - RNA, 22 nt, Homo sapiens
auguaguauuaaugagagauaa

SEQ ID NO: 175756 - RNA, 22 nt, Homo sapiens
auguagugugauuuucacuaga

SEQ ID NO: 175757 - RNA, 22 nt, Homo sapiens
auguauacaugcaggucacagg

SEQ ID NO: 175758 - RNA, 22 nt, Homo sapiens
auguaugagaguuccagcugau

SEQ ID NO: 175759 - RNA, 22 nt, Homo sapiens
augucaacauagacaguagagu

SEQ ID NO: 175760 - RNA, 22 nt, Homo sapiens
augucaaggugggugauaguuu

SEQ ID NO: 175761 - RNA, 20 nt, Homo sapiens
augucagaguguggguacgg

SEQ ID NO: 175762 - RNA, 20 nt, Homo sapiens
augucaggaagggagucagg

SEQ ID NO: 175763 - RNA, 22 nt, Homo sapiens
auguccauggaaucuguagcaa

SEQ ID NO: 175764 - RNA, 22 nt, Homo sapiens
augucuagagcaagagaugcug

SEQ ID NO: 175765 - RNA, 22 nt, Homo sapiens
augucuuucauagagacccaga

SEQ ID NO: 175766 - RNA, 17 nt, Homo sapiens
augugaauguucaaaua

SEQ ID NO: 175767 - RNA, 22 nt, Homo sapiens
augugacagugguuuuaagcgu

SEQ ID NO: 175768 - RNA, 22 nt, Homo sapiens
augugacugauguaaucagaca

SEQ ID NO: 175769 - RNA, 22 nt, Homo sapiens
augugacuugugaaaaguucag

SEQ ID NO: 175770 - RNA, 22 nt, Homo sapiens
augugcaaaguuaagaucccag

SEQ ID NO: 175771 - RNA, 18 nt, Homo sapiens
augugcaauuuuguauuu

SEQ ID NO: 175772 - RNA, 22 nt, Homo sapiens
augugcacaugcuuacauguga

SEQ ID NO: 175773 - RNA, 22 nt, Homo sapiens
augugcagauguuacaaauugu

SEQ ID NO: 175774 - RNA, 22 nt, Homo sapiens
augugccaauuaggauuccaag

SEQ ID NO: 175775 - RNA, 22 nt, Homo sapiens
augugccauucucauggcgcuu

SEQ ID NO: 175776 - RNA, 20 nt, Homo sapiens
augugcuaauauuaauaugu

SEQ ID NO: 175777 - RNA, 22 nt, Homo sapiens
augugcuagguacuguuuagca

SEQ ID NO: 175778 - RNA, 22 nt, Homo sapiens
auguggcauuucucauucauuu

SEQ ID NO: 175779 - RNA, 22 nt, Homo sapiens
auguggcuuuucaacuguguga

SEQ ID NO: 175780 - RNA, 18 nt, Homo sapiens
auguggcuuuugaaggcu

SEQ ID NO: 175781 - RNA, 22 nt, Homo sapiens
augugggaggaauguguuucca

SEQ ID NO: 175782 - RNA, 22 nt, Homo sapiens
augugguaggcccaugagucau

SEQ ID NO: 175783 - RNA, 22 nt, Homo sapiens
augugguaguuauagugauaag

SEQ ID NO: 175784 - RNA, 22 nt, Homo sapiens
auguuauguuaaugauaaugga

SEQ ID NO: 175785 - RNA, 22 nt, Homo sapiens
auguuauguucuucucuguaua

SEQ ID NO: 175786 - RNA, 22 nt, Homo sapiens
auguugcaguuuaauuauccua

SEQ ID NO: 175787 - RNA, 22 nt, Homo sapiens
auguuugguaagaauauuguua

SEQ ID NO: 175788 - RNA, 22 nt, Homo sapiens
auuaaggaguggguucauggug

SEQ ID NO: 175789 - RNA, 23 nt, Homo sapiens
auuaagguuacuacaguaugagg

SEQ ID NO: 175790 - RNA, 22 nt, Homo sapiens
auuaagugcuugcagaagucca

SEQ ID NO: 175791 - RNA, 22 nt, Homo sapiens
auuacacuuucuauucaaugag

SEQ ID NO: 175792 - RNA, 22 nt, Homo sapiens
auuacaugucuauccaugaaca

SEQ ID NO: 175793 - RNA, 22 nt, Homo sapiens
auuagguuggugcaaaacuuuc

SEQ ID NO: 175794 - RNA, 22 nt, Homo sapiens
auuauaugucaucacagacacc

SEQ ID NO: 175795 - RNA, 22 nt, Homo sapiens
auucaaagugcauguucccacu

SEQ ID NO: 175796 - RNA, 22 nt, Homo sapiens
auucaacuaauuauugaagaug

SEQ ID NO: 175797 - RNA, 22 nt, Homo sapiens
ccaaggcacugauucuguacuc

SEQ ID NO: 175798 - RNA, 22 nt, Homo sapiens
ccacacugucuuggugggaaac

SEQ ID NO: 175799 - RNA, 22 nt, Homo sapiens
ccacaguggauuaaaguuacug

SEQ ID NO: 175800 - RNA, 22 nt, Homo sapiens
ccacaguugaaauuuugacugu

SEQ ID NO: 175801 - RNA, 22 nt, Homo sapiens
ccaccgggucccagcucugcuc

SEQ ID NO: 175802 - RNA, 22 nt, Homo sapiens
ccagaguggagccuuugcgagg

SEQ ID NO: 175803 - RNA, 22 nt, Homo sapiens
ccagaguuucugauucagcagg

SEQ ID NO: 175804 - RNA, 22 nt, Homo sapiens
ccagcaccauuuguugaauagg

SEQ ID NO: 175805 - RNA, 22 nt, Homo sapiens
ccaggguuccacgccuggcugu

SEQ ID NO: 175806 - RNA, 22 nt, Homo sapiens
ccaggguugagacccacugacu

SEQ ID NO: 175807 - RNA, 23 nt, Homo sapiens
ccaguauuuauguaaggaagugu

SEQ ID NO: 175808 - RNA, 21 nt, Homo sapiens
ccaguguaaugauagcaggca

SEQ ID NO: 175809 - RNA, 19 nt, Homo sapiens
ccaguguucugauugcacu

SEQ ID NO: 175810 - RNA, 22 nt, Homo sapiens
ccaguuuuuggcaaugaugaau

SEQ ID NO: 175811 - RNA, 22 nt, Homo sapiens
ccaucacaggccucagugggaa

SEQ ID NO: 175812 - RNA, 20 nt, Homo sapiens
ccaucaguccucucuuguuc

SEQ ID NO: 175813 - RNA, 22 nt, Homo sapiens
ccaucccuuucugagcaguucc

SEQ ID NO: 175814 - RNA, 21 nt, Homo sapiens
ccaugggacggaaugaauaca

SEQ ID NO: 175815 - RNA, 22 nt, Homo sapiens
ccauugcacuccagccuaggca

SEQ ID NO: 175816 - RNA, 22 nt, Homo sapiens
ccauugcacuccagccucggca

SEQ ID NO: 175817 - RNA, 22 nt, Homo sapiens
ccauugcacuucagccuaggug

SEQ ID NO: 175818 - RNA, 22 nt, Homo sapiens
ccauuucacucuuccugaagga

SEQ ID NO: 175819 - RNA, 22 nt, Homo sapiens
ccauuugguuauguaucgaaac

SEQ ID NO: 175820 - RNA, 22 nt, Homo sapiens
cccaguaaucuugccaguuuuc

SEQ ID NO: 175821 - RNA, 22 nt, Homo sapiens
cccagugguuacauaaggagua

SEQ ID NO: 175822 - RNA, 22 nt, Homo sapiens
ccccugaaacucacucauuauc

SEQ ID NO: 175823 - RNA, 17 nt, Homo sapiens
ccccugagcgaugcagu

SEQ ID NO: 175824 - RNA, 23 nt, Homo sapiens
cccucagaagugcagggagagaa

SEQ ID NO: 175825 - RNA, 22 nt, Homo sapiens
cccugacauucggagauguagu

SEQ ID NO: 175826 - RNA, 22 nt, Homo sapiens
cccugagagcagggucuuucuc

SEQ ID NO: 175827 - RNA, 22 nt, Homo sapiens
cccugagaugcuguuaaucugu

SEQ ID NO: 175828 - RNA, 22 nt, Homo sapiens
cccugagaugugaauuucagag

SEQ ID NO: 175829 - RNA, 22 nt, Homo sapiens
cccugagcagccugaguuuccc

SEQ ID NO: 175830 - RNA, 21 nt, Homo sapiens
cccugguguuuggaguuugag

SEQ ID NO: 175831 - RNA, 22 nt, Homo sapiens
cccuguguuuagcugaagguuu

SEQ ID NO: 175832 - RNA, 22 nt, Homo sapiens
ccucauggagaaccucugcuag

SEQ ID NO: 175833 - RNA, 22 nt, Homo sapiens
ccucauggagaacuucugcuag

SEQ ID NO: 175834 - RNA, 22 nt, Homo sapiens
ccucuuuguugagacuucacca

SEQ ID NO: 175835 - RNA, 21 nt, Homo sapiens
ccugaagaagugaccucugag

SEQ ID NO: 175836 - RNA, 22 nt, Homo sapiens
ccugagaucauacuguuaguaa

SEQ ID NO: 175837 - RNA, 22 nt, Homo sapiens
ccuggcacugagcaguguucua

SEQ ID NO: 175838 - RNA, 22 nt, Homo sapiens
ccugucuugaagagauccuccu

SEQ ID NO: 175839 - RNA, 22 nt, Homo sapiens
ccuguguuaugguuucuaaugu

SEQ ID NO: 175840 - RNA, 22 nt, Homo sapiens
ccuucuuuuguaaggcugaaua

SEQ ID NO: 175841 - RNA, 22 nt, Homo sapiens
ccuuggcacuuugccacagugc

SEQ ID NO: 175842 - RNA, 22 nt, Homo sapiens
ccuugguaauguguuuuauucu

SEQ ID NO: 175843 - RNA, 19 nt, Homo sapiens
ccuuugguuuccaugacau

SEQ ID NO: 175844 - RNA, 22 nt, Homo sapiens
ccuuuguuaguuugcugagaau

SEQ ID NO: 175845 - RNA, 22 nt, Homo sapiens
ccuuuuugaguugccagaguuc

SEQ ID NO: 175846 - RNA, 22 nt, Homo sapiens
cggucacagugauucaaggguc

SEQ ID NO: 175847 - RNA, 22 nt, Homo sapiens
cggugcaaauguaauugcaguu

SEQ ID NO: 175848 - RNA, 22 nt, Homo sapiens
cgugaggaaaacagaggguguu

SEQ ID NO: 175849 - RNA, 22 nt, Homo sapiens
cuaaaugucucuacuaaguuua

SEQ ID NO: 175850 - RNA, 18 nt, Homo sapiens
cuaagacacuuggcagag

SEQ ID NO: 175851 - RNA, 21 nt, Homo sapiens
cuaaggaaagcuaugaacccu

SEQ ID NO: 175852 - RNA, 17 nt, Homo sapiens
cuaaggcaagagucugc

SEQ ID NO: 175853 - RNA, 22 nt, Homo sapiens
cuaagggaggaagcugugcagg

SEQ ID NO: 175854 - RNA, 22 nt, Homo sapiens
cuaagugaacugucacugagaa

SEQ ID NO: 175855 - RNA, 20 nt, Homo sapiens
cuaaucaucccagaagaaau

SEQ ID NO: 175856 - RNA, 22 nt, Homo sapiens
cuaauccugugguagcacucaa

SEQ ID NO: 175857 - RNA, 21 nt, Homo sapiens
cuaaucucacccuuuucuggg

SEQ ID NO: 175858 - RNA, 22 nt, Homo sapiens
cuaauucuguaccuggcacaua

SEQ ID NO: 175859 - RNA, 22 nt, Homo sapiens
cuacacaugcaggcucccugcc

SEQ ID NO: 175860 - RNA, 22 nt, Homo sapiens
cuagaggcacagccuaggcacu

SEQ ID NO: 175861 - RNA, 22 nt, Homo sapiens
cuagcagacacuuccagagagu

SEQ ID NO: 175862 - RNA, 22 nt, Homo sapiens
cuagcagacaugggcugaacca

SEQ ID NO: 175863 - RNA, 22 nt, Homo sapiens
cuagcuuuugauguaaagugag

SEQ ID NO: 175864 - RNA, 22 nt, Homo sapiens
cuaggcuguagagaaguucagu

SEQ ID NO: 175865 - RNA, 22 nt, Homo sapiens
cuagguuauacucugaaauggu

SEQ ID NO: 175866 - RNA, 22 nt, Homo sapiens
cuauauacugccugcugauuag

SEQ ID NO: 175867 - RNA, 22 nt, Homo sapiens
cuauggcucugucuuuuaaguu

SEQ ID NO: 175868 - RNA, 22 nt, Homo sapiens
cuauggcuguaaggauaguaac

SEQ ID NO: 175869 - RNA, 22 nt, Homo sapiens
cuauguaccuggaacuguauua

SEQ ID NO: 175870 - RNA, 19 nt, Homo sapiens
cuauugcacauagcugaag

SEQ ID NO: 175871 - RNA, 21 nt, Homo sapiens
cucaaaguacugauauuacag

SEQ ID NO: 175872 - RNA, 22 nt, Homo sapiens
cucaaagucaagggaaagcagg

SEQ ID NO: 175873 - RNA, 22 nt, Homo sapiens
cucaaagugcuaagauuaggcu

SEQ ID NO: 175874 - RNA, 22 nt, Homo sapiens
cucaaagugcugggacuggcug

SEQ ID NO: 175875 - RNA, 19 nt, Homo sapiens
cucaaagugguauuuggag

SEQ ID NO: 175876 - RNA, 22 nt, Homo sapiens
cucaaaguguggucuguggguu

SEQ ID NO: 175877 - RNA, 18 nt, Homo sapiens
cucaaccucaugcagggc

SEQ ID NO: 175878 - RNA, 22 nt, Homo sapiens
cucaaguaauccucccgccuug

SEQ ID NO: 175879 - RNA, 20 nt, Homo sapiens
cucacagacagcuucuuucu

SEQ ID NO: 175880 - RNA, 18 nt, Homo sapiens
cucacaguaacuuuuaag

SEQ ID NO: 175881 - RNA, 22 nt, Homo sapiens
cucacagucagaagggacuugc

SEQ ID NO: 175882 - RNA, 20 nt, Homo sapiens
cucaccagguguaggcugag

SEQ ID NO: 175883 - RNA, 22 nt, Homo sapiens
cucacugugguguccuuaggua

SEQ ID NO: 175884 - RNA, 20 nt, Homo sapiens
cucagauuauucugaagcaa

SEQ ID NO: 175885 - RNA, 22 nt, Homo sapiens
cucagcuacuugggaagcugag

SEQ ID NO: 175886 - RNA, 22 nt, Homo sapiens
cucaggguacuucuccuuugcu

SEQ ID NO: 175887 - RNA, 20 nt, Homo sapiens
cucagguauuugaggcugca

SEQ ID NO: 175888 - RNA, 22 nt, Homo sapiens
cucaguggauuagauaaugcac

SEQ ID NO: 175889 - RNA, 22 nt, Homo sapiens
cucagugucuggggccccaggg

SEQ ID NO: 175890 - RNA, 22 nt, Homo sapiens
cucaguuuugccuuguuuaagg

SEQ ID NO: 175891 - RNA, 21 nt, Homo sapiens
cucauauugcuuuuccauggu

SEQ ID NO: 175892 - RNA, 22 nt, Homo sapiens
cucauggagaacaucugcuagg

SEQ ID NO: 175893 - RNA, 22 nt, Homo sapiens
cucauggagaaccucugcuagg

SEQ ID NO: 175894 - RNA, 19 nt, Homo sapiens
cucauggagaaggagaaua

SEQ ID NO: 175895 - RNA, 22 nt, Homo sapiens
cucauugcaaucucugccuccc

SEQ ID NO: 175896 - RNA, 22 nt, Homo sapiens
cuccagugcaaagucaugauca

SEQ ID NO: 175897 - RNA, 22 nt, Homo sapiens
cuccaguuucagaaucccaugu

SEQ ID NO: 175898 - RNA, 22 nt, Homo sapiens
cuccauagucuucgaagaauga

SEQ ID NO: 175899 - RNA, 22 nt, Homo sapiens
cuccauguggcuaacuuuuaaa

SEQ ID NO: 175900 - RNA, 22 nt, Homo sapiens
cuccauuuggaacagauguccu

SEQ ID NO: 175901 - RNA, 22 nt, Homo sapiens
cucccacccucauuuuuaggca

SEQ ID NO: 175902 - RNA, 22 nt, Homo sapiens
cucccauugcaaacaacagaag

SEQ ID NO: 175903 - RNA, 20 nt, Homo sapiens
cucccugacaaauguggaaa

SEQ ID NO: 175904 - RNA, 22 nt, Homo sapiens
cucccugagccagggcuuugac

SEQ ID NO: 175905 - RNA, 22 nt, Homo sapiens
cuccuugauuagaguauagagu

SEQ ID NO: 175906 - RNA, 22 nt, Homo sapiens
cucgcuccauuucggugaucaa

SEQ ID NO: 175907 - RNA, 22 nt, Homo sapiens
uaaagcuuagauccaugguggc

SEQ ID NO: 175908 - RNA, 21 nt, Homo sapiens
uaaagcuuagcuauaguggcu

SEQ ID NO: 175909 - RNA, 22 nt, Homo sapiens
uaaagcuuggauuuaggcuaau

SEQ ID NO: 175910 - RNA, 22 nt, Homo sapiens
uaaaguuauugccccucaguua

SEQ ID NO: 175911 - RNA, 22 nt, Homo sapiens
uaaauugcauaaguacaaauga

SEQ ID NO: 175912 - RNA, 22 nt, Homo sapiens
uaacaaugucuuaugggcuuaa

SEQ ID NO: 175913 - RNA, 16 nt, Homo sapiens
uaacacaguucccacc

SEQ ID NO: 175914 - RNA, 22 nt, Homo sapiens
uaacacccuucuccagguacau

SEQ ID NO: 175915 - RNA, 22 nt, Homo sapiens
uaacaggcaaggucacaccuug

SEQ ID NO: 175916 - RNA, 22 nt, Homo sapiens
uaacaguauaugugguaucuau

SEQ ID NO: 175917 - RNA, 23 nt, Homo sapiens
uaacauguuuuuaagggaagcuu

SEQ ID NO: 175918 - RNA, 22 nt, Homo sapiens
uaacauugucuugcuuaguuuu

SEQ ID NO: 175919 - RNA, 22 nt, Homo sapiens
uaacccagugucugugaugggu

SEQ ID NO: 175920 - RNA, 22 nt, Homo sapiens
uaacuauagagaauguugagua

SEQ ID NO: 175921 - RNA, 22 nt, Homo sapiens
uaacuguggaaaugacuuuaaa

SEQ ID NO: 175922 - RNA, 22 nt, Homo sapiens
uaacuucaucauaagucaagaa

SEQ ID NO: 175923 - RNA, 22 nt, Homo sapiens
uaagacacauguguucccaggc

SEQ ID NO: 175924 - RNA, 22 nt, Homo sapiens
uaagacacuuaaaauguuacau

SEQ ID NO: 175925 - RNA, 22 nt, Homo sapiens
uaagacuguguaauuuaugaag

SEQ ID NO: 175926 - RNA, 22 nt, Homo sapiens
uaagacuguuggcaauuuuugc

SEQ ID NO: 175927 - RNA, 22 nt, Homo sapiens
uaagagagcuccaucuuuuccu

SEQ ID NO: 175928 - RNA, 21 nt, Homo sapiens
uaagcuaaacauucaguuaac

SEQ ID NO: 175929 - RNA, 22 nt, Homo sapiens
uaagcuaauguguuuucucuua

SEQ ID NO: 175930 - RNA, 22 nt, Homo sapiens
uaaggaguagaauaguaaggca

SEQ ID NO: 175931 - RNA, 18 nt, Homo sapiens
uaaggcacuauaggcauu

SEQ ID NO: 175932 - RNA, 22 nt, Homo sapiens
uaaggcuucuuggaauacugca

SEQ ID NO: 175933 - RNA, 22 nt, Homo sapiens
uaaggcuugcuucagucuugaa

SEQ ID NO: 175934 - RNA, 22 nt, Homo sapiens
uaaggcuuugcuggacucaguc

SEQ ID NO: 175935 - RNA, 22 nt, Homo sapiens
uaaggcuuugucuuaggacuuu

SEQ ID NO: 175936 - RNA, 22 nt, Homo sapiens
uaaggcuuuuguucagcguggg

SEQ ID NO: 175937 - RNA, 22 nt, Homo sapiens
uaagggacauguguugccuaag

SEQ ID NO: 175938 - RNA, 22 nt, Homo sapiens
uaagggacgcccccuucucucu

SEQ ID NO: 175939 - RNA, 22 nt, Homo sapiens
uaagguccuuaaauguguaacc

SEQ ID NO: 175940 - RNA, 22 nt, Homo sapiens
uaagguuuuugauaugcugcug

SEQ ID NO: 175941 - RNA, 22 nt, Homo sapiens
uaaguaauugugguuucugcca

SEQ ID NO: 175942 - RNA, 22 nt, Homo sapiens
uaaguaauuguuaauagggaag

SEQ ID NO: 175943 - RNA, 22 nt, Homo sapiens
uaagucguggaugauucuucgg

SEQ ID NO: 175944 - RNA, 22 nt, Homo sapiens
uaagugaauuugacagguaaug

SEQ ID NO: 175945 - RNA, 22 nt, Homo sapiens
uaagugacuuugagauuccuca

SEQ ID NO: 175946 - RNA, 22 nt, Homo sapiens
uaagugaugucuuuuugugugc

SEQ ID NO: 175947 - RNA, 20 nt, Homo sapiens
uaagugcuuuauauugauua

SEQ ID NO: 175948 - RNA, 23 nt, Homo sapiens
uaaguucaucucuaauaggugga

SEQ ID NO: 175949 - RNA, 22 nt, Homo sapiens
uaaguuguagaacguuuucuua

SEQ ID NO: 175950 - RNA, 22 nt, Homo sapiens
uaauacuguaauggugguuccg

SEQ ID NO: 175951 - RNA, 22 nt, Homo sapiens
uaauaguguuaaugcuagagcu

SEQ ID NO: 175952 - RNA, 22 nt, Homo sapiens
uaaugcuguggucuaaugggga

SEQ ID NO: 175953 - RNA, 22 nt, Homo sapiens
uaaugcuguggucugguuuaaa

SEQ ID NO: 175954 - RNA, 22 nt, Homo sapiens
uaaugugcuucucuaccauagg

SEQ ID NO: 175955 - RNA, 22 nt, Homo sapiens
uaauucacauaaagcacuuaga

SEQ ID NO: 175956 - RNA, 22 nt, Homo sapiens
uaauucugacaacaguggcguu

SEQ ID NO: 175957 - RNA, 22 nt, Homo sapiens
uaauucuguauguaucagaguu

SEQ ID NO: 175958 - RNA, 22 nt, Homo sapiens
uaauugaaugcagacaccaggg

SEQ ID NO: 175959 - RNA, 22 nt, Homo sapiens
uaauuggaucucaaaaaagugu

SEQ ID NO: 175960 - RNA, 22 nt, Homo sapiens
uacaacacugguucgacaugug

SEQ ID NO: 175961 - RNA, 22 nt, Homo sapiens
uacaagcacaggcagcaggcug

SEQ ID NO: 175962 - RNA, 22 nt, Homo sapiens
uacaagcuaaaauggaagauca

SEQ ID NO: 175963 - RNA, 16 nt, Homo sapiens
uacaauguagaaaaca

SEQ ID NO: 175964 - RNA, 22 nt, Homo sapiens
uacaccugcacucuagccuggg

SEQ ID NO: 175965 - RNA, 18 nt, Homo sapiens
uacagaacuggaguagaa

SEQ ID NO: 175966 - RNA, 22 nt, Homo sapiens
uacagaguauccauuugaguuc

SEQ ID NO: 175967 - RNA, 23 nt, Homo sapiens
uacagcugcagaaucaggcuaag

SEQ ID NO: 175968 - RNA, 22 nt, Homo sapiens
uacaggacuucucagaguuauu

SEQ ID NO: 175969 - RNA, 22 nt, Homo sapiens
uacagugcuuuuugguggagaa

SEQ ID NO: 175970 - RNA, 22 nt, Homo sapiens
uacaguggugugaucucagcuc

SEQ ID NO: 175971 - RNA, 22 nt, Homo sapiens
uacauacuguaugguucuguuu

SEQ ID NO: 175972 - RNA, 20 nt, Homo sapiens
uacauaguaaacugagagca

SEQ ID NO: 175973 - RNA, 22 nt, Homo sapiens
uacaugcaugggcaugugugca

SEQ ID NO: 175974 - RNA, 22 nt, Homo sapiens
uacauguauacaggguuuacuu

SEQ ID NO: 175975 - RNA, 22 nt, Homo sapiens
uacauguauguguuuauggcug

SEQ ID NO: 175976 - RNA, 22 nt, Homo sapiens
uacaugugcacaacgugcaggu

SEQ ID NO: 175977 - RNA, 22 nt, Homo sapiens
uaccacagucauuacacuugua

SEQ ID NO: 175978 - RNA, 23 nt, Homo sapiens
uaccacauuccuucuuuccuguu

SEQ ID NO: 175979 - RNA, 22 nt, Homo sapiens
uaccaccauuguaguuuggaaa

SEQ ID NO: 175980 - RNA, 22 nt, Homo sapiens
uaccagcauuucucuuuaagua

SEQ ID NO: 175981 - RNA, 22 nt, Homo sapiens
uaccauguauguuucuccauug

SEQ ID NO: 175982 - RNA, 22 nt, Homo sapiens
uacccgucuacuuugaacaaaa

SEQ ID NO: 175983 - RNA, 22 nt, Homo sapiens
uacccuguaaucugaaacauga

SEQ ID NO: 175984 - RNA, 22 nt, Homo sapiens
uaccugagucuagagucuagaa

SEQ ID NO: 175985 - RNA, 22 nt, Homo sapiens
uaccuguagacuacagcuucag

SEQ ID NO: 175986 - RNA, 23 nt, Homo sapiens
uacuacacuuuucccaagguuuu

SEQ ID NO: 175987 - RNA, 22 nt, Homo sapiens
uacucaguagacacucauaugu

SEQ ID NO: 175988 - RNA, 22 nt, Homo sapiens
uacuccccuuguucugugagcu

SEQ ID NO: 175989 - RNA, 22 nt, Homo sapiens
uacucugcagccauaaaacaga

SEQ ID NO: 175990 - RNA, 22 nt, Homo sapiens
uacucuuuagcuccuuaaggaa

SEQ ID NO: 175991 - RNA, 22 nt, Homo sapiens
uacugaccugucauucagaguu

SEQ ID NO: 175992 - RNA, 19 nt, Homo sapiens
uacugcaccucaaccuggg

SEQ ID NO: 175993 - RNA, 18 nt, Homo sapiens
uacugcacucuccagccu

SEQ ID NO: 175994 - RNA, 22 nt, Homo sapiens
uacugcacuggaggccucagau

SEQ ID NO: 175995 - RNA, 22 nt, Homo sapiens
uacugcacuugaccuccugggc

SEQ ID NO: 175996 - RNA, 20 nt, Homo sapiens
uacugcacuuuccucauggu

SEQ ID NO: 175997 - RNA, 22 nt, Homo sapiens
uacugcaucgaaaugcuuuuau

SEQ ID NO: 175998 - RNA, 22 nt, Homo sapiens
uacugcauuucacuguuaaaga

SEQ ID NO: 175999 - RNA, 22 nt, Homo sapiens
uacugguuuuauauauuucucc

SEQ ID NO: 176000 - RNA, 22 nt, Homo sapiens
uacuuagagacaugcagcacug

SEQ ID NO: 176001 - RNA, 22 nt, Homo sapiens
uacuucauucuugaccuugcau

SEQ ID NO: 176002 - RNA, 22 nt, Homo sapiens
uagaacaauugcuggauccgaa

SEQ ID NO: 176003 - RNA, 22 nt, Homo sapiens
uagaagcuacucuucuuguggc

SEQ ID NO: 176004 - RNA, 22 nt, Homo sapiens
uagaaugaaacaagcugugccu

SEQ ID NO: 176005 - RNA, 22 nt, Homo sapiens
uagaauggaaggcauguuugcc

SEQ ID NO: 176006 - RNA, 22 nt, Homo sapiens
uagaauguaacaguuaaaagca

SEQ ID NO: 176007 - RNA, 22 nt, Homo sapiens
uagaauguauaauauuuuacuu

SEQ ID NO: 176008 - RNA, 22 nt, Homo sapiens
uagacaacugaaacacugugca

SEQ ID NO: 176009 - RNA, 22 nt, Homo sapiens
uagaccauucuauuuccuaugc

SEQ ID NO: 176010 - RNA, 20 nt, Homo sapiens
uagagagauauggggguucc

SEQ ID NO: 176011 - RNA, 22 nt, Homo sapiens
uagagauaucaauuucauggug

SEQ ID NO: 176012 - RNA, 22 nt, Homo sapiens
uagagaucuuauauuuuaugac

SEQ ID NO: 176013 - RNA, 18 nt, Homo sapiens
uagagcacaagcuuuggc

SEQ ID NO: 176014 - RNA, 22 nt, Homo sapiens
uagagcaugugccauacguaca

SEQ ID NO: 176015 - RNA, 22 nt, Homo sapiens
uagagcuacagcccucacuguc

SEQ ID NO: 176016 - RNA, 22 nt, Homo sapiens
uagagcuugacacuuuccaugg

SEQ ID NO: 176017 - RNA, 22 nt, Homo sapiens
gucuguuuggggaccuguggcc

SEQ ID NO: 176018 - RNA, 22 nt, Homo sapiens
gucuuccagccuccaucuuucu

SEQ ID NO: 176019 - RNA, 22 nt, Homo sapiens
gucuuugaugucuaugugcuuc

SEQ ID NO: 176020 - RNA, 22 nt, Homo sapiens
gucuuugcuuuuaaccagaggu

SEQ ID NO: 176021 - RNA, 17 nt, Homo sapiens
gucuuugguugaguuua

SEQ ID NO: 176022 - RNA, 22 nt, Homo sapiens
gugaaagcaucugacugugcca

SEQ ID NO: 176023 - RNA, 22 nt, Homo sapiens
gugaaauacauaaucccaagug

SEQ ID NO: 176024 - RNA, 17 nt, Homo sapiens
gugaaaucaucauuuuu

SEQ ID NO: 176025 - RNA, 22 nt, Homo sapiens
gugaaauguguagaggaucugg

SEQ ID NO: 176026 - RNA, 22 nt, Homo sapiens
gugaacuguuugaggaagagaa

SEQ ID NO: 176027 - RNA, 22 nt, Homo sapiens
gugaagugugaccucagcaucu

SEQ ID NO: 176028 - RNA, 22 nt, Homo sapiens
gugaaucauaugccagucaugc

SEQ ID NO: 176029 - RNA, 22 nt, Homo sapiens
gugacaucagcuccagguauaa

SEQ ID NO: 176030 - RNA, 22 nt, Homo sapiens
gugaccaaagauagcucaaguu

SEQ ID NO: 176031 - RNA, 22 nt, Homo sapiens
gugacuacaggccacaguuugg

SEQ ID NO: 176032 - RNA, 22 nt, Homo sapiens
gugagaacugugucuuauaaac

SEQ ID NO: 176033 - RNA, 22 nt, Homo sapiens
gugagaagaaaaauauggcugu

SEQ ID NO: 176034 - RNA, 22 nt, Homo sapiens
gugagaaucaaacuacauaaau

SEQ ID NO: 176035 - RNA, 22 nt, Homo sapiens
gugagaauugacacccuugucu

SEQ ID NO: 176036 - RNA, 22 nt, Homo sapiens
gugagacugaguuucgcucuug

SEQ ID NO: 176037 - RNA, 22 nt, Homo sapiens
gugagaugauggguauguuaau

SEQ ID NO: 176038 - RNA, 22 nt, Homo sapiens
gugagauggaguuggugucuuu

SEQ ID NO: 176039 - RNA, 19 nt, Homo sapiens
gugagcaaugcauugcacu

SEQ ID NO: 176040 - RNA, 22 nt, Homo sapiens
gugagcagagaucgcgugauug

SEQ ID NO: 176041 - RNA, 22 nt, Homo sapiens
gugagcauauuaguauugcacu

SEQ ID NO: 176042 - RNA, 21 nt, Homo sapiens
gugaggaguuacuggcuuuga

SEQ ID NO: 176043 - RNA, 22 nt, Homo sapiens
gugaggcugguccugccuccca

SEQ ID NO: 176044 - RNA, 20 nt, Homo sapiens
gugagguagaggguuaccug

SEQ ID NO: 176045 - RNA, 22 nt, Homo sapiens
gugaggucagggcuguggacag

SEQ ID NO: 176046 - RNA, 22 nt, Homo sapiens
gugagguguuaaccaaccugug

SEQ ID NO: 176047 - RNA, 22 nt, Homo sapiens
gugaucucagcucacuggaacc

SEQ ID NO: 176048 - RNA, 22 nt, Homo sapiens
gugaucuuucaggcuugaccau

SEQ ID NO: 176049 - RNA, 22 nt, Homo sapiens
gugcaacaugccuggcuaauuu

SEQ ID NO: 176050 - RNA, 21 nt, Homo sapiens
gugcaacucccucucccuaca

SEQ ID NO: 176051 - RNA, 22 nt, Homo sapiens
gugcaauucacuguuaugucug

SEQ ID NO: 176052 - RNA, 22 nt, Homo sapiens
gugcacaaaucuuaaauguaca

SEQ ID NO: 176053 - RNA, 22 nt, Homo sapiens
gugcacaacgugcagguuaguu

SEQ ID NO: 176054 - RNA, 21 nt, Homo sapiens
gugcacaguaguguuuaauag

SEQ ID NO: 176055 - RNA, 22 nt, Homo sapiens
gugcacaugcgugcgcacauau

SEQ ID NO: 176056 - RNA, 21 nt, Homo sapiens
gugcagaugccacagucacuc

SEQ ID NO: 176057 - RNA, 22 nt, Homo sapiens
gugcagugugauccuuccguau

SEQ ID NO: 176058 - RNA, 22 nt, Homo sapiens
gugcaguuugaaaguagaaaca

SEQ ID NO: 176059 - RNA, 22 nt, Homo sapiens
gugccacugcacuccggccugg

SEQ ID NO: 176060 - RNA, 22 nt, Homo sapiens
gugcccacugucuguccuguag

SEQ ID NO: 176061 - RNA, 22 nt, Homo sapiens
gugccuuuucugagcaaugagc

SEQ ID NO: 176062 - RNA, 21 nt, Homo sapiens
gugcuuguagccucacuucug

SEQ ID NO: 176063 - RNA, 22 nt, Homo sapiens
gugcuuuguuguggcaguggca

SEQ ID NO: 176064 - RNA, 22 nt, Homo sapiens
guggaaaacauaugcuuguuga

SEQ ID NO: 176065 - RNA, 22 nt, Homo sapiens
guggaagcacaggccuccugga

SEQ ID NO: 176066 - RNA, 22 nt, Homo sapiens
guggaaggucaugaauguucuu

SEQ ID NO: 176067 - RNA, 22 nt, Homo sapiens
guggaguacugagggucacuua

SEQ ID NO: 176068 - RNA, 22 nt, Homo sapiens
guggagucaucacucagagugg

SEQ ID NO: 176069 - RNA, 18 nt, Homo sapiens
guggagugucuuccugga

SEQ ID NO: 176070 - RNA, 22 nt, Homo sapiens
guggaucacuugaggucaagag

SEQ ID NO: 176071 - RNA, 22 nt, Homo sapiens
guggcagaaaagagaagcaaug

SEQ ID NO: 176072 - RNA, 22 nt, Homo sapiens
guggcagaacagguaggguucu

SEQ ID NO: 176073 - RNA, 22 nt, Homo sapiens
guggcaguuuuaaauaugaaaa

SEQ ID NO: 176074 - RNA, 22 nt, Homo sapiens
guggcaugaaagcagauaccac

SEQ ID NO: 176075 - RNA, 22 nt, Homo sapiens
guggcuauucaccuuuaugaaa

SEQ ID NO: 176076 - RNA, 22 nt, Homo sapiens
gugggauggaaaugggcuucag

SEQ ID NO: 176077 - RNA, 22 nt, Homo sapiens
gugguucuagaauugaguaucc

SEQ ID NO: 176078 - RNA, 22 nt, Homo sapiens
gugguucuagagggacagaaug

SEQ ID NO: 176079 - RNA, 20 nt, Homo sapiens
guguaagagcaagcuuccua

SEQ ID NO: 176080 - RNA, 22 nt, Homo sapiens
guguaauaaucguggacuaugu

SEQ ID NO: 176081 - RNA, 22 nt, Homo sapiens
guguagagaaaaguaccauuuu

SEQ ID NO: 176082 - RNA, 22 nt, Homo sapiens
guguauucaucuggcugaggua

SEQ ID NO: 176083 - RNA, 22 nt, Homo sapiens
gugucaaggaugccugucaggc

SEQ ID NO: 176084 - RNA, 22 nt, Homo sapiens
gugucacagcuuccaucucggu

SEQ ID NO: 176085 - RNA, 22 nt, Homo sapiens
gugucaguggggagugaucuuc

SEQ ID NO: 176086 - RNA, 22 nt, Homo sapiens
gugucaugaagguuuuaugcag

SEQ ID NO: 176087 - RNA, 22 nt, Homo sapiens
guguccucgaguacacaucagg

SEQ ID NO: 176088 - RNA, 22 nt, Homo sapiens
gugugaacaucauagaguguau

SEQ ID NO: 176089 - RNA, 22 nt, Homo sapiens
gugugacugcucuauuagggcg

SEQ ID NO: 176090 - RNA, 22 nt, Homo sapiens
gugugauggcgcacacagggug

SEQ ID NO: 176091 - RNA, 22 nt, Homo sapiens
gugugauuguuaauuuuaggug

SEQ ID NO: 176092 - RNA, 19 nt, Homo sapiens
gugugcauaucacagagca

SEQ ID NO: 176093 - RNA, 21 nt, Homo sapiens
gugugcuugaauucagcuguc

SEQ ID NO: 176094 - RNA, 21 nt, Homo sapiens
gugugcuugagugaugggauu

SEQ ID NO: 176095 - RNA, 22 nt, Homo sapiens
guuaaagacauccacauaggag

SEQ ID NO: 176096 - RNA, 22 nt, Homo sapiens
guuauguaucuugauugggugg

SEQ ID NO: 176097 - RNA, 22 nt, Homo sapiens
guuauugcucucgaagacucuc

SEQ ID NO: 176098 - RNA, 22 nt, Homo sapiens
guuauuguccauuuauuuagca

SEQ ID NO: 176099 - RNA, 21 nt, Homo sapiens
guucaagugauccuccugucu

SEQ ID NO: 176100 - RNA, 22 nt, Homo sapiens
guucacagugguugccuuccag

SEQ ID NO: 176101 - RNA, 22 nt, Homo sapiens
guucacaguucagccuguaaca

SEQ ID NO: 176102 - RNA, 22 nt, Homo sapiens
guucacucuggagaauauugac

SEQ ID NO: 176103 - RNA, 22 nt, Homo sapiens
guucaguuuugaaauguuaauu

SEQ ID NO: 176104 - RNA, 20 nt, Homo sapiens
guucccuguaggugugcgga

SEQ ID NO: 176105 - RNA, 22 nt, Homo sapiens
guucucacuggacugugaaaau

SEQ ID NO: 176106 - RNA, 20 nt, Homo sapiens
guucuugcucguguaucuuc

SEQ ID NO: 176107 - RNA, 22 nt, Homo sapiens
guugacuaggagcuacuacuac

SEQ ID NO: 176108 - RNA, 22 nt, Homo sapiens
guugaguuugaccugaacucug

SEQ ID NO: 176109 - RNA, 22 nt, Homo sapiens
guugcacagucuuuccuggacu

SEQ ID NO: 176110 - RNA, 22 nt, Homo sapiens
guugcccuuagcacuucagccu

SEQ ID NO: 176111 - RNA, 22 nt, Homo sapiens
guuggaauguauugcuacuucu

SEQ ID NO: 176112 - RNA, 22 nt, Homo sapiens
guuggcaaguggcugagcuggg

SEQ ID NO: 176113 - RNA, 22 nt, Homo sapiens
guuuaacugguacuucaagucu

SEQ ID NO: 176114 - RNA, 22 nt, Homo sapiens
guuuaggaaugagaauauuuag

SEQ ID NO: 176115 - RNA, 22 nt, Homo sapiens
guuuggcucuuguuucugucaa

SEQ ID NO: 176116 - RNA, 15 nt, Homo sapiens
guuuuuggauacaau

SEQ ID NO: 176117 - RNA, 22 nt, Homo sapiens
guuuuuggggucacuauuaccg

SEQ ID NO: 176118 - RNA, 21 nt, Homo sapiens
uaaaacuguaacuuuguccug

SEQ ID NO: 176119 - RNA, 22 nt, Homo sapiens
uaaacacucacuucauagccau

SEQ ID NO: 176120 - RNA, 22 nt, Homo sapiens
uaaaccacguuuacauuugaga

SEQ ID NO: 176121 - RNA, 22 nt, Homo sapiens
uaaaccuagcauuuugcauaug

SEQ ID NO: 176122 - RNA, 22 nt, Homo sapiens
uaaagcacaaguaaagaauacu

SEQ ID NO: 176123 - RNA, 22 nt, Homo sapiens
uaaagccagugauuaugucucu

SEQ ID NO: 176124 - RNA, 22 nt, Homo sapiens
uaaagccuagaacuuucagccc

SEQ ID NO: 176125 - RNA, 22 nt, Homo sapiens
uaaagcgaggucuccuacaaga

SEQ ID NO: 176126 - RNA, 22 nt, Homo sapiens
uaaagcuacagagcggaaaauu

SEQ ID NO: 176127 - RNA, 22 nt, Homo sapiens
cucucaagaugcugggauuaca

SEQ ID NO: 176128 - RNA, 21 nt, Homo sapiens
cucucugcuuaugaauaguga

SEQ ID NO: 176129 - RNA, 17 nt, Homo sapiens
cucucugguuuaaagca

SEQ ID NO: 176130 - RNA, 22 nt, Homo sapiens
cucugacagugguuagcacugu

SEQ ID NO: 176131 - RNA, 22 nt, Homo sapiens
cucugagguuauucguaauauu

SEQ ID NO: 176132 - RNA, 22 nt, Homo sapiens
cucuuuaguaagcaguugauga

SEQ ID NO: 176133 - RNA, 22 nt, Homo sapiens
cucuuuuguuccuaguuugauc

SEQ ID NO: 176134 - RNA, 22 nt, Homo sapiens
cugaaagagcauuugaaugggu

SEQ ID NO: 176135 - RNA, 22 nt, Homo sapiens
cugaaaugaauuauuuucuuuc

SEQ ID NO: 176136 - RNA, 22 nt, Homo sapiens
cugaauagucaacgauggacug

SEQ ID NO: 176137 - RNA, 22 nt, Homo sapiens
cugaaucauugcauuaucaagg

SEQ ID NO: 176138 - RNA, 22 nt, Homo sapiens
cugaauguuuucuucuauucug

SEQ ID NO: 176139 - RNA, 22 nt, Homo sapiens
cugacauggggauccaccuuag

SEQ ID NO: 176140 - RNA, 22 nt, Homo sapiens
cugaccauagacuacucugggc

SEQ ID NO: 176141 - RNA, 17 nt, Homo sapiens
cugaccucauuguguac

SEQ ID NO: 176142 - RNA, 22 nt, Homo sapiens
cugacguguuuuccagaccuuu

SEQ ID NO: 176143 - RNA, 22 nt, Homo sapiens
cugagacuggguaauguauaaa

SEQ ID NO: 176144 - RNA, 22 nt, Homo sapiens
cugagauaggacucugcuggcu

SEQ ID NO: 176145 - RNA, 22 nt, Homo sapiens
cugagaucaugggucagguggu

SEQ ID NO: 176146 - RNA, 22 nt, Homo sapiens
cugagauggagucucgcauugu

SEQ ID NO: 176147 - RNA, 22 nt, Homo sapiens
cugagcuaguagcauuguguca

SEQ ID NO: 176148 - RNA, 22 nt, Homo sapiens
cugagcucauuucuuuugcuac

SEQ ID NO: 176149 - RNA, 22 nt, Homo sapiens
cugaggaaguucuuuaacaguu

SEQ ID NO: 176150 - RNA, 22 nt, Homo sapiens
cugaggcacggcgaccuuaagu

SEQ ID NO: 176151 - RNA, 22 nt, Homo sapiens
cugagguaauuuguugccagua

SEQ ID NO: 176152 - RNA, 22 nt, Homo sapiens
cugaggucugaauccagguauc

SEQ ID NO: 176153 - RNA, 22 nt, Homo sapiens
cugaguauuugaggccgaagga

SEQ ID NO: 176154 - RNA, 20 nt, Homo sapiens
cugauacagccugagcucuc

SEQ ID NO: 176155 - RNA, 22 nt, Homo sapiens
cugauaguucucuuuagaguuu

SEQ ID NO: 176156 - RNA, 22 nt, Homo sapiens
cugauauuuuaaaauuggcugg

SEQ ID NO: 176157 - RNA, 22 nt, Homo sapiens
cugauauuuuucuggcuugugu

SEQ ID NO: 176158 - RNA, 22 nt, Homo sapiens
cugcaagaugcauaggaauuuu

SEQ ID NO: 176159 - RNA, 22 nt, Homo sapiens
cugcacugagacccucuuugcu

SEQ ID NO: 176160 - RNA, 21 nt, Homo sapiens
cugcauccauuucugagugau

SEQ ID NO: 176161 - RNA, 18 nt, Homo sapiens
cugccagugugcucuccg

SEQ ID NO: 176162 - RNA, 22 nt, Homo sapiens
cugcccguaauccucuccccag

SEQ ID NO: 176163 - RNA, 22 nt, Homo sapiens
cugcccuuucuauaugauguaa

SEQ ID NO: 176164 - RNA, 22 nt, Homo sapiens
cugccugagaaaauggagggca

SEQ ID NO: 176165 - RNA, 22 nt, Homo sapiens
cuggaaagaaacccuuaauucu

SEQ ID NO: 176166 - RNA, 22 nt, Homo sapiens
cuggaaagaaucaggcuaaacu

SEQ ID NO: 176167 - RNA, 18 nt, Homo sapiens
cuggaaggcuacuacagu

SEQ ID NO: 176168 - RNA, 22 nt, Homo sapiens
cuggaaugugagccccaaaaag

SEQ ID NO: 176169 - RNA, 22 nt, Homo sapiens
cuggaauucaaaaucugaauuu

SEQ ID NO: 176170 - RNA, 22 nt, Homo sapiens
cuggacaaaucuggaaagaacc

SEQ ID NO: 176171 - RNA, 22 nt, Homo sapiens
cuggagauuaaccaauugccau

SEQ ID NO: 176172 - RNA, 22 nt, Homo sapiens
cuggaguaugauguuagcguug

SEQ ID NO: 176173 - RNA, 22 nt, Homo sapiens
cuggagucugacugacacaagg

SEQ ID NO: 176174 - RNA, 22 nt, Homo sapiens
cuggcacagugucagaaacaca

SEQ ID NO: 176175 - RNA, 22 nt, Homo sapiens
cuggcaucuaaauacuugaugu

SEQ ID NO: 176176 - RNA, 22 nt, Homo sapiens
cuggcuaagugcuugagugugc

SEQ ID NO: 176177 - RNA, 22 nt, Homo sapiens
cuggcucuguuagaagaaccag

SEQ ID NO: 176178 - RNA, 22 nt, Homo sapiens
cuggcugagugguaaguagagg

SEQ ID NO: 176179 - RNA, 22 nt, Homo sapiens
cugggaugauguaaauaggcua

SEQ ID NO: 176180 - RNA, 22 nt, Homo sapiens
cugggauggaggagaauuagag

SEQ ID NO: 176181 - RNA, 22 nt, Homo sapiens
cuguauguuucuaugaauguga

SEQ ID NO: 176182 - RNA, 19 nt, Homo sapiens
cugucacugaggaagacug

SEQ ID NO: 176183 - RNA, 22 nt, Homo sapiens
cugucaucauuucuaugugcca

SEQ ID NO: 176184 - RNA, 22 nt, Homo sapiens
cuguccugcagagucagaauga

SEQ ID NO: 176185 - RNA, 22 nt, Homo sapiens
cugucucagugaauugguuuua

SEQ ID NO: 176186 - RNA, 22 nt, Homo sapiens
cugucuguuucaaaagugguua

SEQ ID NO: 176187 - RNA, 22 nt, Homo sapiens
cugugacugcagggcauauuug

SEQ ID NO: 176188 - RNA, 22 nt, Homo sapiens
cugugaucuuuuuucauguggu

SEQ ID NO: 176189 - RNA, 17 nt, Homo sapiens
cugugaugaucuugucu

SEQ ID NO: 176190 - RNA, 22 nt, Homo sapiens
cugugcuugagagaugacacag

SEQ ID NO: 176191 - RNA, 22 nt, Homo sapiens
cuguggauguauugcacagucu

SEQ ID NO: 176192 - RNA, 22 nt, Homo sapiens
cuguuagguuaaggaauggcaa

SEQ ID NO: 176193 - RNA, 22 nt, Homo sapiens
cuguuugauuaagugguggaaa

SEQ ID NO: 176194 - RNA, 20 nt, Homo sapiens
cuucacagaaguggaaucau

SEQ ID NO: 176195 - RNA, 22 nt, Homo sapiens
cuucagcaauauauccccuggg

SEQ ID NO: 176196 - RNA, 22 nt, Homo sapiens
cuuccaaguggggcacgugcca

SEQ ID NO: 176197 - RNA, 22 nt, Homo sapiens
cuucuguuaguucugauaacuu

SEQ ID NO: 176198 - RNA, 21 nt, Homo sapiens
cuucuuggggcagggcagggu

SEQ ID NO: 176199 - RNA, 22 nt, Homo sapiens
cuugagcaaacaaaggugguag

SEQ ID NO: 176200 - RNA, 22 nt, Homo sapiens
cuugauagugguaaucauuuuu

SEQ ID NO: 176201 - RNA, 22 nt, Homo sapiens
cuugaucaaugugguacuugau

SEQ ID NO: 176202 - RNA, 22 nt, Homo sapiens
cuugcacauuacagaucugcau

SEQ ID NO: 176203 - RNA, 22 nt, Homo sapiens
cuugccuaaucugcaugauuuu

SEQ ID NO: 176204 - RNA, 22 nt, Homo sapiens
cuuggcauugccccuggaauuu

SEQ ID NO: 176205 - RNA, 22 nt, Homo sapiens
cuuggcuccgacuccccuccaa

SEQ ID NO: 176206 - RNA, 22 nt, Homo sapiens
cuuggcuucuuuauguggcuau

SEQ ID NO: 176207 - RNA, 22 nt, Homo sapiens
cuuggcuuguuguccccugcuc

SEQ ID NO: 176208 - RNA, 22 nt, Homo sapiens
cuuguacacuguuggugggaau

SEQ ID NO: 176209 - RNA, 22 nt, Homo sapiens
cuugugcaugaccccagguggg

SEQ ID NO: 176210 - RNA, 22 nt, Homo sapiens
cuuuaguuaaaauugggguugu

SEQ ID NO: 176211 - RNA, 22 nt, Homo sapiens
cuuucacacuguuggugggaau

SEQ ID NO: 176212 - RNA, 22 nt, Homo sapiens
cuuuccauuguuggagcauaaa

SEQ ID NO: 176213 - RNA, 22 nt, Homo sapiens
cuuugauuauaaaaggguguuu

SEQ ID NO: 176214 - RNA, 22 nt, Homo sapiens
cuuuggagaaaaguucuugggc

SEQ ID NO: 176215 - RNA, 20 nt, Homo sapiens
cuuuggcaaugagaacaggg

SEQ ID NO: 176216 - RNA, 22 nt, Homo sapiens
cuuuggguauucucccuugggg

SEQ ID NO: 176217 - RNA, 22 nt, Homo sapiens
cuuuggugauagauaccccaua

SEQ ID NO: 176218 - RNA, 19 nt, Homo sapiens
cuuugguugagcguguugg

SEQ ID NO: 176219 - RNA, 23 nt, Homo sapiens
cuuuguacagcuugacuacuggg

SEQ ID NO: 176220 - RNA, 22 nt, Homo sapiens
cuuuuacacugguggugggaau

SEQ ID NO: 176221 - RNA, 22 nt, Homo sapiens
cuuuuacacuguuagugggaau

SEQ ID NO: 176222 - RNA, 22 nt, Homo sapiens
cuuuuacacuguuggcaggauu

SEQ ID NO: 176223 - RNA, 22 nt, Homo sapiens
cuuuuggcuuagaauugucuug

SEQ ID NO: 176224 - RNA, 22 nt, Homo sapiens
cuuuuggugguucugaugcagg

SEQ ID NO: 176225 - RNA, 22 nt, Homo sapiens
cuuuuggugugaagaagcucuu

SEQ ID NO: 176226 - RNA, 22 nt, Homo sapiens
cuuuuugguagagcaggugugc

SEQ ID NO: 176227 - RNA, 22 nt, Homo sapiens
gaaaauccauccccagggagua

SEQ ID NO: 176228 - RNA, 22 nt, Homo sapiens
gaaagauuuccugagcuagaaa

SEQ ID NO: 176229 - RNA, 22 nt, Homo sapiens
gaaagguaggaacagggugcag

SEQ ID NO: 176230 - RNA, 22 nt, Homo sapiens
gaaauggaucagagcaagcuuu

SEQ ID NO: 176231 - RNA, 22 nt, Homo sapiens
gaagaaguacaagacaaauuuu

SEQ ID NO: 176232 - RNA, 22 nt, Homo sapiens
gaaggugcuuggugaaugcauu

SEQ ID NO: 176233 - RNA, 23 nt, Homo sapiens
gaaguaauaaauggauucuuaac

SEQ ID NO: 176234 - RNA, 22 nt, Homo sapiens
gaagugcaguggcacagucaug

SEQ ID NO: 176235 - RNA, 22 nt, Homo sapiens
gaagugguaggauugcuuuuga

SEQ ID NO: 176236 - RNA, 17 nt, Homo sapiens
gaaguguuucagcagcu

SEQ ID NO: 176237 - RNA, 23 nt, Homo sapiens
guaguuugaugcaauccacuugu

SEQ ID NO: 176238 - RNA, 22 nt, Homo sapiens
guauacuucugaaaauagcuau

SEQ ID NO: 176239 - RNA, 22 nt, Homo sapiens
guaugaguuuucugaugugugg

SEQ ID NO: 176240 - RNA, 22 nt, Homo sapiens
guaugcaagugauaugacauau

SEQ ID NO: 176241 - RNA, 22 nt, Homo sapiens
guauggaauuugugaccuuaua

SEQ ID NO: 176242 - RNA, 22 nt, Homo sapiens
guauuagaugguauuugaagau

SEQ ID NO: 176243 - RNA, 22 nt, Homo sapiens
guauuagguuggugcaaaauug

SEQ ID NO: 176244 - RNA, 22 nt, Homo sapiens
guauugacuaucaaucaugugc

SEQ ID NO: 176245 - RNA, 19 nt, Homo sapiens
guauuugacuuucuuguuu

SEQ ID NO: 176246 - RNA, 22 nt, Homo sapiens
gucaaggaauuuauccauuucu

SEQ ID NO: 176247 - RNA, 22 nt, Homo sapiens
gucacagcacuuuuaguaagug

SEQ ID NO: 176248 - RNA, 22 nt, Homo sapiens
gucacaguggccagugauguuc

SEQ ID NO: 176249 - RNA, 22 nt, Homo sapiens
gucacugagcagaaggaagcga

SEQ ID NO: 176250 - RNA, 22 nt, Homo sapiens
gucacugccugaggcugaugca

SEQ ID NO: 176251 - RNA, 22 nt, Homo sapiens
gucacuguggagaagaaagugg

SEQ ID NO: 176252 - RNA, 22 nt, Homo sapiens
gucacuguuuccuauuauauuu

SEQ ID NO: 176253 - RNA, 22 nt, Homo sapiens
gucagaaucucagaugacaacg

SEQ ID NO: 176254 - RNA, 22 nt, Homo sapiens
gucagcaaagaggaauaguuug

SEQ ID NO: 176255 - RNA, 22 nt, Homo sapiens
gucaggcaccgauacaguuuuu

SEQ ID NO: 176256 - RNA, 22 nt, Homo sapiens
gucagggagucucuaucagugg

SEQ ID NO: 176257 - RNA, 22 nt, Homo sapiens
gucagugcuuuaguucaggaug

SEQ ID NO: 176258 - RNA, 22 nt, Homo sapiens
gucaugaacuguacuacuccua

SEQ ID NO: 176259 - RNA, 22 nt, Homo sapiens
gucauggacaguuugcuaauug

SEQ ID NO: 176260 - RNA, 22 nt, Homo sapiens
gucauggaggaugaauggccaa

SEQ ID NO: 176261 - RNA, 22 nt, Homo sapiens
gucaugucugcacauaguaaaa

SEQ ID NO: 176262 - RNA, 22 nt, Homo sapiens
gucauguuuaacuucuugagga

SEQ ID NO: 176263 - RNA, 22 nt, Homo sapiens
gucauugagucagggaguaucu

SEQ ID NO: 176264 - RNA, 22 nt, Homo sapiens
guccaagacuaggaguuggcag

SEQ ID NO: 176265 - RNA, 22 nt, Homo sapiens
guccagagaagucauuacuuca

SEQ ID NO: 176266 - RNA, 22 nt, Homo sapiens
guccaguacucuuuccugaaaa

SEQ ID NO: 176267 - RNA, 22 nt, Homo sapiens
gucccaguggaaccuccaagcu

SEQ ID NO: 176268 - RNA, 22 nt, Homo sapiens
gucguggagucucuggcuugua

SEQ ID NO: 176269 - RNA, 22 nt, Homo sapiens
gucucacaggcaugaugccagc

SEQ ID NO: 176270 - RNA, 22 nt, Homo sapiens
gucuccgagccguguggagccg

SEQ ID NO: 176271 - RNA, 22 nt, Homo sapiens
gucuccggcuguccuuugaggu

SEQ ID NO: 176272 - RNA, 22 nt, Homo sapiens
gucucugguugcuuuuguacca

SEQ ID NO: 176273 - RNA, 22 nt, Homo sapiens
gucucuugguuuagagcauuua

SEQ ID NO: 176274 - RNA, 22 nt, Homo sapiens
gucugcaugucauaugauagua

SEQ ID NO: 176275 - RNA, 22 nt, Homo sapiens
gucugguuggaguaguuuucag

SEQ ID NO: 176276 - RNA, 22 nt, Homo sapiens
gucugguuuuuuauauccucac

SEQ ID NO: 176277 - RNA, 22 nt, Homo sapiens
gucugugguuccuaugucaccu

SEQ ID NO: 176278 - RNA, 23 nt, Homo sapiens
uuguaacuggagaguaacauucc

SEQ ID NO: 176279 - RNA, 22 nt, Homo sapiens
uuguaaucaacacaucauuggg

SEQ ID NO: 176280 - RNA, 23 nt, Homo sapiens
uuguacacuaagaaucgcagaug

SEQ ID NO: 176281 - RNA, 22 nt, Homo sapiens
uuguacuagucauauuuugaaa

SEQ ID NO: 176282 - RNA, 22 nt, Homo sapiens
uuguacuucagacaugccaaag

SEQ ID NO: 176283 - RNA, 22 nt, Homo sapiens
uuguagcaaauguguaaacaaa

SEQ ID NO: 176284 - RNA, 22 nt, Homo sapiens
uuguauaguucuauguguuuug

SEQ ID NO: 176285 - RNA, 21 nt, Homo sapiens
uuguaugguugaacuugauac

SEQ ID NO: 176286 - RNA, 22 nt, Homo sapiens
uuguauguuguuugucagagaa

SEQ ID NO: 176287 - RNA, 22 nt, Homo sapiens
uuguauguuucugugcacauga

SEQ ID NO: 176288 - RNA, 22 nt, Homo sapiens
uugucacccuacauaacaggga

SEQ ID NO: 176289 - RNA, 22 nt, Homo sapiens
uugucauuuucagaguguuacg

SEQ ID NO: 176290 - RNA, 22 nt, Homo sapiens
uuguccacugcuagccucugca

SEQ ID NO: 176291 - RNA, 21 nt, Homo sapiens
uuguccccacccaaaucucau

SEQ ID NO: 176292 - RNA, 22 nt, Homo sapiens
uugugaaugaugucgcaguaaa

SEQ ID NO: 176293 - RNA, 22 nt, Homo sapiens
uugugaauggugccacaauaaa

SEQ ID NO: 176294 - RNA, 22 nt, Homo sapiens
uugugcuccuaugagaaucuaa

SEQ ID NO: 176295 - RNA, 22 nt, Homo sapiens
uugugcuugauuugccuagcug

SEQ ID NO: 176296 - RNA, 22 nt, Homo sapiens
uugugcuugcuguguucuaugc

SEQ ID NO: 176297 - RNA, 18 nt, Homo sapiens
uuguggccccuacaaauu

SEQ ID NO: 176298 - RNA, 19 nt, Homo sapiens
uugugggaggacagagggg

SEQ ID NO: 176299 - RNA, 22 nt, Homo sapiens
uugugggaggugauuagaucau

SEQ ID NO: 176300 - RNA, 22 nt, Homo sapiens
uugugguaggaugaagagauga

SEQ ID NO: 176301 - RNA, 22 nt, Homo sapiens
uugugucaaauggcaauuagca

SEQ ID NO: 176302 - RNA, 22 nt, Homo sapiens
uuguguccccacucaaauuaca

SEQ ID NO: 176303 - RNA, 22 nt, Homo sapiens
uugugucccugcggcugaggag

SEQ ID NO: 176304 - RNA, 22 nt, Homo sapiens
uuguuaagaugcagauucugga

SEQ ID NO: 176305 - RNA, 22 nt, Homo sapiens
uuguuauguuaaacuacugaaa

SEQ ID NO: 176306 - RNA, 22 nt, Homo sapiens
uuguuauguuggucaguaaugu

SEQ ID NO: 176307 - RNA, 22 nt, Homo sapiens
uuuaaagcuccaagcaugucug

SEQ ID NO: 176308 - RNA, 22 nt, Homo sapiens
uuuaaugcaucccaaaauguag

SEQ ID NO: 176309 - RNA, 22 nt, Homo sapiens
uuuacagucucauagguggaag

SEQ ID NO: 176310 - RNA, 22 nt, Homo sapiens
uuuacccugaggaaucuauuuu

SEQ ID NO: 176311 - RNA, 19 nt, Homo sapiens
uuuagaucuuuuaugcagc

SEQ ID NO: 176312 - RNA, 22 nt, Homo sapiens
uuuagcaaugcuguggggaagu

SEQ ID NO: 176313 - RNA, 22 nt, Homo sapiens
uuuagcagcaaagagcuguguu

SEQ ID NO: 176314 - RNA, 22 nt, Homo sapiens
uuuauccagccucuagcaaggu

SEQ ID NO: 176315 - RNA, 22 nt, Homo sapiens
uuuaugucuguacaucgggcgg

SEQ ID NO: 176316 - RNA, 19 nt, Homo sapiens
uuucaauguaaggauggag

SEQ ID NO: 176317 - RNA, 22 nt, Homo sapiens
uuucacaguguucucccccaga

SEQ ID NO: 176318 - RNA, 18 nt, Homo sapiens
uuucauugagugugauau

SEQ ID NO: 176319 - RNA, 22 nt, Homo sapiens
uuuccagguggccaacauuuua

SEQ ID NO: 176320 - RNA, 22 nt, Homo sapiens
uuucccuuacuuaaacuuacuc

SEQ ID NO: 176321 - RNA, 22 nt, Homo sapiens
uuuccuggagaaucuuaacaaa

SEQ ID NO: 176322 - RNA, 22 nt, Homo sapiens
uuuccuguaggaaggaaauaga

SEQ ID NO: 176323 - RNA, 22 nt, Homo sapiens
uuuccuguagggggcaaggccu

SEQ ID NO: 176324 - RNA, 22 nt, Homo sapiens
uuucuauguugaccagucuaga

SEQ ID NO: 176325 - RNA, 16 nt, Homo sapiens
uuucuauguuuuacua

SEQ ID NO: 176326 - RNA, 22 nt, Homo sapiens
uuucugcuugagagaauugcug

SEQ ID NO: 176327 - RNA, 22 nt, Homo sapiens
uuucugugguccucuugaaggu

SEQ ID NO: 176328 - RNA, 22 nt, Homo sapiens
uuugaagacuacugggagugaa

SEQ ID NO: 176329 - RNA, 22 nt, Homo sapiens
uuugaaguguggcacugaguuu

SEQ ID NO: 176330 - RNA, 20 nt, Homo sapiens
uuugaauguaaagcauguca

SEQ ID NO: 176331 - RNA, 22 nt, Homo sapiens
uuugacuuuuagaauaugaguu

SEQ ID NO: 176332 - RNA, 22 nt, Homo sapiens
uuugagcaagaggugacauuau

SEQ ID NO: 176333 - RNA, 22 nt, Homo sapiens
uuugagcuugacucagcuggag

SEQ ID NO: 176334 - RNA, 22 nt, Homo sapiens
uuugaguuugaggugcugauga

SEQ ID NO: 176335 - RNA, 22 nt, Homo sapiens
uuugauguccaccucagcccac

SEQ ID NO: 176336 - RNA, 22 nt, Homo sapiens
uuugauguugauacuaccuuca

SEQ ID NO: 176337 - RNA, 22 nt, Homo sapiens
uuugcacauauuugggcaaaag

SEQ ID NO: 176338 - RNA, 22 nt, Homo sapiens
uuugcacuucugagugugacau

SEQ ID NO: 176339 - RNA, 22 nt, Homo sapiens
uuugcacuuuuguaauaugguu

SEQ ID NO: 176340 - RNA, 20 nt, Homo sapiens
uuugcagaaucuaagaagag

SEQ ID NO: 176341 - RNA, 22 nt, Homo sapiens
uuugcagagacuuguuaggaau

SEQ ID NO: 176342 - RNA, 22 nt, Homo sapiens
uuugcaguuuauuccuggggcu

SEQ ID NO: 176343 - RNA, 19 nt, Homo sapiens
uuugcauagugagaauaua

SEQ ID NO: 176344 - RNA, 22 nt, Homo sapiens
uuugcaucuuagaaaguucucc

SEQ ID NO: 176345 - RNA, 23 nt, Homo sapiens
uuugccacuuauuagcugggagg

SEQ ID NO: 176346 - RNA, 22 nt, Homo sapiens
uuugcuuaaaucuuaaucagau

SEQ ID NO: 176347 - RNA, 22 nt, Homo sapiens
uuuggaagaugccacuguauca

SEQ ID NO: 176348 - RNA, 22 nt, Homo sapiens
uuuggaaugugcacucagauug

SEQ ID NO: 176349 - RNA, 22 nt, Homo sapiens
uuuggcaacguuggaucccuca

SEQ ID NO: 176350 - RNA, 22 nt, Homo sapiens
uuuggcauauuuuaagcugguu

SEQ ID NO: 176351 - RNA, 22 nt, Homo sapiens
uuuggcauuaagaugcuguauc

SEQ ID NO: 176352 - RNA, 22 nt, Homo sapiens
uuuggcauuagagagacuugca

SEQ ID NO: 176353 - RNA, 22 nt, Homo sapiens
uuuggccauguuggucaggcug

SEQ ID NO: 176354 - RNA, 22 nt, Homo sapiens
uuuggcuauguuguaucuuucc

SEQ ID NO: 176355 - RNA, 22 nt, Homo sapiens
uuuggcuuaagauugacugcaa

SEQ ID NO: 176356 - RNA, 21 nt, Homo sapiens
uuuggcuucucugcugcagcc

SEQ ID NO: 176357 - RNA, 22 nt, Homo sapiens
uuugggaaugaguuuaucauuu

SEQ ID NO: 176358 - RNA, 22 nt, Homo sapiens
uuugggccauggcuuuuccacg

SEQ ID NO: 176359 - RNA, 22 nt, Homo sapiens
uuugggccaugguuuguguaua

SEQ ID NO: 176360 - RNA, 22 nt, Homo sapiens
uuuggucacugccgccgccagc

SEQ ID NO: 176361 - RNA, 22 nt, Homo sapiens
uuuggucuuuuguaaguuaucu

SEQ ID NO: 176362 - RNA, 22 nt, Homo sapiens
uuugguuuuuguuaucacucau

SEQ ID NO: 176363 - RNA, 22 nt, Homo sapiens
uuuguaagaugcauagauugca

SEQ ID NO: 176364 - RNA, 22 nt, Homo sapiens
uuuguacacuguugguaggauu

SEQ ID NO: 176365 - RNA, 22 nt, Homo sapiens
uuuguacuucauugguucuacu

SEQ ID NO: 176366 - RNA, 23 nt, Homo sapiens
uuuguaguagcaugauuuauaau

SEQ ID NO: 176367 - RNA, 19 nt, Homo sapiens
uuuguauguuuccaguaau

SEQ ID NO: 176368 - RNA, 22 nt, Homo sapiens
uuugugacuugcuucucagaau

SEQ ID NO: 176369 - RNA, 22 nt, Homo sapiens
uuugugagguggauagauugca

SEQ ID NO: 176370 - RNA, 22 nt, Homo sapiens
uuugugcaugaagagggggugc

SEQ ID NO: 176371 - RNA, 22 nt, Homo sapiens
uuuguggaaugcccuuauuuau

SEQ ID NO: 176372 - RNA, 22 nt, Homo sapiens
uuuguuugaagucgagacaacu

SEQ ID NO: 176373 - RNA, 22 nt, Homo sapiens
uuuuaacagccaggggacggcc

SEQ ID NO: 176374 - RNA, 22 nt, Homo sapiens
uuuuagcaaagagacugguggc

SEQ ID NO: 176375 - RNA, 22 nt, Homo sapiens
uuuucaguggccauaguggaga

SEQ ID NO: 176376 - RNA, 22 nt, Homo sapiens
uuuucaguuuuccagguagccg

SEQ ID NO: 176377 - RNA, 22 nt, Homo sapiens
uuuuccagugggacucccauua

SEQ ID NO: 176378 - RNA, 22 nt, Homo sapiens
uuuugcaaauuccaguggccau

SEQ ID NO: 176379 - RNA, 22 nt, Homo sapiens
uuuugcaauauguuccugaaua

SEQ ID NO: 176380 - RNA, 22 nt, Homo sapiens
uuuugcacuagaaccagagguu

SEQ ID NO: 176381 - RNA, 22 nt, Homo sapiens
uuuugcuccuggcaaacucaua

SEQ ID NO: 176382 - RNA, 18 nt, Homo sapiens
uuuugcuuaacugcgcca

SEQ ID NO: 176383 - RNA, 22 nt, Homo sapiens
uuuugcuugugaauagccacau

SEQ ID NO: 176384 - RNA, 19 nt, Homo sapiens
uuuuggaaaugugaacagc

SEQ ID NO: 176385 - RNA, 22 nt, Homo sapiens
uuuuggacuugcuccccugucc

SEQ ID NO: 176386 - RNA, 17 nt, Homo sapiens
uuuuggauuagaaaucc

SEQ ID NO: 176387 - RNA, 22 nt, Homo sapiens
uuuuggcuuaaagagaauguau

SEQ ID NO: 176388 - RNA, 20 nt, Homo sapiens
uuuuggcuuaaagcagucug

SEQ ID NO: 176389 - RNA, 22 nt, Homo sapiens
uuuugguguacaauucuaugga

SEQ ID NO: 176390 - RNA, 22 nt, Homo sapiens
uuuuugagaauuggugaaacac

SEQ ID NO: 176391 - RNA, 18 nt, Homo sapiens
uuuuugaggcacagggga

SEQ ID NO: 176392 - RNA, 22 nt, Homo sapiens
uuuuugagguauaguguggcua

SEQ ID NO: 176393 - RNA, 22 nt, Homo sapiens
uuuuuggaggagguuagaucau

SEQ ID NO: 176394 - RNA, 22 nt, Homo sapiens
uuuuuggauaaugguacaugua

SEQ ID NO: 176395 - RNA, 21 nt, Homo sapiens
uuuuugggcuuucauaguguu

SEQ ID NO: 176396 - RNA, 22 nt, Homo sapiens
uuuuuuaguuagcugggcauga

SEQ ID NO: 176397 - RNA, 22 nt, Homo sapiens
uuuuuugcuguaugcaaacauc

SEQ ID NO: 176398 - RNA, 22 nt, Homo sapiens
uugguaaucccuagugucuaga

SEQ ID NO: 176399 - RNA, 22 nt, Homo sapiens
uuggucacugacauguuugaaa

SEQ ID NO: 176400 - RNA, 22 nt, Homo sapiens
uugguccccuucaaccagcugu

SEQ ID NO: 176401 - RNA, 19 nt, Homo sapiens
uuggucccuuuggguucuu

SEQ ID NO: 176402 - RNA, 22 nt, Homo sapiens
uugguccucccaugcucaagag

SEQ ID NO: 176403 - RNA, 23 nt, Homo sapiens
uuggucucccaaaguguugagau

SEQ ID NO: 176404 - RNA, 22 nt, Homo sapiens
uuggucuucuaauguaccuguu

SEQ ID NO: 176405 - RNA, 21 nt, Homo sapiens
uuggucuucucugugauucuu

SEQ ID NO: 176406 - RNA, 22 nt, Homo sapiens
uugguuccauuuuaccagcucu

SEQ ID NO: 176407 - RNA, 22 nt, Homo sapiens
uugguucucuuuauaugcugga

SEQ ID NO: 176408 - RNA, 22 nt, Homo sapiens
uuguaaagaucauaugcuguuc

SEQ ID NO: 176409 - RNA, 22 nt, Homo sapiens
uuguaaaguucuuaggaagcuc

SEQ ID NO: 176410 - RNA, 22 nt, Homo sapiens
uuguaacaugcuuucacuucag

SEQ ID NO: 176411 - RNA, 22 nt, Homo sapiens
cauggcccugggcugggcgaac

SEQ ID NO: 176412 - RNA, 22 nt, Homo sapiens
cauggcccuggguccauaggaa

SEQ ID NO: 176413 - RNA, 22 nt, Homo sapiens
cauggcuacugcagauguaggg

SEQ ID NO: 176414 - RNA, 22 nt, Homo sapiens
cauggcuuuauuuucagcuucu

SEQ ID NO: 176415 - RNA, 22 nt, Homo sapiens
caugguguuaggcacugggaau

SEQ ID NO: 176416 - RNA, 21 nt, Homo sapiens
caugucacugcacucuagccu

SEQ ID NO: 176417 - RNA, 22 nt, Homo sapiens
caugucacuuccucucugaugg

SEQ ID NO: 176418 - RNA, 22 nt, Homo sapiens
caugucuuuuauucugugugau

SEQ ID NO: 176419 - RNA, 19 nt, Homo sapiens
caugugcacuacuggcuuc

SEQ ID NO: 176420 - RNA, 22 nt, Homo sapiens
cauuaguugaagugcagggaga

SEQ ID NO: 176421 - RNA, 22 nt, Homo sapiens
cauuccacauguaggacaauuu

SEQ ID NO: 176422 - RNA, 22 nt, Homo sapiens
cauugcaaugaggucuugcagu

SEQ ID NO: 176423 - RNA, 22 nt, Homo sapiens
cauugcacuccaccuuggguaa

SEQ ID NO: 176424 - RNA, 22 nt, Homo sapiens
cauugcacuccagcccagguga

SEQ ID NO: 176425 - RNA, 22 nt, Homo sapiens
cauugcacuccauccuuggcaa

SEQ ID NO: 176426 - RNA, 22 nt, Homo sapiens
cauugcacucugcauuccaguc

SEQ ID NO: 176427 - RNA, 22 nt, Homo sapiens
cauugcacuuagacaacuuuug

SEQ ID NO: 176428 - RNA, 22 nt, Homo sapiens
cauugcauuccagucugggcaa

SEQ ID NO: 176429 - RNA, 19 nt, Homo sapiens
cauuggacuugcuuuugcc

SEQ ID NO: 176430 - RNA, 22 nt, Homo sapiens
cauuguacauaaguauggagua

SEQ ID NO: 176431 - RNA, 22 nt, Homo sapiens
ccaagccucaguuucccucugu

SEQ ID NO: 176432 - RNA, 22 nt, Homo sapiens
ccaaguguucucauuguucaau

SEQ ID NO: 176433 - RNA, 22 nt, Homo sapiens
ccaaguguuuucauuguuccau

SEQ ID NO: 176434 - RNA, 23 nt, Homo sapiens
ccacaaugguugaacuagauuac

SEQ ID NO: 176435 - RNA, 22 nt, Homo sapiens
ccacaguagucuugggaugggc

SEQ ID NO: 176436 - RNA, 22 nt, Homo sapiens
ccacagucuaugcaacaagguc

SEQ ID NO: 176437 - RNA, 22 nt, Homo sapiens
ccacauuaccuugcuugcucca

SEQ ID NO: 176438 - RNA, 22 nt, Homo sapiens
ccacugcacuccagcccggcaa

SEQ ID NO: 176439 - RNA, 22 nt, Homo sapiens
ccacugggcuagguguuuugga

SEQ ID NO: 176440 - RNA, 22 nt, Homo sapiens
ccacuguuuaaauggcugagga

SEQ ID NO: 176441 - RNA, 22 nt, Homo sapiens
ccagaguucuaggcauuggaaa

SEQ ID NO: 176442 - RNA, 20 nt, Homo sapiens
ccagcaucauuagauucugg

SEQ ID NO: 176443 - RNA, 22 nt, Homo sapiens
ccaggguugcuuuagauucuga

SEQ ID NO: 176444 - RNA, 22 nt, Homo sapiens
ccaguauuuuauugaggguuuu

SEQ ID NO: 176445 - RNA, 22 nt, Homo sapiens
ccagugaacugcaagguuuuuc

SEQ ID NO: 176446 - RNA, 18 nt, Homo sapiens
ccagugcaaggaaagccc

SEQ ID NO: 176447 - RNA, 22 nt, Homo sapiens
ccagugguucccuguggccuga

SEQ ID NO: 176448 - RNA, 22 nt, Homo sapiens
ccagugucugacagacacggcg

SEQ ID NO: 176449 - RNA, 20 nt, Homo sapiens
ccaguguuauuuauguucua

SEQ ID NO: 176450 - RNA, 19 nt, Homo sapiens
ccaguguugccagagcuga

SEQ ID NO: 176451 - RNA, 22 nt, Homo sapiens
ccaguuuucaagauaaugguuu

SEQ ID NO: 176452 - RNA, 22 nt, Homo sapiens
ccaucacacugugauuauuauc

SEQ ID NO: 176453 - RNA, 22 nt, Homo sapiens
ccaugaacuagaauagaacaug

SEQ ID NO: 176454 - RNA, 21 nt, Homo sapiens
ccauggcaaugguaaacugac

SEQ ID NO: 176455 - RNA, 22 nt, Homo sapiens
ccauggcuauucuguaaggguu

SEQ ID NO: 176456 - RNA, 23 nt, Homo sapiens
ccauugcacuccagccucaguga

SEQ ID NO: 176457 - RNA, 22 nt, Homo sapiens
ccauugcacuccauccugggca

SEQ ID NO: 176458 - RNA, 22 nt, Homo sapiens
ccauugcacucuggccuaggug

SEQ ID NO: 176459 - RNA, 22 nt, Homo sapiens
cccagagacagaaugauaaacu

SEQ ID NO: 176460 - RNA, 22 nt, Homo sapiens
cccagugaagagaaccuuacga

SEQ ID NO: 176461 - RNA, 22 nt, Homo sapiens
cccagugugcugggugacagcu

SEQ ID NO: 176462 - RNA, 23 nt, Homo sapiens
cccaguuaauccuuaaucuccac

SEQ ID NO: 176463 - RNA, 22 nt, Homo sapiens
ccccaguguguaaaggccuugc

SEQ ID NO: 176464 - RNA, 20 nt, Homo sapiens
ccccaguuuuucuauuagcu

SEQ ID NO: 176465 - RNA, 22 nt, Homo sapiens
ccccauguucucucugcagcuc

SEQ ID NO: 176466 - RNA, 22 nt, Homo sapiens
ccccuguaaacuggcuucccug

SEQ ID NO: 176467 - RNA, 18 nt, Homo sapiens
cccgggugggcuguuccc

SEQ ID NO: 176468 - RNA, 17 nt, Homo sapiens
cccuaguagcugggacu

SEQ ID NO: 176469 - RNA, 22 nt, Homo sapiens
cccugaagaaagccuaggacau

SEQ ID NO: 176470 - RNA, 22 nt, Homo sapiens
cccugagaaaacuuuguccuua

SEQ ID NO: 176471 - RNA, 22 nt, Homo sapiens
cccuguagcagcauucuuaaau

SEQ ID NO: 176472 - RNA, 22 nt, Homo sapiens
cccuucauucaaggguugugag

SEQ ID NO: 176473 - RNA, 22 nt, Homo sapiens
cccuugcacuucagagcugcau

SEQ ID NO: 176474 - RNA, 22 nt, Homo sapiens
ccggcugugugacugugggcag

SEQ ID NO: 176475 - RNA, 22 nt, Homo sapiens
ccggguguuuuguucucucaga

SEQ ID NO: 176476 - RNA, 22 nt, Homo sapiens
ccuaggcacugggguccagccc

SEQ ID NO: 176477 - RNA, 22 nt, Homo sapiens
ccucacaaccuuuauugaagag

SEQ ID NO: 176478 - RNA, 22 nt, Homo sapiens
ccucuguaguccugcaagagga

SEQ ID NO: 176479 - RNA, 22 nt, Homo sapiens
ccugagguagaguuuauauuga

SEQ ID NO: 176480 - RNA, 21 nt, Homo sapiens
ccugaguacaacccacuccac

SEQ ID NO: 176481 - RNA, 22 nt, Homo sapiens
ccuggaagaaaggugcuaaaua

SEQ ID NO: 176482 - RNA, 22 nt, Homo sapiens
ccuggcacugggccccguggcu

SEQ ID NO: 176483 - RNA, 22 nt, Homo sapiens
ccugucuugauuaaauuacuua

SEQ ID NO: 176484 - RNA, 22 nt, Homo sapiens
ccugugguuaaccagcuagaug

SEQ ID NO: 176485 - RNA, 22 nt, Homo sapiens
ccuucauccuccagcaggcuag

SEQ ID NO: 176486 - RNA, 22 nt, Homo sapiens
ccuucauugcaucuuuaagaga

SEQ ID NO: 176487 - RNA, 22 nt, Homo sapiens
ccuugguggccacaagacauug

SEQ ID NO: 176488 - RNA, 22 nt, Homo sapiens
ccuugguugugcuucaacuucu

SEQ ID NO: 176489 - RNA, 22 nt, Homo sapiens
ccuuuguuuaguugaauuguau

SEQ ID NO: 176490 - RNA, 22 nt, Homo sapiens
cgaguagcacaaugugugugau

SEQ ID NO: 176491 - RNA, 22 nt, Homo sapiens
cggcaguggguaagccaagcuu

SEQ ID NO: 176492 - RNA, 22 nt, Homo sapiens
cuaagauugucuuaguguguug

SEQ ID NO: 176493 - RNA, 22 nt, Homo sapiens
cuaauacaguuguccaagcugg

SEQ ID NO: 176494 - RNA, 22 nt, Homo sapiens
cuaaugcagucaggagaaggaa

SEQ ID NO: 176495 - RNA, 22 nt, Homo sapiens
cuacagaguaucuaaagaggua

SEQ ID NO: 176496 - RNA, 22 nt, Homo sapiens
cuacagcacugagcugugugca

SEQ ID NO: 176497 - RNA, 22 nt, Homo sapiens
cuacagcagcccaguccccgaa

SEQ ID NO: 176498 - RNA, 22 nt, Homo sapiens
cuacaguaugaaaccuuuacuc

SEQ ID NO: 176499 - RNA, 22 nt, Homo sapiens
cuacagugggucuguaguccuu

SEQ ID NO: 176500 - RNA, 23 nt, Homo sapiens
cuacuagucaagucuuuuccagu

SEQ ID NO: 176501 - RNA, 22 nt, Homo sapiens
cuacucugugguguauuugcau

SEQ ID NO: 176502 - RNA, 22 nt, Homo sapiens
cuacugacacuacugcaaucau

SEQ ID NO: 176503 - RNA, 22 nt, Homo sapiens
cuagaagcauauucagaacaga

SEQ ID NO: 176504 - RNA, 22 nt, Homo sapiens
cuagaguacuuaccacagcaug

SEQ ID NO: 176505 - RNA, 22 nt, Homo sapiens
cuagaguguaguuuucuuagga

SEQ ID NO: 176506 - RNA, 22 nt, Homo sapiens
cuagcacauaguuauucacuca

SEQ ID NO: 176507 - RNA, 22 nt, Homo sapiens
cuagcaggcaagauaagauuca

SEQ ID NO: 176508 - RNA, 22 nt, Homo sapiens
cuagcccugagauaaaugucau

SEQ ID NO: 176509 - RNA, 22 nt, Homo sapiens
cuagcugcacuuccugcuacug

SEQ ID NO: 176510 - RNA, 18 nt, Homo sapiens
cuaguguuucuugaauca

SEQ ID NO: 176511 - RNA, 22 nt, Homo sapiens
cuaucucaggcccaggcccuug

SEQ ID NO: 176512 - RNA, 22 nt, Homo sapiens
cuaugucuuucauauuuugggg

SEQ ID NO: 176513 - RNA, 22 nt, Homo sapiens
cuauucacaauagccaagauuu

SEQ ID NO: 176514 - RNA, 22 nt, Homo sapiens
cucaaaguacuuugguuauugu

SEQ ID NO: 176515 - RNA, 22 nt, Homo sapiens
cucaaaugguccagcuaguggu

SEQ ID NO: 176516 - RNA, 22 nt, Homo sapiens
cucaaguacaugggauuacagg

SEQ ID NO: 176517 - RNA, 22 nt, Homo sapiens
cucaaguagugguuuucauuga

SEQ ID NO: 176518 - RNA, 22 nt, Homo sapiens
cucaccuugugauccuccugcc

SEQ ID NO: 176519 - RNA, 22 nt, Homo sapiens
cucacggcccugcgcacuggca

SEQ ID NO: 176520 - RNA, 20 nt, Homo sapiens
uaugacaaagccuagugagu

SEQ ID NO: 176521 - RNA, 20 nt, Homo sapiens
uaugaccugucuuuucucuc

SEQ ID NO: 176522 - RNA, 22 nt, Homo sapiens
auggauugucuccuugugccau

SEQ ID NO: 176523 - RNA, 22 nt, Homo sapiens
auggcagcugguuuuacccuag

SEQ ID NO: 176524 - RNA, 22 nt, Homo sapiens
auggcagugagucucuaguauu

SEQ ID NO: 176525 - RNA, 22 nt, Homo sapiens
auggcaguuucagcuauaguuu

SEQ ID NO: 176526 - RNA, 22 nt, Homo sapiens
auggcccaguuugcuaucccua

SEQ ID NO: 176527 - RNA, 22 nt, Homo sapiens
auggcccccuguuugugaacau

SEQ ID NO: 176528 - RNA, 22 nt, Homo sapiens
auggccuuucuggcacauuucc

SEQ ID NO: 176529 - RNA, 22 nt, Homo sapiens
auggcucaguguguaucuauca

SEQ ID NO: 176530 - RNA, 22 nt, Homo sapiens
auggcucuggauagaaugcagg

SEQ ID NO: 176531 - RNA, 22 nt, Homo sapiens
auggcuucuuacucuucugcau

SEQ ID NO: 176532 - RNA, 22 nt, Homo sapiens
auggcuuguuaugcauuaguac

SEQ ID NO: 176533 - RNA, 22 nt, Homo sapiens
auggcuuuaagagugucugaau

SEQ ID NO: 176534 - RNA, 22 nt, Homo sapiens
auggcuuuguguucagagcuga

SEQ ID NO: 176535 - RNA, 22 nt, Homo sapiens
auggcuuuuccugucuugcaug

SEQ ID NO: 176536 - RNA, 22 nt, Homo sapiens
auggcuuuuuaaaucauguugu

SEQ ID NO: 176537 - RNA, 22 nt, Homo sapiens
augggaaaaucagaaggccugg

SEQ ID NO: 176538 - RNA, 22 nt, Homo sapiens
augguagacucucgggucaugg

SEQ ID NO: 176539 - RNA, 22 nt, Homo sapiens
auggucuuuauuguguugagug

SEQ ID NO: 176540 - RNA, 22 nt, Homo sapiens
auggucuuuuuguuaugagaga

SEQ ID NO: 176541 - RNA, 22 nt, Homo sapiens
auggugugugaauuaaauguua

SEQ ID NO: 176542 - RNA, 22 nt, Homo sapiens
augguugguuaaaucuguguau

SEQ ID NO: 176543 - RNA, 22 nt, Homo sapiens
augguuuauuuguaagcagagu

SEQ ID NO: 176544 - RNA, 22 nt, Homo sapiens
augguuugugcuccuauaagaa

SEQ ID NO: 176545 - RNA, 22 nt, Homo sapiens
auguaaacuacagauuuugggu

SEQ ID NO: 176546 - RNA, 22 nt, Homo sapiens
auguaacaguauuuggagaugu

SEQ ID NO: 176547 - RNA, 22 nt, Homo sapiens
auguaauguuaaauugcuaauu

SEQ ID NO: 176548 - RNA, 22 nt, Homo sapiens
auguaguagauauuuauggaaa

SEQ ID NO: 176549 - RNA, 22 nt, Homo sapiens
augucauagaagccugugaacc

SEQ ID NO: 176550 - RNA, 22 nt, Homo sapiens
augucauagauaaggaagugga

SEQ ID NO: 176551 - RNA, 21 nt, Homo sapiens
augucauggaugacuaauuca

SEQ ID NO: 176552 - RNA, 22 nt, Homo sapiens
auguccaugagcacauguauca

SEQ ID NO: 176553 - RNA, 22 nt, Homo sapiens
auguccuagagagauggugguc

SEQ ID NO: 176554 - RNA, 22 nt, Homo sapiens
augucugguagccaccuggagg

SEQ ID NO: 176555 - RNA, 22 nt, Homo sapiens
augugaacaucauagaaugcac

SEQ ID NO: 176556 - RNA, 22 nt, Homo sapiens
augugaaugugaucggauaguc

SEQ ID NO: 176557 - RNA, 22 nt, Homo sapiens
augugacagcaacccccagccc

SEQ ID NO: 176558 - RNA, 22 nt, Homo sapiens
augugcaacugcuggaacaguc

SEQ ID NO: 176559 - RNA, 22 nt, Homo sapiens
augugcaagaucauuaaagcuc

SEQ ID NO: 176560 - RNA, 22 nt, Homo sapiens
augugcaauggugucaccacau

SEQ ID NO: 176561 - RNA, 22 nt, Homo sapiens
augugcaauguguacguagccc

SEQ ID NO: 176562 - RNA, 22 nt, Homo sapiens
augugcacaacgugcagguuug

SEQ ID NO: 176563 - RNA, 22 nt, Homo sapiens
augugcauaugaagcacagaca

SEQ ID NO: 176564 - RNA, 22 nt, Homo sapiens
augugcuaguaucaaacgagac

SEQ ID NO: 176565 - RNA, 22 nt, Homo sapiens
augugcuuuuuaaacagaugcu

SEQ ID NO: 176566 - RNA, 22 nt, Homo sapiens
augugggaggacuuggcuguug

SEQ ID NO: 176567 - RNA, 19 nt, Homo sapiens
augugguuagcaugacugc

SEQ ID NO: 176568 - RNA, 22 nt, Homo sapiens
augugucaaaucuaggccaaag

SEQ ID NO: 176569 - RNA, 22 nt, Homo sapiens
augugugaaucccagaaccugu

SEQ ID NO: 176570 - RNA, 22 nt, Homo sapiens
augugugcuugauguaaaaagu

SEQ ID NO: 176571 - RNA, 22 nt, Homo sapiens
auguguucaucacagcacaauu

SEQ ID NO: 176572 - RNA, 22 nt, Homo sapiens
auguuagcaucaauauucauca

SEQ ID NO: 176573 - RNA, 18 nt, Homo sapiens
auguuauguuuguagaag

SEQ ID NO: 176574 - RNA, 22 nt, Homo sapiens
auguuugguagugaauauggua

SEQ ID NO: 176575 - RNA, 22 nt, Homo sapiens
auuaaguaaugguuccaauaau

SEQ ID NO: 176576 - RNA, 22 nt, Homo sapiens
auuaagugcuugccagugcugg

SEQ ID NO: 176577 - RNA, 22 nt, Homo sapiens
auuagguaauauaaucauggca

SEQ ID NO: 176578 - RNA, 22 nt, Homo sapiens
auuagguuagugcaaaaguaau

SEQ ID NO: 176579 - RNA, 22 nt, Homo sapiens
auucaaggacuggauugcggga

SEQ ID NO: 176580 - RNA, 20 nt, Homo sapiens
auucaaguaugccuugagaa

SEQ ID NO: 176581 - RNA, 22 nt, Homo sapiens
auucaagugaugcagcuguuuu

SEQ ID NO: 176582 - RNA, 22 nt, Homo sapiens
auucacagcuuuaaaaggcgug

SEQ ID NO: 176583 - RNA, 22 nt, Homo sapiens
auucacuuuuauagacaggucu

SEQ ID NO: 176584 - RNA, 22 nt, Homo sapiens
auucaugggagcuacuuuaaaa

SEQ ID NO: 176585 - RNA, 22 nt, Homo sapiens
auuccacagccgauaccaugac

SEQ ID NO: 176586 - RNA, 22 nt, Homo sapiens
auuccacuuauaugagguaucu

SEQ ID NO: 176587 - RNA, 21 nt, Homo sapiens
auuccacuuuuccuucaggga

SEQ ID NO: 176588 - RNA, 22 nt, Homo sapiens
auuccaguggguuuacauccca

SEQ ID NO: 176589 - RNA, 22 nt, Homo sapiens
auucccuguagaauaaggaugg

SEQ ID NO: 176590 - RNA, 18 nt, Homo sapiens
auucuacaggccuuuuga

SEQ ID NO: 176591 - RNA, 22 nt, Homo sapiens
auugaacacuucugugugccag

SEQ ID NO: 176592 - RNA, 22 nt, Homo sapiens
auugaacaugccauauguacca

SEQ ID NO: 176593 - RNA, 22 nt, Homo sapiens
auugaacuuuugucacugacau

SEQ ID NO: 176594 - RNA, 22 nt, Homo sapiens
auugaaucuaaaaugagucucu

SEQ ID NO: 176595 - RNA, 22 nt, Homo sapiens
auugacuugauauauagcugau

SEQ ID NO: 176596 - RNA, 22 nt, Homo sapiens
auugagcaaggucuccuaguau

SEQ ID NO: 176597 - RNA, 22 nt, Homo sapiens
auugagcacugacucugugcca

SEQ ID NO: 176598 - RNA, 22 nt, Homo sapiens
auugagucauuucaaauccaag

SEQ ID NO: 176599 - RNA, 22 nt, Homo sapiens
auugauaguuuaauaggaauug

SEQ ID NO: 176600 - RNA, 22 nt, Homo sapiens
auugcacuccagcccugcugac

SEQ ID NO: 176601 - RNA, 22 nt, Homo sapiens
auugcacuccagccuagguaac

SEQ ID NO: 176602 - RNA, 22 nt, Homo sapiens
auugcacuccagccugggcagc

SEQ ID NO: 176603 - RNA, 21 nt, Homo sapiens
auugcacuccagccugggcga

SEQ ID NO: 176604 - RNA, 22 nt, Homo sapiens
auugcacuccagccuggggaac

SEQ ID NO: 176605 - RNA, 22 nt, Homo sapiens
auugcacuccagccuggugaca

SEQ ID NO: 176606 - RNA, 22 nt, Homo sapiens
auugcacuccagccuugacaca

SEQ ID NO: 176607 - RNA, 22 nt, Homo sapiens
auugcacuccagccuugggcaa

SEQ ID NO: 176608 - RNA, 22 nt, Homo sapiens
auugcacuccagucugggcaac

SEQ ID NO: 176609 - RNA, 22 nt, Homo sapiens
auugcacuccauccugggcaau

SEQ ID NO: 176610 - RNA, 18 nt, Homo sapiens
auugcacuccugccuggg

SEQ ID NO: 176611 - RNA, 22 nt, Homo sapiens
auugcacucuaaccuaggugac

SEQ ID NO: 176612 - RNA, 22 nt, Homo sapiens
auugcacucugaucugcacucc

SEQ ID NO: 176613 - RNA, 22 nt, Homo sapiens
auugcagauucgcuuuguguug

SEQ ID NO: 176614 - RNA, 22 nt, Homo sapiens
auugcccaggcuggagugcagu

SEQ ID NO: 176615 - RNA, 23 nt, Homo sapiens
auugcccuugaaggcuaaacucu

SEQ ID NO: 176616 - RNA, 22 nt, Homo sapiens
auugcuauuauuugaccauugu

SEQ ID NO: 176617 - RNA, 22 nt, Homo sapiens
auugcugagacauugcuaaucu

SEQ ID NO: 176618 - RNA, 22 nt, Homo sapiens
auuggccaaugggacgucagca

SEQ ID NO: 176619 - RNA, 22 nt, Homo sapiens
auuggcuauuuggugagugauu

SEQ ID NO: 176620 - RNA, 22 nt, Homo sapiens
auuguacuccagccuaggcaac

SEQ ID NO: 176621 - RNA, 22 nt, Homo sapiens
auuguacuccagccugggcagc

SEQ ID NO: 176622 - RNA, 22 nt, Homo sapiens
auuguacuccagccugggcgac

SEQ ID NO: 176623 - RNA, 22 nt, Homo sapiens
auugucauuuauaacuguguag

SEQ ID NO: 176624 - RNA, 22 nt, Homo sapiens
auuuagcaauggagguagugua

SEQ ID NO: 176625 - RNA, 22 nt, Homo sapiens
auuuaugguuaauauaggaagu

SEQ ID NO: 176626 - RNA, 22 nt, Homo sapiens
auuugacacugagagccucagu

SEQ ID NO: 176627 - RNA, 21 nt, Homo sapiens
auuugcacugagcuccugugc

SEQ ID NO: 176628 - RNA, 22 nt, Homo sapiens
auuuggccuuuguaugcaguau

SEQ ID NO: 176629 - RNA, 22 nt, Homo sapiens
ugugccuaguaauguguccaga

SEQ ID NO: 176630 - RNA, 22 nt, Homo sapiens
ugugccuucuaagaaggagucu

SEQ ID NO: 176631 - RNA, 22 nt, Homo sapiens
ugugcgugugccuguaagaauu

SEQ ID NO: 176632 - RNA, 22 nt, Homo sapiens
uguggaaauaaaagaaagguua

SEQ ID NO: 176633 - RNA, 22 nt, Homo sapiens
uguggccuuuguuucaguuggg

SEQ ID NO: 176634 - RNA, 22 nt, Homo sapiens
ugugguauuagguguaguaucu

SEQ ID NO: 176635 - RNA, 22 nt, Homo sapiens
ugugguuuuuuucuccaauagg

SEQ ID NO: 176636 - RNA, 22 nt, Homo sapiens
uguguaaagcuuguuccagaaa

SEQ ID NO: 176637 - RNA, 22 nt, Homo sapiens
uguguacugcagaguauucugu

SEQ ID NO: 176638 - RNA, 22 nt, Homo sapiens
uguguagagaaauauuacuuau

SEQ ID NO: 176639 - RNA, 22 nt, Homo sapiens
ugugucacugcacuccagcgug

SEQ ID NO: 176640 - RNA, 22 nt, Homo sapiens
ugugucuacugagaugaucaug

SEQ ID NO: 176641 - RNA, 22 nt, Homo sapiens
ugugucuugagagucucgagaa

SEQ ID NO: 176642 - RNA, 22 nt, Homo sapiens
ugugucuuuuaucacacaaugu

SEQ ID NO: 176643 - RNA, 22 nt, Homo sapiens
uguuaagaugucaauuuuccac

SEQ ID NO: 176644 - RNA, 22 nt, Homo sapiens
uguuacagugacuaauguuuua

SEQ ID NO: 176645 - RNA, 22 nt, Homo sapiens
uguuauguauggagugauccca

SEQ ID NO: 176646 - RNA, 22 nt, Homo sapiens
uguuauguuguuugagaaaguc

SEQ ID NO: 176647 - RNA, 22 nt, Homo sapiens
uguucacaguguuucuuugaga

SEQ ID NO: 176648 - RNA, 22 nt, Homo sapiens
uguucaugaguucucauuuuua

SEQ ID NO: 176649 - RNA, 19 nt, Homo sapiens
uguugcacuccagcuuggg

SEQ ID NO: 176650 - RNA, 22 nt, Homo sapiens
uguugcauuugucaaggucaag

SEQ ID NO: 176651 - RNA, 22 nt, Homo sapiens
uguuugcuguuuucuccaauga

SEQ ID NO: 176652 - RNA, 22 nt, Homo sapiens
uguuuguuugauaugggauaaa

SEQ ID NO: 176653 - RNA, 22 nt, Homo sapiens
uguuuuggagguccucacuaga

SEQ ID NO: 176654 - RNA, 22 nt, Homo sapiens
uguuuuguuagcacucugggaa

SEQ ID NO: 176655 - RNA, 21 nt, Homo sapiens
uguuuuugcuguguaucucuc

SEQ ID NO: 176656 - RNA, 22 nt, Homo sapiens
uuaaaagcuaucuccaagguca

SEQ ID NO: 176657 - RNA, 22 nt, Homo sapiens
uuaaagcgacucucaugccuca

SEQ ID NO: 176658 - RNA, 22 nt, Homo sapiens
uuaaauacagcaugguguuucu

SEQ ID NO: 176659 - RNA, 22 nt, Homo sapiens
uuaaaugcauagaauguguagu

SEQ ID NO: 176660 - RNA, 22 nt, Homo sapiens
uuaaaugcuagaauuuucuuug

SEQ ID NO: 176661 - RNA, 22 nt, Homo sapiens
uuaacacugccauugauacugu

SEQ ID NO: 176662 - RNA, 21 nt, Homo sapiens
uuaacagacaagugucuuccc

SEQ ID NO: 176663 - RNA, 22 nt, Homo sapiens
uuaacagucacuuagcucauuu

SEQ ID NO: 176664 - RNA, 22 nt, Homo sapiens
uuaagaagugauuuuccucauu

SEQ ID NO: 176665 - RNA, 22 nt, Homo sapiens
uuaagcaaagguaacaugagaa

SEQ ID NO: 176666 - RNA, 22 nt, Homo sapiens
uuaagcucauuuccauucuaca

SEQ ID NO: 176667 - RNA, 22 nt, Homo sapiens
uuaaggaguagugucugguauu

SEQ ID NO: 176668 - RNA, 22 nt, Homo sapiens
uuaaggcagugcaucuggaguu

SEQ ID NO: 176669 - RNA, 22 nt, Homo sapiens
uuaaggcuccuguuggcuuuua

SEQ ID NO: 176670 - RNA, 23 nt, Homo sapiens
uuaaggugaugucuuugugccuc

SEQ ID NO: 176671 - RNA, 22 nt, Homo sapiens
uuaaguaaucagagaagagaac

SEQ ID NO: 176672 - RNA, 21 nt, Homo sapiens
uuaaguaauuacccaacucuc

SEQ ID NO: 176673 - RNA, 22 nt, Homo sapiens
uuaaguagaugaaugugaaugu

SEQ ID NO: 176674 - RNA, 22 nt, Homo sapiens
uuaagugaauuaucuaacaugu

SEQ ID NO: 176675 - RNA, 22 nt, Homo sapiens
uuaauacugcuuaacuuuagga

SEQ ID NO: 176676 - RNA, 22 nt, Homo sapiens
uuaauagcaaagaguuuagacu

SEQ ID NO: 176677 - RNA, 22 nt, Homo sapiens
uuaaugaacuuuauuuuguaga

SEQ ID NO: 176678 - RNA, 21 nt, Homo sapiens
uuaaugcuaugcagaaaaucu

SEQ ID NO: 176679 - RNA, 22 nt, Homo sapiens
uuaauuguccaaguucaucucu

SEQ ID NO: 176680 - RNA, 22 nt, Homo sapiens
uuacagcugggugugucuggua

SEQ ID NO: 176681 - RNA, 22 nt, Homo sapiens
uuacaggacuaagcagcuuugc

SEQ ID NO: 176682 - RNA, 22 nt, Homo sapiens
uuacagguggagaaguaaggcu

SEQ ID NO: 176683 - RNA, 22 nt, Homo sapiens
uuacaguauugcaaggacuagg

SEQ ID NO: 176684 - RNA, 22 nt, Homo sapiens
uuacagucaaguuacauuucuc

SEQ ID NO: 176685 - RNA, 21 nt, Homo sapiens
uuacaguugguugugaggugg

SEQ ID NO: 176686 - RNA, 22 nt, Homo sapiens
uuacaugagacugucgcuaguu

SEQ ID NO: 176687 - RNA, 22 nt, Homo sapiens
uuacauguggugugaagaagag

SEQ ID NO: 176688 - RNA, 22 nt, Homo sapiens
uuaccagucuagggcucaguuu

SEQ ID NO: 176689 - RNA, 22 nt, Homo sapiens
uuacugcuagcugugugcucuu

SEQ ID NO: 176690 - RNA, 22 nt, Homo sapiens
uuacuggcuuucacugguguua

SEQ ID NO: 176691 - RNA, 22 nt, Homo sapiens
uuacuguagugucauaucguau

SEQ ID NO: 176692 - RNA, 22 nt, Homo sapiens
uuagaacagugcucaccacaaa

SEQ ID NO: 176693 - RNA, 22 nt, Homo sapiens
uuagaguguagcaggaagaggc

SEQ ID NO: 176694 - RNA, 22 nt, Homo sapiens
uuagauaguacuuagggaaaua

SEQ ID NO: 176695 - RNA, 22 nt, Homo sapiens
uuagauuauugagcauccacug

SEQ ID NO: 176696 - RNA, 22 nt, Homo sapiens
uuagcaauagccugcaucugca

SEQ ID NO: 176697 - RNA, 22 nt, Homo sapiens
uuagcaccacacacuuuagagg

SEQ ID NO: 176698 - RNA, 22 nt, Homo sapiens
uuagcaguggauggguggagaa

SEQ ID NO: 176699 - RNA, 21 nt, Homo sapiens
uuagcauccauguucaucaac

SEQ ID NO: 176700 - RNA, 22 nt, Homo sapiens
uuaggcaggauaguuacauauu

SEQ ID NO: 176701 - RNA, 22 nt, Homo sapiens
uuaggcaguuuauugauuuuca

SEQ ID NO: 176702 - RNA, 22 nt, Homo sapiens
uuaggcuuuucagacacuucau

SEQ ID NO: 176703 - RNA, 23 nt, Homo sapiens
uuaguaaacucaaugacaccaca

SEQ ID NO: 176704 - RNA, 22 nt, Homo sapiens
uuaguaguagugcuguaauuuu

SEQ ID NO: 176705 - RNA, 20 nt, Homo sapiens
uuaguucauuuagaagguuu

SEQ ID NO: 176706 - RNA, 22 nt, Homo sapiens
uuaguuuaucagugguuucuga

SEQ ID NO: 176707 - RNA, 20 nt, Homo sapiens
uuauaacuuuuguucugggg

SEQ ID NO: 176708 - RNA, 22 nt, Homo sapiens
uuauacuacuauaaagagguag

SEQ ID NO: 176709 - RNA, 18 nt, Homo sapiens
uuauacuccccaggcaau

SEQ ID NO: 176710 - RNA, 22 nt, Homo sapiens
uuauauguuacucccucuagca

SEQ ID NO: 176711 - RNA, 22 nt, Homo sapiens
uuauauguuucuguuuggaggc

SEQ ID NO: 176712 - RNA, 22 nt, Homo sapiens
uuaucccacuuucuguuccugu

SEQ ID NO: 176713 - RNA, 22 nt, Homo sapiens
uuaugccagugauuauaagggc

SEQ ID NO: 176714 - RNA, 22 nt, Homo sapiens
uuaugcuguuuucuggagauuu

SEQ ID NO: 176715 - RNA, 22 nt, Homo sapiens
uuauggccauucuuguaggagu

SEQ ID NO: 176716 - RNA, 22 nt, Homo sapiens
uuauggcuauugaugacaauug

SEQ ID NO: 176717 - RNA, 22 nt, Homo sapiens
uuaugggucuuggaaugcaaua

SEQ ID NO: 176718 - RNA, 22 nt, Homo sapiens
uuauguccuuuaacuucaucac

SEQ ID NO: 176719 - RNA, 22 nt, Homo sapiens
uuaugugccuuuuugccauuca

SEQ ID NO: 176720 - RNA, 22 nt, Homo sapiens
uuauuagagauauuugguuagg

SEQ ID NO: 176721 - RNA, 22 nt, Homo sapiens
uuauuauguuggugcaaaggua

SEQ ID NO: 176722 - RNA, 22 nt, Homo sapiens
uuauugcuuuugugcaggugag

SEQ ID NO: 176723 - RNA, 22 nt, Homo sapiens
uucaaaaccucugcuuaagccc

SEQ ID NO: 176724 - RNA, 22 nt, Homo sapiens
uucaaaggauuuagauuagcua

SEQ ID NO: 176725 - RNA, 22 nt, Homo sapiens
uucaaaguaaagggauggagac

SEQ ID NO: 176726 - RNA, 22 nt, Homo sapiens
uucaacagugauggccuuugua

SEQ ID NO: 176727 - RNA, 22 nt, Homo sapiens
uucaagaauuaaaguggcuuuu

SEQ ID NO: 176728 - RNA, 22 nt, Homo sapiens
uucaaguguucaggagcuacag

SEQ ID NO: 176729 - RNA, 22 nt, Homo sapiens
uucaauacuguugauccuuaug

SEQ ID NO: 176730 - RNA, 21 nt, Homo sapiens
uucacaagggaaguagggggc

SEQ ID NO: 176731 - RNA, 22 nt, Homo sapiens
uucacaaugccuuguugauggu

SEQ ID NO: 176732 - RNA, 22 nt, Homo sapiens
uucacacuagccacucugguag

SEQ ID NO: 176733 - RNA, 22 nt, Homo sapiens
uucacagaaaaaggcgaugagg

SEQ ID NO: 176734 - RNA, 22 nt, Homo sapiens
uucacagacaacuggucccuua

SEQ ID NO: 176735 - RNA, 22 nt, Homo sapiens
uucacagaguuauuuuuaugcu

SEQ ID NO: 176736 - RNA, 22 nt, Homo sapiens
uucacaguguuucucacgguua

SEQ ID NO: 176737 - RNA, 22 nt, Homo sapiens
uucaccagggaagucucaacuc

SEQ ID NO: 176738 - RNA, 22 nt, Homo sapiens
gagcaaugagcugccugcugag

SEQ ID NO: 176739 - RNA, 22 nt, Homo sapiens
gagcaaugauugagccacugua

SEQ ID NO: 176740 - RNA, 20 nt, Homo sapiens
gagcaucacaggccucugcu

SEQ ID NO: 176741 - RNA, 22 nt, Homo sapiens
gagcaucaguggccucaucuca

SEQ ID NO: 176742 - RNA, 22 nt, Homo sapiens
gagcccauuucacuuguccagc

SEQ ID NO: 176743 - RNA, 22 nt, Homo sapiens
gagcuagggucaugcuacugca

SEQ ID NO: 176744 - RNA, 22 nt, Homo sapiens
gagcuaguagauuuuaaauauu

SEQ ID NO: 176745 - RNA, 22 nt, Homo sapiens
gauguguugggaagauuucaag

SEQ ID NO: 176746 - RNA, 22 nt, Homo sapiens
gauguguuuguuucuggaggag

SEQ ID NO: 176747 - RNA, 22 nt, Homo sapiens
gauuucaucuuuagaggaagga

SEQ ID NO: 176748 - RNA, 22 nt, Homo sapiens
gauuugagagaggguguuuaua

SEQ ID NO: 176749 - RNA, 21 nt, Homo sapiens
gcaaaguggcuaccuugcucc

SEQ ID NO: 176750 - RNA, 22 nt, Homo sapiens
gcaaaguguuuuuaggaagucu

SEQ ID NO: 176751 - RNA, 22 nt, Homo sapiens
gcaaaucuuauguccucacauu

SEQ ID NO: 176752 - RNA, 22 nt, Homo sapiens
gcaaaugcuacaccauuuugua

SEQ ID NO: 176753 - RNA, 22 nt, Homo sapiens
gcaacugguuucaguuuuucag

SEQ ID NO: 176754 - RNA, 22 nt, Homo sapiens
gcaagaaugagaaggauuaauu

SEQ ID NO: 176755 - RNA, 22 nt, Homo sapiens
gcaagaauggaacaggagagcc

SEQ ID NO: 176756 - RNA, 22 nt, Homo sapiens
gcacacuuacacgaaccuagau

SEQ ID NO: 176757 - RNA, 22 nt, Homo sapiens
gcacaguggcucccgucuauaa

SEQ ID NO: 176758 - RNA, 22 nt, Homo sapiens
gcacauuacaaguauuagcuca

SEQ ID NO: 176759 - RNA, 17 nt, Homo sapiens
gcacuggcguaucccac

SEQ ID NO: 176760 - RNA, 22 nt, Homo sapiens
gcagaauugacucuguuuuuuc

SEQ ID NO: 176761 - RNA, 22 nt, Homo sapiens
gcagaauugguuucuucuaagg

SEQ ID NO: 176762 - RNA, 19 nt, Homo sapiens
gcagagaugugguagcuug

SEQ ID NO: 176763 - RNA, 23 nt, Homo sapiens
gcagcaaugucacagggguccgg

SEQ ID NO: 176764 - RNA, 22 nt, Homo sapiens
gcagcacaugacuguauguaua

SEQ ID NO: 176765 - RNA, 22 nt, Homo sapiens
gcagcagugcccuggauggaaa

SEQ ID NO: 176766 - RNA, 22 nt, Homo sapiens
gcagcaguggcaguuaauauuu

SEQ ID NO: 176767 - RNA, 22 nt, Homo sapiens
gcagcagugugggcugaaccua

SEQ ID NO: 176768 - RNA, 22 nt, Homo sapiens
gcaggaauuucucugcagaccc

SEQ ID NO: 176769 - RNA, 22 nt, Homo sapiens
gcaggauuggagccucucugaa

SEQ ID NO: 176770 - RNA, 22 nt, Homo sapiens
gcagguguuaugcaaacaacug

SEQ ID NO: 176771 - RNA, 22 nt, Homo sapiens
gcagucaucugaaggcuuaacu

SEQ ID NO: 176772 - RNA, 22 nt, Homo sapiens
gcagugacaugugccaguuuau

SEQ ID NO: 176773 - RNA, 22 nt, Homo sapiens
gcaguguucaaaucaugcccau

SEQ ID NO: 176774 - RNA, 22 nt, Homo sapiens
gcaugacaaugauugcucuuca

SEQ ID NO: 176775 - RNA, 20 nt, Homo sapiens
gcaugagucuuuauaguaga

SEQ ID NO: 176776 - RNA, 22 nt, Homo sapiens
gcaugaugaauaauaucacaag

SEQ ID NO: 176777 - RNA, 22 nt, Homo sapiens
gcaugugaauguguaagaaaau

SEQ ID NO: 176778 - RNA, 22 nt, Homo sapiens
gccagauuguccaguuuuuuau

SEQ ID NO: 176779 - RNA, 22 nt, Homo sapiens
gccauggaggauuuauagaggc

SEQ ID NO: 176780 - RNA, 22 nt, Homo sapiens
gccauggugucuuauuuuugug

SEQ ID NO: 176781 - RNA, 22 nt, Homo sapiens
gccauugcacuacagccuaggc

SEQ ID NO: 176782 - RNA, 22 nt, Homo sapiens
gccauugcacuccagccuaggc

SEQ ID NO: 176783 - RNA, 22 nt, Homo sapiens
gccauugcacuccagccuaggu

SEQ ID NO: 176784 - RNA, 22 nt, Homo sapiens
gccauugcacuccagccucggg

SEQ ID NO: 176785 - RNA, 22 nt, Homo sapiens
gccauugcacucuagccuaggu

SEQ ID NO: 176786 - RNA, 22 nt, Homo sapiens
gccccugagacuugccucgggc

SEQ ID NO: 176787 - RNA, 22 nt, Homo sapiens
gcccugagauucuuggauucug

SEQ ID NO: 176788 - RNA, 22 nt, Homo sapiens
gcccugauacauucuucugccu

SEQ ID NO: 176789 - RNA, 22 nt, Homo sapiens
gcggguguuuuacccuugcaga

SEQ ID NO: 176790 - RNA, 22 nt, Homo sapiens
gcgguagcauagacugcaggac

SEQ ID NO: 176791 - RNA, 22 nt, Homo sapiens
gcucaguuuccucagcugcaaa

SEQ ID NO: 176792 - RNA, 22 nt, Homo sapiens
gcuccauuuuccauuucucuaa

SEQ ID NO: 176793 - RNA, 22 nt, Homo sapiens
gcucuuuugggguaauucugag

SEQ ID NO: 176794 - RNA, 22 nt, Homo sapiens
gcugacacugggcuauagaucu

SEQ ID NO: 176795 - RNA, 22 nt, Homo sapiens
gcugagacauugguuuucuccu

SEQ ID NO: 176796 - RNA, 22 nt, Homo sapiens
gcugagaucucuugccugaacu

SEQ ID NO: 176797 - RNA, 22 nt, Homo sapiens
gcugaguaguauuucauuguau

SEQ ID NO: 176798 - RNA, 22 nt, Homo sapiens
gcugauggugcaguucuagccu

SEQ ID NO: 176799 - RNA, 22 nt, Homo sapiens
gcugauguuggccucugggcuu

SEQ ID NO: 176800 - RNA, 22 nt, Homo sapiens
gcugcuguggcagauuggauuc

SEQ ID NO: 176801 - RNA, 22 nt, Homo sapiens
gcuggcuuucuccugaucucag

SEQ ID NO: 176802 - RNA, 22 nt, Homo sapiens
gcuggguucagagugggcugcg

SEQ ID NO: 176803 - RNA, 22 nt, Homo sapiens
gcugucuggagucuguucaaug

SEQ ID NO: 176804 - RNA, 22 nt, Homo sapiens
gcuguguucucgaggcggggga

SEQ ID NO: 176805 - RNA, 22 nt, Homo sapiens
gcuguugguaaaaaggacauga

SEQ ID NO: 176806 - RNA, 22 nt, Homo sapiens
gcuguuugccgccaucgcagac

SEQ ID NO: 176807 - RNA, 22 nt, Homo sapiens
gcuuggugugcaagugguacua

SEQ ID NO: 176808 - RNA, 22 nt, Homo sapiens
gcuuuguuguugaugggaaauc

SEQ ID NO: 176809 - RNA, 22 nt, Homo sapiens
ggaaagacaccuuacuauguua

SEQ ID NO: 176810 - RNA, 22 nt, Homo sapiens
ugagaacugguagcacuuguga

SEQ ID NO: 176811 - RNA, 22 nt, Homo sapiens
ugagaagcauaccagugucugu

SEQ ID NO: 176812 - RNA, 22 nt, Homo sapiens
ugagacauauuauacugcuuuu

SEQ ID NO: 176813 - RNA, 22 nt, Homo sapiens
ugagacaucucuccugagacag

SEQ ID NO: 176814 - RNA, 22 nt, Homo sapiens
ugagacaugugaauauuuguac

SEQ ID NO: 176815 - RNA, 22 nt, Homo sapiens
ugagacgaagucuugcucuguu

SEQ ID NO: 176816 - RNA, 22 nt, Homo sapiens
ugagacggagucucacucuguu

SEQ ID NO: 176817 - RNA, 22 nt, Homo sapiens
ugagacggagucucgcucuguc

SEQ ID NO: 176818 - RNA, 22 nt, Homo sapiens
ugagacggagucucgcucuguu

SEQ ID NO: 176819 - RNA, 22 nt, Homo sapiens
ugagacggagucuggcacuguc

SEQ ID NO: 176820 - RNA, 22 nt, Homo sapiens
ugagacggagucuugcucuguc

SEQ ID NO: 176821 - RNA, 22 nt, Homo sapiens
ugagacugagucucgcucuugu

SEQ ID NO: 176822 - RNA, 22 nt, Homo sapiens
ugagacugagucuugcucuauu

SEQ ID NO: 176823 - RNA, 22 nt, Homo sapiens
ugagacugagucuugcucuugu

SEQ ID NO: 176824 - RNA, 22 nt, Homo sapiens
ugagacuguuuuggggaacuuc

SEQ ID NO: 176825 - RNA, 22 nt, Homo sapiens
ugagagacaguuucgucggagg

SEQ ID NO: 176826 - RNA, 22 nt, Homo sapiens
ugagauaaggaaauugaggcuc

SEQ ID NO: 176827 - RNA, 22 nt, Homo sapiens
ugagauaaucaugugguuuuug

SEQ ID NO: 176828 - RNA, 22 nt, Homo sapiens
ugagauaguacuuuuuuaaagg

SEQ ID NO: 176829 - RNA, 22 nt, Homo sapiens
ugagauaucauuucacacccag

SEQ ID NO: 176830 - RNA, 22 nt, Homo sapiens
ugagaucaacugagucagagca

SEQ ID NO: 176831 - RNA, 22 nt, Homo sapiens
ugagaucuguaaagucugacau

SEQ ID NO: 176832 - RNA, 22 nt, Homo sapiens
ugagaucuucgcucuucacaga

SEQ ID NO: 176833 - RNA, 22 nt, Homo sapiens
ugagaucuuggaggcuuuguga

SEQ ID NO: 176834 - RNA, 23 nt, Homo sapiens
ggcagguuggucuaggucuauuc

SEQ ID NO: 176835 - RNA, 22 nt, Homo sapiens
ggcaguuuggcaguuucauaaa

SEQ ID NO: 176836 - RNA, 22 nt, Homo sapiens
ggcaguuuguucuugcuccuuu

SEQ ID NO: 176837 - RNA, 21 nt, Homo sapiens
ggcaugaauggaaaagugaga

SEQ ID NO: 176838 - RNA, 22 nt, Homo sapiens
ggcaugaggccauaaaaguaag

SEQ ID NO: 176839 - RNA, 22 nt, Homo sapiens
ggcauguguggguuauuaaaga

SEQ ID NO: 176840 - RNA, 22 nt, Homo sapiens
ggccggguggccauggcugccc

SEQ ID NO: 176841 - RNA, 22 nt, Homo sapiens
ggcuagagacaaguugcugaga

SEQ ID NO: 176842 - RNA, 22 nt, Homo sapiens
ggcuagagagcucagggauaug

SEQ ID NO: 176843 - RNA, 22 nt, Homo sapiens
ggcucguguuuucuguccaguu

SEQ ID NO: 176844 - RNA, 22 nt, Homo sapiens
ggcucuguugcuaccaauuaag

SEQ ID NO: 176845 - RNA, 22 nt, Homo sapiens
gggaagugugcagaguucucuu

SEQ ID NO: 176846 - RNA, 18 nt, Homo sapiens
gggaauauggggaguuga

SEQ ID NO: 176847 - RNA, 22 nt, Homo sapiens
gggaguguguaggacccagugu

SEQ ID NO: 176848 - RNA, 22 nt, Homo sapiens
gggaugaagaagaauaguucgu

SEQ ID NO: 176849 - RNA, 22 nt, Homo sapiens
gggaugaagcccuaggguuggu

SEQ ID NO: 176850 - RNA, 22 nt, Homo sapiens
gggauuauugugauuucauguu

SEQ ID NO: 176851 - RNA, 22 nt, Homo sapiens
gggcaaaacuguacugccaagg

SEQ ID NO: 176852 - RNA, 21 nt, Homo sapiens
gggcaaaucuuuauccuaagc

SEQ ID NO: 176853 - RNA, 22 nt, Homo sapiens
gggcaaauuauguaucucucag

SEQ ID NO: 176854 - RNA, 22 nt, Homo sapiens
gggcaacauugaguacccugaa

SEQ ID NO: 176855 - RNA, 18 nt, Homo sapiens
gggcaaguugccuggcuu

SEQ ID NO: 176856 - RNA, 22 nt, Homo sapiens
gggcaugauggugcacacaugu

SEQ ID NO: 176857 - RNA, 22 nt, Homo sapiens
gggcaugugugugcacacacau

SEQ ID NO: 176858 - RNA, 23 nt, Homo sapiens
gggcuagaugagagcuuccuggg

SEQ ID NO: 176859 - RNA, 22 nt, Homo sapiens
ggggaguguggacaucacccug

SEQ ID NO: 176860 - RNA, 22 nt, Homo sapiens
ggggcaaaaugccacgagucuc

SEQ ID NO: 176861 - RNA, 22 nt, Homo sapiens
gggguaggcuacacugaguucc

SEQ ID NO: 176862 - RNA, 22 nt, Homo sapiens
gggguuuuaccuucguauucuu

SEQ ID NO: 176863 - RNA, 17 nt, Homo sapiens
gggucaccuugcaggua

SEQ ID NO: 176864 - RNA, 22 nt, Homo sapiens
gguaacaguggggcuaugcuua

SEQ ID NO: 176865 - RNA, 22 nt, Homo sapiens
gguacagcuaguuaaacauuug

SEQ ID NO: 176866 - RNA, 22 nt, Homo sapiens
gguagacucuguaagugaucau

SEQ ID NO: 176867 - RNA, 22 nt, Homo sapiens
gguaucuuggagagagaaguga

SEQ ID NO: 176868 - RNA, 19 nt, Homo sapiens
ggucacagggguuacaagg

SEQ ID NO: 176869 - RNA, 19 nt, Homo sapiens
ggucagcaaagucuagcug

SEQ ID NO: 176870 - RNA, 22 nt, Homo sapiens
ggucagugcauucuaaaggcaa

SEQ ID NO: 176871 - RNA, 22 nt, Homo sapiens
ggucaguguuaucaccgaagga

SEQ ID NO: 176872 - RNA, 19 nt, Homo sapiens
ggucauggagguuguguga

SEQ ID NO: 176873 - RNA, 22 nt, Homo sapiens
ggucauggauaagauccagaag

SEQ ID NO: 176874 - RNA, 22 nt, Homo sapiens
ggucccccuccacucucgcaaa

SEQ ID NO: 176875 - RNA, 22 nt, Homo sapiens
ggugacagugguuaaaauuugu

SEQ ID NO: 176876 - RNA, 22 nt, Homo sapiens
ggugacugguuuaucuggcagu

SEQ ID NO: 176877 - RNA, 22 nt, Homo sapiens
ggugcuugaggaacggaggcug

SEQ ID NO: 176878 - RNA, 22 nt, Homo sapiens
gguggugguauuucagaaaaug

SEQ ID NO: 176879 - RNA, 22 nt, Homo sapiens
ggugucuuguuuaauacucauu

SEQ ID NO: 176880 - RNA, 22 nt, Homo sapiens
guaaagacacaugcacacguau

SEQ ID NO: 176881 - RNA, 22 nt, Homo sapiens
guaaaguaaagcacaucaaggu

SEQ ID NO: 176882 - RNA, 22 nt, Homo sapiens
guaaauaccaguuucuggaaca

SEQ ID NO: 176883 - RNA, 22 nt, Homo sapiens
guaaauguccccugugauauug

SEQ ID NO: 176884 - RNA, 22 nt, Homo sapiens
guaacacucuaaagggaugcac

SEQ ID NO: 176885 - RNA, 22 nt, Homo sapiens
guaacagucucaacaguggucu

SEQ ID NO: 176886 - RNA, 22 nt, Homo sapiens
guaagagcauguaguggcucua

SEQ ID NO: 176887 - RNA, 22 nt, Homo sapiens
guaaucucagcuacucgggagg

SEQ ID NO: 176888 - RNA, 22 nt, Homo sapiens
guacacaacaugcagguuuguu

SEQ ID NO: 176889 - RNA, 16 nt, Homo sapiens
guacacaguaaguaug

SEQ ID NO: 176890 - RNA, 22 nt, Homo sapiens
guacacauacauauaugugugu

SEQ ID NO: 176891 - RNA, 22 nt, Homo sapiens
guacaggugcaggaugggcagg

SEQ ID NO: 176892 - RNA, 22 nt, Homo sapiens
guacaguaguaaaagugaauga

SEQ ID NO: 176893 - RNA, 22 nt, Homo sapiens
guacagugcucacaaugagagc

SEQ ID NO: 176894 - RNA, 22 nt, Homo sapiens
guaccucaguuggaaaugcaga

SEQ ID NO: 176895 - RNA, 22 nt, Homo sapiens
guagaagcacaggugaguuggu

SEQ ID NO: 176896 - RNA, 22 nt, Homo sapiens
guagaggaauggcuccaccaua

SEQ ID NO: 176897 - RNA, 22 nt, Homo sapiens
guagaucucaacacuggaagua

SEQ ID NO: 176898 - RNA, 22 nt, Homo sapiens
guagcagcuacuaaguugcugu

SEQ ID NO: 176899 - RNA, 22 nt, Homo sapiens
guagcaucauuugcaauuucau

SEQ ID NO: 176900 - RNA, 22 nt, Homo sapiens
guagcaugcaauauuauagaga

SEQ ID NO: 176901 - RNA, 22 nt, Homo sapiens
guaguaccauuaggauauuucu

SEQ ID NO: 176902 - RNA, 22 nt, Homo sapiens
ucuggccuagaacaauuaauua

SEQ ID NO: 176903 - RNA, 22 nt, Homo sapiens
ucuggcuccaaagucuauuuuu

SEQ ID NO: 176904 - RNA, 22 nt, Homo sapiens
ucuggcuccacacuuuauuaac

SEQ ID NO: 176905 - RNA, 22 nt, Homo sapiens
ucuggcuucugacuuaggggac

SEQ ID NO: 176906 - RNA, 22 nt, Homo sapiens
ucuggcuugugaacugucuucu

SEQ ID NO: 176907 - RNA, 17 nt, Homo sapiens
ucuggcuuucacaccug

SEQ ID NO: 176908 - RNA, 21 nt, Homo sapiens
ucuggcuuucauuccccuucu

SEQ ID NO: 176909 - RNA, 22 nt, Homo sapiens
ucuggcuuucuuuacuuaaugu

SEQ ID NO: 176910 - RNA, 22 nt, Homo sapiens
ucuggcuuugugaguugccaga

SEQ ID NO: 176911 - RNA, 20 nt, Homo sapiens
ucuggguuuuggccacgccc

SEQ ID NO: 176912 - RNA, 22 nt, Homo sapiens
ucuggugugcucuggacuugca

SEQ ID NO: 176913 - RNA, 22 nt, Homo sapiens
ucuguaacauccaccuucuggg

SEQ ID NO: 176914 - RNA, 22 nt, Homo sapiens
ucugucacugaaucccugucac

SEQ ID NO: 176915 - RNA, 22 nt, Homo sapiens
ucugucuuguccucacccuaga

SEQ ID NO: 176916 - RNA, 22 nt, Homo sapiens
ucugucuugugguuugagugcc

SEQ ID NO: 176917 - RNA, 22 nt, Homo sapiens
ucugucuuugccuaaguuuguc

SEQ ID NO: 176918 - RNA, 22 nt, Homo sapiens
ucugugaaaucauuuccuguaa

SEQ ID NO: 176919 - RNA, 22 nt, Homo sapiens
ucugugaaugugaccuuauuug

SEQ ID NO: 176920 - RNA, 22 nt, Homo sapiens
ucugugcauuguaacaacuaaa

SEQ ID NO: 176921 - RNA, 22 nt, Homo sapiens
ucugugcugagaguugaaaguu

SEQ ID NO: 176922 - RNA, 19 nt, Homo sapiens
ucugugcuugucccccugu

SEQ ID NO: 176923 - RNA, 22 nt, Homo sapiens
ucugugguaagaaacgcauguc

SEQ ID NO: 176924 - RNA, 22 nt, Homo sapiens
ucuguggucagcauccgccacu

SEQ ID NO: 176925 - RNA, 22 nt, Homo sapiens
ucuguggugggcuccacccagu

SEQ ID NO: 176926 - RNA, 18 nt, Homo sapiens
ucugugguguaaauacgu

SEQ ID NO: 176927 - RNA, 22 nt, Homo sapiens
uucaccuggguuggccaucauu

SEQ ID NO: 176928 - RNA, 22 nt, Homo sapiens
uucaccuugcccacagcagucu

SEQ ID NO: 176929 - RNA, 20 nt, Homo sapiens
uucacugggcucucuguugg

SEQ ID NO: 176930 - RNA, 21 nt, Homo sapiens
uucacuggucuauuucccuuu

SEQ ID NO: 176931 - RNA, 22 nt, Homo sapiens
uucacuguaaaaugaagagggu

SEQ ID NO: 176932 - RNA, 22 nt, Homo sapiens
uucacuguagcuuggauguuua

SEQ ID NO: 176933 - RNA, 22 nt, Homo sapiens
uucacugugaacucauauucag

SEQ ID NO: 176934 - RNA, 22 nt, Homo sapiens
uucacugugaauaaaggcuccc

SEQ ID NO: 176935 - RNA, 22 nt, Homo sapiens
uucacuguuaagcaguuaaacu

SEQ ID NO: 176936 - RNA, 22 nt, Homo sapiens
cuuaaagcgaauauugguggua

SEQ ID NO: 176937 - RNA, 22 nt, Homo sapiens
cuuaagcauugacuuuggacag

SEQ ID NO: 176938 - RNA, 22 nt, Homo sapiens
cuuagguaggugccagguuuuu

SEQ ID NO: 176939 - RNA, 19 nt, Homo sapiens
cuuaggugaccaguuccca

SEQ ID NO: 176940 - RNA, 22 nt, Homo sapiens
cuucaagucuuuggauaauuag

SEQ ID NO: 176941 - RNA, 22 nt, Homo sapiens
cuucacuuuguuaaacuccaau

SEQ ID NO: 176942 - RNA, 22 nt, Homo sapiens
cuucuugagacuuaggcuuugg

SEQ ID NO: 176943 - RNA, 22 nt, Homo sapiens
cuucuugagggccugcugggaa

SEQ ID NO: 176944 - RNA, 22 nt, Homo sapiens
augaggugggcggcuuggaaga

SEQ ID NO: 176945 - RNA, 21 nt, Homo sapiens
augagguguacuguggugaaa

SEQ ID NO: 176946 - RNA, 22 nt, Homo sapiens
augagguguuuauuguauccug

SEQ ID NO: 176947 - RNA, 22 nt, Homo sapiens
augaguaguugcuaaauauuga

SEQ ID NO: 176948 - RNA, 19 nt, Homo sapiens
augagucugcaagaaccag

SEQ ID NO: 176949 - RNA, 19 nt, Homo sapiens
augaguuaggggaaauuuc

SEQ ID NO: 176950 - RNA, 22 nt, Homo sapiens
augaguuccuuccuugccuagg

SEQ ID NO: 176951 - RNA, 22 nt, Homo sapiens
augauaaguuauuagaagaaga

SEQ ID NO: 176952 - RNA, 22 nt, Homo sapiens
augauacguuacuucacugggg

SEQ ID NO: 176953 - RNA, 22 nt, Homo sapiens
augauacuggcuucauagaaug

SEQ ID NO: 176954 - RNA, 22 nt, Homo sapiens
augauauggucacccuuaugaa

SEQ ID NO: 176955 - RNA, 22 nt, Homo sapiens
augaucacaccacugcacucca

SEQ ID NO: 176956 - RNA, 22 nt, Homo sapiens
augaucuguuuggugaucuugu

SEQ ID NO: 176957 - RNA, 22 nt, Homo sapiens
augaugucauuuuaauuucuaa

SEQ ID NO: 176958 - RNA, 19 nt, Homo sapiens
augauugucuauggaggaa

SEQ ID NO: 176959 - RNA, 22 nt, Homo sapiens
augauuguucucacucaagaga

SEQ ID NO: 176960 - RNA, 22 nt, Homo sapiens
augcaaacagcuaucuggcugg

SEQ ID NO: 176961 - RNA, 22 nt, Homo sapiens
augcaauucuagauugauagua

SEQ ID NO: 176962 - RNA, 22 nt, Homo sapiens
augcacaguccagcccaugugg

SEQ ID NO: 176963 - RNA, 22 nt, Homo sapiens
augcacaucagcuccagggacc

SEQ ID NO: 176964 - RNA, 22 nt, Homo sapiens
augcacuguuuucuugaugaga

SEQ ID NO: 176965 - RNA, 22 nt, Homo sapiens
augcacuuggcaggaugauucc

SEQ ID NO: 176966 - RNA, 22 nt, Homo sapiens
augcagagucccagccccuagc

SEQ ID NO: 176967 - RNA, 22 nt, Homo sapiens
augcauagcaucugcaaauguu

SEQ ID NO: 176968 - RNA, 22 nt, Homo sapiens
augcauauuuuaccuagaagag

SEQ ID NO: 176969 - RNA, 22 nt, Homo sapiens
augccaagaugagcacgcgucu

SEQ ID NO: 176970 - RNA, 22 nt, Homo sapiens
augccacagaaauaaccaaaau

SEQ ID NO: 176971 - RNA, 22 nt, Homo sapiens
augccucugacaauuggauucu

SEQ ID NO: 176972 - RNA, 22 nt, Homo sapiens
augcuacuggauuuguauaaau

SEQ ID NO: 176973 - RNA, 22 nt, Homo sapiens
augcuggugcuagaaacuggaa

SEQ ID NO: 176974 - RNA, 22 nt, Homo sapiens
augcuggugguucacaugcgca

SEQ ID NO: 176975 - RNA, 19 nt, Homo sapiens
augcugguguugcucaaac

SEQ ID NO: 176976 - RNA, 22 nt, Homo sapiens
augcuuguugcagccugagccu

SEQ ID NO: 176977 - RNA, 19 nt, Homo sapiens
auggaacugcuggagccac

SEQ ID NO: 176978 - RNA, 20 nt, Homo sapiens
auggaacugugagccaauua

SEQ ID NO: 176979 - RNA, 22 nt, Homo sapiens
auggaagaaacgauuuucugga

SEQ ID NO: 176980 - RNA, 22 nt, Homo sapiens
auggaagaaaguuggguucuug

SEQ ID NO: 176981 - RNA, 22 nt, Homo sapiens
auggaagcauaguauucuauug

SEQ ID NO: 176982 - RNA, 22 nt, Homo sapiens
auggaaugguugggucauaagg

SEQ ID NO: 176983 - RNA, 21 nt, Homo sapiens
auggacaugguuaggcuuugu

SEQ ID NO: 176984 - RNA, 21 nt, Homo sapiens
auggacugugugacccugcac

SEQ ID NO: 176985 - RNA, 22 nt, Homo sapiens
auggacuuuuuguucagugucu

SEQ ID NO: 176986 - RNA, 22 nt, Homo sapiens
auggagguguggggagugaguu

SEQ ID NO: 176987 - RNA, 22 nt, Homo sapiens
auggaguguucugaauccuuug

SEQ ID NO: 176988 - RNA, 22 nt, Homo sapiens
auggauuuuaggauacaguuga

SEQ ID NO: 176989 - RNA, 22 nt, Homo sapiens
auggauuuugaacuugagaguu

SEQ ID NO: 176990 - RNA, 22 nt, Homo sapiens
auggauuuuggggccagaggca

SEQ ID NO: 176991 - RNA, 22 nt, Homo sapiens
auggcaaaauguuccuaguggu

SEQ ID NO: 176992 - RNA, 22 nt, Homo sapiens
auggcaauaugaugcacuguuu

SEQ ID NO: 176993 - RNA, 22 nt, Homo sapiens
auggcaaugcgaugaugacuga

SEQ ID NO: 176994 - RNA, 22 nt, Homo sapiens
auggcaauguaagucagaaaaa

SEQ ID NO: 176995 - RNA, 22 nt, Homo sapiens
auggcacagaguagaugcucaa

SEQ ID NO: 176996 - RNA, 22 nt, Homo sapiens
auggcaccauguuaugauaaua

SEQ ID NO: 176997 - RNA, 22 nt, Homo sapiens
auggcacuaaugggaguuuacu

SEQ ID NO: 176998 - RNA, 22 nt, Homo sapiens
auggcacuguguauuuuucugu

SEQ ID NO: 176999 - RNA, 22 nt, Homo sapiens
auggcacuuuggacugcuagau

SEQ ID NO: 177000 - RNA, 22 nt, Homo sapiens
auggcagcaccccacucuacug

SEQ ID NO: 177001 - RNA, 22 nt, Homo sapiens
auggcagcccucuuuauccaug

SEQ ID NO: 177002 - RNA, 22 nt, Homo sapiens
auggcaguguaugauuauauua

SEQ ID NO: 177003 - RNA, 22 nt, Homo sapiens
auggcaguuuggucucugugcu

SEQ ID NO: 177004 - RNA, 22 nt, Homo sapiens
auggccugaugcaccuguccca

SEQ ID NO: 177005 - RNA, 22 nt, Homo sapiens
auggccuuguauaccuggcaaa

SEQ ID NO: 177006 - RNA, 22 nt, Homo sapiens
auggccuuuuuaucucaccaag

SEQ ID NO: 177007 - RNA, 22 nt, Homo sapiens
auggcguguggcuuggaggcug

SEQ ID NO: 177008 - RNA, 22 nt, Homo sapiens
auggcucuguuccaugugucuu

SEQ ID NO: 177009 - RNA, 22 nt, Homo sapiens
auggcucuguuuuuuaugcucu

SEQ ID NO: 177010 - RNA, 22 nt, Homo sapiens
auggcugagugauuucaaacag

SEQ ID NO: 177011 - RNA, 22 nt, Homo sapiens
auggcuguuucugcaaugucua

SEQ ID NO: 177012 - RNA, 22 nt, Homo sapiens
auggcuugugggaacuuuuaaa

SEQ ID NO: 177013 - RNA, 22 nt, Homo sapiens
augggguaggcuuugcugcagu

SEQ ID NO: 177014 - RNA, 17 nt, Homo sapiens
augggguuguagcccca

SEQ ID NO: 177015 - RNA, 22 nt, Homo sapiens
augggugaguaugaguugacuu

SEQ ID NO: 177016 - RNA, 22 nt, Homo sapiens
augguacuagaguaagaauugu

SEQ ID NO: 177017 - RNA, 21 nt, Homo sapiens
augguacugucucuggagaua

SEQ ID NO: 177018 - RNA, 22 nt, Homo sapiens
auggucuuuguuucuaauucug

SEQ ID NO: 177019 - RNA, 22 nt, Homo sapiens
augguguccuguuuccccagga

SEQ ID NO: 177020 - RNA, 22 nt, Homo sapiens
auguaaacagaugugcagcuug

SEQ ID NO: 177021 - RNA, 22 nt, Homo sapiens
auguaacuaucugagccauggg

SEQ ID NO: 177022 - RNA, 22 nt, Homo sapiens
auguaagugugcucaaauguua

SEQ ID NO: 177023 - RNA, 22 nt, Homo sapiens
auguaguagcagaaaauauuuu

SEQ ID NO: 177024 - RNA, 22 nt, Homo sapiens
auguaguaugaagaagaugcuu

SEQ ID NO: 177025 - RNA, 22 nt, Homo sapiens
augucacagguccuagccaagu

SEQ ID NO: 177026 - RNA, 22 nt, Homo sapiens
augucuguuugcugagcccggc

SEQ ID NO: 177027 - RNA, 22 nt, Homo sapiens
augugacugauggagaauaugu

SEQ ID NO: 177028 - RNA, 22 nt, Homo sapiens
augugacuggaucauggggacg

SEQ ID NO: 177029 - RNA, 22 nt, Homo sapiens
augugacuuuuuccugugccuu

SEQ ID NO: 177030 - RNA, 22 nt, Homo sapiens
augugcaaagcacuguucagca

SEQ ID NO: 177031 - RNA, 21 nt, Homo sapiens
augugcacuaugucauuuaau

SEQ ID NO: 177032 - RNA, 22 nt, Homo sapiens
augugcuuuuggugagagauuu

SEQ ID NO: 177033 - RNA, 22 nt, Homo sapiens
auguggcacuugacuuucucgc

SEQ ID NO: 177034 - RNA, 22 nt, Homo sapiens
auguguaaagcuuuucuuuguu

SEQ ID NO: 177035 - RNA, 22 nt, Homo sapiens
auguuacggaguuuuuauccag

SEQ ID NO: 177036 - RNA, 22 nt, Homo sapiens
auguugcuugaaggcauuuugu

SEQ ID NO: 177037 - RNA, 22 nt, Homo sapiens
auguuguaguaugagucaaaau

SEQ ID NO: 177038 - RNA, 22 nt, Homo sapiens
auuaacaucuagaguuuuggug

SEQ ID NO: 177039 - RNA, 22 nt, Homo sapiens
auuaagagcacauguucugggu

SEQ ID NO: 177040 - RNA, 22 nt, Homo sapiens
auuaaguuaggauuuugagaua

SEQ ID NO: 177041 - RNA, 22 nt, Homo sapiens
auuaaguugugccugaaaacuu

SEQ ID NO: 177042 - RNA, 22 nt, Homo sapiens
auuaauguaauuaguaaaguug

SEQ ID NO: 177043 - RNA, 22 nt, Homo sapiens
auuagaugguuauaggugugag

SEQ ID NO: 177044 - RNA, 22 nt, Homo sapiens
auuagguuaggcaaacuucugu

SEQ ID NO: 177045 - RNA, 22 nt, Homo sapiens
auuagguuggugcaaaaguaau

SEQ ID NO: 177046 - RNA, 22 nt, Homo sapiens
auuagguuguugcaaaaguaau

SEQ ID NO: 177047 - RNA, 22 nt, Homo sapiens
auuauaguguauacuugaaauu

SEQ ID NO: 177048 - RNA, 22 nt, Homo sapiens
auuauauguguaugugcauacc

SEQ ID NO: 177049 - RNA, 22 nt, Homo sapiens
auuaucacaguuuugcauaugg

SEQ ID NO: 177050 - RNA, 23 nt, Homo sapiens
auucaaguagugagagugguuau

SEQ ID NO: 177051 - RNA, 22 nt, Homo sapiens
auucaagugaugugauucuucu

SEQ ID NO: 177052 - RNA, 22 nt, Homo sapiens
auucacagggggagaaggguau

SEQ ID NO: 177053 - RNA, 22 nt, Homo sapiens
cuauuagguuggugcaaaaguc

SEQ ID NO: 177054 - RNA, 22 nt, Homo sapiens
cuauucacaggcaauauguaca

SEQ ID NO: 177055 - RNA, 22 nt, Homo sapiens
cucacaguucuaaaggcaagaa

SEQ ID NO: 177056 - RNA, 17 nt, Homo sapiens
cucacugagaacagcua

SEQ ID NO: 177057 - RNA, 22 nt, Homo sapiens
cucacugcauuucaguuuuguu

SEQ ID NO: 177058 - RNA, 22 nt, Homo sapiens
cucacuggguguaaaacaugua

SEQ ID NO: 177059 - RNA, 22 nt, Homo sapiens
cucagcuacuugagaggcuuag

SEQ ID NO: 177060 - RNA, 22 nt, Homo sapiens
cucagucuaugauacuuugcua

SEQ ID NO: 177061 - RNA, 22 nt, Homo sapiens
cucagugguugauuuauuuauc

SEQ ID NO: 177062 - RNA, 22 nt, Homo sapiens
cuccaggugagguuaagggacu

SEQ ID NO: 177063 - RNA, 22 nt, Homo sapiens
cucgaagacuaagcaucucuga

SEQ ID NO: 177064 - RNA, 20 nt, Homo sapiens
cucuaguaauaaaguuuccc

SEQ ID NO: 177065 - RNA, 22 nt, Homo sapiens
cucucaguguggaggccagaaa

SEQ ID NO: 177066 - RNA, 22 nt, Homo sapiens
cucucugagccauggcugcccu

SEQ ID NO: 177067 - RNA, 22 nt, Homo sapiens
cucucugagccccagacaccuu

SEQ ID NO: 177068 - RNA, 22 nt, Homo sapiens
cucugguucugcagugcacccu

SEQ ID NO: 177069 - RNA, 22 nt, Homo sapiens
cucuuggguagauuuugcagag

SEQ ID NO: 177070 - RNA, 22 nt, Homo sapiens
cucuuugaggugagcugcccau

SEQ ID NO: 177071 - RNA, 22 nt, Homo sapiens
cucuuugaguuccuccuggugu

SEQ ID NO: 177072 - RNA, 22 nt, Homo sapiens
cugaaagguauacgcuuguuau

SEQ ID NO: 177073 - RNA, 22 nt, Homo sapiens
cugaaaucagccaguuaguuuc

SEQ ID NO: 177074 - RNA, 22 nt, Homo sapiens
cugaagugugaaagucuuuuuu

SEQ ID NO: 177075 - RNA, 22 nt, Homo sapiens
cugaauagagcacacugauggg

SEQ ID NO: 177076 - RNA, 22 nt, Homo sapiens
cugaauguuucacucugaaaug

SEQ ID NO: 177077 - RNA, 22 nt, Homo sapiens
cugaccucugucaaagacaccc

SEQ ID NO: 177078 - RNA, 22 nt, Homo sapiens
cugacugaggaucaguucauca

SEQ ID NO: 177079 - RNA, 22 nt, Homo sapiens
cugagaguugaugaaauauggu

SEQ ID NO: 177080 - RNA, 22 nt, Homo sapiens
cugagcaaagaagugauaauga

SEQ ID NO: 177081 - RNA, 22 nt, Homo sapiens
cugaggugggaguuuuucucau

SEQ ID NO: 177082 - RNA, 22 nt, Homo sapiens
cugagugcaagugauccuccca

SEQ ID NO: 177083 - RNA, 22 nt, Homo sapiens
cugauacugagaccuuggguua

SEQ ID NO: 177084 - RNA, 22 nt, Homo sapiens
cugaucuguagcagccaccaca

SEQ ID NO: 177085 - RNA, 22 nt, Homo sapiens
cugaugguuuuacacaagggca

SEQ ID NO: 177086 - RNA, 19 nt, Homo sapiens
cugcacugagaaaaggagg

SEQ ID NO: 177087 - RNA, 22 nt, Homo sapiens
cugcaguaaccacuguaggugu

SEQ ID NO: 177088 - RNA, 19 nt, Homo sapiens
cugcaugagacaguugguu

SEQ ID NO: 177089 - RNA, 22 nt, Homo sapiens
cugcauuugaugacguauggug

SEQ ID NO: 177090 - RNA, 22 nt, Homo sapiens
cugccuagauguuguagggggu

SEQ ID NO: 177091 - RNA, 22 nt, Homo sapiens
cugcuaagagaaugagacuuag

SEQ ID NO: 177092 - RNA, 22 nt, Homo sapiens
cugcuguuguuaacuuuuggag

SEQ ID NO: 177093 - RNA, 22 nt, Homo sapiens
cuggaaagcaaagggugcauug

SEQ ID NO: 177094 - RNA, 22 nt, Homo sapiens
cuggaagaaaaucacgccaucu

SEQ ID NO: 177095 - RNA, 22 nt, Homo sapiens
cuggaaucuagaaaagguaagg

SEQ ID NO: 177096 - RNA, 22 nt, Homo sapiens
cuggaauguuccuaaagauuca

SEQ ID NO: 177097 - RNA, 22 nt, Homo sapiens
cuggagaucuugacauugaagu

SEQ ID NO: 177098 - RNA, 22 nt, Homo sapiens
cuggaggccugaacauaaaugg

SEQ ID NO: 177099 - RNA, 22 nt, Homo sapiens
cuggaguaugaaccauguauca

SEQ ID NO: 177100 - RNA, 22 nt, Homo sapiens
cuggauagagauugaugaugcu

SEQ ID NO: 177101 - RNA, 22 nt, Homo sapiens
cuggauagucaggagauauaua

SEQ ID NO: 177102 - RNA, 20 nt, Homo sapiens
cuggaugucgaggcagaggu

SEQ ID NO: 177103 - RNA, 22 nt, Homo sapiens
cuggcacccuugcuuaggaaga

SEQ ID NO: 177104 - RNA, 22 nt, Homo sapiens
cuggcccaguucugcguuuugc

SEQ ID NO: 177105 - RNA, 22 nt, Homo sapiens
cuggcucauuucauuuagcaua

SEQ ID NO: 177106 - RNA, 22 nt, Homo sapiens
cuggcucugagguguuuagggc

SEQ ID NO: 177107 - RNA, 22 nt, Homo sapiens
cuggcucugggcuaaagaaaua

SEQ ID NO: 177108 - RNA, 22 nt, Homo sapiens
cugggaugugacuguugccccc

SEQ ID NO: 177109 - RNA, 22 nt, Homo sapiens
cugggucaguuucugauuauug

SEQ ID NO: 177110 - RNA, 22 nt, Homo sapiens
cuggugauugguuucauucagu

SEQ ID NO: 177111 - RNA, 22 nt, Homo sapiens
cugguuuguaaaguuccugaga

SEQ ID NO: 177112 - RNA, 22 nt, Homo sapiens
cuguaaaguaagagguaaguua

SEQ ID NO: 177113 - RNA, 22 nt, Homo sapiens
cuguaaaguucucauuguagcc

SEQ ID NO: 177114 - RNA, 22 nt, Homo sapiens
cuguaauguaaugagacuacau

SEQ ID NO: 177115 - RNA, 23 nt, Homo sapiens
cuguacacauauacaucuaagua

SEQ ID NO: 177116 - RNA, 22 nt, Homo sapiens
cuguacucaucccauaugcacu

SEQ ID NO: 177117 - RNA, 22 nt, Homo sapiens
cuguaugugagaaauaauaagu

SEQ ID NO: 177118 - RNA, 22 nt, Homo sapiens
cugucagugggaguucaggcuu

SEQ ID NO: 177119 - RNA, 22 nt, Homo sapiens
cugugauuauauaguuaaggua

SEQ ID NO: 177120 - RNA, 22 nt, Homo sapiens
cugugcaaagcgcucucggggu

SEQ ID NO: 177121 - RNA, 22 nt, Homo sapiens
cugugcaaguuauaggccaggu

SEQ ID NO: 177122 - RNA, 22 nt, Homo sapiens
cugugcauaugacuuuauugga

SEQ ID NO: 177123 - RNA, 22 nt, Homo sapiens
cugugcauggauuuuaagauug

SEQ ID NO: 177124 - RNA, 19 nt, Homo sapiens
cugugcauuucuguggaag

SEQ ID NO: 177125 - RNA, 19 nt, Homo sapiens
cuguggucauuauuuugcu

SEQ ID NO: 177126 - RNA, 22 nt, Homo sapiens
cugugguuacguucuuugugcu

SEQ ID NO: 177127 - RNA, 22 nt, Homo sapiens
cuguguaguacuagauugagca

SEQ ID NO: 177128 - RNA, 22 nt, Homo sapiens
cuuaacagugguauugaugacc

SEQ ID NO: 177129 - RNA, 18 nt, Homo sapiens
cuuaacauugggaugaua

SEQ ID NO: 177130 - RNA, 22 nt, Homo sapiens
cuuaaguaguuguggaaugaau

SEQ ID NO: 177131 - RNA, 22 nt, Homo sapiens
cuuagcaaugucguguacucac

SEQ ID NO: 177132 - RNA, 20 nt, Homo sapiens
cuuaucaguggcaaguauaa

SEQ ID NO: 177133 - RNA, 22 nt, Homo sapiens
cuucaaaguuggcuaggagaca

SEQ ID NO: 177134 - RNA, 17 nt, Homo sapiens
cuucaaauaauuucccc

SEQ ID NO: 177135 - RNA, 22 nt, Homo sapiens
cuucaaguguggccaccugacc

SEQ ID NO: 177136 - RNA, 22 nt, Homo sapiens
cuucaaguuggaagggaccuaa

SEQ ID NO: 177137 - RNA, 22 nt, Homo sapiens
cuucacuggagucccuggauuc

SEQ ID NO: 177138 - RNA, 22 nt, Homo sapiens
cuucaguucuguaaggacagca

SEQ ID NO: 177139 - RNA, 18 nt, Homo sapiens
cuucauugcuguuuugcu

SEQ ID NO: 177140 - RNA, 22 nt, Homo sapiens
cuuccagcuggguucagucagu

SEQ ID NO: 177141 - RNA, 20 nt, Homo sapiens
cuuccaguggccccaucuuu

SEQ ID NO: 177142 - RNA, 22 nt, Homo sapiens
cuuccauaguauuuuuacaaaa

SEQ ID NO: 177143 - RNA, 22 nt, Homo sapiens
cuuccauaguuacacccaggga

SEQ ID NO: 177144 - RNA, 22 nt, Homo sapiens
cuuccugaguccugggcucaca

SEQ ID NO: 177145 - RNA, 18 nt, Homo sapiens
cuuccuuagucugguuaa

SEQ ID NO: 177146 - RNA, 22 nt, Homo sapiens
cuugaacaaagagauuccauua

SEQ ID NO: 177147 - RNA, 22 nt, Homo sapiens
cuugaccaauauggugaaaccc

SEQ ID NO: 177148 - RNA, 22 nt, Homo sapiens
cuugagacauuguuuuccaagu

SEQ ID NO: 177149 - RNA, 22 nt, Homo sapiens
cuugagcuugagauccuuucug

SEQ ID NO: 177150 - RNA, 22 nt, Homo sapiens
cuugcacucagaagauucaguu

SEQ ID NO: 177151 - RNA, 22 nt, Homo sapiens
cuugcagaggcccuggggagag

SEQ ID NO: 177152 - RNA, 20 nt, Homo sapiens
cuuggcuuucuugguguuaa

SEQ ID NO: 177153 - RNA, 22 nt, Homo sapiens
cuugggcagugugcauguguau

SEQ ID NO: 177154 - RNA, 22 nt, Homo sapiens
cuugguacucugugucccagcu

SEQ ID NO: 177155 - RNA, 22 nt, Homo sapiens
cuugucacuguuggcuuuagaa

SEQ ID NO: 177156 - RNA, 22 nt, Homo sapiens
cuuuacacauccuaaccagugu

SEQ ID NO: 177157 - RNA, 22 nt, Homo sapiens
cuuuacaguuggacucacgagg

SEQ ID NO: 177158 - RNA, 22 nt, Homo sapiens
cuuuaugagguuggauggaucu

SEQ ID NO: 177159 - RNA, 22 nt, Homo sapiens
cuuucugaggagaauagagaac

SEQ ID NO: 177160 - RNA, 22 nt, Homo sapiens
cuuugcaaaacauugagaccuc

SEQ ID NO: 177161 - RNA, 21 nt, Homo sapiens
cuuugcacugcuccucagcuc

SEQ ID NO: 177162 - RNA, 22 nt, Homo sapiens
cuuuggauggaaccucucuuuc

SEQ ID NO: 177163 - RNA, 22 nt, Homo sapiens
cuuuggcaaugucauuuucaau

SEQ ID NO: 177164 - RNA, 22 nt, Homo sapiens
cuuuggccauagcuaaaugauu

SEQ ID NO: 177165 - RNA, 22 nt, Homo sapiens
cuuuggucaauugcugugggga

SEQ ID NO: 177166 - RNA, 22 nt, Homo sapiens
cuuuggugagggauaaauuuca

SEQ ID NO: 177167 - RNA, 22 nt, Homo sapiens
cuuugguuaauaggauauggca

SEQ ID NO: 177168 - RNA, 22 nt, Homo sapiens
cuuugguucuguuuauaugcug

SEQ ID NO: 177169 - RNA, 23 nt, Homo sapiens
cuuuguccccacccaaaucucau

SEQ ID NO: 177170 - RNA, 22 nt, Homo sapiens
cuuuguccuucaagguguguca

SEQ ID NO: 177171 - RNA, 22 nt, Homo sapiens
cuuuuacacugcuggugggaau

SEQ ID NO: 177172 - RNA, 21 nt, Homo sapiens
cuuuugcacuccagccugggu

SEQ ID NO: 177173 - RNA, 22 nt, Homo sapiens
cuuuuggcuuaagauugucuug

SEQ ID NO: 177174 - RNA, 21 nt, Homo sapiens
cuuuuuacucguucauaugca

SEQ ID NO: 177175 - RNA, 20 nt, Homo sapiens
gaaacaucuauccucuccuu

SEQ ID NO: 177176 - RNA, 22 nt, Homo sapiens
gaaagauuuuaacugggagacu

SEQ ID NO: 177177 - RNA, 22 nt, Homo sapiens
gaaagcugguauagauacauua

SEQ ID NO: 177178 - RNA, 22 nt, Homo sapiens
gaaaguguugagauuacaggca

SEQ ID NO: 177179 - RNA, 23 nt, Homo sapiens
gaaaugucuuagugaaauugcuu

SEQ ID NO: 177180 - RNA, 22 nt, Homo sapiens
gaacccuggaggcggagguugc

SEQ ID NO: 177181 - RNA, 22 nt, Homo sapiens
gaacugggguuggguugcgaua

SEQ ID NO: 177182 - RNA, 20 nt, Homo sapiens
gaacugguguauguuuaacu

SEQ ID NO: 177183 - RNA, 22 nt, Homo sapiens
gaacuuguguugcuucacaugu

SEQ ID NO: 177184 - RNA, 22 nt, Homo sapiens
gaagacauuugcugcacguccu

SEQ ID NO: 177185 - RNA, 22 nt, Homo sapiens
gaagagacagguucccacaaaa

SEQ ID NO: 177186 - RNA, 22 nt, Homo sapiens
gaagauguugcuuaccuuggag

SEQ ID NO: 177187 - RNA, 22 nt, Homo sapiens
gaagcgaggugauuagcagaca

SEQ ID NO: 177188 - RNA, 22 nt, Homo sapiens
gaaggagcuuaucugccauuuc

SEQ ID NO: 177189 - RNA, 22 nt, Homo sapiens
gaaguaguaaaauuuauugcag

SEQ ID NO: 177190 - RNA, 23 nt, Homo sapiens
gaaguauagcaugcacauggaaa

SEQ ID NO: 177191 - RNA, 19 nt, Homo sapiens
gaaguguuuguucuccaug

SEQ ID NO: 177192 - RNA, 22 nt, Homo sapiens
gaauaaacuagagaggacugag

SEQ ID NO: 177193 - RNA, 22 nt, Homo sapiens
gaauacuguccaagagugaugg

SEQ ID NO: 177194 - RNA, 22 nt, Homo sapiens
gaaucacagauuaugaguaucu

SEQ ID NO: 177195 - RNA, 22 nt, Homo sapiens
gaaucacaguuauuagagcagc

SEQ ID NO: 177196 - RNA, 22 nt, Homo sapiens
gaaugaauguuuauccuuagau

SEQ ID NO: 177197 - RNA, 22 nt, Homo sapiens
gaaugcuaccagcaucuagugg

SEQ ID NO: 177198 - RNA, 22 nt, Homo sapiens
gaauggaacugacuauagcuga

SEQ ID NO: 177199 - RNA, 22 nt, Homo sapiens
gaaugugcuguuggcugggcgu

SEQ ID NO: 177200 - RNA, 22 nt, Homo sapiens
gaauucugucgcuuacuagaug

SEQ ID NO: 177201 - RNA, 22 nt, Homo sapiens
gacacagugaagucucuacuug

SEQ ID NO: 177202 - RNA, 22 nt, Homo sapiens
gacaccauuucaguacuagguu

SEQ ID NO: 177203 - RNA, 22 nt, Homo sapiens
gacacugucuucugcucuuaaa

SEQ ID NO: 177204 - RNA, 22 nt, Homo sapiens
gacagacacaauugauccauga

SEQ ID NO: 177205 - RNA, 22 nt, Homo sapiens
gacagugagaugucaugugaaa

SEQ ID NO: 177206 - RNA, 18 nt, Homo sapiens
gacaguguggcaauuccu

SEQ ID NO: 177207 - RNA, 17 nt, Homo sapiens
gacauaggaaaaggaga

SEQ ID NO: 177208 - RNA, 20 nt, Homo sapiens
gacaugacuaggagauagcc

SEQ ID NO: 177209 - RNA, 19 nt, Homo sapiens
gacaugagauuuggugggg

SEQ ID NO: 177210 - RNA, 22 nt, Homo sapiens
gaccaaagaggcaggcauuaga

SEQ ID NO: 177211 - RNA, 22 nt, Homo sapiens
gacuagggaccaugagcaaucc

SEQ ID NO: 177212 - RNA, 22 nt, Homo sapiens
gacucuguagacaaucacaucu

SEQ ID NO: 177213 - RNA, 22 nt, Homo sapiens
gacugcauuugccccaucgaau

SEQ ID NO: 177214 - RNA, 22 nt, Homo sapiens
gacuggccauugauacagaggu

SEQ ID NO: 177215 - RNA, 16 nt, Homo sapiens
gacugggcugaggaau

SEQ ID NO: 177216 - RNA, 20 nt, Homo sapiens
gacuucagaagcuucagagu

SEQ ID NO: 177217 - RNA, 22 nt, Homo sapiens
gacuugaagaaucuaagggagg

SEQ ID NO: 177218 - RNA, 22 nt, Homo sapiens
gacuuugguagaggaaaaaucu

SEQ ID NO: 177219 - RNA, 22 nt, Homo sapiens
gagaacagaagcauuccuaauu

SEQ ID NO: 177220 - RNA, 22 nt, Homo sapiens
gagaacauacggcauuugguuu

SEQ ID NO: 177221 - RNA, 22 nt, Homo sapiens
gagaacugagauaagugauauu

SEQ ID NO: 177222 - RNA, 21 nt, Homo sapiens
gagaaucaucauggcugcaua

SEQ ID NO: 177223 - RNA, 22 nt, Homo sapiens
gagaaugaacagacugccucuu

SEQ ID NO: 177224 - RNA, 22 nt, Homo sapiens
gagacagugucagccauugaaa

SEQ ID NO: 177225 - RNA, 22 nt, Homo sapiens
gagacggagucacgcccuguca

SEQ ID NO: 177226 - RNA, 22 nt, Homo sapiens
gagacggagucucgcucugucg

SEQ ID NO: 177227 - RNA, 22 nt, Homo sapiens
gagacggagucuugcucuguug

SEQ ID NO: 177228 - RNA, 22 nt, Homo sapiens
gagacuaaagagcuugcccugg

SEQ ID NO: 177229 - RNA, 22 nt, Homo sapiens
gagacucuuagauuggaaaucu

SEQ ID NO: 177230 - RNA, 22 nt, Homo sapiens
gagacugagucucgcucugccg

SEQ ID NO: 177231 - RNA, 22 nt, Homo sapiens
gagagcauuaagccaucaucau

SEQ ID NO: 177232 - RNA, 22 nt, Homo sapiens
gagagcuaggccacuggggcuu

SEQ ID NO: 177233 - RNA, 22 nt, Homo sapiens
gagagugcuuggcaucugcuga

SEQ ID NO: 177234 - RNA, 22 nt, Homo sapiens
gagauaggauucacuuucaugu

SEQ ID NO: 177235 - RNA, 22 nt, Homo sapiens
gagaucaaugggauggaauuga

SEQ ID NO: 177236 - RNA, 22 nt, Homo sapiens
gagaucauucugauccagaguc

SEQ ID NO: 177237 - RNA, 23 nt, Homo sapiens
gagaucauucuggaauuagagug

SEQ ID NO: 177238 - RNA, 22 nt, Homo sapiens
gagaucuuggccaaguuucuua

SEQ ID NO: 177239 - RNA, 22 nt, Homo sapiens
gagauggagacuuggccuuaaa

SEQ ID NO: 177240 - RNA, 22 nt, Homo sapiens
gagauggagucuuuuucuguca

SEQ ID NO: 177241 - RNA, 22 nt, Homo sapiens
gagaugguguuccacugccagu

SEQ ID NO: 177242 - RNA, 22 nt, Homo sapiens
gagcaaaaguauguauugguua

SEQ ID NO: 177243 - RNA, 22 nt, Homo sapiens
gagcacauguggagagucuggg

SEQ ID NO: 177244 - RNA, 22 nt, Homo sapiens
gagcaccagucccugucagugc

SEQ ID NO: 177245 - RNA, 22 nt, Homo sapiens
gagcacugauuuauuuuugucu

SEQ ID NO: 177246 - RNA, 22 nt, Homo sapiens
gagcaucauggggccaaagcgc

SEQ ID NO: 177247 - RNA, 22 nt, Homo sapiens
gagccauggagaaaacagcuau

SEQ ID NO: 177248 - RNA, 21 nt, Homo sapiens
gagcuaggugaggcuguaaug

SEQ ID NO: 177249 - RNA, 20 nt, Homo sapiens
gagcucaucuucuuuaccac

SEQ ID NO: 177250 - RNA, 22 nt, Homo sapiens
gagcucauuaaaguaggaccua

SEQ ID NO: 177251 - RNA, 22 nt, Homo sapiens
gagcucauuguugcuaaagaga

SEQ ID NO: 177252 - RNA, 22 nt, Homo sapiens
gagcucguuuuugcugacucuu

SEQ ID NO: 177253 - RNA, 22 nt, Homo sapiens
gagcugaaguuuccauuuguac

SEQ ID NO: 177254 - RNA, 22 nt, Homo sapiens
gagcugccuugccuaugcaaga

SEQ ID NO: 177255 - RNA, 22 nt, Homo sapiens
gagcuggacuucuuaccuuuuc

SEQ ID NO: 177256 - RNA, 20 nt, Homo sapiens
gagcugguguacugccgggc

SEQ ID NO: 177257 - RNA, 22 nt, Homo sapiens
gagcuguugguuugaaagaauu

SEQ ID NO: 177258 - RNA, 22 nt, Homo sapiens
gaggacauuaugcuaaguggaa

SEQ ID NO: 177259 - RNA, 22 nt, Homo sapiens
gaggcaaguggccaccgagucu

SEQ ID NO: 177260 - RNA, 22 nt, Homo sapiens
gaggcaauaugagggaggcuuc

SEQ ID NO: 177261 - RNA, 22 nt, Homo sapiens
gaggcaguguguccguucucgg

SEQ ID NO: 177262 - RNA, 22 nt, Homo sapiens
gagguaagaaagucaguccuuc

SEQ ID NO: 177263 - RNA, 22 nt, Homo sapiens
gagguagagaguuuugauucug

SEQ ID NO: 177264 - RNA, 22 nt, Homo sapiens
gagguaggaauaaacauuugaa

SEQ ID NO: 177265 - RNA, 22 nt, Homo sapiens
gagguaggaggauugcuuaagg

SEQ ID NO: 177266 - RNA, 22 nt, Homo sapiens
gagguagguuugguuacaaaag

SEQ ID NO: 177267 - RNA, 22 nt, Homo sapiens
gagguaguuaaugcauucacua

SEQ ID NO: 177268 - RNA, 22 nt, Homo sapiens
gagguaugauugacauauaaaa

SEQ ID NO: 177269 - RNA, 22 nt, Homo sapiens
gaggucauucugugguacccag

SEQ ID NO: 177270 - RNA, 22 nt, Homo sapiens
gaggugauaucucauugugguu

SEQ ID NO: 177271 - RNA, 22 nt, Homo sapiens
gcuguguguuaucagaaauugc

SEQ ID NO: 177272 - RNA, 22 nt, Homo sapiens
gcuguugcuauuauuccgagaa

SEQ ID NO: 177273 - RNA, 19 nt, Homo sapiens
gcuucuugaggacgaugac

SEQ ID NO: 177274 - RNA, 19 nt, Homo sapiens
gcuuguccacgugagauaa

SEQ ID NO: 177275 - RNA, 22 nt, Homo sapiens
gcuuguguuugcuccccagaau

SEQ ID NO: 177276 - RNA, 22 nt, Homo sapiens
gcuuuguuaaaacacagccaca

SEQ ID NO: 177277 - RNA, 22 nt, Homo sapiens
gcuuuguugauggugagucugu

SEQ ID NO: 177278 - RNA, 23 nt, Homo sapiens
ggaaacauccagucuuucaccau

SEQ ID NO: 177279 - RNA, 22 nt, Homo sapiens
ggaaagcuagguguggguguac

SEQ ID NO: 177280 - RNA, 21 nt, Homo sapiens
ggaaaguuaaggaaauacccc

SEQ ID NO: 177281 - RNA, 22 nt, Homo sapiens
ggaagagugaauuaucuugacu

SEQ ID NO: 177282 - RNA, 22 nt, Homo sapiens
ggaagccugcacucgggcaggg

SEQ ID NO: 177283 - RNA, 22 nt, Homo sapiens
ggaagccuggaaaaaauuguga

SEQ ID NO: 177284 - RNA, 17 nt, Homo sapiens
ggaagccuuugguuuaa

SEQ ID NO: 177285 - RNA, 22 nt, Homo sapiens
ggaagguaauugucagcucaua

SEQ ID NO: 177286 - RNA, 22 nt, Homo sapiens
ggaauauaaaacuuuugacagg

SEQ ID NO: 177287 - RNA, 22 nt, Homo sapiens
ggaauguuaaagacuacacuga

SEQ ID NO: 177288 - RNA, 21 nt, Homo sapiens
ggaauuuagggaaugauuuag

SEQ ID NO: 177289 - RNA, 22 nt, Homo sapiens
ggacauuaacugcaagauagau

SEQ ID NO: 177290 - RNA, 22 nt, Homo sapiens
ggacuagggacauggggagcug

SEQ ID NO: 177291 - RNA, 22 nt, Homo sapiens
ggagaugauuaugaaucacuua

SEQ ID NO: 177292 - RNA, 22 nt, Homo sapiens
ggagauuauugaaucaugaggg

SEQ ID NO: 177293 - RNA, 22 nt, Homo sapiens
ggagcugugauuugaguccaga

SEQ ID NO: 177294 - RNA, 22 nt, Homo sapiens
ggagguagucuuucccuuauca

SEQ ID NO: 177295 - RNA, 21 nt, Homo sapiens
ggaguauaaggcaaaggagug

SEQ ID NO: 177296 - RNA, 22 nt, Homo sapiens
ggaguaugaaacccacuccaau

SEQ ID NO: 177297 - RNA, 22 nt, Homo sapiens
ggagucugaacuggacaaugac

SEQ ID NO: 177298 - RNA, 22 nt, Homo sapiens
ggaguguaguggcuccaucucg

SEQ ID NO: 177299 - RNA, 22 nt, Homo sapiens
ggagugugauuguucucuguua

SEQ ID NO: 177300 - RNA, 22 nt, Homo sapiens
ggaguguguaggagaaagguaa

SEQ ID NO: 177301 - RNA, 22 nt, Homo sapiens
ggaucacagagcuugggaaagg

SEQ ID NO: 177302 - RNA, 22 nt, Homo sapiens
ggaucacagccagcucccagaa

SEQ ID NO: 177303 - RNA, 22 nt, Homo sapiens
ggaugcauucaacuuccaguuc

SEQ ID NO: 177304 - RNA, 22 nt, Homo sapiens
ggaugcauuuuugguugucaca

SEQ ID NO: 177305 - RNA, 23 nt, Homo sapiens
ggauggaaaguuuugagggccac

SEQ ID NO: 177306 - RNA, 22 nt, Homo sapiens
ggaugugugcacgcgcacaugc

SEQ ID NO: 177307 - RNA, 22 nt, Homo sapiens
ggcaaagagacaugcaucgggg

SEQ ID NO: 177308 - RNA, 22 nt, Homo sapiens
ggcaaaugaagauggagaggcu

SEQ ID NO: 177309 - RNA, 21 nt, Homo sapiens
ggcaagaaacacaaucaagua

SEQ ID NO: 177310 - RNA, 22 nt, Homo sapiens
ggcaagaaagaaaucaucuguc

SEQ ID NO: 177311 - RNA, 22 nt, Homo sapiens
ggcaagaacuucacucacuuuu

SEQ ID NO: 177312 - RNA, 21 nt, Homo sapiens
ggcaagagaauacaacauaaa

SEQ ID NO: 177313 - RNA, 22 nt, Homo sapiens
ggcaagaucuuggcucacugaa

SEQ ID NO: 177314 - RNA, 22 nt, Homo sapiens
ggcacaaugucagcucacugca

SEQ ID NO: 177315 - RNA, 22 nt, Homo sapiens
ggcaccauuuuacuccuucccu

SEQ ID NO: 177316 - RNA, 22 nt, Homo sapiens
ggcacugugaugugagggggua

SEQ ID NO: 177317 - RNA, 22 nt, Homo sapiens
ggcacuguggcucaagccugua

SEQ ID NO: 177318 - RNA, 19 nt, Homo sapiens
ggcacugugugagugagga

SEQ ID NO: 177319 - RNA, 22 nt, Homo sapiens
ggcagaucauuggccucaguuu

SEQ ID NO: 177320 - RNA, 22 nt, Homo sapiens
ggcagcauugccuuugcaguga

SEQ ID NO: 177321 - RNA, 22 nt, Homo sapiens
ggcagcuguguccuucguaagg

SEQ ID NO: 177322 - RNA, 22 nt, Homo sapiens
ggcaguguaauaauuuauuaau

SEQ ID NO: 177323 - RNA, 22 nt, Homo sapiens
ggcaguuucucaggcaggggua

SEQ ID NO: 177324 - RNA, 22 nt, Homo sapiens
ggcauugaguggguaggaguca

SEQ ID NO: 177325 - RNA, 22 nt, Homo sapiens
ggccagaugaucuaugaaggaa

SEQ ID NO: 177326 - RNA, 22 nt, Homo sapiens
ggccagaugcgguggcucacac

SEQ ID NO: 177327 - RNA, 22 nt, Homo sapiens
ggcccaguugcgggugguaccg

SEQ ID NO: 177328 - RNA, 22 nt, Homo sapiens
ggcgguguccuccaagugcuuc

SEQ ID NO: 177329 - RNA, 22 nt, Homo sapiens
ggcuagauauucacauauggcu

SEQ ID NO: 177330 - RNA, 22 nt, Homo sapiens
ggcuagaugcuagagauaucau

SEQ ID NO: 177331 - RNA, 22 nt, Homo sapiens
ggcucagugggguccugguucu

SEQ ID NO: 177332 - RNA, 22 nt, Homo sapiens
ggcucaguuuccuccgucugcu

SEQ ID NO: 177333 - RNA, 22 nt, Homo sapiens
ggcugguuuucaguuacugagu

SEQ ID NO: 177334 - RNA, 22 nt, Homo sapiens
gggaagauauaggcugggcacc

SEQ ID NO: 177335 - RNA, 22 nt, Homo sapiens
gggaaugaagagaaccuuccca

SEQ ID NO: 177336 - RNA, 22 nt, Homo sapiens
gggagguagguauuagcuuuuc

SEQ ID NO: 177337 - RNA, 22 nt, Homo sapiens
gggaggucauuguaaggucuua

SEQ ID NO: 177338 - RNA, 22 nt, Homo sapiens
gggaggucauuguucaaugcug

SEQ ID NO: 177339 - RNA, 22 nt, Homo sapiens
gggaguagagaguuucucugac

SEQ ID NO: 177340 - RNA, 22 nt, Homo sapiens
gggagugugcacacaugguaua

SEQ ID NO: 177341 - RNA, 22 nt, Homo sapiens
gggaugauuaugguucacuaca

SEQ ID NO: 177342 - RNA, 22 nt, Homo sapiens
gggauguaaaagugggcacauu

SEQ ID NO: 177343 - RNA, 20 nt, Homo sapiens
gggaugugagguacacucuu

SEQ ID NO: 177344 - RNA, 19 nt, Homo sapiens
gggcaaaucuggaaauuua

SEQ ID NO: 177345 - RNA, 20 nt, Homo sapiens
gggcaaguaugugggaaguc

SEQ ID NO: 177346 - RNA, 22 nt, Homo sapiens
gggcagaugucuggacaccuca

SEQ ID NO: 177347 - RNA, 22 nt, Homo sapiens
gggcaguauggucauuuucaca

SEQ ID NO: 177348 - RNA, 22 nt, Homo sapiens
ggguaaaucucuuuucauggcu

SEQ ID NO: 177349 - RNA, 22 nt, Homo sapiens
gggugguuuuauuaucagugac

SEQ ID NO: 177350 - RNA, 22 nt, Homo sapiens
gguagacaucgugcucugugau

SEQ ID NO: 177351 - RNA, 22 nt, Homo sapiens
gguauguagcaaaagaggugcu

SEQ ID NO: 177352 - RNA, 22 nt, Homo sapiens
ggucacauugcuagcauggguu

SEQ ID NO: 177353 - RNA, 22 nt, Homo sapiens
ggucagaaagacaggcauucag

SEQ ID NO: 177354 - RNA, 19 nt, Homo sapiens
ggucccucucaagucauuc

SEQ ID NO: 177355 - RNA, 22 nt, Homo sapiens
gguccgccugccuuggccuccc

SEQ ID NO: 177356 - RNA, 22 nt, Homo sapiens
ggucuuggagaauuguccuggg

SEQ ID NO: 177357 - RNA, 21 nt, Homo sapiens
ggugagaaaggagacauagac

SEQ ID NO: 177358 - RNA, 22 nt, Homo sapiens
ggugagaaagggauuccuguuc

SEQ ID NO: 177359 - RNA, 22 nt, Homo sapiens
ggugagauguucagacgaacug

SEQ ID NO: 177360 - RNA, 22 nt, Homo sapiens
ggugagguaguaagguacaaua

SEQ ID NO: 177361 - RNA, 22 nt, Homo sapiens
ggugaguggugcuuaaguucag

SEQ ID NO: 177362 - RNA, 22 nt, Homo sapiens
ggugccuacugugugucaggca

SEQ ID NO: 177363 - RNA, 22 nt, Homo sapiens
gguggcaaaucugaguggcgcu

SEQ ID NO: 177364 - RNA, 22 nt, Homo sapiens
ggugucaguuggccccuacugg

SEQ ID NO: 177365 - RNA, 22 nt, Homo sapiens
gguuagaaacagguccucagga

SEQ ID NO: 177366 - RNA, 22 nt, Homo sapiens
guaaaucucuguuuucauggac

SEQ ID NO: 177367 - RNA, 22 nt, Homo sapiens
guaaaugcagaugcaugaccuu

SEQ ID NO: 177368 - RNA, 22 nt, Homo sapiens
guaacccuguaggccuaaagua

SEQ ID NO: 177369 - RNA, 22 nt, Homo sapiens
guaaccuauaguuaccaauagu

SEQ ID NO: 177370 - RNA, 22 nt, Homo sapiens
guaacucugucacuuacuaguu

SEQ ID NO: 177371 - RNA, 22 nt, Homo sapiens
guaagucucaugagaucugaug

SEQ ID NO: 177372 - RNA, 22 nt, Homo sapiens
guaauaacuguggaaaaagguu

SEQ ID NO: 177373 - RNA, 22 nt, Homo sapiens
guaauacuggacaggguaucag

SEQ ID NO: 177374 - RNA, 22 nt, Homo sapiens
guaaucucaccuacuugggagg

SEQ ID NO: 177375 - RNA, 22 nt, Homo sapiens
guaaucucagcuacgcgggagg

SEQ ID NO: 177376 - RNA, 22 nt, Homo sapiens
guacaggcagcaaacaccauaa

SEQ ID NO: 177377 - RNA, 22 nt, Homo sapiens
guacaguauaguaauaggauuu

SEQ ID NO: 177378 - RNA, 22 nt, Homo sapiens
guacauagucacacauauacau

SEQ ID NO: 177379 - RNA, 22 nt, Homo sapiens
guacaugcaugcaugggugugc

SEQ ID NO: 177380 - RNA, 18 nt, Homo sapiens
uaagaugcagccuauucc

SEQ ID NO: 177381 - RNA, 22 nt, Homo sapiens
uaagcagugcaagaauggaaua

SEQ ID NO: 177382 - RNA, 22 nt, Homo sapiens
uaagcuauagugaauaaauugc

SEQ ID NO: 177383 - RNA, 22 nt, Homo sapiens
uaaggcaaucagucaugguguu

SEQ ID NO: 177384 - RNA, 22 nt, Homo sapiens
uaaggcacauaggccuggaaac

SEQ ID NO: 177385 - RNA, 22 nt, Homo sapiens
uaaggcacuacuuuaggcuuuc

SEQ ID NO: 177386 - RNA, 22 nt, Homo sapiens
uaaggcauuuuuuugaguugca

SEQ ID NO: 177387 - RNA, 22 nt, Homo sapiens
uaaggcuagcaagaugagaaua

SEQ ID NO: 177388 - RNA, 22 nt, Homo sapiens
uaagggcacuaaucccauuuau

SEQ ID NO: 177389 - RNA, 22 nt, Homo sapiens
uaagguuacaaaggacuucaua

SEQ ID NO: 177390 - RNA, 22 nt, Homo sapiens
uaaguaauugcagcaauuugcc

SEQ ID NO: 177391 - RNA, 22 nt, Homo sapiens
uaaguagaggaaucauuuugug

SEQ ID NO: 177392 - RNA, 22 nt, Homo sapiens
uaaguauagguaacagaagcaa

SEQ ID NO: 177393 - RNA, 22 nt, Homo sapiens
uaaguauuaggccccaggcugg

SEQ ID NO: 177394 - RNA, 20 nt, Homo sapiens
uaagugcauaggauauuucu

SEQ ID NO: 177395 - RNA, 22 nt, Homo sapiens
uaagugcuugacuuugauguuu

SEQ ID NO: 177396 - RNA, 20 nt, Homo sapiens
uaagugcuugagacuucuga

SEQ ID NO: 177397 - RNA, 22 nt, Homo sapiens
uaagugguguucauucuuuuga

SEQ ID NO: 177398 - RNA, 20 nt, Homo sapiens
uaaguuguauuugucaugaa

SEQ ID NO: 177399 - RNA, 18 nt, Homo sapiens
uaauaacugugaccuuga

SEQ ID NO: 177400 - RNA, 21 nt, Homo sapiens
uaauaaugucucagacaccua

SEQ ID NO: 177401 - RNA, 22 nt, Homo sapiens
uaauaauguuaggcuuacucaa

SEQ ID NO: 177402 - RNA, 22 nt, Homo sapiens
uaauacauucaaggugguaguu

SEQ ID NO: 177403 - RNA, 22 nt, Homo sapiens
uaauacuagugaauagcaggau

SEQ ID NO: 177404 - RNA, 22 nt, Homo sapiens
uaauacuugucauaaaggcauu

SEQ ID NO: 177405 - RNA, 22 nt, Homo sapiens
uaauagcucggauaaacaugau

SEQ ID NO: 177406 - RNA, 22 nt, Homo sapiens
uaauauguuuugaaaucaggaa

SEQ ID NO: 177407 - RNA, 22 nt, Homo sapiens
uaauccuagcacuuuggaagac

SEQ ID NO: 177408 - RNA, 22 nt, Homo sapiens
uaaucucagcuacucaggaggc

SEQ ID NO: 177409 - RNA, 22 nt, Homo sapiens
uaaucucagcugagcugagauu

SEQ ID NO: 177410 - RNA, 22 nt, Homo sapiens
uaaugcacucgaaucauggaau

SEQ ID NO: 177411 - RNA, 22 nt, Homo sapiens
uaaugcacuuuccuccaaggcu

SEQ ID NO: 177412 - RNA, 22 nt, Homo sapiens
uaaugcauacagaagguguuuu

SEQ ID NO: 177413 - RNA, 22 nt, Homo sapiens
uaaugcaucagugguaguucuu

SEQ ID NO: 177414 - RNA, 22 nt, Homo sapiens
uaaugcauguaaugggcugaua

SEQ ID NO: 177415 - RNA, 22 nt, Homo sapiens
uaaugcuaucugggccaggggu

SEQ ID NO: 177416 - RNA, 22 nt, Homo sapiens
uaauugcaguucuguguuauau

SEQ ID NO: 177417 - RNA, 22 nt, Homo sapiens
uacaaagcuacucgagggcagg

SEQ ID NO: 177418 - RNA, 22 nt, Homo sapiens
uacaaagcuuugaugugucuuu

SEQ ID NO: 177419 - RNA, 22 nt, Homo sapiens
uacaaagugggaaacgaagguu

SEQ ID NO: 177420 - RNA, 22 nt, Homo sapiens
uacaaaucuagguuuguuacug

SEQ ID NO: 177421 - RNA, 21 nt, Homo sapiens
uacaagcuguagcacaugcca

SEQ ID NO: 177422 - RNA, 22 nt, Homo sapiens
uacaaguauuuuuauuagugcc

SEQ ID NO: 177423 - RNA, 22 nt, Homo sapiens
uacaaguggguuugugcaggag

SEQ ID NO: 177424 - RNA, 22 nt, Homo sapiens
uacagaauugcagguguggcag

SEQ ID NO: 177425 - RNA, 22 nt, Homo sapiens
uacagcacaggugcagguguug

SEQ ID NO: 177426 - RNA, 22 nt, Homo sapiens
uacaguaauguuaaucuuugug

SEQ ID NO: 177427 - RNA, 22 nt, Homo sapiens
uacagucacauuccugaccaua

SEQ ID NO: 177428 - RNA, 22 nt, Homo sapiens
uacagucuagaggagaaucagg

SEQ ID NO: 177429 - RNA, 22 nt, Homo sapiens
uacagugcuugguaucuaguaa

SEQ ID NO: 177430 - RNA, 22 nt, Homo sapiens
uacaguggcaugucaggugcuu

SEQ ID NO: 177431 - RNA, 22 nt, Homo sapiens
uacagugggcacuggcgcccug

SEQ ID NO: 177432 - RNA, 22 nt, Homo sapiens
uacauccauccugcugggcagu

SEQ ID NO: 177433 - RNA, 19 nt, Homo sapiens
uacaugcagcaggcacgca

SEQ ID NO: 177434 - RNA, 22 nt, Homo sapiens
uaccaaaguuucggccucuguu

SEQ ID NO: 177435 - RNA, 22 nt, Homo sapiens
uaccacaggcuggguaaucuau

SEQ ID NO: 177436 - RNA, 19 nt, Homo sapiens
uaccagcacaguguuugag

SEQ ID NO: 177437 - RNA, 22 nt, Homo sapiens
uaccaugcagguguauguuugu

SEQ ID NO: 177438 - RNA, 22 nt, Homo sapiens
uaccauguaucugggaugcuuu

SEQ ID NO: 177439 - RNA, 19 nt, Homo sapiens
uacccagaagcagcauugu

SEQ ID NO: 177440 - RNA, 22 nt, Homo sapiens
uacccuuuaguauaaaaucaga

SEQ ID NO: 177441 - RNA, 22 nt, Homo sapiens
uacguuaucagguaugcaagag

SEQ ID NO: 177442 - RNA, 22 nt, Homo sapiens
uacuacuuucugacaucuuuaa

SEQ ID NO: 177443 - RNA, 22 nt, Homo sapiens
uacuagaaccuuauucagagug

SEQ ID NO: 177444 - RNA, 22 nt, Homo sapiens
uacuauugcaucggugauuagg

SEQ ID NO: 177445 - RNA, 22 nt, Homo sapiens
uacugcacuccagccucgguga

SEQ ID NO: 177446 - RNA, 22 nt, Homo sapiens
uacugcagucagacuccugggc

SEQ ID NO: 177447 - RNA, 22 nt, Homo sapiens
uacugcaguugcagcuugagga

SEQ ID NO: 177448 - RNA, 22 nt, Homo sapiens
uacugcauuccaaucugggcga

SEQ ID NO: 177449 - RNA, 22 nt, Homo sapiens
uacugcauucuccgccuccggg

SEQ ID NO: 177450 - RNA, 22 nt, Homo sapiens
uacugcugucagugccaaguag

SEQ ID NO: 177451 - RNA, 22 nt, Homo sapiens
uacuggccuugaacucuggugu

SEQ ID NO: 177452 - RNA, 21 nt, Homo sapiens
uacuugagacagggucuugcu

SEQ ID NO: 177453 - RNA, 22 nt, Homo sapiens
uacuuuguagagugugagaauu

SEQ ID NO: 177454 - RNA, 22 nt, Homo sapiens
uacuuuguuauagcagcaggaa

SEQ ID NO: 177455 - RNA, 22 nt, Homo sapiens
uagaaaguagggaagguaggau

SEQ ID NO: 177456 - RNA, 22 nt, Homo sapiens
uagaacauuccaggugauguug

SEQ ID NO: 177457 - RNA, 22 nt, Homo sapiens
uagaaucuaacucgcaugaaaa

SEQ ID NO: 177458 - RNA, 22 nt, Homo sapiens
uagaauggaagguugagaagaa

SEQ ID NO: 177459 - RNA, 22 nt, Homo sapiens
uagaaugucagcuucuugaggg

SEQ ID NO: 177460 - RNA, 22 nt, Homo sapiens
uagacccauuacguaguuucca

SEQ ID NO: 177461 - RNA, 22 nt, Homo sapiens
uagagcaaugacucuggaaacc

SEQ ID NO: 177462 - RNA, 22 nt, Homo sapiens
uagagcuagggacucgcaaugu

SEQ ID NO: 177463 - RNA, 22 nt, Homo sapiens
uagaguguuuuguuaggcagca

SEQ ID NO: 177464 - RNA, 22 nt, Homo sapiens
uagauaguaaagccauuagcuu

SEQ ID NO: 177465 - RNA, 21 nt, Homo sapiens
uagauaguugguucugaaucu

SEQ ID NO: 177466 - RNA, 22 nt, Homo sapiens
uagaucaauuaauuguuacuug

SEQ ID NO: 177467 - RNA, 20 nt, Homo sapiens
uagaugcauuuagauucauu

SEQ ID NO: 177468 - RNA, 22 nt, Homo sapiens
uagauuauuggcugauuugauc

SEQ ID NO: 177469 - RNA, 23 nt, Homo sapiens
uagcaacaguuggaggugaggua

SEQ ID NO: 177470 - RNA, 20 nt, Homo sapiens
uagcacacauguagaauagu

SEQ ID NO: 177471 - RNA, 17 nt, Homo sapiens
uagcacagugccuggua

SEQ ID NO: 177472 - RNA, 20 nt, Homo sapiens
uagcacaucuggcuguagag

SEQ ID NO: 177473 - RNA, 22 nt, Homo sapiens
uagcacaucuucuuggccugca

SEQ ID NO: 177474 - RNA, 22 nt, Homo sapiens
uagcaccuuagcauuucuagug

SEQ ID NO: 177475 - RNA, 22 nt, Homo sapiens
uagcagaauaacuugccagccu

SEQ ID NO: 177476 - RNA, 22 nt, Homo sapiens
uagcagcaaagcaggaucugcu

SEQ ID NO: 177477 - RNA, 22 nt, Homo sapiens
uagcagcaccccacucuacugg

SEQ ID NO: 177478 - RNA, 22 nt, Homo sapiens
uagcagcauaaauggacuaaga

SEQ ID NO: 177479 - RNA, 22 nt, Homo sapiens
uagcaggaaaggggucagaucu

SEQ ID NO: 177480 - RNA, 22 nt, Homo sapiens
uagcagguguuccacaaauauu

SEQ ID NO: 177481 - RNA, 22 nt, Homo sapiens
uagcaguaaagaaugugauguu

SEQ ID NO: 177482 - RNA, 22 nt, Homo sapiens
uagcaguauaugagagcuauug

SEQ ID NO: 177483 - RNA, 22 nt, Homo sapiens
uagcaucaauucauguuaugau

SEQ ID NO: 177484 - RNA, 22 nt, Homo sapiens
uagcaugacacuuguugaaugc

SEQ ID NO: 177485 - RNA, 18 nt, Homo sapiens
uagcaugaugcugagugc

SEQ ID NO: 177486 - RNA, 22 nt, Homo sapiens
uagcauggaggcggccauagug

SEQ ID NO: 177487 - RNA, 22 nt, Homo sapiens
uagcccagugagguugauuugg

SEQ ID NO: 177488 - RNA, 22 nt, Homo sapiens
uagccgggugugguggaacucc

SEQ ID NO: 177489 - RNA, 22 nt, Homo sapiens
ucagugggcuauguaauuaacu

SEQ ID NO: 177490 - RNA, 22 nt, Homo sapiens
ucaguucauggaggugucugcu

SEQ ID NO: 177491 - RNA, 22 nt, Homo sapiens
ucauacuguccaauucuagugg

SEQ ID NO: 177492 - RNA, 20 nt, Homo sapiens
ucauagggugguggcagugg

SEQ ID NO: 177493 - RNA, 22 nt, Homo sapiens
ucauaggucugagaagaaaaua

SEQ ID NO: 177494 - RNA, 22 nt, Homo sapiens
ucauauguaugugcaauuuugu

SEQ ID NO: 177495 - RNA, 22 nt, Homo sapiens
ucauauugcgguucauugacuu

SEQ ID NO: 177496 - RNA, 21 nt, Homo sapiens
ucaucaagcuguagacaugau

SEQ ID NO: 177497 - RNA, 22 nt, Homo sapiens
ucaucuggcgaaugugaagagu

SEQ ID NO: 177498 - RNA, 22 nt, Homo sapiens
ucaugaaguaguuaacugguug

SEQ ID NO: 177499 - RNA, 23 nt, Homo sapiens
ucaugaggccauucaaauccauu

SEQ ID NO: 177500 - RNA, 22 nt, Homo sapiens
ucaugcaaugagucaggaggca

SEQ ID NO: 177501 - RNA, 22 nt, Homo sapiens
ucauggggugcuuugcuagauu

SEQ ID NO: 177502 - RNA, 22 nt, Homo sapiens
ucauggguuuugguccaagcaa

SEQ ID NO: 177503 - RNA, 22 nt, Homo sapiens
ucauguauuaucauuagugggu

SEQ ID NO: 177504 - RNA, 22 nt, Homo sapiens
ucaugugagcaaguugggcuca

SEQ ID NO: 177505 - RNA, 22 nt, Homo sapiens
ucauuagagaucuuggggaaaa

SEQ ID NO: 177506 - RNA, 22 nt, Homo sapiens
ucauucauuugcucacuccaca

SEQ ID NO: 177507 - RNA, 22 nt, Homo sapiens
ucauucuuucuguggaggggcu

SEQ ID NO: 177508 - RNA, 22 nt, Homo sapiens
ucauugcacuucuuuaguugca

SEQ ID NO: 177509 - RNA, 21 nt, Homo sapiens
ucauugggugcagcccacccu

SEQ ID NO: 177510 - RNA, 22 nt, Homo sapiens
uccaagaugcuggcagcuacag

SEQ ID NO: 177511 - RNA, 22 nt, Homo sapiens
uccacaguggugaggugcagca

SEQ ID NO: 177512 - RNA, 19 nt, Homo sapiens
uccacagugguugaacuag

SEQ ID NO: 177513 - RNA, 22 nt, Homo sapiens
uccacagugguugaacuaguuu

SEQ ID NO: 177514 - RNA, 18 nt, Homo sapiens
uccacgugcuuuccagau

SEQ ID NO: 177515 - RNA, 21 nt, Homo sapiens
uccagcuuugagaguuguggu

SEQ ID NO: 177516 - RNA, 22 nt, Homo sapiens
uccagcuuuuucuaauucugug

SEQ ID NO: 177517 - RNA, 22 nt, Homo sapiens
uccagugcauucagacacuugg

SEQ ID NO: 177518 - RNA, 20 nt, Homo sapiens
uccaguuuuggagacauucu

SEQ ID NO: 177519 - RNA, 22 nt, Homo sapiens
uccaguuuuguuaacauauggu

SEQ ID NO: 177520 - RNA, 22 nt, Homo sapiens
uccauaguacuagaaacugacc

SEQ ID NO: 177521 - RNA, 22 nt, Homo sapiens
uccauguagaagacaggggaga

SEQ ID NO: 177522 - RNA, 22 nt, Homo sapiens
uccauugucuagauguaacaca

SEQ ID NO: 177523 - RNA, 19 nt, Homo sapiens
ucccaauguuuccaggcag

SEQ ID NO: 177524 - RNA, 22 nt, Homo sapiens
ucccaguauucauuuacagaag

SEQ ID NO: 177525 - RNA, 22 nt, Homo sapiens
ucccaguuuuucugaauaguca

SEQ ID NO: 177526 - RNA, 22 nt, Homo sapiens
uccccaguaggcaauuaacacc

SEQ ID NO: 177527 - RNA, 19 nt, Homo sapiens
uccccaguuuuccguucag

SEQ ID NO: 177528 - RNA, 22 nt, Homo sapiens
uccccgagcccaggcugugacu

SEQ ID NO: 177529 - RNA, 22 nt, Homo sapiens
uccccgucacacgcaggcuuac

SEQ ID NO: 177530 - RNA, 22 nt, Homo sapiens
uccccugagaccccucagcacu

SEQ ID NO: 177531 - RNA, 22 nt, Homo sapiens
uccccugagucaccugcuucuc

SEQ ID NO: 177532 - RNA, 19 nt, Homo sapiens
uccccuguggauaccaaga

SEQ ID NO: 177533 - RNA, 22 nt, Homo sapiens
uccccuuuguaagauggaaacg

SEQ ID NO: 177534 - RNA, 22 nt, Homo sapiens
ucccuacugggguacugccuag

SEQ ID NO: 177535 - RNA, 22 nt, Homo sapiens
ucccugaaagcugagauuggaa

SEQ ID NO: 177536 - RNA, 22 nt, Homo sapiens
ucccugagcaaaguuuucugua

SEQ ID NO: 177537 - RNA, 22 nt, Homo sapiens
ucccuggacagccuugccuggg

SEQ ID NO: 177538 - RNA, 22 nt, Homo sapiens
ucccuggagcaagagaagaagg

SEQ ID NO: 177539 - RNA, 22 nt, Homo sapiens
uccucauggagaaccucugcua

SEQ ID NO: 177540 - RNA, 20 nt, Homo sapiens
uccugagauucccaguucuc

SEQ ID NO: 177541 - RNA, 22 nt, Homo sapiens
uccuugagccugggaguuauag

SEQ ID NO: 177542 - RNA, 22 nt, Homo sapiens
uccuugagucuuugcucagaug

SEQ ID NO: 177543 - RNA, 22 nt, Homo sapiens
uccuuggucaaaaagaaagugu

SEQ ID NO: 177544 - RNA, 22 nt, Homo sapiens
uccuuggucauggaagagacag

SEQ ID NO: 177545 - RNA, 22 nt, Homo sapiens
uccuuggugacauuucuugucu

SEQ ID NO: 177546 - RNA, 21 nt, Homo sapiens
uccuuggugaugcccugcagu

SEQ ID NO: 177547 - RNA, 23 nt, Homo sapiens
uccuugguuggcgcccuaugugu

SEQ ID NO: 177548 - RNA, 18 nt, Homo sapiens
uccuuuugggguaggaga

SEQ ID NO: 177549 - RNA, 22 nt, Homo sapiens
ucgacacugaccuaguucagca

SEQ ID NO: 177550 - RNA, 22 nt, Homo sapiens
ucgcaccauugcacuccagcca

SEQ ID NO: 177551 - RNA, 22 nt, Homo sapiens
ucgcagcacgagcaugcaaggu

SEQ ID NO: 177552 - RNA, 19 nt, Homo sapiens
ucgcgccauucuccugccu

SEQ ID NO: 177553 - RNA, 17 nt, Homo sapiens
ucuaauaauaugcauuu

SEQ ID NO: 177554 - RNA, 22 nt, Homo sapiens
ucuaaugcucugagaacagugc

SEQ ID NO: 177555 - RNA, 22 nt, Homo sapiens
ucuaauguaaccugcaaauauu

SEQ ID NO: 177556 - RNA, 21 nt, Homo sapiens
ucuaccuacugcucacaggcu

SEQ ID NO: 177557 - RNA, 22 nt, Homo sapiens
ucuagccuaugaagcuugucca

SEQ ID NO: 177558 - RNA, 22 nt, Homo sapiens
ucucaaccuccacacuacaaua

SEQ ID NO: 177559 - RNA, 22 nt, Homo sapiens
ucucaaguaacugggacaauaa

SEQ ID NO: 177560 - RNA, 22 nt, Homo sapiens
ucucacauuucacagggauggg

SEQ ID NO: 177561 - RNA, 22 nt, Homo sapiens
ucucagugaauugguuuugucu

SEQ ID NO: 177562 - RNA, 22 nt, Homo sapiens
ucucaguggugcuggcagggga

SEQ ID NO: 177563 - RNA, 22 nt, Homo sapiens
ucucaugaagguggagaguagg

SEQ ID NO: 177564 - RNA, 23 nt, Homo sapiens
ucucauuccuugaaaauaaugac

SEQ ID NO: 177565 - RNA, 21 nt, Homo sapiens
ucucauugugguuuuaauugg

SEQ ID NO: 177566 - RNA, 22 nt, Homo sapiens
ucuccaguuuccuucgucuauc

SEQ ID NO: 177567 - RNA, 22 nt, Homo sapiens
ucuccauuguccagaugaggaa

SEQ ID NO: 177568 - RNA, 22 nt, Homo sapiens
ucucugaaacucuugacauccu

SEQ ID NO: 177569 - RNA, 22 nt, Homo sapiens
ucucuguuuauuuuugguguau

SEQ ID NO: 177570 - RNA, 19 nt, Homo sapiens
ucugacagccccagucaac

SEQ ID NO: 177571 - RNA, 22 nt, Homo sapiens
ucugacagugagagaaaucuga

SEQ ID NO: 177572 - RNA, 22 nt, Homo sapiens
ucugagacuguuucuaacaagc

SEQ ID NO: 177573 - RNA, 22 nt, Homo sapiens
ucugagguuacugcuuuguaga

SEQ ID NO: 177574 - RNA, 22 nt, Homo sapiens
ucugaguggcagaaugagcuga

SEQ ID NO: 177575 - RNA, 22 nt, Homo sapiens
ucugauggaguugccagggaga

SEQ ID NO: 177576 - RNA, 22 nt, Homo sapiens
ucugcaagucuaaacuagccau

SEQ ID NO: 177577 - RNA, 22 nt, Homo sapiens
ucuggagugugaaguggauaug

SEQ ID NO: 177578 - RNA, 22 nt, Homo sapiens
ucuggcacugaugugggaugcu

SEQ ID NO: 177579 - RNA, 22 nt, Homo sapiens
ucuggcauuuucucugcuugca

SEQ ID NO: 177580 - RNA, 20 nt, Homo sapiens
ucuggccccuccaaaucuca

SEQ ID NO: 177581 - RNA, 23 nt, Homo sapiens
ucuggcuuugggaugcucaaggg

SEQ ID NO: 177582 - RNA, 22 nt, Homo sapiens
ucugguggugaugagagacagu

SEQ ID NO: 177583 - RNA, 22 nt, Homo sapiens
ucugguguuauucauguaguuu

SEQ ID NO: 177584 - RNA, 23 nt, Homo sapiens
ucugguguugucaaaugcugguu

SEQ ID NO: 177585 - RNA, 22 nt, Homo sapiens
ucugguuccugcauucauucaa

SEQ ID NO: 177586 - RNA, 22 nt, Homo sapiens
ucugguuccuuggcuucggguc

SEQ ID NO: 177587 - RNA, 22 nt, Homo sapiens
ucuguacugccaaguuucuuua

SEQ ID NO: 177588 - RNA, 22 nt, Homo sapiens
ucuguacuuccguaccuaaagu

SEQ ID NO: 177589 - RNA, 19 nt, Homo sapiens
ucugucacuggggguauuc

SEQ ID NO: 177590 - RNA, 22 nt, Homo sapiens
ucugugcauuguaggauguuua

SEQ ID NO: 177591 - RNA, 22 nt, Homo sapiens
ucuguguuuagacccaggguag

SEQ ID NO: 177592 - RNA, 22 nt, Homo sapiens
ucuguugguucuuugaggagga

SEQ ID NO: 177593 - RNA, 22 nt, Homo sapiens
ucuguuguuguuuuaagagaca

SEQ ID NO: 177594 - RNA, 22 nt, Homo sapiens
ucuuaggauacugaagucgguu

SEQ ID NO: 177595 - RNA, 22 nt, Homo sapiens
ucuuaguuuagauuagcaauuc

SEQ ID NO: 177596 - RNA, 22 nt, Homo sapiens
ucuugcaauuuccuuaguggug

SEQ ID NO: 177597 - RNA, 22 nt, Homo sapiens
ucuugccacuucauccccuuuc

SEQ ID NO: 177598 - RNA, 22 nt, Homo sapiens
ugagacugagucucgcucuauu

SEQ ID NO: 177599 - RNA, 22 nt, Homo sapiens
ugagacugauaggacauuuucu

SEQ ID NO: 177600 - RNA, 22 nt, Homo sapiens
ugagagacagacauuaucuuau

SEQ ID NO: 177601 - RNA, 19 nt, Homo sapiens
ugagagcacaacugaacaa

SEQ ID NO: 177602 - RNA, 22 nt, Homo sapiens
ugagauagaaaacauaggagaa

SEQ ID NO: 177603 - RNA, 22 nt, Homo sapiens
ugagaucaaggugggcccuggg

SEQ ID NO: 177604 - RNA, 22 nt, Homo sapiens
ugagaucacuaagagguaaugg

SEQ ID NO: 177605 - RNA, 18 nt, Homo sapiens
ugagaucagcaucaaggg

SEQ ID NO: 177606 - RNA, 22 nt, Homo sapiens
ugagaucaugccacugcacuuc

SEQ ID NO: 177607 - RNA, 20 nt, Homo sapiens
ugagauccacgugaaguaug

SEQ ID NO: 177608 - RNA, 22 nt, Homo sapiens
ugagauccugugacuacacuga

SEQ ID NO: 177609 - RNA, 22 nt, Homo sapiens
ugagaucugucuuuauaguauu

SEQ ID NO: 177610 - RNA, 19 nt, Homo sapiens
ugagaucuuuacuggguuu

SEQ ID NO: 177611 - RNA, 22 nt, Homo sapiens
ugagaugaagugauguaaaaca

SEQ ID NO: 177612 - RNA, 22 nt, Homo sapiens
ugagaugacgacacaccucagu

SEQ ID NO: 177613 - RNA, 22 nt, Homo sapiens
ugagaugagucucgcucuguca

SEQ ID NO: 177614 - RNA, 22 nt, Homo sapiens
ugagaugaguugcuggcucuga

SEQ ID NO: 177615 - RNA, 22 nt, Homo sapiens
ugagaugcaaaaugagaauugu

SEQ ID NO: 177616 - RNA, 21 nt, Homo sapiens
ugagaugcaaucaccagggag

SEQ ID NO: 177617 - RNA, 22 nt, Homo sapiens
ugagauggaguuucgcccuugu

SEQ ID NO: 177618 - RNA, 22 nt, Homo sapiens
ugagauggaucuuggauuugaa

SEQ ID NO: 177619 - RNA, 22 nt, Homo sapiens
ugagauggcuuuauugcugaau

SEQ ID NO: 177620 - RNA, 22 nt, Homo sapiens
ugagaugugaucaccugaaggg

SEQ ID NO: 177621 - RNA, 22 nt, Homo sapiens
ugagauguuuguuucagugccu

SEQ ID NO: 177622 - RNA, 21 nt, Homo sapiens
ugagauuaaguuguuuagaag

SEQ ID NO: 177623 - RNA, 21 nt, Homo sapiens
ugagauuauauuaacauggua

SEQ ID NO: 177624 - RNA, 22 nt, Homo sapiens
ugagauuauauuucuuaacaga

SEQ ID NO: 177625 - RNA, 22 nt, Homo sapiens
ugagauuaucguaauguaucuc

SEQ ID NO: 177626 - RNA, 20 nt, Homo sapiens
ugagauuggugugguauaag

SEQ ID NO: 177627 - RNA, 22 nt, Homo sapiens
ugagauuguuagaucaaauggu

SEQ ID NO: 177628 - RNA, 22 nt, Homo sapiens
ugagauuguucuaugucugguu

SEQ ID NO: 177629 - RNA, 22 nt, Homo sapiens
ugagcaaaauuuuggacauaga

SEQ ID NO: 177630 - RNA, 22 nt, Homo sapiens
ugagcaagaucuuuauaauuag

SEQ ID NO: 177631 - RNA, 23 nt, Homo sapiens
ugagcaauauucuacuauugagu

SEQ ID NO: 177632 - RNA, 22 nt, Homo sapiens
ugagcagagaucacggcauugu

SEQ ID NO: 177633 - RNA, 22 nt, Homo sapiens
ugagcagagggagaaguaaauu

SEQ ID NO: 177634 - RNA, 22 nt, Homo sapiens
ugagcauauugugauaccuaaa

SEQ ID NO: 177635 - RNA, 21 nt, Homo sapiens
ugagcauuaguacaguaggga

SEQ ID NO: 177636 - RNA, 22 nt, Homo sapiens
ugagcauuguguuugacuguga

SEQ ID NO: 177637 - RNA, 22 nt, Homo sapiens
ugagccaaguucacaccauugc

SEQ ID NO: 177638 - RNA, 22 nt, Homo sapiens
ugagccaugguuagcuucucau

SEQ ID NO: 177639 - RNA, 22 nt, Homo sapiens
ugagcccauuguccugguuuau

SEQ ID NO: 177640 - RNA, 22 nt, Homo sapiens
ugagcuagagaguuuaguguca

SEQ ID NO: 177641 - RNA, 17 nt, Homo sapiens
ugagcuaugauccuguc

SEQ ID NO: 177642 - RNA, 20 nt, Homo sapiens
ugagcucaugacauuuuucu

SEQ ID NO: 177643 - RNA, 22 nt, Homo sapiens
ugagcugagacaauaaguuuuu

SEQ ID NO: 177644 - RNA, 22 nt, Homo sapiens
ugagcugagaucuuaccacugc

SEQ ID NO: 177645 - RNA, 22 nt, Homo sapiens
ugagcugguacuaauauuauca

SEQ ID NO: 177646 - RNA, 18 nt, Homo sapiens
ugaggaaaggguuugcua

SEQ ID NO: 177647 - RNA, 22 nt, Homo sapiens
ugaggaguauguucuguagacc

SEQ ID NO: 177648 - RNA, 22 nt, Homo sapiens
ugaggagugaacuauuucugau

SEQ ID NO: 177649 - RNA, 22 nt, Homo sapiens
ugaggaucucuaggaauuuauc

SEQ ID NO: 177650 - RNA, 22 nt, Homo sapiens
ugaggcacucccuagcggggug

SEQ ID NO: 177651 - RNA, 22 nt, Homo sapiens
ugaggcuaggauaggcugauuc

SEQ ID NO: 177652 - RNA, 17 nt, Homo sapiens
ugagggaugccugguuc

SEQ ID NO: 177653 - RNA, 22 nt, Homo sapiens
ugagguaacaaacuaugaguua

SEQ ID NO: 177654 - RNA, 22 nt, Homo sapiens
ugagguaagauguucauuuuuc

SEQ ID NO: 177655 - RNA, 22 nt, Homo sapiens
ugagguagaggugaacuugacc

SEQ ID NO: 177656 - RNA, 22 nt, Homo sapiens
ugagguaggugaagaaugcacg

SEQ ID NO: 177657 - RNA, 22 nt, Homo sapiens
ugagguaucauugcccaggcug

SEQ ID NO: 177658 - RNA, 22 nt, Homo sapiens
ugagguaugacuuauuauucuu

SEQ ID NO: 177659 - RNA, 22 nt, Homo sapiens
ugaggucauguucugucagguu

SEQ ID NO: 177660 - RNA, 20 nt, Homo sapiens
ugaggucugagaaagaauga

SEQ ID NO: 177661 - RNA, 22 nt, Homo sapiens
ugaggugaggguaucaaaugcu

SEQ ID NO: 177662 - RNA, 22 nt, Homo sapiens
ugagguuggggucagggcuagc

SEQ ID NO: 177663 - RNA, 22 nt, Homo sapiens
ugagguuggguaauuuaugaag

SEQ ID NO: 177664 - RNA, 22 nt, Homo sapiens
ugagguugguauuacugucucu

SEQ ID NO: 177665 - RNA, 20 nt, Homo sapiens
ugaguagaggaguucuauca

SEQ ID NO: 177666 - RNA, 22 nt, Homo sapiens
ugaguagcuaagacgauaggca

SEQ ID NO: 177667 - RNA, 21 nt, Homo sapiens
ugaguagcuagaacuaggggc

SEQ ID NO: 177668 - RNA, 22 nt, Homo sapiens
ugaguaucuugaugaauuugaa

SEQ ID NO: 177669 - RNA, 22 nt, Homo sapiens
ugagucaauucuaacaauggca

SEQ ID NO: 177670 - RNA, 23 nt, Homo sapiens
ugagucacuuugcuggggucucu

SEQ ID NO: 177671 - RNA, 22 nt, Homo sapiens
ugagucauuuccuuaugcuacu

SEQ ID NO: 177672 - RNA, 22 nt, Homo sapiens
ugagugaggcugggcagucccu

SEQ ID NO: 177673 - RNA, 22 nt, Homo sapiens
ugaguggagaucgcaccauugc

SEQ ID NO: 177674 - RNA, 22 nt, Homo sapiens
ugagugugaggaagaauuagaa

SEQ ID NO: 177675 - RNA, 22 nt, Homo sapiens
ugaguuaaucucuacgauagaa

SEQ ID NO: 177676 - RNA, 22 nt, Homo sapiens
ugaguuaggagaguguggcucu

SEQ ID NO: 177677 - RNA, 22 nt, Homo sapiens
ugaguuagguguuuuaaauaua

SEQ ID NO: 177678 - RNA, 22 nt, Homo sapiens
ugaguucaauuguauuuuauua

SEQ ID NO: 177679 - RNA, 22 nt, Homo sapiens
ugaguucuuuguagauucugug

SEQ ID NO: 177680 - RNA, 22 nt, Homo sapiens
ugauacugugcauuagaggcua

SEQ ID NO: 177681 - RNA, 22 nt, Homo sapiens
ugauagaucugggcaaaguaaa

SEQ ID NO: 177682 - RNA, 22 nt, Homo sapiens
ugauaggagauuuucaucugua

SEQ ID NO: 177683 - RNA, 22 nt, Homo sapiens
ugauaggucuguuuugaaaagg

SEQ ID NO: 177684 - RNA, 22 nt, Homo sapiens
ugauaguguccugugccacauu

SEQ ID NO: 177685 - RNA, 18 nt, Homo sapiens
ugauaucaucacaauuga

SEQ ID NO: 177686 - RNA, 22 nt, Homo sapiens
ugauaucugaucauccuugaua

SEQ ID NO: 177687 - RNA, 22 nt, Homo sapiens
ugauaugucccucgacaucagg

SEQ ID NO: 177688 - RNA, 22 nt, Homo sapiens
ugauauguggauucagcucaaa

SEQ ID NO: 177689 - RNA, 22 nt, Homo sapiens
ugauauguuagaaucuugcaag

SEQ ID NO: 177690 - RNA, 20 nt, Homo sapiens
ugauauuucuggaaguggag

SEQ ID NO: 177691 - RNA, 22 nt, Homo sapiens
ugaucacagcuugacuaaagga

SEQ ID NO: 177692 - RNA, 22 nt, Homo sapiens
ugaucuguccaccucagcuucc

SEQ ID NO: 177693 - RNA, 22 nt, Homo sapiens
ugaugcuaccuaaagcaaccau

SEQ ID NO: 177694 - RNA, 22 nt, Homo sapiens
ugauggcauuuggaguugggac

SEQ ID NO: 177695 - RNA, 22 nt, Homo sapiens
ugaugguuuuaaaaagaggagu

SEQ ID NO: 177696 - RNA, 22 nt, Homo sapiens
ugaugguuuuauaagggagagu

SEQ ID NO: 177697 - RNA, 23 nt, Homo sapiens
ugauguccacuuagggucuaggu

SEQ ID NO: 177698 - RNA, 22 nt, Homo sapiens
ugaugugucaucugagagagug

SEQ ID NO: 177699 - RNA, 21 nt, Homo sapiens
ugauguugaccuaaguaguga

SEQ ID NO: 177700 - RNA, 22 nt, Homo sapiens
ugauugcacaccugcacucaag

SEQ ID NO: 177701 - RNA, 19 nt, Homo sapiens
ugauuguaagcuuggugag

SEQ ID NO: 177702 - RNA, 22 nt, Homo sapiens
ugauugucucuccugccccauc

SEQ ID NO: 177703 - RNA, 22 nt, Homo sapiens
ugauuuguuucaggaguuuucu

SEQ ID NO: 177704 - RNA, 18 nt, Homo sapiens
ugcaaacauguguguguu

SEQ ID NO: 177705 - RNA, 22 nt, Homo sapiens
ugcaaagaaauuuuggugacca

SEQ ID NO: 177706 - RNA, 22 nt, Homo sapiens
ugcaacacauugccccugcucu

SEQ ID NO: 177707 - RNA, 22 nt, Homo sapiens
ugcaagacaucguauuuugguc

SEQ ID NO: 177708 - RNA, 22 nt, Homo sapiens
aaaagagcugagagguauucuu

SEQ ID NO: 177709 - RNA, 22 nt, Homo sapiens
aaaagcauucagagugcugggc

SEQ ID NO: 177710 - RNA, 22 nt, Homo sapiens
aaaagucuguagugaaagguga

SEQ ID NO: 177711 - RNA, 18 nt, Homo sapiens
aaacagugucucuuucug

SEQ ID NO: 177712 - RNA, 22 nt, Homo sapiens
aaaccacagugugcugcugggg

SEQ ID NO: 177713 - RNA, 22 nt, Homo sapiens
aaacccauauaccagcugugcu

SEQ ID NO: 177714 - RNA, 22 nt, Homo sapiens
aaacugaucugaaggccaggcu

SEQ ID NO: 177715 - RNA, 18 nt, Homo sapiens
aaacugcuuccuuggccu

SEQ ID NO: 177716 - RNA, 22 nt, Homo sapiens
aaagcagcaggugguuuucaau

SEQ ID NO: 177717 - RNA, 22 nt, Homo sapiens
aaagcuagagaagcugcuguca

SEQ ID NO: 177718 - RNA, 22 nt, Homo sapiens
aaaggcacugugacuuuauagg

SEQ ID NO: 177719 - RNA, 19 nt, Homo sapiens
aaagguaguaaccucugau

SEQ ID NO: 177720 - RNA, 22 nt, Homo sapiens
aaaguacucaguucaguuccgu

SEQ ID NO: 177721 - RNA, 22 nt, Homo sapiens
aaaguacugggauuggccgggu

SEQ ID NO: 177722 - RNA, 22 nt, Homo sapiens
aaaguaguagcaguuucugcca

SEQ ID NO: 177723 - RNA, 22 nt, Homo sapiens
aaagucuagaggaucaugugug

SEQ ID NO: 177724 - RNA, 22 nt, Homo sapiens
aaagugauguccaggcuuucag

SEQ ID NO: 177725 - RNA, 22 nt, Homo sapiens
aaagugauugcgguuuuugcca

SEQ ID NO: 177726 - RNA, 22 nt, Homo sapiens
aaagugcaguauuugggcagga

SEQ ID NO: 177727 - RNA, 22 nt, Homo sapiens
aaagugccugacucauaguuag

SEQ ID NO: 177728 - RNA, 22 nt, Homo sapiens
aaagugcugagauuguaggcau

SEQ ID NO: 177729 - RNA, 22 nt, Homo sapiens
aaagugcugggauuaggccagg

SEQ ID NO: 177730 - RNA, 22 nt, Homo sapiens
aaagugcugggauuggccgggc

SEQ ID NO: 177731 - RNA, 22 nt, Homo sapiens
aaagugcuuccuuuuugagggu

SEQ ID NO: 177732 - RNA, 22 nt, Homo sapiens
aaaguggacuaagugaauauga

SEQ ID NO: 177733 - RNA, 22 nt, Homo sapiens
aaaguucugcguuagggcuaaa

SEQ ID NO: 177734 - RNA, 22 nt, Homo sapiens
aaaguucuguugauagugcuga

SEQ ID NO: 177735 - RNA, 22 nt, Homo sapiens
aaauaguagcugaaugagggaa

SEQ ID NO: 177736 - RNA, 22 nt, Homo sapiens
aaaugcagcacucaagugggaa

SEQ ID NO: 177737 - RNA, 22 nt, Homo sapiens
aaaugcaguugguggggauaug

SEQ ID NO: 177738 - RNA, 22 nt, Homo sapiens
aaaugcucuguggguaguaaug

SEQ ID NO: 177739 - RNA, 18 nt, Homo sapiens
aaaugcucuucuggaaua

SEQ ID NO: 177740 - RNA, 22 nt, Homo sapiens
aaaugcucuuuaugaaguugga

SEQ ID NO: 177741 - RNA, 22 nt, Homo sapiens
aaauggcuuuuugggcaaggug

SEQ ID NO: 177742 - RNA, 19 nt, Homo sapiens
aaaugugcacuguuuucca

SEQ ID NO: 177743 - RNA, 22 nt, Homo sapiens
aaauucaugucaccucuaggua

SEQ ID NO: 177744 - RNA, 22 nt, Homo sapiens
aaauucauuucagcucugggua

SEQ ID NO: 177745 - RNA, 22 nt, Homo sapiens
aaauugcaaugcgaggcagagg

SEQ ID NO: 177746 - RNA, 22 nt, Homo sapiens
aaauuguccuacugguuugagu

SEQ ID NO: 177747 - RNA, 22 nt, Homo sapiens
aacagaccuagauaguauaguc

SEQ ID NO: 177748 - RNA, 22 nt, Homo sapiens
aacagagcuggugacuccaggu

SEQ ID NO: 177749 - RNA, 23 nt, Homo sapiens
aauugcacauuccuugcuggcag

SEQ ID NO: 177750 - RNA, 22 nt, Homo sapiens
aauugcacuaagcauaguccag

SEQ ID NO: 177751 - RNA, 22 nt, Homo sapiens
aauugcauugaauuuguagcuu

SEQ ID NO: 177752 - RNA, 22 nt, Homo sapiens
aauugcuucuguauuuuggaca

SEQ ID NO: 177753 - RNA, 22 nt, Homo sapiens
aauuguacucccauaauucccu

SEQ ID NO: 177754 - RNA, 22 nt, Homo sapiens
aauuguacucccaucauuccua

SEQ ID NO: 177755 - RNA, 20 nt, Homo sapiens
acaaaugcauucugugacau

SEQ ID NO: 177756 - RNA, 22 nt, Homo sapiens
acaagacuucuuguauucuagu

SEQ ID NO: 177757 - RNA, 22 nt, Homo sapiens
acaagugaauacaggauucucu

SEQ ID NO: 177758 - RNA, 22 nt, Homo sapiens
acacaguaaauauguauugaau

SEQ ID NO: 177759 - RNA, 22 nt, Homo sapiens
acacaguaagcacaguguagau

SEQ ID NO: 177760 - RNA, 22 nt, Homo sapiens
acacaguauaugacaaugcuuu

SEQ ID NO: 177761 - RNA, 22 nt, Homo sapiens
acacagucaaauccacuuggcu

SEQ ID NO: 177762 - RNA, 22 nt, Homo sapiens
acacagugucuguguauuuaaa

SEQ ID NO: 177763 - RNA, 22 nt, Homo sapiens
acacaugcuccacuguggccuc

SEQ ID NO: 177764 - RNA, 22 nt, Homo sapiens
acacaugugaaaaaaauguuac

SEQ ID NO: 177765 - RNA, 22 nt, Homo sapiens
acaccuguggucccaguaacuu

SEQ ID NO: 177766 - RNA, 20 nt, Homo sapiens
acacuggcuuugagauuuag

SEQ ID NO: 177767 - RNA, 22 nt, Homo sapiens
acacuguagcugagggcaugcg

SEQ ID NO: 177768 - RNA, 22 nt, Homo sapiens
acacuguauccuucuguccuuu

SEQ ID NO: 177769 - RNA, 20 nt, Homo sapiens
acacugugcuaaggauuuuc

SEQ ID NO: 177770 - RNA, 22 nt, Homo sapiens
acacuuucuagacaagggaaua

SEQ ID NO: 177771 - RNA, 19 nt, Homo sapiens
acagauagaauguucuaca

SEQ ID NO: 177772 - RNA, 22 nt, Homo sapiens
acagauagacauauauagcuca

SEQ ID NO: 177773 - RNA, 22 nt, Homo sapiens
acaguaaugggccccuuuuccu

SEQ ID NO: 177774 - RNA, 20 nt, Homo sapiens
acaguagaagggauuucaaa

SEQ ID NO: 177775 - RNA, 21 nt, Homo sapiens
acaguaguaauaguguagcca

SEQ ID NO: 177776 - RNA, 22 nt, Homo sapiens
acaguagugggcuacagaauca

SEQ ID NO: 177777 - RNA, 22 nt, Homo sapiens
acaguauaaugcuguagggaga

SEQ ID NO: 177778 - RNA, 23 nt, Homo sapiens
acaguauguggauguggcuaagu

SEQ ID NO: 177779 - RNA, 22 nt, Homo sapiens
acagucauagcagccuuuguua

SEQ ID NO: 177780 - RNA, 18 nt, Homo sapiens
acagugcuggcaugagau

SEQ ID NO: 177781 - RNA, 18 nt, Homo sapiens
acagugcugucacugcuu

SEQ ID NO: 177782 - RNA, 22 nt, Homo sapiens
acagugcugucugcuuuggcua

SEQ ID NO: 177783 - RNA, 22 nt, Homo sapiens
acagugcuuucaauguucagua

SEQ ID NO: 177784 - RNA, 17 nt, Homo sapiens
acagugcuuugcuuucc

SEQ ID NO: 177785 - RNA, 22 nt, Homo sapiens
acagugcuuuuguuccucuccu

SEQ ID NO: 177786 - RNA, 22 nt, Homo sapiens
acaguggugcgaucucggcuca

SEQ ID NO: 177787 - RNA, 23 nt, Homo sapiens
acaguggugugaucuuggcucag

SEQ ID NO: 177788 - RNA, 22 nt, Homo sapiens
acaguguagugacugccaacuu

SEQ ID NO: 177789 - RNA, 22 nt, Homo sapiens
acagugucaugucguguucccc

SEQ ID NO: 177790 - RNA, 18 nt, Homo sapiens
acagugucuuacaccugu

SEQ ID NO: 177791 - RNA, 22 nt, Homo sapiens
acaguguguguguucaccuaga

SEQ ID NO: 177792 - RNA, 22 nt, Homo sapiens
acauaaagaagcaggacauugu

SEQ ID NO: 177793 - RNA, 22 nt, Homo sapiens
acauaguagacacugaaaauau

SEQ ID NO: 177794 - RNA, 22 nt, Homo sapiens
acaucacuguuugauugauuga

SEQ ID NO: 177795 - RNA, 22 nt, Homo sapiens
acauccauuugcuuuauuugcu

SEQ ID NO: 177796 - RNA, 22 nt, Homo sapiens
acaucccuugcucggggccccu

SEQ ID NO: 177797 - RNA, 22 nt, Homo sapiens
acaucuguacaguggguguggu

SEQ ID NO: 177798 - RNA, 22 nt, Homo sapiens
acaugacauugggguggggaua

SEQ ID NO: 177799 - RNA, 22 nt, Homo sapiens
acaugcauccaugugaagagac

SEQ ID NO: 177800 - RNA, 21 nt, Homo sapiens
acauguacacauguaugcaca

SEQ ID NO: 177801 - RNA, 22 nt, Homo sapiens
acauguagacaacggacaaagu

SEQ ID NO: 177802 - RNA, 22 nt, Homo sapiens
acauugcagauguguuuaaugu

SEQ ID NO: 177803 - RNA, 22 nt, Homo sapiens
acauugcauauggcacccucuu

SEQ ID NO: 177804 - RNA, 22 nt, Homo sapiens
accaguguuuaccaaguagcau

SEQ ID NO: 177805 - RNA, 22 nt, Homo sapiens
accauugcacuccagccuuggc

SEQ ID NO: 177806 - RNA, 22 nt, Homo sapiens
acccaguguugggcagaacugu

SEQ ID NO: 177807 - RNA, 21 nt, Homo sapiens
acccccacaccuccuuaguuc

SEQ ID NO: 177808 - RNA, 17 nt, Homo sapiens
accccuaccucagaagc

SEQ ID NO: 177809 - RNA, 20 nt, Homo sapiens
acccucuaggaugauuucuu

SEQ ID NO: 177810 - RNA, 22 nt, Homo sapiens
acccugacacgauucuucacuu

SEQ ID NO: 177811 - RNA, 22 nt, Homo sapiens
acccugucaaaacggaccaauc

SEQ ID NO: 177812 - RNA, 22 nt, Homo sapiens
acccugucauccacauggugcu

SEQ ID NO: 177813 - RNA, 22 nt, Homo sapiens
acccuuuagguuggaugaggau

SEQ ID NO: 177814 - RNA, 22 nt, Homo sapiens
acccuuugucaaucaguacuaa

SEQ ID NO: 177815 - RNA, 22 nt, Homo sapiens
accugagauuacaggugcuggc

SEQ ID NO: 177816 - RNA, 21 nt, Homo sapiens
accugauguuucaguuggagu

SEQ ID NO: 177817 - RNA, 22 nt, Homo sapiens
accugggugcugaugggcuuua

SEQ ID NO: 177818 - RNA, 22 nt, Homo sapiens
accugguuuuaacauuguauua

SEQ ID NO: 177819 - RNA, 22 nt, Homo sapiens
accuguagcagacuuaauauuu

SEQ ID NO: 177820 - RNA, 22 nt, Homo sapiens
accugugguuacagucugucuc

SEQ ID NO: 177821 - RNA, 22 nt, Homo sapiens
accuucauuguugccaugucca

SEQ ID NO: 177822 - RNA, 22 nt, Homo sapiens
acgaagacuauucaaaagguua

SEQ ID NO: 177823 - RNA, 22 nt, Homo sapiens
acgugguaguacaguauuuuaa

SEQ ID NO: 177824 - RNA, 22 nt, Homo sapiens
acuacaugugaugucaguauau

SEQ ID NO: 177825 - RNA, 22 nt, Homo sapiens
acuagaugauuauguuccauug

SEQ ID NO: 177826 - RNA, 22 nt, Homo sapiens
acuaugcuuuucuuagaauuaa

SEQ ID NO: 177827 - RNA, 22 nt, Homo sapiens
acuccauuucauuuuagcucuu

SEQ ID NO: 177828 - RNA, 22 nt, Homo sapiens
acugagacugagaauguuucuu

SEQ ID NO: 177829 - RNA, 22 nt, Homo sapiens
acugagaucuuuaaauaaauaa

SEQ ID NO: 177830 - RNA, 22 nt, Homo sapiens
acugagccuuuaaaugacuuca

SEQ ID NO: 177831 - RNA, 19 nt, Homo sapiens
acugagcuaccugggggca

SEQ ID NO: 177832 - RNA, 22 nt, Homo sapiens
acugagucauugggugcccaga

SEQ ID NO: 177833 - RNA, 22 nt, Homo sapiens
acugcaaugucgaauagagaug

SEQ ID NO: 177834 - RNA, 23 nt, Homo sapiens
acugcaauuacguuugcaccaac

SEQ ID NO: 177835 - RNA, 21 nt, Homo sapiens
acugcacuccaaccucaacag

SEQ ID NO: 177836 - RNA, 22 nt, Homo sapiens
acugcacuccaaccuguugggc

SEQ ID NO: 177837 - RNA, 22 nt, Homo sapiens
acugcacuccagccucccgucu

SEQ ID NO: 177838 - RNA, 22 nt, Homo sapiens
acugcacuccagccugcccaac

SEQ ID NO: 177839 - RNA, 22 nt, Homo sapiens
acugcacuccagccuggaccac

SEQ ID NO: 177840 - RNA, 22 nt, Homo sapiens
acugcacuccagccuggacgaa

SEQ ID NO: 177841 - RNA, 22 nt, Homo sapiens
acugcacuccagccuggcggac

SEQ ID NO: 177842 - RNA, 22 nt, Homo sapiens
acugcacuccagccugugagac

SEQ ID NO: 177843 - RNA, 22 nt, Homo sapiens
acugcacuccagccuugagagc

SEQ ID NO: 177844 - RNA, 22 nt, Homo sapiens
acugcacuccagccuuggagac

SEQ ID NO: 177845 - RNA, 22 nt, Homo sapiens
acugcacuccagcuccagggug

SEQ ID NO: 177846 - RNA, 22 nt, Homo sapiens
acugcacuccaguuugggcagc

SEQ ID NO: 177847 - RNA, 18 nt, Homo sapiens
acugcacuccauccuagg

SEQ ID NO: 177848 - RNA, 22 nt, Homo sapiens
acugcacucccgcccgggugac

SEQ ID NO: 177849 - RNA, 22 nt, Homo sapiens
acugcacuccuccuugggugac

SEQ ID NO: 177850 - RNA, 22 nt, Homo sapiens
acugcacucuagccccugcgac

SEQ ID NO: 177851 - RNA, 22 nt, Homo sapiens
acugcacucuagcuugggugac

SEQ ID NO: 177852 - RNA, 22 nt, Homo sapiens
acugcacugcagccuggccaac

SEQ ID NO: 177853 - RNA, 22 nt, Homo sapiens
acugcacuguccuagaguccuc

SEQ ID NO: 177854 - RNA, 22 nt, Homo sapiens
acugcacuuauccuccaauguu

SEQ ID NO: 177855 - RNA, 20 nt, Homo sapiens
acugcacuucagccugcugg

SEQ ID NO: 177856 - RNA, 22 nt, Homo sapiens
acugcacuucagccuugggaaa

SEQ ID NO: 177857 - RNA, 22 nt, Homo sapiens
acugcacuucagccuuggggac

SEQ ID NO: 177858 - RNA, 22 nt, Homo sapiens
aggcagucugaguuuugaaagg

SEQ ID NO: 177859 - RNA, 22 nt, Homo sapiens
aggccaguuuuuggagggaaac

SEQ ID NO: 177860 - RNA, 22 nt, Homo sapiens
aggcuagaaucuuccaucuugg

SEQ ID NO: 177861 - RNA, 22 nt, Homo sapiens
aggcuuuuggagguggcuuucu

SEQ ID NO: 177862 - RNA, 22 nt, Homo sapiens
agggcauuguacaaaucaucau

SEQ ID NO: 177863 - RNA, 22 nt, Homo sapiens
agguaaguauguuauuacuuuu

SEQ ID NO: 177864 - RNA, 20 nt, Homo sapiens
agguagauagaugauagaua

SEQ ID NO: 177865 - RNA, 22 nt, Homo sapiens
agguagugugaugcuccuguuu

SEQ ID NO: 177866 - RNA, 21 nt, Homo sapiens
agguaguuuuccuuuuggagu

SEQ ID NO: 177867 - RNA, 22 nt, Homo sapiens
agguauauuggacagauguaaa

SEQ ID NO: 177868 - RNA, 22 nt, Homo sapiens
agguauguaugucuguacagcg

SEQ ID NO: 177869 - RNA, 22 nt, Homo sapiens
aggucccauguccucccugacc

SEQ ID NO: 177870 - RNA, 22 nt, Homo sapiens
aggugguguuggguuccagccc

SEQ ID NO: 177871 - RNA, 22 nt, Homo sapiens
aggugguuuuaggcagagacau

SEQ ID NO: 177872 - RNA, 22 nt, Homo sapiens
agguuaugauuauagagcgagg

SEQ ID NO: 177873 - RNA, 18 nt, Homo sapiens
agguuauuucccaagacu

SEQ ID NO: 177874 - RNA, 21 nt, Homo sapiens
agguuguguuuccucuuacuu

SEQ ID NO: 177875 - RNA, 22 nt, Homo sapiens
agguuuucagccccagccuagg

SEQ ID NO: 177876 - RNA, 22 nt, Homo sapiens
aguaaacuucagaguucuuccu

SEQ ID NO: 177877 - RNA, 22 nt, Homo sapiens
aguaaaucacuaauggcuuccg

SEQ ID NO: 177878 - RNA, 22 nt, Homo sapiens
aguaacaggauccaaagaaugu

SEQ ID NO: 177879 - RNA, 22 nt, Homo sapiens
aguacacuguuaaaaagaagug

SEQ ID NO: 177880 - RNA, 22 nt, Homo sapiens
aguaucacaguggguguauacc

SEQ ID NO: 177881 - RNA, 22 nt, Homo sapiens
agucaagaugagauuugggugg

SEQ ID NO: 177882 - RNA, 22 nt, Homo sapiens
agucacagugaccuugucugac

SEQ ID NO: 177883 - RNA, 22 nt, Homo sapiens
agucagucuguccugugcugag

SEQ ID NO: 177884 - RNA, 20 nt, Homo sapiens
agucaguuuauuuucucucu

SEQ ID NO: 177885 - RNA, 22 nt, Homo sapiens
agucauggcagaaggcaccucu

SEQ ID NO: 177886 - RNA, 22 nt, Homo sapiens
agucaugggagagaugugaucg

SEQ ID NO: 177887 - RNA, 19 nt, Homo sapiens
agucaugugaggacccuug

SEQ ID NO: 177888 - RNA, 22 nt, Homo sapiens
aguccaguguuaugaucaguag

SEQ ID NO: 177889 - RNA, 22 nt, Homo sapiens
aguccauuugaugaugauucca

SEQ ID NO: 177890 - RNA, 22 nt, Homo sapiens
agucugguguucucacacuagu

SEQ ID NO: 177891 - RNA, 22 nt, Homo sapiens
agugaaaucugaagaaggucau

SEQ ID NO: 177892 - RNA, 22 nt, Homo sapiens
agugaaaugucaccuuuuagga

SEQ ID NO: 177893 - RNA, 22 nt, Homo sapiens
agugaauguuggaaaguuauuu

SEQ ID NO: 177894 - RNA, 22 nt, Homo sapiens
agugacaugggaucaaaucuga

SEQ ID NO: 177895 - RNA, 22 nt, Homo sapiens
agugcaaugauccggugcuggg

SEQ ID NO: 177896 - RNA, 22 nt, Homo sapiens
agugcaguggugccaucauaac

SEQ ID NO: 177897 - RNA, 22 nt, Homo sapiens
agugcaguugucacgugccuuc

SEQ ID NO: 177898 - RNA, 22 nt, Homo sapiens
agugcauugcaucucugcuuca

SEQ ID NO: 177899 - RNA, 22 nt, Homo sapiens
agugccacugcacucuagccug

SEQ ID NO: 177900 - RNA, 22 nt, Homo sapiens
agugccuauugauggaaagaua

SEQ ID NO: 177901 - RNA, 22 nt, Homo sapiens
aguggcacuauucucagaguca

SEQ ID NO: 177902 - RNA, 22 nt, Homo sapiens
agugguguugccuguugaccua

SEQ ID NO: 177903 - RNA, 22 nt, Homo sapiens
aguguaaugauauuuggagagg

SEQ ID NO: 177904 - RNA, 22 nt, Homo sapiens
aguguuuuuacaagcacucugg

SEQ ID NO: 177905 - RNA, 22 nt, Homo sapiens
aguguuuuucaugggauacuuu

SEQ ID NO: 177906 - RNA, 22 nt, Homo sapiens
aguuccauuuauucucgucucu

SEQ ID NO: 177907 - RNA, 22 nt, Homo sapiens
aguugcaagucuugaguaaaga

SEQ ID NO: 177908 - RNA, 22 nt, Homo sapiens
auaaaccuacauuuucacuucu

SEQ ID NO: 177909 - RNA, 22 nt, Homo sapiens
auaaagccaugagcuugagaug

SEQ ID NO: 177910 - RNA, 22 nt, Homo sapiens
auaaagcuauuccucucuuuuu

SEQ ID NO: 177911 - RNA, 22 nt, Homo sapiens
auaaagguaagcacuauccuga

SEQ ID NO: 177912 - RNA, 22 nt, Homo sapiens
auaaaguagaggugaggugcau

SEQ ID NO: 177913 - RNA, 22 nt, Homo sapiens
auaaauaguaguugugguggcc

SEQ ID NO: 177914 - RNA, 22 nt, Homo sapiens
auaaaugcuuccagucauuaaa

SEQ ID NO: 177915 - RNA, 22 nt, Homo sapiens
auaacucuguuuuuuucaugca

SEQ ID NO: 177916 - RNA, 22 nt, Homo sapiens
auaagaagugaaccagacgucu

SEQ ID NO: 177917 - RNA, 22 nt, Homo sapiens
auaagaucauuugcuaagaggg

SEQ ID NO: 177918 - RNA, 22 nt, Homo sapiens
auaagucaauggaacagauuaa

SEQ ID NO: 177919 - RNA, 19 nt, Homo sapiens
auaagugaaucacgggggc

SEQ ID NO: 177920 - RNA, 22 nt, Homo sapiens
auaagugcuuguugaauaauag

SEQ ID NO: 177921 - RNA, 22 nt, Homo sapiens
auaauacuuuuauuuugaggaa

SEQ ID NO: 177922 - RNA, 22 nt, Homo sapiens
auaauagguugauugacauugc

SEQ ID NO: 177923 - RNA, 22 nt, Homo sapiens
auaauaguguuuagauuuggga

SEQ ID NO: 177924 - RNA, 22 nt, Homo sapiens
auaauaucagguugugaugaug

SEQ ID NO: 177925 - RNA, 22 nt, Homo sapiens
auacacgguaggcacauauuua

SEQ ID NO: 177926 - RNA, 22 nt, Homo sapiens
auacacguguauauguguaucu

SEQ ID NO: 177927 - RNA, 22 nt, Homo sapiens
auacagcuaaaauauuaaguua

SEQ ID NO: 177928 - RNA, 22 nt, Homo sapiens
auacaguaaugucuuaggcugu

SEQ ID NO: 177929 - RNA, 22 nt, Homo sapiens
auacagugaauacuuacagugu

SEQ ID NO: 177930 - RNA, 22 nt, Homo sapiens
auacaugugccauggugguuug

SEQ ID NO: 177931 - RNA, 22 nt, Homo sapiens
auacaugugccauguucgugug

SEQ ID NO: 177932 - RNA, 20 nt, Homo sapiens
auaccacagacuggguaguu

SEQ ID NO: 177933 - RNA, 22 nt, Homo sapiens
auaccuuuuaggggaacguucu

SEQ ID NO: 177934 - RNA, 22 nt, Homo sapiens
auacguacauaugcacauaugg

SEQ ID NO: 177935 - RNA, 22 nt, Homo sapiens
auacuaugagauaauaaagacu

SEQ ID NO: 177936 - RNA, 22 nt, Homo sapiens
auacuguuucugaacuuugauu

SEQ ID NO: 177937 - RNA, 22 nt, Homo sapiens
auacuguuuuacaucauugccu

SEQ ID NO: 177938 - RNA, 21 nt, Homo sapiens
auacuugcauccuuggagaga

SEQ ID NO: 177939 - RNA, 22 nt, Homo sapiens
auagaauguauuaguaaauuug

SEQ ID NO: 177940 - RNA, 22 nt, Homo sapiens
auagagugcuucaucaguagua

SEQ ID NO: 177941 - RNA, 22 nt, Homo sapiens
auagaucauugucauuuuagau

SEQ ID NO: 177942 - RNA, 22 nt, Homo sapiens
auagcaagaugauugauccauu

SEQ ID NO: 177943 - RNA, 22 nt, Homo sapiens
auagcacaguguguguacacca

SEQ ID NO: 177944 - RNA, 21 nt, Homo sapiens
auagcacuucacuugguuaga

SEQ ID NO: 177945 - RNA, 22 nt, Homo sapiens
auagcagaagaagggacaauuc

SEQ ID NO: 177946 - RNA, 22 nt, Homo sapiens
auagcagcaccccacuaccuca

SEQ ID NO: 177947 - RNA, 22 nt, Homo sapiens
auagcagcaccucacucuacug

SEQ ID NO: 177948 - RNA, 22 nt, Homo sapiens
auagcauagucagcuucgcuga

SEQ ID NO: 177949 - RNA, 22 nt, Homo sapiens
auagcauaucccacaugucaga

SEQ ID NO: 177950 - RNA, 22 nt, Homo sapiens
auagcaucauuucuugaaaaga

SEQ ID NO: 177951 - RNA, 22 nt, Homo sapiens
auagccaguagagagcuguuag

SEQ ID NO: 177952 - RNA, 22 nt, Homo sapiens
auaggcaagaugagguuuuuau

SEQ ID NO: 177953 - RNA, 22 nt, Homo sapiens
auagggcacgagaugugagccu

SEQ ID NO: 177954 - RNA, 22 nt, Homo sapiens
auagugaacuuugugagaacaa

SEQ ID NO: 177955 - RNA, 21 nt, Homo sapiens
auagugcuagagaguagcagg

SEQ ID NO: 177956 - RNA, 22 nt, Homo sapiens
auagugcugcaauaaacauacg

SEQ ID NO: 177957 - RNA, 22 nt, Homo sapiens
auagugcugcaaugaacauaca

SEQ ID NO: 177958 - RNA, 22 nt, Homo sapiens
auagugcugcacuaaacauaca

SEQ ID NO: 177959 - RNA, 22 nt, Homo sapiens
auagugcugccauaaacauacg

SEQ ID NO: 177960 - RNA, 22 nt, Homo sapiens
auagugcuguauuaaacauacg

SEQ ID NO: 177961 - RNA, 22 nt, Homo sapiens
auagugcugugaugaacauaca

SEQ ID NO: 177962 - RNA, 19 nt, Homo sapiens
auauaacauccaggagcag

SEQ ID NO: 177963 - RNA, 22 nt, Homo sapiens
auauagcaaugaaagagaugaa

SEQ ID NO: 177964 - RNA, 22 nt, Homo sapiens
auaucaacaucgugucauuagu

SEQ ID NO: 177965 - RNA, 22 nt, Homo sapiens
auaucacagguguuuaccugau

SEQ ID NO: 177966 - RNA, 22 nt, Homo sapiens
auaucccuguauaagugaaugu

SEQ ID NO: 177967 - RNA, 22 nt, Homo sapiens
uggcaacuugcaaccucauucu

SEQ ID NO: 177968 - RNA, 22 nt, Homo sapiens
uggcaagaaggauuuauuccuu

SEQ ID NO: 177969 - RNA, 22 nt, Homo sapiens
uggcaagagcaaaauguacagu

SEQ ID NO: 177970 - RNA, 22 nt, Homo sapiens
uggcaccauccaggugucucua

SEQ ID NO: 177971 - RNA, 19 nt, Homo sapiens
uggcacuugacguccggau

SEQ ID NO: 177972 - RNA, 22 nt, Homo sapiens
uggcagcugcuucaugggaugc

SEQ ID NO: 177973 - RNA, 22 nt, Homo sapiens
uggcaguuuacagcuuuaggag

SEQ ID NO: 177974 - RNA, 22 nt, Homo sapiens
uggcauaugguauuugauaucu

SEQ ID NO: 177975 - RNA, 22 nt, Homo sapiens
uggcaucuguucuacacauaaa

SEQ ID NO: 177976 - RNA, 20 nt, Homo sapiens
uggcaugaaauuuuccaagc

SEQ ID NO: 177977 - RNA, 22 nt, Homo sapiens
uggcauggggcagaacauuaca

SEQ ID NO: 177978 - RNA, 20 nt, Homo sapiens
uggcauguugguaugcaccc

SEQ ID NO: 177979 - RNA, 23 nt, Homo sapiens
uggccagaaacuucuuuucaucc

SEQ ID NO: 177980 - RNA, 22 nt, Homo sapiens
uggccagugucggaggccagga

SEQ ID NO: 177981 - RNA, 22 nt, Homo sapiens
uggccuuuuccaagaacuacua

SEQ ID NO: 177982 - RNA, 22 nt, Homo sapiens
uggcuacuguacuugagcuauu

SEQ ID NO: 177983 - RNA, 21 nt, Homo sapiens
uggcuauuucuguggcauaca

SEQ ID NO: 177984 - RNA, 22 nt, Homo sapiens
uggcuccguuguacaggcugga

SEQ ID NO: 177985 - RNA, 20 nt, Homo sapiens
uggcucuuugcugcuaaagu

SEQ ID NO: 177986 - RNA, 22 nt, Homo sapiens
uggcuguuguuacuaacaguuc

SEQ ID NO: 177987 - RNA, 22 nt, Homo sapiens
uggcuguuuauuucacaugggu

SEQ ID NO: 177988 - RNA, 21 nt, Homo sapiens
uggcuguuuucaugcuagaac

SEQ ID NO: 177989 - RNA, 22 nt, Homo sapiens
uggcuuuuauuauguugaggua

SEQ ID NO: 177990 - RNA, 22 nt, Homo sapiens
uggcuuuucauccugggacauu

SEQ ID NO: 177991 - RNA, 20 nt, Homo sapiens
ugggaacaugugguauaugg

SEQ ID NO: 177992 - RNA, 22 nt, Homo sapiens
ugggaagaagguuuacuugcca

SEQ ID NO: 177993 - RNA, 22 nt, Homo sapiens
ugggaagagggagcgauuuugg

SEQ ID NO: 177994 - RNA, 22 nt, Homo sapiens
ugggaagaugcugcuucuuccu

SEQ ID NO: 177995 - RNA, 22 nt, Homo sapiens
ugggaagcugcugaacuacagu

SEQ ID NO: 177996 - RNA, 22 nt, Homo sapiens
ugggaauaugauacaggucuuu

SEQ ID NO: 177997 - RNA, 22 nt, Homo sapiens
ugggagugugcacaauuucagc

SEQ ID NO: 177998 - RNA, 22 nt, Homo sapiens
ugggaucagcugggcucucugu

SEQ ID NO: 177999 - RNA, 22 nt, Homo sapiens
ugggaucaugagcaccgcuucc

SEQ ID NO: 178000 - RNA, 22 nt, Homo sapiens
ugggaugaauacaaugggauca

SEQ ID NO: 178001 - RNA, 22 nt, Homo sapiens
ugggaugaugcuugagaauauc

SEQ ID NO: 178002 - RNA, 22 nt, Homo sapiens
ugggcaaaugcuuuuuagucaa

SEQ ID NO: 178003 - RNA, 22 nt, Homo sapiens
ugggcaagagagcaugacccug

SEQ ID NO: 178004 - RNA, 22 nt, Homo sapiens
ugggcauuguuccuaguuaucu

SEQ ID NO: 178005 - RNA, 21 nt, Homo sapiens
ugggccccuuccuuacaucau

SEQ ID NO: 178006 - RNA, 22 nt, Homo sapiens
uggggcuuuuucuuguauucuc

SEQ ID NO: 178007 - RNA, 22 nt, Homo sapiens
uggggucguaggugcccgccag

SEQ ID NO: 178008 - RNA, 22 nt, Homo sapiens
uggguaauggagaaauaaaucu

SEQ ID NO: 178009 - RNA, 22 nt, Homo sapiens
uggguagagaaucaggaucuua

SEQ ID NO: 178010 - RNA, 22 nt, Homo sapiens
uggguagauaucauaguugccc

SEQ ID NO: 178011 - RNA, 22 nt, Homo sapiens
ugggugugaccgcucaaggggg

SEQ ID NO: 178012 - RNA, 22 nt, Homo sapiens
ugguacuucaugcucacagaua

SEQ ID NO: 178013 - RNA, 22 nt, Homo sapiens
ugguauguaugauuaacaugga

SEQ ID NO: 178014 - RNA, 22 nt, Homo sapiens
uggucaccugaauuaugcaugu

SEQ ID NO: 178015 - RNA, 22 nt, Homo sapiens
uggucagaaaauuacuugauau

SEQ ID NO: 178016 - RNA, 22 nt, Homo sapiens
uggucaguugaguccuugccaa

SEQ ID NO: 178017 - RNA, 22 nt, Homo sapiens
uggucauggggcagcugacacu

SEQ ID NO: 178018 - RNA, 21 nt, Homo sapiens
uggucccauaagauuauaaug

SEQ ID NO: 178019 - RNA, 22 nt, Homo sapiens
uggucccucugaaaauugggug

SEQ ID NO: 178020 - RNA, 22 nt, Homo sapiens
uggucguggagucccuggcuuc

SEQ ID NO: 178021 - RNA, 22 nt, Homo sapiens
uggucuuuucaacaaaugguau

SEQ ID NO: 178022 - RNA, 22 nt, Homo sapiens
uggugagaaacuagauauuuuu

SEQ ID NO: 178023 - RNA, 22 nt, Homo sapiens
uggugcaaugaagugaucucaa

SEQ ID NO: 178024 - RNA, 17 nt, Homo sapiens
uggugcuugaaaguugc

SEQ ID NO: 178025 - RNA, 22 nt, Homo sapiens
ugguggcuuuucguagguucac

SEQ ID NO: 178026 - RNA, 20 nt, Homo sapiens
ugguguuugaacagugaaug

SEQ ID NO: 178027 - RNA, 22 nt, Homo sapiens
ugguguuugagaagcugauguc

SEQ ID NO: 178028 - RNA, 22 nt, Homo sapiens
ugguucaguugcacaggcuguu

SEQ ID NO: 178029 - RNA, 22 nt, Homo sapiens
ugguuccauauuaauuuuagga

SEQ ID NO: 178030 - RNA, 18 nt, Homo sapiens
uguaaacuaccucaaccu

SEQ ID NO: 178031 - RNA, 22 nt, Homo sapiens
uguaacacacacuguuuacucc

SEQ ID NO: 178032 - RNA, 20 nt, Homo sapiens
uguaacacauggagaacucu

SEQ ID NO: 178033 - RNA, 22 nt, Homo sapiens
uguaacaguaguuacuauucuu

SEQ ID NO: 178034 - RNA, 21 nt, Homo sapiens
uguaacugcaaaccucagauu

SEQ ID NO: 178035 - RNA, 22 nt, Homo sapiens
uguaaggcaguuagagcaaauu

SEQ ID NO: 178036 - RNA, 22 nt, Homo sapiens
uguaauguuucaucauuauuaa

SEQ ID NO: 178037 - RNA, 22 nt, Homo sapiens
uguaauuuaaaugauccuugga

SEQ ID NO: 178038 - RNA, 20 nt, Homo sapiens
uguacacaguguacccacau

SEQ ID NO: 178039 - RNA, 22 nt, Homo sapiens
uguacuagaaauuaaggcaggg

SEQ ID NO: 178040 - RNA, 22 nt, Homo sapiens
uguagauaucauuagugcugug

SEQ ID NO: 178041 - RNA, 22 nt, Homo sapiens
uguagcaaauaaaagucuggau

SEQ ID NO: 178042 - RNA, 22 nt, Homo sapiens
uguagcuuuugagauuuauauu

SEQ ID NO: 178043 - RNA, 22 nt, Homo sapiens
uguagucauuccuuuuugcuuu

SEQ ID NO: 178044 - RNA, 22 nt, Homo sapiens
uguaguuugaaagcucccucug

SEQ ID NO: 178045 - RNA, 23 nt, Homo sapiens
uguauacacccugugcaucuggg

SEQ ID NO: 178046 - RNA, 21 nt, Homo sapiens
uguauacauauguuaggugca

SEQ ID NO: 178047 - RNA, 22 nt, Homo sapiens
uguauguuguaagacuuagacc

SEQ ID NO: 178048 - RNA, 22 nt, Homo sapiens
uguauugcuugaagagugaauu

SEQ ID NO: 178049 - RNA, 22 nt, Homo sapiens
ugucaaagagacaucugcacuc

SEQ ID NO: 178050 - RNA, 22 nt, Homo sapiens
ugucaaaugcagugauauuuga

SEQ ID NO: 178051 - RNA, 22 nt, Homo sapiens
ugucaauauguaauaacugaau

SEQ ID NO: 178052 - RNA, 22 nt, Homo sapiens
ugucaccuugcucauccucgga

SEQ ID NO: 178053 - RNA, 22 nt, Homo sapiens
ugucagaaucugagacgacaac

SEQ ID NO: 178054 - RNA, 22 nt, Homo sapiens
ugucagggaggcucggccgcac

SEQ ID NO: 178055 - RNA, 22 nt, Homo sapiens
ugucaguggacugugaaaggca

SEQ ID NO: 178056 - RNA, 22 nt, Homo sapiens
ugucaguuucaguguuagccuu

SEQ ID NO: 178057 - RNA, 22 nt, Homo sapiens
ugucauagauugcuuggaaaaa

SEQ ID NO: 178058 - RNA, 22 nt, Homo sapiens
ugucaucuagguuuuaagccuu

SEQ ID NO: 178059 - RNA, 22 nt, Homo sapiens
ugucaugaaauauguuuuucua

SEQ ID NO: 178060 - RNA, 21 nt, Homo sapiens
ugucaugcagagacccuggag

SEQ ID NO: 178061 - RNA, 22 nt, Homo sapiens
ugucauggucacaggcauuuca

SEQ ID NO: 178062 - RNA, 22 nt, Homo sapiens
ugucaugucuuuguguaucaau

SEQ ID NO: 178063 - RNA, 22 nt, Homo sapiens
ugucauguugguguacugcacc

SEQ ID NO: 178064 - RNA, 16 nt, Homo sapiens
uguccaaauaaauaca

SEQ ID NO: 178065 - RNA, 22 nt, Homo sapiens
uguccauuuuuaugcuuauggu

SEQ ID NO: 178066 - RNA, 19 nt, Homo sapiens
ugucccagccauagaggca

SEQ ID NO: 178067 - RNA, 22 nt, Homo sapiens
ugucccaguuggguauugaauu

SEQ ID NO: 178068 - RNA, 22 nt, Homo sapiens
uguccugaagcuuuguuaugua

SEQ ID NO: 178069 - RNA, 22 nt, Homo sapiens
ugucuaaagaauggcagacuca

SEQ ID NO: 178070 - RNA, 20 nt, Homo sapiens
ugucuauggggguucucugc

SEQ ID NO: 178071 - RNA, 22 nt, Homo sapiens
ugucucagugauuggcuuucug

SEQ ID NO: 178072 - RNA, 22 nt, Homo sapiens
ugucucaguuacggcaauucca

SEQ ID NO: 178073 - RNA, 22 nt, Homo sapiens
ugucucaguucccuucucugga

SEQ ID NO: 178074 - RNA, 22 nt, Homo sapiens
ugucucaguuucuguggguuag

SEQ ID NO: 178075 - RNA, 22 nt, Homo sapiens
ugucugagacuguuuuacuuuc

SEQ ID NO: 178076 - RNA, 21 nt, Homo sapiens
ugucugagagaggagaucuac

SEQ ID NO: 178077 - RNA, 22 nt, Homo sapiens
ugucuggaguccauagaagugu

SEQ ID NO: 178078 - RNA, 22 nt, Homo sapiens
ugucuguuugcgaaauugcuuc

SEQ ID NO: 178079 - RNA, 18 nt, Homo sapiens
ugucuuagagcuugaccc

SEQ ID NO: 178080 - RNA, 21 nt, Homo sapiens
ugucuuggagccagacgccag

SEQ ID NO: 178081 - RNA, 22 nt, Homo sapiens
ugucuuggaugaggauuaacag

SEQ ID NO: 178082 - RNA, 22 nt, Homo sapiens
ugugaaacacgaaagucuaaaa

SEQ ID NO: 178083 - RNA, 21 nt, Homo sapiens
ugugaacauguuggguggcau

SEQ ID NO: 178084 - RNA, 22 nt, Homo sapiens
ugugaacauuuuguauauauua

SEQ ID NO: 178085 - RNA, 22 nt, Homo sapiens
ugugaagaaagucauugguagc

SEQ ID NO: 178086 - RNA, 22 nt, Homo sapiens
ugugaagaugagaugacgcccu

SEQ ID NO: 178087 - RNA, 22 nt, Homo sapiens
ugugaagauguuucuuaauuga

SEQ ID NO: 178088 - RNA, 22 nt, Homo sapiens
ugugaaugaagaaugcuaaccu

SEQ ID NO: 178089 - RNA, 22 nt, Homo sapiens
ugugacaguguuacauuucaug

SEQ ID NO: 178090 - RNA, 19 nt, Homo sapiens
ugugagcauuagcauuuag

SEQ ID NO: 178091 - RNA, 22 nt, Homo sapiens
ugugaugguuuggaagcuucuu

SEQ ID NO: 178092 - RNA, 22 nt, Homo sapiens
ugugaugugaugagaaguuccu

SEQ ID NO: 178093 - RNA, 22 nt, Homo sapiens
ugugauuauuuauagacaguca

SEQ ID NO: 178094 - RNA, 17 nt, Homo sapiens
ugugauugaagucaucc

SEQ ID NO: 178095 - RNA, 22 nt, Homo sapiens
ugugcaaaaguaauugcgguuu

SEQ ID NO: 178096 - RNA, 22 nt, Homo sapiens
ugugcacaacgugcagguuugu

SEQ ID NO: 178097 - RNA, 22 nt, Homo sapiens
ugugcacaauguacagguuagu

SEQ ID NO: 178098 - RNA, 22 nt, Homo sapiens
ugugcacaugauauaucacaua

SEQ ID NO: 178099 - RNA, 22 nt, Homo sapiens
ugugcacauugugcagguugau

SEQ ID NO: 178100 - RNA, 23 nt, Homo sapiens
ugugcacauuuacauauauacac

SEQ ID NO: 178101 - RNA, 22 nt, Homo sapiens
ugugcauagugugugcggggcg

SEQ ID NO: 178102 - RNA, 22 nt, Homo sapiens
ugugccacuccaggaggcuguu

SEQ ID NO: 178103 - RNA, 22 nt, Homo sapiens
ugugccacugcacucugggcaa

SEQ ID NO: 178104 - RNA, 22 nt, Homo sapiens
ugugcguguaagagaucuaggu

SEQ ID NO: 178105 - RNA, 22 nt, Homo sapiens
ugugcuugcuucuucuccuagu

SEQ ID NO: 178106 - RNA, 22 nt, Homo sapiens
uguggaaauuguuguauuuaau

SEQ ID NO: 178107 - RNA, 22 nt, Homo sapiens
uguggcaaagucuugugaauau

SEQ ID NO: 178108 - RNA, 22 nt, Homo sapiens
uguggcaaauggucaggaagaa

SEQ ID NO: 178109 - RNA, 21 nt, Homo sapiens
uguggcaauggccucacagau

SEQ ID NO: 178110 - RNA, 22 nt, Homo sapiens
uguggcucuucuguucuccacu

SEQ ID NO: 178111 - RNA, 22 nt, Homo sapiens
uguggcuucuuugguucaguau

SEQ ID NO: 178112 - RNA, 22 nt, Homo sapiens
uguggcuuuguaaccauggguc

SEQ ID NO: 178113 - RNA, 22 nt, Homo sapiens
ugugggugguaaaauacaauga

SEQ ID NO: 178114 - RNA, 22 nt, Homo sapiens
ugugguccucugaaggcuuuuc

SEQ ID NO: 178115 - RNA, 22 nt, Homo sapiens
ugugguuuuaguaaaacuaugu

SEQ ID NO: 178116 - RNA, 22 nt, Homo sapiens
uguguaaauacaagugcuugaa

SEQ ID NO: 178117 - RNA, 22 nt, Homo sapiens
uguguaauacucuaaugaugca

SEQ ID NO: 178118 - RNA, 22 nt, Homo sapiens
uguguacaucucuacacacaug

SEQ ID NO: 178119 - RNA, 22 nt, Homo sapiens
ugugucacugaggguuagugua

SEQ ID NO: 178120 - RNA, 22 nt, Homo sapiens
uguuaacauggucucagucugu

SEQ ID NO: 178121 - RNA, 22 nt, Homo sapiens
uguuaguuguucauguuaagag

SEQ ID NO: 178122 - RNA, 22 nt, Homo sapiens
uguuaugaagaugccugguaca

SEQ ID NO: 178123 - RNA, 22 nt, Homo sapiens
uguucaauucccaccuaugagu

SEQ ID NO: 178124 - RNA, 22 nt, Homo sapiens
uguucuggagaggcaggccaca

SEQ ID NO: 178125 - RNA, 22 nt, Homo sapiens
uguucuggagaguuuagucugg

SEQ ID NO: 178126 - RNA, 22 nt, Homo sapiens
uguucuugagccuuuagaccua

SEQ ID NO: 178127 - RNA, 22 nt, Homo sapiens
uguugccacuguuauuaaccua

SEQ ID NO: 178128 - RNA, 22 nt, Homo sapiens
uguuggacuuacuuggcagauu

SEQ ID NO: 178129 - RNA, 22 nt, Homo sapiens
uguuggcauugcugcugacccu

SEQ ID NO: 178130 - RNA, 22 nt, Homo sapiens
uguuuaguuaagacauagaauu

SEQ ID NO: 178131 - RNA, 22 nt, Homo sapiens
uguuuguuugugauacgguaca

SEQ ID NO: 178132 - RNA, 22 nt, Homo sapiens
uguuuuggaggccagaagucca

SEQ ID NO: 178133 - RNA, 22 nt, Homo sapiens
uuaaaccugucuucucacuaau

SEQ ID NO: 178134 - RNA, 22 nt, Homo sapiens
uuaaagcuggcguuacaguuug

SEQ ID NO: 178135 - RNA, 22 nt, Homo sapiens
uuaaaguguuuucaaaauguca

SEQ ID NO: 178136 - RNA, 20 nt, Homo sapiens
uuaaaucuagugcagacuca

SEQ ID NO: 178137 - RNA, 22 nt, Homo sapiens
uuaaaugcucacauaaagguag

SEQ ID NO: 178138 - RNA, 22 nt, Homo sapiens
uuaacagugucaaucuguagua

SEQ ID NO: 178139 - RNA, 23 nt, Homo sapiens
uuaagcaacggcugcuuuucaga

SEQ ID NO: 178140 - RNA, 22 nt, Homo sapiens
uuaagcaguggauuagaauuuu

SEQ ID NO: 178141 - RNA, 22 nt, Homo sapiens
uuaaggcuuuaaguaaacacag

SEQ ID NO: 178142 - RNA, 22 nt, Homo sapiens
uuaaggcuuucccuauguaaaa

SEQ ID NO: 178143 - RNA, 22 nt, Homo sapiens
uuaagguaugugggcauuuugu

SEQ ID NO: 178144 - RNA, 21 nt, Homo sapiens
uuaagugcuuuguaugcacua

SEQ ID NO: 178145 - RNA, 22 nt, Homo sapiens
uuaauccugccuuauuucagua

SEQ ID NO: 178146 - RNA, 22 nt, Homo sapiens
uuaauguaauugauugauugac

SEQ ID NO: 178147 - RNA, 22 nt, Homo sapiens
uuaauucugucugcccucaucc

SEQ ID NO: 178148 - RNA, 22 nt, Homo sapiens
uuaauuguccauuauucuguuc

SEQ ID NO: 178149 - RNA, 22 nt, Homo sapiens
uuacaagaugucuguccaacac

SEQ ID NO: 178150 - RNA, 22 nt, Homo sapiens
uuacaccuguaauccagcacuu

SEQ ID NO: 178151 - RNA, 22 nt, Homo sapiens
uuacagauggauggcagcuggc

SEQ ID NO: 178152 - RNA, 22 nt, Homo sapiens
uuacagauggcacacucaaggg

SEQ ID NO: 178153 - RNA, 22 nt, Homo sapiens
uuacaguagaugaggguauaau

SEQ ID NO: 178154 - RNA, 22 nt, Homo sapiens
uuacaguaugaguaagaguucu

SEQ ID NO: 178155 - RNA, 20 nt, Homo sapiens
uuacagugggaccuuccuga

SEQ ID NO: 178156 - RNA, 22 nt, Homo sapiens
uuacaucaucacauuaguuugc

SEQ ID NO: 178157 - RNA, 22 nt, Homo sapiens
uuacaugucuugguaagguuag

SEQ ID NO: 178158 - RNA, 22 nt, Homo sapiens
uuacauguuuauggggguacau

SEQ ID NO: 178159 - RNA, 22 nt, Homo sapiens
uuacugcucuuuugucaugagu

SEQ ID NO: 178160 - RNA, 22 nt, Homo sapiens
uuacuguauagaaucaucuuga

SEQ ID NO: 178161 - RNA, 22 nt, Homo sapiens
uuacuugagaugaguuggacaa

SEQ ID NO: 178162 - RNA, 22 nt, Homo sapiens
uuagacacacauacauuuaucu

SEQ ID NO: 178163 - RNA, 17 nt, Homo sapiens
uuagacagacauccugc

SEQ ID NO: 178164 - RNA, 22 nt, Homo sapiens
uuagaugguucaccaugaguag

SEQ ID NO: 178165 - RNA, 22 nt, Homo sapiens
uuagcacauuuccagcacaugg

SEQ ID NO: 178166 - RNA, 20 nt, Homo sapiens
uuagcagcaugauuuauaau

SEQ ID NO: 178167 - RNA, 21 nt, Homo sapiens
uuagccuguaagcacuuugca

SEQ ID NO: 178168 - RNA, 22 nt, Homo sapiens
uuaggcucuuuaucaguuaacu

SEQ ID NO: 178169 - RNA, 22 nt, Homo sapiens
uuagggaggcucaggacaagag

SEQ ID NO: 178170 - RNA, 22 nt, Homo sapiens
uuagggcaggcaugagagaacu

SEQ ID NO: 178171 - RNA, 22 nt, Homo sapiens
uuagguaauauauugcugcuuu

SEQ ID NO: 178172 - RNA, 18 nt, Homo sapiens
uuagguaggucuuugugu

SEQ ID NO: 178173 - RNA, 22 nt, Homo sapiens
uuagguuauuacugacaauaau

SEQ ID NO: 178174 - RNA, 22 nt, Homo sapiens
uuagguuguugccauugaaagu

SEQ ID NO: 178175 - RNA, 22 nt, Homo sapiens
uuaguaguugugauagguaccu

SEQ ID NO: 178176 - RNA, 22 nt, Homo sapiens
uuagucaaguguacugugaaug

SEQ ID NO: 178177 - RNA, 22 nt, Homo sapiens
uuagugcugaguggaauguucu

SEQ ID NO: 178178 - RNA, 22 nt, Homo sapiens
uuaucacauugacugauuugca

SEQ ID NO: 178179 - RNA, 21 nt, Homo sapiens
uuaucccagugucucugcagg

SEQ ID NO: 178180 - RNA, 22 nt, Homo sapiens
uuaucucagugaacugagugga

SEQ ID NO: 178181 - RNA, 22 nt, Homo sapiens
uuaugguacaugugcacaaugu

SEQ ID NO: 178182 - RNA, 22 nt, Homo sapiens
uuaugguuuuuagcagaguaau

SEQ ID NO: 178183 - RNA, 22 nt, Homo sapiens
uuauguaaaucaaucuggaauc

SEQ ID NO: 178184 - RNA, 22 nt, Homo sapiens
uuauguguuuaauguuucugaa

SEQ ID NO: 178185 - RNA, 22 nt, Homo sapiens
uugagauggaaucucgcuuugu

SEQ ID NO: 178186 - RNA, 22 nt, Homo sapiens
uugagauggagucucgcucugu

SEQ ID NO: 178187 - RNA, 22 nt, Homo sapiens
uugagauggagucuugcucuug

SEQ ID NO: 178188 - RNA, 22 nt, Homo sapiens
uugagauggaguucauuuuugu

SEQ ID NO: 178189 - RNA, 22 nt, Homo sapiens
uugagauggauagacauagcau

SEQ ID NO: 178190 - RNA, 22 nt, Homo sapiens
uugagauguaagauguuaauau

SEQ ID NO: 178191 - RNA, 21 nt, Homo sapiens
uugagcaacuaggguuauagg

SEQ ID NO: 178192 - RNA, 22 nt, Homo sapiens
uugagcacaguagguuguggcu

SEQ ID NO: 178193 - RNA, 22 nt, Homo sapiens
uugagccaaggauugucuuucc

SEQ ID NO: 178194 - RNA, 22 nt, Homo sapiens
uugagcccuggaggcagaggcu

SEQ ID NO: 178195 - RNA, 22 nt, Homo sapiens
uugagcuauguacagaugcugu

SEQ ID NO: 178196 - RNA, 22 nt, Homo sapiens
uugagcucaucuucagggguga

SEQ ID NO: 178197 - RNA, 22 nt, Homo sapiens
uugagcucuucuagcaauucua

SEQ ID NO: 178198 - RNA, 22 nt, Homo sapiens
uugaggaaugugauuucaaaua

SEQ ID NO: 178199 - RNA, 22 nt, Homo sapiens
uugaggaggcagucucuccauu

SEQ ID NO: 178200 - RNA, 22 nt, Homo sapiens
uugaggaggcagucuguccguu

SEQ ID NO: 178201 - RNA, 23 nt, Homo sapiens
uugaggcauguaccaucaauauc

SEQ ID NO: 178202 - RNA, 16 nt, Homo sapiens
uugaggcaugucucag

SEQ ID NO: 178203 - RNA, 22 nt, Homo sapiens
uugagggagcacagauucuuau

SEQ ID NO: 178204 - RNA, 22 nt, Homo sapiens
uugagggagcauuuguuuugag

SEQ ID NO: 178205 - RNA, 22 nt, Homo sapiens
uugagggagccuguuagucccg

SEQ ID NO: 178206 - RNA, 22 nt, Homo sapiens
uugagggaggccucaguuuaca

SEQ ID NO: 178207 - RNA, 22 nt, Homo sapiens
uugaggugaauuugcaggaugc

SEQ ID NO: 178208 - RNA, 22 nt, Homo sapiens
uugaguagaaguaugucaguau

SEQ ID NO: 178209 - RNA, 20 nt, Homo sapiens
uugaguauugccagggaggc

SEQ ID NO: 178210 - RNA, 22 nt, Homo sapiens
uugaguccccacacuggguccc

SEQ ID NO: 178211 - RNA, 22 nt, Homo sapiens
uugagugaaggcuguguucuug

SEQ ID NO: 178212 - RNA, 22 nt, Homo sapiens
uugauacuagagucuuucugac

SEQ ID NO: 178213 - RNA, 22 nt, Homo sapiens
uugauagaucagggauuugauu

SEQ ID NO: 178214 - RNA, 22 nt, Homo sapiens
uugauauguaguuggacuugau

SEQ ID NO: 178215 - RNA, 22 nt, Homo sapiens
uugauauguguauagcaugugg

SEQ ID NO: 178216 - RNA, 22 nt, Homo sapiens
uugaucaaaucugagugagaau

SEQ ID NO: 178217 - RNA, 22 nt, Homo sapiens
uugaucuaugugucuguuuuua

SEQ ID NO: 178218 - RNA, 22 nt, Homo sapiens
uugauugacaugucucuguuca

SEQ ID NO: 178219 - RNA, 22 nt, Homo sapiens
uugcaaacaucuuguuucacau

SEQ ID NO: 178220 - RNA, 22 nt, Homo sapiens
uugcaaaguugccaaggaagga

SEQ ID NO: 178221 - RNA, 22 nt, Homo sapiens
uugcaaaguuugccuccuguag

SEQ ID NO: 178222 - RNA, 22 nt, Homo sapiens
uugcaacauuguaaguuuauau

SEQ ID NO: 178223 - RNA, 22 nt, Homo sapiens
uugcaagauguuaacauuggag

SEQ ID NO: 178224 - RNA, 22 nt, Homo sapiens
uugcaagugccguaacuaccaa

SEQ ID NO: 178225 - RNA, 22 nt, Homo sapiens
uugcaaguggagcuuccagggc

SEQ ID NO: 178226 - RNA, 20 nt, Homo sapiens
uugcacagagaaggaggcag

SEQ ID NO: 178227 - RNA, 22 nt, Homo sapiens
uugcacuccagcucuaggugac

SEQ ID NO: 178228 - RNA, 22 nt, Homo sapiens
uugcacuccauccuggguugac

SEQ ID NO: 178229 - RNA, 18 nt, Homo sapiens
uugcacuccugccugggu

SEQ ID NO: 178230 - RNA, 22 nt, Homo sapiens
uugcacucugaagaccuacugu

SEQ ID NO: 178231 - RNA, 22 nt, Homo sapiens
uugcacugagauuuugcuuaca

SEQ ID NO: 178232 - RNA, 22 nt, Homo sapiens
uugcacuguaauuuauuuaugu

SEQ ID NO: 178233 - RNA, 22 nt, Homo sapiens
uugcaguaguaacuccuuaccu

SEQ ID NO: 178234 - RNA, 22 nt, Homo sapiens
uugcaguagucugaaagcaaua

SEQ ID NO: 178235 - RNA, 22 nt, Homo sapiens
uugcagugugacgacuauauuu

SEQ ID NO: 178236 - RNA, 22 nt, Homo sapiens
uugcauauguugaaccagccuu

SEQ ID NO: 178237 - RNA, 19 nt, Homo sapiens
uugcauauguugaaccagg

SEQ ID NO: 178238 - RNA, 22 nt, Homo sapiens
uugcauauucucugaggcagga

SEQ ID NO: 178239 - RNA, 22 nt, Homo sapiens
uugcaugguggaacuuggagcu

SEQ ID NO: 178240 - RNA, 22 nt, Homo sapiens
uugccacuucucuugccccauu

SEQ ID NO: 178241 - RNA, 22 nt, Homo sapiens
uugccuaggcuggagugcagua

SEQ ID NO: 178242 - RNA, 22 nt, Homo sapiens
uugcgcuuuuccuauguugccc

SEQ ID NO: 178243 - RNA, 22 nt, Homo sapiens
uugcuaagucaagagaaaugau

SEQ ID NO: 178244 - RNA, 22 nt, Homo sapiens
uugcuacauugauugccucuuu

SEQ ID NO: 178245 - RNA, 22 nt, Homo sapiens
uugcucaccugagaagaauaga

SEQ ID NO: 178246 - RNA, 22 nt, Homo sapiens
uugcuuaggcuggagugcagug

SEQ ID NO: 178247 - RNA, 22 nt, Homo sapiens
uuggaaaccucugcagguguuu

SEQ ID NO: 178248 - RNA, 22 nt, Homo sapiens
uuggaaaguuguuguaguuauu

SEQ ID NO: 178249 - RNA, 22 nt, Homo sapiens
uuggaaauauguuaagugucau

SEQ ID NO: 178250 - RNA, 22 nt, Homo sapiens
uuggaagagaagggagauaaac

SEQ ID NO: 178251 - RNA, 22 nt, Homo sapiens
uuggaagcacauuguuuaauua

SEQ ID NO: 178252 - RNA, 22 nt, Homo sapiens
uuggaaugcacacugagccugc

SEQ ID NO: 178253 - RNA, 22 nt, Homo sapiens
uuggaaugugacugauaauauu

SEQ ID NO: 178254 - RNA, 22 nt, Homo sapiens
uuggaccacuugauuucugguc

SEQ ID NO: 178255 - RNA, 22 nt, Homo sapiens
uuggacugggauggccgaggcu

SEQ ID NO: 178256 - RNA, 22 nt, Homo sapiens
uuggagagaaaggcaguuccug

SEQ ID NO: 178257 - RNA, 22 nt, Homo sapiens
uuggagugugucuuauuccauu

SEQ ID NO: 178258 - RNA, 22 nt, Homo sapiens
uuggaguguucugguccgggcu

SEQ ID NO: 178259 - RNA, 22 nt, Homo sapiens
uuggcaauugcuaugauuugaa

SEQ ID NO: 178260 - RNA, 22 nt, Homo sapiens
uuggcagaaaaggucggggguu

SEQ ID NO: 178261 - RNA, 22 nt, Homo sapiens
uuggcagaguuaauuuguugag

SEQ ID NO: 178262 - RNA, 19 nt, Homo sapiens
uuggcagaguugcccccua

SEQ ID NO: 178263 - RNA, 22 nt, Homo sapiens
uuggcagcuguggaaucugggc

SEQ ID NO: 178264 - RNA, 22 nt, Homo sapiens
uuggcagugguucugacggacc

SEQ ID NO: 178265 - RNA, 22 nt, Homo sapiens
uuggcauagaggcucucaagcu

SEQ ID NO: 178266 - RNA, 20 nt, Homo sapiens
uuggcauuuagacaagaguu

SEQ ID NO: 178267 - RNA, 22 nt, Homo sapiens
uuggcauuuuuagucaugggaa

SEQ ID NO: 178268 - RNA, 22 nt, Homo sapiens
uuggccagugucuuuuuuuccu

SEQ ID NO: 178269 - RNA, 22 nt, Homo sapiens
uuggccauaugacuugcuuugg

SEQ ID NO: 178270 - RNA, 22 nt, Homo sapiens
uuggcccugcugaccauucccu

SEQ ID NO: 178271 - RNA, 22 nt, Homo sapiens
uuggccuuuucaaugccucuuu

SEQ ID NO: 178272 - RNA, 22 nt, Homo sapiens
uuggcuaugaguccuaugugca

SEQ ID NO: 178273 - RNA, 22 nt, Homo sapiens
uuggcucuggcugggcuccagc

SEQ ID NO: 178274 - RNA, 22 nt, Homo sapiens
uugggacuggaaggaguaaggg

SEQ ID NO: 178275 - RNA, 22 nt, Homo sapiens
uugggagugucucuggacugca

SEQ ID NO: 178276 - RNA, 22 nt, Homo sapiens
uugggauaaucacaaaguaaaa

SEQ ID NO: 178277 - RNA, 22 nt, Homo sapiens
uugggccacuuuaguuuccuua

SEQ ID NO: 178278 - RNA, 22 nt, Homo sapiens
uugggcuuuuagguccuuaaca

SEQ ID NO: 178279 - RNA, 22 nt, Homo sapiens
uuggguagugaguuccuccagg

SEQ ID NO: 178280 - RNA, 22 nt, Homo sapiens
uuggguccucugguccuugguu

SEQ ID NO: 178281 - RNA, 22 nt, Homo sapiens
uugguaaaaugaccacagacau

SEQ ID NO: 178282 - RNA, 22 nt, Homo sapiens
uugguauguguuucauacucaa

SEQ ID NO: 178283 - RNA, 22 nt, Homo sapiens
uuggucaggcuagaguguggug

SEQ ID NO: 178284 - RNA, 22 nt, Homo sapiens
uuggucucaucaagagcagcuu

SEQ ID NO: 178285 - RNA, 22 nt, Homo sapiens
uugguuaccuucagaaaugagu

SEQ ID NO: 178286 - RNA, 22 nt, Homo sapiens
uugguuaucaucauuucagcaa

SEQ ID NO: 178287 - RNA, 22 nt, Homo sapiens
uugguucucuuagccaucuuaa

SEQ ID NO: 178288 - RNA, 22 nt, Homo sapiens
uuguacuagaaaauuauucuuu

SEQ ID NO: 178289 - RNA, 20 nt, Homo sapiens
uuguacuccugggcucaagc

SEQ ID NO: 178290 - RNA, 22 nt, Homo sapiens
uuguacucucaccguaucccag

SEQ ID NO: 178291 - RNA, 21 nt, Homo sapiens
uuguagcagcauaaucccaga

SEQ ID NO: 178292 - RNA, 22 nt, Homo sapiens
uuguaguagcauuauuuauaau

SEQ ID NO: 178293 - RNA, 22 nt, Homo sapiens
uuguaguguuuauucugucaac

SEQ ID NO: 178294 - RNA, 22 nt, Homo sapiens
uagagguagagugacuucccca

SEQ ID NO: 178295 - RNA, 22 nt, Homo sapiens
uagaguaguggcgugaucucgg

SEQ ID NO: 178296 - RNA, 22 nt, Homo sapiens
uagagugcugucaaagacuugu

SEQ ID NO: 178297 - RNA, 21 nt, Homo sapiens
uagauacuguauuaaaccuag

SEQ ID NO: 178298 - RNA, 22 nt, Homo sapiens
uagaucauauacuugccaugac

SEQ ID NO: 178299 - RNA, 22 nt, Homo sapiens
uagaucauauucagugcuuacu

SEQ ID NO: 178300 - RNA, 23 nt, Homo sapiens
uagaucaucaaguuuacugugcu

SEQ ID NO: 178301 - RNA, 22 nt, Homo sapiens
uagcaaguguuuaagcacuuuu

SEQ ID NO: 178302 - RNA, 22 nt, Homo sapiens
uagcacagggaauugguucucu

SEQ ID NO: 178303 - RNA, 22 nt, Homo sapiens
uagcacagugucauucuaggua

SEQ ID NO: 178304 - RNA, 22 nt, Homo sapiens
uagcaccaaacauauacucagu

SEQ ID NO: 178305 - RNA, 22 nt, Homo sapiens
uagcaccucuuuggccuuucgu

SEQ ID NO: 178306 - RNA, 22 nt, Homo sapiens
uagcaguaccccaguauccugg

SEQ ID NO: 178307 - RNA, 22 nt, Homo sapiens
uagcaguagacagacuuuggcu

SEQ ID NO: 178308 - RNA, 22 nt, Homo sapiens
uagcagucaagauagucauuau

SEQ ID NO: 178309 - RNA, 22 nt, Homo sapiens
uagcauaauuuguagaaaauca

SEQ ID NO: 178310 - RNA, 21 nt, Homo sapiens
uagcauacauuuugcaucuua

SEQ ID NO: 178311 - RNA, 22 nt, Homo sapiens
uagcaucagauuccauauucua

SEQ ID NO: 178312 - RNA, 22 nt, Homo sapiens
uagcauggagucaugcacggcu

SEQ ID NO: 178313 - RNA, 22 nt, Homo sapiens
uagcccauuuguuuagggaaag

SEQ ID NO: 178314 - RNA, 22 nt, Homo sapiens
uagcucagcccagcuaagcuca

SEQ ID NO: 178315 - RNA, 22 nt, Homo sapiens
uagcuccacagcuauauauaau

SEQ ID NO: 178316 - RNA, 17 nt, Homo sapiens
uagcucuauuucuagcc

SEQ ID NO: 178317 - RNA, 18 nt, Homo sapiens
uagcucuuguugguccau

SEQ ID NO: 178318 - RNA, 22 nt, Homo sapiens
uagcugguucuccaggagcuag

SEQ ID NO: 178319 - RNA, 22 nt, Homo sapiens
uaggaaguuucuugauuacuua

SEQ ID NO: 178320 - RNA, 22 nt, Homo sapiens
uaggagugugaacccuaugaac

SEQ ID NO: 178321 - RNA, 22 nt, Homo sapiens
uaggcagccagcuguggauuga

SEQ ID NO: 178322 - RNA, 22 nt, Homo sapiens
uaggcgagauguguguuucaug

SEQ ID NO: 178323 - RNA, 22 nt, Homo sapiens
uaggcuguguggccguggggcu

SEQ ID NO: 178324 - RNA, 22 nt, Homo sapiens
uaggcuuuuggacccugucucu

SEQ ID NO: 178325 - RNA, 22 nt, Homo sapiens
uagggagugucuucauuuugua

SEQ ID NO: 178326 - RNA, 22 nt, Homo sapiens
uagggcaaggaacaguuaaaaa

SEQ ID NO: 178327 - RNA, 22 nt, Homo sapiens
uagggcuuuuccaagcugccac

SEQ ID NO: 178328 - RNA, 22 nt, Homo sapiens
uagguagcuuuggcguuucuug

SEQ ID NO: 178329 - RNA, 22 nt, Homo sapiens
uagguuaugauccaucuuggcu

SEQ ID NO: 178330 - RNA, 23 nt, Homo sapiens
uagguuauuugguaaauauaugu

SEQ ID NO: 178331 - RNA, 22 nt, Homo sapiens
uagguucuccacagguucucca

SEQ ID NO: 178332 - RNA, 22 nt, Homo sapiens
uaguacccuugaagcagacaua

SEQ ID NO: 178333 - RNA, 22 nt, Homo sapiens
uaguagugucccugacuaucac

SEQ ID NO: 178334 - RNA, 22 nt, Homo sapiens
uaguaguuuuguguauaauaau

SEQ ID NO: 178335 - RNA, 22 nt, Homo sapiens
uaguaucacaagguguacaccc

SEQ ID NO: 178336 - RNA, 20 nt, Homo sapiens
uagucaugagauucuccaag

SEQ ID NO: 178337 - RNA, 22 nt, Homo sapiens
uagucccauaugauuuagugaa

SEQ ID NO: 178338 - RNA, 22 nt, Homo sapiens
uagugacauugcugggaaugcu

SEQ ID NO: 178339 - RNA, 22 nt, Homo sapiens
uaguuaguagacucugauuauu

SEQ ID NO: 178340 - RNA, 22 nt, Homo sapiens
uaguuguugcagguaggaugua

SEQ ID NO: 178341 - RNA, 22 nt, Homo sapiens
uaguuuaucuucuggauggaca

SEQ ID NO: 178342 - RNA, 22 nt, Homo sapiens
uauaacaaugcaagaauggccu

SEQ ID NO: 178343 - RNA, 22 nt, Homo sapiens
uauagcauuuugauccuguaga

SEQ ID NO: 178344 - RNA, 22 nt, Homo sapiens
uauaugcacucagguguaugug

SEQ ID NO: 178345 - RNA, 22 nt, Homo sapiens
uauauguucugugucccuuucg

SEQ ID NO: 178346 - RNA, 22 nt, Homo sapiens
uaucacaaacuuagcaguuuaa

SEQ ID NO: 178347 - RNA, 22 nt, Homo sapiens
uaucacacuguuggauuugauu

SEQ ID NO: 178348 - RNA, 22 nt, Homo sapiens
uaucacaggucaggaaccuugu

SEQ ID NO: 178349 - RNA, 22 nt, Homo sapiens
uaucacaggucaggaaucuugc

SEQ ID NO: 178350 - RNA, 22 nt, Homo sapiens
uaucacaguaaaucugggugca

SEQ ID NO: 178351 - RNA, 22 nt, Homo sapiens
uaucacaguaucuagcacagug

SEQ ID NO: 178352 - RNA, 20 nt, Homo sapiens
uaucacauggggagaaaccu

SEQ ID NO: 178353 - RNA, 22 nt, Homo sapiens
uaucaccacccugggaaacaua

SEQ ID NO: 178354 - RNA, 22 nt, Homo sapiens
uaucacugucaggcccucauau

SEQ ID NO: 178355 - RNA, 19 nt, Homo sapiens
uaucacuucccuggaaaca

SEQ ID NO: 178356 - RNA, 22 nt, Homo sapiens
uaucagagcugucagccuaccu

SEQ ID NO: 178357 - RNA, 22 nt, Homo sapiens
uaucagauugcugccaucugcu

SEQ ID NO: 178358 - RNA, 22 nt, Homo sapiens
uaucagcagagucauacuucaa

SEQ ID NO: 178359 - RNA, 22 nt, Homo sapiens
uaucaguauggauucauggauu

SEQ ID NO: 178360 - RNA, 22 nt, Homo sapiens
uaucauagacaaucaguuauug

SEQ ID NO: 178361 - RNA, 22 nt, Homo sapiens
uaucaucauuggcaggugagaa

SEQ ID NO: 178362 - RNA, 22 nt, Homo sapiens
uaucauggaaagauguugaaau

SEQ ID NO: 178363 - RNA, 22 nt, Homo sapiens
uaucccuuagagcggggugguu

SEQ ID NO: 178364 - RNA, 23 nt, Homo sapiens
uaucccuugccuuaugaugugag

SEQ ID NO: 178365 - RNA, 22 nt, Homo sapiens
uaucucagagaaucagauuuac

SEQ ID NO: 178366 - RNA, 20 nt, Homo sapiens
uaucucaguuuguccuaaac

SEQ ID NO: 178367 - RNA, 22 nt, Homo sapiens
uaucugguuauugcugcugauu

SEQ ID NO: 178368 - RNA, 22 nt, Homo sapiens
uaugaaagcuacuucucacaau

SEQ ID NO: 178369 - RNA, 22 nt, Homo sapiens
uaugacauaguccuuaacccuc

SEQ ID NO: 178370 - RNA, 22 nt, Homo sapiens
uaugacguuuuauuggcgcagu

SEQ ID NO: 178371 - RNA, 20 nt, Homo sapiens
uaugagacugggagaaguuc

SEQ ID NO: 178372 - RNA, 22 nt, Homo sapiens
uaugagagcugguagguagaga

SEQ ID NO: 178373 - RNA, 19 nt, Homo sapiens
uaugagcuaugacaugcau

SEQ ID NO: 178374 - RNA, 22 nt, Homo sapiens
uaugaggaguauaacccgguga

SEQ ID NO: 178375 - RNA, 22 nt, Homo sapiens
uaugaucauuauguuauugcag

SEQ ID NO: 178376 - RNA, 22 nt, Homo sapiens
uaugcacacucucccaggaggg

SEQ ID NO: 178377 - RNA, 22 nt, Homo sapiens
uaugcacuauagcauauguggu

SEQ ID NO: 178378 - RNA, 19 nt, Homo sapiens
uaugcuagagagggaagcu

SEQ ID NO: 178379 - RNA, 22 nt, Homo sapiens
uaugcuuauuaaaacagugugu

SEQ ID NO: 178380 - RNA, 22 nt, Homo sapiens
uauggcuuucuacuugaguucu

SEQ ID NO: 178381 - RNA, 22 nt, Homo sapiens
uauggcuuuguucaacagccuc

SEQ ID NO: 178382 - RNA, 22 nt, Homo sapiens
uauggcuuuuauuauguuguag

SEQ ID NO: 178383 - RNA, 22 nt, Homo sapiens
uaugggauuucauuaagugucu

SEQ ID NO: 178384 - RNA, 22 nt, Homo sapiens
uauggguuuuucauaaauaggu

SEQ ID NO: 178385 - RNA, 19 nt, Homo sapiens
uauguaguuuucucaauau

SEQ ID NO: 178386 - RNA, 22 nt, Homo sapiens
uaugucaugggguuuuugagau

SEQ ID NO: 178387 - RNA, 22 nt, Homo sapiens
uaugucuucuuuagagaaaugu

SEQ ID NO: 178388 - RNA, 22 nt, Homo sapiens
uaugucuuuugcuugcaaauag

SEQ ID NO: 178389 - RNA, 22 nt, Homo sapiens
uaugugcuuuguuaaacagaug

SEQ ID NO: 178390 - RNA, 22 nt, Homo sapiens
uauuacuugucugugucucaau

SEQ ID NO: 178391 - RNA, 22 nt, Homo sapiens
uauuagguuggugcaaaaguaa

SEQ ID NO: 178392 - RNA, 22 nt, Homo sapiens
uauuagguuggugcaaaaguua

SEQ ID NO: 178393 - RNA, 22 nt, Homo sapiens
uauuagguuggugcaacaguaa

SEQ ID NO: 178394 - RNA, 22 nt, Homo sapiens
uauuccacaauaugauuuuuaa

SEQ ID NO: 178395 - RNA, 22 nt, Homo sapiens
uauuccacacuguuggugggau

SEQ ID NO: 178396 - RNA, 22 nt, Homo sapiens
uauugaauuugagcugucucuu

SEQ ID NO: 178397 - RNA, 23 nt, Homo sapiens
uauugcacuaugguaacccuuuu

SEQ ID NO: 178398 - RNA, 22 nt, Homo sapiens
uauugcagauacccaggaaguu

SEQ ID NO: 178399 - RNA, 22 nt, Homo sapiens
uauugcagugagauccaucugg

SEQ ID NO: 178400 - RNA, 22 nt, Homo sapiens
uauugccugucuccaaaaauca

SEQ ID NO: 178401 - RNA, 22 nt, Homo sapiens
uauugccuugccuacuuuucca

SEQ ID NO: 178402 - RNA, 22 nt, Homo sapiens
uauugcuaaauucuuuuccuag

SEQ ID NO: 178403 - RNA, 22 nt, Homo sapiens
aaaacgcauccucacaggucug

SEQ ID NO: 178404 - RNA, 22 nt, Homo sapiens
aaacauugaccucauccuggca

SEQ ID NO: 178405 - RNA, 21 nt, Homo sapiens
aaacuggcccaauuguuccau

SEQ ID NO: 178406 - RNA, 22 nt, Homo sapiens
aaagaagucagccuguccuuug

SEQ ID NO: 178407 - RNA, 23 nt, Homo sapiens
aaagacuagucaggugcaguggu

SEQ ID NO: 178408 - RNA, 22 nt, Homo sapiens
aaagagcugagaccugguggag

SEQ ID NO: 178409 - RNA, 22 nt, Homo sapiens
aaagcacugaauaaauuugcuu

SEQ ID NO: 178410 - RNA, 22 nt, Homo sapiens
aaaggaccacauauaugguggc

SEQ ID NO: 178411 - RNA, 22 nt, Homo sapiens
aaaggcaucauuaguaccaagu

SEQ ID NO: 178412 - RNA, 20 nt, Homo sapiens
aaaggcugugagaacgagau

SEQ ID NO: 178413 - RNA, 22 nt, Homo sapiens
aaagggcuuuguaaacuucaag

SEQ ID NO: 178414 - RNA, 22 nt, Homo sapiens
aaagguaguacuucuagaaggg

SEQ ID NO: 178415 - RNA, 17 nt, Homo sapiens
aaaguccuuugcuaucu

SEQ ID NO: 178416 - RNA, 22 nt, Homo sapiens
aaagucuguuacagcuauuucu

SEQ ID NO: 178417 - RNA, 22 nt, Homo sapiens
aaagucuguuuugucagagacu

SEQ ID NO: 178418 - RNA, 22 nt, Homo sapiens
aaagugaauguaucccguaagu

SEQ ID NO: 178419 - RNA, 22 nt, Homo sapiens
aaagugcaguacuucguauauu

SEQ ID NO: 178420 - RNA, 22 nt, Homo sapiens
aaagugcugagacagacuggga

SEQ ID NO: 178421 - RNA, 22 nt, Homo sapiens
aaagugcugagaguucuaacuu

SEQ ID NO: 178422 - RNA, 22 nt, Homo sapiens
aaagugcugagucuaggcgggg

SEQ ID NO: 178423 - RNA, 22 nt, Homo sapiens
aaagugcugggauuuuaggcau

SEQ ID NO: 178424 - RNA, 22 nt, Homo sapiens
aaagugcuguagacugggcgca

SEQ ID NO: 178425 - RNA, 22 nt, Homo sapiens
aaagugcuuacuaaguugccaa

SEQ ID NO: 178426 - RNA, 22 nt, Homo sapiens
aaagugcuucucuuuggugggu

SEQ ID NO: 178427 - RNA, 22 nt, Homo sapiens
aaaguggugggauuccaggcau

SEQ ID NO: 178428 - RNA, 22 nt, Homo sapiens
aaauaacugucagguucuggaa

SEQ ID NO: 178429 - RNA, 22 nt, Homo sapiens
aaaucccuugcucucucagacc

SEQ ID NO: 178430 - RNA, 22 nt, Homo sapiens
aaaugcagucuuuguucugggc

SEQ ID NO: 178431 - RNA, 22 nt, Homo sapiens
aaaugcaugaauaagcucgugu

SEQ ID NO: 178432 - RNA, 23 nt, Homo sapiens
aaaugcucucaggugccaguaga

SEQ ID NO: 178433 - RNA, 20 nt, Homo sapiens
aaaugcuguaauguuuggga

SEQ ID NO: 178434 - RNA, 22 nt, Homo sapiens
aaaugcugucugugagccucau

SEQ ID NO: 178435 - RNA, 22 nt, Homo sapiens
aaaugcuucuauguggcauguu

SEQ ID NO: 178436 - RNA, 22 nt, Homo sapiens
aaaugcuuucuuggaccauuug

SEQ ID NO: 178437 - RNA, 22 nt, Homo sapiens
aaauggcaccggcucuucccuc

SEQ ID NO: 178438 - RNA, 22 nt, Homo sapiens
aaaugguguuaguagaucuuua

SEQ ID NO: 178439 - RNA, 22 nt, Homo sapiens
aaaugucauggaguguuucccc

SEQ ID NO: 178440 - RNA, 22 nt, Homo sapiens
aaauucaucaaaugguuuguau

SEQ ID NO: 178441 - RNA, 22 nt, Homo sapiens
aaauugcacaaguggugauuug

SEQ ID NO: 178442 - RNA, 22 nt, Homo sapiens
aaauugcaguuaggaugauggu

SEQ ID NO: 178443 - RNA, 22 nt, Homo sapiens
aaauugcuuuugaagacuuagu

SEQ ID NO: 178444 - RNA, 22 nt, Homo sapiens
aacaccaucccuuugaugcuuu

SEQ ID NO: 178445 - RNA, 22 nt, Homo sapiens
aacacuguuuccagucaugauc

SEQ ID NO: 178446 - RNA, 22 nt, Homo sapiens
aacagaauccucuuuuccuggg

SEQ ID NO: 178447 - RNA, 22 nt, Homo sapiens
aacagacugucacauaaaauug

SEQ ID NO: 178448 - RNA, 22 nt, Homo sapiens
aacagauugcugagccccaccc

SEQ ID NO: 178449 - RNA, 22 nt, Homo sapiens
aacagcacacccgcugcuucca

SEQ ID NO: 178450 - RNA, 22 nt, Homo sapiens
aacagcuaguaccaauccacua

SEQ ID NO: 178451 - RNA, 22 nt, Homo sapiens
aacaggguguuugcaguuucuu

SEQ ID NO: 178452 - RNA, 22 nt, Homo sapiens
aacagucuccaguuguauccau

SEQ ID NO: 178453 - RNA, 22 nt, Homo sapiens
aacagugcauuccuguccauau

SEQ ID NO: 178454 - RNA, 21 nt, Homo sapiens
aacagugcugaacagacaccu

SEQ ID NO: 178455 - RNA, 21 nt, Homo sapiens
aacagugcuuaguagauguuc

SEQ ID NO: 178456 - RNA, 22 nt, Homo sapiens
aacauguuuagcagauaccugu

SEQ ID NO: 178457 - RNA, 22 nt, Homo sapiens
aaccuguggauuuugguaucug

SEQ ID NO: 178458 - RNA, 22 nt, Homo sapiens
aaccuucauuccuuucccugcc

SEQ ID NO: 178459 - RNA, 22 nt, Homo sapiens
aacucacauucuuucuugguac

SEQ ID NO: 178460 - RNA, 22 nt, Homo sapiens
aacuggcauagccagacuucuc

SEQ ID NO: 178461 - RNA, 22 nt, Homo sapiens
aacuggccugagaugaaaagug

SEQ ID NO: 178462 - RNA, 19 nt, Homo sapiens
aacuggugugagaugauau

SEQ ID NO: 178463 - RNA, 22 nt, Homo sapiens
aacuugcacuugauugagagcu

SEQ ID NO: 178464 - RNA, 22 nt, Homo sapiens
aagaccuaugcaggaagaaaug

SEQ ID NO: 178465 - RNA, 22 nt, Homo sapiens
aagagaugaagguccugacugu

SEQ ID NO: 178466 - RNA, 22 nt, Homo sapiens
aagagcucauccauaguuguca

SEQ ID NO: 178467 - RNA, 22 nt, Homo sapiens
aagaggcuguaggauaaugccu

SEQ ID NO: 178468 - RNA, 22 nt, Homo sapiens
aagagguagaagcuugccuucu

SEQ ID NO: 178469 - RNA, 22 nt, Homo sapiens
uauugcuccccauaucgcagug

SEQ ID NO: 178470 - RNA, 22 nt, Homo sapiens
uauugcuggcucugucuucauu

SEQ ID NO: 178471 - RNA, 22 nt, Homo sapiens
uauugcuugaggaaaugguaau

SEQ ID NO: 178472 - RNA, 22 nt, Homo sapiens
uauugucaccaucccuguuuua

SEQ ID NO: 178473 - RNA, 22 nt, Homo sapiens
uauuugguuggugcaaaaguaa

SEQ ID NO: 178474 - RNA, 22 nt, Homo sapiens
ucaaacauccccaccagggacu

SEQ ID NO: 178475 - RNA, 22 nt, Homo sapiens
ucaaacugcuugaggccauuua

SEQ ID NO: 178476 - RNA, 22 nt, Homo sapiens
ucaaaucaucuuuuccaaagcu

SEQ ID NO: 178477 - RNA, 22 nt, Homo sapiens
ucaaaugaucugcccgccuugg

SEQ ID NO: 178478 - RNA, 22 nt, Homo sapiens
ucaaaugcucuuugcagagagg

SEQ ID NO: 178479 - RNA, 22 nt, Homo sapiens
ucaaaugcuguauuguaguaau

SEQ ID NO: 178480 - RNA, 20 nt, Homo sapiens
ucaaauucuuggccuccagc

SEQ ID NO: 178481 - RNA, 22 nt, Homo sapiens
ucaacacaguuaaauggggaaa

SEQ ID NO: 178482 - RNA, 22 nt, Homo sapiens
ucaacagugggcacuguaaaug

SEQ ID NO: 178483 - RNA, 21 nt, Homo sapiens
ucaacccuugcgucaccaagc

SEQ ID NO: 178484 - RNA, 22 nt, Homo sapiens
ucaacugcuugagaucacaaau

SEQ ID NO: 178485 - RNA, 22 nt, Homo sapiens
ucaagcaauucgccugucucag

SEQ ID NO: 178486 - RNA, 22 nt, Homo sapiens
ucaagcaauucugcugccucag

SEQ ID NO: 178487 - RNA, 19 nt, Homo sapiens
ucaagcuauucuccugccu

SEQ ID NO: 178488 - RNA, 22 nt, Homo sapiens
ucaaguacugccuugcucuggc

SEQ ID NO: 178489 - RNA, 22 nt, Homo sapiens
ucaaguaguaacuaacugugac

SEQ ID NO: 178490 - RNA, 22 nt, Homo sapiens
ucaagugauucuugugccuuag

SEQ ID NO: 178491 - RNA, 22 nt, Homo sapiens
ucacaagcuccugccuuugcuu

SEQ ID NO: 178492 - RNA, 21 nt, Homo sapiens
ucacaaugaacagcagcagaa

SEQ ID NO: 178493 - RNA, 22 nt, Homo sapiens
ucacaauggagacucgggcgga

SEQ ID NO: 178494 - RNA, 22 nt, Homo sapiens
ucacacucucaccaacauuugg

SEQ ID NO: 178495 - RNA, 22 nt, Homo sapiens
ucacacugaauuugaagcaaug

SEQ ID NO: 178496 - RNA, 22 nt, Homo sapiens
ucacacugcaucuguuggaauu

SEQ ID NO: 178497 - RNA, 22 nt, Homo sapiens
ucacagacauugaggggaccuu

SEQ ID NO: 178498 - RNA, 22 nt, Homo sapiens
ucacagacugagccaaauagag

SEQ ID NO: 178499 - RNA, 19 nt, Homo sapiens
ucacaggguugacuugagg

SEQ ID NO: 178500 - RNA, 22 nt, Homo sapiens
ucacaguagagcuucuuucaga

SEQ ID NO: 178501 - RNA, 22 nt, Homo sapiens
ucacaguagccccucccaucau

SEQ ID NO: 178502 - RNA, 22 nt, Homo sapiens
ucacaguccuguuuaggagagg

SEQ ID NO: 178503 - RNA, 22 nt, Homo sapiens
ucacagucuccucuagggaggg

SEQ ID NO: 178504 - RNA, 22 nt, Homo sapiens
ucacagucugcgugaugagaca

SEQ ID NO: 178505 - RNA, 22 nt, Homo sapiens
ucacagugaguggaguggggug

SEQ ID NO: 178506 - RNA, 22 nt, Homo sapiens
ucacauagcauaaugucugcaa

SEQ ID NO: 178507 - RNA, 22 nt, Homo sapiens
ucacauagcugaguaaaaugga

SEQ ID NO: 178508 - RNA, 22 nt, Homo sapiens
ucacaugaauugucuuguucca

SEQ ID NO: 178509 - RNA, 22 nt, Homo sapiens
ucacaugugcguuuuggcaugu

SEQ ID NO: 178510 - RNA, 22 nt, Homo sapiens
ucacauuaagcuguuauuucuu

SEQ ID NO: 178511 - RNA, 22 nt, Homo sapiens
ucacauuguacaaacagguaag

SEQ ID NO: 178512 - RNA, 22 nt, Homo sapiens
ucaccaccugcugauuguagag

SEQ ID NO: 178513 - RNA, 22 nt, Homo sapiens
ucacccacacaggagacaggga

SEQ ID NO: 178514 - RNA, 16 nt, Homo sapiens
ucaccccuagagaucc

SEQ ID NO: 178515 - RNA, 22 nt, Homo sapiens
ucacccuguguuuugcguuugc

SEQ ID NO: 178516 - RNA, 22 nt, Homo sapiens
ucaccuagacucgaucauguag

SEQ ID NO: 178517 - RNA, 22 nt, Homo sapiens
ucaccuggagccuucacauucu

SEQ ID NO: 178518 - RNA, 22 nt, Homo sapiens
ucaccuggggcacagcugaaga

SEQ ID NO: 178519 - RNA, 23 nt, Homo sapiens
ucacggagaccugcaagaccaau

SEQ ID NO: 178520 - RNA, 19 nt, Homo sapiens
ucacgugcagcagccacac

SEQ ID NO: 178521 - RNA, 22 nt, Homo sapiens
ucacgugcucuuguguguucug

SEQ ID NO: 178522 - RNA, 20 nt, Homo sapiens
ucacuauggagcucuuucuu

SEQ ID NO: 178523 - RNA, 22 nt, Homo sapiens
ucacugaggucugagcuuuaug

SEQ ID NO: 178524 - RNA, 22 nt, Homo sapiens
ucacugcacuccagccuuuaug

SEQ ID NO: 178525 - RNA, 22 nt, Homo sapiens
ucacuggagauagcaaucuggu

SEQ ID NO: 178526 - RNA, 22 nt, Homo sapiens
ucacuggaggagaggaagugga

SEQ ID NO: 178527 - RNA, 22 nt, Homo sapiens
ucacuggagguuccugaaguuc

SEQ ID NO: 178528 - RNA, 22 nt, Homo sapiens
ucacuggccaaauucuggguga

SEQ ID NO: 178529 - RNA, 22 nt, Homo sapiens
ucacuggucuaaguggaggggg

SEQ ID NO: 178530 - RNA, 22 nt, Homo sapiens
ucacugugcaugaaggaugcug

SEQ ID NO: 178531 - RNA, 22 nt, Homo sapiens
ucacuuugacggccaacuucua

SEQ ID NO: 178532 - RNA, 22 nt, Homo sapiens
ucacuuuggguacuauggaaau

SEQ ID NO: 178533 - RNA, 22 nt, Homo sapiens
ucacuuuguauagcgacuggcu

SEQ ID NO: 178534 - RNA, 22 nt, Homo sapiens
ucagacacuguggccuuuggac

SEQ ID NO: 178535 - RNA, 22 nt, Homo sapiens
ucagagcaaagacacuuuauca

SEQ ID NO: 178536 - RNA, 22 nt, Homo sapiens
ucagaguagagcgacuucuccu

SEQ ID NO: 178537 - RNA, 18 nt, Homo sapiens
ucagagugcagacuauac

SEQ ID NO: 178538 - RNA, 22 nt, Homo sapiens
ucagaguggagucugcagccuu

SEQ ID NO: 178539 - RNA, 22 nt, Homo sapiens
ucagaguguuuuccaacuuggu

SEQ ID NO: 178540 - RNA, 22 nt, Homo sapiens
ucagaugaucugguaagaacuu

SEQ ID NO: 178541 - RNA, 22 nt, Homo sapiens
ucagaugauucuguuguugugu

SEQ ID NO: 178542 - RNA, 22 nt, Homo sapiens
ucagauguuuuguuuaucugcu

SEQ ID NO: 178543 - RNA, 22 nt, Homo sapiens
ucagcacauucaaggccugccu

SEQ ID NO: 178544 - RNA, 19 nt, Homo sapiens
ucagcaguaaucaacuuca

SEQ ID NO: 178545 - RNA, 22 nt, Homo sapiens
ucagcagucacuccuaugacaa

SEQ ID NO: 178546 - RNA, 22 nt, Homo sapiens
ucagcagugugaaaauggacua

SEQ ID NO: 178547 - RNA, 16 nt, Homo sapiens
ucagcgagggagccag

SEQ ID NO: 178548 - RNA, 20 nt, Homo sapiens
ucaggcuccgcauuaacuua

SEQ ID NO: 178549 - RNA, 22 nt, Homo sapiens
ucagguaaucuauuugucuuuu

SEQ ID NO: 178550 - RNA, 23 nt, Homo sapiens
ucagguaguuucagaggaccuug

SEQ ID NO: 178551 - RNA, 22 nt, Homo sapiens
ucaguaaaugcuguucucuuuu

SEQ ID NO: 178552 - RNA, 22 nt, Homo sapiens
ucaguaaauguuaggacauuuc

SEQ ID NO: 178553 - RNA, 22 nt, Homo sapiens
ucaguaaucuuagcugugcaga

SEQ ID NO: 178554 - RNA, 23 nt, Homo sapiens
ucaguacuccacuuucaauagug

SEQ ID NO: 178555 - RNA, 22 nt, Homo sapiens
ucaguagcauugcuuauacagu

SEQ ID NO: 178556 - RNA, 22 nt, Homo sapiens
ucagucauguuuaccagacgua

SEQ ID NO: 178557 - RNA, 22 nt, Homo sapiens
ucagugaacgaggaggagggug

SEQ ID NO: 178558 - RNA, 22 nt, Homo sapiens
ucagugaauacauguacucaug

SEQ ID NO: 178559 - RNA, 22 nt, Homo sapiens
ucagugauugcuuucauggaaa

SEQ ID NO: 178560 - RNA, 22 nt, Homo sapiens
ucagugccucaguuuuuaaaga

SEQ ID NO: 178561 - RNA, 21 nt, Homo sapiens
ucagugcugugggcaaggugc

SEQ ID NO: 178562 - RNA, 22 nt, Homo sapiens
ucaguggauuauuaaagucacc

SEQ ID NO: 178563 - RNA, 22 nt, Homo sapiens
ucaguggauuuaaccugaauca

SEQ ID NO: 178564 - RNA, 22 nt, Homo sapiens
ucagugguuaaaagauucuaga

SEQ ID NO: 178565 - RNA, 23 nt, Homo sapiens
ucagugucuggauccugcucagu

SEQ ID NO: 178566 - RNA, 22 nt, Homo sapiens
ucaguguuuggaaucucaauuu

SEQ ID NO: 178567 - RNA, 22 nt, Homo sapiens
ucaguuaaugcugccugcugga

SEQ ID NO: 178568 - RNA, 21 nt, Homo sapiens
ucaguuacugagagagaagug

SEQ ID NO: 178569 - RNA, 22 nt, Homo sapiens
ucauacgucuccuugugccacc

SEQ ID NO: 178570 - RNA, 20 nt, Homo sapiens
ucauacuguggaguaccagg

SEQ ID NO: 178571 - RNA, 22 nt, Homo sapiens
ucauacuguugugaaacaaaac

SEQ ID NO: 178572 - RNA, 22 nt, Homo sapiens
ucauagaucaaguaauaagaca

SEQ ID NO: 178573 - RNA, 18 nt, Homo sapiens
ucauagaucaugacagug

SEQ ID NO: 178574 - RNA, 22 nt, Homo sapiens
ucauaguagucacuuaauaaau

SEQ ID NO: 178575 - RNA, 21 nt, Homo sapiens
ucauauguaucuuugugccuc

SEQ ID NO: 178576 - RNA, 22 nt, Homo sapiens
ucauaugucauaguaugaucuu

SEQ ID NO: 178577 - RNA, 22 nt, Homo sapiens
ucauauugguuaaaauaguggg

SEQ ID NO: 178578 - RNA, 16 nt, Homo sapiens
ucaucacagucucugg

SEQ ID NO: 178579 - RNA, 22 nt, Homo sapiens
agugcauuuguucugugucagg

SEQ ID NO: 178580 - RNA, 23 nt, Homo sapiens
agugccuaguauauaggaggcgc

SEQ ID NO: 178581 - RNA, 22 nt, Homo sapiens
aguggaaucuguuauacuaacu

SEQ ID NO: 178582 - RNA, 23 nt, Homo sapiens
aguggucuccugggcccagcugu

SEQ ID NO: 178583 - RNA, 22 nt, Homo sapiens
agugguuuuaaguagagcauac

SEQ ID NO: 178584 - RNA, 22 nt, Homo sapiens
agugucaggagacagguagcug

SEQ ID NO: 178585 - RNA, 21 nt, Homo sapiens
aguucacauggcuccuguguu

SEQ ID NO: 178586 - RNA, 22 nt, Homo sapiens
aguuggcacugagcugugauug

SEQ ID NO: 178587 - RNA, 18 nt, Homo sapiens
aguuguuuuauccugccc

SEQ ID NO: 178588 - RNA, 22 nt, Homo sapiens
auaaaagcaggucuaggucagg

SEQ ID NO: 178589 - RNA, 19 nt, Homo sapiens
auaaacuagaacugucccc

SEQ ID NO: 178590 - RNA, 22 nt, Homo sapiens
auaaagcaagucucuggccuca

SEQ ID NO: 178591 - RNA, 22 nt, Homo sapiens
auaaaugcaaugguauuuuuga

SEQ ID NO: 178592 - RNA, 22 nt, Homo sapiens
auaaaugcauugagaacugcug

SEQ ID NO: 178593 - RNA, 20 nt, Homo sapiens
auaaauguauagguguacau

SEQ ID NO: 178594 - RNA, 22 nt, Homo sapiens
auaacauccuuucuuaucguug

SEQ ID NO: 178595 - RNA, 22 nt, Homo sapiens
auaacauggaguuugucauuua

SEQ ID NO: 178596 - RNA, 18 nt, Homo sapiens
auaaccuggugcuuucaa

SEQ ID NO: 178597 - RNA, 22 nt, Homo sapiens
auaagagcaggcuucuggccag

SEQ ID NO: 178598 - RNA, 22 nt, Homo sapiens
auaaguauuuggacuuuacugu

SEQ ID NO: 178599 - RNA, 22 nt, Homo sapiens
auaauagguaguaauggauuga

SEQ ID NO: 178600 - RNA, 22 nt, Homo sapiens
auaaucacacccagguuaaaug

SEQ ID NO: 178601 - RNA, 22 nt, Homo sapiens
auaaucaugucugaaaccuuug

SEQ ID NO: 178602 - RNA, 22 nt, Homo sapiens
auaaugacuuccaguuccacuc

SEQ ID NO: 178603 - RNA, 22 nt, Homo sapiens
auaauguuugauugagcagaua

SEQ ID NO: 178604 - RNA, 19 nt, Homo sapiens
auaauuagcagugaggaca

SEQ ID NO: 178605 - RNA, 22 nt, Homo sapiens
auacaagcaguccaacuccaua

SEQ ID NO: 178606 - RNA, 22 nt, Homo sapiens
auacaaguuauuugaacugcgg

SEQ ID NO: 178607 - RNA, 22 nt, Homo sapiens
auacagguauacaaugcauaau

SEQ ID NO: 178608 - RNA, 22 nt, Homo sapiens
auacaguaucuucuggcaagca

SEQ ID NO: 178609 - RNA, 22 nt, Homo sapiens
auacaguguauguauaguacau

SEQ ID NO: 178610 - RNA, 22 nt, Homo sapiens
auacaguguucugggaagaagu

SEQ ID NO: 178611 - RNA, 22 nt, Homo sapiens
auacaucugccauguuggugug

SEQ ID NO: 178612 - RNA, 22 nt, Homo sapiens
auacaugcauuugcacgagagu

SEQ ID NO: 178613 - RNA, 22 nt, Homo sapiens
auacaugugcaggucagguuac

SEQ ID NO: 178614 - RNA, 22 nt, Homo sapiens
auacaugugccauguugguaug

SEQ ID NO: 178615 - RNA, 22 nt, Homo sapiens
auacaugugccauguugguuug

SEQ ID NO: 178616 - RNA, 22 nt, Homo sapiens
auacauguucaagggcauauau

SEQ ID NO: 178617 - RNA, 22 nt, Homo sapiens
auacauguuucauguuggugug

SEQ ID NO: 178618 - RNA, 22 nt, Homo sapiens
auacugccuuuagcaaaacagu

SEQ ID NO: 178619 - RNA, 22 nt, Homo sapiens
auacuguauaggauuguagccu

SEQ ID NO: 178620 - RNA, 22 nt, Homo sapiens
auacugucucuugcuccugccc

SEQ ID NO: 178621 - RNA, 22 nt, Homo sapiens
auagaagcuauguauaggggcc

SEQ ID NO: 178622 - RNA, 22 nt, Homo sapiens
auagauucauuugaggagauuu

SEQ ID NO: 178623 - RNA, 22 nt, Homo sapiens
auagcaaugcaagaauggcuua

SEQ ID NO: 178624 - RNA, 22 nt, Homo sapiens
auagcaaugccccaauccuugg

SEQ ID NO: 178625 - RNA, 22 nt, Homo sapiens
auagcacacuauagcuucaaac

SEQ ID NO: 178626 - RNA, 21 nt, Homo sapiens
auagcacaucagauuuuauua

SEQ ID NO: 178627 - RNA, 22 nt, Homo sapiens
auagcacaugugcaaauggcug

SEQ ID NO: 178628 - RNA, 22 nt, Homo sapiens
auagcagacauuucaaggcagg

SEQ ID NO: 178629 - RNA, 22 nt, Homo sapiens
auagcagcagcuaguagugaua

SEQ ID NO: 178630 - RNA, 22 nt, Homo sapiens
auagcagugucccacuccuugg

SEQ ID NO: 178631 - RNA, 22 nt, Homo sapiens
auagcagugugaaaacagacua

SEQ ID NO: 178632 - RNA, 22 nt, Homo sapiens
auagcagugugaaaauggacua

SEQ ID NO: 178633 - RNA, 22 nt, Homo sapiens
auagcagugugaaaauugacug

SEQ ID NO: 178634 - RNA, 22 nt, Homo sapiens
auagcagugugaggacagacua

SEQ ID NO: 178635 - RNA, 22 nt, Homo sapiens
auagcucuugcuuacccacugu

SEQ ID NO: 178636 - RNA, 19 nt, Homo sapiens
auagggcuagcauauacug

SEQ ID NO: 178637 - RNA, 22 nt, Homo sapiens
auagugcugcaaaaaacauacg

SEQ ID NO: 178638 - RNA, 22 nt, Homo sapiens
auagugcugcaagaaacauacg

SEQ ID NO: 178639 - RNA, 22 nt, Homo sapiens
auagugcugcagucaauguacg

SEQ ID NO: 178640 - RNA, 22 nt, Homo sapiens
auagugcuggaauaaauauacg

SEQ ID NO: 178641 - RNA, 23 nt, Homo sapiens
auauaguagaugugcaguaacau

SEQ ID NO: 178642 - RNA, 22 nt, Homo sapiens
auauaguguuuuuugguacgcu

SEQ ID NO: 178643 - RNA, 22 nt, Homo sapiens
auauaugcacacgugugcauau

SEQ ID NO: 178644 - RNA, 22 nt, Homo sapiens
auaucaacaugguaggguuggu

SEQ ID NO: 178645 - RNA, 22 nt, Homo sapiens
auaucacaaacaagucuguacu

SEQ ID NO: 178646 - RNA, 22 nt, Homo sapiens
auaucacaggaaaggaagauac

SEQ ID NO: 178647 - RNA, 22 nt, Homo sapiens
auaucagugucuuacuguuuuu

SEQ ID NO: 178648 - RNA, 22 nt, Homo sapiens
auauccuggagcauuuuugcaa

SEQ ID NO: 178649 - RNA, 22 nt, Homo sapiens
auaugcaaauccauagagacag

SEQ ID NO: 178650 - RNA, 20 nt, Homo sapiens
auaugcauguguuuucacuu

SEQ ID NO: 178651 - RNA, 22 nt, Homo sapiens
auaugccacugaacuguaccca

SEQ ID NO: 178652 - RNA, 22 nt, Homo sapiens
auaugcuuauuagcaagaaaua

SEQ ID NO: 178653 - RNA, 22 nt, Homo sapiens
auauggucccuguucucaagga

SEQ ID NO: 178654 - RNA, 22 nt, Homo sapiens
auaugguuuuuggaagcauauc

SEQ ID NO: 178655 - RNA, 22 nt, Homo sapiens
auauguaguauggaaacauugu

SEQ ID NO: 178656 - RNA, 22 nt, Homo sapiens
auauguaguuucagaaguggaa

SEQ ID NO: 178657 - RNA, 22 nt, Homo sapiens
auaugucuauuauuagggcagg

SEQ ID NO: 178658 - RNA, 22 nt, Homo sapiens
auauguucucauucauaugugg

SEQ ID NO: 178659 - RNA, 22 nt, Homo sapiens
auauuagcacuaaugucacgau

SEQ ID NO: 178660 - RNA, 18 nt, Homo sapiens
auauugcauuggauggau

SEQ ID NO: 178661 - RNA, 22 nt, Homo sapiens
auauugcuccuaauaccacggu

SEQ ID NO: 178662 - RNA, 22 nt, Homo sapiens
auauuggacugugcuaguuaga

SEQ ID NO: 178663 - RNA, 22 nt, Homo sapiens
auauuggccuaaaauucucuuu

SEQ ID NO: 178664 - RNA, 22 nt, Homo sapiens
auauuggucuucaagaccugug

SEQ ID NO: 178665 - RNA, 22 nt, Homo sapiens
auauugguuaaauauuauguga

SEQ ID NO: 178666 - RNA, 20 nt, Homo sapiens
aucaaagacuuagaggggga

SEQ ID NO: 178667 - RNA, 22 nt, Homo sapiens
aucaaagccaugcucaguuuuc

SEQ ID NO: 178668 - RNA, 22 nt, Homo sapiens
aucaaauugucauuuuaaggau

SEQ ID NO: 178669 - RNA, 22 nt, Homo sapiens
aucaagccaaagaaaguccuug

SEQ ID NO: 178670 - RNA, 22 nt, Homo sapiens
aucaaguaaucugaguaagagu

SEQ ID NO: 178671 - RNA, 22 nt, Homo sapiens
aucacaauuguacguaggagcc

SEQ ID NO: 178672 - RNA, 22 nt, Homo sapiens
aucacacucaccuucuguccuu

SEQ ID NO: 178673 - RNA, 22 nt, Homo sapiens
aucacagaguuaaaacuuucuu

SEQ ID NO: 178674 - RNA, 22 nt, Homo sapiens
aucacaggucaaaucauuauuu

SEQ ID NO: 178675 - RNA, 22 nt, Homo sapiens
aucacagugagcauaugucuau

SEQ ID NO: 178676 - RNA, 22 nt, Homo sapiens
aucacaguggcucacaagagcc

SEQ ID NO: 178677 - RNA, 22 nt, Homo sapiens
aucacaguuuuaccauuuggua

SEQ ID NO: 178678 - RNA, 20 nt, Homo sapiens
aucaccacagcucguucaug

SEQ ID NO: 178679 - RNA, 19 nt, Homo sapiens
aucaccauuauuuggaaca

SEQ ID NO: 178680 - RNA, 22 nt, Homo sapiens
aucacugggagcagccauuaau

SEQ ID NO: 178681 - RNA, 22 nt, Homo sapiens
aucacuguuuugaugcucggac

SEQ ID NO: 178682 - RNA, 22 nt, Homo sapiens
aucagaaucucuagugggacca

SEQ ID NO: 178683 - RNA, 21 nt, Homo sapiens
aucagagacccaggcuuccuc

SEQ ID NO: 178684 - RNA, 20 nt, Homo sapiens
aucagagacuaggauugcca

SEQ ID NO: 178685 - RNA, 22 nt, Homo sapiens
aucagagugaaacaugggagau

SEQ ID NO: 178686 - RNA, 22 nt, Homo sapiens
aucagagugaauaaugacaaaa

SEQ ID NO: 178687 - RNA, 22 nt, Homo sapiens
aucagauaccuguugggaaaug

SEQ ID NO: 178688 - RNA, 22 nt, Homo sapiens
aucagauguuuguauaggagua

SEQ ID NO: 178689 - RNA, 22 nt, Homo sapiens
ugccugauacccucugucucuc

SEQ ID NO: 178690 - RNA, 22 nt, Homo sapiens
ugccuucuguuaaacgaggaug

SEQ ID NO: 178691 - RNA, 23 nt, Homo sapiens
ugcuauguaagcauuuauuaaau

SEQ ID NO: 178692 - RNA, 22 nt, Homo sapiens
ugcuaugucuucucucacagag

SEQ ID NO: 178693 - RNA, 22 nt, Homo sapiens
ugcucaguuuaaaacuuuugag

SEQ ID NO: 178694 - RNA, 21 nt, Homo sapiens
ugcuccauuuucuagccugaa

SEQ ID NO: 178695 - RNA, 18 nt, Homo sapiens
ugcuccccugggugagca

SEQ ID NO: 178696 - RNA, 20 nt, Homo sapiens
ugcugcacuuaagcaugggc

SEQ ID NO: 178697 - RNA, 22 nt, Homo sapiens
ugcugcuguuaucauuuuacca

SEQ ID NO: 178698 - RNA, 22 nt, Homo sapiens
ugcugcuguuguuguuacuagc

SEQ ID NO: 178699 - RNA, 22 nt, Homo sapiens
ugcugguguuuaggaauaagaa

SEQ ID NO: 178700 - RNA, 22 nt, Homo sapiens
ugcuguguugcuggcuuaaaga

SEQ ID NO: 178701 - RNA, 20 nt, Homo sapiens
uggaaaguaagucaugauau

SEQ ID NO: 178702 - RNA, 22 nt, Homo sapiens
uggaaauaaaugugccaagauc

SEQ ID NO: 178703 - RNA, 22 nt, Homo sapiens
uggaacaccaggcuggcguggc

SEQ ID NO: 178704 - RNA, 19 nt, Homo sapiens
uggaacauaaaaguugguu

SEQ ID NO: 178705 - RNA, 19 nt, Homo sapiens
uggaacugauucaguucug

SEQ ID NO: 178706 - RNA, 22 nt, Homo sapiens
uggaagacaaguguuagcaugg

SEQ ID NO: 178707 - RNA, 22 nt, Homo sapiens
uggaagacauugggugaagggu

SEQ ID NO: 178708 - RNA, 22 nt, Homo sapiens
uggaagauucuagaagauucca

SEQ ID NO: 178709 - RNA, 22 nt, Homo sapiens
uggaagcaugcaaucugugggg

SEQ ID NO: 178710 - RNA, 22 nt, Homo sapiens
uggaagccuagauucuuuucuu

SEQ ID NO: 178711 - RNA, 22 nt, Homo sapiens
uggaagguaaguuuugagcauu

SEQ ID NO: 178712 - RNA, 22 nt, Homo sapiens
uggaaguauagauaauugaaag

SEQ ID NO: 178713 - RNA, 23 nt, Homo sapiens
uggaaguauggaggaggcagaau

SEQ ID NO: 178714 - RNA, 22 nt, Homo sapiens
uggaagugaacaaccaaggcag

SEQ ID NO: 178715 - RNA, 22 nt, Homo sapiens
uggaagugucugugcccagcuc

SEQ ID NO: 178716 - RNA, 22 nt, Homo sapiens
uggaaguuaaaugacucuuucu

SEQ ID NO: 178717 - RNA, 22 nt, Homo sapiens
uggaaguuaaauuaguugauga

SEQ ID NO: 178718 - RNA, 22 nt, Homo sapiens
uggaauacuauucugugcugga

SEQ ID NO: 178719 - RNA, 22 nt, Homo sapiens
uggaaucaucaacgaaugaaau

SEQ ID NO: 178720 - RNA, 22 nt, Homo sapiens
uggaaucuagagaaaugcaaac

SEQ ID NO: 178721 - RNA, 21 nt, Homo sapiens
uggaaucuauagaggcaguag

SEQ ID NO: 178722 - RNA, 21 nt, Homo sapiens
uggaaucuauuauuccaguuu

SEQ ID NO: 178723 - RNA, 22 nt, Homo sapiens
uggaaugcuaagcaugugggag

SEQ ID NO: 178724 - RNA, 19 nt, Homo sapiens
uggaauggauuuaaaugug

SEQ ID NO: 178725 - RNA, 22 nt, Homo sapiens
uggaauguauaucguuuuuugu

SEQ ID NO: 178726 - RNA, 22 nt, Homo sapiens
uggaauguuauggcuuuaaucu

SEQ ID NO: 178727 - RNA, 22 nt, Homo sapiens
uggaauuaauuaaaauauacug

SEQ ID NO: 178728 - RNA, 22 nt, Homo sapiens
uggacaagugcccuccaccuca

SEQ ID NO: 178729 - RNA, 22 nt, Homo sapiens
uggacagagagaccggcauuuu

SEQ ID NO: 178730 - RNA, 22 nt, Homo sapiens
uggacauguacauauguguaug

SEQ ID NO: 178731 - RNA, 21 nt, Homo sapiens
uggaccccuuccagucaucau

SEQ ID NO: 178732 - RNA, 22 nt, Homo sapiens
uggacuagagggugggcgaggu

SEQ ID NO: 178733 - RNA, 22 nt, Homo sapiens
uggacugagauuucagcugcca

SEQ ID NO: 178734 - RNA, 22 nt, Homo sapiens
uggagaacauucauuugcaaga

SEQ ID NO: 178735 - RNA, 22 nt, Homo sapiens
uggagagugagggccuccuuaa

SEQ ID NO: 178736 - RNA, 22 nt, Homo sapiens
uggagauguuuaaaauccacug

SEQ ID NO: 178737 - RNA, 23 nt, Homo sapiens
uggaggacaagcauggauaguga

SEQ ID NO: 178738 - RNA, 22 nt, Homo sapiens
uggagucuugaugauuuucaaa

SEQ ID NO: 178739 - RNA, 22 nt, Homo sapiens
uggagucuugcucuguugccca

SEQ ID NO: 178740 - RNA, 22 nt, Homo sapiens
uggagugagaacuucaaugaug

SEQ ID NO: 178741 - RNA, 22 nt, Homo sapiens
uggaguguaauuagccaucagu

SEQ ID NO: 178742 - RNA, 22 nt, Homo sapiens
uggauagauacuauccaggacu

SEQ ID NO: 178743 - RNA, 22 nt, Homo sapiens
uggaucauucuuucuugcaggg

SEQ ID NO: 178744 - RNA, 22 nt, Homo sapiens
uggaucuguucuauuuaucuga

SEQ ID NO: 178745 - RNA, 21 nt, Homo sapiens
uggauugagaaccccaggagg

SEQ ID NO: 178746 - RNA, 18 nt, Homo sapiens
uggauuggaaaaguuccu

SEQ ID NO: 178747 - RNA, 22 nt, Homo sapiens
uggauugugaagaccaugggaa

SEQ ID NO: 178748 - RNA, 22 nt, Homo sapiens
uggauuuuaauuauucugucau

SEQ ID NO: 178749 - RNA, 22 nt, Homo sapiens
uggcaaaaaaacgcaauuacgu

SEQ ID NO: 178750 - RNA, 22 nt, Homo sapiens
uggcaaaaaucacaaguaccuu

SEQ ID NO: 178751 - RNA, 22 nt, Homo sapiens
uggcaaauauuuuguuuuguaa

SEQ ID NO: 178752 - RNA, 22 nt, Homo sapiens
uggcaagaacgaaauguagggu

SEQ ID NO: 178753 - RNA, 22 nt, Homo sapiens
uggcaagaccccaucucuacaa

SEQ ID NO: 178754 - RNA, 22 nt, Homo sapiens
uggcaagagaacaacaucucuc

SEQ ID NO: 178755 - RNA, 22 nt, Homo sapiens
uggcaagagggaugcaagguuu

SEQ ID NO: 178756 - RNA, 20 nt, Homo sapiens
uggcaagugggaauuguggg

SEQ ID NO: 178757 - RNA, 22 nt, Homo sapiens
uggcaaguuucaauccgaggga

SEQ ID NO: 178758 - RNA, 22 nt, Homo sapiens
uggcaauaauucagugugggcu

SEQ ID NO: 178759 - RNA, 22 nt, Homo sapiens
uggcaauauccacaauuacuuu

SEQ ID NO: 178760 - RNA, 19 nt, Homo sapiens
uggcaaugucagcagagau

SEQ ID NO: 178761 - RNA, 20 nt, Homo sapiens
uggcaccugacagauagcca

SEQ ID NO: 178762 - RNA, 22 nt, Homo sapiens
uggcaccugacuccgagaugca

SEQ ID NO: 178763 - RNA, 22 nt, Homo sapiens
uggcacuaugugacaagguuuu

SEQ ID NO: 178764 - RNA, 22 nt, Homo sapiens
uggcagauggugacaccauuag

SEQ ID NO: 178765 - RNA, 22 nt, Homo sapiens
uggcagcgugaauguggcugaa

SEQ ID NO: 178766 - RNA, 22 nt, Homo sapiens
uggcagugggagauauuuuauu

SEQ ID NO: 178767 - RNA, 22 nt, Homo sapiens
uggcaguuucacauggcucaac

SEQ ID NO: 178768 - RNA, 19 nt, Homo sapiens
uggcaugaaugugaacuaa

SEQ ID NO: 178769 - RNA, 22 nt, Homo sapiens
uggcauggaacuacuuugaaac

SEQ ID NO: 178770 - RNA, 22 nt, Homo sapiens
uggcauguauuuuguguauuaa

SEQ ID NO: 178771 - RNA, 22 nt, Homo sapiens
uggcaugucguuuuucauagga

SEQ ID NO: 178772 - RNA, 23 nt, Homo sapiens
uggcauuuuaguuagcuucagug

SEQ ID NO: 178773 - RNA, 22 nt, Homo sapiens
uggccaagagcacagauauugg

SEQ ID NO: 178774 - RNA, 23 nt, Homo sapiens
uggccaagauaaucucaguuuuc

SEQ ID NO: 178775 - RNA, 22 nt, Homo sapiens
uggccaguguuuuuccugggcu

SEQ ID NO: 178776 - RNA, 22 nt, Homo sapiens
uggcccccucccaaaucucaua

SEQ ID NO: 178777 - RNA, 22 nt, Homo sapiens
uggccuguaacgcugucucagc

SEQ ID NO: 178778 - RNA, 22 nt, Homo sapiens
uggcgagcugaaauuauaaaag

SEQ ID NO: 178779 - RNA, 22 nt, Homo sapiens
uggcuaagaugcacacuucacu

SEQ ID NO: 178780 - RNA, 22 nt, Homo sapiens
uggcuaaguuaaucaaggagau

SEQ ID NO: 178781 - RNA, 22 nt, Homo sapiens
uggcuacugacugaugauuaua

SEQ ID NO: 178782 - RNA, 22 nt, Homo sapiens
uggcuguuuauuucacgugggu

SEQ ID NO: 178783 - RNA, 22 nt, Homo sapiens
uggcuuucuggggcuucuguuc

SEQ ID NO: 178784 - RNA, 22 nt, Homo sapiens
uggcuuuguaagguuucauuuu

SEQ ID NO: 178785 - RNA, 22 nt, Homo sapiens
uggcuuuuguuauuuggaagcu

SEQ ID NO: 178786 - RNA, 22 nt, Homo sapiens
ugggaaacauccagcacauacu

SEQ ID NO: 178787 - RNA, 22 nt, Homo sapiens
ugggaaauguagccuagcugug

SEQ ID NO: 178788 - RNA, 22 nt, Homo sapiens
ugggaacaugaagguuaaagag

SEQ ID NO: 178789 - RNA, 18 nt, Homo sapiens
ugggaagaaauucuucuc

SEQ ID NO: 178790 - RNA, 22 nt, Homo sapiens
ugggaccccuacucuuuccaca

SEQ ID NO: 178791 - RNA, 22 nt, Homo sapiens
ugggaucagucuggaauauuga

SEQ ID NO: 178792 - RNA, 22 nt, Homo sapiens
ugggaucauuaugcauagugua

SEQ ID NO: 178793 - RNA, 22 nt, Homo sapiens
ugggauccaugugguuuaagca

SEQ ID NO: 178794 - RNA, 22 nt, Homo sapiens
ugggaugaugaaaaggcuuucu

SEQ ID NO: 178795 - RNA, 22 nt, Homo sapiens
ugggaugauguuaaacguacuc

SEQ ID NO: 178796 - RNA, 22 nt, Homo sapiens
ugggcaaaacuaagagcugugg

SEQ ID NO: 178797 - RNA, 22 nt, Homo sapiens
ugggcagugggacagcuuugug

SEQ ID NO: 178798 - RNA, 22 nt, Homo sapiens
ugggcauggaguggccuuaugu

SEQ ID NO: 178799 - RNA, 22 nt, Homo sapiens
aagagguaggaaauggucauuu

SEQ ID NO: 178800 - RNA, 22 nt, Homo sapiens
aagagguagucugucccuuagc

SEQ ID NO: 178801 - RNA, 22 nt, Homo sapiens
aagagguuuaacugacucacag

SEQ ID NO: 178802 - RNA, 22 nt, Homo sapiens
aagaugauguucuuuuucuuag

SEQ ID NO: 178803 - RNA, 22 nt, Homo sapiens
aagcacaauuucaccuucuugu

SEQ ID NO: 178804 - RNA, 22 nt, Homo sapiens
aagcaccaauaggagauuuguc

SEQ ID NO: 178805 - RNA, 22 nt, Homo sapiens
aagcacccuuugucuggacaug

SEQ ID NO: 178806 - RNA, 21 nt, Homo sapiens
aagcaugguguaucuuuccau

SEQ ID NO: 178807 - RNA, 22 nt, Homo sapiens
aagccacuguaccugucucuua

SEQ ID NO: 178808 - RNA, 22 nt, Homo sapiens
aagccagugugacaggaaacuu

SEQ ID NO: 178809 - RNA, 22 nt, Homo sapiens
aagcccauuguaaguugaggag

SEQ ID NO: 178810 - RNA, 22 nt, Homo sapiens
aagcuacauuuuauuuauguca

SEQ ID NO: 178811 - RNA, 22 nt, Homo sapiens
aagcuggagugcaguggugcaa

SEQ ID NO: 178812 - RNA, 22 nt, Homo sapiens
aagcuggagugcaguggugcga

SEQ ID NO: 178813 - RNA, 22 nt, Homo sapiens
aaggaaguaauuugguuuauag

SEQ ID NO: 178814 - RNA, 22 nt, Homo sapiens
aaggcaagaagagaaccaucgg

SEQ ID NO: 178815 - RNA, 22 nt, Homo sapiens
aaggcacugaacuuaaauucug

SEQ ID NO: 178816 - RNA, 22 nt, Homo sapiens
aaggcaguggcagaagauguca

SEQ ID NO: 178817 - RNA, 22 nt, Homo sapiens
aaggcagugugcacauaacacu

SEQ ID NO: 178818 - RNA, 22 nt, Homo sapiens
aaggcaugcaguacguuucuau

SEQ ID NO: 178819 - RNA, 22 nt, Homo sapiens
aaggcauucucaaacuaguucu

SEQ ID NO: 178820 - RNA, 20 nt, Homo sapiens
aaggcuuucgaguuccaggg

SEQ ID NO: 178821 - RNA, 22 nt, Homo sapiens
aagggaauguugugguugguuu

SEQ ID NO: 178822 - RNA, 22 nt, Homo sapiens
aagguauuuuugucuauaucuu

SEQ ID NO: 178823 - RNA, 22 nt, Homo sapiens
aaggucauugugguuuuugcca

SEQ ID NO: 178824 - RNA, 22 nt, Homo sapiens
aaguaaacauuuuguacaauaa

SEQ ID NO: 178825 - RNA, 22 nt, Homo sapiens
aaguaauugagguuuuugcugu

SEQ ID NO: 178826 - RNA, 19 nt, Homo sapiens
aaguacuugucuuuugaag

SEQ ID NO: 178827 - RNA, 22 nt, Homo sapiens
aaguauuagugaggauauggaa

SEQ ID NO: 178828 - RNA, 23 nt, Homo sapiens
aagucauggaaucaaaugaggug

SEQ ID NO: 178829 - RNA, 22 nt, Homo sapiens
aagugaaugugcuggaauagcu

SEQ ID NO: 178830 - RNA, 22 nt, Homo sapiens
aagugaauucauuguguuauau

SEQ ID NO: 178831 - RNA, 23 nt, Homo sapiens
aagugagcuccaauugggugaga

SEQ ID NO: 178832 - RNA, 22 nt, Homo sapiens
aagugagugacaaaaacugggc

SEQ ID NO: 178833 - RNA, 21 nt, Homo sapiens
aagugcucugggacucuaaau

SEQ ID NO: 178834 - RNA, 22 nt, Homo sapiens
aagugcucuugaaacugccuua

SEQ ID NO: 178835 - RNA, 22 nt, Homo sapiens
aagugcucuugaaacugucuua

SEQ ID NO: 178836 - RNA, 22 nt, Homo sapiens
aagugcuggccuacucaaucga

SEQ ID NO: 178837 - RNA, 22 nt, Homo sapiens
aagugcuguaugggagccuagg

SEQ ID NO: 178838 - RNA, 22 nt, Homo sapiens
aaguggaauguuuguggcacaa

SEQ ID NO: 178839 - RNA, 22 nt, Homo sapiens
aaguggcauugaggaaaaaaau

SEQ ID NO: 178840 - RNA, 22 nt, Homo sapiens
aagugguagggucaggauugga

SEQ ID NO: 178841 - RNA, 22 nt, Homo sapiens
aaguuguuggaguuccauuguu

SEQ ID NO: 178842 - RNA, 22 nt, Homo sapiens
aauaaagcagcuuuuugggacu

SEQ ID NO: 178843 - RNA, 22 nt, Homo sapiens
aauaaagcauggcuacuccaua

SEQ ID NO: 178844 - RNA, 22 nt, Homo sapiens
aauaaagcuuugagcuuugcug

SEQ ID NO: 178845 - RNA, 19 nt, Homo sapiens
aauaaugccagaugucugu

SEQ ID NO: 178846 - RNA, 22 nt, Homo sapiens
aauacugagaugugagguacua

SEQ ID NO: 178847 - RNA, 22 nt, Homo sapiens
aauacuggcacugaagaccaug

SEQ ID NO: 178848 - RNA, 22 nt, Homo sapiens
aauagcacuguagauggaggaa

SEQ ID NO: 178849 - RNA, 22 nt, Homo sapiens
aauauagcuauguacaugucca

SEQ ID NO: 178850 - RNA, 23 nt, Homo sapiens
aauaucacaguggguguacaccc

SEQ ID NO: 178851 - RNA, 22 nt, Homo sapiens
aauaucacaguuggguguacac

SEQ ID NO: 178852 - RNA, 22 nt, Homo sapiens
aauaugucugcuaauuguuucu

SEQ ID NO: 178853 - RNA, 19 nt, Homo sapiens
aauauugacaguggugucu

SEQ ID NO: 178854 - RNA, 22 nt, Homo sapiens
aaucaacauuguuuuaagucaa

SEQ ID NO: 178855 - RNA, 22 nt, Homo sapiens
aaucacagccagcuuccgcuau

SEQ ID NO: 178856 - RNA, 22 nt, Homo sapiens
aaucacaguuaguaagggagaa

SEQ ID NO: 178857 - RNA, 21 nt, Homo sapiens
aaucacaguuguucugccuuc

SEQ ID NO: 178858 - RNA, 22 nt, Homo sapiens
aaucacauugaaucugcuaccu

SEQ ID NO: 178859 - RNA, 17 nt, Homo sapiens
aaucagauuucugagga

SEQ ID NO: 178860 - RNA, 22 nt, Homo sapiens
aaucagcacacugugcuuucca

SEQ ID NO: 178861 - RNA, 22 nt, Homo sapiens
aaucauauugucugccaagagg

SEQ ID NO: 178862 - RNA, 22 nt, Homo sapiens
aauccaugugcuuuaccauuuu

SEQ ID NO: 178863 - RNA, 22 nt, Homo sapiens
aauccauuugccgucuauccau

SEQ ID NO: 178864 - RNA, 22 nt, Homo sapiens
aaucccauuucucuguguuuuu

SEQ ID NO: 178865 - RNA, 22 nt, Homo sapiens
aaucugucaguuuuguguuaau

SEQ ID NO: 178866 - RNA, 22 nt, Homo sapiens
aaugacagccagauucuucucu

SEQ ID NO: 178867 - RNA, 22 nt, Homo sapiens
aaugacagugcuaaagaacccu

SEQ ID NO: 178868 - RNA, 17 nt, Homo sapiens
aaugagacauuucugcu

SEQ ID NO: 178869 - RNA, 22 nt, Homo sapiens
aaugcaagauguuaauuauagg

SEQ ID NO: 178870 - RNA, 22 nt, Homo sapiens
aaugcacauaaaauccuccagg

SEQ ID NO: 178871 - RNA, 22 nt, Homo sapiens
aaugcuaucuggaacauuguug

SEQ ID NO: 178872 - RNA, 22 nt, Homo sapiens
aauggcaaauguuuucuguuga

SEQ ID NO: 178873 - RNA, 22 nt, Homo sapiens
aauggcaagagccacagaggcg

SEQ ID NO: 178874 - RNA, 22 nt, Homo sapiens
aauggcagaugaaauugucauu

SEQ ID NO: 178875 - RNA, 22 nt, Homo sapiens
aauggccuuuuucauuauacug

SEQ ID NO: 178876 - RNA, 22 nt, Homo sapiens
aauggcuauuucaugugguagg

SEQ ID NO: 178877 - RNA, 22 nt, Homo sapiens
aauggcucuguuggcccaagac

SEQ ID NO: 178878 - RNA, 19 nt, Homo sapiens
aauggcuuuuccuguuccc

SEQ ID NO: 178879 - RNA, 22 nt, Homo sapiens
aaugucacugugguccuccagu

SEQ ID NO: 178880 - RNA, 22 nt, Homo sapiens
aauuaguugaaagucugcuuuu

SEQ ID NO: 178881 - RNA, 22 nt, Homo sapiens
ugcauaauuccuugcaccagaa

SEQ ID NO: 178882 - RNA, 18 nt, Homo sapiens
ugcauacuaucugauuuu

SEQ ID NO: 178883 - RNA, 21 nt, Homo sapiens
ugcauacuucucagaugauua

SEQ ID NO: 178884 - RNA, 23 nt, Homo sapiens
ugcauaguacccaauacuuuauc

SEQ ID NO: 178885 - RNA, 21 nt, Homo sapiens
ugcauaucucuaaugaccagu

SEQ ID NO: 178886 - RNA, 22 nt, Homo sapiens
ugcauauguauacaugugccau

SEQ ID NO: 178887 - RNA, 22 nt, Homo sapiens
ugcauauguugaaccagccuug

SEQ ID NO: 178888 - RNA, 22 nt, Homo sapiens
ugcauauucaaggcaggccauu

SEQ ID NO: 178889 - RNA, 22 nt, Homo sapiens
ugcauccauucuagacucaucu

SEQ ID NO: 178890 - RNA, 22 nt, Homo sapiens
ugcaugaugcugagauuuggga

SEQ ID NO: 178891 - RNA, 22 nt, Homo sapiens
ugcaugcaucuuuuauaguagc

SEQ ID NO: 178892 - RNA, 22 nt, Homo sapiens
ugcauuguuccgaauguguccu

SEQ ID NO: 178893 - RNA, 21 nt, Homo sapiens
ugcauuguugcugagagcagg

SEQ ID NO: 178894 - RNA, 22 nt, Homo sapiens
ugcauuguuuagaaacacuggg

SEQ ID NO: 178895 - RNA, 22 nt, Homo sapiens
ugccagaugcuggugugagggg

SEQ ID NO: 178896 - RNA, 22 nt, Homo sapiens
ugccaggaugaggucaauguuu

SEQ ID NO: 178897 - RNA, 22 nt, Homo sapiens
ugccaguauuuuauugaggauu

SEQ ID NO: 178898 - RNA, 22 nt, Homo sapiens
ugccaugaagaucccugaaaug

SEQ ID NO: 178899 - RNA, 22 nt, Homo sapiens
ugccaugaaguaauggcaaaaa

SEQ ID NO: 178900 - RNA, 22 nt, Homo sapiens
ugccuacuuugcaucugucagg

SEQ ID NO: 178901 - RNA, 23 nt, Homo sapiens
ugccuagaccaucagccugaggu

SEQ ID NO: 178902 - RNA, 22 nt, Homo sapiens
ugccuaggcccaguccucagaa

SEQ ID NO: 178903 - RNA, 22 nt, Homo sapiens
aucagcagcaugaaaacggacu

SEQ ID NO: 178904 - RNA, 22 nt, Homo sapiens
aucagucuguuggaauaucgcu

SEQ ID NO: 178905 - RNA, 22 nt, Homo sapiens
aucaugcacaugcauagguaug

SEQ ID NO: 178906 - RNA, 22 nt, Homo sapiens
aucauggaguauuugcaagucu

SEQ ID NO: 178907 - RNA, 22 nt, Homo sapiens
aucauuaguuguggaauucuug

SEQ ID NO: 178908 - RNA, 18 nt, Homo sapiens
aucauugcacugucuugc

SEQ ID NO: 178909 - RNA, 22 nt, Homo sapiens
auccacagugucaauguuguga

SEQ ID NO: 178910 - RNA, 22 nt, Homo sapiens
auccacauucauggaccagucc

SEQ ID NO: 178911 - RNA, 22 nt, Homo sapiens
auccaucagacggcaggcguug

SEQ ID NO: 178912 - RNA, 22 nt, Homo sapiens
aucccaguucagccucugacac

SEQ ID NO: 178913 - RNA, 20 nt, Homo sapiens
aucccauuccugaagauacu

SEQ ID NO: 178914 - RNA, 22 nt, Homo sapiens
auccccugcacggggugucauu

SEQ ID NO: 178915 - RNA, 22 nt, Homo sapiens
aucccgagacuuugcugaaguu

SEQ ID NO: 178916 - RNA, 22 nt, Homo sapiens
aucccugagaacuuuuaauguu

SEQ ID NO: 178917 - RNA, 22 nt, Homo sapiens
aucccugugauccaaucacuuc

SEQ ID NO: 178918 - RNA, 22 nt, Homo sapiens
auccucugagagaguuucauaa

SEQ ID NO: 178919 - RNA, 22 nt, Homo sapiens
auccucugagaucuaggcagag

SEQ ID NO: 178920 - RNA, 22 nt, Homo sapiens
auccugagacuuugcugaaguu

SEQ ID NO: 178921 - RNA, 22 nt, Homo sapiens
auccugaugacacagugcugca

SEQ ID NO: 178922 - RNA, 22 nt, Homo sapiens
auccuguacuaagguuuuccca

SEQ ID NO: 178923 - RNA, 22 nt, Homo sapiens
auccuguaggcuaguagacagu

SEQ ID NO: 178924 - RNA, 22 nt, Homo sapiens
auccuguagucucacagcccca

SEQ ID NO: 178925 - RNA, 21 nt, Homo sapiens
aucgcacaauauaccccugua

SEQ ID NO: 178926 - RNA, 22 nt, Homo sapiens
aucgcaccauugcacuccagca

SEQ ID NO: 178927 - RNA, 22 nt, Homo sapiens
aucgcgccauuguacuccagcc

SEQ ID NO: 178928 - RNA, 22 nt, Homo sapiens
aucuacuugcugggucucugga

SEQ ID NO: 178929 - RNA, 22 nt, Homo sapiens
aucucaguucaggcuggccaca

SEQ ID NO: 178930 - RNA, 22 nt, Homo sapiens
aucucauuccuucugggcugau

SEQ ID NO: 178931 - RNA, 22 nt, Homo sapiens
aucugacuuuuaauuugaaaac

SEQ ID NO: 178932 - RNA, 22 nt, Homo sapiens
aucugcaaagcugggcugagac

SEQ ID NO: 178933 - RNA, 22 nt, Homo sapiens
aucugcauuagggugaagaccu

SEQ ID NO: 178934 - RNA, 22 nt, Homo sapiens
aucugcauucccauguuuauug

SEQ ID NO: 178935 - RNA, 19 nt, Homo sapiens
aucuggaguuccuggggcu

SEQ ID NO: 178936 - RNA, 22 nt, Homo sapiens
aucuuugauuagacugauggau

SEQ ID NO: 178937 - RNA, 22 nt, Homo sapiens
aucuuugauuguagguacaaug

SEQ ID NO: 178938 - RNA, 22 nt, Homo sapiens
aucuuuggucaucacagcuaga

SEQ ID NO: 178939 - RNA, 22 nt, Homo sapiens
augaaaacaugauuugccuguu

SEQ ID NO: 178940 - RNA, 22 nt, Homo sapiens
augaaaagcauaaacgcugaag

SEQ ID NO: 178941 - RNA, 22 nt, Homo sapiens
augaaacuggcuaauuuuugua

SEQ ID NO: 178942 - RNA, 22 nt, Homo sapiens
augaaagugauaaaugucucua

SEQ ID NO: 178943 - RNA, 22 nt, Homo sapiens
augaaaucuuuccugugaggau

SEQ ID NO: 178944 - RNA, 22 nt, Homo sapiens
augaaauugcuaucgcaguacu

SEQ ID NO: 178945 - RNA, 22 nt, Homo sapiens
augaacucaucaucuagguuuu

SEQ ID NO: 178946 - RNA, 18 nt, Homo sapiens
augaacucaucauuuuua

SEQ ID NO: 178947 - RNA, 21 nt, Homo sapiens
augaacucaucauuuuuuaug

SEQ ID NO: 178948 - RNA, 22 nt, Homo sapiens
augaacucaucauuuuuuaugg

SEQ ID NO: 178949 - RNA, 19 nt, Homo sapiens
augaacucauucuuuuuau

SEQ ID NO: 178950 - RNA, 22 nt, Homo sapiens
augaagagaaaguggaucuugg

SEQ ID NO: 178951 - RNA, 22 nt, Homo sapiens
augaagauguugccuuuuuaau

SEQ ID NO: 178952 - RNA, 22 nt, Homo sapiens
augaauacugcugcaaugaaca

SEQ ID NO: 178953 - RNA, 22 nt, Homo sapiens
augacagugagugagcucucac

SEQ ID NO: 178954 - RNA, 22 nt, Homo sapiens
augacauuccacagccguagag

SEQ ID NO: 178955 - RNA, 22 nt, Homo sapiens
augaccagagagugcgcagggu

SEQ ID NO: 178956 - RNA, 19 nt, Homo sapiens
augaccauggggugguuuu

SEQ ID NO: 178957 - RNA, 22 nt, Homo sapiens
augaccauuucaauugauaugg

SEQ ID NO: 178958 - RNA, 19 nt, Homo sapiens
augaccauuuccauaguau

SEQ ID NO: 178959 - RNA, 22 nt, Homo sapiens
augacccugaccuaagccaauc

SEQ ID NO: 178960 - RNA, 21 nt, Homo sapiens
augacccuggguguccuuucc

SEQ ID NO: 178961 - RNA, 22 nt, Homo sapiens
augaccuuggggaaccaugucu

SEQ ID NO: 178962 - RNA, 22 nt, Homo sapiens
augaccuuguccucagugucau

SEQ ID NO: 178963 - RNA, 17 nt, Homo sapiens
augacuucuucagugug

SEQ ID NO: 178964 - RNA, 22 nt, Homo sapiens
augacuuuucugaaaaccacca

SEQ ID NO: 178965 - RNA, 22 nt, Homo sapiens
augagaacauaucaagugauug

SEQ ID NO: 178966 - RNA, 22 nt, Homo sapiens
augagacauuaaaguguguuug

SEQ ID NO: 178967 - RNA, 22 nt, Homo sapiens
augagacuguucuuccucauug

SEQ ID NO: 178968 - RNA, 22 nt, Homo sapiens
augagagcaacaccuucacuug

SEQ ID NO: 178969 - RNA, 22 nt, Homo sapiens
augagauacuacaaaugaguuu

SEQ ID NO: 178970 - RNA, 22 nt, Homo sapiens
augagaugauaggcguucuaac

SEQ ID NO: 178971 - RNA, 22 nt, Homo sapiens
augagauuguuuguacuccaca

SEQ ID NO: 178972 - RNA, 22 nt, Homo sapiens
augagcuauggagacagggcca

SEQ ID NO: 178973 - RNA, 17 nt, Homo sapiens
augagcucaucauuuuu

SEQ ID NO: 178974 - RNA, 22 nt, Homo sapiens
augagcugauuuccuuaccaua

SEQ ID NO: 178975 - RNA, 22 nt, Homo sapiens
augagggagggcaccugaccuu

SEQ ID NO: 178976 - RNA, 22 nt, Homo sapiens
augagguaauaaguccuuggaa

SEQ ID NO: 178977 - RNA, 22 nt, Homo sapiens
augagguaguagaaagucaggu

SEQ ID NO: 178978 - RNA, 22 nt, Homo sapiens
augaggugaggucaguaaggua

SEQ ID NO: 178979 - RNA, 20 nt, Homo sapiens
augagguguaugacacugaa

SEQ ID NO: 178980 - RNA, 22 nt, Homo sapiens
augagucacuuauuauuggggu

SEQ ID NO: 178981 - RNA, 22 nt, Homo sapiens
augagugugaccugccaagaga

SEQ ID NO: 178982 - RNA, 22 nt, Homo sapiens
augaucacuguggaaauucagc

SEQ ID NO: 178983 - RNA, 22 nt, Homo sapiens
augaucaucugaaagcuuuuac

SEQ ID NO: 178984 - RNA, 22 nt, Homo sapiens
augaugaaguaagugcuuagga

SEQ ID NO: 178985 - RNA, 22 nt, Homo sapiens
augaugcugcaguuguugccaa

SEQ ID NO: 178986 - RNA, 22 nt, Homo sapiens
augauguaggccauggguuucu

SEQ ID NO: 178987 - RNA, 22 nt, Homo sapiens
augauuagaacucauuuccagg

SEQ ID NO: 178988 - RNA, 22 nt, Homo sapiens
augauuuuuguaucgccugaug

SEQ ID NO: 178989 - RNA, 22 nt, Homo sapiens
augcaagacaccgauuagcuuu

SEQ ID NO: 178990 - RNA, 22 nt, Homo sapiens
augcacuguuguuauuggauaa

SEQ ID NO: 178991 - RNA, 22 nt, Homo sapiens
augcagacacaaguuauaguaa

SEQ ID NO: 178992 - RNA, 22 nt, Homo sapiens
augcauaugucuuuauaguggc

SEQ ID NO: 178993 - RNA, 22 nt, Homo sapiens
augcauauuccugggccucacu

SEQ ID NO: 178994 - RNA, 22 nt, Homo sapiens
ugggguagaauagaauugauau

SEQ ID NO: 178995 - RNA, 22 nt, Homo sapiens
ugggguaggccugguuaugugc

SEQ ID NO: 178996 - RNA, 22 nt, Homo sapiens
uggguaggaccagaaaugcacu

SEQ ID NO: 178997 - RNA, 22 nt, Homo sapiens
uggguaguguaaagcacuccag

SEQ ID NO: 178998 - RNA, 22 nt, Homo sapiens
uggguccccuacucuuuccaca

SEQ ID NO: 178999 - RNA, 22 nt, Homo sapiens
ugggugaguaucuauuauucag

SEQ ID NO: 179000 - RNA, 22 nt, Homo sapiens
ugguagguuuauaaagaauuua

SEQ ID NO: 179001 - RNA, 22 nt, Homo sapiens
ugguaucauuuuaucugcucua

SEQ ID NO: 179002 - RNA, 22 nt, Homo sapiens
ugguauuuaauauaugagaguu

SEQ ID NO: 179003 - RNA, 20 nt, Homo sapiens
uggucaccuucaggagguuc

SEQ ID NO: 179004 - RNA, 22 nt, Homo sapiens
uggucaccuucuugcucugucu

SEQ ID NO: 179005 - RNA, 22 nt, Homo sapiens
uggucagaugcugaguggaucu

SEQ ID NO: 179006 - RNA, 19 nt, Homo sapiens
uggucaguucugggagcug

SEQ ID NO: 179007 - RNA, 22 nt, Homo sapiens
uggucauggaaauagaaugcac

SEQ ID NO: 179008 - RNA, 21 nt, Homo sapiens
uggucccauaagauuacaaug

SEQ ID NO: 179009 - RNA, 22 nt, Homo sapiens
ugguccccaauacuucuauaga

SEQ ID NO: 179010 - RNA, 21 nt, Homo sapiens
uggucccuucagaucggauuu

SEQ ID NO: 179011 - RNA, 22 nt, Homo sapiens
uggucuucuggccuccagaacc

SEQ ID NO: 179012 - RNA, 22 nt, Homo sapiens
ugguuagucuguguguauauau

SEQ ID NO: 179013 - RNA, 21 nt, Homo sapiens
ugguucaguucguuacgugug

SEQ ID NO: 179014 - RNA, 22 nt, Homo sapiens
ugguuguuuuaaaugucgucug

SEQ ID NO: 179015 - RNA, 23 nt, Homo sapiens
ugguuuguaagagauggacugga

SEQ ID NO: 179016 - RNA, 23 nt, Homo sapiens
uguaaaagcauuugucagccugg

SEQ ID NO: 179017 - RNA, 22 nt, Homo sapiens
uguaaaucuauuuuuaguguuu

SEQ ID NO: 179018 - RNA, 22 nt, Homo sapiens
uguaaaucuuucacaguugaug

SEQ ID NO: 179019 - RNA, 22 nt, Homo sapiens
uguacaaauuucugugguggug

SEQ ID NO: 179020 - RNA, 22 nt, Homo sapiens
uguacacauaugugggguacau

SEQ ID NO: 179021 - RNA, 22 nt, Homo sapiens
uguagauaucuaucaggucaau

SEQ ID NO: 179022 - RNA, 22 nt, Homo sapiens
uguagauauucuuucaguuuuu

SEQ ID NO: 179023 - RNA, 21 nt, Homo sapiens
uguagcagcaugauucauagu

SEQ ID NO: 179024 - RNA, 22 nt, Homo sapiens
uguagggagagggaguugcacc

SEQ ID NO: 179025 - RNA, 20 nt, Homo sapiens
uguagguguacaguaaggag

SEQ ID NO: 179026 - RNA, 22 nt, Homo sapiens
uguagguguacauacaugguua

SEQ ID NO: 179027 - RNA, 21 nt, Homo sapiens
uguauacauggaagaaugguc

SEQ ID NO: 179028 - RNA, 22 nt, Homo sapiens
uguauaggcaaauuuccucaug

SEQ ID NO: 179029 - RNA, 22 nt, Homo sapiens
uguaugagagacauggcugcuu

SEQ ID NO: 179030 - RNA, 22 nt, Homo sapiens
uguaugagagugaaagcauuuc

SEQ ID NO: 179031 - RNA, 22 nt, Homo sapiens
uguaugucugcucuuuggaacu

SEQ ID NO: 179032 - RNA, 22 nt, Homo sapiens
uguauguugggucaaaguacau

SEQ ID NO: 179033 - RNA, 22 nt, Homo sapiens
ugucaacauuuaucaaguuauu

SEQ ID NO: 179034 - RNA, 20 nt, Homo sapiens
ugucaagaaacauuacuuau

SEQ ID NO: 179035 - RNA, 22 nt, Homo sapiens
ugucaagaaaucaaggugugag

SEQ ID NO: 179036 - RNA, 22 nt, Homo sapiens
ugucaagaugguuugauguugu

SEQ ID NO: 179037 - RNA, 22 nt, Homo sapiens
ugucaaggaaugucauugguuu

SEQ ID NO: 179038 - RNA, 22 nt, Homo sapiens
ugucacaguuuguacuuuauag

SEQ ID NO: 179039 - RNA, 22 nt, Homo sapiens
ugucagaaucuagaggcugcua

SEQ ID NO: 179040 - RNA, 18 nt, Homo sapiens
ugucagaguggauuguaa

SEQ ID NO: 179041 - RNA, 22 nt, Homo sapiens
ugucaggaguuuuagaaucuua

SEQ ID NO: 179042 - RNA, 22 nt, Homo sapiens
ugucaguggucuggaugcagcc

SEQ ID NO: 179043 - RNA, 22 nt, Homo sapiens
ugucaguuucuugagauggaac

SEQ ID NO: 179044 - RNA, 22 nt, Homo sapiens
ugucaguuuuaacuagggaaua

SEQ ID NO: 179045 - RNA, 19 nt, Homo sapiens
ugucaucaucuuuucuugc

SEQ ID NO: 179046 - RNA, 22 nt, Homo sapiens
ugucaucuagguauuaagcccc

SEQ ID NO: 179047 - RNA, 22 nt, Homo sapiens
ugucaugagucuccuccaucuu

SEQ ID NO: 179048 - RNA, 22 nt, Homo sapiens
ugucauguaaagaguaaauggu

SEQ ID NO: 179049 - RNA, 22 nt, Homo sapiens
uguccaguguuccucagaagaa

SEQ ID NO: 179050 - RNA, 22 nt, Homo sapiens
ugucccguuuucgaggcugcag

SEQ ID NO: 179051 - RNA, 22 nt, Homo sapiens
uguccuagagggaugucacccc

SEQ ID NO: 179052 - RNA, 22 nt, Homo sapiens
uguccugcagagguguuugccu

SEQ ID NO: 179053 - RNA, 21 nt, Homo sapiens
ugucgugcaggaucuguggga

SEQ ID NO: 179054 - RNA, 22 nt, Homo sapiens
ugucuagaaaagccugccuucu

SEQ ID NO: 179055 - RNA, 16 nt, Homo sapiens
ugucuguuugggcaca

SEQ ID NO: 179056 - RNA, 22 nt, Homo sapiens
ugucuuugguucaggcaaggag

SEQ ID NO: 179057 - RNA, 22 nt, Homo sapiens
ugucuuuguuaguuguccuagu

SEQ ID NO: 179058 - RNA, 22 nt, Homo sapiens
ugugaaaucagauagccuuuuu

SEQ ID NO: 179059 - RNA, 22 nt, Homo sapiens
ugugaacagcagcugggcuuug

SEQ ID NO: 179060 - RNA, 20 nt, Homo sapiens
ugugaacuguagauagucuu

SEQ ID NO: 179061 - RNA, 22 nt, Homo sapiens
ugugaauguaagaaaauccaac

SEQ ID NO: 179062 - RNA, 22 nt, Homo sapiens
ugugacacugaauggcagaacu

SEQ ID NO: 179063 - RNA, 23 nt, Homo sapiens
ugugacacuuccgucaguucauu

SEQ ID NO: 179064 - RNA, 22 nt, Homo sapiens
ugugacagguauccuguguucu

SEQ ID NO: 179065 - RNA, 22 nt, Homo sapiens
ugugaccaaaaucaacauaccu

SEQ ID NO: 179066 - RNA, 19 nt, Homo sapiens
ugugacugggccagccuag

SEQ ID NO: 179067 - RNA, 19 nt, Homo sapiens
ugugacugguugucucgcu

SEQ ID NO: 179068 - RNA, 21 nt, Homo sapiens
ugugacuguugcauuugucgu

SEQ ID NO: 179069 - RNA, 22 nt, Homo sapiens
ugugagaaaugcagaaucucag

SEQ ID NO: 179070 - RNA, 22 nt, Homo sapiens
ugugagcuauggaguuguagag

SEQ ID NO: 179071 - RNA, 22 nt, Homo sapiens
ugugaucauuucaggaauuuug

SEQ ID NO: 179072 - RNA, 22 nt, Homo sapiens
ugugaugaagaguccaagaaca

SEQ ID NO: 179073 - RNA, 22 nt, Homo sapiens
ugugaugaaggcauagggaugu

SEQ ID NO: 179074 - RNA, 22 nt, Homo sapiens
ugugauggaguuucauggacug

SEQ ID NO: 179075 - RNA, 22 nt, Homo sapiens
ugugaugguuuagcauuuucuu

SEQ ID NO: 179076 - RNA, 22 nt, Homo sapiens
ugugcaaaaacaauugcgguuu

SEQ ID NO: 179077 - RNA, 22 nt, Homo sapiens
ugugcaaggcucucaaccugug

SEQ ID NO: 179078 - RNA, 18 nt, Homo sapiens
ugugcaauauuaaccacc

SEQ ID NO: 179079 - RNA, 22 nt, Homo sapiens
ugugcacaaccugcagguuugu

SEQ ID NO: 179080 - RNA, 22 nt, Homo sapiens
ugugcacauaacauuuuuuuag

SEQ ID NO: 179081 - RNA, 22 nt, Homo sapiens
ugugcaccucuucacacaggga

SEQ ID NO: 179082 - RNA, 22 nt, Homo sapiens
ugugcacuggaccuugucuucu

SEQ ID NO: 179083 - RNA, 22 nt, Homo sapiens
ugugcaguuuugagugaauuuc

SEQ ID NO: 179084 - RNA, 22 nt, Homo sapiens
ugugcaugacagcauacaaacg

SEQ ID NO: 179085 - RNA, 22 nt, Homo sapiens
ugugccaaaucccauaauaaau

SEQ ID NO: 179086 - RNA, 22 nt, Homo sapiens
ugugccacuccaaccuggguga

SEQ ID NO: 179087 - RNA, 22 nt, Homo sapiens
ugugccacugcacucuggccug

SEQ ID NO: 179088 - RNA, 22 nt, Homo sapiens
ugugcucaucucagucaacugu

SEQ ID NO: 179089 - RNA, 22 nt, Homo sapiens
uguggaaauggugcuacgaaca

SEQ ID NO: 179090 - RNA, 22 nt, Homo sapiens
uguggcacuguguccagagaaa

SEQ ID NO: 179091 - RNA, 18 nt, Homo sapiens
uguggcuguuuuccaaua

SEQ ID NO: 179092 - RNA, 22 nt, Homo sapiens
uguggcuuuuucuuggcugagg

SEQ ID NO: 179093 - RNA, 22 nt, Homo sapiens
ugugggaggugcuaauguaaau

SEQ ID NO: 179094 - RNA, 22 nt, Homo sapiens
ugugguagugcuuaccugcagu

SEQ ID NO: 179095 - RNA, 22 nt, Homo sapiens
uguguaaauauauacacacgug

SEQ ID NO: 179096 - RNA, 22 nt, Homo sapiens
ugugucacugcacuccagccug

SEQ ID NO: 179097 - RNA, 22 nt, Homo sapiens
ugugucuugcuggugccugcau

SEQ ID NO: 179098 - RNA, 22 nt, Homo sapiens
ugugucuuguuuauagcuuucu

SEQ ID NO: 179099 - RNA, 22 nt, Homo sapiens
uguguuugauaaguccauaguu

SEQ ID NO: 179100 - RNA, 22 nt, Homo sapiens
uguguuuuuauguaaaauggaa

SEQ ID NO: 179101 - RNA, 22 nt, Homo sapiens
uguuaacauuuuagagugggaa

SEQ ID NO: 179102 - RNA, 22 nt, Homo sapiens
uguuacacugugcacuaaauuu

SEQ ID NO: 179103 - RNA, 20 nt, Homo sapiens
uguugcacucuagccugggu

SEQ ID NO: 179104 - RNA, 22 nt, Homo sapiens
auugccucaauuccaagacugc

SEQ ID NO: 179105 - RNA, 22 nt, Homo sapiens
auugcuaauaugcuucaggcaa

SEQ ID NO: 179106 - RNA, 22 nt, Homo sapiens
auugcucaaaucaguacuugag

SEQ ID NO: 179107 - RNA, 22 nt, Homo sapiens
auugcuucugauuuuaaaugag

SEQ ID NO: 179108 - RNA, 22 nt, Homo sapiens
auugcuuuuacugggagcuuug

SEQ ID NO: 179109 - RNA, 22 nt, Homo sapiens
auuggcagaaaucuuuauagua

SEQ ID NO: 179110 - RNA, 22 nt, Homo sapiens
auuggcuuuauacauaagaaua

SEQ ID NO: 179111 - RNA, 22 nt, Homo sapiens
auuggcuuuugaaagucugcga

SEQ ID NO: 179112 - RNA, 22 nt, Homo sapiens
auuggguuaaaggauaugaaca

SEQ ID NO: 179113 - RNA, 22 nt, Homo sapiens
auuguacauacaccggugugua

SEQ ID NO: 179114 - RNA, 22 nt, Homo sapiens
auuguaccccaauguacaauau

SEQ ID NO: 179115 - RNA, 22 nt, Homo sapiens
auuguacuccagccugggcaag

SEQ ID NO: 179116 - RNA, 22 nt, Homo sapiens
auuguacuccagccugggugac

SEQ ID NO: 179117 - RNA, 22 nt, Homo sapiens
auuguacugccccccuguugcu

SEQ ID NO: 179118 - RNA, 22 nt, Homo sapiens
auugucacugugcuccaccagu

SEQ ID NO: 179119 - RNA, 22 nt, Homo sapiens
auugucacuuaaaagugcaugu

SEQ ID NO: 179120 - RNA, 22 nt, Homo sapiens
auuguguuugaaugaggcucca

SEQ ID NO: 179121 - RNA, 22 nt, Homo sapiens
auuuaacuggucuaggggccca

SEQ ID NO: 179122 - RNA, 22 nt, Homo sapiens
auuucuacuccuguguccagaa

SEQ ID NO: 179123 - RNA, 22 nt, Homo sapiens
auuuggcaguauaaugcuuugg

SEQ ID NO: 179124 - RNA, 22 nt, Homo sapiens
auuuuugguugucagcacuagg

SEQ ID NO: 179125 - RNA, 22 nt, Homo sapiens
caaagcuauagcaccagaggga

SEQ ID NO: 179126 - RNA, 22 nt, Homo sapiens
caaaguaauuacgguuuuggcc

SEQ ID NO: 179127 - RNA, 22 nt, Homo sapiens
caaaguaauugugguuuugcca

SEQ ID NO: 179128 - RNA, 22 nt, Homo sapiens
caaagucuauucuacccuuacc

SEQ ID NO: 179129 - RNA, 22 nt, Homo sapiens
caaagugcugggaugggccagg

SEQ ID NO: 179130 - RNA, 22 nt, Homo sapiens
caaaugcuucuauggacugucu

SEQ ID NO: 179131 - RNA, 22 nt, Homo sapiens
caaauugcuugucuguagugga

SEQ ID NO: 179132 - RNA, 22 nt, Homo sapiens
caacacuguuuauuggauagcc

SEQ ID NO: 179133 - RNA, 22 nt, Homo sapiens
caagagaccugagugucauucu

SEQ ID NO: 179134 - RNA, 22 nt, Homo sapiens
caaggcacagccccuacuuccu

SEQ ID NO: 179135 - RNA, 22 nt, Homo sapiens
caaguacugggcuauggauauu

SEQ ID NO: 179136 - RNA, 22 nt, Homo sapiens
caagugcuuucuuggggauuua

SEQ ID NO: 179137 - RNA, 22 nt, Homo sapiens
caaguguuggcuuguauacaaa

SEQ ID NO: 179138 - RNA, 23 nt, Homo sapiens
caauacugaccucacguuaauag

SEQ ID NO: 179139 - RNA, 22 nt, Homo sapiens
caaugcagcuuuuggagagaaa

SEQ ID NO: 179140 - RNA, 22 nt, Homo sapiens
caauugguguuuauggggaagu

SEQ ID NO: 179141 - RNA, 22 nt, Homo sapiens
cacaaugucuaagauguuucua

SEQ ID NO: 179142 - RNA, 22 nt, Homo sapiens
cacacugucuucaauggguggu

SEQ ID NO: 179143 - RNA, 22 nt, Homo sapiens
cacagaauucauuggauuaccu

SEQ ID NO: 179144 - RNA, 22 nt, Homo sapiens
cacaggccugucucuuucuaac

SEQ ID NO: 179145 - RNA, 22 nt, Homo sapiens
cacaguagaauagagcacuagg

SEQ ID NO: 179146 - RNA, 22 nt, Homo sapiens
cacauagucccugcuaaucuuc

SEQ ID NO: 179147 - RNA, 16 nt, Homo sapiens
cacauugcugcauggc

SEQ ID NO: 179148 - RNA, 22 nt, Homo sapiens
caccaaccucaguagcaucugu

SEQ ID NO: 179149 - RNA, 22 nt, Homo sapiens
caccacauuccauugaucaggc

SEQ ID NO: 179150 - RNA, 22 nt, Homo sapiens
caccacuacaccccaggcuggg

SEQ ID NO: 179151 - RNA, 22 nt, Homo sapiens
caccagguuggagugcaguggu

SEQ ID NO: 179152 - RNA, 19 nt, Homo sapiens
caccagugcaugcuacuau

SEQ ID NO: 179153 - RNA, 22 nt, Homo sapiens
caccccuaccugagucaggagu

SEQ ID NO: 179154 - RNA, 22 nt, Homo sapiens
cacccgugcucccuccagcugc

SEQ ID NO: 179155 - RNA, 22 nt, Homo sapiens
cacccuugcagggacagcuuug

SEQ ID NO: 179156 - RNA, 22 nt, Homo sapiens
caccuguacauggcaguguccu

SEQ ID NO: 179157 - RNA, 22 nt, Homo sapiens
cacuaggcuggagugcaguggc

SEQ ID NO: 179158 - RNA, 22 nt, Homo sapiens
cacugcacuccagucugacgac

SEQ ID NO: 179159 - RNA, 22 nt, Homo sapiens
cacugcacuccaguuuggauga

SEQ ID NO: 179160 - RNA, 22 nt, Homo sapiens
cacugcaguggaagauuaagaa

SEQ ID NO: 179161 - RNA, 21 nt, Homo sapiens
cacugcaucacaggacagcau

SEQ ID NO: 179162 - RNA, 22 nt, Homo sapiens
cacugcauucuccaccucccag

SEQ ID NO: 179163 - RNA, 22 nt, Homo sapiens
cacugcgaccucugccuaccgg

SEQ ID NO: 179164 - RNA, 23 nt, Homo sapiens
cacugggcagcagguguucccag

SEQ ID NO: 179165 - RNA, 22 nt, Homo sapiens
cacuggguuagaacaugcuccu

SEQ ID NO: 179166 - RNA, 22 nt, Homo sapiens
cacuggucucauggcaugagag

SEQ ID NO: 179167 - RNA, 22 nt, Homo sapiens
cacugugcaaccuccaccuccc

SEQ ID NO: 179168 - RNA, 22 nt, Homo sapiens
cacuuugguucaccugaguuuc

SEQ ID NO: 179169 - RNA, 22 nt, Homo sapiens
cagacaugucuuguggccgugg

SEQ ID NO: 179170 - RNA, 22 nt, Homo sapiens
cagagaucaugcaacugcucgc

SEQ ID NO: 179171 - RNA, 22 nt, Homo sapiens
cagagguauugcaaaagccuag

SEQ ID NO: 179172 - RNA, 22 nt, Homo sapiens
cagcaaaucauccuauuugagc

SEQ ID NO: 179173 - RNA, 22 nt, Homo sapiens
cagcaguuguuucggauuggga

SEQ ID NO: 179174 - RNA, 22 nt, Homo sapiens
cagccgggugagguggcuuguu

SEQ ID NO: 179175 - RNA, 22 nt, Homo sapiens
cagccggguggcuccuagggua

SEQ ID NO: 179176 - RNA, 20 nt, Homo sapiens
cagcuagugguaggagucgg

SEQ ID NO: 179177 - RNA, 22 nt, Homo sapiens
cagcugcuuuggaaaauauuuu

SEQ ID NO: 179178 - RNA, 22 nt, Homo sapiens
cagcuggugcugcaccaguggg

SEQ ID NO: 179179 - RNA, 22 nt, Homo sapiens
cagcugguggcaagaagacaga

SEQ ID NO: 179180 - RNA, 22 nt, Homo sapiens
cagcugguguuacaaaccagag

SEQ ID NO: 179181 - RNA, 22 nt, Homo sapiens
cagcuguguuauaaacuaccau

SEQ ID NO: 179182 - RNA, 22 nt, Homo sapiens
caggcagucuggggguguaucc

SEQ ID NO: 179183 - RNA, 22 nt, Homo sapiens
caggcauagucuugaguuuuau

SEQ ID NO: 179184 - RNA, 22 nt, Homo sapiens
caggcauuguccaugcugaagg

SEQ ID NO: 179185 - RNA, 22 nt, Homo sapiens
caggugguauuugguuuucugu

SEQ ID NO: 179186 - RNA, 22 nt, Homo sapiens
caguacaauguggaaaaggagu

SEQ ID NO: 179187 - RNA, 20 nt, Homo sapiens
cagucauagacaucagaguc

SEQ ID NO: 179188 - RNA, 22 nt, Homo sapiens
cagugcaaccuccaucucucgg

SEQ ID NO: 179189 - RNA, 18 nt, Homo sapiens
cagugcaauacaggagag

SEQ ID NO: 179190 - RNA, 23 nt, Homo sapiens
cagugcauuguggcauucagcau

SEQ ID NO: 179191 - RNA, 22 nt, Homo sapiens
cagugcuuguuauuguucuauu

SEQ ID NO: 179192 - RNA, 22 nt, Homo sapiens
cagugcuuuaucaaguccucca

SEQ ID NO: 179193 - RNA, 22 nt, Homo sapiens
caguggacuaaauggggaauau

SEQ ID NO: 179194 - RNA, 23 nt, Homo sapiens
cagugguguuagagaaaucuuuu

SEQ ID NO: 179195 - RNA, 22 nt, Homo sapiens
cagugucugcauuuggaacuca

SEQ ID NO: 179196 - RNA, 22 nt, Homo sapiens
caguguuuuuaacaggugcccg

SEQ ID NO: 179197 - RNA, 22 nt, Homo sapiens
cauacaugugcuugucuuaugc

SEQ ID NO: 179198 - RNA, 18 nt, Homo sapiens
cauagcacuucagcacau

SEQ ID NO: 179199 - RNA, 21 nt, Homo sapiens
caucaaauugucauggugggu

SEQ ID NO: 179200 - RNA, 22 nt, Homo sapiens
auugcaccccagccugggugac

SEQ ID NO: 179201 - RNA, 22 nt, Homo sapiens
auugcacuccagccuggcaaua

SEQ ID NO: 179202 - RNA, 22 nt, Homo sapiens
auugcacuccagccuggccaac

SEQ ID NO: 179203 - RNA, 22 nt, Homo sapiens
auugcacuccagccugggggac

SEQ ID NO: 179204 - RNA, 22 nt, Homo sapiens
auugcacuccagccugggugac

SEQ ID NO: 179205 - RNA, 22 nt, Homo sapiens
auugcacuccagcuuaggcgac

SEQ ID NO: 179206 - RNA, 22 nt, Homo sapiens
auugcacucuagccugggugac

SEQ ID NO: 179207 - RNA, 22 nt, Homo sapiens
auugcacucuagccuuggcgac

SEQ ID NO: 179208 - RNA, 22 nt, Homo sapiens
auugcacugcagccugggcaac

SEQ ID NO: 179209 - RNA, 22 nt, Homo sapiens
auugcagaaaugacagagcgcc

SEQ ID NO: 179210 - RNA, 23 nt, Homo sapiens
auugcagaaucacagagguagug

SEQ ID NO: 179211 - RNA, 22 nt, Homo sapiens
auugcagcccacccugggugau

SEQ ID NO: 179212 - RNA, 23 nt, Homo sapiens
auugcagucuugaacuccugggc

SEQ ID NO: 179213 - RNA, 22 nt, Homo sapiens
auugcaguuucaacuccagggc

SEQ ID NO: 179214 - RNA, 18 nt, Homo sapiens
auugcccucauggggcuu

SEQ ID NO: 179215 - RNA, 22 nt, Homo sapiens
uucagagugguaugaagugaug

SEQ ID NO: 179216 - RNA, 22 nt, Homo sapiens
uucagcaaugacagccuauaua

SEQ ID NO: 179217 - RNA, 22 nt, Homo sapiens
uucagcuacuugggaggcugaa

SEQ ID NO: 179218 - RNA, 22 nt, Homo sapiens
uucagggcauuggaguuucuga

SEQ ID NO: 179219 - RNA, 22 nt, Homo sapiens
uucagguacugggggaguaugg

SEQ ID NO: 179220 - RNA, 22 nt, Homo sapiens
uucagguaguuuaacuguucca

SEQ ID NO: 179221 - RNA, 22 nt, Homo sapiens
uucagguaucccuugucuauag

SEQ ID NO: 179222 - RNA, 22 nt, Homo sapiens
uucaguacuucaaaaucuuuaa

SEQ ID NO: 179223 - RNA, 22 nt, Homo sapiens
uucaguagucuccauagaaccg

SEQ ID NO: 179224 - RNA, 22 nt, Homo sapiens
uucaguauugcaccuggagucc

SEQ ID NO: 179225 - RNA, 22 nt, Homo sapiens
uucagugccuggaagucgugcu

SEQ ID NO: 179226 - RNA, 22 nt, Homo sapiens
uucaguugcaucaguugaccag

SEQ ID NO: 179227 - RNA, 18 nt, Homo sapiens
uucauaguagcaugauuu

SEQ ID NO: 179228 - RNA, 22 nt, Homo sapiens
uucauagucacauucgaugucu

SEQ ID NO: 179229 - RNA, 22 nt, Homo sapiens
uucauaguguuuccuuccagug

SEQ ID NO: 179230 - RNA, 22 nt, Homo sapiens
uucaucagggagaaauaauuuc

SEQ ID NO: 179231 - RNA, 22 nt, Homo sapiens
uucaucagggguauuggccaau

SEQ ID NO: 179232 - RNA, 18 nt, Homo sapiens
uucaucaguccucagcug

SEQ ID NO: 179233 - RNA, 22 nt, Homo sapiens
uucaucaguugagcugguugcu

SEQ ID NO: 179234 - RNA, 22 nt, Homo sapiens
uucauggaauauugaccauuuu

SEQ ID NO: 179235 - RNA, 22 nt, Homo sapiens
uucauguagucaucauccugcu

SEQ ID NO: 179236 - RNA, 22 nt, Homo sapiens
uucaugucuuggcuguuagagu

SEQ ID NO: 179237 - RNA, 22 nt, Homo sapiens
uucaugugagucuguauuaacu

SEQ ID NO: 179238 - RNA, 22 nt, Homo sapiens
uuccacaaugguugaacuaauu

SEQ ID NO: 179239 - RNA, 22 nt, Homo sapiens
uuccacaaugguugaacuagcu

SEQ ID NO: 179240 - RNA, 22 nt, Homo sapiens
uuccacuuuuuccuugugcucc

SEQ ID NO: 179241 - RNA, 22 nt, Homo sapiens
uuccaguggacuacuucauccu

SEQ ID NO: 179242 - RNA, 22 nt, Homo sapiens
uuccaguggaguaaauggacaa

SEQ ID NO: 179243 - RNA, 22 nt, Homo sapiens
uuccaguuauuauaccucuuaa

SEQ ID NO: 179244 - RNA, 22 nt, Homo sapiens
uuccauguugauacgugaaguu

SEQ ID NO: 179245 - RNA, 22 nt, Homo sapiens
uucccagagccugggagugagg

SEQ ID NO: 179246 - RNA, 22 nt, Homo sapiens
uucccagugccaggcacuggga

SEQ ID NO: 179247 - RNA, 22 nt, Homo sapiens
uucccugaaauauucacuuuca

SEQ ID NO: 179248 - RNA, 22 nt, Homo sapiens
uucccugaguaucuuaccaugg

SEQ ID NO: 179249 - RNA, 22 nt, Homo sapiens
uucccugugggcuggugcucca

SEQ ID NO: 179250 - RNA, 23 nt, Homo sapiens
uucccuuagaagaaggggagaaa

SEQ ID NO: 179251 - RNA, 22 nt, Homo sapiens
uuccguguaguugagcaguuuu

SEQ ID NO: 179252 - RNA, 22 nt, Homo sapiens
uuccugagaucagaauucaaau

SEQ ID NO: 179253 - RNA, 22 nt, Homo sapiens
uuccugugacccccaagcccac

SEQ ID NO: 179254 - RNA, 22 nt, Homo sapiens
uuccugugacuguguggcaccc

SEQ ID NO: 179255 - RNA, 22 nt, Homo sapiens
uucuaaacaucuuacaaugcau

SEQ ID NO: 179256 - RNA, 20 nt, Homo sapiens
uucuacagucacaggaagau

SEQ ID NO: 179257 - RNA, 22 nt, Homo sapiens
uucuagcaauggcagagugucu

SEQ ID NO: 179258 - RNA, 23 nt, Homo sapiens
uucuaucaggcccaggagcccug

SEQ ID NO: 179259 - RNA, 22 nt, Homo sapiens
uucuauggucacagaugcuuga

SEQ ID NO: 179260 - RNA, 22 nt, Homo sapiens
uucucaauggcaacuuguugcu

SEQ ID NO: 179261 - RNA, 22 nt, Homo sapiens
uucucacaguacagggagcucu

SEQ ID NO: 179262 - RNA, 22 nt, Homo sapiens
uucucagugaaguuuagaacau

SEQ ID NO: 179263 - RNA, 22 nt, Homo sapiens
uucuccugguggacccuaaacg

SEQ ID NO: 179264 - RNA, 22 nt, Homo sapiens
uucucuguggauugggugagag

SEQ ID NO: 179265 - RNA, 22 nt, Homo sapiens
uucugauggaguaguccacaga

SEQ ID NO: 179266 - RNA, 22 nt, Homo sapiens
uucuggcuuauaaacgugacuu

SEQ ID NO: 179267 - RNA, 22 nt, Homo sapiens
uucugugcugaaucaaagacug

SEQ ID NO: 179268 - RNA, 22 nt, Homo sapiens
uucugugcuuguggaugaagug

SEQ ID NO: 179269 - RNA, 22 nt, Homo sapiens
uucugugguugaaaggagagau

SEQ ID NO: 179270 - RNA, 22 nt, Homo sapiens
uucuguguuuaggucacggcua

SEQ ID NO: 179271 - RNA, 22 nt, Homo sapiens
uucuuaguggcaccacuuuuuu

SEQ ID NO: 179272 - RNA, 22 nt, Homo sapiens
uucuucugguuaugaaauuuga

SEQ ID NO: 179273 - RNA, 20 nt, Homo sapiens
uucuugaguuaacaaguuac

SEQ ID NO: 179274 - RNA, 22 nt, Homo sapiens
uucuugcugaauugugcccuuc

SEQ ID NO: 179275 - RNA, 22 nt, Homo sapiens
uucuugcuguauccucacaugg

SEQ ID NO: 179276 - RNA, 18 nt, Homo sapiens
uucuuguguugauauuuu

SEQ ID NO: 179277 - RNA, 22 nt, Homo sapiens
uugaaagacagaggggcaaguu

SEQ ID NO: 179278 - RNA, 22 nt, Homo sapiens
uugaaagcuaucucaaaucgcu

SEQ ID NO: 179279 - RNA, 22 nt, Homo sapiens
uugaaagucauggcacaggcaa

SEQ ID NO: 179280 - RNA, 22 nt, Homo sapiens
uugaacuguaagggucugugug

SEQ ID NO: 179281 - RNA, 22 nt, Homo sapiens
uugaagacuaaguuaucaggau

SEQ ID NO: 179282 - RNA, 22 nt, Homo sapiens
uugaagguaggaugugcuauca

SEQ ID NO: 179283 - RNA, 22 nt, Homo sapiens
uugaaguaguacuuuauuauag

SEQ ID NO: 179284 - RNA, 22 nt, Homo sapiens
uugaaguguguauacauugugg

SEQ ID NO: 179285 - RNA, 22 nt, Homo sapiens
uugaauagaagguuuuuuguuc

SEQ ID NO: 179286 - RNA, 18 nt, Homo sapiens
uugaauagagccaagcac

SEQ ID NO: 179287 - RNA, 22 nt, Homo sapiens
uugaauagugacuuugauucug

SEQ ID NO: 179288 - RNA, 22 nt, Homo sapiens
uugaauaguggugaaaguuuga

SEQ ID NO: 179289 - RNA, 18 nt, Homo sapiens
uugaaugcgucccagaga

SEQ ID NO: 179290 - RNA, 23 nt, Homo sapiens
uugaauguuuccccucccaaauu

SEQ ID NO: 179291 - RNA, 22 nt, Homo sapiens
uugacaaguuguccaguaugag

SEQ ID NO: 179292 - RNA, 22 nt, Homo sapiens
uugacagagaaaagugugacuu

SEQ ID NO: 179293 - RNA, 22 nt, Homo sapiens
uugacaguugggcagggaaguu

SEQ ID NO: 179294 - RNA, 22 nt, Homo sapiens
uugacauauguguguccacaua

SEQ ID NO: 179295 - RNA, 22 nt, Homo sapiens
uugacuccagagugaguaaaug

SEQ ID NO: 179296 - RNA, 22 nt, Homo sapiens
uugacugggccagacagagauc

SEQ ID NO: 179297 - RNA, 22 nt, Homo sapiens
uugacuguaagauggcuauuac

SEQ ID NO: 179298 - RNA, 22 nt, Homo sapiens
uugagaaucuuucgaauguucu

SEQ ID NO: 179299 - RNA, 22 nt, Homo sapiens
uugagacgaagucucacucuug

SEQ ID NO: 179300 - RNA, 22 nt, Homo sapiens
uugagacggagucuugcucuuu

SEQ ID NO: 179301 - RNA, 17 nt, Homo sapiens
uugagaguauaucuuac

SEQ ID NO: 179302 - RNA, 22 nt, Homo sapiens
uugagaguggaggcuauaucuu

SEQ ID NO: 179303 - RNA, 22 nt, Homo sapiens
uugagauacauaauuaugaaug

SEQ ID NO: 179304 - RNA, 22 nt, Homo sapiens
uugagauaggaacucacuaugc

SEQ ID NO: 179305 - RNA, 22 nt, Homo sapiens
uugagauaucuuggccuuugca

SEQ ID NO: 179306 - RNA, 22 nt, Homo sapiens
uugagauggagucucacucugu

SEQ ID NO: 179307 - RNA, 22 nt, Homo sapiens
uugagauggagucucacucuuc

SEQ ID NO: 179308 - RNA, 22 nt, Homo sapiens
uugagauggagucucacucuug

SEQ ID NO: 179309 - RNA, 22 nt, Homo sapiens
augcauggucugaagucaaccu

SEQ ID NO: 179310 - RNA, 22 nt, Homo sapiens
augcaugucaaauuuguagguu

SEQ ID NO: 179311 - RNA, 19 nt, Homo sapiens
augccacagugaggucaga

SEQ ID NO: 179312 - RNA, 22 nt, Homo sapiens
augccacugcacucuagccugg

SEQ ID NO: 179313 - RNA, 22 nt, Homo sapiens
augccacugcacuucagccugg

SEQ ID NO: 179314 - RNA, 22 nt, Homo sapiens
augccacugcgcucuagccugg

SEQ ID NO: 179315 - RNA, 22 nt, Homo sapiens
augccacuucucuaagucaugu

SEQ ID NO: 179316 - RNA, 22 nt, Homo sapiens
augccauugcacuccagccugg

SEQ ID NO: 179317 - RNA, 19 nt, Homo sapiens
augccuggagaugguuaua

SEQ ID NO: 179318 - RNA, 22 nt, Homo sapiens
augcuacauucuacaauuaggc

SEQ ID NO: 179319 - RNA, 22 nt, Homo sapiens
augcuacugaccccuacuuaca

SEQ ID NO: 179320 - RNA, 22 nt, Homo sapiens
augcuguuuugaauucucuaga

SEQ ID NO: 179321 - RNA, 22 nt, Homo sapiens
augcuuguguuggggcagugga

SEQ ID NO: 179322 - RNA, 22 nt, Homo sapiens
auggaaacauaagaguauagau

SEQ ID NO: 179323 - RNA, 22 nt, Homo sapiens
auggaaaugaagggcuggcccu

SEQ ID NO: 179324 - RNA, 22 nt, Homo sapiens
auggaacauuauagauguaaaa

SEQ ID NO: 179325 - RNA, 22 nt, Homo sapiens
auggaacugaagugcugcccuu

SEQ ID NO: 179326 - RNA, 22 nt, Homo sapiens
auggaacuggagaucauuaugu

SEQ ID NO: 179327 - RNA, 22 nt, Homo sapiens
auggaacuggagaugguuauau

SEQ ID NO: 179328 - RNA, 18 nt, Homo sapiens
uguugguguucacucacu

SEQ ID NO: 179329 - RNA, 22 nt, Homo sapiens
uuaaagccauaccugagagagu

SEQ ID NO: 179330 - RNA, 22 nt, Homo sapiens
uuaaaguaauugaaauggccuu

SEQ ID NO: 179331 - RNA, 22 nt, Homo sapiens
uuaaagugaucauaaggauagu

SEQ ID NO: 179332 - RNA, 22 nt, Homo sapiens
uuaaagugcacacgggucaggc

SEQ ID NO: 179333 - RNA, 22 nt, Homo sapiens
uuaaagugcuguuuuugccggg

SEQ ID NO: 179334 - RNA, 22 nt, Homo sapiens
uuaaaugcacauacuugagaaa

SEQ ID NO: 179335 - RNA, 22 nt, Homo sapiens
uuaagacaccaaucauuggauu

SEQ ID NO: 179336 - RNA, 22 nt, Homo sapiens
uuaagaucagugcaaacuggag

SEQ ID NO: 179337 - RNA, 22 nt, Homo sapiens
uuaagaugcauuuugaaguuaa

SEQ ID NO: 179338 - RNA, 22 nt, Homo sapiens
uuaagcaguaguuaaggagagg

SEQ ID NO: 179339 - RNA, 22 nt, Homo sapiens
uuaaggaaagcauuuaauucag

SEQ ID NO: 179340 - RNA, 22 nt, Homo sapiens
uuaaggaaggagucuuaaaugg

SEQ ID NO: 179341 - RNA, 22 nt, Homo sapiens
uuaaggccugaagcucauaaag

SEQ ID NO: 179342 - RNA, 22 nt, Homo sapiens
uuaaggguuuuagaauuuucca

SEQ ID NO: 179343 - RNA, 22 nt, Homo sapiens
uuaaguagcugggcaugguggu

SEQ ID NO: 179344 - RNA, 22 nt, Homo sapiens
uuaagugcucaguuacucaguu

SEQ ID NO: 179345 - RNA, 20 nt, Homo sapiens
uuaagugcuuucugcuuaga

SEQ ID NO: 179346 - RNA, 22 nt, Homo sapiens
uuaaguuaggcuucagcagucu

SEQ ID NO: 179347 - RNA, 22 nt, Homo sapiens
uuaaguuguagcuacaaauaca

SEQ ID NO: 179348 - RNA, 22 nt, Homo sapiens
uuaauacucuucuaaguagucc

SEQ ID NO: 179349 - RNA, 22 nt, Homo sapiens
uuaauagugacucauuuuccac

SEQ ID NO: 179350 - RNA, 22 nt, Homo sapiens
uuaaucacagcugaacucaaac

SEQ ID NO: 179351 - RNA, 22 nt, Homo sapiens
uuaaucucaggaguuugggacc

SEQ ID NO: 179352 - RNA, 22 nt, Homo sapiens
uuaaucuguucucuguauucua

SEQ ID NO: 179353 - RNA, 22 nt, Homo sapiens
uuaaugcuuuugggauauuucu

SEQ ID NO: 179354 - RNA, 22 nt, Homo sapiens
uuaauggagaguuucauuggug

SEQ ID NO: 179355 - RNA, 22 nt, Homo sapiens
uuaaugugaaucaggaugcauu

SEQ ID NO: 179356 - RNA, 22 nt, Homo sapiens
uuaauuguaucuauagauguca

SEQ ID NO: 179357 - RNA, 21 nt, Homo sapiens
uuacaauggcuccuugaaggu

SEQ ID NO: 179358 - RNA, 22 nt, Homo sapiens
uuacacaguaggucccuaguaa

SEQ ID NO: 179359 - RNA, 22 nt, Homo sapiens
uuacacaguugguaggggcaga

SEQ ID NO: 179360 - RNA, 22 nt, Homo sapiens
uuacagcagugccccacuccca

SEQ ID NO: 179361 - RNA, 22 nt, Homo sapiens
uuacagcugcuccccaucacuc

SEQ ID NO: 179362 - RNA, 17 nt, Homo sapiens
uuacaggugcugagagu

SEQ ID NO: 179363 - RNA, 22 nt, Homo sapiens
uuacagucuuaggcagugcuuu

SEQ ID NO: 179364 - RNA, 22 nt, Homo sapiens
uuacaguguuuguucuguuacu

SEQ ID NO: 179365 - RNA, 22 nt, Homo sapiens
uuacaguugugagccaccaugc

SEQ ID NO: 179366 - RNA, 22 nt, Homo sapiens
uuaccaguggugcuguaaacuu

SEQ ID NO: 179367 - RNA, 22 nt, Homo sapiens
uuacccauuagagaauuuaaga

SEQ ID NO: 179368 - RNA, 22 nt, Homo sapiens
uuacccuuuaacccuuuaaagu

SEQ ID NO: 179369 - RNA, 22 nt, Homo sapiens
uuacuacucucuaugaccaguu

SEQ ID NO: 179370 - RNA, 22 nt, Homo sapiens
uuacuagaacauuuagggaacu

SEQ ID NO: 179371 - RNA, 20 nt, Homo sapiens
uuacuauguaguauuggcuc

SEQ ID NO: 179372 - RNA, 22 nt, Homo sapiens
uuacuauguuucaaagugucuc

SEQ ID NO: 179373 - RNA, 22 nt, Homo sapiens
uuacugcuuaagugauucaaca

SEQ ID NO: 179374 - RNA, 22 nt, Homo sapiens
uuacuugagauggggugucacu

SEQ ID NO: 179375 - RNA, 22 nt, Homo sapiens
uuagaaaguagaaaagcugguu

SEQ ID NO: 179376 - RNA, 22 nt, Homo sapiens
uuagaacaguguuugccucgcu

SEQ ID NO: 179377 - RNA, 22 nt, Homo sapiens
uuagaauggaaaugcgagguua

SEQ ID NO: 179378 - RNA, 19 nt, Homo sapiens
uuagagaucaucugcuuca

SEQ ID NO: 179379 - RNA, 22 nt, Homo sapiens
uuagaguacaggggaaucaagg

SEQ ID NO: 179380 - RNA, 18 nt, Homo sapiens
uuagagugcauuacuuug

SEQ ID NO: 179381 - RNA, 22 nt, Homo sapiens
uuagcaauugauucucauaagc

SEQ ID NO: 179382 - RNA, 22 nt, Homo sapiens
uuagcauccauaggagauuggu

SEQ ID NO: 179383 - RNA, 22 nt, Homo sapiens
uuagcaugucuacuaauuugcu

SEQ ID NO: 179384 - RNA, 22 nt, Homo sapiens
uuagcucaguuggugagagcgu

SEQ ID NO: 179385 - RNA, 22 nt, Homo sapiens
uuaggaucacagaaaauccucu

SEQ ID NO: 179386 - RNA, 21 nt, Homo sapiens
uuaggcagugucagaggugag

SEQ ID NO: 179387 - RNA, 22 nt, Homo sapiens
uuagggaguaaucuaaaaaugg

SEQ ID NO: 179388 - RNA, 22 nt, Homo sapiens
uuaguagcacagaguaucagca

SEQ ID NO: 179389 - RNA, 22 nt, Homo sapiens
uuaguaguagcugcaugucagu

SEQ ID NO: 179390 - RNA, 21 nt, Homo sapiens
uuagugcucaguuugacaaaa

SEQ ID NO: 179391 - RNA, 22 nt, Homo sapiens
uuaguucccucauucuugacuu

SEQ ID NO: 179392 - RNA, 22 nt, Homo sapiens
uuauaacagagacuccugugcu

SEQ ID NO: 179393 - RNA, 22 nt, Homo sapiens
uuauacucgucugaaugauucu

SEQ ID NO: 179394 - RNA, 19 nt, Homo sapiens
uuauacuguauuguuuagg

SEQ ID NO: 179395 - RNA, 22 nt, Homo sapiens
uuauagacacguuguaacaaac

SEQ ID NO: 179396 - RNA, 22 nt, Homo sapiens
uuauagcagugcaggaacagac

SEQ ID NO: 179397 - RNA, 22 nt, Homo sapiens
uuauagcuaacaucugugaaaa

SEQ ID NO: 179398 - RNA, 20 nt, Homo sapiens
uuauagcuacaucuugacug

SEQ ID NO: 179399 - RNA, 21 nt, Homo sapiens
uuauaguggcaugauuuauaa

SEQ ID NO: 179400 - RNA, 22 nt, Homo sapiens
uuaucaaacccuaggagguggu

SEQ ID NO: 179401 - RNA, 22 nt, Homo sapiens
uuaucauagugcaguuuucuga

SEQ ID NO: 179402 - RNA, 22 nt, Homo sapiens
uuaucucaguguuuguaaacaa

SEQ ID NO: 179403 - RNA, 22 nt, Homo sapiens
uuaugacaggcucaggagcccc

SEQ ID NO: 179404 - RNA, 22 nt, Homo sapiens
uuaugcuugugugaauuuuccc

SEQ ID NO: 179405 - RNA, 22 nt, Homo sapiens
uuauggcaaugccccacuccua

SEQ ID NO: 179406 - RNA, 23 nt, Homo sapiens
uuauggcuuuuauuauguugagg

SEQ ID NO: 179407 - RNA, 22 nt, Homo sapiens
uuaugguuuuucugugagaugg

SEQ ID NO: 179408 - RNA, 22 nt, Homo sapiens
uuaugucuuuuguguucagcua

SEQ ID NO: 179409 - RNA, 22 nt, Homo sapiens
uuauuacuccuauuuuguagau

SEQ ID NO: 179410 - RNA, 22 nt, Homo sapiens
uuauucagcaccugcuguguuc

SEQ ID NO: 179411 - RNA, 16 nt, Homo sapiens
uuauugcauucuucuc

SEQ ID NO: 179412 - RNA, 17 nt, Homo sapiens
uuauugcuauaagcuga

SEQ ID NO: 179413 - RNA, 22 nt, Homo sapiens
uuauuguccaaguuucccuuug

SEQ ID NO: 179414 - RNA, 22 nt, Homo sapiens
uuauuugguuauuguaauuggg

SEQ ID NO: 179415 - RNA, 22 nt, Homo sapiens
uuauuugguugcugacuuggaa

SEQ ID NO: 179416 - RNA, 22 nt, Homo sapiens
uucaaaggauagauuaagauca

SEQ ID NO: 179417 - RNA, 23 nt, Homo sapiens
uucaaaggaugcuuuauggaauu

SEQ ID NO: 179418 - RNA, 22 nt, Homo sapiens
uucaaaguuggaggacaaacug

SEQ ID NO: 179419 - RNA, 22 nt, Homo sapiens
uucaaaucuucguuuugccaua

SEQ ID NO: 179420 - RNA, 22 nt, Homo sapiens
uucaagcugggcaaauaagggg

SEQ ID NO: 179421 - RNA, 22 nt, Homo sapiens
uucaaggacuaaggauuuuugg

SEQ ID NO: 179422 - RNA, 22 nt, Homo sapiens
uucaaguaguucucaugccuca

SEQ ID NO: 179423 - RNA, 22 nt, Homo sapiens
uucaagucaacaagcacuugag

SEQ ID NO: 179424 - RNA, 22 nt, Homo sapiens
uucaagugaacaaaaugaggag

SEQ ID NO: 179425 - RNA, 22 nt, Homo sapiens
uucaauaugucauuggcaggca

SEQ ID NO: 179426 - RNA, 22 nt, Homo sapiens
uucacaauuaaaugugguuauu

SEQ ID NO: 179427 - RNA, 22 nt, Homo sapiens
uucacacugggccuacucugug

SEQ ID NO: 179428 - RNA, 22 nt, Homo sapiens
uucacagagagaacucaaacca

SEQ ID NO: 179429 - RNA, 20 nt, Homo sapiens
uucacaggcagcuucuuucu

SEQ ID NO: 179430 - RNA, 22 nt, Homo sapiens
uucacaguguguacaccagggg

SEQ ID NO: 179431 - RNA, 22 nt, Homo sapiens
uucacaugguugccuuuugauc

SEQ ID NO: 179432 - RNA, 21 nt, Homo sapiens
uucaccauggcuccacacucu

SEQ ID NO: 179433 - RNA, 23 nt, Homo sapiens
uucaccguguuggccaggcuggu

SEQ ID NO: 179434 - RNA, 22 nt, Homo sapiens
uucaccuugggucccacuugcu

SEQ ID NO: 179435 - RNA, 22 nt, Homo sapiens
uucacugcacuccagccugggu

SEQ ID NO: 179436 - RNA, 22 nt, Homo sapiens
uucacugcauuucagccugggc

SEQ ID NO: 179437 - RNA, 22 nt, Homo sapiens
uucacugugcuuaaauucugcu

SEQ ID NO: 179438 - RNA, 22 nt, Homo sapiens
cuucuugcuguguccucacaug

SEQ ID NO: 179439 - RNA, 22 nt, Homo sapiens
cuugacaucugucaguuccuca

SEQ ID NO: 179440 - RNA, 22 nt, Homo sapiens
cuugcacuagugcagaggcgcu

SEQ ID NO: 179441 - RNA, 22 nt, Homo sapiens
cuugcacuguuguaagggacuu

SEQ ID NO: 179442 - RNA, 19 nt, Homo sapiens
cuugccccauucauccucu

SEQ ID NO: 179443 - RNA, 22 nt, Homo sapiens
cuugccuuugucuucaaaggcu

SEQ ID NO: 179444 - RNA, 22 nt, Homo sapiens
cuuggcacucuguggaguuagg

SEQ ID NO: 179445 - RNA, 22 nt, Homo sapiens
cuuggcauuguguugauagaag

SEQ ID NO: 179446 - RNA, 22 nt, Homo sapiens
cuuggcuagucaaaccuccccg

SEQ ID NO: 179447 - RNA, 22 nt, Homo sapiens
cuuggguaagucauuaaaauua

SEQ ID NO: 179448 - RNA, 21 nt, Homo sapiens
cuugucuugcuuagaauagac

SEQ ID NO: 179449 - RNA, 22 nt, Homo sapiens
cuugugauugcacggcugccug

SEQ ID NO: 179450 - RNA, 22 nt, Homo sapiens
cuuguggugcuuuuacgugggc

SEQ ID NO: 179451 - RNA, 22 nt, Homo sapiens
cuuguuguggaggggagugcag

SEQ ID NO: 179452 - RNA, 22 nt, Homo sapiens
cuuuaguugucuccucaagggu

SEQ ID NO: 179453 - RNA, 21 nt, Homo sapiens
cuuuaugcuguguuagaaaag

SEQ ID NO: 179454 - RNA, 22 nt, Homo sapiens
cuuugcacaucucugcuuuccc

SEQ ID NO: 179455 - RNA, 21 nt, Homo sapiens
cuuugguagaguuuuuagggu

SEQ ID NO: 179456 - RNA, 22 nt, Homo sapiens
cuuugguuuacuuggugcuagu

SEQ ID NO: 179457 - RNA, 22 nt, Homo sapiens
cuuuguaugucaugacaacugu

SEQ ID NO: 179458 - RNA, 20 nt, Homo sapiens
cuuuguccuccugcugugcu

SEQ ID NO: 179459 - RNA, 22 nt, Homo sapiens
cuuuguguggacauuucaggca

SEQ ID NO: 179460 - RNA, 22 nt, Homo sapiens
cuuugugugggccaagggcugg

SEQ ID NO: 179461 - RNA, 22 nt, Homo sapiens
cuuuuacacuguuggugggaau

SEQ ID NO: 179462 - RNA, 22 nt, Homo sapiens
cuuuuggucuaucagagaagca

SEQ ID NO: 179463 - RNA, 22 nt, Homo sapiens
cuuuugugauuccucaguuacu

SEQ ID NO: 179464 - RNA, 22 nt, Homo sapiens
cuuuugugauucuucaguugcu

SEQ ID NO: 179465 - RNA, 22 nt, Homo sapiens
cuuuuguggaucuucuguugcu

SEQ ID NO: 179466 - RNA, 22 nt, Homo sapiens
cuuuuugcaaauacaacucuga

SEQ ID NO: 179467 - RNA, 22 nt, Homo sapiens
gaaaacugcuucucuggguuuc

SEQ ID NO: 179468 - RNA, 22 nt, Homo sapiens
gaaaugcucagggguuuuccag

SEQ ID NO: 179469 - RNA, 22 nt, Homo sapiens
gaaaugcucauuuuggauccuu

SEQ ID NO: 179470 - RNA, 23 nt, Homo sapiens
gaaauguaagugaugccccacag

SEQ ID NO: 179471 - RNA, 22 nt, Homo sapiens
gaaauguauuaaugaguugaaa

SEQ ID NO: 179472 - RNA, 22 nt, Homo sapiens
gaaauguugauagugggcauug

SEQ ID NO: 179473 - RNA, 22 nt, Homo sapiens
gaacacaucuuugguuagagga

SEQ ID NO: 179474 - RNA, 22 nt, Homo sapiens
gaaccagcagacuuugacaggu

SEQ ID NO: 179475 - RNA, 22 nt, Homo sapiens
gaacuguuucuggugaaagagu

SEQ ID NO: 179476 - RNA, 22 nt, Homo sapiens
gaacuuucuacauuaccucuuu

SEQ ID NO: 179477 - RNA, 22 nt, Homo sapiens
gaagaacuaggugagaucuaga

SEQ ID NO: 179478 - RNA, 18 nt, Homo sapiens
gaagaaguaggcauggca

SEQ ID NO: 179479 - RNA, 22 nt, Homo sapiens
gaagcauugauccacaggcgug

SEQ ID NO: 179480 - RNA, 22 nt, Homo sapiens
gaaggcacugugugccacccug

SEQ ID NO: 179481 - RNA, 22 nt, Homo sapiens
gaagguauauucuguuaaugcu

SEQ ID NO: 179482 - RNA, 17 nt, Homo sapiens
gaaguguuucuucauga

SEQ ID NO: 179483 - RNA, 22 nt, Homo sapiens
gaauagugcugcaauaaacaua

SEQ ID NO: 179484 - RNA, 22 nt, Homo sapiens
gaauagugcugcaaugaacaua

SEQ ID NO: 179485 - RNA, 22 nt, Homo sapiens
gaauagugcugcagcaaacaua

SEQ ID NO: 179486 - RNA, 22 nt, Homo sapiens
gaaucauuggguugauucaaga

SEQ ID NO: 179487 - RNA, 22 nt, Homo sapiens
gaaugcagcagugacagggcug

SEQ ID NO: 179488 - RNA, 22 nt, Homo sapiens
gacaagagaacacugcuauauu

SEQ ID NO: 179489 - RNA, 22 nt, Homo sapiens
gacaaguuugauuuauuccaag

SEQ ID NO: 179490 - RNA, 22 nt, Homo sapiens
gacacuggguguuuguuggcgu

SEQ ID NO: 179491 - RNA, 22 nt, Homo sapiens
gacaguguggcgauuccucaag

SEQ ID NO: 179492 - RNA, 20 nt, Homo sapiens
gacauagagacucucaaaaa

SEQ ID NO: 179493 - RNA, 22 nt, Homo sapiens
gacaucauuaugagauuuaaac

SEQ ID NO: 179494 - RNA, 20 nt, Homo sapiens
gacauggaggaggauuauua

SEQ ID NO: 179495 - RNA, 22 nt, Homo sapiens
gacauguuucucucuguuuacu

SEQ ID NO: 179496 - RNA, 22 nt, Homo sapiens
gacauguuuucaagauuuauaa

SEQ ID NO: 179497 - RNA, 22 nt, Homo sapiens
gacauguuuuuuaagguuuaug

SEQ ID NO: 179498 - RNA, 22 nt, Homo sapiens
gacauuaucagguuuguuuucu

SEQ ID NO: 179499 - RNA, 22 nt, Homo sapiens
gaccacauuccacacaggcuuu

SEQ ID NO: 179500 - RNA, 22 nt, Homo sapiens
gacccucuagagggaagcgcuu

SEQ ID NO: 179501 - RNA, 17 nt, Homo sapiens
gacgaucaucaggaggc

SEQ ID NO: 179502 - RNA, 22 nt, Homo sapiens
gacuagggaaaauuauuuuguu

SEQ ID NO: 179503 - RNA, 22 nt, Homo sapiens
gacuauguuaccuuacacauca

SEQ ID NO: 179504 - RNA, 22 nt, Homo sapiens
gacucagaacuaaggguguuuc

SEQ ID NO: 179505 - RNA, 18 nt, Homo sapiens
gacucaguuucuaaggca

SEQ ID NO: 179506 - RNA, 19 nt, Homo sapiens
gacuccagaguugugugcu

SEQ ID NO: 179507 - RNA, 18 nt, Homo sapiens
gacuccauuucagccaga

SEQ ID NO: 179508 - RNA, 22 nt, Homo sapiens
gacuggccuauaauggcgaauu

SEQ ID NO: 179509 - RNA, 22 nt, Homo sapiens
gacuuagagauguuguauuugg

SEQ ID NO: 179510 - RNA, 20 nt, Homo sapiens
gacuugagagugggagagua

SEQ ID NO: 179511 - RNA, 22 nt, Homo sapiens
gacuuugguaaacucgguggca

SEQ ID NO: 179512 - RNA, 22 nt, Homo sapiens
gagaacugagugugcuggcgga

SEQ ID NO: 179513 - RNA, 22 nt, Homo sapiens
gagaacuggcgugaacugcacg

SEQ ID NO: 179514 - RNA, 22 nt, Homo sapiens
gagaaugagaggggaaggccac

SEQ ID NO: 179515 - RNA, 22 nt, Homo sapiens
gagacggagucucgcucuguca

SEQ ID NO: 179516 - RNA, 22 nt, Homo sapiens
gagacugagucuugcuuuguca

SEQ ID NO: 179517 - RNA, 22 nt, Homo sapiens
gagacugaguuuugcucuuguu

SEQ ID NO: 179518 - RNA, 22 nt, Homo sapiens
gagagugcuuuggguguaggcc

SEQ ID NO: 179519 - RNA, 22 nt, Homo sapiens
gagauaaauaggucacaguucu

SEQ ID NO: 179520 - RNA, 21 nt, Homo sapiens
gagauagguaccgaagcuuag

SEQ ID NO: 179521 - RNA, 22 nt, Homo sapiens
gagauagguauuucauuuaccc

SEQ ID NO: 179522 - RNA, 22 nt, Homo sapiens
gagauauuuagaaauguguucu

SEQ ID NO: 179523 - RNA, 22 nt, Homo sapiens
gagaucaaguauucuccacuaa

SEQ ID NO: 179524 - RNA, 22 nt, Homo sapiens
gagaucaaugccuauggcuuuc

SEQ ID NO: 179525 - RNA, 22 nt, Homo sapiens
gagaucaguuaaugaagugagc

SEQ ID NO: 179526 - RNA, 22 nt, Homo sapiens
gagaucaucuaaucuggccucu

SEQ ID NO: 179527 - RNA, 22 nt, Homo sapiens
gagaucauuaugucagggguca

SEQ ID NO: 179528 - RNA, 22 nt, Homo sapiens
gagaugaaguuaaggaucuuua

SEQ ID NO: 179529 - RNA, 22 nt, Homo sapiens
gagaugaucaugugguuuuguc

SEQ ID NO: 179530 - RNA, 22 nt, Homo sapiens
gagaugauuugccccauguauu

SEQ ID NO: 179531 - RNA, 22 nt, Homo sapiens
gagauguagucuugcccuguca

SEQ ID NO: 179532 - RNA, 22 nt, Homo sapiens
gagaugucuauuucagagaugu

SEQ ID NO: 179533 - RNA, 22 nt, Homo sapiens
gagauuaauacacaucaaaugc

SEQ ID NO: 179534 - RNA, 22 nt, Homo sapiens
gagauuauuagauguucugcuu

SEQ ID NO: 179535 - RNA, 22 nt, Homo sapiens
gagauuauugucucccucacca

SEQ ID NO: 179536 - RNA, 22 nt, Homo sapiens
gagauuauuuaaaaggugauuu

SEQ ID NO: 179537 - RNA, 22 nt, Homo sapiens
gagauucaucuagguccagaga

SEQ ID NO: 179538 - RNA, 22 nt, Homo sapiens
gagauugucaugauuacauugu

SEQ ID NO: 179539 - RNA, 22 nt, Homo sapiens
gagcacauaugacauuuucuuc

SEQ ID NO: 179540 - RNA, 22 nt, Homo sapiens
guauggguuuuguuucuucugg

SEQ ID NO: 179541 - RNA, 22 nt, Homo sapiens
guaugugcauuguaaauuuuga

SEQ ID NO: 179542 - RNA, 22 nt, Homo sapiens
guauuagguuggggcaaaagua

SEQ ID NO: 179543 - RNA, 22 nt, Homo sapiens
guauuagguuggugcaaaauaa

SEQ ID NO: 179544 - RNA, 22 nt, Homo sapiens
guauuguacuacaagcucuuua

SEQ ID NO: 179545 - RNA, 22 nt, Homo sapiens
guauuuuguuagggugugguau

SEQ ID NO: 179546 - RNA, 22 nt, Homo sapiens
aauggcacuuuauaaauguuaa

SEQ ID NO: 179547 - RNA, 22 nt, Homo sapiens
aauggcucuuccuggaguugug

SEQ ID NO: 179548 - RNA, 22 nt, Homo sapiens
aauggguaguacugugguaaca

SEQ ID NO: 179549 - RNA, 22 nt, Homo sapiens
aaugucaugaguccaaccagaa

SEQ ID NO: 179550 - RNA, 22 nt, Homo sapiens
aaugugcacuuggagccuugcu

SEQ ID NO: 179551 - RNA, 22 nt, Homo sapiens
aauuacauggcaauugggaaau

SEQ ID NO: 179552 - RNA, 22 nt, Homo sapiens
aauuacucgugucuuuacugcu

SEQ ID NO: 179553 - RNA, 22 nt, Homo sapiens
aauuacuucuacaccaaccuaa

SEQ ID NO: 179554 - RNA, 22 nt, Homo sapiens
aauuaggcuagaauguuauuaa

SEQ ID NO: 179555 - RNA, 22 nt, Homo sapiens
aauuaguuggcugggugcggug

SEQ ID NO: 179556 - RNA, 22 nt, Homo sapiens
aauugcacuacugcacucccac

SEQ ID NO: 179557 - RNA, 22 nt, Homo sapiens
aauugugcuuguaggccaggca

SEQ ID NO: 179558 - RNA, 16 nt, Homo sapiens
acaaagcuggcuaucu

SEQ ID NO: 179559 - RNA, 22 nt, Homo sapiens
acaaaguauggaauguuggugu

SEQ ID NO: 179560 - RNA, 22 nt, Homo sapiens
acaaccauuguaagggcuuugg

SEQ ID NO: 179561 - RNA, 22 nt, Homo sapiens
acaauggaauggaguggaaagu

SEQ ID NO: 179562 - RNA, 22 nt, Homo sapiens
acacauacacauaugguguaua

SEQ ID NO: 179563 - RNA, 22 nt, Homo sapiens
acaccauugcauuccagccugg

SEQ ID NO: 179564 - RNA, 22 nt, Homo sapiens
acacucuaguguucuuaaucag

SEQ ID NO: 179565 - RNA, 22 nt, Homo sapiens
acacugcugaguaaauaauuuu

SEQ ID NO: 179566 - RNA, 22 nt, Homo sapiens
acacuggaggagagcuguugcu

SEQ ID NO: 179567 - RNA, 22 nt, Homo sapiens
acacugucugaugaaaguaguu

SEQ ID NO: 179568 - RNA, 22 nt, Homo sapiens
acacuuucuggagcugcacaua

SEQ ID NO: 179569 - RNA, 22 nt, Homo sapiens
acagaacugggcuugcuuuugg

SEQ ID NO: 179570 - RNA, 22 nt, Homo sapiens
acagauagcacuaagggaucug

SEQ ID NO: 179571 - RNA, 19 nt, Homo sapiens
acaguaccuggcaugaggu

SEQ ID NO: 179572 - RNA, 21 nt, Homo sapiens
acaguacuugagaucuuuuga

SEQ ID NO: 179573 - RNA, 22 nt, Homo sapiens
acagucacaauuuguaccuuuu

SEQ ID NO: 179574 - RNA, 22 nt, Homo sapiens
acagucuggagaaugggugcuc

SEQ ID NO: 179575 - RNA, 22 nt, Homo sapiens
acagugcuguuguguuuucacg

SEQ ID NO: 179576 - RNA, 22 nt, Homo sapiens
acagugcuucugauaugaugcc

SEQ ID NO: 179577 - RNA, 19 nt, Homo sapiens
acagugcuuugucagaagc

SEQ ID NO: 179578 - RNA, 22 nt, Homo sapiens
acaguggaauguaggguuugag

SEQ ID NO: 179579 - RNA, 19 nt, Homo sapiens
acagugucucuauaaugau

SEQ ID NO: 179580 - RNA, 18 nt, Homo sapiens
acaguguguaaggguucu

SEQ ID NO: 179581 - RNA, 22 nt, Homo sapiens
acaguguuccuuuguugugacu

SEQ ID NO: 179582 - RNA, 22 nt, Homo sapiens
acaguuaugugagggccaccag

SEQ ID NO: 179583 - RNA, 22 nt, Homo sapiens
acauauaaggagacuagggcau

SEQ ID NO: 179584 - RNA, 18 nt, Homo sapiens
acaucccaugcuggggug

SEQ ID NO: 179585 - RNA, 22 nt, Homo sapiens
acaucccuuucccacccuucac

SEQ ID NO: 179586 - RNA, 22 nt, Homo sapiens
acaugcauauguuggaagaaag

SEQ ID NO: 179587 - RNA, 22 nt, Homo sapiens
acaugcaucauuaggugguuua

SEQ ID NO: 179588 - RNA, 22 nt, Homo sapiens
acaugcauggcaugcauuguac

SEQ ID NO: 179589 - RNA, 22 nt, Homo sapiens
acauggcacugcgggcuucuug

SEQ ID NO: 179590 - RNA, 22 nt, Homo sapiens
acauguauauaaugcauagcga

SEQ ID NO: 179591 - RNA, 22 nt, Homo sapiens
acauucagcuguuguuucaaug

SEQ ID NO: 179592 - RNA, 22 nt, Homo sapiens
accaccacucccgcauucuaaa

SEQ ID NO: 179593 - RNA, 22 nt, Homo sapiens
accacuguuucaagaagcuugu

SEQ ID NO: 179594 - RNA, 19 nt, Homo sapiens
accagauugcauucuugga

SEQ ID NO: 179595 - RNA, 22 nt, Homo sapiens
accagucucagguaugucuuua

SEQ ID NO: 179596 - RNA, 22 nt, Homo sapiens
accaguuuuuuauacaucuucu

SEQ ID NO: 179597 - RNA, 22 nt, Homo sapiens
acccacuagaugccaguggcac

SEQ ID NO: 179598 - RNA, 22 nt, Homo sapiens
acccagaauucagucuuaggcc

SEQ ID NO: 179599 - RNA, 22 nt, Homo sapiens
acccagaguuccuugucuuuca

SEQ ID NO: 179600 - RNA, 22 nt, Homo sapiens
accccauuugcacugagcccuu

SEQ ID NO: 179601 - RNA, 22 nt, Homo sapiens
acccgggaggcaggagucauag

SEQ ID NO: 179602 - RNA, 22 nt, Homo sapiens
acccuacauaguagauccuaca

SEQ ID NO: 179603 - RNA, 22 nt, Homo sapiens
acccuggagagugcuguaguaa

SEQ ID NO: 179604 - RNA, 22 nt, Homo sapiens
acccugguagcuaugaagucuu

SEQ ID NO: 179605 - RNA, 22 nt, Homo sapiens
acccuguaggacuauucuaauc

SEQ ID NO: 179606 - RNA, 22 nt, Homo sapiens
acccugucaaaauagaccaauc

SEQ ID NO: 179607 - RNA, 22 nt, Homo sapiens
acccugucacucccaucaauuu

SEQ ID NO: 179608 - RNA, 22 nt, Homo sapiens
acccugugaauauuuaaacuuc

SEQ ID NO: 179609 - RNA, 22 nt, Homo sapiens
acccuguugucagaauguggau

SEQ ID NO: 179610 - RNA, 18 nt, Homo sapiens
acccuucagcacugggcc

SEQ ID NO: 179611 - RNA, 22 nt, Homo sapiens
accgggcugagcgcaggccccg

SEQ ID NO: 179612 - RNA, 22 nt, Homo sapiens
accuggacacuuugggcuccuc

SEQ ID NO: 179613 - RNA, 19 nt, Homo sapiens
accuguagaaaguacaaca

SEQ ID NO: 179614 - RNA, 22 nt, Homo sapiens
accuguauaacaagugggaaau

SEQ ID NO: 179615 - RNA, 23 nt, Homo sapiens
accuucauucauucagcugaagu

SEQ ID NO: 179616 - RNA, 22 nt, Homo sapiens
acuacauaugacaucuucuuua

SEQ ID NO: 179617 - RNA, 22 nt, Homo sapiens
acuacuucuaaguuuuggaaga

SEQ ID NO: 179618 - RNA, 22 nt, Homo sapiens
acuauacuguaacuguauucag

SEQ ID NO: 179619 - RNA, 22 nt, Homo sapiens
acuaugagacgaaugcaucagu

SEQ ID NO: 179620 - RNA, 22 nt, Homo sapiens
acucacagcaaccuccgccucc

SEQ ID NO: 179621 - RNA, 22 nt, Homo sapiens
acucagagaacauucccagucu

SEQ ID NO: 179622 - RNA, 22 nt, Homo sapiens
acucauugcucauaccuuaucu

SEQ ID NO: 179623 - RNA, 22 nt, Homo sapiens
acuccauuuggacucugggagg

SEQ ID NO: 179624 - RNA, 18 nt, Homo sapiens
acucuguauguggagugg

SEQ ID NO: 179625 - RNA, 22 nt, Homo sapiens
acucuguugucuggccuuccug

SEQ ID NO: 179626 - RNA, 22 nt, Homo sapiens
acugaguguugauuuagauuaa

SEQ ID NO: 179627 - RNA, 22 nt, Homo sapiens
acugaucaauguuaaggcuuau

SEQ ID NO: 179628 - RNA, 21 nt, Homo sapiens
acugauguuugaaauucgcug

SEQ ID NO: 179629 - RNA, 22 nt, Homo sapiens
acugcacuccagcccaggugac

SEQ ID NO: 179630 - RNA, 22 nt, Homo sapiens
acugcacuccagccuaggcgac

SEQ ID NO: 179631 - RNA, 22 nt, Homo sapiens
acugcacuccagccucaugaca

SEQ ID NO: 179632 - RNA, 22 nt, Homo sapiens
acugcacuccagccucggcaau

SEQ ID NO: 179633 - RNA, 22 nt, Homo sapiens
acugcacuccagccucgugaca

SEQ ID NO: 179634 - RNA, 22 nt, Homo sapiens
acugcacuccagccucguggac

SEQ ID NO: 179635 - RNA, 22 nt, Homo sapiens
acugcacuccagccugcuggau

SEQ ID NO: 179636 - RNA, 22 nt, Homo sapiens
acugcacuccagccuggacgac

SEQ ID NO: 179637 - RNA, 22 nt, Homo sapiens
acugcacuccagccuguugaca

SEQ ID NO: 179638 - RNA, 22 nt, Homo sapiens
acugcacuccagccuucaggac

SEQ ID NO: 179639 - RNA, 20 nt, Homo sapiens
acugcacuccagccuuccag

SEQ ID NO: 179640 - RNA, 22 nt, Homo sapiens
acugcacuccagccuucgugac

SEQ ID NO: 179641 - RNA, 22 nt, Homo sapiens
acugcacuccagccuuggccac

SEQ ID NO: 179642 - RNA, 22 nt, Homo sapiens
acugcacuccagcuugggugac

SEQ ID NO: 179643 - RNA, 22 nt, Homo sapiens
acugcacuccagcuuuggguga

SEQ ID NO: 179644 - RNA, 22 nt, Homo sapiens
acugcacuccggccuggcaaca

SEQ ID NO: 179645 - RNA, 19 nt, Homo sapiens
acugcacuccuccuugggu

SEQ ID NO: 179646 - RNA, 22 nt, Homo sapiens
acugcacucuagccuuggcaac

SEQ ID NO: 179647 - RNA, 22 nt, Homo sapiens
acuggaguuuguucaagaaaua

SEQ ID NO: 179648 - RNA, 22 nt, Homo sapiens
acugggauauuauugguaauau

SEQ ID NO: 179649 - RNA, 22 nt, Homo sapiens
acuggguuaauuugaagguuga

SEQ ID NO: 179650 - RNA, 22 nt, Homo sapiens
acuguauagauggaguugauuu

SEQ ID NO: 179651 - RNA, 22 nt, Homo sapiens
acuuugguuuauagaauuuagg

SEQ ID NO: 179652 - RNA, 22 nt, Homo sapiens
acuuuguguuacccagcaagga

SEQ ID NO: 179653 - RNA, 17 nt, Homo sapiens
acuuuuugaggaggcau

SEQ ID NO: 179654 - RNA, 22 nt, Homo sapiens
acuuuuugaugaggucguuugu

SEQ ID NO: 179655 - RNA, 22 nt, Homo sapiens
acuuuuugauggggagaacauu

SEQ ID NO: 179656 - RNA, 19 nt, Homo sapiens
gucaaagucgguauucaaa

SEQ ID NO: 179657 - RNA, 22 nt, Homo sapiens
gucaaagucuauuggcuaauuc

SEQ ID NO: 179658 - RNA, 22 nt, Homo sapiens
gucaagugaagcagugggagua

SEQ ID NO: 179659 - RNA, 22 nt, Homo sapiens
gucacagaaaaagauaugccaa

SEQ ID NO: 179660 - RNA, 22 nt, Homo sapiens
gucacaguguuuguucauccca

SEQ ID NO: 179661 - RNA, 22 nt, Homo sapiens
gucaccagcuguguuagccccu

SEQ ID NO: 179662 - RNA, 22 nt, Homo sapiens
gucacugggugcugcgccuguc

SEQ ID NO: 179663 - RNA, 22 nt, Homo sapiens
gucacugucuacuguaauagcc

SEQ ID NO: 179664 - RNA, 22 nt, Homo sapiens
gucagagcacugaguugugggc

SEQ ID NO: 179665 - RNA, 22 nt, Homo sapiens
gucagcaaaguucuccugcaga

SEQ ID NO: 179666 - RNA, 22 nt, Homo sapiens
gucagcaucaccaugucuauga

SEQ ID NO: 179667 - RNA, 22 nt, Homo sapiens
gucagcuuuuccuuacuuuagg

SEQ ID NO: 179668 - RNA, 22 nt, Homo sapiens
gucagguaccugaaagcagcca

SEQ ID NO: 179669 - RNA, 22 nt, Homo sapiens
gucaggugcuuacgcggagauc

SEQ ID NO: 179670 - RNA, 22 nt, Homo sapiens
gucagugccugucccaggcuuu

SEQ ID NO: 179671 - RNA, 22 nt, Homo sapiens
gucaguggagaaaaggacaugu

SEQ ID NO: 179672 - RNA, 21 nt, Homo sapiens
gucauaugucucugauuagug

SEQ ID NO: 179673 - RNA, 22 nt, Homo sapiens
gucauggagggacauaacuaac

SEQ ID NO: 179674 - RNA, 22 nt, Homo sapiens
gucaugggguacuacacauggg

SEQ ID NO: 179675 - RNA, 22 nt, Homo sapiens
gucauggguuaaagguggauac

SEQ ID NO: 179676 - RNA, 22 nt, Homo sapiens
gucaugucuugaaauucaguuu

SEQ ID NO: 179677 - RNA, 22 nt, Homo sapiens
gucauucauucagcaagcacug

SEQ ID NO: 179678 - RNA, 22 nt, Homo sapiens
guccaaagugggagaggugggg

SEQ ID NO: 179679 - RNA, 22 nt, Homo sapiens
guccaugagaugaauccacaca

SEQ ID NO: 179680 - RNA, 20 nt, Homo sapiens
guccauuugcugccauugcu

SEQ ID NO: 179681 - RNA, 18 nt, Homo sapiens
guccauuuguugguacac

SEQ ID NO: 179682 - RNA, 22 nt, Homo sapiens
gucccagagauauugugucuuu

SEQ ID NO: 179683 - RNA, 22 nt, Homo sapiens
gucccugaggaacauccagggc

SEQ ID NO: 179684 - RNA, 22 nt, Homo sapiens
gucgguguuuccugagaacgaa

SEQ ID NO: 179685 - RNA, 22 nt, Homo sapiens
gucguggagcucacagugugcc

SEQ ID NO: 179686 - RNA, 22 nt, Homo sapiens
gucuagaacuucugaccuuagg

SEQ ID NO: 179687 - RNA, 22 nt, Homo sapiens
gucuaugguucaggguggagug

SEQ ID NO: 179688 - RNA, 22 nt, Homo sapiens
gucuggagacuugggucaucaa

SEQ ID NO: 179689 - RNA, 22 nt, Homo sapiens
gucuggcaauggcagacuggca

SEQ ID NO: 179690 - RNA, 22 nt, Homo sapiens
gucuggcuuaucucacuuacca

SEQ ID NO: 179691 - RNA, 22 nt, Homo sapiens
gucuggguuuguuuguacuugc

SEQ ID NO: 179692 - RNA, 22 nt, Homo sapiens
gucugugcauuaauacgugcug

SEQ ID NO: 179693 - RNA, 21 nt, Homo sapiens
gucuuacagccagaugccucu

SEQ ID NO: 179694 - RNA, 22 nt, Homo sapiens
gucuugcacuuaccuaagaacu

SEQ ID NO: 179695 - RNA, 22 nt, Homo sapiens
gucuuggagaacucagcuuggc

SEQ ID NO: 179696 - RNA, 22 nt, Homo sapiens
gucuuugagauaggguuauuuu

SEQ ID NO: 179697 - RNA, 22 nt, Homo sapiens
gucuuugcauguauguucauga

SEQ ID NO: 179698 - RNA, 22 nt, Homo sapiens
gucuuuggaaaaaaugucuguu

SEQ ID NO: 179699 - RNA, 22 nt, Homo sapiens
gucuuuggaaagacaaaguuca

SEQ ID NO: 179700 - RNA, 22 nt, Homo sapiens
gugaaagacagcauuaauggcu

SEQ ID NO: 179701 - RNA, 22 nt, Homo sapiens
gugaaagauuaaaccagugugu

SEQ ID NO: 179702 - RNA, 20 nt, Homo sapiens
gugacacucguuaaccucug

SEQ ID NO: 179703 - RNA, 22 nt, Homo sapiens
gugaccagaugggcaggggugu

SEQ ID NO: 179704 - RNA, 22 nt, Homo sapiens
gugaccucuguugcugucacua

SEQ ID NO: 179705 - RNA, 22 nt, Homo sapiens
gugacugcauauaaguguaugu

SEQ ID NO: 179706 - RNA, 22 nt, Homo sapiens
gugagacugguucugaacccag

SEQ ID NO: 179707 - RNA, 22 nt, Homo sapiens
gugagaggaggcagcuuuuaca

SEQ ID NO: 179708 - RNA, 22 nt, Homo sapiens
gugagauaaugucucauugugg

SEQ ID NO: 179709 - RNA, 22 nt, Homo sapiens
gugagaugugacuucugccucu

SEQ ID NO: 179710 - RNA, 22 nt, Homo sapiens
gugagauuaccauuuaaaucag

SEQ ID NO: 179711 - RNA, 22 nt, Homo sapiens
gugagcacugaaagaaggcaag

SEQ ID NO: 179712 - RNA, 22 nt, Homo sapiens
gugagcaguguccuugggggca

SEQ ID NO: 179713 - RNA, 22 nt, Homo sapiens
gugagcuccucuucugcugcag

SEQ ID NO: 179714 - RNA, 22 nt, Homo sapiens
gugagguacgugucaagaacca

SEQ ID NO: 179715 - RNA, 21 nt, Homo sapiens
gugaucaugucacugcacucc

SEQ ID NO: 179716 - RNA, 22 nt, Homo sapiens
gugaucauuguauugggguuau

SEQ ID NO: 179717 - RNA, 22 nt, Homo sapiens
gugaucucauuuggaauuagag

SEQ ID NO: 179718 - RNA, 22 nt, Homo sapiens
gugaugguccagggaaucucuu

SEQ ID NO: 179719 - RNA, 22 nt, Homo sapiens
gugauguguuuguucuaucucu

SEQ ID NO: 179720 - RNA, 22 nt, Homo sapiens
gugauuauuaugcacugcaugc

SEQ ID NO: 179721 - RNA, 22 nt, Homo sapiens
gugauuuaguagaugcuaguua

SEQ ID NO: 179722 - RNA, 22 nt, Homo sapiens
gugcaaacuccaggucucuuca

SEQ ID NO: 179723 - RNA, 22 nt, Homo sapiens
gugcaaaucucugaguaucuuu

SEQ ID NO: 179724 - RNA, 22 nt, Homo sapiens
gugcaacaucccuccauaauuu

SEQ ID NO: 179725 - RNA, 22 nt, Homo sapiens
gugcaagcaucauggaguguac

SEQ ID NO: 179726 - RNA, 22 nt, Homo sapiens
gugcaaguguaauacagcuagg

SEQ ID NO: 179727 - RNA, 18 nt, Homo sapiens
gugcaaugaauagcagag

SEQ ID NO: 179728 - RNA, 22 nt, Homo sapiens
gugcaaugagaaggggcucugg

SEQ ID NO: 179729 - RNA, 22 nt, Homo sapiens
gugcaaugucaggagaugcagc

SEQ ID NO: 179730 - RNA, 22 nt, Homo sapiens
gugcacaacgugcaggcuuguu

SEQ ID NO: 179731 - RNA, 22 nt, Homo sapiens
gugcacaaucgugcauuccuug

SEQ ID NO: 179732 - RNA, 22 nt, Homo sapiens
gugcacaaugugcagguuuguu

SEQ ID NO: 179733 - RNA, 22 nt, Homo sapiens
gugcacaucuguguuccagcua

SEQ ID NO: 179734 - RNA, 22 nt, Homo sapiens
gugcacauuguuuaugucuguu

SEQ ID NO: 179735 - RNA, 22 nt, Homo sapiens
gugcacuguagaacccuuuguu

SEQ ID NO: 179736 - RNA, 22 nt, Homo sapiens
gugcaguuuugagugaguuucu

SEQ ID NO: 179737 - RNA, 22 nt, Homo sapiens
gugcauauaaguuguuucuagu

SEQ ID NO: 179738 - RNA, 23 nt, Homo sapiens
gugcaugagucuuuauaguagca

SEQ ID NO: 179739 - RNA, 22 nt, Homo sapiens
gugccacaguguuaagggauuc

SEQ ID NO: 179740 - RNA, 23 nt, Homo sapiens
gugccuucugagccuagucucca

SEQ ID NO: 179741 - RNA, 22 nt, Homo sapiens
gugcgggaggcgcgccuaggug

SEQ ID NO: 179742 - RNA, 22 nt, Homo sapiens
gugcuauguuauccagcaagau

SEQ ID NO: 179743 - RNA, 22 nt, Homo sapiens
guggaaaaguaguugcgguuuu

SEQ ID NO: 179744 - RNA, 22 nt, Homo sapiens
guggaaaauuauugcuguuuuu

SEQ ID NO: 179745 - RNA, 22 nt, Homo sapiens
guggaagaccagacuuuccaac

SEQ ID NO: 179746 - RNA, 20 nt, Homo sapiens
guggaagauaaguagccuga

SEQ ID NO: 179747 - RNA, 22 nt, Homo sapiens
guggaagguaaugcagcuuacu

SEQ ID NO: 179748 - RNA, 22 nt, Homo sapiens
guggaagucuuugguauuggua

SEQ ID NO: 179749 - RNA, 22 nt, Homo sapiens
guggaaguguaaaagcucuugg

SEQ ID NO: 179750 - RNA, 22 nt, Homo sapiens
guggaauacuaugaugguggau

SEQ ID NO: 179751 - RNA, 22 nt, Homo sapiens
guggaaugaaaacucucucaca

SEQ ID NO: 179752 - RNA, 17 nt, Homo sapiens
guggaaugucaugucaa

SEQ ID NO: 179753 - RNA, 22 nt, Homo sapiens
guggacaugaauuuuggaggca

SEQ ID NO: 179754 - RNA, 22 nt, Homo sapiens
guggacggagguugcagugagc

SEQ ID NO: 179755 - RNA, 22 nt, Homo sapiens
guggcaagaugacuacucacug

SEQ ID NO: 179756 - RNA, 22 nt, Homo sapiens
guggcagagucagagggaaaug

SEQ ID NO: 179757 - RNA, 22 nt, Homo sapiens
guggcagugugaggauccugcu

SEQ ID NO: 179758 - RNA, 22 nt, Homo sapiens
guggcaugaaagcaucugugau

SEQ ID NO: 179759 - RNA, 22 nt, Homo sapiens
aggcaguuucagugagagguga

SEQ ID NO: 179760 - RNA, 22 nt, Homo sapiens
aggcaugauggcuccagaucau

SEQ ID NO: 179761 - RNA, 22 nt, Homo sapiens
aggcaugguggcacauacaugu

SEQ ID NO: 179762 - RNA, 22 nt, Homo sapiens
aggcaugugugcagacugucug

SEQ ID NO: 179763 - RNA, 22 nt, Homo sapiens
aggcuuauuaagauucccuuau

SEQ ID NO: 179764 - RNA, 22 nt, Homo sapiens
aggcuuuauuacagggucucag

SEQ ID NO: 179765 - RNA, 22 nt, Homo sapiens
guggucagaaaucucaguggca

SEQ ID NO: 179766 - RNA, 22 nt, Homo sapiens
gugguguuugagcugccaggga

SEQ ID NO: 179767 - RNA, 22 nt, Homo sapiens
gugguuuuaauauucagucuag

SEQ ID NO: 179768 - RNA, 22 nt, Homo sapiens
gugguuuuacaaagagaaagau

SEQ ID NO: 179769 - RNA, 22 nt, Homo sapiens
gugguuuuuagauuucuacagu

SEQ ID NO: 179770 - RNA, 22 nt, Homo sapiens
gugguuuuuuucugccuuauag

SEQ ID NO: 179771 - RNA, 22 nt, Homo sapiens
guguauauccuauuaguucugu

SEQ ID NO: 179772 - RNA, 22 nt, Homo sapiens
guguaugguuguuguagagaga

SEQ ID NO: 179773 - RNA, 22 nt, Homo sapiens
guguauguuguccauggaugcg

SEQ ID NO: 179774 - RNA, 22 nt, Homo sapiens
gugucacuguauaauauuuauu

SEQ ID NO: 179775 - RNA, 22 nt, Homo sapiens
gugucacugugaggauauugua

SEQ ID NO: 179776 - RNA, 22 nt, Homo sapiens
gugucaugagggggacaggaag

SEQ ID NO: 179777 - RNA, 22 nt, Homo sapiens
gugucuccugccuucaugcagc

SEQ ID NO: 179778 - RNA, 22 nt, Homo sapiens
gugugcaacuuucauuaauauu

SEQ ID NO: 179779 - RNA, 22 nt, Homo sapiens
gugugcacaaucuggcaugugc

SEQ ID NO: 179780 - RNA, 20 nt, Homo sapiens
gugugcauuucagauuuugg

SEQ ID NO: 179781 - RNA, 23 nt, Homo sapiens
gugugguaggcuauaccaucuag

SEQ ID NO: 179782 - RNA, 22 nt, Homo sapiens
guguuauugagaaauagggugu

SEQ ID NO: 179783 - RNA, 22 nt, Homo sapiens
guguuauuuugcugggaaugau

SEQ ID NO: 179784 - RNA, 22 nt, Homo sapiens
guguucaaacccaggucugucu

SEQ ID NO: 179785 - RNA, 22 nt, Homo sapiens
guguucaaagcugauugagauu

SEQ ID NO: 179786 - RNA, 22 nt, Homo sapiens
guguuugguugauagagccacu

SEQ ID NO: 179787 - RNA, 22 nt, Homo sapiens
guuacagucuuguguaagguua

SEQ ID NO: 179788 - RNA, 22 nt, Homo sapiens
guuacugucuuccugauugcuu

SEQ ID NO: 179789 - RNA, 22 nt, Homo sapiens
guuaggcagugugguauagcag

SEQ ID NO: 179790 - RNA, 22 nt, Homo sapiens
guuauauguuuggaaugaggaa

SEQ ID NO: 179791 - RNA, 22 nt, Homo sapiens
guuaugcagcuuagaaaaugaa

SEQ ID NO: 179792 - RNA, 22 nt, Homo sapiens
guuauggaguauaugugaacug

SEQ ID NO: 179793 - RNA, 22 nt, Homo sapiens
guuauguguuuccuuaauugcu

SEQ ID NO: 179794 - RNA, 22 nt, Homo sapiens
guuauguuaguuacaaggcuag

SEQ ID NO: 179795 - RNA, 22 nt, Homo sapiens
guucaguuuuaaagggaaauug

SEQ ID NO: 179796 - RNA, 22 nt, Homo sapiens
guucaucaggcuuucucuagag

SEQ ID NO: 179797 - RNA, 22 nt, Homo sapiens
guucuggagauaaagccaaggu

SEQ ID NO: 179798 - RNA, 22 nt, Homo sapiens
guugaggcaggagaauuacuug

SEQ ID NO: 179799 - RNA, 22 nt, Homo sapiens
guugcucaggcugaagugcagu

SEQ ID NO: 179800 - RNA, 22 nt, Homo sapiens
guugcugagucccaucaccaga

SEQ ID NO: 179801 - RNA, 22 nt, Homo sapiens
guuuacagucgacuugggaaua

SEQ ID NO: 179802 - RNA, 22 nt, Homo sapiens
guuugcacuccuaugagaaucu

SEQ ID NO: 179803 - RNA, 22 nt, Homo sapiens
guuugcagaucaugaagaaccc

SEQ ID NO: 179804 - RNA, 22 nt, Homo sapiens
guuuguaacucuagugacuaga

SEQ ID NO: 179805 - RNA, 22 nt, Homo sapiens
guuugugcuccuaugagaaucu

SEQ ID NO: 179806 - RNA, 22 nt, Homo sapiens
guuuugguuauauggaucaguu

SEQ ID NO: 179807 - RNA, 22 nt, Homo sapiens
uaaacugucuugcaguuacaug

SEQ ID NO: 179808 - RNA, 22 nt, Homo sapiens
uaaagagcuuuugaggugucau

SEQ ID NO: 179809 - RNA, 22 nt, Homo sapiens
uaaagauaaggcucgcuuggau

SEQ ID NO: 179810 - RNA, 22 nt, Homo sapiens
uaaagccauugucaaguuugua

SEQ ID NO: 179811 - RNA, 16 nt, Homo sapiens
uaaagcuaaucacuuu

SEQ ID NO: 179812 - RNA, 22 nt, Homo sapiens
uaaagcuagaauuguuccagca

SEQ ID NO: 179813 - RNA, 20 nt, Homo sapiens
uaaagcugcucagggggcuc

SEQ ID NO: 179814 - RNA, 22 nt, Homo sapiens
uaaagugaggauggcaguaggu

SEQ ID NO: 179815 - RNA, 22 nt, Homo sapiens
uaaaugacugucaguagaugaa

SEQ ID NO: 179816 - RNA, 20 nt, Homo sapiens
uaaaugccucaugcuuuauu

SEQ ID NO: 179817 - RNA, 22 nt, Homo sapiens
uaaaugcuuaauugaaugugga

SEQ ID NO: 179818 - RNA, 22 nt, Homo sapiens
uaacacagagcuccuaaucccu

SEQ ID NO: 179819 - RNA, 22 nt, Homo sapiens
uaacaccuuugauagcacuuuu

SEQ ID NO: 179820 - RNA, 22 nt, Homo sapiens
uaacagucaagguuugaccagg

SEQ ID NO: 179821 - RNA, 22 nt, Homo sapiens
uaacaguguauuuacuacuucc

SEQ ID NO: 179822 - RNA, 22 nt, Homo sapiens
uaacauucacaugcugcaaaaa

SEQ ID NO: 179823 - RNA, 22 nt, Homo sapiens
uaacauuguugauuauacuaag

SEQ ID NO: 179824 - RNA, 21 nt, Homo sapiens
uaacccugaaggagcucugga

SEQ ID NO: 179825 - RNA, 22 nt, Homo sapiens
uaacuaaagagaagucaauguc

SEQ ID NO: 179826 - RNA, 22 nt, Homo sapiens
uaacuacuucugcuucagagua

SEQ ID NO: 179827 - RNA, 22 nt, Homo sapiens
uaacuagaaaggagacaguugc

SEQ ID NO: 179828 - RNA, 22 nt, Homo sapiens
uaagaauucuguccgguauacu

SEQ ID NO: 179829 - RNA, 22 nt, Homo sapiens
uaagacugccccagacagcaag

SEQ ID NO: 179830 - RNA, 22 nt, Homo sapiens
uaagagcuaggauuuuaaauca

SEQ ID NO: 179831 - RNA, 20 nt, Homo sapiens
uaagcauaguugucaggguc

SEQ ID NO: 179832 - RNA, 20 nt, Homo sapiens
uaagccacacagucuaaggu

SEQ ID NO: 179833 - RNA, 22 nt, Homo sapiens
uaagccaccgugccuggccuaa

SEQ ID NO: 179834 - RNA, 16 nt, Homo sapiens
uaagccccacgugcau

SEQ ID NO: 179835 - RNA, 22 nt, Homo sapiens
uaaggcacccuucugaguagag

SEQ ID NO: 179836 - RNA, 22 nt, Homo sapiens
uaaggcacucuucugugugccu

SEQ ID NO: 179837 - RNA, 22 nt, Homo sapiens
uaaggcuuugguagguuugguc

SEQ ID NO: 179838 - RNA, 22 nt, Homo sapiens
uaagguauuuacauuucuguuu

SEQ ID NO: 179839 - RNA, 22 nt, Homo sapiens
uaaguaauugugguuuuugcca

SEQ ID NO: 179840 - RNA, 22 nt, Homo sapiens
uaaguaauuuguauuuuaccca

SEQ ID NO: 179841 - RNA, 19 nt, Homo sapiens
uaaguagaugacugaugcu

SEQ ID NO: 179842 - RNA, 22 nt, Homo sapiens
uaaguagcugggaguacaggca

SEQ ID NO: 179843 - RNA, 22 nt, Homo sapiens
uaaguaguauaagguuuuuuga

SEQ ID NO: 179844 - RNA, 22 nt, Homo sapiens
uaaguauuaugugcugcauuuu

SEQ ID NO: 179845 - RNA, 23 nt, Homo sapiens
uaagucacacagauuaauuuauu

SEQ ID NO: 179846 - RNA, 22 nt, Homo sapiens
uaagugaaggaaguguguuuac

SEQ ID NO: 179847 - RNA, 22 nt, Homo sapiens
uaagugcaacauaaguguuaaa

SEQ ID NO: 179848 - RNA, 22 nt, Homo sapiens
uaagugcaugauuacaugcaua

SEQ ID NO: 179849 - RNA, 22 nt, Homo sapiens
uaagugcuguguuguuaccuaa

SEQ ID NO: 179850 - RNA, 18 nt, Homo sapiens
uaagugcuuuaaacacau

SEQ ID NO: 179851 - RNA, 22 nt, Homo sapiens
uaaguucauucaugaaacuuag

SEQ ID NO: 179852 - RNA, 22 nt, Homo sapiens
uaaguugcagguugugauucca

SEQ ID NO: 179853 - RNA, 22 nt, Homo sapiens
uaauagcaguguuacuaggacu

SEQ ID NO: 179854 - RNA, 22 nt, Homo sapiens
uaauauguauacagacagauac

SEQ ID NO: 179855 - RNA, 22 nt, Homo sapiens
uaaugcacauuuauuuuaccuu

SEQ ID NO: 179856 - RNA, 22 nt, Homo sapiens
uaaugugaauagugcuguaaug

SEQ ID NO: 179857 - RNA, 22 nt, Homo sapiens
uacaagcaggaaaugguauaug

SEQ ID NO: 179858 - RNA, 22 nt, Homo sapiens
uacaaguaauaagggaagaauu

SEQ ID NO: 179859 - RNA, 22 nt, Homo sapiens
uacacagucaaaaauuuccagg

SEQ ID NO: 179860 - RNA, 22 nt, Homo sapiens
uacaccaauuuaaucaaaagca

SEQ ID NO: 179861 - RNA, 22 nt, Homo sapiens
uacagaauucugucccuugagu

SEQ ID NO: 179862 - RNA, 22 nt, Homo sapiens
uacagaguagaagauuugcaga

SEQ ID NO: 179863 - RNA, 22 nt, Homo sapiens
uacagccacauaauguaugauu

SEQ ID NO: 179864 - RNA, 22 nt, Homo sapiens
uacagcuaugugcaugcaugcu

SEQ ID NO: 179865 - RNA, 22 nt, Homo sapiens
uacaggauagacaauuuauuaa

SEQ ID NO: 179866 - RNA, 22 nt, Homo sapiens
uacaggcagguguucccugguu

SEQ ID NO: 179867 - RNA, 22 nt, Homo sapiens
uacagguauagauguguguucu

SEQ ID NO: 179868 - RNA, 22 nt, Homo sapiens
uacaggugcucuacagacagga

SEQ ID NO: 179869 - RNA, 22 nt, Homo sapiens
uacaggugcuuauguggacaua

SEQ ID NO: 179870 - RNA, 22 nt, Homo sapiens
auuugucacuauguggcuaaua

SEQ ID NO: 179871 - RNA, 22 nt, Homo sapiens
ucugcauaucaugcagaacuau

SEQ ID NO: 179872 - RNA, 22 nt, Homo sapiens
ucugccacugucauugugugau

SEQ ID NO: 179873 - RNA, 22 nt, Homo sapiens
ucugccuacugguuggaggaac

SEQ ID NO: 179874 - RNA, 22 nt, Homo sapiens
ucuggcaagauauccauugcuu

SEQ ID NO: 179875 - RNA, 22 nt, Homo sapiens
ucuggcacucagaggccuugcu

SEQ ID NO: 179876 - RNA, 20 nt, Homo sapiens
ucuggccccucuaaaucuca

SEQ ID NO: 179877 - RNA, 22 nt, Homo sapiens
ucuggccuacaaguaauuuuau

SEQ ID NO: 179878 - RNA, 22 nt, Homo sapiens
ucuggccuccuaugagaaucga

SEQ ID NO: 179879 - RNA, 22 nt, Homo sapiens
ucuggcuuuuaacaucuauaaa

SEQ ID NO: 179880 - RNA, 22 nt, Homo sapiens
ucugucacugguggacgaucac

SEQ ID NO: 179881 - RNA, 22 nt, Homo sapiens
ucugucuuugucaggaccagag

SEQ ID NO: 179882 - RNA, 22 nt, Homo sapiens
ucugugaaugaacacuugaaaa

SEQ ID NO: 179883 - RNA, 22 nt, Homo sapiens
ucugugcauuacacuuuucuca

SEQ ID NO: 179884 - RNA, 22 nt, Homo sapiens
ucugugguucaggcuggagugc

SEQ ID NO: 179885 - RNA, 22 nt, Homo sapiens
ucugugguuguugcauggaaug

SEQ ID NO: 179886 - RNA, 22 nt, Homo sapiens
ucuguguuugaucaagauugua

SEQ ID NO: 179887 - RNA, 22 nt, Homo sapiens
ucuucagucauauuggccugga

SEQ ID NO: 179888 - RNA, 22 nt, Homo sapiens
ucuucaugcuugaaauaauagc

SEQ ID NO: 179889 - RNA, 22 nt, Homo sapiens
ucuugcacaaauuauuuuaacu

SEQ ID NO: 179890 - RNA, 19 nt, Homo sapiens
ucuugcacaugugaacuca

SEQ ID NO: 179891 - RNA, 22 nt, Homo sapiens
ucuuggcauggcugaagauucc

SEQ ID NO: 179892 - RNA, 20 nt, Homo sapiens
ucuugggaauguagccuagg

SEQ ID NO: 179893 - RNA, 21 nt, Homo sapiens
ucuugguauguauuuaggagg

SEQ ID NO: 179894 - RNA, 22 nt, Homo sapiens
ucuugucacugcauccccagcu

SEQ ID NO: 179895 - RNA, 17 nt, Homo sapiens
ucuugugguucuugaau

SEQ ID NO: 179896 - RNA, 19 nt, Homo sapiens
ucuuuagucacauuuuuau

SEQ ID NO: 179897 - RNA, 22 nt, Homo sapiens
ucuuuaguuaagggacauuuua

SEQ ID NO: 179898 - RNA, 22 nt, Homo sapiens
ucuuugagugcccugagucccu

SEQ ID NO: 179899 - RNA, 22 nt, Homo sapiens
ucuuugccuaacccaaggucau

SEQ ID NO: 179900 - RNA, 22 nt, Homo sapiens
ucuuuggauggaaauuggaguc

SEQ ID NO: 179901 - RNA, 22 nt, Homo sapiens
ucuuuggguguauuucacagcc

SEQ ID NO: 179902 - RNA, 21 nt, Homo sapiens
ucuuuggucaccaguuuucau

SEQ ID NO: 179903 - RNA, 22 nt, Homo sapiens
ucuuuguuagaacccucuccuu

SEQ ID NO: 179904 - RNA, 22 nt, Homo sapiens
ucuuuuguaaaaugaggaggug

SEQ ID NO: 179905 - RNA, 22 nt, Homo sapiens
ugaaacacacauugcccuuuau

SEQ ID NO: 179906 - RNA, 22 nt, Homo sapiens
ugaaacacaccuccucuccauc

SEQ ID NO: 179907 - RNA, 22 nt, Homo sapiens
ugaaacauacacucugaugggg

SEQ ID NO: 179908 - RNA, 22 nt, Homo sapiens
ugaaagguuuaauucugugaga

SEQ ID NO: 179909 - RNA, 22 nt, Homo sapiens
ugaaaguaauugcaguuuuuac

SEQ ID NO: 179910 - RNA, 22 nt, Homo sapiens
ugaaaguuauauugugaaauuc

SEQ ID NO: 179911 - RNA, 20 nt, Homo sapiens
ugaaaucuucacuaagucuc

SEQ ID NO: 179912 - RNA, 22 nt, Homo sapiens
ugaaaugaucaguuugguuacu

SEQ ID NO: 179913 - RNA, 21 nt, Homo sapiens
ugaaaugcaugugcacauuaa

SEQ ID NO: 179914 - RNA, 22 nt, Homo sapiens
ugaaaugcugucuaggggaaau

SEQ ID NO: 179915 - RNA, 22 nt, Homo sapiens
ugaaauggaaagaguguagacu

SEQ ID NO: 179916 - RNA, 22 nt, Homo sapiens
ugaaauguaaguugucuagucu

SEQ ID NO: 179917 - RNA, 22 nt, Homo sapiens
ugaaauguuaaacaaguggcuc

SEQ ID NO: 179918 - RNA, 22 nt, Homo sapiens
ugaaauuguuugcaaggauagg

SEQ ID NO: 179919 - RNA, 22 nt, Homo sapiens
ugaaauuuuuuauucguuggcu

SEQ ID NO: 179920 - RNA, 22 nt, Homo sapiens
ugaacagucaucucucuuguau

SEQ ID NO: 179921 - RNA, 22 nt, Homo sapiens
ugaacucagcauccagggccaa

SEQ ID NO: 179922 - RNA, 22 nt, Homo sapiens
ugaacuguaagguauaggugau

SEQ ID NO: 179923 - RNA, 22 nt, Homo sapiens
ugaagaucuuaggagcugaggg

SEQ ID NO: 179924 - RNA, 22 nt, Homo sapiens
ugaagcuaacuugauugugaug

SEQ ID NO: 179925 - RNA, 22 nt, Homo sapiens
ugaaggcaggagggagaaaagu

SEQ ID NO: 179926 - RNA, 22 nt, Homo sapiens
ugaagggcauuguuuugccaaa

SEQ ID NO: 179927 - RNA, 22 nt, Homo sapiens
ugaaguaggcauaaguuaagcu

SEQ ID NO: 179928 - RNA, 22 nt, Homo sapiens
ugaagugaagcaguaguguggg

SEQ ID NO: 179929 - RNA, 22 nt, Homo sapiens
ugaaguguuuuuucaggcaugu

SEQ ID NO: 179930 - RNA, 22 nt, Homo sapiens
ugaauaguuugacagaacucuu

SEQ ID NO: 179931 - RNA, 22 nt, Homo sapiens
ugaaucauuucuugucuucagu

SEQ ID NO: 179932 - RNA, 22 nt, Homo sapiens
ugaauguaagaugucugcuggu

SEQ ID NO: 179933 - RNA, 22 nt, Homo sapiens
ugaauguacacgcguacuuguu

SEQ ID NO: 179934 - RNA, 22 nt, Homo sapiens
ugaauucuguccaaaauaacug

SEQ ID NO: 179935 - RNA, 22 nt, Homo sapiens
ugacaagaacuuuccauaguaa

SEQ ID NO: 179936 - RNA, 22 nt, Homo sapiens
ugacaagacuacauaucccauu

SEQ ID NO: 179937 - RNA, 22 nt, Homo sapiens
ugacaagagaccccuccgcagg

SEQ ID NO: 179938 - RNA, 22 nt, Homo sapiens
ugacaaguaaacagucagcacc

SEQ ID NO: 179939 - RNA, 22 nt, Homo sapiens
ugacagagcaggacuucaucuc

SEQ ID NO: 179940 - RNA, 22 nt, Homo sapiens
ugacagaggucuuuuaauagcu

SEQ ID NO: 179941 - RNA, 22 nt, Homo sapiens
ugacagcugaagauguugaacc

SEQ ID NO: 179942 - RNA, 22 nt, Homo sapiens
ugacagugaacagguuaccacu

SEQ ID NO: 179943 - RNA, 18 nt, Homo sapiens
ugacaguuucuuuauauu

SEQ ID NO: 179944 - RNA, 22 nt, Homo sapiens
ugacaugaagaaaaacagauuu

SEQ ID NO: 179945 - RNA, 22 nt, Homo sapiens
ugacaugauuguauauuuagaa

SEQ ID NO: 179946 - RNA, 22 nt, Homo sapiens
ugacauggagagagaagccuuu

SEQ ID NO: 179947 - RNA, 22 nt, Homo sapiens
ugacauguauuagcucagugcu

SEQ ID NO: 179948 - RNA, 22 nt, Homo sapiens
ugacauuacagucacuugcugu

SEQ ID NO: 179949 - RNA, 22 nt, Homo sapiens
ugaccucugauagcaguaggug

SEQ ID NO: 179950 - RNA, 22 nt, Homo sapiens
ugacuacacacaauuugucaag

SEQ ID NO: 179951 - RNA, 22 nt, Homo sapiens
ugacuaggaggcuggaggauga

SEQ ID NO: 179952 - RNA, 22 nt, Homo sapiens
ugacuauaggauaacaugcauu

SEQ ID NO: 179953 - RNA, 22 nt, Homo sapiens
ugacucaagagccugacucauc

SEQ ID NO: 179954 - RNA, 22 nt, Homo sapiens
ugacucgaggcgccuccagucc

SEQ ID NO: 179955 - RNA, 22 nt, Homo sapiens
ugacucuagagcugccuguggc

SEQ ID NO: 179956 - RNA, 22 nt, Homo sapiens
ugacugaguaguauuccacuau

SEQ ID NO: 179957 - RNA, 22 nt, Homo sapiens
ugacuggagaccucaguagggu

SEQ ID NO: 179958 - RNA, 22 nt, Homo sapiens
ugacugucuagauagagcuugg

SEQ ID NO: 179959 - RNA, 22 nt, Homo sapiens
ugacuucagacugaaaugauuc

SEQ ID NO: 179960 - RNA, 22 nt, Homo sapiens
ugacuucauuuuuggccaugag

SEQ ID NO: 179961 - RNA, 22 nt, Homo sapiens
ugacuugaaacgugaacagauc

SEQ ID NO: 179962 - RNA, 22 nt, Homo sapiens
ugacuugaacuucuaugucacc

SEQ ID NO: 179963 - RNA, 22 nt, Homo sapiens
ugacuugauccauggggcucca

SEQ ID NO: 179964 - RNA, 22 nt, Homo sapiens
ugacuuuagaauuuuauccaga

SEQ ID NO: 179965 - RNA, 22 nt, Homo sapiens
ugagaacagcagcuugggacac

SEQ ID NO: 179966 - RNA, 16 nt, Homo sapiens
ugagaacaugugacau

SEQ ID NO: 179967 - RNA, 16 nt, Homo sapiens
ugagaacaugugauau

SEQ ID NO: 179968 - RNA, 20 nt, Homo sapiens
ugagaacaugugguauuugg

SEQ ID NO: 179969 - RNA, 22 nt, Homo sapiens
ugagaacucaugaaucuuucca

SEQ ID NO: 179970 - RNA, 22 nt, Homo sapiens
ugagaacucaugggucugcugg

SEQ ID NO: 179971 - RNA, 22 nt, Homo sapiens
ugagaauauuuuccaugucuca

SEQ ID NO: 179972 - RNA, 22 nt, Homo sapiens
ugagaaugaugauugguaaacc

SEQ ID NO: 179973 - RNA, 22 nt, Homo sapiens
ugagacaaaguuguuggauguu

SEQ ID NO: 179974 - RNA, 22 nt, Homo sapiens
ugagacaugugaacuguaguuc

SEQ ID NO: 179975 - RNA, 22 nt, Homo sapiens
ugagaccugaucuugguacugc

SEQ ID NO: 179976 - RNA, 22 nt, Homo sapiens
ugagacgaagucucguucugua

SEQ ID NO: 179977 - RNA, 22 nt, Homo sapiens
ugagacgucuucucuucuucaa

SEQ ID NO: 179978 - RNA, 22 nt, Homo sapiens
ugagacugaguuucacuuuugu

SEQ ID NO: 179979 - RNA, 22 nt, Homo sapiens
ugagacugaguuuugccuuugu

SEQ ID NO: 179980 - RNA, 22 nt, Homo sapiens
ugucaaauucuggguuaaaaca

SEQ ID NO: 179981 - RNA, 20 nt, Homo sapiens
ugucaaggaauucccaaauc

SEQ ID NO: 179982 - RNA, 22 nt, Homo sapiens
ugucaaugggaauuuguuuuag

SEQ ID NO: 179983 - RNA, 22 nt, Homo sapiens
ugucacagagauuuugguaugu

SEQ ID NO: 179984 - RNA, 22 nt, Homo sapiens
ugucacauccaagaaggugcag

SEQ ID NO: 179985 - RNA, 18 nt, Homo sapiens
ugucacuggauaaugguc

SEQ ID NO: 179986 - RNA, 22 nt, Homo sapiens
ugucaggaggguccagagaaaa

SEQ ID NO: 179987 - RNA, 22 nt, Homo sapiens
ugucaguguacuguaagaauua

SEQ ID NO: 179988 - RNA, 22 nt, Homo sapiens
ugucaguguaugagccccggau

SEQ ID NO: 179989 - RNA, 23 nt, Homo sapiens
ugucaucaagaugaggucacacu

SEQ ID NO: 179990 - RNA, 22 nt, Homo sapiens
ugucauggcauuuguaaacugc

SEQ ID NO: 179991 - RNA, 22 nt, Homo sapiens
ugucauggugcucugggcccug

SEQ ID NO: 179992 - RNA, 22 nt, Homo sapiens
ugucauguuucuacugaccaaa

SEQ ID NO: 179993 - RNA, 20 nt, Homo sapiens
ugucauuaagcacugugcca

SEQ ID NO: 179994 - RNA, 22 nt, Homo sapiens
ugucauucaggaaauucuaagu

SEQ ID NO: 179995 - RNA, 22 nt, Homo sapiens
uguccaaaucagagguaccaaa

SEQ ID NO: 179996 - RNA, 22 nt, Homo sapiens
uguccaaauugaaucaucuggu

SEQ ID NO: 179997 - RNA, 20 nt, Homo sapiens
ugucccaaccccauggguuc

SEQ ID NO: 179998 - RNA, 18 nt, Homo sapiens
ugucccuuugcuguucau

SEQ ID NO: 179999 - RNA, 22 nt, Homo sapiens
uguccuguaggaggcagaacaa

SEQ ID NO: 180000 - RNA, 22 nt, Homo sapiens
ugucuacugaugauguaguuaa

SEQ ID NO: 180001 - RNA, 22 nt, Homo sapiens
ugucuagaucugaauguaauug

SEQ ID NO: 180002 - RNA, 22 nt, Homo sapiens
ugucucccuucccauuaggaag

SEQ ID NO: 180003 - RNA, 22 nt, Homo sapiens
ugucuuggagaauccuggguuu

SEQ ID NO: 180004 - RNA, 22 nt, Homo sapiens
ugugaacaaaauuuguugcaua

SEQ ID NO: 180005 - RNA, 22 nt, Homo sapiens
ugugaacagaauuagucaccua

SEQ ID NO: 180006 - RNA, 19 nt, Homo sapiens
ugugaacaucacagagugu

SEQ ID NO: 180007 - RNA, 22 nt, Homo sapiens
ugugaacaugacagugggcuag

SEQ ID NO: 180008 - RNA, 22 nt, Homo sapiens
ugugaagauggacuaauauagu

SEQ ID NO: 180009 - RNA, 22 nt, Homo sapiens
ugugacagcacagcaucucuuu

SEQ ID NO: 180010 - RNA, 18 nt, Homo sapiens
ugugacauugagcauguc

SEQ ID NO: 180011 - RNA, 21 nt, Homo sapiens
ugugaccucugucucugaguc

SEQ ID NO: 180012 - RNA, 22 nt, Homo sapiens
ugugacuaguggugaaugacgc

SEQ ID NO: 180013 - RNA, 22 nt, Homo sapiens
ugugacucuggcacauggugag

SEQ ID NO: 180014 - RNA, 22 nt, Homo sapiens
ugugacugguugucccacuuuc

SEQ ID NO: 180015 - RNA, 22 nt, Homo sapiens
ugugagacugguucugaaccca

SEQ ID NO: 180016 - RNA, 22 nt, Homo sapiens
ugugauaguuggcuaaagcagu

SEQ ID NO: 180017 - RNA, 22 nt, Homo sapiens
ugugaucaauuagugaugucug

SEQ ID NO: 180018 - RNA, 22 nt, Homo sapiens
ugugaucaugugugccuuaguc

SEQ ID NO: 180019 - RNA, 22 nt, Homo sapiens
ugugaugcagggccugggccuc

SEQ ID NO: 180020 - RNA, 18 nt, Homo sapiens
ugugauggauauguuaau

SEQ ID NO: 180021 - RNA, 22 nt, Homo sapiens
ugugauguggagggcagaucca

SEQ ID NO: 180022 - RNA, 22 nt, Homo sapiens
ugugcaaucuuccauuuuuagg

SEQ ID NO: 180023 - RNA, 22 nt, Homo sapiens
ugugcacaacaugcagguuugu

SEQ ID NO: 180024 - RNA, 22 nt, Homo sapiens
ugugcauaugucuuuauaguag

SEQ ID NO: 180025 - RNA, 22 nt, Homo sapiens
ugugccacuccagcucuagcuu

SEQ ID NO: 180026 - RNA, 22 nt, Homo sapiens
ugugccacugcacucccgccug

SEQ ID NO: 180027 - RNA, 22 nt, Homo sapiens
ugugccacugcacuucagccug

SEQ ID NO: 180028 - RNA, 22 nt, Homo sapiens
ugugccuacugauagagccaag

SEQ ID NO: 180029 - RNA, 22 nt, Homo sapiens
ugugcuaauacauacagugcua

SEQ ID NO: 180030 - RNA, 22 nt, Homo sapiens
ugugcuauguuauucacauggg

SEQ ID NO: 180031 - RNA, 22 nt, Homo sapiens
ugugcuugaauuuaguagcuua

SEQ ID NO: 180032 - RNA, 22 nt, Homo sapiens
uguggaguguaugugacagaga

SEQ ID NO: 180033 - RNA, 22 nt, Homo sapiens
uguggcauuuucagaaaggaug

SEQ ID NO: 180034 - RNA, 22 nt, Homo sapiens
uguggccccuagcuacuagaga

SEQ ID NO: 180035 - RNA, 17 nt, Homo sapiens
uguggcucuuaugcuga

SEQ ID NO: 180036 - RNA, 22 nt, Homo sapiens
uguggcugguggcaccuuuucc

SEQ ID NO: 180037 - RNA, 22 nt, Homo sapiens
uguggcuuuacagcaugguuca

SEQ ID NO: 180038 - RNA, 22 nt, Homo sapiens
uguggucaucacuugaagguaa

SEQ ID NO: 180039 - RNA, 19 nt, Homo sapiens
uguggucauccugggacga

SEQ ID NO: 180040 - RNA, 22 nt, Homo sapiens
ugugguuuuucacauuuagaga

SEQ ID NO: 180041 - RNA, 22 nt, Homo sapiens
uguguaaauaugauagaggaau

SEQ ID NO: 180042 - RNA, 22 nt, Homo sapiens
uguguaauaccuuugacuauau

SEQ ID NO: 180043 - RNA, 22 nt, Homo sapiens
uguguauaucacugcaugagug

SEQ ID NO: 180044 - RNA, 22 nt, Homo sapiens
ugugucuugaauuuuguaugua

SEQ ID NO: 180045 - RNA, 22 nt, Homo sapiens
ugugucuuguuuuuucccaggc

SEQ ID NO: 180046 - RNA, 21 nt, Homo sapiens
uguuaacaugcagauuacugg

SEQ ID NO: 180047 - RNA, 22 nt, Homo sapiens
uguuacagcagaauugaaagag

SEQ ID NO: 180048 - RNA, 22 nt, Homo sapiens
uguuacagcagcacaaaaugga

SEQ ID NO: 180049 - RNA, 22 nt, Homo sapiens
uguuauugagguuacuuauaag

SEQ ID NO: 180050 - RNA, 22 nt, Homo sapiens
uguuauuuuguguuagggcaca

SEQ ID NO: 180051 - RNA, 19 nt, Homo sapiens
uguugcacauaucaauaug

SEQ ID NO: 180052 - RNA, 22 nt, Homo sapiens
uguuugguggucucuucacaug

SEQ ID NO: 180053 - RNA, 22 nt, Homo sapiens
uuaaaaguauaggccuggcaua

SEQ ID NO: 180054 - RNA, 22 nt, Homo sapiens
uuaaaggcauguacacuagagu

SEQ ID NO: 180055 - RNA, 22 nt, Homo sapiens
uuaaaguauaguuccucugguu

SEQ ID NO: 180056 - RNA, 22 nt, Homo sapiens
uuaaaguguuugcagacaggug

SEQ ID NO: 180057 - RNA, 22 nt, Homo sapiens
uuaaaugucuguagaugugcug

SEQ ID NO: 180058 - RNA, 22 nt, Homo sapiens
uuaagccacucaagagauagag

SEQ ID NO: 180059 - RNA, 22 nt, Homo sapiens
uugaagacuauaugauucuuca

SEQ ID NO: 180060 - RNA, 22 nt, Homo sapiens
uugaaggaggugcucacucucg

SEQ ID NO: 180061 - RNA, 22 nt, Homo sapiens
uugaaguagcauuucaugucua

SEQ ID NO: 180062 - RNA, 22 nt, Homo sapiens
uugaauaggcucaugcuuauca

SEQ ID NO: 180063 - RNA, 22 nt, Homo sapiens
uugaaugaaaugaugucauuug

SEQ ID NO: 180064 - RNA, 22 nt, Homo sapiens
uugaaugaauggaaagaagggu

SEQ ID NO: 180065 - RNA, 17 nt, Homo sapiens
uugaaugcauuacuugg

SEQ ID NO: 180066 - RNA, 22 nt, Homo sapiens
uugaauggaauguuggaacuau

SEQ ID NO: 180067 - RNA, 22 nt, Homo sapiens
uugaauguacuuguucucacua

SEQ ID NO: 180068 - RNA, 22 nt, Homo sapiens
uugaauguaugcuggguuuacu

SEQ ID NO: 180069 - RNA, 22 nt, Homo sapiens
uugaaugucuauuaaguuguuu

SEQ ID NO: 180070 - RNA, 22 nt, Homo sapiens
uugacacuuuguaagaaagggg

SEQ ID NO: 180071 - RNA, 21 nt, Homo sapiens
uugacagugacagguaaaguu

SEQ ID NO: 180072 - RNA, 20 nt, Homo sapiens
uugacaguggguuguuaaag

SEQ ID NO: 180073 - RNA, 22 nt, Homo sapiens
uugacauaguuucugaaauaga

SEQ ID NO: 180074 - RNA, 22 nt, Homo sapiens
uugacauugcuguaguguccag

SEQ ID NO: 180075 - RNA, 22 nt, Homo sapiens
uugaccucaucacuucccaaag

SEQ ID NO: 180076 - RNA, 22 nt, Homo sapiens
uugacuuagacauucaguugga

SEQ ID NO: 180077 - RNA, 22 nt, Homo sapiens
uugagaagugucuguucauguc

SEQ ID NO: 180078 - RNA, 21 nt, Homo sapiens
uugagacggagucucacucug

SEQ ID NO: 180079 - RNA, 22 nt, Homo sapiens
uugagacggaguuuugcucuug

SEQ ID NO: 180080 - RNA, 22 nt, Homo sapiens
uugagacugaacauuuguguac

SEQ ID NO: 180081 - RNA, 22 nt, Homo sapiens
uugagacugagucucgcccugu

SEQ ID NO: 180082 - RNA, 22 nt, Homo sapiens
uugagauaggagcuguuguucu

SEQ ID NO: 180083 - RNA, 22 nt, Homo sapiens
uugagauagggucuaccucugu

SEQ ID NO: 180084 - RNA, 22 nt, Homo sapiens
uugagauauccauaaaugggaa

SEQ ID NO: 180085 - RNA, 22 nt, Homo sapiens
uugagaugaagucuugcucucu

SEQ ID NO: 180086 - RNA, 22 nt, Homo sapiens
uugagaugaaguuuugcucuuu

SEQ ID NO: 180087 - RNA, 22 nt, Homo sapiens
uugagauggagcuucacucuug

SEQ ID NO: 180088 - RNA, 22 nt, Homo sapiens
uugagauggagucucacuccuu

SEQ ID NO: 180089 - RNA, 22 nt, Homo sapiens
uugagauggagucucgcacugu

SEQ ID NO: 180090 - RNA, 22 nt, Homo sapiens
uugagauggagucuugcacugu

SEQ ID NO: 180091 - RNA, 22 nt, Homo sapiens
uugagauggagucuuguucucu

SEQ ID NO: 180092 - RNA, 22 nt, Homo sapiens
uugagauggagucuuguucuuu

SEQ ID NO: 180093 - RNA, 22 nt, Homo sapiens
uugagauggaguuucaauauug

SEQ ID NO: 180094 - RNA, 22 nt, Homo sapiens
uugagauggaguuucgcucuug

SEQ ID NO: 180095 - RNA, 22 nt, Homo sapiens
uugagauggaguuuugcucuug

SEQ ID NO: 180096 - RNA, 22 nt, Homo sapiens
uugagauguggcaguuuaugag

SEQ ID NO: 180097 - RNA, 22 nt, Homo sapiens
uugagcaaaacauuaauauuag

SEQ ID NO: 180098 - RNA, 22 nt, Homo sapiens
uugagcacauguguuaaggggu

SEQ ID NO: 180099 - RNA, 22 nt, Homo sapiens
uugagcaccaugccuggccaug

SEQ ID NO: 180100 - RNA, 22 nt, Homo sapiens
uugagcauugguauagguuuua

SEQ ID NO: 180101 - RNA, 22 nt, Homo sapiens
uugagcccuggagguggaggcu

SEQ ID NO: 180102 - RNA, 22 nt, Homo sapiens
uugagcucaucaagauagagaa

SEQ ID NO: 180103 - RNA, 22 nt, Homo sapiens
uugaggacugagacagaccaag

SEQ ID NO: 180104 - RNA, 22 nt, Homo sapiens
uugaggaguacugauuagguau

SEQ ID NO: 180105 - RNA, 22 nt, Homo sapiens
uugaggcaaugaggagaagcug

SEQ ID NO: 180106 - RNA, 22 nt, Homo sapiens
uugaggcuuuugaccucaugug

SEQ ID NO: 180107 - RNA, 22 nt, Homo sapiens
uugaggguggcauauauugauu

SEQ ID NO: 180108 - RNA, 22 nt, Homo sapiens
uugagguagcuuugauggaggu

SEQ ID NO: 180109 - RNA, 22 nt, Homo sapiens
uugagguauugauaaaacauuu

SEQ ID NO: 180110 - RNA, 20 nt, Homo sapiens
uugaggugugaggggcagag

SEQ ID NO: 180111 - RNA, 22 nt, Homo sapiens
uugaguaguaagaagaugauag

SEQ ID NO: 180112 - RNA, 22 nt, Homo sapiens
uugagugaaugaaugauuaaau

SEQ ID NO: 180113 - RNA, 22 nt, Homo sapiens
uugaguuuaucuaaagaccugg

SEQ ID NO: 180114 - RNA, 22 nt, Homo sapiens
uugauaagaaaaauauaccaga

SEQ ID NO: 180115 - RNA, 22 nt, Homo sapiens
uugauaagaaaugccaguuugg

SEQ ID NO: 180116 - RNA, 22 nt, Homo sapiens
uugauagacacauauccaugug

SEQ ID NO: 180117 - RNA, 22 nt, Homo sapiens
uugauaguccuguaucuauuuu

SEQ ID NO: 180118 - RNA, 22 nt, Homo sapiens
uugauaugaauggcuguuugug

SEQ ID NO: 180119 - RNA, 22 nt, Homo sapiens
uugauaugguauaagauuucau

SEQ ID NO: 180120 - RNA, 22 nt, Homo sapiens
uugauauguggaauauuuaucu

SEQ ID NO: 180121 - RNA, 22 nt, Homo sapiens
uugauauguuguuagauucagu

SEQ ID NO: 180122 - RNA, 22 nt, Homo sapiens
uugauauuacucaguaacagau

SEQ ID NO: 180123 - RNA, 22 nt, Homo sapiens
uugaucaauagaauacaacaga

SEQ ID NO: 180124 - RNA, 22 nt, Homo sapiens
uugaucaucagcuuugucaucu

SEQ ID NO: 180125 - RNA, 22 nt, Homo sapiens
uugaucugugucccugcccaau

SEQ ID NO: 180126 - RNA, 22 nt, Homo sapiens
uugaucuguguuagaagcuaag

SEQ ID NO: 180127 - RNA, 22 nt, Homo sapiens
uugaugauguuucugccuugcc

SEQ ID NO: 180128 - RNA, 22 nt, Homo sapiens
uugcaacauguauucuggugau

SEQ ID NO: 180129 - RNA, 22 nt, Homo sapiens
uugcacaauccugugagugagu

SEQ ID NO: 180130 - RNA, 22 nt, Homo sapiens
uugcacaauggaauuuaucuuu

SEQ ID NO: 180131 - RNA, 22 nt, Homo sapiens
uugcacauggcuggggaggccu

SEQ ID NO: 180132 - RNA, 22 nt, Homo sapiens
uugcacauguugaaccagcaaa

SEQ ID NO: 180133 - RNA, 19 nt, Homo sapiens
ucccuuuguauggacauac

SEQ ID NO: 180134 - RNA, 22 nt, Homo sapiens
ucccuuuguccaacggauccac

SEQ ID NO: 180135 - RNA, 22 nt, Homo sapiens
uccugagaauagaguugcaugu

SEQ ID NO: 180136 - RNA, 22 nt, Homo sapiens
uccugagacugaggagcuuugg

SEQ ID NO: 180137 - RNA, 22 nt, Homo sapiens
uccugcauucugacuugcuuuc

SEQ ID NO: 180138 - RNA, 22 nt, Homo sapiens
uccuugaaacaggaagaauuca

SEQ ID NO: 180139 - RNA, 22 nt, Homo sapiens
uccuugagaggacagagccaua

SEQ ID NO: 180140 - RNA, 22 nt, Homo sapiens
uccuuuagacugaauccugaga

SEQ ID NO: 180141 - RNA, 22 nt, Homo sapiens
uccuuuggcuaacuuucuaagu

SEQ ID NO: 180142 - RNA, 22 nt, Homo sapiens
uccuuuguuacaguuggcucug

SEQ ID NO: 180143 - RNA, 22 nt, Homo sapiens
ucgcauuucccucuguagcuuc

SEQ ID NO: 180144 - RNA, 22 nt, Homo sapiens
ucgcgccauucuccugccucag

SEQ ID NO: 180145 - RNA, 22 nt, Homo sapiens
ucuaaaacuagauugugaugau

SEQ ID NO: 180146 - RNA, 19 nt, Homo sapiens
ucuaaaucucuugauagac

SEQ ID NO: 180147 - RNA, 22 nt, Homo sapiens
ucuacagccaguucaggaagaa

SEQ ID NO: 180148 - RNA, 22 nt, Homo sapiens
ucuaugguuuauuuccaagugu

SEQ ID NO: 180149 - RNA, 22 nt, Homo sapiens
ucucaaccucccaaguagcugg

SEQ ID NO: 180150 - RNA, 22 nt, Homo sapiens
ucucacaccccucucauauacc

SEQ ID NO: 180151 - RNA, 22 nt, Homo sapiens
ucucacacugaauguguguggg

SEQ ID NO: 180152 - RNA, 18 nt, Homo sapiens
ucucacagcaaucuguca

SEQ ID NO: 180153 - RNA, 22 nt, Homo sapiens
ucucacagccauuucucccucu

SEQ ID NO: 180154 - RNA, 22 nt, Homo sapiens
ucucagagccuaggguuuuuca

SEQ ID NO: 180155 - RNA, 22 nt, Homo sapiens
ugaauuguuucauucuuuacau

SEQ ID NO: 180156 - RNA, 22 nt, Homo sapiens
ugacaacugauuaacuccuuua

SEQ ID NO: 180157 - RNA, 20 nt, Homo sapiens
ugacaaggugcaaagaauca

SEQ ID NO: 180158 - RNA, 19 nt, Homo sapiens
ugacacuguuggugggagg

SEQ ID NO: 180159 - RNA, 21 nt, Homo sapiens
ugacagaaaauugaguuugcu

SEQ ID NO: 180160 - RNA, 22 nt, Homo sapiens
ugacagagaagcauugaguuca

SEQ ID NO: 180161 - RNA, 22 nt, Homo sapiens
ugacagguugauaggugcagca

SEQ ID NO: 180162 - RNA, 22 nt, Homo sapiens
ugacagguuggaauuaugggag

SEQ ID NO: 180163 - RNA, 23 nt, Homo sapiens
ugacagucucccgauggcuaggc

SEQ ID NO: 180164 - RNA, 22 nt, Homo sapiens
ugacaguguccucauucccaac

SEQ ID NO: 180165 - RNA, 22 nt, Homo sapiens
ugacaguguccuccuccugaga

SEQ ID NO: 180166 - RNA, 22 nt, Homo sapiens
ugacagugugagacuuugucuc

SEQ ID NO: 180167 - RNA, 22 nt, Homo sapiens
ugacaucaccaccuccgucauc

SEQ ID NO: 180168 - RNA, 20 nt, Homo sapiens
ugacaucagcaauguaauaa

SEQ ID NO: 180169 - RNA, 18 nt, Homo sapiens
ugacaucauuuagaaagg

SEQ ID NO: 180170 - RNA, 19 nt, Homo sapiens
ugacaugaaacccaagauc

SEQ ID NO: 180171 - RNA, 22 nt, Homo sapiens
ugacaugaaggcaccucugucc

SEQ ID NO: 180172 - RNA, 22 nt, Homo sapiens
ugacaugaugagcaauaauggc

SEQ ID NO: 180173 - RNA, 22 nt, Homo sapiens
ugacauggagguggaggaagau

SEQ ID NO: 180174 - RNA, 22 nt, Homo sapiens
ugacauggugcucuuucaggca

SEQ ID NO: 180175 - RNA, 21 nt, Homo sapiens
ugacauguugguguucugcac

SEQ ID NO: 180176 - RNA, 21 nt, Homo sapiens
ugacauguugguuugcugcac

SEQ ID NO: 180177 - RNA, 22 nt, Homo sapiens
ugaccacugucuaagauaggug

SEQ ID NO: 180178 - RNA, 19 nt, Homo sapiens
ugaccagggacagaaacca

SEQ ID NO: 180179 - RNA, 22 nt, Homo sapiens
ugacccuguggcagcgucuaag

SEQ ID NO: 180180 - RNA, 22 nt, Homo sapiens
ugacuacagauuugcugccaga

SEQ ID NO: 180181 - RNA, 22 nt, Homo sapiens
ugacuacaggucaggaagcugu

SEQ ID NO: 180182 - RNA, 21 nt, Homo sapiens
ugacuagauuccagauuggcc

SEQ ID NO: 180183 - RNA, 22 nt, Homo sapiens
ugacuauaaauaagcaagggcu

SEQ ID NO: 180184 - RNA, 22 nt, Homo sapiens
ugacucagauagguguguauuc

SEQ ID NO: 180185 - RNA, 22 nt, Homo sapiens
ugacucaguuguuagucuucau

SEQ ID NO: 180186 - RNA, 22 nt, Homo sapiens
ugacuccagagacugugcuguc

SEQ ID NO: 180187 - RNA, 22 nt, Homo sapiens
ugacuggaacuuuagugagucu

SEQ ID NO: 180188 - RNA, 23 nt, Homo sapiens
ugacuggagacuguugauccuuu

SEQ ID NO: 180189 - RNA, 22 nt, Homo sapiens
ugacuggagucuugcucugucg

SEQ ID NO: 180190 - RNA, 18 nt, Homo sapiens
ugacuguccagguggacc

SEQ ID NO: 180191 - RNA, 22 nt, Homo sapiens
ugacuuaugcaacucugaugug

SEQ ID NO: 180192 - RNA, 22 nt, Homo sapiens
ugacuugauacauguuuuugaa

SEQ ID NO: 180193 - RNA, 22 nt, Homo sapiens
ugacuugaucacccccuaaggg

SEQ ID NO: 180194 - RNA, 22 nt, Homo sapiens
ugagaacaugugauauuuggug

SEQ ID NO: 180195 - RNA, 19 nt, Homo sapiens
ugagaacaugugguauuug

SEQ ID NO: 180196 - RNA, 19 nt, Homo sapiens
ugagaaccucuacagaguc

SEQ ID NO: 180197 - RNA, 22 nt, Homo sapiens
ugagaacggauacuaagggcug

SEQ ID NO: 180198 - RNA, 22 nt, Homo sapiens
ugagaagacaucagcuuucgga

SEQ ID NO: 180199 - RNA, 22 nt, Homo sapiens
ugagaagugauauagaaguuaa

SEQ ID NO: 180200 - RNA, 22 nt, Homo sapiens
ugagaaugaugauuuccaguuu

SEQ ID NO: 180201 - RNA, 22 nt, Homo sapiens
ugagaaugcagaaucucgugca

SEQ ID NO: 180202 - RNA, 22 nt, Homo sapiens
ugagaauguagggcucucccag

SEQ ID NO: 180203 - RNA, 21 nt, Homo sapiens
ugagacaauccuggucaauau

SEQ ID NO: 180204 - RNA, 22 nt, Homo sapiens
ugagacacugaauccggccuga

SEQ ID NO: 180205 - RNA, 22 nt, Homo sapiens
ugagacauacuuacaggggaug

SEQ ID NO: 180206 - RNA, 22 nt, Homo sapiens
ugagaccuuucauuucucagug

SEQ ID NO: 180207 - RNA, 22 nt, Homo sapiens
ugagacggagucucgcuguguc

SEQ ID NO: 180208 - RNA, 22 nt, Homo sapiens
ugagacggaguuucacucuugu

SEQ ID NO: 180209 - RNA, 22 nt, Homo sapiens
ugagacggaguuucgcucuugu

SEQ ID NO: 180210 - RNA, 22 nt, Homo sapiens
ugagacggaguuuugcucuugu

SEQ ID NO: 180211 - RNA, 22 nt, Homo sapiens
ugagacugaaauuaggaaacug

SEQ ID NO: 180212 - RNA, 22 nt, Homo sapiens
ugagacugagucucccucuguc

SEQ ID NO: 180213 - RNA, 22 nt, Homo sapiens
ugagacugaguuuccaucuugu

SEQ ID NO: 180214 - RNA, 22 nt, Homo sapiens
ugagacugaguuucgcucuugu

SEQ ID NO: 180215 - RNA, 22 nt, Homo sapiens
ugagacugaguuucucucuugu

SEQ ID NO: 180216 - RNA, 22 nt, Homo sapiens
ugagagacaguuuguuaaaauu

SEQ ID NO: 180217 - RNA, 22 nt, Homo sapiens
ugagagaugaacuauucuugaa

SEQ ID NO: 180218 - RNA, 22 nt, Homo sapiens
ugagagaugaacucugauaugu

SEQ ID NO: 180219 - RNA, 22 nt, Homo sapiens
ugagagaugauaaaauguuugu

SEQ ID NO: 180220 - RNA, 22 nt, Homo sapiens
ugagagcugcauucuugaaagc

SEQ ID NO: 180221 - RNA, 22 nt, Homo sapiens
ugagaggugaauggcaggcuca

SEQ ID NO: 180222 - RNA, 21 nt, Homo sapiens
ugagaguaguguauuauucuc

SEQ ID NO: 180223 - RNA, 22 nt, Homo sapiens
ugagagucauacaaauaaaaau

SEQ ID NO: 180224 - RNA, 21 nt, Homo sapiens
ugagauaauauguuucugaug

SEQ ID NO: 180225 - RNA, 18 nt, Homo sapiens
ugagauacuagaauaggu

SEQ ID NO: 180226 - RNA, 22 nt, Homo sapiens
ugagaucaagguuaauauaauc

SEQ ID NO: 180227 - RNA, 22 nt, Homo sapiens
ugagaucagaaggauuucucug

SEQ ID NO: 180228 - RNA, 22 nt, Homo sapiens
ugagaucagugaagaaguguuu

SEQ ID NO: 180229 - RNA, 22 nt, Homo sapiens
ugagaucaugucauuugcacuc

SEQ ID NO: 180230 - RNA, 22 nt, Homo sapiens
ugagaucauguguggaccccag

SEQ ID NO: 180231 - RNA, 22 nt, Homo sapiens
ugagaucuuaccuuccugccuu

SEQ ID NO: 180232 - RNA, 22 nt, Homo sapiens
ugagaugagaaucaguucuaau

SEQ ID NO: 180233 - RNA, 22 nt, Homo sapiens
ugagaugauaucuuauuguaau

SEQ ID NO: 180234 - RNA, 22 nt, Homo sapiens
ugagaugaucaaaguauaggcu

SEQ ID NO: 180235 - RNA, 22 nt, Homo sapiens
ugagaugaugggauaagagggc

SEQ ID NO: 180236 - RNA, 22 nt, Homo sapiens
ugagaugauuuaauggagccca

SEQ ID NO: 180237 - RNA, 20 nt, Homo sapiens
ugagaugcauugggauguuu

SEQ ID NO: 180238 - RNA, 22 nt, Homo sapiens
ugagaugcucgccggccagcau

SEQ ID NO: 180239 - RNA, 22 nt, Homo sapiens
ugagauggaguuucacuuuugu

SEQ ID NO: 180240 - RNA, 22 nt, Homo sapiens
ugagauggaguuucgcucuugu

SEQ ID NO: 180241 - RNA, 22 nt, Homo sapiens
ugagauggaguuucgcuuuugu

SEQ ID NO: 180242 - RNA, 22 nt, Homo sapiens
gaauagugcugcaagaaacaua

SEQ ID NO: 180243 - RNA, 22 nt, Homo sapiens
gaauagugcugcaguaaacaua

SEQ ID NO: 180244 - RNA, 22 nt, Homo sapiens
gaauagugcugcgauaaacaua

SEQ ID NO: 180245 - RNA, 22 nt, Homo sapiens
gaaucacugugguaucccaugc

SEQ ID NO: 180246 - RNA, 22 nt, Homo sapiens
gaaugcuaagcaugugggaguu

SEQ ID NO: 180247 - RNA, 22 nt, Homo sapiens
gacagagcaagacccuauuuaa

SEQ ID NO: 180248 - RNA, 22 nt, Homo sapiens
gacagguuuucuguuucugaaa

SEQ ID NO: 180249 - RNA, 22 nt, Homo sapiens
gacagugugauacuuagucuca

SEQ ID NO: 180250 - RNA, 18 nt, Homo sapiens
gacaguguggugauuccu

SEQ ID NO: 180251 - RNA, 22 nt, Homo sapiens
gacaguuucucaggcuuccuua

SEQ ID NO: 180252 - RNA, 22 nt, Homo sapiens
gacauguaaggcucucucuguu

SEQ ID NO: 180253 - RNA, 22 nt, Homo sapiens
gacauguuuacaguguugagag

SEQ ID NO: 180254 - RNA, 22 nt, Homo sapiens
gacauguuuucauguauuugga

SEQ ID NO: 180255 - RNA, 20 nt, Homo sapiens
gacauguuuuguggccuaac

SEQ ID NO: 180256 - RNA, 21 nt, Homo sapiens
gaccacagcagggaaugucag

SEQ ID NO: 180257 - RNA, 22 nt, Homo sapiens
gacccuguugggguuuagggcu

SEQ ID NO: 180258 - RNA, 22 nt, Homo sapiens
gacuagaaauuauuuagugagc

SEQ ID NO: 180259 - RNA, 22 nt, Homo sapiens
gacugaggaagcgcucucuccu

SEQ ID NO: 180260 - RNA, 22 nt, Homo sapiens
gacugaguaagcagaagcaauu

SEQ ID NO: 180261 - RNA, 18 nt, Homo sapiens
gacuuggaguuuacagug

SEQ ID NO: 180262 - RNA, 22 nt, Homo sapiens
gagaacaguguuguauuuuuuc

SEQ ID NO: 180263 - RNA, 22 nt, Homo sapiens
gagaacauuaauaguuaauuuu

SEQ ID NO: 180264 - RNA, 22 nt, Homo sapiens
gagaaccauuuggagaaaaagu

SEQ ID NO: 180265 - RNA, 22 nt, Homo sapiens
gagaacuaaugauguacuaggc

SEQ ID NO: 180266 - RNA, 22 nt, Homo sapiens
gagacauguuugcuuaucugag

SEQ ID NO: 180267 - RNA, 20 nt, Homo sapiens
gagaccugagauucacucaa

SEQ ID NO: 180268 - RNA, 22 nt, Homo sapiens
gagacugagucucacucuguca

SEQ ID NO: 180269 - RNA, 22 nt, Homo sapiens
gagacugagucuugcccuguca

SEQ ID NO: 180270 - RNA, 22 nt, Homo sapiens
gagacugagucuugcucugucg

SEQ ID NO: 180271 - RNA, 21 nt, Homo sapiens
gagaggauucgccagccucuu

SEQ ID NO: 180272 - RNA, 22 nt, Homo sapiens
gagagucacagugaauguggca

SEQ ID NO: 180273 - RNA, 22 nt, Homo sapiens
gagauacacccagugcagaggc

SEQ ID NO: 180274 - RNA, 22 nt, Homo sapiens
gagauauucugguuuacuaaau

SEQ ID NO: 180275 - RNA, 22 nt, Homo sapiens
gagaucaugcugguucucucau

SEQ ID NO: 180276 - RNA, 22 nt, Homo sapiens
gagaucauguacuagaacaccu

SEQ ID NO: 180277 - RNA, 22 nt, Homo sapiens
gagaucauugugggccaagcug

SEQ ID NO: 180278 - RNA, 22 nt, Homo sapiens
gagaucuauuccucacccuucu

SEQ ID NO: 180279 - RNA, 22 nt, Homo sapiens
gagaucuucguguggggagaca

SEQ ID NO: 180280 - RNA, 22 nt, Homo sapiens
gagaucuuuaagaacuacugcu

SEQ ID NO: 180281 - RNA, 22 nt, Homo sapiens
gagaugaaaucuugcucuguca

SEQ ID NO: 180282 - RNA, 22 nt, Homo sapiens
gagaugaagugucaauaaggau

SEQ ID NO: 180283 - RNA, 22 nt, Homo sapiens
gagaugaugagauguucacagu

SEQ ID NO: 180284 - RNA, 22 nt, Homo sapiens
gagaugcaccuugucacguuuc

SEQ ID NO: 180285 - RNA, 22 nt, Homo sapiens
gagauggugugcuguuggaagu

SEQ ID NO: 180286 - RNA, 22 nt, Homo sapiens
gagaugugguucaaggguguuu

SEQ ID NO: 180287 - RNA, 22 nt, Homo sapiens
gagaugugugugauuauauaau

SEQ ID NO: 180288 - RNA, 22 nt, Homo sapiens
gagauguuuuguuaucaaagga

SEQ ID NO: 180289 - RNA, 21 nt, Homo sapiens
gagcacauuguccucuaacgc

SEQ ID NO: 180290 - RNA, 18 nt, Homo sapiens
gagcaccuuuuuugcaga

SEQ ID NO: 180291 - RNA, 22 nt, Homo sapiens
gagcacugaauacugugguggu

SEQ ID NO: 180292 - RNA, 22 nt, Homo sapiens
gagcagacaugaggaccgcugg

SEQ ID NO: 180293 - RNA, 22 nt, Homo sapiens
gagcaguugagagugcuggcca

SEQ ID NO: 180294 - RNA, 22 nt, Homo sapiens
gagcaucaauggcaugugggaa

SEQ ID NO: 180295 - RNA, 22 nt, Homo sapiens
gagcaucauucaacaaaagucu

SEQ ID NO: 180296 - RNA, 22 nt, Homo sapiens
gagccuguaggaggagaggugg

SEQ ID NO: 180297 - RNA, 22 nt, Homo sapiens
gagcuaguagagugcacccggc

SEQ ID NO: 180298 - RNA, 22 nt, Homo sapiens
gagcuagugcuuaugcaccacu

SEQ ID NO: 180299 - RNA, 22 nt, Homo sapiens
gagcuaguguaauauuuugggg

SEQ ID NO: 180300 - RNA, 22 nt, Homo sapiens
gagcucauuaaaaauguagaau

SEQ ID NO: 180301 - RNA, 22 nt, Homo sapiens
gagcugaauugcugccauuugc

SEQ ID NO: 180302 - RNA, 22 nt, Homo sapiens
gagcugaucuuuucugauucca

SEQ ID NO: 180303 - RNA, 22 nt, Homo sapiens
agugauuuuaacuuccagcaau

SEQ ID NO: 180304 - RNA, 22 nt, Homo sapiens
agugcaaagccgagguuucuug

SEQ ID NO: 180305 - RNA, 19 nt, Homo sapiens
agugcaauugccuuugugc

SEQ ID NO: 180306 - RNA, 22 nt, Homo sapiens
agugcacuccagccugggcaac

SEQ ID NO: 180307 - RNA, 22 nt, Homo sapiens
agugcaguggcucaaaaugccu

SEQ ID NO: 180308 - RNA, 22 nt, Homo sapiens
agugcauugagacuugugaguu

SEQ ID NO: 180309 - RNA, 22 nt, Homo sapiens
agugcauuugcaucucaauaua

SEQ ID NO: 180310 - RNA, 22 nt, Homo sapiens
agugccaaaucgagggcucuga

SEQ ID NO: 180311 - RNA, 22 nt, Homo sapiens
aguggaauuaagaaacugaauu

SEQ ID NO: 180312 - RNA, 22 nt, Homo sapiens
aguggauuuuauuugacaacua

SEQ ID NO: 180313 - RNA, 22 nt, Homo sapiens
agugggccccuagaggugaggu

SEQ ID NO: 180314 - RNA, 22 nt, Homo sapiens
agugguauaauauuauuuugaa

SEQ ID NO: 180315 - RNA, 22 nt, Homo sapiens
aguggugucugaguggccaggg

SEQ ID NO: 180316 - RNA, 22 nt, Homo sapiens
agugguuuuggaauggaauuca

SEQ ID NO: 180317 - RNA, 22 nt, Homo sapiens
aguucaaugcucuuucuacuau

SEQ ID NO: 180318 - RNA, 22 nt, Homo sapiens
aguuccuacuggcuguaaagaa

SEQ ID NO: 180319 - RNA, 22 nt, Homo sapiens
aguuggccccuacugggaggug

SEQ ID NO: 180320 - RNA, 22 nt, Homo sapiens
aguuuugguugaguuacuagca

SEQ ID NO: 180321 - RNA, 22 nt, Homo sapiens
auaaacugucaguggagaguaa

SEQ ID NO: 180322 - RNA, 22 nt, Homo sapiens
auaaagacacuuggcaugauuu

SEQ ID NO: 180323 - RNA, 22 nt, Homo sapiens
auaaagguaauaauaguugcau

SEQ ID NO: 180324 - RNA, 22 nt, Homo sapiens
auaaaguguuuaguauaggcaa

SEQ ID NO: 180325 - RNA, 22 nt, Homo sapiens
auaaaguucugcuggcauauau

SEQ ID NO: 180326 - RNA, 22 nt, Homo sapiens
auaaaugccuguuguuuuaagc

SEQ ID NO: 180327 - RNA, 22 nt, Homo sapiens
auaaaugcuuagaucuguauau

SEQ ID NO: 180328 - RNA, 22 nt, Homo sapiens
auaaauucauuuaagcuccuua

SEQ ID NO: 180329 - RNA, 22 nt, Homo sapiens
auaacagcauuauugcauacgu

SEQ ID NO: 180330 - RNA, 22 nt, Homo sapiens
auaacaggaaauacagggcuuu

SEQ ID NO: 180331 - RNA, 22 nt, Homo sapiens
auaagauaguggaagugggauu

SEQ ID NO: 180332 - RNA, 22 nt, Homo sapiens
auaagcuaagaguuucugggcu

SEQ ID NO: 180333 - RNA, 22 nt, Homo sapiens
auaaggcugguauagacauuca

SEQ ID NO: 180334 - RNA, 22 nt, Homo sapiens
auaagugagugauucaguguua

SEQ ID NO: 180335 - RNA, 22 nt, Homo sapiens
auaauacugggaagaugagcau

SEQ ID NO: 180336 - RNA, 19 nt, Homo sapiens
auacacguguauacauaca

SEQ ID NO: 180337 - RNA, 22 nt, Homo sapiens
auacaguugccauuucuugugc

SEQ ID NO: 180338 - RNA, 22 nt, Homo sapiens
auacaugugccaugcuggugug

SEQ ID NO: 180339 - RNA, 22 nt, Homo sapiens
auacaugugugagcgaagaugu

SEQ ID NO: 180340 - RNA, 20 nt, Homo sapiens
auacccaguagcacaacagc

SEQ ID NO: 180341 - RNA, 22 nt, Homo sapiens
auacuagucaagaauguaugag

SEQ ID NO: 180342 - RNA, 20 nt, Homo sapiens
auagaagacuagugcagcag

SEQ ID NO: 180343 - RNA, 22 nt, Homo sapiens
auagaagcugccaacguuucag

SEQ ID NO: 180344 - RNA, 22 nt, Homo sapiens
auagaaucaucugugcacuagu

SEQ ID NO: 180345 - RNA, 15 nt, Homo sapiens
auagaaugaaaggga

SEQ ID NO: 180346 - RNA, 22 nt, Homo sapiens
auagaauguuugcgccagguga

SEQ ID NO: 180347 - RNA, 22 nt, Homo sapiens
auagacacugaaaucccugcca

SEQ ID NO: 180348 - RNA, 22 nt, Homo sapiens
auagacugaguggcuuaaacca

SEQ ID NO: 180349 - RNA, 23 nt, Homo sapiens
auagagcuaggaugcagacagau

SEQ ID NO: 180350 - RNA, 22 nt, Homo sapiens
auagaggacugaggugaucuuu

SEQ ID NO: 180351 - RNA, 22 nt, Homo sapiens
auagaucuauuuauguaucccu

SEQ ID NO: 180352 - RNA, 22 nt, Homo sapiens
auagcaaugccccauucccagu

SEQ ID NO: 180353 - RNA, 22 nt, Homo sapiens
auagcacauggcauccucucuu

SEQ ID NO: 180354 - RNA, 22 nt, Homo sapiens
auagcagaacagugucucacug

SEQ ID NO: 180355 - RNA, 22 nt, Homo sapiens
auagcagcauauguaauguuga

SEQ ID NO: 180356 - RNA, 22 nt, Homo sapiens
auagcagugugaaaacagacug

SEQ ID NO: 180357 - RNA, 22 nt, Homo sapiens
auagcagugugaaaauguacua

SEQ ID NO: 180358 - RNA, 22 nt, Homo sapiens
auagcagugugagaaugaacua

SEQ ID NO: 180359 - RNA, 20 nt, Homo sapiens
auagcauugauggacucaaa

SEQ ID NO: 180360 - RNA, 22 nt, Homo sapiens
auaggagcacaaacuauuguga

SEQ ID NO: 180361 - RNA, 22 nt, Homo sapiens
auaggagugugcacagaguagg

SEQ ID NO: 180362 - RNA, 22 nt, Homo sapiens
auaggcacauuaggaacuuuug

SEQ ID NO: 180363 - RNA, 21 nt, Homo sapiens
auagggcuuguugauaguuaa

SEQ ID NO: 180364 - RNA, 22 nt, Homo sapiens
auaguacuauugcaguguuaua

SEQ ID NO: 180365 - RNA, 22 nt, Homo sapiens
auagucaguagucucauaauga

SEQ ID NO: 180366 - RNA, 22 nt, Homo sapiens
auagugcagugaugaaccuagg

SEQ ID NO: 180367 - RNA, 22 nt, Homo sapiens
auagugcugcaacaaauauacg

SEQ ID NO: 180368 - RNA, 22 nt, Homo sapiens
auagugcugcaauaaacacacg

SEQ ID NO: 180369 - RNA, 22 nt, Homo sapiens
auagugcugcaauaaacauaug

SEQ ID NO: 180370 - RNA, 22 nt, Homo sapiens
auagugcugcauuaaacauacg

SEQ ID NO: 180371 - RNA, 22 nt, Homo sapiens
auaguggcaugaucauagcuca

SEQ ID NO: 180372 - RNA, 19 nt, Homo sapiens
auaguguaggaaaacagcu

SEQ ID NO: 180373 - RNA, 22 nt, Homo sapiens
auauagcucuggcuggaugacu

SEQ ID NO: 180374 - RNA, 22 nt, Homo sapiens
auaucaaggccauuuucuaaau

SEQ ID NO: 180375 - RNA, 22 nt, Homo sapiens
auaucacucccaauaucgcagg

SEQ ID NO: 180376 - RNA, 22 nt, Homo sapiens
auaugcauguacccacacaggc

SEQ ID NO: 180377 - RNA, 18 nt, Homo sapiens
auauugccuucagacuag

SEQ ID NO: 180378 - RNA, 22 nt, Homo sapiens
auauuugguuaccugugggucu

SEQ ID NO: 180379 - RNA, 22 nt, Homo sapiens
aucaaaguaggcauauguuuuu

SEQ ID NO: 180380 - RNA, 22 nt, Homo sapiens
aucaaagugaaauauuaguuau

SEQ ID NO: 180381 - RNA, 22 nt, Homo sapiens
aucaaaguuucccagaaguugu

SEQ ID NO: 180382 - RNA, 22 nt, Homo sapiens
aucaagcuggcauauguaguuc

SEQ ID NO: 180383 - RNA, 22 nt, Homo sapiens
aucaaguaguuauacguaaagg

SEQ ID NO: 180384 - RNA, 22 nt, Homo sapiens
aucacagguacuauggcugaca

SEQ ID NO: 180385 - RNA, 22 nt, Homo sapiens
aucacauggccagguaguaauc

SEQ ID NO: 180386 - RNA, 22 nt, Homo sapiens
aucacauggccuagccuaaccu

SEQ ID NO: 180387 - RNA, 22 nt, Homo sapiens
aucaccauguguacauuagacc

SEQ ID NO: 180388 - RNA, 22 nt, Homo sapiens
aucaccuggaguagcccguccc

SEQ ID NO: 180389 - RNA, 22 nt, Homo sapiens
aucacuuucuauuucugugcca

SEQ ID NO: 180390 - RNA, 22 nt, Homo sapiens
aucacuuugcucuccagugugg

SEQ ID NO: 180391 - RNA, 22 nt, Homo sapiens
aucagauuccagaggcagcacc

SEQ ID NO: 180392 - RNA, 22 nt, Homo sapiens
aucagcagcaugaaaacaggcu

SEQ ID NO: 180393 - RNA, 22 nt, Homo sapiens
aucagugauugauuuaaagacg

SEQ ID NO: 180394 - RNA, 22 nt, Homo sapiens
aucauagcucacugcagccucg

SEQ ID NO: 180395 - RNA, 22 nt, Homo sapiens
aucaucacaguuguguguaaug

SEQ ID NO: 180396 - RNA, 22 nt, Homo sapiens
aucauguaguaagacacauuua

SEQ ID NO: 180397 - RNA, 22 nt, Homo sapiens
aucauugugcaucuucauucca

SEQ ID NO: 180398 - RNA, 22 nt, Homo sapiens
auccaagagacugaugacuucc

SEQ ID NO: 180399 - RNA, 22 nt, Homo sapiens
auccaguguuuucuuuugucac

SEQ ID NO: 180400 - RNA, 22 nt, Homo sapiens
auccaguuuuaggagauuucua

SEQ ID NO: 180401 - RNA, 22 nt, Homo sapiens
aucccaguaaaaauggcuucua

SEQ ID NO: 180402 - RNA, 22 nt, Homo sapiens
aucccuagaaaaaucagcacau

SEQ ID NO: 180403 - RNA, 22 nt, Homo sapiens
aucccugagccugacucucaga

SEQ ID NO: 180404 - RNA, 22 nt, Homo sapiens
aucccuguaacuagcagccccu

SEQ ID NO: 180405 - RNA, 22 nt, Homo sapiens
aucccuguaguaauauucuagc

SEQ ID NO: 180406 - RNA, 22 nt, Homo sapiens
aucccuguguccagcaccugug

SEQ ID NO: 180407 - RNA, 22 nt, Homo sapiens
auccugagacuuuucugaaguu

SEQ ID NO: 180408 - RNA, 22 nt, Homo sapiens
auccuguagagaugagggugga

SEQ ID NO: 180409 - RNA, 22 nt, Homo sapiens
aucgcaauguuuagaauuuugu

SEQ ID NO: 180410 - RNA, 22 nt, Homo sapiens
aucucaguuaaugacccuaugc

SEQ ID NO: 180411 - RNA, 22 nt, Homo sapiens
aucucauggagguagagaguaa

SEQ ID NO: 180412 - RNA, 22 nt, Homo sapiens
agcugguaugaaaaucucccca

SEQ ID NO: 180413 - RNA, 22 nt, Homo sapiens
agcugguauuuugucaaggaua

SEQ ID NO: 180414 - RNA, 22 nt, Homo sapiens
agcuggucuacguguguaugag

SEQ ID NO: 180415 - RNA, 21 nt, Homo sapiens
agcugguuucuucuuacuccu

SEQ ID NO: 180416 - RNA, 22 nt, Homo sapiens
agcuguuguacacuuuaccuuu

SEQ ID NO: 180417 - RNA, 22 nt, Homo sapiens
agcuguuguucucagaggcuuu

SEQ ID NO: 180418 - RNA, 22 nt, Homo sapiens
agcuucauuccaacuuccuucu

SEQ ID NO: 180419 - RNA, 22 nt, Homo sapiens
agcuuguuuucccauaacuaga

SEQ ID NO: 180420 - RNA, 22 nt, Homo sapiens
agcuuuggauaccugcuguucc

SEQ ID NO: 180421 - RNA, 22 nt, Homo sapiens
aggaacuguaacuaugucucug

SEQ ID NO: 180422 - RNA, 21 nt, Homo sapiens
aggaagacuaugaucaauugg

SEQ ID NO: 180423 - RNA, 22 nt, Homo sapiens
aggaagacugaaauugcuguuc

SEQ ID NO: 180424 - RNA, 22 nt, Homo sapiens
aggaaucuaagguaucagguua

SEQ ID NO: 180425 - RNA, 18 nt, Homo sapiens
aggaaugguaauacuuca

SEQ ID NO: 180426 - RNA, 22 nt, Homo sapiens
aggaccauuguguagcagacau

SEQ ID NO: 180427 - RNA, 22 nt, Homo sapiens
aggagaugaagcuuuaucuaaa

SEQ ID NO: 180428 - RNA, 22 nt, Homo sapiens
aggagcacuggccuuggaguca

SEQ ID NO: 180429 - RNA, 18 nt, Homo sapiens
aggagcauagugcuauga

SEQ ID NO: 180430 - RNA, 22 nt, Homo sapiens
aggagguagggugugaaacagc

SEQ ID NO: 180431 - RNA, 22 nt, Homo sapiens
aggauacugguaugggcugaau

SEQ ID NO: 180432 - RNA, 22 nt, Homo sapiens
aggauaguaaugauagagaggc

SEQ ID NO: 180433 - RNA, 21 nt, Homo sapiens
aggauaguagauuaaauauuu

SEQ ID NO: 180434 - RNA, 22 nt, Homo sapiens
aggcaaaugccagcaaucacac

SEQ ID NO: 180435 - RNA, 22 nt, Homo sapiens
aggcaagcaucuugcucccuuc

SEQ ID NO: 180436 - RNA, 22 nt, Homo sapiens
aggcaaugugagaguuuauuca

SEQ ID NO: 180437 - RNA, 22 nt, Homo sapiens
aggcagaugagguccucagcug

SEQ ID NO: 180438 - RNA, 22 nt, Homo sapiens
aggcagcuguuauauacugagu

SEQ ID NO: 180439 - RNA, 22 nt, Homo sapiens
aggcagucucugccggcugagg

SEQ ID NO: 180440 - RNA, 22 nt, Homo sapiens
aggcaugaaauacaugcauuga

SEQ ID NO: 180441 - RNA, 22 nt, Homo sapiens
aggcaugaguucagaggguaug

SEQ ID NO: 180442 - RNA, 22 nt, Homo sapiens
aggcauguggcucuguucugac

SEQ ID NO: 180443 - RNA, 19 nt, Homo sapiens
aggcauugugcucaucugu

SEQ ID NO: 180444 - RNA, 22 nt, Homo sapiens
aggcuagacuuugagaauuuuu

SEQ ID NO: 180445 - RNA, 22 nt, Homo sapiens
aggcuuuuguuuuggucucagg

SEQ ID NO: 180446 - RNA, 22 nt, Homo sapiens
agggccuuuguagauguacuca

SEQ ID NO: 180447 - RNA, 22 nt, Homo sapiens
aggguaguaggcuugggauugg

SEQ ID NO: 180448 - RNA, 22 nt, Homo sapiens
agguaagucucuaauuaugaau

SEQ ID NO: 180449 - RNA, 22 nt, Homo sapiens
agguacuuucccaaccauacug

SEQ ID NO: 180450 - RNA, 22 nt, Homo sapiens
agguagaguguuuuguucuucu

SEQ ID NO: 180451 - RNA, 20 nt, Homo sapiens
agguaguuauacaaaugugu

SEQ ID NO: 180452 - RNA, 22 nt, Homo sapiens
agguauguauguaugggagaaa

SEQ ID NO: 180453 - RNA, 22 nt, Homo sapiens
agguauuuucaacuuagaaugg

SEQ ID NO: 180454 - RNA, 22 nt, Homo sapiens
agguccauugguauuauagcau

SEQ ID NO: 180455 - RNA, 22 nt, Homo sapiens
aggugaaugcucacauucuaau

SEQ ID NO: 180456 - RNA, 22 nt, Homo sapiens
aggugcuauauuucgaggauag

SEQ ID NO: 180457 - RNA, 22 nt, Homo sapiens
aggugcucuuccuguaggucac

SEQ ID NO: 180458 - RNA, 22 nt, Homo sapiens
aggugcugacaggauagguuuc

SEQ ID NO: 180459 - RNA, 22 nt, Homo sapiens
aggugcuugaaucuaugagcuc

SEQ ID NO: 180460 - RNA, 22 nt, Homo sapiens
aggugguuuugaugagcaggua

SEQ ID NO: 180461 - RNA, 22 nt, Homo sapiens
agguuaacaucuauuuuggaug

SEQ ID NO: 180462 - RNA, 23 nt, Homo sapiens
agguuaugauuauagagcgagga

SEQ ID NO: 180463 - RNA, 22 nt, Homo sapiens
agguuaugauuguagagcgagg

SEQ ID NO: 180464 - RNA, 20 nt, Homo sapiens
agguuauuauaauuagaaga

SEQ ID NO: 180465 - RNA, 22 nt, Homo sapiens
agguuguugcaugcuccuuagg

SEQ ID NO: 180466 - RNA, 22 nt, Homo sapiens
aguaaagcuacucacugugggc

SEQ ID NO: 180467 - RNA, 22 nt, Homo sapiens
aguaacacaccugcauggugug

SEQ ID NO: 180468 - RNA, 22 nt, Homo sapiens
aguaacauuucuaguagagagu

SEQ ID NO: 180469 - RNA, 22 nt, Homo sapiens
aguaaucaucugagggcagaaa

SEQ ID NO: 180470 - RNA, 22 nt, Homo sapiens
aguacaauguugaguagaagug

SEQ ID NO: 180471 - RNA, 22 nt, Homo sapiens
aguaccauuagauuaggaugac

SEQ ID NO: 180472 - RNA, 21 nt, Homo sapiens
aguagcacugugucuuacaaa

SEQ ID NO: 180473 - RNA, 22 nt, Homo sapiens
aguauugcuaauaagagauuug

SEQ ID NO: 180474 - RNA, 22 nt, Homo sapiens
agucaaguuuuuucagagaaua

SEQ ID NO: 180475 - RNA, 22 nt, Homo sapiens
agucacagccuuuuacuuuaga

SEQ ID NO: 180476 - RNA, 22 nt, Homo sapiens
agucacagguucuugggauuag

SEQ ID NO: 180477 - RNA, 22 nt, Homo sapiens
agucacaugcauuuucuucaau

SEQ ID NO: 180478 - RNA, 22 nt, Homo sapiens
agucacaugccagcacacccag

SEQ ID NO: 180479 - RNA, 22 nt, Homo sapiens
agucaguguguauugauggcac

SEQ ID NO: 180480 - RNA, 22 nt, Homo sapiens
aguccagguuuuguaauggcaa

SEQ ID NO: 180481 - RNA, 22 nt, Homo sapiens
agugagcuggagaaaagaaacu

SEQ ID NO: 180482 - RNA, 22 nt, Homo sapiens
agugauggagccaggauuuaau

SEQ ID NO: 180483 - RNA, 22 nt, Homo sapiens
aauucuguauuguuuagggacu

SEQ ID NO: 180484 - RNA, 22 nt, Homo sapiens
aauugaaucaugugggcagacu

SEQ ID NO: 180485 - RNA, 22 nt, Homo sapiens
aauugcaccaucuagaucaaga

SEQ ID NO: 180486 - RNA, 22 nt, Homo sapiens
aauuggcagugcucuugccaca

SEQ ID NO: 180487 - RNA, 22 nt, Homo sapiens
aauuggugaccaagggaaggac

SEQ ID NO: 180488 - RNA, 22 nt, Homo sapiens
acaaagcuagggaauccaucuu

SEQ ID NO: 180489 - RNA, 21 nt, Homo sapiens
acaaagcuggagggagacugc

SEQ ID NO: 180490 - RNA, 22 nt, Homo sapiens
acaaagugccuccuuuuagagu

SEQ ID NO: 180491 - RNA, 22 nt, Homo sapiens
acaaaguguuuucugaaggccu

SEQ ID NO: 180492 - RNA, 17 nt, Homo sapiens
acaaauugccagcuagg

SEQ ID NO: 180493 - RNA, 22 nt, Homo sapiens
acaagcacaaauuuaauccugu

SEQ ID NO: 180494 - RNA, 22 nt, Homo sapiens
acacaaugguaaguguuugugu

SEQ ID NO: 180495 - RNA, 23 nt, Homo sapiens
acacaguaaacuaaaagcuagcu

SEQ ID NO: 180496 - RNA, 22 nt, Homo sapiens
acaccaugucuguuucugguuu

SEQ ID NO: 180497 - RNA, 22 nt, Homo sapiens
acacucucucauuacuuguuug

SEQ ID NO: 180498 - RNA, 22 nt, Homo sapiens
acacuggguaacauaucuguua

SEQ ID NO: 180499 - RNA, 22 nt, Homo sapiens
acacuguugacauuuuguagug

SEQ ID NO: 180500 - RNA, 22 nt, Homo sapiens
acacuguuuuguggagaaugua

SEQ ID NO: 180501 - RNA, 22 nt, Homo sapiens
acacuugcuugcaauagccucc

SEQ ID NO: 180502 - RNA, 22 nt, Homo sapiens
acagagcaaugagcuacggucu

SEQ ID NO: 180503 - RNA, 22 nt, Homo sapiens
acagcacugccaagugacccau

SEQ ID NO: 180504 - RNA, 22 nt, Homo sapiens
acagcagugccccacucuacug

SEQ ID NO: 180505 - RNA, 20 nt, Homo sapiens
acagcauagccuuuuaaagc

SEQ ID NO: 180506 - RNA, 22 nt, Homo sapiens
acaggguuauuguaauaaugua

SEQ ID NO: 180507 - RNA, 22 nt, Homo sapiens
acagguacaagggauuaggaug

SEQ ID NO: 180508 - RNA, 22 nt, Homo sapiens
acagguauagaaagcuaaaggg

SEQ ID NO: 180509 - RNA, 22 nt, Homo sapiens
acaggugaaguauuacacuaag

SEQ ID NO: 180510 - RNA, 22 nt, Homo sapiens
aucuccaggugccagcugcgcc

SEQ ID NO: 180511 - RNA, 22 nt, Homo sapiens
aucugcacaucuguguuuuugu

SEQ ID NO: 180512 - RNA, 22 nt, Homo sapiens
aucuguagauucagcacaagcu

SEQ ID NO: 180513 - RNA, 21 nt, Homo sapiens
aucugugagaccuuggggguu

SEQ ID NO: 180514 - RNA, 22 nt, Homo sapiens
aucuugcauuugcuaaaaugca

SEQ ID NO: 180515 - RNA, 22 nt, Homo sapiens
aucuuggauuaccugggugggu

SEQ ID NO: 180516 - RNA, 22 nt, Homo sapiens
aucuuugcugagaugcauggca

SEQ ID NO: 180517 - RNA, 22 nt, Homo sapiens
augaaaguguguggaaacuuga

SEQ ID NO: 180518 - RNA, 22 nt, Homo sapiens
augaaaucacugugaugcccua

SEQ ID NO: 180519 - RNA, 22 nt, Homo sapiens
augaaaucuuuggcagaucuua

SEQ ID NO: 180520 - RNA, 18 nt, Homo sapiens
augaacucaucauuuuuu

SEQ ID NO: 180521 - RNA, 22 nt, Homo sapiens
augaagaucucugccuuguguc

SEQ ID NO: 180522 - RNA, 22 nt, Homo sapiens
augaagcuagcugauugcugau

SEQ ID NO: 180523 - RNA, 20 nt, Homo sapiens
augaaggcaggugugaguuu

SEQ ID NO: 180524 - RNA, 18 nt, Homo sapiens
augaagucaucacuuuua

SEQ ID NO: 180525 - RNA, 22 nt, Homo sapiens
augaagucguuacuaccaauug

SEQ ID NO: 180526 - RNA, 22 nt, Homo sapiens
augaaugcaucuaucaaagcau

SEQ ID NO: 180527 - RNA, 22 nt, Homo sapiens
augaaugcuuuuggauguaucu

SEQ ID NO: 180528 - RNA, 22 nt, Homo sapiens
augaauuuucugauguugggua

SEQ ID NO: 180529 - RNA, 22 nt, Homo sapiens
augacaagaguguucagggaga

SEQ ID NO: 180530 - RNA, 22 nt, Homo sapiens
augacacugcagagauguccca

SEQ ID NO: 180531 - RNA, 22 nt, Homo sapiens
augacaguguggauuauuguaa

SEQ ID NO: 180532 - RNA, 22 nt, Homo sapiens
augacauugaaaagcaagugga

SEQ ID NO: 180533 - RNA, 22 nt, Homo sapiens
augacauugaugcucuggcugg

SEQ ID NO: 180534 - RNA, 22 nt, Homo sapiens
augaccaugauccuugccgacc

SEQ ID NO: 180535 - RNA, 22 nt, Homo sapiens
augacugaguagcauuccauua

SEQ ID NO: 180536 - RNA, 22 nt, Homo sapiens
augacuggauaauggacacaca

SEQ ID NO: 180537 - RNA, 22 nt, Homo sapiens
augagaaucauuucagcuugua

SEQ ID NO: 180538 - RNA, 22 nt, Homo sapiens
augagaaugauucuguuauggu

SEQ ID NO: 180539 - RNA, 22 nt, Homo sapiens
augagaauguaaguuaaugaaa

SEQ ID NO: 180540 - RNA, 22 nt, Homo sapiens
augagaccagcagaaaaccugu

SEQ ID NO: 180541 - RNA, 22 nt, Homo sapiens
augagagugagagcagccccuu

SEQ ID NO: 180542 - RNA, 22 nt, Homo sapiens
augagauaggaacaaacuuaca

SEQ ID NO: 180543 - RNA, 22 nt, Homo sapiens
augagauauuuuauaagaucau

SEQ ID NO: 180544 - RNA, 22 nt, Homo sapiens
augagaugaggaauggcccucc

SEQ ID NO: 180545 - RNA, 22 nt, Homo sapiens
augagauuauguaaagagacca

SEQ ID NO: 180546 - RNA, 22 nt, Homo sapiens
augagauucuuagagaagucug

SEQ ID NO: 180547 - RNA, 22 nt, Homo sapiens
augagauuguuugugugaaaua

SEQ ID NO: 180548 - RNA, 22 nt, Homo sapiens
augagcaaagagaugagacccu

SEQ ID NO: 180549 - RNA, 19 nt, Homo sapiens
augagcaauaguuuuaauc

SEQ ID NO: 180550 - RNA, 22 nt, Homo sapiens
augagcacuuguuuugggcaca

SEQ ID NO: 180551 - RNA, 22 nt, Homo sapiens
augagcagaagagauacacugu

SEQ ID NO: 180552 - RNA, 22 nt, Homo sapiens
augaggcacugcgcccuacuga

SEQ ID NO: 180553 - RNA, 22 nt, Homo sapiens
augaggcuauaauuuuuaugua

SEQ ID NO: 180554 - RNA, 20 nt, Homo sapiens
uagccggguguugugucaug

SEQ ID NO: 180555 - RNA, 22 nt, Homo sapiens
uagccucacaaagugcuuaaga

SEQ ID NO: 180556 - RNA, 21 nt, Homo sapiens
uagcuacacugugauucaugg

SEQ ID NO: 180557 - RNA, 21 nt, Homo sapiens
uagcucagugguguugccaua

SEQ ID NO: 180558 - RNA, 22 nt, Homo sapiens
uagcugagacuacaguaggugc

SEQ ID NO: 180559 - RNA, 22 nt, Homo sapiens
uagcugaucuuuuaaagaauga

SEQ ID NO: 180560 - RNA, 22 nt, Homo sapiens
uagcugcauccugugcacucaa

SEQ ID NO: 180561 - RNA, 22 nt, Homo sapiens
uagcugcuguauguacacggau

SEQ ID NO: 180562 - RNA, 22 nt, Homo sapiens
uagcuggaauuacuugcaccug

SEQ ID NO: 180563 - RNA, 22 nt, Homo sapiens
uaggaaugaacgauuuauuggu

SEQ ID NO: 180564 - RNA, 22 nt, Homo sapiens
uaggacacucucuccaccagua

SEQ ID NO: 180565 - RNA, 22 nt, Homo sapiens
uaggagugugaacccuguuuug

SEQ ID NO: 180566 - RNA, 22 nt, Homo sapiens
uaggaucauuuuauguugccca

SEQ ID NO: 180567 - RNA, 22 nt, Homo sapiens
uaggcaauggagauagaggaug

SEQ ID NO: 180568 - RNA, 22 nt, Homo sapiens
uaggcaguggagaaauaaacag

SEQ ID NO: 180569 - RNA, 19 nt, Homo sapiens
uagggcacgaggcagaguc

SEQ ID NO: 180570 - RNA, 22 nt, Homo sapiens
uagggcuugugaucagguguag

SEQ ID NO: 180571 - RNA, 22 nt, Homo sapiens
uagggcuuuaguuugcuugugu

SEQ ID NO: 180572 - RNA, 22 nt, Homo sapiens
uagggcuuuccggccugucaga

SEQ ID NO: 180573 - RNA, 22 nt, Homo sapiens
uaggucaguuuuggcuuggcuu

SEQ ID NO: 180574 - RNA, 22 nt, Homo sapiens
uaggucccguuucagacugaga

SEQ ID NO: 180575 - RNA, 22 nt, Homo sapiens
uaggugauccauuuguauuuua

SEQ ID NO: 180576 - RNA, 22 nt, Homo sapiens
uagguucucaggaaugagcuuc

SEQ ID NO: 180577 - RNA, 22 nt, Homo sapiens
uaguaaacagcucugccacaau

SEQ ID NO: 180578 - RNA, 22 nt, Homo sapiens
uaguaaacauaguucuuuugcu

SEQ ID NO: 180579 - RNA, 22 nt, Homo sapiens
uaguauguuuauagcauugagu

SEQ ID NO: 180580 - RNA, 22 nt, Homo sapiens
uagugcugagauugagaagccc

SEQ ID NO: 180581 - RNA, 20 nt, Homo sapiens
uaguggaaaucagguccucu

SEQ ID NO: 180582 - RNA, 22 nt, Homo sapiens
uaguuauggaguaauuuuaagc

SEQ ID NO: 180583 - RNA, 22 nt, Homo sapiens
uaguucauuuuucuugcuuaga

SEQ ID NO: 180584 - RNA, 22 nt, Homo sapiens
uauaacacccacauauagucuu

SEQ ID NO: 180585 - RNA, 20 nt, Homo sapiens
uauaacaguuuggacccagu

SEQ ID NO: 180586 - RNA, 22 nt, Homo sapiens
uauaaccauuucuucucucuuc

SEQ ID NO: 180587 - RNA, 23 nt, Homo sapiens
uauaacuuuuaauuuacuggccu

SEQ ID NO: 180588 - RNA, 22 nt, Homo sapiens
uauacacgugugcauauauaca

SEQ ID NO: 180589 - RNA, 22 nt, Homo sapiens
uauacaugugggcaucaggaga

SEQ ID NO: 180590 - RNA, 22 nt, Homo sapiens
uauacuguuuucuauaguggcu

SEQ ID NO: 180591 - RNA, 22 nt, Homo sapiens
uauagcacugagaauguaauuc

SEQ ID NO: 180592 - RNA, 22 nt, Homo sapiens
uauagcagccugaacaaaguaa

SEQ ID NO: 180593 - RNA, 22 nt, Homo sapiens
uauagcagugaguauugacuaa

SEQ ID NO: 180594 - RNA, 22 nt, Homo sapiens
uauagcuaugggauguauuugc

SEQ ID NO: 180595 - RNA, 21 nt, Homo sapiens
uauaguaguaugauuuacaau

SEQ ID NO: 180596 - RNA, 22 nt, Homo sapiens
uauauaagcugaugagccacaa

SEQ ID NO: 180597 - RNA, 22 nt, Homo sapiens
uauauagcuaugucuguccauu

SEQ ID NO: 180598 - RNA, 22 nt, Homo sapiens
uauaucuguccauggcccugcu

SEQ ID NO: 180599 - RNA, 22 nt, Homo sapiens
uauaugcauugugggguacuga

SEQ ID NO: 180600 - RNA, 22 nt, Homo sapiens
uauaugcuaaacaagggguggg

SEQ ID NO: 180601 - RNA, 23 nt, Homo sapiens
uauaugugucuaggagcuauggu

SEQ ID NO: 180602 - RNA, 22 nt, Homo sapiens
uaucaagaugacaaacuuugcu

SEQ ID NO: 180603 - RNA, 22 nt, Homo sapiens
uaucaaggccacucauuuuaug

SEQ ID NO: 180604 - RNA, 22 nt, Homo sapiens
uaucacacgccuugcuucauuu

SEQ ID NO: 180605 - RNA, 22 nt, Homo sapiens
uaucacacuggaagaaguuaag

SEQ ID NO: 180606 - RNA, 20 nt, Homo sapiens
uaucacaggucagaaacccu

SEQ ID NO: 180607 - RNA, 22 nt, Homo sapiens
uaucacagugcuggaguauucc

SEQ ID NO: 180608 - RNA, 22 nt, Homo sapiens
uaucacaguugcauauuuaagg

SEQ ID NO: 180609 - RNA, 21 nt, Homo sapiens
uaucacauuggugauuaaguu

SEQ ID NO: 180610 - RNA, 22 nt, Homo sapiens
uaucaccauguccguuuuaaaa

SEQ ID NO: 180611 - RNA, 21 nt, Homo sapiens
uaucagagacauugagaggca

SEQ ID NO: 180612 - RNA, 22 nt, Homo sapiens
uaucagcagcaggggcugcaga

SEQ ID NO: 180613 - RNA, 22 nt, Homo sapiens
uaucauggaaugagguuggaca

SEQ ID NO: 180614 - RNA, 22 nt, Homo sapiens
uaucauggggacugcagccuag

SEQ ID NO: 180615 - RNA, 22 nt, Homo sapiens
uaucaugucuguguguaccuag

SEQ ID NO: 180616 - RNA, 22 nt, Homo sapiens
uaucauugccucaaucuguauu

SEQ ID NO: 180617 - RNA, 22 nt, Homo sapiens
uaucauuguguuauuucuucca

SEQ ID NO: 180618 - RNA, 22 nt, Homo sapiens
uauccugaagcuuuauuuaagu

SEQ ID NO: 180619 - RNA, 22 nt, Homo sapiens
uauccuguagcucauccaccgc

SEQ ID NO: 180620 - RNA, 23 nt, Homo sapiens
uaucucaaugcacagagaggaaa

SEQ ID NO: 180621 - RNA, 22 nt, Homo sapiens
uaucucagaguguacaagauua

SEQ ID NO: 180622 - RNA, 22 nt, Homo sapiens
uaucucaguguacaggaugaua

SEQ ID NO: 180623 - RNA, 22 nt, Homo sapiens
uaucugcaucccauuuuuauca

SEQ ID NO: 180624 - RNA, 22 nt, Homo sapiens
uaugaauuuuauccaggauaua

SEQ ID NO: 180625 - RNA, 22 nt, Homo sapiens
uaugaccuuguccccucucgcc

SEQ ID NO: 180626 - RNA, 22 nt, Homo sapiens
uaugacuguuugcucauucagg

SEQ ID NO: 180627 - RNA, 22 nt, Homo sapiens
uaugacuuuggaaaaauuacuu

SEQ ID NO: 180628 - RNA, 22 nt, Homo sapiens
uaugaucacuacagcagggaug

SEQ ID NO: 180629 - RNA, 22 nt, Homo sapiens
uaugauuuuugggagaggucaa

SEQ ID NO: 180630 - RNA, 22 nt, Homo sapiens
uaugcacacguguccaugugca

SEQ ID NO: 180631 - RNA, 22 nt, Homo sapiens
uaugcacaugcaugcuugaaua

SEQ ID NO: 180632 - RNA, 22 nt, Homo sapiens
uaugcagacauuguuccaacca

SEQ ID NO: 180633 - RNA, 22 nt, Homo sapiens
uaugccucuucauaaaguauga

SEQ ID NO: 180634 - RNA, 23 nt, Homo sapiens
uaugccuguuucaaacaaacuuu

SEQ ID NO: 180635 - RNA, 22 nt, Homo sapiens
uaugcuuauaaacauuugucag

SEQ ID NO: 180636 - RNA, 22 nt, Homo sapiens
uaugcuuauugucucauccacu

SEQ ID NO: 180637 - RNA, 22 nt, Homo sapiens
uauggaaaucuuaccuuauggu

SEQ ID NO: 180638 - RNA, 22 nt, Homo sapiens
uauggauuuucagauucuuauc

SEQ ID NO: 180639 - RNA, 22 nt, Homo sapiens
uauggauuuuuuugacaagagc

SEQ ID NO: 180640 - RNA, 22 nt, Homo sapiens
uauggcauguauguguggcgca

SEQ ID NO: 180641 - RNA, 22 nt, Homo sapiens
uauggcauuauuuugauagaca

SEQ ID NO: 180642 - RNA, 22 nt, Homo sapiens
uauggcuucuuuaaauugaggu

SEQ ID NO: 180643 - RNA, 22 nt, Homo sapiens
uauggcuuuguuaacauuuucu

SEQ ID NO: 180644 - RNA, 22 nt, Homo sapiens
uauggcuuuucacuuaaguccu

SEQ ID NO: 180645 - RNA, 22 nt, Homo sapiens
uauggguauuuuauacauaacc

SEQ ID NO: 180646 - RNA, 22 nt, Homo sapiens
uaugguuuuaagguuaaggacu

SEQ ID NO: 180647 - RNA, 22 nt, Homo sapiens
uaugucacuggacauaaguucu

SEQ ID NO: 180648 - RNA, 22 nt, Homo sapiens
uaugugcacaugcccuggugac

SEQ ID NO: 180649 - RNA, 22 nt, Homo sapiens
uauguguuuuauggucagggag

SEQ ID NO: 180650 - RNA, 22 nt, Homo sapiens
uauuacacuuuagugucuucca

SEQ ID NO: 180651 - RNA, 20 nt, Homo sapiens
uauuacagaguaauggugga

SEQ ID NO: 180652 - RNA, 22 nt, Homo sapiens
uauuagguuggggcaaaaguaa

SEQ ID NO: 180653 - RNA, 22 nt, Homo sapiens
uauucacuguaucauugauggg

SEQ ID NO: 180654 - RNA, 18 nt, Homo sapiens
uauuccucuuccucuauc

SEQ ID NO: 180655 - RNA, 22 nt, Homo sapiens
uauugaacuggaucagaaggcc

SEQ ID NO: 180656 - RNA, 17 nt, Homo sapiens
uauugaccuuuguaugu

SEQ ID NO: 180657 - RNA, 22 nt, Homo sapiens
uauugauuaauugugauuaggc

SEQ ID NO: 180658 - RNA, 22 nt, Homo sapiens
uauugcaaauggugaucccagg

SEQ ID NO: 180659 - RNA, 22 nt, Homo sapiens
uauugcauauuauucuaguggc

SEQ ID NO: 180660 - RNA, 22 nt, Homo sapiens
uauugcauguugagcaguaccu

SEQ ID NO: 180661 - RNA, 22 nt, Homo sapiens
uauugcuccuaauaucacggug

SEQ ID NO: 180662 - RNA, 22 nt, Homo sapiens
uauugcucugacugauuggaug

SEQ ID NO: 180663 - RNA, 22 nt, Homo sapiens
ucuugcuuguuguucccuucau

SEQ ID NO: 180664 - RNA, 22 nt, Homo sapiens
ucuugcuuuugcagagcuucuc

SEQ ID NO: 180665 - RNA, 21 nt, Homo sapiens
ucuuggguugaauucucccag

SEQ ID NO: 180666 - RNA, 22 nt, Homo sapiens
ucuuggguuuguccuucuccua

SEQ ID NO: 180667 - RNA, 22 nt, Homo sapiens
ucuugguaaugucacauuuccu

SEQ ID NO: 180668 - RNA, 22 nt, Homo sapiens
ucuuuagguguuauaguucaag

SEQ ID NO: 180669 - RNA, 22 nt, Homo sapiens
ucuuucacuuagcaugauguuu

SEQ ID NO: 180670 - RNA, 22 nt, Homo sapiens
ucuuugauguucugaaagaugg

SEQ ID NO: 180671 - RNA, 22 nt, Homo sapiens
ucuuugauuuuguuacuaagac

SEQ ID NO: 180672 - RNA, 22 nt, Homo sapiens
ucuuugggauauucugaaaggg

SEQ ID NO: 180673 - RNA, 22 nt, Homo sapiens
ucuuuggguagauauguagcug

SEQ ID NO: 180674 - RNA, 19 nt, Homo sapiens
ucuuugguacgugcuuuga

SEQ ID NO: 180675 - RNA, 22 nt, Homo sapiens
ucuuugguagaagcuauuuuau

SEQ ID NO: 180676 - RNA, 22 nt, Homo sapiens
ucuuuggucaucaugggaagca

SEQ ID NO: 180677 - RNA, 22 nt, Homo sapiens
ucuuugguugcacugcaggugu

SEQ ID NO: 180678 - RNA, 22 nt, Homo sapiens
ucuuuguguucaggagccacgu

SEQ ID NO: 180679 - RNA, 22 nt, Homo sapiens
ucuuuugggccucuugucagac

SEQ ID NO: 180680 - RNA, 22 nt, Homo sapiens
ucuuuuggguauggagccauca

SEQ ID NO: 180681 - RNA, 22 nt, Homo sapiens
ugaaacacacagagaagggaga

SEQ ID NO: 180682 - RNA, 22 nt, Homo sapiens
ugaaagguauagguucuggagg

SEQ ID NO: 180683 - RNA, 22 nt, Homo sapiens
ugaaauacuuaauuucuccaug

SEQ ID NO: 180684 - RNA, 22 nt, Homo sapiens
ugaaauaguuaaguugccuagu

SEQ ID NO: 180685 - RNA, 22 nt, Homo sapiens
ugaaaucauguaguuauugcaa

SEQ ID NO: 180686 - RNA, 22 nt, Homo sapiens
ugaaaucuaaaauguuccaaga

SEQ ID NO: 180687 - RNA, 22 nt, Homo sapiens
ugaaaugcagaacuuuaggucu

SEQ ID NO: 180688 - RNA, 22 nt, Homo sapiens
ugaaaugccuugagauuuugac

SEQ ID NO: 180689 - RNA, 22 nt, Homo sapiens
ugaaaugcuaauucguagcuaa

SEQ ID NO: 180690 - RNA, 22 nt, Homo sapiens
ugaaaugguuaugugaggagau

SEQ ID NO: 180691 - RNA, 22 nt, Homo sapiens
ugaacacagccugccucugcca

SEQ ID NO: 180692 - RNA, 22 nt, Homo sapiens
ugaacacaucuccugguaccug

SEQ ID NO: 180693 - RNA, 22 nt, Homo sapiens
ugaacacuggauaaggagucag

SEQ ID NO: 180694 - RNA, 22 nt, Homo sapiens
ugaacagcuaucuugucagugu

SEQ ID NO: 180695 - RNA, 21 nt, Homo sapiens
ugaaccccugcucucaagaaa

SEQ ID NO: 180696 - RNA, 22 nt, Homo sapiens
ugaacugagacuagacuuguuc

SEQ ID NO: 180697 - RNA, 22 nt, Homo sapiens
ugaagcuuguuucuguaccuuu

SEQ ID NO: 180698 - RNA, 22 nt, Homo sapiens
ugaaggccgggcaugguggcuc

SEQ ID NO: 180699 - RNA, 22 nt, Homo sapiens
ugaaguaauguuuuauucuauu

SEQ ID NO: 180700 - RNA, 22 nt, Homo sapiens
ugaagugaaugguaaguaugcc

SEQ ID NO: 180701 - RNA, 22 nt, Homo sapiens
ugaagugggaaaugaguauuaa

SEQ ID NO: 180702 - RNA, 21 nt, Homo sapiens
ugaaguguaaccgugcagggc

SEQ ID NO: 180703 - RNA, 22 nt, Homo sapiens
ugaaguguuuauuuuggccuuc

SEQ ID NO: 180704 - RNA, 22 nt, Homo sapiens
ugaauacuucaaaaaaauagcu

SEQ ID NO: 180705 - RNA, 22 nt, Homo sapiens
ugaauagacacuaaagacugua

SEQ ID NO: 180706 - RNA, 22 nt, Homo sapiens
ugaauagugucacaauaaacau

SEQ ID NO: 180707 - RNA, 22 nt, Homo sapiens
ugaaugauuuuaaaagccucuc

SEQ ID NO: 180708 - RNA, 20 nt, Homo sapiens
ugaauguaauuacagaugua

SEQ ID NO: 180709 - RNA, 23 nt, Homo sapiens
ugaauguaucgaaugugggaaag

SEQ ID NO: 180710 - RNA, 22 nt, Homo sapiens
ugaauguauuuauuaccauuca

SEQ ID NO: 180711 - RNA, 22 nt, Homo sapiens
ugaauguccugacgcugcaguu

SEQ ID NO: 180712 - RNA, 22 nt, Homo sapiens
ugaaugugauggguuucaugug

SEQ ID NO: 180713 - RNA, 22 nt, Homo sapiens
ugaauguucuuaaaacccuugu

SEQ ID NO: 180714 - RNA, 22 nt, Homo sapiens
ugaauucaucucacagaguuaa

SEQ ID NO: 180715 - RNA, 22 nt, Homo sapiens
ugaauugucucucacuggguuc

SEQ ID NO: 180716 - RNA, 22 nt, Homo sapiens
ugacaagaguagagagggugcc

SEQ ID NO: 180717 - RNA, 22 nt, Homo sapiens
ugacaagauauggucuuaucaa

SEQ ID NO: 180718 - RNA, 20 nt, Homo sapiens
ugacaagugagaauuauggg

SEQ ID NO: 180719 - RNA, 18 nt, Homo sapiens
ugacaaugcuaguccugg

SEQ ID NO: 180720 - RNA, 22 nt, Homo sapiens
ugacacagugggggauccuuuu

SEQ ID NO: 180721 - RNA, 22 nt, Homo sapiens
ugacacauguagacaucuggug

SEQ ID NO: 180722 - RNA, 22 nt, Homo sapiens
ugacacuugcccuuagaaacau

SEQ ID NO: 180723 - RNA, 18 nt, Homo sapiens
ugacagcacaugugggga

SEQ ID NO: 180724 - RNA, 22 nt, Homo sapiens
ugacagcuguugaggcauuuau

SEQ ID NO: 180725 - RNA, 22 nt, Homo sapiens
ugacaggagauuaugugauguu

SEQ ID NO: 180726 - RNA, 22 nt, Homo sapiens
ugacaggauggagaucgguauu

SEQ ID NO: 180727 - RNA, 22 nt, Homo sapiens
ugacaggucuaauuuacugaca

SEQ ID NO: 180728 - RNA, 22 nt, Homo sapiens
ugacagugaauaagucucuuaa

SEQ ID NO: 180729 - RNA, 22 nt, Homo sapiens
ugacagugugagauccugucuc

SEQ ID NO: 180730 - RNA, 22 nt, Homo sapiens
ugacaugauguuccuacacugu

SEQ ID NO: 180731 - RNA, 22 nt, Homo sapiens
ugacauggaaguagguauacau

SEQ ID NO: 180732 - RNA, 22 nt, Homo sapiens
ugacauguccaggugguccugu

SEQ ID NO: 180733 - RNA, 21 nt, Homo sapiens
ugacauguuggugugcugcac

SEQ ID NO: 180734 - RNA, 21 nt, Homo sapiens
ugacauuauuucaugucagua

SEQ ID NO: 180735 - RNA, 22 nt, Homo sapiens
ugaccacagaaagugagggagc

SEQ ID NO: 180736 - RNA, 22 nt, Homo sapiens
ugacggaggcauuggaagcuug

SEQ ID NO: 180737 - RNA, 22 nt, Homo sapiens
ugacuaaaacugaguuucauua

SEQ ID NO: 180738 - RNA, 22 nt, Homo sapiens
ugacuacauaaguaaucucaaa

SEQ ID NO: 180739 - RNA, 22 nt, Homo sapiens
ugacuagacuugcaagguugca

SEQ ID NO: 180740 - RNA, 22 nt, Homo sapiens
ugacuagagcaauuggaaacaa

SEQ ID NO: 180741 - RNA, 22 nt, Homo sapiens
ugacuagagggcuuuuguguag

SEQ ID NO: 180742 - RNA, 22 nt, Homo sapiens
ugacuagugcccuuugcugccu

SEQ ID NO: 180743 - RNA, 22 nt, Homo sapiens
ugacuaguuuugcuguuguuau

SEQ ID NO: 180744 - RNA, 22 nt, Homo sapiens
ugacuauugauuuagacgugcu

SEQ ID NO: 180745 - RNA, 22 nt, Homo sapiens
ugacucaguuucucagguagua

SEQ ID NO: 180746 - RNA, 23 nt, Homo sapiens
ugacugaguauauguuuggugcu

SEQ ID NO: 180747 - RNA, 20 nt, Homo sapiens
ugacuggauacccuuuggcu

SEQ ID NO: 180748 - RNA, 22 nt, Homo sapiens
ugacuugaggcucgcacaaguu

SEQ ID NO: 180749 - RNA, 21 nt, Homo sapiens
ugagaacaacaggucaagcag

SEQ ID NO: 180750 - RNA, 22 nt, Homo sapiens
ugagaacaugcacuugagguug

SEQ ID NO: 180751 - RNA, 16 nt, Homo sapiens
ugagaacaugcagcau

SEQ ID NO: 180752 - RNA, 16 nt, Homo sapiens
ugagaacaugggguau

SEQ ID NO: 180753 - RNA, 17 nt, Homo sapiens
ugagaacaugugguauu

SEQ ID NO: 180754 - RNA, 22 nt, Homo sapiens
ugagaacauuccucuuccuggc

SEQ ID NO: 180755 - RNA, 22 nt, Homo sapiens
ugagaaccucugugugcccacu

SEQ ID NO: 180756 - RNA, 22 nt, Homo sapiens
ugagaacugccuguauuuaucu

SEQ ID NO: 180757 - RNA, 22 nt, Homo sapiens
ugagaacuuauggugauuuuuu

SEQ ID NO: 180758 - RNA, 22 nt, Homo sapiens
ugagaacuuugucuuuuacucu

SEQ ID NO: 180759 - RNA, 22 nt, Homo sapiens
ugagaagacaucuuugcuuugu

SEQ ID NO: 180760 - RNA, 22 nt, Homo sapiens
ugagaagaugaacuccuugguc

SEQ ID NO: 180761 - RNA, 22 nt, Homo sapiens
ugagaagugacgcagcaggguu

SEQ ID NO: 180762 - RNA, 22 nt, Homo sapiens
ugagaauauuugaagauguuag

SEQ ID NO: 180763 - RNA, 22 nt, Homo sapiens
ugagaaugacugggcaugcugc

SEQ ID NO: 180764 - RNA, 19 nt, Homo sapiens
ugagaauguuaccaggucc

SEQ ID NO: 180765 - RNA, 22 nt, Homo sapiens
ugagacaaucucaucucaguga

SEQ ID NO: 180766 - RNA, 22 nt, Homo sapiens
ugagacacuucccagaucccuu

SEQ ID NO: 180767 - RNA, 23 nt, Homo sapiens
ugagacauuggaaaguuaggcag

SEQ ID NO: 180768 - RNA, 22 nt, Homo sapiens
ugagacggagucucgcucucua

SEQ ID NO: 180769 - RNA, 22 nt, Homo sapiens
ugagacggagucuugcccuguc

SEQ ID NO: 180770 - RNA, 22 nt, Homo sapiens
ugagacggagucuugcuaaguu

SEQ ID NO: 180771 - RNA, 22 nt, Homo sapiens
ugagacggaguuauuuauaaua

SEQ ID NO: 180772 - RNA, 22 nt, Homo sapiens
acccuggaguaguaggaaucug

SEQ ID NO: 180773 - RNA, 22 nt, Homo sapiens
acccugucaaaauggaccaauc

SEQ ID NO: 180774 - RNA, 22 nt, Homo sapiens
acccugucagcuggccugggca

SEQ ID NO: 180775 - RNA, 19 nt, Homo sapiens
acccuguccccaccuuuac

SEQ ID NO: 180776 - RNA, 22 nt, Homo sapiens
accugagacuaggcauuuuaua

SEQ ID NO: 180777 - RNA, 23 nt, Homo sapiens
accugauguuucuguggggagcc

SEQ ID NO: 180778 - RNA, 22 nt, Homo sapiens
accugcacagccgaacauagac

SEQ ID NO: 180779 - RNA, 22 nt, Homo sapiens
accuggcacuuagcaaaucuga

SEQ ID NO: 180780 - RNA, 23 nt, Homo sapiens
accugugguuauuuuacucuucc

SEQ ID NO: 180781 - RNA, 22 nt, Homo sapiens
acuagguaguaaucugcagaga

SEQ ID NO: 180782 - RNA, 22 nt, Homo sapiens
acuauacugaagcaaauuaaca

SEQ ID NO: 180783 - RNA, 22 nt, Homo sapiens
acucagagauuagcacauguuu

SEQ ID NO: 180784 - RNA, 22 nt, Homo sapiens
acucagagugggccccuagaua

SEQ ID NO: 180785 - RNA, 22 nt, Homo sapiens
acuccacuuucaccacagcgga

SEQ ID NO: 180786 - RNA, 22 nt, Homo sapiens
acucuguauaaacauugcugua

SEQ ID NO: 180787 - RNA, 22 nt, Homo sapiens
acugacaugaucaggcauguuc

SEQ ID NO: 180788 - RNA, 18 nt, Homo sapiens
acugcacuccaccuuggg

SEQ ID NO: 180789 - RNA, 22 nt, Homo sapiens
acugcacuccaccuugggcaac

SEQ ID NO: 180790 - RNA, 22 nt, Homo sapiens
acugcacuccagacucugucuc

SEQ ID NO: 180791 - RNA, 22 nt, Homo sapiens
acugcacuccagcccgggugac

SEQ ID NO: 180792 - RNA, 22 nt, Homo sapiens
acugcacuccagccuccugaca

SEQ ID NO: 180793 - RNA, 22 nt, Homo sapiens
acugcacuccagccucgcaaca

SEQ ID NO: 180794 - RNA, 22 nt, Homo sapiens
acugcacuccagccucggggac

SEQ ID NO: 180795 - RNA, 22 nt, Homo sapiens
acugcacuccagccucggugac

SEQ ID NO: 180796 - RNA, 22 nt, Homo sapiens
acugcacuccagccugagccug

SEQ ID NO: 180797 - RNA, 22 nt, Homo sapiens
acugcacuccagccugccgaca

SEQ ID NO: 180798 - RNA, 22 nt, Homo sapiens
acugcacuccagccugcuggca

SEQ ID NO: 180799 - RNA, 22 nt, Homo sapiens
acugcacuccagccugcugggu

SEQ ID NO: 180800 - RNA, 22 nt, Homo sapiens
acugcacuccagccuugcgaca

SEQ ID NO: 180801 - RNA, 22 nt, Homo sapiens
acugcacuccagccuuggcggc

SEQ ID NO: 180802 - RNA, 22 nt, Homo sapiens
acugcacuccagcuuuggugac

SEQ ID NO: 180803 - RNA, 20 nt, Homo sapiens
acugcacuccaggcugccca

SEQ ID NO: 180804 - RNA, 20 nt, Homo sapiens
acugcacuccagucucuggg

SEQ ID NO: 180805 - RNA, 22 nt, Homo sapiens
acugcacuccggccucgugaca

SEQ ID NO: 180806 - RNA, 22 nt, Homo sapiens
acugcacuucaaccucauugac

SEQ ID NO: 180807 - RNA, 22 nt, Homo sapiens
acugcauuugucccuuuugaac

SEQ ID NO: 180808 - RNA, 22 nt, Homo sapiens
acugcauuugucugucucaauu

SEQ ID NO: 180809 - RNA, 22 nt, Homo sapiens
acugccuaaugacuuauguuuu

SEQ ID NO: 180810 - RNA, 22 nt, Homo sapiens
acuggacuuaaugaugaauugu

SEQ ID NO: 180811 - RNA, 22 nt, Homo sapiens
acuggcaauggcagaaauaguu

SEQ ID NO: 180812 - RNA, 22 nt, Homo sapiens
acuggcauagggcgggcacagu

SEQ ID NO: 180813 - RNA, 22 nt, Homo sapiens
acuggcucugcuuuacaaacag

SEQ ID NO: 180814 - RNA, 22 nt, Homo sapiens
acuggcuuauuucacuuagcau

SEQ ID NO: 180815 - RNA, 22 nt, Homo sapiens
acuguacuccauccugggugac

SEQ ID NO: 180816 - RNA, 22 nt, Homo sapiens
acuguguguuugucuagcacag

SEQ ID NO: 180817 - RNA, 22 nt, Homo sapiens
acuuggcaaaguuuuaaacagc

SEQ ID NO: 180818 - RNA, 21 nt, Homo sapiens
agaaaaucuuaugggaaacau

SEQ ID NO: 180819 - RNA, 22 nt, Homo sapiens
agaaaugcagcaugaggcggca

SEQ ID NO: 180820 - RNA, 22 nt, Homo sapiens
agaaccaaucccacauggauac

SEQ ID NO: 180821 - RNA, 22 nt, Homo sapiens
agaagaacauagggugacugaa

SEQ ID NO: 180822 - RNA, 22 nt, Homo sapiens
agaauaauguccccccaaggga

SEQ ID NO: 180823 - RNA, 22 nt, Homo sapiens
agaauguaaacagaauagagga

SEQ ID NO: 180824 - RNA, 22 nt, Homo sapiens
agaauguauauucuguaguugu

SEQ ID NO: 180825 - RNA, 22 nt, Homo sapiens
agaaugucaguauuggcuaaaa

SEQ ID NO: 180826 - RNA, 22 nt, Homo sapiens
agaauucugucauguuuauauu

SEQ ID NO: 180827 - RNA, 22 nt, Homo sapiens
agacagcugguagcacuuccug

SEQ ID NO: 180828 - RNA, 22 nt, Homo sapiens
agacaguguguguauauauggu

SEQ ID NO: 180829 - RNA, 22 nt, Homo sapiens
agacccuguauguguuuaguuu

SEQ ID NO: 180830 - RNA, 22 nt, Homo sapiens
agacucauuuuuaucgagcaug

SEQ ID NO: 180831 - RNA, 22 nt, Homo sapiens
agacuuagagagucuauucuau

SEQ ID NO: 180832 - RNA, 21 nt, Homo sapiens
agagaacugaaacaugugacu

SEQ ID NO: 180833 - RNA, 19 nt, Homo sapiens
agagacucauuguagcauu

SEQ ID NO: 180834 - RNA, 22 nt, Homo sapiens
agagagguggguggagccccca

SEQ ID NO: 180835 - RNA, 20 nt, Homo sapiens
agagcaaagccgcaccccua

SEQ ID NO: 180836 - RNA, 22 nt, Homo sapiens
agagccacacucuccuaacuca

SEQ ID NO: 180837 - RNA, 22 nt, Homo sapiens
agagguauuggaaggaguguca

SEQ ID NO: 180838 - RNA, 20 nt, Homo sapiens
agagguuuugauagguucug

SEQ ID NO: 180839 - RNA, 22 nt, Homo sapiens
agagguuuugcacugguucuuu

SEQ ID NO: 180840 - RNA, 22 nt, Homo sapiens
agaguauagcaacuuaguaaaa

SEQ ID NO: 180841 - RNA, 18 nt, Homo sapiens
agaguaucauuuccccca

SEQ ID NO: 180842 - RNA, 22 nt, Homo sapiens
agagucacaugaggcccuucau

SEQ ID NO: 180843 - RNA, 22 nt, Homo sapiens
agagugcaaagguuggggcugg

SEQ ID NO: 180844 - RNA, 22 nt, Homo sapiens
agagugcaauggcaccaucucg

SEQ ID NO: 180845 - RNA, 22 nt, Homo sapiens
agagugcuuuauuagauguagc

SEQ ID NO: 180846 - RNA, 22 nt, Homo sapiens
cagggcauugucuucuuaguac

SEQ ID NO: 180847 - RNA, 22 nt, Homo sapiens
cagguaagaugcuuucucuuau

SEQ ID NO: 180848 - RNA, 22 nt, Homo sapiens
cagguacauuuuaaagggcuca

SEQ ID NO: 180849 - RNA, 19 nt, Homo sapiens
cagguagugugcugacaug

SEQ ID NO: 180850 - RNA, 23 nt, Homo sapiens
cagguaguucuuuauaguagugu

SEQ ID NO: 180851 - RNA, 22 nt, Homo sapiens
caggucaucugaguuuaguucu

SEQ ID NO: 180852 - RNA, 22 nt, Homo sapiens
caguacaauguugauuagaagu

SEQ ID NO: 180853 - RNA, 22 nt, Homo sapiens
caguagcaugccucagaaugag

SEQ ID NO: 180854 - RNA, 22 nt, Homo sapiens
cagucacagugacaggaugugg

SEQ ID NO: 180855 - RNA, 20 nt, Homo sapiens
cagucaugaagaacugugag

SEQ ID NO: 180856 - RNA, 22 nt, Homo sapiens
cagugacacugaaaaguucggg

SEQ ID NO: 180857 - RNA, 22 nt, Homo sapiens
cagugcaaagccucugcccaga

SEQ ID NO: 180858 - RNA, 20 nt, Homo sapiens
cagugcacuuucccacuggu

SEQ ID NO: 180859 - RNA, 22 nt, Homo sapiens
cagugcauagaugugccacauu

SEQ ID NO: 180860 - RNA, 22 nt, Homo sapiens
cagugcauaggaucuaaaauuu

SEQ ID NO: 180861 - RNA, 22 nt, Homo sapiens
caguggaugaacaagaagugau

SEQ ID NO: 180862 - RNA, 22 nt, Homo sapiens
cauacaagcuacaaucacaaag

SEQ ID NO: 180863 - RNA, 22 nt, Homo sapiens
cauagcacugagcucuacccuc

SEQ ID NO: 180864 - RNA, 22 nt, Homo sapiens
cauagcacugcacuucagccug

SEQ ID NO: 180865 - RNA, 22 nt, Homo sapiens
caucaaaguggagggaaggacc

SEQ ID NO: 180866 - RNA, 23 nt, Homo sapiens
caucacauagaggaaagaggaca

SEQ ID NO: 180867 - RNA, 22 nt, Homo sapiens
caucacauucugagauacugag

SEQ ID NO: 180868 - RNA, 22 nt, Homo sapiens
caucagagugagauauaagauc

SEQ ID NO: 180869 - RNA, 22 nt, Homo sapiens
caucccauucgaggggcacagc

SEQ ID NO: 180870 - RNA, 22 nt, Homo sapiens
caucccugaaccccagaaaucu

SEQ ID NO: 180871 - RNA, 22 nt, Homo sapiens
caucccugucgucaagucucug

SEQ ID NO: 180872 - RNA, 22 nt, Homo sapiens
caucgcacuccagccuggguaa

SEQ ID NO: 180873 - RNA, 22 nt, Homo sapiens
caugaaagacugaggaauugga

SEQ ID NO: 180874 - RNA, 22 nt, Homo sapiens
caugaacacugugcggcuuccu

SEQ ID NO: 180875 - RNA, 22 nt, Homo sapiens
caugacacuggcauguuucuuu

SEQ ID NO: 180876 - RNA, 22 nt, Homo sapiens
caugcauagccauucauucguu

SEQ ID NO: 180877 - RNA, 22 nt, Homo sapiens
cauggcacagagaauguguucu

SEQ ID NO: 180878 - RNA, 22 nt, Homo sapiens
cauggcacauauauaucuaggu

SEQ ID NO: 180879 - RNA, 22 nt, Homo sapiens
cauggcacuggugggagugucu

SEQ ID NO: 180880 - RNA, 22 nt, Homo sapiens
cauggcauuugcagaguugaaa

SEQ ID NO: 180881 - RNA, 22 nt, Homo sapiens
cauggcucuuguuuacucccag

SEQ ID NO: 180882 - RNA, 22 nt, Homo sapiens
cauggguuuucucaaguaguca

SEQ ID NO: 180883 - RNA, 22 nt, Homo sapiens
caugucuuuuaaacauucaacu

SEQ ID NO: 180884 - RNA, 22 nt, Homo sapiens
caugugcaugagcacauacgug

SEQ ID NO: 180885 - RNA, 22 nt, Homo sapiens
caugugcaugcuuucuuaugug

SEQ ID NO: 180886 - RNA, 22 nt, Homo sapiens
cauugcacuccagccuaggcaa

SEQ ID NO: 180887 - RNA, 22 nt, Homo sapiens
cauugcacuccagccugaggga

SEQ ID NO: 180888 - RNA, 22 nt, Homo sapiens
cauugcacuccagccugaguga

SEQ ID NO: 180889 - RNA, 22 nt, Homo sapiens
cauugcacuccagccugccugg

SEQ ID NO: 180890 - RNA, 22 nt, Homo sapiens
cauugcacuccagccugcugac

SEQ ID NO: 180891 - RNA, 22 nt, Homo sapiens
cauugcacuccagccuggcaac

SEQ ID NO: 180892 - RNA, 22 nt, Homo sapiens
cauugcacuccagcucugggcg

SEQ ID NO: 180893 - RNA, 22 nt, Homo sapiens
cauugcacugcagcccgggcaa

SEQ ID NO: 180894 - RNA, 22 nt, Homo sapiens
cauugcagauccuucaaaugac

SEQ ID NO: 180895 - RNA, 22 nt, Homo sapiens
cauugucccucaaugacuauga

SEQ ID NO: 180896 - RNA, 22 nt, Homo sapiens
cauugucccucaaugucuauga

SEQ ID NO: 180897 - RNA, 22 nt, Homo sapiens
cauuguccuccuggggcuauuu

SEQ ID NO: 180898 - RNA, 22 nt, Homo sapiens
cauuugcacugagacucagcuu

SEQ ID NO: 180899 - RNA, 22 nt, Homo sapiens
cauuugguggcuacagaguaac

SEQ ID NO: 180900 - RNA, 22 nt, Homo sapiens
cauuuuacuuuccagacgugga

SEQ ID NO: 180901 - RNA, 22 nt, Homo sapiens
cauuuugcaguuucugucucca

SEQ ID NO: 180902 - RNA, 22 nt, Homo sapiens
ccaaaguauuuucacugauauc

SEQ ID NO: 180903 - RNA, 22 nt, Homo sapiens
agcacauauauuucccaaaaca

SEQ ID NO: 180904 - RNA, 22 nt, Homo sapiens
agcagagcauauucauucgggg

SEQ ID NO: 180905 - RNA, 22 nt, Homo sapiens
agcagauguuuagugagcgccu

SEQ ID NO: 180906 - RNA, 22 nt, Homo sapiens
agcagcauauuuuuauaaugua

SEQ ID NO: 180907 - RNA, 22 nt, Homo sapiens
agcagcaucgggaaguuggcca

SEQ ID NO: 180908 - RNA, 22 nt, Homo sapiens
agcagcaugaggggacuucugc

SEQ ID NO: 180909 - RNA, 22 nt, Homo sapiens
agcagcaugcaaauggacuaau

SEQ ID NO: 180910 - RNA, 22 nt, Homo sapiens
agcagcauuaugauauaucuua

SEQ ID NO: 180911 - RNA, 22 nt, Homo sapiens
agcagcuuugaucugaaugauu

SEQ ID NO: 180912 - RNA, 22 nt, Homo sapiens
agcagcuuugcauggccugugg

SEQ ID NO: 180913 - RNA, 21 nt, Homo sapiens
agcagcuuugguugaagcaga

SEQ ID NO: 180914 - RNA, 22 nt, Homo sapiens
agcagguguccacaauguuugc

SEQ ID NO: 180915 - RNA, 22 nt, Homo sapiens
agcagguguggcuuauccugaa

SEQ ID NO: 180916 - RNA, 22 nt, Homo sapiens
agcaguagaauuccugcaucac

SEQ ID NO: 180917 - RNA, 22 nt, Homo sapiens
agcaucacaugggcugcuuggg

SEQ ID NO: 180918 - RNA, 20 nt, Homo sapiens
agcaucauugcaauuuguca

SEQ ID NO: 180919 - RNA, 22 nt, Homo sapiens
agcaucauuugauguucccgag

SEQ ID NO: 180920 - RNA, 20 nt, Homo sapiens
agcaucguuguguuauagcc

SEQ ID NO: 180921 - RNA, 22 nt, Homo sapiens
agccaagacucuguuccccuug

SEQ ID NO: 180922 - RNA, 21 nt, Homo sapiens
agccaguguuccuuguggcuc

SEQ ID NO: 180923 - RNA, 22 nt, Homo sapiens
agccaguuuggcuaauuuuggc

SEQ ID NO: 180924 - RNA, 22 nt, Homo sapiens
agccuguguugaauuauagaaa

SEQ ID NO: 180925 - RNA, 22 nt, Homo sapiens
agccuucauucugacaguagga

SEQ ID NO: 180926 - RNA, 22 nt, Homo sapiens
agcuaaaucucauguugaauug

SEQ ID NO: 180927 - RNA, 22 nt, Homo sapiens
agcuaacauuuuuccucuucca

SEQ ID NO: 180928 - RNA, 23 nt, Homo sapiens
agcuagagaggcuggggauacag

SEQ ID NO: 180929 - RNA, 22 nt, Homo sapiens
agcugaguguuccaagagcgag

SEQ ID NO: 180930 - RNA, 22 nt, Homo sapiens
agcugcaauguuuaguauaaua

SEQ ID NO: 180931 - RNA, 22 nt, Homo sapiens
agcugcacaaauggaugugagg

SEQ ID NO: 180932 - RNA, 20 nt, Homo sapiens
agcugcagauauaaauccgc

SEQ ID NO: 180933 - RNA, 16 nt, Homo sapiens
agcuggaauuacaggc

SEQ ID NO: 180934 - RNA, 22 nt, Homo sapiens
agcuggcuguggagaaaccccu

SEQ ID NO: 180935 - RNA, 23 nt, Homo sapiens
agcugguacuagaggcuugcgcc

SEQ ID NO: 180936 - RNA, 22 nt, Homo sapiens
agcuggucucaggugcccugcu

SEQ ID NO: 180937 - RNA, 22 nt, Homo sapiens
agcugguuuauuucucacaaca

SEQ ID NO: 180938 - RNA, 22 nt, Homo sapiens
agcuguaguuuauucauguuaa

SEQ ID NO: 180939 - RNA, 22 nt, Homo sapiens
agcuguaguuugguggauguaa

SEQ ID NO: 180940 - RNA, 19 nt, Homo sapiens
agcuguguugccugugaga

SEQ ID NO: 180941 - RNA, 22 nt, Homo sapiens
agcuguuguuaauuaacucauu

SEQ ID NO: 180942 - RNA, 22 nt, Homo sapiens
agcuuaugcuuggaagagauga

SEQ ID NO: 180943 - RNA, 22 nt, Homo sapiens
agcuucauucugaauagguuga

SEQ ID NO: 180944 - RNA, 22 nt, Homo sapiens
agcuucauuguuaugaauguca

SEQ ID NO: 180945 - RNA, 20 nt, Homo sapiens
agcuugguuuggaugaucac

SEQ ID NO: 180946 - RNA, 22 nt, Homo sapiens
aggaagacauauagaacuaaaa

SEQ ID NO: 180947 - RNA, 16 nt, Homo sapiens
aggaagacuuagagau

SEQ ID NO: 180948 - RNA, 22 nt, Homo sapiens
aggaagugugcaauuaauuucu

SEQ ID NO: 180949 - RNA, 23 nt, Homo sapiens
aggaauggaaaaccaaguaucau

SEQ ID NO: 180950 - RNA, 22 nt, Homo sapiens
aggaauggaaacuuuugauggu

SEQ ID NO: 180951 - RNA, 22 nt, Homo sapiens
aggaaugucaaugguaguuuaa

SEQ ID NO: 180952 - RNA, 22 nt, Homo sapiens
aggacacugauagucuuuggca

SEQ ID NO: 180953 - RNA, 22 nt, Homo sapiens
aggagcacaauggucaugugga

SEQ ID NO: 180954 - RNA, 21 nt, Homo sapiens
aggagcauuguugugguggag

SEQ ID NO: 180955 - RNA, 22 nt, Homo sapiens
aggagcuuuggggaaaacagau

SEQ ID NO: 180956 - RNA, 22 nt, Homo sapiens
aggagguagaacauugccauuu

SEQ ID NO: 180957 - RNA, 22 nt, Homo sapiens
aggagguagucugucccuuagc

SEQ ID NO: 180958 - RNA, 22 nt, Homo sapiens
aggagguugguaccaucuguuu

SEQ ID NO: 180959 - RNA, 22 nt, Homo sapiens
aggcaagugggagacagcauuu

SEQ ID NO: 180960 - RNA, 22 nt, Homo sapiens
aggcacgguggcucacaccugu

SEQ ID NO: 180961 - RNA, 22 nt, Homo sapiens
aggcacggugucucaugccugu

SEQ ID NO: 180962 - RNA, 22 nt, Homo sapiens
aggcauggagacuaaaauuaua

SEQ ID NO: 180963 - RNA, 23 nt, Homo sapiens
aggcauuguacaguaauggaaaa

SEQ ID NO: 180964 - RNA, 22 nt, Homo sapiens
aggcauugugcaucgaugauuu

SEQ ID NO: 180965 - RNA, 23 nt, Homo sapiens
aggccaguuuuuccugcuugcug

SEQ ID NO: 180966 - RNA, 22 nt, Homo sapiens
aggcugguauuuacaaaagcuc

SEQ ID NO: 180967 - RNA, 22 nt, Homo sapiens
aggcuguguggauaauauuggg

SEQ ID NO: 180968 - RNA, 22 nt, Homo sapiens
aggcuuguuuuacuaacuggua

SEQ ID NO: 180969 - RNA, 22 nt, Homo sapiens
agggaagugugcuaugcauuua

SEQ ID NO: 180970 - RNA, 22 nt, Homo sapiens
agggaauguaaguuuuaugaga

SEQ ID NO: 180971 - RNA, 22 nt, Homo sapiens
agggagcaaaguggucuuucuc

SEQ ID NO: 180972 - RNA, 22 nt, Homo sapiens
agggcaagacuuguuaagaaca

SEQ ID NO: 180973 - RNA, 22 nt, Homo sapiens
agguaaacauggggacugcuac

SEQ ID NO: 180974 - RNA, 22 nt, Homo sapiens
agguaagaugugacuugguguu

SEQ ID NO: 180975 - RNA, 22 nt, Homo sapiens
agguaauuuuaucauuauguga

SEQ ID NO: 180976 - RNA, 22 nt, Homo sapiens
agguaauuuucccagagggaaa

SEQ ID NO: 180977 - RNA, 22 nt, Homo sapiens
agguagguugagaugggcauca

SEQ ID NO: 180978 - RNA, 22 nt, Homo sapiens
aggucaccucaggaaauacuga

SEQ ID NO: 180979 - RNA, 21 nt, Homo sapiens
aggucaugaagauguucuaau

SEQ ID NO: 180980 - RNA, 22 nt, Homo sapiens
agguccacuuacuacuccuguu

SEQ ID NO: 180981 - RNA, 22 nt, Homo sapiens
aggugacugguuuaucuggcag

SEQ ID NO: 180982 - RNA, 22 nt, Homo sapiens
aggugcacucagaaaacagaua

SEQ ID NO: 180983 - RNA, 22 nt, Homo sapiens
aggugcugagcagagaauccug

SEQ ID NO: 180984 - RNA, 21 nt, Homo sapiens
aggugucuuggguucccuggc

SEQ ID NO: 180985 - RNA, 22 nt, Homo sapiens
agguuaucccgcauuauuuggu

SEQ ID NO: 180986 - RNA, 22 nt, Homo sapiens
agguucccuuuuggccugggau

SEQ ID NO: 180987 - RNA, 22 nt, Homo sapiens
agguuguguuugugauuagaua

SEQ ID NO: 180988 - RNA, 22 nt, Homo sapiens
aguaaagcaucagcuagaugug

SEQ ID NO: 180989 - RNA, 22 nt, Homo sapiens
aguaaauuucugugcuuucaua

SEQ ID NO: 180990 - RNA, 22 nt, Homo sapiens
aucagugagugguuagugaaug

SEQ ID NO: 180991 - RNA, 22 nt, Homo sapiens
aucagugcagugggaacuagaa

SEQ ID NO: 180992 - RNA, 22 nt, Homo sapiens
aucagugcauguuuguugagcu

SEQ ID NO: 180993 - RNA, 22 nt, Homo sapiens
aucauacuguuuugauuacugu

SEQ ID NO: 180994 - RNA, 22 nt, Homo sapiens
aucauaucauuggugaacagug

SEQ ID NO: 180995 - RNA, 22 nt, Homo sapiens
aucaucaugcacuacagccugg

SEQ ID NO: 180996 - RNA, 22 nt, Homo sapiens
aucauccugucaggagcuguga

SEQ ID NO: 180997 - RNA, 22 nt, Homo sapiens
aucaugucuucccagugauucu

SEQ ID NO: 180998 - RNA, 22 nt, Homo sapiens
aucauguuuauguguaggauau

SEQ ID NO: 180999 - RNA, 22 nt, Homo sapiens
auccagaugggcuuaauguaau

SEQ ID NO: 181000 - RNA, 22 nt, Homo sapiens
auccauguggauaaauguguau

SEQ ID NO: 181001 - RNA, 22 nt, Homo sapiens
auccauugcucaagagaaguca

SEQ ID NO: 181002 - RNA, 22 nt, Homo sapiens
aucccagaaacucggguuucuc

SEQ ID NO: 181003 - RNA, 22 nt, Homo sapiens
auccccuugcagugaccggggc

SEQ ID NO: 181004 - RNA, 22 nt, Homo sapiens
aucccugugacgagcaucccua

SEQ ID NO: 181005 - RNA, 22 nt, Homo sapiens
aucccuugacguggagucucug

SEQ ID NO: 181006 - RNA, 22 nt, Homo sapiens
aucccuuucugauacuuucccu

SEQ ID NO: 181007 - RNA, 22 nt, Homo sapiens
auccucaguggcuuaaguauag

SEQ ID NO: 181008 - RNA, 22 nt, Homo sapiens
auccugaagcuuuacugaauuc

SEQ ID NO: 181009 - RNA, 22 nt, Homo sapiens
auccuugagaaaauaaaugacc

SEQ ID NO: 181010 - RNA, 22 nt, Homo sapiens
auccuuuagacuguccaguuga

SEQ ID NO: 181011 - RNA, 22 nt, Homo sapiens
aucuaaaucucauaugggcaca

SEQ ID NO: 181012 - RNA, 22 nt, Homo sapiens
aucuagagaggcagucuggccg

SEQ ID NO: 181013 - RNA, 21 nt, Homo sapiens
aucucacuugaauguaaaagc

SEQ ID NO: 181014 - RNA, 20 nt, Homo sapiens
aucucugggcaaaggaaaau

SEQ ID NO: 181015 - RNA, 22 nt, Homo sapiens
aucugauggagagcguguggcu

SEQ ID NO: 181016 - RNA, 22 nt, Homo sapiens
aucugcuccuggugaggguuuc

SEQ ID NO: 181017 - RNA, 22 nt, Homo sapiens
aucuggcuccuuuugacaaugc

SEQ ID NO: 181018 - RNA, 22 nt, Homo sapiens
aucugguguccucgugggaguc

SEQ ID NO: 181019 - RNA, 22 nt, Homo sapiens
aucuguguuuaaggucccagaa

SEQ ID NO: 181020 - RNA, 22 nt, Homo sapiens
aucuuuggauacuugauauagu

SEQ ID NO: 181021 - RNA, 22 nt, Homo sapiens
aucuuuggcgggaauaucacag

SEQ ID NO: 181022 - RNA, 22 nt, Homo sapiens
aucuuuggugcaugauacuuug

SEQ ID NO: 181023 - RNA, 22 nt, Homo sapiens
augaaagguugucuuaagccau

SEQ ID NO: 181024 - RNA, 22 nt, Homo sapiens
augaaaugcauguuaaguccgu

SEQ ID NO: 181025 - RNA, 22 nt, Homo sapiens
augaaauguaugagucuggguu

SEQ ID NO: 181026 - RNA, 17 nt, Homo sapiens
augaacucaucauuuuu

SEQ ID NO: 181027 - RNA, 22 nt, Homo sapiens
augaacucaucauuuuuauggc

SEQ ID NO: 181028 - RNA, 22 nt, Homo sapiens
augaacucaucauuuuuugugg

SEQ ID NO: 181029 - RNA, 17 nt, Homo sapiens
augaacucaucguucuu

SEQ ID NO: 181030 - RNA, 22 nt, Homo sapiens
augaaguauuaggacacauuua

SEQ ID NO: 181031 - RNA, 22 nt, Homo sapiens
augaagugcaugauaguugguu

SEQ ID NO: 181032 - RNA, 22 nt, Homo sapiens
augaaguguguguucaagucuu

SEQ ID NO: 181033 - RNA, 22 nt, Homo sapiens
augaauagaguuaauugaguac

SEQ ID NO: 181034 - RNA, 22 nt, Homo sapiens
augaauccauuccugccacaga

SEQ ID NO: 181035 - RNA, 22 nt, Homo sapiens
augaaugcacugcggguggaug

SEQ ID NO: 181036 - RNA, 22 nt, Homo sapiens
augaaugucuuauuuugagaaa

SEQ ID NO: 181037 - RNA, 22 nt, Homo sapiens
augacaagagccuucuuuccuu

SEQ ID NO: 181038 - RNA, 22 nt, Homo sapiens
augacagagauaugugaauuuu

SEQ ID NO: 181039 - RNA, 22 nt, Homo sapiens
augacagcaucugugaaguugu

SEQ ID NO: 181040 - RNA, 22 nt, Homo sapiens
augacauguauuuccaggauuu

SEQ ID NO: 181041 - RNA, 22 nt, Homo sapiens
augaccagagguaugauguuug

SEQ ID NO: 181042 - RNA, 22 nt, Homo sapiens
augacuauugcacuuuccuggu

SEQ ID NO: 181043 - RNA, 22 nt, Homo sapiens
augacucagaucuguuccuggu

SEQ ID NO: 181044 - RNA, 22 nt, Homo sapiens
augacuggaacggcacuuuaca

SEQ ID NO: 181045 - RNA, 19 nt, Homo sapiens
augagaacagacuccauuu

SEQ ID NO: 181046 - RNA, 22 nt, Homo sapiens
augagaacugucaaugagagcu

SEQ ID NO: 181047 - RNA, 22 nt, Homo sapiens
augagacuagaagagaauaaua

SEQ ID NO: 181048 - RNA, 18 nt, Homo sapiens
augagagccgauuccugg

SEQ ID NO: 181049 - RNA, 22 nt, Homo sapiens
augagauaaaccaucucuuaag

SEQ ID NO: 181050 - RNA, 22 nt, Homo sapiens
augagauauguuaaaaguuaaa

SEQ ID NO: 181051 - RNA, 22 nt, Homo sapiens
augagaugcaagauuagauggg

SEQ ID NO: 181052 - RNA, 22 nt, Homo sapiens
augagcagaugcuccugccucu

SEQ ID NO: 181053 - RNA, 22 nt, Homo sapiens
augagcucauaaagagugauuu

SEQ ID NO: 181054 - RNA, 22 nt, Homo sapiens
augagcuccucaaggucagaga

SEQ ID NO: 181055 - RNA, 22 nt, Homo sapiens
augaggaaggagccuuugucug

SEQ ID NO: 181056 - RNA, 22 nt, Homo sapiens
augaggaagucaggcccagggg

SEQ ID NO: 181057 - RNA, 22 nt, Homo sapiens
augagggcggacgcccuggaga

SEQ ID NO: 181058 - RNA, 22 nt, Homo sapiens
augagguccuagccaacuuuuu

SEQ ID NO: 181059 - RNA, 22 nt, Homo sapiens
augaggugauaucuggaaauua

SEQ ID NO: 181060 - RNA, 18 nt, Homo sapiens
augagucauuguggaaau

SEQ ID NO: 181061 - RNA, 22 nt, Homo sapiens
augauacugaguugaguucuca

SEQ ID NO: 181062 - RNA, 22 nt, Homo sapiens
augauacuguucuaagauuuuu

SEQ ID NO: 181063 - RNA, 22 nt, Homo sapiens
augaucauggaaguuuuccugu

SEQ ID NO: 181064 - RNA, 22 nt, Homo sapiens
augaucuguagaacuaguccuu

SEQ ID NO: 181065 - RNA, 22 nt, Homo sapiens
augauggaggccgugauggacg

SEQ ID NO: 181066 - RNA, 22 nt, Homo sapiens
augauguguguuuaagaugucu

SEQ ID NO: 181067 - RNA, 22 nt, Homo sapiens
augcaaacaucugaagagacau

SEQ ID NO: 181068 - RNA, 20 nt, Homo sapiens
augcaaacccugcuuugugg

SEQ ID NO: 181069 - RNA, 22 nt, Homo sapiens
augcaaaucuuaaguaugugug

SEQ ID NO: 181070 - RNA, 22 nt, Homo sapiens
augcaacugcacuccagccugg

SEQ ID NO: 181071 - RNA, 22 nt, Homo sapiens
augcaauggaaaggacaauuac

SEQ ID NO: 181072 - RNA, 22 nt, Homo sapiens
augcacaugcgaaaacuugugu

SEQ ID NO: 181073 - RNA, 22 nt, Homo sapiens
augcagaucacauuuuucuguc

SEQ ID NO: 181074 - RNA, 22 nt, Homo sapiens
augcagcugaggguaguggagc

SEQ ID NO: 181075 - RNA, 22 nt, Homo sapiens
augcagguguuuugcacugagu

SEQ ID NO: 181076 - RNA, 22 nt, Homo sapiens
augcauggcagagucaggguac

SEQ ID NO: 181077 - RNA, 20 nt, Homo sapiens
augccacugagcagugguga

SEQ ID NO: 181078 - RNA, 22 nt, Homo sapiens
augccacugcacuucagccugc

SEQ ID NO: 181079 - RNA, 22 nt, Homo sapiens
augccacugcacuucagcuugg

SEQ ID NO: 181080 - RNA, 22 nt, Homo sapiens
augccacuguacucuagccuag

SEQ ID NO: 181081 - RNA, 22 nt, Homo sapiens
augccacuguccuccugccuag

SEQ ID NO: 181082 - RNA, 22 nt, Homo sapiens
augccagggagaauuguucaag

SEQ ID NO: 181083 - RNA, 22 nt, Homo sapiens
augccauugcacuccagccuag

SEQ ID NO: 181084 - RNA, 22 nt, Homo sapiens
augcccauuuguuuucugaaag

SEQ ID NO: 181085 - RNA, 19 nt, Homo sapiens
augccucaguuuuguacuu

SEQ ID NO: 181086 - RNA, 22 nt, Homo sapiens
augcuacugauaagcaaucauu

SEQ ID NO: 181087 - RNA, 22 nt, Homo sapiens
augcuguuuuguagcucccucu

SEQ ID NO: 181088 - RNA, 21 nt, Homo sapiens
auggaaagacugccucuucaa

SEQ ID NO: 181089 - RNA, 22 nt, Homo sapiens
auggaaagcuguuccuacacaa

SEQ ID NO: 181090 - RNA, 22 nt, Homo sapiens
auggaagacuccucuuugggua

SEQ ID NO: 181091 - RNA, 22 nt, Homo sapiens
auggaagcugauuagauaguac

SEQ ID NO: 181092 - RNA, 22 nt, Homo sapiens
auggaaggagaauggucuuuga

SEQ ID NO: 181093 - RNA, 22 nt, Homo sapiens
auggaaugccauuuauaaugga

SEQ ID NO: 181094 - RNA, 22 nt, Homo sapiens
auggacagaaaaaaauagaugu

SEQ ID NO: 181095 - RNA, 22 nt, Homo sapiens
auggacauuaaagcgauguaga

SEQ ID NO: 181096 - RNA, 22 nt, Homo sapiens
auggagagaauuauucucucag

SEQ ID NO: 181097 - RNA, 22 nt, Homo sapiens
auggaguguaauauugagagcu

SEQ ID NO: 181098 - RNA, 22 nt, Homo sapiens
auggaucauauucuugaggagg

SEQ ID NO: 181099 - RNA, 21 nt, Homo sapiens
auuugguguuagaaauaaauu

SEQ ID NO: 181100 - RNA, 22 nt, Homo sapiens
auuugguugggugcgguggcuu

SEQ ID NO: 181101 - RNA, 22 nt, Homo sapiens
uaugaccuuggacaaguuacuu

SEQ ID NO: 181102 - RNA, 22 nt, Homo sapiens
uucagaguggacagaaauuaag

SEQ ID NO: 181103 - RNA, 22 nt, Homo sapiens
uucagcaggccaggcccugacu

SEQ ID NO: 181104 - RNA, 22 nt, Homo sapiens
uucagcaguggccaguggaaau

SEQ ID NO: 181105 - RNA, 22 nt, Homo sapiens
uucagcuaccugggaugcugaa

SEQ ID NO: 181106 - RNA, 22 nt, Homo sapiens
uucaggcuccugugagaaucua

SEQ ID NO: 181107 - RNA, 22 nt, Homo sapiens
uucagggacuuuagacaagaga

SEQ ID NO: 181108 - RNA, 22 nt, Homo sapiens
uucaguaguaaguuggaacucu

SEQ ID NO: 181109 - RNA, 22 nt, Homo sapiens
uucaguagucaaaagauaaggg

SEQ ID NO: 181110 - RNA, 22 nt, Homo sapiens
uucagugagacgaaaacaacaa

SEQ ID NO: 181111 - RNA, 22 nt, Homo sapiens
uucaguggagaggcugaguggu

SEQ ID NO: 181112 - RNA, 22 nt, Homo sapiens
uucaguggguggaugaauauga

SEQ ID NO: 181113 - RNA, 22 nt, Homo sapiens
uucagugguuauuugugagauu

SEQ ID NO: 181114 - RNA, 22 nt, Homo sapiens
uucaguucugcacugaucuuag

SEQ ID NO: 181115 - RNA, 19 nt, Homo sapiens
uucauacagugagagcagc

SEQ ID NO: 181116 - RNA, 22 nt, Homo sapiens
uucauaguaacaguaacuaugg

SEQ ID NO: 181117 - RNA, 22 nt, Homo sapiens
uucauaguauuuuucuccaaau

SEQ ID NO: 181118 - RNA, 22 nt, Homo sapiens
uucauagucuaauuuuuuccac

SEQ ID NO: 181119 - RNA, 22 nt, Homo sapiens
uucauagugaaaaauucaaagu

SEQ ID NO: 181120 - RNA, 22 nt, Homo sapiens
uucauaguucuuuuagucauua

SEQ ID NO: 181121 - RNA, 22 nt, Homo sapiens
uucaucaggaauauugaccugu

SEQ ID NO: 181122 - RNA, 20 nt, Homo sapiens
uucaucaggauauuggucua

SEQ ID NO: 181123 - RNA, 23 nt, Homo sapiens
uucaucagggauauuggccugaa

SEQ ID NO: 181124 - RNA, 21 nt, Homo sapiens
uucaucuggccguauuccagg

SEQ ID NO: 181125 - RNA, 22 nt, Homo sapiens
uucauggaacaaguggguucaa

SEQ ID NO: 181126 - RNA, 22 nt, Homo sapiens
uucauggacucaauaguuucgc

SEQ ID NO: 181127 - RNA, 22 nt, Homo sapiens
uucauggguuaauuuguucgau

SEQ ID NO: 181128 - RNA, 22 nt, Homo sapiens
uucauguaauauuucacagcuu

SEQ ID NO: 181129 - RNA, 22 nt, Homo sapiens
uucauguaauuccauaagguaa

SEQ ID NO: 181130 - RNA, 22 nt, Homo sapiens
uucauugcugcuuaucuccaga

SEQ ID NO: 181131 - RNA, 22 nt, Homo sapiens
uuccaauguuccguguugcagu

SEQ ID NO: 181132 - RNA, 16 nt, Homo sapiens
uuccacagucgaggug

SEQ ID NO: 181133 - RNA, 23 nt, Homo sapiens
uuccaccauugacuaguuacaua

SEQ ID NO: 181134 - RNA, 22 nt, Homo sapiens
uuccaggugggcgugggccugg

SEQ ID NO: 181135 - RNA, 22 nt, Homo sapiens
uuccaguaauagcacagcauug

SEQ ID NO: 181136 - RNA, 22 nt, Homo sapiens
uuccagugggacgagaugugga

SEQ ID NO: 181137 - RNA, 22 nt, Homo sapiens
uuccauguaguugagcaguuuu

SEQ ID NO: 181138 - RNA, 22 nt, Homo sapiens
uucccagagagggacuucuaau

SEQ ID NO: 181139 - RNA, 22 nt, Homo sapiens
uucccagucaaacgaaggacuu

SEQ ID NO: 181140 - RNA, 22 nt, Homo sapiens
uucccaguggaacauguaguca

SEQ ID NO: 181141 - RNA, 22 nt, Homo sapiens
uucccagugguuagcucugguc

SEQ ID NO: 181142 - RNA, 20 nt, Homo sapiens
uucccucagccuugagggua

SEQ ID NO: 181143 - RNA, 22 nt, Homo sapiens
uucccuguaucuucugccaugu

SEQ ID NO: 181144 - RNA, 22 nt, Homo sapiens
uucccugugggaguaggaaagu

SEQ ID NO: 181145 - RNA, 22 nt, Homo sapiens
uucccuuucugaaaaucucauu

SEQ ID NO: 181146 - RNA, 22 nt, Homo sapiens
uucccuuucuuaaagaguuagg

SEQ ID NO: 181147 - RNA, 22 nt, Homo sapiens
uucccuuuguuaaauuggaaga

SEQ ID NO: 181148 - RNA, 22 nt, Homo sapiens
uucccuuuuuucuaguagguag

SEQ ID NO: 181149 - RNA, 19 nt, Homo sapiens
uuccuagugguugggaagu

SEQ ID NO: 181150 - RNA, 19 nt, Homo sapiens
uuccugagaacaagggcuu

SEQ ID NO: 181151 - RNA, 22 nt, Homo sapiens
uuccugaggccuccccagaagc

SEQ ID NO: 181152 - RNA, 22 nt, Homo sapiens
uuccugucuuccaagagagauu

SEQ ID NO: 181153 - RNA, 22 nt, Homo sapiens
uuccuuaguuauuugguccccu

SEQ ID NO: 181154 - RNA, 22 nt, Homo sapiens
uuccuugagaaaggcacaaguu

SEQ ID NO: 181155 - RNA, 22 nt, Homo sapiens
uuccuugagaaaguacaaggcu

SEQ ID NO: 181156 - RNA, 22 nt, Homo sapiens
uuccuugguucagggaaggucc

SEQ ID NO: 181157 - RNA, 22 nt, Homo sapiens
uucuacuucauuaggaggauug

SEQ ID NO: 181158 - RNA, 22 nt, Homo sapiens
uucuagcacuuugggagacuga

SEQ ID NO: 181159 - RNA, 20 nt, Homo sapiens
uucuaguacuucuguuucca

SEQ ID NO: 181160 - RNA, 22 nt, Homo sapiens
uucucaauggaugugggaccag

SEQ ID NO: 181161 - RNA, 22 nt, Homo sapiens
uucucagcccccugacagucag

SEQ ID NO: 181162 - RNA, 22 nt, Homo sapiens
uucucaguaauuccagauuuuu

SEQ ID NO: 181163 - RNA, 22 nt, Homo sapiens
uucucagugaacuccagcuugu

SEQ ID NO: 181164 - RNA, 17 nt, Homo sapiens
uucucaguucugaucuc

SEQ ID NO: 181165 - RNA, 22 nt, Homo sapiens
uucucauggaacaucuguacug

SEQ ID NO: 181166 - RNA, 22 nt, Homo sapiens
uucucgcuuuuuccaccuguau

SEQ ID NO: 181167 - RNA, 22 nt, Homo sapiens
uucucugggacauaggucgggu

SEQ ID NO: 181168 - RNA, 22 nt, Homo sapiens
uucugcacaucgaucacaagau

SEQ ID NO: 181169 - RNA, 22 nt, Homo sapiens
uucuggaaaucagcagagggug

SEQ ID NO: 181170 - RNA, 22 nt, Homo sapiens
uucugugguagaaaucucaaau

SEQ ID NO: 181171 - RNA, 22 nt, Homo sapiens
uucugugguuucauuuaccugu

SEQ ID NO: 181172 - RNA, 21 nt, Homo sapiens
uucuucaggcagaaggauuau

SEQ ID NO: 181173 - RNA, 22 nt, Homo sapiens
uucuuccagccuugaggggccc

SEQ ID NO: 181174 - RNA, 22 nt, Homo sapiens
uucuugcacuuggcccucauua

SEQ ID NO: 181175 - RNA, 22 nt, Homo sapiens
uucuuuaguucacuugcuccag

SEQ ID NO: 181176 - RNA, 21 nt, Homo sapiens
uucuuugcucaguguuagagu

SEQ ID NO: 181177 - RNA, 22 nt, Homo sapiens
uucuuugguacaagggccgacc

SEQ ID NO: 181178 - RNA, 19 nt, Homo sapiens
uucuuuguugugggggcug

SEQ ID NO: 181179 - RNA, 23 nt, Homo sapiens
uugaaaagucaguagccucugau

SEQ ID NO: 181180 - RNA, 22 nt, Homo sapiens
uugaaagaaaggagacugaguu

SEQ ID NO: 181181 - RNA, 22 nt, Homo sapiens
uugaaagcuaucagagauucca

SEQ ID NO: 181182 - RNA, 22 nt, Homo sapiens
uugaaaguguucacaaugguau

SEQ ID NO: 181183 - RNA, 22 nt, Homo sapiens
uugaagacuaauuuagauaaug

SEQ ID NO: 181184 - RNA, 22 nt, Homo sapiens
uugaaggaacgcuguucccuug

SEQ ID NO: 181185 - RNA, 19 nt, Homo sapiens
uugaaggccgccuugcaga

SEQ ID NO: 181186 - RNA, 22 nt, Homo sapiens
uugaagugaagaacaauaucac

SEQ ID NO: 181187 - RNA, 22 nt, Homo sapiens
uugaauagaaguguugaaagug

SEQ ID NO: 181188 - RNA, 22 nt, Homo sapiens
uugaauagacagccagcuuuaa

SEQ ID NO: 181189 - RNA, 22 nt, Homo sapiens
uugaauagcauguuuagugcau

SEQ ID NO: 181190 - RNA, 18 nt, Homo sapiens
uugaauaguguccaaucu

SEQ ID NO: 181191 - RNA, 22 nt, Homo sapiens
uugacaaggagccauugcaucu

SEQ ID NO: 181192 - RNA, 22 nt, Homo sapiens
uugacaaggagugggguugaga

SEQ ID NO: 181193 - RNA, 22 nt, Homo sapiens
uugacaaugcacugugcuaagu

SEQ ID NO: 181194 - RNA, 22 nt, Homo sapiens
uugacacuaauuauuauaggug

SEQ ID NO: 181195 - RNA, 20 nt, Homo sapiens
uugacagagggaaaguugcu

SEQ ID NO: 181196 - RNA, 22 nt, Homo sapiens
uugacaguggcuuaaauugguu

SEQ ID NO: 181197 - RNA, 22 nt, Homo sapiens
uugaccacugggcacaguaagu

SEQ ID NO: 181198 - RNA, 22 nt, Homo sapiens
uugacuucagagcugauucaag

SEQ ID NO: 181199 - RNA, 22 nt, Homo sapiens
uugacuuuuaggaggaaaauga

SEQ ID NO: 181200 - RNA, 22 nt, Homo sapiens
uugagaaucuuugcuaaaggaa

SEQ ID NO: 181201 - RNA, 22 nt, Homo sapiens
uugagacggagucucacucugu

SEQ ID NO: 181202 - RNA, 22 nt, Homo sapiens
uugagauggagccucacucugc

SEQ ID NO: 181203 - RNA, 22 nt, Homo sapiens
gcuagcacauugucaccucuca

SEQ ID NO: 181204 - RNA, 22 nt, Homo sapiens
gcuaugguuuuuagcuccauca

SEQ ID NO: 181205 - RNA, 19 nt, Homo sapiens
gcucaccuugcugcuccag

SEQ ID NO: 181206 - RNA, 17 nt, Homo sapiens
gcugcauucauguagaa

SEQ ID NO: 181207 - RNA, 22 nt, Homo sapiens
gcugcuguaccagaugugguua

SEQ ID NO: 181208 - RNA, 22 nt, Homo sapiens
gcugcuguuucucuuucagcau

SEQ ID NO: 181209 - RNA, 22 nt, Homo sapiens
gcuggaauuaacauagaugugc

SEQ ID NO: 181210 - RNA, 22 nt, Homo sapiens
gcuggcaagaugcugaugcaac

SEQ ID NO: 181211 - RNA, 22 nt, Homo sapiens
uuggcaaguuucugucagcaaa

SEQ ID NO: 181212 - RNA, 22 nt, Homo sapiens
uuggcaaucaauucugacgucu

SEQ ID NO: 181213 - RNA, 21 nt, Homo sapiens
uuggcacucuucucuccuuau

SEQ ID NO: 181214 - RNA, 20 nt, Homo sapiens
uuggcagagucuuuagggua

SEQ ID NO: 181215 - RNA, 22 nt, Homo sapiens
uuggcagucugaggcacagacu

SEQ ID NO: 181216 - RNA, 23 nt, Homo sapiens
uuggcaucugggacacaagcuga

SEQ ID NO: 181217 - RNA, 22 nt, Homo sapiens
uuggcauuguggauggaaucau

SEQ ID NO: 181218 - RNA, 22 nt, Homo sapiens
uuggccaauggugauucccggc

SEQ ID NO: 181219 - RNA, 22 nt, Homo sapiens
uuggccuccuggucauauccag

SEQ ID NO: 181220 - RNA, 21 nt, Homo sapiens
uuggccuggaggccugaaugu

SEQ ID NO: 181221 - RNA, 22 nt, Homo sapiens
uuggcuaagaucacgugagaau

SEQ ID NO: 181222 - RNA, 22 nt, Homo sapiens
uuggcuacagauuaugaauuuc

SEQ ID NO: 181223 - RNA, 22 nt, Homo sapiens
uuggcuguguuccucaaggagu

SEQ ID NO: 181224 - RNA, 22 nt, Homo sapiens
uuggcuguguuucccuacaaau

SEQ ID NO: 181225 - RNA, 22 nt, Homo sapiens
uuggcuuggagaguugaaaugu

SEQ ID NO: 181226 - RNA, 22 nt, Homo sapiens
uuggcuuuuaugcagcuuaggu

SEQ ID NO: 181227 - RNA, 22 nt, Homo sapiens
uugggaauguccuaauaucucg

SEQ ID NO: 181228 - RNA, 22 nt, Homo sapiens
uugggauggaacuuuucaguga

SEQ ID NO: 181229 - RNA, 23 nt, Homo sapiens
uugggcaaaucacuaacgucucc

SEQ ID NO: 181230 - RNA, 23 nt, Homo sapiens
uugggcaaaucacugagggcaga

SEQ ID NO: 181231 - RNA, 17 nt, Homo sapiens
uugggcaagguagguga

SEQ ID NO: 181232 - RNA, 22 nt, Homo sapiens
uugggcaaguggcaugaccaug

SEQ ID NO: 181233 - RNA, 22 nt, Homo sapiens
uugggcaauaggaagcaggugg

SEQ ID NO: 181234 - RNA, 22 nt, Homo sapiens
uugggcuugagggugcccaguc

SEQ ID NO: 181235 - RNA, 22 nt, Homo sapiens
uugguaggcuggccucucucag

SEQ ID NO: 181236 - RNA, 22 nt, Homo sapiens
uuggucagcucaauggagaggg

SEQ ID NO: 181237 - RNA, 22 nt, Homo sapiens
uuggucaggcuaaucucgaacg

SEQ ID NO: 181238 - RNA, 21 nt, Homo sapiens
uugguucccucugacaggucu

SEQ ID NO: 181239 - RNA, 22 nt, Homo sapiens
uugguuccuuagccuaggacua

SEQ ID NO: 181240 - RNA, 22 nt, Homo sapiens
uugguuuccuuccugcuuaacu

SEQ ID NO: 181241 - RNA, 22 nt, Homo sapiens
uuguaaacaucuguacauugcu

SEQ ID NO: 181242 - RNA, 22 nt, Homo sapiens
uuguaaaguucucucccgaaaa

SEQ ID NO: 181243 - RNA, 22 nt, Homo sapiens
uuguacuccagccugggugaca

SEQ ID NO: 181244 - RNA, 22 nt, Homo sapiens
uuguauacucuauuuuagcagu

SEQ ID NO: 181245 - RNA, 22 nt, Homo sapiens
uuguauguaaccauuuggcaaa

SEQ ID NO: 181246 - RNA, 22 nt, Homo sapiens
uuguaugucuucauuugaaaaa

SEQ ID NO: 181247 - RNA, 22 nt, Homo sapiens
uugucaaacucauucuccaucc

SEQ ID NO: 181248 - RNA, 22 nt, Homo sapiens
uuguccaagucccauuuguuga

SEQ ID NO: 181249 - RNA, 22 nt, Homo sapiens
uuguccccacccaaaugucauc

SEQ ID NO: 181250 - RNA, 22 nt, Homo sapiens
uuguccccaucugcugccagaa

SEQ ID NO: 181251 - RNA, 22 nt, Homo sapiens
uuguccccuuccaaaucucaug

SEQ ID NO: 181252 - RNA, 16 nt, Homo sapiens
uugucccuucccaaau

SEQ ID NO: 181253 - RNA, 22 nt, Homo sapiens
uuguccucuccaaaucucaugu

SEQ ID NO: 181254 - RNA, 22 nt, Homo sapiens
uuguccuugagauaguuugcag

SEQ ID NO: 181255 - RNA, 22 nt, Homo sapiens
uugucuccuagacgaccaggcg

SEQ ID NO: 181256 - RNA, 22 nt, Homo sapiens
uugucuugcagcuuaggcauca

SEQ ID NO: 181257 - RNA, 22 nt, Homo sapiens
uugugaauggaguagcaggauc

SEQ ID NO: 181258 - RNA, 22 nt, Homo sapiens
uugugaauggugccgcgauaaa

SEQ ID NO: 181259 - RNA, 22 nt, Homo sapiens
uugugaauggugccucaguaaa

SEQ ID NO: 181260 - RNA, 22 nt, Homo sapiens
uugugaauggugcugcaguaaa

SEQ ID NO: 181261 - RNA, 22 nt, Homo sapiens
uugugaucauugucaaauagug

SEQ ID NO: 181262 - RNA, 22 nt, Homo sapiens
uugugcaaaaguaauugcgguu

SEQ ID NO: 181263 - RNA, 22 nt, Homo sapiens
uugugcauaucagagguuugcu

SEQ ID NO: 181264 - RNA, 22 nt, Homo sapiens
uugugccauucuucugccucag

SEQ ID NO: 181265 - RNA, 22 nt, Homo sapiens
uugugccccuucucagucgggc

SEQ ID NO: 181266 - RNA, 22 nt, Homo sapiens
uugugcuccugugagaaucuag

SEQ ID NO: 181267 - RNA, 22 nt, Homo sapiens
uugugcuuuugagcugagauga

SEQ ID NO: 181268 - RNA, 19 nt, Homo sapiens
uuguguccccacaaaauuc

SEQ ID NO: 181269 - RNA, 22 nt, Homo sapiens
uuguguccccacccaaaucuca

SEQ ID NO: 181270 - RNA, 23 nt, Homo sapiens
uugugucccuacccaaaucucau

SEQ ID NO: 181271 - RNA, 22 nt, Homo sapiens
uugugucccugcccaaaucuca

SEQ ID NO: 181272 - RNA, 17 nt, Homo sapiens
uuguucccauuaaaaag

SEQ ID NO: 181273 - RNA, 22 nt, Homo sapiens
uuuaaaguuagaaggaaagggc

SEQ ID NO: 181274 - RNA, 22 nt, Homo sapiens
uuuaauacugcaucuuuacucu

SEQ ID NO: 181275 - RNA, 18 nt, Homo sapiens
uuuacaguagaaggacuu

SEQ ID NO: 181276 - RNA, 22 nt, Homo sapiens
uuuacaguuuucuaggcuacca

SEQ ID NO: 181277 - RNA, 22 nt, Homo sapiens
uuuacugugggguuucuuagag

SEQ ID NO: 181278 - RNA, 22 nt, Homo sapiens
uuuagcacugugauugacaaaa

SEQ ID NO: 181279 - RNA, 22 nt, Homo sapiens
uuuaggcaauauauucaugucu

SEQ ID NO: 181280 - RNA, 22 nt, Homo sapiens
uuuaggcaugcaguucuauuua

SEQ ID NO: 181281 - RNA, 22 nt, Homo sapiens
uuuagguaauauuaaguagcug

SEQ ID NO: 181282 - RNA, 22 nt, Homo sapiens
uuuagguacgcaccggcucagu

SEQ ID NO: 181283 - RNA, 22 nt, Homo sapiens
uuugagcuagagucucacucug

SEQ ID NO: 181284 - RNA, 22 nt, Homo sapiens
uuugauguugagacuauaaagc

SEQ ID NO: 181285 - RNA, 22 nt, Homo sapiens
uuugauugguguaccugaaagu

SEQ ID NO: 181286 - RNA, 22 nt, Homo sapiens
uuugcaauagguuguggggagg

SEQ ID NO: 181287 - RNA, 23 nt, Homo sapiens
uuugcacuugcuccuucuauggc

SEQ ID NO: 181288 - RNA, 22 nt, Homo sapiens
uuugcaucuuuugcuuccugga

SEQ ID NO: 181289 - RNA, 22 nt, Homo sapiens
uuugcaugcuccuuaugagaau

SEQ ID NO: 181290 - RNA, 22 nt, Homo sapiens
uuugccacugcaggcuguuuaa

SEQ ID NO: 181291 - RNA, 22 nt, Homo sapiens
uuugcugagucugacuucaugg

SEQ ID NO: 181292 - RNA, 22 nt, Homo sapiens
uuugcuugaggucuagcuaccc

SEQ ID NO: 181293 - RNA, 22 nt, Homo sapiens
uuuggauagugugguccuuuua

SEQ ID NO: 181294 - RNA, 22 nt, Homo sapiens
uuuggcauuagauaauugugua

SEQ ID NO: 181295 - RNA, 22 nt, Homo sapiens
uuuggcuguuucuggacuaaga

SEQ ID NO: 181296 - RNA, 22 nt, Homo sapiens
uuuggcuuugagaagcagugga

SEQ ID NO: 181297 - RNA, 22 nt, Homo sapiens
uuugggcuuuuaaucuagagca

SEQ ID NO: 181298 - RNA, 22 nt, Homo sapiens
uuuggucagcugcgggucagcu

SEQ ID NO: 181299 - RNA, 22 nt, Homo sapiens
uuugguguauauguaaacuaug

SEQ ID NO: 181300 - RNA, 22 nt, Homo sapiens
uuugguugccucuaugagccug

SEQ ID NO: 181301 - RNA, 22 nt, Homo sapiens
uuuguacacuguuggugguuau

SEQ ID NO: 181302 - RNA, 22 nt, Homo sapiens
uuuguacucccuuuagauaaaa

SEQ ID NO: 181303 - RNA, 22 nt, Homo sapiens
uuuguacuugguguucuggaaa

SEQ ID NO: 181304 - RNA, 22 nt, Homo sapiens
uuuguagcuacaaagugagaug

SEQ ID NO: 181305 - RNA, 22 nt, Homo sapiens
uuugucacucuuggagguuguu

SEQ ID NO: 181306 - RNA, 22 nt, Homo sapiens
uuuguccccgcccagaucucau

SEQ ID NO: 181307 - RNA, 22 nt, Homo sapiens
uuugucccuuugcaguggcaca

SEQ ID NO: 181308 - RNA, 19 nt, Homo sapiens
uuuguccugcccuuucuca

SEQ ID NO: 181309 - RNA, 22 nt, Homo sapiens
uuugugacacaaacacauauau

SEQ ID NO: 181310 - RNA, 22 nt, Homo sapiens
uuugugacucauggucuagugc

SEQ ID NO: 181311 - RNA, 22 nt, Homo sapiens
uuugugcaaacuaggauugcga

SEQ ID NO: 181312 - RNA, 22 nt, Homo sapiens
uuugugcuaacuuuaacucuua

SEQ ID NO: 181313 - RNA, 22 nt, Homo sapiens
uuugugcuccuaugagaaucua

SEQ ID NO: 181314 - RNA, 22 nt, Homo sapiens
uuuguguccccacccaaaucuc

SEQ ID NO: 181315 - RNA, 22 nt, Homo sapiens
uuuuaagcuacaagagacauau

SEQ ID NO: 181316 - RNA, 22 nt, Homo sapiens
uuuuacacaucaccgcucgugu

SEQ ID NO: 181317 - RNA, 22 nt, Homo sapiens
uuuuacacuucgguugugugca

SEQ ID NO: 181318 - RNA, 22 nt, Homo sapiens
uuuuaguggaauauuuacaguu

SEQ ID NO: 181319 - RNA, 22 nt, Homo sapiens
uuuuaguggacaaagguauuua

SEQ ID NO: 181320 - RNA, 20 nt, Homo sapiens
uuuugaacuuggcaaccugu

SEQ ID NO: 181321 - RNA, 21 nt, Homo sapiens
uuuugcacacuaugcagcuuu

SEQ ID NO: 181322 - RNA, 22 nt, Homo sapiens
uuuugcaguuacagagagugag

SEQ ID NO: 181323 - RNA, 22 nt, Homo sapiens
uuuugcucuucauagguccugu

SEQ ID NO: 181324 - RNA, 22 nt, Homo sapiens
uuuugcucuugguaaugaaaga

SEQ ID NO: 181325 - RNA, 22 nt, Homo sapiens
uuuuggcuagaaauauaccucc

SEQ ID NO: 181326 - RNA, 22 nt, Homo sapiens
uuuugggggugauucacacagu

SEQ ID NO: 181327 - RNA, 22 nt, Homo sapiens
uuuugguauaugcaggggucuu

SEQ ID NO: 181328 - RNA, 22 nt, Homo sapiens
uuuuguacgccuguguccauca

SEQ ID NO: 181329 - RNA, 22 nt, Homo sapiens
uuuugucccaugggcuguuccc

SEQ ID NO: 181330 - RNA, 22 nt, Homo sapiens
uuuuucacuuaaguuaggcuca

SEQ ID NO: 181331 - RNA, 22 nt, Homo sapiens
uuuuugguugguaggcuauuaa

SEQ ID NO: 181332 - RNA, 22 nt, Homo sapiens
ugaaauuauucuuaccaaggug

SEQ ID NO: 181333 - RNA, 21 nt, Homo sapiens
ugaacacuggacugagugucc

SEQ ID NO: 181334 - RNA, 22 nt, Homo sapiens
ugaacagagaaacacuggccau

SEQ ID NO: 181335 - RNA, 22 nt, Homo sapiens
ugaagacucaauuauuaugaac

SEQ ID NO: 181336 - RNA, 22 nt, Homo sapiens
ugaagagucuaaaucugucuuc

SEQ ID NO: 181337 - RNA, 22 nt, Homo sapiens
ugaagcuaugacuauugagcau

SEQ ID NO: 181338 - RNA, 22 nt, Homo sapiens
ugaaggacauucuaugguagau

SEQ ID NO: 181339 - RNA, 22 nt, Homo sapiens
ugaaggaguauggauaagucgu

SEQ ID NO: 181340 - RNA, 22 nt, Homo sapiens
ugaagugcugugggccaggcgu

SEQ ID NO: 181341 - RNA, 22 nt, Homo sapiens
ugaauacugugcaaaggauuug

SEQ ID NO: 181342 - RNA, 22 nt, Homo sapiens
ugaauacuucguucaaagauaa

SEQ ID NO: 181343 - RNA, 22 nt, Homo sapiens
ugaauagacagucacugccucc

SEQ ID NO: 181344 - RNA, 22 nt, Homo sapiens
ugaauauguuaaauaauguucu

SEQ ID NO: 181345 - RNA, 22 nt, Homo sapiens
ugaauauguuaauuagcaucau

SEQ ID NO: 181346 - RNA, 22 nt, Homo sapiens
ugaauauuugcuacucacucuu

SEQ ID NO: 181347 - RNA, 21 nt, Homo sapiens
ugaauauuuggguugugucca

SEQ ID NO: 181348 - RNA, 22 nt, Homo sapiens
ugaaucaugcugcuauaaagac

SEQ ID NO: 181349 - RNA, 22 nt, Homo sapiens
ugaaugcaucauguagggcuca

SEQ ID NO: 181350 - RNA, 22 nt, Homo sapiens
ugaaugcauggggccaagaagg

SEQ ID NO: 181351 - RNA, 21 nt, Homo sapiens
ugaaugcuuuaaauauuagaa

SEQ ID NO: 181352 - RNA, 22 nt, Homo sapiens
ugaauguacuuaacacuggauu

SEQ ID NO: 181353 - RNA, 22 nt, Homo sapiens
ugaauguuugcagcuuauacca

SEQ ID NO: 181354 - RNA, 22 nt, Homo sapiens
ugaauguuugcuuacuuccaua

SEQ ID NO: 181355 - RNA, 22 nt, Homo sapiens
agagguuuugcccucgagauaa

SEQ ID NO: 181356 - RNA, 22 nt, Homo sapiens
agagguuuuggggcugagagcu

SEQ ID NO: 181357 - RNA, 22 nt, Homo sapiens
agaguacugacguuugcaaauu

SEQ ID NO: 181358 - RNA, 15 nt, Homo sapiens
agaguagagacgccc

SEQ ID NO: 181359 - RNA, 22 nt, Homo sapiens
agaguaguuuauuaugcuaagg

SEQ ID NO: 181360 - RNA, 19 nt, Homo sapiens
agaguauugaauuugcccu

SEQ ID NO: 181361 - RNA, 21 nt, Homo sapiens
agagucaucucuaucuguacc

SEQ ID NO: 181362 - RNA, 22 nt, Homo sapiens
agagugcuaaggaaguaauuua

SEQ ID NO: 181363 - RNA, 22 nt, Homo sapiens
agauacaucuaugugucugugu

SEQ ID NO: 181364 - RNA, 22 nt, Homo sapiens
agauauguuuaguuucaaaaug

SEQ ID NO: 181365 - RNA, 22 nt, Homo sapiens
agauauuuguuaggucugucag

SEQ ID NO: 181366 - RNA, 22 nt, Homo sapiens
agaucaauugcugauucgcucu

SEQ ID NO: 181367 - RNA, 22 nt, Homo sapiens
agaucacaguaccguaaggcug

SEQ ID NO: 181368 - RNA, 22 nt, Homo sapiens
agaugccucauguucuagguuc

SEQ ID NO: 181369 - RNA, 22 nt, Homo sapiens
agaugcuguuaucaacuguagc

SEQ ID NO: 181370 - RNA, 22 nt, Homo sapiens
agaugguguuggcugaguguau

SEQ ID NO: 181371 - RNA, 22 nt, Homo sapiens
agauguuguucaucugauuguu

SEQ ID NO: 181372 - RNA, 22 nt, Homo sapiens
agauucauccaaguuguugcau

SEQ ID NO: 181373 - RNA, 22 nt, Homo sapiens
agcaaaucuaugaauguauauu

SEQ ID NO: 181374 - RNA, 23 nt, Homo sapiens
agcaaaugcucuagcacuccaac

SEQ ID NO: 181375 - RNA, 22 nt, Homo sapiens
agcaagaugaaguugagcuagg

SEQ ID NO: 181376 - RNA, 22 nt, Homo sapiens
agcaagauuguucccauuuucu

SEQ ID NO: 181377 - RNA, 22 nt, Homo sapiens
agcacagugaaugguuuacuca

SEQ ID NO: 181378 - RNA, 22 nt, Homo sapiens
agcacaguuaaaugaggcuucu

SEQ ID NO: 181379 - RNA, 21 nt, Homo sapiens
ucuguguugaucucacuggga

SEQ ID NO: 181380 - RNA, 22 nt, Homo sapiens
ucuguguugaugcucauuaauu

SEQ ID NO: 181381 - RNA, 22 nt, Homo sapiens
ucuguuguuaucauaauauuga

SEQ ID NO: 181382 - RNA, 22 nt, Homo sapiens
ucuuauuuggggaaaggguccu

SEQ ID NO: 181383 - RNA, 17 nt, Homo sapiens
ucuucuguuacuguggc

SEQ ID NO: 181384 - RNA, 22 nt, Homo sapiens
ucuuggcaaagaauuuuuggcu

SEQ ID NO: 181385 - RNA, 22 nt, Homo sapiens
ucuugggugaguuugugaauaa

SEQ ID NO: 181386 - RNA, 22 nt, Homo sapiens
ucuuggguuugccuugcugcug

SEQ ID NO: 181387 - RNA, 20 nt, Homo sapiens
ucuuucgguuaccaggcagu

SEQ ID NO: 181388 - RNA, 22 nt, Homo sapiens
ucuuugauaagauccagaagaa

SEQ ID NO: 181389 - RNA, 19 nt, Homo sapiens
ucuuugcuuuucuaagagg

SEQ ID NO: 181390 - RNA, 22 nt, Homo sapiens
ucuuuggagacaaccccagucu

SEQ ID NO: 181391 - RNA, 23 nt, Homo sapiens
ucuuuggcucuaauauaccuugu

SEQ ID NO: 181392 - RNA, 22 nt, Homo sapiens
ucuuugguauuuguggggaauu

SEQ ID NO: 181393 - RNA, 22 nt, Homo sapiens
ucuuugguuagguuuaguugau

SEQ ID NO: 181394 - RNA, 22 nt, Homo sapiens
ucuuuguugcauaggcuuguuc

SEQ ID NO: 181395 - RNA, 22 nt, Homo sapiens
ucuuuugugagucagccucucc

SEQ ID NO: 181396 - RNA, 20 nt, Homo sapiens
ugaaacacauggacuggggu

SEQ ID NO: 181397 - RNA, 18 nt, Homo sapiens
ugaaacacauuuuuuccu

SEQ ID NO: 181398 - RNA, 22 nt, Homo sapiens
ugaaagcuacaggaaaguauuu

SEQ ID NO: 181399 - RNA, 22 nt, Homo sapiens
ugaaaugccuuuaaugaauuua

SEQ ID NO: 181400 - RNA, 22 nt, Homo sapiens
ugaaauggugcggucugcagca

SEQ ID NO: 181401 - RNA, 22 nt, Homo sapiens
ugaaaugucuuuaggaggcuuc

SEQ ID NO: 181402 - RNA, 22 nt, Homo sapiens
ugaaauguugggugauggaauc

SEQ ID NO: 181403 - RNA, 22 nt, Homo sapiens
ugaacagcaccuccuagaguug

SEQ ID NO: 181404 - RNA, 22 nt, Homo sapiens
ugaacagcacguuuauucagaa

SEQ ID NO: 181405 - RNA, 20 nt, Homo sapiens
ugaacugguuacuuucuguc

SEQ ID NO: 181406 - RNA, 22 nt, Homo sapiens
ugaacuguugggggaaauucag

SEQ ID NO: 181407 - RNA, 22 nt, Homo sapiens
ugaagacauuuuugggugugua

SEQ ID NO: 181408 - RNA, 22 nt, Homo sapiens
ugaagacucaguuugagggaca

SEQ ID NO: 181409 - RNA, 22 nt, Homo sapiens
ugaagacucauacuugaaucag

SEQ ID NO: 181410 - RNA, 22 nt, Homo sapiens
ugaaggacauaaggcagaguga

SEQ ID NO: 181411 - RNA, 20 nt, Homo sapiens
ugaaggaggucauuuauacc

SEQ ID NO: 181412 - RNA, 19 nt, Homo sapiens
ugaaguauagggcuucuga

SEQ ID NO: 181413 - RNA, 22 nt, Homo sapiens
ugaagugaagacucacagaagg

SEQ ID NO: 181414 - RNA, 22 nt, Homo sapiens
ugaauacagcacacccaugggu

SEQ ID NO: 181415 - RNA, 18 nt, Homo sapiens
ugaauacagcguugggaa

SEQ ID NO: 181416 - RNA, 22 nt, Homo sapiens
ugaauagaaguggcaggaguag

SEQ ID NO: 181417 - RNA, 22 nt, Homo sapiens
ugaauagagcugcaguggacau

SEQ ID NO: 181418 - RNA, 19 nt, Homo sapiens
ugaaugacaucuaaagucc

SEQ ID NO: 181419 - RNA, 22 nt, Homo sapiens
ugaaugcaucuagaaauuuauu

SEQ ID NO: 181420 - RNA, 22 nt, Homo sapiens
ugaaugcuucaugucugggcug

SEQ ID NO: 181421 - RNA, 22 nt, Homo sapiens
ugaauggauccaauucuuagua

SEQ ID NO: 181422 - RNA, 22 nt, Homo sapiens
ugaauguaacuaaaccugugaa

SEQ ID NO: 181423 - RNA, 22 nt, Homo sapiens
ugaauguaacuaaaggacuuuu

SEQ ID NO: 181424 - RNA, 22 nt, Homo sapiens
ugaauguuguugguugagauau

SEQ ID NO: 181425 - RNA, 22 nt, Homo sapiens
ugaauuguuuacgagaugugag

SEQ ID NO: 181426 - RNA, 23 nt, Homo sapiens
ugacaaccucaugcuuugucaug

SEQ ID NO: 181427 - RNA, 22 nt, Homo sapiens
ugacaagaaagcgucuucuuuu

SEQ ID NO: 181428 - RNA, 23 nt, Homo sapiens
ugacaagagcgagacuuggucuc

SEQ ID NO: 181429 - RNA, 22 nt, Homo sapiens
ugacaagugauuaaggcauauu

SEQ ID NO: 181430 - RNA, 22 nt, Homo sapiens
ugacacagcaagauggaaccau

SEQ ID NO: 181431 - RNA, 17 nt, Homo sapiens
ugacagaaacuuguugu

SEQ ID NO: 181432 - RNA, 23 nt, Homo sapiens
ugacagaccuucuggaagaaguc

SEQ ID NO: 181433 - RNA, 22 nt, Homo sapiens
ugacagcaucaggauuggagag

SEQ ID NO: 181434 - RNA, 22 nt, Homo sapiens
ugacaguaaacagucuugauua

SEQ ID NO: 181435 - RNA, 22 nt, Homo sapiens
ugacaguaucuacagcuucuua

SEQ ID NO: 181436 - RNA, 22 nt, Homo sapiens
ugacagucaccaggacccacag

SEQ ID NO: 181437 - RNA, 23 nt, Homo sapiens
ugacagugcuugaaauugcucuu

SEQ ID NO: 181438 - RNA, 22 nt, Homo sapiens
ugacaugaagucucccucuguu

SEQ ID NO: 181439 - RNA, 22 nt, Homo sapiens
ugacauguagagaacuucucau

SEQ ID NO: 181440 - RNA, 22 nt, Homo sapiens
ugacauguauaucuuacgcuau

SEQ ID NO: 181441 - RNA, 22 nt, Homo sapiens
ugacauugggagugaagugaag

SEQ ID NO: 181442 - RNA, 17 nt, Homo sapiens
ugaccacugauucuacu

SEQ ID NO: 181443 - RNA, 22 nt, Homo sapiens
ugacccauagaaauguggauaa

SEQ ID NO: 181444 - RNA, 22 nt, Homo sapiens
ugaccuguuugaaauugccaau

SEQ ID NO: 181445 - RNA, 22 nt, Homo sapiens
ugacggaggacaccugcggaau

SEQ ID NO: 181446 - RNA, 22 nt, Homo sapiens
ugacuacaaccuccaccucccg

SEQ ID NO: 181447 - RNA, 22 nt, Homo sapiens
ugacuaggaaauuagaacuuuu

SEQ ID NO: 181448 - RNA, 22 nt, Homo sapiens
ugacuagggcucuaaacagcuc

SEQ ID NO: 181449 - RNA, 22 nt, Homo sapiens
ugacuagucauaggcauggggg

SEQ ID NO: 181450 - RNA, 22 nt, Homo sapiens
ugacuauaucucuguauaaacu

SEQ ID NO: 181451 - RNA, 22 nt, Homo sapiens
ugacuggaaacaguguuauuug

SEQ ID NO: 181452 - RNA, 22 nt, Homo sapiens
ugacugguguuuaaugagucaa

SEQ ID NO: 181453 - RNA, 22 nt, Homo sapiens
ugacugugcagcuccaucaggg

SEQ ID NO: 181454 - RNA, 23 nt, Homo sapiens
ugacuuaggccucaacuaugacu

SEQ ID NO: 181455 - RNA, 22 nt, Homo sapiens
ugacuucauuugguaauugggu

SEQ ID NO: 181456 - RNA, 22 nt, Homo sapiens
ugacuugaaguuaccauaugca

SEQ ID NO: 181457 - RNA, 22 nt, Homo sapiens
ugacuugagcuggagccugccu

SEQ ID NO: 181458 - RNA, 22 nt, Homo sapiens
ugacuugaguaacuggcucagg

SEQ ID NO: 181459 - RNA, 22 nt, Homo sapiens
ugagaacagauggcuuuauuau

SEQ ID NO: 181460 - RNA, 22 nt, Homo sapiens
ugagaacauggagaacccccca

SEQ ID NO: 181461 - RNA, 20 nt, Homo sapiens
ugagaacauguggcauuugg

SEQ ID NO: 181462 - RNA, 18 nt, Homo sapiens
ugagaacauguguacaca

SEQ ID NO: 181463 - RNA, 22 nt, Homo sapiens
ugagaacuagagaacaagguga

SEQ ID NO: 181464 - RNA, 22 nt, Homo sapiens
ugagaacugcagggagcugcau

SEQ ID NO: 181465 - RNA, 22 nt, Homo sapiens
ggaaagacuauuguaaaggaug

SEQ ID NO: 181466 - RNA, 22 nt, Homo sapiens
ggaaagauguaauauuaucuaa

SEQ ID NO: 181467 - RNA, 22 nt, Homo sapiens
ggaaaguaacccauucucuuac

SEQ ID NO: 181468 - RNA, 19 nt, Homo sapiens
ggaaaugucuauuaagauc

SEQ ID NO: 181469 - RNA, 18 nt, Homo sapiens
ggaagccuauuuaguaac

SEQ ID NO: 181470 - RNA, 22 nt, Homo sapiens
ggaaguauaaacuuaguggagu

SEQ ID NO: 181471 - RNA, 22 nt, Homo sapiens
ggaaucugaaccaugggaaugg

SEQ ID NO: 181472 - RNA, 17 nt, Homo sapiens
ggaaugaauuccagccc

SEQ ID NO: 181473 - RNA, 22 nt, Homo sapiens
ggaaugagaaauauuacacaau

SEQ ID NO: 181474 - RNA, 22 nt, Homo sapiens
ggaaugcuaaaauaggaugcug

SEQ ID NO: 181475 - RNA, 19 nt, Homo sapiens
ggaaugcuauucaaccuuu

SEQ ID NO: 181476 - RNA, 22 nt, Homo sapiens
ggaaugggauuugaagucuggc

SEQ ID NO: 181477 - RNA, 20 nt, Homo sapiens
ggaauguuaaucuccaugau

SEQ ID NO: 181478 - RNA, 21 nt, Homo sapiens
ggaauguugccagcagccaga

SEQ ID NO: 181479 - RNA, 22 nt, Homo sapiens
ggaauuaaggcaauugaaagcu

SEQ ID NO: 181480 - RNA, 22 nt, Homo sapiens
ggacagaaaggguucaccaaac

SEQ ID NO: 181481 - RNA, 22 nt, Homo sapiens
ggacuagaggugaaaagaagac

SEQ ID NO: 181482 - RNA, 23 nt, Homo sapiens
ggacuguaagggauauaaagguu

SEQ ID NO: 181483 - RNA, 22 nt, Homo sapiens
ggagaauguaauugguauuuug

SEQ ID NO: 181484 - RNA, 22 nt, Homo sapiens
ggagagugacauauuucuaggc

SEQ ID NO: 181485 - RNA, 22 nt, Homo sapiens
ggagaucacucuuuguagcgug

SEQ ID NO: 181486 - RNA, 22 nt, Homo sapiens
ggagaucauuuccuauuugaag

SEQ ID NO: 181487 - RNA, 22 nt, Homo sapiens
ggagaucuuuaggaguuggacu

SEQ ID NO: 181488 - RNA, 22 nt, Homo sapiens
ggagaugaaaugagcuacuuaa

SEQ ID NO: 181489 - RNA, 22 nt, Homo sapiens
ggagaugugccugcucugcucu

SEQ ID NO: 181490 - RNA, 22 nt, Homo sapiens
ggagggugagaucaauuuggga

SEQ ID NO: 181491 - RNA, 22 nt, Homo sapiens
ggagugcuguuguuacacaagg

SEQ ID NO: 181492 - RNA, 23 nt, Homo sapiens
ggaguguauuggcacgaucucag

SEQ ID NO: 181493 - RNA, 22 nt, Homo sapiens
ggaguguguuuuccaacuuggu

SEQ ID NO: 181494 - RNA, 21 nt, Homo sapiens
ggauagaaaacuuggcuguau

SEQ ID NO: 181495 - RNA, 22 nt, Homo sapiens
ggauccaucuggaaauguggga

SEQ ID NO: 181496 - RNA, 22 nt, Homo sapiens
ggauugcuuaagaaguuucauu

SEQ ID NO: 181497 - RNA, 22 nt, Homo sapiens
ggcaaaauauugucugguauag

SEQ ID NO: 181498 - RNA, 22 nt, Homo sapiens
ggcaaaauggccagugggucac

SEQ ID NO: 181499 - RNA, 22 nt, Homo sapiens
ggcaaaucugcaauuacuuuug

SEQ ID NO: 181500 - RNA, 23 nt, Homo sapiens
ggcaagaucucagcucacugcaa

SEQ ID NO: 181501 - RNA, 22 nt, Homo sapiens
ggcaaguugcuauucuuuaaug

SEQ ID NO: 181502 - RNA, 22 nt, Homo sapiens
ggcaaugaggcggaccagcagg

SEQ ID NO: 181503 - RNA, 22 nt, Homo sapiens
ggcaccacagacgccaggcgug

SEQ ID NO: 181504 - RNA, 22 nt, Homo sapiens
ggcaccauggaaggacgggagc

SEQ ID NO: 181505 - RNA, 22 nt, Homo sapiens
ggcacgguggcucacgccugua

SEQ ID NO: 181506 - RNA, 22 nt, Homo sapiens
ggcagagucuugcaucuuuaga

SEQ ID NO: 181507 - RNA, 22 nt, Homo sapiens
ggcagcacaauuuucugaugga

SEQ ID NO: 181508 - RNA, 22 nt, Homo sapiens
ggcagguaaggagugggagccu

SEQ ID NO: 181509 - RNA, 22 nt, Homo sapiens
augagguauccaagcccagaaa

SEQ ID NO: 181510 - RNA, 23 nt, Homo sapiens
augagguaucugagcccagaaau

SEQ ID NO: 181511 - RNA, 22 nt, Homo sapiens
augaggugaguaaauaaaugaa

SEQ ID NO: 181512 - RNA, 22 nt, Homo sapiens
augaggugggagaaucacuuga

SEQ ID NO: 181513 - RNA, 22 nt, Homo sapiens
augaguaugagaauacauuaag

SEQ ID NO: 181514 - RNA, 22 nt, Homo sapiens
augauagucuugagaagcauuu

SEQ ID NO: 181515 - RNA, 22 nt, Homo sapiens
augauauuauucuagcccagag

SEQ ID NO: 181516 - RNA, 22 nt, Homo sapiens
augaucuagaguaggaaacaga

SEQ ID NO: 181517 - RNA, 22 nt, Homo sapiens
augauggagguagauuguccau

SEQ ID NO: 181518 - RNA, 22 nt, Homo sapiens
augauguguucuguguucccau

SEQ ID NO: 181519 - RNA, 22 nt, Homo sapiens
augauucugaucuagagcuugg

SEQ ID NO: 181520 - RNA, 22 nt, Homo sapiens
augauugaccaucugcugggcu

SEQ ID NO: 181521 - RNA, 22 nt, Homo sapiens
augcaaacaucauagaguguac

SEQ ID NO: 181522 - RNA, 22 nt, Homo sapiens
augcaagaaauaucucuuuuuc

SEQ ID NO: 181523 - RNA, 22 nt, Homo sapiens
augcaagcacacaagaggaaau

SEQ ID NO: 181524 - RNA, 22 nt, Homo sapiens
augcaaggaugguuagauauau

SEQ ID NO: 181525 - RNA, 19 nt, Homo sapiens
augcaaugucacaggcugc

SEQ ID NO: 181526 - RNA, 22 nt, Homo sapiens
augcacauauguacugcccuau

SEQ ID NO: 181527 - RNA, 22 nt, Homo sapiens
augcacauggcuaacuuuuuuc

SEQ ID NO: 181528 - RNA, 19 nt, Homo sapiens
augcacgugaaaugcauuu

SEQ ID NO: 181529 - RNA, 22 nt, Homo sapiens
augcacuguauaggaucuugcg

SEQ ID NO: 181530 - RNA, 22 nt, Homo sapiens
augcagagaaaucuaaaauaug

SEQ ID NO: 181531 - RNA, 22 nt, Homo sapiens
augcagauauuuuugugguugc

SEQ ID NO: 181532 - RNA, 22 nt, Homo sapiens
augcagugugcaacagauuaag

SEQ ID NO: 181533 - RNA, 18 nt, Homo sapiens
augcauauuuuaaguugu

SEQ ID NO: 181534 - RNA, 22 nt, Homo sapiens
augccaagagacaaagggaauc

SEQ ID NO: 181535 - RNA, 22 nt, Homo sapiens
augccacugcauaagguuuuca

SEQ ID NO: 181536 - RNA, 22 nt, Homo sapiens
augccacuguuuaugucacuua

SEQ ID NO: 181537 - RNA, 22 nt, Homo sapiens
augccaguguccagaguggguu

SEQ ID NO: 181538 - RNA, 22 nt, Homo sapiens
augcuacuggacaauggugacu

SEQ ID NO: 181539 - RNA, 22 nt, Homo sapiens
auggaacauaacuauuugggga

SEQ ID NO: 181540 - RNA, 22 nt, Homo sapiens
auggaagucucuguuaaguuuc

SEQ ID NO: 181541 - RNA, 22 nt, Homo sapiens
auggaauguggaaugguaagua

SEQ ID NO: 181542 - RNA, 22 nt, Homo sapiens
auggacagacacuggccuucug

SEQ ID NO: 181543 - RNA, 22 nt, Homo sapiens
auggagcuugacaguuguagag

SEQ ID NO: 181544 - RNA, 22 nt, Homo sapiens
auggaggaggaagcugaaacaa

SEQ ID NO: 181545 - RNA, 22 nt, Homo sapiens
auggaggccuacagaauuuugg

SEQ ID NO: 181546 - RNA, 22 nt, Homo sapiens
auggaguguggaacugggaauc

SEQ ID NO: 181547 - RNA, 22 nt, Homo sapiens
auggauauuuuuugaacauaga

SEQ ID NO: 181548 - RNA, 22 nt, Homo sapiens
auggcacuacugggaaugucuu

SEQ ID NO: 181549 - RNA, 22 nt, Homo sapiens
auggcacuguguccugggguca

SEQ ID NO: 181550 - RNA, 22 nt, Homo sapiens
auggcagaaucaagccgacagc

SEQ ID NO: 181551 - RNA, 22 nt, Homo sapiens
auggcagagucagaaagucagg

SEQ ID NO: 181552 - RNA, 22 nt, Homo sapiens
auggcaguuucacucugggauu

SEQ ID NO: 181553 - RNA, 22 nt, Homo sapiens
auggcaucgucaccuuuucagu

SEQ ID NO: 181554 - RNA, 22 nt, Homo sapiens
auggcauugaagaguugucccu

SEQ ID NO: 181555 - RNA, 22 nt, Homo sapiens
auggcccugaguucaauauauu

SEQ ID NO: 181556 - RNA, 22 nt, Homo sapiens
auggcccugcuaccacuuuucu

SEQ ID NO: 181557 - RNA, 20 nt, Homo sapiens
auggcccugcugggaguguc

SEQ ID NO: 181558 - RNA, 22 nt, Homo sapiens
auggcccugggaaaggaggcau

SEQ ID NO: 181559 - RNA, 22 nt, Homo sapiens
auggccgggugcgguggcucac

SEQ ID NO: 181560 - RNA, 22 nt, Homo sapiens
auggcucaauucuuucccugaa

SEQ ID NO: 181561 - RNA, 22 nt, Homo sapiens
auggcucuuauuauuugaggua

SEQ ID NO: 181562 - RNA, 22 nt, Homo sapiens
auggcuguuccugggaguucua

SEQ ID NO: 181563 - RNA, 22 nt, Homo sapiens
auggcuucuucuaaaagugggg

SEQ ID NO: 181564 - RNA, 22 nt, Homo sapiens
auggcuuuuauuguguugaggu

SEQ ID NO: 181565 - RNA, 22 nt, Homo sapiens
auggcuuuugaccugguaggau

SEQ ID NO: 181566 - RNA, 22 nt, Homo sapiens
augggcaaauguuggaaauucc

SEQ ID NO: 181567 - RNA, 22 nt, Homo sapiens
augggguaggcuugcuguagua

SEQ ID NO: 181568 - RNA, 22 nt, Homo sapiens
augguacuccagagaagcagaa

SEQ ID NO: 181569 - RNA, 22 nt, Homo sapiens
augguacuggguaaaagugggg

SEQ ID NO: 181570 - RNA, 22 nt, Homo sapiens
augguauuuaacagucuuucua

SEQ ID NO: 181571 - RNA, 22 nt, Homo sapiens
auggucccauucauucacguau

SEQ ID NO: 181572 - RNA, 22 nt, Homo sapiens
auggucuuuucccuggauuaua

SEQ ID NO: 181573 - RNA, 21 nt, Homo sapiens
auggugagaaaguagugucaa

SEQ ID NO: 181574 - RNA, 22 nt, Homo sapiens
gaggaucucuugagcccagaag

SEQ ID NO: 181575 - RNA, 22 nt, Homo sapiens
gaggcaagaguaguuaaguuag

SEQ ID NO: 181576 - RNA, 22 nt, Homo sapiens
gaggcuagauggggaugugucc

SEQ ID NO: 181577 - RNA, 22 nt, Homo sapiens
gagggcacugcuuuccuuucaa

SEQ ID NO: 181578 - RNA, 22 nt, Homo sapiens
gagguaggggccuuaaagaugc

SEQ ID NO: 181579 - RNA, 22 nt, Homo sapiens
gagguaucauuauguugcccag

SEQ ID NO: 181580 - RNA, 22 nt, Homo sapiens
gagguauggauaucuggagagg

SEQ ID NO: 181581 - RNA, 22 nt, Homo sapiens
gaggucaugucgggccccagga

SEQ ID NO: 181582 - RNA, 22 nt, Homo sapiens
gaggucuuacauuuuaauauuu

SEQ ID NO: 181583 - RNA, 22 nt, Homo sapiens
gaggugaaggucucaauaaaua

SEQ ID NO: 181584 - RNA, 22 nt, Homo sapiens
gaggugguagguucacagcagc

SEQ ID NO: 181585 - RNA, 22 nt, Homo sapiens
gagguguagagauauaccugaa

SEQ ID NO: 181586 - RNA, 22 nt, Homo sapiens
gagguuuuagugagucccacug

SEQ ID NO: 181587 - RNA, 22 nt, Homo sapiens
gaguaaaugucacuguugcugu

SEQ ID NO: 181588 - RNA, 22 nt, Homo sapiens
gaguaaauguccuagcuucuug

SEQ ID NO: 181589 - RNA, 22 nt, Homo sapiens
gaguagugcugcaauaaacaua

SEQ ID NO: 181590 - RNA, 22 nt, Homo sapiens
gaguauuuuacaucguguaauu

SEQ ID NO: 181591 - RNA, 22 nt, Homo sapiens
gagugcaagguuuuucugagug

SEQ ID NO: 181592 - RNA, 22 nt, Homo sapiens
gagugcaauggcaagaucuugg

SEQ ID NO: 181593 - RNA, 22 nt, Homo sapiens
gagugcaauggcaugaucuggg

SEQ ID NO: 181594 - RNA, 22 nt, Homo sapiens
gagugcaauggcaugaucuugg

SEQ ID NO: 181595 - RNA, 22 nt, Homo sapiens
gagugcaauggcgcgaucuggg

SEQ ID NO: 181596 - RNA, 21 nt, Homo sapiens
gaguggcuuuuguuucaccag

SEQ ID NO: 181597 - RNA, 22 nt, Homo sapiens
gaguucauaucuaugagugugc

SEQ ID NO: 181598 - RNA, 22 nt, Homo sapiens
gaguuuguaaacuauucacuaa

SEQ ID NO: 181599 - RNA, 22 nt, Homo sapiens
gauaaagauagcaauagggaca

SEQ ID NO: 181600 - RNA, 22 nt, Homo sapiens
gauaaauccagauucugaugua

SEQ ID NO: 181601 - RNA, 22 nt, Homo sapiens
gauaauucuagcagauacaggc

SEQ ID NO: 181602 - RNA, 22 nt, Homo sapiens
gauacaguaugcaugugguauu

SEQ ID NO: 181603 - RNA, 22 nt, Homo sapiens
gauagcauucaauuaucuguug

SEQ ID NO: 181604 - RNA, 22 nt, Homo sapiens
gauaugugauaagaguuaucuu

SEQ ID NO: 181605 - RNA, 22 nt, Homo sapiens
gaucaauuggcugaagacacgu

SEQ ID NO: 181606 - RNA, 17 nt, Homo sapiens
gaucacagucgucuccu

SEQ ID NO: 181607 - RNA, 20 nt, Homo sapiens
gaucaguuuggaguaagugc

SEQ ID NO: 181608 - RNA, 22 nt, Homo sapiens
gaucucaguggauacugugaug

SEQ ID NO: 181609 - RNA, 22 nt, Homo sapiens
gaucuguuuuccuauuguuugu

SEQ ID NO: 181610 - RNA, 22 nt, Homo sapiens
gaugacagugaguaaccccaac

SEQ ID NO: 181611 - RNA, 22 nt, Homo sapiens
gaugagcuaaguucucacagca

SEQ ID NO: 181612 - RNA, 22 nt, Homo sapiens
gaugagguagaagacucagcaa

SEQ ID NO: 181613 - RNA, 22 nt, Homo sapiens
gaugauguuugauaaauaauaa

SEQ ID NO: 181614 - RNA, 19 nt, Homo sapiens
gaugcaaugcacugagguc

SEQ ID NO: 181615 - RNA, 22 nt, Homo sapiens
gaugcaguaagaaugcauagcg

SEQ ID NO: 181616 - RNA, 22 nt, Homo sapiens
gauggauuuuaagugaaugaaa

SEQ ID NO: 181617 - RNA, 22 nt, Homo sapiens
gauggcauuucuggaucugaca

SEQ ID NO: 181618 - RNA, 22 nt, Homo sapiens
gauggcuacugauuaaauauag

SEQ ID NO: 181619 - RNA, 22 nt, Homo sapiens
gauggguuuuuugaagacagca

SEQ ID NO: 181620 - RNA, 22 nt, Homo sapiens
gaugguuuuucuccgauuuaua

SEQ ID NO: 181621 - RNA, 18 nt, Homo sapiens
gauguaguauggugugga

SEQ ID NO: 181622 - RNA, 22 nt, Homo sapiens
gaugugaaaucauaguuucuag

SEQ ID NO: 181623 - RNA, 22 nt, Homo sapiens
uacaaagcuuucugcaaaucau

SEQ ID NO: 181624 - RNA, 22 nt, Homo sapiens
uacaaaguaacaguuccuguau

SEQ ID NO: 181625 - RNA, 22 nt, Homo sapiens
uacaauagugacaaaucagcau

SEQ ID NO: 181626 - RNA, 21 nt, Homo sapiens
uacaaugcacaggagagccuc

SEQ ID NO: 181627 - RNA, 22 nt, Homo sapiens
uacacacguguguauauauaca

SEQ ID NO: 181628 - RNA, 22 nt, Homo sapiens
uacacaugugaguucuuuucua

SEQ ID NO: 181629 - RNA, 22 nt, Homo sapiens
uacaccauuugauucuuuaagc

SEQ ID NO: 181630 - RNA, 22 nt, Homo sapiens
uacacgugcacaacgugcacgu

SEQ ID NO: 181631 - RNA, 22 nt, Homo sapiens
uacaggaaugucagguugcugu

SEQ ID NO: 181632 - RNA, 19 nt, Homo sapiens
uacaggacugagcugaggu

SEQ ID NO: 181633 - RNA, 22 nt, Homo sapiens
uacaggcaccuggcuaauuuuu

SEQ ID NO: 181634 - RNA, 22 nt, Homo sapiens
uacagguaugugucuauauaca

SEQ ID NO: 181635 - RNA, 22 nt, Homo sapiens
uugcacauugauuuuguaucuu

SEQ ID NO: 181636 - RNA, 22 nt, Homo sapiens
uugcaccccuacuauuugccaa

SEQ ID NO: 181637 - RNA, 22 nt, Homo sapiens
uugcacuauaggaaaauguguc

SEQ ID NO: 181638 - RNA, 22 nt, Homo sapiens
uugcacuccagccuggaugaca

SEQ ID NO: 181639 - RNA, 22 nt, Homo sapiens
uugcacuccagcucgggugaca

SEQ ID NO: 181640 - RNA, 22 nt, Homo sapiens
uugcacuccagucuggggggca

SEQ ID NO: 181641 - RNA, 22 nt, Homo sapiens
uugcacucuagccugggugaca

SEQ ID NO: 181642 - RNA, 22 nt, Homo sapiens
uugcacucuccagccucggcaa

SEQ ID NO: 181643 - RNA, 22 nt, Homo sapiens
uugcagagccccacacugggcu

SEQ ID NO: 181644 - RNA, 22 nt, Homo sapiens
uugcagagucaguuauuuugcc

SEQ ID NO: 181645 - RNA, 22 nt, Homo sapiens
uugcagcaaagagggaggggca

SEQ ID NO: 181646 - RNA, 22 nt, Homo sapiens
uugcaguacuucuggcuuuaca

SEQ ID NO: 181647 - RNA, 19 nt, Homo sapiens
uugcaguauccuauauguu

SEQ ID NO: 181648 - RNA, 22 nt, Homo sapiens
uugcagugguuucacuggcaaa

SEQ ID NO: 181649 - RNA, 19 nt, Homo sapiens
uugcauagguugaaccagc

SEQ ID NO: 181650 - RNA, 22 nt, Homo sapiens
uugcauauguugaaccaagcgu

SEQ ID NO: 181651 - RNA, 22 nt, Homo sapiens
uugcaucagcaggcauaauugg

SEQ ID NO: 181652 - RNA, 22 nt, Homo sapiens
uugcaugcacaguucucaauag

SEQ ID NO: 181653 - RNA, 22 nt, Homo sapiens
uugcauugacacaugaagcuca

SEQ ID NO: 181654 - RNA, 22 nt, Homo sapiens
uugcauuuucuaggagggcaaa

SEQ ID NO: 181655 - RNA, 22 nt, Homo sapiens
uugcccuuuagguaacuauaua

SEQ ID NO: 181656 - RNA, 22 nt, Homo sapiens
uugccuaggcuggagugcagug

SEQ ID NO: 181657 - RNA, 21 nt, Homo sapiens
uugccugacacuggaagaaau

SEQ ID NO: 181658 - RNA, 22 nt, Homo sapiens
uugcucaggcuggaguacaaug

SEQ ID NO: 181659 - RNA, 22 nt, Homo sapiens
uugcuuagagccaaucuugauu

SEQ ID NO: 181660 - RNA, 20 nt, Homo sapiens
uuggaaaugugaauugggag

SEQ ID NO: 181661 - RNA, 22 nt, Homo sapiens
uuggaagacauucugucugcua

SEQ ID NO: 181662 - RNA, 22 nt, Homo sapiens
uuggaaggcugaauggccucuc

SEQ ID NO: 181663 - RNA, 22 nt, Homo sapiens
uuggaauauaaccuguuucuaa

SEQ ID NO: 181664 - RNA, 22 nt, Homo sapiens
uuggaauguauggcaucuugcg

SEQ ID NO: 181665 - RNA, 22 nt, Homo sapiens
uuggacaagauugcagagaauu

SEQ ID NO: 181666 - RNA, 22 nt, Homo sapiens
uuggacagaugguuacauuuuu

SEQ ID NO: 181667 - RNA, 22 nt, Homo sapiens
uuggagagucacuaguuagugc

SEQ ID NO: 181668 - RNA, 22 nt, Homo sapiens
uuggagcacuggggcacugaca

SEQ ID NO: 181669 - RNA, 22 nt, Homo sapiens
uuggaugauaaagaagccuaag

SEQ ID NO: 181670 - RNA, 22 nt, Homo sapiens
uuggauuuuaacaaacuaggug

SEQ ID NO: 181671 - RNA, 22 nt, Homo sapiens
uuggcaaauagguuuuauugca

SEQ ID NO: 181672 - RNA, 22 nt, Homo sapiens
uuccuacuguucaucaggaacc

SEQ ID NO: 181673 - RNA, 22 nt, Homo sapiens
uuccugagagggcugggugcag

SEQ ID NO: 181674 - RNA, 22 nt, Homo sapiens
uuccugcacuugcuugccuaug

SEQ ID NO: 181675 - RNA, 22 nt, Homo sapiens
uuccuggaggggaaguguccaa

SEQ ID NO: 181676 - RNA, 22 nt, Homo sapiens
uuccuguagcgauuuuaguaau

SEQ ID NO: 181677 - RNA, 22 nt, Homo sapiens
uuccuucaugcuugaaggguau

SEQ ID NO: 181678 - RNA, 22 nt, Homo sapiens
uuccuugaaacagucaagagaa

SEQ ID NO: 181679 - RNA, 22 nt, Homo sapiens
uuccuugagagcuugauaucac

SEQ ID NO: 181680 - RNA, 22 nt, Homo sapiens
uucuaaguaauuuugcaugccu

SEQ ID NO: 181681 - RNA, 22 nt, Homo sapiens
uucuacaggcuguucaagaagc

SEQ ID NO: 181682 - RNA, 22 nt, Homo sapiens
uucuacagugacugcagccaua

SEQ ID NO: 181683 - RNA, 22 nt, Homo sapiens
uucuacaugggucgucggugag

SEQ ID NO: 181684 - RNA, 22 nt, Homo sapiens
uucucaaggagccuucguaacu

SEQ ID NO: 181685 - RNA, 21 nt, Homo sapiens
uucucagaggcaggggauaaa

SEQ ID NO: 181686 - RNA, 22 nt, Homo sapiens
uucucagugcuaucuuuuaugc

SEQ ID NO: 181687 - RNA, 22 nt, Homo sapiens
uucucaguucgguggcagugcu

SEQ ID NO: 181688 - RNA, 22 nt, Homo sapiens
uucugacuggugugagauggua

SEQ ID NO: 181689 - RNA, 22 nt, Homo sapiens
uucugagguuauauucucucaa

SEQ ID NO: 181690 - RNA, 22 nt, Homo sapiens
uucugaguggcuuucaacacug

SEQ ID NO: 181691 - RNA, 22 nt, Homo sapiens
uucugcuagucugucagaucuu

SEQ ID NO: 181692 - RNA, 22 nt, Homo sapiens
uucugcuugaucuaguguguug

SEQ ID NO: 181693 - RNA, 22 nt, Homo sapiens
uucuggccccucccaaucucau

SEQ ID NO: 181694 - RNA, 22 nt, Homo sapiens
uucuggcucgauucucugaccg

SEQ ID NO: 181695 - RNA, 22 nt, Homo sapiens
uucuggcuuuuaaagaaauguu

SEQ ID NO: 181696 - RNA, 19 nt, Homo sapiens
uucugguguuuuaagccaa

SEQ ID NO: 181697 - RNA, 22 nt, Homo sapiens
uucuuagucauguaauagucca

SEQ ID NO: 181698 - RNA, 22 nt, Homo sapiens
uucuucaguuacaacaaggggg

SEQ ID NO: 181699 - RNA, 22 nt, Homo sapiens
uucuugguguaguaguugaaaa

SEQ ID NO: 181700 - RNA, 22 nt, Homo sapiens
uugaaagacaucaccuacugcu

SEQ ID NO: 181701 - RNA, 22 nt, Homo sapiens
uugaaagucuaggcuuacagua

SEQ ID NO: 181702 - RNA, 22 nt, Homo sapiens
uugaaaucuuccacagcccaag

SEQ ID NO: 181703 - RNA, 22 nt, Homo sapiens
uugaaauguguaagcuccgaaa

SEQ ID NO: 181704 - RNA, 22 nt, Homo sapiens
uugaaauguuuagaaguuugga

SEQ ID NO: 181705 - RNA, 22 nt, Homo sapiens
uugaaccauucuuuugauagag

SEQ ID NO: 181706 - RNA, 22 nt, Homo sapiens
uugaacugguaguuggaaaucu

SEQ ID NO: 181707 - RNA, 22 nt, Homo sapiens
uaugacugagacuuaaauugug

SEQ ID NO: 181708 - RNA, 22 nt, Homo sapiens
uaugagacugguuaauuuuugu

SEQ ID NO: 181709 - RNA, 22 nt, Homo sapiens
uaugaugcugagguuuggagug

SEQ ID NO: 181710 - RNA, 22 nt, Homo sapiens
uaugcacacacguguuuaugug

SEQ ID NO: 181711 - RNA, 22 nt, Homo sapiens
uaugcaugucucuguacacgug

SEQ ID NO: 181712 - RNA, 19 nt, Homo sapiens
uaugcuauuuauuagaagu

SEQ ID NO: 181713 - RNA, 22 nt, Homo sapiens
uauggauuuuggaauauguggg

SEQ ID NO: 181714 - RNA, 22 nt, Homo sapiens
uauggccccuacaugugcaaaa

SEQ ID NO: 181715 - RNA, 22 nt, Homo sapiens
uauggcuacuacgaauaaugcu

SEQ ID NO: 181716 - RNA, 22 nt, Homo sapiens
uauggcugugacuuaucuuguu

SEQ ID NO: 181717 - RNA, 17 nt, Homo sapiens
uauguaguacuuauaaa

SEQ ID NO: 181718 - RNA, 22 nt, Homo sapiens
uauguuaucaaaaagcuaagga

SEQ ID NO: 181719 - RNA, 22 nt, Homo sapiens
uauuacagaccauaucgccggg

SEQ ID NO: 181720 - RNA, 22 nt, Homo sapiens
uauuacauccauaggcucugcu

SEQ ID NO: 181721 - RNA, 22 nt, Homo sapiens
uauuaguuuucuguggauuaca

SEQ ID NO: 181722 - RNA, 22 nt, Homo sapiens
uauuauagugauaggucuacug

SEQ ID NO: 181723 - RNA, 22 nt, Homo sapiens
uauucacaggugugggacaaag

SEQ ID NO: 181724 - RNA, 20 nt, Homo sapiens
uauucacucuccagucuugc

SEQ ID NO: 181725 - RNA, 22 nt, Homo sapiens
uauuccacuggcacugcauuug

SEQ ID NO: 181726 - RNA, 22 nt, Homo sapiens
uauuccacuuacaugagguauc

SEQ ID NO: 181727 - RNA, 22 nt, Homo sapiens
uauuccuuuugcauuuccacau

SEQ ID NO: 181728 - RNA, 22 nt, Homo sapiens
uauugauuuucaguguucagcu

SEQ ID NO: 181729 - RNA, 22 nt, Homo sapiens
uauugcacaugaggagacauug

SEQ ID NO: 181730 - RNA, 22 nt, Homo sapiens
uauugcacgccagccugagcaa

SEQ ID NO: 181731 - RNA, 20 nt, Homo sapiens
uauugcacuccagucugggc

SEQ ID NO: 181732 - RNA, 22 nt, Homo sapiens
uauugcacuccucaugcauuug

SEQ ID NO: 181733 - RNA, 22 nt, Homo sapiens
uauugcuuaugaugcugaauua

SEQ ID NO: 181734 - RNA, 22 nt, Homo sapiens
uauuguacauguuauagauuuu

SEQ ID NO: 181735 - RNA, 22 nt, Homo sapiens
uauugucacuaaaggaagcugg

SEQ ID NO: 181736 - RNA, 22 nt, Homo sapiens
uauuguuuuucccaggagucua

SEQ ID NO: 181737 - RNA, 22 nt, Homo sapiens
uauuugcacucccaucauggug

SEQ ID NO: 181738 - RNA, 22 nt, Homo sapiens
uauuuggauagucuggaaaaaa

SEQ ID NO: 181739 - RNA, 22 nt, Homo sapiens
uauuuggugaaugaaugcaugu

SEQ ID NO: 181740 - RNA, 22 nt, Homo sapiens
uauuuguccccuccaaaaguca

SEQ ID NO: 181741 - RNA, 22 nt, Homo sapiens
ucaaaaucucuuagcugugucu

SEQ ID NO: 181742 - RNA, 22 nt, Homo sapiens
ucaaacacuccauaucgcgauu

SEQ ID NO: 181743 - RNA, 22 nt, Homo sapiens
ucaaacugucagguugaccaga

SEQ ID NO: 181744 - RNA, 20 nt, Homo sapiens
ucaaagacauggcugucaga

SEQ ID NO: 181745 - RNA, 22 nt, Homo sapiens
ucaaagugagcuccuucucacu

SEQ ID NO: 181746 - RNA, 22 nt, Homo sapiens
ucaaagugcuauggcucagguu

SEQ ID NO: 181747 - RNA, 22 nt, Homo sapiens
ucaaaugauucacccaccuuug

SEQ ID NO: 181748 - RNA, 22 nt, Homo sapiens
ucaaaugauucuccugccucag

SEQ ID NO: 181749 - RNA, 22 nt, Homo sapiens
ucaacauugcugucaggcaucu

SEQ ID NO: 181750 - RNA, 22 nt, Homo sapiens
ucaagcaauucuccucucagcc

SEQ ID NO: 181751 - RNA, 22 nt, Homo sapiens
ucaagcaauucuccugccucag

SEQ ID NO: 181752 - RNA, 20 nt, Homo sapiens
ucaaggcacgaauaaaaguu

SEQ ID NO: 181753 - RNA, 20 nt, Homo sapiens
ucaaggcaggaacuguacau

SEQ ID NO: 181754 - RNA, 22 nt, Homo sapiens
ucaaugaaugaugguugguaug

SEQ ID NO: 181755 - RNA, 22 nt, Homo sapiens
ucacaaguguauagacaugucc

SEQ ID NO: 181756 - RNA, 22 nt, Homo sapiens
ucacaauggcugaacuaauuua

SEQ ID NO: 181757 - RNA, 22 nt, Homo sapiens
ucacacgugaacucaucacaga

SEQ ID NO: 181758 - RNA, 22 nt, Homo sapiens
ucacacugucuugguuacucuu

SEQ ID NO: 181759 - RNA, 22 nt, Homo sapiens
ucacacuguuuugauuauuaua

SEQ ID NO: 181760 - RNA, 23 nt, Homo sapiens
ucacacuuaagagaaaugcagcu

SEQ ID NO: 181761 - RNA, 22 nt, Homo sapiens
ucacagauaaauaaagaugauu

SEQ ID NO: 181762 - RNA, 22 nt, Homo sapiens
ucacagaugaggcgagaggcag

SEQ ID NO: 181763 - RNA, 22 nt, Homo sapiens
ucacagaugcuugacccauuuc

SEQ ID NO: 181764 - RNA, 18 nt, Homo sapiens
ucacagguaaaguugaca

SEQ ID NO: 181765 - RNA, 22 nt, Homo sapiens
ucacaguagcaaauguuagaaa

SEQ ID NO: 181766 - RNA, 22 nt, Homo sapiens
ucacaguagggaacugacaaag

SEQ ID NO: 181767 - RNA, 22 nt, Homo sapiens
ucacaguguuaaaccuuucuuu

SEQ ID NO: 181768 - RNA, 22 nt, Homo sapiens
ucacaguugauugaaacacagc

SEQ ID NO: 181769 - RNA, 22 nt, Homo sapiens
ucacaucucagguuucuugaca

SEQ ID NO: 181770 - RNA, 22 nt, Homo sapiens
ucacaugcacaucucuggaacc

SEQ ID NO: 181771 - RNA, 22 nt, Homo sapiens
ucacauggaggugauaguugaa

SEQ ID NO: 181772 - RNA, 22 nt, Homo sapiens
ucacauggcagagaagaagcuc

SEQ ID NO: 181773 - RNA, 22 nt, Homo sapiens
ucacaugucagccguggggaag

SEQ ID NO: 181774 - RNA, 22 nt, Homo sapiens
ucacaugugaagauugggagua

SEQ ID NO: 181775 - RNA, 22 nt, Homo sapiens
ucacauuguuauguaaauguuu

SEQ ID NO: 181776 - RNA, 22 nt, Homo sapiens
ucaccagugucagggaacugcu

SEQ ID NO: 181777 - RNA, 20 nt, Homo sapiens
ucacccugacaucugcccag

SEQ ID NO: 181778 - RNA, 22 nt, Homo sapiens
ucaccuggagaagauggaucau

SEQ ID NO: 181779 - RNA, 18 nt, Homo sapiens
ucaccuugaugcuggguc

SEQ ID NO: 181780 - RNA, 18 nt, Homo sapiens
ucaccuugugagagagag

SEQ ID NO: 181781 - RNA, 22 nt, Homo sapiens
ucacgcugcugcaaccagccug

SEQ ID NO: 181782 - RNA, 22 nt, Homo sapiens
ucacgugguucauaaggcagaa

SEQ ID NO: 181783 - RNA, 23 nt, Homo sapiens
ucacuagaguccuggaguuugag

SEQ ID NO: 181784 - RNA, 22 nt, Homo sapiens
ucacuagaucaagggagagaaa

SEQ ID NO: 181785 - RNA, 22 nt, Homo sapiens
ucacuaggcuggagugcagugg

SEQ ID NO: 181786 - RNA, 22 nt, Homo sapiens
ucacuagggaucacuuuacccg

SEQ ID NO: 181787 - RNA, 22 nt, Homo sapiens
ucacucagaccuggugauaugc

SEQ ID NO: 181788 - RNA, 22 nt, Homo sapiens
ucacugaaaccgccuccaccuc

SEQ ID NO: 181789 - RNA, 22 nt, Homo sapiens
ucacugaaaccuccaccucucg

SEQ ID NO: 181790 - RNA, 22 nt, Homo sapiens
ucacugaaaccuccgccuucug

SEQ ID NO: 181791 - RNA, 22 nt, Homo sapiens
ucacugcacuagguaaugccac

SEQ ID NO: 181792 - RNA, 22 nt, Homo sapiens
ucacugcacucuccgccuugcg

SEQ ID NO: 181793 - RNA, 22 nt, Homo sapiens
ucacugcacuucaggcuuucuc

SEQ ID NO: 181794 - RNA, 22 nt, Homo sapiens
ucacugcgaccuccaccucccg

SEQ ID NO: 181795 - RNA, 22 nt, Homo sapiens
ucacugcgaccuccaccuccug

SEQ ID NO: 181796 - RNA, 22 nt, Homo sapiens
ucacugcgaccucugccucccg

SEQ ID NO: 181797 - RNA, 22 nt, Homo sapiens
ucacuggacucuagccugggug

SEQ ID NO: 181798 - RNA, 20 nt, Homo sapiens
ucacuggagcucauuugauu

SEQ ID NO: 181799 - RNA, 22 nt, Homo sapiens
ucacugggagaccaaagccauc

SEQ ID NO: 181800 - RNA, 22 nt, Homo sapiens
ucacugggagcauuugagccuu

SEQ ID NO: 181801 - RNA, 20 nt, Homo sapiens
ucacugugaacuucuugagg

SEQ ID NO: 181802 - RNA, 22 nt, Homo sapiens
ucacuuggccgcagccuucucu

SEQ ID NO: 181803 - RNA, 22 nt, Homo sapiens
ucagacacugcccuccaccugu

SEQ ID NO: 181804 - RNA, 22 nt, Homo sapiens
ucagaccauuucauuacagacu

SEQ ID NO: 181805 - RNA, 22 nt, Homo sapiens
ucagaguagcugucugaggugc

SEQ ID NO: 181806 - RNA, 22 nt, Homo sapiens
ucagaguaguuccuggcagaaa

SEQ ID NO: 181807 - RNA, 22 nt, Homo sapiens
ucagagugcagggaguagcagc

SEQ ID NO: 181808 - RNA, 22 nt, Homo sapiens
ucagaucacuggcgcuggcgga

SEQ ID NO: 181809 - RNA, 22 nt, Homo sapiens
ucagaucauauucuucgcugcu

SEQ ID NO: 181810 - RNA, 22 nt, Homo sapiens
ucagcaaugaccuaagcaaaua

SEQ ID NO: 181811 - RNA, 22 nt, Homo sapiens
ucagcaccauguaacaauugau

SEQ ID NO: 181812 - RNA, 22 nt, Homo sapiens
ucagcagugagagaccucaccc

SEQ ID NO: 181813 - RNA, 22 nt, Homo sapiens
ucagcaucacaggcagugagug

SEQ ID NO: 181814 - RNA, 22 nt, Homo sapiens
ucagcaucacgugggcucccgu

SEQ ID NO: 181815 - RNA, 22 nt, Homo sapiens
ucaggcaugcagcaaugcagug

SEQ ID NO: 181816 - RNA, 23 nt, Homo sapiens
ucagguaggccuagaguauucuu

SEQ ID NO: 181817 - RNA, 22 nt, Homo sapiens
ucagguauuucuuuuagcugug

SEQ ID NO: 181818 - RNA, 22 nt, Homo sapiens
ucagguauuuuaucacaugaag

SEQ ID NO: 181819 - RNA, 23 nt, Homo sapiens
ucaguacucuauaagugccagcu

SEQ ID NO: 181820 - RNA, 23 nt, Homo sapiens
ucaguagucauugggaaagugug

SEQ ID NO: 181821 - RNA, 22 nt, Homo sapiens
ucaguaguuuuuuuacuaggug

SEQ ID NO: 181822 - RNA, 18 nt, Homo sapiens
ucagucacugccuggcuu

SEQ ID NO: 181823 - RNA, 22 nt, Homo sapiens
ucagucauucaauuguugaaug

SEQ ID NO: 181824 - RNA, 22 nt, Homo sapiens
ucagucauucacucacucggac

SEQ ID NO: 181825 - RNA, 22 nt, Homo sapiens
ucagucauugauggaguagguc

SEQ ID NO: 181826 - RNA, 22 nt, Homo sapiens
ucagucuuuuaccauuaaguau

SEQ ID NO: 181827 - RNA, 22 nt, Homo sapiens
ucagucuuuuuuuggcaagcau

SEQ ID NO: 181828 - RNA, 22 nt, Homo sapiens
ucagugaauguuggccacuacu

SEQ ID NO: 181829 - RNA, 22 nt, Homo sapiens
ucagugauugguuauuuuaggc

SEQ ID NO: 181830 - RNA, 20 nt, Homo sapiens
ucagugauugguuuaguuau

SEQ ID NO: 181831 - RNA, 20 nt, Homo sapiens
ucagugcagauuguccaagu

SEQ ID NO: 181832 - RNA, 22 nt, Homo sapiens
ucagugccauugccauaugagu

SEQ ID NO: 181833 - RNA, 22 nt, Homo sapiens
ucagugcuguaccaucuaagga

SEQ ID NO: 181834 - RNA, 22 nt, Homo sapiens
ucagugcuguuugcccucguuu

SEQ ID NO: 181835 - RNA, 22 nt, Homo sapiens
ucagugucaucuggguuguuug

SEQ ID NO: 181836 - RNA, 22 nt, Homo sapiens
ucagugucugugauggagaggu

SEQ ID NO: 181837 - RNA, 22 nt, Homo sapiens
ucaguguugauggcugcugacu

SEQ ID NO: 181838 - RNA, 21 nt, Homo sapiens
ucauaagcucaacaucuguag

SEQ ID NO: 181839 - RNA, 22 nt, Homo sapiens
ucauacaguaguccucacuugu

SEQ ID NO: 181840 - RNA, 16 nt, Homo sapiens
ucauaguaucucuucu

SEQ ID NO: 181841 - RNA, 22 nt, Homo sapiens
ucaucagugcuugcaaauuauu

SEQ ID NO: 181842 - RNA, 22 nt, Homo sapiens
ucaugaccaugguauagaccac

SEQ ID NO: 181843 - RNA, 22 nt, Homo sapiens
ucaugcaaugcaaggggaaauu

SEQ ID NO: 181844 - RNA, 22 nt, Homo sapiens
ucauggcauuguuaaggguuuu

SEQ ID NO: 181845 - RNA, 22 nt, Homo sapiens
ucauguguugcacugaggaccu

SEQ ID NO: 181846 - RNA, 22 nt, Homo sapiens
ucauucauucauccagcuugag

SEQ ID NO: 181847 - RNA, 22 nt, Homo sapiens
ucauucauucuucaguggguac

SEQ ID NO: 181848 - RNA, 22 nt, Homo sapiens
ucauugguagcucauggaaccg

SEQ ID NO: 181849 - RNA, 22 nt, Homo sapiens
ucauugguucuggguguuguug

SEQ ID NO: 181850 - RNA, 22 nt, Homo sapiens
ucauugguugcguaauuugauu

SEQ ID NO: 181851 - RNA, 22 nt, Homo sapiens
uccaauguaaucaucauugaau

SEQ ID NO: 181852 - RNA, 22 nt, Homo sapiens
uccacaauggagaagaguauga

SEQ ID NO: 181853 - RNA, 22 nt, Homo sapiens
uccacaguaaggacccugccuu

SEQ ID NO: 181854 - RNA, 22 nt, Homo sapiens
uccacguggucuaucuguccuu

SEQ ID NO: 181855 - RNA, 20 nt, Homo sapiens
uccacugagcgucacggcag

SEQ ID NO: 181856 - RNA, 22 nt, Homo sapiens
uccagugugcaggcaaguuuga

SEQ ID NO: 181857 - RNA, 22 nt, Homo sapiens
uccaguguuauaauaugcgucu

SEQ ID NO: 181858 - RNA, 22 nt, Homo sapiens
uccaguuguuauuuuuauaaag

SEQ ID NO: 181859 - RNA, 22 nt, Homo sapiens
uccauagacauuuuaagguagu

SEQ ID NO: 181860 - RNA, 22 nt, Homo sapiens
uccauaguugcacucuggagcc

SEQ ID NO: 181861 - RNA, 22 nt, Homo sapiens
uccaugagaauaguuaggcucu

SEQ ID NO: 181862 - RNA, 19 nt, Homo sapiens
uccaugagcccacagugau

SEQ ID NO: 181863 - RNA, 22 nt, Homo sapiens
uccaugaguccauuagaaaaaa

SEQ ID NO: 181864 - RNA, 22 nt, Homo sapiens
uccauggagacacauuuuauau

SEQ ID NO: 181865 - RNA, 22 nt, Homo sapiens
uccauguagaugcuauguuguc

SEQ ID NO: 181866 - RNA, 22 nt, Homo sapiens
ucccacugucuucucgugcucg

SEQ ID NO: 181867 - RNA, 22 nt, Homo sapiens
ucccagucuagagccggauugg

SEQ ID NO: 181868 - RNA, 22 nt, Homo sapiens
ucccagugaaaccccaccuuca

SEQ ID NO: 181869 - RNA, 22 nt, Homo sapiens
ucccaguggucuugaaacaggg

SEQ ID NO: 181870 - RNA, 22 nt, Homo sapiens
ucccauugucucugaccuugcc

SEQ ID NO: 181871 - RNA, 23 nt, Homo sapiens
uccccgggagcaccagcuuguug

SEQ ID NO: 181872 - RNA, 22 nt, Homo sapiens
ucccgaggacaucugggggcaa

SEQ ID NO: 181873 - RNA, 22 nt, Homo sapiens
ucccuagagaagugauuuuuga

SEQ ID NO: 181874 - RNA, 18 nt, Homo sapiens
ucccucagaauuauagaa

SEQ ID NO: 181875 - RNA, 22 nt, Homo sapiens
ucccugaagcugcagcaacaca

SEQ ID NO: 181876 - RNA, 22 nt, Homo sapiens
ucccugagguccuggauuauug

SEQ ID NO: 181877 - RNA, 22 nt, Homo sapiens
ucccugaguaucuaauguguuu

SEQ ID NO: 181878 - RNA, 19 nt, Homo sapiens
ucccugagucuuagcuuga

SEQ ID NO: 181879 - RNA, 22 nt, Homo sapiens
ucccugagugauugaaaauaaa

SEQ ID NO: 181880 - RNA, 19 nt, Homo sapiens
ucccuguagaccacagugc

SEQ ID NO: 181881 - RNA, 22 nt, Homo sapiens
ucccuguguuccuuuugaauug

SEQ ID NO: 181882 - RNA, 22 nt, Homo sapiens
ucccuugagccuggcuucucac

SEQ ID NO: 181883 - RNA, 18 nt, Homo sapiens
ucccuuuguagaugaccc

SEQ ID NO: 181884 - RNA, 19 nt, Homo sapiens
ucccuuuguagguaaccug

SEQ ID NO: 181885 - RNA, 22 nt, Homo sapiens
uccugagagcagacccucuaua

SEQ ID NO: 181886 - RNA, 22 nt, Homo sapiens
uccuucaguccaguggguuuug

SEQ ID NO: 181887 - RNA, 22 nt, Homo sapiens
uccuucaugcaucaauguaucc

SEQ ID NO: 181888 - RNA, 22 nt, Homo sapiens
uccuucauuugucaacucuagu

SEQ ID NO: 181889 - RNA, 22 nt, Homo sapiens
uccuugagccucccagacucag

SEQ ID NO: 181890 - RNA, 22 nt, Homo sapiens
uccuugagccuuaaauuauaaa

SEQ ID NO: 181891 - RNA, 22 nt, Homo sapiens
uccuugagucugaacuuuggau

SEQ ID NO: 181892 - RNA, 22 nt, Homo sapiens
uccuuugguggagucuuuaggg

SEQ ID NO: 181893 - RNA, 22 nt, Homo sapiens
ucgcaguuaauaaugaugugcg

SEQ ID NO: 181894 - RNA, 22 nt, Homo sapiens
ucggcucagugcaagcucugcc

SEQ ID NO: 181895 - RNA, 23 nt, Homo sapiens
ucgguccccuuggcugcccucgg

SEQ ID NO: 181896 - RNA, 22 nt, Homo sapiens
ucgugccacugcacuccagccu

SEQ ID NO: 181897 - RNA, 22 nt, Homo sapiens
ucguucuugucaguuuauaaag

SEQ ID NO: 181898 - RNA, 22 nt, Homo sapiens
ucuaagaauucauuuauaagcc

SEQ ID NO: 181899 - RNA, 22 nt, Homo sapiens
ucuaaggcaccuagagucauca

SEQ ID NO: 181900 - RNA, 18 nt, Homo sapiens
ucuagacacugugucuau

SEQ ID NO: 181901 - RNA, 15 nt, Homo sapiens
ucuaguuuugaagac

SEQ ID NO: 181902 - RNA, 22 nt, Homo sapiens
ucuaucacagccccacacucuc

SEQ ID NO: 181903 - RNA, 22 nt, Homo sapiens
ucuauggauaaaaugcccucau

SEQ ID NO: 181904 - RNA, 22 nt, Homo sapiens
ucuauugguugaaauugcuuuu

SEQ ID NO: 181905 - RNA, 22 nt, Homo sapiens
ucucacagaguugaacuuucuu

SEQ ID NO: 181906 - RNA, 22 nt, Homo sapiens
ucucacagaguugaauguuucu

SEQ ID NO: 181907 - RNA, 19 nt, Homo sapiens
ucucacagcucuacuaugu

SEQ ID NO: 181908 - RNA, 22 nt, Homo sapiens
ucucagcacaaacaaaauugcu

SEQ ID NO: 181909 - RNA, 22 nt, Homo sapiens
ucucagcacagucagggcgccu

SEQ ID NO: 181910 - RNA, 22 nt, Homo sapiens
ucucagugaauguggaaaaagc

SEQ ID NO: 181911 - RNA, 19 nt, Homo sapiens
ucucaguguuggucaggug

SEQ ID NO: 181912 - RNA, 20 nt, Homo sapiens
ucucauggagggaaagagca

SEQ ID NO: 181913 - RNA, 20 nt, Homo sapiens
ucucauggagguagagaaua

SEQ ID NO: 181914 - RNA, 22 nt, Homo sapiens
ucucauggagguagagaguaaa

SEQ ID NO: 181915 - RNA, 22 nt, Homo sapiens
ucuccauugaaauggacauaau

SEQ ID NO: 181916 - RNA, 22 nt, Homo sapiens
ucucugacacugaccccaaaaa

SEQ ID NO: 181917 - RNA, 22 nt, Homo sapiens
ucucugagaaaaguuucuccca

SEQ ID NO: 181918 - RNA, 22 nt, Homo sapiens
ucucuggauaucuacuuauguu

SEQ ID NO: 181919 - RNA, 22 nt, Homo sapiens
ucucuguuuagagccagcaauu

SEQ ID NO: 181920 - RNA, 22 nt, Homo sapiens
ucucuguuugucuguuacuggu

SEQ ID NO: 181921 - RNA, 22 nt, Homo sapiens
ucucuuggugacuuaaaauguu

SEQ ID NO: 181922 - RNA, 22 nt, Homo sapiens
ucugacaaugaacaaucuauag

SEQ ID NO: 181923 - RNA, 22 nt, Homo sapiens
ucugacucugugaugggcccaa

SEQ ID NO: 181924 - RNA, 22 nt, Homo sapiens
ucugagcaauaaacaacauauu

SEQ ID NO: 181925 - RNA, 22 nt, Homo sapiens
ucugagcaauagauguggauau

SEQ ID NO: 181926 - RNA, 22 nt, Homo sapiens
aucagaguggguuuuaaaagug

SEQ ID NO: 181927 - RNA, 22 nt, Homo sapiens
aucagauuccacauuuuaucag

SEQ ID NO: 181928 - RNA, 19 nt, Homo sapiens
aucagcacaagugugcuuu

SEQ ID NO: 181929 - RNA, 22 nt, Homo sapiens
aucaggcacacauuggaguuug

SEQ ID NO: 181930 - RNA, 22 nt, Homo sapiens
aucagugaaagugaaaucuccg

SEQ ID NO: 181931 - RNA, 22 nt, Homo sapiens
ugagacugaguuuugcucguug

SEQ ID NO: 181932 - RNA, 22 nt, Homo sapiens
ugagacugaguuuugcucuugu

SEQ ID NO: 181933 - RNA, 22 nt, Homo sapiens
ugagacugguaauguguagggc

SEQ ID NO: 181934 - RNA, 22 nt, Homo sapiens
ugagaggugauaaagcaagggu

SEQ ID NO: 181935 - RNA, 22 nt, Homo sapiens
ugagaguagggguugggauugg

SEQ ID NO: 181936 - RNA, 22 nt, Homo sapiens
cucaccuugugauccacccacc

SEQ ID NO: 181937 - RNA, 22 nt, Homo sapiens
cucaccuugugauccacccgcc

SEQ ID NO: 181938 - RNA, 22 nt, Homo sapiens
cucacggugcaggcuucuggga

SEQ ID NO: 181939 - RNA, 22 nt, Homo sapiens
cucagagcacaguuuaugacag

SEQ ID NO: 181940 - RNA, 22 nt, Homo sapiens
cucagcaguggauuuaccacca

SEQ ID NO: 181941 - RNA, 22 nt, Homo sapiens
cucaggcacucugauuccagug

SEQ ID NO: 181942 - RNA, 22 nt, Homo sapiens
cucagugaagggcaagaggcaa

SEQ ID NO: 181943 - RNA, 20 nt, Homo sapiens
cucagugcacccccauaaaa

SEQ ID NO: 181944 - RNA, 22 nt, Homo sapiens
cucaguguuaaggccaccucug

SEQ ID NO: 181945 - RNA, 22 nt, Homo sapiens
cucaguguuucagcugcucaga

SEQ ID NO: 181946 - RNA, 22 nt, Homo sapiens
cucaugcugucuucugggguaa

SEQ ID NO: 181947 - RNA, 22 nt, Homo sapiens
cucauggaauacuucacagcca

SEQ ID NO: 181948 - RNA, 22 nt, Homo sapiens
cucauggauggucuggcagcca

SEQ ID NO: 181949 - RNA, 22 nt, Homo sapiens
cucauuaguuguuuuaagauga

SEQ ID NO: 181950 - RNA, 22 nt, Homo sapiens
cucauugcaaucuccaccuccc

SEQ ID NO: 181951 - RNA, 22 nt, Homo sapiens
cuccacgugaaugccaaguauu

SEQ ID NO: 181952 - RNA, 22 nt, Homo sapiens
cuccauuuaguccuuuuagaag

SEQ ID NO: 181953 - RNA, 22 nt, Homo sapiens
cucccagagccaguuauaggcu

SEQ ID NO: 181954 - RNA, 22 nt, Homo sapiens
cucccagugacccaggaacagg

SEQ ID NO: 181955 - RNA, 23 nt, Homo sapiens
cucccugaacaugacacaccaga

SEQ ID NO: 181956 - RNA, 22 nt, Homo sapiens
cucccuuugcugaauguuuuuc

SEQ ID NO: 181957 - RNA, 22 nt, Homo sapiens
cuccuggugauuggagugugaa

SEQ ID NO: 181958 - RNA, 22 nt, Homo sapiens
cucugagccugagguuccuacu

SEQ ID NO: 181959 - RNA, 22 nt, Homo sapiens
cucuuuggaugccuuaggguua

SEQ ID NO: 181960 - RNA, 19 nt, Homo sapiens
cugaaacacagagagggcu

SEQ ID NO: 181961 - RNA, 22 nt, Homo sapiens
cugaaaguuauucaggggcaag

SEQ ID NO: 181962 - RNA, 22 nt, Homo sapiens
cugaaauggaaugugugcacag

SEQ ID NO: 181963 - RNA, 22 nt, Homo sapiens
cugacagaugacugccacugua

SEQ ID NO: 181964 - RNA, 22 nt, Homo sapiens
cugacaucuucaagugaggaga

SEQ ID NO: 181965 - RNA, 22 nt, Homo sapiens
cugacuuuagaacccaaaaagu

SEQ ID NO: 181966 - RNA, 22 nt, Homo sapiens
cugagaaugaugauuuccaguu

SEQ ID NO: 181967 - RNA, 22 nt, Homo sapiens
cugagaauguaaaugaagcuuu

SEQ ID NO: 181968 - RNA, 22 nt, Homo sapiens
cugagagaggagcuaaaacugc

SEQ ID NO: 181969 - RNA, 22 nt, Homo sapiens
cugagauaauuucuagguguca

SEQ ID NO: 181970 - RNA, 22 nt, Homo sapiens
cugagauacacuaauagucucu

SEQ ID NO: 181971 - RNA, 22 nt, Homo sapiens
cugagaucaagucuugcucugu

SEQ ID NO: 181972 - RNA, 22 nt, Homo sapiens
cugagaucugaaccaggagugu

SEQ ID NO: 181973 - RNA, 22 nt, Homo sapiens
cugagaucuuauuagaaaugca

SEQ ID NO: 181974 - RNA, 22 nt, Homo sapiens
cugagcaagucauuuuguuaaa

SEQ ID NO: 181975 - RNA, 22 nt, Homo sapiens
cugagcaauauagugagaucuu

SEQ ID NO: 181976 - RNA, 22 nt, Homo sapiens
cugagcacugagauccucuagc

SEQ ID NO: 181977 - RNA, 22 nt, Homo sapiens
cugagcuagaccacuuggcucc

SEQ ID NO: 181978 - RNA, 22 nt, Homo sapiens
cugaggguagaaggaucacuug

SEQ ID NO: 181979 - RNA, 22 nt, Homo sapiens
cugagguaauuuuccagauaau

SEQ ID NO: 181980 - RNA, 22 nt, Homo sapiens
cugagguacccacuucaucuca

SEQ ID NO: 181981 - RNA, 22 nt, Homo sapiens
cugagguacugggggccaggau

SEQ ID NO: 181982 - RNA, 22 nt, Homo sapiens
cugagguauuuaggugaaagaa

SEQ ID NO: 181983 - RNA, 22 nt, Homo sapiens
cugaggugauauauacauauuu

SEQ ID NO: 181984 - RNA, 22 nt, Homo sapiens
cugaggugggaggauuacuuga

SEQ ID NO: 181985 - RNA, 22 nt, Homo sapiens
cugaggugggaggauuggcuug

SEQ ID NO: 181986 - RNA, 22 nt, Homo sapiens
cugagguuaggaguuugagacc

SEQ ID NO: 181987 - RNA, 18 nt, Homo sapiens
cugagucauuccuggguc

SEQ ID NO: 181988 - RNA, 22 nt, Homo sapiens
cugauacucuccuuuuagagag

SEQ ID NO: 181989 - RNA, 22 nt, Homo sapiens
cugaucuggaggugucugggga

SEQ ID NO: 181990 - RNA, 22 nt, Homo sapiens
cugaugaaguauuuguucugga

SEQ ID NO: 181991 - RNA, 22 nt, Homo sapiens
cugauguagguggucugugauc

SEQ ID NO: 181992 - RNA, 22 nt, Homo sapiens
cugauugucaucaauauuauua

SEQ ID NO: 181993 - RNA, 22 nt, Homo sapiens
cugcaagaaucguaguauuuga

SEQ ID NO: 181994 - RNA, 20 nt, Homo sapiens
cugcacauccacucuacuuc

SEQ ID NO: 181995 - RNA, 22 nt, Homo sapiens
cugcagaucuuggggcuugcca

SEQ ID NO: 181996 - RNA, 22 nt, Homo sapiens
cugcagucaucugaagauuuug

SEQ ID NO: 181997 - RNA, 22 nt, Homo sapiens
cugccacugacaccucaaggac

SEQ ID NO: 181998 - RNA, 22 nt, Homo sapiens
cugccuagaucugaaccuggcu

SEQ ID NO: 181999 - RNA, 22 nt, Homo sapiens
cuggaaagcaaguccauugcuc

SEQ ID NO: 182000 - RNA, 22 nt, Homo sapiens
cuggaaggaaaaacaaccacag

SEQ ID NO: 182001 - RNA, 22 nt, Homo sapiens
cuggaauauuagcuggucuuaa

SEQ ID NO: 182002 - RNA, 22 nt, Homo sapiens
cuggaauuacaggguugagcua

SEQ ID NO: 182003 - RNA, 22 nt, Homo sapiens
cuggagcauugguggauuuguu

SEQ ID NO: 182004 - RNA, 22 nt, Homo sapiens
cuggaguuugaggcugcaguga

SEQ ID NO: 182005 - RNA, 22 nt, Homo sapiens
cuggauauuaacauugaugaaa

SEQ ID NO: 182006 - RNA, 20 nt, Homo sapiens
cuggaucaucaguaaaguua

SEQ ID NO: 182007 - RNA, 22 nt, Homo sapiens
cuggcaaauaguagagccagga

SEQ ID NO: 182008 - RNA, 19 nt, Homo sapiens
cuggcaaaugcuuuggcca

SEQ ID NO: 182009 - RNA, 22 nt, Homo sapiens
cuggcaaauguuuucuguaaag

SEQ ID NO: 182010 - RNA, 22 nt, Homo sapiens
cuggcaagagugaaccagcugu

SEQ ID NO: 182011 - RNA, 22 nt, Homo sapiens
cuggcaccauacacuguuguug

SEQ ID NO: 182012 - RNA, 22 nt, Homo sapiens
cuggcaccauuuugaucaaagg

SEQ ID NO: 182013 - RNA, 22 nt, Homo sapiens
cuggcagucugccucuucacug

SEQ ID NO: 182014 - RNA, 22 nt, Homo sapiens
cuggcaguguuucuugugggcu

SEQ ID NO: 182015 - RNA, 22 nt, Homo sapiens
cugggaucaguucuagucagaa

SEQ ID NO: 182016 - RNA, 22 nt, Homo sapiens
cugggcaaugcggcuggauaga

SEQ ID NO: 182017 - RNA, 22 nt, Homo sapiens
cuggugugugacuuuucauuau

SEQ ID NO: 182018 - RNA, 22 nt, Homo sapiens
cugguuguucuggaugggcagg

SEQ ID NO: 182019 - RNA, 22 nt, Homo sapiens
cuguaacagaauaaauuuguuu

SEQ ID NO: 182020 - RNA, 22 nt, Homo sapiens
cuguaagcauuauaaagagaua

SEQ ID NO: 182021 - RNA, 22 nt, Homo sapiens
cuguagacauuaggccugcacu

SEQ ID NO: 182022 - RNA, 22 nt, Homo sapiens
cugucacugggaggggcagcag

SEQ ID NO: 182023 - RNA, 22 nt, Homo sapiens
cugucucagccucuccaguagc

SEQ ID NO: 182024 - RNA, 22 nt, Homo sapiens
cugugauagguuagucaugaau

SEQ ID NO: 182025 - RNA, 22 nt, Homo sapiens
cugugcaaacaagugaaccccu

SEQ ID NO: 182026 - RNA, 22 nt, Homo sapiens
cugugcaugcgcggagcugaaa

SEQ ID NO: 182027 - RNA, 22 nt, Homo sapiens
cugugcauguaugcgugaguuc

SEQ ID NO: 182028 - RNA, 22 nt, Homo sapiens
cugugcauguuguccaauucuu

SEQ ID NO: 182029 - RNA, 22 nt, Homo sapiens
cugugcauuggaugucucccug

SEQ ID NO: 182030 - RNA, 22 nt, Homo sapiens
cugugcuuggagucccccuagg

SEQ ID NO: 182031 - RNA, 23 nt, Homo sapiens
cuguggauaugaguuguaaaugg

SEQ ID NO: 182032 - RNA, 22 nt, Homo sapiens
cuguggguuuuacuguuuuacu

SEQ ID NO: 182033 - RNA, 22 nt, Homo sapiens
cugugguguaacucuuggggcg

SEQ ID NO: 182034 - RNA, 22 nt, Homo sapiens
cuguuauguucuagagggugca

SEQ ID NO: 182035 - RNA, 22 nt, Homo sapiens
cuguucaaauuguuugugaagu

SEQ ID NO: 182036 - RNA, 22 nt, Homo sapiens
cuguucaggaggcauuuggugg

SEQ ID NO: 182037 - RNA, 22 nt, Homo sapiens
cuguugguguuuaaucacugca

SEQ ID NO: 182038 - RNA, 22 nt, Homo sapiens
cuguuugaggguuugcuuucag

SEQ ID NO: 182039 - RNA, 20 nt, Homo sapiens
cuuaaugcagcauuucucag

SEQ ID NO: 182040 - RNA, 23 nt, Homo sapiens
ugcaccacuacacacucuugggu

SEQ ID NO: 182041 - RNA, 22 nt, Homo sapiens
ugcaccacugcacuucagccug

SEQ ID NO: 182042 - RNA, 22 nt, Homo sapiens
ugcaccacuguacuccagucug

SEQ ID NO: 182043 - RNA, 22 nt, Homo sapiens
ugcaccauugcauacuuaauua

SEQ ID NO: 182044 - RNA, 22 nt, Homo sapiens
ugcagagaaacauuuuguauuu

SEQ ID NO: 182045 - RNA, 20 nt, Homo sapiens
ugcagauucaaccaacugug

SEQ ID NO: 182046 - RNA, 20 nt, Homo sapiens
ugcagcacgggcccuuucca

SEQ ID NO: 182047 - RNA, 22 nt, Homo sapiens
ugcaguacuuugaaauauacug

SEQ ID NO: 182048 - RNA, 22 nt, Homo sapiens
ugcagugugaaagagccugaca

SEQ ID NO: 182049 - RNA, 22 nt, Homo sapiens
ugcaguguucuuuagaggaaau

SEQ ID NO: 182050 - RNA, 22 nt, Homo sapiens
ugcauacacaagcauacaugua

SEQ ID NO: 182051 - RNA, 22 nt, Homo sapiens
ugcauaucuucuuuugagaaau

SEQ ID NO: 182052 - RNA, 22 nt, Homo sapiens
ugcauaucuuguggaauaucuc

SEQ ID NO: 182053 - RNA, 22 nt, Homo sapiens
ugcauaugcagcauuuaugauu

SEQ ID NO: 182054 - RNA, 22 nt, Homo sapiens
ugcauaugucuuuauagcagca

SEQ ID NO: 182055 - RNA, 22 nt, Homo sapiens
ugcauauguucaaaguauucug

SEQ ID NO: 182056 - RNA, 22 nt, Homo sapiens
ugcauauucgaguuauuuuggg

SEQ ID NO: 182057 - RNA, 22 nt, Homo sapiens
ugcauauuuuauaaagauggaa

SEQ ID NO: 182058 - RNA, 22 nt, Homo sapiens
ugcauggagauauacaguuuuu

SEQ ID NO: 182059 - RNA, 22 nt, Homo sapiens
ugcauggauguuugaacacacu

SEQ ID NO: 182060 - RNA, 22 nt, Homo sapiens
ugcauggucauacauggcaccc

SEQ ID NO: 182061 - RNA, 21 nt, Homo sapiens
ugcauuggagaauguuucuca

SEQ ID NO: 182062 - RNA, 22 nt, Homo sapiens
ugccaagaacauuuucuguuuu

SEQ ID NO: 182063 - RNA, 22 nt, Homo sapiens
ugccagagacguagggaauauu

SEQ ID NO: 182064 - RNA, 22 nt, Homo sapiens
ugccaguauuuuauugagcauu

SEQ ID NO: 182065 - RNA, 22 nt, Homo sapiens
ugccaguguugccuuucacuag

SEQ ID NO: 182066 - RNA, 19 nt, Homo sapiens
ugccauguaacaggaaaau

SEQ ID NO: 182067 - RNA, 22 nt, Homo sapiens
ugcccaguggacagaaagucau

SEQ ID NO: 182068 - RNA, 21 nt, Homo sapiens
ugcccaguggcuuggggucag

SEQ ID NO: 182069 - RNA, 22 nt, Homo sapiens
ugccuagaaacacuauuucucc

SEQ ID NO: 182070 - RNA, 22 nt, Homo sapiens
ugccuaggcuggaguguagugg

SEQ ID NO: 182071 - RNA, 21 nt, Homo sapiens
ugccuuuguaguaggugucuu

SEQ ID NO: 182072 - RNA, 22 nt, Homo sapiens
ugccuuuguucuggaaugggaa

SEQ ID NO: 182073 - RNA, 22 nt, Homo sapiens
ugcgccauugaacuccuccugg

SEQ ID NO: 182074 - RNA, 22 nt, Homo sapiens
ugcgccauugcacuccagucuu

SEQ ID NO: 182075 - RNA, 22 nt, Homo sapiens
ugcgccauugcacucuagccug

SEQ ID NO: 182076 - RNA, 22 nt, Homo sapiens
ugcguucauuuggccaguggcg

SEQ ID NO: 182077 - RNA, 22 nt, Homo sapiens
ugcuacccuucgucucucuggu

SEQ ID NO: 182078 - RNA, 22 nt, Homo sapiens
ugcucaccugcugcucaccucc

SEQ ID NO: 182079 - RNA, 23 nt, Homo sapiens
ugcuccccucauggaugaauaaa

SEQ ID NO: 182080 - RNA, 22 nt, Homo sapiens
ugcugcacuuauggcucugagg

SEQ ID NO: 182081 - RNA, 22 nt, Homo sapiens
ugcugcauuggggauuaaguuu

SEQ ID NO: 182082 - RNA, 22 nt, Homo sapiens
ugcugguaguuuaugacuaauu

SEQ ID NO: 182083 - RNA, 22 nt, Homo sapiens
ugcugguggucccauaugauua

SEQ ID NO: 182084 - RNA, 22 nt, Homo sapiens
ugcugguguggucuagccgcuu

SEQ ID NO: 182085 - RNA, 22 nt, Homo sapiens
ugcuuaggcuaacaaaaauagc

SEQ ID NO: 182086 - RNA, 22 nt, Homo sapiens
ugcuuaggcuuccuuacaguau

SEQ ID NO: 182087 - RNA, 22 nt, Homo sapiens
ugcuuguguucagguaaccuuu

SEQ ID NO: 182088 - RNA, 22 nt, Homo sapiens
ugcuuuguuauauggggauucu

SEQ ID NO: 182089 - RNA, 22 nt, Homo sapiens
uggaaacuuauguucuucugug

SEQ ID NO: 182090 - RNA, 22 nt, Homo sapiens
uggaacacauaaauagcauagu

SEQ ID NO: 182091 - RNA, 22 nt, Homo sapiens
uggaacacaucuaaggaagcag

SEQ ID NO: 182092 - RNA, 22 nt, Homo sapiens
uggaagacaggcuguauuuuaa

SEQ ID NO: 182093 - RNA, 22 nt, Homo sapiens
uggaagacucuagucucuugag

SEQ ID NO: 182094 - RNA, 22 nt, Homo sapiens
uggaagacuuuagaggcuuaua

SEQ ID NO: 182095 - RNA, 22 nt, Homo sapiens
uggaagauggaguuuuaucauu

SEQ ID NO: 182096 - RNA, 22 nt, Homo sapiens
uggaagaugggaccucaguuuu

SEQ ID NO: 182097 - RNA, 22 nt, Homo sapiens
uggaagcauagcagcgugugug

SEQ ID NO: 182098 - RNA, 20 nt, Homo sapiens
uggaagccuggugcuaucuu

SEQ ID NO: 182099 - RNA, 20 nt, Homo sapiens
uggaaggcaucugcauuauu

SEQ ID NO: 182100 - RNA, 22 nt, Homo sapiens
uggaaggcuucauauguaaaga

SEQ ID NO: 182101 - RNA, 22 nt, Homo sapiens
uggaaguaaccaugaauggaau

SEQ ID NO: 182102 - RNA, 22 nt, Homo sapiens
uggaaguaaucaugagguagca

SEQ ID NO: 182103 - RNA, 22 nt, Homo sapiens
uggaagucaugcugcaagaaca

SEQ ID NO: 182104 - RNA, 19 nt, Homo sapiens
uggaaugaaauguuagggg

SEQ ID NO: 182105 - RNA, 22 nt, Homo sapiens
uggaauggagagagggugcacg

SEQ ID NO: 182106 - RNA, 22 nt, Homo sapiens
uggaauguagcguugacacgag

SEQ ID NO: 182107 - RNA, 22 nt, Homo sapiens
uggacaagauagguucuauauu

SEQ ID NO: 182108 - RNA, 22 nt, Homo sapiens
uggacagaaacauguuuucagu

SEQ ID NO: 182109 - RNA, 18 nt, Homo sapiens
uggacagugauuauccau

SEQ ID NO: 182110 - RNA, 21 nt, Homo sapiens
uggaccccuacuucucaccau

SEQ ID NO: 182111 - RNA, 21 nt, Homo sapiens
uggaccccuuucuuacaccgu

SEQ ID NO: 182112 - RNA, 22 nt, Homo sapiens
uggagacaaagauagaaaagca

SEQ ID NO: 182113 - RNA, 22 nt, Homo sapiens
uggagacugaucccucuuuccu

SEQ ID NO: 182114 - RNA, 22 nt, Homo sapiens
uggagagugauaaguaaaugga

SEQ ID NO: 182115 - RNA, 22 nt, Homo sapiens
uggagugaaaacacacuaaucu

SEQ ID NO: 182116 - RNA, 22 nt, Homo sapiens
uggagugcgugucugaguuuuu

SEQ ID NO: 182117 - RNA, 22 nt, Homo sapiens
uggaguguuggggcaggaucuc

SEQ ID NO: 182118 - RNA, 19 nt, Homo sapiens
uggaugacugucugggucu

SEQ ID NO: 182119 - RNA, 22 nt, Homo sapiens
uggaugacuguuauaugcauau

SEQ ID NO: 182120 - RNA, 21 nt, Homo sapiens
uggaugccuaggcagaaguuu

SEQ ID NO: 182121 - RNA, 22 nt, Homo sapiens
uggcaaaugaaagaaagccagu

SEQ ID NO: 182122 - RNA, 22 nt, Homo sapiens
uggcaaaugaagucagcuguac

SEQ ID NO: 182123 - RNA, 22 nt, Homo sapiens
uggcaaauguaguacccaauag

SEQ ID NO: 182124 - RNA, 22 nt, Homo sapiens
uggcaagagcugcauucaucug

SEQ ID NO: 182125 - RNA, 22 nt, Homo sapiens
uggcaauaaaaugcaguuacuu

SEQ ID NO: 182126 - RNA, 22 nt, Homo sapiens
uggcaauguggaaugguccagg

SEQ ID NO: 182127 - RNA, 22 nt, Homo sapiens
uggcacuggagauacauuaaua

SEQ ID NO: 182128 - RNA, 22 nt, Homo sapiens
uggcagauagaaaugugguuaa

SEQ ID NO: 182129 - RNA, 22 nt, Homo sapiens
uggcagauaggauacaggacua

SEQ ID NO: 182130 - RNA, 22 nt, Homo sapiens
uggcaguuuugauguggagaga

SEQ ID NO: 182131 - RNA, 22 nt, Homo sapiens
uggcaugauauauauucguuug

SEQ ID NO: 182132 - RNA, 22 nt, Homo sapiens
uggcaugauccuagauucaaca

SEQ ID NO: 182133 - RNA, 22 nt, Homo sapiens
uggcauggaaagcuuuucauac

SEQ ID NO: 182134 - RNA, 22 nt, Homo sapiens
uggcaugggguaguagcgcugg

SEQ ID NO: 182135 - RNA, 22 nt, Homo sapiens
uggcauggucugcccaaguuuc

SEQ ID NO: 182136 - RNA, 22 nt, Homo sapiens
uggcauguguuugaaugaguau

SEQ ID NO: 182137 - RNA, 22 nt, Homo sapiens
uggcauuuucucuguucuuaga

SEQ ID NO: 182138 - RNA, 22 nt, Homo sapiens
uggcgagaaaccauaugcuuuc

SEQ ID NO: 182139 - RNA, 22 nt, Homo sapiens
uggcgagaugcucgugugcaga

SEQ ID NO: 182140 - RNA, 20 nt, Homo sapiens
uggcuaaaugaaugauagca

SEQ ID NO: 182141 - RNA, 18 nt, Homo sapiens
uggcuacugaacuagaug

SEQ ID NO: 182142 - RNA, 22 nt, Homo sapiens
uggcuauuucgucaugcucccc

SEQ ID NO: 182143 - RNA, 22 nt, Homo sapiens
uggcucauuucuaaacccagcu

SEQ ID NO: 182144 - RNA, 22 nt, Homo sapiens
uggcuguguccucucccaaauc

SEQ ID NO: 182145 - RNA, 22 nt, Homo sapiens
uugagauggagucucacgcauu

SEQ ID NO: 182146 - RNA, 22 nt, Homo sapiens
uugagauggagucucacucugc

SEQ ID NO: 182147 - RNA, 22 nt, Homo sapiens
uugagauggagucucacugugu

SEQ ID NO: 182148 - RNA, 22 nt, Homo sapiens
uugagauggagucucguucugu

SEQ ID NO: 182149 - RNA, 22 nt, Homo sapiens
uugagauggagucuugcucugu

SEQ ID NO: 182150 - RNA, 22 nt, Homo sapiens
uugagauggaguuucacucuug

SEQ ID NO: 182151 - RNA, 22 nt, Homo sapiens
uugagauguaguuucacuccug

SEQ ID NO: 182152 - RNA, 19 nt, Homo sapiens
uugagaugugaacucacac

SEQ ID NO: 182153 - RNA, 22 nt, Homo sapiens
uugagauuuuccucaaauauuu

SEQ ID NO: 182154 - RNA, 22 nt, Homo sapiens
uuguacaggaguguaagcuuca

SEQ ID NO: 182155 - RNA, 22 nt, Homo sapiens
uuguacuauuuuuaucagugau

SEQ ID NO: 182156 - RNA, 22 nt, Homo sapiens
uuguacuggguuuucuggaauu

SEQ ID NO: 182157 - RNA, 22 nt, Homo sapiens
uuguacuuuuaguagagacggg

SEQ ID NO: 182158 - RNA, 22 nt, Homo sapiens
uuguagaucuucaguugcuaca

SEQ ID NO: 182159 - RNA, 22 nt, Homo sapiens
uuguauccaucuuucaggcaac

SEQ ID NO: 182160 - RNA, 22 nt, Homo sapiens
uugucacauggggcggcugccc

SEQ ID NO: 182161 - RNA, 22 nt, Homo sapiens
uugucacuauaaauaagcauuu

SEQ ID NO: 182162 - RNA, 22 nt, Homo sapiens
uugucacucuuccuaggguagg

SEQ ID NO: 182163 - RNA, 22 nt, Homo sapiens
uugucacugcacuccagucugg

SEQ ID NO: 182164 - RNA, 18 nt, Homo sapiens
uugcaaauucuucccugu

SEQ ID NO: 182165 - RNA, 22 nt, Homo sapiens
uugcaacuuagaaaaaucauuu

SEQ ID NO: 182166 - RNA, 22 nt, Homo sapiens
uugcacuccagccuggaugaca

SEQ ID NO: 182167 - RNA, 22 nt, Homo sapiens
uugcacuccagucuggggggca

SEQ ID NO: 182168 - RNA, 22 nt, Homo sapiens
uugcacucuagccugggugaca

SEQ ID NO: 182169 - RNA, 20 nt, Homo sapiens
uugcagagcccaacccugga

SEQ ID NO: 182170 - RNA, 22 nt, Homo sapiens
uugcagagccccugcaaggguc

SEQ ID NO: 182171 - RNA, 22 nt, Homo sapiens
uugcauagacaauauuaaucuu

SEQ ID NO: 182172 - RNA, 22 nt, Homo sapiens
uugcaugucugcuucuccuccu

SEQ ID NO: 182173 - RNA, 22 nt, Homo sapiens
uugcauugacacaugaagcuca

SEQ ID NO: 182174 - RNA, 22 nt, Homo sapiens
uuggacuuuuauucugcaggca

SEQ ID NO: 182175 - RNA, 22 nt, Homo sapiens
uuggagcacuggggcacugaca

SEQ ID NO: 182176 - RNA, 22 nt, Homo sapiens
uuggauuuuaacaaacuaggug

SEQ ID NO: 182177 - RNA, 23 nt, Homo sapiens
uuggccuccuugugucuagggcu

SEQ ID NO: 182178 - RNA, 22 nt, Homo sapiens
uuggcuucuggacuauugugca

SEQ ID NO: 182179 - RNA, 22 nt, Homo sapiens
uugggcaauaggaagcaggugg

SEQ ID NO: 182180 - RNA, 22 nt, Homo sapiens
uugguauguaauuuauauugua

SEQ ID NO: 182181 - RNA, 22 nt, Homo sapiens
uuguaaaguucuuaggaagcuc

SEQ ID NO: 182182 - RNA, 23 nt, Homo sapiens
uuguaacuggagaguaacauucc

SEQ ID NO: 182183 - RNA, 22 nt, Homo sapiens
uuguaugucuucauuugaaaaa

SEQ ID NO: 182184 - RNA, 22 nt, Homo sapiens
uugucacccuacauaacaggga

SEQ ID NO: 182185 - RNA, 22 nt, Homo sapiens
uuguccacugcuagccucugca

SEQ ID NO: 182186 - RNA, 22 nt, Homo sapiens
uugugaauggugcugcaguaaa

SEQ ID NO: 182187 - RNA, 22 nt, Homo sapiens
uugugcuucaucaccuagcaga

SEQ ID NO: 182188 - RNA, 22 nt, Homo sapiens
uuguggcuuaucucauuuagcg

SEQ ID NO: 182189 - RNA, 16 nt, Homo sapiens
uuguggcuuuugcaca

SEQ ID NO: 182190 - RNA, 22 nt, Homo sapiens
uugugguuuuuaaaacuaggug

SEQ ID NO: 182191 - RNA, 22 nt, Homo sapiens
uugugucaaauggcaauuagca

SEQ ID NO: 182192 - RNA, 22 nt, Homo sapiens
uuguguccccacccaaaucuca

SEQ ID NO: 182193 - RNA, 22 nt, Homo sapiens
uuuaauacugcaucuuuacucu

SEQ ID NO: 182194 - RNA, 22 nt, Homo sapiens
uuuagguauuugguauagcagu

SEQ ID NO: 182195 - RNA, 22 nt, Homo sapiens
uuuauccagccucuagcaaggu

SEQ ID NO: 182196 - RNA, 22 nt, Homo sapiens
uuucacaguguucucccccaga

SEQ ID NO: 182197 - RNA, 22 nt, Homo sapiens
uuucaccguguuggccaggcug

SEQ ID NO: 182198 - RNA, 17 nt, Homo sapiens
uuucagaguggaagugu

SEQ ID NO: 182199 - RNA, 22 nt, Homo sapiens
uuucaguagagacacgguuuug

SEQ ID NO: 182200 - RNA, 23 nt, Homo sapiens
uuucaguaguuguauccuguugc

SEQ ID NO: 182201 - RNA, 22 nt, Homo sapiens
uuucaguguggcaggcauagcu

SEQ ID NO: 182202 - RNA, 22 nt, Homo sapiens
uuucauggagaaucuucuuacu

SEQ ID NO: 182203 - RNA, 22 nt, Homo sapiens
uuuccagguggccaacauuuua

SEQ ID NO: 182204 - RNA, 22 nt, Homo sapiens
uuucccauuguucugcucugug

SEQ ID NO: 182205 - RNA, 20 nt, Homo sapiens
uuucuccccuauaaaucuca

SEQ ID NO: 182206 - RNA, 22 nt, Homo sapiens
uuucugguuaauuucuaagagc

SEQ ID NO: 182207 - RNA, 22 nt, Homo sapiens
uuugacaaugugugcuuguauu

SEQ ID NO: 182208 - RNA, 22 nt, Homo sapiens
uuugcaauagguuguggggagg

SEQ ID NO: 182209 - RNA, 22 nt, Homo sapiens
uuugcacucaguaagugggagc

SEQ ID NO: 182210 - RNA, 22 nt, Homo sapiens
uuugcuucacuguuuggcaaaa

SEQ ID NO: 182211 - RNA, 22 nt, Homo sapiens
uuuggaagaugccacuguauca

SEQ ID NO: 182212 - RNA, 22 nt, Homo sapiens
uuuggcagaaaacaagaaucug

SEQ ID NO: 182213 - RNA, 22 nt, Homo sapiens
uuuggcauuagagagacuugca

SEQ ID NO: 182214 - RNA, 22 nt, Homo sapiens
uuuggcauuuuacuacucaaau

SEQ ID NO: 182215 - RNA, 22 nt, Homo sapiens
uuugguugucacaacuggggga

SEQ ID NO: 182216 - RNA, 22 nt, Homo sapiens
uuuguaauccuauuccaaagga

SEQ ID NO: 182217 - RNA, 22 nt, Homo sapiens
uuuguccccgcccagaucucau

SEQ ID NO: 182218 - RNA, 22 nt, Homo sapiens
uuugucuccuaagacucugugg

SEQ ID NO: 182219 - RNA, 22 nt, Homo sapiens
uuugugcuauguuauauauucu

SEQ ID NO: 182220 - RNA, 22 nt, Homo sapiens
uuuugcacuguuuuaucugaca

SEQ ID NO: 182221 - RNA, 22 nt, Homo sapiens
uuuuggcuagaaauauaccucc

SEQ ID NO: 182222 - RNA, 22 nt, Homo sapiens
uuuuggcucugucuguaucuuu

SEQ ID NO: 182223 - RNA, 22 nt, Homo sapiens
uuuuggcucuugguaggucaga

SEQ ID NO: 182224 - RNA, 22 nt, Homo sapiens
uuuuuugguaauugaacaauga

SEQ ID NO: 182225 - RNA, 23 nt, Homo sapiens
ucugauguuauaaaauucuuugg

SEQ ID NO: 182226 - RNA, 22 nt, Homo sapiens
ucugccacugucauugugugau

SEQ ID NO: 182227 - RNA, 22 nt, Homo sapiens
ucugccuuuucaugugggaugg

SEQ ID NO: 182228 - RNA, 22 nt, Homo sapiens
ucuggagugugaaguggauaug

SEQ ID NO: 182229 - RNA, 22 nt, Homo sapiens
ucuggccuccuaugagaaucga

SEQ ID NO: 182230 - RNA, 22 nt, Homo sapiens
ucuggcuuugugaguugccaga

SEQ ID NO: 182231 - RNA, 20 nt, Homo sapiens
ucuggguuuuggccacgccc

SEQ ID NO: 182232 - RNA, 19 nt, Homo sapiens
ucuguaguuagggcuacag

SEQ ID NO: 182233 - RNA, 22 nt, Homo sapiens
ucugugguuguugcauggaaug

SEQ ID NO: 182234 - RNA, 22 nt, Homo sapiens
ucuguguuugaucaagauugua

SEQ ID NO: 182235 - RNA, 22 nt, Homo sapiens
ucuucaugcuugaaauaauagc

SEQ ID NO: 182236 - RNA, 22 nt, Homo sapiens
ucuugcacaaauuauuuuaacu

SEQ ID NO: 182237 - RNA, 22 nt, Homo sapiens
ucuugcaccuacaugcuuuguc

SEQ ID NO: 182238 - RNA, 22 nt, Homo sapiens
ucuuggguuguuggcuucuccu

SEQ ID NO: 182239 - RNA, 22 nt, Homo sapiens
ucuuggguuuguccuucuccua

SEQ ID NO: 182240 - RNA, 22 nt, Homo sapiens
ucuuugauaagauccagaagaa

SEQ ID NO: 182241 - RNA, 22 nt, Homo sapiens
ucuuugauuuuguuacuaagac

SEQ ID NO: 182242 - RNA, 22 nt, Homo sapiens
ugaaauuuuuuauucguuggcu

SEQ ID NO: 182243 - RNA, 21 nt, Homo sapiens
ugacagaaaauugaguuugcu

SEQ ID NO: 182244 - RNA, 22 nt, Homo sapiens
ugacagagcaggacuucaucuc

SEQ ID NO: 182245 - RNA, 23 nt, Homo sapiens
ugacagugcuugaaauugcucuu

SEQ ID NO: 182246 - RNA, 22 nt, Homo sapiens
ugacaguguccucauucccaac

SEQ ID NO: 182247 - RNA, 23 nt, Homo sapiens
ugacauguaauucaguccagcag

SEQ ID NO: 182248 - RNA, 22 nt, Homo sapiens
ugacauguagagaacuucucau

SEQ ID NO: 182249 - RNA, 22 nt, Homo sapiens
ugacauuacagucacuugcugu

SEQ ID NO: 182250 - RNA, 22 nt, Homo sapiens
ugacucaguuguuagucuucau

SEQ ID NO: 182251 - RNA, 22 nt, Homo sapiens
ugacuccagagacugugcuguc

SEQ ID NO: 182252 - RNA, 23 nt, Homo sapiens
ugacugaguauauguuuggugcu

SEQ ID NO: 182253 - RNA, 22 nt, Homo sapiens
ugacugugcagcuccaucaggg

SEQ ID NO: 182254 - RNA, 22 nt, Homo sapiens
ugacuucauuuuuggccaugag

SEQ ID NO: 182255 - RNA, 22 nt, Homo sapiens
ugagaacuagagaacaagguga

SEQ ID NO: 182256 - RNA, 22 nt, Homo sapiens
cuguaguuagcagaugaugaau

SEQ ID NO: 182257 - RNA, 22 nt, Homo sapiens
cugugcuugagagaugacacag

SEQ ID NO: 182258 - RNA, 22 nt, Homo sapiens
cuucaugggagaaccacaggua

SEQ ID NO: 182259 - RNA, 21 nt, Homo sapiens
cuucuuggggcagggcagggu

SEQ ID NO: 182260 - RNA, 22 nt, Homo sapiens
cuugagcaaacaaaggugguag

SEQ ID NO: 182261 - RNA, 22 nt, Homo sapiens
cuugcacuagugcagaggcgcu

SEQ ID NO: 182262 - RNA, 22 nt, Homo sapiens
cuugcacuugaaauuccaguuu

SEQ ID NO: 182263 - RNA, 22 nt, Homo sapiens
cuuggcacugcucacccuccuu

SEQ ID NO: 182264 - RNA, 22 nt, Homo sapiens
cuugggcagugugcauguguau

SEQ ID NO: 182265 - RNA, 22 nt, Homo sapiens
cuuuacaguuggacucacgagg

SEQ ID NO: 182266 - RNA, 22 nt, Homo sapiens
cuuugguuuacuuggugcuagu

SEQ ID NO: 182267 - RNA, 23 nt, Homo sapiens
cuuuguccccacccaaaucucau

SEQ ID NO: 182268 - RNA, 22 nt, Homo sapiens
cuuuguggggucuuuccucaaa

SEQ ID NO: 182269 - RNA, 22 nt, Homo sapiens
cuuuuugguagagcaggugugc

SEQ ID NO: 182270 - RNA, 22 nt, Homo sapiens
gaaaacugcuucucuggguuuc

SEQ ID NO: 182271 - RNA, 22 nt, Homo sapiens
gaaagcugguauagauacauua

SEQ ID NO: 182272 - RNA, 18 nt, Homo sapiens
gaagaaguaggcauggca

SEQ ID NO: 182273 - RNA, 22 nt, Homo sapiens
gaagcgaggugauuagcagaca

SEQ ID NO: 182274 - RNA, 23 nt, Homo sapiens
gaaguauagcaugcacauggaaa

SEQ ID NO: 182275 - RNA, 22 nt, Homo sapiens
gaauagugcugcagcaaacaua

SEQ ID NO: 182276 - RNA, 18 nt, Homo sapiens
gacaguguggcaauuccu

SEQ ID NO: 182277 - RNA, 21 nt, Homo sapiens
gaccacagcagggaaugucag

SEQ ID NO: 182278 - RNA, 22 nt, Homo sapiens
gagaacagaagcauuccuaauu

SEQ ID NO: 182279 - RNA, 21 nt, Homo sapiens
gagaaucuuuucagggcaaac

SEQ ID NO: 182280 - RNA, 22 nt, Homo sapiens
gagacugagucuugcccuguca

SEQ ID NO: 182281 - RNA, 22 nt, Homo sapiens
gagacugagucuugcucugucg

SEQ ID NO: 182282 - RNA, 22 nt, Homo sapiens
gagacugagucuugcuuuguca

SEQ ID NO: 182283 - RNA, 22 nt, Homo sapiens
gagaucaaguauucuccacuaa

SEQ ID NO: 182284 - RNA, 22 nt, Homo sapiens
gagauguaagaauuuauuuguu

SEQ ID NO: 182285 - RNA, 22 nt, Homo sapiens
gagauuauuagauguucugcuu

SEQ ID NO: 182286 - RNA, 22 nt, Homo sapiens
gagauuauuuaaaaggugauuu

SEQ ID NO: 182287 - RNA, 22 nt, Homo sapiens
gagauuuucagcuugacuggga

SEQ ID NO: 182288 - RNA, 22 nt, Homo sapiens
gagcucaccuuaccucuggagc

SEQ ID NO: 182289 - RNA, 22 nt, Homo sapiens
gagcugguccuuuaaggaugca

SEQ ID NO: 182290 - RNA, 22 nt, Homo sapiens
gaggaaguaauuuuaggccugu

SEQ ID NO: 182291 - RNA, 22 nt, Homo sapiens
gaguagugcuguaauaaacaua

SEQ ID NO: 182292 - RNA, 22 nt, Homo sapiens
gaguauuuuacaucguguaauu

SEQ ID NO: 182293 - RNA, 22 nt, Homo sapiens
gagugcaaagguccugaggugg

SEQ ID NO: 182294 - RNA, 22 nt, Homo sapiens
gagugcaauggcaagaucuugg

SEQ ID NO: 182295 - RNA, 22 nt, Homo sapiens
gagugcaauggugcuaucucgg

SEQ ID NO: 182296 - RNA, 21 nt, Homo sapiens
gaguggcuuuuguuucaccag

SEQ ID NO: 182297 - RNA, 20 nt, Homo sapiens
auggcccugcugggaguguc

SEQ ID NO: 182298 - RNA, 22 nt, Homo sapiens
auggcuauuccauaggcagagc

SEQ ID NO: 182299 - RNA, 22 nt, Homo sapiens
auggcuuuuuaaaucauguugu

SEQ ID NO: 182300 - RNA, 22 nt, Homo sapiens
augguugguuaaaucuguguau

SEQ ID NO: 182301 - RNA, 22 nt, Homo sapiens
augucaaagaggaaaacuggau

SEQ ID NO: 182302 - RNA, 22 nt, Homo sapiens
augugcacaugcuuacauguga

SEQ ID NO: 182303 - RNA, 21 nt, Homo sapiens
augugcacuaugucauuuaau

SEQ ID NO: 182304 - RNA, 22 nt, Homo sapiens
auguggcuuuccuagaucuuag

SEQ ID NO: 182305 - RNA, 22 nt, Homo sapiens
auguuauguucuucucuguaua

SEQ ID NO: 182306 - RNA, 22 nt, Homo sapiens
auuaaguugugccugaaaacuu

SEQ ID NO: 182307 - RNA, 22 nt, Homo sapiens
auuccacuuacaugaaguaccu

SEQ ID NO: 182308 - RNA, 20 nt, Homo sapiens
auugaacucaguauucugaa

SEQ ID NO: 182309 - RNA, 22 nt, Homo sapiens
auugaacuuaaaagacuugcca

SEQ ID NO: 182310 - RNA, 22 nt, Homo sapiens
auugaaugaaauggcagacacu

SEQ ID NO: 182311 - RNA, 19 nt, Homo sapiens
auugcacuccaaccugggu

SEQ ID NO: 182312 - RNA, 22 nt, Homo sapiens
auugcacuccagccugggcuag

SEQ ID NO: 182313 - RNA, 22 nt, Homo sapiens
auugcacuccagccugggugac

SEQ ID NO: 182314 - RNA, 22 nt, Homo sapiens
auugcacuccagccuggugaca

SEQ ID NO: 182315 - RNA, 22 nt, Homo sapiens
auugcacuccagccuugggcaa

SEQ ID NO: 182316 - RNA, 22 nt, Homo sapiens
auugcacuccagccuugugaca

SEQ ID NO: 182317 - RNA, 22 nt, Homo sapiens
auugcacuccagcuugggugac

SEQ ID NO: 182318 - RNA, 22 nt, Homo sapiens
auugcacuggggguuagaauuu

SEQ ID NO: 182319 - RNA, 23 nt, Homo sapiens
auugcagucuugaacuccugggc

SEQ ID NO: 182320 - RNA, 22 nt, Homo sapiens
auugcauaaacacauuucuuau

SEQ ID NO: 182321 - RNA, 22 nt, Homo sapiens
auugcuauuauuugaccauugu

SEQ ID NO: 182322 - RNA, 22 nt, Homo sapiens
auugcuuuuacugggagcuuug

SEQ ID NO: 182323 - RNA, 22 nt, Homo sapiens
auuucacugagacaugugccca

SEQ ID NO: 182324 - RNA, 22 nt, Homo sapiens
auuuccuguaggggcuugcgaa

SEQ ID NO: 182325 - RNA, 22 nt, Homo sapiens
auuuuugguugguaggcuauua

SEQ ID NO: 182326 - RNA, 22 nt, Homo sapiens
caaaggcuguuauaggccagga

SEQ ID NO: 182327 - RNA, 22 nt, Homo sapiens
caacacuguuuauuggauagcc

SEQ ID NO: 182328 - RNA, 22 nt, Homo sapiens
caacucuguaggauccaggugg

SEQ ID NO: 182329 - RNA, 22 nt, Homo sapiens
caagacuguccaacauauuggg

SEQ ID NO: 182330 - RNA, 21 nt, Homo sapiens
caagugaugcuucugcuuuaa

SEQ ID NO: 182331 - RNA, 22 nt, Homo sapiens
caaugcauuauucucccacuuc

SEQ ID NO: 182332 - RNA, 22 nt, Homo sapiens
caccagguuggagugcaguggu

SEQ ID NO: 182333 - RNA, 22 nt, Homo sapiens
cacugcaguaaauugcgucggu

SEQ ID NO: 182334 - RNA, 22 nt, Homo sapiens
cacugcauccuccaccuccugg

SEQ ID NO: 182335 - RNA, 22 nt, Homo sapiens
cacugcauccuccauauccugg

SEQ ID NO: 182336 - RNA, 22 nt, Homo sapiens
cagagagcuugcccuuguauau

SEQ ID NO: 182337 - RNA, 22 nt, Homo sapiens
cagcuaaauuguuaaauccaag

SEQ ID NO: 182338 - RNA, 22 nt, Homo sapiens
caguacaauguugauuagaagu

SEQ ID NO: 182339 - RNA, 22 nt, Homo sapiens
cagugauaggugguuguuggca

SEQ ID NO: 182340 - RNA, 22 nt, Homo sapiens
cauacagcuaguaaguguaaga

SEQ ID NO: 182341 - RNA, 22 nt, Homo sapiens
cauacaguaggcacuauuugua

SEQ ID NO: 182342 - RNA, 22 nt, Homo sapiens
cauacaugugcuugucuuaugc

SEQ ID NO: 182343 - RNA, 22 nt, Homo sapiens
cauauucacuuuacagagcugu

SEQ ID NO: 182344 - RNA, 22 nt, Homo sapiens
auaaacagcuuauccucuauuc

SEQ ID NO: 182345 - RNA, 18 nt, Homo sapiens
auaaacucaucauuuuua

SEQ ID NO: 182346 - RNA, 22 nt, Homo sapiens
auaagaagugaaccagacgucu

SEQ ID NO: 182347 - RNA, 22 nt, Homo sapiens
auaagucaauggaacagauuaa

SEQ ID NO: 182348 - RNA, 22 nt, Homo sapiens
auacaguaaugucuuaggcugu

SEQ ID NO: 182349 - RNA, 22 nt, Homo sapiens
auacaguaucuucuggcaagca

SEQ ID NO: 182350 - RNA, 22 nt, Homo sapiens
auacaguauggagggcccagcu

SEQ ID NO: 182351 - RNA, 22 nt, Homo sapiens
auacaguugccauuucuugugc

SEQ ID NO: 182352 - RNA, 22 nt, Homo sapiens
auacaugugccaugcuggugug

SEQ ID NO: 182353 - RNA, 22 nt, Homo sapiens
auagaauguuugcgccagguga

SEQ ID NO: 182354 - RNA, 22 nt, Homo sapiens
auagcagcucacuuauuuaugg

SEQ ID NO: 182355 - RNA, 22 nt, Homo sapiens
auagguauuuuuaaaugacugu

SEQ ID NO: 182356 - RNA, 22 nt, Homo sapiens
auagugcuauggcagaccuuga

SEQ ID NO: 182357 - RNA, 22 nt, Homo sapiens
auagugcugcaauaaacauaca

SEQ ID NO: 182358 - RNA, 22 nt, Homo sapiens
auagugcugcauuaaacauacg

SEQ ID NO: 182359 - RNA, 22 nt, Homo sapiens
auagugcugugaugaacauaca

SEQ ID NO: 182360 - RNA, 22 nt, Homo sapiens
auauagcaaugaaagagaugaa

SEQ ID NO: 182361 - RNA, 22 nt, Homo sapiens
auauaugcacacgugugcauau

SEQ ID NO: 182362 - RNA, 22 nt, Homo sapiens
auaugcacgugcauacacacuu

SEQ ID NO: 182363 - RNA, 22 nt, Homo sapiens
auauucacagguaucagagauu

SEQ ID NO: 182364 - RNA, 22 nt, Homo sapiens
aucaaaugcuggcagagugccu

SEQ ID NO: 182365 - RNA, 22 nt, Homo sapiens
aucacagugaaaacagucaauu

SEQ ID NO: 182366 - RNA, 22 nt, Homo sapiens
aucacaguggucagguauagau

SEQ ID NO: 182367 - RNA, 22 nt, Homo sapiens
aucagaaucucuagaggacugu

SEQ ID NO: 182368 - RNA, 22 nt, Homo sapiens
aucagugcauguuuguugagcu

SEQ ID NO: 182369 - RNA, 22 nt, Homo sapiens
aucauacuguuuugauuacugu

SEQ ID NO: 182370 - RNA, 22 nt, Homo sapiens
aucaucacaguuguguguaaug

SEQ ID NO: 182371 - RNA, 22 nt, Homo sapiens
aucauguaguaagacacauuua

SEQ ID NO: 182372 - RNA, 22 nt, Homo sapiens
aucauugugugaguugauggga

SEQ ID NO: 182373 - RNA, 22 nt, Homo sapiens
aucccuguaacuagcagccccu

SEQ ID NO: 182374 - RNA, 22 nt, Homo sapiens
auccucaguggcuuaaguauag

SEQ ID NO: 182375 - RNA, 22 nt, Homo sapiens
auccuguacuaagguuuuccca

SEQ ID NO: 182376 - RNA, 22 nt, Homo sapiens
aucugcaaauaaugaagauugg

SEQ ID NO: 182377 - RNA, 22 nt, Homo sapiens
aucugcacaucuguguuuuugu

SEQ ID NO: 182378 - RNA, 19 nt, Homo sapiens
aucuggaguuccuggggcu

SEQ ID NO: 182379 - RNA, 22 nt, Homo sapiens
aucuggcuccuuuugacaaugc

SEQ ID NO: 182380 - RNA, 22 nt, Homo sapiens
aucugguguauuggugcugggu

SEQ ID NO: 182381 - RNA, 22 nt, Homo sapiens
aucugguguuuccuucacauug

SEQ ID NO: 182382 - RNA, 22 nt, Homo sapiens
aucuguagauucagcacaagcu

SEQ ID NO: 182383 - RNA, 22 nt, Homo sapiens
augaaagguauguuuucuguga

SEQ ID NO: 182384 - RNA, 22 nt, Homo sapiens
augaaagugauaaaugucucua

SEQ ID NO: 182385 - RNA, 18 nt, Homo sapiens
augaacucaucaguucuu

SEQ ID NO: 182386 - RNA, 22 nt, Homo sapiens
augaacucaucaucuagguuuu

SEQ ID NO: 182387 - RNA, 17 nt, Homo sapiens
augaacucaucauuuuu

SEQ ID NO: 182388 - RNA, 17 nt, Homo sapiens
augaacucaucguucuu

SEQ ID NO: 182389 - RNA, 22 nt, Homo sapiens
augaagagaaaguggaucuugg

SEQ ID NO: 182390 - RNA, 22 nt, Homo sapiens
augacauugaaaagcaagugga

SEQ ID NO: 182391 - RNA, 22 nt, Homo sapiens
augaccuuguccucagugucau

SEQ ID NO: 182392 - RNA, 22 nt, Homo sapiens
augacuauugcacuuuccuggu

SEQ ID NO: 182393 - RNA, 22 nt, Homo sapiens
augagaccagcagaaaaccugu

SEQ ID NO: 182394 - RNA, 22 nt, Homo sapiens
augagcagaugcuccugccucu

SEQ ID NO: 182395 - RNA, 22 nt, Homo sapiens
augaggacaucuuccuuaugga

SEQ ID NO: 182396 - RNA, 22 nt, Homo sapiens
augaggcaggaaaggcguaucu

SEQ ID NO: 182397 - RNA, 22 nt, Homo sapiens
augagguccuagccaacuuuuu

SEQ ID NO: 182398 - RNA, 22 nt, Homo sapiens
augaggugggcggcuuggaaga

SEQ ID NO: 182399 - RNA, 22 nt, Homo sapiens
augaugaaguaagugcuuagga

SEQ ID NO: 182400 - RNA, 22 nt, Homo sapiens
augaugcaguacuuugggaaca

SEQ ID NO: 182401 - RNA, 22 nt, Homo sapiens
augauuuuuguaucgccugaug

SEQ ID NO: 182402 - RNA, 22 nt, Homo sapiens
augcagagaaaucuaaaauaug

SEQ ID NO: 182403 - RNA, 19 nt, Homo sapiens
augccacagugaggucaga

SEQ ID NO: 182404 - RNA, 22 nt, Homo sapiens
augccacugcacuucagccugg

SEQ ID NO: 182405 - RNA, 22 nt, Homo sapiens
augccacugcacuucagcuugg

SEQ ID NO: 182406 - RNA, 22 nt, Homo sapiens
augccacuguacucuagccuag

SEQ ID NO: 182407 - RNA, 22 nt, Homo sapiens
augccacuguuuaugucacuua

SEQ ID NO: 182408 - RNA, 22 nt, Homo sapiens
auggaacuggagaucauuaugu

SEQ ID NO: 182409 - RNA, 22 nt, Homo sapiens
auggaagaaacgauuuucugga

SEQ ID NO: 182410 - RNA, 21 nt, Homo sapiens
auggacugugugacccugcac

SEQ ID NO: 182411 - RNA, 22 nt, Homo sapiens
auggagugagaauggagguucc

SEQ ID NO: 182412 - RNA, 22 nt, Homo sapiens
auggccauuacuaagaauguuu

SEQ ID NO: 182413 - RNA, 22 nt, Homo sapiens
auggccuaugaccguuauguug

SEQ ID NO: 182414 - RNA, 22 nt, Homo sapiens
auggcucaguguguaucuauca

SEQ ID NO: 182415 - RNA, 22 nt, Homo sapiens
augggucuccugaauacagcac

SEQ ID NO: 182416 - RNA, 21 nt, Homo sapiens
auguaacugggaaugugagag

SEQ ID NO: 182417 - RNA, 22 nt, Homo sapiens
auguaguagcagaaaauauuuu

SEQ ID NO: 182418 - RNA, 22 nt, Homo sapiens
augucuuucauagagacccaga

SEQ ID NO: 182419 - RNA, 22 nt, Homo sapiens
augugggaggaauguguuucca

SEQ ID NO: 182420 - RNA, 22 nt, Homo sapiens
augugggaggacuuggcuguug

SEQ ID NO: 182421 - RNA, 18 nt, Homo sapiens
auguuauguuuguagaag

SEQ ID NO: 182422 - RNA, 22 nt, Homo sapiens
auuauaugucaucacagacacc

SEQ ID NO: 182423 - RNA, 22 nt, Homo sapiens
auucagaggggcagcugucuug

SEQ ID NO: 182424 - RNA, 22 nt, Homo sapiens
auuccacuuccacuaguuucuc

SEQ ID NO: 182425 - RNA, 20 nt, Homo sapiens
auuccacuuguuugagguac

SEQ ID NO: 182426 - RNA, 22 nt, Homo sapiens
ugucaagaugguuugauguugu

SEQ ID NO: 182427 - RNA, 22 nt, Homo sapiens
ugucaccauuuguaggugagga

SEQ ID NO: 182428 - RNA, 22 nt, Homo sapiens
ugucacccuuuauccauuuccu

SEQ ID NO: 182429 - RNA, 22 nt, Homo sapiens
ugucagaaucugagacgacaac

SEQ ID NO: 182430 - RNA, 22 nt, Homo sapiens
ugucauauagaauguucuauga

SEQ ID NO: 182431 - RNA, 22 nt, Homo sapiens
ugucauguggcuaacgauucau

SEQ ID NO: 182432 - RNA, 22 nt, Homo sapiens
ugucauguugguguacugcacc

SEQ ID NO: 182433 - RNA, 19 nt, Homo sapiens
ugucccagccauagaggca

SEQ ID NO: 182434 - RNA, 22 nt, Homo sapiens
ugugaagauggacuaauauagu

SEQ ID NO: 182435 - RNA, 22 nt, Homo sapiens
ugugacagcacgguucaacugc

SEQ ID NO: 182436 - RNA, 22 nt, Homo sapiens
ugugacaguuaguuugguguua

SEQ ID NO: 182437 - RNA, 22 nt, Homo sapiens
ugugaugugaugagaaguuccu

SEQ ID NO: 182438 - RNA, 22 nt, Homo sapiens
ugugcacaacaugcagguuugu

SEQ ID NO: 182439 - RNA, 23 nt, Homo sapiens
ugugcacauuuacauauauacac

SEQ ID NO: 182440 - RNA, 22 nt, Homo sapiens
ugugguuuuaguaaaacuaugu

SEQ ID NO: 182441 - RNA, 22 nt, Homo sapiens
uguguaaauacaagugcuugaa

SEQ ID NO: 182442 - RNA, 22 nt, Homo sapiens
uguguuuuuauguaaaauggaa

SEQ ID NO: 182443 - RNA, 22 nt, Homo sapiens
uguucaauucccaccuaugagu

SEQ ID NO: 182444 - RNA, 22 nt, Homo sapiens
uuaaagcgacucucaugccuca

SEQ ID NO: 182445 - RNA, 22 nt, Homo sapiens
uuaagcucauuuccauucuaca

SEQ ID NO: 182446 - RNA, 22 nt, Homo sapiens
uuaaucaggccguuuccuaaga

SEQ ID NO: 182447 - RNA, 21 nt, Homo sapiens
uuaaugcuaugcagaaaaucu

SEQ ID NO: 182448 - RNA, 22 nt, Homo sapiens
uuaauucugucugcccucaucc

SEQ ID NO: 182449 - RNA, 22 nt, Homo sapiens
uuaauuguaucuauagauguca

SEQ ID NO: 182450 - RNA, 22 nt, Homo sapiens
uuacaguugugagccaccaugc

SEQ ID NO: 182451 - RNA, 22 nt, Homo sapiens
uuacauguggugugaagaagag

SEQ ID NO: 182452 - RNA, 22 nt, Homo sapiens
uuacguaguuuuggagaucaua

SEQ ID NO: 182453 - RNA, 22 nt, Homo sapiens
aaaaggcuagcuaguaacagaa

SEQ ID NO: 182454 - RNA, 22 nt, Homo sapiens
aaagaagucagccuguccuuug

SEQ ID NO: 182455 - RNA, 22 nt, Homo sapiens
aaagcugucaaggcaggaggcu

SEQ ID NO: 182456 - RNA, 22 nt, Homo sapiens
aaagggcuugaauacucuuuuu

SEQ ID NO: 182457 - RNA, 22 nt, Homo sapiens
aaagugauuguaguuuuugcca

SEQ ID NO: 182458 - RNA, 22 nt, Homo sapiens
aaagugcuuccuuuuugagggu

SEQ ID NO: 182459 - RNA, 22 nt, Homo sapiens
aaagugcuucucuuuggugggu

SEQ ID NO: 182460 - RNA, 22 nt, Homo sapiens
aaagugguuuuucagacuuuga

SEQ ID NO: 182461 - RNA, 22 nt, Homo sapiens
aaaugacuuuuuaugcagagua

SEQ ID NO: 182462 - RNA, 22 nt, Homo sapiens
aaaugggacugggguccuuuga

SEQ ID NO: 182463 - RNA, 22 nt, Homo sapiens
aaaugguguuaguagaucuuua

SEQ ID NO: 182464 - RNA, 22 nt, Homo sapiens
aaauugcacaaguggugauuug

SEQ ID NO: 182465 - RNA, 22 nt, Homo sapiens
aacaggguguuugcaguuucuu

SEQ ID NO: 182466 - RNA, 22 nt, Homo sapiens
aacagucaauugcugaugaccu

SEQ ID NO: 182467 - RNA, 22 nt, Homo sapiens
aacccugacacaagcagaauuu

SEQ ID NO: 182468 - RNA, 22 nt, Homo sapiens
aacuacaucucuuugaggcagg

SEQ ID NO: 182469 - RNA, 18 nt, Homo sapiens
uuuugcuuaacugcgcca

SEQ ID NO: 182470 - RNA, 22 nt, Homo sapiens
uuuuucacuuaaguuaggcuca

SEQ ID NO: 182471 - RNA, 22 nt, Homo sapiens
uuuuugagaauuggugaaacac

SEQ ID NO: 182472 - RNA, 18 nt, Homo sapiens
uuuuugaggcacagggga

SEQ ID NO: 182473 - RNA, 22 nt, Homo sapiens
uuuuugaguagcuggagagcag

SEQ ID NO: 182474 - RNA, 22 nt, Homo sapiens
uuuuugguugguaggcuauuaa

SEQ ID NO: 182475 - RNA, 22 nt, Homo sapiens
guggcaaggaaaugcugcucac

SEQ ID NO: 182476 - RNA, 22 nt, Homo sapiens
gugggaugaucgcuugagccca

SEQ ID NO: 182477 - RNA, 20 nt, Homo sapiens
gugggcaaauccuuuccucu

SEQ ID NO: 182478 - RNA, 22 nt, Homo sapiens
gugguucuaaaccuuuuuuggu

SEQ ID NO: 182479 - RNA, 22 nt, Homo sapiens
guguauacauagaauuguguau

SEQ ID NO: 182480 - RNA, 22 nt, Homo sapiens
gugugguaggauugguuacuca

SEQ ID NO: 182481 - RNA, 22 nt, Homo sapiens
guuauuguccauuuauuuagca

SEQ ID NO: 182482 - RNA, 22 nt, Homo sapiens
guugccuaggcuggagugcagu

SEQ ID NO: 182483 - RNA, 15 nt, Homo sapiens
guuuuuggauacaau

SEQ ID NO: 182484 - RNA, 21 nt, Homo sapiens
uaaaacuguaacuuuguccug

SEQ ID NO: 182485 - RNA, 22 nt, Homo sapiens
uaaaccacguuuacauuugaga

SEQ ID NO: 182486 - RNA, 22 nt, Homo sapiens
uaacauugcuggacuaccugcu

SEQ ID NO: 182487 - RNA, 22 nt, Homo sapiens
uaagaauucuguccgguauacu

SEQ ID NO: 182488 - RNA, 23 nt, Homo sapiens
uaagacacuaacuuuaugcuuug

SEQ ID NO: 182489 - RNA, 22 nt, Homo sapiens
uaagacacuuaaaauguuacau

SEQ ID NO: 182490 - RNA, 22 nt, Homo sapiens
uaagacuguguaauuuaugaag

SEQ ID NO: 182491 - RNA, 22 nt, Homo sapiens
uaaggcacuacuuuaggcuuuc

SEQ ID NO: 182492 - RNA, 22 nt, Homo sapiens
uaaggcuuugcuggacucaguc

SEQ ID NO: 182493 - RNA, 22 nt, Homo sapiens
uaagguguagacuggucacaag

SEQ ID NO: 182494 - RNA, 22 nt, Homo sapiens
uaaguauuaugugcugcauuuu

SEQ ID NO: 182495 - RNA, 22 nt, Homo sapiens
uaagucacuccagguuaaagug

SEQ ID NO: 182496 - RNA, 22 nt, Homo sapiens
uacaaaguaacaguuccuguau

SEQ ID NO: 182497 - RNA, 16 nt, Homo sapiens
uacaacagugaguaug

SEQ ID NO: 182498 - RNA, 22 nt, Homo sapiens
uacagaauauuucugcccugag

SEQ ID NO: 182499 - RNA, 22 nt, Homo sapiens
uacagaauugcagguguggcag

SEQ ID NO: 182500 - RNA, 22 nt, Homo sapiens
uacagaucaguuauuuuguaga

SEQ ID NO: 182501 - RNA, 22 nt, Homo sapiens
uacagcacaggugcagguguug

SEQ ID NO: 182502 - RNA, 22 nt, Homo sapiens
uacagccacauaauguaugauu

SEQ ID NO: 182503 - RNA, 22 nt, Homo sapiens
uacaguaauguuaaucuuugug

SEQ ID NO: 182504 - RNA, 22 nt, Homo sapiens
uacucugcaguaauuccagccc

SEQ ID NO: 182505 - RNA, 22 nt, Homo sapiens
uacugcaguugcagcuugagga

SEQ ID NO: 182506 - RNA, 22 nt, Homo sapiens
uacugcaucgaaaugcuuuuau

SEQ ID NO: 182507 - RNA, 22 nt, Homo sapiens
uacugcauuucacuguuaaaga

SEQ ID NO: 182508 - RNA, 22 nt, Homo sapiens
uagaagcacuaucccuccuagu

SEQ ID NO: 182509 - RNA, 22 nt, Homo sapiens
uagaaugaaacaagcugugccu

SEQ ID NO: 182510 - RNA, 22 nt, Homo sapiens
uagaauggaaggcauguuugcc

SEQ ID NO: 182511 - RNA, 22 nt, Homo sapiens
uagaauguaaauuccaagggca

SEQ ID NO: 182512 - RNA, 22 nt, Homo sapiens
uagagcuaguuuuuaaucuaac

SEQ ID NO: 182513 - RNA, 22 nt, Homo sapiens
uagcaaaucaauggaauugaag

SEQ ID NO: 182514 - RNA, 22 nt, Homo sapiens
uagcagcuuuauugagguaaau

SEQ ID NO: 182515 - RNA, 22 nt, Homo sapiens
uagcaguaccccaguauccugg

SEQ ID NO: 182516 - RNA, 22 nt, Homo sapiens
uagcaucaauucauguuaugau

SEQ ID NO: 182517 - RNA, 22 nt, Homo sapiens
uaggauaguccuccugagaccu

SEQ ID NO: 182518 - RNA, 22 nt, Homo sapiens
uagguuguccaucucuagaagc

SEQ ID NO: 182519 - RNA, 22 nt, Homo sapiens
uagguugucuguucacucugau

SEQ ID NO: 182520 - RNA, 22 nt, Homo sapiens
uagucaaaucugaaggaaauuu

SEQ ID NO: 182521 - RNA, 22 nt, Homo sapiens
uagugcuguaauucuaaugaaa

SEQ ID NO: 182522 - RNA, 22 nt, Homo sapiens
uaucacagcauugucuauaaua

SEQ ID NO: 182523 - RNA, 22 nt, Homo sapiens
uaucaguauggauucauggauu

SEQ ID NO: 182524 - RNA, 22 nt, Homo sapiens
uaugaagccaggauuuauuauu

SEQ ID NO: 182525 - RNA, 22 nt, Homo sapiens
uaugcacaugugccugggugug

SEQ ID NO: 182526 - RNA, 22 nt, Homo sapiens
uaugcacuaggcacuguguuug

SEQ ID NO: 182527 - RNA, 22 nt, Homo sapiens
uauucacuguaucauugauggg

SEQ ID NO: 182528 - RNA, 22 nt, Homo sapiens
uauuugguuauaugaguaaguu

SEQ ID NO: 182529 - RNA, 22 nt, Homo sapiens
ucaaaugaucugcccgccuugg

SEQ ID NO: 182530 - RNA, 22 nt, Homo sapiens
ucaaaugauucagaagccaccu

SEQ ID NO: 182531 - RNA, 22 nt, Homo sapiens
ucaaaugguccacgugaacauu

SEQ ID NO: 182532 - RNA, 22 nt, Homo sapiens
ucaagcaauucugcugccucag

SEQ ID NO: 182533 - RNA, 19 nt, Homo sapiens
ucaagcuauucuccugccu

SEQ ID NO: 182534 - RNA, 18 nt, Homo sapiens
ucaagcuauugucaugcc

SEQ ID NO: 182535 - RNA, 22 nt, Homo sapiens
ucacaguauucaugaacaugga

SEQ ID NO: 182536 - RNA, 17 nt, Homo sapiens
ucacaguguuaggauga

SEQ ID NO: 182537 - RNA, 22 nt, Homo sapiens
ucacaguucagcauggcugagg

SEQ ID NO: 182538 - RNA, 22 nt, Homo sapiens
ucacaugugacauauauauuug

SEQ ID NO: 182539 - RNA, 22 nt, Homo sapiens
ucacauguguaugagcuuugau

SEQ ID NO: 182540 - RNA, 22 nt, Homo sapiens
ucaccuggagagcuugcuaaua

SEQ ID NO: 182541 - RNA, 22 nt, Homo sapiens
ucaccuggagccuucacauucu

SEQ ID NO: 182542 - RNA, 22 nt, Homo sapiens
ucaccuggggaucuuguuuaca

SEQ ID NO: 182543 - RNA, 18 nt, Homo sapiens
ucaccuugugagagagag

SEQ ID NO: 182544 - RNA, 22 nt, Homo sapiens
ucagcagucacuccuaugacaa

SEQ ID NO: 182545 - RNA, 22 nt, Homo sapiens
ucagcagugccccacucuacug

SEQ ID NO: 182546 - RNA, 22 nt, Homo sapiens
ucagcaucacaggcagugagug

SEQ ID NO: 182547 - RNA, 22 nt, Homo sapiens
ucaggugcagagaagaaauggg

SEQ ID NO: 182548 - RNA, 22 nt, Homo sapiens
ucaguaaauguuaggacauuuc

SEQ ID NO: 182549 - RNA, 22 nt, Homo sapiens
cuucuguuaguucugauaacuu

SEQ ID NO: 182550 - RNA, 22 nt, Homo sapiens
cuugcacucagaagauucaguu

SEQ ID NO: 182551 - RNA, 22 nt, Homo sapiens
cuugcagagucauucuaauuuc

SEQ ID NO: 182552 - RNA, 22 nt, Homo sapiens
cuuuccauuguuggagcauaaa

SEQ ID NO: 182553 - RNA, 22 nt, Homo sapiens
cuuucugaggagaauagagaac

SEQ ID NO: 182554 - RNA, 22 nt, Homo sapiens
cuuugcaaaacauugagaccuc

SEQ ID NO: 182555 - RNA, 22 nt, Homo sapiens
cuuuuggcuuagaauugucuug

SEQ ID NO: 182556 - RNA, 22 nt, Homo sapiens
gaaagacuuucugcuguggaua

SEQ ID NO: 182557 - RNA, 22 nt, Homo sapiens
gaaaguaauuaacgauuguugc

SEQ ID NO: 182558 - RNA, 22 nt, Homo sapiens
gaagaacuaggugagaucuaga

SEQ ID NO: 182559 - RNA, 22 nt, Homo sapiens
gaagugcaguggcacagucaug

SEQ ID NO: 182560 - RNA, 22 nt, Homo sapiens
gaauagugcugcaguaaacaua

SEQ ID NO: 182561 - RNA, 22 nt, Homo sapiens
gaauguuuacuuuguuuaauac

SEQ ID NO: 182562 - RNA, 18 nt, Homo sapiens
gacagugugaagauuccu

SEQ ID NO: 182563 - RNA, 22 nt, Homo sapiens
gacauguuucucucuguuuacu

SEQ ID NO: 182564 - RNA, 22 nt, Homo sapiens
gacauguuuuuuaagguuuaug

SEQ ID NO: 182565 - RNA, 22 nt, Homo sapiens
gaccacauuccacacaggcuuu

SEQ ID NO: 182566 - RNA, 22 nt, Homo sapiens
gagaacagagauaauuuuacuu

SEQ ID NO: 182567 - RNA, 22 nt, Homo sapiens
gagacugaguuuugcucuuguu

SEQ ID NO: 182568 - RNA, 22 nt, Homo sapiens
gagagcuaggccacuggggcuu

SEQ ID NO: 182569 - RNA, 22 nt, Homo sapiens
gagagugugucagaggcugcga

SEQ ID NO: 182570 - RNA, 22 nt, Homo sapiens
gagauauuauuucccuuucaca

SEQ ID NO: 182571 - RNA, 22 nt, Homo sapiens
gagauuaauacacaucaaaugc

SEQ ID NO: 182572 - RNA, 22 nt, Homo sapiens
gagauucaucuagguccagaga

SEQ ID NO: 182573 - RNA, 22 nt, Homo sapiens
gagauucuucaauauuuauucu

SEQ ID NO: 182574 - RNA, 20 nt, Homo sapiens
gagcucaucuucuuuaccac

SEQ ID NO: 182575 - RNA, 22 nt, Homo sapiens
gagcuguuuuucacuagaccaa

SEQ ID NO: 182576 - RNA, 22 nt, Homo sapiens
gagcuuggguuaaaguugccuu

SEQ ID NO: 182577 - RNA, 22 nt, Homo sapiens
gaggcaagaguaguuaaguuag

SEQ ID NO: 182578 - RNA, 22 nt, Homo sapiens
gaggcaaugugcccggcccaca

SEQ ID NO: 182579 - RNA, 22 nt, Homo sapiens
gaggcauuauucccaucuuaca

SEQ ID NO: 182580 - RNA, 22 nt, Homo sapiens
gagggcacugcuuuccuuucaa

SEQ ID NO: 182581 - RNA, 22 nt, Homo sapiens
gagguauagaacaccuuucaag

SEQ ID NO: 182582 - RNA, 22 nt, Homo sapiens
gagguguagucaugccaagauc

SEQ ID NO: 182583 - RNA, 22 nt, Homo sapiens
gaguaacauugacaacuucaug

SEQ ID NO: 182584 - RNA, 22 nt, Homo sapiens
gagugcaauggcaugaucuugg

SEQ ID NO: 182585 - RNA, 22 nt, Homo sapiens
gagugcaauggugccaucucgg

SEQ ID NO: 182586 - RNA, 22 nt, Homo sapiens
gaguucaaaucucagcucuguu

SEQ ID NO: 182587 - RNA, 22 nt, Homo sapiens
gauacaguaugcaugugguauu

SEQ ID NO: 182588 - RNA, 22 nt, Homo sapiens
gauuagaacagaagucagauua

SEQ ID NO: 182589 - RNA, 22 nt, Homo sapiens
gauuccacuuacuuagcauucc

SEQ ID NO: 182590 - RNA, 22 nt, Homo sapiens
gcaaaaaguagugcugguuagg

SEQ ID NO: 182591 - RNA, 21 nt, Homo sapiens
gcaaaggaauugccuaagcuu

SEQ ID NO: 182592 - RNA, 21 nt, Homo sapiens
gcaaaguggcuaccuugcucc

SEQ ID NO: 182593 - RNA, 22 nt, Homo sapiens
gcaaaugcuacaccauuuugua

SEQ ID NO: 182594 - RNA, 22 nt, Homo sapiens
gcacagaugaggagaggucuca

SEQ ID NO: 182595 - RNA, 22 nt, Homo sapiens
gcacauauguaaauagcugccu

SEQ ID NO: 182596 - RNA, 22 nt, Homo sapiens
gcagcaucaaaucacacaagau

SEQ ID NO: 182597 - RNA, 22 nt, Homo sapiens
gccauggugucuuauuuuugug

SEQ ID NO: 182598 - RNA, 22 nt, Homo sapiens
gcccuguugcccaggcuggagu

SEQ ID NO: 182599 - RNA, 22 nt, Homo sapiens
gcugagguucaagaagguuaaa

SEQ ID NO: 182600 - RNA, 22 nt, Homo sapiens
gcugauguuggccucugggcuu

SEQ ID NO: 182601 - RNA, 17 nt, Homo sapiens
gcugauguuugcauuuu

SEQ ID NO: 182602 - RNA, 17 nt, Homo sapiens
gcugcauucauguagaa

SEQ ID NO: 182603 - RNA, 22 nt, Homo sapiens
gcugcuguuuaguuucuccugg

SEQ ID NO: 182604 - RNA, 22 nt, Homo sapiens
gcuggguucagagugggcugcg

SEQ ID NO: 182605 - RNA, 22 nt, Homo sapiens
gcuguaguugaggauuuuaaga

SEQ ID NO: 182606 - RNA, 23 nt, Homo sapiens
ggaaacauccagucuuucaccau

SEQ ID NO: 182607 - RNA, 22 nt, Homo sapiens
ggaaagacuauuguaaaggaug

SEQ ID NO: 182608 - RNA, 22 nt, Homo sapiens
ggaagacuuagaguagcaucag

SEQ ID NO: 182609 - RNA, 22 nt, Homo sapiens
ggaaucugaaccaugggaaugg

SEQ ID NO: 182610 - RNA, 22 nt, Homo sapiens
ggacagugaaugccacuccucc

SEQ ID NO: 182611 - RNA, 22 nt, Homo sapiens
ggagaauguaauugguauuuug

SEQ ID NO: 182612 - RNA, 16 nt, Homo sapiens
ggaggucaucugggaa

SEQ ID NO: 182613 - RNA, 22 nt, Homo sapiens
ggagugucugugcuggucaaag

SEQ ID NO: 182614 - RNA, 22 nt, Homo sapiens
ggcaaauucuuguaugccuacu

SEQ ID NO: 182615 - RNA, 22 nt, Homo sapiens
ggcaagaaagaaaucaucuguc

SEQ ID NO: 182616 - RNA, 19 nt, Homo sapiens
ggcaauacuuucuuguugg

SEQ ID NO: 182617 - RNA, 22 nt, Homo sapiens
ggcagcuguguccuucguaagg

SEQ ID NO: 182618 - RNA, 17 nt, Homo sapiens
ggcaggaauuaauguca

SEQ ID NO: 182619 - RNA, 17 nt, Homo sapiens
ggcaggauccaggaucc

SEQ ID NO: 182620 - RNA, 22 nt, Homo sapiens
ggcaugguggugugugccuaua

SEQ ID NO: 182621 - RNA, 22 nt, Homo sapiens
ggccagaugcgguggcucacac

SEQ ID NO: 182622 - RNA, 22 nt, Homo sapiens
gggaaauguaaagucauaagau

SEQ ID NO: 182623 - RNA, 23 nt, Homo sapiens
gggauuguaaaauaugagggcag

SEQ ID NO: 182624 - RNA, 22 nt, Homo sapiens
gggcauugugggcagagggcag

SEQ ID NO: 182625 - RNA, 22 nt, Homo sapiens
ggugagaaagggauuccuguuc

SEQ ID NO: 182626 - RNA, 22 nt, Homo sapiens
guaaucucagcuacuugggagc

SEQ ID NO: 182627 - RNA, 22 nt, Homo sapiens
guacaguuuagugcuuugagaa

SEQ ID NO: 182628 - RNA, 22 nt, Homo sapiens
guacaguuuucaguguucacug

SEQ ID NO: 182629 - RNA, 22 nt, Homo sapiens
guacauguaugcaugcaugcau

SEQ ID NO: 182630 - RNA, 22 nt, Homo sapiens
guaguuuaucagaaagaauagg

SEQ ID NO: 182631 - RNA, 22 nt, Homo sapiens
gucagaaucucagaugacaacg

SEQ ID NO: 182632 - RNA, 22 nt, Homo sapiens
gucagugugauaucugcagggg

SEQ ID NO: 182633 - RNA, 22 nt, Homo sapiens
guccagagaagucauuacuuca

SEQ ID NO: 182634 - RNA, 22 nt, Homo sapiens
gucuagaacuucugaccuuagg

SEQ ID NO: 182635 - RNA, 22 nt, Homo sapiens
gucuggcuccuucuacuacaug

SEQ ID NO: 182636 - RNA, 22 nt, Homo sapiens
gucuguuuggggaccuguggcc

SEQ ID NO: 182637 - RNA, 22 nt, Homo sapiens
gugaaguuuuugugaggccuaa

SEQ ID NO: 182638 - RNA, 22 nt, Homo sapiens
gugacuacaggccacaguuugg

SEQ ID NO: 182639 - RNA, 22 nt, Homo sapiens
gugagagaaugacuauguguuu

SEQ ID NO: 182640 - RNA, 16 nt, Homo sapiens
gugagagaugacaaac

SEQ ID NO: 182641 - RNA, 22 nt, Homo sapiens
gugagaggaggcagcuuuuaca

SEQ ID NO: 182642 - RNA, 22 nt, Homo sapiens
gugagguaauuagcucccuuag

SEQ ID NO: 182643 - RNA, 20 nt, Homo sapiens
ucauacuguggaguaccagg

SEQ ID NO: 182644 - RNA, 22 nt, Homo sapiens
ucauaugucauaguaugaucuu

SEQ ID NO: 182645 - RNA, 20 nt, Homo sapiens
ucaucaguuggugcucgcug

SEQ ID NO: 182646 - RNA, 22 nt, Homo sapiens
ucauuagagaucuuggggaaaa

SEQ ID NO: 182647 - RNA, 22 nt, Homo sapiens
ucauugcaaucucugccucccg

SEQ ID NO: 182648 - RNA, 22 nt, Homo sapiens
uccaaaucucuggcacugggau

SEQ ID NO: 182649 - RNA, 22 nt, Homo sapiens
uccagaguggugaugcuggggc

SEQ ID NO: 182650 - RNA, 22 nt, Homo sapiens
ucccacugucuucucgugcucg

SEQ ID NO: 182651 - RNA, 22 nt, Homo sapiens
ucccagugcuaugcaaaagccu

SEQ ID NO: 182652 - RNA, 22 nt, Homo sapiens
ucccaguggucuugaaacaggg

SEQ ID NO: 182653 - RNA, 22 nt, Homo sapiens
ucccaguguguagcuugucucu

SEQ ID NO: 182654 - RNA, 18 nt, Homo sapiens
ucccucagaauuauagaa

SEQ ID NO: 182655 - RNA, 22 nt, Homo sapiens
uccugagacugaggagcuuugg

SEQ ID NO: 182656 - RNA, 22 nt, Homo sapiens
uccuguaaucccagcuaccaga

SEQ ID NO: 182657 - RNA, 22 nt, Homo sapiens
uccuugguugauccugugcaga

SEQ ID NO: 182658 - RNA, 20 nt, Homo sapiens
ucucccaaacagcaggcccu

SEQ ID NO: 182659 - RNA, 22 nt, Homo sapiens
ucucccuaccugagccgagcca

SEQ ID NO: 182660 - RNA, 22 nt, Homo sapiens
ucugagcaauagauguggauau

SEQ ID NO: 182661 - RNA, 22 nt, Homo sapiens
ucugaguggcagaaugagcuga

SEQ ID NO: 182662 - RNA, 22 nt, Homo sapiens
ucuggguuuuguaccgugcucg

SEQ ID NO: 182663 - RNA, 22 nt, Homo sapiens
ucugucaaaucuuauguuguag

SEQ ID NO: 182664 - RNA, 22 nt, Homo sapiens
ucugugaaugaacacuugaaaa

SEQ ID NO: 182665 - RNA, 22 nt, Homo sapiens
ucugugcauuguaacaacuaaa

SEQ ID NO: 182666 - RNA, 22 nt, Homo sapiens
ucuguuguuaucauaauauuga

SEQ ID NO: 182667 - RNA, 22 nt, Homo sapiens
ucuugcuuuugcagagcuucuc

SEQ ID NO: 182668 - RNA, 22 nt, Homo sapiens
ucuuggguuugccuugcugcug

SEQ ID NO: 182669 - RNA, 22 nt, Homo sapiens
ucuuuguguucaggagccacgu

SEQ ID NO: 182670 - RNA, 22 nt, Homo sapiens
ugaaagguauagguucuggagg

SEQ ID NO: 182671 - RNA, 22 nt, Homo sapiens
ugaagagucuaaaucugucuuc

SEQ ID NO: 182672 - RNA, 22 nt, Homo sapiens
ugaaggaguauggauaagucgu

SEQ ID NO: 182673 - RNA, 22 nt, Homo sapiens
ugaagugaagacucacagaagg

SEQ ID NO: 182674 - RNA, 22 nt, Homo sapiens
ugaauagacacuaaagacugua

SEQ ID NO: 182675 - RNA, 20 nt, Homo sapiens
ugaauguaauuacagaugua

SEQ ID NO: 182676 - RNA, 23 nt, Homo sapiens
ugaauguaucgaaugugggaaag

SEQ ID NO: 182677 - RNA, 22 nt, Homo sapiens
ugaauucaucucacagaguuaa

SEQ ID NO: 182678 - RNA, 22 nt, Homo sapiens
ugacaagaaagcgucuucuuuu

SEQ ID NO: 182679 - RNA, 20 nt, Homo sapiens
ugacaaggugcaaagaauca

SEQ ID NO: 182680 - RNA, 17 nt, Homo sapiens
ugacagaaacuuguugu

SEQ ID NO: 182681 - RNA, 22 nt, Homo sapiens
ugacagcuguugaggcauuuau

SEQ ID NO: 182682 - RNA, 22 nt, Homo sapiens
ugacaggucuaauuuacugaca

SEQ ID NO: 182683 - RNA, 22 nt, Homo sapiens
ugacauggugcucuuucaggca

SEQ ID NO: 182684 - RNA, 22 nt, Homo sapiens
ugacuauaggauaacaugcauu

SEQ ID NO: 182685 - RNA, 22 nt, Homo sapiens
ugacuucagacugaaaugauuc

SEQ ID NO: 182686 - RNA, 18 nt, Homo sapiens
ugagaacauguguacaca

SEQ ID NO: 182687 - RNA, 22 nt, Homo sapiens
ugagacacuucccagaucccuu

SEQ ID NO: 182688 - RNA, 22 nt, Homo sapiens
ugagacugagucuugcucuauu

SEQ ID NO: 182689 - RNA, 22 nt, Homo sapiens
ugagacugaguuuugcucguug

SEQ ID NO: 182690 - RNA, 22 nt, Homo sapiens
ugagagcuuuuuugccugguga

SEQ ID NO: 182691 - RNA, 18 nt, Homo sapiens
ugagaucagcaucaaggg

SEQ ID NO: 182692 - RNA, 22 nt, Homo sapiens
ugagaugaagucuugcucuguu

SEQ ID NO: 182693 - RNA, 22 nt, Homo sapiens
ugagaugaguugcuggcucuga

SEQ ID NO: 182694 - RNA, 22 nt, Homo sapiens
ugagaugauaucuuauuguaau

SEQ ID NO: 182695 - RNA, 22 nt, Homo sapiens
ugagcaagaucuuuauaauuag

SEQ ID NO: 182696 - RNA, 22 nt, Homo sapiens
ugagcagaaagcugcaaggucg

SEQ ID NO: 182697 - RNA, 22 nt, Homo sapiens
ugagcugagaaaugcagcagcu

SEQ ID NO: 182698 - RNA, 22 nt, Homo sapiens
ugaggauaguguugaaggcagg

SEQ ID NO: 182699 - RNA, 22 nt, Homo sapiens
ugagguaacaaacuaugaguua

SEQ ID NO: 182700 - RNA, 22 nt, Homo sapiens
ugaggugaaguaauauucuaag

SEQ ID NO: 182701 - RNA, 22 nt, Homo sapiens
ugagguuggguaauuuaugaag

SEQ ID NO: 182702 - RNA, 22 nt, Homo sapiens
ugagguugucagugucauucuu

SEQ ID NO: 182703 - RNA, 22 nt, Homo sapiens
ugagugaaagaagcacuaagga

SEQ ID NO: 182704 - RNA, 22 nt, Homo sapiens
ugagugaaugugaaggcuaggg

SEQ ID NO: 182705 - RNA, 22 nt, Homo sapiens
ugagugagguucuacucuguga

SEQ ID NO: 182706 - RNA, 22 nt, Homo sapiens
ugauagaucugggcaaaguaaa

SEQ ID NO: 182707 - RNA, 22 nt, Homo sapiens
ugauauguguaaacaauguaua

SEQ ID NO: 182708 - RNA, 22 nt, Homo sapiens
ugauauuuuugauccuuaaguu

SEQ ID NO: 182709 - RNA, 22 nt, Homo sapiens
ugaucucagcucacugguugaa

SEQ ID NO: 182710 - RNA, 22 nt, Homo sapiens
ugaugcugaugccugccagaag

SEQ ID NO: 182711 - RNA, 23 nt, Homo sapiens
ugauguccacuuagggucuaggu

SEQ ID NO: 182712 - RNA, 22 nt, Homo sapiens
ugauguugaauuguucagcguc

SEQ ID NO: 182713 - RNA, 22 nt, Homo sapiens
ugauugcacaccugcacucaag

SEQ ID NO: 182714 - RNA, 22 nt, Homo sapiens
ugauuuguuucaggaguuuucu

SEQ ID NO: 182715 - RNA, 22 nt, Homo sapiens
ugcaaaguccucauucuuaccc

SEQ ID NO: 182716 - RNA, 22 nt, Homo sapiens
ugcaaauuauugggccccaacu

SEQ ID NO: 182717 - RNA, 20 nt, Homo sapiens
ugcagcacugggaaugcagu

SEQ ID NO: 182718 - RNA, 22 nt, Homo sapiens
ugccaucauuaauauuaggcau

SEQ ID NO: 182719 - RNA, 22 nt, Homo sapiens
ugccuuauuccaacugagcucu

SEQ ID NO: 182720 - RNA, 22 nt, Homo sapiens
ugcuaugucuucucucacagag

SEQ ID NO: 182721 - RNA, 22 nt, Homo sapiens
ugcucaccugcugcucaccucc

SEQ ID NO: 182722 - RNA, 20 nt, Homo sapiens
ugcugcacuuaagcaugggc

SEQ ID NO: 182723 - RNA, 22 nt, Homo sapiens
ugcugcauuggggauuaaguuu

SEQ ID NO: 182724 - RNA, 22 nt, Homo sapiens
uggaaaguccaagccaaccggg

SEQ ID NO: 182725 - RNA, 22 nt, Homo sapiens
uggaaucuagagaaaugcaaac

SEQ ID NO: 182726 - RNA, 21 nt, Homo sapiens
uggaaucuauagaggcaguag

SEQ ID NO: 182727 - RNA, 22 nt, Homo sapiens
uggaauggagagagggugcacg

SEQ ID NO: 182728 - RNA, 21 nt, Homo sapiens
uggaauuaauggagagguguu

SEQ ID NO: 182729 - RNA, 22 nt, Homo sapiens
uggacagagagaccggcauuuu

SEQ ID NO: 182730 - RNA, 22 nt, Homo sapiens
uggacuguaaauuggggacucu

SEQ ID NO: 182731 - RNA, 22 nt, Homo sapiens
uggacuguaauagagaacagaa

SEQ ID NO: 182732 - RNA, 22 nt, Homo sapiens
uggacuguaauuuuauaggcau

SEQ ID NO: 182733 - RNA, 22 nt, Homo sapiens
uggagcccuaaacuucuaauau

SEQ ID NO: 182734 - RNA, 22 nt, Homo sapiens
uggagggcuagucauuucuuuu

SEQ ID NO: 182735 - RNA, 20 nt, Homo sapiens
uggaguuugaguucuuggag

SEQ ID NO: 182736 - RNA, 22 nt, Homo sapiens
uggauaguuuacugaagagugg

SEQ ID NO: 182737 - RNA, 22 nt, Homo sapiens
uuguuauguuggucaguaaugu

SEQ ID NO: 182738 - RNA, 17 nt, Homo sapiens
uuguucccauuaaaaag

SEQ ID NO: 182739 - RNA, 22 nt, Homo sapiens
uuguuuuggagaugagcuaaaa

SEQ ID NO: 182740 - RNA, 22 nt, Homo sapiens
uuuaaagcuaaaauauguuuau

SEQ ID NO: 182741 - RNA, 22 nt, Homo sapiens
uuuaugcuacauguguuggaaa

SEQ ID NO: 182742 - RNA, 22 nt, Homo sapiens
uuucaacuaauuuuuuggugag

SEQ ID NO: 182743 - RNA, 22 nt, Homo sapiens
uuucacagagggcuucuuucua

SEQ ID NO: 182744 - RNA, 22 nt, Homo sapiens
uuucacuagccagcccuuuauu

SEQ ID NO: 182745 - RNA, 22 nt, Homo sapiens
uuucagagucaucugcccaagu

SEQ ID NO: 182746 - RNA, 22 nt, Homo sapiens
uuucaucaagcacagaguagau

SEQ ID NO: 182747 - RNA, 22 nt, Homo sapiens
uuucccuuacuuaaacuuacuc

SEQ ID NO: 182748 - RNA, 22 nt, Homo sapiens
uuuccuguagggggcaaggccu

SEQ ID NO: 182749 - RNA, 22 nt, Homo sapiens
uuucucaguguuucaggguagg

SEQ ID NO: 182750 - RNA, 21 nt, Homo sapiens
uuugcacuuugcaaaucccua

SEQ ID NO: 182751 - RNA, 22 nt, Homo sapiens
uuugcagagacuuguuaggaau

SEQ ID NO: 182752 - RNA, 22 nt, Homo sapiens
uuugcaguguaguuggccagca

SEQ ID NO: 182753 - RNA, 23 nt, Homo sapiens
uuugccacuuauuagcugggagg

SEQ ID NO: 182754 - RNA, 22 nt, Homo sapiens
uuugcuugaggucuagcuaccc

SEQ ID NO: 182755 - RNA, 22 nt, Homo sapiens
uuugcuuguguaaaaaucugga

SEQ ID NO: 182756 - RNA, 22 nt, Homo sapiens
uuuggcuuuuguaauaacugcc

SEQ ID NO: 182757 - RNA, 19 nt, Homo sapiens
uuuuccccuuucuuaagac

SEQ ID NO: 182758 - RNA, 22 nt, Homo sapiens
uuuugcaauauguuccugaaua

SEQ ID NO: 182759 - RNA, 23 nt, Homo sapiens
ucaguacuccacuuucaauagug

SEQ ID NO: 182760 - RNA, 22 nt, Homo sapiens
ucagugucaucuggguuguuug

SEQ ID NO: 182761 - RNA, 22 nt, Homo sapiens
ucauacgucuccuugugccacc

SEQ ID NO: 182762 - RNA, 21 nt, Homo sapiens
ucaucagucaaagacaauggu

SEQ ID NO: 182763 - RNA, 22 nt, Homo sapiens
ucauggcacugaugagaguuuc

SEQ ID NO: 182764 - RNA, 22 nt, Homo sapiens
ucauguaauuuugugucuauga

SEQ ID NO: 182765 - RNA, 22 nt, Homo sapiens
uccacaguggugaggugcagca

SEQ ID NO: 182766 - RNA, 22 nt, Homo sapiens
ucccagugaaaccccaccuuca

SEQ ID NO: 182767 - RNA, 22 nt, Homo sapiens
ucccuagagaagugauuuuuga

SEQ ID NO: 182768 - RNA, 18 nt, Homo sapiens
ucccuuuguagaugaccc

SEQ ID NO: 182769 - RNA, 22 nt, Homo sapiens
uccuugaaacaggaagaauuca

SEQ ID NO: 182770 - RNA, 22 nt, Homo sapiens
ucucaaguggucgcaguuagau

SEQ ID NO: 182771 - RNA, 20 nt, Homo sapiens
ucucauggagguagagaaua

SEQ ID NO: 182772 - RNA, 22 nt, Homo sapiens
ucucccauccaugaacuucugu

SEQ ID NO: 182773 - RNA, 17 nt, Homo sapiens
ucucccaucccuuucuc

SEQ ID NO: 182774 - RNA, 22 nt, Homo sapiens
ucugagcaauaaacaacauauu

SEQ ID NO: 182775 - RNA, 22 nt, Homo sapiens
ucugagguaggugcauggauac

SEQ ID NO: 182776 - RNA, 21 nt, Homo sapiens
ucugagucauucaguggccug

SEQ ID NO: 182777 - RNA, 22 nt, Homo sapiens
ucuggccuacaaguaauuuuau

SEQ ID NO: 182778 - RNA, 22 nt, Homo sapiens
auaggagcacaaacuauuguga

SEQ ID NO: 182779 - RNA, 22 nt, Homo sapiens
auagguauguaauacaaaugaa

SEQ ID NO: 182780 - RNA, 22 nt, Homo sapiens
auagugcugcaaucaacauaca

SEQ ID NO: 182781 - RNA, 22 nt, Homo sapiens
auagugcugcaauuaacauaca

SEQ ID NO: 182782 - RNA, 22 nt, Homo sapiens
auagugcugcacuaaacauaca

SEQ ID NO: 182783 - RNA, 22 nt, Homo sapiens
auagugcuggaauaaauauacg

SEQ ID NO: 182784 - RNA, 22 nt, Homo sapiens
auaugcauacauguaugcagga

SEQ ID NO: 182785 - RNA, 20 nt, Homo sapiens
auaugguugugagugauuuu

SEQ ID NO: 182786 - RNA, 22 nt, Homo sapiens
auauugguuaaauauuauguga

SEQ ID NO: 182787 - RNA, 22 nt, Homo sapiens
aucaaaguaucucaauauggua

SEQ ID NO: 182788 - RNA, 22 nt, Homo sapiens
aucaagcugcuuguuugaaucu

SEQ ID NO: 182789 - RNA, 22 nt, Homo sapiens
aucacagugagcauaugucuau

SEQ ID NO: 182790 - RNA, 19 nt, Homo sapiens
aucaccauuauuuggaaca

SEQ ID NO: 182791 - RNA, 22 nt, Homo sapiens
aucaccuggaguagcccguccc

SEQ ID NO: 182792 - RNA, 22 nt, Homo sapiens
aucagucuguuggaauaucgcu

SEQ ID NO: 182793 - RNA, 23 nt, Homo sapiens
auccacauucuaguccuuuaugc

SEQ ID NO: 182794 - RNA, 22 nt, Homo sapiens
aucccuguguccagcaccugug

SEQ ID NO: 182795 - RNA, 22 nt, Homo sapiens
aucccuuccuagcacuuggugu

SEQ ID NO: 182796 - RNA, 22 nt, Homo sapiens
aucuuuaguggcuguuuucaga

SEQ ID NO: 182797 - RNA, 22 nt, Homo sapiens
aucuuuggugaguucuuugguc

SEQ ID NO: 182798 - RNA, 23 nt, Homo sapiens
augaaagcccuugcaaaugcugg

SEQ ID NO: 182799 - RNA, 22 nt, Homo sapiens
augaaugucuuauuuugagaaa

SEQ ID NO: 182800 - RNA, 22 nt, Homo sapiens
augaccuuggggaaccaugucu

SEQ ID NO: 182801 - RNA, 18 nt, Homo sapiens
augacucuggguguuccu

SEQ ID NO: 182802 - RNA, 22 nt, Homo sapiens
augagagugagagcagccccuu

SEQ ID NO: 182803 - RNA, 22 nt, Homo sapiens
augagauuauguaaagagacca

SEQ ID NO: 182804 - RNA, 22 nt, Homo sapiens
augagauuguuuguacuccaca

SEQ ID NO: 182805 - RNA, 22 nt, Homo sapiens
augagcagaagagauacacugu

SEQ ID NO: 182806 - RNA, 22 nt, Homo sapiens
augaggagauauuaaauaccau

SEQ ID NO: 182807 - RNA, 22 nt, Homo sapiens
augagggcggacgcccuggaga

SEQ ID NO: 182808 - RNA, 22 nt, Homo sapiens
augaggugaguaaauaaaugaa

SEQ ID NO: 182809 - RNA, 22 nt, Homo sapiens
augaggugcagaggaaaugagu

SEQ ID NO: 182810 - RNA, 21 nt, Homo sapiens
augagguguacuguggugaaa

SEQ ID NO: 182811 - RNA, 22 nt, Homo sapiens
augagucacuuauuauuggggu

SEQ ID NO: 182812 - RNA, 22 nt, Homo sapiens
augauaaguuauuagaagaaga

SEQ ID NO: 182813 - RNA, 22 nt, Homo sapiens
augauaugagaaaggaucaaca

SEQ ID NO: 182814 - RNA, 22 nt, Homo sapiens
augauucugaucuagagcuugg

SEQ ID NO: 182815 - RNA, 22 nt, Homo sapiens
augcaaaucuuaaguaugugug

SEQ ID NO: 182816 - RNA, 22 nt, Homo sapiens
augcaauucuagauugauagua

SEQ ID NO: 182817 - RNA, 22 nt, Homo sapiens
augcacauggcuaacuuuuuuc

SEQ ID NO: 182818 - RNA, 22 nt, Homo sapiens
augcacuuggcaggaugauucc

SEQ ID NO: 182819 - RNA, 22 nt, Homo sapiens
augccacugcacuucagccugc

SEQ ID NO: 182820 - RNA, 22 nt, Homo sapiens
augccacuucucuaagucaugu

SEQ ID NO: 182821 - RNA, 19 nt, Homo sapiens
augcugguguugcucaaac

SEQ ID NO: 182822 - RNA, 22 nt, Homo sapiens
auggaaggagaggaaugaauga

SEQ ID NO: 182823 - RNA, 22 nt, Homo sapiens
uggaaaauuaggggagguuaua

SEQ ID NO: 182824 - RNA, 22 nt, Homo sapiens
uggaagguaaguuuugagcauu

SEQ ID NO: 182825 - RNA, 22 nt, Homo sapiens
uggaauacuauucugugcugga

SEQ ID NO: 182826 - RNA, 22 nt, Homo sapiens
uggaaucuuaggugaaggcuuu

SEQ ID NO: 182827 - RNA, 19 nt, Homo sapiens
uggaauggauuuaaaugug

SEQ ID NO: 182828 - RNA, 22 nt, Homo sapiens
uggacuguaagugccuugagua

SEQ ID NO: 182829 - RNA, 22 nt, Homo sapiens
uggagacaaagauagaaaagca

SEQ ID NO: 182830 - RNA, 22 nt, Homo sapiens
uggaggacugcagaacugaggc

SEQ ID NO: 182831 - RNA, 22 nt, Homo sapiens
uggaggucauuggaucaugggg

SEQ ID NO: 182832 - RNA, 22 nt, Homo sapiens
uggagugagaacuucaaugaug

SEQ ID NO: 182833 - RNA, 22 nt, Homo sapiens
uggagugauaugguuauauggg

SEQ ID NO: 182834 - RNA, 22 nt, Homo sapiens
uggaguguaauuagccaucagu

SEQ ID NO: 182835 - RNA, 22 nt, Homo sapiens
uggaugccuaauaaaugcagac

SEQ ID NO: 182836 - RNA, 19 nt, Homo sapiens
uggcacauguauacauaug

SEQ ID NO: 182837 - RNA, 22 nt, Homo sapiens
uggcagauaggauacaggacua

SEQ ID NO: 182838 - RNA, 22 nt, Homo sapiens
uggcuacugaccugcuaggggg

SEQ ID NO: 182839 - RNA, 22 nt, Homo sapiens
uggcuuuuguuauuuggaagcu

SEQ ID NO: 182840 - RNA, 22 nt, Homo sapiens
ugggaucauuaugcauagugua

SEQ ID NO: 182841 - RNA, 23 nt, Homo sapiens
ugggauguuuuuggaaacuucug

SEQ ID NO: 182842 - RNA, 23 nt, Homo sapiens
ugggucaguuuuucugacaucau

SEQ ID NO: 182843 - RNA, 22 nt, Homo sapiens
ugguauguuuauaaguauagga

SEQ ID NO: 182844 - RNA, 22 nt, Homo sapiens
uggucauggggcagcugacacu

SEQ ID NO: 182845 - RNA, 20 nt, Homo sapiens
ugguguuugaacagugaaug

SEQ ID NO: 182846 - RNA, 22 nt, Homo sapiens
uguaacacacacuguuuacucc

SEQ ID NO: 182847 - RNA, 22 nt, Homo sapiens
uguaauggcagacuccggugga

SEQ ID NO: 182848 - RNA, 22 nt, Homo sapiens
uguauguaaagacaggauaaca

SEQ ID NO: 182849 - RNA, 22 nt, Homo sapiens
ugucaugucaacuauggaauuu

SEQ ID NO: 182850 - RNA, 22 nt, Homo sapiens
ugucauguugagaaacuuggau

SEQ ID NO: 182851 - RNA, 22 nt, Homo sapiens
ugucauguuucuacugaccaaa

SEQ ID NO: 182852 - RNA, 22 nt, Homo sapiens
uguccaaauugaaucaucuggu

SEQ ID NO: 182853 - RNA, 22 nt, Homo sapiens
ugucucaguucccuucucugga

SEQ ID NO: 182854 - RNA, 22 nt, Homo sapiens
ugucuguuugcgaaauugcuuc

SEQ ID NO: 182855 - RNA, 19 nt, Homo sapiens
ugugacugggccagccuag

SEQ ID NO: 182856 - RNA, 20 nt, Homo sapiens
ugugauuauuuaguugcaug

SEQ ID NO: 182857 - RNA, 22 nt, Homo sapiens
ugugcacaaugugcagguuugu

SEQ ID NO: 182858 - RNA, 22 nt, Homo sapiens
ugugcacauugugcagguugau

SEQ ID NO: 182859 - RNA, 22 nt, Homo sapiens
ugugggugguaaaauacaauga

SEQ ID NO: 182860 - RNA, 22 nt, Homo sapiens
uguguaaagcuuguuccagaaa

SEQ ID NO: 182861 - RNA, 22 nt, Homo sapiens
uguuaagaugucaauuuuccac

SEQ ID NO: 182862 - RNA, 19 nt, Homo sapiens
uguugcacauaucaauaug

SEQ ID NO: 182863 - RNA, 22 nt, Homo sapiens
uguugcuuaagccacccagucu

SEQ ID NO: 182864 - RNA, 22 nt, Homo sapiens
uguuugcuguuuucuccaauga

SEQ ID NO: 182865 - RNA, 22 nt, Homo sapiens
uguuuguuugagauggagucuc

SEQ ID NO: 182866 - RNA, 22 nt, Homo sapiens
uuaaaggcaugguuagacaugg

SEQ ID NO: 182867 - RNA, 22 nt, Homo sapiens
uuaaaugcauagaauguguagu

SEQ ID NO: 182868 - RNA, 22 nt, Homo sapiens
uuaaggccugaagcucauaaag

SEQ ID NO: 182869 - RNA, 22 nt, Homo sapiens
uuaauguaucuaucacaucaca

SEQ ID NO: 182870 - RNA, 22 nt, Homo sapiens
uuaauuguccaaguucaucucu

SEQ ID NO: 182871 - RNA, 22 nt, Homo sapiens
uuacaagaugucuguccaacac

SEQ ID NO: 182872 - RNA, 22 nt, Homo sapiens
uuacaguauugcaaggacuagg

SEQ ID NO: 182873 - RNA, 22 nt, Homo sapiens
uuaggcuuuauugaaaacaaua

SEQ ID NO: 182874 - RNA, 22 nt, Homo sapiens
uuaguaguuugauaggaauagc

SEQ ID NO: 182875 - RNA, 22 nt, Homo sapiens
uuauucauuaauugcuaagguu

SEQ ID NO: 182876 - RNA, 23 nt, Homo sapiens
uucaaaggaugcuuuauggaauu

SEQ ID NO: 182877 - RNA, 22 nt, Homo sapiens
uucaauuaauauuauacucuca

SEQ ID NO: 182878 - RNA, 22 nt, Homo sapiens
uucacagugugaucuaugggca

SEQ ID NO: 182879 - RNA, 22 nt, Homo sapiens
uucacaguguuucucacgguua

SEQ ID NO: 182880 - RNA, 16 nt, Homo sapiens
uucacauggcagcagg

SEQ ID NO: 182881 - RNA, 22 nt, Homo sapiens
uucacccugguuguagauggac

SEQ ID NO: 182882 - RNA, 22 nt, Homo sapiens
uucacuguaaaaugaagagggu

SEQ ID NO: 182883 - RNA, 22 nt, Homo sapiens
uucagagagggagggauaccua

SEQ ID NO: 182884 - RNA, 22 nt, Homo sapiens
uucagagugguaugaagugaug

SEQ ID NO: 182885 - RNA, 22 nt, Homo sapiens
uucaggcaccauggucauugau

SEQ ID NO: 182886 - RNA, 23 nt, Homo sapiens
uucaucagggauauuggccugaa

SEQ ID NO: 182887 - RNA, 22 nt, Homo sapiens
uuccacaauggcugaacuaguu

SEQ ID NO: 182888 - RNA, 22 nt, Homo sapiens
uuccacaaugguugaacuaauu

SEQ ID NO: 182889 - RNA, 22 nt, Homo sapiens
uuccacaaugguugaacuaguu

SEQ ID NO: 182890 - RNA, 22 nt, Homo sapiens
uuccacaggguugaacuaguuu

SEQ ID NO: 182891 - RNA, 22 nt, Homo sapiens
uuccacuuuuuccuugugcucc

SEQ ID NO: 182892 - RNA, 22 nt, Homo sapiens
uucccagagccugggagugagg

SEQ ID NO: 182893 - RNA, 22 nt, Homo sapiens
uucccagucaaacgaaggacuu

SEQ ID NO: 182894 - RNA, 22 nt, Homo sapiens
uucccagugccaggcacuggga

SEQ ID NO: 182895 - RNA, 22 nt, Homo sapiens
uucccucagaaacacacagccc

SEQ ID NO: 182896 - RNA, 22 nt, Homo sapiens
uucccugugguauagaagccgu

SEQ ID NO: 182897 - RNA, 22 nt, Homo sapiens
uuccuacugcccauuaaaaugg

SEQ ID NO: 182898 - RNA, 22 nt, Homo sapiens
uuccuugugacuaguagugacc

SEQ ID NO: 182899 - RNA, 22 nt, Homo sapiens
uucucaaggagccuucguaacu

SEQ ID NO: 182900 - RNA, 22 nt, Homo sapiens
uucugccaaucaacccacaucc

SEQ ID NO: 182901 - RNA, 23 nt, Homo sapiens
uucugccacugaaaaugccucag

SEQ ID NO: 182902 - RNA, 22 nt, Homo sapiens
uucuggcuuauaaacgugacuu

SEQ ID NO: 182903 - RNA, 22 nt, Homo sapiens
uucuugcugaauugugcccuuc

SEQ ID NO: 182904 - RNA, 22 nt, Homo sapiens
uugaaagaaaggagacugaguu

SEQ ID NO: 182905 - RNA, 22 nt, Homo sapiens
uugaagacuauaugauucuuca

SEQ ID NO: 182906 - RNA, 22 nt, Homo sapiens
uugaagguaauugguuuuauga

SEQ ID NO: 182907 - RNA, 21 nt, Homo sapiens
uugagaagaauuagcucuucc

SEQ ID NO: 182908 - RNA, 22 nt, Homo sapiens
uugagcacaggaguuugagacc

SEQ ID NO: 182909 - RNA, 22 nt, Homo sapiens
uugaggacugagacagaccaag

SEQ ID NO: 182910 - RNA, 22 nt, Homo sapiens
uugaggacugcuaagcauuuga

SEQ ID NO: 182911 - RNA, 22 nt, Homo sapiens
ucaucuggcgaaugugaagagu

SEQ ID NO: 182912 - RNA, 23 nt, Homo sapiens
ucaugaggccauucaaauccauu

SEQ ID NO: 182913 - RNA, 22 nt, Homo sapiens
ucaugggagcccccaucaugag

SEQ ID NO: 182914 - RNA, 22 nt, Homo sapiens
ucauuagagacagggugucacu

SEQ ID NO: 182915 - RNA, 22 nt, Homo sapiens
ucauucacucccuugaaguuag

SEQ ID NO: 182916 - RNA, 19 nt, Homo sapiens
uccaccgcgugcaccucua

SEQ ID NO: 182917 - RNA, 22 nt, Homo sapiens
uccaguuuuguuaacauauggu

SEQ ID NO: 182918 - RNA, 20 nt, Homo sapiens
ucccuaagagccuuuccuuc

SEQ ID NO: 182919 - RNA, 22 nt, Homo sapiens
ucccugagguccuggauuauug

SEQ ID NO: 182920 - RNA, 22 nt, Homo sapiens
ucccugaguaucuaauguguuu

SEQ ID NO: 182921 - RNA, 22 nt, Homo sapiens
ucccugagugauugaaaauaaa

SEQ ID NO: 182922 - RNA, 22 nt, Homo sapiens
uccucaguggauuggauggugc

SEQ ID NO: 182923 - RNA, 22 nt, Homo sapiens
uccuucacucuacaucuuuguu

SEQ ID NO: 182924 - RNA, 22 nt, Homo sapiens
uccuuggucauggaagagacag

SEQ ID NO: 182925 - RNA, 22 nt, Homo sapiens
uccuuugguggagucuuuaggg

SEQ ID NO: 182926 - RNA, 22 nt, Homo sapiens
ucgcagcacgagcaugcaaggu

SEQ ID NO: 182927 - RNA, 17 nt, Homo sapiens
ucuaauaauaugcauuu

SEQ ID NO: 182928 - RNA, 22 nt, Homo sapiens
ucuauugguaggggcugaggca

SEQ ID NO: 182929 - RNA, 22 nt, Homo sapiens
ucuauuugggguaccuguggua

SEQ ID NO: 182930 - RNA, 22 nt, Homo sapiens
ucucaaccucccaaguagcugg

SEQ ID NO: 182931 - RNA, 22 nt, Homo sapiens
ucucaauggguuguagacaaag

SEQ ID NO: 182932 - RNA, 22 nt, Homo sapiens
ucucaauuugauuacauucaua

SEQ ID NO: 182933 - RNA, 22 nt, Homo sapiens
ucucagugacugcugggucccc

SEQ ID NO: 182934 - RNA, 22 nt, Homo sapiens
ucuggccuagaacaauuaauua

SEQ ID NO: 182935 - RNA, 22 nt, Homo sapiens
ucuggguuuuuccauugccggu

SEQ ID NO: 182936 - RNA, 22 nt, Homo sapiens
ucugguguuacugagccuccca

SEQ ID NO: 182937 - RNA, 22 nt, Homo sapiens
ucuguacugccaaguuucuuua

SEQ ID NO: 182938 - RNA, 22 nt, Homo sapiens
ucuguaguuaacagcuucagcu

SEQ ID NO: 182939 - RNA, 22 nt, Homo sapiens
ucugucuuugccuaaguuuguc

SEQ ID NO: 182940 - RNA, 22 nt, Homo sapiens
ucugucuuugucaggaccagag

SEQ ID NO: 182941 - RNA, 19 nt, Homo sapiens
ucugugcuugucccccugu

SEQ ID NO: 182942 - RNA, 22 nt, Homo sapiens
ucuugcacacaguaaguguuuu

SEQ ID NO: 182943 - RNA, 19 nt, Homo sapiens
ucuugcacaugugaacuca

SEQ ID NO: 182944 - RNA, 22 nt, Homo sapiens
ucuugcuuguuguucccuucau

SEQ ID NO: 182945 - RNA, 22 nt, Homo sapiens
ucuuugauuaugcagauggguu

SEQ ID NO: 182946 - RNA, 22 nt, Homo sapiens
ucuuugucuacauccuguuaaa

SEQ ID NO: 182947 - RNA, 22 nt, Homo sapiens
ucuuuguguaggucaaucuggc

SEQ ID NO: 182948 - RNA, 22 nt, Homo sapiens
ugaaacacacagagaagggaga

SEQ ID NO: 182949 - RNA, 22 nt, Homo sapiens
ugaaacauacacucugaugggg

SEQ ID NO: 182950 - RNA, 22 nt, Homo sapiens
ugaaagguuuaauucugugaga

SEQ ID NO: 182951 - RNA, 22 nt, Homo sapiens
ugaaaugauuauaugguguuug

SEQ ID NO: 182952 - RNA, 22 nt, Homo sapiens
ugaacagcuaucuugucagugu

SEQ ID NO: 182953 - RNA, 21 nt, Homo sapiens
ugaauacugcugcucccuuug

SEQ ID NO: 182954 - RNA, 22 nt, Homo sapiens
ugaauguucuuaaaacccuugu

SEQ ID NO: 182955 - RNA, 22 nt, Homo sapiens
ugaauuguuucauucuuuacau

SEQ ID NO: 182956 - RNA, 22 nt, Homo sapiens
ugacagguugauaggugcagca

SEQ ID NO: 182957 - RNA, 23 nt, Homo sapiens
ugacagucucccgauggcuaggc

SEQ ID NO: 182958 - RNA, 22 nt, Homo sapiens
ugacagugaauaagucucuuaa

SEQ ID NO: 182959 - RNA, 22 nt, Homo sapiens
ugacaguguccuccuccugaga

SEQ ID NO: 182960 - RNA, 21 nt, Homo sapiens
ugacauuauuucaugucagua

SEQ ID NO: 182961 - RNA, 22 nt, Homo sapiens
ugacccuguggcagcgucuaag

SEQ ID NO: 182962 - RNA, 22 nt, Homo sapiens
ugagaagaugaacuccuugguc

SEQ ID NO: 182963 - RNA, 22 nt, Homo sapiens
ugagaaugacugggcaugcugc

SEQ ID NO: 182964 - RNA, 22 nt, Homo sapiens
ugagaaugaugauugguaaacc

SEQ ID NO: 182965 - RNA, 22 nt, Homo sapiens
ugagaauguagggcucucccag

SEQ ID NO: 182966 - RNA, 19 nt, Homo sapiens
ugagaauguuaccaggucc

SEQ ID NO: 182967 - RNA, 22 nt, Homo sapiens
ugagacugagucucgcucuugu

SEQ ID NO: 182968 - RNA, 22 nt, Homo sapiens
ugagacugagucuugcucuugu

SEQ ID NO: 182969 - RNA, 22 nt, Homo sapiens
ugagauaaucaugugguuuuug

SEQ ID NO: 182970 - RNA, 22 nt, Homo sapiens
ugagaucagaaggauuucucug

SEQ ID NO: 182971 - RNA, 22 nt, Homo sapiens
ugagaugaacuugauuguuuua

SEQ ID NO: 182972 - RNA, 19 nt, Homo sapiens
ugagaugaagacagggguu

SEQ ID NO: 182973 - RNA, 22 nt, Homo sapiens
ugagaugagggcugcacucaaa

SEQ ID NO: 182974 - RNA, 22 nt, Homo sapiens
ugagaugagucucgcucuguca

SEQ ID NO: 182975 - RNA, 22 nt, Homo sapiens
ugagauggguucugguccccug

SEQ ID NO: 182976 - RNA, 22 nt, Homo sapiens
ugagcacauuuacaucaguucc

SEQ ID NO: 182977 - RNA, 22 nt, Homo sapiens
ugaggaauguguguuaaagaua

SEQ ID NO: 182978 - RNA, 22 nt, Homo sapiens
ugaggacugagaggcacugugg

SEQ ID NO: 182979 - RNA, 22 nt, Homo sapiens
ugaggagugaacuauuucugau

SEQ ID NO: 182980 - RNA, 22 nt, Homo sapiens
ugaggaguguauuucauucgcu

SEQ ID NO: 182981 - RNA, 22 nt, Homo sapiens
ugaggugagggguuaggugcua

SEQ ID NO: 182982 - RNA, 22 nt, Homo sapiens
ugaguaauguugaucuuugaua

SEQ ID NO: 182983 - RNA, 22 nt, Homo sapiens
ugagucagucucacucugcugc

SEQ ID NO: 182984 - RNA, 22 nt, Homo sapiens
ugagucaugcuggagucauggc

SEQ ID NO: 182985 - RNA, 22 nt, Homo sapiens
ugagugaacgcugagaccaaau

SEQ ID NO: 182986 - RNA, 22 nt, Homo sapiens
ugaguuaauuuuuguaucaugu

SEQ ID NO: 182987 - RNA, 22 nt, Homo sapiens
ugauaacauugggggaagcuga

SEQ ID NO: 182988 - RNA, 22 nt, Homo sapiens
ugaucacagcuugacuaaagga

SEQ ID NO: 182989 - RNA, 22 nt, Homo sapiens
ugaugcugaguggcuauuugaa

SEQ ID NO: 182990 - RNA, 19 nt, Homo sapiens
ugcaaauucuaaaaacuga

SEQ ID NO: 182991 - RNA, 20 nt, Homo sapiens
ugcaguguccucacuuguca

SEQ ID NO: 182992 - RNA, 22 nt, Homo sapiens
ugcagugugaaagagccugaca

SEQ ID NO: 182993 - RNA, 21 nt, Homo sapiens
ugcauggagaacacugagggu

SEQ ID NO: 182994 - RNA, 22 nt, Homo sapiens
ugcauuguggaucuaaaugcau

SEQ ID NO: 182995 - RNA, 21 nt, Homo sapiens
ugcauuguugcugagagcagg

SEQ ID NO: 182996 - RNA, 22 nt, Homo sapiens
ugccaacugguuucuuuuaguu

SEQ ID NO: 182997 - RNA, 22 nt, Homo sapiens
ugccaagauuucaggaauuaag

SEQ ID NO: 182998 - RNA, 22 nt, Homo sapiens
ugccuacagaaggggcucagca

SEQ ID NO: 182999 - RNA, 22 nt, Homo sapiens
ugccuaggcuggaaugcagugg

SEQ ID NO: 183000 - RNA, 22 nt, Homo sapiens
ugcuauguccccacccaaaucu

SEQ ID NO: 183001 - RNA, 18 nt, Homo sapiens
ugcuccccugggugagca

SEQ ID NO: 183002 - RNA, 22 nt, Homo sapiens
ugcugguguuuaggaauaagaa

SEQ ID NO: 183003 - RNA, 22 nt, Homo sapiens
ugcuugagacacauaugaauuu

SEQ ID NO: 183004 - RNA, 22 nt, Homo sapiens
auugcacuccagccuggccgag

SEQ ID NO: 183005 - RNA, 22 nt, Homo sapiens
auugcacuccagccugggcagc

SEQ ID NO: 183006 - RNA, 22 nt, Homo sapiens
auugcacuccagccugggggac

SEQ ID NO: 183007 - RNA, 22 nt, Homo sapiens
auugcacuccagccuugacaca

SEQ ID NO: 183008 - RNA, 22 nt, Homo sapiens
auugcacuccagucucaccagg

SEQ ID NO: 183009 - RNA, 22 nt, Homo sapiens
auugcacuccauccugggcaau

SEQ ID NO: 183010 - RNA, 22 nt, Homo sapiens
agcuggucugauacuuaccucc

SEQ ID NO: 183011 - RNA, 21 nt, Homo sapiens
aggaagacuaugaucaauugg

SEQ ID NO: 183012 - RNA, 22 nt, Homo sapiens
aggaagugucuucuuuuaggca

SEQ ID NO: 183013 - RNA, 22 nt, Homo sapiens
aggaaucuaagguaucagguua

SEQ ID NO: 183014 - RNA, 23 nt, Homo sapiens
aggaauggaaaaccaaguaucau

SEQ ID NO: 183015 - RNA, 22 nt, Homo sapiens
aggcaacaugguaaaacccugu

SEQ ID NO: 183016 - RNA, 22 nt, Homo sapiens
aggcagcuguuauauacugagu

SEQ ID NO: 183017 - RNA, 22 nt, Homo sapiens
aggcaugauggcuccagaucau

SEQ ID NO: 183018 - RNA, 22 nt, Homo sapiens
aggcaugguggcacauacaugu

SEQ ID NO: 183019 - RNA, 22 nt, Homo sapiens
aggcugguauuuacaaaagcuc

SEQ ID NO: 183020 - RNA, 22 nt, Homo sapiens
aggcuguguggauaauauuggg

SEQ ID NO: 183021 - RNA, 22 nt, Homo sapiens
agggaagugugcuaugcauuua

SEQ ID NO: 183022 - RNA, 22 nt, Homo sapiens
agggcuuguuuaacuaucauua

SEQ ID NO: 183023 - RNA, 22 nt, Homo sapiens
aggguuuuuauuuauguggcau

SEQ ID NO: 183024 - RNA, 22 nt, Homo sapiens
agucacagugaccuugucugac

SEQ ID NO: 183025 - RNA, 19 nt, Homo sapiens
agugagccaagauccuacc

SEQ ID NO: 183026 - RNA, 22 nt, Homo sapiens
agugauguggaguuuggaugga

SEQ ID NO: 183027 - RNA, 22 nt, Homo sapiens
agugcauuuguucugugucagg

SEQ ID NO: 183028 - RNA, 22 nt, Homo sapiens
aguggauuuuagacugagauuu

SEQ ID NO: 183029 - RNA, 22 nt, Homo sapiens
auaaagcaagucucuggccuca

SEQ ID NO: 183030 - RNA, 22 nt, Homo sapiens
auaaaugcaaugguauuuuuga

SEQ ID NO: 183031 - RNA, 22 nt, Homo sapiens
auacagcuaaaauauuaaguua

SEQ ID NO: 183032 - RNA, 22 nt, Homo sapiens
auacaugugcaggucagguuac

SEQ ID NO: 183033 - RNA, 22 nt, Homo sapiens
auacauguucaagggcauauau

SEQ ID NO: 183034 - RNA, 22 nt, Homo sapiens
auacuagucaagaauguaugag

SEQ ID NO: 183035 - RNA, 22 nt, Homo sapiens
auacuguuuuacaucauugccu

SEQ ID NO: 183036 - RNA, 21 nt, Homo sapiens
auagugcuagagaguagcagg

SEQ ID NO: 183037 - RNA, 22 nt, Homo sapiens
auagugcugcaagaaacauacg

SEQ ID NO: 183038 - RNA, 22 nt, Homo sapiens
auagugcugcaauaaacacacg

SEQ ID NO: 183039 - RNA, 22 nt, Homo sapiens
auagugcugcaauaaacauacg

SEQ ID NO: 183040 - RNA, 22 nt, Homo sapiens
auagugcugcaauaaacauaug

SEQ ID NO: 183041 - RNA, 22 nt, Homo sapiens
auagugcugcaauaaccauggg

SEQ ID NO: 183042 - RNA, 22 nt, Homo sapiens
auagugcugcaaugaacauaca

SEQ ID NO: 183043 - RNA, 22 nt, Homo sapiens
auauguucucauucauaugugg

SEQ ID NO: 183044 - RNA, 22 nt, Homo sapiens
auauuggucuucaagaccugug

SEQ ID NO: 183045 - RNA, 19 nt, Homo sapiens
aucaaacugcucuuugagg

SEQ ID NO: 183046 - RNA, 22 nt, Homo sapiens
aucacaguuauaacauccuuuu

SEQ ID NO: 183047 - RNA, 22 nt, Homo sapiens
aucacaguuuuaccauuuggua

SEQ ID NO: 183048 - RNA, 22 nt, Homo sapiens
aucaccuuucccuuucugaauc

SEQ ID NO: 183049 - RNA, 22 nt, Homo sapiens
aucagaaucucuagugggacca

SEQ ID NO: 183050 - RNA, 22 nt, Homo sapiens
aucagaaucucuugagaguguu

SEQ ID NO: 183051 - RNA, 22 nt, Homo sapiens
auccaucagacggcaggcguug

SEQ ID NO: 183052 - RNA, 22 nt, Homo sapiens
auccauugcucaagagaaguca

SEQ ID NO: 183053 - RNA, 22 nt, Homo sapiens
aucuacuugcugggucucugga

SEQ ID NO: 183054 - RNA, 22 nt, Homo sapiens
aucuagagaggcagucuggccg

SEQ ID NO: 183055 - RNA, 22 nt, Homo sapiens
aucuggcuucuuuuaguccaca

SEQ ID NO: 183056 - RNA, 22 nt, Homo sapiens
aucugguguggcugugauccuc

SEQ ID NO: 183057 - RNA, 22 nt, Homo sapiens
aucuucucuugaagggugggga

SEQ ID NO: 183058 - RNA, 22 nt, Homo sapiens
augaagauguugccuuuuuaau

SEQ ID NO: 183059 - RNA, 20 nt, Homo sapiens
augaagugaaguuagggaac

SEQ ID NO: 183060 - RNA, 22 nt, Homo sapiens
augaagugcaugauaguugguu

SEQ ID NO: 183061 - RNA, 23 nt, Homo sapiens
augaauguaaggaguguaagaaa

SEQ ID NO: 183062 - RNA, 22 nt, Homo sapiens
augacaagagccuucuuuccuu

SEQ ID NO: 183063 - RNA, 22 nt, Homo sapiens
augacacugcagagauguccca

SEQ ID NO: 183064 - RNA, 22 nt, Homo sapiens
augacaguguggauuauuguaa

SEQ ID NO: 183065 - RNA, 19 nt, Homo sapiens
augaccauuuccauaguau

SEQ ID NO: 183066 - RNA, 18 nt, Homo sapiens
augaccugcggguuauau

SEQ ID NO: 183067 - RNA, 17 nt, Homo sapiens
augagcucaucauuuuu

SEQ ID NO: 183068 - RNA, 22 nt, Homo sapiens
augaggagguaugauuuucuga

SEQ ID NO: 183069 - RNA, 22 nt, Homo sapiens
augaggcacugcgcccuacuga

SEQ ID NO: 183070 - RNA, 22 nt, Homo sapiens
augaggugauaucuggaaauua

SEQ ID NO: 183071 - RNA, 22 nt, Homo sapiens
augaucauggaaguuuuccugu

SEQ ID NO: 183072 - RNA, 22 nt, Homo sapiens
augauuguucucacucaagaga

SEQ ID NO: 183073 - RNA, 22 nt, Homo sapiens
augcagagucccagccccuagc

SEQ ID NO: 183074 - RNA, 22 nt, Homo sapiens
augcagaucacauuuuucuguc

SEQ ID NO: 183075 - RNA, 20 nt, Homo sapiens
augccacugagcagugguga

SEQ ID NO: 183076 - RNA, 22 nt, Homo sapiens
augccacuguccuccugccuag

SEQ ID NO: 183077 - RNA, 22 nt, Homo sapiens
augccauugcacuccagccuag

SEQ ID NO: 183078 - RNA, 21 nt, Homo sapiens
auggaaagacugccucuucaa

SEQ ID NO: 183079 - RNA, 22 nt, Homo sapiens
auggaacauuauagauguaaaa

SEQ ID NO: 183080 - RNA, 22 nt, Homo sapiens
auggaaggagaauggucuuuga

SEQ ID NO: 183081 - RNA, 22 nt, Homo sapiens
auggcugagugauuucaaacag

SEQ ID NO: 183082 - RNA, 22 nt, Homo sapiens
auggucuuuuuguuaugagaga

SEQ ID NO: 183083 - RNA, 22 nt, Homo sapiens
augguuugugcuccuauaagaa

SEQ ID NO: 183084 - RNA, 22 nt, Homo sapiens
augucaacauagacaguagagu

SEQ ID NO: 183085 - RNA, 18 nt, Homo sapiens
auguggcuuuugaaggcu

SEQ ID NO: 183086 - RNA, 22 nt, Homo sapiens
augugugaaucccagaaccugu

SEQ ID NO: 183087 - RNA, 22 nt, Homo sapiens
auguugcuugaaggcauuuugu

SEQ ID NO: 183088 - RNA, 22 nt, Homo sapiens
auguuugguaagaauauuguua

SEQ ID NO: 183089 - RNA, 22 nt, Homo sapiens
auuaauguaauuaguaaaguug

SEQ ID NO: 183090 - RNA, 22 nt, Homo sapiens
auuacaugucuauccaugaaca

SEQ ID NO: 183091 - RNA, 22 nt, Homo sapiens
auucacagggggagaaggguau

SEQ ID NO: 183092 - RNA, 22 nt, Homo sapiens
auucacugugcuuggccaaauu

SEQ ID NO: 183093 - RNA, 23 nt, Homo sapiens
auuccaguggcaauuggagaaac

SEQ ID NO: 183094 - RNA, 22 nt, Homo sapiens
auuccaguuugugagaagcugu

SEQ ID NO: 183095 - RNA, 19 nt, Homo sapiens
auugauuaaguuugcuguc

SEQ ID NO: 183096 - RNA, 22 nt, Homo sapiens
auugcaauuaguccauagaguu

SEQ ID NO: 183097 - RNA, 22 nt, Homo sapiens
auugcacuccagcccgggugac

SEQ ID NO: 183098 - RNA, 22 nt, Homo sapiens
auugcacuccagcccugcugac

SEQ ID NO: 183099 - RNA, 22 nt, Homo sapiens
auugcacuccagccuaggcaac

SEQ ID NO: 183100 - RNA, 22 nt, Homo sapiens
auugcacuccagccuagguaac

SEQ ID NO: 183101 - RNA, 22 nt, Homo sapiens
auugcacuccagccucggugac

SEQ ID NO: 183102 - RNA, 22 nt, Homo sapiens
auugcacuccagccugagcaaa

SEQ ID NO: 183103 - RNA, 22 nt, Homo sapiens
auugcacuccagccugcggaac

SEQ ID NO: 183104 - RNA, 22 nt, Homo sapiens
gugagucaugucccaucugauu

SEQ ID NO: 183105 - RNA, 22 nt, Homo sapiens
gugcacaacaugcaguuuuguu

SEQ ID NO: 183106 - RNA, 22 nt, Homo sapiens
gugcacaaucgugcauuccuug

SEQ ID NO: 183107 - RNA, 23 nt, Homo sapiens
gugcaguggcgagauuucggcuc

SEQ ID NO: 183108 - RNA, 22 nt, Homo sapiens
gugcuauguuauccagcaagau

SEQ ID NO: 183109 - RNA, 22 nt, Homo sapiens
guggcuagaaugaagguagcug

SEQ ID NO: 183110 - RNA, 22 nt, Homo sapiens
guggcuuuauuuagaagcaggg

SEQ ID NO: 183111 - RNA, 22 nt, Homo sapiens
gugggaagcuggaacucccucc

SEQ ID NO: 183112 - RNA, 22 nt, Homo sapiens
gugguucuagaauugaguaucc

SEQ ID NO: 183113 - RNA, 22 nt, Homo sapiens
guguaaaucaaucuguugucuu

SEQ ID NO: 183114 - RNA, 22 nt, Homo sapiens
guguaugugagaaugcucaugu

SEQ ID NO: 183115 - RNA, 22 nt, Homo sapiens
gugugacagcuauagacaugau

SEQ ID NO: 183116 - RNA, 22 nt, Homo sapiens
gugugcaugucuuuuuaguagg

SEQ ID NO: 183117 - RNA, 22 nt, Homo sapiens
guguucaaacccaggucugucu

SEQ ID NO: 183118 - RNA, 22 nt, Homo sapiens
guguuugguugauagagccacu

SEQ ID NO: 183119 - RNA, 22 nt, Homo sapiens
guucagguauucuggaacagag

SEQ ID NO: 183120 - RNA, 22 nt, Homo sapiens
guugcucaggccggagugcagu

SEQ ID NO: 183121 - RNA, 17 nt, Homo sapiens
guuuggguacuggguaa

SEQ ID NO: 183122 - RNA, 22 nt, Homo sapiens
guuuguaacucuagugacuaga

SEQ ID NO: 183123 - RNA, 22 nt, Homo sapiens
guuuuuggggucacuauuaccg

SEQ ID NO: 183124 - RNA, 22 nt, Homo sapiens
uaaagagcuuuugaggugucau

SEQ ID NO: 183125 - RNA, 22 nt, Homo sapiens
uaaagcacuuuuuucugcaugg

SEQ ID NO: 183126 - RNA, 22 nt, Homo sapiens
uaaagccauugucaaguuugua

SEQ ID NO: 183127 - RNA, 22 nt, Homo sapiens
uaaauggauauugccaucuccu

SEQ ID NO: 183128 - RNA, 22 nt, Homo sapiens
uaacaggcuacucuugcauugc

SEQ ID NO: 183129 - RNA, 22 nt, Homo sapiens
uaacccugaggggcuuggggac

SEQ ID NO: 183130 - RNA, 22 nt, Homo sapiens
uaagacugccccagacagcaag

SEQ ID NO: 183131 - RNA, 22 nt, Homo sapiens
uaagagcuaggauuuuaaauca

SEQ ID NO: 183132 - RNA, 22 nt, Homo sapiens
uaagcagugcaagaauggaaua

SEQ ID NO: 183133 - RNA, 22 nt, Homo sapiens
uaagcaguguggauccaccuug

SEQ ID NO: 183134 - RNA, 16 nt, Homo sapiens
uaagccccacgugcau

SEQ ID NO: 183135 - RNA, 22 nt, Homo sapiens
uaaggaaggcugugugcuuuua

SEQ ID NO: 183136 - RNA, 22 nt, Homo sapiens
uaaggcauuuuuuugaguugca

SEQ ID NO: 183137 - RNA, 22 nt, Homo sapiens
uaaggcuucuuggaauacugca

SEQ ID NO: 183138 - RNA, 22 nt, Homo sapiens
uaaggcuugaucuuggugagau

SEQ ID NO: 183139 - RNA, 22 nt, Homo sapiens
uaaggcuuugucuuaggacuuu

SEQ ID NO: 183140 - RNA, 22 nt, Homo sapiens
uaaguagaggaaucauuuugug

SEQ ID NO: 183141 - RNA, 22 nt, Homo sapiens
uaauaguuucagaaguuguuuu

SEQ ID NO: 183142 - RNA, 22 nt, Homo sapiens
uacaaagugggaaacgaagguu

SEQ ID NO: 183143 - RNA, 22 nt, Homo sapiens
uacagguaugugucuauauaca

SEQ ID NO: 183144 - RNA, 22 nt, Homo sapiens
uacagucauaaugccuagugac

SEQ ID NO: 183145 - RNA, 22 nt, Homo sapiens
uacaguccaugcauuauccucc

SEQ ID NO: 183146 - RNA, 22 nt, Homo sapiens
uacaguguuuugguauuccaca

SEQ ID NO: 183147 - RNA, 22 nt, Homo sapiens
uacauguauguguuuauggcug

SEQ ID NO: 183148 - RNA, 22 nt, Homo sapiens
uacccugaaggaaaguauguuu

SEQ ID NO: 183149 - RNA, 22 nt, Homo sapiens
uacucugcagagaugcauaaca

SEQ ID NO: 183150 - RNA, 22 nt, Homo sapiens
uacugcaucuacuuagagccag

SEQ ID NO: 183151 - RNA, 22 nt, Homo sapiens
uacugcauuccaaucugggcga

SEQ ID NO: 183152 - RNA, 22 nt, Homo sapiens
uacugcauucuccgccuccggg

SEQ ID NO: 183153 - RNA, 22 nt, Homo sapiens
uagaaagcaugaccuucagaua

SEQ ID NO: 183154 - RNA, 21 nt, Homo sapiens
uagagcaacacacgcccucuc

SEQ ID NO: 183155 - RNA, 22 nt, Homo sapiens
uagauaauuagaggguuuuaag

SEQ ID NO: 183156 - RNA, 22 nt, Homo sapiens
uagauuaucuguaugugcucuu

SEQ ID NO: 183157 - RNA, 22 nt, Homo sapiens
uagauuauuggcugauuugauc

SEQ ID NO: 183158 - RNA, 22 nt, Homo sapiens
uagcagguggugaccacauuuu

SEQ ID NO: 183159 - RNA, 22 nt, Homo sapiens
uagccucacaaagugcuuaaga

SEQ ID NO: 183160 - RNA, 22 nt, Homo sapiens
uagcugagacuacaguaggugc

SEQ ID NO: 183161 - RNA, 17 nt, Homo sapiens
uagcuucacauuaggaa

SEQ ID NO: 183162 - RNA, 22 nt, Homo sapiens
uaggcaauggagauagaggaug

SEQ ID NO: 183163 - RNA, 22 nt, Homo sapiens
uaggcaauguggcgaaacucug

SEQ ID NO: 183164 - RNA, 19 nt, Homo sapiens
uagguacauucaagucucc

SEQ ID NO: 183165 - RNA, 22 nt, Homo sapiens
uagguugucucuucacucugau

SEQ ID NO: 183166 - RNA, 20 nt, Homo sapiens
uagguuuucacagaauugcc

SEQ ID NO: 183167 - RNA, 22 nt, Homo sapiens
uauacacgugugcauauauaca

SEQ ID NO: 183168 - RNA, 22 nt, Homo sapiens
uauacagcaaguuacugugcug

SEQ ID NO: 183169 - RNA, 22 nt, Homo sapiens
uaucacaguugcauauuuaagg

SEQ ID NO: 183170 - RNA, 22 nt, Homo sapiens
uauccuguagcucauccaccgc

SEQ ID NO: 183171 - RNA, 22 nt, Homo sapiens
uaugauuuuugggagaggucaa

SEQ ID NO: 183172 - RNA, 19 nt, Homo sapiens
uaugcaacuuauagugcug

SEQ ID NO: 183173 - RNA, 22 nt, Homo sapiens
uauggauuugcauuccccaugu

SEQ ID NO: 183174 - RNA, 22 nt, Homo sapiens
uauggauuuucagauucuuauc

SEQ ID NO: 183175 - RNA, 22 nt, Homo sapiens
uauggcaaugcauaggaaggaa

SEQ ID NO: 183176 - RNA, 22 nt, Homo sapiens
uauuauagugauaggucuacug

SEQ ID NO: 183177 - RNA, 22 nt, Homo sapiens
uauugcuggcucugucuucauu

SEQ ID NO: 183178 - RNA, 22 nt, Homo sapiens
uauuguuuuucccaggagucua

SEQ ID NO: 183179 - RNA, 22 nt, Homo sapiens
uauuucccuuaacuuuccugca

SEQ ID NO: 183180 - RNA, 22 nt, Homo sapiens
uauuugguuggugcaaaaguaa

SEQ ID NO: 183181 - RNA, 22 nt, Homo sapiens
ucaaaugcacguagagaaaaua

SEQ ID NO: 183182 - RNA, 22 nt, Homo sapiens
ucaagugauucuugugccuuag

SEQ ID NO: 183183 - RNA, 18 nt, Homo sapiens
ucaauguggauguucuuu

SEQ ID NO: 183184 - RNA, 22 nt, Homo sapiens
ucacaaggcaggaaugaaaggg

SEQ ID NO: 183185 - RNA, 22 nt, Homo sapiens
ucacaggguguuauuagaauua

SEQ ID NO: 183186 - RNA, 22 nt, Homo sapiens
ucacauggcagagaagaagcuc

SEQ ID NO: 183187 - RNA, 22 nt, Homo sapiens
ucaccuggagaagauggaucau

SEQ ID NO: 183188 - RNA, 22 nt, Homo sapiens
ucaccuggggcacagcugaaga

SEQ ID NO: 183189 - RNA, 22 nt, Homo sapiens
ucacucagaccuggugauaugc

SEQ ID NO: 183190 - RNA, 20 nt, Homo sapiens
ucacuggguucuugaagucu

SEQ ID NO: 183191 - RNA, 22 nt, Homo sapiens
ucagaguggagucugcagccuu

SEQ ID NO: 183192 - RNA, 22 nt, Homo sapiens
ucagaguggccucucuugaaga

SEQ ID NO: 183193 - RNA, 22 nt, Homo sapiens
ucagcaucacgugggcucccgu

SEQ ID NO: 183194 - RNA, 22 nt, Homo sapiens
ucagugauugguuauuuuaggc

SEQ ID NO: 183195 - RNA, 22 nt, Homo sapiens
ucagugucugugauggagaggu

SEQ ID NO: 183196 - RNA, 22 nt, Homo sapiens
ucaguucauggaggugucugcu

SEQ ID NO: 183197 - RNA, 21 nt, Homo sapiens
ucauaagcucaacaucuguag

SEQ ID NO: 183198 - RNA, 22 nt, Homo sapiens
uuugaauguaaugagcaggaag

SEQ ID NO: 183199 - RNA, 22 nt, Homo sapiens
uuugcacuucugagugugacau

SEQ ID NO: 183200 - RNA, 22 nt, Homo sapiens
uuugcacuugaaaacacucuca

SEQ ID NO: 183201 - RNA, 23 nt, Homo sapiens
uuugcacuugcuccuucuauggc

SEQ ID NO: 183202 - RNA, 22 nt, Homo sapiens
uuuggguuaguuuuccaaucuu

SEQ ID NO: 183203 - RNA, 22 nt, Homo sapiens
uuugguguauaaaaaugcuagu

SEQ ID NO: 183204 - RNA, 22 nt, Homo sapiens
uuugguugcauucacauauuuc

SEQ ID NO: 183205 - RNA, 22 nt, Homo sapiens
uuugguugccucuaugagccug

SEQ ID NO: 183206 - RNA, 22 nt, Homo sapiens
uuuguacacuguugguaggauu

SEQ ID NO: 183207 - RNA, 23 nt, Homo sapiens
uuuguaguagcaugauuuauaau

SEQ ID NO: 183208 - RNA, 19 nt, Homo sapiens
uuuguauguuuccaguaau

SEQ ID NO: 183209 - RNA, 22 nt, Homo sapiens
uuugucacccugaauguaagau

SEQ ID NO: 183210 - RNA, 22 nt, Homo sapiens
uuuucaguggccauaguggaga

SEQ ID NO: 183211 - RNA, 22 nt, Homo sapiens
uuuucaguuuuccagguagccg

SEQ ID NO: 183212 - RNA, 23 nt, Homo sapiens
uuuugcaauaagucacuggaaua

SEQ ID NO: 183213 - RNA, 22 nt, Homo sapiens
uuuugcaccauccuaauaguau

SEQ ID NO: 183214 - RNA, 22 nt, Homo sapiens
uuuugcuugugaauagccacau

SEQ ID NO: 183215 - RNA, 22 nt, Homo sapiens
uuuugcuuuuccucggucccac

SEQ ID NO: 183216 - RNA, 22 nt, Homo sapiens
uuuugguguauuguauaaggua

SEQ ID NO: 183217 - RNA, 22 nt, Homo sapiens
uuuuuauggccaauccucagaa

SEQ ID NO: 183218 - RNA, 22 nt, Homo sapiens
uuuuuggaggagguuagaucau

SEQ ID NO: 183219 - RNA, 21 nt, Homo sapiens
cuuuuuacucguucauaugca

SEQ ID NO: 183220 - RNA, 22 nt, Homo sapiens
gaaaugcucagggguuuuccag

SEQ ID NO: 183221 - RNA, 22 nt, Homo sapiens
gaacuguuucuggugaaagagu

SEQ ID NO: 183222 - RNA, 22 nt, Homo sapiens
gaaggcacugugugccacccug

SEQ ID NO: 183223 - RNA, 22 nt, Homo sapiens
gaaguaauaaauggauucuuaa

SEQ ID NO: 183224 - RNA, 23 nt, Homo sapiens
gaaguaauaaauggauucuuaac

SEQ ID NO: 183225 - RNA, 22 nt, Homo sapiens
gaauagugcugcgauaaacaua

SEQ ID NO: 183226 - RNA, 22 nt, Homo sapiens
gacauguuuucauguauuugga

SEQ ID NO: 183227 - RNA, 19 nt, Homo sapiens
gacuccagaguugugugcu

SEQ ID NO: 183228 - RNA, 22 nt, Homo sapiens
gagaacaguguuguauuuuuuc

SEQ ID NO: 183229 - RNA, 22 nt, Homo sapiens
gagaacuggcgugaacugcacg

SEQ ID NO: 183230 - RNA, 22 nt, Homo sapiens
gagacuaaagagcuugcccugg

SEQ ID NO: 183231 - RNA, 22 nt, Homo sapiens
gagaugaaguuaaggaucuuua

SEQ ID NO: 183232 - RNA, 22 nt, Homo sapiens
gagauugucaugauuacauugu

SEQ ID NO: 183233 - RNA, 22 nt, Homo sapiens
gagcaucaauggcaugugggaa

SEQ ID NO: 183234 - RNA, 22 nt, Homo sapiens
gagcugaucuuuucugauucca

SEQ ID NO: 183235 - RNA, 22 nt, Homo sapiens
gaguagugcugcaauaaacaua

SEQ ID NO: 183236 - RNA, 21 nt, Homo sapiens
gagugcaaauaaagagagggc

SEQ ID NO: 183237 - RNA, 22 nt, Homo sapiens
gaucacaguuccucacgggcau

SEQ ID NO: 183238 - RNA, 22 nt, Homo sapiens
gaugaaacaucuuuggaaacug

SEQ ID NO: 183239 - RNA, 22 nt, Homo sapiens
gaugacagugaguaaccccaac

SEQ ID NO: 183240 - RNA, 22 nt, Homo sapiens
gauggcaugugcugccaccaag

SEQ ID NO: 183241 - RNA, 22 nt, Homo sapiens
gaugugaaaucauaguuucuag

SEQ ID NO: 183242 - RNA, 22 nt, Homo sapiens
gauuuuccaguggcccugauca

SEQ ID NO: 183243 - RNA, 22 nt, Homo sapiens
gcaagaauggaacaggagagcc

SEQ ID NO: 183244 - RNA, 22 nt, Homo sapiens
gcaagaguauuucaaggaagau

SEQ ID NO: 183245 - RNA, 22 nt, Homo sapiens
gcaauacugacagcauuaguuu

SEQ ID NO: 183246 - RNA, 17 nt, Homo sapiens
gcacuggcguaucccac

SEQ ID NO: 183247 - RNA, 22 nt, Homo sapiens
gcagaucucuucauuucucuua

SEQ ID NO: 183248 - RNA, 22 nt, Homo sapiens
gcagcagugcccuggauggaaa

SEQ ID NO: 183249 - RNA, 22 nt, Homo sapiens
gcaggaaucuugagaaggauuc

SEQ ID NO: 183250 - RNA, 22 nt, Homo sapiens
gcaguagugugaucuuggcuca

SEQ ID NO: 183251 - RNA, 22 nt, Homo sapiens
gcaguauuguugaaauguccau

SEQ ID NO: 183252 - RNA, 23 nt, Homo sapiens
gcagucauuuggaaaagguugaa

SEQ ID NO: 183253 - RNA, 22 nt, Homo sapiens
gcauggaaggcgcuuugugacu

SEQ ID NO: 183254 - RNA, 22 nt, Homo sapiens
gccaagaagugucuaagcagga

SEQ ID NO: 183255 - RNA, 22 nt, Homo sapiens
gcccugagauucuuggauucug

SEQ ID NO: 183256 - RNA, 22 nt, Homo sapiens
gccugagaggauaugauccccu

SEQ ID NO: 183257 - RNA, 22 nt, Homo sapiens
gccuguagaagaguagaugacc

SEQ ID NO: 183258 - RNA, 22 nt, Homo sapiens
gcuggcuuucuccugaucucag

SEQ ID NO: 183259 - RNA, 22 nt, Homo sapiens
gcugguguugugaaucaggccg

SEQ ID NO: 183260 - RNA, 22 nt, Homo sapiens
gcugucuggagucuguucaaug

SEQ ID NO: 183261 - RNA, 21 nt, Homo sapiens
gcuuuuucggaagucuuuggc

SEQ ID NO: 183262 - RNA, 22 nt, Homo sapiens
ggaagaauauuaggggauuucg

SEQ ID NO: 183263 - RNA, 22 nt, Homo sapiens
ggaagguaauuggguaaugaga

SEQ ID NO: 183264 - RNA, 22 nt, Homo sapiens
ggacauuaacugcaagauagau

SEQ ID NO: 183265 - RNA, 22 nt, Homo sapiens
ggagaugauuaugaaucacuua

SEQ ID NO: 183266 - RNA, 22 nt, Homo sapiens
ggagcucaucuagcauagaggu

SEQ ID NO: 183267 - RNA, 22 nt, Homo sapiens
ggagcugugauuugaguccaga

SEQ ID NO: 183268 - RNA, 22 nt, Homo sapiens
ggagucugauguucuaaggcag

SEQ ID NO: 183269 - RNA, 22 nt, Homo sapiens
ggagugugauuguucucuguua

SEQ ID NO: 183270 - RNA, 22 nt, Homo sapiens
ggaguguguuuuccaacuuggu

SEQ ID NO: 183271 - RNA, 22 nt, Homo sapiens
ggaucacuugagaccaggaguu

SEQ ID NO: 183272 - RNA, 22 nt, Homo sapiens
ggcaagaacuucacucacuuuu

SEQ ID NO: 183273 - RNA, 21 nt, Homo sapiens
ggcaagugugagguuuggggu

SEQ ID NO: 183274 - RNA, 22 nt, Homo sapiens
ggcacaaugucagcucacugca

SEQ ID NO: 183275 - RNA, 22 nt, Homo sapiens
ggcacaauugcagcaauaaaca

SEQ ID NO: 183276 - RNA, 21 nt, Homo sapiens
ggcaugaauggaaaagugaga

SEQ ID NO: 183277 - RNA, 22 nt, Homo sapiens
ggccagaugcaguggcucacac

SEQ ID NO: 183278 - RNA, 22 nt, Homo sapiens
ggccugaugaaauguuagagua

SEQ ID NO: 183279 - RNA, 22 nt, Homo sapiens
ggcgguguccuccaagugcuuc

SEQ ID NO: 183280 - RNA, 22 nt, Homo sapiens
ggcucagugaucuguuucugua

SEQ ID NO: 183281 - RNA, 22 nt, Homo sapiens
gggaaaaugucuauugaaugaa

SEQ ID NO: 183282 - RNA, 22 nt, Homo sapiens
gggaagaaggagugguuuacuc

SEQ ID NO: 183283 - RNA, 22 nt, Homo sapiens
gggaggucauuguucaaugcug

SEQ ID NO: 183284 - RNA, 22 nt, Homo sapiens
ggucauguguccaggagguagc

SEQ ID NO: 183285 - RNA, 22 nt, Homo sapiens
gguccgccugccuuggccuccc

SEQ ID NO: 183286 - RNA, 22 nt, Homo sapiens
guaaccuauaguuaccaauagu

SEQ ID NO: 183287 - RNA, 22 nt, Homo sapiens
guaacucugucacuuacuaguu

SEQ ID NO: 183288 - RNA, 22 nt, Homo sapiens
guacaggugcaggaugggcagg

SEQ ID NO: 183289 - RNA, 22 nt, Homo sapiens
guagagagaaauacaaagcugu

SEQ ID NO: 183290 - RNA, 22 nt, Homo sapiens
guauacacccugugauauuauu

SEQ ID NO: 183291 - RNA, 22 nt, Homo sapiens
guaugcaagugauaugacauau

SEQ ID NO: 183292 - RNA, 22 nt, Homo sapiens
guauuguacuacaagcucuuua

SEQ ID NO: 183293 - RNA, 22 nt, Homo sapiens
gucacaguggccagugauguuc

SEQ ID NO: 183294 - RNA, 22 nt, Homo sapiens
gucacaguguuuguucauccca

SEQ ID NO: 183295 - RNA, 22 nt, Homo sapiens
guccaugagaugaauccacaca

SEQ ID NO: 183296 - RNA, 22 nt, Homo sapiens
acugggucaaaguagaaaacua

SEQ ID NO: 183297 - RNA, 22 nt, Homo sapiens
acugguguaugggaggucccaa

SEQ ID NO: 183298 - RNA, 22 nt, Homo sapiens
acuucauucucuggaucagaau

SEQ ID NO: 183299 - RNA, 22 nt, Homo sapiens
agaaacauucucuugccuccuu

SEQ ID NO: 183300 - RNA, 19 nt, Homo sapiens
agaagugcauggucuagag

SEQ ID NO: 183301 - RNA, 19 nt, Homo sapiens
agaaucuaaauuauuucug

SEQ ID NO: 183302 - RNA, 22 nt, Homo sapiens
agaauguauauucuguaguugu

SEQ ID NO: 183303 - RNA, 22 nt, Homo sapiens
agaaugugaacaucuugaaagu

SEQ ID NO: 183304 - RNA, 20 nt, Homo sapiens
agacagcugcagcccacauc

SEQ ID NO: 183305 - RNA, 22 nt, Homo sapiens
agaggaguacuacuccaagucu

SEQ ID NO: 183306 - RNA, 20 nt, Homo sapiens
agagugcugucuguccugag

SEQ ID NO: 183307 - RNA, 22 nt, Homo sapiens
agaucacagucuuugguuuuag

SEQ ID NO: 183308 - RNA, 22 nt, Homo sapiens
agaucauaugcaguaaugaacu

SEQ ID NO: 183309 - RNA, 22 nt, Homo sapiens
agcaacauagugagacccccau

SEQ ID NO: 183310 - RNA, 22 nt, Homo sapiens
agcaacauuuuugaccuuucuu

SEQ ID NO: 183311 - RNA, 22 nt, Homo sapiens
agcaauaugacauugcuacauc

SEQ ID NO: 183312 - RNA, 22 nt, Homo sapiens
agcagcaugcaaauggacuaau

SEQ ID NO: 183313 - RNA, 22 nt, Homo sapiens
agcagcauuaugauauaucuua

SEQ ID NO: 183314 - RNA, 22 nt, Homo sapiens
agcagcauuccaaaaaucugcu

SEQ ID NO: 183315 - RNA, 17 nt, Homo sapiens
agcagcccauaucccca

SEQ ID NO: 183316 - RNA, 23 nt, Homo sapiens
agccugguuucccugcuucuccc

SEQ ID NO: 183317 - RNA, 21 nt, Homo sapiens
agcugcguuuaggcauuuucc

SEQ ID NO: 183318 - RNA, 22 nt, Homo sapiens
agcuggucucaggugcccugcu

SEQ ID NO: 183319 - RNA, 22 nt, Homo sapiens
agcuguuguacacuuuaccuuu

SEQ ID NO: 183320 - RNA, 22 nt, Homo sapiens
agcuucauuguuaugaauguca

SEQ ID NO: 183321 - RNA, 22 nt, Homo sapiens
agcuuuuugggaggccuuagga

SEQ ID NO: 183322 - RNA, 22 nt, Homo sapiens
aggacacugagcaugggagguu

SEQ ID NO: 183323 - RNA, 22 nt, Homo sapiens
aggcaugaguucagaggguaug

SEQ ID NO: 183324 - RNA, 22 nt, Homo sapiens
aggcuagaaucuuccaucuugg

SEQ ID NO: 183325 - RNA, 22 nt, Homo sapiens
aggcuagacuuugagaauuuuu

SEQ ID NO: 183326 - RNA, 21 nt, Homo sapiens
aggucaguaagaaugcagcac

SEQ ID NO: 183327 - RNA, 22 nt, Homo sapiens
aggugacugguuuaucuggcag

SEQ ID NO: 183328 - RNA, 22 nt, Homo sapiens
aggugcuauauuucgaggauag

SEQ ID NO: 183329 - RNA, 22 nt, Homo sapiens
aggugcuugaaucuaugagcuc

SEQ ID NO: 183330 - RNA, 22 nt, Homo sapiens
aggugguguuggguuccagccc

SEQ ID NO: 183331 - RNA, 22 nt, Homo sapiens
agugacaugggaucaaaucuga

SEQ ID NO: 183332 - RNA, 22 nt, Homo sapiens
agugcaguggcacaaucuuggc

SEQ ID NO: 183333 - RNA, 22 nt, Homo sapiens
agugggccccuagaggugaggu

SEQ ID NO: 183334 - RNA, 19 nt, Homo sapiens
aguggguguuuucuguuug

SEQ ID NO: 183335 - RNA, 22 nt, Homo sapiens
agugguuuuaaguagagcauac

SEQ ID NO: 183336 - RNA, 22 nt, Homo sapiens
aguguuuuuaacaagaaagggu

SEQ ID NO: 183337 - RNA, 22 nt, Homo sapiens
aguuccuacuggcuguaaagaa

SEQ ID NO: 183338 - RNA, 22 nt, Homo sapiens
auaaaguagaggugaggugcau

SEQ ID NO: 183339 - RNA, 22 nt, Homo sapiens
auaagaguaguacauaugagac

SEQ ID NO: 183340 - RNA, 22 nt, Homo sapiens
auaagaugaaggaagccauauc

SEQ ID NO: 183341 - RNA, 22 nt, Homo sapiens
auacacguguauauguguaucu

SEQ ID NO: 183342 - RNA, 22 nt, Homo sapiens
auacagguauacaaugcauaau

SEQ ID NO: 183343 - RNA, 22 nt, Homo sapiens
auacagugaauacuuacagugu

SEQ ID NO: 183344 - RNA, 22 nt, Homo sapiens
auagaagcuauguauaggggcc

SEQ ID NO: 183345 - RNA, 22 nt, Homo sapiens
auagaauguaauguaccuccuu

SEQ ID NO: 183346 - RNA, 22 nt, Homo sapiens
auagagcuaccauagaauccag

SEQ ID NO: 183347 - RNA, 22 nt, Homo sapiens
auagcacaugugcaaauggcug

SEQ ID NO: 183348 - RNA, 22 nt, Homo sapiens
aaaacgcauccucacaggucug

SEQ ID NO: 183349 - RNA, 22 nt, Homo sapiens
aaacauugaccucauccuggca

SEQ ID NO: 183350 - RNA, 22 nt, Homo sapiens
aaacucuguagcagagacagau

SEQ ID NO: 183351 - RNA, 22 nt, Homo sapiens
aaacugaucugaaggccaggcu

SEQ ID NO: 183352 - RNA, 22 nt, Homo sapiens
aaagagcugagaccugguggag

SEQ ID NO: 183353 - RNA, 22 nt, Homo sapiens
aaagcagcaggugguuuucaau

SEQ ID NO: 183354 - RNA, 22 nt, Homo sapiens
aaaggauucuaauggaaaugcu

SEQ ID NO: 183355 - RNA, 22 nt, Homo sapiens
aaaggcacugaucuuauccagu

SEQ ID NO: 183356 - RNA, 22 nt, Homo sapiens
aaaguaauugcaguuuuugcaa

SEQ ID NO: 183357 - RNA, 18 nt, Homo sapiens
aaagugaugucauucuuu

SEQ ID NO: 183358 - RNA, 22 nt, Homo sapiens
aaagugauugcgguuuuugcca

SEQ ID NO: 183359 - RNA, 22 nt, Homo sapiens
aaagugcugagauuguaggcau

SEQ ID NO: 183360 - RNA, 22 nt, Homo sapiens
aaaucccuugcucucucagacc

SEQ ID NO: 183361 - RNA, 22 nt, Homo sapiens
aaaugcuucuauguggcauguu

SEQ ID NO: 183362 - RNA, 22 nt, Homo sapiens
aaauggcuuuuugggcaaggug

SEQ ID NO: 183363 - RNA, 22 nt, Homo sapiens
aacaccauucucuguaacaaga

SEQ ID NO: 183364 - RNA, 22 nt, Homo sapiens
aacagagcuggugacuccaggu

SEQ ID NO: 183365 - RNA, 22 nt, Homo sapiens
aacagauugcugagccccaccc

SEQ ID NO: 183366 - RNA, 20 nt, Homo sapiens
aacagcacugucugaagcuu

SEQ ID NO: 183367 - RNA, 22 nt, Homo sapiens
aacccugagucaugagucuaga

SEQ ID NO: 183368 - RNA, 22 nt, Homo sapiens
aagaccuaugcaggaagaaaug

SEQ ID NO: 183369 - RNA, 22 nt, Homo sapiens
aagagcucauccauaguuguca

SEQ ID NO: 183370 - RNA, 21 nt, Homo sapiens
aagcacauugaguguguguga

SEQ ID NO: 183371 - RNA, 22 nt, Homo sapiens
aagcaguguggacuaaugggaa

SEQ ID NO: 183372 - RNA, 22 nt, Homo sapiens
aagcuacauuuuauuuauguca

SEQ ID NO: 183373 - RNA, 22 nt, Homo sapiens
aagcuggauuucgcauccuguu

SEQ ID NO: 183374 - RNA, 22 nt, Homo sapiens
aaggaauacuggugguugcuau

SEQ ID NO: 183375 - RNA, 22 nt, Homo sapiens
aaggcuauuugagaaugugugu

SEQ ID NO: 183376 - RNA, 22 nt, Homo sapiens
aaggcuguucauuuagcacagu

SEQ ID NO: 183377 - RNA, 20 nt, Homo sapiens
aaggcuuucgaguuccaggg

SEQ ID NO: 183378 - RNA, 23 nt, Homo sapiens
aagguaagcuagaaagauguaga

SEQ ID NO: 183379 - RNA, 22 nt, Homo sapiens
aagguguagucucuggauaagc

SEQ ID NO: 183380 - RNA, 22 nt, Homo sapiens
aaguauuagcuaauugugcuua

SEQ ID NO: 183381 - RNA, 22 nt, Homo sapiens
aagucaugaagaggaaaggaca

SEQ ID NO: 183382 - RNA, 22 nt, Homo sapiens
aagugcuuuacacaugcaugau

SEQ ID NO: 183383 - RNA, 22 nt, Homo sapiens
aagugcuuuguacagggguuga

SEQ ID NO: 183384 - RNA, 22 nt, Homo sapiens
aauaagcugagagaauucuaca

SEQ ID NO: 183385 - RNA, 22 nt, Homo sapiens
aauaguggcuuggacuaaauau

SEQ ID NO: 183386 - RNA, 19 nt, Homo sapiens
aauauugacaguggugucu

SEQ ID NO: 183387 - RNA, 22 nt, Homo sapiens
aaugcaagauguuaauuauagg

SEQ ID NO: 183388 - RNA, 22 nt, Homo sapiens
aauggcaaauguuuucuguuga

SEQ ID NO: 183389 - RNA, 22 nt, Homo sapiens
aauguguuuugaaaucaggaag

SEQ ID NO: 183390 - RNA, 22 nt, Homo sapiens
aauuacucgugucuuuacugcu

SEQ ID NO: 183391 - RNA, 22 nt, Homo sapiens
aauuaguuggcugggugcggug

SEQ ID NO: 183392 - RNA, 22 nt, Homo sapiens
aauuggugaccaagggaaggac

SEQ ID NO: 183393 - RNA, 22 nt, Homo sapiens
acacaguaaauauguauugaau

SEQ ID NO: 183394 - RNA, 22 nt, Homo sapiens
acaccaugucuguuucugguuu

SEQ ID NO: 183395 - RNA, 20 nt, Homo sapiens
acacugugcuaaggauuuuc

SEQ ID NO: 183396 - RNA, 22 nt, Homo sapiens
acacuguugacauuuuguagug

SEQ ID NO: 183397 - RNA, 22 nt, Homo sapiens
acaguggugcgaucucggcuca

SEQ ID NO: 183398 - RNA, 22 nt, Homo sapiens
acaguguuacuugauaguguau

SEQ ID NO: 183399 - RNA, 22 nt, Homo sapiens
acauucagcuguuguuucaaug

SEQ ID NO: 183400 - RNA, 22 nt, Homo sapiens
acccaguguucaacauucacau

SEQ ID NO: 183401 - RNA, 22 nt, Homo sapiens
accccuuacaucagcucuggua

SEQ ID NO: 183402 - RNA, 22 nt, Homo sapiens
acccuggagagugcuguaguaa

SEQ ID NO: 183403 - RNA, 22 nt, Homo sapiens
acccuguaggacuauucuaauc

SEQ ID NO: 183404 - RNA, 19 nt, Homo sapiens
accuguagaaaguacaaca

SEQ ID NO: 183405 - RNA, 22 nt, Homo sapiens
acuauacugaagcaaauuaaca

SEQ ID NO: 183406 - RNA, 22 nt, Homo sapiens
acugcacuccagccucgcaaca

SEQ ID NO: 183407 - RNA, 22 nt, Homo sapiens
acugcauuugucccuuuugaac

SEQ ID NO: 183408 - RNA, 22 nt, Homo sapiens
acuuuguguuacccagcaagga

SEQ ID NO: 183409 - RNA, 22 nt, Homo sapiens
agacagcuggaguaucauagcu

SEQ ID NO: 183410 - RNA, 22 nt, Homo sapiens
agacuagaaaucauuuguugag

SEQ ID NO: 183411 - RNA, 22 nt, Homo sapiens
agagagguggguggagccccca

SEQ ID NO: 183412 - RNA, 23 nt, Homo sapiens
agcaaaugcucuagcacuccaac

SEQ ID NO: 183413 - RNA, 22 nt, Homo sapiens
agcaccauuucucuaaagcacu

SEQ ID NO: 183414 - RNA, 22 nt, Homo sapiens
agcagcauggguauaaaucucc

SEQ ID NO: 183415 - RNA, 21 nt, Homo sapiens
agcagcuuugguugaagcaga

SEQ ID NO: 183416 - RNA, 22 nt, Homo sapiens
agcaggacaauaugggaucagg

SEQ ID NO: 183417 - RNA, 22 nt, Homo sapiens
agcaucacaugggcugcuuggg

SEQ ID NO: 183418 - RNA, 18 nt, Homo sapiens
agcaucacugaucauccu

SEQ ID NO: 183419 - RNA, 22 nt, Homo sapiens
agcccugugauuacuuuuauaa

SEQ ID NO: 183420 - RNA, 22 nt, Homo sapiens
agccuguguugaauuauagaaa

SEQ ID NO: 183421 - RNA, 22 nt, Homo sapiens
agcuacuguuagucuaguuagg

SEQ ID NO: 183422 - RNA, 22 nt, Homo sapiens
agcuccuacuguuacaucauug

SEQ ID NO: 183423 - RNA, 22 nt, Homo sapiens
aggaagacugaaauugcuguuc

SEQ ID NO: 183424 - RNA, 22 nt, Homo sapiens
aggcaagagugacuacgugaaa

SEQ ID NO: 183425 - RNA, 22 nt, Homo sapiens
ugagaaugaugauuuccaguuu

SEQ ID NO: 183426 - RNA, 22 nt, Homo sapiens
ugagaaugcagaaucucgugca

SEQ ID NO: 183427 - RNA, 22 nt, Homo sapiens
ugagaccaacagauuccaguuc

SEQ ID NO: 183428 - RNA, 22 nt, Homo sapiens
ugagacugaguuucgcucuugu

SEQ ID NO: 183429 - RNA, 22 nt, Homo sapiens
ugagacugaguuucucucuugu

SEQ ID NO: 183430 - RNA, 22 nt, Homo sapiens
ugagacugaguuuugcucuugu

SEQ ID NO: 183431 - RNA, 22 nt, Homo sapiens
ugagagaugauaaaauguuugu

SEQ ID NO: 183432 - RNA, 22 nt, Homo sapiens
ugagaguagggguugggauugg

SEQ ID NO: 183433 - RNA, 22 nt, Homo sapiens
ugagaugagaaucaguucuaau

SEQ ID NO: 183434 - RNA, 22 nt, Homo sapiens
ugagaugagggaagccuaggca

SEQ ID NO: 183435 - RNA, 22 nt, Homo sapiens
ugagaugauuuaauggagccca

SEQ ID NO: 183436 - RNA, 22 nt, Homo sapiens
ugagcaauaaaguuacacaguu

SEQ ID NO: 183437 - RNA, 22 nt, Homo sapiens
ugagcacagcgugugggagagc

SEQ ID NO: 183438 - RNA, 22 nt, Homo sapiens
ugagcacuguacuuuaucaggu

SEQ ID NO: 183439 - RNA, 22 nt, Homo sapiens
ugagcagagaagugcccugcgc

SEQ ID NO: 183440 - RNA, 22 nt, Homo sapiens
ugagcagagaucacggcauugu

SEQ ID NO: 183441 - RNA, 22 nt, Homo sapiens
ugaggaguauguucuguagacc

SEQ ID NO: 183442 - RNA, 22 nt, Homo sapiens
ugagggcguauccuucauuaag

SEQ ID NO: 183443 - RNA, 22 nt, Homo sapiens
ugagguaaaacaaggauuggau

SEQ ID NO: 183444 - RNA, 22 nt, Homo sapiens
ugaguagaaauaaacgcaaacu

SEQ ID NO: 183445 - RNA, 22 nt, Homo sapiens
ugaguagaacuccuggagaugu

SEQ ID NO: 183446 - RNA, 20 nt, Homo sapiens
ugaguagaggaguucuauca

SEQ ID NO: 183447 - RNA, 22 nt, Homo sapiens
ugagucauguaauaaugcugcu

SEQ ID NO: 183448 - RNA, 22 nt, Homo sapiens
ugagugaaggggcucuguugug

SEQ ID NO: 183449 - RNA, 22 nt, Homo sapiens
ugagugaggcugggcagucccu

SEQ ID NO: 183450 - RNA, 22 nt, Homo sapiens
ugagugccuggagggcagggac

SEQ ID NO: 183451 - RNA, 22 nt, Homo sapiens
ugagugugacuuagcagaagga

SEQ ID NO: 183452 - RNA, 22 nt, Homo sapiens
ugagugugaggaagaauuagaa

SEQ ID NO: 183453 - RNA, 22 nt, Homo sapiens
ugauaagaaauuguucauguag

SEQ ID NO: 183454 - RNA, 22 nt, Homo sapiens
ugauaagugagauagcaaguga

SEQ ID NO: 183455 - RNA, 17 nt, Homo sapiens
ugauauuuucccagaua

SEQ ID NO: 183456 - RNA, 20 nt, Homo sapiens
ugauguccaggcagagguuu

SEQ ID NO: 183457 - RNA, 22 nt, Homo sapiens
ugauguccaguucauagaaacu

SEQ ID NO: 183458 - RNA, 22 nt, Homo sapiens
ugcaaugugaaauaagcacauc

SEQ ID NO: 183459 - RNA, 22 nt, Homo sapiens
ugcaccacugcuagccugggua

SEQ ID NO: 183460 - RNA, 19 nt, Homo sapiens
ugcauugucugggaaaugg

SEQ ID NO: 183461 - RNA, 21 nt, Homo sapiens
ugcauugucuugaguuuaaau

SEQ ID NO: 183462 - RNA, 19 nt, Homo sapiens
ugccaagaaagucagcuua

SEQ ID NO: 183463 - RNA, 22 nt, Homo sapiens
ugccaguauuuuauuaagaauu

SEQ ID NO: 183464 - RNA, 22 nt, Homo sapiens
ugcugguauuauguuauccaga

SEQ ID NO: 183465 - RNA, 22 nt, Homo sapiens
ugcuguguugcuggcuuaaaga

SEQ ID NO: 183466 - RNA, 22 nt, Homo sapiens
uggaagacauuuuggaccuugg

SEQ ID NO: 183467 - RNA, 22 nt, Homo sapiens
uggaagucauugagguguguua

SEQ ID NO: 183468 - RNA, 22 nt, Homo sapiens
uggaaucuacuaaagcaaaauc

SEQ ID NO: 183469 - RNA, 20 nt, Homo sapiens
uggaaucuaggcggagguuu

SEQ ID NO: 183470 - RNA, 20 nt, Homo sapiens
uggaaucugaagaucucagu

SEQ ID NO: 183471 - RNA, 19 nt, Homo sapiens
uggagucaucaugcugcua

SEQ ID NO: 183472 - RNA, 20 nt, Homo sapiens
uggagugaagguucuggacc

SEQ ID NO: 183473 - RNA, 22 nt, Homo sapiens
uggagugcgugucugaguuuuu

SEQ ID NO: 183474 - RNA, 22 nt, Homo sapiens
uggaguuugacaugccuuuggg

SEQ ID NO: 183475 - RNA, 22 nt, Homo sapiens
uggcagcugcuucaugggaugc

SEQ ID NO: 183476 - RNA, 22 nt, Homo sapiens
uggcaguuucacauggcucaac

SEQ ID NO: 183477 - RNA, 22 nt, Homo sapiens
ugggaaauguagccuagcugug

SEQ ID NO: 183478 - RNA, 22 nt, Homo sapiens
ugggaucagcugggcucucugu

SEQ ID NO: 183479 - RNA, 22 nt, Homo sapiens
ugggauguagccuucuauuuuc

SEQ ID NO: 183480 - RNA, 22 nt, Homo sapiens
ugggcauggaguggccuuaugu

SEQ ID NO: 183481 - RNA, 22 nt, Homo sapiens
uggucaguugugccucaauucc

SEQ ID NO: 183482 - RNA, 21 nt, Homo sapiens
uggucaguuuucucacuagga

SEQ ID NO: 183483 - RNA, 22 nt, Homo sapiens
uggugagaaaugagaugcuuuu

SEQ ID NO: 183484 - RNA, 22 nt, Homo sapiens
uggugccgugguccuggggcca

SEQ ID NO: 183485 - RNA, 16 nt, Homo sapiens
uguaaauguuuugcau

SEQ ID NO: 183486 - RNA, 22 nt, Homo sapiens
uguaaugaucaaaucagaguaa

SEQ ID NO: 183487 - RNA, 22 nt, Homo sapiens
uguauaguugagucaaguuuca

SEQ ID NO: 183488 - RNA, 22 nt, Homo sapiens
uguauguugauguuauauucug

SEQ ID NO: 183489 - RNA, 22 nt, Homo sapiens
uguauguuguaagacuuagacc

SEQ ID NO: 183490 - RNA, 22 nt, Homo sapiens
uguauguuuaaggccaguggaa

SEQ ID NO: 183491 - RNA, 22 nt, Homo sapiens
uugcacugagauuuugcuuaca

SEQ ID NO: 183492 - RNA, 22 nt, Homo sapiens
uugcagagaaauuucugguuua

SEQ ID NO: 183493 - RNA, 22 nt, Homo sapiens
uugcagagccccacacugggcu

SEQ ID NO: 183494 - RNA, 18 nt, Homo sapiens
uugcauaguguauccaaa

SEQ ID NO: 183495 - RNA, 22 nt, Homo sapiens
uugcaucagcaggcauaauugg

SEQ ID NO: 183496 - RNA, 22 nt, Homo sapiens
uugccacuucucuugccccauu

SEQ ID NO: 183497 - RNA, 22 nt, Homo sapiens
uugcuccccaggaaaggaagca

SEQ ID NO: 183498 - RNA, 22 nt, Homo sapiens
uuggaaacgucaccuuuuccuu

SEQ ID NO: 183499 - RNA, 22 nt, Homo sapiens
uuggaaggcugaauggccucuc

SEQ ID NO: 183500 - RNA, 22 nt, Homo sapiens
uuggaagguaaucaaaaguucu

SEQ ID NO: 183501 - RNA, 22 nt, Homo sapiens
uuggauuauaaacugagauuug

SEQ ID NO: 183502 - RNA, 22 nt, Homo sapiens
uuggcaaauagguuuuauugca

SEQ ID NO: 183503 - RNA, 22 nt, Homo sapiens
uuggcaagaaccuucuuccaag

SEQ ID NO: 183504 - RNA, 22 nt, Homo sapiens
uuggcauuguggauggaaucau

SEQ ID NO: 183505 - RNA, 22 nt, Homo sapiens
uuggccccuuucauccacagcu

SEQ ID NO: 183506 - RNA, 22 nt, Homo sapiens
uugggacuggaaggaguaaggg

SEQ ID NO: 183507 - RNA, 22 nt, Homo sapiens
uugggcaaguggcaugaccaug

SEQ ID NO: 183508 - RNA, 22 nt, Homo sapiens
uuggucaggcuaaucucgaacg

SEQ ID NO: 183509 - RNA, 22 nt, Homo sapiens
uuggucucuuaaucacacuuuu

SEQ ID NO: 183510 - RNA, 21 nt, Homo sapiens
uugguucccucugacaggucu

SEQ ID NO: 183511 - RNA, 22 nt, Homo sapiens
uuguacuggguuuucuggaauu

SEQ ID NO: 183512 - RNA, 22 nt, Homo sapiens
uuguauccaucuuucaggcaac

SEQ ID NO: 183513 - RNA, 22 nt, Homo sapiens
uugugaauggaguagcaggauc

SEQ ID NO: 183514 - RNA, 22 nt, Homo sapiens
uugugcuuuugagcugagauga

SEQ ID NO: 183515 - RNA, 22 nt, Homo sapiens
uuguuauguaucucaagauaaa

SEQ ID NO: 183516 - RNA, 22 nt, Homo sapiens
uggcaaaugaagucagcuguac

SEQ ID NO: 183517 - RNA, 23 nt, Homo sapiens
uggccaagauaaucucaguuuuc

SEQ ID NO: 183518 - RNA, 22 nt, Homo sapiens
uggcgggaaaguugggagaaga

SEQ ID NO: 183519 - RNA, 20 nt, Homo sapiens
ugggaaauguccaggacaua

SEQ ID NO: 183520 - RNA, 22 nt, Homo sapiens
ugggaauaugauacaggucuuu

SEQ ID NO: 183521 - RNA, 22 nt, Homo sapiens
ugggaugaaaauagcuucuucc

SEQ ID NO: 183522 - RNA, 19 nt, Homo sapiens
uggucaguucugggagcug

SEQ ID NO: 183523 - RNA, 22 nt, Homo sapiens
uggucuuuucaacaaaugguau

SEQ ID NO: 183524 - RNA, 22 nt, Homo sapiens
uguauagaucugauucaucucc

SEQ ID NO: 183525 - RNA, 22 nt, Homo sapiens
uguaugagagugaaagcauuuc

SEQ ID NO: 183526 - RNA, 22 nt, Homo sapiens
uguauguugggucaaaguacau

SEQ ID NO: 183527 - RNA, 22 nt, Homo sapiens
ugucaaaugcagugauauuuga

SEQ ID NO: 183528 - RNA, 22 nt, Homo sapiens
ugucauguaaagaguaaauggu

SEQ ID NO: 183529 - RNA, 22 nt, Homo sapiens
ugucauguauauaccacuucca

SEQ ID NO: 183530 - RNA, 18 nt, Homo sapiens
ugucccuuugcuguucau

SEQ ID NO: 183531 - RNA, 22 nt, Homo sapiens
uguccugaagcuuuguuaugua

SEQ ID NO: 183532 - RNA, 22 nt, Homo sapiens
ugucuaaagaauggcagacuca

SEQ ID NO: 183533 - RNA, 22 nt, Homo sapiens
ugucucagugauuggcuuucug

SEQ ID NO: 183534 - RNA, 22 nt, Homo sapiens
ugucucaguuacggcaauucca

SEQ ID NO: 183535 - RNA, 22 nt, Homo sapiens
ugugaagaaagucauugguagc

SEQ ID NO: 183536 - RNA, 22 nt, Homo sapiens
ugugaauggugcugcaaugaac

SEQ ID NO: 183537 - RNA, 22 nt, Homo sapiens
ugugaauggugcugccgugaag

SEQ ID NO: 183538 - RNA, 22 nt, Homo sapiens
ugugacagcacagcaucucuuu

SEQ ID NO: 183539 - RNA, 22 nt, Homo sapiens
ugugacagguauccuguguucu

SEQ ID NO: 183540 - RNA, 22 nt, Homo sapiens
cuggagaucuugacauugaagu

SEQ ID NO: 183541 - RNA, 22 nt, Homo sapiens
cuggagcauugguggauuuguu

SEQ ID NO: 183542 - RNA, 22 nt, Homo sapiens
cuggaguaugauguuagcguug

SEQ ID NO: 183543 - RNA, 20 nt, Homo sapiens
cuggaugucgaggcagaggu

SEQ ID NO: 183544 - RNA, 22 nt, Homo sapiens
cuggccagagacauucauuaaa

SEQ ID NO: 183545 - RNA, 22 nt, Homo sapiens
cugguaugcuucauaugcaaac

SEQ ID NO: 183546 - RNA, 22 nt, Homo sapiens
cuguaugugagaaauaauaagu

SEQ ID NO: 183547 - RNA, 22 nt, Homo sapiens
cuguuuguuuaggguacucaga

SEQ ID NO: 183548 - RNA, 22 nt, Homo sapiens
cuuccauaguauuuuuacaaaa

SEQ ID NO: 183549 - RNA, 22 nt, Homo sapiens
cuugagacauuguuuuccaagu

SEQ ID NO: 183550 - RNA, 22 nt, Homo sapiens
cuugcacuguuguaagggacuu

SEQ ID NO: 183551 - RNA, 22 nt, Homo sapiens
cuuuaguugucuccucaagggu

SEQ ID NO: 183552 - RNA, 22 nt, Homo sapiens
cuuuguaugucaugacaacugu

SEQ ID NO: 183553 - RNA, 22 nt, Homo sapiens
cuuugugcccuucugcccauca

SEQ ID NO: 183554 - RNA, 22 nt, Homo sapiens
cuuuuggugguucugaugcagg

SEQ ID NO: 183555 - RNA, 22 nt, Homo sapiens
aaagcacugaauaaauuugcuu

SEQ ID NO: 183556 - RNA, 22 nt, Homo sapiens
aaagggcuuuguaaacuucaag

SEQ ID NO: 183557 - RNA, 22 nt, Homo sapiens
aaagugcugagaguucuaacuu

SEQ ID NO: 183558 - RNA, 22 nt, Homo sapiens
aaauccauuuguucagcuaugc

SEQ ID NO: 183559 - RNA, 22 nt, Homo sapiens
aaaugcacaaagauuuugcacu

SEQ ID NO: 183560 - RNA, 22 nt, Homo sapiens
aaaugcagauucugcuuagguu

SEQ ID NO: 183561 - RNA, 22 nt, Homo sapiens
aacacggcccgcagagcaagcu

SEQ ID NO: 183562 - RNA, 22 nt, Homo sapiens
aacaggguggugccugguccau

SEQ ID NO: 183563 - RNA, 22 nt, Homo sapiens
aacauguuuagcagauaccugu

SEQ ID NO: 183564 - RNA, 22 nt, Homo sapiens
aagagaugaagguccugacugu

SEQ ID NO: 183565 - RNA, 22 nt, Homo sapiens
aagagguuuaacugacucacag

SEQ ID NO: 183566 - RNA, 22 nt, Homo sapiens
aaggaacuggaauauuuugaac

SEQ ID NO: 183567 - RNA, 22 nt, Homo sapiens
aaggaagcuagcaggaauuggu

SEQ ID NO: 183568 - RNA, 22 nt, Homo sapiens
aaggcaagaagagaaccaucgg

SEQ ID NO: 183569 - RNA, 22 nt, Homo sapiens
aaggcauucucaaacuaguucu

SEQ ID NO: 183570 - RNA, 22 nt, Homo sapiens
aagggaaugcgcugccuguguu

SEQ ID NO: 183571 - RNA, 21 nt, Homo sapiens
aaggugguggugauugagaug

SEQ ID NO: 183572 - RNA, 22 nt, Homo sapiens
aaguagcuggaugcaguggcac

SEQ ID NO: 183573 - RNA, 22 nt, Homo sapiens
aaguauuagugaggauauggaa

SEQ ID NO: 183574 - RNA, 22 nt, Homo sapiens
aaguauuaugaguccuuguuuu

SEQ ID NO: 183575 - RNA, 22 nt, Homo sapiens
aagucaaggagagaagcuucag

SEQ ID NO: 183576 - RNA, 22 nt, Homo sapiens
aagucacugagacuuguggcug

SEQ ID NO: 183577 - RNA, 22 nt, Homo sapiens
aagugcuuaggauagugugugg

SEQ ID NO: 183578 - RNA, 22 nt, Homo sapiens
aaguggaauguuuguggcacaa

SEQ ID NO: 183579 - RNA, 23 nt, Homo sapiens
aaguucaugcucaucuguuacac

SEQ ID NO: 183580 - RNA, 22 nt, Homo sapiens
aauaaagccugucucuuuagag

SEQ ID NO: 183581 - RNA, 22 nt, Homo sapiens
aauaauggcaccaaagcacaag

SEQ ID NO: 183582 - RNA, 22 nt, Homo sapiens
aauacugagaugugagguacua

SEQ ID NO: 183583 - RNA, 22 nt, Homo sapiens
aauagcauugaaucuaccaauu

SEQ ID NO: 183584 - RNA, 22 nt, Homo sapiens
aauccuguagauucuaauuccu

SEQ ID NO: 183585 - RNA, 22 nt, Homo sapiens
aauccugucuugccauccaaua

SEQ ID NO: 183586 - RNA, 22 nt, Homo sapiens
aaucuguagaaggugcacauuc

SEQ ID NO: 183587 - RNA, 22 nt, Homo sapiens
aaugacacugagcaucuuucau

SEQ ID NO: 183588 - RNA, 22 nt, Homo sapiens
aaugacagccagauucuucucu

SEQ ID NO: 183589 - RNA, 22 nt, Homo sapiens
aaugcuguguuauuucaugacc

SEQ ID NO: 183590 - RNA, 22 nt, Homo sapiens
aauggcaagagccacagaggcg

SEQ ID NO: 183591 - RNA, 22 nt, Homo sapiens
aauggcuuuuaauauccauaau

SEQ ID NO: 183592 - RNA, 22 nt, Homo sapiens
aauugcaauggacaaugcagca

SEQ ID NO: 183593 - RNA, 22 nt, Homo sapiens
aauugguuaagauaagaucaua

SEQ ID NO: 183594 - RNA, 22 nt, Homo sapiens
acaaaguauggaauguuggugu

SEQ ID NO: 183595 - RNA, 22 nt, Homo sapiens
acaauguauauuuuacuguagg

SEQ ID NO: 183596 - RNA, 20 nt, Homo sapiens
acaguauguuuggaugcaua

SEQ ID NO: 183597 - RNA, 22 nt, Homo sapiens
acagugcuuggcacacaguaau

SEQ ID NO: 183598 - RNA, 22 nt, Homo sapiens
acauaguagacacugaaaauau

SEQ ID NO: 183599 - RNA, 22 nt, Homo sapiens
accacaggguaaaguuagauau

SEQ ID NO: 183600 - RNA, 22 nt, Homo sapiens
accaccacucccgcauucuaaa

SEQ ID NO: 183601 - RNA, 22 nt, Homo sapiens
accaccauugcacugaacuuuc

SEQ ID NO: 183602 - RNA, 22 nt, Homo sapiens
acccuggauucguggccuugaa

SEQ ID NO: 183603 - RNA, 22 nt, Homo sapiens
acccuguaacauacaagugguu

SEQ ID NO: 183604 - RNA, 22 nt, Homo sapiens
acccuguaggugcuggcagaga

SEQ ID NO: 183605 - RNA, 22 nt, Homo sapiens
accuguagcagacuuaauauuu

SEQ ID NO: 183606 - RNA, 22 nt, Homo sapiens
acugacaugaucaggcauguuc

SEQ ID NO: 183607 - RNA, 22 nt, Homo sapiens
acugcauuugucugucucaauu

SEQ ID NO: 183608 - RNA, 22 nt, Homo sapiens
acuggacuuaaugaugaauugu

SEQ ID NO: 183609 - RNA, 22 nt, Homo sapiens
acuggaguuuguucaagaaaua

SEQ ID NO: 183610 - RNA, 22 nt, Homo sapiens
acugggauauuauugguaauau

SEQ ID NO: 183611 - RNA, 22 nt, Homo sapiens
acuuuuugauggggagaacauu

SEQ ID NO: 183612 - RNA, 22 nt, Homo sapiens
acuuuuugcaaccauuuggacc

SEQ ID NO: 183613 - RNA, 22 nt, Homo sapiens
agaaagcgcuucccuuugcugg

SEQ ID NO: 183614 - RNA, 22 nt, Homo sapiens
agacagcugggaaauggagugu

SEQ ID NO: 183615 - RNA, 22 nt, Homo sapiens
agacaguguguguauauauggu

SEQ ID NO: 183616 - RNA, 22 nt, Homo sapiens
agaguauagcaacuuaguaaaa

SEQ ID NO: 183617 - RNA, 22 nt, Homo sapiens
agaugccuaugaagagaaauua

SEQ ID NO: 183618 - RNA, 22 nt, Homo sapiens
agauggguuuucacauguuggc

SEQ ID NO: 183619 - RNA, 22 nt, Homo sapiens
agcaacauuguucauaauagcu

SEQ ID NO: 183620 - RNA, 19 nt, Homo sapiens
agcagaacaaauguguggg

SEQ ID NO: 183621 - RNA, 20 nt, Homo sapiens
agcagccacagauuccucag

SEQ ID NO: 183622 - RNA, 22 nt, Homo sapiens
agcaguagugaaaguagacuua

SEQ ID NO: 183623 - RNA, 22 nt, Homo sapiens
agcaucaugcaguugcuauuca

SEQ ID NO: 183624 - RNA, 17 nt, Homo sapiens
agcauguguuugagauu

SEQ ID NO: 183625 - RNA, 22 nt, Homo sapiens
agccaagacucuguuccccuug

SEQ ID NO: 183626 - RNA, 22 nt, Homo sapiens
agcuccuuugcuuuuuccagga

SEQ ID NO: 183627 - RNA, 22 nt, Homo sapiens
agcuggcuguagcugcaagucu

SEQ ID NO: 183628 - RNA, 22 nt, Homo sapiens
agcugguccugugacuugcuuc

SEQ ID NO: 183629 - RNA, 22 nt, Homo sapiens
auugcacuccagccugggcaac

SEQ ID NO: 183630 - RNA, 21 nt, Homo sapiens
auugcacuccagccugggcga

SEQ ID NO: 183631 - RNA, 22 nt, Homo sapiens
auugcacuccagccugggcgac

SEQ ID NO: 183632 - RNA, 22 nt, Homo sapiens
auugcacuccagccuuggggau

SEQ ID NO: 183633 - RNA, 22 nt, Homo sapiens
auugcacuccagucugggcaac

SEQ ID NO: 183634 - RNA, 22 nt, Homo sapiens
auugcacuccauccuaggugac

SEQ ID NO: 183635 - RNA, 22 nt, Homo sapiens
auugcacuccggccugggugac

SEQ ID NO: 183636 - RNA, 18 nt, Homo sapiens
auugcacuccugccuggg

SEQ ID NO: 183637 - RNA, 22 nt, Homo sapiens
auugcacucuagccuuggcgac

SEQ ID NO: 183638 - RNA, 22 nt, Homo sapiens
auugcccaggcuggagugcagu

SEQ ID NO: 183639 - RNA, 22 nt, Homo sapiens
auuguacuccagccuaggcaac

SEQ ID NO: 183640 - RNA, 22 nt, Homo sapiens
auuuagcaauggagguagugua

SEQ ID NO: 183641 - RNA, 19 nt, Homo sapiens
auuugaucaucaggcacag

SEQ ID NO: 183642 - RNA, 22 nt, Homo sapiens
auuugguugggugcgguggcuu

SEQ ID NO: 183643 - RNA, 22 nt, Homo sapiens
auuuugguuacauaguugagcu

SEQ ID NO: 183644 - RNA, 22 nt, Homo sapiens
caaaggugcuuuccagguccaa

SEQ ID NO: 183645 - RNA, 22 nt, Homo sapiens
caaaugacaucauuucauucaa

SEQ ID NO: 183646 - RNA, 22 nt, Homo sapiens
cacagagugagacccugucucu

SEQ ID NO: 183647 - RNA, 22 nt, Homo sapiens
cacagugaaugucaucauugcc

SEQ ID NO: 183648 - RNA, 22 nt, Homo sapiens
cacauguucaggagcacuuaga

SEQ ID NO: 183649 - RNA, 22 nt, Homo sapiens
cacauguuuuagcauggcuguu

SEQ ID NO: 183650 - RNA, 22 nt, Homo sapiens
cacauugcaggaaaguucauua

SEQ ID NO: 183651 - RNA, 22 nt, Homo sapiens
cacugcaguggaagauuaagaa

SEQ ID NO: 183652 - RNA, 22 nt, Homo sapiens
cacugcauccuugaccuucugg

SEQ ID NO: 183653 - RNA, 22 nt, Homo sapiens
cacugcauucuccaccucccag

SEQ ID NO: 183654 - RNA, 22 nt, Homo sapiens
cacuuugguucaccugaguuuc

SEQ ID NO: 183655 - RNA, 22 nt, Homo sapiens
cagaaguauugguaugcucugu

SEQ ID NO: 183656 - RNA, 22 nt, Homo sapiens
cagagcacugauacuggguucu

SEQ ID NO: 183657 - RNA, 22 nt, Homo sapiens
cagcuguuguuaugucugcagg

SEQ ID NO: 183658 - RNA, 22 nt, Homo sapiens
cagguacaugcaugugugugca

SEQ ID NO: 183659 - RNA, 22 nt, Homo sapiens
caguaaauaucugagcgagguc

SEQ ID NO: 183660 - RNA, 22 nt, Homo sapiens
caguacaauguggaaaaggagu

SEQ ID NO: 183661 - RNA, 22 nt, Homo sapiens
cagugguuuucucaguucagca

SEQ ID NO: 183662 - RNA, 22 nt, Homo sapiens
caguucaugguaggcaccauag

SEQ ID NO: 183663 - RNA, 22 nt, Homo sapiens
caucacuuugccuccgucucua

SEQ ID NO: 183664 - RNA, 22 nt, Homo sapiens
cauggagcuaggcuugaucccu

SEQ ID NO: 183665 - RNA, 22 nt, Homo sapiens
cauggcccugggcugggcgaac

SEQ ID NO: 183666 - RNA, 22 nt, Homo sapiens
cauggcccuggguccauaggaa

SEQ ID NO: 183667 - RNA, 22 nt, Homo sapiens
cauugcacuccauccuuggcaa

SEQ ID NO: 183668 - RNA, 22 nt, Homo sapiens
cauuggugauuagugaaugaac

SEQ ID NO: 183669 - RNA, 22 nt, Homo sapiens
ccaaaucucauguugaaaugug

SEQ ID NO: 183670 - RNA, 22 nt, Homo sapiens
ccacacugucuuggugggaaac

SEQ ID NO: 183671 - RNA, 22 nt, Homo sapiens
ccaccuguacuuaagucacuuu

SEQ ID NO: 183672 - RNA, 22 nt, Homo sapiens
ccaggguugcuuuagauucuga

SEQ ID NO: 183673 - RNA, 22 nt, Homo sapiens
ccaguauuuuauugaggguuuu

SEQ ID NO: 183674 - RNA, 20 nt, Homo sapiens
ccaguguuauuuauguucua

SEQ ID NO: 183675 - RNA, 22 nt, Homo sapiens
ccauugcacuccauccugggca

SEQ ID NO: 183676 - RNA, 22 nt, Homo sapiens
cccagugugaacuuggcauuuu

SEQ ID NO: 183677 - RNA, 22 nt, Homo sapiens
cccaguguuuauuuugagccaa

SEQ ID NO: 183678 - RNA, 22 nt, Homo sapiens
ccccagugguugcaacagcaga

SEQ ID NO: 183679 - RNA, 22 nt, Homo sapiens
ccccaguguguaaaggccuugc

SEQ ID NO: 183680 - RNA, 17 nt, Homo sapiens
ccccugagcgaugcagu

SEQ ID NO: 183681 - RNA, 22 nt, Homo sapiens
ccuaggcacugggguccagccc

SEQ ID NO: 183682 - RNA, 22 nt, Homo sapiens
ccucauggagaacaucugcuag

SEQ ID NO: 183683 - RNA, 22 nt, Homo sapiens
ccugagacgaauggagugaaca

SEQ ID NO: 183684 - RNA, 22 nt, Homo sapiens
ccuucauucauuaauuuagccc

SEQ ID NO: 183685 - RNA, 22 nt, Homo sapiens
ccuugcacuucccaggugaggc

SEQ ID NO: 183686 - RNA, 22 nt, Homo sapiens
cuaaagauagugacaugauuug

SEQ ID NO: 183687 - RNA, 22 nt, Homo sapiens
cuaaaugucucuacuaaguuua

SEQ ID NO: 183688 - RNA, 22 nt, Homo sapiens
cuacaguaugaaaccuuuacuc

SEQ ID NO: 183689 - RNA, 22 nt, Homo sapiens
cuacaguucucaggaguuggcc

SEQ ID NO: 183690 - RNA, 22 nt, Homo sapiens
cuacugcacaucaucugaguua

SEQ ID NO: 183691 - RNA, 22 nt, Homo sapiens
cuaggcuguagagaaguucagu

SEQ ID NO: 183692 - RNA, 22 nt, Homo sapiens
cuauauacugccugcugauuag

SEQ ID NO: 183693 - RNA, 22 nt, Homo sapiens
cuauggcagccacggccuggag

SEQ ID NO: 183694 - RNA, 21 nt, Homo sapiens
cucaaaguacugauauuacag

SEQ ID NO: 183695 - RNA, 22 nt, Homo sapiens
cucacagugacacgaaccccca

SEQ ID NO: 183696 - RNA, 22 nt, Homo sapiens
cucacuaguaaggcuguuuagu

SEQ ID NO: 183697 - RNA, 22 nt, Homo sapiens
cucagcuacuugagaggcuuag

SEQ ID NO: 183698 - RNA, 22 nt, Homo sapiens
cucagcuacuugggaagcugag

SEQ ID NO: 183699 - RNA, 22 nt, Homo sapiens
cuccacugagcaggugggaggc

SEQ ID NO: 183700 - RNA, 22 nt, Homo sapiens
cucccagagccaguuauaggcu

SEQ ID NO: 183701 - RNA, 22 nt, Homo sapiens
cucccagugacccaggaacagg

SEQ ID NO: 183702 - RNA, 20 nt, Homo sapiens
cucccugacaaauguggaaa

SEQ ID NO: 183703 - RNA, 22 nt, Homo sapiens
cuccuguagccccaucaucuuu

SEQ ID NO: 183704 - RNA, 22 nt, Homo sapiens
cucugcuuaaugucccacuuga

SEQ ID NO: 183705 - RNA, 22 nt, Homo sapiens
cugaaagagcauguaacacagu

SEQ ID NO: 183706 - RNA, 22 nt, Homo sapiens
cugaagugcuugccacauaaaa

SEQ ID NO: 183707 - RNA, 22 nt, Homo sapiens
cugaggauauucagccucugug

SEQ ID NO: 183708 - RNA, 22 nt, Homo sapiens
cugaggugauauauacauauuu

SEQ ID NO: 183709 - RNA, 22 nt, Homo sapiens
cugaggugggagaaucacauaa

SEQ ID NO: 183710 - RNA, 22 nt, Homo sapiens
cugagugcaagugauccuccca

SEQ ID NO: 183711 - RNA, 22 nt, Homo sapiens
cugauuguuugccucuaaaauc

SEQ ID NO: 183712 - RNA, 20 nt, Homo sapiens
cugcacauccacucuacuuc

SEQ ID NO: 183713 - RNA, 22 nt, Homo sapiens
cugcacugagacccucuuugcu

SEQ ID NO: 183714 - RNA, 22 nt, Homo sapiens
cugccaguuugauucgggccac

SEQ ID NO: 183715 - RNA, 22 nt, Homo sapiens
cuggauguaaaugaaacuacag

SEQ ID NO: 183716 - RNA, 18 nt, Homo sapiens
cuggaugucgaguguguu

SEQ ID NO: 183717 - RNA, 22 nt, Homo sapiens
cuggcaccauacacuguuguug

SEQ ID NO: 183718 - RNA, 21 nt, Homo sapiens
cugguguuagcacuucuuccc

SEQ ID NO: 183719 - RNA, 22 nt, Homo sapiens
cugucuguuucaaaagugguua

SEQ ID NO: 183720 - RNA, 22 nt, Homo sapiens
cugugguuuaaggaauuuugac

SEQ ID NO: 183721 - RNA, 22 nt, Homo sapiens
cuuaggguacuuuggugcauca

SEQ ID NO: 183722 - RNA, 21 nt, Homo sapiens
uggaugccuaggcagaaguuu

SEQ ID NO: 183723 - RNA, 22 nt, Homo sapiens
uggcagcgcaguugaaaaagaa

SEQ ID NO: 183724 - RNA, 19 nt, Homo sapiens
uggcuagagcagauauccu

SEQ ID NO: 183725 - RNA, 22 nt, Homo sapiens
uggcuuuucauccugggacauu

SEQ ID NO: 183726 - RNA, 22 nt, Homo sapiens
ugggaugaugaaaaggcuuucu

SEQ ID NO: 183727 - RNA, 22 nt, Homo sapiens
ugggcaagagagcaugacccug

SEQ ID NO: 183728 - RNA, 22 nt, Homo sapiens
ugggucaguagcauguaugucu

SEQ ID NO: 183729 - RNA, 22 nt, Homo sapiens
ugguguuugagaagcugauguc

SEQ ID NO: 183730 - RNA, 23 nt, Homo sapiens
uguaaaagcauuugucagccugg

SEQ ID NO: 183731 - RNA, 20 nt, Homo sapiens
uguaaaggagauugcagcug

SEQ ID NO: 183732 - RNA, 20 nt, Homo sapiens
uguaaucuaaguuuuaagcc

SEQ ID NO: 183733 - RNA, 23 nt, Homo sapiens
uguauacacccugugcaucuggg

SEQ ID NO: 183734 - RNA, 22 nt, Homo sapiens
uguauguaauugaaguuaaguu

SEQ ID NO: 183735 - RNA, 22 nt, Homo sapiens
ugucagggaggcucggccgcac

SEQ ID NO: 183736 - RNA, 22 nt, Homo sapiens
ugucauguagaaauuguccauu

SEQ ID NO: 183737 - RNA, 22 nt, Homo sapiens
ugucaugucuuuguguaucaau

SEQ ID NO: 183738 - RNA, 22 nt, Homo sapiens
ugucaugugagggaacuuguuc

SEQ ID NO: 183739 - RNA, 22 nt, Homo sapiens
ugucucaguuucuguggguuag

SEQ ID NO: 183740 - RNA, 22 nt, Homo sapiens
ugucuuggagaauccuggguuu

SEQ ID NO: 183741 - RNA, 22 nt, Homo sapiens
ugucuuguagacaauguauagu

SEQ ID NO: 183742 - RNA, 22 nt, Homo sapiens
ugugaacagaauuagucaccua

SEQ ID NO: 183743 - RNA, 22 nt, Homo sapiens
ugugaccaaaaucaacauaccu

SEQ ID NO: 183744 - RNA, 19 nt, Homo sapiens
ugugagcauuagcauuuag

SEQ ID NO: 183745 - RNA, 22 nt, Homo sapiens
ugugauuauuuauagacaguca

SEQ ID NO: 183746 - RNA, 22 nt, Homo sapiens
ugugcaaauguuaaacuaacuu

SEQ ID NO: 183747 - RNA, 22 nt, Homo sapiens
ugugcaaucagcuucauuacau

SEQ ID NO: 183748 - RNA, 22 nt, Homo sapiens
ugugcacaaccugcagguuugu

SEQ ID NO: 183749 - RNA, 22 nt, Homo sapiens
ugugcacaauguacagguuagu

SEQ ID NO: 183750 - RNA, 22 nt, Homo sapiens
ugugcacaugauauaucacaua

SEQ ID NO: 183751 - RNA, 22 nt, Homo sapiens
uguggcugguggcaccuuuucc

SEQ ID NO: 183752 - RNA, 18 nt, Homo sapiens
uguggcuguuuuccaaua

SEQ ID NO: 183753 - RNA, 22 nt, Homo sapiens
ugugguuuuuuucuccaauagg

SEQ ID NO: 183754 - RNA, 22 nt, Homo sapiens
ugugucuuuuaucacacaaugu

SEQ ID NO: 183755 - RNA, 22 nt, Homo sapiens
uguuauuuuguguuagggcaca

SEQ ID NO: 183756 - RNA, 22 nt, Homo sapiens
uuaaaguguuugcagacaggug

SEQ ID NO: 183757 - RNA, 22 nt, Homo sapiens
uuaaaugcuagaauuuucuuug

SEQ ID NO: 183758 - RNA, 21 nt, Homo sapiens
uuaacagacaagugucuuccc

SEQ ID NO: 183759 - RNA, 22 nt, Homo sapiens
uuaagcaguaguuaaggagagg

SEQ ID NO: 183760 - RNA, 22 nt, Homo sapiens
uuaagcuaguuuauucaggaaa

SEQ ID NO: 183761 - RNA, 22 nt, Homo sapiens
uuacacaguugguaggggcaga

SEQ ID NO: 183762 - RNA, 17 nt, Homo sapiens
uuacaggugcugagagu

SEQ ID NO: 183763 - RNA, 22 nt, Homo sapiens
uuacaguagaugaggguauaau

SEQ ID NO: 183764 - RNA, 23 nt, Homo sapiens
uuacaguggcaugaucucugcuc

SEQ ID NO: 183765 - RNA, 22 nt, Homo sapiens
uuacaguucugguggagaggua

SEQ ID NO: 183766 - RNA, 21 nt, Homo sapiens
uuacaguugguugugaggugg

SEQ ID NO: 183767 - RNA, 22 nt, Homo sapiens
uuagaguguagcaggaagaggc

SEQ ID NO: 183768 - RNA, 22 nt, Homo sapiens
uuagaugaagucacagaaccca

SEQ ID NO: 183769 - RNA, 22 nt, Homo sapiens
uuagauuauugagcauccacug

SEQ ID NO: 183770 - RNA, 22 nt, Homo sapiens
uuagauuauugguguuuugcaa

SEQ ID NO: 183771 - RNA, 22 nt, Homo sapiens
uuauguguuuaauguuucugaa

SEQ ID NO: 183772 - RNA, 22 nt, Homo sapiens
uucaaguagguaggaccacagg

SEQ ID NO: 183773 - RNA, 22 nt, Homo sapiens
uucacagucacccuucuccaug

SEQ ID NO: 183774 - RNA, 22 nt, Homo sapiens
uucacugugaacucauauucag

SEQ ID NO: 183775 - RNA, 22 nt, Homo sapiens
uucagggacuuuagacaagaga

SEQ ID NO: 183776 - RNA, 22 nt, Homo sapiens
uucaguggguggaugaauauga

SEQ ID NO: 183777 - RNA, 22 nt, Homo sapiens
uucaguucugcucugaucuuag

SEQ ID NO: 183778 - RNA, 22 nt, Homo sapiens
uucauacaguggcugcacucca

SEQ ID NO: 183779 - RNA, 18 nt, Homo sapiens
uucaucaguccucagcug

SEQ ID NO: 183780 - RNA, 22 nt, Homo sapiens
uucaugcaucuguagugguuaa

SEQ ID NO: 183781 - RNA, 22 nt, Homo sapiens
uucauggaauauugaccauuuu

SEQ ID NO: 183782 - RNA, 22 nt, Homo sapiens
uuccacaaugguugaacuagcu

SEQ ID NO: 183783 - RNA, 22 nt, Homo sapiens
uucccagugguuagcucugguc

SEQ ID NO: 183784 - RNA, 22 nt, Homo sapiens
uuccugucuuccaagagagauu

SEQ ID NO: 183785 - RNA, 20 nt, Homo sapiens
uuccuuaggcauuggaagaa

SEQ ID NO: 183786 - RNA, 22 nt, Homo sapiens
uucugagguuauauucucucaa

SEQ ID NO: 183787 - RNA, 22 nt, Homo sapiens
uucugcuugaucuaguguguug

SEQ ID NO: 183788 - RNA, 22 nt, Homo sapiens
uucuggccuccauuuuucuccu

SEQ ID NO: 183789 - RNA, 22 nt, Homo sapiens
uucuggcuuuuaaagaaauguu

SEQ ID NO: 183790 - RNA, 22 nt, Homo sapiens
uucuugaggcaugccgcuggga

SEQ ID NO: 183791 - RNA, 22 nt, Homo sapiens
uucuugcacugaucccauaagc

SEQ ID NO: 183792 - RNA, 22 nt, Homo sapiens
uugaaagaugaacuggauugga

SEQ ID NO: 183793 - RNA, 22 nt, Homo sapiens
uugaacuagaaccugcaaauuu

SEQ ID NO: 183794 - RNA, 22 nt, Homo sapiens
uugacaaggagccauugcaucu

SEQ ID NO: 183795 - RNA, 22 nt, Homo sapiens
uugagaguggcagagguggaac

SEQ ID NO: 183796 - RNA, 22 nt, Homo sapiens
uugaggugaauuugcaggaugc

SEQ ID NO: 183797 - RNA, 20 nt, Homo sapiens
uugaggugugaggggcagag

SEQ ID NO: 183798 - RNA, 22 nt, Homo sapiens
uugagugaaugaaugauuaaau

SEQ ID NO: 183799 - RNA, 22 nt, Homo sapiens
uugauauuaaguacugaagugg

SEQ ID NO: 183800 - RNA, 22 nt, Homo sapiens
uugcacuccagccugggugaca

SEQ ID NO: 183801 - RNA, 22 nt, Homo sapiens
uugcacuccggccuggguaaca

SEQ ID NO: 183802 - RNA, 22 nt, Homo sapiens
uugccuuuguuggaaacaagug

SEQ ID NO: 183803 - RNA, 22 nt, Homo sapiens
uuggaaauguguuugcauucag

SEQ ID NO: 183804 - RNA, 22 nt, Homo sapiens
uuggaaggcuccuaaugaaugg

SEQ ID NO: 183805 - RNA, 22 nt, Homo sapiens
uuggauugugaaaguauucucu

SEQ ID NO: 183806 - RNA, 22 nt, Homo sapiens
uuggcuuuuaugcagcuuaggu

SEQ ID NO: 183807 - RNA, 17 nt, Homo sapiens
uugggcaagguagguga

SEQ ID NO: 183808 - RNA, 23 nt, Homo sapiens
uuggucucccaaaguguugagau

SEQ ID NO: 183809 - RNA, 22 nt, Homo sapiens
uugugucccuacccaaaucuca

SEQ ID NO: 183810 - RNA, 22 nt, Homo sapiens
uuuaaguguuuguuccugaaaa

SEQ ID NO: 183811 - RNA, 22 nt, Homo sapiens
uuuagcucauucaauuucaguc

SEQ ID NO: 183812 - RNA, 22 nt, Homo sapiens
uuuccaguuggaaagccuguuu

SEQ ID NO: 183813 - RNA, 22 nt, Homo sapiens
uuucccagugguacaguuuaua

SEQ ID NO: 183814 - RNA, 22 nt, Homo sapiens
uuucuacagugaacgauuucua

SEQ ID NO: 183815 - RNA, 22 nt, Homo sapiens
uuucuuggagcucuuagggucg

SEQ ID NO: 183816 - RNA, 22 nt, Homo sapiens
gaucugagaaagugucauaaca

SEQ ID NO: 183817 - RNA, 22 nt, Homo sapiens
gaugacagcugacucccuugcu

SEQ ID NO: 183818 - RNA, 22 nt, Homo sapiens
gauuuguuggccugugagcuag

SEQ ID NO: 183819 - RNA, 22 nt, Homo sapiens
gcaaagaaugcagauuugccuc

SEQ ID NO: 183820 - RNA, 22 nt, Homo sapiens
gcaaaugcuaugccauuuuaua

SEQ ID NO: 183821 - RNA, 21 nt, Homo sapiens
gcaaguacuaucaucauuauc

SEQ ID NO: 183822 - RNA, 22 nt, Homo sapiens
gcagaauugguuucuucuaagg

SEQ ID NO: 183823 - RNA, 22 nt, Homo sapiens
gcagaguauagagggcugggcc

SEQ ID NO: 183824 - RNA, 22 nt, Homo sapiens
gcaggauuggagccucucugaa

SEQ ID NO: 183825 - RNA, 22 nt, Homo sapiens
gcagugaugugaucauagcuca

SEQ ID NO: 183826 - RNA, 20 nt, Homo sapiens
gcaguguucacuguauuccu

SEQ ID NO: 183827 - RNA, 22 nt, Homo sapiens
gcauggccuuuaaaugucacag

SEQ ID NO: 183828 - RNA, 18 nt, Homo sapiens
gccaacauguaaacaggu

SEQ ID NO: 183829 - RNA, 17 nt, Homo sapiens
gcccuuugugccucuuc

SEQ ID NO: 183830 - RNA, 22 nt, Homo sapiens
gccucaguuguggccagggauu

SEQ ID NO: 183831 - RNA, 19 nt, Homo sapiens
gcugauguuacauucuugc

SEQ ID NO: 183832 - RNA, 22 nt, Homo sapiens
gcugauguugaccuugaucacc

SEQ ID NO: 183833 - RNA, 22 nt, Homo sapiens
gcugauguuuucagguaauucu

SEQ ID NO: 183834 - RNA, 22 nt, Homo sapiens
gcuggucugccguaguaggugc

SEQ ID NO: 183835 - RNA, 22 nt, Homo sapiens
gcuguguguuaucagaaauugc

SEQ ID NO: 183836 - RNA, 19 nt, Homo sapiens
gcuuuguggggaaggagcc

SEQ ID NO: 183837 - RNA, 22 nt, Homo sapiens
ggaaagcuagguguggguguac

SEQ ID NO: 183838 - RNA, 22 nt, Homo sapiens
ggaagaauaaugggccuuagag

SEQ ID NO: 183839 - RNA, 22 nt, Homo sapiens
ggaaguuaauacagauagagua

SEQ ID NO: 183840 - RNA, 22 nt, Homo sapiens
ggacaaaguauuuucaaaugua

SEQ ID NO: 183841 - RNA, 22 nt, Homo sapiens
ggaguguguaggagaaagguaa

SEQ ID NO: 183842 - RNA, 22 nt, Homo sapiens
ggcaaagagacaugcaucgggg

SEQ ID NO: 183843 - RNA, 21 nt, Homo sapiens
ggcaagaaacacaaucaagua

SEQ ID NO: 183844 - RNA, 22 nt, Homo sapiens
ggcaaggaggggcacuuucacu

SEQ ID NO: 183845 - RNA, 22 nt, Homo sapiens
ggcaaguugcuauucuuuaaug

SEQ ID NO: 183846 - RNA, 22 nt, Homo sapiens
ggcacuguggcucaagccugua

SEQ ID NO: 183847 - RNA, 19 nt, Homo sapiens
ggcacugugugagugagga

SEQ ID NO: 183848 - RNA, 22 nt, Homo sapiens
ggcagcauugccuuugcaguga

SEQ ID NO: 183849 - RNA, 22 nt, Homo sapiens
gggaguagagaguuucucugac

SEQ ID NO: 183850 - RNA, 22 nt, Homo sapiens
gguauuauuugccuuuuacuga

SEQ ID NO: 183851 - RNA, 22 nt, Homo sapiens
ggucaggagaaugguaacugag

SEQ ID NO: 183852 - RNA, 19 nt, Homo sapiens
ggucccucucaagucauuc

SEQ ID NO: 183853 - RNA, 22 nt, Homo sapiens
ggucuuggagaauuguccuggg

SEQ ID NO: 183854 - RNA, 22 nt, Homo sapiens
ggugagaaaaacauagucucag

SEQ ID NO: 183855 - RNA, 22 nt, Homo sapiens
ggugcuugaggaacggaggcug

SEQ ID NO: 183856 - RNA, 22 nt, Homo sapiens
guaaucucagcuacuugggagg

SEQ ID NO: 183857 - RNA, 22 nt, Homo sapiens
guaaucucagcuucuugggagg

SEQ ID NO: 183858 - RNA, 22 nt, Homo sapiens
guacaggcagcaaacaccauaa

SEQ ID NO: 183859 - RNA, 22 nt, Homo sapiens
guacaguacugaaugaauguau

SEQ ID NO: 183860 - RNA, 22 nt, Homo sapiens
guacaugugcacagugugcagg

SEQ ID NO: 183861 - RNA, 22 nt, Homo sapiens
guagaauguauacaguauacag

SEQ ID NO: 183862 - RNA, 22 nt, Homo sapiens
guagaauguauguauaacgcaa

SEQ ID NO: 183863 - RNA, 22 nt, Homo sapiens
gucagucugucccugccuggcg

SEQ ID NO: 183864 - RNA, 22 nt, Homo sapiens
gucaucaggacgggucaucugc

SEQ ID NO: 183865 - RNA, 22 nt, Homo sapiens
gucauucauucagcaagcacug

SEQ ID NO: 183866 - RNA, 22 nt, Homo sapiens
gucuggagacuugggucaucaa

SEQ ID NO: 183867 - RNA, 22 nt, Homo sapiens
gucuggcuuaucucacuuacca

SEQ ID NO: 183868 - RNA, 22 nt, Homo sapiens
gucuuggagacauugccauuga

SEQ ID NO: 183869 - RNA, 22 nt, Homo sapiens
gugaaauauuuaacguccaggu

SEQ ID NO: 183870 - RNA, 22 nt, Homo sapiens
gugaaaugaaacgcuaugucuu

SEQ ID NO: 183871 - RNA, 22 nt, Homo sapiens
gugaaguuuuuugcugagaguc

SEQ ID NO: 183872 - RNA, 22 nt, Homo sapiens
gugagaagaaaaauauggcugu

SEQ ID NO: 183873 - RNA, 22 nt, Homo sapiens
gugagacugguccugaacccag

SEQ ID NO: 183874 - RNA, 22 nt, Homo sapiens
gugauguguuucaacagcuccu

SEQ ID NO: 183875 - RNA, 20 nt, Homo sapiens
gugauuggucacugguuguu

SEQ ID NO: 183876 - RNA, 22 nt, Homo sapiens
gugcauauaaguuguuucuagu

SEQ ID NO: 183877 - RNA, 22 nt, Homo sapiens
guggaucacuugaggucaagag

SEQ ID NO: 183878 - RNA, 21 nt, Homo sapiens
gugguucuagagaaacagaau

SEQ ID NO: 183879 - RNA, 22 nt, Homo sapiens
gugguucuagagggacagaaug

SEQ ID NO: 183880 - RNA, 22 nt, Homo sapiens
guguaacaacagcacuccacug

SEQ ID NO: 183881 - RNA, 22 nt, Homo sapiens
gugugcaacuuucauuaauauu

SEQ ID NO: 183882 - RNA, 20 nt, Homo sapiens
guucauguaauuaguucagg

SEQ ID NO: 183883 - RNA, 22 nt, Homo sapiens
guucuggagauaaagccaaggu

SEQ ID NO: 183884 - RNA, 18 nt, Homo sapiens
guugagcuuuuccuuuag

SEQ ID NO: 183885 - RNA, 22 nt, Homo sapiens
guuggcaaguggcugagcuggg

SEQ ID NO: 183886 - RNA, 22 nt, Homo sapiens
guugguuuccuguaacuggaca

SEQ ID NO: 183887 - RNA, 22 nt, Homo sapiens
uaaacugucuuuggagcuuugc

SEQ ID NO: 183888 - RNA, 22 nt, Homo sapiens
uaaagaugcugggaaggcuagg

SEQ ID NO: 183889 - RNA, 21 nt, Homo sapiens
uaaaugucauacaaagcaaug

SEQ ID NO: 183890 - RNA, 22 nt, Homo sapiens
uaacauugucuugcuuaguuuu

SEQ ID NO: 183891 - RNA, 22 nt, Homo sapiens
uaacauuguugauuauacuaag

SEQ ID NO: 183892 - RNA, 22 nt, Homo sapiens
uaaggcuuaugguaaaguccug

SEQ ID NO: 183893 - RNA, 22 nt, Homo sapiens
uaaguaauuguuaauagggaag

SEQ ID NO: 183894 - RNA, 22 nt, Homo sapiens
uaagugguguucauucuuuuga

SEQ ID NO: 183895 - RNA, 22 nt, Homo sapiens
uaaguuguagaacguuuucuua

SEQ ID NO: 183896 - RNA, 22 nt, Homo sapiens
uaaugcuguggucugguuuaaa

SEQ ID NO: 183897 - RNA, 22 nt, Homo sapiens
uacaauagugacaaaucagcau

SEQ ID NO: 183898 - RNA, 22 nt, Homo sapiens
uacaggauagacaauuuauuaa

SEQ ID NO: 183899 - RNA, 22 nt, Homo sapiens
uacaguauuaugagugauugaa

SEQ ID NO: 183900 - RNA, 22 nt, Homo sapiens
uacagucacauuccugaccaua

SEQ ID NO: 183901 - RNA, 22 nt, Homo sapiens
uacagucuagaggagaaucagg

SEQ ID NO: 183902 - RNA, 22 nt, Homo sapiens
uacauacuucacagacuuuaaa

SEQ ID NO: 183903 - RNA, 22 nt, Homo sapiens
uaccagugaauuccaggggcua

SEQ ID NO: 183904 - RNA, 19 nt, Homo sapiens
uacccagaagcagcauugu

SEQ ID NO: 183905 - RNA, 22 nt, Homo sapiens
uaccuguagacuacagcuucag

SEQ ID NO: 183906 - RNA, 22 nt, Homo sapiens
uacucugcagccauaaaacaga

SEQ ID NO: 183907 - RNA, 21 nt, Homo sapiens
uacuggagauacagucugcaa

SEQ ID NO: 183908 - RNA, 22 nt, Homo sapiens
uacuucauucuugaccuugcau

SEQ ID NO: 183909 - RNA, 23 nt, Homo sapiens
ccacacuguuuagaauggcauca

SEQ ID NO: 183910 - RNA, 22 nt, Homo sapiens
ccacagucuaugcaacaagguc

SEQ ID NO: 183911 - RNA, 20 nt, Homo sapiens
ccagcaucauuagauucugg

SEQ ID NO: 183912 - RNA, 22 nt, Homo sapiens
ccagucuuggugucuguagcac

SEQ ID NO: 183913 - RNA, 22 nt, Homo sapiens
ccagugauuguauggugaaggu

SEQ ID NO: 183914 - RNA, 22 nt, Homo sapiens
ccagugguucccuguggccuga

SEQ ID NO: 183915 - RNA, 22 nt, Homo sapiens
ccaguuuucaagauaaugguuu

SEQ ID NO: 183916 - RNA, 22 nt, Homo sapiens
ccaucccuuucugagcaguucc

SEQ ID NO: 183917 - RNA, 22 nt, Homo sapiens
ccauugaacaugaaggaaugug

SEQ ID NO: 183918 - RNA, 22 nt, Homo sapiens
ccauuucacucuuccugaagga

SEQ ID NO: 183919 - RNA, 22 nt, Homo sapiens
cccagaguucuuaaauacugag

SEQ ID NO: 183920 - RNA, 21 nt, Homo sapiens
cccagguucucugaggguaga

SEQ ID NO: 183921 - RNA, 22 nt, Homo sapiens
cccagugugcugggugacagcu

SEQ ID NO: 183922 - RNA, 22 nt, Homo sapiens
ccccuguaucucagcgucuuca

SEQ ID NO: 183923 - RNA, 22 nt, Homo sapiens
cccugagaaaacuuuguccuua

SEQ ID NO: 183924 - RNA, 22 nt, Homo sapiens
cccuguagcagcauucuuaaau

SEQ ID NO: 183925 - RNA, 22 nt, Homo sapiens
ccugagacuugagggggcuucu

SEQ ID NO: 183926 - RNA, 22 nt, Homo sapiens
ccuggaagaaaggugcuaaaua

SEQ ID NO: 183927 - RNA, 23 nt, Homo sapiens
ccuguagaaugucugugauacuu

SEQ ID NO: 183928 - RNA, 22 nt, Homo sapiens
ccuuuguggggcgguggguaau

SEQ ID NO: 183929 - RNA, 22 nt, Homo sapiens
cgaggaguaucuuugugguguu

SEQ ID NO: 183930 - RNA, 22 nt, Homo sapiens
cuaaaguagccaggacugcagg

SEQ ID NO: 183931 - RNA, 22 nt, Homo sapiens
cuaagugaguauaauuuuaaga

SEQ ID NO: 183932 - RNA, 22 nt, Homo sapiens
cuacaguagagaggauguagaa

SEQ ID NO: 183933 - RNA, 22 nt, Homo sapiens
cuacaguuauguuuuaaaugug

SEQ ID NO: 183934 - RNA, 22 nt, Homo sapiens
cuacugacacuacugcaaucau

SEQ ID NO: 183935 - RNA, 22 nt, Homo sapiens
cuacugauuaaaagaacagguc

SEQ ID NO: 183936 - RNA, 22 nt, Homo sapiens
cuagcuuuugauguaaagugag

SEQ ID NO: 183937 - RNA, 22 nt, Homo sapiens
cuaggcacugauaguuguauuu

SEQ ID NO: 183938 - RNA, 22 nt, Homo sapiens
cucaauuuggaauugucaguaa

SEQ ID NO: 183939 - RNA, 22 nt, Homo sapiens
cucacaguucuaaaggcaagaa

SEQ ID NO: 183940 - RNA, 22 nt, Homo sapiens
cucaguguuaaggccaccucug

SEQ ID NO: 183941 - RNA, 22 nt, Homo sapiens
cuccagugcaaagucaugauca

SEQ ID NO: 183942 - RNA, 22 nt, Homo sapiens
cucugagguuauucguaauauu

SEQ ID NO: 183943 - RNA, 22 nt, Homo sapiens
cugaaagagcauuugaaugggu

SEQ ID NO: 183944 - RNA, 22 nt, Homo sapiens
cugacagaugacugccacugua

SEQ ID NO: 183945 - RNA, 22 nt, Homo sapiens
cugaccucugucaaagacaccc

SEQ ID NO: 183946 - RNA, 22 nt, Homo sapiens
cugagagaugagaccucucacu

SEQ ID NO: 183947 - RNA, 22 nt, Homo sapiens
cugagcaaagaagugauaauga

SEQ ID NO: 183948 - RNA, 22 nt, Homo sapiens
cugaggaaguucuuuaacaguu

SEQ ID NO: 183949 - RNA, 22 nt, Homo sapiens
cugaggguagaaggaucacuug

SEQ ID NO: 183950 - RNA, 20 nt, Homo sapiens
cugaggugggagaaucgcuu

SEQ ID NO: 183951 - RNA, 22 nt, Homo sapiens
cugaggugggaggauuacuuga

SEQ ID NO: 183952 - RNA, 22 nt, Homo sapiens
cugcauuugaugacguauggug

SEQ ID NO: 183953 - RNA, 22 nt, Homo sapiens
cuggaaagcaaagggugcauug

SEQ ID NO: 183954 - RNA, 22 nt, Homo sapiens
cuggaauguuccuaaagauuca

SEQ ID NO: 183955 - RNA, 22 nt, Homo sapiens
cuggagauuaaccaauugccau

SEQ ID NO: 183956 - RNA, 22 nt, Homo sapiens
cuggaggccugaacauaaaugg

SEQ ID NO: 183957 - RNA, 22 nt, Homo sapiens
cugggaucaguucuagucagaa

SEQ ID NO: 183958 - RNA, 22 nt, Homo sapiens
cuggugugugacuuuucauuau

SEQ ID NO: 183959 - RNA, 22 nt, Homo sapiens
cuguaaagaucacagagcuggu

SEQ ID NO: 183960 - RNA, 22 nt, Homo sapiens
uagaauggaagguugagaagaa

SEQ ID NO: 183961 - RNA, 22 nt, Homo sapiens
uagaccauucuauuuccuaugc

SEQ ID NO: 183962 - RNA, 22 nt, Homo sapiens
uagacugguuuagcacugaaua

SEQ ID NO: 183963 - RNA, 21 nt, Homo sapiens
uagcaaauugcuauuaaggca

SEQ ID NO: 183964 - RNA, 20 nt, Homo sapiens
uagcacacauguagaauagu

SEQ ID NO: 183965 - RNA, 22 nt, Homo sapiens
uagcacagugucauucuaggua

SEQ ID NO: 183966 - RNA, 22 nt, Homo sapiens
uagcaggaaaggggucagaucu

SEQ ID NO: 183967 - RNA, 22 nt, Homo sapiens
uaggcuuuucugggaugugggc

SEQ ID NO: 183968 - RNA, 22 nt, Homo sapiens
uagguauguauauacacacaca

SEQ ID NO: 183969 - RNA, 22 nt, Homo sapiens
uaguuauggaguaauuuuaagc

SEQ ID NO: 183970 - RNA, 22 nt, Homo sapiens
uaucaagauggauaaggauaga

SEQ ID NO: 183971 - RNA, 21 nt, Homo sapiens
uaucacaguagaauaggaucu

SEQ ID NO: 183972 - RNA, 22 nt, Homo sapiens
uaucagcagagucauacuucaa

SEQ ID NO: 183973 - RNA, 22 nt, Homo sapiens
uaucucagaguguacaagauua

SEQ ID NO: 183974 - RNA, 22 nt, Homo sapiens
uaugaaagcuacuucucacaau

SEQ ID NO: 183975 - RNA, 20 nt, Homo sapiens
uaugaccugucuuuucucuc

SEQ ID NO: 183976 - RNA, 22 nt, Homo sapiens
uaugaccuuggacaaguuacuu

SEQ ID NO: 183977 - RNA, 22 nt, Homo sapiens
uaugaccuuguccccucucgcc

SEQ ID NO: 183978 - RNA, 22 nt, Homo sapiens
uaugacugagacuuaaauugug

SEQ ID NO: 183979 - RNA, 22 nt, Homo sapiens
uaugagacugguuaauuuuugu

SEQ ID NO: 183980 - RNA, 22 nt, Homo sapiens
uaugcacaugcaugcuugaaua

SEQ ID NO: 183981 - RNA, 22 nt, Homo sapiens
uauggauuuuuuugacaagagc

SEQ ID NO: 183982 - RNA, 22 nt, Homo sapiens
uauggccugcguccagugguau

SEQ ID NO: 183983 - RNA, 22 nt, Homo sapiens
uauuacagaccauaucgccggg

SEQ ID NO: 183984 - RNA, 20 nt, Homo sapiens
uauuacagaguaauggugga

SEQ ID NO: 183985 - RNA, 22 nt, Homo sapiens
uauugcauauuauucuaguggc

SEQ ID NO: 183986 - RNA, 22 nt, Homo sapiens
ucaagcaauucuccugccucag

SEQ ID NO: 183987 - RNA, 22 nt, Homo sapiens
ucaaguacugccuugcucuggc

SEQ ID NO: 183988 - RNA, 22 nt, Homo sapiens
ucaaguagugacucgaguuauu

SEQ ID NO: 183989 - RNA, 22 nt, Homo sapiens
ucacacgugaacucaucacaga

SEQ ID NO: 183990 - RNA, 19 nt, Homo sapiens
ucacacuguggcuucuuua

SEQ ID NO: 183991 - RNA, 22 nt, Homo sapiens
ucacagaggagaagaccuuuaa

SEQ ID NO: 183992 - RNA, 21 nt, Homo sapiens
ucacagccuaggaccugaaga

SEQ ID NO: 183993 - RNA, 22 nt, Homo sapiens
ucacagccuaguuuuauacauu

SEQ ID NO: 183994 - RNA, 22 nt, Homo sapiens
ucacaucucagguuucuugaca

SEQ ID NO: 183995 - RNA, 21 nt, Homo sapiens
ucaccuguugcgaugaagcug

SEQ ID NO: 183996 - RNA, 22 nt, Homo sapiens
ucacugggagcauuugagccuu

SEQ ID NO: 183997 - RNA, 22 nt, Homo sapiens
ucagguaaucuauuugucuuuu

SEQ ID NO: 183998 - RNA, 20 nt, Homo sapiens
ucagguagaucuuugagguc

SEQ ID NO: 183999 - RNA, 22 nt, Homo sapiens
ucaguaaaugcuguucucuuuu

SEQ ID NO: 184000 - RNA, 23 nt, Homo sapiens
ucaguacucuauaagugccagcu

SEQ ID NO: 184001 - RNA, 22 nt, Homo sapiens
ucagugaauguuggccacuacu

SEQ ID NO: 184002 - RNA, 21 nt, Homo sapiens
ucagugcugugggcaaggugc

SEQ ID NO: 184003 - RNA, 22 nt, Homo sapiens
ucaugcaaugagucaggaggca

SEQ ID NO: 184004 - RNA, 22 nt, Homo sapiens
ucaugguuuuauaacccucuug

SEQ ID NO: 184005 - RNA, 22 nt, Homo sapiens
ucauucauuugcucacuccaca

SEQ ID NO: 184006 - RNA, 22 nt, Homo sapiens
ucauugguugcguaauuugauu

SEQ ID NO: 184007 - RNA, 22 nt, Homo sapiens
uccauggagacacauuuuauau

SEQ ID NO: 184008 - RNA, 22 nt, Homo sapiens
uccccuuuguaagauggaaacg

SEQ ID NO: 184009 - RNA, 22 nt, Homo sapiens
ucccugagcaaaguuuucugua

SEQ ID NO: 184010 - RNA, 19 nt, Homo sapiens
ucccugagucuuagcuuga

SEQ ID NO: 184011 - RNA, 22 nt, Homo sapiens
ucccuggagcaagagaagaagg

SEQ ID NO: 184012 - RNA, 19 nt, Homo sapiens
ucccuguagaccacagugc

SEQ ID NO: 184013 - RNA, 22 nt, Homo sapiens
ucccuguagugccuagaucaga

SEQ ID NO: 184014 - RNA, 22 nt, Homo sapiens
uccugagaauagaguugcaugu

SEQ ID NO: 184015 - RNA, 22 nt, Homo sapiens
uccuugagccucccagacucag

SEQ ID NO: 184016 - RNA, 22 nt, Homo sapiens
uccuuggucaaaaagaaagugu

SEQ ID NO: 184017 - RNA, 23 nt, Homo sapiens
ucgcagcauucaauaccaggcag

SEQ ID NO: 184018 - RNA, 22 nt, Homo sapiens
ucucacagaguugaauguuucu

SEQ ID NO: 184019 - RNA, 22 nt, Homo sapiens
ucucagugugguaaaaguuuuu

SEQ ID NO: 184020 - RNA, 22 nt, Homo sapiens
ucugagcaugcaucuugccugg

SEQ ID NO: 184021 - RNA, 22 nt, Homo sapiens
uuguugcacugcuuuccuggcc

SEQ ID NO: 184022 - RNA, 22 nt, Homo sapiens
uuuaaugcgucucugaguuuug

SEQ ID NO: 184023 - RNA, 22 nt, Homo sapiens
uuuaauguuacaguauugguau

SEQ ID NO: 184024 - RNA, 22 nt, Homo sapiens
uuuaucaggccuuuggaaaaau

SEQ ID NO: 184025 - RNA, 22 nt, Homo sapiens
uuuaugguuuucugggagauug

SEQ ID NO: 184026 - RNA, 23 nt, Homo sapiens
uuucacaguagcuggaucagccu

SEQ ID NO: 184027 - RNA, 15 nt, Homo sapiens
uuucaguacagauuc

SEQ ID NO: 184028 - RNA, 20 nt, Homo sapiens
uuucaguacuuucuacuggc

SEQ ID NO: 184029 - RNA, 19 nt, Homo sapiens
uuuccaguaaucuuaugug

SEQ ID NO: 184030 - RNA, 22 nt, Homo sapiens
uuuccuguaggaaggaaauaga

SEQ ID NO: 184031 - RNA, 22 nt, Homo sapiens
uuugaaccauuugaagaaugau

SEQ ID NO: 184032 - RNA, 22 nt, Homo sapiens
uuugagcauuagggcaaaggca

SEQ ID NO: 184033 - RNA, 22 nt, Homo sapiens
uuugauguugauacuaccuuca

SEQ ID NO: 184034 - RNA, 22 nt, Homo sapiens
uuugcacauauuugggcaaaag

SEQ ID NO: 184035 - RNA, 22 nt, Homo sapiens
uuugcacuggagauucaauggg

SEQ ID NO: 184036 - RNA, 22 nt, Homo sapiens
uuugcacuuuaauauaauguga

SEQ ID NO: 184037 - RNA, 22 nt, Homo sapiens
uuugcacuuuuguaauaugguu

SEQ ID NO: 184038 - RNA, 22 nt, Homo sapiens
uuugucacucuuggagguuguu

SEQ ID NO: 184039 - RNA, 22 nt, Homo sapiens
uuuguggaaugcccuuauuuau

SEQ ID NO: 184040 - RNA, 22 nt, Homo sapiens
uuugugugugauuauaaaaggu

SEQ ID NO: 184041 - RNA, 22 nt, Homo sapiens
uuuguuugaagucgagacaacu

SEQ ID NO: 184042 - RNA, 20 nt, Homo sapiens
uuuugaacuuggcaaccugu

SEQ ID NO: 184043 - RNA, 21 nt, Homo sapiens
uuuuggucauucaggaagaaa

SEQ ID NO: 184044 - RNA, 22 nt, Homo sapiens
uuuugugacuauuguaaauggg

SEQ ID NO: 184045 - RNA, 22 nt, Homo sapiens
uuuuugauuaauggguagacca

SEQ ID NO: 184046 - RNA, 21 nt, Homo sapiens
uuuuugguggucauggauaga

SEQ ID NO: 184047 - RNA, 22 nt, Homo sapiens
uuuuuuaguuagcugggcauga

SEQ ID NO: 184048 - RNA, 21 nt, Homo sapiens
auuccacuuuuccuucaggga

SEQ ID NO: 184049 - RNA, 22 nt, Homo sapiens
auugaacuuacuaucuaaacua

SEQ ID NO: 184050 - RNA, 22 nt, Homo sapiens
auugaauuugguuugcuaagaa

SEQ ID NO: 184051 - RNA, 22 nt, Homo sapiens
auugcacuccagccuggcagca

SEQ ID NO: 184052 - RNA, 22 nt, Homo sapiens
auugcacuccagccuggccaac

SEQ ID NO: 184053 - RNA, 22 nt, Homo sapiens
auugcacuccagccuggggaac

SEQ ID NO: 184054 - RNA, 22 nt, Homo sapiens
auugcacuccagccugggugag

SEQ ID NO: 184055 - RNA, 22 nt, Homo sapiens
auugcacuccagcuuaggcgac

SEQ ID NO: 184056 - RNA, 22 nt, Homo sapiens
auugcacucuaaccuaggugac

SEQ ID NO: 184057 - RNA, 22 nt, Homo sapiens
auugcacucugaucugcacucc

SEQ ID NO: 184058 - RNA, 22 nt, Homo sapiens
auugcacugcagccugggcaac

SEQ ID NO: 184059 - RNA, 22 nt, Homo sapiens
auugcucagucagggagcucgg

SEQ ID NO: 184060 - RNA, 19 nt, Homo sapiens
auuuccuggagcuggucuc

SEQ ID NO: 184061 - RNA, 22 nt, Homo sapiens
auuuggguuuuacaucaggcua

SEQ ID NO: 184062 - RNA, 22 nt, Homo sapiens
auuugucacuauguggcuaaua

SEQ ID NO: 184063 - RNA, 22 nt, Homo sapiens
auuuuuggauauagggaaggau

SEQ ID NO: 184064 - RNA, 22 nt, Homo sapiens
auuuuugguugucagcacuagg

SEQ ID NO: 184065 - RNA, 22 nt, Homo sapiens
caaaagugguucuuauccuuuu

SEQ ID NO: 184066 - RNA, 22 nt, Homo sapiens
caaaugcuucuauggacugucu

SEQ ID NO: 184067 - RNA, 19 nt, Homo sapiens
caacccugcagagaaagga

SEQ ID NO: 184068 - RNA, 22 nt, Homo sapiens
cacaaaguagauuagucuucca

SEQ ID NO: 184069 - RNA, 23 nt, Homo sapiens
cacagggugaacaccccuaaucc

SEQ ID NO: 184070 - RNA, 22 nt, Homo sapiens
cacagugaacaauauccucugu

SEQ ID NO: 184071 - RNA, 22 nt, Homo sapiens
caccuguagucccagcugaggc

SEQ ID NO: 184072 - RNA, 22 nt, Homo sapiens
cacugcauuacucaugagcaug

SEQ ID NO: 184073 - RNA, 20 nt, Homo sapiens
cagagcaaagcaguccuggc

SEQ ID NO: 184074 - RNA, 22 nt, Homo sapiens
cagcacauagcaguugcucagu

SEQ ID NO: 184075 - RNA, 22 nt, Homo sapiens
caggcuuuuccacacauggguu

SEQ ID NO: 184076 - RNA, 22 nt, Homo sapiens
cagggaauguuauuuaauagca

SEQ ID NO: 184077 - RNA, 22 nt, Homo sapiens
caguagcaugccucagaaugag

SEQ ID NO: 184078 - RNA, 22 nt, Homo sapiens
caguaguagccccuuagaugga

SEQ ID NO: 184079 - RNA, 22 nt, Homo sapiens
cagucacagugacaggaugugg

SEQ ID NO: 184080 - RNA, 20 nt, Homo sapiens
caucaccuggcaggauuugu

SEQ ID NO: 184081 - RNA, 22 nt, Homo sapiens
caucagagugagauauaagauc

SEQ ID NO: 184082 - RNA, 22 nt, Homo sapiens
caugaaagugagaaacuccugg

SEQ ID NO: 184083 - RNA, 22 nt, Homo sapiens
cauggccuuuggaaugugucua

SEQ ID NO: 184084 - RNA, 22 nt, Homo sapiens
cauggcuuguauaagauucuca

SEQ ID NO: 184085 - RNA, 22 nt, Homo sapiens
cauggcuuuaagcaacaccaag

SEQ ID NO: 184086 - RNA, 22 nt, Homo sapiens
cauugcacuccagccugaguga

SEQ ID NO: 184087 - RNA, 22 nt, Homo sapiens
cauugcacuccagccuuggcaa

SEQ ID NO: 184088 - RNA, 22 nt, Homo sapiens
cauugcaugcauauggcuuggu

SEQ ID NO: 184089 - RNA, 22 nt, Homo sapiens
cauugcccuccagccugggcaa

SEQ ID NO: 184090 - RNA, 22 nt, Homo sapiens
ccaguauugaacacaaugaaag

SEQ ID NO: 184091 - RNA, 22 nt, Homo sapiens
ccaguguucuggaaggcugagu

SEQ ID NO: 184092 - RNA, 22 nt, Homo sapiens
ccaguuuucucacuguugcagu

SEQ ID NO: 184093 - RNA, 20 nt, Homo sapiens
ccaucaguccucucuuguuc

SEQ ID NO: 184094 - RNA, 22 nt, Homo sapiens
cccaguguuacgugacagccug

SEQ ID NO: 184095 - RNA, 22 nt, Homo sapiens
ccccuguaaacuggcuucccug

SEQ ID NO: 184096 - RNA, 22 nt, Homo sapiens
cccugaagaaagccuaggacau

SEQ ID NO: 184097 - RNA, 22 nt, Homo sapiens
cccugagagcagggucuuucuc

SEQ ID NO: 184098 - RNA, 22 nt, Homo sapiens
cccuguguuguucaaggaucug

SEQ ID NO: 184099 - RNA, 22 nt, Homo sapiens
cccuugcacuucagagcugcau

SEQ ID NO: 184100 - RNA, 22 nt, Homo sapiens
ccuggguuacaggugugagcca

SEQ ID NO: 184101 - RNA, 22 nt, Homo sapiens
ccugucuugauuaaauuacuua

SEQ ID NO: 184102 - RNA, 22 nt, Homo sapiens
ccuugcacuucccaagugaggc

SEQ ID NO: 184103 - RNA, 22 nt, Homo sapiens
cgcccuguagcuagcuagaggu

SEQ ID NO: 184104 - RNA, 22 nt, Homo sapiens
cuaaaguauugagugguaaaga

SEQ ID NO: 184105 - RNA, 22 nt, Homo sapiens
cuaaagugcugagauuauaggu

SEQ ID NO: 184106 - RNA, 21 nt, Homo sapiens
cuaaggaaagcuaugaacccu

SEQ ID NO: 184107 - RNA, 22 nt, Homo sapiens
cuaauacaguuguccaagcugg

SEQ ID NO: 184108 - RNA, 22 nt, Homo sapiens
cuacagguaugaaagggaguau

SEQ ID NO: 184109 - RNA, 22 nt, Homo sapiens
cuacaguucuuaauuaaguagu

SEQ ID NO: 184110 - RNA, 21 nt, Homo sapiens
cuacccuguauuagagaaaga

SEQ ID NO: 184111 - RNA, 22 nt, Homo sapiens
cuagaagcauauucagaacaga

SEQ ID NO: 184112 - RNA, 22 nt, Homo sapiens
cucaaaguacuuugguuauugu

SEQ ID NO: 184113 - RNA, 22 nt, Homo sapiens
cucaaagugcuaagauuaggcu

SEQ ID NO: 184114 - RNA, 22 nt, Homo sapiens
cucaaagugcugggacuggcug

SEQ ID NO: 184115 - RNA, 22 nt, Homo sapiens
cucaaagugcugggauuggcca

SEQ ID NO: 184116 - RNA, 22 nt, Homo sapiens
cucaaguaauccucccgccuug

SEQ ID NO: 184117 - RNA, 22 nt, Homo sapiens
cucaaguacaugggauuacagg

SEQ ID NO: 184118 - RNA, 22 nt, Homo sapiens
cucacagucagaagggacuugc

SEQ ID NO: 184119 - RNA, 22 nt, Homo sapiens
cucacagucucucccuaauuuu

SEQ ID NO: 184120 - RNA, 22 nt, Homo sapiens
cucacugggaccacucugaagu

SEQ ID NO: 184121 - RNA, 20 nt, Homo sapiens
cucagguauuugaggcugca

SEQ ID NO: 184122 - RNA, 22 nt, Homo sapiens
cucucaagaugcugggauuaca

SEQ ID NO: 184123 - RNA, 21 nt, Homo sapiens
cucucugcuuaugaauaguga

SEQ ID NO: 184124 - RNA, 22 nt, Homo sapiens
cucugguuuuucuuccauuaag

SEQ ID NO: 184125 - RNA, 22 nt, Homo sapiens
cugaaucauugcauuaucaagg

SEQ ID NO: 184126 - RNA, 22 nt, Homo sapiens
cugaauguucuauagaagccgc

SEQ ID NO: 184127 - RNA, 22 nt, Homo sapiens
cugacauuguugaucacagcca

SEQ ID NO: 184128 - RNA, 22 nt, Homo sapiens
cugaccauagacuacucugggc

SEQ ID NO: 184129 - RNA, 22 nt, Homo sapiens
cugaggugggaggauuggcuug

SEQ ID NO: 184130 - RNA, 22 nt, Homo sapiens
cugaggugggaguuuuucucau

SEQ ID NO: 184131 - RNA, 22 nt, Homo sapiens
cugauugugcagagguguaauu

SEQ ID NO: 184132 - RNA, 22 nt, Homo sapiens
cugauuuguccccagccucaug

SEQ ID NO: 184133 - RNA, 22 nt, Homo sapiens
cugcaaauacuugugggauuuu

SEQ ID NO: 184134 - RNA, 22 nt, Homo sapiens
cugcauuagucuguuuaguguu

SEQ ID NO: 184135 - RNA, 22 nt, Homo sapiens
cugccacugacaccucaaggac

SEQ ID NO: 184136 - RNA, 18 nt, Homo sapiens
cugccagugugcucuccg

SEQ ID NO: 184137 - RNA, 22 nt, Homo sapiens
cuggaaaguagacaaucuaaaa

SEQ ID NO: 184138 - RNA, 22 nt, Homo sapiens
cuggaaggaaaaacaaccacag

SEQ ID NO: 184139 - RNA, 22 nt, Homo sapiens
cuggaaugugagccccaaaaag

SEQ ID NO: 184140 - RNA, 22 nt, Homo sapiens
ugugaugauuugauaaacguau

SEQ ID NO: 184141 - RNA, 22 nt, Homo sapiens
ugugcacaacgugcagguuugu

SEQ ID NO: 184142 - RNA, 22 nt, Homo sapiens
ugugcacaaugugcagguuuga

SEQ ID NO: 184143 - RNA, 22 nt, Homo sapiens
uguggaaauuguuguauuuaau

SEQ ID NO: 184144 - RNA, 22 nt, Homo sapiens
uguggcauuuucagaaaggaug

SEQ ID NO: 184145 - RNA, 22 nt, Homo sapiens
uguguaauaccuuugacuauau

SEQ ID NO: 184146 - RNA, 21 nt, Homo sapiens
uguuaacaugcagauuacugg

SEQ ID NO: 184147 - RNA, 22 nt, Homo sapiens
uguuugcuuaacguggagccag

SEQ ID NO: 184148 - RNA, 22 nt, Homo sapiens
uguuuguuugugauacgguaca

SEQ ID NO: 184149 - RNA, 22 nt, Homo sapiens
uuaagcaaagguaacaugagaa

SEQ ID NO: 184150 - RNA, 22 nt, Homo sapiens
uuaauguaauugauugauugac

SEQ ID NO: 184151 - RNA, 22 nt, Homo sapiens
uuaauuguccauuauucuguuc

SEQ ID NO: 184152 - RNA, 22 nt, Homo sapiens
uuacagcagugccccacuccca

SEQ ID NO: 184153 - RNA, 22 nt, Homo sapiens
uuacagguggagaaguaaggcu

SEQ ID NO: 184154 - RNA, 22 nt, Homo sapiens
uuacaguaugaguaagaguucu

SEQ ID NO: 184155 - RNA, 22 nt, Homo sapiens
uuagaaaguagaaaagcugguu

SEQ ID NO: 184156 - RNA, 22 nt, Homo sapiens
uuagaauggaaaugcgagguua

SEQ ID NO: 184157 - RNA, 22 nt, Homo sapiens
uuagacaguggugcacugcacu

SEQ ID NO: 184158 - RNA, 22 nt, Homo sapiens
uuagagcacugaucugcucuuu

SEQ ID NO: 184159 - RNA, 22 nt, Homo sapiens
uuagcaauagccugcaucugca

SEQ ID NO: 184160 - RNA, 19 nt, Homo sapiens
uuauacuguauuguuuagg

SEQ ID NO: 184161 - RNA, 22 nt, Homo sapiens
uuauggccauucuuguaggagu

SEQ ID NO: 184162 - RNA, 22 nt, Homo sapiens
uuauuguccaaguuucccuuug

SEQ ID NO: 184163 - RNA, 22 nt, Homo sapiens
uucaaaaccucugcuuaagccc

SEQ ID NO: 184164 - RNA, 22 nt, Homo sapiens
uucaagaauuaaaguggcuuuu

SEQ ID NO: 184165 - RNA, 22 nt, Homo sapiens
uucaaguaguucucaugccuca

SEQ ID NO: 184166 - RNA, 22 nt, Homo sapiens
uucaagugguucagaagucuga

SEQ ID NO: 184167 - RNA, 22 nt, Homo sapiens
uucacagccgcaccccaucacu

SEQ ID NO: 184168 - RNA, 22 nt, Homo sapiens
uucacaguacucccuggaauua

SEQ ID NO: 184169 - RNA, 22 nt, Homo sapiens
uucacaguggugggagacguca

SEQ ID NO: 184170 - RNA, 22 nt, Homo sapiens
uucaccuggaguucaggauaag

SEQ ID NO: 184171 - RNA, 23 nt, Homo sapiens
uucaccugguuauuaauagccuc

SEQ ID NO: 184172 - RNA, 22 nt, Homo sapiens
uucacuggagcccaggaguugg

SEQ ID NO: 184173 - RNA, 22 nt, Homo sapiens
uucagaguggacagaaauuaag

SEQ ID NO: 184174 - RNA, 22 nt, Homo sapiens
uucagcuacuuggaaacagcaa

SEQ ID NO: 184175 - RNA, 22 nt, Homo sapiens
uucagcuacuugggaggcugaa

SEQ ID NO: 184176 - RNA, 22 nt, Homo sapiens
uucaguucugcacugaucuuag

SEQ ID NO: 184177 - RNA, 22 nt, Homo sapiens
uucaucagggguauuggccaau

SEQ ID NO: 184178 - RNA, 22 nt, Homo sapiens
uucaucaguugagcugguugcu

SEQ ID NO: 184179 - RNA, 22 nt, Homo sapiens
uucauggaguugagaaggcuaa

SEQ ID NO: 184180 - RNA, 22 nt, Homo sapiens
uucauggugguacaaaagcaau

SEQ ID NO: 184181 - RNA, 22 nt, Homo sapiens
uucccagagaaaaggguuucuu

SEQ ID NO: 184182 - RNA, 22 nt, Homo sapiens
uucccagagagggacuucuaau

SEQ ID NO: 184183 - RNA, 22 nt, Homo sapiens
uucccaguaaacucuaucccuc

SEQ ID NO: 184184 - RNA, 22 nt, Homo sapiens
uucccaguggaacauguaguca

SEQ ID NO: 184185 - RNA, 22 nt, Homo sapiens
uucccuguaucuucugccaugu

SEQ ID NO: 184186 - RNA, 22 nt, Homo sapiens
uuccuaguccugagucucugcg

SEQ ID NO: 184187 - RNA, 22 nt, Homo sapiens
uucuggcuaugggauacuaaau

SEQ ID NO: 184188 - RNA, 22 nt, Homo sapiens
uucuggcucgauucucugaccg

SEQ ID NO: 184189 - RNA, 22 nt, Homo sapiens
uucuugcacuuaacugacauuc

SEQ ID NO: 184190 - RNA, 22 nt, Homo sapiens
uucuugcuguauccucacaugg

SEQ ID NO: 184191 - RNA, 22 nt, Homo sapiens
uucuuugcaugaucucaaaguc

SEQ ID NO: 184192 - RNA, 22 nt, Homo sapiens
uugaagguagaaguucucaauu

SEQ ID NO: 184193 - RNA, 22 nt, Homo sapiens
uugaaguagaaagacgaaauuu

SEQ ID NO: 184194 - RNA, 23 nt, Homo sapiens
uugacuguggguacaaugugaua

SEQ ID NO: 184195 - RNA, 22 nt, Homo sapiens
uugagaaucuuucgaauguucu

SEQ ID NO: 184196 - RNA, 22 nt, Homo sapiens
uugagagaaaaaauuuauuggu

SEQ ID NO: 184197 - RNA, 22 nt, Homo sapiens
uugagagaaaaggccaugccuu

SEQ ID NO: 184198 - RNA, 22 nt, Homo sapiens
uugaggaggcagucuucccauu

SEQ ID NO: 184199 - RNA, 22 nt, Homo sapiens
uugagguggugucuugcucugu

SEQ ID NO: 184200 - RNA, 22 nt, Homo sapiens
uugaguagugugaugcaugucu

SEQ ID NO: 184201 - RNA, 22 nt, Homo sapiens
uugauauauugcaugggcuacu

SEQ ID NO: 184202 - RNA, 22 nt, Homo sapiens
uugauuuguagaaugccccaac

SEQ ID NO: 184203 - RNA, 22 nt, Homo sapiens
uugcacuccagccuuggggaga

SEQ ID NO: 184204 - RNA, 22 nt, Homo sapiens
uugcacuccagcucgggugaca

SEQ ID NO: 184205 - RNA, 22 nt, Homo sapiens
uugcacuccagcucuaggugac

SEQ ID NO: 184206 - RNA, 18 nt, Homo sapiens
uugcacuccugccugggu

SEQ ID NO: 184207 - RNA, 22 nt, Homo sapiens
uugcacucugaagaccuacugu

SEQ ID NO: 184208 - RNA, 22 nt, Homo sapiens
aggcuuuuguuuuggucucagg

SEQ ID NO: 184209 - RNA, 22 nt, Homo sapiens
agggcuuuugagcugagauggu

SEQ ID NO: 184210 - RNA, 21 nt, Homo sapiens
aggugucuuggguucccuggc

SEQ ID NO: 184211 - RNA, 22 nt, Homo sapiens
agguuaacaucuauuuuggaug

SEQ ID NO: 184212 - RNA, 22 nt, Homo sapiens
aguccaguguuaugaucaguag

SEQ ID NO: 184213 - RNA, 22 nt, Homo sapiens
agugagcugcagucuggggucc

SEQ ID NO: 184214 - RNA, 22 nt, Homo sapiens
agugcaauggcgugaucuuggc

SEQ ID NO: 184215 - RNA, 22 nt, Homo sapiens
agugcauugagacuugugaguu

SEQ ID NO: 184216 - RNA, 23 nt, Homo sapiens
agugccuaguauauaggaggcgc

SEQ ID NO: 184217 - RNA, 22 nt, Homo sapiens
aguggauguuguggccugggag

SEQ ID NO: 184218 - RNA, 22 nt, Homo sapiens
aaaagucuguagugaaagguga

SEQ ID NO: 184219 - RNA, 22 nt, Homo sapiens
aaaccaccauuacuuuugcacc

SEQ ID NO: 184220 - RNA, 20 nt, Homo sapiens
aaacucugucuucuuuauca

SEQ ID NO: 184221 - RNA, 22 nt, Homo sapiens
aaagcacuggagucaucaucua

SEQ ID NO: 184222 - RNA, 22 nt, Homo sapiens
aaaggcuucggaucagaaggua

SEQ ID NO: 184223 - RNA, 22 nt, Homo sapiens
aaagugauguccaggcuuucag

SEQ ID NO: 184224 - RNA, 22 nt, Homo sapiens
aaagugcugagucuaggcgggg

SEQ ID NO: 184225 - RNA, 22 nt, Homo sapiens
aaagugcugggauuuuaggcau

SEQ ID NO: 184226 - RNA, 22 nt, Homo sapiens
aaaguucuguugauagugcuga

SEQ ID NO: 184227 - RNA, 22 nt, Homo sapiens
aaaugcaccacucuggugcagg

SEQ ID NO: 184228 - RNA, 22 nt, Homo sapiens
aaaugcugucaaauuguguucu

SEQ ID NO: 184229 - RNA, 22 nt, Homo sapiens
aaauggcuuugaggguaggaca

SEQ ID NO: 184230 - RNA, 22 nt, Homo sapiens
aaauucaugucaccucuaggua

SEQ ID NO: 184231 - RNA, 23 nt, Homo sapiens
aaauuugccuauuauuccuaugg

SEQ ID NO: 184232 - RNA, 22 nt, Homo sapiens
aacaccauuuuucugcagccuu

SEQ ID NO: 184233 - RNA, 22 nt, Homo sapiens
aacaguaucuaacgagugauga

SEQ ID NO: 184234 - RNA, 22 nt, Homo sapiens
aacagugcauucagggauauau

SEQ ID NO: 184235 - RNA, 19 nt, Homo sapiens
aacuggugugagaugguau

SEQ ID NO: 184236 - RNA, 22 nt, Homo sapiens
aagaguuaguaaaauuuccucu

SEQ ID NO: 184237 - RNA, 19 nt, Homo sapiens
aagaugauguuugggcuaa

SEQ ID NO: 184238 - RNA, 22 nt, Homo sapiens
aagccacuguaccugucucuua

SEQ ID NO: 184239 - RNA, 22 nt, Homo sapiens
aagcuaccauuuguauauaaag

SEQ ID NO: 184240 - RNA, 22 nt, Homo sapiens
aagcugccaggcaugguggcug

SEQ ID NO: 184241 - RNA, 22 nt, Homo sapiens
aagcugccuugcugaggagaaa

SEQ ID NO: 184242 - RNA, 22 nt, Homo sapiens
aagcugguguugcugcucuguu

SEQ ID NO: 184243 - RNA, 22 nt, Homo sapiens
aaggcgguguggauccuacagc

SEQ ID NO: 184244 - RNA, 22 nt, Homo sapiens
aaggcuagagaagaagggcauc

SEQ ID NO: 184245 - RNA, 22 nt, Homo sapiens
aaguaaaucuuaugucagggag

SEQ ID NO: 184246 - RNA, 22 nt, Homo sapiens
aaguacuguuuaaauugcagaa

SEQ ID NO: 184247 - RNA, 22 nt, Homo sapiens
aagucauggaggaguaugugag

SEQ ID NO: 184248 - RNA, 22 nt, Homo sapiens
aagugcaaaucuguggcugaaa

SEQ ID NO: 184249 - RNA, 22 nt, Homo sapiens
aagugguagggucaggauugga

SEQ ID NO: 184250 - RNA, 21 nt, Homo sapiens
aauacucuagguuaagagagc

SEQ ID NO: 184251 - RNA, 22 nt, Homo sapiens
aauacugaaaguauuuucaaau

SEQ ID NO: 184252 - RNA, 22 nt, Homo sapiens
aauagcuguccuuagaagugug

SEQ ID NO: 184253 - RNA, 22 nt, Homo sapiens
aaucccuggacuuucggaggcu

SEQ ID NO: 184254 - RNA, 22 nt, Homo sapiens
aaucucagcauuuugggcugag

SEQ ID NO: 184255 - RNA, 22 nt, Homo sapiens
aauggcaucuacguuaaauguc

SEQ ID NO: 184256 - RNA, 22 nt, Homo sapiens
acaggugaaguauuacacuaag

SEQ ID NO: 184257 - RNA, 22 nt, Homo sapiens
acagugacagaaagcugauuau

SEQ ID NO: 184258 - RNA, 22 nt, Homo sapiens
acaguguuccuuuguugugacu

SEQ ID NO: 184259 - RNA, 22 nt, Homo sapiens
acaugguacugauuuacgaaau

SEQ ID NO: 184260 - RNA, 22 nt, Homo sapiens
acccaguguugggcagaacugu

SEQ ID NO: 184261 - RNA, 22 nt, Homo sapiens
accccauuugcacugagcccuu

SEQ ID NO: 184262 - RNA, 22 nt, Homo sapiens
acccucaagggacugacagaau

SEQ ID NO: 184263 - RNA, 22 nt, Homo sapiens
acccucagaccaguuucccugg

SEQ ID NO: 184264 - RNA, 22 nt, Homo sapiens
accucagcccggggaaguugag

SEQ ID NO: 184265 - RNA, 22 nt, Homo sapiens
accugagauuacaggugcuggc

SEQ ID NO: 184266 - RNA, 22 nt, Homo sapiens
accuguauaacaagugggaaau

SEQ ID NO: 184267 - RNA, 23 nt, Homo sapiens
accugugguuauuuuacucuucc

SEQ ID NO: 184268 - RNA, 22 nt, Homo sapiens
acgcagcacauucacagcuaug

SEQ ID NO: 184269 - RNA, 22 nt, Homo sapiens
acuccauuucauuuuagcucuu

SEQ ID NO: 184270 - RNA, 22 nt, Homo sapiens
acugaauguaaacacggagugu

SEQ ID NO: 184271 - RNA, 23 nt, Homo sapiens
acugagcaauguuuacauacuug

SEQ ID NO: 184272 - RNA, 22 nt, Homo sapiens
acuggguuaauuugaagguuga

SEQ ID NO: 184273 - RNA, 21 nt, Homo sapiens
acuuucuguggcaguccauuc

SEQ ID NO: 184274 - RNA, 22 nt, Homo sapiens
agagauaauuagguuaaaugag

SEQ ID NO: 184275 - RNA, 22 nt, Homo sapiens
agagauaguuuccaacucauac

SEQ ID NO: 184276 - RNA, 22 nt, Homo sapiens
agagauuauccuggcuucucug

SEQ ID NO: 184277 - RNA, 22 nt, Homo sapiens
agagguaagaauaguaguugga

SEQ ID NO: 184278 - RNA, 22 nt, Homo sapiens
agagugaagcuuuuuauauucu

SEQ ID NO: 184279 - RNA, 22 nt, Homo sapiens
agauauguuuaguuucaaaaug

SEQ ID NO: 184280 - RNA, 22 nt, Homo sapiens
agauauuuguuaggucugucag

SEQ ID NO: 184281 - RNA, 22 nt, Homo sapiens
agaugcauugguggcauauuca

SEQ ID NO: 184282 - RNA, 22 nt, Homo sapiens
agcaacaucagcagcaggaaaa

SEQ ID NO: 184283 - RNA, 22 nt, Homo sapiens
agcacagccuuguguuuucuug

SEQ ID NO: 184284 - RNA, 23 nt, Homo sapiens
agcaccuuuccuccacuaucugc

SEQ ID NO: 184285 - RNA, 22 nt, Homo sapiens
agcagcauuaguggaaucuugu

SEQ ID NO: 184286 - RNA, 22 nt, Homo sapiens
agcaggauuguuacaauaguaa

SEQ ID NO: 184287 - RNA, 22 nt, Homo sapiens
agcaucauguuuucgagguuca

SEQ ID NO: 184288 - RNA, 22 nt, Homo sapiens
agcuggaauuuaagguagauag

SEQ ID NO: 184289 - RNA, 22 nt, Homo sapiens
agcuggucuacguguguaugag

SEQ ID NO: 184290 - RNA, 22 nt, Homo sapiens
agcuuuuugggcagcuauugac

SEQ ID NO: 184291 - RNA, 22 nt, Homo sapiens
aggaagcuagcauuuguucagu

SEQ ID NO: 184292 - RNA, 22 nt, Homo sapiens
aggcaaguugcucaaaugcaaa

SEQ ID NO: 184293 - RNA, 22 nt, Homo sapiens
aggcaggugaaagauaguuuua

SEQ ID NO: 184294 - RNA, 22 nt, Homo sapiens
aggcagucucugccggcugagg

SEQ ID NO: 184295 - RNA, 22 nt, Homo sapiens
cuuuggcauuagccuguauaga

SEQ ID NO: 184296 - RNA, 22 nt, Homo sapiens
cuuuggccauagcuaaaugauu

SEQ ID NO: 184297 - RNA, 22 nt, Homo sapiens
cuuuuggcuuaagauugucuug

SEQ ID NO: 184298 - RNA, 22 nt, Homo sapiens
cuuuuggucuaucagagaagca

SEQ ID NO: 184299 - RNA, 22 nt, Homo sapiens
gaagaucacacuguagaucuau

SEQ ID NO: 184300 - RNA, 22 nt, Homo sapiens
gaagcauugauccacaggcgug

SEQ ID NO: 184301 - RNA, 22 nt, Homo sapiens
gaaggcaugcugcauggccaga

SEQ ID NO: 184302 - RNA, 22 nt, Homo sapiens
gaaguaggugcuguuauuaucu

SEQ ID NO: 184303 - RNA, 22 nt, Homo sapiens
gaauagugcugcaagaaacaua

SEQ ID NO: 184304 - RNA, 22 nt, Homo sapiens
gaauagugcugcaauaaacaua

SEQ ID NO: 184305 - RNA, 22 nt, Homo sapiens
gaauagugcugcaaugaacaua

SEQ ID NO: 184306 - RNA, 22 nt, Homo sapiens
gaaugauacuguuaacgaaaga

SEQ ID NO: 184307 - RNA, 22 nt, Homo sapiens
gacagugagaugucaugugaaa

SEQ ID NO: 184308 - RNA, 22 nt, Homo sapiens
gacauguuuacaguguugagag

SEQ ID NO: 184309 - RNA, 18 nt, Homo sapiens
gacuccauuucagccaga

SEQ ID NO: 184310 - RNA, 22 nt, Homo sapiens
gacuggauagauaaaguuaguu

SEQ ID NO: 184311 - RNA, 22 nt, Homo sapiens
gacuggccuauaauggcgaauu

SEQ ID NO: 184312 - RNA, 22 nt, Homo sapiens
gagaaugaacagacugccucuu

SEQ ID NO: 184313 - RNA, 22 nt, Homo sapiens
gagaaugagaggggaaggccac

SEQ ID NO: 184314 - RNA, 22 nt, Homo sapiens
gagacauugacuuuguuccaga

SEQ ID NO: 184315 - RNA, 22 nt, Homo sapiens
gagacugagucucacucuguca

SEQ ID NO: 184316 - RNA, 22 nt, Homo sapiens
gagacugagucucgcucugccg

SEQ ID NO: 184317 - RNA, 22 nt, Homo sapiens
gagacugagucuugcucuguca

SEQ ID NO: 184318 - RNA, 22 nt, Homo sapiens
gagagugaaguuugcuaccugu

SEQ ID NO: 184319 - RNA, 22 nt, Homo sapiens
gagauauucugguuuacuaaau

SEQ ID NO: 184320 - RNA, 22 nt, Homo sapiens
gagcaaaaguauguauugguua

SEQ ID NO: 184321 - RNA, 22 nt, Homo sapiens
gagcaguugagagugcuggcca

SEQ ID NO: 184322 - RNA, 22 nt, Homo sapiens
gaggaguagggcacaaagccuu

SEQ ID NO: 184323 - RNA, 22 nt, Homo sapiens
gaggcaauaugagggaggcuuc

SEQ ID NO: 184324 - RNA, 22 nt, Homo sapiens
gagguuuuagugagucccacug

SEQ ID NO: 184325 - RNA, 22 nt, Homo sapiens
gagugcaauggcagaucuccgc

SEQ ID NO: 184326 - RNA, 22 nt, Homo sapiens
gaguuuguacuaauuuguugua

SEQ ID NO: 184327 - RNA, 22 nt, Homo sapiens
gauuagugacguugagcacugu

SEQ ID NO: 184328 - RNA, 22 nt, Homo sapiens
gauuuuuggggaagccucuuau

SEQ ID NO: 184329 - RNA, 21 nt, Homo sapiens
gcaaacauccuuugaugccag

SEQ ID NO: 184330 - RNA, 20 nt, Homo sapiens
gcaaauggaucccacaagcc

SEQ ID NO: 184331 - RNA, 22 nt, Homo sapiens
gcacugagagaagccccaagua

SEQ ID NO: 184332 - RNA, 22 nt, Homo sapiens
gcagagaaacaggucuaaggag

SEQ ID NO: 184333 - RNA, 22 nt, Homo sapiens
gcaguguugugauccaggucuu

SEQ ID NO: 184334 - RNA, 22 nt, Homo sapiens
gcauggagaaggggacugauuc

SEQ ID NO: 184335 - RNA, 21 nt, Homo sapiens
gccaguguggcaauuuuucaa

SEQ ID NO: 184336 - RNA, 22 nt, Homo sapiens
gccaguguguguuguucuccgc

SEQ ID NO: 184337 - RNA, 22 nt, Homo sapiens
gcccuguaguauaguuugaagu

SEQ ID NO: 184338 - RNA, 19 nt, Homo sapiens
gcucaccuugcugcuccag

SEQ ID NO: 184339 - RNA, 22 nt, Homo sapiens
gcugagaucucuugccugaacu

SEQ ID NO: 184340 - RNA, 22 nt, Homo sapiens
gcuggaauuaacauagaugugc

SEQ ID NO: 184341 - RNA, 22 nt, Homo sapiens
gcuggguugccagguuacuuaa

SEQ ID NO: 184342 - RNA, 22 nt, Homo sapiens
gcugguauuacaggcaugagcc

SEQ ID NO: 184343 - RNA, 22 nt, Homo sapiens
gcugguguagagugcagaaagg

SEQ ID NO: 184344 - RNA, 22 nt, Homo sapiens
gcugguguucaggcccucaguc

SEQ ID NO: 184345 - RNA, 20 nt, Homo sapiens
ggaauagucuacacucugac

SEQ ID NO: 184346 - RNA, 22 nt, Homo sapiens
ggaaugagaaauauuacacaau

SEQ ID NO: 184347 - RNA, 22 nt, Homo sapiens
ggagagcuaggcagagguuugu

SEQ ID NO: 184348 - RNA, 22 nt, Homo sapiens
ggagagugacauauuucuaggc

SEQ ID NO: 184349 - RNA, 22 nt, Homo sapiens
ggagauuauugaaucaugaggg

SEQ ID NO: 184350 - RNA, 22 nt, Homo sapiens
ggagugugauucaguauaauau

SEQ ID NO: 184351 - RNA, 23 nt, Homo sapiens
ggauggaaaguuuugagggccac

SEQ ID NO: 184352 - RNA, 22 nt, Homo sapiens
ggcaaagaugaccauuacuuuu

SEQ ID NO: 184353 - RNA, 22 nt, Homo sapiens
ggcaagugggagggaguguuuc

SEQ ID NO: 184354 - RNA, 22 nt, Homo sapiens
ggcacuguugccggccugaauu

SEQ ID NO: 184355 - RNA, 22 nt, Homo sapiens
ggcucaguugcaaaucaguuca

SEQ ID NO: 184356 - RNA, 22 nt, Homo sapiens
ggcuuggaggaaugugagggcu

SEQ ID NO: 184357 - RNA, 19 nt, Homo sapiens
gggaggaugcgucuucagg

SEQ ID NO: 184358 - RNA, 22 nt, Homo sapiens
ggguucaaaucuuggcucuuac

SEQ ID NO: 184359 - RNA, 22 nt, Homo sapiens
ggugagcacagaaugcccugag

SEQ ID NO: 184360 - RNA, 22 nt, Homo sapiens
guaaucucaccuacuugggagg

SEQ ID NO: 184361 - RNA, 22 nt, Homo sapiens
guaaucucagcuacuugggagu

SEQ ID NO: 184362 - RNA, 22 nt, Homo sapiens
guacaguaguaaaagugaauga

SEQ ID NO: 184363 - RNA, 22 nt, Homo sapiens
guacaguauaguaauaggauuu

SEQ ID NO: 184364 - RNA, 22 nt, Homo sapiens
guacaguucucuuuguugucag

SEQ ID NO: 184365 - RNA, 22 nt, Homo sapiens
guaguggcaugaucuuggcuca

SEQ ID NO: 184366 - RNA, 22 nt, Homo sapiens
guauagaucguagaccaauaaa

SEQ ID NO: 184367 - RNA, 22 nt, Homo sapiens
gucccaguggaaccuccaagcu

SEQ ID NO: 184368 - RNA, 22 nt, Homo sapiens
gucugucuuuugucuuugaaau

SEQ ID NO: 184369 - RNA, 20 nt, Homo sapiens
gucuugcuccguugcccagg

SEQ ID NO: 184370 - RNA, 22 nt, Homo sapiens
gucuuuaguugaaacauguggu

SEQ ID NO: 184371 - RNA, 22 nt, Homo sapiens
gucuuugcuuuuaaccagaggu

SEQ ID NO: 184372 - RNA, 22 nt, Homo sapiens
gugaaagauuaaaccagugugu

SEQ ID NO: 184373 - RNA, 22 nt, Homo sapiens
gugaaaugaaucuggaaauauu

SEQ ID NO: 184374 - RNA, 22 nt, Homo sapiens
gugaacagaaccugggaucgaa

SEQ ID NO: 184375 - RNA, 22 nt, Homo sapiens
gugaccucuguugcugucacua

SEQ ID NO: 184376 - RNA, 22 nt, Homo sapiens
gugagaauauuuuaaauacuaa

SEQ ID NO: 184377 - RNA, 22 nt, Homo sapiens
gugagacugaguuucgcucuug

SEQ ID NO: 184378 - RNA, 22 nt, Homo sapiens
gugagccaugauuuuaccacug

SEQ ID NO: 184379 - RNA, 22 nt, Homo sapiens
gugaucuuucaggcuugaccau

SEQ ID NO: 184380 - RNA, 22 nt, Homo sapiens
gugcauaucugugguuggcuga

SEQ ID NO: 184381 - RNA, 22 nt, Homo sapiens
gugccacugcaccuggccuaag

SEQ ID NO: 184382 - RNA, 22 nt, Homo sapiens
guggaagcacaggccuccugga

SEQ ID NO: 184383 - RNA, 22 nt, Homo sapiens
guggaagguaaugcagcuuacu

SEQ ID NO: 184384 - RNA, 22 nt, Homo sapiens
guggaaggucaugaauguucuu

SEQ ID NO: 184385 - RNA, 22 nt, Homo sapiens
guggaagucuuugguauuggua

SEQ ID NO: 184386 - RNA, 22 nt, Homo sapiens
guggaagugucuggggccaggg

SEQ ID NO: 184387 - RNA, 22 nt, Homo sapiens
guggagacaaaggcugagugag

SEQ ID NO: 184388 - RNA, 22 nt, Homo sapiens
guggagcuguguggccuugggc

SEQ ID NO: 184389 - RNA, 22 nt, Homo sapiens
guggcaugaaagcaucugugau

SEQ ID NO: 184390 - RNA, 22 nt, Homo sapiens
guggcauuucccaaaguauucu

SEQ ID NO: 184391 - RNA, 22 nt, Homo sapiens
guggcuuguaggggucaaggga

SEQ ID NO: 184392 - RNA, 22 nt, Homo sapiens
gugguuuuuaaaguaccugugg

SEQ ID NO: 184393 - RNA, 22 nt, Homo sapiens
guguagagaaaaguaccauuuu

SEQ ID NO: 184394 - RNA, 22 nt, Homo sapiens
guguagagaaauagccugaagg

SEQ ID NO: 184395 - RNA, 22 nt, Homo sapiens
guguauauccuauuaguucugu

SEQ ID NO: 184396 - RNA, 21 nt, Homo sapiens
gugugcuugaauucagcuguc

SEQ ID NO: 184397 - RNA, 22 nt, Homo sapiens
guuaaagacauccacauaggag

SEQ ID NO: 184398 - RNA, 22 nt, Homo sapiens
guuaagaaguguaacuuaaguu

SEQ ID NO: 184399 - RNA, 17 nt, Homo sapiens
guugaguuugagucaag

SEQ ID NO: 184400 - RNA, 22 nt, Homo sapiens
guugcucaggcuggagugcagu

SEQ ID NO: 184401 - RNA, 22 nt, Homo sapiens
uaaagcacaaguaaagaauacu

SEQ ID NO: 184402 - RNA, 22 nt, Homo sapiens
uaaagccagugauuaugucucu

SEQ ID NO: 184403 - RNA, 18 nt, Homo sapiens
uaaaggcacuguguuguu

SEQ ID NO: 184404 - RNA, 21 nt, Homo sapiens
uaaaggcuccaauuauacccc

SEQ ID NO: 184405 - RNA, 22 nt, Homo sapiens
uaacagucuccucaagguguug

SEQ ID NO: 184406 - RNA, 23 nt, Homo sapiens
uaacauugcaugauuaccugcau

SEQ ID NO: 184407 - RNA, 22 nt, Homo sapiens
uaacccuuacaacuacacucgu

SEQ ID NO: 184408 - RNA, 21 nt, Homo sapiens
uaagacugccaguagggcugu

SEQ ID NO: 184409 - RNA, 22 nt, Homo sapiens
uaagacuguuggcaauuuuugc

SEQ ID NO: 184410 - RNA, 20 nt, Homo sapiens
uaagccacacagucuaaggu

SEQ ID NO: 184411 - RNA, 22 nt, Homo sapiens
uaagcuauagugaauaaauugc

SEQ ID NO: 184412 - RNA, 22 nt, Homo sapiens
uaaggcaaguuuuuaguggaca

SEQ ID NO: 184413 - RNA, 22 nt, Homo sapiens
uaaggcuugcuucagucuugaa

SEQ ID NO: 184414 - RNA, 22 nt, Homo sapiens
uaaggcuuugguagguuugguc

SEQ ID NO: 184415 - RNA, 22 nt, Homo sapiens
uaaggcuuuuguucagcguggg

SEQ ID NO: 184416 - RNA, 22 nt, Homo sapiens
uaaguaauugugguuucugcca

SEQ ID NO: 184417 - RNA, 23 nt, Homo sapiens
uaagucacacagauuaauuuauu

SEQ ID NO: 184418 - RNA, 22 nt, Homo sapiens
uaaguguaaugucugaaguuug

SEQ ID NO: 184419 - RNA, 23 nt, Homo sapiens
uaaguucaucucuaauaggugga

SEQ ID NO: 184420 - RNA, 20 nt, Homo sapiens
uaaguuguauuugucaugaa

SEQ ID NO: 184421 - RNA, 22 nt, Homo sapiens
uaauaguuggcacuggagaaag

SEQ ID NO: 184422 - RNA, 22 nt, Homo sapiens
uaaucucagcugagcugagauu

SEQ ID NO: 184423 - RNA, 22 nt, Homo sapiens
uaauugaaugcagacaccaggg

SEQ ID NO: 184424 - RNA, 22 nt, Homo sapiens
uacaagcacaggcagcaggcug

SEQ ID NO: 184425 - RNA, 22 nt, Homo sapiens
uacauugucauauucucucucu

SEQ ID NO: 184426 - RNA, 22 nt, Homo sapiens
uaccacauuguagagggcauuc

SEQ ID NO: 184427 - RNA, 19 nt, Homo sapiens
uacuggcucgggaauuuuc

SEQ ID NO: 184428 - RNA, 22 nt, Homo sapiens
uagaauguaacaguuaaaagca

SEQ ID NO: 184429 - RNA, 22 nt, Homo sapiens
uagaguguuuuguuaggcagca

SEQ ID NO: 184430 - RNA, 22 nt, Homo sapiens
uagaucauauucagugcuuacu

SEQ ID NO: 184431 - RNA, 22 nt, Homo sapiens
uaggcuuuuggacccugucucu

SEQ ID NO: 184432 - RNA, 19 nt, Homo sapiens
uagggcacgaggcagaguc

SEQ ID NO: 184433 - RNA, 22 nt, Homo sapiens
uagugcccuuauaagagcagga

SEQ ID NO: 184434 - RNA, 21 nt, Homo sapiens
uagugcugaggcaguauggga

SEQ ID NO: 184435 - RNA, 20 nt, Homo sapiens
uaguggaaaucagguccucu

SEQ ID NO: 184436 - RNA, 22 nt, Homo sapiens
uauacaguaggcacucaguggc

SEQ ID NO: 184437 - RNA, 22 nt, Homo sapiens
uaucacaggucaggaaucuugc

SEQ ID NO: 184438 - RNA, 22 nt, Homo sapiens
uaucacagugcuggaguauucc

SEQ ID NO: 184439 - RNA, 22 nt, Homo sapiens
uauccugaagcuuuauuuaagu

SEQ ID NO: 184440 - RNA, 22 nt, Homo sapiens
uaucucagagaaucagauuuac

SEQ ID NO: 184441 - RNA, 22 nt, Homo sapiens
uaugaaccuguuaucuagguuu

SEQ ID NO: 184442 - RNA, 22 nt, Homo sapiens
uaugacuuuugaauacagaugg

SEQ ID NO: 184443 - RNA, 22 nt, Homo sapiens
uaugagcacauauguaucuaug

SEQ ID NO: 184444 - RNA, 22 nt, Homo sapiens
uaugcacacacguguuuaugug

SEQ ID NO: 184445 - RNA, 22 nt, Homo sapiens
uaugcacacguguccaugugca

SEQ ID NO: 184446 - RNA, 22 nt, Homo sapiens
uaugccucuucauaaaguauga

SEQ ID NO: 184447 - RNA, 22 nt, Homo sapiens
uauggacuuuaggauagcuuuu

SEQ ID NO: 184448 - RNA, 22 nt, Homo sapiens
uauggcucuauuuccuugucua

SEQ ID NO: 184449 - RNA, 22 nt, Homo sapiens
uaugucuucuuuagagaaaugu

SEQ ID NO: 184450 - RNA, 22 nt, Homo sapiens
uaugugguuaauaggaauuugu

SEQ ID NO: 184451 - RNA, 20 nt, Homo sapiens
uauucacucuccagucuugc

SEQ ID NO: 184452 - RNA, 22 nt, Homo sapiens
uauuccuuuugcauuuccacau

SEQ ID NO: 184453 - RNA, 22 nt, Homo sapiens
uauuguacauguuauagauuuu

SEQ ID NO: 184454 - RNA, 22 nt, Homo sapiens
uauuugguuacuugaauagcua

SEQ ID NO: 184455 - RNA, 18 nt, Homo sapiens
ucaaauacuuugggcagu

SEQ ID NO: 184456 - RNA, 22 nt, Homo sapiens
ucaaauuccaagucuagguagg

SEQ ID NO: 184457 - RNA, 20 nt, Homo sapiens
ucaaauucuuggccuccagc

SEQ ID NO: 184458 - RNA, 22 nt, Homo sapiens
ucaaguaguaacuaacugugac

SEQ ID NO: 184459 - RNA, 22 nt, Homo sapiens
ucacagauaaauaaagaugauu

SEQ ID NO: 184460 - RNA, 22 nt, Homo sapiens
ucacauagcugaguaaaaugga

SEQ ID NO: 184461 - RNA, 20 nt, Homo sapiens
ucacauccucucccaacaug

SEQ ID NO: 184462 - RNA, 22 nt, Homo sapiens
ucacaugaagauuuuaguauac

SEQ ID NO: 184463 - RNA, 22 nt, Homo sapiens
ucacaugugcguuuuggcaugu

SEQ ID NO: 184464 - RNA, 22 nt, Homo sapiens
ucacauguguaaauugguguaa

SEQ ID NO: 184465 - RNA, 22 nt, Homo sapiens
ucaccuggagacaugaagacug

SEQ ID NO: 184466 - RNA, 22 nt, Homo sapiens
ucacugugcaugaaggaugcug

SEQ ID NO: 184467 - RNA, 22 nt, Homo sapiens
ucagacacugcccuccaccugu

SEQ ID NO: 184468 - RNA, 19 nt, Homo sapiens
ucagcaguaaucaacuuca

SEQ ID NO: 184469 - RNA, 22 nt, Homo sapiens
ucagguagugccaugauugauu

SEQ ID NO: 184470 - RNA, 22 nt, Homo sapiens
ucagguauuucuuuuagcugug

SEQ ID NO: 184471 - RNA, 22 nt, Homo sapiens
ucaggugcaguggcucugaccu

SEQ ID NO: 184472 - RNA, 22 nt, Homo sapiens
ucaguaccugagagugggcaga

SEQ ID NO: 184473 - RNA, 22 nt, Homo sapiens
ucagugauugcuuucauggaaa

SEQ ID NO: 184474 - RNA, 20 nt, Homo sapiens
ucagugauugguuuaguuau

SEQ ID NO: 184475 - RNA, 22 nt, Homo sapiens
ucagugcaggaaucucuagcca

SEQ ID NO: 184476 - RNA, 22 nt, Homo sapiens
ucaguguuuggaaucucaauuu

SEQ ID NO: 184477 - RNA, 22 nt, Homo sapiens
ucauaaaguuguuuuaauggga

SEQ ID NO: 184478 - RNA, 22 nt, Homo sapiens
ucauagaucaaguaauaagaca

SEQ ID NO: 184479 - RNA, 20 nt, Homo sapiens
ucauagggugguggcagugg

SEQ ID NO: 184480 - RNA, 22 nt, Homo sapiens
uugaggaggcagucucuccauu

SEQ ID NO: 184481 - RNA, 22 nt, Homo sapiens
uugagggcugaauaccaaucag

SEQ ID NO: 184482 - RNA, 20 nt, Homo sapiens
uugaggucaggaguuuggga

SEQ ID NO: 184483 - RNA, 22 nt, Homo sapiens
uugaggugaagggcagagcagc

SEQ ID NO: 184484 - RNA, 22 nt, Homo sapiens
auugcacucuagccugggugac

SEQ ID NO: 184485 - RNA, 22 nt, Homo sapiens
auugcauugugaucuucccaga

SEQ ID NO: 184486 - RNA, 22 nt, Homo sapiens
auuggcaauccauauauuuucu

SEQ ID NO: 184487 - RNA, 22 nt, Homo sapiens
auuggcaauguacauaucuugc

SEQ ID NO: 184488 - RNA, 22 nt, Homo sapiens
auuggccaaugggacgucagca

SEQ ID NO: 184489 - RNA, 21 nt, Homo sapiens
auuguauguaaaccaaaugag

SEQ ID NO: 184490 - RNA, 21 nt, Homo sapiens
auuugguggcugugugacacu

SEQ ID NO: 184491 - RNA, 21 nt, Homo sapiens
auuugguguuagaaauaaauu

SEQ ID NO: 184492 - RNA, 22 nt, Homo sapiens
auuuugcauugcuguaaaggaa

SEQ ID NO: 184493 - RNA, 21 nt, Homo sapiens
auuuuugcagagcugguagug

SEQ ID NO: 184494 - RNA, 22 nt, Homo sapiens
auuuuugguuucaccugcacgc

SEQ ID NO: 184495 - RNA, 22 nt, Homo sapiens
caaaggcuucugaaacugcaga

SEQ ID NO: 184496 - RNA, 22 nt, Homo sapiens
caaaugaucugcuggccucagc

SEQ ID NO: 184497 - RNA, 22 nt, Homo sapiens
caagugacugagccgccucggc

SEQ ID NO: 184498 - RNA, 22 nt, Homo sapiens
cacagugaacugguggguuuuu

SEQ ID NO: 184499 - RNA, 22 nt, Homo sapiens
cacaguguuacugguaugaagu

SEQ ID NO: 184500 - RNA, 22 nt, Homo sapiens
cacauguuugcuacauuuuucu

SEQ ID NO: 184501 - RNA, 22 nt, Homo sapiens
caccacuacaccccaggcuggg

SEQ ID NO: 184502 - RNA, 22 nt, Homo sapiens
cacccaguaagcaugaggcccu

SEQ ID NO: 184503 - RNA, 22 nt, Homo sapiens
cacugcaguguaauuaagguug

SEQ ID NO: 184504 - RNA, 22 nt, Homo sapiens
cacugcauccuccaccugccag

SEQ ID NO: 184505 - RNA, 22 nt, Homo sapiens
cagagcaaugcuuuugcuuuga

SEQ ID NO: 184506 - RNA, 22 nt, Homo sapiens
cagcacauuacaaguacuuggu

SEQ ID NO: 184507 - RNA, 22 nt, Homo sapiens
cagcagguuuuuaucaguuaag

SEQ ID NO: 184508 - RNA, 20 nt, Homo sapiens
cagcuaccugggaaauuugg

SEQ ID NO: 184509 - RNA, 20 nt, Homo sapiens
cagcuagugguaggagucgg

SEQ ID NO: 184510 - RNA, 22 nt, Homo sapiens
cagcuguuguuccagucuuuua

SEQ ID NO: 184511 - RNA, 22 nt, Homo sapiens
caggaccucuugccuggaagcc

SEQ ID NO: 184512 - RNA, 21 nt, Homo sapiens
cagguagugucugaagccaga

SEQ ID NO: 184513 - RNA, 22 nt, Homo sapiens
cagugaauuucaggucaagagu

SEQ ID NO: 184514 - RNA, 22 nt, Homo sapiens
cagugcauagaugugccacauu

SEQ ID NO: 184515 - RNA, 22 nt, Homo sapiens
cagugguuuuuagcuugcuggg

SEQ ID NO: 184516 - RNA, 22 nt, Homo sapiens
caucccugaaccccagaaaucu

SEQ ID NO: 184517 - RNA, 22 nt, Homo sapiens
caugaaagacugaggaauugga

SEQ ID NO: 184518 - RNA, 22 nt, Homo sapiens
caugcacugagagggucucggc

SEQ ID NO: 184519 - RNA, 22 nt, Homo sapiens
cauggcucuuugcugcuaaagu

SEQ ID NO: 184520 - RNA, 19 nt, Homo sapiens
cauggcuuauaauuuuaau

SEQ ID NO: 184521 - RNA, 22 nt, Homo sapiens
cauguauagauuccauaguggu

SEQ ID NO: 184522 - RNA, 22 nt, Homo sapiens
caugucacuuccucucugaugg

SEQ ID NO: 184523 - RNA, 20 nt, Homo sapiens
cauugcccuccagccugggc

SEQ ID NO: 184524 - RNA, 22 nt, Homo sapiens
cauuuugguuaaauagguagcu

SEQ ID NO: 184525 - RNA, 22 nt, Homo sapiens
ccaaggaauacccucccuuuuu

SEQ ID NO: 184526 - RNA, 19 nt, Homo sapiens
ccaguguucugauugcacu

SEQ ID NO: 184527 - RNA, 19 nt, Homo sapiens
ccaguguugccagagcuga

SEQ ID NO: 184528 - RNA, 18 nt, Homo sapiens
ccauucaacagauuuguc

SEQ ID NO: 184529 - RNA, 22 nt, Homo sapiens
cccauuguuaaguugaguaucu

SEQ ID NO: 184530 - RNA, 17 nt, Homo sapiens
cccuaguagcugggacu

SEQ ID NO: 184531 - RNA, 22 nt, Homo sapiens
ccucauggagaaccucugcuag

SEQ ID NO: 184532 - RNA, 21 nt, Homo sapiens
ccugauguucacuuggccuuc

SEQ ID NO: 184533 - RNA, 22 nt, Homo sapiens
ccuggaucauugucauucccaa

SEQ ID NO: 184534 - RNA, 22 nt, Homo sapiens
ccugguguuuugauggucgggu

SEQ ID NO: 184535 - RNA, 22 nt, Homo sapiens
ccuucuuuuguaaggcugaaua

SEQ ID NO: 184536 - RNA, 22 nt, Homo sapiens
cuaaggaaggacugaaaggaca

SEQ ID NO: 184537 - RNA, 17 nt, Homo sapiens
cuaaggcaagagucugc

SEQ ID NO: 184538 - RNA, 22 nt, Homo sapiens
cuaauucuggccaaagggauaa

SEQ ID NO: 184539 - RNA, 22 nt, Homo sapiens
cuagaacuagaacugcuggggu

SEQ ID NO: 184540 - RNA, 22 nt, Homo sapiens
cuagagagaagcugugugaccu

SEQ ID NO: 184541 - RNA, 22 nt, Homo sapiens
cuagcagacacuuccagagagu

SEQ ID NO: 184542 - RNA, 22 nt, Homo sapiens
cucaaaguguggucuguggguu

SEQ ID NO: 184543 - RNA, 18 nt, Homo sapiens
cucacaguaacuuuuaag

SEQ ID NO: 184544 - RNA, 22 nt, Homo sapiens
cucacuaggaaguaaaguuugu

SEQ ID NO: 184545 - RNA, 22 nt, Homo sapiens
cucagucuaugauacuuugcua

SEQ ID NO: 184546 - RNA, 23 nt, Homo sapiens
cucccugaacaugacacaccaga

SEQ ID NO: 184547 - RNA, 22 nt, Homo sapiens
cucuuuaguaagcaguugauga

SEQ ID NO: 184548 - RNA, 19 nt, Homo sapiens
cugaaacacagagagggcu

SEQ ID NO: 184549 - RNA, 22 nt, Homo sapiens
cugaaaguuauucaggggcaag

SEQ ID NO: 184550 - RNA, 22 nt, Homo sapiens
cugaaggcagguagaauagaga

SEQ ID NO: 184551 - RNA, 22 nt, Homo sapiens
cugaauguucuggauggaagag

SEQ ID NO: 184552 - RNA, 22 nt, Homo sapiens
cugaauguuucacucugaaaug

SEQ ID NO: 184553 - RNA, 22 nt, Homo sapiens
cugagagaggagcuaaaacugc

SEQ ID NO: 184554 - RNA, 22 nt, Homo sapiens
cugagguuaggaguuugagacc

SEQ ID NO: 184555 - RNA, 21 nt, Homo sapiens
cugcaaaugcugcugccugau

SEQ ID NO: 184556 - RNA, 22 nt, Homo sapiens
cugcaauguuugaaauggcaaa

SEQ ID NO: 184557 - RNA, 21 nt, Homo sapiens
cugcauccauuucugagugau

SEQ ID NO: 184558 - RNA, 22 nt, Homo sapiens
cugcccguaauccucuccccag

SEQ ID NO: 184559 - RNA, 22 nt, Homo sapiens
cuggaaagaaacccuuaauucu

SEQ ID NO: 184560 - RNA, 22 nt, Homo sapiens
cuggaauauuagcuggucuuaa

SEQ ID NO: 184561 - RNA, 22 nt, Homo sapiens
cuggaauucaaaaucugaauuu

SEQ ID NO: 184562 - RNA, 22 nt, Homo sapiens
cuggagcaaaggugacucuugu

SEQ ID NO: 184563 - RNA, 22 nt, Homo sapiens
cuggagucugacugacacaagg

SEQ ID NO: 184564 - RNA, 22 nt, Homo sapiens
cuggcaauaaauuuuuguguug

SEQ ID NO: 184565 - RNA, 22 nt, Homo sapiens
cuggcucauuucauuuagcaua

SEQ ID NO: 184566 - RNA, 22 nt, Homo sapiens
cuggcugagugguaaguagagg

SEQ ID NO: 184567 - RNA, 22 nt, Homo sapiens
cugggucaguuucugauuauug

SEQ ID NO: 184568 - RNA, 22 nt, Homo sapiens
cuguauguuucuaugaauguga

SEQ ID NO: 184569 - RNA, 22 nt, Homo sapiens
cuguccugcagagucagaauga

SEQ ID NO: 184570 - RNA, 22 nt, Homo sapiens
cugucucagccucuccaguagc

SEQ ID NO: 184571 - RNA, 22 nt, Homo sapiens
cugugcaaguuauaggccaggu

SEQ ID NO: 184572 - RNA, 22 nt, Homo sapiens
cuucaguucuguaaggacagca

SEQ ID NO: 184573 - RNA, 22 nt, Homo sapiens
cuuccugaguccugggcucaca

SEQ ID NO: 184574 - RNA, 22 nt, Homo sapiens
cuucuugcuguguccucacaug

SEQ ID NO: 184575 - RNA, 22 nt, Homo sapiens
cuugcacuccacuguucuccug

SEQ ID NO: 184576 - RNA, 22 nt, Homo sapiens
cuuugcaaauggccuuuccaag

SEQ ID NO: 184577 - RNA, 19 nt, Homo sapiens
aacuggugugagaugauau

SEQ ID NO: 184578 - RNA, 20 nt, Homo sapiens
aagagcucaccagaauaucu

SEQ ID NO: 184579 - RNA, 22 nt, Homo sapiens
aagagcucucuguagcauguga

SEQ ID NO: 184580 - RNA, 22 nt, Homo sapiens
aagcagacauguucauuuugaa

SEQ ID NO: 184581 - RNA, 22 nt, Homo sapiens
aagccagugugacaggaaacuu

SEQ ID NO: 184582 - RNA, 22 nt, Homo sapiens
aagcuguuguucauccugaauu

SEQ ID NO: 184583 - RNA, 22 nt, Homo sapiens
aaggaauucaaauuuucucugg

SEQ ID NO: 184584 - RNA, 22 nt, Homo sapiens
aaggcuuuuugcugacguccuu

SEQ ID NO: 184585 - RNA, 22 nt, Homo sapiens
aaggugcucucuuauguagaaa

SEQ ID NO: 184586 - RNA, 22 nt, Homo sapiens
aaggugguuuucucuuggaguc

SEQ ID NO: 184587 - RNA, 22 nt, Homo sapiens
aaguauagcuaugauaaacauu

SEQ ID NO: 184588 - RNA, 22 nt, Homo sapiens
aaguauuaagacuaagaggcuu

SEQ ID NO: 184589 - RNA, 19 nt, Homo sapiens
aagugaaugcuuuguucac

SEQ ID NO: 184590 - RNA, 22 nt, Homo sapiens
aagugcuuccuuucagaggguu

SEQ ID NO: 184591 - RNA, 22 nt, Homo sapiens
aagugcuuuuuagauaugguuu

SEQ ID NO: 184592 - RNA, 17 nt, Homo sapiens
aaguggcuuguucacca

SEQ ID NO: 184593 - RNA, 22 nt, Homo sapiens
aauaagcauaguaccugauagg

SEQ ID NO: 184594 - RNA, 22 nt, Homo sapiens
aaugcacauauauuuccuuauu

SEQ ID NO: 184595 - RNA, 22 nt, Homo sapiens
aaugcuaucuggaacauuguug

SEQ ID NO: 184596 - RNA, 22 nt, Homo sapiens
aauggcacuuuauaaauguuaa

SEQ ID NO: 184597 - RNA, 22 nt, Homo sapiens
aauggcauugguccuuuuggau

SEQ ID NO: 184598 - RNA, 22 nt, Homo sapiens
acacuggguaacauaucuguua

SEQ ID NO: 184599 - RNA, 22 nt, Homo sapiens
acacuguaacucuuugagggca

SEQ ID NO: 184600 - RNA, 22 nt, Homo sapiens
acacuuucuggagcugcacaua

SEQ ID NO: 184601 - RNA, 22 nt, Homo sapiens
acaggagugggauuugaguccu

SEQ ID NO: 184602 - RNA, 22 nt, Homo sapiens
acaguaaugggccccuuuuccu

SEQ ID NO: 184603 - RNA, 22 nt, Homo sapiens
acagucuggagaaugggugcuc

SEQ ID NO: 184604 - RNA, 18 nt, Homo sapiens
acagugucuuacaccugu

SEQ ID NO: 184605 - RNA, 21 nt, Homo sapiens
acaucagaguugugaagguag

SEQ ID NO: 184606 - RNA, 22 nt, Homo sapiens
acccaguguucagacuaccugu

SEQ ID NO: 184607 - RNA, 22 nt, Homo sapiens
accccugagaucgaaucaugcu

SEQ ID NO: 184608 - RNA, 22 nt, Homo sapiens
acccuggaggucuacagugcag

SEQ ID NO: 184609 - RNA, 22 nt, Homo sapiens
acccuguaguuagaaacuuuca

SEQ ID NO: 184610 - RNA, 22 nt, Homo sapiens
accuucauuguugccaugucca

SEQ ID NO: 184611 - RNA, 22 nt, Homo sapiens
acuauacuguaacuguauucag

SEQ ID NO: 184612 - RNA, 22 nt, Homo sapiens
acugaucaauguuaaggcuuau

SEQ ID NO: 184613 - RNA, 21 nt, Homo sapiens
acugauguuugaaauucgcug

SEQ ID NO: 184614 - RNA, 22 nt, Homo sapiens
acugcacugcagccuggccaac

SEQ ID NO: 184615 - RNA, 22 nt, Homo sapiens
acugcauaaauauguguaauau

SEQ ID NO: 184616 - RNA, 20 nt, Homo sapiens
acugcauuuaguccucagga

SEQ ID NO: 184617 - RNA, 22 nt, Homo sapiens
acugcauuugguaaagucaaga

SEQ ID NO: 184618 - RNA, 22 nt, Homo sapiens
uuagaguacaggggaaucaagg

SEQ ID NO: 184619 - RNA, 21 nt, Homo sapiens
uuagccuguaagcacuuugca

SEQ ID NO: 184620 - RNA, 22 nt, Homo sapiens
uuagguaauauauugcugcuuu

SEQ ID NO: 184621 - RNA, 22 nt, Homo sapiens
uuaguaguagugcuguaauuuu

SEQ ID NO: 184622 - RNA, 22 nt, Homo sapiens
uuauacacugugggaguguaaa

SEQ ID NO: 184623 - RNA, 18 nt, Homo sapiens
uuauacuccccaggcaau

SEQ ID NO: 184624 - RNA, 22 nt, Homo sapiens
uuauguccuuuaacuucaucac

SEQ ID NO: 184625 - RNA, 22 nt, Homo sapiens
uucaaaggauagauuaagauca

SEQ ID NO: 184626 - RNA, 22 nt, Homo sapiens
uucaaaguuggaggacaaacug

SEQ ID NO: 184627 - RNA, 22 nt, Homo sapiens
uucaaaucuuuggcucccacua

SEQ ID NO: 184628 - RNA, 22 nt, Homo sapiens
uucaaguaagaaagacaucagg

SEQ ID NO: 184629 - RNA, 22 nt, Homo sapiens
uucaagugaacaaaaugaggag

SEQ ID NO: 184630 - RNA, 22 nt, Homo sapiens
uucacaauuaaaugugguuauu

SEQ ID NO: 184631 - RNA, 22 nt, Homo sapiens
uucacacugggccuacucugug

SEQ ID NO: 184632 - RNA, 22 nt, Homo sapiens
uucacaguguguacaccagggg

SEQ ID NO: 184633 - RNA, 22 nt, Homo sapiens
uucacaugacagggugaagcau

SEQ ID NO: 184634 - RNA, 21 nt, Homo sapiens
uucaccauggcuccacacucu

SEQ ID NO: 184635 - RNA, 23 nt, Homo sapiens
uucaccguguuggccaggcuggu

SEQ ID NO: 184636 - RNA, 22 nt, Homo sapiens
uucaccuggguuggccaucauu

SEQ ID NO: 184637 - RNA, 22 nt, Homo sapiens
uucaccuguagcaugcccuugg

SEQ ID NO: 184638 - RNA, 22 nt, Homo sapiens
uucaccuugcccacagcagucu

SEQ ID NO: 184639 - RNA, 22 nt, Homo sapiens
uucaggcaccauugucauugau

SEQ ID NO: 184640 - RNA, 22 nt, Homo sapiens
uucaggguggagaguaugaggu

SEQ ID NO: 184641 - RNA, 22 nt, Homo sapiens
uucagugucauuaacacaguag

SEQ ID NO: 184642 - RNA, 22 nt, Homo sapiens
uucccaguuggggaaagcgacc

SEQ ID NO: 184643 - RNA, 22 nt, Homo sapiens
uuccguguaguugagcaguuuu

SEQ ID NO: 184644 - RNA, 22 nt, Homo sapiens
uuccuggaggggaaguguccaa

SEQ ID NO: 184645 - RNA, 22 nt, Homo sapiens
uuccuuguagcaaaugcgauga

SEQ ID NO: 184646 - RNA, 22 nt, Homo sapiens
uucuauguuguuagacccacca

SEQ ID NO: 184647 - RNA, 22 nt, Homo sapiens
uucucaauggcaacuuguugcu

SEQ ID NO: 184648 - RNA, 22 nt, Homo sapiens
uucucaguuccuacuuugguga

SEQ ID NO: 184649 - RNA, 22 nt, Homo sapiens
uucuggccccucccaaucucau

SEQ ID NO: 184650 - RNA, 22 nt, Homo sapiens
uucuggcucaggucaacacuuc

SEQ ID NO: 184651 - RNA, 19 nt, Homo sapiens
uugaaggccgccuugcaga

SEQ ID NO: 184652 - RNA, 22 nt, Homo sapiens
uugaagguaggaugugcuauca

SEQ ID NO: 184653 - RNA, 22 nt, Homo sapiens
uugaaguaugaccgcugagaau

SEQ ID NO: 184654 - RNA, 22 nt, Homo sapiens
uugaauaggcucaugcuuauca

SEQ ID NO: 184655 - RNA, 22 nt, Homo sapiens
uugagagagaacauuuguuaca

SEQ ID NO: 184656 - RNA, 22 nt, Homo sapiens
uugaggaggcagucugcccauu

SEQ ID NO: 184657 - RNA, 22 nt, Homo sapiens
uugaggaggcagucuguccguu

SEQ ID NO: 184658 - RNA, 22 nt, Homo sapiens
uugaggaguacugauuagguau

SEQ ID NO: 184659 - RNA, 16 nt, Homo sapiens
uugaggcaugucucag

SEQ ID NO: 184660 - RNA, 22 nt, Homo sapiens
uugaggucuucaggaucaggcu

SEQ ID NO: 184661 - RNA, 22 nt, Homo sapiens
uugaggugggaggaucacuuga

SEQ ID NO: 184662 - RNA, 22 nt, Homo sapiens
uugaguagauaccuaggaauag

SEQ ID NO: 184663 - RNA, 22 nt, Homo sapiens
uugaguaguaagugguucaccg

SEQ ID NO: 184664 - RNA, 22 nt, Homo sapiens
uugauaagaaaugccaguuugg

SEQ ID NO: 184665 - RNA, 22 nt, Homo sapiens
uugcaaaguugccaaggaagga

SEQ ID NO: 184666 - RNA, 21 nt, Homo sapiens
uugcaaaugcugcugccugau

SEQ ID NO: 184667 - RNA, 22 nt, Homo sapiens
uugcaccuugaagccaauagca

SEQ ID NO: 184668 - RNA, 22 nt, Homo sapiens
uugcacuccauccuggguugac

SEQ ID NO: 184669 - RNA, 22 nt, Homo sapiens
uugcacucuccagccucggcaa

SEQ ID NO: 184670 - RNA, 22 nt, Homo sapiens
uugcagagucaguuauuuugcc

SEQ ID NO: 184671 - RNA, 22 nt, Homo sapiens
uugcuacauugauugccucuuu

SEQ ID NO: 184672 - RNA, 22 nt, Homo sapiens
uugcuauguugcccagucugga

SEQ ID NO: 184673 - RNA, 22 nt, Homo sapiens
uugcucaggcuggaguacaaug

SEQ ID NO: 184674 - RNA, 22 nt, Homo sapiens
uuggaauuaaccuggugcugga

SEQ ID NO: 184675 - RNA, 22 nt, Homo sapiens
uuggagcccuaacucucaguac

SEQ ID NO: 184676 - RNA, 22 nt, Homo sapiens
uuggcagcuguggaaucugggc

SEQ ID NO: 184677 - RNA, 22 nt, Homo sapiens
uuggccuccuggucauauccag

SEQ ID NO: 184678 - RNA, 22 nt, Homo sapiens
uuggcuauagauacauggauua

SEQ ID NO: 184679 - RNA, 22 nt, Homo sapiens
uugggcuuuuagguccuuaaca

SEQ ID NO: 184680 - RNA, 22 nt, Homo sapiens
uuguacuucagacaugccaaag

SEQ ID NO: 184681 - RNA, 22 nt, Homo sapiens
uuguauguugaaugaugguaua

SEQ ID NO: 184682 - RNA, 22 nt, Homo sapiens
uuguauguuguuugucagagaa

SEQ ID NO: 184683 - RNA, 22 nt, Homo sapiens
uuguauguuucugugcacauga

SEQ ID NO: 184684 - RNA, 22 nt, Homo sapiens
uugucaguguucacucaaagcu

SEQ ID NO: 184685 - RNA, 22 nt, Homo sapiens
uugugcaaaaguaauugcgguu

SEQ ID NO: 184686 - RNA, 22 nt, Homo sapiens
uugugucccugcccaaaucuca

SEQ ID NO: 184687 - RNA, 22 nt, Homo sapiens
uuguuaugggguggcuugaaag

SEQ ID NO: 184688 - RNA, 22 nt, Homo sapiens
gucccagagauauugugucuuu

SEQ ID NO: 184689 - RNA, 22 nt, Homo sapiens
gucucauugcaguuagaccugu

SEQ ID NO: 184690 - RNA, 22 nt, Homo sapiens
gucuggcuccugucuaaucacu

SEQ ID NO: 184691 - RNA, 22 nt, Homo sapiens
gucuuggcaugugcagcuggga

SEQ ID NO: 184692 - RNA, 20 nt, Homo sapiens
gucuuguagcucaaguuauu

SEQ ID NO: 184693 - RNA, 22 nt, Homo sapiens
gucuuuguuuggucuguaucag

SEQ ID NO: 184694 - RNA, 22 nt, Homo sapiens
gugaaaagaugagcaccauaca

SEQ ID NO: 184695 - RNA, 22 nt, Homo sapiens
gugaaauacauaaucccaagug

SEQ ID NO: 184696 - RNA, 22 nt, Homo sapiens
gugaaauguguagaggaucugg

SEQ ID NO: 184697 - RNA, 18 nt, Homo sapiens
gugagaaugacuguucug

SEQ ID NO: 184698 - RNA, 22 nt, Homo sapiens
gugagaccaauguacuaccuuc

SEQ ID NO: 184699 - RNA, 22 nt, Homo sapiens
gugagacugguucugaacccag

SEQ ID NO: 184700 - RNA, 21 nt, Homo sapiens
gugaggaguuacuggcuuuga

SEQ ID NO: 184701 - RNA, 22 nt, Homo sapiens
gugaggcugguccugccuccca

SEQ ID NO: 184702 - RNA, 22 nt, Homo sapiens
gugcacaaaucuuaaauguaca

SEQ ID NO: 184703 - RNA, 22 nt, Homo sapiens
gugcacaacgugcaggcuuguu

SEQ ID NO: 184704 - RNA, 22 nt, Homo sapiens
gugcauacucuggagacauugu

SEQ ID NO: 184705 - RNA, 22 nt, Homo sapiens
gugccacugcacuccggccugg

SEQ ID NO: 184706 - RNA, 23 nt, Homo sapiens
gugccuucugagccuagucucca

SEQ ID NO: 184707 - RNA, 22 nt, Homo sapiens
ucuggccuacaucauuuuuccg

SEQ ID NO: 184708 - RNA, 21 nt, Homo sapiens
ucuggcuuucauuccccuucu

SEQ ID NO: 184709 - RNA, 23 nt, Homo sapiens
ucuggcuuugggaugcucaaggg

SEQ ID NO: 184710 - RNA, 22 nt, Homo sapiens
ucuggguuuuuacaauguuuac

SEQ ID NO: 184711 - RNA, 22 nt, Homo sapiens
ucugucuugugguuugagugcc

SEQ ID NO: 184712 - RNA, 22 nt, Homo sapiens
ucugugcugagaguugaaaguu

SEQ ID NO: 184713 - RNA, 22 nt, Homo sapiens
ucuguuguuguuuuaagagaca

SEQ ID NO: 184714 - RNA, 22 nt, Homo sapiens
ucuuauuuggggaaaggguccu

SEQ ID NO: 184715 - RNA, 22 nt, Homo sapiens
ucuugggugaguuugugaauaa

SEQ ID NO: 184716 - RNA, 22 nt, Homo sapiens
ucuuggguggauucauucuuuc

SEQ ID NO: 184717 - RNA, 21 nt, Homo sapiens
ucuuggguugaauucucccag

SEQ ID NO: 184718 - RNA, 22 nt, Homo sapiens
ucuuuagguguuauaguucaag

SEQ ID NO: 184719 - RNA, 22 nt, Homo sapiens
ucuuugauguucugaaagaugg

SEQ ID NO: 184720 - RNA, 22 nt, Homo sapiens
ucuuugccuaacccaaggucau

SEQ ID NO: 184721 - RNA, 22 nt, Homo sapiens
ucuuuugggccucuugucagac

SEQ ID NO: 184722 - RNA, 22 nt, Homo sapiens
ucuuuugguuucuagaggccgc

SEQ ID NO: 184723 - RNA, 22 nt, Homo sapiens
ugaaacacacauugcccuuuau

SEQ ID NO: 184724 - RNA, 21 nt, Homo sapiens
ugaaaugcaugugcacauuaa

SEQ ID NO: 184725 - RNA, 21 nt, Homo sapiens
ugaaccccugcucucaagaaa

SEQ ID NO: 184726 - RNA, 22 nt, Homo sapiens
ugaaggccgggcaugguggcuc

SEQ ID NO: 184727 - RNA, 22 nt, Homo sapiens
ugaaguaauguuuuauucuauu

SEQ ID NO: 184728 - RNA, 22 nt, Homo sapiens
ugaauacuucaaaaaaauagcu

SEQ ID NO: 184729 - RNA, 22 nt, Homo sapiens
ugaauacuucguucaaagauaa

SEQ ID NO: 184730 - RNA, 22 nt, Homo sapiens
ugaauagaaguggcaggaguag

SEQ ID NO: 184731 - RNA, 22 nt, Homo sapiens
ugaauauguuaaauaauguucu

SEQ ID NO: 184732 - RNA, 22 nt, Homo sapiens
ugaauauguuucuaaaagugca

SEQ ID NO: 184733 - RNA, 22 nt, Homo sapiens
ugaauauuugcuacucacucuu

SEQ ID NO: 184734 - RNA, 22 nt, Homo sapiens
ugaaugguuuuuagagaacaau

SEQ ID NO: 184735 - RNA, 22 nt, Homo sapiens
ugaauuguuuacgagaugugag

SEQ ID NO: 184736 - RNA, 22 nt, Homo sapiens
ugacaagauauggucuuaucaa

SEQ ID NO: 184737 - RNA, 20 nt, Homo sapiens
ugacaucagcaauguaauaa

SEQ ID NO: 184738 - RNA, 22 nt, Homo sapiens
ugacucaguuucucagguagua

SEQ ID NO: 184739 - RNA, 22 nt, Homo sapiens
ugagacaaucucaucucaguga

SEQ ID NO: 184740 - RNA, 22 nt, Homo sapiens
ugagacugaaauuaggaaacug

SEQ ID NO: 184741 - RNA, 22 nt, Homo sapiens
ugagacugaguuuccaucuugu

SEQ ID NO: 184742 - RNA, 22 nt, Homo sapiens
ugagaggugaauggcaggcuca

SEQ ID NO: 184743 - RNA, 22 nt, Homo sapiens
ugagaggugauaaagcaagggu

SEQ ID NO: 184744 - RNA, 22 nt, Homo sapiens
ugagaugaguugcgcucugucg

SEQ ID NO: 184745 - RNA, 22 nt, Homo sapiens
ugagcagaaguuuugauuggcg

SEQ ID NO: 184746 - RNA, 22 nt, Homo sapiens
ugagcagagggagaaguaaauu

SEQ ID NO: 184747 - RNA, 22 nt, Homo sapiens
ugagcagaguuguuucuccuga

SEQ ID NO: 184748 - RNA, 22 nt, Homo sapiens
ugaggagugagaaauugguuuc

SEQ ID NO: 184749 - RNA, 22 nt, Homo sapiens
ugagguaagauguucauuuuuc

SEQ ID NO: 184750 - RNA, 22 nt, Homo sapiens
ugagguuauuuguucaagaagu

SEQ ID NO: 184751 - RNA, 22 nt, Homo sapiens
ugagucauuuccuuaugcuacu

SEQ ID NO: 184752 - RNA, 22 nt, Homo sapiens
ugaguguguaugugcauacaca

SEQ ID NO: 184753 - RNA, 23 nt, Homo sapiens
ugauaacagcauaugaagauucu

SEQ ID NO: 184754 - RNA, 17 nt, Homo sapiens
ugauaagugugagguga

SEQ ID NO: 184755 - RNA, 22 nt, Homo sapiens
ugauauauugaaugaugaaaca

SEQ ID NO: 184756 - RNA, 22 nt, Homo sapiens
ugcaagaaucagccuaucauua

SEQ ID NO: 184757 - RNA, 22 nt, Homo sapiens
ugcacugucuugucgcauagca

SEQ ID NO: 184758 - RNA, 22 nt, Homo sapiens
ugcacuguggucugagagacag

SEQ ID NO: 184759 - RNA, 22 nt, Homo sapiens
ugcagcacaguagguuugcaau

SEQ ID NO: 184760 - RNA, 22 nt, Homo sapiens
ugcaguagugugaucuuggcuc

SEQ ID NO: 184761 - RNA, 22 nt, Homo sapiens
ugcauccauucuagacucaucu

SEQ ID NO: 184762 - RNA, 22 nt, Homo sapiens
ugcauuaucagauguuugcuuu

SEQ ID NO: 184763 - RNA, 22 nt, Homo sapiens
ugcauuguuccgaauguguccu

SEQ ID NO: 184764 - RNA, 20 nt, Homo sapiens
ugccaagaaaugaggguauu

SEQ ID NO: 184765 - RNA, 22 nt, Homo sapiens
ugccaagaacauuuucuguuuu

SEQ ID NO: 184766 - RNA, 20 nt, Homo sapiens
ugccaagaugacuauagcuc

SEQ ID NO: 184767 - RNA, 21 nt, Homo sapiens
ugccuuuguaguaggugucuu

SEQ ID NO: 184768 - RNA, 23 nt, Homo sapiens
ugcugagaccuagauccuaaaga

SEQ ID NO: 184769 - RNA, 22 nt, Homo sapiens
ugcugcacuuauggcucugagg

SEQ ID NO: 184770 - RNA, 22 nt, Homo sapiens
uggaagauggaguuuuaucauu

SEQ ID NO: 184771 - RNA, 22 nt, Homo sapiens
uggaagauucuagaagauucca

SEQ ID NO: 184772 - RNA, 22 nt, Homo sapiens
uggaaggcuucauauguaaaga

SEQ ID NO: 184773 - RNA, 22 nt, Homo sapiens
uggaaguuaaaugacucuuucu

SEQ ID NO: 184774 - RNA, 22 nt, Homo sapiens
uggaauacaugucgcugagcug

SEQ ID NO: 184775 - RNA, 21 nt, Homo sapiens
uggaaucuauuauuccaguuu

SEQ ID NO: 184776 - RNA, 19 nt, Homo sapiens
uggaaugaaauguuagggg

SEQ ID NO: 184777 - RNA, 20 nt, Homo sapiens
uggaccagagagguggggac

SEQ ID NO: 184778 - RNA, 22 nt, Homo sapiens
uggaccccugcucgggagcccu

SEQ ID NO: 184779 - RNA, 23 nt, Homo sapiens
uggaggacaagcauggauaguga

SEQ ID NO: 184780 - RNA, 22 nt, Homo sapiens
agguuuucagccccagccuagg

SEQ ID NO: 184781 - RNA, 22 nt, Homo sapiens
aguacacuguuaaaaagaagug

SEQ ID NO: 184782 - RNA, 22 nt, Homo sapiens
aguauguuuugaaaccaagaag

SEQ ID NO: 184783 - RNA, 22 nt, Homo sapiens
agucacagccuuuuacuuuaga

SEQ ID NO: 184784 - RNA, 19 nt, Homo sapiens
agucaugugaggacccuug

SEQ ID NO: 184785 - RNA, 22 nt, Homo sapiens
agugagcuggagaaaagaaacu

SEQ ID NO: 184786 - RNA, 22 nt, Homo sapiens
agugcaaagccgagguuucuug

SEQ ID NO: 184787 - RNA, 22 nt, Homo sapiens
agugcaauaaggauguagaacu

SEQ ID NO: 184788 - RNA, 22 nt, Homo sapiens
agugcacuccagccugggcaac

SEQ ID NO: 184789 - RNA, 22 nt, Homo sapiens
auaaagccaugagcuugagaug

SEQ ID NO: 184790 - RNA, 22 nt, Homo sapiens
auaagagugggguguuagggau

SEQ ID NO: 184791 - RNA, 22 nt, Homo sapiens
auaagugagugauucaguguua

SEQ ID NO: 184792 - RNA, 19 nt, Homo sapiens
auacacguguauacauaca

SEQ ID NO: 184793 - RNA, 22 nt, Homo sapiens
auacaguguauguauaguacau

SEQ ID NO: 184794 - RNA, 22 nt, Homo sapiens
auacuaugagauaauaaagacu

SEQ ID NO: 184795 - RNA, 22 nt, Homo sapiens
auagagcuggcagacacccuua

SEQ ID NO: 184796 - RNA, 22 nt, Homo sapiens
auagaguuagaaagaaauguuu

SEQ ID NO: 184797 - RNA, 22 nt, Homo sapiens
auagcagaagaagggacaauuc

SEQ ID NO: 184798 - RNA, 22 nt, Homo sapiens
auaguagagagggcaaaaugcu

SEQ ID NO: 184799 - RNA, 22 nt, Homo sapiens
auagugcugcaaaaaacauacg

SEQ ID NO: 184800 - RNA, 22 nt, Homo sapiens
auagugcugcaacaaauauacg

SEQ ID NO: 184801 - RNA, 22 nt, Homo sapiens
auagugcugcagucaauguacg

SEQ ID NO: 184802 - RNA, 22 nt, Homo sapiens
auagugcugccauaaacauacg

SEQ ID NO: 184803 - RNA, 22 nt, Homo sapiens
auagugcuguauuaaacauacg

SEQ ID NO: 184804 - RNA, 23 nt, Homo sapiens
auauaguagaugugcaguaacau

SEQ ID NO: 184805 - RNA, 22 nt, Homo sapiens
auaugcacuauacacacguaua

SEQ ID NO: 184806 - RNA, 22 nt, Homo sapiens
auauggguuuuauauuaggcuc

SEQ ID NO: 184807 - RNA, 22 nt, Homo sapiens
auaugguguuugcuauucagcu

SEQ ID NO: 184808 - RNA, 22 nt, Homo sapiens
auauucaagugaggauggcuaa

SEQ ID NO: 184809 - RNA, 22 nt, Homo sapiens
aucaaauugucauuuuaaggau

SEQ ID NO: 184810 - RNA, 22 nt, Homo sapiens
aucacagguacuauggcugaca

SEQ ID NO: 184811 - RNA, 22 nt, Homo sapiens
aucacaguggcucacaagagcc

SEQ ID NO: 184812 - RNA, 22 nt, Homo sapiens
aucacaguuaagaggugaugaa

SEQ ID NO: 184813 - RNA, 22 nt, Homo sapiens
aucaccugagcaguauacacug

SEQ ID NO: 184814 - RNA, 22 nt, Homo sapiens
aucaccuggaggugaucacuug

SEQ ID NO: 184815 - RNA, 22 nt, Homo sapiens
aucauuaguuguggaauucuug

SEQ ID NO: 184816 - RNA, 22 nt, Homo sapiens
aucauugugcaucuucauucca

SEQ ID NO: 184817 - RNA, 22 nt, Homo sapiens
aucccagaaacucggguuucuc

SEQ ID NO: 184818 - RNA, 22 nt, Homo sapiens
aucccaguaaaaauggcuucua

SEQ ID NO: 184819 - RNA, 22 nt, Homo sapiens
aucccaguucagccucugacac

SEQ ID NO: 184820 - RNA, 22 nt, Homo sapiens
auccugagacuuugcugaaguu

SEQ ID NO: 184821 - RNA, 22 nt, Homo sapiens
aucugguguccucgugggaguc

SEQ ID NO: 184822 - RNA, 22 nt, Homo sapiens
aucugguguuuuucucccucgu

SEQ ID NO: 184823 - RNA, 22 nt, Homo sapiens
aucugugguuguaugcauauua

SEQ ID NO: 184824 - RNA, 22 nt, Homo sapiens
augaaagguugucuuaagccau

SEQ ID NO: 184825 - RNA, 22 nt, Homo sapiens
augaaaugcauguuaaguccgu

SEQ ID NO: 184826 - RNA, 20 nt, Homo sapiens
augaaggcaggugugaguuu

SEQ ID NO: 184827 - RNA, 22 nt, Homo sapiens
augacauugaugcucuggcugg

SEQ ID NO: 184828 - RNA, 22 nt, Homo sapiens
augagcuguuuggaagacacuu

SEQ ID NO: 184829 - RNA, 22 nt, Homo sapiens
augaggaaggagccuuugucug

SEQ ID NO: 184830 - RNA, 22 nt, Homo sapiens
augaggugauuucuguucgggu

SEQ ID NO: 184831 - RNA, 20 nt, Homo sapiens
augagguguaugacacugaa

SEQ ID NO: 184832 - RNA, 18 nt, Homo sapiens
augagucauuguggaaau

SEQ ID NO: 184833 - RNA, 22 nt, Homo sapiens
augcauaugucuuuauaguggc

SEQ ID NO: 184834 - RNA, 22 nt, Homo sapiens
augccaagaugagcacgcgucu

SEQ ID NO: 184835 - RNA, 22 nt, Homo sapiens
augccacugcacuccaaccugg

SEQ ID NO: 184836 - RNA, 22 nt, Homo sapiens
augccacugcacucuagccugg

SEQ ID NO: 184837 - RNA, 22 nt, Homo sapiens
augccacugcauaagguuuuca

SEQ ID NO: 184838 - RNA, 22 nt, Homo sapiens
augccacugcgcucuagccugg

SEQ ID NO: 184839 - RNA, 22 nt, Homo sapiens
augccauugcacuccagccugg

SEQ ID NO: 184840 - RNA, 22 nt, Homo sapiens
augcuacauucuacaauuaggc

SEQ ID NO: 184841 - RNA, 22 nt, Homo sapiens
auggaggccuacagaauuuugg

SEQ ID NO: 184842 - RNA, 22 nt, Homo sapiens
auggaguguaauauugagagcu

SEQ ID NO: 184843 - RNA, 22 nt, Homo sapiens
auggauauuuuuugaacauaga

SEQ ID NO: 184844 - RNA, 22 nt, Homo sapiens
auggcccuguguggagcugcug

SEQ ID NO: 184845 - RNA, 22 nt, Homo sapiens
auggccugaugcaccuguccca

SEQ ID NO: 184846 - RNA, 22 nt, Homo sapiens
auggcucuguuccaugugucuu

SEQ ID NO: 184847 - RNA, 22 nt, Homo sapiens
auguaauugagguuuuugccau

SEQ ID NO: 184848 - RNA, 22 nt, Homo sapiens
auguaguagauauuuauggaaa

SEQ ID NO: 184849 - RNA, 22 nt, Homo sapiens
augugacagcaacccccagccc

SEQ ID NO: 184850 - RNA, 22 nt, Homo sapiens
augugacugauggagaauaugu

SEQ ID NO: 184851 - RNA, 22 nt, Homo sapiens
augugacuuuuuccugugccuu

SEQ ID NO: 184852 - RNA, 22 nt, Homo sapiens
auguggcuuuucaacuguguga

SEQ ID NO: 184853 - RNA, 22 nt, Homo sapiens
augugucaaaucuaggccaaag

SEQ ID NO: 184854 - RNA, 22 nt, Homo sapiens
augugugcuugugacacagccu

SEQ ID NO: 184855 - RNA, 22 nt, Homo sapiens
auguguucaucacagcacaauu

SEQ ID NO: 184856 - RNA, 20 nt, Homo sapiens
auguucuggaggacagaagc

SEQ ID NO: 184857 - RNA, 22 nt, Homo sapiens
auucaagugaugugauucuucu

SEQ ID NO: 184858 - RNA, 22 nt, Homo sapiens
auuccacuuagugacucauuug

SEQ ID NO: 184859 - RNA, 22 nt, Homo sapiens
auugcacaucugcacuacagcc

SEQ ID NO: 184860 - RNA, 22 nt, Homo sapiens
auugcacuccacccugggcaac

SEQ ID NO: 184861 - RNA, 22 nt, Homo sapiens
auugcacuccagccccggggac

SEQ ID NO: 184862 - RNA, 23 nt, Homo sapiens
auugcacuccagccuaccugggc

SEQ ID NO: 184863 - RNA, 22 nt, Homo sapiens
auugcacuccagccuagucaac

SEQ ID NO: 184864 - RNA, 22 nt, Homo sapiens
auugcacuccagccuggaugac

SEQ ID NO: 184865 - RNA, 22 nt, Homo sapiens
auugcacuccagccuggcaaua

SEQ ID NO: 184866 - RNA, 22 nt, Homo sapiens
aggcaagugggagacagcauuu

SEQ ID NO: 184867 - RNA, 22 nt, Homo sapiens
aggcacggugucucaugccugu

SEQ ID NO: 184868 - RNA, 22 nt, Homo sapiens
aggcaugauuguauuuugcucu

SEQ ID NO: 184869 - RNA, 22 nt, Homo sapiens
aggcuuuauuacagggucucag

SEQ ID NO: 184870 - RNA, 22 nt, Homo sapiens
agguagguugagaugggcauca

SEQ ID NO: 184871 - RNA, 22 nt, Homo sapiens
aggugcugacaggauagguuuc

SEQ ID NO: 184872 - RNA, 20 nt, Homo sapiens
agguucaaaucccaaucaug

SEQ ID NO: 184873 - RNA, 22 nt, Homo sapiens
augaaaugcauguuaaguccgu

SEQ ID NO: 184874 - RNA, 22 nt, Homo sapiens
augacaagagccuucuuuccuu

SEQ ID NO: 184875 - RNA, 22 nt, Homo sapiens
augagauuauguaaagagacca

SEQ ID NO: 184876 - RNA, 22 nt, Homo sapiens
augagauucuuagagaagucug

SEQ ID NO: 184877 - RNA, 22 nt, Homo sapiens
augaucauggaaguuuuccugu

SEQ ID NO: 184878 - RNA, 22 nt, Homo sapiens
augaugcaguacuuugggaaca

SEQ ID NO: 184879 - RNA, 22 nt, Homo sapiens
augcagugugcaacagauuaag

SEQ ID NO: 184880 - RNA, 22 nt, Homo sapiens
auggaagaaaguuggguucuug

SEQ ID NO: 184881 - RNA, 22 nt, Homo sapiens
augucaaagaggaaaacuggau

SEQ ID NO: 184882 - RNA, 22 nt, Homo sapiens
augugaacaucauagaaugcac

SEQ ID NO: 184883 - RNA, 22 nt, Homo sapiens
augugaaugugaucggauaguc

SEQ ID NO: 184884 - RNA, 22 nt, Homo sapiens
auucagaggggcagcugucuug

SEQ ID NO: 184885 - RNA, 22 nt, Homo sapiens
auugcaaugggaaacuaugaaa

SEQ ID NO: 184886 - RNA, 22 nt, Homo sapiens
auugcacuccagccuugugaca

SEQ ID NO: 184887 - RNA, 22 nt, Homo sapiens
auugcauaaacacauuucuuau

SEQ ID NO: 184888 - RNA, 22 nt, Homo sapiens
auuggcaauggcaaagcagagu

SEQ ID NO: 184889 - RNA, 22 nt, Homo sapiens
auugucauuuauaacuguguag

SEQ ID NO: 184890 - RNA, 22 nt, Homo sapiens
auuuggcaacguagggaggcau

SEQ ID NO: 184891 - RNA, 22 nt, Homo sapiens
cacagaauucauuggauuaccu

SEQ ID NO: 184892 - RNA, 22 nt, Homo sapiens
cacauguuugcuacauuuuucu

SEQ ID NO: 184893 - RNA, 22 nt, Homo sapiens
cacugcauccuccaccuccugg

SEQ ID NO: 184894 - RNA, 22 nt, Homo sapiens
cacugcauucuccaccucccag

SEQ ID NO: 184895 - RNA, 22 nt, Homo sapiens
cacugcgaccuccaccucccgg

SEQ ID NO: 184896 - RNA, 22 nt, Homo sapiens
cagagaaugucuuuuuuaacca

SEQ ID NO: 184897 - RNA, 22 nt, Homo sapiens
caugccauugcucuccugggug

SEQ ID NO: 184898 - RNA, 22 nt, Homo sapiens
cauugcaugccagccugggcaa

SEQ ID NO: 184899 - RNA, 22 nt, Homo sapiens
cauugcauuccagucugggcaa

SEQ ID NO: 184900 - RNA, 22 nt, Homo sapiens
cauugcauuuucuuuguaccuu

SEQ ID NO: 184901 - RNA, 23 nt, Homo sapiens
ccacacuguuuagaauggcauca

SEQ ID NO: 184902 - RNA, 22 nt, Homo sapiens
ccaucccuuucugagcaguucc

SEQ ID NO: 184903 - RNA, 17 nt, Homo sapiens
cccuaguagcugggacu

SEQ ID NO: 184904 - RNA, 22 nt, Homo sapiens
cgaguagcacaaugugugugau

SEQ ID NO: 184905 - RNA, 22 nt, Homo sapiens
cuacaguuauguuuuaaaugug

SEQ ID NO: 184906 - RNA, 22 nt, Homo sapiens
cucaguuuugccuuguuuaagg

SEQ ID NO: 184907 - RNA, 22 nt, Homo sapiens
cuccauuuaguccuuuuagaag

SEQ ID NO: 184908 - RNA, 22 nt, Homo sapiens
cuccuggugauuggagugugaa

SEQ ID NO: 184909 - RNA, 22 nt, Homo sapiens
cuccuugauuagaguauagagu

SEQ ID NO: 184910 - RNA, 22 nt, Homo sapiens
cucucaagaugcugggauuaca

SEQ ID NO: 184911 - RNA, 22 nt, Homo sapiens
cucugagccugagguuccuacu

SEQ ID NO: 184912 - RNA, 22 nt, Homo sapiens
cugagauggagucucgcauugu

SEQ ID NO: 184913 - RNA, 22 nt, Homo sapiens
cugagcaaaaugaagacacgau

SEQ ID NO: 184914 - RNA, 22 nt, Homo sapiens
cugauacugagaccuuggguua

SEQ ID NO: 184915 - RNA, 22 nt, Homo sapiens
cugauugucaucaauauuauua

SEQ ID NO: 184916 - RNA, 22 nt, Homo sapiens
cugcaaauacuugugggauuuu

SEQ ID NO: 184917 - RNA, 18 nt, Homo sapiens
cuggaugucgaguguguu

SEQ ID NO: 184918 - RNA, 23 nt, Homo sapiens
cuguggugaggcccuagaaucug

SEQ ID NO: 184919 - RNA, 22 nt, Homo sapiens
cuugagacauuguuuuccaagu

SEQ ID NO: 184920 - RNA, 18 nt, Homo sapiens
cuugucaaaucuuuccuc

SEQ ID NO: 184921 - RNA, 22 nt, Homo sapiens
cuuucugaggagaauagagaac

SEQ ID NO: 184922 - RNA, 23 nt, Homo sapiens
cuuuugcaaugugaucuugccac

SEQ ID NO: 184923 - RNA, 21 nt, Homo sapiens
cuuuugcacuccagccugggu

SEQ ID NO: 184924 - RNA, 22 nt, Homo sapiens
gaaaacugcuucucuggguuuc

SEQ ID NO: 184925 - RNA, 22 nt, Homo sapiens
gaagaacuaggugagaucuaga

SEQ ID NO: 184926 - RNA, 22 nt, Homo sapiens
gaaucacaguuauuagagcagc

SEQ ID NO: 184927 - RNA, 22 nt, Homo sapiens
gaaucauuguuucuaaguuugu

SEQ ID NO: 184928 - RNA, 22 nt, Homo sapiens
gaauguuuacuuuguuuaauac

SEQ ID NO: 184929 - RNA, 22 nt, Homo sapiens
gaauuguacugcaaucagggga

SEQ ID NO: 184930 - RNA, 22 nt, Homo sapiens
gacauguaaggcucucucuguu

SEQ ID NO: 184931 - RNA, 22 nt, Homo sapiens
gagacggagucucgcucuguca

SEQ ID NO: 184932 - RNA, 22 nt, Homo sapiens
gaguagugcugcaguaaacaca

SEQ ID NO: 184933 - RNA, 22 nt, Homo sapiens
gagugcaauggcaccgucucgg

SEQ ID NO: 184934 - RNA, 22 nt, Homo sapiens
gagugcaauggcaugaucuggg

SEQ ID NO: 184935 - RNA, 22 nt, Homo sapiens
gagugcaauggcgcgaucucgg

SEQ ID NO: 184936 - RNA, 22 nt, Homo sapiens
gauauguucugagaaaugcauu

SEQ ID NO: 184937 - RNA, 22 nt, Homo sapiens
gaugacagcugacucccuugcu

SEQ ID NO: 184938 - RNA, 22 nt, Homo sapiens
gaugacagugaguaaccccaac

SEQ ID NO: 184939 - RNA, 22 nt, Homo sapiens
gauguguuuguuucuggaggag

SEQ ID NO: 184940 - RNA, 22 nt, Homo sapiens
gauuccauugcgaauuuucaga

SEQ ID NO: 184941 - RNA, 22 nt, Homo sapiens
gcaagaaugagaaggauuaauu

SEQ ID NO: 184942 - RNA, 22 nt, Homo sapiens
gcagugcaguggcgcgaucucg

SEQ ID NO: 184943 - RNA, 22 nt, Homo sapiens
ggacaaaguauuuucaaaugua

SEQ ID NO: 184944 - RNA, 22 nt, Homo sapiens
ggagaugauuaugaaucacuua

SEQ ID NO: 184945 - RNA, 23 nt, Homo sapiens
ggaguguauuggcacgaucucag

SEQ ID NO: 184946 - RNA, 22 nt, Homo sapiens
ggagugucagaaacaguguccu

SEQ ID NO: 184947 - RNA, 22 nt, Homo sapiens
ggaucacagccagcucccagaa

SEQ ID NO: 184948 - RNA, 22 nt, Homo sapiens
ggcacaaugucagcucacugca

SEQ ID NO: 184949 - RNA, 22 nt, Homo sapiens
guaaauaccaguuucuggaaca

SEQ ID NO: 184950 - RNA, 22 nt, Homo sapiens
guacaguaguaaaagugaauga

SEQ ID NO: 184951 - RNA, 22 nt, Homo sapiens
guauuuuguuagggugugguau

SEQ ID NO: 184952 - RNA, 22 nt, Homo sapiens
gucacugccugaggcugaugca

SEQ ID NO: 184953 - RNA, 22 nt, Homo sapiens
gucuggcacagggaaaguacaa

SEQ ID NO: 184954 - RNA, 22 nt, Homo sapiens
gucuuccagccuccaucuuucu

SEQ ID NO: 184955 - RNA, 22 nt, Homo sapiens
gugaaagauuaaaccagugugu

SEQ ID NO: 184956 - RNA, 22 nt, Homo sapiens
gugagauuuucuccagguucag

SEQ ID NO: 184957 - RNA, 22 nt, Homo sapiens
gugcaguguuugcauggaauca

SEQ ID NO: 184958 - RNA, 22 nt, Homo sapiens
guguaaaacaauuagaggauuu

SEQ ID NO: 184959 - RNA, 22 nt, Homo sapiens
gugugguaggauugguuacuca

SEQ ID NO: 184960 - RNA, 22 nt, Homo sapiens
gugugguauuauaacuagguau

SEQ ID NO: 184961 - RNA, 22 nt, Homo sapiens
guuuuuggggucacuauuaccg

SEQ ID NO: 184962 - RNA, 22 nt, Homo sapiens
uaaagauaaggcucgcuuggau

SEQ ID NO: 184963 - RNA, 22 nt, Homo sapiens
uaaagccagugauuaugucucu

SEQ ID NO: 184964 - RNA, 22 nt, Homo sapiens
uacaagcacaggcagcaggcug

SEQ ID NO: 184965 - RNA, 22 nt, Homo sapiens
uacagccacauaauguaugauu

SEQ ID NO: 184966 - RNA, 22 nt, Homo sapiens
uagcaguaagaaacugacauug

SEQ ID NO: 184967 - RNA, 22 nt, Homo sapiens
uagcaguagacagacuuuggcu

SEQ ID NO: 184968 - RNA, 22 nt, Homo sapiens
uagcaguauaugagagcuauug

SEQ ID NO: 184969 - RNA, 22 nt, Homo sapiens
uaucacagcgggguguacaccc

SEQ ID NO: 184970 - RNA, 22 nt, Homo sapiens
uaucacaggucaggaaucuugc

SEQ ID NO: 184971 - RNA, 22 nt, Homo sapiens
uaucacaguaaaucugggugca

SEQ ID NO: 184972 - RNA, 20 nt, Homo sapiens
uaucacaguucaggaacucu

SEQ ID NO: 184973 - RNA, 22 nt, Homo sapiens
uaucucagaguguacaagauua

SEQ ID NO: 184974 - RNA, 22 nt, Homo sapiens
uauuacauccauaggcucugcu

SEQ ID NO: 184975 - RNA, 22 nt, Homo sapiens
uauugcauauuauucuaguggc

SEQ ID NO: 184976 - RNA, 22 nt, Homo sapiens
uauugcauguugagcaguaccu

SEQ ID NO: 184977 - RNA, 22 nt, Homo sapiens
gugguuguuggaguggcaauuu

SEQ ID NO: 184978 - RNA, 21 nt, Homo sapiens
uaaaacuguaacuuuguccug

SEQ ID NO: 184979 - RNA, 22 nt, Homo sapiens
uaaagccauugucaaguuugua

SEQ ID NO: 184980 - RNA, 22 nt, Homo sapiens
uaacaagagagucagucagucc

SEQ ID NO: 184981 - RNA, 22 nt, Homo sapiens
uaacaggcaaggucacaccuug

SEQ ID NO: 184982 - RNA, 22 nt, Homo sapiens
uaagaugaaggcucaccuagaa

SEQ ID NO: 184983 - RNA, 22 nt, Homo sapiens
uaauccuggcacuuugggaggc

SEQ ID NO: 184984 - RNA, 22 nt, Homo sapiens
uacaaagcuuucugcaaaucau

SEQ ID NO: 184985 - RNA, 21 nt, Homo sapiens
uacaaugcacaggagagccuc

SEQ ID NO: 184986 - RNA, 22 nt, Homo sapiens
uacugcagucagacuccugggc

SEQ ID NO: 184987 - RNA, 22 nt, Homo sapiens
uagaaaguagggaagguaggau

SEQ ID NO: 184988 - RNA, 22 nt, Homo sapiens
uagacacuagauaugugacuga

SEQ ID NO: 184989 - RNA, 22 nt, Homo sapiens
uagcaguauacguacugggucc

SEQ ID NO: 184990 - RNA, 22 nt, Homo sapiens
uagcaguauggagcgaggccca

SEQ ID NO: 184991 - RNA, 22 nt, Homo sapiens
uagucaaaucugaaggaaauuu

SEQ ID NO: 184992 - RNA, 22 nt, Homo sapiens
uauaagacuagcagcugaauug

SEQ ID NO: 184993 - RNA, 22 nt, Homo sapiens
uauacagcaaguuacugugcug

SEQ ID NO: 184994 - RNA, 22 nt, Homo sapiens
uauaugcaacauaguguaugug

SEQ ID NO: 184995 - RNA, 22 nt, Homo sapiens
uauaugcacucagguguaugug

SEQ ID NO: 184996 - RNA, 22 nt, Homo sapiens
uaucaacaggguggccagugua

SEQ ID NO: 184997 - RNA, 22 nt, Homo sapiens
uaucaagaugacaaacuuugcu

SEQ ID NO: 184998 - RNA, 21 nt, Homo sapiens
uaucagagacauugagaggca

SEQ ID NO: 184999 - RNA, 22 nt, Homo sapiens
uaugcuuauaaacauuugucag

SEQ ID NO: 185000 - RNA, 22 nt, Homo sapiens
uauggcauuguuggugaugaua

SEQ ID NO: 185001 - RNA, 22 nt, Homo sapiens
uauugcagauacccaggaaguu

SEQ ID NO: 185002 - RNA, 22 nt, Homo sapiens
uauugucacuaaaggaagcugg

SEQ ID NO: 185003 - RNA, 22 nt, Homo sapiens
ucaaagucuucucaaguaacau

SEQ ID NO: 185004 - RNA, 22 nt, Homo sapiens
ucacagacugagccaaauagag

SEQ ID NO: 185005 - RNA, 22 nt, Homo sapiens
ucacugaaaccacugccuccug

SEQ ID NO: 185006 - RNA, 22 nt, Homo sapiens
ucacugagcacaggagaugugc

SEQ ID NO: 185007 - RNA, 22 nt, Homo sapiens
ucacugcacuagguaaugccac

SEQ ID NO: 185008 - RNA, 22 nt, Homo sapiens
ucacugcacuccagccuuuaug

SEQ ID NO: 185009 - RNA, 22 nt, Homo sapiens
ucacugcacuucaggcuuucuc

SEQ ID NO: 185010 - RNA, 22 nt, Homo sapiens
ucagaguagagcgacuucuccu

SEQ ID NO: 185011 - RNA, 22 nt, Homo sapiens
ucaguaaaugcuguucucuuuu

SEQ ID NO: 185012 - RNA, 22 nt, Homo sapiens
ucaguggagagcuuccaggauu

SEQ ID NO: 185013 - RNA, 22 nt, Homo sapiens
ucauugcauguuaauuaaacag

SEQ ID NO: 185014 - RNA, 22 nt, Homo sapiens
uccacagugguugaacuaguuu

SEQ ID NO: 185015 - RNA, 20 nt, Homo sapiens
uccaguuuuggagacauucu

SEQ ID NO: 185016 - RNA, 22 nt, Homo sapiens
ucccugaaaauuagcauuuuaa

SEQ ID NO: 185017 - RNA, 22 nt, Homo sapiens
ucccugaaucucagguucugua

SEQ ID NO: 185018 - RNA, 22 nt, Homo sapiens
ucucagugaauguggaaaaagc

SEQ ID NO: 185019 - RNA, 22 nt, Homo sapiens
ucuuuggguguauuucacagcc

SEQ ID NO: 185020 - RNA, 22 nt, Homo sapiens
ucuuuggucuacuuucauaugu

SEQ ID NO: 185021 - RNA, 22 nt, Homo sapiens
ugaaagcuacaggaaaguauuu

SEQ ID NO: 185022 - RNA, 22 nt, Homo sapiens
ugaaaugauuauaugguguuug

SEQ ID NO: 185023 - RNA, 22 nt, Homo sapiens
ugagaaugcagaaucucgugca

SEQ ID NO: 185024 - RNA, 22 nt, Homo sapiens
ugagacggagucuugcccuguc

SEQ ID NO: 185025 - RNA, 22 nt, Homo sapiens
ugagacggaguuauuuauaaua

SEQ ID NO: 185026 - RNA, 22 nt, Homo sapiens
ugagagaugauaaaauguuugu

SEQ ID NO: 185027 - RNA, 22 nt, Homo sapiens
ugagauggagucuugucgccua

SEQ ID NO: 185028 - RNA, 23 nt, Homo sapiens
ugagauuacccagaaagaguaua

SEQ ID NO: 185029 - RNA, 22 nt, Homo sapiens
ugagcaagaaauagaaacagau

SEQ ID NO: 185030 - RNA, 22 nt, Homo sapiens
ugaguuagguaauaauaaauau

SEQ ID NO: 185031 - RNA, 22 nt, Homo sapiens
ugaguuuaucuaaagaccuggg

SEQ ID NO: 185032 - RNA, 22 nt, Homo sapiens
ugaucugucacuuaucacauuu

SEQ ID NO: 185033 - RNA, 17 nt, Homo sapiens
ugcaauuuaagcuagau

SEQ ID NO: 185034 - RNA, 22 nt, Homo sapiens
ugccauagcaaugguaagcuga

SEQ ID NO: 185035 - RNA, 22 nt, Homo sapiens
ugccaucauuaauauuaggcau

SEQ ID NO: 185036 - RNA, 22 nt, Homo sapiens
ugccugcugucuaauauauucu

SEQ ID NO: 185037 - RNA, 22 nt, Homo sapiens
ugcugcaaacaggcaucugugg

SEQ ID NO: 185038 - RNA, 22 nt, Homo sapiens
ugcugcauuggggauuaaguuu

SEQ ID NO: 185039 - RNA, 22 nt, Homo sapiens
uggagucuugcucuguugccca

SEQ ID NO: 185040 - RNA, 22 nt, Homo sapiens
uggcaaaugaaagaaagccagu

SEQ ID NO: 185041 - RNA, 22 nt, Homo sapiens
uggcuguuuauuucacaugggu

SEQ ID NO: 185042 - RNA, 22 nt, Homo sapiens
ugggaauaugauacaggucuuu

SEQ ID NO: 185043 - RNA, 22 nt, Homo sapiens
uguauuuguuguuaaauggaga

SEQ ID NO: 185044 - RNA, 22 nt, Homo sapiens
ugucaauauguaauaacugaau

SEQ ID NO: 185045 - RNA, 22 nt, Homo sapiens
ugucucagugauuggcuuucug

SEQ ID NO: 185046 - RNA, 22 nt, Homo sapiens
ugugauaguuggcuaaagcagu

SEQ ID NO: 185047 - RNA, 22 nt, Homo sapiens
uuaaauacagcaugguguuucu

SEQ ID NO: 185048 - RNA, 22 nt, Homo sapiens
uuaaggguuuuagaauuuucca

SEQ ID NO: 185049 - RNA, 22 nt, Homo sapiens
uuaagguaugugggcauuuugu

SEQ ID NO: 185050 - RNA, 19 nt, Homo sapiens
uuacagugugcccuuuuag

SEQ ID NO: 185051 - RNA, 22 nt, Homo sapiens
uuacaguugugagccaccaugc

SEQ ID NO: 185052 - RNA, 22 nt, Homo sapiens
uuacauugcuucaaauucagug

SEQ ID NO: 185053 - RNA, 22 nt, Homo sapiens
uuagguauuaggaaauaugcuu

SEQ ID NO: 185054 - RNA, 22 nt, Homo sapiens
uuaugcagcaaagugcuugaaa

SEQ ID NO: 185055 - RNA, 16 nt, Homo sapiens
uuauugcauucuucuc

SEQ ID NO: 185056 - RNA, 22 nt, Homo sapiens
uucaaaucuucguuuugccaua

SEQ ID NO: 185057 - RNA, 22 nt, Homo sapiens
uucacugcauuucagccugggc

SEQ ID NO: 185058 - RNA, 22 nt, Homo sapiens
uucauaguaacaguaacuaugg

SEQ ID NO: 185059 - RNA, 22 nt, Homo sapiens
uucauaguuuauacugauauuu

SEQ ID NO: 185060 - RNA, 22 nt, Homo sapiens
uucccugaaguguuacucuaga

SEQ ID NO: 185061 - RNA, 22 nt, Homo sapiens
uucucaauggcaacuuguugcu

SEQ ID NO: 185062 - RNA, 22 nt, Homo sapiens
uugaaagacaucaccuacugcu

SEQ ID NO: 185063 - RNA, 20 nt, Homo sapiens
uugacaguggguuguuaaag

SEQ ID NO: 185064 - RNA, 22 nt, Homo sapiens
uugacaguugggcagggaaguu

SEQ ID NO: 185065 - RNA, 22 nt, Homo sapiens
uugacauaaucauuucacagug

SEQ ID NO: 185066 - RNA, 21 nt, Homo sapiens
uugagacggagucucacucug

SEQ ID NO: 185067 - RNA, 22 nt, Homo sapiens
uugagauggaaucucgcuuugu

SEQ ID NO: 185068 - RNA, 22 nt, Homo sapiens
aaagugcuuacuaaguugccaa

SEQ ID NO: 185069 - RNA, 22 nt, Homo sapiens
aagcacccagccucacgccugc

SEQ ID NO: 185070 - RNA, 22 nt, Homo sapiens
aaguugcuuuagguaagucaau

SEQ ID NO: 185071 - RNA, 22 nt, Homo sapiens
aauacagcacacagaugggucu

SEQ ID NO: 185072 - RNA, 22 nt, Homo sapiens
aaucuguagaaggugcacauuc

SEQ ID NO: 185073 - RNA, 22 nt, Homo sapiens
acaaaguaggcagugggcugga

SEQ ID NO: 185074 - RNA, 22 nt, Homo sapiens
acaguaaugggccccuuuuccu

SEQ ID NO: 185075 - RNA, 22 nt, Homo sapiens
acuccauuucauuuuagcucuu

SEQ ID NO: 185076 - RNA, 22 nt, Homo sapiens
acugcacuccagccugaugaaa

SEQ ID NO: 185077 - RNA, 22 nt, Homo sapiens
agaaugugaccuuauuuggaga

SEQ ID NO: 185078 - RNA, 22 nt, Homo sapiens
agagagcuugggguguuaaauu

SEQ ID NO: 185079 - RNA, 22 nt, Homo sapiens
agagugcaaagguuggggcugg

SEQ ID NO: 185080 - RNA, 22 nt, Homo sapiens
agauggguuuucacauguuggc

SEQ ID NO: 185081 - RNA, 22 nt, Homo sapiens
aggacacugagcaugggagguu

SEQ ID NO: 185082 - RNA, 22 nt, Homo sapiens
aggcugguauuuacaaaagcuc

SEQ ID NO: 185083 - RNA, 22 nt, Homo sapiens
aggcuguguggauaauauuggg

SEQ ID NO: 185084 - RNA, 22 nt, Homo sapiens
agugcaaggacauuuagguugu

SEQ ID NO: 185085 - RNA, 22 nt, Homo sapiens
agugcaguggugccaucauaac

SEQ ID NO: 185086 - RNA, 22 nt, Homo sapiens
agugcaguugucacgugccuuc

SEQ ID NO: 185087 - RNA, 22 nt, Homo sapiens
auacaagugccauguuggugug

SEQ ID NO: 185088 - RNA, 22 nt, Homo sapiens
auacuguuucugaacuuugauu

SEQ ID NO: 185089 - RNA, 22 nt, Homo sapiens
auagcagugugaaaacagacug

SEQ ID NO: 185090 - RNA, 22 nt, Homo sapiens
auaugcauacauguaugcagga

SEQ ID NO: 185091 - RNA, 22 nt, Homo sapiens
auauucacagguaucagagauu

SEQ ID NO: 185092 - RNA, 23 nt, Homo sapiens
auccacauucuaguccuuuaugc

SEQ ID NO: 185093 - RNA, 22 nt, Homo sapiens
augacaguaugacuccaaaagu

SEQ ID NO: 185094 - RNA, 22 nt, Homo sapiens
augaucaucugaaagcuuuuac

SEQ ID NO: 185095 - RNA, 22 nt, Homo sapiens
augggaaaaucagaaggccugg

SEQ ID NO: 185096 - RNA, 22 nt, Homo sapiens
auguauacaugcaggucacagg

SEQ ID NO: 185097 - RNA, 22 nt, Homo sapiens
auuccauuuguuaucacacccg

SEQ ID NO: 185098 - RNA, 22 nt, Homo sapiens
auucccuuagcugccucagccu

SEQ ID NO: 185099 - RNA, 22 nt, Homo sapiens
auuccuuaggcccuuugguuag

SEQ ID NO: 185100 - RNA, 22 nt, Homo sapiens
auugagacaaauuuguaugcag

SEQ ID NO: 185101 - RNA, 22 nt, Homo sapiens
auugcaacuuccgccuccuggg

SEQ ID NO: 185102 - RNA, 22 nt, Homo sapiens
auugcacaucugcacuacagcc

SEQ ID NO: 185103 - RNA, 22 nt, Homo sapiens
auugcacuggggguuagaauuu

SEQ ID NO: 185104 - RNA, 22 nt, Homo sapiens
auuguaguuugcuauggcaaua

SEQ ID NO: 185105 - RNA, 21 nt, Homo sapiens
auuguauguaaaccaaaugag

SEQ ID NO: 185106 - RNA, 18 nt, Homo sapiens
auuuuugcaguccacaug

SEQ ID NO: 185107 - RNA, 22 nt, Homo sapiens
caaagcuauagcaccagaggga

SEQ ID NO: 185108 - RNA, 22 nt, Homo sapiens
caaaggcuuccacugcauccuu

SEQ ID NO: 185109 - RNA, 22 nt, Homo sapiens
cagagcaaugcuuuugcuuuga

SEQ ID NO: 185110 - RNA, 22 nt, Homo sapiens
cagauguaguauuuuagugaaa

SEQ ID NO: 185111 - RNA, 22 nt, Homo sapiens
cauacaagcuacaaucacaaag

SEQ ID NO: 185112 - RNA, 22 nt, Homo sapiens
cauugcaugcauauggcuuggu

SEQ ID NO: 185113 - RNA, 19 nt, Homo sapiens
ccuuugguuuccaugacau

SEQ ID NO: 185114 - RNA, 22 nt, Homo sapiens
cgcuggugucuaagcgacagcu

SEQ ID NO: 185115 - RNA, 22 nt, Homo sapiens
uuagaacagugcucaccacaaa

SEQ ID NO: 185116 - RNA, 22 nt, Homo sapiens
uuaggcuuuauugaaaacaaua

SEQ ID NO: 185117 - RNA, 22 nt, Homo sapiens
uuagugaaugcaccacuucuga

SEQ ID NO: 185118 - RNA, 22 nt, Homo sapiens
uuauugcacuccagccugggua

SEQ ID NO: 185119 - RNA, 22 nt, Homo sapiens
uucaaaguuggaggacaaacug

SEQ ID NO: 185120 - RNA, 22 nt, Homo sapiens
uucacugcacuccagccugagc

SEQ ID NO: 185121 - RNA, 22 nt, Homo sapiens
uucccugaaauauucacuuuca

SEQ ID NO: 185122 - RNA, 22 nt, Homo sapiens
uucccugaguaucuuaccaugg

SEQ ID NO: 185123 - RNA, 22 nt, Homo sapiens
uuccugugacccccaagcccac

SEQ ID NO: 185124 - RNA, 17 nt, Homo sapiens
uucucaguucugaucuc

SEQ ID NO: 185125 - RNA, 22 nt, Homo sapiens
uucuguguuuaggucacggcua

SEQ ID NO: 185126 - RNA, 22 nt, Homo sapiens
uugaaagaugaacuggauugga

SEQ ID NO: 185127 - RNA, 22 nt, Homo sapiens
uugaaagucauuucuucuaagu

SEQ ID NO: 185128 - RNA, 22 nt, Homo sapiens
uugaagacuaauuuagauaaug

SEQ ID NO: 185129 - RNA, 22 nt, Homo sapiens
uugagacggagucucacucugu

SEQ ID NO: 185130 - RNA, 22 nt, Homo sapiens
uugagacggaguuuugcucuug

SEQ ID NO: 185131 - RNA, 22 nt, Homo sapiens
uugagauggaguuucgcucuug

SEQ ID NO: 185132 - RNA, 22 nt, Homo sapiens
uugagcacauguguuaaggggu

SEQ ID NO: 185133 - RNA, 23 nt, Homo sapiens
uugcaaagccugaaacucuucag

SEQ ID NO: 185134 - RNA, 23 nt, Homo sapiens
uugcauugcccuccauaguacuc

SEQ ID NO: 185135 - RNA, 22 nt, Homo sapiens
uuggaaaaauccaccuugaucu

SEQ ID NO: 185136 - RNA, 22 nt, Homo sapiens
uuggcauuuuggacacccagga

SEQ ID NO: 185137 - RNA, 22 nt, Homo sapiens
uuggcuuggagaguugaaaugu

SEQ ID NO: 185138 - RNA, 21 nt, Homo sapiens
uuggggaauggagagguuuuc

SEQ ID NO: 185139 - RNA, 23 nt, Homo sapiens
uuggucucccaaaguguugagau

SEQ ID NO: 185140 - RNA, 22 nt, Homo sapiens
uuguaaacaucuguacauugcu

SEQ ID NO: 185141 - RNA, 22 nt, Homo sapiens
uugucauuuucagaguguuacg

SEQ ID NO: 185142 - RNA, 19 nt, Homo sapiens
uuguccccucuaaaucuca

SEQ ID NO: 185143 - RNA, 22 nt, Homo sapiens
uugugaaugaugucgcaguaaa

SEQ ID NO: 185144 - RNA, 22 nt, Homo sapiens
uugugaauggugccgcaauaaa

SEQ ID NO: 185145 - RNA, 22 nt, Homo sapiens
uugugaauggugccucaguaaa

SEQ ID NO: 185146 - RNA, 22 nt, Homo sapiens
uuguucccuucuggcuuuuaug

SEQ ID NO: 185147 - RNA, 19 nt, Homo sapiens
uuuccaguaaucuuaugug

SEQ ID NO: 185148 - RNA, 22 nt, Homo sapiens
uuuccaguuguucuagaaagcu

SEQ ID NO: 185149 - RNA, 18 nt, Homo sapiens
uuuguacuuuuucuaaug

SEQ ID NO: 185150 - RNA, 22 nt, Homo sapiens
uuugugaaugucauaagcucca

SEQ ID NO: 185151 - RNA, 18 nt, Homo sapiens
uuugugcuccacaaagga

SEQ ID NO: 185152 - RNA, 20 nt, Homo sapiens
uuuuagcuuuuauugaaagc

SEQ ID NO: 185153 - RNA, 19 nt, Homo sapiens
uuuugcucuuuauaccuau

SEQ ID NO: 185154 - RNA, 22 nt, Homo sapiens
uuuuggcucugucuguaucuuu

SEQ ID NO: 185155 - RNA, 16 nt, Homo sapiens
uuuuugcagaaaugac

SEQ ID NO: 185156 - RNA, 22 nt, Homo sapiens
uuuuugugguauauugcaacaa

SEQ ID NO: 185157 - RNA, 22 nt, Homo sapiens
gucacuguuuccuauuauauuu

SEQ ID NO: 185158 - RNA, 22 nt, Homo sapiens
gucccugaggaacauccagggc

SEQ ID NO: 185159 - RNA, 22 nt, Homo sapiens
gucugcaugucauaugauagua

SEQ ID NO: 185160 - RNA, 22 nt, Homo sapiens
gucugugguuccuaugucaccu

SEQ ID NO: 185161 - RNA, 22 nt, Homo sapiens
gugaaagacagcauuaauggcu

SEQ ID NO: 185162 - RNA, 22 nt, Homo sapiens
gugaaagacauauaugguuuga

SEQ ID NO: 185163 - RNA, 22 nt, Homo sapiens
guggaaaacauaugcuuguuga

SEQ ID NO: 185164 - RNA, 22 nt, Homo sapiens
guggaaaaguaguugcgguuuu

SEQ ID NO: 185165 - RNA, 22 nt, Homo sapiens
guguauauccuauuaguucugu

SEQ ID NO: 185166 - RNA, 22 nt, Homo sapiens
gugucaugagggggacaggaag

SEQ ID NO: 185167 - RNA, 22 nt, Homo sapiens
guucaagcaauucugcugccuc

SEQ ID NO: 185168 - RNA, 22 nt, Homo sapiens
guucaguuuugaaauguuaauu

SEQ ID NO: 185169 - RNA, 22 nt, Homo sapiens
uaagcagugcaagaauggaaua

SEQ ID NO: 185170 - RNA, 22 nt, Homo sapiens
uaagggacgcccccuucucucu

SEQ ID NO: 185171 - RNA, 22 nt, Homo sapiens
uaaguaaaugaaagguugauuu

SEQ ID NO: 185172 - RNA, 22 nt, Homo sapiens
uaauauguauacagacagauac

SEQ ID NO: 185173 - RNA, 21 nt, Homo sapiens
uaauggcaugaucucggcuca

SEQ ID NO: 185174 - RNA, 22 nt, Homo sapiens
uaauuggaucucaaaaaagugu

SEQ ID NO: 185175 - RNA, 22 nt, Homo sapiens
uacagaauugcagguguggcag

SEQ ID NO: 185176 - RNA, 22 nt, Homo sapiens
uagaauguaacaguuaaaagca

SEQ ID NO: 185177 - RNA, 22 nt, Homo sapiens
uagcagcauaaauggacuaaga

SEQ ID NO: 185178 - RNA, 22 nt, Homo sapiens
uagcaguaaagaaugugauguu

SEQ ID NO: 185179 - RNA, 22 nt, Homo sapiens
uagcaguaucccaccaucuggu

SEQ ID NO: 185180 - RNA, 22 nt, Homo sapiens
uaggacaaugguacagcagaaa

SEQ ID NO: 185181 - RNA, 22 nt, Homo sapiens
uaggcaaaugcaagaguagaac

SEQ ID NO: 185182 - RNA, 22 nt, Homo sapiens
uaguauguuuauagcauugagu

SEQ ID NO: 185183 - RNA, 22 nt, Homo sapiens
uagugcaguggcuccaucucag

SEQ ID NO: 185184 - RNA, 22 nt, Homo sapiens
uauaaaguaauuucuaggggcu

SEQ ID NO: 185185 - RNA, 22 nt, Homo sapiens
uaucacaguaucuagcacagug

SEQ ID NO: 185186 - RNA, 22 nt, Homo sapiens
uaucacagugcuggaguauucc

SEQ ID NO: 185187 - RNA, 18 nt, Homo sapiens
uaucucauuucuuagguc

SEQ ID NO: 185188 - RNA, 22 nt, Homo sapiens
uaucugcacauacacuuauagc

SEQ ID NO: 185189 - RNA, 22 nt, Homo sapiens
uauggcauuauuuugauagaca

SEQ ID NO: 185190 - RNA, 22 nt, Homo sapiens
uaugucauggguaaagugcccu

SEQ ID NO: 185191 - RNA, 22 nt, Homo sapiens
uauugcaaauggugaucccagg

SEQ ID NO: 185192 - RNA, 22 nt, Homo sapiens
uauugcacuccucaugcauuug

SEQ ID NO: 185193 - RNA, 22 nt, Homo sapiens
ucaaaugauucacccaccuuug

SEQ ID NO: 185194 - RNA, 22 nt, Homo sapiens
ucaaguaauacucccaucuugg

SEQ ID NO: 185195 - RNA, 22 nt, Homo sapiens
ucaccaccugcugauuguagag

SEQ ID NO: 185196 - RNA, 22 nt, Homo sapiens
ucacugaaaccgccuccaccuc

SEQ ID NO: 185197 - RNA, 22 nt, Homo sapiens
ucacugcgaccuccaccuccug

SEQ ID NO: 185198 - RNA, 22 nt, Homo sapiens
ucacugcgaccucugccucccg

SEQ ID NO: 185199 - RNA, 22 nt, Homo sapiens
ucacugugugucucuguaucug

SEQ ID NO: 185200 - RNA, 22 nt, Homo sapiens
ucagaguagaaacacuuccaua

SEQ ID NO: 185201 - RNA, 22 nt, Homo sapiens
ucagcagugugaaaauggacua

SEQ ID NO: 185202 - RNA, 22 nt, Homo sapiens
ucaguggauuauuaaagucacc

SEQ ID NO: 185203 - RNA, 21 nt, Homo sapiens
ucaguuacugagagagaagug

SEQ ID NO: 185204 - RNA, 22 nt, Homo sapiens
uccacagugguugaacuaguaa

SEQ ID NO: 185205 - RNA, 22 nt, Homo sapiens
uccccgagcccaggcugugacu

SEQ ID NO: 185206 - RNA, 22 nt, Homo sapiens
ucccugaaaaauuggcuuaaca

SEQ ID NO: 185207 - RNA, 22 nt, Homo sapiens
ucccugaaagcugagauuggaa

SEQ ID NO: 185208 - RNA, 22 nt, Homo sapiens
uccuucaguccaguggguuuug

SEQ ID NO: 185209 - RNA, 19 nt, Homo sapiens
ucgcgccauucuccugccu

SEQ ID NO: 185210 - RNA, 22 nt, Homo sapiens
ucuuggccaugaauggcaaggc

SEQ ID NO: 185211 - RNA, 22 nt, Homo sapiens
ugaauguaagaugucugcuggu

SEQ ID NO: 185212 - RNA, 22 nt, Homo sapiens
ugacaguguccucauucccaac

SEQ ID NO: 185213 - RNA, 21 nt, Homo sapiens
ugacauuauuucaugucagua

SEQ ID NO: 185214 - RNA, 22 nt, Homo sapiens
ugagacaucugagauuuuaagc

SEQ ID NO: 185215 - RNA, 22 nt, Homo sapiens
ugagacggagucucacucuguu

SEQ ID NO: 185216 - RNA, 22 nt, Homo sapiens
ugagacggagucucgcucucua

SEQ ID NO: 185217 - RNA, 22 nt, Homo sapiens
ugagacggagucucgcucuguc

SEQ ID NO: 185218 - RNA, 22 nt, Homo sapiens
ugagacggagucuggcacuguc

SEQ ID NO: 185219 - RNA, 22 nt, Homo sapiens
ugaugguuuuaaaaagaggagu

SEQ ID NO: 185220 - RNA, 22 nt, Homo sapiens
ugcaaaugcugcuauuucucuu

SEQ ID NO: 185221 - RNA, 22 nt, Homo sapiens
ugcaagauaggcaguuugcacu

SEQ ID NO: 185222 - RNA, 22 nt, Homo sapiens
uggagauguuuaaaauccacug

SEQ ID NO: 185223 - RNA, 22 nt, Homo sapiens
uggagugcaauggcaccaucuu

SEQ ID NO: 185224 - RNA, 21 nt, Homo sapiens
uggcuguuuucaugcuagaac

SEQ ID NO: 185225 - RNA, 20 nt, Homo sapiens
ugggaaauguccaggacaua

SEQ ID NO: 185226 - RNA, 22 nt, Homo sapiens
uguagcagccauaaacacagug

SEQ ID NO: 185227 - RNA, 21 nt, Homo sapiens
ugucaagugggaaaacaugua

SEQ ID NO: 185228 - RNA, 22 nt, Homo sapiens
ugucaccuugcucauccucgga

SEQ ID NO: 185229 - RNA, 22 nt, Homo sapiens
ugugaacauuuuguauauauua

SEQ ID NO: 185230 - RNA, 22 nt, Homo sapiens
ugugaauguaagaaaauccaac

SEQ ID NO: 185231 - RNA, 22 nt, Homo sapiens
uguuacagcagaauugaaagag

SEQ ID NO: 185232 - RNA, 21 nt, Homo sapiens
uguuuuugcuguguaucucuc

SEQ ID NO: 185233 - RNA, 22 nt, Homo sapiens
uuaauuguccaaguucaucucu

SEQ ID NO: 185234 - RNA, 22 nt, Homo sapiens
uuacaguucugguggagaggua

SEQ ID NO: 185235 - RNA, 20 nt, Homo sapiens
uucuaguacuucuguuucca

SEQ ID NO: 185236 - RNA, 22 nt, Homo sapiens
uucugaguggcuuucaacacug

SEQ ID NO: 185237 - RNA, 22 nt, Homo sapiens
uugaaagacagaggggcaaguu

SEQ ID NO: 185238 - RNA, 22 nt, Homo sapiens
uugagacggagucuugcucuuu

SEQ ID NO: 185239 - RNA, 22 nt, Homo sapiens
uugagauggagucucgcucuuu

SEQ ID NO: 185240 - RNA, 22 nt, Homo sapiens
uugagauggaguuucgcucuuu

SEQ ID NO: 185241 - RNA, 22 nt, Homo sapiens
uugauauguuguuagauucagu

SEQ ID NO: 185242 - RNA, 20 nt, Homo sapiens
uuggcauuuagacaagaguu

SEQ ID NO: 185243 - RNA, 22 nt, Homo sapiens
uuggucaggcuaaucucgaacg

SEQ ID NO: 185244 - RNA, 22 nt, Homo sapiens
uugucaacaugaaacuguguuu

SEQ ID NO: 185245 - RNA, 22 nt, Homo sapiens
uugucaccucuaaaucucauau

SEQ ID NO: 185246 - RNA, 22 nt, Homo sapiens
uuguccccaucugcugccagaa

SEQ ID NO: 185247 - RNA, 22 nt, Homo sapiens
uuguccccuuccaaaucucaug

SEQ ID NO: 185248 - RNA, 22 nt, Homo sapiens
uugugaaaucuaggcagagguu

SEQ ID NO: 185249 - RNA, 22 nt, Homo sapiens
uugugaauggugccgcgauaaa

SEQ ID NO: 185250 - RNA, 22 nt, Homo sapiens
uugugaauggugcugcaguaaa

SEQ ID NO: 185251 - RNA, 22 nt, Homo sapiens
uugugcauaucagagguuugcu

SEQ ID NO: 185252 - RNA, 22 nt, Homo sapiens
uugugguuauagagucucccug

SEQ ID NO: 185253 - RNA, 22 nt, Homo sapiens
uugugguuuucagcuuauauau

SEQ ID NO: 185254 - RNA, 22 nt, Homo sapiens
uugugguuuuuaaaacuaggug

SEQ ID NO: 185255 - RNA, 22 nt, Homo sapiens
uuucagagucaucugcccaagu

SEQ ID NO: 185256 - RNA, 22 nt, Homo sapiens
uuugucaauaacuaccaacagg

SEQ ID NO: 185257 - RNA, 23 nt, Homo sapiens
uuugugacacucuccaucuccag

SEQ ID NO: 185258 - RNA, 22 nt, Homo sapiens
uuugugacucauggucuagugc

SEQ ID NO: 185259 - RNA, 22 nt, Homo sapiens
uuuuagcagccaugacaaagau

SEQ ID NO: 185260 - RNA, 22 nt, Homo sapiens
uuuuaugggcuauuugcauuag

SEQ ID NO: 185261 - RNA, 22 nt, Homo sapiens
uuuugcaggcauuggaaguuua

SEQ ID NO: 185262 - RNA, 22 nt, Homo sapiens
uuuuugauuaauggguagacca

SEQ ID NO: 185263 - RNA, 22 nt, Homo sapiens
uuuuuugguaauugaacaauga

SEQ ID NO: 185264 - RNA, 22 nt, Homo sapiens
ucaacaggucaauugcauagaa

SEQ ID NO: 185265 - RNA, 22 nt, Homo sapiens
ucacagccuaguuuuauacauu

SEQ ID NO: 185266 - RNA, 22 nt, Homo sapiens
ucacaguaacuuuguugcuuuu

SEQ ID NO: 185267 - RNA, 22 nt, Homo sapiens
ucacauuguuauguaaauguuu

SEQ ID NO: 185268 - RNA, 22 nt, Homo sapiens
ucacugcacucuccgccuugcg

SEQ ID NO: 185269 - RNA, 22 nt, Homo sapiens
ucacugcgaccuccaccucccg

SEQ ID NO: 185270 - RNA, 22 nt, Homo sapiens
ucagaguagcugucugaggugc

SEQ ID NO: 185271 - RNA, 22 nt, Homo sapiens
ucauugcaaucucugccucccg

SEQ ID NO: 185272 - RNA, 22 nt, Homo sapiens
ucauugcacucccagacacccu

SEQ ID NO: 185273 - RNA, 22 nt, Homo sapiens
ucauuguccaacuucuuucagu

SEQ ID NO: 185274 - RNA, 22 nt, Homo sapiens
uccagaguggugaugcuggggc

SEQ ID NO: 185275 - RNA, 22 nt, Homo sapiens
uccauugucuagauguaacaca

SEQ ID NO: 185276 - RNA, 22 nt, Homo sapiens
ucccauguagcuaggauuacag

SEQ ID NO: 185277 - RNA, 22 nt, Homo sapiens
ucccugaacacauguugagaag

SEQ ID NO: 185278 - RNA, 22 nt, Homo sapiens
ucggcucagugcaagcucugcc

SEQ ID NO: 185279 - RNA, 22 nt, Homo sapiens
ucucaaguggucgcaguuagau

SEQ ID NO: 185280 - RNA, 22 nt, Homo sapiens
ucugucaaaucuuauguuguag

SEQ ID NO: 185281 - RNA, 22 nt, Homo sapiens
ucuugccacuucauccccuuuc

SEQ ID NO: 185282 - RNA, 22 nt, Homo sapiens
ucuuugauuuuguuacuaagac

SEQ ID NO: 185283 - RNA, 22 nt, Homo sapiens
ugaaacacacauugcccuuuau

SEQ ID NO: 185284 - RNA, 18 nt, Homo sapiens
ugaaacacauuuuuuccu

SEQ ID NO: 185285 - RNA, 22 nt, Homo sapiens
ugaaacauacacucugaugggg

SEQ ID NO: 185286 - RNA, 22 nt, Homo sapiens
ugaaauacuuuggcucuuuguu

SEQ ID NO: 185287 - RNA, 22 nt, Homo sapiens
ugaacagcacguuuauucagaa

SEQ ID NO: 185288 - RNA, 22 nt, Homo sapiens
ugaagcuaacuugauugugaug

SEQ ID NO: 185289 - RNA, 22 nt, Homo sapiens
ugacacuugcccuuagaaacau

SEQ ID NO: 185290 - RNA, 22 nt, Homo sapiens
ugagaacggauacuaagggcug

SEQ ID NO: 185291 - RNA, 22 nt, Homo sapiens
ugagaaugacugggcaugcugc

SEQ ID NO: 185292 - RNA, 22 nt, Homo sapiens
ugagaaugaugauuuccaguuu

SEQ ID NO: 185293 - RNA, 22 nt, Homo sapiens
ugagacggaguuucacucuugu

SEQ ID NO: 185294 - RNA, 22 nt, Homo sapiens
ugagacggaguuucgcucuugu

SEQ ID NO: 185295 - RNA, 22 nt, Homo sapiens
ugagauuaaucuuuaaguaaga

SEQ ID NO: 185296 - RNA, 21 nt, Homo sapiens
ugagcauuaguacaguaggga

SEQ ID NO: 185297 - RNA, 22 nt, Homo sapiens
ugaguaugaguucaggaaaggc

SEQ ID NO: 185298 - RNA, 22 nt, Homo sapiens
ugaguauguaggaugugucuua

SEQ ID NO: 185299 - RNA, 22 nt, Homo sapiens
ugaguuccuugugugaccuugc

SEQ ID NO: 185300 - RNA, 22 nt, Homo sapiens
ugauauauugaaugaugaaaca

SEQ ID NO: 185301 - RNA, 22 nt, Homo sapiens
ugcaagaugagauuuuggaugg

SEQ ID NO: 185302 - RNA, 22 nt, Homo sapiens
ugcaagcacacccagggauugu

SEQ ID NO: 185303 - RNA, 22 nt, Homo sapiens
ugcagagaaacauuuuguauuu

SEQ ID NO: 185304 - RNA, 22 nt, Homo sapiens
ugccagaugcuggugugagggg

SEQ ID NO: 185305 - RNA, 19 nt, Homo sapiens
ugcugcauugugaccuugc

SEQ ID NO: 185306 - RNA, 22 nt, Homo sapiens
uggagugaaaacacacuaaucu

SEQ ID NO: 185307 - RNA, 22 nt, Homo sapiens
uggggcaaugaacauuuuugca

SEQ ID NO: 185308 - RNA, 22 nt, Homo sapiens
ugguauguaugauuaacaugga

SEQ ID NO: 185309 - RNA, 22 nt, Homo sapiens
uggugagaaaagaugucuuugu

SEQ ID NO: 185310 - RNA, 22 nt, Homo sapiens
uguacuucaagauuaugguuua

SEQ ID NO: 185311 - RNA, 22 nt, Homo sapiens
uguauguuguaagacuuagacc

SEQ ID NO: 185312 - RNA, 22 nt, Homo sapiens
ugucaguuuuaacuagggaaua

SEQ ID NO: 185313 - RNA, 22 nt, Homo sapiens
ugugaacagcagcugggcuuug

SEQ ID NO: 185314 - RNA, 22 nt, Homo sapiens
ugugaauguaaccuuauuugga

SEQ ID NO: 185315 - RNA, 22 nt, Homo sapiens
ugugcauaugucuuuauaguag

SEQ ID NO: 185316 - RNA, 22 nt, Homo sapiens
uguggcuuuuucuuggcugagg

SEQ ID NO: 185317 - RNA, 21 nt, Homo sapiens
uguuaacaugcagauuacugg

SEQ ID NO: 185318 - RNA, 22 nt, Homo sapiens
uuaaaugucuguagaugugcug

SEQ ID NO: 185319 - RNA, 22 nt, Homo sapiens
uuaacaguugcaugagacugag

SEQ ID NO: 185320 - RNA, 22 nt, Homo sapiens
uuacaguguuuguucuguuacu

SEQ ID NO: 185321 - RNA, 21 nt, Homo sapiens
uuacaguugguugugaggugg

SEQ ID NO: 185322 - RNA, 22 nt, Homo sapiens
uuagggaguaaucuaaaaaugg

SEQ ID NO: 185323 - RNA, 22 nt, Homo sapiens
uuaucauagugcaguuuucuga

SEQ ID NO: 185324 - RNA, 22 nt, Homo sapiens
uucaacagugauggccuuugua

SEQ ID NO: 185325 - RNA, 22 nt, Homo sapiens
uucaauaugucauuggcaggca

SEQ ID NO: 185326 - RNA, 22 nt, Homo sapiens
uucaccagggaagucucaacuc

SEQ ID NO: 185327 - RNA, 22 nt, Homo sapiens
uucccugagcaucuguugagcc

SEQ ID NO: 185328 - RNA, 22 nt, Homo sapiens
uucuaaacaucuuacaaugcau

SEQ ID NO: 185329 - RNA, 22 nt, Homo sapiens
uucucaguuccuacuuugguga

SEQ ID NO: 185330 - RNA, 22 nt, Homo sapiens
uugaaagaaaggagacugaguu

SEQ ID NO: 185331 - RNA, 22 nt, Homo sapiens
uugaaauguguaagcuccgaaa

SEQ ID NO: 185332 - RNA, 22 nt, Homo sapiens
uugaaugaaauuggugugggga

SEQ ID NO: 185333 - RNA, 22 nt, Homo sapiens
uugagacgaagucucacucuug

SEQ ID NO: 185334 - RNA, 22 nt, Homo sapiens
uugagauggagucucgcucugu

SEQ ID NO: 185335 - RNA, 22 nt, Homo sapiens
uugagcuuuuuacuuguccaau

SEQ ID NO: 185336 - RNA, 22 nt, Homo sapiens
uugauaagaaaaauauaccaga

SEQ ID NO: 185337 - RNA, 22 nt, Homo sapiens
uugcaaaguugccaaggaagga

SEQ ID NO: 185338 - RNA, 22 nt, Homo sapiens
uugcaaaguuugccuccuguag

SEQ ID NO: 185339 - RNA, 22 nt, Homo sapiens
uugucacccuacauaacaggga

SEQ ID NO: 185340 - RNA, 22 nt, Homo sapiens
uugugaaaaaccucucguggaa

SEQ ID NO: 185341 - RNA, 22 nt, Homo sapiens
uugugaauggaguagcaggauc

SEQ ID NO: 185342 - RNA, 22 nt, Homo sapiens
uugugcaugaugcauacauggu

SEQ ID NO: 185343 - RNA, 22 nt, Homo sapiens
uuuaaagcuaaaauauguuuau

SEQ ID NO: 185344 - RNA, 22 nt, Homo sapiens
uuuaaugcgucucugaguuuug

SEQ ID NO: 185345 - RNA, 22 nt, Homo sapiens
uuuagguauuugguauagcagu

SEQ ID NO: 185346 - RNA, 22 nt, Homo sapiens
uuucugagaccaaaacuuguaa

SEQ ID NO: 185347 - RNA, 22 nt, Homo sapiens
uuugcuuaaaucuuaaucagau

SEQ ID NO: 185348 - RNA, 22 nt, Homo sapiens
uuugggaaugaguuuaucauuu

SEQ ID NO: 185349 - RNA, 22 nt, Homo sapiens
uuuguaagaugcauagauugca

SEQ ID NO: 185350 - RNA, 22 nt, Homo sapiens
uuuguauguuggagauuggaga

SEQ ID NO: 185351 - RNA, 22 nt, Homo sapiens
uuugugacuugcuucucagaau

SEQ ID NO: 185352 - RNA, 22 nt, Homo sapiens
uuugugucccucuaaaauuuau

SEQ ID NO: 185353 - RNA, 20 nt, Homo sapiens
uuuuagcacuuguuauggug

SEQ ID NO: 185354 - RNA, 22 nt, Homo sapiens
uuuuggcuagaaauauaccucc

SEQ ID NO: 185355 - RNA, 22 nt, Homo sapiens
gaucacaugggagaaugagagu

SEQ ID NO: 185356 - RNA, 22 nt, Homo sapiens
gauggaguaauguaaucuugag

SEQ ID NO: 185357 - RNA, 22 nt, Homo sapiens
gaugugaaaucauaguuucuag

SEQ ID NO: 185358 - RNA, 23 nt, Homo sapiens
ggaguguaaugacucgaucucgg

SEQ ID NO: 185359 - RNA, 22 nt, Homo sapiens
ggcaaaaucgcaauuacuuuug

SEQ ID NO: 185360 - RNA, 22 nt, Homo sapiens
ggcaacaauuccuacuucuuuu

SEQ ID NO: 185361 - RNA, 19 nt, Homo sapiens
ggucacagggguuacaagg

SEQ ID NO: 185362 - RNA, 22 nt, Homo sapiens
guaaaguaaagcacaucaaggu

SEQ ID NO: 185363 - RNA, 18 nt, Homo sapiens
guaaauguaucuauugcc

SEQ ID NO: 185364 - RNA, 22 nt, Homo sapiens
guacaguuuagugcuuugagaa

SEQ ID NO: 185365 - RNA, 22 nt, Homo sapiens
guacaguuuucaguguucacug

SEQ ID NO: 185366 - RNA, 22 nt, Homo sapiens
guaucaucauguuggccaggcu

SEQ ID NO: 185367 - RNA, 22 nt, Homo sapiens
gucaagagaacuuucuaucacu

SEQ ID NO: 185368 - RNA, 22 nt, Homo sapiens
gucauccaggcuggagugaagc

SEQ ID NO: 185369 - RNA, 18 nt, Homo sapiens
guccauuuguugguacac

SEQ ID NO: 185370 - RNA, 22 nt, Homo sapiens
gugaagugugaccucagcaucu

SEQ ID NO: 185371 - RNA, 23 nt, Homo sapiens
gugcaguggcgagauuucggcuc

SEQ ID NO: 185372 - RNA, 22 nt, Homo sapiens
gugcgguauuagcaagccaaca

SEQ ID NO: 185373 - RNA, 22 nt, Homo sapiens
gugcucauuuagagagaagcac

SEQ ID NO: 185374 - RNA, 22 nt, Homo sapiens
guggaaaauuauugcuguuuuu

SEQ ID NO: 185375 - RNA, 18 nt, Homo sapiens
guggagugucuuccugga

SEQ ID NO: 185376 - RNA, 22 nt, Homo sapiens
gugggguagcaggcuccuaucu

SEQ ID NO: 185377 - RNA, 22 nt, Homo sapiens
aaagucuagaggaucaugugug

SEQ ID NO: 185378 - RNA, 22 nt, Homo sapiens
aaagugcuuccuuuuugagggu

SEQ ID NO: 185379 - RNA, 22 nt, Homo sapiens
aacacggcccgcagagcaagcu

SEQ ID NO: 185380 - RNA, 22 nt, Homo sapiens
aagagcucauccauaguuguca

SEQ ID NO: 185381 - RNA, 22 nt, Homo sapiens
aagcucuuguugaaucuuguca

SEQ ID NO: 185382 - RNA, 22 nt, Homo sapiens
aaguagcuggaugcaguggcac

SEQ ID NO: 185383 - RNA, 22 nt, Homo sapiens
aagugacauugugcccauuuga

SEQ ID NO: 185384 - RNA, 22 nt, Homo sapiens
aauaugucugcuaauuguuucu

SEQ ID NO: 185385 - RNA, 22 nt, Homo sapiens
aaucacaguguucuugugaggg

SEQ ID NO: 185386 - RNA, 22 nt, Homo sapiens
aaugauacuguguacaagggca

SEQ ID NO: 185387 - RNA, 22 nt, Homo sapiens
aauugcauaaaauucaacucug

SEQ ID NO: 185388 - RNA, 22 nt, Homo sapiens
acacaugugcguagacucuuua

SEQ ID NO: 185389 - RNA, 20 nt, Homo sapiens
acaguagaagggauuucaaa

SEQ ID NO: 185390 - RNA, 22 nt, Homo sapiens
acaguguacaauagccuuuuaa

SEQ ID NO: 185391 - RNA, 22 nt, Homo sapiens
acauaguagacacugaaaauau

SEQ ID NO: 185392 - RNA, 22 nt, Homo sapiens
acauguaauugauuuuguguua

SEQ ID NO: 185393 - RNA, 22 nt, Homo sapiens
agaaacauucucuugccuccuu

SEQ ID NO: 185394 - RNA, 22 nt, Homo sapiens
agacagcuggaguaucauagcu

SEQ ID NO: 185395 - RNA, 22 nt, Homo sapiens
agagaacugauucagggaaaau

SEQ ID NO: 185396 - RNA, 18 nt, Homo sapiens
agaguaucauuuccccca

SEQ ID NO: 185397 - RNA, 22 nt, Homo sapiens
agagugcaauggcaccaucucg

SEQ ID NO: 185398 - RNA, 23 nt, Homo sapiens
agagugcaauggugccaucucgg

SEQ ID NO: 185399 - RNA, 22 nt, Homo sapiens
agcuaaaucucauguugaauug

SEQ ID NO: 185400 - RNA, 22 nt, Homo sapiens
agcuccaugauaguaugucugu

SEQ ID NO: 185401 - RNA, 22 nt, Homo sapiens
agcuguuguuaauuaacucauu

SEQ ID NO: 185402 - RNA, 22 nt, Homo sapiens
agugcaauggcgugaucuuggc

SEQ ID NO: 185403 - RNA, 22 nt, Homo sapiens
agugcaguggcacaaucuuggc

SEQ ID NO: 185404 - RNA, 22 nt, Homo sapiens
agugcaguggcauggucauaac

SEQ ID NO: 185405 - RNA, 22 nt, Homo sapiens
agugcaguggcucaaaaugccu

SEQ ID NO: 185406 - RNA, 22 nt, Homo sapiens
auagcagugugaaaacagacua

SEQ ID NO: 185407 - RNA, 22 nt, Homo sapiens
auagcagugugaaaauggacua

SEQ ID NO: 185408 - RNA, 22 nt, Homo sapiens
auagcagugugagaaugaacua

SEQ ID NO: 185409 - RNA, 22 nt, Homo sapiens
auagcccuuuucuaacuaugug

SEQ ID NO: 185410 - RNA, 22 nt, Homo sapiens
auauaugcuaagugcuaauaaa

SEQ ID NO: 185411 - RNA, 22 nt, Homo sapiens
aucaaagugaauuaaugagaau

SEQ ID NO: 185412 - RNA, 22 nt, Homo sapiens
aucaccagaugcuucaagcaga

SEQ ID NO: 185413 - RNA, 22 nt, Homo sapiens
aucauguaguaagacacauuua

SEQ ID NO: 185414 - RNA, 22 nt, Homo sapiens
aucauguuuauguguaggauau

SEQ ID NO: 185415 - RNA, 22 nt, Homo sapiens
auccacaugcaguuggaaacag

SEQ ID NO: 185416 - RNA, 22 nt, Homo sapiens
aucccgagacuuugcugaaguu

SEQ ID NO: 185417 - RNA, 22 nt, Homo sapiens
aucuaaaucucauaugggcaca

SEQ ID NO: 185418 - RNA, 22 nt, Homo sapiens
aucucagcaacuaaagauccuu

SEQ ID NO: 185419 - RNA, 22 nt, Homo sapiens
augaagcuagcugauugcugau

SEQ ID NO: 185420 - RNA, 22 nt, Homo sapiens
augacaguguggauuauuguaa

SEQ ID NO: 185421 - RNA, 22 nt, Homo sapiens
augacauguauuuccaggauuu

SEQ ID NO: 185422 - RNA, 22 nt, Homo sapiens
augauaaguuauuagaagaaga

SEQ ID NO: 185423 - RNA, 22 nt, Homo sapiens
augauauuauucuagcccagag

SEQ ID NO: 185424 - RNA, 19 nt, Homo sapiens
augcaaugucacaggcugc

SEQ ID NO: 185425 - RNA, 17 nt, Homo sapiens
augugaauguucaaaua

SEQ ID NO: 185426 - RNA, 22 nt, Homo sapiens
augugcauaugaagcacagaca

SEQ ID NO: 185427 - RNA, 22 nt, Homo sapiens
auguuagcaucaauauucauca

SEQ ID NO: 185428 - RNA, 22 nt, Homo sapiens
auucacuuuuauagacaggucu

SEQ ID NO: 185429 - RNA, 22 nt, Homo sapiens
auugcacuccagccuggaugac

SEQ ID NO: 185430 - RNA, 19 nt, Homo sapiens
auugcaguguaaaacuauu

SEQ ID NO: 185431 - RNA, 22 nt, Homo sapiens
auugcuauuauuugaccauugu

SEQ ID NO: 185432 - RNA, 22 nt, Homo sapiens
auuguacuccagccugggugac

SEQ ID NO: 185433 - RNA, 22 nt, Homo sapiens
auugucacugugcuccaccagu

SEQ ID NO: 185434 - RNA, 22 nt, Homo sapiens
auugucacuuaaaagugcaugu

SEQ ID NO: 185435 - RNA, 22 nt, Homo sapiens
auuuggcaauuuugaagaugcc

SEQ ID NO: 185436 - RNA, 22 nt, Homo sapiens
auuuugcauugcuguaaaggaa

SEQ ID NO: 185437 - RNA, 21 nt, Homo sapiens
caaugacacuguagcugugcu

SEQ ID NO: 185438 - RNA, 21 nt, Homo sapiens
caauggcacaaucucugcuca

SEQ ID NO: 185439 - RNA, 21 nt, Homo sapiens
caauggcacgaucuuggcuca

SEQ ID NO: 185440 - RNA, 22 nt, Homo sapiens
cacaguguuccagcuauuugaa

SEQ ID NO: 185441 - RNA, 22 nt, Homo sapiens
cacugcgacguccgccucccgg

SEQ ID NO: 185442 - RNA, 22 nt, Homo sapiens
cauggcuuuauuuucagcuucu

SEQ ID NO: 185443 - RNA, 22 nt, Homo sapiens
ccacacugucuuggugggaaac

SEQ ID NO: 185444 - RNA, 23 nt, Homo sapiens
ccgugagagaguucauagaaagc

SEQ ID NO: 185445 - RNA, 22 nt, Homo sapiens
ccuggaucauugucauucccaa

SEQ ID NO: 185446 - RNA, 22 nt, Homo sapiens
cuacaguucucaggaguuggcc

SEQ ID NO: 185447 - RNA, 19 nt, Homo sapiens
cuauugcacauagcugaag

SEQ ID NO: 185448 - RNA, 22 nt, Homo sapiens
cucaaguacaugggauuacagg

SEQ ID NO: 185449 - RNA, 22 nt, Homo sapiens
cucaccuugugauccacccacc

SEQ ID NO: 185450 - RNA, 17 nt, Homo sapiens
cucacugagaacagcua

SEQ ID NO: 185451 - RNA, 22 nt, Homo sapiens
cucacugcauuucaguuuuguu

SEQ ID NO: 185452 - RNA, 22 nt, Homo sapiens
cucauugcaaucucugccuccc

SEQ ID NO: 185453 - RNA, 22 nt, Homo sapiens
cuccauuuaucugaaauuuuau

SEQ ID NO: 185454 - RNA, 20 nt, Homo sapiens
cucuaguaauaaaguuuccc

SEQ ID NO: 185455 - RNA, 20 nt, Homo sapiens
cugcaaaugcugcugcugau

SEQ ID NO: 185456 - RNA, 20 nt, Homo sapiens
cuggaugucgaggcagaggu

SEQ ID NO: 185457 - RNA, 22 nt, Homo sapiens
cuggcaaauguuuucuguaaag

SEQ ID NO: 185458 - RNA, 22 nt, Homo sapiens
cugugguuacguucuuugugcu

SEQ ID NO: 185459 - RNA, 22 nt, Homo sapiens
cuugccuuugucuucaaaggcu

SEQ ID NO: 185460 - RNA, 21 nt, Homo sapiens
cuuuuuacucguucauaugca

SEQ ID NO: 185461 - RNA, 22 nt, Homo sapiens
aucaaagccaugcucaguuuuc

SEQ ID NO: 185462 - RNA, 16 nt, Homo sapiens
aucacuugcuucuuuu

SEQ ID NO: 185463 - RNA, 22 nt, Homo sapiens
auccacauucauggaccagucc

SEQ ID NO: 185464 - RNA, 22 nt, Homo sapiens
auccauugucuaaugcuaagau

SEQ ID NO: 185465 - RNA, 22 nt, Homo sapiens
uuucugaggccucaccagaagc

SEQ ID NO: 185466 - RNA, 22 nt, Homo sapiens
uuugaauggaaguuuugugaaa

SEQ ID NO: 185467 - RNA, 22 nt, Homo sapiens
uuuugcauuggcugaggagugu

SEQ ID NO: 185468 - RNA, 22 nt, Homo sapiens
uuuuggcacuuugucugauucu

SEQ ID NO: 185469 - RNA, 22 nt, Homo sapiens
cuaauccugugguagcacucaa

SEQ ID NO: 185470 - RNA, 22 nt, Homo sapiens
cuagagagaagcugugugaccu

SEQ ID NO: 185471 - RNA, 22 nt, Homo sapiens
cuccauuuggaacagauguccu

SEQ ID NO: 185472 - RNA, 22 nt, Homo sapiens
cugaucuguuauacuuuucuau

SEQ ID NO: 185473 - RNA, 21 nt, Homo sapiens
cugcaaaugcugcugccugau

SEQ ID NO: 185474 - RNA, 22 nt, Homo sapiens
cuugagcuugagauccuuucug

SEQ ID NO: 185475 - RNA, 22 nt, Homo sapiens
cuuuuggcuuaagauugucuug

SEQ ID NO: 185476 - RNA, 22 nt, Homo sapiens
cuuuuggcuuagaauugucuug

SEQ ID NO: 185477 - RNA, 22 nt, Homo sapiens
gaaugauacuguuaacgaaaga

SEQ ID NO: 185478 - RNA, 22 nt, Homo sapiens
gagaacauuaauaguuaauuuu

SEQ ID NO: 185479 - RNA, 22 nt, Homo sapiens
gagaacugagauaagugauauu

SEQ ID NO: 185480 - RNA, 22 nt, Homo sapiens
gagaaugaugauuuccaauuuc

SEQ ID NO: 185481 - RNA, 22 nt, Homo sapiens
gagaugaaguuaaggaucuuua

SEQ ID NO: 185482 - RNA, 22 nt, Homo sapiens
gagcacugauuuauuuuugucu

SEQ ID NO: 185483 - RNA, 22 nt, Homo sapiens
gagcucaccuuaccucuggagc

SEQ ID NO: 185484 - RNA, 22 nt, Homo sapiens
gaggcaguguguccguucucgg

SEQ ID NO: 185485 - RNA, 22 nt, Homo sapiens
gaguagugcugcaguaaacaua

SEQ ID NO: 185486 - RNA, 22 nt, Homo sapiens
gagugcaauggcgcgaucuggg

SEQ ID NO: 185487 - RNA, 22 nt, Homo sapiens
gauuccauuuguggcuauuuac

SEQ ID NO: 185488 - RNA, 22 nt, Homo sapiens
gcaaaauugagaagggaauaua

SEQ ID NO: 185489 - RNA, 22 nt, Homo sapiens
gcaaagaaugcagauuugccuc

SEQ ID NO: 185490 - RNA, 22 nt, Homo sapiens
gcauugcacuuggcauagacug

SEQ ID NO: 185491 - RNA, 22 nt, Homo sapiens
gccaaaaugcugggauuacagg

SEQ ID NO: 185492 - RNA, 22 nt, Homo sapiens
gcugauguuggccucugggcuu

SEQ ID NO: 185493 - RNA, 22 nt, Homo sapiens
gcuggguucagagugggcugcg

SEQ ID NO: 185494 - RNA, 23 nt, Homo sapiens
ggaaacauccagucuuucaccau

SEQ ID NO: 185495 - RNA, 22 nt, Homo sapiens
ggcaagaucuuggcucacugaa

SEQ ID NO: 185496 - RNA, 22 nt, Homo sapiens
guaauaacuguggaaaaagguu

SEQ ID NO: 185497 - RNA, 22 nt, Homo sapiens
guacaguucucuuuguugucag

SEQ ID NO: 185498 - RNA, 22 nt, Homo sapiens
guaugauacuguaacagugggu

SEQ ID NO: 185499 - RNA, 22 nt, Homo sapiens
uugagauggagucucgcugugu

SEQ ID NO: 185500 - RNA, 22 nt, Homo sapiens
uugagcacaggaguuugagacc

SEQ ID NO: 185501 - RNA, 22 nt, Homo sapiens
uugaggacugguugaaagcuuu

SEQ ID NO: 185502 - RNA, 22 nt, Homo sapiens
uugcaaagaccucuucacuucc

SEQ ID NO: 185503 - RNA, 22 nt, Homo sapiens
uugcagugguuucacuggcaaa

SEQ ID NO: 185504 - RNA, 22 nt, Homo sapiens
uugcagugugacgacuauauuu

SEQ ID NO: 185505 - RNA, 22 nt, Homo sapiens
uugcauuagugugguacauuug

SEQ ID NO: 185506 - RNA, 22 nt, Homo sapiens
uuguaaagaucauaugcuguuc

SEQ ID NO: 185507 - RNA, 22 nt, Homo sapiens
uugucacccucucuuggugucu

SEQ ID NO: 185508 - RNA, 22 nt, Homo sapiens
uugugaaugaugccgcaauaaa

SEQ ID NO: 185509 - RNA, 22 nt, Homo sapiens
uugugaaugaugucgcaauaaa

SEQ ID NO: 185510 - RNA, 22 nt, Homo sapiens
uugugaauggugccacaauaaa

SEQ ID NO: 185511 - RNA, 22 nt, Homo sapiens
uugugaauggugccgcaguaaa

SEQ ID NO: 185512 - RNA, 22 nt, Homo sapiens
uugugguuuuaucuaccuuugg

SEQ ID NO: 185513 - RNA, 22 nt, Homo sapiens
uuuauccagccucuagcaaggu

SEQ ID NO: 185514 - RNA, 17 nt, Homo sapiens
uuucagaguggaagugu

SEQ ID NO: 185515 - RNA, 22 nt, Homo sapiens
uuucauagccuucuaaugaguu

SEQ ID NO: 185516 - RNA, 22 nt, Homo sapiens
gaaagauuuccugagcuagaaa

SEQ ID NO: 185517 - RNA, 18 nt, Homo sapiens
gaagaaguaggcauggca

SEQ ID NO: 185518 - RNA, 22 nt, Homo sapiens
gaagcauugauccacaggcgug

SEQ ID NO: 185519 - RNA, 22 nt, Homo sapiens
gaauggaacugacuauagcuga

SEQ ID NO: 185520 - RNA, 22 nt, Homo sapiens
gacaguuucucaggcuuccuua

SEQ ID NO: 185521 - RNA, 22 nt, Homo sapiens
gagacugagucuugcucuguca

SEQ ID NO: 185522 - RNA, 22 nt, Homo sapiens
gagauuuucagcuugacuggga

SEQ ID NO: 185523 - RNA, 22 nt, Homo sapiens
gaguagugcugcaauaaacaua

SEQ ID NO: 185524 - RNA, 22 nt, Homo sapiens
gaguagugcuguaauaaacaua

SEQ ID NO: 185525 - RNA, 23 nt, Homo sapiens
gagugcaaugacaugaucucgga

SEQ ID NO: 185526 - RNA, 22 nt, Homo sapiens
gagugcaauggugccaucucgg

SEQ ID NO: 185527 - RNA, 17 nt, Homo sapiens
gaucacagucgucuccu

SEQ ID NO: 185528 - RNA, 22 nt, Homo sapiens
gaucuguguuuguaugcauaag

SEQ ID NO: 185529 - RNA, 22 nt, Homo sapiens
gcaguguggguagagggcaaga

SEQ ID NO: 185530 - RNA, 22 nt, Homo sapiens
gcuguugguaaaaaggacauga

SEQ ID NO: 185531 - RNA, 18 nt, Homo sapiens
ggaaaacuuuucuaagua

SEQ ID NO: 185532 - RNA, 22 nt, Homo sapiens
ggagaauguaauugguauuuug

SEQ ID NO: 185533 - RNA, 23 nt, Homo sapiens
ggcaagaucucagcucacugcaa

SEQ ID NO: 185534 - RNA, 22 nt, Homo sapiens
guacaggcagcaaacaccauaa

SEQ ID NO: 185535 - RNA, 22 nt, Homo sapiens
guacaguauaguaauaggauuu

SEQ ID NO: 185536 - RNA, 22 nt, Homo sapiens
guacaugcauaguuuauuucug

SEQ ID NO: 185537 - RNA, 20 nt, Homo sapiens
guccauuugcugccauugcu

SEQ ID NO: 185538 - RNA, 22 nt, Homo sapiens
guccauuuguuuccagagcacu

SEQ ID NO: 185539 - RNA, 22 nt, Homo sapiens
gugaaaugaaucuggaaauauu

SEQ ID NO: 185540 - RNA, 22 nt, Homo sapiens
gugcagugugauccuuccguau

SEQ ID NO: 185541 - RNA, 22 nt, Homo sapiens
gugcccacugucuguccuguag

SEQ ID NO: 185542 - RNA, 22 nt, Homo sapiens
guggcuuuauuuagaagcaggg

SEQ ID NO: 185543 - RNA, 22 nt, Homo sapiens
gugggaagcuggaacucccucc

SEQ ID NO: 185544 - RNA, 22 nt, Homo sapiens
guuauccugucuuuacauacaa

SEQ ID NO: 185545 - RNA, 22 nt, Homo sapiens
uaacugcaaccuccgccucccg

SEQ ID NO: 185546 - RNA, 22 nt, Homo sapiens
uaagggacauguguugccuaag

SEQ ID NO: 185547 - RNA, 22 nt, Homo sapiens
uaagugcuugacuuugauguuu

SEQ ID NO: 185548 - RNA, 22 nt, Homo sapiens
uacaaagcuuugaugugucuuu

SEQ ID NO: 185549 - RNA, 22 nt, Homo sapiens
uacuagaggcgggguuucgcca

SEQ ID NO: 185550 - RNA, 22 nt, Homo sapiens
uagagugcugucaaagacuugu

SEQ ID NO: 185551 - RNA, 22 nt, Homo sapiens
uagcaguaccccaguauccugg

SEQ ID NO: 185552 - RNA, 22 nt, Homo sapiens
uagcaguauugaaagaugaggg

SEQ ID NO: 185553 - RNA, 22 nt, Homo sapiens
uaguagagauggggcacaugcc

SEQ ID NO: 185554 - RNA, 22 nt, Homo sapiens
uaucacaggucaggaaccuugu

SEQ ID NO: 185555 - RNA, 22 nt, Homo sapiens
uaucacagguggacugcacacc

SEQ ID NO: 185556 - RNA, 22 nt, Homo sapiens
uaucacuuugauaguuuaaaug

SEQ ID NO: 185557 - RNA, 22 nt, Homo sapiens
uaucugcaucccauuuuuauca

SEQ ID NO: 185558 - RNA, 20 nt, Homo sapiens
uaugacaaagccuagugagu

SEQ ID NO: 185559 - RNA, 19 nt, Homo sapiens
uauguaguuuucucaauau

SEQ ID NO: 185560 - RNA, 22 nt, Homo sapiens
uauugcacaugaggagacauug

SEQ ID NO: 185561 - RNA, 22 nt, Homo sapiens
uauugcauuugagguugguuga

SEQ ID NO: 185562 - RNA, 22 nt, Homo sapiens
ucacacugucuugguuacucuu

SEQ ID NO: 185563 - RNA, 18 nt, Homo sapiens
ucacagguaaaguugaca

SEQ ID NO: 185564 - RNA, 21 nt, Homo sapiens
ucacauggccagaguaggaac

SEQ ID NO: 185565 - RNA, 22 nt, Homo sapiens
ucacugcgaccuccgccucccg

SEQ ID NO: 185566 - RNA, 22 nt, Homo sapiens
ucacuuuggguacuauggaaau

SEQ ID NO: 185567 - RNA, 22 nt, Homo sapiens
ucagaacugauacuagaacuuu

SEQ ID NO: 185568 - RNA, 22 nt, Homo sapiens
ucagcagugugaaaacaaacua

SEQ ID NO: 185569 - RNA, 22 nt, Homo sapiens
ucaguuuagguguaacggccac

SEQ ID NO: 185570 - RNA, 22 nt, Homo sapiens
ucccacugucuucucgugcucg

SEQ ID NO: 185571 - RNA, 22 nt, Homo sapiens
ucccugaagcugcagcaacaca

SEQ ID NO: 185572 - RNA, 22 nt, Homo sapiens
uccuuuaguuaauaaagacaag

SEQ ID NO: 185573 - RNA, 22 nt, Homo sapiens
ucgcgccauucuccugccucag

SEQ ID NO: 185574 - RNA, 18 nt, Homo sapiens
ucuggcuucuuuguucca

SEQ ID NO: 185575 - RNA, 22 nt, Homo sapiens
ucugucuuugccuaaguuuguc

SEQ ID NO: 185576 - RNA, 22 nt, Homo sapiens
ugaaucaugcugcuauaaagac

SEQ ID NO: 185577 - RNA, 23 nt, Homo sapiens
ugacagugcuugaaauugcucuu

SEQ ID NO: 185578 - RNA, 22 nt, Homo sapiens
ugacauugggagugaagugaag

SEQ ID NO: 185579 - RNA, 22 nt, Homo sapiens
ugagacggagucucgcucuguu

SEQ ID NO: 185580 - RNA, 22 nt, Homo sapiens
ugagacggagucucgcuguguc

SEQ ID NO: 185581 - RNA, 22 nt, Homo sapiens
ugagacggagucuugcuaaguu

SEQ ID NO: 185582 - RNA, 22 nt, Homo sapiens
ugagacggagucuugcucuguc

SEQ ID NO: 185583 - RNA, 22 nt, Homo sapiens
ugagacggaguuuugcucuugu

SEQ ID NO: 185584 - RNA, 22 nt, Homo sapiens
ugagaucgagucucgcucuguc

SEQ ID NO: 185585 - RNA, 22 nt, Homo sapiens
ugagauggaguuucgcucuugu

SEQ ID NO: 185586 - RNA, 22 nt, Homo sapiens
ugagauggaguuucgcuuuugu

SEQ ID NO: 185587 - RNA, 22 nt, Homo sapiens
ugagaugugugcauucaacuca

SEQ ID NO: 185588 - RNA, 21 nt, Homo sapiens
ugaguagcuagaacuaggggc

SEQ ID NO: 185589 - RNA, 20 nt, Homo sapiens
ugaguuccuuguucagaagc

SEQ ID NO: 185590 - RNA, 20 nt, Homo sapiens
ugaugcaaaucuuuaaaagu

SEQ ID NO: 185591 - RNA, 22 nt, Homo sapiens
ugcaaauguuaggugucauuau

SEQ ID NO: 185592 - RNA, 22 nt, Homo sapiens
ugcagcucaaauuccuaacaag

SEQ ID NO: 185593 - RNA, 22 nt, Homo sapiens
ugcagugugauuuucuggcuga

SEQ ID NO: 185594 - RNA, 22 nt, Homo sapiens
ugcaugaugcugagauuuggga

SEQ ID NO: 185595 - RNA, 22 nt, Homo sapiens
uggcaaaaaucacaaguaccuu

SEQ ID NO: 185596 - RNA, 22 nt, Homo sapiens
uggcaaauauuuuguuuuguaa

SEQ ID NO: 185597 - RNA, 21 nt, Homo sapiens
uggcuauuucuguggcauaca

SEQ ID NO: 185598 - RNA, 22 nt, Homo sapiens
ugggaagcugcauuuuaacaag

SEQ ID NO: 185599 - RNA, 22 nt, Homo sapiens
ugggguagaauagaauugauau

SEQ ID NO: 185600 - RNA, 22 nt, Homo sapiens
ugggguaggccugguuaugugc

SEQ ID NO: 185601 - RNA, 22 nt, Homo sapiens
ugggguaggcuguauacucugu

SEQ ID NO: 185602 - RNA, 22 nt, Homo sapiens
uguaacacacacuguuuacucc

SEQ ID NO: 185603 - RNA, 22 nt, Homo sapiens
ugucaguuucuugagauggaac

SEQ ID NO: 185604 - RNA, 19 nt, Homo sapiens
ugucaucaucuuuucuugc

SEQ ID NO: 185605 - RNA, 22 nt, Homo sapiens
ugucaugaacucacauucuggg

SEQ ID NO: 185606 - RNA, 22 nt, Homo sapiens
ugugaauggugcugcaaugaac

SEQ ID NO: 185607 - RNA, 22 nt, Homo sapiens
uguguuuuuauguaaaauggaa

SEQ ID NO: 185608 - RNA, 22 nt, Homo sapiens
uguuaagaugucaauuuuccac

SEQ ID NO: 185609 - RNA, 22 nt, Homo sapiens
uguucuggagccgguucaaaug

SEQ ID NO: 185610 - RNA, 22 nt, Homo sapiens
uuaaaguaauugaaauggccuu

SEQ ID NO: 185611 - RNA, 22 nt, Homo sapiens
uuaauagugacucauuuuccac

SEQ ID NO: 185612 - RNA, 22 nt, Homo sapiens
uuacaggacuaagcagcuuugc

SEQ ID NO: 185613 - RNA, 22 nt, Homo sapiens
uuaggacaauguucguuuuuug

SEQ ID NO: 185614 - RNA, 22 nt, Homo sapiens
uuagugaaugggugugauuugu

SEQ ID NO: 185615 - RNA, 22 nt, Homo sapiens
uuauacucgucugaaugauucu

SEQ ID NO: 185616 - RNA, 22 nt, Homo sapiens
uuaugacaggcucaggagcccc

SEQ ID NO: 185617 - RNA, 22 nt, Homo sapiens
uucaaaguaaagggauggagac

SEQ ID NO: 185618 - RNA, 22 nt, Homo sapiens
uucaaaguguugguuuugggcu

SEQ ID NO: 185619 - RNA, 22 nt, Homo sapiens
uucaccaguuuugucacgaaug

SEQ ID NO: 185620 - RNA, 22 nt, Homo sapiens
uucacugcacuccagccugggu

SEQ ID NO: 185621 - RNA, 22 nt, Homo sapiens
uucauaguguaccugaaggcac

SEQ ID NO: 185622 - RNA, 22 nt, Homo sapiens
uucaucagggguauuggccaau

SEQ ID NO: 185623 - RNA, 22 nt, Homo sapiens
uuccauuuguucggugucgcca

SEQ ID NO: 185624 - RNA, 22 nt, Homo sapiens
aaaaugcugauauugggcccca

SEQ ID NO: 185625 - RNA, 22 nt, Homo sapiens
aaagcacuggagucaucaucua

SEQ ID NO: 185626 - RNA, 22 nt, Homo sapiens
aaaugcuuucuuggaccauuug

SEQ ID NO: 185627 - RNA, 22 nt, Homo sapiens
aauaaagucugaagugugcuua

SEQ ID NO: 185628 - RNA, 22 nt, Homo sapiens
aauauguccuugaaauggugcu

SEQ ID NO: 185629 - RNA, 22 nt, Homo sapiens
aauugcaucuguucuuugccag

SEQ ID NO: 185630 - RNA, 21 nt, Homo sapiens
acauguacacauguaugcaca

SEQ ID NO: 185631 - RNA, 22 nt, Homo sapiens
agaauguauauucuguaguugu

SEQ ID NO: 185632 - RNA, 22 nt, Homo sapiens
agaguaguaggaugaauggacu

SEQ ID NO: 185633 - RNA, 22 nt, Homo sapiens
agaguaguuuauuaugcuaagg

SEQ ID NO: 185634 - RNA, 22 nt, Homo sapiens
agcaguacauaaaaagcauccu

SEQ ID NO: 185635 - RNA, 22 nt, Homo sapiens
agcuguuguuuuaagauacuaa

SEQ ID NO: 185636 - RNA, 22 nt, Homo sapiens
agcuuuuugggcagcuauugac

SEQ ID NO: 185637 - RNA, 22 nt, Homo sapiens
agugcagugguuaggagccagg

SEQ ID NO: 185638 - RNA, 22 nt, Homo sapiens
auaaagccaggagacguaauug

SEQ ID NO: 185639 - RNA, 22 nt, Homo sapiens
auacaguugccauuucuugugc

SEQ ID NO: 185640 - RNA, 20 nt, Homo sapiens
auagaagacuagugcagcag

SEQ ID NO: 185641 - RNA, 22 nt, Homo sapiens
auagaauguauuaguaaauuug

SEQ ID NO: 185642 - RNA, 22 nt, Homo sapiens
auagcagugugaaaauugacug

SEQ ID NO: 185643 - RNA, 22 nt, Homo sapiens
auagcagugugaggacagacua

SEQ ID NO: 185644 - RNA, 22 nt, Homo sapiens
auauuacagagaggaccuggga

SEQ ID NO: 185645 - RNA, 22 nt, Homo sapiens
aucaaaguaucucaauauggua

SEQ ID NO: 185646 - RNA, 22 nt, Homo sapiens
aucacagcuacuccucugucuu

SEQ ID NO: 185647 - RNA, 22 nt, Homo sapiens
aucuugcauuugcuaaaaugca

SEQ ID NO: 185648 - RNA, 22 nt, Homo sapiens
augaaagucaauccccaagugu

SEQ ID NO: 185649 - RNA, 22 nt, Homo sapiens
augaaaguguguggaaacuuga

SEQ ID NO: 185650 - RNA, 22 nt, Homo sapiens
augacagugagugagcucucac

SEQ ID NO: 185651 - RNA, 22 nt, Homo sapiens
augcaauucuagauugauagua

SEQ ID NO: 185652 - RNA, 22 nt, Homo sapiens
augguuugugcuccuauaagaa

SEQ ID NO: 185653 - RNA, 22 nt, Homo sapiens
augugcaacugcuggaacaguc

SEQ ID NO: 185654 - RNA, 22 nt, Homo sapiens
auguggaaagcagcaugauaug

SEQ ID NO: 185655 - RNA, 22 nt, Homo sapiens
auguguaaagcuuuucuuuguu

SEQ ID NO: 185656 - RNA, 22 nt, Homo sapiens
auuauauguguaugugcauacc

SEQ ID NO: 185657 - RNA, 22 nt, Homo sapiens
auuguacuuaagccugggugaa

SEQ ID NO: 185658 - RNA, 22 nt, Homo sapiens
auugucacccgggcaguaagca

SEQ ID NO: 185659 - RNA, 22 nt, Homo sapiens
auuguucuuacaugcugucauc

SEQ ID NO: 185660 - RNA, 22 nt, Homo sapiens
auuuggcaguauaaugcuuugg

SEQ ID NO: 185661 - RNA, 22 nt, Homo sapiens
caauggcacgaucucgucucac

SEQ ID NO: 185662 - RNA, 22 nt, Homo sapiens
cacauguuuuagcauggcuguu

SEQ ID NO: 185663 - RNA, 22 nt, Homo sapiens
cacugcgaccucugccuaccgg

SEQ ID NO: 185664 - RNA, 22 nt, Homo sapiens
cagagaacauucagagcuguag

SEQ ID NO: 185665 - RNA, 22 nt, Homo sapiens
cagccgggugagguggcuuguu

SEQ ID NO: 185666 - RNA, 22 nt, Homo sapiens
cauacagcuaguaaguguaaga

SEQ ID NO: 185667 - RNA, 22 nt, Homo sapiens
cauauucacuuuacagagcugu

SEQ ID NO: 185668 - RNA, 22 nt, Homo sapiens
cauugcaacuucugccucccag

SEQ ID NO: 185669 - RNA, 22 nt, Homo sapiens
cauugucccucaaugucuauga

SEQ ID NO: 185670 - RNA, 22 nt, Homo sapiens
cauuuugcaguuucugucucca

SEQ ID NO: 185671 - RNA, 22 nt, Homo sapiens
cccagaguucuuaaauacugag

SEQ ID NO: 185672 - RNA, 22 nt, Homo sapiens
ccuuuuuguaguggaaguagga

SEQ ID NO: 185673 - RNA, 22 nt, Homo sapiens
cuacaguucuuaauuaaguagu

SEQ ID NO: 185674 - RNA, 22 nt, Homo sapiens
cucauuaguuguuuuaagauga

SEQ ID NO: 185675 - RNA, 22 nt, Homo sapiens
cucauugcaaucuccaccuccc

SEQ ID NO: 185676 - RNA, 20 nt, Homo sapiens
cucccugacaaauguggaaa

SEQ ID NO: 185677 - RNA, 22 nt, Homo sapiens
cucccuuugcugaauguuuuuc

SEQ ID NO: 185678 - RNA, 22 nt, Homo sapiens
cugaaagagcauguaacacagu

SEQ ID NO: 185679 - RNA, 22 nt, Homo sapiens
cugaaagagcauuugaaugggu

SEQ ID NO: 185680 - RNA, 22 nt, Homo sapiens
cugacuuuagaacccaaaaagu

SEQ ID NO: 185681 - RNA, 22 nt, Homo sapiens
cugcaagaaucguaguauuuga

SEQ ID NO: 185682 - RNA, 22 nt, Homo sapiens
cugcaauggagaaagugagacu

SEQ ID NO: 185683 - RNA, 22 nt, Homo sapiens
cugcauaaucaucucucugcau

SEQ ID NO: 185684 - RNA, 22 nt, Homo sapiens
cuggcaaaaagagggcaauaau

SEQ ID NO: 185685 - RNA, 22 nt, Homo sapiens
cugggguaggacuggcuuuuga

SEQ ID NO: 185686 - RNA, 22 nt, Homo sapiens
cugucucagugaauugguuuua

SEQ ID NO: 185687 - RNA, 22 nt, Homo sapiens
cugugguuuaaggaauuuugac

SEQ ID NO: 185688 - RNA, 22 nt, Homo sapiens
cuucaaaguuggcuaggagaca

SEQ ID NO: 185689 - RNA, 20 nt, Homo sapiens
cuuggcuuucuugguguuaa

SEQ ID NO: 185690 - RNA, 18 nt, Homo sapiens
cuuugcagcuuccagagg

SEQ ID NO: 185691 - RNA, 22 nt, Homo sapiens
gacaguuuggugaggaagacga

SEQ ID NO: 185692 - RNA, 22 nt, Homo sapiens
gagaacauuuaagccacucagg

SEQ ID NO: 185693 - RNA, 21 nt, Homo sapiens
gagaaucaucauggcugcaua

SEQ ID NO: 185694 - RNA, 22 nt, Homo sapiens
gagacggagucacgcccuguca

SEQ ID NO: 185695 - RNA, 22 nt, Homo sapiens
gagacggagucucgcucugucg

SEQ ID NO: 185696 - RNA, 22 nt, Homo sapiens
gagacggagucuugcucuguug

SEQ ID NO: 185697 - RNA, 22 nt, Homo sapiens
gagacugagucuugcucugucg

SEQ ID NO: 185698 - RNA, 22 nt, Homo sapiens
gagcugaucuuuucugauucca

SEQ ID NO: 185699 - RNA, 22 nt, Homo sapiens
gaggcauuauucccaucuuaca

SEQ ID NO: 185700 - RNA, 22 nt, Homo sapiens
gagugcaauggcagaucuccgc

SEQ ID NO: 185701 - RNA, 22 nt, Homo sapiens
gagugcaauggugcuaucucgg

SEQ ID NO: 185702 - RNA, 22 nt, Homo sapiens
gauagugaaccaagggguaauu

SEQ ID NO: 185703 - RNA, 22 nt, Homo sapiens
aaaaggcuagcuaguaacagaa

SEQ ID NO: 185704 - RNA, 22 nt, Homo sapiens
aaaagucuguagugaaagguga

SEQ ID NO: 185705 - RNA, 22 nt, Homo sapiens
aaagugauguccaggcuuucag

SEQ ID NO: 185706 - RNA, 19 nt, Homo sapiens
aaaugugcacuguuuucca

SEQ ID NO: 185707 - RNA, 23 nt, Homo sapiens
aaauuugccuauuauuccuaugg

SEQ ID NO: 185708 - RNA, 22 nt, Homo sapiens
aaccuacauucuuaacuguugc

SEQ ID NO: 185709 - RNA, 22 nt, Homo sapiens
aacugcuguuuggguacuggug

SEQ ID NO: 185710 - RNA, 22 nt, Homo sapiens
aagucaaggagagaagcuucag

SEQ ID NO: 185711 - RNA, 22 nt, Homo sapiens
aauugcauaugcaguagaucua

SEQ ID NO: 185712 - RNA, 22 nt, Homo sapiens
aauugcauugaauuuguagcuu

SEQ ID NO: 185713 - RNA, 22 nt, Homo sapiens
acacuauugagguuuguuugca

SEQ ID NO: 185714 - RNA, 22 nt, Homo sapiens
acagaacugggcuugcuuuugg

SEQ ID NO: 185715 - RNA, 22 nt, Homo sapiens
acagugcuuucaauguucagua

SEQ ID NO: 185716 - RNA, 22 nt, Homo sapiens
acccuuuagguuggaugaggau

SEQ ID NO: 185717 - RNA, 22 nt, Homo sapiens
acugaguguugauuuagauuaa

SEQ ID NO: 185718 - RNA, 22 nt, Homo sapiens
acuucauucucuggaucagaau

SEQ ID NO: 185719 - RNA, 22 nt, Homo sapiens
acuuuuugaugaggucguuugu

SEQ ID NO: 185720 - RNA, 22 nt, Homo sapiens
agaacuguccauucagcaugaa

SEQ ID NO: 185721 - RNA, 22 nt, Homo sapiens
agaauguaaacagaauagagga

SEQ ID NO: 185722 - RNA, 22 nt, Homo sapiens
agcccauguggcugaggcuucu

SEQ ID NO: 185723 - RNA, 21 nt, Homo sapiens
agcuaaauuggaaauuucugu

SEQ ID NO: 185724 - RNA, 16 nt, Homo sapiens
agcuggaauuacaggc

SEQ ID NO: 185725 - RNA, 17 nt, Homo sapiens
agcuggaauuacgggag

SEQ ID NO: 185726 - RNA, 22 nt, Homo sapiens
agguagcauagcgggaauauca

SEQ ID NO: 185727 - RNA, 22 nt, Homo sapiens
aguagcaauggcucugagcuau

SEQ ID NO: 185728 - RNA, 22 nt, Homo sapiens
agugauggagccaggauuuaau

SEQ ID NO: 185729 - RNA, 22 nt, Homo sapiens
agugccauggcugcuagauggc

SEQ ID NO: 185730 - RNA, 22 nt, Homo sapiens
auaaagacacuuggcaugauuu

SEQ ID NO: 185731 - RNA, 22 nt, Homo sapiens
auagcagugugaaaauguacua

SEQ ID NO: 185732 - RNA, 20 nt, Homo sapiens
auaugcagacacauacauac

SEQ ID NO: 185733 - RNA, 22 nt, Homo sapiens
auauggcauucagaacuguaua

SEQ ID NO: 185734 - RNA, 18 nt, Homo sapiens
auauugcauuggauggau

SEQ ID NO: 185735 - RNA, 22 nt, Homo sapiens
auauuguacugcuacugguucu

SEQ ID NO: 185736 - RNA, 22 nt, Homo sapiens
ucuugguuuauugauggagagg

SEQ ID NO: 185737 - RNA, 22 nt, Homo sapiens
ucuuugggauauucugaaaggg

SEQ ID NO: 185738 - RNA, 22 nt, Homo sapiens
ucuuugguaugugcaugugcuu

SEQ ID NO: 185739 - RNA, 22 nt, Homo sapiens
ucuuugguauugugaauagugu

SEQ ID NO: 185740 - RNA, 22 nt, Homo sapiens
ucuuuggucaucaugggaagca

SEQ ID NO: 185741 - RNA, 22 nt, Homo sapiens
ucuuuggucuacuuucauaugu

SEQ ID NO: 185742 - RNA, 22 nt, Homo sapiens
ucuuugguuguuuagggugcau

SEQ ID NO: 185743 - RNA, 22 nt, Homo sapiens
ucuuuguguaggucaaucuggc

SEQ ID NO: 185744 - RNA, 22 nt, Homo sapiens
ugaaaagucuaagauuaagguu

SEQ ID NO: 185745 - RNA, 22 nt, Homo sapiens
ugaaaucauguaguuauugcaa

SEQ ID NO: 185746 - RNA, 22 nt, Homo sapiens
ugaaaucuaaaauguuccaaga

SEQ ID NO: 185747 - RNA, 22 nt, Homo sapiens
ugaaggacauucuaugguagau

SEQ ID NO: 185748 - RNA, 22 nt, Homo sapiens
ugaagugggaaaugaguauuaa

SEQ ID NO: 185749 - RNA, 22 nt, Homo sapiens
ugaauacuucaaaaaaauagcu

SEQ ID NO: 185750 - RNA, 22 nt, Homo sapiens
ugaaucauuucuugucuucagu

SEQ ID NO: 185751 - RNA, 22 nt, Homo sapiens
ugacacagugggggauccuuuu

SEQ ID NO: 185752 - RNA, 22 nt, Homo sapiens
ugacagcugaagauguugaacc

SEQ ID NO: 185753 - RNA, 22 nt, Homo sapiens
ugacaggauggagaucgguauu

SEQ ID NO: 185754 - RNA, 22 nt, Homo sapiens
ugacaguaucuacagcuucuua

SEQ ID NO: 185755 - RNA, 22 nt, Homo sapiens
ugacagugaauaagucucuuaa

SEQ ID NO: 185756 - RNA, 22 nt, Homo sapiens
ugacauguauuagcucagugcu

SEQ ID NO: 185757 - RNA, 22 nt, Homo sapiens
ugagacggagucucgcuguguc

SEQ ID NO: 185758 - RNA, 22 nt, Homo sapiens
ugagagaugaacucugauaugu

SEQ ID NO: 185759 - RNA, 22 nt, Homo sapiens
ugagguuauuuguucaagaagu

SEQ ID NO: 185760 - RNA, 22 nt, Homo sapiens
ugaguagaacuccuggagaugu

SEQ ID NO: 185761 - RNA, 22 nt, Homo sapiens
ugagucagucucacucugcugc

SEQ ID NO: 185762 - RNA, 22 nt, Homo sapiens
ugagucauuuccuuaugcuacu

SEQ ID NO: 185763 - RNA, 22 nt, Homo sapiens
ugagugaggcugggcagucccu

SEQ ID NO: 185764 - RNA, 22 nt, Homo sapiens
ugaguucaauuguauuuuauua

SEQ ID NO: 185765 - RNA, 23 nt, Homo sapiens
ugauguccacuuagggucuaggu

SEQ ID NO: 185766 - RNA, 22 nt, Homo sapiens
ugcaauauccucuacuauaggu

SEQ ID NO: 185767 - RNA, 22 nt, Homo sapiens
ugcaccacugcacuucagccug

SEQ ID NO: 185768 - RNA, 16 nt, Homo sapiens
ugcagaguaggugaau

SEQ ID NO: 185769 - RNA, 22 nt, Homo sapiens
ugcagcacuguucacaauagcc

SEQ ID NO: 185770 - RNA, 18 nt, Homo sapiens
ugcagcuuugugauuggc

SEQ ID NO: 185771 - RNA, 18 nt, Homo sapiens
ugcauauguugaaccagc

SEQ ID NO: 185772 - RNA, 21 nt, Homo sapiens
ugcaugguagucacaugauuc

SEQ ID NO: 185773 - RNA, 22 nt, Homo sapiens
ugccuaggcuggagugcagugg

SEQ ID NO: 185774 - RNA, 22 nt, Homo sapiens
ugccugagcccagcccuguagu

SEQ ID NO: 185775 - RNA, 16 nt, Homo sapiens
ugccuucuucuguauu

SEQ ID NO: 185776 - RNA, 22 nt, Homo sapiens
ugcugcuguuguuguuacuagc

SEQ ID NO: 185777 - RNA, 22 nt, Homo sapiens
ugcugguggucccauaugauua

SEQ ID NO: 185778 - RNA, 22 nt, Homo sapiens
ugcugguguuuaggaauaagaa

SEQ ID NO: 185779 - RNA, 21 nt, Homo sapiens
ugcuuuggucauacuucuucc

SEQ ID NO: 185780 - RNA, 22 nt, Homo sapiens
uggaaaauuaggggagguuaua

SEQ ID NO: 185781 - RNA, 22 nt, Homo sapiens
uggaaaguaguucuaaucuaag

SEQ ID NO: 185782 - RNA, 22 nt, Homo sapiens
uggaagacaggcuguauuuuaa

SEQ ID NO: 185783 - RNA, 22 nt, Homo sapiens
uggaagacauuuuggaccuugg

SEQ ID NO: 185784 - RNA, 22 nt, Homo sapiens
uggaagacucaagguggugaau

SEQ ID NO: 185785 - RNA, 22 nt, Homo sapiens
uggaagacuuuagaggcuuaua

SEQ ID NO: 185786 - RNA, 22 nt, Homo sapiens
uggacauguacauauguguaug

SEQ ID NO: 185787 - RNA, 21 nt, Homo sapiens
uggaccccuuccagucaucau

SEQ ID NO: 185788 - RNA, 22 nt, Homo sapiens
uggaguguaauuagccaucagu

SEQ ID NO: 185789 - RNA, 20 nt, Homo sapiens
uggcaccugacagauagcca

SEQ ID NO: 185790 - RNA, 22 nt, Homo sapiens
uggcauggucugcccaaguuuc

SEQ ID NO: 185791 - RNA, 22 nt, Homo sapiens
uggcaugucguuuuucauagga

SEQ ID NO: 185792 - RNA, 22 nt, Homo sapiens
uggccagugucggaggccagga

SEQ ID NO: 185793 - RNA, 22 nt, Homo sapiens
uggccuguaacgcugucucagc

SEQ ID NO: 185794 - RNA, 22 nt, Homo sapiens
uggcgagaaaccauaugcuuuc

SEQ ID NO: 185795 - RNA, 20 nt, Homo sapiens
uggcuucuuaauugcaggca

SEQ ID NO: 185796 - RNA, 22 nt, Homo sapiens
uggcuuucuggggcuucuguuc

SEQ ID NO: 185797 - RNA, 22 nt, Homo sapiens
ugggauguagccuucuauuuuc

SEQ ID NO: 185798 - RNA, 23 nt, Homo sapiens
ugggauguuuuuggaaacuucug

SEQ ID NO: 185799 - RNA, 22 nt, Homo sapiens
uggguaggcccucauuggacag

SEQ ID NO: 185800 - RNA, 22 nt, Homo sapiens
uggguaguuucuuacaacucug

SEQ ID NO: 185801 - RNA, 22 nt, Homo sapiens
uggguaguuuuucagcucuugc

SEQ ID NO: 185802 - RNA, 19 nt, Homo sapiens
uggucaguucugggagcug

SEQ ID NO: 185803 - RNA, 21 nt, Homo sapiens
uggucaguuuucucacuagga

SEQ ID NO: 185804 - RNA, 22 nt, Homo sapiens
ugguccaguucugugauauugc

SEQ ID NO: 185805 - RNA, 22 nt, Homo sapiens
uggucuucuggccuccagaacc

SEQ ID NO: 185806 - RNA, 20 nt, Homo sapiens
uggugucuuggaaagagcuc

SEQ ID NO: 185807 - RNA, 22 nt, Homo sapiens
ugguuccauauuaauuuuagga

SEQ ID NO: 185808 - RNA, 22 nt, Homo sapiens
uguaaagaaagcuguuguugua

SEQ ID NO: 185809 - RNA, 20 nt, Homo sapiens
uguaacaaucuggauguugc

SEQ ID NO: 185810 - RNA, 22 nt, Homo sapiens
uguaacaggaggaaaaugugaa

SEQ ID NO: 185811 - RNA, 22 nt, Homo sapiens
uguauguugauguuauauucug

SEQ ID NO: 185812 - RNA, 18 nt, Homo sapiens
ugucacuggauaaugguc

SEQ ID NO: 185813 - RNA, 22 nt, Homo sapiens
ugucaguggacugugaaaggca

SEQ ID NO: 185814 - RNA, 22 nt, Homo sapiens
ugucaguguacuguaagaauua

SEQ ID NO: 185815 - RNA, 21 nt, Homo sapiens
ugucaugcagagacccuggag

SEQ ID NO: 185816 - RNA, 22 nt, Homo sapiens
ugucucaguucccuucucugga

SEQ ID NO: 185817 - RNA, 22 nt, Homo sapiens
ugucuuggaugaggauuaacag

SEQ ID NO: 185818 - RNA, 19 nt, Homo sapiens
ugugaacaucacagagugu

SEQ ID NO: 185819 - RNA, 22 nt, Homo sapiens
ugugacagguauccuguguucu

SEQ ID NO: 185820 - RNA, 22 nt, Homo sapiens
ugugccaaucauagggcuuggu

SEQ ID NO: 185821 - RNA, 22 nt, Homo sapiens
ugugccacuccagcucuagcuu

SEQ ID NO: 185822 - RNA, 22 nt, Homo sapiens
ugugccacugcacucuggccug

SEQ ID NO: 185823 - RNA, 22 nt, Homo sapiens
ugugucuuuuaucacacaaugu

SEQ ID NO: 185824 - RNA, 22 nt, Homo sapiens
uguuucuacugucucuguagua

SEQ ID NO: 185825 - RNA, 22 nt, Homo sapiens
uguuugcuguguggaguagcag

SEQ ID NO: 185826 - RNA, 22 nt, Homo sapiens
uguuugguggucucuucacaug

SEQ ID NO: 185827 - RNA, 22 nt, Homo sapiens
uuaagcaaagguaacaugagaa

SEQ ID NO: 185828 - RNA, 22 nt, Homo sapiens
uuaagcaguaguuaaggagagg

SEQ ID NO: 185829 - RNA, 22 nt, Homo sapiens
uuaauucugucugcccucaucc

SEQ ID NO: 185830 - RNA, 22 nt, Homo sapiens
uuauaacagagacuccugugcu

SEQ ID NO: 185831 - RNA, 22 nt, Homo sapiens
uuauauguuacucccucuagca

SEQ ID NO: 185832 - RNA, 22 nt, Homo sapiens
uuauauguuucuuagggacaga

SEQ ID NO: 185833 - RNA, 22 nt, Homo sapiens
uuauuagagauauuugguuagg

SEQ ID NO: 185834 - RNA, 22 nt, Homo sapiens
uucaaaguuggaggacaaacug

SEQ ID NO: 185835 - RNA, 19 nt, Homo sapiens
uucaaugcagcauugccac

SEQ ID NO: 185836 - RNA, 22 nt, Homo sapiens
uucaccuggaguucaggauaag

SEQ ID NO: 185837 - RNA, 22 nt, Homo sapiens
uucaccuggguuggccaucauu

SEQ ID NO: 185838 - RNA, 22 nt, Homo sapiens
uucacugagccagacuaagaca

SEQ ID NO: 185839 - RNA, 21 nt, Homo sapiens
uucacuggucuauuucccuuu

SEQ ID NO: 185840 - RNA, 22 nt, Homo sapiens
uucagagagggagggauaccua

SEQ ID NO: 185841 - RNA, 22 nt, Homo sapiens
uucaggcuccugugagaaucua

SEQ ID NO: 185842 - RNA, 22 nt, Homo sapiens
uucaguggagaggcugaguggu

SEQ ID NO: 185843 - RNA, 22 nt, Homo sapiens
uucagugguuauuugugagauu

SEQ ID NO: 185844 - RNA, 18 nt, Homo sapiens
uucauaguagcaugauuu

SEQ ID NO: 185845 - RNA, 22 nt, Homo sapiens
uucaucaguuauauuggccuga

SEQ ID NO: 185846 - RNA, 22 nt, Homo sapiens
uucauggugguacaaaagcaau

SEQ ID NO: 185847 - RNA, 22 nt, Homo sapiens
uuccacaaugguugaacuaauu

SEQ ID NO: 185848 - RNA, 22 nt, Homo sapiens
uuccaguggacuacuucauccu

SEQ ID NO: 185849 - RNA, 22 nt, Homo sapiens
uuccuacugugcaaaguugcaa

SEQ ID NO: 185850 - RNA, 22 nt, Homo sapiens
uuccugagagggcugggugcag

SEQ ID NO: 185851 - RNA, 22 nt, Homo sapiens
uuccuugguucagggaaggucc

SEQ ID NO: 185852 - RNA, 22 nt, Homo sapiens
uuccuuguuuauuuacaggagg

SEQ ID NO: 185853 - RNA, 21 nt, Homo sapiens
uucucagaggcaggggauaaa

SEQ ID NO: 185854 - RNA, 21 nt, Homo sapiens
uucucaggguguguccuaccc

SEQ ID NO: 185855 - RNA, 22 nt, Homo sapiens
uucucagugaaguuuagaacau

SEQ ID NO: 185856 - RNA, 22 nt, Homo sapiens
uucuggcuaugggauacuaaau

SEQ ID NO: 185857 - RNA, 22 nt, Homo sapiens
uucuggcucgauucucugaccg

SEQ ID NO: 185858 - RNA, 22 nt, Homo sapiens
uucuucaggccacaaaaauggu

SEQ ID NO: 185859 - RNA, 22 nt, Homo sapiens
uucuuugguacaagggccgacc

SEQ ID NO: 185860 - RNA, 22 nt, Homo sapiens
uugagacgaagucucacucuug

SEQ ID NO: 185861 - RNA, 22 nt, Homo sapiens
uugaucaaaucugagugagaau

SEQ ID NO: 185862 - RNA, 23 nt, Homo sapiens
uugcauagacauccucauagauu

SEQ ID NO: 185863 - RNA, 22 nt, Homo sapiens
uugccuaggcuggagugcagua

SEQ ID NO: 185864 - RNA, 22 nt, Homo sapiens
uugcuccucugccaggaccugu

SEQ ID NO: 185865 - RNA, 22 nt, Homo sapiens
uuggaaaaauccaccuugaucu

SEQ ID NO: 185866 - RNA, 22 nt, Homo sapiens
uuggaaaccucugcagguguuu

SEQ ID NO: 185867 - RNA, 22 nt, Homo sapiens
uuggcagaauguuagaaacuua

SEQ ID NO: 185868 - RNA, 22 nt, Homo sapiens
uuggcuacagauuaugaauuuc

SEQ ID NO: 185869 - RNA, 21 nt, Homo sapiens
uuggcuacugcuucagaggga

SEQ ID NO: 185870 - RNA, 22 nt, Homo sapiens
uuggcuucuggacuauugugca

SEQ ID NO: 185871 - RNA, 22 nt, Homo sapiens
uuggucaggcuaaucucgaacg

SEQ ID NO: 185872 - RNA, 21 nt, Homo sapiens
uugguccacaugucauaguua

SEQ ID NO: 185873 - RNA, 21 nt, Homo sapiens
uuggucuucucugugauucuu

SEQ ID NO: 185874 - RNA, 22 nt, Homo sapiens
uugguucucuuagccaucuuaa

SEQ ID NO: 185875 - RNA, 22 nt, Homo sapiens
uugguucucuuuauaugcugga

SEQ ID NO: 185876 - RNA, 22 nt, Homo sapiens
uuguagcaaauauauuuuggaa

SEQ ID NO: 185877 - RNA, 22 nt, Homo sapiens
uuuaaagcuaaaauauguuuau

SEQ ID NO: 185878 - RNA, 22 nt, Homo sapiens
uuuaauacugcaucuuuacucu

SEQ ID NO: 185879 - RNA, 22 nt, Homo sapiens
uuuagcaaagcaauuuacacca

SEQ ID NO: 185880 - RNA, 22 nt, Homo sapiens
uuucagagucaucugcccaagu

SEQ ID NO: 185881 - RNA, 22 nt, Homo sapiens
uuucuauguugaccagucuaga

SEQ ID NO: 185882 - RNA, 22 nt, Homo sapiens
uuugaaguguggcacugaguuu

SEQ ID NO: 185883 - RNA, 22 nt, Homo sapiens
uuugaauguaaugagcaggaag

SEQ ID NO: 185884 - RNA, 22 nt, Homo sapiens
uuugacaaugugugcuuguauu

SEQ ID NO: 185885 - RNA, 22 nt, Homo sapiens
uuugaggaaaggcauaaguagg

SEQ ID NO: 185886 - RNA, 22 nt, Homo sapiens
uuugcuucacuguuuggcaaaa

SEQ ID NO: 185887 - RNA, 22 nt, Homo sapiens
uuuggucacugccgccgccagc

SEQ ID NO: 185888 - RNA, 22 nt, Homo sapiens
uuugguccaguguucagguccu

SEQ ID NO: 185889 - RNA, 22 nt, Homo sapiens
uuugguccuccuacagggcagg

SEQ ID NO: 185890 - RNA, 18 nt, Homo sapiens
uuugguccuuuauaaaca

SEQ ID NO: 185891 - RNA, 22 nt, Homo sapiens
uuugguuuuuguuaucacucau

SEQ ID NO: 185892 - RNA, 22 nt, Homo sapiens
uuuguguccccacccaaacauc

SEQ ID NO: 185893 - RNA, 21 nt, Homo sapiens
uuuguguccccacccaaaucu

SEQ ID NO: 185894 - RNA, 23 nt, Homo sapiens
uuugugucccucuagaauucaug

SEQ ID NO: 185895 - RNA, 22 nt, Homo sapiens
uuuuggucuccaguuucugcug

SEQ ID NO: 185896 - RNA, 22 nt, Homo sapiens
uuuugguuaggauggguggcau

SEQ ID NO: 185897 - RNA, 22 nt, Homo sapiens
uuuugucccaugggcuguuccc

SEQ ID NO: 185898 - RNA, 22 nt, Homo sapiens
ugagauaaucaugugauuucau

SEQ ID NO: 185899 - RNA, 18 nt, Homo sapiens
ugagaucagcaucaaggg

SEQ ID NO: 185900 - RNA, 22 nt, Homo sapiens
ugagaucgagucucgcucuguc

SEQ ID NO: 185901 - RNA, 22 nt, Homo sapiens
ugagauggaguuucgcccuugu

SEQ ID NO: 185902 - RNA, 22 nt, Homo sapiens
ugagauggcugaauucagaaua

SEQ ID NO: 185903 - RNA, 22 nt, Homo sapiens
ugagauggguucugguccccug

SEQ ID NO: 185904 - RNA, 22 nt, Homo sapiens
ugagcaauaaaguuacacaguu

SEQ ID NO: 185905 - RNA, 22 nt, Homo sapiens
ugagcuguuugaagaagcauuu

SEQ ID NO: 185906 - RNA, 22 nt, Homo sapiens
ugagucaauggaggcucagagc

SEQ ID NO: 185907 - RNA, 22 nt, Homo sapiens
ugauagucauucaauuuagcca

SEQ ID NO: 185908 - RNA, 22 nt, Homo sapiens
ugauagugccuuuuauaucucu

SEQ ID NO: 185909 - RNA, 22 nt, Homo sapiens
ugaugcugaugccugccagaag

SEQ ID NO: 185910 - RNA, 22 nt, Homo sapiens
ugcauagaauguucuguaaaua

SEQ ID NO: 185911 - RNA, 22 nt, Homo sapiens
ugcauggaagggagggaaagag

SEQ ID NO: 185912 - RNA, 22 nt, Homo sapiens
ugccuaggcccaguccucagaa

SEQ ID NO: 185913 - RNA, 22 nt, Homo sapiens
ugccuaggcuggaaugcaaugg

SEQ ID NO: 185914 - RNA, 20 nt, Homo sapiens
ugccugacacucuuugcuuc

SEQ ID NO: 185915 - RNA, 21 nt, Homo sapiens
ugcuauguuguccaggcuggc

SEQ ID NO: 185916 - RNA, 22 nt, Homo sapiens
ugcuuaguguugacccucugcc

SEQ ID NO: 185917 - RNA, 22 nt, Homo sapiens
ugcuuugguagaaaucuuuggu

SEQ ID NO: 185918 - RNA, 22 nt, Homo sapiens
uggaagcauagcagcgugugug

SEQ ID NO: 185919 - RNA, 22 nt, Homo sapiens
uggacacugguggauauggaau

SEQ ID NO: 185920 - RNA, 22 nt, Homo sapiens
uggacaugaagggcacaggagg

SEQ ID NO: 185921 - RNA, 22 nt, Homo sapiens
uggaccccugcucgggagcccu

SEQ ID NO: 185922 - RNA, 21 nt, Homo sapiens
uggaccccuuccuugcaccau

SEQ ID NO: 185923 - RNA, 22 nt, Homo sapiens
uggaugccuaauaaaugcagac

SEQ ID NO: 185924 - RNA, 22 nt, Homo sapiens
uggcagcgugaauguggcugaa

SEQ ID NO: 185925 - RNA, 22 nt, Homo sapiens
uggcaggugcacuggcuuugaa

SEQ ID NO: 185926 - RNA, 23 nt, Homo sapiens
uggcauuuuaguuagcuucagug

SEQ ID NO: 185927 - RNA, 23 nt, Homo sapiens
uggccagaaacuucuuuucaucc

SEQ ID NO: 185928 - RNA, 22 nt, Homo sapiens
uggcuuuuauuauguugaggua

SEQ ID NO: 185929 - RNA, 20 nt, Homo sapiens
ugggaaauguccaggacaua

SEQ ID NO: 185930 - RNA, 22 nt, Homo sapiens
ugggagcauugcauuagaagcc

SEQ ID NO: 185931 - RNA, 22 nt, Homo sapiens
ugggaucauucaaugacgaaau

SEQ ID NO: 185932 - RNA, 22 nt, Homo sapiens
uggggugugagggagaaagaaa

SEQ ID NO: 185933 - RNA, 22 nt, Homo sapiens
uggguaggaccagaaaugcacu

SEQ ID NO: 185934 - RNA, 22 nt, Homo sapiens
ugguccacuaacccucaguauc

SEQ ID NO: 185935 - RNA, 22 nt, Homo sapiens
ugguucaguugcacaggcuguu

SEQ ID NO: 185936 - RNA, 22 nt, Homo sapiens
uguaaaaagcccagccgcugag

SEQ ID NO: 185937 - RNA, 22 nt, Homo sapiens
uguagcaaauaaaagucuggau

SEQ ID NO: 185938 - RNA, 22 nt, Homo sapiens
uguagcaaaucgauacuauugg

SEQ ID NO: 185939 - RNA, 22 nt, Homo sapiens
uguagcuuuugagauuuauauu

SEQ ID NO: 185940 - RNA, 22 nt, Homo sapiens
uguauguugggucaaaguacau

SEQ ID NO: 185941 - RNA, 22 nt, Homo sapiens
ugucagggaggcucggccgcac

SEQ ID NO: 185942 - RNA, 22 nt, Homo sapiens
uucuuuggauaaaguuuuaugc

SEQ ID NO: 185943 - RNA, 22 nt, Homo sapiens
uugaaggaacgcuguucccuug

SEQ ID NO: 185944 - RNA, 22 nt, Homo sapiens
uugaaguaggaaaggaggaggu

SEQ ID NO: 185945 - RNA, 22 nt, Homo sapiens
uugacuuuuauucacucugcua

SEQ ID NO: 185946 - RNA, 22 nt, Homo sapiens
uugagacggagucucacucugu

SEQ ID NO: 185947 - RNA, 22 nt, Homo sapiens
uugagacggaguuuugcucuug

SEQ ID NO: 185948 - RNA, 22 nt, Homo sapiens
uugagauggaguuucgcucuug

SEQ ID NO: 185949 - RNA, 22 nt, Homo sapiens
uugagccaaggauugucuuucc

SEQ ID NO: 185950 - RNA, 22 nt, Homo sapiens
uugaguccccacacuggguccc

SEQ ID NO: 185951 - RNA, 22 nt, Homo sapiens
uugaucaauagaauacaacaga

SEQ ID NO: 185952 - RNA, 22 nt, Homo sapiens
uugcagugugacgacuauauuu

SEQ ID NO: 185953 - RNA, 22 nt, Homo sapiens
uugcauagugcugagguucggg

SEQ ID NO: 185954 - RNA, 22 nt, Homo sapiens
uugcaugcacaguucucaauag

SEQ ID NO: 185955 - RNA, 22 nt, Homo sapiens
uugccuaggcuggagugcagug

SEQ ID NO: 185956 - RNA, 22 nt, Homo sapiens
uugcuucuuucgucuggcccca

SEQ ID NO: 185957 - RNA, 22 nt, Homo sapiens
uuggaaacauuuaugguaacag

SEQ ID NO: 185958 - RNA, 22 nt, Homo sapiens
uuggaagacauucugucugcua

SEQ ID NO: 185959 - RNA, 22 nt, Homo sapiens
uuggaagagaagggagauaaac

SEQ ID NO: 185960 - RNA, 22 nt, Homo sapiens
uuggcagaaaaggucggggguu

SEQ ID NO: 185961 - RNA, 22 nt, Homo sapiens
uuggguagugaguuccuccagg

SEQ ID NO: 185962 - RNA, 22 nt, Homo sapiens
uugguccacugugaaauuggga

SEQ ID NO: 185963 - RNA, 22 nt, Homo sapiens
uugguccauuacauugaugaca

SEQ ID NO: 185964 - RNA, 22 nt, Homo sapiens
uuggucucaucaagagcagcuu

SEQ ID NO: 185965 - RNA, 23 nt, Homo sapiens
uuggucucccaaaguguugagau

SEQ ID NO: 185966 - RNA, 22 nt, Homo sapiens
uuguacuuuuaguagagacggg

SEQ ID NO: 185967 - RNA, 22 nt, Homo sapiens
uuguagcaaauguguaaacaaa

SEQ ID NO: 185968 - RNA, 21 nt, Homo sapiens
uuguagcagcauaaucccaga

SEQ ID NO: 185969 - RNA, 22 nt, Homo sapiens
uugucaaacucauucuccaucc

SEQ ID NO: 185970 - RNA, 23 nt, Homo sapiens
uuguccccuccaaagcucauguu

SEQ ID NO: 185971 - RNA, 16 nt, Homo sapiens
uugucccuucccaaau

SEQ ID NO: 185972 - RNA, 22 nt, Homo sapiens
uuuaaugcaucccaaaauguag

SEQ ID NO: 185973 - RNA, 22 nt, Homo sapiens
uuucaacuaauuuuuuggugag

SEQ ID NO: 185974 - RNA, 22 nt, Homo sapiens
uuucaccguguuggccaggcug

SEQ ID NO: 185975 - RNA, 21 nt, Homo sapiens
uuucacugugaguuuuucugu

SEQ ID NO: 185976 - RNA, 16 nt, Homo sapiens
uuucaucaguuuuaau

SEQ ID NO: 185977 - RNA, 22 nt, Homo sapiens
uuuccagguggccaacauuuua

SEQ ID NO: 185978 - RNA, 22 nt, Homo sapiens
uuuccauguuggugaaaugagg

SEQ ID NO: 185979 - RNA, 22 nt, Homo sapiens
uuuccuggagaaucuuaacaaa

SEQ ID NO: 185980 - RNA, 22 nt, Homo sapiens
uuucuacagggcuugccaggua

SEQ ID NO: 185981 - RNA, 22 nt, Homo sapiens
uuugacucacagccuggcugcc

SEQ ID NO: 185982 - RNA, 22 nt, Homo sapiens
uuugagauaucuuccaucagua

SEQ ID NO: 185983 - RNA, 21 nt, Homo sapiens
uuugaucauuaaaagugaauc

SEQ ID NO: 185984 - RNA, 22 nt, Homo sapiens
uuuggcaguuauuuacucagug

SEQ ID NO: 185985 - RNA, 22 nt, Homo sapiens
uuuggcauuagagagacuugca

SEQ ID NO: 185986 - RNA, 22 nt, Homo sapiens
uuugggacuguauuaaaugccu

SEQ ID NO: 185987 - RNA, 22 nt, Homo sapiens
uuuggucccaaugugauaaggu

SEQ ID NO: 185988 - RNA, 22 nt, Homo sapiens
uuugguuauauauauacacucu

SEQ ID NO: 185989 - RNA, 23 nt, Homo sapiens
uuuguguccccacccaaaucuca

SEQ ID NO: 185990 - RNA, 22 nt, Homo sapiens
uuugugucccucuaaaauuuau

SEQ ID NO: 185991 - RNA, 23 nt, Homo sapiens
auauaguagaugugcaguaacau

SEQ ID NO: 185992 - RNA, 22 nt, Homo sapiens
auauauguuuucugggaagaaa

SEQ ID NO: 185993 - RNA, 22 nt, Homo sapiens
aucaccuggaggugaucacuug

SEQ ID NO: 185994 - RNA, 22 nt, Homo sapiens
aucauugcacaucacagccuca

SEQ ID NO: 185995 - RNA, 22 nt, Homo sapiens
auccugagacuuugcugaaguu

SEQ ID NO: 185996 - RNA, 22 nt, Homo sapiens
augaaacuggcuaauuuuugua

SEQ ID NO: 185997 - RNA, 22 nt, Homo sapiens
augaacuaugugggauguuuua

SEQ ID NO: 185998 - RNA, 22 nt, Homo sapiens
augacagcaucugugaaguugu

SEQ ID NO: 185999 - RNA, 22 nt, Homo sapiens
augacaguaugacuccaaaagu

SEQ ID NO: 186000 - RNA, 22 nt, Homo sapiens
augagauauuuuauaagaucau

SEQ ID NO: 186001 - RNA, 22 nt, Homo sapiens
augaggcacugcgcccuacuga

SEQ ID NO: 186002 - RNA, 22 nt, Homo sapiens
augagucacuuauuauuggggu

SEQ ID NO: 186003 - RNA, 18 nt, Homo sapiens
augagucauuguggaaau

SEQ ID NO: 186004 - RNA, 22 nt, Homo sapiens
augcagaucacauuuuucuguc

SEQ ID NO: 186005 - RNA, 22 nt, Homo sapiens
augcccauuuguuuucugaaag

SEQ ID NO: 186006 - RNA, 22 nt, Homo sapiens
auggaaggagaggaaugaauga

SEQ ID NO: 186007 - RNA, 22 nt, Homo sapiens
auggcaagaagagcaauuauuu

SEQ ID NO: 186008 - RNA, 22 nt, Homo sapiens
auggcaauguaagucagaaaaa

SEQ ID NO: 186009 - RNA, 22 nt, Homo sapiens
auggcucaguguguaucuauca

SEQ ID NO: 186010 - RNA, 22 nt, Homo sapiens
auggcuguuuaagaguuucauu

SEQ ID NO: 186011 - RNA, 22 nt, Homo sapiens
augguguccuguuuccccagga

SEQ ID NO: 186012 - RNA, 22 nt, Homo sapiens
augguuuuacugcaaaauggga

SEQ ID NO: 186013 - RNA, 22 nt, Homo sapiens
auguaaacuacagauuuugggu

SEQ ID NO: 186014 - RNA, 22 nt, Homo sapiens
augucacagguccuagccaagu

SEQ ID NO: 186015 - RNA, 22 nt, Homo sapiens
augugcaauggugucaccacau

SEQ ID NO: 186016 - RNA, 18 nt, Homo sapiens
augugcaauuuuguauuu

SEQ ID NO: 186017 - RNA, 22 nt, Homo sapiens
augugcauaugaagcacagaca

SEQ ID NO: 186018 - RNA, 20 nt, Homo sapiens
augugcuaauauuaauaugu

SEQ ID NO: 186019 - RNA, 22 nt, Homo sapiens
augugcuagguacuguuuagca

SEQ ID NO: 186020 - RNA, 22 nt, Homo sapiens
augugucaaaucuaggccaaag

SEQ ID NO: 186021 - RNA, 22 nt, Homo sapiens
auuaaggaguggguucauggug

SEQ ID NO: 186022 - RNA, 22 nt, Homo sapiens
auuaaguugugccugaaaacuu

SEQ ID NO: 186023 - RNA, 22 nt, Homo sapiens
auucacuguggcuuucucugau

SEQ ID NO: 186024 - RNA, 22 nt, Homo sapiens
auucacuuuuauagacaggucu

SEQ ID NO: 186025 - RNA, 22 nt, Homo sapiens
auucagaggggcagcugucuug

SEQ ID NO: 186026 - RNA, 22 nt, Homo sapiens
auugaaugaaauggcagacacu

SEQ ID NO: 186027 - RNA, 22 nt, Homo sapiens
auugcaaugggaaacuaugaaa

SEQ ID NO: 186028 - RNA, 21 nt, Homo sapiens
auugcacuccagccugggcga

SEQ ID NO: 186029 - RNA, 22 nt, Homo sapiens
auugcacuccauccugggcaau

SEQ ID NO: 186030 - RNA, 22 nt, Homo sapiens
auugcagauucgcuuuguguug

SEQ ID NO: 186031 - RNA, 22 nt, Homo sapiens
auugccuagccuggucucaaaa

SEQ ID NO: 186032 - RNA, 22 nt, Homo sapiens
auuggcagaaaucuuuauagua

SEQ ID NO: 186033 - RNA, 20 nt, Homo sapiens
auuugcauuauggagcaccc

SEQ ID NO: 186034 - RNA, 22 nt, Homo sapiens
caaaggcuguuauaggccagga

SEQ ID NO: 186035 - RNA, 22 nt, Homo sapiens
caaagugcuggaauuggccggg

SEQ ID NO: 186036 - RNA, 22 nt, Homo sapiens
caacagucagcccauccacaga

SEQ ID NO: 186037 - RNA, 22 nt, Homo sapiens
caagagagcugaugguuuuaaa

SEQ ID NO: 186038 - RNA, 22 nt, Homo sapiens
caagaggcuguguauaaagcca

SEQ ID NO: 186039 - RNA, 22 nt, Homo sapiens
caagugacugagccgccucggc

SEQ ID NO: 186040 - RNA, 22 nt, Homo sapiens
cacagugaacaauauccucugu

SEQ ID NO: 186041 - RNA, 22 nt, Homo sapiens
cacaguguucauagccaucagg

SEQ ID NO: 186042 - RNA, 22 nt, Homo sapiens
cacaguugccuaucuccugaag

SEQ ID NO: 186043 - RNA, 19 nt, Homo sapiens
caccagugcaugcuacuau

SEQ ID NO: 186044 - RNA, 22 nt, Homo sapiens
cacugcaauuacuuuugcacca

SEQ ID NO: 186045 - RNA, 22 nt, Homo sapiens
cacugcacuccagccuaagagg

SEQ ID NO: 186046 - RNA, 22 nt, Homo sapiens
cagagcacugauacuggguucu

SEQ ID NO: 186047 - RNA, 22 nt, Homo sapiens
cagagguaagcaagucagcauu

SEQ ID NO: 186048 - RNA, 22 nt, Homo sapiens
cagguacauuuuaaagggcuca

SEQ ID NO: 186049 - RNA, 22 nt, Homo sapiens
auuauaguguauacuugaaauu

SEQ ID NO: 186050 - RNA, 22 nt, Homo sapiens
auuauguuguauuuccuugcag

SEQ ID NO: 186051 - RNA, 22 nt, Homo sapiens
auucaucagggauauugguuga

SEQ ID NO: 186052 - RNA, 22 nt, Homo sapiens
auugcaacuuccgccuccuggg

SEQ ID NO: 186053 - RNA, 22 nt, Homo sapiens
auugcaauuaguccauagaguu

SEQ ID NO: 186054 - RNA, 22 nt, Homo sapiens
auugcacuccagucugggcaac

SEQ ID NO: 186055 - RNA, 22 nt, Homo sapiens
auugcacugcagccugggcaac

SEQ ID NO: 186056 - RNA, 22 nt, Homo sapiens
auugcccaggcuggagugcagu

SEQ ID NO: 186057 - RNA, 22 nt, Homo sapiens
auuggcuuuauacauaagaaua

SEQ ID NO: 186058 - RNA, 22 nt, Homo sapiens
auuguacucuagccucugggca

SEQ ID NO: 186059 - RNA, 22 nt, Homo sapiens
auuguucuuguguccuuuuccu

SEQ ID NO: 186060 - RNA, 22 nt, Homo sapiens
auuugguuauucaguuguucag

SEQ ID NO: 186061 - RNA, 22 nt, Homo sapiens
caaaagugauugcgguuuuugc

SEQ ID NO: 186062 - RNA, 22 nt, Homo sapiens
caaagugcugggaugggccagg

SEQ ID NO: 186063 - RNA, 22 nt, Homo sapiens
caaaugcuucuauggacugucu

SEQ ID NO: 186064 - RNA, 22 nt, Homo sapiens
caaugcagcuuuuggagagaaa

SEQ ID NO: 186065 - RNA, 22 nt, Homo sapiens
cacaggaagaggcacggucccu

SEQ ID NO: 186066 - RNA, 22 nt, Homo sapiens
cacaguguuccagcuauuugaa

SEQ ID NO: 186067 - RNA, 21 nt, Homo sapiens
cacugcacuugccuucugggu

SEQ ID NO: 186068 - RNA, 22 nt, Homo sapiens
cacuggacauguugaagcuuuu

SEQ ID NO: 186069 - RNA, 21 nt, Homo sapiens
cacugguguugcuauaucaaa

SEQ ID NO: 186070 - RNA, 22 nt, Homo sapiens
cagcuggugcugcaccaguggg

SEQ ID NO: 186071 - RNA, 22 nt, Homo sapiens
caggcaaggugaaguguacugg

SEQ ID NO: 186072 - RNA, 22 nt, Homo sapiens
cagugcauagaugugccacauu

SEQ ID NO: 186073 - RNA, 22 nt, Homo sapiens
caugaaagugagaaacuccugg

SEQ ID NO: 186074 - RNA, 22 nt, Homo sapiens
cauggcucuuguuuacucccag

SEQ ID NO: 186075 - RNA, 22 nt, Homo sapiens
cauggcuuuuauaacaagaaau

SEQ ID NO: 186076 - RNA, 22 nt, Homo sapiens
cauugcauuccagucugggcaa

SEQ ID NO: 186077 - RNA, 22 nt, Homo sapiens
cauuugguggcuacagaguaac

SEQ ID NO: 186078 - RNA, 22 nt, Homo sapiens
ccacagucuaugcaacaagguc

SEQ ID NO: 186079 - RNA, 22 nt, Homo sapiens
ccaccuguacuuaagucacuuu

SEQ ID NO: 186080 - RNA, 22 nt, Homo sapiens
ccaguguucuggaaggcugagu

SEQ ID NO: 186081 - RNA, 22 nt, Homo sapiens
ccaguguuuuugaauuccagga

SEQ ID NO: 186082 - RNA, 19 nt, Homo sapiens
ccauggcaaugaucugaug

SEQ ID NO: 186083 - RNA, 22 nt, Homo sapiens
ccauuucacucuuccugaagga

SEQ ID NO: 186084 - RNA, 22 nt, Homo sapiens
cccagagacagaaugauaaacu

SEQ ID NO: 186085 - RNA, 22 nt, Homo sapiens
cccagaguucuuaaauacugag

SEQ ID NO: 186086 - RNA, 22 nt, Homo sapiens
cccuguagcagcauucuuaaau

SEQ ID NO: 186087 - RNA, 22 nt, Homo sapiens
cccuguguuguucaaggaucug

SEQ ID NO: 186088 - RNA, 22 nt, Homo sapiens
ccuccauuugugucaggaaguc

SEQ ID NO: 186089 - RNA, 22 nt, Homo sapiens
ccuggcacugggccccguggcu

SEQ ID NO: 186090 - RNA, 22 nt, Homo sapiens
ccugucuugauuaaauuacuua

SEQ ID NO: 186091 - RNA, 22 nt, Homo sapiens
ccuguguuaugguuucuaaugu

SEQ ID NO: 186092 - RNA, 22 nt, Homo sapiens
ccuucauucauuaauuuagccc

SEQ ID NO: 186093 - RNA, 22 nt, Homo sapiens
ccuuggcacuuugccacagugc

SEQ ID NO: 186094 - RNA, 22 nt, Homo sapiens
cgccugagcugaggaagcugca

SEQ ID NO: 186095 - RNA, 22 nt, Homo sapiens
cggucacagugauucaaggguc

SEQ ID NO: 186096 - RNA, 22 nt, Homo sapiens
cuacagugggucuguaguccuu

SEQ ID NO: 186097 - RNA, 22 nt, Homo sapiens
cuagcacauaguuauucacuca

SEQ ID NO: 186098 - RNA, 22 nt, Homo sapiens
cuauggcagccacggccuggag

SEQ ID NO: 186099 - RNA, 22 nt, Homo sapiens
cucaaguacaugggauuacagg

SEQ ID NO: 186100 - RNA, 22 nt, Homo sapiens
cucacuggguguaaaacaugua

SEQ ID NO: 186101 - RNA, 22 nt, Homo sapiens
cucagugguugauuuauuuauc

SEQ ID NO: 186102 - RNA, 22 nt, Homo sapiens
cucauugcaaucuccaccuccc

SEQ ID NO: 186103 - RNA, 23 nt, Homo sapiens
cuccaugagccguccagggccug

SEQ ID NO: 186104 - RNA, 22 nt, Homo sapiens
cuccccuuuaguuucuuaauaa

SEQ ID NO: 186105 - RNA, 22 nt, Homo sapiens
cucucaagaugcugggauuaca

SEQ ID NO: 186106 - RNA, 22 nt, Homo sapiens
cucugauggagauauacaagga

SEQ ID NO: 186107 - RNA, 22 nt, Homo sapiens
cucuuuggaugccuuaggguua

SEQ ID NO: 186108 - RNA, 22 nt, Homo sapiens
cugaaagagcauguaacacagu

SEQ ID NO: 186109 - RNA, 22 nt, Homo sapiens
cugaaagagcauuugaaugggu

SEQ ID NO: 186110 - RNA, 20 nt, Homo sapiens
cugaggugggagaaucgcuu

SEQ ID NO: 186111 - RNA, 21 nt, Homo sapiens
cugcauccauuucugagugau

SEQ ID NO: 186112 - RNA, 22 nt, Homo sapiens
cugcauuugaugacguauggug

SEQ ID NO: 186113 - RNA, 22 nt, Homo sapiens
cuggaaggaaaaacaaccacag

SEQ ID NO: 186114 - RNA, 20 nt, Homo sapiens
cuggaugucgaggcagaggu

SEQ ID NO: 186115 - RNA, 22 nt, Homo sapiens
cuggcaagagugaaccagcugu

SEQ ID NO: 186116 - RNA, 22 nt, Homo sapiens
cuggcaccauuuugaucaaagg

SEQ ID NO: 186117 - RNA, 22 nt, Homo sapiens
cugggauggaggagaauuagag

SEQ ID NO: 186118 - RNA, 22 nt, Homo sapiens
cuucuugagggccugcugggaa

SEQ ID NO: 186119 - RNA, 22 nt, Homo sapiens
cuugaucaaugugguacuugau

SEQ ID NO: 186120 - RNA, 20 nt, Homo sapiens
cuugcuccccuuguucuaga

SEQ ID NO: 186121 - RNA, 22 nt, Homo sapiens
cuuggcuagucaaaccuccccg

SEQ ID NO: 186122 - RNA, 22 nt, Homo sapiens
cuuuggucaauugcugcgggga

SEQ ID NO: 186123 - RNA, 22 nt, Homo sapiens
cuuuggugagggauaaauuuca

SEQ ID NO: 186124 - RNA, 22 nt, Homo sapiens
cuuugguguauuuucagagacc

SEQ ID NO: 186125 - RNA, 22 nt, Homo sapiens
cuuuguguggacauuucaggca

SEQ ID NO: 186126 - RNA, 22 nt, Homo sapiens
cuuuuggucuaucagagaagca

SEQ ID NO: 186127 - RNA, 22 nt, Homo sapiens
gaaagugcugcaaggccaugca

SEQ ID NO: 186128 - RNA, 22 nt, Homo sapiens
gaagcgaggugauuagcagaca

SEQ ID NO: 186129 - RNA, 19 nt, Homo sapiens
gaaguguuuguucuccaug

SEQ ID NO: 186130 - RNA, 22 nt, Homo sapiens
gacagugugauacuuagucuca

SEQ ID NO: 186131 - RNA, 18 nt, Homo sapiens
gacaguguggcgauuccu

SEQ ID NO: 186132 - RNA, 22 nt, Homo sapiens
gacuucaucauacuaugugugg

SEQ ID NO: 186133 - RNA, 22 nt, Homo sapiens
gagacauugacuuuguuccaga

SEQ ID NO: 186134 - RNA, 22 nt, Homo sapiens
gagacggagucucgcucugucg

SEQ ID NO: 186135 - RNA, 22 nt, Homo sapiens
gagacggagucuugcucuguug

SEQ ID NO: 186136 - RNA, 22 nt, Homo sapiens
gagacugagucuugcucuguca

SEQ ID NO: 186137 - RNA, 22 nt, Homo sapiens
gagcuuggguuaaaguugccuu

SEQ ID NO: 186138 - RNA, 22 nt, Homo sapiens
gaggcauuauucccaucuuaca

SEQ ID NO: 186139 - RNA, 22 nt, Homo sapiens
gaggugauaucucauugugguu

SEQ ID NO: 186140 - RNA, 22 nt, Homo sapiens
gaguauauuugcacuguuaugu

SEQ ID NO: 186141 - RNA, 22 nt, Homo sapiens
gagugcaaagguccugaggugg

SEQ ID NO: 186142 - RNA, 22 nt, Homo sapiens
gagugcaauggcagaucuccgc

SEQ ID NO: 186143 - RNA, 22 nt, Homo sapiens
gagugcaauggcaugaucuugg

SEQ ID NO: 186144 - RNA, 22 nt, Homo sapiens
gagugcaauggugcuaucucgg

SEQ ID NO: 186145 - RNA, 22 nt, Homo sapiens
gagugcuguuagcccuggguuu

SEQ ID NO: 186146 - RNA, 22 nt, Homo sapiens
gaguucaaaucucagcucuguu

SEQ ID NO: 186147 - RNA, 22 nt, Homo sapiens
gauauguguuuuagucaggguu

SEQ ID NO: 186148 - RNA, 17 nt, Homo sapiens
gaucacagucgucuccu

SEQ ID NO: 186149 - RNA, 22 nt, Homo sapiens
gaucucaguggauacugugaug

SEQ ID NO: 186150 - RNA, 22 nt, Homo sapiens
gaugccuuuuuguccucaguua

SEQ ID NO: 186151 - RNA, 22 nt, Homo sapiens
gauggcagugcagccccuggcu

SEQ ID NO: 186152 - RNA, 22 nt, Homo sapiens
gcaaaguguuuuuaggaagucu

SEQ ID NO: 186153 - RNA, 20 nt, Homo sapiens
gcaguacuuuuaguucuaag

SEQ ID NO: 186154 - RNA, 20 nt, Homo sapiens
gcauaugucuuuauggcagc

SEQ ID NO: 186155 - RNA, 22 nt, Homo sapiens
gccaagauuuaauucaucaguu

SEQ ID NO: 186156 - RNA, 22 nt, Homo sapiens
gcuaugguuuuuagcuccauca

SEQ ID NO: 186157 - RNA, 22 nt, Homo sapiens
gcuggcuuucuccugaucucag

SEQ ID NO: 186158 - RNA, 22 nt, Homo sapiens
gcuggguugccagguuacuuaa

SEQ ID NO: 186159 - RNA, 22 nt, Homo sapiens
gcuggugaaggcugaaaagugg

SEQ ID NO: 186160 - RNA, 22 nt, Homo sapiens
gcuguuugccgccaucgcagac

SEQ ID NO: 186161 - RNA, 22 nt, Homo sapiens
gcuuggugugcaagugguacua

SEQ ID NO: 186162 - RNA, 22 nt, Homo sapiens
gcuuuggauaaaugucaguuua

SEQ ID NO: 186163 - RNA, 22 nt, Homo sapiens
gcuuugguucaaccaggcaauu

SEQ ID NO: 186164 - RNA, 22 nt, Homo sapiens
gcuuuguugauggugagucugu

SEQ ID NO: 186165 - RNA, 22 nt, Homo sapiens
ggacagaaaggguucaccaaac

SEQ ID NO: 186166 - RNA, 21 nt, Homo sapiens
ggauucaucccucaugaauuu

SEQ ID NO: 186167 - RNA, 22 nt, Homo sapiens
ggcaagugucagcagcaacacc

SEQ ID NO: 186168 - RNA, 22 nt, Homo sapiens
ggcacaaugucagcucacugca

SEQ ID NO: 186169 - RNA, 22 nt, Homo sapiens
ggcagguaaggagugggagccu

SEQ ID NO: 186170 - RNA, 22 nt, Homo sapiens
ggcaguguauuacuuaggguuc

SEQ ID NO: 186171 - RNA, 22 nt, Homo sapiens
ggcauugugauccaccagccuu

SEQ ID NO: 186172 - RNA, 22 nt, Homo sapiens
ggcucagugggguccugguucu

SEQ ID NO: 186173 - RNA, 22 nt, Homo sapiens
gggaagguaaucauuacuugau

SEQ ID NO: 186174 - RNA, 23 nt, Homo sapiens
gggcuagaugagagcuuccuggg

SEQ ID NO: 186175 - RNA, 22 nt, Homo sapiens
ggucaguguuaucaccgaagga

SEQ ID NO: 186176 - RNA, 22 nt, Homo sapiens
ggucauagagaauucaccagga

SEQ ID NO: 186177 - RNA, 22 nt, Homo sapiens
ggugacagugguuaaaauuugu

SEQ ID NO: 186178 - RNA, 22 nt, Homo sapiens
ggugacugguuuaucuggcagu

SEQ ID NO: 186179 - RNA, 22 nt, Homo sapiens
guaagagcauguaguggcucua

SEQ ID NO: 186180 - RNA, 22 nt, Homo sapiens
guagaugcauggauuuacuucu

SEQ ID NO: 186181 - RNA, 22 nt, Homo sapiens
guaguggcaugaucuuggcuca

SEQ ID NO: 186182 - RNA, 22 nt, Homo sapiens
guauggcacuauccucucugau

SEQ ID NO: 186183 - RNA, 22 nt, Homo sapiens
gucacagcacuuuuaguaagug

SEQ ID NO: 186184 - RNA, 21 nt, Homo sapiens
gucacuggggcuggauaauuc

SEQ ID NO: 186185 - RNA, 22 nt, Homo sapiens
gucagaugcagauuccaguucu

SEQ ID NO: 186186 - RNA, 22 nt, Homo sapiens
gucagucugucccugccuggcg

SEQ ID NO: 186187 - RNA, 22 nt, Homo sapiens
gucagugcuuuaguucaggaug

SEQ ID NO: 186188 - RNA, 22 nt, Homo sapiens
guccagagaagucauuacuuca

SEQ ID NO: 186189 - RNA, 22 nt, Homo sapiens
gucccugaggaacauccagggc

SEQ ID NO: 186190 - RNA, 22 nt, Homo sapiens
gucucccagccuacaucuuucu

SEQ ID NO: 186191 - RNA, 22 nt, Homo sapiens
gucuggcuccuucuacuacaug

SEQ ID NO: 186192 - RNA, 22 nt, Homo sapiens
gucuggcuuaucucacuuacca

SEQ ID NO: 186193 - RNA, 22 nt, Homo sapiens
gucuuugagauaggguuauuuu

SEQ ID NO: 186194 - RNA, 22 nt, Homo sapiens
gucuuuggaaaaaaugucuguu

SEQ ID NO: 186195 - RNA, 22 nt, Homo sapiens
gugaaaugaaucuggaaauauu

SEQ ID NO: 186196 - RNA, 22 nt, Homo sapiens
gugagaugugacuucugccucu

SEQ ID NO: 186197 - RNA, 22 nt, Homo sapiens
gugagucaugucccaucugauu

SEQ ID NO: 186198 - RNA, 20 nt, Homo sapiens
gugagucauuaguaaccaaa

SEQ ID NO: 186199 - RNA, 21 nt, Homo sapiens
gugcaaacaucauagaaugua

SEQ ID NO: 186200 - RNA, 22 nt, Homo sapiens
gugcaaccaucaccacugacuc

SEQ ID NO: 186201 - RNA, 22 nt, Homo sapiens
gugcacaacgugcaggcuuguu

SEQ ID NO: 186202 - RNA, 23 nt, Homo sapiens
gugcaguggcgagauuucggcuc

SEQ ID NO: 186203 - RNA, 22 nt, Homo sapiens
gugcagugugauccuuccguau

SEQ ID NO: 186204 - RNA, 22 nt, Homo sapiens
gugcaguguuugcauggaauca

SEQ ID NO: 186205 - RNA, 19 nt, Homo sapiens
gugcauaguuauuaaagag

SEQ ID NO: 186206 - RNA, 22 nt, Homo sapiens
gugccacugcacuccggccugg

SEQ ID NO: 186207 - RNA, 22 nt, Homo sapiens
gugcuuauccccauucuggagg

SEQ ID NO: 186208 - RNA, 22 nt, Homo sapiens
guggaggagaaagaagcauuuc

SEQ ID NO: 186209 - RNA, 22 nt, Homo sapiens
guggagucaucacucagagugg

SEQ ID NO: 186210 - RNA, 22 nt, Homo sapiens
guggcaagaugacuacucacug

SEQ ID NO: 186211 - RNA, 22 nt, Homo sapiens
guggcaugaaagcaucugugau

SEQ ID NO: 186212 - RNA, 22 nt, Homo sapiens
gugguuuuuagauuucuacagu

SEQ ID NO: 186213 - RNA, 22 nt, Homo sapiens
guguaaguccugaguuuggaua

SEQ ID NO: 186214 - RNA, 22 nt, Homo sapiens
gugugcaauuuugugggaggca

SEQ ID NO: 186215 - RNA, 22 nt, Homo sapiens
guucaucaggaauauuggccua

SEQ ID NO: 186216 - RNA, 22 nt, Homo sapiens
guucaucagggauacuggccug

SEQ ID NO: 186217 - RNA, 20 nt, Homo sapiens
guucccuguaggugugcgga

SEQ ID NO: 186218 - RNA, 22 nt, Homo sapiens
guugcucaggcugaagugcagu

SEQ ID NO: 186219 - RNA, 22 nt, Homo sapiens
uaaagccagugauuaugucucu

SEQ ID NO: 186220 - RNA, 22 nt, Homo sapiens
uaaagugaggauggcaguaggu

SEQ ID NO: 186221 - RNA, 22 nt, Homo sapiens
uaacaagagagucagucagucc

SEQ ID NO: 186222 - RNA, 22 nt, Homo sapiens
uaacaguguauuccuuuggaca

SEQ ID NO: 186223 - RNA, 22 nt, Homo sapiens
aaguggcauugaggaaaaaaau

SEQ ID NO: 186224 - RNA, 22 nt, Homo sapiens
aaugacagccagauucuucucu

SEQ ID NO: 186225 - RNA, 22 nt, Homo sapiens
aauuacauggcaauugggaaau

SEQ ID NO: 186226 - RNA, 22 nt, Homo sapiens
aauugcauugaauuuguagcuu

SEQ ID NO: 186227 - RNA, 22 nt, Homo sapiens
aauugguuaagauaagaucaua

SEQ ID NO: 186228 - RNA, 22 nt, Homo sapiens
acacuauugagguuuguuugca

SEQ ID NO: 186229 - RNA, 22 nt, Homo sapiens
acacuguccaguuaggcuacau

SEQ ID NO: 186230 - RNA, 22 nt, Homo sapiens
acacuguuuuguggagaaugua

SEQ ID NO: 186231 - RNA, 22 nt, Homo sapiens
acagugcugucugcuuuggcua

SEQ ID NO: 186232 - RNA, 22 nt, Homo sapiens
acagugcuucugauaugaugcc

SEQ ID NO: 186233 - RNA, 22 nt, Homo sapiens
acaguggugcgaucucggcuca

SEQ ID NO: 186234 - RNA, 23 nt, Homo sapiens
acaguggugugaucuuggcucag

SEQ ID NO: 186235 - RNA, 18 nt, Homo sapiens
acagugucauggcucaau

SEQ ID NO: 186236 - RNA, 22 nt, Homo sapiens
acaucauugggggcuacaggug

SEQ ID NO: 186237 - RNA, 23 nt, Homo sapiens
acauguauagacuuuuuuuccuu

SEQ ID NO: 186238 - RNA, 22 nt, Homo sapiens
accauugcacuccagccugggc

SEQ ID NO: 186239 - RNA, 22 nt, Homo sapiens
acccaguagucauucaggagca

SEQ ID NO: 186240 - RNA, 22 nt, Homo sapiens
accgggcugagcgcaggccccg

SEQ ID NO: 186241 - RNA, 22 nt, Homo sapiens
acucugucuaguuguaaaauuu

SEQ ID NO: 186242 - RNA, 22 nt, Homo sapiens
acugcacuccagccuccugaca

SEQ ID NO: 186243 - RNA, 22 nt, Homo sapiens
acugcacuccagccuuggcaac

SEQ ID NO: 186244 - RNA, 22 nt, Homo sapiens
acugcacuccaguuugggcagc

SEQ ID NO: 186245 - RNA, 22 nt, Homo sapiens
acugcacugcagccuggccaac

SEQ ID NO: 186246 - RNA, 20 nt, Homo sapiens
acugggcuaccgaaguaagg

SEQ ID NO: 186247 - RNA, 22 nt, Homo sapiens
acuuugguuuauagaauuuagg

SEQ ID NO: 186248 - RNA, 22 nt, Homo sapiens
agagaacugauucagggaaaau

SEQ ID NO: 186249 - RNA, 19 nt, Homo sapiens
agagacucauuguagcauu

SEQ ID NO: 186250 - RNA, 22 nt, Homo sapiens
agagcuaguauuuacggagcau

SEQ ID NO: 186251 - RNA, 22 nt, Homo sapiens
agagugcaaagguuggggcugg

SEQ ID NO: 186252 - RNA, 22 nt, Homo sapiens
agauauguuauugauguuaaug

SEQ ID NO: 186253 - RNA, 22 nt, Homo sapiens
agaugguauuauagguuucugu

SEQ ID NO: 186254 - RNA, 22 nt, Homo sapiens
agcacagccuuguguuuucuug

SEQ ID NO: 186255 - RNA, 22 nt, Homo sapiens
agcaccaugggcugaguaagug

SEQ ID NO: 186256 - RNA, 22 nt, Homo sapiens
agcaguacauaaaaagcauccu

SEQ ID NO: 186257 - RNA, 20 nt, Homo sapiens
agcauugguuagaacaguag

SEQ ID NO: 186258 - RNA, 16 nt, Homo sapiens
agccaccauuuacuug

SEQ ID NO: 186259 - RNA, 23 nt, Homo sapiens
agccugguuucccugcuucuccc

SEQ ID NO: 186260 - RNA, 22 nt, Homo sapiens
agcuccuacuguuacaucauug

SEQ ID NO: 186261 - RNA, 22 nt, Homo sapiens
agcugauuuuaaguccuugucc

SEQ ID NO: 186262 - RNA, 22 nt, Homo sapiens
aggaagugugcaauuaauuucu

SEQ ID NO: 186263 - RNA, 22 nt, Homo sapiens
aggcuagaaucuuccaucuugg

SEQ ID NO: 186264 - RNA, 22 nt, Homo sapiens
agguauuuuuuauccuccagca

SEQ ID NO: 186265 - RNA, 22 nt, Homo sapiens
agguccauuauuuucauucaug

SEQ ID NO: 186266 - RNA, 22 nt, Homo sapiens
aggugcacucagaaaacagaua

SEQ ID NO: 186267 - RNA, 22 nt, Homo sapiens
agucaacaucaugaaguggaaa

SEQ ID NO: 186268 - RNA, 22 nt, Homo sapiens
agucacagugaccuugucugac

SEQ ID NO: 186269 - RNA, 22 nt, Homo sapiens
agucagugucuguaaggagaac

SEQ ID NO: 186270 - RNA, 22 nt, Homo sapiens
aguccaguguuaugaucaguag

SEQ ID NO: 186271 - RNA, 23 nt, Homo sapiens
agucuguguuuacaggcucucug

SEQ ID NO: 186272 - RNA, 19 nt, Homo sapiens
agugagccaagauccuacc

SEQ ID NO: 186273 - RNA, 22 nt, Homo sapiens
agugccaaaucgagggcucuga

SEQ ID NO: 186274 - RNA, 22 nt, Homo sapiens
aguggugucugaguggccaggg

SEQ ID NO: 186275 - RNA, 22 nt, Homo sapiens
aguugcaagucuugaguaaaga

SEQ ID NO: 186276 - RNA, 19 nt, Homo sapiens
auaaacuagaacugucccc

SEQ ID NO: 186277 - RNA, 22 nt, Homo sapiens
auaacaggaaauacagggcuuu

SEQ ID NO: 186278 - RNA, 22 nt, Homo sapiens
auagcaaugcaagaauggcuua

SEQ ID NO: 186279 - RNA, 22 nt, Homo sapiens
auauagcaaugaaagagaugaa

SEQ ID NO: 186280 - RNA, 21 nt, Homo sapiens
auaugugcuguggaagucagc

SEQ ID NO: 186281 - RNA, 22 nt, Homo sapiens
auauguucucauucauaugugg

SEQ ID NO: 186282 - RNA, 22 nt, Homo sapiens
auauuacuggcuauaucgcaag

SEQ ID NO: 186283 - RNA, 22 nt, Homo sapiens
aucaaauugucauuuuaaggau

SEQ ID NO: 186284 - RNA, 22 nt, Homo sapiens
aucaaguaaucugaguaagagu

SEQ ID NO: 186285 - RNA, 22 nt, Homo sapiens
aucacagaacuuugagcagaga

SEQ ID NO: 186286 - RNA, 22 nt, Homo sapiens
aucacuggucaugagagaagua

SEQ ID NO: 186287 - RNA, 22 nt, Homo sapiens
aucacuguaaguuuacacuuug

SEQ ID NO: 186288 - RNA, 22 nt, Homo sapiens
aucagagugaauaaugacaaaa

SEQ ID NO: 186289 - RNA, 22 nt, Homo sapiens
aucagauaccuguugggaaaug

SEQ ID NO: 186290 - RNA, 22 nt, Homo sapiens
aucauauccuagauauaacuuc

SEQ ID NO: 186291 - RNA, 22 nt, Homo sapiens
aucgcaccauugcacuccagca

SEQ ID NO: 186292 - RNA, 22 nt, Homo sapiens
aucucugagauguucugauuuu

SEQ ID NO: 186293 - RNA, 22 nt, Homo sapiens
aucucuugccagucagaauggu

SEQ ID NO: 186294 - RNA, 22 nt, Homo sapiens
aucuggcuccuuuugacaaugc

SEQ ID NO: 186295 - RNA, 22 nt, Homo sapiens
aucuguguuuaaggucccagaa

SEQ ID NO: 186296 - RNA, 22 nt, Homo sapiens
augagauauguuaaaaguuaaa

SEQ ID NO: 186297 - RNA, 21 nt, Homo sapiens
auggaaagacugccucuucaa

SEQ ID NO: 186298 - RNA, 18 nt, Homo sapiens
auggcagaacaauuuaca

SEQ ID NO: 186299 - RNA, 22 nt, Homo sapiens
auggcagagucagaaagucagg

SEQ ID NO: 186300 - RNA, 22 nt, Homo sapiens
auggccugaugcaccuguccca

SEQ ID NO: 186301 - RNA, 22 nt, Homo sapiens
auggcucaauucuuucccugaa

SEQ ID NO: 186302 - RNA, 22 nt, Homo sapiens
auggcuuaagacaaccuuucau

SEQ ID NO: 186303 - RNA, 22 nt, Homo sapiens
auggcuuuaagagugucugaau

SEQ ID NO: 186304 - RNA, 22 nt, Homo sapiens
augggcacugauguauucugug

SEQ ID NO: 186305 - RNA, 22 nt, Homo sapiens
augguauuuaacagucuuucua

SEQ ID NO: 186306 - RNA, 22 nt, Homo sapiens
auguaguugcucugccuguuuu

SEQ ID NO: 186307 - RNA, 22 nt, Homo sapiens
augugacagugguuuuaagcgu

SEQ ID NO: 186308 - RNA, 22 nt, Homo sapiens
auguggcuuuccuagaucuuag

SEQ ID NO: 186309 - RNA, 22 nt, Homo sapiens
aagucauggagaagguggaggu

SEQ ID NO: 186310 - RNA, 22 nt, Homo sapiens
aagugcugggauuggccgggca

SEQ ID NO: 186311 - RNA, 22 nt, Homo sapiens
aagugcuuuguacagggguuga

SEQ ID NO: 186312 - RNA, 22 nt, Homo sapiens
cacaguguuacugguaugaagu

SEQ ID NO: 186313 - RNA, 22 nt, Homo sapiens
caccacauuccauugaucaggc

SEQ ID NO: 186314 - RNA, 22 nt, Homo sapiens
caccgagguuggagugcagugg

SEQ ID NO: 186315 - RNA, 22 nt, Homo sapiens
cagagaucaugcaacugcucgc

SEQ ID NO: 186316 - RNA, 22 nt, Homo sapiens
cagcugguggcaagaagacaga

SEQ ID NO: 186317 - RNA, 22 nt, Homo sapiens
caggaaugugaggguucccugc

SEQ ID NO: 186318 - RNA, 22 nt, Homo sapiens
cagugcaaagccucugcccaga

SEQ ID NO: 186319 - RNA, 20 nt, Homo sapiens
cagugcacuuucccacuggu

SEQ ID NO: 186320 - RNA, 22 nt, Homo sapiens
cagugcuuguuauuguucuauu

SEQ ID NO: 186321 - RNA, 22 nt, Homo sapiens
cagugcuuuaucaaguccucca

SEQ ID NO: 186322 - RNA, 22 nt, Homo sapiens
cauaaagauggaggaggccagg

SEQ ID NO: 186323 - RNA, 23 nt, Homo sapiens
caugaacuaguuugcagccauga

SEQ ID NO: 186324 - RNA, 22 nt, Homo sapiens
cauugcacuccagcccuggcaa

SEQ ID NO: 186325 - RNA, 22 nt, Homo sapiens
cauugcacuccagccugaggga

SEQ ID NO: 186326 - RNA, 20 nt, Homo sapiens
cauugcccuccagccugggc

SEQ ID NO: 186327 - RNA, 22 nt, Homo sapiens
ccauggcaauggucagucuauu

SEQ ID NO: 186328 - RNA, 19 nt, Homo sapiens
ccccuguggauaccgaggg

SEQ ID NO: 186329 - RNA, 19 nt, Homo sapiens
ccucaaguacuaauauguu

SEQ ID NO: 186330 - RNA, 22 nt, Homo sapiens
ccucauggagaaccucugcuag

SEQ ID NO: 186331 - RNA, 22 nt, Homo sapiens
ccuggcacugagcaguguucua

SEQ ID NO: 186332 - RNA, 22 nt, Homo sapiens
cuacacaugcaggcucccugcc

SEQ ID NO: 186333 - RNA, 22 nt, Homo sapiens
cuacugcacaucaucugaguua

SEQ ID NO: 186334 - RNA, 22 nt, Homo sapiens
cuagaagcauauucagaacaga

SEQ ID NO: 186335 - RNA, 20 nt, Homo sapiens
cucagguauuugaggcugca

SEQ ID NO: 186336 - RNA, 22 nt, Homo sapiens
cucaguggauuagauaaugcac

SEQ ID NO: 186337 - RNA, 22 nt, Homo sapiens
cucuuugaugugaaccgugguu

SEQ ID NO: 186338 - RNA, 19 nt, Homo sapiens
cucuuuggugucucuucuu

SEQ ID NO: 186339 - RNA, 22 nt, Homo sapiens
cugaccucugucaaagacaccc

SEQ ID NO: 186340 - RNA, 22 nt, Homo sapiens
cugagaaugaugauuuccaguu

SEQ ID NO: 186341 - RNA, 22 nt, Homo sapiens
cugagcaaagaagugauaauga

SEQ ID NO: 186342 - RNA, 22 nt, Homo sapiens
cugagcccauucuggggagaag

SEQ ID NO: 186343 - RNA, 22 nt, Homo sapiens
cugaggugggaggauuacuuga

SEQ ID NO: 186344 - RNA, 22 nt, Homo sapiens
cugaggugggaggauuggcuug

SEQ ID NO: 186345 - RNA, 22 nt, Homo sapiens
cugauaguucucuuuagaguuu

SEQ ID NO: 186346 - RNA, 22 nt, Homo sapiens
cugcuggucuuuaaggucuagg

SEQ ID NO: 186347 - RNA, 22 nt, Homo sapiens
cuggaaacaucuuaggaaugca

SEQ ID NO: 186348 - RNA, 22 nt, Homo sapiens
cuggacaaaucuggaaagaacc

SEQ ID NO: 186349 - RNA, 22 nt, Homo sapiens
cuggcacagugucagaaacaca

SEQ ID NO: 186350 - RNA, 22 nt, Homo sapiens
cuggccagagacauucauuaaa

SEQ ID NO: 186351 - RNA, 22 nt, Homo sapiens
cugggaugauguaaauaggcua

SEQ ID NO: 186352 - RNA, 22 nt, Homo sapiens
cugggaugugacuguugccccc

SEQ ID NO: 186353 - RNA, 22 nt, Homo sapiens
cuucacuggagucccuggauuc

SEQ ID NO: 186354 - RNA, 22 nt, Homo sapiens
cuugaauguaaauaauguacag

SEQ ID NO: 186355 - RNA, 21 nt, Homo sapiens
cuugucuugcuuagaauagac

SEQ ID NO: 186356 - RNA, 22 nt, Homo sapiens
cuuguucuccuaagaugaaugc

SEQ ID NO: 186357 - RNA, 22 nt, Homo sapiens
cuuuggucaaaauaaguaaguu

SEQ ID NO: 186358 - RNA, 22 nt, Homo sapiens
cuuuggucaauugcugugggga

SEQ ID NO: 186359 - RNA, 18 nt, Homo sapiens
cuuugguccccgcacccu

SEQ ID NO: 186360 - RNA, 22 nt, Homo sapiens
cuuugguucuguuuauaugcug

SEQ ID NO: 186361 - RNA, 19 nt, Homo sapiens
cuuugguugagcguguugg

SEQ ID NO: 186362 - RNA, 22 nt, Homo sapiens
cuuugguuuacuuggugcuagu

SEQ ID NO: 186363 - RNA, 22 nt, Homo sapiens
cuuuuggugugaagaagcucuu

SEQ ID NO: 186364 - RNA, 22 nt, Homo sapiens
gaaauggaucagagcaagcuuu

SEQ ID NO: 186365 - RNA, 22 nt, Homo sapiens
gaacuggcuuagugaaacuucc

SEQ ID NO: 186366 - RNA, 22 nt, Homo sapiens
gaagaaguacaagacaaauuuu

SEQ ID NO: 186367 - RNA, 22 nt, Homo sapiens
gaauacuguccaagagugaugg

SEQ ID NO: 186368 - RNA, 22 nt, Homo sapiens
gaauguuuacuuuguuuaauac

SEQ ID NO: 186369 - RNA, 22 nt, Homo sapiens
gacacagugaagucucuacuug

SEQ ID NO: 186370 - RNA, 22 nt, Homo sapiens
gacaguguggcgauuccucaag

SEQ ID NO: 186371 - RNA, 19 nt, Homo sapiens
gacuccagaguugugugcu

SEQ ID NO: 186372 - RNA, 22 nt, Homo sapiens
gacuggcuguuuucuuuauuau

SEQ ID NO: 186373 - RNA, 22 nt, Homo sapiens
gagacggagucacgcccuguca

SEQ ID NO: 186374 - RNA, 22 nt, Homo sapiens
gagauaaauaggucacaguucu

SEQ ID NO: 186375 - RNA, 22 nt, Homo sapiens
gagauacacccagugcagaggc

SEQ ID NO: 186376 - RNA, 22 nt, Homo sapiens
gagauucuucaauauuuauucu

SEQ ID NO: 186377 - RNA, 22 nt, Homo sapiens
gagcuccuccccuuggcuuuca

SEQ ID NO: 186378 - RNA, 22 nt, Homo sapiens
gagcugguccuuuaaggaugca

SEQ ID NO: 186379 - RNA, 22 nt, Homo sapiens
gaggaaguagcuacugucuuuc

SEQ ID NO: 186380 - RNA, 22 nt, Homo sapiens
gaggcauugaaauauugcuuau

SEQ ID NO: 186381 - RNA, 22 nt, Homo sapiens
gaggcuagauggggaugugucc

SEQ ID NO: 186382 - RNA, 21 nt, Homo sapiens
gagguagggauuaaagaccuc

SEQ ID NO: 186383 - RNA, 22 nt, Homo sapiens
gagguggugguggaggcauagc

SEQ ID NO: 186384 - RNA, 21 nt, Homo sapiens
gagugcaaauaaagagagggc

SEQ ID NO: 186385 - RNA, 22 nt, Homo sapiens
gagugcaagguuuuucugagug

SEQ ID NO: 186386 - RNA, 22 nt, Homo sapiens
gagugcaauggcaagaucuugg

SEQ ID NO: 186387 - RNA, 22 nt, Homo sapiens
gagugcaauggcaugaucuggg

SEQ ID NO: 186388 - RNA, 22 nt, Homo sapiens
gagugcaauggcgcgaucucgg

SEQ ID NO: 186389 - RNA, 22 nt, Homo sapiens
gagugcaauggugccaucucgg

SEQ ID NO: 186390 - RNA, 22 nt, Homo sapiens
gauaaagauagcaauagggaca

SEQ ID NO: 186391 - RNA, 22 nt, Homo sapiens
gauaugugauaagaguuaucuu

SEQ ID NO: 186392 - RNA, 22 nt, Homo sapiens
gaugacagcugacucccuugcu

SEQ ID NO: 186393 - RNA, 22 nt, Homo sapiens
gauuccauuuguggcuauuuac

SEQ ID NO: 186394 - RNA, 22 nt, Homo sapiens
gauuuguuggccugugagcuag

SEQ ID NO: 186395 - RNA, 22 nt, Homo sapiens
gcaagaauggaacaggagagcc

SEQ ID NO: 186396 - RNA, 22 nt, Homo sapiens
gcaaugcugucugugcacagau

SEQ ID NO: 186397 - RNA, 22 nt, Homo sapiens
gcacauuacaaguauuagcuca

SEQ ID NO: 186398 - RNA, 22 nt, Homo sapiens
gcagguaguuucugacuuuuac

SEQ ID NO: 186399 - RNA, 22 nt, Homo sapiens
gcagugcaugacgguauauaua

SEQ ID NO: 186400 - RNA, 22 nt, Homo sapiens
gcauaaagcuaauaagacgaag

SEQ ID NO: 186401 - RNA, 22 nt, Homo sapiens
gcauugcacuuggcauagacug

SEQ ID NO: 186402 - RNA, 22 nt, Homo sapiens
gccauugcacucuagccugagc

SEQ ID NO: 186403 - RNA, 22 nt, Homo sapiens
gccuagagacuugguaucuugc

SEQ ID NO: 186404 - RNA, 22 nt, Homo sapiens
gcuggauguuucaauacaaaua

SEQ ID NO: 186405 - RNA, 22 nt, Homo sapiens
gcuguguucucgaggcggggga

SEQ ID NO: 186406 - RNA, 22 nt, Homo sapiens
ggaaaguaacccauucucuuac

SEQ ID NO: 186407 - RNA, 22 nt, Homo sapiens
ggaagacaguguggugauuccu

SEQ ID NO: 186408 - RNA, 20 nt, Homo sapiens
ggaagagugacacaagguau

SEQ ID NO: 186409 - RNA, 22 nt, Homo sapiens
ggaagugcuguguggaagucug

SEQ ID NO: 186410 - RNA, 22 nt, Homo sapiens
ggacauguauauauaugugugu

SEQ ID NO: 186411 - RNA, 22 nt, Homo sapiens
ggagucuugcuauguugccaag

SEQ ID NO: 186412 - RNA, 21 nt, Homo sapiens
ggcaagagaauacaacauaaa

SEQ ID NO: 186413 - RNA, 22 nt, Homo sapiens
ggcaaggauuagauucuccccu

SEQ ID NO: 186414 - RNA, 21 nt, Homo sapiens
ggcaagugugagguuuggggu

SEQ ID NO: 186415 - RNA, 22 nt, Homo sapiens
ggcaguggaagugccaguuucu

SEQ ID NO: 186416 - RNA, 22 nt, Homo sapiens
ggcaugcauuguacuaguaugc

SEQ ID NO: 186417 - RNA, 22 nt, Homo sapiens
ggcucagugaucuguuucugua

SEQ ID NO: 186418 - RNA, 22 nt, Homo sapiens
ggcucaguuuccuccgucugcu

SEQ ID NO: 186419 - RNA, 19 nt, Homo sapiens
ggucacagggguuacaagg

SEQ ID NO: 186420 - RNA, 22 nt, Homo sapiens
ggucagugcauucuaaaggcaa

SEQ ID NO: 186421 - RNA, 22 nt, Homo sapiens
ggugucaguuggccccuacugg

SEQ ID NO: 186422 - RNA, 22 nt, Homo sapiens
guaccugauacaggcgcacggu

SEQ ID NO: 186423 - RNA, 22 nt, Homo sapiens
guauacacccugugauauuauu

SEQ ID NO: 186424 - RNA, 22 nt, Homo sapiens
gucaagagaacuuucuaucacu

SEQ ID NO: 186425 - RNA, 22 nt, Homo sapiens
gucacagaaaaagauaugccaa

SEQ ID NO: 186426 - RNA, 22 nt, Homo sapiens
gucacaguggccagugauguuc

SEQ ID NO: 186427 - RNA, 22 nt, Homo sapiens
gucagugccugucccaggcuuu

SEQ ID NO: 186428 - RNA, 22 nt, Homo sapiens
gucaguggauacugucucuguc

SEQ ID NO: 186429 - RNA, 22 nt, Homo sapiens
gucauuguguggacauggagaa

SEQ ID NO: 186430 - RNA, 22 nt, Homo sapiens
gucccugcgauugugggauccu

SEQ ID NO: 186431 - RNA, 22 nt, Homo sapiens
gucucauugcaguuagaccugu

SEQ ID NO: 186432 - RNA, 22 nt, Homo sapiens
gucucugagaugucaacaccua

SEQ ID NO: 186433 - RNA, 22 nt, Homo sapiens
gucucugguugcuuuuguacca

SEQ ID NO: 186434 - RNA, 22 nt, Homo sapiens
gucuggagacuugggucaucaa

SEQ ID NO: 186435 - RNA, 22 nt, Homo sapiens
gucuggcaauggcagacuggca

SEQ ID NO: 186436 - RNA, 22 nt, Homo sapiens
gucuggcuccugucuaaucacu

SEQ ID NO: 186437 - RNA, 22 nt, Homo sapiens
gucuuuaguugaaacauguggu

SEQ ID NO: 186438 - RNA, 22 nt, Homo sapiens
gucuuuugcuagccagagagcu

SEQ ID NO: 186439 - RNA, 22 nt, Homo sapiens
gugcaaugaguguggcaaagcc

SEQ ID NO: 186440 - RNA, 22 nt, Homo sapiens
gugcaguuuugagugaguuucu

SEQ ID NO: 186441 - RNA, 22 nt, Homo sapiens
gugcauguccacuaguccauau

SEQ ID NO: 186442 - RNA, 22 nt, Homo sapiens
guggaggacuggauaaagaaaa

SEQ ID NO: 186443 - RNA, 22 nt, Homo sapiens
guggaguaugaaaacugacuuu

SEQ ID NO: 186444 - RNA, 23 nt, Homo sapiens
guggccuuuggccaguccgaguc

SEQ ID NO: 186445 - RNA, 22 nt, Homo sapiens
gugguuuucaacuccaccugca

SEQ ID NO: 186446 - RNA, 22 nt, Homo sapiens
guguagagaaaaguaccauuuu

SEQ ID NO: 186447 - RNA, 18 nt, Homo sapiens
guguauggauggaggcca

SEQ ID NO: 186448 - RNA, 22 nt, Homo sapiens
guuaaagacauccacauaggag

SEQ ID NO: 186449 - RNA, 22 nt, Homo sapiens
guucacaguuaggacaacugcu

SEQ ID NO: 186450 - RNA, 22 nt, Homo sapiens
guucaucagggauacuggcuua

SEQ ID NO: 186451 - RNA, 22 nt, Homo sapiens
guucaucagggauauuggccug

SEQ ID NO: 186452 - RNA, 22 nt, Homo sapiens
guucaucagggauauuggcuua

SEQ ID NO: 186453 - RNA, 22 nt, Homo sapiens
guugcacagucuuuccuggacu

SEQ ID NO: 186454 - RNA, 22 nt, Homo sapiens
guugcucaggccggagugcagu

SEQ ID NO: 186455 - RNA, 22 nt, Homo sapiens
guuuugguuauauggaucaguu

SEQ ID NO: 186456 - RNA, 22 nt, Homo sapiens
uaaaagucaucacaacuggagu

SEQ ID NO: 186457 - RNA, 22 nt, Homo sapiens
uaaaccacguuuacauuugaga

SEQ ID NO: 186458 - RNA, 22 nt, Homo sapiens
uaaagcugaaaugauuaugaca

SEQ ID NO: 186459 - RNA, 22 nt, Homo sapiens
uaagacacuuaaaauguuacau

SEQ ID NO: 186460 - RNA, 22 nt, Homo sapiens
uaagagagcuccaucuuuuccu

SEQ ID NO: 186461 - RNA, 22 nt, Homo sapiens
uaaguucauucaugaaacuuag

SEQ ID NO: 186462 - RNA, 22 nt, Homo sapiens
uaauauguauacagacagauac

SEQ ID NO: 186463 - RNA, 22 nt, Homo sapiens
uaaugcuguggucugguuuaaa

SEQ ID NO: 186464 - RNA, 22 nt, Homo sapiens
uacugcaucgaaaugcuuuuau

SEQ ID NO: 186465 - RNA, 22 nt, Homo sapiens
uagcacagugucauucuaggua

SEQ ID NO: 186466 - RNA, 22 nt, Homo sapiens
uagcagugugaaaacggacuaa

SEQ ID NO: 186467 - RNA, 22 nt, Homo sapiens
uaggugauugaagguggaaugu

SEQ ID NO: 186468 - RNA, 19 nt, Homo sapiens
uaggugguuuuccccucac

SEQ ID NO: 186469 - RNA, 22 nt, Homo sapiens
uaguaaacauuuuucuaucauu

SEQ ID NO: 186470 - RNA, 22 nt, Homo sapiens
uagugcugagauugagaagccc

SEQ ID NO: 186471 - RNA, 22 nt, Homo sapiens
uauagcuuaaaguuuagauccu

SEQ ID NO: 186472 - RNA, 22 nt, Homo sapiens
uaucacagcauugucuauaaua

SEQ ID NO: 186473 - RNA, 22 nt, Homo sapiens
uaucacagguggacugcacacc

SEQ ID NO: 186474 - RNA, 22 nt, Homo sapiens
uaucacaguagaacucuuucca

SEQ ID NO: 186475 - RNA, 22 nt, Homo sapiens
uaucagagcugucagccuaccu

SEQ ID NO: 186476 - RNA, 22 nt, Homo sapiens
uaucagaguuacacugaagacu

SEQ ID NO: 186477 - RNA, 23 nt, Homo sapiens
uaugccuguuucaaacaaacuuu

SEQ ID NO: 186478 - RNA, 18 nt, Homo sapiens
uauuaagcuagauauuau

SEQ ID NO: 186479 - RNA, 22 nt, Homo sapiens
uauuugguagcuauuuugcagu

SEQ ID NO: 186480 - RNA, 20 nt, Homo sapiens
ucaaagacauggcugucaga

SEQ ID NO: 186481 - RNA, 22 nt, Homo sapiens
ucaaugcaaccuccaccucugg

SEQ ID NO: 186482 - RNA, 22 nt, Homo sapiens
ucaaugcaugugacaaagagua

SEQ ID NO: 186483 - RNA, 22 nt, Homo sapiens
ucacaauggcugaacuaauuua

SEQ ID NO: 186484 - RNA, 21 nt, Homo sapiens
ucacagccuaggaccugaaga

SEQ ID NO: 186485 - RNA, 17 nt, Homo sapiens
ucacaguguuaggauga

SEQ ID NO: 186486 - RNA, 22 nt, Homo sapiens
ucacaugugcguuuuggcaugu

SEQ ID NO: 186487 - RNA, 22 nt, Homo sapiens
ucacauuguuauguaaauguuu

SEQ ID NO: 186488 - RNA, 23 nt, Homo sapiens
uggccaagauaaucucaguuuuc

SEQ ID NO: 186489 - RNA, 22 nt, Homo sapiens
uggccagugucuauugguuucc

SEQ ID NO: 186490 - RNA, 22 nt, Homo sapiens
uggcgggaaaguugggagaaga

SEQ ID NO: 186491 - RNA, 22 nt, Homo sapiens
ugggaaauguagccuagcugug

SEQ ID NO: 186492 - RNA, 22 nt, Homo sapiens
ugggagugugcacaauuucagc

SEQ ID NO: 186493 - RNA, 22 nt, Homo sapiens
ugggaucaugagcaccgcuucc

SEQ ID NO: 186494 - RNA, 22 nt, Homo sapiens
ugggaugugagucuucgcuuuc

SEQ ID NO: 186495 - RNA, 22 nt, Homo sapiens
uggguaguguaaagcacuccag

SEQ ID NO: 186496 - RNA, 22 nt, Homo sapiens
ugguauuuaauauaugagaguu

SEQ ID NO: 186497 - RNA, 22 nt, Homo sapiens
ugguccuuuccauuggagacac

SEQ ID NO: 186498 - RNA, 22 nt, Homo sapiens
uguagucauuuggaguccagcu

SEQ ID NO: 186499 - RNA, 22 nt, Homo sapiens
ugucacagagauuuugguaugu

SEQ ID NO: 186500 - RNA, 22 nt, Homo sapiens
ugucacaguuuguacuuuauag

SEQ ID NO: 186501 - RNA, 22 nt, Homo sapiens
ugucauauagaauguucuauga

SEQ ID NO: 186502 - RNA, 22 nt, Homo sapiens
ugucauguggcuaacgauucau

SEQ ID NO: 186503 - RNA, 22 nt, Homo sapiens
uguccugcagagguguuugccu

SEQ ID NO: 186504 - RNA, 22 nt, Homo sapiens
ugucuuuguuaguuguccuagu

SEQ ID NO: 186505 - RNA, 22 nt, Homo sapiens
ugugaacaaaauuuguugcaua

SEQ ID NO: 186506 - RNA, 22 nt, Homo sapiens
ugugacagcacagcaucucuuu

SEQ ID NO: 186507 - RNA, 22 nt, Homo sapiens
ugugacagcacgguucaacugc

SEQ ID NO: 186508 - RNA, 22 nt, Homo sapiens
ugugacagguagguaauuuuug

SEQ ID NO: 186509 - RNA, 22 nt, Homo sapiens
ugugacaguguuacauuucaug

SEQ ID NO: 186510 - RNA, 22 nt, Homo sapiens
ugugcaaaaguaauugcgguuu

SEQ ID NO: 186511 - RNA, 22 nt, Homo sapiens
ugugccacugcacucugggcaa

SEQ ID NO: 186512 - RNA, 22 nt, Homo sapiens
ugugcucaucucagucaacugu

SEQ ID NO: 186513 - RNA, 22 nt, Homo sapiens
uguggaaauaaaagaaagguua

SEQ ID NO: 186514 - RNA, 22 nt, Homo sapiens
uguggcuuuuucuuggcugagg

SEQ ID NO: 186515 - RNA, 22 nt, Homo sapiens
uguguagagaaauauuacuuau

SEQ ID NO: 186516 - RNA, 22 nt, Homo sapiens
ugugucuccugaaaauucacau

SEQ ID NO: 186517 - RNA, 22 nt, Homo sapiens
ugugucuugagagucucgagaa

SEQ ID NO: 186518 - RNA, 20 nt, Homo sapiens
uguugcacucuagccugggu

SEQ ID NO: 186519 - RNA, 22 nt, Homo sapiens
uuaacagucacuuagcucauuu

SEQ ID NO: 186520 - RNA, 22 nt, Homo sapiens
uuaacagugucaaucuguagua

SEQ ID NO: 186521 - RNA, 22 nt, Homo sapiens
uuaagaagugauuuuccucauu

SEQ ID NO: 186522 - RNA, 22 nt, Homo sapiens
uuacaggacuaagcagcuuugc

SEQ ID NO: 186523 - RNA, 22 nt, Homo sapiens
uuagcaauagccugcaucugca

SEQ ID NO: 186524 - RNA, 22 nt, Homo sapiens
uuagcacaguucauucauguua

SEQ ID NO: 186525 - RNA, 20 nt, Homo sapiens
uuauagcuacaucuugacug

SEQ ID NO: 186526 - RNA, 22 nt, Homo sapiens
uuaugacauugacaguuuuuag

SEQ ID NO: 186527 - RNA, 22 nt, Homo sapiens
uuauggauuuauauucuguagu

SEQ ID NO: 186528 - RNA, 22 nt, Homo sapiens
uuauggcaaugccccacuccua

SEQ ID NO: 186529 - RNA, 22 nt, Homo sapiens
uuauguguuuaauguuucugaa

SEQ ID NO: 186530 - RNA, 22 nt, Homo sapiens
uucaagucaaggaaagaggucu

SEQ ID NO: 186531 - RNA, 22 nt, Homo sapiens
uucacagaguuauuuuuaugcu

SEQ ID NO: 186532 - RNA, 22 nt, Homo sapiens
uucaccuguagcaugcccuugg

SEQ ID NO: 186533 - RNA, 22 nt, Homo sapiens
uucaguggacuuaguagugcuu

SEQ ID NO: 186534 - RNA, 22 nt, Homo sapiens
uucauagucacauucgaugucu

SEQ ID NO: 186535 - RNA, 22 nt, Homo sapiens
uucauagucuaugcaaguaaga

SEQ ID NO: 186536 - RNA, 21 nt, Homo sapiens
uucaucagccagaaaucaagc

SEQ ID NO: 186537 - RNA, 18 nt, Homo sapiens
uucaucaguccucagcug

SEQ ID NO: 186538 - RNA, 22 nt, Homo sapiens
uucaucuggcaauucagagauu

SEQ ID NO: 186539 - RNA, 22 nt, Homo sapiens
uuccaguuuuauggguauagag

SEQ ID NO: 186540 - RNA, 19 nt, Homo sapiens
uuccugagaacaagggcuu

SEQ ID NO: 186541 - RNA, 22 nt, Homo sapiens
uuccugagaucagaauucaaau

SEQ ID NO: 186542 - RNA, 22 nt, Homo sapiens
uucucaguaauuccagauuuuu

SEQ ID NO: 186543 - RNA, 22 nt, Homo sapiens
uucucugggacauaggucgggu

SEQ ID NO: 186544 - RNA, 22 nt, Homo sapiens
uucugaguggcuuucaacacug

SEQ ID NO: 186545 - RNA, 22 nt, Homo sapiens
uucuggcuuauaaacgugacuu

SEQ ID NO: 186546 - RNA, 18 nt, Homo sapiens
uucuuguguugauauuuu

SEQ ID NO: 186547 - RNA, 22 nt, Homo sapiens
uugaaagaaaggagacugaguu

SEQ ID NO: 186548 - RNA, 22 nt, Homo sapiens
uugaaagcuaucagagauucca

SEQ ID NO: 186549 - RNA, 22 nt, Homo sapiens
uugaaaguguucacaaugguau

SEQ ID NO: 186550 - RNA, 22 nt, Homo sapiens
uugaaauguuuagaaguuugga

SEQ ID NO: 186551 - RNA, 19 nt, Homo sapiens
uugaaggccgccuugcaga

SEQ ID NO: 186552 - RNA, 22 nt, Homo sapiens
uugagaagugucuguucauguc

SEQ ID NO: 186553 - RNA, 21 nt, Homo sapiens
uugagacggagucucacucug

SEQ ID NO: 186554 - RNA, 22 nt, Homo sapiens
uugagauggagucucgcucugu

SEQ ID NO: 186555 - RNA, 22 nt, Homo sapiens
uugagauggauagacauagcau

SEQ ID NO: 186556 - RNA, 22 nt, Homo sapiens
uugaguauuggacugguaucuu

SEQ ID NO: 186557 - RNA, 22 nt, Homo sapiens
uugcagugguuucacuggcaaa

SEQ ID NO: 186558 - RNA, 22 nt, Homo sapiens
uugcauagaggugaguauagua

SEQ ID NO: 186559 - RNA, 19 nt, Homo sapiens
uugcauagguugaaccagc

SEQ ID NO: 186560 - RNA, 22 nt, Homo sapiens
uugcaugggagcugggugaagc

SEQ ID NO: 186561 - RNA, 22 nt, Homo sapiens
uugcucaggcuggaguacaaug

SEQ ID NO: 186562 - RNA, 22 nt, Homo sapiens
uuggaaacgucaccuuuuccuu

SEQ ID NO: 186563 - RNA, 22 nt, Homo sapiens
uuggaauauaaccuguuucuaa

SEQ ID NO: 186564 - RNA, 22 nt, Homo sapiens
uuggagagugauauucagaugc

SEQ ID NO: 186565 - RNA, 22 nt, Homo sapiens
uuggagcacuggggcacugaca

SEQ ID NO: 186566 - RNA, 22 nt, Homo sapiens
uuggcccugcugaccauucccu

SEQ ID NO: 186567 - RNA, 22 nt, Homo sapiens
uuggccuuuucaaugccucuuu

SEQ ID NO: 186568 - RNA, 22 nt, Homo sapiens
uuggcuuaguugaccacagucu

SEQ ID NO: 186569 - RNA, 22 nt, Homo sapiens
uuggucaggagccucccucuuu

SEQ ID NO: 186570 - RNA, 22 nt, Homo sapiens
uuggucaggcuagaguguggug

SEQ ID NO: 186571 - RNA, 22 nt, Homo sapiens
uuggucucuuaaucacacuuuu

SEQ ID NO: 186572 - RNA, 22 nt, Homo sapiens
uugguucaguuuaacgaguaau

SEQ ID NO: 186573 - RNA, 21 nt, Homo sapiens
uugguucccucugacaggucu

SEQ ID NO: 186574 - RNA, 22 nt, Homo sapiens
uugguuuccuuccugcuuaacu

SEQ ID NO: 186575 - RNA, 22 nt, Homo sapiens
uuguaaacaucuguacauugcu

SEQ ID NO: 186576 - RNA, 22 nt, Homo sapiens
uuggucagcuagauuauucccu

SEQ ID NO: 186577 - RNA, 22 nt, Homo sapiens
uuggucagcucaauggagaggg

SEQ ID NO: 186578 - RNA, 22 nt, Homo sapiens
uuggucuucuaauguaccuguu

SEQ ID NO: 186579 - RNA, 22 nt, Homo sapiens
uuguaaagaucauaugcuguuc

SEQ ID NO: 186580 - RNA, 22 nt, Homo sapiens
uuguaacaguuuauugacucga

SEQ ID NO: 186581 - RNA, 22 nt, Homo sapiens
uugucuccuagacgaccaggcg

SEQ ID NO: 186582 - RNA, 22 nt, Homo sapiens
uugugaauggugcugcaguaaa

SEQ ID NO: 186583 - RNA, 19 nt, Homo sapiens
uugugggaggacagagggg

SEQ ID NO: 186584 - RNA, 22 nt, Homo sapiens
uugugguuauagagucucccug

SEQ ID NO: 186585 - RNA, 22 nt, Homo sapiens
uugugguugauacacguaggaa

SEQ ID NO: 186586 - RNA, 22 nt, Homo sapiens
uugugguuuuaucuaccuuugg

SEQ ID NO: 186587 - RNA, 22 nt, Homo sapiens
uugugguuuuuaaaacuaggug

SEQ ID NO: 186588 - RNA, 22 nt, Homo sapiens
uuuaguucauuaaggaaucucc

SEQ ID NO: 186589 - RNA, 22 nt, Homo sapiens
uuucacagcugucuuccgucuc

SEQ ID NO: 186590 - RNA, 23 nt, Homo sapiens
uuucacaguagcuggaucagccu

SEQ ID NO: 186591 - RNA, 22 nt, Homo sapiens
uuucaucaagcacagaguagau

SEQ ID NO: 186592 - RNA, 22 nt, Homo sapiens
uuucaucagccagggucagucu

SEQ ID NO: 186593 - RNA, 19 nt, Homo sapiens
uuucauguuuuuggugaga

SEQ ID NO: 186594 - RNA, 21 nt, Homo sapiens
uuuccuggagcguauggcuuc

SEQ ID NO: 186595 - RNA, 22 nt, Homo sapiens
uuucuacagugaacgauuucua

SEQ ID NO: 186596 - RNA, 16 nt, Homo sapiens
uuucuauguuuuacua

SEQ ID NO: 186597 - RNA, 22 nt, Homo sapiens
uuucugguuaauuucuaagagc

SEQ ID NO: 186598 - RNA, 22 nt, Homo sapiens
uuugaguuugaggugcugauga

SEQ ID NO: 186599 - RNA, 22 nt, Homo sapiens
uuuggcuuuuguaauaacugcc

SEQ ID NO: 186600 - RNA, 22 nt, Homo sapiens
uuugggaaaugaaguugguaga

SEQ ID NO: 186601 - RNA, 22 nt, Homo sapiens
uuuggguuaguuuuccaaucuu

SEQ ID NO: 186602 - RNA, 22 nt, Homo sapiens
uuuguguccccacccacaucuc

SEQ ID NO: 186603 - RNA, 22 nt, Homo sapiens
uuugugucccuacccgaaucuc

SEQ ID NO: 186604 - RNA, 18 nt, Homo sapiens
uuuugcuuaacugcgcca

SEQ ID NO: 186605 - RNA, 22 nt, Homo sapiens
uuuugggggugauucacacagu

SEQ ID NO: 186606 - RNA, 22 nt, Homo sapiens
uuuugguuguuggguaagagua

SEQ ID NO: 186607 - RNA, 18 nt, Homo sapiens
uuuuugaggcacagggga

SEQ ID NO: 186608 - RNA, 21 nt, Homo sapiens
uuuuugguggucauggauaga

SEQ ID NO: 186609 - RNA, 21 nt, Homo sapiens
uccugagagaggaguaacucu

SEQ ID NO: 186610 - RNA, 21 nt, Homo sapiens
uccuuggugaugcccugcagu

SEQ ID NO: 186611 - RNA, 20 nt, Homo sapiens
ucgcaccacuauacuccagc

SEQ ID NO: 186612 - RNA, 22 nt, Homo sapiens
ucggcucagugcaagcucugcc

SEQ ID NO: 186613 - RNA, 19 nt, Homo sapiens
ucuaaaucucuugauagac

SEQ ID NO: 186614 - RNA, 22 nt, Homo sapiens
ucucacauuucacagggauggg

SEQ ID NO: 186615 - RNA, 22 nt, Homo sapiens
ucucagcacagucagggcgccu

SEQ ID NO: 186616 - RNA, 20 nt, Homo sapiens
ucucauggagguagagaaua

SEQ ID NO: 186617 - RNA, 20 nt, Homo sapiens
ucucccaaacagcaggcccu

SEQ ID NO: 186618 - RNA, 22 nt, Homo sapiens
ucucugaaacucuugacauccu

SEQ ID NO: 186619 - RNA, 22 nt, Homo sapiens
ucugagguuacugcuuuguaga

SEQ ID NO: 186620 - RNA, 22 nt, Homo sapiens
ucugccaaccacaaaauuuauu

SEQ ID NO: 186621 - RNA, 22 nt, Homo sapiens
ucuggagugugaaguggauaug

SEQ ID NO: 186622 - RNA, 21 nt, Homo sapiens
ucuggcuuucauuccccuucu

SEQ ID NO: 186623 - RNA, 22 nt, Homo sapiens
ucugugcugagaguugaaaguu

SEQ ID NO: 186624 - RNA, 19 nt, Homo sapiens
ucugugcuugucccccugu

SEQ ID NO: 186625 - RNA, 22 nt, Homo sapiens
ucuguguuuagacccaggguag

SEQ ID NO: 186626 - RNA, 22 nt, Homo sapiens
ucuguguuugaucaagauugua

SEQ ID NO: 186627 - RNA, 22 nt, Homo sapiens
ucuugcuuuugcagagcuucuc

SEQ ID NO: 186628 - RNA, 22 nt, Homo sapiens
ucuugguuaggggaaauaggca

SEQ ID NO: 186629 - RNA, 22 nt, Homo sapiens
ucuuuggaggcgaucuguuuga

SEQ ID NO: 186630 - RNA, 22 nt, Homo sapiens
ucuuuggguguauuucacagcc

SEQ ID NO: 186631 - RNA, 22 nt, Homo sapiens
ucuuugguaauggaugucugau

SEQ ID NO: 186632 - RNA, 22 nt, Homo sapiens
ucuuugguagaagcuauuuuau

SEQ ID NO: 186633 - RNA, 22 nt, Homo sapiens
ucuuuggucagaaagauuacac

SEQ ID NO: 186634 - RNA, 22 nt, Homo sapiens
ucuuuggugaauggucauccag

SEQ ID NO: 186635 - RNA, 22 nt, Homo sapiens
ucuuugguucugugcagccuau

SEQ ID NO: 186636 - RNA, 22 nt, Homo sapiens
ucuuugguuucugucucuguaa

SEQ ID NO: 186637 - RNA, 22 nt, Homo sapiens
ugaaaaguuguugaaggcuuca

SEQ ID NO: 186638 - RNA, 22 nt, Homo sapiens
ugaaacacacauugcccuuuau

SEQ ID NO: 186639 - RNA, 22 nt, Homo sapiens
ugaaaugccuuuaaugaauuua

SEQ ID NO: 186640 - RNA, 22 nt, Homo sapiens
ugaaaugcuaauucguagcuaa

SEQ ID NO: 186641 - RNA, 22 nt, Homo sapiens
ugaaaugcugucuaggggaaau

SEQ ID NO: 186642 - RNA, 22 nt, Homo sapiens
ugaacacuggauaaggagucag

SEQ ID NO: 186643 - RNA, 22 nt, Homo sapiens
ugaauauagacagggguagaga

SEQ ID NO: 186644 - RNA, 21 nt, Homo sapiens
ugaauauuuggguugugucca

SEQ ID NO: 186645 - RNA, 22 nt, Homo sapiens
ugacagguugauaggugcagca

SEQ ID NO: 186646 - RNA, 22 nt, Homo sapiens
ugagaauauuuuccaugucuca

SEQ ID NO: 186647 - RNA, 22 nt, Homo sapiens
ugagaaugaugauugguaaacc

SEQ ID NO: 186648 - RNA, 22 nt, Homo sapiens
ugagacacugaauccggccuga

SEQ ID NO: 186649 - RNA, 22 nt, Homo sapiens
ugagaccuuucauuucucagug

SEQ ID NO: 186650 - RNA, 22 nt, Homo sapiens
ugagacggagucucacucuguu

SEQ ID NO: 186651 - RNA, 22 nt, Homo sapiens
ugagacggagucucgcucucua

SEQ ID NO: 186652 - RNA, 22 nt, Homo sapiens
ugagacggagucuggcacuguc

SEQ ID NO: 186653 - RNA, 22 nt, Homo sapiens
ugagacggaguuucacucuugu

SEQ ID NO: 186654 - RNA, 22 nt, Homo sapiens
ugagacggaguuucgcucuugu

SEQ ID NO: 186655 - RNA, 22 nt, Homo sapiens
ugagagacaguuuguuaaaauu

SEQ ID NO: 186656 - RNA, 22 nt, Homo sapiens
ugagaggugaauggcaggcuca

SEQ ID NO: 186657 - RNA, 22 nt, Homo sapiens
agcagguguggcuuauccugaa

SEQ ID NO: 186658 - RNA, 16 nt, Homo sapiens
agcagguguuagguga

SEQ ID NO: 186659 - RNA, 19 nt, Homo sapiens
agcaguguggagauuucuc

SEQ ID NO: 186660 - RNA, 17 nt, Homo sapiens
agccccauuagcuaguu

SEQ ID NO: 186661 - RNA, 21 nt, Homo sapiens
agccugugggucauaguugcc

SEQ ID NO: 186662 - RNA, 22 nt, Homo sapiens
agccuguguugaauuauagaaa

SEQ ID NO: 186663 - RNA, 23 nt, Homo sapiens
agccuguugccuaggcagcucau

SEQ ID NO: 186664 - RNA, 23 nt, Homo sapiens
agcuagagaggcuggggauacag

SEQ ID NO: 186665 - RNA, 22 nt, Homo sapiens
agcugguauuuugucaaggaua

SEQ ID NO: 186666 - RNA, 22 nt, Homo sapiens
agcugguccugugacuugcuuc

SEQ ID NO: 186667 - RNA, 19 nt, Homo sapiens
agcuuuggcuaacuuucuc

SEQ ID NO: 186668 - RNA, 22 nt, Homo sapiens
aggaagugucuucuuuuaggca

SEQ ID NO: 186669 - RNA, 22 nt, Homo sapiens
aggagaugaagcuuuaucuaaa

SEQ ID NO: 186670 - RNA, 22 nt, Homo sapiens
aggcaacgugcauuucuggugu

SEQ ID NO: 186671 - RNA, 22 nt, Homo sapiens
aggcagaugagguccucagcug

SEQ ID NO: 186672 - RNA, 22 nt, Homo sapiens
aggcaguuucagugagagguga

SEQ ID NO: 186673 - RNA, 22 nt, Homo sapiens
agguaaacauggggacugcuac

SEQ ID NO: 186674 - RNA, 22 nt, Homo sapiens
agguauauuggacagauguaaa

SEQ ID NO: 186675 - RNA, 22 nt, Homo sapiens
aggugguuuugaugagcaggua

SEQ ID NO: 186676 - RNA, 22 nt, Homo sapiens
agucacagguucuugggauuag

SEQ ID NO: 186677 - RNA, 22 nt, Homo sapiens
agucagugcauaagaaugaagu

SEQ ID NO: 186678 - RNA, 22 nt, Homo sapiens
agucaguggaguaaauguaauu

SEQ ID NO: 186679 - RNA, 21 nt, Homo sapiens
agugagucauuuggaaagcaa

SEQ ID NO: 186680 - RNA, 22 nt, Homo sapiens
agugcaaagccgagguuucuug

SEQ ID NO: 186681 - RNA, 22 nt, Homo sapiens
aguggauguuguggccugggag

SEQ ID NO: 186682 - RNA, 22 nt, Homo sapiens
aguggguguuccauuggauaaa

SEQ ID NO: 186683 - RNA, 22 nt, Homo sapiens
aguuggccccuacugggaggug

SEQ ID NO: 186684 - RNA, 22 nt, Homo sapiens
auagcaaugccccaauccuugg

SEQ ID NO: 186685 - RNA, 22 nt, Homo sapiens
auauaccuaggcuacaugguuu

SEQ ID NO: 186686 - RNA, 18 nt, Homo sapiens
aaaaagugcucaggccua

SEQ ID NO: 186687 - RNA, 22 nt, Homo sapiens
aaaagcauucagagugcugggc

SEQ ID NO: 186688 - RNA, 22 nt, Homo sapiens
aaaagucuguagugaaagguga

SEQ ID NO: 186689 - RNA, 22 nt, Homo sapiens
aaagguaguacuucuagaaggg

SEQ ID NO: 186690 - RNA, 22 nt, Homo sapiens
aaagugcaguauuugggcagaa

SEQ ID NO: 186691 - RNA, 22 nt, Homo sapiens
aaagugcuaggauuaccugggg

SEQ ID NO: 186692 - RNA, 22 nt, Homo sapiens
aaagugcugggauuggcugggc

SEQ ID NO: 186693 - RNA, 22 nt, Homo sapiens
aaagugcugggauuuuaggcau

SEQ ID NO: 186694 - RNA, 22 nt, Homo sapiens
aaagugcuucucuuuggugggu

SEQ ID NO: 186695 - RNA, 22 nt, Homo sapiens
aacaggcuccuaggggugcacc

SEQ ID NO: 186696 - RNA, 22 nt, Homo sapiens
aacagucaauugcugaugaccu

SEQ ID NO: 186697 - RNA, 22 nt, Homo sapiens
aacagugcauucagggauauau

SEQ ID NO: 186698 - RNA, 22 nt, Homo sapiens
aagaccuaugcaggaagaaaug

SEQ ID NO: 186699 - RNA, 22 nt, Homo sapiens
aagaucaucauagagggcauga

SEQ ID NO: 186700 - RNA, 22 nt, Homo sapiens
aagcuggagugcaguggugcaa

SEQ ID NO: 186701 - RNA, 22 nt, Homo sapiens
aaggaauucaaauuuucucugg

SEQ ID NO: 186702 - RNA, 22 nt, Homo sapiens
aaggcaagaaaauggauucucc

SEQ ID NO: 186703 - RNA, 22 nt, Homo sapiens
aaggcauucucaaacuaguucu

SEQ ID NO: 186704 - RNA, 22 nt, Homo sapiens
aaguaagcauccaauaaauguu

SEQ ID NO: 186705 - RNA, 22 nt, Homo sapiens
aagucacugagacuuguggcug

SEQ ID NO: 186706 - RNA, 22 nt, Homo sapiens
aagucaugaagaggaaaggaca

SEQ ID NO: 186707 - RNA, 22 nt, Homo sapiens
aagugacauugugcccauuuga

SEQ ID NO: 186708 - RNA, 22 nt, Homo sapiens
aagugcaaaucuguggcugaaa

SEQ ID NO: 186709 - RNA, 22 nt, Homo sapiens
aagugcuggccuacucaaucga

SEQ ID NO: 186710 - RNA, 22 nt, Homo sapiens
aauacugcuuugauguaagcua

SEQ ID NO: 186711 - RNA, 22 nt, Homo sapiens
aauagugcugcaaaaacauacg

SEQ ID NO: 186712 - RNA, 22 nt, Homo sapiens
aauauugucaaaauggauucca

SEQ ID NO: 186713 - RNA, 22 nt, Homo sapiens
aaucacaggucuuggcugcaug

SEQ ID NO: 186714 - RNA, 22 nt, Homo sapiens
aauccauuugccgucuauccau

SEQ ID NO: 186715 - RNA, 22 nt, Homo sapiens
aaucccuuuguccagucucuuu

SEQ ID NO: 186716 - RNA, 22 nt, Homo sapiens
aauugcauaaaauucaacucug

SEQ ID NO: 186717 - RNA, 22 nt, Homo sapiens
acaaaguguuuucugaaggccu

SEQ ID NO: 186718 - RNA, 22 nt, Homo sapiens
acaagugcuuuuccuggagaca

SEQ ID NO: 186719 - RNA, 22 nt, Homo sapiens
acacagugucuguguauuuaaa

SEQ ID NO: 186720 - RNA, 22 nt, Homo sapiens
acacaguguuuauugugguuag

SEQ ID NO: 186721 - RNA, 22 nt, Homo sapiens
acacaugugaaaaaaauguuac

SEQ ID NO: 186722 - RNA, 22 nt, Homo sapiens
acacuggaggagagcuguugcu

SEQ ID NO: 186723 - RNA, 20 nt, Homo sapiens
acagcauagccuuuuaaagc

SEQ ID NO: 186724 - RNA, 22 nt, Homo sapiens
acaggagugggauuugaguccu

SEQ ID NO: 186725 - RNA, 22 nt, Homo sapiens
acagucacaauuuguaccuuuu

SEQ ID NO: 186726 - RNA, 22 nt, Homo sapiens
acagugcuguuguguuuucacg

SEQ ID NO: 186727 - RNA, 22 nt, Homo sapiens
acagugcuuucaauguucagua

SEQ ID NO: 186728 - RNA, 22 nt, Homo sapiens
acaguguuacuugauaguguau

SEQ ID NO: 186729 - RNA, 22 nt, Homo sapiens
acauaaagaagcaggacauugu

SEQ ID NO: 186730 - RNA, 22 nt, Homo sapiens
accagucucagguaugucuuua

SEQ ID NO: 186731 - RNA, 17 nt, Homo sapiens
accagugcaugugcuuu

SEQ ID NO: 186732 - RNA, 22 nt, Homo sapiens
acccaguagccagauguagcug

SEQ ID NO: 186733 - RNA, 22 nt, Homo sapiens
acccuacauaguagauccuaca

SEQ ID NO: 186734 - RNA, 22 nt, Homo sapiens
accuggcacuuagcaaaucuga

SEQ ID NO: 186735 - RNA, 23 nt, Homo sapiens
accugugguuauuuuacucuucc

SEQ ID NO: 186736 - RNA, 22 nt, Homo sapiens
acuacauaugacaucuucuuua

SEQ ID NO: 186737 - RNA, 22 nt, Homo sapiens
acucagagaacauucccagucu

SEQ ID NO: 186738 - RNA, 18 nt, Homo sapiens
acugcacuccaccuuggg

SEQ ID NO: 186739 - RNA, 22 nt, Homo sapiens
acugcacuccagccugaugaaa

SEQ ID NO: 186740 - RNA, 22 nt, Homo sapiens
acugcacuccagccugccgaca

SEQ ID NO: 186741 - RNA, 22 nt, Homo sapiens
acugcacuccagccuugugaca

SEQ ID NO: 186742 - RNA, 22 nt, Homo sapiens
acugcacucuagccuuggcaac

SEQ ID NO: 186743 - RNA, 21 nt, Homo sapiens
acuggaccccuuccauacacc

SEQ ID NO: 186744 - RNA, 22 nt, Homo sapiens
acuguacuccagccugggcaac

SEQ ID NO: 186745 - RNA, 22 nt, Homo sapiens
agaaacauucucuugccuccuu

SEQ ID NO: 186746 - RNA, 20 nt, Homo sapiens
agaagcauugcucucuucag

SEQ ID NO: 186747 - RNA, 22 nt, Homo sapiens
agacacuguugaaaaggcccca

SEQ ID NO: 186748 - RNA, 19 nt, Homo sapiens
agacuggcccaggcgggug

SEQ ID NO: 186749 - RNA, 22 nt, Homo sapiens
agagagcuuuugguugcccuaa

SEQ ID NO: 186750 - RNA, 22 nt, Homo sapiens
agagccacauuaaauaugggaa

SEQ ID NO: 186751 - RNA, 22 nt, Homo sapiens
agauggguuuucacauguuggc

SEQ ID NO: 186752 - RNA, 22 nt, Homo sapiens
agcacagugaaugguuuacuca

SEQ ID NO: 186753 - RNA, 22 nt, Homo sapiens
agcaggacaauaugggaucagg

SEQ ID NO: 186754 - RNA, 22 nt, Homo sapiens
agcagguguccacaauguuugc

SEQ ID NO: 186755 - RNA, 18 nt, Homo sapiens
agcucaguguuugcuuac

SEQ ID NO: 186756 - RNA, 20 nt, Homo sapiens
agcuggguguguuggugcau

SEQ ID NO: 186757 - RNA, 22 nt, Homo sapiens
agcuuuggauaccugcuguucc

SEQ ID NO: 186758 - RNA, 22 nt, Homo sapiens
aggaagacauauagaacuaaaa

SEQ ID NO: 186759 - RNA, 22 nt, Homo sapiens
aggaccccucaucagcaccagu

SEQ ID NO: 186760 - RNA, 22 nt, Homo sapiens
aggcaagcaucuugcucccuuc

SEQ ID NO: 186761 - RNA, 22 nt, Homo sapiens
aggcacgguggcucacaccugu

SEQ ID NO: 186762 - RNA, 22 nt, Homo sapiens
agguagguugagaugggcauca

SEQ ID NO: 186763 - RNA, 22 nt, Homo sapiens
aguaccauuccguuggagcugg

SEQ ID NO: 186764 - RNA, 22 nt, Homo sapiens
agucaagaaucucagcaucuuu

SEQ ID NO: 186765 - RNA, 22 nt, Homo sapiens
agucaguguguauugauggcac

SEQ ID NO: 186766 - RNA, 19 nt, Homo sapiens
agucaugugaggacccuug

SEQ ID NO: 186767 - RNA, 22 nt, Homo sapiens
agucugguguucucacacuagu

SEQ ID NO: 186768 - RNA, 22 nt, Homo sapiens
agugcacuccagccugggcaac

SEQ ID NO: 186769 - RNA, 22 nt, Homo sapiens
agugucaggagacagguagcug

SEQ ID NO: 186770 - RNA, 22 nt, Homo sapiens
ccugagguagaguuuauauuga

SEQ ID NO: 186771 - RNA, 22 nt, Homo sapiens
uaacuaaagagaagucaauguc

SEQ ID NO: 186772 - RNA, 22 nt, Homo sapiens
uaacugcaaccucugccugcug

SEQ ID NO: 186773 - RNA, 23 nt, Homo sapiens
uaagacacuaacuuuaugcuuug

SEQ ID NO: 186774 - RNA, 23 nt, Homo sapiens
uaagucacacagauuaauuuauu

SEQ ID NO: 186775 - RNA, 22 nt, Homo sapiens
uaagugcaacauaaguguuaaa

SEQ ID NO: 186776 - RNA, 18 nt, Homo sapiens
uaagugcuuuaaacacau

SEQ ID NO: 186777 - RNA, 22 nt, Homo sapiens
uaaugcaucaugguuggcaaac

SEQ ID NO: 186778 - RNA, 22 nt, Homo sapiens
uacacagucaaaaauuuccagg

SEQ ID NO: 186779 - RNA, 22 nt, Homo sapiens
uacaggaaugucagguugcugu

SEQ ID NO: 186780 - RNA, 22 nt, Homo sapiens
uacaggacuucucagaguuauu

SEQ ID NO: 186781 - RNA, 22 nt, Homo sapiens
uacuacuuucugacaucuuuaa

SEQ ID NO: 186782 - RNA, 22 nt, Homo sapiens
uacugcagucagacuccugggc

SEQ ID NO: 186783 - RNA, 19 nt, Homo sapiens
uacuggcucgggaauuuuc

SEQ ID NO: 186784 - RNA, 22 nt, Homo sapiens
uagagguaggucuucgagucuc

SEQ ID NO: 186785 - RNA, 22 nt, Homo sapiens
uagaguacucugguaaguucuu

SEQ ID NO: 186786 - RNA, 22 nt, Homo sapiens
uagcacagggaauugguucucu

SEQ ID NO: 186787 - RNA, 22 nt, Homo sapiens
uagcacaguucacccucgauuu

SEQ ID NO: 186788 - RNA, 22 nt, Homo sapiens
uagcacaucccuaaaaugcugu

SEQ ID NO: 186789 - RNA, 22 nt, Homo sapiens
uagcacuauguuaucacauacu

SEQ ID NO: 186790 - RNA, 21 nt, Homo sapiens
uagcucagugguguugccaua

SEQ ID NO: 186791 - RNA, 22 nt, Homo sapiens
uagguaguuagcauacuacaca

SEQ ID NO: 186792 - RNA, 22 nt, Homo sapiens
uagguugucaucagucuccacu

SEQ ID NO: 186793 - RNA, 22 nt, Homo sapiens
uauaucacaugcacucauuuuc

SEQ ID NO: 186794 - RNA, 20 nt, Homo sapiens
uaucacaggucagaaacccu

SEQ ID NO: 186795 - RNA, 22 nt, Homo sapiens
uaucacaguaucuagcacagug

SEQ ID NO: 186796 - RNA, 22 nt, Homo sapiens
uaugaugcuguuuagaaucucu

SEQ ID NO: 186797 - RNA, 22 nt, Homo sapiens
uauggcauuguuggugaugaua

SEQ ID NO: 186798 - RNA, 22 nt, Homo sapiens
uauggcuacuacgaauaaugcu

SEQ ID NO: 186799 - RNA, 20 nt, Homo sapiens
uaugguuuuagguauagcau

SEQ ID NO: 186800 - RNA, 22 nt, Homo sapiens
uauuacagaccauaucgccggg

SEQ ID NO: 186801 - RNA, 20 nt, Homo sapiens
uauuacagaguaauggugga

SEQ ID NO: 186802 - RNA, 22 nt, Homo sapiens
uauuacuugucugugucucaau

SEQ ID NO: 186803 - RNA, 22 nt, Homo sapiens
uauugaauuugagcugucucuu

SEQ ID NO: 186804 - RNA, 22 nt, Homo sapiens
uauugauuuucaguguucagcu

SEQ ID NO: 186805 - RNA, 22 nt, Homo sapiens
uauugcaauuggggaaacuggg

SEQ ID NO: 186806 - RNA, 22 nt, Homo sapiens
ucaaagucuucucaaguaacau

SEQ ID NO: 186807 - RNA, 20 nt, Homo sapiens
ucaaggcaggaacuguacau

SEQ ID NO: 186808 - RNA, 22 nt, Homo sapiens
ucacagaggagaagaccuuuaa

SEQ ID NO: 186809 - RNA, 22 nt, Homo sapiens
ucaccgugaauuaacaacacuu

SEQ ID NO: 186810 - RNA, 22 nt, Homo sapiens
ucacugaaaccacugccuccug

SEQ ID NO: 186811 - RNA, 22 nt, Homo sapiens
ucacugcacuccagccuuuaug

SEQ ID NO: 186812 - RNA, 22 nt, Homo sapiens
ucacugcacuucaggcuuucuc

SEQ ID NO: 186813 - RNA, 22 nt, Homo sapiens
ucacuggccaaauucuggguga

SEQ ID NO: 186814 - RNA, 22 nt, Homo sapiens
ucacugggagaccaaagccauc

SEQ ID NO: 186815 - RNA, 22 nt, Homo sapiens
ucacugggagcauuugagccuu

SEQ ID NO: 186816 - RNA, 22 nt, Homo sapiens
ucagacacugcccuccaccugu

SEQ ID NO: 186817 - RNA, 22 nt, Homo sapiens
ucagacacuguggccuuuggac

SEQ ID NO: 186818 - RNA, 22 nt, Homo sapiens
ucagaguagcugucugaggugc

SEQ ID NO: 186819 - RNA, 22 nt, Homo sapiens
ucagaucaguuccacaagaacu

SEQ ID NO: 186820 - RNA, 19 nt, Homo sapiens
ucagaugcauuagggguua

SEQ ID NO: 186821 - RNA, 22 nt, Homo sapiens
ucagcacauucaaggccugccu

SEQ ID NO: 186822 - RNA, 22 nt, Homo sapiens
ucagggacuuacaaaccagaag

SEQ ID NO: 186823 - RNA, 22 nt, Homo sapiens
ucaggugccuuggcuaauuguu

SEQ ID NO: 186824 - RNA, 22 nt, Homo sapiens
ucaguaaauguuaggacauuuc

SEQ ID NO: 186825 - RNA, 22 nt, Homo sapiens
ucaguccccucgcugagucuac

SEQ ID NO: 186826 - RNA, 22 nt, Homo sapiens
ucagugccucaguuuuuaaaga

SEQ ID NO: 186827 - RNA, 22 nt, Homo sapiens
ucauacuguccaauucuagugg

SEQ ID NO: 186828 - RNA, 22 nt, Homo sapiens
ucauaucauuagaucuacugua

SEQ ID NO: 186829 - RNA, 21 nt, Homo sapiens
ucauauguaucuuugugccuc

SEQ ID NO: 186830 - RNA, 22 nt, Homo sapiens
ucauucacucccuugaaguuag

SEQ ID NO: 186831 - RNA, 22 nt, Homo sapiens
ucauugguucuggguguuguug

SEQ ID NO: 186832 - RNA, 22 nt, Homo sapiens
ucauugguugcguaauuugauu

SEQ ID NO: 186833 - RNA, 22 nt, Homo sapiens
uccagcuuuuucuaauucugug

SEQ ID NO: 186834 - RNA, 22 nt, Homo sapiens
uccaugagaauaguuaggcucu

SEQ ID NO: 186835 - RNA, 22 nt, Homo sapiens
ucccaguauucauuuacagaag

SEQ ID NO: 186836 - RNA, 22 nt, Homo sapiens
ucccugaaagcugagauuggaa

SEQ ID NO: 186837 - RNA, 22 nt, Homo sapiens
uccucugaacuccagacccaua

SEQ ID NO: 186838 - RNA, 22 nt, Homo sapiens
uccuggcuccacuguuuauucc

SEQ ID NO: 186839 - RNA, 22 nt, Homo sapiens
uccuuuggguagcuguucagau

SEQ ID NO: 186840 - RNA, 22 nt, Homo sapiens
ucgcugggaaccagagguaaag

SEQ ID NO: 186841 - RNA, 22 nt, Homo sapiens
ucucaauuugauuacauucaua

SEQ ID NO: 186842 - RNA, 22 nt, Homo sapiens
ucucagcacaaacaaaauugcu

SEQ ID NO: 186843 - RNA, 22 nt, Homo sapiens
ucucugagaaaaguuucuccca

SEQ ID NO: 186844 - RNA, 22 nt, Homo sapiens
ucucugauuauugcauuucauu

SEQ ID NO: 186845 - RNA, 22 nt, Homo sapiens
ucucugguuuucaaagcaguau

SEQ ID NO: 186846 - RNA, 22 nt, Homo sapiens
ucucuuggcggaaguugcagug

SEQ ID NO: 186847 - RNA, 22 nt, Homo sapiens
ucugacucuggagucucagguu

SEQ ID NO: 186848 - RNA, 22 nt, Homo sapiens
ucuggccuccuaugagaaucga

SEQ ID NO: 186849 - RNA, 22 nt, Homo sapiens
ucuggcuuauuucacuuagcau

SEQ ID NO: 186850 - RNA, 22 nt, Homo sapiens
ucuggcuuuagcaugugggaag

SEQ ID NO: 186851 - RNA, 23 nt, Homo sapiens
ucuggcuuugggaugcucaaggg

SEQ ID NO: 186852 - RNA, 22 nt, Homo sapiens
ucuggcuuugugaguugccaga

SEQ ID NO: 186853 - RNA, 22 nt, Homo sapiens
ucugguuccugcauucauucaa

SEQ ID NO: 186854 - RNA, 22 nt, Homo sapiens
ucugucaaaucuuauguuguag

SEQ ID NO: 186855 - RNA, 22 nt, Homo sapiens
ucuguguuugguuggcaauuuc

SEQ ID NO: 186856 - RNA, 22 nt, Homo sapiens
ucuuggccaugaauggcaaggc

SEQ ID NO: 186857 - RNA, 22 nt, Homo sapiens
ucuugggugaguuugugaauaa

SEQ ID NO: 186858 - RNA, 22 nt, Homo sapiens
agcuggcuguagcugcaagucu

SEQ ID NO: 186859 - RNA, 22 nt, Homo sapiens
agcuggucuacguguguaugag

SEQ ID NO: 186860 - RNA, 22 nt, Homo sapiens
agcuggucuuggggaagaguag

SEQ ID NO: 186861 - RNA, 22 nt, Homo sapiens
agcuuguauuuguagccuguug

SEQ ID NO: 186862 - RNA, 21 nt, Homo sapiens
aggaagacuaugaucaauugg

SEQ ID NO: 186863 - RNA, 23 nt, Homo sapiens
aggaauggaaaaccaaguaucau

SEQ ID NO: 186864 - RNA, 22 nt, Homo sapiens
aggacacugagcaugggagguu

SEQ ID NO: 186865 - RNA, 22 nt, Homo sapiens
aggacacugauguaugcugugg

SEQ ID NO: 186866 - RNA, 22 nt, Homo sapiens
aggagguugguaccaucuguuu

SEQ ID NO: 186867 - RNA, 22 nt, Homo sapiens
aggcaacaugguaaaacccugu

SEQ ID NO: 186868 - RNA, 22 nt, Homo sapiens
aggcaggugaaagauaguuuua

SEQ ID NO: 186869 - RNA, 22 nt, Homo sapiens
aggcuagacuuugagaauuuuu

SEQ ID NO: 186870 - RNA, 22 nt, Homo sapiens
aggcuuauuaagauucccuuau

SEQ ID NO: 186871 - RNA, 22 nt, Homo sapiens
aggcuuuuggagguggcuuucu

SEQ ID NO: 186872 - RNA, 22 nt, Homo sapiens
agguaauuuuaucauuauguga

SEQ ID NO: 186873 - RNA, 22 nt, Homo sapiens
agguaauuuucccagagggaaa

SEQ ID NO: 186874 - RNA, 20 nt, Homo sapiens
agguaguuauacaaaugugu

SEQ ID NO: 186875 - RNA, 22 nt, Homo sapiens
agguauuuucaacuuagaaugg

SEQ ID NO: 186876 - RNA, 20 nt, Homo sapiens
agguuauuauaauuagaaga

SEQ ID NO: 186877 - RNA, 22 nt, Homo sapiens
aguaacaggauccaaagaaugu

SEQ ID NO: 186878 - RNA, 22 nt, Homo sapiens
agucaagugggguuagauaguu

SEQ ID NO: 186879 - RNA, 22 nt, Homo sapiens
agucacagccuuuuacuuuaga

SEQ ID NO: 186880 - RNA, 22 nt, Homo sapiens
agucacaugcauuuucuucaau

SEQ ID NO: 186881 - RNA, 21 nt, Homo sapiens
agucauaggaguacauaaugc

SEQ ID NO: 186882 - RNA, 22 nt, Homo sapiens
agucaugggagagaugugaucg

SEQ ID NO: 186883 - RNA, 22 nt, Homo sapiens
agugaaaugucaccuuuuagga

SEQ ID NO: 186884 - RNA, 22 nt, Homo sapiens
agugauggagccaggauuuaau

SEQ ID NO: 186885 - RNA, 19 nt, Homo sapiens
aguggguguuuucuguuug

SEQ ID NO: 186886 - RNA, 23 nt, Homo sapiens
aguggucuccugggcccagcugu

SEQ ID NO: 186887 - RNA, 22 nt, Homo sapiens
agugguuuuaaguagagcauac

SEQ ID NO: 186888 - RNA, 22 nt, Homo sapiens
aguguuuuucaugggauacuuu

SEQ ID NO: 186889 - RNA, 22 nt, Homo sapiens
aguucaaugcucuuucuacuau

SEQ ID NO: 186890 - RNA, 22 nt, Homo sapiens
auaaagcaagucucuggccuca

SEQ ID NO: 186891 - RNA, 20 nt, Homo sapiens
auaaauguauagguguacau

SEQ ID NO: 186892 - RNA, 22 nt, Homo sapiens
auaacagcauuauugcauacgu

SEQ ID NO: 186893 - RNA, 20 nt, Homo sapiens
auagaagacuagugcagcag

SEQ ID NO: 186894 - RNA, 22 nt, Homo sapiens
auagguaguugaggagauuuca

SEQ ID NO: 186895 - RNA, 22 nt, Homo sapiens
auauaugcacacgugugcauau

SEQ ID NO: 186896 - RNA, 22 nt, Homo sapiens
auaugcuaauuuuuagucgagc

SEQ ID NO: 186897 - RNA, 22 nt, Homo sapiens
auauuacuggccauaucgcagg

SEQ ID NO: 186898 - RNA, 22 nt, Homo sapiens
aucacagauauggguuuaaauc

SEQ ID NO: 186899 - RNA, 22 nt, Homo sapiens
aucaccuggaguagcccguccc

SEQ ID NO: 186900 - RNA, 22 nt, Homo sapiens
aucaggaaccuuuuuggugugu

SEQ ID NO: 186901 - RNA, 22 nt, Homo sapiens
aucagugcauguuuguugagcu

SEQ ID NO: 186902 - RNA, 22 nt, Homo sapiens
aucauagcucacugcagccucg

SEQ ID NO: 186903 - RNA, 22 nt, Homo sapiens
aucaucaugcacuacagccugg

SEQ ID NO: 186904 - RNA, 22 nt, Homo sapiens
aucauguaguaagacacauuua

SEQ ID NO: 186905 - RNA, 22 nt, Homo sapiens
aucccaguaaaaauggcuucua

SEQ ID NO: 186906 - RNA, 22 nt, Homo sapiens
auccugaagcuuuacugaauuc

SEQ ID NO: 186907 - RNA, 22 nt, Homo sapiens
auccugagacuuuucugaaguu

SEQ ID NO: 186908 - RNA, 22 nt, Homo sapiens
aucuggcuucuuuuaguccaca

SEQ ID NO: 186909 - RNA, 22 nt, Homo sapiens
aucuuuggcgggaauaucacag

SEQ ID NO: 186910 - RNA, 22 nt, Homo sapiens
aucuuuggugaguucuuugguc

SEQ ID NO: 186911 - RNA, 22 nt, Homo sapiens
aucuuuggugcaugauacuuug

SEQ ID NO: 186912 - RNA, 22 nt, Homo sapiens
augaaguuagcucauuucuuuu

SEQ ID NO: 186913 - RNA, 23 nt, Homo sapiens
augacacuguccuugaccauuuc

SEQ ID NO: 186914 - RNA, 19 nt, Homo sapiens
augagucugcaagaaccag

SEQ ID NO: 186915 - RNA, 22 nt, Homo sapiens
augcaauucuagauugauagua

SEQ ID NO: 186916 - RNA, 22 nt, Homo sapiens
augcagugugcaacagauuaag

SEQ ID NO: 186917 - RNA, 22 nt, Homo sapiens
augccaagagacaaagggaauc

SEQ ID NO: 186918 - RNA, 22 nt, Homo sapiens
augccaagaugagcacgcgucu

SEQ ID NO: 186919 - RNA, 22 nt, Homo sapiens
auggaaacauaagaguauagau

SEQ ID NO: 186920 - RNA, 22 nt, Homo sapiens
auggagagaauuauucucucag

SEQ ID NO: 186921 - RNA, 22 nt, Homo sapiens
auggaggaggaagcugaaacaa

SEQ ID NO: 186922 - RNA, 22 nt, Homo sapiens
auggauauugccuaggguagua

SEQ ID NO: 186923 - RNA, 22 nt, Homo sapiens
auggcaguuucagcuauaguuu

SEQ ID NO: 186924 - RNA, 22 nt, Homo sapiens
auggccuuguauaccuggcaaa

SEQ ID NO: 186925 - RNA, 22 nt, Homo sapiens
auggccuuucuggcacauuucc

SEQ ID NO: 186926 - RNA, 22 nt, Homo sapiens
auggcuuuggucucccagugau

SEQ ID NO: 186927 - RNA, 22 nt, Homo sapiens
auggucuuuauuguguugagug

SEQ ID NO: 186928 - RNA, 22 nt, Homo sapiens
auggucuuuguuucuaauucug

SEQ ID NO: 186929 - RNA, 22 nt, Homo sapiens
auggucuuuuuguuaugagaga

SEQ ID NO: 186930 - RNA, 22 nt, Homo sapiens
auguaacugggacacaagccuc

SEQ ID NO: 186931 - RNA, 22 nt, Homo sapiens
auguaguagcagaaaauauuuu

SEQ ID NO: 186932 - RNA, 22 nt, Homo sapiens
augugcaagaucauuaaagcuc

SEQ ID NO: 186933 - RNA, 22 nt, Homo sapiens
augugcaauguguacguagccc

SEQ ID NO: 186934 - RNA, 22 nt, Homo sapiens
augugccaauuaggauuccaag

SEQ ID NO: 186935 - RNA, 22 nt, Homo sapiens
auguguucaucacagcacaauu

SEQ ID NO: 186936 - RNA, 22 nt, Homo sapiens
auuaaguaaugguuccaauaau

SEQ ID NO: 186937 - RNA, 22 nt, Homo sapiens
auugcacuccacccugggcaac

SEQ ID NO: 186938 - RNA, 22 nt, Homo sapiens
auugcacuccagucucaccagg

SEQ ID NO: 186939 - RNA, 22 nt, Homo sapiens
auuguacugccccccuguugcu

SEQ ID NO: 186940 - RNA, 19 nt, Homo sapiens
auuuccuggagcuggucuc

SEQ ID NO: 186941 - RNA, 22 nt, Homo sapiens
auuuccuguaggggcuugcgaa

SEQ ID NO: 186942 - RNA, 22 nt, Homo sapiens
auuuugguuacauaguugagcu

SEQ ID NO: 186943 - RNA, 22 nt, Homo sapiens
cacagaauucauuggauuaccu

SEQ ID NO: 186944 - RNA, 22 nt, Homo sapiens
cacagucugggcuuguuuguac

SEQ ID NO: 186945 - RNA, 22 nt, Homo sapiens
cacagugaacugguggguuuuu

SEQ ID NO: 186946 - RNA, 19 nt, Homo sapiens
ucacgugcagcagccacac

SEQ ID NO: 186947 - RNA, 22 nt, Homo sapiens
ucacgugcucuuguguguucug

SEQ ID NO: 186948 - RNA, 22 nt, Homo sapiens
ucacugaaacuguccuggguua

SEQ ID NO: 186949 - RNA, 22 nt, Homo sapiens
ucacugcgaccuccgccucccg

SEQ ID NO: 186950 - RNA, 22 nt, Homo sapiens
ucacuggacucuagccugggug

SEQ ID NO: 186951 - RNA, 22 nt, Homo sapiens
ucacuggagguuccugaaguuc

SEQ ID NO: 186952 - RNA, 22 nt, Homo sapiens
ucacuggcaaauauauccguug

SEQ ID NO: 186953 - RNA, 22 nt, Homo sapiens
ucagaucaugcuuaugauggga

SEQ ID NO: 186954 - RNA, 22 nt, Homo sapiens
ucagggacgcuugacacaagcc

SEQ ID NO: 186955 - RNA, 18 nt, Homo sapiens
ucagucacugccuggcuu

SEQ ID NO: 186956 - RNA, 22 nt, Homo sapiens
ucagugggcuauguaauuaacu

SEQ ID NO: 186957 - RNA, 22 nt, Homo sapiens
ucauaugucauaguaugaucuu

SEQ ID NO: 186958 - RNA, 22 nt, Homo sapiens
ucaucaguuuuuuauaugugau

SEQ ID NO: 186959 - RNA, 22 nt, Homo sapiens
uccaguguuauaauaugcgucu

SEQ ID NO: 186960 - RNA, 16 nt, Homo sapiens
ucccaccauugcuugu

SEQ ID NO: 186961 - RNA, 17 nt, Homo sapiens
ucccauguuucuucuac

SEQ ID NO: 186962 - RNA, 22 nt, Homo sapiens
uccccggaugacggccgcuuca

SEQ ID NO: 186963 - RNA, 22 nt, Homo sapiens
uccuuuaguuaauaaagacaag

SEQ ID NO: 186964 - RNA, 22 nt, Homo sapiens
ucgcgccauucuccugccucag

SEQ ID NO: 186965 - RNA, 22 nt, Homo sapiens
ucuaaagcauccagauugcuuc

SEQ ID NO: 186966 - RNA, 22 nt, Homo sapiens
ucucugauuaaacaagauagug

SEQ ID NO: 186967 - RNA, 22 nt, Homo sapiens
ucucugguuuguggaaucuuag

SEQ ID NO: 186968 - RNA, 22 nt, Homo sapiens
ucugagguuaaauuuuauaguu

SEQ ID NO: 186969 - RNA, 22 nt, Homo sapiens
ucugaguggcagaaugagcuga

SEQ ID NO: 186970 - RNA, 22 nt, Homo sapiens
ucuggccuacaucauuuuuccg

SEQ ID NO: 186971 - RNA, 22 nt, Homo sapiens
ucuggcuccaaagucuauuuuu

SEQ ID NO: 186972 - RNA, 22 nt, Homo sapiens
ucuggcuccacacuuuauuaac

SEQ ID NO: 186973 - RNA, 18 nt, Homo sapiens
ucuggcuucuuuguucca

SEQ ID NO: 186974 - RNA, 22 nt, Homo sapiens
ucugucacugguggacgaucac

SEQ ID NO: 186975 - RNA, 22 nt, Homo sapiens
ucugugcauggcagaggaauga

SEQ ID NO: 186976 - RNA, 22 nt, Homo sapiens
ucugugguuguugcauggaaug

SEQ ID NO: 186977 - RNA, 22 nt, Homo sapiens
ucuguguugaucacacugggag

SEQ ID NO: 186978 - RNA, 21 nt, Homo sapiens
ucuguguugaucucacuggga

SEQ ID NO: 186979 - RNA, 22 nt, Homo sapiens
ucuugguaaugucacauuuccu

SEQ ID NO: 186980 - RNA, 22 nt, Homo sapiens
ucuuuagugacaguugugcaag

SEQ ID NO: 186981 - RNA, 22 nt, Homo sapiens
ucuuugguaggaguaggaggcc

SEQ ID NO: 186982 - RNA, 22 nt, Homo sapiens
ucuuugguauuuguggggaauu

SEQ ID NO: 186983 - RNA, 22 nt, Homo sapiens
ucuuugguuagguuuaguugau

SEQ ID NO: 186984 - RNA, 22 nt, Homo sapiens
ucuuugguucuguuuauguaau

SEQ ID NO: 186985 - RNA, 22 nt, Homo sapiens
ucuuugguugcacugcaggugu

SEQ ID NO: 186986 - RNA, 22 nt, Homo sapiens
ucuuuugggccucuugucagac

SEQ ID NO: 186987 - RNA, 18 nt, Homo sapiens
ugaaacacauuuuuuccu

SEQ ID NO: 186988 - RNA, 22 nt, Homo sapiens
ugaaaugcagaacuuuaggucu

SEQ ID NO: 186989 - RNA, 21 nt, Homo sapiens
ugaacacuggacugagugucc

SEQ ID NO: 186990 - RNA, 22 nt, Homo sapiens
ugaaggacauaaggcagaguga

SEQ ID NO: 186991 - RNA, 22 nt, Homo sapiens
ugaagugaaugguaaguaugcc

SEQ ID NO: 186992 - RNA, 22 nt, Homo sapiens
ugaaguguuuuuucaggcaugu

SEQ ID NO: 186993 - RNA, 22 nt, Homo sapiens
ugaauauuugcuacucacucuu

SEQ ID NO: 186994 - RNA, 22 nt, Homo sapiens
ugacaagugauuaaggcauauu

SEQ ID NO: 186995 - RNA, 22 nt, Homo sapiens
ugacagugugagauccugucuc

SEQ ID NO: 186996 - RNA, 22 nt, Homo sapiens
ugagaacaugugauauuuggug

SEQ ID NO: 186997 - RNA, 22 nt, Homo sapiens
ugagaaugaugauuuccaguuu

SEQ ID NO: 186998 - RNA, 22 nt, Homo sapiens
ugagacggagucuugcccuguc

SEQ ID NO: 186999 - RNA, 22 nt, Homo sapiens
ugagacugaguuuugccuuugu

SEQ ID NO: 187000 - RNA, 22 nt, Homo sapiens
ugagagcuuugaugcacuguuu

SEQ ID NO: 187001 - RNA, 22 nt, Homo sapiens
ugagaggugauaaagcaagggu

SEQ ID NO: 187002 - RNA, 22 nt, Homo sapiens
ugagauagggucucacucuguc

SEQ ID NO: 187003 - RNA, 22 nt, Homo sapiens
ugagauauauauauuugagaca

SEQ ID NO: 187004 - RNA, 22 nt, Homo sapiens
ugagaucuuggaggcuuuguga

SEQ ID NO: 187005 - RNA, 22 nt, Homo sapiens
ugagaugcauauucuggcuccu

SEQ ID NO: 187006 - RNA, 22 nt, Homo sapiens
ugagauggaguuucacuuuugu

SEQ ID NO: 187007 - RNA, 22 nt, Homo sapiens
ugagaugguaaauuuuuguugu

SEQ ID NO: 187008 - RNA, 22 nt, Homo sapiens
ugagauguggcuagagagguug

SEQ ID NO: 187009 - RNA, 22 nt, Homo sapiens
ugagccaaguucacaccauugc

SEQ ID NO: 187010 - RNA, 22 nt, Homo sapiens
ugaggugaggguaucaaaugcu

SEQ ID NO: 187011 - RNA, 22 nt, Homo sapiens
ugagguguauugggggaaauuc

SEQ ID NO: 187012 - RNA, 22 nt, Homo sapiens
ugaguagcuaagacgauaggca

SEQ ID NO: 187013 - RNA, 22 nt, Homo sapiens
ugaguucaugcuuguaguucua

SEQ ID NO: 187014 - RNA, 22 nt, Homo sapiens
ugaguuccuugugugaccuugc

SEQ ID NO: 187015 - RNA, 22 nt, Homo sapiens
ugcaccacacuccauccugggc

SEQ ID NO: 187016 - RNA, 22 nt, Homo sapiens
ugcaccacuacacuccaggcug

SEQ ID NO: 187017 - RNA, 22 nt, Homo sapiens
ugcaccacugcacuccaggcug

SEQ ID NO: 187018 - RNA, 21 nt, Homo sapiens
ugcagccauucagcccuaugc

SEQ ID NO: 187019 - RNA, 22 nt, Homo sapiens
ugcauauucuaggauuuuguau

SEQ ID NO: 187020 - RNA, 22 nt, Homo sapiens
ugcauggaggagcuccccgcag

SEQ ID NO: 187021 - RNA, 19 nt, Homo sapiens
ugccaagaaagucagcuua

SEQ ID NO: 187022 - RNA, 22 nt, Homo sapiens
ugcugcuguuaucauuuuacca

SEQ ID NO: 187023 - RNA, 22 nt, Homo sapiens
uggaagacaaguguuagcaugg

SEQ ID NO: 187024 - RNA, 22 nt, Homo sapiens
uggaagacacauaccugauaac

SEQ ID NO: 187025 - RNA, 22 nt, Homo sapiens
uggaagacauugggugaagggu

SEQ ID NO: 187026 - RNA, 23 nt, Homo sapiens
uggaagacuccucucuuggcugc

SEQ ID NO: 187027 - RNA, 22 nt, Homo sapiens
uggaagguaaguuuugagcauu

SEQ ID NO: 187028 - RNA, 22 nt, Homo sapiens
uggaagugaacaaccaaggcag

SEQ ID NO: 187029 - RNA, 22 nt, Homo sapiens
uggaaucaucaacgaaugaaau

SEQ ID NO: 187030 - RNA, 21 nt, Homo sapiens
uggaugccuaggcagaaguuu

SEQ ID NO: 187031 - RNA, 19 nt, Homo sapiens
uggauuguuagagcagugu

SEQ ID NO: 187032 - RNA, 20 nt, Homo sapiens
uggcaagauggcagaauaga

SEQ ID NO: 187033 - RNA, 22 nt, Homo sapiens
uggcagauagaaaugugguuaa

SEQ ID NO: 187034 - RNA, 22 nt, Homo sapiens
uuguagaucuucaguugcuaca

SEQ ID NO: 187035 - RNA, 22 nt, Homo sapiens
uuguccacugcuagccucugca

SEQ ID NO: 187036 - RNA, 22 nt, Homo sapiens
uugugagggagcuaagaugagu

SEQ ID NO: 187037 - RNA, 22 nt, Homo sapiens
uugugcuugcuguguucuaugc

SEQ ID NO: 187038 - RNA, 22 nt, Homo sapiens
uugugucaaauggcaauuagca

SEQ ID NO: 187039 - RNA, 17 nt, Homo sapiens
uuucagaguggaagugu

SEQ ID NO: 187040 - RNA, 22 nt, Homo sapiens
uuucauggcaguuuggggccug

SEQ ID NO: 187041 - RNA, 22 nt, Homo sapiens
uuuggcuuaagauugacugcaa

SEQ ID NO: 187042 - RNA, 22 nt, Homo sapiens
uuuggucagcugcgggucagcu

SEQ ID NO: 187043 - RNA, 22 nt, Homo sapiens
uuuggucuuuuauuuaaagcag

SEQ ID NO: 187044 - RNA, 22 nt, Homo sapiens
uuuggucuuuuguaaguuaucu

SEQ ID NO: 187045 - RNA, 22 nt, Homo sapiens
uuuguguccccacccaaaucuc

SEQ ID NO: 187046 - RNA, 20 nt, Homo sapiens
uuuuagcacuuguuauggug

SEQ ID NO: 187047 - RNA, 22 nt, Homo sapiens
uuuucacggugucccagagagu

SEQ ID NO: 187048 - RNA, 21 nt, Homo sapiens
uuuuggucauucaggaagaaa

SEQ ID NO: 187049 - RNA, 22 nt, Homo sapiens
uuuugguuuuauccagggucuc

SEQ ID NO: 187050 - RNA, 20 nt, Homo sapiens
gcauaugucuuuauagcaga

SEQ ID NO: 187051 - RNA, 22 nt, Homo sapiens
gccaagaugcugcccacagaca

SEQ ID NO: 187052 - RNA, 22 nt, Homo sapiens
gccauugcacuccagccugagc

SEQ ID NO: 187053 - RNA, 23 nt, Homo sapiens
gcuaggagagaugaaacacaggu

SEQ ID NO: 187054 - RNA, 22 nt, Homo sapiens
gcugagaucucuugccugaacu

SEQ ID NO: 187055 - RNA, 20 nt, Homo sapiens
gcugugcuuaauacacuuuc

SEQ ID NO: 187056 - RNA, 22 nt, Homo sapiens
gcuugguccccacccaaaucgc

SEQ ID NO: 187057 - RNA, 22 nt, Homo sapiens
gcuuuguuguugaugggaaauc

SEQ ID NO: 187058 - RNA, 22 nt, Homo sapiens
ggacuagaggugaaaagaagac

SEQ ID NO: 187059 - RNA, 22 nt, Homo sapiens
ggagugucagaaacaguguccu

SEQ ID NO: 187060 - RNA, 23 nt, Homo sapiens
ggauucaucuguuuguucgcugu

SEQ ID NO: 187061 - RNA, 22 nt, Homo sapiens
ggcaagcucaggccucaggugu

SEQ ID NO: 187062 - RNA, 22 nt, Homo sapiens
ggcacugugaugugagggggua

SEQ ID NO: 187063 - RNA, 22 nt, Homo sapiens
ggcacuguggcucaagccugua

SEQ ID NO: 187064 - RNA, 22 nt, Homo sapiens
ggcuagauauucacauauggcu

SEQ ID NO: 187065 - RNA, 19 nt, Homo sapiens
ggcucagucaacugacugu

SEQ ID NO: 187066 - RNA, 22 nt, Homo sapiens
ggcuuuggucacacaggggcaa

SEQ ID NO: 187067 - RNA, 22 nt, Homo sapiens
gggaagugugguuucuuuacag

SEQ ID NO: 187068 - RNA, 22 nt, Homo sapiens
ggucugguguugaaauucuuca

SEQ ID NO: 187069 - RNA, 22 nt, Homo sapiens
gguggucuuccccuggaguucg

SEQ ID NO: 187070 - RNA, 22 nt, Homo sapiens
guaagugguagagcugggcuau

SEQ ID NO: 187071 - RNA, 22 nt, Homo sapiens
guaaugcacucccaaagaucca

SEQ ID NO: 187072 - RNA, 22 nt, Homo sapiens
guacacauacauauaugugugu

SEQ ID NO: 187073 - RNA, 22 nt, Homo sapiens
guaguuuaucagaaagaauagg

SEQ ID NO: 187074 - RNA, 22 nt, Homo sapiens
guauacuucugaaaauagcuau

SEQ ID NO: 187075 - RNA, 22 nt, Homo sapiens
guauggcaugcaugagaauuuc

SEQ ID NO: 187076 - RNA, 22 nt, Homo sapiens
guauggcauuuguggauuggcc

SEQ ID NO: 187077 - RNA, 19 nt, Homo sapiens
guauuugacuuucuuguuu

SEQ ID NO: 187078 - RNA, 22 nt, Homo sapiens
gucacagcuggcauugucugca

SEQ ID NO: 187079 - RNA, 22 nt, Homo sapiens
gucauaugcucggaaaauguua

SEQ ID NO: 187080 - RNA, 22 nt, Homo sapiens
guccaguacucuuuccugaaaa

SEQ ID NO: 187081 - RNA, 22 nt, Homo sapiens
guccaugagaugaauccacaca

SEQ ID NO: 187082 - RNA, 22 nt, Homo sapiens
gucucccaaccccugugcccag

SEQ ID NO: 187083 - RNA, 22 nt, Homo sapiens
gucucccagccuacauauuucu

SEQ ID NO: 187084 - RNA, 22 nt, Homo sapiens
gucucuuguuaucauuucugag

SEQ ID NO: 187085 - RNA, 22 nt, Homo sapiens
gucugucuuuugucuuugaaau

SEQ ID NO: 187086 - RNA, 20 nt, Homo sapiens
gucuugcuccguugcccagg

SEQ ID NO: 187087 - RNA, 22 nt, Homo sapiens
uaugucuuuugcuugcaaauag

SEQ ID NO: 187088 - RNA, 22 nt, Homo sapiens
uauuaguuuucuguggauuaca

SEQ ID NO: 187089 - RNA, 22 nt, Homo sapiens
uauugaauuuuuaagcccuuug

SEQ ID NO: 187090 - RNA, 22 nt, Homo sapiens
uauugauuaauugugauuaggc

SEQ ID NO: 187091 - RNA, 22 nt, Homo sapiens
uauugccugucuccaaaaauca

SEQ ID NO: 187092 - RNA, 22 nt, Homo sapiens
ucaaacauccccaccagggacu

SEQ ID NO: 187093 - RNA, 22 nt, Homo sapiens
ucaaagugacaaaguugcagca

SEQ ID NO: 187094 - RNA, 22 nt, Homo sapiens
ucaaagugagcuccuucucacu

SEQ ID NO: 187095 - RNA, 21 nt, Homo sapiens
ucaaaguguucuuuuguugaa

SEQ ID NO: 187096 - RNA, 18 nt, Homo sapiens
ucacaaccacagugcugu

SEQ ID NO: 187097 - RNA, 22 nt, Homo sapiens
ucacagccuaguuuuauacauu

SEQ ID NO: 187098 - RNA, 22 nt, Homo sapiens
ucacagucggugacuucuugcu

SEQ ID NO: 187099 - RNA, 22 nt, Homo sapiens
ucacaucucagguuucuugaca

SEQ ID NO: 187100 - RNA, 22 nt, Homo sapiens
ucacauguguaugagcuuugau

SEQ ID NO: 187101 - RNA, 20 nt, Homo sapiens
ucacccugacaucugcccag

SEQ ID NO: 187102 - RNA, 21 nt, Homo sapiens
ucaccuguagcugcauguucu

SEQ ID NO: 187103 - RNA, 22 nt, Homo sapiens
ucacugaaaccgccuccaccuc

SEQ ID NO: 187104 - RNA, 22 nt, Homo sapiens
ucacugaaaccuccgccuucug

SEQ ID NO: 187105 - RNA, 22 nt, Homo sapiens
ucacugcacuagguaaugccac

SEQ ID NO: 187106 - RNA, 22 nt, Homo sapiens
ucacugcacucuccgccuugcg

SEQ ID NO: 187107 - RNA, 22 nt, Homo sapiens
ucacugcgaccuccaccucccg

SEQ ID NO: 187108 - RNA, 22 nt, Homo sapiens
ucacugcgaccuccaccuccug

SEQ ID NO: 187109 - RNA, 22 nt, Homo sapiens
ucacuggacagaaauaaaggug

SEQ ID NO: 187110 - RNA, 21 nt, Homo sapiens
ucagggaccugcuguacugau

SEQ ID NO: 187111 - RNA, 22 nt, Homo sapiens
ucaggugcagagaagaaauggg

SEQ ID NO: 187112 - RNA, 22 nt, Homo sapiens
ucagucauugauggaguagguc

SEQ ID NO: 187113 - RNA, 22 nt, Homo sapiens
ucagugcaggaaucucuagcca

SEQ ID NO: 187114 - RNA, 22 nt, Homo sapiens
ucagugccauugccauaugagu

SEQ ID NO: 187115 - RNA, 22 nt, Homo sapiens
ucaguggauuauuaaagucacc

SEQ ID NO: 187116 - RNA, 22 nt, Homo sapiens
ucauauguaugugcaauuuugu

SEQ ID NO: 187117 - RNA, 21 nt, Homo sapiens
ucaucagucaaagacaauggu

SEQ ID NO: 187118 - RNA, 22 nt, Homo sapiens
ucaucuggcgaaugugaagagu

SEQ ID NO: 187119 - RNA, 22 nt, Homo sapiens
ucauggcacugaugagaguuuc

SEQ ID NO: 187120 - RNA, 22 nt, Homo sapiens
ucaugucuuguuguauuuauuu

SEQ ID NO: 187121 - RNA, 22 nt, Homo sapiens
uccaguacaggucucucauuuc

SEQ ID NO: 187122 - RNA, 22 nt, Homo sapiens
uccauaguugcacucuggagcc

SEQ ID NO: 187123 - RNA, 22 nt, Homo sapiens
uccauuuguagguagugagaca

SEQ ID NO: 187124 - RNA, 22 nt, Homo sapiens
uccccgucacacgcaggcuuac

SEQ ID NO: 187125 - RNA, 22 nt, Homo sapiens
uccugagacugaggagcuuugg

SEQ ID NO: 187126 - RNA, 22 nt, Homo sapiens
cagguaggccaauguuuuccaa

SEQ ID NO: 187127 - RNA, 22 nt, Homo sapiens
caggugcauuggcugacaccug

SEQ ID NO: 187128 - RNA, 22 nt, Homo sapiens
cagugcaaccuccaucucucgg

SEQ ID NO: 187129 - RNA, 20 nt, Homo sapiens
cagugcauugcuucugauuu

SEQ ID NO: 187130 - RNA, 22 nt, Homo sapiens
caucaaaguggagggaaggacc

SEQ ID NO: 187131 - RNA, 22 nt, Homo sapiens
cauugggugagaacaugcuccu

SEQ ID NO: 187132 - RNA, 22 nt, Homo sapiens
ccacugcacuccagcccggcaa

SEQ ID NO: 187133 - RNA, 18 nt, Homo sapiens
ccagugcaaggaaagccc

SEQ ID NO: 187134 - RNA, 22 nt, Homo sapiens
ccaucccuuucugagcaguucc

SEQ ID NO: 187135 - RNA, 22 nt, Homo sapiens
ccaugaacuagaauagaacaug

SEQ ID NO: 187136 - RNA, 22 nt, Homo sapiens
ccauggcuucugcauucuguca

SEQ ID NO: 187137 - RNA, 17 nt, Homo sapiens
cccuaguagcugggacu

SEQ ID NO: 187138 - RNA, 22 nt, Homo sapiens
cccuguguuuagcugaagguuu

SEQ ID NO: 187139 - RNA, 22 nt, Homo sapiens
cccuugcacuucagagcugcau

SEQ ID NO: 187140 - RNA, 22 nt, Homo sapiens
ccucccuuuguugcaagggaaa

SEQ ID NO: 187141 - RNA, 22 nt, Homo sapiens
cgcaguguuugugucccugggu

SEQ ID NO: 187142 - RNA, 22 nt, Homo sapiens
cuaaaguauugagugguaaaga

SEQ ID NO: 187143 - RNA, 23 nt, Homo sapiens
cuaaagucugucacugaggacuu

SEQ ID NO: 187144 - RNA, 22 nt, Homo sapiens
cuaaucuagccuuauaaguauu

SEQ ID NO: 187145 - RNA, 22 nt, Homo sapiens
cuaaugcagucaggagaaggaa

SEQ ID NO: 187146 - RNA, 22 nt, Homo sapiens
cuacagcagcccaguccccgaa

SEQ ID NO: 187147 - RNA, 22 nt, Homo sapiens
cuagcuccauauaaagcaggau

SEQ ID NO: 187148 - RNA, 22 nt, Homo sapiens
cuaggaaguauguguuauugcu

SEQ ID NO: 187149 - RNA, 22 nt, Homo sapiens
cuaggcuguagagaaguucagu

SEQ ID NO: 187150 - RNA, 22 nt, Homo sapiens
cuauauacugccugcugauuag

SEQ ID NO: 187151 - RNA, 22 nt, Homo sapiens
cucaaguaauccucccgccuug

SEQ ID NO: 187152 - RNA, 22 nt, Homo sapiens
cucacggcccugcgcacuggca

SEQ ID NO: 187153 - RNA, 22 nt, Homo sapiens
cucacugcauuucaguuuuguu

SEQ ID NO: 187154 - RNA, 22 nt, Homo sapiens
cucacugggaccacucugaagu

SEQ ID NO: 187155 - RNA, 22 nt, Homo sapiens
cucagcaguggauuuaccacca

SEQ ID NO: 187156 - RNA, 22 nt, Homo sapiens
cuccaguacagagagguuccuc

SEQ ID NO: 187157 - RNA, 22 nt, Homo sapiens
cucccagagccaguuauaggcu

SEQ ID NO: 187158 - RNA, 22 nt, Homo sapiens
uggccaguguuuuuccugggcu

SEQ ID NO: 187159 - RNA, 22 nt, Homo sapiens
uggccaguugaagacaaugcuc

SEQ ID NO: 187160 - RNA, 22 nt, Homo sapiens
uggccaguuuuuaauugggucu

SEQ ID NO: 187161 - RNA, 22 nt, Homo sapiens
uggcuacagaaaguacuaguga

SEQ ID NO: 187162 - RNA, 22 nt, Homo sapiens
uggcuagaccugcauaacagcu

SEQ ID NO: 187163 - RNA, 22 nt, Homo sapiens
uggcuagauauccagaguucug

SEQ ID NO: 187164 - RNA, 22 nt, Homo sapiens
uggcuuuguaagguuucauuuu

SEQ ID NO: 187165 - RNA, 22 nt, Homo sapiens
ugggaauaugauacaggucuuu

SEQ ID NO: 187166 - RNA, 22 nt, Homo sapiens
ugggaucagcugggcucucugu

SEQ ID NO: 187167 - RNA, 22 nt, Homo sapiens
ugggaucagucuggaauauuga

SEQ ID NO: 187168 - RNA, 22 nt, Homo sapiens
ugggaucauuaugcauagugua

SEQ ID NO: 187169 - RNA, 22 nt, Homo sapiens
ugggguaggcuguauacucugu

SEQ ID NO: 187170 - RNA, 19 nt, Homo sapiens
uggguagugaugagacaua

SEQ ID NO: 187171 - RNA, 22 nt, Homo sapiens
ugguacuucaugcucacagaua

SEQ ID NO: 187172 - RNA, 22 nt, Homo sapiens
ugguagguuuauaaagaauuua

SEQ ID NO: 187173 - RNA, 22 nt, Homo sapiens
uggucuuuucaacaaaugguau

SEQ ID NO: 187174 - RNA, 22 nt, Homo sapiens
ugucaaagagacaucugcacuc

SEQ ID NO: 187175 - RNA, 22 nt, Homo sapiens
ugucacugugcagucaugcauu

SEQ ID NO: 187176 - RNA, 22 nt, Homo sapiens
ugucaguguaugagccccggau

SEQ ID NO: 187177 - RNA, 23 nt, Homo sapiens
ugucaucaagaugaggucacacu

SEQ ID NO: 187178 - RNA, 22 nt, Homo sapiens
ugucccugagccuggauuccug

SEQ ID NO: 187179 - RNA, 22 nt, Homo sapiens
ugucuuugguucaggcaaggag

SEQ ID NO: 187180 - RNA, 22 nt, Homo sapiens
ugugacaguuaguuugguguua

SEQ ID NO: 187181 - RNA, 22 nt, Homo sapiens
ugugcaaauguuaaacuaacuu

SEQ ID NO: 187182 - RNA, 22 nt, Homo sapiens
ugugccaaaucccauaauaaau

SEQ ID NO: 187183 - RNA, 22 nt, Homo sapiens
ugugccacugcacuccugccug

SEQ ID NO: 187184 - RNA, 22 nt, Homo sapiens
ugugcuuguaaaggccagagca

SEQ ID NO: 187185 - RNA, 22 nt, Homo sapiens
uguggaaauggugcuacgaaca

SEQ ID NO: 187186 - RNA, 22 nt, Homo sapiens
uguggcuuuacagcaugguuca

SEQ ID NO: 187187 - RNA, 22 nt, Homo sapiens
uguguuuuuauguaaaauggaa

SEQ ID NO: 187188 - RNA, 22 nt, Homo sapiens
uguugcacuccagccuggguga

SEQ ID NO: 187189 - RNA, 22 nt, Homo sapiens
uguuuaguuaagacauagaauu

SEQ ID NO: 187190 - RNA, 22 nt, Homo sapiens
uguuugcuuaacguggagccag

SEQ ID NO: 187191 - RNA, 22 nt, Homo sapiens
uguuuuguuagcacucugggaa

SEQ ID NO: 187192 - RNA, 22 nt, Homo sapiens
uuaaggcuuuaaguaaacacag

SEQ ID NO: 187193 - RNA, 22 nt, Homo sapiens
uuaauagcaaagaguuuagacu

SEQ ID NO: 187194 - RNA, 17 nt, Homo sapiens
uuacaggugcugagagu

SEQ ID NO: 187195 - RNA, 22 nt, Homo sapiens
uuauagcuaacaucugugaaaa

SEQ ID NO: 187196 - RNA, 22 nt, Homo sapiens
uuauauguuagacauggugggu

SEQ ID NO: 187197 - RNA, 22 nt, Homo sapiens
uuauauguuucuguuuggaggc

SEQ ID NO: 187198 - RNA, 22 nt, Homo sapiens
uuauauguuuguacuuaggccu

SEQ ID NO: 187199 - RNA, 22 nt, Homo sapiens
uuaugccagugauuauaagggc

SEQ ID NO: 187200 - RNA, 22 nt, Homo sapiens
uucaaaaccucugcuuaagccc

SEQ ID NO: 187201 - RNA, 23 nt, Homo sapiens
uucaccguguuggccaggcuggu

SEQ ID NO: 187202 - RNA, 22 nt, Homo sapiens
uucacugcacuccagccugagc

SEQ ID NO: 187203 - RNA, 22 nt, Homo sapiens
uucacuggagcccaggaguugg

SEQ ID NO: 187204 - RNA, 22 nt, Homo sapiens
uucaggcuccgugccagcuccg

SEQ ID NO: 187205 - RNA, 22 nt, Homo sapiens
uucaggcuuuuauuuacugaua

SEQ ID NO: 187206 - RNA, 22 nt, Homo sapiens
uucaguggguggaugaauauga

SEQ ID NO: 187207 - RNA, 22 nt, Homo sapiens
uucauagaggacauuacuggag

SEQ ID NO: 187208 - RNA, 22 nt, Homo sapiens
uucauaguauuuuucuccaaau

SEQ ID NO: 187209 - RNA, 22 nt, Homo sapiens
uuccagagucaccuuucugucg

SEQ ID NO: 187210 - RNA, 22 nt, Homo sapiens
uuccaguguguucauccucaga

SEQ ID NO: 187211 - RNA, 22 nt, Homo sapiens
uuccaguguuugacucaccuuu

SEQ ID NO: 187212 - RNA, 22 nt, Homo sapiens
uuccuaguccugagucucugcg

SEQ ID NO: 187213 - RNA, 22 nt, Homo sapiens
uuccugagccuuguaucuagua

SEQ ID NO: 187214 - RNA, 22 nt, Homo sapiens
uuccugaggccuccccagaagc

SEQ ID NO: 187215 - RNA, 22 nt, Homo sapiens
uuccuguagcgauuuuaguaau

SEQ ID NO: 187216 - RNA, 22 nt, Homo sapiens
uucuaaacaucuuacaaugcau

SEQ ID NO: 187217 - RNA, 22 nt, Homo sapiens
uucuauggucacagaugcuuga

SEQ ID NO: 187218 - RNA, 22 nt, Homo sapiens
uucuaugguuaccaggcuaguc

SEQ ID NO: 187219 - RNA, 22 nt, Homo sapiens
uucucuggucagaggggagguu

SEQ ID NO: 187220 - RNA, 22 nt, Homo sapiens
uucuggcuuuuaaagaaauguu

SEQ ID NO: 187221 - RNA, 22 nt, Homo sapiens
uucuucaguuacaacaaggggg

SEQ ID NO: 187222 - RNA, 22 nt, Homo sapiens
uucuugcuguauccucacaugg

SEQ ID NO: 187223 - RNA, 22 nt, Homo sapiens
uugaaagacaucaccuacugcu

SEQ ID NO: 187224 - RNA, 22 nt, Homo sapiens
uugaaaguaaacaucacaaaga

SEQ ID NO: 187225 - RNA, 22 nt, Homo sapiens
uugaaagucauuucuucuaagu

SEQ ID NO: 187226 - RNA, 22 nt, Homo sapiens
uugaaagucuaggcuuacagua

SEQ ID NO: 187227 - RNA, 22 nt, Homo sapiens
uugagacggagucuugcucuuu

SEQ ID NO: 187228 - RNA, 22 nt, Homo sapiens
uugagauggaaucucgcuuugu

SEQ ID NO: 187229 - RNA, 22 nt, Homo sapiens
uugagauggagucucgcucuuu

SEQ ID NO: 187230 - RNA, 22 nt, Homo sapiens
uugagauggaguuucgcucuuu

SEQ ID NO: 187231 - RNA, 22 nt, Homo sapiens
aaaagagcugagagguauucuu

SEQ ID NO: 187232 - RNA, 22 nt, Homo sapiens
aaagugcaguauuugggcagga

SEQ ID NO: 187233 - RNA, 22 nt, Homo sapiens
aaagugcugagauuguaggcau

SEQ ID NO: 187234 - RNA, 22 nt, Homo sapiens
aaagugcugggauuaggccagg

SEQ ID NO: 187235 - RNA, 22 nt, Homo sapiens
aaagugcuuacuaaguugccaa

SEQ ID NO: 187236 - RNA, 22 nt, Homo sapiens
aacaggguggugccugguccau

SEQ ID NO: 187237 - RNA, 22 nt, Homo sapiens
aaccuuuagucagcucuuagga

SEQ ID NO: 187238 - RNA, 22 nt, Homo sapiens
aagagagcuaugugcauaauua

SEQ ID NO: 187239 - RNA, 22 nt, Homo sapiens
aagagcgcugauaacauguuug

SEQ ID NO: 187240 - RNA, 20 nt, Homo sapiens
aagagcucaccagaauaucu

SEQ ID NO: 187241 - RNA, 22 nt, Homo sapiens
aagcuggagugcaguggugcga

SEQ ID NO: 187242 - RNA, 22 nt, Homo sapiens
aaggcaagagaaaauuucgagu

SEQ ID NO: 187243 - RNA, 22 nt, Homo sapiens
aaguacuguuuaaauugcagaa

SEQ ID NO: 187244 - RNA, 22 nt, Homo sapiens
aaguagcuggaugcaguggcac

SEQ ID NO: 187245 - RNA, 22 nt, Homo sapiens
ccuggcaagagacugaagauag

SEQ ID NO: 187246 - RNA, 19 nt, Homo sapiens
ccuuugguuuccaugacau

SEQ ID NO: 187247 - RNA, 23 nt, Homo sapiens
cuacagugccugucucuuuggcc

SEQ ID NO: 187248 - RNA, 22 nt, Homo sapiens
cuagaggcacagccuaggcacu

SEQ ID NO: 187249 - RNA, 22 nt, Homo sapiens
cuagccuggagugcaguggugc

SEQ ID NO: 187250 - RNA, 22 nt, Homo sapiens
cuauaugucuguuuugguacca

SEQ ID NO: 187251 - RNA, 22 nt, Homo sapiens
cuaucugcacaggguggaaauu

SEQ ID NO: 187252 - RNA, 18 nt, Homo sapiens
cuaugccacuuuauauca

SEQ ID NO: 187253 - RNA, 22 nt, Homo sapiens
cuauucacaggcaauauguaca

SEQ ID NO: 187254 - RNA, 22 nt, Homo sapiens
cucaaaguguggucuguggguu

SEQ ID NO: 187255 - RNA, 18 nt, Homo sapiens
cucaaccucaugcagggc

SEQ ID NO: 187256 - RNA, 22 nt, Homo sapiens
cucauggauggucuggcagcca

SEQ ID NO: 187257 - RNA, 22 nt, Homo sapiens
cucuuggguagauuuugcagag

SEQ ID NO: 187258 - RNA, 22 nt, Homo sapiens
cucuuugaguuccuccuggugu

SEQ ID NO: 187259 - RNA, 22 nt, Homo sapiens
cugacuuuagaacccaaaaagu

SEQ ID NO: 187260 - RNA, 22 nt, Homo sapiens
cugagacacucuuaucugcaua

SEQ ID NO: 187261 - RNA, 22 nt, Homo sapiens
cugagcaucauggcagaaucuu

SEQ ID NO: 187262 - RNA, 22 nt, Homo sapiens
cugagguaggugaucagugcuu

SEQ ID NO: 187263 - RNA, 22 nt, Homo sapiens
cugaggugggagaaucacauaa

SEQ ID NO: 187264 - RNA, 22 nt, Homo sapiens
cugaggugggaguuuuucucau

SEQ ID NO: 187265 - RNA, 18 nt, Homo sapiens
cugagucauuccuggguc

SEQ ID NO: 187266 - RNA, 22 nt, Homo sapiens
cugaugaaguauuuguucugga

SEQ ID NO: 187267 - RNA, 22 nt, Homo sapiens
cugccugagaaaauggagggca

SEQ ID NO: 187268 - RNA, 22 nt, Homo sapiens
cuggaauuacaggguugagcua

SEQ ID NO: 187269 - RNA, 22 nt, Homo sapiens
cuggauagucaggagauauaua

SEQ ID NO: 187270 - RNA, 22 nt, Homo sapiens
cuggcucauuucauuuagcaua

SEQ ID NO: 187271 - RNA, 22 nt, Homo sapiens
cuggcucugagguguuuagggc

SEQ ID NO: 187272 - RNA, 22 nt, Homo sapiens
cugggaucaguucuagucagaa

SEQ ID NO: 187273 - RNA, 22 nt, Homo sapiens
cuuccaaguggggcacgugcca

SEQ ID NO: 187274 - RNA, 22 nt, Homo sapiens
cuuggcuucuuuauguggcuau

SEQ ID NO: 187275 - RNA, 22 nt, Homo sapiens
cuuuacacauccuaaccagugu

SEQ ID NO: 187276 - RNA, 21 nt, Homo sapiens
cuuuaugcuguguuagaaaag

SEQ ID NO: 187277 - RNA, 22 nt, Homo sapiens
cuuucacacuguuggugggaau

SEQ ID NO: 187278 - RNA, 22 nt, Homo sapiens
cuuugggaccgcgguuuauacu

SEQ ID NO: 187279 - RNA, 23 nt, Homo sapiens
cuuuggucucugguugacuucag

SEQ ID NO: 187280 - RNA, 22 nt, Homo sapiens
cuuugguuaauaggauauggca

SEQ ID NO: 187281 - RNA, 21 nt, Homo sapiens
cuuugguuucugacuugcaua

SEQ ID NO: 187282 - RNA, 22 nt, Homo sapiens
cuuuuggugguucugaugcagg

SEQ ID NO: 187283 - RNA, 22 nt, Homo sapiens
cuuuugugauucuucaguuacu

SEQ ID NO: 187284 - RNA, 22 nt, Homo sapiens
gaaagcuaaugacuuuggguga

SEQ ID NO: 187285 - RNA, 22 nt, Homo sapiens
gaaggcacugugugccacccug

SEQ ID NO: 187286 - RNA, 22 nt, Homo sapiens
gaaugcaugaggggaucagaug

SEQ ID NO: 187287 - RNA, 18 nt, Homo sapiens
gacucaguuucuaaggca

SEQ ID NO: 187288 - RNA, 22 nt, Homo sapiens
gacuggccuauaauggcgaauu

SEQ ID NO: 187289 - RNA, 22 nt, Homo sapiens
gagaagugcgucguuugaugau

SEQ ID NO: 187290 - RNA, 22 nt, Homo sapiens
gagaugguacacauacgauucu

SEQ ID NO: 187291 - RNA, 22 nt, Homo sapiens
gagcacauguggagagucuggg

SEQ ID NO: 187292 - RNA, 22 nt, Homo sapiens
gagcaccagucccugucagugc

SEQ ID NO: 187293 - RNA, 22 nt, Homo sapiens
gagcacccuuuguugauugcaa

SEQ ID NO: 187294 - RNA, 22 nt, Homo sapiens
gagcaucaguggccucaucuca

SEQ ID NO: 187295 - RNA, 22 nt, Homo sapiens
gaggaaguaauuuuaggccugu

SEQ ID NO: 187296 - RNA, 22 nt, Homo sapiens
gaggacauuaugcuaaguggaa

SEQ ID NO: 187297 - RNA, 22 nt, Homo sapiens
gaggaucucuugagcccagaag

SEQ ID NO: 187298 - RNA, 22 nt, Homo sapiens
gaggugguagguucacagcagc

SEQ ID NO: 187299 - RNA, 22 nt, Homo sapiens
gaguaaauguccuagcuucuug

SEQ ID NO: 187300 - RNA, 23 nt, Homo sapiens
gagugcaaugacaugaucucgga

SEQ ID NO: 187301 - RNA, 22 nt, Homo sapiens
gagugcaauggcgcgaucuggg

SEQ ID NO: 187302 - RNA, 22 nt, Homo sapiens
gaguucauuuugaaaccuugau

SEQ ID NO: 187303 - RNA, 22 nt, Homo sapiens
gauauguguaucuauguacaug

SEQ ID NO: 187304 - RNA, 22 nt, Homo sapiens
gaucacaguuccucacgggcau

SEQ ID NO: 187305 - RNA, 22 nt, Homo sapiens
gaugacagugaguaaccccaac

SEQ ID NO: 187306 - RNA, 22 nt, Homo sapiens
gauuugagagaggguguuuaua

SEQ ID NO: 187307 - RNA, 22 nt, Homo sapiens
gcacgugcacccacaugcacgu

SEQ ID NO: 187308 - RNA, 22 nt, Homo sapiens
gcacugagagaagccccaagua

SEQ ID NO: 187309 - RNA, 22 nt, Homo sapiens
gcagagaaacaggucuaaggag

SEQ ID NO: 187310 - RNA, 20 nt, Homo sapiens
gcagcaccauauuucuaaga

SEQ ID NO: 187311 - RNA, 22 nt, Homo sapiens
gcaggaaucuugagaaggauuc

SEQ ID NO: 187312 - RNA, 22 nt, Homo sapiens
gcagguguuaugcaaacaacug

SEQ ID NO: 187313 - RNA, 22 nt, Homo sapiens
gcagugcaguggcgcgaucucg

SEQ ID NO: 187314 - RNA, 22 nt, Homo sapiens
gcaguguucugggcaggaagaa

SEQ ID NO: 187315 - RNA, 22 nt, Homo sapiens
gccaaaaugcugggauuacagg

SEQ ID NO: 187316 - RNA, 22 nt, Homo sapiens
gccaagaucugaauaauuaaga

SEQ ID NO: 187317 - RNA, 22 nt, Homo sapiens
gccaagauugguuuaauauucc

SEQ ID NO: 187318 - RNA, 22 nt, Homo sapiens
gcuagcacauugucaccucuca

SEQ ID NO: 187319 - RNA, 19 nt, Homo sapiens
gcucaccuugcugcuccag

SEQ ID NO: 187320 - RNA, 22 nt, Homo sapiens
gcugagguucaagaagguuaaa

SEQ ID NO: 187321 - RNA, 22 nt, Homo sapiens
gcuggucugccguaguaggugc

SEQ ID NO: 187322 - RNA, 22 nt, Homo sapiens
gcuguguugugcccagcaucau

SEQ ID NO: 187323 - RNA, 22 nt, Homo sapiens
ggacaagagacugggacacuga

SEQ ID NO: 187324 - RNA, 22 nt, Homo sapiens
ggacagugaaugccacuccucc

SEQ ID NO: 187325 - RNA, 22 nt, Homo sapiens
ggacaucauuaccauggaccca

SEQ ID NO: 187326 - RNA, 22 nt, Homo sapiens
ggacuggaagcauauuuauuuu

SEQ ID NO: 187327 - RNA, 20 nt, Homo sapiens
ggagguuguauaaguacauc

SEQ ID NO: 187328 - RNA, 22 nt, Homo sapiens
ggaucacagccagcucccagaa

SEQ ID NO: 187329 - RNA, 22 nt, Homo sapiens
ggcauguuuaguagaauguggu

SEQ ID NO: 187330 - RNA, 22 nt, Homo sapiens
ggcuagaugcuagagauaucau

SEQ ID NO: 187331 - RNA, 22 nt, Homo sapiens
ugucaguggucuggaugcagcc

SEQ ID NO: 187332 - RNA, 22 nt, Homo sapiens
ugucaugucuuuguguaucaau

SEQ ID NO: 187333 - RNA, 18 nt, Homo sapiens
ugucccuuugcuguucau

SEQ ID NO: 187334 - RNA, 22 nt, Homo sapiens
ugucucagugauuggcuuucug

SEQ ID NO: 187335 - RNA, 22 nt, Homo sapiens
ugugaacagaauuagucaccua

SEQ ID NO: 187336 - RNA, 22 nt, Homo sapiens
ugugaacauuuuguauauauua

SEQ ID NO: 187337 - RNA, 22 nt, Homo sapiens
ugugaauggugcugcaaugaac

SEQ ID NO: 187338 - RNA, 22 nt, Homo sapiens
ugugcaaaaacaauugcgguuu

SEQ ID NO: 187339 - RNA, 22 nt, Homo sapiens
ugugcaaauuagcacaacccga

SEQ ID NO: 187340 - RNA, 22 nt, Homo sapiens
uguggaaauuguuguauuuaau

SEQ ID NO: 187341 - RNA, 22 nt, Homo sapiens
ugugucuugaauuuuguaugua

SEQ ID NO: 187342 - RNA, 22 nt, Homo sapiens
uguuacagugacuaauguuuua

SEQ ID NO: 187343 - RNA, 23 nt, Homo sapiens
uuaagcaacggcugcuuuucaga

SEQ ID NO: 187344 - RNA, 22 nt, Homo sapiens
uuaaggaaagcauuuaauucag

SEQ ID NO: 187345 - RNA, 22 nt, Homo sapiens
uuacaaguggcaucucucugga

SEQ ID NO: 187346 - RNA, 22 nt, Homo sapiens
uuacagguggagaaguaaggcu

SEQ ID NO: 187347 - RNA, 22 nt, Homo sapiens
uuaccuuuuuaagacagguuag

SEQ ID NO: 187348 - RNA, 19 nt, Homo sapiens
uuagagaucaucugcuuca

SEQ ID NO: 187349 - RNA, 22 nt, Homo sapiens
uuagcacaucuuucuauguaag

SEQ ID NO: 187350 - RNA, 22 nt, Homo sapiens
uuaguuuaucagugguuucuga

SEQ ID NO: 187351 - RNA, 23 nt, Homo sapiens
uucaccugguuauuaauagccuc

SEQ ID NO: 187352 - RNA, 22 nt, Homo sapiens
uucacugcacuccagccugggu

SEQ ID NO: 187353 - RNA, 22 nt, Homo sapiens
uucacugcauuucagccugggc

SEQ ID NO: 187354 - RNA, 22 nt, Homo sapiens
uucagggcauuggaguuucuga

SEQ ID NO: 187355 - RNA, 18 nt, Homo sapiens
uucaguuuguaucugggg

SEQ ID NO: 187356 - RNA, 22 nt, Homo sapiens
uucaucagggagaaauaauuuc

SEQ ID NO: 187357 - RNA, 23 nt, Homo sapiens
uucaucagggauauuggccugaa

SEQ ID NO: 187358 - RNA, 22 nt, Homo sapiens
uucaucagggguauuggccaau

SEQ ID NO: 187359 - RNA, 22 nt, Homo sapiens
uucauggaugcauuugaggggu

SEQ ID NO: 187360 - RNA, 22 nt, Homo sapiens
uucaugugagucuguauuaacu

SEQ ID NO: 187361 - RNA, 22 nt, Homo sapiens
uuccuggaggggaaguguccaa

SEQ ID NO: 187362 - RNA, 22 nt, Homo sapiens
uuccuuguagcaaaugcgauga

SEQ ID NO: 187363 - RNA, 22 nt, Homo sapiens
uucuagagagaagacuuaagcu

SEQ ID NO: 187364 - RNA, 22 nt, Homo sapiens
uucuaugguuuuuaugguguua

SEQ ID NO: 187365 - RNA, 22 nt, Homo sapiens
uucucaaggagccuucguaacu

SEQ ID NO: 187366 - RNA, 22 nt, Homo sapiens
uucucagcccccugacagucag

SEQ ID NO: 187367 - RNA, 17 nt, Homo sapiens
uucucaguucugaucuc

SEQ ID NO: 187368 - RNA, 19 nt, Homo sapiens
uucucugguuguacuaccc

SEQ ID NO: 187369 - RNA, 23 nt, Homo sapiens
uucugccacugaaaaugccucag

SEQ ID NO: 187370 - RNA, 22 nt, Homo sapiens
uucuggcucaggucaacacuuc

SEQ ID NO: 187371 - RNA, 22 nt, Homo sapiens
uucugguuaauacuugcaaaaa

SEQ ID NO: 187372 - RNA, 22 nt, Homo sapiens
uucuugguuggcaaccaacagu

SEQ ID NO: 187373 - RNA, 22 nt, Homo sapiens
uucuuuggaaacaguacuaauu

SEQ ID NO: 187374 - RNA, 22 nt, Homo sapiens
uuuguguggccuuggccuggca

SEQ ID NO: 187375 - RNA, 22 nt, Homo sapiens
uuuuaguggacaaagguauuua

SEQ ID NO: 187376 - RNA, 22 nt, Homo sapiens
uuuugcucuugguaaugaaaga

SEQ ID NO: 187377 - RNA, 22 nt, Homo sapiens
uuuugguucaauuaauuugcua

SEQ ID NO: 187378 - RNA, 22 nt, Homo sapiens
uuuuugguugguaggcuauuaa

SEQ ID NO: 187379 - RNA, 22 nt, Homo sapiens
uggagcccuaaacuucuaauau

SEQ ID NO: 187380 - RNA, 22 nt, Homo sapiens
uggagggcuagucauuucuuuu

SEQ ID NO: 187381 - RNA, 22 nt, Homo sapiens
uggagucuugcucuguugccca

SEQ ID NO: 187382 - RNA, 22 nt, Homo sapiens
uggcaaaauggaauauguuggg

SEQ ID NO: 187383 - RNA, 22 nt, Homo sapiens
uggcaagaagagcaugagacca

SEQ ID NO: 187384 - RNA, 22 nt, Homo sapiens
uggcaccugacuccgagaugca

SEQ ID NO: 187385 - RNA, 22 nt, Homo sapiens
uggcagacaaauuugagcauau

SEQ ID NO: 187386 - RNA, 22 nt, Homo sapiens
uggcagaugggugagcuggaga

SEQ ID NO: 187387 - RNA, 22 nt, Homo sapiens
uggcaucuguucuacacauaaa

SEQ ID NO: 187388 - RNA, 20 nt, Homo sapiens
uggcaugaaauuuuccaagc

SEQ ID NO: 187389 - RNA, 22 nt, Homo sapiens
uggcauguguuugaaugaguau

SEQ ID NO: 187390 - RNA, 22 nt, Homo sapiens
uggcauuuuguuuuagaauuag

SEQ ID NO: 187391 - RNA, 23 nt, Homo sapiens
uggcauuuuuggcaaugccuucu

SEQ ID NO: 187392 - RNA, 22 nt, Homo sapiens
uggccagagggcaauuagcugu

SEQ ID NO: 187393 - RNA, 22 nt, Homo sapiens
ccaguguuuggauuagggaugc

SEQ ID NO: 187394 - RNA, 22 nt, Homo sapiens
ccauggcuauucuguaaggguu

SEQ ID NO: 187395 - RNA, 19 nt, Homo sapiens
cccuggcacauggaaaaug

SEQ ID NO: 187396 - RNA, 22 nt, Homo sapiens
gggaagugugcagaguucucuu

SEQ ID NO: 187397 - RNA, 18 nt, Homo sapiens
gggaauauggggaguuga

SEQ ID NO: 187398 - RNA, 22 nt, Homo sapiens
gggccagaugcauuuguuauuu

SEQ ID NO: 187399 - RNA, 22 nt, Homo sapiens
gggguuuuaccuucguauucuu

SEQ ID NO: 187400 - RNA, 22 nt, Homo sapiens
guacccaguagauaguuuuuca

SEQ ID NO: 187401 - RNA, 22 nt, Homo sapiens
guagcagcuacuaaguugcugu

SEQ ID NO: 187402 - RNA, 22 nt, Homo sapiens
guauagaucguagaccaauaaa

SEQ ID NO: 187403 - RNA, 21 nt, Homo sapiens
guauggcauugauuaguuacu

SEQ ID NO: 187404 - RNA, 22 nt, Homo sapiens
gucacaguguuuguucauccca

SEQ ID NO: 187405 - RNA, 22 nt, Homo sapiens
gucagagcacugaguugugggc

SEQ ID NO: 187406 - RNA, 22 nt, Homo sapiens
gucaggaugauuuggggaggug

SEQ ID NO: 187407 - RNA, 22 nt, Homo sapiens
gucaguggagaaaaggacaugu

SEQ ID NO: 187408 - RNA, 22 nt, Homo sapiens
gucaguuugguuaaucauucca

SEQ ID NO: 187409 - RNA, 22 nt, Homo sapiens
gucucuugguuuagagcauuua

SEQ ID NO: 187410 - RNA, 22 nt, Homo sapiens
gugaaguuuuugugaggccuaa

SEQ ID NO: 187411 - RNA, 22 nt, Homo sapiens
gugacaucagcuccagguauaa

SEQ ID NO: 187412 - RNA, 22 nt, Homo sapiens
gugagauggagucuugcuuugu

SEQ ID NO: 187413 - RNA, 22 nt, Homo sapiens
gugagcuccucuucugcugcag

SEQ ID NO: 187414 - RNA, 22 nt, Homo sapiens
gugaggcugguccugccuccca

SEQ ID NO: 187415 - RNA, 22 nt, Homo sapiens
gugagguguuaaccaaccugug

SEQ ID NO: 187416 - RNA, 22 nt, Homo sapiens
gugcaguuuuaagugaguuucu

SEQ ID NO: 187417 - RNA, 22 nt, Homo sapiens
gugcauauaaguuguuucuagu

SEQ ID NO: 187418 - RNA, 22 nt, Homo sapiens
gugccuucuagcuaugguuggc

SEQ ID NO: 187419 - RNA, 23 nt, Homo sapiens
gugccuucugagccuagucucca

SEQ ID NO: 187420 - RNA, 22 nt, Homo sapiens
guggaaggucaugaauguucuu

SEQ ID NO: 187421 - RNA, 22 nt, Homo sapiens
guggagacaaaggcugagugag

SEQ ID NO: 187422 - RNA, 22 nt, Homo sapiens
gugguuuuacaaagagaaagau

SEQ ID NO: 187423 - RNA, 22 nt, Homo sapiens
gugguuuuaucccagaaauuaa

SEQ ID NO: 187424 - RNA, 22 nt, Homo sapiens
gugguuuuuaaaguaccugugg

SEQ ID NO: 187425 - RNA, 22 nt, Homo sapiens
gugguuuuuuucugccuuauag

SEQ ID NO: 187426 - RNA, 22 nt, Homo sapiens
guguaaaucugcugugaacauu

SEQ ID NO: 187427 - RNA, 22 nt, Homo sapiens
gugucaaggaugccugucaggc

SEQ ID NO: 187428 - RNA, 22 nt, Homo sapiens
gugucaguggggagugaucuuc

SEQ ID NO: 187429 - RNA, 22 nt, Homo sapiens
guguccucgaguacacaucagg

SEQ ID NO: 187430 - RNA, 22 nt, Homo sapiens
guucagguauucuggaacagag

SEQ ID NO: 187431 - RNA, 22 nt, Homo sapiens
guucaucagggacacugguuug

SEQ ID NO: 187432 - RNA, 22 nt, Homo sapiens
guugcucaggcuggagugcagu

SEQ ID NO: 187433 - RNA, 22 nt, Homo sapiens
guuggcuguuucccccaaguga

SEQ ID NO: 187434 - RNA, 22 nt, Homo sapiens
uaaagagcuuuugaggugucau

SEQ ID NO: 187435 - RNA, 22 nt, Homo sapiens
uaaaugacugucaguagaugaa

SEQ ID NO: 187436 - RNA, 22 nt, Homo sapiens
uaaaugcucuuuaaaagugcuu

SEQ ID NO: 187437 - RNA, 18 nt, Homo sapiens
uaagaugcagccuauucc

SEQ ID NO: 187438 - RNA, 22 nt, Homo sapiens
uaagccaccgugccuggccuaa

SEQ ID NO: 187439 - RNA, 22 nt, Homo sapiens
uaaguaaaugaaagguugauuu

SEQ ID NO: 187440 - RNA, 22 nt, Homo sapiens
uaagugcuugacuuugauguuu

SEQ ID NO: 187441 - RNA, 20 nt, Homo sapiens
uaagugcuuuauauugauua

SEQ ID NO: 187442 - RNA, 22 nt, Homo sapiens
uaaugcaucagugguaguucuu

SEQ ID NO: 187443 - RNA, 22 nt, Homo sapiens
uaaugcuguggucuaaugggga

SEQ ID NO: 187444 - RNA, 22 nt, Homo sapiens
uaauugcaguucuguguuauau

SEQ ID NO: 187445 - RNA, 22 nt, Homo sapiens
uacagaguauccauuugaguuc

SEQ ID NO: 187446 - RNA, 22 nt, Homo sapiens
uacauagucuucuuuugguuau

SEQ ID NO: 187447 - RNA, 19 nt, Homo sapiens
uacccagaagcagcauugu

SEQ ID NO: 187448 - RNA, 21 nt, Homo sapiens
uacuggagauacagucugcaa

SEQ ID NO: 187449 - RNA, 22 nt, Homo sapiens
uagaggaaugaauuuggccaga

SEQ ID NO: 187450 - RNA, 22 nt, Homo sapiens
uagagguagagugacuucccca

SEQ ID NO: 187451 - RNA, 22 nt, Homo sapiens
uagagguagguguaugaacuag

SEQ ID NO: 187452 - RNA, 17 nt, Homo sapiens
uagcacagugccuggua

SEQ ID NO: 187453 - RNA, 22 nt, Homo sapiens
uagcaccaggguugacugaccu

SEQ ID NO: 187454 - RNA, 22 nt, Homo sapiens
uagcaggaaaccuguguugagg

SEQ ID NO: 187455 - RNA, 22 nt, Homo sapiens
uagcaggaaaggggucagaucu

SEQ ID NO: 187456 - RNA, 21 nt, Homo sapiens
uagcauacauuuugcaucuua

SEQ ID NO: 187457 - RNA, 22 nt, Homo sapiens
uagcauggagucaugcacggcu

SEQ ID NO: 187458 - RNA, 22 nt, Homo sapiens
uagccucacaaagugcuuaaga

SEQ ID NO: 187459 - RNA, 22 nt, Homo sapiens
uaggcuuuuggacccugucucu

SEQ ID NO: 187460 - RNA, 22 nt, Homo sapiens
uagguaguugugggcuugaaug

SEQ ID NO: 187461 - RNA, 22 nt, Homo sapiens
uaggucuccuuuuugccuaaau

SEQ ID NO: 187462 - RNA, 22 nt, Homo sapiens
uaggugauccauuuguauuuua

SEQ ID NO: 187463 - RNA, 22 nt, Homo sapiens
uaguaucacauggucuuaauua

SEQ ID NO: 187464 - RNA, 23 nt, Homo sapiens
uauaugugucuaggagcuauggu

SEQ ID NO: 187465 - RNA, 22 nt, Homo sapiens
uaucacaaacuuagcaguuuaa

SEQ ID NO: 187466 - RNA, 22 nt, Homo sapiens
uaucacagcgggguguacaccc

SEQ ID NO: 187467 - RNA, 22 nt, Homo sapiens
uaucacaggucaggaaucuugc

SEQ ID NO: 187468 - RNA, 22 nt, Homo sapiens
uaucacaguaaaucugggugca

SEQ ID NO: 187469 - RNA, 21 nt, Homo sapiens
uauccacuugcaacagagaag

SEQ ID NO: 187470 - RNA, 21 nt, Homo sapiens
uauggauuugccuauucugga

SEQ ID NO: 187471 - RNA, 22 nt, Homo sapiens
uauggauuuucagauucuuauc

SEQ ID NO: 187472 - RNA, 22 nt, Homo sapiens
uauggauuuuggaauauguggg

SEQ ID NO: 187473 - RNA, 22 nt, Homo sapiens
uauggcauuauuuugauagaca

SEQ ID NO: 187474 - RNA, 22 nt, Homo sapiens
uaugugcaaauuaauugcuaga

SEQ ID NO: 187475 - RNA, 22 nt, Homo sapiens
uauugcuggcucugucuucauu

SEQ ID NO: 187476 - RNA, 22 nt, Homo sapiens
ucaaagugcuauggcucagguu

SEQ ID NO: 187477 - RNA, 22 nt, Homo sapiens
ucaaaucaucuuuuccaaagcu

SEQ ID NO: 187478 - RNA, 22 nt, Homo sapiens
ucaacaggucaauugcauagaa

SEQ ID NO: 187479 - RNA, 22 nt, Homo sapiens
ucaaguacugccuugcucuggc

SEQ ID NO: 187480 - RNA, 22 nt, Homo sapiens
ucaaguacuuugcauagugccg

SEQ ID NO: 187481 - RNA, 22 nt, Homo sapiens
ucaaugggcuacacauugagug

SEQ ID NO: 187482 - RNA, 22 nt, Homo sapiens
ucacagucacugucacguugaa

SEQ ID NO: 187483 - RNA, 22 nt, Homo sapiens
ucacaguugauugaaacacagc

SEQ ID NO: 187484 - RNA, 22 nt, Homo sapiens
ucacauguguaaauugguguaa

SEQ ID NO: 187485 - RNA, 22 nt, Homo sapiens
ucacgugguucauaaggcagaa

SEQ ID NO: 187486 - RNA, 22 nt, Homo sapiens
ucacugaaaccuccaccucucg

SEQ ID NO: 187487 - RNA, 20 nt, Homo sapiens
ucacuggagcucauuugauu

SEQ ID NO: 187488 - RNA, 22 nt, Homo sapiens
ucacuggucuaaguggaggggg

SEQ ID NO: 187489 - RNA, 22 nt, Homo sapiens
ucacuuuguauagcgacuggcu

SEQ ID NO: 187490 - RNA, 22 nt, Homo sapiens
ucagaucauuaagguagguuua

SEQ ID NO: 187491 - RNA, 20 nt, Homo sapiens
ucaggcuccgcauuaacuua

SEQ ID NO: 187492 - RNA, 22 nt, Homo sapiens
ucaggugcaguggcucaugcuu

SEQ ID NO: 187493 - RNA, 22 nt, Homo sapiens
ucaggugcaguggcucugaccu

SEQ ID NO: 187494 - RNA, 21 nt, Homo sapiens
ucagugcugugggcaaggugc

SEQ ID NO: 187495 - RNA, 22 nt, Homo sapiens
ucauggcuuuuauuauguugag

SEQ ID NO: 187496 - RNA, 22 nt, Homo sapiens
ucauugguagcucauggaaccg

SEQ ID NO: 187497 - RNA, 22 nt, Homo sapiens
uccacaguggugaggugcagca

SEQ ID NO: 187498 - RNA, 22 nt, Homo sapiens
uccagaguggugaugcuggggc

SEQ ID NO: 187499 - RNA, 19 nt, Homo sapiens
ucccaagaugcucauacau

SEQ ID NO: 187500 - RNA, 22 nt, Homo sapiens
ucccacugucuucucgugcucg

SEQ ID NO: 187501 - RNA, 22 nt, Homo sapiens
ucccauguagcuaggauuacag

SEQ ID NO: 187502 - RNA, 22 nt, Homo sapiens
uccuucaugcaucaauguaucc

SEQ ID NO: 187503 - RNA, 22 nt, Homo sapiens
ucgcaccauugcacuccagcca

SEQ ID NO: 187504 - RNA, 22 nt, Homo sapiens
ucuaaugcucugagaacagugc

SEQ ID NO: 187505 - RNA, 22 nt, Homo sapiens
ucucugagaccacuccaaacuc

SEQ ID NO: 187506 - RNA, 22 nt, Homo sapiens
ucugagguaggugcauggauac

SEQ ID NO: 187507 - RNA, 22 nt, Homo sapiens
ucuggcacugaugugggaugcu

SEQ ID NO: 187508 - RNA, 22 nt, Homo sapiens
ucuggccuagaacaauuaauua

SEQ ID NO: 187509 - RNA, 22 nt, Homo sapiens
ucuggcuugugaacugucuucu

SEQ ID NO: 187510 - RNA, 17 nt, Homo sapiens
ucuggcuuucacaccug

SEQ ID NO: 187511 - RNA, 22 nt, Homo sapiens
ucugguggugaugagagacagu

SEQ ID NO: 187512 - RNA, 22 nt, Homo sapiens
ucugugcuugucauaugcuuug

SEQ ID NO: 187513 - RNA, 22 nt, Homo sapiens
ucuguguugaugcucauuaauu

SEQ ID NO: 187514 - RNA, 22 nt, Homo sapiens
ucuuggguuugccuugcugcug

SEQ ID NO: 187515 - RNA, 23 nt, Homo sapiens
ucuugguuauagaaaaauaguug

SEQ ID NO: 187516 - RNA, 23 nt, Homo sapiens
ucuuguacuuugagugagcaugg

SEQ ID NO: 187517 - RNA, 22 nt, Homo sapiens
ucuuuggauggaaauuggaguc

SEQ ID NO: 187518 - RNA, 22 nt, Homo sapiens
ucuuuggguagauauguagcug

SEQ ID NO: 187519 - RNA, 19 nt, Homo sapiens
ucuuugguacgugcuuuga

SEQ ID NO: 187520 - RNA, 21 nt, Homo sapiens
ucuuuggucaccaguuuucau

SEQ ID NO: 187521 - RNA, 22 nt, Homo sapiens
ugaaagcuacaggaaaguauuu

SEQ ID NO: 187522 - RNA, 20 nt, Homo sapiens
ugaacugguuacuuucuguc

SEQ ID NO: 187523 - RNA, 22 nt, Homo sapiens
ugacacagcaagauggaaccau

SEQ ID NO: 187524 - RNA, 22 nt, Homo sapiens
ugacagcuguugaggcauuuau

SEQ ID NO: 187525 - RNA, 22 nt, Homo sapiens
ugacaguguccuccuccugaga

SEQ ID NO: 187526 - RNA, 22 nt, Homo sapiens
ugacauggagagagaagccuuu

SEQ ID NO: 187527 - RNA, 19 nt, Homo sapiens
ugaccagggacagaaacca

SEQ ID NO: 187528 - RNA, 22 nt, Homo sapiens
ugagaagaugaacuccuugguc

SEQ ID NO: 187529 - RNA, 22 nt, Homo sapiens
ugagacggagucucgcucuguc

SEQ ID NO: 187530 - RNA, 22 nt, Homo sapiens
ugagacggagucucgcucuguu

SEQ ID NO: 187531 - RNA, 22 nt, Homo sapiens
ugagacggagucuugcucuguc

SEQ ID NO: 187532 - RNA, 22 nt, Homo sapiens
ugagauaguacuuuuuuaaagg

SEQ ID NO: 187533 - RNA, 22 nt, Homo sapiens
ugagauaucauuucacacccag

SEQ ID NO: 187534 - RNA, 22 nt, Homo sapiens
ugagaugacgacacaccucagu

SEQ ID NO: 187535 - RNA, 22 nt, Homo sapiens
ugagauggagucuugucgccua

SEQ ID NO: 187536 - RNA, 22 nt, Homo sapiens
ugagauggaguuucgcucuugu

SEQ ID NO: 187537 - RNA, 22 nt, Homo sapiens
ugagauggaguuucgcuuuugu

SEQ ID NO: 187538 - RNA, 22 nt, Homo sapiens
ugagauggaucuuggauuugaa

SEQ ID NO: 187539 - RNA, 22 nt, Homo sapiens
ugagauggcuuuauugcugaau

SEQ ID NO: 187540 - RNA, 22 nt, Homo sapiens
ugagauggguaauuaaauggug

SEQ ID NO: 187541 - RNA, 19 nt, Homo sapiens
ugagauuguaugaggagau

SEQ ID NO: 187542 - RNA, 22 nt, Homo sapiens
ugagcacagagccugggguggc

SEQ ID NO: 187543 - RNA, 22 nt, Homo sapiens
ugagcagagggagaaguaaauu

SEQ ID NO: 187544 - RNA, 22 nt, Homo sapiens
ugagcagaguuguuucuccuga

SEQ ID NO: 187545 - RNA, 20 nt, Homo sapiens
ugaggucaggaguuacagac

SEQ ID NO: 187546 - RNA, 22 nt, Homo sapiens
ugaggugagauggcuaccccaa

SEQ ID NO: 187547 - RNA, 20 nt, Homo sapiens
ugaguagaggaguucuauca

SEQ ID NO: 187548 - RNA, 22 nt, Homo sapiens
ugagugccuggagggcagggac

SEQ ID NO: 187549 - RNA, 22 nt, Homo sapiens
ugauauguggauucagcucaaa

SEQ ID NO: 187550 - RNA, 22 nt, Homo sapiens
ugaucaaagugcuggaauuaca

SEQ ID NO: 187551 - RNA, 22 nt, Homo sapiens
ugaucuuuuuaauguccauggg

SEQ ID NO: 187552 - RNA, 22 nt, Homo sapiens
ugauugcacaccugcacucaag

SEQ ID NO: 187553 - RNA, 20 nt, Homo sapiens
ugcagcacgggcccuuucca

SEQ ID NO: 187554 - RNA, 22 nt, Homo sapiens
ugcauccauucuagacucaucu

SEQ ID NO: 187555 - RNA, 21 nt, Homo sapiens
ugcauggagaacacugagggu

SEQ ID NO: 187556 - RNA, 22 nt, Homo sapiens
ugccaagaacauuuucuguuuu

SEQ ID NO: 187557 - RNA, 22 nt, Homo sapiens
ugccaagauuucaggaauuaag

SEQ ID NO: 187558 - RNA, 22 nt, Homo sapiens
ugccaaggagucagucccuaga

SEQ ID NO: 187559 - RNA, 18 nt, Homo sapiens
ugccuacugggcucaagc

SEQ ID NO: 187560 - RNA, 22 nt, Homo sapiens
ugccugagccagguuuuaggag

SEQ ID NO: 187561 - RNA, 21 nt, Homo sapiens
ugcuacugucacuuccuuugu

SEQ ID NO: 187562 - RNA, 22 nt, Homo sapiens
ugcuaugucagccaggcugguc

SEQ ID NO: 187563 - RNA, 22 nt, Homo sapiens
ugcuggugucaucaaggcuuug

SEQ ID NO: 187564 - RNA, 22 nt, Homo sapiens
uggaagacucuagucucuugag

SEQ ID NO: 187565 - RNA, 22 nt, Homo sapiens
uggaagcaugcaaucugugggg

SEQ ID NO: 187566 - RNA, 21 nt, Homo sapiens
uggaaguguacaauuauaccc

SEQ ID NO: 187567 - RNA, 22 nt, Homo sapiens
uggaagugucugugcccagcuc

SEQ ID NO: 187568 - RNA, 22 nt, Homo sapiens
uggaauuuagguugauaguaua

SEQ ID NO: 187569 - RNA, 22 nt, Homo sapiens
uggagagcaaaaucaauccaaa

SEQ ID NO: 187570 - RNA, 22 nt, Homo sapiens
aaaacgcauccucacaggucug

SEQ ID NO: 187571 - RNA, 20 nt, Homo sapiens
aaaggcugugagaacgagau

SEQ ID NO: 187572 - RNA, 22 nt, Homo sapiens
aaagucacuggagaaggaauau

SEQ ID NO: 187573 - RNA, 22 nt, Homo sapiens
aaagugcacuuggaagagggcc

SEQ ID NO: 187574 - RNA, 22 nt, Homo sapiens
aaagugcaguacuucguauauu

SEQ ID NO: 187575 - RNA, 22 nt, Homo sapiens
aaagugcugagucuaggcgggg

SEQ ID NO: 187576 - RNA, 22 nt, Homo sapiens
aaagugcugggauuggccgggc

SEQ ID NO: 187577 - RNA, 22 nt, Homo sapiens
aaauggauuaaguucacuugcu

SEQ ID NO: 187578 - RNA, 22 nt, Homo sapiens
aacagugcuucauucacacauu

SEQ ID NO: 187579 - RNA, 22 nt, Homo sapiens
aacaguguuuuggguuuucugg

SEQ ID NO: 187580 - RNA, 20 nt, Homo sapiens
aagacacuguccccacugga

SEQ ID NO: 187581 - RNA, 23 nt, Homo sapiens
aagagguaugacuaugaagugga

SEQ ID NO: 187582 - RNA, 22 nt, Homo sapiens
aagagguuguaccuaaaguguu

SEQ ID NO: 187583 - RNA, 22 nt, Homo sapiens
aagaucauucagggaaggcuga

SEQ ID NO: 187584 - RNA, 22 nt, Homo sapiens
aagaugguauuucauuaguuuu

SEQ ID NO: 187585 - RNA, 22 nt, Homo sapiens
aaggaagcuagcaggaauuggu

SEQ ID NO: 187586 - RNA, 22 nt, Homo sapiens
aaggagcuuaagugacuuguac

SEQ ID NO: 187587 - RNA, 22 nt, Homo sapiens
aagguauuuuugucuauaucuu

SEQ ID NO: 187588 - RNA, 22 nt, Homo sapiens
aaguaauggaguuauuuuauga

SEQ ID NO: 187589 - RNA, 22 nt, Homo sapiens
aaguaauugagguuuuugcugu

SEQ ID NO: 187590 - RNA, 22 nt, Homo sapiens
aagugcuguaugggagccuagg

SEQ ID NO: 187591 - RNA, 22 nt, Homo sapiens
aagugcuguccuaccuuuggga

SEQ ID NO: 187592 - RNA, 20 nt, Homo sapiens
aagugcuuccuuuuagaggg

SEQ ID NO: 187593 - RNA, 23 nt, Homo sapiens
aaguucaugcucaucuguuacac

SEQ ID NO: 187594 - RNA, 19 nt, Homo sapiens
aauauugacaguggugucu

SEQ ID NO: 187595 - RNA, 22 nt, Homo sapiens
aaucucagagauaucugugucc

SEQ ID NO: 187596 - RNA, 22 nt, Homo sapiens
aauggcagaugaaauugucauu

SEQ ID NO: 187597 - RNA, 22 nt, Homo sapiens
aauggcauugguccuuuuggau

SEQ ID NO: 187598 - RNA, 22 nt, Homo sapiens
aaugucaucuucaguuguacag

SEQ ID NO: 187599 - RNA, 22 nt, Homo sapiens
aaugugcuguucagaggagucc

SEQ ID NO: 187600 - RNA, 22 nt, Homo sapiens
aauugcaauggacaaugcagca

SEQ ID NO: 187601 - RNA, 22 nt, Homo sapiens
aauuguacucccauaauucccu

SEQ ID NO: 187602 - RNA, 20 nt, Homo sapiens
acaaaugcauucugugacau

SEQ ID NO: 187603 - RNA, 22 nt, Homo sapiens
acaccauugcauuccagccugg

SEQ ID NO: 187604 - RNA, 22 nt, Homo sapiens
acagagcaaugagcuacggucu

SEQ ID NO: 187605 - RNA, 22 nt, Homo sapiens
acaguguuccuuuguugugacu

SEQ ID NO: 187606 - RNA, 22 nt, Homo sapiens
accaccacucccgcauucuaaa

SEQ ID NO: 187607 - RNA, 21 nt, Homo sapiens
acccccacaccuccuuaguuc

SEQ ID NO: 187608 - RNA, 22 nt, Homo sapiens
accucagcccggggaaguugag

SEQ ID NO: 187609 - RNA, 22 nt, Homo sapiens
accuuguagcaaaccuaacaua

SEQ ID NO: 187610 - RNA, 22 nt, Homo sapiens
acugcaaugucgaauagagaug

SEQ ID NO: 187611 - RNA, 22 nt, Homo sapiens
acugcaauuacuguuguaccaa

SEQ ID NO: 187612 - RNA, 22 nt, Homo sapiens
acugcacuccaccuugggcaac

SEQ ID NO: 187613 - RNA, 22 nt, Homo sapiens
acugcacuccagccucggcaau

SEQ ID NO: 187614 - RNA, 22 nt, Homo sapiens
acugcacuccggccuggcaaca

SEQ ID NO: 187615 - RNA, 22 nt, Homo sapiens
acugggauauuauugguaauau

SEQ ID NO: 187616 - RNA, 22 nt, Homo sapiens
acuuugcuuaucccaggcacug

SEQ ID NO: 187617 - RNA, 22 nt, Homo sapiens
acuuuuguuauacagugugaua

SEQ ID NO: 187618 - RNA, 22 nt, Homo sapiens
agaaagugcuucccuuugguga

SEQ ID NO: 187619 - RNA, 22 nt, Homo sapiens
agaauguuuuagaccaauacaa

SEQ ID NO: 187620 - RNA, 22 nt, Homo sapiens
agacuagacagaugaacagcac

SEQ ID NO: 187621 - RNA, 21 nt, Homo sapiens
agagaacugaaacaugugacu

SEQ ID NO: 187622 - RNA, 22 nt, Homo sapiens
agagaccuguaaaguucaggca

SEQ ID NO: 187623 - RNA, 22 nt, Homo sapiens
agagagcuugggguguuaaauu

SEQ ID NO: 187624 - RNA, 22 nt, Homo sapiens
agagauaaagauuuuaauuuug

SEQ ID NO: 187625 - RNA, 21 nt, Homo sapiens
agaggacugaccacagcccua

SEQ ID NO: 187626 - RNA, 20 nt, Homo sapiens
agagugcugucuguccugag

SEQ ID NO: 187627 - RNA, 22 nt, Homo sapiens
agaugcauuuuuauuggaauac

SEQ ID NO: 187628 - RNA, 22 nt, Homo sapiens
agcaacauuguucauaauagcu

SEQ ID NO: 187629 - RNA, 22 nt, Homo sapiens
agcaccauuucucuaaagcacu

SEQ ID NO: 187630 - RNA, 22 nt, Homo sapiens
agcagcucaagacuuaaauuug

SEQ ID NO: 187631 - RNA, 22 nt, Homo sapiens
agcagcuuugaucugaaugauu

SEQ ID NO: 187632 - RNA, 22 nt, Homo sapiens
agcagcuuugcauggccugugg

SEQ ID NO: 187633 - RNA, 21 nt, Homo sapiens
agcagcuuugguugaagcaga

SEQ ID NO: 187634 - RNA, 22 nt, Homo sapiens
aaaaggcuagcuaguaacagaa

SEQ ID NO: 187635 - RNA, 18 nt, Homo sapiens
aaacagugucucuuucug

SEQ ID NO: 187636 - RNA, 22 nt, Homo sapiens
aaacauugaccucauccuggca

SEQ ID NO: 187637 - RNA, 22 nt, Homo sapiens
aaagcacuggagucaucaucua

SEQ ID NO: 187638 - RNA, 22 nt, Homo sapiens
aaagugauguccaggcuuucag

SEQ ID NO: 187639 - RNA, 22 nt, Homo sapiens
aaagugcugagacagacuggga

SEQ ID NO: 187640 - RNA, 22 nt, Homo sapiens
aaagugcugagaguucuaacuu

SEQ ID NO: 187641 - RNA, 22 nt, Homo sapiens
aaagugcugggaucacacugaa

SEQ ID NO: 187642 - RNA, 22 nt, Homo sapiens
aaagugcuguagacugggcgca

SEQ ID NO: 187643 - RNA, 22 nt, Homo sapiens
aaagugcuuccuuuuugagggu

SEQ ID NO: 187644 - RNA, 22 nt, Homo sapiens
aaauucaucaaaugguuuguau

SEQ ID NO: 187645 - RNA, 20 nt, Homo sapiens
aacagcacugucugaagcuu

SEQ ID NO: 187646 - RNA, 21 nt, Homo sapiens
aacagugcugaacagacaccu

SEQ ID NO: 187647 - RNA, 20 nt, Homo sapiens
aacaguguguaaguuuccuu

SEQ ID NO: 187648 - RNA, 22 nt, Homo sapiens
aagagagccagcugguauauuu

SEQ ID NO: 187649 - RNA, 22 nt, Homo sapiens
aagagcucucuguagcauguga

SEQ ID NO: 187650 - RNA, 22 nt, Homo sapiens
aagcaaacaucagcuugguuaa

SEQ ID NO: 187651 - RNA, 20 nt, Homo sapiens
aagcagacauuuggaugaaa

SEQ ID NO: 187652 - RNA, 22 nt, Homo sapiens
aagccacuguaccugucucuua

SEQ ID NO: 187653 - RNA, 22 nt, Homo sapiens
aagcugccuugugaaggcauuc

SEQ ID NO: 187654 - RNA, 22 nt, Homo sapiens
aagcugugucuugucagcuacc

SEQ ID NO: 187655 - RNA, 22 nt, Homo sapiens
aagugauguuauugggugacuc

SEQ ID NO: 187656 - RNA, 22 nt, Homo sapiens
aagugcaaauucccaggcucug

SEQ ID NO: 187657 - RNA, 20 nt, Homo sapiens
aagugcaucguugugucugc

SEQ ID NO: 187658 - RNA, 17 nt, Homo sapiens
aaguggcuuguucacca

SEQ ID NO: 187659 - RNA, 22 nt, Homo sapiens
aaugcaagauguuaauuauagg

SEQ ID NO: 187660 - RNA, 22 nt, Homo sapiens
aauuguacucccaucauuccua

SEQ ID NO: 187661 - RNA, 22 nt, Homo sapiens
acaaagugccuccuuuuagagu

SEQ ID NO: 187662 - RNA, 19 nt, Homo sapiens
acagcugguuuugguuucu

SEQ ID NO: 187663 - RNA, 20 nt, Homo sapiens
acaguagaagggauuucaaa

SEQ ID NO: 187664 - RNA, 18 nt, Homo sapiens
acagugcuggcaugagau

SEQ ID NO: 187665 - RNA, 19 nt, Homo sapiens
acagugcuuugucagaagc

SEQ ID NO: 187666 - RNA, 22 nt, Homo sapiens
acaucacuguuugauugauuga

SEQ ID NO: 187667 - RNA, 22 nt, Homo sapiens
acauccauuugcuuuauuugcu

SEQ ID NO: 187668 - RNA, 22 nt, Homo sapiens
acaugccucccugguccgcugu

SEQ ID NO: 187669 - RNA, 20 nt, Homo sapiens
acugcacuccaaccuuugug

SEQ ID NO: 187670 - RNA, 22 nt, Homo sapiens
acugcacuccacccuuggcagc

SEQ ID NO: 187671 - RNA, 22 nt, Homo sapiens
acugcacuucagccuugugaca

SEQ ID NO: 187672 - RNA, 22 nt, Homo sapiens
acuguacucuacccugggcaac

SEQ ID NO: 187673 - RNA, 22 nt, Homo sapiens
acugugcuguuuuaauuauuga

SEQ ID NO: 187674 - RNA, 19 nt, Homo sapiens
acuuuggugauuagaggga

SEQ ID NO: 187675 - RNA, 22 nt, Homo sapiens
acuuugguuaucauacuuucag

SEQ ID NO: 187676 - RNA, 22 nt, Homo sapiens
agaauguaacucuaugaaggca

SEQ ID NO: 187677 - RNA, 22 nt, Homo sapiens
agaauucugucauguuuauauu

SEQ ID NO: 187678 - RNA, 22 nt, Homo sapiens
agacagcugguagcacuuccug

SEQ ID NO: 187679 - RNA, 22 nt, Homo sapiens
agagacauugcuccaacucacc

SEQ ID NO: 187680 - RNA, 22 nt, Homo sapiens
agagagcuuuaacuacccauuu

SEQ ID NO: 187681 - RNA, 22 nt, Homo sapiens
agagauaauuagguuaaaugag

SEQ ID NO: 187682 - RNA, 20 nt, Homo sapiens
agagaucaguaauucaucaa

SEQ ID NO: 187683 - RNA, 22 nt, Homo sapiens
agauucauccaaguuguugcau

SEQ ID NO: 187684 - RNA, 22 nt, Homo sapiens
agcaagauuguucccauuuucu

SEQ ID NO: 187685 - RNA, 22 nt, Homo sapiens
agcagauguuuagugagcgccu

SEQ ID NO: 187686 - RNA, 22 nt, Homo sapiens
agcagcuuugcauggccuguga

SEQ ID NO: 187687 - RNA, 22 nt, Homo sapiens
ugugccacugcacuucagccug

SEQ ID NO: 187688 - RNA, 22 nt, Homo sapiens
uguggcucuucuguucuccacu

SEQ ID NO: 187689 - RNA, 22 nt, Homo sapiens
aguguuuuuaacaagaaagggu

SEQ ID NO: 187690 - RNA, 22 nt, Homo sapiens
auaaagguaagcacuauccuga

SEQ ID NO: 187691 - RNA, 22 nt, Homo sapiens
auaaaugcuuagaucuguauau

SEQ ID NO: 187692 - RNA, 22 nt, Homo sapiens
auaagaagugaaccagacgucu

SEQ ID NO: 187693 - RNA, 23 nt, Homo sapiens
auaaugcaaguggugguaaucug

SEQ ID NO: 187694 - RNA, 22 nt, Homo sapiens
auacaguguauguauaguacau

SEQ ID NO: 187695 - RNA, 22 nt, Homo sapiens
auaccugguagucuugcuacac

SEQ ID NO: 187696 - RNA, 22 nt, Homo sapiens
auaguggcaugaucauagcuca

SEQ ID NO: 187697 - RNA, 19 nt, Homo sapiens
auaguguaggaaaacagcu

SEQ ID NO: 187698 - RNA, 22 nt, Homo sapiens
auaucccuguauaagugaaugu

SEQ ID NO: 187699 - RNA, 22 nt, Homo sapiens
auauggcauucagaacuguaua

SEQ ID NO: 187700 - RNA, 20 nt, Homo sapiens
aucagagccggugaaagggc

SEQ ID NO: 187701 - RNA, 22 nt, Homo sapiens
aucgcgccauuguacuccagcc

SEQ ID NO: 187702 - RNA, 22 nt, Homo sapiens
aucugguguauuggugcugggu

SEQ ID NO: 187703 - RNA, 22 nt, Homo sapiens
aucugguguggcugugauccuc

SEQ ID NO: 187704 - RNA, 22 nt, Homo sapiens
aucuuuggauacuugauauagu

SEQ ID NO: 187705 - RNA, 22 nt, Homo sapiens
aucuuuggucaucacagcuaga

SEQ ID NO: 187706 - RNA, 22 nt, Homo sapiens
augaagaucaugaagacggcuu

SEQ ID NO: 187707 - RNA, 22 nt, Homo sapiens
augaagauguugccuuuuuaau

SEQ ID NO: 187708 - RNA, 22 nt, Homo sapiens
augagacaguucccuuuaucuu

SEQ ID NO: 187709 - RNA, 22 nt, Homo sapiens
augagauaggaacaaacuuaca

SEQ ID NO: 187710 - RNA, 22 nt, Homo sapiens
augagauuauguaaagagacca

SEQ ID NO: 187711 - RNA, 22 nt, Homo sapiens
augagauuguuuguacuccaca

SEQ ID NO: 187712 - RNA, 22 nt, Homo sapiens
augagcagaagagauacacugu

SEQ ID NO: 187713 - RNA, 20 nt, Homo sapiens
augcaaacccugcuuugugg

SEQ ID NO: 187714 - RNA, 22 nt, Homo sapiens
augcuuguugcagccugagccu

SEQ ID NO: 187715 - RNA, 22 nt, Homo sapiens
auggaaggagaauggucuuuga

SEQ ID NO: 187716 - RNA, 22 nt, Homo sapiens
auggaggacaaugucaccuuca

SEQ ID NO: 187717 - RNA, 22 nt, Homo sapiens
auggauuuguaguacaugguug

SEQ ID NO: 187718 - RNA, 22 nt, Homo sapiens
auggcagaaucaagccgacagc

SEQ ID NO: 187719 - RNA, 22 nt, Homo sapiens
auggcagcccucuuuauccaug

SEQ ID NO: 187720 - RNA, 22 nt, Homo sapiens
auggcauggugaagucuuugga

SEQ ID NO: 187721 - RNA, 22 nt, Homo sapiens
auggccuuuacaauuugguaug

SEQ ID NO: 187722 - RNA, 22 nt, Homo sapiens
auggccuuuuuaucucaccaag

SEQ ID NO: 187723 - RNA, 22 nt, Homo sapiens
auggcuguuuuuuauguuacag

SEQ ID NO: 187724 - RNA, 22 nt, Homo sapiens
auggcuuuguguucagagcuga

SEQ ID NO: 187725 - RNA, 22 nt, Homo sapiens
auggucuuuucccuggauuaua

SEQ ID NO: 187726 - RNA, 20 nt, Homo sapiens
augucaggaagggagucagg

SEQ ID NO: 187727 - RNA, 22 nt, Homo sapiens
augugcuuuuuaaacagaugcu

SEQ ID NO: 187728 - RNA, 23 nt, Homo sapiens
augugugcuuggagagcaggaug

SEQ ID NO: 187729 - RNA, 22 nt, Homo sapiens
auguugcuugaaggcauuuugu

SEQ ID NO: 187730 - RNA, 22 nt, Homo sapiens
auucacugugcuuggccaaauu

SEQ ID NO: 187731 - RNA, 22 nt, Homo sapiens
auucaucagggauacuggccug

SEQ ID NO: 187732 - RNA, 22 nt, Homo sapiens
auucaucagggauauuggucug

SEQ ID NO: 187733 - RNA, 18 nt, Homo sapiens
auucuacaggccuuuuga

SEQ ID NO: 187734 - RNA, 22 nt, Homo sapiens
auucuauaguccuaggauuggg

SEQ ID NO: 187735 - RNA, 22 nt, Homo sapiens
auugaacuguuggagagguuuu

SEQ ID NO: 187736 - RNA, 22 nt, Homo sapiens
auugcacuccagccugggcaac

SEQ ID NO: 187737 - RNA, 22 nt, Homo sapiens
auugcacuccagccugggcagc

SEQ ID NO: 187738 - RNA, 22 nt, Homo sapiens
auuggcuauuuggugagugauu

SEQ ID NO: 187739 - RNA, 22 nt, Homo sapiens
auugugucuuguagagagauau

SEQ ID NO: 187740 - RNA, 22 nt, Homo sapiens
auuguucuuacaugcugucauc

SEQ ID NO: 187741 - RNA, 22 nt, Homo sapiens
auuuggcaauuuugaagaugcc

SEQ ID NO: 187742 - RNA, 22 nt, Homo sapiens
caaagcuauagcaccagaggga

SEQ ID NO: 187743 - RNA, 22 nt, Homo sapiens
caaagugcugaaagaggccagg

SEQ ID NO: 187744 - RNA, 22 nt, Homo sapiens
caaagugcuggccgggcgcagu

SEQ ID NO: 187745 - RNA, 22 nt, Homo sapiens
caaagugcugggacuggccggg

SEQ ID NO: 187746 - RNA, 22 nt, Homo sapiens
caaauugcuuguggaggauaau

SEQ ID NO: 187747 - RNA, 19 nt, Homo sapiens
caacccugcagagaaagga

SEQ ID NO: 187748 - RNA, 22 nt, Homo sapiens
caagaucauuuaugcuaaaauu

SEQ ID NO: 187749 - RNA, 22 nt, Homo sapiens
caaggugcugagacaggagccc

SEQ ID NO: 187750 - RNA, 22 nt, Homo sapiens
caagugcuuucuuggggauuua

SEQ ID NO: 187751 - RNA, 22 nt, Homo sapiens
cacagucuugcaauauugagau

SEQ ID NO: 187752 - RNA, 21 nt, Homo sapiens
cacauggaggcagagagugua

SEQ ID NO: 187753 - RNA, 22 nt, Homo sapiens
cacauguuuuagcauggcuguu

SEQ ID NO: 187754 - RNA, 22 nt, Homo sapiens
caccugagcgggaugcucgccu

SEQ ID NO: 187755 - RNA, 22 nt, Homo sapiens
cacugcauccuccaccuccugg

SEQ ID NO: 187756 - RNA, 22 nt, Homo sapiens
cacugcauuacucaugagcaug

SEQ ID NO: 187757 - RNA, 22 nt, Homo sapiens
cacuggguuagaacaugcuccu

SEQ ID NO: 187758 - RNA, 22 nt, Homo sapiens
cagagguauugcaaaagccuag

SEQ ID NO: 187759 - RNA, 22 nt, Homo sapiens
cagcaucauucaucugggguaa

SEQ ID NO: 187760 - RNA, 22 nt, Homo sapiens
cagcugaugucgaaugcacucu

SEQ ID NO: 187761 - RNA, 22 nt, Homo sapiens
cagcuggugggagcuggguucc

SEQ ID NO: 187762 - RNA, 20 nt, Homo sapiens
cagggcaaugaggagguaaa

SEQ ID NO: 187763 - RNA, 22 nt, Homo sapiens
cagucacugggauuauggucau

SEQ ID NO: 187764 - RNA, 18 nt, Homo sapiens
cagugcaauacaggagag

SEQ ID NO: 187765 - RNA, 22 nt, Homo sapiens
caguguuuuuaacaggugcccg

SEQ ID NO: 187766 - RNA, 22 nt, Homo sapiens
caucacagcaaguagggagugg

SEQ ID NO: 187767 - RNA, 22 nt, Homo sapiens
caucccugucgucaagucucug

SEQ ID NO: 187768 - RNA, 22 nt, Homo sapiens
caucgcacuccagcuugggcaa

SEQ ID NO: 187769 - RNA, 22 nt, Homo sapiens
cauugcacuccagccuggccaa

SEQ ID NO: 187770 - RNA, 22 nt, Homo sapiens
ccacaguggauuaaaguuacug

SEQ ID NO: 187771 - RNA, 22 nt, Homo sapiens
ccagugcugugcaguguaugag

SEQ ID NO: 187772 - RNA, 19 nt, Homo sapiens
ccaguguucugauugcacu

SEQ ID NO: 187773 - RNA, 22 nt, Homo sapiens
gucuuugaugucuaugugcuuc

SEQ ID NO: 187774 - RNA, 22 nt, Homo sapiens
gucuuugcauguauguucauga

SEQ ID NO: 187775 - RNA, 22 nt, Homo sapiens
gucuuuggaaagacaaaguuca

SEQ ID NO: 187776 - RNA, 17 nt, Homo sapiens
gucuuugguugaguuua

SEQ ID NO: 187777 - RNA, 22 nt, Homo sapiens
gugaaagauuaaaccagugugu

SEQ ID NO: 187778 - RNA, 22 nt, Homo sapiens
gugaacaagcaaaggcaggagg

SEQ ID NO: 187779 - RNA, 22 nt, Homo sapiens
gugagaagaaaaauauggcugu

SEQ ID NO: 187780 - RNA, 22 nt, Homo sapiens
gugagacugaguuucgcucuug

SEQ ID NO: 187781 - RNA, 22 nt, Homo sapiens
gugagucaaucugagggguuca

SEQ ID NO: 187782 - RNA, 22 nt, Homo sapiens
gugagucagucuguguagggcu

SEQ ID NO: 187783 - RNA, 21 nt, Homo sapiens
gugaucaugucacugcacucc

SEQ ID NO: 187784 - RNA, 22 nt, Homo sapiens
gugcuuuguuguggcaguggca

SEQ ID NO: 187785 - RNA, 22 nt, Homo sapiens
guggaaagaacacaaaauuagg

SEQ ID NO: 187786 - RNA, 22 nt, Homo sapiens
guggcaaguguuccaagaggcg

SEQ ID NO: 187787 - RNA, 22 nt, Homo sapiens
guggcagaaaagagaagcaaug

SEQ ID NO: 187788 - RNA, 22 nt, Homo sapiens
guggcagaacagguaggguucu

SEQ ID NO: 187789 - RNA, 22 nt, Homo sapiens
guggcagagucagagggaaaug

SEQ ID NO: 187790 - RNA, 22 nt, Homo sapiens
guggcuagaaugaagguagcug

SEQ ID NO: 187791 - RNA, 22 nt, Homo sapiens
guggugucuuguuuaauauaua

SEQ ID NO: 187792 - RNA, 22 nt, Homo sapiens
gugguuuuaauauucagucuag

SEQ ID NO: 187793 - RNA, 22 nt, Homo sapiens
guucaucagggauacuggccuu

SEQ ID NO: 187794 - RNA, 22 nt, Homo sapiens
guugccuaggcuggagugcagu

SEQ ID NO: 187795 - RNA, 22 nt, Homo sapiens
guuggucaaugugauuaggcca

SEQ ID NO: 187796 - RNA, 22 nt, Homo sapiens
uaaagcauguaauuagguuaga

SEQ ID NO: 187797 - RNA, 22 nt, Homo sapiens
uaaagugcugagaugaggcugg

SEQ ID NO: 187798 - RNA, 22 nt, Homo sapiens
uaacaguguauuuacuacuucc

SEQ ID NO: 187799 - RNA, 22 nt, Homo sapiens
uaagacacauguguucccaggc

SEQ ID NO: 187800 - RNA, 22 nt, Homo sapiens
uaaggaacucugauaucuggaa

SEQ ID NO: 187801 - RNA, 22 nt, Homo sapiens
uaagugcuguguuguuaccuaa

SEQ ID NO: 187802 - RNA, 21 nt, Homo sapiens
uaauggcaugaucucggcuca

SEQ ID NO: 187803 - RNA, 22 nt, Homo sapiens
uacaagcaggaaaugguauaug

SEQ ID NO: 187804 - RNA, 22 nt, Homo sapiens
uacagucacauuccugaccaua

SEQ ID NO: 187805 - RNA, 22 nt, Homo sapiens
uacagucuggaggccuguguug

SEQ ID NO: 187806 - RNA, 22 nt, Homo sapiens
uacagugcauagaggcaugaua

SEQ ID NO: 187807 - RNA, 22 nt, Homo sapiens
uacuuuguuauagcagcaggaa

SEQ ID NO: 187808 - RNA, 20 nt, Homo sapiens
uagagagauauggggguucc

SEQ ID NO: 187809 - RNA, 21 nt, Homo sapiens
uagauacuguauuaaaccuag

SEQ ID NO: 187810 - RNA, 19 nt, Homo sapiens
uagcacagggucccagacu

SEQ ID NO: 187811 - RNA, 23 nt, Homo sapiens
uagguuauuugguaaauauaugu

SEQ ID NO: 187812 - RNA, 22 nt, Homo sapiens
uauaagacuagcagcugaauug

SEQ ID NO: 187813 - RNA, 22 nt, Homo sapiens
uaucacagcaaggacccauuau

SEQ ID NO: 187814 - RNA, 22 nt, Homo sapiens
uaucacagugcuggaguauucc

SEQ ID NO: 187815 - RNA, 20 nt, Homo sapiens
uaucacaguucaggaacucu

SEQ ID NO: 187816 - RNA, 22 nt, Homo sapiens
uaucacaguugcauauuuaagg

SEQ ID NO: 187817 - RNA, 22 nt, Homo sapiens
uaucacuuugauaguuuaaaug

SEQ ID NO: 187818 - RNA, 22 nt, Homo sapiens
uauggaaaucuuaccuuauggu

SEQ ID NO: 187819 - RNA, 22 nt, Homo sapiens
uauggauuugccuauucuguau

SEQ ID NO: 187820 - RNA, 22 nt, Homo sapiens
uauggcaaugcauaggaaggaa

SEQ ID NO: 187821 - RNA, 22 nt, Homo sapiens
uaugguuuuggaauccugcaga

SEQ ID NO: 187822 - RNA, 17 nt, Homo sapiens
uauguaguacuuauaaa

SEQ ID NO: 187823 - RNA, 22 nt, Homo sapiens
cucucugagccauggcugcccu

SEQ ID NO: 187824 - RNA, 22 nt, Homo sapiens
cucucugagccccagacaccuu

SEQ ID NO: 187825 - RNA, 22 nt, Homo sapiens
cugagagaggagcuaaaacugc

SEQ ID NO: 187826 - RNA, 22 nt, Homo sapiens
cugagagaugagaccucucacu

SEQ ID NO: 187827 - RNA, 22 nt, Homo sapiens
cugagcaauauagugagaucuu

SEQ ID NO: 187828 - RNA, 22 nt, Homo sapiens
cugagguaauuuguugccagua

SEQ ID NO: 187829 - RNA, 22 nt, Homo sapiens
cugaggugauauauacauauuu

SEQ ID NO: 187830 - RNA, 21 nt, Homo sapiens
cugcaaaugcugcugccugau

SEQ ID NO: 187831 - RNA, 22 nt, Homo sapiens
cugcagguaggggcagcuuugg

SEQ ID NO: 187832 - RNA, 22 nt, Homo sapiens
cuggaaagcaaagggugcauug

SEQ ID NO: 187833 - RNA, 22 nt, Homo sapiens
cuguaguuagcagaugaugaau

SEQ ID NO: 187834 - RNA, 22 nt, Homo sapiens
cugucucagccucuccaguagc

SEQ ID NO: 187835 - RNA, 22 nt, Homo sapiens
cugugccaagcuugcgaugugc

SEQ ID NO: 187836 - RNA, 22 nt, Homo sapiens
cuguuugauuaagugguggaaa

SEQ ID NO: 187837 - RNA, 22 nt, Homo sapiens
cuuagcaaugucguguacucac

SEQ ID NO: 187838 - RNA, 22 nt, Homo sapiens
cuuggauuauaauggaauauuu

SEQ ID NO: 187839 - RNA, 22 nt, Homo sapiens
cuuggcauugccccuggaauuu

SEQ ID NO: 187840 - RNA, 22 nt, Homo sapiens
cuuggcuccgacuccccuccaa

SEQ ID NO: 187841 - RNA, 20 nt, Homo sapiens
cuuggcuuucuugguguuaa

SEQ ID NO: 187842 - RNA, 22 nt, Homo sapiens
cuugggauauguguuacucugu

SEQ ID NO: 187843 - RNA, 22 nt, Homo sapiens
cuugugcaugaccccagguggg

SEQ ID NO: 187844 - RNA, 22 nt, Homo sapiens
cuuugauuauaaaaggguguuu

SEQ ID NO: 187845 - RNA, 20 nt, Homo sapiens
cuuuggcaaugagaacaggg

SEQ ID NO: 187846 - RNA, 22 nt, Homo sapiens
cuuuggcaaugucauuuucaau

SEQ ID NO: 187847 - RNA, 22 nt, Homo sapiens
cuuuggguauucucccuugggg

SEQ ID NO: 187848 - RNA, 20 nt, Homo sapiens
cuuuuagcagcagcaagaga

SEQ ID NO: 187849 - RNA, 22 nt, Homo sapiens
cuuuugugauuccucaguuacu

SEQ ID NO: 187850 - RNA, 22 nt, Homo sapiens
cuuuuguggaucuucuguugcu

SEQ ID NO: 187851 - RNA, 22 nt, Homo sapiens
gaaagugcugcuugacugggau

SEQ ID NO: 187852 - RNA, 18 nt, Homo sapiens
gaaaugccucuugcuuac

SEQ ID NO: 187853 - RNA, 22 nt, Homo sapiens
gaaaugcucauuuuggauccuu

SEQ ID NO: 187854 - RNA, 22 nt, Homo sapiens
gaaggcaugcugcauggccaga

SEQ ID NO: 187855 - RNA, 23 nt, Homo sapiens
gaaguaauaaauggauucuuaac

SEQ ID NO: 187856 - RNA, 22 nt, Homo sapiens
gaaucauuggguugauucaaga

SEQ ID NO: 187857 - RNA, 22 nt, Homo sapiens
gacagacacaauugauccauga

SEQ ID NO: 187858 - RNA, 18 nt, Homo sapiens
gacaguguggugauuccu

SEQ ID NO: 187859 - RNA, 22 nt, Homo sapiens
gacugaggaagcgcucucuccu

SEQ ID NO: 187860 - RNA, 22 nt, Homo sapiens
gacuggccauugauacagaggu

SEQ ID NO: 187861 - RNA, 22 nt, Homo sapiens
gagaacauacggcauuugguuu

SEQ ID NO: 187862 - RNA, 20 nt, Homo sapiens
gagaccugagauucacucaa

SEQ ID NO: 187863 - RNA, 22 nt, Homo sapiens
gagacggagucucgcucuguca

SEQ ID NO: 187864 - RNA, 22 nt, Homo sapiens
gagacugagucuugcucugucg

SEQ ID NO: 187865 - RNA, 22 nt, Homo sapiens
gagcuacacugauucauuuguu

SEQ ID NO: 187866 - RNA, 22 nt, Homo sapiens
gaggaaguuuacaaagcaucug

SEQ ID NO: 187867 - RNA, 22 nt, Homo sapiens
gaggcauugaagauauggaagu

SEQ ID NO: 187868 - RNA, 22 nt, Homo sapiens
gagugcaauggcaccgucucgg

SEQ ID NO: 187869 - RNA, 22 nt, Homo sapiens
gauauguuucuucaauaccuag

SEQ ID NO: 187870 - RNA, 22 nt, Homo sapiens
gauggcucugcaggugagggua

SEQ ID NO: 187871 - RNA, 22 nt, Homo sapiens
gauugcaauuuaggugagagag

SEQ ID NO: 187872 - RNA, 21 nt, Homo sapiens
gcaaacauccuuugaugccag

SEQ ID NO: 187873 - RNA, 21 nt, Homo sapiens
gcaaaguggcuaccuugcucc

SEQ ID NO: 187874 - RNA, 22 nt, Homo sapiens
gcaaaguguuuuccaacuuggu

SEQ ID NO: 187875 - RNA, 22 nt, Homo sapiens
gcacaguuaaagggucauguga

SEQ ID NO: 187876 - RNA, 22 nt, Homo sapiens
gcaccauugacaagaaauaggu

SEQ ID NO: 187877 - RNA, 22 nt, Homo sapiens
gcagucacagggagauggugac

SEQ ID NO: 187878 - RNA, 16 nt, Homo sapiens
uugaggcaugucucag

SEQ ID NO: 187879 - RNA, 22 nt, Homo sapiens
uugcacaguguguacagcacca

SEQ ID NO: 187880 - RNA, 22 nt, Homo sapiens
uugcauagacaauauuaaucuu

SEQ ID NO: 187881 - RNA, 22 nt, Homo sapiens
uugcauagaccgaugucuugga

SEQ ID NO: 187882 - RNA, 18 nt, Homo sapiens
uugcauaguguauccaaa

SEQ ID NO: 187883 - RNA, 18 nt, Homo sapiens
uugcaucauuuuguuguu

SEQ ID NO: 187884 - RNA, 22 nt, Homo sapiens
uugcauuuucuaggagggcaaa

SEQ ID NO: 187885 - RNA, 22 nt, Homo sapiens
uuggaaacaccuggugagguua

SEQ ID NO: 187886 - RNA, 22 nt, Homo sapiens
uuggaagacaaugcugauucuc

SEQ ID NO: 187887 - RNA, 22 nt, Homo sapiens
uuggaagauuacuuaguuuucu

SEQ ID NO: 187888 - RNA, 22 nt, Homo sapiens
uuggacuuuuauucugcaggca

SEQ ID NO: 187889 - RNA, 22 nt, Homo sapiens
uuggagagucacuaguuagugc

SEQ ID NO: 187890 - RNA, 22 nt, Homo sapiens
uuggauuuugguggcaacucau

SEQ ID NO: 187891 - RNA, 22 nt, Homo sapiens
uuggcaaaugucacaaaucagg

SEQ ID NO: 187892 - RNA, 20 nt, Homo sapiens
uuggcagagucuuuagggua

SEQ ID NO: 187893 - RNA, 22 nt, Homo sapiens
uuggcagaguuaauuuguugag

SEQ ID NO: 187894 - RNA, 19 nt, Homo sapiens
uuggcagaguugcccccua

SEQ ID NO: 187895 - RNA, 21 nt, Homo sapiens
uuggccuggaggccugaaugu

SEQ ID NO: 187896 - RNA, 22 nt, Homo sapiens
auuaaguuaggauuuugagaua

SEQ ID NO: 187897 - RNA, 22 nt, Homo sapiens
auggcagcccucuuuauccaug

SEQ ID NO: 187898 - RNA, 22 nt, Homo sapiens
auguaguagcagaaaauauuuu

SEQ ID NO: 187899 - RNA, 22 nt, Homo sapiens
auuccauuuguuaucacacccg

SEQ ID NO: 187900 - RNA, 23 nt, Homo sapiens
auugaacacuuucauaugugagg

SEQ ID NO: 187901 - RNA, 22 nt, Homo sapiens
auugcuuuuacugggagcuuug

SEQ ID NO: 187902 - RNA, 22 nt, Homo sapiens
auuguaccccaauguacaauau

SEQ ID NO: 187903 - RNA, 22 nt, Homo sapiens
cagauacuggaguccugaaguu

SEQ ID NO: 187904 - RNA, 22 nt, Homo sapiens
cagcaucauucaucugggguaa

SEQ ID NO: 187905 - RNA, 22 nt, Homo sapiens
cauugcacuccagccugaggga

SEQ ID NO: 187906 - RNA, 20 nt, Homo sapiens
cauugcccuccagccugggc

SEQ ID NO: 187907 - RNA, 22 nt, Homo sapiens
ccaguauugaacacaaugaaag

SEQ ID NO: 187908 - RNA, 22 nt, Homo sapiens
cuaaaacuuucugagugcagca

SEQ ID NO: 187909 - RNA, 23 nt, Homo sapiens
cuacuagucaagucuuuuccagu

SEQ ID NO: 187910 - RNA, 22 nt, Homo sapiens
cugagaaugaugauuuccaguu

SEQ ID NO: 187911 - RNA, 22 nt, Homo sapiens
cugagcaucauggcagaaucuu

SEQ ID NO: 187912 - RNA, 22 nt, Homo sapiens
cugagcccauucuggggagaag

SEQ ID NO: 187913 - RNA, 22 nt, Homo sapiens
cugaggacaucagggaagcauc

SEQ ID NO: 187914 - RNA, 20 nt, Homo sapiens
cuggaugucgaggcagaggu

SEQ ID NO: 187915 - RNA, 22 nt, Homo sapiens
cugggaugauguaaauaggcua

SEQ ID NO: 187916 - RNA, 22 nt, Homo sapiens
cuugacacugcaguuuuccugg

SEQ ID NO: 187917 - RNA, 22 nt, Homo sapiens
cuugaucaaugugguacuugau

SEQ ID NO: 187918 - RNA, 22 nt, Homo sapiens
cuuggcauugccccuggaauuu

SEQ ID NO: 187919 - RNA, 22 nt, Homo sapiens
cuuuacacauccuaaccagugu

SEQ ID NO: 187920 - RNA, 22 nt, Homo sapiens
cuuuuacacugguggugggaau

SEQ ID NO: 187921 - RNA, 22 nt, Homo sapiens
aucagauggcuaaaacagaaga

SEQ ID NO: 187922 - RNA, 22 nt, Homo sapiens
aucauagcucacugcagccucg

SEQ ID NO: 187923 - RNA, 22 nt, Homo sapiens
auccugagacuuugcugaaguu

SEQ ID NO: 187924 - RNA, 22 nt, Homo sapiens
auggauuuuaggauacaguuga

SEQ ID NO: 187925 - RNA, 22 nt, Homo sapiens
auggcaauaauagcuaccauuu

SEQ ID NO: 187926 - RNA, 18 nt, Homo sapiens
auggcagaacaauuuaca

SEQ ID NO: 187927 - RNA, 22 nt, Homo sapiens
auguaguagauauuuauggaaa

SEQ ID NO: 187928 - RNA, 22 nt, Homo sapiens
auuaaguaaugguuccaauaau

SEQ ID NO: 187929 - RNA, 22 nt, Homo sapiens
auuacacuuucuauucaaugag

SEQ ID NO: 187930 - RNA, 22 nt, Homo sapiens
auuggcagaaaucuuuauagua

SEQ ID NO: 187931 - RNA, 22 nt, Homo sapiens
auuggcuauuuggugagugauu

SEQ ID NO: 187932 - RNA, 22 nt, Homo sapiens
auuguaguuugcuauggcaaua

SEQ ID NO: 187933 - RNA, 21 nt, Homo sapiens
auuguauguaaaccaaaugag

SEQ ID NO: 187934 - RNA, 22 nt, Homo sapiens
caaagucuucucauuaugucuu

SEQ ID NO: 187935 - RNA, 22 nt, Homo sapiens
caaggugcugagacaggagccc

SEQ ID NO: 187936 - RNA, 22 nt, Homo sapiens
cacauugaauuucugaugacaa

SEQ ID NO: 187937 - RNA, 22 nt, Homo sapiens
ccacugcacuccagcccggcaa

SEQ ID NO: 187938 - RNA, 19 nt, Homo sapiens
ccucaaguacuaauauguu

SEQ ID NO: 187939 - RNA, 22 nt, Homo sapiens
ccugcauaguucaccgcugaua

SEQ ID NO: 187940 - RNA, 23 nt, Homo sapiens
cuaaagucugucacugaggacuu

SEQ ID NO: 187941 - RNA, 22 nt, Homo sapiens
cuagauuauccaacuuauuagc

SEQ ID NO: 187942 - RNA, 22 nt, Homo sapiens
cuaguaaugucugucuuaugga

SEQ ID NO: 187943 - RNA, 22 nt, Homo sapiens
cuauucacaggcaauauguaca

SEQ ID NO: 187944 - RNA, 22 nt, Homo sapiens
cucagcaguggauuuaccacca

SEQ ID NO: 187945 - RNA, 22 nt, Homo sapiens
cucagucuaugauacuuugcua

SEQ ID NO: 187946 - RNA, 20 nt, Homo sapiens
cucuaguaauaaaguuuccc

SEQ ID NO: 187947 - RNA, 22 nt, Homo sapiens
cugagguaauuuguugccagua

SEQ ID NO: 187948 - RNA, 21 nt, Homo sapiens
cugcaaaugcugcugccugau

SEQ ID NO: 187949 - RNA, 22 nt, Homo sapiens
cugggaucaguucuagucagaa

SEQ ID NO: 187950 - RNA, 22 nt, Homo sapiens
cugggauggaggagaauuagag

SEQ ID NO: 187951 - RNA, 22 nt, Homo sapiens
cugggaugugacuguugccccc

SEQ ID NO: 187952 - RNA, 23 nt, Homo sapiens
cuguacacauauacaucuaagua

SEQ ID NO: 187953 - RNA, 22 nt, Homo sapiens
cuugagcuugagauccuuucug

SEQ ID NO: 187954 - RNA, 20 nt, Homo sapiens
cuuggcuuucuugguguuaa

SEQ ID NO: 187955 - RNA, 22 nt, Homo sapiens
cuuuuacacugcuggugggaau

SEQ ID NO: 187956 - RNA, 22 nt, Homo sapiens
cuuuuacacuguuggugggaau

SEQ ID NO: 187957 - RNA, 22 nt, Homo sapiens
gaauagugcugcaagaaacaua

SEQ ID NO: 187958 - RNA, 22 nt, Homo sapiens
gacacuggguguuuguuggcgu

SEQ ID NO: 187959 - RNA, 22 nt, Homo sapiens
gacuucaucauacuaugugugg

SEQ ID NO: 187960 - RNA, 22 nt, Homo sapiens
gagauaacuacuggauuaaguu

SEQ ID NO: 187961 - RNA, 22 nt, Homo sapiens
gagaugugguucaaggguguuu

SEQ ID NO: 187962 - RNA, 22 nt, Homo sapiens
gagguaagaguuuuccauuucu

SEQ ID NO: 187963 - RNA, 22 nt, Homo sapiens
gaguaaaugucaaguacuuagg

SEQ ID NO: 187964 - RNA, 22 nt, Homo sapiens
gcacugagagaagccccaagua

SEQ ID NO: 187965 - RNA, 22 nt, Homo sapiens
gcagugugaucacagcuuacug

SEQ ID NO: 187966 - RNA, 22 nt, Homo sapiens
gcaguguggguagagggcaaga

SEQ ID NO: 187967 - RNA, 16 nt, Homo sapiens
gcaguguguuuaauag

SEQ ID NO: 187968 - RNA, 22 nt, Homo sapiens
ggaauaguauaaauaccacaaa

SEQ ID NO: 187969 - RNA, 20 nt, Homo sapiens
ggaauagucuacacucugac

SEQ ID NO: 187970 - RNA, 23 nt, Homo sapiens
ggaaugaaaccugguuaugauau

SEQ ID NO: 187971 - RNA, 21 nt, Homo sapiens
ggauucaucccucaugaauuu

SEQ ID NO: 187972 - RNA, 22 nt, Homo sapiens
gguggucuuccccuggaguucg

SEQ ID NO: 187973 - RNA, 19 nt, Homo sapiens
guaaucucaguacuuuggu

SEQ ID NO: 187974 - RNA, 22 nt, Homo sapiens
guacaagugcaguuucguuaca

SEQ ID NO: 187975 - RNA, 22 nt, Homo sapiens
guacaugcauaguuuauuucug

SEQ ID NO: 187976 - RNA, 22 nt, Homo sapiens
gucauaugcucggaaaauguua

SEQ ID NO: 187977 - RNA, 22 nt, Homo sapiens
gugagauaaugucucauugugg

SEQ ID NO: 187978 - RNA, 22 nt, Homo sapiens
uugagauggaguuucacucucg

SEQ ID NO: 187979 - RNA, 22 nt, Homo sapiens
uugagauggaguuucacucuug

SEQ ID NO: 187980 - RNA, 22 nt, Homo sapiens
uugagauggaguuucgcucuuu

SEQ ID NO: 187981 - RNA, 22 nt, Homo sapiens
uugagauguauguauauaaugu

SEQ ID NO: 187982 - RNA, 23 nt, Homo sapiens
uugaggcauguaccaucaauauc

SEQ ID NO: 187983 - RNA, 22 nt, Homo sapiens
uuggaaguguguauguauagcu

SEQ ID NO: 187984 - RNA, 19 nt, Homo sapiens
uuggcagaguugcccccua

SEQ ID NO: 187985 - RNA, 21 nt, Homo sapiens
uuggccuggaggccugaaugu

SEQ ID NO: 187986 - RNA, 21 nt, Homo sapiens
uuggcuacugcuucagaggga

SEQ ID NO: 187987 - RNA, 22 nt, Homo sapiens
uuggucaggcuaaucucgaacg

SEQ ID NO: 187988 - RNA, 22 nt, Homo sapiens
uuguaaucaacacaucauuggg

SEQ ID NO: 187989 - RNA, 23 nt, Homo sapiens
uuguccccuccaaagcucauguu

SEQ ID NO: 187990 - RNA, 22 nt, Homo sapiens
uuuauguggagcacuugacaca

SEQ ID NO: 187991 - RNA, 23 nt, Homo sapiens
uuugcacuugcuccuucuauggc

SEQ ID NO: 187992 - RNA, 22 nt, Homo sapiens
uuugcagugucagcuucugugu

SEQ ID NO: 187993 - RNA, 22 nt, Homo sapiens
aaaguggugugaguauguaucu

SEQ ID NO: 187994 - RNA, 22 nt, Homo sapiens
aaaucccuugcucucucagacc

SEQ ID NO: 187995 - RNA, 22 nt, Homo sapiens
aaauugcuuuugaagacuuagu

SEQ ID NO: 187996 - RNA, 23 nt, Homo sapiens
aagagguaugacuaugaagugga

SEQ ID NO: 187997 - RNA, 22 nt, Homo sapiens
aaggagugugauucuucaguuu

SEQ ID NO: 187998 - RNA, 22 nt, Homo sapiens
aaggcaguggcagaagauguca

SEQ ID NO: 187999 - RNA, 22 nt, Homo sapiens
aagguaguuuucuuuaaugcug

SEQ ID NO: 188000 - RNA, 23 nt, Homo sapiens
aaguucaugcucaucuguuacac

SEQ ID NO: 188001 - RNA, 21 nt, Homo sapiens
aaucacugucuguuuccccuu

SEQ ID NO: 188002 - RNA, 22 nt, Homo sapiens
aaucagcacacugugcuuucca

SEQ ID NO: 188003 - RNA, 22 nt, Homo sapiens
aauuacucgugucuuuacugcu

SEQ ID NO: 188004 - RNA, 22 nt, Homo sapiens
aauuaguaaccuaauuccaucu

SEQ ID NO: 188005 - RNA, 22 nt, Homo sapiens
acaguguguguguucaccuaga

SEQ ID NO: 188006 - RNA, 22 nt, Homo sapiens
acaucccaugccuggguacucc

SEQ ID NO: 188007 - RNA, 18 nt, Homo sapiens
acaucccaugcuggggug

SEQ ID NO: 188008 - RNA, 22 nt, Homo sapiens
accaguguuuaccaaguagcau

SEQ ID NO: 188009 - RNA, 22 nt, Homo sapiens
accaugcaguccaauaugcaca

SEQ ID NO: 188010 - RNA, 21 nt, Homo sapiens
acccucuaguuuucaacaggc

SEQ ID NO: 188011 - RNA, 22 nt, Homo sapiens
acugaaucaucagguguguuug

SEQ ID NO: 188012 - RNA, 22 nt, Homo sapiens
agacuagacagaugaacagcac

SEQ ID NO: 188013 - RNA, 22 nt, Homo sapiens
agagguauuggaaggaguguca

SEQ ID NO: 188014 - RNA, 21 nt, Homo sapiens
agagucaucucuaucuguacc

SEQ ID NO: 188015 - RNA, 22 nt, Homo sapiens
agcagcuuugaucugaaugauu

SEQ ID NO: 188016 - RNA, 22 nt, Homo sapiens
agcagcuuugcauggccugugg

SEQ ID NO: 188017 - RNA, 22 nt, Homo sapiens
agcagguguccacaauguuugc

SEQ ID NO: 188018 - RNA, 23 nt, Homo sapiens
agcccugugacucgaacgaggag

SEQ ID NO: 188019 - RNA, 22 nt, Homo sapiens
agcugcaauguuuaguauaaua

SEQ ID NO: 188020 - RNA, 22 nt, Homo sapiens
aggcuagaaucuuccaucuugg

SEQ ID NO: 188021 - RNA, 22 nt, Homo sapiens
aguggcaaugugauguccugaa

SEQ ID NO: 188022 - RNA, 20 nt, Homo sapiens
auaaauguauagguguacau

SEQ ID NO: 188023 - RNA, 22 nt, Homo sapiens
auacuguacugaaguacccauu

SEQ ID NO: 188024 - RNA, 22 nt, Homo sapiens
auagcuguugaauggaauauuc

SEQ ID NO: 188025 - RNA, 22 nt, Homo sapiens
auauuggucuucaagaccugug

SEQ ID NO: 188026 - RNA, 22 nt, Homo sapiens
auauugguuaaauauuauguga

SEQ ID NO: 188027 - RNA, 22 nt, Homo sapiens
aucagaaucucuagaggacugu

SEQ ID NO: 188028 - RNA, 22 nt, Homo sapiens
uccauguagaagacaggggaga

SEQ ID NO: 188029 - RNA, 22 nt, Homo sapiens
ucccugaaagcugagauuggaa

SEQ ID NO: 188030 - RNA, 22 nt, Homo sapiens
ucucaaguaacugggacaauaa

SEQ ID NO: 188031 - RNA, 22 nt, Homo sapiens
ucucauggagguagagaguaaa

SEQ ID NO: 188032 - RNA, 22 nt, Homo sapiens
ucugacucuggagucucagguu

SEQ ID NO: 188033 - RNA, 22 nt, Homo sapiens
ucugagguuacugcuuuguaga

SEQ ID NO: 188034 - RNA, 22 nt, Homo sapiens
ucuggagugugaaguggauaug

SEQ ID NO: 188035 - RNA, 17 nt, Homo sapiens
ucuggcuuucacaccug

SEQ ID NO: 188036 - RNA, 22 nt, Homo sapiens
ucuguaguuaacagcuucagcu

SEQ ID NO: 188037 - RNA, 22 nt, Homo sapiens
ugaauaguuugacagaacucuu

SEQ ID NO: 188038 - RNA, 22 nt, Homo sapiens
ugaauauuugcuacucacucuu

SEQ ID NO: 188039 - RNA, 22 nt, Homo sapiens
ugacagguugauaggugcagca

SEQ ID NO: 188040 - RNA, 19 nt, Homo sapiens
ugaccagggacagaaacca

SEQ ID NO: 188041 - RNA, 22 nt, Homo sapiens
ugacugucuagauagagcuugg

SEQ ID NO: 188042 - RNA, 18 nt, Homo sapiens
ugagaacauguguacaca

SEQ ID NO: 188043 - RNA, 19 nt, Homo sapiens
ugagaauguuaccaggucc

SEQ ID NO: 188044 - RNA, 22 nt, Homo sapiens
ugagaggugaauggcaggcuca

SEQ ID NO: 188045 - RNA, 22 nt, Homo sapiens
ugagauggaguuucacuuuugu

SEQ ID NO: 188046 - RNA, 22 nt, Homo sapiens
ugagauggguaauuaaauggug

SEQ ID NO: 188047 - RNA, 21 nt, Homo sapiens
ugagauuaaguuguuuagaag

SEQ ID NO: 188048 - RNA, 22 nt, Homo sapiens
ugagguguauugggggaaauuc

SEQ ID NO: 188049 - RNA, 20 nt, Homo sapiens
ugaguagaggaguucuauca

SEQ ID NO: 188050 - RNA, 22 nt, Homo sapiens
ugcaagacacuguccugggcau

SEQ ID NO: 188051 - RNA, 22 nt, Homo sapiens
ugcaagauaggcaguuugcacu

SEQ ID NO: 188052 - RNA, 22 nt, Homo sapiens
uggaaaguaguucuaaucuaag

SEQ ID NO: 188053 - RNA, 23 nt, Homo sapiens
uggaaguauggaggaggcagaau

SEQ ID NO: 188054 - RNA, 22 nt, Homo sapiens
uggaguguaauuagccaucagu

SEQ ID NO: 188055 - RNA, 22 nt, Homo sapiens
uggauuuuaauuauucugucau

SEQ ID NO: 188056 - RNA, 22 nt, Homo sapiens
uggcaaauuccaaaguuaauuc

SEQ ID NO: 188057 - RNA, 22 nt, Homo sapiens
uggcaccugacuccgagaugca

SEQ ID NO: 188058 - RNA, 22 nt, Homo sapiens
uggcacuggagauacauuaaua

SEQ ID NO: 188059 - RNA, 22 nt, Homo sapiens
uggcagcgugaauguggcugaa

SEQ ID NO: 188060 - RNA, 22 nt, Homo sapiens
uggcauguguuugaaugaguau

SEQ ID NO: 188061 - RNA, 22 nt, Homo sapiens
ugggaaauguagccuagcugug

SEQ ID NO: 188062 - RNA, 22 nt, Homo sapiens
ugggaucaugagcaccgcuucc

SEQ ID NO: 188063 - RNA, 22 nt, Homo sapiens
ugggcaaaacuaagagcugugg

SEQ ID NO: 188064 - RNA, 22 nt, Homo sapiens
ugguggcuuuucguagguucac

SEQ ID NO: 188065 - RNA, 20 nt, Homo sapiens
uguaaucuaaguuuuaagcc

SEQ ID NO: 188066 - RNA, 22 nt, Homo sapiens
uguuacagcagaauugaaagag

SEQ ID NO: 188067 - RNA, 22 nt, Homo sapiens
uuacaaccucagcagugcaaag

SEQ ID NO: 188068 - RNA, 23 nt, Homo sapiens
uuacaguggcaugaucucugcuc

SEQ ID NO: 188069 - RNA, 22 nt, Homo sapiens
uuacaguguuuguucuguuacu

SEQ ID NO: 188070 - RNA, 22 nt, Homo sapiens
uuagaacagugcucaccacaaa

SEQ ID NO: 188071 - RNA, 22 nt, Homo sapiens
uuagcacuugggaguauuuauu

SEQ ID NO: 188072 - RNA, 22 nt, Homo sapiens
uuaggcuuuauugaaaacaaua

SEQ ID NO: 188073 - RNA, 22 nt, Homo sapiens
uuaugcaucuuccacacucauu

SEQ ID NO: 188074 - RNA, 22 nt, Homo sapiens
uuauugcucauuugggcauucu

SEQ ID NO: 188075 - RNA, 22 nt, Homo sapiens
uucagacugggugaagagggua

SEQ ID NO: 188076 - RNA, 22 nt, Homo sapiens
uuccaguguguucauccucaga

SEQ ID NO: 188077 - RNA, 22 nt, Homo sapiens
uucuacaggcuguucaagaagc

SEQ ID NO: 188078 - RNA, 22 nt, Homo sapiens
uugaaggaacgcuguucccuug

SEQ ID NO: 188079 - RNA, 22 nt, Homo sapiens
uugaauagacagccagcuuuaa

SEQ ID NO: 188080 - RNA, 22 nt, Homo sapiens
uugacuucagagcugauucaag

SEQ ID NO: 188081 - RNA, 22 nt, Homo sapiens
uugagauacauaauuaugaaug

SEQ ID NO: 188082 - RNA, 22 nt, Homo sapiens
uugagauggagucucacucugc

SEQ ID NO: 188083 - RNA, 22 nt, Homo sapiens
uugagauggagucucacucuuc

SEQ ID NO: 188084 - RNA, 22 nt, Homo sapiens
uugagauggagucucacucuug

SEQ ID NO: 188085 - RNA, 22 nt, Homo sapiens
uugagauggagucucgcucugu

SEQ ID NO: 188086 - RNA, 22 nt, Homo sapiens
uugagauggagucucgcucuuu

SEQ ID NO: 188087 - RNA, 22 nt, Homo sapiens
uugagauggagucuugcucucu

SEQ ID NO: 188088 - RNA, 22 nt, Homo sapiens
uugagauggaguguugcucugu

SEQ ID NO: 188089 - RNA, 22 nt, Homo sapiens
acacagugucuguguauuuaaa

SEQ ID NO: 188090 - RNA, 22 nt, Homo sapiens
acauguaauugauuuuguguua

SEQ ID NO: 188091 - RNA, 22 nt, Homo sapiens
acccugugagagaguuaauauu

SEQ ID NO: 188092 - RNA, 22 nt, Homo sapiens
agaauacugucuauucauggua

SEQ ID NO: 188093 - RNA, 22 nt, Homo sapiens
agagugcaauggcaccaucucg

SEQ ID NO: 188094 - RNA, 22 nt, Homo sapiens
agauacaucuaugugucugugu

SEQ ID NO: 188095 - RNA, 22 nt, Homo sapiens
agauggguuuucacauguuggc

SEQ ID NO: 188096 - RNA, 22 nt, Homo sapiens
agaugguguuggcugaguguau

SEQ ID NO: 188097 - RNA, 22 nt, Homo sapiens
agcaagauuguucccauuuucu

SEQ ID NO: 188098 - RNA, 22 nt, Homo sapiens
agcuucauuccaacuuccuucu

SEQ ID NO: 188099 - RNA, 23 nt, Homo sapiens
aggaaguaacuaucuuuucuguc

SEQ ID NO: 188100 - RNA, 22 nt, Homo sapiens
aggcaugaguucagaggguaug

SEQ ID NO: 188101 - RNA, 22 nt, Homo sapiens
agucagauuggcauuuguuggg

SEQ ID NO: 188102 - RNA, 22 nt, Homo sapiens
agucauggcagaaggcaccucu

SEQ ID NO: 188103 - RNA, 22 nt, Homo sapiens
aguccaguguuaugaucaguag

SEQ ID NO: 188104 - RNA, 22 nt, Homo sapiens
auaauaguguuuagauuuggga

SEQ ID NO: 188105 - RNA, 22 nt, Homo sapiens
auacaguguucugggaagaagu

SEQ ID NO: 188106 - RNA, 22 nt, Homo sapiens
auacguacauaugcacauaugg

SEQ ID NO: 188107 - RNA, 22 nt, Homo sapiens
auagagguagacagaggggaaa

SEQ ID NO: 188108 - RNA, 22 nt, Homo sapiens
auagaguuagaaagaaauguuu

SEQ ID NO: 188109 - RNA, 22 nt, Homo sapiens
auagcaaugccccacuccuugg

SEQ ID NO: 188110 - RNA, 22 nt, Homo sapiens
auaguacuauugcaguguuaua

SEQ ID NO: 188111 - RNA, 22 nt, Homo sapiens
auaguagagagggcaaaaugcu

SEQ ID NO: 188112 - RNA, 22 nt, Homo sapiens
auaguggcaugaucauagcuca

SEQ ID NO: 188113 - RNA, 22 nt, Homo sapiens
auauaccuaggcuacaugguuu

SEQ ID NO: 188114 - RNA, 22 nt, Homo sapiens
auauauguuuucugggaagaaa

SEQ ID NO: 188115 - RNA, 22 nt, Homo sapiens
aucacugggagcagccauuaau

SEQ ID NO: 188116 - RNA, 22 nt, Homo sapiens
aucauguaguaagacacauuua

SEQ ID NO: 188117 - RNA, 22 nt, Homo sapiens
aucauugugugaguugauggga

SEQ ID NO: 188118 - RNA, 22 nt, Homo sapiens
aucccaguaaaaauggcuucua

SEQ ID NO: 188119 - RNA, 22 nt, Homo sapiens
auccugagacuuuucugaaguu

SEQ ID NO: 188120 - RNA, 22 nt, Homo sapiens
auccuuuagacuguccaguuga

SEQ ID NO: 188121 - RNA, 22 nt, Homo sapiens
augagaauguaaguuaaugaaa

SEQ ID NO: 188122 - RNA, 22 nt, Homo sapiens
augagauaggaacaaacuuaca

SEQ ID NO: 188123 - RNA, 22 nt, Homo sapiens
augagauauguuaaaaguuaaa

SEQ ID NO: 188124 - RNA, 19 nt, Homo sapiens
augauugucuauggaggaa

SEQ ID NO: 188125 - RNA, 22 nt, Homo sapiens
auggauuuguaguacaugguug

SEQ ID NO: 188126 - RNA, 22 nt, Homo sapiens
auggcagaaucaagccgacagc

SEQ ID NO: 188127 - RNA, 22 nt, Homo sapiens
auggccugaugcaccuguccca

SEQ ID NO: 188128 - RNA, 18 nt, Homo sapiens
auggguguuggaaaauga

SEQ ID NO: 188129 - RNA, 20 nt, Homo sapiens
auguaauguaugauauguac

SEQ ID NO: 188130 - RNA, 22 nt, Homo sapiens
auugcauaaacacauuucuuau

SEQ ID NO: 188131 - RNA, 22 nt, Homo sapiens
auuggcuuuauacauaagaaua

SEQ ID NO: 188132 - RNA, 22 nt, Homo sapiens
auuguaauuuuagagaaagugg

SEQ ID NO: 188133 - RNA, 22 nt, Homo sapiens
caaccaguagcugaguucaaaa

SEQ ID NO: 188134 - RNA, 22 nt, Homo sapiens
caacucuguaggauccaggugg

SEQ ID NO: 188135 - RNA, 21 nt, Homo sapiens
cacauggaggcagagagugua

SEQ ID NO: 188136 - RNA, 22 nt, Homo sapiens
cacugcauucuccaccucccag

SEQ ID NO: 188137 - RNA, 17 nt, Homo sapiens
cacugggugcaagagga

SEQ ID NO: 188138 - RNA, 21 nt, Homo sapiens
cacuggguucaggcuugugga

SEQ ID NO: 188139 - RNA, 21 nt, Homo sapiens
cacugguguugcuauaucaaa

SEQ ID NO: 188140 - RNA, 22 nt, Homo sapiens
caggugcauuggcugacaccug

SEQ ID NO: 188141 - RNA, 22 nt, Homo sapiens
caguaguagccccuuagaugga

SEQ ID NO: 188142 - RNA, 22 nt, Homo sapiens
caucauugcacccuauagagaa

SEQ ID NO: 188143 - RNA, 22 nt, Homo sapiens
cauggucaccuuccaaguuauu

SEQ ID NO: 188144 - RNA, 22 nt, Homo sapiens
ccacugggcaguuuauuaucag

SEQ ID NO: 188145 - RNA, 22 nt, Homo sapiens
ccacugggcuagguguuuugga

SEQ ID NO: 188146 - RNA, 22 nt, Homo sapiens
cgccugagcugaggaagcugca

SEQ ID NO: 188147 - RNA, 18 nt, Homo sapiens
cuaauacuauucaacaag

SEQ ID NO: 188148 - RNA, 22 nt, Homo sapiens
cuacagugggucuguaguccuu

SEQ ID NO: 188149 - RNA, 22 nt, Homo sapiens
cuacauuguagguauucaaacu

SEQ ID NO: 188150 - RNA, 22 nt, Homo sapiens
cuaugcuucuuaaauuaguuau

SEQ ID NO: 188151 - RNA, 21 nt, Homo sapiens
cucaaaguacugauauuacag

SEQ ID NO: 188152 - RNA, 22 nt, Homo sapiens
cucaaaguguggucuguggguu

SEQ ID NO: 188153 - RNA, 22 nt, Homo sapiens
cugaagugcuugccacauaaaa

SEQ ID NO: 188154 - RNA, 22 nt, Homo sapiens
cugacuuuagaacccaaaaagu

SEQ ID NO: 188155 - RNA, 17 nt, Homo sapiens
cuucaaauaauuucccc

SEQ ID NO: 188156 - RNA, 22 nt, Homo sapiens
cuuccaaguggggcacgugcca

SEQ ID NO: 188157 - RNA, 22 nt, Homo sapiens
cuugagcauauucuauauuaaa

SEQ ID NO: 188158 - RNA, 22 nt, Homo sapiens
cuugggauauguguuacucugu

SEQ ID NO: 188159 - RNA, 22 nt, Homo sapiens
gaagcgaggugauuagcagaca

SEQ ID NO: 188160 - RNA, 22 nt, Homo sapiens
gacugaggaagcgcucucuccu

SEQ ID NO: 188161 - RNA, 22 nt, Homo sapiens
gagacggagucucgcucuguca

SEQ ID NO: 188162 - RNA, 22 nt, Homo sapiens
gagacugagucuugcucugucg

SEQ ID NO: 188163 - RNA, 22 nt, Homo sapiens
gagaugguacacauacgauucu

SEQ ID NO: 188164 - RNA, 22 nt, Homo sapiens
gagauucaucuagguccagaga

SEQ ID NO: 188165 - RNA, 22 nt, Homo sapiens
gagcaaaaguauguauugguua

SEQ ID NO: 188166 - RNA, 22 nt, Homo sapiens
gaggcuagauggggaugugucc

SEQ ID NO: 188167 - RNA, 22 nt, Homo sapiens
gaggugguagguucacagcagc

SEQ ID NO: 188168 - RNA, 22 nt, Homo sapiens
gaguaaaugucacuguugcugu

SEQ ID NO: 188169 - RNA, 22 nt, Homo sapiens
gauauguaaaaauuauaucuga

SEQ ID NO: 188170 - RNA, 22 nt, Homo sapiens
gauauguaguaguugaaaaaga

SEQ ID NO: 188171 - RNA, 22 nt, Homo sapiens
gauuccauugcgaauuuucaga

SEQ ID NO: 188172 - RNA, 22 nt, Homo sapiens
gcaggaaucuugagaaggauuc

SEQ ID NO: 188173 - RNA, 22 nt, Homo sapiens
gcagguguuaugcaaacaacug

SEQ ID NO: 188174 - RNA, 22 nt, Homo sapiens
gccuagagacuugguaucuugc

SEQ ID NO: 188175 - RNA, 22 nt, Homo sapiens
gcucaaguaauggcaguuuugc

SEQ ID NO: 188176 - RNA, 23 nt, Homo sapiens
ggauucaucuguuuguucgcugu

SEQ ID NO: 188177 - RNA, 22 nt, Homo sapiens
ggcaaguauguuuuaggaugcu

SEQ ID NO: 188178 - RNA, 22 nt, Homo sapiens
guaaacuuccccucaugaauga

SEQ ID NO: 188179 - RNA, 22 nt, Homo sapiens
uguggcuuuuucuuggcugagg

SEQ ID NO: 188180 - RNA, 21 nt, Homo sapiens
uguuaacaugcagauuacugg

SEQ ID NO: 188181 - RNA, 22 nt, Homo sapiens
uguucacaguguuucuuugaga

SEQ ID NO: 188182 - RNA, 22 nt, Homo sapiens
uuaaguagaugaaugugaaugu

SEQ ID NO: 188183 - RNA, 22 nt, Homo sapiens
guaauagucucaaacuccugga

SEQ ID NO: 188184 - RNA, 22 nt, Homo sapiens
guaugugacuggaacaguagga

SEQ ID NO: 188185 - RNA, 22 nt, Homo sapiens
gucaguggauacugucucuguc

SEQ ID NO: 188186 - RNA, 22 nt, Homo sapiens
gucucccagccuacaucuuucu

SEQ ID NO: 188187 - RNA, 22 nt, Homo sapiens
gucuggcaauggcagacuggca

SEQ ID NO: 188188 - RNA, 22 nt, Homo sapiens
gugagauuaccauuuaaaucag

SEQ ID NO: 188189 - RNA, 21 nt, Homo sapiens
gugaucaugucacugcacucc

SEQ ID NO: 188190 - RNA, 20 nt, Homo sapiens
guggaaguagaaacauaugu

SEQ ID NO: 188191 - RNA, 22 nt, Homo sapiens
guggaaguguaaaagcucuugg

SEQ ID NO: 188192 - RNA, 22 nt, Homo sapiens
guggaagugucuggggccaggg

SEQ ID NO: 188193 - RNA, 22 nt, Homo sapiens
guggcagaacagguaggguucu

SEQ ID NO: 188194 - RNA, 22 nt, Homo sapiens
guggcagagucagagggaaaug

SEQ ID NO: 188195 - RNA, 22 nt, Homo sapiens
guggcuagaaugaagguagcug

SEQ ID NO: 188196 - RNA, 23 nt, Homo sapiens
uaacauguuuuuaagggaagcuu

SEQ ID NO: 188197 - RNA, 22 nt, Homo sapiens
uaacuaguagauggcugacaua

SEQ ID NO: 188198 - RNA, 22 nt, Homo sapiens
uaagacuuuuugggaauauaga

SEQ ID NO: 188199 - RNA, 22 nt, Homo sapiens
uaagccaccgugccuggccuaa

SEQ ID NO: 188200 - RNA, 22 nt, Homo sapiens
uaaguucauucaugaaacuuag

SEQ ID NO: 188201 - RNA, 22 nt, Homo sapiens
uaauaguuucagaaguuguuuu

SEQ ID NO: 188202 - RNA, 22 nt, Homo sapiens
uaaugcauacagaagguguuuu

SEQ ID NO: 188203 - RNA, 22 nt, Homo sapiens
uacacaugugaguucuuuucua

SEQ ID NO: 188204 - RNA, 22 nt, Homo sapiens
uacauguauccauuguuuuugg

SEQ ID NO: 188205 - RNA, 22 nt, Homo sapiens
uagaggaaugaauuuggccaga

SEQ ID NO: 188206 - RNA, 22 nt, Homo sapiens
uagauaguaaagccauuagcuu

SEQ ID NO: 188207 - RNA, 22 nt, Homo sapiens
uagauucauuuuagcaaaaguu

SEQ ID NO: 188208 - RNA, 22 nt, Homo sapiens
uaggugauugaagguggaaugu

SEQ ID NO: 188209 - RNA, 21 nt, Homo sapiens
uauaguaguaugauuuacaau

SEQ ID NO: 188210 - RNA, 22 nt, Homo sapiens
uaucucuuuucauguguaaaug

SEQ ID NO: 188211 - RNA, 22 nt, Homo sapiens
uaugagaugaggccacugggua

SEQ ID NO: 188212 - RNA, 22 nt, Homo sapiens
uaugcuguuucugauuuaggga

SEQ ID NO: 188213 - RNA, 22 nt, Homo sapiens
uauuacuugucugugucucaau

SEQ ID NO: 188214 - RNA, 22 nt, Homo sapiens
uauugaauuuuuaagcccuuug

SEQ ID NO: 188215 - RNA, 22 nt, Homo sapiens
uauugcuuuacucucuuauccu

SEQ ID NO: 188216 - RNA, 22 nt, Homo sapiens
ucaaagucuucucaaguaacau

SEQ ID NO: 188217 - RNA, 22 nt, Homo sapiens
ucacaauucucaauuugugaaa

SEQ ID NO: 188218 - RNA, 22 nt, Homo sapiens
ucacagcuaaaaugaaaguagu

SEQ ID NO: 188219 - RNA, 22 nt, Homo sapiens
ucacaguccuguuuaggagagg

SEQ ID NO: 188220 - RNA, 20 nt, Homo sapiens
ucacccugacaucugcccag

SEQ ID NO: 188221 - RNA, 22 nt, Homo sapiens
ucacgugguucauaaggcagaa

SEQ ID NO: 188222 - RNA, 22 nt, Homo sapiens
ucauauguaugugcaauuuugu

SEQ ID NO: 188223 - RNA, 22 nt, Homo sapiens
uccauagugagcagucaaugua

SEQ ID NO: 188224 - RNA, 22 nt, Homo sapiens
ucucaaguggucgcaguuagau

SEQ ID NO: 188225 - RNA, 22 nt, Homo sapiens
ucucagcacaaacaaaauugcu

SEQ ID NO: 188226 - RNA, 22 nt, Homo sapiens
ucugagguaggugcauggauac

SEQ ID NO: 188227 - RNA, 22 nt, Homo sapiens
ucugagguuaaauuuuauaguu

SEQ ID NO: 188228 - RNA, 22 nt, Homo sapiens
ucuggguuuuuacaauguuuac

SEQ ID NO: 188229 - RNA, 22 nt, Homo sapiens
ucuuuggguagauauguagcug

SEQ ID NO: 188230 - RNA, 22 nt, Homo sapiens
ucuuuggguguauuucacagcc

SEQ ID NO: 188231 - RNA, 22 nt, Homo sapiens
ugaaagcuacagucuccuagga

SEQ ID NO: 188232 - RNA, 22 nt, Homo sapiens
ugaauaguaauguguuuggucu

SEQ ID NO: 188233 - RNA, 21 nt, Homo sapiens
ugaauauuuggguugugucca

SEQ ID NO: 188234 - RNA, 22 nt, Homo sapiens
ugacagcugaagauguugaacc

SEQ ID NO: 188235 - RNA, 22 nt, Homo sapiens
ugagacggagucucgcucuguc

SEQ ID NO: 188236 - RNA, 22 nt, Homo sapiens
ugagacugaguuuugccuuugu

SEQ ID NO: 188237 - RNA, 22 nt, Homo sapiens
ugagaggugauaaagcaagggu

SEQ ID NO: 188238 - RNA, 18 nt, Homo sapiens
ugagauacuagaauaggu

SEQ ID NO: 188239 - RNA, 19 nt, Homo sapiens
ugagaugaagacagggguu

SEQ ID NO: 188240 - RNA, 22 nt, Homo sapiens
ugagauggagucuugucgccua

SEQ ID NO: 188241 - RNA, 22 nt, Homo sapiens
ugagauggaucuuggauuugaa

SEQ ID NO: 188242 - RNA, 22 nt, Homo sapiens
ugaguucuuuguagauucugug

SEQ ID NO: 188243 - RNA, 22 nt, Homo sapiens
ugauaucucuugccuccaaaug

SEQ ID NO: 188244 - RNA, 22 nt, Homo sapiens
ugauaugugaguauaugguuau

SEQ ID NO: 188245 - RNA, 22 nt, Homo sapiens
ugcaauauccucuacuauaggu

SEQ ID NO: 188246 - RNA, 22 nt, Homo sapiens
ugcaucacaguacuccagccug

SEQ ID NO: 188247 - RNA, 22 nt, Homo sapiens
ugccugagcccagcccuguagu

SEQ ID NO: 188248 - RNA, 22 nt, Homo sapiens
uggaaaacaugcacauuggauu

SEQ ID NO: 188249 - RNA, 22 nt, Homo sapiens
uggaaauaaaugugccaagauc

SEQ ID NO: 188250 - RNA, 22 nt, Homo sapiens
uggaagucaugcugcaagaaca

SEQ ID NO: 188251 - RNA, 22 nt, Homo sapiens
uggaagucuauggcauuugagu

SEQ ID NO: 188252 - RNA, 22 nt, Homo sapiens
uggaagucuucauuauguauag

SEQ ID NO: 188253 - RNA, 22 nt, Homo sapiens
uggacauguacauauguguaug

SEQ ID NO: 188254 - RNA, 22 nt, Homo sapiens
uggauagugauaagguagauga

SEQ ID NO: 188255 - RNA, 21 nt, Homo sapiens
uggauuguacacccuaucauu

SEQ ID NO: 188256 - RNA, 19 nt, Homo sapiens
uggauuguuagagcagugu

SEQ ID NO: 188257 - RNA, 22 nt, Homo sapiens
uggcaaaugugagaugagaacu

SEQ ID NO: 188258 - RNA, 22 nt, Homo sapiens
uggcagauagaaaugugguuaa

SEQ ID NO: 188259 - RNA, 22 nt, Homo sapiens
uggcagaugggugagcuggaga

SEQ ID NO: 188260 - RNA, 22 nt, Homo sapiens
uggcauaugguauuugauaucu

SEQ ID NO: 188261 - RNA, 20 nt, Homo sapiens
uggcaugaaauuuuccaagc

SEQ ID NO: 188262 - RNA, 23 nt, Homo sapiens
uggccagaaacuucuuuucaucc

SEQ ID NO: 188263 - RNA, 22 nt, Homo sapiens
uggcuacagaaaguacuaguga

SEQ ID NO: 188264 - RNA, 20 nt, Homo sapiens
ugggaaauguccaggacaua

SEQ ID NO: 188265 - RNA, 22 nt, Homo sapiens
ugggauguagccuucuauuuuc

SEQ ID NO: 188266 - RNA, 22 nt, Homo sapiens
ugggaugugagucuucgcuuuc

SEQ ID NO: 188267 - RNA, 22 nt, Homo sapiens
ugguaugucuagauggggaagu

SEQ ID NO: 188268 - RNA, 22 nt, Homo sapiens
uguaauaguaggcucacauuug

SEQ ID NO: 188269 - RNA, 22 nt, Homo sapiens
ugucaaacauuaugaugcucua

SEQ ID NO: 188270 - RNA, 22 nt, Homo sapiens
ugucaaaugcagugauauuuga

SEQ ID NO: 188271 - RNA, 22 nt, Homo sapiens
ugucuuggaugaggauuaacag

SEQ ID NO: 188272 - RNA, 22 nt, Homo sapiens
ugugaaaucagauagccuuuuu

SEQ ID NO: 188273 - RNA, 22 nt, Homo sapiens
aaauaacugucagguucuggaa

SEQ ID NO: 188274 - RNA, 22 nt, Homo sapiens
aaaugcuuucuuggaccauuug

SEQ ID NO: 188275 - RNA, 22 nt, Homo sapiens
aaauggauuaaguucacuugcu

SEQ ID NO: 188276 - RNA, 22 nt, Homo sapiens
aagagagccagcugguauauuu

SEQ ID NO: 188277 - RNA, 22 nt, Homo sapiens
aaggaaguaauuugguuuauag

SEQ ID NO: 188278 - RNA, 22 nt, Homo sapiens
aaggaauucaaauuuucucugg

SEQ ID NO: 188279 - RNA, 22 nt, Homo sapiens
aaggaguagaauagaugcaccu

SEQ ID NO: 188280 - RNA, 22 nt, Homo sapiens
aaguguaaguuaauguuuaggu

SEQ ID NO: 188281 - RNA, 22 nt, Homo sapiens
aauauagcuauguacaugucca

SEQ ID NO: 188282 - RNA, 22 nt, Homo sapiens
aaugcauaauuuguaugaggua

SEQ ID NO: 188283 - RNA, 22 nt, Homo sapiens
aauuguacucccauaauucccu

SEQ ID NO: 188284 - RNA, 22 nt, Homo sapiens
acacuggguaacauaucuguua

SEQ ID NO: 188285 - RNA, 18 nt, Homo sapiens
acaguguguaaggguucu

SEQ ID NO: 188286 - RNA, 22 nt, Homo sapiens
acccuuaagcacuaguucagcu

SEQ ID NO: 188287 - RNA, 22 nt, Homo sapiens
acucagagaacauucccagucu

SEQ ID NO: 188288 - RNA, 22 nt, Homo sapiens
agagcaaugggugaauauuaaa

SEQ ID NO: 188289 - RNA, 21 nt, Homo sapiens
agaggacugaccacagcccua

SEQ ID NO: 188290 - RNA, 22 nt, Homo sapiens
agagguaugccugggcuggagc

SEQ ID NO: 188291 - RNA, 22 nt, Homo sapiens
agagugcaaagguuggggcugg

SEQ ID NO: 188292 - RNA, 22 nt, Homo sapiens
agcaaccuugaauagcccuuuc

SEQ ID NO: 188293 - RNA, 22 nt, Homo sapiens
agcagcuuugcauggccuguga

SEQ ID NO: 188294 - RNA, 21 nt, Homo sapiens
agcagcuuugguugaagcaga

SEQ ID NO: 188295 - RNA, 16 nt, Homo sapiens
agcagguguuagguga

SEQ ID NO: 188296 - RNA, 21 nt, Homo sapiens
agcugguuuccacagugugcu

SEQ ID NO: 188297 - RNA, 22 nt, Homo sapiens
aggcaggugaaagauaguuuua

SEQ ID NO: 188298 - RNA, 22 nt, Homo sapiens
agguccauugguauuauagcau

SEQ ID NO: 188299 - RNA, 22 nt, Homo sapiens
aguaaauuucugugcuuucaua

SEQ ID NO: 188300 - RNA, 22 nt, Homo sapiens
auaacauggaguuugucauuua

SEQ ID NO: 188301 - RNA, 22 nt, Homo sapiens
auaauaccugccacauuugaau

SEQ ID NO: 188302 - RNA, 22 nt, Homo sapiens
auacacuggagcaaaccuggag

SEQ ID NO: 188303 - RNA, 22 nt, Homo sapiens
auacaguguauguauaguacau

SEQ ID NO: 188304 - RNA, 22 nt, Homo sapiens
auacaguugccauuucuugugc

SEQ ID NO: 188305 - RNA, 22 nt, Homo sapiens
auacuagucaagaauguaugag

SEQ ID NO: 188306 - RNA, 23 nt, Homo sapiens
auauaguagaugugcaguaacau

SEQ ID NO: 188307 - RNA, 22 nt, Homo sapiens
auauucacagguaucagagauu

SEQ ID NO: 188308 - RNA, 22 nt, Homo sapiens
aucacuggccuuuuuaaaugcu

SEQ ID NO: 188309 - RNA, 22 nt, Homo sapiens
aucagaaucucuagugggacca

SEQ ID NO: 188310 - RNA, 22 nt, Homo sapiens
aucagaaucucuugagaguguu

SEQ ID NO: 188311 - RNA, 22 nt, Homo sapiens
augagaacugucaaugagagcu

SEQ ID NO: 188312 - RNA, 22 nt, Homo sapiens
augagauauuuuauaagaucau

SEQ ID NO: 188313 - RNA, 22 nt, Homo sapiens
augaggugaggucaguaaggua

SEQ ID NO: 188314 - RNA, 19 nt, Homo sapiens
augaguuaggggaaauuuc

SEQ ID NO: 188315 - RNA, 22 nt, Homo sapiens
augcuuguugcagccugagccu

SEQ ID NO: 188316 - RNA, 22 nt, Homo sapiens
auggaagucucuguuaaguuuc

SEQ ID NO: 188317 - RNA, 22 nt, Homo sapiens
auggauuuugaacuugagaguu

SEQ ID NO: 188318 - RNA, 22 nt, Homo sapiens
auggcagagucagaaagucagg

SEQ ID NO: 188319 - RNA, 20 nt, Homo sapiens
auggcccugcugggaguguc

SEQ ID NO: 188320 - RNA, 17 nt, Homo sapiens
auguaauccucaucucu

SEQ ID NO: 188321 - RNA, 22 nt, Homo sapiens
auuacaugucuauccaugaaca

SEQ ID NO: 188322 - RNA, 22 nt, Homo sapiens
auugaacaugccauauguacca

SEQ ID NO: 188323 - RNA, 22 nt, Homo sapiens
auugcauugugaucuucccaga

SEQ ID NO: 188324 - RNA, 22 nt, Homo sapiens
auuggauagucuuuaucuguug

SEQ ID NO: 188325 - RNA, 22 nt, Homo sapiens
auuuggcaauuuugaagaugcc

SEQ ID NO: 188326 - RNA, 22 nt, Homo sapiens
caaaguaauugcuguuuugcca

SEQ ID NO: 188327 - RNA, 22 nt, Homo sapiens
caaaguaauugugguuuugcca

SEQ ID NO: 188328 - RNA, 22 nt, Homo sapiens
cacuggacauguugaagcuuuu

SEQ ID NO: 188329 - RNA, 23 nt, Homo sapiens
cagcuucauugaacauaacuccu

SEQ ID NO: 188330 - RNA, 22 nt, Homo sapiens
cagguacauuuuaaagggcuca

SEQ ID NO: 188331 - RNA, 22 nt, Homo sapiens
caguacaauguugauuagaagu

SEQ ID NO: 188332 - RNA, 22 nt, Homo sapiens
cauaguacuugcauaguacuau

SEQ ID NO: 188333 - RNA, 22 nt, Homo sapiens
caucccugucgucaagucucug

SEQ ID NO: 188334 - RNA, 22 nt, Homo sapiens
cauuacacuccagccuggguga

SEQ ID NO: 188335 - RNA, 22 nt, Homo sapiens
cauuacacuuguaagguuuuuc

SEQ ID NO: 188336 - RNA, 18 nt, Homo sapiens
ccagugcaaggaaagccc

SEQ ID NO: 188337 - RNA, 22 nt, Homo sapiens
ccugagguagaguuuauauuga

SEQ ID NO: 188338 - RNA, 22 nt, Homo sapiens
cuaagauugucuuaguguguug

SEQ ID NO: 188339 - RNA, 22 nt, Homo sapiens
cuaggcuguagagaaguucagu

SEQ ID NO: 188340 - RNA, 23 nt, Homo sapiens
cuccaugagccguccagggccug

SEQ ID NO: 188341 - RNA, 22 nt, Homo sapiens
cucugacagugguuagcacugu

SEQ ID NO: 188342 - RNA, 22 nt, Homo sapiens
cugaauagucaacgauggacug

SEQ ID NO: 188343 - RNA, 22 nt, Homo sapiens
cugaggcacggcgaccuuaagu

SEQ ID NO: 188344 - RNA, 22 nt, Homo sapiens
cuggaauauuagcuggucuuaa

SEQ ID NO: 188345 - RNA, 22 nt, Homo sapiens
cuggcaagagugaaccagcugu

SEQ ID NO: 188346 - RNA, 22 nt, Homo sapiens
cugugcaaagcgcucucggggu

SEQ ID NO: 188347 - RNA, 22 nt, Homo sapiens
cuugacacugguuuucugaaua

SEQ ID NO: 188348 - RNA, 22 nt, Homo sapiens
cuuggcuagucaaaccuccccg

SEQ ID NO: 188349 - RNA, 22 nt, Homo sapiens
cuuugcacaucucugcuuuccc

SEQ ID NO: 188350 - RNA, 22 nt, Homo sapiens
cuuugggaccgcgguuuauacu

SEQ ID NO: 188351 - RNA, 22 nt, Homo sapiens
ugauauguggauucagcucaaa

SEQ ID NO: 188352 - RNA, 22 nt, Homo sapiens
ugaucaaagugcuggaauuaca

SEQ ID NO: 188353 - RNA, 19 nt, Homo sapiens
ugcagcaauguaaaagaca

SEQ ID NO: 188354 - RNA, 22 nt, Homo sapiens
ugccugagccagguuuuaggag

SEQ ID NO: 188355 - RNA, 22 nt, Homo sapiens
uggaaaguacuugaguuuguau

SEQ ID NO: 188356 - RNA, 22 nt, Homo sapiens
uggaaauaaaauagaguuugcc

SEQ ID NO: 188357 - RNA, 18 nt, Homo sapiens
uggcaauaugguucuacc

SEQ ID NO: 188358 - RNA, 20 nt, Homo sapiens
uggcaccugacagauagcca

SEQ ID NO: 188359 - RNA, 22 nt, Homo sapiens
uggcaggugcacuggcuuugaa

SEQ ID NO: 188360 - RNA, 23 nt, Homo sapiens
uggccaagauaaucucaguuuuc

SEQ ID NO: 188361 - RNA, 22 nt, Homo sapiens
uggccuguaacgcugucucagc

SEQ ID NO: 188362 - RNA, 22 nt, Homo sapiens
uggcgagaaaccauaugcuuuc

SEQ ID NO: 188363 - RNA, 22 nt, Homo sapiens
ugggagugugcacaauuucagc

SEQ ID NO: 188364 - RNA, 22 nt, Homo sapiens
ugggaucagucuggaauauuga

SEQ ID NO: 188365 - RNA, 22 nt, Homo sapiens
uguacuagaaauuaaggcaggg

SEQ ID NO: 188366 - RNA, 22 nt, Homo sapiens
uguauacauauguauguuuugu

SEQ ID NO: 188367 - RNA, 22 nt, Homo sapiens
uguaugagagacauggcugcuu

SEQ ID NO: 188368 - RNA, 22 nt, Homo sapiens
ugugaacagcuccaaaugugga

SEQ ID NO: 188369 - RNA, 22 nt, Homo sapiens
ugugcauaugucuuuauaguag

SEQ ID NO: 188370 - RNA, 22 nt, Homo sapiens
uguggcuuuacagcaugguuca

SEQ ID NO: 188371 - RNA, 22 nt, Homo sapiens
uuaauacugcuuaacuuuagga

SEQ ID NO: 188372 - RNA, 22 nt, Homo sapiens
uuaauagugacucauuuuccac

SEQ ID NO: 188373 - RNA, 22 nt, Homo sapiens
uuaauguaucuaucacaucaca

SEQ ID NO: 188374 - RNA, 22 nt, Homo sapiens
uuacagauggcacacucaaggg

SEQ ID NO: 188375 - RNA, 20 nt, Homo sapiens
uuacagugggaccuuccuga

SEQ ID NO: 188376 - RNA, 22 nt, Homo sapiens
uuacaguggugaccuuguauug

SEQ ID NO: 188377 - RNA, 22 nt, Homo sapiens
uuacccauuagagaauuuaaga

SEQ ID NO: 188378 - RNA, 22 nt, Homo sapiens
uuacccuuuaacccuuuaaagu

SEQ ID NO: 188379 - RNA, 18 nt, Homo sapiens
uuagaugguuuuaaaacu

SEQ ID NO: 188380 - RNA, 22 nt, Homo sapiens
uuauagacacguuguaacaaac

SEQ ID NO: 188381 - RNA, 22 nt, Homo sapiens
uuauccugucaguaaauauuuu

SEQ ID NO: 188382 - RNA, 22 nt, Homo sapiens
uuaugacaggcucaggagcccc

SEQ ID NO: 188383 - RNA, 22 nt, Homo sapiens
uucaauuaauauuauacucuca

SEQ ID NO: 188384 - RNA, 22 nt, Homo sapiens
uucaggguggagaguaugaggu

SEQ ID NO: 188385 - RNA, 22 nt, Homo sapiens
uucagguacuauaggcuguugg

SEQ ID NO: 188386 - RNA, 22 nt, Homo sapiens
uucauaguaacaguaacuaugg

SEQ ID NO: 188387 - RNA, 22 nt, Homo sapiens
uucauguaauauuucacagcuu

SEQ ID NO: 188388 - RNA, 22 nt, Homo sapiens
uucauugaaugauuuuuagaag

SEQ ID NO: 188389 - RNA, 22 nt, Homo sapiens
uuccauguugauacgugaaguu

SEQ ID NO: 188390 - RNA, 19 nt, Homo sapiens
uuccugagaacaagggcuu

SEQ ID NO: 188391 - RNA, 22 nt, Homo sapiens
uuccugagccuuguaucuagua

SEQ ID NO: 188392 - RNA, 22 nt, Homo sapiens
uugagauggagccucacucugc

SEQ ID NO: 188393 - RNA, 22 nt, Homo sapiens
uugagauggagcuucacucuug

SEQ ID NO: 188394 - RNA, 22 nt, Homo sapiens
uugagauggagucucacucuuu

SEQ ID NO: 188395 - RNA, 22 nt, Homo sapiens
uugagauggaguuucgcucuug

SEQ ID NO: 188396 - RNA, 22 nt, Homo sapiens
uugagauggauagacauagcau

SEQ ID NO: 188397 - RNA, 22 nt, Homo sapiens
uugagauuauuguguuccuuua

SEQ ID NO: 188398 - RNA, 22 nt, Homo sapiens
uugagcaucauguuagcacuca

SEQ ID NO: 188399 - RNA, 22 nt, Homo sapiens
uugcacuguaauuuauuuaugu

SEQ ID NO: 188400 - RNA, 22 nt, Homo sapiens
uuggaauacucaaaagguuggg

SEQ ID NO: 188401 - RNA, 22 nt, Homo sapiens
uuguacccuuucuaugaggcca

SEQ ID NO: 188402 - RNA, 22 nt, Homo sapiens
uuguaguguuuauucugucaac

SEQ ID NO: 188403 - RNA, 22 nt, Homo sapiens
uuguauguaaccauuuggcaaa

SEQ ID NO: 188404 - RNA, 19 nt, Homo sapiens
uugugggaggacagagggg

SEQ ID NO: 188405 - RNA, 22 nt, Homo sapiens
uugugguuuucagcuuauauau

SEQ ID NO: 188406 - RNA, 22 nt, Homo sapiens
uuuaaacugucuuggguuugga

SEQ ID NO: 188407 - RNA, 19 nt, Homo sapiens
uuuagaucuuuuaugcagc

SEQ ID NO: 188408 - RNA, 22 nt, Homo sapiens
uuuaguucauuaaggaaucucc

SEQ ID NO: 188409 - RNA, 22 nt, Homo sapiens
uuuauucggcuaggagcuucgg

SEQ ID NO: 188410 - RNA, 17 nt, Homo sapiens
uuucagaguggaagugu

SEQ ID NO: 188411 - RNA, 22 nt, Homo sapiens
uuucauggcaguuuggggccug

SEQ ID NO: 188412 - RNA, 22 nt, Homo sapiens
uuugaguuugaggugcugauga

SEQ ID NO: 188413 - RNA, 22 nt, Homo sapiens
uuugcuuaaaucuuaaucagau

SEQ ID NO: 188414 - RNA, 22 nt, Homo sapiens
uuuggcuuuuguaauaacugcc

SEQ ID NO: 188415 - RNA, 22 nt, Homo sapiens
uuugggacuguauuaaaugccu

SEQ ID NO: 188416 - RNA, 22 nt, Homo sapiens
uuuguagcucacucugagcuga

SEQ ID NO: 188417 - RNA, 22 nt, Homo sapiens
uuuuacacaucaccgcucgugu

SEQ ID NO: 188418 - RNA, 22 nt, Homo sapiens
uuuugcucuucggaagagcuug

SEQ ID NO: 188419 - RNA, 22 nt, Homo sapiens
uuuuuggguaaugauuaucaau

SEQ ID NO: 188420 - RNA, 22 nt, Homo sapiens
ucagugcaggaaucucuagcca

SEQ ID NO: 188421 - RNA, 22 nt, Homo sapiens
ucauaguagucacuuaauaaau

SEQ ID NO: 188422 - RNA, 22 nt, Homo sapiens
ucaugugaggauaacaauagug

SEQ ID NO: 188423 - RNA, 22 nt, Homo sapiens
ucauucauucuucaguggguac

SEQ ID NO: 188424 - RNA, 22 nt, Homo sapiens
uccaauguaaucaucauugaau

SEQ ID NO: 188425 - RNA, 22 nt, Homo sapiens
uccaccgugggcugcggggcuc

SEQ ID NO: 188426 - RNA, 22 nt, Homo sapiens
ucccacugucuucucgugcucg

SEQ ID NO: 188427 - RNA, 20 nt, Homo sapiens
ucccucaaacuuuuccacug

SEQ ID NO: 188428 - RNA, 22 nt, Homo sapiens
uccuucauuugucaacucuagu

SEQ ID NO: 188429 - RNA, 22 nt, Homo sapiens
ucucacauuucacagggauggg

SEQ ID NO: 188430 - RNA, 22 nt, Homo sapiens
ucucagcacagucagggcgccu

SEQ ID NO: 188431 - RNA, 20 nt, Homo sapiens
ucucauggagguagagaaua

SEQ ID NO: 188432 - RNA, 22 nt, Homo sapiens
ucucuggauaucuacuuauguu

SEQ ID NO: 188433 - RNA, 22 nt, Homo sapiens
ucugguguuauucauguaguuu

SEQ ID NO: 188434 - RNA, 22 nt, Homo sapiens
ugaauagugucacaauaaacau

SEQ ID NO: 188435 - RNA, 22 nt, Homo sapiens
ugagacauauuauacugcuuuu

SEQ ID NO: 188436 - RNA, 22 nt, Homo sapiens
ugagauagaaaacauaggagaa

SEQ ID NO: 188437 - RNA, 22 nt, Homo sapiens
ugagaugaugggauaagagggc

SEQ ID NO: 188438 - RNA, 22 nt, Homo sapiens
ugagauggaguuucgcucuugu

SEQ ID NO: 188439 - RNA, 22 nt, Homo sapiens
ugagauggcugaauucagaaua

SEQ ID NO: 188440 - RNA, 22 nt, Homo sapiens
ugagauggcuuuauugcugaau

SEQ ID NO: 188441 - RNA, 22 nt, Homo sapiens
ugagcagaguuguuucuccuga

SEQ ID NO: 188442 - RNA, 22 nt, Homo sapiens
ugaguagcuaagacgauaggca

SEQ ID NO: 188443 - RNA, 22 nt, Homo sapiens
ugauaucugaauagauacacaa

SEQ ID NO: 188444 - RNA, 22 nt, Homo sapiens
ugauaucugaucauccuugaua

SEQ ID NO: 188445 - RNA, 22 nt, Homo sapiens
ugccuaggcccaguccucagaa

SEQ ID NO: 188446 - RNA, 22 nt, Homo sapiens
ugcgauaguuugcugguaaauu

SEQ ID NO: 188447 - RNA, 22 nt, Homo sapiens
uggaagauggaguuuuaucauu

SEQ ID NO: 188448 - RNA, 22 nt, Homo sapiens
uggaagucauugagguguguua

SEQ ID NO: 188449 - RNA, 22 nt, Homo sapiens
uggacaugaagggcacaggagg

SEQ ID NO: 188450 - RNA, 22 nt, Homo sapiens
uggccagagggcaauuagcugu

SEQ ID NO: 188451 - RNA, 22 nt, Homo sapiens
uggcuuucuggggcuucuguuc

SEQ ID NO: 188452 - RNA, 22 nt, Homo sapiens
uggcuuuuauuauguugaggua

SEQ ID NO: 188453 - RNA, 22 nt, Homo sapiens
ugggaucagcugggcucucugu

SEQ ID NO: 188454 - RNA, 22 nt, Homo sapiens
ugggaucauuaugcauagugua

SEQ ID NO: 188455 - RNA, 22 nt, Homo sapiens
ugggaucauucaaugacgaaau

SEQ ID NO: 188456 - RNA, 23 nt, Homo sapiens
ugggauguuuuuggaaacuucug

SEQ ID NO: 188457 - RNA, 22 nt, Homo sapiens
uggggugugagggagaaagaaa

SEQ ID NO: 188458 - RNA, 22 nt, Homo sapiens
uggguaggcccucauuggacag

SEQ ID NO: 188459 - RNA, 22 nt, Homo sapiens
ugucagggaggcucggccgcac

SEQ ID NO: 188460 - RNA, 22 nt, Homo sapiens
uguuacacugugcacuaaauuu

SEQ ID NO: 188461 - RNA, 22 nt, Homo sapiens
uuaacacugccauugauacugu

SEQ ID NO: 188462 - RNA, 22 nt, Homo sapiens
uuaagugaauuaucuaacaugu

SEQ ID NO: 188463 - RNA, 22 nt, Homo sapiens
uuaauacucuucuaaguagucc

SEQ ID NO: 188464 - RNA, 21 nt, Homo sapiens
uuaaugcuaugcagaaaaucu

SEQ ID NO: 188465 - RNA, 22 nt, Homo sapiens
uuagaacaguguuugccucgcu

SEQ ID NO: 188466 - RNA, 19 nt, Homo sapiens
uuauacuguauuguuuagg

SEQ ID NO: 188467 - RNA, 22 nt, Homo sapiens
uuaucagcagcaugaaaauaga

SEQ ID NO: 188468 - RNA, 22 nt, Homo sapiens
uuauucugucuuuggucucaau

SEQ ID NO: 188469 - RNA, 22 nt, Homo sapiens
uucacagcuuaauaaggcucag

SEQ ID NO: 188470 - RNA, 22 nt, Homo sapiens
uucaggcuccugugagaaucua

SEQ ID NO: 188471 - RNA, 21 nt, Homo sapiens
uucaucagccagaaaucaagc

SEQ ID NO: 188472 - RNA, 22 nt, Homo sapiens
uucauguagucaucauccugcu

SEQ ID NO: 188473 - RNA, 22 nt, Homo sapiens
uuccaguguuugacucaccuuu

SEQ ID NO: 188474 - RNA, 22 nt, Homo sapiens
uuccccgugaaacuuucucauu

SEQ ID NO: 188475 - RNA, 22 nt, Homo sapiens
uuccuguagcgauuuuaguaau

SEQ ID NO: 188476 - RNA, 22 nt, Homo sapiens
uucucaaggagccuucguaacu

SEQ ID NO: 188477 - RNA, 22 nt, Homo sapiens
uucuuugcuuggaagcggggga

SEQ ID NO: 188478 - RNA, 22 nt, Homo sapiens
uucuuuggaaacaguacuaauu

SEQ ID NO: 188479 - RNA, 22 nt, Homo sapiens
uucuuuggauaaaguuuuaugc

SEQ ID NO: 188480 - RNA, 22 nt, Homo sapiens
uugaauagcauguuuagugcau

SEQ ID NO: 188481 - RNA, 22 nt, Homo sapiens
uugaauaggcucaugcuuauca

SEQ ID NO: 188482 - RNA, 22 nt, Homo sapiens
uugaaugaauggaaagaagggu

SEQ ID NO: 188483 - RNA, 22 nt, Homo sapiens
uugagauggagucucacucugu

SEQ ID NO: 188484 - RNA, 22 nt, Homo sapiens
uugagauggagucuugcucugu

SEQ ID NO: 188485 - RNA, 22 nt, Homo sapiens
uugagauggagucuugcucuug

SEQ ID NO: 188486 - RNA, 22 nt, Homo sapiens
uugagauggaguuucacucugu

SEQ ID NO: 188487 - RNA, 22 nt, Homo sapiens
uugagauggaguuuugcucuug

SEQ ID NO: 188488 - RNA, 22 nt, Homo sapiens
uugaucaaaucugagugagaau

SEQ ID NO: 188489 - RNA, 22 nt, Homo sapiens
uugcacaguguguacagcacca

SEQ ID NO: 188490 - RNA, 22 nt, Homo sapiens
uugcacugagauuuugcuuaca

SEQ ID NO: 188491 - RNA, 18 nt, Homo sapiens
uuggacggagagucaaau

SEQ ID NO: 188492 - RNA, 22 nt, Homo sapiens
uuggcagaaaaggucggggguu

SEQ ID NO: 188493 - RNA, 22 nt, Homo sapiens
uuggcagaauguuagaaacuua

SEQ ID NO: 188494 - RNA, 20 nt, Homo sapiens
uuggcagagucuuuagggua

SEQ ID NO: 188495 - RNA, 22 nt, Homo sapiens
uuggcagaguuaauuuguugag

SEQ ID NO: 188496 - RNA, 22 nt, Homo sapiens
uugugaaaaaccucucguggaa

SEQ ID NO: 188497 - RNA, 22 nt, Homo sapiens
uugugaaaucuaggcagagguu

SEQ ID NO: 188498 - RNA, 22 nt, Homo sapiens
uuuacagucuuuugugugaguc

SEQ ID NO: 188499 - RNA, 22 nt, Homo sapiens
uuucagagucaucugcccaagu

SEQ ID NO: 188500 - RNA, 22 nt, Homo sapiens
uuugagaaugcuaccagagaag

SEQ ID NO: 188501 - RNA, 22 nt, Homo sapiens
uuuggcuuaagauugacugcaa

SEQ ID NO: 188502 - RNA, 22 nt, Homo sapiens
uuuuacacuguugguuggaaug

SEQ ID NO: 188503 - RNA, 22 nt, Homo sapiens
uuuuacacuucgguugugugca

SEQ ID NO: 188504 - RNA, 19 nt, Homo sapiens
uuuugcucuuuauaccuau

SEQ ID NO: 188505 - RNA, 22 nt, Homo sapiens
aaaaugcugauauugggcccca

SEQ ID NO: 188506 - RNA, 22 nt, Homo sapiens
aaaugacuuuuuaugcagagua

SEQ ID NO: 188507 - RNA, 22 nt, Homo sapiens
aaaugguguuaguagaucuuua

SEQ ID NO: 188508 - RNA, 22 nt, Homo sapiens
aacagagcuggugacuccaggu

SEQ ID NO: 188509 - RNA, 22 nt, Homo sapiens
aagaggcuguaggauaaugccu

SEQ ID NO: 188510 - RNA, 22 nt, Homo sapiens
aagcuuucaacuguuugccauu

SEQ ID NO: 188511 - RNA, 22 nt, Homo sapiens
aagugaguaauacgucaguugu

SEQ ID NO: 188512 - RNA, 22 nt, Homo sapiens
aagugguguuuguauuuaugca

SEQ ID NO: 188513 - RNA, 22 nt, Homo sapiens
acaauguauauuuuacuguagg

SEQ ID NO: 188514 - RNA, 22 nt, Homo sapiens
acaggagugggauuugaguccu

SEQ ID NO: 188515 - RNA, 22 nt, Homo sapiens
acauaguagacacugaaaauau

SEQ ID NO: 188516 - RNA, 20 nt, Homo sapiens
acugauauguuccuguucuc

SEQ ID NO: 188517 - RNA, 22 nt, Homo sapiens
agagaacugauuggaguugggc

SEQ ID NO: 188518 - RNA, 22 nt, Homo sapiens
agagagguggguggagccccca

SEQ ID NO: 188519 - RNA, 22 nt, Homo sapiens
agagguauacauuugagagcca

SEQ ID NO: 188520 - RNA, 22 nt, Homo sapiens
agaugguguuuucucaccagau

SEQ ID NO: 188521 - RNA, 22 nt, Homo sapiens
agauucauccaaguuguugcau

SEQ ID NO: 188522 - RNA, 22 nt, Homo sapiens
agcagguguggcuuauccugaa

SEQ ID NO: 188523 - RNA, 22 nt, Homo sapiens
aggaaguaauaaguuugguucu

SEQ ID NO: 188524 - RNA, 23 nt, Homo sapiens
aggaauggaaaaccaaguaucau

SEQ ID NO: 188525 - RNA, 22 nt, Homo sapiens
aggagguagaacauugccauuu

SEQ ID NO: 188526 - RNA, 22 nt, Homo sapiens
aggagguagucugucccuuagc

SEQ ID NO: 188527 - RNA, 22 nt, Homo sapiens
aggcuagacuuugagaauuuuu

SEQ ID NO: 188528 - RNA, 22 nt, Homo sapiens
agggcuuuugagcugagauggu

SEQ ID NO: 188529 - RNA, 22 nt, Homo sapiens
aguaagauggcaacucuccaca

SEQ ID NO: 188530 - RNA, 20 nt, Homo sapiens
aguauucacuuuuuucaugg

SEQ ID NO: 188531 - RNA, 23 nt, Homo sapiens
aguggucuccugggcccagcugu

SEQ ID NO: 188532 - RNA, 22 nt, Homo sapiens
aguuggccccuacugggaggug

SEQ ID NO: 188533 - RNA, 22 nt, Homo sapiens
auagcaauuugggaaucagacu

SEQ ID NO: 188534 - RNA, 22 nt, Homo sapiens
auauguauuuuaacguguaagg

SEQ ID NO: 188535 - RNA, 22 nt, Homo sapiens
auaugugacuucaugcaaggcu

SEQ ID NO: 188536 - RNA, 22 nt, Homo sapiens
aucacugggcaagauaucauga

SEQ ID NO: 188537 - RNA, 22 nt, Homo sapiens
augaaaagcauaaacgcugaag

SEQ ID NO: 188538 - RNA, 22 nt, Homo sapiens
augaggugaguaaauaaaugaa

SEQ ID NO: 188539 - RNA, 22 nt, Homo sapiens
augauggaggccgugauggacg

SEQ ID NO: 188540 - RNA, 22 nt, Homo sapiens
augcacauggcuaacuuuuuuc

SEQ ID NO: 188541 - RNA, 22 nt, Homo sapiens
augcauauuuuaccuagaagag

SEQ ID NO: 188542 - RNA, 22 nt, Homo sapiens
auggaaaugaagggcuggcccu

SEQ ID NO: 188543 - RNA, 22 nt, Homo sapiens
auggauuuuggggccagaggca

SEQ ID NO: 188544 - RNA, 22 nt, Homo sapiens
cuuuuacacuguuggcaggauu

SEQ ID NO: 188545 - RNA, 22 nt, Homo sapiens
gagacugagucuugcucuguca

SEQ ID NO: 188546 - RNA, 22 nt, Homo sapiens
gagauacacccagugcagaggc

SEQ ID NO: 188547 - RNA, 22 nt, Homo sapiens
gaggaguauuuugucgaauguc

SEQ ID NO: 188548 - RNA, 22 nt, Homo sapiens
gagguaggaggauugcuuaagg

SEQ ID NO: 188549 - RNA, 22 nt, Homo sapiens
gagguagggucccacuauguug

SEQ ID NO: 188550 - RNA, 22 nt, Homo sapiens
gagguaugugggcagacauuua

SEQ ID NO: 188551 - RNA, 22 nt, Homo sapiens
gagguggugguggaggcauagc

SEQ ID NO: 188552 - RNA, 23 nt, Homo sapiens
gagugcaaugacaugaucucgga

SEQ ID NO: 188553 - RNA, 22 nt, Homo sapiens
gauaucuuuuguauggugagcu

SEQ ID NO: 188554 - RNA, 22 nt, Homo sapiens
gaugccuuuuuguccucaguua

SEQ ID NO: 188555 - RNA, 22 nt, Homo sapiens
gaugugaaaucauaguuucuag

SEQ ID NO: 188556 - RNA, 22 nt, Homo sapiens
gauuuuuggggaagccucuuau

SEQ ID NO: 188557 - RNA, 22 nt, Homo sapiens
gcacugggccacauuuauuuuc

SEQ ID NO: 188558 - RNA, 22 nt, Homo sapiens
gcagugugauguuuuaaucuau

SEQ ID NO: 188559 - RNA, 22 nt, Homo sapiens
gcagugugugaggaauuugggu

SEQ ID NO: 188560 - RNA, 20 nt, Homo sapiens
gcaugagucuuuauaguaga

SEQ ID NO: 188561 - RNA, 22 nt, Homo sapiens
gcuagcacauugucaccucuca

SEQ ID NO: 188562 - RNA, 22 nt, Homo sapiens
gcuuggugugcaagugguacua

SEQ ID NO: 188563 - RNA, 22 nt, Homo sapiens
ggacauguauauauaugugugu

SEQ ID NO: 188564 - RNA, 22 nt, Homo sapiens
ggcaaggauuagauucuccccu

SEQ ID NO: 188565 - RNA, 22 nt, Homo sapiens
ggcaaugucagcuaaugaugga

SEQ ID NO: 188566 - RNA, 22 nt, Homo sapiens
ggcuagauauucacauauggcu

SEQ ID NO: 188567 - RNA, 22 nt, Homo sapiens
gggaaaaugucuauugaaugaa

SEQ ID NO: 188568 - RNA, 22 nt, Homo sapiens
gggguuuuaccuucguauucuu

SEQ ID NO: 188569 - RNA, 22 nt, Homo sapiens
guaauacuuuugggauauuaga

SEQ ID NO: 188570 - RNA, 22 nt, Homo sapiens
guacaguaguaaaagugaauga

SEQ ID NO: 188571 - RNA, 22 nt, Homo sapiens
guacaguauaguaauaggauuu

SEQ ID NO: 188572 - RNA, 22 nt, Homo sapiens
guacauagucacacauauacau

SEQ ID NO: 188573 - RNA, 22 nt, Homo sapiens
gucagcuuguccagagacucug

SEQ ID NO: 188574 - RNA, 22 nt, Homo sapiens
guccuggagaagcguggaccgg

SEQ ID NO: 188575 - RNA, 22 nt, Homo sapiens
gucucccaaccccugugcccag

SEQ ID NO: 188576 - RNA, 20 nt, Homo sapiens
gucugucuccgaguagaauu

SEQ ID NO: 188577 - RNA, 22 nt, Homo sapiens
gugaaauacauaaucccaagug

SEQ ID NO: 188578 - RNA, 22 nt, Homo sapiens
guggaaaacauaugcuuguuga

SEQ ID NO: 188579 - RNA, 22 nt, Homo sapiens
guggaaaauuauugcuguuuuu

SEQ ID NO: 188580 - RNA, 22 nt, Homo sapiens
guggaaguuaagugacuuucug

SEQ ID NO: 188581 - RNA, 22 nt, Homo sapiens
guggcagaaaagagaagcaaug

SEQ ID NO: 188582 - RNA, 22 nt, Homo sapiens
gugggaagcuggaacucccucc

SEQ ID NO: 188583 - RNA, 22 nt, Homo sapiens
guguccucgaguacacaucagg

SEQ ID NO: 188584 - RNA, 22 nt, Homo sapiens
gugugcaugucuuuuuaguagg

SEQ ID NO: 188585 - RNA, 22 nt, Homo sapiens
guugcucaggcuggagugcagu

SEQ ID NO: 188586 - RNA, 22 nt, Homo sapiens
uaaacugucuugcaguuacaug

SEQ ID NO: 188587 - RNA, 22 nt, Homo sapiens
uaagcuauagugaauaaauugc

SEQ ID NO: 188588 - RNA, 22 nt, Homo sapiens
uaauagcaguguuacuaggacu

SEQ ID NO: 188589 - RNA, 22 nt, Homo sapiens
uaauauguauacagacagauac

SEQ ID NO: 188590 - RNA, 22 nt, Homo sapiens
uaauauguuuugaaaucaggaa

SEQ ID NO: 188591 - RNA, 19 nt, Homo sapiens
uacaugcagcaggcacgca

SEQ ID NO: 188592 - RNA, 22 nt, Homo sapiens
uagaacaauugcuggauccgaa

SEQ ID NO: 188593 - RNA, 21 nt, Homo sapiens
uagcaaauugcuauuaaggca

SEQ ID NO: 188594 - RNA, 22 nt, Homo sapiens
uagcagcaccccacucuacugg

SEQ ID NO: 188595 - RNA, 22 nt, Homo sapiens
uaggcacugagaauaugaggau

SEQ ID NO: 188596 - RNA, 19 nt, Homo sapiens
uaggugguuuuccccucac

SEQ ID NO: 188597 - RNA, 22 nt, Homo sapiens
uagugaauguuggcuauuaaua

SEQ ID NO: 188598 - RNA, 22 nt, Homo sapiens
uaguggauguucagagauuuga

SEQ ID NO: 188599 - RNA, 22 nt, Homo sapiens
uauacaugugggcaucaggaga

SEQ ID NO: 188600 - RNA, 22 nt, Homo sapiens
uauagcaaugugccacucucug

SEQ ID NO: 188601 - RNA, 22 nt, Homo sapiens
uaucucaguguacaggaugaua

SEQ ID NO: 188602 - RNA, 22 nt, Homo sapiens
uauggguuuuucauaaauaggu

SEQ ID NO: 188603 - RNA, 22 nt, Homo sapiens
uauuacacuuuagugucuucca

SEQ ID NO: 188604 - RNA, 18 nt, Homo sapiens
uauugcuugguuuggaga

SEQ ID NO: 188605 - RNA, 20 nt, Homo sapiens
ucaaauucuuggccuccagc

SEQ ID NO: 188606 - RNA, 22 nt, Homo sapiens
ucaagaccucacauagaggaga

SEQ ID NO: 188607 - RNA, 22 nt, Homo sapiens
ucacacuguuuugauuauuaua

SEQ ID NO: 188608 - RNA, 22 nt, Homo sapiens
ucacagaggagaagaccuuuaa

SEQ ID NO: 188609 - RNA, 22 nt, Homo sapiens
ucacugcacucuccgccuugcg

SEQ ID NO: 188610 - RNA, 21 nt, Homo sapiens
ucagaagcucccagggaggac

SEQ ID NO: 188611 - RNA, 22 nt, Homo sapiens
ucagcaaugaccuaagcaaaua

SEQ ID NO: 188612 - RNA, 21 nt, Homo sapiens
ucagcucaucacugccuggag

SEQ ID NO: 188613 - RNA, 22 nt, Homo sapiens
ucaggugcagagaagaaauggg

SEQ ID NO: 188614 - RNA, 22 nt, Homo sapiens
cuuuuacacuguuagugggaau

SEQ ID NO: 188615 - RNA, 22 nt, Homo sapiens
gaagauaucuaguaccauuguc

SEQ ID NO: 188616 - RNA, 22 nt, Homo sapiens
gaagauucaaccaaaccagaac

SEQ ID NO: 188617 - RNA, 22 nt, Homo sapiens
gacagacacaauugauccauga

SEQ ID NO: 188618 - RNA, 22 nt, Homo sapiens
gagacggagucucgcucugucg

SEQ ID NO: 188619 - RNA, 22 nt, Homo sapiens
gagacggagucuugcucuguug

SEQ ID NO: 188620 - RNA, 22 nt, Homo sapiens
gagauucuucaauauuuauucu

SEQ ID NO: 188621 - RNA, 22 nt, Homo sapiens
gaggaguagggcacaaagccuu

SEQ ID NO: 188622 - RNA, 22 nt, Homo sapiens
gaggaucucuugagcccagaag

SEQ ID NO: 188623 - RNA, 22 nt, Homo sapiens
gaggcacucuguacaaaucugc

SEQ ID NO: 188624 - RNA, 22 nt, Homo sapiens
gaggugauaucucauugugguu

SEQ ID NO: 188625 - RNA, 22 nt, Homo sapiens
gaguaaauguccuagcuucuug

SEQ ID NO: 188626 - RNA, 22 nt, Homo sapiens
gaguaacagcauaaauuuguga

SEQ ID NO: 188627 - RNA, 21 nt, Homo sapiens
gauaucuuuauucccaagagc

SEQ ID NO: 188628 - RNA, 22 nt, Homo sapiens
gaucaauuggcugaagacacgu

SEQ ID NO: 188629 - RNA, 22 nt, Homo sapiens
gauggcagugcagccccuggcu

SEQ ID NO: 188630 - RNA, 22 nt, Homo sapiens
gcgguagcauagacugcaggac

SEQ ID NO: 188631 - RNA, 22 nt, Homo sapiens
gcugagguucaagaagguuaaa

SEQ ID NO: 188632 - RNA, 22 nt, Homo sapiens
ggaauauaaaaagccccagaau

SEQ ID NO: 188633 - RNA, 22 nt, Homo sapiens
ggaauuaaggcaauugaaagcu

SEQ ID NO: 188634 - RNA, 22 nt, Homo sapiens
ggaguaggaaggaaauguuaaa

SEQ ID NO: 188635 - RNA, 22 nt, Homo sapiens
ggcaguguauuacuuaggguuc

SEQ ID NO: 188636 - RNA, 22 nt, Homo sapiens
ggcuagaugcuagagauaucau

SEQ ID NO: 188637 - RNA, 22 nt, Homo sapiens
gggaugaagaagaauaguucgu

SEQ ID NO: 188638 - RNA, 22 nt, Homo sapiens
gugaagaucccuguccuguucc

SEQ ID NO: 188639 - RNA, 22 nt, Homo sapiens
gugagguagagcaugugaaaga

SEQ ID NO: 188640 - RNA, 22 nt, Homo sapiens
gugcacaaaucuuaaauguaca

SEQ ID NO: 188641 - RNA, 22 nt, Homo sapiens
guggaaaaguaguugcgguuuu

SEQ ID NO: 188642 - RNA, 21 nt, Homo sapiens
guggaaauggaauuuacuaau

SEQ ID NO: 188643 - RNA, 22 nt, Homo sapiens
guggcaugaaagcagauaccac

SEQ ID NO: 188644 - RNA, 22 nt, Homo sapiens
guggcgagaucauagcucauug

SEQ ID NO: 188645 - RNA, 22 nt, Homo sapiens
gugggguaggaggaguacuucc

SEQ ID NO: 188646 - RNA, 20 nt, Homo sapiens
gugugcauuucagauuuugg

SEQ ID NO: 188647 - RNA, 22 nt, Homo sapiens
guugguauuacagaaauuaguu

SEQ ID NO: 188648 - RNA, 22 nt, Homo sapiens
uaacauuguugauuauacuaag

SEQ ID NO: 188649 - RNA, 22 nt, Homo sapiens
uaaggauuuuggugauuacacu

SEQ ID NO: 188650 - RNA, 22 nt, Homo sapiens
uaaguacuuuacagacauuauc

SEQ ID NO: 188651 - RNA, 22 nt, Homo sapiens
uaauacuagugaauagcaggau

SEQ ID NO: 188652 - RNA, 22 nt, Homo sapiens
uaauaguuggcacuggagaaag

SEQ ID NO: 188653 - RNA, 22 nt, Homo sapiens
uacaguacacagguaccaagcu

SEQ ID NO: 188654 - RNA, 23 nt, Homo sapiens
uacuaguaagcguguucuuugca

SEQ ID NO: 188655 - RNA, 18 nt, Homo sapiens
uacuaguaaggcuucuga

SEQ ID NO: 188656 - RNA, 22 nt, Homo sapiens
uacucaguagacacucauaugu

SEQ ID NO: 188657 - RNA, 22 nt, Homo sapiens
uacuccccuuguucugugagcu

SEQ ID NO: 188658 - RNA, 22 nt, Homo sapiens
uacuguacugcaguucugcaaa

SEQ ID NO: 188659 - RNA, 22 nt, Homo sapiens
uagaaucuaacucgcaugaaaa

SEQ ID NO: 188660 - RNA, 22 nt, Homo sapiens
uagacugguuuagcacugaaua

SEQ ID NO: 188661 - RNA, 22 nt, Homo sapiens
uagaucaauuaauuguuacuug

SEQ ID NO: 188662 - RNA, 22 nt, Homo sapiens
uagauucaucuguuccuuuuga

SEQ ID NO: 188663 - RNA, 22 nt, Homo sapiens
uagcagcaucucuggcuucuac

SEQ ID NO: 188664 - RNA, 22 nt, Homo sapiens
uagccucacaaagugcuuaaga

SEQ ID NO: 188665 - RNA, 22 nt, Homo sapiens
uaggugauccauuuguauuuua

SEQ ID NO: 188666 - RNA, 18 nt, Homo sapiens
uaguacuguucucaugau

SEQ ID NO: 188667 - RNA, 18 nt, Homo sapiens
uagugcuguucucaugau

SEQ ID NO: 188668 - RNA, 22 nt, Homo sapiens
uaucacugucaggcccucauau

SEQ ID NO: 188669 - RNA, 22 nt, Homo sapiens
uaugaucacuacagcagggaug

SEQ ID NO: 188670 - RNA, 22 nt, Homo sapiens
uaugucuuuugcuugcaaauag

SEQ ID NO: 188671 - RNA, 22 nt, Homo sapiens
uauucacaggugugggacaaag

SEQ ID NO: 188672 - RNA, 22 nt, Homo sapiens
uauuccauuugugaaaggaagu

SEQ ID NO: 188673 - RNA, 22 nt, Homo sapiens
uauugaauuugagcugucucuu

SEQ ID NO: 188674 - RNA, 22 nt, Homo sapiens
uauugcuugaggaaaugguaau

SEQ ID NO: 188675 - RNA, 22 nt, Homo sapiens
uauuguuuuucccaggagucua

SEQ ID NO: 188676 - RNA, 22 nt, Homo sapiens
ucacuggagguuccugaaguuc

SEQ ID NO: 188677 - RNA, 22 nt, Homo sapiens
ucacugggagcauuugagccuu

SEQ ID NO: 188678 - RNA, 22 nt, Homo sapiens
ucagauacuggugacaugaaug

SEQ ID NO: 188679 - RNA, 22 nt, Homo sapiens
ucagcacauucaaggccugccu

SEQ ID NO: 188680 - RNA, 22 nt, Homo sapiens
ucagggacuuacaaaccagaag

SEQ ID NO: 188681 - RNA, 22 nt, Homo sapiens
ucaggguacuuguggccaaagu

SEQ ID NO: 188682 - RNA, 22 nt, Homo sapiens
ucaggugcaguggcucugaccu

SEQ ID NO: 188683 - RNA, 22 nt, Homo sapiens
ucaggugccuuggcuaauuguu

SEQ ID NO: 188684 - RNA, 22 nt, Homo sapiens
ucauucauucauccagcuugag

SEQ ID NO: 188685 - RNA, 22 nt, Homo sapiens
uccccgucacacgcaggcuuac

SEQ ID NO: 188686 - RNA, 22 nt, Homo sapiens
uccugagaauagaguugcaugu

SEQ ID NO: 188687 - RNA, 22 nt, Homo sapiens
uccugagacugaggagcuuugg

SEQ ID NO: 188688 - RNA, 22 nt, Homo sapiens
ucuaugguuuauuuccaagugu

SEQ ID NO: 188689 - RNA, 22 nt, Homo sapiens
ucuuggccaugaauggcaaggc

SEQ ID NO: 188690 - RNA, 22 nt, Homo sapiens
ucuuugggauauucugaaaggg

SEQ ID NO: 188691 - RNA, 22 nt, Homo sapiens
ugaaugguuuuuagagaacaau

SEQ ID NO: 188692 - RNA, 22 nt, Homo sapiens
ugaauguauuuauuaccauuca

SEQ ID NO: 188693 - RNA, 22 nt, Homo sapiens
ugacacagugggggauccuuuu

SEQ ID NO: 188694 - RNA, 22 nt, Homo sapiens
ugagaacauuccucuuccuggc

SEQ ID NO: 188695 - RNA, 22 nt, Homo sapiens
ugagaacuaaugaagaauuuau

SEQ ID NO: 188696 - RNA, 22 nt, Homo sapiens
ugagaacuuugucuuuuacucu

SEQ ID NO: 188697 - RNA, 22 nt, Homo sapiens
ugagaauauuugaagauguuag

SEQ ID NO: 188698 - RNA, 22 nt, Homo sapiens
ugagacggagucucgcucuguu

SEQ ID NO: 188699 - RNA, 22 nt, Homo sapiens
ugagagaugauaaaauguuugu

SEQ ID NO: 188700 - RNA, 22 nt, Homo sapiens
ugagauggaguuucgcccuugu

SEQ ID NO: 188701 - RNA, 22 nt, Homo sapiens
ugagauggaguuucgcuuuugu

SEQ ID NO: 188702 - RNA, 22 nt, Homo sapiens
ugagauggguucugguccccug

SEQ ID NO: 188703 - RNA, 22 nt, Homo sapiens
ugagaugguaaauuuuuguugu

SEQ ID NO: 188704 - RNA, 22 nt, Homo sapiens
ugagcacagagccugggguggc

SEQ ID NO: 188705 - RNA, 22 nt, Homo sapiens
ugaggugagauggcuaccccaa

SEQ ID NO: 188706 - RNA, 22 nt, Homo sapiens
ugaguagaacuccuggagaugu

SEQ ID NO: 188707 - RNA, 22 nt, Homo sapiens
ugagucagucucacucugcugc

SEQ ID NO: 188708 - RNA, 22 nt, Homo sapiens
uuacauugcuucaaauucagug

SEQ ID NO: 188709 - RNA, 22 nt, Homo sapiens
uuaguuuaucagugguuucuga

SEQ ID NO: 188710 - RNA, 22 nt, Homo sapiens
uuauguaaaucaaucuggaauc

SEQ ID NO: 188711 - RNA, 22 nt, Homo sapiens
uucaaaguguugguuuugggcu

SEQ ID NO: 188712 - RNA, 22 nt, Homo sapiens
uucaggcuccgugccagcuccg

SEQ ID NO: 188713 - RNA, 22 nt, Homo sapiens
uucaggcuuuuauuuacugaua

SEQ ID NO: 188714 - RNA, 18 nt, Homo sapiens
uucaguuuguaucugggg

SEQ ID NO: 188715 - RNA, 22 nt, Homo sapiens
uuccaguggacuacuucauccu

SEQ ID NO: 188716 - RNA, 22 nt, Homo sapiens
uuccugagagggcugggugcag

SEQ ID NO: 188717 - RNA, 22 nt, Homo sapiens
uuccugagaucagaauucaaau

SEQ ID NO: 188718 - RNA, 22 nt, Homo sapiens
uuccugaggccuccccagaagc

SEQ ID NO: 188719 - RNA, 22 nt, Homo sapiens
uucucagcccccugacagucag

SEQ ID NO: 188720 - RNA, 22 nt, Homo sapiens
uucuuugguacaagggccgacc

SEQ ID NO: 188721 - RNA, 22 nt, Homo sapiens
uugaauagaagguuuuuuguuc

SEQ ID NO: 188722 - RNA, 22 nt, Homo sapiens
uugaauagugacuuugauucug

SEQ ID NO: 188723 - RNA, 22 nt, Homo sapiens
uugaaugaaaugaugucauuug

SEQ ID NO: 188724 - RNA, 22 nt, Homo sapiens
uugagaaucuuucgaauguucu

SEQ ID NO: 188725 - RNA, 22 nt, Homo sapiens
uugagaugaagucuugcucucu

SEQ ID NO: 188726 - RNA, 22 nt, Homo sapiens
uugagaugaaguuuugcucuuu

SEQ ID NO: 188727 - RNA, 22 nt, Homo sapiens
uugagauggagucucacugugu

SEQ ID NO: 188728 - RNA, 22 nt, Homo sapiens
uugagauggaguuucaauauug

SEQ ID NO: 188729 - RNA, 22 nt, Homo sapiens
uuggaagacaaugcugauucuc

SEQ ID NO: 188730 - RNA, 22 nt, Homo sapiens
uuggcuacagauuaugaauuuc

SEQ ID NO: 188731 - RNA, 22 nt, Homo sapiens
uuguccacugcuagccucugca

SEQ ID NO: 188732 - RNA, 22 nt, Homo sapiens
uugugaauggugcugcaguaaa

SEQ ID NO: 188733 - RNA, 22 nt, Homo sapiens
uuuacccugaggaaucuauuuu

SEQ ID NO: 188734 - RNA, 22 nt, Homo sapiens
uuuagcacugugauugacaaaa

SEQ ID NO: 188735 - RNA, 19 nt, Homo sapiens
uuucacacucgccuacuuc

SEQ ID NO: 188736 - RNA, 18 nt, Homo sapiens
uuucaggguggacaugag

SEQ ID NO: 188737 - RNA, 22 nt, Homo sapiens
uuugaagugugaugccuugaug

SEQ ID NO: 188738 - RNA, 22 nt, Homo sapiens
uuugcacuggagauucaauggg

SEQ ID NO: 188739 - RNA, 21 nt, Homo sapiens
uuuguaguagcaugauuuaua

SEQ ID NO: 188740 - RNA, 22 nt, Homo sapiens
uuuuugaguaaauauaaauugu

SEQ ID NO: 188741 - RNA, 21 nt, Homo sapiens
uuuuugggcuuucauaguguu

SEQ ID NO: 188742 - RNA, 22 nt, Homo sapiens
gugagcuaagcaaauaugagcc

SEQ ID NO: 188743 - RNA, 22 nt, Homo sapiens
gugaguaaagguucauugaauu

SEQ ID NO: 188744 - RNA, 23 nt, Homo sapiens
gugcaguggcgagauuucggcuc

SEQ ID NO: 188745 - RNA, 22 nt, Homo sapiens
guggaagucuuugguauuggua

SEQ ID NO: 188746 - RNA, 22 nt, Homo sapiens
guggaauauaaagcaucgugua

SEQ ID NO: 188747 - RNA, 22 nt, Homo sapiens
gugucaguggggagugaucuuc

SEQ ID NO: 188748 - RNA, 22 nt, Homo sapiens
guguucauggaauuugcaauug

SEQ ID NO: 188749 - RNA, 22 nt, Homo sapiens
guuauguguuuccuuaauugcu

SEQ ID NO: 188750 - RNA, 22 nt, Homo sapiens
guugcucaggccggagugcagu

SEQ ID NO: 188751 - RNA, 22 nt, Homo sapiens
uaaagcuuggauuuaggcuaau

SEQ ID NO: 188752 - RNA, 22 nt, Homo sapiens
uaacaguggucugugguaucug

SEQ ID NO: 188753 - RNA, 22 nt, Homo sapiens
uaaguaauuguuaauagggaag

SEQ ID NO: 188754 - RNA, 22 nt, Homo sapiens
uaaguacugucagaauuggacu

SEQ ID NO: 188755 - RNA, 22 nt, Homo sapiens
uaaguaguguugagacaaguuu

SEQ ID NO: 188756 - RNA, 22 nt, Homo sapiens
uacuaguaagggugguuuggcu

SEQ ID NO: 188757 - RNA, 22 nt, Homo sapiens
uacuauugcaucggugauuagg

SEQ ID NO: 188758 - RNA, 18 nt, Homo sapiens
uagaauauaggucauucu

SEQ ID NO: 188759 - RNA, 22 nt, Homo sapiens
uagcacuauguuaucacauacu

SEQ ID NO: 188760 - RNA, 22 nt, Homo sapiens
uaggauaguccuccugagaccu

SEQ ID NO: 188761 - RNA, 22 nt, Homo sapiens
uaggcacuguguuuguaggagu

SEQ ID NO: 188762 - RNA, 22 nt, Homo sapiens
uaguaguuuuguguauaauaau

SEQ ID NO: 188763 - RNA, 22 nt, Homo sapiens
uaucacuguuguuuguuuaagg

SEQ ID NO: 188764 - RNA, 22 nt, Homo sapiens
uaucauugccucaaucuguauu

SEQ ID NO: 188765 - RNA, 17 nt, Homo sapiens
uauguaguacuuauaaa

SEQ ID NO: 188766 - RNA, 20 nt, Homo sapiens
uauucacucuccagucuugc

SEQ ID NO: 188767 - RNA, 22 nt, Homo sapiens
uauuccauuugggucaggauga

SEQ ID NO: 188768 - RNA, 22 nt, Homo sapiens
uauugcacaugaggagacauug

SEQ ID NO: 188769 - RNA, 20 nt, Homo sapiens
uauugcacuccagucugggc

SEQ ID NO: 188770 - RNA, 20 nt, Homo sapiens
ucaaggcaggaacuguacau

SEQ ID NO: 188771 - RNA, 19 nt, Homo sapiens
ucacacuguggcuucuuua

SEQ ID NO: 188772 - RNA, 22 nt, Homo sapiens
ucacugcacuccagccuuuaug

SEQ ID NO: 188773 - RNA, 22 nt, Homo sapiens
ucacugggagaccaaagccauc

SEQ ID NO: 188774 - RNA, 20 nt, Homo sapiens
ucacuggguucuugaagucu

SEQ ID NO: 188775 - RNA, 22 nt, Homo sapiens
ucagcaaugcugcacucuacug

SEQ ID NO: 188776 - RNA, 22 nt, Homo sapiens
ucaggugcaguggcucaugcuu

SEQ ID NO: 188777 - RNA, 23 nt, Homo sapiens
ucaguacuccacuuucaauagug

SEQ ID NO: 188778 - RNA, 23 nt, Homo sapiens
ucauguauucccuguaaugggua

SEQ ID NO: 188779 - RNA, 22 nt, Homo sapiens
aaagugcugagucuaggcgggg

SEQ ID NO: 188780 - RNA, 22 nt, Homo sapiens
aaauaguagcugaaugagggaa

SEQ ID NO: 188781 - RNA, 22 nt, Homo sapiens
aacacuggcugcucgaguucuc

SEQ ID NO: 188782 - RNA, 22 nt, Homo sapiens
aacagugccugucauuuaguag

SEQ ID NO: 188783 - RNA, 22 nt, Homo sapiens
aagagagcuaugugcauaauua

SEQ ID NO: 188784 - RNA, 22 nt, Homo sapiens
aagcuguugguggaucuaccau

SEQ ID NO: 188785 - RNA, 22 nt, Homo sapiens
aaggaguagacaacauggcgcc

SEQ ID NO: 188786 - RNA, 22 nt, Homo sapiens
aaggaguagaggaauagcaaug

SEQ ID NO: 188787 - RNA, 22 nt, Homo sapiens
aaggaguaucuguuuucucacc

SEQ ID NO: 188788 - RNA, 22 nt, Homo sapiens
aaggaguauugaaugaccaagu

SEQ ID NO: 188789 - RNA, 22 nt, Homo sapiens
aauaaagccugucucuuuagag

SEQ ID NO: 188790 - RNA, 19 nt, Homo sapiens
aauauugacaguggugucu

SEQ ID NO: 188791 - RNA, 22 nt, Homo sapiens
aauggcagaugaaauugucauu

SEQ ID NO: 188792 - RNA, 23 nt, Homo sapiens
aauugcuuuugaggacuuaguug

SEQ ID NO: 188793 - RNA, 22 nt, Homo sapiens
guaagacuuauuuucuuuauca

SEQ ID NO: 188794 - RNA, 22 nt, Homo sapiens
guaagauaguauguuuaaccca

SEQ ID NO: 188795 - RNA, 22 nt, Homo sapiens
guaagugguagagcugggcuau

SEQ ID NO: 188796 - RNA, 23 nt, Homo sapiens
guaauacuagucauaguagcagg

SEQ ID NO: 188797 - RNA, 22 nt, Homo sapiens
cugucacuggggcacauguccc

SEQ ID NO: 188798 - RNA, 22 nt, Homo sapiens
cugugguuacguucuuugugcu

SEQ ID NO: 188799 - RNA, 22 nt, Homo sapiens
cugugguugagcuuugccauga

SEQ ID NO: 188800 - RNA, 22 nt, Homo sapiens
cuguuugaggguuugcuuucag

SEQ ID NO: 188801 - RNA, 22 nt, Homo sapiens
cuguuuguuuaggguacucaga

SEQ ID NO: 188802 - RNA, 18 nt, Homo sapiens
cuuaacauugggaugaua

SEQ ID NO: 188803 - RNA, 19 nt, Homo sapiens
cuuaggugaccaguuccca

SEQ ID NO: 188804 - RNA, 22 nt, Homo sapiens
cuucaaaguuggcuaggagaca

SEQ ID NO: 188805 - RNA, 22 nt, Homo sapiens
cuucaaguguggccaccugacc

SEQ ID NO: 188806 - RNA, 20 nt, Homo sapiens
cuucacagaaguggaaucau

SEQ ID NO: 188807 - RNA, 22 nt, Homo sapiens
cuuccaaguggggcacgugcca

SEQ ID NO: 188808 - RNA, 22 nt, Homo sapiens
cuucccguuauugcccuugggu

SEQ ID NO: 188809 - RNA, 22 nt, Homo sapiens
cuugcagagcccauggauguca

SEQ ID NO: 188810 - RNA, 22 nt, Homo sapiens
cuugugccugaucuuagggggc

SEQ ID NO: 188811 - RNA, 22 nt, Homo sapiens
cuuuaguugucuccucaagggu

SEQ ID NO: 188812 - RNA, 22 nt, Homo sapiens
cuuucugaggagaauagagaac

SEQ ID NO: 188813 - RNA, 22 nt, Homo sapiens
cuuuggcaaugucauuuucaau

SEQ ID NO: 188814 - RNA, 19 nt, Homo sapiens
cuuugguugagcguguugg

SEQ ID NO: 188815 - RNA, 22 nt, Homo sapiens
cuuuuacacuguuagugggaau

SEQ ID NO: 188816 - RNA, 22 nt, Homo sapiens
cuuuuacacuguuggcaggauu

SEQ ID NO: 188817 - RNA, 22 nt, Homo sapiens
cuuuuggucuaucagagaagca

SEQ ID NO: 188818 - RNA, 22 nt, Homo sapiens
cuuuuguggaucuucuguugcu

SEQ ID NO: 188819 - RNA, 22 nt, Homo sapiens
gaaaauccauccccagggagua

SEQ ID NO: 188820 - RNA, 21 nt, Homo sapiens
gaaauacugccuuaggagcug

SEQ ID NO: 188821 - RNA, 22 nt, Homo sapiens
gaaauggaucagagcaagcuuu

SEQ ID NO: 188822 - RNA, 22 nt, Homo sapiens
gaauagugcugcaagaaacaua

SEQ ID NO: 188823 - RNA, 22 nt, Homo sapiens
gaaucacugugguaucccaugc

SEQ ID NO: 188824 - RNA, 22 nt, Homo sapiens
gaaucauuguuucuaaguuugu

SEQ ID NO: 188825 - RNA, 22 nt, Homo sapiens
gaaugaauguuuauccuuagau

SEQ ID NO: 188826 - RNA, 22 nt, Homo sapiens
gacagugagaugucaugugaaa

SEQ ID NO: 188827 - RNA, 18 nt, Homo sapiens
gacaguguggcaauuccu

SEQ ID NO: 188828 - RNA, 20 nt, Homo sapiens
gacauggaggaggauuauua

SEQ ID NO: 188829 - RNA, 22 nt, Homo sapiens
gacuaggagauauguuuucuuc

SEQ ID NO: 188830 - RNA, 22 nt, Homo sapiens
gacugaggaagcgcucucuccu

SEQ ID NO: 188831 - RNA, 22 nt, Homo sapiens
gacuggccauugauacagaggu

SEQ ID NO: 188832 - RNA, 22 nt, Homo sapiens
gacuggccuauaauggcgaauu

SEQ ID NO: 188833 - RNA, 22 nt, Homo sapiens
gacuugaagaaucuaagggagg

SEQ ID NO: 188834 - RNA, 18 nt, Homo sapiens
gacuuggaguuuacagug

SEQ ID NO: 188835 - RNA, 22 nt, Homo sapiens
gagaacaguguuguauuuuuuc

SEQ ID NO: 188836 - RNA, 22 nt, Homo sapiens
gagaaugaugauuuccaauuuc

SEQ ID NO: 188837 - RNA, 22 nt, Homo sapiens
gagacugagucuugcucugucg

SEQ ID NO: 188838 - RNA, 22 nt, Homo sapiens
gagagugugucagaggcugcga

SEQ ID NO: 188839 - RNA, 22 nt, Homo sapiens
gagauaggauucacuuucaugu

SEQ ID NO: 188840 - RNA, 22 nt, Homo sapiens
gagaucacuguuuauauucucu

SEQ ID NO: 188841 - RNA, 22 nt, Homo sapiens
gagauguuuuguuaucaaagga

SEQ ID NO: 188842 - RNA, 22 nt, Homo sapiens
gagcuagguuuugaauccagac

SEQ ID NO: 188843 - RNA, 22 nt, Homo sapiens
gagcugguccuuuaaggaugca

SEQ ID NO: 188844 - RNA, 22 nt, Homo sapiens
gaggagucagacugugcaaggu

SEQ ID NO: 188845 - RNA, 22 nt, Homo sapiens
gaggugguagguucacagcagc

SEQ ID NO: 188846 - RNA, 22 nt, Homo sapiens
gaguagaacugguuaucuaaua

SEQ ID NO: 188847 - RNA, 23 nt, Homo sapiens
gagugcaaugacaugaucucgga

SEQ ID NO: 188848 - RNA, 22 nt, Homo sapiens
gagugcugagcccacuuccuug

SEQ ID NO: 188849 - RNA, 22 nt, Homo sapiens
gauaaagauagcaauagggaca

SEQ ID NO: 188850 - RNA, 22 nt, Homo sapiens
gauauguaaaaauuauaucuga

SEQ ID NO: 188851 - RNA, 22 nt, Homo sapiens
gauaugugauaagaguuaucuu

SEQ ID NO: 188852 - RNA, 22 nt, Homo sapiens
gaucauggaguuggguucaagg

SEQ ID NO: 188853 - RNA, 22 nt, Homo sapiens
gaucucaguggauacugugaug

SEQ ID NO: 188854 - RNA, 22 nt, Homo sapiens
gaugaggcuagagacaugugua

SEQ ID NO: 188855 - RNA, 22 nt, Homo sapiens
gaugccuuuuuguccucaguua

SEQ ID NO: 188856 - RNA, 22 nt, Homo sapiens
gauggcacuuaagagcaagagc

SEQ ID NO: 188857 - RNA, 22 nt, Homo sapiens
gauguguuuaucacccaguccu

SEQ ID NO: 188858 - RNA, 22 nt, Homo sapiens
gauuagaacagaagucagauua

SEQ ID NO: 188859 - RNA, 22 nt, Homo sapiens
gauuagcacuucaguuacagua

SEQ ID NO: 188860 - RNA, 22 nt, Homo sapiens
gcaaaaaguagugcugguuagg

SEQ ID NO: 188861 - RNA, 22 nt, Homo sapiens
gcacaggguuacauucuaaggu

SEQ ID NO: 188862 - RNA, 22 nt, Homo sapiens
gcacauuacaaguauuagcuca

SEQ ID NO: 188863 - RNA, 22 nt, Homo sapiens
gcacugggccacauuuauuuuc

SEQ ID NO: 188864 - RNA, 22 nt, Homo sapiens
gcaguacuuuauguccuaauua

SEQ ID NO: 188865 - RNA, 20 nt, Homo sapiens
gcaguacuuuuaguucuaag

SEQ ID NO: 188866 - RNA, 22 nt, Homo sapiens
gcagugcaguggcgcgaucucg

SEQ ID NO: 188867 - RNA, 22 nt, Homo sapiens
gcaguguucugggcaggaagaa

SEQ ID NO: 188868 - RNA, 22 nt, Homo sapiens
gcaucacagggagacaggccuc

SEQ ID NO: 188869 - RNA, 22 nt, Homo sapiens
gcauggagcauacauuucuguu

SEQ ID NO: 188870 - RNA, 22 nt, Homo sapiens
gccccugagacuugccucgggc

SEQ ID NO: 188871 - RNA, 22 nt, Homo sapiens
gcccugauacauucuucugccu

SEQ ID NO: 188872 - RNA, 22 nt, Homo sapiens
gccuagagacuugguaucuugc

SEQ ID NO: 188873 - RNA, 22 nt, Homo sapiens
gccucaguuguggccagggauu

SEQ ID NO: 188874 - RNA, 22 nt, Homo sapiens
gcggguguuuuacccuugcaga

SEQ ID NO: 188875 - RNA, 22 nt, Homo sapiens
gcgguuuuaagugaguuucuua

SEQ ID NO: 188876 - RNA, 22 nt, Homo sapiens
gcuaaggcagggcaaucauuug

SEQ ID NO: 188877 - RNA, 23 nt, Homo sapiens
gcuaggagagaugaaacacaggu

SEQ ID NO: 188878 - RNA, 22 nt, Homo sapiens
gcucaaguaauggcaguuuugc

SEQ ID NO: 188879 - RNA, 22 nt, Homo sapiens
gcucaugagacaagcaggagua

SEQ ID NO: 188880 - RNA, 17 nt, Homo sapiens
gcugcauucauguagaa

SEQ ID NO: 188881 - RNA, 22 nt, Homo sapiens
gcugcuguggcagauuggauuc

SEQ ID NO: 188882 - RNA, 22 nt, Homo sapiens
gcugcuuuugaugacaaaaaca

SEQ ID NO: 188883 - RNA, 22 nt, Homo sapiens
gcuggcuuucuccugaucucag

SEQ ID NO: 188884 - RNA, 22 nt, Homo sapiens
gcugguauuacaggcaugagcc

SEQ ID NO: 188885 - RNA, 22 nt, Homo sapiens
gcuggugacuuuaaguugaagc

SEQ ID NO: 188886 - RNA, 22 nt, Homo sapiens
uaaacugucuugcaguuacaug

SEQ ID NO: 188887 - RNA, 22 nt, Homo sapiens
uaaagccauugucaaguuugua

SEQ ID NO: 188888 - RNA, 22 nt, Homo sapiens
uaaagcuacagagcggaaaauu

SEQ ID NO: 188889 - RNA, 22 nt, Homo sapiens
uaaagcuaucacauuggugauu

SEQ ID NO: 188890 - RNA, 22 nt, Homo sapiens
uaaagcugaaaugauuaugaca

SEQ ID NO: 188891 - RNA, 20 nt, Homo sapiens
uaaagcugcucagggggcuc

SEQ ID NO: 188892 - RNA, 21 nt, Homo sapiens
uaaagcuuagcuauaguggcu

SEQ ID NO: 188893 - RNA, 22 nt, Homo sapiens
uaaagcuuggauuuaggcuaau

SEQ ID NO: 188894 - RNA, 22 nt, Homo sapiens
uaaaugcuuaauugaaugugga

SEQ ID NO: 188895 - RNA, 22 nt, Homo sapiens
uaacagcauuugugucuaguag

SEQ ID NO: 188896 - RNA, 22 nt, Homo sapiens
uaagacacauguguucccaggc

SEQ ID NO: 188897 - RNA, 23 nt, Homo sapiens
uaagacacuaacuuuaugcuuug

SEQ ID NO: 188898 - RNA, 22 nt, Homo sapiens
uaagugaauauggacaguuagc

SEQ ID NO: 188899 - RNA, 22 nt, Homo sapiens
uaagugaauuucacuacugagu

SEQ ID NO: 188900 - RNA, 22 nt, Homo sapiens
uaagugcaacauaaguguuaaa

SEQ ID NO: 188901 - RNA, 20 nt, Homo sapiens
uaagugcuuuauauugauua

SEQ ID NO: 188902 - RNA, 22 nt, Homo sapiens
uaaugcacucgaaucauggaau

SEQ ID NO: 188903 - RNA, 22 nt, Homo sapiens
uaaugcauacagaagguguuuu

SEQ ID NO: 188904 - RNA, 22 nt, Homo sapiens
uaaugugaauagugcuguaaug

SEQ ID NO: 188905 - RNA, 22 nt, Homo sapiens
uacaacacugguucgacaugug

SEQ ID NO: 188906 - RNA, 22 nt, Homo sapiens
uacacacguguguauauauaca

SEQ ID NO: 188907 - RNA, 22 nt, Homo sapiens
uacacagucaaaaauuuccagg

SEQ ID NO: 188908 - RNA, 22 nt, Homo sapiens
uacaggacuucucagaguuauu

SEQ ID NO: 188909 - RNA, 22 nt, Homo sapiens
uacaggcaccuggcuaauuuuu

SEQ ID NO: 188910 - RNA, 22 nt, Homo sapiens
uacaguaguaucuucauuuguu

SEQ ID NO: 188911 - RNA, 22 nt, Homo sapiens
uacagucuagaggagaaucagg

SEQ ID NO: 188912 - RNA, 22 nt, Homo sapiens
uacaguggaaguuaaccccauu

SEQ ID NO: 188913 - RNA, 19 nt, Homo sapiens
uacaugcagcaggcacgca

SEQ ID NO: 188914 - RNA, 22 nt, Homo sapiens
uaccacaggcuggguaaucuau

SEQ ID NO: 188915 - RNA, 22 nt, Homo sapiens
uaccauguaucugggaugcuuu

SEQ ID NO: 188916 - RNA, 22 nt, Homo sapiens
uaccucagccaaugcccagaag

SEQ ID NO: 188917 - RNA, 22 nt, Homo sapiens
uaccucaguucaauaacagaua

SEQ ID NO: 188918 - RNA, 22 nt, Homo sapiens
uacucaauugcagucaccuggc

SEQ ID NO: 188919 - RNA, 22 nt, Homo sapiens
uacugcacucuagccuggguga

SEQ ID NO: 188920 - RNA, 22 nt, Homo sapiens
uacugcacuugaccuccugggc

SEQ ID NO: 188921 - RNA, 22 nt, Homo sapiens
uacuguacugcaguucugcaaa

SEQ ID NO: 188922 - RNA, 22 nt, Homo sapiens
uagaagcacuaucccuccuagu

SEQ ID NO: 188923 - RNA, 22 nt, Homo sapiens
uagaauguaacuuccaugucau

SEQ ID NO: 188924 - RNA, 22 nt, Homo sapiens
uagacacuagauaugugacuga

SEQ ID NO: 188925 - RNA, 22 nt, Homo sapiens
uagacacugcauauuuuuuuaa

SEQ ID NO: 188926 - RNA, 22 nt, Homo sapiens
uagagguauaccaaaaaggcau

SEQ ID NO: 188927 - RNA, 22 nt, Homo sapiens
uagaucuuuaaaaggugcuaga

SEQ ID NO: 188928 - RNA, 22 nt, Homo sapiens
uagcacaugucagguaauuugc

SEQ ID NO: 188929 - RNA, 22 nt, Homo sapiens
uagcauaauuuguagaaaauca

SEQ ID NO: 188930 - RNA, 22 nt, Homo sapiens
uagccucacaaagugcuuaaga

SEQ ID NO: 188931 - RNA, 21 nt, Homo sapiens
uagcucagugguguugccaua

SEQ ID NO: 188932 - RNA, 22 nt, Homo sapiens
uagcugagacuacaguaggugc

SEQ ID NO: 188933 - RNA, 22 nt, Homo sapiens
uagcugcaaaauauagacuucu

SEQ ID NO: 188934 - RNA, 22 nt, Homo sapiens
uaggaaguacaucucagaaucu

SEQ ID NO: 188935 - RNA, 22 nt, Homo sapiens
uaggacacagauggagaaaagc

SEQ ID NO: 188936 - RNA, 22 nt, Homo sapiens
uaggagcacaaacccuacugug

SEQ ID NO: 188937 - RNA, 22 nt, Homo sapiens
uaggagugugaacccuguuuug

SEQ ID NO: 188938 - RNA, 22 nt, Homo sapiens
uaggcaaguugcccaaucucuc

SEQ ID NO: 188939 - RNA, 19 nt, Homo sapiens
uagggcacgaggcagaguc

SEQ ID NO: 188940 - RNA, 22 nt, Homo sapiens
uagggcuuuccggccugucaga

SEQ ID NO: 188941 - RNA, 22 nt, Homo sapiens
uaguaucacaagguguacaccc

SEQ ID NO: 188942 - RNA, 22 nt, Homo sapiens
uaguaucauugaaacggcuugu

SEQ ID NO: 188943 - RNA, 22 nt, Homo sapiens
uagucaaaucugaaggaaauuu

SEQ ID NO: 188944 - RNA, 22 nt, Homo sapiens
uauacaugugccauguuggugu

SEQ ID NO: 188945 - RNA, 22 nt, Homo sapiens
uauagcagccugaacaaaguaa

SEQ ID NO: 188946 - RNA, 22 nt, Homo sapiens
uauagcuugaaggaauggucau

SEQ ID NO: 188947 - RNA, 22 nt, Homo sapiens
uauaugcacucagguguaugug

SEQ ID NO: 188948 - RNA, 22 nt, Homo sapiens
uaucaaggccacucauuuuaug

SEQ ID NO: 188949 - RNA, 22 nt, Homo sapiens
uaucaaguguuagggagaugug

SEQ ID NO: 188950 - RNA, 22 nt, Homo sapiens
uaucacacgccuugcuucauuu

SEQ ID NO: 188951 - RNA, 22 nt, Homo sapiens
uaucacagaggguauccuagag

SEQ ID NO: 188952 - RNA, 22 nt, Homo sapiens
uaucacagcauugucuauaaua

SEQ ID NO: 188953 - RNA, 22 nt, Homo sapiens
uaucacaggucaggaaucuugc

SEQ ID NO: 188954 - RNA, 22 nt, Homo sapiens
uaucacagguggacugcacacc

SEQ ID NO: 188955 - RNA, 21 nt, Homo sapiens
uaucacauuggugauuaaguu

SEQ ID NO: 188956 - RNA, 22 nt, Homo sapiens
uaucacggaguacauguucugu

SEQ ID NO: 188957 - RNA, 22 nt, Homo sapiens
uaucauggaaugagguuggaca

SEQ ID NO: 188958 - RNA, 21 nt, Homo sapiens
uaucauggccauccucuucuc

SEQ ID NO: 188959 - RNA, 22 nt, Homo sapiens
uaucaugggggguguacacucc

SEQ ID NO: 188960 - RNA, 22 nt, Homo sapiens
uaucuacauguagguauguaug

SEQ ID NO: 188961 - RNA, 22 nt, Homo sapiens
uaucucagaugagacuuguaac

SEQ ID NO: 188962 - RNA, 21 nt, Homo sapiens
uaucucaguuuuccuuugugg

SEQ ID NO: 188963 - RNA, 22 nt, Homo sapiens
uaugacauaguccuuaacccuc

SEQ ID NO: 188964 - RNA, 22 nt, Homo sapiens
uaugcacacacguguuuaugug

SEQ ID NO: 188965 - RNA, 22 nt, Homo sapiens
uaugcacaugcaugcuugaaua

SEQ ID NO: 188966 - RNA, 22 nt, Homo sapiens
uaugcacaugugccugggugug

SEQ ID NO: 188967 - RNA, 22 nt, Homo sapiens
uauggcuuuuaacugucguaug

SEQ ID NO: 188968 - RNA, 22 nt, Homo sapiens
uauggcuuuuauuauguuguag

SEQ ID NO: 188969 - RNA, 20 nt, Homo sapiens
uaugguuuuagguauagcau

SEQ ID NO: 188970 - RNA, 22 nt, Homo sapiens
uaugugcaaauuaauugcuaga

SEQ ID NO: 188971 - RNA, 22 nt, Homo sapiens
uauuagguuggugcaaaaguua

SEQ ID NO: 188972 - RNA, 19 nt, Homo sapiens
ggacugucauggaguaguu

SEQ ID NO: 188973 - RNA, 22 nt, Homo sapiens
ggagaguaauuagacugaaaga

SEQ ID NO: 188974 - RNA, 22 nt, Homo sapiens
ggagaugaaaugagcuacuuaa

SEQ ID NO: 188975 - RNA, 22 nt, Homo sapiens
ggaguaaaagaguaggaggaau

SEQ ID NO: 188976 - RNA, 22 nt, Homo sapiens
ggaucacagccagcucccagaa

SEQ ID NO: 188977 - RNA, 21 nt, Homo sapiens
ggauucaucccucaugaauuu

SEQ ID NO: 188978 - RNA, 22 nt, Homo sapiens
ggauugugauaauuguugcaaa

SEQ ID NO: 188979 - RNA, 19 nt, Homo sapiens
ggcaagaguuguucugugu

SEQ ID NO: 188980 - RNA, 22 nt, Homo sapiens
ggcaaggauuagauucuccccu

SEQ ID NO: 188981 - RNA, 20 nt, Homo sapiens
ggcaagguagcauuucuucu

SEQ ID NO: 188982 - RNA, 17 nt, Homo sapiens
ggcaggaauuaauguca

SEQ ID NO: 188983 - RNA, 22 nt, Homo sapiens
ggcaguguggcugcauauagca

SEQ ID NO: 188984 - RNA, 22 nt, Homo sapiens
ggcaguguuauuauauuuuugg

SEQ ID NO: 188985 - RNA, 21 nt, Homo sapiens
ggcaugaauggaaaagugaga

SEQ ID NO: 188986 - RNA, 22 nt, Homo sapiens
ggccagaugcgguggcucacac

SEQ ID NO: 188987 - RNA, 22 nt, Homo sapiens
ggccggguggccauggcugccc

SEQ ID NO: 188988 - RNA, 22 nt, Homo sapiens
ggcuagagagcucagggauaug

SEQ ID NO: 188989 - RNA, 22 nt, Homo sapiens
gggaaaaugucuauugaaugaa

SEQ ID NO: 188990 - RNA, 22 nt, Homo sapiens
gggagugugcacacaugguaua

SEQ ID NO: 188991 - RNA, 22 nt, Homo sapiens
gggaguguguaggacccagugu

SEQ ID NO: 188992 - RNA, 22 nt, Homo sapiens
gggaugaagcccuaggguuggu

SEQ ID NO: 188993 - RNA, 22 nt, Homo sapiens
gggauguuuuauacugagccug

SEQ ID NO: 188994 - RNA, 23 nt, Homo sapiens
gggauuguaaaauaugagggcag

SEQ ID NO: 188995 - RNA, 19 nt, Homo sapiens
gggcaaaucuggaaauuua

SEQ ID NO: 188996 - RNA, 21 nt, Homo sapiens
gggcaaaucuuuauccuaagc

SEQ ID NO: 188997 - RNA, 22 nt, Homo sapiens
gggcaaauuauguaucucucag

SEQ ID NO: 188998 - RNA, 22 nt, Homo sapiens
gggcacgugugugcugugcuca

SEQ ID NO: 188999 - RNA, 22 nt, Homo sapiens
gggggagugugguacccagcau

SEQ ID NO: 189000 - RNA, 22 nt, Homo sapiens
gggguaggcuacacugaguucc

SEQ ID NO: 189001 - RNA, 22 nt, Homo sapiens
gggguauguaagugagugagug

SEQ ID NO: 189002 - RNA, 22 nt, Homo sapiens
ggguucaaaucuuggcucuuac

SEQ ID NO: 189003 - RNA, 22 nt, Homo sapiens
gguauuauuugccuuuuacuga

SEQ ID NO: 189004 - RNA, 22 nt, Homo sapiens
ggucugguguugaaauucuuca

SEQ ID NO: 189005 - RNA, 22 nt, Homo sapiens
ggugcagcacaccaacauggca

SEQ ID NO: 189006 - RNA, 22 nt, Homo sapiens
guaaagacacaugcacacguau

SEQ ID NO: 189007 - RNA, 22 nt, Homo sapiens
guaaucucaccuacuugggagg

SEQ ID NO: 189008 - RNA, 22 nt, Homo sapiens
guaaugcacucccaaagaucca

SEQ ID NO: 189009 - RNA, 22 nt, Homo sapiens
guacaugcaugcaugggugugc

SEQ ID NO: 189010 - RNA, 22 nt, Homo sapiens
guaucaugaaguuucuucauuu

SEQ ID NO: 189011 - RNA, 22 nt, Homo sapiens
guaucauugccuaaugcucuca

SEQ ID NO: 189012 - RNA, 19 nt, Homo sapiens
guauuugguaaacucucca

SEQ ID NO: 189013 - RNA, 22 nt, Homo sapiens
guauuuggugaugccuccaaac

SEQ ID NO: 189014 - RNA, 22 nt, Homo sapiens
guauuugguuauugcagccuga

SEQ ID NO: 189015 - RNA, 22 nt, Homo sapiens
gucacugagaagguuaguuugu

SEQ ID NO: 189016 - RNA, 22 nt, Homo sapiens
gucacugagcagaaggaagcga

SEQ ID NO: 189017 - RNA, 22 nt, Homo sapiens
gucacugggugcugcgccuguc

SEQ ID NO: 189018 - RNA, 22 nt, Homo sapiens
gucagaugcagauuccaguucu

SEQ ID NO: 189019 - RNA, 22 nt, Homo sapiens
gucagcaucaccaugucuauga

SEQ ID NO: 189020 - RNA, 22 nt, Homo sapiens
gucauaugcucggaaaauguua

SEQ ID NO: 189021 - RNA, 22 nt, Homo sapiens
gucauggacaguuugcuaauug

SEQ ID NO: 189022 - RNA, 22 nt, Homo sapiens
gucauugcacuccagccuggac

SEQ ID NO: 189023 - RNA, 22 nt, Homo sapiens
gucccagagauauugugucuuu

SEQ ID NO: 189024 - RNA, 22 nt, Homo sapiens
gucuaugagucccugaauuuaa

SEQ ID NO: 189025 - RNA, 22 nt, Homo sapiens
gucucacagcuagcugcuuuau

SEQ ID NO: 189026 - RNA, 22 nt, Homo sapiens
gucugguuuuuuauauccucac

SEQ ID NO: 189027 - RNA, 22 nt, Homo sapiens
gucuuuaguugaaacauguggu

SEQ ID NO: 189028 - RNA, 22 nt, Homo sapiens
gugaaguuuuugugaggccuaa

SEQ ID NO: 189029 - RNA, 22 nt, Homo sapiens
gugaaugaaugggugaauacau

SEQ ID NO: 189030 - RNA, 22 nt, Homo sapiens
gugacacuggagcuggcacaau

SEQ ID NO: 189031 - RNA, 22 nt, Homo sapiens
gugacaguggagacuuacuuca

SEQ ID NO: 189032 - RNA, 22 nt, Homo sapiens
gugacauuuuuacugaugagag

SEQ ID NO: 189033 - RNA, 22 nt, Homo sapiens
gugaccucauuacggggccugc

SEQ ID NO: 189034 - RNA, 22 nt, Homo sapiens
gugaggaaggaaaccugcuagc

SEQ ID NO: 189035 - RNA, 22 nt, Homo sapiens
gugaggcacugcugcuuuccag

SEQ ID NO: 189036 - RNA, 22 nt, Homo sapiens
gugagguagagcaugugaaaga

SEQ ID NO: 189037 - RNA, 22 nt, Homo sapiens
gugaucaugauccugaagcauu

SEQ ID NO: 189038 - RNA, 21 nt, Homo sapiens
gugaucaugucacugcacucc

SEQ ID NO: 189039 - RNA, 22 nt, Homo sapiens
gugauuauccacgucuuuguga

SEQ ID NO: 189040 - RNA, 22 nt, Homo sapiens
gugcaaaucucugaguaucuuu

SEQ ID NO: 189041 - RNA, 22 nt, Homo sapiens
gugcacaugguagguauugagu

SEQ ID NO: 189042 - RNA, 21 nt, Homo sapiens
gugcagacacacauauaggcu

SEQ ID NO: 189043 - RNA, 22 nt, Homo sapiens
gugcauaugcaugugcaugcac

SEQ ID NO: 189044 - RNA, 22 nt, Homo sapiens
guggaaagaacacaaaauuagg

SEQ ID NO: 189045 - RNA, 22 nt, Homo sapiens
guggaagucuuugguauuggua

SEQ ID NO: 189046 - RNA, 22 nt, Homo sapiens
guggaaugaaaacucucucaca

SEQ ID NO: 189047 - RNA, 22 nt, Homo sapiens
guggaaugauaucucauugugg

SEQ ID NO: 189048 - RNA, 17 nt, Homo sapiens
guggaaugucaugucaa

SEQ ID NO: 189049 - RNA, 22 nt, Homo sapiens
guggagcuguguggccuugggc

SEQ ID NO: 189050 - RNA, 22 nt, Homo sapiens
guggaggacuggauaaagaaaa

SEQ ID NO: 189051 - RNA, 22 nt, Homo sapiens
guggcaaacucagcaugcccca

SEQ ID NO: 189052 - RNA, 22 nt, Homo sapiens
guggcaaagaugccuucuccaa

SEQ ID NO: 189053 - RNA, 22 nt, Homo sapiens
guggcaaggaaaugcugcucac

SEQ ID NO: 189054 - RNA, 22 nt, Homo sapiens
guggcauuucccaaaguauucu

SEQ ID NO: 189055 - RNA, 22 nt, Homo sapiens
guggcuuguaggggucaaggga

SEQ ID NO: 189056 - RNA, 22 nt, Homo sapiens
gugggguaggaggaguacuucc

SEQ ID NO: 189057 - RNA, 22 nt, Homo sapiens
gugggguaggguaggacucaac

SEQ ID NO: 189058 - RNA, 22 nt, Homo sapiens
gugguagaaaguaccaaacuag

SEQ ID NO: 189059 - RNA, 22 nt, Homo sapiens
guguaaaucaaucuguugucuu

SEQ ID NO: 189060 - RNA, 22 nt, Homo sapiens
uauuagguuggugcaacaguaa

SEQ ID NO: 189061 - RNA, 22 nt, Homo sapiens
uauuagguugguggaaaaguaa

SEQ ID NO: 189062 - RNA, 22 nt, Homo sapiens
uauucaagccaaauucaagcca

SEQ ID NO: 189063 - RNA, 22 nt, Homo sapiens
uauuccauuugggucaggauga

SEQ ID NO: 189064 - RNA, 22 nt, Homo sapiens
uauugauuaauugugauuaggc

SEQ ID NO: 189065 - RNA, 22 nt, Homo sapiens
uauugcagugagauccaucugg

SEQ ID NO: 189066 - RNA, 22 nt, Homo sapiens
uauugcauauuauucuaguggc

SEQ ID NO: 189067 - RNA, 22 nt, Homo sapiens
uauugcuuuuaacccaaucucu

SEQ ID NO: 189068 - RNA, 22 nt, Homo sapiens
uauugggcuucucagaauagag

SEQ ID NO: 189069 - RNA, 22 nt, Homo sapiens
ucaaacacuccauaucgcgauu

SEQ ID NO: 189070 - RNA, 22 nt, Homo sapiens
ucaaaguagaaaaggggcaauu

SEQ ID NO: 189071 - RNA, 22 nt, Homo sapiens
ucaaaucaucuuuuccaaagcu

SEQ ID NO: 189072 - RNA, 22 nt, Homo sapiens
agcugguuuaauaugcugucug

SEQ ID NO: 189073 - RNA, 20 nt, Homo sapiens
agcugguuuuaugaaucuuu

SEQ ID NO: 189074 - RNA, 19 nt, Homo sapiens
agcuguguugccugugaga

SEQ ID NO: 189075 - RNA, 21 nt, Homo sapiens
agcuuguguguaucacagugu

SEQ ID NO: 189076 - RNA, 23 nt, Homo sapiens
aggaaguaacuaucuuuucuguc

SEQ ID NO: 189077 - RNA, 22 nt, Homo sapiens
aggaagugucuucuuuuaggca

SEQ ID NO: 189078 - RNA, 22 nt, Homo sapiens
aggaaugucaaugguaguuuaa

SEQ ID NO: 189079 - RNA, 22 nt, Homo sapiens
aggacacugauagucuuuggca

SEQ ID NO: 189080 - RNA, 22 nt, Homo sapiens
aggagaugaagcuuuaucuaaa

SEQ ID NO: 189081 - RNA, 22 nt, Homo sapiens
aggcaagcaucuugcucccuuc

SEQ ID NO: 189082 - RNA, 22 nt, Homo sapiens
aggcauggagacuaaaauuaua

SEQ ID NO: 189083 - RNA, 22 nt, Homo sapiens
aggcuuuuggagguggcuuucu

SEQ ID NO: 189084 - RNA, 22 nt, Homo sapiens
agggaagugugcuaugcauuua

SEQ ID NO: 189085 - RNA, 22 nt, Homo sapiens
agggcauuguacaaaucaucau

SEQ ID NO: 189086 - RNA, 22 nt, Homo sapiens
agguagcauagcgggaauauca

SEQ ID NO: 189087 - RNA, 22 nt, Homo sapiens
agguccauugguauuauagcau

SEQ ID NO: 189088 - RNA, 22 nt, Homo sapiens
agguuuucagccccagccuagg

SEQ ID NO: 189089 - RNA, 22 nt, Homo sapiens
aguaucaagccacacaugguca

SEQ ID NO: 189090 - RNA, 22 nt, Homo sapiens
aguaucacaggcaaaacagaau

SEQ ID NO: 189091 - RNA, 22 nt, Homo sapiens
agucaacaucaugaaguggaaa

SEQ ID NO: 189092 - RNA, 22 nt, Homo sapiens
agucacagugaccuugucugac

SEQ ID NO: 189093 - RNA, 22 nt, Homo sapiens
agucacaugcauuuucuucaau

SEQ ID NO: 189094 - RNA, 22 nt, Homo sapiens
agucacaugccagcacacccag

SEQ ID NO: 189095 - RNA, 22 nt, Homo sapiens
agucugguguucucacacuagu

SEQ ID NO: 189096 - RNA, 22 nt, Homo sapiens
agugacaugggaucaaaucuga

SEQ ID NO: 189097 - RNA, 22 nt, Homo sapiens
agugcaguggcacaaucuuggc

SEQ ID NO: 189098 - RNA, 22 nt, Homo sapiens
aguggaaucuguuauacuaacu

SEQ ID NO: 189099 - RNA, 22 nt, Homo sapiens
aguggcaaugugauguccugaa

SEQ ID NO: 189100 - RNA, 22 nt, Homo sapiens
aguggguguuccauuggauaaa

SEQ ID NO: 189101 - RNA, 23 nt, Homo sapiens
aguggucuccugggcccagcugu

SEQ ID NO: 189102 - RNA, 22 nt, Homo sapiens
aguggugucugaguggccaggg

SEQ ID NO: 189103 - RNA, 20 nt, Homo sapiens
agugguuuucaaauaugucu

SEQ ID NO: 189104 - RNA, 22 nt, Homo sapiens
auaaagacacuuggcaugauuu

SEQ ID NO: 189105 - RNA, 22 nt, Homo sapiens
auaaauucauuuaagcuccuua

SEQ ID NO: 189106 - RNA, 22 nt, Homo sapiens
auaacaggaaauacagggcuuu

SEQ ID NO: 189107 - RNA, 22 nt, Homo sapiens
auaauaguguuuagauuuggga

SEQ ID NO: 189108 - RNA, 22 nt, Homo sapiens
auaaugacuuccaguuccacuc

SEQ ID NO: 189109 - RNA, 22 nt, Homo sapiens
auacacauuccugggccucacc

SEQ ID NO: 189110 - RNA, 22 nt, Homo sapiens
auacagacacagucagaggggu

SEQ ID NO: 189111 - RNA, 22 nt, Homo sapiens
auacaguaucuucuggcaagca

SEQ ID NO: 189112 - RNA, 22 nt, Homo sapiens
auacaugugccauggugguuug

SEQ ID NO: 189113 - RNA, 19 nt, Homo sapiens
auacccacuagguuacuua

SEQ ID NO: 189114 - RNA, 22 nt, Homo sapiens
auagcaauuugggaaucagacu

SEQ ID NO: 189115 - RNA, 22 nt, Homo sapiens
auagcagaagaagggacaauuc

SEQ ID NO: 189116 - RNA, 22 nt, Homo sapiens
auagcagaauuuggucaagucu

SEQ ID NO: 189117 - RNA, 22 nt, Homo sapiens
auagcagcuugucagggcagac

SEQ ID NO: 189118 - RNA, 19 nt, Homo sapiens
auagggcuagcauauacug

SEQ ID NO: 189119 - RNA, 22 nt, Homo sapiens
auagugcugcaacaaauauacg

SEQ ID NO: 189120 - RNA, 22 nt, Homo sapiens
auagugcuggaauaaauauacg

SEQ ID NO: 189121 - RNA, 22 nt, Homo sapiens
auaguggcaugaucauagcuca

SEQ ID NO: 189122 - RNA, 22 nt, Homo sapiens
auaucacaaacaagucuguacu

SEQ ID NO: 189123 - RNA, 22 nt, Homo sapiens
auaugacugccagggcccaguc

SEQ ID NO: 189124 - RNA, 21 nt, Homo sapiens
auauuacuguuagaggacugc

SEQ ID NO: 189125 - RNA, 22 nt, Homo sapiens
auauugcuccuaauaccacggu

SEQ ID NO: 189126 - RNA, 22 nt, Homo sapiens
auauuugguuaccugugggucu

SEQ ID NO: 189127 - RNA, 22 nt, Homo sapiens
aucaaaguaucucaauauggua

SEQ ID NO: 189128 - RNA, 22 nt, Homo sapiens
aucaaagugaauuaaugagaau

SEQ ID NO: 189129 - RNA, 22 nt, Homo sapiens
aucaaaugcuggcagagugccu

SEQ ID NO: 189130 - RNA, 22 nt, Homo sapiens
aucaagcuggcauauguaguuc

SEQ ID NO: 189131 - RNA, 22 nt, Homo sapiens
aucacagaguuaaaacuuucuu

SEQ ID NO: 189132 - RNA, 22 nt, Homo sapiens
aucacugggcaagauaucauga

SEQ ID NO: 189133 - RNA, 22 nt, Homo sapiens
aucacuggucaugagagaagua

SEQ ID NO: 189134 - RNA, 22 nt, Homo sapiens
aucagaaucucuagugggacca

SEQ ID NO: 189135 - RNA, 22 nt, Homo sapiens
aucagugcagugggaacuagaa

SEQ ID NO: 189136 - RNA, 22 nt, Homo sapiens
aucauugugcaucuucauucca

SEQ ID NO: 189137 - RNA, 22 nt, Homo sapiens
auccaagagacugaugacuucc

SEQ ID NO: 189138 - RNA, 22 nt, Homo sapiens
aucccuguguccagcaccugug

SEQ ID NO: 189139 - RNA, 22 nt, Homo sapiens
aucccuuucugauacuuucccu

SEQ ID NO: 189140 - RNA, 22 nt, Homo sapiens
auccugagacuuuucugaaguu

SEQ ID NO: 189141 - RNA, 22 nt, Homo sapiens
uuuacagucuuuugugugaguc

SEQ ID NO: 189142 - RNA, 22 nt, Homo sapiens
uuuagcaauucauuuugugucu

SEQ ID NO: 189143 - RNA, 22 nt, Homo sapiens
uuuaugucuguacaucgggcgg

SEQ ID NO: 189144 - RNA, 22 nt, Homo sapiens
uuucauagccuuugucgucuga

SEQ ID NO: 189145 - RNA, 22 nt, Homo sapiens
uuucauaguuugcauagggcau

SEQ ID NO: 189146 - RNA, 22 nt, Homo sapiens
uuucauggcaguuuggggccug

SEQ ID NO: 189147 - RNA, 23 nt, Homo sapiens
uuucauggggauuuacucauucc

SEQ ID NO: 189148 - RNA, 22 nt, Homo sapiens
uuucauguuuuucugugaggca

SEQ ID NO: 189149 - RNA, 18 nt, Homo sapiens
uuucauugagugugauau

SEQ ID NO: 189150 - RNA, 16 nt, Homo sapiens
uuucuauguuuuacua

SEQ ID NO: 189151 - RNA, 22 nt, Homo sapiens
uuucugcuugagagaauugcug

SEQ ID NO: 189152 - RNA, 22 nt, Homo sapiens
uuugaagacuacugggagugaa

SEQ ID NO: 189153 - RNA, 20 nt, Homo sapiens
uuugaauguaaagcauguca

SEQ ID NO: 189154 - RNA, 22 nt, Homo sapiens
uuugacaaugugugcuuguauu

SEQ ID NO: 189155 - RNA, 22 nt, Homo sapiens
uuugagcauggaaauggcauga

SEQ ID NO: 189156 - RNA, 22 nt, Homo sapiens
uuugauguccaccucagcccac

SEQ ID NO: 189157 - RNA, 22 nt, Homo sapiens
uuugauguugauacuaccuuca

SEQ ID NO: 189158 - RNA, 22 nt, Homo sapiens
uuugcacuuuaauauaauguga

SEQ ID NO: 189159 - RNA, 20 nt, Homo sapiens
uuugcagaaucuaagaagag

SEQ ID NO: 189160 - RNA, 22 nt, Homo sapiens
uuugcaugcuccuuaugagaau

SEQ ID NO: 189161 - RNA, 22 nt, Homo sapiens
uuuggcagaaaacuaaaaggua

SEQ ID NO: 189162 - RNA, 22 nt, Homo sapiens
uuuggcaguuauuuacucagug

SEQ ID NO: 189163 - RNA, 22 nt, Homo sapiens
uuuggcuuuuguaauaacugcc

SEQ ID NO: 189164 - RNA, 22 nt, Homo sapiens
uuugguaauguuucauugcaga

SEQ ID NO: 189165 - RNA, 22 nt, Homo sapiens
uuuggucuuuuauuuaaagcag

SEQ ID NO: 189166 - RNA, 22 nt, Homo sapiens
uuugucuccuaagacucugugg

SEQ ID NO: 189167 - RNA, 22 nt, Homo sapiens
uuugugcaaacuaggauugcga

SEQ ID NO: 189168 - RNA, 22 nt, Homo sapiens
uuugugcuccugugagaaucua

SEQ ID NO: 189169 - RNA, 22 nt, Homo sapiens
uuugugcuccuguugagaaucu

SEQ ID NO: 189170 - RNA, 22 nt, Homo sapiens
uuuguucaccucaaggauggga

SEQ ID NO: 189171 - RNA, 22 nt, Homo sapiens
uuuguucuucguuccugagcca

SEQ ID NO: 189172 - RNA, 22 nt, Homo sapiens
uuuuaacagccaggggacggcc

SEQ ID NO: 189173 - RNA, 20 nt, Homo sapiens
uuuugcacuccuacuaaggu

SEQ ID NO: 189174 - RNA, 22 nt, Homo sapiens
uuuugcacuguuuuaucugaca

SEQ ID NO: 189175 - RNA, 22 nt, Homo sapiens
uuuugcuugugaauagccacau

SEQ ID NO: 189176 - RNA, 22 nt, Homo sapiens
uuuugguaaugaacuuaggaag

SEQ ID NO: 189177 - RNA, 22 nt, Homo sapiens
uuuugguauacacaaggguccu

SEQ ID NO: 189178 - RNA, 22 nt, Homo sapiens
uuuugugcauggcccaguggua

SEQ ID NO: 189179 - RNA, 22 nt, Homo sapiens
uuuuucacuuaaguuaggcuca

SEQ ID NO: 189180 - RNA, 23 nt, Homo sapiens
uuuuuguguuucauggaaauagg

SEQ ID NO: 189181 - RNA, 22 nt, Homo sapiens
uuuuuugguaauugaacaauga

SEQ ID NO: 189182 - RNA, 22 nt, Homo sapiens
caguuacuuuugcaccaaccua

SEQ ID NO: 189183 - RNA, 22 nt, Homo sapiens
cauagguugggcguuugauuuu

SEQ ID NO: 189184 - RNA, 23 nt, Homo sapiens
caucacagagccuuccuugacuc

SEQ ID NO: 189185 - RNA, 19 nt, Homo sapiens
caucacagagucuuccauu

SEQ ID NO: 189186 - RNA, 20 nt, Homo sapiens
caucaccuggcaggauuugu

SEQ ID NO: 189187 - RNA, 22 nt, Homo sapiens
caucacuuuuccuuuuacagau

SEQ ID NO: 189188 - RNA, 22 nt, Homo sapiens
caugaacacugugcggcuuccu

SEQ ID NO: 189189 - RNA, 22 nt, Homo sapiens
cauggccuuuggaaugugucua

SEQ ID NO: 189190 - RNA, 22 nt, Homo sapiens
caugucuuuuaaacauucaacu

SEQ ID NO: 189191 - RNA, 22 nt, Homo sapiens
caugucuuuuauucugugugau

SEQ ID NO: 189192 - RNA, 22 nt, Homo sapiens
caugugcaugcuuucuuaugug

SEQ ID NO: 189193 - RNA, 22 nt, Homo sapiens
cauuuuacuuuccagacgugga

SEQ ID NO: 189194 - RNA, 22 nt, Homo sapiens
ccaaaucucauguugaaaugug

SEQ ID NO: 189195 - RNA, 22 nt, Homo sapiens
ccacacugucuuggugggaaac

SEQ ID NO: 189196 - RNA, 22 nt, Homo sapiens
ccagaguugccucagguuucug

SEQ ID NO: 189197 - RNA, 22 nt, Homo sapiens
ccagugaacugcaagguuuuuc

SEQ ID NO: 189198 - RNA, 22 nt, Homo sapiens
ccaucccuuucugagcaguucc

SEQ ID NO: 189199 - RNA, 21 nt, Homo sapiens
ccaugggacggaaugaauaca

SEQ ID NO: 189200 - RNA, 18 nt, Homo sapiens
ccauucaacagauuuguc

SEQ ID NO: 189201 - RNA, 22 nt, Homo sapiens
ccauugcacuccauccugggca

SEQ ID NO: 189202 - RNA, 22 nt, Homo sapiens
cccagugguuacauaaggagua

SEQ ID NO: 189203 - RNA, 19 nt, Homo sapiens
cccagugucagagaagggu

SEQ ID NO: 189204 - RNA, 22 nt, Homo sapiens
ccccauguucucucugcagcuc

SEQ ID NO: 189205 - RNA, 22 nt, Homo sapiens
ccccugaaacucacucauuauc

SEQ ID NO: 189206 - RNA, 23 nt, Homo sapiens
cccucagaagugcagggagagaa

SEQ ID NO: 189207 - RNA, 22 nt, Homo sapiens
cccugaagaaagccuaggacau

SEQ ID NO: 189208 - RNA, 22 nt, Homo sapiens
cccugacauucggagauguagu

SEQ ID NO: 189209 - RNA, 22 nt, Homo sapiens
ccucauugcuaucccaggcuga

SEQ ID NO: 189210 - RNA, 22 nt, Homo sapiens
ccugagguagaguuuauauuga

SEQ ID NO: 189211 - RNA, 22 nt, Homo sapiens
ccuucauucauuaauuuagccc

SEQ ID NO: 189212 - RNA, 22 nt, Homo sapiens
ccuuggcacuuugccacagugc

SEQ ID NO: 189213 - RNA, 19 nt, Homo sapiens
ccuuugguuuccaugacau

SEQ ID NO: 189214 - RNA, 22 nt, Homo sapiens
cgccgggggaugggcaccagcg

SEQ ID NO: 189215 - RNA, 22 nt, Homo sapiens
cggcaguggguaagccaagcuu

SEQ ID NO: 189216 - RNA, 22 nt, Homo sapiens
cuaaaacuuucugagugcagca

SEQ ID NO: 189217 - RNA, 22 nt, Homo sapiens
cuaaucuagccuuauaaguauu

SEQ ID NO: 189218 - RNA, 22 nt, Homo sapiens
cuacccuuaaguuucugugggg

SEQ ID NO: 189219 - RNA, 22 nt, Homo sapiens
cuacugcacaucaucugaguua

SEQ ID NO: 189220 - RNA, 22 nt, Homo sapiens
cuagccuggagugcaguggugc

SEQ ID NO: 189221 - RNA, 22 nt, Homo sapiens
cuauuagguuggugcaaaaguc

SEQ ID NO: 189222 - RNA, 21 nt, Homo sapiens
cucaaaguacugauauuacag

SEQ ID NO: 189223 - RNA, 22 nt, Homo sapiens
cucaaaugguccagcuaguggu

SEQ ID NO: 189224 - RNA, 22 nt, Homo sapiens
cucacaugcucaccugguguuc

SEQ ID NO: 189225 - RNA, 17 nt, Homo sapiens
cucacugagaacagcua

SEQ ID NO: 189226 - RNA, 22 nt, Homo sapiens
cucacugugguguccuuaggua

SEQ ID NO: 189227 - RNA, 22 nt, Homo sapiens
cucagcuacuugagaggcuuag

SEQ ID NO: 189228 - RNA, 22 nt, Homo sapiens
cucaguacuugcacagaagaac

SEQ ID NO: 189229 - RNA, 19 nt, Homo sapiens
cucauggagaaggagaaua

SEQ ID NO: 189230 - RNA, 22 nt, Homo sapiens
cucauugcaaucucugccuccc

SEQ ID NO: 189231 - RNA, 22 nt, Homo sapiens
cuccaggugucauccaccuccu

SEQ ID NO: 189232 - RNA, 22 nt, Homo sapiens
cuccaguacagagagguuccuc

SEQ ID NO: 189233 - RNA, 22 nt, Homo sapiens
cugaaaucagccaguuaguuuc

SEQ ID NO: 189234 - RNA, 22 nt, Homo sapiens
cugaagugcuugccacauaaaa

SEQ ID NO: 189235 - RNA, 22 nt, Homo sapiens
cugaagugugaaagucuuuuuu

SEQ ID NO: 189236 - RNA, 22 nt, Homo sapiens
cugagaucaagucuugcucugu

SEQ ID NO: 189237 - RNA, 22 nt, Homo sapiens
cugaggaaguucuuuaacaguu

SEQ ID NO: 189238 - RNA, 22 nt, Homo sapiens
cugaggguagaaggaucacuug

SEQ ID NO: 189239 - RNA, 22 nt, Homo sapiens
cugagguaauuuguugccagua

SEQ ID NO: 189240 - RNA, 22 nt, Homo sapiens
cugaggugggaguuuuucucau

SEQ ID NO: 189241 - RNA, 22 nt, Homo sapiens
cugagguuaggaguuugagacc

SEQ ID NO: 189242 - RNA, 22 nt, Homo sapiens
cugauguagguggucugugauc

SEQ ID NO: 189243 - RNA, 22 nt, Homo sapiens
cugauugugcagagguguaauu

SEQ ID NO: 189244 - RNA, 21 nt, Homo sapiens
cugcaaaugcugcugccugau

SEQ ID NO: 189245 - RNA, 22 nt, Homo sapiens
cuggaaacaucuuaggaaugca

SEQ ID NO: 189246 - RNA, 22 nt, Homo sapiens
cuggaguuugaggcugcaguga

SEQ ID NO: 189247 - RNA, 22 nt, Homo sapiens
cuggcaaaaagagggcaauaau

SEQ ID NO: 189248 - RNA, 22 nt, Homo sapiens
cuggccagagacauucauuaaa

SEQ ID NO: 189249 - RNA, 22 nt, Homo sapiens
cuguaauguaaugagacuacau

SEQ ID NO: 189250 - RNA, 22 nt, Homo sapiens
cugucacaguuuuggaggccag

SEQ ID NO: 189251 - RNA, 22 nt, Homo sapiens
cugugcaugcgcggagcugaaa

SEQ ID NO: 189252 - RNA, 22 nt, Homo sapiens
cuguuauguucuagagggugca

SEQ ID NO: 189253 - RNA, 22 nt, Homo sapiens
cuuaaguaguuguggaaugaau

SEQ ID NO: 189254 - RNA, 22 nt, Homo sapiens
cuuaggguacuuuggugcauca

SEQ ID NO: 189255 - RNA, 22 nt, Homo sapiens
cuucaccaguuuggcagucuca

SEQ ID NO: 189256 - RNA, 22 nt, Homo sapiens
cuucacggugccuacuuguguc

SEQ ID NO: 189257 - RNA, 22 nt, Homo sapiens
cuuucacacuguuggugggaau

SEQ ID NO: 189258 - RNA, 21 nt, Homo sapiens
cuuugguagaguuuuuagggu

SEQ ID NO: 189259 - RNA, 22 nt, Homo sapiens
cuuuuacacugguggugggaau

SEQ ID NO: 189260 - RNA, 22 nt, Homo sapiens
gaaagauuuccugagcuagaaa

SEQ ID NO: 189261 - RNA, 22 nt, Homo sapiens
gaagaacuaggugagaucuaga

SEQ ID NO: 189262 - RNA, 22 nt, Homo sapiens
gaagauucaaccaaaccagaac

SEQ ID NO: 189263 - RNA, 22 nt, Homo sapiens
gaagguaguuuauagauguggu

SEQ ID NO: 189264 - RNA, 19 nt, Homo sapiens
gaaguguuuguucuccaug

SEQ ID NO: 189265 - RNA, 22 nt, Homo sapiens
gaauucugucgcuuacuagaug

SEQ ID NO: 189266 - RNA, 22 nt, Homo sapiens
gacacagugaagucucuacuug

SEQ ID NO: 189267 - RNA, 22 nt, Homo sapiens
gacacuggguguuuguuggcgu

SEQ ID NO: 189268 - RNA, 22 nt, Homo sapiens
gacacugucuucugcucuuaaa

SEQ ID NO: 189269 - RNA, 22 nt, Homo sapiens
gacagacacaauugauccauga

SEQ ID NO: 189270 - RNA, 22 nt, Homo sapiens
gacuaggagagcagcugcccau

SEQ ID NO: 189271 - RNA, 22 nt, Homo sapiens
gagaacagagauaauuuuacuu

SEQ ID NO: 189272 - RNA, 22 nt, Homo sapiens
gagacggagucucgcucuguca

SEQ ID NO: 189273 - RNA, 22 nt, Homo sapiens
gagacucuuagauuggaaaucu

SEQ ID NO: 189274 - RNA, 22 nt, Homo sapiens
gagacugagucuugcuuuguca

SEQ ID NO: 189275 - RNA, 22 nt, Homo sapiens
gagauauucugguuuacuaaau

SEQ ID NO: 189276 - RNA, 22 nt, Homo sapiens
gagcaacaguggcagugguggg

SEQ ID NO: 189277 - RNA, 22 nt, Homo sapiens
gagcacauaugacauuuucuuc

SEQ ID NO: 189278 - RNA, 22 nt, Homo sapiens
gagcacugaauacugugguggu

SEQ ID NO: 189279 - RNA, 22 nt, Homo sapiens
gugagaugugacuucugccucu

SEQ ID NO: 189280 - RNA, 22 nt, Homo sapiens
gugagcuaagcaaauaugagcc

SEQ ID NO: 189281 - RNA, 22 nt, Homo sapiens
gugagcuccucuucugcugcag

SEQ ID NO: 189282 - RNA, 22 nt, Homo sapiens
gugaggcuuuuccuguuagacu

SEQ ID NO: 189283 - RNA, 22 nt, Homo sapiens
gugaucauuguauugggguuau

SEQ ID NO: 189284 - RNA, 22 nt, Homo sapiens
gugaugacauucagagaugaag

SEQ ID NO: 189285 - RNA, 22 nt, Homo sapiens
gugcaauucacuguuaugucug

SEQ ID NO: 189286 - RNA, 22 nt, Homo sapiens
gugcacaucgugcagguuuguu

SEQ ID NO: 189287 - RNA, 22 nt, Homo sapiens
gugcacaugcgugcgcacauau

SEQ ID NO: 189288 - RNA, 22 nt, Homo sapiens
gugcacauuguuuaugucuguu

SEQ ID NO: 189289 - RNA, 22 nt, Homo sapiens
gugcagugugauccuuccguau

SEQ ID NO: 189290 - RNA, 22 nt, Homo sapiens
gugcaguguuugcauggaauca

SEQ ID NO: 189291 - RNA, 22 nt, Homo sapiens
gugcaguuugaaaguagaaaca

SEQ ID NO: 189292 - RNA, 22 nt, Homo sapiens
guggaagaaaucagguuauuug

SEQ ID NO: 189293 - RNA, 22 nt, Homo sapiens
guggaagaccagacuuuccaac

SEQ ID NO: 189294 - RNA, 20 nt, Homo sapiens
guggaagauaaguagccuga

SEQ ID NO: 189295 - RNA, 20 nt, Homo sapiens
guggaaguagaaacauaugu

SEQ ID NO: 189296 - RNA, 22 nt, Homo sapiens
guggaaguuaagugacuuucug

SEQ ID NO: 189297 - RNA, 22 nt, Homo sapiens
guggaaugcaguguugauucaa

SEQ ID NO: 189298 - RNA, 22 nt, Homo sapiens
guggacggagguugcagugagc

SEQ ID NO: 189299 - RNA, 22 nt, Homo sapiens
guggcagaacagguaggguucu

SEQ ID NO: 189300 - RNA, 22 nt, Homo sapiens
guguagagaaaaguaccauuuu

SEQ ID NO: 189301 - RNA, 22 nt, Homo sapiens
gugucacagcuuccaucucggu

SEQ ID NO: 189302 - RNA, 22 nt, Homo sapiens
gugucacuguugagaaguccac

SEQ ID NO: 189303 - RNA, 22 nt, Homo sapiens
gugucaugagggggacaggaag

SEQ ID NO: 189304 - RNA, 22 nt, Homo sapiens
gugugcacaaucuggcaugugc

SEQ ID NO: 189305 - RNA, 22 nt, Homo sapiens
guuaaagacauccacauaggag

SEQ ID NO: 189306 - RNA, 20 nt, Homo sapiens
guucacagagguuaugauua

SEQ ID NO: 189307 - RNA, 22 nt, Homo sapiens
guugcucaggcuggagugcagu

SEQ ID NO: 189308 - RNA, 22 nt, Homo sapiens
guuggcuuuuuaaggaaauugc

SEQ ID NO: 189309 - RNA, 22 nt, Homo sapiens
guugugcuuaagccuauugauu

SEQ ID NO: 189310 - RNA, 22 nt, Homo sapiens
guuuacagucgacuugggaaua

SEQ ID NO: 189311 - RNA, 22 nt, Homo sapiens
guuuuuggggucacuauuaccg

SEQ ID NO: 189312 - RNA, 17 nt, Homo sapiens
uaaagccagucaaguca

SEQ ID NO: 189313 - RNA, 16 nt, Homo sapiens
uaaagcuaaucacuuu

SEQ ID NO: 189314 - RNA, 22 nt, Homo sapiens
uaaagcuacaguauaugguauu

SEQ ID NO: 189315 - RNA, 22 nt, Homo sapiens
uaaagcuagagcuggaguggca

SEQ ID NO: 189316 - RNA, 18 nt, Homo sapiens
uaaauugcuucaccugag

SEQ ID NO: 189317 - RNA, 22 nt, Homo sapiens
uaacaguauaugugguaucuau

SEQ ID NO: 189318 - RNA, 22 nt, Homo sapiens
uaagacuguuggcaauuuuugc

SEQ ID NO: 189319 - RNA, 22 nt, Homo sapiens
uaagacuuuuugggaauauaga

SEQ ID NO: 189320 - RNA, 22 nt, Homo sapiens
uaagagagcuccaucuuuuccu

SEQ ID NO: 189321 - RNA, 22 nt, Homo sapiens
uaagccaccgugccuggccuaa

SEQ ID NO: 189322 - RNA, 22 nt, Homo sapiens
uaagcuauagugaauaaauugc

SEQ ID NO: 189323 - RNA, 22 nt, Homo sapiens
uaaggaaggcugugugcuuuua

SEQ ID NO: 189324 - RNA, 22 nt, Homo sapiens
uaaggcaaguuuuuaguggaca

SEQ ID NO: 189325 - RNA, 22 nt, Homo sapiens
uaaguaaaugaaagguugauuu

SEQ ID NO: 189326 - RNA, 22 nt, Homo sapiens
uaauaauguuaggcuuacucaa

SEQ ID NO: 189327 - RNA, 22 nt, Homo sapiens
uaauaugugguugcuugggcac

SEQ ID NO: 189328 - RNA, 22 nt, Homo sapiens
uaauccuggcacuuugggaggc

SEQ ID NO: 189329 - RNA, 22 nt, Homo sapiens
uaaucucagcugagcugagauu

SEQ ID NO: 189330 - RNA, 22 nt, Homo sapiens
uaaugcaucagugguaguucuu

SEQ ID NO: 189331 - RNA, 22 nt, Homo sapiens
uaaugcaucaugguuggcaaac

SEQ ID NO: 189332 - RNA, 22 nt, Homo sapiens
uaauucugacaacaguggcguu

SEQ ID NO: 189333 - RNA, 22 nt, Homo sapiens
uacaagguaucagugaccguaa

SEQ ID NO: 189334 - RNA, 22 nt, Homo sapiens
uacaaguaauaagggaagaauu

SEQ ID NO: 189335 - RNA, 22 nt, Homo sapiens
uacagguauagauguguguucu

SEQ ID NO: 189336 - RNA, 22 nt, Homo sapiens
uacaguaggauuuucagggucu

SEQ ID NO: 189337 - RNA, 22 nt, Homo sapiens
uacagugggcacuggcgcccug

SEQ ID NO: 189338 - RNA, 22 nt, Homo sapiens
uaccagugaauuccaggggcua

SEQ ID NO: 189339 - RNA, 22 nt, Homo sapiens
uacccgucuacuuugaacaaaa

SEQ ID NO: 189340 - RNA, 22 nt, Homo sapiens
uacugagagaggaauauugaaa

SEQ ID NO: 189341 - RNA, 22 nt, Homo sapiens
uacugcacuccacccuggguga

SEQ ID NO: 189342 - RNA, 22 nt, Homo sapiens
uacugcacuccagccugggaga

SEQ ID NO: 189343 - RNA, 22 nt, Homo sapiens
uacugcacuccagccuggguga

SEQ ID NO: 189344 - RNA, 22 nt, Homo sapiens
uacuuuguagagugugagaauu

SEQ ID NO: 189345 - RNA, 22 nt, Homo sapiens
uagaauguaaauuccaagggca

SEQ ID NO: 189346 - RNA, 22 nt, Homo sapiens
uagaauguaacaguuaaaagca

SEQ ID NO: 189347 - RNA, 22 nt, Homo sapiens
uagagcaaugacucuggaaacc

SEQ ID NO: 189348 - RNA, 22 nt, Homo sapiens
uagagguucuaagauucucaga

SEQ ID NO: 189349 - RNA, 22 nt, Homo sapiens
uagaguguuuuguuaggcagca

SEQ ID NO: 189350 - RNA, 20 nt, Homo sapiens
uagaugcauuuagauucauu

SEQ ID NO: 189351 - RNA, 21 nt, Homo sapiens
uagcaaauugcuauuaaggca

SEQ ID NO: 189352 - RNA, 23 nt, Homo sapiens
uagcaacaguuggaggugaggua

SEQ ID NO: 189353 - RNA, 22 nt, Homo sapiens
uagcacuauguuaucacauacu

SEQ ID NO: 189354 - RNA, 22 nt, Homo sapiens
uagcagaauaacuugccagccu

SEQ ID NO: 189355 - RNA, 22 nt, Homo sapiens
uagcagcaaagcaggaucugcu

SEQ ID NO: 189356 - RNA, 22 nt, Homo sapiens
uagcagcaccccacucuacugg

SEQ ID NO: 189357 - RNA, 22 nt, Homo sapiens
uagcagcaucucuggcuucuac

SEQ ID NO: 189358 - RNA, 22 nt, Homo sapiens
uagcaggaaaccuguguugagg

SEQ ID NO: 189359 - RNA, 22 nt, Homo sapiens
uagcaggaaaggggucagaucu

SEQ ID NO: 189360 - RNA, 22 nt, Homo sapiens
uagcaucagauuccauauucua

SEQ ID NO: 189361 - RNA, 22 nt, Homo sapiens
uagcugcacuuacaagugagaa

SEQ ID NO: 189362 - RNA, 22 nt, Homo sapiens
uagcugcauccugugcacucaa

SEQ ID NO: 189363 - RNA, 22 nt, Homo sapiens
uaggagcacaaaccccauugug

SEQ ID NO: 189364 - RNA, 22 nt, Homo sapiens
uaggagcacagcagcauguggg

SEQ ID NO: 189365 - RNA, 22 nt, Homo sapiens
uaggcaaaugcaagaguagaac

SEQ ID NO: 189366 - RNA, 22 nt, Homo sapiens
uaggcacugagaauaugaggau

SEQ ID NO: 189367 - RNA, 22 nt, Homo sapiens
uaggcacuguguuuguaggagu

SEQ ID NO: 189368 - RNA, 22 nt, Homo sapiens
uaggcagccagcuguggauuga

SEQ ID NO: 189369 - RNA, 21 nt, Homo sapiens
uaggccgggugcaggaugcuu

SEQ ID NO: 189370 - RNA, 22 nt, Homo sapiens
uaggcgagauguguguuucaug

SEQ ID NO: 189371 - RNA, 22 nt, Homo sapiens
uagggcaaggaacaguuaaaaa

SEQ ID NO: 189372 - RNA, 22 nt, Homo sapiens
uaggucaguuuuggcuuggcuu

SEQ ID NO: 189373 - RNA, 22 nt, Homo sapiens
uaggugauccauuuguauuuua

SEQ ID NO: 189374 - RNA, 22 nt, Homo sapiens
uaggugauugaagguggaaugu

SEQ ID NO: 189375 - RNA, 22 nt, Homo sapiens
uaggugguuugaaauacucaag

SEQ ID NO: 189376 - RNA, 22 nt, Homo sapiens
ucugacucuggagucucagguu

SEQ ID NO: 189377 - RNA, 22 nt, Homo sapiens
ucugagcaugcaucuugccugg

SEQ ID NO: 189378 - RNA, 23 nt, Homo sapiens
ucugauguuauaaaauucuuugg

SEQ ID NO: 189379 - RNA, 22 nt, Homo sapiens
ucugcauaucaugcagaacuau

SEQ ID NO: 189380 - RNA, 22 nt, Homo sapiens
ucuggccuccuaugagaaucga

SEQ ID NO: 189381 - RNA, 20 nt, Homo sapiens
ucuggguuuuggccacgccc

SEQ ID NO: 189382 - RNA, 22 nt, Homo sapiens
ucugguuccugcauucauucaa

SEQ ID NO: 189383 - RNA, 22 nt, Homo sapiens
ucuuggccaugaauggcaaggc

SEQ ID NO: 189384 - RNA, 20 nt, Homo sapiens
ucuuucgguuaccaggcagu

SEQ ID NO: 189385 - RNA, 22 nt, Homo sapiens
ucuuugaguuauugugcagacu

SEQ ID NO: 189386 - RNA, 22 nt, Homo sapiens
ucuuugccuaacccaaggucau

SEQ ID NO: 189387 - RNA, 22 nt, Homo sapiens
ucuuugguaggaguaggaggcc

SEQ ID NO: 189388 - RNA, 22 nt, Homo sapiens
ucuuugguaugugcaugugcuu

SEQ ID NO: 189389 - RNA, 22 nt, Homo sapiens
ucuuugguauugugaauagugu

SEQ ID NO: 189390 - RNA, 22 nt, Homo sapiens
ucuuuggucagaaagauuacac

SEQ ID NO: 189391 - RNA, 22 nt, Homo sapiens
ucuuugguuguuuagggugcau

SEQ ID NO: 189392 - RNA, 22 nt, Homo sapiens
ucuuuuugagucaguuucggua

SEQ ID NO: 189393 - RNA, 20 nt, Homo sapiens
ucuuuuuguggccccagagu

SEQ ID NO: 189394 - RNA, 22 nt, Homo sapiens
ugaaaagucuaagauuaagguu

SEQ ID NO: 189395 - RNA, 22 nt, Homo sapiens
ugaaagcuacagucuccuagga

SEQ ID NO: 189396 - RNA, 22 nt, Homo sapiens
ugaaaugucuuuaggaggcuuc

SEQ ID NO: 189397 - RNA, 22 nt, Homo sapiens
ugaaguaauguuuuauucuauu

SEQ ID NO: 189398 - RNA, 22 nt, Homo sapiens
ugaauagaaguggcaggaguag

SEQ ID NO: 189399 - RNA, 22 nt, Homo sapiens
ugaauauagacagggguagaga

SEQ ID NO: 189400 - RNA, 22 nt, Homo sapiens
ugaauauguuucuaaaagugca

SEQ ID NO: 189401 - RNA, 22 nt, Homo sapiens
ugaauauuugcuacucacucuu

SEQ ID NO: 189402 - RNA, 21 nt, Homo sapiens
ugaaugcuuuaaauauuagaa

SEQ ID NO: 189403 - RNA, 22 nt, Homo sapiens
ugacacuugcccuuagaaacau

SEQ ID NO: 189404 - RNA, 22 nt, Homo sapiens
ugacaggucuaauuuacugaca

SEQ ID NO: 189405 - RNA, 22 nt, Homo sapiens
ugacagguugauaggugcagca

SEQ ID NO: 189406 - RNA, 22 nt, Homo sapiens
ugacaucugcuugugcccagga

SEQ ID NO: 189407 - RNA, 22 nt, Homo sapiens
ugacaugaagaaaaacagauuu

SEQ ID NO: 189408 - RNA, 22 nt, Homo sapiens
ugacauggaagauguucaugau

SEQ ID NO: 189409 - RNA, 22 nt, Homo sapiens
ugacauggagguggaggaagau

SEQ ID NO: 189410 - RNA, 22 nt, Homo sapiens
ugacauguccaggugguccugu

SEQ ID NO: 189411 - RNA, 22 nt, Homo sapiens
ugacucaagagccugacucauc

SEQ ID NO: 189412 - RNA, 22 nt, Homo sapiens
ugacucagauagguguguauuc

SEQ ID NO: 189413 - RNA, 22 nt, Homo sapiens
ugacucaguuucucagguagua

SEQ ID NO: 189414 - RNA, 22 nt, Homo sapiens
ugacuggaacuuuagugagucu

SEQ ID NO: 189415 - RNA, 22 nt, Homo sapiens
ugacuugaguaacuggcucagg

SEQ ID NO: 189416 - RNA, 22 nt, Homo sapiens
ugagaaugacugggcaugcugc

SEQ ID NO: 189417 - RNA, 22 nt, Homo sapiens
ugagagacaguuucgucggagg

SEQ ID NO: 189418 - RNA, 22 nt, Homo sapiens
ugagauaggaucuugcucuguu

SEQ ID NO: 189419 - RNA, 22 nt, Homo sapiens
ugagaucacgccacugcacucc

SEQ ID NO: 189420 - RNA, 22 nt, Homo sapiens
ugagaucacuaagagguaaugg

SEQ ID NO: 189421 - RNA, 22 nt, Homo sapiens
ugagaucaugccacugcacuuc

SEQ ID NO: 189422 - RNA, 22 nt, Homo sapiens
ugagaucaugucauuugcacuc

SEQ ID NO: 189423 - RNA, 20 nt, Homo sapiens
ugagauccacgugaaguaug

SEQ ID NO: 189424 - RNA, 19 nt, Homo sapiens
ugagauccacugaagauuc

SEQ ID NO: 189425 - RNA, 22 nt, Homo sapiens
ugagaucuuaccuuccugccuu

SEQ ID NO: 189426 - RNA, 22 nt, Homo sapiens
ugagaugaacuugauuguuuua

SEQ ID NO: 189427 - RNA, 22 nt, Homo sapiens
ugagauggaguuucgcccuugu

SEQ ID NO: 189428 - RNA, 22 nt, Homo sapiens
ugagauggaguuucgcucuugu

SEQ ID NO: 189429 - RNA, 22 nt, Homo sapiens
ugagaugguaaauuuuuguugu

SEQ ID NO: 189430 - RNA, 23 nt, Homo sapiens
ugagauuacccagaaagaguaua

SEQ ID NO: 189431 - RNA, 22 nt, Homo sapiens
ugagauuaucguaauguaucuc

SEQ ID NO: 189432 - RNA, 19 nt, Homo sapiens
ugagauuguaugaggagau

SEQ ID NO: 189433 - RNA, 22 nt, Homo sapiens
ugagcacagagccugggguggc

SEQ ID NO: 189434 - RNA, 22 nt, Homo sapiens
ugagcagaguuguuucuccuga

SEQ ID NO: 189435 - RNA, 22 nt, Homo sapiens
ugagccauggcaccuugucuaa

SEQ ID NO: 189436 - RNA, 20 nt, Homo sapiens
ugagcucaugacauuuuucu

SEQ ID NO: 189437 - RNA, 22 nt, Homo sapiens
ugagcucaugcauucuugagga

SEQ ID NO: 189438 - RNA, 22 nt, Homo sapiens
ugaggaauguguguuaaagaua

SEQ ID NO: 189439 - RNA, 22 nt, Homo sapiens
ugaggacugagaggcacugugg

SEQ ID NO: 189440 - RNA, 17 nt, Homo sapiens
ugaggcacuaguaucac

SEQ ID NO: 189441 - RNA, 22 nt, Homo sapiens
ugaggcacucuagacuuauuca

SEQ ID NO: 189442 - RNA, 22 nt, Homo sapiens
ugagguagaggugaacuugacc

SEQ ID NO: 189443 - RNA, 22 nt, Homo sapiens
ugaguagcuaagacgauaggca

SEQ ID NO: 189444 - RNA, 22 nt, Homo sapiens
ugaguguguaugugcauacaca

SEQ ID NO: 189445 - RNA, 22 nt, Homo sapiens
ugaguucaauuguauuuuauua

SEQ ID NO: 189446 - RNA, 22 nt, Homo sapiens
ugauaacauugggggaagcuga

SEQ ID NO: 189447 - RNA, 22 nt, Homo sapiens
ugaucuuuuuaauguccauggg

SEQ ID NO: 189448 - RNA, 20 nt, Homo sapiens
ugaugcaaaucuuuaaaagu

SEQ ID NO: 189449 - RNA, 22 nt, Homo sapiens
ugaugucuugagauggagcuua

SEQ ID NO: 189450 - RNA, 22 nt, Homo sapiens
ugauuggagaugaauuucguuu

SEQ ID NO: 189451 - RNA, 19 nt, Homo sapiens
ugauuguaagcuuggugag

SEQ ID NO: 189452 - RNA, 22 nt, Homo sapiens
ugauuuguccauguggcacgug

SEQ ID NO: 189453 - RNA, 22 nt, Homo sapiens
ugcaaacuuccuugggcagcau

SEQ ID NO: 189454 - RNA, 22 nt, Homo sapiens
ugcaauauccucuacuauaggu

SEQ ID NO: 189455 - RNA, 22 nt, Homo sapiens
ugcagauucguuuugaggggua

SEQ ID NO: 189456 - RNA, 17 nt, Homo sapiens
ugcagcacacugauggg

SEQ ID NO: 189457 - RNA, 23 nt, Homo sapiens
ugcagcacacugaugggucuuga

SEQ ID NO: 189458 - RNA, 22 nt, Homo sapiens
ugcagcacugaacuucugggcu

SEQ ID NO: 189459 - RNA, 22 nt, Homo sapiens
ugcagcacuguucacaauagcc

SEQ ID NO: 189460 - RNA, 22 nt, Homo sapiens
ugcaggauguucaguaauuucc

SEQ ID NO: 189461 - RNA, 22 nt, Homo sapiens
ugcauacugggagguugggugu

SEQ ID NO: 189462 - RNA, 22 nt, Homo sapiens
ugcauagcaaaauaggauuaga

SEQ ID NO: 189463 - RNA, 22 nt, Homo sapiens
ugcauauguauacaugugccau

SEQ ID NO: 189464 - RNA, 22 nt, Homo sapiens
ugcauggaagggagggaaagag

SEQ ID NO: 189465 - RNA, 22 nt, Homo sapiens
ugcauggucauacauggcaccc

SEQ ID NO: 189466 - RNA, 22 nt, Homo sapiens
ugcauguucuuacucauacaug

SEQ ID NO: 189467 - RNA, 22 nt, Homo sapiens
ugcauuaucagauguuugcuuu

SEQ ID NO: 189468 - RNA, 22 nt, Homo sapiens
ugccaguauuuuauuaagaauu

SEQ ID NO: 189469 - RNA, 22 nt, Homo sapiens
ugccugagcccagcccuguagu

SEQ ID NO: 189470 - RNA, 22 nt, Homo sapiens
ugcugguggucccauaugauua

SEQ ID NO: 189471 - RNA, 22 nt, Homo sapiens
ugcuucauuggccaccaggaag

SEQ ID NO: 189472 - RNA, 22 nt, Homo sapiens
uggaagacacauaccugauaac

SEQ ID NO: 189473 - RNA, 22 nt, Homo sapiens
uggaagacauuuuggaccuugg

SEQ ID NO: 189474 - RNA, 22 nt, Homo sapiens
uggaagauucuagaagauucca

SEQ ID NO: 189475 - RNA, 22 nt, Homo sapiens
uggaagcauagcagcgugugug

SEQ ID NO: 189476 - RNA, 22 nt, Homo sapiens
uggaaguauagauaauugaaag

SEQ ID NO: 189477 - RNA, 22 nt, Homo sapiens
uggaagucaugcugcaagaaca

SEQ ID NO: 189478 - RNA, 22 nt, Homo sapiens
uggaagugaacaaccaaggcag

SEQ ID NO: 189479 - RNA, 21 nt, Homo sapiens
uggaaguguacaauuauaccc

SEQ ID NO: 189480 - RNA, 22 nt, Homo sapiens
uggaagugucugugcccagcuc

SEQ ID NO: 189481 - RNA, 22 nt, Homo sapiens
uggaaucaucaacgaaugaaau

SEQ ID NO: 189482 - RNA, 22 nt, Homo sapiens
uggaaugcuaagcaugugggag

SEQ ID NO: 189483 - RNA, 18 nt, Homo sapiens
uggaauguuuggguuaau

SEQ ID NO: 189484 - RNA, 21 nt, Homo sapiens
uggaauuaauggagagguguu

SEQ ID NO: 189485 - RNA, 22 nt, Homo sapiens
uggacagacaagguuauagauc

SEQ ID NO: 189486 - RNA, 22 nt, Homo sapiens
uggagaacugaugucuccaaga

SEQ ID NO: 189487 - RNA, 22 nt, Homo sapiens
uggagguagagaugggaucucc

SEQ ID NO: 189488 - RNA, 22 nt, Homo sapiens
uggaguaggccuaagaaugaca

SEQ ID NO: 189489 - RNA, 22 nt, Homo sapiens
uggaguguaauuagccaucagu

SEQ ID NO: 189490 - RNA, 16 nt, Homo sapiens
uggaguguuuguuaga

SEQ ID NO: 189491 - RNA, 22 nt, Homo sapiens
uggauagauacuauccaggacu

SEQ ID NO: 189492 - RNA, 22 nt, Homo sapiens
uggcaaaaaaacgcaauuacgu

SEQ ID NO: 189493 - RNA, 22 nt, Homo sapiens
uggcaaauguaguacccaauag

SEQ ID NO: 189494 - RNA, 22 nt, Homo sapiens
uggcaagaaccacaguuacuuu

SEQ ID NO: 189495 - RNA, 22 nt, Homo sapiens
uggcaagagaacaacaucucuc

SEQ ID NO: 189496 - RNA, 22 nt, Homo sapiens
uggcaagagcaaaauguacagu

SEQ ID NO: 189497 - RNA, 19 nt, Homo sapiens
uggcacauguauacauaug

SEQ ID NO: 189498 - RNA, 22 nt, Homo sapiens
uggcaccauccaggugucucua

SEQ ID NO: 189499 - RNA, 22 nt, Homo sapiens
uggcaguuuuugccuucaauac

SEQ ID NO: 189500 - RNA, 19 nt, Homo sapiens
uggcaugaaugugaacuaa

SEQ ID NO: 189501 - RNA, 23 nt, Homo sapiens
uggcauuuuuggcaaugccuucu

SEQ ID NO: 189502 - RNA, 23 nt, Homo sapiens
uggccaagauaaucucaguuuuc

SEQ ID NO: 189503 - RNA, 23 nt, Homo sapiens
uggccagaaacuucuuuucaucc

SEQ ID NO: 189504 - RNA, 22 nt, Homo sapiens
uggcuacugacugaugauuaua

SEQ ID NO: 189505 - RNA, 22 nt, Homo sapiens
uggcuuuuaucuacucucaacu

SEQ ID NO: 189506 - RNA, 22 nt, Homo sapiens
uggcuuuucauccugggacauu

SEQ ID NO: 189507 - RNA, 22 nt, Homo sapiens
uggcuuuuguuauuuggaagcu

SEQ ID NO: 189508 - RNA, 22 nt, Homo sapiens
ugggaaacauccagcacauacu

SEQ ID NO: 189509 - RNA, 22 nt, Homo sapiens
ugggaagcugcauuuuaacaag

SEQ ID NO: 189510 - RNA, 22 nt, Homo sapiens
ugggcaagagagcaugacccug

SEQ ID NO: 189511 - RNA, 22 nt, Homo sapiens
ugggguaggccugguuaugugc

SEQ ID NO: 189512 - RNA, 23 nt, Homo sapiens
ugggucaguuuuucugacaucau

SEQ ID NO: 189513 - RNA, 22 nt, Homo sapiens
uggugagaaaugagaugcuuuu

SEQ ID NO: 189514 - RNA, 22 nt, Homo sapiens
uggugcaaugaagugaucucaa

SEQ ID NO: 189515 - RNA, 22 nt, Homo sapiens
ugguguccugucucugcgcuug

SEQ ID NO: 189516 - RNA, 22 nt, Homo sapiens
uguaaacucaguauguuuuacu

SEQ ID NO: 189517 - RNA, 20 nt, Homo sapiens
uguaacaaucuggauguugc

SEQ ID NO: 189518 - RNA, 22 nt, Homo sapiens
uguaaugaucaaaucagaguaa

SEQ ID NO: 189519 - RNA, 22 nt, Homo sapiens
uguaugagagacauggcugcuu

SEQ ID NO: 189520 - RNA, 22 nt, Homo sapiens
ugucaaacauuaugaugcucua

SEQ ID NO: 189521 - RNA, 22 nt, Homo sapiens
ugucaaauucuggguuaaaaca

SEQ ID NO: 189522 - RNA, 22 nt, Homo sapiens
ugucaagaaaucaaggugugag

SEQ ID NO: 189523 - RNA, 22 nt, Homo sapiens
ugucaucauuugagagaagaaa

SEQ ID NO: 189524 - RNA, 22 nt, Homo sapiens
ugucaugagucuccuccaucuu

SEQ ID NO: 189525 - RNA, 22 nt, Homo sapiens
ugucauuggacuucuuucaugg

SEQ ID NO: 189526 - RNA, 21 nt, Homo sapiens
uguccagcuuuuggaauauaa

SEQ ID NO: 189527 - RNA, 22 nt, Homo sapiens
ugucccugagccuggauuccug

SEQ ID NO: 189528 - RNA, 22 nt, Homo sapiens
ugucucaguucccuucucugga

SEQ ID NO: 189529 - RNA, 22 nt, Homo sapiens
ugugacagcacgguucaacugc

SEQ ID NO: 189530 - RNA, 22 nt, Homo sapiens
ugugaugaaggcauagggaugu

SEQ ID NO: 189531 - RNA, 22 nt, Homo sapiens
ugugcaaucagcuucauuacau

SEQ ID NO: 189532 - RNA, 22 nt, Homo sapiens
ugugcacaacaugcagguuugu

SEQ ID NO: 189533 - RNA, 22 nt, Homo sapiens
ugugccacugcacucuggccug

SEQ ID NO: 189534 - RNA, 22 nt, Homo sapiens
ugugccacuguucuguaaagug

SEQ ID NO: 189535 - RNA, 22 nt, Homo sapiens
ugugcuugaauuuaguagcuua

SEQ ID NO: 189536 - RNA, 22 nt, Homo sapiens
uguggaaauuguuguauuuaau

SEQ ID NO: 189537 - RNA, 22 nt, Homo sapiens
uguggcaaagucuugugaauau

SEQ ID NO: 189538 - RNA, 22 nt, Homo sapiens
uguggcuuuuucuuggcugagg

SEQ ID NO: 189539 - RNA, 22 nt, Homo sapiens
ugugguagugcuuaccugcagu

SEQ ID NO: 189540 - RNA, 22 nt, Homo sapiens
uguuaacauggucucagucugu

SEQ ID NO: 189541 - RNA, 22 nt, Homo sapiens
uguuacagcagaauugaaagag

SEQ ID NO: 189542 - RNA, 22 nt, Homo sapiens
uguuuugguugucccuggccag

SEQ ID NO: 189543 - RNA, 22 nt, Homo sapiens
uuaaaguaauugaaauggccuu

SEQ ID NO: 189544 - RNA, 22 nt, Homo sapiens
uuaaagugaucauaaggauagu

SEQ ID NO: 189545 - RNA, 22 nt, Homo sapiens
uuaaaugcucacauaaagguag

SEQ ID NO: 189546 - RNA, 22 nt, Homo sapiens
uuaacagucacuuagcucauuu

SEQ ID NO: 189547 - RNA, 22 nt, Homo sapiens
uuaagagcauggugccagguug

SEQ ID NO: 189548 - RNA, 22 nt, Homo sapiens
uuaaggcuccuguuggcuuuua

SEQ ID NO: 189549 - RNA, 22 nt, Homo sapiens
uuaagugaauuaucuaacaugu

SEQ ID NO: 189550 - RNA, 21 nt, Homo sapiens
uuaaugcuaugcagaaaaucu

SEQ ID NO: 189551 - RNA, 22 nt, Homo sapiens
uuaauguaauugauugauugac

SEQ ID NO: 189552 - RNA, 22 nt, Homo sapiens
uuacaguagaugaggguauaau

SEQ ID NO: 189553 - RNA, 22 nt, Homo sapiens
uuacauugcuucaaauucagug

SEQ ID NO: 189554 - RNA, 22 nt, Homo sapiens
uuagaguacaggggaaucaagg

SEQ ID NO: 189555 - RNA, 22 nt, Homo sapiens
uuagcacaucuuucuauguaag

SEQ ID NO: 189556 - RNA, 22 nt, Homo sapiens
uuaggcucuuuaucaguuaacu

SEQ ID NO: 189557 - RNA, 22 nt, Homo sapiens
uuaggugcauggaaguguuuuc

SEQ ID NO: 189558 - RNA, 22 nt, Homo sapiens
uuagucaaguguacugugaaug

SEQ ID NO: 189559 - RNA, 22 nt, Homo sapiens
uuagugcaaacucuucaaugcu

SEQ ID NO: 189560 - RNA, 22 nt, Homo sapiens
uuauauguuacucccucuagca

SEQ ID NO: 189561 - RNA, 22 nt, Homo sapiens
uuauauguuucuguuuggaggc

SEQ ID NO: 189562 - RNA, 22 nt, Homo sapiens
uuauauguuucuuagggacaga

SEQ ID NO: 189563 - RNA, 22 nt, Homo sapiens
uuauauguuuguacuuaggccu

SEQ ID NO: 189564 - RNA, 22 nt, Homo sapiens
uuauguaaaucaaucuggaauc

SEQ ID NO: 189565 - RNA, 22 nt, Homo sapiens
uuauuagguuagugcaaaaguu

SEQ ID NO: 189566 - RNA, 17 nt, Homo sapiens
uuauugcuauaagcuga

SEQ ID NO: 189567 - RNA, 22 nt, Homo sapiens
uucaaauguucuuucaccaccc

SEQ ID NO: 189568 - RNA, 22 nt, Homo sapiens
uucaaguguucaggagcuacag

SEQ ID NO: 189569 - RNA, 20 nt, Homo sapiens
uucacaggcagcuucuuucu

SEQ ID NO: 189570 - RNA, 22 nt, Homo sapiens
aaaccacagugugcugcugggg

SEQ ID NO: 189571 - RNA, 20 nt, Homo sapiens
aaacucugucuucuuuauca

SEQ ID NO: 189572 - RNA, 21 nt, Homo sapiens
aaacuggcccaauuguuccau

SEQ ID NO: 189573 - RNA, 23 nt, Homo sapiens
aaagacuagucaggugcaguggu

SEQ ID NO: 189574 - RNA, 22 nt, Homo sapiens
aaagggcuguuucuugacuugg

SEQ ID NO: 189575 - RNA, 22 nt, Homo sapiens
aaagguaguacuucuagaaggg

SEQ ID NO: 189576 - RNA, 22 nt, Homo sapiens
aaagucacuggagaaggaauau

SEQ ID NO: 189577 - RNA, 17 nt, Homo sapiens
aaaguccuuugcuaucu

SEQ ID NO: 189578 - RNA, 22 nt, Homo sapiens
aaagugaauguaucccguaagu

SEQ ID NO: 189579 - RNA, 22 nt, Homo sapiens
aaagugacuuagugccccauuu

SEQ ID NO: 189580 - RNA, 15 nt, Homo sapiens
aaauaugucaguucu

SEQ ID NO: 189581 - RNA, 21 nt, Homo sapiens
aaaugcacauuacugcuggug

SEQ ID NO: 189582 - RNA, 22 nt, Homo sapiens
aaaugcaguugguggggauaug

SEQ ID NO: 189583 - RNA, 22 nt, Homo sapiens
aaaugcugcuuuggccucuucu

SEQ ID NO: 189584 - RNA, 22 nt, Homo sapiens
aaaugcuguuccaggaccuauc

SEQ ID NO: 189585 - RNA, 22 nt, Homo sapiens
aaauggcuuugaggguaggaca

SEQ ID NO: 189586 - RNA, 22 nt, Homo sapiens
aaauggcuuuuugggcaaggug

SEQ ID NO: 189587 - RNA, 22 nt, Homo sapiens
aacacuggcugcucgaguucuc

SEQ ID NO: 189588 - RNA, 22 nt, Homo sapiens
aacacuguuuccagucaugauc

SEQ ID NO: 189589 - RNA, 22 nt, Homo sapiens
aacugcucuuaccagauggguc

SEQ ID NO: 189590 - RNA, 21 nt, Homo sapiens
aacuggugugagaugguaugu

SEQ ID NO: 189591 - RNA, 22 nt, Homo sapiens
aacuugcacuugauugagagcu

SEQ ID NO: 189592 - RNA, 22 nt, Homo sapiens
aagcaggugugggaggaaaugg

SEQ ID NO: 189593 - RNA, 22 nt, Homo sapiens
aagcaucauuuggaauuugaga

SEQ ID NO: 189594 - RNA, 22 nt, Homo sapiens
aagcuacuuuggugguuccuua

SEQ ID NO: 189595 - RNA, 20 nt, Homo sapiens
aagcugaguguuuuuuuaau

SEQ ID NO: 189596 - RNA, 22 nt, Homo sapiens
aagcugcauuuucuagaugcuu

SEQ ID NO: 189597 - RNA, 22 nt, Homo sapiens
aagcuggagugcaguggugcaa

SEQ ID NO: 189598 - RNA, 22 nt, Homo sapiens
aaggagcagagagcccuguuuc

SEQ ID NO: 189599 - RNA, 22 nt, Homo sapiens
aaggaguaucuguuuucucacc

SEQ ID NO: 189600 - RNA, 22 nt, Homo sapiens
aaggaguauugaaugaccaagu

SEQ ID NO: 189601 - RNA, 22 nt, Homo sapiens
aaggagugugauucuucaguuu

SEQ ID NO: 189602 - RNA, 22 nt, Homo sapiens
aaggaguguggugaucuugggc

SEQ ID NO: 189603 - RNA, 22 nt, Homo sapiens
aagggaaugcuuccaguuugug

SEQ ID NO: 189604 - RNA, 22 nt, Homo sapiens
aagggaauguuguggcugguuu

SEQ ID NO: 189605 - RNA, 22 nt, Homo sapiens
aagucaaggagagaggcgucag

SEQ ID NO: 189606 - RNA, 22 nt, Homo sapiens
aagucauggagaagguggaggu

SEQ ID NO: 189607 - RNA, 23 nt, Homo sapiens
aaguucaugcucaucuguuacac

SEQ ID NO: 189608 - RNA, 22 nt, Homo sapiens
aauaaaguaggaggugaggaaa

SEQ ID NO: 189609 - RNA, 22 nt, Homo sapiens
aauauagcuauguacaugucca

SEQ ID NO: 189610 - RNA, 23 nt, Homo sapiens
aauaucacaguggguguacaccc

SEQ ID NO: 189611 - RNA, 22 nt, Homo sapiens
aaucacaguguucuugugaggg

SEQ ID NO: 189612 - RNA, 22 nt, Homo sapiens
aaucacaguuaguaagggagaa

SEQ ID NO: 189613 - RNA, 21 nt, Homo sapiens
aaucacaguuguucugccuuc

SEQ ID NO: 189614 - RNA, 16 nt, Homo sapiens
aauccauuggcccugc

SEQ ID NO: 189615 - RNA, 22 nt, Homo sapiens
aauccauuugccgucuauccau

SEQ ID NO: 189616 - RNA, 22 nt, Homo sapiens
aaucucagagauaucugugucc

SEQ ID NO: 189617 - RNA, 22 nt, Homo sapiens
aaugaaguuagauguugagaag

SEQ ID NO: 189618 - RNA, 22 nt, Homo sapiens
aaugacucugccuaaauuucac

SEQ ID NO: 189619 - RNA, 22 nt, Homo sapiens
aaugcacauauauuuccuuauu

SEQ ID NO: 189620 - RNA, 22 nt, Homo sapiens
aauuaguugaaagucugcuuuu

SEQ ID NO: 189621 - RNA, 22 nt, Homo sapiens
acaauguauauuuuacuguagg

SEQ ID NO: 189622 - RNA, 22 nt, Homo sapiens
acacuggaguuaaaggugauuu

SEQ ID NO: 189623 - RNA, 22 nt, Homo sapiens
acacuggguaacauaucuguua

SEQ ID NO: 189624 - RNA, 20 nt, Homo sapiens
acacugugcuaaggauuuuc

SEQ ID NO: 189625 - RNA, 22 nt, Homo sapiens
acacuuucuagacaagggaaua

SEQ ID NO: 189626 - RNA, 22 nt, Homo sapiens
acaguacuuuuggauuugugaa

SEQ ID NO: 189627 - RNA, 22 nt, Homo sapiens
acaguaugcuuuaaacuuuguu

SEQ ID NO: 189628 - RNA, 18 nt, Homo sapiens
acagugcugucacugcuu

SEQ ID NO: 189629 - RNA, 22 nt, Homo sapiens
acauaugaguacaugugccaug

SEQ ID NO: 189630 - RNA, 22 nt, Homo sapiens
acaucauugggggcuacaggug

SEQ ID NO: 189631 - RNA, 22 nt, Homo sapiens
acaucccaugccuggguacucc

SEQ ID NO: 189632 - RNA, 22 nt, Homo sapiens
auaugcacaguggaguacuauu

SEQ ID NO: 189633 - RNA, 20 nt, Homo sapiens
auaugcagacacauacauac

SEQ ID NO: 189634 - RNA, 22 nt, Homo sapiens
auaugcauacauguaugcagga

SEQ ID NO: 189635 - RNA, 22 nt, Homo sapiens
auauggcuaugugagcauacca

SEQ ID NO: 189636 - RNA, 22 nt, Homo sapiens
auaugguuuuuggaagcauauc

SEQ ID NO: 189637 - RNA, 22 nt, Homo sapiens
auaugucuauuauuagggcagg

SEQ ID NO: 189638 - RNA, 22 nt, Homo sapiens
auaugugacuucaugcaaggcu

SEQ ID NO: 189639 - RNA, 21 nt, Homo sapiens
auaugugcuguggaagucagc

SEQ ID NO: 189640 - RNA, 22 nt, Homo sapiens
auauucacagguaucagagauu

SEQ ID NO: 189641 - RNA, 18 nt, Homo sapiens
auauugcauuggauggau

SEQ ID NO: 189642 - RNA, 20 nt, Homo sapiens
aucaaagacuuagaggggga

SEQ ID NO: 189643 - RNA, 22 nt, Homo sapiens
aucaaauugucauuuuaaggau

SEQ ID NO: 189644 - RNA, 22 nt, Homo sapiens
aucacuuucuauuucugugcca

SEQ ID NO: 189645 - RNA, 22 nt, Homo sapiens
aucacuuugcucuccagugugg

SEQ ID NO: 189646 - RNA, 22 nt, Homo sapiens
aucagaaucucuagaggacugu

SEQ ID NO: 189647 - RNA, 23 nt, Homo sapiens
aucagauaguuguagguaugugg

SEQ ID NO: 189648 - RNA, 22 nt, Homo sapiens
aucaggaaccuuuuuggugugu

SEQ ID NO: 189649 - RNA, 22 nt, Homo sapiens
aucaggcacacauuggaguuug

SEQ ID NO: 189650 - RNA, 22 nt, Homo sapiens
aucauauccuagauauaacuuc

SEQ ID NO: 189651 - RNA, 22 nt, Homo sapiens
aucauguuuauguguaggauau

SEQ ID NO: 189652 - RNA, 22 nt, Homo sapiens
auccacagugucaauguuguga

SEQ ID NO: 189653 - RNA, 22 nt, Homo sapiens
auccagaugggcuuaauguaau

SEQ ID NO: 189654 - RNA, 22 nt, Homo sapiens
auccauguggauaaauguguau

SEQ ID NO: 189655 - RNA, 22 nt, Homo sapiens
aucccaguaaaaauggcuucua

SEQ ID NO: 189656 - RNA, 22 nt, Homo sapiens
aucccaguucagccucugacac

SEQ ID NO: 189657 - RNA, 22 nt, Homo sapiens
auccccugcacggggugucauu

SEQ ID NO: 189658 - RNA, 22 nt, Homo sapiens
aucccuguaguaauauucuagc

SEQ ID NO: 189659 - RNA, 22 nt, Homo sapiens
auccuacaguccauucuuugug

SEQ ID NO: 189660 - RNA, 22 nt, Homo sapiens
aucugcacaucuguguuuuugu

SEQ ID NO: 189661 - RNA, 22 nt, Homo sapiens
augaaacuggagcgccuggagg

SEQ ID NO: 189662 - RNA, 22 nt, Homo sapiens
augaacagagccuugagaaccu

SEQ ID NO: 189663 - RNA, 18 nt, Homo sapiens
augaagucaucacuuuua

SEQ ID NO: 189664 - RNA, 20 nt, Homo sapiens
augaauguccuugauggcau

SEQ ID NO: 189665 - RNA, 19 nt, Homo sapiens
augacauuuggggguggac

SEQ ID NO: 189666 - RNA, 22 nt, Homo sapiens
augacucagaucuguuccuggu

SEQ ID NO: 189667 - RNA, 22 nt, Homo sapiens
augacuggaacggcacuuuaca

SEQ ID NO: 189668 - RNA, 22 nt, Homo sapiens
augacuuuucugaaaaccacca

SEQ ID NO: 189669 - RNA, 22 nt, Homo sapiens
augagggaagcucacgugucca

SEQ ID NO: 189670 - RNA, 22 nt, Homo sapiens
augagggagggcaccugaccuu

SEQ ID NO: 189671 - RNA, 18 nt, Homo sapiens
augagucauuguggaaau

SEQ ID NO: 189672 - RNA, 22 nt, Homo sapiens
augauuguucucacucaagaga

SEQ ID NO: 189673 - RNA, 22 nt, Homo sapiens
augcaaacaucauagaguguac

SEQ ID NO: 189674 - RNA, 22 nt, Homo sapiens
augcaauucuagauugauagua

SEQ ID NO: 189675 - RNA, 22 nt, Homo sapiens
augcacaguccagcccaugugg

SEQ ID NO: 189676 - RNA, 22 nt, Homo sapiens
augcacauauguacugcccuau

SEQ ID NO: 189677 - RNA, 22 nt, Homo sapiens
augcacauggcuaacuuuuuuc

SEQ ID NO: 189678 - RNA, 22 nt, Homo sapiens
augcacuguuuucuugaugaga

SEQ ID NO: 189679 - RNA, 22 nt, Homo sapiens
augcagagaaaucuaaaauaug

SEQ ID NO: 189680 - RNA, 22 nt, Homo sapiens
augcagagucccagccccuagc

SEQ ID NO: 189681 - RNA, 22 nt, Homo sapiens
augcagaucacauuuuucuguc

SEQ ID NO: 189682 - RNA, 18 nt, Homo sapiens
augcauauuuuaaguugu

SEQ ID NO: 189683 - RNA, 22 nt, Homo sapiens
augcauggagucuuucacaagu

SEQ ID NO: 189684 - RNA, 22 nt, Homo sapiens
augccacugcacucuagccugg

SEQ ID NO: 189685 - RNA, 22 nt, Homo sapiens
augccacugcacuucagccugc

SEQ ID NO: 189686 - RNA, 22 nt, Homo sapiens
augccacugcgcucuagccugg

SEQ ID NO: 189687 - RNA, 22 nt, Homo sapiens
augccacuguacucuagccuag

SEQ ID NO: 189688 - RNA, 22 nt, Homo sapiens
augccacuguuuaugucacuua

SEQ ID NO: 189689 - RNA, 21 nt, Homo sapiens
auggaaagacugccucuucaa

SEQ ID NO: 189690 - RNA, 22 nt, Homo sapiens
auggaacauuauagauguaaaa

SEQ ID NO: 189691 - RNA, 19 nt, Homo sapiens
auggaacugcuggagccac

SEQ ID NO: 189692 - RNA, 22 nt, Homo sapiens
auggaagcugauuagauaguac

SEQ ID NO: 189693 - RNA, 22 nt, Homo sapiens
auggaaugccauuuauaaugga

SEQ ID NO: 189694 - RNA, 22 nt, Homo sapiens
auggaauggcacuuugaagauu

SEQ ID NO: 189695 - RNA, 22 nt, Homo sapiens
auggaaugguugggucauaagg

SEQ ID NO: 189696 - RNA, 22 nt, Homo sapiens
auggaauguauagucauguagg

SEQ ID NO: 189697 - RNA, 22 nt, Homo sapiens
auggacagaaaaaaauagaugu

SEQ ID NO: 189698 - RNA, 22 nt, Homo sapiens
auggagcuugacaguuguagag

SEQ ID NO: 189699 - RNA, 22 nt, Homo sapiens
auggagugagaauggagguucc

SEQ ID NO: 189700 - RNA, 19 nt, Homo sapiens
auggauacauuuucugcua

SEQ ID NO: 189701 - RNA, 22 nt, Homo sapiens
auggcagcccucuuuauccaug

SEQ ID NO: 189702 - RNA, 22 nt, Homo sapiens
auggcccugggaaaggaggcau

SEQ ID NO: 189703 - RNA, 22 nt, Homo sapiens
auggcuuuuccugucuugcaug

SEQ ID NO: 189704 - RNA, 22 nt, Homo sapiens
auggcuuuuuucuugggcacuc

SEQ ID NO: 189705 - RNA, 22 nt, Homo sapiens
augggaaaaucagaaggccugg

SEQ ID NO: 189706 - RNA, 22 nt, Homo sapiens
augggagugugguuagagaccu

SEQ ID NO: 189707 - RNA, 22 nt, Homo sapiens
augggguaggcuugcuguagua

SEQ ID NO: 189708 - RNA, 18 nt, Homo sapiens
auggguguuggaaaauga

SEQ ID NO: 189709 - RNA, 22 nt, Homo sapiens
augguacucucuugucugcaaa

SEQ ID NO: 189710 - RNA, 22 nt, Homo sapiens
auggugugugaauuaaauguua

SEQ ID NO: 189711 - RNA, 22 nt, Homo sapiens
auguaacacagugcggcugggc

SEQ ID NO: 189712 - RNA, 22 nt, Homo sapiens
auguaguagcagaaaauauuuu

SEQ ID NO: 189713 - RNA, 22 nt, Homo sapiens
augucaaagaggaaaacuggau

SEQ ID NO: 189714 - RNA, 22 nt, Homo sapiens
auguccauggaaucuguagcaa

SEQ ID NO: 189715 - RNA, 22 nt, Homo sapiens
augucuagagcaagagaugcug

SEQ ID NO: 189716 - RNA, 22 nt, Homo sapiens
augucuagagugauacugaagc

SEQ ID NO: 189717 - RNA, 22 nt, Homo sapiens
augugcuuauagguguauguuu

SEQ ID NO: 189718 - RNA, 22 nt, Homo sapiens
auguuaacaucuuaguuuucau

SEQ ID NO: 189719 - RNA, 20 nt, Homo sapiens
auguucuggaggacagaagc

SEQ ID NO: 189720 - RNA, 22 nt, Homo sapiens
auguugcuugaaggcauuuugu

SEQ ID NO: 189721 - RNA, 22 nt, Homo sapiens
auuaaguugugccugaaaacuu

SEQ ID NO: 189722 - RNA, 22 nt, Homo sapiens
auuagaugguuauaggugugag

SEQ ID NO: 189723 - RNA, 22 nt, Homo sapiens
auucaagggauuucaggaggcu

SEQ ID NO: 189724 - RNA, 23 nt, Homo sapiens
auucaaguagugagagugguuau

SEQ ID NO: 189725 - RNA, 22 nt, Homo sapiens
auuccacuuccacuaguuucuc

SEQ ID NO: 189726 - RNA, 22 nt, Homo sapiens
auuccauaguacagugaugagu

SEQ ID NO: 189727 - RNA, 23 nt, Homo sapiens
auugaacacuuucauaugugagg

SEQ ID NO: 189728 - RNA, 22 nt, Homo sapiens
auugcacuccagccuugugaca

SEQ ID NO: 189729 - RNA, 22 nt, Homo sapiens
uucaucagcuguagaugucaug

SEQ ID NO: 189730 - RNA, 22 nt, Homo sapiens
uucaucaggaauauugaccugu

SEQ ID NO: 189731 - RNA, 20 nt, Homo sapiens
uucaucaggauauuggucua

SEQ ID NO: 189732 - RNA, 22 nt, Homo sapiens
uucaucagggagaaauaauuuc

SEQ ID NO: 189733 - RNA, 22 nt, Homo sapiens
uucaugcaucuguagugguuaa

SEQ ID NO: 189734 - RNA, 22 nt, Homo sapiens
uucauggagccauccuuugauc

SEQ ID NO: 189735 - RNA, 22 nt, Homo sapiens
uucauggaugcauuugaggggu

SEQ ID NO: 189736 - RNA, 22 nt, Homo sapiens
uucauggauggaaaugauuuug

SEQ ID NO: 189737 - RNA, 22 nt, Homo sapiens
uucauggugguacaaaagcaau

SEQ ID NO: 189738 - RNA, 22 nt, Homo sapiens
uuccaggugggcgugggccugg

SEQ ID NO: 189739 - RNA, 22 nt, Homo sapiens
uucccguacugguguugccuau

SEQ ID NO: 189740 - RNA, 22 nt, Homo sapiens
uucccuguaucuucugccaugu

SEQ ID NO: 189741 - RNA, 22 nt, Homo sapiens
uucccugugggaguaggaaagu

SEQ ID NO: 189742 - RNA, 22 nt, Homo sapiens
uuccugagagggcugggugcag

SEQ ID NO: 189743 - RNA, 22 nt, Homo sapiens
uuccugaggccuccccagaagc

SEQ ID NO: 189744 - RNA, 22 nt, Homo sapiens
uuccugugacccccaagcccac

SEQ ID NO: 189745 - RNA, 22 nt, Homo sapiens
uuccugugacuguguggcaccc

SEQ ID NO: 189746 - RNA, 22 nt, Homo sapiens
uuccuugaaacagucaagagaa

SEQ ID NO: 189747 - RNA, 22 nt, Homo sapiens
uucuacaugggucgucggugag

SEQ ID NO: 189748 - RNA, 22 nt, Homo sapiens
uucuacuucauuaggaggauug

SEQ ID NO: 189749 - RNA, 22 nt, Homo sapiens
uucuccugguggacccuaaacg

SEQ ID NO: 189750 - RNA, 22 nt, Homo sapiens
uucuggcucaggucaacacuuc

SEQ ID NO: 189751 - RNA, 22 nt, Homo sapiens
uucuggcucgauucucugaccg

SEQ ID NO: 189752 - RNA, 22 nt, Homo sapiens
uucuucaguuacaacaaggggg

SEQ ID NO: 189753 - RNA, 22 nt, Homo sapiens
uucuuugcaugaucucaaaguc

SEQ ID NO: 189754 - RNA, 22 nt, Homo sapiens
uugaaagaaaggagacugaguu

SEQ ID NO: 189755 - RNA, 22 nt, Homo sapiens
uugaaagacaucaccuacugcu

SEQ ID NO: 189756 - RNA, 22 nt, Homo sapiens
uugaaagcuaucagagauucca

SEQ ID NO: 189757 - RNA, 22 nt, Homo sapiens
uugaaauguuuagaaguuugga

SEQ ID NO: 189758 - RNA, 22 nt, Homo sapiens
uugaauagaagguuuuuuguuc

SEQ ID NO: 189759 - RNA, 22 nt, Homo sapiens
uugaauagugacuuugauucug

SEQ ID NO: 189760 - RNA, 22 nt, Homo sapiens
uugacauguaaguacucuauag

SEQ ID NO: 189761 - RNA, 22 nt, Homo sapiens
uugacuuuuauucacucugcua

SEQ ID NO: 189762 - RNA, 22 nt, Homo sapiens
uugagcuuuuuacuuguccaau

SEQ ID NO: 189763 - RNA, 22 nt, Homo sapiens
uugaggacugcuaagcauuuga

SEQ ID NO: 189764 - RNA, 23 nt, Homo sapiens
uugaggcauguaccaucaauauc

SEQ ID NO: 189765 - RNA, 16 nt, Homo sapiens
uugaggcaugucucag

SEQ ID NO: 189766 - RNA, 22 nt, Homo sapiens
uugaggcuuuugaccucaugug

SEQ ID NO: 189767 - RNA, 22 nt, Homo sapiens
uugagggaagccagaggucugc

SEQ ID NO: 189768 - RNA, 22 nt, Homo sapiens
uugagggagccuguuagucccg

SEQ ID NO: 189769 - RNA, 22 nt, Homo sapiens
uugaggguggcauauauugauu

SEQ ID NO: 189770 - RNA, 22 nt, Homo sapiens
uugaggugaauuugcaggaugc

SEQ ID NO: 189771 - RNA, 20 nt, Homo sapiens
uugaggugugaggggcagag

SEQ ID NO: 189772 - RNA, 22 nt, Homo sapiens
uugaucaaaucugagugagaau

SEQ ID NO: 189773 - RNA, 20 nt, Homo sapiens
uugauucccucuaaacucgc

SEQ ID NO: 189774 - RNA, 22 nt, Homo sapiens
uugcaaagaccucuucacuucc

SEQ ID NO: 189775 - RNA, 22 nt, Homo sapiens
uugcaaaguuugccuccuguag

SEQ ID NO: 189776 - RNA, 22 nt, Homo sapiens
uugcaacauguauucuggugau

SEQ ID NO: 189777 - RNA, 22 nt, Homo sapiens
uugcaagaaaucagagccuucc

SEQ ID NO: 189778 - RNA, 22 nt, Homo sapiens
uugcaagaaaugcagauucuca

SEQ ID NO: 189779 - RNA, 22 nt, Homo sapiens
uugcacauggcaggugcucaau

SEQ ID NO: 189780 - RNA, 22 nt, Homo sapiens
uugcacauggcuggggaggccu

SEQ ID NO: 189781 - RNA, 22 nt, Homo sapiens
uugcacauguugaaccagcaaa

SEQ ID NO: 189782 - RNA, 22 nt, Homo sapiens
uugcacauugauuuuguaucuu

SEQ ID NO: 189783 - RNA, 22 nt, Homo sapiens
uugcacuccggccuggguaaca

SEQ ID NO: 189784 - RNA, 22 nt, Homo sapiens
uugcagcauucugguuccuggu

SEQ ID NO: 189785 - RNA, 19 nt, Homo sapiens
uugcauauguugaaccagc

SEQ ID NO: 189786 - RNA, 22 nt, Homo sapiens
uugcaugggagcugggugaagc

SEQ ID NO: 189787 - RNA, 22 nt, Homo sapiens
uugcauguacguacagagagag

SEQ ID NO: 189788 - RNA, 22 nt, Homo sapiens
uugccauggaguagaauugaag

SEQ ID NO: 189789 - RNA, 22 nt, Homo sapiens
uugcuuuguuacugcaguuucc

SEQ ID NO: 189790 - RNA, 22 nt, Homo sapiens
uuggaagacaaugcugauucuc

SEQ ID NO: 189791 - RNA, 22 nt, Homo sapiens
uuggaagacauucugucugcua

SEQ ID NO: 189792 - RNA, 22 nt, Homo sapiens
uuggaagagaagggagauaaac

SEQ ID NO: 189793 - RNA, 22 nt, Homo sapiens
uuggaaguguguauguauagcu

SEQ ID NO: 189794 - RNA, 22 nt, Homo sapiens
uuggaauauuauuauugggcag

SEQ ID NO: 189795 - RNA, 23 nt, Homo sapiens
uuggaaugagaccuaagaguuuu

SEQ ID NO: 189796 - RNA, 22 nt, Homo sapiens
uuggacuucuaacugacaugga

SEQ ID NO: 189797 - RNA, 22 nt, Homo sapiens
uuggagugugagagcagccugg

SEQ ID NO: 189798 - RNA, 22 nt, Homo sapiens
uuggauuuuaacaaacuaggug

SEQ ID NO: 189799 - RNA, 22 nt, Homo sapiens
uuggauuuugguggcaacucau

SEQ ID NO: 189800 - RNA, 22 nt, Homo sapiens
uuggcaaauagguuuuauugca

SEQ ID NO: 189801 - RNA, 22 nt, Homo sapiens
uuggccagugucuuuuuuuccu

SEQ ID NO: 189802 - RNA, 21 nt, Homo sapiens
uuggccuggaggccugaaugu

SEQ ID NO: 189803 - RNA, 22 nt, Homo sapiens
uuggcuacagauuaugaauuuc

SEQ ID NO: 189804 - RNA, 21 nt, Homo sapiens
uuggcuacugcuucagaggga

SEQ ID NO: 189805 - RNA, 22 nt, Homo sapiens
uugggauggaaauuuguacccc

SEQ ID NO: 189806 - RNA, 22 nt, Homo sapiens
uugguacuaaaaaguagggugu

SEQ ID NO: 189807 - RNA, 22 nt, Homo sapiens
uugguuaucaucauuucagcaa

SEQ ID NO: 189808 - RNA, 22 nt, Homo sapiens
uuguaaagaucauaugcuguuc

SEQ ID NO: 189809 - RNA, 22 nt, Homo sapiens
uuguaguagcauuauuuauaau

SEQ ID NO: 189810 - RNA, 22 nt, Homo sapiens
uuguauguaaccauuuggcaaa

SEQ ID NO: 189811 - RNA, 21 nt, Homo sapiens
uugucuagagaaauauaucuc

SEQ ID NO: 189812 - RNA, 22 nt, Homo sapiens
uugugcuuaaugaguguaaggu

SEQ ID NO: 189813 - RNA, 22 nt, Homo sapiens
uugugguuuucagcuuauauau

SEQ ID NO: 189814 - RNA, 22 nt, Homo sapiens
uuguguuugaugcugacacgca

SEQ ID NO: 189815 - RNA, 22 nt, Homo sapiens
uuuaaaguuagaaggaaagggc

SEQ ID NO: 189816 - RNA, 22 nt, Homo sapiens
uuuaacauuggaugagaucguc

SEQ ID NO: 189817 - RNA, 22 nt, Homo sapiens
uuuaagccaggugcaguggcuc

SEQ ID NO: 189818 - RNA, 22 nt, Homo sapiens
uuuaauacugcaucuuuacucu

SEQ ID NO: 189819 - RNA, 22 nt, Homo sapiens
uuuaauguuacaguauugguau

SEQ ID NO: 189820 - RNA, 18 nt, Homo sapiens
uuuacaguagaaggacuu

SEQ ID NO: 189821 - RNA, 19 nt, Homo sapiens
uuuagaucuuuuaugcagc

SEQ ID NO: 189822 - RNA, 22 nt, Homo sapiens
uuuagcaaagcaauuuacacca

SEQ ID NO: 189823 - RNA, 22 nt, Homo sapiens
uuuagcagcaaagagccaugcu

SEQ ID NO: 189824 - RNA, 21 nt, Homo sapiens
uuucacugugaguuuuucugu

SEQ ID NO: 189825 - RNA, 22 nt, Homo sapiens
uuucauccggcuguguauuaug

SEQ ID NO: 189826 - RNA, 22 nt, Homo sapiens
cugugaucuuuuuucauguggu

SEQ ID NO: 189827 - RNA, 23 nt, Homo sapiens
cuguggugaggcccuagaaucug

SEQ ID NO: 189828 - RNA, 22 nt, Homo sapiens
cuguugguuaaauuccaugcag

SEQ ID NO: 189829 - RNA, 22 nt, Homo sapiens
cuuacagucuaucagccacaac

SEQ ID NO: 189830 - RNA, 17 nt, Homo sapiens
cuucaaauaauuucccc

SEQ ID NO: 189831 - RNA, 22 nt, Homo sapiens
cuuccagcuggguucagucagu

SEQ ID NO: 189832 - RNA, 19 nt, Homo sapiens
cuugccccauucauccucu

SEQ ID NO: 189833 - RNA, 22 nt, Homo sapiens
cuuggcauugccccuggaauuu

SEQ ID NO: 189834 - RNA, 22 nt, Homo sapiens
cuuggcuagucaaaccuccccg

SEQ ID NO: 189835 - RNA, 20 nt, Homo sapiens
cuuggcuuucuugguguuaa

SEQ ID NO: 189836 - RNA, 22 nt, Homo sapiens
cuugggauauguguuacucugu

SEQ ID NO: 189837 - RNA, 19 nt, Homo sapiens
cuugugccugaagcuuggg

SEQ ID NO: 189838 - RNA, 21 nt, Homo sapiens
cuuuaugcuguguuagaaaag

SEQ ID NO: 189839 - RNA, 22 nt, Homo sapiens
cuuuccauuguuggagcauaaa

SEQ ID NO: 189840 - RNA, 23 nt, Homo sapiens
cuuugguaggaaauuugaauuau

SEQ ID NO: 189841 - RNA, 22 nt, Homo sapiens
cuuuggucaauugcugcgggga

SEQ ID NO: 189842 - RNA, 22 nt, Homo sapiens
cuuugguuaauaggauauggca

SEQ ID NO: 189843 - RNA, 20 nt, Homo sapiens
cuuuguccuccugcugugcu

SEQ ID NO: 189844 - RNA, 22 nt, Homo sapiens
cuuuuacacugcuggugggaau

SEQ ID NO: 189845 - RNA, 20 nt, Homo sapiens
ggaauagucuacacucugac

SEQ ID NO: 189846 - RNA, 22 nt, Homo sapiens
ggaaucugaaccaugggaaugg

SEQ ID NO: 189847 - RNA, 22 nt, Homo sapiens
ggaauuaaggcaauugaaagcu

SEQ ID NO: 189848 - RNA, 21 nt, Homo sapiens
ggaauuuagggaaugauuuag

SEQ ID NO: 189849 - RNA, 22 nt, Homo sapiens
ggagguaauaaguuccagugua

SEQ ID NO: 189850 - RNA, 22 nt, Homo sapiens
ggagugucccaaucucagcuca

SEQ ID NO: 189851 - RNA, 22 nt, Homo sapiens
ggagugugauucaguauaauau

SEQ ID NO: 189852 - RNA, 17 nt, Homo sapiens
ggcaagaaguggaacuc

SEQ ID NO: 189853 - RNA, 21 nt, Homo sapiens
ggcaagagaauacaacauaaa

SEQ ID NO: 189854 - RNA, 22 nt, Homo sapiens
ggcaagcucaggccucaggugu

SEQ ID NO: 189855 - RNA, 22 nt, Homo sapiens
ggcacaaugucagcucacugca

SEQ ID NO: 189856 - RNA, 22 nt, Homo sapiens
ggcaguggaagugccaguuucu

SEQ ID NO: 189857 - RNA, 22 nt, Homo sapiens
ggcaguguauuacuuaggguuc

SEQ ID NO: 189858 - RNA, 22 nt, Homo sapiens
ggcaguuuguucuugcuccuuu

SEQ ID NO: 189859 - RNA, 22 nt, Homo sapiens
ggcauugugauccaccagccuu

SEQ ID NO: 189860 - RNA, 22 nt, Homo sapiens
ggcccaguugcgggugguaccg

SEQ ID NO: 189861 - RNA, 22 nt, Homo sapiens
ggccuguaaacuagagacccug

SEQ ID NO: 189862 - RNA, 21 nt, Homo sapiens
ggcucuguggucucagguuuc

SEQ ID NO: 189863 - RNA, 22 nt, Homo sapiens
ggcugguuuucaguuacugagu

SEQ ID NO: 189864 - RNA, 22 nt, Homo sapiens
gggaagugugguuucuuuacag

SEQ ID NO: 189865 - RNA, 22 nt, Homo sapiens
gggagcaaaaaugaugcccaag

SEQ ID NO: 189866 - RNA, 19 nt, Homo sapiens
gggaggaugcgucuucagg

SEQ ID NO: 189867 - RNA, 22 nt, Homo sapiens
ggggaauguuaaagaauuugca

SEQ ID NO: 189868 - RNA, 22 nt, Homo sapiens
ggggcaaaaugccacgagucuc

SEQ ID NO: 189869 - RNA, 22 nt, Homo sapiens
gguaaacauacugcugucuucu

SEQ ID NO: 189870 - RNA, 22 nt, Homo sapiens
gguauuuaaaguaccugucugc

SEQ ID NO: 189871 - RNA, 22 nt, Homo sapiens
ggugaauuguaccccauaggau

SEQ ID NO: 189872 - RNA, 22 nt, Homo sapiens
ggugucaguuggccccuacugg

SEQ ID NO: 189873 - RNA, 22 nt, Homo sapiens
guaacagucucaacaguggucu

SEQ ID NO: 189874 - RNA, 22 nt, Homo sapiens
guaagugguagagcugggcuau

SEQ ID NO: 189875 - RNA, 22 nt, Homo sapiens
guaaucucagcuacuugggagg

SEQ ID NO: 189876 - RNA, 22 nt, Homo sapiens
guaaucucagcuacuugggagu

SEQ ID NO: 189877 - RNA, 22 nt, Homo sapiens
guaaucucagcuucuugggagg

SEQ ID NO: 189878 - RNA, 22 nt, Homo sapiens
guacaugcauacaugcacaucu

SEQ ID NO: 189879 - RNA, 22 nt, Homo sapiens
guacaugcauaguuuauuucug

SEQ ID NO: 189880 - RNA, 22 nt, Homo sapiens
guagcagcuacuaaguugcugu

SEQ ID NO: 189881 - RNA, 22 nt, Homo sapiens
guaugguugaagugacaagcca

SEQ ID NO: 189882 - RNA, 22 nt, Homo sapiens
gucagucugucccugccuggcg

SEQ ID NO: 189883 - RNA, 22 nt, Homo sapiens
gucaguggauacugucucuguc

SEQ ID NO: 189884 - RNA, 22 nt, Homo sapiens
gucauggaggaugaauggccaa

SEQ ID NO: 189885 - RNA, 22 nt, Homo sapiens
guccaagacuaggaguuggcag

SEQ ID NO: 189886 - RNA, 22 nt, Homo sapiens
guccagagaagucauuacuuca

SEQ ID NO: 189887 - RNA, 22 nt, Homo sapiens
guccaguuguuuucugagguug

SEQ ID NO: 189888 - RNA, 22 nt, Homo sapiens
gucucagugcgaaucucaaaga

SEQ ID NO: 189889 - RNA, 22 nt, Homo sapiens
gucuccgagccguguggagccg

SEQ ID NO: 189890 - RNA, 22 nt, Homo sapiens
gucuggagacuugggucaucaa

SEQ ID NO: 189891 - RNA, 22 nt, Homo sapiens
uugaggaagugguuccccagag

SEQ ID NO: 189892 - RNA, 22 nt, Homo sapiens
uugaggccugauaacacacuga

SEQ ID NO: 189893 - RNA, 22 nt, Homo sapiens
uugagggaggcagggcuugucu

SEQ ID NO: 189894 - RNA, 22 nt, Homo sapiens
uugaucaucagcuuugucaucu

SEQ ID NO: 189895 - RNA, 22 nt, Homo sapiens
uugauguccaucucuagguaaa

SEQ ID NO: 189896 - RNA, 23 nt, Homo sapiens
uugcaaagccugaaacucuucag

SEQ ID NO: 189897 - RNA, 22 nt, Homo sapiens
uugcaaggugcagcuuaugcaa

SEQ ID NO: 189898 - RNA, 22 nt, Homo sapiens
uugcacauugauuuuguauccu

SEQ ID NO: 189899 - RNA, 22 nt, Homo sapiens
uugcacauugcaccuuuuguau

SEQ ID NO: 189900 - RNA, 22 nt, Homo sapiens
uugcacauuuuuucuggcagaa

SEQ ID NO: 189901 - RNA, 22 nt, Homo sapiens
uugcacuccagcucuaggugac

SEQ ID NO: 189902 - RNA, 22 nt, Homo sapiens
uugcacuccauccuggguugac

SEQ ID NO: 189903 - RNA, 18 nt, Homo sapiens
uugcacuccugccugggu

SEQ ID NO: 189904 - RNA, 22 nt, Homo sapiens
uugcagagaaauuucugguuua

SEQ ID NO: 189905 - RNA, 20 nt, Homo sapiens
uugcagagcccaacccugga

SEQ ID NO: 189906 - RNA, 22 nt, Homo sapiens
uugcagaucccacacucacccu

SEQ ID NO: 189907 - RNA, 22 nt, Homo sapiens
uugcagcaaauaggaaugagga

SEQ ID NO: 189908 - RNA, 22 nt, Homo sapiens
uugcagugugacgacuauauuu

SEQ ID NO: 189909 - RNA, 19 nt, Homo sapiens
uugcauauguugaaccagg

SEQ ID NO: 189910 - RNA, 22 nt, Homo sapiens
gucugguuccugggagauuucu

SEQ ID NO: 189911 - RNA, 22 nt, Homo sapiens
gucugguugacagcauguggcc

SEQ ID NO: 189912 - RNA, 22 nt, Homo sapiens
gucugugcauuaauacgugcug

SEQ ID NO: 189913 - RNA, 21 nt, Homo sapiens
gucuuacagccagaugccucu

SEQ ID NO: 189914 - RNA, 22 nt, Homo sapiens
gucuuuggaaagacaaaguuca

SEQ ID NO: 189915 - RNA, 22 nt, Homo sapiens
gucuuuugcuagccagagagcu

SEQ ID NO: 189916 - RNA, 22 nt, Homo sapiens
gugacagucaaagacaugacuu

SEQ ID NO: 189917 - RNA, 22 nt, Homo sapiens
gugagauggagucuugcuuugu

SEQ ID NO: 189918 - RNA, 22 nt, Homo sapiens
gugaggcugguccugccuccca

SEQ ID NO: 189919 - RNA, 22 nt, Homo sapiens
gugagucaugucccaucugauu

SEQ ID NO: 189920 - RNA, 22 nt, Homo sapiens
gugcaaugaguguggcaaagcc

SEQ ID NO: 189921 - RNA, 22 nt, Homo sapiens
gugcacuguagaacccuuuguu

SEQ ID NO: 189922 - RNA, 22 nt, Homo sapiens
gugccacaguguuaagggauuc

SEQ ID NO: 189923 - RNA, 16 nt, Homo sapiens
gugcuguguuguuagg

SEQ ID NO: 189924 - RNA, 22 nt, Homo sapiens
guggaaaauuauugcuguuuuu

SEQ ID NO: 189925 - RNA, 21 nt, Homo sapiens
guggaaauggaauuuacuaau

SEQ ID NO: 189926 - RNA, 22 nt, Homo sapiens
guggacaugaauuuuggaggca

SEQ ID NO: 189927 - RNA, 22 nt, Homo sapiens
guggaggagaaagaagcauuuc

SEQ ID NO: 189928 - RNA, 18 nt, Homo sapiens
guggagugucuuccugga

SEQ ID NO: 189929 - RNA, 22 nt, Homo sapiens
guggcagaaaagagaagcaaug

SEQ ID NO: 189930 - RNA, 22 nt, Homo sapiens
guggcagagucagagggaaaug

SEQ ID NO: 189931 - RNA, 22 nt, Homo sapiens
guggcuaaagauuuggaaucug

SEQ ID NO: 189932 - RNA, 22 nt, Homo sapiens
guggcuuuauuuagaagcaggg

SEQ ID NO: 189933 - RNA, 22 nt, Homo sapiens
gugguacuaucuuugguuucag

SEQ ID NO: 189934 - RNA, 22 nt, Homo sapiens
guguaaaacaauuagaggauuu

SEQ ID NO: 189935 - RNA, 22 nt, Homo sapiens
gugugcauggagggggcaguga

SEQ ID NO: 189936 - RNA, 22 nt, Homo sapiens
guguucaaacccaggucugucu

SEQ ID NO: 189937 - RNA, 22 nt, Homo sapiens
guguucauggaauuugcaauug

SEQ ID NO: 189938 - RNA, 22 nt, Homo sapiens
guguugcacauucuguggaugu

SEQ ID NO: 189939 - RNA, 22 nt, Homo sapiens
guuauguuaaauuguuguaugc

SEQ ID NO: 189940 - RNA, 22 nt, Homo sapiens
guucaagugauucuacugccuc

SEQ ID NO: 189941 - RNA, 20 nt, Homo sapiens
guucacaggcuuccuuucag

SEQ ID NO: 189942 - RNA, 22 nt, Homo sapiens
guucacaguuaggacaacugcu

SEQ ID NO: 189943 - RNA, 17 nt, Homo sapiens
guucccaguggcauuug

SEQ ID NO: 189944 - RNA, 22 nt, Homo sapiens
guucucacuggacugugaaaau

SEQ ID NO: 189945 - RNA, 20 nt, Homo sapiens
guucuugcucguguaucuuc

SEQ ID NO: 189946 - RNA, 22 nt, Homo sapiens
guugcccuuagcacuucagccu

SEQ ID NO: 189947 - RNA, 22 nt, Homo sapiens
guuugcagaucaugaagaaccc

SEQ ID NO: 189948 - RNA, 22 nt, Homo sapiens
uaaagccagugauuaugucucu

SEQ ID NO: 189949 - RNA, 22 nt, Homo sapiens
uaaagcuauuauaguuauguuu

SEQ ID NO: 189950 - RNA, 22 nt, Homo sapiens
uaaagugaggauggcaguaggu

SEQ ID NO: 189951 - RNA, 21 nt, Homo sapiens
uaaaugucauacaaagcaaug

SEQ ID NO: 189952 - RNA, 22 nt, Homo sapiens
uaacaacauucuaacugacggc

SEQ ID NO: 189953 - RNA, 23 nt, Homo sapiens
uaacauguuuuuaagggaagcuu

SEQ ID NO: 189954 - RNA, 22 nt, Homo sapiens
uaaggcaaaccuuggcugcagu

SEQ ID NO: 189955 - RNA, 22 nt, Homo sapiens
uaaguaauuguuaauagggaag

SEQ ID NO: 189956 - RNA, 22 nt, Homo sapiens
uaaguagaggaaucauuuugug

SEQ ID NO: 189957 - RNA, 22 nt, Homo sapiens
uaagugcuugacuuugauguuu

SEQ ID NO: 189958 - RNA, 22 nt, Homo sapiens
uaauauguauacagacagauac

SEQ ID NO: 189959 - RNA, 22 nt, Homo sapiens
uaauauguuuugaaaucaggaa

SEQ ID NO: 189960 - RNA, 22 nt, Homo sapiens
uaauucuguauguaucagaguu

SEQ ID NO: 189961 - RNA, 18 nt, Homo sapiens
uacagaacuggaguagaa

SEQ ID NO: 189962 - RNA, 22 nt, Homo sapiens
uacagaauauuucugcccugag

SEQ ID NO: 189963 - RNA, 19 nt, Homo sapiens
uacaggacugagcugaggu

SEQ ID NO: 189964 - RNA, 23 nt, Homo sapiens
uaccacauuccuucuuuccuguu

SEQ ID NO: 189965 - RNA, 22 nt, Homo sapiens
uaccaguaaugguucuagagga

SEQ ID NO: 189966 - RNA, 22 nt, Homo sapiens
aacaguguuuuggguuuucugg

SEQ ID NO: 189967 - RNA, 22 nt, Homo sapiens
aaccuuuagucagcucuuagga

SEQ ID NO: 189968 - RNA, 19 nt, Homo sapiens
aacuggugugagaugguau

SEQ ID NO: 189969 - RNA, 20 nt, Homo sapiens
aagacacuguccccacugga

SEQ ID NO: 189970 - RNA, 22 nt, Homo sapiens
aagaggccuaggaaucuguauu

SEQ ID NO: 189971 - RNA, 22 nt, Homo sapiens
aagaguaguaguggcacucucu

SEQ ID NO: 189972 - RNA, 22 nt, Homo sapiens
aagagugucuuugugcuggccc

SEQ ID NO: 189973 - RNA, 22 nt, Homo sapiens
aagaguuaguaaaauuuccucu

SEQ ID NO: 189974 - RNA, 22 nt, Homo sapiens
aagaugcagucauacuggagga

SEQ ID NO: 189975 - RNA, 22 nt, Homo sapiens
aagccacuguaccugucucuua

SEQ ID NO: 189976 - RNA, 22 nt, Homo sapiens
aagcugugucuugucagcuacc

SEQ ID NO: 189977 - RNA, 22 nt, Homo sapiens
aagcuuucaacuguuugccauu

SEQ ID NO: 189978 - RNA, 22 nt, Homo sapiens
aaggaagcuagcaggaauuggu

SEQ ID NO: 189979 - RNA, 22 nt, Homo sapiens
aaggaguagaauagaugcaccu

SEQ ID NO: 189980 - RNA, 22 nt, Homo sapiens
aaggcaagaaaauggauucucc

SEQ ID NO: 189981 - RNA, 22 nt, Homo sapiens
aaggcacugaacuuaaauucug

SEQ ID NO: 189982 - RNA, 20 nt, Homo sapiens
aaggcuuucgaguuccaggg

SEQ ID NO: 189983 - RNA, 22 nt, Homo sapiens
aagggaauguuguggcugguug

SEQ ID NO: 189984 - RNA, 22 nt, Homo sapiens
aagggaauguugugguugguuu

SEQ ID NO: 189985 - RNA, 21 nt, Homo sapiens
aaggugguggugauugagaug

SEQ ID NO: 189986 - RNA, 22 nt, Homo sapiens
aaggugguuuucucuuggaguc

SEQ ID NO: 189987 - RNA, 22 nt, Homo sapiens
aaguaaacauugagagacaaga

SEQ ID NO: 189988 - RNA, 22 nt, Homo sapiens
aaguaagcauccaauaaauguu

SEQ ID NO: 189989 - RNA, 22 nt, Homo sapiens
aaguauguaucaagucauacuu

SEQ ID NO: 189990 - RNA, 22 nt, Homo sapiens
aagucauggaggaguaugugag

SEQ ID NO: 189991 - RNA, 22 nt, Homo sapiens
aagugaccuaacaaugaaggcc

SEQ ID NO: 189992 - RNA, 20 nt, Homo sapiens
aagugcaucguugugucugc

SEQ ID NO: 189993 - RNA, 17 nt, Homo sapiens
aaguggcuuguucacca

SEQ ID NO: 189994 - RNA, 22 nt, Homo sapiens
aauaaagucugaagugugcuua

SEQ ID NO: 189995 - RNA, 22 nt, Homo sapiens
aauaauggcaccaaagcacaag

SEQ ID NO: 189996 - RNA, 22 nt, Homo sapiens
aauaaugucacaggggguuagc

SEQ ID NO: 189997 - RNA, 22 nt, Homo sapiens
aauacuuccaaaucuagucauu

SEQ ID NO: 189998 - RNA, 22 nt, Homo sapiens
aauaucacaguggguguacacc

SEQ ID NO: 189999 - RNA, 22 nt, Homo sapiens
aauaucacaguuggguguacac

SEQ ID NO: 190000 - RNA, 22 nt, Homo sapiens
aaucacaggucuuggcugcaug

SEQ ID NO: 190001 - RNA, 22 nt, Homo sapiens
aaucacuuugcuacaaggcagu

SEQ ID NO: 190002 - RNA, 22 nt, Homo sapiens
aaucacuuuggcaccaaccuaa

SEQ ID NO: 190003 - RNA, 22 nt, Homo sapiens
aaucccuuuguccagucucuuu

SEQ ID NO: 190004 - RNA, 22 nt, Homo sapiens
aaugcacuccagccugggcgac

SEQ ID NO: 190005 - RNA, 22 nt, Homo sapiens
aaugcaucuagaaaggugaauu

SEQ ID NO: 190006 - RNA, 22 nt, Homo sapiens
aaugccacugugccugccaagg

SEQ ID NO: 190007 - RNA, 22 nt, Homo sapiens
aauggcacaccuagcccuaacc

SEQ ID NO: 190008 - RNA, 22 nt, Homo sapiens
aauggcucugauguuguuguga

SEQ ID NO: 190009 - RNA, 22 nt, Homo sapiens
aauggcuuucagcuuuucccca

SEQ ID NO: 190010 - RNA, 19 nt, Homo sapiens
aauggcuuuuccuguuccc

SEQ ID NO: 190011 - RNA, 21 nt, Homo sapiens
aaugguguugccaacaaggug

SEQ ID NO: 190012 - RNA, 22 nt, Homo sapiens
aauuacauggcaauugggaaau

SEQ ID NO: 190013 - RNA, 22 nt, Homo sapiens
acacagucaaauccacuuggcu

SEQ ID NO: 190014 - RNA, 22 nt, Homo sapiens
acacuguugacauuuuguagug

SEQ ID NO: 190015 - RNA, 22 nt, Homo sapiens
acacuguuuuaguuauuauagc

SEQ ID NO: 190016 - RNA, 22 nt, Homo sapiens
acacuguuuuguggagaaugua

SEQ ID NO: 190017 - RNA, 22 nt, Homo sapiens
acacuugcuugcaauagccucc

SEQ ID NO: 190018 - RNA, 22 nt, Homo sapiens
acacuuucuggagcugcacaua

SEQ ID NO: 190019 - RNA, 22 nt, Homo sapiens
acaguagaaaacaauggauuug

SEQ ID NO: 190020 - RNA, 22 nt, Homo sapiens
acauagaguaguggugaggaug

SEQ ID NO: 190021 - RNA, 22 nt, Homo sapiens
acaucacuguuugauugauuga

SEQ ID NO: 190022 - RNA, 22 nt, Homo sapiens
acaucccuugcucggggccccu

SEQ ID NO: 190023 - RNA, 22 nt, Homo sapiens
acaugagacuggguuuguaggg

SEQ ID NO: 190024 - RNA, 22 nt, Homo sapiens
acauguaauugauuuuguguua

SEQ ID NO: 190025 - RNA, 22 nt, Homo sapiens
accagucucagguaugucuuua

SEQ ID NO: 190026 - RNA, 22 nt, Homo sapiens
accauugcacuccagcccaggc

SEQ ID NO: 190027 - RNA, 22 nt, Homo sapiens
acccaguaacauaugggaggga

SEQ ID NO: 190028 - RNA, 22 nt, Homo sapiens
accugagacuaggcauuuuaua

SEQ ID NO: 190029 - RNA, 21 nt, Homo sapiens
accugauguuucaguuggagu

SEQ ID NO: 190030 - RNA, 22 nt, Homo sapiens
acgcagcacauucacagcuaug

SEQ ID NO: 190031 - RNA, 22 nt, Homo sapiens
acucuguauaaacauugcugua

SEQ ID NO: 190032 - RNA, 22 nt, Homo sapiens
acugcacuccaaccuguugggc

SEQ ID NO: 190033 - RNA, 22 nt, Homo sapiens
acugcacuccagccucgcaaca

SEQ ID NO: 190034 - RNA, 22 nt, Homo sapiens
acugcacuccagccugagccug

SEQ ID NO: 190035 - RNA, 22 nt, Homo sapiens
acugcacuccagccugcuggau

SEQ ID NO: 190036 - RNA, 22 nt, Homo sapiens
acugcacuccagccugcugggu

SEQ ID NO: 190037 - RNA, 22 nt, Homo sapiens
acugcacuccagccuggacgaa

SEQ ID NO: 190038 - RNA, 22 nt, Homo sapiens
acugcacuccagccugugagac

SEQ ID NO: 190039 - RNA, 22 nt, Homo sapiens
acugcacuccagccugugcgua

SEQ ID NO: 190040 - RNA, 22 nt, Homo sapiens
acugcacuccagccuuggagac

SEQ ID NO: 190041 - RNA, 22 nt, Homo sapiens
acugcacuucaaccucauugac

SEQ ID NO: 190042 - RNA, 22 nt, Homo sapiens
acuuuuugaugaggucguuugu

SEQ ID NO: 190043 - RNA, 22 nt, Homo sapiens
agaaagugcuucccuuugguga

SEQ ID NO: 190044 - RNA, 22 nt, Homo sapiens
agaaauguuuauucaaacccgu

SEQ ID NO: 190045 - RNA, 22 nt, Homo sapiens
agaaccaaucccacauggauac

SEQ ID NO: 190046 - RNA, 22 nt, Homo sapiens
agaacccuuugaaauguguuug

SEQ ID NO: 190047 - RNA, 22 nt, Homo sapiens
agaacuguccauucagcaugaa

SEQ ID NO: 190048 - RNA, 22 nt, Homo sapiens
agaagacuauucuggguugggc

SEQ ID NO: 190049 - RNA, 22 nt, Homo sapiens
agacacugaaauguauugaaga

SEQ ID NO: 190050 - RNA, 22 nt, Homo sapiens
agacacuguugaaaaggcccca

SEQ ID NO: 190051 - RNA, 20 nt, Homo sapiens
agacaguguggagauuccuu

SEQ ID NO: 190052 - RNA, 20 nt, Homo sapiens
agacuagggagcagaaagcc

SEQ ID NO: 190053 - RNA, 22 nt, Homo sapiens
agagcaaugacaugcuaugugg

SEQ ID NO: 190054 - RNA, 21 nt, Homo sapiens
agagucaucucuaucuguacc

SEQ ID NO: 190055 - RNA, 22 nt, Homo sapiens
agagugcaaagguuggggcugg

SEQ ID NO: 190056 - RNA, 22 nt, Homo sapiens
agauauguuuaguuucaaaaug

SEQ ID NO: 190057 - RNA, 22 nt, Homo sapiens
agauggguuuucacauguuggc

SEQ ID NO: 190058 - RNA, 22 nt, Homo sapiens
agcaccaauaaucagaguucuu

SEQ ID NO: 190059 - RNA, 22 nt, Homo sapiens
agcaccauuucucuaaagcacu

SEQ ID NO: 190060 - RNA, 22 nt, Homo sapiens
agcagcgacacccuguggugag

SEQ ID NO: 190061 - RNA, 22 nt, Homo sapiens
agcaggacaauaugggaucagg

SEQ ID NO: 190062 - RNA, 16 nt, Homo sapiens
agcagguguuagguga

SEQ ID NO: 190063 - RNA, 22 nt, Homo sapiens
uuuaaugcgucucugaguuuug

SEQ ID NO: 190064 - RNA, 22 nt, Homo sapiens
uuuagcagcaaagagcuguguu

SEQ ID NO: 190065 - RNA, 22 nt, Homo sapiens
uuuaucuguuuaaaacuguuca

SEQ ID NO: 190066 - RNA, 22 nt, Homo sapiens
uuuauguggagcacuugacaca

SEQ ID NO: 190067 - RNA, 23 nt, Homo sapiens
uuucacagaaggauuguagggcc

SEQ ID NO: 190068 - RNA, 22 nt, Homo sapiens
uuucacagagggcuucuuucua

SEQ ID NO: 190069 - RNA, 22 nt, Homo sapiens
uuucacagcaauugccuauugu

SEQ ID NO: 190070 - RNA, 22 nt, Homo sapiens
uuucaggcagggagcuucagug

SEQ ID NO: 190071 - RNA, 22 nt, Homo sapiens
uuucauggcgaggcuucauggg

SEQ ID NO: 190072 - RNA, 22 nt, Homo sapiens
uuucccagugguacaguuuaua

SEQ ID NO: 190073 - RNA, 22 nt, Homo sapiens
uuucuacagggcuugccaggua

SEQ ID NO: 190074 - RNA, 22 nt, Homo sapiens
uuucuuggagcucuuagggucg

SEQ ID NO: 190075 - RNA, 23 nt, Homo sapiens
uuucuugggcaugcuaugucagu

SEQ ID NO: 190076 - RNA, 22 nt, Homo sapiens
uuucuugguuguauuuagacuu

SEQ ID NO: 190077 - RNA, 22 nt, Homo sapiens
uuugagauaucuuccaucagua

SEQ ID NO: 190078 - RNA, 23 nt, Homo sapiens
uuugagugugauaaacacuguca

SEQ ID NO: 190079 - RNA, 22 nt, Homo sapiens
uuugcacauauuugggcaaaag

SEQ ID NO: 190080 - RNA, 21 nt, Homo sapiens
uuugcauauguugaaccagcc

SEQ ID NO: 190081 - RNA, 22 nt, Homo sapiens
uuuggcaacguuggaucccuca

SEQ ID NO: 190082 - RNA, 22 nt, Homo sapiens
uuugguguauauguaaacuaug

SEQ ID NO: 190083 - RNA, 18 nt, Homo sapiens
uuuguacuuuuucuaaug

SEQ ID NO: 190084 - RNA, 22 nt, Homo sapiens
uuugucacccugaauguaagau

SEQ ID NO: 190085 - RNA, 22 nt, Homo sapiens
uuugucauagcagcaggaaugg

SEQ ID NO: 190086 - RNA, 22 nt, Homo sapiens
uuugugcuccuaugagaaucua

SEQ ID NO: 190087 - RNA, 22 nt, Homo sapiens
uuuuaguggaauauuuacaguu

SEQ ID NO: 190088 - RNA, 22 nt, Homo sapiens
uuuugcaguuacagagagugag

SEQ ID NO: 190089 - RNA, 22 nt, Homo sapiens
uuuugcucuugguaaugaaaga

SEQ ID NO: 190090 - RNA, 18 nt, Homo sapiens
uuuugcuuaacugcgcca

SEQ ID NO: 190091 - RNA, 22 nt, Homo sapiens
uuuugcuuuuccucggucccac

SEQ ID NO: 190092 - RNA, 21 nt, Homo sapiens
uuuuugguggucauggauaga

SEQ ID NO: 190093 - RNA, 22 nt, Homo sapiens
uaugacugagacuuaaauugug

SEQ ID NO: 190094 - RNA, 22 nt, Homo sapiens
uaugacuuuugaauacagaugg

SEQ ID NO: 190095 - RNA, 22 nt, Homo sapiens
uaugaucauuauguuauugcag

SEQ ID NO: 190096 - RNA, 21 nt, Homo sapiens
uauggauuugccuauucugga

SEQ ID NO: 190097 - RNA, 22 nt, Homo sapiens
uauggcuuucuacuugaguucu

SEQ ID NO: 190098 - RNA, 22 nt, Homo sapiens
uauggguaguacaaaguguaua

SEQ ID NO: 190099 - RNA, 22 nt, Homo sapiens
uauggguuucagagggugauag

SEQ ID NO: 190100 - RNA, 22 nt, Homo sapiens
uaugucuuuugcuugcaaauag

SEQ ID NO: 190101 - RNA, 22 nt, Homo sapiens
uauuacauccauaggcucugcu

SEQ ID NO: 190102 - RNA, 22 nt, Homo sapiens
uauuacuugucugugucucaau

SEQ ID NO: 190103 - RNA, 22 nt, Homo sapiens
uauuagguuggggcaaaaguaa

SEQ ID NO: 190104 - RNA, 20 nt, Homo sapiens
uauucacucuccagucuugc

SEQ ID NO: 190105 - RNA, 22 nt, Homo sapiens
uauucaucuuaagcuuuggcuu

SEQ ID NO: 190106 - RNA, 22 nt, Homo sapiens
uauugcuaaauucuuuuccuag

SEQ ID NO: 190107 - RNA, 22 nt, Homo sapiens
uauugcuccccauaucgcagug

SEQ ID NO: 190108 - RNA, 22 nt, Homo sapiens
uauuugguuauaugaguaaguu

SEQ ID NO: 190109 - RNA, 20 nt, Homo sapiens
ucaaagacauggcugucaga

SEQ ID NO: 190110 - RNA, 22 nt, Homo sapiens
ucaaagucuucucaaguaacau

SEQ ID NO: 190111 - RNA, 22 nt, Homo sapiens
ucaaaugcucuuugcagagagg

SEQ ID NO: 190112 - RNA, 22 nt, Homo sapiens
ucaacaggucaauugcauagaa

SEQ ID NO: 190113 - RNA, 20 nt, Homo sapiens
ucaaggcacgaauaaaaguu

SEQ ID NO: 190114 - RNA, 23 nt, Homo sapiens
ucaagugaugguggccacaaggg

SEQ ID NO: 190115 - RNA, 22 nt, Homo sapiens
ucacaagugagaggaauuagau

SEQ ID NO: 190116 - RNA, 22 nt, Homo sapiens
ucacaauggcugaacuaauuua

SEQ ID NO: 190117 - RNA, 22 nt, Homo sapiens
ucacaauguaaaugaggguugg

SEQ ID NO: 190118 - RNA, 22 nt, Homo sapiens
ucacaauucucaauuugugaaa

SEQ ID NO: 190119 - RNA, 22 nt, Homo sapiens
ucacagacauugaggggaccuu

SEQ ID NO: 190120 - RNA, 22 nt, Homo sapiens
ucacagaggagaagaccuuuaa

SEQ ID NO: 190121 - RNA, 21 nt, Homo sapiens
ucacagccuaggaccugaaga

SEQ ID NO: 190122 - RNA, 22 nt, Homo sapiens
ucacaguagcaaauguuagaaa

SEQ ID NO: 190123 - RNA, 22 nt, Homo sapiens
ucacaguagggaacugacaaag

SEQ ID NO: 190124 - RNA, 22 nt, Homo sapiens
ucacagucaaaguaaucauaga

SEQ ID NO: 190125 - RNA, 23 nt, Homo sapiens
ucacaguuacuuuugcaucaacc

SEQ ID NO: 190126 - RNA, 22 nt, Homo sapiens
ucacauagcugaguaaaaugga

SEQ ID NO: 190127 - RNA, 22 nt, Homo sapiens
ucacaugaagauuuuaguauac

SEQ ID NO: 190128 - RNA, 22 nt, Homo sapiens
ucacaugcacaucucuggaacc

SEQ ID NO: 190129 - RNA, 18 nt, Homo sapiens
ucacauggccgagagaga

SEQ ID NO: 190130 - RNA, 22 nt, Homo sapiens
ucaccuguagcuaagaccuaau

SEQ ID NO: 190131 - RNA, 22 nt, Homo sapiens
ucacuagggagaaacugaggcu

SEQ ID NO: 190132 - RNA, 22 nt, Homo sapiens
ucacugaaaccuccaccucucg

SEQ ID NO: 190133 - RNA, 19 nt, Homo sapiens
ucacuggacagcacacuca

SEQ ID NO: 190134 - RNA, 22 nt, Homo sapiens
ucacuggagauagcaaucuggu

SEQ ID NO: 190135 - RNA, 22 nt, Homo sapiens
ucacuggaggagaggaagugga

SEQ ID NO: 190136 - RNA, 22 nt, Homo sapiens
ucacugggagcauuugagccuu

SEQ ID NO: 190137 - RNA, 22 nt, Homo sapiens
ucacugugagaguuuauccugu

SEQ ID NO: 190138 - RNA, 22 nt, Homo sapiens
ucacugugcaugaaggaugcug

SEQ ID NO: 190139 - RNA, 22 nt, Homo sapiens
ucacugugguuuugaugugcau

SEQ ID NO: 190140 - RNA, 22 nt, Homo sapiens
ucacuuggccgcagccuucucu

SEQ ID NO: 190141 - RNA, 22 nt, Homo sapiens
ucacuuggugaacacauuaugu

SEQ ID NO: 190142 - RNA, 22 nt, Homo sapiens
ucagaacugauacuagaacuuu

SEQ ID NO: 190143 - RNA, 22 nt, Homo sapiens
ucagacacugagcaaacgacua

SEQ ID NO: 190144 - RNA, 22 nt, Homo sapiens
ucagacacugcccuccaccugu

SEQ ID NO: 190145 - RNA, 22 nt, Homo sapiens
ucagaccauuucauuacagacu

SEQ ID NO: 190146 - RNA, 20 nt, Homo sapiens
ucagcagucuggagcagagg

SEQ ID NO: 190147 - RNA, 22 nt, Homo sapiens
ucaggcaccuuccucuuaucug

SEQ ID NO: 190148 - RNA, 20 nt, Homo sapiens
ucagguagaucuuugagguc

SEQ ID NO: 190149 - RNA, 23 nt, Homo sapiens
ucagguaguuucagaggaccuug

SEQ ID NO: 190150 - RNA, 22 nt, Homo sapiens
ucagguauuuuaucacaugaag

SEQ ID NO: 190151 - RNA, 22 nt, Homo sapiens
ucaggugcaguggcucugaccu

SEQ ID NO: 190152 - RNA, 23 nt, Homo sapiens
ucaguacuccacuuucaauagug

SEQ ID NO: 190153 - RNA, 22 nt, Homo sapiens
ucaguacuuuggagcucacaua

SEQ ID NO: 190154 - RNA, 19 nt, Homo sapiens
ucauagucuaagaugagaa

SEQ ID NO: 190155 - RNA, 23 nt, Homo sapiens
cuuuugcaaugugaucuugccac

SEQ ID NO: 190156 - RNA, 22 nt, Homo sapiens
cuuuuggugugaagaagcucuu

SEQ ID NO: 190157 - RNA, 22 nt, Homo sapiens
cuuuugugauucuucaguugcu

SEQ ID NO: 190158 - RNA, 22 nt, Homo sapiens
cuuuuugguagagcaggugugc

SEQ ID NO: 190159 - RNA, 22 nt, Homo sapiens
gaaagguaggaacagggugcag

SEQ ID NO: 190160 - RNA, 22 nt, Homo sapiens
gaaaugcucagggguuuuccag

SEQ ID NO: 190161 - RNA, 22 nt, Homo sapiens
gaaaugcucauuuuggauccuu

SEQ ID NO: 190162 - RNA, 22 nt, Homo sapiens
gaagcgaggugauuagcagaca

SEQ ID NO: 190163 - RNA, 22 nt, Homo sapiens
gaaguaggugcuguuauuaucu

SEQ ID NO: 190164 - RNA, 17 nt, Homo sapiens
gaaguguuucagcagcu

SEQ ID NO: 190165 - RNA, 22 nt, Homo sapiens
gaaucacaguuauuagagcagc

SEQ ID NO: 190166 - RNA, 22 nt, Homo sapiens
gaaucauuggguugauucaaga

SEQ ID NO: 190167 - RNA, 21 nt, Homo sapiens
gaccacagcagggaaugucag

SEQ ID NO: 190168 - RNA, 22 nt, Homo sapiens
gacuagggaaaauuauuuuguu

SEQ ID NO: 190169 - RNA, 22 nt, Homo sapiens
gacuucaucauacuaugugugg

SEQ ID NO: 190170 - RNA, 22 nt, Homo sapiens
gacuuugguagaggaaaaaucu

SEQ ID NO: 190171 - RNA, 22 nt, Homo sapiens
gagaacagaagcauuccuaauu

SEQ ID NO: 190172 - RNA, 22 nt, Homo sapiens
gagacauugacuuuguuccaga

SEQ ID NO: 190173 - RNA, 22 nt, Homo sapiens
gagacggagucucgcucugucg

SEQ ID NO: 190174 - RNA, 22 nt, Homo sapiens
gagacggagucuugcucuguug

SEQ ID NO: 190175 - RNA, 22 nt, Homo sapiens
gagauacacccagugcagaggc

SEQ ID NO: 190176 - RNA, 22 nt, Homo sapiens
gagauaguguggguacagcuau

SEQ ID NO: 190177 - RNA, 22 nt, Homo sapiens
gagaucaguuaaugaagugagc

SEQ ID NO: 190178 - RNA, 22 nt, Homo sapiens
gagaugguacacauacgauucu

SEQ ID NO: 190179 - RNA, 22 nt, Homo sapiens
gagauuuucagcuugacuggga

SEQ ID NO: 190180 - RNA, 22 nt, Homo sapiens
gagcuagugcuuaugcaccacu

SEQ ID NO: 190181 - RNA, 22 nt, Homo sapiens
gaggaaguuuacaaagcaucug

SEQ ID NO: 190182 - RNA, 22 nt, Homo sapiens
gaggaucucuugagcccagaag

SEQ ID NO: 190183 - RNA, 22 nt, Homo sapiens
gaggcacucuguacaaaucugc

SEQ ID NO: 190184 - RNA, 22 nt, Homo sapiens
gagggcacugcuuuccuuucaa

SEQ ID NO: 190185 - RNA, 22 nt, Homo sapiens
gagugcuguuagcccuggguuu

SEQ ID NO: 190186 - RNA, 22 nt, Homo sapiens
gaguggugguucugaaacuuuu

SEQ ID NO: 190187 - RNA, 22 nt, Homo sapiens
gaguucaaaucucagcucuguu

SEQ ID NO: 190188 - RNA, 22 nt, Homo sapiens
gauaaaucuuggcuagucuaag

SEQ ID NO: 190189 - RNA, 22 nt, Homo sapiens
gauacaccauuuucuagcuauu

SEQ ID NO: 190190 - RNA, 22 nt, Homo sapiens
gauauguguaucuauguacaug

SEQ ID NO: 190191 - RNA, 22 nt, Homo sapiens
gaugauguuggaaacuuggugc

SEQ ID NO: 190192 - RNA, 19 nt, Homo sapiens
gaugcaaugcacugagguc

SEQ ID NO: 190193 - RNA, 22 nt, Homo sapiens
gaugguguuuugauaggaauug

SEQ ID NO: 190194 - RNA, 22 nt, Homo sapiens
gaugguuuuucuccgauuuaua

SEQ ID NO: 190195 - RNA, 22 nt, Homo sapiens
gauuccacuuacuuagcauucc

SEQ ID NO: 190196 - RNA, 22 nt, Homo sapiens
gcaaaauugagaagggaauaua

SEQ ID NO: 190197 - RNA, 22 nt, Homo sapiens
gcaagaugagagcccgggcagu

SEQ ID NO: 190198 - RNA, 22 nt, Homo sapiens
gcacaaugccugacgaguccug

SEQ ID NO: 190199 - RNA, 22 nt, Homo sapiens
gcacaguuaaagggucauguga

SEQ ID NO: 190200 - RNA, 22 nt, Homo sapiens
gcacauggccccaucgugccga

SEQ ID NO: 190201 - RNA, 22 nt, Homo sapiens
gcaccauugacaagaaauaggu

SEQ ID NO: 190202 - RNA, 22 nt, Homo sapiens
gcagcagugcccuggauggaaa

SEQ ID NO: 190203 - RNA, 22 nt, Homo sapiens
gcauggaguggaaauucuuggg

SEQ ID NO: 190204 - RNA, 18 nt, Homo sapiens
gccaacauguaaacaggu

SEQ ID NO: 190205 - RNA, 22 nt, Homo sapiens
gccaagauugguuuaauauucc

SEQ ID NO: 190206 - RNA, 22 nt, Homo sapiens
gccagugugaugugaucauggc

SEQ ID NO: 190207 - RNA, 22 nt, Homo sapiens
gccauugcacucuagccugagc

SEQ ID NO: 190208 - RNA, 22 nt, Homo sapiens
gcccuguugcccaggcuggagu

SEQ ID NO: 190209 - RNA, 22 nt, Homo sapiens
gcccuguugcccugaauacaua

SEQ ID NO: 190210 - RNA, 22 nt, Homo sapiens
gcgcagugggcugugccaucca

SEQ ID NO: 190211 - RNA, 22 nt, Homo sapiens
gcuaggagauccacugcucucu

SEQ ID NO: 190212 - RNA, 19 nt, Homo sapiens
gcucaccuugcugcuccag

SEQ ID NO: 190213 - RNA, 22 nt, Homo sapiens
gcucaguuuccucagcugcaaa

SEQ ID NO: 190214 - RNA, 22 nt, Homo sapiens
gcugauggugcaguucuagccu

SEQ ID NO: 190215 - RNA, 22 nt, Homo sapiens
gcugauguugaccuugaucacc

SEQ ID NO: 190216 - RNA, 22 nt, Homo sapiens
gcuggucugccguaguaggugc

SEQ ID NO: 190217 - RNA, 22 nt, Homo sapiens
gcugguguucaggcccucaguc

SEQ ID NO: 190218 - RNA, 22 nt, Homo sapiens
gcuguauugacuuuguaucaua

SEQ ID NO: 190219 - RNA, 22 nt, Homo sapiens
gcuuggugugcaagugguacua

SEQ ID NO: 190220 - RNA, 22 nt, Homo sapiens
gcuuuguugauggugagucugu

SEQ ID NO: 190221 - RNA, 22 nt, Homo sapiens
ggaaagcuagguguggguguac

SEQ ID NO: 190222 - RNA, 22 nt, Homo sapiens
ggaaaguaacccauucucuuac

SEQ ID NO: 190223 - RNA, 22 nt, Homo sapiens
ggaagccugcacucgggcaggg

SEQ ID NO: 190224 - RNA, 22 nt, Homo sapiens
ggaauaguauaaauaccacaaa

SEQ ID NO: 190225 - RNA, 22 nt, Homo sapiens
ggacagugaaugccacuccucc

SEQ ID NO: 190226 - RNA, 22 nt, Homo sapiens
ggacaucauuaccauggaccca

SEQ ID NO: 190227 - RNA, 22 nt, Homo sapiens
ggacuguaauaccaugaggaca

SEQ ID NO: 190228 - RNA, 22 nt, Homo sapiens
ggagaauguaauugguauuuug

SEQ ID NO: 190229 - RNA, 22 nt, Homo sapiens
ggagugugauuguucucuguua

SEQ ID NO: 190230 - RNA, 22 nt, Homo sapiens
ggaguguguaggagaaagguaa

SEQ ID NO: 190231 - RNA, 22 nt, Homo sapiens
ggauggcauuucuuuagcuuuu

SEQ ID NO: 190232 - RNA, 22 nt, Homo sapiens
ggcaaagaugaccauuacuuuu

SEQ ID NO: 190233 - RNA, 22 nt, Homo sapiens
ggcaagaggagauucugcuccc

SEQ ID NO: 190234 - RNA, 22 nt, Homo sapiens
ggcagcacaauuuucugaugga

SEQ ID NO: 190235 - RNA, 22 nt, Homo sapiens
ggcauugaguggguaggaguca

SEQ ID NO: 190236 - RNA, 22 nt, Homo sapiens
ggccuguaggguauugguaggg

SEQ ID NO: 190237 - RNA, 22 nt, Homo sapiens
auggaauguggaaugguaagua

SEQ ID NO: 190238 - RNA, 22 nt, Homo sapiens
auggagguguggggagugaguu

SEQ ID NO: 190239 - RNA, 22 nt, Homo sapiens
auggaguguggaacugggaauc

SEQ ID NO: 190240 - RNA, 22 nt, Homo sapiens
auggcaguuucagcuauaguuu

SEQ ID NO: 190241 - RNA, 22 nt, Homo sapiens
auggccuuuacaauuugguaug

SEQ ID NO: 190242 - RNA, 22 nt, Homo sapiens
auggcucuggauagaaugcagg

SEQ ID NO: 190243 - RNA, 22 nt, Homo sapiens
auggcuucuucuaaaagugggg

SEQ ID NO: 190244 - RNA, 22 nt, Homo sapiens
auggcuuuuuaaaucauguugu

SEQ ID NO: 190245 - RNA, 22 nt, Homo sapiens
augggcacugauguauucugug

SEQ ID NO: 190246 - RNA, 22 nt, Homo sapiens
augguaagcugaaaauaucgaa

SEQ ID NO: 190247 - RNA, 22 nt, Homo sapiens
augguacuccagagaagcagaa

SEQ ID NO: 190248 - RNA, 22 nt, Homo sapiens
augguacuggggucccggaguu

SEQ ID NO: 190249 - RNA, 22 nt, Homo sapiens
augguauuuaacagucuuucua

SEQ ID NO: 190250 - RNA, 22 nt, Homo sapiens
augguuuuacugcaaaauggga

SEQ ID NO: 190251 - RNA, 22 nt, Homo sapiens
auguaagugugcucaaauguua

SEQ ID NO: 190252 - RNA, 17 nt, Homo sapiens
auguaauccucaucucu

SEQ ID NO: 190253 - RNA, 22 nt, Homo sapiens
auguagugugauuuucacuaga

SEQ ID NO: 190254 - RNA, 22 nt, Homo sapiens
auguaugagaguuccagcugau

SEQ ID NO: 190255 - RNA, 22 nt, Homo sapiens
augucaacauagacaguagagu

SEQ ID NO: 190256 - RNA, 22 nt, Homo sapiens
augucaaggugggugauaguuu

SEQ ID NO: 190257 - RNA, 22 nt, Homo sapiens
augucuggcagaagacuucuca

SEQ ID NO: 190258 - RNA, 22 nt, Homo sapiens
augucuuucauagagacccaga

SEQ ID NO: 190259 - RNA, 22 nt, Homo sapiens
augugcaauguguacguagccc

SEQ ID NO: 190260 - RNA, 22 nt, Homo sapiens
augugcacaugcuuacauguga

SEQ ID NO: 190261 - RNA, 22 nt, Homo sapiens
augugcuuaaaaaugcagagaa

SEQ ID NO: 190262 - RNA, 22 nt, Homo sapiens
auguggcacuugacuuucucgc

SEQ ID NO: 190263 - RNA, 22 nt, Homo sapiens
auguggcuuuucaacuguguga

SEQ ID NO: 190264 - RNA, 18 nt, Homo sapiens
auguggcuuuugaaggcu

SEQ ID NO: 190265 - RNA, 22 nt, Homo sapiens
auguuauguucuucucuguaua

SEQ ID NO: 190266 - RNA, 22 nt, Homo sapiens
auguuuagagagggugucaaau

SEQ ID NO: 190267 - RNA, 22 nt, Homo sapiens
auuaacaucuagaguuuuggug

SEQ ID NO: 190268 - RNA, 23 nt, Homo sapiens
auuaagguuacuacaguaugagg

SEQ ID NO: 190269 - RNA, 22 nt, Homo sapiens
auuaaucaggcaaugcuugcua

SEQ ID NO: 190270 - RNA, 22 nt, Homo sapiens
auuaauguaauuaguaaaguug

SEQ ID NO: 190271 - RNA, 22 nt, Homo sapiens
auuacauagucaaggugucuca

SEQ ID NO: 190272 - RNA, 22 nt, Homo sapiens
auuacuuugcaccaaccuaaua

SEQ ID NO: 190273 - RNA, 22 nt, Homo sapiens
auuauaguguauacuugaaauu

SEQ ID NO: 190274 - RNA, 22 nt, Homo sapiens
auuauauguguaugugcauacc

SEQ ID NO: 190275 - RNA, 22 nt, Homo sapiens
auuaucacaguuuugcauaugg

SEQ ID NO: 190276 - RNA, 22 nt, Homo sapiens
auuauuagucggccagcuguua

SEQ ID NO: 190277 - RNA, 22 nt, Homo sapiens
auucaaagugcauguucccacu

SEQ ID NO: 190278 - RNA, 22 nt, Homo sapiens
auucaagucaucucuccgcauu

SEQ ID NO: 190279 - RNA, 22 nt, Homo sapiens
auucauagugcuaagguguauc

SEQ ID NO: 190280 - RNA, 20 nt, Homo sapiens
auuccacuuguuugagguac

SEQ ID NO: 190281 - RNA, 22 nt, Homo sapiens
auuccauagugucuguggcaga

SEQ ID NO: 190282 - RNA, 22 nt, Homo sapiens
auugaacacagaguagcuuucc

SEQ ID NO: 190283 - RNA, 22 nt, Homo sapiens
auugaacacuucugugugccag

SEQ ID NO: 190284 - RNA, 19 nt, Homo sapiens
auugauuaaguuugcuguc

SEQ ID NO: 190285 - RNA, 22 nt, Homo sapiens
auugcacuccagccugggggac

SEQ ID NO: 190286 - RNA, 22 nt, Homo sapiens
auugcagaaaugacagagcgcc

SEQ ID NO: 190287 - RNA, 22 nt, Homo sapiens
auugccucaauuccaagacugc

SEQ ID NO: 190288 - RNA, 22 nt, Homo sapiens
auuggggaaugguggcuuuagu

SEQ ID NO: 190289 - RNA, 22 nt, Homo sapiens
auuguacuagguccuagggcuu

SEQ ID NO: 190290 - RNA, 22 nt, Homo sapiens
auuguacuccagccuuggggac

SEQ ID NO: 190291 - RNA, 22 nt, Homo sapiens
auuguaguuugcuauggcaaua

SEQ ID NO: 190292 - RNA, 20 nt, Homo sapiens
auuguccuugauuacacaga

SEQ ID NO: 190293 - RNA, 22 nt, Homo sapiens
auuuaacuggucuaggggccca

SEQ ID NO: 190294 - RNA, 22 nt, Homo sapiens
auuucuacuccuguguccagaa

SEQ ID NO: 190295 - RNA, 21 nt, Homo sapiens
auuugguguuagaaauaaauu

SEQ ID NO: 190296 - RNA, 22 nt, Homo sapiens
caaaagugauugcgguuuuugc

SEQ ID NO: 190297 - RNA, 22 nt, Homo sapiens
caaaggcuuccacugcauccuu

SEQ ID NO: 190298 - RNA, 22 nt, Homo sapiens
caaaguaauuacgguuuuggcc

SEQ ID NO: 190299 - RNA, 22 nt, Homo sapiens
caaaguaauugcuguuuugcca

SEQ ID NO: 190300 - RNA, 22 nt, Homo sapiens
caaaguaauugugguuuugcca

SEQ ID NO: 190301 - RNA, 22 nt, Homo sapiens
caaaugacaucauuucauucaa

SEQ ID NO: 190302 - RNA, 22 nt, Homo sapiens
caacaguaaagcauuuuuaagu

SEQ ID NO: 190303 - RNA, 22 nt, Homo sapiens
caacccgugcagagcgcuuagu

SEQ ID NO: 190304 - RNA, 22 nt, Homo sapiens
caaggaauucucaauagaguua

SEQ ID NO: 190305 - RNA, 22 nt, Homo sapiens
caaggugcugagacaggagccc

SEQ ID NO: 190306 - RNA, 21 nt, Homo sapiens
caauggcacaaucucugcuca

SEQ ID NO: 190307 - RNA, 21 nt, Homo sapiens
caauggcacgaucuuggcuca

SEQ ID NO: 190308 - RNA, 22 nt, Homo sapiens
cacaaaguagauuagucuucca

SEQ ID NO: 190309 - RNA, 22 nt, Homo sapiens
cacacugucuucauuacuguag

SEQ ID NO: 190310 - RNA, 22 nt, Homo sapiens
cacacugucuuucagaaugguu

SEQ ID NO: 190311 - RNA, 22 nt, Homo sapiens
uuuccacauggacuuaccuucg

SEQ ID NO: 190312 - RNA, 22 nt, Homo sapiens
uuucccauuguucugcucugug

SEQ ID NO: 190313 - RNA, 21 nt, Homo sapiens
uuucugggggagcauggcagg

SEQ ID NO: 190314 - RNA, 22 nt, Homo sapiens
uuucugggggugcugauggaaa

SEQ ID NO: 190315 - RNA, 19 nt, Homo sapiens
uuugaauauaaugcagcua

SEQ ID NO: 190316 - RNA, 22 nt, Homo sapiens
uuugagcaggcuaaucaauaua

SEQ ID NO: 190317 - RNA, 21 nt, Homo sapiens
uuugaucauuaaaagugaauc

SEQ ID NO: 190318 - RNA, 21 nt, Homo sapiens
uuugcacuuugcaaaucccua

SEQ ID NO: 190319 - RNA, 22 nt, Homo sapiens
uuugcugagucugacuucaugg

SEQ ID NO: 190320 - RNA, 22 nt, Homo sapiens
uuuggcagaugacccucaaguu

SEQ ID NO: 190321 - RNA, 22 nt, Homo sapiens
uuuggcuguuucuggacuaaga

SEQ ID NO: 190322 - RNA, 22 nt, Homo sapiens
uuuggcuuaagauugacugcaa

SEQ ID NO: 190323 - RNA, 21 nt, Homo sapiens
uuuguaguagcaugauuuaua

SEQ ID NO: 190324 - RNA, 23 nt, Homo sapiens
uuuguaguagcaugauuuauaau

SEQ ID NO: 190325 - RNA, 22 nt, Homo sapiens
uuugucccccguaguucauaua

SEQ ID NO: 190326 - RNA, 22 nt, Homo sapiens
uuugugcaugaagagggggugc

SEQ ID NO: 190327 - RNA, 18 nt, Homo sapiens
uuugugcuccacaaagga

SEQ ID NO: 190328 - RNA, 22 nt, Homo sapiens
uuugugucccucuaaaauuuau

SEQ ID NO: 190329 - RNA, 20 nt, Homo sapiens
uuuuagcacuuguuauggug

SEQ ID NO: 190330 - RNA, 22 nt, Homo sapiens
uuuuaugggcuauuugcauuag

SEQ ID NO: 190331 - RNA, 22 nt, Homo sapiens
uuuugcucuucggaagagcuug

SEQ ID NO: 190332 - RNA, 19 nt, Homo sapiens
uuuugcucuuuauaccuau

SEQ ID NO: 190333 - RNA, 22 nt, Homo sapiens
uuuuggcuagaaauauaccucc

SEQ ID NO: 190334 - RNA, 22 nt, Homo sapiens
uuuuggcucuugguaggucaga

SEQ ID NO: 190335 - RNA, 22 nt, Homo sapiens
uuuugggggugauucacacagu

SEQ ID NO: 190336 - RNA, 21 nt, Homo sapiens
uuuuugggcuuucauaguguu

SEQ ID NO: 190337 - RNA, 22 nt, Homo sapiens
uuuuuggguaaugauuaucaau

SEQ ID NO: 190338 - RNA, 22 nt, Homo sapiens
aaaagcauucagagugcugggc

SEQ ID NO: 190339 - RNA, 22 nt, Homo sapiens
aaacagucuucuccugagggac

SEQ ID NO: 190340 - RNA, 22 nt, Homo sapiens
aaacccguagauccgaucuugu

SEQ ID NO: 190341 - RNA, 22 nt, Homo sapiens
aaagaagucagccuguccuuug

SEQ ID NO: 190342 - RNA, 22 nt, Homo sapiens
aaaggauucuaauggaaaugcu

SEQ ID NO: 190343 - RNA, 22 nt, Homo sapiens
aaagucuagaggaucaugugug

SEQ ID NO: 190344 - RNA, 22 nt, Homo sapiens
aaagugauuguaguuuuugcca

SEQ ID NO: 190345 - RNA, 22 nt, Homo sapiens
aaagugcaguauuugggcagaa

SEQ ID NO: 190346 - RNA, 22 nt, Homo sapiens
aaaguucugcguuagggcuaaa

SEQ ID NO: 190347 - RNA, 22 nt, Homo sapiens
aaauaguagcugaaugagggaa

SEQ ID NO: 190348 - RNA, 22 nt, Homo sapiens
aaaucccuugcucucucagacc

SEQ ID NO: 190349 - RNA, 22 nt, Homo sapiens
aaaugcaccacucuggugcagg

SEQ ID NO: 190350 - RNA, 22 nt, Homo sapiens
aaauggcaccggcucuucccuc

SEQ ID NO: 190351 - RNA, 19 nt, Homo sapiens
aaaugugcacuguuuucca

SEQ ID NO: 190352 - RNA, 22 nt, Homo sapiens
aaauugcacaaguggugauuug

SEQ ID NO: 190353 - RNA, 22 nt, Homo sapiens
aaauugcauugagcugcuuauu

SEQ ID NO: 190354 - RNA, 22 nt, Homo sapiens
aacagcacacccgcugcuucca

SEQ ID NO: 190355 - RNA, 21 nt, Homo sapiens
aagaaagcuggacuugccgcu

SEQ ID NO: 190356 - RNA, 22 nt, Homo sapiens
aagagguuguaccuaaaguguu

SEQ ID NO: 190357 - RNA, 22 nt, Homo sapiens
aagagguuuaacugacucacag

SEQ ID NO: 190358 - RNA, 22 nt, Homo sapiens
aagauauguuaguuauaaacuc

SEQ ID NO: 190359 - RNA, 22 nt, Homo sapiens
aagaucauucagggaaggcuga

SEQ ID NO: 190360 - RNA, 22 nt, Homo sapiens
aagaugauguuguguuuucacu

SEQ ID NO: 190361 - RNA, 22 nt, Homo sapiens
aagaugcagaagcccagauguu

SEQ ID NO: 190362 - RNA, 22 nt, Homo sapiens
aagcaacacaucugccccgguu

SEQ ID NO: 190363 - RNA, 21 nt, Homo sapiens
aagcacauugaguguguguga

SEQ ID NO: 190364 - RNA, 22 nt, Homo sapiens
aagcaucacauaauggaucaug

SEQ ID NO: 190365 - RNA, 22 nt, Homo sapiens
aagcuaggguuaauuuauuauu

SEQ ID NO: 190366 - RNA, 22 nt, Homo sapiens
aagcuggauuuaguguggagca

SEQ ID NO: 190367 - RNA, 22 nt, Homo sapiens
aaggagcaguggacggguccua

SEQ ID NO: 190368 - RNA, 22 nt, Homo sapiens
aaggagcuaagagaucauacau

SEQ ID NO: 190369 - RNA, 22 nt, Homo sapiens
aaggcauucucaaacuaguucu

SEQ ID NO: 190370 - RNA, 22 nt, Homo sapiens
aaggugcuguaagcauccaugu

SEQ ID NO: 190371 - RNA, 17 nt, Homo sapiens
aaggugcuucgaccucc

SEQ ID NO: 190372 - RNA, 22 nt, Homo sapiens
aagguggugucagagagcuuau

SEQ ID NO: 190373 - RNA, 22 nt, Homo sapiens
aaguaaacauuuuguacaauaa

SEQ ID NO: 190374 - RNA, 19 nt, Homo sapiens
aaguacuugucuuuugaag

SEQ ID NO: 190375 - RNA, 22 nt, Homo sapiens
aaguagcuggaugcaguggcac

SEQ ID NO: 190376 - RNA, 22 nt, Homo sapiens
aagucaugaagaggaaaggaca

SEQ ID NO: 190377 - RNA, 23 nt, Homo sapiens
aagucauggaaucaaaugaggug

SEQ ID NO: 190378 - RNA, 22 nt, Homo sapiens
aagugaauucauuguguuauau

SEQ ID NO: 190379 - RNA, 22 nt, Homo sapiens
aagugccauguggaugggcccu

SEQ ID NO: 190380 - RNA, 22 nt, Homo sapiens
aagugguguuuguauuuaugca

SEQ ID NO: 190381 - RNA, 22 nt, Homo sapiens
aaguguaaguuaauguuuaggu

SEQ ID NO: 190382 - RNA, 22 nt, Homo sapiens
aauaaagcagcuuuuugggacu

SEQ ID NO: 190383 - RNA, 22 nt, Homo sapiens
aauaaagccugucucuuuagag

SEQ ID NO: 190384 - RNA, 22 nt, Homo sapiens
aauaucacaggguguacacuca

SEQ ID NO: 190385 - RNA, 21 nt, Homo sapiens
aaucacugucuguuuccccuu

SEQ ID NO: 190386 - RNA, 22 nt, Homo sapiens
aauccaugugcuuuaccauuuu

SEQ ID NO: 190387 - RNA, 22 nt, Homo sapiens
aaucccugagcuagacacaaag

SEQ ID NO: 190388 - RNA, 17 nt, Homo sapiens
aaugagacauuucugcu

SEQ ID NO: 190389 - RNA, 22 nt, Homo sapiens
aaugaucaauguuugaggugau

SEQ ID NO: 190390 - RNA, 22 nt, Homo sapiens
aauggcagaugaaauugucauu

SEQ ID NO: 190391 - RNA, 22 nt, Homo sapiens
aauggcuuuuaauauccauaau

SEQ ID NO: 190392 - RNA, 22 nt, Homo sapiens
aaugguguuuccguuaagcuga

SEQ ID NO: 190393 - RNA, 22 nt, Homo sapiens
aauuaguuggcugccuaugauu

SEQ ID NO: 190394 - RNA, 22 nt, Homo sapiens
aauuguacucccauaauucccu

SEQ ID NO: 190395 - RNA, 22 nt, Homo sapiens
acaaaguauggaauguuggugu

SEQ ID NO: 190396 - RNA, 22 nt, Homo sapiens
acacaaugguaaguguuugugu

SEQ ID NO: 190397 - RNA, 22 nt, Homo sapiens
acacaugugcguagacucuuua

SEQ ID NO: 190398 - RNA, 22 nt, Homo sapiens
acaccaucuccuuauuucucuu

SEQ ID NO: 190399 - RNA, 20 nt, Homo sapiens
acagcacugguuucaagcaa

SEQ ID NO: 190400 - RNA, 19 nt, Homo sapiens
acagcugguuuugguuucu

SEQ ID NO: 190401 - RNA, 22 nt, Homo sapiens
acaggagugggauuugaguccu

SEQ ID NO: 190402 - RNA, 21 nt, Homo sapiens
acaguacuugagaucuuuuga

SEQ ID NO: 190403 - RNA, 22 nt, Homo sapiens
acagugcuguggucaugggucu

SEQ ID NO: 190404 - RNA, 22 nt, Homo sapiens
acagugcuuuuguuccucuccu

SEQ ID NO: 190405 - RNA, 22 nt, Homo sapiens
acaguggugcgaucucggcuca

SEQ ID NO: 190406 - RNA, 22 nt, Homo sapiens
acauacacuagggauguggugu

SEQ ID NO: 190407 - RNA, 22 nt, Homo sapiens
acauagaguagcuaccuguaga

SEQ ID NO: 190408 - RNA, 22 nt, Homo sapiens
accacagugcuuccugcucacg

SEQ ID NO: 190409 - RNA, 22 nt, Homo sapiens
acccuggagagugcuguaguaa

SEQ ID NO: 190410 - RNA, 22 nt, Homo sapiens
acccuguugagcaacuggccau

SEQ ID NO: 190411 - RNA, 22 nt, Homo sapiens
accucagcccggggaaguugag

SEQ ID NO: 190412 - RNA, 19 nt, Homo sapiens
accuguagaaaguacaaca

SEQ ID NO: 190413 - RNA, 22 nt, Homo sapiens
acucagagaacauucccagucu

SEQ ID NO: 190414 - RNA, 22 nt, Homo sapiens
acucagagagaacugucauuug

SEQ ID NO: 190415 - RNA, 22 nt, Homo sapiens
acugagucauugggugcccaga

SEQ ID NO: 190416 - RNA, 22 nt, Homo sapiens
acugcacuccaaccuuggugac

SEQ ID NO: 190417 - RNA, 22 nt, Homo sapiens
acugcacuccacccuuggcagc

SEQ ID NO: 190418 - RNA, 22 nt, Homo sapiens
acugcacuccagcccgggugac

SEQ ID NO: 190419 - RNA, 22 nt, Homo sapiens
acugcacuccagccucggcaau

SEQ ID NO: 190420 - RNA, 22 nt, Homo sapiens
acugcacuccagccucggggac

SEQ ID NO: 190421 - RNA, 22 nt, Homo sapiens
acugcacuccagccugcccaac

SEQ ID NO: 190422 - RNA, 22 nt, Homo sapiens
acugcacuccagccugcugaca

SEQ ID NO: 190423 - RNA, 22 nt, Homo sapiens
acugcacuccagccugcuggca

SEQ ID NO: 190424 - RNA, 22 nt, Homo sapiens
acugcacuccagccuugagagc

SEQ ID NO: 190425 - RNA, 22 nt, Homo sapiens
acugcacuccagccuugauggc

SEQ ID NO: 190426 - RNA, 22 nt, Homo sapiens
acugcacuccagccuuggcaac

SEQ ID NO: 190427 - RNA, 22 nt, Homo sapiens
acugcacuccaguuugggcagc

SEQ ID NO: 190428 - RNA, 18 nt, Homo sapiens
acugcacuccauccuagg

SEQ ID NO: 190429 - RNA, 22 nt, Homo sapiens
acugcacugcagccuggccaac

SEQ ID NO: 190430 - RNA, 22 nt, Homo sapiens
acugcacuguccuagaguccuc

SEQ ID NO: 190431 - RNA, 22 nt, Homo sapiens
acugcacuucagccuguugaca

SEQ ID NO: 190432 - RNA, 22 nt, Homo sapiens
acugguguaugggaggucccaa

SEQ ID NO: 190433 - RNA, 22 nt, Homo sapiens
acugugcuguuuuaauuauuga

SEQ ID NO: 190434 - RNA, 22 nt, Homo sapiens
acuuugguuuauagaauuuagg

SEQ ID NO: 190435 - RNA, 22 nt, Homo sapiens
acuuuuugcaaccauuuggacc

SEQ ID NO: 190436 - RNA, 22 nt, Homo sapiens
agaaacauucucuugccuccuu

SEQ ID NO: 190437 - RNA, 23 nt, Homo sapiens
agaaaugucuauucagggucccu

SEQ ID NO: 190438 - RNA, 22 nt, Homo sapiens
agaagaacauagggugacugaa

SEQ ID NO: 190439 - RNA, 22 nt, Homo sapiens
agaaugucaguauuggcuaaaa

SEQ ID NO: 190440 - RNA, 19 nt, Homo sapiens
agacuggcccaggcgggug

SEQ ID NO: 190441 - RNA, 22 nt, Homo sapiens
agagaacugauucagggaaaau

SEQ ID NO: 190442 - RNA, 22 nt, Homo sapiens
agagaacuggcuucaccauucu

SEQ ID NO: 190443 - RNA, 22 nt, Homo sapiens
aggcugguauuuacaaaagcuc

SEQ ID NO: 190444 - RNA, 21 nt, Homo sapiens
aggcuguuguuuugggaugga

SEQ ID NO: 190445 - RNA, 22 nt, Homo sapiens
aggcuuuauuacagggucucag

SEQ ID NO: 190446 - RNA, 22 nt, Homo sapiens
agggcuuuugagcugagauggu

SEQ ID NO: 190447 - RNA, 22 nt, Homo sapiens
aggugguguuggguuccagccc

SEQ ID NO: 190448 - RNA, 22 nt, Homo sapiens
aguaacacaccugcauggugug

SEQ ID NO: 190449 - RNA, 22 nt, Homo sapiens
aguaccauuagauuaggaugac

SEQ ID NO: 190450 - RNA, 23 nt, Homo sapiens
aguacuguaguaauugaggggaa

SEQ ID NO: 190451 - RNA, 22 nt, Homo sapiens
agucauggcagaaggcaccucu

SEQ ID NO: 190452 - RNA, 22 nt, Homo sapiens
agucaugggagagaugugaucg

SEQ ID NO: 190453 - RNA, 22 nt, Homo sapiens
agucaugguaguaaauuuggac

SEQ ID NO: 190454 - RNA, 22 nt, Homo sapiens
aguccauuugaugaugauucca

SEQ ID NO: 190455 - RNA, 22 nt, Homo sapiens
agucgguguuacugacagaaug

SEQ ID NO: 190456 - RNA, 22 nt, Homo sapiens
agugcacucuuuccucucuuac

SEQ ID NO: 190457 - RNA, 22 nt, Homo sapiens
aguuccauuuauucucgucucu

SEQ ID NO: 190458 - RNA, 22 nt, Homo sapiens
auaaagccaggagacguaauug

SEQ ID NO: 190459 - RNA, 22 nt, Homo sapiens
auaagugagugauucaguguua

SEQ ID NO: 190460 - RNA, 22 nt, Homo sapiens
auaauacugggaagaugagcau

SEQ ID NO: 190461 - RNA, 22 nt, Homo sapiens
auacaguguauguauaguacau

SEQ ID NO: 190462 - RNA, 22 nt, Homo sapiens
auacaugugugagcgaagaugu

SEQ ID NO: 190463 - RNA, 22 nt, Homo sapiens
auagcaaugcaagaauggcuua

SEQ ID NO: 190464 - RNA, 22 nt, Homo sapiens
auauaugcacacgugugcauau

SEQ ID NO: 190465 - RNA, 22 nt, Homo sapiens
auauauguuuucugggaagaaa

SEQ ID NO: 190466 - RNA, 22 nt, Homo sapiens
auaugcacgugcauacacacuu

SEQ ID NO: 190467 - RNA, 22 nt, Homo sapiens
auaugcacuauacacacguaua

SEQ ID NO: 190468 - RNA, 20 nt, Homo sapiens
auaugcauguguuuucacuu

SEQ ID NO: 190469 - RNA, 22 nt, Homo sapiens
auauguauuuuaacguguaagg

SEQ ID NO: 190470 - RNA, 22 nt, Homo sapiens
auauuagguuggugcaaaagua

SEQ ID NO: 190471 - RNA, 22 nt, Homo sapiens
aucaaaguaggcauauguuuuu

SEQ ID NO: 190472 - RNA, 22 nt, Homo sapiens
aucaaagugaaauauuaguuau

SEQ ID NO: 190473 - RNA, 22 nt, Homo sapiens
aucaaaguuucccagaaguugu

SEQ ID NO: 190474 - RNA, 22 nt, Homo sapiens
aucacagaacuuugagcagaga

SEQ ID NO: 190475 - RNA, 22 nt, Homo sapiens
aucacagagucacgggcaacuu

SEQ ID NO: 190476 - RNA, 22 nt, Homo sapiens
aucacauggccagguaguaauc

SEQ ID NO: 190477 - RNA, 22 nt, Homo sapiens
aucaccuggaggugaucacuug

SEQ ID NO: 190478 - RNA, 22 nt, Homo sapiens
aucacguguguuuaugcuacgc

SEQ ID NO: 190479 - RNA, 22 nt, Homo sapiens
aucacugggauggaacugcuga

SEQ ID NO: 190480 - RNA, 22 nt, Homo sapiens
aucacuguccacucaucuuucu

SEQ ID NO: 190481 - RNA, 22 nt, Homo sapiens
aucagagugaauaaugacaaaa

SEQ ID NO: 190482 - RNA, 22 nt, Homo sapiens
aucagcagcaugaaaacaggcu

SEQ ID NO: 190483 - RNA, 22 nt, Homo sapiens
aucauagcucacugcagccucg

SEQ ID NO: 190484 - RNA, 22 nt, Homo sapiens
aucaugcacaugcauagguaug

SEQ ID NO: 190485 - RNA, 22 nt, Homo sapiens
aucccugaggaauuucugcacu

SEQ ID NO: 190486 - RNA, 22 nt, Homo sapiens
aucccuguaacuagcagccccu

SEQ ID NO: 190487 - RNA, 22 nt, Homo sapiens
aucccugugacgagcaucccua

SEQ ID NO: 190488 - RNA, 22 nt, Homo sapiens
auccucugagagaguuucauaa

SEQ ID NO: 190489 - RNA, 22 nt, Homo sapiens
auccugagacuuugcugaaguu

SEQ ID NO: 190490 - RNA, 22 nt, Homo sapiens
aucucagcaacuaaagauccuu

SEQ ID NO: 190491 - RNA, 22 nt, Homo sapiens
aucuuuggugcaugauacuuug

SEQ ID NO: 190492 - RNA, 22 nt, Homo sapiens
augaaaagcauaaacgcugaag

SEQ ID NO: 190493 - RNA, 22 nt, Homo sapiens
augaaaguguguggaaacuuga

SEQ ID NO: 190494 - RNA, 22 nt, Homo sapiens
augaacuaugugggauguuuua

SEQ ID NO: 190495 - RNA, 22 nt, Homo sapiens
augaagauguugccuuuuuaau

SEQ ID NO: 190496 - RNA, 17 nt, Homo sapiens
augaagucaucauuuuu

SEQ ID NO: 190497 - RNA, 22 nt, Homo sapiens
augaaguuagcucauuucuuuu

SEQ ID NO: 190498 - RNA, 23 nt, Homo sapiens
augacacuguccuugaccauuuc

SEQ ID NO: 190499 - RNA, 22 nt, Homo sapiens
augaccauuucaauugauaugg

SEQ ID NO: 190500 - RNA, 22 nt, Homo sapiens
augacuagaggagggauggcca

SEQ ID NO: 190501 - RNA, 18 nt, Homo sapiens
augacucuggguguuccu

SEQ ID NO: 190502 - RNA, 22 nt, Homo sapiens
augagagcugacuuuaaggcaa

SEQ ID NO: 190503 - RNA, 22 nt, Homo sapiens
augagauacuacaaaugaguuu

SEQ ID NO: 190504 - RNA, 22 nt, Homo sapiens
augagauauguuaaaaguuaaa

SEQ ID NO: 190505 - RNA, 22 nt, Homo sapiens
augagcugauuuccuuaccaua

SEQ ID NO: 190506 - RNA, 22 nt, Homo sapiens
augaggaagucaggcccagggg

SEQ ID NO: 190507 - RNA, 22 nt, Homo sapiens
augaggcaggaaaggcguaucu

SEQ ID NO: 190508 - RNA, 22 nt, Homo sapiens
augauaaguuauuagaagaaga

SEQ ID NO: 190509 - RNA, 22 nt, Homo sapiens
augaucuguagaacuaguccuu

SEQ ID NO: 190510 - RNA, 22 nt, Homo sapiens
augauggaggccgugauggacg

SEQ ID NO: 190511 - RNA, 22 nt, Homo sapiens
augauguccacagggguguuca

SEQ ID NO: 190512 - RNA, 22 nt, Homo sapiens
augcauauuuuaccuagaagag

SEQ ID NO: 190513 - RNA, 22 nt, Homo sapiens
augcauggcagagucaggguac

SEQ ID NO: 190514 - RNA, 22 nt, Homo sapiens
augcauggucugaagucaaccu

SEQ ID NO: 190515 - RNA, 22 nt, Homo sapiens
augccacuucucuaagucaugu

SEQ ID NO: 190516 - RNA, 22 nt, Homo sapiens
auggaaacauaagaguauagau

SEQ ID NO: 190517 - RNA, 22 nt, Homo sapiens
auggaaggagaggaaugaauga

SEQ ID NO: 190518 - RNA, 22 nt, Homo sapiens
auggcaaaaaaugcaauuacuu

SEQ ID NO: 190519 - RNA, 22 nt, Homo sapiens
auggcacuccagccugggcaac

SEQ ID NO: 190520 - RNA, 22 nt, Homo sapiens
auggcagaaucaagccgacagc

SEQ ID NO: 190521 - RNA, 22 nt, Homo sapiens
auggcucuguuccaugugucuu

SEQ ID NO: 190522 - RNA, 22 nt, Homo sapiens
auggcuugugacccaugcuuca

SEQ ID NO: 190523 - RNA, 22 nt, Homo sapiens
augguacuagaguaagaauugu

SEQ ID NO: 190524 - RNA, 22 nt, Homo sapiens
augguacuggguaaaagugggg

SEQ ID NO: 190525 - RNA, 21 nt, Homo sapiens
augguacugucucuggagaua

SEQ ID NO: 190526 - RNA, 22 nt, Homo sapiens
augguugguuaaaucuguguau

SEQ ID NO: 190527 - RNA, 22 nt, Homo sapiens
augguuuauuuguaagcagagu

SEQ ID NO: 190528 - RNA, 22 nt, Homo sapiens
auguccuggacccagacaaagc

SEQ ID NO: 190529 - RNA, 18 nt, Homo sapiens
augugcaauuuuguauuu

SEQ ID NO: 190530 - RNA, 22 nt, Homo sapiens
augugcaugcuguucugccaga

SEQ ID NO: 190531 - RNA, 22 nt, Homo sapiens
auguggcauuucucauucauuu

SEQ ID NO: 190532 - RNA, 22 nt, Homo sapiens
auguuaagauggaacaugggaa

SEQ ID NO: 190533 - RNA, 22 nt, Homo sapiens
auuauaugucaucacagacacc

SEQ ID NO: 190534 - RNA, 22 nt, Homo sapiens
auuauuaguuguugaaugaagu

SEQ ID NO: 190535 - RNA, 22 nt, Homo sapiens
auucaaggacuggauugcggga

SEQ ID NO: 190536 - RNA, 22 nt, Homo sapiens
auucacuuuuauagacaggucu

SEQ ID NO: 190537 - RNA, 22 nt, Homo sapiens
auuccacuuacaugaaguaccu

SEQ ID NO: 190538 - RNA, 21 nt, Homo sapiens
auuccacuuuuccuucaggga

SEQ ID NO: 190539 - RNA, 18 nt, Homo sapiens
auucuacaggccuuuuga

SEQ ID NO: 190540 - RNA, 22 nt, Homo sapiens
auugaguaaaaaauagugaugu

SEQ ID NO: 190541 - RNA, 22 nt, Homo sapiens
auugcacaaagagggaaacuga

SEQ ID NO: 190542 - RNA, 22 nt, Homo sapiens
auugcacaccagucugggcaaa

SEQ ID NO: 190543 - RNA, 22 nt, Homo sapiens
uggaacacauaaauagcauagu

SEQ ID NO: 190544 - RNA, 22 nt, Homo sapiens
uggaagacaggcuguauuuuaa

SEQ ID NO: 190545 - RNA, 22 nt, Homo sapiens
uggaagacucuagucucuugag

SEQ ID NO: 190546 - RNA, 22 nt, Homo sapiens
uggaagacuuuagaggcuuaua

SEQ ID NO: 190547 - RNA, 22 nt, Homo sapiens
uggaaguaaccaugaauggaau

SEQ ID NO: 190548 - RNA, 20 nt, Homo sapiens
uggaaguaagaauauaggug

SEQ ID NO: 190549 - RNA, 22 nt, Homo sapiens
uggaauaugagacgggguuguc

SEQ ID NO: 190550 - RNA, 22 nt, Homo sapiens
uggaaugguuggugugauuuua

SEQ ID NO: 190551 - RNA, 22 nt, Homo sapiens
uggacaagugcccuccaccuca

SEQ ID NO: 190552 - RNA, 22 nt, Homo sapiens
uggacuagagggugggcgaggu

SEQ ID NO: 190553 - RNA, 22 nt, Homo sapiens
uggagagucauuuauaguauuu

SEQ ID NO: 190554 - RNA, 22 nt, Homo sapiens
uggagagugauaaguaaaugga

SEQ ID NO: 190555 - RNA, 22 nt, Homo sapiens
uggagguagacauugggaagag

SEQ ID NO: 190556 - RNA, 22 nt, Homo sapiens
uggaguguaaauuaguucagcc

SEQ ID NO: 190557 - RNA, 19 nt, Homo sapiens
uggauuguuagagcagugu

SEQ ID NO: 190558 - RNA, 22 nt, Homo sapiens
uggcaaauauuuuguuuuguaa

SEQ ID NO: 190559 - RNA, 22 nt, Homo sapiens
uggcaaaucagaggcauggaca

SEQ ID NO: 190560 - RNA, 22 nt, Homo sapiens
uggcaaaugaaagaaagccagu

SEQ ID NO: 190561 - RNA, 22 nt, Homo sapiens
uggcaaaugaagucagcuguac

SEQ ID NO: 190562 - RNA, 22 nt, Homo sapiens
uggcaacuugcaaccucauucu

SEQ ID NO: 190563 - RNA, 22 nt, Homo sapiens
uggcaagaacaacaauuacuuu

SEQ ID NO: 190564 - RNA, 22 nt, Homo sapiens
uggcaagaacugcaauugcuuu

SEQ ID NO: 190565 - RNA, 22 nt, Homo sapiens
uggcaagagggaugcaagguuu

SEQ ID NO: 190566 - RNA, 22 nt, Homo sapiens
uggcaagaucacaauuacuuuu

SEQ ID NO: 190567 - RNA, 20 nt, Homo sapiens
uggcaagugggaauuguggg

SEQ ID NO: 190568 - RNA, 19 nt, Homo sapiens
uggcaaugucagcagagau

SEQ ID NO: 190569 - RNA, 22 nt, Homo sapiens
uggcaccugacuccgagaugca

SEQ ID NO: 190570 - RNA, 22 nt, Homo sapiens
uggcagaugggugagcuggaga

SEQ ID NO: 190571 - RNA, 22 nt, Homo sapiens
uggcagcgugaauguggcugaa

SEQ ID NO: 190572 - RNA, 20 nt, Homo sapiens
uggcaugaaauuuuccaagc

SEQ ID NO: 190573 - RNA, 17 nt, Homo sapiens
uggcaugaggguguggg

SEQ ID NO: 190574 - RNA, 22 nt, Homo sapiens
uggcaugauguguucauugaaa

SEQ ID NO: 190575 - RNA, 22 nt, Homo sapiens
uggcaugcauuguggguaauua

SEQ ID NO: 190576 - RNA, 22 nt, Homo sapiens
uggccagagggcaauuagcugu

SEQ ID NO: 190577 - RNA, 22 nt, Homo sapiens
uggcuacagaaaguacuaguga

SEQ ID NO: 190578 - RNA, 22 nt, Homo sapiens
uggcucauuucuaaacccagcu

SEQ ID NO: 190579 - RNA, 22 nt, Homo sapiens
uggcuuuuauuauguugaggua

SEQ ID NO: 190580 - RNA, 22 nt, Homo sapiens
uggcuuuuccaggcauuacgau

SEQ ID NO: 190581 - RNA, 22 nt, Homo sapiens
ugggaacugaggugaaaagaca

SEQ ID NO: 190582 - RNA, 22 nt, Homo sapiens
ugggaagaagguuuacuugcca

SEQ ID NO: 190583 - RNA, 22 nt, Homo sapiens
ugggaauaugauacaggucuuu

SEQ ID NO: 190584 - RNA, 22 nt, Homo sapiens
ugggaaugaaauuacauagcuu

SEQ ID NO: 190585 - RNA, 22 nt, Homo sapiens
ugggagugugcacaauuucagc

SEQ ID NO: 190586 - RNA, 22 nt, Homo sapiens
ugggaucagcugggcucucugu

SEQ ID NO: 190587 - RNA, 22 nt, Homo sapiens
ugggaucuuuccuauuagcgag

SEQ ID NO: 190588 - RNA, 22 nt, Homo sapiens
ugggaugaugcuugagaauauc

SEQ ID NO: 190589 - RNA, 22 nt, Homo sapiens
ugggcaaaacuaagagcugugg

SEQ ID NO: 190590 - RNA, 22 nt, Homo sapiens
uggggcaaugaacauuuuugca

SEQ ID NO: 190591 - RNA, 19 nt, Homo sapiens
uggguagugaugagacaua

SEQ ID NO: 190592 - RNA, 22 nt, Homo sapiens
uggguagugucagcugauccau

SEQ ID NO: 190593 - RNA, 22 nt, Homo sapiens
ugggugugaccgcucaaggggg

SEQ ID NO: 190594 - RNA, 22 nt, Homo sapiens
ugguaaguuuaacaugcauccc

SEQ ID NO: 190595 - RNA, 17 nt, Homo sapiens
ugguagguuuuucuggc

SEQ ID NO: 190596 - RNA, 22 nt, Homo sapiens
uggucauggggcagcugacacu

SEQ ID NO: 190597 - RNA, 22 nt, Homo sapiens
uggugcccuguccuucuguggc

SEQ ID NO: 190598 - RNA, 19 nt, Homo sapiens
uggugccuuguucuuggau

SEQ ID NO: 190599 - RNA, 23 nt, Homo sapiens
ugguuuguaagagauggacugga

SEQ ID NO: 190600 - RNA, 22 nt, Homo sapiens
uguaaaaagcccagccgcugag

SEQ ID NO: 190601 - RNA, 20 nt, Homo sapiens
uguaacacauggagaacucu

SEQ ID NO: 190602 - RNA, 22 nt, Homo sapiens
uguaauguuucaucauuauuaa

SEQ ID NO: 190603 - RNA, 22 nt, Homo sapiens
uguagcaaaucgauacuauugg

SEQ ID NO: 190604 - RNA, 22 nt, Homo sapiens
ugucaauauguaauaacugaau

SEQ ID NO: 190605 - RNA, 22 nt, Homo sapiens
ugucauggcauuuguaaacugc

SEQ ID NO: 190606 - RNA, 19 nt, Homo sapiens
ugucccagccauagaggca

SEQ ID NO: 190607 - RNA, 22 nt, Homo sapiens
ugucucagugauuggcuuucug

SEQ ID NO: 190608 - RNA, 22 nt, Homo sapiens
ugucuggaaggguggccuccug

SEQ ID NO: 190609 - RNA, 22 nt, Homo sapiens
ugugagacugacagggcagggu

SEQ ID NO: 190610 - RNA, 22 nt, Homo sapiens
ugugcacaaccugcagguuugu

SEQ ID NO: 190611 - RNA, 22 nt, Homo sapiens
ugugcacaaugugcagguuugu

SEQ ID NO: 190612 - RNA, 22 nt, Homo sapiens
ugugccacuccaaccuggguga

SEQ ID NO: 190613 - RNA, 22 nt, Homo sapiens
ugugccacuccagcucuagcuu

SEQ ID NO: 190614 - RNA, 22 nt, Homo sapiens
ugugccacuccaggaggcuguu

SEQ ID NO: 190615 - RNA, 22 nt, Homo sapiens
ugugccugagguuaacauuguu

SEQ ID NO: 190616 - RNA, 22 nt, Homo sapiens
uguggaaauaaaagaaagguua

SEQ ID NO: 190617 - RNA, 22 nt, Homo sapiens
uguggcaaauggucaggaagaa

SEQ ID NO: 190618 - RNA, 23 nt, Homo sapiens
uucaaaggaugcuuuauggaauu

SEQ ID NO: 190619 - RNA, 22 nt, Homo sapiens
uucaaaguaaaaauguguucac

SEQ ID NO: 190620 - RNA, 22 nt, Homo sapiens
uucaacagugauggccuuugua

SEQ ID NO: 190621 - RNA, 22 nt, Homo sapiens
uucaaguaagaaagacaucagg

SEQ ID NO: 190622 - RNA, 20 nt, Homo sapiens
uucaagugauucucaugccu

SEQ ID NO: 190623 - RNA, 22 nt, Homo sapiens
uucacagagagaacucaaacca

SEQ ID NO: 190624 - RNA, 22 nt, Homo sapiens
uucacagucacccuucuccaug

SEQ ID NO: 190625 - RNA, 22 nt, Homo sapiens
uucacaguguuucucacgguua

SEQ ID NO: 190626 - RNA, 22 nt, Homo sapiens
uucaccuggguuggccaucauu

SEQ ID NO: 190627 - RNA, 22 nt, Homo sapiens
uucacugugaauaaaggcuccc

SEQ ID NO: 190628 - RNA, 19 nt, Homo sapiens
uucagcagugucugcucuu

SEQ ID NO: 190629 - RNA, 22 nt, Homo sapiens
uucaggcuccgugccagcuccg

SEQ ID NO: 190630 - RNA, 22 nt, Homo sapiens
uucaggcuuuuauuuacugaua

SEQ ID NO: 190631 - RNA, 22 nt, Homo sapiens
uucagguacuauaggcuguugg

SEQ ID NO: 190632 - RNA, 22 nt, Homo sapiens
uucagguaguuuaacuguucca

SEQ ID NO: 190633 - RNA, 22 nt, Homo sapiens
uucaguaguaaguuggaacucu

SEQ ID NO: 190634 - RNA, 22 nt, Homo sapiens
uucaguggagaggcugaguggu

SEQ ID NO: 190635 - RNA, 22 nt, Homo sapiens
uucaguucugcacugaucuuag

SEQ ID NO: 190636 - RNA, 18 nt, Homo sapiens
uucaucaguccucagcug

SEQ ID NO: 190637 - RNA, 22 nt, Homo sapiens
uucaucaguuauauuggccuga

SEQ ID NO: 190638 - RNA, 22 nt, Homo sapiens
uucauggaacaaguggguucaa

SEQ ID NO: 190639 - RNA, 22 nt, Homo sapiens
uucauuggacuuguguucuuga

SEQ ID NO: 190640 - RNA, 22 nt, Homo sapiens
uuccaauguuccguguugcagu

SEQ ID NO: 190641 - RNA, 22 nt, Homo sapiens
uuccaguguguucauccucaga

SEQ ID NO: 190642 - RNA, 22 nt, Homo sapiens
uuccaguguuugacucaccuuu

SEQ ID NO: 190643 - RNA, 22 nt, Homo sapiens
uuccaugugggcuugucaagua

SEQ ID NO: 190644 - RNA, 22 nt, Homo sapiens
uucccagucaaacgaaggacuu

SEQ ID NO: 190645 - RNA, 22 nt, Homo sapiens
uucccagugccaggcacuggga

SEQ ID NO: 190646 - RNA, 22 nt, Homo sapiens
uucccaguggaacauguaguca

SEQ ID NO: 190647 - RNA, 22 nt, Homo sapiens
uucccagugguuagcucugguc

SEQ ID NO: 190648 - RNA, 22 nt, Homo sapiens
uucuaaacaucuuacaaugcau

SEQ ID NO: 190649 - RNA, 20 nt, Homo sapiens
uucuacagucacaggaagau

SEQ ID NO: 190650 - RNA, 22 nt, Homo sapiens
uucuacuccucauggcagguug

SEQ ID NO: 190651 - RNA, 22 nt, Homo sapiens
uucuagagagaagacuuaagcu

SEQ ID NO: 190652 - RNA, 22 nt, Homo sapiens
uucuagcacuuugggagacuga

SEQ ID NO: 190653 - RNA, 22 nt, Homo sapiens
uucuauugguaauauuuucugu

SEQ ID NO: 190654 - RNA, 22 nt, Homo sapiens
uucucaauggaugugggaccag

SEQ ID NO: 190655 - RNA, 22 nt, Homo sapiens
uucucagcccccugacagucag

SEQ ID NO: 190656 - RNA, 22 nt, Homo sapiens
uucucuggucagaggggagguu

SEQ ID NO: 190657 - RNA, 22 nt, Homo sapiens
uucugaguggcuuucaacacug

SEQ ID NO: 190658 - RNA, 22 nt, Homo sapiens
uucuggcuuuuaaagaaauguu

SEQ ID NO: 190659 - RNA, 22 nt, Homo sapiens
uucuucugguuaugaaauuuga

SEQ ID NO: 190660 - RNA, 22 nt, Homo sapiens
uucuugcacugaucccauaagc

SEQ ID NO: 190661 - RNA, 22 nt, Homo sapiens
uugaaagacagaggggcaaguu

SEQ ID NO: 190662 - RNA, 22 nt, Homo sapiens
uugaaagucauuucuucuaagu

SEQ ID NO: 190663 - RNA, 22 nt, Homo sapiens
uugaaguagaaagacgaaauuu

SEQ ID NO: 190664 - RNA, 22 nt, Homo sapiens
uugaauaggcucaugcuuauca

SEQ ID NO: 190665 - RNA, 22 nt, Homo sapiens
uugacacuuuguaagaaagggg

SEQ ID NO: 190666 - RNA, 22 nt, Homo sapiens
uugacagaccuuggucauaucc

SEQ ID NO: 190667 - RNA, 22 nt, Homo sapiens
uugacuuagacauucaguugga

SEQ ID NO: 190668 - RNA, 22 nt, Homo sapiens
uugacuuuuaggaggaaaauga

SEQ ID NO: 190669 - RNA, 21 nt, Homo sapiens
uugagcuuuuaguacagacag

SEQ ID NO: 190670 - RNA, 22 nt, Homo sapiens
uugaggaaugucauuuguguuu

SEQ ID NO: 190671 - RNA, 22 nt, Homo sapiens
uugaggaaugugauuucaaaua

SEQ ID NO: 190672 - RNA, 22 nt, Homo sapiens
uugaggcaaugaggagaagcug

SEQ ID NO: 190673 - RNA, 22 nt, Homo sapiens
uugagggaaacauucacaucau

SEQ ID NO: 190674 - RNA, 22 nt, Homo sapiens
uugagggagcauuuguuuugag

SEQ ID NO: 190675 - RNA, 22 nt, Homo sapiens
uugaguaguaagugguucaccg

SEQ ID NO: 190676 - RNA, 22 nt, Homo sapiens
uugauguugaggacauaaaccu

SEQ ID NO: 190677 - RNA, 22 nt, Homo sapiens
uugcaagauguucaugggcugu

SEQ ID NO: 190678 - RNA, 22 nt, Homo sapiens
uugcaccacugcacuccacccu

SEQ ID NO: 190679 - RNA, 22 nt, Homo sapiens
uugcagagccccacacugggcu

SEQ ID NO: 190680 - RNA, 22 nt, Homo sapiens
uugcagagucaguuauuuugcc

SEQ ID NO: 190681 - RNA, 22 nt, Homo sapiens
uugcagcaaagagggaggggca

SEQ ID NO: 190682 - RNA, 22 nt, Homo sapiens
uugcauauguugaaccaagcgu

SEQ ID NO: 190683 - RNA, 22 nt, Homo sapiens
uugcaugguggaacuuggagcu

SEQ ID NO: 190684 - RNA, 22 nt, Homo sapiens
uugcaugguuuuuaucugaaau

SEQ ID NO: 190685 - RNA, 22 nt, Homo sapiens
uugcauuuucuaggagggcaaa

SEQ ID NO: 190686 - RNA, 22 nt, Homo sapiens
uugcuccucugccaggaccugu

SEQ ID NO: 190687 - RNA, 22 nt, Homo sapiens
uuggaaaccucugcagguguuu

SEQ ID NO: 190688 - RNA, 22 nt, Homo sapiens
uuggaaaguuguuguaguuauu

SEQ ID NO: 190689 - RNA, 22 nt, Homo sapiens
uuggaauguacucuagccuaug

SEQ ID NO: 190690 - RNA, 22 nt, Homo sapiens
uuggacucccuccccagcuuca

SEQ ID NO: 190691 - RNA, 22 nt, Homo sapiens
uuggauuauaaacugagauuug

SEQ ID NO: 190692 - RNA, 22 nt, Homo sapiens
uuggcaauauuuacugaaguug

SEQ ID NO: 190693 - RNA, 22 nt, Homo sapiens
uuggcagaaaaggucggggguu

SEQ ID NO: 190694 - RNA, 22 nt, Homo sapiens
uuggcagcauuccagccaagca

SEQ ID NO: 190695 - RNA, 22 nt, Homo sapiens
uuggccccuccaaaucucaugu

SEQ ID NO: 190696 - RNA, 22 nt, Homo sapiens
uugggagugucucuggacugca

SEQ ID NO: 190697 - RNA, 22 nt, Homo sapiens
uugggauggaacuuuucaguga

SEQ ID NO: 190698 - RNA, 22 nt, Homo sapiens
aucucaguucaggcuggccaca

SEQ ID NO: 190699 - RNA, 22 nt, Homo sapiens
aucucauggagguagagaguaa

SEQ ID NO: 190700 - RNA, 22 nt, Homo sapiens
aucucuugccagucagaauggu

SEQ ID NO: 190701 - RNA, 22 nt, Homo sapiens
aucugacuuuuaauuugaaaac

SEQ ID NO: 190702 - RNA, 22 nt, Homo sapiens
aucugguguauuggugcugggu

SEQ ID NO: 190703 - RNA, 22 nt, Homo sapiens
aucugguguccucgugggaguc

SEQ ID NO: 190704 - RNA, 22 nt, Homo sapiens
aucuugcauuugcuaaaaugca

SEQ ID NO: 190705 - RNA, 22 nt, Homo sapiens
aucuuguccugagguuuuauug

SEQ ID NO: 190706 - RNA, 23 nt, Homo sapiens
augaaagcccuugcaaaugcugg

SEQ ID NO: 190707 - RNA, 22 nt, Homo sapiens
augaaagugauaaaugucucua

SEQ ID NO: 190708 - RNA, 22 nt, Homo sapiens
augaaguauuaggacacauuua

SEQ ID NO: 190709 - RNA, 20 nt, Homo sapiens
augaagugaaguuagggaac

SEQ ID NO: 190710 - RNA, 22 nt, Homo sapiens
augacagagauaugugaauuuu

SEQ ID NO: 190711 - RNA, 22 nt, Homo sapiens
augagaugauaggcguucuaac

SEQ ID NO: 190712 - RNA, 21 nt, Homo sapiens
augagauguuagacuuuagac

SEQ ID NO: 190713 - RNA, 22 nt, Homo sapiens
augagcuccucaaggucagaga

SEQ ID NO: 190714 - RNA, 22 nt, Homo sapiens
augaggaaggagccuuugucug

SEQ ID NO: 190715 - RNA, 22 nt, Homo sapiens
augauacuggcuucauagaaug

SEQ ID NO: 190716 - RNA, 22 nt, Homo sapiens
augauacuguucuaagauuuuu

SEQ ID NO: 190717 - RNA, 22 nt, Homo sapiens
augaucacuguggaaauucagc

SEQ ID NO: 190718 - RNA, 22 nt, Homo sapiens
augaucuagaguaggaaacaga

SEQ ID NO: 190719 - RNA, 22 nt, Homo sapiens
augaugucauuuuaauuucuaa

SEQ ID NO: 190720 - RNA, 22 nt, Homo sapiens
augcagcugaggguaguggagc

SEQ ID NO: 190721 - RNA, 19 nt, Homo sapiens
augccacagugaggucaga

SEQ ID NO: 190722 - RNA, 22 nt, Homo sapiens
augccacugcacuucagccugg

SEQ ID NO: 190723 - RNA, 22 nt, Homo sapiens
augccagggagaauuguucaag

SEQ ID NO: 190724 - RNA, 22 nt, Homo sapiens
augcuuguugcagccugagccu

SEQ ID NO: 190725 - RNA, 22 nt, Homo sapiens
guauacuucugaaaauagcuau

SEQ ID NO: 190726 - RNA, 22 nt, Homo sapiens
guaucaucauguuggccaggcu

SEQ ID NO: 190727 - RNA, 22 nt, Homo sapiens
guauccugaaguucucagcacu

SEQ ID NO: 190728 - RNA, 22 nt, Homo sapiens
guaugcacauauguguauguau

SEQ ID NO: 190729 - RNA, 22 nt, Homo sapiens
guaugugacuggaacaguagga

SEQ ID NO: 190730 - RNA, 22 nt, Homo sapiens
gucaaaugcacagaaccauuaa

SEQ ID NO: 190731 - RNA, 22 nt, Homo sapiens
gucaccagcuguguuagccccu

SEQ ID NO: 190732 - RNA, 20 nt, Homo sapiens
gucacuggcccagggcuugu

SEQ ID NO: 190733 - RNA, 22 nt, Homo sapiens
gucaggaccucgguggcauucu

SEQ ID NO: 190734 - RNA, 22 nt, Homo sapiens
gucaggaugauuuggggaggug

SEQ ID NO: 190735 - RNA, 22 nt, Homo sapiens
gucaggcaccgauacaguuuuu

SEQ ID NO: 190736 - RNA, 22 nt, Homo sapiens
gucaucaggacgggucaucugc

SEQ ID NO: 190737 - RNA, 22 nt, Homo sapiens
gucauggacaaggugugagcca

SEQ ID NO: 190738 - RNA, 22 nt, Homo sapiens
gucauggagggacauaacuaac

SEQ ID NO: 190739 - RNA, 22 nt, Homo sapiens
guccugaagaccuuccucugga

SEQ ID NO: 190740 - RNA, 22 nt, Homo sapiens
guccuggagaagcguggaccgg

SEQ ID NO: 190741 - RNA, 22 nt, Homo sapiens
gucucccagccuacaucuuucu

SEQ ID NO: 190742 - RNA, 22 nt, Homo sapiens
gucugagcauggggccggcagg

SEQ ID NO: 190743 - RNA, 22 nt, Homo sapiens
gucuuggagacauugccauuga

SEQ ID NO: 190744 - RNA, 22 nt, Homo sapiens
gucuuuggaaaaaaugucuguu

SEQ ID NO: 190745 - RNA, 22 nt, Homo sapiens
gugaaagcaucugacugugcca

SEQ ID NO: 190746 - RNA, 17 nt, Homo sapiens
gugaaaucaucauuuuu

SEQ ID NO: 190747 - RNA, 22 nt, Homo sapiens
gugaacaauguuuuauccuggg

SEQ ID NO: 190748 - RNA, 22 nt, Homo sapiens
gugaacagcagaugagugagug

SEQ ID NO: 190749 - RNA, 22 nt, Homo sapiens
gugaccagaugggcaggggugu

SEQ ID NO: 190750 - RNA, 22 nt, Homo sapiens
gugacugggaguggugaagaua

SEQ ID NO: 190751 - RNA, 22 nt, Homo sapiens
gugagaugguaucucauugugg

SEQ ID NO: 190752 - RNA, 22 nt, Homo sapiens
gugagcacugaaagaaggcaag

SEQ ID NO: 190753 - RNA, 22 nt, Homo sapiens
gugagggaugugaaaaagguca

SEQ ID NO: 190754 - RNA, 22 nt, Homo sapiens
gugauacugcuuauuaauuuaa

SEQ ID NO: 190755 - RNA, 22 nt, Homo sapiens
gugcacaaaucuuaaauguaca

SEQ ID NO: 190756 - RNA, 22 nt, Homo sapiens
gugcacauauggugcauaagug

SEQ ID NO: 190757 - RNA, 22 nt, Homo sapiens
gugcacaucuguguuccagcua

SEQ ID NO: 190758 - RNA, 23 nt, Homo sapiens
gugcaguggcgagauuucggcuc

SEQ ID NO: 190759 - RNA, 22 nt, Homo sapiens
gugccacugcaccuggccuaag

SEQ ID NO: 190760 - RNA, 22 nt, Homo sapiens
gugccacugcacuccggccugg

SEQ ID NO: 190761 - RNA, 22 nt, Homo sapiens
guggaaaacauaugcuuguuga

SEQ ID NO: 190762 - RNA, 22 nt, Homo sapiens
guggaaguguaaaagcucuugg

SEQ ID NO: 190763 - RNA, 22 nt, Homo sapiens
guggaagugucuggggccaggg

SEQ ID NO: 190764 - RNA, 22 nt, Homo sapiens
guggagacaaaggcugagugag

SEQ ID NO: 190765 - RNA, 22 nt, Homo sapiens
guggcaagaugacuacucacug

SEQ ID NO: 190766 - RNA, 22 nt, Homo sapiens
guggcaaguguuccaagaggcg

SEQ ID NO: 190767 - RNA, 22 nt, Homo sapiens
guggcaugaaagcaucugugau

SEQ ID NO: 190768 - RNA, 21 nt, Homo sapiens
guggccuuuggagcaugucag

SEQ ID NO: 190769 - RNA, 22 nt, Homo sapiens
guggcuuuaaguacgauugagg

SEQ ID NO: 190770 - RNA, 22 nt, Homo sapiens
gugggaagcuggaacucccucc

SEQ ID NO: 190771 - RNA, 22 nt, Homo sapiens
gugggagugucccguuuuucca

SEQ ID NO: 190772 - RNA, 22 nt, Homo sapiens
gugggaugaucacaguucacug

SEQ ID NO: 190773 - RNA, 22 nt, Homo sapiens
guggucagaaaucucaguggca

SEQ ID NO: 190774 - RNA, 21 nt, Homo sapiens
gugucacagacaugacagaug

SEQ ID NO: 190775 - RNA, 22 nt, Homo sapiens
guuaugcagcaauugauaaucu

SEQ ID NO: 190776 - RNA, 22 nt, Homo sapiens
guucaaggaauguuggcuucuc

SEQ ID NO: 190777 - RNA, 22 nt, Homo sapiens
guucccaguugaaaugauuagu

SEQ ID NO: 190778 - RNA, 22 nt, Homo sapiens
guucucacuggugcugguaagu

SEQ ID NO: 190779 - RNA, 22 nt, Homo sapiens
guugaggcaggagaauuacuug

SEQ ID NO: 190780 - RNA, 22 nt, Homo sapiens
guugauguugcagucuugagga

SEQ ID NO: 190781 - RNA, 22 nt, Homo sapiens
guugcacagucuuuccuggacu

SEQ ID NO: 190782 - RNA, 22 nt, Homo sapiens
guugcaugucugggaggccagc

SEQ ID NO: 190783 - RNA, 22 nt, Homo sapiens
guugcucaggccggagugcagu

SEQ ID NO: 190784 - RNA, 22 nt, Homo sapiens
guugggcccauagacugccagu

SEQ ID NO: 190785 - RNA, 22 nt, Homo sapiens
guuugugcuccuaugagaaucu

SEQ ID NO: 190786 - RNA, 15 nt, Homo sapiens
guuuuuggauacaau

SEQ ID NO: 190787 - RNA, 22 nt, Homo sapiens
uaaacacucacuucauagccau

SEQ ID NO: 190788 - RNA, 22 nt, Homo sapiens
uaaagauaaggcucgcuuggau

SEQ ID NO: 190789 - RNA, 22 nt, Homo sapiens
uaaagaugcugggaaggcuagg

SEQ ID NO: 190790 - RNA, 21 nt, Homo sapiens
uaaagcuagaaccuuagcuuu

SEQ ID NO: 190791 - RNA, 22 nt, Homo sapiens
uaaagcuagaauuguuccagca

SEQ ID NO: 190792 - RNA, 22 nt, Homo sapiens
uaaagcuaugagaacaccguag

SEQ ID NO: 190793 - RNA, 22 nt, Homo sapiens
uaaagcuuagauccaugguggc

SEQ ID NO: 190794 - RNA, 22 nt, Homo sapiens
uaaaguguuuguuauuaaaggu

SEQ ID NO: 190795 - RNA, 22 nt, Homo sapiens
uaaaugacugucaguagaugaa

SEQ ID NO: 190796 - RNA, 22 nt, Homo sapiens
uaaaugcucuuuaaaagugcuu

SEQ ID NO: 190797 - RNA, 22 nt, Homo sapiens
uaaaugcuugagaugauggaua

SEQ ID NO: 190798 - RNA, 22 nt, Homo sapiens
uaacaagagagucagucagucc

SEQ ID NO: 190799 - RNA, 22 nt, Homo sapiens
uaacagucuccucaagguguug

SEQ ID NO: 190800 - RNA, 22 nt, Homo sapiens
uaacaguguauuccuuuggaca

SEQ ID NO: 190801 - RNA, 22 nt, Homo sapiens
uaacccagugucugugaugggu

SEQ ID NO: 190802 - RNA, 18 nt, Homo sapiens
uaacuggugugagauggu

SEQ ID NO: 190803 - RNA, 22 nt, Homo sapiens
uaagacacuuaaaauguuacau

SEQ ID NO: 190804 - RNA, 22 nt, Homo sapiens
uaagacugccccagacagcaag

SEQ ID NO: 190805 - RNA, 22 nt, Homo sapiens
uaagacuguguaauuuaugaag

SEQ ID NO: 190806 - RNA, 19 nt, Homo sapiens
uaagaugaagcugucuggg

SEQ ID NO: 190807 - RNA, 22 nt, Homo sapiens
uaaguaucaguuuagcuaugau

SEQ ID NO: 190808 - RNA, 22 nt, Homo sapiens
uaagugaaggaaguguguuuac

SEQ ID NO: 190809 - RNA, 22 nt, Homo sapiens
uaagugaauguuggcuacugaa

SEQ ID NO: 190810 - RNA, 22 nt, Homo sapiens
uaagugaauuugacagguaaug

SEQ ID NO: 190811 - RNA, 22 nt, Homo sapiens
uaauacuagugaauagcaggau

SEQ ID NO: 190812 - RNA, 22 nt, Homo sapiens
uaauagcucggauaaacaugau

SEQ ID NO: 190813 - RNA, 16 nt, Homo sapiens
uacauuuguuacaugg

SEQ ID NO: 190814 - RNA, 22 nt, Homo sapiens
uacuacuuucugacaucuuuaa

SEQ ID NO: 190815 - RNA, 22 nt, Homo sapiens
uacucugcagagaugcauaaca

SEQ ID NO: 190816 - RNA, 22 nt, Homo sapiens
uacugcacuccagccuugccaa

SEQ ID NO: 190817 - RNA, 19 nt, Homo sapiens
uacugcacuccagucuggg

SEQ ID NO: 190818 - RNA, 20 nt, Homo sapiens
uacugcacuccauccugggu

SEQ ID NO: 190819 - RNA, 22 nt, Homo sapiens
uagaaucuaacucgcaugaaaa

SEQ ID NO: 190820 - RNA, 22 nt, Homo sapiens
uagaauguauaauauuuuacuu

SEQ ID NO: 190821 - RNA, 20 nt, Homo sapiens
uagagagauauggggguucc

SEQ ID NO: 190822 - RNA, 22 nt, Homo sapiens
uagagagcuguuugaaagcagg

SEQ ID NO: 190823 - RNA, 22 nt, Homo sapiens
uagaggaaugaauuuggccaga

SEQ ID NO: 190824 - RNA, 21 nt, Homo sapiens
uagauacuguauuaaaccuag

SEQ ID NO: 190825 - RNA, 22 nt, Homo sapiens
uagaucaacuuugguaagagaa

SEQ ID NO: 190826 - RNA, 22 nt, Homo sapiens
uagauuaucucaccacucgagu

SEQ ID NO: 190827 - RNA, 22 nt, Homo sapiens
uagcacaucccuaaaaugcugu

SEQ ID NO: 190828 - RNA, 22 nt, Homo sapiens
uagcaccucuuuggccuuucgu

SEQ ID NO: 190829 - RNA, 20 nt, Homo sapiens
uagcagcagacagagggagg

SEQ ID NO: 190830 - RNA, 22 nt, Homo sapiens
uagcaucaauucauguuaugau

SEQ ID NO: 190831 - RNA, 21 nt, Homo sapiens
uagcugcacccaggccuccuu

SEQ ID NO: 190832 - RNA, 20 nt, Homo sapiens
uaggagcaaugagaguagaa

SEQ ID NO: 190833 - RNA, 22 nt, Homo sapiens
uaggagugugaacccuaugaac

SEQ ID NO: 190834 - RNA, 22 nt, Homo sapiens
uaggccuuuuuaugucaauauc

SEQ ID NO: 190835 - RNA, 22 nt, Homo sapiens
uagggcaugugggaaguuauaa

SEQ ID NO: 190836 - RNA, 22 nt, Homo sapiens
uagggcuuuuccaagcugccac

SEQ ID NO: 190837 - RNA, 23 nt, Homo sapiens
uaguaccauauuguuggcagcac

SEQ ID NO: 190838 - RNA, 22 nt, Homo sapiens
uaguaucacauggucuuaauua

SEQ ID NO: 190839 - RNA, 22 nt, Homo sapiens
uaguccauuuucaugcugcuau

SEQ ID NO: 190840 - RNA, 22 nt, Homo sapiens
uagugcuguaauucuaaugaaa

SEQ ID NO: 190841 - RNA, 22 nt, Homo sapiens
uagugguaguagcaguaauauu

SEQ ID NO: 190842 - RNA, 22 nt, Homo sapiens
uauagcaaugugccacucucug

SEQ ID NO: 190843 - RNA, 22 nt, Homo sapiens
uauagcagugaguauugacuaa

SEQ ID NO: 190844 - RNA, 22 nt, Homo sapiens
uauagcagugugagaacagacu

SEQ ID NO: 190845 - RNA, 22 nt, Homo sapiens
uauagcuuaaaguuuagauccu

SEQ ID NO: 190846 - RNA, 20 nt, Homo sapiens
uaucacaggucagaaacccu

SEQ ID NO: 190847 - RNA, 22 nt, Homo sapiens
uaucauggggacugcagccuag

SEQ ID NO: 190848 - RNA, 22 nt, Homo sapiens
uaucucagagaaucagauuuac

SEQ ID NO: 190849 - RNA, 22 nt, Homo sapiens
uaucucagaguguacaagauua

SEQ ID NO: 190850 - RNA, 22 nt, Homo sapiens
uaugagagcugguagguagaga

SEQ ID NO: 190851 - RNA, 22 nt, Homo sapiens
uaugcacacucucccaggaggg

SEQ ID NO: 190852 - RNA, 22 nt, Homo sapiens
uaugccuuuugguucaagcaac

SEQ ID NO: 190853 - RNA, 22 nt, Homo sapiens
uaugcuuauuaaaacagugugu

SEQ ID NO: 190854 - RNA, 22 nt, Homo sapiens
uauggauguuaagguucacagc

SEQ ID NO: 190855 - RNA, 21 nt, Homo sapiens
uauggcuuagucaguguuucc

SEQ ID NO: 190856 - RNA, 22 nt, Homo sapiens
uaugggauuucauuaagugucu

SEQ ID NO: 190857 - RNA, 22 nt, Homo sapiens
uaugguuuuaagguuaaggacu

SEQ ID NO: 190858 - RNA, 22 nt, Homo sapiens
uaugucuucuuuagagaaaugu

SEQ ID NO: 190859 - RNA, 22 nt, Homo sapiens
uauuagguuggugcaaaaguaa

SEQ ID NO: 190860 - RNA, 22 nt, Homo sapiens
uauuccauuugugaaaggaagu

SEQ ID NO: 190861 - RNA, 18 nt, Homo sapiens
uauuccucuuccucuauc

SEQ ID NO: 190862 - RNA, 22 nt, Homo sapiens
uauugcauguugagcaguaccu

SEQ ID NO: 190863 - RNA, 22 nt, Homo sapiens
uauugcccugcuuuguucuaaa

SEQ ID NO: 190864 - RNA, 22 nt, Homo sapiens
uauugcuugaggaaaugguaau

SEQ ID NO: 190865 - RNA, 22 nt, Homo sapiens
uauuguacauauccucccuuca

SEQ ID NO: 190866 - RNA, 22 nt, Homo sapiens
uauuucccuuaacuuuccugca

SEQ ID NO: 190867 - RNA, 22 nt, Homo sapiens
uauuugauuaacaagagccuaa

SEQ ID NO: 190868 - RNA, 22 nt, Homo sapiens
uauuugauugacuuuagcagga

SEQ ID NO: 190869 - RNA, 22 nt, Homo sapiens
ucaaaguauucuucugagaacc

SEQ ID NO: 190870 - RNA, 22 nt, Homo sapiens
ucaaagugcuauggcucagguu

SEQ ID NO: 190871 - RNA, 18 nt, Homo sapiens
ucaaauacuuugggcagu

SEQ ID NO: 190872 - RNA, 20 nt, Homo sapiens
ucaaauucuuggccuccagc

SEQ ID NO: 190873 - RNA, 22 nt, Homo sapiens
ucaacagugggcacuguaaaug

SEQ ID NO: 190874 - RNA, 18 nt, Homo sapiens
ucaagcaauugucaugcc

SEQ ID NO: 190875 - RNA, 22 nt, Homo sapiens
ucaaggcacuagcugagcugca

SEQ ID NO: 190876 - RNA, 22 nt, Homo sapiens
ucacaccauucuucuacuucag

SEQ ID NO: 190877 - RNA, 22 nt, Homo sapiens
ucacagcuaaaaugaaaguagu

SEQ ID NO: 190878 - RNA, 18 nt, Homo sapiens
ucacagguaauuaggauu

SEQ ID NO: 190879 - RNA, 22 nt, Homo sapiens
ucacagucacugucacguugaa

SEQ ID NO: 190880 - RNA, 22 nt, Homo sapiens
ucacagucuccucuagggaggg

SEQ ID NO: 190881 - RNA, 22 nt, Homo sapiens
ucacagucugcgugaugagaca

SEQ ID NO: 190882 - RNA, 22 nt, Homo sapiens
ucacaguucagcauggcugagg

SEQ ID NO: 190883 - RNA, 22 nt, Homo sapiens
ucacaguugauugaaacacagc

SEQ ID NO: 190884 - RNA, 22 nt, Homo sapiens
ucacauggaggugauaguugaa

SEQ ID NO: 190885 - RNA, 22 nt, Homo sapiens
ucacauggcagagaagaagcuc

SEQ ID NO: 190886 - RNA, 22 nt, Homo sapiens
ucacauuguuauguaaauguuu

SEQ ID NO: 190887 - RNA, 22 nt, Homo sapiens
ucacucagaccuggugauaugc

SEQ ID NO: 190888 - RNA, 20 nt, Homo sapiens
ucacugagugguccacagua

SEQ ID NO: 190889 - RNA, 22 nt, Homo sapiens
ucacugcacuagguaaugccac

SEQ ID NO: 190890 - RNA, 22 nt, Homo sapiens
ucacugcacuccagccuuuaug

SEQ ID NO: 190891 - RNA, 22 nt, Homo sapiens
ucacuggacucuagccugggug

SEQ ID NO: 190892 - RNA, 22 nt, Homo sapiens
ucacugugcacauaugauaggu

SEQ ID NO: 190893 - RNA, 22 nt, Homo sapiens
ucacuguugaugggcaugcagg

SEQ ID NO: 190894 - RNA, 21 nt, Homo sapiens
ucagaagcucccagggaggac

SEQ ID NO: 190895 - RNA, 22 nt, Homo sapiens
ucagcaucacgugggcucccgu

SEQ ID NO: 190896 - RNA, 21 nt, Homo sapiens
ucaggaccucuaguuagccag

SEQ ID NO: 190897 - RNA, 22 nt, Homo sapiens
ucaggcacuaguaagaaaaagg

SEQ ID NO: 190898 - RNA, 22 nt, Homo sapiens
ucaggucauuccaggagggcca

SEQ ID NO: 190899 - RNA, 22 nt, Homo sapiens
ucaggugcagagaagaaauggg

SEQ ID NO: 190900 - RNA, 23 nt, Homo sapiens
ucaguacucuauaagugccagcu

SEQ ID NO: 190901 - RNA, 22 nt, Homo sapiens
ucagugaacgaggaggagggug

SEQ ID NO: 190902 - RNA, 22 nt, Homo sapiens
ucagugcaggaaucucuagcca

SEQ ID NO: 190903 - RNA, 22 nt, Homo sapiens
ucagugccauugccauaugagu

SEQ ID NO: 190904 - RNA, 22 nt, Homo sapiens
ucaguggauuauuaaagucacc

SEQ ID NO: 190905 - RNA, 21 nt, Homo sapiens
ucaucaagcuguagacaugau

SEQ ID NO: 190906 - RNA, 22 nt, Homo sapiens
ucaucaggaaacuuaugcagug

SEQ ID NO: 190907 - RNA, 22 nt, Homo sapiens
ucaucagguaugucagcggagu

SEQ ID NO: 190908 - RNA, 22 nt, Homo sapiens
ucaucaguuuuuuauaugugau

SEQ ID NO: 190909 - RNA, 22 nt, Homo sapiens
agcaucacacacuacagggaaa

SEQ ID NO: 190910 - RNA, 18 nt, Homo sapiens
agcaucacugaucauccu

SEQ ID NO: 190911 - RNA, 20 nt, Homo sapiens
agcaucauugcaauuuguca

SEQ ID NO: 190912 - RNA, 22 nt, Homo sapiens
agcccugugauuacuuuuauaa

SEQ ID NO: 190913 - RNA, 23 nt, Homo sapiens
agccuguugccuaggcagcucau

SEQ ID NO: 190914 - RNA, 19 nt, Homo sapiens
agcuagugcucagcuguca

SEQ ID NO: 190915 - RNA, 22 nt, Homo sapiens
agcuagugugauucuuuggggu

SEQ ID NO: 190916 - RNA, 22 nt, Homo sapiens
agcuauauugaggaugccauuc

SEQ ID NO: 190917 - RNA, 22 nt, Homo sapiens
agcuccauuguaaucaccuggu

SEQ ID NO: 190918 - RNA, 22 nt, Homo sapiens
agcuccuacuguuacaucauug

SEQ ID NO: 190919 - RNA, 22 nt, Homo sapiens
agcugcacaaauggaugugagg

SEQ ID NO: 190920 - RNA, 22 nt, Homo sapiens
agcuggcuguagcugcaagucu

SEQ ID NO: 190921 - RNA, 21 nt, Homo sapiens
agcugguuuccacagugugcu

SEQ ID NO: 190922 - RNA, 22 nt, Homo sapiens
agcuguuguuaauuaacucauu

SEQ ID NO: 190923 - RNA, 22 nt, Homo sapiens
agcuuguguuugucugccuggg

SEQ ID NO: 190924 - RNA, 22 nt, Homo sapiens
aggaaaucuuagcugaggggau

SEQ ID NO: 190925 - RNA, 21 nt, Homo sapiens
aggaagacuaugaucaauugg

SEQ ID NO: 190926 - RNA, 23 nt, Homo sapiens
aggaauggaaaaccaaguaucau

SEQ ID NO: 190927 - RNA, 22 nt, Homo sapiens
aggacacugagcaugggagguu

SEQ ID NO: 190928 - RNA, 22 nt, Homo sapiens
aggacacugauguaugcugugg

SEQ ID NO: 190929 - RNA, 21 nt, Homo sapiens
aggagcauuguugugguggag

SEQ ID NO: 190930 - RNA, 20 nt, Homo sapiens
aggagcauuuacauuggcuc

SEQ ID NO: 190931 - RNA, 22 nt, Homo sapiens
aggagcuuuggggaaaacagau

SEQ ID NO: 190932 - RNA, 22 nt, Homo sapiens
aggaggauugcuuucaucuuuu

SEQ ID NO: 190933 - RNA, 22 nt, Homo sapiens
aggcaagugggagacagcauuu

SEQ ID NO: 190934 - RNA, 22 nt, Homo sapiens
aggcaugugugcagacugucug

SEQ ID NO: 190935 - RNA, 22 nt, Homo sapiens
agggcacuguagguccugccuc

SEQ ID NO: 190936 - RNA, 22 nt, Homo sapiens
agggccuuuguagauguacuca

SEQ ID NO: 190937 - RNA, 22 nt, Homo sapiens
aggguuuuuauuuauguggcau

SEQ ID NO: 190938 - RNA, 21 nt, Homo sapiens
aggucaguaagaaugcagcac

SEQ ID NO: 190939 - RNA, 22 nt, Homo sapiens
aggugcuugaaucuaugagcuc

SEQ ID NO: 190940 - RNA, 22 nt, Homo sapiens
aggugguuuugaugagcaggua

SEQ ID NO: 190941 - RNA, 20 nt, Homo sapiens
agguucaaaucccaaucaug

SEQ ID NO: 190942 - RNA, 22 nt, Homo sapiens
aguaaauuucugugcuuucaua

SEQ ID NO: 190943 - RNA, 22 nt, Homo sapiens
aguaacauuucuaguagagagu

SEQ ID NO: 190944 - RNA, 22 nt, Homo sapiens
aguaccauuugacaugggaccc

SEQ ID NO: 190945 - RNA, 22 nt, Homo sapiens
aguaucaucuuguuggccaggc

SEQ ID NO: 190946 - RNA, 22 nt, Homo sapiens
aguauguuuugaaaccaagaag

SEQ ID NO: 190947 - RNA, 22 nt, Homo sapiens
aguauuuguuggaauaccuguu

SEQ ID NO: 190948 - RNA, 22 nt, Homo sapiens
agucaagaaucucagcaucuuu

SEQ ID NO: 190949 - RNA, 22 nt, Homo sapiens
agucaguguguauugauggcac

SEQ ID NO: 190950 - RNA, 17 nt, Homo sapiens
agugagaucauggcuua

SEQ ID NO: 190951 - RNA, 22 nt, Homo sapiens
agugcaaagccgagguuucuug

SEQ ID NO: 190952 - RNA, 22 nt, Homo sapiens
agugcaauggugccaucauagc

SEQ ID NO: 190953 - RNA, 22 nt, Homo sapiens
agugcaguugucacgugccuuc

SEQ ID NO: 190954 - RNA, 22 nt, Homo sapiens
aguggcuuuuuaguggcagaug

SEQ ID NO: 190955 - RNA, 22 nt, Homo sapiens
aguuggccccuacugggaggug

SEQ ID NO: 190956 - RNA, 22 nt, Homo sapiens
auaaaguucugcuggcauauau

SEQ ID NO: 190957 - RNA, 19 nt, Homo sapiens
auaaaugccuacaagggug

SEQ ID NO: 190958 - RNA, 22 nt, Homo sapiens
auaaaugcuuagaucuguauau

SEQ ID NO: 190959 - RNA, 22 nt, Homo sapiens
auaagagcaggcuucuggccag

SEQ ID NO: 190960 - RNA, 22 nt, Homo sapiens
auaaucaugucugaaaccuuug

SEQ ID NO: 190961 - RNA, 22 nt, Homo sapiens
auaauguuugauugagcagaua

SEQ ID NO: 190962 - RNA, 22 nt, Homo sapiens
auacauguuucauguuggugug

SEQ ID NO: 190963 - RNA, 21 nt, Homo sapiens
auacuugagacuggguaauuu

SEQ ID NO: 190964 - RNA, 20 nt, Homo sapiens
auagaagacuagugcagcag

SEQ ID NO: 190965 - RNA, 22 nt, Homo sapiens
auagaucauugucauuuuagau

SEQ ID NO: 190966 - RNA, 21 nt, Homo sapiens
auagcacaucagauuuuauua

SEQ ID NO: 190967 - RNA, 22 nt, Homo sapiens
auagcagaacagugucucacug

SEQ ID NO: 190968 - RNA, 22 nt, Homo sapiens
auagcagacauuucaaggcagg

SEQ ID NO: 190969 - RNA, 22 nt, Homo sapiens
auagcagaccaccucucccacu

SEQ ID NO: 190970 - RNA, 22 nt, Homo sapiens
auagcagugugaaaauugacug

SEQ ID NO: 190971 - RNA, 22 nt, Homo sapiens
auagcugcucaggcuuuccuca

SEQ ID NO: 190972 - RNA, 22 nt, Homo sapiens
auagucaguagucucauaauga

SEQ ID NO: 190973 - RNA, 22 nt, Homo sapiens
auauaccuaggcuacaugguuu

SEQ ID NO: 190974 - RNA, 22 nt, Homo sapiens
auauagcaaugaaagagaugaa

SEQ ID NO: 190975 - RNA, 22 nt, Homo sapiens
auauaugcuaagugcuaauaaa

SEQ ID NO: 190976 - RNA, 22 nt, Homo sapiens
auaugcaaauccauagagacag

SEQ ID NO: 190977 - RNA, 22 nt, Homo sapiens
auauuagguuggugccaaagua

SEQ ID NO: 190978 - RNA, 22 nt, Homo sapiens
aucaagcugcuuguuugaaucu

SEQ ID NO: 190979 - RNA, 22 nt, Homo sapiens
aucaaguaaucugaguaagagu

SEQ ID NO: 190980 - RNA, 22 nt, Homo sapiens
aucacagcccuccucuuggaug

SEQ ID NO: 190981 - RNA, 22 nt, Homo sapiens
aucacagugaaaacagucaauu

SEQ ID NO: 190982 - RNA, 20 nt, Homo sapiens
aucacuggagaaggaaaccu

SEQ ID NO: 190983 - RNA, 22 nt, Homo sapiens
aucacuggccuuuuuaaaugcu

SEQ ID NO: 190984 - RNA, 22 nt, Homo sapiens
aucacuguaaguuuacacuuug

SEQ ID NO: 190985 - RNA, 22 nt, Homo sapiens
aucacugugauuucuacugugc

SEQ ID NO: 190986 - RNA, 22 nt, Homo sapiens
aucagcauucccaaaugaugug

SEQ ID NO: 190987 - RNA, 22 nt, Homo sapiens
aucagugcauguuuguugagcu

SEQ ID NO: 190988 - RNA, 22 nt, Homo sapiens
aucaucacaguuguguguaaug

SEQ ID NO: 190989 - RNA, 22 nt, Homo sapiens
aucauggaguauuugcaagucu

SEQ ID NO: 190990 - RNA, 22 nt, Homo sapiens
auccaucagacggcaggcguug

SEQ ID NO: 190991 - RNA, 22 nt, Homo sapiens
aucccugugauccaaucacuuc

SEQ ID NO: 190992 - RNA, 22 nt, Homo sapiens
aucccuuccuagcacuuggugu

SEQ ID NO: 190993 - RNA, 22 nt, Homo sapiens
aucugauggagagcguguggcu

SEQ ID NO: 190994 - RNA, 22 nt, Homo sapiens
aucuggcguuuacuuccuuccu

SEQ ID NO: 190995 - RNA, 22 nt, Homo sapiens
aucuuuggcgggaauaucacag

SEQ ID NO: 190996 - RNA, 22 nt, Homo sapiens
augaaagguauguuuucuguga

SEQ ID NO: 190997 - RNA, 22 nt, Homo sapiens
augaaaucuuuggcagaucuua

SEQ ID NO: 190998 - RNA, 22 nt, Homo sapiens
augaaaugcauguuaaguccgu

SEQ ID NO: 190999 - RNA, 22 nt, Homo sapiens
augaagugcaugauaguugguu

SEQ ID NO: 191000 - RNA, 23 nt, Homo sapiens
augaauguaaggaguguaagaaa

SEQ ID NO: 191001 - RNA, 22 nt, Homo sapiens
augaauucaucugguuuuggga

SEQ ID NO: 191002 - RNA, 22 nt, Homo sapiens
augacaguaugacuccaaaagu

SEQ ID NO: 191003 - RNA, 22 nt, Homo sapiens
augagacaguucccuuuaucuu

SEQ ID NO: 191004 - RNA, 22 nt, Homo sapiens
augagauaggaacaaacuuaca

SEQ ID NO: 191005 - RNA, 22 nt, Homo sapiens
augagauauuuuauaagaucau

SEQ ID NO: 191006 - RNA, 22 nt, Homo sapiens
augagcaucaccagaaucaaua

SEQ ID NO: 191007 - RNA, 22 nt, Homo sapiens
augaggcacugcgcccuacuga

SEQ ID NO: 191008 - RNA, 22 nt, Homo sapiens
augagggcggacgcccuggaga

SEQ ID NO: 191009 - RNA, 22 nt, Homo sapiens
augaucacaccacugcacucca

SEQ ID NO: 191010 - RNA, 22 nt, Homo sapiens
augauuuuuguaucgccugaug

SEQ ID NO: 191011 - RNA, 22 nt, Homo sapiens
augcacaucagcuccagggacc

SEQ ID NO: 191012 - RNA, 22 nt, Homo sapiens
augcacaugcgaaaacuugugu

SEQ ID NO: 191013 - RNA, 22 nt, Homo sapiens
augcacuuggcaggaugauucc

SEQ ID NO: 191014 - RNA, 22 nt, Homo sapiens
augcagauauuuuugugguugc

SEQ ID NO: 191015 - RNA, 22 nt, Homo sapiens
augcagugugcaacagauuaag

SEQ ID NO: 191016 - RNA, 22 nt, Homo sapiens
augcauaugucuuuauaguggc

SEQ ID NO: 191017 - RNA, 20 nt, Homo sapiens
augccacugagcagugguga

SEQ ID NO: 191018 - RNA, 22 nt, Homo sapiens
augccacugcacuucagcuugg

SEQ ID NO: 191019 - RNA, 22 nt, Homo sapiens
augcuacugaccccuacuuaca

SEQ ID NO: 191020 - RNA, 22 nt, Homo sapiens
auggaacuggagaugguuauau

SEQ ID NO: 191021 - RNA, 22 nt, Homo sapiens
auggaagucucuguuaaguuuc

SEQ ID NO: 191022 - RNA, 22 nt, Homo sapiens
auggacuuuuuguucagugucu

SEQ ID NO: 191023 - RNA, 22 nt, Homo sapiens
auggagagaauuauucucucag

SEQ ID NO: 191024 - RNA, 22 nt, Homo sapiens
auggagcaaaacagauuuggga

SEQ ID NO: 191025 - RNA, 22 nt, Homo sapiens
auggaguguaauauugagagcu

SEQ ID NO: 191026 - RNA, 22 nt, Homo sapiens
auggcaaaauguuccuaguggu

SEQ ID NO: 191027 - RNA, 18 nt, Homo sapiens
auggcagaacaauuuaca

SEQ ID NO: 191028 - RNA, 22 nt, Homo sapiens
auggcagagucagaaagucagg

SEQ ID NO: 191029 - RNA, 22 nt, Homo sapiens
auggcagcaccccacucuacug

SEQ ID NO: 191030 - RNA, 22 nt, Homo sapiens
auggcagcugguuuuacccuag

SEQ ID NO: 191031 - RNA, 22 nt, Homo sapiens
auggccugaugcaccuguccca

SEQ ID NO: 191032 - RNA, 22 nt, Homo sapiens
auggccuuguauaccuggcaaa

SEQ ID NO: 191033 - RNA, 22 nt, Homo sapiens
auggccuuucuggcacauuucc

SEQ ID NO: 191034 - RNA, 22 nt, Homo sapiens
auggcucaguguguaucuauca

SEQ ID NO: 191035 - RNA, 22 nt, Homo sapiens
auggcuuugggcugcucugccc

SEQ ID NO: 191036 - RNA, 22 nt, Homo sapiens
auguaaacagaugugcagcuug

SEQ ID NO: 191037 - RNA, 22 nt, Homo sapiens
auguaauguuaaauugcuaauu

SEQ ID NO: 191038 - RNA, 22 nt, Homo sapiens
augugacugauguaaucagaca

SEQ ID NO: 191039 - RNA, 22 nt, Homo sapiens
augugcaaagcacuguucagca

SEQ ID NO: 191040 - RNA, 22 nt, Homo sapiens
augugcaauggugucaccacau

SEQ ID NO: 191041 - RNA, 22 nt, Homo sapiens
augugcacaacgugcagguuug

SEQ ID NO: 191042 - RNA, 20 nt, Homo sapiens
augugcuaauauuaauaugu

SEQ ID NO: 191043 - RNA, 22 nt, Homo sapiens
augugcuuuuggugagagauuu

SEQ ID NO: 191044 - RNA, 22 nt, Homo sapiens
augugcuuuuuaaacagaugcu

SEQ ID NO: 191045 - RNA, 22 nt, Homo sapiens
auguguucaucacagcacaauu

SEQ ID NO: 191046 - RNA, 22 nt, Homo sapiens
auguuagcaucaauauucauca

SEQ ID NO: 191047 - RNA, 22 nt, Homo sapiens
auguuauguuaaugauaaugga

SEQ ID NO: 191048 - RNA, 22 nt, Homo sapiens
auuacaugucuauccaugaaca

SEQ ID NO: 191049 - RNA, 22 nt, Homo sapiens
auuauugacucauagaaaggau

SEQ ID NO: 191050 - RNA, 22 nt, Homo sapiens
auucaaggagucuucgucccaa

SEQ ID NO: 191051 - RNA, 22 nt, Homo sapiens
auucagaggggcagcugucuug

SEQ ID NO: 191052 - RNA, 22 nt, Homo sapiens
auuccacagccgauaccaugac

SEQ ID NO: 191053 - RNA, 22 nt, Homo sapiens
auuccacaguuaacacagaccg

SEQ ID NO: 191054 - RNA, 22 nt, Homo sapiens
auuccacuuagugacucauuug

SEQ ID NO: 191055 - RNA, 22 nt, Homo sapiens
auuccacuuauaugagguaucu

SEQ ID NO: 191056 - RNA, 20 nt, Homo sapiens
auuccacuuauaugaggucc

SEQ ID NO: 191057 - RNA, 22 nt, Homo sapiens
auuccagguggcgccauucaca

SEQ ID NO: 191058 - RNA, 22 nt, Homo sapiens
auugacuugauauauagcugau

SEQ ID NO: 191059 - RNA, 22 nt, Homo sapiens
auugagcacugacucugugcca

SEQ ID NO: 191060 - RNA, 22 nt, Homo sapiens
auugcaaugggaaacuaugaaa

SEQ ID NO: 191061 - RNA, 22 nt, Homo sapiens
auugcacuccacccugggcaac

SEQ ID NO: 191062 - RNA, 22 nt, Homo sapiens
auugcacuccagccuggcaaua

SEQ ID NO: 191063 - RNA, 22 nt, Homo sapiens
auugcacuccagucugggcaac

SEQ ID NO: 191064 - RNA, 22 nt, Homo sapiens
auugcacuccauccugggcaau

SEQ ID NO: 191065 - RNA, 22 nt, Homo sapiens
auugcacugcagccugggcaac

SEQ ID NO: 191066 - RNA, 23 nt, Homo sapiens
auugcagaaucacagagguagug

SEQ ID NO: 191067 - RNA, 22 nt, Homo sapiens
auugccacaucucagaggcaga

SEQ ID NO: 191068 - RNA, 22 nt, Homo sapiens
auugcccaggcuggagugcagu

SEQ ID NO: 191069 - RNA, 22 nt, Homo sapiens
auuguucuuacaugcugucauc

SEQ ID NO: 191070 - RNA, 22 nt, Homo sapiens
auuguucuuguguccuuuuccu

SEQ ID NO: 191071 - RNA, 22 nt, Homo sapiens
auuuggcagugaagggaucaca

SEQ ID NO: 191072 - RNA, 22 nt, Homo sapiens
auuuugguuacauaguugagcu

SEQ ID NO: 191073 - RNA, 22 nt, Homo sapiens
auuuuugguugguaggcuauua

SEQ ID NO: 191074 - RNA, 22 nt, Homo sapiens
auuuuugguuucaccugcacgc

SEQ ID NO: 191075 - RNA, 22 nt, Homo sapiens
caaagcuauagcaccagaggga

SEQ ID NO: 191076 - RNA, 22 nt, Homo sapiens
caaauacuuucauguugucuug

SEQ ID NO: 191077 - RNA, 22 nt, Homo sapiens
caagugaauaguugcucucaga

SEQ ID NO: 191078 - RNA, 22 nt, Homo sapiens
caauggcaaugaaauagugaga

SEQ ID NO: 191079 - RNA, 22 nt, Homo sapiens
cacagaauucauuggauuaccu

SEQ ID NO: 191080 - RNA, 21 nt, Homo sapiens
cacauggaggcagagagugua

SEQ ID NO: 191081 - RNA, 22 nt, Homo sapiens
caccacauuccauugaucaggc

SEQ ID NO: 191082 - RNA, 22 nt, Homo sapiens
caccgagguuggagugcagugg

SEQ ID NO: 191083 - RNA, 22 nt, Homo sapiens
cacugcacuccagucugacgac

SEQ ID NO: 191084 - RNA, 22 nt, Homo sapiens
cacugcacuccaguuuggauga

SEQ ID NO: 191085 - RNA, 22 nt, Homo sapiens
cacuuugguucaccugaguuuc

SEQ ID NO: 191086 - RNA, 22 nt, Homo sapiens
cagagcacugauacuggguucu

SEQ ID NO: 191087 - RNA, 22 nt, Homo sapiens
cagauacuggaguccugaaguu

SEQ ID NO: 191088 - RNA, 22 nt, Homo sapiens
cagauacuggccuggagcugug

SEQ ID NO: 191089 - RNA, 20 nt, Homo sapiens
cagcaaccugcucucuuccu

SEQ ID NO: 191090 - RNA, 22 nt, Homo sapiens
cagcacauuacaaguacuuggu

SEQ ID NO: 191091 - RNA, 20 nt, Homo sapiens
cagcacgcacaugagacugu

SEQ ID NO: 191092 - RNA, 22 nt, Homo sapiens
cagcucauugcagucucgaccu

SEQ ID NO: 191093 - RNA, 22 nt, Homo sapiens
cagcugguggcaagaagacaga

SEQ ID NO: 191094 - RNA, 22 nt, Homo sapiens
cagcuggugggagcuggguucc

SEQ ID NO: 191095 - RNA, 22 nt, Homo sapiens
cagcuguguuauaaacuaccau

SEQ ID NO: 191096 - RNA, 22 nt, Homo sapiens
cagcuguuguugggguauagga

SEQ ID NO: 191097 - RNA, 22 nt, Homo sapiens
caggcaacauggcgaaacucug

SEQ ID NO: 191098 - RNA, 22 nt, Homo sapiens
caggugcauuggcugacaccug

SEQ ID NO: 191099 - RNA, 22 nt, Homo sapiens
caguagcaugccucagaaugag

SEQ ID NO: 191100 - RNA, 20 nt, Homo sapiens
cagucaugaagaacugugag

SEQ ID NO: 191101 - RNA, 18 nt, Homo sapiens
cagugcaauacaggagag

SEQ ID NO: 191102 - RNA, 22 nt, Homo sapiens
cagugcauaggaucuaaaauuu

SEQ ID NO: 191103 - RNA, 22 nt, Homo sapiens
gagcaucaauggcaugugggaa

SEQ ID NO: 191104 - RNA, 22 nt, Homo sapiens
gagcuagcauuuagacaucugg

SEQ ID NO: 191105 - RNA, 22 nt, Homo sapiens
gaggaaguagcuacugucuuuc

SEQ ID NO: 191106 - RNA, 22 nt, Homo sapiens
gaggagauauucugcuggaugg

SEQ ID NO: 191107 - RNA, 22 nt, Homo sapiens
gagguggugguggaggcauagc

SEQ ID NO: 191108 - RNA, 22 nt, Homo sapiens
gagguugggaugagggauacag

SEQ ID NO: 191109 - RNA, 22 nt, Homo sapiens
gaguucaauuuccagcuguucu

SEQ ID NO: 191110 - RNA, 22 nt, Homo sapiens
gauaaaguauuggguacuaugc

SEQ ID NO: 191111 - RNA, 22 nt, Homo sapiens
gauauguguuuuagucaggguu

SEQ ID NO: 191112 - RNA, 22 nt, Homo sapiens
gaucaauuggcugaagacacgu

SEQ ID NO: 191113 - RNA, 22 nt, Homo sapiens
gaucacaguuccucacgggcau

SEQ ID NO: 191114 - RNA, 22 nt, Homo sapiens
gaugaucaugaccuacagaugg

SEQ ID NO: 191115 - RNA, 22 nt, Homo sapiens
gaugcaaauuaagcuugggaca

SEQ ID NO: 191116 - RNA, 22 nt, Homo sapiens
gaugcagcuaggauuugugaca

SEQ ID NO: 191117 - RNA, 22 nt, Homo sapiens
gaugcaguaagaaugcauagcg

SEQ ID NO: 191118 - RNA, 22 nt, Homo sapiens
gauuugagagaggguguuuaua

SEQ ID NO: 191119 - RNA, 22 nt, Homo sapiens
gauuuguauuaaaagugugacg

SEQ ID NO: 191120 - RNA, 23 nt, Homo sapiens
gcaaauaucguagagugucccug

SEQ ID NO: 191121 - RNA, 20 nt, Homo sapiens
gcaacauggccagagugaau

SEQ ID NO: 191122 - RNA, 22 nt, Homo sapiens
gcaagagguaucuuauuuuccc

SEQ ID NO: 191123 - RNA, 22 nt, Homo sapiens
gcaauguuacugaauguguuuu

SEQ ID NO: 191124 - RNA, 22 nt, Homo sapiens
gcacagucaacacuuauucacc

SEQ ID NO: 191125 - RNA, 22 nt, Homo sapiens
gcacugagagaagccccaagua

SEQ ID NO: 191126 - RNA, 22 nt, Homo sapiens
gcagagaaacaggucuaaggag

SEQ ID NO: 191127 - RNA, 22 nt, Homo sapiens
gcagaguauagagggcugggcc

SEQ ID NO: 191128 - RNA, 22 nt, Homo sapiens
gcagcauuaccaagacauggca

SEQ ID NO: 191129 - RNA, 22 nt, Homo sapiens
gcagugaugugaucauagcuca

SEQ ID NO: 191130 - RNA, 22 nt, Homo sapiens
gcagugcaugacgguauauaua

SEQ ID NO: 191131 - RNA, 22 nt, Homo sapiens
gcagugugauguuuuaaucuau

SEQ ID NO: 191132 - RNA, 22 nt, Homo sapiens
gcaguguggguagagggcaaga

SEQ ID NO: 191133 - RNA, 22 nt, Homo sapiens
gccaagaucugaauaauuaaga

SEQ ID NO: 191134 - RNA, 22 nt, Homo sapiens
gccaagauuuaauucaucaguu

SEQ ID NO: 191135 - RNA, 22 nt, Homo sapiens
gccauugcacuccagccugagc

SEQ ID NO: 191136 - RNA, 22 nt, Homo sapiens
gccauugcacuccgcccugggc

SEQ ID NO: 191137 - RNA, 22 nt, Homo sapiens
gcccauuguuccuaggcuacaa

SEQ ID NO: 191138 - RNA, 22 nt, Homo sapiens
gcuaaggcaggagcauugcuug

SEQ ID NO: 191139 - RNA, 22 nt, Homo sapiens
gcucugguuacaaaggcaaauu

SEQ ID NO: 191140 - RNA, 22 nt, Homo sapiens
gcugagguucaagaagguuaaa

SEQ ID NO: 191141 - RNA, 22 nt, Homo sapiens
gcuggguucagagugggcugcg

SEQ ID NO: 191142 - RNA, 22 nt, Homo sapiens
gcuggguugccagguuacuuaa

SEQ ID NO: 191143 - RNA, 22 nt, Homo sapiens
ggaaauguuggugucaugaguu

SEQ ID NO: 191144 - RNA, 23 nt, Homo sapiens
ggaaauguuuaagggguugggag

SEQ ID NO: 191145 - RNA, 22 nt, Homo sapiens
ggaagguaauuggguaaugaga

SEQ ID NO: 191146 - RNA, 22 nt, Homo sapiens
ggaagguaauugucagcucaua

SEQ ID NO: 191147 - RNA, 19 nt, Homo sapiens
ggaaugcaccaguccuugc

SEQ ID NO: 191148 - RNA, 22 nt, Homo sapiens
ggaaugggauuugaagucuggc

SEQ ID NO: 191149 - RNA, 22 nt, Homo sapiens
ggacaaaguauuuucaaaugua

SEQ ID NO: 191150 - RNA, 22 nt, Homo sapiens
ggacaagagacugggacacuga

SEQ ID NO: 191151 - RNA, 22 nt, Homo sapiens
ggagagcuaggcagagguuugu

SEQ ID NO: 191152 - RNA, 22 nt, Homo sapiens
ggagggugagaucaauuuggga

SEQ ID NO: 191153 - RNA, 22 nt, Homo sapiens
ggaguguguuuuccaacuuggu

SEQ ID NO: 191154 - RNA, 22 nt, Homo sapiens
ggaguguuccauuugucacauu

SEQ ID NO: 191155 - RNA, 22 nt, Homo sapiens
ggauaucauuauuucuagggcu

SEQ ID NO: 191156 - RNA, 23 nt, Homo sapiens
ggauucaucuguuuguucgcugu

SEQ ID NO: 191157 - RNA, 22 nt, Homo sapiens
ggcaagugucagcagcaacacc

SEQ ID NO: 191158 - RNA, 22 nt, Homo sapiens
ggcacugugaugugagggggua

SEQ ID NO: 191159 - RNA, 19 nt, Homo sapiens
ggcacugugugagugagga

SEQ ID NO: 191160 - RNA, 22 nt, Homo sapiens
ggcagagucuugcaucuuuaga

SEQ ID NO: 191161 - RNA, 22 nt, Homo sapiens
ggcaguguaauaauuuauuaau

SEQ ID NO: 191162 - RNA, 22 nt, Homo sapiens
ggccagaugcaguggcucacac

SEQ ID NO: 191163 - RNA, 22 nt, Homo sapiens
ggcuguguguuaaaauaggcuu

SEQ ID NO: 191164 - RNA, 22 nt, Homo sapiens
gggaacaugagaaugugaauga

SEQ ID NO: 191165 - RNA, 22 nt, Homo sapiens
gggaagauauaggcugggcacc

SEQ ID NO: 191166 - RNA, 20 nt, Homo sapiens
gggaaugcaaauucucaucc

SEQ ID NO: 191167 - RNA, 22 nt, Homo sapiens
gggagugucuaaccuguuaaca

SEQ ID NO: 191168 - RNA, 22 nt, Homo sapiens
gggguuuuaccuucguauucuu

SEQ ID NO: 191169 - RNA, 22 nt, Homo sapiens
gguaaaucuucacuaagacuga

SEQ ID NO: 191170 - RNA, 22 nt, Homo sapiens
guaaacuuccccucaugaauga

SEQ ID NO: 191171 - RNA, 22 nt, Homo sapiens
guaaaguaaagcacaucaaggu

SEQ ID NO: 191172 - RNA, 22 nt, Homo sapiens
guaaaucucuguuuucauggac

SEQ ID NO: 191173 - RNA, 22 nt, Homo sapiens
guaacacaugcugcucucuggu

SEQ ID NO: 191174 - RNA, 22 nt, Homo sapiens
guaagagcauguaguggcucua

SEQ ID NO: 191175 - RNA, 19 nt, Homo sapiens
guaaucucaguacuuuggu

SEQ ID NO: 191176 - RNA, 22 nt, Homo sapiens
guacaggcagcaaacaccauaa

SEQ ID NO: 191177 - RNA, 22 nt, Homo sapiens
guacauggaaugaaauucaaaa

SEQ ID NO: 191178 - RNA, 22 nt, Homo sapiens
guagaaaguuugcugucacaug

SEQ ID NO: 191179 - RNA, 22 nt, Homo sapiens
guaucauuggcauguaaccaga

SEQ ID NO: 191180 - RNA, 21 nt, Homo sapiens
guaugguugaagugacaagcc

SEQ ID NO: 191181 - RNA, 22 nt, Homo sapiens
guauuagguuggggcaaaagua

SEQ ID NO: 191182 - RNA, 18 nt, Homo sapiens
guauuccagccugaguga

SEQ ID NO: 191183 - RNA, 22 nt, Homo sapiens
guauuuguugcagcagcacuau

SEQ ID NO: 191184 - RNA, 22 nt, Homo sapiens
gucagugucuuugcagcucaga

SEQ ID NO: 191185 - RNA, 22 nt, Homo sapiens
gucauggaaaucuacauuguua

SEQ ID NO: 191186 - RNA, 22 nt, Homo sapiens
gucauggaacaacuuaaaguca

SEQ ID NO: 191187 - RNA, 22 nt, Homo sapiens
gucauugaaguggaaucaucca

SEQ ID NO: 191188 - RNA, 22 nt, Homo sapiens
gucauugagucagggaguaucu

SEQ ID NO: 191189 - RNA, 22 nt, Homo sapiens
gucccaguggaaccuccaagcu

SEQ ID NO: 191190 - RNA, 22 nt, Homo sapiens
gucccugugucuuuauguggcc

SEQ ID NO: 191191 - RNA, 22 nt, Homo sapiens
gucucccaaccccugugcccag

SEQ ID NO: 191192 - RNA, 22 nt, Homo sapiens
gucuggcaauggcagacuggca

SEQ ID NO: 191193 - RNA, 22 nt, Homo sapiens
gucugguuggaguaguuuucag

SEQ ID NO: 191194 - RNA, 22 nt, Homo sapiens
gucuugcacuuaccuaagaacu

SEQ ID NO: 191195 - RNA, 22 nt, Homo sapiens
gugaagaucccuguccuguucc

SEQ ID NO: 191196 - RNA, 22 nt, Homo sapiens
gugaagugugaccucagcaucu

SEQ ID NO: 191197 - RNA, 22 nt, Homo sapiens
gugacauuauuucagcuacaug

SEQ ID NO: 191198 - RNA, 22 nt, Homo sapiens
gugagaaucaaacuacauaaau

SEQ ID NO: 191199 - RNA, 22 nt, Homo sapiens
gugagauggaguuggugucuuu

SEQ ID NO: 191200 - RNA, 22 nt, Homo sapiens
uaguagcauaccuaaguauacu

SEQ ID NO: 191201 - RNA, 22 nt, Homo sapiens
uagugcugagauugagaagccc

SEQ ID NO: 191202 - RNA, 22 nt, Homo sapiens
uauaacaaugcaagaauggccu

SEQ ID NO: 191203 - RNA, 22 nt, Homo sapiens
uauaguguuuucaaaaguaugu

SEQ ID NO: 191204 - RNA, 22 nt, Homo sapiens
uauaugcaacauaguguaugug

SEQ ID NO: 191205 - RNA, 23 nt, Homo sapiens
uauaugugucuaggagcuauggu

SEQ ID NO: 191206 - RNA, 19 nt, Homo sapiens
uaucaaguaugcacuguac

SEQ ID NO: 191207 - RNA, 23 nt, Homo sapiens
uaucacacuuucucugugccaca

SEQ ID NO: 191208 - RNA, 22 nt, Homo sapiens
uaucacagcgggguguacaccc

SEQ ID NO: 191209 - RNA, 22 nt, Homo sapiens
uaucacaggucaggaaccuugu

SEQ ID NO: 191210 - RNA, 22 nt, Homo sapiens
uaucacuuugauaguuuaaaug

SEQ ID NO: 191211 - RNA, 22 nt, Homo sapiens
uaucauggaaagauguugaaau

SEQ ID NO: 191212 - RNA, 21 nt, Homo sapiens
uaucauggugaaacccugucu

SEQ ID NO: 191213 - RNA, 18 nt, Homo sapiens
uaucauguagggaaguug

SEQ ID NO: 191214 - RNA, 18 nt, Homo sapiens
uaucucauuucuuagguc

SEQ ID NO: 191215 - RNA, 22 nt, Homo sapiens
uaugaauuuuauccaggauaua

SEQ ID NO: 191216 - RNA, 22 nt, Homo sapiens
uaugacuuuggaaaaauuacuu

SEQ ID NO: 191217 - RNA, 22 nt, Homo sapiens
uaugcacacguguccaugugca

SEQ ID NO: 191218 - RNA, 22 nt, Homo sapiens
uaugcagacauuguuccaacca

SEQ ID NO: 191219 - RNA, 22 nt, Homo sapiens
uauggcuucuauaaggaagcuu

SEQ ID NO: 191220 - RNA, 22 nt, Homo sapiens
uauggcuucuuuaaauugaggu

SEQ ID NO: 191221 - RNA, 22 nt, Homo sapiens
uauuacugucaauaucacagaa

SEQ ID NO: 191222 - RNA, 22 nt, Homo sapiens
uauuaugcacuuuauaaaaauu

SEQ ID NO: 191223 - RNA, 22 nt, Homo sapiens
uauuauuguccuucuauaccca

SEQ ID NO: 191224 - RNA, 22 nt, Homo sapiens
uauuccacuauuaguccagaug

SEQ ID NO: 191225 - RNA, 22 nt, Homo sapiens
uauuccacucuguuggagguaa

SEQ ID NO: 191226 - RNA, 22 nt, Homo sapiens
uauugcauuugagguugguuga

SEQ ID NO: 191227 - RNA, 22 nt, Homo sapiens
uauugccugucuccaaaaauca

SEQ ID NO: 191228 - RNA, 22 nt, Homo sapiens
uauugcuggcucugucuucauu

SEQ ID NO: 191229 - RNA, 22 nt, Homo sapiens
uauuuguccccuccaaaaguca

SEQ ID NO: 191230 - RNA, 22 nt, Homo sapiens
ucaaagacacacaaggagaagg

SEQ ID NO: 191231 - RNA, 22 nt, Homo sapiens
ucaaaguaaagccucaggaugg

SEQ ID NO: 191232 - RNA, 22 nt, Homo sapiens
ucaaaugauucagaagccaccu

SEQ ID NO: 191233 - RNA, 22 nt, Homo sapiens
ucaagcaauucuccucucagcc

SEQ ID NO: 191234 - RNA, 22 nt, Homo sapiens
ucaaguaauacucccaucuugg

SEQ ID NO: 191235 - RNA, 22 nt, Homo sapiens
ucaaugaaugaugguugguaug

SEQ ID NO: 191236 - RNA, 22 nt, Homo sapiens
ucaaugcaaccuccaccucugg

SEQ ID NO: 191237 - RNA, 22 nt, Homo sapiens
ucaauguaucuccaagaauuga

SEQ ID NO: 191238 - RNA, 19 nt, Homo sapiens
ucaauucugucaauggcuu

SEQ ID NO: 191239 - RNA, 22 nt, Homo sapiens
ucacaauucacuacaggcuuga

SEQ ID NO: 191240 - RNA, 22 nt, Homo sapiens
ucacaggguguuauuagaauua

SEQ ID NO: 191241 - RNA, 19 nt, Homo sapiens
ucacaggguugacuugagg

SEQ ID NO: 191242 - RNA, 22 nt, Homo sapiens
ucacaguaaauccagaagaaau

SEQ ID NO: 191243 - RNA, 22 nt, Homo sapiens
ucacaugugacauauauauuug

SEQ ID NO: 191244 - RNA, 22 nt, Homo sapiens
ucacauguguaugagcuuugau

SEQ ID NO: 191245 - RNA, 20 nt, Homo sapiens
ucacccugacaucugcccag

SEQ ID NO: 191246 - RNA, 22 nt, Homo sapiens
ucaccuggggaucuuguuuaca

SEQ ID NO: 191247 - RNA, 18 nt, Homo sapiens
ucaccuugaugcuggguc

SEQ ID NO: 191248 - RNA, 22 nt, Homo sapiens
ucacgugguucauaaggcagaa

SEQ ID NO: 191249 - RNA, 20 nt, Homo sapiens
ucacuauggagcucuuucuu

SEQ ID NO: 191250 - RNA, 22 nt, Homo sapiens
ucacugagcacaggagaugugc

SEQ ID NO: 191251 - RNA, 21 nt, Homo sapiens
ucacugagguuaaauaggguu

SEQ ID NO: 191252 - RNA, 20 nt, Homo sapiens
ucacugugaacuucuugagg

SEQ ID NO: 191253 - RNA, 22 nt, Homo sapiens
ucacugugguuugggaaagugc

SEQ ID NO: 191254 - RNA, 22 nt, Homo sapiens
ucacuguguauguauaugcagg

SEQ ID NO: 191255 - RNA, 22 nt, Homo sapiens
ucacugugugucucuguaucug

SEQ ID NO: 191256 - RNA, 22 nt, Homo sapiens
ucacuugguggcaaaguuuaug

SEQ ID NO: 191257 - RNA, 22 nt, Homo sapiens
ucacuuugacggccaacuucua

SEQ ID NO: 191258 - RNA, 22 nt, Homo sapiens
ucagaacugaacaaaccagucu

SEQ ID NO: 191259 - RNA, 22 nt, Homo sapiens
ucagauacuggugacaugaaug

SEQ ID NO: 191260 - RNA, 22 nt, Homo sapiens
ucagguaguuugugggagauga

SEQ ID NO: 191261 - RNA, 22 nt, Homo sapiens
ucaggugcaguggcucaugcuu

SEQ ID NO: 191262 - RNA, 22 nt, Homo sapiens
ucaguaccugagagugggcaga

SEQ ID NO: 191263 - RNA, 22 nt, Homo sapiens
ucagugaauauauaacagcgau

SEQ ID NO: 191264 - RNA, 22 nt, Homo sapiens
ucagugacugcugcuuguauac

SEQ ID NO: 191265 - RNA, 22 nt, Homo sapiens
ucagugcgugcauagccuggau

SEQ ID NO: 191266 - RNA, 22 nt, Homo sapiens
ucagugcuuggcacagagagcu

SEQ ID NO: 191267 - RNA, 22 nt, Homo sapiens
ucagugggcuauguaauuaacu

SEQ ID NO: 191268 - RNA, 22 nt, Homo sapiens
ucauacuguugugaaacaaaac

SEQ ID NO: 191269 - RNA, 22 nt, Homo sapiens
ucaucagaguuuacaagcucag

SEQ ID NO: 191270 - RNA, 21 nt, Homo sapiens
ucaucagucaaagacaauggu

SEQ ID NO: 191271 - RNA, 22 nt, Homo sapiens
ucaugacacuggcaggagcuaa

SEQ ID NO: 191272 - RNA, 22 nt, Homo sapiens
ucauggcacugaugagaguuuc

SEQ ID NO: 191273 - RNA, 22 nt, Homo sapiens
ucauugcacucccagacacccu

SEQ ID NO: 191274 - RNA, 22 nt, Homo sapiens
uccagguacucagggggcugag

SEQ ID NO: 191275 - RNA, 22 nt, Homo sapiens
uccagguuucaugcucuuuauu

SEQ ID NO: 191276 - RNA, 22 nt, Homo sapiens
uccagguuuugugaguuuaaau

SEQ ID NO: 191277 - RNA, 22 nt, Homo sapiens
uccauggagacacauuuuauau

SEQ ID NO: 191278 - RNA, 19 nt, Homo sapiens
ucccaauguuuccaggcag

SEQ ID NO: 191279 - RNA, 22 nt, Homo sapiens
uccccugauaccaaccaccaug

SEQ ID NO: 191280 - RNA, 22 nt, Homo sapiens
ucccuguuaggcacagauuuau

SEQ ID NO: 191281 - RNA, 22 nt, Homo sapiens
ucccuuucuggaguuucccaag

SEQ ID NO: 191282 - RNA, 22 nt, Homo sapiens
uccucaguggauuggauggugc

SEQ ID NO: 191283 - RNA, 22 nt, Homo sapiens
uccucauggagaaccucugcua

SEQ ID NO: 191284 - RNA, 21 nt, Homo sapiens
uccugagagaggaguaacucu

SEQ ID NO: 191285 - RNA, 22 nt, Homo sapiens
uccugagagcagacccucuaua

SEQ ID NO: 191286 - RNA, 22 nt, Homo sapiens
uccugcauucugacuugcuuuc

SEQ ID NO: 191287 - RNA, 22 nt, Homo sapiens
uccuucaugcaucaauguaucc

SEQ ID NO: 191288 - RNA, 22 nt, Homo sapiens
uccuuugguucuugucacccca

SEQ ID NO: 191289 - RNA, 22 nt, Homo sapiens
ucucacacugaauguguguggg

SEQ ID NO: 191290 - RNA, 22 nt, Homo sapiens
ucucacagaguugaacuuucuu

SEQ ID NO: 191291 - RNA, 22 nt, Homo sapiens
ucucacauuucacagggauggg

SEQ ID NO: 191292 - RNA, 22 nt, Homo sapiens
ucucagagccuaggguuuuuca

SEQ ID NO: 191293 - RNA, 22 nt, Homo sapiens
ucucagcacaaacaaaauugcu

SEQ ID NO: 191294 - RNA, 22 nt, Homo sapiens
ucucagugaauugguuuugucu

SEQ ID NO: 191295 - RNA, 19 nt, Homo sapiens
ucucaguguuggucaggug

SEQ ID NO: 191296 - RNA, 22 nt, Homo sapiens
ucucccauccaugaacuucugu

SEQ ID NO: 191297 - RNA, 22 nt, Homo sapiens
aaaagugguguuguuucuaaau

SEQ ID NO: 191298 - RNA, 22 nt, Homo sapiens
aaaaugcugauauugggcccca

SEQ ID NO: 191299 - RNA, 22 nt, Homo sapiens
aaacugaucugaaggccaggcu

SEQ ID NO: 191300 - RNA, 22 nt, Homo sapiens
aaagcacuggagucaucaucua

SEQ ID NO: 191301 - RNA, 22 nt, Homo sapiens
aaaggcaucugcucggcucccu

SEQ ID NO: 191302 - RNA, 22 nt, Homo sapiens
aaagggcuugaauacucuuuuu

SEQ ID NO: 191303 - RNA, 19 nt, Homo sapiens
aaagguaguaaccucugau

SEQ ID NO: 191304 - RNA, 22 nt, Homo sapiens
aaaguaauugcaguuuuugcaa

SEQ ID NO: 191305 - RNA, 22 nt, Homo sapiens
aaagugcaguacuucguauauu

SEQ ID NO: 191306 - RNA, 22 nt, Homo sapiens
aaagugcugagucuaggcgggg

SEQ ID NO: 191307 - RNA, 22 nt, Homo sapiens
aaagugcugggauuaggccagg

SEQ ID NO: 191308 - RNA, 22 nt, Homo sapiens
aaagugcugggauuggccgggc

SEQ ID NO: 191309 - RNA, 22 nt, Homo sapiens
aaaguggugggauuccaggcau

SEQ ID NO: 191310 - RNA, 22 nt, Homo sapiens
aaaguucuguugauagugcuga

SEQ ID NO: 191311 - RNA, 22 nt, Homo sapiens
aaauaacugucagguucuggaa

SEQ ID NO: 191312 - RNA, 22 nt, Homo sapiens
aaauccauuuguucagcuaugc

SEQ ID NO: 191313 - RNA, 22 nt, Homo sapiens
aaaugacuuuuuaugcagagua

SEQ ID NO: 191314 - RNA, 22 nt, Homo sapiens
aaaugcacaaagauuuugcacu

SEQ ID NO: 191315 - RNA, 22 nt, Homo sapiens
aaaugcacagaaaggaugugga

SEQ ID NO: 191316 - RNA, 22 nt, Homo sapiens
aaaugcagucuuuguucugggc

SEQ ID NO: 191317 - RNA, 22 nt, Homo sapiens
aaaugguguuaguagaucuuua

SEQ ID NO: 191318 - RNA, 22 nt, Homo sapiens
aaauucaucaaaugguuuguau

SEQ ID NO: 191319 - RNA, 18 nt, Homo sapiens
aaauucugucccuucuuc

SEQ ID NO: 191320 - RNA, 20 nt, Homo sapiens
aacagcacugucugaagcuu

SEQ ID NO: 191321 - RNA, 22 nt, Homo sapiens
aacagucaauugcugaugaccu

SEQ ID NO: 191322 - RNA, 22 nt, Homo sapiens
aacagucuccaguuguauccau

SEQ ID NO: 191323 - RNA, 22 nt, Homo sapiens
uucaccaguuuugucacgaaug

SEQ ID NO: 191324 - RNA, 22 nt, Homo sapiens
uucaccuggaguucaggauaag

SEQ ID NO: 191325 - RNA, 23 nt, Homo sapiens
uucaccugguuauuaauagccuc

SEQ ID NO: 191326 - RNA, 22 nt, Homo sapiens
uucaccuguagcaugcccuugg

SEQ ID NO: 191327 - RNA, 19 nt, Homo sapiens
uucacguaggagaaagaag

SEQ ID NO: 191328 - RNA, 22 nt, Homo sapiens
uucacugcacuccagccugggu

SEQ ID NO: 191329 - RNA, 22 nt, Homo sapiens
uucagaguggacagaaauuaag

SEQ ID NO: 191330 - RNA, 22 nt, Homo sapiens
uucaggcuccugugagaaucua

SEQ ID NO: 191331 - RNA, 22 nt, Homo sapiens
uucaguacuucaaaaucuuuaa

SEQ ID NO: 191332 - RNA, 22 nt, Homo sapiens
uucauagucacauucgaugucu

SEQ ID NO: 191333 - RNA, 21 nt, Homo sapiens
uucaucagccagaaaucaagc

SEQ ID NO: 191334 - RNA, 23 nt, Homo sapiens
uucaucagggauauuggccugaa

SEQ ID NO: 191335 - RNA, 22 nt, Homo sapiens
uucaucaguugagcugguugcu

SEQ ID NO: 191336 - RNA, 22 nt, Homo sapiens
uucauggaauauugaccauuuu

SEQ ID NO: 191337 - RNA, 22 nt, Homo sapiens
uucauggacucaauaguuucgc

SEQ ID NO: 191338 - RNA, 22 nt, Homo sapiens
uucauggaguugagaaggcuaa

SEQ ID NO: 191339 - RNA, 22 nt, Homo sapiens
uucauggguuaauuuguucgau

SEQ ID NO: 191340 - RNA, 22 nt, Homo sapiens
uucauguaauauauuucaggcc

SEQ ID NO: 191341 - RNA, 22 nt, Homo sapiens
uucauugaaugauuuuuagaag

SEQ ID NO: 191342 - RNA, 22 nt, Homo sapiens
uuccagagucaccuuucugucg

SEQ ID NO: 191343 - RNA, 20 nt, Homo sapiens
uuccagcacauuagggaagc

SEQ ID NO: 191344 - RNA, 22 nt, Homo sapiens
uuccaguggacuacuucauccu

SEQ ID NO: 191345 - RNA, 22 nt, Homo sapiens
uucccagagccugggagugagg

SEQ ID NO: 191346 - RNA, 22 nt, Homo sapiens
uucccaguaaacucuaucccuc

SEQ ID NO: 191347 - RNA, 22 nt, Homo sapiens
uucccugugguauagaagccgu

SEQ ID NO: 191348 - RNA, 22 nt, Homo sapiens
uucccugugugcagaugggugu

SEQ ID NO: 191349 - RNA, 19 nt, Homo sapiens
uuccugagaacaagggcuu

SEQ ID NO: 191350 - RNA, 22 nt, Homo sapiens
uuccugagaucagaauucaaau

SEQ ID NO: 191351 - RNA, 22 nt, Homo sapiens
uuccuguagcgauuuuaguaau

SEQ ID NO: 191352 - RNA, 21 nt, Homo sapiens
uucuaaguaaauguuggacau

SEQ ID NO: 191353 - RNA, 22 nt, Homo sapiens
uucuacaggcuguucaagaagc

SEQ ID NO: 191354 - RNA, 22 nt, Homo sapiens
uucuaugguuuuuaugguguua

SEQ ID NO: 191355 - RNA, 22 nt, Homo sapiens
uucucaguaauuccagauuuuu

SEQ ID NO: 191356 - RNA, 22 nt, Homo sapiens
uucucugggacauaggucgggu

SEQ ID NO: 191357 - RNA, 22 nt, Homo sapiens
uucugcuugaucuaguguguug

SEQ ID NO: 191358 - RNA, 22 nt, Homo sapiens
uucuggcuaugggauacuaaau

SEQ ID NO: 191359 - RNA, 22 nt, Homo sapiens
uucuggcuuauaaacgugacuu

SEQ ID NO: 191360 - RNA, 22 nt, Homo sapiens
uugaaaguaaacaucacaaaga

SEQ ID NO: 191361 - RNA, 22 nt, Homo sapiens
uugaaaguguucacaaugguau

SEQ ID NO: 191362 - RNA, 22 nt, Homo sapiens
uugaagacuaccuaccauacuu

SEQ ID NO: 191363 - RNA, 22 nt, Homo sapiens
uugaaguagcauuucaugucua

SEQ ID NO: 191364 - RNA, 22 nt, Homo sapiens
uugaaugaaauuggugugggga

SEQ ID NO: 191365 - RNA, 22 nt, Homo sapiens
uugaaugaauggaaagaagggu

SEQ ID NO: 191366 - RNA, 22 nt, Homo sapiens
uugacauaguuucugaaauaga

SEQ ID NO: 191367 - RNA, 22 nt, Homo sapiens
uugacauugcuguaguguccag

SEQ ID NO: 191368 - RNA, 22 nt, Homo sapiens
uugagcaaugucacugaggcuu

SEQ ID NO: 191369 - RNA, 22 nt, Homo sapiens
uugagccaaggauugucuuucc

SEQ ID NO: 191370 - RNA, 22 nt, Homo sapiens
uugagcucaucaagauagagaa

SEQ ID NO: 191371 - RNA, 22 nt, Homo sapiens
uugaggugggaggaucacuuga

SEQ ID NO: 191372 - RNA, 22 nt, Homo sapiens
uugaucaauagaauacaacaga

SEQ ID NO: 191373 - RNA, 22 nt, Homo sapiens
uugcaacauuguaaguuuauau

SEQ ID NO: 191374 - RNA, 22 nt, Homo sapiens
uugcacaguguguacagcacca

SEQ ID NO: 191375 - RNA, 22 nt, Homo sapiens
uugcacuccagccugggugaca

SEQ ID NO: 191376 - RNA, 22 nt, Homo sapiens
uugcacuccagccuuggggaga

SEQ ID NO: 191377 - RNA, 22 nt, Homo sapiens
uugcacuccagucuggggggca

SEQ ID NO: 191378 - RNA, 22 nt, Homo sapiens
uugcacucuagccugggugaca

SEQ ID NO: 191379 - RNA, 22 nt, Homo sapiens
uugcagcaacauggaugaaacu

SEQ ID NO: 191380 - RNA, 22 nt, Homo sapiens
uugcagugguuucacuggcaaa

SEQ ID NO: 191381 - RNA, 22 nt, Homo sapiens
uugcauagaccgaugucuugga

SEQ ID NO: 191382 - RNA, 22 nt, Homo sapiens
uugcaucagcaggcauaauugg

SEQ ID NO: 191383 - RNA, 22 nt, Homo sapiens
uugcaugggagcugggugaggc

SEQ ID NO: 191384 - RNA, 22 nt, Homo sapiens
uugccacuucucuugccccauu

SEQ ID NO: 191385 - RNA, 22 nt, Homo sapiens
uugcucaggcuggaguacaaug

SEQ ID NO: 191386 - RNA, 22 nt, Homo sapiens
uuggaaaaauccaccuugaucu

SEQ ID NO: 191387 - RNA, 22 nt, Homo sapiens
uuggaaacaccuggugagguua

SEQ ID NO: 191388 - RNA, 22 nt, Homo sapiens
uuggaaaugguaaaggguuaau

SEQ ID NO: 191389 - RNA, 22 nt, Homo sapiens
uuggaagauuacuuaguuuucu

SEQ ID NO: 191390 - RNA, 22 nt, Homo sapiens
uuggaaugcaacagaaggauaa

SEQ ID NO: 191391 - RNA, 22 nt, Homo sapiens
uuggaaugcacacugagccugc

SEQ ID NO: 191392 - RNA, 22 nt, Homo sapiens
uuggaauguauggcaucuugcg

SEQ ID NO: 191393 - RNA, 22 nt, Homo sapiens
uuggaaugugacugauaauauu

SEQ ID NO: 191394 - RNA, 18 nt, Homo sapiens
uuggacggagagucaaau

SEQ ID NO: 191395 - RNA, 22 nt, Homo sapiens
uuggacuucucaaggcaauaaa

SEQ ID NO: 191396 - RNA, 22 nt, Homo sapiens
uuggagagugauauucagaugc

SEQ ID NO: 191397 - RNA, 22 nt, Homo sapiens
uuggagugugcucauaacugcu

SEQ ID NO: 191398 - RNA, 22 nt, Homo sapiens
uuggcagaauguuagaaacuua

SEQ ID NO: 191399 - RNA, 22 nt, Homo sapiens
uuggcagaguuaauuuguugag

SEQ ID NO: 191400 - RNA, 22 nt, Homo sapiens
uugggcaauaggaagcaggugg

SEQ ID NO: 191401 - RNA, 22 nt, Homo sapiens
uugggccacuuuaguuuccuua

SEQ ID NO: 191402 - RNA, 22 nt, Homo sapiens
uugguaagguggaugaugaaua

SEQ ID NO: 191403 - RNA, 22 nt, Homo sapiens
uugguacuacacuucuaaucuu

SEQ ID NO: 191404 - RNA, 22 nt, Homo sapiens
uuggucaggcuaaucucgaacg

SEQ ID NO: 191405 - RNA, 22 nt, Homo sapiens
uugguucaguuuaacgaguaau

SEQ ID NO: 191406 - RNA, 22 nt, Homo sapiens
uugguucucuuagccaucuuaa

SEQ ID NO: 191407 - RNA, 22 nt, Homo sapiens
uuguaacaguuuauugacucga

SEQ ID NO: 191408 - RNA, 22 nt, Homo sapiens
uuguagcaaauauauuuuggaa

SEQ ID NO: 191409 - RNA, 22 nt, Homo sapiens
uuguauguugaaugaugguaua

SEQ ID NO: 191410 - RNA, 22 nt, Homo sapiens
uuguauguuucugugcacauga

SEQ ID NO: 191411 - RNA, 22 nt, Homo sapiens
uuguccacugcuagccucugca

SEQ ID NO: 191412 - RNA, 22 nt, Homo sapiens
uugugagggagcuaagaugagu

SEQ ID NO: 191413 - RNA, 22 nt, Homo sapiens
uugugcaaaguugugguuucug

SEQ ID NO: 191414 - RNA, 22 nt, Homo sapiens
uugugcuuguaacuacauucag

SEQ ID NO: 191415 - RNA, 22 nt, Homo sapiens
uugugcuuuuuaaauagcuucc

SEQ ID NO: 191416 - RNA, 22 nt, Homo sapiens
uuguguuuuuaguagggaaggg

SEQ ID NO: 191417 - RNA, 22 nt, Homo sapiens
uuguuuuggagaugagcuaaaa

SEQ ID NO: 191418 - RNA, 20 nt, Homo sapiens
uuuaagacaugcugaauuga

SEQ ID NO: 191419 - RNA, 22 nt, Homo sapiens
uuuaaugcaucccaaaauguag

SEQ ID NO: 191420 - RNA, 22 nt, Homo sapiens
gcugucaugagcaacacaugaa

SEQ ID NO: 191421 - RNA, 22 nt, Homo sapiens
gcugucuggagucuguucaaug

SEQ ID NO: 191422 - RNA, 20 nt, Homo sapiens
gcugugcuuaauacacuuuc

SEQ ID NO: 191423 - RNA, 22 nt, Homo sapiens
ggaagacaguguggugauuccu

SEQ ID NO: 191424 - RNA, 22 nt, Homo sapiens
ggaagagugaauuaucuugacu

SEQ ID NO: 191425 - RNA, 22 nt, Homo sapiens
ggaaugcagugagcauuagaua

SEQ ID NO: 191426 - RNA, 22 nt, Homo sapiens
ggacacaucaugugaccaaggu

SEQ ID NO: 191427 - RNA, 22 nt, Homo sapiens
ggacauuaacugcaagauagau

SEQ ID NO: 191428 - RNA, 19 nt, Homo sapiens
uggaauggauuuaaaugug

SEQ ID NO: 191429 - RNA, 17 nt, Homo sapiens
uggaaugucuaagccug

SEQ ID NO: 191430 - RNA, 22 nt, Homo sapiens
uggaauuaauuaaaauauacug

SEQ ID NO: 191431 - RNA, 22 nt, Homo sapiens
uggacagaaacauguuuucagu

SEQ ID NO: 191432 - RNA, 22 nt, Homo sapiens
uggacagagagaccggcauuuu

SEQ ID NO: 191433 - RNA, 18 nt, Homo sapiens
uggacagugauuauccau

SEQ ID NO: 191434 - RNA, 22 nt, Homo sapiens
uggacaugaagggcacaggagg

SEQ ID NO: 191435 - RNA, 20 nt, Homo sapiens
uggaccagagagguggggac

SEQ ID NO: 191436 - RNA, 22 nt, Homo sapiens
uggacuguaaauuggggacucu

SEQ ID NO: 191437 - RNA, 22 nt, Homo sapiens
uggagauguuuaaaauccacug

SEQ ID NO: 191438 - RNA, 22 nt, Homo sapiens
uggagguagggccuaggaaucu

SEQ ID NO: 191439 - RNA, 22 nt, Homo sapiens
uggagugcaauggugagaucuu

SEQ ID NO: 191440 - RNA, 22 nt, Homo sapiens
uggaguguagaagccagccucc

SEQ ID NO: 191441 - RNA, 22 nt, Homo sapiens
uggaguguagcggcaccuauua

SEQ ID NO: 191442 - RNA, 22 nt, Homo sapiens
uggaguguguugcagaugaagg

SEQ ID NO: 191443 - RNA, 22 nt, Homo sapiens
uggauagugauaagguagauga

SEQ ID NO: 191444 - RNA, 22 nt, Homo sapiens
uggauauguucuuuguguaagg

SEQ ID NO: 191445 - RNA, 22 nt, Homo sapiens
uggauggagaggcuugugaugc

SEQ ID NO: 191446 - RNA, 22 nt, Homo sapiens
uggauugaaagcuuuaauauug

SEQ ID NO: 191447 - RNA, 18 nt, Homo sapiens
uggauuggaaaaguuccu

SEQ ID NO: 191448 - RNA, 22 nt, Homo sapiens
uggcaaaaaaccgcaguugccu

SEQ ID NO: 191449 - RNA, 22 nt, Homo sapiens
uggcaaaauggaauauguuggg

SEQ ID NO: 191450 - RNA, 22 nt, Homo sapiens
uggcaaauagcaauaggagggu

SEQ ID NO: 191451 - RNA, 22 nt, Homo sapiens
uggcaagaaccacaauuacuuu

SEQ ID NO: 191452 - RNA, 22 nt, Homo sapiens
uggcaagaagagcaugagacca

SEQ ID NO: 191453 - RNA, 22 nt, Homo sapiens
uggcaagaaggauuuauuccuu

SEQ ID NO: 191454 - RNA, 22 nt, Homo sapiens
uggcaugaagaccccauccuuu

SEQ ID NO: 191455 - RNA, 22 nt, Homo sapiens
uggcaugauccuagauucaaca

SEQ ID NO: 191456 - RNA, 22 nt, Homo sapiens
uggccaguguuuuuccugggcu

SEQ ID NO: 191457 - RNA, 22 nt, Homo sapiens
uggccaguuuuuaauugggucu

SEQ ID NO: 191458 - RNA, 22 nt, Homo sapiens
uggccuguaacccucucauagg

SEQ ID NO: 191459 - RNA, 22 nt, Homo sapiens
uggcgagaaaccauaugcuuuc

SEQ ID NO: 191460 - RNA, 22 nt, Homo sapiens
uggcucuguuuguuaacuagac

SEQ ID NO: 191461 - RNA, 21 nt, Homo sapiens
uggcuuauuugaaucuggcuu

SEQ ID NO: 191462 - RNA, 22 nt, Homo sapiens
uggcuuucuggggcuucuguuc

SEQ ID NO: 191463 - RNA, 22 nt, Homo sapiens
uggcuuuguaagguuucauuuu

SEQ ID NO: 191464 - RNA, 22 nt, Homo sapiens
ugggaucaugagcaccgcuucc

SEQ ID NO: 191465 - RNA, 22 nt, Homo sapiens
ugggaucgucaagugaggcucg

SEQ ID NO: 191466 - RNA, 22 nt, Homo sapiens
ugggaugauguuaaacguacuc

SEQ ID NO: 191467 - RNA, 22 nt, Homo sapiens
uggucuccuuuguacccugggc

SEQ ID NO: 191468 - RNA, 23 nt, Homo sapiens
uguaaaagcauuugucagccugg

SEQ ID NO: 191469 - RNA, 22 nt, Homo sapiens
uguaagcauuauauaauuguug

SEQ ID NO: 191470 - RNA, 22 nt, Homo sapiens
uguaauuuaaaugauccuugga

SEQ ID NO: 191471 - RNA, 22 nt, Homo sapiens
uguacaaauuucugugguggug

SEQ ID NO: 191472 - RNA, 22 nt, Homo sapiens
uguagcagccauaaacacagug

SEQ ID NO: 191473 - RNA, 22 nt, Homo sapiens
uguauugcuugaagagugaauu

SEQ ID NO: 191474 - RNA, 22 nt, Homo sapiens
ugucaaaugcagugauauuuga

SEQ ID NO: 191475 - RNA, 21 nt, Homo sapiens
ugucaagaugacugcugcggc

SEQ ID NO: 191476 - RNA, 22 nt, Homo sapiens
ugucacugugaguuugacugcu

SEQ ID NO: 191477 - RNA, 22 nt, Homo sapiens
ugucaggaguuuuagaaucuua

SEQ ID NO: 191478 - RNA, 22 nt, Homo sapiens
ugucagggaggcucggccgcac

SEQ ID NO: 191479 - RNA, 22 nt, Homo sapiens
ugucaguuucuugagauggaac

SEQ ID NO: 191480 - RNA, 22 nt, Homo sapiens
ugucucaguuucuguggguuag

SEQ ID NO: 191481 - RNA, 23 nt, Homo sapiens
ugugacacuuccgucaguucauu

SEQ ID NO: 191482 - RNA, 19 nt, Homo sapiens
ugugacugguugucucgcu

SEQ ID NO: 191483 - RNA, 22 nt, Homo sapiens
ugugcaaauguuaaacuaacuu

SEQ ID NO: 191484 - RNA, 22 nt, Homo sapiens
ugugcaaucuuccauuuuuagg

SEQ ID NO: 191485 - RNA, 22 nt, Homo sapiens
ugugcacaugauauaucacaua

SEQ ID NO: 191486 - RNA, 22 nt, Homo sapiens
ugugcaccucuucacacaggga

SEQ ID NO: 191487 - RNA, 22 nt, Homo sapiens
ugugccacugcacucccgccug

SEQ ID NO: 191488 - RNA, 22 nt, Homo sapiens
ugugucacugcacuccagccug

SEQ ID NO: 191489 - RNA, 22 nt, Homo sapiens
uguucacaguguuucuuugaga

SEQ ID NO: 191490 - RNA, 22 nt, Homo sapiens
uguugcaccugccuugcuuuag

SEQ ID NO: 191491 - RNA, 22 nt, Homo sapiens
uguuuuggaggccagaagucca

SEQ ID NO: 191492 - RNA, 22 nt, Homo sapiens
uuaaaaguauaggccuggcaua

SEQ ID NO: 191493 - RNA, 22 nt, Homo sapiens
uuaaaugcauagaauguguagu

SEQ ID NO: 191494 - RNA, 19 nt, Homo sapiens
uuaagguacuuagaugugu

SEQ ID NO: 191495 - RNA, 22 nt, Homo sapiens
uuaaguaaucagagaagagaac

SEQ ID NO: 191496 - RNA, 22 nt, Homo sapiens
uuaauagcaaagaguuuagacu

SEQ ID NO: 191497 - RNA, 21 nt, Homo sapiens
uuacaguugguugugaggugg

SEQ ID NO: 191498 - RNA, 22 nt, Homo sapiens
uuacauguggugugaagaagag

SEQ ID NO: 191499 - RNA, 22 nt, Homo sapiens
uuaccuuuuuaagacagguuag

SEQ ID NO: 191500 - RNA, 22 nt, Homo sapiens
uuacugcuagcugugugcucuu

SEQ ID NO: 191501 - RNA, 21 nt, Homo sapiens
uuaggcagugucagaggugag

SEQ ID NO: 191502 - RNA, 22 nt, Homo sapiens
uuaggcuuuauugaaaacaaua

SEQ ID NO: 191503 - RNA, 22 nt, Homo sapiens
uuaguuuaucagugguuucuga

SEQ ID NO: 191504 - RNA, 22 nt, Homo sapiens
uuauagcagugcaggaacagac

SEQ ID NO: 191505 - RNA, 22 nt, Homo sapiens
uuauagcagugcccaacuccug

SEQ ID NO: 191506 - RNA, 22 nt, Homo sapiens
uuauauguuagacauggugggu

SEQ ID NO: 191507 - RNA, 22 nt, Homo sapiens
uuaucacauugacugauuugca

SEQ ID NO: 191508 - RNA, 22 nt, Homo sapiens
uuaucucaguguuuguaaacaa

SEQ ID NO: 191509 - RNA, 20 nt, Homo sapiens
agacagcugcagcccacauc

SEQ ID NO: 191510 - RNA, 22 nt, Homo sapiens
agacuuagagagucuauucuau

SEQ ID NO: 191511 - RNA, 21 nt, Homo sapiens
agagaacugaaacaugugacu

SEQ ID NO: 191512 - RNA, 22 nt, Homo sapiens
agagaacugauuggaguugggc

SEQ ID NO: 191513 - RNA, 22 nt, Homo sapiens
agagaacugauuggaugugggc

SEQ ID NO: 191514 - RNA, 22 nt, Homo sapiens
agagaccuguaaaguucaggca

SEQ ID NO: 191515 - RNA, 21 nt, Homo sapiens
agaggacugaccacagcccua

SEQ ID NO: 191516 - RNA, 22 nt, Homo sapiens
agagguuuaacuggcuuauggu

SEQ ID NO: 191517 - RNA, 22 nt, Homo sapiens
agagucacaugaggcccuucau

SEQ ID NO: 191518 - RNA, 22 nt, Homo sapiens
agagugcaauggcaccaucucg

SEQ ID NO: 191519 - RNA, 22 nt, Homo sapiens
agagugcuauagauuagauuuc

SEQ ID NO: 191520 - RNA, 20 nt, Homo sapiens
agagugcugucuguccugag

SEQ ID NO: 191521 - RNA, 22 nt, Homo sapiens
agaugguguuuucucaccagau

SEQ ID NO: 191522 - RNA, 22 nt, Homo sapiens
agauguuguucaucugauuguu

SEQ ID NO: 191523 - RNA, 22 nt, Homo sapiens
agcaacaucagcagcaggaaaa

SEQ ID NO: 191524 - RNA, 22 nt, Homo sapiens
agcaccaugggcugaguaagug

SEQ ID NO: 191525 - RNA, 22 nt, Homo sapiens
agcaccguucaaacccagguua

SEQ ID NO: 191526 - RNA, 22 nt, Homo sapiens
agcagagcauauucauucgggg

SEQ ID NO: 191527 - RNA, 21 nt, Homo sapiens
agcagaguggcagcucuuuug

SEQ ID NO: 191528 - RNA, 22 nt, Homo sapiens
agcagcaauuuuguaugguuua

SEQ ID NO: 191529 - RNA, 22 nt, Homo sapiens
agcagcacaucccuuucuggcc

SEQ ID NO: 191530 - RNA, 20 nt, Homo sapiens
agcagccacagauuccucag

SEQ ID NO: 191531 - RNA, 22 nt, Homo sapiens
agcagguauuuaagaaacucag

SEQ ID NO: 191532 - RNA, 19 nt, Homo sapiens
agcaucauuauuguuuugg

SEQ ID NO: 191533 - RNA, 22 nt, Homo sapiens
agcucuuguuaguauuagcagu

SEQ ID NO: 191534 - RNA, 22 nt, Homo sapiens
agcugauggucuuguaugaugu

SEQ ID NO: 191535 - RNA, 22 nt, Homo sapiens
agcugauuuuaaguccuugucc

SEQ ID NO: 191536 - RNA, 22 nt, Homo sapiens
agcugguauuuugucaaggaua

SEQ ID NO: 191537 - RNA, 22 nt, Homo sapiens
agcugguucuuugccuuguaga

SEQ ID NO: 191538 - RNA, 22 nt, Homo sapiens
uaaucucagcuacucaggaggc

SEQ ID NO: 191539 - RNA, 21 nt, Homo sapiens
uaauggcaugaucucggcuca

SEQ ID NO: 191540 - RNA, 22 nt, Homo sapiens
uacaaaucuagguuuguuacug

SEQ ID NO: 191541 - RNA, 22 nt, Homo sapiens
uacagaauugcagguguggcag

SEQ ID NO: 191542 - RNA, 22 nt, Homo sapiens
uacagucuggaggccuguguug

SEQ ID NO: 191543 - RNA, 22 nt, Homo sapiens
uacaguggcaugucaggugcuu

SEQ ID NO: 191544 - RNA, 22 nt, Homo sapiens
uacaucagccugaaagagcucg

SEQ ID NO: 191545 - RNA, 22 nt, Homo sapiens
uacaugcaugggcaugugugca

SEQ ID NO: 191546 - RNA, 22 nt, Homo sapiens
ugaggagugaacuauuucugau

SEQ ID NO: 191547 - RNA, 22 nt, Homo sapiens
ugaggaguguauuucauucgcu

SEQ ID NO: 191548 - RNA, 22 nt, Homo sapiens
ugaggcacucccuagcggggug

SEQ ID NO: 191549 - RNA, 22 nt, Homo sapiens
ugaggugagauggcuaccccaa

SEQ ID NO: 191550 - RNA, 22 nt, Homo sapiens
ugaguagaacuccuggagaugu

SEQ ID NO: 191551 - RNA, 22 nt, Homo sapiens
ugaguaugaguucaggaaaggc

SEQ ID NO: 191552 - RNA, 22 nt, Homo sapiens
ugaguauuugggggaccagaga

SEQ ID NO: 191553 - RNA, 22 nt, Homo sapiens
ugagucaauggaggcucagagc

SEQ ID NO: 191554 - RNA, 22 nt, Homo sapiens
ugagucagucucacucugcugc

SEQ ID NO: 191555 - RNA, 22 nt, Homo sapiens
ugagucuguucucacauugcua

SEQ ID NO: 191556 - RNA, 22 nt, Homo sapiens
ugaguucaugcuuguaguucua

SEQ ID NO: 191557 - RNA, 22 nt, Homo sapiens
ugaucacagcuugacuaaagga

SEQ ID NO: 191558 - RNA, 22 nt, Homo sapiens
ugaugacacugauuucuucaau

SEQ ID NO: 191559 - RNA, 22 nt, Homo sapiens
ugaugacauugucacagucuga

SEQ ID NO: 191560 - RNA, 22 nt, Homo sapiens
ugaugucuugcaggcacgagau

SEQ ID NO: 191561 - RNA, 22 nt, Homo sapiens
ugauuugucugcaggaauagug

SEQ ID NO: 191562 - RNA, 22 nt, Homo sapiens
ugauuuguuuagugccaaguuu

SEQ ID NO: 191563 - RNA, 19 nt, Homo sapiens
ugcaaagucuuuuccuauu

SEQ ID NO: 191564 - RNA, 19 nt, Homo sapiens
ugcaaauucuaaaaacuga

SEQ ID NO: 191565 - RNA, 22 nt, Homo sapiens
ugcaaucauuuggaggagaaga

SEQ ID NO: 191566 - RNA, 22 nt, Homo sapiens
ugcacacucuguaugagaaucu

SEQ ID NO: 191567 - RNA, 22 nt, Homo sapiens
ugcagagucuguccugccugcc

SEQ ID NO: 191568 - RNA, 21 nt, Homo sapiens
ugcagccauucagcccuaugc

SEQ ID NO: 191569 - RNA, 20 nt, Homo sapiens
ugcaguguccucacuuguca

SEQ ID NO: 191570 - RNA, 22 nt, Homo sapiens
ugcauacacaagcauacaugua

SEQ ID NO: 191571 - RNA, 18 nt, Homo sapiens
ugcauacuaucugauuuu

SEQ ID NO: 191572 - RNA, 21 nt, Homo sapiens
ugcauggagaacacugagggu

SEQ ID NO: 191573 - RNA, 22 nt, Homo sapiens
ugcauggagcucucuuuggacu

SEQ ID NO: 191574 - RNA, 22 nt, Homo sapiens
ugccaaggagucagucccuaga

SEQ ID NO: 191575 - RNA, 22 nt, Homo sapiens
ugccaguauuuuacugaggauu

SEQ ID NO: 191576 - RNA, 22 nt, Homo sapiens
ugccauugcacuccagccuggg

SEQ ID NO: 191577 - RNA, 22 nt, Homo sapiens
ugcccuguaucccacuguuuca

SEQ ID NO: 191578 - RNA, 21 nt, Homo sapiens
ugcugcacuucuuuugcugug

SEQ ID NO: 191579 - RNA, 19 nt, Homo sapiens
ugcugcauugugaccuugc

SEQ ID NO: 191580 - RNA, 22 nt, Homo sapiens
ugcugcuguuguuguuacuagc

SEQ ID NO: 191581 - RNA, 22 nt, Homo sapiens
ugcugguguggucuagccgcuu

SEQ ID NO: 191582 - RNA, 22 nt, Homo sapiens
ugcuguuguuugaugaaguaau

SEQ ID NO: 191583 - RNA, 18 nt, Homo sapiens
ugcuuagucauuuucaau

SEQ ID NO: 191584 - RNA, 22 nt, Homo sapiens
ugcuuagucuugcuuuagcuau

SEQ ID NO: 191585 - RNA, 20 nt, Homo sapiens
uggaaauuaaccuuucaggu

SEQ ID NO: 191586 - RNA, 22 nt, Homo sapiens
uggaagacaaguguuagcaugg

SEQ ID NO: 191587 - RNA, 22 nt, Homo sapiens
uggaagacauugggugaagggu

SEQ ID NO: 191588 - RNA, 22 nt, Homo sapiens
uggaaguagauagauuguguca

SEQ ID NO: 191589 - RNA, 22 nt, Homo sapiens
uggaaguuaaaugacucuuucu

SEQ ID NO: 191590 - RNA, 22 nt, Homo sapiens
uggaauguuuaucaaaacagua

SEQ ID NO: 191591 - RNA, 22 nt, Homo sapiens
uggaggacugcagaacugaggc

SEQ ID NO: 191592 - RNA, 19 nt, Homo sapiens
uggagucaucaugcugcua

SEQ ID NO: 191593 - RNA, 22 nt, Homo sapiens
uggagugcgugucugaguuuuu

SEQ ID NO: 191594 - RNA, 22 nt, Homo sapiens
uggagugucaguuuccagaguu

SEQ ID NO: 191595 - RNA, 22 nt, Homo sapiens
uggaguguguuaacuuuacaag

SEQ ID NO: 191596 - RNA, 22 nt, Homo sapiens
uggaguguuggggcaggaucuc

SEQ ID NO: 191597 - RNA, 22 nt, Homo sapiens
uggcaaagugugacgugggggu

SEQ ID NO: 191598 - RNA, 22 nt, Homo sapiens
uggcaaaugugagaugagaacu

SEQ ID NO: 191599 - RNA, 22 nt, Homo sapiens
uggcaaauuccaaaguuaauuc

SEQ ID NO: 191600 - RNA, 23 nt, Homo sapiens
uggcaagaauucuuaccgugugg

SEQ ID NO: 191601 - RNA, 19 nt, Homo sapiens
uggcacauguauacuuaug

SEQ ID NO: 191602 - RNA, 22 nt, Homo sapiens
uggcagauagaaaugugguuaa

SEQ ID NO: 191603 - RNA, 22 nt, Homo sapiens
uggcagcugcuucaugggaugc

SEQ ID NO: 191604 - RNA, 22 nt, Homo sapiens
uggcaggugcacuggcuuugaa

SEQ ID NO: 191605 - RNA, 22 nt, Homo sapiens
uggcaguuucacauggcucaac

SEQ ID NO: 191606 - RNA, 22 nt, Homo sapiens
uggcauguguuugaaugaguau

SEQ ID NO: 191607 - RNA, 23 nt, Homo sapiens
uggcauuuuaguuagcuucagug

SEQ ID NO: 191608 - RNA, 22 nt, Homo sapiens
uggcauuuugugugaauuagaa

SEQ ID NO: 191609 - RNA, 22 nt, Homo sapiens
uggccagugucggaggccagga

SEQ ID NO: 191610 - RNA, 22 nt, Homo sapiens
uggccagugucuauugguuucc

SEQ ID NO: 191611 - RNA, 22 nt, Homo sapiens
uggccaguugaagacaaugcuc

SEQ ID NO: 191612 - RNA, 22 nt, Homo sapiens
uggccuguaacgcugucucagc

SEQ ID NO: 191613 - RNA, 22 nt, Homo sapiens
uggcggagacauggacuucaga

SEQ ID NO: 191614 - RNA, 22 nt, Homo sapiens
uggcuuuuccuugaaucugccu

SEQ ID NO: 191615 - RNA, 22 nt, Homo sapiens
ugggaagcugcugaacuacagu

SEQ ID NO: 191616 - RNA, 22 nt, Homo sapiens
ugggagcauugcauuagaagcc

SEQ ID NO: 191617 - RNA, 22 nt, Homo sapiens
ugggaucagucuggaauauuga

SEQ ID NO: 191618 - RNA, 22 nt, Homo sapiens
ugggaucauuaugcauagugua

SEQ ID NO: 191619 - RNA, 22 nt, Homo sapiens
ugggaucauucaaugacgaaau

SEQ ID NO: 191620 - RNA, 22 nt, Homo sapiens
ugggaugaaaauagcuucuucc

SEQ ID NO: 191621 - RNA, 22 nt, Homo sapiens
ugggcuagaugcuuugggguca

SEQ ID NO: 191622 - RNA, 22 nt, Homo sapiens
uggggcuuuuucuuguauucuc

SEQ ID NO: 191623 - RNA, 22 nt, Homo sapiens
ugggguagaauagaauugauau

SEQ ID NO: 191624 - RNA, 22 nt, Homo sapiens
ugggguaggcuguauacucugu

SEQ ID NO: 191625 - RNA, 22 nt, Homo sapiens
uggguaggaccagaaaugcacu

SEQ ID NO: 191626 - RNA, 22 nt, Homo sapiens
uggguaggcccucauuggacag

SEQ ID NO: 191627 - RNA, 22 nt, Homo sapiens
ugguaaaaugucauuuaccaga

SEQ ID NO: 191628 - RNA, 22 nt, Homo sapiens
uggucaccuucuugcucugucu

SEQ ID NO: 191629 - RNA, 22 nt, Homo sapiens
ugguccaguucugugauauugc

SEQ ID NO: 191630 - RNA, 22 nt, Homo sapiens
uggugagaaaagaugucuuugu

SEQ ID NO: 191631 - RNA, 22 nt, Homo sapiens
uggugccguccugcaauccugg

SEQ ID NO: 191632 - RNA, 15 nt, Homo sapiens
uggugguguugagac

SEQ ID NO: 191633 - RNA, 20 nt, Homo sapiens
uggugucuuggaaagagcuc

SEQ ID NO: 191634 - RNA, 19 nt, Homo sapiens
uguaccagcaagucuuuuc

SEQ ID NO: 191635 - RNA, 22 nt, Homo sapiens
uguagcaaauaaaagucuggau

SEQ ID NO: 191636 - RNA, 22 nt, Homo sapiens
uguauacauauguauguuuugu

SEQ ID NO: 191637 - RNA, 16 nt, Homo sapiens
uguauugcuaaaaaga

SEQ ID NO: 191638 - RNA, 22 nt, Homo sapiens
uguauuuguuguuaaauggaga

SEQ ID NO: 191639 - RNA, 22 nt, Homo sapiens
ugucaagaugguuugauguugu

SEQ ID NO: 191640 - RNA, 22 nt, Homo sapiens
ugucacagagauuuugguaugu

SEQ ID NO: 191641 - RNA, 22 nt, Homo sapiens
ugucacaguuuguacuuuauag

SEQ ID NO: 191642 - RNA, 22 nt, Homo sapiens
ucaugcaucuuguggaauuuga

SEQ ID NO: 191643 - RNA, 22 nt, Homo sapiens
ucaugucuuguuguauuuauuu

SEQ ID NO: 191644 - RNA, 22 nt, Homo sapiens
ucaugugaggauaacaauagug

SEQ ID NO: 191645 - RNA, 22 nt, Homo sapiens
ucauuggaugucugaaaugauu

SEQ ID NO: 191646 - RNA, 22 nt, Homo sapiens
uccaguacaggucucucauuuc

SEQ ID NO: 191647 - RNA, 22 nt, Homo sapiens
uccaguggacagacauaccaug

SEQ ID NO: 191648 - RNA, 22 nt, Homo sapiens
uccaguuuuguuaacauauggu

SEQ ID NO: 191649 - RNA, 22 nt, Homo sapiens
uccauagacauuuuaagguagu

SEQ ID NO: 191650 - RNA, 20 nt, Homo sapiens
ucccaguaggagaaggaagg

SEQ ID NO: 191651 - RNA, 22 nt, Homo sapiens
uccccugagaacuugcuagaaa

SEQ ID NO: 191652 - RNA, 22 nt, Homo sapiens
uccccugagucaccugcuucuc

SEQ ID NO: 191653 - RNA, 22 nt, Homo sapiens
ucccuggagcaagagaagaagg

SEQ ID NO: 191654 - RNA, 17 nt, Homo sapiens
ucccuguuuuuucaguc

SEQ ID NO: 191655 - RNA, 18 nt, Homo sapiens
ucccuuuguagaugaccc

SEQ ID NO: 191656 - RNA, 22 nt, Homo sapiens
uccuugagccucccagacucag

SEQ ID NO: 191657 - RNA, 22 nt, Homo sapiens
uccuugagucugaacuuuggau

SEQ ID NO: 191658 - RNA, 22 nt, Homo sapiens
ucgcugggaaccagagguaaag

SEQ ID NO: 191659 - RNA, 19 nt, Homo sapiens
ucuaaaucucuugauagac

SEQ ID NO: 191660 - RNA, 22 nt, Homo sapiens
ucucaaccuccacacuacaaua

SEQ ID NO: 191661 - RNA, 22 nt, Homo sapiens
ucucaguuuucuggggaagaaa

SEQ ID NO: 191662 - RNA, 21 nt, Homo sapiens
ucucauuacugaugagccaga

SEQ ID NO: 191663 - RNA, 22 nt, Homo sapiens
ucucccauccguacacggauug

SEQ ID NO: 191664 - RNA, 19 nt, Homo sapiens
ucucugguguuggagggga

SEQ ID NO: 191665 - RNA, 22 nt, Homo sapiens
ucucuuggcggaaguugcagug

SEQ ID NO: 191666 - RNA, 22 nt, Homo sapiens
ucugagaucaugucugugcugu

SEQ ID NO: 191667 - RNA, 22 nt, Homo sapiens
ucugagguaggugcauggauac

SEQ ID NO: 191668 - RNA, 17 nt, Homo sapiens
ucuggcuuucacaccug

SEQ ID NO: 191669 - RNA, 22 nt, Homo sapiens
ucugguggugaugagagacagu

SEQ ID NO: 191670 - RNA, 22 nt, Homo sapiens
ucugucaaaucuuauguuguag

SEQ ID NO: 191671 - RNA, 22 nt, Homo sapiens
ucugugcauggcagaggaauga

SEQ ID NO: 191672 - RNA, 22 nt, Homo sapiens
ucugugcauuguaacaacuaaa

SEQ ID NO: 191673 - RNA, 22 nt, Homo sapiens
ucugugcauuguaggauguuua

SEQ ID NO: 191674 - RNA, 22 nt, Homo sapiens
ucugugguuguugcauggaaug

SEQ ID NO: 191675 - RNA, 22 nt, Homo sapiens
ucuugcaguucccaaauucaca

SEQ ID NO: 191676 - RNA, 22 nt, Homo sapiens
ucuugccacuucauccccuuuc

SEQ ID NO: 191677 - RNA, 22 nt, Homo sapiens
ucuugggugaguuugugaauaa

SEQ ID NO: 191678 - RNA, 22 nt, Homo sapiens
ucuuuaguuaagggacauuuua

SEQ ID NO: 191679 - RNA, 22 nt, Homo sapiens
ucuuugaguggagcgaggcaga

SEQ ID NO: 191680 - RNA, 22 nt, Homo sapiens
ucuuugauguucugaaagaugg

SEQ ID NO: 191681 - RNA, 22 nt, Homo sapiens
ucuuuggauggaaauuggaguc

SEQ ID NO: 191682 - RNA, 22 nt, Homo sapiens
ucuuuggcugugaagaauaaug

SEQ ID NO: 191683 - RNA, 22 nt, Homo sapiens
ucuuugggauauucugaaaggg

SEQ ID NO: 191684 - RNA, 22 nt, Homo sapiens
ucuuuggguguauuucacagcc

SEQ ID NO: 191685 - RNA, 22 nt, Homo sapiens
ucuuugguaauggaugucugau

SEQ ID NO: 191686 - RNA, 22 nt, Homo sapiens
ucuuugguagaagcuauuuuau

SEQ ID NO: 191687 - RNA, 21 nt, Homo sapiens
ucuuuggucaccaguuuucau

SEQ ID NO: 191688 - RNA, 22 nt, Homo sapiens
ucuuuggucuacuuucauaugu

SEQ ID NO: 191689 - RNA, 22 nt, Homo sapiens
ucuuugguuucugucucuguaa

SEQ ID NO: 191690 - RNA, 22 nt, Homo sapiens
ugaaaugauuauaugguguuug

SEQ ID NO: 191691 - RNA, 22 nt, Homo sapiens
ugaaauguaaguugucuagucu

SEQ ID NO: 191692 - RNA, 22 nt, Homo sapiens
ugaacacaucuccugguaccug

SEQ ID NO: 191693 - RNA, 22 nt, Homo sapiens
ugaagcuuguuucuguaccuuu

SEQ ID NO: 191694 - RNA, 22 nt, Homo sapiens
ugaaggccgggcaugguggcuc

SEQ ID NO: 191695 - RNA, 21 nt, Homo sapiens
ugaaguguaaccgugcagggc

SEQ ID NO: 191696 - RNA, 22 nt, Homo sapiens
ugaauaguaauguguuuggucu

SEQ ID NO: 191697 - RNA, 18 nt, Homo sapiens
ugaauaguguccccauga

SEQ ID NO: 191698 - RNA, 22 nt, Homo sapiens
ugaaucauuucuugucuucagu

SEQ ID NO: 191699 - RNA, 22 nt, Homo sapiens
ugacacagcaagauggaaccau

SEQ ID NO: 191700 - RNA, 19 nt, Homo sapiens
ugacacuguuggugggagg

SEQ ID NO: 191701 - RNA, 22 nt, Homo sapiens
ugacagagcaggacuucaucuc

SEQ ID NO: 191702 - RNA, 22 nt, Homo sapiens
ugacaggagauuaugugauguu

SEQ ID NO: 191703 - RNA, 22 nt, Homo sapiens
ugacaggauggagaucgguauu

SEQ ID NO: 191704 - RNA, 18 nt, Homo sapiens
ugacaucauuuagaaagg

SEQ ID NO: 191705 - RNA, 22 nt, Homo sapiens
ugaccacagaaagugagggagc

SEQ ID NO: 191706 - RNA, 19 nt, Homo sapiens
ugaccagggacagaaacca

SEQ ID NO: 191707 - RNA, 22 nt, Homo sapiens
ugacuacaggucaggaagcugu

SEQ ID NO: 191708 - RNA, 22 nt, Homo sapiens
ugacuaggaggcuggaggauga

SEQ ID NO: 191709 - RNA, 22 nt, Homo sapiens
ugacuggagaccucaguagggu

SEQ ID NO: 191710 - RNA, 22 nt, Homo sapiens
ugacuugaucauuacacauucu

SEQ ID NO: 191711 - RNA, 22 nt, Homo sapiens
ugacuugauccauggggcucca

SEQ ID NO: 191712 - RNA, 22 nt, Homo sapiens
ugagaacagcagcuugggacac

SEQ ID NO: 191713 - RNA, 22 nt, Homo sapiens
ugagaacaugcacuugagguug

SEQ ID NO: 191714 - RNA, 16 nt, Homo sapiens
ugagaacaugcagcau

SEQ ID NO: 191715 - RNA, 20 nt, Homo sapiens
ugagaacauguggcauuugg

SEQ ID NO: 191716 - RNA, 17 nt, Homo sapiens
ugagaacaugugguauu

SEQ ID NO: 191717 - RNA, 20 nt, Homo sapiens
ugagaacaugugguauuugg

SEQ ID NO: 191718 - RNA, 22 nt, Homo sapiens
ugagaacauuccucuuccuggc

SEQ ID NO: 191719 - RNA, 22 nt, Homo sapiens
ugagaagacaucagcuuucgga

SEQ ID NO: 191720 - RNA, 22 nt, Homo sapiens
ugagaagaugaacuccuugguc

SEQ ID NO: 191721 - RNA, 22 nt, Homo sapiens
ugagaaugaugauugguaaacc

SEQ ID NO: 191722 - RNA, 22 nt, Homo sapiens
ugagaaugaugauuuccaguuu

SEQ ID NO: 191723 - RNA, 22 nt, Homo sapiens
ugagaauguagggcucucccag

SEQ ID NO: 191724 - RNA, 22 nt, Homo sapiens
ugagacacuucccagaucccuu

SEQ ID NO: 191725 - RNA, 19 nt, Homo sapiens
ugagagcacaacugaacaa

SEQ ID NO: 191726 - RNA, 18 nt, Homo sapiens
ugagauacuagaauaggu

SEQ ID NO: 191727 - RNA, 22 nt, Homo sapiens
ugagaucaacugagucagagca

SEQ ID NO: 191728 - RNA, 22 nt, Homo sapiens
ugagaucagaaggauuucucug

SEQ ID NO: 191729 - RNA, 22 nt, Homo sapiens
ugagaucuuggaggcuuuguga

SEQ ID NO: 191730 - RNA, 22 nt, Homo sapiens
ugagaugaagucuugcucuguu

SEQ ID NO: 191731 - RNA, 22 nt, Homo sapiens
ugagaugaguugcuggcucuga

SEQ ID NO: 191732 - RNA, 22 nt, Homo sapiens
ugagauggaucuuggauuugaa

SEQ ID NO: 191733 - RNA, 22 nt, Homo sapiens
ugagauggcuuuauugcugaau

SEQ ID NO: 191734 - RNA, 23 nt, Homo sapiens
ugagauuauaaucuuuuacuucu

SEQ ID NO: 191735 - RNA, 22 nt, Homo sapiens
ugagcagagggagaaguaaauu

SEQ ID NO: 191736 - RNA, 22 nt, Homo sapiens
ugagcucagcuuucuuuuucac

SEQ ID NO: 191737 - RNA, 22 nt, Homo sapiens
ugagcucaguauuucauaaaca

SEQ ID NO: 191738 - RNA, 22 nt, Homo sapiens
ugagcugguacuaauauuauca

SEQ ID NO: 191739 - RNA, 18 nt, Homo sapiens
ugucacuggauaaugguc

SEQ ID NO: 191740 - RNA, 22 nt, Homo sapiens
ugucaguggucuggaugcagcc

SEQ ID NO: 191741 - RNA, 22 nt, Homo sapiens
ugucaguguacuguaagaauua

SEQ ID NO: 191742 - RNA, 22 nt, Homo sapiens
ugucauggggaaaauaacagac

SEQ ID NO: 191743 - RNA, 20 nt, Homo sapiens
ugucauuaagcacugugcca

SEQ ID NO: 191744 - RNA, 22 nt, Homo sapiens
ugucucaguuacggcaauucca

SEQ ID NO: 191745 - RNA, 21 nt, Homo sapiens
ugucuuggagccagacgccag

SEQ ID NO: 191746 - RNA, 22 nt, Homo sapiens
ugucuuggaugaggauuaacag

SEQ ID NO: 191747 - RNA, 22 nt, Homo sapiens
ugucuuuguuaguuguccuagu

SEQ ID NO: 191748 - RNA, 22 nt, Homo sapiens
ugugacacugaauggcagaacu

SEQ ID NO: 191749 - RNA, 22 nt, Homo sapiens
ugugaugaagaguccaagaaca

SEQ ID NO: 191750 - RNA, 22 nt, Homo sapiens
ugugaugcagggccugggccuc

SEQ ID NO: 191751 - RNA, 18 nt, Homo sapiens
ugugcaauauuaaccacc

SEQ ID NO: 191752 - RNA, 22 nt, Homo sapiens
ugugcacaacgugcagguuugu

SEQ ID NO: 191753 - RNA, 22 nt, Homo sapiens
ugugcacaaugugcagguuuga

SEQ ID NO: 191754 - RNA, 22 nt, Homo sapiens
ugugcacauaacauuuuuuuag

SEQ ID NO: 191755 - RNA, 22 nt, Homo sapiens
ugugccacugcacuccugccug

SEQ ID NO: 191756 - RNA, 22 nt, Homo sapiens
uguggaaauggugcuacgaaca

SEQ ID NO: 191757 - RNA, 20 nt, Homo sapiens
uguggcacuguaucucucag

SEQ ID NO: 191758 - RNA, 18 nt, Homo sapiens
uguggcuguuuuccaaua

SEQ ID NO: 191759 - RNA, 22 nt, Homo sapiens
uguggcuuuacagcaugguuca

SEQ ID NO: 191760 - RNA, 22 nt, Homo sapiens
ugugucacugcacuccagcgug

SEQ ID NO: 191761 - RNA, 22 nt, Homo sapiens
uguuaucauuacguucuuaguu

SEQ ID NO: 191762 - RNA, 22 nt, Homo sapiens
uguugcacugguaauguacuga

SEQ ID NO: 191763 - RNA, 22 nt, Homo sapiens
uguuggacuuacuuggcagauu

SEQ ID NO: 191764 - RNA, 22 nt, Homo sapiens
uguuuaguuaagacauagaauu

SEQ ID NO: 191765 - RNA, 22 nt, Homo sapiens
uguuucuacugucucuguagua

SEQ ID NO: 191766 - RNA, 22 nt, Homo sapiens
uguuugguggucucuucacaug

SEQ ID NO: 191767 - RNA, 22 nt, Homo sapiens
uguuuguuugugauacgguaca

SEQ ID NO: 191768 - RNA, 22 nt, Homo sapiens
uguuuuggaguggacuuugcau

SEQ ID NO: 191769 - RNA, 21 nt, Homo sapiens
uguuuuugcuguguaucucuc

SEQ ID NO: 191770 - RNA, 22 nt, Homo sapiens
uuaaaguauaguuccucugguu

SEQ ID NO: 191771 - RNA, 22 nt, Homo sapiens
uuaaaguguuuucaaaauguca

SEQ ID NO: 191772 - RNA, 22 nt, Homo sapiens
uuaaauacagcaugguguuucu

SEQ ID NO: 191773 - RNA, 23 nt, Homo sapiens
uuaagcaacggcugcuuuucaga

SEQ ID NO: 191774 - RNA, 22 nt, Homo sapiens
uuaauguaucuaucacaucaca

SEQ ID NO: 191775 - RNA, 22 nt, Homo sapiens
uuaauuguaucuauagauguca

SEQ ID NO: 191776 - RNA, 22 nt, Homo sapiens
uuacagauggcacacucaaggg

SEQ ID NO: 191777 - RNA, 22 nt, Homo sapiens
uuacaguauugcaaggacuagg

SEQ ID NO: 191778 - RNA, 22 nt, Homo sapiens
uuacaugucuugguaagguuag

SEQ ID NO: 191779 - RNA, 22 nt, Homo sapiens
uuacccauuagagaauuuaaga

SEQ ID NO: 191780 - RNA, 22 nt, Homo sapiens
uuacccuuuaacccuuuaaagu

SEQ ID NO: 191781 - RNA, 22 nt, Homo sapiens
uuagcacaguucauucauguua

SEQ ID NO: 191782 - RNA, 21 nt, Homo sapiens
uuagcauccauguucaucaac

SEQ ID NO: 191783 - RNA, 22 nt, Homo sapiens
uuagcaugucuacuaauuugcu

SEQ ID NO: 191784 - RNA, 22 nt, Homo sapiens
uuaggcuuuucagacacuucau

SEQ ID NO: 191785 - RNA, 22 nt, Homo sapiens
uuagggaggacaguuacaacag

SEQ ID NO: 191786 - RNA, 23 nt, Homo sapiens
uuaguaaacucaaugacaccaca

SEQ ID NO: 191787 - RNA, 22 nt, Homo sapiens
uuauagacacguuguaacaaac

SEQ ID NO: 191788 - RNA, 22 nt, Homo sapiens
uuaucauagugcaguuuucuga

SEQ ID NO: 191789 - RNA, 21 nt, Homo sapiens
uuaucccagugucucugcagg

SEQ ID NO: 191790 - RNA, 22 nt, Homo sapiens
uuauggauuuauauucuguagu

SEQ ID NO: 191791 - RNA, 22 nt, Homo sapiens
uuauguccuuuaacuucaucac

SEQ ID NO: 191792 - RNA, 22 nt, Homo sapiens
uuauucauuaauugcuaagguu

SEQ ID NO: 191793 - RNA, 22 nt, Homo sapiens
uuauugcuuuugugcaggugag

SEQ ID NO: 191794 - RNA, 23 nt, Homo sapiens
uucaaauguucucugguugucag

SEQ ID NO: 191795 - RNA, 22 nt, Homo sapiens
uucaagaauuaaaguggcuuuu

SEQ ID NO: 191796 - RNA, 22 nt, Homo sapiens
uucaaguaguucucaugccuca

SEQ ID NO: 191797 - RNA, 22 nt, Homo sapiens
uucacagaguuauuuuuaugcu

SEQ ID NO: 191798 - RNA, 22 nt, Homo sapiens
uucacugcauuucagccugggc

SEQ ID NO: 191799 - RNA, 22 nt, Homo sapiens
uucacugugcuuaaauucugcu

SEQ ID NO: 191800 - RNA, 22 nt, Homo sapiens
uucaggcaccauugucauugau

SEQ ID NO: 191801 - RNA, 22 nt, Homo sapiens
uucagguaauuaugguuugucu

SEQ ID NO: 191802 - RNA, 22 nt, Homo sapiens
uucagguacugggggaguaugg

SEQ ID NO: 191803 - RNA, 22 nt, Homo sapiens
uucaguauugcaccuggagucc

SEQ ID NO: 191804 - RNA, 22 nt, Homo sapiens
uucaguucugcucugaucuuag

SEQ ID NO: 191805 - RNA, 22 nt, Homo sapiens
uucauaguguuuccuuccagug

SEQ ID NO: 191806 - RNA, 22 nt, Homo sapiens
uucaucagggguauuggccaau

SEQ ID NO: 191807 - RNA, 22 nt, Homo sapiens
uucaucuggcaauucagagauu

SEQ ID NO: 191808 - RNA, 21 nt, Homo sapiens
uucaucuggccguauuccagg

SEQ ID NO: 191809 - RNA, 22 nt, Homo sapiens
uucauggaguuuaaauuguagu

SEQ ID NO: 191810 - RNA, 22 nt, Homo sapiens
uuccacagggauuugcauugau

SEQ ID NO: 191811 - RNA, 21 nt, Homo sapiens
uuccagugagccuagaugccu

SEQ ID NO: 191812 - RNA, 22 nt, Homo sapiens
uuccauguugauacgugaaguu

SEQ ID NO: 191813 - RNA, 22 nt, Homo sapiens
uuccauuuguucggugucgcca

SEQ ID NO: 191814 - RNA, 22 nt, Homo sapiens
uucccaguuggggaaagcgacc

SEQ ID NO: 191815 - RNA, 22 nt, Homo sapiens
uucccucagaaacacacagccc

SEQ ID NO: 191816 - RNA, 22 nt, Homo sapiens
uucccugugggcuggugcucca

SEQ ID NO: 191817 - RNA, 22 nt, Homo sapiens
uuccugagccuuguaucuagua

SEQ ID NO: 191818 - RNA, 22 nt, Homo sapiens
uuccuggaggggaaguguccaa

SEQ ID NO: 191819 - RNA, 22 nt, Homo sapiens
uuccuuaguuauuugguccccu

SEQ ID NO: 191820 - RNA, 22 nt, Homo sapiens
uucuauguuguuagacccacca

SEQ ID NO: 191821 - RNA, 21 nt, Homo sapiens
uucucaggguguguccuaccc

SEQ ID NO: 191822 - RNA, 22 nt, Homo sapiens
uucucagugaaguuuagaacau

SEQ ID NO: 191823 - RNA, 22 nt, Homo sapiens
uucugugcugaaucaaagacug

SEQ ID NO: 191824 - RNA, 22 nt, Homo sapiens
uucuuccagccuugaggggccc

SEQ ID NO: 191825 - RNA, 22 nt, Homo sapiens
uucuugguguaguaguugaaaa

SEQ ID NO: 191826 - RNA, 21 nt, Homo sapiens
uucuuugcucaguguuagagu

SEQ ID NO: 191827 - RNA, 22 nt, Homo sapiens
uugaaagucuaggcuuacagua

SEQ ID NO: 191828 - RNA, 22 nt, Homo sapiens
uugaaggaacgcuguucccuug

SEQ ID NO: 191829 - RNA, 22 nt, Homo sapiens
uugaaguaggaaaggaggaggu

SEQ ID NO: 191830 - RNA, 22 nt, Homo sapiens
uugaauagacagccagcuuuaa

SEQ ID NO: 191831 - RNA, 22 nt, Homo sapiens
uugaauagcauguuuagugcau

SEQ ID NO: 191832 - RNA, 22 nt, Homo sapiens
uugaaugaaaugaugucauuug

SEQ ID NO: 191833 - RNA, 17 nt, Homo sapiens
uugaaugcauuacuugg

SEQ ID NO: 191834 - RNA, 22 nt, Homo sapiens
uugacugggccagacagagauc

SEQ ID NO: 191835 - RNA, 22 nt, Homo sapiens
ccuggcaagagacugaagauag

SEQ ID NO: 191836 - RNA, 22 nt, Homo sapiens
ccuucauugcaucuuuaagaga

SEQ ID NO: 191837 - RNA, 22 nt, Homo sapiens
ccuuggcaauggcuggggcuga

SEQ ID NO: 191838 - RNA, 22 nt, Homo sapiens
ccuuuuuguaguggaaguagga

SEQ ID NO: 191839 - RNA, 22 nt, Homo sapiens
cgcccuguagcuagcuagaggu

SEQ ID NO: 191840 - RNA, 22 nt, Homo sapiens
cuaaaguauugagugguaaaga

SEQ ID NO: 191841 - RNA, 22 nt, Homo sapiens
cuaacacagagguuuauuucuc

SEQ ID NO: 191842 - RNA, 22 nt, Homo sapiens
cuaagugaacugucacugagaa

SEQ ID NO: 191843 - RNA, 20 nt, Homo sapiens
cuaaucaucccagaagaaau

SEQ ID NO: 191844 - RNA, 22 nt, Homo sapiens
cuagaggcacagccuaggcacu

SEQ ID NO: 191845 - RNA, 22 nt, Homo sapiens
cuagcacauaguuauucacuca

SEQ ID NO: 191846 - RNA, 22 nt, Homo sapiens
cuagcagacacuuccagagagu

SEQ ID NO: 191847 - RNA, 22 nt, Homo sapiens
cuagcagacaugggcugaacca

SEQ ID NO: 191848 - RNA, 22 nt, Homo sapiens
cuagugcaauccuuugauggua

SEQ ID NO: 191849 - RNA, 22 nt, Homo sapiens
cuauaugucuguuuugguacca

SEQ ID NO: 191850 - RNA, 22 nt, Homo sapiens
cucacagucagaagggacuugc

SEQ ID NO: 191851 - RNA, 22 nt, Homo sapiens
cucacagucucucccuaauuuu

SEQ ID NO: 191852 - RNA, 22 nt, Homo sapiens
cucagcuacuugggaagcugag

SEQ ID NO: 191853 - RNA, 22 nt, Homo sapiens
cucaggcacucugauuccagug

SEQ ID NO: 191854 - RNA, 22 nt, Homo sapiens
cucagugaagggcaagaggcaa

SEQ ID NO: 191855 - RNA, 21 nt, Homo sapiens
cucauauugcuuuuccauggu

SEQ ID NO: 191856 - RNA, 22 nt, Homo sapiens
cucauggauggucuggcagcca

SEQ ID NO: 191857 - RNA, 23 nt, Homo sapiens
cuccaugagccguccagggccug

SEQ ID NO: 191858 - RNA, 22 nt, Homo sapiens
cuccauuuaucugaaauuuuau

SEQ ID NO: 191859 - RNA, 22 nt, Homo sapiens
cucucugagccauggcugcccu

SEQ ID NO: 191860 - RNA, 22 nt, Homo sapiens
cucucugagccccagacaccuu

SEQ ID NO: 191861 - RNA, 22 nt, Homo sapiens
cucuuugaguuccuccuggugu

SEQ ID NO: 191862 - RNA, 22 nt, Homo sapiens
cugaaaagcaucugcauagcug

SEQ ID NO: 191863 - RNA, 22 nt, Homo sapiens
cugaaaguuauucaggggcaag

SEQ ID NO: 191864 - RNA, 22 nt, Homo sapiens
cugaauagucaacgauggacug

SEQ ID NO: 191865 - RNA, 22 nt, Homo sapiens
cugacauggggauccaccuuag

SEQ ID NO: 191866 - RNA, 22 nt, Homo sapiens
cugagaucaugggucagguggu

SEQ ID NO: 191867 - RNA, 22 nt, Homo sapiens
cugagauggagucucgcauugu

SEQ ID NO: 191868 - RNA, 22 nt, Homo sapiens
cugagcacugagauccucuagc

SEQ ID NO: 191869 - RNA, 22 nt, Homo sapiens
cugagcccauucuggggagaag

SEQ ID NO: 191870 - RNA, 22 nt, Homo sapiens
cugaggucugaauccagguauc

SEQ ID NO: 191871 - RNA, 22 nt, Homo sapiens
cugaggugauauauacauauuu

SEQ ID NO: 191872 - RNA, 22 nt, Homo sapiens
cugagguuguucuucucagugg

SEQ ID NO: 191873 - RNA, 22 nt, Homo sapiens
cugauuuguccccagccucaug

SEQ ID NO: 191874 - RNA, 22 nt, Homo sapiens
cugcagaucuuggggcuugcca

SEQ ID NO: 191875 - RNA, 19 nt, Homo sapiens
cugcaugagacaguugguu

SEQ ID NO: 191876 - RNA, 22 nt, Homo sapiens
cuggaaagaaucaggcuaaacu

SEQ ID NO: 191877 - RNA, 22 nt, Homo sapiens
cuggaaagcaaagggugcauug

SEQ ID NO: 191878 - RNA, 22 nt, Homo sapiens
cuggaauguuccuaaagauuca

SEQ ID NO: 191879 - RNA, 22 nt, Homo sapiens
cuggacguugaggcugcaguga

SEQ ID NO: 191880 - RNA, 22 nt, Homo sapiens
cuggagauuaaccaauugccau

SEQ ID NO: 191881 - RNA, 22 nt, Homo sapiens
cuggagcaaaggugacucuugu

SEQ ID NO: 191882 - RNA, 22 nt, Homo sapiens
cuggcuaagugcuugagugugc

SEQ ID NO: 191883 - RNA, 22 nt, Homo sapiens
cugggaugauguaaauaggcua

SEQ ID NO: 191884 - RNA, 22 nt, Homo sapiens
cugggaugugacuguugccccc

SEQ ID NO: 191885 - RNA, 22 nt, Homo sapiens
cugugcacaucuggcggcccga

SEQ ID NO: 191886 - RNA, 22 nt, Homo sapiens
cugugcauggauuuuaagauug

SEQ ID NO: 191887 - RNA, 22 nt, Homo sapiens
cuguggguuuuacuguuuuacu

SEQ ID NO: 191888 - RNA, 22 nt, Homo sapiens
cuguuugauuaagugguggaaa

SEQ ID NO: 191889 - RNA, 22 nt, Homo sapiens
cuucaguucuguaaggacagca

SEQ ID NO: 191890 - RNA, 18 nt, Homo sapiens
cuucauugcuguuuugcu

SEQ ID NO: 191891 - RNA, 22 nt, Homo sapiens
cuucuguuaguucugauaacuu

SEQ ID NO: 191892 - RNA, 22 nt, Homo sapiens
cuugacacugucacucaggcca

SEQ ID NO: 191893 - RNA, 22 nt, Homo sapiens
cuugcacauuacagaucugcau

SEQ ID NO: 191894 - RNA, 22 nt, Homo sapiens
cuugcacuagugcagaggcgcu

SEQ ID NO: 191895 - RNA, 22 nt, Homo sapiens
cuugccuuugucuucaaaggcu

SEQ ID NO: 191896 - RNA, 20 nt, Homo sapiens
cuugcuccccuuguucuaga

SEQ ID NO: 191897 - RNA, 22 nt, Homo sapiens
cuuugauuauaaaaggguguuu

SEQ ID NO: 191898 - RNA, 22 nt, Homo sapiens
cuuugcguugaacaaagccaua

SEQ ID NO: 191899 - RNA, 20 nt, Homo sapiens
cuuuggcaaugagaacaggg

SEQ ID NO: 191900 - RNA, 20 nt, Homo sapiens
cuuuggugagucaacuccuu

SEQ ID NO: 191901 - RNA, 22 nt, Homo sapiens
cuuuguaugucaugacaacugu

SEQ ID NO: 191902 - RNA, 22 nt, Homo sapiens
cuuuuacacuguuggugggaau

SEQ ID NO: 191903 - RNA, 22 nt, Homo sapiens
gaaagcuaaugacuuuggguga

SEQ ID NO: 191904 - RNA, 22 nt, Homo sapiens
gaaagcugguauagauacauua

SEQ ID NO: 191905 - RNA, 22 nt, Homo sapiens
gaaaguaauuaacgauuguugc

SEQ ID NO: 191906 - RNA, 22 nt, Homo sapiens
gaaauguugauagugggcauug

SEQ ID NO: 191907 - RNA, 18 nt, Homo sapiens
gaagaaguaggcauggca

SEQ ID NO: 191908 - RNA, 22 nt, Homo sapiens
gaagauaucuaguaccauuguc

SEQ ID NO: 191909 - RNA, 17 nt, Homo sapiens
gaaguguuucuucauga

SEQ ID NO: 191910 - RNA, 22 nt, Homo sapiens
gaaucaauugaucuaugugucu

SEQ ID NO: 191911 - RNA, 22 nt, Homo sapiens
gaaugcaugaggggaucagaug

SEQ ID NO: 191912 - RNA, 22 nt, Homo sapiens
gaaugcuaccagcaucuagugg

SEQ ID NO: 191913 - RNA, 22 nt, Homo sapiens
gaauugcacaaaaacugcuugu

SEQ ID NO: 191914 - RNA, 18 nt, Homo sapiens
gacagugugaagauuccu

SEQ ID NO: 191915 - RNA, 19 nt, Homo sapiens
gacaugagauuuggugggg

SEQ ID NO: 191916 - RNA, 22 nt, Homo sapiens
gacuggcuguuuucuuuauuau

SEQ ID NO: 191917 - RNA, 21 nt, Homo sapiens
gagaaucaucauggcugcaua

SEQ ID NO: 191918 - RNA, 21 nt, Homo sapiens
gagaaucuuuucagggcaaac

SEQ ID NO: 191919 - RNA, 22 nt, Homo sapiens
gagacugagucuugcccuguca

SEQ ID NO: 191920 - RNA, 22 nt, Homo sapiens
gagacugagucuugcucuguca

SEQ ID NO: 191921 - RNA, 22 nt, Homo sapiens
gagauauuuagaaauguguucu

SEQ ID NO: 191922 - RNA, 22 nt, Homo sapiens
gagaucauugugggccaagcug

SEQ ID NO: 191923 - RNA, 22 nt, Homo sapiens
gagaugcaccuugucacguuuc

SEQ ID NO: 191924 - RNA, 22 nt, Homo sapiens
gagaugucuauuucagagaugu

SEQ ID NO: 191925 - RNA, 22 nt, Homo sapiens
gagaugugguucaaggguguuu

SEQ ID NO: 191926 - RNA, 22 nt, Homo sapiens
gagcaaaaguauguauugguua

SEQ ID NO: 191927 - RNA, 22 nt, Homo sapiens
gagcuaguguuuacuugccacu

SEQ ID NO: 191928 - RNA, 22 nt, Homo sapiens
gaggacauuaugcuaaguggaa

SEQ ID NO: 191929 - RNA, 22 nt, Homo sapiens
gaggcaauaugagggaggcuuc

SEQ ID NO: 191930 - RNA, 22 nt, Homo sapiens
gaggucaggacauuuuugcuuu

SEQ ID NO: 191931 - RNA, 22 nt, Homo sapiens
ucugggguuuccacuuuuacuu

SEQ ID NO: 191932 - RNA, 22 nt, Homo sapiens
ucugguuccuuggcuucggguc

SEQ ID NO: 191933 - RNA, 22 nt, Homo sapiens
ucugugcugagaguugaaaguu

SEQ ID NO: 191934 - RNA, 22 nt, Homo sapiens
ucugugcuugucauaugcuuug

SEQ ID NO: 191935 - RNA, 22 nt, Homo sapiens
ucuuaguuuagauuagcaauuc

SEQ ID NO: 191936 - RNA, 22 nt, Homo sapiens
ucuugguuaggggaaauaggca

SEQ ID NO: 191937 - RNA, 22 nt, Homo sapiens
ucuuuagugacaguugugcaag

SEQ ID NO: 191938 - RNA, 22 nt, Homo sapiens
ucuuugguuagguuuaguugau

SEQ ID NO: 191939 - RNA, 22 nt, Homo sapiens
ucuuugguucuguuuauguaau

SEQ ID NO: 191940 - RNA, 22 nt, Homo sapiens
ucuuugguugcacugcaggugu

SEQ ID NO: 191941 - RNA, 22 nt, Homo sapiens
ucuuuguucaggagccaacucc

SEQ ID NO: 191942 - RNA, 22 nt, Homo sapiens
ugaaaaguuguugaaggcuuca

SEQ ID NO: 191943 - RNA, 22 nt, Homo sapiens
ugaaauaguuaaguugccuagu

SEQ ID NO: 191944 - RNA, 22 nt, Homo sapiens
ugaaaugaucaguuugguuacu

SEQ ID NO: 191945 - RNA, 22 nt, Homo sapiens
ugaagagucuaaaucugucuuc

SEQ ID NO: 191946 - RNA, 22 nt, Homo sapiens
ugaagugggaaaugaguauuaa

SEQ ID NO: 191947 - RNA, 22 nt, Homo sapiens
ugaaugguuuuuagagaacaau

SEQ ID NO: 191948 - RNA, 22 nt, Homo sapiens
ugacaagaacuuuccauaguaa

SEQ ID NO: 191949 - RNA, 23 nt, Homo sapiens
ugacaagagcgagacuuggucuc

SEQ ID NO: 191950 - RNA, 22 nt, Homo sapiens
ugacacauguagacaucuggug

SEQ ID NO: 191951 - RNA, 22 nt, Homo sapiens
ugacagcugaggcccagaguac

SEQ ID NO: 191952 - RNA, 22 nt, Homo sapiens
ugacauggagagagaagccuuu

SEQ ID NO: 191953 - RNA, 22 nt, Homo sapiens
ugacauggagggugcggcugca

SEQ ID NO: 191954 - RNA, 22 nt, Homo sapiens
ugacauguauuagcucagugcu

SEQ ID NO: 191955 - RNA, 18 nt, Homo sapiens
ugacauugagcugagaaa

SEQ ID NO: 191956 - RNA, 23 nt, Homo sapiens
ugacuggagacuguugauccuuu

SEQ ID NO: 191957 - RNA, 22 nt, Homo sapiens
ugacuugaaguuaccauaugca

SEQ ID NO: 191958 - RNA, 20 nt, Homo sapiens
ugacuuguccgagguccccc

SEQ ID NO: 191959 - RNA, 16 nt, Homo sapiens
ugagaacaugggguau

SEQ ID NO: 191960 - RNA, 18 nt, Homo sapiens
ugagaacauguguacaca

SEQ ID NO: 191961 - RNA, 22 nt, Homo sapiens
ugagaaugcagaaucucgugca

SEQ ID NO: 191962 - RNA, 22 nt, Homo sapiens
ugagacggagucucgcucuguc

SEQ ID NO: 191963 - RNA, 22 nt, Homo sapiens
ugagacggagucucgcucuguu

SEQ ID NO: 191964 - RNA, 22 nt, Homo sapiens
ugagacugagucuugcucuauu

SEQ ID NO: 191965 - RNA, 22 nt, Homo sapiens
ugagacugaguuuugccuuugu

SEQ ID NO: 191966 - RNA, 22 nt, Homo sapiens
ugagacugguaauguguagggc

SEQ ID NO: 191967 - RNA, 22 nt, Homo sapiens
ugagagcugcauucuugaaagc

SEQ ID NO: 191968 - RNA, 22 nt, Homo sapiens
ugagagcuuuuuugccugguga

SEQ ID NO: 191969 - RNA, 22 nt, Homo sapiens
ugagaucaagguuaauauaauc

SEQ ID NO: 191970 - RNA, 22 nt, Homo sapiens
ugagaucuuuuguggcugagaa

SEQ ID NO: 191971 - RNA, 22 nt, Homo sapiens
ugagauggagucuugucgccua

SEQ ID NO: 191972 - RNA, 22 nt, Homo sapiens
ugagauggaguuucacuuuugu

SEQ ID NO: 191973 - RNA, 22 nt, Homo sapiens
ugagauggaguuucgcuuuugu

SEQ ID NO: 191974 - RNA, 22 nt, Homo sapiens
ugagauggguucugguccccug

SEQ ID NO: 191975 - RNA, 22 nt, Homo sapiens
ugagauguuuguuucagugccu

SEQ ID NO: 191976 - RNA, 22 nt, Homo sapiens
ugagcacaggugcgcgguuacu

SEQ ID NO: 191977 - RNA, 22 nt, Homo sapiens
ugagcacauuuacaucaguucc

SEQ ID NO: 191978 - RNA, 22 nt, Homo sapiens
ugagcagaaagcugcaaggucg

SEQ ID NO: 191979 - RNA, 22 nt, Homo sapiens
ugagcagagaagugcccugcgc

SEQ ID NO: 191980 - RNA, 22 nt, Homo sapiens
ugagcagagaucacggcauugu

SEQ ID NO: 191981 - RNA, 20 nt, Homo sapiens
ugagcucaauuguugcaagu

SEQ ID NO: 191982 - RNA, 18 nt, Homo sapiens
ugaggaaaggguuugcua

SEQ ID NO: 191983 - RNA, 22 nt, Homo sapiens
ugaggagugagaaauugguuuc

SEQ ID NO: 191984 - RNA, 22 nt, Homo sapiens
ugaggcaaggcugaaugaaggc

SEQ ID NO: 191985 - RNA, 22 nt, Homo sapiens
ugaggcaggagaacggcuugaa

SEQ ID NO: 191986 - RNA, 22 nt, Homo sapiens
ugagggaugccugguuuguuuu

SEQ ID NO: 191987 - RNA, 20 nt, Homo sapiens
ugaggucaggaguuacagac

SEQ ID NO: 191988 - RNA, 22 nt, Homo sapiens
ugaguagucagugggcaggaag

SEQ ID NO: 191989 - RNA, 22 nt, Homo sapiens
ugagucaugcuggagucauggc

SEQ ID NO: 191990 - RNA, 22 nt, Homo sapiens
ugagucauguaauaaugcugcu

SEQ ID NO: 191991 - RNA, 22 nt, Homo sapiens
ugagugagguucuacucuguga

SEQ ID NO: 191992 - RNA, 22 nt, Homo sapiens
ugagugugaggaagaauuagaa

SEQ ID NO: 191993 - RNA, 22 nt, Homo sapiens
ugaguucauggucauuugucac

SEQ ID NO: 191994 - RNA, 22 nt, Homo sapiens
ugaguuccuuucccaguccagu

SEQ ID NO: 191995 - RNA, 22 nt, Homo sapiens
ugauaauguuaggcuuuauuca

SEQ ID NO: 191996 - RNA, 22 nt, Homo sapiens
ugauaauuuugucagguuuugg

SEQ ID NO: 191997 - RNA, 22 nt, Homo sapiens
ugauauguuagaaucuugcaag

SEQ ID NO: 191998 - RNA, 20 nt, Homo sapiens
ugauauuucuggaaguggag

SEQ ID NO: 191999 - RNA, 22 nt, Homo sapiens
ugaugcuacuaccugggcugaa

SEQ ID NO: 192000 - RNA, 21 nt, Homo sapiens
uguggcaauggccucacagau

SEQ ID NO: 192001 - RNA, 22 nt, Homo sapiens
uguggcauuuucagaaaggaug

SEQ ID NO: 192002 - RNA, 22 nt, Homo sapiens
uguggcuucuuugguucaguau

SEQ ID NO: 192003 - RNA, 22 nt, Homo sapiens
ugugggaggugcuaauguaaau

SEQ ID NO: 192004 - RNA, 22 nt, Homo sapiens
uguggucaucacuugaagguaa

SEQ ID NO: 192005 - RNA, 22 nt, Homo sapiens
uguguaaauaugauagaggaau

SEQ ID NO: 192006 - RNA, 22 nt, Homo sapiens
uguguagagaaauauuacuuau

SEQ ID NO: 192007 - RNA, 22 nt, Homo sapiens
ugugucuuguuuauagcuuucu

SEQ ID NO: 192008 - RNA, 22 nt, Homo sapiens
uguguuuuuauguaaaauggaa

SEQ ID NO: 192009 - RNA, 22 nt, Homo sapiens
uguucuggagaggcaggccaca

SEQ ID NO: 192010 - RNA, 22 nt, Homo sapiens
uuaagcaguaguuaaggagagg

SEQ ID NO: 192011 - RNA, 21 nt, Homo sapiens
uuaaguaauuacccaacucuc

SEQ ID NO: 192012 - RNA, 22 nt, Homo sapiens
uuaaugugaaucaggaugcauu

SEQ ID NO: 192013 - RNA, 22 nt, Homo sapiens
uuagagcacugaucugcucuuu

SEQ ID NO: 192014 - RNA, 22 nt, Homo sapiens
uuagcacauuuccagcacaugg

SEQ ID NO: 192015 - RNA, 22 nt, Homo sapiens
uuagcagcacaaaagcagacua

SEQ ID NO: 192016 - RNA, 22 nt, Homo sapiens
uuauaacagagacuccugugcu

SEQ ID NO: 192017 - RNA, 22 nt, Homo sapiens
uuaucagcagcaugaaaauaga

SEQ ID NO: 192018 - RNA, 22 nt, Homo sapiens
uuauggcuauugaugacaauug

SEQ ID NO: 192019 - RNA, 22 nt, Homo sapiens
uuauugcucauuugggcauucu

SEQ ID NO: 192020 - RNA, 22 nt, Homo sapiens
uuauugcuccagaggcugauuu

SEQ ID NO: 192021 - RNA, 21 nt, Homo sapiens
uuggggaauggagagguuuuc

SEQ ID NO: 192022 - RNA, 22 nt, Homo sapiens
uugguauguaauuuauauugua

SEQ ID NO: 192023 - RNA, 22 nt, Homo sapiens
uuguaaucaacacaucauuggg

SEQ ID NO: 192024 - RNA, 22 nt, Homo sapiens
uuguagcaaauguguaaacaaa

SEQ ID NO: 192025 - RNA, 21 nt, Homo sapiens
uuguagcagcauaaucccaga

SEQ ID NO: 192026 - RNA, 22 nt, Homo sapiens
uuguauaggcucaguaagaauc

SEQ ID NO: 192027 - RNA, 22 nt, Homo sapiens
uuguauguuuguucuuucagau

SEQ ID NO: 192028 - RNA, 22 nt, Homo sapiens
uugucaaacucauucuccaucc

SEQ ID NO: 192029 - RNA, 22 nt, Homo sapiens
uugucacccuacauaacaggga

SEQ ID NO: 192030 - RNA, 23 nt, Homo sapiens
uuguccccuccaaagcucauguu

SEQ ID NO: 192031 - RNA, 19 nt, Homo sapiens
uugucuuagaguugucauu

SEQ ID NO: 192032 - RNA, 22 nt, Homo sapiens
uugugaauggaguagcaggauc

SEQ ID NO: 192033 - RNA, 22 nt, Homo sapiens
uugugcaaaaguaauugcgguu

SEQ ID NO: 192034 - RNA, 22 nt, Homo sapiens
uugugcaugaugcauacauggu

SEQ ID NO: 192035 - RNA, 22 nt, Homo sapiens
uugugcuugcuguguucuaugc

SEQ ID NO: 192036 - RNA, 22 nt, Homo sapiens
uuuaaagcacggaguuuguggc

SEQ ID NO: 192037 - RNA, 22 nt, Homo sapiens
auugcagcccacccugggugau

SEQ ID NO: 192038 - RNA, 22 nt, Homo sapiens
auugcauaaacacauuucuuau

SEQ ID NO: 192039 - RNA, 22 nt, Homo sapiens
auugcaugucauguuuagugua

SEQ ID NO: 192040 - RNA, 22 nt, Homo sapiens
auuggcagaaaucuuuauagua

SEQ ID NO: 192041 - RNA, 22 nt, Homo sapiens
auuggcuuuauacauaagaaua

SEQ ID NO: 192042 - RNA, 22 nt, Homo sapiens
auuggcuuuugaaagucugcga

SEQ ID NO: 192043 - RNA, 22 nt, Homo sapiens
auuguacugccccccuguugcu

SEQ ID NO: 192044 - RNA, 22 nt, Homo sapiens
auugugcuaaaguaauaaguca

SEQ ID NO: 192045 - RNA, 22 nt, Homo sapiens
auuuggcaauuuugaagaugcc

SEQ ID NO: 192046 - RNA, 22 nt, Homo sapiens
auuuuugguugucagcacuagg

SEQ ID NO: 192047 - RNA, 22 nt, Homo sapiens
caaagucuucaguugauucuga

SEQ ID NO: 192048 - RNA, 22 nt, Homo sapiens
caaagucuucucauuaugucuu

SEQ ID NO: 192049 - RNA, 22 nt, Homo sapiens
caaauccucaccucaucaugaa

SEQ ID NO: 192050 - RNA, 22 nt, Homo sapiens
caaaugcuucuauggacugucu

SEQ ID NO: 192051 - RNA, 21 nt, Homo sapiens
caaugacacuguagcugugcu

SEQ ID NO: 192052 - RNA, 22 nt, Homo sapiens
caauggcacgaucucgucucac

SEQ ID NO: 192053 - RNA, 22 nt, Homo sapiens
caauugcacucuuagguguaca

SEQ ID NO: 192054 - RNA, 22 nt, Homo sapiens
cacagcgacuuccgccuaccgg

SEQ ID NO: 192055 - RNA, 22 nt, Homo sapiens
cacauguuugcuacauuuuucu

SEQ ID NO: 192056 - RNA, 22 nt, Homo sapiens
cacauguuuuagcauggcuguu

SEQ ID NO: 192057 - RNA, 22 nt, Homo sapiens
cacucaguuugugguacuuugu

SEQ ID NO: 192058 - RNA, 22 nt, Homo sapiens
cacugcacuccagucccgucuc

SEQ ID NO: 192059 - RNA, 21 nt, Homo sapiens
cacugcaucacaggacagcau

SEQ ID NO: 192060 - RNA, 22 nt, Homo sapiens
cacuguggauggaacuauguga

SEQ ID NO: 192061 - RNA, 22 nt, Homo sapiens
cagauacuccuggucucaggag

SEQ ID NO: 192062 - RNA, 22 nt, Homo sapiens
cagcaaaucauccuauuugagc

SEQ ID NO: 192063 - RNA, 22 nt, Homo sapiens
cagcacauagcaguugcucagu

SEQ ID NO: 192064 - RNA, 22 nt, Homo sapiens
cagcaguuguuucggauuggga

SEQ ID NO: 192065 - RNA, 22 nt, Homo sapiens
cagcaucauucaucugggguaa

SEQ ID NO: 192066 - RNA, 22 nt, Homo sapiens
caggcaaggugaaguguacugg

SEQ ID NO: 192067 - RNA, 22 nt, Homo sapiens
caggcacgcuugggagacacac

SEQ ID NO: 192068 - RNA, 22 nt, Homo sapiens
caggcagucuggcucccaagug

SEQ ID NO: 192069 - RNA, 22 nt, Homo sapiens
cagguacauuuuaaagggcuca

SEQ ID NO: 192070 - RNA, 22 nt, Homo sapiens
cagguacuucugggcugagcag

SEQ ID NO: 192071 - RNA, 19 nt, Homo sapiens
cagguagugugcugacaug

SEQ ID NO: 192072 - RNA, 23 nt, Homo sapiens
cagguaguucuuuauaguagugu

SEQ ID NO: 192073 - RNA, 22 nt, Homo sapiens
caguggacuaaauggggaauau

SEQ ID NO: 192074 - RNA, 22 nt, Homo sapiens
caguguaugcuucuauuuuugg

SEQ ID NO: 192075 - RNA, 22 nt, Homo sapiens
cauaaagauggaggaggccagg

SEQ ID NO: 192076 - RNA, 22 nt, Homo sapiens
caucacacuuggauguaagaca

SEQ ID NO: 192077 - RNA, 22 nt, Homo sapiens
caucagcaauguaugaggguuc

SEQ ID NO: 192078 - RNA, 22 nt, Homo sapiens
caucccugucgucaagucucug

SEQ ID NO: 192079 - RNA, 22 nt, Homo sapiens
caugacacauguuuaccuaugu

SEQ ID NO: 192080 - RNA, 22 nt, Homo sapiens
caugauauugcagaauguuggu

SEQ ID NO: 192081 - RNA, 22 nt, Homo sapiens
cauggcuuuuauaacaagaaau

SEQ ID NO: 192082 - RNA, 22 nt, Homo sapiens
cauugcauuccagucugggcaa

SEQ ID NO: 192083 - RNA, 20 nt, Homo sapiens
cauugcccuccagccugggc

SEQ ID NO: 192084 - RNA, 22 nt, Homo sapiens
cauugcucuuacagagugagua

SEQ ID NO: 192085 - RNA, 22 nt, Homo sapiens
ccacaaccuccauauccugggu

SEQ ID NO: 192086 - RNA, 22 nt, Homo sapiens
ccacagucuaugcaacaagguc

SEQ ID NO: 192087 - RNA, 22 nt, Homo sapiens
ccaccuguacuuaagucacuuu

SEQ ID NO: 192088 - RNA, 22 nt, Homo sapiens
ccacugcacuccagcccggcaa

SEQ ID NO: 192089 - RNA, 22 nt, Homo sapiens
ccacuguuuaaauggcugagga

SEQ ID NO: 192090 - RNA, 18 nt, Homo sapiens
ccagugcaaggaaagccc

SEQ ID NO: 192091 - RNA, 21 nt, Homo sapiens
ccagugguuggaaacuauggg

SEQ ID NO: 192092 - RNA, 22 nt, Homo sapiens
cccauuguuaaguugaguaucu

SEQ ID NO: 192093 - RNA, 19 nt, Homo sapiens
cccuggcacauggaaaaug

SEQ ID NO: 192094 - RNA, 21 nt, Homo sapiens
cccugguguuuggaguuugag

SEQ ID NO: 192095 - RNA, 22 nt, Homo sapiens
ccugagaucauacuguuaguaa

SEQ ID NO: 192096 - RNA, 22 nt, Homo sapiens
ccugcauugucaaggccaagcc

SEQ ID NO: 192097 - RNA, 22 nt, Homo sapiens
ccugucuugauuaaauuacuua

SEQ ID NO: 192098 - RNA, 22 nt, Homo sapiens
cgcuggugucuaagcgacagcu

SEQ ID NO: 192099 - RNA, 22 nt, Homo sapiens
cuaaagauagugacaugauuug

SEQ ID NO: 192100 - RNA, 22 nt, Homo sapiens
cuaaaguagccaggacugcagg

SEQ ID NO: 192101 - RNA, 23 nt, Homo sapiens
cuaaagucugucacugaggacuu

SEQ ID NO: 192102 - RNA, 22 nt, Homo sapiens
cuaaaguucuucugagagaaca

SEQ ID NO: 192103 - RNA, 22 nt, Homo sapiens
cuacagugggucuguaguccuu

SEQ ID NO: 192104 - RNA, 22 nt, Homo sapiens
cuagcccagugcuccuggauca

SEQ ID NO: 192105 - RNA, 22 nt, Homo sapiens
cuagcuuuuuaugacaaucuug

SEQ ID NO: 192106 - RNA, 22 nt, Homo sapiens
cuaggcuguagagaaguucagu

SEQ ID NO: 192107 - RNA, 22 nt, Homo sapiens
cuagugcaguuccccugucuua

SEQ ID NO: 192108 - RNA, 22 nt, Homo sapiens
cuauauacugccugcugauuag

SEQ ID NO: 192109 - RNA, 22 nt, Homo sapiens
cuaucugcacaggguggaaauu

SEQ ID NO: 192110 - RNA, 22 nt, Homo sapiens
cuauguaccuggaacuguauua

SEQ ID NO: 192111 - RNA, 22 nt, Homo sapiens
cuauuacuuuuauugaacucag

SEQ ID NO: 192112 - RNA, 22 nt, Homo sapiens
cucaaagugcugggacuggcug

SEQ ID NO: 192113 - RNA, 18 nt, Homo sapiens
cucaaccucaugcagggc

SEQ ID NO: 192114 - RNA, 20 nt, Homo sapiens
cucagguauuugaggcugca

SEQ ID NO: 192115 - RNA, 22 nt, Homo sapiens
cucauggaauacuucacagcca

SEQ ID NO: 192116 - RNA, 22 nt, Homo sapiens
cucauggagaacaucugcuagg

SEQ ID NO: 192117 - RNA, 22 nt, Homo sapiens
cucauggagaaccucugcuagg

SEQ ID NO: 192118 - RNA, 22 nt, Homo sapiens
cuccuaaccagggcuguuaguc

SEQ ID NO: 192119 - RNA, 22 nt, Homo sapiens
cucugacagugguuagcacugu

SEQ ID NO: 192120 - RNA, 22 nt, Homo sapiens
cucuuugcuucuggcaucauug

SEQ ID NO: 192121 - RNA, 20 nt, Homo sapiens
cugaaugucaaggcagaggu

SEQ ID NO: 192122 - RNA, 22 nt, Homo sapiens
cugacaugcagccacugcaccu

SEQ ID NO: 192123 - RNA, 22 nt, Homo sapiens
cugagacuggugauuuaugaag

SEQ ID NO: 192124 - RNA, 22 nt, Homo sapiens
cugagaucugaaccaggagugu

SEQ ID NO: 192125 - RNA, 22 nt, Homo sapiens
cugaggcacggcgaccuuaagu

SEQ ID NO: 192126 - RNA, 22 nt, Homo sapiens
acaugcauauguuggaagaaag

SEQ ID NO: 192127 - RNA, 22 nt, Homo sapiens
accaugcaguccaauaugcaca

SEQ ID NO: 192128 - RNA, 22 nt, Homo sapiens
acccaguagucauucaggagca

SEQ ID NO: 192129 - RNA, 22 nt, Homo sapiens
acccugcuaaacagcccccugc

SEQ ID NO: 192130 - RNA, 22 nt, Homo sapiens
acccuguugucagaauguggau

SEQ ID NO: 192131 - RNA, 23 nt, Homo sapiens
accugauguuucuguggggagcc

SEQ ID NO: 192132 - RNA, 22 nt, Homo sapiens
acuauacuguaacuguauucag

SEQ ID NO: 192133 - RNA, 22 nt, Homo sapiens
acugagccuuuaaaugacuuca

SEQ ID NO: 192134 - RNA, 21 nt, Homo sapiens
acugcacuccaaccucaacag

SEQ ID NO: 192135 - RNA, 22 nt, Homo sapiens
acugcacuccagccucaugaca

SEQ ID NO: 192136 - RNA, 22 nt, Homo sapiens
acugcacuccagccucggugac

SEQ ID NO: 192137 - RNA, 22 nt, Homo sapiens
acugcacuccagccucguggac

SEQ ID NO: 192138 - RNA, 22 nt, Homo sapiens
acugcacuccagccugaugaaa

SEQ ID NO: 192139 - RNA, 22 nt, Homo sapiens
acugcacuccggccucgugaca

SEQ ID NO: 192140 - RNA, 22 nt, Homo sapiens
acugcacuccggccuggcaaca

SEQ ID NO: 192141 - RNA, 22 nt, Homo sapiens
acugcacuuauccuccaauguu

SEQ ID NO: 192142 - RNA, 20 nt, Homo sapiens
acuggcacugguaggugugg

SEQ ID NO: 192143 - RNA, 22 nt, Homo sapiens
acuggcuguuaggaauuaccuc

SEQ ID NO: 192144 - RNA, 22 nt, Homo sapiens
acuggcuuauuucacuuagcau

SEQ ID NO: 192145 - RNA, 22 nt, Homo sapiens
agaacacugaguucagggucag

SEQ ID NO: 192146 - RNA, 20 nt, Homo sapiens
agaagcauugcucucuucag

SEQ ID NO: 192147 - RNA, 19 nt, Homo sapiens
agaaucuaaauuauuucug

SEQ ID NO: 192148 - RNA, 22 nt, Homo sapiens
agaaugucagcuggauucagcu

SEQ ID NO: 192149 - RNA, 22 nt, Homo sapiens
agacagcugguagcacuuccug

SEQ ID NO: 192150 - RNA, 22 nt, Homo sapiens
agacuguaaugcauaauuuacu

SEQ ID NO: 192151 - RNA, 19 nt, Homo sapiens
agagacucauuguagcauu

SEQ ID NO: 192152 - RNA, 20 nt, Homo sapiens
agagaucaguaauucaucaa

SEQ ID NO: 192153 - RNA, 22 nt, Homo sapiens
agagcaaugggugaauauuaaa

SEQ ID NO: 192154 - RNA, 22 nt, Homo sapiens
agagguaagaauaguaguugga

SEQ ID NO: 192155 - RNA, 22 nt, Homo sapiens
agagguuuuggggcugagagcu

SEQ ID NO: 192156 - RNA, 23 nt, Homo sapiens
agagugcaauggugccaucucgg

SEQ ID NO: 192157 - RNA, 22 nt, Homo sapiens
agauauuuguuaggucugucag

SEQ ID NO: 192158 - RNA, 22 nt, Homo sapiens
agaucacaguaccguaaggcug

SEQ ID NO: 192159 - RNA, 22 nt, Homo sapiens
agaugauguuucuggcacauga

SEQ ID NO: 192160 - RNA, 22 nt, Homo sapiens
agcacaguuaaaugaggcuucu

SEQ ID NO: 192161 - RNA, 22 nt, Homo sapiens
agcagagcaguggauuuuguga

SEQ ID NO: 192162 - RNA, 22 nt, Homo sapiens
agcagguauucgggucaugggg

SEQ ID NO: 192163 - RNA, 22 nt, Homo sapiens
agcagguguccacaauguuugc

SEQ ID NO: 192164 - RNA, 22 nt, Homo sapiens
agcaguagaauuccugcaucac

SEQ ID NO: 192165 - RNA, 22 nt, Homo sapiens
agcaguagugaaaguagacuua

SEQ ID NO: 192166 - RNA, 20 nt, Homo sapiens
agcaucacagagccgggugu

SEQ ID NO: 192167 - RNA, 22 nt, Homo sapiens
agcaucaugcaguugcuauuca

SEQ ID NO: 192168 - RNA, 22 nt, Homo sapiens
agcucacagccuagcacuguga

SEQ ID NO: 192169 - RNA, 22 nt, Homo sapiens
agcugcaauguuuaguauaaua

SEQ ID NO: 192170 - RNA, 20 nt, Homo sapiens
agcugcagauauaaauccgc

SEQ ID NO: 192171 - RNA, 22 nt, Homo sapiens
agcugguuuauuucuauauccu

SEQ ID NO: 192172 - RNA, 22 nt, Homo sapiens
agcugguuuauuucucacaaca

SEQ ID NO: 192173 - RNA, 22 nt, Homo sapiens
agcuucauuccaacuuccuucu

SEQ ID NO: 192174 - RNA, 22 nt, Homo sapiens
agcuuguguuuuucuaaguauc

SEQ ID NO: 192175 - RNA, 22 nt, Homo sapiens
aggaaguaauaaguuugguucu

SEQ ID NO: 192176 - RNA, 22 nt, Homo sapiens
aggaagugugcaauuaauuucu

SEQ ID NO: 192177 - RNA, 18 nt, Homo sapiens
aggaaugguaauacuuca

SEQ ID NO: 192178 - RNA, 22 nt, Homo sapiens
aggaccauuguguagcagacau

SEQ ID NO: 192179 - RNA, 22 nt, Homo sapiens
aggagaauugguucuucuugau

SEQ ID NO: 192180 - RNA, 22 nt, Homo sapiens
aggagcacaauggucaugugga

SEQ ID NO: 192181 - RNA, 22 nt, Homo sapiens
aggagcacaggacuuugauuau

SEQ ID NO: 192182 - RNA, 22 nt, Homo sapiens
aggagcacuggccuuggaguca

SEQ ID NO: 192183 - RNA, 21 nt, Homo sapiens
aggagcauucaugacgagguu

SEQ ID NO: 192184 - RNA, 21 nt, Homo sapiens
aggcaaaugaagcagccgcuc

SEQ ID NO: 192185 - RNA, 22 nt, Homo sapiens
aggcaaaugccagcaaucacac

SEQ ID NO: 192186 - RNA, 22 nt, Homo sapiens
aggcagcuguuauauacugagu

SEQ ID NO: 192187 - RNA, 22 nt, Homo sapiens
agggagcaaaguggucuuucuc

SEQ ID NO: 192188 - RNA, 22 nt, Homo sapiens
agggcuuguuuaacuaucauua

SEQ ID NO: 192189 - RNA, 20 nt, Homo sapiens
agguacacugacaugccuuc

SEQ ID NO: 192190 - RNA, 22 nt, Homo sapiens
aggugcaauggugguuuugugg

SEQ ID NO: 192191 - RNA, 22 nt, Homo sapiens
aggugcaugcuucacuggauau

SEQ ID NO: 192192 - RNA, 22 nt, Homo sapiens
aggugcugacaggauagguuuc

SEQ ID NO: 192193 - RNA, 22 nt, Homo sapiens
aguaacaggauccaaagaaugu

SEQ ID NO: 192194 - RNA, 22 nt, Homo sapiens
aguacacuguuaaaaagaagug

SEQ ID NO: 192195 - RNA, 22 nt, Homo sapiens
aguacacuguugaacagaagug

SEQ ID NO: 192196 - RNA, 22 nt, Homo sapiens
aguaccauuccguuggagcugg

SEQ ID NO: 192197 - RNA, 22 nt, Homo sapiens
agucacagguucuugggauuag

SEQ ID NO: 192198 - RNA, 22 nt, Homo sapiens
aguccagguuuuguaauggcaa

SEQ ID NO: 192199 - RNA, 22 nt, Homo sapiens
aguccaguguuaugaucaguag

SEQ ID NO: 192200 - RNA, 23 nt, Homo sapiens
agucuguguuuacaggcucucug

SEQ ID NO: 192201 - RNA, 22 nt, Homo sapiens
agugaaaugucaccuuuuagga

SEQ ID NO: 192202 - RNA, 22 nt, Homo sapiens
agugaauuguucaacaggagga

SEQ ID NO: 192203 - RNA, 22 nt, Homo sapiens
agugagcugcagucuggggucc

SEQ ID NO: 192204 - RNA, 22 nt, Homo sapiens
agugaucauuugaauugaugau

SEQ ID NO: 192205 - RNA, 22 nt, Homo sapiens
agugcaauaaggauguagaacu

SEQ ID NO: 192206 - RNA, 22 nt, Homo sapiens
agugcacuccagccugggcaac

SEQ ID NO: 192207 - RNA, 19 nt, Homo sapiens
aguggguguuuucuguuug

SEQ ID NO: 192208 - RNA, 22 nt, Homo sapiens
agugucaggagacagguagcug

SEQ ID NO: 192209 - RNA, 22 nt, Homo sapiens
auaaaguagaggugaggugcau

SEQ ID NO: 192210 - RNA, 19 nt, Homo sapiens
auaagugaaucacgggggc

SEQ ID NO: 192211 - RNA, 22 nt, Homo sapiens
auaauaccugccacauuugaau

SEQ ID NO: 192212 - RNA, 23 nt, Homo sapiens
auaaugcaaguggugguaaucug

SEQ ID NO: 192213 - RNA, 22 nt, Homo sapiens
auaaugcuuuucuagguugcau

SEQ ID NO: 192214 - RNA, 22 nt, Homo sapiens
auacaguaaugucuuaggcugu

SEQ ID NO: 192215 - RNA, 22 nt, Homo sapiens
auacaguauggagggcccagcu

SEQ ID NO: 192216 - RNA, 22 nt, Homo sapiens
auacaguugccauuucuugugc

SEQ ID NO: 192217 - RNA, 22 nt, Homo sapiens
uaccugagacaacuuugaggaa

SEQ ID NO: 192218 - RNA, 22 nt, Homo sapiens
uacucaguaagugcuggcugcu

SEQ ID NO: 192219 - RNA, 22 nt, Homo sapiens
uacucaguagucuguugcuguc

SEQ ID NO: 192220 - RNA, 22 nt, Homo sapiens
uacucagugacugguggaucaa

SEQ ID NO: 192221 - RNA, 22 nt, Homo sapiens
uacugcacuccagccucgguga

SEQ ID NO: 192222 - RNA, 22 nt, Homo sapiens
uacuuuguuauagcagcaggaa

SEQ ID NO: 192223 - RNA, 22 nt, Homo sapiens
uagaaagcaugaccuucagaua

SEQ ID NO: 192224 - RNA, 23 nt, Homo sapiens
uagaauguuuuuccauguuucuu

SEQ ID NO: 192225 - RNA, 22 nt, Homo sapiens
uagagcacagugauuagaccua

SEQ ID NO: 192226 - RNA, 22 nt, Homo sapiens
uagagcuagggacucgcaaugu

SEQ ID NO: 192227 - RNA, 22 nt, Homo sapiens
uagagcuugacacuuuccaugg

SEQ ID NO: 192228 - RNA, 19 nt, Homo sapiens
uagagguuuaagaaaagaa

SEQ ID NO: 192229 - RNA, 22 nt, Homo sapiens
uagcaacauucagcucagguac

SEQ ID NO: 192230 - RNA, 22 nt, Homo sapiens
uagcacagugucauucuaggua

SEQ ID NO: 192231 - RNA, 22 nt, Homo sapiens
uagcagcauaaauggacuaaga

SEQ ID NO: 192232 - RNA, 22 nt, Homo sapiens
uagcagcauuuuuguagaguau

SEQ ID NO: 192233 - RNA, 22 nt, Homo sapiens
uagcccagugagguugauuugg

SEQ ID NO: 192234 - RNA, 22 nt, Homo sapiens
uagcuggaauuacuugcaccug

SEQ ID NO: 192235 - RNA, 22 nt, Homo sapiens
uaggacacagaccuggauggaa

SEQ ID NO: 192236 - RNA, 22 nt, Homo sapiens
uaggacacaggacauauguaga

SEQ ID NO: 192237 - RNA, 22 nt, Homo sapiens
uaggacacucucuccaccagua

SEQ ID NO: 192238 - RNA, 22 nt, Homo sapiens
uaggagcauaggauuguuugag

SEQ ID NO: 192239 - RNA, 22 nt, Homo sapiens
uagggcuugugaucagguguag

SEQ ID NO: 192240 - RNA, 22 nt, Homo sapiens
uagggcuuuaguuugcuugugu

SEQ ID NO: 192241 - RNA, 19 nt, Homo sapiens
uaggugguuuuccccucac

SEQ ID NO: 192242 - RNA, 22 nt, Homo sapiens
uaguaccauucccaaaccaacu

SEQ ID NO: 192243 - RNA, 21 nt, Homo sapiens
uagugcugaggcaguauggga

SEQ ID NO: 192244 - RNA, 22 nt, Homo sapiens
uauaagacuagcagcugaauug

SEQ ID NO: 192245 - RNA, 22 nt, Homo sapiens
uauacaguaggcacucaguggc

SEQ ID NO: 192246 - RNA, 22 nt, Homo sapiens
uauacaugugggcaucaggaga

SEQ ID NO: 192247 - RNA, 22 nt, Homo sapiens
uauaucacaugcacucauuuuc

SEQ ID NO: 192248 - RNA, 22 nt, Homo sapiens
uaucaaacccaaggaggggguu

SEQ ID NO: 192249 - RNA, 22 nt, Homo sapiens
uaucaaguuggaagagaaguaa

SEQ ID NO: 192250 - RNA, 22 nt, Homo sapiens
uaucacaaacuuagcaguuuaa

SEQ ID NO: 192251 - RNA, 22 nt, Homo sapiens
uaucacaguugcauauuuaagg

SEQ ID NO: 192252 - RNA, 22 nt, Homo sapiens
uaucucaguguacaggaugaua

SEQ ID NO: 192253 - RNA, 20 nt, Homo sapiens
uaucucaguuuguccuaaac

SEQ ID NO: 192254 - RNA, 22 nt, Homo sapiens
uaucucuuuucauguguaaaug

SEQ ID NO: 192255 - RNA, 22 nt, Homo sapiens
uaugaacacuuuugggaggcau

SEQ ID NO: 192256 - RNA, 20 nt, Homo sapiens
uaugacacugucauaaaaau

SEQ ID NO: 192257 - RNA, 22 nt, Homo sapiens
ucaucagaaucccuuagggaug

SEQ ID NO: 192258 - RNA, 22 nt, Homo sapiens
ucaucaggcucauucaagcuga

SEQ ID NO: 192259 - RNA, 22 nt, Homo sapiens
ucaugaaguaguuaacugguug

SEQ ID NO: 192260 - RNA, 22 nt, Homo sapiens
ucaugagacacacuggaaagga

SEQ ID NO: 192261 - RNA, 22 nt, Homo sapiens
ucaugggagcccccaucaugag

SEQ ID NO: 192262 - RNA, 22 nt, Homo sapiens
ucauguauuaucauuagugggu

SEQ ID NO: 192263 - RNA, 22 nt, Homo sapiens
ucauucacucccuugaaguuag

SEQ ID NO: 192264 - RNA, 22 nt, Homo sapiens
ucauucuuucuguggaggggcu

SEQ ID NO: 192265 - RNA, 22 nt, Homo sapiens
uccacuuuugugcugaauugga

SEQ ID NO: 192266 - RNA, 22 nt, Homo sapiens
uccaugugaaaaggucgugaua

SEQ ID NO: 192267 - RNA, 22 nt, Homo sapiens
uccauuugucuauguuucuguu

SEQ ID NO: 192268 - RNA, 22 nt, Homo sapiens
ucccaagaugagaugggggcug

SEQ ID NO: 192269 - RNA, 23 nt, Homo sapiens
ucccaagauggaccagaccaagg

SEQ ID NO: 192270 - RNA, 22 nt, Homo sapiens
ucccaguauucauuuacagaag

SEQ ID NO: 192271 - RNA, 23 nt, Homo sapiens
uccccgggagcaccagcuuguug

SEQ ID NO: 192272 - RNA, 22 nt, Homo sapiens
uccccugagaccccucagcacu

SEQ ID NO: 192273 - RNA, 20 nt, Homo sapiens
ucccucaaacuuuuccacug

SEQ ID NO: 192274 - RNA, 22 nt, Homo sapiens
uccugagacugaggagcuuugg

SEQ ID NO: 192275 - RNA, 22 nt, Homo sapiens
uccugcauucauccugguguug

SEQ ID NO: 192276 - RNA, 22 nt, Homo sapiens
uccuucauuugucaacucuagu

SEQ ID NO: 192277 - RNA, 22 nt, Homo sapiens
uccuugagaggacagagccaua

SEQ ID NO: 192278 - RNA, 21 nt, Homo sapiens
uccuuggugaugcccugcagu

SEQ ID NO: 192279 - RNA, 22 nt, Homo sapiens
ucgacacugaccuaguucagca

SEQ ID NO: 192280 - RNA, 22 nt, Homo sapiens
ucucaaccucccaaguagcugg

SEQ ID NO: 192281 - RNA, 18 nt, Homo sapiens
ucucacagcaaucuguca

SEQ ID NO: 192282 - RNA, 19 nt, Homo sapiens
ucucacagcucuacuaugu

SEQ ID NO: 192283 - RNA, 22 nt, Homo sapiens
ucucaguguuaucuaucugccu

SEQ ID NO: 192284 - RNA, 17 nt, Homo sapiens
ucucccaucccuuucuc

SEQ ID NO: 192285 - RNA, 22 nt, Homo sapiens
ucucuguuuauuuuugguguau

SEQ ID NO: 192286 - RNA, 22 nt, Homo sapiens
ucugagguuaaauuuuauaguu

SEQ ID NO: 192287 - RNA, 22 nt, Homo sapiens
ucugagguuacugcuuuguaga

SEQ ID NO: 192288 - RNA, 21 nt, Homo sapiens
ucugagucauucaguggccug

SEQ ID NO: 192289 - RNA, 22 nt, Homo sapiens
ucuggagugugaaguggauaug

SEQ ID NO: 192290 - RNA, 22 nt, Homo sapiens
ucugggguuagucaaagguaug

SEQ ID NO: 192291 - RNA, 22 nt, Homo sapiens
uuaugcagcaaagugcuugaaa

SEQ ID NO: 192292 - RNA, 22 nt, Homo sapiens
uuauuagguuaaccuauagcua

SEQ ID NO: 192293 - RNA, 22 nt, Homo sapiens
uuauuagguugguggaaaagua

SEQ ID NO: 192294 - RNA, 22 nt, Homo sapiens
uuauugcuuaugauuagguguu

SEQ ID NO: 192295 - RNA, 22 nt, Homo sapiens
uuauuugguuauuguaauuggg

SEQ ID NO: 192296 - RNA, 22 nt, Homo sapiens
uuauuugguugcugacuuggaa

SEQ ID NO: 192297 - RNA, 22 nt, Homo sapiens
uucaaaguaaagggauggagac

SEQ ID NO: 192298 - RNA, 22 nt, Homo sapiens
uucaauuaauauuauacucuca

SEQ ID NO: 192299 - RNA, 22 nt, Homo sapiens
uucacagcuuaauaaggcucag

SEQ ID NO: 192300 - RNA, 22 nt, Homo sapiens
uucacaguacucccuggaauua

SEQ ID NO: 192301 - RNA, 22 nt, Homo sapiens
uucagcuacuugggaggcugaa

SEQ ID NO: 192302 - RNA, 22 nt, Homo sapiens
uucaggcaccauggucauugau

SEQ ID NO: 192303 - RNA, 22 nt, Homo sapiens
uucagggcauuggaguuucuga

SEQ ID NO: 192304 - RNA, 22 nt, Homo sapiens
uucaguacacguguucucauuu

SEQ ID NO: 192305 - RNA, 18 nt, Homo sapiens
uucagugaauucuuuuga

SEQ ID NO: 192306 - RNA, 22 nt, Homo sapiens
uucagugagacgaaaacaacaa

SEQ ID NO: 192307 - RNA, 22 nt, Homo sapiens
uucaguggacuuaguagugcuu

SEQ ID NO: 192308 - RNA, 22 nt, Homo sapiens
cacaggaagaggcacggucccu

SEQ ID NO: 192309 - RNA, 22 nt, Homo sapiens
cacagucugggcuuguuuguac

SEQ ID NO: 192310 - RNA, 22 nt, Homo sapiens
caccagcuggcauugaauaccu

SEQ ID NO: 192311 - RNA, 22 nt, Homo sapiens
caccaggugcccagcacggcca

SEQ ID NO: 192312 - RNA, 22 nt, Homo sapiens
cacccaguaagcaugaggcccu

SEQ ID NO: 192313 - RNA, 22 nt, Homo sapiens
cacugcacuccagcuugugggc

SEQ ID NO: 192314 - RNA, 22 nt, Homo sapiens
cacugcaguggaagauuaagaa

SEQ ID NO: 192315 - RNA, 22 nt, Homo sapiens
cacugcauccucugccuggcgg

SEQ ID NO: 192316 - RNA, 22 nt, Homo sapiens
cacugggccaucacuuaauauu

SEQ ID NO: 192317 - RNA, 22 nt, Homo sapiens
cagacaugucuuguggccgugg

SEQ ID NO: 192318 - RNA, 22 nt, Homo sapiens
cagagcacuaaagguaaaaggc

SEQ ID NO: 192319 - RNA, 22 nt, Homo sapiens
cagccgggugagguggcuuguu

SEQ ID NO: 192320 - RNA, 23 nt, Homo sapiens
cagcucauuuggguccccuuguc

SEQ ID NO: 192321 - RNA, 22 nt, Homo sapiens
caggcauagucuugaguuuuau

SEQ ID NO: 192322 - RNA, 20 nt, Homo sapiens
cagggcaaugaggagguaaa

SEQ ID NO: 192323 - RNA, 22 nt, Homo sapiens
cagguacaugcaugugugugca

SEQ ID NO: 192324 - RNA, 22 nt, Homo sapiens
caggugaaugccucuccuucug

SEQ ID NO: 192325 - RNA, 22 nt, Homo sapiens
caggugguauuugguuuucugu

SEQ ID NO: 192326 - RNA, 22 nt, Homo sapiens
caguacaauguugauuagaagu

SEQ ID NO: 192327 - RNA, 19 nt, Homo sapiens
caguaucauugcacauagu

SEQ ID NO: 192328 - RNA, 22 nt, Homo sapiens
cagugacacugaaaaguucggg

SEQ ID NO: 192329 - RNA, 22 nt, Homo sapiens
cagugcaugacuguauauuauc

SEQ ID NO: 192330 - RNA, 22 nt, Homo sapiens
cagugcuuguuauuguucuauu

SEQ ID NO: 192331 - RNA, 22 nt, Homo sapiens
caguggaugaacaagaagugau

SEQ ID NO: 192332 - RNA, 22 nt, Homo sapiens
cauacaugugcuugucuuaugc

SEQ ID NO: 192333 - RNA, 22 nt, Homo sapiens
caugaaagacugaggaauugga

SEQ ID NO: 192334 - RNA, 22 nt, Homo sapiens
cauggcacuggugggagugucu

SEQ ID NO: 192335 - RNA, 22 nt, Homo sapiens
cauggcuuuaagcaacaccaag

SEQ ID NO: 192336 - RNA, 22 nt, Homo sapiens
cauggcuuucacaguaaagccu

SEQ ID NO: 192337 - RNA, 21 nt, Homo sapiens
caugucacugcacucuagccu

SEQ ID NO: 192338 - RNA, 22 nt, Homo sapiens
cauugcacuccagccugaggga

SEQ ID NO: 192339 - RNA, 19 nt, Homo sapiens
ccacaaugguugaacuaga

SEQ ID NO: 192340 - RNA, 23 nt, Homo sapiens
ccacaaugguugaacuagauuac

SEQ ID NO: 192341 - RNA, 22 nt, Homo sapiens
ccacugggcuagguguuuugga

SEQ ID NO: 192342 - RNA, 20 nt, Homo sapiens
ccagcaucauuagauucugg

SEQ ID NO: 192343 - RNA, 22 nt, Homo sapiens
ccagugguucccuguggccuga

SEQ ID NO: 192344 - RNA, 22 nt, Homo sapiens
ccagugucugacagacacggcg

SEQ ID NO: 192345 - RNA, 22 nt, Homo sapiens
ccaguuuucccagcaccauuaa

SEQ ID NO: 192346 - RNA, 22 nt, Homo sapiens
ccaguuuuucauuuauacuagu

SEQ ID NO: 192347 - RNA, 22 nt, Homo sapiens
ccaguuuuuggcaaugaugaau

SEQ ID NO: 192348 - RNA, 22 nt, Homo sapiens
ccauggcaauggucagucuauu

SEQ ID NO: 192349 - RNA, 22 nt, Homo sapiens
cccagaguucuuaaauacugag

SEQ ID NO: 192350 - RNA, 22 nt, Homo sapiens
cccaguuuugccacuuacuagc

SEQ ID NO: 192351 - RNA, 22 nt, Homo sapiens
ccccagguuucaauaaagccca

SEQ ID NO: 192352 - RNA, 22 nt, Homo sapiens
cccugugaauauuaccuuauuu

SEQ ID NO: 192353 - RNA, 22 nt, Homo sapiens
cccuugcacuucagagcugcau

SEQ ID NO: 192354 - RNA, 22 nt, Homo sapiens
ccuaggcacugggguccagccc

SEQ ID NO: 192355 - RNA, 19 nt, Homo sapiens
ccucaaguacuaauauguu

SEQ ID NO: 192356 - RNA, 22 nt, Homo sapiens
ccugcauaguucaccgcugaua

SEQ ID NO: 192357 - RNA, 22 nt, Homo sapiens
ccuuuuugaguugccagaguuc

SEQ ID NO: 192358 - RNA, 22 nt, Homo sapiens
cgccugagcugaggaagcugca

SEQ ID NO: 192359 - RNA, 16 nt, Homo sapiens
cuaaaaugucuacuug

SEQ ID NO: 192360 - RNA, 22 nt, Homo sapiens
cuaaugcagucaggagaaggaa

SEQ ID NO: 192361 - RNA, 22 nt, Homo sapiens
cuacaguguauuuauggagggu

SEQ ID NO: 192362 - RNA, 22 nt, Homo sapiens
cuacugacacuacugcaaucau

SEQ ID NO: 192363 - RNA, 22 nt, Homo sapiens
cuagcagaacaauacaauucgg

SEQ ID NO: 192364 - RNA, 22 nt, Homo sapiens
cuagcagacaggcugggagcag

SEQ ID NO: 192365 - RNA, 22 nt, Homo sapiens
cuagcaggcaagauaagauuca

SEQ ID NO: 192366 - RNA, 22 nt, Homo sapiens
cuaggaaguauguguuauugcu

SEQ ID NO: 192367 - RNA, 22 nt, Homo sapiens
cuauuagguuggggcgaaagua

SEQ ID NO: 192368 - RNA, 22 nt, Homo sapiens
cuauuagguuggugcaaaagua

SEQ ID NO: 192369 - RNA, 19 nt, Homo sapiens
cuauugcacauagcugaag

SEQ ID NO: 192370 - RNA, 22 nt, Homo sapiens
cuauuugguuggugaaaaaagu

SEQ ID NO: 192371 - RNA, 22 nt, Homo sapiens
cucaaagucaagggaaagcagg

SEQ ID NO: 192372 - RNA, 22 nt, Homo sapiens
cucaaagugcugggauuggcca

SEQ ID NO: 192373 - RNA, 22 nt, Homo sapiens
cucaaaguguggucuguggguu

SEQ ID NO: 192374 - RNA, 18 nt, Homo sapiens
cucacaguaacuuuuaag

SEQ ID NO: 192375 - RNA, 22 nt, Homo sapiens
cucacagugacacgaaccccca

SEQ ID NO: 192376 - RNA, 22 nt, Homo sapiens
cucacaguucuaaaggcaagaa

SEQ ID NO: 192377 - RNA, 22 nt, Homo sapiens
cucauggagauagagaauagaa

SEQ ID NO: 192378 - RNA, 22 nt, Homo sapiens
cucccacccucauuuuuaggca

SEQ ID NO: 192379 - RNA, 22 nt, Homo sapiens
cucccagugacccaggaacagg

SEQ ID NO: 192380 - RNA, 22 nt, Homo sapiens
cuccuguagccccaucaucuuu

SEQ ID NO: 192381 - RNA, 20 nt, Homo sapiens
cucuaguaauaaaguuuccc

SEQ ID NO: 192382 - RNA, 22 nt, Homo sapiens
cucucaguguggaggccagaaa

SEQ ID NO: 192383 - RNA, 22 nt, Homo sapiens
cucugguggaagcagggggcaa

SEQ ID NO: 192384 - RNA, 22 nt, Homo sapiens
cucuuugaggugagcugcccau

SEQ ID NO: 192385 - RNA, 22 nt, Homo sapiens
cugaaagagcauguaacacagu

SEQ ID NO: 192386 - RNA, 22 nt, Homo sapiens
cugaaaugaauuauuuucuuuc

SEQ ID NO: 192387 - RNA, 22 nt, Homo sapiens
cugaaggcagguagaauagaga

SEQ ID NO: 192388 - RNA, 22 nt, Homo sapiens
cugaauagagcacacugauggg

SEQ ID NO: 192389 - RNA, 22 nt, Homo sapiens
cugaaucauugcauuaucaagg

SEQ ID NO: 192390 - RNA, 22 nt, Homo sapiens
cugacuaguuuuaaugcagauu

SEQ ID NO: 192391 - RNA, 22 nt, Homo sapiens
cugacuuuagaacccaaaaagu

SEQ ID NO: 192392 - RNA, 22 nt, Homo sapiens
cugagaaugaugauuuccaguu

SEQ ID NO: 192393 - RNA, 22 nt, Homo sapiens
cugagacuggguaauguauaaa

SEQ ID NO: 192394 - RNA, 22 nt, Homo sapiens
cugaggugggaggauuacuuga

SEQ ID NO: 192395 - RNA, 22 nt, Homo sapiens
cugaguauaacugaccuuauga

SEQ ID NO: 192396 - RNA, 18 nt, Homo sapiens
cugagucauuccuggguc

SEQ ID NO: 192397 - RNA, 22 nt, Homo sapiens
cugcacugagacccucuuugcu

SEQ ID NO: 192398 - RNA, 22 nt, Homo sapiens
cugcauuugaugacguauggug

SEQ ID NO: 192399 - RNA, 18 nt, Homo sapiens
cugccagugugcucuccg

SEQ ID NO: 192400 - RNA, 22 nt, Homo sapiens
cuggaaugugagccccaaaaag

SEQ ID NO: 192401 - RNA, 22 nt, Homo sapiens
cuggauauuaacauugaugaaa

SEQ ID NO: 192402 - RNA, 22 nt, Homo sapiens
cuggcaagagugaaccagcugu

SEQ ID NO: 192403 - RNA, 22 nt, Homo sapiens
cugggucaguuucugauuauug

SEQ ID NO: 192404 - RNA, 22 nt, Homo sapiens
cuguaugugagaaauaauaagu

SEQ ID NO: 192405 - RNA, 22 nt, Homo sapiens
cuguauguuucuaugaauguga

SEQ ID NO: 192406 - RNA, 19 nt, Homo sapiens
cugucacugaggaagacug

SEQ ID NO: 192407 - RNA, 18 nt, Homo sapiens
aaaaagugcucaggccua

SEQ ID NO: 192408 - RNA, 22 nt, Homo sapiens
aaacauugaccucauccuggca

SEQ ID NO: 192409 - RNA, 22 nt, Homo sapiens
aaacugccuuccuuguaggugc

SEQ ID NO: 192410 - RNA, 22 nt, Homo sapiens
aaagcugucaaggcaggaggcu

SEQ ID NO: 192411 - RNA, 22 nt, Homo sapiens
aaagggcuuuguaaacuucaag

SEQ ID NO: 192412 - RNA, 22 nt, Homo sapiens
aaagugauugcgguuuuugcca

SEQ ID NO: 192413 - RNA, 22 nt, Homo sapiens
aaagugcaguauuugggcagga

SEQ ID NO: 192414 - RNA, 22 nt, Homo sapiens
aaaugcaucauuaggugauuuu

SEQ ID NO: 192415 - RNA, 22 nt, Homo sapiens
aaaugcuucuauguggcauguu

SEQ ID NO: 192416 - RNA, 22 nt, Homo sapiens
aaaugcuuucuuggaccauuug

SEQ ID NO: 192417 - RNA, 22 nt, Homo sapiens
aaauucaugucaccucuaggua

SEQ ID NO: 192418 - RNA, 22 nt, Homo sapiens
aacagacugucacauaaaauug

SEQ ID NO: 192419 - RNA, 23 nt, Homo sapiens
aagagguaugacuaugaagugga

SEQ ID NO: 192420 - RNA, 22 nt, Homo sapiens
aagaugcagucauacuggagua

SEQ ID NO: 192421 - RNA, 22 nt, Homo sapiens
aagcacccuuugucuggacaug

SEQ ID NO: 192422 - RNA, 22 nt, Homo sapiens
aagcaugguuuccaggggucac

SEQ ID NO: 192423 - RNA, 22 nt, Homo sapiens
aagcuccauuucugccaugaga

SEQ ID NO: 192424 - RNA, 22 nt, Homo sapiens
aagcuggagugcaguggugcga

SEQ ID NO: 192425 - RNA, 22 nt, Homo sapiens
aagcugguuuuauaucugugag

SEQ ID NO: 192426 - RNA, 22 nt, Homo sapiens
aaggaauucaaauuuucucugg

SEQ ID NO: 192427 - RNA, 23 nt, Homo sapiens
aaggacacugaacacuucccagc

SEQ ID NO: 192428 - RNA, 22 nt, Homo sapiens
aagggaaugugguagcugguuu

SEQ ID NO: 192429 - RNA, 22 nt, Homo sapiens
aagggaauguuguagcugguuu

SEQ ID NO: 192430 - RNA, 18 nt, Homo sapiens
aaggugcuucuguucuga

SEQ ID NO: 192431 - RNA, 22 nt, Homo sapiens
aaguaucaggaauaguuauugg

SEQ ID NO: 192432 - RNA, 22 nt, Homo sapiens
aaguauuagugaggauauggaa

SEQ ID NO: 192433 - RNA, 22 nt, Homo sapiens
aagucaaggagagaagcuucag

SEQ ID NO: 192434 - RNA, 22 nt, Homo sapiens
aagugguguuugggagcuggac

SEQ ID NO: 192435 - RNA, 22 nt, Homo sapiens
aauaagaaguggaagggaccgg

SEQ ID NO: 192436 - RNA, 22 nt, Homo sapiens
aauauguccuugaaauggugcu

SEQ ID NO: 192437 - RNA, 22 nt, Homo sapiens
aaucacacuugauguugagcaa

SEQ ID NO: 192438 - RNA, 22 nt, Homo sapiens
aaucauggaguauuuguccuug

SEQ ID NO: 192439 - RNA, 22 nt, Homo sapiens
aaucucagcauuuugggcugag

SEQ ID NO: 192440 - RNA, 22 nt, Homo sapiens
aaucugggguuguuuggggagu

SEQ ID NO: 192441 - RNA, 22 nt, Homo sapiens
aaugacacugagcaucuuucau

SEQ ID NO: 192442 - RNA, 22 nt, Homo sapiens
aaugauauguuauguuuagguu

SEQ ID NO: 192443 - RNA, 22 nt, Homo sapiens
aaugcacauaaaauccuccagg

SEQ ID NO: 192444 - RNA, 22 nt, Homo sapiens
aauggcacaagacaugaagaag

SEQ ID NO: 192445 - RNA, 22 nt, Homo sapiens
aauugcauaaaauucaacucug

SEQ ID NO: 192446 - RNA, 22 nt, Homo sapiens
aauugcauugaauuuguagcuu

SEQ ID NO: 192447 - RNA, 22 nt, Homo sapiens
aauuggcagugcucuugccaca

SEQ ID NO: 192448 - RNA, 22 nt, Homo sapiens
aauugguuaagauaagaucaua

SEQ ID NO: 192449 - RNA, 22 nt, Homo sapiens
acacaugugaaaaaaauguuac

SEQ ID NO: 192450 - RNA, 22 nt, Homo sapiens
acacuauugagguuuguuugca

SEQ ID NO: 192451 - RNA, 22 nt, Homo sapiens
acacuguuggugggaguguaaa

SEQ ID NO: 192452 - RNA, 22 nt, Homo sapiens
acagaacugggcuugcuuuugg

SEQ ID NO: 192453 - RNA, 19 nt, Homo sapiens
acaguaccuggcaugaggu

SEQ ID NO: 192454 - RNA, 22 nt, Homo sapiens
acaguacucugcucuuuugauu

SEQ ID NO: 192455 - RNA, 22 nt, Homo sapiens
acaguacuguuguuugcugcca

SEQ ID NO: 192456 - RNA, 20 nt, Homo sapiens
acaguagaagggauuucaaa

SEQ ID NO: 192457 - RNA, 22 nt, Homo sapiens
acaguguguguguucaccuaga

SEQ ID NO: 192458 - RNA, 22 nt, Homo sapiens
acauaaagaagcaggacauugu

SEQ ID NO: 192459 - RNA, 22 nt, Homo sapiens
acaucaggcuugugaugauuac

SEQ ID NO: 192460 - RNA, 22 nt, Homo sapiens
acaucccuuucccacccuucac

SEQ ID NO: 192461 - RNA, 22 nt, Homo sapiens
acaugacauugggguggggaua

SEQ ID NO: 192462 - RNA, 22 nt, Homo sapiens
acccaguagccagauguagcug

SEQ ID NO: 192463 - RNA, 22 nt, Homo sapiens
acccgcccagguguggccggga

SEQ ID NO: 192464 - RNA, 21 nt, Homo sapiens
acccucuaguuuucaacaggc

SEQ ID NO: 192465 - RNA, 22 nt, Homo sapiens
acccuguugguggaucagauug

SEQ ID NO: 192466 - RNA, 22 nt, Homo sapiens
acccuuaagcacuaguucagcu

SEQ ID NO: 192467 - RNA, 22 nt, Homo sapiens
acggaacugcuccauucuuugc

SEQ ID NO: 192468 - RNA, 22 nt, Homo sapiens
acuauacugaagcaaauuaaca

SEQ ID NO: 192469 - RNA, 22 nt, Homo sapiens
acucacagcaaccuccgccucc

SEQ ID NO: 192470 - RNA, 22 nt, Homo sapiens
acucagagauuagcacauguuu

SEQ ID NO: 192471 - RNA, 23 nt, Homo sapiens
acugagcaauguuuacauacuug

SEQ ID NO: 192472 - RNA, 18 nt, Homo sapiens
acugcacuccaccuuggg

SEQ ID NO: 192473 - RNA, 22 nt, Homo sapiens
acugcacuccaccuugggcaac

SEQ ID NO: 192474 - RNA, 22 nt, Homo sapiens
acugcacuccagcccaggugac

SEQ ID NO: 192475 - RNA, 22 nt, Homo sapiens
acugcacuccagccucgugaca

SEQ ID NO: 192476 - RNA, 22 nt, Homo sapiens
acugcacuccagccuggacgac

SEQ ID NO: 192477 - RNA, 22 nt, Homo sapiens
acugcacuccagccuguugaca

SEQ ID NO: 192478 - RNA, 22 nt, Homo sapiens
acugcacuccagccuuagugac

SEQ ID NO: 192479 - RNA, 22 nt, Homo sapiens
acugcacuccagccuucaggac

SEQ ID NO: 192480 - RNA, 22 nt, Homo sapiens
acugcacuccagcuccagggug

SEQ ID NO: 192481 - RNA, 22 nt, Homo sapiens
acugcacuccaguuccgggcaa

SEQ ID NO: 192482 - RNA, 22 nt, Homo sapiens
acugcacucccgcccgggugac

SEQ ID NO: 192483 - RNA, 22 nt, Homo sapiens
acugcacucuagccccugcgac

SEQ ID NO: 192484 - RNA, 22 nt, Homo sapiens
acugcacucuagccuuggcaac

SEQ ID NO: 192485 - RNA, 22 nt, Homo sapiens
acugcacugucaaccuccuggg

SEQ ID NO: 192486 - RNA, 19 nt, Homo sapiens
acuuuggugauuagaggga

SEQ ID NO: 192487 - RNA, 22 nt, Homo sapiens
acuuugguuaucauacuuucag

SEQ ID NO: 192488 - RNA, 22 nt, Homo sapiens
acuuuuguuauacagugugaua

SEQ ID NO: 192489 - RNA, 22 nt, Homo sapiens
acuuuuugauggggagaacauu

SEQ ID NO: 192490 - RNA, 22 nt, Homo sapiens
agaaauguuuacucacccccuu

SEQ ID NO: 192491 - RNA, 21 nt, Homo sapiens
agacacuuggaagguuuuaga

SEQ ID NO: 192492 - RNA, 18 nt, Homo sapiens
ggcggguguuuuauucac

SEQ ID NO: 192493 - RNA, 22 nt, Homo sapiens
gggaagugugcagaguucucuu

SEQ ID NO: 192494 - RNA, 22 nt, Homo sapiens
ggguaggcaagcggaugucaga

SEQ ID NO: 192495 - RNA, 22 nt, Homo sapiens
gggucauggaugugaagcuaga

SEQ ID NO: 192496 - RNA, 22 nt, Homo sapiens
gggugguuuuauuaucagugac

SEQ ID NO: 192497 - RNA, 22 nt, Homo sapiens
ggucaaguaauccuggguguca

SEQ ID NO: 192498 - RNA, 19 nt, Homo sapiens
ggucagcaaagucuagcug

SEQ ID NO: 192499 - RNA, 22 nt, Homo sapiens
ggucaggagaaugguaacugag

SEQ ID NO: 192500 - RNA, 22 nt, Homo sapiens
ggugaggaaaguugaguuucua

SEQ ID NO: 192501 - RNA, 23 nt, Homo sapiens
ggugaggaguacagagucuucau

SEQ ID NO: 192502 - RNA, 22 nt, Homo sapiens
gguggcaaaucugaguggcgcu

SEQ ID NO: 192503 - RNA, 22 nt, Homo sapiens
guaaauaccaguuucuggaaca

SEQ ID NO: 192504 - RNA, 22 nt, Homo sapiens
guaaucucagcuacuugggagc

SEQ ID NO: 192505 - RNA, 22 nt, Homo sapiens
guauacacccugugauauuauu

SEQ ID NO: 192506 - RNA, 21 nt, Homo sapiens
ugcccaguggcuuggggucag

SEQ ID NO: 192507 - RNA, 22 nt, Homo sapiens
ugcccguaauuccagcacuuug

SEQ ID NO: 192508 - RNA, 22 nt, Homo sapiens
ugccugagccagguuuuaggag

SEQ ID NO: 192509 - RNA, 22 nt, Homo sapiens
ugcuagaagaucacacacauca

SEQ ID NO: 192510 - RNA, 20 nt, Homo sapiens
ugcugcacuuaagcaugggc

SEQ ID NO: 192511 - RNA, 22 nt, Homo sapiens
ugcugcuguuaucauuuuacca

SEQ ID NO: 192512 - RNA, 22 nt, Homo sapiens
ugcugguguuuaggaauaagaa

SEQ ID NO: 192513 - RNA, 22 nt, Homo sapiens
ugcugguuuucaucaucagugg

SEQ ID NO: 192514 - RNA, 22 nt, Homo sapiens
ugcuuugguagaaaucuuuggu

SEQ ID NO: 192515 - RNA, 22 nt, Homo sapiens
uggaaaacaugcacauuggauu

SEQ ID NO: 192516 - RNA, 22 nt, Homo sapiens
uggaagacucaagguggugaau

SEQ ID NO: 192517 - RNA, 23 nt, Homo sapiens
uggaagacuccucucuuggcugc

SEQ ID NO: 192518 - RNA, 22 nt, Homo sapiens
uggaaguaaucaugagguagca

SEQ ID NO: 192519 - RNA, 23 nt, Homo sapiens
uggaaguauggaggaggcagaau

SEQ ID NO: 192520 - RNA, 22 nt, Homo sapiens
uggaagucuauggcauuugagu

SEQ ID NO: 192521 - RNA, 22 nt, Homo sapiens
gugucaguggggagugaucuuc

SEQ ID NO: 192522 - RNA, 22 nt, Homo sapiens
guguccucgaguacacaucagg

SEQ ID NO: 192523 - RNA, 22 nt, Homo sapiens
guguuauggagccaaacuacua

SEQ ID NO: 192524 - RNA, 22 nt, Homo sapiens
guucacaguuucuaaucccagc

SEQ ID NO: 192525 - RNA, 22 nt, Homo sapiens
guugcagcacacaggcugucag

SEQ ID NO: 192526 - RNA, 22 nt, Homo sapiens
guuggaauguauugcuacuucu

SEQ ID NO: 192527 - RNA, 22 nt, Homo sapiens
guuugcauagugcugggagggg

SEQ ID NO: 192528 - RNA, 21 nt, Homo sapiens
uaaaacuguaacuuuguccug

SEQ ID NO: 192529 - RNA, 22 nt, Homo sapiens
uaaaccacguuuacauuugaga

SEQ ID NO: 192530 - RNA, 22 nt, Homo sapiens
uaaacugcuugaaaugguguca

SEQ ID NO: 192531 - RNA, 22 nt, Homo sapiens
ucaaaugguccacgugaacauu

SEQ ID NO: 192532 - RNA, 22 nt, Homo sapiens
ucaagcaauucgccugucucag

SEQ ID NO: 192533 - RNA, 22 nt, Homo sapiens
ucaaggacucagagagggauua

SEQ ID NO: 192534 - RNA, 20 nt, Homo sapiens
ucaaggcaggaacuguacau

SEQ ID NO: 192535 - RNA, 22 nt, Homo sapiens
ucaaguaagaagugggcauaaa

SEQ ID NO: 192536 - RNA, 22 nt, Homo sapiens
ucaaugcaugugacaaagagua

SEQ ID NO: 192537 - RNA, 22 nt, Homo sapiens
ucaauugcaucaacaguguaca

SEQ ID NO: 192538 - RNA, 21 nt, Homo sapiens
ucacaaugaacagcagcagaa

SEQ ID NO: 192539 - RNA, 22 nt, Homo sapiens
ucacaauggagacucgggcgga

SEQ ID NO: 192540 - RNA, 23 nt, Homo sapiens
ucacacuuaagagaaaugcagcu

SEQ ID NO: 192541 - RNA, 22 nt, Homo sapiens
ucacagauaaauaaagaugauu

SEQ ID NO: 192542 - RNA, 20 nt, Homo sapiens
ucacagucacacauaauccu

SEQ ID NO: 192543 - RNA, 22 nt, Homo sapiens
ucacaguccuguuuaggagagg

SEQ ID NO: 192544 - RNA, 22 nt, Homo sapiens
ucacagucggugacuucuugcu

SEQ ID NO: 192545 - RNA, 22 nt, Homo sapiens
ucacaguuggccuggccuuuua

SEQ ID NO: 192546 - RNA, 22 nt, Homo sapiens
ucacaugaauugucuuguucca

SEQ ID NO: 192547 - RNA, 21 nt, Homo sapiens
ucacauggccagaguaggaac

SEQ ID NO: 192548 - RNA, 22 nt, Homo sapiens
ucacauggggaagggacuagcu

SEQ ID NO: 192549 - RNA, 22 nt, Homo sapiens
ucacaugggugcaauauaauca

SEQ ID NO: 192550 - RNA, 22 nt, Homo sapiens
ucacaugugcguuuuggcaugu

SEQ ID NO: 192551 - RNA, 22 nt, Homo sapiens
ucacauguguaaauugguguaa

SEQ ID NO: 192552 - RNA, 22 nt, Homo sapiens
ucacauuaagcuguuauuucuu

SEQ ID NO: 192553 - RNA, 22 nt, Homo sapiens
ucaccaguggcacuccagccug

SEQ ID NO: 192554 - RNA, 22 nt, Homo sapiens
ucaccuggagaagauggaucau

SEQ ID NO: 192555 - RNA, 22 nt, Homo sapiens
ucacuaaagaaaauggcaugga

SEQ ID NO: 192556 - RNA, 22 nt, Homo sapiens
ucacugagaaugauguuucuga

SEQ ID NO: 192557 - RNA, 22 nt, Homo sapiens
ucacugagcuagaucacuugac

SEQ ID NO: 192558 - RNA, 22 nt, Homo sapiens
ucacugaggucugagcuuuaug

SEQ ID NO: 192559 - RNA, 22 nt, Homo sapiens
ucacugcacucuccgccuugcg

SEQ ID NO: 192560 - RNA, 22 nt, Homo sapiens
ucacuggacagaaauaaaggug

SEQ ID NO: 192561 - RNA, 22 nt, Homo sapiens
ucacuguggaacucaaaaagcu

SEQ ID NO: 192562 - RNA, 22 nt, Homo sapiens
ucacugugguuggaaggcuuaa

SEQ ID NO: 192563 - RNA, 18 nt, Homo sapiens
ucacugugugucuugggu

SEQ ID NO: 192564 - RNA, 22 nt, Homo sapiens
ucagagucuagaucacucacug

SEQ ID NO: 192565 - RNA, 22 nt, Homo sapiens
ucagcagugugaaaauggacua

SEQ ID NO: 192566 - RNA, 22 nt, Homo sapiens
ucagcaucacaggcagugagug

SEQ ID NO: 192567 - RNA, 21 nt, Homo sapiens
ucagcucaucacugccuggag

SEQ ID NO: 192568 - RNA, 22 nt, Homo sapiens
ucaggcacucagcuuagagucu

SEQ ID NO: 192569 - RNA, 21 nt, Homo sapiens
ucagggaccugcuguacugau

SEQ ID NO: 192570 - RNA, 22 nt, Homo sapiens
ucagggacgcuugacacaagcc

SEQ ID NO: 192571 - RNA, 22 nt, Homo sapiens
ucaggugccuuggcuaauuguu

SEQ ID NO: 192572 - RNA, 22 nt, Homo sapiens
ucaguaaaugcuguucucuuuu

SEQ ID NO: 192573 - RNA, 18 nt, Homo sapiens
ucagucacugccuggcuu

SEQ ID NO: 192574 - RNA, 22 nt, Homo sapiens
ucaguccccucgcugagucuac

SEQ ID NO: 192575 - RNA, 22 nt, Homo sapiens
ucagugacuggguauuaaauca

SEQ ID NO: 192576 - RNA, 22 nt, Homo sapiens
ucagugucugugauggagaggu

SEQ ID NO: 192577 - RNA, 22 nt, Homo sapiens
ucauagaucaaguaauaagaca

SEQ ID NO: 192578 - RNA, 21 nt, Homo sapiens
ucauauguaucuuugugccuc

SEQ ID NO: 192579 - RNA, 22 nt, Homo sapiens
ucauugcacuucuuuaguugca

SEQ ID NO: 192580 - RNA, 22 nt, Homo sapiens
ucauuggaugagaccccugucc

SEQ ID NO: 192581 - RNA, 22 nt, Homo sapiens
ucauuguccaacuucuuucagu

SEQ ID NO: 192582 - RNA, 22 nt, Homo sapiens
uccaagaugcuggcagcuacag

SEQ ID NO: 192583 - RNA, 22 nt, Homo sapiens
uccauguagaagacaggggaga

SEQ ID NO: 192584 - RNA, 22 nt, Homo sapiens
uccauuuguagguagugagaca

SEQ ID NO: 192585 - RNA, 22 nt, Homo sapiens
uccauuuguucagcuucaggaa

SEQ ID NO: 192586 - RNA, 19 nt, Homo sapiens
ucccaagaugcucauacau

SEQ ID NO: 192587 - RNA, 22 nt, Homo sapiens
ucccagugaaaccccaccuuca

SEQ ID NO: 192588 - RNA, 19 nt, Homo sapiens
uccccgggucuagugcagc

SEQ ID NO: 192589 - RNA, 22 nt, Homo sapiens
ucccugaaagcugagauuggaa

SEQ ID NO: 192590 - RNA, 22 nt, Homo sapiens
ucccuguuguuucauaauuuua

SEQ ID NO: 192591 - RNA, 22 nt, Homo sapiens
uccugagacucacaggcucccc

SEQ ID NO: 192592 - RNA, 22 nt, Homo sapiens
uccugauacgguugcaguucuc

SEQ ID NO: 192593 - RNA, 22 nt, Homo sapiens
uccuugagucuuugcucagaug

SEQ ID NO: 192594 - RNA, 22 nt, Homo sapiens
uccuuuggguagcuguucagau

SEQ ID NO: 192595 - RNA, 22 nt, Homo sapiens
ucuaaugcucugagaacagugc

SEQ ID NO: 192596 - RNA, 22 nt, Homo sapiens
ucuauggaguuugaaugagaaa

SEQ ID NO: 192597 - RNA, 22 nt, Homo sapiens
ucucaaguaacugggacaauaa

SEQ ID NO: 192598 - RNA, 22 nt, Homo sapiens
ucucaaguggucgcaguuagau

SEQ ID NO: 192599 - RNA, 22 nt, Homo sapiens
ucucaauuugauuacauucaua

SEQ ID NO: 192600 - RNA, 22 nt, Homo sapiens
ucucacaggguuauugaggggg

SEQ ID NO: 192601 - RNA, 22 nt, Homo sapiens
ucucagugaauguggaaaaagc

SEQ ID NO: 192602 - RNA, 22 nt, Homo sapiens
ucucaguggugcuggcagggga

SEQ ID NO: 192603 - RNA, 22 nt, Homo sapiens
ucucaguuuucaagcugucgau

SEQ ID NO: 192604 - RNA, 20 nt, Homo sapiens
ucucauggagguagagaaua

SEQ ID NO: 192605 - RNA, 22 nt, Homo sapiens
ucucauggagguagagaguaaa

SEQ ID NO: 192606 - RNA, 22 nt, Homo sapiens
ucucugagaaaaguuucuccca

SEQ ID NO: 192607 - RNA, 22 nt, Homo sapiens
ucucugagaccacuccaaacuc

SEQ ID NO: 192608 - RNA, 22 nt, Homo sapiens
ucucugguuuguggaaucuuag

SEQ ID NO: 192609 - RNA, 22 nt, Homo sapiens
ucucuguuuagagccagcaauu

SEQ ID NO: 192610 - RNA, 22 nt, Homo sapiens
ucugagcaauaaacaacauauu

SEQ ID NO: 192611 - RNA, 22 nt, Homo sapiens
ucugucacugguggacgaucac

SEQ ID NO: 192612 - RNA, 19 nt, Homo sapiens
ucugugcuugucccccugu

SEQ ID NO: 192613 - RNA, 18 nt, Homo sapiens
ucugugguguaaauacgu

SEQ ID NO: 192614 - RNA, 22 nt, Homo sapiens
ucuugcauuuuuaaauagugcu

SEQ ID NO: 192615 - RNA, 22 nt, Homo sapiens
ucuugcuuguuguucccuucau

SEQ ID NO: 192616 - RNA, 22 nt, Homo sapiens
ucuuggcauggcugaagauucc

SEQ ID NO: 192617 - RNA, 23 nt, Homo sapiens
ucuugguuauagaaaaauaguug

SEQ ID NO: 192618 - RNA, 22 nt, Homo sapiens
ucuugguugaaaauucauaaua

SEQ ID NO: 192619 - RNA, 19 nt, Homo sapiens
ucuuuagucacauuuuuau

SEQ ID NO: 192620 - RNA, 22 nt, Homo sapiens
ucuuucacuuagcaugauguuu

SEQ ID NO: 192621 - RNA, 19 nt, Homo sapiens
ucuuugcuuuucuaagagg

SEQ ID NO: 192622 - RNA, 22 nt, Homo sapiens
ucuuuggguagauauguagcug

SEQ ID NO: 192623 - RNA, 19 nt, Homo sapiens
ucuuugguacgugcuuuga

SEQ ID NO: 192624 - RNA, 22 nt, Homo sapiens
ucuuugguauuuguggggaauu

SEQ ID NO: 192625 - RNA, 22 nt, Homo sapiens
ucuuuggucaucaugggaagca

SEQ ID NO: 192626 - RNA, 22 nt, Homo sapiens
ucuuuggugaauggucauccag

SEQ ID NO: 192627 - RNA, 22 nt, Homo sapiens
ucuuugguucugugcagccuau

SEQ ID NO: 192628 - RNA, 22 nt, Homo sapiens
ugaaaguuauauugugaaauuc

SEQ ID NO: 192629 - RNA, 22 nt, Homo sapiens
ugaaauggaaagaguguagacu

SEQ ID NO: 192630 - RNA, 22 nt, Homo sapiens
ugaaauggugcggucugcagca

SEQ ID NO: 192631 - RNA, 22 nt, Homo sapiens
ugaaaugguuaugugaggagau

SEQ ID NO: 192632 - RNA, 22 nt, Homo sapiens
ugaaauguguuaucugggccug

SEQ ID NO: 192633 - RNA, 22 nt, Homo sapiens
ugaaauguuaaacaaguggcuc

SEQ ID NO: 192634 - RNA, 22 nt, Homo sapiens
ugaaauguugggugauggaauc

SEQ ID NO: 192635 - RNA, 22 nt, Homo sapiens
ugaaauuuuuuauucguuggcu

SEQ ID NO: 192636 - RNA, 22 nt, Homo sapiens
ugaacacagccugccucugcca

SEQ ID NO: 192637 - RNA, 22 nt, Homo sapiens
ugaacagucaucucucuuguau

SEQ ID NO: 192638 - RNA, 22 nt, Homo sapiens
ugaagggcauuguuuugccaaa

SEQ ID NO: 192639 - RNA, 22 nt, Homo sapiens
ugaagugaagacucacagaagg

SEQ ID NO: 192640 - RNA, 20 nt, Homo sapiens
ugaauguaauuacagaugua

SEQ ID NO: 192641 - RNA, 22 nt, Homo sapiens
ugacacagugggggauccuuuu

SEQ ID NO: 192642 - RNA, 22 nt, Homo sapiens
ugacagucaccaggacccacag

SEQ ID NO: 192643 - RNA, 23 nt, Homo sapiens
ugacagucucccgauggcuaggc

SEQ ID NO: 192644 - RNA, 22 nt, Homo sapiens
ugacagugaauaagucucuuaa

SEQ ID NO: 192645 - RNA, 22 nt, Homo sapiens
ugacaugaugagcaauaauggc

SEQ ID NO: 192646 - RNA, 21 nt, Homo sapiens
ugacuagauuccagauuggcc

SEQ ID NO: 192647 - RNA, 22 nt, Homo sapiens
ugacucaguuguuagucuucau

SEQ ID NO: 192648 - RNA, 22 nt, Homo sapiens
ugacucuagagcugccuguggc

SEQ ID NO: 192649 - RNA, 23 nt, Homo sapiens
ugacugaguauauguuuggugcu

SEQ ID NO: 192650 - RNA, 22 nt, Homo sapiens
ugacuuaugcaacucugaugug

SEQ ID NO: 192651 - RNA, 22 nt, Homo sapiens
ugacuugagcuggagccugccu

SEQ ID NO: 192652 - RNA, 22 nt, Homo sapiens
ugacuugaggcucgcacaaguu

SEQ ID NO: 192653 - RNA, 22 nt, Homo sapiens
ugacuugaucacccccuaaggg

SEQ ID NO: 192654 - RNA, 23 nt, Homo sapiens
ugacuuguccagugauaguucgu

SEQ ID NO: 192655 - RNA, 21 nt, Homo sapiens
ugagaacaacaggucaagcag

SEQ ID NO: 192656 - RNA, 22 nt, Homo sapiens
ugagaacaugugauauuuggug

SEQ ID NO: 192657 - RNA, 22 nt, Homo sapiens
ugagaagacaucuuugcuuugu

SEQ ID NO: 192658 - RNA, 22 nt, Homo sapiens
ugagaauauuuuccaugucuca

SEQ ID NO: 192659 - RNA, 19 nt, Homo sapiens
ugagaauguuaccaggucc

SEQ ID NO: 192660 - RNA, 22 nt, Homo sapiens
ugagacaucucuccugagacag

SEQ ID NO: 192661 - RNA, 22 nt, Homo sapiens
ugagacugaguuucucucuugu

SEQ ID NO: 192662 - RNA, 22 nt, Homo sapiens
ugagagacagacauuaucuuau

SEQ ID NO: 192663 - RNA, 22 nt, Homo sapiens
ugagagacaguuuguuaaaauu

SEQ ID NO: 192664 - RNA, 22 nt, Homo sapiens
ugagagacauuuguuguagagu

SEQ ID NO: 192665 - RNA, 22 nt, Homo sapiens
ugagauagggucucacucuguc

SEQ ID NO: 192666 - RNA, 22 nt, Homo sapiens
ugagauaguacuuuuuuaaagg

SEQ ID NO: 192667 - RNA, 22 nt, Homo sapiens
ugagaucagugaagaaguguuu

SEQ ID NO: 192668 - RNA, 22 nt, Homo sapiens
ugagaucaguuguuauaauucu

SEQ ID NO: 192669 - RNA, 22 nt, Homo sapiens
ugagaugagaaucaguucuaau

SEQ ID NO: 192670 - RNA, 21 nt, Homo sapiens
ugagaugcaaucaccagggag

SEQ ID NO: 192671 - RNA, 22 nt, Homo sapiens
ugagauggcugaauucagaaua

SEQ ID NO: 192672 - RNA, 22 nt, Homo sapiens
ugagauggguaauuaaauggug

SEQ ID NO: 192673 - RNA, 22 nt, Homo sapiens
ugagauuaaucuuuaaguaaga

SEQ ID NO: 192674 - RNA, 22 nt, Homo sapiens
ugagcacagcgugugggagagc

SEQ ID NO: 192675 - RNA, 22 nt, Homo sapiens
ugagcagugaguguggugcagg

SEQ ID NO: 192676 - RNA, 22 nt, Homo sapiens
ugagcccauuguccugguuuau

SEQ ID NO: 192677 - RNA, 22 nt, Homo sapiens
ugagcuaggauccugucacugu

SEQ ID NO: 192678 - RNA, 20 nt, Homo sapiens
ugagcuuguaaacacuguuu

SEQ ID NO: 192679 - RNA, 22 nt, Homo sapiens
ugaggaaugaccccgugugguc

SEQ ID NO: 192680 - RNA, 22 nt, Homo sapiens
ugaggcuagucagaucagauga

SEQ ID NO: 192681 - RNA, 22 nt, Homo sapiens
ugagguaacaaacuaugaguua

SEQ ID NO: 192682 - RNA, 22 nt, Homo sapiens
ugagguaggugaagaaugcacg

SEQ ID NO: 192683 - RNA, 22 nt, Homo sapiens
ugaggugcagcaauccucaugu

SEQ ID NO: 192684 - RNA, 22 nt, Homo sapiens
ugagguguuugugcaccaucug

SEQ ID NO: 192685 - RNA, 20 nt, Homo sapiens
ugaguagaggaguucuauca

SEQ ID NO: 192686 - RNA, 23 nt, Homo sapiens
ugagucacuuugcuggggucucu

SEQ ID NO: 192687 - RNA, 22 nt, Homo sapiens
ugagugugacuuagcagaagga

SEQ ID NO: 192688 - RNA, 22 nt, Homo sapiens
ugauacuggcuucauagaauga

SEQ ID NO: 192689 - RNA, 22 nt, Homo sapiens
ugauauguggcuauugagauug

SEQ ID NO: 192690 - RNA, 20 nt, Homo sapiens
ugauauuuucugagcaggaa

SEQ ID NO: 192691 - RNA, 21 nt, Homo sapiens
ugaucacaugaaaaccaugca

SEQ ID NO: 192692 - RNA, 22 nt, Homo sapiens
ugaucugucacuuaucacauuu

SEQ ID NO: 192693 - RNA, 22 nt, Homo sapiens
ugauguguuuuguaguucaacu

SEQ ID NO: 192694 - RNA, 22 nt, Homo sapiens
ugauuggagaacaaacugcaua

SEQ ID NO: 192695 - RNA, 22 nt, Homo sapiens
ugauuuguuucaggaguuuucu

SEQ ID NO: 192696 - RNA, 22 nt, Homo sapiens
ugcaaugucuucugaggggagc

SEQ ID NO: 192697 - RNA, 22 nt, Homo sapiens
ugcaaugugaaauaagcacauc

SEQ ID NO: 192698 - RNA, 22 nt, Homo sapiens
ugcaccauugucaccuggguga

SEQ ID NO: 192699 - RNA, 22 nt, Homo sapiens
ugcacuguggucugagagacag

SEQ ID NO: 192700 - RNA, 22 nt, Homo sapiens
ugcagagaaacauuuuguauuu

SEQ ID NO: 192701 - RNA, 22 nt, Homo sapiens
ugcagcacaguagguuugcaau

SEQ ID NO: 192702 - RNA, 22 nt, Homo sapiens
ugcagcauguaggcacguuauu

SEQ ID NO: 192703 - RNA, 22 nt, Homo sapiens
ugcagguacuugacaacuuggg

SEQ ID NO: 192704 - RNA, 23 nt, Homo sapiens
ugcaguagugagaucuaggcuca

SEQ ID NO: 192705 - RNA, 22 nt, Homo sapiens
ugcagugcaugacuguguuaug

SEQ ID NO: 192706 - RNA, 19 nt, Homo sapiens
ugcauaggguuacauacuc

SEQ ID NO: 192707 - RNA, 22 nt, Homo sapiens
ugcauauucuaggauuuuguau

SEQ ID NO: 192708 - RNA, 22 nt, Homo sapiens
ugcaugcaucuuuuauaguagc

SEQ ID NO: 192709 - RNA, 22 nt, Homo sapiens
ugcauugcacuugcaugagaua

SEQ ID NO: 192710 - RNA, 22 nt, Homo sapiens
ugccaguauuuuauugagcauu

SEQ ID NO: 192711 - RNA, 22 nt, Homo sapiens
agagauaaagauuuuaauuuug

SEQ ID NO: 192712 - RNA, 22 nt, Homo sapiens
agagauaauuagguuaaaugag

SEQ ID NO: 192713 - RNA, 22 nt, Homo sapiens
agagcacugcugcaggguucug

SEQ ID NO: 192714 - RNA, 22 nt, Homo sapiens
agagcuaguauuuacggagcau

SEQ ID NO: 192715 - RNA, 22 nt, Homo sapiens
agaggucuuaucaaacaugcuu

SEQ ID NO: 192716 - RNA, 23 nt, Homo sapiens
agagguuuaaucaggcaguugcu

SEQ ID NO: 192717 - RNA, 22 nt, Homo sapiens
agagguuuaauugauucacagu

SEQ ID NO: 192718 - RNA, 19 nt, Homo sapiens
agaguauugaauuugcccu

SEQ ID NO: 192719 - RNA, 19 nt, Homo sapiens
agaguauuguuacuucucu

SEQ ID NO: 192720 - RNA, 20 nt, Homo sapiens
agagugcuggacugaggagc

SEQ ID NO: 192721 - RNA, 22 nt, Homo sapiens
agaugcuguuaucaacuguagc

SEQ ID NO: 192722 - RNA, 22 nt, Homo sapiens
agcacauuaguaucuaagaaca

SEQ ID NO: 192723 - RNA, 19 nt, Homo sapiens
agcagaacaaauguguggg

SEQ ID NO: 192724 - RNA, 22 nt, Homo sapiens
agcagguguggcuuauccugaa

SEQ ID NO: 192725 - RNA, 22 nt, Homo sapiens
agcaucacaugggcugcuuggg

SEQ ID NO: 192726 - RNA, 22 nt, Homo sapiens
agcaucacguagacuuuaccau

SEQ ID NO: 192727 - RNA, 22 nt, Homo sapiens
agcaugauugggguugggcaca

SEQ ID NO: 192728 - RNA, 22 nt, Homo sapiens
agcccauguggcugaggcuucu

SEQ ID NO: 192729 - RNA, 23 nt, Homo sapiens
agcccugugacucgaacgaggag

SEQ ID NO: 192730 - RNA, 22 nt, Homo sapiens
agcccuuagauggcuccuucca

SEQ ID NO: 192731 - RNA, 22 nt, Homo sapiens
agccuucauucugacaguagga

SEQ ID NO: 192732 - RNA, 22 nt, Homo sapiens
agcgguguuaggaaggugaggg

SEQ ID NO: 192733 - RNA, 18 nt, Homo sapiens
agcucaguguuugcuuac

SEQ ID NO: 192734 - RNA, 22 nt, Homo sapiens
agcuggcuguggagaaaccccu

SEQ ID NO: 192735 - RNA, 22 nt, Homo sapiens
agcuggucuuggggaagaguag

SEQ ID NO: 192736 - RNA, 21 nt, Homo sapiens
agcugguuucuucuuacuccu

SEQ ID NO: 192737 - RNA, 22 nt, Homo sapiens
agcuguguugucugaagucaga

SEQ ID NO: 192738 - RNA, 22 nt, Homo sapiens
agcuugugauucuccaucaugu

SEQ ID NO: 192739 - RNA, 22 nt, Homo sapiens
agcuuguggugaauacugcuag

SEQ ID NO: 192740 - RNA, 22 nt, Homo sapiens
aggaagcuagcauuuguucagu

SEQ ID NO: 192741 - RNA, 21 nt, Homo sapiens
aggagauguuuguccuuuuag

SEQ ID NO: 192742 - RNA, 23 nt, Homo sapiens
aggagcuuagaaguugccauugc

SEQ ID NO: 192743 - RNA, 22 nt, Homo sapiens
aggaguguguauuaaugaaauu

SEQ ID NO: 192744 - RNA, 22 nt, Homo sapiens
aggaucauugacuauuauaagg

SEQ ID NO: 192745 - RNA, 22 nt, Homo sapiens
aggcaagagugacuacgugaaa

SEQ ID NO: 192746 - RNA, 22 nt, Homo sapiens
aggcagaugagguccucagcug

SEQ ID NO: 192747 - RNA, 22 nt, Homo sapiens
aggcaggugaaagauaguuuua

SEQ ID NO: 192748 - RNA, 22 nt, Homo sapiens
aggcaugaaauacaugcauuga

SEQ ID NO: 192749 - RNA, 22 nt, Homo sapiens
auugcacuccagccugggcaac

SEQ ID NO: 192750 - RNA, 22 nt, Homo sapiens
auugcacuccagccugggcagc

SEQ ID NO: 192751 - RNA, 21 nt, Homo sapiens
auugcacuccagccugggcga

SEQ ID NO: 192752 - RNA, 22 nt, Homo sapiens
auugcuuuuacugggagcuuug

SEQ ID NO: 192753 - RNA, 22 nt, Homo sapiens
auuggcuauuuggugagugauu

SEQ ID NO: 192754 - RNA, 22 nt, Homo sapiens
auuuggcaacguagggaggcau

SEQ ID NO: 192755 - RNA, 22 nt, Homo sapiens
auuugucacuauguggcuaaua

SEQ ID NO: 192756 - RNA, 22 nt, Homo sapiens
auuuuuggauauagggaaggau

SEQ ID NO: 192757 - RNA, 22 nt, Homo sapiens
caaaagugguucuuauccuuuu

SEQ ID NO: 192758 - RNA, 22 nt, Homo sapiens
caaaccuguaggggccaagagg

SEQ ID NO: 192759 - RNA, 22 nt, Homo sapiens
caacagucagcccauccacaga

SEQ ID NO: 192760 - RNA, 22 nt, Homo sapiens
caagagagcugaugguuuuaaa

SEQ ID NO: 192761 - RNA, 22 nt, Homo sapiens
caauacuguguugaauaagagu

SEQ ID NO: 192762 - RNA, 22 nt, Homo sapiens
cacagcuagucaaugguagaca

SEQ ID NO: 192763 - RNA, 22 nt, Homo sapiens
cacagggcuaacauuuuugccc

SEQ ID NO: 192764 - RNA, 22 nt, Homo sapiens
cacagucuugcaauauugagau

SEQ ID NO: 192765 - RNA, 22 nt, Homo sapiens
caccagguggcugaggccauga

SEQ ID NO: 192766 - RNA, 22 nt, Homo sapiens
caccagguuggagugcaguggu

SEQ ID NO: 192767 - RNA, 22 nt, Homo sapiens
caccugagcgggaugcucgccu

SEQ ID NO: 192768 - RNA, 22 nt, Homo sapiens
cacugcgacguccgccucccgg

SEQ ID NO: 192769 - RNA, 22 nt, Homo sapiens
cacuggucucauggcaugagag

SEQ ID NO: 192770 - RNA, 22 nt, Homo sapiens
cagaaguauugguaugcucugu

SEQ ID NO: 192771 - RNA, 22 nt, Homo sapiens
cagagaaugucuuuuuuaacca

SEQ ID NO: 192772 - RNA, 22 nt, Homo sapiens
cagagaucaugcaacugcucgc

SEQ ID NO: 192773 - RNA, 22 nt, Homo sapiens
cagagcaaugcuuuugcuuuga

SEQ ID NO: 192774 - RNA, 22 nt, Homo sapiens
cagagugcauguuuagaugagu

SEQ ID NO: 192775 - RNA, 22 nt, Homo sapiens
cagaugcaugaccugggcuugg

SEQ ID NO: 192776 - RNA, 22 nt, Homo sapiens
cagcuguuguuaugucugcagg

SEQ ID NO: 192777 - RNA, 22 nt, Homo sapiens
caggaccucuugccuggaagcc

SEQ ID NO: 192778 - RNA, 22 nt, Homo sapiens
cagggaauguuauuuaauagca

SEQ ID NO: 192779 - RNA, 22 nt, Homo sapiens
cagguaguauuugguuacauaa

SEQ ID NO: 192780 - RNA, 22 nt, Homo sapiens
caguaaauaucugagcgagguc

SEQ ID NO: 192781 - RNA, 22 nt, Homo sapiens
cagugcauagaugugccacauu

SEQ ID NO: 192782 - RNA, 23 nt, Homo sapiens
cagugguguuagagaaaucuuuu

SEQ ID NO: 192783 - RNA, 22 nt, Homo sapiens
caguuacuugacacaaccaauu

SEQ ID NO: 192784 - RNA, 22 nt, Homo sapiens
cauagcacugcacuucagccug

SEQ ID NO: 192785 - RNA, 22 nt, Homo sapiens
cauccccugcaccaaccuuuac

SEQ ID NO: 192786 - RNA, 22 nt, Homo sapiens
caucucauugaauugcugagca

SEQ ID NO: 192787 - RNA, 22 nt, Homo sapiens
caugcacugaguccaccucugg

SEQ ID NO: 192788 - RNA, 22 nt, Homo sapiens
cauggcacaucuuuucugacua

SEQ ID NO: 192789 - RNA, 23 nt, Homo sapiens
cauggcuguuaacacuguuugag

SEQ ID NO: 192790 - RNA, 22 nt, Homo sapiens
cauggucaccuuccaaguuauu

SEQ ID NO: 192791 - RNA, 22 nt, Homo sapiens
cauguaguagaaggagccagac

SEQ ID NO: 192792 - RNA, 22 nt, Homo sapiens
caugucacuuccucucugaugg

SEQ ID NO: 192793 - RNA, 22 nt, Homo sapiens
ccacaguugaaauuuugacugu

SEQ ID NO: 192794 - RNA, 22 nt, Homo sapiens
ccacugggcaguuuauuaucag

SEQ ID NO: 192795 - RNA, 22 nt, Homo sapiens
ccacugugguaucugauacugg

SEQ ID NO: 192796 - RNA, 22 nt, Homo sapiens
ccaguuuucaagauaaugguuu

SEQ ID NO: 192797 - RNA, 22 nt, Homo sapiens
ccaucacacugugauuauuauc

SEQ ID NO: 192798 - RNA, 22 nt, Homo sapiens
cccagugugaacuuggcauuuu

SEQ ID NO: 192799 - RNA, 22 nt, Homo sapiens
cccaguguguuguggauauuua

SEQ ID NO: 192800 - RNA, 22 nt, Homo sapiens
cccaguguuuauuuugagccaa

SEQ ID NO: 192801 - RNA, 22 nt, Homo sapiens
ccggguguuuuguucucucaga

SEQ ID NO: 192802 - RNA, 22 nt, Homo sapiens
ccugagacgaauggagugaaca

SEQ ID NO: 192803 - RNA, 22 nt, Homo sapiens
gaggucaugucgggccccagga

SEQ ID NO: 192804 - RNA, 22 nt, Homo sapiens
gaggugauaucucauugugguu

SEQ ID NO: 192805 - RNA, 22 nt, Homo sapiens
gaguauauuugcacuguuaugu

SEQ ID NO: 192806 - RNA, 22 nt, Homo sapiens
gaguauuuuacaucguguaauu

SEQ ID NO: 192807 - RNA, 22 nt, Homo sapiens
gagugcaauggcaagaucuugg

SEQ ID NO: 192808 - RNA, 21 nt, Homo sapiens
gaguggcuuuuguuucaccag

SEQ ID NO: 192809 - RNA, 18 nt, Homo sapiens
gaguggugcuucccuugu

SEQ ID NO: 192810 - RNA, 22 nt, Homo sapiens
gaucacauggccauuucuagcu

SEQ ID NO: 192811 - RNA, 22 nt, Homo sapiens
gauggcagugcagccccuggcu

SEQ ID NO: 192812 - RNA, 22 nt, Homo sapiens
gaugguuuucaccugcaugcuu

SEQ ID NO: 192813 - RNA, 22 nt, Homo sapiens
gauuccauugcgaauuuucaga

SEQ ID NO: 192814 - RNA, 22 nt, Homo sapiens
gauuccauuuguggcuauuuac

SEQ ID NO: 192815 - RNA, 22 nt, Homo sapiens
gcaacccgucaucuagguuuua

SEQ ID NO: 192816 - RNA, 22 nt, Homo sapiens
gcaaugcugucugugcacagau

SEQ ID NO: 192817 - RNA, 22 nt, Homo sapiens
gcacauauguaaauagcugccu

SEQ ID NO: 192818 - RNA, 22 nt, Homo sapiens
gcagaucuucgcgguaaguguu

SEQ ID NO: 192819 - RNA, 22 nt, Homo sapiens
gcagcacaugacuguauguaua

SEQ ID NO: 192820 - RNA, 22 nt, Homo sapiens
gcagcaucaaaucacacaagau

SEQ ID NO: 192821 - RNA, 22 nt, Homo sapiens
gcaggaaucuugagaaggauuc

SEQ ID NO: 192822 - RNA, 22 nt, Homo sapiens
gcaggauuggagccucucugaa

SEQ ID NO: 192823 - RNA, 17 nt, Homo sapiens
gcaguacuuaguaagga

SEQ ID NO: 192824 - RNA, 20 nt, Homo sapiens
gcauaugucuuuauagcaga

SEQ ID NO: 192825 - RNA, 22 nt, Homo sapiens
gcauauuuuaaaguguaaccug

SEQ ID NO: 192826 - RNA, 19 nt, Homo sapiens
gcaucauuaguugcuuuuc

SEQ ID NO: 192827 - RNA, 22 nt, Homo sapiens
gcauggaaggcgcuuugugacu

SEQ ID NO: 192828 - RNA, 22 nt, Homo sapiens
gcauggagaaggggacugauuc

SEQ ID NO: 192829 - RNA, 22 nt, Homo sapiens
gccaagaugcugcccacagaca

SEQ ID NO: 192830 - RNA, 20 nt, Homo sapiens
gccacaguuaagcuucugcc

SEQ ID NO: 192831 - RNA, 22 nt, Homo sapiens
gccauggaggauuuauagaggc

SEQ ID NO: 192832 - RNA, 22 nt, Homo sapiens
gcccaguagcaguacaucccuu

SEQ ID NO: 192833 - RNA, 22 nt, Homo sapiens
gccccgggugaugcagccguca

SEQ ID NO: 192834 - RNA, 22 nt, Homo sapiens
gccuuuggugacaggcaugugu

SEQ ID NO: 192835 - RNA, 22 nt, Homo sapiens
gcuagcacauugucaccucuca

SEQ ID NO: 192836 - RNA, 22 nt, Homo sapiens
gcuaggagaucugcugcucucu

SEQ ID NO: 192837 - RNA, 22 nt, Homo sapiens
gcugauguuggccucugggcuu

SEQ ID NO: 192838 - RNA, 22 nt, Homo sapiens
gcugauguuuucagguaauucu

SEQ ID NO: 192839 - RNA, 22 nt, Homo sapiens
gcugcacuuuaaggcauccccu

SEQ ID NO: 192840 - RNA, 22 nt, Homo sapiens
gcugcuguaccagaugugguua

SEQ ID NO: 192841 - RNA, 22 nt, Homo sapiens
gcugcuguuauucaucagaacu

SEQ ID NO: 192842 - RNA, 22 nt, Homo sapiens
gcuguugcuauuauuccgagaa

SEQ ID NO: 192843 - RNA, 22 nt, Homo sapiens
gcuguuugccgccaucgcagac

SEQ ID NO: 192844 - RNA, 22 nt, Homo sapiens
gcuuuggauaaaugucaguuua

SEQ ID NO: 192845 - RNA, 22 nt, Homo sapiens
gcuuugguucaaccaggcaauu

SEQ ID NO: 192846 - RNA, 22 nt, Homo sapiens
gcuuuguuguugaugggaaauc

SEQ ID NO: 192847 - RNA, 22 nt, Homo sapiens
ggaaaucaucauucucgguaua

SEQ ID NO: 192848 - RNA, 22 nt, Homo sapiens
ggaaauguaaacaauggggcua

SEQ ID NO: 192849 - RNA, 19 nt, Homo sapiens
ggaaaugucuauuaagauc

SEQ ID NO: 192850 - RNA, 22 nt, Homo sapiens
ggaaauguuuagcauccacuuu

SEQ ID NO: 192851 - RNA, 20 nt, Homo sapiens
ggaagagugacacaagguau

SEQ ID NO: 192852 - RNA, 22 nt, Homo sapiens
ggaaguauaaacuuaguggagu

SEQ ID NO: 192853 - RNA, 22 nt, Homo sapiens
ugauguccaguucauagaaacu

SEQ ID NO: 192854 - RNA, 18 nt, Homo sapiens
ugcaaacauguguguguu

SEQ ID NO: 192855 - RNA, 22 nt, Homo sapiens
ugcaaagaaauuuuggugacca

SEQ ID NO: 192856 - RNA, 22 nt, Homo sapiens
ugcaaagucgaaacugcaguuu

SEQ ID NO: 192857 - RNA, 22 nt, Homo sapiens
ugcaauuuaaugugucccaauu

SEQ ID NO: 192858 - RNA, 18 nt, Homo sapiens
ugcaccaguuuacacuuc

SEQ ID NO: 192859 - RNA, 22 nt, Homo sapiens
ugcaccaucuugcuucuguggu

SEQ ID NO: 192860 - RNA, 17 nt, Homo sapiens
ugcaccauuugauuuuu

SEQ ID NO: 192861 - RNA, 16 nt, Homo sapiens
ugcagaguaggugaau

SEQ ID NO: 192862 - RNA, 19 nt, Homo sapiens
ugcagcaauguaaaagaca

SEQ ID NO: 192863 - RNA, 22 nt, Homo sapiens
ugcaguacauucagcauccucu

SEQ ID NO: 192864 - RNA, 22 nt, Homo sapiens
ugcaguaggcccagcgggaggc

SEQ ID NO: 192865 - RNA, 22 nt, Homo sapiens
ugcaguagugugaucuuggcuc

SEQ ID NO: 192866 - RNA, 22 nt, Homo sapiens
ugcauauucgaguuauuuuggg

SEQ ID NO: 192867 - RNA, 22 nt, Homo sapiens
ugcauggauguuugaacacacu

SEQ ID NO: 192868 - RNA, 22 nt, Homo sapiens
ugccaagauuucaggaauuaag

SEQ ID NO: 192869 - RNA, 22 nt, Homo sapiens
ugcccuuugucagaugaguagg

SEQ ID NO: 192870 - RNA, 22 nt, Homo sapiens
ugccuaggcccaguccucagaa

SEQ ID NO: 192871 - RNA, 22 nt, Homo sapiens
ugccuggagagcuccuacauau

SEQ ID NO: 192872 - RNA, 18 nt, Homo sapiens
ugcuccccugggugagca

SEQ ID NO: 192873 - RNA, 22 nt, Homo sapiens
ugcugaguguuaccggacaccg

SEQ ID NO: 192874 - RNA, 22 nt, Homo sapiens
ugcugcacaguucuuaagauua

SEQ ID NO: 192875 - RNA, 22 nt, Homo sapiens
ugcugguuuaaaaugcaaauuc

SEQ ID NO: 192876 - RNA, 22 nt, Homo sapiens
ugcuuaguuguauguuccacau

SEQ ID NO: 192877 - RNA, 21 nt, Homo sapiens
ugcuuuggucauacuucuucc

SEQ ID NO: 192878 - RNA, 22 nt, Homo sapiens
uggaaacuuauguucuucugug

SEQ ID NO: 192879 - RNA, 22 nt, Homo sapiens
uggaaaguaguucuaaucuaag

SEQ ID NO: 192880 - RNA, 20 nt, Homo sapiens
cugcacauccacucuacuuc

SEQ ID NO: 192881 - RNA, 22 nt, Homo sapiens
cugccacugacaccucaaggac

SEQ ID NO: 192882 - RNA, 20 nt, Homo sapiens
cuggaugucgaggcagaggu

SEQ ID NO: 192883 - RNA, 22 nt, Homo sapiens
cugggaucaguucuagucagaa

SEQ ID NO: 192884 - RNA, 22 nt, Homo sapiens
cuggugugugacuuuucauuau

SEQ ID NO: 192885 - RNA, 22 nt, Homo sapiens
cuguaagcauuauaaagagaua

SEQ ID NO: 192886 - RNA, 22 nt, Homo sapiens
cugucacugggaggggcagcag

SEQ ID NO: 192887 - RNA, 22 nt, Homo sapiens
uugcaugucauaacugauggaa

SEQ ID NO: 192888 - RNA, 22 nt, Homo sapiens
uugccaucaucucuuacucagu

SEQ ID NO: 192889 - RNA, 22 nt, Homo sapiens
uuggaaacauuuaugguaacag

SEQ ID NO: 192890 - RNA, 22 nt, Homo sapiens
uuggaaacgucaccuuuuccuu

SEQ ID NO: 192891 - RNA, 22 nt, Homo sapiens
uuggagagagaggacucccggc

SEQ ID NO: 192892 - RNA, 22 nt, Homo sapiens
uuggagcacuggggcacugaca

SEQ ID NO: 192893 - RNA, 22 nt, Homo sapiens
uuggaguguucugguccgggcu

SEQ ID NO: 192894 - RNA, 22 nt, Homo sapiens
uuggcaaucaauucugacgucu

SEQ ID NO: 192895 - RNA, 20 nt, Homo sapiens
uuggcagagucuuuagggua

SEQ ID NO: 192896 - RNA, 19 nt, Homo sapiens
uuggcagaguugcccccua

SEQ ID NO: 192897 - RNA, 22 nt, Homo sapiens
uuggcagcacgcaguccagagg

SEQ ID NO: 192898 - RNA, 22 nt, Homo sapiens
uuggccaauggugauucccggc

SEQ ID NO: 192899 - RNA, 22 nt, Homo sapiens
uuggcuucuggacuauugugca

SEQ ID NO: 192900 - RNA, 23 nt, Homo sapiens
uugggcaaaucacugagggcaga

SEQ ID NO: 192901 - RNA, 22 nt, Homo sapiens
uugggcauugcuauaaauucuu

SEQ ID NO: 192902 - RNA, 22 nt, Homo sapiens
uuggggcacggccucuguugcc

SEQ ID NO: 192903 - RNA, 22 nt, Homo sapiens
uugguacuagcugaucgcagag

SEQ ID NO: 192904 - RNA, 22 nt, Homo sapiens
uugguaugaaaaggaauuagac

SEQ ID NO: 192905 - RNA, 20 nt, Homo sapiens
uuggugaccuacagaugugg

SEQ ID NO: 192906 - RNA, 22 nt, Homo sapiens
uugguuauccugucgguaauuc

SEQ ID NO: 192907 - RNA, 22 nt, Homo sapiens
uuguaugucuucauuugaaaaa

SEQ ID NO: 192908 - RNA, 16 nt, Homo sapiens
uugucccuucccaaau

SEQ ID NO: 192909 - RNA, 22 nt, Homo sapiens
uugucuagugaauacauuaaug

SEQ ID NO: 192910 - RNA, 22 nt, Homo sapiens
uugucuccuagacgaccaggcg

SEQ ID NO: 192911 - RNA, 22 nt, Homo sapiens
uugugaaaaaccucucguggaa

SEQ ID NO: 192912 - RNA, 22 nt, Homo sapiens
uugugaaaucuaggcagagguu

SEQ ID NO: 192913 - RNA, 22 nt, Homo sapiens
uugugcauaucagagguuugcu

SEQ ID NO: 192914 - RNA, 18 nt, Homo sapiens
uuguggccccuacaaauu

SEQ ID NO: 192915 - RNA, 19 nt, Homo sapiens
uugugggaggacagagggg

SEQ ID NO: 192916 - RNA, 22 nt, Homo sapiens
uuguuauguuggucaguaaugu

SEQ ID NO: 192917 - RNA, 22 nt, Homo sapiens
uuuaaagcuaaaauauguuuau

SEQ ID NO: 192918 - RNA, 22 nt, Homo sapiens
uuuaaagcuccaagcaugucug

SEQ ID NO: 192919 - RNA, 22 nt, Homo sapiens
uuuacagucucauagguggaag

SEQ ID NO: 192920 - RNA, 22 nt, Homo sapiens
uuuauccagccucuagcaaggu

SEQ ID NO: 192921 - RNA, 22 nt, Homo sapiens
uuuaugcuacauguguuggaaa

SEQ ID NO: 192922 - RNA, 22 nt, Homo sapiens
uuucacaguguucucccccaga

SEQ ID NO: 192923 - RNA, 22 nt, Homo sapiens
uuucaccguguuggccaggcug

SEQ ID NO: 192924 - RNA, 22 nt, Homo sapiens
uuucaggcaagggugacccuga

SEQ ID NO: 192925 - RNA, 22 nt, Homo sapiens
uuucauagaucaugcuuuugga

SEQ ID NO: 192926 - RNA, 22 nt, Homo sapiens
uuucaucaagcacagaguagau

SEQ ID NO: 192927 - RNA, 22 nt, Homo sapiens
uuucauggacgcaaugccuuuu

SEQ ID NO: 192928 - RNA, 22 nt, Homo sapiens
uuuccagguggccaacauuuua

SEQ ID NO: 192929 - RNA, 19 nt, Homo sapiens
uuucccugcagaccuacua

SEQ ID NO: 192930 - RNA, 22 nt, Homo sapiens
uuucuauguugaccagucuaga

SEQ ID NO: 192931 - RNA, 22 nt, Homo sapiens
uuugacuaccaggaauguucuu

SEQ ID NO: 192932 - RNA, 22 nt, Homo sapiens
uuugauguugagacuauaaagc

SEQ ID NO: 192933 - RNA, 22 nt, Homo sapiens
uuugcagagacuuguuaggaau

SEQ ID NO: 192934 - RNA, 22 nt, Homo sapiens
uuugcaucuuuugcuuccugga

SEQ ID NO: 192935 - RNA, 22 nt, Homo sapiens
uuugcuuaguaaauguagaaaa

SEQ ID NO: 192936 - RNA, 22 nt, Homo sapiens
uuugcuucacuguuuggcaaaa

SEQ ID NO: 192937 - RNA, 22 nt, Homo sapiens
uuuggaaugugcacucagauug

SEQ ID NO: 192938 - RNA, 22 nt, Homo sapiens
uuuggcagaaaacaagaaucug

SEQ ID NO: 192939 - RNA, 22 nt, Homo sapiens
uuuggccauguuggucaggcug

SEQ ID NO: 192940 - RNA, 18 nt, Homo sapiens
uuuggcuguucaugacuc

SEQ ID NO: 192941 - RNA, 22 nt, Homo sapiens
uuuguacucccuuuagauaaaa

SEQ ID NO: 192942 - RNA, 22 nt, Homo sapiens
uuuguauguuggagauuggaga

SEQ ID NO: 192943 - RNA, 19 nt, Homo sapiens
uuuguauguuuccaguaau

SEQ ID NO: 192944 - RNA, 22 nt, Homo sapiens
uuugugcuccucucaguaugug

SEQ ID NO: 192945 - RNA, 22 nt, Homo sapiens
uuuguggaaugcucauguguag

SEQ ID NO: 192946 - RNA, 23 nt, Homo sapiens
uuuguguccccacccaaaucuca

SEQ ID NO: 192947 - RNA, 22 nt, Homo sapiens
uuuguuugaagucgagacaacu

SEQ ID NO: 192948 - RNA, 22 nt, Homo sapiens
uuuugcacauugauuugguauc

SEQ ID NO: 192949 - RNA, 22 nt, Homo sapiens
uuuugcaccauccuaauaguau

SEQ ID NO: 192950 - RNA, 22 nt, Homo sapiens
uuuugcuccuggcaaacucaua

SEQ ID NO: 192951 - RNA, 19 nt, Homo sapiens
uuuuggaaaugugaacagc

SEQ ID NO: 192952 - RNA, 22 nt, Homo sapiens
uuuuggacuucaauuugacacu

SEQ ID NO: 192953 - RNA, 22 nt, Homo sapiens
uuuuggcuuuuccucagcaagc

SEQ ID NO: 192954 - RNA, 21 nt, Homo sapiens
uuuugugcaugugcagccugc

SEQ ID NO: 192955 - RNA, 22 nt, Homo sapiens
uuuuugugguauauugcaacaa

SEQ ID NO: 192956 - RNA, 22 nt, Homo sapiens
auagagcuggcagacacccuua

SEQ ID NO: 192957 - RNA, 22 nt, Homo sapiens
auagcaaugccccacuccuugg

SEQ ID NO: 192958 - RNA, 22 nt, Homo sapiens
auagcacaguguguguacacca

SEQ ID NO: 192959 - RNA, 22 nt, Homo sapiens
auagcagcaccucacucuacug

SEQ ID NO: 192960 - RNA, 22 nt, Homo sapiens
auagcaucauuucuugaaaaga

SEQ ID NO: 192961 - RNA, 23 nt, Homo sapiens
auauaguagaugugcaguaacau

SEQ ID NO: 192962 - RNA, 22 nt, Homo sapiens
auuugacacugagagccucagu

SEQ ID NO: 192963 - RNA, 22 nt, Homo sapiens
caaagugcuggaauuggccggg

SEQ ID NO: 192964 - RNA, 22 nt, Homo sapiens
cacaaugucuaagauguuucua

SEQ ID NO: 192965 - RNA, 22 nt, Homo sapiens
cacaguguucauagccaucagg

SEQ ID NO: 192966 - RNA, 22 nt, Homo sapiens
cacaguguuccagcuauuugaa

SEQ ID NO: 192967 - RNA, 22 nt, Homo sapiens
cagcccguaaucccagcacuuu

SEQ ID NO: 192968 - RNA, 20 nt, Homo sapiens
cagucauagacaucagaguc

SEQ ID NO: 192969 - RNA, 22 nt, Homo sapiens
cagugucugcauuuggaacuca

SEQ ID NO: 192970 - RNA, 22 nt, Homo sapiens
cauauucacuuuacagagcugu

SEQ ID NO: 192971 - RNA, 22 nt, Homo sapiens
cccagugugcugggugacagcu

SEQ ID NO: 192972 - RNA, 22 nt, Homo sapiens
cuggcaagaggauaaaguccua

SEQ ID NO: 192973 - RNA, 22 nt, Homo sapiens
cuggcaagagugaaccagcugu

SEQ ID NO: 192974 - RNA, 22 nt, Homo sapiens
cuucaaguaauucugauggcua

SEQ ID NO: 192975 - RNA, 22 nt, Homo sapiens
gaaagauuuccugagcuagaaa

SEQ ID NO: 192976 - RNA, 22 nt, Homo sapiens
gaaagauuuuaacugggagacu

SEQ ID NO: 192977 - RNA, 17 nt, Homo sapiens
gaaguguuucagcagcu

SEQ ID NO: 192978 - RNA, 17 nt, Homo sapiens
gaaguguuucuucauga

SEQ ID NO: 192979 - RNA, 18 nt, Homo sapiens
gacagugugaagauuccu

SEQ ID NO: 192980 - RNA, 22 nt, Homo sapiens
aaauugcuuuugaagacuuagu

SEQ ID NO: 192981 - RNA, 22 nt, Homo sapiens
aaggcacugaacuuaaauucug

SEQ ID NO: 192982 - RNA, 22 nt, Homo sapiens
aaucuguagaaggugcacauuc

SEQ ID NO: 192983 - RNA, 22 nt, Homo sapiens
aauugcuucuguauuuuggaca

SEQ ID NO: 192984 - RNA, 22 nt, Homo sapiens
aauugcuuuuauuuagggccag

SEQ ID NO: 192985 - RNA, 22 nt, Homo sapiens
acaacaguuuuaucaccccaga

SEQ ID NO: 192986 - RNA, 22 nt, Homo sapiens
acaggguuauuguaauaaugua

SEQ ID NO: 192987 - RNA, 22 nt, Homo sapiens
augagauuguuugugugaaaua

SEQ ID NO: 192988 - RNA, 22 nt, Homo sapiens
augauggaggccgugauggacg

SEQ ID NO: 192989 - RNA, 22 nt, Homo sapiens
auggcacuacugggaaugucuu

SEQ ID NO: 192990 - RNA, 22 nt, Homo sapiens
augggagugugguuagagaccu

SEQ ID NO: 192991 - RNA, 20 nt, Homo sapiens
augucagaguguggguacgg

SEQ ID NO: 192992 - RNA, 23 nt, Homo sapiens
auuaagguuacuacaguaugagg

SEQ ID NO: 192993 - RNA, 22 nt, Homo sapiens
auugacaguuggccaguaagug

SEQ ID NO: 192994 - RNA, 22 nt, Homo sapiens
auugcuuuuacugggagcuuug

SEQ ID NO: 192995 - RNA, 16 nt, Homo sapiens
auuggcaagaugccuu

SEQ ID NO: 192996 - RNA, 22 nt, Homo sapiens
auuggcaauagcuuucuuacua

SEQ ID NO: 192997 - RNA, 22 nt, Homo sapiens
auuggcaauccauauauuuucu

SEQ ID NO: 192998 - RNA, 22 nt, Homo sapiens
auuggcaauggcaaagcagagu

SEQ ID NO: 192999 - RNA, 22 nt, Homo sapiens
auuugguuauucaguuguucag

SEQ ID NO: 193000 - RNA, 22 nt, Homo sapiens
caaguguuuccuuaaauacuug

SEQ ID NO: 193001 - RNA, 22 nt, Homo sapiens
cacaguagaauagagcacuagg

SEQ ID NO: 193002 - RNA, 22 nt, Homo sapiens
cacaguguuacugguaugaagu

SEQ ID NO: 193003 - RNA, 21 nt, Homo sapiens
cacauggaggcagagagugua

SEQ ID NO: 193004 - RNA, 19 nt, Homo sapiens
caccagugcaugcuacuau

SEQ ID NO: 193005 - RNA, 22 nt, Homo sapiens
caucagagugagauauaagauc

SEQ ID NO: 193006 - RNA, 22 nt, Homo sapiens
cuaaugcagucaggagaaggaa

SEQ ID NO: 193007 - RNA, 22 nt, Homo sapiens
cuacagguaugaaagggaguau

SEQ ID NO: 193008 - RNA, 20 nt, Homo sapiens
cugagguugggguccuuccc

SEQ ID NO: 193009 - RNA, 22 nt, Homo sapiens
cugauauuuuucuggcuugugu

SEQ ID NO: 193010 - RNA, 22 nt, Homo sapiens
cuguaaagaucacagagcuggu

SEQ ID NO: 193011 - RNA, 22 nt, Homo sapiens
cuuagguuaugauaaauuuagu

SEQ ID NO: 193012 - RNA, 22 nt, Homo sapiens
cuuggcuucuuuauguggcuau

SEQ ID NO: 193013 - RNA, 20 nt, Homo sapiens
cuuggcuuucuugguguuaa

SEQ ID NO: 193014 - RNA, 22 nt, Homo sapiens
gacagguuuucuguuucugaaa

SEQ ID NO: 193015 - RNA, 22 nt, Homo sapiens
gagguugggaugagggauacag

SEQ ID NO: 193016 - RNA, 22 nt, Homo sapiens
gauuucacuuucuggaugugca

SEQ ID NO: 193017 - RNA, 22 nt, Homo sapiens
gcacaguguuacuugauauauu

SEQ ID NO: 193018 - RNA, 22 nt, Homo sapiens
gcacgcauuguccuucuaguca

SEQ ID NO: 193019 - RNA, 22 nt, Homo sapiens
ggaagguaauuggguaaugaga

SEQ ID NO: 193020 - RNA, 22 nt, Homo sapiens
ggcaagaggagauucugcuccc

SEQ ID NO: 193021 - RNA, 22 nt, Homo sapiens
ggcaaggugcuacagacaguga

SEQ ID NO: 193022 - RNA, 22 nt, Homo sapiens
ggugagguaguaagguacaaua

SEQ ID NO: 193023 - RNA, 22 nt, Homo sapiens
guacaggugcaggaugggcagg

SEQ ID NO: 193024 - RNA, 22 nt, Homo sapiens
gucuuggagacauugccauuga

SEQ ID NO: 193025 - RNA, 22 nt, Homo sapiens
gugagaggaggcagcuuuuaca

SEQ ID NO: 193026 - RNA, 22 nt, Homo sapiens
gugagauuuucuccagguucag

SEQ ID NO: 193027 - RNA, 22 nt, Homo sapiens
gugcaauucacuguuaugucug

SEQ ID NO: 193028 - RNA, 22 nt, Homo sapiens
guuggcaaguggcugagcuggg

SEQ ID NO: 193029 - RNA, 22 nt, Homo sapiens
guuuggcucuuguuucugucaa

SEQ ID NO: 193030 - RNA, 21 nt, Homo sapiens
uaaaugucauacaaagcaaug

SEQ ID NO: 193031 - RNA, 22 nt, Homo sapiens
uaaugcuguggucuaaugggga

SEQ ID NO: 193032 - RNA, 19 nt, Homo sapiens
uagcacagggucccagacu

SEQ ID NO: 193033 - RNA, 20 nt, Homo sapiens
uagcaggugucaggugauau

SEQ ID NO: 193034 - RNA, 22 nt, Homo sapiens
uagcaucaauucauguuaugau

SEQ ID NO: 193035 - RNA, 22 nt, Homo sapiens
uaggccuuuuuaugucaauauc

SEQ ID NO: 193036 - RNA, 22 nt, Homo sapiens
uaggugcacaguaaauauaugu

SEQ ID NO: 193037 - RNA, 22 nt, Homo sapiens
uaucacagauucuccaggguuu

SEQ ID NO: 193038 - RNA, 22 nt, Homo sapiens
uaucuacauguagguauguaug

SEQ ID NO: 193039 - RNA, 22 nt, Homo sapiens
uauuacagaccauaucgccggg

SEQ ID NO: 193040 - RNA, 22 nt, Homo sapiens
uauuccacuggcacugcauuug

SEQ ID NO: 193041 - RNA, 22 nt, Homo sapiens
uauuccagcccuggugagccag

SEQ ID NO: 193042 - RNA, 22 nt, Homo sapiens
uauugcagauacccaggaaguu

SEQ ID NO: 193043 - RNA, 22 nt, Homo sapiens
uauugcuugaggaaaugguaau

SEQ ID NO: 193044 - RNA, 22 nt, Homo sapiens
uauuugauugacuuuagcagga

SEQ ID NO: 193045 - RNA, 22 nt, Homo sapiens
ucaacagugggcacuguaaaug

SEQ ID NO: 193046 - RNA, 21 nt, Homo sapiens
ucacagccuaggaccugaaga

SEQ ID NO: 193047 - RNA, 22 nt, Homo sapiens
ucacagccuaguuuuauacauu

SEQ ID NO: 193048 - RNA, 22 nt, Homo sapiens
uuggcaauauuuacugaaguug

SEQ ID NO: 193049 - RNA, 22 nt, Homo sapiens
uuggcacuugauaauauucugg

SEQ ID NO: 193050 - RNA, 22 nt, Homo sapiens
uuggccaauggugauucccggc

SEQ ID NO: 193051 - RNA, 17 nt, Homo sapiens
uugggcaagguagguga

SEQ ID NO: 193052 - RNA, 22 nt, Homo sapiens
uugggcaauaggaagcaggugg

SEQ ID NO: 193053 - RNA, 22 nt, Homo sapiens
uugucaugguuaauuuuaugua

SEQ ID NO: 193054 - RNA, 22 nt, Homo sapiens
uuuaggcaauauauucaugucu

SEQ ID NO: 193055 - RNA, 22 nt, Homo sapiens
uuuggcaacguuggaucccuca

SEQ ID NO: 193056 - RNA, 22 nt, Homo sapiens
uuugguugcauucacauauuuc

SEQ ID NO: 193057 - RNA, 22 nt, Homo sapiens
uuuuacagaggagguugcugau

SEQ ID NO: 193058 - RNA, 19 nt, Homo sapiens
uuuuggaaaugugaacagc

SEQ ID NO: 193059 - RNA, 22 nt, Homo sapiens
caacacuguuuauuggauagcc

SEQ ID NO: 193060 - RNA, 22 nt, Homo sapiens
caaugguacuagauaucuucag

SEQ ID NO: 193061 - RNA, 22 nt, Homo sapiens
cacugcauuacucaugagcaug

SEQ ID NO: 193062 - RNA, 22 nt, Homo sapiens
cagguaggccaauguuuuccaa

SEQ ID NO: 193063 - RNA, 22 nt, Homo sapiens
caugccacuguggacaaagaca

SEQ ID NO: 193064 - RNA, 22 nt, Homo sapiens
cccagugugaacuuggcauuuu

SEQ ID NO: 193065 - RNA, 22 nt, Homo sapiens
cugaggcacggcgaccuuaagu

SEQ ID NO: 193066 - RNA, 22 nt, Homo sapiens
cugauauuuuaaaauuggcugg

SEQ ID NO: 193067 - RNA, 20 nt, Homo sapiens
uggcaugaaauuuuccaagc

SEQ ID NO: 193068 - RNA, 22 nt, Homo sapiens
uggcuacugacugaugauuaua

SEQ ID NO: 193069 - RNA, 19 nt, Homo sapiens
uggcuagagcagauauccu

SEQ ID NO: 193070 - RNA, 22 nt, Homo sapiens
uguaagcauugggcaugcaguc

SEQ ID NO: 193071 - RNA, 22 nt, Homo sapiens
uguaaugaucaaaucagaguaa

SEQ ID NO: 193072 - RNA, 22 nt, Homo sapiens
ugucaccauuuguaggugagga

SEQ ID NO: 193073 - RNA, 18 nt, Homo sapiens
ugucacuggauaaugguc

SEQ ID NO: 193074 - RNA, 22 nt, Homo sapiens
ugugcaaucuuccauuuuuagg

SEQ ID NO: 193075 - RNA, 22 nt, Homo sapiens
uguuaagaugucaauuuuccac

SEQ ID NO: 193076 - RNA, 22 nt, Homo sapiens
uguuacagcagaauugaaagag

SEQ ID NO: 193077 - RNA, 22 nt, Homo sapiens
uuacaugucuugguaagguuag

SEQ ID NO: 193078 - RNA, 22 nt, Homo sapiens
uuacauguggugugaagaagag

SEQ ID NO: 193079 - RNA, 22 nt, Homo sapiens
uuacauguuguggguuguggcc

SEQ ID NO: 193080 - RNA, 17 nt, Homo sapiens
uuagagguagacucauu

SEQ ID NO: 193081 - RNA, 22 nt, Homo sapiens
uuauugcacuccagccugggua

SEQ ID NO: 193082 - RNA, 22 nt, Homo sapiens
uucaaggacuaaggauuuuugg

SEQ ID NO: 193083 - RNA, 22 nt, Homo sapiens
uucacaaugccuuguugauggu

SEQ ID NO: 193084 - RNA, 22 nt, Homo sapiens
uucagagagggagggauaccua

SEQ ID NO: 193085 - RNA, 22 nt, Homo sapiens
uucugcuugaucuaguguguug

SEQ ID NO: 193086 - RNA, 22 nt, Homo sapiens
uugagcucaucaagauagagaa

SEQ ID NO: 193087 - RNA, 23 nt, Homo sapiens
uugaggcauguaccaucaauauc

SEQ ID NO: 193088 - RNA, 22 nt, Homo sapiens
uugcaaaguugccaaggaagga

SEQ ID NO: 193089 - RNA, 22 nt, Homo sapiens
uuggaaagagguguuuaugacu

SEQ ID NO: 193090 - RNA, 22 nt, Homo sapiens
uuggaaggcuccuaaugaaugg

SEQ ID NO: 193091 - RNA, 22 nt, Homo sapiens
uuggcaaguccccaccucucuc

SEQ ID NO: 193092 - RNA, 22 nt, Homo sapiens
uuggcauaguugcacuuacuag

SEQ ID NO: 193093 - RNA, 22 nt, Homo sapiens
uuggccgugucauuugcuuuga

SEQ ID NO: 193094 - RNA, 22 nt, Homo sapiens
uugugcaaaguugugguuucug

SEQ ID NO: 193095 - RNA, 22 nt, Homo sapiens
uuuaaugcugcccagucauggg

SEQ ID NO: 193096 - RNA, 22 nt, Homo sapiens
uuucccuuuagcuuagugauuu

SEQ ID NO: 193097 - RNA, 22 nt, Homo sapiens
uuugcaagaugaaaaaguucua

SEQ ID NO: 193098 - RNA, 20 nt, Homo sapiens
uuuggcaauaggguuuuugu

SEQ ID NO: 193099 - RNA, 22 nt, Homo sapiens
uuuggcaauuugacuguauagg

SEQ ID NO: 193100 - RNA, 22 nt, Homo sapiens
uuuuggcucugucuguaucuuu

SEQ ID NO: 193101 - RNA, 22 nt, Homo sapiens
uuuuggcuuaaagagaauguau

SEQ ID NO: 193102 - RNA, 22 nt, Homo sapiens
ugaggcacucuagacuuauuca

SEQ ID NO: 193103 - RNA, 22 nt, Homo sapiens
ugauaugcuuugaacucucugg

SEQ ID NO: 193104 - RNA, 22 nt, Homo sapiens
ugcaagaggagacuguacucag

SEQ ID NO: 193105 - RNA, 22 nt, Homo sapiens
ugcauuguuccgaauguguccu

SEQ ID NO: 193106 - RNA, 22 nt, Homo sapiens
uggaaggucauuguucauuuga

SEQ ID NO: 193107 - RNA, 22 nt, Homo sapiens
uggcaagaacaacaauuacuuu

SEQ ID NO: 193108 - RNA, 22 nt, Homo sapiens
uggcaagaaccacaauuacuuu

SEQ ID NO: 193109 - RNA, 23 nt, Homo sapiens
uggcaagaauucuuaccgugugg

SEQ ID NO: 193110 - RNA, 22 nt, Homo sapiens
uggcaagaccccaucucuacaa

SEQ ID NO: 193111 - RNA, 22 nt, Homo sapiens
uggcaagauuguuccgguuugg

SEQ ID NO: 193112 - RNA, 22 nt, Homo sapiens
uggcaauaaggacuccuuaggu

SEQ ID NO: 193113 - RNA, 22 nt, Homo sapiens
uggcacuggagauacauuaaua

SEQ ID NO: 193114 - RNA, 22 nt, Homo sapiens
uggcauauaaagauguguucaa

SEQ ID NO: 193115 - RNA, 22 nt, Homo sapiens
uggcuagauauccagaguucug

SEQ ID NO: 193116 - RNA, 22 nt, Homo sapiens
ugguaagaggcccugaguuugu

SEQ ID NO: 193117 - RNA, 22 nt, Homo sapiens
uguaaggcaguuagagcaaauu

SEQ ID NO: 193118 - RNA, 23 nt, Homo sapiens
ugucaucaagaugaggucacacu

SEQ ID NO: 193119 - RNA, 22 nt, Homo sapiens
ugugcaaucagcuucauuacau

SEQ ID NO: 193120 - RNA, 22 nt, Homo sapiens
uguuacaguguaggccuugggu

SEQ ID NO: 193121 - RNA, 22 nt, Homo sapiens
uguuggcauugcugcugacccu

SEQ ID NO: 193122 - RNA, 22 nt, Homo sapiens
uuaaagugaucauaaggauagu

SEQ ID NO: 193123 - RNA, 22 nt, Homo sapiens
uuaaaugucuguagaugugcug

SEQ ID NO: 193124 - RNA, 22 nt, Homo sapiens
uuaagguuuuuguagcaaggau

SEQ ID NO: 193125 - RNA, 22 nt, Homo sapiens
uuaaugugaaucaggaugcauu

SEQ ID NO: 193126 - RNA, 22 nt, Homo sapiens
uuacacaguaggucccuaguaa

SEQ ID NO: 193127 - RNA, 22 nt, Homo sapiens
uuacagauggauggcagcuggc

SEQ ID NO: 193128 - RNA, 22 nt, Homo sapiens
uuacaguucugguggagaggua

SEQ ID NO: 193129 - RNA, 22 nt, Homo sapiens
uuagcacugucuacucuggauu

SEQ ID NO: 193130 - RNA, 22 nt, Homo sapiens
uuagguaggugcuuuuuucaca

SEQ ID NO: 193131 - RNA, 22 nt, Homo sapiens
uuaggugcauggaaguguuuuc

SEQ ID NO: 193132 - RNA, 22 nt, Homo sapiens
uuauuagagauauuugguuagg

SEQ ID NO: 193133 - RNA, 22 nt, Homo sapiens
uucaaaguaaagggauggagac

SEQ ID NO: 193134 - RNA, 22 nt, Homo sapiens
uuccacagggauuugcauugau

SEQ ID NO: 193135 - RNA, 22 nt, Homo sapiens
uugaaagucuaggcuuacagua

SEQ ID NO: 193136 - RNA, 22 nt, Homo sapiens
uugaaugaaauuggugugggga

SEQ ID NO: 193137 - RNA, 16 nt, Homo sapiens
uugaggcaugucucag

SEQ ID NO: 193138 - RNA, 22 nt, Homo sapiens
uugaguaguaagugguucaccg

SEQ ID NO: 193139 - RNA, 22 nt, Homo sapiens
uugcaaagaccucuucacuucc

SEQ ID NO: 193140 - RNA, 22 nt, Homo sapiens
uugcaaaguuugccuccuguag

SEQ ID NO: 193141 - RNA, 22 nt, Homo sapiens
uugcaagaaaugcagauucuca

SEQ ID NO: 193142 - RNA, 22 nt, Homo sapiens
uugcacuccagcucuaggugac

SEQ ID NO: 193143 - RNA, 22 nt, Homo sapiens
uuggcuaagaucacgugagaau

SEQ ID NO: 193144 - RNA, 20 nt, Homo sapiens
uuuaagacaugcugaauuga

SEQ ID NO: 193145 - RNA, 17 nt, Homo sapiens
uuuaaugcuaggacucu

SEQ ID NO: 193146 - RNA, 23 nt, Homo sapiens
uuucacaguagcuggaucagccu

SEQ ID NO: 193147 - RNA, 22 nt, Homo sapiens
uuugauuguacuaaaauuguac

SEQ ID NO: 193148 - RNA, 22 nt, Homo sapiens
uuuggcaaagaucaacauguua

SEQ ID NO: 193149 - RNA, 22 nt, Homo sapiens
uuuguauguuggagauuggaga

SEQ ID NO: 193150 - RNA, 22 nt, Homo sapiens
uuugugaaugucauaagcucca

SEQ ID NO: 193151 - RNA, 22 nt, Homo sapiens
cuggcaccauacacuguuguug

SEQ ID NO: 193152 - RNA, 22 nt, Homo sapiens
cuuuaguuaaaauugggguugu

SEQ ID NO: 193153 - RNA, 22 nt, Homo sapiens
gaaaguguugagauuacaggca

SEQ ID NO: 193154 - RNA, 19 nt, Homo sapiens
gaaguguuguccuccagua

SEQ ID NO: 193155 - RNA, 22 nt, Homo sapiens
gacaguguggcgauuccucaag

SEQ ID NO: 193156 - RNA, 22 nt, Homo sapiens
gagauuauuagauguucugcuu

SEQ ID NO: 193157 - RNA, 22 nt, Homo sapiens
gagauucuucaauauuuauucu

SEQ ID NO: 193158 - RNA, 22 nt, Homo sapiens
gagguaggggccuuaaagaugc

SEQ ID NO: 193159 - RNA, 22 nt, Homo sapiens
gauauuacuuccaauauugcaa

SEQ ID NO: 193160 - RNA, 22 nt, Homo sapiens
gaugagaucauaaguguggagc

SEQ ID NO: 193161 - RNA, 22 nt, Homo sapiens
gaugagaugagcauuugaauug

SEQ ID NO: 193162 - RNA, 22 nt, Homo sapiens
gaugagauguucucauggauug

SEQ ID NO: 193163 - RNA, 22 nt, Homo sapiens
gcaagaugagagcccgggcagu

SEQ ID NO: 193164 - RNA, 22 nt, Homo sapiens
gcaauguuacugaauguguuuu

SEQ ID NO: 193165 - RNA, 22 nt, Homo sapiens
gcacaguggcucccgucuauaa

SEQ ID NO: 193166 - RNA, 23 nt, Homo sapiens
gcagucauuuggaaaagguugaa

SEQ ID NO: 193167 - RNA, 22 nt, Homo sapiens
gcugcuguuauucaucagaacu

SEQ ID NO: 193168 - RNA, 22 nt, Homo sapiens
gcuguugcuauuauuccgagaa

SEQ ID NO: 193169 - RNA, 22 nt, Homo sapiens
ggaaagaucagcuaaauguaag

SEQ ID NO: 193170 - RNA, 22 nt, Homo sapiens
ggaaggucaaagggaaagcaga

SEQ ID NO: 193171 - RNA, 22 nt, Homo sapiens
ggauggcauuucuuuagcuuuu

SEQ ID NO: 193172 - RNA, 22 nt, Homo sapiens
ggcaaagagacaugcaucgggg

SEQ ID NO: 193173 - RNA, 22 nt, Homo sapiens
ggcaaggauuagauucuccccu

SEQ ID NO: 193174 - RNA, 22 nt, Homo sapiens
ggcaagugggagggaguguuuc

SEQ ID NO: 193175 - RNA, 22 nt, Homo sapiens
gguggcaaaucugaguggcgcu

SEQ ID NO: 193176 - RNA, 22 nt, Homo sapiens
gucuggcaauggcagacuggca

SEQ ID NO: 193177 - RNA, 22 nt, Homo sapiens
gugaggcacugcugcuuuccag

SEQ ID NO: 193178 - RNA, 22 nt, Homo sapiens
gugcaagagugacugcaguuuu

SEQ ID NO: 193179 - RNA, 22 nt, Homo sapiens
gugcaagagugauugcaguuuu

SEQ ID NO: 193180 - RNA, 22 nt, Homo sapiens
gugcaauguuaauuacuugacu

SEQ ID NO: 193181 - RNA, 22 nt, Homo sapiens
guggcaagaauguacaaaaggu

SEQ ID NO: 193182 - RNA, 22 nt, Homo sapiens
guggcaagaugacuacucacug

SEQ ID NO: 193183 - RNA, 22 nt, Homo sapiens
guggcaaggaaaugcugcucac

SEQ ID NO: 193184 - RNA, 22 nt, Homo sapiens
guggcaaguguuccaagaggcg

SEQ ID NO: 193185 - RNA, 22 nt, Homo sapiens
guguauauccuauuaguucugu

SEQ ID NO: 193186 - RNA, 21 nt, Homo sapiens
gugucacagacaugacagaug

SEQ ID NO: 193187 - RNA, 22 nt, Homo sapiens
guguuugguugauagagccacu

SEQ ID NO: 193188 - RNA, 21 nt, Homo sapiens
uaauaaugucucagacaccua

SEQ ID NO: 193189 - RNA, 22 nt, Homo sapiens
uaauauguauacagacagauac

SEQ ID NO: 193190 - RNA, 22 nt, Homo sapiens
uaaugcauguaaugggcugaua

SEQ ID NO: 193191 - RNA, 22 nt, Homo sapiens
uaaugcuguggucugguuuaaa

SEQ ID NO: 193192 - RNA, 22 nt, Homo sapiens
uaauucuguauguaucagaguu

SEQ ID NO: 193193 - RNA, 22 nt, Homo sapiens
uacaagguaucagugaccguaa

SEQ ID NO: 193194 - RNA, 22 nt, Homo sapiens
uacacacguguguauauauaca

SEQ ID NO: 193195 - RNA, 22 nt, Homo sapiens
uagaagcacuaucccuccuagu

SEQ ID NO: 193196 - RNA, 22 nt, Homo sapiens
uaguuuaucuucuggauggaca

SEQ ID NO: 193197 - RNA, 22 nt, Homo sapiens
uauacaugugccauguuggugu

SEQ ID NO: 193198 - RNA, 22 nt, Homo sapiens
uaucaaguguuagggagaugug

SEQ ID NO: 193199 - RNA, 22 nt, Homo sapiens
uaucaucauguuuuugcugugu

SEQ ID NO: 193200 - RNA, 22 nt, Homo sapiens
uauugacauuacagugggucuu

SEQ ID NO: 193201 - RNA, 22 nt, Homo sapiens
ucaaagugcuauggcucagguu

SEQ ID NO: 193202 - RNA, 18 nt, Homo sapiens
ucacagguaaaguugaca

SEQ ID NO: 193203 - RNA, 22 nt, Homo sapiens
ucacagugcaggaucaguuaau

SEQ ID NO: 193204 - RNA, 22 nt, Homo sapiens
ucacauggggaagggacuagcu

SEQ ID NO: 193205 - RNA, 18 nt, Homo sapiens
ucagagugcagacuauac

SEQ ID NO: 193206 - RNA, 22 nt, Homo sapiens
ucagauacuggugacaugaaug

SEQ ID NO: 193207 - RNA, 21 nt, Homo sapiens
ucauauguaucuuugugccuc

SEQ ID NO: 193208 - RNA, 20 nt, Homo sapiens
ugacaucagcaauguaauaa

SEQ ID NO: 193209 - RNA, 22 nt, Homo sapiens
ugaccagaaaacaaauuaguuu

SEQ ID NO: 193210 - RNA, 22 nt, Homo sapiens
ugagaauauuuuccaugucuca

SEQ ID NO: 193211 - RNA, 22 nt, Homo sapiens
ugagauuaucuugaucuugaaa

SEQ ID NO: 193212 - RNA, 22 nt, Homo sapiens
ugagcacuguacuuuaucaggu

SEQ ID NO: 193213 - RNA, 20 nt, Homo sapiens
ugauauuuucugagcaggaa

SEQ ID NO: 193214 - RNA, 22 nt, Homo sapiens
ugcaaagaaauuuuggugacca

SEQ ID NO: 193215 - RNA, 22 nt, Homo sapiens
ugcaaaugcugcuauuucucuu

SEQ ID NO: 193216 - RNA, 21 nt, Homo sapiens
ugcagccauucagcccuaugc

SEQ ID NO: 193217 - RNA, 22 nt, Homo sapiens
ugcauauguauacaugugccau

SEQ ID NO: 193218 - RNA, 22 nt, Homo sapiens
ugcauauguucaaaguauucug

SEQ ID NO: 193219 - RNA, 22 nt, Homo sapiens
ugcuuugguagaaaucuuuggu

SEQ ID NO: 193220 - RNA, 20 nt, Homo sapiens
uggaaaguaagucaugauau

SEQ ID NO: 193221 - RNA, 22 nt, Homo sapiens
uggaagauucuagaagauucca

SEQ ID NO: 193222 - RNA, 22 nt, Homo sapiens
uggcaaaauauuuugguuucug

SEQ ID NO: 193223 - RNA, 22 nt, Homo sapiens
uggcaagaaggauuuauuccuu

SEQ ID NO: 193224 - RNA, 22 nt, Homo sapiens
uggcaagagauaugugucuaua

SEQ ID NO: 193225 - RNA, 22 nt, Homo sapiens
uggcaagaucacaauuacuuuu

SEQ ID NO: 193226 - RNA, 20 nt, Homo sapiens
uggcaagauggcagaauaga

SEQ ID NO: 193227 - RNA, 18 nt, Homo sapiens
uggcaauaugguucuacc

SEQ ID NO: 193228 - RNA, 19 nt, Homo sapiens
uggcacauguauacauaug

SEQ ID NO: 193229 - RNA, 19 nt, Homo sapiens
uggcacauguauacuuaug

SEQ ID NO: 193230 - RNA, 19 nt, Homo sapiens
uggcaugaaugugaacuaa

SEQ ID NO: 193231 - RNA, 23 nt, Homo sapiens
uggccaagauaaucucaguuuuc

SEQ ID NO: 193232 - RNA, 23 nt, Homo sapiens
uggcuagacguccuuuccugaug

SEQ ID NO: 193233 - RNA, 22 nt, Homo sapiens
ugguuccauauuaauuuuagga

SEQ ID NO: 193234 - RNA, 22 nt, Homo sapiens
ugucaagaaaucaaggugugag

SEQ ID NO: 193235 - RNA, 22 nt, Homo sapiens
ugucaugagucuccuccaucuu

SEQ ID NO: 193236 - RNA, 22 nt, Homo sapiens
uguuacacugugcacuaaauuu

SEQ ID NO: 193237 - RNA, 22 nt, Homo sapiens
uuaaaguguuugcagacaggug

SEQ ID NO: 193238 - RNA, 22 nt, Homo sapiens
uuaaaguguuuucaaaauguca

SEQ ID NO: 193239 - RNA, 22 nt, Homo sapiens
uuaaguuguagcuacaaauaca

SEQ ID NO: 193240 - RNA, 22 nt, Homo sapiens
uuacacaguugguaggggcaga

SEQ ID NO: 193241 - RNA, 22 nt, Homo sapiens
uuacacguaauaucacggugug

SEQ ID NO: 193242 - RNA, 17 nt, Homo sapiens
uuacaggugcugagagu

SEQ ID NO: 193243 - RNA, 22 nt, Homo sapiens
uuacagguggagaaguaaggcu

SEQ ID NO: 193244 - RNA, 22 nt, Homo sapiens
uuacauugcuucaaauucagug

SEQ ID NO: 193245 - RNA, 22 nt, Homo sapiens
uuauagguuucuacaggacuau

SEQ ID NO: 193246 - RNA, 22 nt, Homo sapiens
uuauucugucuuuggucucaau

SEQ ID NO: 193247 - RNA, 23 nt, Homo sapiens
uucaaauguucucugguugucag

SEQ ID NO: 193248 - RNA, 22 nt, Homo sapiens
uucacaauuaaaugugguuauu

SEQ ID NO: 193249 - RNA, 22 nt, Homo sapiens
uucacacuagccacucugguag

SEQ ID NO: 193250 - RNA, 22 nt, Homo sapiens
uugagcaaaacauuaauauuag

SEQ ID NO: 193251 - RNA, 22 nt, Homo sapiens
uugagcaacauagugagacugu

SEQ ID NO: 193252 - RNA, 22 nt, Homo sapiens
uugagcaaugucacugaggcuu

SEQ ID NO: 193253 - RNA, 22 nt, Homo sapiens
uugaggcaaugaggagaagcug

SEQ ID NO: 193254 - RNA, 22 nt, Homo sapiens
uugauuagauccaguugauuga

SEQ ID NO: 193255 - RNA, 23 nt, Homo sapiens
uugcaaagccugaaacucuucag

SEQ ID NO: 193256 - RNA, 19 nt, Homo sapiens
uugcauagguugaaccagc

SEQ ID NO: 193257 - RNA, 22 nt, Homo sapiens
uugcuacauugauugccucuuu

SEQ ID NO: 193258 - RNA, 22 nt, Homo sapiens
uuggaaauguguuugcauucag

SEQ ID NO: 193259 - RNA, 22 nt, Homo sapiens
uuggcaagaaccuucuuccaag

SEQ ID NO: 193260 - RNA, 22 nt, Homo sapiens
uuggcaagaauguaugccgauc

SEQ ID NO: 193261 - RNA, 22 nt, Homo sapiens
uuggcaagcuguuaauuauaaa

SEQ ID NO: 193262 - RNA, 22 nt, Homo sapiens
uuggcaaguuucugucagcaaa

SEQ ID NO: 193263 - RNA, 22 nt, Homo sapiens
uuggcaaucaauucugacgucu

SEQ ID NO: 193264 - RNA, 22 nt, Homo sapiens
uuggcacugagcaagaacaggg

SEQ ID NO: 193265 - RNA, 23 nt, Homo sapiens
uugggcaaaucacugagggcaga

SEQ ID NO: 193266 - RNA, 22 nt, Homo sapiens
uuggucaaaucugaugggagaa

SEQ ID NO: 193267 - RNA, 22 nt, Homo sapiens
uuguaauguuaggguguccaug

SEQ ID NO: 193268 - RNA, 22 nt, Homo sapiens
uugugcaaaaguaauugcgguu

SEQ ID NO: 193269 - RNA, 22 nt, Homo sapiens
uuuauugcucuaaaguugccau

SEQ ID NO: 193270 - RNA, 22 nt, Homo sapiens
uuuccacauggacuuaccuucg

SEQ ID NO: 193271 - RNA, 22 nt, Homo sapiens
uuugaaugcaacaaaugcggga

SEQ ID NO: 193272 - RNA, 22 nt, Homo sapiens
uuuggcaauaaacuccccuaac

SEQ ID NO: 193273 - RNA, 22 nt, Homo sapiens
uuuggcuuaagauugacugcaa

SEQ ID NO: 193274 - RNA, 22 nt, Homo sapiens
uuuuuggaggagguuagaucau

SEQ ID NO: 193275 - RNA, 22 nt, Homo sapiens
aaagcagcaggugguuuucaau

SEQ ID NO: 193276 - RNA, 22 nt, Homo sapiens
aaaguguuucugcaguagguuu

SEQ ID NO: 193277 - RNA, 19 nt, Homo sapiens
aaaguguuuuaaagaggau

SEQ ID NO: 193278 - RNA, 22 nt, Homo sapiens
aaauugcauugagcugcuuauu

SEQ ID NO: 193279 - RNA, 22 nt, Homo sapiens
aacagugcuguuauaaauguac

SEQ ID NO: 193280 - RNA, 21 nt, Homo sapiens
aacagugcuuaguagauguuc

SEQ ID NO: 193281 - RNA, 22 nt, Homo sapiens
aagcacaauuucaccuucuugu

SEQ ID NO: 193282 - RNA, 19 nt, Homo sapiens
aaguaguugugacagaugc

SEQ ID NO: 193283 - RNA, 22 nt, Homo sapiens
aaugaaguuagauguugagaag

SEQ ID NO: 193284 - RNA, 23 nt, Homo sapiens
aauugcuuuugaggacuuaguug

SEQ ID NO: 193285 - RNA, 22 nt, Homo sapiens
acacagugucuguguauuuaaa

SEQ ID NO: 193286 - RNA, 18 nt, Homo sapiens
acagugucauggcucaau

SEQ ID NO: 193287 - RNA, 17 nt, Homo sapiens
acagugucuaugaaaug

SEQ ID NO: 193288 - RNA, 22 nt, Homo sapiens
acaguguuccuuuguugugacu

SEQ ID NO: 193289 - RNA, 22 nt, Homo sapiens
acuuuuugcaaccauuuggacc

SEQ ID NO: 193290 - RNA, 22 nt, Homo sapiens
agacaucauuugauggugggag

SEQ ID NO: 193291 - RNA, 22 nt, Homo sapiens
agagaugaagauggggcucccg

SEQ ID NO: 193292 - RNA, 22 nt, Homo sapiens
agaugauguuucuggcacauga

SEQ ID NO: 193293 - RNA, 22 nt, Homo sapiens
agcacagccuuguguuuucuug

SEQ ID NO: 193294 - RNA, 22 nt, Homo sapiens
agcacagugaaugguuuacuca

SEQ ID NO: 193295 - RNA, 17 nt, Homo sapiens
agcagcccauaucccca

SEQ ID NO: 193296 - RNA, 22 nt, Homo sapiens
agcuggaauuuaagguagauag

SEQ ID NO: 193297 - RNA, 21 nt, Homo sapiens
aggagauguuuguccuuuuag

SEQ ID NO: 193298 - RNA, 22 nt, Homo sapiens
aggcaagaaugcuuguuucacc

SEQ ID NO: 193299 - RNA, 22 nt, Homo sapiens
aggcaagagugacuacgugaaa

SEQ ID NO: 193300 - RNA, 22 nt, Homo sapiens
agugcauugcaucucugcuuca

SEQ ID NO: 193301 - RNA, 22 nt, Homo sapiens
aguucaaugcucuuucuacuau

SEQ ID NO: 193302 - RNA, 22 nt, Homo sapiens
auaaaguguuuaguauaggcaa

SEQ ID NO: 193303 - RNA, 22 nt, Homo sapiens
auacagguauacaaugcauaau

SEQ ID NO: 193304 - RNA, 19 nt, Homo sapiens
auaugggguuugaacugug

SEQ ID NO: 193305 - RNA, 22 nt, Homo sapiens
auauguucucauucauaugugg

SEQ ID NO: 193306 - RNA, 22 nt, Homo sapiens
auauugacuuucucuuagauca

SEQ ID NO: 193307 - RNA, 22 nt, Homo sapiens
aucacagguacuauggcugaca

SEQ ID NO: 193308 - RNA, 22 nt, Homo sapiens
aucauacuguuuugauuacugu

SEQ ID NO: 193309 - RNA, 22 nt, Homo sapiens
augaggcaggaaaggcguaucu

SEQ ID NO: 193310 - RNA, 22 nt, Homo sapiens
auggaaggagaauggucuuuga

SEQ ID NO: 193311 - RNA, 22 nt, Homo sapiens
auggcaagaagagcaauuauuu

SEQ ID NO: 193312 - RNA, 22 nt, Homo sapiens
auggccuaugacagguauguug

SEQ ID NO: 193313 - RNA, 22 nt, Homo sapiens
auggcggugugggcggugcagc

SEQ ID NO: 193314 - RNA, 22 nt, Homo sapiens
augugcaugcuguucugccaga

SEQ ID NO: 193315 - RNA, 22 nt, Homo sapiens
auuccacaguuaacacagaccg

SEQ ID NO: 193316 - RNA, 22 nt, Homo sapiens
auugcuuacccuguauuagauc

SEQ ID NO: 193317 - RNA, 22 nt, Homo sapiens
auuggcaagauagcauaugagg

SEQ ID NO: 193318 - RNA, 21 nt, Homo sapiens
gacauggcgauacuccgucuc

SEQ ID NO: 193319 - RNA, 22 nt, Homo sapiens
gauuccacuuacuuagcauucc

SEQ ID NO: 193320 - RNA, 22 nt, Homo sapiens
gcaaaguguuuuuaggaagucu

SEQ ID NO: 193321 - RNA, 22 nt, Homo sapiens
gcaagaguauuucaaggaagau

SEQ ID NO: 193322 - RNA, 22 nt, Homo sapiens
gcacccguagugcuuucaauua

SEQ ID NO: 193323 - RNA, 23 nt, Homo sapiens
gcuaggagagaugaaacacaggu

SEQ ID NO: 193324 - RNA, 22 nt, Homo sapiens
gcugguguugugaaucaggccg

SEQ ID NO: 193325 - RNA, 22 nt, Homo sapiens
ggagcugugauuugaguccaga

SEQ ID NO: 193326 - RNA, 22 nt, Homo sapiens
ggcaaagaugaccauuacuuuu

SEQ ID NO: 193327 - RNA, 22 nt, Homo sapiens
ggcaagauagauaucaguguca

SEQ ID NO: 193328 - RNA, 22 nt, Homo sapiens
ggcuagagacaaguugcugaga

SEQ ID NO: 193329 - RNA, 22 nt, Homo sapiens
gggaagguaaucauuacuugau

SEQ ID NO: 193330 - RNA, 22 nt, Homo sapiens
ggugagguaggaaaaguuagga

SEQ ID NO: 193331 - RNA, 22 nt, Homo sapiens
guaaaugcagaugcaugaccuu

SEQ ID NO: 193332 - RNA, 22 nt, Homo sapiens
gugcaaugucaggagaugcagc

SEQ ID NO: 193333 - RNA, 21 nt, Homo sapiens
gugcacaguaguguuuaauag

SEQ ID NO: 193334 - RNA, 22 nt, Homo sapiens
gugggcaaagcuaguguguaga

SEQ ID NO: 193335 - RNA, 22 nt, Homo sapiens
guguggaacucaauacaacgca

SEQ ID NO: 193336 - RNA, 22 nt, Homo sapiens
guuggcaagaggugcuguacac

SEQ ID NO: 193337 - RNA, 22 nt, Homo sapiens
uaaagugaggauggcaguaggu

SEQ ID NO: 193338 - RNA, 22 nt, Homo sapiens
uaaaguguuuguuauuaaaggu

SEQ ID NO: 193339 - RNA, 22 nt, Homo sapiens
uacagaauucugucccuugagu

SEQ ID NO: 193340 - RNA, 22 nt, Homo sapiens
uacaggugcucuacagacagga

SEQ ID NO: 193341 - RNA, 22 nt, Homo sapiens
uacauugcacuuuauuagauac

SEQ ID NO: 193342 - RNA, 22 nt, Homo sapiens
uacugguuuuggugggcaggug

SEQ ID NO: 193343 - RNA, 22 nt, Homo sapiens
uacuuuguagauuguuuccuuu

SEQ ID NO: 193344 - RNA, 22 nt, Homo sapiens
uagcacagggaauugguucucu

SEQ ID NO: 193345 - RNA, 22 nt, Homo sapiens
uaucacaguaucuagcacagug

SEQ ID NO: 193346 - RNA, 22 nt, Homo sapiens
uauuagguuggugcaacaguaa

SEQ ID NO: 193347 - RNA, 22 nt, Homo sapiens
uauucacaggugugggacaaag

SEQ ID NO: 193348 - RNA, 22 nt, Homo sapiens
uauuucaguugugcagguaguu

SEQ ID NO: 193349 - RNA, 22 nt, Homo sapiens
ucacagugaguggaguggggug

SEQ ID NO: 193350 - RNA, 22 nt, Homo sapiens
ucagaucaguuccacaagaacu

SEQ ID NO: 193351 - RNA, 21 nt, Homo sapiens
ucagggaccugcuguacugau

SEQ ID NO: 193352 - RNA, 22 nt, Homo sapiens
ucagguugcuaaguauaauauu

SEQ ID NO: 193353 - RNA, 22 nt, Homo sapiens
ucauauugcgguucauugacuu

SEQ ID NO: 193354 - RNA, 22 nt, Homo sapiens
uccacagugguugaacuaguaa

SEQ ID NO: 193355 - RNA, 22 nt, Homo sapiens
ugacaagacuacauaucccauu

SEQ ID NO: 193356 - RNA, 22 nt, Homo sapiens
ugacagguugauaggugcagca

SEQ ID NO: 193357 - RNA, 22 nt, Homo sapiens
ugagacggagucuggcacuguc

SEQ ID NO: 193358 - RNA, 22 nt, Homo sapiens
ugagacggagucuugcccuguc

SEQ ID NO: 193359 - RNA, 22 nt, Homo sapiens
ugagacggagucuugcuaaguu

SEQ ID NO: 193360 - RNA, 22 nt, Homo sapiens
ugagaggugaauggcaggcuca

SEQ ID NO: 193361 - RNA, 21 nt, Homo sapiens
ugagauuaaguuguuuagaag

SEQ ID NO: 193362 - RNA, 22 nt, Homo sapiens
ugagcagagggagaaguaaauu

SEQ ID NO: 193363 - RNA, 22 nt, Homo sapiens
ugagcucagcuaguugaggugu

SEQ ID NO: 193364 - RNA, 22 nt, Homo sapiens
ugcacaguccagugcccacuga

SEQ ID NO: 193365 - RNA, 16 nt, Homo sapiens
ugcagaguaggugaau

SEQ ID NO: 193366 - RNA, 22 nt, Homo sapiens
ugcauauuuuauaaagauggaa

SEQ ID NO: 193367 - RNA, 19 nt, Homo sapiens
ugccaagaaagucagcuua

SEQ ID NO: 193368 - RNA, 22 nt, Homo sapiens
ugcuauguuuucccuccuuauc

SEQ ID NO: 193369 - RNA, 22 nt, Homo sapiens
ugcugcaaacaugagaggaagu

SEQ ID NO: 193370 - RNA, 22 nt, Homo sapiens
ugcugcauuggggauuaaguuu

SEQ ID NO: 193371 - RNA, 22 nt, Homo sapiens
uggaaguaaccaugaauggaau

SEQ ID NO: 193372 - RNA, 23 nt, Homo sapiens
uggaaguauggaggaggcagaau

SEQ ID NO: 193373 - RNA, 22 nt, Homo sapiens
uggcaaaaaucacaaguaccuu

SEQ ID NO: 193374 - RNA, 22 nt, Homo sapiens
uggcaagagaacaacaucucuc

SEQ ID NO: 193375 - RNA, 22 nt, Homo sapiens
uggcaagagcaaaauguacagu

SEQ ID NO: 193376 - RNA, 23 nt, Homo sapiens
uggcaagauuuguauugccugga

SEQ ID NO: 193377 - RNA, 22 nt, Homo sapiens
uggcaauaauucagugugggcu

SEQ ID NO: 193378 - RNA, 19 nt, Homo sapiens
uggcaaugucagcagagau

SEQ ID NO: 193379 - RNA, 22 nt, Homo sapiens
uggcacuaugugacaagguuuu

SEQ ID NO: 193380 - RNA, 22 nt, Homo sapiens
ugggcaagugacuuggcuucuc

SEQ ID NO: 193381 - RNA, 22 nt, Homo sapiens
uggggcuuuuucuuguauucuc

SEQ ID NO: 193382 - RNA, 23 nt, Homo sapiens
ugguaacauguuguggcagggga

SEQ ID NO: 193383 - RNA, 22 nt, Homo sapiens
uggugcccuguccuucuguggc

SEQ ID NO: 193384 - RNA, 22 nt, Homo sapiens
ugucaagaugguuugauguugu

SEQ ID NO: 193385 - RNA, 18 nt, Homo sapiens
ugugcaauauuaaccacc

SEQ ID NO: 193386 - RNA, 22 nt, Homo sapiens
ugugcacuggaccuugucuucu

SEQ ID NO: 193387 - RNA, 22 nt, Homo sapiens
uguuacagcagcacaaaaugga

SEQ ID NO: 193388 - RNA, 22 nt, Homo sapiens
uguuaguuguucauguuaagag

SEQ ID NO: 193389 - RNA, 22 nt, Homo sapiens
uuaaagugcacacgggucaggc

SEQ ID NO: 193390 - RNA, 22 nt, Homo sapiens
uuacaguagaugaggguauaau

SEQ ID NO: 193391 - RNA, 21 nt, Homo sapiens
uuacaguugguugugaggugg

SEQ ID NO: 193392 - RNA, 22 nt, Homo sapiens
uuagaacuagaggaguuugagu

SEQ ID NO: 193393 - RNA, 22 nt, Homo sapiens
uuagaugaagucacagaaccca

SEQ ID NO: 193394 - RNA, 22 nt, Homo sapiens
uugagcaaugaacgauucaggg

SEQ ID NO: 193395 - RNA, 22 nt, Homo sapiens
uugagcuauguacagaugcugu

SEQ ID NO: 193396 - RNA, 20 nt, Homo sapiens
uugaggugugaggggcagag

SEQ ID NO: 193397 - RNA, 22 nt, Homo sapiens
uugcaagaaaucagagccuucc

SEQ ID NO: 193398 - RNA, 22 nt, Homo sapiens
uugcaggugguuuaugcaagac

SEQ ID NO: 193399 - RNA, 22 nt, Homo sapiens
uuggaaaaauccaccuugaucu

SEQ ID NO: 193400 - RNA, 22 nt, Homo sapiens
aaaacgcauccucacaggucug

SEQ ID NO: 193401 - RNA, 22 nt, Homo sapiens
aaagugccugacucauaguuag

SEQ ID NO: 193402 - RNA, 20 nt, Homo sapiens
aacaguguguaaguuuccuu

SEQ ID NO: 193403 - RNA, 22 nt, Homo sapiens
aacaguguuuuggguuuucugg

SEQ ID NO: 193404 - RNA, 20 nt, Homo sapiens
aagagcucaccagaauaucu

SEQ ID NO: 193405 - RNA, 22 nt, Homo sapiens
aaggagcuaagagaucauacau

SEQ ID NO: 193406 - RNA, 22 nt, Homo sapiens
aagugagaugcaguggaguucc

SEQ ID NO: 193407 - RNA, 22 nt, Homo sapiens
aauugaaucaugugggcagacu

SEQ ID NO: 193408 - RNA, 22 nt, Homo sapiens
acacaguguuuauugugguuag

SEQ ID NO: 193409 - RNA, 22 nt, Homo sapiens
acagguauagaaagcuaaaggg

SEQ ID NO: 193410 - RNA, 23 nt, Homo sapiens
acaguauguggauguggcuaagu

SEQ ID NO: 193411 - RNA, 19 nt, Homo sapiens
acaguauugugcacagguu

SEQ ID NO: 193412 - RNA, 19 nt, Homo sapiens
acagugucucuauaaugau

SEQ ID NO: 193413 - RNA, 22 nt, Homo sapiens
acagugucugacacguaggaag

SEQ ID NO: 193414 - RNA, 22 nt, Homo sapiens
acaugagacuggguuuguaggg

SEQ ID NO: 193415 - RNA, 22 nt, Homo sapiens
acuacauaugacaucuucuuua

SEQ ID NO: 193416 - RNA, 22 nt, Homo sapiens
acuuuuugaugaggucguuugu

SEQ ID NO: 193417 - RNA, 22 nt, Homo sapiens
agaauguauauucuguaguugu

SEQ ID NO: 193418 - RNA, 22 nt, Homo sapiens
agauguuguucaucugauuguu

SEQ ID NO: 193419 - RNA, 22 nt, Homo sapiens
agcaucacacacuacagggaaa

SEQ ID NO: 193420 - RNA, 23 nt, Homo sapiens
agcccugugacucgaacgaggag

SEQ ID NO: 193421 - RNA, 20 nt, Homo sapiens
agcugcagauauaaauccgc

SEQ ID NO: 193422 - RNA, 22 nt, Homo sapiens
agcuucauucugaauagguuga

SEQ ID NO: 193423 - RNA, 22 nt, Homo sapiens
agcuugugcuguaugaagggcc

SEQ ID NO: 193424 - RNA, 22 nt, Homo sapiens
agcuuuuugggcagcuauugac

SEQ ID NO: 193425 - RNA, 21 nt, Homo sapiens
aggcaagacuuuuagguuugu

SEQ ID NO: 193426 - RNA, 22 nt, Homo sapiens
aggcaugaguucagaggguaug

SEQ ID NO: 193427 - RNA, 20 nt, Homo sapiens
aguauucacuuuuuucaugg

SEQ ID NO: 193428 - RNA, 22 nt, Homo sapiens
aguuggcacugagcugugauug

SEQ ID NO: 193429 - RNA, 22 nt, Homo sapiens
auaaucaugucugaaaccuuug

SEQ ID NO: 193430 - RNA, 22 nt, Homo sapiens
auacagcuaaaauauuaaguua

SEQ ID NO: 193431 - RNA, 22 nt, Homo sapiens
auauuguacugcuacugguucu

SEQ ID NO: 193432 - RNA, 22 nt, Homo sapiens
augagagcuaacuguggguaca

SEQ ID NO: 193433 - RNA, 22 nt, Homo sapiens
augaggcacugcgcccuacuga

SEQ ID NO: 193434 - RNA, 22 nt, Homo sapiens
augcaagacaccacgugagaau

SEQ ID NO: 193435 - RNA, 22 nt, Homo sapiens
auggaaggagaggaaugaauga

SEQ ID NO: 193436 - RNA, 22 nt, Homo sapiens
auuaucacaguuuugcauaugg

SEQ ID NO: 193437 - RNA, 22 nt, Homo sapiens
auugaacuuaaaagacuugcca

SEQ ID NO: 193438 - RNA, 22 nt, Homo sapiens
auugcaaagcguagacucuaaa

SEQ ID NO: 193439 - RNA, 22 nt, Homo sapiens
caaguguuggcuuguauacaaa

SEQ ID NO: 193440 - RNA, 22 nt, Homo sapiens
caaugcauuauucucccacuuc

SEQ ID NO: 193441 - RNA, 22 nt, Homo sapiens
cacaguugccuaucuccugaag

SEQ ID NO: 193442 - RNA, 22 nt, Homo sapiens
cagugcauagaugugccacauu

SEQ ID NO: 193443 - RNA, 22 nt, Homo sapiens
cagugcauccauguucagcagu

SEQ ID NO: 193444 - RNA, 22 nt, Homo sapiens
cagugcaugacuguauauuauc

SEQ ID NO: 193445 - RNA, 22 nt, Homo sapiens
caucacagcaaguagggagugg

SEQ ID NO: 193446 - RNA, 22 nt, Homo sapiens
caugauauugcagaauguuggu

SEQ ID NO: 193447 - RNA, 22 nt, Homo sapiens
ccacaguggauuaaaguuacug

SEQ ID NO: 193448 - RNA, 22 nt, Homo sapiens
ccagaguggagccuuugcgagg

SEQ ID NO: 193449 - RNA, 21 nt, Homo sapiens
cucauauugcuuuuccauggu

SEQ ID NO: 193450 - RNA, 22 nt, Homo sapiens
cuggacaaaucuggaaagaacc

SEQ ID NO: 193451 - RNA, 22 nt, Homo sapiens
cuggcaccauuuugaucaaagg

SEQ ID NO: 193452 - RNA, 22 nt, Homo sapiens
cuggcacccuugcuuaggaaga

SEQ ID NO: 193453 - RNA, 22 nt, Homo sapiens
cugugcauguuguccaauucuu

SEQ ID NO: 193454 - RNA, 22 nt, Homo sapiens
cuuagguaggugccagguuuuu

SEQ ID NO: 193455 - RNA, 22 nt, Homo sapiens
cuuccaaguggggcacgugcca

SEQ ID NO: 193456 - RNA, 22 nt, Homo sapiens
cuuuugugauucuucaguugcu

SEQ ID NO: 193457 - RNA, 19 nt, Homo sapiens
gaaguguuuguucuccaug

SEQ ID NO: 193458 - RNA, 22 nt, Homo sapiens
gacacagugaagucucuacuug

SEQ ID NO: 193459 - RNA, 22 nt, Homo sapiens
gacagugugauacuuagucuca

SEQ ID NO: 193460 - RNA, 18 nt, Homo sapiens
gacaguguggcaauuccu

SEQ ID NO: 193461 - RNA, 18 nt, Homo sapiens
gacaguguggcgauuccu

SEQ ID NO: 193462 - RNA, 18 nt, Homo sapiens
gacaguguggugauuccu

SEQ ID NO: 193463 - RNA, 22 nt, Homo sapiens
gacaucauuaugagauuuaaac

SEQ ID NO: 193464 - RNA, 22 nt, Homo sapiens
gagagugaaguuugcuaccugu

SEQ ID NO: 193465 - RNA, 22 nt, Homo sapiens
gagauguaagaauuuauuuguu

SEQ ID NO: 193466 - RNA, 22 nt, Homo sapiens
gagcuguugguuugaaagaauu

SEQ ID NO: 193467 - RNA, 22 nt, Homo sapiens
gagcuguuuuucacuagaccaa

SEQ ID NO: 193468 - RNA, 19 nt, Homo sapiens
gauagacaucacagugcca

SEQ ID NO: 193469 - RNA, 22 nt, Homo sapiens
gauagcagccauucuuuuuauu

SEQ ID NO: 193470 - RNA, 22 nt, Homo sapiens
gaugaggcuagagacaugugua

SEQ ID NO: 193471 - RNA, 20 nt, Homo sapiens
gcagcaccauauuucuaaga

SEQ ID NO: 193472 - RNA, 22 nt, Homo sapiens
gcaguguggguagagggcaaga

SEQ ID NO: 193473 - RNA, 22 nt, Homo sapiens
gcauauuuuaaaguguaaccug

SEQ ID NO: 193474 - RNA, 22 nt, Homo sapiens
gcuggcaaaugguuauaaggcc

SEQ ID NO: 193475 - RNA, 18 nt, Homo sapiens
gcuguugucagagcacau

SEQ ID NO: 193476 - RNA, 22 nt, Homo sapiens
gcuguuugccgccaucgcagac

SEQ ID NO: 193477 - RNA, 21 nt, Homo sapiens
ggcaagagaauacaacauaaa

SEQ ID NO: 193478 - RNA, 19 nt, Homo sapiens
ggcaagaguuguucugugu

SEQ ID NO: 193479 - RNA, 22 nt, Homo sapiens
gggcaagaagucuuguaguuuu

SEQ ID NO: 193480 - RNA, 22 nt, Homo sapiens
guaauacuuuugggauauuaga

SEQ ID NO: 193481 - RNA, 22 nt, Homo sapiens
guauacuucugaaaauagcuau

SEQ ID NO: 193482 - RNA, 22 nt, Homo sapiens
guauggcaugcaugagaauuuc

SEQ ID NO: 193483 - RNA, 22 nt, Homo sapiens
gugaaaugaaucuggaaauauu

SEQ ID NO: 193484 - RNA, 17 nt, Homo sapiens
gugagguggguaguauc

SEQ ID NO: 193485 - RNA, 22 nt, Homo sapiens
gugcaaaucucugaguaucuuu

SEQ ID NO: 193486 - RNA, 22 nt, Homo sapiens
gugcagaugucuuuauaguagc

SEQ ID NO: 193487 - RNA, 22 nt, Homo sapiens
uaaacugcuugaaaugguguca

SEQ ID NO: 193488 - RNA, 22 nt, Homo sapiens
uacagguauagauguguguucu

SEQ ID NO: 193489 - RNA, 22 nt, Homo sapiens
uacaguguuuugguauuccaca

SEQ ID NO: 193490 - RNA, 17 nt, Homo sapiens
uagcacagugccuggua

SEQ ID NO: 193491 - RNA, 22 nt, Homo sapiens
uagcacaguucacccucgauuu

SEQ ID NO: 193492 - RNA, 22 nt, Homo sapiens
uagcacaugucagguaauuugc

SEQ ID NO: 193493 - RNA, 22 nt, Homo sapiens
uaggcacugagaauaugaggau

SEQ ID NO: 193494 - RNA, 22 nt, Homo sapiens
uauaugauugguagacccugca

SEQ ID NO: 193495 - RNA, 22 nt, Homo sapiens
uauggcaaugcauaggaaggaa

SEQ ID NO: 193496 - RNA, 22 nt, Homo sapiens
uauguuaucaaaaagcuaagga

SEQ ID NO: 193497 - RNA, 22 nt, Homo sapiens
uauuacacuuuagugucuucca

SEQ ID NO: 193498 - RNA, 20 nt, Homo sapiens
uauuacagaguaauggugga

SEQ ID NO: 193499 - RNA, 22 nt, Homo sapiens
uauuagguuggggcaaaaguaa

SEQ ID NO: 193500 - RNA, 22 nt, Homo sapiens
uauuagguuggugcaaaaguaa

SEQ ID NO: 193501 - RNA, 22 nt, Homo sapiens
uauuagguuggugcaaaaguua

SEQ ID NO: 193502 - RNA, 22 nt, Homo sapiens
uauugcagaaugugaguuggca

SEQ ID NO: 193503 - RNA, 22 nt, Homo sapiens
ucaacagugauggaaaguuaua

SEQ ID NO: 193504 - RNA, 22 nt, Homo sapiens
ucacaguguuaaaccuuucuuu

SEQ ID NO: 193505 - RNA, 22 nt, Homo sapiens
uccacaauggagaagaguauga

SEQ ID NO: 193506 - RNA, 22 nt, Homo sapiens
ugaaggcaggagggagaaaagu

SEQ ID NO: 193507 - RNA, 22 nt, Homo sapiens
ugaauagacacuaaagacugua

SEQ ID NO: 193508 - RNA, 22 nt, Homo sapiens
ugacaagagaccccuccgcagg

SEQ ID NO: 193509 - RNA, 22 nt, Homo sapiens
ugacaagaguagagagggugcc

SEQ ID NO: 193510 - RNA, 22 nt, Homo sapiens
ugagacggagucucacucuguu

SEQ ID NO: 193511 - RNA, 22 nt, Homo sapiens
ugagacggagucucgcucucua

SEQ ID NO: 193512 - RNA, 22 nt, Homo sapiens
ugagacggagucucgcucuguc

SEQ ID NO: 193513 - RNA, 22 nt, Homo sapiens
ugagacggaguuucgcucuugu

SEQ ID NO: 193514 - RNA, 22 nt, Homo sapiens
ugagcaagaucuuuauaauuag

SEQ ID NO: 193515 - RNA, 22 nt, Homo sapiens
ugagcagaaagcugcaaggucg

SEQ ID NO: 193516 - RNA, 22 nt, Homo sapiens
ugagcagaaguuuugauuggcg

SEQ ID NO: 193517 - RNA, 22 nt, Homo sapiens
ugagcagagaagugcccugcgc

SEQ ID NO: 193518 - RNA, 22 nt, Homo sapiens
ugagugaggcugggcagucccu

SEQ ID NO: 193519 - RNA, 22 nt, Homo sapiens
ugagugagguucuacucuguga

SEQ ID NO: 193520 - RNA, 22 nt, Homo sapiens
ugaguggagacuguguguagag

SEQ ID NO: 193521 - RNA, 22 nt, Homo sapiens
ugcaauauccucuacuauaggu

SEQ ID NO: 193522 - RNA, 20 nt, Homo sapiens
ugccaagaaaugaggguauu

SEQ ID NO: 193523 - RNA, 22 nt, Homo sapiens
uggaagguaaguuuugagcauu

SEQ ID NO: 193524 - RNA, 22 nt, Homo sapiens
uggacacugguggauauggaau

SEQ ID NO: 193525 - RNA, 20 nt, Homo sapiens
uggauugugaugggauuugc

SEQ ID NO: 193526 - RNA, 22 nt, Homo sapiens
uggcaacaucuggggacauguu

SEQ ID NO: 193527 - RNA, 21 nt, Homo sapiens
uggcaacauggauggauucug

SEQ ID NO: 193528 - RNA, 22 nt, Homo sapiens
uggcaacuugcaaccucauucu

SEQ ID NO: 193529 - RNA, 22 nt, Homo sapiens
uggcaagaaccacaguuacuuu

SEQ ID NO: 193530 - RNA, 22 nt, Homo sapiens
uggcaagaacgaaauguagggu

SEQ ID NO: 193531 - RNA, 22 nt, Homo sapiens
uggcaagaacugcaauugcuuu

SEQ ID NO: 193532 - RNA, 22 nt, Homo sapiens
uggcaagaagagcaugagacca

SEQ ID NO: 193533 - RNA, 22 nt, Homo sapiens
uggcaagagcugcauucaucug

SEQ ID NO: 193534 - RNA, 22 nt, Homo sapiens
uggcaagagggaugcaagguuu

SEQ ID NO: 193535 - RNA, 22 nt, Homo sapiens
uggcaaguuucaauccgaggga

SEQ ID NO: 193536 - RNA, 20 nt, Homo sapiens
uggcaccugacagauagcca

SEQ ID NO: 193537 - RNA, 22 nt, Homo sapiens
uggcaccugacuccgagaugca

SEQ ID NO: 193538 - RNA, 20 nt, Homo sapiens
acaguauguuuggaugcaua

SEQ ID NO: 193539 - RNA, 22 nt, Homo sapiens
acagugcugucugcuuuggcua

SEQ ID NO: 193540 - RNA, 22 nt, Homo sapiens
acaguguuacuugauaguguau

SEQ ID NO: 193541 - RNA, 22 nt, Homo sapiens
acauggcuuaugaauuuggaga

SEQ ID NO: 193542 - RNA, 21 nt, Homo sapiens
agagaacugaaacaugugacu

SEQ ID NO: 193543 - RNA, 22 nt, Homo sapiens
agagcaaugggugaauauuaaa

SEQ ID NO: 193544 - RNA, 22 nt, Homo sapiens
agcacagugguuaaguuucuua

SEQ ID NO: 193545 - RNA, 22 nt, Homo sapiens
agcagugugaaaugauuuaagg

SEQ ID NO: 193546 - RNA, 22 nt, Homo sapiens
aggaagguaaacuaacuugccu

SEQ ID NO: 193547 - RNA, 21 nt, Homo sapiens
aggcaagauuacuuacgagca

SEQ ID NO: 193548 - RNA, 22 nt, Homo sapiens
aggugcugagcagagaauccug

SEQ ID NO: 193549 - RNA, 22 nt, Homo sapiens
auacaaguuauuugaacugcgg

SEQ ID NO: 193550 - RNA, 22 nt, Homo sapiens
auacaguaaugucuuaggcugu

SEQ ID NO: 193551 - RNA, 20 nt, Homo sapiens
aucagagacuaggauugcca

SEQ ID NO: 193552 - RNA, 23 nt, Homo sapiens
aucagguuguagaauguguuugc

SEQ ID NO: 193553 - RNA, 22 nt, Homo sapiens
auccacagugucaauguuguga

SEQ ID NO: 193554 - RNA, 22 nt, Homo sapiens
augaaaagcauaaacgcugaag

SEQ ID NO: 193555 - RNA, 22 nt, Homo sapiens
augaauagaguuaauugaguac

SEQ ID NO: 193556 - RNA, 22 nt, Homo sapiens
augacuggauaauggacacaca

SEQ ID NO: 193557 - RNA, 23 nt, Homo sapiens
ucacaguggcugcuuaauuguga

SEQ ID NO: 193558 - RNA, 17 nt, Homo sapiens
ucacaguguuaggauga

SEQ ID NO: 193559 - RNA, 22 nt, Homo sapiens
ucacauggcagagaagaagcuc

SEQ ID NO: 193560 - RNA, 22 nt, Homo sapiens
ucacuauugacaacagugugga

SEQ ID NO: 193561 - RNA, 22 nt, Homo sapiens
ucagaucaugcuuaugauggga

SEQ ID NO: 193562 - RNA, 22 nt, Homo sapiens
ucauggggugcuuugcuagauu

SEQ ID NO: 193563 - RNA, 22 nt, Homo sapiens
uccacagugguggaauuguuca

SEQ ID NO: 193564 - RNA, 22 nt, Homo sapiens
uccacagugguugaacuaguuu

SEQ ID NO: 193565 - RNA, 22 nt, Homo sapiens
ucuggcaagagccgagggcagu

SEQ ID NO: 193566 - RNA, 22 nt, Homo sapiens
ucuuagguaagaaauuuuaaca

SEQ ID NO: 193567 - RNA, 18 nt, Homo sapiens
ugacaucauuuagaaagg

SEQ ID NO: 193568 - RNA, 22 nt, Homo sapiens
ugacuugaaacgugaacagauc

SEQ ID NO: 193569 - RNA, 22 nt, Homo sapiens
ugagacggagucucgcucuguu

SEQ ID NO: 193570 - RNA, 22 nt, Homo sapiens
ugagacggagucuugcucuguc

SEQ ID NO: 193571 - RNA, 22 nt, Homo sapiens
ugagacggaguuucacucuugu

SEQ ID NO: 193572 - RNA, 22 nt, Homo sapiens
ugagacggaguuuugcucuugu

SEQ ID NO: 193573 - RNA, 22 nt, Homo sapiens
ugagagaugaacuauucuugaa

SEQ ID NO: 193574 - RNA, 22 nt, Homo sapiens
ugagaggugauaaagcaagggu

SEQ ID NO: 193575 - RNA, 21 nt, Homo sapiens
ugagauuauauuaacauggua

SEQ ID NO: 193576 - RNA, 22 nt, Homo sapiens
ugagauuaucguaauguaucuc

SEQ ID NO: 193577 - RNA, 22 nt, Homo sapiens
ugagcagagaucacggcauugu

SEQ ID NO: 193578 - RNA, 22 nt, Homo sapiens
ugagcagaguuguuucuccuga

SEQ ID NO: 193579 - RNA, 17 nt, Homo sapiens
ugaggcacuaguaucac

SEQ ID NO: 193580 - RNA, 22 nt, Homo sapiens
aaagagaucuaugggcacuaug

SEQ ID NO: 193581 - RNA, 22 nt, Homo sapiens
aaagcugucaaggcaggaggcu

SEQ ID NO: 193582 - RNA, 22 nt, Homo sapiens
aaaggauucuaauggaaaugcu

SEQ ID NO: 193583 - RNA, 22 nt, Homo sapiens
aaagugguuuuucagacuuuga

SEQ ID NO: 193584 - RNA, 22 nt, Homo sapiens
aaaugcacagaaaggaugugga

SEQ ID NO: 193585 - RNA, 20 nt, Homo sapiens
aagcagacauuuggaugaaa

SEQ ID NO: 193586 - RNA, 22 nt, Homo sapiens
aagcaucacuggaggcagccau

SEQ ID NO: 193587 - RNA, 22 nt, Homo sapiens
aaggagcuuaagugacuuguac

SEQ ID NO: 193588 - RNA, 22 nt, Homo sapiens
aagguauuuuugucuauaucuu

SEQ ID NO: 193589 - RNA, 22 nt, Homo sapiens
aaguguaugaaacaguccaugg

SEQ ID NO: 193590 - RNA, 22 nt, Homo sapiens
aauccaugugcuuuaccauuuu

SEQ ID NO: 193591 - RNA, 22 nt, Homo sapiens
acaguaugcuuuaaacuuuguu

SEQ ID NO: 193592 - RNA, 23 nt, Homo sapiens
acaguggugugaucuuggcucag

SEQ ID NO: 193593 - RNA, 19 nt, Homo sapiens
agaguauuguuacuucucu

SEQ ID NO: 193594 - RNA, 22 nt, Homo sapiens
agauggauuuuguagccccagc

SEQ ID NO: 193595 - RNA, 22 nt, Homo sapiens
agcagugugaaaauggacuaau

SEQ ID NO: 193596 - RNA, 22 nt, Homo sapiens
agcagugugagaauggacuaau

SEQ ID NO: 193597 - RNA, 22 nt, Homo sapiens
agccaguuuggcuaauuuuggc

SEQ ID NO: 193598 - RNA, 22 nt, Homo sapiens
agcugccagucuuguaaggccu

SEQ ID NO: 193599 - RNA, 16 nt, Homo sapiens
aggcaagaauugaggu

SEQ ID NO: 193600 - RNA, 20 nt, Homo sapiens
agguuauuauaauuagaaga

SEQ ID NO: 193601 - RNA, 22 nt, Homo sapiens
agguuguguuugugauuagaua

SEQ ID NO: 193602 - RNA, 22 nt, Homo sapiens
aguauguuuugaaaccaagaag

SEQ ID NO: 193603 - RNA, 22 nt, Homo sapiens
agugacaugggaucaaaucuga

SEQ ID NO: 193604 - RNA, 22 nt, Homo sapiens
auaacauggaguuugucauuua

SEQ ID NO: 193605 - RNA, 22 nt, Homo sapiens
auacaaggaaugaagagauuug

SEQ ID NO: 193606 - RNA, 22 nt, Homo sapiens
auauuacagagaggaccuggga

SEQ ID NO: 193607 - RNA, 22 nt, Homo sapiens
auauugguuaaauauuauguga

SEQ ID NO: 193608 - RNA, 22 nt, Homo sapiens
aucacagugaaaacagucaauu

SEQ ID NO: 193609 - RNA, 22 nt, Homo sapiens
aucacagugagcauaugucuau

SEQ ID NO: 193610 - RNA, 21 nt, Homo sapiens
aucagagacccaggcuuccuc

SEQ ID NO: 193611 - RNA, 22 nt, Homo sapiens
auccacaugcaguuggaaacag

SEQ ID NO: 193612 - RNA, 23 nt, Homo sapiens
augaaagcccuugcaaaugcugg

SEQ ID NO: 193613 - RNA, 22 nt, Homo sapiens
augaggugaguaaauaaaugaa

SEQ ID NO: 193614 - RNA, 22 nt, Homo sapiens
auucacagggggagaaggguau

SEQ ID NO: 193615 - RNA, 22 nt, Homo sapiens
auuggcaaucgucuccauuuuu

SEQ ID NO: 193616 - RNA, 22 nt, Homo sapiens
auuggcaauguacauaucuugc

SEQ ID NO: 193617 - RNA, 19 nt, Homo sapiens
caaaguguucuucuuugcc

SEQ ID NO: 193618 - RNA, 22 nt, Homo sapiens
uugggcaauaggaagcaggugg

SEQ ID NO: 193619 - RNA, 21 nt, Homo sapiens
uuguaugguugaacuugauac

SEQ ID NO: 193620 - RNA, 22 nt, Homo sapiens
uuguauguuucugugcacauga

SEQ ID NO: 193621 - RNA, 22 nt, Homo sapiens
uugucccauggggucuuccuuu

SEQ ID NO: 193622 - RNA, 22 nt, Homo sapiens
uugucucacuggaguuuaguaa

SEQ ID NO: 193623 - RNA, 22 nt, Homo sapiens
uugugauugagugauccuuguu

SEQ ID NO: 193624 - RNA, 22 nt, Homo sapiens
uuucaacaggucuggggugguc

SEQ ID NO: 193625 - RNA, 22 nt, Homo sapiens
uuucauagccuucuaaugaguu

SEQ ID NO: 193626 - RNA, 19 nt, Homo sapiens
uuucauguuuuuggugaga

SEQ ID NO: 193627 - RNA, 22 nt, Homo sapiens
uuuccacauggacuuaccuucg

SEQ ID NO: 193628 - RNA, 22 nt, Homo sapiens
uuuccaguuguucuagaaagcu

SEQ ID NO: 193629 - RNA, 22 nt, Homo sapiens
uuucccuuugcuuugucagcca

SEQ ID NO: 193630 - RNA, 22 nt, Homo sapiens
uuucugagaccaaaacuuguaa

SEQ ID NO: 193631 - RNA, 22 nt, Homo sapiens
uuucugggggugcugauggaaa

SEQ ID NO: 193632 - RNA, 22 nt, Homo sapiens
uuugagcaagaggugacauuau

SEQ ID NO: 193633 - RNA, 22 nt, Homo sapiens
uuugagcaggcuaaucaauaua

SEQ ID NO: 193634 - RNA, 22 nt, Homo sapiens
uuugagcaugcagauugccagg

SEQ ID NO: 193635 - RNA, 22 nt, Homo sapiens
uuugagcauggaaauggcauga

SEQ ID NO: 193636 - RNA, 22 nt, Homo sapiens
uuugagcauguaguuuaacccu

SEQ ID NO: 193637 - RNA, 22 nt, Homo sapiens
uuugaugcaucucuacuuuguu

SEQ ID NO: 193638 - RNA, 23 nt, Homo sapiens
uuugccacuuauuagcugggagg

SEQ ID NO: 193639 - RNA, 22 nt, Homo sapiens
uuugggccaugguuuguguaua

SEQ ID NO: 193640 - RNA, 22 nt, Homo sapiens
uuuguagcucacucugagcuga

SEQ ID NO: 193641 - RNA, 22 nt, Homo sapiens
ugugguuuuaguaaaacuaugu

SEQ ID NO: 193642 - RNA, 22 nt, Homo sapiens
uguuuuguuagcacucugggaa

SEQ ID NO: 193643 - RNA, 22 nt, Homo sapiens
uuaaaagcuaucuccaagguca

SEQ ID NO: 193644 - RNA, 22 nt, Homo sapiens
uuaaaugcuagaauuuucuuug

SEQ ID NO: 193645 - RNA, 22 nt, Homo sapiens
uuaacagugaccccugguggcc

SEQ ID NO: 193646 - RNA, 22 nt, Homo sapiens
uuaacaguuaauucuuuggcaa

SEQ ID NO: 193647 - RNA, 22 nt, Homo sapiens
uuaacaguugcaugagacugag

SEQ ID NO: 193648 - RNA, 23 nt, Homo sapiens
uuaagcaacggcugcuuuucaga

SEQ ID NO: 193649 - RNA, 22 nt, Homo sapiens
uuaaggguuuuagaauuuucca

SEQ ID NO: 193650 - RNA, 22 nt, Homo sapiens
uuaaugugaaucaggaugcauu

SEQ ID NO: 193651 - RNA, 19 nt, Homo sapiens
uuacacaaccuaguggggc

SEQ ID NO: 193652 - RNA, 22 nt, Homo sapiens
uuacagauggauggcagcuggc

SEQ ID NO: 193653 - RNA, 22 nt, Homo sapiens
uuacagcugcuccccaucacuc

SEQ ID NO: 193654 - RNA, 22 nt, Homo sapiens
uuacaguguuuguucuguuacu

SEQ ID NO: 193655 - RNA, 22 nt, Homo sapiens
uuacaguucugguggagaggua

SEQ ID NO: 193656 - RNA, 22 nt, Homo sapiens
uuacuguauagaaucaucuuga

SEQ ID NO: 193657 - RNA, 22 nt, Homo sapiens
uuauagacacguuguaacaaac

SEQ ID NO: 193658 - RNA, 22 nt, Homo sapiens
uuaucucagugaacugagugga

SEQ ID NO: 193659 - RNA, 22 nt, Homo sapiens
uuauggccauucuuguaggagu

SEQ ID NO: 193660 - RNA, 22 nt, Homo sapiens
uuaugucuuuuguguucagcua

SEQ ID NO: 193661 - RNA, 22 nt, Homo sapiens
uuauucauuaacagggaccaaa

SEQ ID NO: 193662 - RNA, 22 nt, Homo sapiens
uucaaaguuggaggacaaacug

SEQ ID NO: 193663 - RNA, 22 nt, Homo sapiens
uucaaguaguucucaugccuca

SEQ ID NO: 193664 - RNA, 20 nt, Homo sapiens
uucacugggcucucuguugg

SEQ ID NO: 193665 - RNA, 22 nt, Homo sapiens
uucaggguggagaguaugaggu

SEQ ID NO: 193666 - RNA, 22 nt, Homo sapiens
uuccacagggauuugcauugau

SEQ ID NO: 193667 - RNA, 22 nt, Homo sapiens
uuccagcugggggcaacucugc

SEQ ID NO: 193668 - RNA, 22 nt, Homo sapiens
uuccaggugggcgugggccugg

SEQ ID NO: 193669 - RNA, 22 nt, Homo sapiens
uuccauguaguugagcaguuuu

SEQ ID NO: 193670 - RNA, 22 nt, Homo sapiens
uucccaguggaacauguaguca

SEQ ID NO: 193671 - RNA, 22 nt, Homo sapiens
uucccugaaguguuacucuaga

SEQ ID NO: 193672 - RNA, 22 nt, Homo sapiens
uucccugagcaucuguugagcc

SEQ ID NO: 193673 - RNA, 22 nt, Homo sapiens
uuccugagccuuguaucuagua

SEQ ID NO: 193674 - RNA, 22 nt, Homo sapiens
uuccuucaugcuugaaggguau

SEQ ID NO: 193675 - RNA, 20 nt, Homo sapiens
uucuacagucacaggaagau

SEQ ID NO: 193676 - RNA, 23 nt, Homo sapiens
uucuaucaggcccaggagcccug

SEQ ID NO: 193677 - RNA, 17 nt, Homo sapiens
uucucaguucugaucuc

SEQ ID NO: 193678 - RNA, 22 nt, Homo sapiens
uucugguuaauacuugcaaaaa

SEQ ID NO: 193679 - RNA, 22 nt, Homo sapiens
uucuucaggccacaaaaauggu

SEQ ID NO: 193680 - RNA, 18 nt, Homo sapiens
uucuuguguugauauuuu

SEQ ID NO: 193681 - RNA, 22 nt, Homo sapiens
uugaaauguguaagcuccgaaa

SEQ ID NO: 193682 - RNA, 22 nt, Homo sapiens
uugaagacuaaguuaucaggau

SEQ ID NO: 193683 - RNA, 22 nt, Homo sapiens
uugaaggaacgcuguucccuug

SEQ ID NO: 193684 - RNA, 22 nt, Homo sapiens
uugagaaucuuucgaauguucu

SEQ ID NO: 193685 - RNA, 22 nt, Homo sapiens
uugagauaggaacucacuaugc

SEQ ID NO: 193686 - RNA, 22 nt, Homo sapiens
uugagcacaguagguuguggcu

SEQ ID NO: 193687 - RNA, 22 nt, Homo sapiens
uugagcauugguauagguuuua

SEQ ID NO: 193688 - RNA, 22 nt, Homo sapiens
uugagggagccuguuagucccg

SEQ ID NO: 193689 - RNA, 21 nt, Homo sapiens
uugagguaaaauccuauggga

SEQ ID NO: 193690 - RNA, 22 nt, Homo sapiens
uugauguguuuccaggauuugu

SEQ ID NO: 193691 - RNA, 22 nt, Homo sapiens
uugcaaugugaugugauuugga

SEQ ID NO: 193692 - RNA, 22 nt, Homo sapiens
uugcacauguugaaccagcaaa

SEQ ID NO: 193693 - RNA, 22 nt, Homo sapiens
uugcaugucauaacugauggaa

SEQ ID NO: 193694 - RNA, 22 nt, Homo sapiens
uugcauugacacaugaagcuca

SEQ ID NO: 193695 - RNA, 23 nt, Homo sapiens
uugcauugcccuccauaguacuc

SEQ ID NO: 193696 - RNA, 22 nt, Homo sapiens
uugccacuucucuugccccauu

SEQ ID NO: 193697 - RNA, 22 nt, Homo sapiens
uugcugguuuucauaugagcag

SEQ ID NO: 193698 - RNA, 22 nt, Homo sapiens
uuggauggucuuuauauaguau

SEQ ID NO: 193699 - RNA, 22 nt, Homo sapiens
uuggcauuuuuagucaugggaa

SEQ ID NO: 193700 - RNA, 23 nt, Homo sapiens
uuggccuccuugugucuagggcu

SEQ ID NO: 193701 - RNA, 22 nt, Homo sapiens
uugggacccuguccuguaacaa

SEQ ID NO: 193702 - RNA, 22 nt, Homo sapiens
uugguaguaaucccucacaaaa

SEQ ID NO: 193703 - RNA, 23 nt, Homo sapiens
uuguacacuaagaaucgcagaug

SEQ ID NO: 193704 - RNA, 22 nt, Homo sapiens
uuguaguguuuauucugucaac

SEQ ID NO: 193705 - RNA, 22 nt, Homo sapiens
uugugaauggugccacaauaaa

SEQ ID NO: 193706 - RNA, 22 nt, Homo sapiens
uugugguuuuagcacuguggau

SEQ ID NO: 193707 - RNA, 22 nt, Homo sapiens
uugugguuuuuaaaacuaggug

SEQ ID NO: 193708 - RNA, 22 nt, Homo sapiens
uuuaaagcuccaagcaugucug

SEQ ID NO: 193709 - RNA, 22 nt, Homo sapiens
uuuaaugcgucucugaguuuug

SEQ ID NO: 193710 - RNA, 22 nt, Homo sapiens
uuuagggcagggacaguucuuc

SEQ ID NO: 193711 - RNA, 22 nt, Homo sapiens
uuuagguauuugguauagcagu

SEQ ID NO: 193712 - RNA, 22 nt, Homo sapiens
uuucacguuggggaguugagug

SEQ ID NO: 193713 - RNA, 22 nt, Homo sapiens
uuucaguguggcaggcauagcu

SEQ ID NO: 193714 - RNA, 22 nt, Homo sapiens
uuuccagguggccaacauuuua

SEQ ID NO: 193715 - RNA, 19 nt, Homo sapiens
uuuccaguaaucuuaugug

SEQ ID NO: 193716 - RNA, 22 nt, Homo sapiens
uuuccauguuggugaaaugagg

SEQ ID NO: 193717 - RNA, 22 nt, Homo sapiens
uuucgguuaucuagcuuuauga

SEQ ID NO: 193718 - RNA, 22 nt, Homo sapiens
uuucuacagggcuugccaggua

SEQ ID NO: 193719 - RNA, 22 nt, Homo sapiens
uuugaagugugaugccuugaug

SEQ ID NO: 193720 - RNA, 20 nt, Homo sapiens
uuugaauguaaagcauguca

SEQ ID NO: 193721 - RNA, 22 nt, Homo sapiens
uuugacaaugugugcuuguauu

SEQ ID NO: 193722 - RNA, 22 nt, Homo sapiens
uuugauguugagacuauaaagc

SEQ ID NO: 193723 - RNA, 22 nt, Homo sapiens
uuugauguugauacuaccuuca

SEQ ID NO: 193724 - RNA, 22 nt, Homo sapiens
uuugcagugucagcuucugugu

SEQ ID NO: 193725 - RNA, 22 nt, Homo sapiens
uuugcuucacuguuuggcaaaa

SEQ ID NO: 193726 - RNA, 20 nt, Homo sapiens
uuuggcaauaggguuuuugu

SEQ ID NO: 193727 - RNA, 22 nt, Homo sapiens
uuugggaaugaguuuaucauuu

SEQ ID NO: 193728 - RNA, 22 nt, Homo sapiens
uuugggaaugguuugucuccca

SEQ ID NO: 193729 - RNA, 22 nt, Homo sapiens
uuugguguauaaaaaugcuagu

SEQ ID NO: 193730 - RNA, 22 nt, Homo sapiens
uuuguaagaugcauagauugca

SEQ ID NO: 193731 - RNA, 18 nt, Homo sapiens
uuuguacuuuuucuaaug

SEQ ID NO: 193732 - RNA, 22 nt, Homo sapiens
uuugugacucauggucuagugc

SEQ ID NO: 193733 - RNA, 23 nt, Homo sapiens
uuugugcuaauuuaugggcucuu

SEQ ID NO: 193734 - RNA, 21 nt, Homo sapiens
uuugugguuacugugugagcu

SEQ ID NO: 193735 - RNA, 20 nt, Homo sapiens
uuuuagcacuuguuauggug

SEQ ID NO: 193736 - RNA, 22 nt, Homo sapiens
uuuuagcuuuucccaggacucc

SEQ ID NO: 193737 - RNA, 22 nt, Homo sapiens
uuuucaguuuuccagguagccg

SEQ ID NO: 193738 - RNA, 19 nt, Homo sapiens
uuuuccccuuucuuaagac

SEQ ID NO: 193739 - RNA, 22 nt, Homo sapiens
uuuugguauacacaaggguccu

SEQ ID NO: 193740 - RNA, 22 nt, Homo sapiens
uuuugguauaugcaggggucuu

SEQ ID NO: 193741 - RNA, 22 nt, Homo sapiens
uuguuuuggagaugagcuaaaa

SEQ ID NO: 193742 - RNA, 22 nt, Homo sapiens
uuuagggcaggccuggugguga

SEQ ID NO: 193743 - RNA, 23 nt, Homo sapiens
uuuauacguugucauuuaucagg

SEQ ID NO: 193744 - RNA, 22 nt, Homo sapiens
uuuaugagguagagugguuuau

SEQ ID NO: 193745 - RNA, 22 nt, Homo sapiens
uuucaacuaauuuuuuggugag

SEQ ID NO: 193746 - RNA, 22 nt, Homo sapiens
uuucaagugcugucuuagcugu

SEQ ID NO: 193747 - RNA, 22 nt, Homo sapiens
uuucaucaagcacagaguagau

SEQ ID NO: 193748 - RNA, 19 nt, Homo sapiens
uuucccugcagaccuacua

SEQ ID NO: 193749 - RNA, 22 nt, Homo sapiens
uuucucaguguuucaggguagg

SEQ ID NO: 193750 - RNA, 21 nt, Homo sapiens
uuucugggggagcauggcagg

SEQ ID NO: 193751 - RNA, 22 nt, Homo sapiens
uuugaaaguaauuugguuggug

SEQ ID NO: 193752 - RNA, 22 nt, Homo sapiens
uuugacuagaguguuuuacaac

SEQ ID NO: 193753 - RNA, 22 nt, Homo sapiens
uuugagcauuagggcaaaggca

SEQ ID NO: 193754 - RNA, 22 nt, Homo sapiens
uuugauguccaccucagcccac

SEQ ID NO: 193755 - RNA, 22 nt, Homo sapiens
uuugcaugcuccuuaugagaau

SEQ ID NO: 193756 - RNA, 22 nt, Homo sapiens
uuugcuauagugaauagugcug

SEQ ID NO: 193757 - RNA, 22 nt, Homo sapiens
uuugggaaaugaaguugguaga

SEQ ID NO: 193758 - RNA, 22 nt, Homo sapiens
uuugggcuuuuaaucuagagca

SEQ ID NO: 193759 - RNA, 22 nt, Homo sapiens
uuuguacuucauugguucuacu

SEQ ID NO: 193760 - RNA, 22 nt, Homo sapiens
uuuguagcuacaaagugagaug

SEQ ID NO: 193761 - RNA, 22 nt, Homo sapiens
uuugugcuaaugcuagauuacu

SEQ ID NO: 193762 - RNA, 22 nt, Homo sapiens
uuuucaguggccauaguggaga

SEQ ID NO: 193763 - RNA, 22 nt, Homo sapiens
uuuugguaaugaacuuaggaag

SEQ ID NO: 193764 - RNA, 21 nt, Homo sapiens
uuuuugggcuuucauaguguu

SEQ ID NO: 193765 - RNA, 22 nt, Homo sapiens
gcaaaugcuacaccauuuugua

SEQ ID NO: 193766 - RNA, 22 nt, Homo sapiens
gcaagaaugagaaggauuaauu

SEQ ID NO: 193767 - RNA, 22 nt, Homo sapiens
gcaauacugacagcauuaguuu

SEQ ID NO: 193768 - RNA, 22 nt, Homo sapiens
gcaguagugugaucuuggcuca

SEQ ID NO: 193769 - RNA, 22 nt, Homo sapiens
gcauggccuuuaaaugucacag

SEQ ID NO: 193770 - RNA, 22 nt, Homo sapiens
gccucaguuguggccagggauu

SEQ ID NO: 193771 - RNA, 22 nt, Homo sapiens
gccuguagaagaguagaugacc

SEQ ID NO: 193772 - RNA, 22 nt, Homo sapiens
gcugcuguaccagaugugguua

SEQ ID NO: 193773 - RNA, 22 nt, Homo sapiens
gcugcuguggcagauuggauuc

SEQ ID NO: 193774 - RNA, 22 nt, Homo sapiens
ggacaucauuaccauggaccca

SEQ ID NO: 193775 - RNA, 22 nt, Homo sapiens
ggagaauguaauugguauuuug

SEQ ID NO: 193776 - RNA, 22 nt, Homo sapiens
ucacagacugagccaaauagag

SEQ ID NO: 193777 - RNA, 21 nt, Homo sapiens
ucacauggccagaguaggaac

SEQ ID NO: 193778 - RNA, 22 nt, Homo sapiens
ucaccgugaauuaacaacacuu

SEQ ID NO: 193779 - RNA, 22 nt, Homo sapiens
ucacucggugaugauucuuaaa

SEQ ID NO: 193780 - RNA, 22 nt, Homo sapiens
ucacugggagcauuugagccuu

SEQ ID NO: 193781 - RNA, 22 nt, Homo sapiens
ucacuuggccgcagccuucucu

SEQ ID NO: 193782 - RNA, 22 nt, Homo sapiens
ucagauugaugcauacuuaaau

SEQ ID NO: 193783 - RNA, 22 nt, Homo sapiens
ucagcaaugaccuaagcaaaua

SEQ ID NO: 193784 - RNA, 22 nt, Homo sapiens
ucagggacgcuugacacaagcc

SEQ ID NO: 193785 - RNA, 22 nt, Homo sapiens
ucaggguacuuguggccaaagu

SEQ ID NO: 193786 - RNA, 20 nt, Homo sapiens
ucauacuguggaguaccagg

SEQ ID NO: 193787 - RNA, 22 nt, Homo sapiens
ucaugguuuuauaacccucuug

SEQ ID NO: 193788 - RNA, 22 nt, Homo sapiens
uccacagugguugaacuaguaa

SEQ ID NO: 193789 - RNA, 20 nt, Homo sapiens
uccacugagcgucacggcag

SEQ ID NO: 193790 - RNA, 22 nt, Homo sapiens
uccccugagaccccucagcacu

SEQ ID NO: 193791 - RNA, 19 nt, Homo sapiens
uccccuguggauaccaaga

SEQ ID NO: 193792 - RNA, 22 nt, Homo sapiens
ucccugaaagcugagauuggaa

SEQ ID NO: 193793 - RNA, 22 nt, Homo sapiens
ucccugaagcugcagcaacaca

SEQ ID NO: 193794 - RNA, 22 nt, Homo sapiens
uccugagagcagacccucuaua

SEQ ID NO: 193795 - RNA, 22 nt, Homo sapiens
ucgcagcucacuggagccucga

SEQ ID NO: 193796 - RNA, 18 nt, Homo sapiens
ucuagacacugugucuau

SEQ ID NO: 193797 - RNA, 21 nt, Homo sapiens
ucucauagaguuucacuuucu

SEQ ID NO: 193798 - RNA, 22 nt, Homo sapiens
ucucaugaagauagagaauaga

SEQ ID NO: 193799 - RNA, 17 nt, Homo sapiens
ucucccaucccuuucuc

SEQ ID NO: 193800 - RNA, 22 nt, Homo sapiens
ucucuuggcggaaguugcagug

SEQ ID NO: 193801 - RNA, 22 nt, Homo sapiens
ucucuugguugaacaguuugga

SEQ ID NO: 193802 - RNA, 22 nt, Homo sapiens
ucugacaaugaacaaucuauag

SEQ ID NO: 193803 - RNA, 22 nt, Homo sapiens
ucugugaaaucauuuccuguaa

SEQ ID NO: 193804 - RNA, 22 nt, Homo sapiens
ucuugcuuuugcagagcuucuc

SEQ ID NO: 193805 - RNA, 22 nt, Homo sapiens
ucuuugccuaacccaaggucau

SEQ ID NO: 193806 - RNA, 22 nt, Homo sapiens
ucuuuugugagucagccucucc

SEQ ID NO: 193807 - RNA, 22 nt, Homo sapiens
ugaaaaguuguugaaggcuuca

SEQ ID NO: 193808 - RNA, 22 nt, Homo sapiens
ugaaauacuuuggcucuuuguu

SEQ ID NO: 193809 - RNA, 22 nt, Homo sapiens
ugaaaugcagaacuuuaggucu

SEQ ID NO: 193810 - RNA, 22 nt, Homo sapiens
ugaaauuuuuuauucguuggcu

SEQ ID NO: 193811 - RNA, 22 nt, Homo sapiens
ugaaggacauaaggcagaguga

SEQ ID NO: 193812 - RNA, 22 nt, Homo sapiens
ugaauacagcacacccaugggu

SEQ ID NO: 193813 - RNA, 22 nt, Homo sapiens
ugaaucaugcugcuauaaagac

SEQ ID NO: 193814 - RNA, 22 nt, Homo sapiens
ugaauguacacgcguacuuguu

SEQ ID NO: 193815 - RNA, 22 nt, Homo sapiens
ugaauguauuuauuaccauuca

SEQ ID NO: 193816 - RNA, 22 nt, Homo sapiens
ugaauguuugcuuacuuccaua

SEQ ID NO: 193817 - RNA, 16 nt, Homo sapiens
ugaauguuuguggcug

SEQ ID NO: 193818 - RNA, 22 nt, Homo sapiens
ugacagcugaagauguugaacc

SEQ ID NO: 193819 - RNA, 22 nt, Homo sapiens
ugacauguagagaacuucucau

SEQ ID NO: 193820 - RNA, 22 nt, Homo sapiens
ugacauguauuagcucagugcu

SEQ ID NO: 193821 - RNA, 22 nt, Homo sapiens
ugagaacauuccucuuccuggc

SEQ ID NO: 193822 - RNA, 22 nt, Homo sapiens
ugagaauguagggcucucccag

SEQ ID NO: 193823 - RNA, 22 nt, Homo sapiens
ugagacauacuuacaggggaug

SEQ ID NO: 193824 - RNA, 22 nt, Homo sapiens
ugagacaugugaacuguaguuc

SEQ ID NO: 193825 - RNA, 23 nt, Homo sapiens
ugagacauuggaaaguuaggcag

SEQ ID NO: 193826 - RNA, 22 nt, Homo sapiens
ugagacugauaggacauuuucu

SEQ ID NO: 193827 - RNA, 22 nt, Homo sapiens
ugagaguagggguugggauugg

SEQ ID NO: 193828 - RNA, 22 nt, Homo sapiens
ugagauaguuguagauguacau

SEQ ID NO: 193829 - RNA, 22 nt, Homo sapiens
ugagauuaaucuuuaaguaaga

SEQ ID NO: 193830 - RNA, 22 nt, Homo sapiens
ugagcagugaguguggugcagg

SEQ ID NO: 193831 - RNA, 21 nt, Homo sapiens
ugagcauuaguacaguaggga

SEQ ID NO: 193832 - RNA, 22 nt, Homo sapiens
ugagcuccuucauaaaaaggca

SEQ ID NO: 193833 - RNA, 18 nt, Homo sapiens
ugaggaaaggguuugcua

SEQ ID NO: 193834 - RNA, 22 nt, Homo sapiens
ugagguaagauguucauuuuuc

SEQ ID NO: 193835 - RNA, 22 nt, Homo sapiens
ugagguaauagauaauauuuuu

SEQ ID NO: 193836 - RNA, 23 nt, Homo sapiens
ugaguagguccacguaugugagu

SEQ ID NO: 193837 - RNA, 22 nt, Homo sapiens
ugaguaugaguucaggaaaggc

SEQ ID NO: 193838 - RNA, 22 nt, Homo sapiens
ugaguucuuuguagauucugug

SEQ ID NO: 193839 - RNA, 22 nt, Homo sapiens
ugaguucuuuuagggauauugc

SEQ ID NO: 193840 - RNA, 22 nt, Homo sapiens
ugauaauuuugucagguuuugg

SEQ ID NO: 193841 - RNA, 22 nt, Homo sapiens
ugauagucauucaauuuagcca

SEQ ID NO: 193842 - RNA, 21 nt, Homo sapiens
ugauaugguagaagagagaca

SEQ ID NO: 193843 - RNA, 20 nt, Homo sapiens
ugaugcaaaucuuuaaaagu

SEQ ID NO: 193844 - RNA, 22 nt, Homo sapiens
ugauggcauuuggaguugggac

SEQ ID NO: 193845 - RNA, 22 nt, Homo sapiens
ugaugucuugagauggagcuua

SEQ ID NO: 193846 - RNA, 22 nt, Homo sapiens
ugcaaaguccucauucuuaccc

SEQ ID NO: 193847 - RNA, 19 nt, Homo sapiens
ugcaaauucuaaaaacuga

SEQ ID NO: 193848 - RNA, 22 nt, Homo sapiens
ugcaagacacuguccugggcau

SEQ ID NO: 193849 - RNA, 22 nt, Homo sapiens
ugcaagauaggcaguuugcacu

SEQ ID NO: 193850 - RNA, 22 nt, Homo sapiens
ugcaagaugagauuuuggaugg

SEQ ID NO: 193851 - RNA, 23 nt, Homo sapiens
ugcagcuacauguggccaugugc

SEQ ID NO: 193852 - RNA, 22 nt, Homo sapiens
ugcauauguugagaugcauauu

SEQ ID NO: 193853 - RNA, 22 nt, Homo sapiens
ugcauuguuccgaauguguccu

SEQ ID NO: 193854 - RNA, 22 nt, Homo sapiens
ugcauuguuuagaaacacuggg

SEQ ID NO: 193855 - RNA, 22 nt, Homo sapiens
ugccaacugguuucuuuuaguu

SEQ ID NO: 193856 - RNA, 22 nt, Homo sapiens
ugccaaggagucagucccuaga

SEQ ID NO: 193857 - RNA, 22 nt, Homo sapiens
ugccuacucucugccaggaaug

SEQ ID NO: 193858 - RNA, 22 nt, Homo sapiens
ugccuucuguuaaacgaggaug

SEQ ID NO: 193859 - RNA, 22 nt, Homo sapiens
ugcuacccuucgucucucuggu

SEQ ID NO: 193860 - RNA, 22 nt, Homo sapiens
ugcuaugucuucucucacagag

SEQ ID NO: 193861 - RNA, 21 nt, Homo sapiens
ugcuauguuguccaggcuggc

SEQ ID NO: 193862 - RNA, 22 nt, Homo sapiens
agaagacuauucuggguugggc

SEQ ID NO: 193863 - RNA, 22 nt, Homo sapiens
agaaugauccuucucagaggca

SEQ ID NO: 193864 - RNA, 22 nt, Homo sapiens
agaauguauauucuguaguugu

SEQ ID NO: 193865 - RNA, 22 nt, Homo sapiens
agaaugugaccuuauuuggaga

SEQ ID NO: 193866 - RNA, 22 nt, Homo sapiens
agaauucugucauguuuauauu

SEQ ID NO: 193867 - RNA, 22 nt, Homo sapiens
agagcaaugggugaauauuaaa

SEQ ID NO: 193868 - RNA, 22 nt, Homo sapiens
agaucauaugcaguaaugaacu

SEQ ID NO: 193869 - RNA, 22 nt, Homo sapiens
agcaaaucuaugaauguauauu

SEQ ID NO: 193870 - RNA, 22 nt, Homo sapiens
agcaauaugacauugcuacauc

SEQ ID NO: 193871 - RNA, 22 nt, Homo sapiens
agcaccacauacuacagagaua

SEQ ID NO: 193872 - RNA, 22 nt, Homo sapiens
agcagauguuuagugagcgccu

SEQ ID NO: 193873 - RNA, 22 nt, Homo sapiens
agcagcauggguauaaaucucc

SEQ ID NO: 193874 - RNA, 22 nt, Homo sapiens
agcagcauuccaaaaaucugcu

SEQ ID NO: 193875 - RNA, 22 nt, Homo sapiens
agccuguagugagcugugauug

SEQ ID NO: 193876 - RNA, 21 nt, Homo sapiens
agcuaaauuggaaauuucugu

SEQ ID NO: 193877 - RNA, 22 nt, Homo sapiens
agcugcacaaauggaugugagg

SEQ ID NO: 193878 - RNA, 22 nt, Homo sapiens
agcugccagucuuguaaggccu

SEQ ID NO: 193879 - RNA, 22 nt, Homo sapiens
agcuggcuguagcugcaagucu

SEQ ID NO: 193880 - RNA, 20 nt, Homo sapiens
agcuggguguguuggugcau

SEQ ID NO: 193881 - RNA, 22 nt, Homo sapiens
agcugguuuauuucucacaaca

SEQ ID NO: 193882 - RNA, 22 nt, Homo sapiens
agcuguuguuuuaagauacuaa

SEQ ID NO: 193883 - RNA, 22 nt, Homo sapiens
aggcaagugauagcugcguaau

SEQ ID NO: 193884 - RNA, 22 nt, Homo sapiens
aggcaaguugcucaaaugcaaa

SEQ ID NO: 193885 - RNA, 22 nt, Homo sapiens
aggcaaugugagaguuuauuca

SEQ ID NO: 193886 - RNA, 22 nt, Homo sapiens
aggcagucugaguuuugaaagg

SEQ ID NO: 193887 - RNA, 22 nt, Homo sapiens
aggcaugugugcagacugucug

SEQ ID NO: 193888 - RNA, 21 nt, Homo sapiens
aggcuguuguuuugggaugga

SEQ ID NO: 193889 - RNA, 22 nt, Homo sapiens
agguaagucucuaauuaugaau

SEQ ID NO: 193890 - RNA, 22 nt, Homo sapiens
agguauguauguaugggagaaa

SEQ ID NO: 193891 - RNA, 22 nt, Homo sapiens
aggugcugagcagagaauccug

SEQ ID NO: 193892 - RNA, 22 nt, Homo sapiens
agguucccuuuuggccugggau

SEQ ID NO: 193893 - RNA, 22 nt, Homo sapiens
aguacugucugguuaccugaca

SEQ ID NO: 193894 - RNA, 20 nt, Homo sapiens
agucaguuuauuuucucucu

SEQ ID NO: 193895 - RNA, 22 nt, Homo sapiens
agugacaugggaucaaaucuga

SEQ ID NO: 193896 - RNA, 22 nt, Homo sapiens
aguggcacaauuuugacucccc

SEQ ID NO: 193897 - RNA, 23 nt, Homo sapiens
auaaacugucaaaagccagcccu

SEQ ID NO: 193898 - RNA, 22 nt, Homo sapiens
auaaagccaggagacguaauug

SEQ ID NO: 193899 - RNA, 22 nt, Homo sapiens
auaacauggaguuugucauuua

SEQ ID NO: 193900 - RNA, 22 nt, Homo sapiens
auaagugcuuguugaauaauag

SEQ ID NO: 193901 - RNA, 22 nt, Homo sapiens
auaaucaugucugaaaccuuug

SEQ ID NO: 193902 - RNA, 22 nt, Homo sapiens
auacagcuaaaauauuaaguua

SEQ ID NO: 193903 - RNA, 22 nt, Homo sapiens
auacaguugccauuucuugugc

SEQ ID NO: 193904 - RNA, 22 nt, Homo sapiens
auacuguacugaaguacccauu

SEQ ID NO: 193905 - RNA, 22 nt, Homo sapiens
auagaauguauuaguaaauuug

SEQ ID NO: 193906 - RNA, 22 nt, Homo sapiens
auauagcaaugaaagagaugaa

SEQ ID NO: 193907 - RNA, 22 nt, Homo sapiens
auaucaacaugguaggguuggu

SEQ ID NO: 193908 - RNA, 22 nt, Homo sapiens
auaucacagguguuuaccugau

SEQ ID NO: 193909 - RNA, 22 nt, Homo sapiens
aucaaaugcuggcagagugccu

SEQ ID NO: 193910 - RNA, 22 nt, Homo sapiens
aucacagaguuaaaacuuucuu

SEQ ID NO: 193911 - RNA, 22 nt, Homo sapiens
aucacauggccagguaguaauc

SEQ ID NO: 193912 - RNA, 22 nt, Homo sapiens
aucacuguaaguuuacacuuug

SEQ ID NO: 193913 - RNA, 22 nt, Homo sapiens
aucagauuccagaggcagcacc

SEQ ID NO: 193914 - RNA, 22 nt, Homo sapiens
auccauugcucaagagaaguca

SEQ ID NO: 193915 - RNA, 22 nt, Homo sapiens
aucuuguccugagguuuuauug

SEQ ID NO: 193916 - RNA, 23 nt, Homo sapiens
augaaagcccuugcaaaugcugg

SEQ ID NO: 193917 - RNA, 22 nt, Homo sapiens
augaacacuccaauuguacucc

SEQ ID NO: 193918 - RNA, 22 nt, Homo sapiens
augaaguauuaggacacauuua

SEQ ID NO: 193919 - RNA, 22 nt, Homo sapiens
augaagugcaugauaguugguu

SEQ ID NO: 193920 - RNA, 22 nt, Homo sapiens
augagaauguaaguuaaugaaa

SEQ ID NO: 193921 - RNA, 22 nt, Homo sapiens
augagacuagaagagaauaaua

SEQ ID NO: 193922 - RNA, 22 nt, Homo sapiens
augagagugagagcagccccuu

SEQ ID NO: 193923 - RNA, 19 nt, Homo sapiens
augagcaauaguuuuaauc

SEQ ID NO: 193924 - RNA, 22 nt, Homo sapiens
augagcaucaccagaaucaaua

SEQ ID NO: 193925 - RNA, 22 nt, Homo sapiens
augaggaaggagccuuugucug

SEQ ID NO: 193926 - RNA, 22 nt, Homo sapiens
augagggagggcaccugaccuu

SEQ ID NO: 193927 - RNA, 22 nt, Homo sapiens
augagguauccaagcccagaaa

SEQ ID NO: 193928 - RNA, 22 nt, Homo sapiens
augaguaguugcuaaauauuga

SEQ ID NO: 193929 - RNA, 22 nt, Homo sapiens
augauagucuugagaagcauuu

SEQ ID NO: 193930 - RNA, 22 nt, Homo sapiens
augaucauggaaguuuuccugu

SEQ ID NO: 193931 - RNA, 22 nt, Homo sapiens
augaugaaguaagugcuuagga

SEQ ID NO: 193932 - RNA, 22 nt, Homo sapiens
augaugucauuuuaauuucuaa

SEQ ID NO: 193933 - RNA, 22 nt, Homo sapiens
augauguguucuguguucccau

SEQ ID NO: 193934 - RNA, 22 nt, Homo sapiens
augcaugucaaauuuguagguu

SEQ ID NO: 193935 - RNA, 22 nt, Homo sapiens
augccaagaugagcacgcgucu

SEQ ID NO: 193936 - RNA, 22 nt, Homo sapiens
augccacuucucuaagucaugu

SEQ ID NO: 193937 - RNA, 22 nt, Homo sapiens
augcuggugcuagaaacuggaa

SEQ ID NO: 193938 - RNA, 22 nt, Homo sapiens
auggaguuuacuuaguguaaua

SEQ ID NO: 193939 - RNA, 22 nt, Homo sapiens
auggcaauguaagucagaaaaa

SEQ ID NO: 193940 - RNA, 22 nt, Homo sapiens
auggcacuguguccugggguca

SEQ ID NO: 193941 - RNA, 23 nt, Homo sapiens
auggcccuggugggagugucuuu

SEQ ID NO: 193942 - RNA, 22 nt, Homo sapiens
auggccuaugacagguauguug

SEQ ID NO: 193943 - RNA, 22 nt, Homo sapiens
auggcucuguuccaugugucuu

SEQ ID NO: 193944 - RNA, 22 nt, Homo sapiens
augguauggaaggucuggagga

SEQ ID NO: 193945 - RNA, 22 nt, Homo sapiens
auguaacaguauuuggagaugu

SEQ ID NO: 193946 - RNA, 21 nt, Homo sapiens
auguaaugaagaagccacugg

SEQ ID NO: 193947 - RNA, 22 nt, Homo sapiens
auguauacaugcaggucacagg

SEQ ID NO: 193948 - RNA, 22 nt, Homo sapiens
augucuggcagaagacuucuca

SEQ ID NO: 193949 - RNA, 17 nt, Homo sapiens
augugaauguucaaaua

SEQ ID NO: 193950 - RNA, 22 nt, Homo sapiens
auguggcacuugacuuucucgc

SEQ ID NO: 193951 - RNA, 22 nt, Homo sapiens
auguguaaagcuuuucuuuguu

SEQ ID NO: 193952 - RNA, 22 nt, Homo sapiens
auuaagagcacauguucugggu

SEQ ID NO: 193953 - RNA, 20 nt, Homo sapiens
auuagagcuacauggcuaca

SEQ ID NO: 193954 - RNA, 22 nt, Homo sapiens
auuagguuggugcaaaacuuuc

SEQ ID NO: 193955 - RNA, 22 nt, Homo sapiens
auuauauguguaugugcauacc

SEQ ID NO: 193956 - RNA, 22 nt, Homo sapiens
auucaucagggauauugguuga

SEQ ID NO: 193957 - RNA, 22 nt, Homo sapiens
auuccauuuguuaucacacccg

SEQ ID NO: 193958 - RNA, 22 nt, Homo sapiens
auucuauaguccuaggauuggg

SEQ ID NO: 193959 - RNA, 22 nt, Homo sapiens
auugagcaauuccuaugugcuu

SEQ ID NO: 193960 - RNA, 22 nt, Homo sapiens
gaucacauggccauuucuagcu

SEQ ID NO: 193961 - RNA, 22 nt, Homo sapiens
gaucacauguguacucaaugug

SEQ ID NO: 193962 - RNA, 22 nt, Homo sapiens
gauggaauuaaaaucagaauca

SEQ ID NO: 193963 - RNA, 22 nt, Homo sapiens
gauggcagugcagccccuggcu

SEQ ID NO: 193964 - RNA, 22 nt, Homo sapiens
gauuucaucuuuagaggaagga

SEQ ID NO: 193965 - RNA, 22 nt, Homo sapiens
gcaaaaaguagugcugguuagg

SEQ ID NO: 193966 - RNA, 22 nt, Homo sapiens
gcaaaauugagaagggaauaua

SEQ ID NO: 193967 - RNA, 22 nt, Homo sapiens
gcaagaaucugggaguaaaauu

SEQ ID NO: 193968 - RNA, 22 nt, Homo sapiens
gcaagagguaucuuauuuuccc

SEQ ID NO: 193969 - RNA, 22 nt, Homo sapiens
gcaagauguuaccauuagggaa

SEQ ID NO: 193970 - RNA, 22 nt, Homo sapiens
gcaauguuacugaauguguuuu

SEQ ID NO: 193971 - RNA, 22 nt, Homo sapiens
gcacaguguuacuugauauauu

SEQ ID NO: 193972 - RNA, 22 nt, Homo sapiens
gcaguagugcgaucucagcuca

SEQ ID NO: 193973 - RNA, 22 nt, Homo sapiens
gcauguaguagauguugaauaa

SEQ ID NO: 193974 - RNA, 22 nt, Homo sapiens
gcugcuguuuaguuucuccugg

SEQ ID NO: 193975 - RNA, 22 nt, Homo sapiens
gcugcuguuucucuuucagcau

SEQ ID NO: 193976 - RNA, 21 nt, Homo sapiens
gcuuuuucggaagucuuuggc

SEQ ID NO: 193977 - RNA, 22 nt, Homo sapiens
ggagaguaauuagacugaaaga

SEQ ID NO: 193978 - RNA, 22 nt, Homo sapiens
ggagggugagaucaauuuggga

SEQ ID NO: 193979 - RNA, 21 nt, Homo sapiens
ggcaagagaauacaacauaaa

SEQ ID NO: 193980 - RNA, 22 nt, Homo sapiens
ggcaaggugaugaaugucuaca

SEQ ID NO: 193981 - RNA, 22 nt, Homo sapiens
ggcaguguaauaauuuauuaau

SEQ ID NO: 193982 - RNA, 22 nt, Homo sapiens
ggcaugaaguagcccacaggca

SEQ ID NO: 193983 - RNA, 22 nt, Homo sapiens
ggcauugugauccaccagccuu

SEQ ID NO: 193984 - RNA, 22 nt, Homo sapiens
ggccagaugaucuaugaaggaa

SEQ ID NO: 193985 - RNA, 22 nt, Homo sapiens
gguauuauuugccuuuuacuga

SEQ ID NO: 193986 - RNA, 22 nt, Homo sapiens
ggucauagagaauucaccagga

SEQ ID NO: 193987 - RNA, 22 nt, Homo sapiens
guaaauaccaguuucuggaaca

SEQ ID NO: 193988 - RNA, 19 nt, Homo sapiens
guaaugugcuucaguagca

SEQ ID NO: 193989 - RNA, 22 nt, Homo sapiens
guacaguucucuuuguugucag

SEQ ID NO: 193990 - RNA, 22 nt, Homo sapiens
guaccugauacaggcgcacggu

SEQ ID NO: 193991 - RNA, 22 nt, Homo sapiens
guaucucaguucucgugauuag

SEQ ID NO: 193992 - RNA, 22 nt, Homo sapiens
gucaaugcauccaugaauggcu

SEQ ID NO: 193993 - RNA, 22 nt, Homo sapiens
gucauaugcucggaaaauguua

SEQ ID NO: 193994 - RNA, 18 nt, Homo sapiens
guccauuuguugguacac

SEQ ID NO: 193995 - RNA, 22 nt, Homo sapiens
gucuugcacuuaccuaagaacu

SEQ ID NO: 193996 - RNA, 22 nt, Homo sapiens
gugaccauuugacauauccuug

SEQ ID NO: 193997 - RNA, 22 nt, Homo sapiens
gugagaauugacacccuugucu

SEQ ID NO: 193998 - RNA, 22 nt, Homo sapiens
gugagaugguaucucauugugg

SEQ ID NO: 193999 - RNA, 22 nt, Homo sapiens
gugagcauaacaacagaguuua

SEQ ID NO: 194000 - RNA, 22 nt, Homo sapiens
gugagggaugugaaaaagguca

SEQ ID NO: 194001 - RNA, 22 nt, Homo sapiens
gugaguuauuauuuauguaaac

SEQ ID NO: 194002 - RNA, 22 nt, Homo sapiens
gugauguguuucaacagcuccu

SEQ ID NO: 194003 - RNA, 22 nt, Homo sapiens
gugccacugcacuccggccugg

SEQ ID NO: 194004 - RNA, 22 nt, Homo sapiens
guggcaaggaaaugcugcucac

SEQ ID NO: 194005 - RNA, 18 nt, Homo sapiens
gugucugguuaugggagu

SEQ ID NO: 194006 - RNA, 22 nt, Homo sapiens
gugugaacaucauagaguguau

SEQ ID NO: 194007 - RNA, 22 nt, Homo sapiens
gugugcauaugucuuuauagua

SEQ ID NO: 194008 - RNA, 22 nt, Homo sapiens
guuaugacacucuuuuuaucau

SEQ ID NO: 194009 - RNA, 22 nt, Homo sapiens
guucaaguuuucucuugugggu

SEQ ID NO: 194010 - RNA, 22 nt, Homo sapiens
guugagcaaacagcuuaacagu

SEQ ID NO: 194011 - RNA, 22 nt, Homo sapiens
guugauguugcagucuugagga

SEQ ID NO: 194012 - RNA, 22 nt, Homo sapiens
guuuaacugguacuucaagucu

SEQ ID NO: 194013 - RNA, 21 nt, Homo sapiens
uaaaacuguaacuuuguccug

SEQ ID NO: 194014 - RNA, 22 nt, Homo sapiens
uaaaagucaucacaacuggagu

SEQ ID NO: 194015 - RNA, 22 nt, Homo sapiens
uaaagcauguaauuagguuaga

SEQ ID NO: 194016 - RNA, 22 nt, Homo sapiens
uaaagccagugauuaugucucu

SEQ ID NO: 194017 - RNA, 22 nt, Homo sapiens
uaacauucacaugcugcaaaaa

SEQ ID NO: 194018 - RNA, 22 nt, Homo sapiens
uaacuacuucugcuucagagua

SEQ ID NO: 194019 - RNA, 22 nt, Homo sapiens
uaacuagaaaggagacaguugc

SEQ ID NO: 194020 - RNA, 22 nt, Homo sapiens
uaacuaguggaauuugauuuca

SEQ ID NO: 194021 - RNA, 22 nt, Homo sapiens
uaaggaguagaauaguaaggca

SEQ ID NO: 194022 - RNA, 22 nt, Homo sapiens
uaaggcacauaggccuggaaac

SEQ ID NO: 194023 - RNA, 20 nt, Homo sapiens
uaagugcuugagacuucuga

SEQ ID NO: 194024 - RNA, 18 nt, Homo sapiens
uaagugcuuuaaacacau

SEQ ID NO: 194025 - RNA, 22 nt, Homo sapiens
uaaugcaucagugguaguucuu

SEQ ID NO: 194026 - RNA, 22 nt, Homo sapiens
uacaaagcuuucugcaaaucau

SEQ ID NO: 194027 - RNA, 22 nt, Homo sapiens
uacauacuucacagacuuuaaa

SEQ ID NO: 194028 - RNA, 22 nt, Homo sapiens
uacccuguaaucugaaacauga

SEQ ID NO: 194029 - RNA, 22 nt, Homo sapiens
uacccuuauguaaucauuauac

SEQ ID NO: 194030 - RNA, 22 nt, Homo sapiens
uacugcaucuacuuagagccag

SEQ ID NO: 194031 - RNA, 22 nt, Homo sapiens
uacugcauucuccgccuccggg

SEQ ID NO: 194032 - RNA, 22 nt, Homo sapiens
uacugcauuucacuguuaaaga

SEQ ID NO: 194033 - RNA, 22 nt, Homo sapiens
uacuguacugcaguucugcaaa

SEQ ID NO: 194034 - RNA, 22 nt, Homo sapiens
uagacccauuacguaguuucca

SEQ ID NO: 194035 - RNA, 22 nt, Homo sapiens
uagaucacucaggcaauaaaag

SEQ ID NO: 194036 - RNA, 22 nt, Homo sapiens
uagcaagaugaauuugugcaaa

SEQ ID NO: 194037 - RNA, 22 nt, Homo sapiens
uagcacagugucauucuaggua

SEQ ID NO: 194038 - RNA, 22 nt, Homo sapiens
uagggcauugaacugaauucuu

SEQ ID NO: 194039 - RNA, 22 nt, Homo sapiens
uaguggauguucagagauuuga

SEQ ID NO: 194040 - RNA, 22 nt, Homo sapiens
uaguuauggaguaauuuuaagc

SEQ ID NO: 194041 - RNA, 22 nt, Homo sapiens
uaguugcauuggcugcuaugcu

SEQ ID NO: 194042 - RNA, 20 nt, Homo sapiens
uauagcaauuuuuuucuccu

SEQ ID NO: 194043 - RNA, 22 nt, Homo sapiens
uauagcacaucuguguguacau

SEQ ID NO: 194044 - RNA, 21 nt, Homo sapiens
uauagcagcacgauuuauaau

SEQ ID NO: 194045 - RNA, 22 nt, Homo sapiens
uauauguuuucauaaggcuaga

SEQ ID NO: 194046 - RNA, 22 nt, Homo sapiens
uaugagagcugguagguagaga

SEQ ID NO: 194047 - RNA, 19 nt, Homo sapiens
uaugcaacuuauagugcug

SEQ ID NO: 194048 - RNA, 22 nt, Homo sapiens
uaugcacuauagcauauguggu

SEQ ID NO: 194049 - RNA, 22 nt, Homo sapiens
uauggcaaugcauaggaaggaa

SEQ ID NO: 194050 - RNA, 22 nt, Homo sapiens
uauggcauuauuuugauagaca

SEQ ID NO: 194051 - RNA, 21 nt, Homo sapiens
uauggcuuagucaguguuucc

SEQ ID NO: 194052 - RNA, 19 nt, Homo sapiens
uauguaguuuucucaauau

SEQ ID NO: 194053 - RNA, 22 nt, Homo sapiens
uaugucauggguaaagugcccu

SEQ ID NO: 194054 - RNA, 22 nt, Homo sapiens
uauucaucuuaagcuuuggcuu

SEQ ID NO: 194055 - RNA, 22 nt, Homo sapiens
uauuccauuugggucaggauga

SEQ ID NO: 194056 - RNA, 22 nt, Homo sapiens
uauuccauuugugaaaggaagu

SEQ ID NO: 194057 - RNA, 22 nt, Homo sapiens
uauugcauauuauucuaguggc

SEQ ID NO: 194058 - RNA, 22 nt, Homo sapiens
uggcaagaaccacaauuacuuu

SEQ ID NO: 194059 - RNA, 22 nt, Homo sapiens
uggcaagaacgaaauguagggu

SEQ ID NO: 194060 - RNA, 23 nt, Homo sapiens
uggcaagaauucuuaccgugugg

SEQ ID NO: 194061 - RNA, 22 nt, Homo sapiens
uggcaagaccccaucucuacaa

SEQ ID NO: 194062 - RNA, 22 nt, Homo sapiens
uggcaagagcugcauucaucug

SEQ ID NO: 194063 - RNA, 22 nt, Homo sapiens
uggcaagagggaugcaagguuu

SEQ ID NO: 194064 - RNA, 20 nt, Homo sapiens
uggcaagauggcagaauaga

SEQ ID NO: 194065 - RNA, 22 nt, Homo sapiens
uggcaagauuguuccgguuugg

SEQ ID NO: 194066 - RNA, 18 nt, Homo sapiens
uggcaagugccauacggu

SEQ ID NO: 194067 - RNA, 22 nt, Homo sapiens
uggcaaguuucaauccgaggga

SEQ ID NO: 194068 - RNA, 22 nt, Homo sapiens
uggcaggugcacuggcuuugaa

SEQ ID NO: 194069 - RNA, 22 nt, Homo sapiens
uggcauauaaagauguguucaa

SEQ ID NO: 194070 - RNA, 22 nt, Homo sapiens
uggcauuuucucuguucuuaga

SEQ ID NO: 194071 - RNA, 22 nt, Homo sapiens
uggcauuuugugugaauuagaa

SEQ ID NO: 194072 - RNA, 23 nt, Homo sapiens
uggcauuuuuggcaaugccuucu

SEQ ID NO: 194073 - RNA, 22 nt, Homo sapiens
uggcuaagaugcacacuucacu

SEQ ID NO: 194074 - RNA, 22 nt, Homo sapiens
uggcuuuucauccugggacauu

SEQ ID NO: 194075 - RNA, 22 nt, Homo sapiens
ugggagugugcacaauuucagc

SEQ ID NO: 194076 - RNA, 23 nt, Homo sapiens
ugguaacauguuguggcagggga

SEQ ID NO: 194077 - RNA, 20 nt, Homo sapiens
ugguaauguaagagaggaga

SEQ ID NO: 194078 - RNA, 22 nt, Homo sapiens
ugguauuuaauauaugagaguu

SEQ ID NO: 194079 - RNA, 22 nt, Homo sapiens
uggucuggagagucccgcccag

SEQ ID NO: 194080 - RNA, 22 nt, Homo sapiens
uguaaaaagcccagccgcugag

SEQ ID NO: 194081 - RNA, 23 nt, Homo sapiens
uguaaaagcauuugucagccugg

SEQ ID NO: 194082 - RNA, 22 nt, Homo sapiens
uguacaaauuucugugguggug

SEQ ID NO: 194083 - RNA, 22 nt, Homo sapiens
ugucaguuuuaacuagggaaua

SEQ ID NO: 194084 - RNA, 22 nt, Homo sapiens
ugucauucaggaaauucuaagu

SEQ ID NO: 194085 - RNA, 22 nt, Homo sapiens
ugucauuggacuucuuucaugg

SEQ ID NO: 194086 - RNA, 21 nt, Homo sapiens
ugucuuggagccagacgccag

SEQ ID NO: 194087 - RNA, 18 nt, Homo sapiens
ugugacauugagcauguc

SEQ ID NO: 194088 - RNA, 22 nt, Homo sapiens
ugugcaaucagcuucauuacau

SEQ ID NO: 194089 - RNA, 22 nt, Homo sapiens
ugugcauaugucuuuauaguag

SEQ ID NO: 194090 - RNA, 22 nt, Homo sapiens
ugugccacugcacuucagccug

SEQ ID NO: 194091 - RNA, 22 nt, Homo sapiens
uguggcaaauggucaggaagaa

SEQ ID NO: 194092 - RNA, 22 nt, Homo sapiens
uguggccuuuguuucaguuggg

SEQ ID NO: 194093 - RNA, 21 nt, Homo sapiens
uguuaacaugcagauuacugg

SEQ ID NO: 194094 - RNA, 22 nt, Homo sapiens
uguucuugagccuuuagaccua

SEQ ID NO: 194095 - RNA, 22 nt, Homo sapiens
uguuggcauugcugcugacccu

SEQ ID NO: 194096 - RNA, 22 nt, Homo sapiens
uguuuuggaggccagaagucca

SEQ ID NO: 194097 - RNA, 22 nt, Homo sapiens
uuaacagucacuuagcucauuu

SEQ ID NO: 194098 - RNA, 22 nt, Homo sapiens
uuaagguaugugggcauuuugu

SEQ ID NO: 194099 - RNA, 22 nt, Homo sapiens
uuaauguaauugauugauugac

SEQ ID NO: 194100 - RNA, 22 nt, Homo sapiens
uuacagcagugccccacuccca

SEQ ID NO: 194101 - RNA, 22 nt, Homo sapiens
uuacaguugugagccaccaugc

SEQ ID NO: 194102 - RNA, 22 nt, Homo sapiens
uuagauaguacugaaugguucu

SEQ ID NO: 194103 - RNA, 22 nt, Homo sapiens
uuagauguuuagaagugggcca

SEQ ID NO: 194104 - RNA, 22 nt, Homo sapiens
uuaggcaguuuauugauuuuca

SEQ ID NO: 194105 - RNA, 22 nt, Homo sapiens
uuagguauuaggaaauaugcuu

SEQ ID NO: 194106 - RNA, 22 nt, Homo sapiens
uuagugaaugggugugauuugu

SEQ ID NO: 194107 - RNA, 22 nt, Homo sapiens
uuauaacagagacuccugugcu

SEQ ID NO: 194108 - RNA, 22 nt, Homo sapiens
uuauagcacuaagaagguaaua

SEQ ID NO: 194109 - RNA, 22 nt, Homo sapiens
uuauccugucaguaaauauuuu

SEQ ID NO: 194110 - RNA, 22 nt, Homo sapiens
uuaucucaguguuuguaaacaa

SEQ ID NO: 194111 - RNA, 22 nt, Homo sapiens
uuauguguuuaauguuucugaa

SEQ ID NO: 194112 - RNA, 22 nt, Homo sapiens
uuauucugucuuuggucucaau

SEQ ID NO: 194113 - RNA, 22 nt, Homo sapiens
uuauugcacuccagccugggua

SEQ ID NO: 194114 - RNA, 23 nt, Homo sapiens
uucaaaggaugcuuuauggaauu

SEQ ID NO: 194115 - RNA, 22 nt, Homo sapiens
uucaagauggccccagugagcc

SEQ ID NO: 194116 - RNA, 22 nt, Homo sapiens
uucaauaugucauuggcaggca

SEQ ID NO: 194117 - RNA, 22 nt, Homo sapiens
uucagacugggugaagagggua

SEQ ID NO: 194118 - RNA, 22 nt, Homo sapiens
uucaguacuucaaaaucuuuaa

SEQ ID NO: 194119 - RNA, 22 nt, Homo sapiens
uucagugucauuaacacaguag

SEQ ID NO: 194120 - RNA, 22 nt, Homo sapiens
uuccaagugggaaacaaaaaug

SEQ ID NO: 194121 - RNA, 22 nt, Homo sapiens
uuccaauguuccguguugcagu

SEQ ID NO: 194122 - RNA, 22 nt, Homo sapiens
uucccugaaauauucacuuuca

SEQ ID NO: 194123 - RNA, 22 nt, Homo sapiens
uucccugaguaucuuaccaugg

SEQ ID NO: 194124 - RNA, 22 nt, Homo sapiens
uuccugugacccccaagcccac

SEQ ID NO: 194125 - RNA, 22 nt, Homo sapiens
uuccugugacuguguggcaccc

SEQ ID NO: 194126 - RNA, 20 nt, Homo sapiens
uuccuuaggcauuggaagaa

SEQ ID NO: 194127 - RNA, 22 nt, Homo sapiens
uuccuugugacuaguagugacc

SEQ ID NO: 194128 - RNA, 22 nt, Homo sapiens
uucuacaggcuguucaagaagc

SEQ ID NO: 194129 - RNA, 22 nt, Homo sapiens
uucuauggucacagaugcuuga

SEQ ID NO: 194130 - RNA, 21 nt, Homo sapiens
uucucaggguguguccuaccc

SEQ ID NO: 194131 - RNA, 23 nt, Homo sapiens
uucugccacugaaaaugccucag

SEQ ID NO: 194132 - RNA, 22 nt, Homo sapiens
uugaaagcuaucucaaaucgcu

SEQ ID NO: 194133 - RNA, 22 nt, Homo sapiens
uugaaguagcauuucaugucua

SEQ ID NO: 194134 - RNA, 22 nt, Homo sapiens
uugaaguaguacuuuauuauag

SEQ ID NO: 194135 - RNA, 22 nt, Homo sapiens
uugacaggaugcucagggccca

SEQ ID NO: 194136 - RNA, 22 nt, Homo sapiens
uugacauaguuucugaaauaga

SEQ ID NO: 194137 - RNA, 22 nt, Homo sapiens
uugacugugguaauggaagcug

SEQ ID NO: 194138 - RNA, 22 nt, Homo sapiens
uugacuuuuauucacucugcua

SEQ ID NO: 194139 - RNA, 21 nt, Homo sapiens
uugagaagaauuagcucuucc

SEQ ID NO: 194140 - RNA, 22 nt, Homo sapiens
uugagcacauguguuaaggggu

SEQ ID NO: 194141 - RNA, 22 nt, Homo sapiens
uugagcuauguacagaugcugu

SEQ ID NO: 194142 - RNA, 22 nt, Homo sapiens
uugaggacugcuaagcauuuga

SEQ ID NO: 194143 - RNA, 22 nt, Homo sapiens
uugaguagugugaugcaugucu

SEQ ID NO: 194144 - RNA, 22 nt, Homo sapiens
uugaguccccacacuggguccc

SEQ ID NO: 194145 - RNA, 22 nt, Homo sapiens
uugcaaaguuugccuccuguag

SEQ ID NO: 194146 - RNA, 22 nt, Homo sapiens
uugcaacauuguaaguuuauau

SEQ ID NO: 194147 - RNA, 22 nt, Homo sapiens
uugcaacuuagaaaaaucauuu

SEQ ID NO: 194148 - RNA, 22 nt, Homo sapiens
uugcacaauccugugagugagu

SEQ ID NO: 194149 - RNA, 22 nt, Homo sapiens
uugcagcaaagagggaggggca

SEQ ID NO: 194150 - RNA, 22 nt, Homo sapiens
uugcagcaaauaggaaugagga

SEQ ID NO: 194151 - RNA, 22 nt, Homo sapiens
uugcagcaacauggaugaaacu

SEQ ID NO: 194152 - RNA, 22 nt, Homo sapiens
uugcaugguuuuuaucugaaau

SEQ ID NO: 194153 - RNA, 22 nt, Homo sapiens
uuggaaaguuguuguaguuauu

SEQ ID NO: 194154 - RNA, 22 nt, Homo sapiens
uuggagagagaggacucccggc

SEQ ID NO: 194155 - RNA, 20 nt, Homo sapiens
uuggcauuuagacaagaguu

SEQ ID NO: 194156 - RNA, 22 nt, Homo sapiens
cacuguggauggaacuauguga

SEQ ID NO: 194157 - RNA, 22 nt, Homo sapiens
cacuuugguucaccugaguuuc

SEQ ID NO: 194158 - RNA, 22 nt, Homo sapiens
cagagcacuaaagguaaaaggc

SEQ ID NO: 194159 - RNA, 22 nt, Homo sapiens
cagcugaugucgaaugcacucu

SEQ ID NO: 194160 - RNA, 22 nt, Homo sapiens
cagggaauguuauuuaauagca

SEQ ID NO: 194161 - RNA, 22 nt, Homo sapiens
cauacaagcuacaaucacaaag

SEQ ID NO: 194162 - RNA, 22 nt, Homo sapiens
cauagcacugagcucuacccuc

SEQ ID NO: 194163 - RNA, 22 nt, Homo sapiens
uauugcccugcuuuguucuaaa

SEQ ID NO: 194164 - RNA, 22 nt, Homo sapiens
uauugggcuucucagaauagag

SEQ ID NO: 194165 - RNA, 22 nt, Homo sapiens
uauuugguagcuauuuugcagu

SEQ ID NO: 194166 - RNA, 22 nt, Homo sapiens
ucaacauugcugucaggcaucu

SEQ ID NO: 194167 - RNA, 20 nt, Homo sapiens
ucaaggcacgaauaaaaguu

SEQ ID NO: 194168 - RNA, 22 nt, Homo sapiens
ucaaggcacuagcugagcugca

SEQ ID NO: 194169 - RNA, 22 nt, Homo sapiens
ucaagugcauaugcuaacgguu

SEQ ID NO: 194170 - RNA, 22 nt, Homo sapiens
ucaagugcauugauucaguauu

SEQ ID NO: 194171 - RNA, 22 nt, Homo sapiens
ucaauugcaucaacaguguaca

SEQ ID NO: 194172 - RNA, 22 nt, Homo sapiens
ucacaaagcuuggccugcuucu

SEQ ID NO: 194173 - RNA, 22 nt, Homo sapiens
ucacaccauucuucuacuucag

SEQ ID NO: 194174 - RNA, 22 nt, Homo sapiens
ucacacugcaucuguuggaauu

SEQ ID NO: 194175 - RNA, 22 nt, Homo sapiens
aaaaugcugauauugggcccca

SEQ ID NO: 194176 - RNA, 22 nt, Homo sapiens
aaaguaguagcaguuucugcca

SEQ ID NO: 194177 - RNA, 22 nt, Homo sapiens
aaagugcugggauuuuaggcau

SEQ ID NO: 194178 - RNA, 22 nt, Homo sapiens
aaagugcuucucuuuggugggu

SEQ ID NO: 194179 - RNA, 22 nt, Homo sapiens
aaaguggugugaguauguaucu

SEQ ID NO: 194180 - RNA, 22 nt, Homo sapiens
aaaguucuugcugaaggauuau

SEQ ID NO: 194181 - RNA, 22 nt, Homo sapiens
aaaugcagucuuuguucugggc

SEQ ID NO: 194182 - RNA, 19 nt, Homo sapiens
aaaugugcacuguuuucca

SEQ ID NO: 194183 - RNA, 22 nt, Homo sapiens
aaauucaucaaaugguuuguau

SEQ ID NO: 194184 - RNA, 22 nt, Homo sapiens
aaauucauuucagcucugggua

SEQ ID NO: 194185 - RNA, 22 nt, Homo sapiens
aaauugcacaaguggugauuug

SEQ ID NO: 194186 - RNA, 22 nt, Homo sapiens
aaauugcauugagcugcuuauu

SEQ ID NO: 194187 - RNA, 22 nt, Homo sapiens
aacagaccuagauaguauaguc

SEQ ID NO: 194188 - RNA, 20 nt, Homo sapiens
aacaguguguaaguuuccuu

SEQ ID NO: 194189 - RNA, 22 nt, Homo sapiens
aacauguuuagcagauaccugu

SEQ ID NO: 194190 - RNA, 22 nt, Homo sapiens
aacuacaucucuuugaggcagg

SEQ ID NO: 194191 - RNA, 22 nt, Homo sapiens
aacuaugucaaauaaaaugagg

SEQ ID NO: 194192 - RNA, 22 nt, Homo sapiens
aacugcacauauuuguaugggu

SEQ ID NO: 194193 - RNA, 22 nt, Homo sapiens
aagcaggugugggaggaaaugg

SEQ ID NO: 194194 - RNA, 23 nt, Homo sapiens
aagguaagcuagaaagauguaga

SEQ ID NO: 194195 - RNA, 22 nt, Homo sapiens
aaguaaauauccgguaguccca

SEQ ID NO: 194196 - RNA, 22 nt, Homo sapiens
aagugcuuuuuagauaugguuu

SEQ ID NO: 194197 - RNA, 22 nt, Homo sapiens
aagugguagggucaggauugga

SEQ ID NO: 194198 - RNA, 22 nt, Homo sapiens
aauaaagccugucucuuuagag

SEQ ID NO: 194199 - RNA, 22 nt, Homo sapiens
aauaaugucacaggggguuagc

SEQ ID NO: 194200 - RNA, 22 nt, Homo sapiens
aauacagcacacagaugggucu

SEQ ID NO: 194201 - RNA, 22 nt, Homo sapiens
aauauguccuugaaauggugcu

SEQ ID NO: 194202 - RNA, 22 nt, Homo sapiens
aaugacccugauuggcaaguug

SEQ ID NO: 194203 - RNA, 22 nt, Homo sapiens
aauuacauggcaauugggaaau

SEQ ID NO: 194204 - RNA, 23 nt, Homo sapiens
aauugcacauuccuugcuggcag

SEQ ID NO: 194205 - RNA, 22 nt, Homo sapiens
aauugcacuacugcacucccac

SEQ ID NO: 194206 - RNA, 23 nt, Homo sapiens
aauugcuuuugaggacuuaguug

SEQ ID NO: 194207 - RNA, 22 nt, Homo sapiens
acaagugcuuuuccuggagaca

SEQ ID NO: 194208 - RNA, 22 nt, Homo sapiens
acacuguuuuguggagaaugua

SEQ ID NO: 194209 - RNA, 22 nt, Homo sapiens
acagcagugccccacucuacug

SEQ ID NO: 194210 - RNA, 22 nt, Homo sapiens
acaggugaaguauuacacuaag

SEQ ID NO: 194211 - RNA, 22 nt, Homo sapiens
acaguguuccuuuguugugacu

SEQ ID NO: 194212 - RNA, 22 nt, Homo sapiens
acccagaauucagucuuaggcc

SEQ ID NO: 194213 - RNA, 22 nt, Homo sapiens
accccauuugcacugagcccuu

SEQ ID NO: 194214 - RNA, 22 nt, Homo sapiens
acgcagcacauucacagcuaug

SEQ ID NO: 194215 - RNA, 22 nt, Homo sapiens
acuauacugaagcaaauuaaca

SEQ ID NO: 194216 - RNA, 22 nt, Homo sapiens
acuaugcuuuucuuagaauuaa

SEQ ID NO: 194217 - RNA, 22 nt, Homo sapiens
acugagccuuuaaaugacuuca

SEQ ID NO: 194218 - RNA, 22 nt, Homo sapiens
acugcacuccagccugagccug

SEQ ID NO: 194219 - RNA, 22 nt, Homo sapiens
acugcacuccagccugcccaac

SEQ ID NO: 194220 - RNA, 22 nt, Homo sapiens
ugucagaaucugagacgacaac

SEQ ID NO: 194221 - RNA, 22 nt, Homo sapiens
ugucaugagucuccuccaucuu

SEQ ID NO: 194222 - RNA, 22 nt, Homo sapiens
uguccugcagagguguuugccu

SEQ ID NO: 194223 - RNA, 22 nt, Homo sapiens
ugugaauguaaccuuauuugga

SEQ ID NO: 194224 - RNA, 22 nt, Homo sapiens
ugugaccaaaaucaacauaccu

SEQ ID NO: 194225 - RNA, 22 nt, Homo sapiens
ugugaucauugcuguuaaagug

SEQ ID NO: 194226 - RNA, 22 nt, Homo sapiens
ugugcuauguuauucacauggg

SEQ ID NO: 194227 - RNA, 22 nt, Homo sapiens
uguggcaaagucuugugaauau

SEQ ID NO: 194228 - RNA, 21 nt, Homo sapiens
uguggcaauggccucacagau

SEQ ID NO: 194229 - RNA, 22 nt, Homo sapiens
uguuacagcagaauugaaagag

SEQ ID NO: 194230 - RNA, 22 nt, Homo sapiens
uguucuggagaggcaggccaca

SEQ ID NO: 194231 - RNA, 22 nt, Homo sapiens
uguucuggagccgguucaaaug

SEQ ID NO: 194232 - RNA, 22 nt, Homo sapiens
uguuucuacugucucuguagua

SEQ ID NO: 194233 - RNA, 21 nt, Homo sapiens
uguuuuugcuguguaucucuc

SEQ ID NO: 194234 - RNA, 22 nt, Homo sapiens
uuaaaaguauaggccuggcaua

SEQ ID NO: 194235 - RNA, 22 nt, Homo sapiens
uuaaauacagcaugguguuucu

SEQ ID NO: 194236 - RNA, 21 nt, Homo sapiens
uuacaguugguugugaggugg

SEQ ID NO: 194237 - RNA, 22 nt, Homo sapiens
uuacugcucuuuugucaugagu

SEQ ID NO: 194238 - RNA, 22 nt, Homo sapiens
uuagaacagugcucaccacaaa

SEQ ID NO: 194239 - RNA, 21 nt, Homo sapiens
uuagcauccauguucaucaac

SEQ ID NO: 194240 - RNA, 22 nt, Homo sapiens
uuauacacugugggaguguaaa

SEQ ID NO: 194241 - RNA, 22 nt, Homo sapiens
uuauguaggcuauagcucugca

SEQ ID NO: 194242 - RNA, 16 nt, Homo sapiens
uuauugcauucuucuc

SEQ ID NO: 194243 - RNA, 22 nt, Homo sapiens
uucaaaucuucguuuugccaua

SEQ ID NO: 194244 - RNA, 23 nt, Homo sapiens
uucaaauguucucugguugucag

SEQ ID NO: 194245 - RNA, 22 nt, Homo sapiens
uucaagaauuaaaguggcuuuu

SEQ ID NO: 194246 - RNA, 22 nt, Homo sapiens
uucaagauggcaccagugagug

SEQ ID NO: 194247 - RNA, 22 nt, Homo sapiens
uucacaauuaaaugugguuauu

SEQ ID NO: 194248 - RNA, 22 nt, Homo sapiens
uucagagcauugguuuuuugaa

SEQ ID NO: 194249 - RNA, 22 nt, Homo sapiens
uucagggagaaggcaaacguug

SEQ ID NO: 194250 - RNA, 22 nt, Homo sapiens
uucaguucugcacugaucuuag

SEQ ID NO: 194251 - RNA, 22 nt, Homo sapiens
uucauaguuuauacugauauuu

SEQ ID NO: 194252 - RNA, 21 nt, Homo sapiens
uucaucuggccguauuccagg

SEQ ID NO: 194253 - RNA, 22 nt, Homo sapiens
uucaugcaucuguagugguuaa

SEQ ID NO: 194254 - RNA, 22 nt, Homo sapiens
uucauggacucaauaguuucgc

SEQ ID NO: 194255 - RNA, 22 nt, Homo sapiens
uuccaguguguucauccucaga

SEQ ID NO: 194256 - RNA, 22 nt, Homo sapiens
uuccaugagaugcaucaaagcu

SEQ ID NO: 194257 - RNA, 22 nt, Homo sapiens
uucccugugguauagaagccgu

SEQ ID NO: 194258 - RNA, 19 nt, Homo sapiens
uuccugagaacaagggcuu

SEQ ID NO: 194259 - RNA, 22 nt, Homo sapiens
uucuaaacaucuuacaaugcau

SEQ ID NO: 194260 - RNA, 20 nt, Homo sapiens
uucuaguacuucuguuucca

SEQ ID NO: 194261 - RNA, 22 nt, Homo sapiens
uucuaugguuuaauaguuuggg

SEQ ID NO: 194262 - RNA, 21 nt, Homo sapiens
uucuucaggcagaaggauuau

SEQ ID NO: 194263 - RNA, 22 nt, Homo sapiens
uucuucaggcauucccagaagc

SEQ ID NO: 194264 - RNA, 22 nt, Homo sapiens
uucuucaguuacaacaaggggg

SEQ ID NO: 194265 - RNA, 22 nt, Homo sapiens
uucuugcacuuaacugacauuc

SEQ ID NO: 194266 - RNA, 23 nt, Homo sapiens
uugaaaagucaguagccucugau

SEQ ID NO: 194267 - RNA, 22 nt, Homo sapiens
uugaaagucuaggcuuacagua

SEQ ID NO: 194268 - RNA, 22 nt, Homo sapiens
uugaaauguuuagaaguuugga

SEQ ID NO: 194269 - RNA, 22 nt, Homo sapiens
uugaaugaaauuggugugggga

SEQ ID NO: 194270 - RNA, 22 nt, Homo sapiens
uugaaugucuauuaaguuguuu

SEQ ID NO: 194271 - RNA, 20 nt, Homo sapiens
uugacaguggguuguuaaag

SEQ ID NO: 194272 - RNA, 22 nt, Homo sapiens
uugacuguaagauggcuauuac

SEQ ID NO: 194273 - RNA, 22 nt, Homo sapiens
uugagacugaacauuuguguac

SEQ ID NO: 194274 - RNA, 22 nt, Homo sapiens
uugagagaaaaggccaugccuu

SEQ ID NO: 194275 - RNA, 22 nt, Homo sapiens
uugagagagaacauuuguuaca

SEQ ID NO: 194276 - RNA, 22 nt, Homo sapiens
uugagauacauaauuaugaaug

SEQ ID NO: 194277 - RNA, 22 nt, Homo sapiens
uugagcaaugaacgauucaggg

SEQ ID NO: 194278 - RNA, 22 nt, Homo sapiens
uugagcaucauguuagcacuca

SEQ ID NO: 194279 - RNA, 22 nt, Homo sapiens
uugagcuaugaguuaauaggac

SEQ ID NO: 194280 - RNA, 22 nt, Homo sapiens
uugaggaaugucauuuguguuu

SEQ ID NO: 194281 - RNA, 22 nt, Homo sapiens
uugaggaguacugauuagguau

SEQ ID NO: 194282 - RNA, 22 nt, Homo sapiens
uugagggaagccagaggucugc

SEQ ID NO: 194283 - RNA, 22 nt, Homo sapiens
uugagggaggcagggcuugucu

SEQ ID NO: 194284 - RNA, 22 nt, Homo sapiens
uugagggaggccucaguuuaca

SEQ ID NO: 194285 - RNA, 22 nt, Homo sapiens
uugauaguuuaauuaaugcuag

SEQ ID NO: 194286 - RNA, 22 nt, Homo sapiens
uugauauauugcaugggcuacu

SEQ ID NO: 194287 - RNA, 23 nt, Homo sapiens
uugcaaagccugaaacucuucag

SEQ ID NO: 194288 - RNA, 22 nt, Homo sapiens
uugcaagaaaugcagauucuca

SEQ ID NO: 194289 - RNA, 22 nt, Homo sapiens
uugcaugguggaacuuggagcu

SEQ ID NO: 194290 - RNA, 22 nt, Homo sapiens
uugcauguacguacagagagag

SEQ ID NO: 194291 - RNA, 22 nt, Homo sapiens
uugcaugucugcuucuccuccu

SEQ ID NO: 194292 - RNA, 22 nt, Homo sapiens
uugcauuagugugguacauuug

SEQ ID NO: 194293 - RNA, 22 nt, Homo sapiens
uugccaauauuuuacugagaag

SEQ ID NO: 194294 - RNA, 21 nt, Homo sapiens
uugccugacacuggaagaaau

SEQ ID NO: 194295 - RNA, 22 nt, Homo sapiens
uugcuauguugcccagucugga

SEQ ID NO: 194296 - RNA, 22 nt, Homo sapiens
uuggaaaccucugcagguguuu

SEQ ID NO: 194297 - RNA, 22 nt, Homo sapiens
uuggauggugauaugguuugga

SEQ ID NO: 194298 - RNA, 22 nt, Homo sapiens
uuggcaagaaccuucuuccaag

SEQ ID NO: 194299 - RNA, 22 nt, Homo sapiens
uuggcaauucagauucuuuuau

SEQ ID NO: 194300 - RNA, 22 nt, Homo sapiens
uuggcauugccaaacugucaac

SEQ ID NO: 194301 - RNA, 19 nt, Homo sapiens
uuuguccugcccuuucuca

SEQ ID NO: 194302 - RNA, 18 nt, Homo sapiens
uuugugcuccacaaagga

SEQ ID NO: 194303 - RNA, 22 nt, Homo sapiens
uuugugcuccuguugagaaucu

SEQ ID NO: 194304 - RNA, 22 nt, Homo sapiens
uuugugucccucuaaaauuuau

SEQ ID NO: 194305 - RNA, 22 nt, Homo sapiens
uuuuaguugcucagguauucuc

SEQ ID NO: 194306 - RNA, 22 nt, Homo sapiens
uuuuccagugggacucccauua

SEQ ID NO: 194307 - RNA, 22 nt, Homo sapiens
uuuugcaggucaggggcagaga

SEQ ID NO: 194308 - RNA, 22 nt, Homo sapiens
uuuugcaguuacagagagugag

SEQ ID NO: 194309 - RNA, 22 nt, Homo sapiens
uuuuggcacuuugucugauucu

SEQ ID NO: 194310 - RNA, 22 nt, Homo sapiens
uuuuuugguaauugaacaauga

SEQ ID NO: 194311 - RNA, 22 nt, Homo sapiens
aaagcgcuguuaagaagacuga

SEQ ID NO: 194312 - RNA, 22 nt, Homo sapiens
aaaguaauugcaguuuuugcaa

SEQ ID NO: 194313 - RNA, 20 nt, Homo sapiens
aaaguaggcuaauaccaaaa

SEQ ID NO: 194314 - RNA, 22 nt, Homo sapiens
aaagugcugagacagacuggga

SEQ ID NO: 194315 - RNA, 22 nt, Homo sapiens
aaagugcugagucuaggcgggg

SEQ ID NO: 194316 - RNA, 22 nt, Homo sapiens
aaagugcugggauuggcugggc

SEQ ID NO: 194317 - RNA, 22 nt, Homo sapiens
aaaugcagcacucaagugggaa

SEQ ID NO: 194318 - RNA, 22 nt, Homo sapiens
aaaugccucccauucuacugac

SEQ ID NO: 194319 - RNA, 22 nt, Homo sapiens
aacagagcuggugacuccaggu

SEQ ID NO: 194320 - RNA, 22 nt, Homo sapiens
aacagcacacccgcugcuucca

SEQ ID NO: 194321 - RNA, 21 nt, Homo sapiens
ggcaugaauggaaaagugaga

SEQ ID NO: 194322 - RNA, 22 nt, Homo sapiens
ggcaugaggccauaaaaguaag

SEQ ID NO: 194323 - RNA, 22 nt, Homo sapiens
ggcauugaguggguaggaguca

SEQ ID NO: 194324 - RNA, 22 nt, Homo sapiens
ggcuagagacaaguugcugaga

SEQ ID NO: 194325 - RNA, 22 nt, Homo sapiens
ggcuuggaggaaugugagggcu

SEQ ID NO: 194326 - RNA, 22 nt, Homo sapiens
gggaacauggaaauucugcucu

SEQ ID NO: 194327 - RNA, 20 nt, Homo sapiens
gggcaaguaugugggaaguc

SEQ ID NO: 194328 - RNA, 22 nt, Homo sapiens
ggucaguuuuuuuaaccaucca

SEQ ID NO: 194329 - RNA, 22 nt, Homo sapiens
guaaucucagcuacucaggagg

SEQ ID NO: 194330 - RNA, 22 nt, Homo sapiens
guacaugcauaguuuauuucug

SEQ ID NO: 194331 - RNA, 22 nt, Homo sapiens
guagcagucacauagcagauug

SEQ ID NO: 194332 - RNA, 22 nt, Homo sapiens
guaugacacaggaagcuuaacc

SEQ ID NO: 194333 - RNA, 21 nt, Homo sapiens
guaugguugaagugacaagcc

SEQ ID NO: 194334 - RNA, 19 nt, Homo sapiens
guauuugacuuucuuguuu

SEQ ID NO: 194335 - RNA, 22 nt, Homo sapiens
gucaggcaccgauacaguuuuu

SEQ ID NO: 194336 - RNA, 22 nt, Homo sapiens
gucagugucuuaacagagauua

SEQ ID NO: 194337 - RNA, 22 nt, Homo sapiens
gucagugucuuugcagcucaga

SEQ ID NO: 194338 - RNA, 22 nt, Homo sapiens
gucauccaggcuggagugaagc

SEQ ID NO: 194339 - RNA, 22 nt, Homo sapiens
gucaugucuugaaauucaguuu

SEQ ID NO: 194340 - RNA, 22 nt, Homo sapiens
guccaugagaugaauccacaca

SEQ ID NO: 194341 - RNA, 20 nt, Homo sapiens
gucugucuccgaguagaauu

SEQ ID NO: 194342 - RNA, 22 nt, Homo sapiens
gucugugguuccuaugucaccu

SEQ ID NO: 194343 - RNA, 22 nt, Homo sapiens
gugaaaagaugagcaccauaca

SEQ ID NO: 194344 - RNA, 22 nt, Homo sapiens
gugagaauauuuuaaauacuaa

SEQ ID NO: 194345 - RNA, 22 nt, Homo sapiens
gugagaaucaaacuacauaaau

SEQ ID NO: 194346 - RNA, 22 nt, Homo sapiens
gugagauaaugucucauugugg

SEQ ID NO: 194347 - RNA, 22 nt, Homo sapiens
gugagcauaggaggcuucuguu

SEQ ID NO: 194348 - RNA, 22 nt, Homo sapiens
gugagcauauuaguauugcacu

SEQ ID NO: 194349 - RNA, 22 nt, Homo sapiens
gugagcuaguuucuuugcugug

SEQ ID NO: 194350 - RNA, 19 nt, Homo sapiens
gugcauaguuauuaaagag

SEQ ID NO: 194351 - RNA, 22 nt, Homo sapiens
gugcgguauuagcaagccaaca

SEQ ID NO: 194352 - RNA, 22 nt, Homo sapiens
gugcuauguuauccagcaagau

SEQ ID NO: 194353 - RNA, 22 nt, Homo sapiens
gugcuauguuguuuuggccgaa

SEQ ID NO: 194354 - RNA, 21 nt, Homo sapiens
gugcuuguagccucacuucug

SEQ ID NO: 194355 - RNA, 22 nt, Homo sapiens
gugcuuguauuuaaaucaugug

SEQ ID NO: 194356 - RNA, 22 nt, Homo sapiens
guggcaaguguuccaagaggcg

SEQ ID NO: 194357 - RNA, 22 nt, Homo sapiens
guggcaugaaagcaucugugau

SEQ ID NO: 194358 - RNA, 22 nt, Homo sapiens
guggguaaaucucuguuugagg

SEQ ID NO: 194359 - RNA, 22 nt, Homo sapiens
gugguuguuggaguggcaauuu

SEQ ID NO: 194360 - RNA, 22 nt, Homo sapiens
guguauauccuauuaguucugu

SEQ ID NO: 194361 - RNA, 22 nt, Homo sapiens
guguccucgaguacacaucagg

SEQ ID NO: 194362 - RNA, 22 nt, Homo sapiens
gugugucuugaccaggaucgga

SEQ ID NO: 194363 - RNA, 22 nt, Homo sapiens
guuaagaaguguaacuuaaguu

SEQ ID NO: 194364 - RNA, 22 nt, Homo sapiens
guuugcagaucaugaagaaccc

SEQ ID NO: 194365 - RNA, 22 nt, Homo sapiens
uaaacugcuugaaaugguguca

SEQ ID NO: 194366 - RNA, 22 nt, Homo sapiens
uaaagccauugucaaguuugua

SEQ ID NO: 194367 - RNA, 22 nt, Homo sapiens
uaaaugcucuuuaaaagugcuu

SEQ ID NO: 194368 - RNA, 22 nt, Homo sapiens
uaacaagagagucagucagucc

SEQ ID NO: 194369 - RNA, 22 nt, Homo sapiens
uaacagcauuugugucuaguag

SEQ ID NO: 194370 - RNA, 18 nt, Homo sapiens
uaacugugggaacuaacu

SEQ ID NO: 194371 - RNA, 22 nt, Homo sapiens
uaaggcacuacuuuaggcuuuc

SEQ ID NO: 194372 - RNA, 22 nt, Homo sapiens
uaaguacuuuacagacauuauc

SEQ ID NO: 194373 - RNA, 23 nt, Homo sapiens
uaagucacacagauuaauuuauu

SEQ ID NO: 194374 - RNA, 22 nt, Homo sapiens
uaauacuagugaauagcaggau

SEQ ID NO: 194375 - RNA, 22 nt, Homo sapiens
uaauacuugucauaaaggcauu

SEQ ID NO: 194376 - RNA, 22 nt, Homo sapiens
uaauagcucggauaaacaugau

SEQ ID NO: 194377 - RNA, 22 nt, Homo sapiens
aacucacauucuuucuugguac

SEQ ID NO: 194378 - RNA, 22 nt, Homo sapiens
aacugcauuuucugauugugug

SEQ ID NO: 194379 - RNA, 22 nt, Homo sapiens
aacugccucugacauaggcagg

SEQ ID NO: 194380 - RNA, 22 nt, Homo sapiens
aagacuguaauccaucuugagu

SEQ ID NO: 194381 - RNA, 22 nt, Homo sapiens
aagcuccauuucugccaugaga

SEQ ID NO: 194382 - RNA, 22 nt, Homo sapiens
aagcuguauuguguugcuauaa

SEQ ID NO: 194383 - RNA, 22 nt, Homo sapiens
aaggaguagaggaauagcaaug

SEQ ID NO: 194384 - RNA, 22 nt, Homo sapiens
aaggcaagguggauaaugaagc

SEQ ID NO: 194385 - RNA, 22 nt, Homo sapiens
aaggcaguggcagaagauguca

SEQ ID NO: 194386 - RNA, 22 nt, Homo sapiens
aaggcaugcaaagaacauuuua

SEQ ID NO: 194387 - RNA, 22 nt, Homo sapiens
aaguagcagaggcaagacuuga

SEQ ID NO: 194388 - RNA, 22 nt, Homo sapiens
aagucacugagacuuguggcug

SEQ ID NO: 194389 - RNA, 22 nt, Homo sapiens
aagugaauucauuguguuauau

SEQ ID NO: 194390 - RNA, 22 nt, Homo sapiens
aagugcaaaucuguggcugaaa

SEQ ID NO: 194391 - RNA, 21 nt, Homo sapiens
aagugcucugggacucuaaau

SEQ ID NO: 194392 - RNA, 22 nt, Homo sapiens
aagugcucuugaaacugccuua

SEQ ID NO: 194393 - RNA, 22 nt, Homo sapiens
aagugcuggccuacucaaucga

SEQ ID NO: 194394 - RNA, 22 nt, Homo sapiens
aagugcuguaugggagccuagg

SEQ ID NO: 194395 - RNA, 22 nt, Homo sapiens
aagugcuuaggauagugugugg

SEQ ID NO: 194396 - RNA, 21 nt, Homo sapiens
aauaaagcaaccuuaugccau

SEQ ID NO: 194397 - RNA, 22 nt, Homo sapiens
aauaagaaguggaagggaccgg

SEQ ID NO: 194398 - RNA, 22 nt, Homo sapiens
aauacuuccaaaucuagucauu

SEQ ID NO: 194399 - RNA, 22 nt, Homo sapiens
aaugauacuguguacaagggca

SEQ ID NO: 194400 - RNA, 22 nt, Homo sapiens
aauggcaagagccacagaggcg

SEQ ID NO: 194401 - RNA, 22 nt, Homo sapiens
aauugcaauggacaaugcagca

SEQ ID NO: 194402 - RNA, 22 nt, Homo sapiens
aauugcauugaauuuguagcuu

SEQ ID NO: 194403 - RNA, 22 nt, Homo sapiens
acacaaugguaaguguuugugu

SEQ ID NO: 194404 - RNA, 22 nt, Homo sapiens
acagaacugggcuugcuuuugg

SEQ ID NO: 194405 - RNA, 20 nt, Homo sapiens
acagcauagccuuuuaaagc

SEQ ID NO: 194406 - RNA, 22 nt, Homo sapiens
acaguagugggcuacagaauca

SEQ ID NO: 194407 - RNA, 22 nt, Homo sapiens
acagugcuucugauaugaugcc

SEQ ID NO: 194408 - RNA, 22 nt, Homo sapiens
acaguggugcgaucucggcuca

SEQ ID NO: 194409 - RNA, 22 nt, Homo sapiens
acaguguacaauagccuuuuaa

SEQ ID NO: 194410 - RNA, 22 nt, Homo sapiens
acaguguuacuugauaguguau

SEQ ID NO: 194411 - RNA, 22 nt, Homo sapiens
acaugagacuggguuuguaggg

SEQ ID NO: 194412 - RNA, 22 nt, Homo sapiens
acauggcacugcgggcuucuug

SEQ ID NO: 194413 - RNA, 22 nt, Homo sapiens
acccacuagaugccaguggcac

SEQ ID NO: 194414 - RNA, 22 nt, Homo sapiens
acuagagaugcauuuguaguuu

SEQ ID NO: 194415 - RNA, 21 nt, Homo sapiens
acugcacuccaaccucaacag

SEQ ID NO: 194416 - RNA, 22 nt, Homo sapiens
acugcacuccaccuugggcaac

SEQ ID NO: 194417 - RNA, 22 nt, Homo sapiens
acugcacuccagccuucgugac

SEQ ID NO: 194418 - RNA, 22 nt, Homo sapiens
acugcacuccggccucgugaca

SEQ ID NO: 194419 - RNA, 22 nt, Homo sapiens
acugggucaaaguagaaaacua

SEQ ID NO: 194420 - RNA, 22 nt, Homo sapiens
agaagaacauagggugacugaa

SEQ ID NO: 194421 - RNA, 22 nt, Homo sapiens
agaauguaaacagaauagagga

SEQ ID NO: 194422 - RNA, 22 nt, Homo sapiens
agagauaaagauuuuaauuuug

SEQ ID NO: 194423 - RNA, 22 nt, Homo sapiens
agagcauugaguuaaugguuca

SEQ ID NO: 194424 - RNA, 22 nt, Homo sapiens
agaguaguuuauuaugcuaagg

SEQ ID NO: 194425 - RNA, 22 nt, Homo sapiens
agagugcuauagauuagauuuc

SEQ ID NO: 194426 - RNA, 22 nt, Homo sapiens
agauaugucugcuauuugcugu

SEQ ID NO: 194427 - RNA, 22 nt, Homo sapiens
agauauguuuaguuucaaaaug

SEQ ID NO: 194428 - RNA, 22 nt, Homo sapiens
agaugcauugguggcauauuca

SEQ ID NO: 194429 - RNA, 22 nt, Homo sapiens
agcaacauagugagacccccau

SEQ ID NO: 194430 - RNA, 22 nt, Homo sapiens
agcacauauauuucccaaaaca

SEQ ID NO: 194431 - RNA, 22 nt, Homo sapiens
agcacauuaguaucuaagaaca

SEQ ID NO: 194432 - RNA, 22 nt, Homo sapiens
agcagguguccacaauguuugc

SEQ ID NO: 194433 - RNA, 22 nt, Homo sapiens
agcagguguggcuuauccugaa

SEQ ID NO: 194434 - RNA, 22 nt, Homo sapiens
agcuaaaucucauguugaauug

SEQ ID NO: 194435 - RNA, 22 nt, Homo sapiens
agcuauauugaggaugccauuc

SEQ ID NO: 194436 - RNA, 22 nt, Homo sapiens
agcugauuuuaaguccuugucc

SEQ ID NO: 194437 - RNA, 22 nt, Homo sapiens
agcugcacugguauaggagaaa

SEQ ID NO: 194438 - RNA, 22 nt, Homo sapiens
agcugguauuuugucaaggaua

SEQ ID NO: 194439 - RNA, 22 nt, Homo sapiens
agcuguuuuugugggcauguga

SEQ ID NO: 194440 - RNA, 22 nt, Homo sapiens
agcuuuggauaccugcuguucc

SEQ ID NO: 194441 - RNA, 22 nt, Homo sapiens
aggcaaaugccagcaaucacac

SEQ ID NO: 194442 - RNA, 22 nt, Homo sapiens
aggcaagaaugcuuguuucacc

SEQ ID NO: 194443 - RNA, 22 nt, Homo sapiens
aggcaugguggcacauacaugu

SEQ ID NO: 194444 - RNA, 22 nt, Homo sapiens
aggcugguauuuacaaaagcuc

SEQ ID NO: 194445 - RNA, 22 nt, Homo sapiens
agggcuuguuuaacuaucauua

SEQ ID NO: 194446 - RNA, 22 nt, Homo sapiens
aggguuuuuauuuauguggcau

SEQ ID NO: 194447 - RNA, 21 nt, Homo sapiens
aggucaugaagauguucuaau

SEQ ID NO: 194448 - RNA, 22 nt, Homo sapiens
agguuguguuugugauuagaua

SEQ ID NO: 194449 - RNA, 22 nt, Homo sapiens
aguaacaggauccaaagaaugu

SEQ ID NO: 194450 - RNA, 22 nt, Homo sapiens
aguacacuguuaaaaagaagug

SEQ ID NO: 194451 - RNA, 22 nt, Homo sapiens
agucagugucuguaaggagaac

SEQ ID NO: 194452 - RNA, 22 nt, Homo sapiens
agugcaaugauccggugcuggg

SEQ ID NO: 194453 - RNA, 19 nt, Homo sapiens
auaaacuagaacugucccc

SEQ ID NO: 194454 - RNA, 22 nt, Homo sapiens
auaaagacacuuggcaugauuu

SEQ ID NO: 194455 - RNA, 22 nt, Homo sapiens
auaaagcuauuccucucuuuuu

SEQ ID NO: 194456 - RNA, 22 nt, Homo sapiens
auaaaugccuguuguuuuaagc

SEQ ID NO: 194457 - RNA, 22 nt, Homo sapiens
auaacagcugcaaggcaaaagc

SEQ ID NO: 194458 - RNA, 22 nt, Homo sapiens
auacaguaucuucuggcaagca

SEQ ID NO: 194459 - RNA, 22 nt, Homo sapiens
auacugucucuugcuccugccc

SEQ ID NO: 194460 - RNA, 22 nt, Homo sapiens
auagcaagaugauugauccauu

SEQ ID NO: 194461 - RNA, 22 nt, Homo sapiens
auagcacuuauagauuuggucu

SEQ ID NO: 194462 - RNA, 22 nt, Homo sapiens
auagcagcaccccacuaccuca

SEQ ID NO: 194463 - RNA, 22 nt, Homo sapiens
auagcagcucacuuauuuaugg

SEQ ID NO: 194464 - RNA, 22 nt, Homo sapiens
auaucacaaacaagucuguacu

SEQ ID NO: 194465 - RNA, 22 nt, Homo sapiens
auaugcuuauuagcaagaaaua

SEQ ID NO: 194466 - RNA, 18 nt, Homo sapiens
auauugcauuggauggau

SEQ ID NO: 194467 - RNA, 22 nt, Homo sapiens
aucacaauuguacguaggagcc

SEQ ID NO: 194468 - RNA, 22 nt, Homo sapiens
aucagauuccacauuuuaucag

SEQ ID NO: 194469 - RNA, 22 nt, Homo sapiens
auccacauucauggaccagucc

SEQ ID NO: 194470 - RNA, 22 nt, Homo sapiens
aucucauggagguagagaguaa

SEQ ID NO: 194471 - RNA, 22 nt, Homo sapiens
aucugugaaugaaguuauuuug

SEQ ID NO: 194472 - RNA, 22 nt, Homo sapiens
aucugugguuguaugcauauua

SEQ ID NO: 194473 - RNA, 22 nt, Homo sapiens
aucuguguuuaaggucccagaa

SEQ ID NO: 194474 - RNA, 21 nt, Homo sapiens
uaauggcaugaucucggcuca

SEQ ID NO: 194475 - RNA, 22 nt, Homo sapiens
uaaugugcuucucuaccauagg

SEQ ID NO: 194476 - RNA, 22 nt, Homo sapiens
uaauugcaguucuguguuauau

SEQ ID NO: 194477 - RNA, 22 nt, Homo sapiens
uacaaagcuuugaugugucuuu

SEQ ID NO: 194478 - RNA, 22 nt, Homo sapiens
uacaacacugguucgacaugug

SEQ ID NO: 194479 - RNA, 23 nt, Homo sapiens
uacugcauccuccgccucuaggg

SEQ ID NO: 194480 - RNA, 22 nt, Homo sapiens
uacugcauuccaaucugggcga

SEQ ID NO: 194481 - RNA, 21 nt, Homo sapiens
uacuugagacagggucuugcu

SEQ ID NO: 194482 - RNA, 22 nt, Homo sapiens
uagagauaucaauuucauggug

SEQ ID NO: 194483 - RNA, 21 nt, Homo sapiens
uagagcaacacacgcccucuc

SEQ ID NO: 194484 - RNA, 22 nt, Homo sapiens
uagagccauugcagauguuuga

SEQ ID NO: 194485 - RNA, 22 nt, Homo sapiens
uagagguagguguaugaacuag

SEQ ID NO: 194486 - RNA, 22 nt, Homo sapiens
uagcagcuuuauugagguaaau

SEQ ID NO: 194487 - RNA, 22 nt, Homo sapiens
uagcccagugagguugauuugg

SEQ ID NO: 194488 - RNA, 22 nt, Homo sapiens
uauaacaaugcaagaauggccu

SEQ ID NO: 194489 - RNA, 22 nt, Homo sapiens
uauaccacugauuuuauucuga

SEQ ID NO: 194490 - RNA, 22 nt, Homo sapiens
uauacuguuuucuauaguggcu

SEQ ID NO: 194491 - RNA, 22 nt, Homo sapiens
uauagcaaugccccacuccuga

SEQ ID NO: 194492 - RNA, 21 nt, Homo sapiens
uauagcagcacgauuuauagu

SEQ ID NO: 194493 - RNA, 22 nt, Homo sapiens
uaucaaacccaaggaggggguu

SEQ ID NO: 194494 - RNA, 21 nt, Homo sapiens
uaucacaguagaauaggaucu

SEQ ID NO: 194495 - RNA, 21 nt, Homo sapiens
uaucacauuggugauuaaguu

SEQ ID NO: 194496 - RNA, 22 nt, Homo sapiens
uaucucagaugagacuuguaac

SEQ ID NO: 194497 - RNA, 22 nt, Homo sapiens
uaucugcacuucugucuagguc

SEQ ID NO: 194498 - RNA, 20 nt, Homo sapiens
uaugaaacaguguagagcaa

SEQ ID NO: 194499 - RNA, 20 nt, Homo sapiens
uaugacaaagccuagugagu

SEQ ID NO: 194500 - RNA, 22 nt, Homo sapiens
uaugacauaguccuuaacccuc

SEQ ID NO: 194501 - RNA, 22 nt, Homo sapiens
uaugagcacauauguaucuaug

SEQ ID NO: 194502 - RNA, 22 nt, Homo sapiens
uaugaugcuguuuagaaucucu

SEQ ID NO: 194503 - RNA, 22 nt, Homo sapiens
uauggauguuaagguucacagc

SEQ ID NO: 194504 - RNA, 22 nt, Homo sapiens
uauggcauuguuggugaugaua

SEQ ID NO: 194505 - RNA, 22 nt, Homo sapiens
uauggccugcguccagugguau

SEQ ID NO: 194506 - RNA, 22 nt, Homo sapiens
uauggcuucuuauucuuucccg

SEQ ID NO: 194507 - RNA, 22 nt, Homo sapiens
uauggcuuuuauuauguuguag

SEQ ID NO: 194508 - RNA, 21 nt, Homo sapiens
uaugguuucuaauucugcagg

SEQ ID NO: 194509 - RNA, 22 nt, Homo sapiens
uaugucaugggguuuuugagau

SEQ ID NO: 194510 - RNA, 22 nt, Homo sapiens
uauuacuugucugugucucaau

SEQ ID NO: 194511 - RNA, 22 nt, Homo sapiens
uauuagguuggugcaacaguaa

SEQ ID NO: 194512 - RNA, 22 nt, Homo sapiens
uauugacauuacagugggucuu

SEQ ID NO: 194513 - RNA, 22 nt, Homo sapiens
uauuucccuuaacuuuccugca

SEQ ID NO: 194514 - RNA, 20 nt, Homo sapiens
ucaaaguaugcucugcacua

SEQ ID NO: 194515 - RNA, 22 nt, Homo sapiens
ucaaagugagcuccuucucacu

SEQ ID NO: 194516 - RNA, 22 nt, Homo sapiens
ucaaaucaucuuuuccaaagcu

SEQ ID NO: 194517 - RNA, 20 nt, Homo sapiens
ucaaggcaggaacuguacau

SEQ ID NO: 194518 - RNA, 22 nt, Homo sapiens
ucacacuguuuugauuauuaua

SEQ ID NO: 194519 - RNA, 22 nt, Homo sapiens
ucacagacauugaggggaccuu

SEQ ID NO: 194520 - RNA, 20 nt, Homo sapiens
ucucauggagggaaagagca

SEQ ID NO: 194521 - RNA, 20 nt, Homo sapiens
ucucauggagguagagaaua

SEQ ID NO: 194522 - RNA, 22 nt, Homo sapiens
ucugcaagucuaaacuagccau

SEQ ID NO: 194523 - RNA, 22 nt, Homo sapiens
ucuggccuacaucauuuuuccg

SEQ ID NO: 194524 - RNA, 22 nt, Homo sapiens
ucugucacugaaucccugucac

SEQ ID NO: 194525 - RNA, 22 nt, Homo sapiens
ucuuuggcugugaagaauaaug

SEQ ID NO: 194526 - RNA, 22 nt, Homo sapiens
ucuuuggguagauauguagcug

SEQ ID NO: 194527 - RNA, 22 nt, Homo sapiens
ucuuuggguguauuucacagcc

SEQ ID NO: 194528 - RNA, 22 nt, Homo sapiens
ucuuuguguucaggagccacgu

SEQ ID NO: 194529 - RNA, 22 nt, Homo sapiens
ugaaagcuacaggaaaguauuu

SEQ ID NO: 194530 - RNA, 22 nt, Homo sapiens
ugaaaugaucaguuugguuacu

SEQ ID NO: 194531 - RNA, 22 nt, Homo sapiens
ugaaaugccuuuaaugaauuua

SEQ ID NO: 194532 - RNA, 22 nt, Homo sapiens
ugaagacucaauuauuaugaac

SEQ ID NO: 194533 - RNA, 22 nt, Homo sapiens
ugaaguagguucucguaucgcc

SEQ ID NO: 194534 - RNA, 22 nt, Homo sapiens
ugaauacuucaaaaaaauagcu

SEQ ID NO: 194535 - RNA, 22 nt, Homo sapiens
ugaauacuucguucaaagauaa

SEQ ID NO: 194536 - RNA, 22 nt, Homo sapiens
ugaaugccauucuguguuagcu

SEQ ID NO: 194537 - RNA, 23 nt, Homo sapiens
ugaauguaucgaaugugggaaag

SEQ ID NO: 194538 - RNA, 18 nt, Homo sapiens
ugacaucauuuagaaagg

SEQ ID NO: 194539 - RNA, 22 nt, Homo sapiens
ugacauguccaggugguccugu

SEQ ID NO: 194540 - RNA, 22 nt, Homo sapiens
ugacuacaaccuccaccucccg

SEQ ID NO: 194541 - RNA, 22 nt, Homo sapiens
ugacuacauaaguaaucucaaa

SEQ ID NO: 194542 - RNA, 22 nt, Homo sapiens
ugacuucauuugguaauugggu

SEQ ID NO: 194543 - RNA, 22 nt, Homo sapiens
ugagaguauaaauugaugcagc

SEQ ID NO: 194544 - RNA, 22 nt, Homo sapiens
ugagaugagggcugcacucaaa

SEQ ID NO: 194545 - RNA, 23 nt, Homo sapiens
ugagauuacccagaaagaguaua

SEQ ID NO: 194546 - RNA, 23 nt, Homo sapiens
ugagauuauaaucuuuuacuucu

SEQ ID NO: 194547 - RNA, 22 nt, Homo sapiens
ugagccauggcaccuugucuaa

SEQ ID NO: 194548 - RNA, 20 nt, Homo sapiens
ugagccccuggacucaagcg

SEQ ID NO: 194549 - RNA, 17 nt, Homo sapiens
ugagcuaugauccuguc

SEQ ID NO: 194550 - RNA, 20 nt, Homo sapiens
ugagcuuguaaacacuguuu

SEQ ID NO: 194551 - RNA, 22 nt, Homo sapiens
ugagguaaaacaaggauuggau

SEQ ID NO: 194552 - RNA, 22 nt, Homo sapiens
ugagguaggugaagaaugcacg

SEQ ID NO: 194553 - RNA, 22 nt, Homo sapiens
ugagguugguauuacugucucu

SEQ ID NO: 194554 - RNA, 22 nt, Homo sapiens
ugaguaguauucuaugguaugu

SEQ ID NO: 194555 - RNA, 22 nt, Homo sapiens
ugaguguccaccccuuucacag

SEQ ID NO: 194556 - RNA, 22 nt, Homo sapiens
ugaguuaguguggugcuuggaa

SEQ ID NO: 194557 - RNA, 22 nt, Homo sapiens
ugaguucaauuguauuuuauua

SEQ ID NO: 194558 - RNA, 22 nt, Homo sapiens
ugauaugaaguuagcuggcugu

SEQ ID NO: 194559 - RNA, 20 nt, Homo sapiens
ugauaugguuuggcuguguu

SEQ ID NO: 194560 - RNA, 22 nt, Homo sapiens
ugauguaggacauuauuauuuc

SEQ ID NO: 194561 - RNA, 22 nt, Homo sapiens
ugauguaggcauuuaagguuau

SEQ ID NO: 194562 - RNA, 22 nt, Homo sapiens
ugcaaauguuaguaacaccacu

SEQ ID NO: 194563 - RNA, 22 nt, Homo sapiens
ugcaagacugcaguuacuuuug

SEQ ID NO: 194564 - RNA, 22 nt, Homo sapiens
ugcaaugugaaauaagcacauc

SEQ ID NO: 194565 - RNA, 22 nt, Homo sapiens
ugcagugucaauaauaauuagu

SEQ ID NO: 194566 - RNA, 22 nt, Homo sapiens
ugcauauguucaaaguauucug

SEQ ID NO: 194567 - RNA, 21 nt, Homo sapiens
ugcauuggagaauguuucuca

SEQ ID NO: 194568 - RNA, 19 nt, Homo sapiens
ugccauguagcacaugguc

SEQ ID NO: 194569 - RNA, 22 nt, Homo sapiens
ugccugagcccagcccuguagu

SEQ ID NO: 194570 - RNA, 22 nt, Homo sapiens
ugccugcugucuaauauauucu

SEQ ID NO: 194571 - RNA, 22 nt, Homo sapiens
ugcugcaaucucggcacuuugg

SEQ ID NO: 194572 - RNA, 22 nt, Homo sapiens
ugcuggugucaucaaggcuuug

SEQ ID NO: 194573 - RNA, 22 nt, Homo sapiens
uggaaauuaagucuuuccugag

SEQ ID NO: 194574 - RNA, 21 nt, Homo sapiens
uggaauuaauggagagguguu

SEQ ID NO: 194575 - RNA, 22 nt, Homo sapiens
uggaauuaauuaaaauauacug

SEQ ID NO: 194576 - RNA, 22 nt, Homo sapiens
uggacugagauuucagcugcca

SEQ ID NO: 194577 - RNA, 22 nt, Homo sapiens
uggagacaaagauagaaaagca

SEQ ID NO: 194578 - RNA, 22 nt, Homo sapiens
uggagguagacauugggaagag

SEQ ID NO: 194579 - RNA, 22 nt, Homo sapiens
uggauagauacuauccaggacu

SEQ ID NO: 194580 - RNA, 22 nt, Homo sapiens
uggauggugauuggaucaugga

SEQ ID NO: 194581 - RNA, 22 nt, Homo sapiens
uggcaaaugaaagaaagccagu

SEQ ID NO: 194582 - RNA, 22 nt, Homo sapiens
uggcaaaugaagucagcuguac

SEQ ID NO: 194583 - RNA, 22 nt, Homo sapiens
uggcaagaacugcaauugcuuu

SEQ ID NO: 194584 - RNA, 22 nt, Homo sapiens
uggcaagaagagcaugagacca

SEQ ID NO: 194585 - RNA, 22 nt, Homo sapiens
uggcaagagaacaacaucucuc

SEQ ID NO: 194586 - RNA, 22 nt, Homo sapiens
uggcaagagauaugugucuaua

SEQ ID NO: 194587 - RNA, 22 nt, Homo sapiens
uggcaagagcaaaauguacagu

SEQ ID NO: 194588 - RNA, 19 nt, Homo sapiens
uggcaaugucagcagagau

SEQ ID NO: 194589 - RNA, 19 nt, Homo sapiens
uggcaugaaugugaacuaa

SEQ ID NO: 194590 - RNA, 22 nt, Homo sapiens
uggcaugugugaagugcccagc

SEQ ID NO: 194591 - RNA, 22 nt, Homo sapiens
uggcauguuggguguugacucc

SEQ ID NO: 194592 - RNA, 23 nt, Homo sapiens
uggcauuuuaguuagcuucagug

SEQ ID NO: 194593 - RNA, 22 nt, Homo sapiens
uggcauuuuguuuuagaauuag

SEQ ID NO: 194594 - RNA, 22 nt, Homo sapiens
uggccagagggcaauuagcugu

SEQ ID NO: 194595 - RNA, 22 nt, Homo sapiens
uggcuuuuguuauuuggaagcu

SEQ ID NO: 194596 - RNA, 18 nt, Homo sapiens
ugggaagaaauucuucuc

SEQ ID NO: 194597 - RNA, 22 nt, Homo sapiens
ugggaauaugauacaggucuuu

SEQ ID NO: 194598 - RNA, 22 nt, Homo sapiens
ugggcaaaacuaagagcugugg

SEQ ID NO: 194599 - RNA, 22 nt, Homo sapiens
uggggcaaugaacauuuuugca

SEQ ID NO: 194600 - RNA, 19 nt, Homo sapiens
uggucaguucugggagcug

SEQ ID NO: 194601 - RNA, 22 nt, Homo sapiens
ugguguccugucucugcgcuug

SEQ ID NO: 194602 - RNA, 22 nt, Homo sapiens
uguaaugaucaaaucagaguaa

SEQ ID NO: 194603 - RNA, 22 nt, Homo sapiens
uguagcaaaucgauacuauugg

SEQ ID NO: 194604 - RNA, 22 nt, Homo sapiens
ugucaauauguaauaacugaau

SEQ ID NO: 194605 - RNA, 22 nt, Homo sapiens
ugucacccuuuauccauuuccu

SEQ ID NO: 194606 - RNA, 22 nt, Homo sapiens
ugucauacaguaacaugguugg

SEQ ID NO: 194607 - RNA, 19 nt, Homo sapiens
ugucaucaucuuuucuugc

SEQ ID NO: 194608 - RNA, 22 nt, Homo sapiens
ugucauggucacaggcauuuca

SEQ ID NO: 194609 - RNA, 22 nt, Homo sapiens
ugucauggugcucugggcccug

SEQ ID NO: 194610 - RNA, 22 nt, Homo sapiens
ugucauguggcuaacgauucau

SEQ ID NO: 194611 - RNA, 22 nt, Homo sapiens
ugucuaaagaauggcagacuca

SEQ ID NO: 194612 - RNA, 22 nt, Homo sapiens
ugugaaaucagauagccuuuuu

SEQ ID NO: 194613 - RNA, 22 nt, Homo sapiens
ugugaaugaagaaugcuaaccu

SEQ ID NO: 194614 - RNA, 22 nt, Homo sapiens
ugugacagguagguaauuuuug

SEQ ID NO: 194615 - RNA, 22 nt, Homo sapiens
ugugauggaguuucauggacug

SEQ ID NO: 194616 - RNA, 22 nt, Homo sapiens
ugugaugguuuagcauuuucuu

SEQ ID NO: 194617 - RNA, 22 nt, Homo sapiens
ugugaugugaugagaaguuccu

SEQ ID NO: 194618 - RNA, 22 nt, Homo sapiens
aaacauugaccucauccuggca

SEQ ID NO: 194619 - RNA, 22 nt, Homo sapiens
aaagaagucagccuguccuuug

SEQ ID NO: 194620 - RNA, 22 nt, Homo sapiens
aaagagaucuaugggcacuaug

SEQ ID NO: 194621 - RNA, 22 nt, Homo sapiens
aaagucacuggagaaggaauau

SEQ ID NO: 194622 - RNA, 22 nt, Homo sapiens
aaagugccugacucauaguuag

SEQ ID NO: 194623 - RNA, 22 nt, Homo sapiens
aaagugcuaggauuaccugggg

SEQ ID NO: 194624 - RNA, 22 nt, Homo sapiens
aaagugcugagaguucuaacuu

SEQ ID NO: 194625 - RNA, 22 nt, Homo sapiens
aaagugcugggauuggccgggc

SEQ ID NO: 194626 - RNA, 22 nt, Homo sapiens
aaagugcuuacuaaguugccaa

SEQ ID NO: 194627 - RNA, 22 nt, Homo sapiens
aaagugcuuccuuuuugagggu

SEQ ID NO: 194628 - RNA, 22 nt, Homo sapiens
aaaguguguuuccaaccugugg

SEQ ID NO: 194629 - RNA, 22 nt, Homo sapiens
aaaguguuucugcaguagguuu

SEQ ID NO: 194630 - RNA, 22 nt, Homo sapiens
aaaugcagauuccuaggcccca

SEQ ID NO: 194631 - RNA, 22 nt, Homo sapiens
aaaugcaucauuaggugauuuu

SEQ ID NO: 194632 - RNA, 22 nt, Homo sapiens
aaaugcuucuauguggcauguu

SEQ ID NO: 194633 - RNA, 22 nt, Homo sapiens
aaauggcuuuuugggcaaggug

SEQ ID NO: 194634 - RNA, 22 nt, Homo sapiens
aaauucaugucaccucuaggua

SEQ ID NO: 194635 - RNA, 22 nt, Homo sapiens
aaauugcaaugcgaggcagagg

SEQ ID NO: 194636 - RNA, 22 nt, Homo sapiens
aaauugcaguuaggaugauggu

SEQ ID NO: 194637 - RNA, 22 nt, Homo sapiens
aacagucaauugcugaugaccu

SEQ ID NO: 194638 - RNA, 22 nt, Homo sapiens
aaccuacauucuuaacuguugc

SEQ ID NO: 194639 - RNA, 22 nt, Homo sapiens
aacuggccuggcgugcagaggg

SEQ ID NO: 194640 - RNA, 22 nt, Homo sapiens
aagagcauuauuuaguaauuuc

SEQ ID NO: 194641 - RNA, 22 nt, Homo sapiens
aagauaguaaacauuuucugcu

SEQ ID NO: 194642 - RNA, 22 nt, Homo sapiens
aagaugauguucuuuuucuuag

SEQ ID NO: 194643 - RNA, 22 nt, Homo sapiens
aagcaaacaucagcuugguuaa

SEQ ID NO: 194644 - RNA, 22 nt, Homo sapiens
aaggagcaguggacggguccua

SEQ ID NO: 194645 - RNA, 22 nt, Homo sapiens
aaguauuagugaggauauggaa

SEQ ID NO: 194646 - RNA, 19 nt, Homo sapiens
aagugaaugcuuuguucac

SEQ ID NO: 194647 - RNA, 22 nt, Homo sapiens
aauaaagcugaauccuuccuga

SEQ ID NO: 194648 - RNA, 22 nt, Homo sapiens
aauaagcugagagaauucuaca

SEQ ID NO: 194649 - RNA, 22 nt, Homo sapiens
aauacugugauaucgagcgauu

SEQ ID NO: 194650 - RNA, 22 nt, Homo sapiens
aauagcacugcuaugguuugaa

SEQ ID NO: 194651 - RNA, 22 nt, Homo sapiens
aauauagcuauguacaugucca

SEQ ID NO: 194652 - RNA, 22 nt, Homo sapiens
aaucacaggucuuggcugcaug

SEQ ID NO: 194653 - RNA, 22 nt, Homo sapiens
aaucugguguguggccgggcac

SEQ ID NO: 194654 - RNA, 22 nt, Homo sapiens
aauggccuuuuucauuauacug

SEQ ID NO: 194655 - RNA, 22 nt, Homo sapiens
aaugguguuuccguuaagcuga

SEQ ID NO: 194656 - RNA, 22 nt, Homo sapiens
aauugcauaugcaguagaucua

SEQ ID NO: 194657 - RNA, 22 nt, Homo sapiens
aauugcaucuguucuuugccag

SEQ ID NO: 194658 - RNA, 20 nt, Homo sapiens
acaaaugcauucugugacau

SEQ ID NO: 194659 - RNA, 22 nt, Homo sapiens
acaauguauauuuuacuguagg

SEQ ID NO: 194660 - RNA, 22 nt, Homo sapiens
acacuguuuuaguuauuauagc

SEQ ID NO: 194661 - RNA, 22 nt, Homo sapiens
acacuugcuugcaauagccucc

SEQ ID NO: 194662 - RNA, 21 nt, Homo sapiens
acaguaguaauaguguagcca

SEQ ID NO: 194663 - RNA, 18 nt, Homo sapiens
acagugucauggcucaau

SEQ ID NO: 194664 - RNA, 22 nt, Homo sapiens
acauaaagaagcaggacauugu

SEQ ID NO: 194665 - RNA, 23 nt, Homo sapiens
acauguauagacuuuuuuuccuu

SEQ ID NO: 194666 - RNA, 22 nt, Homo sapiens
accaguuuuuuauacaucuucu

SEQ ID NO: 194667 - RNA, 22 nt, Homo sapiens
acccuuaagcacuaguucagcu

SEQ ID NO: 194668 - RNA, 22 nt, Homo sapiens
acugaucaauguuaaggcuuau

SEQ ID NO: 194669 - RNA, 22 nt, Homo sapiens
acugcacuccagccugugagac

SEQ ID NO: 194670 - RNA, 22 nt, Homo sapiens
acugcacuccagccuuggagac

SEQ ID NO: 194671 - RNA, 22 nt, Homo sapiens
acugcacucuagccccugcgac

SEQ ID NO: 194672 - RNA, 22 nt, Homo sapiens
acuguauagauggaguugauuu

SEQ ID NO: 194673 - RNA, 22 nt, Homo sapiens
acuuugguuuauagaauuuagg

SEQ ID NO: 194674 - RNA, 21 nt, Homo sapiens
auugagcacaugaaacauggc

SEQ ID NO: 194675 - RNA, 22 nt, Homo sapiens
auugcacuccagccuugugaca

SEQ ID NO: 194676 - RNA, 22 nt, Homo sapiens
auuggcaauccauauauuuucu

SEQ ID NO: 194677 - RNA, 22 nt, Homo sapiens
auuggguuaaaggauaugaaca

SEQ ID NO: 194678 - RNA, 22 nt, Homo sapiens
auuucacugagacaugugccca

SEQ ID NO: 194679 - RNA, 22 nt, Homo sapiens
caaagcacuuggcuuggaagau

SEQ ID NO: 194680 - RNA, 22 nt, Homo sapiens
caaagugcugggacuggccggg

SEQ ID NO: 194681 - RNA, 22 nt, Homo sapiens
caaauugcuugucuguagugga

SEQ ID NO: 194682 - RNA, 22 nt, Homo sapiens
caaggugcugagacaggagccc

SEQ ID NO: 194683 - RNA, 22 nt, Homo sapiens
caauggcaaugaaauagugaga

SEQ ID NO: 194684 - RNA, 21 nt, Homo sapiens
caauggcacaaucucugcuca

SEQ ID NO: 194685 - RNA, 22 nt, Homo sapiens
caauugcacucuuagguguaca

SEQ ID NO: 194686 - RNA, 22 nt, Homo sapiens
cacaaugucuaagauguuucua

SEQ ID NO: 194687 - RNA, 22 nt, Homo sapiens
cacccgugcucccuccagcugc

SEQ ID NO: 194688 - RNA, 22 nt, Homo sapiens
cacugaaugugagguuggggag

SEQ ID NO: 194689 - RNA, 22 nt, Homo sapiens
cacugcacuccagccuaagagg

SEQ ID NO: 194690 - RNA, 22 nt, Homo sapiens
cacugcacuccagcuugugggc

SEQ ID NO: 194691 - RNA, 22 nt, Homo sapiens
cacugcacuccagucuggcgac

SEQ ID NO: 194692 - RNA, 22 nt, Homo sapiens
cacugcauccuccaccugccag

SEQ ID NO: 194693 - RNA, 22 nt, Homo sapiens
cacugcauccuccauauccugg

SEQ ID NO: 194694 - RNA, 22 nt, Homo sapiens
cacugcauucuccaccucccag

SEQ ID NO: 194695 - RNA, 21 nt, Homo sapiens
cacuggguucaggcuugugga

SEQ ID NO: 194696 - RNA, 22 nt, Homo sapiens
cagagaaugucuuuuuuaacca

SEQ ID NO: 194697 - RNA, 22 nt, Homo sapiens
cagagguauugcaaaagccuag

SEQ ID NO: 194698 - RNA, 22 nt, Homo sapiens
cagauguaguauuuuagugaaa

SEQ ID NO: 194699 - RNA, 22 nt, Homo sapiens
cagugauaggugguuguuggca

SEQ ID NO: 194700 - RNA, 22 nt, Homo sapiens
cagugucugcauuuggaacuca

SEQ ID NO: 194701 - RNA, 22 nt, Homo sapiens
cauagcacugcacuucagccug

SEQ ID NO: 194702 - RNA, 18 nt, Homo sapiens
cauagcacuucagcacau

SEQ ID NO: 194703 - RNA, 21 nt, Homo sapiens
caucacauuacucaaaguccu

SEQ ID NO: 194704 - RNA, 22 nt, Homo sapiens
caugcagcacacaugucugugc

SEQ ID NO: 194705 - RNA, 22 nt, Homo sapiens
cauggagcuaggcuugaucccu

SEQ ID NO: 194706 - RNA, 22 nt, Homo sapiens
cauggcauuucaagauuuacca

SEQ ID NO: 194707 - RNA, 22 nt, Homo sapiens
cauugcauuuucuuuguaccuu

SEQ ID NO: 194708 - RNA, 22 nt, Homo sapiens
ccaagccucaguuucccucugu

SEQ ID NO: 194709 - RNA, 22 nt, Homo sapiens
ccagccgggugcaguggcucac

SEQ ID NO: 194710 - RNA, 21 nt, Homo sapiens
ccaugggacggaaugaauaca

SEQ ID NO: 194711 - RNA, 19 nt, Homo sapiens
ccugcuguucuuuugcacc

SEQ ID NO: 194712 - RNA, 22 nt, Homo sapiens
ccuggaucauugucauucccaa

SEQ ID NO: 194713 - RNA, 22 nt, Homo sapiens
ccuggguuacaggugugagcca

SEQ ID NO: 194714 - RNA, 22 nt, Homo sapiens
ccuucauucauuaauuuagccc

SEQ ID NO: 194715 - RNA, 22 nt, Homo sapiens
ccuuggcacuuugccacagugc

SEQ ID NO: 194716 - RNA, 22 nt, Homo sapiens
cuaaaugucucuacuaaguuua

SEQ ID NO: 194717 - RNA, 22 nt, Homo sapiens
cuaaggaaggacugaaaggaca

SEQ ID NO: 194718 - RNA, 17 nt, Homo sapiens
cuaaggcaagagucugc

SEQ ID NO: 194719 - RNA, 18 nt, Homo sapiens
cuaauacuauucaacaag

SEQ ID NO: 194720 - RNA, 22 nt, Homo sapiens
cuaccuggguggcucaugacuu

SEQ ID NO: 194721 - RNA, 22 nt, Homo sapiens
cuauaacagugugguuuggaga

SEQ ID NO: 194722 - RNA, 22 nt, Homo sapiens
cucacugggaccacucugaagu

SEQ ID NO: 194723 - RNA, 22 nt, Homo sapiens
cucaguguucccauucuaccuu

SEQ ID NO: 194724 - RNA, 22 nt, Homo sapiens
cucaguguuucagcugcucaga

SEQ ID NO: 194725 - RNA, 22 nt, Homo sapiens
cucauggauggucuggcagcca

SEQ ID NO: 194726 - RNA, 22 nt, Homo sapiens
cuccauguggcuaacuuuuaaa

SEQ ID NO: 194727 - RNA, 22 nt, Homo sapiens
cuccauuuaucugaaauuuuau

SEQ ID NO: 194728 - RNA, 22 nt, Homo sapiens
cugaaauguccaucgacugaug

SEQ ID NO: 194729 - RNA, 22 nt, Homo sapiens
cugacuuuagaacccaaaaagu

SEQ ID NO: 194730 - RNA, 22 nt, Homo sapiens
cugagagaggagcuaaaacugc

SEQ ID NO: 194731 - RNA, 22 nt, Homo sapiens
cugagcuagaccacuuggcucc

SEQ ID NO: 194732 - RNA, 22 nt, Homo sapiens
cugagcuaugccuggaaaggca

SEQ ID NO: 194733 - RNA, 22 nt, Homo sapiens
cugauguagguggucugugauc

SEQ ID NO: 194734 - RNA, 21 nt, Homo sapiens
cugcauccauuucugagugau

SEQ ID NO: 194735 - RNA, 22 nt, Homo sapiens
cugggaugauguaaauaggcua

SEQ ID NO: 194736 - RNA, 22 nt, Homo sapiens
cugucacugggaggggcagcag

SEQ ID NO: 194737 - RNA, 22 nt, Homo sapiens
cuuccagcuggguucagucagu

SEQ ID NO: 194738 - RNA, 22 nt, Homo sapiens
cuugacaaugcuucaggcugaa

SEQ ID NO: 194739 - RNA, 22 nt, Homo sapiens
cuugagcaaacaaaggugguag

SEQ ID NO: 194740 - RNA, 22 nt, Homo sapiens
cuugcacauuacagaucugcau

SEQ ID NO: 194741 - RNA, 19 nt, Homo sapiens
cuuguacucggcgcaguug

SEQ ID NO: 194742 - RNA, 22 nt, Homo sapiens
cuuuaguuaaaauugggguugu

SEQ ID NO: 194743 - RNA, 21 nt, Homo sapiens
cuuugcacugcuccucagcuc

SEQ ID NO: 194744 - RNA, 22 nt, Homo sapiens
cuuugguuaauaggauauggca

SEQ ID NO: 194745 - RNA, 22 nt, Homo sapiens
cuuuguguaggugccucuggcu

SEQ ID NO: 194746 - RNA, 22 nt, Homo sapiens
cuuuugcugggucagcgguggu

SEQ ID NO: 194747 - RNA, 22 nt, Homo sapiens
cuuuugugauucuucaguuacu

SEQ ID NO: 194748 - RNA, 22 nt, Homo sapiens
cuuuugugauucuucaguugcu

SEQ ID NO: 194749 - RNA, 22 nt, Homo sapiens
gaaagauuuuaacugggagacu

SEQ ID NO: 194750 - RNA, 22 nt, Homo sapiens
gaaagugcugcuugacugggau

SEQ ID NO: 194751 - RNA, 22 nt, Homo sapiens
gaauaaacuagagaggacugag

SEQ ID NO: 194752 - RNA, 22 nt, Homo sapiens
gaauggaacugacuauagcuga

SEQ ID NO: 194753 - RNA, 22 nt, Homo sapiens
gaauugcacaaaaacugcuugu

SEQ ID NO: 194754 - RNA, 22 nt, Homo sapiens
gacaguuucucaggcuuccuua

SEQ ID NO: 194755 - RNA, 22 nt, Homo sapiens
gacauguaaggcucucucuguu

SEQ ID NO: 194756 - RNA, 22 nt, Homo sapiens
gacugcauuugccccaucgaau

SEQ ID NO: 194757 - RNA, 22 nt, Homo sapiens
gagaacuaaugauguacuaggc

SEQ ID NO: 194758 - RNA, 22 nt, Homo sapiens
gagaacuaaugguuugauaagg

SEQ ID NO: 194759 - RNA, 22 nt, Homo sapiens
gagaaugaacagacugccucuu

SEQ ID NO: 194760 - RNA, 22 nt, Homo sapiens
gagagcaugugcuggcaucagu

SEQ ID NO: 194761 - RNA, 22 nt, Homo sapiens
gagaugucuauuucagagaugu

SEQ ID NO: 194762 - RNA, 22 nt, Homo sapiens
gagguagggucccacuauguug

SEQ ID NO: 194763 - RNA, 22 nt, Homo sapiens
gagguaugauugacauauaaaa

SEQ ID NO: 194764 - RNA, 22 nt, Homo sapiens
gagguaugugggcagacauuua

SEQ ID NO: 194765 - RNA, 22 nt, Homo sapiens
gaguaaaugucaaguacuuagg

SEQ ID NO: 194766 - RNA, 22 nt, Homo sapiens
gaguagugcugcaguaaacaca

SEQ ID NO: 194767 - RNA, 22 nt, Homo sapiens
gaguagugcuguaauaaacaua

SEQ ID NO: 194768 - RNA, 22 nt, Homo sapiens
gagugcaauggcgcgaucuggg

SEQ ID NO: 194769 - RNA, 22 nt, Homo sapiens
gauaaauccagauucugaugua

SEQ ID NO: 194770 - RNA, 22 nt, Homo sapiens
gauaaaucuuggcuagucuaag

SEQ ID NO: 194771 - RNA, 22 nt, Homo sapiens
gauaguugugagaacucuuacu

SEQ ID NO: 194772 - RNA, 22 nt, Homo sapiens
uauugcauuugagguugguuga

SEQ ID NO: 194773 - RNA, 22 nt, Homo sapiens
uauuugauuaacaagagccuaa

SEQ ID NO: 194774 - RNA, 22 nt, Homo sapiens
uauuugauugacuuuagcagga

SEQ ID NO: 194775 - RNA, 22 nt, Homo sapiens
ucaaaugcucuuugcagagagg

SEQ ID NO: 194776 - RNA, 22 nt, Homo sapiens
ucaaaugcuguauuguaguaau

SEQ ID NO: 194777 - RNA, 22 nt, Homo sapiens
ucaaauguucccuguacuggcc

SEQ ID NO: 194778 - RNA, 22 nt, Homo sapiens
ucaaauguuuguuuaaggcuua

SEQ ID NO: 194779 - RNA, 22 nt, Homo sapiens
ucaacugcuugagaucacaaau

SEQ ID NO: 194780 - RNA, 22 nt, Homo sapiens
ucaagaccucacauagaggaga

SEQ ID NO: 194781 - RNA, 22 nt, Homo sapiens
ucaaggcacauuugacauuuuc

SEQ ID NO: 194782 - RNA, 22 nt, Homo sapiens
ucaaggcaguggccuuccuucu

SEQ ID NO: 194783 - RNA, 18 nt, Homo sapiens
ucaauguggauguucuuu

SEQ ID NO: 194784 - RNA, 22 nt, Homo sapiens
ucacaauucucaauuugugaaa

SEQ ID NO: 194785 - RNA, 19 nt, Homo sapiens
ucacacuguggcuucuuua

SEQ ID NO: 194786 - RNA, 22 nt, Homo sapiens
ucacaguagcaaauguuagaaa

SEQ ID NO: 194787 - RNA, 22 nt, Homo sapiens
ucaccaccugcugauuguagag

SEQ ID NO: 194788 - RNA, 20 nt, Homo sapiens
ucacccugacaucugcccag

SEQ ID NO: 194789 - RNA, 22 nt, Homo sapiens
ucacugaaaccuccgccuucug

SEQ ID NO: 194790 - RNA, 22 nt, Homo sapiens
ucacugggagaccaaagccauc

SEQ ID NO: 194791 - RNA, 22 nt, Homo sapiens
ucacugugguuugggaaagugc

SEQ ID NO: 194792 - RNA, 22 nt, Homo sapiens
ucagcguguggacggccaucuu

SEQ ID NO: 194793 - RNA, 22 nt, Homo sapiens
ucagggacuuacaaaccagaag

SEQ ID NO: 194794 - RNA, 19 nt, Homo sapiens
ucaguagugcacauaagcc

SEQ ID NO: 194795 - RNA, 22 nt, Homo sapiens
ucaguuuagguguaacggccac

SEQ ID NO: 194796 - RNA, 22 nt, Homo sapiens
ucauagucuaagguucuuuugc

SEQ ID NO: 194797 - RNA, 22 nt, Homo sapiens
ucauccauacaguuagcaaagg

SEQ ID NO: 194798 - RNA, 22 nt, Homo sapiens
uccacaauggcugaacuagauu

SEQ ID NO: 194799 - RNA, 22 nt, Homo sapiens
uccaccgugggcugcggggcuc

SEQ ID NO: 194800 - RNA, 22 nt, Homo sapiens
uccaugagaauaguuaggcucu

SEQ ID NO: 194801 - RNA, 22 nt, Homo sapiens
uccaugaggcuacaguaaucuc

SEQ ID NO: 194802 - RNA, 22 nt, Homo sapiens
ucccugaaaaauuggcuuaaca

SEQ ID NO: 194803 - RNA, 22 nt, Homo sapiens
ucccugaaaauuagcauuuuaa

SEQ ID NO: 194804 - RNA, 22 nt, Homo sapiens
ucccugaacacauguugagaag

SEQ ID NO: 194805 - RNA, 22 nt, Homo sapiens
ucccugaaucucagguucugua

SEQ ID NO: 194806 - RNA, 22 nt, Homo sapiens
ucccuuuguccaacggauccac

SEQ ID NO: 194807 - RNA, 21 nt, Homo sapiens
uccugagagaggaguaacucu

SEQ ID NO: 194808 - RNA, 22 nt, Homo sapiens
uccuuuaguuaauaaagacaag

SEQ ID NO: 194809 - RNA, 22 nt, Homo sapiens
ucuacagccaguucaggaagaa

SEQ ID NO: 194810 - RNA, 22 nt, Homo sapiens
ucuacccugugagggacacagu

SEQ ID NO: 194811 - RNA, 22 nt, Homo sapiens
ucucccauccaugaacuucugu

SEQ ID NO: 194812 - RNA, 22 nt, Homo sapiens
ucucugguuuucaaagcaguau

SEQ ID NO: 194813 - RNA, 22 nt, Homo sapiens
ucuggcaagagccgagggcagu

SEQ ID NO: 194814 - RNA, 22 nt, Homo sapiens
ucuggccuagaacaauuaauua

SEQ ID NO: 194815 - RNA, 23 nt, Homo sapiens
ucuggcuuugggaugcucaaggg

SEQ ID NO: 194816 - RNA, 22 nt, Homo sapiens
ucuucagucauauuggccugga

SEQ ID NO: 194817 - RNA, 22 nt, Homo sapiens
ucuuggacuuuugugagaaauc

SEQ ID NO: 194818 - RNA, 22 nt, Homo sapiens
ucuuggcaaagaauuuuuggcu

SEQ ID NO: 194819 - RNA, 17 nt, Homo sapiens
ucuugugguucuugaau

SEQ ID NO: 194820 - RNA, 22 nt, Homo sapiens
ucuuugauuuuguuacuaagac

SEQ ID NO: 194821 - RNA, 22 nt, Homo sapiens
ucuuuguucaggagccaacucc

SEQ ID NO: 194822 - RNA, 21 nt, Homo sapiens
ugaaaugcaugugcacauuaa

SEQ ID NO: 194823 - RNA, 22 nt, Homo sapiens
ugaaaugccuugagauuuugac

SEQ ID NO: 194824 - RNA, 22 nt, Homo sapiens
ugaagcuaacuugauugugaug

SEQ ID NO: 194825 - RNA, 20 nt, Homo sapiens
ugaaggaggucauuuauacc

SEQ ID NO: 194826 - RNA, 22 nt, Homo sapiens
ugaagggcauuguuuugccaaa

SEQ ID NO: 194827 - RNA, 22 nt, Homo sapiens
ugaauguaacuaaaggacuuuu

SEQ ID NO: 194828 - RNA, 21 nt, Homo sapiens
ugacagaaaauugaguuugcu

SEQ ID NO: 194829 - RNA, 17 nt, Homo sapiens
ugacagaaacuuguugu

SEQ ID NO: 194830 - RNA, 22 nt, Homo sapiens
ugacaggagauuaugugauguu

SEQ ID NO: 194831 - RNA, 20 nt, Homo sapiens
ugacaucagcaauguaauaa

SEQ ID NO: 194832 - RNA, 22 nt, Homo sapiens
ugacuaaaacugaguuucauua

SEQ ID NO: 194833 - RNA, 22 nt, Homo sapiens
ugacuacagauuugcugccaga

SEQ ID NO: 194834 - RNA, 17 nt, Homo sapiens
ugacuagugcccuuauu

SEQ ID NO: 194835 - RNA, 22 nt, Homo sapiens
ugagaacugccuguauuuaucu

SEQ ID NO: 194836 - RNA, 22 nt, Homo sapiens
ugagagacagacauuaucuuau

SEQ ID NO: 194837 - RNA, 22 nt, Homo sapiens
ugagagacaguuucgucggagg

SEQ ID NO: 194838 - RNA, 22 nt, Homo sapiens
ugagagaugaacucugauaugu

SEQ ID NO: 194839 - RNA, 22 nt, Homo sapiens
ugagaugacgacacaccucagu

SEQ ID NO: 194840 - RNA, 21 nt, Homo sapiens
ugagauuauauuaacauggua

SEQ ID NO: 194841 - RNA, 22 nt, Homo sapiens
ugagcauuguuuggacuuggau

SEQ ID NO: 194842 - RNA, 22 nt, Homo sapiens
ugagguaacaaacuaugaguua

SEQ ID NO: 194843 - RNA, 22 nt, Homo sapiens
ugagguaaugcuguagcuguga

SEQ ID NO: 194844 - RNA, 22 nt, Homo sapiens
ugagguguuaacuuuacuuuua

SEQ ID NO: 194845 - RNA, 22 nt, Homo sapiens
ugagucauuuccuuaugcuacu

SEQ ID NO: 194846 - RNA, 22 nt, Homo sapiens
ugaguucauggucauuugucac

SEQ ID NO: 194847 - RNA, 22 nt, Homo sapiens
ugauauauugaaugaugaaaca

SEQ ID NO: 194848 - RNA, 22 nt, Homo sapiens
ugaugguaguucagucaaugua

SEQ ID NO: 194849 - RNA, 22 nt, Homo sapiens
ugaugugucaucugagagagug

SEQ ID NO: 194850 - RNA, 22 nt, Homo sapiens
ugauguguuuuguaguucaacu

SEQ ID NO: 194851 - RNA, 22 nt, Homo sapiens
ugcaagcacacccagggauugu

SEQ ID NO: 194852 - RNA, 22 nt, Homo sapiens
ugcaauauccucuacuauaggu

SEQ ID NO: 194853 - RNA, 22 nt, Homo sapiens
ugcauauguugaaccagccuug

SEQ ID NO: 194854 - RNA, 22 nt, Homo sapiens
ugcauggaagggagggaaagag

SEQ ID NO: 194855 - RNA, 21 nt, Homo sapiens
ugcaugguagucacaugauuc

SEQ ID NO: 194856 - RNA, 22 nt, Homo sapiens
ugccaucauuaauauuaggcau

SEQ ID NO: 194857 - RNA, 20 nt, Homo sapiens
ugccugacacucuuugcuuc

SEQ ID NO: 194858 - RNA, 22 nt, Homo sapiens
ugccugagccagguuuuaggag

SEQ ID NO: 194859 - RNA, 22 nt, Homo sapiens
ugcgaucuuuuuccuuguuccu

SEQ ID NO: 194860 - RNA, 22 nt, Homo sapiens
ugcuauagcuauaucaucuccu

SEQ ID NO: 194861 - RNA, 18 nt, Homo sapiens
ugcuccccugggugagca

SEQ ID NO: 194862 - RNA, 22 nt, Homo sapiens
ugcugcaaacaggcaucugugg

SEQ ID NO: 194863 - RNA, 22 nt, Homo sapiens
ugcugcauuggggauuaaguuu

SEQ ID NO: 194864 - RNA, 22 nt, Homo sapiens
ugcuuaguuguauguuccacau

SEQ ID NO: 194865 - RNA, 22 nt, Homo sapiens
uggaagccuagauucuuuucuu

SEQ ID NO: 194866 - RNA, 22 nt, Homo sapiens
uggaauuuagguugauaguaua

SEQ ID NO: 194867 - RNA, 21 nt, Homo sapiens
uggcaaaaugggcaguggguu

SEQ ID NO: 194868 - RNA, 22 nt, Homo sapiens
uggcaaagugugacgugggggu

SEQ ID NO: 194869 - RNA, 22 nt, Homo sapiens
uggcaacaucuggggacauguu

SEQ ID NO: 194870 - RNA, 22 nt, Homo sapiens
uuggcauuuuggacacccagga

SEQ ID NO: 194871 - RNA, 22 nt, Homo sapiens
uuggccagugucuuuuuuuccu

SEQ ID NO: 194872 - RNA, 22 nt, Homo sapiens
uuggccccuccaaaucucaugu

SEQ ID NO: 194873 - RNA, 23 nt, Homo sapiens
uugggcaaaucacugagggcaga

SEQ ID NO: 194874 - RNA, 22 nt, Homo sapiens
uugggcauugggcuaaacuccc

SEQ ID NO: 194875 - RNA, 22 nt, Homo sapiens
uugguaagguggaugaugaaua

SEQ ID NO: 194876 - RNA, 19 nt, Homo sapiens
uugguugguuauuucuuac

SEQ ID NO: 194877 - RNA, 22 nt, Homo sapiens
uuguauaggcucaguaagaauc

SEQ ID NO: 194878 - RNA, 22 nt, Homo sapiens
uuguauaguucuauguguuuug

SEQ ID NO: 194879 - RNA, 22 nt, Homo sapiens
uugucaccucuaaaucucauau

SEQ ID NO: 194880 - RNA, 22 nt, Homo sapiens
uugugguuauagagucucccug

SEQ ID NO: 194881 - RNA, 22 nt, Homo sapiens
uugugguuuucagcuuauauau

SEQ ID NO: 194882 - RNA, 22 nt, Homo sapiens
uuguucccuucuggcuuuuaug

SEQ ID NO: 194883 - RNA, 22 nt, Homo sapiens
uuuaaaguuagaaggaaagggc

SEQ ID NO: 194884 - RNA, 22 nt, Homo sapiens
uuuaaugcugcccagucauggg

SEQ ID NO: 194885 - RNA, 22 nt, Homo sapiens
uuuauccagccucuagcaaggu

SEQ ID NO: 194886 - RNA, 22 nt, Homo sapiens
uuuauucggcuaggagcuucgg

SEQ ID NO: 194887 - RNA, 22 nt, Homo sapiens
uuucauggacgcaaugccuuuu

SEQ ID NO: 194888 - RNA, 22 nt, Homo sapiens
uuucauguuuuucugugaggca

SEQ ID NO: 194889 - RNA, 22 nt, Homo sapiens
uuucccauuguucugcucugug

SEQ ID NO: 194890 - RNA, 17 nt, Homo sapiens
uuucucagcccucuucu

SEQ ID NO: 194891 - RNA, 22 nt, Homo sapiens
uuucugcuugagagaauugcug

SEQ ID NO: 194892 - RNA, 22 nt, Homo sapiens
uuugaauguaaugagcaggaag

SEQ ID NO: 194893 - RNA, 22 nt, Homo sapiens
uuugagguguauggcaaguuga

SEQ ID NO: 194894 - RNA, 22 nt, Homo sapiens
uuugaguuugaggugcugauga

SEQ ID NO: 194895 - RNA, 22 nt, Homo sapiens
uuugcuuaguaaauguagaaaa

SEQ ID NO: 194896 - RNA, 22 nt, Homo sapiens
uuugguaauguuucauugcaga

SEQ ID NO: 194897 - RNA, 22 nt, Homo sapiens
uuuguccugccaugguuuauuu

SEQ ID NO: 194898 - RNA, 22 nt, Homo sapiens
uuugugcugcaauuaauuuccc

SEQ ID NO: 194899 - RNA, 22 nt, Homo sapiens
uuuguucuucguuccugagcca

SEQ ID NO: 194900 - RNA, 22 nt, Homo sapiens
uuuuaacagccaggggacggcc

SEQ ID NO: 194901 - RNA, 20 nt, Homo sapiens
uuuuagcuuuuauugaaagc

SEQ ID NO: 194902 - RNA, 22 nt, Homo sapiens
uuuuaugggcuauuugcauuag

SEQ ID NO: 194903 - RNA, 22 nt, Homo sapiens
uuuugcaggcauuggaaguuua

SEQ ID NO: 194904 - RNA, 22 nt, Homo sapiens
uuuugcuugugaauagccacau

SEQ ID NO: 194905 - RNA, 22 nt, Homo sapiens
uuuuggcuuaaagagaauguau

SEQ ID NO: 194906 - RNA, 22 nt, Homo sapiens
uuuuggugguuaugugucaaug

SEQ ID NO: 194907 - RNA, 18 nt, Homo sapiens
aaacagugucucuuucug

SEQ ID NO: 194908 - RNA, 22 nt, Homo sapiens
aaagucuguuacagcuauuucu

SEQ ID NO: 194909 - RNA, 22 nt, Homo sapiens
aaagugcugagauuguaggcau

SEQ ID NO: 194910 - RNA, 22 nt, Homo sapiens
aaagugcugggaucacacugaa

SEQ ID NO: 194911 - RNA, 22 nt, Homo sapiens
aaagugcugggauuaggccagg

SEQ ID NO: 194912 - RNA, 22 nt, Homo sapiens
aaagugcuguagacugggcgca

SEQ ID NO: 194913 - RNA, 22 nt, Homo sapiens
aaaugcagauucugcuuagguu

SEQ ID NO: 194914 - RNA, 22 nt, Homo sapiens
aaaugcaguugguggggauaug

SEQ ID NO: 194915 - RNA, 22 nt, Homo sapiens
aaaugcugcuuuggccucuucu

SEQ ID NO: 194916 - RNA, 22 nt, Homo sapiens
aagagcauuggauggggagauu

SEQ ID NO: 194917 - RNA, 22 nt, Homo sapiens
aagagguaggaaauggucauuu

SEQ ID NO: 194918 - RNA, 23 nt, Homo sapiens
aagagguaugacuaugaagugga

SEQ ID NO: 194919 - RNA, 22 nt, Homo sapiens
aagaugguauuucauuaguuuu

SEQ ID NO: 194920 - RNA, 22 nt, Homo sapiens
aagcaucauuuggaauuugaga

SEQ ID NO: 194921 - RNA, 22 nt, Homo sapiens
aagccacuguaccugucucuua

SEQ ID NO: 194922 - RNA, 22 nt, Homo sapiens
aagcuggauuucgcauccuguu

SEQ ID NO: 194923 - RNA, 23 nt, Homo sapiens
aaggacacugaacacuucccagc

SEQ ID NO: 194924 - RNA, 22 nt, Homo sapiens
aaguaaacauugagagacaaga

SEQ ID NO: 194925 - RNA, 22 nt, Homo sapiens
aaguaauggaguuauuuuauga

SEQ ID NO: 194926 - RNA, 22 nt, Homo sapiens
aaguagcuggaugcaguggcac

SEQ ID NO: 194927 - RNA, 22 nt, Homo sapiens
aagugccauguggaugggcccu

SEQ ID NO: 194928 - RNA, 20 nt, Homo sapiens
aagugcuauuucuuuugugg

SEQ ID NO: 194929 - RNA, 22 nt, Homo sapiens
aauaaagcagcuuuuugggacu

SEQ ID NO: 194930 - RNA, 22 nt, Homo sapiens
aauaaagcaggguccuugcacu

SEQ ID NO: 194931 - RNA, 22 nt, Homo sapiens
aauaaagcauggcuacuccaua

SEQ ID NO: 194932 - RNA, 22 nt, Homo sapiens
aauaaagcuuugagcuuugcug

SEQ ID NO: 194933 - RNA, 19 nt, Homo sapiens
aauaaugccagaugucugu

SEQ ID NO: 194934 - RNA, 22 nt, Homo sapiens
aauacugaaaguauuuucaaau

SEQ ID NO: 194935 - RNA, 22 nt, Homo sapiens
aauaugucugcuaauuguuucu

SEQ ID NO: 194936 - RNA, 22 nt, Homo sapiens
aauggcaaauguuuucuguuga

SEQ ID NO: 194937 - RNA, 22 nt, Homo sapiens
aauugcauaaaauucaacucug

SEQ ID NO: 194938 - RNA, 22 nt, Homo sapiens
aauugcuuuuauuuagggccag

SEQ ID NO: 194939 - RNA, 17 nt, Homo sapiens
acaaauugccagcuagg

SEQ ID NO: 194940 - RNA, 22 nt, Homo sapiens
acacauacacauaugguguaua

SEQ ID NO: 194941 - RNA, 22 nt, Homo sapiens
acacuauugagguuuguuugca

SEQ ID NO: 194942 - RNA, 19 nt, Homo sapiens
acagcugguuuugguuucu

SEQ ID NO: 194943 - RNA, 20 nt, Homo sapiens
acaguagaagggauuucaaa

SEQ ID NO: 194944 - RNA, 22 nt, Homo sapiens
acauaguagacacugaaaauau

SEQ ID NO: 194945 - RNA, 17 nt, Homo sapiens
acaugagacuggauucu

SEQ ID NO: 194946 - RNA, 22 nt, Homo sapiens
acaugcauggcaugcauuguac

SEQ ID NO: 194947 - RNA, 21 nt, Homo sapiens
acauguacacauguaugcaca

SEQ ID NO: 194948 - RNA, 22 nt, Homo sapiens
acauucagcuguuguuucaaug

SEQ ID NO: 194949 - RNA, 17 nt, Homo sapiens
accagugcaugugcuuu

SEQ ID NO: 194950 - RNA, 22 nt, Homo sapiens
acccagaagucauucaggaaca

SEQ ID NO: 194951 - RNA, 22 nt, Homo sapiens
acccaguguucaacauucacau

SEQ ID NO: 194952 - RNA, 17 nt, Homo sapiens
accccuaccucagaagc

SEQ ID NO: 194953 - RNA, 22 nt, Homo sapiens
acccuggaggucuacagugcag

SEQ ID NO: 194954 - RNA, 22 nt, Homo sapiens
acccuugaguguguuucaggca

SEQ ID NO: 194955 - RNA, 22 nt, Homo sapiens
acuccauuuggacucugggagg

SEQ ID NO: 194956 - RNA, 22 nt, Homo sapiens
acugcacuccagcccaggugac

SEQ ID NO: 194957 - RNA, 22 nt, Homo sapiens
acugcacuccagcccgggugac

SEQ ID NO: 194958 - RNA, 22 nt, Homo sapiens
acugcacuccagccucggugac

SEQ ID NO: 194959 - RNA, 22 nt, Homo sapiens
acugcacuccagccucgugaca

SEQ ID NO: 194960 - RNA, 22 nt, Homo sapiens
acugcacuccagccucguggac

SEQ ID NO: 194961 - RNA, 20 nt, Homo sapiens
acugcacuccagccuuccag

SEQ ID NO: 194962 - RNA, 18 nt, Homo sapiens
acugcacuccauccuagg

SEQ ID NO: 194963 - RNA, 22 nt, Homo sapiens
agaauaauguccccccaaggga

SEQ ID NO: 194964 - RNA, 22 nt, Homo sapiens
agagacauugcuccaacucacc

SEQ ID NO: 194965 - RNA, 22 nt, Homo sapiens
agagccacacucuccuaacuca

SEQ ID NO: 194966 - RNA, 22 nt, Homo sapiens
agagguagaagauaggcuacag

SEQ ID NO: 194967 - RNA, 22 nt, Homo sapiens
cucauggaauacuucacagcca

SEQ ID NO: 194968 - RNA, 22 nt, Homo sapiens
cuccaugagauuguugaaguag

SEQ ID NO: 194969 - RNA, 22 nt, Homo sapiens
cugaaagagcauguaacacagu

SEQ ID NO: 194970 - RNA, 22 nt, Homo sapiens
cugacagaugacugccacugua

SEQ ID NO: 194971 - RNA, 22 nt, Homo sapiens
cugagagaugagaccucucacu

SEQ ID NO: 194972 - RNA, 22 nt, Homo sapiens
cugagaguugaugaaauauggu

SEQ ID NO: 194973 - RNA, 22 nt, Homo sapiens
cugaggcacggcgaccuuaagu

SEQ ID NO: 194974 - RNA, 22 nt, Homo sapiens
cugaggguagaaggaucacuug

SEQ ID NO: 194975 - RNA, 22 nt, Homo sapiens
cugagguacugggggccaggau

SEQ ID NO: 194976 - RNA, 19 nt, Homo sapiens
cugcaugagacaguugguu

SEQ ID NO: 194977 - RNA, 22 nt, Homo sapiens
cugcuauauugguucaggcuug

SEQ ID NO: 194978 - RNA, 22 nt, Homo sapiens
cuggcagucugccucuucacug

SEQ ID NO: 194979 - RNA, 22 nt, Homo sapiens
cuggcgagacagcuccaucacu

SEQ ID NO: 194980 - RNA, 22 nt, Homo sapiens
cugguuguuacaugcuugccag

SEQ ID NO: 194981 - RNA, 22 nt, Homo sapiens
cuguaguuagcagaugaugaau

SEQ ID NO: 194982 - RNA, 22 nt, Homo sapiens
cugucuggaguccuucgugugc

SEQ ID NO: 194983 - RNA, 22 nt, Homo sapiens
cuguucaaauuguuugugaagu

SEQ ID NO: 194984 - RNA, 22 nt, Homo sapiens
cuuaagcauugacuuuggacag

SEQ ID NO: 194985 - RNA, 21 nt, Homo sapiens
cuucuuggggcagggcagggu

SEQ ID NO: 194986 - RNA, 22 nt, Homo sapiens
cuuguguuacauauuuaagaga

SEQ ID NO: 194987 - RNA, 22 nt, Homo sapiens
cuuuaguugucuccucaagggu

SEQ ID NO: 194988 - RNA, 18 nt, Homo sapiens
cuuugcagcuuccagagg

SEQ ID NO: 194989 - RNA, 22 nt, Homo sapiens
gaagaacuaggugagaucuaga

SEQ ID NO: 194990 - RNA, 22 nt, Homo sapiens
gaagcauugauccacaggcgug

SEQ ID NO: 194991 - RNA, 22 nt, Homo sapiens
gaaguaggugcuguuauuaucu

SEQ ID NO: 194992 - RNA, 22 nt, Homo sapiens
gaagugcuuuuggacuaacagu

SEQ ID NO: 194993 - RNA, 22 nt, Homo sapiens
gacaaguuugauuuauuccaag

SEQ ID NO: 194994 - RNA, 22 nt, Homo sapiens
gagaaccauuuggagaaaaagu

SEQ ID NO: 194995 - RNA, 22 nt, Homo sapiens
gagaugguacacauacgauucu

SEQ ID NO: 194996 - RNA, 22 nt, Homo sapiens
gagcuaguguuuacuugccacu

SEQ ID NO: 194997 - RNA, 22 nt, Homo sapiens
gaggcauuauucccaucuuaca

SEQ ID NO: 194998 - RNA, 22 nt, Homo sapiens
gaggcauugaagauauggaagu

SEQ ID NO: 194999 - RNA, 22 nt, Homo sapiens
gagguagguacaauugccacca

SEQ ID NO: 195000 - RNA, 22 nt, Homo sapiens
gaguaaauguccuagcuucuug

SEQ ID NO: 195001 - RNA, 22 nt, Homo sapiens
gaguucaaaucucagcucuguu

SEQ ID NO: 195002 - RNA, 22 nt, Homo sapiens
gaguuccuuugagccugagagg

SEQ ID NO: 195003 - RNA, 22 nt, Homo sapiens
gauaaaguauuggguacuaugc

SEQ ID NO: 195004 - RNA, 22 nt, Homo sapiens
gauacaguaugcaugugguauu

SEQ ID NO: 195005 - RNA, 22 nt, Homo sapiens
gauauuacuuccaauauugcaa

SEQ ID NO: 195006 - RNA, 22 nt, Homo sapiens
gaucaauuggcugaagacacgu

SEQ ID NO: 195007 - RNA, 22 nt, Homo sapiens
gauggcauuucuggaucugccc

SEQ ID NO: 195008 - RNA, 22 nt, Homo sapiens
gauguaggugcauuugcacgug

SEQ ID NO: 195009 - RNA, 22 nt, Homo sapiens
gauuccauugcgaauuuucaga

SEQ ID NO: 195010 - RNA, 22 nt, Homo sapiens
gcacaggguuacauucuaaggu

SEQ ID NO: 195011 - RNA, 22 nt, Homo sapiens
gcaccguggaguauggggagga

SEQ ID NO: 195012 - RNA, 22 nt, Homo sapiens
gcacgugcucauuugaggucuu

SEQ ID NO: 195013 - RNA, 22 nt, Homo sapiens
gcagaauugguuucuucuaagg

SEQ ID NO: 195014 - RNA, 22 nt, Homo sapiens
gcagaucuucgcgguaaguguu

SEQ ID NO: 195015 - RNA, 22 nt, Homo sapiens
gcagcacaugacuguauguaua

SEQ ID NO: 195016 - RNA, 22 nt, Homo sapiens
gcagcacauggcagaacauauu

SEQ ID NO: 195017 - RNA, 22 nt, Homo sapiens
gcagguauuagagagccugaaa

SEQ ID NO: 195018 - RNA, 22 nt, Homo sapiens
gcaugacaaugauugcucuuca

SEQ ID NO: 195019 - RNA, 22 nt, Homo sapiens
gcauugcacuuggcauagacug

SEQ ID NO: 195020 - RNA, 22 nt, Homo sapiens
gccugagaggauaugauccccu

SEQ ID NO: 195021 - RNA, 22 nt, Homo sapiens
gcgguuuuaagugaguuucuua

SEQ ID NO: 195022 - RNA, 22 nt, Homo sapiens
gcuaugucuguugcucuugggc

SEQ ID NO: 195023 - RNA, 22 nt, Homo sapiens
gcucaugggcagugugauuguu

SEQ ID NO: 195024 - RNA, 22 nt, Homo sapiens
gcugcuguuauucaucagaacu

SEQ ID NO: 195025 - RNA, 22 nt, Homo sapiens
gcuguguguuaucagaaauugc

SEQ ID NO: 195026 - RNA, 23 nt, Homo sapiens
ggaaacauccagucuuucaccau

SEQ ID NO: 195027 - RNA, 22 nt, Homo sapiens
ggaaaguaacccauucucuuac

SEQ ID NO: 195028 - RNA, 20 nt, Homo sapiens
ggaagagugacacaagguau

SEQ ID NO: 195029 - RNA, 22 nt, Homo sapiens
ggagauuauuaguguuucaugc

SEQ ID NO: 195030 - RNA, 22 nt, Homo sapiens
ggauugugauaauuguugcaaa

SEQ ID NO: 195031 - RNA, 22 nt, Homo sapiens
ggcaaaaucgcaauuacuuuug

SEQ ID NO: 195032 - RNA, 22 nt, Homo sapiens
ggcaagaggagauucugcuccc

SEQ ID NO: 195033 - RNA, 22 nt, Homo sapiens
ggcaagaucuuggcucacugaa

SEQ ID NO: 195034 - RNA, 22 nt, Homo sapiens
ggcaauauauucugaauucagu

SEQ ID NO: 195035 - RNA, 22 nt, Homo sapiens
ggcauuguccaauuucugcccu

SEQ ID NO: 195036 - RNA, 22 nt, Homo sapiens
ggugagaaaaacauagucucag

SEQ ID NO: 195037 - RNA, 22 nt, Homo sapiens
guaacagucucaacaguggucu

SEQ ID NO: 195038 - RNA, 22 nt, Homo sapiens
guaagugauagaauuaggauuc

SEQ ID NO: 195039 - RNA, 22 nt, Homo sapiens
guaaucucagcuccucaugagg

SEQ ID NO: 195040 - RNA, 22 nt, Homo sapiens
guacaguuuagugcuuugagaa

SEQ ID NO: 195041 - RNA, 22 nt, Homo sapiens
guaguuuaucagaaagaauagg

SEQ ID NO: 195042 - RNA, 21 nt, Homo sapiens
guauggcauugauuaguuacu

SEQ ID NO: 195043 - RNA, 22 nt, Homo sapiens
gucagugccugucccaggcuuu

SEQ ID NO: 195044 - RNA, 22 nt, Homo sapiens
gucagugugauaucugcagggg

SEQ ID NO: 195045 - RNA, 22 nt, Homo sapiens
gucugguugacagcauguggcc

SEQ ID NO: 195046 - RNA, 22 nt, Homo sapiens
gucuguuugauccagaucaaaa

SEQ ID NO: 195047 - RNA, 22 nt, Homo sapiens
gucuguuuggggaccuguggcc

SEQ ID NO: 195048 - RNA, 22 nt, Homo sapiens
gucuuugagauaggguuauuuu

SEQ ID NO: 195049 - RNA, 22 nt, Homo sapiens
gucuuugaugucuaugugcuuc

SEQ ID NO: 195050 - RNA, 22 nt, Homo sapiens
gugagcauucaaggaaggagcu

SEQ ID NO: 195051 - RNA, 22 nt, Homo sapiens
gugauaguucuuacuccaaagu

SEQ ID NO: 195052 - RNA, 22 nt, Homo sapiens
gugauuguuaaacugccucucu

SEQ ID NO: 195053 - RNA, 22 nt, Homo sapiens
gugccacugcaccuggccuaag

SEQ ID NO: 195054 - RNA, 22 nt, Homo sapiens
gugcuuguguuaauauguagcu

SEQ ID NO: 195055 - RNA, 22 nt, Homo sapiens
guggcuuguaggggucaaggga

SEQ ID NO: 195056 - RNA, 22 nt, Homo sapiens
guguaaaucaaucuguugucuu

SEQ ID NO: 195057 - RNA, 22 nt, Homo sapiens
guguaugugagaaugcucaugu

SEQ ID NO: 195058 - RNA, 22 nt, Homo sapiens
gugugauuauuucaauugaugc

SEQ ID NO: 195059 - RNA, 22 nt, Homo sapiens
guuauguuaguuacaaggcuag

SEQ ID NO: 195060 - RNA, 22 nt, Homo sapiens
guucaguuuugaaauguuaauu

SEQ ID NO: 195061 - RNA, 22 nt, Homo sapiens
guucccaguugaaaugauuagu

SEQ ID NO: 195062 - RNA, 22 nt, Homo sapiens
guugagcaagcuuuggagccua

SEQ ID NO: 195063 - RNA, 18 nt, Homo sapiens
uaaauugcuucaccugag

SEQ ID NO: 195064 - RNA, 22 nt, Homo sapiens
ucacaguuggccuggccuuuua

SEQ ID NO: 195065 - RNA, 22 nt, Homo sapiens
ucacaugggugcaauauaauca

SEQ ID NO: 195066 - RNA, 22 nt, Homo sapiens
ucacuaaagaaaauggcaugga

SEQ ID NO: 195067 - RNA, 22 nt, Homo sapiens
ucacuuuggguacuauggaaau

SEQ ID NO: 195068 - RNA, 22 nt, Homo sapiens
ucagaauguaacuuuaguugga

SEQ ID NO: 195069 - RNA, 22 nt, Homo sapiens
ucagaguagcugucugaggugc

SEQ ID NO: 195070 - RNA, 22 nt, Homo sapiens
ucagaucaguuccacaagaacu

SEQ ID NO: 195071 - RNA, 22 nt, Homo sapiens
ucagaugauucuguuguugugu

SEQ ID NO: 195072 - RNA, 22 nt, Homo sapiens
ucagauuggugcaaaaguaauu

SEQ ID NO: 195073 - RNA, 22 nt, Homo sapiens
ucagcaccauguaacaauugau

SEQ ID NO: 195074 - RNA, 22 nt, Homo sapiens
ucaggcacuaguaagaaaaagg

SEQ ID NO: 195075 - RNA, 22 nt, Homo sapiens
ucaguaguaaauggauuuggaa

SEQ ID NO: 195076 - RNA, 22 nt, Homo sapiens
ucaguaguuccaguggguauuu

SEQ ID NO: 195077 - RNA, 23 nt, Homo sapiens
ucagugucuggauccugcucagu

SEQ ID NO: 195078 - RNA, 22 nt, Homo sapiens
ucauauguaugugcaauuuugu

SEQ ID NO: 195079 - RNA, 22 nt, Homo sapiens
ucaugagacacacuggaaagga

SEQ ID NO: 195080 - RNA, 23 nt, Homo sapiens
ucaugaggccauucaaauccauu

SEQ ID NO: 195081 - RNA, 20 nt, Homo sapiens
ucaugccacugcgcuccagc

SEQ ID NO: 195082 - RNA, 20 nt, Homo sapiens
uccaguuuuggagacauucu

SEQ ID NO: 195083 - RNA, 22 nt, Homo sapiens
uccauuuguagguagugagaca

SEQ ID NO: 195084 - RNA, 22 nt, Homo sapiens
uccauuugucuauguuucuguu

SEQ ID NO: 195085 - RNA, 22 nt, Homo sapiens
uccccaguaggcaauuaacacc

SEQ ID NO: 195086 - RNA, 20 nt, Homo sapiens
ucccuaagagccuuuccuuc

SEQ ID NO: 195087 - RNA, 22 nt, Homo sapiens
uccugagacucacaggcucccc

SEQ ID NO: 195088 - RNA, 20 nt, Homo sapiens
ucgcaccacuauacuccagc

SEQ ID NO: 195089 - RNA, 22 nt, Homo sapiens
ucgugccacugcacuccagccu

SEQ ID NO: 195090 - RNA, 22 nt, Homo sapiens
ucuaguaaugagaggcaggaga

SEQ ID NO: 195091 - RNA, 22 nt, Homo sapiens
ucucauggagguagagaguaaa

SEQ ID NO: 195092 - RNA, 22 nt, Homo sapiens
ucucauggagucaggagcagaa

SEQ ID NO: 195093 - RNA, 22 nt, Homo sapiens
ucucauggcucacccugcauag

SEQ ID NO: 195094 - RNA, 20 nt, Homo sapiens
ucucccaaacagcaggcccu

SEQ ID NO: 195095 - RNA, 22 nt, Homo sapiens
ucucuuggugacuuaaaauguu

SEQ ID NO: 195096 - RNA, 22 nt, Homo sapiens
ucugacagugugaauauugacu

SEQ ID NO: 195097 - RNA, 22 nt, Homo sapiens
ucugagcaauagauguggauau

SEQ ID NO: 195098 - RNA, 22 nt, Homo sapiens
ucugaguggcagaaugagcuga

SEQ ID NO: 195099 - RNA, 22 nt, Homo sapiens
ucuggcuuugugaguugccaga

SEQ ID NO: 195100 - RNA, 22 nt, Homo sapiens
ucuggcuuuuaacaucuauaaa

SEQ ID NO: 195101 - RNA, 23 nt, Homo sapiens
ucuuguacuuugagugagcaugg

SEQ ID NO: 195102 - RNA, 22 nt, Homo sapiens
ucuuugucuacauccuguuaaa

SEQ ID NO: 195103 - RNA, 22 nt, Homo sapiens
ugaaagacugaagaauaggcau

SEQ ID NO: 195104 - RNA, 22 nt, Homo sapiens
ugaagacucaguuugagggaca

SEQ ID NO: 195105 - RNA, 22 nt, Homo sapiens
ugaauguaagaugucugcuggu

SEQ ID NO: 195106 - RNA, 22 nt, Homo sapiens
ugacaacugauuaacuccuuua

SEQ ID NO: 195107 - RNA, 22 nt, Homo sapiens
ugacuacacacaauuugucaag

SEQ ID NO: 195108 - RNA, 22 nt, Homo sapiens
ugacuacaccacacgguuaagg

SEQ ID NO: 195109 - RNA, 22 nt, Homo sapiens
ugacuacaggucaggaagcugu

SEQ ID NO: 195110 - RNA, 22 nt, Homo sapiens
ugacuagucauaggcauggggg

SEQ ID NO: 195111 - RNA, 22 nt, Homo sapiens
ugacucuagagcugccuguggc

SEQ ID NO: 195112 - RNA, 22 nt, Homo sapiens
ugagaacucaugaaucuuucca

SEQ ID NO: 195113 - RNA, 22 nt, Homo sapiens
ugagaacucaugggucugcugg

SEQ ID NO: 195114 - RNA, 22 nt, Homo sapiens
ugagaagaugaacuccuugguc

SEQ ID NO: 195115 - RNA, 22 nt, Homo sapiens
caugaaagugagaaacuccugg

SEQ ID NO: 195116 - RNA, 22 nt, Homo sapiens
caugccauugcucuccugggug

SEQ ID NO: 195117 - RNA, 22 nt, Homo sapiens
cauggcacuguaugaaaugugc

SEQ ID NO: 195118 - RNA, 22 nt, Homo sapiens
caugggacugucuuggcuauac

SEQ ID NO: 195119 - RNA, 22 nt, Homo sapiens
caugugcaugcuuucuuaugug

SEQ ID NO: 195120 - RNA, 20 nt, Homo sapiens
cauuacacuccaaccugggu

SEQ ID NO: 195121 - RNA, 22 nt, Homo sapiens
cauugcaaugaggucuugcagu

SEQ ID NO: 195122 - RNA, 22 nt, Homo sapiens
cauugcauuccagucugggcaa

SEQ ID NO: 195123 - RNA, 22 nt, Homo sapiens
cauugguuggacaguucucucu

SEQ ID NO: 195124 - RNA, 22 nt, Homo sapiens
ccaagugcuuaaaauuucauuu

SEQ ID NO: 195125 - RNA, 22 nt, Homo sapiens
ccacacugucuuggugggaaac

SEQ ID NO: 195126 - RNA, 22 nt, Homo sapiens
ccaguuuuucauuuauacuagu

SEQ ID NO: 195127 - RNA, 22 nt, Homo sapiens
ccaucacacugugauuauuauc

SEQ ID NO: 195128 - RNA, 22 nt, Homo sapiens
ccauggcaauggucagucuauu

SEQ ID NO: 195129 - RNA, 18 nt, Homo sapiens
ccauucaacagauuuguc

SEQ ID NO: 195130 - RNA, 22 nt, Homo sapiens
ccccagguuucaauaaagccca

SEQ ID NO: 195131 - RNA, 23 nt, Homo sapiens
ccgugagagaguucauagaaagc

SEQ ID NO: 195132 - RNA, 22 nt, Homo sapiens
ccucauugcuaucccaggcuga

SEQ ID NO: 195133 - RNA, 22 nt, Homo sapiens
ccuggcaagagacugaagauag

SEQ ID NO: 195134 - RNA, 22 nt, Homo sapiens
ccuguguuaugguuucuaaugu

SEQ ID NO: 195135 - RNA, 22 nt, Homo sapiens
cuaaaggaaucugagccccuga

SEQ ID NO: 195136 - RNA, 22 nt, Homo sapiens
cuacagcacugagcugugugca

SEQ ID NO: 195137 - RNA, 22 nt, Homo sapiens
cuacaguuauguuuuaaaugug

SEQ ID NO: 195138 - RNA, 22 nt, Homo sapiens
cuagcuuuuuaugacaaucuug

SEQ ID NO: 195139 - RNA, 22 nt, Homo sapiens
cuaguaaugucugucuuaugga

SEQ ID NO: 195140 - RNA, 22 nt, Homo sapiens
cuauauacugccugcugauuag

SEQ ID NO: 195141 - RNA, 19 nt, Homo sapiens
cuaugaccaugugauuuuu

SEQ ID NO: 195142 - RNA, 22 nt, Homo sapiens
cuauggcuguaaggauaguaac

SEQ ID NO: 195143 - RNA, 22 nt, Homo sapiens
cuauggcuguagucccugugua

SEQ ID NO: 195144 - RNA, 22 nt, Homo sapiens
cucaaguaauccucccgccuug

SEQ ID NO: 195145 - RNA, 22 nt, Homo sapiens
cucaccuugugauccaccggcc

SEQ ID NO: 195146 - RNA, 22 nt, Homo sapiens
cucacuggguguaaaacaugua

SEQ ID NO: 195147 - RNA, 22 nt, Homo sapiens
cucagugucuggcacacagaaa

SEQ ID NO: 195148 - RNA, 22 nt, Homo sapiens
cucaguguuaaggccaccucug

SEQ ID NO: 195149 - RNA, 22 nt, Homo sapiens
cucauuaguuguuuuaagauga

SEQ ID NO: 195150 - RNA, 22 nt, Homo sapiens
cuccauagucuucgaagaauga

SEQ ID NO: 195151 - RNA, 23 nt, Homo sapiens
cuccaugagccguccagggccug

SEQ ID NO: 195152 - RNA, 22 nt, Homo sapiens
cucccuuugcugaauguuuuuc

SEQ ID NO: 195153 - RNA, 20 nt, Homo sapiens
cucuaguaauaaaguuuccc

SEQ ID NO: 195154 - RNA, 22 nt, Homo sapiens
cucugacagugguuagcacugu

SEQ ID NO: 195155 - RNA, 22 nt, Homo sapiens
cugagauuaagauauugggagu

SEQ ID NO: 195156 - RNA, 22 nt, Homo sapiens
cugagcaucauggcagaaucuu

SEQ ID NO: 195157 - RNA, 22 nt, Homo sapiens
cugagcaugacaucaugugacu

SEQ ID NO: 195158 - RNA, 22 nt, Homo sapiens
cugagguauuuaggugaaagaa

SEQ ID NO: 195159 - RNA, 22 nt, Homo sapiens
cugagguuguucuucucagugg

SEQ ID NO: 195160 - RNA, 22 nt, Homo sapiens
cugauaguucucuuuagaguuu

SEQ ID NO: 195161 - RNA, 22 nt, Homo sapiens
cugcaaauacuugugggauuuu

SEQ ID NO: 195162 - RNA, 20 nt, Homo sapiens
cugcaaaugcugcugcugau

SEQ ID NO: 195163 - RNA, 22 nt, Homo sapiens
cugcaauggagaaagugagacu

SEQ ID NO: 195164 - RNA, 22 nt, Homo sapiens
cugcagaucuuggggcuugcca

SEQ ID NO: 195165 - RNA, 20 nt, Homo sapiens
cugcuccccuacaaaucuca

SEQ ID NO: 195166 - RNA, 22 nt, Homo sapiens
cuggaauucaaaaucugaauuu

SEQ ID NO: 195167 - RNA, 22 nt, Homo sapiens
cuggacaaaucuggaaagaacc

SEQ ID NO: 195168 - RNA, 22 nt, Homo sapiens
cuggaguuugaggcugcaguga

SEQ ID NO: 195169 - RNA, 22 nt, Homo sapiens
cuggcaaaaagagggcaauaau

SEQ ID NO: 195170 - RNA, 22 nt, Homo sapiens
cugguaagaaggucuaagucaa

SEQ ID NO: 195171 - RNA, 22 nt, Homo sapiens
cuggucguuauuuaucuucuca

SEQ ID NO: 195172 - RNA, 21 nt, Homo sapiens
cugguguuagcacuucuuccc

SEQ ID NO: 195173 - RNA, 22 nt, Homo sapiens
cugucacuggggcacauguccc

SEQ ID NO: 195174 - RNA, 22 nt, Homo sapiens
cugucuggaggccugcaaauaa

SEQ ID NO: 195175 - RNA, 22 nt, Homo sapiens
cugugcauguaugcgugaguuc

SEQ ID NO: 195176 - RNA, 22 nt, Homo sapiens
cugugguuacguucuuugugcu

SEQ ID NO: 195177 - RNA, 22 nt, Homo sapiens
cuuagcaaugucguguacucac

SEQ ID NO: 195178 - RNA, 20 nt, Homo sapiens
cuucacagaaguggaaucau

SEQ ID NO: 195179 - RNA, 22 nt, Homo sapiens
cuucaugggagaaccacaggua

SEQ ID NO: 195180 - RNA, 22 nt, Homo sapiens
cuuuagcaaggauauggggaug

SEQ ID NO: 195181 - RNA, 22 nt, Homo sapiens
cuuugaugagaaaauacuuugu

SEQ ID NO: 195182 - RNA, 22 nt, Homo sapiens
cuuuguaugucaugacaacugu

SEQ ID NO: 195183 - RNA, 20 nt, Homo sapiens
cuuuguccuccugcugugcu

SEQ ID NO: 195184 - RNA, 22 nt, Homo sapiens
cuuuugugauuccucaguuacu

SEQ ID NO: 195185 - RNA, 21 nt, Homo sapiens
cuuuuuacucguucauaugca

SEQ ID NO: 195186 - RNA, 22 nt, Homo sapiens
gaaccagcagacuuugacaggu

SEQ ID NO: 195187 - RNA, 23 nt, Homo sapiens
gaaguaauaaauggauucuuaac

SEQ ID NO: 195188 - RNA, 22 nt, Homo sapiens
gaaguaguaaaauuuauugcag

SEQ ID NO: 195189 - RNA, 22 nt, Homo sapiens
gacaguuuggugaggaagacga

SEQ ID NO: 195190 - RNA, 22 nt, Homo sapiens
gacugaggaagcgcucucuccu

SEQ ID NO: 195191 - RNA, 22 nt, Homo sapiens
gagagcauuaagccaucaucau

SEQ ID NO: 195192 - RNA, 22 nt, Homo sapiens
gagauaaauaggucacaguucu

SEQ ID NO: 195193 - RNA, 22 nt, Homo sapiens
gagaugaaguuaaggaucuuua

SEQ ID NO: 195194 - RNA, 22 nt, Homo sapiens
gagauguaagaauuuauuuguu

SEQ ID NO: 195195 - RNA, 22 nt, Homo sapiens
gaggaucucuugagcccagaag

SEQ ID NO: 195196 - RNA, 22 nt, Homo sapiens
gagguaggaggauugcuuaagg

SEQ ID NO: 195197 - RNA, 22 nt, Homo sapiens
gagguuuuagugagucccacug

SEQ ID NO: 195198 - RNA, 22 nt, Homo sapiens
gaguagugcugcaauaaacaua

SEQ ID NO: 195199 - RNA, 22 nt, Homo sapiens
gagugcaauggcaugaucuggg

SEQ ID NO: 195200 - RNA, 22 nt, Homo sapiens
gauaacagauaaugucaguuau

SEQ ID NO: 195201 - RNA, 22 nt, Homo sapiens
gaucacauuguuucauacauau

SEQ ID NO: 195202 - RNA, 22 nt, Homo sapiens
gaugguggucuacccuuucccu

SEQ ID NO: 195203 - RNA, 18 nt, Homo sapiens
gauguaguauggugugga

SEQ ID NO: 195204 - RNA, 22 nt, Homo sapiens
gauuuguuggccugugagcuag

SEQ ID NO: 195205 - RNA, 22 nt, Homo sapiens
acugcacuccaguuugggcagc

SEQ ID NO: 195206 - RNA, 22 nt, Homo sapiens
acugcacucccgcccgggugac

SEQ ID NO: 195207 - RNA, 22 nt, Homo sapiens
acuuuuguuauacagugugaua

SEQ ID NO: 195208 - RNA, 22 nt, Homo sapiens
agaaccauuagagggagauauu

SEQ ID NO: 195209 - RNA, 20 nt, Homo sapiens
agaagcauugcucucuucag

SEQ ID NO: 195210 - RNA, 22 nt, Homo sapiens
agacucauuuuuaucgagcaug

SEQ ID NO: 195211 - RNA, 22 nt, Homo sapiens
agagguaagcaguggcaagugc

SEQ ID NO: 195212 - RNA, 22 nt, Homo sapiens
agaguacaggcaaguuagucau

SEQ ID NO: 195213 - RNA, 22 nt, Homo sapiens
agaguaguaggaugaauggacu

SEQ ID NO: 195214 - RNA, 22 nt, Homo sapiens
agaugauguuuacugagcauca

SEQ ID NO: 195215 - RNA, 22 nt, Homo sapiens
agaugauguuucuggcacauga

SEQ ID NO: 195216 - RNA, 23 nt, Homo sapiens
agcaccaccccaggucacaagug

SEQ ID NO: 195217 - RNA, 20 nt, Homo sapiens
agcaucagugguaguguugc

SEQ ID NO: 195218 - RNA, 17 nt, Homo sapiens
agcauguguuugagauu

SEQ ID NO: 195219 - RNA, 21 nt, Homo sapiens
agccaguguuccuuguggcuc

SEQ ID NO: 195220 - RNA, 20 nt, Homo sapiens
agccccauguaaaccacaug

SEQ ID NO: 195221 - RNA, 23 nt, Homo sapiens
agcugguacuagaggcuugcgcc

SEQ ID NO: 195222 - RNA, 22 nt, Homo sapiens
agcuuguguuugucugccuggg

SEQ ID NO: 195223 - RNA, 22 nt, Homo sapiens
aggaauuuaauguaugauaaua

SEQ ID NO: 195224 - RNA, 22 nt, Homo sapiens
aggagguagggugugaaacagc

SEQ ID NO: 195225 - RNA, 22 nt, Homo sapiens
agggcuuaucuguguagaguuc

SEQ ID NO: 195226 - RNA, 22 nt, Homo sapiens
agguagucuuuuccuauuguca

SEQ ID NO: 195227 - RNA, 22 nt, Homo sapiens
aggugacugguuuaucuggcag

SEQ ID NO: 195228 - RNA, 21 nt, Homo sapiens
aggugucuuggguucccuggc

SEQ ID NO: 195229 - RNA, 22 nt, Homo sapiens
aguaacacaccugcauggugug

SEQ ID NO: 195230 - RNA, 22 nt, Homo sapiens
aguacacuguugaacagaagug

SEQ ID NO: 195231 - RNA, 22 nt, Homo sapiens
agucaguggaguaaauguaauu

SEQ ID NO: 195232 - RNA, 22 nt, Homo sapiens
agugcaguggcacaaucuuggc

SEQ ID NO: 195233 - RNA, 22 nt, Homo sapiens
aguuuugguugaguuacuagca

SEQ ID NO: 195234 - RNA, 22 nt, Homo sapiens
auaaguauuuggacuuuacugu

SEQ ID NO: 195235 - RNA, 22 nt, Homo sapiens
auaauagcugaucauuuagaag

SEQ ID NO: 195236 - RNA, 22 nt, Homo sapiens
auaauugcuaagugaagauggu

SEQ ID NO: 195237 - RNA, 22 nt, Homo sapiens
auacacuggagcaaaccuggag

SEQ ID NO: 195238 - RNA, 22 nt, Homo sapiens
auacuguuucugaacuuugauu

SEQ ID NO: 195239 - RNA, 21 nt, Homo sapiens
auacuugcauccuuggagaga

SEQ ID NO: 195240 - RNA, 23 nt, Homo sapiens
auagagcuaggaugcagacagau

SEQ ID NO: 195241 - RNA, 20 nt, Homo sapiens
auagcagcaugauuuauaau

SEQ ID NO: 195242 - RNA, 20 nt, Homo sapiens
auagcagcaugauuuauagu

SEQ ID NO: 195243 - RNA, 22 nt, Homo sapiens
auauauguuuucugggaagaaa

SEQ ID NO: 195244 - RNA, 22 nt, Homo sapiens
aucaaaguuucccagaaguugu

SEQ ID NO: 195245 - RNA, 22 nt, Homo sapiens
aucacagauauggguuuaaauc

SEQ ID NO: 195246 - RNA, 22 nt, Homo sapiens
aucagcagcaugaaaagcaacu

SEQ ID NO: 195247 - RNA, 22 nt, Homo sapiens
aucauagcucacugcagccucg

SEQ ID NO: 195248 - RNA, 22 nt, Homo sapiens
auccacaugcaguuggaaacag

SEQ ID NO: 195249 - RNA, 23 nt, Homo sapiens
auccacauucuaguccuuuaugc

SEQ ID NO: 195250 - RNA, 22 nt, Homo sapiens
auccagaugggcuuaauguaau

SEQ ID NO: 195251 - RNA, 22 nt, Homo sapiens
auccucugagaucuaggcagag

SEQ ID NO: 195252 - RNA, 22 nt, Homo sapiens
aucuuguguugaauggugcaga

SEQ ID NO: 195253 - RNA, 22 nt, Homo sapiens
augaaacuggcuaauuuuugua

SEQ ID NO: 195254 - RNA, 22 nt, Homo sapiens
augaagcuagcugauugcugau

SEQ ID NO: 195255 - RNA, 22 nt, Homo sapiens
augacuuuucugaaaaccacca

SEQ ID NO: 195256 - RNA, 22 nt, Homo sapiens
augagaugaggaauggcccucc

SEQ ID NO: 195257 - RNA, 22 nt, Homo sapiens
augaggaagucaggcccagggg

SEQ ID NO: 195258 - RNA, 22 nt, Homo sapiens
augagggcggacgcccuggaga

SEQ ID NO: 195259 - RNA, 23 nt, Homo sapiens
augagguaucugagcccagaaau

SEQ ID NO: 195260 - RNA, 22 nt, Homo sapiens
augauaaguuauuagaagaaga

SEQ ID NO: 195261 - RNA, 22 nt, Homo sapiens
augaucaucugaaagcuuuuac

SEQ ID NO: 195262 - RNA, 22 nt, Homo sapiens
augaugcaguacuuugggaaca

SEQ ID NO: 195263 - RNA, 22 nt, Homo sapiens
augaugcugcaguuguugccaa

SEQ ID NO: 195264 - RNA, 22 nt, Homo sapiens
augauguaggccauggguuucu

SEQ ID NO: 195265 - RNA, 22 nt, Homo sapiens
augccaagagacaaagggaauc

SEQ ID NO: 195266 - RNA, 19 nt, Homo sapiens
augccucaguuuuguacuu

SEQ ID NO: 195267 - RNA, 22 nt, Homo sapiens
augcuauguagaugagggccca

SEQ ID NO: 195268 - RNA, 22 nt, Homo sapiens
augcuggugguucacaugcgca

SEQ ID NO: 195269 - RNA, 22 nt, Homo sapiens
augcuuguguuggggcagugga

SEQ ID NO: 195270 - RNA, 22 nt, Homo sapiens
auggcaaaauguuccuaguggu

SEQ ID NO: 195271 - RNA, 22 nt, Homo sapiens
auggcuguuccugggaguucua

SEQ ID NO: 195272 - RNA, 22 nt, Homo sapiens
augguaguagaugugugguuuu

SEQ ID NO: 195273 - RNA, 22 nt, Homo sapiens
auggugugugaauuaaauguua

SEQ ID NO: 195274 - RNA, 22 nt, Homo sapiens
augucaaggugggugauaguuu

SEQ ID NO: 195275 - RNA, 22 nt, Homo sapiens
auguccauggaaucuguagcaa

SEQ ID NO: 195276 - RNA, 22 nt, Homo sapiens
augucuagagugauacugaagc

SEQ ID NO: 195277 - RNA, 22 nt, Homo sapiens
augugacagugguuuuaagcgu

SEQ ID NO: 195278 - RNA, 22 nt, Homo sapiens
augugcauaugaagcacagaca

SEQ ID NO: 195279 - RNA, 22 nt, Homo sapiens
augugcaugcuguucugccaga

SEQ ID NO: 195280 - RNA, 22 nt, Homo sapiens
auuaaucaggcaaugcuugcua

SEQ ID NO: 195281 - RNA, 22 nt, Homo sapiens
auuagaugguuauaggugugag

SEQ ID NO: 195282 - RNA, 22 nt, Homo sapiens
auuagguuagugcaaaaguaau

SEQ ID NO: 195283 - RNA, 22 nt, Homo sapiens
auuccacaguuaacacagaccg

SEQ ID NO: 195284 - RNA, 21 nt, Homo sapiens
auuccacuuuuccuucaggga

SEQ ID NO: 195285 - RNA, 22 nt, Homo sapiens
auuccauagugucuguggcaga

SEQ ID NO: 195286 - RNA, 18 nt, Homo sapiens
auugagcaugacagaccu

SEQ ID NO: 195287 - RNA, 22 nt, Homo sapiens
auugcaaugggaaacuaugaaa

SEQ ID NO: 195288 - RNA, 22 nt, Homo sapiens
auugcacaucugcacuacagcc

SEQ ID NO: 195289 - RNA, 22 nt, Homo sapiens
auugcacuccagccuggaugac

SEQ ID NO: 195290 - RNA, 22 nt, Homo sapiens
auugcauaaacacauuucuuau

SEQ ID NO: 195291 - RNA, 22 nt, Homo sapiens
auuguuccccggucauuuuugu

SEQ ID NO: 195292 - RNA, 22 nt, Homo sapiens
auuguucuuacaugcugucauc

SEQ ID NO: 195293 - RNA, 22 nt, Homo sapiens
auuuuugguuucaccugcacgc

SEQ ID NO: 195294 - RNA, 22 nt, Homo sapiens
caaagugcugggaugggccagg

SEQ ID NO: 195295 - RNA, 22 nt, Homo sapiens
caaauacuuucauguugucuug

SEQ ID NO: 195296 - RNA, 22 nt, Homo sapiens
caaggaauucucaauagaguua

SEQ ID NO: 195297 - RNA, 22 nt, Homo sapiens
caaugcagcuuuuggagagaaa

SEQ ID NO: 195298 - RNA, 22 nt, Homo sapiens
cacaggccugucucuuucuaac

SEQ ID NO: 195299 - RNA, 22 nt, Homo sapiens
cacauugaauuucugaugacaa

SEQ ID NO: 195300 - RNA, 22 nt, Homo sapiens
cacugcauggccacccauguua

SEQ ID NO: 195301 - RNA, 19 nt, Homo sapiens
uucauacagugagagcagc

SEQ ID NO: 195302 - RNA, 22 nt, Homo sapiens
uucauaguaacaguaacuaugg

SEQ ID NO: 195303 - RNA, 22 nt, Homo sapiens
uucauaguguaccugaaggcac

SEQ ID NO: 195304 - RNA, 22 nt, Homo sapiens
uucaucuggcaauucagagauu

SEQ ID NO: 195305 - RNA, 20 nt, Homo sapiens
uucaugggagcaaagaggcc

SEQ ID NO: 195306 - RNA, 22 nt, Homo sapiens
uuccacaaugguugaacuaauu

SEQ ID NO: 195307 - RNA, 22 nt, Homo sapiens
uuccauuuguucggugucgcca

SEQ ID NO: 195308 - RNA, 23 nt, Homo sapiens
uucccuuagaagaaggggagaaa

SEQ ID NO: 195309 - RNA, 22 nt, Homo sapiens
uuccuuaguuauuugguccccu

SEQ ID NO: 195310 - RNA, 22 nt, Homo sapiens
uuccuugagucuuuuuccugag

SEQ ID NO: 195311 - RNA, 22 nt, Homo sapiens
uucuaugguuuuuaugguguua

SEQ ID NO: 195312 - RNA, 22 nt, Homo sapiens
uucuauugguaauauuuucugu

SEQ ID NO: 195313 - RNA, 22 nt, Homo sapiens
uucugcuugaucuaguguguug

SEQ ID NO: 195314 - RNA, 22 nt, Homo sapiens
uucuggcucgauucucugaccg

SEQ ID NO: 195315 - RNA, 22 nt, Homo sapiens
uugaagacuaauuuagauaaug

SEQ ID NO: 195316 - RNA, 22 nt, Homo sapiens
uugaaguaggaaaggaggaggu

SEQ ID NO: 195317 - RNA, 22 nt, Homo sapiens
uugacaaugcacugugcuaagu

SEQ ID NO: 195318 - RNA, 22 nt, Homo sapiens
uugacauaaucauuucacagug

SEQ ID NO: 195319 - RNA, 22 nt, Homo sapiens
uugaccccuucuaauagccuca

SEQ ID NO: 195320 - RNA, 22 nt, Homo sapiens
uugacuacaccaugccaggaac

SEQ ID NO: 195321 - RNA, 22 nt, Homo sapiens
uugacuuuuaggaggaaaauga

SEQ ID NO: 195322 - RNA, 22 nt, Homo sapiens
uugagcuagggagaucgagguc

SEQ ID NO: 195323 - RNA, 22 nt, Homo sapiens
uugagguaggaggagcuuggau

SEQ ID NO: 195324 - RNA, 20 nt, Homo sapiens
uugaguauugccagggaggc

SEQ ID NO: 195325 - RNA, 22 nt, Homo sapiens
uugauaguaccauugggaaauu

SEQ ID NO: 195326 - RNA, 22 nt, Homo sapiens
uugauaguccuguaucuauuuu

SEQ ID NO: 195327 - RNA, 22 nt, Homo sapiens
uugauaguguccucuuuggcag

SEQ ID NO: 195328 - RNA, 22 nt, Homo sapiens
uugauaguuuuaaaauuaaucu

SEQ ID NO: 195329 - RNA, 22 nt, Homo sapiens
uugaucaucagcuuugucaucu

SEQ ID NO: 195330 - RNA, 22 nt, Homo sapiens
uugaucuggagagaggcccgug

SEQ ID NO: 195331 - RNA, 22 nt, Homo sapiens
uugaugauguuucugccuugcc

SEQ ID NO: 195332 - RNA, 22 nt, Homo sapiens
uugauguaggcauucaaggcua

SEQ ID NO: 195333 - RNA, 22 nt, Homo sapiens
uugcaaaguugccaaggaagga

SEQ ID NO: 195334 - RNA, 22 nt, Homo sapiens
uugcaccacugcguuccagccu

SEQ ID NO: 195335 - RNA, 22 nt, Homo sapiens
uugcacuguaauuuauuuaugu

SEQ ID NO: 195336 - RNA, 18 nt, Homo sapiens
uugccuauucacucugau

SEQ ID NO: 195337 - RNA, 22 nt, Homo sapiens
uugccugagaagccaagaauaa

SEQ ID NO: 195338 - RNA, 22 nt, Homo sapiens
uugcuuuguuacugcaguuucc

SEQ ID NO: 195339 - RNA, 22 nt, Homo sapiens
uuggaaaaauccaccuugaucu

SEQ ID NO: 195340 - RNA, 22 nt, Homo sapiens
uuggauauucaguuuuuccauc

SEQ ID NO: 195341 - RNA, 22 nt, Homo sapiens
uuggcaaauagguuuuauugca

SEQ ID NO: 195342 - RNA, 20 nt, Homo sapiens
uuggcagagucuuuagggua

SEQ ID NO: 195343 - RNA, 22 nt, Homo sapiens
uuggccuccuggucauauccag

SEQ ID NO: 195344 - RNA, 22 nt, Homo sapiens
uuggcuaugaguccuaugugca

SEQ ID NO: 195345 - RNA, 22 nt, Homo sapiens
uuggggcacggccucuguugcc

SEQ ID NO: 195346 - RNA, 22 nt, Homo sapiens
uuguaaacaucuguacauugcu

SEQ ID NO: 195347 - RNA, 22 nt, Homo sapiens
uuguacuagaaaauuauucuuu

SEQ ID NO: 195348 - RNA, 22 nt, Homo sapiens
uuguagcaaauauauuuuggaa

SEQ ID NO: 195349 - RNA, 22 nt, Homo sapiens
uuguagcuuuuuaaugugcugc

SEQ ID NO: 195350 - RNA, 22 nt, Homo sapiens
uuguaugucuucauuugaaaaa

SEQ ID NO: 195351 - RNA, 22 nt, Homo sapiens
uuguauugucuugaugaguuga

SEQ ID NO: 195352 - RNA, 22 nt, Homo sapiens
uugucacuauaaauaagcauuu

SEQ ID NO: 195353 - RNA, 22 nt, Homo sapiens
uuguccuggagguucuugcaag

SEQ ID NO: 195354 - RNA, 22 nt, Homo sapiens
uugugcauaucagagguuugcu

SEQ ID NO: 195355 - RNA, 22 nt, Homo sapiens
uugugguuuuaucuaccuuugg

SEQ ID NO: 195356 - RNA, 22 nt, Homo sapiens
ggagauuauugaaucaugaggg

SEQ ID NO: 195357 - RNA, 22 nt, Homo sapiens
ggagucugaacuggacaaugac

SEQ ID NO: 195358 - RNA, 22 nt, Homo sapiens
ggagucugacuuauaggaaccu

SEQ ID NO: 195359 - RNA, 22 nt, Homo sapiens
ggagugugauucaguauaauau

SEQ ID NO: 195360 - RNA, 22 nt, Homo sapiens
ggcaaaugaagauggagaggcu

SEQ ID NO: 195361 - RNA, 19 nt, Homo sapiens
ggcaagaguuguucugugu

SEQ ID NO: 195362 - RNA, 22 nt, Homo sapiens
ggcaaggauguuuuucuggcaa

SEQ ID NO: 195363 - RNA, 22 nt, Homo sapiens
ggcaagugucagcagcaacacc

SEQ ID NO: 195364 - RNA, 22 nt, Homo sapiens
ggcaauauuauuaacccucugu

SEQ ID NO: 195365 - RNA, 22 nt, Homo sapiens
ggcaaugucagcuaaugaugga

SEQ ID NO: 195366 - RNA, 22 nt, Homo sapiens
ggcauugugaacauuucccugc

SEQ ID NO: 195367 - RNA, 21 nt, Homo sapiens
ggcauugugcccuugcucuag

SEQ ID NO: 195368 - RNA, 23 nt, Homo sapiens
ggcauuguggcucacaucuguaa

SEQ ID NO: 195369 - RNA, 22 nt, Homo sapiens
ggccuguaaacuagagacccug

SEQ ID NO: 195370 - RNA, 22 nt, Homo sapiens
ggccuguaggguauugguaggg

SEQ ID NO: 195371 - RNA, 22 nt, Homo sapiens
gggaaugaagagaaccuuccca

SEQ ID NO: 195372 - RNA, 22 nt, Homo sapiens
gggagguuguauguaugcgggg

SEQ ID NO: 195373 - RNA, 22 nt, Homo sapiens
guacaguuuucaguguucacug

SEQ ID NO: 195374 - RNA, 22 nt, Homo sapiens
guaugauacuguaacagugggu

SEQ ID NO: 195375 - RNA, 22 nt, Homo sapiens
guauuugauuauagcaugcuua

SEQ ID NO: 195376 - RNA, 22 nt, Homo sapiens
gucaaaugcacagaaccauuaa

SEQ ID NO: 195377 - RNA, 22 nt, Homo sapiens
gucucugguugcuuuuguacca

SEQ ID NO: 195378 - RNA, 22 nt, Homo sapiens
gucugguacuuguuuguaaggg

SEQ ID NO: 195379 - RNA, 22 nt, Homo sapiens
gugaaugaaugggugaauacau

SEQ ID NO: 195380 - RNA, 22 nt, Homo sapiens
gugagaugauggguauguuaau

SEQ ID NO: 195381 - RNA, 22 nt, Homo sapiens
gugagcauuacucaugggauca

SEQ ID NO: 195382 - RNA, 22 nt, Homo sapiens
gugcauaugcaugugcaugcac

SEQ ID NO: 195383 - RNA, 22 nt, Homo sapiens
gugccuagugcuauugugcccu

SEQ ID NO: 195384 - RNA, 22 nt, Homo sapiens
guggaaugauaucucauugugg

SEQ ID NO: 195385 - RNA, 22 nt, Homo sapiens
guggcaagaauguacaaaaggu

SEQ ID NO: 195386 - RNA, 22 nt, Homo sapiens
guggcaagaugacuacucacug

SEQ ID NO: 195387 - RNA, 22 nt, Homo sapiens
guggcauuucccaaaguauucu

SEQ ID NO: 195388 - RNA, 22 nt, Homo sapiens
guguauguuguccauggaugcg

SEQ ID NO: 195389 - RNA, 22 nt, Homo sapiens
gugucccagugugcauacaggu

SEQ ID NO: 195390 - RNA, 22 nt, Homo sapiens
guucaagugauagcugggauua

SEQ ID NO: 195391 - RNA, 18 nt, Homo sapiens
uaaaggcacuguguuguu

SEQ ID NO: 195392 - RNA, 22 nt, Homo sapiens
uaacaggcuacucuugcauugc

SEQ ID NO: 195393 - RNA, 22 nt, Homo sapiens
uaacaguguagaggccuauugg

SEQ ID NO: 195394 - RNA, 22 nt, Homo sapiens
uaacugcaaccuccgccucccg

SEQ ID NO: 195395 - RNA, 22 nt, Homo sapiens
uaagagcuaggauuuuaaauca

SEQ ID NO: 195396 - RNA, 22 nt, Homo sapiens
uaaggcacccuucugaguagag

SEQ ID NO: 195397 - RNA, 22 nt, Homo sapiens
uaagugaauuucacuacugagu

SEQ ID NO: 195398 - RNA, 22 nt, Homo sapiens
uaagugcuguguuguuaccuaa

SEQ ID NO: 195399 - RNA, 22 nt, Homo sapiens
uaagugcuugacuuugauguuu

SEQ ID NO: 195400 - RNA, 20 nt, Homo sapiens
uaagugcuugaugaaugaac

SEQ ID NO: 195401 - RNA, 20 nt, Homo sapiens
uaagugcuuuauauugauua

SEQ ID NO: 195402 - RNA, 22 nt, Homo sapiens
uaauacucuucucauuuuacag

SEQ ID NO: 195403 - RNA, 22 nt, Homo sapiens
uaauagcaguguuacuaggacu

SEQ ID NO: 195404 - RNA, 22 nt, Homo sapiens
uaauauguauacagacagauac

SEQ ID NO: 195405 - RNA, 18 nt, Homo sapiens
uacagaacuggaguagaa

SEQ ID NO: 195406 - RNA, 22 nt, Homo sapiens
uacagguaugugucuauauaca

SEQ ID NO: 195407 - RNA, 22 nt, Homo sapiens
uacaguagaaugucuuucaaaa

SEQ ID NO: 195408 - RNA, 22 nt, Homo sapiens
uacaguagagaucagcaaacua

SEQ ID NO: 195409 - RNA, 22 nt, Homo sapiens
uacaguaguaucuucauuuguu

SEQ ID NO: 195410 - RNA, 22 nt, Homo sapiens
uacagucauaaugccuagugac

SEQ ID NO: 195411 - RNA, 18 nt, Homo sapiens
uacuaguaaggcuucuga

SEQ ID NO: 195412 - RNA, 22 nt, Homo sapiens
uacuggccuugaacucuggugu

SEQ ID NO: 195413 - RNA, 22 nt, Homo sapiens
uagaaugaaacaagcugugccu

SEQ ID NO: 195414 - RNA, 22 nt, Homo sapiens
uagaauguaacaguuaaaagca

SEQ ID NO: 195415 - RNA, 22 nt, Homo sapiens
uagaauguauaauauuuuacuu

SEQ ID NO: 195416 - RNA, 22 nt, Homo sapiens
uagacuguaagauccaggagag

SEQ ID NO: 195417 - RNA, 20 nt, Homo sapiens
uagagagauauggggguucc

SEQ ID NO: 195418 - RNA, 22 nt, Homo sapiens
uagagguauuaacaguagaaga

SEQ ID NO: 195419 - RNA, 19 nt, Homo sapiens
uagcacagggucccagacu

SEQ ID NO: 195420 - RNA, 22 nt, Homo sapiens
uagcugguucuccaggagcuag

SEQ ID NO: 195421 - RNA, 23 nt, Homo sapiens
uaguaccauauuguuggcagcac

SEQ ID NO: 195422 - RNA, 22 nt, Homo sapiens
uagugaauguuggcuauuaaua

SEQ ID NO: 195423 - RNA, 22 nt, Homo sapiens
uaguugcaucuuaggucuguga

SEQ ID NO: 195424 - RNA, 22 nt, Homo sapiens
uaguuguugcagguaggaugua

SEQ ID NO: 195425 - RNA, 22 nt, Homo sapiens
uauaagacuagcagcugaauug

SEQ ID NO: 195426 - RNA, 22 nt, Homo sapiens
uauagcaaugugccacucucug

SEQ ID NO: 195427 - RNA, 22 nt, Homo sapiens
uauauguucuugcacuggaaag

SEQ ID NO: 195428 - RNA, 22 nt, Homo sapiens
uaucaaggccacucauuuuaug

SEQ ID NO: 195429 - RNA, 20 nt, Homo sapiens
uaucacaguucaggaacucu

SEQ ID NO: 195430 - RNA, 21 nt, Homo sapiens
uaucucaguuuuccuuugugg

SEQ ID NO: 195431 - RNA, 18 nt, Homo sapiens
uaucucauuucuuagguc

SEQ ID NO: 195432 - RNA, 22 nt, Homo sapiens
uaucugcacauacacuuauagc

SEQ ID NO: 195433 - RNA, 22 nt, Homo sapiens
uaucugcaucccauuuuuauca

SEQ ID NO: 195434 - RNA, 20 nt, Homo sapiens
uaugaccugucuuuucucuc

SEQ ID NO: 195435 - RNA, 22 nt, Homo sapiens
uaugaucauuauguuauugcag

SEQ ID NO: 195436 - RNA, 23 nt, Homo sapiens
uaugccuguuucaaacaaacuuu

SEQ ID NO: 195437 - RNA, 22 nt, Homo sapiens
uaugcuguuucugauuuaggga

SEQ ID NO: 195438 - RNA, 22 nt, Homo sapiens
uauggccugaauuagaaaagug

SEQ ID NO: 195439 - RNA, 22 nt, Homo sapiens
uauggcugugacuuaucuuguu

SEQ ID NO: 195440 - RNA, 22 nt, Homo sapiens
uauuccacuauuaguccagaug

SEQ ID NO: 195441 - RNA, 22 nt, Homo sapiens
uauuccacuggcacugcauuug

SEQ ID NO: 195442 - RNA, 22 nt, Homo sapiens
uauugcacaugaggagacauug

SEQ ID NO: 195443 - RNA, 22 nt, Homo sapiens
ugagacaucugagauuuuaagc

SEQ ID NO: 195444 - RNA, 22 nt, Homo sapiens
ugagacugaguuuccaucuugu

SEQ ID NO: 195445 - RNA, 21 nt, Homo sapiens
ugagaguaguguauuauucuc

SEQ ID NO: 195446 - RNA, 22 nt, Homo sapiens
ugagagucacugaccugguaua

SEQ ID NO: 195447 - RNA, 22 nt, Homo sapiens
ugagaugaugggauaagagggc

SEQ ID NO: 195448 - RNA, 22 nt, Homo sapiens
ugagauuaucguaauguaucuc

SEQ ID NO: 195449 - RNA, 22 nt, Homo sapiens
ugagauuaucuguacauaggag

SEQ ID NO: 195450 - RNA, 22 nt, Homo sapiens
ugagauuaucuugaucuugaaa

SEQ ID NO: 195451 - RNA, 22 nt, Homo sapiens
ugagcagugagugugcugcagg

SEQ ID NO: 195452 - RNA, 22 nt, Homo sapiens
ugagcauuguguuugacuguga

SEQ ID NO: 195453 - RNA, 22 nt, Homo sapiens
ugagcgaugggaggaagugaua

SEQ ID NO: 195454 - RNA, 22 nt, Homo sapiens
ugagcucaugcauucuugagga

SEQ ID NO: 195455 - RNA, 22 nt, Homo sapiens
ugagguagaaugauucuaauau

SEQ ID NO: 195456 - RNA, 22 nt, Homo sapiens
ugagguuggggucagggcuagc

SEQ ID NO: 195457 - RNA, 22 nt, Homo sapiens
ugaguagagaauucagcuaagg

SEQ ID NO: 195458 - RNA, 22 nt, Homo sapiens
ugagugugaggaagaauuagaa

SEQ ID NO: 195459 - RNA, 17 nt, Homo sapiens
ugaguuaaucuuugugc

SEQ ID NO: 195460 - RNA, 22 nt, Homo sapiens
ugaguuaauuuuuguaucaugu

SEQ ID NO: 195461 - RNA, 22 nt, Homo sapiens
ugaguucuuccuaucucugccu

SEQ ID NO: 195462 - RNA, 22 nt, Homo sapiens
ugaguuuaucuaaagaccuggg

SEQ ID NO: 195463 - RNA, 22 nt, Homo sapiens
ugauaauguuaggcuuuauuca

SEQ ID NO: 195464 - RNA, 22 nt, Homo sapiens
ugauggcauuucauguuuguaa

SEQ ID NO: 195465 - RNA, 22 nt, Homo sapiens
ugaugucuugcaggcacgagau

SEQ ID NO: 195466 - RNA, 18 nt, Homo sapiens
ugauugacuuauuuaggu

SEQ ID NO: 195467 - RNA, 22 nt, Homo sapiens
ugcaaguggauuuuuccccaga

SEQ ID NO: 195468 - RNA, 22 nt, Homo sapiens
ugcaccauggcacuccaggcug

SEQ ID NO: 195469 - RNA, 22 nt, Homo sapiens
ugcaccauuacacuccaggcug

SEQ ID NO: 195470 - RNA, 22 nt, Homo sapiens
ugcagguaggcaguaucauuua

SEQ ID NO: 195471 - RNA, 20 nt, Homo sapiens
ugcaguguccucacuuguca

SEQ ID NO: 195472 - RNA, 22 nt, Homo sapiens
ugcauauguauacaugugccau

SEQ ID NO: 195473 - RNA, 22 nt, Homo sapiens
ugcauaugucuuuauagcagca

SEQ ID NO: 195474 - RNA, 22 nt, Homo sapiens
ugcauauguugaaccaggcuug

SEQ ID NO: 195475 - RNA, 21 nt, Homo sapiens
ugcauggagaacacugagggu

SEQ ID NO: 195476 - RNA, 19 nt, Homo sapiens
ugccaagaaagucagcuua

SEQ ID NO: 195477 - RNA, 22 nt, Homo sapiens
ugcuaugucagccaggcugguc

SEQ ID NO: 195478 - RNA, 22 nt, Homo sapiens
ugcuggugauuaaauccugaag

SEQ ID NO: 195479 - RNA, 22 nt, Homo sapiens
ugcuugagacacauaugaauuu

SEQ ID NO: 195480 - RNA, 22 nt, Homo sapiens
uggaaauaaaauagaguuugcc

SEQ ID NO: 195481 - RNA, 22 nt, Homo sapiens
uggaaguuaaaugacucuuucu

SEQ ID NO: 195482 - RNA, 22 nt, Homo sapiens
uggaaguuaaauuaguugauga

SEQ ID NO: 195483 - RNA, 22 nt, Homo sapiens
uggagguaggacgaagaacucu

SEQ ID NO: 195484 - RNA, 22 nt, Homo sapiens
uggagguaggugauauguagca

SEQ ID NO: 195485 - RNA, 22 nt, Homo sapiens
uggagucuugcucuguugccca

SEQ ID NO: 195486 - RNA, 22 nt, Homo sapiens
uggagugucaguuuccagaguu

SEQ ID NO: 195487 - RNA, 22 nt, Homo sapiens
uggaguguguugcagaugaagg

SEQ ID NO: 195488 - RNA, 21 nt, Homo sapiens
uggauugagaaccccaggagg

SEQ ID NO: 195489 - RNA, 20 nt, Homo sapiens
uggauugugaugggauuugc

SEQ ID NO: 195490 - RNA, 21 nt, Homo sapiens
uggcaacgaggugugcauuau

SEQ ID NO: 195491 - RNA, 22 nt, Homo sapiens
uggcaagaacaacaauuacuuu

SEQ ID NO: 195492 - RNA, 22 nt, Homo sapiens
uggcaagaaggauuuauuccuu

SEQ ID NO: 195493 - RNA, 23 nt, Homo sapiens
uggcaagauuuguauugccugga

SEQ ID NO: 195494 - RNA, 22 nt, Homo sapiens
uggcaagugggaccuaguuaaa

SEQ ID NO: 195495 - RNA, 21 nt, Homo sapiens
uggcacuauucacaauagcaa

SEQ ID NO: 195496 - RNA, 22 nt, Homo sapiens
uggcuugauggcacaagguuuc

SEQ ID NO: 195497 - RNA, 22 nt, Homo sapiens
ugggaaauguagccuagcugug

SEQ ID NO: 195498 - RNA, 22 nt, Homo sapiens
ugggaaugaaauuacauagcuu

SEQ ID NO: 195499 - RNA, 19 nt, Homo sapiens
ugggaauguaaauuaguuc

SEQ ID NO: 195500 - RNA, 21 nt, Homo sapiens
uggguaguuuucaaggccccg

SEQ ID NO: 195501 - RNA, 21 nt, Homo sapiens
uggucaguuuucucacuagga

SEQ ID NO: 195502 - RNA, 22 nt, Homo sapiens
ugguccucugcuuccagaauuc

SEQ ID NO: 195503 - RNA, 22 nt, Homo sapiens
uggugagaaaagaugucuuugu

SEQ ID NO: 195504 - RNA, 22 nt, Homo sapiens
uguaaaucuauuuuuaguguuu

SEQ ID NO: 195505 - RNA, 22 nt, Homo sapiens
uguacaaaacaagaugggggua

SEQ ID NO: 195506 - RNA, 19 nt, Homo sapiens
uguacacuguaaaccugug

SEQ ID NO: 195507 - RNA, 19 nt, Homo sapiens
uguaccagcaagucuuuuc

SEQ ID NO: 195508 - RNA, 22 nt, Homo sapiens
uguagggagagggaguugcacc

SEQ ID NO: 195509 - RNA, 22 nt, Homo sapiens
ugucaugaacucacauucuggg

SEQ ID NO: 195510 - RNA, 20 nt, Homo sapiens
ugucccaaccccauggguuc

SEQ ID NO: 195511 - RNA, 18 nt, Homo sapiens
ugucccuuugcuguucau

SEQ ID NO: 195512 - RNA, 19 nt, Homo sapiens
uguccuagaggaguucaca

SEQ ID NO: 195513 - RNA, 22 nt, Homo sapiens
uguccuagagggaugucacccc

SEQ ID NO: 195514 - RNA, 22 nt, Homo sapiens
uguccuguaggaggcagaacaa

SEQ ID NO: 195515 - RNA, 22 nt, Homo sapiens
ugugaacagcuccaaaugugga

SEQ ID NO: 195516 - RNA, 22 nt, Homo sapiens
ugugagaucucagaauugaacu

SEQ ID NO: 195517 - RNA, 22 nt, Homo sapiens
ugugaucaugcuccaggcgaga

SEQ ID NO: 195518 - RNA, 22 nt, Homo sapiens
ugugccacuccagcucuagcuu

SEQ ID NO: 195519 - RNA, 22 nt, Homo sapiens
ugugucuuuuaucacacaaugu

SEQ ID NO: 195520 - RNA, 22 nt, Homo sapiens
uguuacagugacuaauguuuua

SEQ ID NO: 195521 - RNA, 22 nt, Homo sapiens
uguuaguuguucauguuaagag

SEQ ID NO: 195522 - RNA, 22 nt, Homo sapiens
uguugcauuugucaaggucaag

SEQ ID NO: 195523 - RNA, 22 nt, Homo sapiens
uguuuuggagguccucacuaga

SEQ ID NO: 195524 - RNA, 22 nt, Homo sapiens
uuaacagugucaaucuguagua

SEQ ID NO: 195525 - RNA, 22 nt, Homo sapiens
uuacaagaugucuguccaacac

SEQ ID NO: 195526 - RNA, 19 nt, Homo sapiens
uuacagugugcccuuuuag

SEQ ID NO: 195527 - RNA, 22 nt, Homo sapiens
uuaggagacuggauaucucuuu

SEQ ID NO: 195528 - RNA, 22 nt, Homo sapiens
uuagguaauauauugcugcuuu

SEQ ID NO: 195529 - RNA, 22 nt, Homo sapiens
uuauacucgucugaaugauucu

SEQ ID NO: 195530 - RNA, 22 nt, Homo sapiens
uuauagcagugcaggaacagac

SEQ ID NO: 195531 - RNA, 22 nt, Homo sapiens
uuauagcagugcccaacuccug

SEQ ID NO: 195532 - RNA, 22 nt, Homo sapiens
uuaucacauugacugauuugca

SEQ ID NO: 195533 - RNA, 22 nt, Homo sapiens
uuauucauuaauugcuaagguu

SEQ ID NO: 195534 - RNA, 22 nt, Homo sapiens
uucaaaguaaagggauggagac

SEQ ID NO: 195535 - RNA, 22 nt, Homo sapiens
uucaagcuacaguggcaggguu

SEQ ID NO: 195536 - RNA, 22 nt, Homo sapiens
uucacaaugccuuguugauggu

SEQ ID NO: 195537 - RNA, 22 nt, Homo sapiens
uucacacuagccacucugguag

SEQ ID NO: 195538 - RNA, 22 nt, Homo sapiens
uucacugugcuuaaauucugcu

SEQ ID NO: 195539 - RNA, 22 nt, Homo sapiens
uucagaguggacagaaauuaag

SEQ ID NO: 195540 - RNA, 22 nt, Homo sapiens
uucaguucugcucugaucuuag

SEQ ID NO: 195541 - RNA, 22 nt, Homo sapiens
augaaaagcauaaacgcugaag

SEQ ID NO: 195542 - RNA, 22 nt, Homo sapiens
augaaacuggagcgccuggagg

SEQ ID NO: 195543 - RNA, 22 nt, Homo sapiens
augacaaugaaucccuguuuca

SEQ ID NO: 195544 - RNA, 22 nt, Homo sapiens
augagaaucauuucagcuugua

SEQ ID NO: 195545 - RNA, 22 nt, Homo sapiens
augagagcaacaccuucacuug

SEQ ID NO: 195546 - RNA, 22 nt, Homo sapiens
augagcagaugcuccugccucu

SEQ ID NO: 195547 - RNA, 22 nt, Homo sapiens
augaggugaguaaauaaaugaa

SEQ ID NO: 195548 - RNA, 22 nt, Homo sapiens
augaucuguuuggugaucuugu

SEQ ID NO: 195549 - RNA, 22 nt, Homo sapiens
augcaaaucuuaaguaugugug

SEQ ID NO: 195550 - RNA, 22 nt, Homo sapiens
augcagagucccagccccuagc

SEQ ID NO: 195551 - RNA, 22 nt, Homo sapiens
augcuacauucuacaauuaggc

SEQ ID NO: 195552 - RNA, 22 nt, Homo sapiens
augcuuguugcagccugagccu

SEQ ID NO: 195553 - RNA, 22 nt, Homo sapiens
auggcacuguguauuuuucugu

SEQ ID NO: 195554 - RNA, 22 nt, Homo sapiens
auggcacuuuggacugcuagau

SEQ ID NO: 195555 - RNA, 22 nt, Homo sapiens
auggcaguuuauucuaaaucaa

SEQ ID NO: 195556 - RNA, 22 nt, Homo sapiens
auguagugugauuuucacuaga

SEQ ID NO: 195557 - RNA, 22 nt, Homo sapiens
augucaacauagacaguagagu

SEQ ID NO: 195558 - RNA, 22 nt, Homo sapiens
auguccuggacccagacaaagc

SEQ ID NO: 195559 - RNA, 22 nt, Homo sapiens
auguggcauuucucauucauuu

SEQ ID NO: 195560 - RNA, 22 nt, Homo sapiens
augugggaggacuuggcuguug

SEQ ID NO: 195561 - RNA, 22 nt, Homo sapiens
auguuugguagugaauauggua

SEQ ID NO: 195562 - RNA, 22 nt, Homo sapiens
auuaagugcuugcagaagucca

SEQ ID NO: 195563 - RNA, 22 nt, Homo sapiens
auuagguuguugcaaaaguaau

SEQ ID NO: 195564 - RNA, 22 nt, Homo sapiens
auuccacagccgauaccaugac

SEQ ID NO: 195565 - RNA, 20 nt, Homo sapiens
auuccacuuguuugagguac

SEQ ID NO: 195566 - RNA, 22 nt, Homo sapiens
auugacaguuggccaguaagug

SEQ ID NO: 195567 - RNA, 22 nt, Homo sapiens
auugagcacugacucugugcca

SEQ ID NO: 195568 - RNA, 22 nt, Homo sapiens
auugcacuggggguuagaauuu

SEQ ID NO: 195569 - RNA, 22 nt, Homo sapiens
auugcauugugaucuucccaga

SEQ ID NO: 195570 - RNA, 22 nt, Homo sapiens
auugcauuuucagguuggucug

SEQ ID NO: 195571 - RNA, 22 nt, Homo sapiens
auugcccauaaggauauuguca

SEQ ID NO: 195572 - RNA, 22 nt, Homo sapiens
auugcuuuuacugggagcuuug

SEQ ID NO: 195573 - RNA, 22 nt, Homo sapiens
auuguacuuaagccugggugaa

SEQ ID NO: 195574 - RNA, 22 nt, Homo sapiens
auuguaguuugcuauggcaaua

SEQ ID NO: 195575 - RNA, 22 nt, Homo sapiens
auuucacuucgcaugguguccg

SEQ ID NO: 195576 - RNA, 22 nt, Homo sapiens
auuuggccuuuguaugcaguau

SEQ ID NO: 195577 - RNA, 22 nt, Homo sapiens
auuugucacuuaacagccauua

SEQ ID NO: 195578 - RNA, 22 nt, Homo sapiens
caaaggcuuccacugcauccuu

SEQ ID NO: 195579 - RNA, 22 nt, Homo sapiens
caaaguaauugcuguuuugcca

SEQ ID NO: 195580 - RNA, 22 nt, Homo sapiens
caaagucuucaguugauucuga

SEQ ID NO: 195581 - RNA, 22 nt, Homo sapiens
caaagugcuggccgggcgcagu

SEQ ID NO: 195582 - RNA, 22 nt, Homo sapiens
caagugcuuucuuggggauuua

SEQ ID NO: 195583 - RNA, 22 nt, Homo sapiens
caaugcauuauucucccacuuc

SEQ ID NO: 195584 - RNA, 22 nt, Homo sapiens
cacaaaguagauuagucuucca

SEQ ID NO: 195585 - RNA, 22 nt, Homo sapiens
cacacugucuucauuacuguag

SEQ ID NO: 195586 - RNA, 22 nt, Homo sapiens
caccaggugcccagcacggcca

SEQ ID NO: 195587 - RNA, 22 nt, Homo sapiens
caccagguggcugaggccauga

SEQ ID NO: 195588 - RNA, 22 nt, Homo sapiens
cacugcaauuacuuuugcacca

SEQ ID NO: 195589 - RNA, 22 nt, Homo sapiens
cacugcauccucugccuggcgg

SEQ ID NO: 195590 - RNA, 22 nt, Homo sapiens
cacugcauuacucaugagcaug

SEQ ID NO: 195591 - RNA, 22 nt, Homo sapiens
cacugggugagauccauguuua

SEQ ID NO: 195592 - RNA, 22 nt, Homo sapiens
cagcuugugguauugcugguug

SEQ ID NO: 195593 - RNA, 22 nt, Homo sapiens
cagugcaaagccucugcccaga

SEQ ID NO: 195594 - RNA, 22 nt, Homo sapiens
cagugcaugacuguauauuauc

SEQ ID NO: 195595 - RNA, 21 nt, Homo sapiens
cauaaugcuacuuauuuuaug

SEQ ID NO: 195596 - RNA, 22 nt, Homo sapiens
cauacagcuaguaaguguaaga

SEQ ID NO: 195597 - RNA, 22 nt, Homo sapiens
caucacagcaaguagggagugg

SEQ ID NO: 195598 - RNA, 22 nt, Homo sapiens
caucccauucgaggggcacagc

SEQ ID NO: 195599 - RNA, 19 nt, Homo sapiens
caucccugagcugaagugg

SEQ ID NO: 195600 - RNA, 22 nt, Homo sapiens
cauggccuuuggaaugugucua

SEQ ID NO: 195601 - RNA, 23 nt, Homo sapiens
cauggcuguuaacacuguuugag

SEQ ID NO: 195602 - RNA, 22 nt, Homo sapiens
cauugcacuccagcccagguga

SEQ ID NO: 195603 - RNA, 22 nt, Homo sapiens
cauugcaugcauauggcuuggu

SEQ ID NO: 195604 - RNA, 22 nt, Homo sapiens
ccagucuuggugucuguagcac

SEQ ID NO: 195605 - RNA, 21 nt, Homo sapiens
cccagguucucugaggguaga

SEQ ID NO: 195606 - RNA, 22 nt, Homo sapiens
cccugaagaaagccuaggacau

SEQ ID NO: 195607 - RNA, 22 nt, Homo sapiens
cccugagaugugaauuucagag

SEQ ID NO: 195608 - RNA, 22 nt, Homo sapiens
ccuaaguaauggcaguuuuugc

SEQ ID NO: 195609 - RNA, 22 nt, Homo sapiens
ccuaggcacugggguccagccc

SEQ ID NO: 195610 - RNA, 22 nt, Homo sapiens
ccugaugacacgggagauguac

SEQ ID NO: 195611 - RNA, 22 nt, Homo sapiens
ccuggaaugaagcuuauauugc

SEQ ID NO: 195612 - RNA, 18 nt, Homo sapiens
ccuuaguuauagagaguc

SEQ ID NO: 195613 - RNA, 22 nt, Homo sapiens
cuaauucuguaccuggcacaua

SEQ ID NO: 195614 - RNA, 22 nt, Homo sapiens
cuacauuguagguauucaaacu

SEQ ID NO: 195615 - RNA, 22 nt, Homo sapiens
cuacugcacaucaucugaguua

SEQ ID NO: 195616 - RNA, 22 nt, Homo sapiens
cuagacuagacccaaauugaag

SEQ ID NO: 195617 - RNA, 22 nt, Homo sapiens
cuauggccugcuuagaacauac

SEQ ID NO: 195618 - RNA, 22 nt, Homo sapiens
cuauuugguuggugaaaaaagu

SEQ ID NO: 195619 - RNA, 22 nt, Homo sapiens
cucaaagugcugggacuggcug

SEQ ID NO: 195620 - RNA, 22 nt, Homo sapiens
cucaccuugugauccacccgcc

SEQ ID NO: 195621 - RNA, 22 nt, Homo sapiens
cucaccuugugauccuccugcc

SEQ ID NO: 195622 - RNA, 22 nt, Homo sapiens
cucacuaguaaggcuguuuagu

SEQ ID NO: 195623 - RNA, 17 nt, Homo sapiens
cucacugagaacagcua

SEQ ID NO: 195624 - RNA, 22 nt, Homo sapiens
cucaguacuugcacagaagaac

SEQ ID NO: 195625 - RNA, 19 nt, Homo sapiens
cucauggagaaggagaaua

SEQ ID NO: 195626 - RNA, 22 nt, Homo sapiens
cuccuggugauuggagugugaa

SEQ ID NO: 195627 - RNA, 22 nt, Homo sapiens
cugaaauggaaugugugcacag

SEQ ID NO: 195628 - RNA, 22 nt, Homo sapiens
cugagagugguauguuuaagug

SEQ ID NO: 195629 - RNA, 21 nt, Homo sapiens
cugcaaaugcugcugccugau

SEQ ID NO: 195630 - RNA, 22 nt, Homo sapiens
cugcaagaaucguaguauuuga

SEQ ID NO: 195631 - RNA, 22 nt, Homo sapiens
cugcaguaaccacuguaggugu

SEQ ID NO: 195632 - RNA, 22 nt, Homo sapiens
cuggcaaauaguagagccagga

SEQ ID NO: 195633 - RNA, 22 nt, Homo sapiens
cugugguauuauuagaaauauc

SEQ ID NO: 195634 - RNA, 22 nt, Homo sapiens
cugugguuuaaggaauuuugac

SEQ ID NO: 195635 - RNA, 22 nt, Homo sapiens
cuucaaaguuggcuaggagaca

SEQ ID NO: 195636 - RNA, 22 nt, Homo sapiens
cuucuugcuguguccucacaug

SEQ ID NO: 195637 - RNA, 22 nt, Homo sapiens
cuugagcauauucuauauuaaa

SEQ ID NO: 195638 - RNA, 22 nt, Homo sapiens
cuuggcauugccccuggaauuu

SEQ ID NO: 195639 - RNA, 22 nt, Homo sapiens
cuuggcauuguguugauagaag

SEQ ID NO: 195640 - RNA, 22 nt, Homo sapiens
cuuggcuugguaucaaauaacc

SEQ ID NO: 195641 - RNA, 22 nt, Homo sapiens
cuugggcagugugcauguguau

SEQ ID NO: 195642 - RNA, 22 nt, Homo sapiens
cuugucuugcacacgguugcca

SEQ ID NO: 195643 - RNA, 22 nt, Homo sapiens
cuuuacaguuggacucacgagg

SEQ ID NO: 195644 - RNA, 22 nt, Homo sapiens
cuuuggcauuagccuguauaga

SEQ ID NO: 195645 - RNA, 23 nt, Homo sapiens
cuuugguaggaaauuugaauuau

SEQ ID NO: 195646 - RNA, 22 nt, Homo sapiens
cuuuuguggaucuucuguugcu

SEQ ID NO: 195647 - RNA, 22 nt, Homo sapiens
gaaagacuuucugcuguggaua

SEQ ID NO: 195648 - RNA, 22 nt, Homo sapiens
gaagguacgcuuaggaaaugau

SEQ ID NO: 195649 - RNA, 22 nt, Homo sapiens
gaaucauuguuucuaaguuugu

SEQ ID NO: 195650 - RNA, 22 nt, Homo sapiens
gaaugauacuguuaacgaaaga

SEQ ID NO: 195651 - RNA, 22 nt, Homo sapiens
gaauguuuacuuuguuuaauac

SEQ ID NO: 195652 - RNA, 22 nt, Homo sapiens
gaauucugucgcuuacuagaug

SEQ ID NO: 195653 - RNA, 22 nt, Homo sapiens
gacaguguggcgauuccucaag

SEQ ID NO: 195654 - RNA, 19 nt, Homo sapiens
gacuccagaguugugugcu

SEQ ID NO: 195655 - RNA, 22 nt, Homo sapiens
gagagguaguuuuuuggucguc

SEQ ID NO: 195656 - RNA, 22 nt, Homo sapiens
gagaucauugugggccaagcug

SEQ ID NO: 195657 - RNA, 22 nt, Homo sapiens
gagcaguugagagugcuggcca

SEQ ID NO: 195658 - RNA, 22 nt, Homo sapiens
gagcuagaauauuuuguauagu

SEQ ID NO: 195659 - RNA, 22 nt, Homo sapiens
gagcugaaguuuccauuuguac

SEQ ID NO: 195660 - RNA, 22 nt, Homo sapiens
gagguggugguggaggcauagc

SEQ ID NO: 195661 - RNA, 23 nt, Homo sapiens
gaguacauuaaaagcccagacug

SEQ ID NO: 195662 - RNA, 22 nt, Homo sapiens
gaguagugcugcaguaaacaua

SEQ ID NO: 195663 - RNA, 22 nt, Homo sapiens
gagucuauucaauguaguuaga

SEQ ID NO: 195664 - RNA, 22 nt, Homo sapiens
gaucacaugggagaaugagagu

SEQ ID NO: 195665 - RNA, 22 nt, Homo sapiens
gauuccauuuguggcuauuuac

SEQ ID NO: 195666 - RNA, 22 nt, Homo sapiens
gcaaaguaauuguuguuuuugc

SEQ ID NO: 195667 - RNA, 22 nt, Homo sapiens
gcaaaugcuaugccauuuuaua

SEQ ID NO: 195668 - RNA, 22 nt, Homo sapiens
gcagcaguggcaguuaauauuu

SEQ ID NO: 195669 - RNA, 22 nt, Homo sapiens
gccaagauugguuuaauauucc

SEQ ID NO: 195670 - RNA, 22 nt, Homo sapiens
gccaagauuuaauucaucaguu

SEQ ID NO: 195671 - RNA, 22 nt, Homo sapiens
gcuauggccugaauguuugugu

SEQ ID NO: 195672 - RNA, 22 nt, Homo sapiens
gcuuugcaauggcauugaccau

SEQ ID NO: 195673 - RNA, 22 nt, Homo sapiens
gcuuuggcauguagauguaugg

SEQ ID NO: 195674 - RNA, 17 nt, Homo sapiens
ggaaugaauuccagccc

SEQ ID NO: 195675 - RNA, 22 nt, Homo sapiens
ggcaaagagacaugcaucgggg

SEQ ID NO: 195676 - RNA, 22 nt, Homo sapiens
ggcaagugggagggaguguuuc

SEQ ID NO: 195677 - RNA, 21 nt, Homo sapiens
ggcaagugugagguuuggggu

SEQ ID NO: 195678 - RNA, 22 nt, Homo sapiens
ggcacaaugucagcucacugca

SEQ ID NO: 195679 - RNA, 23 nt, Homo sapiens
ugcuccccucauggaugaauaaa

SEQ ID NO: 195680 - RNA, 19 nt, Homo sapiens
ugcugcauugugaccuugc

SEQ ID NO: 195681 - RNA, 20 nt, Homo sapiens
uggaaucugaagaucucagu

SEQ ID NO: 195682 - RNA, 23 nt, Homo sapiens
uggaggacaagcauggauaguga

SEQ ID NO: 195683 - RNA, 20 nt, Homo sapiens
uggaguuguggcaguuugga

SEQ ID NO: 195684 - RNA, 22 nt, Homo sapiens
uggauggucagaggguuucugu

SEQ ID NO: 195685 - RNA, 22 nt, Homo sapiens
uggcaagaaccacaguuacuuu

SEQ ID NO: 195686 - RNA, 22 nt, Homo sapiens
uggcaagaucacaauuacuuuu

SEQ ID NO: 195687 - RNA, 18 nt, Homo sapiens
uggcaaguuuaguagcac

SEQ ID NO: 195688 - RNA, 22 nt, Homo sapiens
uggcauggaguggauggcccca

SEQ ID NO: 195689 - RNA, 22 nt, Homo sapiens
uggcuuuuaucuacucucaacu

SEQ ID NO: 195690 - RNA, 22 nt, Homo sapiens
ugggaagaagguuuacuugcca

SEQ ID NO: 195691 - RNA, 22 nt, Homo sapiens
uggucucuuugcuuuagucauc

SEQ ID NO: 195692 - RNA, 20 nt, Homo sapiens
ugguguuugaacagugaaug

SEQ ID NO: 195693 - RNA, 22 nt, Homo sapiens
ugguguuugagaagcugauguc

SEQ ID NO: 195694 - RNA, 22 nt, Homo sapiens
ugucacuuugccuucuggacuu

SEQ ID NO: 195695 - RNA, 23 nt, Homo sapiens
agaugcauucuuguaggauauau

SEQ ID NO: 195696 - RNA, 22 nt, Homo sapiens
agcacagccuuguguuuucuug

SEQ ID NO: 195697 - RNA, 22 nt, Homo sapiens
agcaccauuucucuaaagcacu

SEQ ID NO: 195698 - RNA, 22 nt, Homo sapiens
agcagcaccaaacagacuaaga

SEQ ID NO: 195699 - RNA, 22 nt, Homo sapiens
agcagcauuaugauauaucuua

SEQ ID NO: 195700 - RNA, 22 nt, Homo sapiens
agcaggucuuaacuugugaggu

SEQ ID NO: 195701 - RNA, 16 nt, Homo sapiens
agcagguguuagguga

SEQ ID NO: 195702 - RNA, 22 nt, Homo sapiens
agcuccaugauaguaugucugu

SEQ ID NO: 195703 - RNA, 20 nt, Homo sapiens
agcuugguuuggaugaucac

SEQ ID NO: 195704 - RNA, 22 nt, Homo sapiens
agcuuuuugggcagcuauugac

SEQ ID NO: 195705 - RNA, 22 nt, Homo sapiens
aggaagcuagcauuuguucagu

SEQ ID NO: 195706 - RNA, 22 nt, Homo sapiens
aggagguugguaccaucuguuu

SEQ ID NO: 195707 - RNA, 21 nt, Homo sapiens
aggcaaaugaagcagccgcuc

SEQ ID NO: 195708 - RNA, 22 nt, Homo sapiens
aggcaggugaaagauaguuuua

SEQ ID NO: 195709 - RNA, 22 nt, Homo sapiens
agguauauuggacagauguaaa

SEQ ID NO: 195710 - RNA, 22 nt, Homo sapiens
agucagugcauaagaaugaagu

SEQ ID NO: 195711 - RNA, 22 nt, Homo sapiens
agucugguguucucacacuagu

SEQ ID NO: 195712 - RNA, 22 nt, Homo sapiens
agugcaaggacauuuagguugu

SEQ ID NO: 195713 - RNA, 22 nt, Homo sapiens
agugcauuugcaucucaauaua

SEQ ID NO: 195714 - RNA, 22 nt, Homo sapiens
auaaacagcuuauccucuauuc

SEQ ID NO: 195715 - RNA, 22 nt, Homo sapiens
auaaaugcaaugguauuuuuga

SEQ ID NO: 195716 - RNA, 22 nt, Homo sapiens
auaaaugcuuagaucuguauau

SEQ ID NO: 195717 - RNA, 22 nt, Homo sapiens
auacaagcaguccaacuccaua

SEQ ID NO: 195718 - RNA, 22 nt, Homo sapiens
auacaucugccauguuggugug

SEQ ID NO: 195719 - RNA, 22 nt, Homo sapiens
auagauucauuugaggagauuu

SEQ ID NO: 195720 - RNA, 22 nt, Homo sapiens
auagcuguccuuacuagcuagg

SEQ ID NO: 195721 - RNA, 22 nt, Homo sapiens
auaguggcaugaucauagcuca

SEQ ID NO: 195722 - RNA, 22 nt, Homo sapiens
auauaugcuaagugcuaauaaa

SEQ ID NO: 195723 - RNA, 22 nt, Homo sapiens
auaucugcauugccauuuaugu

SEQ ID NO: 195724 - RNA, 22 nt, Homo sapiens
auauuguacugcuacugguucu

SEQ ID NO: 195725 - RNA, 22 nt, Homo sapiens
aucagaaucucuagaggacugu

SEQ ID NO: 195726 - RNA, 22 nt, Homo sapiens
aucaggcacacauuggaguuug

SEQ ID NO: 195727 - RNA, 22 nt, Homo sapiens
aucuacagccagucugguuugu

SEQ ID NO: 195728 - RNA, 22 nt, Homo sapiens
aucugcaaagcugggcugagac

SEQ ID NO: 195729 - RNA, 22 nt, Homo sapiens
aucuucucuugaagggugggga

SEQ ID NO: 195730 - RNA, 22 nt, Homo sapiens
augaaugcuuuuggauguaucu

SEQ ID NO: 195731 - RNA, 22 nt, Homo sapiens
augacauguauuuccaggauuu

SEQ ID NO: 195732 - RNA, 19 nt, Homo sapiens
augagaacagacuccauuu

SEQ ID NO: 195733 - RNA, 22 nt, Homo sapiens
augagaacauaucaagugauug

SEQ ID NO: 195734 - RNA, 22 nt, Homo sapiens
augagaaugauucuguuauggu

SEQ ID NO: 195735 - RNA, 22 nt, Homo sapiens
augaggcuauaauuuuuaugua

SEQ ID NO: 195736 - RNA, 22 nt, Homo sapiens
augauacguuacuucacugggg

SEQ ID NO: 195737 - RNA, 22 nt, Homo sapiens
augauauggucacccuuaugaa

SEQ ID NO: 195738 - RNA, 22 nt, Homo sapiens
augcaacuugaaauuuuccgga

SEQ ID NO: 195739 - RNA, 22 nt, Homo sapiens
augcaagacaccgauuagcuuu

SEQ ID NO: 195740 - RNA, 22 nt, Homo sapiens
augcaauggaaaggacaauuac

SEQ ID NO: 195741 - RNA, 19 nt, Homo sapiens
augcaaugucacaggcugc

SEQ ID NO: 195742 - RNA, 22 nt, Homo sapiens
augcaauucuagauugauagua

SEQ ID NO: 195743 - RNA, 22 nt, Homo sapiens
augcagcugaggguaguggagc

SEQ ID NO: 195744 - RNA, 22 nt, Homo sapiens
augccacuguuuaugucacuua

SEQ ID NO: 195745 - RNA, 22 nt, Homo sapiens
augcuaugugugacuucuuaug

SEQ ID NO: 195746 - RNA, 22 nt, Homo sapiens
auggcaaaaaaugcaauuacuu

SEQ ID NO: 195747 - RNA, 22 nt, Homo sapiens
auggcacuaaugggaguuuacu

SEQ ID NO: 195748 - RNA, 22 nt, Homo sapiens
auggcacugaagcguauugaca

SEQ ID NO: 195749 - RNA, 22 nt, Homo sapiens
auggcagcccucuuuauccaug

SEQ ID NO: 195750 - RNA, 22 nt, Homo sapiens
augguugguuaaaucuguguau

SEQ ID NO: 195751 - RNA, 22 nt, Homo sapiens
augucugguagccaccuggagg

SEQ ID NO: 195752 - RNA, 22 nt, Homo sapiens
augugcaaauuuccaaacucuu

SEQ ID NO: 195753 - RNA, 22 nt, Homo sapiens
augugcaagaucauuaaagcuc

SEQ ID NO: 195754 - RNA, 22 nt, Homo sapiens
auuagguagugagaugcugcug

SEQ ID NO: 195755 - RNA, 22 nt, Homo sapiens
auuagguuggugcaaaaguaau

SEQ ID NO: 195756 - RNA, 22 nt, Homo sapiens
auuaucacaguuuugcauaugg

SEQ ID NO: 195757 - RNA, 22 nt, Homo sapiens
auuccacuuagugacucauuug

SEQ ID NO: 195758 - RNA, 22 nt, Homo sapiens
auucccuuagcugccucagccu

SEQ ID NO: 195759 - RNA, 22 nt, Homo sapiens
auucccuuggucaacggaugca

SEQ ID NO: 195760 - RNA, 18 nt, Homo sapiens
auucuacaggccuuuuga

SEQ ID NO: 195761 - RNA, 23 nt, Homo sapiens
auugaacacuuucauaugugagg

SEQ ID NO: 195762 - RNA, 22 nt, Homo sapiens
auugaacuguuggagagguuuu

SEQ ID NO: 195763 - RNA, 16 nt, Homo sapiens
auugacaguggguguu

SEQ ID NO: 195764 - RNA, 22 nt, Homo sapiens
auugagcaaggucuccuaguau

SEQ ID NO: 195765 - RNA, 20 nt, Homo sapiens
auugcagcaugauuuauaau

SEQ ID NO: 195766 - RNA, 19 nt, Homo sapiens
auugcaguguaaaacuauu

SEQ ID NO: 195767 - RNA, 22 nt, Homo sapiens
auugcuauuauuugaccauugu

SEQ ID NO: 195768 - RNA, 22 nt, Homo sapiens
auuggcaauagcuuucuuacua

SEQ ID NO: 195769 - RNA, 22 nt, Homo sapiens
auuguacuccagccugggugac

SEQ ID NO: 195770 - RNA, 22 nt, Homo sapiens
auugucauuuauaacuguguag

SEQ ID NO: 195771 - RNA, 22 nt, Homo sapiens
auuguguagucuuacugcuugc

SEQ ID NO: 195772 - RNA, 22 nt, Homo sapiens
auuugucacuauguggcuaaua

SEQ ID NO: 195773 - RNA, 22 nt, Homo sapiens
caaaguaauugugguuuugcca

SEQ ID NO: 195774 - RNA, 22 nt, Homo sapiens
caaagucuucucauuaugucuu

SEQ ID NO: 195775 - RNA, 22 nt, Homo sapiens
caaagugcuggaauuggccggg

SEQ ID NO: 195776 - RNA, 22 nt, Homo sapiens
caaccaguagcugaguucaaaa

SEQ ID NO: 195777 - RNA, 22 nt, Homo sapiens
caagagagcugaugguuuuaaa

SEQ ID NO: 195778 - RNA, 22 nt, Homo sapiens
caagugcuacagagaaaucuuu

SEQ ID NO: 195779 - RNA, 22 nt, Homo sapiens
caagugcucuaggauccugagu

SEQ ID NO: 195780 - RNA, 22 nt, Homo sapiens
caagugcuugaugaaugaucaa

SEQ ID NO: 195781 - RNA, 22 nt, Homo sapiens
caaguguuuccuuaaauacuug

SEQ ID NO: 195782 - RNA, 22 nt, Homo sapiens
cacugcacuccaguuuggauga

SEQ ID NO: 195783 - RNA, 21 nt, Homo sapiens
cacugcaucacaggacagcau

SEQ ID NO: 195784 - RNA, 22 nt, Homo sapiens
cacugcauccuccaccuccugg

SEQ ID NO: 195785 - RNA, 22 nt, Homo sapiens
cacugcauccuugaccuucugg

SEQ ID NO: 195786 - RNA, 22 nt, Homo sapiens
cacugcauggucuagcuggguu

SEQ ID NO: 195787 - RNA, 22 nt, Homo sapiens
cacugcauuggaugguuccucc

SEQ ID NO: 195788 - RNA, 17 nt, Homo sapiens
cacugggugcaagagga

SEQ ID NO: 195789 - RNA, 22 nt, Homo sapiens
cacugggugccauauguuugcu

SEQ ID NO: 195790 - RNA, 22 nt, Homo sapiens
cacuggguuagaacaugcuccu

SEQ ID NO: 195791 - RNA, 22 nt, Homo sapiens
cacuggucagugaaacaguauu

SEQ ID NO: 195792 - RNA, 22 nt, Homo sapiens
cagcccguaaucccagcacuuu

SEQ ID NO: 195793 - RNA, 22 nt, Homo sapiens
caggugcuuacuuaauagccau

SEQ ID NO: 195794 - RNA, 22 nt, Homo sapiens
cagugcauguggcacucuccag

SEQ ID NO: 195795 - RNA, 22 nt, Homo sapiens
cagugguuuucaacccugguug

SEQ ID NO: 195796 - RNA, 22 nt, Homo sapiens
cauggcacugagcagguaugca

SEQ ID NO: 195797 - RNA, 22 nt, Homo sapiens
cauggcuuuauuuucagcuucu

SEQ ID NO: 195798 - RNA, 22 nt, Homo sapiens
cauugcaugccagccugggcaa

SEQ ID NO: 195799 - RNA, 19 nt, Homo sapiens
cauuggacuugcuuuugcc

SEQ ID NO: 195800 - RNA, 22 nt, Homo sapiens
ccaaggcacugauucuguacuc

SEQ ID NO: 195801 - RNA, 22 nt, Homo sapiens
ccaaguguuuucauuguuccau

SEQ ID NO: 195802 - RNA, 23 nt, Homo sapiens
ccacacuguuuagaauggcauca

SEQ ID NO: 195803 - RNA, 22 nt, Homo sapiens
ccaccgggucccagcucugcuc

SEQ ID NO: 195804 - RNA, 22 nt, Homo sapiens
ccaucacaggccucagugggaa

SEQ ID NO: 195805 - RNA, 22 nt, Homo sapiens
ccaucccuuucugagcaguucc

SEQ ID NO: 195806 - RNA, 22 nt, Homo sapiens
cccugagaugcuguuaaucugu

SEQ ID NO: 195807 - RNA, 22 nt, Homo sapiens
ccucccuuuguugcaagggaaa

SEQ ID NO: 195808 - RNA, 22 nt, Homo sapiens
cgccugagcugaggaagcugca

SEQ ID NO: 195809 - RNA, 22 nt, Homo sapiens
cuaaaguagccaggacugcagg

SEQ ID NO: 195810 - RNA, 20 nt, Homo sapiens
cuaaucaucccagaagaaau

SEQ ID NO: 195811 - RNA, 22 nt, Homo sapiens
cuacagcagcccaguccccgaa

SEQ ID NO: 195812 - RNA, 22 nt, Homo sapiens
cuacaguucucaggaguuggcc

SEQ ID NO: 195813 - RNA, 22 nt, Homo sapiens
cuacaguucuuaauuaaguagu

SEQ ID NO: 195814 - RNA, 22 nt, Homo sapiens
cuagcacauuuaucuuuauaca

SEQ ID NO: 195815 - RNA, 19 nt, Homo sapiens
cuauugcacauagcugaag

SEQ ID NO: 195816 - RNA, 22 nt, Homo sapiens
cucaaaguguggucuguggguu

SEQ ID NO: 195817 - RNA, 22 nt, Homo sapiens
cucaccuugugauccacccacc

SEQ ID NO: 195818 - RNA, 22 nt, Homo sapiens
cucaggcacucugauuccagug

SEQ ID NO: 195819 - RNA, 22 nt, Homo sapiens
cucagugucuggggccccaggg

SEQ ID NO: 195820 - RNA, 22 nt, Homo sapiens
ucacugaaaccgccuccaccuc

SEQ ID NO: 195821 - RNA, 20 nt, Homo sapiens
ucacugagugguccacagua

SEQ ID NO: 195822 - RNA, 22 nt, Homo sapiens
ucacugcacuccagccuuuaug

SEQ ID NO: 195823 - RNA, 20 nt, Homo sapiens
ucacuggguucuugaagucu

SEQ ID NO: 195824 - RNA, 22 nt, Homo sapiens
ucagcacauucaaggccugccu

SEQ ID NO: 195825 - RNA, 23 nt, Homo sapiens
ucaguagucauugggaaagugug

SEQ ID NO: 195826 - RNA, 22 nt, Homo sapiens
ucaguaguuuuuuuacuaggug

SEQ ID NO: 195827 - RNA, 22 nt, Homo sapiens
ucagugucugcauucuuauugu

SEQ ID NO: 195828 - RNA, 22 nt, Homo sapiens
ucaguguuuggaaucucaauuu

SEQ ID NO: 195829 - RNA, 22 nt, Homo sapiens
ucaguuaaugcugccugcugga

SEQ ID NO: 195830 - RNA, 22 nt, Homo sapiens
ucaguucauggaggugucugcu

SEQ ID NO: 195831 - RNA, 22 nt, Homo sapiens
ucaugggagcccccaucaugag

SEQ ID NO: 195832 - RNA, 22 nt, Homo sapiens
ucauugcacucccagacacccu

SEQ ID NO: 195833 - RNA, 22 nt, Homo sapiens
ucauugcauguuaauuaaacag

SEQ ID NO: 195834 - RNA, 22 nt, Homo sapiens
uccaauguaaucaucauugaau

SEQ ID NO: 195835 - RNA, 22 nt, Homo sapiens
uccacagugguugaacuaguuu

SEQ ID NO: 195836 - RNA, 22 nt, Homo sapiens
uccacugagcuagaccacuugg

SEQ ID NO: 195837 - RNA, 19 nt, Homo sapiens
uccaugagcccacagugau

SEQ ID NO: 195838 - RNA, 22 nt, Homo sapiens
uccaugaguccauuagaaaaaa

SEQ ID NO: 195839 - RNA, 22 nt, Homo sapiens
uccauuuguucagcuucaggaa

SEQ ID NO: 195840 - RNA, 22 nt, Homo sapiens
ucccauguagcuaggauuacag

SEQ ID NO: 195841 - RNA, 22 nt, Homo sapiens
uccucaguggauuggauggugc

SEQ ID NO: 195842 - RNA, 22 nt, Homo sapiens
uccugagucagcauccguuugu

SEQ ID NO: 195843 - RNA, 22 nt, Homo sapiens
ucgcugggaagacugaaguguc

SEQ ID NO: 195844 - RNA, 22 nt, Homo sapiens
ucgguauuuuagaauugagacu

SEQ ID NO: 195845 - RNA, 22 nt, Homo sapiens
ucgugcaaacguaauugugguu

SEQ ID NO: 195846 - RNA, 17 nt, Homo sapiens
ucuaauaauaugcauuu

SEQ ID NO: 195847 - RNA, 22 nt, Homo sapiens
ucuauguuuuugcuaguagugu

SEQ ID NO: 195848 - RNA, 22 nt, Homo sapiens
ucucaguggcuuccucacuuuu

SEQ ID NO: 195849 - RNA, 22 nt, Homo sapiens
ucucaugaagguggagaguagg

SEQ ID NO: 195850 - RNA, 22 nt, Homo sapiens
uaacagucaagguuugaccagg

SEQ ID NO: 195851 - RNA, 18 nt, Homo sapiens
uaacagucucucaggauc

SEQ ID NO: 195852 - RNA, 22 nt, Homo sapiens
uaacaguggucugugguaucug

SEQ ID NO: 195853 - RNA, 22 nt, Homo sapiens
uaacugcaaccucugccugcug

SEQ ID NO: 195854 - RNA, 22 nt, Homo sapiens
uaacuguggaaaugacuuuaaa

SEQ ID NO: 195855 - RNA, 22 nt, Homo sapiens
uaagacuguuggcaauuuuugc

SEQ ID NO: 195856 - RNA, 22 nt, Homo sapiens
uaagaugaaggcucaccuagaa

SEQ ID NO: 195857 - RNA, 22 nt, Homo sapiens
uaaggaacucugauaucuggaa

SEQ ID NO: 195858 - RNA, 22 nt, Homo sapiens
uaaggcacucuucugugugccu

SEQ ID NO: 195859 - RNA, 22 nt, Homo sapiens
uaaguacaugcuagauggaaug

SEQ ID NO: 195860 - RNA, 22 nt, Homo sapiens
uaaguagcugggaguacaggca

SEQ ID NO: 195861 - RNA, 22 nt, Homo sapiens
uaagugaauguuggcuacugaa

SEQ ID NO: 195862 - RNA, 22 nt, Homo sapiens
uaauccuggcacuuugggaggc

SEQ ID NO: 195863 - RNA, 22 nt, Homo sapiens
uaaugcuguggucugguuuaaa

SEQ ID NO: 195864 - RNA, 22 nt, Homo sapiens
uaaugcuugguuguuuggaaaa

SEQ ID NO: 195865 - RNA, 22 nt, Homo sapiens
uacaaaucuagguuuguuacug

SEQ ID NO: 195866 - RNA, 22 nt, Homo sapiens
uacaagcaggaaaugguauaug

SEQ ID NO: 195867 - RNA, 22 nt, Homo sapiens
uacagaauugcagguguggcag

SEQ ID NO: 195868 - RNA, 22 nt, Homo sapiens
uacagcuaugugcaugcaugcu

SEQ ID NO: 195869 - RNA, 22 nt, Homo sapiens
uacaggugcucuacagacagga

SEQ ID NO: 195870 - RNA, 22 nt, Homo sapiens
uacaguauuaugagugauugaa

SEQ ID NO: 195871 - RNA, 22 nt, Homo sapiens
uacaugcaugggcaugugugca

SEQ ID NO: 195872 - RNA, 22 nt, Homo sapiens
uacauguauccauuguuuuugg

SEQ ID NO: 195873 - RNA, 22 nt, Homo sapiens
uacuacuuucugacaucuuuaa

SEQ ID NO: 195874 - RNA, 22 nt, Homo sapiens
uacucaauugcagucaccuggc

SEQ ID NO: 195875 - RNA, 22 nt, Homo sapiens
uacucacauucuguuucuugcu

SEQ ID NO: 195876 - RNA, 22 nt, Homo sapiens
uacucuuuagcuccuuaaggaa

SEQ ID NO: 195877 - RNA, 22 nt, Homo sapiens
uacugcaucgaaaugcuuuuau

SEQ ID NO: 195878 - RNA, 22 nt, Homo sapiens
uagaacauuccaggugauguug

SEQ ID NO: 195879 - RNA, 22 nt, Homo sapiens
uagaaugucagcuucuugaggg

SEQ ID NO: 195880 - RNA, 22 nt, Homo sapiens
uagagcaugugccauacguaca

SEQ ID NO: 195881 - RNA, 22 nt, Homo sapiens
uagagguagccuacuacacacc

SEQ ID NO: 195882 - RNA, 22 nt, Homo sapiens
uagauucaucuguuccuuuuga

SEQ ID NO: 195883 - RNA, 21 nt, Homo sapiens
uagcaaauugcuauuaaggca

SEQ ID NO: 195884 - RNA, 17 nt, Homo sapiens
uagcacagugccuggua

SEQ ID NO: 195885 - RNA, 22 nt, Homo sapiens
uagcagguguuccacaaauauu

SEQ ID NO: 195886 - RNA, 22 nt, Homo sapiens
uagcuccacagcuauauauaau

SEQ ID NO: 195887 - RNA, 22 nt, Homo sapiens
uagcuccagugggguuacugcu

SEQ ID NO: 195888 - RNA, 22 nt, Homo sapiens
uaggcaauggagauagaggaug

SEQ ID NO: 195889 - RNA, 20 nt, Homo sapiens
uagguuuucacagaauugcc

SEQ ID NO: 195890 - RNA, 22 nt, Homo sapiens
uagugcuagaugacuuugccau

SEQ ID NO: 195891 - RNA, 22 nt, Homo sapiens
uagugcuguaauucuaaugaaa

SEQ ID NO: 195892 - RNA, 22 nt, Homo sapiens
uauagcuaugggauguauuugc

SEQ ID NO: 195893 - RNA, 22 nt, Homo sapiens
uauaucacaugcacucauuuuc

SEQ ID NO: 195894 - RNA, 22 nt, Homo sapiens
uauauguucugugucccuuucg

SEQ ID NO: 195895 - RNA, 22 nt, Homo sapiens
uaucagcagagucauacuucaa

SEQ ID NO: 195896 - RNA, 22 nt, Homo sapiens
uaucuacauguagguauguaug

SEQ ID NO: 195897 - RNA, 22 nt, Homo sapiens
uaugagcaaaaugaggguuagu

SEQ ID NO: 195898 - RNA, 22 nt, Homo sapiens
uauggauuuuuuugacaagagc

SEQ ID NO: 195899 - RNA, 22 nt, Homo sapiens
uauggcauuuuguaagggcuug

SEQ ID NO: 195900 - RNA, 22 nt, Homo sapiens
uauggccuuuuuaaugauauug

SEQ ID NO: 195901 - RNA, 22 nt, Homo sapiens
uauuccuuuugcauuuccacau

SEQ ID NO: 195902 - RNA, 22 nt, Homo sapiens
uauugcaaauggugaucccagg

SEQ ID NO: 195903 - RNA, 22 nt, Homo sapiens
uauugcacuccucaugcauuug

SEQ ID NO: 195904 - RNA, 22 nt, Homo sapiens
uauugcauguugagcaguaccu

SEQ ID NO: 195905 - RNA, 22 nt, Homo sapiens
uauugccucagugacuuugggg

SEQ ID NO: 195906 - RNA, 22 nt, Homo sapiens
ucaaaugaucugcccgccuugg

SEQ ID NO: 195907 - RNA, 22 nt, Homo sapiens
ucaacagugggcacuguaaaug

SEQ ID NO: 195908 - RNA, 22 nt, Homo sapiens
ucacacugaaacuaggguguga

SEQ ID NO: 195909 - RNA, 22 nt, Homo sapiens
ucacacugaauuugaagcaaug

SEQ ID NO: 195910 - RNA, 22 nt, Homo sapiens
ucacacugucuugguuacucuu

SEQ ID NO: 195911 - RNA, 22 nt, Homo sapiens
ucacagauaaauaaagaugauu

SEQ ID NO: 195912 - RNA, 22 nt, Homo sapiens
ucacauggaggugauaguugaa

SEQ ID NO: 195913 - RNA, 22 nt, Homo sapiens
ucacauggggaagggacuagcu

SEQ ID NO: 195914 - RNA, 22 nt, Homo sapiens
ucacccugacaugcggccgaac

SEQ ID NO: 195915 - RNA, 22 nt, Homo sapiens
ucaccguguaucauuucauccg

SEQ ID NO: 195916 - RNA, 22 nt, Homo sapiens
ucaccuggagaagauggaucau

SEQ ID NO: 195917 - RNA, 22 nt, Homo sapiens
ucacgcugcugcaaccagccug

SEQ ID NO: 195918 - RNA, 23 nt, Homo sapiens
ucacuagaguccuggaguuugag

SEQ ID NO: 195919 - RNA, 22 nt, Homo sapiens
ucacuagaucaagggagagaaa

SEQ ID NO: 195920 - RNA, 22 nt, Homo sapiens
agguccacuuacuacuccuguu

SEQ ID NO: 195921 - RNA, 22 nt, Homo sapiens
aggugcucuuccuguaggucac

SEQ ID NO: 195922 - RNA, 22 nt, Homo sapiens
aggugcuugaaucuaugagcuc

SEQ ID NO: 195923 - RNA, 22 nt, Homo sapiens
agguuaucccgcauuauuuggu

SEQ ID NO: 195924 - RNA, 22 nt, Homo sapiens
agguuaugauuguagagcgagg

SEQ ID NO: 195925 - RNA, 20 nt, Homo sapiens
agguuauuauaauuagaaga

SEQ ID NO: 195926 - RNA, 22 nt, Homo sapiens
aguaaacuucagaguucuuccu

SEQ ID NO: 195927 - RNA, 22 nt, Homo sapiens
aguaacacaccugcauggugug

SEQ ID NO: 195928 - RNA, 22 nt, Homo sapiens
aguacaauguugaguagaagug

SEQ ID NO: 195929 - RNA, 22 nt, Homo sapiens
aguaccauuacucacuuauuuu

SEQ ID NO: 195930 - RNA, 22 nt, Homo sapiens
aguaccauuagauuaggaugac

SEQ ID NO: 195931 - RNA, 22 nt, Homo sapiens
aguaccauuccguuggagcugg

SEQ ID NO: 195932 - RNA, 16 nt, Homo sapiens
aguaguuuuacagauu

SEQ ID NO: 195933 - RNA, 22 nt, Homo sapiens
agucaagaaucucagcaucuuu

SEQ ID NO: 195934 - RNA, 22 nt, Homo sapiens
agucaagauggcaagguaaggc

SEQ ID NO: 195935 - RNA, 22 nt, Homo sapiens
agucaaggaggccuuucagaug

SEQ ID NO: 195936 - RNA, 22 nt, Homo sapiens
agucauagaguuugcccuucuc

SEQ ID NO: 195937 - RNA, 22 nt, Homo sapiens
agucugguguucucacacuagu

SEQ ID NO: 195938 - RNA, 22 nt, Homo sapiens
agugaaaucugaagaaggucau

SEQ ID NO: 195939 - RNA, 22 nt, Homo sapiens
agugaacaaagaagugcagaua

SEQ ID NO: 195940 - RNA, 22 nt, Homo sapiens
agugacuagaauaugaauuuua

SEQ ID NO: 195941 - RNA, 19 nt, Homo sapiens
agugagccaagauccuacc

SEQ ID NO: 195942 - RNA, 22 nt, Homo sapiens
agugagcuggagaaaagaaacu

SEQ ID NO: 195943 - RNA, 22 nt, Homo sapiens
agugcacucuuuccucucuuac

SEQ ID NO: 195944 - RNA, 22 nt, Homo sapiens
agugcacugcccgcuuccuguc

SEQ ID NO: 195945 - RNA, 22 nt, Homo sapiens
agugcauaugucuuuuuggaag

SEQ ID NO: 195946 - RNA, 22 nt, Homo sapiens
agugcauugcaucucugcuuca

SEQ ID NO: 195947 - RNA, 22 nt, Homo sapiens
agugccacugcacucuagccug

SEQ ID NO: 195948 - RNA, 22 nt, Homo sapiens
aguuuugguugaguuacuagca

SEQ ID NO: 195949 - RNA, 22 nt, Homo sapiens
auaaacugucaguggagaguaa

SEQ ID NO: 195950 - RNA, 22 nt, Homo sapiens
auaaagcuauuccucucuuuuu

SEQ ID NO: 195951 - RNA, 22 nt, Homo sapiens
auaaagguaagcacuauccuga

SEQ ID NO: 195952 - RNA, 22 nt, Homo sapiens
auaaaugcaaugguauuuuuga

SEQ ID NO: 195953 - RNA, 20 nt, Homo sapiens
auaaauguauagguguacau

SEQ ID NO: 195954 - RNA, 22 nt, Homo sapiens
cuuguucuccuaagaugaaugc

SEQ ID NO: 195955 - RNA, 22 nt, Homo sapiens
cuuuaguugucuccucaagggu

SEQ ID NO: 195956 - RNA, 21 nt, Homo sapiens
cuuuaugcuguguuagaaaag

SEQ ID NO: 195957 - RNA, 21 nt, Homo sapiens
cuuugcacugcuccucagcuc

SEQ ID NO: 195958 - RNA, 18 nt, Homo sapiens
cuuugcagcuuccagagg

SEQ ID NO: 195959 - RNA, 22 nt, Homo sapiens
cuuugcuaauccaacccucauc

SEQ ID NO: 195960 - RNA, 20 nt, Homo sapiens
cuuuggcaaugagaacaggg

SEQ ID NO: 195961 - RNA, 22 nt, Homo sapiens
cuuuggcauuagccuguauaga

SEQ ID NO: 195962 - RNA, 23 nt, Homo sapiens
cuuugguaggaaauuugaauuau

SEQ ID NO: 195963 - RNA, 22 nt, Homo sapiens
cuuuggucaauugcugugggga

SEQ ID NO: 195964 - RNA, 22 nt, Homo sapiens
cuuuggugagggauaaauuuca

SEQ ID NO: 195965 - RNA, 22 nt, Homo sapiens
cuuuuacacugguggugggaau

SEQ ID NO: 195966 - RNA, 22 nt, Homo sapiens
cuuuuacacuguuggugggaau

SEQ ID NO: 195967 - RNA, 23 nt, Homo sapiens
cuuuugcaaugugaucuugccac

SEQ ID NO: 195968 - RNA, 21 nt, Homo sapiens
cuuuugcacuccagccugggu

SEQ ID NO: 195969 - RNA, 22 nt, Homo sapiens
cuuuuggugugaagaagcucuu

SEQ ID NO: 195970 - RNA, 22 nt, Homo sapiens
cuuuugugauucuucaguuacu

SEQ ID NO: 195971 - RNA, 22 nt, Homo sapiens
cuuuuguggaucuucuguugcu

SEQ ID NO: 195972 - RNA, 22 nt, Homo sapiens
cuuuuugcuagagucuaggguc

SEQ ID NO: 195973 - RNA, 22 nt, Homo sapiens
gaaagauuuccugagcuagaaa

SEQ ID NO: 195974 - RNA, 22 nt, Homo sapiens
gaaagcugguauagauacauua

SEQ ID NO: 195975 - RNA, 22 nt, Homo sapiens
gaaagugcugcuugacugggau

SEQ ID NO: 195976 - RNA, 22 nt, Homo sapiens
gaaauggaucagagcaagcuuu

SEQ ID NO: 195977 - RNA, 22 nt, Homo sapiens
gaagaacuaggugagaucuaga

SEQ ID NO: 195978 - RNA, 22 nt, Homo sapiens
gaagacauuuacaugggagacc

SEQ ID NO: 195979 - RNA, 22 nt, Homo sapiens
gaagaucacacuguagaucuau

SEQ ID NO: 195980 - RNA, 22 nt, Homo sapiens
gaagauucaaccaaaccagaac

SEQ ID NO: 195981 - RNA, 22 nt, Homo sapiens
gaaggugcuuggugaaugcauu

SEQ ID NO: 195982 - RNA, 23 nt, Homo sapiens
gaaguaauaaauggauucuuaac

SEQ ID NO: 195983 - RNA, 22 nt, Homo sapiens
gaaguaggugcuguuauuaucu

SEQ ID NO: 195984 - RNA, 23 nt, Homo sapiens
gaaguauagcaugcacauggaaa

SEQ ID NO: 195985 - RNA, 22 nt, Homo sapiens
gaagugcuuuuggacuaacagu

SEQ ID NO: 195986 - RNA, 17 nt, Homo sapiens
gaaguguuucagcagcu

SEQ ID NO: 195987 - RNA, 17 nt, Homo sapiens
gaaguguuucuucauga

SEQ ID NO: 195988 - RNA, 22 nt, Homo sapiens
gaauagugcugcaauaaacaua

SEQ ID NO: 195989 - RNA, 22 nt, Homo sapiens
gaauagugcugcaaugaacaua

SEQ ID NO: 195990 - RNA, 22 nt, Homo sapiens
gaaucaauugaucuaugugucu

SEQ ID NO: 195991 - RNA, 22 nt, Homo sapiens
gaaucacugugguaucccaugc

SEQ ID NO: 195992 - RNA, 22 nt, Homo sapiens
gaaucauuguuucuaaguuugu

SEQ ID NO: 195993 - RNA, 22 nt, Homo sapiens
gaaugcaugaggggaucagaug

SEQ ID NO: 195994 - RNA, 22 nt, Homo sapiens
gaauggaacugacuauagcuga

SEQ ID NO: 195995 - RNA, 22 nt, Homo sapiens
gaaugucuuauugcucguugua

SEQ ID NO: 195996 - RNA, 22 nt, Homo sapiens
gaauucugucgcuuacuagaug

SEQ ID NO: 195997 - RNA, 22 nt, Homo sapiens
gacaaguuugauuuauuccaag

SEQ ID NO: 195998 - RNA, 22 nt, Homo sapiens
gacacagugaagucucuacuug

SEQ ID NO: 195999 - RNA, 22 nt, Homo sapiens
gacagacacaauugauccauga

SEQ ID NO: 196000 - RNA, 22 nt, Homo sapiens
gacagugagaugucaugugaaa

SEQ ID NO: 196001 - RNA, 18 nt, Homo sapiens
gacaguguggcgauuccu

SEQ ID NO: 196002 - RNA, 22 nt, Homo sapiens
gacaguguggcgauuccucaag

SEQ ID NO: 196003 - RNA, 22 nt, Homo sapiens
gacauguaaggcucucucuguu

SEQ ID NO: 196004 - RNA, 22 nt, Homo sapiens
gacauguuuucaagauuuauaa

SEQ ID NO: 196005 - RNA, 22 nt, Homo sapiens
gacauguuuucauguauuugga

SEQ ID NO: 196006 - RNA, 22 nt, Homo sapiens
gaccacagacuggaaagagggc

SEQ ID NO: 196007 - RNA, 21 nt, Homo sapiens
gaccacagcagggaaugucag

SEQ ID NO: 196008 - RNA, 22 nt, Homo sapiens
gacccuuagaaugugaucuuau

SEQ ID NO: 196009 - RNA, 22 nt, Homo sapiens
gacuagggaaaauuauuuuguu

SEQ ID NO: 196010 - RNA, 22 nt, Homo sapiens
gacuauaucaggaauggggauu

SEQ ID NO: 196011 - RNA, 22 nt, Homo sapiens
gacuggcuguuuucuuuauuau

SEQ ID NO: 196012 - RNA, 22 nt, Homo sapiens
gacuucaucauacuaugugugg

SEQ ID NO: 196013 - RNA, 20 nt, Homo sapiens
gacuugagagugggagagua

SEQ ID NO: 196014 - RNA, 22 nt, Homo sapiens
gagaacagaagcauuccuaauu

SEQ ID NO: 196015 - RNA, 22 nt, Homo sapiens
gagaacauacggcauuugguuu

SEQ ID NO: 196016 - RNA, 22 nt, Homo sapiens
gagaacugagauaagugauauu

SEQ ID NO: 196017 - RNA, 22 nt, Homo sapiens
gagaacugagugugcuggcgga

SEQ ID NO: 196018 - RNA, 22 nt, Homo sapiens
gagaacuggcugauucaaggac

SEQ ID NO: 196019 - RNA, 22 nt, Homo sapiens
gcacaguguuacuugauauauu

SEQ ID NO: 196020 - RNA, 22 nt, Homo sapiens
gcacaguuaaagggucauguga

SEQ ID NO: 196021 - RNA, 22 nt, Homo sapiens
gcagaauugguuucuucuaagg

SEQ ID NO: 196022 - RNA, 19 nt, Homo sapiens
gcagagaugugguagcuug

SEQ ID NO: 196023 - RNA, 22 nt, Homo sapiens
auuggccccguuuuaaauguca

SEQ ID NO: 196024 - RNA, 22 nt, Homo sapiens
auuggcuuuauacauaagaaua

SEQ ID NO: 196025 - RNA, 22 nt, Homo sapiens
auuguacauacaccggugugua

SEQ ID NO: 196026 - RNA, 20 nt, Homo sapiens
auuguccuugauuacacaga

SEQ ID NO: 196027 - RNA, 22 nt, Homo sapiens
auuuggcaacguagggaggcau

SEQ ID NO: 196028 - RNA, 22 nt, Homo sapiens
auuuggcaauuuugaagaugcc

SEQ ID NO: 196029 - RNA, 20 nt, Homo sapiens
auuuggcauaguuuaagcaa

SEQ ID NO: 196030 - RNA, 22 nt, Homo sapiens
auuuggguaaugagugcaaggg

SEQ ID NO: 196031 - RNA, 21 nt, Homo sapiens
auuugguguuagaaauaaauu

SEQ ID NO: 196032 - RNA, 22 nt, Homo sapiens
auuugucaauacacuucuucca

SEQ ID NO: 196033 - RNA, 22 nt, Homo sapiens
auuuguccugccuuuuccuccu

SEQ ID NO: 196034 - RNA, 22 nt, Homo sapiens
caaaagugguucuuauccuuuu

SEQ ID NO: 196035 - RNA, 22 nt, Homo sapiens
caaaguaauuacgguuuuggcc

SEQ ID NO: 196036 - RNA, 22 nt, Homo sapiens
caaaguaauugcuguuuugcca

SEQ ID NO: 196037 - RNA, 22 nt, Homo sapiens
caaagugcuggaauuggccggg

SEQ ID NO: 196038 - RNA, 22 nt, Homo sapiens
caaagugcugggaugggccagg

SEQ ID NO: 196039 - RNA, 19 nt, Homo sapiens
caaaguguucuucuuugcc

SEQ ID NO: 196040 - RNA, 22 nt, Homo sapiens
caaauugcuuguggaggauaau

SEQ ID NO: 196041 - RNA, 22 nt, Homo sapiens
caacauccaccuccuggguuca

SEQ ID NO: 196042 - RNA, 22 nt, Homo sapiens
caacucuguaggauccaggugg

SEQ ID NO: 196043 - RNA, 22 nt, Homo sapiens
caagacuguccaacauauuggg

SEQ ID NO: 196044 - RNA, 22 nt, Homo sapiens
caagagagcugaugguuuuaaa

SEQ ID NO: 196045 - RNA, 22 nt, Homo sapiens
caagaucauuuaugcuaaaauu

SEQ ID NO: 196046 - RNA, 22 nt, Homo sapiens
auauuugguuaccugugggucu

SEQ ID NO: 196047 - RNA, 19 nt, Homo sapiens
aucaaacugcucuuugagg

SEQ ID NO: 196048 - RNA, 20 nt, Homo sapiens
aucaaagacuuagaggggga

SEQ ID NO: 196049 - RNA, 22 nt, Homo sapiens
aucaaagcagcauggcccaguc

SEQ ID NO: 196050 - RNA, 22 nt, Homo sapiens
aucaaaguaggcauauguuuuu

SEQ ID NO: 196051 - RNA, 22 nt, Homo sapiens
aucaaagugaauuaaugagaau

SEQ ID NO: 196052 - RNA, 22 nt, Homo sapiens
aucaaaugcuggcagagugccu

SEQ ID NO: 196053 - RNA, 22 nt, Homo sapiens
aucaagcuacacccuuuggaaa

SEQ ID NO: 196054 - RNA, 22 nt, Homo sapiens
aucacacucaccuucuguccuu

SEQ ID NO: 196055 - RNA, 22 nt, Homo sapiens
aucacagaguuaaaacuuucuu

SEQ ID NO: 196056 - RNA, 22 nt, Homo sapiens
aucaccuuucccuuucugaauc

SEQ ID NO: 196057 - RNA, 22 nt, Homo sapiens
aucacuuugcucuccagugugg

SEQ ID NO: 196058 - RNA, 22 nt, Homo sapiens
aucagagugaaacaugggagau

SEQ ID NO: 196059 - RNA, 22 nt, Homo sapiens
aucagaguugucagggagcuuu

SEQ ID NO: 196060 - RNA, 22 nt, Homo sapiens
aucagauuccacauuuuaucag

SEQ ID NO: 196061 - RNA, 22 nt, Homo sapiens
aucagauuccagaggcagcacc

SEQ ID NO: 196062 - RNA, 22 nt, Homo sapiens
aucauagcucacugcagccucg

SEQ ID NO: 196063 - RNA, 22 nt, Homo sapiens
aucauaucaucugcaaacaaag

SEQ ID NO: 196064 - RNA, 22 nt, Homo sapiens
aucauauccuagauauaacuuc

SEQ ID NO: 196065 - RNA, 22 nt, Homo sapiens
aucauggaguauuugcaagucu

SEQ ID NO: 196066 - RNA, 22 nt, Homo sapiens
aucauugugcaucuucauucca

SEQ ID NO: 196067 - RNA, 22 nt, Homo sapiens
auccaguuuuaggagauuucua

SEQ ID NO: 196068 - RNA, 22 nt, Homo sapiens
auccauguggauaaauguguau

SEQ ID NO: 196069 - RNA, 22 nt, Homo sapiens
auccauugcucaagagaaguca

SEQ ID NO: 196070 - RNA, 22 nt, Homo sapiens
aucccagaaacucggguuucuc

SEQ ID NO: 196071 - RNA, 22 nt, Homo sapiens
auccccuugcagugaccggggc

SEQ ID NO: 196072 - RNA, 22 nt, Homo sapiens
aucccuguaacuagcagccccu

SEQ ID NO: 196073 - RNA, 22 nt, Homo sapiens
aucccuuccuagcacuuggugu

SEQ ID NO: 196074 - RNA, 22 nt, Homo sapiens
auccucugagagaguuucauaa

SEQ ID NO: 196075 - RNA, 22 nt, Homo sapiens
auccucugagaucuaggcagag

SEQ ID NO: 196076 - RNA, 22 nt, Homo sapiens
gagacugagucucgcucugccg

SEQ ID NO: 196077 - RNA, 22 nt, Homo sapiens
gagacugagucuugcccuguca

SEQ ID NO: 196078 - RNA, 22 nt, Homo sapiens
gagacugaguuuugcucuuguu

SEQ ID NO: 196079 - RNA, 22 nt, Homo sapiens
gagagaguacuugauauaauuu

SEQ ID NO: 196080 - RNA, 22 nt, Homo sapiens
gagauaacuacuggauuaaguu

SEQ ID NO: 196081 - RNA, 22 nt, Homo sapiens
gagauauuuagaaauguguucu

SEQ ID NO: 196082 - RNA, 22 nt, Homo sapiens
gagaucaucuaaucuggccucu

SEQ ID NO: 196083 - RNA, 22 nt, Homo sapiens
gagaucaugcugguucucucau

SEQ ID NO: 196084 - RNA, 22 nt, Homo sapiens
gagaucauucugauccagaguc

SEQ ID NO: 196085 - RNA, 22 nt, Homo sapiens
gagaugauuugccccauguauu

SEQ ID NO: 196086 - RNA, 22 nt, Homo sapiens
gagauguagucuugcccuguca

SEQ ID NO: 196087 - RNA, 22 nt, Homo sapiens
gagauucuucaauauuuauucu

SEQ ID NO: 196088 - RNA, 22 nt, Homo sapiens
gagauuuucagcuugacuggga

SEQ ID NO: 196089 - RNA, 22 nt, Homo sapiens
gagcaacaguggcagugguggg

SEQ ID NO: 196090 - RNA, 22 nt, Homo sapiens
gagcacauguggagagucuggg

SEQ ID NO: 196091 - RNA, 22 nt, Homo sapiens
gcauggagcauacauuucuguu

SEQ ID NO: 196092 - RNA, 22 nt, Homo sapiens
gcauggccuuuaaaugucacag

SEQ ID NO: 196093 - RNA, 22 nt, Homo sapiens
gcauguaguagauguugaauaa

SEQ ID NO: 196094 - RNA, 22 nt, Homo sapiens
gccaagauuuaauucaucaguu

SEQ ID NO: 196095 - RNA, 22 nt, Homo sapiens
gccauagucauagauggcaggg

SEQ ID NO: 196096 - RNA, 22 nt, Homo sapiens
gccauggaggauuuauagaggc

SEQ ID NO: 196097 - RNA, 22 nt, Homo sapiens
gcccagcguucagggaggggcu

SEQ ID NO: 196098 - RNA, 22 nt, Homo sapiens
gccccugagacuugccucgggc

SEQ ID NO: 196099 - RNA, 22 nt, Homo sapiens
gcccuacuguuuauacauagga

SEQ ID NO: 196100 - RNA, 22 nt, Homo sapiens
gccuagagaaguaaauauuauc

SEQ ID NO: 196101 - RNA, 22 nt, Homo sapiens
gccucaguuguggccagggauu

SEQ ID NO: 196102 - RNA, 22 nt, Homo sapiens
gccuguagaagaguagaugacc

SEQ ID NO: 196103 - RNA, 19 nt, Homo sapiens
gcggcacuggagacacagc

SEQ ID NO: 196104 - RNA, 22 nt, Homo sapiens
gcuaaggcaggagcauugcuug

SEQ ID NO: 196105 - RNA, 22 nt, Homo sapiens
gcuaggagauccacugcucucu

SEQ ID NO: 196106 - RNA, 22 nt, Homo sapiens
gcucaaguaauggcaguuuugc

SEQ ID NO: 196107 - RNA, 22 nt, Homo sapiens
gcucaguuuccucagcugcaaa

SEQ ID NO: 196108 - RNA, 22 nt, Homo sapiens
gcucguccccuccugacucugc

SEQ ID NO: 196109 - RNA, 22 nt, Homo sapiens
gcucugguuacaaaggcaaauu

SEQ ID NO: 196110 - RNA, 21 nt, Homo sapiens
ggcucuguggucucagguuuc

SEQ ID NO: 196111 - RNA, 22 nt, Homo sapiens
ggcuuuggucacacaggggcaa

SEQ ID NO: 196112 - RNA, 22 nt, Homo sapiens
gggaaaaugucuauugaaugaa

SEQ ID NO: 196113 - RNA, 22 nt, Homo sapiens
gggaagugugcagaguucucuu

SEQ ID NO: 196114 - RNA, 22 nt, Homo sapiens
gggagcaaaaaugaugcccaag

SEQ ID NO: 196115 - RNA, 22 nt, Homo sapiens
gggagguaggaguuauuauuuu

SEQ ID NO: 196116 - RNA, 22 nt, Homo sapiens
gggaugaagaagaauaguucgu

SEQ ID NO: 196117 - RNA, 22 nt, Homo sapiens
gggcauguggacuuguauguuu

SEQ ID NO: 196118 - RNA, 22 nt, Homo sapiens
gggguuuuaccuucguauucuu

SEQ ID NO: 196119 - RNA, 17 nt, Homo sapiens
gggucaccuugcaggua

SEQ ID NO: 196120 - RNA, 22 nt, Homo sapiens
ggguucccuucuggcucagggu

SEQ ID NO: 196121 - RNA, 22 nt, Homo sapiens
gguaacaguggggcuaugcuua

SEQ ID NO: 196122 - RNA, 22 nt, Homo sapiens
ggucaguguuaucaccgaagga

SEQ ID NO: 196123 - RNA, 22 nt, Homo sapiens
ggugacugguuuaucuggcagu

SEQ ID NO: 196124 - RNA, 22 nt, Homo sapiens
ggugagaaagggauuccuguuc

SEQ ID NO: 196125 - RNA, 22 nt, Homo sapiens
ggugagcacagaaugcccugag

SEQ ID NO: 196126 - RNA, 19 nt, Homo sapiens
ggugcuugaauauuccucc

SEQ ID NO: 196127 - RNA, 22 nt, Homo sapiens
gguggcuuuuugugauggcuga

SEQ ID NO: 196128 - RNA, 22 nt, Homo sapiens
gguggugguauuucagaaaaug

SEQ ID NO: 196129 - RNA, 22 nt, Homo sapiens
ggugucaguuggccccuacugg

SEQ ID NO: 196130 - RNA, 22 nt, Homo sapiens
guaaaguaaagcacaucaaggu

SEQ ID NO: 196131 - RNA, 22 nt, Homo sapiens
guaaaugcagaugcaugaccuu

SEQ ID NO: 196132 - RNA, 18 nt, Homo sapiens
guaaauguaucuauugcc

SEQ ID NO: 196133 - RNA, 22 nt, Homo sapiens
guaacacucuaaagggaugcac

SEQ ID NO: 196134 - RNA, 22 nt, Homo sapiens
agccccauuuguugaaaagacg

SEQ ID NO: 196135 - RNA, 21 nt, Homo sapiens
agccugugggucauaguugcc

SEQ ID NO: 196136 - RNA, 22 nt, Homo sapiens
agccuguguugaauuauagaaa

SEQ ID NO: 196137 - RNA, 22 nt, Homo sapiens
agcggcuguuccccuggucuau

SEQ ID NO: 196138 - RNA, 20 nt, Homo sapiens
agcuaguauuuccaugguua

SEQ ID NO: 196139 - RNA, 21 nt, Homo sapiens
agcuccacucguucccaaagc

SEQ ID NO: 196140 - RNA, 22 nt, Homo sapiens
agcuccuuucugcaggcagguc

SEQ ID NO: 196141 - RNA, 20 nt, Homo sapiens
agcugcagauauaaauccgc

SEQ ID NO: 196142 - RNA, 20 nt, Homo sapiens
agcuggguguguuggugcau

SEQ ID NO: 196143 - RNA, 22 nt, Homo sapiens
agcugguccugugacuugcuuc

SEQ ID NO: 196144 - RNA, 22 nt, Homo sapiens
agcugguucuuugccuuguaga

SEQ ID NO: 196145 - RNA, 22 nt, Homo sapiens
agcugguuuauuucuauauccu

SEQ ID NO: 196146 - RNA, 22 nt, Homo sapiens
agcuucauuccaacuuccuucu

SEQ ID NO: 196147 - RNA, 21 nt, Homo sapiens
agcuuguguguaucacagugu

SEQ ID NO: 196148 - RNA, 19 nt, Homo sapiens
agcuuuggcuaacuuucuc

SEQ ID NO: 196149 - RNA, 22 nt, Homo sapiens
aggaaguaauaaguuugguucu

SEQ ID NO: 196150 - RNA, 22 nt, Homo sapiens
aggaaugucaaugguaguuuaa

SEQ ID NO: 196151 - RNA, 22 nt, Homo sapiens
aggaccccucaucagcaccagu

SEQ ID NO: 196152 - RNA, 22 nt, Homo sapiens
aggagaugaagcuuuaucuaaa

SEQ ID NO: 196153 - RNA, 20 nt, Homo sapiens
aggagcauuuacauuggcuc

SEQ ID NO: 196154 - RNA, 22 nt, Homo sapiens
aggagguagucugucccuuagc

SEQ ID NO: 196155 - RNA, 22 nt, Homo sapiens
aggaucauugacuauuauaagg

SEQ ID NO: 196156 - RNA, 22 nt, Homo sapiens
aggauuagagacuucucuaccu

SEQ ID NO: 196157 - RNA, 21 nt, Homo sapiens
aggcaagacuuuuagguuugu

SEQ ID NO: 196158 - RNA, 22 nt, Homo sapiens
aggcaagugggagacagcauuu

SEQ ID NO: 196159 - RNA, 22 nt, Homo sapiens
aggcaggugaaagauaguuuua

SEQ ID NO: 196160 - RNA, 22 nt, Homo sapiens
aggcaugaguucagaggguaug

SEQ ID NO: 196161 - RNA, 22 nt, Homo sapiens
aggcuagacuuugagaauuuuu

SEQ ID NO: 196162 - RNA, 22 nt, Homo sapiens
aggcuuauuaagauucccuuau

SEQ ID NO: 196163 - RNA, 20 nt, Homo sapiens
agguacacugacaugccuuc

SEQ ID NO: 196164 - RNA, 22 nt, Homo sapiens
agguagcauagcgggaauauca

SEQ ID NO: 196165 - RNA, 22 nt, Homo sapiens
agguauuuuuuauccuccagca

SEQ ID NO: 196166 - RNA, 22 nt, Homo sapiens
aggucaccucaggaaauacuga

SEQ ID NO: 196167 - RNA, 22 nt, Homo sapiens
aggugaaugcucacauucuaau

SEQ ID NO: 196168 - RNA, 22 nt, Homo sapiens
aggugcacucagaaaacagaua

SEQ ID NO: 196169 - RNA, 22 nt, Homo sapiens
agguucccuuuuggccugggau

SEQ ID NO: 196170 - RNA, 22 nt, Homo sapiens
agguuguugcaugcuccuuagg

SEQ ID NO: 196171 - RNA, 22 nt, Homo sapiens
aguaacaggauccaaagaaugu

SEQ ID NO: 196172 - RNA, 22 nt, Homo sapiens
aguaagucucaagguaggguag

SEQ ID NO: 196173 - RNA, 22 nt, Homo sapiens
aguagcauuggggggcauccuc

SEQ ID NO: 196174 - RNA, 20 nt, Homo sapiens
aguauucacuuuuuucaugg

SEQ ID NO: 196175 - RNA, 22 nt, Homo sapiens
agucaguggaguaaauguaauu

SEQ ID NO: 196176 - RNA, 22 nt, Homo sapiens
agucaguguguauugauggcac

SEQ ID NO: 196177 - RNA, 22 nt, Homo sapiens
uaagugaauguuggcuacugaa

SEQ ID NO: 196178 - RNA, 22 nt, Homo sapiens
uaagugaugucuuuuugugugc

SEQ ID NO: 196179 - RNA, 22 nt, Homo sapiens
uaagugcaacauaaguguuaaa

SEQ ID NO: 196180 - RNA, 20 nt, Homo sapiens
uaagugcuugaugaaugaac

SEQ ID NO: 196181 - RNA, 18 nt, Homo sapiens
uaagugcuuuaaacacau

SEQ ID NO: 196182 - RNA, 20 nt, Homo sapiens
uaagugcuuuauauugauua

SEQ ID NO: 196183 - RNA, 22 nt, Homo sapiens
uaaguugcagguugugauucca

SEQ ID NO: 196184 - RNA, 18 nt, Homo sapiens
uaauaacugugaccuuga

SEQ ID NO: 196185 - RNA, 22 nt, Homo sapiens
uaauaauguuaggcuuacucaa

SEQ ID NO: 196186 - RNA, 22 nt, Homo sapiens
uaauacauucaaggugguaguu

SEQ ID NO: 196187 - RNA, 22 nt, Homo sapiens
uaauacuagugaauagcaggau

SEQ ID NO: 196188 - RNA, 22 nt, Homo sapiens
uaauacuugucauaaaggcauu

SEQ ID NO: 196189 - RNA, 22 nt, Homo sapiens
uaauauguauacagacagauac

SEQ ID NO: 196190 - RNA, 22 nt, Homo sapiens
uaauaugugguugcuugggcac

SEQ ID NO: 196191 - RNA, 22 nt, Homo sapiens
uaauccuggcacuuugggaggc

SEQ ID NO: 196192 - RNA, 22 nt, Homo sapiens
uaauccugucuugaccaucagg

SEQ ID NO: 196193 - RNA, 22 nt, Homo sapiens
uaaucucagcugagcugagauu

SEQ ID NO: 196194 - RNA, 22 nt, Homo sapiens
uaaugcauguaaugggcugaua

SEQ ID NO: 196195 - RNA, 19 nt, Homo sapiens
uaaugccacugccuggcau

SEQ ID NO: 196196 - RNA, 22 nt, Homo sapiens
uaaugcuguggucuaaugggga

SEQ ID NO: 196197 - RNA, 22 nt, Homo sapiens
uaaugugaauagugcuguaaug

SEQ ID NO: 196198 - RNA, 22 nt, Homo sapiens
uaauucacauaaagcacuuaga

SEQ ID NO: 196199 - RNA, 22 nt, Homo sapiens
uacaaagcuuugaugugucuuu

SEQ ID NO: 196200 - RNA, 22 nt, Homo sapiens
uacaaagugggaaacgaagguu

SEQ ID NO: 196201 - RNA, 22 nt, Homo sapiens
uacaagcuaaaauggaagauca

SEQ ID NO: 196202 - RNA, 21 nt, Homo sapiens
uacaagcuguagcacaugcca

SEQ ID NO: 196203 - RNA, 22 nt, Homo sapiens
uacaaguaauaagggaagaauu

SEQ ID NO: 196204 - RNA, 21 nt, Homo sapiens
uacaaugcacaggagagccuc

SEQ ID NO: 196205 - RNA, 22 nt, Homo sapiens
uacacaugugaguucuuuucua

SEQ ID NO: 196206 - RNA, 22 nt, Homo sapiens
uacacgugcacaacgugcacgu

SEQ ID NO: 196207 - RNA, 22 nt, Homo sapiens
uacagaauugcagguguggcag

SEQ ID NO: 196208 - RNA, 22 nt, Homo sapiens
uacagaguagaagauuugcaga

SEQ ID NO: 196209 - RNA, 22 nt, Homo sapiens
uacagaguauccauuugaguuc

SEQ ID NO: 196210 - RNA, 23 nt, Homo sapiens
uacagcacacugaugggucuuga

SEQ ID NO: 196211 - RNA, 22 nt, Homo sapiens
uacagcacugugcauagugguu

SEQ ID NO: 196212 - RNA, 22 nt, Homo sapiens
uacagccacauaauguaugauu

SEQ ID NO: 196213 - RNA, 20 nt, Homo sapiens
uacaggacugagaaucugug

SEQ ID NO: 196214 - RNA, 22 nt, Homo sapiens
uacaggcaccuggcuaauuuuu

SEQ ID NO: 196215 - RNA, 22 nt, Homo sapiens
uacaggugcucuacagacagga

SEQ ID NO: 196216 - RNA, 22 nt, Homo sapiens
uacaguagaaugucuuucaaaa

SEQ ID NO: 196217 - RNA, 20 nt, Homo sapiens
agucaguuuauuuucucucu

SEQ ID NO: 196218 - RNA, 22 nt, Homo sapiens
agucaugggagagaugugaucg

SEQ ID NO: 196219 - RNA, 22 nt, Homo sapiens
aguccauuugaugaugauucca

SEQ ID NO: 196220 - RNA, 23 nt, Homo sapiens
agucuguguuuacaggcucucug

SEQ ID NO: 196221 - RNA, 22 nt, Homo sapiens
agugauuuuaacuuccagcaau

SEQ ID NO: 196222 - RNA, 22 nt, Homo sapiens
agugcaauggcgugaucuuggc

SEQ ID NO: 196223 - RNA, 22 nt, Homo sapiens
agugcacuccagccugggcaac

SEQ ID NO: 196224 - RNA, 22 nt, Homo sapiens
agugcaguggcacaaucuuggc

SEQ ID NO: 196225 - RNA, 22 nt, Homo sapiens
agugcagugguuaggagccagg

SEQ ID NO: 196226 - RNA, 22 nt, Homo sapiens
agugcauugagacuugugaguu

SEQ ID NO: 196227 - RNA, 22 nt, Homo sapiens
aguggcaaugugauguccugaa

SEQ ID NO: 196228 - RNA, 22 nt, Homo sapiens
agugguuugaucacagcucacu

SEQ ID NO: 196229 - RNA, 20 nt, Homo sapiens
agugguuuucaaauaugucu

SEQ ID NO: 196230 - RNA, 22 nt, Homo sapiens
agugguuuuggaauggaauuca

SEQ ID NO: 196231 - RNA, 22 nt, Homo sapiens
agugucaggagacagguagcug

SEQ ID NO: 196232 - RNA, 19 nt, Homo sapiens
agugucauggucauuauuu

SEQ ID NO: 196233 - RNA, 22 nt, Homo sapiens
aguguuuuucaugggauacuuu

SEQ ID NO: 196234 - RNA, 22 nt, Homo sapiens
aguugcaagucuugaguaaaga

SEQ ID NO: 196235 - RNA, 22 nt, Homo sapiens
auaaagcaagucucuggccuca

SEQ ID NO: 196236 - RNA, 22 nt, Homo sapiens
auaaaguguuuaguauaggcaa

SEQ ID NO: 196237 - RNA, 19 nt, Homo sapiens
auaaaugccuacaagggug

SEQ ID NO: 196238 - RNA, 22 nt, Homo sapiens
auaaaugccuguuguuuuaagc

SEQ ID NO: 196239 - RNA, 22 nt, Homo sapiens
auaaaugcuuagaucuguauau

SEQ ID NO: 196240 - RNA, 22 nt, Homo sapiens
auaaauucauuuaagcuccuua

SEQ ID NO: 196241 - RNA, 22 nt, Homo sapiens
auaaguagaaugauggucaaaa

SEQ ID NO: 196242 - RNA, 22 nt, Homo sapiens
auaauaucagguugugaugaug

SEQ ID NO: 196243 - RNA, 22 nt, Homo sapiens
auaaucaugucugaaaccuuug

SEQ ID NO: 196244 - RNA, 22 nt, Homo sapiens
auaauguuuauccagaggaguu

SEQ ID NO: 196245 - RNA, 22 nt, Homo sapiens
auaauguuugauugagcagaua

SEQ ID NO: 196246 - RNA, 22 nt, Homo sapiens
auacaagcaguccaacuccaua

SEQ ID NO: 196247 - RNA, 22 nt, Homo sapiens
auacaaguuauuugaacugcgg

SEQ ID NO: 196248 - RNA, 22 nt, Homo sapiens
auacaguauggagggcccagcu

SEQ ID NO: 196249 - RNA, 22 nt, Homo sapiens
auacaguguauguauaguacau

SEQ ID NO: 196250 - RNA, 22 nt, Homo sapiens
auacaugugcaggucagguuac

SEQ ID NO: 196251 - RNA, 22 nt, Homo sapiens
auacaugugccauguucgugug

SEQ ID NO: 196252 - RNA, 22 nt, Homo sapiens
ccugagacgaauggagugaaca

SEQ ID NO: 196253 - RNA, 22 nt, Homo sapiens
ccugagguagaguuuauauuga

SEQ ID NO: 196254 - RNA, 21 nt, Homo sapiens
ccugauguucacuuggccuuc

SEQ ID NO: 196255 - RNA, 22 nt, Homo sapiens
ccuggaagaaaggugcuaaaua

SEQ ID NO: 196256 - RNA, 22 nt, Homo sapiens
ccuggguuacaggugugagcca

SEQ ID NO: 196257 - RNA, 18 nt, Homo sapiens
ccuuaguuauagagaguc

SEQ ID NO: 196258 - RNA, 22 nt, Homo sapiens
ccuucacaggcacugguucaga

SEQ ID NO: 196259 - RNA, 22 nt, Homo sapiens
ccuucauccuccagcaggcuag

SEQ ID NO: 196260 - RNA, 21 nt, Homo sapiens
ccuugagaacaucaauuugcu

SEQ ID NO: 196261 - RNA, 22 nt, Homo sapiens
ccuuuguuaguuugcugagaau

SEQ ID NO: 196262 - RNA, 22 nt, Homo sapiens
cgccgggggaugggcaccagcg

SEQ ID NO: 196263 - RNA, 22 nt, Homo sapiens
cgcuggugucuaagcgacagcu

SEQ ID NO: 196264 - RNA, 22 nt, Homo sapiens
cggucacagugauucaaggguc

SEQ ID NO: 196265 - RNA, 22 nt, Homo sapiens
cuaaaugucucuacuaaguuua

SEQ ID NO: 196266 - RNA, 22 nt, Homo sapiens
cuacagaguaucuaaagaggua

SEQ ID NO: 196267 - RNA, 22 nt, Homo sapiens
cuacagcagcccaguccccgaa

SEQ ID NO: 196268 - RNA, 23 nt, Homo sapiens
cuacagugccugucucuuuggcc

SEQ ID NO: 196269 - RNA, 22 nt, Homo sapiens
cuacagugggucuguaguccuu

SEQ ID NO: 196270 - RNA, 22 nt, Homo sapiens
cuacaguguauuuauggagggu

SEQ ID NO: 196271 - RNA, 22 nt, Homo sapiens
cuaccuggguggcucaugacuu

SEQ ID NO: 196272 - RNA, 23 nt, Homo sapiens
cuacuagucaagucuuuuccagu

SEQ ID NO: 196273 - RNA, 22 nt, Homo sapiens
cuagacacugacguuccuccga

SEQ ID NO: 196274 - RNA, 22 nt, Homo sapiens
cuagcagacaggcugggagcag

SEQ ID NO: 196275 - RNA, 22 nt, Homo sapiens
cuaggcuguagagaaguucagu

SEQ ID NO: 196276 - RNA, 22 nt, Homo sapiens
cuauauacugccugcugauuag

SEQ ID NO: 196277 - RNA, 22 nt, Homo sapiens
cuauaugucuguuuugguacca

SEQ ID NO: 196278 - RNA, 22 nt, Homo sapiens
cuaucucaggcccaggcccuug

SEQ ID NO: 196279 - RNA, 22 nt, Homo sapiens
cuaucucauugguuuuugaaag

SEQ ID NO: 196280 - RNA, 22 nt, Homo sapiens
cuauuugguuggugaaaaaagu

SEQ ID NO: 196281 - RNA, 22 nt, Homo sapiens
cucaaaguguggucuguggguu

SEQ ID NO: 196282 - RNA, 22 nt, Homo sapiens
cucaaguacaugggauuacagg

SEQ ID NO: 196283 - RNA, 22 nt, Homo sapiens
cucaauuuggaauugucaguaa

SEQ ID NO: 196284 - RNA, 20 nt, Homo sapiens
cucaccagguguaggcugag

SEQ ID NO: 196285 - RNA, 22 nt, Homo sapiens
cucacggcccugcgcacuggca

SEQ ID NO: 196286 - RNA, 17 nt, Homo sapiens
cucacugagaacagcua

SEQ ID NO: 196287 - RNA, 22 nt, Homo sapiens
cucagcuacuugagaggcuuag

SEQ ID NO: 196288 - RNA, 22 nt, Homo sapiens
cucagggugguggacucuaaua

SEQ ID NO: 196289 - RNA, 22 nt, Homo sapiens
cucaguacuugcacagaagaac

SEQ ID NO: 196290 - RNA, 22 nt, Homo sapiens
cucaguuuugccuuguuuaagg

SEQ ID NO: 196291 - RNA, 22 nt, Homo sapiens
cucauuggcuacugaggcuugu

SEQ ID NO: 196292 - RNA, 22 nt, Homo sapiens
cuccauagucuucgaagaauga

SEQ ID NO: 196293 - RNA, 20 nt, Homo sapiens
cuccuucauuccuuuggacc

SEQ ID NO: 196294 - RNA, 22 nt, Homo sapiens
cucgcuccauuucggugaucaa

SEQ ID NO: 196295 - RNA, 22 nt, Homo sapiens
cucugacagugguuagcacugu

SEQ ID NO: 196296 - RNA, 22 nt, Homo sapiens
cucugguuaaggcugaacuaua

SEQ ID NO: 196297 - RNA, 15 nt, Homo sapiens
cucugguuuuucuuc

SEQ ID NO: 196298 - RNA, 22 nt, Homo sapiens
cucugguuuuucuuccauuaag

SEQ ID NO: 196299 - RNA, 22 nt, Homo sapiens
cucuuuuguuccuaguuugauc

SEQ ID NO: 196300 - RNA, 22 nt, Homo sapiens
cugaaagagcauuugaaugggu

SEQ ID NO: 196301 - RNA, 22 nt, Homo sapiens
cugaaucauugcauuaucaagg

SEQ ID NO: 196302 - RNA, 22 nt, Homo sapiens
cugaauguucuggauggaagag

SEQ ID NO: 196303 - RNA, 22 nt, Homo sapiens
cugacuuuagaacccaaaaagu

SEQ ID NO: 196304 - RNA, 22 nt, Homo sapiens
cugagaauguaaaugaagcuuu

SEQ ID NO: 196305 - RNA, 22 nt, Homo sapiens
cugagagaggagcuaaaacugc

SEQ ID NO: 196306 - RNA, 22 nt, Homo sapiens
cugagagaugagaccucucacu

SEQ ID NO: 196307 - RNA, 22 nt, Homo sapiens
cugagauaggacucugcuggcu

SEQ ID NO: 196308 - RNA, 22 nt, Homo sapiens
cugagaucaagucuugcucugu

SEQ ID NO: 196309 - RNA, 22 nt, Homo sapiens
cugagaucugaaccaggagugu

SEQ ID NO: 196310 - RNA, 22 nt, Homo sapiens
cugagguaauuuguugccagua

SEQ ID NO: 196311 - RNA, 22 nt, Homo sapiens
cugaggugggagaaucacauaa

SEQ ID NO: 196312 - RNA, 22 nt, Homo sapiens
cugagguuaggaguuugagacc

SEQ ID NO: 196313 - RNA, 22 nt, Homo sapiens
cugaucuggaggugucugggga

SEQ ID NO: 196314 - RNA, 22 nt, Homo sapiens
cugaucuguuauacuuuucuau

SEQ ID NO: 196315 - RNA, 22 nt, Homo sapiens
cugauuuguccccagccucaug

SEQ ID NO: 196316 - RNA, 19 nt, Homo sapiens
cugcacugagaaaaggagg

SEQ ID NO: 196317 - RNA, 18 nt, Homo sapiens
cugccagugugcucuccg

SEQ ID NO: 196318 - RNA, 22 nt, Homo sapiens
cugccuagaucugaaccuggcu

SEQ ID NO: 196319 - RNA, 22 nt, Homo sapiens
cugcuaagagaaugagacuuag

SEQ ID NO: 196320 - RNA, 22 nt, Homo sapiens
cugcuguuguuaacuuuuggag

SEQ ID NO: 196321 - RNA, 22 nt, Homo sapiens
cuggaaagcaaguccauugcuc

SEQ ID NO: 196322 - RNA, 22 nt, Homo sapiens
cuggaaggaaaaacaaccacag

SEQ ID NO: 196323 - RNA, 22 nt, Homo sapiens
cuggagaucuugacauugaagu

SEQ ID NO: 196324 - RNA, 22 nt, Homo sapiens
cuggagauuaaccaauugccau

SEQ ID NO: 196325 - RNA, 22 nt, Homo sapiens
cuggaguuugaggcugcaguga

SEQ ID NO: 196326 - RNA, 22 nt, Homo sapiens
cuggauagucaggagauauaua

SEQ ID NO: 196327 - RNA, 22 nt, Homo sapiens
gguauguagcaaaagaggugcu

SEQ ID NO: 196328 - RNA, 22 nt, Homo sapiens
ggucacauugcuagcauggguu

SEQ ID NO: 196329 - RNA, 22 nt, Homo sapiens
ggucacauuggacuaucaaguu

SEQ ID NO: 196330 - RNA, 22 nt, Homo sapiens
ggucaggagaaugguaacugag

SEQ ID NO: 196331 - RNA, 22 nt, Homo sapiens
ggugaguggugcuuaaguucag

SEQ ID NO: 196332 - RNA, 22 nt, Homo sapiens
ggugcuugaggaacggaggcug

SEQ ID NO: 196333 - RNA, 22 nt, Homo sapiens
gguggcaaaucugaguggcgcu

SEQ ID NO: 196334 - RNA, 22 nt, Homo sapiens
guaaauguccccugugauauug

SEQ ID NO: 196335 - RNA, 22 nt, Homo sapiens
guaaucucaccuacuugggagg

SEQ ID NO: 196336 - RNA, 22 nt, Homo sapiens
guaaucucagcuacucaggagg

SEQ ID NO: 196337 - RNA, 22 nt, Homo sapiens
guaaucucagcuacucgggagg

SEQ ID NO: 196338 - RNA, 22 nt, Homo sapiens
guacuuagagauagggucuuua

SEQ ID NO: 196339 - RNA, 22 nt, Homo sapiens
guagaaaguuugcugucacaug

SEQ ID NO: 196340 - RNA, 22 nt, Homo sapiens
guagcagaauaucagauaauuu

SEQ ID NO: 196341 - RNA, 22 nt, Homo sapiens
guagcagcaauuuacuccauac

SEQ ID NO: 196342 - RNA, 22 nt, Homo sapiens
guaguggcaugaucuuggcuca

SEQ ID NO: 196343 - RNA, 22 nt, Homo sapiens
guauacacccugugauauuauu

SEQ ID NO: 196344 - RNA, 22 nt, Homo sapiens
guauagaucguagaccaauaaa

SEQ ID NO: 196345 - RNA, 22 nt, Homo sapiens
guaucaugaaguuucuucauuu

SEQ ID NO: 196346 - RNA, 21 nt, Homo sapiens
guauggcauugauuaguuacu

SEQ ID NO: 196347 - RNA, 22 nt, Homo sapiens
guauggcauuuguggauuggcc

SEQ ID NO: 196348 - RNA, 22 nt, Homo sapiens
guaugucuuuauagcagugugg

SEQ ID NO: 196349 - RNA, 19 nt, Homo sapiens
guauuugacuuucuuguuu

SEQ ID NO: 196350 - RNA, 22 nt, Homo sapiens
gucaaggaauuuauccauuucu

SEQ ID NO: 196351 - RNA, 22 nt, Homo sapiens
gucaauguaucuagcuguauua

SEQ ID NO: 196352 - RNA, 22 nt, Homo sapiens
gucacugggugcugcgccuguc

SEQ ID NO: 196353 - RNA, 22 nt, Homo sapiens
gucagcuuguccagagacucug

SEQ ID NO: 196354 - RNA, 22 nt, Homo sapiens
gucagggagggauagaugauua

SEQ ID NO: 196355 - RNA, 22 nt, Homo sapiens
gucagugucuuugcagcucaga

SEQ ID NO: 196356 - RNA, 22 nt, Homo sapiens
gucagugugauaucugcagggg

SEQ ID NO: 196357 - RNA, 22 nt, Homo sapiens
gucauauaggguuuaccuguau

SEQ ID NO: 196358 - RNA, 22 nt, Homo sapiens
gucauaugcucggaaaauguua

SEQ ID NO: 196359 - RNA, 22 nt, Homo sapiens
gucaugggguacuacacauggg

SEQ ID NO: 196360 - RNA, 22 nt, Homo sapiens
gucaugucugcacauaguaaaa

SEQ ID NO: 196361 - RNA, 21 nt, Homo sapiens
guccaaaacaguguccaaugc

SEQ ID NO: 196362 - RNA, 22 nt, Homo sapiens
gucccagagauauugugucuuu

SEQ ID NO: 196363 - RNA, 22 nt, Homo sapiens
gucccugcgauugugggauccu

SEQ ID NO: 196364 - RNA, 22 nt, Homo sapiens
guccugaagaccuuccucugga

SEQ ID NO: 196365 - RNA, 22 nt, Homo sapiens
guccuugaggcuuugacugugg

SEQ ID NO: 196366 - RNA, 22 nt, Homo sapiens
gucucccaaccccugugcccag

SEQ ID NO: 196367 - RNA, 22 nt, Homo sapiens
gucugugcauuaauacgugcug

SEQ ID NO: 196368 - RNA, 22 nt, Homo sapiens
gucuguuugauccagaucaaaa

SEQ ID NO: 196369 - RNA, 20 nt, Homo sapiens
gucuugcuccguugcccagg

SEQ ID NO: 196370 - RNA, 22 nt, Homo sapiens
gucuuugaugucuaugugcuuc

SEQ ID NO: 196371 - RNA, 22 nt, Homo sapiens
gucuuugcauguauguucauga

SEQ ID NO: 196372 - RNA, 22 nt, Homo sapiens
gucuuuggaaagacaaaguuca

SEQ ID NO: 196373 - RNA, 22 nt, Homo sapiens
gucuuuugcuagccagagagcu

SEQ ID NO: 196374 - RNA, 22 nt, Homo sapiens
gugaaauguguagaggaucugg

SEQ ID NO: 196375 - RNA, 22 nt, Homo sapiens
gugaaugaaugggugaauacau

SEQ ID NO: 196376 - RNA, 22 nt, Homo sapiens
gugaauguaaagucaugugacu

SEQ ID NO: 196377 - RNA, 22 nt, Homo sapiens
gugaauugagagaacuguguua

SEQ ID NO: 196378 - RNA, 22 nt, Homo sapiens
gugacagaguaagacccuguau

SEQ ID NO: 196379 - RNA, 22 nt, Homo sapiens
gugacgucauuguuccuggcuc

SEQ ID NO: 196380 - RNA, 22 nt, Homo sapiens
gugagaagaaaaauauggcugu

SEQ ID NO: 196381 - RNA, 22 nt, Homo sapiens
gugagacugaguuucgcucuug

SEQ ID NO: 196382 - RNA, 22 nt, Homo sapiens
gugagaugaggucucacucugu

SEQ ID NO: 196383 - RNA, 22 nt, Homo sapiens
gugagaugugacuucugccucu

SEQ ID NO: 196384 - RNA, 22 nt, Homo sapiens
gugagauuaccauuuaaaucag

SEQ ID NO: 196385 - RNA, 19 nt, Homo sapiens
gugagcacagacaauacaa

SEQ ID NO: 196386 - RNA, 22 nt, Homo sapiens
gugagcagagaucgcgugauug

SEQ ID NO: 196387 - RNA, 22 nt, Homo sapiens
gugagcauuacucaugggauca

SEQ ID NO: 196388 - RNA, 22 nt, Homo sapiens
gugagcuccucuucugcugcag

SEQ ID NO: 196389 - RNA, 22 nt, Homo sapiens
gugaggaaggaaaccugcuagc

SEQ ID NO: 196390 - RNA, 20 nt, Homo sapiens
gugagguagaggguuaccug

SEQ ID NO: 196391 - RNA, 22 nt, Homo sapiens
gugagguguuaaccaaccugug

SEQ ID NO: 196392 - RNA, 22 nt, Homo sapiens
gugagguugaaaauaauggaaa

SEQ ID NO: 196393 - RNA, 22 nt, Homo sapiens
gugagucagucuguguagggcu

SEQ ID NO: 196394 - RNA, 20 nt, Homo sapiens
gugagucauuaguaaccaaa

SEQ ID NO: 196395 - RNA, 22 nt, Homo sapiens
gugauuauccacgucuuuguga

SEQ ID NO: 196396 - RNA, 22 nt, Homo sapiens
cuggcaucuaaauacuugaugu

SEQ ID NO: 196397 - RNA, 22 nt, Homo sapiens
cuggcucugggcuaaagaaaua

SEQ ID NO: 196398 - RNA, 22 nt, Homo sapiens
cugggaugauguaaauaggcua

SEQ ID NO: 196399 - RNA, 22 nt, Homo sapiens
cugggauggaggagaauuagag

SEQ ID NO: 196400 - RNA, 22 nt, Homo sapiens
cugggcaaugcggcuggauaga

SEQ ID NO: 196401 - RNA, 22 nt, Homo sapiens
cuggguacccuuuaaacaggaa

SEQ ID NO: 196402 - RNA, 21 nt, Homo sapiens
cugguccccuuuauguaugug

SEQ ID NO: 196403 - RNA, 22 nt, Homo sapiens
cugguuuguaaaguuccugaga

SEQ ID NO: 196404 - RNA, 22 nt, Homo sapiens
cuguaaaguucucauuguagcc

SEQ ID NO: 196405 - RNA, 22 nt, Homo sapiens
cugucaucauuucuaugugcca

SEQ ID NO: 196406 - RNA, 22 nt, Homo sapiens
cuguccugcagagucagaauga

SEQ ID NO: 196407 - RNA, 22 nt, Homo sapiens
cugucuggaguccuucgugugc

SEQ ID NO: 196408 - RNA, 22 nt, Homo sapiens
cugugauagguuagucaugaau

SEQ ID NO: 196409 - RNA, 22 nt, Homo sapiens
cugugcauaugacuuuauugga

SEQ ID NO: 196410 - RNA, 22 nt, Homo sapiens
cugugcauguuguccaauucuu

SEQ ID NO: 196411 - RNA, 22 nt, Homo sapiens
cugugcuugagagaugacacag

SEQ ID NO: 196412 - RNA, 22 nt, Homo sapiens
cuguuugguaaggaugccucag

SEQ ID NO: 196413 - RNA, 22 nt, Homo sapiens
cuguuugguuaucuuuuccugu

SEQ ID NO: 196414 - RNA, 22 nt, Homo sapiens
cuucaaguaauucugauggcua

SEQ ID NO: 196415 - RNA, 22 nt, Homo sapiens
cuuccagcuggguucagucagu

SEQ ID NO: 196416 - RNA, 22 nt, Homo sapiens
cuuccauaguauuuuuacaaaa

SEQ ID NO: 196417 - RNA, 22 nt, Homo sapiens
cuugaccaauauggugaaaccc

SEQ ID NO: 196418 - RNA, 22 nt, Homo sapiens
cuugagcaaacaaaggugguag

SEQ ID NO: 196419 - RNA, 22 nt, Homo sapiens
cuugcacuugaaauuccaguuu

SEQ ID NO: 196420 - RNA, 22 nt, Homo sapiens
cuugcauuuuggagaaugcuga

SEQ ID NO: 196421 - RNA, 19 nt, Homo sapiens
cuugccccauucauccucu

SEQ ID NO: 196422 - RNA, 20 nt, Homo sapiens
cuugcuccccuuguucuaga

SEQ ID NO: 196423 - RNA, 22 nt, Homo sapiens
cuuggcuagucaaaccuccccg

SEQ ID NO: 196424 - RNA, 22 nt, Homo sapiens
cuugugccugaucuuagggggc

SEQ ID NO: 196425 - RNA, 22 nt, Homo sapiens
cuuucacacuguuggugggaau

SEQ ID NO: 196426 - RNA, 22 nt, Homo sapiens
cuuugauuauaaaaggguguuu

SEQ ID NO: 196427 - RNA, 22 nt, Homo sapiens
cuuugggaccgcgguuuauacu

SEQ ID NO: 196428 - RNA, 22 nt, Homo sapiens
cuuuggguauucucccuugggg

SEQ ID NO: 196429 - RNA, 21 nt, Homo sapiens
cuuugguagaguuuuuagggu

SEQ ID NO: 196430 - RNA, 21 nt, Homo sapiens
cuuugguuucugacuugcaua

SEQ ID NO: 196431 - RNA, 20 nt, Homo sapiens
cuuuguccuccugcugugcu

SEQ ID NO: 196432 - RNA, 22 nt, Homo sapiens
cuuuguccuucaagguguguca

SEQ ID NO: 196433 - RNA, 22 nt, Homo sapiens
cuuugugcccuucugcccauca

SEQ ID NO: 196434 - RNA, 22 nt, Homo sapiens
cuuuuggcuuaagauugucuug

SEQ ID NO: 196435 - RNA, 22 nt, Homo sapiens
cuuuuggcuuagaauugucuug

SEQ ID NO: 196436 - RNA, 22 nt, Homo sapiens
cuuuugugauuccucaguuacu

SEQ ID NO: 196437 - RNA, 22 nt, Homo sapiens
gaaagauuuuaacugggagacu

SEQ ID NO: 196438 - RNA, 22 nt, Homo sapiens
gaaagcuaaugacuuuggguga

SEQ ID NO: 196439 - RNA, 22 nt, Homo sapiens
gaacugggguuggguugcgaua

SEQ ID NO: 196440 - RNA, 22 nt, Homo sapiens
gaagaaguacaagacaaauuuu

SEQ ID NO: 196441 - RNA, 22 nt, Homo sapiens
gaagcgaggugauuagcagaca

SEQ ID NO: 196442 - RNA, 22 nt, Homo sapiens
gaagguaguuuauagauguggu

SEQ ID NO: 196443 - RNA, 22 nt, Homo sapiens
gaauaaacuagagaggacugag

SEQ ID NO: 196444 - RNA, 22 nt, Homo sapiens
gaauagugcugcaagaaacaua

SEQ ID NO: 196445 - RNA, 22 nt, Homo sapiens
gaauagugcugcagcaaacaua

SEQ ID NO: 196446 - RNA, 22 nt, Homo sapiens
gaauagugcugcgauaaacaua

SEQ ID NO: 196447 - RNA, 22 nt, Homo sapiens
gaaucacagauuaugaguaucu

SEQ ID NO: 196448 - RNA, 22 nt, Homo sapiens
gaaucacaguuauuagagcagc

SEQ ID NO: 196449 - RNA, 22 nt, Homo sapiens
gaaugauacuguuaacgaaaga

SEQ ID NO: 196450 - RNA, 18 nt, Homo sapiens
gacagugugaagauuccu

SEQ ID NO: 196451 - RNA, 22 nt, Homo sapiens
gacagugugauacuuagucuca

SEQ ID NO: 196452 - RNA, 22 nt, Homo sapiens
gaccuuguagaaucucaugauu

SEQ ID NO: 196453 - RNA, 22 nt, Homo sapiens
gacucagucuuggauuuuuaau

SEQ ID NO: 196454 - RNA, 22 nt, Homo sapiens
gacuggauagauaaaguuaguu

SEQ ID NO: 196455 - RNA, 22 nt, Homo sapiens
gacuuugguagaggaaaaaucu

SEQ ID NO: 196456 - RNA, 22 nt, Homo sapiens
gagaacauuaauaguuaauuuu

SEQ ID NO: 196457 - RNA, 22 nt, Homo sapiens
gagaaccauuuggagaaaaagu

SEQ ID NO: 196458 - RNA, 22 nt, Homo sapiens
gagacauguuugcuuaucugag

SEQ ID NO: 196459 - RNA, 22 nt, Homo sapiens
ucuuuguuagaacccucuccuu

SEQ ID NO: 196460 - RNA, 22 nt, Homo sapiens
ucuuuugggccucuugucagac

SEQ ID NO: 196461 - RNA, 22 nt, Homo sapiens
ugaaacacacauugcccuuuau

SEQ ID NO: 196462 - RNA, 20 nt, Homo sapiens
ugaaacacauggacuggggu

SEQ ID NO: 196463 - RNA, 22 nt, Homo sapiens
ugaaagguuuaauucugugaga

SEQ ID NO: 196464 - RNA, 22 nt, Homo sapiens
ugaaaugaucaguuugguuacu

SEQ ID NO: 196465 - RNA, 22 nt, Homo sapiens
ugaaaugauuauaugguguuug

SEQ ID NO: 196466 - RNA, 22 nt, Homo sapiens
ugaaauggaaagaguguagacu

SEQ ID NO: 196467 - RNA, 22 nt, Homo sapiens
ugaaauggugcggucugcagca

SEQ ID NO: 196468 - RNA, 22 nt, Homo sapiens
ugaacagcuaucuugucagugu

SEQ ID NO: 196469 - RNA, 22 nt, Homo sapiens
ugaagacauuuuugggugugua

SEQ ID NO: 196470 - RNA, 22 nt, Homo sapiens
ugaagacucauacuugaaucag

SEQ ID NO: 196471 - RNA, 22 nt, Homo sapiens
ugaagagucuaaaucugucuuc

SEQ ID NO: 196472 - RNA, 22 nt, Homo sapiens
ugaagggcauuguuuugccaaa

SEQ ID NO: 196473 - RNA, 22 nt, Homo sapiens
ugaauacugugcaaaggauuug

SEQ ID NO: 196474 - RNA, 22 nt, Homo sapiens
ugaauauagacagggguagaga

SEQ ID NO: 196475 - RNA, 22 nt, Homo sapiens
ugaauauguuaaauaauguucu

SEQ ID NO: 196476 - RNA, 21 nt, Homo sapiens
ugaaugcuuuaaauauuagaa

SEQ ID NO: 196477 - RNA, 22 nt, Homo sapiens
ugaauggauccaauucuuagua

SEQ ID NO: 196478 - RNA, 22 nt, Homo sapiens
ugaauguaacuaaaggacuuuu

SEQ ID NO: 196479 - RNA, 22 nt, Homo sapiens
ugaauucuguccaaaauaacug

SEQ ID NO: 196480 - RNA, 20 nt, Homo sapiens
ugacaagugagaauuauggg

SEQ ID NO: 196481 - RNA, 17 nt, Homo sapiens
ugacagaaacuuguugu

SEQ ID NO: 196482 - RNA, 23 nt, Homo sapiens
ugacagaccuucuggaagaaguc

SEQ ID NO: 196483 - RNA, 22 nt, Homo sapiens
ugacagaggucuuuuaauagcu

SEQ ID NO: 196484 - RNA, 22 nt, Homo sapiens
ugacagcugaggcccagaguac

SEQ ID NO: 196485 - RNA, 22 nt, Homo sapiens
ugacaggagauuaugugauguu

SEQ ID NO: 196486 - RNA, 22 nt, Homo sapiens
ugacagguuggaauuaugggag

SEQ ID NO: 196487 - RNA, 23 nt, Homo sapiens
ugacauguaauucaguccagcag

SEQ ID NO: 196488 - RNA, 21 nt, Homo sapiens
ugacauuauuucaugucagua

SEQ ID NO: 196489 - RNA, 22 nt, Homo sapiens
ugaccacugucuaagauaggug

SEQ ID NO: 196490 - RNA, 22 nt, Homo sapiens
ugacuaggggcccuggcuucuu

SEQ ID NO: 196491 - RNA, 22 nt, Homo sapiens
ugacuauaaauaagcaagggcu

SEQ ID NO: 196492 - RNA, 22 nt, Homo sapiens
ugacuauaguuuucuugacaca

SEQ ID NO: 196493 - RNA, 22 nt, Homo sapiens
ugacuauaucucuguauaaacu

SEQ ID NO: 196494 - RNA, 22 nt, Homo sapiens
ugacuggaaacaguguuauuug

SEQ ID NO: 196495 - RNA, 22 nt, Homo sapiens
ugacuucauuuuuggccaugag

SEQ ID NO: 196496 - RNA, 22 nt, Homo sapiens
ugacuugaggcucgcacaaguu

SEQ ID NO: 196497 - RNA, 22 nt, Homo sapiens
ugagaacagauggcuuuauuau

SEQ ID NO: 196498 - RNA, 19 nt, Homo sapiens
ugagaacaugugguauuug

SEQ ID NO: 196499 - RNA, 18 nt, Homo sapiens
ugagaacauguguacaca

SEQ ID NO: 196500 - RNA, 22 nt, Homo sapiens
ugagaacucaugggucugcugg

SEQ ID NO: 196501 - RNA, 22 nt, Homo sapiens
ugagaacuuauggugauuuuuu

SEQ ID NO: 196502 - RNA, 22 nt, Homo sapiens
ugagaacuuugucuuuuacucu

SEQ ID NO: 196503 - RNA, 22 nt, Homo sapiens
ugagaaugaugauugguaaacc

SEQ ID NO: 196504 - RNA, 22 nt, Homo sapiens
ugagacacuucccagaucccuu

SEQ ID NO: 196505 - RNA, 22 nt, Homo sapiens
ugagacaucugagauuuuaagc

SEQ ID NO: 196506 - RNA, 22 nt, Homo sapiens
ugagaccaacagauuccaguuc

SEQ ID NO: 196507 - RNA, 22 nt, Homo sapiens
ugagacggagucucacucuguu

SEQ ID NO: 196508 - RNA, 22 nt, Homo sapiens
ugagacggagucucgcucuguu

SEQ ID NO: 196509 - RNA, 22 nt, Homo sapiens
ugagacggagucuugcucuguc

SEQ ID NO: 196510 - RNA, 22 nt, Homo sapiens
ugagacggaguuucacucuugu

SEQ ID NO: 196511 - RNA, 22 nt, Homo sapiens
ugagacggaguuucgcucuugu

SEQ ID NO: 196512 - RNA, 22 nt, Homo sapiens
ugagacugaguuucucucuugu

SEQ ID NO: 196513 - RNA, 22 nt, Homo sapiens
ugagacugaguuuugccuuugu

SEQ ID NO: 196514 - RNA, 20 nt, Homo sapiens
uuuugcacuccuacuaaggu

SEQ ID NO: 196515 - RNA, 22 nt, Homo sapiens
uuuugcaggcauuggaaguuua

SEQ ID NO: 196516 - RNA, 18 nt, Homo sapiens
uuuugcuuaacugcgcca

SEQ ID NO: 196517 - RNA, 19 nt, Homo sapiens
uuuuggaaaugugaacagc

SEQ ID NO: 196518 - RNA, 22 nt, Homo sapiens
uuuugguguauuguauaaggua

SEQ ID NO: 196519 - RNA, 22 nt, Homo sapiens
uuuuugaguaaauauaaauugu

SEQ ID NO: 196520 - RNA, 22 nt, Homo sapiens
uuuuugauuaauggguagacca

SEQ ID NO: 196521 - RNA, 22 nt, Homo sapiens
uuuuuggauaaugguacaugua

SEQ ID NO: 196522 - RNA, 22 nt, Homo sapiens
uuuuugguugguaggcuauuaa

SEQ ID NO: 196523 - RNA, 22 nt, Homo sapiens
uuuuuugguaauugaacaauga

SEQ ID NO: 196524 - RNA, 22 nt, Homo sapiens
agcuugugauucuccaucaugu

SEQ ID NO: 196525 - RNA, 22 nt, Homo sapiens
agcuuguuuucccauaacuaga

SEQ ID NO: 196526 - RNA, 22 nt, Homo sapiens
agcuuuuugggcagcuauugac

SEQ ID NO: 196527 - RNA, 22 nt, Homo sapiens
aggaaauguuggucccauuucu

SEQ ID NO: 196528 - RNA, 21 nt, Homo sapiens
aggaagacuaugaucaauugg

SEQ ID NO: 196529 - RNA, 23 nt, Homo sapiens
aggaauggaaaaccaaguaucau

SEQ ID NO: 196530 - RNA, 22 nt, Homo sapiens
aggaauguuaguacuucuuagu

SEQ ID NO: 196531 - RNA, 22 nt, Homo sapiens
aggacacugauguaugcugugg

SEQ ID NO: 196532 - RNA, 21 nt, Homo sapiens
aggagcauucaugacgagguu

SEQ ID NO: 196533 - RNA, 22 nt, Homo sapiens
aggagcuuuggggaaaacagau

SEQ ID NO: 196534 - RNA, 22 nt, Homo sapiens
aggcaaaugccagcaaucacac

SEQ ID NO: 196535 - RNA, 22 nt, Homo sapiens
aggcaagaaugcuuguuucacc

SEQ ID NO: 196536 - RNA, 16 nt, Homo sapiens
aggcaagaauugaggu

SEQ ID NO: 196537 - RNA, 22 nt, Homo sapiens
aggcaagagugacuacgugaaa

SEQ ID NO: 196538 - RNA, 22 nt, Homo sapiens
aggcaguuucagugagagguga

SEQ ID NO: 196539 - RNA, 20 nt, Homo sapiens
aggcauguugguuugcgugu

SEQ ID NO: 196540 - RNA, 23 nt, Homo sapiens
aggcauuguacaguaauggaaaa

SEQ ID NO: 196541 - RNA, 22 nt, Homo sapiens
aggcuuguuuuacuaacuggua

SEQ ID NO: 196542 - RNA, 22 nt, Homo sapiens
aggcuuuuguuuuggucucagg

SEQ ID NO: 196543 - RNA, 22 nt, Homo sapiens
agggcaagacuuguuaagaaca

SEQ ID NO: 196544 - RNA, 22 nt, Homo sapiens
agggcauuguacaaaucaucau

SEQ ID NO: 196545 - RNA, 22 nt, Homo sapiens
agggcuuguuuaacuaucauua

SEQ ID NO: 196546 - RNA, 22 nt, Homo sapiens
aggguaguaggcuugggauugg

SEQ ID NO: 196547 - RNA, 22 nt, Homo sapiens
agguaagucucuaauuaugaau

SEQ ID NO: 196548 - RNA, 22 nt, Homo sapiens
agguaauuuuaucauuauguga

SEQ ID NO: 196549 - RNA, 22 nt, Homo sapiens
agguauauuggacagauguaaa

SEQ ID NO: 196550 - RNA, 22 nt, Homo sapiens
agguauguaugucuguacagcg

SEQ ID NO: 196551 - RNA, 21 nt, Homo sapiens
aggucaugaagauguucuaau

SEQ ID NO: 196552 - RNA, 22 nt, Homo sapiens
aggugcaugcuucacuggauau

SEQ ID NO: 196553 - RNA, 22 nt, Homo sapiens
agguuaugauuauagagcgagg

SEQ ID NO: 196554 - RNA, 22 nt, Homo sapiens
aguaaauuucugugcuuucaua

SEQ ID NO: 196555 - RNA, 22 nt, Homo sapiens
aguaacauuucuaguagagagu

SEQ ID NO: 196556 - RNA, 22 nt, Homo sapiens
aguacacuguuaaaaagaagug

SEQ ID NO: 196557 - RNA, 22 nt, Homo sapiens
aguaucaagccacacaugguca

SEQ ID NO: 196558 - RNA, 22 nt, Homo sapiens
aguaucacaagguguacaccca

SEQ ID NO: 196559 - RNA, 22 nt, Homo sapiens
aguaucacaguggguguauacc

SEQ ID NO: 196560 - RNA, 22 nt, Homo sapiens
agucaagugggguuagauaguu

SEQ ID NO: 196561 - RNA, 22 nt, Homo sapiens
agucaaguuuuuucagagaaua

SEQ ID NO: 196562 - RNA, 17 nt, Homo sapiens
agucaguaguuuguauu

SEQ ID NO: 196563 - RNA, 22 nt, Homo sapiens
agucagucuguccugugcugag

SEQ ID NO: 196564 - RNA, 22 nt, Homo sapiens
agucagugcauaagaaugaagu

SEQ ID NO: 196565 - RNA, 22 nt, Homo sapiens
aguccagguuuuguaauggcaa

SEQ ID NO: 196566 - RNA, 21 nt, Homo sapiens
agugagucauuuggaaagcaa

SEQ ID NO: 196567 - RNA, 22 nt, Homo sapiens
agugcaauaaggauguagaacu

SEQ ID NO: 196568 - RNA, 22 nt, Homo sapiens
agugcaguggugccaucauaac

SEQ ID NO: 196569 - RNA, 22 nt, Homo sapiens
agugcaguugucacgugccuuc

SEQ ID NO: 196570 - RNA, 22 nt, Homo sapiens
agugcauuugcaucucaauaua

SEQ ID NO: 196571 - RNA, 22 nt, Homo sapiens
aguggaguguaaagcgucuuuu

SEQ ID NO: 196572 - RNA, 22 nt, Homo sapiens
aguggcuuuuuaguggcagaug

SEQ ID NO: 196573 - RNA, 22 nt, Homo sapiens
agugggccccuagaggugaggu

SEQ ID NO: 196574 - RNA, 19 nt, Homo sapiens
aguggguguuuucuguuug

SEQ ID NO: 196575 - RNA, 23 nt, Homo sapiens
aguggucuccugggcccagcugu

SEQ ID NO: 196576 - RNA, 22 nt, Homo sapiens
agugguuuuaaguagagcauac

SEQ ID NO: 196577 - RNA, 22 nt, Homo sapiens
aguguuuuuaucaugaaagggu

SEQ ID NO: 196578 - RNA, 22 nt, Homo sapiens
aguucaaugcucuuucuacuau

SEQ ID NO: 196579 - RNA, 22 nt, Homo sapiens
aguucaauggguuuucacucau

SEQ ID NO: 196580 - RNA, 21 nt, Homo sapiens
aguucacauggcuccuguguu

SEQ ID NO: 196581 - RNA, 22 nt, Homo sapiens
aguuccauuuauucucgucucu

SEQ ID NO: 196582 - RNA, 22 nt, Homo sapiens
aguuggccccuacugggaggug

SEQ ID NO: 196583 - RNA, 18 nt, Homo sapiens
auaaacucaucauuuuua

SEQ ID NO: 196584 - RNA, 22 nt, Homo sapiens
uggcaaaaaaacgcaauuacgu

SEQ ID NO: 196585 - RNA, 22 nt, Homo sapiens
uggcaaauagcaauaggagggu

SEQ ID NO: 196586 - RNA, 22 nt, Homo sapiens
uggcaacaucuggggacauguu

SEQ ID NO: 196587 - RNA, 22 nt, Homo sapiens
uggcaagaaccacaauuacuuu

SEQ ID NO: 196588 - RNA, 22 nt, Homo sapiens
uggcaagaaggauuuauuccuu

SEQ ID NO: 196589 - RNA, 23 nt, Homo sapiens
uggcaagaauucuuaccgugugg

SEQ ID NO: 196590 - RNA, 22 nt, Homo sapiens
uggcaagaccccaucucuacaa

SEQ ID NO: 196591 - RNA, 22 nt, Homo sapiens
uggcaagagaacaacaucucuc

SEQ ID NO: 196592 - RNA, 22 nt, Homo sapiens
uggcaagagcugcauucaucug

SEQ ID NO: 196593 - RNA, 22 nt, Homo sapiens
uggcaagagggaugcaagguuu

SEQ ID NO: 196594 - RNA, 19 nt, Homo sapiens
uggcacauguauacauaug

SEQ ID NO: 196595 - RNA, 22 nt, Homo sapiens
uggcaccugacuccgagaugca

SEQ ID NO: 196596 - RNA, 19 nt, Homo sapiens
uggcacuugacguccggau

SEQ ID NO: 196597 - RNA, 22 nt, Homo sapiens
uggcagcgugaauguggcugaa

SEQ ID NO: 196598 - RNA, 22 nt, Homo sapiens
uggcaguuuacagcuuuaggag

SEQ ID NO: 196599 - RNA, 22 nt, Homo sapiens
uggcauaugguauuugauaucu

SEQ ID NO: 196600 - RNA, 22 nt, Homo sapiens
uggcauggaacuacuuugaaac

SEQ ID NO: 196601 - RNA, 22 nt, Homo sapiens
uggcauggucugcccaaguuuc

SEQ ID NO: 196602 - RNA, 22 nt, Homo sapiens
uggcauuuucucuguucuuaga

SEQ ID NO: 196603 - RNA, 18 nt, Homo sapiens
uggccaauggcaaacaga

SEQ ID NO: 196604 - RNA, 22 nt, Homo sapiens
uggccuguaacccucucauagg

SEQ ID NO: 196605 - RNA, 22 nt, Homo sapiens
uggcgagaaaccauaugcuuuc

SEQ ID NO: 196606 - RNA, 20 nt, Homo sapiens
uggcuaaaugaaugauagca

SEQ ID NO: 196607 - RNA, 22 nt, Homo sapiens
uggcuauuucgucaugcucccc

SEQ ID NO: 196608 - RNA, 22 nt, Homo sapiens
uggcucuguuuguuaacuagac

SEQ ID NO: 196609 - RNA, 22 nt, Homo sapiens
uggcuguuuauuucaccuggau

SEQ ID NO: 196610 - RNA, 21 nt, Homo sapiens
uggcuuauuugaaucuggcuu

SEQ ID NO: 196611 - RNA, 22 nt, Homo sapiens
uggcuuuguaagguuucauuuu

SEQ ID NO: 196612 - RNA, 22 nt, Homo sapiens
ugggaacaugaagguuaaagag

SEQ ID NO: 196613 - RNA, 22 nt, Homo sapiens
ugggaagagggagcgauuuugg

SEQ ID NO: 196614 - RNA, 22 nt, Homo sapiens
ugggaaugaaauuacauagcuu

SEQ ID NO: 196615 - RNA, 22 nt, Homo sapiens
ugggagcauugcauuagaagcc

SEQ ID NO: 196616 - RNA, 22 nt, Homo sapiens
ugggagugugcacaauuucagc

SEQ ID NO: 196617 - RNA, 22 nt, Homo sapiens
ugggaucaugagcaccgcuucc

SEQ ID NO: 196618 - RNA, 22 nt, Homo sapiens
ugggaugaaaauagcuucuucc

SEQ ID NO: 196619 - RNA, 22 nt, Homo sapiens
ugggaugaauacaaugggauca

SEQ ID NO: 196620 - RNA, 22 nt, Homo sapiens
ugggaugaugcuugagaauauc

SEQ ID NO: 196621 - RNA, 22 nt, Homo sapiens
ugggcaagugacuuggcuucuc

SEQ ID NO: 196622 - RNA, 22 nt, Homo sapiens
ugggcaguauggucauuuucgu

SEQ ID NO: 196623 - RNA, 22 nt, Homo sapiens
uggguaggcccucauuggacag

SEQ ID NO: 196624 - RNA, 22 nt, Homo sapiens
ugggugugaccgcucaaggggg

SEQ ID NO: 196625 - RNA, 22 nt, Homo sapiens
uggucaaaucugaugugagaaa

SEQ ID NO: 196626 - RNA, 22 nt, Homo sapiens
ugguccuuuccauuggagacac

SEQ ID NO: 196627 - RNA, 22 nt, Homo sapiens
uggucuucuggccuccagaacc

SEQ ID NO: 196628 - RNA, 22 nt, Homo sapiens
ugagucagucucacucugcugc

SEQ ID NO: 196629 - RNA, 22 nt, Homo sapiens
ugaguuagguaauaauaaauau

SEQ ID NO: 196630 - RNA, 18 nt, Homo sapiens
ugaguucauuagacuucc

SEQ ID NO: 196631 - RNA, 23 nt, Homo sapiens
ugauaacagcauaugaagauucu

SEQ ID NO: 196632 - RNA, 22 nt, Homo sapiens
ugauaauguuaggcuuuauuca

SEQ ID NO: 196633 - RNA, 22 nt, Homo sapiens
ugauaggucagaugauauugaa

SEQ ID NO: 196634 - RNA, 22 nt, Homo sapiens
ugauaucugaauagauacacaa

SEQ ID NO: 196635 - RNA, 22 nt, Homo sapiens
ugauaugaaagggaaauaagug

SEQ ID NO: 196636 - RNA, 21 nt, Homo sapiens
ugauaugguagaagagagaca

SEQ ID NO: 196637 - RNA, 21 nt, Homo sapiens
ugauaugguuuggauaugugu

SEQ ID NO: 196638 - RNA, 18 nt, Homo sapiens
ugauaugguuuggcucug

SEQ ID NO: 196639 - RNA, 22 nt, Homo sapiens
ugauaugucccucgacaucagg

SEQ ID NO: 196640 - RNA, 22 nt, Homo sapiens
ugauauguggauucagcucaaa

SEQ ID NO: 196641 - RNA, 20 nt, Homo sapiens
ugaugcaaaucuuuaaaagu

SEQ ID NO: 196642 - RNA, 22 nt, Homo sapiens
ugaugcuacuaccugggcugaa

SEQ ID NO: 196643 - RNA, 22 nt, Homo sapiens
ugauggcaauggcauucauuuu

SEQ ID NO: 196644 - RNA, 22 nt, Homo sapiens
ugaugguccauaguucauggua

SEQ ID NO: 196645 - RNA, 20 nt, Homo sapiens
ugauguccaggcagagguuu

SEQ ID NO: 196646 - RNA, 22 nt, Homo sapiens
ugauuagaggaaugguagauua

SEQ ID NO: 196647 - RNA, 22 nt, Homo sapiens
ugauucccucaagugccuuaug

SEQ ID NO: 196648 - RNA, 22 nt, Homo sapiens
ugcaaacuuccuugggcagcau

SEQ ID NO: 196649 - RNA, 19 nt, Homo sapiens
ugcaaagucagugaagggu

SEQ ID NO: 196650 - RNA, 22 nt, Homo sapiens
ugcaagaaacauauuccacaag

SEQ ID NO: 196651 - RNA, 21 nt, Homo sapiens
ugcaagaaucaggaagcugcc

SEQ ID NO: 196652 - RNA, 22 nt, Homo sapiens
ugcaaguaauuccagcuacuga

SEQ ID NO: 196653 - RNA, 17 nt, Homo sapiens
ugcaauuuaagcuagau

SEQ ID NO: 196654 - RNA, 22 nt, Homo sapiens
ugcaccaucuugcuucuguggu

SEQ ID NO: 196655 - RNA, 17 nt, Homo sapiens
ugcagcacacugauggg

SEQ ID NO: 196656 - RNA, 23 nt, Homo sapiens
ugcagcacacugaugggucuuga

SEQ ID NO: 196657 - RNA, 18 nt, Homo sapiens
ugcagcaucaguacccag

SEQ ID NO: 196658 - RNA, 22 nt, Homo sapiens
ugcagcucaaauuccuaacaag

SEQ ID NO: 196659 - RNA, 22 nt, Homo sapiens
ugcaguacuuugaaauauacug

SEQ ID NO: 196660 - RNA, 22 nt, Homo sapiens
ugcaguaggcccagcgggaggc

SEQ ID NO: 196661 - RNA, 21 nt, Homo sapiens
ugcagugugguugcccugcug

SEQ ID NO: 196662 - RNA, 22 nt, Homo sapiens
ugcauacugaaauauuuuagag

SEQ ID NO: 196663 - RNA, 22 nt, Homo sapiens
ugcauaggcuaaaauccuggcc

SEQ ID NO: 196664 - RNA, 22 nt, Homo sapiens
ugcauauguugagaugcauauu

SEQ ID NO: 196665 - RNA, 22 nt, Homo sapiens
ugcauuagucuguucucacacu

SEQ ID NO: 196666 - RNA, 22 nt, Homo sapiens
ugcauugcacuugcaugagaua

SEQ ID NO: 196667 - RNA, 22 nt, Homo sapiens
ugcauuguauuguugacucgcc

SEQ ID NO: 196668 - RNA, 22 nt, Homo sapiens
ugccaacaugccuggcuguuuu

SEQ ID NO: 196669 - RNA, 19 nt, Homo sapiens
ugccaagaaagucagcuua

SEQ ID NO: 196670 - RNA, 22 nt, Homo sapiens
ugccaguguuuuguugaagauu

SEQ ID NO: 196671 - RNA, 22 nt, Homo sapiens
ugccaugaaguaauggcaaaaa

SEQ ID NO: 196672 - RNA, 22 nt, Homo sapiens
ugccuagaaacacuauuucucc

SEQ ID NO: 196673 - RNA, 22 nt, Homo sapiens
ugccuaggcccaguccucagaa

SEQ ID NO: 196674 - RNA, 22 nt, Homo sapiens
ugccugagcccagcccuguagu

SEQ ID NO: 196675 - RNA, 22 nt, Homo sapiens
uggugagaaaugagaugcuuuu

SEQ ID NO: 196676 - RNA, 22 nt, Homo sapiens
uggugcaaugaagugaucucaa

SEQ ID NO: 196677 - RNA, 17 nt, Homo sapiens
uggugcuugaaaguugc

SEQ ID NO: 196678 - RNA, 22 nt, Homo sapiens
ugguguccugucucugcgcuug

SEQ ID NO: 196679 - RNA, 22 nt, Homo sapiens
ugguucaguugcacaggcuguu

SEQ ID NO: 196680 - RNA, 22 nt, Homo sapiens
uguaaaaagcccagccgcugag

SEQ ID NO: 196681 - RNA, 22 nt, Homo sapiens
uguaaacucaguauguuuuacu

SEQ ID NO: 196682 - RNA, 22 nt, Homo sapiens
uguaacaggaggaaaaugugaa

SEQ ID NO: 196683 - RNA, 22 nt, Homo sapiens
uguaagcauugggcaugcaguc

SEQ ID NO: 196684 - RNA, 20 nt, Homo sapiens
uguacacaguguacccacau

SEQ ID NO: 196685 - RNA, 22 nt, Homo sapiens
uguacaugggacaggaggagag

SEQ ID NO: 196686 - RNA, 19 nt, Homo sapiens
uguaccagcaagucuuuuc

SEQ ID NO: 196687 - RNA, 22 nt, Homo sapiens
uguagauaucuaucaggucaau

SEQ ID NO: 196688 - RNA, 22 nt, Homo sapiens
uguagucauuuggaguccagcu

SEQ ID NO: 196689 - RNA, 22 nt, Homo sapiens
uguauacauauguauguuuugu

SEQ ID NO: 196690 - RNA, 22 nt, Homo sapiens
uguauacugucuaauauguugu

SEQ ID NO: 196691 - RNA, 22 nt, Homo sapiens
uguaugagagugaaagcauuuc

SEQ ID NO: 196692 - RNA, 22 nt, Homo sapiens
uguauguugggucaaaguacau

SEQ ID NO: 196693 - RNA, 22 nt, Homo sapiens
ugucaaagagacaucugcacuc

SEQ ID NO: 196694 - RNA, 22 nt, Homo sapiens
ugucaacauuuaucaaguuauu

SEQ ID NO: 196695 - RNA, 22 nt, Homo sapiens
ugucaaguugugguucaauuuu

SEQ ID NO: 196696 - RNA, 22 nt, Homo sapiens
ugucagcacaacucagguuccu

SEQ ID NO: 196697 - RNA, 22 nt, Homo sapiens
ugucaggagcaaugauaaauuu

SEQ ID NO: 196698 - RNA, 22 nt, Homo sapiens
ugucauauagaauguucuauga

SEQ ID NO: 196699 - RNA, 22 nt, Homo sapiens
ugucaucauuugagagaagaaa

SEQ ID NO: 196700 - RNA, 22 nt, Homo sapiens
ugucauguugagaaacuuggau

SEQ ID NO: 196701 - RNA, 22 nt, Homo sapiens
ugucauguuucuacugaccaaa

SEQ ID NO: 196702 - RNA, 22 nt, Homo sapiens
uguccaguguuccucagaagaa

SEQ ID NO: 196703 - RNA, 22 nt, Homo sapiens
uguccuagagggaugucacccc

SEQ ID NO: 196704 - RNA, 21 nt, Homo sapiens
ugucgugcaggaucuguggga

SEQ ID NO: 196705 - RNA, 22 nt, Homo sapiens
ugucuagaucugaauguaauug

SEQ ID NO: 196706 - RNA, 22 nt, Homo sapiens
ugucucaguuucuguggguuag

SEQ ID NO: 196707 - RNA, 21 nt, Homo sapiens
ugucugagagaggagaucuac

SEQ ID NO: 196708 - RNA, 22 nt, Homo sapiens
uuagacacacauacauuuaucu

SEQ ID NO: 196709 - RNA, 18 nt, Homo sapiens
uuagaugguuuuaaaacu

SEQ ID NO: 196710 - RNA, 22 nt, Homo sapiens
uuagcaauugauucucauaagc

SEQ ID NO: 196711 - RNA, 22 nt, Homo sapiens
uuagcacuugggaguauuuauu

SEQ ID NO: 196712 - RNA, 20 nt, Homo sapiens
uuagcagcaugauuuauaau

SEQ ID NO: 196713 - RNA, 21 nt, Homo sapiens
uuaggcagugucagaggugag

SEQ ID NO: 196714 - RNA, 23 nt, Homo sapiens
uuaguaaacucaaugacaccaca

SEQ ID NO: 196715 - RNA, 20 nt, Homo sapiens
uuagucuccucugcccuguc

SEQ ID NO: 196716 - RNA, 22 nt, Homo sapiens
uuauagacacguuguaacaaac

SEQ ID NO: 196717 - RNA, 22 nt, Homo sapiens
uuauagcagugcaggaacagac

SEQ ID NO: 196718 - RNA, 22 nt, Homo sapiens
uuauauguuucuuagggacaga

SEQ ID NO: 196719 - RNA, 22 nt, Homo sapiens
uuaucauagugcaguuuucuga

SEQ ID NO: 196720 - RNA, 22 nt, Homo sapiens
uuaugccagugauuauaagggc

SEQ ID NO: 196721 - RNA, 22 nt, Homo sapiens
uuauggcaaugccccacuccua

SEQ ID NO: 196722 - RNA, 22 nt, Homo sapiens
uuauguaaaucaaucuggaauc

SEQ ID NO: 196723 - RNA, 22 nt, Homo sapiens
uuauguccuuuaacuucaucac

SEQ ID NO: 196724 - RNA, 22 nt, Homo sapiens
uuaugucuuugagcaaugcugu

SEQ ID NO: 196725 - RNA, 22 nt, Homo sapiens
uuaugucuuuuguguucagcua

SEQ ID NO: 196726 - RNA, 22 nt, Homo sapiens
uuauucauuaauugcuaagguu

SEQ ID NO: 196727 - RNA, 22 nt, Homo sapiens
uuauucugucuuuggucucaau

SEQ ID NO: 196728 - RNA, 16 nt, Homo sapiens
uuauugcauucuucuc

SEQ ID NO: 196729 - RNA, 22 nt, Homo sapiens
uuauuguccaaguuucccuuug

SEQ ID NO: 196730 - RNA, 22 nt, Homo sapiens
uuauuugguuauuguaauuggg

SEQ ID NO: 196731 - RNA, 22 nt, Homo sapiens
uucaaaguguugguuuugggcu

SEQ ID NO: 196732 - RNA, 22 nt, Homo sapiens
uucaaggacuaaggauuuuugg

SEQ ID NO: 196733 - RNA, 22 nt, Homo sapiens
uucaaguaagaaagacaucagg

SEQ ID NO: 196734 - RNA, 22 nt, Homo sapiens
uucacagccgcaccccaucacu

SEQ ID NO: 196735 - RNA, 22 nt, Homo sapiens
uucacaguacucccuggaauua

SEQ ID NO: 196736 - RNA, 21 nt, Homo sapiens
uucaccauggcuccacacucu

SEQ ID NO: 196737 - RNA, 22 nt, Homo sapiens
uucaccuggguuggccaucauu

SEQ ID NO: 196738 - RNA, 22 nt, Homo sapiens
uucacuguagccucagccucuu

SEQ ID NO: 196739 - RNA, 22 nt, Homo sapiens
uucacugugaacucauauucag

SEQ ID NO: 196740 - RNA, 22 nt, Homo sapiens
uucagcuacuuggaaacagcaa

SEQ ID NO: 196741 - RNA, 22 nt, Homo sapiens
uucaguagucuccauagaaccg

SEQ ID NO: 196742 - RNA, 18 nt, Homo sapiens
uucagugaauucuuuuga

SEQ ID NO: 196743 - RNA, 20 nt, Homo sapiens
uucagugcagguaacaaucc

SEQ ID NO: 196744 - RNA, 22 nt, Homo sapiens
uucauaguaacaguaacuaugg

SEQ ID NO: 196745 - RNA, 22 nt, Homo sapiens
acccugucacucccaucaauuu

SEQ ID NO: 196746 - RNA, 18 nt, Homo sapiens
acccuucagcacugggcc

SEQ ID NO: 196747 - RNA, 22 nt, Homo sapiens
accgggcugagcgcaggccccg

SEQ ID NO: 196748 - RNA, 22 nt, Homo sapiens
accugcacagccgaacauagac

SEQ ID NO: 196749 - RNA, 23 nt, Homo sapiens
accugugguuauuuuacucuucc

SEQ ID NO: 196750 - RNA, 22 nt, Homo sapiens
acggcacugguggaaguguagc

SEQ ID NO: 196751 - RNA, 22 nt, Homo sapiens
acgugccuuguuguucauauga

SEQ ID NO: 196752 - RNA, 22 nt, Homo sapiens
acuacuucuaaguuuuggaaga

SEQ ID NO: 196753 - RNA, 22 nt, Homo sapiens
acuagagaugcauuuguaguuu

SEQ ID NO: 196754 - RNA, 22 nt, Homo sapiens
acucagagauuagcacauguuu

SEQ ID NO: 196755 - RNA, 22 nt, Homo sapiens
acucuguugucuggccuuccug

SEQ ID NO: 196756 - RNA, 22 nt, Homo sapiens
acugcaaugucgaauagagaug

SEQ ID NO: 196757 - RNA, 22 nt, Homo sapiens
acugcacuccagccuccugaca

SEQ ID NO: 196758 - RNA, 22 nt, Homo sapiens
acugcacuccagccuuagugac

SEQ ID NO: 196759 - RNA, 22 nt, Homo sapiens
acugcacuccagccuucgugac

SEQ ID NO: 196760 - RNA, 22 nt, Homo sapiens
acugcacuccagccuugauggc

SEQ ID NO: 196761 - RNA, 22 nt, Homo sapiens
acugcacuccagcuccagggug

SEQ ID NO: 196762 - RNA, 20 nt, Homo sapiens
acugcacuccagucucuggg

SEQ ID NO: 196763 - RNA, 22 nt, Homo sapiens
acugcacuccggccucgugaca

SEQ ID NO: 196764 - RNA, 22 nt, Homo sapiens
acugcacugucaaccuccuggg

SEQ ID NO: 196765 - RNA, 22 nt, Homo sapiens
acugggauauuauugguaauau

SEQ ID NO: 196766 - RNA, 22 nt, Homo sapiens
acuguacuccagccugggcaac

SEQ ID NO: 196767 - RNA, 22 nt, Homo sapiens
acuuauuguggcugacccaaac

SEQ ID NO: 196768 - RNA, 22 nt, Homo sapiens
acuuugcuuagagggcauuaaa

SEQ ID NO: 196769 - RNA, 22 nt, Homo sapiens
acuuuguuauggcaacccuaag

SEQ ID NO: 196770 - RNA, 22 nt, Homo sapiens
acuuuuugauggggagaacauu

SEQ ID NO: 196771 - RNA, 22 nt, Homo sapiens
agaaagugcuucccuuugguga

SEQ ID NO: 196772 - RNA, 22 nt, Homo sapiens
agaauguaacucuaugaaggca

SEQ ID NO: 196773 - RNA, 22 nt, Homo sapiens
agacaagauggcuugagguuca

SEQ ID NO: 196774 - RNA, 22 nt, Homo sapiens
agacaguguguguauauauggu

SEQ ID NO: 196775 - RNA, 22 nt, Homo sapiens
agacaucauuugauggugggag

SEQ ID NO: 196776 - RNA, 22 nt, Homo sapiens
agacuagagggaaaugaguugg

SEQ ID NO: 196777 - RNA, 22 nt, Homo sapiens
agacuuagagagucuauucuau

SEQ ID NO: 196778 - RNA, 19 nt, Homo sapiens
agagacucauuguagcauu

SEQ ID NO: 196779 - RNA, 22 nt, Homo sapiens
agagagguggguggagccccca

SEQ ID NO: 196780 - RNA, 22 nt, Homo sapiens
agagaucaacugaauuacugga

SEQ ID NO: 196781 - RNA, 20 nt, Homo sapiens
agagaucaguaauucaucaa

SEQ ID NO: 196782 - RNA, 22 nt, Homo sapiens
agagaucauuuuguuucaaauc

SEQ ID NO: 196783 - RNA, 22 nt, Homo sapiens
agagcuguguuuuaacuuuuua

SEQ ID NO: 196784 - RNA, 21 nt, Homo sapiens
agaggacugaccacagcccua

SEQ ID NO: 196785 - RNA, 22 nt, Homo sapiens
agagguaugccugggcuggagc

SEQ ID NO: 196786 - RNA, 22 nt, Homo sapiens
agagguuuaauugauucacagu

SEQ ID NO: 196787 - RNA, 22 nt, Homo sapiens
agagguuuuggggcugagagcu

SEQ ID NO: 196788 - RNA, 22 nt, Homo sapiens
agaguauacaugugagugagau

SEQ ID NO: 196789 - RNA, 22 nt, Homo sapiens
agaguauagcaacuuaguaaaa

SEQ ID NO: 196790 - RNA, 22 nt, Homo sapiens
agauacauuggauaaugguggg

SEQ ID NO: 196791 - RNA, 20 nt, Homo sapiens
agaugcaugcacauaaacac

SEQ ID NO: 196792 - RNA, 22 nt, Homo sapiens
agaugccuaugaagagaaauua

SEQ ID NO: 196793 - RNA, 23 nt, Homo sapiens
agauggcauuucaguucuuuagg

SEQ ID NO: 196794 - RNA, 22 nt, Homo sapiens
agcaacauugagacugcaguug

SEQ ID NO: 196795 - RNA, 22 nt, Homo sapiens
agcaccguucaaacccagguua

SEQ ID NO: 196796 - RNA, 21 nt, Homo sapiens
agcagaguggcagcucuuuug

SEQ ID NO: 196797 - RNA, 22 nt, Homo sapiens
agcagauguuuagugagcgccu

SEQ ID NO: 196798 - RNA, 22 nt, Homo sapiens
agcagcaugaggggacuucugc

SEQ ID NO: 196799 - RNA, 22 nt, Homo sapiens
agcagguauucgggucaugggg

SEQ ID NO: 196800 - RNA, 22 nt, Homo sapiens
agcaggucuuaacuugugaggu

SEQ ID NO: 196801 - RNA, 16 nt, Homo sapiens
agccaccauuuacuug

SEQ ID NO: 196802 - RNA, 22 nt, Homo sapiens
agccaguauuuugaguuggucu

SEQ ID NO: 196803 - RNA, 20 nt, Homo sapiens
agccccauguaaaccacaug

SEQ ID NO: 196804 - RNA, 22 nt, Homo sapiens
agccucauucuacauguuaaug

SEQ ID NO: 196805 - RNA, 22 nt, Homo sapiens
agccuguagugagcugugauug

SEQ ID NO: 196806 - RNA, 22 nt, Homo sapiens
agcuacuguuagucuaguuagg

SEQ ID NO: 196807 - RNA, 22 nt, Homo sapiens
agcuccauuguaaucaccuggu

SEQ ID NO: 196808 - RNA, 22 nt, Homo sapiens
agcuccuuugcuuuuuccagga

SEQ ID NO: 196809 - RNA, 22 nt, Homo sapiens
agcucuuguuaguauuagcagu

SEQ ID NO: 196810 - RNA, 22 nt, Homo sapiens
agcugaguguuccaagagcgag

SEQ ID NO: 196811 - RNA, 22 nt, Homo sapiens
agcugcauuuacuuuugcacaa

SEQ ID NO: 196812 - RNA, 22 nt, Homo sapiens
agcuggaauuuaagguagauag

SEQ ID NO: 196813 - RNA, 21 nt, Homo sapiens
agcugguuucuucuuacuccu

SEQ ID NO: 196814 - RNA, 20 nt, Homo sapiens
agcugguuuuaugaaucuuu

SEQ ID NO: 196815 - RNA, 22 nt, Homo sapiens
agcugugucuucuuaaagauuu

SEQ ID NO: 196816 - RNA, 22 nt, Homo sapiens
agcuguguugucugaagucaga

SEQ ID NO: 196817 - RNA, 22 nt, Homo sapiens
agcuuguauuuguagccuguug

SEQ ID NO: 196818 - RNA, 22 nt, Homo sapiens
uuugugucccuacccgaaucuc

SEQ ID NO: 196819 - RNA, 22 nt, Homo sapiens
uuuguguggccuuggccuggca

SEQ ID NO: 196820 - RNA, 22 nt, Homo sapiens
uuuuaagcuacaagagacauau

SEQ ID NO: 196821 - RNA, 22 nt, Homo sapiens
uuuuacacaucaccgcucgugu

SEQ ID NO: 196822 - RNA, 22 nt, Homo sapiens
uuuuagcagccaugacaaagau

SEQ ID NO: 196823 - RNA, 20 nt, Homo sapiens
uuuuagcuuuuauugaaagc

SEQ ID NO: 196824 - RNA, 22 nt, Homo sapiens
uuuuaguggaauauuuacaguu

SEQ ID NO: 196825 - RNA, 22 nt, Homo sapiens
uuuuaguugcucagguauucuc

SEQ ID NO: 196826 - RNA, 19 nt, Homo sapiens
uuuuccccuuucuuaagac

SEQ ID NO: 196827 - RNA, 21 nt, Homo sapiens
uuuugcacacuaugcagcuuu

SEQ ID NO: 196828 - RNA, 22 nt, Homo sapiens
uuuugcaccauccuaauaguau

SEQ ID NO: 196829 - RNA, 22 nt, Homo sapiens
uuuugcaguuacagagagugag

SEQ ID NO: 196830 - RNA, 22 nt, Homo sapiens
uuuugcauuggcugaggagugu

SEQ ID NO: 196831 - RNA, 22 nt, Homo sapiens
uuuugcucuugguaaugaaaga

SEQ ID NO: 196832 - RNA, 17 nt, Homo sapiens
uuuuggauuagaaaucc

SEQ ID NO: 196833 - RNA, 22 nt, Homo sapiens
uuuuggcuagaaauauaccucc

SEQ ID NO: 196834 - RNA, 22 nt, Homo sapiens
uuuuggcuuaaagagaauguau

SEQ ID NO: 196835 - RNA, 20 nt, Homo sapiens
uuuuggcuuaaagcagucug

SEQ ID NO: 196836 - RNA, 22 nt, Homo sapiens
uuuugguauauacggggguccu

SEQ ID NO: 196837 - RNA, 22 nt, Homo sapiens
uuuugguauaugcaggggucuu

SEQ ID NO: 196838 - RNA, 22 nt, Homo sapiens
uuuugugacuauuguaaauggg

SEQ ID NO: 196839 - RNA, 22 nt, Homo sapiens
uuuuuauggccaauccucagaa

SEQ ID NO: 196840 - RNA, 18 nt, Homo sapiens
uuuuugaggcacagggga

SEQ ID NO: 196841 - RNA, 22 nt, Homo sapiens
uuuuuggaggagguuagaucau

SEQ ID NO: 196842 - RNA, 22 nt, Homo sapiens
uuuuuuaguuagcugggcauga

SEQ ID NO: 196843 - RNA, 22 nt, Homo sapiens
gcauauuuuaaaguguaaccug

SEQ ID NO: 196844 - RNA, 20 nt, Homo sapiens
gcaugagucuuuauaguaga

SEQ ID NO: 196845 - RNA, 22 nt, Homo sapiens
gccaaaaugcugggauuacagg

SEQ ID NO: 196846 - RNA, 22 nt, Homo sapiens
gccaagaagugucuaagcagga

SEQ ID NO: 196847 - RNA, 22 nt, Homo sapiens
gccaagaucugaauaauuaaga

SEQ ID NO: 196848 - RNA, 21 nt, Homo sapiens
gccaguguggcaauuuuucaa

SEQ ID NO: 196849 - RNA, 22 nt, Homo sapiens
gccauggugucuuauuuuugug

SEQ ID NO: 196850 - RNA, 22 nt, Homo sapiens
gcccugagauucuuggauucug

SEQ ID NO: 196851 - RNA, 22 nt, Homo sapiens
gcccuguguuuggguaugguca

SEQ ID NO: 196852 - RNA, 22 nt, Homo sapiens
gcccuguugcccaggcuggagu

SEQ ID NO: 196853 - RNA, 22 nt, Homo sapiens
gcggguguuuuacccuugcaga

SEQ ID NO: 196854 - RNA, 22 nt, Homo sapiens
gcgugguguuagaaugagaagu

SEQ ID NO: 196855 - RNA, 21 nt, Homo sapiens
ugcauacuucucagaugauua

SEQ ID NO: 196856 - RNA, 22 nt, Homo sapiens
ugcauaugcagcauuuaugauu

SEQ ID NO: 196857 - RNA, 18 nt, Homo sapiens
ugcauauguugaaccagc

SEQ ID NO: 196858 - RNA, 22 nt, Homo sapiens
ugcauauucuaggauuuuguau

SEQ ID NO: 196859 - RNA, 22 nt, Homo sapiens
ugcaugcaucuuuuauaguagc

SEQ ID NO: 196860 - RNA, 22 nt, Homo sapiens
ugcauuaguaaguaauuuuaau

SEQ ID NO: 196861 - RNA, 22 nt, Homo sapiens
ugcauuaucagauguuugcuuu

SEQ ID NO: 196862 - RNA, 21 nt, Homo sapiens
ugcauugucuugaguuuaaau

SEQ ID NO: 196863 - RNA, 22 nt, Homo sapiens
ugcauuguggaucuaaaugcau

SEQ ID NO: 196864 - RNA, 21 nt, Homo sapiens
ugcauuguugcugagagcagg

SEQ ID NO: 196865 - RNA, 20 nt, Homo sapiens
ugccaagaaaugaggguauu

SEQ ID NO: 196866 - RNA, 19 nt, Homo sapiens
ugccauguagcacaugguc

SEQ ID NO: 196867 - RNA, 22 nt, Homo sapiens
ugcccaguggacagaaagucau

SEQ ID NO: 196868 - RNA, 21 nt, Homo sapiens
ugcccaguggcuuggggucag

SEQ ID NO: 196869 - RNA, 22 nt, Homo sapiens
ugcccuguaucccacuguuuca

SEQ ID NO: 196870 - RNA, 22 nt, Homo sapiens
ugccugagccagguuuuaggag

SEQ ID NO: 196871 - RNA, 22 nt, Homo sapiens
ugcuauagcuauaucaucuccu

SEQ ID NO: 196872 - RNA, 22 nt, Homo sapiens
ugcuaucauugauuagugaugu

SEQ ID NO: 196873 - RNA, 21 nt, Homo sapiens
ugcuccauuuucuagccugaa

SEQ ID NO: 196874 - RNA, 22 nt, Homo sapiens
ugcugguauuauguuauccaga

SEQ ID NO: 196875 - RNA, 22 nt, Homo sapiens
ugcugguauuuggaccagccug

SEQ ID NO: 196876 - RNA, 22 nt, Homo sapiens
ugcuuaggcuaacaaaaauagc

SEQ ID NO: 196877 - RNA, 22 nt, Homo sapiens
ugcuuaggcuuccuuacaguau

SEQ ID NO: 196878 - RNA, 22 nt, Homo sapiens
ugcuuaguuguauguuccacau

SEQ ID NO: 196879 - RNA, 19 nt, Homo sapiens
ugcuuaguuuuauguguaa

SEQ ID NO: 196880 - RNA, 22 nt, Homo sapiens
ugcuucauuggccaccaggaag

SEQ ID NO: 196881 - RNA, 22 nt, Homo sapiens
uggaaaucuaaguuuggauuga

SEQ ID NO: 196882 - RNA, 22 nt, Homo sapiens
uggaaauuaagucuuuccugag

SEQ ID NO: 196883 - RNA, 22 nt, Homo sapiens
uggaagacacauaccugauaac

SEQ ID NO: 196884 - RNA, 23 nt, Homo sapiens
uggaagacuccucucuuggcugc

SEQ ID NO: 196885 - RNA, 22 nt, Homo sapiens
uggaagacuuuagaggcuuaua

SEQ ID NO: 196886 - RNA, 22 nt, Homo sapiens
uggaagcauagcagcgugugug

SEQ ID NO: 196887 - RNA, 22 nt, Homo sapiens
uggaaguuaaaugacucuuucu

SEQ ID NO: 196888 - RNA, 22 nt, Homo sapiens
uggaauacaugucgcugagcug

SEQ ID NO: 196889 - RNA, 22 nt, Homo sapiens
uggaauacuauucugugcugga

SEQ ID NO: 196890 - RNA, 21 nt, Homo sapiens
uggaaucuauuauuccaguuu

SEQ ID NO: 196891 - RNA, 20 nt, Homo sapiens
uggaaugcagccuccuucug

SEQ ID NO: 196892 - RNA, 22 nt, Homo sapiens
uggaaugggauuggaaauuuug

SEQ ID NO: 196893 - RNA, 22 nt, Homo sapiens
uggaaugguaucuuguuggggu

SEQ ID NO: 196894 - RNA, 22 nt, Homo sapiens
uggacaagauagguucuauauu

SEQ ID NO: 196895 - RNA, 22 nt, Homo sapiens
uggacagacaagguuauagauc

SEQ ID NO: 196896 - RNA, 18 nt, Homo sapiens
uggacagugauuauccau

SEQ ID NO: 196897 - RNA, 22 nt, Homo sapiens
uggagagugauaaguaaaugga

SEQ ID NO: 196898 - RNA, 22 nt, Homo sapiens
uggagauguuuaaaauccacug

SEQ ID NO: 196899 - RNA, 22 nt, Homo sapiens
uggaggacugcagaacugaggc

SEQ ID NO: 196900 - RNA, 22 nt, Homo sapiens
uggagguagagaugggaucucc

SEQ ID NO: 196901 - RNA, 20 nt, Homo sapiens
uggaggucaucugucacuac

SEQ ID NO: 196902 - RNA, 22 nt, Homo sapiens
uggaggucauuggaucaugggg

SEQ ID NO: 196903 - RNA, 22 nt, Homo sapiens
uggagucgugcccuugcauuua

SEQ ID NO: 196904 - RNA, 22 nt, Homo sapiens
uggagugaaaacacacuaaucu

SEQ ID NO: 196905 - RNA, 21 nt, Homo sapiens
uggagugaagaguuuauugac

SEQ ID NO: 196906 - RNA, 20 nt, Homo sapiens
uggagugaagguucuggacc

SEQ ID NO: 196907 - RNA, 22 nt, Homo sapiens
uggaguguguugcagaugaagg

SEQ ID NO: 196908 - RNA, 22 nt, Homo sapiens
uggauagaaauguacuguuuuc

SEQ ID NO: 196909 - RNA, 22 nt, Homo sapiens
uggauagaacuaagugcuuaga

SEQ ID NO: 196910 - RNA, 18 nt, Homo sapiens
uggauaugaaauucugga

SEQ ID NO: 196911 - RNA, 22 nt, Homo sapiens
uggaugccuaauaaaugcagac

SEQ ID NO: 196912 - RNA, 22 nt, Homo sapiens
uggauggagaggcuugugaugc

SEQ ID NO: 196913 - RNA, 22 nt, Homo sapiens
uggauugaaagcuuuaauauug

SEQ ID NO: 196914 - RNA, 21 nt, Homo sapiens
uggauugagaaccccaggagg

SEQ ID NO: 196915 - RNA, 18 nt, Homo sapiens
uggauuguacuguguucu

SEQ ID NO: 196916 - RNA, 22 nt, Homo sapiens
uggcaaagugugacgugggggu

SEQ ID NO: 196917 - RNA, 22 nt, Homo sapiens
uggcaaaucagaggcauggaca

SEQ ID NO: 196918 - RNA, 22 nt, Homo sapiens
uggcaaaugaaagaaagccagu

SEQ ID NO: 196919 - RNA, 22 nt, Homo sapiens
gggcaagaagucuuguaguuuu

SEQ ID NO: 196920 - RNA, 20 nt, Homo sapiens
gggcaaguaugugggaaguc

SEQ ID NO: 196921 - RNA, 18 nt, Homo sapiens
gggcaaguugccuggcuu

SEQ ID NO: 196922 - RNA, 22 nt, Homo sapiens
gggcaugauggugcacacaugu

SEQ ID NO: 196923 - RNA, 22 nt, Homo sapiens
ggggaguguggacaucacccug

SEQ ID NO: 196924 - RNA, 22 nt, Homo sapiens
ggggcaaaaugccacgagucuc

SEQ ID NO: 196925 - RNA, 22 nt, Homo sapiens
ggguaggcaagcggaugucaga

SEQ ID NO: 196926 - RNA, 22 nt, Homo sapiens
gguaaacauaagagagcugacu

SEQ ID NO: 196927 - RNA, 22 nt, Homo sapiens
gguaaacauacugcugucuucu

SEQ ID NO: 196928 - RNA, 17 nt, Homo sapiens
uggcaugaggguguggg

SEQ ID NO: 196929 - RNA, 22 nt, Homo sapiens
uggcauggggcagaacauuaca

SEQ ID NO: 196930 - RNA, 22 nt, Homo sapiens
uggcaugggguaguagcgcugg

SEQ ID NO: 196931 - RNA, 22 nt, Homo sapiens
uggcaugucagguuucuggguu

SEQ ID NO: 196932 - RNA, 22 nt, Homo sapiens
uggcaugucguuuuucauagga

SEQ ID NO: 196933 - RNA, 22 nt, Homo sapiens
uggcauguguuugaaugaguau

SEQ ID NO: 196934 - RNA, 23 nt, Homo sapiens
uggcauuuuaguuagcuucagug

SEQ ID NO: 196935 - RNA, 23 nt, Homo sapiens
uggccagaaacuucuuuucaucc

SEQ ID NO: 196936 - RNA, 22 nt, Homo sapiens
uggccuguaacgcugucucagc

SEQ ID NO: 196937 - RNA, 22 nt, Homo sapiens
uggcgggaaaguugggagaaga

SEQ ID NO: 196938 - RNA, 22 nt, Homo sapiens
uggcuacagaaaguacuaguga

SEQ ID NO: 196939 - RNA, 20 nt, Homo sapiens
uggcucuuugcugcuaaagu

SEQ ID NO: 196940 - RNA, 22 nt, Homo sapiens
uggcuguuguuacuaacaguuc

SEQ ID NO: 196941 - RNA, 22 nt, Homo sapiens
uggcuguuuauuucaccugggc

SEQ ID NO: 196942 - RNA, 22 nt, Homo sapiens
uggcuguuuauuucacgugggu

SEQ ID NO: 196943 - RNA, 22 nt, Homo sapiens
uggcuuucuggggcuucuguuc

SEQ ID NO: 196944 - RNA, 22 nt, Homo sapiens
uggcuuuuccuugaaucugccu

SEQ ID NO: 196945 - RNA, 22 nt, Homo sapiens
ugggaagaagguuuacuugcca

SEQ ID NO: 196946 - RNA, 22 nt, Homo sapiens
ugggaauaugauacaggucuuu

SEQ ID NO: 196947 - RNA, 22 nt, Homo sapiens
ugggaucauuaugcauagugua

SEQ ID NO: 196948 - RNA, 22 nt, Homo sapiens
ugggaugauguuaaacguacuc

SEQ ID NO: 196949 - RNA, 22 nt, Homo sapiens
ugggcaagagagcaugacccug

SEQ ID NO: 196950 - RNA, 21 nt, Homo sapiens
ugggccccuuccuuacaucau

SEQ ID NO: 196951 - RNA, 22 nt, Homo sapiens
uggguagagaaucaggaucuua

SEQ ID NO: 196952 - RNA, 22 nt, Homo sapiens
ugggugaguaucuauuauucag

SEQ ID NO: 196953 - RNA, 23 nt, Homo sapiens
uggguucauucuugaagucagug

SEQ ID NO: 196954 - RNA, 22 nt, Homo sapiens
ugguauguaugauuaacaugga

SEQ ID NO: 196955 - RNA, 22 nt, Homo sapiens
ugguauguuuauaaguauagga

SEQ ID NO: 196956 - RNA, 22 nt, Homo sapiens
uggucaccugaauuaugcaugu

SEQ ID NO: 196957 - RNA, 22 nt, Homo sapiens
uggucaccuucuugcucugucu

SEQ ID NO: 196958 - RNA, 22 nt, Homo sapiens
ugguccacuaacccucaguauc

SEQ ID NO: 196959 - RNA, 21 nt, Homo sapiens
uggucccauaagauuacaaug

SEQ ID NO: 196960 - RNA, 19 nt, Homo sapiens
uggucccccgcaaucucau

SEQ ID NO: 196961 - RNA, 22 nt, Homo sapiens
uggucuggagagucccgcccag

SEQ ID NO: 196962 - RNA, 22 nt, Homo sapiens
uggugagaaaagaugucuuugu

SEQ ID NO: 196963 - RNA, 22 nt, Homo sapiens
uggugcccuguccuucuguggc

SEQ ID NO: 196964 - RNA, 22 nt, Homo sapiens
uggugcuuaaauaaggcuuuca

SEQ ID NO: 196965 - RNA, 22 nt, Homo sapiens
uggugcuugaugaggguggagc

SEQ ID NO: 196966 - RNA, 20 nt, Homo sapiens
ugguguuugaacagugaaug

SEQ ID NO: 196967 - RNA, 22 nt, Homo sapiens
ugguuccauauuaauuuuagga

SEQ ID NO: 196968 - RNA, 22 nt, Homo sapiens
ugguuguuuuaaaugucgucug

SEQ ID NO: 196969 - RNA, 22 nt, Homo sapiens
uguaauguuucaucauuauuaa

SEQ ID NO: 196970 - RNA, 22 nt, Homo sapiens
uguacacauaugugggguacau

SEQ ID NO: 196971 - RNA, 22 nt, Homo sapiens
uguagacaccaaagacagcaua

SEQ ID NO: 196972 - RNA, 21 nt, Homo sapiens
uguagcagcaugauucauagu

SEQ ID NO: 196973 - RNA, 22 nt, Homo sapiens
uguagggagagggaguugcacc

SEQ ID NO: 196974 - RNA, 22 nt, Homo sapiens
uguagguguacauacaugguua

SEQ ID NO: 196975 - RNA, 23 nt, Homo sapiens
uguauacacccugugcaucuggg

SEQ ID NO: 196976 - RNA, 21 nt, Homo sapiens
uguauacauauguuaggugca

SEQ ID NO: 196977 - RNA, 21 nt, Homo sapiens
uguauacauggaagaaugguc

SEQ ID NO: 196978 - RNA, 22 nt, Homo sapiens
uguaugaguuguuuauaaauuu

SEQ ID NO: 196979 - RNA, 22 nt, Homo sapiens
uguaugcuuuugagagauauuu

SEQ ID NO: 196980 - RNA, 22 nt, Homo sapiens
uguauguugauguuauauucug

SEQ ID NO: 196981 - RNA, 22 nt, Homo sapiens
ugucaagaugguuugauguugu

SEQ ID NO: 196982 - RNA, 22 nt, Homo sapiens
ugucacauccaagaaggugcag

SEQ ID NO: 196983 - RNA, 22 nt, Homo sapiens
ugucacuuugccuucuggacuu

SEQ ID NO: 196984 - RNA, 22 nt, Homo sapiens
ugucaggaguuuuagaaucuua

SEQ ID NO: 196985 - RNA, 22 nt, Homo sapiens
ugucaggaugcuccuuuuggcu

SEQ ID NO: 196986 - RNA, 22 nt, Homo sapiens
ugucaucauuggaaucugccuc

SEQ ID NO: 196987 - RNA, 22 nt, Homo sapiens
ugucauguagaaauuguccauu

SEQ ID NO: 196988 - RNA, 22 nt, Homo sapiens
ugucauguauauaccacuucca

SEQ ID NO: 196989 - RNA, 22 nt, Homo sapiens
ugucauguugguguacugcacc

SEQ ID NO: 196990 - RNA, 20 nt, Homo sapiens
ugucauuaagcacugugcca

SEQ ID NO: 196991 - RNA, 22 nt, Homo sapiens
uguccaaauugaaucaucuggu

SEQ ID NO: 196992 - RNA, 22 nt, Homo sapiens
uguccuggugaugcccaaauuc

SEQ ID NO: 196993 - RNA, 22 nt, Homo sapiens
ugucucagugauuggcuuucug

SEQ ID NO: 196994 - RNA, 22 nt, Homo sapiens
ugucucaguuacggcaauucca

SEQ ID NO: 196995 - RNA, 22 nt, Homo sapiens
ugucuuugguucaggcaaggag

SEQ ID NO: 196996 - RNA, 22 nt, Homo sapiens
ugugaaauguuaucccgucgug

SEQ ID NO: 196997 - RNA, 22 nt, Homo sapiens
ugugaacagcuccaaaugugga

SEQ ID NO: 196998 - RNA, 22 nt, Homo sapiens
ugugacagcacgguucaacugc

SEQ ID NO: 196999 - RNA, 18 nt, Homo sapiens
ugugacauugagcauguc

SEQ ID NO: 197000 - RNA, 22 nt, Homo sapiens
ugugaccaaaaucaacauaccu

SEQ ID NO: 197001 - RNA, 17 nt, Homo sapiens
cuucaaauaauuucccc

SEQ ID NO: 197002 - RNA, 22 nt, Homo sapiens
cuucaaguguggccaccugacc

SEQ ID NO: 197003 - RNA, 22 nt, Homo sapiens
cuucacuggagucccuggauuc

SEQ ID NO: 197004 - RNA, 22 nt, Homo sapiens
cuuccaaguggggcacgugcca

SEQ ID NO: 197005 - RNA, 22 nt, Homo sapiens
cuucucagugcucaucuuauuu

SEQ ID NO: 197006 - RNA, 20 nt, Homo sapiens
cuugaagacuaugcugcuga

SEQ ID NO: 197007 - RNA, 22 nt, Homo sapiens
cuugacacugcaguuuuccugg

SEQ ID NO: 197008 - RNA, 22 nt, Homo sapiens
cuuggcauugccccuggaauuu

SEQ ID NO: 197009 - RNA, 20 nt, Homo sapiens
cuuggcuuucuugguguuaa

SEQ ID NO: 197010 - RNA, 22 nt, Homo sapiens
cuuggguaagucauuaaaauua

SEQ ID NO: 197011 - RNA, 22 nt, Homo sapiens
cuuguacacuguuggugggaau

SEQ ID NO: 197012 - RNA, 21 nt, Homo sapiens
cuugucuugcuuagaauagac

SEQ ID NO: 197013 - RNA, 22 nt, Homo sapiens
uuggcagcuguggaaucugggc

SEQ ID NO: 197014 - RNA, 22 nt, Homo sapiens
uuggcauugccaaacugucaac

SEQ ID NO: 197015 - RNA, 22 nt, Homo sapiens
uuggccauaugacuugcuuugg

SEQ ID NO: 197016 - RNA, 22 nt, Homo sapiens
uuggcccugcugaccauucccu

SEQ ID NO: 197017 - RNA, 22 nt, Homo sapiens
uuggcuaugaguccuaugugca

SEQ ID NO: 197018 - RNA, 22 nt, Homo sapiens
uuggcuguguuccucaaggagu

SEQ ID NO: 197019 - RNA, 22 nt, Homo sapiens
uuggcuuaguugaccacagucu

SEQ ID NO: 197020 - RNA, 22 nt, Homo sapiens
uuggcuuuuaugcagcuuaggu

SEQ ID NO: 197021 - RNA, 22 nt, Homo sapiens
uugggaauguccuaauaucucg

SEQ ID NO: 197022 - RNA, 22 nt, Homo sapiens
uugggccacuuuaguuuccuua

SEQ ID NO: 197023 - RNA, 22 nt, Homo sapiens
uugggcuuuuagguccuuaaca

SEQ ID NO: 197024 - RNA, 21 nt, Homo sapiens
uuggggaauggagagguuuuc

SEQ ID NO: 197025 - RNA, 22 nt, Homo sapiens
uuggguccucugguccuugguu

SEQ ID NO: 197026 - RNA, 22 nt, Homo sapiens
uuggucagcucaauggagaggg

SEQ ID NO: 197027 - RNA, 22 nt, Homo sapiens
uuggucaggagccucccucuuu

SEQ ID NO: 197028 - RNA, 22 nt, Homo sapiens
uugguccauuacauugaugaca

SEQ ID NO: 197029 - RNA, 19 nt, Homo sapiens
uuggucccuuuggguucuu

SEQ ID NO: 197030 - RNA, 22 nt, Homo sapiens
uuggucucaucaagagcagcuu

SEQ ID NO: 197031 - RNA, 21 nt, Homo sapiens
uuggucuucucugugauucuu

SEQ ID NO: 197032 - RNA, 20 nt, Homo sapiens
uuggugaccuacagaugugg

SEQ ID NO: 197033 - RNA, 22 nt, Homo sapiens
uugguuaucaucauuucagcaa

SEQ ID NO: 197034 - RNA, 22 nt, Homo sapiens
uuguaaagucugucucagucag

SEQ ID NO: 197035 - RNA, 22 nt, Homo sapiens
uuguaaaguucuuaggaagcuc

SEQ ID NO: 197036 - RNA, 22 nt, Homo sapiens
uuguacaggaguguaagcuuca

SEQ ID NO: 197037 - RNA, 22 nt, Homo sapiens
uuguacuauuuuuaucagugau

SEQ ID NO: 197038 - RNA, 22 nt, Homo sapiens
uuguacuucagacaugccaaag

SEQ ID NO: 197039 - RNA, 22 nt, Homo sapiens
uuguacuuuuaguagagacggg

SEQ ID NO: 197040 - RNA, 22 nt, Homo sapiens
uuguauaggcucaguaagaauc

SEQ ID NO: 197041 - RNA, 22 nt, Homo sapiens
uuguauccaucuuucaggcaac

SEQ ID NO: 197042 - RNA, 22 nt, Homo sapiens
aaagguaguacuucuagaaggg

SEQ ID NO: 197043 - RNA, 19 nt, Homo sapiens
aaaguacucugaugccucu

SEQ ID NO: 197044 - RNA, 22 nt, Homo sapiens
aaagucuguuacagcuauuucu

SEQ ID NO: 197045 - RNA, 22 nt, Homo sapiens
aaagugcaguauuugggcagaa

SEQ ID NO: 197046 - RNA, 22 nt, Homo sapiens
aaagugcugagucuaggcgggg

SEQ ID NO: 197047 - RNA, 22 nt, Homo sapiens
aaagugcugggaucacacugaa

SEQ ID NO: 197048 - RNA, 22 nt, Homo sapiens
aaagugcuuacuaaguugccaa

SEQ ID NO: 197049 - RNA, 22 nt, Homo sapiens
aaaguggacuaagugaauauga

SEQ ID NO: 197050 - RNA, 22 nt, Homo sapiens
aaaguguguuuccaaccugugg

SEQ ID NO: 197051 - RNA, 22 nt, Homo sapiens
aaaugacuuuuuaugcagagua

SEQ ID NO: 197052 - RNA, 22 nt, Homo sapiens
aaaugcaccacucuggugcagg

SEQ ID NO: 197053 - RNA, 22 nt, Homo sapiens
aaaugcauaucaagauugcccu

SEQ ID NO: 197054 - RNA, 22 nt, Homo sapiens
aaaugcauggacagcuggucuu

SEQ ID NO: 197055 - RNA, 22 nt, Homo sapiens
aaaugcucuuuaugaaguugga

SEQ ID NO: 197056 - RNA, 22 nt, Homo sapiens
aaaugcuucuauguggcauguu

SEQ ID NO: 197057 - RNA, 22 nt, Homo sapiens
aaaugcuuucuuggaccauuug

SEQ ID NO: 197058 - RNA, 19 nt, Homo sapiens
aaaugugcacuguuuucca

SEQ ID NO: 197059 - RNA, 22 nt, Homo sapiens
aaauugcaaugcgaggcagagg

SEQ ID NO: 197060 - RNA, 22 nt, Homo sapiens
aacagaauccucuuuuccuggg

SEQ ID NO: 197061 - RNA, 20 nt, Homo sapiens
aacagcacugucugaagcuu

SEQ ID NO: 197062 - RNA, 22 nt, Homo sapiens
aacagcauaguacccgugauaa

SEQ ID NO: 197063 - RNA, 22 nt, Homo sapiens
aacagucaauugcugaugaccu

SEQ ID NO: 197064 - RNA, 22 nt, Homo sapiens
aaccuauaguauugaaaucaag

SEQ ID NO: 197065 - RNA, 22 nt, Homo sapiens
aaccuguggauuuugguaucug

SEQ ID NO: 197066 - RNA, 22 nt, Homo sapiens
aacucacauucuuucuugguac

SEQ ID NO: 197067 - RNA, 22 nt, Homo sapiens
aacugcacauauuuguaugggu

SEQ ID NO: 197068 - RNA, 22 nt, Homo sapiens
aacugcacuaggacagguuuuu

SEQ ID NO: 197069 - RNA, 22 nt, Homo sapiens
aacuggccuggcgugcagaggg

SEQ ID NO: 197070 - RNA, 19 nt, Homo sapiens
aacuggugugagaugguau

SEQ ID NO: 197071 - RNA, 22 nt, Homo sapiens
aagacuguaauccaucuugagu

SEQ ID NO: 197072 - RNA, 22 nt, Homo sapiens
aagagagcuaugugcauaauua

SEQ ID NO: 197073 - RNA, 18 nt, Homo sapiens
aagagcucagcacagguu

SEQ ID NO: 197074 - RNA, 22 nt, Homo sapiens
aagagcucauccauaguuguca

SEQ ID NO: 197075 - RNA, 23 nt, Homo sapiens
aagagguaugacuaugaagugga

SEQ ID NO: 197076 - RNA, 22 nt, Homo sapiens
aagagguuuaacugacucacag

SEQ ID NO: 197077 - RNA, 22 nt, Homo sapiens
aagaucauucagggaaggcuga

SEQ ID NO: 197078 - RNA, 22 nt, Homo sapiens
aagcaaacaucagcuugguuaa

SEQ ID NO: 197079 - RNA, 20 nt, Homo sapiens
aagcaagcauuugcaaucau

SEQ ID NO: 197080 - RNA, 22 nt, Homo sapiens
aagcuaggguuaauuuauuauu

SEQ ID NO: 197081 - RNA, 22 nt, Homo sapiens
aagcuccauuucugccaugaga

SEQ ID NO: 197082 - RNA, 22 nt, Homo sapiens
aagcugcauuuucuagaugcuu

SEQ ID NO: 197083 - RNA, 22 nt, Homo sapiens
aagcugccaggcaugguggcug

SEQ ID NO: 197084 - RNA, 22 nt, Homo sapiens
aagcuggagugcaguggugcga

SEQ ID NO: 197085 - RNA, 22 nt, Homo sapiens
aagcuggauuucgcauccuguu

SEQ ID NO: 197086 - RNA, 22 nt, Homo sapiens
aagcuguugguggauguaccau

SEQ ID NO: 197087 - RNA, 22 nt, Homo sapiens
aaggaacuggaauauuuugaac

SEQ ID NO: 197088 - RNA, 21 nt, Homo sapiens
caucacauuacucaaaguccu

SEQ ID NO: 197089 - RNA, 20 nt, Homo sapiens
caucaccuggcaggauuugu

SEQ ID NO: 197090 - RNA, 22 nt, Homo sapiens
caucacuuugccuccgucucua

SEQ ID NO: 197091 - RNA, 22 nt, Homo sapiens
caucccauucgaggggcacagc

SEQ ID NO: 197092 - RNA, 22 nt, Homo sapiens
cauccccugcaccaaccuuuac

SEQ ID NO: 197093 - RNA, 22 nt, Homo sapiens
caucccugaaccccagaaaucu

SEQ ID NO: 197094 - RNA, 22 nt, Homo sapiens
caugaaagugagaaacuccugg

SEQ ID NO: 197095 - RNA, 22 nt, Homo sapiens
caugauauugcagaauguuggu

SEQ ID NO: 197096 - RNA, 22 nt, Homo sapiens
cauggcacaucuuuucugacua

SEQ ID NO: 197097 - RNA, 22 nt, Homo sapiens
cauggcacugagcagguaugca

SEQ ID NO: 197098 - RNA, 22 nt, Homo sapiens
cauggcccugggcugggcgaac

SEQ ID NO: 197099 - RNA, 22 nt, Homo sapiens
cauggcccuggguccauaggaa

SEQ ID NO: 197100 - RNA, 22 nt, Homo sapiens
cauggccuuuggaaugugucua

SEQ ID NO: 197101 - RNA, 22 nt, Homo sapiens
cauggcucuuugcugcuaaagu

SEQ ID NO: 197102 - RNA, 22 nt, Homo sapiens
cauuacacuccagccuggguga

SEQ ID NO: 197103 - RNA, 22 nt, Homo sapiens
cauuacacuuguaagguuuuuc

SEQ ID NO: 197104 - RNA, 20 nt, Homo sapiens
cauuccacuuuccugucagu

SEQ ID NO: 197105 - RNA, 22 nt, Homo sapiens
cauugcaacuucugccucccag

SEQ ID NO: 197106 - RNA, 22 nt, Homo sapiens
cauugcaaugaggucuugcagu

SEQ ID NO: 197107 - RNA, 22 nt, Homo sapiens
uuguaacaguuuauugacucga

SEQ ID NO: 197108 - RNA, 23 nt, Homo sapiens
uuguacacuaagaaucgcagaug

SEQ ID NO: 197109 - RNA, 22 nt, Homo sapiens
uuguaguagcauuauuuauaau

SEQ ID NO: 197110 - RNA, 22 nt, Homo sapiens
uugucaaacucauucuccaucc

SEQ ID NO: 197111 - RNA, 22 nt, Homo sapiens
uugucaaugggugagugcagag

SEQ ID NO: 197112 - RNA, 22 nt, Homo sapiens
uugucacauggggcggcugccc

SEQ ID NO: 197113 - RNA, 22 nt, Homo sapiens
uugucacuauaaauaagcauuu

SEQ ID NO: 197114 - RNA, 21 nt, Homo sapiens
uuguccccacccaaaucucau

SEQ ID NO: 197115 - RNA, 22 nt, Homo sapiens
uuguccccacccaaaugucauc

SEQ ID NO: 197116 - RNA, 23 nt, Homo sapiens
uuguccccuccaaagcucauguu

SEQ ID NO: 197117 - RNA, 22 nt, Homo sapiens
uugucuccuagacgaccaggcg

SEQ ID NO: 197118 - RNA, 22 nt, Homo sapiens
uugugaauggaguagcaggauc

SEQ ID NO: 197119 - RNA, 22 nt, Homo sapiens
uugugcaugaugcauacauggu

SEQ ID NO: 197120 - RNA, 22 nt, Homo sapiens
uugugcauguauauuaguucac

SEQ ID NO: 197121 - RNA, 22 nt, Homo sapiens
uugugguaaucugugacagcag

SEQ ID NO: 197122 - RNA, 22 nt, Homo sapiens
uugugguaggcauguaagauga

SEQ ID NO: 197123 - RNA, 22 nt, Homo sapiens
uugugguugaugaagacugucu

SEQ ID NO: 197124 - RNA, 22 nt, Homo sapiens
uugugguuuuuaaaacuaggug

SEQ ID NO: 197125 - RNA, 22 nt, Homo sapiens
uuguuauguaucucaagauaaa

SEQ ID NO: 197126 - RNA, 22 nt, Homo sapiens
uuguuauguuaaacuacugaaa

SEQ ID NO: 197127 - RNA, 22 nt, Homo sapiens
uuguuauguuggucaguaaugu

SEQ ID NO: 197128 - RNA, 22 nt, Homo sapiens
uuuaaagcacggaguuuguggc

SEQ ID NO: 197129 - RNA, 22 nt, Homo sapiens
uuuaaaguuagaaggaaagggc

SEQ ID NO: 197130 - RNA, 22 nt, Homo sapiens
uuuaauagcagggacuuccggg

SEQ ID NO: 197131 - RNA, 22 nt, Homo sapiens
uuuaaugcgucucugaguuuug

SEQ ID NO: 197132 - RNA, 17 nt, Homo sapiens
uuuaaugcuaggacucu

SEQ ID NO: 197133 - RNA, 18 nt, Homo sapiens
uuuacaguagaaggacuu

SEQ ID NO: 197134 - RNA, 22 nt, Homo sapiens
uuuacagucuuuugugugaguc

SEQ ID NO: 197135 - RNA, 19 nt, Homo sapiens
uuuagaucuuuuaugcagc

SEQ ID NO: 197136 - RNA, 22 nt, Homo sapiens
uuuagcacugugauugacaaaa

SEQ ID NO: 197137 - RNA, 22 nt, Homo sapiens
uuuaggcaugcaguucuauuua

SEQ ID NO: 197138 - RNA, 22 nt, Homo sapiens
uuuagguauuugguauagcagu

SEQ ID NO: 197139 - RNA, 22 nt, Homo sapiens
uuuauccagccucuagcaaggu

SEQ ID NO: 197140 - RNA, 22 nt, Homo sapiens
uuuaugucuguacaucgggcgg

SEQ ID NO: 197141 - RNA, 22 nt, Homo sapiens
uuuauucggcuaggagcuucgg

SEQ ID NO: 197142 - RNA, 23 nt, Homo sapiens
uuucacaguagcuggaucagccu

SEQ ID NO: 197143 - RNA, 21 nt, Homo sapiens
uuucacugugaguuuuucugu

SEQ ID NO: 197144 - RNA, 22 nt, Homo sapiens
uuucaggcagggagcuucagug

SEQ ID NO: 197145 - RNA, 22 nt, Homo sapiens
uuucaguagagacacgguuuug

SEQ ID NO: 197146 - RNA, 19 nt, Homo sapiens
uuucauguuuuuggugaga

SEQ ID NO: 197147 - RNA, 22 nt, Homo sapiens
uuuccacauggacuuaccuucg

SEQ ID NO: 197148 - RNA, 19 nt, Homo sapiens
uuuccaguaaucuuaugug

SEQ ID NO: 197149 - RNA, 22 nt, Homo sapiens
uuuccaguuggaagaaggggga

SEQ ID NO: 197150 - RNA, 22 nt, Homo sapiens
uuuccauguuggugaaaugagg

SEQ ID NO: 197151 - RNA, 22 nt, Homo sapiens
uuucccuuuagcuuagugauuu

SEQ ID NO: 197152 - RNA, 22 nt, Homo sapiens
uuucuauguugaccagucuaga

SEQ ID NO: 197153 - RNA, 22 nt, Homo sapiens
uuucucaguguuucaggguagg

SEQ ID NO: 197154 - RNA, 22 nt, Homo sapiens
uuucugggggugcugauggaaa

SEQ ID NO: 197155 - RNA, 23 nt, Homo sapiens
uuucuugggcaugcuaugucagu

SEQ ID NO: 197156 - RNA, 22 nt, Homo sapiens
uuucuugguuguauuuagacuu

SEQ ID NO: 197157 - RNA, 22 nt, Homo sapiens
uuugacucacagccuggcugcc

SEQ ID NO: 197158 - RNA, 22 nt, Homo sapiens
uuugagcaggcuaaucaauaua

SEQ ID NO: 197159 - RNA, 22 nt, Homo sapiens
uuugagcauggaaauggcauga

SEQ ID NO: 197160 - RNA, 22 nt, Homo sapiens
uuugauguugauacuaccuuca

SEQ ID NO: 197161 - RNA, 22 nt, Homo sapiens
uuugcacauauuugggcaaaag

SEQ ID NO: 197162 - RNA, 22 nt, Homo sapiens
uuugccaaucagaggcaucuug

SEQ ID NO: 197163 - RNA, 23 nt, Homo sapiens
uuugccacuuauuagcugggagg

SEQ ID NO: 197164 - RNA, 22 nt, Homo sapiens
uuugccuguagacacuuacccu

SEQ ID NO: 197165 - RNA, 22 nt, Homo sapiens
uuugcugagucugacuucaugg

SEQ ID NO: 197166 - RNA, 22 nt, Homo sapiens
uuuggauagugugguccuuuua

SEQ ID NO: 197167 - RNA, 20 nt, Homo sapiens
uuuggcaauaggguuuuugu

SEQ ID NO: 197168 - RNA, 22 nt, Homo sapiens
uuuggcauuagagagacuugca

SEQ ID NO: 197169 - RNA, 22 nt, Homo sapiens
uuuggcuauguuguaucuuucc

SEQ ID NO: 197170 - RNA, 22 nt, Homo sapiens
uuugggcuuuuaaucuagagca

SEQ ID NO: 197171 - RNA, 22 nt, Homo sapiens
uuuggguuaguuuuccaaucuu

SEQ ID NO: 197172 - RNA, 22 nt, Homo sapiens
uuugguguauaaaaaugcuagu

SEQ ID NO: 197173 - RNA, 22 nt, Homo sapiens
uaggacauugcccuuguggaga

SEQ ID NO: 197174 - RNA, 20 nt, Homo sapiens
uaggagcaaugagaguagaa

SEQ ID NO: 197175 - RNA, 22 nt, Homo sapiens
uaggagcacaaacccuacugug

SEQ ID NO: 197176 - RNA, 22 nt, Homo sapiens
uaggagcauaggauuguuugag

SEQ ID NO: 197177 - RNA, 22 nt, Homo sapiens
uaggcaaguugcccaaucucuc

SEQ ID NO: 197178 - RNA, 22 nt, Homo sapiens
uaggcaguggagaaauaaacag

SEQ ID NO: 197179 - RNA, 22 nt, Homo sapiens
uagggcaaggaacaguuaaaaa

SEQ ID NO: 197180 - RNA, 22 nt, Homo sapiens
uagguaaguaauauacagauga

SEQ ID NO: 197181 - RNA, 19 nt, Homo sapiens
uagguacauucaagucucc

SEQ ID NO: 197182 - RNA, 22 nt, Homo sapiens
uuuuaacagccaggggacggcc

SEQ ID NO: 197183 - RNA, 22 nt, Homo sapiens
uuuucaguggccauaguggaga

SEQ ID NO: 197184 - RNA, 20 nt, Homo sapiens
uuuugaacuuggcaaccugu

SEQ ID NO: 197185 - RNA, 22 nt, Homo sapiens
uuuugcacuguuuuaucugaca

SEQ ID NO: 197186 - RNA, 22 nt, Homo sapiens
uuuugcuccuggcaaacucaua

SEQ ID NO: 197187 - RNA, 22 nt, Homo sapiens
uuuugcuugugaauagccacau

SEQ ID NO: 197188 - RNA, 22 nt, Homo sapiens
uuuuggcacuuugucugauucu

SEQ ID NO: 197189 - RNA, 22 nt, Homo sapiens
uuuuggcucuugguaggucaga

SEQ ID NO: 197190 - RNA, 22 nt, Homo sapiens
uuuuggcuuuuccucagcaagc

SEQ ID NO: 197191 - RNA, 22 nt, Homo sapiens
uuuugguguacaauucuaugga

SEQ ID NO: 197192 - RNA, 22 nt, Homo sapiens
uuuuguacgccuguguccauca

SEQ ID NO: 197193 - RNA, 21 nt, Homo sapiens
uuuuugggcuuucauaguguu

SEQ ID NO: 197194 - RNA, 22 nt, Homo sapiens
uuuuugugguauauugcaacaa

SEQ ID NO: 197195 - RNA, 22 nt, Homo sapiens
uuuuuugcuguaugcaaacauc

SEQ ID NO: 197196 - RNA, 22 nt, Homo sapiens
uucaguucugcucugaucuuag

SEQ ID NO: 197197 - RNA, 18 nt, Homo sapiens
uucaguuuguaucugggg

SEQ ID NO: 197198 - RNA, 22 nt, Homo sapiens
uucauagaggacauuacuggag

SEQ ID NO: 197199 - RNA, 22 nt, Homo sapiens
uucauagucacauucgaugucu

SEQ ID NO: 197200 - RNA, 22 nt, Homo sapiens
uucaucaguuauauuggccuga

SEQ ID NO: 197201 - RNA, 21 nt, Homo sapiens
uucaucuggccguauuccagg

SEQ ID NO: 197202 - RNA, 22 nt, Homo sapiens
uucauggaauauugaccauuuu

SEQ ID NO: 197203 - RNA, 22 nt, Homo sapiens
uucauggacucaauaguuucgc

SEQ ID NO: 197204 - RNA, 22 nt, Homo sapiens
uucauggagccauccuuugauc

SEQ ID NO: 197205 - RNA, 22 nt, Homo sapiens
uucauggaguuuaaauuguagu

SEQ ID NO: 197206 - RNA, 22 nt, Homo sapiens
uucauggaugcauuugaggggu

SEQ ID NO: 197207 - RNA, 22 nt, Homo sapiens
uucauguagucaucauccugcu

SEQ ID NO: 197208 - RNA, 22 nt, Homo sapiens
uucaugucuuggcuguuagagu

SEQ ID NO: 197209 - RNA, 22 nt, Homo sapiens
uucauuggacuuguguucuuga

SEQ ID NO: 197210 - RNA, 22 nt, Homo sapiens
uuccacaaugguugaacuaauu

SEQ ID NO: 197211 - RNA, 22 nt, Homo sapiens
uuccacaaugguugaacuagcu

SEQ ID NO: 197212 - RNA, 22 nt, Homo sapiens
uuccacagggauuugcauugau

SEQ ID NO: 197213 - RNA, 23 nt, Homo sapiens
uuccaccauugacuaguuacaua

SEQ ID NO: 197214 - RNA, 22 nt, Homo sapiens
uuccaguauuugggcaagcgca

SEQ ID NO: 197215 - RNA, 22 nt, Homo sapiens
uuccaguguuugacucaccuuu

SEQ ID NO: 197216 - RNA, 22 nt, Homo sapiens
uuccauagucauagugcugaug

SEQ ID NO: 197217 - RNA, 22 nt, Homo sapiens
uuccaugugggcuugucaagua

SEQ ID NO: 197218 - RNA, 22 nt, Homo sapiens
uuccauugugucaucuuggugg

SEQ ID NO: 197219 - RNA, 22 nt, Homo sapiens
uucccagagaaaaggguuucuu

SEQ ID NO: 197220 - RNA, 22 nt, Homo sapiens
uucccagucaaacgaaggacuu

SEQ ID NO: 197221 - RNA, 22 nt, Homo sapiens
uuccuagagauuagcaagcugc

SEQ ID NO: 197222 - RNA, 19 nt, Homo sapiens
uuccugagaacaagggcuu

SEQ ID NO: 197223 - RNA, 22 nt, Homo sapiens
uuccugagaucagaauucaaau

SEQ ID NO: 197224 - RNA, 22 nt, Homo sapiens
uuccugagccuuguaucuagua

SEQ ID NO: 197225 - RNA, 22 nt, Homo sapiens
uuccuguagcgauuuuaguaau

SEQ ID NO: 197226 - RNA, 20 nt, Homo sapiens
uuccuuaggcauuggaagaa

SEQ ID NO: 197227 - RNA, 22 nt, Homo sapiens
uuccuuguagcaaaugcgauga

SEQ ID NO: 197228 - RNA, 22 nt, Homo sapiens
uucuaaacaucuuacaaugcau

SEQ ID NO: 197229 - RNA, 20 nt, Homo sapiens
uucuacagucacaggaagau

SEQ ID NO: 197230 - RNA, 21 nt, Homo sapiens
uucucagaggcaggggauaaa

SEQ ID NO: 197231 - RNA, 22 nt, Homo sapiens
uucucagugcuaucuuuuaugc

SEQ ID NO: 197232 - RNA, 22 nt, Homo sapiens
uucucauggaacaucuguacug

SEQ ID NO: 197233 - RNA, 22 nt, Homo sapiens
uucugagguuauauucucucaa

SEQ ID NO: 197234 - RNA, 22 nt, Homo sapiens
uguggaaauaaaagaaagguua

SEQ ID NO: 197235 - RNA, 22 nt, Homo sapiens
uguggcuuuguaaccauggguc

SEQ ID NO: 197236 - RNA, 22 nt, Homo sapiens
uguguaaauagcuacggaucug

SEQ ID NO: 197237 - RNA, 22 nt, Homo sapiens
uguguaauaccuuugacuauau

SEQ ID NO: 197238 - RNA, 22 nt, Homo sapiens
ugugucacugaggguuagugua

SEQ ID NO: 197239 - RNA, 22 nt, Homo sapiens
ugugucuuguuuuuucccaggc

SEQ ID NO: 197240 - RNA, 22 nt, Homo sapiens
ugugucuuuuaucacacaaugu

SEQ ID NO: 197241 - RNA, 22 nt, Homo sapiens
uguguuugauaaguccauaguu

SEQ ID NO: 197242 - RNA, 22 nt, Homo sapiens
uguuaacauggucucagucugu

SEQ ID NO: 197243 - RNA, 22 nt, Homo sapiens
uguuaaggcagagauaauacau

SEQ ID NO: 197244 - RNA, 22 nt, Homo sapiens
uguuacagcagcacaaaaugga

SEQ ID NO: 197245 - RNA, 22 nt, Homo sapiens
uguuauguuguuugagaaaguc

SEQ ID NO: 197246 - RNA, 22 nt, Homo sapiens
uguucaauucccaccuaugagu

SEQ ID NO: 197247 - RNA, 22 nt, Homo sapiens
uguucuugagccuuuagaccua

SEQ ID NO: 197248 - RNA, 22 nt, Homo sapiens
uguugcuuaagccacccagucu

SEQ ID NO: 197249 - RNA, 22 nt, Homo sapiens
uguuuuggagguccucacuaga

SEQ ID NO: 197250 - RNA, 22 nt, Homo sapiens
uguuuuguuagcacucugggaa

SEQ ID NO: 197251 - RNA, 22 nt, Homo sapiens
uuaaaguaauugaaauggccuu

SEQ ID NO: 197252 - RNA, 22 nt, Homo sapiens
uuaaauacagcaugguguuucu

SEQ ID NO: 197253 - RNA, 22 nt, Homo sapiens
uuaagugcucaguuacucaguu

SEQ ID NO: 197254 - RNA, 21 nt, Homo sapiens
uuaagugcuuuguaugcacua

SEQ ID NO: 197255 - RNA, 22 nt, Homo sapiens
uuaaguuguagcuacaaauaca

SEQ ID NO: 197256 - RNA, 22 nt, Homo sapiens
uuaaugaacuuuauuuuguaga

SEQ ID NO: 197257 - RNA, 22 nt, Homo sapiens
uuaauguaauugauugauugac

SEQ ID NO: 197258 - RNA, 22 nt, Homo sapiens
uuacaggacuaagcagcuuugc

SEQ ID NO: 197259 - RNA, 22 nt, Homo sapiens
uuaccagucugauaaacagaaa

SEQ ID NO: 197260 - RNA, 22 nt, Homo sapiens
uuaccuuuuuaagacagguuag

SEQ ID NO: 197261 - RNA, 22 nt, Homo sapiens
uuacugcuagcugugugcucuu

SEQ ID NO: 197262 - RNA, 22 nt, Homo sapiens
uuacuguagugucauaucguau

SEQ ID NO: 197263 - RNA, 22 nt, Homo sapiens
uuagaugaaugucucuuaaaca

SEQ ID NO: 197264 - RNA, 22 nt, Homo sapiens
uuagcaauagccugcaucugca

SEQ ID NO: 197265 - RNA, 22 nt, Homo sapiens
uuagcacaguucauucauguua

SEQ ID NO: 197266 - RNA, 22 nt, Homo sapiens
uuagcacaucuuucuauguaag

SEQ ID NO: 197267 - RNA, 22 nt, Homo sapiens
uuagcagcucuggugacaaggu

SEQ ID NO: 197268 - RNA, 21 nt, Homo sapiens
uuagcauccauguucaucaac

SEQ ID NO: 197269 - RNA, 22 nt, Homo sapiens
uuaggcuuuuuaaccaguuguu

SEQ ID NO: 197270 - RNA, 22 nt, Homo sapiens
uuagguauuuuguuaugucagc

SEQ ID NO: 197271 - RNA, 22 nt, Homo sapiens
uuaguagcacagaguaucagca

SEQ ID NO: 197272 - RNA, 22 nt, Homo sapiens
uuaguaguagcugcaugucagu

SEQ ID NO: 197273 - RNA, 22 nt, Homo sapiens
uuaguaguaguuugcauuuacc

SEQ ID NO: 197274 - RNA, 21 nt, Homo sapiens
uuagugcucaguuugacaaaa

SEQ ID NO: 197275 - RNA, 22 nt, Homo sapiens
uucugcuagucugucagaucuu

SEQ ID NO: 197276 - RNA, 22 nt, Homo sapiens
uucuggaaaucagcagagggug

SEQ ID NO: 197277 - RNA, 22 nt, Homo sapiens
uucuggcuuauaaacgugacuu

SEQ ID NO: 197278 - RNA, 22 nt, Homo sapiens
uucugugcuuguggaugaagug

SEQ ID NO: 197279 - RNA, 22 nt, Homo sapiens
uucuuagucaaguuguauuuca

SEQ ID NO: 197280 - RNA, 21 nt, Homo sapiens
uucuucaggcagaaggauuau

SEQ ID NO: 197281 - RNA, 22 nt, Homo sapiens
uucuucaggcauucccagaagc

SEQ ID NO: 197282 - RNA, 22 nt, Homo sapiens
uucuucaggccacaaaaauggu

SEQ ID NO: 197283 - RNA, 22 nt, Homo sapiens
uucuuccagccuugaggggccc

SEQ ID NO: 197284 - RNA, 22 nt, Homo sapiens
uucuugcacuuaacugacauuc

SEQ ID NO: 197285 - RNA, 22 nt, Homo sapiens
uucuuugcuuggaagcggggga

SEQ ID NO: 197286 - RNA, 22 nt, Homo sapiens
uucuuuggaaacaguacuaauu

SEQ ID NO: 197287 - RNA, 22 nt, Homo sapiens
uugaaagacagaggggcaaguu

SEQ ID NO: 197288 - RNA, 22 nt, Homo sapiens
uugaaagucauuucuucuaagu

SEQ ID NO: 197289 - RNA, 22 nt, Homo sapiens
uugaaaucuuccacagcccaag

SEQ ID NO: 197290 - RNA, 22 nt, Homo sapiens
uugaaccauucuuuugauagag

SEQ ID NO: 197291 - RNA, 22 nt, Homo sapiens
uugaaguauagaguuuaagaac

SEQ ID NO: 197292 - RNA, 22 nt, Homo sapiens
uugaauagaagguuuuuuguuc

SEQ ID NO: 197293 - RNA, 22 nt, Homo sapiens
uugaauaggcucaugcuuauca

SEQ ID NO: 197294 - RNA, 17 nt, Homo sapiens
uugaaugcauuacuugg

SEQ ID NO: 197295 - RNA, 22 nt, Homo sapiens
uugaaugcguuguguggcccgu

SEQ ID NO: 197296 - RNA, 22 nt, Homo sapiens
uugaccacugggcacaguaagu

SEQ ID NO: 197297 - RNA, 22 nt, Homo sapiens
uugaccuggagaguacuuugac

SEQ ID NO: 197298 - RNA, 22 nt, Homo sapiens
uugacuucagagcugauucaag

SEQ ID NO: 197299 - RNA, 22 nt, Homo sapiens
uugagagaaaaggccaugccuu

SEQ ID NO: 197300 - RNA, 22 nt, Homo sapiens
uugagauagggucuaccucugu

SEQ ID NO: 197301 - RNA, 22 nt, Homo sapiens
uugagaucaugcuacugcacuc

SEQ ID NO: 197302 - RNA, 22 nt, Homo sapiens
uugagaucugugcuuuugcguu

SEQ ID NO: 197303 - RNA, 22 nt, Homo sapiens
uugagaugaagucuugcucucu

SEQ ID NO: 197304 - RNA, 22 nt, Homo sapiens
uugagaugaaguuuugcucuuu

SEQ ID NO: 197305 - RNA, 22 nt, Homo sapiens
uugagauggagcuucacucuug

SEQ ID NO: 197306 - RNA, 22 nt, Homo sapiens
uugagauggagucucacuccuu

SEQ ID NO: 197307 - RNA, 22 nt, Homo sapiens
uugagauggagucucacucuuc

SEQ ID NO: 197308 - RNA, 22 nt, Homo sapiens
uugagauggagucucacucuuu

SEQ ID NO: 197309 - RNA, 22 nt, Homo sapiens
uugagauggagucucguucugu

SEQ ID NO: 197310 - RNA, 22 nt, Homo sapiens
uugagauggagucuugcucucu

SEQ ID NO: 197311 - RNA, 22 nt, Homo sapiens
uugagauggagucuugcucuug

SEQ ID NO: 197312 - RNA, 22 nt, Homo sapiens
uugagauggaguguugcucugu

SEQ ID NO: 197313 - RNA, 22 nt, Homo sapiens
cacugcgacguccgccucccgg

SEQ ID NO: 197314 - RNA, 22 nt, Homo sapiens
cacuggcacuguguuuagaugg

SEQ ID NO: 197315 - RNA, 22 nt, Homo sapiens
ccaguuuucucacuguugcagu

SEQ ID NO: 197316 - RNA, 22 nt, Homo sapiens
ccaucacacugugauuauuauc

SEQ ID NO: 197317 - RNA, 22 nt, Homo sapiens
ccauugaacaugaaggaaugug

SEQ ID NO: 197318 - RNA, 22 nt, Homo sapiens
cccagagacagaaugauaaacu

SEQ ID NO: 197319 - RNA, 22 nt, Homo sapiens
cccagaguucuuaaauacugag

SEQ ID NO: 197320 - RNA, 22 nt, Homo sapiens
ccccauguucucucugcagcuc

SEQ ID NO: 197321 - RNA, 22 nt, Homo sapiens
cauugcacuccagccugaggga

SEQ ID NO: 197322 - RNA, 22 nt, Homo sapiens
cauugcacuccagccugcacga

SEQ ID NO: 197323 - RNA, 22 nt, Homo sapiens
cauugcacuccagccugccugg

SEQ ID NO: 197324 - RNA, 20 nt, Homo sapiens
cauugcacuccagcuugggc

SEQ ID NO: 197325 - RNA, 22 nt, Homo sapiens
cauugcacuccagucugggcaa

SEQ ID NO: 197326 - RNA, 22 nt, Homo sapiens
cauugcacuccaucccgggaaa

SEQ ID NO: 197327 - RNA, 22 nt, Homo sapiens
cauugcacuccaucuugggcaa

SEQ ID NO: 197328 - RNA, 22 nt, Homo sapiens
cauugcacucuagccucggcaa

SEQ ID NO: 197329 - RNA, 22 nt, Homo sapiens
cauugcacugcagcccgggcaa

SEQ ID NO: 197330 - RNA, 20 nt, Homo sapiens
cauugcccuccagccugggc

SEQ ID NO: 197331 - RNA, 22 nt, Homo sapiens
cauugcuaaaagucauauauaa

SEQ ID NO: 197332 - RNA, 19 nt, Homo sapiens
cauuggacuugcuuuugcc

SEQ ID NO: 197333 - RNA, 22 nt, Homo sapiens
cauugucccucaaugacuauga

SEQ ID NO: 197334 - RNA, 22 nt, Homo sapiens
cauuuugguuaaauagguagcu

SEQ ID NO: 197335 - RNA, 22 nt, Homo sapiens
ccaaggaauacccucccuuuuu

SEQ ID NO: 197336 - RNA, 22 nt, Homo sapiens
ccaaguguuuucauuguuccau

SEQ ID NO: 197337 - RNA, 22 nt, Homo sapiens
ccacaguugaaauuuugacugu

SEQ ID NO: 197338 - RNA, 22 nt, Homo sapiens
ccagugcugugcaguguaugag

SEQ ID NO: 197339 - RNA, 20 nt, Homo sapiens
ccaguguuauuuauguucua

SEQ ID NO: 197340 - RNA, 22 nt, Homo sapiens
ccaugaacuagaauagaacaug

SEQ ID NO: 197341 - RNA, 22 nt, Homo sapiens
ccauggcuucugcauucuguca

SEQ ID NO: 197342 - RNA, 23 nt, Homo sapiens
ccauugcacuccagccucaguga

SEQ ID NO: 197343 - RNA, 22 nt, Homo sapiens
cccagugugcugggugacagcu

SEQ ID NO: 197344 - RNA, 22 nt, Homo sapiens
cccaguguuacgugacagccug

SEQ ID NO: 197345 - RNA, 20 nt, Homo sapiens
ccccuggaguggggcugcuu

SEQ ID NO: 197346 - RNA, 22 nt, Homo sapiens
cccugacauucggagauguagu

SEQ ID NO: 197347 - RNA, 22 nt, Homo sapiens
cccugagaugugaauuucagag

SEQ ID NO: 197348 - RNA, 22 nt, Homo sapiens
cccuguguuuagcugaagguuu

SEQ ID NO: 197349 - RNA, 22 nt, Homo sapiens
ccucaguguuuaucauuauuuu

SEQ ID NO: 197350 - RNA, 21 nt, Homo sapiens
ccucuuugagggaagaaaggg

SEQ ID NO: 197351 - RNA, 22 nt, Homo sapiens
ccucuuuguugagacuucacca

SEQ ID NO: 197352 - RNA, 22 nt, Homo sapiens
ccugagaucauacuguuaguaa

SEQ ID NO: 197353 - RNA, 19 nt, Homo sapiens
ccugcuguucuuuugcacc

SEQ ID NO: 197354 - RNA, 22 nt, Homo sapiens
ccuggaucauugucauucccaa

SEQ ID NO: 197355 - RNA, 22 nt, Homo sapiens
ccugucuugaagagauccuccu

SEQ ID NO: 197356 - RNA, 22 nt, Homo sapiens
ccugucuugauuaaauuacuua

SEQ ID NO: 197357 - RNA, 22 nt, Homo sapiens
ccuguguuaugguuucuaaugu

SEQ ID NO: 197358 - RNA, 22 nt, Homo sapiens
ccuucauucauuaauuuagccc

SEQ ID NO: 197359 - RNA, 22 nt, Homo sapiens
ccuucuuuuguaaggcugaaua

SEQ ID NO: 197360 - RNA, 22 nt, Homo sapiens
ccuugcacuucccaggugaggc

SEQ ID NO: 197361 - RNA, 22 nt, Homo sapiens
ccuuggcacuuugccacagugc

SEQ ID NO: 197362 - RNA, 22 nt, Homo sapiens
ccuuuguuuaguugaauuguau

SEQ ID NO: 197363 - RNA, 22 nt, Homo sapiens
cgccugagcugaggaagcugca

SEQ ID NO: 197364 - RNA, 22 nt, Homo sapiens
cgugaggaaaacagaggguguu

SEQ ID NO: 197365 - RNA, 22 nt, Homo sapiens
cuaaaacuuucugagugcagca

SEQ ID NO: 197366 - RNA, 22 nt, Homo sapiens
cuaaaguagccaggacugcagg

SEQ ID NO: 197367 - RNA, 22 nt, Homo sapiens
cuaaagugcuuaaaaucucauu

SEQ ID NO: 197368 - RNA, 22 nt, Homo sapiens
cuaacacagagguuuauuucuc

SEQ ID NO: 197369 - RNA, 18 nt, Homo sapiens
cuaauacuauucaacaag

SEQ ID NO: 197370 - RNA, 22 nt, Homo sapiens
cuaaucuagccuuauaaguauu

SEQ ID NO: 197371 - RNA, 21 nt, Homo sapiens
cuaaucucacccuuuucuggg

SEQ ID NO: 197372 - RNA, 22 nt, Homo sapiens
cuaauucuggccaaagggauaa

SEQ ID NO: 197373 - RNA, 22 nt, Homo sapiens
cuacaguaugaaaccuuuacuc

SEQ ID NO: 197374 - RNA, 22 nt, Homo sapiens
cuacucuggagagugacaauca

SEQ ID NO: 197375 - RNA, 22 nt, Homo sapiens
cuacugcacaucaucugaguua

SEQ ID NO: 197376 - RNA, 22 nt, Homo sapiens
cuagagagaagcugugugaccu

SEQ ID NO: 197377 - RNA, 22 nt, Homo sapiens
cuagaguguaguuuucuuagga

SEQ ID NO: 197378 - RNA, 22 nt, Homo sapiens
cuagcagacaugggcugaacca

SEQ ID NO: 197379 - RNA, 22 nt, Homo sapiens
aaaguaauugcaguuuuugcaa

SEQ ID NO: 197380 - RNA, 20 nt, Homo sapiens
aaaguaggcuaauaccaaaa

SEQ ID NO: 197381 - RNA, 22 nt, Homo sapiens
aaagucacuggagaaggaauau

SEQ ID NO: 197382 - RNA, 22 nt, Homo sapiens
aaagugcuaggauuaccugggg

SEQ ID NO: 197383 - RNA, 22 nt, Homo sapiens
aaagugcugagauuguaggcau

SEQ ID NO: 197384 - RNA, 19 nt, Homo sapiens
aaaguguuuuaaagaggau

SEQ ID NO: 197385 - RNA, 22 nt, Homo sapiens
aaaugcacaaagauuuugcacu

SEQ ID NO: 197386 - RNA, 22 nt, Homo sapiens
aaaugcaugaauaagcucgugu

SEQ ID NO: 197387 - RNA, 22 nt, Homo sapiens
aaaugccucccauucuacugac

SEQ ID NO: 197388 - RNA, 22 nt, Homo sapiens
aaaugcucucuacacguuucug

SEQ ID NO: 197389 - RNA, 22 nt, Homo sapiens
aaauucaucaaaugguuuguau

SEQ ID NO: 197390 - RNA, 22 nt, Homo sapiens
aaauucauuucagcucugggua

SEQ ID NO: 197391 - RNA, 18 nt, Homo sapiens
aaauucugucccuucuuc

SEQ ID NO: 197392 - RNA, 22 nt, Homo sapiens
aaauugcaguuaggaugauggu

SEQ ID NO: 197393 - RNA, 22 nt, Homo sapiens
aaauugcauugagcugcuuauu

SEQ ID NO: 197394 - RNA, 22 nt, Homo sapiens
aacaggcuccuaggggugcacc

SEQ ID NO: 197395 - RNA, 22 nt, Homo sapiens
aacaggguggugccugguccau

SEQ ID NO: 197396 - RNA, 22 nt, Homo sapiens
aacagugcauucagggauauau

SEQ ID NO: 197397 - RNA, 22 nt, Homo sapiens
aacagugcuguuauaaauguac

SEQ ID NO: 197398 - RNA, 22 nt, Homo sapiens
aacaucaaccaugaggguugga

SEQ ID NO: 197399 - RNA, 22 nt, Homo sapiens
aaccugaagaaaauauuugcug

SEQ ID NO: 197400 - RNA, 22 nt, Homo sapiens
aaccuuuagucagcucuuagga

SEQ ID NO: 197401 - RNA, 22 nt, Homo sapiens
aacuggcauagccagacuucuc

SEQ ID NO: 197402 - RNA, 22 nt, Homo sapiens
aacuggcauauucugguugcgg

SEQ ID NO: 197403 - RNA, 22 nt, Homo sapiens
aacugggcaagcauuacauggu

SEQ ID NO: 197404 - RNA, 22 nt, Homo sapiens
aacuggucuuaugcaagcacua

SEQ ID NO: 197405 - RNA, 21 nt, Homo sapiens
aagaaagcuggacuugccgcu

SEQ ID NO: 197406 - RNA, 22 nt, Homo sapiens
aagaccuaugcaggaagaaaug

SEQ ID NO: 197407 - RNA, 22 nt, Homo sapiens
aagagaugaagguccugacugu

SEQ ID NO: 197408 - RNA, 22 nt, Homo sapiens
aagagcucucuguagcauguga

SEQ ID NO: 197409 - RNA, 22 nt, Homo sapiens
aagagguagaagcuugccuucu

SEQ ID NO: 197410 - RNA, 22 nt, Homo sapiens
aagagguaggaaauggucauuu

SEQ ID NO: 197411 - RNA, 22 nt, Homo sapiens
aagagugucuuugugcuggccc

SEQ ID NO: 197412 - RNA, 22 nt, Homo sapiens
aagaucaucauagagggcauga

SEQ ID NO: 197413 - RNA, 22 nt, Homo sapiens
aagaugcagucauacuggagua

SEQ ID NO: 197414 - RNA, 22 nt, Homo sapiens
aagaugguauuucauuaguuuu

SEQ ID NO: 197415 - RNA, 22 nt, Homo sapiens
aagcaccaauaggagauuuguc

SEQ ID NO: 197416 - RNA, 22 nt, Homo sapiens
aagcaggugaugagugggugug

SEQ ID NO: 197417 - RNA, 20 nt, Homo sapiens
aagcauggguuuuaggguca

SEQ ID NO: 197418 - RNA, 22 nt, Homo sapiens
aagcccauuguaaguugaggag

SEQ ID NO: 197419 - RNA, 22 nt, Homo sapiens
aagcuggagugcaguggugcaa

SEQ ID NO: 197420 - RNA, 22 nt, Homo sapiens
aagcuguguguaagcucucaca

SEQ ID NO: 197421 - RNA, 22 nt, Homo sapiens
aaggagcaguggacggguccua

SEQ ID NO: 197422 - RNA, 22 nt, Homo sapiens
aaggaguagacaacauggcgcc

SEQ ID NO: 197423 - RNA, 22 nt, Homo sapiens
aaggaguaucuguuuucucacc

SEQ ID NO: 197424 - RNA, 22 nt, Homo sapiens
aaggcacugaacuuaaauucug

SEQ ID NO: 197425 - RNA, 22 nt, Homo sapiens
aaggcaguggcagaagauguca

SEQ ID NO: 197426 - RNA, 22 nt, Homo sapiens
aaggcaugcaguacguuucuau

SEQ ID NO: 197427 - RNA, 22 nt, Homo sapiens
aauccaugugcuuuaccauuuu

SEQ ID NO: 197428 - RNA, 22 nt, Homo sapiens
aaucucagagauaucugugucc

SEQ ID NO: 197429 - RNA, 22 nt, Homo sapiens
aauggcacuuuauaaauguuaa

SEQ ID NO: 197430 - RNA, 22 nt, Homo sapiens
aauggcuuuuaauauccauaau

SEQ ID NO: 197431 - RNA, 22 nt, Homo sapiens
aauuacauggcaauugggaaau

SEQ ID NO: 197432 - RNA, 22 nt, Homo sapiens
aauuaguaaccuaauuccaucu

SEQ ID NO: 197433 - RNA, 22 nt, Homo sapiens
aauuaguuggcugccuaugauu

SEQ ID NO: 197434 - RNA, 22 nt, Homo sapiens
aauugaaugauaugggacauuu

SEQ ID NO: 197435 - RNA, 22 nt, Homo sapiens
aauugcaauggacaaugcagca

SEQ ID NO: 197436 - RNA, 22 nt, Homo sapiens
aauugcauugaauuuguagcuu

SEQ ID NO: 197437 - RNA, 22 nt, Homo sapiens
aauuguacucccauaauucccu

SEQ ID NO: 197438 - RNA, 22 nt, Homo sapiens
aauugugcuuguaggccaggca

SEQ ID NO: 197439 - RNA, 22 nt, Homo sapiens
acaaagugccuccuuuuagagu

SEQ ID NO: 197440 - RNA, 22 nt, Homo sapiens
acacaguauaugacaaugcuuu

SEQ ID NO: 197441 - RNA, 22 nt, Homo sapiens
acacagucaaauccacuuggcu

SEQ ID NO: 197442 - RNA, 22 nt, Homo sapiens
acacagugucuguguauuuaaa

SEQ ID NO: 197443 - RNA, 22 nt, Homo sapiens
acacuggaggagagcuguugcu

SEQ ID NO: 197444 - RNA, 22 nt, Homo sapiens
acacuguacuuauguuuugcag

SEQ ID NO: 197445 - RNA, 22 nt, Homo sapiens
acacuguuuuguggagaaugua

SEQ ID NO: 197446 - RNA, 22 nt, Homo sapiens
acacuuucuagacaagggaaua

SEQ ID NO: 197447 - RNA, 19 nt, Homo sapiens
acagcugguuuugguuucu

SEQ ID NO: 197448 - RNA, 22 nt, Homo sapiens
acaggagugggauuugaguccu

SEQ ID NO: 197449 - RNA, 22 nt, Homo sapiens
acagugcugucugcuuuggcua

SEQ ID NO: 197450 - RNA, 22 nt, Homo sapiens
acagugcuuucaauguucagua

SEQ ID NO: 197451 - RNA, 22 nt, Homo sapiens
acaguguacaauagccuuuuaa

SEQ ID NO: 197452 - RNA, 22 nt, Homo sapiens
acagugucaugucguguucccc

SEQ ID NO: 197453 - RNA, 22 nt, Homo sapiens
acaucauugggggcuacaggug

SEQ ID NO: 197454 - RNA, 18 nt, Homo sapiens
acaucccaugcuggggug

SEQ ID NO: 197455 - RNA, 22 nt, Homo sapiens
acaugcauauguuggaagaaag

SEQ ID NO: 197456 - RNA, 22 nt, Homo sapiens
acauggcacugcgggcuucuug

SEQ ID NO: 197457 - RNA, 21 nt, Homo sapiens
acauguacacauguaugcaca

SEQ ID NO: 197458 - RNA, 22 nt, Homo sapiens
accaguuuuuuauacaucuucu

SEQ ID NO: 197459 - RNA, 22 nt, Homo sapiens
accaugcaguccaauaugcaca

SEQ ID NO: 197460 - RNA, 22 nt, Homo sapiens
acccagaagucauucaggaaca

SEQ ID NO: 197461 - RNA, 17 nt, Homo sapiens
acccagucuuuuugcac

SEQ ID NO: 197462 - RNA, 22 nt, Homo sapiens
acccaguguugggcagaacugu

SEQ ID NO: 197463 - RNA, 22 nt, Homo sapiens
acccgggaggcaggagucauag

SEQ ID NO: 197464 - RNA, 22 nt, Homo sapiens
acccuacauaguagauccuaca

SEQ ID NO: 197465 - RNA, 22 nt, Homo sapiens
acccuggagagugcuguaguaa

SEQ ID NO: 197466 - RNA, 22 nt, Homo sapiens
acccuggauucguggccuugaa

SEQ ID NO: 197467 - RNA, 22 nt, Homo sapiens
acccugguagcuaugaagucuu

SEQ ID NO: 197468 - RNA, 19 nt, Homo sapiens
acccuguccccaccuuuac

SEQ ID NO: 197469 - RNA, 22 nt, Homo sapiens
acgcagcacauucacagcuaug

SEQ ID NO: 197470 - RNA, 22 nt, Homo sapiens
acuauacugaagcaaauuaaca

SEQ ID NO: 197471 - RNA, 22 nt, Homo sapiens
aaguguaugaaacaguccaugg

SEQ ID NO: 197472 - RNA, 22 nt, Homo sapiens
aaguugcuuuagguaagucaau

SEQ ID NO: 197473 - RNA, 22 nt, Homo sapiens
aauaaagcaggguccuugcacu

SEQ ID NO: 197474 - RNA, 22 nt, Homo sapiens
aauaaagcauggcuacuccaua

SEQ ID NO: 197475 - RNA, 22 nt, Homo sapiens
aauaaagcugaauccuuccuga

SEQ ID NO: 197476 - RNA, 20 nt, Homo sapiens
aauaacagccccagggaggu

SEQ ID NO: 197477 - RNA, 22 nt, Homo sapiens
aauaagcauaguaccugauagg

SEQ ID NO: 197478 - RNA, 22 nt, Homo sapiens
aauaagcugagagaauucuaca

SEQ ID NO: 197479 - RNA, 22 nt, Homo sapiens
aauaauggcaccaaagcacaag

SEQ ID NO: 197480 - RNA, 22 nt, Homo sapiens
aauaaugucacaggggguuagc

SEQ ID NO: 197481 - RNA, 21 nt, Homo sapiens
aauacucuagguuaagagagc

SEQ ID NO: 197482 - RNA, 22 nt, Homo sapiens
aauacuggcacugaagaccaug

SEQ ID NO: 197483 - RNA, 22 nt, Homo sapiens
aauacuuccaaaucuagucauu

SEQ ID NO: 197484 - RNA, 22 nt, Homo sapiens
aauagugcugugcagugagugg

SEQ ID NO: 197485 - RNA, 22 nt, Homo sapiens
aauauguccaguguuuugggag

SEQ ID NO: 197486 - RNA, 22 nt, Homo sapiens
aauaugucugcuaauuguuucu

SEQ ID NO: 197487 - RNA, 22 nt, Homo sapiens
aauaugucuugaaauuggguaa

SEQ ID NO: 197488 - RNA, 19 nt, Homo sapiens
aauauugacaguggugucu

SEQ ID NO: 197489 - RNA, 22 nt, Homo sapiens
aaucaacauuguuuuaagucaa

SEQ ID NO: 197490 - RNA, 21 nt, Homo sapiens
aaucacaguuguucugccuuc

SEQ ID NO: 197491 - RNA, 22 nt, Homo sapiens
aaucccauuucucuguguuuuu

SEQ ID NO: 197492 - RNA, 22 nt, Homo sapiens
aaucugauguuaucagcuuaag

SEQ ID NO: 197493 - RNA, 22 nt, Homo sapiens
aaugaaguuagauguugagaag

SEQ ID NO: 197494 - RNA, 22 nt, Homo sapiens
aaugcacauaaaauccuccagg

SEQ ID NO: 197495 - RNA, 22 nt, Homo sapiens
aaugcaucuagaaaggugaauu

SEQ ID NO: 197496 - RNA, 22 nt, Homo sapiens
aaugccaucagagaaaacucuu

SEQ ID NO: 197497 - RNA, 22 nt, Homo sapiens
aauggcaguagauggaugggua

SEQ ID NO: 197498 - RNA, 22 nt, Homo sapiens
aauggcuucuuauugugguuca

SEQ ID NO: 197499 - RNA, 22 nt, Homo sapiens
aaugucaucuucaguuguacag

SEQ ID NO: 197500 - RNA, 22 nt, Homo sapiens
aaugugcacuauuagggugaua

SEQ ID NO: 197501 - RNA, 22 nt, Homo sapiens
aauuacuucuacaccaaccuaa

SEQ ID NO: 197502 - RNA, 22 nt, Homo sapiens
aauuaguugaaagucugcuuuu

SEQ ID NO: 197503 - RNA, 22 nt, Homo sapiens
aauuaguuggcugggugcggug

SEQ ID NO: 197504 - RNA, 22 nt, Homo sapiens
aauucugugagauggugcagau

SEQ ID NO: 197505 - RNA, 22 nt, Homo sapiens
aauugaccuaaucugauuacug

SEQ ID NO: 197506 - RNA, 23 nt, Homo sapiens
aauugcacauuccuugcuggcag

SEQ ID NO: 197507 - RNA, 22 nt, Homo sapiens
aauugcaccaucuagaucaaga

SEQ ID NO: 197508 - RNA, 22 nt, Homo sapiens
aauugcacuaagcauaguccag

SEQ ID NO: 197509 - RNA, 22 nt, Homo sapiens
aauugcauaaaauucaacucug

SEQ ID NO: 197510 - RNA, 22 nt, Homo sapiens
acaaaguauggaauguuggugu

SEQ ID NO: 197511 - RNA, 22 nt, Homo sapiens
acaaaguguuuucugaaggccu

SEQ ID NO: 197512 - RNA, 20 nt, Homo sapiens
acaaaugcauucugugacau

SEQ ID NO: 197513 - RNA, 22 nt, Homo sapiens
acaagcacaaaugcauagaugg

SEQ ID NO: 197514 - RNA, 22 nt, Homo sapiens
acacaguaagcacaguguagau

SEQ ID NO: 197515 - RNA, 22 nt, Homo sapiens
acacaugugcguagacucuuua

SEQ ID NO: 197516 - RNA, 22 nt, Homo sapiens
acacugcugaguaaauaauuuu

SEQ ID NO: 197517 - RNA, 20 nt, Homo sapiens
acacuggaguaucaaggccc

SEQ ID NO: 197518 - RNA, 22 nt, Homo sapiens
acacuggguaacauaucuguua

SEQ ID NO: 197519 - RNA, 20 nt, Homo sapiens
acagcacugguuucaagcaa

SEQ ID NO: 197520 - RNA, 22 nt, Homo sapiens
uugaggacugcuaagcauuuga

SEQ ID NO: 197521 - RNA, 22 nt, Homo sapiens
uugaggaggcagucucuccauu

SEQ ID NO: 197522 - RNA, 22 nt, Homo sapiens
uugaggcuuuugaccucaugug

SEQ ID NO: 197523 - RNA, 22 nt, Homo sapiens
uugagggaagccagaggucugc

SEQ ID NO: 197524 - RNA, 22 nt, Homo sapiens
uugagggagccuguuagucccg

SEQ ID NO: 197525 - RNA, 20 nt, Homo sapiens
uugaggucaggaguuuggga

SEQ ID NO: 197526 - RNA, 22 nt, Homo sapiens
uugaggucuuugagcaaacgca

SEQ ID NO: 197527 - RNA, 22 nt, Homo sapiens
uugaguagugugaugcaugucu

SEQ ID NO: 197528 - RNA, 22 nt, Homo sapiens
uugaguauuggacugguaucuu

SEQ ID NO: 197529 - RNA, 22 nt, Homo sapiens
uugauagguuuuauguauaguu

SEQ ID NO: 197530 - RNA, 22 nt, Homo sapiens
uugauaugaauggcuguuugug

SEQ ID NO: 197531 - RNA, 19 nt, Homo sapiens
uugauaugauuaggagcac

SEQ ID NO: 197532 - RNA, 22 nt, Homo sapiens
uugauaugguauaagauuucau

SEQ ID NO: 197533 - RNA, 22 nt, Homo sapiens
uugaucaauagaauacaacaga

SEQ ID NO: 197534 - RNA, 22 nt, Homo sapiens
uugauguccaucucuagguaaa

SEQ ID NO: 197535 - RNA, 22 nt, Homo sapiens
uugcaacuuagaaaaaucauuu

SEQ ID NO: 197536 - RNA, 22 nt, Homo sapiens
uugcacagucuagcuccaccuu

SEQ ID NO: 197537 - RNA, 22 nt, Homo sapiens
uugcacuauuaguauagauguc

SEQ ID NO: 197538 - RNA, 22 nt, Homo sapiens
uugcacuccagcucuaggugac

SEQ ID NO: 197539 - RNA, 18 nt, Homo sapiens
uugcacuccugccugggu

SEQ ID NO: 197540 - RNA, 20 nt, Homo sapiens
uugcagagcccaacccugga

SEQ ID NO: 197541 - RNA, 22 nt, Homo sapiens
uugcagcaaauaggaaugagga

SEQ ID NO: 197542 - RNA, 22 nt, Homo sapiens
uugcagcaacauggaugaaacu

SEQ ID NO: 197543 - RNA, 22 nt, Homo sapiens
uugcaguagucugaaagcaaua

SEQ ID NO: 197544 - RNA, 22 nt, Homo sapiens
uugcagugugacgacuauauuu

SEQ ID NO: 197545 - RNA, 23 nt, Homo sapiens
uugcauagacauccucauagauu

SEQ ID NO: 197546 - RNA, 19 nt, Homo sapiens
uugcauauguugaaccagc

SEQ ID NO: 197547 - RNA, 18 nt, Homo sapiens
uugcaucauuuuguuguu

SEQ ID NO: 197548 - RNA, 22 nt, Homo sapiens
uugccauggaguagaauugaag

SEQ ID NO: 197549 - RNA, 22 nt, Homo sapiens
uugcccuuuagguaacuauaua

SEQ ID NO: 197550 - RNA, 22 nt, Homo sapiens
uugccuaguuuaggucugugcu

SEQ ID NO: 197551 - RNA, 22 nt, Homo sapiens
uugcuacuuggauguacaugug

SEQ ID NO: 197552 - RNA, 22 nt, Homo sapiens
uugcuauguugcccagucugga

SEQ ID NO: 197553 - RNA, 22 nt, Homo sapiens
uuggaaacauuuaugguaacag

SEQ ID NO: 197554 - RNA, 22 nt, Homo sapiens
uuggaaaguuguuguaguuauu

SEQ ID NO: 197555 - RNA, 22 nt, Homo sapiens
uuggaagacauucugucugcua

SEQ ID NO: 197556 - RNA, 22 nt, Homo sapiens
uuggaagauuacuuaguuuucu

SEQ ID NO: 197557 - RNA, 22 nt, Homo sapiens
uuggaaugcaacagaaggauaa

SEQ ID NO: 197558 - RNA, 22 nt, Homo sapiens
uuggacuacagauuacuucauc

SEQ ID NO: 197559 - RNA, 22 nt, Homo sapiens
uuggacuuuaagauagagaugu

SEQ ID NO: 197560 - RNA, 22 nt, Homo sapiens
uuggagagugauauucagaugc

SEQ ID NO: 197561 - RNA, 22 nt, Homo sapiens
uuggcaagaaccuucuuccaag

SEQ ID NO: 197562 - RNA, 22 nt, Homo sapiens
uuggcaaucaauucugacgucu

SEQ ID NO: 197563 - RNA, 22 nt, Homo sapiens
uuggcagaguuaauuuguugag

SEQ ID NO: 197564 - RNA, 22 nt, Homo sapiens
uagagguauuaacaguagaaga

SEQ ID NO: 197565 - RNA, 22 nt, Homo sapiens
uagagguucuaagauucucaga

SEQ ID NO: 197566 - RNA, 22 nt, Homo sapiens
uagaguacucugguaaguucuu

SEQ ID NO: 197567 - RNA, 22 nt, Homo sapiens
uagaguguaaaccacauaguga

SEQ ID NO: 197568 - RNA, 20 nt, Homo sapiens
uagcacacauguagaauagu

SEQ ID NO: 197569 - RNA, 22 nt, Homo sapiens
uagcacagggaauugguucucu

SEQ ID NO: 197570 - RNA, 22 nt, Homo sapiens
uagcacuauguuaucacauacu

SEQ ID NO: 197571 - RNA, 22 nt, Homo sapiens
uagcagcaccccacucuacugg

SEQ ID NO: 197572 - RNA, 20 nt, Homo sapiens
uagcagcagacagagggagg

SEQ ID NO: 197573 - RNA, 22 nt, Homo sapiens
uagcaguaagaaacugacauug

SEQ ID NO: 197574 - RNA, 22 nt, Homo sapiens
uagcugguucuccaggagcuag

SEQ ID NO: 197575 - RNA, 22 nt, Homo sapiens
uaggagcacaaaccccauugug

SEQ ID NO: 197576 - RNA, 22 nt, Homo sapiens
uaggagcacagcagcauguggg

SEQ ID NO: 197577 - RNA, 22 nt, Homo sapiens
uucuuugguacaagggccgacc

SEQ ID NO: 197578 - RNA, 22 nt, Homo sapiens
uugaaagaaaggagacugaguu

SEQ ID NO: 197579 - RNA, 22 nt, Homo sapiens
uugaaagucuaggcuuacagua

SEQ ID NO: 197580 - RNA, 22 nt, Homo sapiens
uugaaauguuuagaaguuugga

SEQ ID NO: 197581 - RNA, 22 nt, Homo sapiens
uugaacugguaguuggaaaucu

SEQ ID NO: 197582 - RNA, 22 nt, Homo sapiens
uugaaggaacgcuguucccuug

SEQ ID NO: 197583 - RNA, 22 nt, Homo sapiens
uugaagguaauugguuuuauga

SEQ ID NO: 197584 - RNA, 22 nt, Homo sapiens
uugaaguguguauacauugugg

SEQ ID NO: 197585 - RNA, 22 nt, Homo sapiens
uugaauagcauguuuagugcau

SEQ ID NO: 197586 - RNA, 18 nt, Homo sapiens
uugaauaguguccaaucu

SEQ ID NO: 197587 - RNA, 18 nt, Homo sapiens
uugaaugcgucccagaga

SEQ ID NO: 197588 - RNA, 22 nt, Homo sapiens
uugacacuaauuauuauaggug

SEQ ID NO: 197589 - RNA, 22 nt, Homo sapiens
uugacauauguguguccacaua

SEQ ID NO: 197590 - RNA, 21 nt, Homo sapiens
uugagacggagucucacucug

SEQ ID NO: 197591 - RNA, 22 nt, Homo sapiens
uugagacggagucucacucugu

SEQ ID NO: 197592 - RNA, 22 nt, Homo sapiens
uugagacggaguuuugcucuug

SEQ ID NO: 197593 - RNA, 22 nt, Homo sapiens
uugagagagaacauuuguuaca

SEQ ID NO: 197594 - RNA, 22 nt, Homo sapiens
uugagauacauaauuaugaaug

SEQ ID NO: 197595 - RNA, 22 nt, Homo sapiens
uugagauaggaacucacuaugc

SEQ ID NO: 197596 - RNA, 22 nt, Homo sapiens
uugagauaucuuggccuuugca

SEQ ID NO: 197597 - RNA, 22 nt, Homo sapiens
uugagauggagucucacugugu

SEQ ID NO: 197598 - RNA, 22 nt, Homo sapiens
uugagauggagucucgcacugu

SEQ ID NO: 197599 - RNA, 22 nt, Homo sapiens
uugagauggagucucgcucugu

SEQ ID NO: 197600 - RNA, 22 nt, Homo sapiens
uugagauggagucuuguucucu

SEQ ID NO: 197601 - RNA, 22 nt, Homo sapiens
uugagauggagucuuguucuuu

SEQ ID NO: 197602 - RNA, 22 nt, Homo sapiens
uugagauggaguucauuuuugu

SEQ ID NO: 197603 - RNA, 22 nt, Homo sapiens
uugagauggaguuucaauauug

SEQ ID NO: 197604 - RNA, 22 nt, Homo sapiens
uugagauggaguuucgcucuug

SEQ ID NO: 197605 - RNA, 22 nt, Homo sapiens
uugagauguaguuucacuccug

SEQ ID NO: 197606 - RNA, 22 nt, Homo sapiens
uugagauguauguauauaaugu

SEQ ID NO: 197607 - RNA, 22 nt, Homo sapiens
uugagauguggguuggugacuu

SEQ ID NO: 197608 - RNA, 22 nt, Homo sapiens
uugagcucaucuucagggguga

SEQ ID NO: 197609 - RNA, 22 nt, Homo sapiens
uugaggaagugguuccccagag

SEQ ID NO: 197610 - RNA, 22 nt, Homo sapiens
uguugcauuugucaaggucaag

SEQ ID NO: 197611 - RNA, 22 nt, Homo sapiens
uguuggacuuacuuggcagauu

SEQ ID NO: 197612 - RNA, 19 nt, Homo sapiens
uguuuggcuauaggucuaa

SEQ ID NO: 197613 - RNA, 22 nt, Homo sapiens
uuaaaguguuugcagacaggug

SEQ ID NO: 197614 - RNA, 20 nt, Homo sapiens
uuaaaucuagugcagacuca

SEQ ID NO: 197615 - RNA, 22 nt, Homo sapiens
uuaaaugcuagaauuuucuuug

SEQ ID NO: 197616 - RNA, 22 nt, Homo sapiens
uuaaaugucuguagaugugcug

SEQ ID NO: 197617 - RNA, 22 nt, Homo sapiens
uuaagaagugauuuuccucauu

SEQ ID NO: 197618 - RNA, 22 nt, Homo sapiens
uuaagagcauggugccagguug

SEQ ID NO: 197619 - RNA, 22 nt, Homo sapiens
uuaagcaaagguaacaugagaa

SEQ ID NO: 197620 - RNA, 22 nt, Homo sapiens
uuaaggaguagugucugguauu

SEQ ID NO: 197621 - RNA, 22 nt, Homo sapiens
uuaagguaugugggcauuuugu

SEQ ID NO: 197622 - RNA, 21 nt, Homo sapiens
uuaaguaauuacccaacucuc

SEQ ID NO: 197623 - RNA, 22 nt, Homo sapiens
uuaagugaauuaucuaacaugu

SEQ ID NO: 197624 - RNA, 20 nt, Homo sapiens
uuaagugcuuucugcuuaga

SEQ ID NO: 197625 - RNA, 22 nt, Homo sapiens
uuaaguuaggcuucagcagucu

SEQ ID NO: 197626 - RNA, 22 nt, Homo sapiens
uuaauacugcuuaacuuuagga

SEQ ID NO: 197627 - RNA, 22 nt, Homo sapiens
uuaauagcaaagaguuuagacu

SEQ ID NO: 197628 - RNA, 22 nt, Homo sapiens
uuaauagugacucauuuuccac

SEQ ID NO: 197629 - RNA, 22 nt, Homo sapiens
uuaauuguccaaguucaucucu

SEQ ID NO: 197630 - RNA, 19 nt, Homo sapiens
uuacacaaccuaguggggc

SEQ ID NO: 197631 - RNA, 22 nt, Homo sapiens
uuacacaguaggucccuaguaa

SEQ ID NO: 197632 - RNA, 22 nt, Homo sapiens
uuacaccuguaauccagcacuu

SEQ ID NO: 197633 - RNA, 22 nt, Homo sapiens
uuacagguggagaaguaaggcu

SEQ ID NO: 197634 - RNA, 22 nt, Homo sapiens
uuacagucaaguuacauuucuc

SEQ ID NO: 197635 - RNA, 23 nt, Homo sapiens
uuacaguggcaugaucucugcuc

SEQ ID NO: 197636 - RNA, 20 nt, Homo sapiens
uuacagugggaccuuccuga

SEQ ID NO: 197637 - RNA, 22 nt, Homo sapiens
uuacaguucugguggagaggua

SEQ ID NO: 197638 - RNA, 22 nt, Homo sapiens
uuacauugcuucaaauucagug

SEQ ID NO: 197639 - RNA, 22 nt, Homo sapiens
uuaccagucuagggcucaguuu

SEQ ID NO: 197640 - RNA, 22 nt, Homo sapiens
uuacccauuagagaauuuaaga

SEQ ID NO: 197641 - RNA, 22 nt, Homo sapiens
uuacuacucucuaugaccaguu

SEQ ID NO: 197642 - RNA, 22 nt, Homo sapiens
uuacuauguuucaaagugucuc

SEQ ID NO: 197643 - RNA, 20 nt, Homo sapiens
uuacuccuuaaugagguuuu

SEQ ID NO: 197644 - RNA, 22 nt, Homo sapiens
uuacugcuuaagugauucaaca

SEQ ID NO: 197645 - RNA, 22 nt, Homo sapiens
uuacuugagauggggugucacu

SEQ ID NO: 197646 - RNA, 22 nt, Homo sapiens
uuagaaaguagaaaagcugguu

SEQ ID NO: 197647 - RNA, 22 nt, Homo sapiens
uuugcuucacuguuuggcaaaa

SEQ ID NO: 197648 - RNA, 22 nt, Homo sapiens
uuugcuugaggucuagcuaccc

SEQ ID NO: 197649 - RNA, 22 nt, Homo sapiens
uuugcuuguguaaaaaucugga

SEQ ID NO: 197650 - RNA, 22 nt, Homo sapiens
uuuggcaauuugacuguauagg

SEQ ID NO: 197651 - RNA, 22 nt, Homo sapiens
uuuggcaugggcuauuugcuuu

SEQ ID NO: 197652 - RNA, 22 nt, Homo sapiens
uuuggcauuaagaugcuguauc

SEQ ID NO: 197653 - RNA, 23 nt, Homo sapiens
uuuggcauuccagaaauuuucau

SEQ ID NO: 197654 - RNA, 22 nt, Homo sapiens
uuuggcuuuuguaauaacugcc

SEQ ID NO: 197655 - RNA, 22 nt, Homo sapiens
uuugggaaaugaaguugguaga

SEQ ID NO: 197656 - RNA, 22 nt, Homo sapiens
uuugggaaugaguuuaucauuu

SEQ ID NO: 197657 - RNA, 22 nt, Homo sapiens
uuugggacuguauuaaaugccu

SEQ ID NO: 197658 - RNA, 22 nt, Homo sapiens
uuuggucuuuuauuuaaagcag

SEQ ID NO: 197659 - RNA, 22 nt, Homo sapiens
uuugguuuuuguuaucacucau

SEQ ID NO: 197660 - RNA, 22 nt, Homo sapiens
uuuguacacgugggugaauugu

SEQ ID NO: 197661 - RNA, 22 nt, Homo sapiens
uuuguacacuguugguaggauu

SEQ ID NO: 197662 - RNA, 22 nt, Homo sapiens
uuuguacacuguuggugguuau

SEQ ID NO: 197663 - RNA, 22 nt, Homo sapiens
uuuguacuccuuggccagcuuc

SEQ ID NO: 197664 - RNA, 22 nt, Homo sapiens
uuuguacuucauacaauaacuc

SEQ ID NO: 197665 - RNA, 22 nt, Homo sapiens
uuugucacccugaauguaagau

SEQ ID NO: 197666 - RNA, 22 nt, Homo sapiens
uuugucccccguaguucauaua

SEQ ID NO: 197667 - RNA, 22 nt, Homo sapiens
uuugugagguggauagauugca

SEQ ID NO: 197668 - RNA, 22 nt, Homo sapiens
uuugugcaaacuaggauugcga

SEQ ID NO: 197669 - RNA, 22 nt, Homo sapiens
auacuguacugaaguacccauu

SEQ ID NO: 197670 - RNA, 22 nt, Homo sapiens
auagagcuggcagacacccuua

SEQ ID NO: 197671 - RNA, 22 nt, Homo sapiens
auagcaaugcaagaauggcuua

SEQ ID NO: 197672 - RNA, 22 nt, Homo sapiens
auagcaaugccccaauccuugg

SEQ ID NO: 197673 - RNA, 22 nt, Homo sapiens
auagcagugccccaaacuccug

SEQ ID NO: 197674 - RNA, 22 nt, Homo sapiens
auagcauagucagcuucgcuga

SEQ ID NO: 197675 - RNA, 22 nt, Homo sapiens
auagcauaucccacaugucaga

SEQ ID NO: 197676 - RNA, 22 nt, Homo sapiens
auaggagcacgaacucuagugu

SEQ ID NO: 197677 - RNA, 22 nt, Homo sapiens
auaggcacauuaggaacuuuug

SEQ ID NO: 197678 - RNA, 21 nt, Homo sapiens
auagggcuuguugauaguuaa

SEQ ID NO: 197679 - RNA, 22 nt, Homo sapiens
auagguagcauagcaggaauau

SEQ ID NO: 197680 - RNA, 22 nt, Homo sapiens
auagguauuuuuaaaugacugu

SEQ ID NO: 197681 - RNA, 22 nt, Homo sapiens
auagugaacuuugugagaacaa

SEQ ID NO: 197682 - RNA, 22 nt, Homo sapiens
auagugcugcaauaaacacacg

SEQ ID NO: 197683 - RNA, 22 nt, Homo sapiens
auagugcugcaauaaacauacg

SEQ ID NO: 197684 - RNA, 22 nt, Homo sapiens
auagugcugcaaugaacauaca

SEQ ID NO: 197685 - RNA, 22 nt, Homo sapiens
auagugcuuuugaaucuuguug

SEQ ID NO: 197686 - RNA, 19 nt, Homo sapiens
auauaacauccaggagcag

SEQ ID NO: 197687 - RNA, 22 nt, Homo sapiens
auauaccuaggcuacaugguuu

SEQ ID NO: 197688 - RNA, 22 nt, Homo sapiens
auauagcaaugaaagagaugaa

SEQ ID NO: 197689 - RNA, 22 nt, Homo sapiens
auaucaaggccauuuucuaaau

SEQ ID NO: 197690 - RNA, 22 nt, Homo sapiens
auaucacaaacaagucuguacu

SEQ ID NO: 197691 - RNA, 22 nt, Homo sapiens
auaucacaggaaaggaagauac

SEQ ID NO: 197692 - RNA, 22 nt, Homo sapiens
auauccaugccauagguuuuga

SEQ ID NO: 197693 - RNA, 22 nt, Homo sapiens
auaucccuguauaagugaaugu

SEQ ID NO: 197694 - RNA, 22 nt, Homo sapiens
auauccuggagcauuuuugcaa

SEQ ID NO: 197695 - RNA, 22 nt, Homo sapiens
auaucugcauugccauuuaugu

SEQ ID NO: 197696 - RNA, 20 nt, Homo sapiens
auaugcauguguuuucacuu

SEQ ID NO: 197697 - RNA, 22 nt, Homo sapiens
auauggcuuuuauuauguugag

SEQ ID NO: 197698 - RNA, 22 nt, Homo sapiens
auauggguuuuauauuaggcuc

SEQ ID NO: 197699 - RNA, 22 nt, Homo sapiens
auaugguguuugcuauucagcu

SEQ ID NO: 197700 - RNA, 20 nt, Homo sapiens
auaugguugugagugauuuu

SEQ ID NO: 197701 - RNA, 22 nt, Homo sapiens
auauguaguuucagaaguggaa

SEQ ID NO: 197702 - RNA, 22 nt, Homo sapiens
auaugucuauuauuagggcagg

SEQ ID NO: 197703 - RNA, 22 nt, Homo sapiens
auauguucucauucauaugugg

SEQ ID NO: 197704 - RNA, 22 nt, Homo sapiens
auauucacagguaucagagauu

SEQ ID NO: 197705 - RNA, 22 nt, Homo sapiens
aucaaagugaaauauuaguuau

SEQ ID NO: 197706 - RNA, 22 nt, Homo sapiens
aucaagcuggcauauguaguuc

SEQ ID NO: 197707 - RNA, 22 nt, Homo sapiens
aucaagguaggacuugaacccu

SEQ ID NO: 197708 - RNA, 22 nt, Homo sapiens
aucaaguacuguacugaaagug

SEQ ID NO: 197709 - RNA, 22 nt, Homo sapiens
aucaaguaguuauacguaaagg

SEQ ID NO: 197710 - RNA, 22 nt, Homo sapiens
aucacauggccuagccuaaccu

SEQ ID NO: 197711 - RNA, 22 nt, Homo sapiens
aucacauuuauaguggcacgca

SEQ ID NO: 197712 - RNA, 22 nt, Homo sapiens
aucacuggccuuuuuaaaugcu

SEQ ID NO: 197713 - RNA, 22 nt, Homo sapiens
aucacugggcaagauaucauga

SEQ ID NO: 197714 - RNA, 22 nt, Homo sapiens
aucagaaucucuagaggacugu

SEQ ID NO: 197715 - RNA, 20 nt, Homo sapiens
aucagagacuaggauugcca

SEQ ID NO: 197716 - RNA, 22 nt, Homo sapiens
aucaggcacacauuggaguuug

SEQ ID NO: 197717 - RNA, 22 nt, Homo sapiens
aucagugauugauuuaaagacg

SEQ ID NO: 197718 - RNA, 22 nt, Homo sapiens
aucagugcauguuuguugagcu

SEQ ID NO: 197719 - RNA, 22 nt, Homo sapiens
aucaugcacaugcauagguaug

SEQ ID NO: 197720 - RNA, 22 nt, Homo sapiens
aucauguaguaagacacauuua

SEQ ID NO: 197721 - RNA, 22 nt, Homo sapiens
auccagaugggcuuaauguaau

SEQ ID NO: 197722 - RNA, 22 nt, Homo sapiens
aucccgagacuuugcugaaguu

SEQ ID NO: 197723 - RNA, 22 nt, Homo sapiens
aucccuguaguaauauucuagc

SEQ ID NO: 197724 - RNA, 22 nt, Homo sapiens
auccuguagucucacagcccca

SEQ ID NO: 197725 - RNA, 22 nt, Homo sapiens
auccuuuagacuguccaguuga

SEQ ID NO: 197726 - RNA, 22 nt, Homo sapiens
aucuacuugcugggucucugga

SEQ ID NO: 197727 - RNA, 21 nt, Homo sapiens
aucucacuugaauguaaaagc

SEQ ID NO: 197728 - RNA, 22 nt, Homo sapiens
aucucuugccagucagaauggu

SEQ ID NO: 197729 - RNA, 22 nt, Homo sapiens
aucugcauuagggugaagaccu

SEQ ID NO: 197730 - RNA, 22 nt, Homo sapiens
aucuggcuucuuuuaguccaca

SEQ ID NO: 197731 - RNA, 22 nt, Homo sapiens
aucugguguuuuucucccucgu

SEQ ID NO: 197732 - RNA, 22 nt, Homo sapiens
aucuuguccugagguuuuauug

SEQ ID NO: 197733 - RNA, 22 nt, Homo sapiens
aucuuguguugaauggugcaga

SEQ ID NO: 197734 - RNA, 22 nt, Homo sapiens
aucuuugcugagaugcauggca

SEQ ID NO: 197735 - RNA, 23 nt, Homo sapiens
augaaagcccuugcaaaugcugg

SEQ ID NO: 197736 - RNA, 22 nt, Homo sapiens
augaaauguaugagucuggguu

SEQ ID NO: 197737 - RNA, 17 nt, Homo sapiens
augaacucaucguucuu

SEQ ID NO: 197738 - RNA, 22 nt, Homo sapiens
augaagcuagcugauugcugau

SEQ ID NO: 197739 - RNA, 18 nt, Homo sapiens
augaagucaucacuuuua

SEQ ID NO: 197740 - RNA, 22 nt, Homo sapiens
augaagucguuacuaccaauug

SEQ ID NO: 197741 - RNA, 22 nt, Homo sapiens
augaagugcaugauaguugguu

SEQ ID NO: 197742 - RNA, 22 nt, Homo sapiens
gucugguuuuuuauauccucac

SEQ ID NO: 197743 - RNA, 22 nt, Homo sapiens
gucuuggagacauugccauuga

SEQ ID NO: 197744 - RNA, 22 nt, Homo sapiens
gucuuuaguugaaacauguggu

SEQ ID NO: 197745 - RNA, 22 nt, Homo sapiens
gucuuuggaaaaaaugucuguu

SEQ ID NO: 197746 - RNA, 17 nt, Homo sapiens
gucuuugguugaguuua

SEQ ID NO: 197747 - RNA, 22 nt, Homo sapiens
gugaaaagaugagcaccauaca

SEQ ID NO: 197748 - RNA, 22 nt, Homo sapiens
gugaaauacauaaucccaagug

SEQ ID NO: 197749 - RNA, 17 nt, Homo sapiens
gugaaaucaucauuuuu

SEQ ID NO: 197750 - RNA, 22 nt, Homo sapiens
gugaaaugaaucuggaaauauu

SEQ ID NO: 197751 - RNA, 22 nt, Homo sapiens
gugaacaagcaaaggcaggagg

SEQ ID NO: 197752 - RNA, 22 nt, Homo sapiens
gugacaguggagacuuacuuca

SEQ ID NO: 197753 - RNA, 22 nt, Homo sapiens
gugaccucauuacggggccugc

SEQ ID NO: 197754 - RNA, 22 nt, Homo sapiens
gugaccucuguugcugucacua

SEQ ID NO: 197755 - RNA, 22 nt, Homo sapiens
gugagaccaauguacuaccuuc

SEQ ID NO: 197756 - RNA, 22 nt, Homo sapiens
gugagauggagucuugcuuugu

SEQ ID NO: 197757 - RNA, 22 nt, Homo sapiens
gugagaugguaucucauugugg

SEQ ID NO: 197758 - RNA, 19 nt, Homo sapiens
gugagcaaugcauugcacu

SEQ ID NO: 197759 - RNA, 22 nt, Homo sapiens
gugagcauauuaguauugcacu

SEQ ID NO: 197760 - RNA, 22 nt, Homo sapiens
gugagggaugugaaaaagguca

SEQ ID NO: 197761 - RNA, 17 nt, Homo sapiens
gugagguauccucaaaa

SEQ ID NO: 197762 - RNA, 22 nt, Homo sapiens
gugaggucguagucauaggcaa

SEQ ID NO: 197763 - RNA, 22 nt, Homo sapiens
gugaguaaagguucauugaauu

SEQ ID NO: 197764 - RNA, 22 nt, Homo sapiens
gugagucaaucugagggguuca

SEQ ID NO: 197765 - RNA, 22 nt, Homo sapiens
gugagucaugucccaucugauu

SEQ ID NO: 197766 - RNA, 22 nt, Homo sapiens
gugauauguuaggaucuaaguc

SEQ ID NO: 197767 - RNA, 22 nt, Homo sapiens
gugcaauucacuguuaugucug

SEQ ID NO: 197768 - RNA, 21 nt, Homo sapiens
gugcagacacacauauaggcu

SEQ ID NO: 197769 - RNA, 21 nt, Homo sapiens
gugcagaugccacagucacuc

SEQ ID NO: 197770 - RNA, 22 nt, Homo sapiens
gugcaguguuugcauggaauca

SEQ ID NO: 197771 - RNA, 22 nt, Homo sapiens
gugcaguuuacaguuacccagu

SEQ ID NO: 197772 - RNA, 18 nt, Homo sapiens
gugcauagccauggcagc

SEQ ID NO: 197773 - RNA, 22 nt, Homo sapiens
gugcauauaaguuguuucuagu

SEQ ID NO: 197774 - RNA, 22 nt, Homo sapiens
gugcauaucugugguuggcuga

SEQ ID NO: 197775 - RNA, 22 nt, Homo sapiens
gugccacaguguuaagggauuc

SEQ ID NO: 197776 - RNA, 22 nt, Homo sapiens
gugccacugcacuccggccugg

SEQ ID NO: 197777 - RNA, 22 nt, Homo sapiens
gugcuauguuauccagcaagau

SEQ ID NO: 197778 - RNA, 16 nt, Homo sapiens
gugcuguguuguuagg

SEQ ID NO: 197779 - RNA, 22 nt, Homo sapiens
gugcuuguguuaauauguagcu

SEQ ID NO: 197780 - RNA, 22 nt, Homo sapiens
guggaagaccagacuuuccaac

SEQ ID NO: 197781 - RNA, 20 nt, Homo sapiens
guggaagauaaguagccuga

SEQ ID NO: 197782 - RNA, 22 nt, Homo sapiens
guggaaucuagagaggcaguag

SEQ ID NO: 197783 - RNA, 22 nt, Homo sapiens
guggagcuguguggccuugggc

SEQ ID NO: 197784 - RNA, 22 nt, Homo sapiens
guggagucaucacucagagugg

SEQ ID NO: 197785 - RNA, 22 nt, Homo sapiens
guggcagagucagagggaaaug

SEQ ID NO: 197786 - RNA, 22 nt, Homo sapiens
guggcaugaaagcaucugugau

SEQ ID NO: 197787 - RNA, 21 nt, Homo sapiens
guggccuuuggagcaugucag

SEQ ID NO: 197788 - RNA, 22 nt, Homo sapiens
gugggaugaucgcuugagccca

SEQ ID NO: 197789 - RNA, 22 nt, Homo sapiens
gugggauggaaaugggcuucag

SEQ ID NO: 197790 - RNA, 22 nt, Homo sapiens
gugggcucguucguguuagaca

SEQ ID NO: 197791 - RNA, 22 nt, Homo sapiens
guggucagaaaucucaguggca

SEQ ID NO: 197792 - RNA, 22 nt, Homo sapiens
gugguucuagaauugaguaucc

SEQ ID NO: 197793 - RNA, 21 nt, Homo sapiens
gugguucuagagaaacagaau

SEQ ID NO: 197794 - RNA, 22 nt, Homo sapiens
gugguucuagagggacagaaug

SEQ ID NO: 197795 - RNA, 22 nt, Homo sapiens
gugguuuuuaaaguaccugugg

SEQ ID NO: 197796 - RNA, 22 nt, Homo sapiens
gugguuuuuagauuucuacagu

SEQ ID NO: 197797 - RNA, 22 nt, Homo sapiens
guguaaaucugcugugaacauu

SEQ ID NO: 197798 - RNA, 22 nt, Homo sapiens
gugucacagcuuccaucucggu

SEQ ID NO: 197799 - RNA, 22 nt, Homo sapiens
gugucuccuguggagcuaugua

SEQ ID NO: 197800 - RNA, 22 nt, Homo sapiens
gugugacuagucaugccugaau

SEQ ID NO: 197801 - RNA, 22 nt, Homo sapiens
gugugcaaauguguaccuacau

SEQ ID NO: 197802 - RNA, 22 nt, Homo sapiens
gugugcaugucuuuuuaguagg

SEQ ID NO: 197803 - RNA, 22 nt, Homo sapiens
gugugucuugaccaggaucgga

SEQ ID NO: 197804 - RNA, 22 nt, Homo sapiens
guguucaaacccaggucugucu

SEQ ID NO: 197805 - RNA, 22 nt, Homo sapiens
guguucaaagcugauugagauu

SEQ ID NO: 197806 - RNA, 22 nt, Homo sapiens
guguucauggaauuugcaauug

SEQ ID NO: 197807 - RNA, 22 nt, Homo sapiens
guuacugucuuccugauugcuu

SEQ ID NO: 197808 - RNA, 22 nt, Homo sapiens
guuagugcuuauuaaauaguau

SEQ ID NO: 197809 - RNA, 22 nt, Homo sapiens
guucaagugauucuacugccuc

SEQ ID NO: 197810 - RNA, 22 nt, Homo sapiens
guucaaguuuucucuugugggu

SEQ ID NO: 197811 - RNA, 20 nt, Homo sapiens
guucacagagguuaugauua

SEQ ID NO: 197812 - RNA, 20 nt, Homo sapiens
guucacaggcuuccuuucag

SEQ ID NO: 197813 - RNA, 22 nt, Homo sapiens
guucagguauucuggaacagag

SEQ ID NO: 197814 - RNA, 22 nt, Homo sapiens
guucaguuuuaaagggaaauug

SEQ ID NO: 197815 - RNA, 22 nt, Homo sapiens
guucaucaggaauauuggccua

SEQ ID NO: 197816 - RNA, 22 nt, Homo sapiens
ggcuguguguuaaaauaggcuu

SEQ ID NO: 197817 - RNA, 22 nt, Homo sapiens
gggaaauguaaagucauaagau

SEQ ID NO: 197818 - RNA, 22 nt, Homo sapiens
gggaacauggaaauucugcucu

SEQ ID NO: 197819 - RNA, 22 nt, Homo sapiens
gggaagauauaggcugggcacc

SEQ ID NO: 197820 - RNA, 22 nt, Homo sapiens
gggagguagguauuagcuuuuc

SEQ ID NO: 197821 - RNA, 22 nt, Homo sapiens
gggaggucauuguucaaugcug

SEQ ID NO: 197822 - RNA, 22 nt, Homo sapiens
gggaucaacuuauacuaaaauu

SEQ ID NO: 197823 - RNA, 22 nt, Homo sapiens
gggcaacauugaguacccugaa

SEQ ID NO: 197824 - RNA, 22 nt, Homo sapiens
gggguaggcuacacugaguucc

SEQ ID NO: 197825 - RNA, 22 nt, Homo sapiens
gggucaguuuugagaaagcgug

SEQ ID NO: 197826 - RNA, 22 nt, Homo sapiens
gggugguuuuauuaucagugac

SEQ ID NO: 197827 - RNA, 22 nt, Homo sapiens
ggguucaaaucuuggcucuuac

SEQ ID NO: 197828 - RNA, 22 nt, Homo sapiens
gguauguuuagaccauuuacau

SEQ ID NO: 197829 - RNA, 22 nt, Homo sapiens
gguauuuaaaguaccugucugc

SEQ ID NO: 197830 - RNA, 22 nt, Homo sapiens
ggucaacaucaucaugguaagu

SEQ ID NO: 197831 - RNA, 19 nt, Homo sapiens
ggucauggagguuguguga

SEQ ID NO: 197832 - RNA, 22 nt, Homo sapiens
ggucauguguccaggagguagc

SEQ ID NO: 197833 - RNA, 22 nt, Homo sapiens
ggucuuggagaauuguccuggg

SEQ ID NO: 197834 - RNA, 21 nt, Homo sapiens
ggugagaaaggagacauagac

SEQ ID NO: 197835 - RNA, 22 nt, Homo sapiens
ggugagguaggaaaaguuagga

SEQ ID NO: 197836 - RNA, 22 nt, Homo sapiens
ggugagguaguaagguacaaua

SEQ ID NO: 197837 - RNA, 22 nt, Homo sapiens
ggugaucauugucucuaguaug

SEQ ID NO: 197838 - RNA, 22 nt, Homo sapiens
guaaaucucuguuuucauggac

SEQ ID NO: 197839 - RNA, 22 nt, Homo sapiens
guaacucugucacuuacuaguu

SEQ ID NO: 197840 - RNA, 22 nt, Homo sapiens
guaaggcuucuggucaacagca

SEQ ID NO: 197841 - RNA, 22 nt, Homo sapiens
guaagucucaugagaucugaug

SEQ ID NO: 197842 - RNA, 22 nt, Homo sapiens
guaauacuggacaggguaucag

SEQ ID NO: 197843 - RNA, 22 nt, Homo sapiens
guaaucucagcuacucgggaga

SEQ ID NO: 197844 - RNA, 22 nt, Homo sapiens
guaaucucagcuacuugggagg

SEQ ID NO: 197845 - RNA, 22 nt, Homo sapiens
guaaucucagcuucuugggagg

SEQ ID NO: 197846 - RNA, 22 nt, Homo sapiens
guacaagugcaguuucguuaca

SEQ ID NO: 197847 - RNA, 22 nt, Homo sapiens
guacaggcagcaaacaccauaa

SEQ ID NO: 197848 - RNA, 22 nt, Homo sapiens
guacaugcauaguuuauuucug

SEQ ID NO: 197849 - RNA, 22 nt, Homo sapiens
guacauguaugcaugcaugcau

SEQ ID NO: 197850 - RNA, 22 nt, Homo sapiens
guacaugugcacagugugcagg

SEQ ID NO: 197851 - RNA, 22 nt, Homo sapiens
guacuuuguuauaacccacagg

SEQ ID NO: 197852 - RNA, 22 nt, Homo sapiens
guagagagaaauacaaagcugu

SEQ ID NO: 197853 - RNA, 22 nt, Homo sapiens
guagcagcuacuaaguugcugu

SEQ ID NO: 197854 - RNA, 22 nt, Homo sapiens
guauagcacauaauacuugaug

SEQ ID NO: 197855 - RNA, 22 nt, Homo sapiens
guaucauugccuaaugcucuca

SEQ ID NO: 197856 - RNA, 22 nt, Homo sapiens
guauccugaaguucucagcacu

SEQ ID NO: 197857 - RNA, 22 nt, Homo sapiens
guaugaaaaucggagauugggu

SEQ ID NO: 197858 - RNA, 22 nt, Homo sapiens
guauggguuuuguuucuucugg

SEQ ID NO: 197859 - RNA, 22 nt, Homo sapiens
guauugcuugagcccaggaguu

SEQ ID NO: 197860 - RNA, 22 nt, Homo sapiens
guauuguacuacaagcucuuua

SEQ ID NO: 197861 - RNA, 19 nt, Homo sapiens
gucaaagucgguauucaaa

SEQ ID NO: 197862 - RNA, 22 nt, Homo sapiens
gucacagaaaaagauaugccaa

SEQ ID NO: 197863 - RNA, 22 nt, Homo sapiens
gucacagcacuuuuaguaagug

SEQ ID NO: 197864 - RNA, 22 nt, Homo sapiens
gucacugagcagaaggaagcga

SEQ ID NO: 197865 - RNA, 22 nt, Homo sapiens
gucagagcacugaguugugggc

SEQ ID NO: 197866 - RNA, 22 nt, Homo sapiens
gucagcaaaguucuccugcaga

SEQ ID NO: 197867 - RNA, 22 nt, Homo sapiens
gucagguaccugaaagcagcca

SEQ ID NO: 197868 - RNA, 22 nt, Homo sapiens
gucaggugcuuacgcggagauc

SEQ ID NO: 197869 - RNA, 22 nt, Homo sapiens
gucaguggauacugucucuguc

SEQ ID NO: 197870 - RNA, 22 nt, Homo sapiens
gucagugucuuaacagagauua

SEQ ID NO: 197871 - RNA, 18 nt, Homo sapiens
gucauagaaugaugguuc

SEQ ID NO: 197872 - RNA, 22 nt, Homo sapiens
gucaucaucaguccucugugca

SEQ ID NO: 197873 - RNA, 22 nt, Homo sapiens
gucaugaaguuuugaaugaaau

SEQ ID NO: 197874 - RNA, 22 nt, Homo sapiens
gucauggaaaucuacauuguua

SEQ ID NO: 197875 - RNA, 22 nt, Homo sapiens
gucauggagggacauaacuaac

SEQ ID NO: 197876 - RNA, 22 nt, Homo sapiens
gucauguuuaacuucuugagga

SEQ ID NO: 197877 - RNA, 22 nt, Homo sapiens
gucauugagucagggaguaucu

SEQ ID NO: 197878 - RNA, 22 nt, Homo sapiens
guccaguacucuuuccugaaaa

SEQ ID NO: 197879 - RNA, 20 nt, Homo sapiens
guccauuugcugccauugcu

SEQ ID NO: 197880 - RNA, 22 nt, Homo sapiens
gucucagugcgaaucucaaaga

SEQ ID NO: 197881 - RNA, 22 nt, Homo sapiens
gucucugguugcuuuuguacca

SEQ ID NO: 197882 - RNA, 22 nt, Homo sapiens
gucucuugguuuagagcauuua

SEQ ID NO: 197883 - RNA, 22 nt, Homo sapiens
gucugagcauggggccggcagg

SEQ ID NO: 197884 - RNA, 22 nt, Homo sapiens
gucuggcacagggaaaguacaa

SEQ ID NO: 197885 - RNA, 22 nt, Homo sapiens
gucugguugacagcauguggcc

SEQ ID NO: 197886 - RNA, 22 nt, Homo sapiens
gucugguuggaguaguuuucag

SEQ ID NO: 197887 - RNA, 22 nt, Homo sapiens
guucaucagggacacugguuug

SEQ ID NO: 197888 - RNA, 20 nt, Homo sapiens
guucauguaauuaguucagg

SEQ ID NO: 197889 - RNA, 22 nt, Homo sapiens
guugagcaaacagcuuaacagu

SEQ ID NO: 197890 - RNA, 22 nt, Homo sapiens
guugccuaggcuggagugcagu

SEQ ID NO: 197891 - RNA, 22 nt, Homo sapiens
guugcucaggccggagugcagu

SEQ ID NO: 197892 - RNA, 22 nt, Homo sapiens
guugcuuauuccuguaauccca

SEQ ID NO: 197893 - RNA, 22 nt, Homo sapiens
guuggucucguauaaaucaagg

SEQ ID NO: 197894 - RNA, 22 nt, Homo sapiens
guuguauaggcauggggagaau

SEQ ID NO: 197895 - RNA, 22 nt, Homo sapiens
guuuguaacucuagugacuaga

SEQ ID NO: 197896 - RNA, 22 nt, Homo sapiens
uaaagauaaggcucgcuuggau

SEQ ID NO: 197897 - RNA, 22 nt, Homo sapiens
uaaagccuagaacuuucagccc

SEQ ID NO: 197898 - RNA, 22 nt, Homo sapiens
uaaagcuuagauccaugguggc

SEQ ID NO: 197899 - RNA, 18 nt, Homo sapiens
uaaaggcacuguguuguu

SEQ ID NO: 197900 - RNA, 22 nt, Homo sapiens
uaaagugaggauggcaguaggu

SEQ ID NO: 197901 - RNA, 20 nt, Homo sapiens
uaaaugccucaugcuuuauu

SEQ ID NO: 197902 - RNA, 22 nt, Homo sapiens
uaaaugcucuuuaaaagugcuu

SEQ ID NO: 197903 - RNA, 22 nt, Homo sapiens
uaaauggauauugccaucuccu

SEQ ID NO: 197904 - RNA, 18 nt, Homo sapiens
uaaauugcuucaccugag

SEQ ID NO: 197905 - RNA, 22 nt, Homo sapiens
uaacaccuuugauagcacuuuu

SEQ ID NO: 197906 - RNA, 22 nt, Homo sapiens
uaacagcauuugugucuaguag

SEQ ID NO: 197907 - RNA, 22 nt, Homo sapiens
uaacauagucauauacuugcuu

SEQ ID NO: 197908 - RNA, 22 nt, Homo sapiens
uaacuaaagagaagucaauguc

SEQ ID NO: 197909 - RNA, 22 nt, Homo sapiens
uaacucugccuagugacauggu

SEQ ID NO: 197910 - RNA, 22 nt, Homo sapiens
uaacugcaaccuccgccucccg

SEQ ID NO: 197911 - RNA, 22 nt, Homo sapiens
uaagaauucuguccgguauacu

SEQ ID NO: 197912 - RNA, 22 nt, Homo sapiens
uaagagagcuccaucuuuuccu

SEQ ID NO: 197913 - RNA, 20 nt, Homo sapiens
uaagccacacagucuaaggu

SEQ ID NO: 197914 - RNA, 22 nt, Homo sapiens
uaagccaccgugccuggccuaa

SEQ ID NO: 197915 - RNA, 22 nt, Homo sapiens
uaagcuauagugaauaaauugc

SEQ ID NO: 197916 - RNA, 22 nt, Homo sapiens
uaaggcacuacuuuaggcuuuc

SEQ ID NO: 197917 - RNA, 18 nt, Homo sapiens
uaaggcacuauaggcauu

SEQ ID NO: 197918 - RNA, 22 nt, Homo sapiens
uaaggcuucuuggaauacugca

SEQ ID NO: 197919 - RNA, 22 nt, Homo sapiens
uaaggcuugaucuuggugagau

SEQ ID NO: 197920 - RNA, 22 nt, Homo sapiens
uaaggcuugcuucagucuugaa

SEQ ID NO: 197921 - RNA, 22 nt, Homo sapiens
uaaguaaaugaaagguugauuu

SEQ ID NO: 197922 - RNA, 22 nt, Homo sapiens
uaaguaauugugguuuuugcca

SEQ ID NO: 197923 - RNA, 22 nt, Homo sapiens
uaaguaguuuucuuggaggcga

SEQ ID NO: 197924 - RNA, 22 nt, Homo sapiens
uaaguauagguaacagaagcaa

SEQ ID NO: 197925 - RNA, 22 nt, Homo sapiens
uaaguauuaugugcugcauuuu

SEQ ID NO: 197926 - RNA, 22 nt, Homo sapiens
uaagugaauauggacaguuagc

SEQ ID NO: 197927 - RNA, 20 nt, Homo sapiens
uaagugcauaggauauuucu

SEQ ID NO: 197928 - RNA, 22 nt, Homo sapiens
uaagugcaugauuacaugcaua

SEQ ID NO: 197929 - RNA, 22 nt, Homo sapiens
uaagugcuguguuguuaccuaa

SEQ ID NO: 197930 - RNA, 20 nt, Homo sapiens
uaagugcuugagacuucuga

SEQ ID NO: 197931 - RNA, 22 nt, Homo sapiens
uaaguguaaugucugaaguuug

SEQ ID NO: 197932 - RNA, 22 nt, Homo sapiens
uaauagcucggauaaacaugau

SEQ ID NO: 197933 - RNA, 22 nt, Homo sapiens
uaauaguuggcacuggagaaag

SEQ ID NO: 197934 - RNA, 22 nt, Homo sapiens
uaaugcauacagaagguguuuu

SEQ ID NO: 197935 - RNA, 21 nt, Homo sapiens
uaauggcaugaucucggcuca

SEQ ID NO: 197936 - RNA, 22 nt, Homo sapiens
uaaugugcuucucuaccauagg

SEQ ID NO: 197937 - RNA, 22 nt, Homo sapiens
uaauucugacaacaguggcguu

SEQ ID NO: 197938 - RNA, 22 nt, Homo sapiens
uacaaaguaacaguuccuguau

SEQ ID NO: 197939 - RNA, 22 nt, Homo sapiens
uacagguaugugucuauauaca

SEQ ID NO: 197940 - RNA, 22 nt, Homo sapiens
uacaguggaaguuaaccccauu

SEQ ID NO: 197941 - RNA, 22 nt, Homo sapiens
uacaguggcaugucaggugcuu

SEQ ID NO: 197942 - RNA, 22 nt, Homo sapiens
uacauagucuucuuuugguuau

SEQ ID NO: 197943 - RNA, 22 nt, Homo sapiens
uacauccauccugcugggcagu

SEQ ID NO: 197944 - RNA, 22 nt, Homo sapiens
uacauguauguguuuauggcug

SEQ ID NO: 197945 - RNA, 22 nt, Homo sapiens
uaccaguaaugguucuagagga

SEQ ID NO: 197946 - RNA, 22 nt, Homo sapiens
uacucaguaagugcuggcugcu

SEQ ID NO: 197947 - RNA, 22 nt, Homo sapiens
uacucugcagccauaaaacaga

SEQ ID NO: 197948 - RNA, 22 nt, Homo sapiens
uacucugcaguaauuccagccc

SEQ ID NO: 197949 - RNA, 22 nt, Homo sapiens
uacugcacuccagccucgguga

SEQ ID NO: 197950 - RNA, 22 nt, Homo sapiens
uacugcagucagacuccugggc

SEQ ID NO: 197951 - RNA, 22 nt, Homo sapiens
uacuguguaguuagaccucaga

SEQ ID NO: 197952 - RNA, 20 nt, Homo sapiens
uagaaaguagaguggugguu

SEQ ID NO: 197953 - RNA, 18 nt, Homo sapiens
uagaauauaggucauucu

SEQ ID NO: 197954 - RNA, 22 nt, Homo sapiens
uagaauggaagguugagaagaa

SEQ ID NO: 197955 - RNA, 22 nt, Homo sapiens
uagaauguaacaguuaaaagca

SEQ ID NO: 197956 - RNA, 22 nt, Homo sapiens
uagacccauuguucagagagug

SEQ ID NO: 197957 - RNA, 22 nt, Homo sapiens
uagacugguuuagcacugaaua

SEQ ID NO: 197958 - RNA, 21 nt, Homo sapiens
uagagcaacacacgcccucuc

SEQ ID NO: 197959 - RNA, 22 nt, Homo sapiens
uagaggaaugaauuuggccaga

SEQ ID NO: 197960 - RNA, 22 nt, Homo sapiens
uagagguagagugacuucccca

SEQ ID NO: 197961 - RNA, 22 nt, Homo sapiens
gcagcaucaaaucacacaagau

SEQ ID NO: 197962 - RNA, 22 nt, Homo sapiens
gcagguguuaugcaaacaacug

SEQ ID NO: 197963 - RNA, 23 nt, Homo sapiens
gcagucauuuggaaaagguugaa

SEQ ID NO: 197964 - RNA, 22 nt, Homo sapiens
gcaugcacuguauuuaaguauc

SEQ ID NO: 197965 - RNA, 22 nt, Homo sapiens
gcaugcauuuuccuaacuagaa

SEQ ID NO: 197966 - RNA, 22 nt, Homo sapiens
gcauggaguggaaauucuuggg

SEQ ID NO: 197967 - RNA, 22 nt, Homo sapiens
gcauggauguugauggcugcug

SEQ ID NO: 197968 - RNA, 22 nt, Homo sapiens
gcaugugaauguguaagaaaau

SEQ ID NO: 197969 - RNA, 18 nt, Homo sapiens
gccaacauguaaacaggu

SEQ ID NO: 197970 - RNA, 19 nt, Homo sapiens
gccaccuggugcguguucu

SEQ ID NO: 197971 - RNA, 22 nt, Homo sapiens
gccauugcacuccgcccugggc

SEQ ID NO: 197972 - RNA, 22 nt, Homo sapiens
gccccaguacaggcuccuuaga

SEQ ID NO: 197973 - RNA, 22 nt, Homo sapiens
gcccugauacauucuucugccu

SEQ ID NO: 197974 - RNA, 22 nt, Homo sapiens
gccuagagacuugguaucuugc

SEQ ID NO: 197975 - RNA, 22 nt, Homo sapiens
gccuagagaguuaucaggcugu

SEQ ID NO: 197976 - RNA, 22 nt, Homo sapiens
gcuacugucuaucugugcuucu

SEQ ID NO: 197977 - RNA, 22 nt, Homo sapiens
gcuagcacauugucaccucuca

SEQ ID NO: 197978 - RNA, 22 nt, Homo sapiens
gcuauggccugaauguuugugu

SEQ ID NO: 197979 - RNA, 19 nt, Homo sapiens
gcucaccuugcugcuccag

SEQ ID NO: 197980 - RNA, 17 nt, Homo sapiens
gcugcauucauguagaa

SEQ ID NO: 197981 - RNA, 22 nt, Homo sapiens
gcugcuguaccagaugugguua

SEQ ID NO: 197982 - RNA, 22 nt, Homo sapiens
gcugcuguuucucuuucagcau

SEQ ID NO: 197983 - RNA, 22 nt, Homo sapiens
gcugcuuuugaugacaaaaaca

SEQ ID NO: 197984 - RNA, 22 nt, Homo sapiens
gcuggauguuucaauacaaaua

SEQ ID NO: 197985 - RNA, 22 nt, Homo sapiens
gcuggguucagagugggcugcg

SEQ ID NO: 197986 - RNA, 22 nt, Homo sapiens
gcuggucugccguaguaggugc

SEQ ID NO: 197987 - RNA, 22 nt, Homo sapiens
gcugguguagagugcagaaagg

SEQ ID NO: 197988 - RNA, 22 nt, Homo sapiens
gcuguguguuaucagaaauugc

SEQ ID NO: 197989 - RNA, 22 nt, Homo sapiens
gcuguguucucgaggcggggga

SEQ ID NO: 197990 - RNA, 22 nt, Homo sapiens
gcuucauggaggcugggcgcag

SEQ ID NO: 197991 - RNA, 22 nt, Homo sapiens
gcuuuggauaaaugucaguuua

SEQ ID NO: 197992 - RNA, 21 nt, Homo sapiens
gcuuuuucggaagucuuuggc

SEQ ID NO: 197993 - RNA, 22 nt, Homo sapiens
ggaaagcuagguguggguguac

SEQ ID NO: 197994 - RNA, 22 nt, Homo sapiens
ggaaaguaacccauucucuuac

SEQ ID NO: 197995 - RNA, 22 nt, Homo sapiens
ggaaaguccuucuguaggcucc

SEQ ID NO: 197996 - RNA, 23 nt, Homo sapiens
ggaaauguuuaagggguugggag

SEQ ID NO: 197997 - RNA, 22 nt, Homo sapiens
ggaacaccauuuuuccugccuu

SEQ ID NO: 197998 - RNA, 22 nt, Homo sapiens
ggaagaauauuaggggauuucg

SEQ ID NO: 197999 - RNA, 18 nt, Homo sapiens
ggaagauuggcuaugugc

SEQ ID NO: 198000 - RNA, 22 nt, Homo sapiens
ggaauauaaaaagccccagaau

SEQ ID NO: 198001 - RNA, 22 nt, Homo sapiens
ggaauguaguaauuugguuagu

SEQ ID NO: 198002 - RNA, 22 nt, Homo sapiens
ggacaguagugcuuucuaucau

SEQ ID NO: 198003 - RNA, 22 nt, Homo sapiens
ggacugagaggacuacagugua

SEQ ID NO: 198004 - RNA, 22 nt, Homo sapiens
ggacuguacuccuggccagugu

SEQ ID NO: 198005 - RNA, 20 nt, Homo sapiens
ggagagugacauaauucugg

SEQ ID NO: 198006 - RNA, 22 nt, Homo sapiens
ggagaucauuuccuauuugaag

SEQ ID NO: 198007 - RNA, 22 nt, Homo sapiens
ggagaucuuguuaaaguacaga

SEQ ID NO: 198008 - RNA, 22 nt, Homo sapiens
ggagaucuuugaaguguugugc

SEQ ID NO: 198009 - RNA, 22 nt, Homo sapiens
ggagauuauuaguguuucaugc

SEQ ID NO: 198010 - RNA, 22 nt, Homo sapiens
ggaggcuaguaaaaagguagaa

SEQ ID NO: 198011 - RNA, 22 nt, Homo sapiens
ggagucuugcuauguugccaag

SEQ ID NO: 198012 - RNA, 22 nt, Homo sapiens
ggaugcauuuuugguugucaca

SEQ ID NO: 198013 - RNA, 22 nt, Homo sapiens
ggcaaagagacaugcaucgggg

SEQ ID NO: 198014 - RNA, 22 nt, Homo sapiens
ggcaacauggugaaacucuguc

SEQ ID NO: 198015 - RNA, 22 nt, Homo sapiens
ggcaagaacuucacucacuuuu

SEQ ID NO: 198016 - RNA, 22 nt, Homo sapiens
ggcaagaagaacuauaacuuuu

SEQ ID NO: 198017 - RNA, 22 nt, Homo sapiens
ggcaagaggagauucugcuccc

SEQ ID NO: 198018 - RNA, 23 nt, Homo sapiens
ggcaagaucucagcucacugcaa

SEQ ID NO: 198019 - RNA, 22 nt, Homo sapiens
ggcaagcucaggccucaggugu

SEQ ID NO: 198020 - RNA, 22 nt, Homo sapiens
ggcaaguugcuauucuuuaaug

SEQ ID NO: 198021 - RNA, 22 nt, Homo sapiens
ggcaaugaggcggaccagcagg

SEQ ID NO: 198022 - RNA, 22 nt, Homo sapiens
ggcaaugucagcuaaugaugga

SEQ ID NO: 198023 - RNA, 22 nt, Homo sapiens
ggcacugugaugugagggggua

SEQ ID NO: 198024 - RNA, 22 nt, Homo sapiens
ggcacuguugccggccugaauu

SEQ ID NO: 198025 - RNA, 22 nt, Homo sapiens
ggcagacuguggaguucuuucu

SEQ ID NO: 198026 - RNA, 22 nt, Homo sapiens
ggcagagucuugcaucuuuaga

SEQ ID NO: 198027 - RNA, 22 nt, Homo sapiens
ggcagcgugcacuuucgccacu

SEQ ID NO: 198028 - RNA, 23 nt, Homo sapiens
ggcagguuggucuaggucuauuc

SEQ ID NO: 198029 - RNA, 22 nt, Homo sapiens
ggcaguguuauuauauuuuugg

SEQ ID NO: 198030 - RNA, 21 nt, Homo sapiens
ggcaugaauggaaaagugaga

SEQ ID NO: 198031 - RNA, 22 nt, Homo sapiens
ggcauugugaacauuucccugc

SEQ ID NO: 198032 - RNA, 22 nt, Homo sapiens
ggcccugagacaggaaaaagcu

SEQ ID NO: 198033 - RNA, 22 nt, Homo sapiens
ggccggguggccauggcugccc

SEQ ID NO: 198034 - RNA, 20 nt, Homo sapiens
agcuccauuccugaaggcug

SEQ ID NO: 198035 - RNA, 22 nt, Homo sapiens
agcuccuacuguuacaucauug

SEQ ID NO: 198036 - RNA, 22 nt, Homo sapiens
agcugauggucuuguaugaugu

SEQ ID NO: 198037 - RNA, 22 nt, Homo sapiens
agcugauuuuaaguccuugucc

SEQ ID NO: 198038 - RNA, 17 nt, Homo sapiens
agcuggaauuacgggag

SEQ ID NO: 198039 - RNA, 22 nt, Homo sapiens
agcuggauguggaugacccugu

SEQ ID NO: 198040 - RNA, 22 nt, Homo sapiens
agcuggucucaggugcccugcu

SEQ ID NO: 198041 - RNA, 22 nt, Homo sapiens
agcugguuuaauaugcugucug

SEQ ID NO: 198042 - RNA, 21 nt, Homo sapiens
agcugguuuccacagugugcu

SEQ ID NO: 198043 - RNA, 20 nt, Homo sapiens
agcuguuguuaaaaaggagg

SEQ ID NO: 198044 - RNA, 22 nt, Homo sapiens
agcuucauucugaauagguuga

SEQ ID NO: 198045 - RNA, 22 nt, Homo sapiens
agcuugugcuguaugaagggcc

SEQ ID NO: 198046 - RNA, 22 nt, Homo sapiens
agcuuguguuuuucuaaguauc

SEQ ID NO: 198047 - RNA, 22 nt, Homo sapiens
agcuuguuuuauagaaagucaa

SEQ ID NO: 198048 - RNA, 22 nt, Homo sapiens
agcuuguuuuccugcaacuaga

SEQ ID NO: 198049 - RNA, 22 nt, Homo sapiens
aggaaucuaagguaucagguua

SEQ ID NO: 198050 - RNA, 22 nt, Homo sapiens
aggacacugagcaugggagguu

SEQ ID NO: 198051 - RNA, 22 nt, Homo sapiens
aggaccauuguguagcagacau

SEQ ID NO: 198052 - RNA, 22 nt, Homo sapiens
aggagaauugguucuucuugau

SEQ ID NO: 198053 - RNA, 22 nt, Homo sapiens
aggagaucagccucccugcaac

SEQ ID NO: 198054 - RNA, 21 nt, Homo sapiens
aggagauguuuguccuuuuag

SEQ ID NO: 198055 - RNA, 23 nt, Homo sapiens
aggagcuuagaaguugccauugc

SEQ ID NO: 198056 - RNA, 22 nt, Homo sapiens
aggauaguaaugauagagaggc

SEQ ID NO: 198057 - RNA, 21 nt, Homo sapiens
aggcaaaugaagcagccgcuc

SEQ ID NO: 198058 - RNA, 22 nt, Homo sapiens
aggcaacaugguaaaacccugu

SEQ ID NO: 198059 - RNA, 22 nt, Homo sapiens
aggcaagcaucuugcucccuuc

SEQ ID NO: 198060 - RNA, 21 nt, Homo sapiens
aggcaagguguuauuauugaa

SEQ ID NO: 198061 - RNA, 22 nt, Homo sapiens
aggcagucucugccggcugagg

SEQ ID NO: 198062 - RNA, 22 nt, Homo sapiens
aggcauguggcucuguucugac

SEQ ID NO: 198063 - RNA, 22 nt, Homo sapiens
aggccaguuuuuggagggaaac

SEQ ID NO: 198064 - RNA, 22 nt, Homo sapiens
aggcuagaaucuuccaucuugg

SEQ ID NO: 198065 - RNA, 22 nt, Homo sapiens
aggcugguauuuacaaaagcuc

SEQ ID NO: 198066 - RNA, 22 nt, Homo sapiens
aggcuguguggauaauauuggg

SEQ ID NO: 198067 - RNA, 22 nt, Homo sapiens
agggagcaaaguggucuuucuc

SEQ ID NO: 198068 - RNA, 22 nt, Homo sapiens
agggccuuuguagauguacuca

SEQ ID NO: 198069 - RNA, 22 nt, Homo sapiens
agggcuuuugagcugagauggu

SEQ ID NO: 198070 - RNA, 22 nt, Homo sapiens
agguacuugagauucugaacug

SEQ ID NO: 198071 - RNA, 22 nt, Homo sapiens
agguagguugagaugggcauca

SEQ ID NO: 198072 - RNA, 22 nt, Homo sapiens
agguauuuucaacuuagaaugg

SEQ ID NO: 198073 - RNA, 22 nt, Homo sapiens
auaacauccuuucuuaucguug

SEQ ID NO: 198074 - RNA, 22 nt, Homo sapiens
auaacucuguuuuuuucaugca

SEQ ID NO: 198075 - RNA, 22 nt, Homo sapiens
auaagauaguggaagugggauu

SEQ ID NO: 198076 - RNA, 22 nt, Homo sapiens
auaaggcugguauagacauuca

SEQ ID NO: 198077 - RNA, 22 nt, Homo sapiens
auaagugagugauucaguguua

SEQ ID NO: 198078 - RNA, 22 nt, Homo sapiens
auaauagguaguaauggauuga

SEQ ID NO: 198079 - RNA, 22 nt, Homo sapiens
auaauaguguuuagauuuggga

SEQ ID NO: 198080 - RNA, 22 nt, Homo sapiens
auaaugacuuccaguuccacuc

SEQ ID NO: 198081 - RNA, 23 nt, Homo sapiens
auaaugcaaguggugguaaucug

SEQ ID NO: 198082 - RNA, 22 nt, Homo sapiens
auacacauuccugggccucacc

SEQ ID NO: 198083 - RNA, 22 nt, Homo sapiens
auacagacacagucagaggggu

SEQ ID NO: 198084 - RNA, 22 nt, Homo sapiens
auacaguugccauuucuugugc

SEQ ID NO: 198085 - RNA, 22 nt, Homo sapiens
auacaugugugagcgaagaugu

SEQ ID NO: 198086 - RNA, 22 nt, Homo sapiens
auacuaugagauaauaaagacu

SEQ ID NO: 198087 - RNA, 22 nt, Homo sapiens
auagacacugaaaucccugcca

SEQ ID NO: 198088 - RNA, 22 nt, Homo sapiens
auagaggacugaggugaucuuu

SEQ ID NO: 198089 - RNA, 22 nt, Homo sapiens
auagauucauuugaggagauuu

SEQ ID NO: 198090 - RNA, 22 nt, Homo sapiens
auagcaaugccccauucccagu

SEQ ID NO: 198091 - RNA, 22 nt, Homo sapiens
auagcacacuauagcuucaaac

SEQ ID NO: 198092 - RNA, 22 nt, Homo sapiens
auagcacaguguguguacacca

SEQ ID NO: 198093 - RNA, 22 nt, Homo sapiens
auagcacaugugcaaauggcug

SEQ ID NO: 198094 - RNA, 22 nt, Homo sapiens
auagcagugugaaaauggacua

SEQ ID NO: 198095 - RNA, 22 nt, Homo sapiens
auagcagugugaaaauguacua

SEQ ID NO: 198096 - RNA, 22 nt, Homo sapiens
auagcaucauuucuugaaaaga

SEQ ID NO: 198097 - RNA, 22 nt, Homo sapiens
auagcccauuuguugguccugg

SEQ ID NO: 198098 - RNA, 22 nt, Homo sapiens
auagcucuugcuuacccacugu

SEQ ID NO: 198099 - RNA, 22 nt, Homo sapiens
auagcugcucaggcuuuccuca

SEQ ID NO: 198100 - RNA, 22 nt, Homo sapiens
auaggagcacaaacuauuguga

SEQ ID NO: 198101 - RNA, 22 nt, Homo sapiens
auaggagugugcacagaguagg

SEQ ID NO: 198102 - RNA, 19 nt, Homo sapiens
auagggcuagcauauacug

SEQ ID NO: 198103 - RNA, 22 nt, Homo sapiens
auagugcugcaaaaaacauacg

SEQ ID NO: 198104 - RNA, 22 nt, Homo sapiens
auagugcugcaacaaauauacg

SEQ ID NO: 198105 - RNA, 22 nt, Homo sapiens
auagugcugcaauaaacauaug

SEQ ID NO: 198106 - RNA, 22 nt, Homo sapiens
auagugcugcacuaaacauaca

SEQ ID NO: 198107 - RNA, 22 nt, Homo sapiens
auagugcugcagucaauguacg

SEQ ID NO: 198108 - RNA, 22 nt, Homo sapiens
auagugcugccauaaacauacg

SEQ ID NO: 198109 - RNA, 22 nt, Homo sapiens
auauaugcacacgugugcauau

SEQ ID NO: 198110 - RNA, 21 nt, Homo sapiens
auauggaacuggugacguguu

SEQ ID NO: 198111 - RNA, 22 nt, Homo sapiens
auauguaguauggaaacauugu

SEQ ID NO: 198112 - RNA, 22 nt, Homo sapiens
auauguauuuuaacguguaagg

SEQ ID NO: 198113 - RNA, 22 nt, Homo sapiens
auauuacagagaggaccuggga

SEQ ID NO: 198114 - RNA, 22 nt, Homo sapiens
auauucaagugaggauggcuaa

SEQ ID NO: 198115 - RNA, 22 nt, Homo sapiens
auauuggacugugcuaguuaga

SEQ ID NO: 198116 - RNA, 22 nt, Homo sapiens
augccaguguccagaguggguu

SEQ ID NO: 198117 - RNA, 22 nt, Homo sapiens
augcccauuuguuuucugaaag

SEQ ID NO: 198118 - RNA, 19 nt, Homo sapiens
augcugguguugcucaaac

SEQ ID NO: 198119 - RNA, 22 nt, Homo sapiens
auggaagacuccucuuugggua

SEQ ID NO: 198120 - RNA, 22 nt, Homo sapiens
auggaaugccauuuauaaugga

SEQ ID NO: 198121 - RNA, 22 nt, Homo sapiens
auggaauguaaguuauguuugc

SEQ ID NO: 198122 - RNA, 21 nt, Homo sapiens
auggacaugguuaggcuuugu

SEQ ID NO: 198123 - RNA, 22 nt, Homo sapiens
auggagagaauuauucucucag

SEQ ID NO: 198124 - RNA, 22 nt, Homo sapiens
auggagaugaauaucaucuguu

SEQ ID NO: 198125 - RNA, 22 nt, Homo sapiens
auggagcuugacaguuguagag

SEQ ID NO: 198126 - RNA, 19 nt, Homo sapiens
auggauacauuuucugcua

SEQ ID NO: 198127 - RNA, 22 nt, Homo sapiens
auggauauuuuuugaacauaga

SEQ ID NO: 198128 - RNA, 22 nt, Homo sapiens
auggauuuuaggauacaguuga

SEQ ID NO: 198129 - RNA, 22 nt, Homo sapiens
auggcaaaaaaugcaauuacuu

SEQ ID NO: 198130 - RNA, 22 nt, Homo sapiens
auggcaauaauagcuaccauuu

SEQ ID NO: 198131 - RNA, 22 nt, Homo sapiens
auggcacagaguagaugcucaa

SEQ ID NO: 198132 - RNA, 22 nt, Homo sapiens
auggcacuaaguucaacacuua

SEQ ID NO: 198133 - RNA, 22 nt, Homo sapiens
auggcacugauggaaguaccuu

SEQ ID NO: 198134 - RNA, 22 nt, Homo sapiens
auggcacuguguauuuuucugu

SEQ ID NO: 198135 - RNA, 22 nt, Homo sapiens
auggcauuuuuagggcugggug

SEQ ID NO: 198136 - RNA, 22 nt, Homo sapiens
auggccugaugcaccuguccca

SEQ ID NO: 198137 - RNA, 22 nt, Homo sapiens
auggccuuuacaauuugguaug

SEQ ID NO: 198138 - RNA, 22 nt, Homo sapiens
auggcucuggauagaaugcagg

SEQ ID NO: 198139 - RNA, 22 nt, Homo sapiens
auggcuuaagacaaccuuucau

SEQ ID NO: 198140 - RNA, 22 nt, Homo sapiens
auggcuuuguguucagagcuga

SEQ ID NO: 198141 - RNA, 22 nt, Homo sapiens
augguauuuugugauaccuugu

SEQ ID NO: 198142 - RNA, 22 nt, Homo sapiens
augguuuauuuguaagcagagu

SEQ ID NO: 198143 - RNA, 22 nt, Homo sapiens
gagaugaucaugugguuuuguc

SEQ ID NO: 198144 - RNA, 22 nt, Homo sapiens
gagaugguacacauacgauucu

SEQ ID NO: 198145 - RNA, 22 nt, Homo sapiens
gagauggugugcuguuggaagu

SEQ ID NO: 198146 - RNA, 22 nt, Homo sapiens
gagauuauuagauguucugcuu

SEQ ID NO: 198147 - RNA, 22 nt, Homo sapiens
gagauucaucuagguccagaga

SEQ ID NO: 198148 - RNA, 22 nt, Homo sapiens
gagcaaugauugagccacugua

SEQ ID NO: 198149 - RNA, 22 nt, Homo sapiens
gagcacauaugacauuuucuuc

SEQ ID NO: 198150 - RNA, 22 nt, Homo sapiens
gagcacccuuuguugauugcaa

SEQ ID NO: 198151 - RNA, 18 nt, Homo sapiens
gagcaccuuuuuugcaga

SEQ ID NO: 198152 - RNA, 22 nt, Homo sapiens
gagcagacaugaggaccgcugg

SEQ ID NO: 198153 - RNA, 22 nt, Homo sapiens
gagcuacauggauagucugcau

SEQ ID NO: 198154 - RNA, 21 nt, Homo sapiens
gagcuaggugaggcuguaaug

SEQ ID NO: 198155 - RNA, 22 nt, Homo sapiens
gagcuccuccccuuggcuuuca

SEQ ID NO: 198156 - RNA, 22 nt, Homo sapiens
gagcugaauugcugccauuugc

SEQ ID NO: 198157 - RNA, 22 nt, Homo sapiens
gagcugccuugccuaugcaaga

SEQ ID NO: 198158 - RNA, 22 nt, Homo sapiens
gaggacauuaugcuaaguggaa

SEQ ID NO: 198159 - RNA, 22 nt, Homo sapiens
gaggagucagacugugcaaggu

SEQ ID NO: 198160 - RNA, 22 nt, Homo sapiens
gagguaagagaauaaacaguuu

SEQ ID NO: 198161 - RNA, 22 nt, Homo sapiens
gagguaaguaagaauggcaagc

SEQ ID NO: 198162 - RNA, 21 nt, Homo sapiens
gagguagggauuaaagaccuc

SEQ ID NO: 198163 - RNA, 22 nt, Homo sapiens
gagguaguuaaugcauucacua

SEQ ID NO: 198164 - RNA, 22 nt, Homo sapiens
gagguaguuuaguuuuggggaa

SEQ ID NO: 198165 - RNA, 22 nt, Homo sapiens
gagguaugauugacauauaaaa

SEQ ID NO: 198166 - RNA, 22 nt, Homo sapiens
gaggucauguggcaggcagcca

SEQ ID NO: 198167 - RNA, 22 nt, Homo sapiens
gaggucauucugugguacccag

SEQ ID NO: 198168 - RNA, 22 nt, Homo sapiens
gaggugauaucucauugugguu

SEQ ID NO: 198169 - RNA, 22 nt, Homo sapiens
gagguguaaggacaacagagac

SEQ ID NO: 198170 - RNA, 22 nt, Homo sapiens
gagguugggaugagggauacag

SEQ ID NO: 198171 - RNA, 22 nt, Homo sapiens
gaguaaaugucacuguugcugu

SEQ ID NO: 198172 - RNA, 22 nt, Homo sapiens
gaguaacagcauaaauuuguga

SEQ ID NO: 198173 - RNA, 22 nt, Homo sapiens
gaguagugcugcaguaaacaca

SEQ ID NO: 198174 - RNA, 22 nt, Homo sapiens
gagucagugucuugcucuguca

SEQ ID NO: 198175 - RNA, 22 nt, Homo sapiens
gagugcaagguuuuucugagug

SEQ ID NO: 198176 - RNA, 23 nt, Homo sapiens
gagugcaaugacaugaucucgga

SEQ ID NO: 198177 - RNA, 22 nt, Homo sapiens
gagugcaauggcagaucuccgc

SEQ ID NO: 198178 - RNA, 22 nt, Homo sapiens
gagugcaauggugccaucucgg

SEQ ID NO: 198179 - RNA, 22 nt, Homo sapiens
gagugcaauggugcuaucucgg

SEQ ID NO: 198180 - RNA, 22 nt, Homo sapiens
gagugcugagcccacuuccuug

SEQ ID NO: 198181 - RNA, 23 nt, Homo sapiens
gaguggagacucauugauuuccu

SEQ ID NO: 198182 - RNA, 22 nt, Homo sapiens
gaguggugguucugaaacuuuu

SEQ ID NO: 198183 - RNA, 22 nt, Homo sapiens
gaguucaauuuccagcuguucu

SEQ ID NO: 198184 - RNA, 22 nt, Homo sapiens
gaguuguuuuaaggcacugacu

SEQ ID NO: 198185 - RNA, 22 nt, Homo sapiens
gauacaguaugcaugugguauu

SEQ ID NO: 198186 - RNA, 19 nt, Homo sapiens
gauagacaucacagugcca

SEQ ID NO: 198187 - RNA, 22 nt, Homo sapiens
gauauguaaaaauuauaucuga

SEQ ID NO: 198188 - RNA, 22 nt, Homo sapiens
gauauguaguaguugaaaaaga

SEQ ID NO: 198189 - RNA, 22 nt, Homo sapiens
gaucagauggcuguuggugugu

SEQ ID NO: 198190 - RNA, 22 nt, Homo sapiens
gaucugucuuuccuuauagucu

SEQ ID NO: 198191 - RNA, 22 nt, Homo sapiens
gaugacagcugacucccuugcu

SEQ ID NO: 198192 - RNA, 22 nt, Homo sapiens
gaugacagugaguaaccccaac

SEQ ID NO: 198193 - RNA, 22 nt, Homo sapiens
gaugagaugagcauuugaauug

SEQ ID NO: 198194 - RNA, 22 nt, Homo sapiens
gaugagcuaaguucucacagca

SEQ ID NO: 198195 - RNA, 22 nt, Homo sapiens
gaugagguaggccugcuuugaa

SEQ ID NO: 198196 - RNA, 22 nt, Homo sapiens
gaugauauuugagucauuagaa

SEQ ID NO: 198197 - RNA, 22 nt, Homo sapiens
gauggaguaauguaaucuugag

SEQ ID NO: 198198 - RNA, 22 nt, Homo sapiens
gauggcaucugagaguguuaga

SEQ ID NO: 198199 - RNA, 22 nt, Homo sapiens
gauggcaugugcugccaccaag

SEQ ID NO: 198200 - RNA, 22 nt, Homo sapiens
gauggcuacugauuaaauauag

SEQ ID NO: 198201 - RNA, 22 nt, Homo sapiens
gauggugucccaggcucaggcu

SEQ ID NO: 198202 - RNA, 22 nt, Homo sapiens
gaugugaaaucauaguuucuag

SEQ ID NO: 198203 - RNA, 22 nt, Homo sapiens
gauguuguuuagccuuugaugu

SEQ ID NO: 198204 - RNA, 22 nt, Homo sapiens
gauuuguuggccugugagcuag

SEQ ID NO: 198205 - RNA, 22 nt, Homo sapiens
gauuuugguuagggaaggauac

SEQ ID NO: 198206 - RNA, 22 nt, Homo sapiens
gcaagacaugucuaagguuuaa

SEQ ID NO: 198207 - RNA, 22 nt, Homo sapiens
gcaagugucugagguuuuguau

SEQ ID NO: 198208 - RNA, 22 nt, Homo sapiens
gcaaugcugucugugcacagau

SEQ ID NO: 198209 - RNA, 22 nt, Homo sapiens
gcacaggguuacauucuaaggu

SEQ ID NO: 198210 - RNA, 22 nt, Homo sapiens
gcacagucaacacuuauucacc

SEQ ID NO: 198211 - RNA, 22 nt, Homo sapiens
gcacaguggcucccgucuauaa

SEQ ID NO: 198212 - RNA, 22 nt, Homo sapiens
ggcuagauauucacauauggcu

SEQ ID NO: 198213 - RNA, 22 nt, Homo sapiens
ggcucguguuuucuguccaguu

SEQ ID NO: 198214 - RNA, 22 nt, Homo sapiens
augacauugaaaagcaagugga

SEQ ID NO: 198215 - RNA, 22 nt, Homo sapiens
augacauugaugcucuggcugg

SEQ ID NO: 198216 - RNA, 22 nt, Homo sapiens
augaccaugauccuugccgacc

SEQ ID NO: 198217 - RNA, 19 nt, Homo sapiens
augaccauuuccauaguau

SEQ ID NO: 198218 - RNA, 22 nt, Homo sapiens
augacuauugcacuuuccuggu

SEQ ID NO: 198219 - RNA, 18 nt, Homo sapiens
augacucuggguguuccu

SEQ ID NO: 198220 - RNA, 22 nt, Homo sapiens
augacugucagggcagucauug

SEQ ID NO: 198221 - RNA, 22 nt, Homo sapiens
augagaacugucaaugagagcu

SEQ ID NO: 198222 - RNA, 22 nt, Homo sapiens
augagaaucauuucagcuugua

SEQ ID NO: 198223 - RNA, 22 nt, Homo sapiens
augagaugaauaccgacgaugu

SEQ ID NO: 198224 - RNA, 22 nt, Homo sapiens
augagaugaggaauggcccucc

SEQ ID NO: 198225 - RNA, 22 nt, Homo sapiens
augagauuguuugugugaaaua

SEQ ID NO: 198226 - RNA, 22 nt, Homo sapiens
augagcagaagagauacacugu

SEQ ID NO: 198227 - RNA, 22 nt, Homo sapiens
augagcaucaccagaaucaaua

SEQ ID NO: 198228 - RNA, 22 nt, Homo sapiens
augagcuauggagacagggcca

SEQ ID NO: 198229 - RNA, 22 nt, Homo sapiens
augaggcaggaaaggcguaucu

SEQ ID NO: 198230 - RNA, 22 nt, Homo sapiens
augaggugcagaggaaaugagu

SEQ ID NO: 198231 - RNA, 22 nt, Homo sapiens
augaggugggagaaucacuuga

SEQ ID NO: 198232 - RNA, 21 nt, Homo sapiens
augagguguacuguggugaaa

SEQ ID NO: 198233 - RNA, 20 nt, Homo sapiens
augagguguaugacacugaa

SEQ ID NO: 198234 - RNA, 18 nt, Homo sapiens
augagucauuguggaaau

SEQ ID NO: 198235 - RNA, 19 nt, Homo sapiens
augagucugcaagaaccag

SEQ ID NO: 198236 - RNA, 22 nt, Homo sapiens
augauacugaguugaguucuca

SEQ ID NO: 198237 - RNA, 22 nt, Homo sapiens
augauacuggcuucauagaaug

SEQ ID NO: 198238 - RNA, 22 nt, Homo sapiens
augauaugagaaaggaucaaca

SEQ ID NO: 198239 - RNA, 22 nt, Homo sapiens
augcaaaucuuaaguaugugug

SEQ ID NO: 198240 - RNA, 22 nt, Homo sapiens
augcaaggaugguuagauauau

SEQ ID NO: 198241 - RNA, 22 nt, Homo sapiens
augcacauauguacugcccuau

SEQ ID NO: 198242 - RNA, 22 nt, Homo sapiens
augcacauggcuaacuuuuuuc

SEQ ID NO: 198243 - RNA, 22 nt, Homo sapiens
augcagagaaaucuaaaauaug

SEQ ID NO: 198244 - RNA, 22 nt, Homo sapiens
augcagaucacauuuuucuguc

SEQ ID NO: 198245 - RNA, 22 nt, Homo sapiens
augcagcugaggguaguggagc

SEQ ID NO: 198246 - RNA, 18 nt, Homo sapiens
augcauauuuuaaguugu

SEQ ID NO: 198247 - RNA, 22 nt, Homo sapiens
augcauggagucuuucacaagu

SEQ ID NO: 198248 - RNA, 22 nt, Homo sapiens
augcauggucugaagucaaccu

SEQ ID NO: 198249 - RNA, 22 nt, Homo sapiens
augccacugcacucuagccugg

SEQ ID NO: 198250 - RNA, 22 nt, Homo sapiens
augccacugcgcucuagccugg

SEQ ID NO: 198251 - RNA, 22 nt, Homo sapiens
augccacuucucuaagucaugu

SEQ ID NO: 198252 - RNA, 22 nt, Homo sapiens
augccagggagaauuguucaag

SEQ ID NO: 198253 - RNA, 22 nt, Homo sapiens
augccauugcacuccagccuag

SEQ ID NO: 198254 - RNA, 22 nt, Homo sapiens
augccauugcacuccagccugg

SEQ ID NO: 198255 - RNA, 22 nt, Homo sapiens
auggaagcauaguauucuauug

SEQ ID NO: 198256 - RNA, 22 nt, Homo sapiens
auggagaugugcgaacugagua

SEQ ID NO: 198257 - RNA, 22 nt, Homo sapiens
auggcaauguaagucagaaaaa

SEQ ID NO: 198258 - RNA, 22 nt, Homo sapiens
auggcaccauguuaugauaaua

SEQ ID NO: 198259 - RNA, 22 nt, Homo sapiens
auggcacugaagcguauugaca

SEQ ID NO: 198260 - RNA, 22 nt, Homo sapiens
auggcacuuuggacugcuagau

SEQ ID NO: 198261 - RNA, 18 nt, Homo sapiens
auggcagaacaauuuaca

SEQ ID NO: 198262 - RNA, 22 nt, Homo sapiens
auggcagcugguuuuacccuag

SEQ ID NO: 198263 - RNA, 22 nt, Homo sapiens
auggcccuguguggagcugcug

SEQ ID NO: 198264 - RNA, 22 nt, Homo sapiens
auggccuuuuuaucucaccaag

SEQ ID NO: 198265 - RNA, 22 nt, Homo sapiens
auggcucuuauuauuugaggua

SEQ ID NO: 198266 - RNA, 22 nt, Homo sapiens
auggcugagugauuucaaacag

SEQ ID NO: 198267 - RNA, 22 nt, Homo sapiens
auggcuguuucugcaaugucua

SEQ ID NO: 198268 - RNA, 22 nt, Homo sapiens
auggcuuguuaugcauuaguac

SEQ ID NO: 198269 - RNA, 22 nt, Homo sapiens
auggcuuuuuaaaucauguugu

SEQ ID NO: 198270 - RNA, 22 nt, Homo sapiens
augggguaggcuugcuguagua

SEQ ID NO: 198271 - RNA, 22 nt, Homo sapiens
auggucccauucauucacguau

SEQ ID NO: 198272 - RNA, 22 nt, Homo sapiens
auggucccuguuccaugcuccu

SEQ ID NO: 198273 - RNA, 22 nt, Homo sapiens
auggucuuuauuguguugagug

SEQ ID NO: 198274 - RNA, 22 nt, Homo sapiens
auggucuuuguuucuaauucug

SEQ ID NO: 198275 - RNA, 22 nt, Homo sapiens
augguugguuaaaucuguguau

SEQ ID NO: 198276 - RNA, 22 nt, Homo sapiens
auguaacaguauuuggagaugu

SEQ ID NO: 198277 - RNA, 22 nt, Homo sapiens
auguaagugugcucaaauguua

SEQ ID NO: 198278 - RNA, 22 nt, Homo sapiens
auguaauugagguuuuugccau

SEQ ID NO: 198279 - RNA, 22 nt, Homo sapiens
auguagauaucaagaggcauau

SEQ ID NO: 198280 - RNA, 22 nt, Homo sapiens
auguaguagauauuuauggaaa

SEQ ID NO: 198281 - RNA, 22 nt, Homo sapiens
auguauacaugcaggucacagg

SEQ ID NO: 198282 - RNA, 22 nt, Homo sapiens
gugcaaaucucugaguaucuuu

SEQ ID NO: 198283 - RNA, 22 nt, Homo sapiens
gugcaaauuccagcucaacucc

SEQ ID NO: 198284 - RNA, 22 nt, Homo sapiens
gugcaagagugauugcaguuuu

SEQ ID NO: 198285 - RNA, 22 nt, Homo sapiens
gugcaaguguaauacagcuagg

SEQ ID NO: 198286 - RNA, 22 nt, Homo sapiens
ugugacugguugucccgcuuuc

SEQ ID NO: 198287 - RNA, 22 nt, Homo sapiens
ugugaucaauuagugaugucug

SEQ ID NO: 198288 - RNA, 22 nt, Homo sapiens
ugugaucauuucaggaauuuug

SEQ ID NO: 198289 - RNA, 22 nt, Homo sapiens
ugugcacaacgugcagguuugu

SEQ ID NO: 198290 - RNA, 22 nt, Homo sapiens
ugugcacaauguacagguuagu

SEQ ID NO: 198291 - RNA, 22 nt, Homo sapiens
ugugcaguuuuagcguauuuua

SEQ ID NO: 198292 - RNA, 22 nt, Homo sapiens
ugugcauauaaguguguauaua

SEQ ID NO: 198293 - RNA, 22 nt, Homo sapiens
ugugcauaugucuuuauaguag

SEQ ID NO: 198294 - RNA, 22 nt, Homo sapiens
ugugccacugcacuccugccug

SEQ ID NO: 198295 - RNA, 22 nt, Homo sapiens
ugugcguguaagagaucuaggu

SEQ ID NO: 198296 - RNA, 22 nt, Homo sapiens
uguggaaauggugcuacgaaca

SEQ ID NO: 198297 - RNA, 22 nt, Homo sapiens
uguggcauuuucagaaaggaug

SEQ ID NO: 198298 - RNA, 17 nt, Homo sapiens
uguggcucuuaugcuga

SEQ ID NO: 198299 - RNA, 22 nt, Homo sapiens
uguggcuuuuucuuggcugagg

SEQ ID NO: 198300 - RNA, 22 nt, Homo sapiens
ugugggaggugcuaauguaaau

SEQ ID NO: 198301 - RNA, 19 nt, Homo sapiens
uguggucauccugggacga

SEQ ID NO: 198302 - RNA, 22 nt, Homo sapiens
uguguaaagcuuguuccagaaa

SEQ ID NO: 198303 - RNA, 22 nt, Homo sapiens
uguguacaucucuacacacaug

SEQ ID NO: 198304 - RNA, 22 nt, Homo sapiens
ugugucacugcacuccagcgug

SEQ ID NO: 198305 - RNA, 22 nt, Homo sapiens
uguuaacauuuuagagugggaa

SEQ ID NO: 198306 - RNA, 22 nt, Homo sapiens
uguuacagugacuaauguuuua

SEQ ID NO: 198307 - RNA, 22 nt, Homo sapiens
uguuauguuuuagagguuucaa

SEQ ID NO: 198308 - RNA, 22 nt, Homo sapiens
uguuugguggucucuucacaug

SEQ ID NO: 198309 - RNA, 22 nt, Homo sapiens
uguuuguuugauaugggauaaa

SEQ ID NO: 198310 - RNA, 21 nt, Homo sapiens
uguuuuugcuguguaucucuc

SEQ ID NO: 198311 - RNA, 22 nt, Homo sapiens
uuaaaaguauaggccuggcaua

SEQ ID NO: 198312 - RNA, 22 nt, Homo sapiens
uuaaaugcucacauaaagguag

SEQ ID NO: 198313 - RNA, 22 nt, Homo sapiens
uuaacagucacuuagcucauuu

SEQ ID NO: 198314 - RNA, 22 nt, Homo sapiens
uuaacaguugcaugagacugag

SEQ ID NO: 198315 - RNA, 22 nt, Homo sapiens
uuaagacaccaaucauuggauu

SEQ ID NO: 198316 - RNA, 23 nt, Homo sapiens
uuaagcaacggcugcuuuucaga

SEQ ID NO: 198317 - RNA, 22 nt, Homo sapiens
uuaagcaguaguuaaggagagg

SEQ ID NO: 198318 - RNA, 22 nt, Homo sapiens
uuaaggaaggagucuuaaaugg

SEQ ID NO: 198319 - RNA, 22 nt, Homo sapiens
uuaaguacuucccuguuggaca

SEQ ID NO: 198320 - RNA, 22 nt, Homo sapiens
uuaaucaggccguuuccuaaga

SEQ ID NO: 198321 - RNA, 22 nt, Homo sapiens
uuaauccugccuuauuucagua

SEQ ID NO: 198322 - RNA, 22 nt, Homo sapiens
uuaaugugaaucaggaugcauu

SEQ ID NO: 198323 - RNA, 22 nt, Homo sapiens
uuaauuguccauuauucuguuc

SEQ ID NO: 198324 - RNA, 22 nt, Homo sapiens
uuacaaccucagcagugcaaag

SEQ ID NO: 198325 - RNA, 22 nt, Homo sapiens
uuacaaguggcaucucucugga

SEQ ID NO: 198326 - RNA, 22 nt, Homo sapiens
uuacagauggcacacucaaggg

SEQ ID NO: 198327 - RNA, 17 nt, Homo sapiens
uuacaggugcugagagu

SEQ ID NO: 198328 - RNA, 22 nt, Homo sapiens
uuacaguauugcaaggacuagg

SEQ ID NO: 198329 - RNA, 22 nt, Homo sapiens
uuacagucucaagagugcugca

SEQ ID NO: 198330 - RNA, 22 nt, Homo sapiens
uuacaguguuuguucuguuacu

SEQ ID NO: 198331 - RNA, 21 nt, Homo sapiens
uuacaguugguugugaggugg

SEQ ID NO: 198332 - RNA, 22 nt, Homo sapiens
uuacaugagacugucgcuaguu

SEQ ID NO: 198333 - RNA, 22 nt, Homo sapiens
uuacauguggugugaagaagag

SEQ ID NO: 198334 - RNA, 22 nt, Homo sapiens
uuacuagaacauuuagggaacu

SEQ ID NO: 198335 - RNA, 22 nt, Homo sapiens
uuacugcucuuuugucaugagu

SEQ ID NO: 198336 - RNA, 22 nt, Homo sapiens
uuacuguauagaaucaucuuga

SEQ ID NO: 198337 - RNA, 22 nt, Homo sapiens
uuagaguguagcaggaagaggc

SEQ ID NO: 198338 - RNA, 22 nt, Homo sapiens
uuaggcuaguuucuuaaacucu

SEQ ID NO: 198339 - RNA, 22 nt, Homo sapiens
uuaggcuuuauugaaaacaaua

SEQ ID NO: 198340 - RNA, 22 nt, Homo sapiens
uuagggaggcucaggacaagag

SEQ ID NO: 198341 - RNA, 22 nt, Homo sapiens
uuagguaauauauugcugcuuu

SEQ ID NO: 198342 - RNA, 22 nt, Homo sapiens
uuagguuauuacugacaauaau

SEQ ID NO: 198343 - RNA, 22 nt, Homo sapiens
uuaguaguagugcuguaauuuu

SEQ ID NO: 198344 - RNA, 22 nt, Homo sapiens
uuagugaaugcaccacuucuga

SEQ ID NO: 198345 - RNA, 22 nt, Homo sapiens
uuaguuuaucagugguuucuga

SEQ ID NO: 198346 - RNA, 22 nt, Homo sapiens
uuauaggcaggugguguagaug

SEQ ID NO: 198347 - RNA, 22 nt, Homo sapiens
uuauauguuagacauggugggu

SEQ ID NO: 198348 - RNA, 22 nt, Homo sapiens
uuauauguuuguacuuaggccu

SEQ ID NO: 198349 - RNA, 22 nt, Homo sapiens
uuaucacauugacugauuugca

SEQ ID NO: 198350 - RNA, 22 nt, Homo sapiens
uuaucucagugaacugagugga

SEQ ID NO: 198351 - RNA, 22 nt, Homo sapiens
uuauguguuuaauguuucugaa

SEQ ID NO: 198352 - RNA, 22 nt, Homo sapiens
uuauuagcacccuaccaugugg

SEQ ID NO: 198353 - RNA, 22 nt, Homo sapiens
uuauugcacuccagccugggua

SEQ ID NO: 198354 - RNA, 22 nt, Homo sapiens
uuauugcucauuugggcauucu

SEQ ID NO: 198355 - RNA, 22 nt, Homo sapiens
uucaaaguaaaaauguguucac

SEQ ID NO: 198356 - RNA, 22 nt, Homo sapiens
uucaaaguaaagggauggagac

SEQ ID NO: 198357 - RNA, 22 nt, Homo sapiens
uucaaauguucuuucaccaccc

SEQ ID NO: 198358 - RNA, 22 nt, Homo sapiens
uucacagagagaacucaaacca

SEQ ID NO: 198359 - RNA, 22 nt, Homo sapiens
uucaccaguuuugucacgaaug

SEQ ID NO: 198360 - RNA, 23 nt, Homo sapiens
uucaccguguuggccaggcuggu

SEQ ID NO: 198361 - RNA, 22 nt, Homo sapiens
uucacgguguucacgggggucc

SEQ ID NO: 198362 - RNA, 22 nt, Homo sapiens
uucacugcacuccagccugagc

SEQ ID NO: 198363 - RNA, 22 nt, Homo sapiens
uucacuggagcccaggaguugg

SEQ ID NO: 198364 - RNA, 22 nt, Homo sapiens
uucacugugugacccugggcca

SEQ ID NO: 198365 - RNA, 22 nt, Homo sapiens
uucagagugaggcucucggaac

SEQ ID NO: 198366 - RNA, 22 nt, Homo sapiens
uucagaugcacacuguagucua

SEQ ID NO: 198367 - RNA, 22 nt, Homo sapiens
uucagcaaugacagccuauaua

SEQ ID NO: 198368 - RNA, 22 nt, Homo sapiens
uucagcaggccaggcccugacu

SEQ ID NO: 198369 - RNA, 22 nt, Homo sapiens
uucaguacacguguucucauuu

SEQ ID NO: 198370 - RNA, 22 nt, Homo sapiens
uucagugucauuaacacaguag

SEQ ID NO: 198371 - RNA, 22 nt, Homo sapiens
uucaguugcaucaguugaccag

SEQ ID NO: 198372 - RNA, 22 nt, Homo sapiens
uucauacaguggcugcacucca

SEQ ID NO: 198373 - RNA, 22 nt, Homo sapiens
uucauagugaaaaauucaaagu

SEQ ID NO: 198374 - RNA, 22 nt, Homo sapiens
uucauaguguuuccuuccagug

SEQ ID NO: 198375 - RNA, 21 nt, Homo sapiens
uucaucagccagaaaucaagc

SEQ ID NO: 198376 - RNA, 22 nt, Homo sapiens
uucaugcaucuguagugguuaa

SEQ ID NO: 198377 - RNA, 22 nt, Homo sapiens
uucauggauggaaaugauuuug

SEQ ID NO: 198378 - RNA, 22 nt, Homo sapiens
uucauggguuaauuuguucgau

SEQ ID NO: 198379 - RNA, 22 nt, Homo sapiens
uucauguaauauuucacagcuu

SEQ ID NO: 198380 - RNA, 22 nt, Homo sapiens
uuccacaauggcugaacuaguu

SEQ ID NO: 198381 - RNA, 22 nt, Homo sapiens
uuccacgugaaguauucuaaag

SEQ ID NO: 198382 - RNA, 20 nt, Homo sapiens
uuccagcacauuagggaagc

SEQ ID NO: 198383 - RNA, 22 nt, Homo sapiens
uuccagcugggggcaacucugc

SEQ ID NO: 198384 - RNA, 22 nt, Homo sapiens
uuccaggugggcgugggccugg

SEQ ID NO: 198385 - RNA, 22 nt, Homo sapiens
uuccaguggacuacuucauccu

SEQ ID NO: 198386 - RNA, 22 nt, Homo sapiens
uuccaguuauuauaccucuuaa

SEQ ID NO: 198387 - RNA, 22 nt, Homo sapiens
uucccugagcaucuguugagcc

SEQ ID NO: 198388 - RNA, 22 nt, Homo sapiens
uuccuacugugcaaaguugcaa

SEQ ID NO: 198389 - RNA, 22 nt, Homo sapiens
uuccugaggccuccccagaagc

SEQ ID NO: 198390 - RNA, 22 nt, Homo sapiens
uuccuuaguuauuugguccccu

SEQ ID NO: 198391 - RNA, 22 nt, Homo sapiens
uuccuugagaaaguacaaggcu

SEQ ID NO: 198392 - RNA, 22 nt, Homo sapiens
uuccuugagucuuuuuccugag

SEQ ID NO: 198393 - RNA, 22 nt, Homo sapiens
uucuaaguaauuuugcaugccu

SEQ ID NO: 198394 - RNA, 22 nt, Homo sapiens
uucuagagagaagacuuaagcu

SEQ ID NO: 198395 - RNA, 22 nt, Homo sapiens
uucucacaguacagggagcucu

SEQ ID NO: 198396 - RNA, 22 nt, Homo sapiens
uucucagcccccugacagucag

SEQ ID NO: 198397 - RNA, 17 nt, Homo sapiens
uucucaguucugaucuc

SEQ ID NO: 198398 - RNA, 22 nt, Homo sapiens
uucucauggugauggcaaaauc

SEQ ID NO: 198399 - RNA, 22 nt, Homo sapiens
uucugacuggugugagauggua

SEQ ID NO: 198400 - RNA, 23 nt, Homo sapiens
uucugccacugaaaaugccucag

SEQ ID NO: 198401 - RNA, 22 nt, Homo sapiens
uucuggcucaggucaacacuuc

SEQ ID NO: 198402 - RNA, 22 nt, Homo sapiens
uucuggcucgauucucugaccg

SEQ ID NO: 198403 - RNA, 22 nt, Homo sapiens
uucuuagucauguaauagucca

SEQ ID NO: 198404 - RNA, 22 nt, Homo sapiens
uucuuaguggcaccacuuuuuu

SEQ ID NO: 198405 - RNA, 22 nt, Homo sapiens
uucuucaguuacaacaaggggg

SEQ ID NO: 198406 - RNA, 22 nt, Homo sapiens
uucuucugguuaugaaauuuga

SEQ ID NO: 198407 - RNA, 18 nt, Homo sapiens
uucuuguguugauauuuu

SEQ ID NO: 198408 - RNA, 22 nt, Homo sapiens
uucuuuggauaaaguuuuaugc

SEQ ID NO: 198409 - RNA, 22 nt, Homo sapiens
uugaaagaugaacuggauugga

SEQ ID NO: 198410 - RNA, 22 nt, Homo sapiens
uugaaaguguucacaaugguau

SEQ ID NO: 198411 - RNA, 22 nt, Homo sapiens
uugaagacuauaugauucuuca

SEQ ID NO: 198412 - RNA, 22 nt, Homo sapiens
uugaaggaggugcucacucucg

SEQ ID NO: 198413 - RNA, 19 nt, Homo sapiens
uugaaggccgccuugcaga

SEQ ID NO: 198414 - RNA, 22 nt, Homo sapiens
uugaagguaggaugugcuauca

SEQ ID NO: 198415 - RNA, 22 nt, Homo sapiens
uugaaguagcauuucaugucua

SEQ ID NO: 198416 - RNA, 22 nt, Homo sapiens
uugaaguaguacuuuauuauag

SEQ ID NO: 198417 - RNA, 22 nt, Homo sapiens
uugaaguaugaccgcugagaau

SEQ ID NO: 198418 - RNA, 22 nt, Homo sapiens
uugaauagugacuuugauucug

SEQ ID NO: 198419 - RNA, 22 nt, Homo sapiens
uugaauaguggugaaaguuuga

SEQ ID NO: 198420 - RNA, 22 nt, Homo sapiens
uugaaugaaaugaugucauuug

SEQ ID NO: 198421 - RNA, 22 nt, Homo sapiens
uugacaguggcuuaaauugguu

SEQ ID NO: 198422 - RNA, 22 nt, Homo sapiens
uugacauaaucauuucacagug

SEQ ID NO: 198423 - RNA, 22 nt, Homo sapiens
uugacauaguuucugaaauaga

SEQ ID NO: 198424 - RNA, 22 nt, Homo sapiens
uugacuuuuaggaggaaaauga

SEQ ID NO: 198425 - RNA, 22 nt, Homo sapiens
uugacuuuuauucacucugcua

SEQ ID NO: 198426 - RNA, 21 nt, Homo sapiens
uugagaagaauuagcucuucc

SEQ ID NO: 198427 - RNA, 22 nt, Homo sapiens
uugagauaggagcuguuguucu

SEQ ID NO: 198428 - RNA, 22 nt, Homo sapiens
uugagaugauggauaugcuaau

SEQ ID NO: 198429 - RNA, 22 nt, Homo sapiens
uugagauggagucucacgcauu

SEQ ID NO: 198430 - RNA, 22 nt, Homo sapiens
uugagauggagucucacucugc

SEQ ID NO: 198431 - RNA, 22 nt, Homo sapiens
uugagauggagucucacucuug

SEQ ID NO: 198432 - RNA, 22 nt, Homo sapiens
ucaacugcuugagaucacaaau

SEQ ID NO: 198433 - RNA, 22 nt, Homo sapiens
ucaagaccucacauagaggaga

SEQ ID NO: 198434 - RNA, 22 nt, Homo sapiens
ucaagcaauucgccugucucag

SEQ ID NO: 198435 - RNA, 22 nt, Homo sapiens
ucaagcaauucuccucucagcc

SEQ ID NO: 198436 - RNA, 18 nt, Homo sapiens
ucaagcaauugucaugcc

SEQ ID NO: 198437 - RNA, 19 nt, Homo sapiens
ucaagcuauucuccugccu

SEQ ID NO: 198438 - RNA, 22 nt, Homo sapiens
ucaaggacuacauggggugaaa

SEQ ID NO: 198439 - RNA, 22 nt, Homo sapiens
ucaagugcauugauucaguauu

SEQ ID NO: 198440 - RNA, 22 nt, Homo sapiens
ucaaugcaugugacaaagagua

SEQ ID NO: 198441 - RNA, 22 nt, Homo sapiens
ucacaaguguauagacaugucc

SEQ ID NO: 198442 - RNA, 22 nt, Homo sapiens
ucacaauucucaauuugugaaa

SEQ ID NO: 198443 - RNA, 22 nt, Homo sapiens
ucacaccauucuucuacuucag

SEQ ID NO: 198444 - RNA, 22 nt, Homo sapiens
ucacacgugaacucaucacaga

SEQ ID NO: 198445 - RNA, 23 nt, Homo sapiens
ucacacuuaagagaaaugcagcu

SEQ ID NO: 198446 - RNA, 22 nt, Homo sapiens
ucacagacugagccaaauagag

SEQ ID NO: 198447 - RNA, 22 nt, Homo sapiens
ucacagaggagaagaccuuuaa

SEQ ID NO: 198448 - RNA, 22 nt, Homo sapiens
ucacagaugcuugacccauuuc

SEQ ID NO: 198449 - RNA, 18 nt, Homo sapiens
ucacagguaauuaggauu

SEQ ID NO: 198450 - RNA, 22 nt, Homo sapiens
ucacaguaaauccagaagaaau

SEQ ID NO: 198451 - RNA, 22 nt, Homo sapiens
ucacaguagagcuucuuucaga

SEQ ID NO: 198452 - RNA, 22 nt, Homo sapiens
ucacaguagggaacugacaaag

SEQ ID NO: 198453 - RNA, 22 nt, Homo sapiens
ucacagucaaaguaaucauaga

SEQ ID NO: 198454 - RNA, 22 nt, Homo sapiens
ucacaguccuguuuaggagagg

SEQ ID NO: 198455 - RNA, 22 nt, Homo sapiens
ucacagucggugacuucuugcu

SEQ ID NO: 198456 - RNA, 22 nt, Homo sapiens
ucacagucuccucuagggaggg

SEQ ID NO: 198457 - RNA, 22 nt, Homo sapiens
ucacagugaguggaguggggug

SEQ ID NO: 198458 - RNA, 17 nt, Homo sapiens
ucacaguguuaggauga

SEQ ID NO: 198459 - RNA, 22 nt, Homo sapiens
ucacaugaagauuuuaguauac

SEQ ID NO: 198460 - RNA, 22 nt, Homo sapiens
ucacaugucagccguggggaag

SEQ ID NO: 198461 - RNA, 22 nt, Homo sapiens
ucacauguguaaauugguguaa

SEQ ID NO: 198462 - RNA, 22 nt, Homo sapiens
ucaccaccuuccaggaccacug

SEQ ID NO: 198463 - RNA, 22 nt, Homo sapiens
ucaccaguacuccaaauugagg

SEQ ID NO: 198464 - RNA, 22 nt, Homo sapiens
ucacccacacaggagacaggga

SEQ ID NO: 198465 - RNA, 16 nt, Homo sapiens
ucaccccuagagaucc

SEQ ID NO: 198466 - RNA, 22 nt, Homo sapiens
ucaccuggagccuucacauucu

SEQ ID NO: 198467 - RNA, 22 nt, Homo sapiens
ucacuagaucaagggagagaaa

SEQ ID NO: 198468 - RNA, 22 nt, Homo sapiens
ucacuagggagaaacugaggcu

SEQ ID NO: 198469 - RNA, 22 nt, Homo sapiens
ucacugaaaccacugccuccug

SEQ ID NO: 198470 - RNA, 22 nt, Homo sapiens
ucacugaggucugagcuuuaug

SEQ ID NO: 198471 - RNA, 22 nt, Homo sapiens
ucacuggaggagaggaagugga

SEQ ID NO: 198472 - RNA, 22 nt, Homo sapiens
ucacugggagaccaaagccauc

SEQ ID NO: 198473 - RNA, 20 nt, Homo sapiens
ucacugugaacuucuugagg

SEQ ID NO: 198474 - RNA, 22 nt, Homo sapiens
ucacugugugucucuguaucug

SEQ ID NO: 198475 - RNA, 22 nt, Homo sapiens
ucacuuggccgcagccuucucu

SEQ ID NO: 198476 - RNA, 22 nt, Homo sapiens
ucacuuuguauagcgacuggcu

SEQ ID NO: 198477 - RNA, 21 nt, Homo sapiens
ucagaagcucccagggaggac

SEQ ID NO: 198478 - RNA, 22 nt, Homo sapiens
ucagacacugcccuccaccugu

SEQ ID NO: 198479 - RNA, 22 nt, Homo sapiens
ucagagcaaagacacuuuauca

SEQ ID NO: 198480 - RNA, 22 nt, Homo sapiens
ucagagucuagaucacucacug

SEQ ID NO: 198481 - RNA, 22 nt, Homo sapiens
ucagaguguuuuccaacuuggu

SEQ ID NO: 198482 - RNA, 22 nt, Homo sapiens
ucagaugaugucccuguucuaa

SEQ ID NO: 198483 - RNA, 20 nt, Homo sapiens
ucagcagucuggagcagagg

SEQ ID NO: 198484 - RNA, 22 nt, Homo sapiens
ucagcagugagagaccucaccc

SEQ ID NO: 198485 - RNA, 22 nt, Homo sapiens
ucaggcuuuucccagagugaug

SEQ ID NO: 198486 - RNA, 21 nt, Homo sapiens
ucagggaccugcuguacugau

SEQ ID NO: 198487 - RNA, 22 nt, Homo sapiens
ucaguaaaugcuguucucuuuu

SEQ ID NO: 198488 - RNA, 23 nt, Homo sapiens
ucaguacuccacuuucaauagug

SEQ ID NO: 198489 - RNA, 18 nt, Homo sapiens
ucagucacugccuggcuu

SEQ ID NO: 198490 - RNA, 22 nt, Homo sapiens
ucagucauucaauuguugaaug

SEQ ID NO: 198491 - RNA, 22 nt, Homo sapiens
ucagugauugguuauuuuaggc

SEQ ID NO: 198492 - RNA, 22 nt, Homo sapiens
ucaguggauuauuaaagucacc

SEQ ID NO: 198493 - RNA, 22 nt, Homo sapiens
ucagugucugcauucuuauugu

SEQ ID NO: 198494 - RNA, 22 nt, Homo sapiens
ucaguguuuuauccuccagagc

SEQ ID NO: 198495 - RNA, 21 nt, Homo sapiens
ucaguuacugagagagaagug

SEQ ID NO: 198496 - RNA, 22 nt, Homo sapiens
ucauacgucuccuugugccacc

SEQ ID NO: 198497 - RNA, 22 nt, Homo sapiens
ucauacuguugugaaacaaaac

SEQ ID NO: 198498 - RNA, 21 nt, Homo sapiens
ucauauguaucuuugugccuc

SEQ ID NO: 198499 - RNA, 22 nt, Homo sapiens
ucauaugucauaguaugaucuu

SEQ ID NO: 198500 - RNA, 23 nt, Homo sapiens
ucaucacagcauuuccugguauu

SEQ ID NO: 198501 - RNA, 22 nt, Homo sapiens
ucaucagugcuugcaaauuauu

SEQ ID NO: 198502 - RNA, 22 nt, Homo sapiens
ucauccauacaguuagcaaagg

SEQ ID NO: 198503 - RNA, 22 nt, Homo sapiens
ucaucuggcgaaugugaagagu

SEQ ID NO: 198504 - RNA, 22 nt, Homo sapiens
ucaugagacacacuggaaagga

SEQ ID NO: 198505 - RNA, 22 nt, Homo sapiens
ucaugcaucuuguggaauuuga

SEQ ID NO: 198506 - RNA, 22 nt, Homo sapiens
uccaugaguccauuagaaaaaa

SEQ ID NO: 198507 - RNA, 22 nt, Homo sapiens
uccaugugaaaucuaugaggac

SEQ ID NO: 198508 - RNA, 22 nt, Homo sapiens
uccauuuguagguagugagaca

SEQ ID NO: 198509 - RNA, 20 nt, Homo sapiens
ucccaguaggagaaggaagg

SEQ ID NO: 198510 - RNA, 22 nt, Homo sapiens
ucccagugaaaccccaccuuca

SEQ ID NO: 198511 - RNA, 22 nt, Homo sapiens
uccccaguaggcaauuaacacc

SEQ ID NO: 198512 - RNA, 19 nt, Homo sapiens
uccccaguuuuccguucag

SEQ ID NO: 198513 - RNA, 22 nt, Homo sapiens
uccccgagcccaggcugugacu

SEQ ID NO: 198514 - RNA, 22 nt, Homo sapiens
uccccugagaacuugcuagaaa

SEQ ID NO: 198515 - RNA, 22 nt, Homo sapiens
uccccugagucaccugcuucuc

SEQ ID NO: 198516 - RNA, 22 nt, Homo sapiens
ucccugagcaaaguuuucugua

SEQ ID NO: 198517 - RNA, 22 nt, Homo sapiens
ucccugagguccuggauuauug

SEQ ID NO: 198518 - RNA, 22 nt, Homo sapiens
ucccugaguaucuaauguguuu

SEQ ID NO: 198519 - RNA, 19 nt, Homo sapiens
ucccuguagaccacagugc

SEQ ID NO: 198520 - RNA, 22 nt, Homo sapiens
ucccuuaaugaugaacaaugag

SEQ ID NO: 198521 - RNA, 22 nt, Homo sapiens
uccuacugucuucggggcacug

SEQ ID NO: 198522 - RNA, 22 nt, Homo sapiens
uccuggcuccacuguuuauucc

SEQ ID NO: 198523 - RNA, 22 nt, Homo sapiens
uccuguaaucccagcuaccaga

SEQ ID NO: 198524 - RNA, 22 nt, Homo sapiens
uccuucaguccaguggguuuug

SEQ ID NO: 198525 - RNA, 22 nt, Homo sapiens
uccuucauuugucaacucuagu

SEQ ID NO: 198526 - RNA, 22 nt, Homo sapiens
uccuugagccucccagacucag

SEQ ID NO: 198527 - RNA, 22 nt, Homo sapiens
uccuugagucugaacuuuggau

SEQ ID NO: 198528 - RNA, 22 nt, Homo sapiens
uccuuggucaaaaagaaagugu

SEQ ID NO: 198529 - RNA, 22 nt, Homo sapiens
uccuuggugacauuucuugucu

SEQ ID NO: 198530 - RNA, 22 nt, Homo sapiens
uccuuuaguuaauaaagacaag

SEQ ID NO: 198531 - RNA, 22 nt, Homo sapiens
uccuuugguggagucuuuaggg

SEQ ID NO: 198532 - RNA, 22 nt, Homo sapiens
ucuaaaacuagauugugaugau

SEQ ID NO: 198533 - RNA, 17 nt, Homo sapiens
ucuaauaauaugcauuu

SEQ ID NO: 198534 - RNA, 22 nt, Homo sapiens
ucucagcacagucagggcgccu

SEQ ID NO: 198535 - RNA, 22 nt, Homo sapiens
ucucaguguuaucuaucugccu

SEQ ID NO: 198536 - RNA, 20 nt, Homo sapiens
ucucauagagguagagaaua

SEQ ID NO: 198537 - RNA, 22 nt, Homo sapiens
ucuccauuguccagaugaggaa

SEQ ID NO: 198538 - RNA, 20 nt, Homo sapiens
ucucccaaacagcaggcccu

SEQ ID NO: 198539 - RNA, 22 nt, Homo sapiens
ucucugagaccacuccaaacuc

SEQ ID NO: 198540 - RNA, 22 nt, Homo sapiens
ucucugauuaaacaagauagug

SEQ ID NO: 198541 - RNA, 22 nt, Homo sapiens
ucucuuggcggaaguugcagug

SEQ ID NO: 198542 - RNA, 22 nt, Homo sapiens
ucucuugguugaacaguuugga

SEQ ID NO: 198543 - RNA, 19 nt, Homo sapiens
ucugacagccccagucaac

SEQ ID NO: 198544 - RNA, 22 nt, Homo sapiens
ucugaguggcagaaugagcuga

SEQ ID NO: 198545 - RNA, 22 nt, Homo sapiens
ucugccaaccacaaaauuuauu

SEQ ID NO: 198546 - RNA, 22 nt, Homo sapiens
ucugccacugucauugugugau

SEQ ID NO: 198547 - RNA, 22 nt, Homo sapiens
ucugccuuuucaugugggaugg

SEQ ID NO: 198548 - RNA, 22 nt, Homo sapiens
ucuggcuuauuucacuuagcau

SEQ ID NO: 198549 - RNA, 22 nt, Homo sapiens
ucuggcuugugaacugucuucu

SEQ ID NO: 198550 - RNA, 22 nt, Homo sapiens
ucuggcuuuagcaugugggaag

SEQ ID NO: 198551 - RNA, 22 nt, Homo sapiens
ucugggguuagucaaagguaug

SEQ ID NO: 198552 - RNA, 22 nt, Homo sapiens
ucuggguuuuguaccgugcucg

SEQ ID NO: 198553 - RNA, 22 nt, Homo sapiens
ucuggugugcucuggacuugca

SEQ ID NO: 198554 - RNA, 22 nt, Homo sapiens
ucugguguuauucauguaguuu

SEQ ID NO: 198555 - RNA, 22 nt, Homo sapiens
ucugugcugagaguugaaaguu

SEQ ID NO: 198556 - RNA, 18 nt, Homo sapiens
ucugugguguaaauacgu

SEQ ID NO: 198557 - RNA, 22 nt, Homo sapiens
ucugugguucaggcuggagugc

SEQ ID NO: 198558 - RNA, 22 nt, Homo sapiens
ucugugguucuagcuacuuugg

SEQ ID NO: 198559 - RNA, 22 nt, Homo sapiens
ucugugguuguugcauggaaug

SEQ ID NO: 198560 - RNA, 22 nt, Homo sapiens
ucuuaguuuagauuagcaauuc

SEQ ID NO: 198561 - RNA, 22 nt, Homo sapiens
ucuucagucauauuggccugga

SEQ ID NO: 198562 - RNA, 22 nt, Homo sapiens
ucuucaugcuugaaauaauagc

SEQ ID NO: 198563 - RNA, 22 nt, Homo sapiens
ugcauggagauauacaguuuuu

SEQ ID NO: 198564 - RNA, 21 nt, Homo sapiens
ugcaugguagucacaugauuc

SEQ ID NO: 198565 - RNA, 22 nt, Homo sapiens
ugcauguucuuacucauacaug

SEQ ID NO: 198566 - RNA, 22 nt, Homo sapiens
ugccaacugguuucuuuuaguu

SEQ ID NO: 198567 - RNA, 20 nt, Homo sapiens
ugccagugugucaauuuaua

SEQ ID NO: 198568 - RNA, 22 nt, Homo sapiens
ugccaucauuaauauuaggcau

SEQ ID NO: 198569 - RNA, 22 nt, Homo sapiens
ugccaugaagagaggaagcagu

SEQ ID NO: 198570 - RNA, 22 nt, Homo sapiens
ugcccuuugucagaugaguagg

SEQ ID NO: 198571 - RNA, 18 nt, Homo sapiens
ugccuacugggcucaagc

SEQ ID NO: 198572 - RNA, 22 nt, Homo sapiens
ugccuacuuugcaucugucagg

SEQ ID NO: 198573 - RNA, 22 nt, Homo sapiens
ugccuaggcuggaaugcaaugg

SEQ ID NO: 198574 - RNA, 22 nt, Homo sapiens
ugccuaggcuggagugcagugg

SEQ ID NO: 198575 - RNA, 22 nt, Homo sapiens
ugccuaggcuggaguguagugg

SEQ ID NO: 198576 - RNA, 22 nt, Homo sapiens
ugccugauacccucugucucuc

SEQ ID NO: 198577 - RNA, 21 nt, Homo sapiens
ugccuuuguaguaggugucuu

SEQ ID NO: 198578 - RNA, 22 nt, Homo sapiens
ugccuuuguucuggaaugggaa

SEQ ID NO: 198579 - RNA, 22 nt, Homo sapiens
ugcuaugucagccaggcugguc

SEQ ID NO: 198580 - RNA, 22 nt, Homo sapiens
ugcuaugucuucucucacagag

SEQ ID NO: 198581 - RNA, 21 nt, Homo sapiens
ugcucaugaguaaugcaguga

SEQ ID NO: 198582 - RNA, 23 nt, Homo sapiens
ugcugagaccuagauccuaaaga

SEQ ID NO: 198583 - RNA, 22 nt, Homo sapiens
ugcugcuguuaucauuuuacca

SEQ ID NO: 198584 - RNA, 22 nt, Homo sapiens
ugcugcuguuguuguuacuagc

SEQ ID NO: 198585 - RNA, 22 nt, Homo sapiens
ugcugguggucccauaugauua

SEQ ID NO: 198586 - RNA, 21 nt, Homo sapiens
ugcuuuggucauacuucuucc

SEQ ID NO: 198587 - RNA, 22 nt, Homo sapiens
ugcuuuguugaaaaucauuugg

SEQ ID NO: 198588 - RNA, 22 nt, Homo sapiens
uggaaauaaaauagaguuugcc

SEQ ID NO: 198589 - RNA, 22 nt, Homo sapiens
uggaacaccaggcuggcguggc

SEQ ID NO: 198590 - RNA, 22 nt, Homo sapiens
uggaagacaaguguuagcaugg

SEQ ID NO: 198591 - RNA, 22 nt, Homo sapiens
uggaagauggaguuuuaucauu

SEQ ID NO: 198592 - RNA, 22 nt, Homo sapiens
uggaagauuacuuuuuguugaa

SEQ ID NO: 198593 - RNA, 22 nt, Homo sapiens
uggaagguaaguuuugagcauu

SEQ ID NO: 198594 - RNA, 22 nt, Homo sapiens
uggaaguuaaauuaguugauga

SEQ ID NO: 198595 - RNA, 22 nt, Homo sapiens
uggaaucaucaacgaaugaaau

SEQ ID NO: 198596 - RNA, 22 nt, Homo sapiens
uggaauggagagagggugcacg

SEQ ID NO: 198597 - RNA, 19 nt, Homo sapiens
uggaauggauuuaaaugug

SEQ ID NO: 198598 - RNA, 22 nt, Homo sapiens
uggaauuuagguugauaguaua

SEQ ID NO: 198599 - RNA, 22 nt, Homo sapiens
uggacagaaacauguuuucagu

SEQ ID NO: 198600 - RNA, 22 nt, Homo sapiens
uggacagagagaccggcauuuu

SEQ ID NO: 198601 - RNA, 22 nt, Homo sapiens
uggacauguacauauguguaug

SEQ ID NO: 198602 - RNA, 21 nt, Homo sapiens
uggaccccuuccuuacaucau

SEQ ID NO: 198603 - RNA, 22 nt, Homo sapiens
uggagacaaagauagaaaagca

SEQ ID NO: 198604 - RNA, 22 nt, Homo sapiens
uggagagcaaaaucaauccaaa

SEQ ID NO: 198605 - RNA, 22 nt, Homo sapiens
uggagagucauuuauaguauuu

SEQ ID NO: 198606 - RNA, 18 nt, Homo sapiens
uggagauaagaagaacuu

SEQ ID NO: 198607 - RNA, 22 nt, Homo sapiens
uggagcccuaaacuucuaauau

SEQ ID NO: 198608 - RNA, 22 nt, Homo sapiens
uggagucuugcucuguugccca

SEQ ID NO: 198609 - RNA, 17 nt, Homo sapiens
ucuucuguuacuguggc

SEQ ID NO: 198610 - RNA, 22 nt, Homo sapiens
ucuugcuuguuguucccuucau

SEQ ID NO: 198611 - RNA, 22 nt, Homo sapiens
ucuuggcaaagaauuuuuggcu

SEQ ID NO: 198612 - RNA, 22 nt, Homo sapiens
ucuuggccaugaauggcaaggc

SEQ ID NO: 198613 - RNA, 22 nt, Homo sapiens
ucuugggugaguuugugaauaa

SEQ ID NO: 198614 - RNA, 22 nt, Homo sapiens
ucuuggguuugccuugcugcug

SEQ ID NO: 198615 - RNA, 20 nt, Homo sapiens
ucuugguuggaggucuuuua

SEQ ID NO: 198616 - RNA, 22 nt, Homo sapiens
ucuugguuuauugugguaugaa

SEQ ID NO: 198617 - RNA, 22 nt, Homo sapiens
ucuuuaguaauuucuguaaggc

SEQ ID NO: 198618 - RNA, 19 nt, Homo sapiens
ucuuuagucacauuuuuau

SEQ ID NO: 198619 - RNA, 22 nt, Homo sapiens
ucuuuaguuaagggacauuuua

SEQ ID NO: 198620 - RNA, 20 nt, Homo sapiens
ucuuucgguuaccaggcagu

SEQ ID NO: 198621 - RNA, 22 nt, Homo sapiens
ucuuugauaagauccagaagaa

SEQ ID NO: 198622 - RNA, 22 nt, Homo sapiens
ucuuugauuuuguuacuaagac

SEQ ID NO: 198623 - RNA, 22 nt, Homo sapiens
ucuuugccuaacccaaggucau

SEQ ID NO: 198624 - RNA, 22 nt, Homo sapiens
ucuuuggauggaaauuggaguc

SEQ ID NO: 198625 - RNA, 22 nt, Homo sapiens
ucuuuggcugugaagaauaaug

SEQ ID NO: 198626 - RNA, 22 nt, Homo sapiens
ucuuuggucaucaugggaagca

SEQ ID NO: 198627 - RNA, 22 nt, Homo sapiens
ucuuugguuguuuagggugcau

SEQ ID NO: 198628 - RNA, 22 nt, Homo sapiens
ucuuuguucaggagccaacucc

SEQ ID NO: 198629 - RNA, 22 nt, Homo sapiens
ugaaaugccuuuaaugaauuua

SEQ ID NO: 198630 - RNA, 22 nt, Homo sapiens
ugaaauggaagaagucccuuuu

SEQ ID NO: 198631 - RNA, 22 nt, Homo sapiens
ugaaauguaaguugucuagucu

SEQ ID NO: 198632 - RNA, 22 nt, Homo sapiens
ugaacacagccugccucugcca

SEQ ID NO: 198633 - RNA, 22 nt, Homo sapiens
ugaacacuggauaaggagucag

SEQ ID NO: 198634 - RNA, 22 nt, Homo sapiens
ugaacagucaucucucuuguau

SEQ ID NO: 198635 - RNA, 22 nt, Homo sapiens
ugaacuguaagguauaggugau

SEQ ID NO: 198636 - RNA, 22 nt, Homo sapiens
ugaagacucaauuauuaugaac

SEQ ID NO: 198637 - RNA, 22 nt, Homo sapiens
ugaaguaauguuuuauucuauu

SEQ ID NO: 198638 - RNA, 22 nt, Homo sapiens
ugaagugaagcaguaguguggg

SEQ ID NO: 198639 - RNA, 22 nt, Homo sapiens
ugaauauguuaauuagcaucau

SEQ ID NO: 198640 - RNA, 22 nt, Homo sapiens
ugaaugcaucuagaaauuuauu

SEQ ID NO: 198641 - RNA, 22 nt, Homo sapiens
ugaauguaacuaaaccugugaa

SEQ ID NO: 198642 - RNA, 22 nt, Homo sapiens
ugaauguaagaugucugcuggu

SEQ ID NO: 198643 - RNA, 20 nt, Homo sapiens
ugaauguaauuacagaugua

SEQ ID NO: 198644 - RNA, 22 nt, Homo sapiens
ugaauguacacgcguacuuguu

SEQ ID NO: 198645 - RNA, 22 nt, Homo sapiens
ugaauguuguugguugagauau

SEQ ID NO: 198646 - RNA, 22 nt, Homo sapiens
ugaauguuugcagcuuauacca

SEQ ID NO: 198647 - RNA, 22 nt, Homo sapiens
ugaauguuugcuuacuuccaua

SEQ ID NO: 198648 - RNA, 22 nt, Homo sapiens
ugacaagaacuuuccauaguaa

SEQ ID NO: 198649 - RNA, 23 nt, Homo sapiens
ugacaagagcgagacuuggucuc

SEQ ID NO: 198650 - RNA, 22 nt, Homo sapiens
ugacaagauauggucuuaucaa

SEQ ID NO: 198651 - RNA, 22 nt, Homo sapiens
ugacaaguaaacagucagcacc

SEQ ID NO: 198652 - RNA, 22 nt, Homo sapiens
ugacacagugggggauccuuuu

SEQ ID NO: 198653 - RNA, 19 nt, Homo sapiens
ugacacuguuggugggagg

SEQ ID NO: 198654 - RNA, 21 nt, Homo sapiens
ugacagaaaauugaguuugcu

SEQ ID NO: 198655 - RNA, 22 nt, Homo sapiens
ugacagcugaagauguugaacc

SEQ ID NO: 198656 - RNA, 22 nt, Homo sapiens
ugacaguaucuacagcuucuua

SEQ ID NO: 198657 - RNA, 23 nt, Homo sapiens
ugacagucucccgauggcuaggc

SEQ ID NO: 198658 - RNA, 23 nt, Homo sapiens
ugacagugcuugaaauugcucuu

SEQ ID NO: 198659 - RNA, 22 nt, Homo sapiens
ugacaugaagaaaaacagauuu

SEQ ID NO: 198660 - RNA, 22 nt, Homo sapiens
ugacaugaugagcaauaauggc

SEQ ID NO: 198661 - RNA, 19 nt, Homo sapiens
ugaccagggacagaaacca

SEQ ID NO: 198662 - RNA, 22 nt, Homo sapiens
ugacuauaggauaacaugcauu

SEQ ID NO: 198663 - RNA, 22 nt, Homo sapiens
ugacuauugauuuagacgugcu

SEQ ID NO: 198664 - RNA, 22 nt, Homo sapiens
ugacucaguuucucagguagua

SEQ ID NO: 198665 - RNA, 23 nt, Homo sapiens
ugacugaguauauguuuggugcu

SEQ ID NO: 198666 - RNA, 23 nt, Homo sapiens
ugacuggagacuguugauccuuu

SEQ ID NO: 198667 - RNA, 23 nt, Homo sapiens
ugacuuaggccucaacuaugacu

SEQ ID NO: 198668 - RNA, 22 nt, Homo sapiens
ugacuucagacugaaaugauuc

SEQ ID NO: 198669 - RNA, 22 nt, Homo sapiens
ugacuugaacuucuaugucacc

SEQ ID NO: 198670 - RNA, 22 nt, Homo sapiens
ugacuugaguaacuggcucagg

SEQ ID NO: 198671 - RNA, 22 nt, Homo sapiens
ugacuugaucacccccuaaggg

SEQ ID NO: 198672 - RNA, 22 nt, Homo sapiens
ugacuugauccauggggcucca

SEQ ID NO: 198673 - RNA, 20 nt, Homo sapiens
ugagaacaugugguauuugg

SEQ ID NO: 198674 - RNA, 22 nt, Homo sapiens
ugagaagaugaacuccuugguc

SEQ ID NO: 198675 - RNA, 22 nt, Homo sapiens
ugagaagugacgcagcaggguu

SEQ ID NO: 198676 - RNA, 22 nt, Homo sapiens
ugagaaugcagaaucucgugca

SEQ ID NO: 198677 - RNA, 19 nt, Homo sapiens
ugagaauguuaccaggucc

SEQ ID NO: 198678 - RNA, 21 nt, Homo sapiens
ugagacaauccuggucaauau

SEQ ID NO: 198679 - RNA, 22 nt, Homo sapiens
ugagacgaagucucguucugua

SEQ ID NO: 198680 - RNA, 22 nt, Homo sapiens
ugagacgaagucuugcucuguu

SEQ ID NO: 198681 - RNA, 22 nt, Homo sapiens
ugagacggagucucgcucuguc

SEQ ID NO: 198682 - RNA, 21 nt, Homo sapiens
uggagugcaacacuagguaua

SEQ ID NO: 198683 - RNA, 20 nt, Homo sapiens
uggaguuugaguucuuggag

SEQ ID NO: 198684 - RNA, 22 nt, Homo sapiens
uggauaguuuacugaagagugg

SEQ ID NO: 198685 - RNA, 22 nt, Homo sapiens
uggauggucagaggguuucugu

SEQ ID NO: 198686 - RNA, 22 nt, Homo sapiens
uggauugagaagcuguggcuca

SEQ ID NO: 198687 - RNA, 21 nt, Homo sapiens
uggauuguacacccuaucauu

SEQ ID NO: 198688 - RNA, 19 nt, Homo sapiens
uggauuguuagagcagugu

SEQ ID NO: 198689 - RNA, 22 nt, Homo sapiens
uggcaaaugaagucagcuguac

SEQ ID NO: 198690 - RNA, 21 nt, Homo sapiens
uggcaacauggauggauucug

SEQ ID NO: 198691 - RNA, 22 nt, Homo sapiens
uggcaagaucacaauuacuuuu

SEQ ID NO: 198692 - RNA, 20 nt, Homo sapiens
uggcaagauggcagaauaga

SEQ ID NO: 198693 - RNA, 22 nt, Homo sapiens
uggcaauaaaaugcaguuacuu

SEQ ID NO: 198694 - RNA, 18 nt, Homo sapiens
uggcaauaugguucuacc

SEQ ID NO: 198695 - RNA, 20 nt, Homo sapiens
uggcaccugacagauagcca

SEQ ID NO: 198696 - RNA, 22 nt, Homo sapiens
uggcagaugggugagcuggaga

SEQ ID NO: 198697 - RNA, 22 nt, Homo sapiens
uggcaugcauuguggguaauua

SEQ ID NO: 198698 - RNA, 22 nt, Homo sapiens
uggcauuuuguuuuagaauuag

SEQ ID NO: 198699 - RNA, 23 nt, Homo sapiens
uggcauuuuuggcaaugccuucu

SEQ ID NO: 198700 - RNA, 23 nt, Homo sapiens
uggccaagauaaucucaguuuuc

SEQ ID NO: 198701 - RNA, 22 nt, Homo sapiens
uggccagagggcaauuagcugu

SEQ ID NO: 198702 - RNA, 22 nt, Homo sapiens
uggccagugucggaggccagga

SEQ ID NO: 198703 - RNA, 22 nt, Homo sapiens
uggccaguguuuuuccugggcu

SEQ ID NO: 198704 - RNA, 22 nt, Homo sapiens
uggccuuuuccaagaacuacua

SEQ ID NO: 198705 - RNA, 21 nt, Homo sapiens
uggcuauuucuguggcauaca

SEQ ID NO: 198706 - RNA, 22 nt, Homo sapiens
uggcuguuuauuucacaugggu

SEQ ID NO: 198707 - RNA, 22 nt, Homo sapiens
uggcuguuuauuucaccugggu

SEQ ID NO: 198708 - RNA, 21 nt, Homo sapiens
uggcuguuuucaugcuagaac

SEQ ID NO: 198709 - RNA, 22 nt, Homo sapiens
uggcuuuuaucuacucucaacu

SEQ ID NO: 198710 - RNA, 22 nt, Homo sapiens
uggcuuuuauuauguugaggua

SEQ ID NO: 198711 - RNA, 22 nt, Homo sapiens
uggcuuuucauccugggacauu

SEQ ID NO: 198712 - RNA, 20 nt, Homo sapiens
ugggaaauguccaggacaua

SEQ ID NO: 198713 - RNA, 18 nt, Homo sapiens
ugggaagaaauucuucuc

SEQ ID NO: 198714 - RNA, 22 nt, Homo sapiens
ugggaagaugcugcuucuuccu

SEQ ID NO: 198715 - RNA, 22 nt, Homo sapiens
ugggaagauucuguguuuuucc

SEQ ID NO: 198716 - RNA, 22 nt, Homo sapiens
ugggaagcugcugaacuacagu

SEQ ID NO: 198717 - RNA, 22 nt, Homo sapiens
ugggaucauucaaugacgaaau

SEQ ID NO: 198718 - RNA, 22 nt, Homo sapiens
ugggauccaugugguuuaagca

SEQ ID NO: 198719 - RNA, 22 nt, Homo sapiens
ugggcaaaacuaagagcugugg

SEQ ID NO: 198720 - RNA, 22 nt, Homo sapiens
ugggcggagacgugcagccgcc

SEQ ID NO: 198721 - RNA, 22 nt, Homo sapiens
uggggugugagggagaaagaaa

SEQ ID NO: 198722 - RNA, 22 nt, Homo sapiens
uggguaaaucucuguucagggc

SEQ ID NO: 198723 - RNA, 22 nt, Homo sapiens
uggguucccugucuguccuuga

SEQ ID NO: 198724 - RNA, 22 nt, Homo sapiens
ugguaagaaaaccauuauuagc

SEQ ID NO: 198725 - RNA, 22 nt, Homo sapiens
ugguaagaggcccugaguuugu

SEQ ID NO: 198726 - RNA, 22 nt, Homo sapiens
ugguagguuuauaaagaauuua

SEQ ID NO: 198727 - RNA, 17 nt, Homo sapiens
ugguagguuuuucuggc

SEQ ID NO: 198728 - RNA, 22 nt, Homo sapiens
ugguauuuaauauaugagaguu

SEQ ID NO: 198729 - RNA, 20 nt, Homo sapiens
uggucaccuucaggagguuc

SEQ ID NO: 198730 - RNA, 22 nt, Homo sapiens
uggucaguugugccucaauucc

SEQ ID NO: 198731 - RNA, 21 nt, Homo sapiens
uggucccauaagauuauaaug

SEQ ID NO: 198732 - RNA, 22 nt, Homo sapiens
ugguccccaauacuucuauaga

SEQ ID NO: 198733 - RNA, 22 nt, Homo sapiens
uggugagaaacuagauauuuuu

SEQ ID NO: 198734 - RNA, 22 nt, Homo sapiens
ugguggcuuuucguagguucac

SEQ ID NO: 198735 - RNA, 15 nt, Homo sapiens
uggugguguugagac

SEQ ID NO: 198736 - RNA, 21 nt, Homo sapiens
ugguugauccuccuagugccu

SEQ ID NO: 198737 - RNA, 22 nt, Homo sapiens
uguaaaccauauauguauguag

SEQ ID NO: 198738 - RNA, 23 nt, Homo sapiens
uguaaagcuaugaauuauucuuu

SEQ ID NO: 198739 - RNA, 22 nt, Homo sapiens
uguaacaguaguuacuauucuu

SEQ ID NO: 198740 - RNA, 19 nt, Homo sapiens
uguacacuguaaaccugug

SEQ ID NO: 198741 - RNA, 22 nt, Homo sapiens
uguagcaaaucgauacuauugg

SEQ ID NO: 198742 - RNA, 22 nt, Homo sapiens
uguauauguuuguacauauguc

SEQ ID NO: 198743 - RNA, 22 nt, Homo sapiens
uguaugucugcucuuuggaacu

SEQ ID NO: 198744 - RNA, 22 nt, Homo sapiens
uguauguuguaagacuuagacc

SEQ ID NO: 198745 - RNA, 16 nt, Homo sapiens
uguauugcuaaaaaga

SEQ ID NO: 198746 - RNA, 22 nt, Homo sapiens
ugucaaaugcagugauauuuga

SEQ ID NO: 198747 - RNA, 20 nt, Homo sapiens
ugucaagaaacauuacuuau

SEQ ID NO: 198748 - RNA, 22 nt, Homo sapiens
ugucaaugggaauuuguuuuag

SEQ ID NO: 198749 - RNA, 22 nt, Homo sapiens
ugucacagagauuuugguaugu

SEQ ID NO: 198750 - RNA, 22 nt, Homo sapiens
ugucacaguuuguacuuuauag

SEQ ID NO: 198751 - RNA, 22 nt, Homo sapiens
ugucagggaggcucggccgcac

SEQ ID NO: 198752 - RNA, 22 nt, Homo sapiens
ugucaguggucuggaugcagcc

SEQ ID NO: 198753 - RNA, 22 nt, Homo sapiens
ugucaguuucuugagauggaac

SEQ ID NO: 198754 - RNA, 22 nt, Homo sapiens
ugucauacaguaacaugguugg

SEQ ID NO: 198755 - RNA, 22 nt, Homo sapiens
ugucaugaaauauguuuuucua

SEQ ID NO: 198756 - RNA, 21 nt, Homo sapiens
uuguagcagcauaaucccaga

SEQ ID NO: 198757 - RNA, 22 nt, Homo sapiens
uuguaguguuuauucugucaac

SEQ ID NO: 198758 - RNA, 21 nt, Homo sapiens
uuguaugguugaacuugauac

SEQ ID NO: 198759 - RNA, 22 nt, Homo sapiens
uuguauguuguuugucagagaa

SEQ ID NO: 198760 - RNA, 22 nt, Homo sapiens
uugucacccuacauaacaggga

SEQ ID NO: 198761 - RNA, 22 nt, Homo sapiens
uugucauuuucagaguguuacg

SEQ ID NO: 198762 - RNA, 22 nt, Homo sapiens
uuguccaagucccauuuguuga

SEQ ID NO: 198763 - RNA, 22 nt, Homo sapiens
uugucccauggggucuuccuuu

SEQ ID NO: 198764 - RNA, 22 nt, Homo sapiens
uuguccccaucugcugccagaa

SEQ ID NO: 198765 - RNA, 22 nt, Homo sapiens
uuguccucuccaaaucucaugu

SEQ ID NO: 198766 - RNA, 22 nt, Homo sapiens
uuguccuggagguucuugcaag

SEQ ID NO: 198767 - RNA, 22 nt, Homo sapiens
uugugcaaaguugugguuucug

SEQ ID NO: 198768 - RNA, 22 nt, Homo sapiens
uugugcuugcuguguucuaugc

SEQ ID NO: 198769 - RNA, 23 nt, Homo sapiens
uuguucccuuccacucagucucc

SEQ ID NO: 198770 - RNA, 22 nt, Homo sapiens
uuguugcacugcuuuccuggcc

SEQ ID NO: 198771 - RNA, 22 nt, Homo sapiens
uuuaaacugucuuggguuugga

SEQ ID NO: 198772 - RNA, 20 nt, Homo sapiens
uuuaagacaugcugaauuga

SEQ ID NO: 198773 - RNA, 22 nt, Homo sapiens
uuuaauacugcaucuuuacucu

SEQ ID NO: 198774 - RNA, 22 nt, Homo sapiens
uuuaaugcugcccagucauggg

SEQ ID NO: 198775 - RNA, 22 nt, Homo sapiens
uuuacccugaggaaucuauuuu

SEQ ID NO: 198776 - RNA, 22 nt, Homo sapiens
uuuaggcaauauauucaugucu

SEQ ID NO: 198777 - RNA, 23 nt, Homo sapiens
uuuaguccccuaugagcuggugu

SEQ ID NO: 198778 - RNA, 22 nt, Homo sapiens
uuuaguucauuaaggaaucucc

SEQ ID NO: 198779 - RNA, 22 nt, Homo sapiens
uuuauagucaggaacuugagga

SEQ ID NO: 198780 - RNA, 22 nt, Homo sapiens
uuuaucuguuuaaaacuguuca

SEQ ID NO: 198781 - RNA, 22 nt, Homo sapiens
uuuaugcuacauguguuggaaa

SEQ ID NO: 198782 - RNA, 22 nt, Homo sapiens
uuuauggagagauauuuauggu

SEQ ID NO: 198783 - RNA, 18 nt, Homo sapiens
uuucaagucuuaggugac

SEQ ID NO: 198784 - RNA, 23 nt, Homo sapiens
uuucacagaaggauuguagggcc

SEQ ID NO: 198785 - RNA, 18 nt, Homo sapiens
uuucaggguggacaugag

SEQ ID NO: 198786 - RNA, 20 nt, Homo sapiens
uuucaguacuuucuacuggc

SEQ ID NO: 198787 - RNA, 22 nt, Homo sapiens
aaaagcauucagagugcugggc

SEQ ID NO: 198788 - RNA, 18 nt, Homo sapiens
aaacagugucucuuucug

SEQ ID NO: 198789 - RNA, 22 nt, Homo sapiens
aaacauugaccucauccuggca

SEQ ID NO: 198790 - RNA, 15 nt, Homo sapiens
aaacccugucucaag

SEQ ID NO: 198791 - RNA, 20 nt, Homo sapiens
aaacucugucuucuuuauca

SEQ ID NO: 198792 - RNA, 22 nt, Homo sapiens
aaagcacuggagucaucaucua

SEQ ID NO: 198793 - RNA, 22 nt, Homo sapiens
aaaggcacugaucuuauccagu

SEQ ID NO: 198794 - RNA, 22 nt, Homo sapiens
aaaggcacugugacuuuauagg

SEQ ID NO: 198795 - RNA, 22 nt, Homo sapiens
aaaggcaucauuaguaccaagu

SEQ ID NO: 198796 - RNA, 20 nt, Homo sapiens
aaaggcugugagaacgagau

SEQ ID NO: 198797 - RNA, 22 nt, Homo sapiens
aaagggcuuuguaaacuucaag

SEQ ID NO: 198798 - RNA, 22 nt, Homo sapiens
aaaguacucaguucaguuccgu

SEQ ID NO: 198799 - RNA, 17 nt, Homo sapiens
aaaguccuuugcuaucu

SEQ ID NO: 198800 - RNA, 22 nt, Homo sapiens
aaagucuguuuugucagagacu

SEQ ID NO: 198801 - RNA, 22 nt, Homo sapiens
aaagugcaguacuucguauauu

SEQ ID NO: 198802 - RNA, 22 nt, Homo sapiens
aaagugcaguauuugggcagga

SEQ ID NO: 198803 - RNA, 22 nt, Homo sapiens
aaagugcugagacagacuggga

SEQ ID NO: 198804 - RNA, 22 nt, Homo sapiens
aaagugcugagaguucuaacuu

SEQ ID NO: 198805 - RNA, 22 nt, Homo sapiens
aaagugcugggauuggccgggc

SEQ ID NO: 198806 - RNA, 22 nt, Homo sapiens
aaagugcugggauuggcugggc

SEQ ID NO: 198807 - RNA, 22 nt, Homo sapiens
aaagugcugggauuuuaggcau

SEQ ID NO: 198808 - RNA, 22 nt, Homo sapiens
aaagugcuguagacugggcgca

SEQ ID NO: 198809 - RNA, 22 nt, Homo sapiens
aaagugcuuccuuuuugagggu

SEQ ID NO: 198810 - RNA, 22 nt, Homo sapiens
aaaguggugugaguauguaucu

SEQ ID NO: 198811 - RNA, 22 nt, Homo sapiens
aaaugcacagaaaggaugugga

SEQ ID NO: 198812 - RNA, 21 nt, Homo sapiens
aaaugcacauuacugcuggug

SEQ ID NO: 198813 - RNA, 22 nt, Homo sapiens
aaaugcaguugguggggauaug

SEQ ID NO: 198814 - RNA, 22 nt, Homo sapiens
aaaugcaucauuaggugauuuu

SEQ ID NO: 198815 - RNA, 22 nt, Homo sapiens
aaaugcaugaggugggaagaaa

SEQ ID NO: 198816 - RNA, 22 nt, Homo sapiens
aaauggauuaaguucacuugcu

SEQ ID NO: 198817 - RNA, 22 nt, Homo sapiens
aaaugggacugggguccuuuga

SEQ ID NO: 198818 - RNA, 22 nt, Homo sapiens
aaauugcuuuugaagacuuagu

SEQ ID NO: 198819 - RNA, 22 nt, Homo sapiens
aacacuaucugccuuacaggga

SEQ ID NO: 198820 - RNA, 22 nt, Homo sapiens
aacaggguguuugcaguuucuu

SEQ ID NO: 198821 - RNA, 22 nt, Homo sapiens
aacagugcauuccuguccauau

SEQ ID NO: 198822 - RNA, 22 nt, Homo sapiens
aacagugccugucauuuaguag

SEQ ID NO: 198823 - RNA, 21 nt, Homo sapiens
aacagugcugaacagacaccu

SEQ ID NO: 198824 - RNA, 22 nt, Homo sapiens
aacuggccuccuugggaaauua

SEQ ID NO: 198825 - RNA, 19 nt, Homo sapiens
aacuggugugagaugauau

SEQ ID NO: 198826 - RNA, 22 nt, Homo sapiens
aagaggcuguaggauaaugccu

SEQ ID NO: 198827 - RNA, 22 nt, Homo sapiens
aagagguuguaccuaaaguguu

SEQ ID NO: 198828 - RNA, 22 nt, Homo sapiens
aagaguuaguaaaauuuccucu

SEQ ID NO: 198829 - RNA, 22 nt, Homo sapiens
aagauauguuaguuauaaacuc

SEQ ID NO: 198830 - RNA, 22 nt, Homo sapiens
aagaugcagaagcccagauguu

SEQ ID NO: 198831 - RNA, 22 nt, Homo sapiens
aagaugcagucauacuggagga

SEQ ID NO: 198832 - RNA, 22 nt, Homo sapiens
aagcaugguuuccaggggucac

SEQ ID NO: 198833 - RNA, 22 nt, Homo sapiens
aagccacuguaccugucucuua

SEQ ID NO: 198834 - RNA, 22 nt, Homo sapiens
acagcacugccaagugacccau

SEQ ID NO: 198835 - RNA, 22 nt, Homo sapiens
acaggguuauuguaauaaugua

SEQ ID NO: 198836 - RNA, 22 nt, Homo sapiens
acagguacacagaauauccaga

SEQ ID NO: 198837 - RNA, 22 nt, Homo sapiens
acaguacaugauaaauaaggua

SEQ ID NO: 198838 - RNA, 22 nt, Homo sapiens
acaguagcgcaaucucggcuca

SEQ ID NO: 198839 - RNA, 22 nt, Homo sapiens
acagucuggagaaugggugcuc

SEQ ID NO: 198840 - RNA, 22 nt, Homo sapiens
acagugcuguggucaugggucu

SEQ ID NO: 198841 - RNA, 19 nt, Homo sapiens
acagugcuuugucagaagc

SEQ ID NO: 198842 - RNA, 22 nt, Homo sapiens
acagugcuuuuguuccucuccu

SEQ ID NO: 198843 - RNA, 22 nt, Homo sapiens
acagugucugacacguaggaag

SEQ ID NO: 198844 - RNA, 18 nt, Homo sapiens
acaguguguaaggguucu

SEQ ID NO: 198845 - RNA, 22 nt, Homo sapiens
acaguguguguguucaccuaga

SEQ ID NO: 198846 - RNA, 22 nt, Homo sapiens
acaguguuccuuuguugugacu

SEQ ID NO: 198847 - RNA, 22 nt, Homo sapiens
acauagaguaguggugaggaug

SEQ ID NO: 198848 - RNA, 22 nt, Homo sapiens
acauaguagacacugaaaauau

SEQ ID NO: 198849 - RNA, 22 nt, Homo sapiens
acaugacauugggguggggaua

SEQ ID NO: 198850 - RNA, 22 nt, Homo sapiens
accaccacucccgcauucuaaa

SEQ ID NO: 198851 - RNA, 22 nt, Homo sapiens
accagucucagguaugucuuua

SEQ ID NO: 198852 - RNA, 22 nt, Homo sapiens
acccaguagucauucaggagca

SEQ ID NO: 198853 - RNA, 22 nt, Homo sapiens
acccaguguucaacauucacau

SEQ ID NO: 198854 - RNA, 23 nt, Homo sapiens
accccuacaggcuuguguccugc

SEQ ID NO: 198855 - RNA, 22 nt, Homo sapiens
acccuugaguguguuucaggca

SEQ ID NO: 198856 - RNA, 22 nt, Homo sapiens
accucagcccggggaaguugag

SEQ ID NO: 198857 - RNA, 22 nt, Homo sapiens
accugagauuacaggugcuggc

SEQ ID NO: 198858 - RNA, 22 nt, Homo sapiens
accuggguguauguucaguuug

SEQ ID NO: 198859 - RNA, 19 nt, Homo sapiens
accuguagaaaguacaaca

SEQ ID NO: 198860 - RNA, 18 nt, Homo sapiens
accuucauuccuuugccu

SEQ ID NO: 198861 - RNA, 22 nt, Homo sapiens
acuacaugugaugucaguauau

SEQ ID NO: 198862 - RNA, 22 nt, Homo sapiens
acucagagaacauucccagucu

SEQ ID NO: 198863 - RNA, 22 nt, Homo sapiens
acugacaugaucaggcauguuc

SEQ ID NO: 198864 - RNA, 21 nt, Homo sapiens
acugagagaucuggggcacau

SEQ ID NO: 198865 - RNA, 20 nt, Homo sapiens
acugauauguuccuguucuc

SEQ ID NO: 198866 - RNA, 22 nt, Homo sapiens
acugcacuccagcccaggugac

SEQ ID NO: 198867 - RNA, 22 nt, Homo sapiens
acugcacuccagccucggcaau

SEQ ID NO: 198868 - RNA, 22 nt, Homo sapiens
acugcacuccagccucgugaca

SEQ ID NO: 198869 - RNA, 22 nt, Homo sapiens
acugcacuccagccucguggac

SEQ ID NO: 198870 - RNA, 22 nt, Homo sapiens
acuggcucugcuuuacaaacag

SEQ ID NO: 198871 - RNA, 21 nt, Homo sapiens
acuuucuguggcaguccauuc

SEQ ID NO: 198872 - RNA, 17 nt, Homo sapiens
acuuuuugaggaggcau

SEQ ID NO: 198873 - RNA, 22 nt, Homo sapiens
acuuuuugcaaccauuuggacc

SEQ ID NO: 198874 - RNA, 22 nt, Homo sapiens
agaaacauucucuugccuccuu

SEQ ID NO: 198875 - RNA, 22 nt, Homo sapiens
agaacacugaguucagggucag

SEQ ID NO: 198876 - RNA, 22 nt, Homo sapiens
agaauguuuuagaccaauacaa

SEQ ID NO: 198877 - RNA, 22 nt, Homo sapiens
agacacuguugaaaaggcccca

SEQ ID NO: 198878 - RNA, 22 nt, Homo sapiens
agagauaaagauuuuaauuuug

SEQ ID NO: 198879 - RNA, 22 nt, Homo sapiens
agagauacauucugagaagugc

SEQ ID NO: 198880 - RNA, 22 nt, Homo sapiens
agagauaguuuccaacucauac

SEQ ID NO: 198881 - RNA, 22 nt, Homo sapiens
agagaugauuaacauuuuggua

SEQ ID NO: 198882 - RNA, 20 nt, Homo sapiens
agagcaaagccgcaccccua

SEQ ID NO: 198883 - RNA, 22 nt, Homo sapiens
agagcacugcugcaggguucug

SEQ ID NO: 198884 - RNA, 22 nt, Homo sapiens
agagccacacucuccuaacuca

SEQ ID NO: 198885 - RNA, 22 nt, Homo sapiens
agaggaguacuacuccaagucu

SEQ ID NO: 198886 - RNA, 22 nt, Homo sapiens
agagguagaagauaggcuacag

SEQ ID NO: 198887 - RNA, 22 nt, Homo sapiens
agaggucuuaucaaacaugcuu

SEQ ID NO: 198888 - RNA, 22 nt, Homo sapiens
agaguacugacguuugcaaauu

SEQ ID NO: 198889 - RNA, 22 nt, Homo sapiens
agaguaguuucuauauucuuca

SEQ ID NO: 198890 - RNA, 22 nt, Homo sapiens
agagugaagcuuuuuauauucu

SEQ ID NO: 198891 - RNA, 20 nt, Homo sapiens
agagugcugucuguccugag

SEQ ID NO: 198892 - RNA, 22 nt, Homo sapiens
agaucacaguaccguaaggcug

SEQ ID NO: 198893 - RNA, 22 nt, Homo sapiens
agaucauaugcaguaaugaacu

SEQ ID NO: 198894 - RNA, 22 nt, Homo sapiens
agaugauguuucuggcacauga

SEQ ID NO: 198895 - RNA, 22 nt, Homo sapiens
agaugcauugguggcauauuca

SEQ ID NO: 198896 - RNA, 22 nt, Homo sapiens
agauggguuuucacauguuggc

SEQ ID NO: 198897 - RNA, 22 nt, Homo sapiens
agauggugauaaaugugguacc

SEQ ID NO: 198898 - RNA, 18 nt, Homo sapiens
agaugguguugcuucugu

SEQ ID NO: 198899 - RNA, 22 nt, Homo sapiens
agaugguguuuucucaccagau

SEQ ID NO: 198900 - RNA, 22 nt, Homo sapiens
agcaaaucuaugaauguauauu

SEQ ID NO: 198901 - RNA, 22 nt, Homo sapiens
agcaacauuuuugaccuuucuu

SEQ ID NO: 198902 - RNA, 22 nt, Homo sapiens
agcaagauuguucccauuuucu

SEQ ID NO: 198903 - RNA, 19 nt, Homo sapiens
agcagaacaaauguguggg

SEQ ID NO: 198904 - RNA, 22 nt, Homo sapiens
agcagcauauuuuuauaaugua

SEQ ID NO: 198905 - RNA, 22 nt, Homo sapiens
agcagcaugcaaauggacuaau

SEQ ID NO: 198906 - RNA, 22 nt, Homo sapiens
agcagcauggguauaaaucucc

SEQ ID NO: 198907 - RNA, 22 nt, Homo sapiens
agcagcauuaugauauaucuua

SEQ ID NO: 198908 - RNA, 22 nt, Homo sapiens
agcagcuuugaucugaaugauu

SEQ ID NO: 198909 - RNA, 22 nt, Homo sapiens
agcagcuuugcauggccugugg

SEQ ID NO: 198910 - RNA, 22 nt, Homo sapiens
agugccauggcugcuagauggc

SEQ ID NO: 198911 - RNA, 22 nt, Homo sapiens
agugcuuguacaaaccccgagg

SEQ ID NO: 198912 - RNA, 22 nt, Homo sapiens
aguggcacaauuuugacucccc

SEQ ID NO: 198913 - RNA, 22 nt, Homo sapiens
aguguuuuuaacaagaaagggu

SEQ ID NO: 198914 - RNA, 22 nt, Homo sapiens
auaaacagcuuauccucuauuc

SEQ ID NO: 198915 - RNA, 22 nt, Homo sapiens
auaaagccaugagcuugagaug

SEQ ID NO: 198916 - RNA, 22 nt, Homo sapiens
auaaagguaauaauaguugcau

SEQ ID NO: 198917 - RNA, 22 nt, Homo sapiens
auaaaguucugcuggcauauau

SEQ ID NO: 198918 - RNA, 22 nt, Homo sapiens
auaaaugcuuccagucauuaaa

SEQ ID NO: 198919 - RNA, 22 nt, Homo sapiens
auaacauggaguuugucauuua

SEQ ID NO: 198920 - RNA, 22 nt, Homo sapiens
auaagaagugaaccagacgucu

SEQ ID NO: 198921 - RNA, 22 nt, Homo sapiens
auaagagcaggcuucuggccag

SEQ ID NO: 198922 - RNA, 22 nt, Homo sapiens
auaagaguaguacauaugagac

SEQ ID NO: 198923 - RNA, 22 nt, Homo sapiens
auaagcuaagaguuucugggcu

SEQ ID NO: 198924 - RNA, 22 nt, Homo sapiens
auaaggaguaucauauuaaaac

SEQ ID NO: 198925 - RNA, 22 nt, Homo sapiens
auaagucaauggaacagauuaa

SEQ ID NO: 198926 - RNA, 22 nt, Homo sapiens
auaagugcuuguugaauaauag

SEQ ID NO: 198927 - RNA, 22 nt, Homo sapiens
auaauacugggaagaugagcau

SEQ ID NO: 198928 - RNA, 22 nt, Homo sapiens
auaauagcugaucauuuagaag

SEQ ID NO: 198929 - RNA, 22 nt, Homo sapiens
auaauagguugauugacauugc

SEQ ID NO: 198930 - RNA, 22 nt, Homo sapiens
auaaucacacccagguuaaaug

SEQ ID NO: 198931 - RNA, 22 nt, Homo sapiens
auacacuggagcaaaccuggag

SEQ ID NO: 198932 - RNA, 22 nt, Homo sapiens
auacagcuaaaauauuaaguua

SEQ ID NO: 198933 - RNA, 22 nt, Homo sapiens
auacaguguucugggaagaagu

SEQ ID NO: 198934 - RNA, 22 nt, Homo sapiens
auacaugugccaugcuggugug

SEQ ID NO: 198935 - RNA, 22 nt, Homo sapiens
auacauguuucauguuggugug

SEQ ID NO: 198936 - RNA, 22 nt, Homo sapiens
auacccaguaguggaauugcua

SEQ ID NO: 198937 - RNA, 22 nt, Homo sapiens
auacuagucaagaauguaugag

SEQ ID NO: 198938 - RNA, 22 nt, Homo sapiens
auacuguauaggauuguagccu

SEQ ID NO: 198939 - RNA, 20 nt, Homo sapiens
auagaagacuagugcagcag

SEQ ID NO: 198940 - RNA, 23 nt, Homo sapiens
auagagcuaggaugcagacagau

SEQ ID NO: 198941 - RNA, 20 nt, Homo sapiens
auagcauugauggacucaaa

SEQ ID NO: 198942 - RNA, 22 nt, Homo sapiens
auaguauaguugaggauggcau

SEQ ID NO: 198943 - RNA, 22 nt, Homo sapiens
auagucaguagucucauaauga

SEQ ID NO: 198944 - RNA, 22 nt, Homo sapiens
auagugcagugaugaaccuagg

SEQ ID NO: 198945 - RNA, 21 nt, Homo sapiens
auagugcuagagaguagcagg

SEQ ID NO: 198946 - RNA, 22 nt, Homo sapiens
auagugcuauggcagaccuuga

SEQ ID NO: 198947 - RNA, 22 nt, Homo sapiens
auagugcugcaagaaacauacg

SEQ ID NO: 198948 - RNA, 22 nt, Homo sapiens
auagugcugcaauaaacauaca

SEQ ID NO: 198949 - RNA, 22 nt, Homo sapiens
auagugcugcauuaaacauacg

SEQ ID NO: 198950 - RNA, 22 nt, Homo sapiens
auagugcuggaauaaauauacg

SEQ ID NO: 198951 - RNA, 22 nt, Homo sapiens
auagugcuguauuaaacauacg

SEQ ID NO: 198952 - RNA, 22 nt, Homo sapiens
auaguggcaugaucauagcuca

SEQ ID NO: 198953 - RNA, 22 nt, Homo sapiens
auauagcucuggcuggaugacu

SEQ ID NO: 198954 - RNA, 22 nt, Homo sapiens
auauauguuuucugggaagaaa

SEQ ID NO: 198955 - RNA, 22 nt, Homo sapiens
auaugcacgugcauacacacuu

SEQ ID NO: 198956 - RNA, 20 nt, Homo sapiens
auaugcagacacauacauac

SEQ ID NO: 198957 - RNA, 22 nt, Homo sapiens
auaugcauacauguaugcagga

SEQ ID NO: 198958 - RNA, 22 nt, Homo sapiens
auauggcauucagaacuguaua

SEQ ID NO: 198959 - RNA, 22 nt, Homo sapiens
auaugguuuuuggaagcauauc

SEQ ID NO: 198960 - RNA, 22 nt, Homo sapiens
auaugucuguuuagucuguaau

SEQ ID NO: 198961 - RNA, 22 nt, Homo sapiens
auaugucuuaguuaccuugggc

SEQ ID NO: 198962 - RNA, 22 nt, Homo sapiens
aucaaguaaucugaguaagagu

SEQ ID NO: 198963 - RNA, 22 nt, Homo sapiens
aucacagcccuccucuuggaug

SEQ ID NO: 198964 - RNA, 22 nt, Homo sapiens
aucacagcuacuccucugucuu

SEQ ID NO: 198965 - RNA, 22 nt, Homo sapiens
aucacaggucaaaucauuauuu

SEQ ID NO: 198966 - RNA, 16 nt, Homo sapiens
aucacuugcuucuuuu

SEQ ID NO: 198967 - RNA, 22 nt, Homo sapiens
aucagaaucucuagugggacca

SEQ ID NO: 198968 - RNA, 22 nt, Homo sapiens
aucagauggcuaaaacagaaga

SEQ ID NO: 198969 - RNA, 18 nt, Homo sapiens
aucagggugaagagagga

SEQ ID NO: 198970 - RNA, 22 nt, Homo sapiens
aucaucacaguuguguguaaug

SEQ ID NO: 198971 - RNA, 22 nt, Homo sapiens
aucaucaugcacuacagccugg

SEQ ID NO: 198972 - RNA, 22 nt, Homo sapiens
aucauugugugaguugauggga

SEQ ID NO: 198973 - RNA, 22 nt, Homo sapiens
auccaagagacugaugacuucc

SEQ ID NO: 198974 - RNA, 22 nt, Homo sapiens
auccacagugucaauguuguga

SEQ ID NO: 198975 - RNA, 22 nt, Homo sapiens
aucccaguucagccucugacac

SEQ ID NO: 198976 - RNA, 22 nt, Homo sapiens
aucccuuucugauacuuucccu

SEQ ID NO: 198977 - RNA, 22 nt, Homo sapiens
auccugaagcuuuacugaauuc

SEQ ID NO: 198978 - RNA, 22 nt, Homo sapiens
auccugagacuuuucugaaguu

SEQ ID NO: 198979 - RNA, 22 nt, Homo sapiens
auccuguacuaagguuuuccca

SEQ ID NO: 198980 - RNA, 22 nt, Homo sapiens
aucgcaccauugcacuccagca

SEQ ID NO: 198981 - RNA, 22 nt, Homo sapiens
aucgcgccauuguacuccagcc

SEQ ID NO: 198982 - RNA, 22 nt, Homo sapiens
aucucaguuaaugacccuaugc

SEQ ID NO: 198983 - RNA, 22 nt, Homo sapiens
aucucauggagguagagaguaa

SEQ ID NO: 198984 - RNA, 22 nt, Homo sapiens
aucuccaggugccagcugcgcc

SEQ ID NO: 198985 - RNA, 22 nt, Homo sapiens
augguagacucucgggucaugg

SEQ ID NO: 198986 - RNA, 22 nt, Homo sapiens
augguauggaaggucuggagga

SEQ ID NO: 198987 - RNA, 22 nt, Homo sapiens
augguauuuaacagucuuucua

SEQ ID NO: 198988 - RNA, 22 nt, Homo sapiens
auggugugugaauuaaauguua

SEQ ID NO: 198989 - RNA, 22 nt, Homo sapiens
augguuuuacugcaaaauggga

SEQ ID NO: 198990 - RNA, 22 nt, Homo sapiens
auguaaacauuuggucuaaauu

SEQ ID NO: 198991 - RNA, 22 nt, Homo sapiens
auguaguaugaagaagaugcuu

SEQ ID NO: 198992 - RNA, 22 nt, Homo sapiens
auguauggagauauuuuugguu

SEQ ID NO: 198993 - RNA, 22 nt, Homo sapiens
augucauagaagccugugaacc

SEQ ID NO: 198994 - RNA, 22 nt, Homo sapiens
augucuagagcaagagaugcug

SEQ ID NO: 198995 - RNA, 22 nt, Homo sapiens
augucugguagccaccuggagg

SEQ ID NO: 198996 - RNA, 22 nt, Homo sapiens
augugaacugaauuaauucaca

SEQ ID NO: 198997 - RNA, 22 nt, Homo sapiens
augugacugauggagaauaugu

SEQ ID NO: 198998 - RNA, 22 nt, Homo sapiens
augugacuugugaaaaguucag

SEQ ID NO: 198999 - RNA, 22 nt, Homo sapiens
augugcaagaucauuaaagcuc

SEQ ID NO: 199000 - RNA, 22 nt, Homo sapiens
augugcauaugaagcacagaca

SEQ ID NO: 199001 - RNA, 22 nt, Homo sapiens
augugccauucucauggcgcuu

SEQ ID NO: 199002 - RNA, 22 nt, Homo sapiens
auguggcauuucucauucauuu

SEQ ID NO: 199003 - RNA, 22 nt, Homo sapiens
augugguaggcccaugagucau

SEQ ID NO: 199004 - RNA, 19 nt, Homo sapiens
augugguuagcaugacugc

SEQ ID NO: 199005 - RNA, 22 nt, Homo sapiens
augugugcuugauguaaaaagu

SEQ ID NO: 199006 - RNA, 22 nt, Homo sapiens
augugugcuugugacacagccu

SEQ ID NO: 199007 - RNA, 22 nt, Homo sapiens
auguguucaucacagcacaauu

SEQ ID NO: 199008 - RNA, 22 nt, Homo sapiens
auguuagcaucuggcacuaugg

SEQ ID NO: 199009 - RNA, 22 nt, Homo sapiens
auuaacaucuagaguuuuggug

SEQ ID NO: 199010 - RNA, 22 nt, Homo sapiens
auuaagugaaugaaguuguucc

SEQ ID NO: 199011 - RNA, 22 nt, Homo sapiens
auuaaguuaggauuuugagaua

SEQ ID NO: 199012 - RNA, 22 nt, Homo sapiens
auuaaguugugccugaaaacuu

SEQ ID NO: 199013 - RNA, 21 nt, Homo sapiens
auuaaugcucugguuagaggc

SEQ ID NO: 199014 - RNA, 22 nt, Homo sapiens
auuacaugucuauccaugaaca

SEQ ID NO: 199015 - RNA, 22 nt, Homo sapiens
auuacuuugcaccaaccuaaua

SEQ ID NO: 199016 - RNA, 22 nt, Homo sapiens
auuagguauuuucuggacaggg

SEQ ID NO: 199017 - RNA, 22 nt, Homo sapiens
auuauaguguauacuugaaauu

SEQ ID NO: 199018 - RNA, 22 nt, Homo sapiens
auuauaugucaucacagacacc

SEQ ID NO: 199019 - RNA, 22 nt, Homo sapiens
auucaagggauuucaggaggcu

SEQ ID NO: 199020 - RNA, 23 nt, Homo sapiens
auucaaguagugagagugguuau

SEQ ID NO: 199021 - RNA, 22 nt, Homo sapiens
auucaucagggauauugguuga

SEQ ID NO: 199022 - RNA, 22 nt, Homo sapiens
auuccaguuguaagguuuuuca

SEQ ID NO: 199023 - RNA, 22 nt, Homo sapiens
auuccauagugucuguggcaga

SEQ ID NO: 199024 - RNA, 22 nt, Homo sapiens
auugaacuuacuaucuaaacua

SEQ ID NO: 199025 - RNA, 22 nt, Homo sapiens
auugacuugauauauagcugau

SEQ ID NO: 199026 - RNA, 21 nt, Homo sapiens
auugagcacaugaaacauggc

SEQ ID NO: 199027 - RNA, 22 nt, Homo sapiens
auugaggcaggaggaccaucua

SEQ ID NO: 199028 - RNA, 22 nt, Homo sapiens
auugauagaucauaugguaggu

SEQ ID NO: 199029 - RNA, 22 nt, Homo sapiens
auugauaguuuaauaggaauug

SEQ ID NO: 199030 - RNA, 22 nt, Homo sapiens
auugcaaagcguagacucuaaa

SEQ ID NO: 199031 - RNA, 22 nt, Homo sapiens
auugcaaugggaaacuaugaaa

SEQ ID NO: 199032 - RNA, 22 nt, Homo sapiens
auugcaauuaguccauagaguu

SEQ ID NO: 199033 - RNA, 22 nt, Homo sapiens
auugcacaaagagggaaacuga

SEQ ID NO: 199034 - RNA, 22 nt, Homo sapiens
auugcacuccacccugggcaac

SEQ ID NO: 199035 - RNA, 22 nt, Homo sapiens
auugcacuccagucugggcaac

SEQ ID NO: 199036 - RNA, 22 nt, Homo sapiens
auugcacuccauccugggcaau

SEQ ID NO: 199037 - RNA, 22 nt, Homo sapiens
auugcagcuugcagggugugua

SEQ ID NO: 199038 - RNA, 19 nt, Homo sapiens
auugcaguguaaaacuauu

SEQ ID NO: 199039 - RNA, 22 nt, Homo sapiens
auugcaguuagaacagaagucu

SEQ ID NO: 199040 - RNA, 22 nt, Homo sapiens
auugcuucugauuuuaaaugag

SEQ ID NO: 199041 - RNA, 22 nt, Homo sapiens
auuggcaauccauauauuuucu

SEQ ID NO: 199042 - RNA, 22 nt, Homo sapiens
auuggcagaaaucuuuauagua

SEQ ID NO: 199043 - RNA, 22 nt, Homo sapiens
auugucacccgggcaguaagca

SEQ ID NO: 199044 - RNA, 22 nt, Homo sapiens
auugucauuuauaacuguguag

SEQ ID NO: 199045 - RNA, 22 nt, Homo sapiens
auuguuccccggucauuuuugu

SEQ ID NO: 199046 - RNA, 22 nt, Homo sapiens
auuguucuuacaugcugucauc

SEQ ID NO: 199047 - RNA, 22 nt, Homo sapiens
auuguucuuguguccuuuuccu

SEQ ID NO: 199048 - RNA, 22 nt, Homo sapiens
auuuagcaauggagguagugua

SEQ ID NO: 199049 - RNA, 22 nt, Homo sapiens
auuucuacuccuguguccagaa

SEQ ID NO: 199050 - RNA, 22 nt, Homo sapiens
auuuggcaguauaaugcuuugg

SEQ ID NO: 199051 - RNA, 22 nt, Homo sapiens
auuuggcagugaagggaucaca

SEQ ID NO: 199052 - RNA, 22 nt, Homo sapiens
auuugggaaugugcauuauacu

SEQ ID NO: 199053 - RNA, 22 nt, Homo sapiens
auuuugcauugcuguaaaggaa

SEQ ID NO: 199054 - RNA, 22 nt, Homo sapiens
auuuugguuacauaguugagcu

SEQ ID NO: 199055 - RNA, 21 nt, Homo sapiens
auuuuugcagagcugguagug

SEQ ID NO: 199056 - RNA, 22 nt, Homo sapiens
auuuuugguugguaggcuauua

SEQ ID NO: 199057 - RNA, 22 nt, Homo sapiens
caaagcuauagcaccagaggga

SEQ ID NO: 199058 - RNA, 22 nt, Homo sapiens
caaaggauucauuuccaggagu

SEQ ID NO: 199059 - RNA, 22 nt, Homo sapiens
caaaggcuguuauaggccagga

SEQ ID NO: 199060 - RNA, 22 nt, Homo sapiens
uauuauuguccuucuauaccca

SEQ ID NO: 199061 - RNA, 20 nt, Homo sapiens
uauucacucuccagucuugc

SEQ ID NO: 199062 - RNA, 22 nt, Homo sapiens
uauugacuuuuuuguuaggagg

SEQ ID NO: 199063 - RNA, 22 nt, Homo sapiens
uauugauuuucaguguucagcu

SEQ ID NO: 199064 - RNA, 23 nt, Homo sapiens
uauugcacuaugguaacccuuuu

SEQ ID NO: 199065 - RNA, 22 nt, Homo sapiens
uauugcacuuuuccauaggagu

SEQ ID NO: 199066 - RNA, 22 nt, Homo sapiens
uauugccuugccuacuuuucca

SEQ ID NO: 199067 - RNA, 22 nt, Homo sapiens
uauugcuaaaacucaugguugc

SEQ ID NO: 199068 - RNA, 22 nt, Homo sapiens
uauugcuccccauaucgcagug

SEQ ID NO: 199069 - RNA, 22 nt, Homo sapiens
uauugcuggauguauuacaugu

SEQ ID NO: 199070 - RNA, 22 nt, Homo sapiens
uauugcuggcacauaguagguc

SEQ ID NO: 199071 - RNA, 18 nt, Homo sapiens
uauugcuugguuuggaga

SEQ ID NO: 199072 - RNA, 22 nt, Homo sapiens
uauugcuuuuaacccaaucucu

SEQ ID NO: 199073 - RNA, 22 nt, Homo sapiens
uauuguuaaagauguuaaugau

SEQ ID NO: 199074 - RNA, 22 nt, Homo sapiens
uauuugauuaacaagagccuaa

SEQ ID NO: 199075 - RNA, 22 nt, Homo sapiens
uauuugguagcuauuuugcagu

SEQ ID NO: 199076 - RNA, 22 nt, Homo sapiens
ucaaacauccccaccagggacu

SEQ ID NO: 199077 - RNA, 22 nt, Homo sapiens
ucaaacugcuugaggccauuua

SEQ ID NO: 199078 - RNA, 22 nt, Homo sapiens
ucaaagugacaaaguugcagca

SEQ ID NO: 199079 - RNA, 21 nt, Homo sapiens
ucaaaguguucuuuuguugaa

SEQ ID NO: 199080 - RNA, 22 nt, Homo sapiens
ucaaaugauucuccugccucag

SEQ ID NO: 199081 - RNA, 22 nt, Homo sapiens
ucaacagugauggaaaguuaua

SEQ ID NO: 199082 - RNA, 22 nt, Homo sapiens
ucaaguacugccuugcucuggc

SEQ ID NO: 199083 - RNA, 22 nt, Homo sapiens
ucaaguacuuauuugauaauua

SEQ ID NO: 199084 - RNA, 19 nt, Homo sapiens
ucacacuguggcuucuuua

SEQ ID NO: 199085 - RNA, 22 nt, Homo sapiens
ucacagauaaauaaagaugauu

SEQ ID NO: 199086 - RNA, 21 nt, Homo sapiens
ucacagccuaggaccugaaga

SEQ ID NO: 199087 - RNA, 22 nt, Homo sapiens
ucacagcuaaaaugaaaguagu

SEQ ID NO: 199088 - RNA, 22 nt, Homo sapiens
ucacaguauucaugaacaugga

SEQ ID NO: 199089 - RNA, 22 nt, Homo sapiens
ucacagucugcgugaugagaca

SEQ ID NO: 199090 - RNA, 23 nt, Homo sapiens
ucacaguuacuuuugcaucaacc

SEQ ID NO: 199091 - RNA, 22 nt, Homo sapiens
ucacaguucagcauggcugagg

SEQ ID NO: 199092 - RNA, 22 nt, Homo sapiens
ucacaguugauugaaacacagc

SEQ ID NO: 199093 - RNA, 22 nt, Homo sapiens
ucacaguuggccuggccuuuua

SEQ ID NO: 199094 - RNA, 22 nt, Homo sapiens
ucacaugugaagauugggagua

SEQ ID NO: 199095 - RNA, 20 nt, Homo sapiens
ucacccugacaucugcccag

SEQ ID NO: 199096 - RNA, 21 nt, Homo sapiens
ucaccuguagcugcauguucu

SEQ ID NO: 199097 - RNA, 22 nt, Homo sapiens
ucacgcugcugcaaccagccug

SEQ ID NO: 199098 - RNA, 18 nt, Homo sapiens
ucacggggagcagcagcc

SEQ ID NO: 199099 - RNA, 22 nt, Homo sapiens
ucacucagaccuggugauaugc

SEQ ID NO: 199100 - RNA, 21 nt, Homo sapiens
ucacugagcaucaugguuuca

SEQ ID NO: 199101 - RNA, 22 nt, Homo sapiens
ucacugagcuagaucacuugac

SEQ ID NO: 199102 - RNA, 20 nt, Homo sapiens
ucacugaguaucuacgauua

SEQ ID NO: 199103 - RNA, 20 nt, Homo sapiens
ucacugagugguccacagua

SEQ ID NO: 199104 - RNA, 22 nt, Homo sapiens
ucacugcacuccagccuuuaug

SEQ ID NO: 199105 - RNA, 22 nt, Homo sapiens
ucacuggacagaaauaaaggug

SEQ ID NO: 199106 - RNA, 20 nt, Homo sapiens
ucacuggagcucauuugauu

SEQ ID NO: 199107 - RNA, 22 nt, Homo sapiens
ucacuggagguuccugaaguuc

SEQ ID NO: 199108 - RNA, 22 nt, Homo sapiens
ucacugggagcauuugagccuu

SEQ ID NO: 199109 - RNA, 22 nt, Homo sapiens
ucacuggucuaaguggaggggg

SEQ ID NO: 199110 - RNA, 22 nt, Homo sapiens
ucacuugguggcaaaguuuaug

SEQ ID NO: 199111 - RNA, 22 nt, Homo sapiens
ucagacacugagcaaacgacua

SEQ ID NO: 199112 - RNA, 22 nt, Homo sapiens
ucagaguagcugucugaggugc

SEQ ID NO: 199113 - RNA, 19 nt, Homo sapiens
ucagaugcauuagggguua

SEQ ID NO: 199114 - RNA, 22 nt, Homo sapiens
ucagcaguggacagaaugguag

SEQ ID NO: 199115 - RNA, 21 nt, Homo sapiens
ucagcucaucacugccuggag

SEQ ID NO: 199116 - RNA, 22 nt, Homo sapiens
ucaggcaccuuccucuuaucug

SEQ ID NO: 199117 - RNA, 22 nt, Homo sapiens
ucagguaucuucauagcaaugc

SEQ ID NO: 199118 - RNA, 22 nt, Homo sapiens
ucagguauuucuuuuagcugug

SEQ ID NO: 199119 - RNA, 22 nt, Homo sapiens
ucagguccuuacugugcucccu

SEQ ID NO: 199120 - RNA, 22 nt, Homo sapiens
ucaggugcaguggcucaugcuu

SEQ ID NO: 199121 - RNA, 22 nt, Homo sapiens
ucaggugcaguggcucugaccu

SEQ ID NO: 199122 - RNA, 22 nt, Homo sapiens
ucaguaccugagagugggcaga

SEQ ID NO: 199123 - RNA, 23 nt, Homo sapiens
ucaguagucauugggaaagugug

SEQ ID NO: 199124 - RNA, 22 nt, Homo sapiens
ucagucauguuuaccagacgua

SEQ ID NO: 199125 - RNA, 22 nt, Homo sapiens
ucagugaauguuggccacuacu

SEQ ID NO: 199126 - RNA, 22 nt, Homo sapiens
ucagugacugcugcuuguauac

SEQ ID NO: 199127 - RNA, 17 nt, Homo sapiens
ucagugcauuuaagaga

SEQ ID NO: 199128 - RNA, 22 nt, Homo sapiens
ucagugccauugccauaugagu

SEQ ID NO: 199129 - RNA, 21 nt, Homo sapiens
ucagugcugugggcaaggugc

SEQ ID NO: 199130 - RNA, 22 nt, Homo sapiens
ucagugcuuggcacagagagcu

SEQ ID NO: 199131 - RNA, 22 nt, Homo sapiens
ucagugguuaaaagauucuaga

SEQ ID NO: 199132 - RNA, 22 nt, Homo sapiens
ucagugucugugauggagaggu

SEQ ID NO: 199133 - RNA, 22 nt, Homo sapiens
ucaguuaaugcugccugcugga

SEQ ID NO: 199134 - RNA, 21 nt, Homo sapiens
ucauaagcucaacaucuguag

SEQ ID NO: 199135 - RNA, 22 nt, Homo sapiens
ucauacuguuaaaugguuuagu

SEQ ID NO: 199136 - RNA, 23 nt, Homo sapiens
ucuggcuuugggaugcucaaggg

SEQ ID NO: 199137 - RNA, 22 nt, Homo sapiens
ucugguuccugcauucauucaa

SEQ ID NO: 199138 - RNA, 22 nt, Homo sapiens
ucugucacugguggacgaucac

SEQ ID NO: 199139 - RNA, 22 nt, Homo sapiens
ucugugaaugaacacuugaaaa

SEQ ID NO: 199140 - RNA, 22 nt, Homo sapiens
ucugugcauuacacuuuucuca

SEQ ID NO: 199141 - RNA, 22 nt, Homo sapiens
ucugugcauuguaacaacuaaa

SEQ ID NO: 199142 - RNA, 22 nt, Homo sapiens
ucugugcggucuguguuaugaa

SEQ ID NO: 199143 - RNA, 22 nt, Homo sapiens
ucugugcuugucauaugcuuug

SEQ ID NO: 199144 - RNA, 22 nt, Homo sapiens
ucuguggucagaguccuuggcc

SEQ ID NO: 199145 - RNA, 22 nt, Homo sapiens
ucuguguugaugcucauuaauu

SEQ ID NO: 199146 - RNA, 22 nt, Homo sapiens
ucuguguuugaucaagauugua

SEQ ID NO: 199147 - RNA, 20 nt, Homo sapiens
ucuugaacuuagucaacagg

SEQ ID NO: 199148 - RNA, 22 nt, Homo sapiens
ucuuggguggauucauucuuuc

SEQ ID NO: 199149 - RNA, 22 nt, Homo sapiens
ucuuggguuguuggcuucuccu

SEQ ID NO: 199150 - RNA, 22 nt, Homo sapiens
ucuugguuuauugauggagagg

SEQ ID NO: 199151 - RNA, 22 nt, Homo sapiens
ucuugucacugcauccccagcu

SEQ ID NO: 199152 - RNA, 22 nt, Homo sapiens
ucuuugaguguauacuuagauu

SEQ ID NO: 199153 - RNA, 22 nt, Homo sapiens
ucuuugaguuauugugcagacu

SEQ ID NO: 199154 - RNA, 22 nt, Homo sapiens
ucuuugauguucugaaagaugg

SEQ ID NO: 199155 - RNA, 22 nt, Homo sapiens
ucuuugauuaugcagauggguu

SEQ ID NO: 199156 - RNA, 19 nt, Homo sapiens
ucuuugcuuuucuaagagg

SEQ ID NO: 199157 - RNA, 22 nt, Homo sapiens
ucuuuggagacaaccccagucu

SEQ ID NO: 199158 - RNA, 22 nt, Homo sapiens
ucuuugguaauggaugucugau

SEQ ID NO: 199159 - RNA, 22 nt, Homo sapiens
ucuuugguaggaguaggaggcc

SEQ ID NO: 199160 - RNA, 22 nt, Homo sapiens
ucuuugguaugugcaugugcuu

SEQ ID NO: 199161 - RNA, 22 nt, Homo sapiens
ucuuuggucagaaagauuacac

SEQ ID NO: 199162 - RNA, 22 nt, Homo sapiens
ucuuuguuuucugauccugaag

SEQ ID NO: 199163 - RNA, 22 nt, Homo sapiens
ucuuuugugagucagccucucc

SEQ ID NO: 199164 - RNA, 22 nt, Homo sapiens
ucuuuuguucuauucaggccuu

SEQ ID NO: 199165 - RNA, 22 nt, Homo sapiens
ugaaaaguuguugaaggcuuca

SEQ ID NO: 199166 - RNA, 22 nt, Homo sapiens
ugaaacacaccuccucuccauc

SEQ ID NO: 199167 - RNA, 18 nt, Homo sapiens
ugaaacacauuuuuuccu

SEQ ID NO: 199168 - RNA, 22 nt, Homo sapiens
ugaaagcuacaggaaaguauuu

SEQ ID NO: 199169 - RNA, 22 nt, Homo sapiens
ugaaagguauagguucuggagg

SEQ ID NO: 199170 - RNA, 22 nt, Homo sapiens
ugaaaguaauugcaguuuuuac

SEQ ID NO: 199171 - RNA, 22 nt, Homo sapiens
ugaaauacuuaauuucuccaug

SEQ ID NO: 199172 - RNA, 22 nt, Homo sapiens
ugaaaucauguaguuauugcaa

SEQ ID NO: 199173 - RNA, 22 nt, Homo sapiens
ugaaaugguuaugugaggagau

SEQ ID NO: 199174 - RNA, 22 nt, Homo sapiens
ugaaaugucuuuaggaggcuuc

SEQ ID NO: 199175 - RNA, 22 nt, Homo sapiens
ugaaauguuaaacaaguggcuc

SEQ ID NO: 199176 - RNA, 22 nt, Homo sapiens
ugaaauuauucuuaccaaggug

SEQ ID NO: 199177 - RNA, 22 nt, Homo sapiens
ugaaauuguuugcaaggauagg

SEQ ID NO: 199178 - RNA, 22 nt, Homo sapiens
ugaacacaucuccugguaccug

SEQ ID NO: 199179 - RNA, 22 nt, Homo sapiens
ugaagacucaguuugagggaca

SEQ ID NO: 199180 - RNA, 22 nt, Homo sapiens
ugaaggacauucuaugguagau

SEQ ID NO: 199181 - RNA, 22 nt, Homo sapiens
ugaaguagguucucguaucgcc

SEQ ID NO: 199182 - RNA, 22 nt, Homo sapiens
ugaauagacacuaaagacugua

SEQ ID NO: 199183 - RNA, 22 nt, Homo sapiens
ugaauagacagucacugccucc

SEQ ID NO: 199184 - RNA, 22 nt, Homo sapiens
ugaauagagcugcaguggacau

SEQ ID NO: 199185 - RNA, 22 nt, Homo sapiens
ugaauauuugcuacucacucuu

SEQ ID NO: 199186 - RNA, 22 nt, Homo sapiens
ugaaucaugcugcuauaaagac

SEQ ID NO: 199187 - RNA, 22 nt, Homo sapiens
ugaaucauuucuugucuucagu

SEQ ID NO: 199188 - RNA, 22 nt, Homo sapiens
ugaaugauuuuaaaagccucuc

SEQ ID NO: 199189 - RNA, 22 nt, Homo sapiens
ugaaugcauggggccaagaagg

SEQ ID NO: 199190 - RNA, 22 nt, Homo sapiens
ugaaugcuaaaggaaaacagua

SEQ ID NO: 199191 - RNA, 22 nt, Homo sapiens
ugaauguacuuaacacuggauu

SEQ ID NO: 199192 - RNA, 22 nt, Homo sapiens
ugaaugugauggguuucaugug

SEQ ID NO: 199193 - RNA, 22 nt, Homo sapiens
ugaauuguuuacgagaugugag

SEQ ID NO: 199194 - RNA, 22 nt, Homo sapiens
ugacaagacuacauaucccauu

SEQ ID NO: 199195 - RNA, 22 nt, Homo sapiens
ugacaagaguagagagggugcc

SEQ ID NO: 199196 - RNA, 22 nt, Homo sapiens
ugacagagcaggacuucaucuc

SEQ ID NO: 199197 - RNA, 22 nt, Homo sapiens
ugacagcuguugaggcauuuau

SEQ ID NO: 199198 - RNA, 22 nt, Homo sapiens
ugacaggucuaauuuacugaca

SEQ ID NO: 199199 - RNA, 22 nt, Homo sapiens
ugacagguugauaggugcagca

SEQ ID NO: 199200 - RNA, 22 nt, Homo sapiens
ugacaguguccucauucccaac

SEQ ID NO: 199201 - RNA, 22 nt, Homo sapiens
ugacagugugagauccugucuc

SEQ ID NO: 199202 - RNA, 22 nt, Homo sapiens
ugacauagcuauuaagugaugc

SEQ ID NO: 199203 - RNA, 20 nt, Homo sapiens
ugacaucagcaauguaauaa

SEQ ID NO: 199204 - RNA, 18 nt, Homo sapiens
ugacaucauuuagaaagg

SEQ ID NO: 199205 - RNA, 22 nt, Homo sapiens
ugacauggagggugcggcugca

SEQ ID NO: 199206 - RNA, 22 nt, Homo sapiens
ugacauguauuagcucagugcu

SEQ ID NO: 199207 - RNA, 22 nt, Homo sapiens
ugaccacagaaagugagggagc

SEQ ID NO: 199208 - RNA, 22 nt, Homo sapiens
ugacggaggcauuggaagcuug

SEQ ID NO: 199209 - RNA, 22 nt, Homo sapiens
ugacuacagauuugcugccaga

SEQ ID NO: 199210 - RNA, 22 nt, Homo sapiens
ugacuaguuugaggacauuaua

SEQ ID NO: 199211 - RNA, 22 nt, Homo sapiens
uggcacuggagauacauuaaua

SEQ ID NO: 199212 - RNA, 22 nt, Homo sapiens
uggcaguuucacauggcucaac

SEQ ID NO: 199213 - RNA, 20 nt, Homo sapiens
uggcaugaaauuuuccaagc

SEQ ID NO: 199214 - RNA, 22 nt, Homo sapiens
uggcauggaaagcuuuucauac

SEQ ID NO: 199215 - RNA, 22 nt, Homo sapiens
uggcauggaguggauggcccca

SEQ ID NO: 199216 - RNA, 22 nt, Homo sapiens
uggcauguagucugggaccugg

SEQ ID NO: 199217 - RNA, 22 nt, Homo sapiens
uggcuagaccugcauaacagcu

SEQ ID NO: 199218 - RNA, 22 nt, Homo sapiens
uggcucauuucuaaacccagcu

SEQ ID NO: 199219 - RNA, 22 nt, Homo sapiens
uggcuguguccucucccaaauc

SEQ ID NO: 199220 - RNA, 22 nt, Homo sapiens
ugggaaauguagccuagcugug

SEQ ID NO: 199221 - RNA, 20 nt, Homo sapiens
ugggaacaugugguauaugg

SEQ ID NO: 199222 - RNA, 22 nt, Homo sapiens
ugggaccccuacucuuuccaca

SEQ ID NO: 199223 - RNA, 22 nt, Homo sapiens
ugggaucagcugggcucucugu

SEQ ID NO: 199224 - RNA, 22 nt, Homo sapiens
ugggaucagucuggaauauuga

SEQ ID NO: 199225 - RNA, 22 nt, Homo sapiens
ugggaucuuuccuauuagcgag

SEQ ID NO: 199226 - RNA, 22 nt, Homo sapiens
ugggaugaugaaaaggcuuucu

SEQ ID NO: 199227 - RNA, 22 nt, Homo sapiens
uggggucguaggugcccgccag

SEQ ID NO: 199228 - RNA, 22 nt, Homo sapiens
uggguagauaucauaguugccc

SEQ ID NO: 199229 - RNA, 22 nt, Homo sapiens
uggguagaugaauccauuccaa

SEQ ID NO: 199230 - RNA, 22 nt, Homo sapiens
uggguaguguaaagcacuccag

SEQ ID NO: 199231 - RNA, 22 nt, Homo sapiens
uggguccccuacucuuuccaca

SEQ ID NO: 199232 - RNA, 23 nt, Homo sapiens
uggguucccuaagcgcaugcugc

SEQ ID NO: 199233 - RNA, 22 nt, Homo sapiens
ugguacuucaugcucacagaua

SEQ ID NO: 199234 - RNA, 22 nt, Homo sapiens
ugguaugucuagauggggaagu

SEQ ID NO: 199235 - RNA, 22 nt, Homo sapiens
uggucagaugcugaguggaucu

SEQ ID NO: 199236 - RNA, 22 nt, Homo sapiens
uggucaguugaguccuugccaa

SEQ ID NO: 199237 - RNA, 21 nt, Homo sapiens
uggucaguuuucucacuagga

SEQ ID NO: 199238 - RNA, 22 nt, Homo sapiens
ugguccaguucugugauauugc

SEQ ID NO: 199239 - RNA, 22 nt, Homo sapiens
uggucccaugaacuuuagguca

SEQ ID NO: 199240 - RNA, 22 nt, Homo sapiens
uggucuccuuuguacccugggc

SEQ ID NO: 199241 - RNA, 22 nt, Homo sapiens
uggucucuuugcuuuagucauc

SEQ ID NO: 199242 - RNA, 22 nt, Homo sapiens
uggucuuuucaacaaaugguau

SEQ ID NO: 199243 - RNA, 22 nt, Homo sapiens
ugguuaucacuuuccuuccauc

SEQ ID NO: 199244 - RNA, 22 nt, Homo sapiens
ugguugaucccaucacccaggu

SEQ ID NO: 199245 - RNA, 22 nt, Homo sapiens
uguaaacauguauguguuuaug

SEQ ID NO: 199246 - RNA, 22 nt, Homo sapiens
uguaaaucuauuuuuaguguuu

SEQ ID NO: 199247 - RNA, 22 nt, Homo sapiens
uguaaaucugguuaauuggaua

SEQ ID NO: 199248 - RNA, 22 nt, Homo sapiens
uguacaaaacaagaugggggua

SEQ ID NO: 199249 - RNA, 22 nt, Homo sapiens
uguacaaauuucugugguggug

SEQ ID NO: 199250 - RNA, 22 nt, Homo sapiens
uguacccuuagagagugaucga

SEQ ID NO: 199251 - RNA, 22 nt, Homo sapiens
uguacuagaaauuaaggcaggg

SEQ ID NO: 199252 - RNA, 22 nt, Homo sapiens
uguagauaucauuagugcugug

SEQ ID NO: 199253 - RNA, 22 nt, Homo sapiens
uguagauauucuuucaguuuuu

SEQ ID NO: 199254 - RNA, 22 nt, Homo sapiens
uguagcaaauaaaagucuggau

SEQ ID NO: 199255 - RNA, 22 nt, Homo sapiens
uguagcagccauaaacacagug

SEQ ID NO: 199256 - RNA, 22 nt, Homo sapiens
ugucaaacauuaugaugcucua

SEQ ID NO: 199257 - RNA, 21 nt, Homo sapiens
ugucaagugggaaaacaugua

SEQ ID NO: 199258 - RNA, 22 nt, Homo sapiens
ugucaccauuuguaggugagga

SEQ ID NO: 199259 - RNA, 22 nt, Homo sapiens
ugucacccuuuauccauuuccu

SEQ ID NO: 199260 - RNA, 22 nt, Homo sapiens
ugucaccuugcucauccucgga

SEQ ID NO: 199261 - RNA, 22 nt, Homo sapiens
ugucacugugcagucaugcauu

SEQ ID NO: 199262 - RNA, 22 nt, Homo sapiens
ugucagaaucugagacgacaac

SEQ ID NO: 199263 - RNA, 22 nt, Homo sapiens
ugucaggaggguccagagaaaa

SEQ ID NO: 199264 - RNA, 22 nt, Homo sapiens
ugucaguggacugugaaaggca

SEQ ID NO: 199265 - RNA, 22 nt, Homo sapiens
ugucaguguacuguaagaauua

SEQ ID NO: 199266 - RNA, 22 nt, Homo sapiens
ugucaguuucccuccucuuccu

SEQ ID NO: 199267 - RNA, 22 nt, Homo sapiens
ugucauguaaagaguaaauggu

SEQ ID NO: 199268 - RNA, 22 nt, Homo sapiens
ugucauguggcuaacgauucau

SEQ ID NO: 199269 - RNA, 22 nt, Homo sapiens
ugucauuguggugcagauauaa

SEQ ID NO: 199270 - RNA, 20 nt, Homo sapiens
ugucccaaccccauggguuc

SEQ ID NO: 199271 - RNA, 22 nt, Homo sapiens
uguccugaagcuuuguuaugua

SEQ ID NO: 199272 - RNA, 22 nt, Homo sapiens
ugucuacugaugauguaguuaa

SEQ ID NO: 199273 - RNA, 20 nt, Homo sapiens
ugucuauggggguucucugc

SEQ ID NO: 199274 - RNA, 22 nt, Homo sapiens
ugucuugagagaggacaugacu

SEQ ID NO: 199275 - RNA, 22 nt, Homo sapiens
ugucuuguagacaauguauagu

SEQ ID NO: 199276 - RNA, 22 nt, Homo sapiens
ugucuuguagacugaaggcuuc

SEQ ID NO: 199277 - RNA, 21 nt, Homo sapiens
ugugaaaucuaggcagagguu

SEQ ID NO: 199278 - RNA, 22 nt, Homo sapiens
ugugaacaaaauuuguugcaua

SEQ ID NO: 199279 - RNA, 22 nt, Homo sapiens
ugugaagaaagucauugguagc

SEQ ID NO: 199280 - RNA, 22 nt, Homo sapiens
ugugaagauggacuaauauagu

SEQ ID NO: 199281 - RNA, 23 nt, Homo sapiens
ugugacacuuccgucaguucauu

SEQ ID NO: 199282 - RNA, 22 nt, Homo sapiens
ugugacagguauccuguguucu

SEQ ID NO: 199283 - RNA, 22 nt, Homo sapiens
ugugacaguguuacauuucaug

SEQ ID NO: 199284 - RNA, 19 nt, Homo sapiens
ugugacugggccagccuag

SEQ ID NO: 199285 - RNA, 22 nt, Homo sapiens
ugugagacugacagggcagggu

SEQ ID NO: 199286 - RNA, 20 nt, Homo sapiens
uucacaggcagcuucuuucu

SEQ ID NO: 199287 - RNA, 22 nt, Homo sapiens
uucaccagggaagucucaacuc

SEQ ID NO: 199288 - RNA, 22 nt, Homo sapiens
uucaccggggaccccuggcugu

SEQ ID NO: 199289 - RNA, 22 nt, Homo sapiens
uucacugcaugaaaaggacagc

SEQ ID NO: 199290 - RNA, 22 nt, Homo sapiens
uucagauugcauaccgaaagua

SEQ ID NO: 199291 - RNA, 19 nt, Homo sapiens
uucagcagugucugcucuu

SEQ ID NO: 199292 - RNA, 22 nt, Homo sapiens
uucaggcuccgugccagcuccg

SEQ ID NO: 199293 - RNA, 22 nt, Homo sapiens
uucaggcuccugugagaaucua

SEQ ID NO: 199294 - RNA, 22 nt, Homo sapiens
uucaggguggagaguaugaggu

SEQ ID NO: 199295 - RNA, 22 nt, Homo sapiens
uucagguucauuugcugcuauu

SEQ ID NO: 199296 - RNA, 22 nt, Homo sapiens
uucaguaaauguucuuacuaua

SEQ ID NO: 199297 - RNA, 22 nt, Homo sapiens
uucaguaguaaguuggaacucu

SEQ ID NO: 199298 - RNA, 22 nt, Homo sapiens
uucagugguuauuugugagauu

SEQ ID NO: 199299 - RNA, 22 nt, Homo sapiens
uucaguucugcacugaucuuag

SEQ ID NO: 199300 - RNA, 18 nt, Homo sapiens
uucauaguagcaugauuu

SEQ ID NO: 199301 - RNA, 22 nt, Homo sapiens
uucauagucuaugcaaguaaga

SEQ ID NO: 199302 - RNA, 22 nt, Homo sapiens
uucaucagcuguagaugucaug

SEQ ID NO: 199303 - RNA, 22 nt, Homo sapiens
uucaucagggagaaauaauuuc

SEQ ID NO: 199304 - RNA, 22 nt, Homo sapiens
uucauggugguacaaaagcaau

SEQ ID NO: 199305 - RNA, 22 nt, Homo sapiens
uucauguaaucaaggcagcuaa

SEQ ID NO: 199306 - RNA, 22 nt, Homo sapiens
uucauguaauuccauaagguaa

SEQ ID NO: 199307 - RNA, 22 nt, Homo sapiens
uucaugugagucuguauuaacu

SEQ ID NO: 199308 - RNA, 22 nt, Homo sapiens
uucauugaaugauuuuuagaag

SEQ ID NO: 199309 - RNA, 22 nt, Homo sapiens
uuccacaaugguugaacuaguu

SEQ ID NO: 199310 - RNA, 21 nt, Homo sapiens
uuccagugagccuagaugccu

SEQ ID NO: 199311 - RNA, 22 nt, Homo sapiens
uuccagugggacgagaugugga

SEQ ID NO: 199312 - RNA, 22 nt, Homo sapiens
uuccaguguguucauccucaga

SEQ ID NO: 199313 - RNA, 22 nt, Homo sapiens
uuccaugagaugcaucaaagcu

SEQ ID NO: 199314 - RNA, 22 nt, Homo sapiens
uucccagagagggacuucuaau

SEQ ID NO: 199315 - RNA, 22 nt, Homo sapiens
uucccagagccugggagugagg

SEQ ID NO: 199316 - RNA, 22 nt, Homo sapiens
uucccuagaacacauggaggga

SEQ ID NO: 199317 - RNA, 22 nt, Homo sapiens
uucccugaaauauucacuuuca

SEQ ID NO: 199318 - RNA, 22 nt, Homo sapiens
uucccugaaguguuacucuaga

SEQ ID NO: 199319 - RNA, 22 nt, Homo sapiens
uucccuugcaggaugaucugga

SEQ ID NO: 199320 - RNA, 22 nt, Homo sapiens
uucccuuucugaaaaucucauu

SEQ ID NO: 199321 - RNA, 22 nt, Homo sapiens
uuccuacuguucaucaggaacc

SEQ ID NO: 199322 - RNA, 22 nt, Homo sapiens
uuccuaguccugagucucugcg

SEQ ID NO: 199323 - RNA, 22 nt, Homo sapiens
uuccugcacuugcuugccuaug

SEQ ID NO: 199324 - RNA, 22 nt, Homo sapiens
uuccugucuuccaagagagauu

SEQ ID NO: 199325 - RNA, 22 nt, Homo sapiens
uuccugugacccccaagcccac

SEQ ID NO: 199326 - RNA, 22 nt, Homo sapiens
uuccuugguucagggaaggucc

SEQ ID NO: 199327 - RNA, 22 nt, Homo sapiens
uuccuuguuuauuuacaggagg

SEQ ID NO: 199328 - RNA, 22 nt, Homo sapiens
uucuacaggcuguucaagaagc

SEQ ID NO: 199329 - RNA, 22 nt, Homo sapiens
uucuacaugggucgucggugag

SEQ ID NO: 199330 - RNA, 22 nt, Homo sapiens
uucuacuucauuaggaggauug

SEQ ID NO: 199331 - RNA, 20 nt, Homo sapiens
uucuauggugaugaguccug

SEQ ID NO: 199332 - RNA, 22 nt, Homo sapiens
uucuaugguuuaauaguuuggg

SEQ ID NO: 199333 - RNA, 22 nt, Homo sapiens
uucucaguaauuccagauuuuu

SEQ ID NO: 199334 - RNA, 22 nt, Homo sapiens
uucucagugaaguuuagaacau

SEQ ID NO: 199335 - RNA, 22 nt, Homo sapiens
uucuccugguggacccuaaacg

SEQ ID NO: 199336 - RNA, 22 nt, Homo sapiens
uucucuggucagaggggagguu

SEQ ID NO: 199337 - RNA, 19 nt, Homo sapiens
uucucugguuguacuaccc

SEQ ID NO: 199338 - RNA, 22 nt, Homo sapiens
uucugauggaguaguccacaga

SEQ ID NO: 199339 - RNA, 22 nt, Homo sapiens
uucugcacaucgaucacaagau

SEQ ID NO: 199340 - RNA, 22 nt, Homo sapiens
uucuggccccucccaaucucau

SEQ ID NO: 199341 - RNA, 22 nt, Homo sapiens
uucuggcuaugggauacuaaau

SEQ ID NO: 199342 - RNA, 22 nt, Homo sapiens
uucuggcuuuuaaagaaauguu

SEQ ID NO: 199343 - RNA, 22 nt, Homo sapiens
uucugguuaauacuugcaaaaa

SEQ ID NO: 199344 - RNA, 22 nt, Homo sapiens
uucugugguagaaaucucaaau

SEQ ID NO: 199345 - RNA, 22 nt, Homo sapiens
uucuguguuuaggucacggcua

SEQ ID NO: 199346 - RNA, 22 nt, Homo sapiens
uucuugaggcaugccgcuggga

SEQ ID NO: 199347 - RNA, 20 nt, Homo sapiens
uucuugaguuaacaaguuac

SEQ ID NO: 199348 - RNA, 22 nt, Homo sapiens
uucuugcacugaucccauaagc

SEQ ID NO: 199349 - RNA, 22 nt, Homo sapiens
uucuugcugaauugugcccuuc

SEQ ID NO: 199350 - RNA, 22 nt, Homo sapiens
uucuugcuguauccucacaugg

SEQ ID NO: 199351 - RNA, 22 nt, Homo sapiens
uucuugguguaguaguugaaaa

SEQ ID NO: 199352 - RNA, 21 nt, Homo sapiens
uucuuugcucaguguuagagu

SEQ ID NO: 199353 - RNA, 22 nt, Homo sapiens
uugaaagucauggcacaggcaa

SEQ ID NO: 199354 - RNA, 22 nt, Homo sapiens
uugaaauguguaagcuccgaaa

SEQ ID NO: 199355 - RNA, 22 nt, Homo sapiens
uugaacuagaaccugcaaauuu

SEQ ID NO: 199356 - RNA, 22 nt, Homo sapiens
uugaacuguaagggucugugug

SEQ ID NO: 199357 - RNA, 22 nt, Homo sapiens
uugaagguagaaguucucaauu

SEQ ID NO: 199358 - RNA, 22 nt, Homo sapiens
uugaaguagaaagacgaaauuu

SEQ ID NO: 199359 - RNA, 22 nt, Homo sapiens
uugaaguaggaaaggaggaggu

SEQ ID NO: 199360 - RNA, 22 nt, Homo sapiens
uugaaugaauggaaagaagggu

SEQ ID NO: 199361 - RNA, 22 nt, Homo sapiens
uugaauguacuuguucucacua

SEQ ID NO: 199362 - RNA, 22 nt, Homo sapiens
uugaaugucuauuaaguuguuu

SEQ ID NO: 199363 - RNA, 23 nt, Homo sapiens
uugaauguuuccccucccaaauu

SEQ ID NO: 199364 - RNA, 22 nt, Homo sapiens
uugacaggaugcucagggccca

SEQ ID NO: 199365 - RNA, 22 nt, Homo sapiens
uugacauguaggcagggaaugg

SEQ ID NO: 199366 - RNA, 22 nt, Homo sapiens
uugacugggccagacagagauc

SEQ ID NO: 199367 - RNA, 22 nt, Homo sapiens
uugacuguaagauggcuauuac

SEQ ID NO: 199368 - RNA, 22 nt, Homo sapiens
uugagaagugucuguucauguc

SEQ ID NO: 199369 - RNA, 22 nt, Homo sapiens
uugagacgaagucucacucuug

SEQ ID NO: 199370 - RNA, 22 nt, Homo sapiens
uugagacggagucuugcucuuu

SEQ ID NO: 199371 - RNA, 22 nt, Homo sapiens
uugagagaaaaaauuuauuggu

SEQ ID NO: 199372 - RNA, 22 nt, Homo sapiens
uugagagcugaugaaagauaaa

SEQ ID NO: 199373 - RNA, 22 nt, Homo sapiens
uugagauggaaucucgcuuugu

SEQ ID NO: 199374 - RNA, 22 nt, Homo sapiens
uugagauggagccucacucugc

SEQ ID NO: 199375 - RNA, 22 nt, Homo sapiens
uugagauggagucucacucugu

SEQ ID NO: 199376 - RNA, 22 nt, Homo sapiens
uugagauggagucucgcucuuu

SEQ ID NO: 199377 - RNA, 22 nt, Homo sapiens
uugagauggagucuugcgcugu

SEQ ID NO: 199378 - RNA, 22 nt, Homo sapiens
uugagauggaguuucacucugu

SEQ ID NO: 199379 - RNA, 22 nt, Homo sapiens
uugagauggaguuucgcucuuu

SEQ ID NO: 199380 - RNA, 22 nt, Homo sapiens
uugagauggaguuuugcucuug

SEQ ID NO: 199381 - RNA, 22 nt, Homo sapiens
uugagauguggcaguuuaugag

SEQ ID NO: 199382 - RNA, 22 nt, Homo sapiens
uugagcaaaacauuaauauuag

SEQ ID NO: 199383 - RNA, 22 nt, Homo sapiens
uugagcaacauagugagacugu

SEQ ID NO: 199384 - RNA, 22 nt, Homo sapiens
uugagcaaugaacgauucaggg

SEQ ID NO: 199385 - RNA, 22 nt, Homo sapiens
uugagcauugguauagguuuua

SEQ ID NO: 199386 - RNA, 22 nt, Homo sapiens
uugaggaaugucauuuguguuu

SEQ ID NO: 199387 - RNA, 16 nt, Homo sapiens
uugaggcaugucucag

SEQ ID NO: 199388 - RNA, 22 nt, Homo sapiens
uugaggguggcauauauugauu

SEQ ID NO: 199389 - RNA, 22 nt, Homo sapiens
uugaguaguaagaagaugauag

SEQ ID NO: 199390 - RNA, 22 nt, Homo sapiens
uugaguauuugcagucugaaca

SEQ ID NO: 199391 - RNA, 22 nt, Homo sapiens
uugauaauguuaacuuugguca

SEQ ID NO: 199392 - RNA, 22 nt, Homo sapiens
uugauacuagagucuuucugac

SEQ ID NO: 199393 - RNA, 22 nt, Homo sapiens
uugauaguccuguaucuauuuu

SEQ ID NO: 199394 - RNA, 22 nt, Homo sapiens
uugauaugcuugucaguccauu

SEQ ID NO: 199395 - RNA, 22 nt, Homo sapiens
uugauauguggaauauuuaucu

SEQ ID NO: 199396 - RNA, 22 nt, Homo sapiens
uugauauucugagaagcugaag

SEQ ID NO: 199397 - RNA, 22 nt, Homo sapiens
uugauuuguagaaugccccaac

SEQ ID NO: 199398 - RNA, 22 nt, Homo sapiens
uugcaaaguugccaaggaagga

SEQ ID NO: 199399 - RNA, 18 nt, Homo sapiens
uugcaaauucuucccugu

SEQ ID NO: 199400 - RNA, 22 nt, Homo sapiens
uugcaacauguauucuggugau

SEQ ID NO: 199401 - RNA, 22 nt, Homo sapiens
uugcaagaaaugcagauucuca

SEQ ID NO: 199402 - RNA, 22 nt, Homo sapiens
uugcaaugugaugugauuugga

SEQ ID NO: 199403 - RNA, 20 nt, Homo sapiens
uugcacagagaaggaggcag

SEQ ID NO: 199404 - RNA, 22 nt, Homo sapiens
uugcacagugguuuagagccug

SEQ ID NO: 199405 - RNA, 22 nt, Homo sapiens
uugcacauggcuggggaggccu

SEQ ID NO: 199406 - RNA, 22 nt, Homo sapiens
uugcacauguugaaccagcaaa

SEQ ID NO: 199407 - RNA, 22 nt, Homo sapiens
uugcacugagauuuugcuuaca

SEQ ID NO: 199408 - RNA, 22 nt, Homo sapiens
uugcacuuccgccugggugaca

SEQ ID NO: 199409 - RNA, 22 nt, Homo sapiens
uugcacuugcugaggagugauu

SEQ ID NO: 199410 - RNA, 22 nt, Homo sapiens
uugcagagccccacacugggcu

SEQ ID NO: 199411 - RNA, 22 nt, Homo sapiens
uugcagagucaguuauuuugcc

SEQ ID NO: 199412 - RNA, 22 nt, Homo sapiens
uugcagcaaagagggaggggca

SEQ ID NO: 199413 - RNA, 22 nt, Homo sapiens
uugcagcauucugguuccuggu

SEQ ID NO: 199414 - RNA, 22 nt, Homo sapiens
uugcaggcaugagccaccgugc

SEQ ID NO: 199415 - RNA, 22 nt, Homo sapiens
uugcauaagugcauucugugau

SEQ ID NO: 199416 - RNA, 22 nt, Homo sapiens
uugcauagaggugaguauagua

SEQ ID NO: 199417 - RNA, 22 nt, Homo sapiens
uugcaugcuccuuaugagaauc

SEQ ID NO: 199418 - RNA, 22 nt, Homo sapiens
uugcauuuucuaggagggcaaa

SEQ ID NO: 199419 - RNA, 21 nt, Homo sapiens
uugccugacacuggaagaaau

SEQ ID NO: 199420 - RNA, 22 nt, Homo sapiens
uugccuuuguuggaaacaagug

SEQ ID NO: 199421 - RNA, 22 nt, Homo sapiens
uugcucaggcuagaguucagcu

SEQ ID NO: 199422 - RNA, 22 nt, Homo sapiens
uugcucaggcuggaguacaaug

SEQ ID NO: 199423 - RNA, 22 nt, Homo sapiens
uuggaaaccucugcagguguuu

SEQ ID NO: 199424 - RNA, 22 nt, Homo sapiens
uuggaaacgucaccuuuuccuu

SEQ ID NO: 199425 - RNA, 22 nt, Homo sapiens
uuggaaauguguuugcauucag

SEQ ID NO: 199426 - RNA, 22 nt, Homo sapiens
uuggaagagaagggagauaaac

SEQ ID NO: 199427 - RNA, 22 nt, Homo sapiens
uuggaauuaaccuggugcugga

SEQ ID NO: 199428 - RNA, 22 nt, Homo sapiens
uuggaauuaagagauauuuucu

SEQ ID NO: 199429 - RNA, 22 nt, Homo sapiens
uuggacucccuccccagcuuca

SEQ ID NO: 199430 - RNA, 22 nt, Homo sapiens
uuggagagagaggacucccggc

SEQ ID NO: 199431 - RNA, 22 nt, Homo sapiens
uuggagugugagagcagccugg

SEQ ID NO: 199432 - RNA, 22 nt, Homo sapiens
uuggauauucaguuuuuccauc

SEQ ID NO: 199433 - RNA, 22 nt, Homo sapiens
uuggcaacauagugagaccccc

SEQ ID NO: 199434 - RNA, 22 nt, Homo sapiens
uuggcaagaauguaugccgauc

SEQ ID NO: 199435 - RNA, 22 nt, Homo sapiens
uuggcaaguccccaccucucuc

SEQ ID NO: 199436 - RNA, 22 nt, Homo sapiens
uuggcaaguuucugucagcaaa

SEQ ID NO: 199437 - RNA, 21 nt, Homo sapiens
uuggcacucuucucuccuuau

SEQ ID NO: 199438 - RNA, 22 nt, Homo sapiens
uuggcagaaaaggucggggguu

SEQ ID NO: 199439 - RNA, 22 nt, Homo sapiens
uuggccauggagcacuuuucua

SEQ ID NO: 199440 - RNA, 22 nt, Homo sapiens
uuggcuauagauacauggauua

SEQ ID NO: 199441 - RNA, 22 nt, Homo sapiens
uuggcuucuggacuauugugca

SEQ ID NO: 199442 - RNA, 22 nt, Homo sapiens
uugggcaauaggaagcaggugg

SEQ ID NO: 199443 - RNA, 22 nt, Homo sapiens
uugggucaguuccuugacuccu

SEQ ID NO: 199444 - RNA, 22 nt, Homo sapiens
uugguaggcuggccucucucag

SEQ ID NO: 199445 - RNA, 22 nt, Homo sapiens
uuggucaggcuaaucucgaacg

SEQ ID NO: 199446 - RNA, 22 nt, Homo sapiens
uuggucaggcuagaguguggug

SEQ ID NO: 199447 - RNA, 22 nt, Homo sapiens
uugguccacugugaaauuggga

SEQ ID NO: 199448 - RNA, 22 nt, Homo sapiens
uugguuccauuuuaccagcucu

SEQ ID NO: 199449 - RNA, 21 nt, Homo sapiens
uugguucccucugacaggucu

SEQ ID NO: 199450 - RNA, 22 nt, Homo sapiens
uugguuccuuagccuaggacua

SEQ ID NO: 199451 - RNA, 22 nt, Homo sapiens
uuguaaacaucuguacauugcu

SEQ ID NO: 199452 - RNA, 22 nt, Homo sapiens
uuguaaaguucucucccgaaaa

SEQ ID NO: 199453 - RNA, 22 nt, Homo sapiens
uuguagaucuucaguugcuaca

SEQ ID NO: 199454 - RNA, 22 nt, Homo sapiens
uuguauaguucuauguguuuug

SEQ ID NO: 199455 - RNA, 22 nt, Homo sapiens
uuguaugucuucauuugaaaaa

SEQ ID NO: 199456 - RNA, 22 nt, Homo sapiens
uuguauguuucugugcacauga

SEQ ID NO: 199457 - RNA, 22 nt, Homo sapiens
uuguauugucuugaugaguuga

SEQ ID NO: 199458 - RNA, 22 nt, Homo sapiens
uugucacugcacuccagucugg

SEQ ID NO: 199459 - RNA, 22 nt, Homo sapiens
uuguccacugcuagccucugca

SEQ ID NO: 199460 - RNA, 19 nt, Homo sapiens
uuguccccucuaaaucuca

SEQ ID NO: 199461 - RNA, 22 nt, Homo sapiens
uuguccccuuccaaaucucaug

SEQ ID NO: 199462 - RNA, 22 nt, Homo sapiens
uuguccuccacauuugaucagu

SEQ ID NO: 199463 - RNA, 22 nt, Homo sapiens
uugugaaaaaccucucguggaa

SEQ ID NO: 199464 - RNA, 22 nt, Homo sapiens
uugugaaaucuaggcagagguu

SEQ ID NO: 199465 - RNA, 22 nt, Homo sapiens
uugugaauggugccacaauaaa

SEQ ID NO: 199466 - RNA, 22 nt, Homo sapiens
uugugagggagcuaagaugagu

SEQ ID NO: 199467 - RNA, 22 nt, Homo sapiens
uugugcacauguacccuagaac

SEQ ID NO: 199468 - RNA, 22 nt, Homo sapiens
uugugcuuaaugaguguaaggu

SEQ ID NO: 199469 - RNA, 22 nt, Homo sapiens
uugugcuucaucaccuagcaga

SEQ ID NO: 199470 - RNA, 22 nt, Homo sapiens
uugugcuugauuugccuagcug

SEQ ID NO: 199471 - RNA, 22 nt, Homo sapiens
uugugguaggaugaagagauga

SEQ ID NO: 199472 - RNA, 22 nt, Homo sapiens
uugugguuuucagcuuauauau

SEQ ID NO: 199473 - RNA, 19 nt, Homo sapiens
uuguguccccacaaaauuc

SEQ ID NO: 199474 - RNA, 22 nt, Homo sapiens
uuguguccccacucaaauuaca

SEQ ID NO: 199475 - RNA, 22 nt, Homo sapiens
uuguuaugggguggcuugaaag

SEQ ID NO: 199476 - RNA, 22 nt, Homo sapiens
uuuaaagcuaaaauauguuuau

SEQ ID NO: 199477 - RNA, 22 nt, Homo sapiens
uuuaacauuggaugagaucguc

SEQ ID NO: 199478 - RNA, 22 nt, Homo sapiens
uuuacaguuuucuaggcuacca

SEQ ID NO: 199479 - RNA, 22 nt, Homo sapiens
uuuagcaaagcaauuuacacca

SEQ ID NO: 199480 - RNA, 22 nt, Homo sapiens
uuuagcaauucauuuugugucu

SEQ ID NO: 199481 - RNA, 22 nt, Homo sapiens
uuuagcagcaaagagcuguguu

SEQ ID NO: 199482 - RNA, 22 nt, Homo sapiens
uuuagguagucaaagguuaguc

SEQ ID NO: 199483 - RNA, 22 nt, Homo sapiens
uuucacagagggcuucuuucua

SEQ ID NO: 199484 - RNA, 22 nt, Homo sapiens
uuucacagcaauugccuauugu

SEQ ID NO: 199485 - RNA, 22 nt, Homo sapiens
uuucacagcugucuuccgucuc

SEQ ID NO: 199486 - RNA, 17 nt, Homo sapiens
uuucagaguggaagugu

SEQ ID NO: 199487 - RNA, 22 nt, Homo sapiens
uuucaggcaagggugacccuga

SEQ ID NO: 199488 - RNA, 22 nt, Homo sapiens
uuucauagccuucuaaugaguu

SEQ ID NO: 199489 - RNA, 22 nt, Homo sapiens
uuucauggaauauagucauuuu

SEQ ID NO: 199490 - RNA, 22 nt, Homo sapiens
uuucauggagaaucuucuuacu

SEQ ID NO: 199491 - RNA, 22 nt, Homo sapiens
uuucauggaggauuugcuucuu

SEQ ID NO: 199492 - RNA, 22 nt, Homo sapiens
uuucauguuuuucugugaggca

SEQ ID NO: 199493 - RNA, 22 nt, Homo sapiens
uuuccaagaugcuuacuuucuc

SEQ ID NO: 199494 - RNA, 22 nt, Homo sapiens
uuucccauuguucugcucugug

SEQ ID NO: 199495 - RNA, 22 nt, Homo sapiens
uuucuacagggcuugccaggua

SEQ ID NO: 199496 - RNA, 15 nt, Homo sapiens
uuucuacugcacuuc

SEQ ID NO: 199497 - RNA, 21 nt, Homo sapiens
uuucugggggagcauggcagg

SEQ ID NO: 199498 - RNA, 22 nt, Homo sapiens
uuugaaaguaauuugguuggug

SEQ ID NO: 199499 - RNA, 22 nt, Homo sapiens
uuugaagacuacugggagugaa

SEQ ID NO: 199500 - RNA, 22 nt, Homo sapiens
uuugaauggaaguuuugugaaa

SEQ ID NO: 199501 - RNA, 22 nt, Homo sapiens
uuugacaaugugugcuuguauu

SEQ ID NO: 199502 - RNA, 22 nt, Homo sapiens
uuugacuuuuagaauaugaguu

SEQ ID NO: 199503 - RNA, 22 nt, Homo sapiens
uuugagauaucuuccaucagua

SEQ ID NO: 199504 - RNA, 22 nt, Homo sapiens
uuugagcauuagggcaaaggca

SEQ ID NO: 199505 - RNA, 22 nt, Homo sapiens
uuugagguguauggcaaguuga

SEQ ID NO: 199506 - RNA, 21 nt, Homo sapiens
uuugaucauuaaaagugaauc

SEQ ID NO: 199507 - RNA, 22 nt, Homo sapiens
uuugauguccaccucagcccac

SEQ ID NO: 199508 - RNA, 22 nt, Homo sapiens
uuugauugguguaccugaaagu

SEQ ID NO: 199509 - RNA, 22 nt, Homo sapiens
uuugcaagaugaaaaaguucua

SEQ ID NO: 199510 - RNA, 22 nt, Homo sapiens
uuugcacuucugagugugacau

SEQ ID NO: 199511 - RNA, 22 nt, Homo sapiens
uuugcagagacuuguuaggaau

SEQ ID NO: 199512 - RNA, 19 nt, Homo sapiens
uuugcauagugagaauaua

SEQ ID NO: 199513 - RNA, 22 nt, Homo sapiens
uuugcaucuuagaaaguucucc

SEQ ID NO: 199514 - RNA, 22 nt, Homo sapiens
uuugccaaugggaauuuuccua

SEQ ID NO: 199515 - RNA, 22 nt, Homo sapiens
uuugcuuaaaucuuaaucagau

SEQ ID NO: 199516 - RNA, 22 nt, Homo sapiens
uuuggcaacguuggaucccuca

SEQ ID NO: 199517 - RNA, 22 nt, Homo sapiens
uuuggcagaaaacaagaaucug

SEQ ID NO: 199518 - RNA, 22 nt, Homo sapiens
uuugggccucugauuucuuugg

SEQ ID NO: 199519 - RNA, 22 nt, Homo sapiens
uuugguccaguguucagguccu

SEQ ID NO: 199520 - RNA, 22 nt, Homo sapiens
uuugguguauauguaaacuaug

SEQ ID NO: 199521 - RNA, 22 nt, Homo sapiens
uuuguaagaugcauagauugca

SEQ ID NO: 199522 - RNA, 23 nt, Homo sapiens
uuuguacuaugucaguuuagaua

SEQ ID NO: 199523 - RNA, 22 nt, Homo sapiens
uuuguagcucacucugagcuga

SEQ ID NO: 199524 - RNA, 21 nt, Homo sapiens
uuuguaguagcaugauuuaua

SEQ ID NO: 199525 - RNA, 23 nt, Homo sapiens
uuuguaguagcaugauuuauaau

SEQ ID NO: 199526 - RNA, 22 nt, Homo sapiens
uuuguccugccaugguuuauuu

SEQ ID NO: 199527 - RNA, 22 nt, Homo sapiens
uuugucuccuaagacucugugg

SEQ ID NO: 199528 - RNA, 22 nt, Homo sapiens
uuugugcaugaagagggggugc

SEQ ID NO: 199529 - RNA, 18 nt, Homo sapiens
uuugugcuccacaaagga

SEQ ID NO: 199530 - RNA, 21 nt, Homo sapiens
uuugugguuacugugugagcu

SEQ ID NO: 199531 - RNA, 22 nt, Homo sapiens
uuugugucccucuaaaauuuau

SEQ ID NO: 199532 - RNA, 22 nt, Homo sapiens
uuuguuugaagucgagacaacu

SEQ ID NO: 199533 - RNA, 22 nt, Homo sapiens
uuuuagcaaagagacugguggc

SEQ ID NO: 199534 - RNA, 20 nt, Homo sapiens
uuuuagcacuuguuauggug

SEQ ID NO: 199535 - RNA, 22 nt, Homo sapiens
uuuuagcuuuucccaggacucc

SEQ ID NO: 199536 - RNA, 22 nt, Homo sapiens
uuuucaguuuuccagguagccg

SEQ ID NO: 199537 - RNA, 22 nt, Homo sapiens
uuuuggacuugcuccccugucc

SEQ ID NO: 199538 - RNA, 22 nt, Homo sapiens
uuuuggcucugucuguaucuuu

SEQ ID NO: 199539 - RNA, 22 nt, Homo sapiens
uuuugggggugauucacacagu

SEQ ID NO: 199540 - RNA, 22 nt, Homo sapiens
uuuuugagaauuggugaaacac

SEQ ID NO: 199541 - RNA, 22 nt, Homo sapiens
uuuuugagguauaguguggcua

SEQ ID NO: 199542 - RNA, 22 nt, Homo sapiens
uuuuugaguagcuggagagcag

SEQ ID NO: 199543 - RNA, 16 nt, Homo sapiens
uuuuugcagaaaugac

SEQ ID NO: 199544 - RNA, 22 nt, Homo sapiens
uuuuuggguaaugauuaucaau

SEQ ID NO: 199545 - RNA, 21 nt, Homo sapiens
uuuuugguggucauggauaga

SEQ ID NO: 199546 - RNA, 22 nt, Homo sapiens
agagcacuguggguccaaauau

SEQ ID NO: 199547 - RNA, 22 nt, Homo sapiens
agagccacauuaaauaugggaa

SEQ ID NO: 199548 - RNA, 22 nt, Homo sapiens
agagguauuggaaggaguguca

SEQ ID NO: 199549 - RNA, 18 nt, Homo sapiens
agaguaucauuuccccca

SEQ ID NO: 199550 - RNA, 21 nt, Homo sapiens
agagucaucucuaucuguacc

SEQ ID NO: 199551 - RNA, 22 nt, Homo sapiens
agagugcaauggcaccaucucg

SEQ ID NO: 199552 - RNA, 23 nt, Homo sapiens
agagugcaauggugccaucucgg

SEQ ID NO: 199553 - RNA, 22 nt, Homo sapiens
agagugcuauagauuagauuuc

SEQ ID NO: 199554 - RNA, 22 nt, Homo sapiens
agauauguuauugauguuaaug

SEQ ID NO: 199555 - RNA, 22 nt, Homo sapiens
agauauuuguuaggucugucag

SEQ ID NO: 199556 - RNA, 22 nt, Homo sapiens
agaucacagucuuugguuuuag

SEQ ID NO: 199557 - RNA, 22 nt, Homo sapiens
agaugauguuuacugagcauca

SEQ ID NO: 199558 - RNA, 22 nt, Homo sapiens
agaugcauuuuuauuggaauac

SEQ ID NO: 199559 - RNA, 22 nt, Homo sapiens
agaugccucauguucuagguuc

SEQ ID NO: 199560 - RNA, 22 nt, Homo sapiens
agauggauuuuguagccccagc

SEQ ID NO: 199561 - RNA, 22 nt, Homo sapiens
agaugguauuauagguuucugu

SEQ ID NO: 199562 - RNA, 22 nt, Homo sapiens
agauucauccaaguuguugcau

SEQ ID NO: 199563 - RNA, 22 nt, Homo sapiens
agcaaccuugaauagcccuuuc

SEQ ID NO: 199564 - RNA, 22 nt, Homo sapiens
agcaagacauggcuuccaaaug

SEQ ID NO: 199565 - RNA, 22 nt, Homo sapiens
agcaccauuuauugaaaagaca

SEQ ID NO: 199566 - RNA, 22 nt, Homo sapiens
agcaccauuucucuaaagcacu

SEQ ID NO: 199567 - RNA, 23 nt, Homo sapiens
agcaccuuuccuccacuaucugc

SEQ ID NO: 199568 - RNA, 22 nt, Homo sapiens
agcagagcaguggauuuuguga

SEQ ID NO: 199569 - RNA, 22 nt, Homo sapiens
agcagcaccaaacagacuaaga

SEQ ID NO: 199570 - RNA, 22 nt, Homo sapiens
agcagcauuaguggaaucuugu

SEQ ID NO: 199571 - RNA, 22 nt, Homo sapiens
agcagcauuccaaaaaucugcu

SEQ ID NO: 199572 - RNA, 21 nt, Homo sapiens
agcagcuuugguugaagcaga

SEQ ID NO: 199573 - RNA, 22 nt, Homo sapiens
agcaucacaugggcugcuuggg

SEQ ID NO: 199574 - RNA, 17 nt, Homo sapiens
agcauguguuugagauu

SEQ ID NO: 199575 - RNA, 20 nt, Homo sapiens
agcauugguuagaacaguag

SEQ ID NO: 199576 - RNA, 22 nt, Homo sapiens
agccaagacucuguuccccuug

SEQ ID NO: 199577 - RNA, 22 nt, Homo sapiens
agccaguauuuccacagagugg

SEQ ID NO: 199578 - RNA, 22 nt, Homo sapiens
agccauacaacguaugcaugua

SEQ ID NO: 199579 - RNA, 22 nt, Homo sapiens
agcccagagacuguguaaauuu

SEQ ID NO: 199580 - RNA, 22 nt, Homo sapiens
agcccauguggcugaggcuucu

SEQ ID NO: 199581 - RNA, 23 nt, Homo sapiens
agccugguuucccugcuucuccc

SEQ ID NO: 199582 - RNA, 21 nt, Homo sapiens
agcuaaauuggaaauuucugu

SEQ ID NO: 199583 - RNA, 23 nt, Homo sapiens
agcuagagaggcuggggauacag

SEQ ID NO: 199584 - RNA, 22 nt, Homo sapiens
agcucauugcaaccuccgccuc

SEQ ID NO: 199585 - RNA, 22 nt, Homo sapiens
caagugcucuaggauccugagu

SEQ ID NO: 199586 - RNA, 22 nt, Homo sapiens
caaguguuggcuuguauacaaa

SEQ ID NO: 199587 - RNA, 22 nt, Homo sapiens
caaguguuuccuuaaauacuug

SEQ ID NO: 199588 - RNA, 19 nt, Homo sapiens
caauacuucuuggcauaca

SEQ ID NO: 199589 - RNA, 22 nt, Homo sapiens
caaugcagcuuuuggagagaaa

SEQ ID NO: 199590 - RNA, 22 nt, Homo sapiens
cacacugucuucaauggguggu

SEQ ID NO: 199591 - RNA, 22 nt, Homo sapiens
cacacuguuuuccauggggguu

SEQ ID NO: 199592 - RNA, 22 nt, Homo sapiens
cacagcuagucaaugguagaca

SEQ ID NO: 199593 - RNA, 22 nt, Homo sapiens
cacagggcuaacauuuuugccc

SEQ ID NO: 199594 - RNA, 23 nt, Homo sapiens
cacagggugaacaccccuaaucc

SEQ ID NO: 199595 - RNA, 22 nt, Homo sapiens
cacagugaacugguggguuuuu

SEQ ID NO: 199596 - RNA, 22 nt, Homo sapiens
cacaguguucauagccaucagg

SEQ ID NO: 199597 - RNA, 22 nt, Homo sapiens
cacccaguaagcaugaggcccu

SEQ ID NO: 199598 - RNA, 22 nt, Homo sapiens
cacccagucaucuuggguuuuu

SEQ ID NO: 199599 - RNA, 22 nt, Homo sapiens
cacccuugcagggacagcuuug

SEQ ID NO: 199600 - RNA, 22 nt, Homo sapiens
caccgagguuggagugcagugg

SEQ ID NO: 199601 - RNA, 19 nt, Homo sapiens
caccgccugcccccugcug

SEQ ID NO: 199602 - RNA, 22 nt, Homo sapiens
caccuagacuggagugcagugg

SEQ ID NO: 199603 - RNA, 18 nt, Homo sapiens
cacugagcccuucacucu

SEQ ID NO: 199604 - RNA, 22 nt, Homo sapiens
cacugcacuccagcuuugguga

SEQ ID NO: 199605 - RNA, 22 nt, Homo sapiens
cacugcacuccaguuucgguaa

SEQ ID NO: 199606 - RNA, 22 nt, Homo sapiens
cacugcacuccaguuuggauga

SEQ ID NO: 199607 - RNA, 22 nt, Homo sapiens
cacugcacucuucuucugggca

SEQ ID NO: 199608 - RNA, 21 nt, Homo sapiens
cacugcacuugccuucugggu

SEQ ID NO: 199609 - RNA, 22 nt, Homo sapiens
cacugcaguaaauugcgucggu

SEQ ID NO: 199610 - RNA, 22 nt, Homo sapiens
cacugcgaccucugccuaccgg

SEQ ID NO: 199611 - RNA, 22 nt, Homo sapiens
cacuggacauguugaagcuuuu

SEQ ID NO: 199612 - RNA, 23 nt, Homo sapiens
cacugggcagcagguguucccag

SEQ ID NO: 199613 - RNA, 22 nt, Homo sapiens
cacugggccaucacuuaauauu

SEQ ID NO: 199614 - RNA, 22 nt, Homo sapiens
cacugggugccauauguuugcu

SEQ ID NO: 199615 - RNA, 22 nt, Homo sapiens
cagagaacauucagagcuguag

SEQ ID NO: 199616 - RNA, 22 nt, Homo sapiens
cagagcacugauacuggguucu

SEQ ID NO: 199617 - RNA, 22 nt, Homo sapiens
cagauacuccuggucucaggag

SEQ ID NO: 199618 - RNA, 22 nt, Homo sapiens
cagaucaucuugagcuuaggaa

SEQ ID NO: 199619 - RNA, 22 nt, Homo sapiens
cagccggguggcuccuagggua

SEQ ID NO: 199620 - RNA, 22 nt, Homo sapiens
cagcuaguaauuuauugaagau

SEQ ID NO: 199621 - RNA, 23 nt, Homo sapiens
cagcuggugauuuuaaguugaag

SEQ ID NO: 199622 - RNA, 22 nt, Homo sapiens
cagcuugugguauugcugguug

SEQ ID NO: 199623 - RNA, 22 nt, Homo sapiens
caggcacgcuugggagacacac

SEQ ID NO: 199624 - RNA, 22 nt, Homo sapiens
cagguacauuuuaaagggcuca

SEQ ID NO: 199625 - RNA, 22 nt, Homo sapiens
caguaaauaucugagcgagguc

SEQ ID NO: 199626 - RNA, 22 nt, Homo sapiens
caguacaauguugauuagaagu

SEQ ID NO: 199627 - RNA, 22 nt, Homo sapiens
caguaguagccccuuagaugga

SEQ ID NO: 199628 - RNA, 20 nt, Homo sapiens
cagucaugaagaacugugag

SEQ ID NO: 199629 - RNA, 22 nt, Homo sapiens
cagugacacugaaaaguucggg

SEQ ID NO: 199630 - RNA, 18 nt, Homo sapiens
cagugcaauacaggagag

SEQ ID NO: 199631 - RNA, 20 nt, Homo sapiens
cagugcacuuucccacuggu

SEQ ID NO: 199632 - RNA, 22 nt, Homo sapiens
cagugcauaggaucuaaaauuu

SEQ ID NO: 199633 - RNA, 23 nt, Homo sapiens
cagugguguuagagaaaucuuuu

SEQ ID NO: 199634 - RNA, 22 nt, Homo sapiens
caguguuuuuaacaggugcccg

SEQ ID NO: 199635 - RNA, 21 nt, Homo sapiens
cauaaugcuacuuauuuuaug

SEQ ID NO: 199636 - RNA, 22 nt, Homo sapiens
cauacaagcuacaaucacaaag

SEQ ID NO: 199637 - RNA, 22 nt, Homo sapiens
caucaaaguggagggaaggacc

SEQ ID NO: 199638 - RNA, 22 nt, Homo sapiens
caucacacuuggauguaagaca

SEQ ID NO: 199639 - RNA, 22 nt, Homo sapiens
gagaagugcgucguuugaugau

SEQ ID NO: 199640 - RNA, 22 nt, Homo sapiens
gagacggagucucgcucuguca

SEQ ID NO: 199641 - RNA, 22 nt, Homo sapiens
gagacugagucuugcucuguca

SEQ ID NO: 199642 - RNA, 22 nt, Homo sapiens
gagagcaugugcuggcaucagu

SEQ ID NO: 199643 - RNA, 22 nt, Homo sapiens
gagagguaguuuuuuggucguc

SEQ ID NO: 199644 - RNA, 22 nt, Homo sapiens
gagagucacagugaauguggca

SEQ ID NO: 199645 - RNA, 22 nt, Homo sapiens
gagagugcuuggcaucugcuga

SEQ ID NO: 199646 - RNA, 23 nt, Homo sapiens
gagaucauucuggaauuagagug

SEQ ID NO: 199647 - RNA, 23 nt, Homo sapiens
auaaacugucaaaagccagcccu

SEQ ID NO: 199648 - RNA, 22 nt, Homo sapiens
auaaagacacuuggcaugauuu

SEQ ID NO: 199649 - RNA, 22 nt, Homo sapiens
auaaagccaggagacguaauug

SEQ ID NO: 199650 - RNA, 22 nt, Homo sapiens
auaaauaguaguugugguggcc

SEQ ID NO: 199651 - RNA, 22 nt, Homo sapiens
auaacaggaaauacagggcuuu

SEQ ID NO: 199652 - RNA, 22 nt, Homo sapiens
auaagaucauuugcuaagaggg

SEQ ID NO: 199653 - RNA, 22 nt, Homo sapiens
auaagaugaaggaagccauauc

SEQ ID NO: 199654 - RNA, 22 nt, Homo sapiens
auaaguauuuggacuuuacugu

SEQ ID NO: 199655 - RNA, 19 nt, Homo sapiens
auaagugaaucacgggggc

SEQ ID NO: 199656 - RNA, 22 nt, Homo sapiens
auacaaggaaugaagagauuug

SEQ ID NO: 199657 - RNA, 22 nt, Homo sapiens
auacaagugccauguuggugug

SEQ ID NO: 199658 - RNA, 22 nt, Homo sapiens
auacagguauacaaugcauaau

SEQ ID NO: 199659 - RNA, 22 nt, Homo sapiens
auacagugaauacuuacagugu

SEQ ID NO: 199660 - RNA, 22 nt, Homo sapiens
ugaaauacuuuggcucuuuguu

SEQ ID NO: 199661 - RNA, 22 nt, Homo sapiens
ugaaaugcuaauucguagcuaa

SEQ ID NO: 199662 - RNA, 22 nt, Homo sapiens
ugaaauguugggugauggaauc

SEQ ID NO: 199663 - RNA, 22 nt, Homo sapiens
ugaaauuuuuuauucguuggcu

SEQ ID NO: 199664 - RNA, 22 nt, Homo sapiens
ugaaggacauaaggcagaguga

SEQ ID NO: 199665 - RNA, 20 nt, Homo sapiens
ugaaggaggucauuuauacc

SEQ ID NO: 199666 - RNA, 22 nt, Homo sapiens
ugaaggcaggagggagaaaagu

SEQ ID NO: 199667 - RNA, 22 nt, Homo sapiens
ugaagugaaugguaaguaugcc

SEQ ID NO: 199668 - RNA, 22 nt, Homo sapiens
ugaaguguuuuuucaggcaugu

SEQ ID NO: 199669 - RNA, 22 nt, Homo sapiens
ugaauacuucaaaaaaauagcu

SEQ ID NO: 199670 - RNA, 22 nt, Homo sapiens
ugaauagaaguggcaggaguag

SEQ ID NO: 199671 - RNA, 22 nt, Homo sapiens
ugaauauguuucuaaaagugca

SEQ ID NO: 199672 - RNA, 21 nt, Homo sapiens
ugaauauuuggguugugucca

SEQ ID NO: 199673 - RNA, 22 nt, Homo sapiens
ugaaugguuuuuagagaacaau

SEQ ID NO: 199674 - RNA, 23 nt, Homo sapiens
ugaauguaucgaaugugggaaag

SEQ ID NO: 199675 - RNA, 22 nt, Homo sapiens
ugaauguauuuauuaccauuca

SEQ ID NO: 199676 - RNA, 22 nt, Homo sapiens
ugaauucaucucacagaguuaa

SEQ ID NO: 199677 - RNA, 22 nt, Homo sapiens
ugacaagaaagcgucuucuuuu

SEQ ID NO: 199678 - RNA, 22 nt, Homo sapiens
ugacaagugauuaaggcauauu

SEQ ID NO: 199679 - RNA, 22 nt, Homo sapiens
ugacacuugcccuuagaaacau

SEQ ID NO: 199680 - RNA, 22 nt, Homo sapiens
ugacagagaagcauugaguuca

SEQ ID NO: 199681 - RNA, 18 nt, Homo sapiens
ugacagcacaugugggga

SEQ ID NO: 199682 - RNA, 22 nt, Homo sapiens
ugacaggauggagaucgguauu

SEQ ID NO: 199683 - RNA, 22 nt, Homo sapiens
ugacagucaccaggacccacag

SEQ ID NO: 199684 - RNA, 22 nt, Homo sapiens
ugacagugaauaagucucuuaa

SEQ ID NO: 199685 - RNA, 22 nt, Homo sapiens
ugacaguguccuccuccugaga

SEQ ID NO: 199686 - RNA, 20 nt, Homo sapiens
ugacaguuaagggauagaag

SEQ ID NO: 199687 - RNA, 22 nt, Homo sapiens
ugacauggugcucuuucaggca

SEQ ID NO: 199688 - RNA, 22 nt, Homo sapiens
ugacccauagaaauguggauaa

SEQ ID NO: 199689 - RNA, 22 nt, Homo sapiens
ugacuacaaccuccaccucccg

SEQ ID NO: 199690 - RNA, 22 nt, Homo sapiens
ugacuacaccacacgguuaagg

SEQ ID NO: 199691 - RNA, 22 nt, Homo sapiens
ugacuacaggucaggaagcugu

SEQ ID NO: 199692 - RNA, 22 nt, Homo sapiens
ugacuacauaaguaaucucaaa

SEQ ID NO: 199693 - RNA, 22 nt, Homo sapiens
ugacuagagcaauuggaaacaa

SEQ ID NO: 199694 - RNA, 22 nt, Homo sapiens
ugacuagucauaggcauggggg

SEQ ID NO: 199695 - RNA, 22 nt, Homo sapiens
ugacuaguuuugcuguuguuau

SEQ ID NO: 199696 - RNA, 22 nt, Homo sapiens
ugacucaguuguuagucuucau

SEQ ID NO: 199697 - RNA, 22 nt, Homo sapiens
ugacuggagaccucaguagggu

SEQ ID NO: 199698 - RNA, 22 nt, Homo sapiens
ugacuuuagaauuuuauccaga

SEQ ID NO: 199699 - RNA, 22 nt, Homo sapiens
ugagaacagcagcuugggacac

SEQ ID NO: 199700 - RNA, 20 nt, Homo sapiens
ugagaacauguggcauuugg

SEQ ID NO: 199701 - RNA, 19 nt, Homo sapiens
ugagaaccucuacagaguc

SEQ ID NO: 199702 - RNA, 22 nt, Homo sapiens
ugagaacugccuguauuuaucu

SEQ ID NO: 199703 - RNA, 22 nt, Homo sapiens
ugagaauauuugaagauguuag

SEQ ID NO: 199704 - RNA, 22 nt, Homo sapiens
ugagaaugacugggcaugcugc

SEQ ID NO: 199705 - RNA, 22 nt, Homo sapiens
ugagacaaaguuguuggauguu

SEQ ID NO: 199706 - RNA, 22 nt, Homo sapiens
ugagacacugaauccggccuga

SEQ ID NO: 199707 - RNA, 22 nt, Homo sapiens
ugagacaugugaacuguaguuc

SEQ ID NO: 199708 - RNA, 22 nt, Homo sapiens
ugagacaugugaauauuuguac

SEQ ID NO: 199709 - RNA, 23 nt, Homo sapiens
ugagacauuggaaaguuaggcag

SEQ ID NO: 199710 - RNA, 22 nt, Homo sapiens
ugagacugagucuugcucuauu

SEQ ID NO: 199711 - RNA, 22 nt, Homo sapiens
ugagagacaguuucgucggagg

SEQ ID NO: 199712 - RNA, 22 nt, Homo sapiens
ugagagacauuuguuguagagu

SEQ ID NO: 199713 - RNA, 22 nt, Homo sapiens
ugagagcuuuuuugccugguga

SEQ ID NO: 199714 - RNA, 22 nt, Homo sapiens
ugagaggugauaaagcaagggu

SEQ ID NO: 199715 - RNA, 22 nt, Homo sapiens
ugagauaaucaugugauuucau

SEQ ID NO: 199716 - RNA, 22 nt, Homo sapiens
ugagauagggucucacucuguc

SEQ ID NO: 199717 - RNA, 22 nt, Homo sapiens
ugagaucacgccacugcacucc

SEQ ID NO: 199718 - RNA, 22 nt, Homo sapiens
ugagaucacuaagagguaaugg

SEQ ID NO: 199719 - RNA, 19 nt, Homo sapiens
ugagauccacugaagauuc

SEQ ID NO: 199720 - RNA, 22 nt, Homo sapiens
ugagaucucauuaugguuuuaa

SEQ ID NO: 199721 - RNA, 22 nt, Homo sapiens
ugagaucuuuuguggcugagaa

SEQ ID NO: 199722 - RNA, 22 nt, Homo sapiens
ugagaugaagcuagaagaaugg

SEQ ID NO: 199723 - RNA, 22 nt, Homo sapiens
ugagaugaggucucacucuguu

SEQ ID NO: 199724 - RNA, 22 nt, Homo sapiens
ugagaugaggucucgcucuguc

SEQ ID NO: 199725 - RNA, 22 nt, Homo sapiens
ugagaugauaucuuauuguaau

SEQ ID NO: 199726 - RNA, 21 nt, Homo sapiens
ugagaugauccugcaugcaug

SEQ ID NO: 199727 - RNA, 22 nt, Homo sapiens
ugagaugaugggauaagagggc

SEQ ID NO: 199728 - RNA, 22 nt, Homo sapiens
ugagaugauuuaauggagccca

SEQ ID NO: 199729 - RNA, 22 nt, Homo sapiens
ugagauggguaauuaaauggug

SEQ ID NO: 199730 - RNA, 22 nt, Homo sapiens
ugagauguuccaaugacuauua

SEQ ID NO: 199731 - RNA, 21 nt, Homo sapiens
ugagauuaaguuguuuagaag

SEQ ID NO: 199732 - RNA, 23 nt, Homo sapiens
ugagauuauaaucuuuuacuucu

SEQ ID NO: 199733 - RNA, 22 nt, Homo sapiens
ugucuuggagaauccuggguuu

SEQ ID NO: 199734 - RNA, 22 nt, Homo sapiens
ugucuuuguuaguuguccuagu

SEQ ID NO: 199735 - RNA, 22 nt, Homo sapiens
ugugaaacauggauagaacugg

SEQ ID NO: 199736 - RNA, 22 nt, Homo sapiens
ugugaacauuuuguauauauua

SEQ ID NO: 199737 - RNA, 19 nt, Homo sapiens
ugugaagaaaugcugcaag

SEQ ID NO: 199738 - RNA, 22 nt, Homo sapiens
ugugaagaugagaugacgcccu

SEQ ID NO: 199739 - RNA, 22 nt, Homo sapiens
ugugaauggugcuuccuagaug

SEQ ID NO: 199740 - RNA, 22 nt, Homo sapiens
ugugacacugaauggcagaacu

SEQ ID NO: 199741 - RNA, 22 nt, Homo sapiens
ugugacagcacagcaucucuuu

SEQ ID NO: 199742 - RNA, 22 nt, Homo sapiens
ugugacaguuaguuugguguua

SEQ ID NO: 199743 - RNA, 22 nt, Homo sapiens
ugugauaguuggcuaaagcagu

SEQ ID NO: 199744 - RNA, 22 nt, Homo sapiens
ugugaugcagggccugggccuc

SEQ ID NO: 199745 - RNA, 22 nt, Homo sapiens
ugugaugugaugagaaguuccu

SEQ ID NO: 199746 - RNA, 22 nt, Homo sapiens
ugugauuauuuaaauaggacag

SEQ ID NO: 199747 - RNA, 22 nt, Homo sapiens
ugugauuauuuauagacaguca

SEQ ID NO: 199748 - RNA, 22 nt, Homo sapiens
ugugcaaauguuaaacuaacuu

SEQ ID NO: 199749 - RNA, 22 nt, Homo sapiens
ugugcacaacaugcagguuugu

SEQ ID NO: 199750 - RNA, 22 nt, Homo sapiens
ugugccacugcacuucagccug

SEQ ID NO: 199751 - RNA, 22 nt, Homo sapiens
ugugcuaauacauacagugcua

SEQ ID NO: 199752 - RNA, 22 nt, Homo sapiens
ugugcuugaauuuaguagcuua

SEQ ID NO: 199753 - RNA, 22 nt, Homo sapiens
uguggaaauuguuguauuuaau

SEQ ID NO: 199754 - RNA, 22 nt, Homo sapiens
uguggaguguaugugacagaga

SEQ ID NO: 199755 - RNA, 22 nt, Homo sapiens
uguggcaaauggucaggaagaa

SEQ ID NO: 199756 - RNA, 22 nt, Homo sapiens
uguggccuuuguuucaguuggg

SEQ ID NO: 199757 - RNA, 22 nt, Homo sapiens
uguggcucuucuguucuccacu

SEQ ID NO: 199758 - RNA, 22 nt, Homo sapiens
uguggcugguggcaccuuuucc

SEQ ID NO: 199759 - RNA, 18 nt, Homo sapiens
uguggcuguuuuccaaua

SEQ ID NO: 199760 - RNA, 22 nt, Homo sapiens
ugugguuuuucacauuuagaga

SEQ ID NO: 199761 - RNA, 22 nt, Homo sapiens
ugugguuuuuuucuccaauagg

SEQ ID NO: 199762 - RNA, 22 nt, Homo sapiens
uguguaaauaugauagaggaau

SEQ ID NO: 199763 - RNA, 22 nt, Homo sapiens
ugugucacugcacuccagccug

SEQ ID NO: 199764 - RNA, 22 nt, Homo sapiens
ugugucuugaauuuuguaugua

SEQ ID NO: 199765 - RNA, 22 nt, Homo sapiens
ugugucuugagagucucgagaa

SEQ ID NO: 199766 - RNA, 22 nt, Homo sapiens
ugugucuugcuggugccugcau

SEQ ID NO: 199767 - RNA, 22 nt, Homo sapiens
ugugucuuguuuauagcuuucu

SEQ ID NO: 199768 - RNA, 22 nt, Homo sapiens
uguuacacugugcacuaaauuu

SEQ ID NO: 199769 - RNA, 22 nt, Homo sapiens
uguuaugaagaugccugguaca

SEQ ID NO: 199770 - RNA, 22 nt, Homo sapiens
uguucauggauccaguggcuuc

SEQ ID NO: 199771 - RNA, 22 nt, Homo sapiens
uguucuggagccgguucaaaug

SEQ ID NO: 199772 - RNA, 19 nt, Homo sapiens
uguugcacauaucaauaug

SEQ ID NO: 199773 - RNA, 22 nt, Homo sapiens
ugccugcugucuaauauauucu

SEQ ID NO: 199774 - RNA, 22 nt, Homo sapiens
ugcgauaguuugcugguaaauu

SEQ ID NO: 199775 - RNA, 21 nt, Homo sapiens
ugcuacugucacuuccuuugu

SEQ ID NO: 199776 - RNA, 22 nt, Homo sapiens
ugcuagaagaucacacacauca

SEQ ID NO: 199777 - RNA, 21 nt, Homo sapiens
ugcuauguuguccaggcuggc

SEQ ID NO: 199778 - RNA, 22 nt, Homo sapiens
ugcuggcguuacucuccaucag

SEQ ID NO: 199779 - RNA, 22 nt, Homo sapiens
ugcuggugucaucaaggcuuug

SEQ ID NO: 199780 - RNA, 22 nt, Homo sapiens
ugcugguuuaaaaugcaaauuc

SEQ ID NO: 199781 - RNA, 22 nt, Homo sapiens
ugcugguuuucaucaucagugg

SEQ ID NO: 199782 - RNA, 22 nt, Homo sapiens
ugcuuugguagaaaucuuuggu

SEQ ID NO: 199783 - RNA, 22 nt, Homo sapiens
uggaaaacaugcacauuggauu

SEQ ID NO: 199784 - RNA, 22 nt, Homo sapiens
uggaaaguaguucuaaucuaag

SEQ ID NO: 199785 - RNA, 20 nt, Homo sapiens
uggaaauuaaccuuucaggu

SEQ ID NO: 199786 - RNA, 22 nt, Homo sapiens
uggaagacauuuuggaccuugg

SEQ ID NO: 199787 - RNA, 22 nt, Homo sapiens
uggaagccuagauucuuuucuu

SEQ ID NO: 199788 - RNA, 21 nt, Homo sapiens
uggaaguguacaauuauaccc

SEQ ID NO: 199789 - RNA, 19 nt, Homo sapiens
uggaaugaaauguuagggg

SEQ ID NO: 199790 - RNA, 22 nt, Homo sapiens
uggaaugcuaagcaugugggag

SEQ ID NO: 199791 - RNA, 17 nt, Homo sapiens
uggaaugucuaagccug

SEQ ID NO: 199792 - RNA, 21 nt, Homo sapiens
uggaauguucugacuucaggg

SEQ ID NO: 199793 - RNA, 21 nt, Homo sapiens
uggaauuaauggagagguguu

SEQ ID NO: 199794 - RNA, 22 nt, Homo sapiens
uggacaagugcccuccaccuca

SEQ ID NO: 199795 - RNA, 21 nt, Homo sapiens
uggaccccuuccagucaucau

SEQ ID NO: 199796 - RNA, 22 nt, Homo sapiens
uggagagcaaagaauuuguuag

SEQ ID NO: 199797 - RNA, 22 nt, Homo sapiens
uggagagugagggccuccuuaa

SEQ ID NO: 199798 - RNA, 22 nt, Homo sapiens
uggagcccuaguuccucauaac

SEQ ID NO: 199799 - RNA, 19 nt, Homo sapiens
uggagucaucaugcugcua

SEQ ID NO: 199800 - RNA, 22 nt, Homo sapiens
uggagugcaauggcaccaucuu

SEQ ID NO: 199801 - RNA, 22 nt, Homo sapiens
uggauagauacuauccaggacu

SEQ ID NO: 199802 - RNA, 22 nt, Homo sapiens
uggauuuuaauuauucugucau

SEQ ID NO: 199803 - RNA, 22 nt, Homo sapiens
ugagcacagagccugggguggc

SEQ ID NO: 199804 - RNA, 22 nt, Homo sapiens
ugagcagaaguuuugauuggcg

SEQ ID NO: 199805 - RNA, 22 nt, Homo sapiens
ugagcauauuuaagguaugcua

SEQ ID NO: 199806 - RNA, 21 nt, Homo sapiens
ugagcauuaguacaguaggga

SEQ ID NO: 199807 - RNA, 22 nt, Homo sapiens
ugagcauuguguuugacuguga

SEQ ID NO: 199808 - RNA, 22 nt, Homo sapiens
ugagcucaugcauucuugagga

SEQ ID NO: 199809 - RNA, 22 nt, Homo sapiens
ugagcuguuugaagaagcauuu

SEQ ID NO: 199810 - RNA, 22 nt, Homo sapiens
ugaggaguguauuucauucgcu

SEQ ID NO: 199811 - RNA, 22 nt, Homo sapiens
ugaggcaaggcugaaugaaggc

SEQ ID NO: 199812 - RNA, 17 nt, Homo sapiens
ugaggcacuaguaucac

SEQ ID NO: 199813 - RNA, 22 nt, Homo sapiens
ugaggcacucuagacuuauuca

SEQ ID NO: 199814 - RNA, 22 nt, Homo sapiens
ugaggcuagucagaucagauga

SEQ ID NO: 199815 - RNA, 22 nt, Homo sapiens
ugagguaacaaacuaugaguua

SEQ ID NO: 199816 - RNA, 22 nt, Homo sapiens
ugagguaacagaagcgagcauu

SEQ ID NO: 199817 - RNA, 22 nt, Homo sapiens
ugagguaauagauaauauuuuu

SEQ ID NO: 199818 - RNA, 22 nt, Homo sapiens
ugagguaaugcuguagcuguga

SEQ ID NO: 199819 - RNA, 22 nt, Homo sapiens
ugagguagaggugaacuugacc

SEQ ID NO: 199820 - RNA, 22 nt, Homo sapiens
ugagguaugugaugucuuuuag

SEQ ID NO: 199821 - RNA, 20 nt, Homo sapiens
ugaggucaggaguuacagac

SEQ ID NO: 199822 - RNA, 22 nt, Homo sapiens
ugaggucuuuauuuagugcuca

SEQ ID NO: 199823 - RNA, 22 nt, Homo sapiens
ugaggugaaguaauauucuaag

SEQ ID NO: 199824 - RNA, 22 nt, Homo sapiens
ugagguugaaggacauuuuuau

SEQ ID NO: 199825 - RNA, 22 nt, Homo sapiens
ugagguuggggucagggcuagc

SEQ ID NO: 199826 - RNA, 22 nt, Homo sapiens
ugagguugucagugucauucuu

SEQ ID NO: 199827 - RNA, 22 nt, Homo sapiens
ugaguagaaauaaacgcaaacu

SEQ ID NO: 199828 - RNA, 22 nt, Homo sapiens
ugaguagaacuagucuagagcu

SEQ ID NO: 199829 - RNA, 20 nt, Homo sapiens
ugaguagaggaguucuauca

SEQ ID NO: 199830 - RNA, 18 nt, Homo sapiens
aaaaagugcucaggccua

SEQ ID NO: 199831 - RNA, 22 nt, Homo sapiens
aaaagucuguagugaaagguga

SEQ ID NO: 199832 - RNA, 22 nt, Homo sapiens
aaagaguucagguagauuucaa

SEQ ID NO: 199833 - RNA, 22 nt, Homo sapiens
aaagcuaagguagcauuggaga

SEQ ID NO: 199834 - RNA, 22 nt, Homo sapiens
aaaggcuucggaucagaaggua

SEQ ID NO: 199835 - RNA, 22 nt, Homo sapiens
aaagucuagaggaucaugugug

SEQ ID NO: 199836 - RNA, 22 nt, Homo sapiens
aaagugaauguaucccguaagu

SEQ ID NO: 199837 - RNA, 22 nt, Homo sapiens
aaagugauguccaggcuuucag

SEQ ID NO: 199838 - RNA, 22 nt, Homo sapiens
aaagugcugggauuaggccagg

SEQ ID NO: 199839 - RNA, 22 nt, Homo sapiens
aaagugcuucucuuuggugggu

SEQ ID NO: 199840 - RNA, 22 nt, Homo sapiens
aaaguggugggauuccaggcau

SEQ ID NO: 199841 - RNA, 22 nt, Homo sapiens
aaagugguuuuucagacuuuga

SEQ ID NO: 199842 - RNA, 22 nt, Homo sapiens
aaauaacugucagguucuggaa

SEQ ID NO: 199843 - RNA, 22 nt, Homo sapiens
aaaucccuugcucucucagacc

SEQ ID NO: 199844 - RNA, 22 nt, Homo sapiens
aaaugcauugagggaaaaggca

SEQ ID NO: 199845 - RNA, 22 nt, Homo sapiens
aaaugcccuaaaauggagcauc

SEQ ID NO: 199846 - RNA, 22 nt, Homo sapiens
aaaugcugcuuuggccucuucu

SEQ ID NO: 199847 - RNA, 22 nt, Homo sapiens
aaaugcugucugugagccucau

SEQ ID NO: 199848 - RNA, 22 nt, Homo sapiens
aaauggcaccggcucuucccuc

SEQ ID NO: 199849 - RNA, 22 nt, Homo sapiens
aaauugcacaaguggugauuug

SEQ ID NO: 199850 - RNA, 22 nt, Homo sapiens
aacaccauucucuguaacaaga

SEQ ID NO: 199851 - RNA, 22 nt, Homo sapiens
aacaccuugcagggauuaugac

SEQ ID NO: 199852 - RNA, 22 nt, Homo sapiens
aacacuggcugcucgaguucuc

SEQ ID NO: 199853 - RNA, 22 nt, Homo sapiens
aacacuguuuccagucaugauc

SEQ ID NO: 199854 - RNA, 22 nt, Homo sapiens
aacagagcuggugacuccaggu

SEQ ID NO: 199855 - RNA, 22 nt, Homo sapiens
aacaguaucuaacgagugauga

SEQ ID NO: 199856 - RNA, 21 nt, Homo sapiens
aacagugcuuaguagauguuc

SEQ ID NO: 199857 - RNA, 20 nt, Homo sapiens
aacaguguguaaguuuccuu

SEQ ID NO: 199858 - RNA, 22 nt, Homo sapiens
aacauagucaugggguaauguu

SEQ ID NO: 199859 - RNA, 22 nt, Homo sapiens
aacauguuuagcagauaccugu

SEQ ID NO: 199860 - RNA, 22 nt, Homo sapiens
aacuacaucucuuugaggcagg

SEQ ID NO: 199861 - RNA, 22 nt, Homo sapiens
aacucugucuccuucaaguuca

SEQ ID NO: 199862 - RNA, 22 nt, Homo sapiens
aacugcuguuuggguacuggug

SEQ ID NO: 199863 - RNA, 22 nt, Homo sapiens
aacuggcacuacaucaagagcu

SEQ ID NO: 199864 - RNA, 22 nt, Homo sapiens
aacuggccugagaugaaaagug

SEQ ID NO: 199865 - RNA, 22 nt, Homo sapiens
aacuugcacuugauugagagcu

SEQ ID NO: 199866 - RNA, 20 nt, Homo sapiens
aagacacuguccccacugga

SEQ ID NO: 199867 - RNA, 22 nt, Homo sapiens
aagagagccagcugguauauuu

SEQ ID NO: 199868 - RNA, 22 nt, Homo sapiens
aagagcauuauuuaguaauuuc

SEQ ID NO: 199869 - RNA, 20 nt, Homo sapiens
aagagcucaccagaauaucu

SEQ ID NO: 199870 - RNA, 22 nt, Homo sapiens
aagagguaauaacaaagcuucu

SEQ ID NO: 199871 - RNA, 22 nt, Homo sapiens
aagagguagcagucacaaaaga

SEQ ID NO: 199872 - RNA, 22 nt, Homo sapiens
aagagguagucugucccuuagc

SEQ ID NO: 199873 - RNA, 19 nt, Homo sapiens
aagaugauguuugggcuaa

SEQ ID NO: 199874 - RNA, 22 nt, Homo sapiens
aagcaacacaucugccccgguu

SEQ ID NO: 199875 - RNA, 22 nt, Homo sapiens
aagcacaauuucaccuucuugu

SEQ ID NO: 199876 - RNA, 21 nt, Homo sapiens
aagcacauugaguguguguga

SEQ ID NO: 199877 - RNA, 20 nt, Homo sapiens
aagcagacauuuggaugaaa

SEQ ID NO: 199878 - RNA, 22 nt, Homo sapiens
aagcagauguguugaaaguacu

SEQ ID NO: 199879 - RNA, 22 nt, Homo sapiens
augugcaauggugucaccacau

SEQ ID NO: 199880 - RNA, 22 nt, Homo sapiens
augugcacauucugguaaauau

SEQ ID NO: 199881 - RNA, 20 nt, Homo sapiens
augugcuaauauuaauaugu

SEQ ID NO: 199882 - RNA, 22 nt, Homo sapiens
augugcuuauagguguauguuu

SEQ ID NO: 199883 - RNA, 22 nt, Homo sapiens
auguguauuaccucgauuguga

SEQ ID NO: 199884 - RNA, 22 nt, Homo sapiens
auguuaacaucuuaguuuucau

SEQ ID NO: 199885 - RNA, 20 nt, Homo sapiens
auguucuggaggacagaagc

SEQ ID NO: 199886 - RNA, 22 nt, Homo sapiens
auguuuagagagggugucaaau

SEQ ID NO: 199887 - RNA, 22 nt, Homo sapiens
auguuugguaagaauauuguua

SEQ ID NO: 199888 - RNA, 22 nt, Homo sapiens
auguuugguagugaauauggua

SEQ ID NO: 199889 - RNA, 22 nt, Homo sapiens
auuaagagcacauguucugggu

SEQ ID NO: 199890 - RNA, 23 nt, Homo sapiens
auuaagguuacuacaguaugagg

SEQ ID NO: 199891 - RNA, 22 nt, Homo sapiens
auuaagugcuugcagaagucca

SEQ ID NO: 199892 - RNA, 22 nt, Homo sapiens
auuacauagucaaggugucuca

SEQ ID NO: 199893 - RNA, 22 nt, Homo sapiens
auuacccuuagacuccagagug

SEQ ID NO: 199894 - RNA, 20 nt, Homo sapiens
auuagacuugccuuauccuu

SEQ ID NO: 199895 - RNA, 22 nt, Homo sapiens
auuagaugguuauaggugugag

SEQ ID NO: 199896 - RNA, 22 nt, Homo sapiens
auuauuagucggccagcuguua

SEQ ID NO: 199897 - RNA, 22 nt, Homo sapiens
auucaaagugcauguucccacu

SEQ ID NO: 199898 - RNA, 22 nt, Homo sapiens
auucaagugaugugauucuucu

SEQ ID NO: 199899 - RNA, 20 nt, Homo sapiens
auucauggaggagcaauugg

SEQ ID NO: 199900 - RNA, 22 nt, Homo sapiens
auuccacaguuaacacagaccg

SEQ ID NO: 199901 - RNA, 22 nt, Homo sapiens
auuccacuuacaugaaguaccu

SEQ ID NO: 199902 - RNA, 22 nt, Homo sapiens
auuccuuaggcccuuugguuag

SEQ ID NO: 199903 - RNA, 18 nt, Homo sapiens
auucuacaggccuuuuga

SEQ ID NO: 199904 - RNA, 22 nt, Homo sapiens
auugaacaugccauauguacca

SEQ ID NO: 199905 - RNA, 22 nt, Homo sapiens
auugagcaaggucuccuaguau

SEQ ID NO: 199906 - RNA, 22 nt, Homo sapiens
auugcacacagaaucaggguaa

SEQ ID NO: 199907 - RNA, 18 nt, Homo sapiens
auugcacaccagccuggg

SEQ ID NO: 199908 - RNA, 21 nt, Homo sapiens
auugcacuccagccugggcga

SEQ ID NO: 199909 - RNA, 22 nt, Homo sapiens
auugcauugugaucuucccaga

SEQ ID NO: 199910 - RNA, 22 nt, Homo sapiens
auugccucaauuccaagacugc

SEQ ID NO: 199911 - RNA, 22 nt, Homo sapiens
auugcucacacaaagccuguuu

SEQ ID NO: 199912 - RNA, 22 nt, Homo sapiens
auuggucuugaaaccagagaga

SEQ ID NO: 199913 - RNA, 22 nt, Homo sapiens
auuguaauuuuagagaaagugg

SEQ ID NO: 199914 - RNA, 22 nt, Homo sapiens
auuguaccccaauguacaauau

SEQ ID NO: 199915 - RNA, 22 nt, Homo sapiens
auugucacugugcuccaccagu

SEQ ID NO: 199916 - RNA, 22 nt, Homo sapiens
auugugauggucaaaggaaaua

SEQ ID NO: 199917 - RNA, 19 nt, Homo sapiens
auuuccuggagcuggucuc

SEQ ID NO: 199918 - RNA, 22 nt, Homo sapiens
auuugacacugagagccucagu

SEQ ID NO: 199919 - RNA, 22 nt, Homo sapiens
auuugucacuuaacagccauua

SEQ ID NO: 199920 - RNA, 22 nt, Homo sapiens
auuuuuggauauagggaaggau

SEQ ID NO: 199921 - RNA, 22 nt, Homo sapiens
auuuuugguuucaccugcacgc

SEQ ID NO: 199922 - RNA, 22 nt, Homo sapiens
caaaagugauugcgguuuuugc

SEQ ID NO: 199923 - RNA, 22 nt, Homo sapiens
caaagcacuuggcuuggaagau

SEQ ID NO: 199924 - RNA, 22 nt, Homo sapiens
caaagucuucaguugauucuga

SEQ ID NO: 199925 - RNA, 22 nt, Homo sapiens
caaagucuucucauuaugucuu

SEQ ID NO: 199926 - RNA, 22 nt, Homo sapiens
caaagugcugaaagaggccagg

SEQ ID NO: 199927 - RNA, 22 nt, Homo sapiens
caaagugcugggacuggccggg

SEQ ID NO: 199928 - RNA, 22 nt, Homo sapiens
caaauugcuugucuguagugga

SEQ ID NO: 199929 - RNA, 22 nt, Homo sapiens
caaccaguagcugaguucaaaa

SEQ ID NO: 199930 - RNA, 22 nt, Homo sapiens
caagagaccugagugucauucu

SEQ ID NO: 199931 - RNA, 22 nt, Homo sapiens
caaggaauucucaauagaguua

SEQ ID NO: 199932 - RNA, 22 nt, Homo sapiens
caagggguggaaaugguagugu

SEQ ID NO: 199933 - RNA, 21 nt, Homo sapiens
caagugaugcuucugcuuuaa

SEQ ID NO: 199934 - RNA, 22 nt, Homo sapiens
caagugcuacagagaaaucuuu

SEQ ID NO: 199935 - RNA, 22 nt, Homo sapiens
caauacuguuaccugaaauagg

SEQ ID NO: 199936 - RNA, 22 nt, Homo sapiens
caaugcauuauucucccacuuc

SEQ ID NO: 199937 - RNA, 22 nt, Homo sapiens
caauggcacuauuggaaaaggu

SEQ ID NO: 199938 - RNA, 22 nt, Homo sapiens
cacagaauucauuggauuaccu

SEQ ID NO: 199939 - RNA, 22 nt, Homo sapiens
cacagcacaggcaugaguguca

SEQ ID NO: 199940 - RNA, 22 nt, Homo sapiens
cacagucugggcuuguuuguac

SEQ ID NO: 199941 - RNA, 22 nt, Homo sapiens
cacaguguuacugguaugaagu

SEQ ID NO: 199942 - RNA, 21 nt, Homo sapiens
cacauggaggcagagagugua

SEQ ID NO: 199943 - RNA, 22 nt, Homo sapiens
cacauguuuuagcauggcuguu

SEQ ID NO: 199944 - RNA, 22 nt, Homo sapiens
caccaggugcccagcacggcca

SEQ ID NO: 199945 - RNA, 23 nt, Homo sapiens
caccaguauaauuagcuuuuaaa

SEQ ID NO: 199946 - RNA, 22 nt, Homo sapiens
caccaguuuuucagugauucaa

SEQ ID NO: 199947 - RNA, 22 nt, Homo sapiens
caccugagcgggaugcucgccu

SEQ ID NO: 199948 - RNA, 22 nt, Homo sapiens
caccuguacauggcaguguccu

SEQ ID NO: 199949 - RNA, 22 nt, Homo sapiens
cacugcacuccagcuugugggc

SEQ ID NO: 199950 - RNA, 22 nt, Homo sapiens
cacugcacuccagucccgucuc

SEQ ID NO: 199951 - RNA, 22 nt, Homo sapiens
cacugcauucuccaccucccag

SEQ ID NO: 199952 - RNA, 22 nt, Homo sapiens
augucacugcacuccugccugg

SEQ ID NO: 199953 - RNA, 22 nt, Homo sapiens
augucauagauaaggaagugga

SEQ ID NO: 199954 - RNA, 22 nt, Homo sapiens
auguccaugagcacauguauca

SEQ ID NO: 199955 - RNA, 22 nt, Homo sapiens
augucuuucauagagacccaga

SEQ ID NO: 199956 - RNA, 17 nt, Homo sapiens
augugaauguucaaaua

SEQ ID NO: 199957 - RNA, 22 nt, Homo sapiens
augugacagcaacccccagccc

SEQ ID NO: 199958 - RNA, 22 nt, Homo sapiens
ucuggguuuuuacaauguuuac

SEQ ID NO: 199959 - RNA, 22 nt, Homo sapiens
ucugguggugaugagagacagu

SEQ ID NO: 199960 - RNA, 22 nt, Homo sapiens
ucugguuccuuggcuucggguc

SEQ ID NO: 199961 - RNA, 22 nt, Homo sapiens
ucugucuugugguuugagugcc

SEQ ID NO: 199962 - RNA, 22 nt, Homo sapiens
ucugucuuugucaggaccagag

SEQ ID NO: 199963 - RNA, 19 nt, Homo sapiens
ucugugcuugucccccugu

SEQ ID NO: 199964 - RNA, 22 nt, Homo sapiens
ucuguggucagcauccgccacu

SEQ ID NO: 199965 - RNA, 22 nt, Homo sapiens
ucuguggugggcuccacccagu

SEQ ID NO: 199966 - RNA, 22 nt, Homo sapiens
ucuguuguuguuuuaagagaca

SEQ ID NO: 199967 - RNA, 22 nt, Homo sapiens
ucuuaggauacugaagucgguu

SEQ ID NO: 199968 - RNA, 22 nt, Homo sapiens
ucuuaggugaugauugauguga

SEQ ID NO: 199969 - RNA, 22 nt, Homo sapiens
ucuugcaguucccaaauucaca

SEQ ID NO: 199970 - RNA, 22 nt, Homo sapiens
ucuugcuuuugcagagcuucuc

SEQ ID NO: 199971 - RNA, 22 nt, Homo sapiens
ucuuugagugcccugagucccu

SEQ ID NO: 199972 - RNA, 22 nt, Homo sapiens
ucuuuggguagauauguagcug

SEQ ID NO: 199973 - RNA, 22 nt, Homo sapiens
ucuuuggguguauuucacagcc

SEQ ID NO: 199974 - RNA, 22 nt, Homo sapiens
ucuuuggucuacuuucauaugu

SEQ ID NO: 199975 - RNA, 22 nt, Homo sapiens
ucuuugguuagguuuaguugau

SEQ ID NO: 199976 - RNA, 22 nt, Homo sapiens
ucuuugguucugugcagccuau

SEQ ID NO: 199977 - RNA, 22 nt, Homo sapiens
ucuuugguucuguuuauguaau

SEQ ID NO: 199978 - RNA, 22 nt, Homo sapiens
ucuuugguugcacugcaggugu

SEQ ID NO: 199979 - RNA, 22 nt, Homo sapiens
ucuuugucuacauccuguuaaa

SEQ ID NO: 199980 - RNA, 22 nt, Homo sapiens
ucuuuguguaggucaaucuggc

SEQ ID NO: 199981 - RNA, 22 nt, Homo sapiens
cauggauuuuuuugaauggcag

SEQ ID NO: 199982 - RNA, 22 nt, Homo sapiens
cauggcacagagaauguguucu

SEQ ID NO: 199983 - RNA, 22 nt, Homo sapiens
cauggcacauauauaucuaggu

SEQ ID NO: 199984 - RNA, 22 nt, Homo sapiens
cauggcacuguaugaaaugugc

SEQ ID NO: 199985 - RNA, 21 nt, Homo sapiens
caugucacugcacucuagccu

SEQ ID NO: 199986 - RNA, 22 nt, Homo sapiens
caugucuuuuaaacauucaacu

SEQ ID NO: 199987 - RNA, 22 nt, Homo sapiens
cauugcacuccacuccugaaca

SEQ ID NO: 199988 - RNA, 22 nt, Homo sapiens
cauugcacuccagccugaguga

SEQ ID NO: 199989 - RNA, 20 nt, Homo sapiens
cauugcacuccagccugcug

SEQ ID NO: 199990 - RNA, 22 nt, Homo sapiens
cauugcacuccagccuggccaa

SEQ ID NO: 199991 - RNA, 22 nt, Homo sapiens
cauugcacuccagccuugguga

SEQ ID NO: 199992 - RNA, 22 nt, Homo sapiens
cauugcacuccagcuugggcga

SEQ ID NO: 199993 - RNA, 22 nt, Homo sapiens
cauugcacuccauccuuggcaa

SEQ ID NO: 199994 - RNA, 22 nt, Homo sapiens
cauugcacugcauucugggcaa

SEQ ID NO: 199995 - RNA, 22 nt, Homo sapiens
cauugguuaguuaacuuuaaga

SEQ ID NO: 199996 - RNA, 22 nt, Homo sapiens
cauugguuccaguuuguccuua

SEQ ID NO: 199997 - RNA, 22 nt, Homo sapiens
cauugguuggacaguucucucu

SEQ ID NO: 199998 - RNA, 22 nt, Homo sapiens
cauuguacauaaguauggagua

SEQ ID NO: 199999 - RNA, 22 nt, Homo sapiens
cauuuuacuuuccagacgugga

SEQ ID NO: 200000 - RNA, 22 nt, Homo sapiens
ccaagccucaguuucccucugu

SEQ ID NO: 200001 - RNA, 22 nt, Homo sapiens
ccaagugcuuaaaauuucauuu

SEQ ID NO: 200002 - RNA, 22 nt, Homo sapiens
ccaaguguucucauuguucaau

SEQ ID NO: 200003 - RNA, 19 nt, Homo sapiens
ccacaaugguugaacuaga

SEQ ID NO: 200004 - RNA, 22 nt, Homo sapiens
ccacaguggauuaaaguuacug

SEQ ID NO: 200005 - RNA, 22 nt, Homo sapiens
ccacccuggagaauuugagguc

SEQ ID NO: 200006 - RNA, 22 nt, Homo sapiens
ccacugcacuccagcccggcaa

SEQ ID NO: 200007 - RNA, 22 nt, Homo sapiens
ccacugggcaguuuauuaucag

SEQ ID NO: 200008 - RNA, 22 nt, Homo sapiens
ccagaauucucauuggaaggaa

SEQ ID NO: 200009 - RNA, 22 nt, Homo sapiens
ccagaguugccucagguuucug

SEQ ID NO: 200010 - RNA, 22 nt, Homo sapiens
ccagaguuucugauucagcagg

SEQ ID NO: 200011 - RNA, 22 nt, Homo sapiens
ccagccgggugcaguggcucac

SEQ ID NO: 200012 - RNA, 22 nt, Homo sapiens
ccaggguugcuuuagauucuga

SEQ ID NO: 200013 - RNA, 18 nt, Homo sapiens
ccagugcaaggaaagccc

SEQ ID NO: 200014 - RNA, 22 nt, Homo sapiens
ccaguguucuggaaggcugagu

SEQ ID NO: 200015 - RNA, 22 nt, Homo sapiens
ccauacugucaaauagauuucc

SEQ ID NO: 200016 - RNA, 22 nt, Homo sapiens
ccaucccuuucugagcaguucc

SEQ ID NO: 200017 - RNA, 21 nt, Homo sapiens
ccaugggacggaaugaauaca

SEQ ID NO: 200018 - RNA, 18 nt, Homo sapiens
ccauucaacagauuuguc

SEQ ID NO: 200019 - RNA, 22 nt, Homo sapiens
ccauuucacucuuccugaagga

SEQ ID NO: 200020 - RNA, 22 nt, Homo sapiens
cccagcguucggcauggcugag

SEQ ID NO: 200021 - RNA, 18 nt, Homo sapiens
cccagugacuuauggccu

SEQ ID NO: 200022 - RNA, 22 nt, Homo sapiens
cccauuguuaaguugaguaucu

SEQ ID NO: 200023 - RNA, 22 nt, Homo sapiens
ccccagugguugcaacagcaga

SEQ ID NO: 200024 - RNA, 22 nt, Homo sapiens
ccccggguggauguacauguga

SEQ ID NO: 200025 - RNA, 21 nt, Homo sapiens
ccccugauacuuagucaagag

SEQ ID NO: 200026 - RNA, 19 nt, Homo sapiens
ccccuguggauaccgaggg

SEQ ID NO: 200027 - RNA, 23 nt, Homo sapiens
cccucagaagugcagggagagaa

SEQ ID NO: 200028 - RNA, 22 nt, Homo sapiens
cccugaagaaagccuaggacau

SEQ ID NO: 200029 - RNA, 22 nt, Homo sapiens
cccugagaugcuguuaaucugu

SEQ ID NO: 200030 - RNA, 22 nt, Homo sapiens
ccggguguuuuguucucucaga

SEQ ID NO: 200031 - RNA, 19 nt, Homo sapiens
ccucaaguacuaauauguu

SEQ ID NO: 200032 - RNA, 22 nt, Homo sapiens
ccucauggagaacaucugcuag

SEQ ID NO: 200033 - RNA, 20 nt, Homo sapiens
cuggaugucgaggcagaggu

SEQ ID NO: 200034 - RNA, 22 nt, Homo sapiens
cuggcucugagguguuuagggc

SEQ ID NO: 200035 - RNA, 22 nt, Homo sapiens
cuggcugagugguaaguagagg

SEQ ID NO: 200036 - RNA, 22 nt, Homo sapiens
cugggaucaguucuagucagaa

SEQ ID NO: 200037 - RNA, 22 nt, Homo sapiens
cuggucaugggggcacccucug

SEQ ID NO: 200038 - RNA, 22 nt, Homo sapiens
cugguuguuacaaagagccugg

SEQ ID NO: 200039 - RNA, 22 nt, Homo sapiens
cugguuguucuggaugggcagg

SEQ ID NO: 200040 - RNA, 22 nt, Homo sapiens
cuguaaagaucacagagcuggu

SEQ ID NO: 200041 - RNA, 23 nt, Homo sapiens
cuguacacauauacaucuaagua

SEQ ID NO: 200042 - RNA, 22 nt, Homo sapiens
cugucacaguuuuggaggccag

SEQ ID NO: 200043 - RNA, 22 nt, Homo sapiens
cugucucagccucuccaguagc

SEQ ID NO: 200044 - RNA, 22 nt, Homo sapiens
cugucuggaggccugcaaauaa

SEQ ID NO: 200045 - RNA, 22 nt, Homo sapiens
cuguggauguauugcacagucu

SEQ ID NO: 200046 - RNA, 22 nt, Homo sapiens
cuguggguuuuacuguuuuacu

SEQ ID NO: 200047 - RNA, 20 nt, Homo sapiens
cugugguagggaccaggaau

SEQ ID NO: 200048 - RNA, 22 nt, Homo sapiens
cuguucaaauuguuugugaagu

SEQ ID NO: 200049 - RNA, 22 nt, Homo sapiens
cuguugguuaaauuccaugcag

SEQ ID NO: 200050 - RNA, 18 nt, Homo sapiens
cuuaacauugggaugaua

SEQ ID NO: 200051 - RNA, 22 nt, Homo sapiens
cuuaaguaguuguggaaugaau

SEQ ID NO: 200052 - RNA, 22 nt, Homo sapiens
cuucaagucuuuggauaauuag

SEQ ID NO: 200053 - RNA, 22 nt, Homo sapiens
ugagagacaguuuguuaaaauu

SEQ ID NO: 200054 - RNA, 22 nt, Homo sapiens
ugagagucacugaccugguaua

SEQ ID NO: 200055 - RNA, 22 nt, Homo sapiens
ugagauaauuuacuuguugagg

SEQ ID NO: 200056 - RNA, 22 nt, Homo sapiens
ugagauaggaucuugcucuguu

SEQ ID NO: 200057 - RNA, 18 nt, Homo sapiens
ugagaucagcaucaaggg

SEQ ID NO: 200058 - RNA, 22 nt, Homo sapiens
ugagaucagugaagaaguguuu

SEQ ID NO: 200059 - RNA, 22 nt, Homo sapiens
ugagaucaugucauuugcacuc

SEQ ID NO: 200060 - RNA, 22 nt, Homo sapiens
ugagauccugugacuacacuga

SEQ ID NO: 200061 - RNA, 22 nt, Homo sapiens
ugagaucgagucucgcucuguc

SEQ ID NO: 200062 - RNA, 22 nt, Homo sapiens
ugagaucugauaggccuggguu

SEQ ID NO: 200063 - RNA, 22 nt, Homo sapiens
ugagaucuguaaagucugacau

SEQ ID NO: 200064 - RNA, 22 nt, Homo sapiens
ugagaucuuaccuuccugccuu

SEQ ID NO: 200065 - RNA, 19 nt, Homo sapiens
ugagaucuuuacuggguuu

SEQ ID NO: 200066 - RNA, 22 nt, Homo sapiens
ugagaugaaagcagaaagacuu

SEQ ID NO: 200067 - RNA, 19 nt, Homo sapiens
ugagaugaagacagggguu

SEQ ID NO: 200068 - RNA, 22 nt, Homo sapiens
ugagaugaagucucacucuguc

SEQ ID NO: 200069 - RNA, 22 nt, Homo sapiens
ugagaugaagucuugcucuguu

SEQ ID NO: 200070 - RNA, 22 nt, Homo sapiens
ugagaugaagugauguaaaaca

SEQ ID NO: 200071 - RNA, 20 nt, Homo sapiens
cuucacagaaguggaaucau

SEQ ID NO: 200072 - RNA, 22 nt, Homo sapiens
cuucaucugguuugugaacuuu

SEQ ID NO: 200073 - RNA, 18 nt, Homo sapiens
cuuccuuagucugguuaa

SEQ ID NO: 200074 - RNA, 22 nt, Homo sapiens
cuucuugagggccugcugggaa

SEQ ID NO: 200075 - RNA, 22 nt, Homo sapiens
cuugacaaugcuucaggcugaa

SEQ ID NO: 200076 - RNA, 23 nt, Homo sapiens
cuugagacaaaugcgugugugca

SEQ ID NO: 200077 - RNA, 22 nt, Homo sapiens
cuugagcauauucuauauuaaa

SEQ ID NO: 200078 - RNA, 22 nt, Homo sapiens
cuugcacauuacagaucugcau

SEQ ID NO: 200079 - RNA, 22 nt, Homo sapiens
cuugcacuccacuguucuccug

SEQ ID NO: 200080 - RNA, 22 nt, Homo sapiens
cuugcagaggcccuggggagag

SEQ ID NO: 200081 - RNA, 22 nt, Homo sapiens
cuugccuuugucuucaaaggcu

SEQ ID NO: 200082 - RNA, 22 nt, Homo sapiens
cuuggcacugcucacccuccuu

SEQ ID NO: 200083 - RNA, 22 nt, Homo sapiens
cuuggcaugaagaauaauuuuu

SEQ ID NO: 200084 - RNA, 22 nt, Homo sapiens
cuuggcuucuuuauguggcuau

SEQ ID NO: 200085 - RNA, 22 nt, Homo sapiens
cuugggauauguguuacucugu

SEQ ID NO: 200086 - RNA, 22 nt, Homo sapiens
cuugguuacauuuuccuagaaa

SEQ ID NO: 200087 - RNA, 22 nt, Homo sapiens
cuuugcaaaacauugagaccuc

SEQ ID NO: 200088 - RNA, 22 nt, Homo sapiens
cuuugcacaucucugcuuuccc

SEQ ID NO: 200089 - RNA, 22 nt, Homo sapiens
cuuuggcacuuccuaagugcca

SEQ ID NO: 200090 - RNA, 19 nt, Homo sapiens
cuuugguugagcguguugg

SEQ ID NO: 200091 - RNA, 22 nt, Homo sapiens
cuuugguuuacuuggugcuagu

SEQ ID NO: 200092 - RNA, 22 nt, Homo sapiens
cuuuguaugucaugacaacugu

SEQ ID NO: 200093 - RNA, 23 nt, Homo sapiens
cuuuguccccacccaaaucucau

SEQ ID NO: 200094 - RNA, 20 nt, Homo sapiens
cuuuuagcagcagcaagaga

SEQ ID NO: 200095 - RNA, 22 nt, Homo sapiens
cuuuuggucuaucagagaagca

SEQ ID NO: 200096 - RNA, 22 nt, Homo sapiens
cuuuuggugguucugaugcagg

SEQ ID NO: 200097 - RNA, 22 nt, Homo sapiens
cuuuuugcugcagcaauacugg

SEQ ID NO: 200098 - RNA, 22 nt, Homo sapiens
gaaaacugcuucucuggguuuc

SEQ ID NO: 200099 - RNA, 22 nt, Homo sapiens
gaaaauccauccccagggagua

SEQ ID NO: 200100 - RNA, 20 nt, Homo sapiens
gaaacaucuauccucuccuu

SEQ ID NO: 200101 - RNA, 22 nt, Homo sapiens
gaaagugcugcaaggccaugca

SEQ ID NO: 200102 - RNA, 21 nt, Homo sapiens
gaaauacugccuuaggagcug

SEQ ID NO: 200103 - RNA, 23 nt, Homo sapiens
gaaauguaagugaugccccacag

SEQ ID NO: 200104 - RNA, 22 nt, Homo sapiens
gaaaugucugagauguggcuca

SEQ ID NO: 200105 - RNA, 22 nt, Homo sapiens
gaagacauuugcugcacguccu

SEQ ID NO: 200106 - RNA, 22 nt, Homo sapiens
gaagagacagguucccacaaaa

SEQ ID NO: 200107 - RNA, 22 nt, Homo sapiens
gaaggcaugcugcauggccaga

SEQ ID NO: 200108 - RNA, 22 nt, Homo sapiens
gaagguacgcuuaggaaaugau

SEQ ID NO: 200109 - RNA, 22 nt, Homo sapiens
gaagguauauucuguuaaugcu

SEQ ID NO: 200110 - RNA, 22 nt, Homo sapiens
gaaucauuggguugauucaaga

SEQ ID NO: 200111 - RNA, 22 nt, Homo sapiens
gaaugcagcagugacagggcug

SEQ ID NO: 200112 - RNA, 22 nt, Homo sapiens
gacacuggguguuuguuggcgu

SEQ ID NO: 200113 - RNA, 22 nt, Homo sapiens
gacacugucuucugcucuuaaa

SEQ ID NO: 200114 - RNA, 20 nt, Homo sapiens
gacauagagacucucaaaaa

SEQ ID NO: 200115 - RNA, 20 nt, Homo sapiens
gacauaggcugguaucuggc

SEQ ID NO: 200116 - RNA, 22 nt, Homo sapiens
gacauguuuacaguguugagag

SEQ ID NO: 200117 - RNA, 22 nt, Homo sapiens
gaccaaagaggcaggcauuaga

SEQ ID NO: 200118 - RNA, 21 nt, Homo sapiens
gacuacaccaggaugcuaguu

SEQ ID NO: 200119 - RNA, 22 nt, Homo sapiens
gacuauguuaccuuacacauca

SEQ ID NO: 200120 - RNA, 19 nt, Homo sapiens
gacuccagaguugugugcu

SEQ ID NO: 200121 - RNA, 22 nt, Homo sapiens
gacugaggaagcgcucucuccu

SEQ ID NO: 200122 - RNA, 22 nt, Homo sapiens
gacuggagcuguaugugguuac

SEQ ID NO: 200123 - RNA, 22 nt, Homo sapiens
gagaaguaaauuuauuugcaaa

SEQ ID NO: 200124 - RNA, 22 nt, Homo sapiens
gagaaugagaggggaaggccac

SEQ ID NO: 200125 - RNA, 22 nt, Homo sapiens
gagaaugagauuaugguuacau

SEQ ID NO: 200126 - RNA, 23 nt, Homo sapiens
gagaccagcuucagaaagcacga

SEQ ID NO: 200127 - RNA, 22 nt, Homo sapiens
gagacggagucucgcucugucg

SEQ ID NO: 200128 - RNA, 22 nt, Homo sapiens
gagacggagucuugcucuguug

SEQ ID NO: 200129 - RNA, 22 nt, Homo sapiens
gagacugagucucacucuguca

SEQ ID NO: 200130 - RNA, 22 nt, Homo sapiens
gagacugagucuugcucugucg

SEQ ID NO: 200131 - RNA, 22 nt, Homo sapiens
gagagugugucagaggcugcga

SEQ ID NO: 200132 - RNA, 22 nt, Homo sapiens
gagauacacccagugcagaggc

SEQ ID NO: 200133 - RNA, 22 nt, Homo sapiens
gagaucuuggccaaguuucuua

SEQ ID NO: 200134 - RNA, 22 nt, Homo sapiens
gagaugaagugucaauaaggau

SEQ ID NO: 200135 - RNA, 22 nt, Homo sapiens
gagauggagucuuuuucuguca

SEQ ID NO: 200136 - RNA, 22 nt, Homo sapiens
gagaugugguucaaggguguuu

SEQ ID NO: 200137 - RNA, 22 nt, Homo sapiens
gagaugugugugauuauauaau

SEQ ID NO: 200138 - RNA, 22 nt, Homo sapiens
gagauguuuguuucacugucac

SEQ ID NO: 200139 - RNA, 22 nt, Homo sapiens
gagcacugauuuauuuuugucu

SEQ ID NO: 200140 - RNA, 22 nt, Homo sapiens
gagcuagggucaugcuacugca

SEQ ID NO: 200141 - RNA, 22 nt, Homo sapiens
gagcuaguguaauauuuugggg

SEQ ID NO: 200142 - RNA, 22 nt, Homo sapiens
gagcugaaguuuccauuuguac

SEQ ID NO: 200143 - RNA, 22 nt, Homo sapiens
gagcugaucuuuucugauucca

SEQ ID NO: 200144 - RNA, 22 nt, Homo sapiens
ugagaugacgacacaccucagu

SEQ ID NO: 200145 - RNA, 22 nt, Homo sapiens
ugagaugagggcugcacucaaa

SEQ ID NO: 200146 - RNA, 22 nt, Homo sapiens
ugagaugagucucgcucuguca

SEQ ID NO: 200147 - RNA, 22 nt, Homo sapiens
ugagaugaguucucgcucuguc

SEQ ID NO: 200148 - RNA, 22 nt, Homo sapiens
ugagaugaguugcgcucugucg

SEQ ID NO: 200149 - RNA, 21 nt, Homo sapiens
ugagaugcaaucaccagggag

SEQ ID NO: 200150 - RNA, 22 nt, Homo sapiens
ugagaugcucgccggccagcau

SEQ ID NO: 200151 - RNA, 22 nt, Homo sapiens
ugagauggagucuugucgccua

SEQ ID NO: 200152 - RNA, 22 nt, Homo sapiens
ugagauggcugaauucagaaua

SEQ ID NO: 200153 - RNA, 21 nt, Homo sapiens
ugagaugugaccagggcauca

SEQ ID NO: 200154 - RNA, 22 nt, Homo sapiens
ugagaugugugcauucaacuca

SEQ ID NO: 200155 - RNA, 22 nt, Homo sapiens
ugagauuauauuucuuaacaga

SEQ ID NO: 200156 - RNA, 22 nt, Homo sapiens
ugagcaagaucuuuauaauuag

SEQ ID NO: 200157 - RNA, 22 nt, Homo sapiens
ugagcacaggugcgcgguuacu

SEQ ID NO: 200158 - RNA, 22 nt, Homo sapiens
ugagcacuguacuuuaucaggu

SEQ ID NO: 200159 - RNA, 22 nt, Homo sapiens
ugagcagagaagugcccugcgc

SEQ ID NO: 200160 - RNA, 22 nt, Homo sapiens
ugagcagagaucacggcauugu

SEQ ID NO: 200161 - RNA, 22 nt, Homo sapiens
ugagcagaguuguuucuccuga

SEQ ID NO: 200162 - RNA, 22 nt, Homo sapiens
ugagcagugaguguggugcagg

SEQ ID NO: 200163 - RNA, 22 nt, Homo sapiens
ugagcuaagugccaauauuaau

SEQ ID NO: 200164 - RNA, 22 nt, Homo sapiens
ugagcuaggaucacaccugcau

SEQ ID NO: 200165 - RNA, 22 nt, Homo sapiens
ugagcugagaucuuaccacugc

SEQ ID NO: 200166 - RNA, 20 nt, Homo sapiens
ugagcuuguaaacacuguuu

SEQ ID NO: 200167 - RNA, 22 nt, Homo sapiens
ugaggaaugaccccgugugguc

SEQ ID NO: 200168 - RNA, 22 nt, Homo sapiens
ugaggcaagauacugauuucau

SEQ ID NO: 200169 - RNA, 22 nt, Homo sapiens
ugagguaaaacaaggauuggau

SEQ ID NO: 200170 - RNA, 22 nt, Homo sapiens
ugagguaagauguucauuuuuc

SEQ ID NO: 200171 - RNA, 22 nt, Homo sapiens
ugaggucauucaugugggcgca

SEQ ID NO: 200172 - RNA, 22 nt, Homo sapiens
ugaggugaggguaucaaaugcu

SEQ ID NO: 200173 - RNA, 22 nt, Homo sapiens
ugaggugcagcaauccucaugu

SEQ ID NO: 200174 - RNA, 22 nt, Homo sapiens
ugaguagauccaagacuguccu

SEQ ID NO: 200175 - RNA, 21 nt, Homo sapiens
ugaguagcuagaacuaggggc

SEQ ID NO: 200176 - RNA, 23 nt, Homo sapiens
ugaguagguccacguaugugagu

SEQ ID NO: 200177 - RNA, 22 nt, Homo sapiens
ugaguauagaucaguucaagug

SEQ ID NO: 200178 - RNA, 22 nt, Homo sapiens
ugagucaauggaggcucagagc

SEQ ID NO: 200179 - RNA, 22 nt, Homo sapiens
ugagucaugcuggagucauggc

SEQ ID NO: 200180 - RNA, 22 nt, Homo sapiens
ugagugccuggagggcagggac

SEQ ID NO: 200181 - RNA, 22 nt, Homo sapiens
ugaguguccaaguaaggugaaa

SEQ ID NO: 200182 - RNA, 22 nt, Homo sapiens
ugaguucaauuguauuuuauua

SEQ ID NO: 200183 - RNA, 22 nt, Homo sapiens
ugaguucuuccaccgggaccag

SEQ ID NO: 200184 - RNA, 22 nt, Homo sapiens
ugaguucuuuuacauuuugaau

SEQ ID NO: 200185 - RNA, 22 nt, Homo sapiens
ugaguuguugcauucuuggugu

SEQ ID NO: 200186 - RNA, 22 nt, Homo sapiens
ugaguuuaucuaaagaccuggg

SEQ ID NO: 200187 - RNA, 22 nt, Homo sapiens
ugauaacauugggggaagcuga

SEQ ID NO: 200188 - RNA, 22 nt, Homo sapiens
ugauaagaaauuguucauguag

SEQ ID NO: 200189 - RNA, 22 nt, Homo sapiens
ugauacugugcauuagaggcua

SEQ ID NO: 200190 - RNA, 22 nt, Homo sapiens
ugauauggcuuggcuaugucac

SEQ ID NO: 200191 - RNA, 22 nt, Homo sapiens
ugauaugucacuugaucauggu

SEQ ID NO: 200192 - RNA, 22 nt, Homo sapiens
ugauaugugaguauaugguuau

SEQ ID NO: 200193 - RNA, 22 nt, Homo sapiens
ugauauguuagaaucuugcaag

SEQ ID NO: 200194 - RNA, 22 nt, Homo sapiens
ugaucaaagugcuggaauuaca

SEQ ID NO: 200195 - RNA, 22 nt, Homo sapiens
ugaucacagcuugacuaaagga

SEQ ID NO: 200196 - RNA, 21 nt, Homo sapiens
ugaucacaugaaaaccaugca

SEQ ID NO: 200197 - RNA, 22 nt, Homo sapiens
ugaucuguccaccucagcuucc

SEQ ID NO: 200198 - RNA, 22 nt, Homo sapiens
ugaucugucucggguuaucagu

SEQ ID NO: 200199 - RNA, 22 nt, Homo sapiens
ugaugaaguauaggaagggcuu

SEQ ID NO: 200200 - RNA, 22 nt, Homo sapiens
ugaugacauugucacagucuga

SEQ ID NO: 200201 - RNA, 22 nt, Homo sapiens
ugaugguuuuauuaauaggacc

SEQ ID NO: 200202 - RNA, 22 nt, Homo sapiens
ugauguaggcauuuaagguuau

SEQ ID NO: 200203 - RNA, 22 nt, Homo sapiens
ugauugacauacauaggugugg

SEQ ID NO: 200204 - RNA, 22 nt, Homo sapiens
ugauuuccaugagaacaugccu

SEQ ID NO: 200205 - RNA, 22 nt, Homo sapiens
ugauuuguccauguggcacgug

SEQ ID NO: 200206 - RNA, 19 nt, Homo sapiens
ugcaaauucuaaaaacuga

SEQ ID NO: 200207 - RNA, 22 nt, Homo sapiens
ugcaagaugauuucaauugaua

SEQ ID NO: 200208 - RNA, 20 nt, Homo sapiens
ugcaaguugccuuuggaggc

SEQ ID NO: 200209 - RNA, 23 nt, Homo sapiens
ugcaccacuacacacucuugggu

SEQ ID NO: 200210 - RNA, 22 nt, Homo sapiens
ugcaccacuacacuccaggcug

SEQ ID NO: 200211 - RNA, 22 nt, Homo sapiens
ugcagagucuguccugccugcc

SEQ ID NO: 200212 - RNA, 20 nt, Homo sapiens
ugcagcacugggaaugcagu

SEQ ID NO: 200213 - RNA, 21 nt, Homo sapiens
ugcagccauucagcccuaugc

SEQ ID NO: 200214 - RNA, 22 nt, Homo sapiens
ugcagugugcuggggucuccau

SEQ ID NO: 200215 - RNA, 22 nt, Homo sapiens
ugcaguguucuuuagaggaaau

SEQ ID NO: 200216 - RNA, 22 nt, Homo sapiens
ugcauacuguaugcgugcauac

SEQ ID NO: 200217 - RNA, 22 nt, Homo sapiens
caaaggcuuccacugcauccuu

SEQ ID NO: 200218 - RNA, 22 nt, Homo sapiens
caacacuguuuauuggauagcc

SEQ ID NO: 200219 - RNA, 22 nt, Homo sapiens
caagaggcuguguauaaagcca

SEQ ID NO: 200220 - RNA, 22 nt, Homo sapiens
caagguacuuuuacaauuuccc

SEQ ID NO: 200221 - RNA, 22 nt, Homo sapiens
caaggugcugagacaggagccc

SEQ ID NO: 200222 - RNA, 22 nt, Homo sapiens
caagugcuugaugaaugaucaa

SEQ ID NO: 200223 - RNA, 22 nt, Homo sapiens
caagugcuuucuuggggauuua

SEQ ID NO: 200224 - RNA, 21 nt, Homo sapiens
caaugacacuguagcugugcu

SEQ ID NO: 200225 - RNA, 22 nt, Homo sapiens
caaugguacuagauaucuucag

SEQ ID NO: 200226 - RNA, 22 nt, Homo sapiens
caaugugcuuggggcacaugag

SEQ ID NO: 200227 - RNA, 22 nt, Homo sapiens
caauugcacucuuagguguaca

SEQ ID NO: 200228 - RNA, 22 nt, Homo sapiens
cacaaugucuaagauguuucua

SEQ ID NO: 200229 - RNA, 22 nt, Homo sapiens
cacaccuacuagggccgugggc

SEQ ID NO: 200230 - RNA, 22 nt, Homo sapiens
cacacugucuucauuacuguag

SEQ ID NO: 200231 - RNA, 22 nt, Homo sapiens
cacacugucuuucagaaugguu

SEQ ID NO: 200232 - RNA, 22 nt, Homo sapiens
cacaggaagaggcacggucccu

SEQ ID NO: 200233 - RNA, 22 nt, Homo sapiens
cacaggccugucucuuucuaac

SEQ ID NO: 200234 - RNA, 22 nt, Homo sapiens
cacaggucauccuggaucaagg

SEQ ID NO: 200235 - RNA, 22 nt, Homo sapiens
cacagucuugcaauauugagau

SEQ ID NO: 200236 - RNA, 22 nt, Homo sapiens
cacaguguuccagcuauuugaa

SEQ ID NO: 200237 - RNA, 22 nt, Homo sapiens
cacauguuugcuacauuuuucu

SEQ ID NO: 200238 - RNA, 19 nt, Homo sapiens
caccagugcaugcuacuau

SEQ ID NO: 200239 - RNA, 22 nt, Homo sapiens
cacuaggcuggagugcaguggc

SEQ ID NO: 200240 - RNA, 22 nt, Homo sapiens
cacugcaauuacuuuugcacca

SEQ ID NO: 200241 - RNA, 22 nt, Homo sapiens
cacugcacuccagucugacgac

SEQ ID NO: 200242 - RNA, 22 nt, Homo sapiens
cacugugcaaccuccaccuccc

SEQ ID NO: 200243 - RNA, 22 nt, Homo sapiens
cagaaguauugguaugcucugu

SEQ ID NO: 200244 - RNA, 21 nt, Homo sapiens
cagagaucaucucuguuuuaa

SEQ ID NO: 200245 - RNA, 22 nt, Homo sapiens
cagagguaagcaagucagcauu

SEQ ID NO: 200246 - RNA, 22 nt, Homo sapiens
cagaugcaugaccugggcuugg

SEQ ID NO: 200247 - RNA, 22 nt, Homo sapiens
cagcaaaucauccuauuugagc

SEQ ID NO: 200248 - RNA, 23 nt, Homo sapiens
cagcucauuuggguccccuuguc

SEQ ID NO: 200249 - RNA, 22 nt, Homo sapiens
cagcuggugcugcaccaguggg

SEQ ID NO: 200250 - RNA, 22 nt, Homo sapiens
cagcuguguuauaaacuaccau

SEQ ID NO: 200251 - RNA, 22 nt, Homo sapiens
cagcuguuguuaugucugcagg

SEQ ID NO: 200252 - RNA, 23 nt, Homo sapiens
cagcuucauugaacauaacuccu

SEQ ID NO: 200253 - RNA, 22 nt, Homo sapiens
caggaaugugaggguucccugc

SEQ ID NO: 200254 - RNA, 22 nt, Homo sapiens
caggcuuuuccacacauggguu

SEQ ID NO: 200255 - RNA, 22 nt, Homo sapiens
cagggcauuggcugguaccugg

SEQ ID NO: 200256 - RNA, 22 nt, Homo sapiens
cagguaagaugcuuucucuuau

SEQ ID NO: 200257 - RNA, 22 nt, Homo sapiens
cagguacaugcaugugugugca

SEQ ID NO: 200258 - RNA, 22 nt, Homo sapiens
cagguacuucugggcugagcag

SEQ ID NO: 200259 - RNA, 23 nt, Homo sapiens
cagguaguucuuuauaguagugu

SEQ ID NO: 200260 - RNA, 22 nt, Homo sapiens
caggucaucugaguuuaguucu

SEQ ID NO: 200261 - RNA, 19 nt, Homo sapiens
caguaucauugcacauagu

SEQ ID NO: 200262 - RNA, 20 nt, Homo sapiens
cagucauagacaucagaguc
